United States Patent 10,968,269 (MHC MULTIMERS IN BORRELIA DIAGNOSTICS AND DISEASE) - sequence listing, part 4

SEQ ID NO: 88176 - protein, 16 aa, Borrelia garinii PBi
TTEGNLNEVEKVLVRM

SEQ ID NO: 88177 - protein, 16 aa, Borrelia garinii PBi
TEGNLNEVEKVLVRMK

SEQ ID NO: 88178 - protein, 16 aa, Borrelia garinii PBi
EGNLNEVEKVLVRMKE

SEQ ID NO: 88179 - protein, 16 aa, Borrelia garinii PBi
GNLNEVEKVLVRMKEL

SEQ ID NO: 88180 - protein, 16 aa, Borrelia garinii PBi
NLNEVEKVLVRMKELA

SEQ ID NO: 88181 - protein, 16 aa, Borrelia garinii PBi
LNEVEKVLVRMKELAV

SEQ ID NO: 88182 - protein, 16 aa, Borrelia garinii PBi
NEVEKVLVRMKELAVQ

SEQ ID NO: 88183 - protein, 16 aa, Borrelia garinii PBi
EVEKVLVRMKELAVQS

SEQ ID NO: 88184 - protein, 16 aa, Borrelia garinii PBi
VEKVLVRMKELAVQSG

SEQ ID NO: 88185 - protein, 16 aa, Borrelia garinii PBi
EKVLVRMKELAVQSGN

SEQ ID NO: 88186 - protein, 16 aa, Borrelia garinii PBi
KVLVRMKELAVQSGNG

SEQ ID NO: 88187 - protein, 16 aa, Borrelia garinii PBi
VLVRMKELAVQSGNGT

SEQ ID NO: 88188 - protein, 16 aa, Borrelia garinii PBi
LVRMKELAVQSGNGTY

SEQ ID NO: 88189 - protein, 16 aa, Borrelia garinii PBi
VRMKELAVQSGNGTYS

SEQ ID NO: 88190 - protein, 16 aa, Borrelia garinii PBi
RMKELAVQSGNGTYSD

SEQ ID NO: 88191 - protein, 16 aa, Borrelia garinii PBi
MKELAVQSGNGTYSDA

SEQ ID NO: 88192 - protein, 16 aa, Borrelia garinii PBi
KELAVQSGNGTYSDAD

SEQ ID NO: 88193 - protein, 16 aa, Borrelia garinii PBi
ELAVQSGNGTYSDADR

SEQ ID NO: 88194 - protein, 16 aa, Borrelia garinii PBi
LAVQSGNGTYSDADRG

SEQ ID NO: 88195 - protein, 16 aa, Borrelia garinii PBi
AVQSGNGTYSDADRGS

SEQ ID NO: 88196 - protein, 16 aa, Borrelia garinii PBi
VQSGNGTYSDADRGSI

SEQ ID NO: 88197 - protein, 16 aa, Borrelia garinii PBi
QSGNGTYSDADRGSIQ

SEQ ID NO: 88198 - protein, 16 aa, Borrelia garinii PBi
SGNGTYSDADRGSIQI

SEQ ID NO: 88199 - protein, 16 aa, Borrelia garinii PBi
GNGTYSDADRGSIQIE

SEQ ID NO: 88200 - protein, 16 aa, Borrelia garinii PBi
NGTYSDADRGSIQIEI

SEQ ID NO: 88201 - protein, 16 aa, Borrelia garinii PBi
GTYSDADRGSIQIEIE

SEQ ID NO: 88202 - protein, 16 aa, Borrelia garinii PBi
TYSDADRGSIQIEIEQ

SEQ ID NO: 88203 - protein, 16 aa, Borrelia garinii PBi
YSDADRGSIQIEIEQL

SEQ ID NO: 88204 - protein, 16 aa, Borrelia garinii PBi
SDADRGSIQIEIEQLT

SEQ ID NO: 88205 - protein, 16 aa, Borrelia garinii PBi
DADRGSIQIEIEQLTD

SEQ ID NO: 88206 - protein, 16 aa, Borrelia garinii PBi
ADRGSIQIEIEQLTDE

SEQ ID NO: 88207 - protein, 16 aa, Borrelia garinii PBi
DRGSIQIEIEQLTDEI

SEQ ID NO: 88208 - protein, 16 aa, Borrelia garinii PBi
RGSIQIEIEQLTDEIN

SEQ ID NO: 88209 - protein, 16 aa, Borrelia garinii PBi
GSIQIEIEQLTDEINR

SEQ ID NO: 88210 - protein, 16 aa, Borrelia garinii PBi
SIQIEIEQLTDEINRI

SEQ ID NO: 88211 - protein, 16 aa, Borrelia garinii PBi
IQIEIEQLTDEINRIA

SEQ ID NO: 88212 - protein, 16 aa, Borrelia garinii PBi
QIEIEQLTDEINRIAD

SEQ ID NO: 88213 - protein, 16 aa, Borrelia garinii PBi
IEIEQLTDEINRIADQ

SEQ ID NO: 88214 - protein, 16 aa, Borrelia garinii PBi
EIEQLTDEINRIADQA

SEQ ID NO: 88215 - protein, 16 aa, Borrelia garinii PBi
IEQLTDEINRIADQAQ

SEQ ID NO: 88216 - protein, 16 aa, Borrelia garinii PBi
EQLTDEINRIADQAQY

SEQ ID NO: 88217 - protein, 16 aa, Borrelia garinii PBi
QLTDEINRIADQAQYN

SEQ ID NO: 88218 - protein, 16 aa, Borrelia garinii PBi
LTDEINRIADQAQYNQ

SEQ ID NO: 88219 - protein, 16 aa, Borrelia garinii PBi
TDEINRIADQAQYNQM

SEQ ID NO: 88220 - protein, 16 aa, Borrelia garinii PBi
DEINRIADQAQYNQMH

SEQ ID NO: 88221 - protein, 16 aa, Borrelia garinii PBi
EINRIADQAQYNQMHM

SEQ ID NO: 88222 - protein, 16 aa, Borrelia garinii PBi
INRIADQAQYNQMHML

SEQ ID NO: 88223 - protein, 16 aa, Borrelia garinii PBi
NRIADQAQYNQMHMLS

SEQ ID NO: 88224 - protein, 16 aa, Borrelia garinii PBi
RIADQAQYNQMHMLSN

SEQ ID NO: 88225 - protein, 16 aa, Borrelia garinii PBi
IADQAQYNQMHMLSNK

SEQ ID NO: 88226 - protein, 16 aa, Borrelia garinii PBi
ADQAQYNQMHMLSNKS

SEQ ID NO: 88227 - protein, 16 aa, Borrelia garinii PBi
DQAQYNQMHMLSNKSA

SEQ ID NO: 88228 - protein, 16 aa, Borrelia garinii PBi
QAQYNQMHMLSNKSAS

SEQ ID NO: 88229 - protein, 16 aa, Borrelia garinii PBi
AQYNQMHMLSNKSASQ

SEQ ID NO: 88230 - protein, 16 aa, Borrelia garinii PBi
QYNQMHMLSNKSASQN

SEQ ID NO: 88231 - protein, 16 aa, Borrelia garinii PBi
YNQMHMLSNKSASQNV

SEQ ID NO: 88232 - protein, 16 aa, Borrelia garinii PBi
NQMHMLSNKSASQNVR

SEQ ID NO: 88233 - protein, 16 aa, Borrelia garinii PBi
QMHMLSNKSASQNVRT

SEQ ID NO: 88234 - protein, 16 aa, Borrelia garinii PBi
MHMLSNKSASQNVRTA

SEQ ID NO: 88235 - protein, 16 aa, Borrelia garinii PBi
HMLSNKSASQNVRTAE

SEQ ID NO: 88236 - protein, 16 aa, Borrelia garinii PBi
MLSNKSASQNVRTAEE

SEQ ID NO: 88237 - protein, 16 aa, Borrelia garinii PBi
LSNKSASQNVRTAEEL

SEQ ID NO: 88238 - protein, 16 aa, Borrelia garinii PBi
SNKSASQNVRTAEELG

SEQ ID NO: 88239 - protein, 16 aa, Borrelia garinii PBi
NKSASQNVRTAEELGM

SEQ ID NO: 88240 - protein, 16 aa, Borrelia garinii PBi
KSASQNVRTAEELGMQ

SEQ ID NO: 88241 - protein, 16 aa, Borrelia garinii PBi
SASQNVRTAEELGMQP

SEQ ID NO: 88242 - protein, 16 aa, Borrelia garinii PBi
ASQNVRTAEELGMQPA

SEQ ID NO: 88243 - protein, 16 aa, Borrelia garinii PBi
SQNVRTAEELGMQPAK

SEQ ID NO: 88244 - protein, 16 aa, Borrelia garinii PBi
QNVRTAEELGMQPAKI

SEQ ID NO: 88245 - protein, 16 aa, Borrelia garinii PBi
NVRTAEELGMQPAKIN

SEQ ID NO: 88246 - protein, 16 aa, Borrelia garinii PBi
VRTAEELGMQPAKINT

SEQ ID NO: 88247 - protein, 16 aa, Borrelia garinii PBi
RTAEELGMQPAKINTP

SEQ ID NO: 88248 - protein, 16 aa, Borrelia garinii PBi
TAEELGMQPAKINTPA

SEQ ID NO: 88249 - protein, 16 aa, Borrelia garinii PBi
AEELGMQPAKINTPAS

SEQ ID NO: 88250 - protein, 16 aa, Borrelia garinii PBi
EELGMQPAKINTPASL

SEQ ID NO: 88251 - protein, 16 aa, Borrelia garinii PBi
ELGMQPAKINTPASLS

SEQ ID NO: 88252 - protein, 16 aa, Borrelia garinii PBi
LGMQPAKINTPASLSG

SEQ ID NO: 88253 - protein, 16 aa, Borrelia garinii PBi
GMQPAKINTPASLSGS

SEQ ID NO: 88254 - protein, 16 aa, Borrelia garinii PBi
MQPAKINTPASLSGSQ

SEQ ID NO: 88255 - protein, 16 aa, Borrelia garinii PBi
QPAKINTPASLSGSQA

SEQ ID NO: 88256 - protein, 16 aa, Borrelia garinii PBi
PAKINTPASLSGSQAS

SEQ ID NO: 88257 - protein, 16 aa, Borrelia garinii PBi
AKINTPASLSGSQASW

SEQ ID NO: 88258 - protein, 16 aa, Borrelia garinii PBi
KINTPASLSGSQASWT

SEQ ID NO: 88259 - protein, 16 aa, Borrelia garinii PBi
INTPASLSGSQASWTL

SEQ ID NO: 88260 - protein, 16 aa, Borrelia garinii PBi
NTPASLSGSQASWTLR

SEQ ID NO: 88261 - protein, 16 aa, Borrelia garinii PBi
TPASLSGSQASWTLRV

SEQ ID NO: 88262 - protein, 16 aa, Borrelia garinii PBi
PASLSGSQASWTLRVH

SEQ ID NO: 88263 - protein, 16 aa, Borrelia garinii PBi
ASLSGSQASWTLRVHV

SEQ ID NO: 88264 - protein, 16 aa, Borrelia garinii PBi
SLSGSQASWTLRVHVG

SEQ ID NO: 88265 - protein, 16 aa, Borrelia garinii PBi
LSGSQASWTLRVHVGA

SEQ ID NO: 88266 - protein, 16 aa, Borrelia garinii PBi
SGSQASWTLRVHVGAN

SEQ ID NO: 88267 - protein, 16 aa, Borrelia garinii PBi
GSQASWTLRVHVGANQ

SEQ ID NO: 88268 - protein, 16 aa, Borrelia garinii PBi
SQASWTLRVHVGANQD

SEQ ID NO: 88269 - protein, 16 aa, Borrelia garinii PBi
QASWTLRVHVGANQDE

SEQ ID NO: 88270 - protein, 16 aa, Borrelia garinii PBi
ASWTLRVHVGANQDEA

SEQ ID NO: 88271 - protein, 16 aa, Borrelia garinii PBi
SWTLRVHVGANQDEAI

SEQ ID NO: 88272 - protein, 16 aa, Borrelia garinii PBi
WTLRVHVGANQDEAIA

SEQ ID NO: 88273 - protein, 16 aa, Borrelia garinii PBi
TLRVHVGANQDEAIAV

SEQ ID NO: 88274 - protein, 16 aa, Borrelia garinii PBi
LRVHVGANQDEAIAVN

SEQ ID NO: 88275 - protein, 16 aa, Borrelia garinii PBi
RVHVGANQDEAIAVNI

SEQ ID NO: 88276 - protein, 16 aa, Borrelia garinii PBi
VHVGANQDEAIAVNIY

SEQ ID NO: 88277 - protein, 16 aa, Borrelia garinii PBi
HVGANQDEAIAVNIYA

SEQ ID NO: 88278 - protein, 16 aa, Borrelia garinii PBi
VGANQDEAIAVNIYAA

SEQ ID NO: 88279 - protein, 16 aa, Borrelia garinii PBi
GANQDEAIAVNIYAAN

SEQ ID NO: 88280 - protein, 16 aa, Borrelia garinii PBi
ANQDEAIAVNIYAANV

SEQ ID NO: 88281 - protein, 16 aa, Borrelia garinii PBi
NQDEAIAVNIYAANVA

SEQ ID NO: 88282 - protein, 16 aa, Borrelia garinii PBi
QDEAIAVNIYAANVAN

SEQ ID NO: 88283 - protein, 16 aa, Borrelia garinii PBi
DEAIAVNIYAANVANL

SEQ ID NO: 88284 - protein, 16 aa, Borrelia garinii PBi
EAIAVNIYAANVANLF

SEQ ID NO: 88285 - protein, 16 aa, Borrelia garinii PBi
AIAVNIYAANVANLFS

SEQ ID NO: 88286 - protein, 16 aa, Borrelia garinii PBi
IAVNIYAANVANLFSG

SEQ ID NO: 88287 - protein, 16 aa, Borrelia garinii PBi
AVNIYAANVANLFSGE

SEQ ID NO: 88288 - protein, 16 aa, Borrelia garinii PBi
VNIYAANVANLFSGEG

SEQ ID NO: 88289 - protein, 16 aa, Borrelia garinii PBi
NIYAANVANLFSGEGS

SEQ ID NO: 88290 - protein, 16 aa, Borrelia garinii PBi
IYAANVANLFSGEGSQ

SEQ ID NO: 88291 - protein, 16 aa, Borrelia garinii PBi
YAANVANLFSGEGSQA

SEQ ID NO: 88292 - protein, 16 aa, Borrelia garinii PBi
AANVANLFSGEGSQAA

SEQ ID NO: 88293 - protein, 16 aa, Borrelia garinii PBi
ANVANLFSGEGSQAAQ

SEQ ID NO: 88294 - protein, 16 aa, Borrelia garinii PBi
NVANLFSGEGSQAAQT

SEQ ID NO: 88295 - protein, 16 aa, Borrelia garinii PBi
VANLFSGEGSQAAQTA

SEQ ID NO: 88296 - protein, 16 aa, Borrelia garinii PBi
ANLFSGEGSQAAQTAP

SEQ ID NO: 88297 - protein, 16 aa, Borrelia garinii PBi
NLFSGEGSQAAQTAPV

SEQ ID NO: 88298 - protein, 16 aa, Borrelia garinii PBi
LFSGEGSQAAQTAPVQ

SEQ ID NO: 88299 - protein, 16 aa, Borrelia garinii PBi
FSGEGSQAAQTAPVQE

SEQ ID NO: 88300 - protein, 16 aa, Borrelia garinii PBi
SGEGSQAAQTAPVQEG

SEQ ID NO: 88301 - protein, 16 aa, Borrelia garinii PBi
GEGSQAAQTAPVQEGA

SEQ ID NO: 88302 - protein, 16 aa, Borrelia garinii PBi
EGSQAAQTAPVQEGAQ

SEQ ID NO: 88303 - protein, 16 aa, Borrelia garinii PBi
GSQAAQTAPVQEGAQQ

SEQ ID NO: 88304 - protein, 16 aa, Borrelia garinii PBi
SQAAQTAPVQEGAQQE

SEQ ID NO: 88305 - protein, 16 aa, Borrelia garinii PBi
QAAQTAPVQEGAQQEG

SEQ ID NO: 88306 - protein, 16 aa, Borrelia garinii PBi
AAQTAPVQEGAQQEGA

SEQ ID NO: 88307 - protein, 16 aa, Borrelia garinii PBi
AQTAPVQEGAQQEGAQ

SEQ ID NO: 88308 - protein, 16 aa, Borrelia garinii PBi
QTAPVQEGAQQEGAQQ

SEQ ID NO: 88309 - protein, 16 aa, Borrelia garinii PBi
TAPVQEGAQQEGAQQP

SEQ ID NO: 88310 - protein, 16 aa, Borrelia garinii PBi
APVQEGAQQEGAQQPA

SEQ ID NO: 88311 - protein, 16 aa, Borrelia garinii PBi
PVQEGAQQEGAQQPAP

SEQ ID NO: 88312 - protein, 16 aa, Borrelia garinii PBi
VQEGAQQEGAQQPAPA

SEQ ID NO: 88313 - protein, 16 aa, Borrelia garinii PBi
QEGAQQEGAQQPAPAT

SEQ ID NO: 88314 - protein, 16 aa, Borrelia garinii PBi
EGAQQEGAQQPAPATA

SEQ ID NO: 88315 - protein, 16 aa, Borrelia garinii PBi
GAQQEGAQQPAPATAP

SEQ ID NO: 88316 - protein, 16 aa, Borrelia garinii PBi
AQQEGAQQPAPATAPS

SEQ ID NO: 88317 - protein, 16 aa, Borrelia garinii PBi
QQEGAQQPAPATAPSQ

SEQ ID NO: 88318 - protein, 16 aa, Borrelia garinii PBi
QEGAQQPAPATAPSQG

SEQ ID NO: 88319 - protein, 16 aa, Borrelia garinii PBi
EGAQQPAPATAPSQGG

SEQ ID NO: 88320 - protein, 16 aa, Borrelia garinii PBi
GAQQPAPATAPSQGGV

SEQ ID NO: 88321 - protein, 16 aa, Borrelia garinii PBi
AQQPAPATAPSQGGVN

SEQ ID NO: 88322 - protein, 16 aa, Borrelia garinii PBi
QQPAPATAPSQGGVNS

SEQ ID NO: 88323 - protein, 16 aa, Borrelia garinii PBi
QPAPATAPSQGGVNSP

SEQ ID NO: 88324 - protein, 16 aa, Borrelia garinii PBi
PAPATAPSQGGVNSPV

SEQ ID NO: 88325 - protein, 16 aa, Borrelia garinii PBi
APATAPSQGGVNSPVN

SEQ ID NO: 88326 - protein, 16 aa, Borrelia garinii PBi
PATAPSQGGVNSPVNV

SEQ ID NO: 88327 - protein, 16 aa, Borrelia garinii PBi
ATAPSQGGVNSPVNVT

SEQ ID NO: 88328 - protein, 16 aa, Borrelia garinii PBi
TAPSQGGVNSPVNVTT

SEQ ID NO: 88329 - protein, 16 aa, Borrelia garinii PBi
APSQGGVNSPVNVTTT

SEQ ID NO: 88330 - protein, 16 aa, Borrelia garinii PBi
PSQGGVNSPVNVTTTV

SEQ ID NO: 88331 - protein, 16 aa, Borrelia garinii PBi
SQGGVNSPVNVTTTVD

SEQ ID NO: 88332 - protein, 16 aa, Borrelia garinii PBi
QGGVNSPVNVTTTVDA

SEQ ID NO: 88333 - protein, 16 aa, Borrelia garinii PBi
GGVNSPVNVTTTVDAN

SEQ ID NO: 88334 - protein, 16 aa, Borrelia garinii PBi
GVNSPVNVTTTVDANT

SEQ ID NO: 88335 - protein, 16 aa, Borrelia garinii PBi
VNSPVNVTTTVDANTS

SEQ ID NO: 88336 - protein, 16 aa, Borrelia garinii PBi
NSPVNVTTTVDANTSL

SEQ ID NO: 88337 - protein, 16 aa, Borrelia garinii PBi
SPVNVTTTVDANTSLA

SEQ ID NO: 88338 - protein, 16 aa, Borrelia garinii PBi
PVNVTTTVDANTSLAK

SEQ ID NO: 88339 - protein, 16 aa, Borrelia garinii PBi
VNVTTTVDANTSLAKI

SEQ ID NO: 88340 - protein, 16 aa, Borrelia garinii PBi
NVTTTVDANTSLAKIE

SEQ ID NO: 88341 - protein, 16 aa, Borrelia garinii PBi
VTTTVDANTSLAKIEN

SEQ ID NO: 88342 - protein, 16 aa, Borrelia garinii PBi
TTTVDANTSLAKIENA

SEQ ID NO: 88343 - protein, 16 aa, Borrelia garinii PBi
TTVDANTSLAKIENAI

SEQ ID NO: 88344 - protein, 16 aa, Borrelia garinii PBi
TVDANTSLAKIENAIR

SEQ ID NO: 88345 - protein, 16 aa, Borrelia garinii PBi
VDANTSLAKIENAIRM

SEQ ID NO: 88346 - protein, 16 aa, Borrelia garinii PBi
DANTSLAKIENAIRMI

SEQ ID NO: 88347 - protein, 16 aa, Borrelia garinii PBi
ANTSLAKIENAIRMIS

SEQ ID NO: 88348 - protein, 16 aa, Borrelia garinii PBi
NTSLAKIENAIRMISD

SEQ ID NO: 88349 - protein, 16 aa, Borrelia garinii PBi
TSLAKIENAIRMISDQ

SEQ ID NO: 88350 - protein, 16 aa, Borrelia garinii PBi
SLAKIENAIRMISDQR

SEQ ID NO: 88351 - protein, 16 aa, Borrelia garinii PBi
LAKIENAIRMISDQRA

SEQ ID NO: 88352 - protein, 16 aa, Borrelia garinii PBi
AKIENAIRMISDQRAN

SEQ ID NO: 88353 - protein, 16 aa, Borrelia garinii PBi
KIENAIRMISDQRANL

SEQ ID NO: 88354 - protein, 16 aa, Borrelia garinii PBi
IENAIRMISDQRANLG

SEQ ID NO: 88355 - protein, 16 aa, Borrelia garinii PBi
ENAIRMISDQRANLGA

SEQ ID NO: 88356 - protein, 16 aa, Borrelia garinii PBi
NAIRMISDQRANLGAF

SEQ ID NO: 88357 - protein, 16 aa, Borrelia garinii PBi
AIRMISDQRANLGAFQ

SEQ ID NO: 88358 - protein, 16 aa, Borrelia garinii PBi
IRMISDQRANLGAFQN

SEQ ID NO: 88359 - protein, 16 aa, Borrelia garinii PBi
RMISDQRANLGAFQNR

SEQ ID NO: 88360 - protein, 16 aa, Borrelia garinii PBi
MISDQRANLGAFQNRL

SEQ ID NO: 88361 - protein, 16 aa, Borrelia garinii PBi
ISDQRANLGAFQNRLE

SEQ ID NO: 88362 - protein, 16 aa, Borrelia garinii PBi
SDQRANLGAFQNRLES

SEQ ID NO: 88363 - protein, 16 aa, Borrelia garinii PBi
DQRANLGAFQNRLESI

SEQ ID NO: 88364 - protein, 16 aa, Borrelia garinii PBi
QRANLGAFQNRLESIK

SEQ ID NO: 88365 - protein, 16 aa, Borrelia garinii PBi
RANLGAFQNRLESIKD

SEQ ID NO: 88366 - protein, 16 aa, Borrelia garinii PBi
ANLGAFQNRLESIKDS

SEQ ID NO: 88367 - protein, 16 aa, Borrelia garinii PBi
NLGAFQNRLESIKDST

SEQ ID NO: 88368 - protein, 16 aa, Borrelia garinii PBi
LGAFQNRLESIKDSTE

SEQ ID NO: 88369 - protein, 16 aa, Borrelia garinii PBi
GAFQNRLESIKDSTEY

SEQ ID NO: 88370 - protein, 16 aa, Borrelia garinii PBi
AFQNRLESIKDSTEYA

SEQ ID NO: 88371 - protein, 16 aa, Borrelia garinii PBi
FQNRLESIKDSTEYAI

SEQ ID NO: 88372 - protein, 16 aa, Borrelia garinii PBi
QNRLESIKDSTEYAIE

SEQ ID NO: 88373 - protein, 16 aa, Borrelia garinii PBi
NRLESIKDSTEYAIEN

SEQ ID NO: 88374 - protein, 16 aa, Borrelia garinii PBi
RLESIKDSTEYAIENL

SEQ ID NO: 88375 - protein, 16 aa, Borrelia garinii PBi
LESIKDSTEYAIENLK

SEQ ID NO: 88376 - protein, 16 aa, Borrelia garinii PBi
ESIKDSTEYAIENLKA

SEQ ID NO: 88377 - protein, 16 aa, Borrelia garinii PBi
SIKDSTEYAIENLKAS

SEQ ID NO: 88378 - protein, 16 aa, Borrelia garinii PBi
IKDSTEYAIENLKASY

SEQ ID NO: 88379 - protein, 16 aa, Borrelia garinii PBi
KDSTEYAIENLKASYA

SEQ ID NO: 88380 - protein, 16 aa, Borrelia garinii PBi
DSTEYAIENLKASYAQ

SEQ ID NO: 88381 - protein, 16 aa, Borrelia garinii PBi
STEYAIENLKASYAQI

SEQ ID NO: 88382 - protein, 16 aa, Borrelia garinii PBi
TEYAIENLKASYAQIK

SEQ ID NO: 88383 - protein, 16 aa, Borrelia garinii PBi
EYAIENLKASYAQIKD

SEQ ID NO: 88384 - protein, 16 aa, Borrelia garinii PBi
YAIENLKASYAQIKDA

SEQ ID NO: 88385 - protein, 16 aa, Borrelia garinii PBi
AIENLKASYAQIKDAT

SEQ ID NO: 88386 - protein, 16 aa, Borrelia garinii PBi
IENLKASYAQIKDATM

SEQ ID NO: 88387 - protein, 16 aa, Borrelia garinii PBi
ENLKASYAQIKDATMT

SEQ ID NO: 88388 - protein, 16 aa, Borrelia garinii PBi
NLKASYAQIKDATMTD

SEQ ID NO: 88389 - protein, 16 aa, Borrelia garinii PBi
LKASYAQIKDATMTDE

SEQ ID NO: 88390 - protein, 16 aa, Borrelia garinii PBi
KASYAQIKDATMTDEV

SEQ ID NO: 88391 - protein, 16 aa, Borrelia garinii PBi
ASYAQIKDATMTDEVV

SEQ ID NO: 88392 - protein, 16 aa, Borrelia garinii PBi
SYAQIKDATMTDEVVA

SEQ ID NO: 88393 - protein, 16 aa, Borrelia garinii PBi
YAQIKDATMTDEVVAS

SEQ ID NO: 88394 - protein, 16 aa, Borrelia garinii PBi
AQIKDATMTDEVVAST

SEQ ID NO: 88395 - protein, 16 aa, Borrelia garinii PBi
QIKDATMTDEVVASTT

SEQ ID NO: 88396 - protein, 16 aa, Borrelia garinii PBi
IKDATMTDEVVASTTN

SEQ ID NO: 88397 - protein, 16 aa, Borrelia garinii PBi
KDATMTDEVVASTTNS

SEQ ID NO: 88398 - protein, 16 aa, Borrelia garinii PBi
DATMTDEVVASTTNSI

SEQ ID NO: 88399 - protein, 16 aa, Borrelia garinii PBi
ATMTDEVVASTTNSIL

SEQ ID NO: 88400 - protein, 16 aa, Borrelia garinii PBi
TMTDEVVASTTNSILT

SEQ ID NO: 88401 - protein, 16 aa, Borrelia garinii PBi
MTDEVVASTTNSILTQ

SEQ ID NO: 88402 - protein, 16 aa, Borrelia garinii PBi
TDEVVASTTNSILTQS

SEQ ID NO: 88403 - protein, 16 aa, Borrelia garinii PBi
DEVVASTTNSILTQSA

SEQ ID NO: 88404 - protein, 16 aa, Borrelia garinii PBi
EVVASTTNSILTQSAM

SEQ ID NO: 88405 - protein, 16 aa, Borrelia garinii PBi
VVASTTNSILTQSAMA

SEQ ID NO: 88406 - protein, 16 aa, Borrelia garinii PBi
VASTTNSILTQSAMAM

SEQ ID NO: 88407 - protein, 16 aa, Borrelia garinii PBi
ASTTNSILTQSAMAMI

SEQ ID NO: 88408 - protein, 16 aa, Borrelia garinii PBi
STTNSILTQSAMAMIA

SEQ ID NO: 88409 - protein, 16 aa, Borrelia garinii PBi
TTNSILTQSAMAMIAQ

SEQ ID NO: 88410 - protein, 16 aa, Borrelia garinii PBi
TNSILTQSAMAMIAQA

SEQ ID NO: 88411 - protein, 16 aa, Borrelia garinii PBi
NSILTQSAMAMIAQAN

SEQ ID NO: 88412 - protein, 16 aa, Borrelia garinii PBi
SILTQSAMAMIAQANQ

SEQ ID NO: 88413 - protein, 16 aa, Borrelia garinii PBi
ILTQSAMAMIAQANQV

SEQ ID NO: 88414 - protein, 16 aa, Borrelia garinii PBi
LTQSAMAMIAQANQVP

SEQ ID NO: 88415 - protein, 16 aa, Borrelia garinii PBi
TQSAMAMIAQANQVPQ

SEQ ID NO: 88416 - protein, 16 aa, Borrelia garinii PBi
QSAMAMIAQANQVPQY

SEQ ID NO: 88417 - protein, 16 aa, Borrelia garinii PBi
SAMAMIAQANQVPQYV

SEQ ID NO: 88418 - protein, 16 aa, Borrelia garinii PBi
AMAMIAQANQVPQYVL

SEQ ID NO: 88419 - protein, 16 aa, Borrelia garinii PBi
MAMIAQANQVPQYVLS

SEQ ID NO: 88420 - protein, 16 aa, Borrelia garinii PBi
AMIAQANQVPQYVLSL

SEQ ID NO: 88421 - protein, 16 aa, Borrelia garinii PBi
MIAQANQVPQYVLSLL

SEQ ID NO: 88422 - protein, 16 aa, Borrelia garinii PBi
IAQANQVPQYVLSLLR

SEQ ID NO: 88423 - protein, 13 aa, Borrelia Burgdorferi
MRGSHHHHHHGSS

SEQ ID NO: 88424 - protein, 13 aa, Borrelia Burgdorferi
RGSHHHHHHGSSQ

SEQ ID NO: 88425 - protein, 13 aa, Borrelia Burgdorferi
GSHHHHHHGSSQV

SEQ ID NO: 88426 - protein, 13 aa, Borrelia Burgdorferi
SHHHHHHGSSQVA

SEQ ID NO: 88427 - protein, 13 aa, Borrelia Burgdorferi
HHHHHHGSSQVAD

SEQ ID NO: 88428 - protein, 13 aa, Borrelia Burgdorferi
HHHHHGSSQVADK

SEQ ID NO: 88429 - protein, 13 aa, Borrelia Burgdorferi
HHHHGSSQVADKD

SEQ ID NO: 88430 - protein, 13 aa, Borrelia Burgdorferi
HHHGSSQVADKDD

SEQ ID NO: 88431 - protein, 13 aa, Borrelia Burgdorferi
HHGSSQVADKDDP

SEQ ID NO: 88432 - protein, 13 aa, Borrelia Burgdorferi
HGSSQVADKDDPT

SEQ ID NO: 88433 - protein, 13 aa, Borrelia Burgdorferi
GSSQVADKDDPTN

SEQ ID NO: 88434 - protein, 13 aa, Borrelia Burgdorferi
SSQVADKDDPTNK

SEQ ID NO: 88435 - protein, 13 aa, Borrelia Burgdorferi
SQVADKDDPTNKF

SEQ ID NO: 88436 - protein, 13 aa, Borrelia Burgdorferi
QVADKDDPTNKFY

SEQ ID NO: 88437 - protein, 13 aa, Borrelia Burgdorferi
VADKDDPTNKFYQ

SEQ ID NO: 88438 - protein, 13 aa, Borrelia Burgdorferi
ADKDDPTNKFYQS

SEQ ID NO: 88439 - protein, 13 aa, Borrelia Burgdorferi
DKDDPTNKFYQSV

SEQ ID NO: 88440 - protein, 13 aa, Borrelia Burgdorferi
KDDPTNKFYQSVI

SEQ ID NO: 88441 - protein, 13 aa, Borrelia Burgdorferi
DDPTNKFYQSVIQ

SEQ ID NO: 88442 - protein, 13 aa, Borrelia Burgdorferi
DPTNKFYQSVIQL

SEQ ID NO: 88443 - protein, 13 aa, Borrelia Burgdorferi
PTNKFYQSVIQLG

SEQ ID NO: 88444 - protein, 13 aa, Borrelia Burgdorferi
TNKFYQSVIQLGN

SEQ ID NO: 88445 - protein, 13 aa, Borrelia Burgdorferi
NKFYQSVIQLGNG

SEQ ID NO: 88446 - protein, 13 aa, Borrelia Burgdorferi
KFYQSVIQLGNGF

SEQ ID NO: 88447 - protein, 13 aa, Borrelia Burgdorferi
FYQSVIQLGNGFL

SEQ ID NO: 88448 - protein, 13 aa, Borrelia Burgdorferi
YQSVIQLGNGFLD

SEQ ID NO: 88449 - protein, 13 aa, Borrelia Burgdorferi
QSVIQLGNGFLDV

SEQ ID NO: 88450 - protein, 13 aa, Borrelia Burgdorferi
SVIQLGNGFLDVF

SEQ ID NO: 88451 - protein, 13 aa, Borrelia Burgdorferi
VIQLGNGFLDVFT

SEQ ID NO: 88452 - protein, 13 aa, Borrelia Burgdorferi
IQLGNGFLDVFTS

SEQ ID NO: 88453 - protein, 13 aa, Borrelia Burgdorferi
QLGNGFLDVFTSF

SEQ ID NO: 88454 - protein, 13 aa, Borrelia Burgdorferi
LGNGFLDVFTSFG

SEQ ID NO: 88455 - protein, 13 aa, Borrelia Burgdorferi
GNGFLDVFTSFGG

SEQ ID NO: 88456 - protein, 13 aa, Borrelia Burgdorferi
NGFLDVFTSFGGL

SEQ ID NO: 88457 - protein, 13 aa, Borrelia Burgdorferi
GFLDVFTSFGGLV

SEQ ID NO: 88458 - protein, 13 aa, Borrelia Burgdorferi
FLDVFTSFGGLVA

SEQ ID NO: 88459 - protein, 13 aa, Borrelia Burgdorferi
LDVFTSFGGLVAE

SEQ ID NO: 88460 - protein, 13 aa, Borrelia Burgdorferi
DVFTSFGGLVAEA

SEQ ID NO: 88461 - protein, 13 aa, Borrelia Burgdorferi
VFTSFGGLVAEAF

SEQ ID NO: 88462 - protein, 13 aa, Borrelia Burgdorferi
FTSFGGLVAEAFG

SEQ ID NO: 88463 - protein, 13 aa, Borrelia Burgdorferi
TSFGGLVAEAFGF

SEQ ID NO: 88464 - protein, 13 aa, Borrelia Burgdorferi
SFGGLVAEAFGFK

SEQ ID NO: 88465 - protein, 13 aa, Borrelia Burgdorferi
FGGLVAEAFGFKS

SEQ ID NO: 88466 - protein, 13 aa, Borrelia Burgdorferi
GGLVAEAFGFKSD

SEQ ID NO: 88467 - protein, 13 aa, Borrelia Burgdorferi
GLVAEAFGFKSDP

SEQ ID NO: 88468 - protein, 13 aa, Borrelia Burgdorferi
LVAEAFGFKSDPK

SEQ ID NO: 88469 - protein, 13 aa, Borrelia Burgdorferi
VAEAFGFKSDPKK

SEQ ID NO: 88470 - protein, 13 aa, Borrelia Burgdorferi
AEAFGFKSDPKKS

SEQ ID NO: 88471 - protein, 13 aa, Borrelia Burgdorferi
EAFGFKSDPKKSD

SEQ ID NO: 88472 - protein, 13 aa, Borrelia Burgdorferi
AFGFKSDPKKSDV

SEQ ID NO: 88473 - protein, 13 aa, Borrelia Burgdorferi
FGFKSDPKKSDVK

SEQ ID NO: 88474 - protein, 13 aa, Borrelia Burgdorferi
GFKSDPKKSDVKT

SEQ ID NO: 88475 - protein, 13 aa, Borrelia Burgdorferi
FKSDPKKSDVKTY

SEQ ID NO: 88476 - protein, 13 aa, Borrelia Burgdorferi
KSDPKKSDVKTYF

SEQ ID NO: 88477 - protein, 13 aa, Borrelia Burgdorferi
SDPKKSDVKTYFT

SEQ ID NO: 88478 - protein, 13 aa, Borrelia Burgdorferi
DPKKSDVKTYFTT

SEQ ID NO: 88479 - protein, 13 aa, Borrelia Burgdorferi
PKKSDVKTYFTTV

SEQ ID NO: 88480 - protein, 13 aa, Borrelia Burgdorferi
KKSDVKTYFTTVA

SEQ ID NO: 88481 - protein, 13 aa, Borrelia Burgdorferi
KSDVKTYFTTVAA

SEQ ID NO: 88482 - protein, 13 aa, Borrelia Burgdorferi
SDVKTYFTTVAAK

SEQ ID NO: 88483 - protein, 13 aa, Borrelia Burgdorferi
DVKTYFTTVAAKL

SEQ ID NO: 88484 - protein, 13 aa, Borrelia Burgdorferi
VKTYFTTVAAKLE

SEQ ID NO: 88485 - protein, 13 aa, Borrelia Burgdorferi
KTYFTTVAAKLEK

SEQ ID NO: 88486 - protein, 13 aa, Borrelia Burgdorferi
TYFTTVAAKLEKT

SEQ ID NO: 88487 - protein, 13 aa, Borrelia Burgdorferi
YFTTVAAKLEKTK

SEQ ID NO: 88488 - protein, 13 aa, Borrelia Burgdorferi
FTTVAAKLEKTKT

SEQ ID NO: 88489 - protein, 13 aa, Borrelia Burgdorferi
TTVAAKLEKTKTD

SEQ ID NO: 88490 - protein, 13 aa, Borrelia Burgdorferi
TVAAKLEKTKTDL

SEQ ID NO: 88491 - protein, 13 aa, Borrelia Burgdorferi
VAAKLEKTKTDLN

SEQ ID NO: 88492 - protein, 13 aa, Borrelia Burgdorferi
AAKLEKTKTDLNS

SEQ ID NO: 88493 - protein, 13 aa, Borrelia Burgdorferi
AKLEKTKTDLNSL

SEQ ID NO: 88494 - protein, 13 aa, Borrelia Burgdorferi
KLEKTKTDLNSLP

SEQ ID NO: 88495 - protein, 13 aa, Borrelia Burgdorferi
LEKTKTDLNSLPK

SEQ ID NO: 88496 - protein, 13 aa, Borrelia Burgdorferi
EKTKTDLNSLPKE

SEQ ID NO: 88497 - protein, 13 aa, Borrelia Burgdorferi
KTKTDLNSLPKEK

SEQ ID NO: 88498 - protein, 13 aa, Borrelia Burgdorferi
TKTDLNSLPKEKS

SEQ ID NO: 88499 - protein, 13 aa, Borrelia Burgdorferi
KTDLNSLPKEKSD

SEQ ID NO: 88500 - protein, 13 aa, Borrelia Burgdorferi
TDLNSLPKEKSDI

SEQ ID NO: 88501 - protein, 13 aa, Borrelia Burgdorferi
DLNSLPKEKSDIS

SEQ ID NO: 88502 - protein, 13 aa, Borrelia Burgdorferi
LNSLPKEKSDISS

SEQ ID NO: 88503 - protein, 13 aa, Borrelia Burgdorferi
NSLPKEKSDISST

SEQ ID NO: 88504 - protein, 13 aa, Borrelia Burgdorferi
SLPKEKSDISSTT

SEQ ID NO: 88505 - protein, 13 aa, Borrelia Burgdorferi
LPKEKSDISSTTG

SEQ ID NO: 88506 - protein, 13 aa, Borrelia Burgdorferi
PKEKSDISSTTGK

SEQ ID NO: 88507 - protein, 13 aa, Borrelia Burgdorferi
KEKSDISSTTGKP

SEQ ID NO: 88508 - protein, 13 aa, Borrelia Burgdorferi
EKSDISSTTGKPD

SEQ ID NO: 88509 - protein, 13 aa, Borrelia Burgdorferi
KSDISSTTGKPDS

SEQ ID NO: 88510 - protein, 13 aa, Borrelia Burgdorferi
SDISSTTGKPDST

SEQ ID NO: 88511 - protein, 13 aa, Borrelia Burgdorferi
DISSTTGKPDSTG

SEQ ID NO: 88512 - protein, 13 aa, Borrelia Burgdorferi
ISSTTGKPDSTGS

SEQ ID NO: 88513 - protein, 13 aa, Borrelia Burgdorferi
SSTTGKPDSTGSV

SEQ ID NO: 88514 - protein, 13 aa, Borrelia Burgdorferi
STTGKPDSTGSVG

SEQ ID NO: 88515 - protein, 13 aa, Borrelia Burgdorferi
TTGKPDSTGSVGT

SEQ ID NO: 88516 - protein, 13 aa, Borrelia Burgdorferi
TGKPDSTGSVGTA

SEQ ID NO: 88517 - protein, 13 aa, Borrelia Burgdorferi
GKPDSTGSVGTAV

SEQ ID NO: 88518 - protein, 13 aa, Borrelia Burgdorferi
KPDSTGSVGTAVE

SEQ ID NO: 88519 - protein, 13 aa, Borrelia Burgdorferi
PDSTGSVGTAVEG

SEQ ID NO: 88520 - protein, 13 aa, Borrelia Burgdorferi
DSTGSVGTAVEGA

SEQ ID NO: 88521 - protein, 13 aa, Borrelia Burgdorferi
STGSVGTAVEGAI

SEQ ID NO: 88522 - protein, 13 aa, Borrelia Burgdorferi
TGSVGTAVEGAIK

SEQ ID NO: 88523 - protein, 13 aa, Borrelia Burgdorferi
GSVGTAVEGAIKE

SEQ ID NO: 88524 - protein, 13 aa, Borrelia Burgdorferi
SVGTAVEGAIKEV

SEQ ID NO: 88525 - protein, 13 aa, Borrelia Burgdorferi
VGTAVEGAIKEVS

SEQ ID NO: 88526 - protein, 13 aa, Borrelia Burgdorferi
GTAVEGAIKEVSE

SEQ ID NO: 88527 - protein, 13 aa, Borrelia Burgdorferi
TAVEGAIKEVSEL

SEQ ID NO: 88528 - protein, 13 aa, Borrelia Burgdorferi
AVEGAIKEVSELL

SEQ ID NO: 88529 - protein, 13 aa, Borrelia Burgdorferi
VEGAIKEVSELLD

SEQ ID NO: 88530 - protein, 13 aa, Borrelia Burgdorferi
EGAIKEVSELLDK

SEQ ID NO: 88531 - protein, 13 aa, Borrelia Burgdorferi
GAIKEVSELLDKL

SEQ ID NO: 88532 - protein, 13 aa, Borrelia Burgdorferi
AIKEVSELLDKLV

SEQ ID NO: 88533 - protein, 13 aa, Borrelia Burgdorferi
IKEVSELLDKLVK

SEQ ID NO: 88534 - protein, 13 aa, Borrelia Burgdorferi
KEVSELLDKLVKA

SEQ ID NO: 88535 - protein, 13 aa, Borrelia Burgdorferi
EVSELLDKLVKAV

SEQ ID NO: 88536 - protein, 13 aa, Borrelia Burgdorferi
VSELLDKLVKAVK

SEQ ID NO: 88537 - protein, 13 aa, Borrelia Burgdorferi
SELLDKLVKAVKT

SEQ ID NO: 88538 - protein, 13 aa, Borrelia Burgdorferi
ELLDKLVKAVKTA

SEQ ID NO: 88539 - protein, 13 aa, Borrelia Burgdorferi
LLDKLVKAVKTAE

SEQ ID NO: 88540 - protein, 13 aa, Borrelia Burgdorferi
LDKLVKAVKTAEG

SEQ ID NO: 88541 - protein, 13 aa, Borrelia Burgdorferi
DKLVKAVKTAEGA

SEQ ID NO: 88542 - protein, 13 aa, Borrelia Burgdorferi
KLVKAVKTAEGAS

SEQ ID NO: 88543 - protein, 13 aa, Borrelia Burgdorferi
LVKAVKTAEGASS

SEQ ID NO: 88544 - protein, 13 aa, Borrelia Burgdorferi
VKAVKTAEGASSG

SEQ ID NO: 88545 - protein, 13 aa, Borrelia Burgdorferi
KAVKTAEGASSGT

SEQ ID NO: 88546 - protein, 13 aa, Borrelia Burgdorferi
AVKTAEGASSGTA

SEQ ID NO: 88547 - protein, 13 aa, Borrelia Burgdorferi
VKTAEGASSGTAA

SEQ ID NO: 88548 - protein, 13 aa, Borrelia Burgdorferi
KTAEGASSGTAAI

SEQ ID NO: 88549 - protein, 13 aa, Borrelia Burgdorferi
TAEGASSGTAAIG

SEQ ID NO: 88550 - protein, 13 aa, Borrelia Burgdorferi
AEGASSGTAAIGE

SEQ ID NO: 88551 - protein, 13 aa, Borrelia Burgdorferi
EGASSGTAAIGEV

SEQ ID NO: 88552 - protein, 13 aa, Borrelia Burgdorferi
GASSGTAAIGEVV

SEQ ID NO: 88553 - protein, 13 aa, Borrelia Burgdorferi
ASSGTAAIGEVVA

SEQ ID NO: 88554 - protein, 13 aa, Borrelia Burgdorferi
SSGTAAIGEVVAD

SEQ ID NO: 88555 - protein, 13 aa, Borrelia Burgdorferi
SGTAAIGEVVADA

SEQ ID NO: 88556 - protein, 13 aa, Borrelia Burgdorferi
GTAAIGEVVADAD

SEQ ID NO: 88557 - protein, 13 aa, Borrelia Burgdorferi
TAAIGEVVADADA

SEQ ID NO: 88558 - protein, 13 aa, Borrelia Burgdorferi
AAIGEVVADADAA

SEQ ID NO: 88559 - protein, 13 aa, Borrelia Burgdorferi
AIGEVVADADAAK

SEQ ID NO: 88560 - protein, 13 aa, Borrelia Burgdorferi
IGEVVADADAAKV

SEQ ID NO: 88561 - protein, 13 aa, Borrelia Burgdorferi
GEVVADADAAKVA

SEQ ID NO: 88562 - protein, 13 aa, Borrelia Burgdorferi
EVVADADAAKVAD

SEQ ID NO: 88563 - protein, 13 aa, Borrelia Burgdorferi
VVADADAAKVADK

SEQ ID NO: 88564 - protein, 13 aa, Borrelia Burgdorferi
VADADAAKVADKA

SEQ ID NO: 88565 - protein, 13 aa, Borrelia Burgdorferi
ADADAAKVADKAS

SEQ ID NO: 88566 - protein, 13 aa, Borrelia Burgdorferi
DADAAKVADKASV

SEQ ID NO: 88567 - protein, 13 aa, Borrelia Burgdorferi
ADAAKVADKASVK

SEQ ID NO: 88568 - protein, 13 aa, Borrelia Burgdorferi
DAAKVADKASVKG

SEQ ID NO: 88569 - protein, 13 aa, Borrelia Burgdorferi
AAKVADKASVKGI

SEQ ID NO: 88570 - protein, 13 aa, Borrelia Burgdorferi
AKVADKASVKGIA

SEQ ID NO: 88571 - protein, 13 aa, Borrelia Burgdorferi
KVADKASVKGIAK

SEQ ID NO: 88572 - protein, 13 aa, Borrelia Burgdorferi
VADKASVKGIAKG

SEQ ID NO: 88573 - protein, 13 aa, Borrelia Burgdorferi
ADKASVKGIAKGI

SEQ ID NO: 88574 - protein, 13 aa, Borrelia Burgdorferi
DKASVKGIAKGIK

SEQ ID NO: 88575 - protein, 13 aa, Borrelia Burgdorferi
KASVKGIAKGIKE

SEQ ID NO: 88576 - protein, 13 aa, Borrelia Burgdorferi
ASVKGIAKGIKEI

SEQ ID NO: 88577 - protein, 13 aa, Borrelia Burgdorferi
SVKGIAKGIKEIV

SEQ ID NO: 88578 - protein, 13 aa, Borrelia Burgdorferi
VKGIAKGIKEIVE

SEQ ID NO: 88579 - protein, 13 aa, Borrelia Burgdorferi
KGIAKGIKEIVEA

SEQ ID NO: 88580 - protein, 13 aa, Borrelia Burgdorferi
GIAKGIKEIVEAA

SEQ ID NO: 88581 - protein, 13 aa, Borrelia Burgdorferi
IAKGIKEIVEAAG

SEQ ID NO: 88582 - protein, 13 aa, Borrelia Burgdorferi
AKGIKEIVEAAGG

SEQ ID NO: 88583 - protein, 13 aa, Borrelia Burgdorferi
KGIKEIVEAAGGS

SEQ ID NO: 88584 - protein, 13 aa, Borrelia Burgdorferi
GIKEIVEAAGGSE

SEQ ID NO: 88585 - protein, 13 aa, Borrelia Burgdorferi
IKEIVEAAGGSEK

SEQ ID NO: 88586 - protein, 13 aa, Borrelia Burgdorferi
KEIVEAAGGSEKL

SEQ ID NO: 88587 - protein, 13 aa, Borrelia Burgdorferi
EIVEAAGGSEKLK

SEQ ID NO: 88588 - protein, 13 aa, Borrelia Burgdorferi
IVEAAGGSEKLKA

SEQ ID NO: 88589 - protein, 13 aa, Borrelia Burgdorferi
VEAAGGSEKLKAV

SEQ ID NO: 88590 - protein, 13 aa, Borrelia Burgdorferi
EAAGGSEKLKAVA

SEQ ID NO: 88591 - protein, 13 aa, Borrelia Burgdorferi
AAGGSEKLKAVAA

SEQ ID NO: 88592 - protein, 13 aa, Borrelia Burgdorferi
AGGSEKLKAVAAA

SEQ ID NO: 88593 - protein, 13 aa, Borrelia Burgdorferi
GGSEKLKAVAAAK

SEQ ID NO: 88594 - protein, 13 aa, Borrelia Burgdorferi
GSEKLKAVAAAKG

SEQ ID NO: 88595 - protein, 13 aa, Borrelia Burgdorferi
SEKLKAVAAAKGE

SEQ ID NO: 88596 - protein, 13 aa, Borrelia Burgdorferi
EKLKAVAAAKGEN

SEQ ID NO: 88597 - protein, 13 aa, Borrelia Burgdorferi
KLKAVAAAKGENN

SEQ ID NO: 88598 - protein, 13 aa, Borrelia Burgdorferi
LKAVAAAKGENNK

SEQ ID NO: 88599 - protein, 13 aa, Borrelia Burgdorferi
KAVAAAKGENNKG

SEQ ID NO: 88600 - protein, 13 aa, Borrelia Burgdorferi
AVAAAKGENNKGA

SEQ ID NO: 88601 - protein, 13 aa, Borrelia Burgdorferi
VAAAKGENNKGAG

SEQ ID NO: 88602 - protein, 13 aa, Borrelia Burgdorferi
AAAKGENNKGAGK

SEQ ID NO: 88603 - protein, 13 aa, Borrelia Burgdorferi
AAKGENNKGAGKL

SEQ ID NO: 88604 - protein, 13 aa, Borrelia Burgdorferi
AKGENNKGAGKLF

SEQ ID NO: 88605 - protein, 13 aa, Borrelia Burgdorferi
KGENNKGAGKLFG

SEQ ID NO: 88606 - protein, 13 aa, Borrelia Burgdorferi
GENNKGAGKLFGK

SEQ ID NO: 88607 - protein, 13 aa, Borrelia Burgdorferi
ENNKGAGKLFGKA

SEQ ID NO: 88608 - protein, 13 aa, Borrelia Burgdorferi
NNKGAGKLFGKAG

SEQ ID NO: 88609 - protein, 13 aa, Borrelia Burgdorferi
NKGAGKLFGKAGA

SEQ ID NO: 88610 - protein, 13 aa, Borrelia Burgdorferi
KGAGKLFGKAGAA

SEQ ID NO: 88611 - protein, 13 aa, Borrelia Burgdorferi
GAGKLFGKAGAAA

SEQ ID NO: 88612 - protein, 13 aa, Borrelia Burgdorferi
AGKLFGKAGAAAH

SEQ ID NO: 88613 - protein, 13 aa, Borrelia Burgdorferi
GKLFGKAGAAAHG

SEQ ID NO: 88614 - protein, 13 aa, Borrelia Burgdorferi
KLFGKAGAAAHGD

SEQ ID NO: 88615 - protein, 13 aa, Borrelia Burgdorferi
LFGKAGAAAHGDS

SEQ ID NO: 88616 - protein, 13 aa, Borrelia Burgdorferi
FGKAGAAAHGDSE

SEQ ID NO: 88617 - protein, 13 aa, Borrelia Burgdorferi
GKAGAAAHGDSEA

SEQ ID NO: 88618 - protein, 13 aa, Borrelia Burgdorferi
KAGAAAHGDSEAA

SEQ ID NO: 88619 - protein, 13 aa, Borrelia Burgdorferi
AGAAAHGDSEAAS

SEQ ID NO: 88620 - protein, 13 aa, Borrelia Burgdorferi
GAAAHGDSEAASK

SEQ ID NO: 88621 - protein, 13 aa, Borrelia Burgdorferi
AAAHGDSEAASKA

SEQ ID NO: 88622 - protein, 13 aa, Borrelia Burgdorferi
AAHGDSEAASKAA

SEQ ID NO: 88623 - protein, 13 aa, Borrelia Burgdorferi
AHGDSEAASKAAG

SEQ ID NO: 88624 - protein, 13 aa, Borrelia Burgdorferi
HGDSEAASKAAGA

SEQ ID NO: 88625 - protein, 13 aa, Borrelia Burgdorferi
GDSEAASKAAGAV

SEQ ID NO: 88626 - protein, 13 aa, Borrelia Burgdorferi
DSEAASKAAGAVS

SEQ ID NO: 88627 - protein, 13 aa, Borrelia Burgdorferi
SEAASKAAGAVSA

SEQ ID NO: 88628 - protein, 13 aa, Borrelia Burgdorferi
EAASKAAGAVSAV

SEQ ID NO: 88629 - protein, 13 aa, Borrelia Burgdorferi
AASKAAGAVSAVS

SEQ ID NO: 88630 - protein, 13 aa, Borrelia Burgdorferi
ASKAAGAVSAVSG

SEQ ID NO: 88631 - protein, 13 aa, Borrelia Burgdorferi
SKAAGAVSAVSGE

SEQ ID NO: 88632 - protein, 13 aa, Borrelia Burgdorferi
KAAGAVSAVSGEQ

SEQ ID NO: 88633 - protein, 13 aa, Borrelia Burgdorferi
AAGAVSAVSGEQI

SEQ ID NO: 88634 - protein, 13 aa, Borrelia Burgdorferi
AGAVSAVSGEQIL

SEQ ID NO: 88635 - protein, 13 aa, Borrelia Burgdorferi
GAVSAVSGEQILS

SEQ ID NO: 88636 - protein, 13 aa, Borrelia Burgdorferi
AVSAVSGEQILSA

SEQ ID NO: 88637 - protein, 13 aa, Borrelia Burgdorferi
VSAVSGEQILSAI

SEQ ID NO: 88638 - protein, 13 aa, Borrelia Burgdorferi
SAVSGEQILSAIV

SEQ ID NO: 88639 - protein, 13 aa, Borrelia Burgdorferi
AVSGEQILSAIVT

SEQ ID NO: 88640 - protein, 13 aa, Borrelia Burgdorferi
VSGEQILSAIVTA

SEQ ID NO: 88641 - protein, 13 aa, Borrelia Burgdorferi
SGEQILSAIVTAA

SEQ ID NO: 88642 - protein, 13 aa, Borrelia Burgdorferi
GEQILSAIVTAAD

SEQ ID NO: 88643 - protein, 13 aa, Borrelia Burgdorferi
EQILSAIVTAADA

SEQ ID NO: 88644 - protein, 13 aa, Borrelia Burgdorferi
QILSAIVTAADAA

SEQ ID NO: 88645 - protein, 13 aa, Borrelia Burgdorferi
ILSAIVTAADAAE

SEQ ID NO: 88646 - protein, 13 aa, Borrelia Burgdorferi
LSAIVTAADAAEQ

SEQ ID NO: 88647 - protein, 13 aa, Borrelia Burgdorferi
SAIVTAADAAEQD

SEQ ID NO: 88648 - protein, 13 aa, Borrelia Burgdorferi
AIVTAADAAEQDG

SEQ ID NO: 88649 - protein, 13 aa, Borrelia Burgdorferi
IVTAADAAEQDGK

SEQ ID NO: 88650 - protein, 13 aa, Borrelia Burgdorferi
VTAADAAEQDGKK

SEQ ID NO: 88651 - protein, 13 aa, Borrelia Burgdorferi
TAADAAEQDGKKP

SEQ ID NO: 88652 - protein, 13 aa, Borrelia Burgdorferi
AADAAEQDGKKPE

SEQ ID NO: 88653 - protein, 13 aa, Borrelia Burgdorferi
ADAAEQDGKKPEE

SEQ ID NO: 88654 - protein, 13 aa, Borrelia Burgdorferi
DAAEQDGKKPEEA

SEQ ID NO: 88655 - protein, 13 aa, Borrelia Burgdorferi
AAEQDGKKPEEAK

SEQ ID NO: 88656 - protein, 13 aa, Borrelia Burgdorferi
AEQDGKKPEEAKN

SEQ ID NO: 88657 - protein, 13 aa, Borrelia Burgdorferi
EQDGKKPEEAKNP

SEQ ID NO: 88658 - protein, 13 aa, Borrelia Burgdorferi
QDGKKPEEAKNPI

SEQ ID NO: 88659 - protein, 13 aa, Borrelia Burgdorferi
DGKKPEEAKNPIA

SEQ ID NO: 88660 - protein, 13 aa, Borrelia Burgdorferi
GKKPEEAKNPIAA

SEQ ID NO: 88661 - protein, 13 aa, Borrelia Burgdorferi
KKPEEAKNPIAAA

SEQ ID NO: 88662 - protein, 13 aa, Borrelia Burgdorferi
KPEEAKNPIAAAI

SEQ ID NO: 88663 - protein, 13 aa, Borrelia Burgdorferi
PEEAKNPIAAAIG

SEQ ID NO: 88664 - protein, 13 aa, Borrelia Burgdorferi
EEAKNPIAAAIGD

SEQ ID NO: 88665 - protein, 13 aa, Borrelia Burgdorferi
EAKNPIAAAIGDK

SEQ ID NO: 88666 - protein, 13 aa, Borrelia Burgdorferi
AKNPIAAAIGDKD

SEQ ID NO: 88667 - protein, 13 aa, Borrelia Burgdorferi
KNPIAAAIGDKDG

SEQ ID NO: 88668 - protein, 13 aa, Borrelia Burgdorferi
NPIAAAIGDKDGG

SEQ ID NO: 88669 - protein, 13 aa, Borrelia Burgdorferi
PIAAAIGDKDGGA

SEQ ID NO: 88670 - protein, 13 aa, Borrelia Burgdorferi
IAAAIGDKDGGAE

SEQ ID NO: 88671 - protein, 13 aa, Borrelia Burgdorferi
AAAIGDKDGGAEF

SEQ ID NO: 88672 - protein, 13 aa, Borrelia Burgdorferi
AAIGDKDGGAEFG

SEQ ID NO: 88673 - protein, 13 aa, Borrelia Burgdorferi
AIGDKDGGAEFGQ

SEQ ID NO: 88674 - protein, 13 aa, Borrelia Burgdorferi
IGDKDGGAEFGQD

SEQ ID NO: 88675 - protein, 13 aa, Borrelia Burgdorferi
GDKDGGAEFGQDE

SEQ ID NO: 88676 - protein, 13 aa, Borrelia Burgdorferi
  Xaa can be any naturally occurring amino acid
  VARIANT 13: Xaa = Any Amino Acid
DKDGGAEFGQDEX

SEQ ID NO: 88677 - protein, 13 aa, Borrelia Burgdorferi
  Xaa can be any naturally occurring amino acid
  VARIANT 12: Xaa = Any Amino Acid
KDGGAEFGQDEXK

SEQ ID NO: 88678 - protein, 13 aa, Borrelia Burgdorferi
  Xaa can be any naturally occurring amino acid
  VARIANT 11: Xaa = Any Amino Acid
DGGAEFGQDEXKK

SEQ ID NO: 88679 - protein, 13 aa, Borrelia Burgdorferi
  Xaa can be any naturally occurring amino acid
  VARIANT 10: Xaa = Any Amino Acid
GGAEFGQDEXKKD

SEQ ID NO: 88680 - protein, 13 aa, Borrelia Burgdorferi
  Xaa can be any naturally occurring amino acid
  VARIANT 9: Xaa = Any Amino Acid
GAEFGQDEXKKDD

SEQ ID NO: 88681 - protein, 13 aa, Borrelia Burgdorferi
  Xaa can be any naturally occurring amino acid
  VARIANT 8: Xaa = Any Amino Acid
AEFGQDEXKKDDQ

SEQ ID NO: 88682 - protein, 13 aa, Borrelia Burgdorferi
  Xaa can be any naturally occurring amino acid
  VARIANT 7: Xaa = Any Amino Acid
EFGQDEXKKDDQI

SEQ ID NO: 88683 - protein, 13 aa, Borrelia Burgdorferi
  Xaa can be any naturally occurring amino acid
  VARIANT 6: Xaa = Any Amino Acid
FGQDEXKKDDQIA

SEQ ID NO: 88684 - protein, 13 aa, Borrelia Burgdorferi
  Xaa can be any naturally occurring amino acid
  VARIANT 5: Xaa = Any Amino Acid
GQDEXKKDDQIAA

SEQ ID NO: 88685 - protein, 13 aa, Borrelia Burgdorferi
  Xaa can be any naturally occurring amino acid
  VARIANT 4: Xaa = Any Amino Acid
QDEXKKDDQIAAA

SEQ ID NO: 88686 - protein, 13 aa, Borrelia Burgdorferi
  Xaa can be any naturally occurring amino acid
  VARIANT 3: Xaa = Any Amino Acid
DEXKKDDQIAAAI

SEQ ID NO: 88687 - protein, 13 aa, Borrelia Burgdorferi
  Xaa can be any naturally occurring amino acid
  VARIANT 2: Xaa = Any Amino Acid
EXKKDDQIAAAIA

SEQ ID NO: 88688 - protein, 13 aa, Borrelia Burgdorferi
  Xaa can be any naturally occurring amino acid
  VARIANT 1: Xaa = Any Amino Acid
XKKDDQIAAAIAL

SEQ ID NO: 88689 - protein, 13 aa, Borrelia Burgdorferi
KKDDQIAAAIALR

SEQ ID NO: 88690 - protein, 13 aa, Borrelia Burgdorferi
KDDQIAAAIALRG

SEQ ID NO: 88691 - protein, 13 aa, Borrelia Burgdorferi
  Xaa can be any naturally occurring amino acid
  VARIANT 13: Xaa = Any Amino Acid
DDQIAAAIALRGX

SEQ ID NO: 88692 - protein, 13 aa, Borrelia Burgdorferi
  Xaa can be any naturally occurring amino acid
  VARIANT 12: Xaa = Any Amino Acid
DQIAAAIALRGXA

SEQ ID NO: 88693 - protein, 13 aa, Borrelia Burgdorferi
  Xaa can be any naturally occurring amino acid
  VARIANT 11: Xaa = Any Amino Acid
QIAAAIALRGXAK

SEQ ID NO: 88694 - protein, 13 aa, Borrelia Burgdorferi
  Xaa can be any naturally occurring amino acid
  VARIANT 10: Xaa = Any Amino Acid
IAAAIALRGXAKD

SEQ ID NO: 88695 - protein, 13 aa, Borrelia Burgdorferi
  Xaa can be any naturally occurring amino acid
  VARIANT 9: Xaa = Any Amino Acid
AAAIALRGXAKDG

SEQ ID NO: 88696 - protein, 13 aa, Borrelia Burgdorferi
  Xaa can be any naturally occurring amino acid
  VARIANT 8: Xaa = Any Amino Acid
AAIALRGXAKDGK

SEQ ID NO: 88697 - protein, 13 aa, Borrelia Burgdorferi
  Xaa can be any naturally occurring amino acid
  VARIANT 7: Xaa = Any Amino Acid
AIALRGXAKDGKF

SEQ ID NO: 88698 - protein, 13 aa, Borrelia Burgdorferi
  Xaa can be any naturally occurring amino acid
  VARIANT 6: Xaa = Any Amino Acid
IALRGXAKDGKFA

SEQ ID NO: 88699 - protein, 13 aa, Borrelia Burgdorferi
  Xaa can be any naturally occurring amino acid
  VARIANT 5: Xaa = Any Amino Acid
ALRGXAKDGKFAV

SEQ ID NO: 88700 - protein, 13 aa, Borrelia Burgdorferi
  Xaa can be any naturally occurring amino acid
  VARIANT 4: Xaa = Any Amino Acid
LRGXAKDGKFAVK

SEQ ID NO: 88701 - protein, 13 aa, Borrelia Burgdorferi
  Xaa can be any naturally occurring amino acid
  VARIANT 3: Xaa = Any Amino Acid
RGXAKDGKFAVKD

SEQ ID NO: 88702 - protein, 13 aa, Borrelia Burgdorferi
  Xaa can be any naturally occurring amino acid
  VARIANT 2: Xaa = Any Amino Acid
GXAKDGKFAVKDG

SEQ ID NO: 88703 - protein, 13 aa, Borrelia Burgdorferi
  Xaa can be any naturally occurring amino acid
  VARIANT 1: Xaa = Any Amino Acid
XAKDGKFAVKDGE

SEQ ID NO: 88704 - protein, 13 aa, Borrelia Burgdorferi
AKDGKFAVKDGEK

SEQ ID NO: 88705 - protein, 13 aa, Borrelia Burgdorferi
KDGKFAVKDGEKE

SEQ ID NO: 88706 - protein, 13 aa, Borrelia Burgdorferi
DGKFAVKDGEKEK

SEQ ID NO: 88707 - protein, 13 aa, Borrelia Burgdorferi
GKFAVKDGEKEKA

SEQ ID NO: 88708 - protein, 13 aa, Borrelia Burgdorferi
KFAVKDGEKEKAE

SEQ ID NO: 88709 - protein, 13 aa, Borrelia Burgdorferi
FAVKDGEKEKAEG

SEQ ID NO: 88710 - protein, 13 aa, Borrelia Burgdorferi
AVKDGEKEKAEGA

SEQ ID NO: 88711 - protein, 13 aa, Borrelia Burgdorferi
VKDGEKEKAEGAI

SEQ ID NO: 88712 - protein, 13 aa, Borrelia Burgdorferi
KDGEKEKAEGAIK

SEQ ID NO: 88713 - protein, 13 aa, Borrelia Burgdorferi
DGEKEKAEGAIKG

SEQ ID NO: 88714 - protein, 13 aa, Borrelia Burgdorferi
GEKEKAEGAIKGA

SEQ ID NO: 88715 - protein, 13 aa, Borrelia Burgdorferi
EKEKAEGAIKGAA

SEQ ID NO: 88716 - protein, 13 aa, Borrelia Burgdorferi
KEKAEGAIKGAAE

SEQ ID NO: 88717 - protein, 13 aa, Borrelia Burgdorferi
EKAEGAIKGAAES

SEQ ID NO: 88718 - protein, 13 aa, Borrelia Burgdorferi
KAEGAIKGAAESA

SEQ ID NO: 88719 - protein, 13 aa, Borrelia Burgdorferi
AEGAIKGAAESAV

SEQ ID NO: 88720 - protein, 13 aa, Borrelia Burgdorferi
EGAIKGAAESAVR

SEQ ID NO: 88721 - protein, 13 aa, Borrelia Burgdorferi
GAIKGAAESAVRK

SEQ ID NO: 88722 - protein, 13 aa, Borrelia Burgdorferi
AIKGAAESAVRKV

SEQ ID NO: 88723 - protein, 13 aa, Borrelia Burgdorferi
IKGAAESAVRKVL

SEQ ID NO: 88724 - protein, 13 aa, Borrelia Burgdorferi
KGAAESAVRKVLG

SEQ ID NO: 88725 - protein, 13 aa, Borrelia Burgdorferi
GAAESAVRKVLGA

SEQ ID NO: 88726 - protein, 13 aa, Borrelia Burgdorferi
AAESAVRKVLGAI

SEQ ID NO: 88727 - protein, 13 aa, Borrelia Burgdorferi
AESAVRKVLGAIT

SEQ ID NO: 88728 - protein, 13 aa, Borrelia Burgdorferi
ESAVRKVLGAITG

SEQ ID NO: 88729 - protein, 13 aa, Borrelia Burgdorferi
SAVRKVLGAITGL

SEQ ID NO: 88730 - protein, 13 aa, Borrelia Burgdorferi
AVRKVLGAITGLI

SEQ ID NO: 88731 - protein, 13 aa, Borrelia Burgdorferi
VRKVLGAITGLIG

SEQ ID NO: 88732 - protein, 13 aa, Borrelia Burgdorferi
RKVLGAITGLIGD

SEQ ID NO: 88733 - protein, 13 aa, Borrelia Burgdorferi
KVLGAITGLIGDA

SEQ ID NO: 88734 - protein, 13 aa, Borrelia Burgdorferi
VLGAITGLIGDAV

SEQ ID NO: 88735 - protein, 13 aa, Borrelia Burgdorferi
LGAITGLIGDAVS

SEQ ID NO: 88736 - protein, 13 aa, Borrelia Burgdorferi
GAITGLIGDAVSS

SEQ ID NO: 88737 - protein, 13 aa, Borrelia Burgdorferi
AITGLIGDAVSSG

SEQ ID NO: 88738 - protein, 13 aa, Borrelia Burgdorferi
ITGLIGDAVSSGL

SEQ ID NO: 88739 - protein, 13 aa, Borrelia Burgdorferi
TGLIGDAVSSGLR

SEQ ID NO: 88740 - protein, 13 aa, Borrelia Burgdorferi
GLIGDAVSSGLRK

SEQ ID NO: 88741 - protein, 13 aa, Borrelia Burgdorferi
LIGDAVSSGLRKV

SEQ ID NO: 88742 - protein, 13 aa, Borrelia Burgdorferi
IGDAVSSGLRKVG

SEQ ID NO: 88743 - protein, 13 aa, Borrelia Burgdorferi
GDAVSSGLRKVGD

SEQ ID NO: 88744 - protein, 13 aa, Borrelia Burgdorferi
DAVSSGLRKVGDS

SEQ ID NO: 88745 - protein, 13 aa, Borrelia Burgdorferi
AVSSGLRKVGDSV

SEQ ID NO: 88746 - protein, 13 aa, Borrelia Burgdorferi
VSSGLRKVGDSVK

SEQ ID NO: 88747 - protein, 13 aa, Borrelia Burgdorferi
SSGLRKVGDSVKA

SEQ ID NO: 88748 - protein, 13 aa, Borrelia Burgdorferi
SGLRKVGDSVKAA

SEQ ID NO: 88749 - protein, 13 aa, Borrelia Burgdorferi
GLRKVGDSVKAAS

SEQ ID NO: 88750 - protein, 13 aa, Borrelia Burgdorferi
LRKVGDSVKAASK

SEQ ID NO: 88751 - protein, 13 aa, Borrelia Burgdorferi
RKVGDSVKAASKE

SEQ ID NO: 88752 - protein, 13 aa, Borrelia Burgdorferi
KVGDSVKAASKET

SEQ ID NO: 88753 - protein, 13 aa, Borrelia Burgdorferi
VGDSVKAASKETP

SEQ ID NO: 88754 - protein, 13 aa, Borrelia Burgdorferi
GDSVKAASKETPP

SEQ ID NO: 88755 - protein, 13 aa, Borrelia Burgdorferi
DSVKAASKETPPA

SEQ ID NO: 88756 - protein, 13 aa, Borrelia Burgdorferi
SVKAASKETPPAL

SEQ ID NO: 88757 - protein, 13 aa, Borrelia Burgdorferi
VKAASKETPPALN

SEQ ID NO: 88758 - protein, 13 aa, Borrelia Burgdorferi
KAASKETPPALNK

SEQ ID NO: 88759 - protein, 14 aa, Borrelia Burgdorferi
MRGSHHHHHHGSSQ

SEQ ID NO: 88760 - protein, 14 aa, Borrelia Burgdorferi
RGSHHHHHHGSSQV

SEQ ID NO: 88761 - protein, 14 aa, Borrelia Burgdorferi
GSHHHHHHGSSQVA

SEQ ID NO: 88762 - protein, 14 aa, Borrelia Burgdorferi
SHHHHHHGSSQVAD

SEQ ID NO: 88763 - protein, 14 aa, Borrelia Burgdorferi
HHHHHHGSSQVADK

SEQ ID NO: 88764 - protein, 14 aa, Borrelia Burgdorferi
HHHHHGSSQVADKD

SEQ ID NO: 88765 - protein, 14 aa, Borrelia Burgdorferi
HHHHGSSQVADKDD

SEQ ID NO: 88766 - protein, 14 aa, Borrelia Burgdorferi
HHHGSSQVADKDDP

SEQ ID NO: 88767 - protein, 14 aa, Borrelia Burgdorferi
HHGSSQVADKDDPT

SEQ ID NO: 88768 - protein, 14 aa, Borrelia Burgdorferi
HGSSQVADKDDPTN

SEQ ID NO: 88769 - protein, 14 aa, Borrelia Burgdorferi
GSSQVADKDDPTNK

SEQ ID NO: 88770 - protein, 14 aa, Borrelia Burgdorferi
SSQVADKDDPTNKF

SEQ ID NO: 88771 - protein, 14 aa, Borrelia Burgdorferi
SQVADKDDPTNKFY

SEQ ID NO: 88772 - protein, 14 aa, Borrelia Burgdorferi
QVADKDDPTNKFYQ

SEQ ID NO: 88773 - protein, 14 aa, Borrelia Burgdorferi
VADKDDPTNKFYQS

SEQ ID NO: 88774 - protein, 14 aa, Borrelia Burgdorferi
ADKDDPTNKFYQSV

SEQ ID NO: 88775 - protein, 14 aa, Borrelia Burgdorferi
DKDDPTNKFYQSVI

SEQ ID NO: 88776 - protein, 14 aa, Borrelia Burgdorferi
KDDPTNKFYQSVIQ

SEQ ID NO: 88777 - protein, 14 aa, Borrelia Burgdorferi
DDPTNKFYQSVIQL

SEQ ID NO: 88778 - protein, 14 aa, Borrelia Burgdorferi
DPTNKFYQSVIQLG

SEQ ID NO: 88779 - protein, 14 aa, Borrelia Burgdorferi
PTNKFYQSVIQLGN

SEQ ID NO: 88780 - protein, 14 aa, Borrelia Burgdorferi
TNKFYQSVIQLGNG

SEQ ID NO: 88781 - protein, 14 aa, Borrelia Burgdorferi
NKFYQSVIQLGNGF

SEQ ID NO: 88782 - protein, 14 aa, Borrelia Burgdorferi
KFYQSVIQLGNGFL

SEQ ID NO: 88783 - protein, 14 aa, Borrelia Burgdorferi
FYQSVIQLGNGFLD

SEQ ID NO: 88784 - protein, 14 aa, Borrelia Burgdorferi
YQSVIQLGNGFLDV

SEQ ID NO: 88785 - protein, 14 aa, Borrelia Burgdorferi
QSVIQLGNGFLDVF

SEQ ID NO: 88786 - protein, 14 aa, Borrelia Burgdorferi
SVIQLGNGFLDVFT

SEQ ID NO: 88787 - protein, 14 aa, Borrelia Burgdorferi
VIQLGNGFLDVFTS

SEQ ID NO: 88788 - protein, 14 aa, Borrelia Burgdorferi
IQLGNGFLDVFTSF

SEQ ID NO: 88789 - protein, 14 aa, Borrelia Burgdorferi
QLGNGFLDVFTSFG

SEQ ID NO: 88790 - protein, 14 aa, Borrelia Burgdorferi
LGNGFLDVFTSFGG

SEQ ID NO: 88791 - protein, 14 aa, Borrelia Burgdorferi
GNGFLDVFTSFGGL

SEQ ID NO: 88792 - protein, 14 aa, Borrelia Burgdorferi
NGFLDVFTSFGGLV

SEQ ID NO: 88793 - protein, 14 aa, Borrelia Burgdorferi
GFLDVFTSFGGLVA

SEQ ID NO: 88794 - protein, 14 aa, Borrelia Burgdorferi
FLDVFTSFGGLVAE

SEQ ID NO: 88795 - protein, 14 aa, Borrelia Burgdorferi
LDVFTSFGGLVAEA

SEQ ID NO: 88796 - protein, 14 aa, Borrelia Burgdorferi
DVFTSFGGLVAEAF

SEQ ID NO: 88797 - protein, 14 aa, Borrelia Burgdorferi
VFTSFGGLVAEAFG

SEQ ID NO: 88798 - protein, 14 aa, Borrelia Burgdorferi
FTSFGGLVAEAFGF

SEQ ID NO: 88799 - protein, 14 aa, Borrelia Burgdorferi
TSFGGLVAEAFGFK

SEQ ID NO: 88800 - protein, 14 aa, Borrelia Burgdorferi
SFGGLVAEAFGFKS

SEQ ID NO: 88801 - protein, 14 aa, Borrelia Burgdorferi
FGGLVAEAFGFKSD

SEQ ID NO: 88802 - protein, 14 aa, Borrelia Burgdorferi
GGLVAEAFGFKSDP

SEQ ID NO: 88803 - protein, 14 aa, Borrelia Burgdorferi
GLVAEAFGFKSDPK

SEQ ID NO: 88804 - protein, 14 aa, Borrelia Burgdorferi
LVAEAFGFKSDPKK

SEQ ID NO: 88805 - protein, 14 aa, Borrelia Burgdorferi
VAEAFGFKSDPKKS

SEQ ID NO: 88806 - protein, 14 aa, Borrelia Burgdorferi
AEAFGFKSDPKKSD

SEQ ID NO: 88807 - protein, 14 aa, Borrelia Burgdorferi
EAFGFKSDPKKSDV

SEQ ID NO: 88808 - protein, 14 aa, Borrelia Burgdorferi
AFGFKSDPKKSDVK

SEQ ID NO: 88809 - protein, 14 aa, Borrelia Burgdorferi
FGFKSDPKKSDVKT

SEQ ID NO: 88810 - protein, 14 aa, Borrelia Burgdorferi
GFKSDPKKSDVKTY

SEQ ID NO: 88811 - protein, 14 aa, Borrelia Burgdorferi
FKSDPKKSDVKTYF

SEQ ID NO: 88812 - protein, 14 aa, Borrelia Burgdorferi
KSDPKKSDVKTYFT

SEQ ID NO: 88813 - protein, 14 aa, Borrelia Burgdorferi
SDPKKSDVKTYFTT

SEQ ID NO: 88814 - protein, 14 aa, Borrelia Burgdorferi
DPKKSDVKTYFTTV

SEQ ID NO: 88815 - protein, 14 aa, Borrelia Burgdorferi
PKKSDVKTYFTTVA

SEQ ID NO: 88816 - protein, 14 aa, Borrelia Burgdorferi
KKSDVKTYFTTVAA

SEQ ID NO: 88817 - protein, 14 aa, Borrelia Burgdorferi
KSDVKTYFTTVAAK

SEQ ID NO: 88818 - protein, 14 aa, Borrelia Burgdorferi
SDVKTYFTTVAAKL

SEQ ID NO: 88819 - protein, 14 aa, Borrelia Burgdorferi
DVKTYFTTVAAKLE

SEQ ID NO: 88820 - protein, 14 aa, Borrelia Burgdorferi
VKTYFTTVAAKLEK

SEQ ID NO: 88821 - protein, 14 aa, Borrelia Burgdorferi
KTYFTTVAAKLEKT

SEQ ID NO: 88822 - protein, 14 aa, Borrelia Burgdorferi
TYFTTVAAKLEKTK

SEQ ID NO: 88823 - protein, 14 aa, Borrelia Burgdorferi
YFTTVAAKLEKTKT

SEQ ID NO: 88824 - protein, 14 aa, Borrelia Burgdorferi
FTTVAAKLEKTKTD

SEQ ID NO: 88825 - protein, 14 aa, Borrelia Burgdorferi
TTVAAKLEKTKTDL

SEQ ID NO: 88826 - protein, 14 aa, Borrelia Burgdorferi
TVAAKLEKTKTDLN

SEQ ID NO: 88827 - protein, 14 aa, Borrelia Burgdorferi
VAAKLEKTKTDLNS

SEQ ID NO: 88828 - protein, 14 aa, Borrelia Burgdorferi
AAKLEKTKTDLNSL

SEQ ID NO: 88829 - protein, 14 aa, Borrelia Burgdorferi
AKLEKTKTDLNSLP

SEQ ID NO: 88830 - protein, 14 aa, Borrelia Burgdorferi
KLEKTKTDLNSLPK

SEQ ID NO: 88831 - protein, 14 aa, Borrelia Burgdorferi
LEKTKTDLNSLPKE

SEQ ID NO: 88832 - protein, 14 aa, Borrelia Burgdorferi
EKTKTDLNSLPKEK

SEQ ID NO: 88833 - protein, 14 aa, Borrelia Burgdorferi
KTKTDLNSLPKEKS

SEQ ID NO: 88834 - protein, 14 aa, Borrelia Burgdorferi
TKTDLNSLPKEKSD

SEQ ID NO: 88835 - protein, 14 aa, Borrelia Burgdorferi
KTDLNSLPKEKSDI

SEQ ID NO: 88836 - protein, 14 aa, Borrelia Burgdorferi
TDLNSLPKEKSDIS

SEQ ID NO: 88837 - protein, 14 aa, Borrelia Burgdorferi
DLNSLPKEKSDISS

SEQ ID NO: 88838 - protein, 14 aa, Borrelia Burgdorferi
LNSLPKEKSDISST

SEQ ID NO: 88839 - protein, 14 aa, Borrelia Burgdorferi
NSLPKEKSDISSTT

SEQ ID NO: 88840 - protein, 14 aa, Borrelia Burgdorferi
SLPKEKSDISSTTG

SEQ ID NO: 88841 - protein, 14 aa, Borrelia Burgdorferi
LPKEKSDISSTTGK

SEQ ID NO: 88842 - protein, 14 aa, Borrelia Burgdorferi
PKEKSDISSTTGKP

SEQ ID NO: 88843 - protein, 14 aa, Borrelia Burgdorferi
KEKSDISSTTGKPD

SEQ ID NO: 88844 - protein, 14 aa, Borrelia Burgdorferi
EKSDISSTTGKPDS

SEQ ID NO: 88845 - protein, 14 aa, Borrelia Burgdorferi
KSDISSTTGKPDST

SEQ ID NO: 88846 - protein, 14 aa, Borrelia Burgdorferi
SDISSTTGKPDSTG

SEQ ID NO: 88847 - protein, 14 aa, Borrelia Burgdorferi
DISSTTGKPDSTGS

SEQ ID NO: 88848 - protein, 14 aa, Borrelia Burgdorferi
ISSTTGKPDSTGSV

SEQ ID NO: 88849 - protein, 14 aa, Borrelia Burgdorferi
SSTTGKPDSTGSVG

SEQ ID NO: 88850 - protein, 14 aa, Borrelia Burgdorferi
STTGKPDSTGSVGT

SEQ ID NO: 88851 - protein, 14 aa, Borrelia Burgdorferi
TTGKPDSTGSVGTA

SEQ ID NO: 88852 - protein, 14 aa, Borrelia Burgdorferi
TGKPDSTGSVGTAV

SEQ ID NO: 88853 - protein, 14 aa, Borrelia Burgdorferi
GKPDSTGSVGTAVE

SEQ ID NO: 88854 - protein, 14 aa, Borrelia Burgdorferi
KPDSTGSVGTAVEG

SEQ ID NO: 88855 - protein, 14 aa, Borrelia Burgdorferi
PDSTGSVGTAVEGA

SEQ ID NO: 88856 - protein, 14 aa, Borrelia Burgdorferi
DSTGSVGTAVEGAI

SEQ ID NO: 88857 - protein, 14 aa, Borrelia Burgdorferi
STGSVGTAVEGAIK

SEQ ID NO: 88858 - protein, 14 aa, Borrelia Burgdorferi
TGSVGTAVEGAIKE

SEQ ID NO: 88859 - protein, 14 aa, Borrelia Burgdorferi
GSVGTAVEGAIKEV

SEQ ID NO: 88860 - protein, 14 aa, Borrelia Burgdorferi
SVGTAVEGAIKEVS

SEQ ID NO: 88861 - protein, 14 aa, Borrelia Burgdorferi
VGTAVEGAIKEVSE

SEQ ID NO: 88862 - protein, 14 aa, Borrelia Burgdorferi
GTAVEGAIKEVSEL

SEQ ID NO: 88863 - protein, 14 aa, Borrelia Burgdorferi
TAVEGAIKEVSELL

SEQ ID NO: 88864 - protein, 14 aa, Borrelia Burgdorferi
AVEGAIKEVSELLD

SEQ ID NO: 88865 - protein, 14 aa, Borrelia Burgdorferi
VEGAIKEVSELLDK

SEQ ID NO: 88866 - protein, 14 aa, Borrelia Burgdorferi
EGAIKEVSELLDKL

SEQ ID NO: 88867 - protein, 14 aa, Borrelia Burgdorferi
GAIKEVSELLDKLV

SEQ ID NO: 88868 - protein, 14 aa, Borrelia Burgdorferi
AIKEVSELLDKLVK

SEQ ID NO: 88869 - protein, 14 aa, Borrelia Burgdorferi
IKEVSELLDKLVKA

SEQ ID NO: 88870 - protein, 14 aa, Borrelia Burgdorferi
KEVSELLDKLVKAV

SEQ ID NO: 88871 - protein, 14 aa, Borrelia Burgdorferi
EVSELLDKLVKAVK

SEQ ID NO: 88872 - protein, 14 aa, Borrelia Burgdorferi
VSELLDKLVKAVKT

SEQ ID NO: 88873 - protein, 14 aa, Borrelia Burgdorferi
SELLDKLVKAVKTA

SEQ ID NO: 88874 - protein, 14 aa, Borrelia Burgdorferi
ELLDKLVKAVKTAE

SEQ ID NO: 88875 - protein, 14 aa, Borrelia Burgdorferi
LLDKLVKAVKTAEG

SEQ ID NO: 88876 - protein, 14 aa, Borrelia Burgdorferi
LDKLVKAVKTAEGA

SEQ ID NO: 88877 - protein, 14 aa, Borrelia Burgdorferi
DKLVKAVKTAEGAS

SEQ ID NO: 88878 - protein, 14 aa, Borrelia Burgdorferi
KLVKAVKTAEGASS

SEQ ID NO: 88879 - protein, 14 aa, Borrelia Burgdorferi
LVKAVKTAEGASSG

SEQ ID NO: 88880 - protein, 14 aa, Borrelia Burgdorferi
VKAVKTAEGASSGT

SEQ ID NO: 88881 - protein, 14 aa, Borrelia Burgdorferi
KAVKTAEGASSGTA

SEQ ID NO: 88882 - protein, 14 aa, Borrelia Burgdorferi
AVKTAEGASSGTAA

SEQ ID NO: 88883 - protein, 14 aa, Borrelia Burgdorferi
VKTAEGASSGTAAI

SEQ ID NO: 88884 - protein, 14 aa, Borrelia Burgdorferi
KTAEGASSGTAAIG

SEQ ID NO: 88885 - protein, 14 aa, Borrelia Burgdorferi
TAEGASSGTAAIGE

SEQ ID NO: 88886 - protein, 14 aa, Borrelia Burgdorferi
AEGASSGTAAIGEV

SEQ ID NO: 88887 - protein, 14 aa, Borrelia Burgdorferi
EGASSGTAAIGEVV

SEQ ID NO: 88888 - protein, 14 aa, Borrelia Burgdorferi
GASSGTAAIGEVVA

SEQ ID NO: 88889 - protein, 14 aa, Borrelia Burgdorferi
ASSGTAAIGEVVAD

SEQ ID NO: 88890 - protein, 14 aa, Borrelia Burgdorferi
SSGTAAIGEVVADA

SEQ ID NO: 88891 - protein, 14 aa, Borrelia Burgdorferi
SGTAAIGEVVADAD

SEQ ID NO: 88892 - protein, 14 aa, Borrelia Burgdorferi
GTAAIGEVVADADA

SEQ ID NO: 88893 - protein, 14 aa, Borrelia Burgdorferi
TAAIGEVVADADAA

SEQ ID NO: 88894 - protein, 14 aa, Borrelia Burgdorferi
AAIGEVVADADAAK

SEQ ID NO: 88895 - protein, 14 aa, Borrelia Burgdorferi
AIGEVVADADAAKV

SEQ ID NO: 88896 - protein, 14 aa, Borrelia Burgdorferi
IGEVVADADAAKVA

SEQ ID NO: 88897 - protein, 14 aa, Borrelia Burgdorferi
GEVVADADAAKVAD

SEQ ID NO: 88898 - protein, 14 aa, Borrelia Burgdorferi
EVVADADAAKVADK

SEQ ID NO: 88899 - protein, 14 aa, Borrelia Burgdorferi
VVADADAAKVADKA

SEQ ID NO: 88900 - protein, 14 aa, Borrelia Burgdorferi
VADADAAKVADKAS

SEQ ID NO: 88901 - protein, 14 aa, Borrelia Burgdorferi
ADADAAKVADKASV

SEQ ID NO: 88902 - protein, 14 aa, Borrelia Burgdorferi
DADAAKVADKASVK

SEQ ID NO: 88903 - protein, 14 aa, Borrelia Burgdorferi
ADAAKVADKASVKG

SEQ ID NO: 88904 - protein, 14 aa, Borrelia Burgdorferi
DAAKVADKASVKGI

SEQ ID NO: 88905 - protein, 14 aa, Borrelia Burgdorferi
AAKVADKASVKGIA

SEQ ID NO: 88906 - protein, 14 aa, Borrelia Burgdorferi
AKVADKASVKGIAK

SEQ ID NO: 88907 - protein, 14 aa, Borrelia Burgdorferi
KVADKASVKGIAKG

SEQ ID NO: 88908 - protein, 14 aa, Borrelia Burgdorferi
VADKASVKGIAKGI

SEQ ID NO: 88909 - protein, 14 aa, Borrelia Burgdorferi
ADKASVKGIAKGIK

SEQ ID NO: 88910 - protein, 14 aa, Borrelia Burgdorferi
DKASVKGIAKGIKE

SEQ ID NO: 88911 - protein, 14 aa, Borrelia Burgdorferi
KASVKGIAKGIKEI

SEQ ID NO: 88912 - protein, 14 aa, Borrelia Burgdorferi
ASVKGIAKGIKEIV

SEQ ID NO: 88913 - protein, 14 aa, Borrelia Burgdorferi
SVKGIAKGIKEIVE

SEQ ID NO: 88914 - protein, 14 aa, Borrelia Burgdorferi
VKGIAKGIKEIVEA

SEQ ID NO: 88915 - protein, 14 aa, Borrelia Burgdorferi
KGIAKGIKEIVEAA

SEQ ID NO: 88916 - protein, 14 aa, Borrelia Burgdorferi
GIAKGIKEIVEAAG

SEQ ID NO: 88917 - protein, 14 aa, Borrelia Burgdorferi
IAKGIKEIVEAAGG

SEQ ID NO: 88918 - protein, 14 aa, Borrelia Burgdorferi
AKGIKEIVEAAGGS

SEQ ID NO: 88919 - protein, 14 aa, Borrelia Burgdorferi
KGIKEIVEAAGGSE

SEQ ID NO: 88920 - protein, 14 aa, Borrelia Burgdorferi
GIKEIVEAAGGSEK

SEQ ID NO: 88921 - protein, 14 aa, Borrelia Burgdorferi
IKEIVEAAGGSEKL

SEQ ID NO: 88922 - protein, 14 aa, Borrelia Burgdorferi
KEIVEAAGGSEKLK

SEQ ID NO: 88923 - protein, 14 aa, Borrelia Burgdorferi
EIVEAAGGSEKLKA

SEQ ID NO: 88924 - protein, 14 aa, Borrelia Burgdorferi
IVEAAGGSEKLKAV

SEQ ID NO: 88925 - protein, 14 aa, Borrelia Burgdorferi
VEAAGGSEKLKAVA

SEQ ID NO: 88926 - protein, 14 aa, Borrelia Burgdorferi
EAAGGSEKLKAVAA

SEQ ID NO: 88927 - protein, 14 aa, Borrelia Burgdorferi
AAGGSEKLKAVAAA

SEQ ID NO: 88928 - protein, 14 aa, Borrelia Burgdorferi
AGGSEKLKAVAAAK

SEQ ID NO: 88929 - protein, 14 aa, Borrelia Burgdorferi
GGSEKLKAVAAAKG

SEQ ID NO: 88930 - protein, 14 aa, Borrelia Burgdorferi
GSEKLKAVAAAKGE

SEQ ID NO: 88931 - protein, 14 aa, Borrelia Burgdorferi
SEKLKAVAAAKGEN

SEQ ID NO: 88932 - protein, 14 aa, Borrelia Burgdorferi
EKLKAVAAAKGENN

SEQ ID NO: 88933 - protein, 14 aa, Borrelia Burgdorferi
KLKAVAAAKGENNK

SEQ ID NO: 88934 - protein, 14 aa, Borrelia Burgdorferi
LKAVAAAKGENNKG

SEQ ID NO: 88935 - protein, 14 aa, Borrelia Burgdorferi
KAVAAAKGENNKGA

SEQ ID NO: 88936 - protein, 14 aa, Borrelia Burgdorferi
AVAAAKGENNKGAG

SEQ ID NO: 88937 - protein, 14 aa, Borrelia Burgdorferi
VAAAKGENNKGAGK

SEQ ID NO: 88938 - protein, 14 aa, Borrelia Burgdorferi
AAAKGENNKGAGKL

SEQ ID NO: 88939 - protein, 14 aa, Borrelia Burgdorferi
AAKGENNKGAGKLF

SEQ ID NO: 88940 - protein, 14 aa, Borrelia Burgdorferi
AKGENNKGAGKLFG

SEQ ID NO: 88941 - protein, 14 aa, Borrelia Burgdorferi
KGENNKGAGKLFGK

SEQ ID NO: 88942 - protein, 14 aa, Borrelia Burgdorferi
GENNKGAGKLFGKA

SEQ ID NO: 88943 - protein, 14 aa, Borrelia Burgdorferi
ENNKGAGKLFGKAG

SEQ ID NO: 88944 - protein, 14 aa, Borrelia Burgdorferi
NNKGAGKLFGKAGA

SEQ ID NO: 88945 - protein, 14 aa, Borrelia Burgdorferi
NKGAGKLFGKAGAA

SEQ ID NO: 88946 - protein, 14 aa, Borrelia Burgdorferi
KGAGKLFGKAGAAA

SEQ ID NO: 88947 - protein, 14 aa, Borrelia Burgdorferi
GAGKLFGKAGAAAH

SEQ ID NO: 88948 - protein, 14 aa, Borrelia Burgdorferi
AGKLFGKAGAAAHG

SEQ ID NO: 88949 - protein, 14 aa, Borrelia Burgdorferi
GKLFGKAGAAAHGD

SEQ ID NO: 88950 - protein, 14 aa, Borrelia Burgdorferi
KLFGKAGAAAHGDS

SEQ ID NO: 88951 - protein, 14 aa, Borrelia Burgdorferi
LFGKAGAAAHGDSE

SEQ ID NO: 88952 - protein, 14 aa, Borrelia Burgdorferi
FGKAGAAAHGDSEA

SEQ ID NO: 88953 - protein, 14 aa, Borrelia Burgdorferi
GKAGAAAHGDSEAA

SEQ ID NO: 88954 - protein, 14 aa, Borrelia Burgdorferi
KAGAAAHGDSEAAS

SEQ ID NO: 88955 - protein, 14 aa, Borrelia Burgdorferi
AGAAAHGDSEAASK

SEQ ID NO: 88956 - protein, 14 aa, Borrelia Burgdorferi
GAAAHGDSEAASKA

SEQ ID NO: 88957 - protein, 14 aa, Borrelia Burgdorferi
AAAHGDSEAASKAA

SEQ ID NO: 88958 - protein, 14 aa, Borrelia Burgdorferi
AAHGDSEAASKAAG

SEQ ID NO: 88959 - protein, 14 aa, Borrelia Burgdorferi
AHGDSEAASKAAGA

SEQ ID NO: 88960 - protein, 14 aa, Borrelia Burgdorferi
HGDSEAASKAAGAV

SEQ ID NO: 88961 - protein, 14 aa, Borrelia Burgdorferi
GDSEAASKAAGAVS

SEQ ID NO: 88962 - protein, 14 aa, Borrelia Burgdorferi
DSEAASKAAGAVSA

SEQ ID NO: 88963 - protein, 14 aa, Borrelia Burgdorferi
SEAASKAAGAVSAV

SEQ ID NO: 88964 - protein, 14 aa, Borrelia Burgdorferi
EAASKAAGAVSAVS

SEQ ID NO: 88965 - protein, 14 aa, Borrelia Burgdorferi
AASKAAGAVSAVSG

SEQ ID NO: 88966 - protein, 14 aa, Borrelia Burgdorferi
ASKAAGAVSAVSGE

SEQ ID NO: 88967 - protein, 14 aa, Borrelia Burgdorferi
SKAAGAVSAVSGEQ

SEQ ID NO: 88968 - protein, 14 aa, Borrelia Burgdorferi
KAAGAVSAVSGEQI

SEQ ID NO: 88969 - protein, 14 aa, Borrelia Burgdorferi
AAGAVSAVSGEQIL

SEQ ID NO: 88970 - protein, 14 aa, Borrelia Burgdorferi
AGAVSAVSGEQILS

SEQ ID NO: 88971 - protein, 14 aa, Borrelia Burgdorferi
GAVSAVSGEQILSA

SEQ ID NO: 88972 - protein, 14 aa, Borrelia Burgdorferi
AVSAVSGEQILSAI

SEQ ID NO: 88973 - protein, 14 aa, Borrelia Burgdorferi
VSAVSGEQILSAIV

SEQ ID NO: 88974 - protein, 14 aa, Borrelia Burgdorferi
SAVSGEQILSAIVT

SEQ ID NO: 88975 - protein, 14 aa, Borrelia Burgdorferi
AVSGEQILSAIVTA

SEQ ID NO: 88976 - protein, 14 aa, Borrelia Burgdorferi
VSGEQILSAIVTAA

SEQ ID NO: 88977 - protein, 14 aa, Borrelia Burgdorferi
SGEQILSAIVTAAD

SEQ ID NO: 88978 - protein, 14 aa, Borrelia Burgdorferi
GEQILSAIVTAADA

SEQ ID NO: 88979 - protein, 14 aa, Borrelia Burgdorferi
EQILSAIVTAADAA

SEQ ID NO: 88980 - protein, 14 aa, Borrelia Burgdorferi
QILSAIVTAADAAE

SEQ ID NO: 88981 - protein, 14 aa, Borrelia Burgdorferi
ILSAIVTAADAAEQ

SEQ ID NO: 88982 - protein, 14 aa, Borrelia Burgdorferi
LSAIVTAADAAEQD

SEQ ID NO: 88983 - protein, 14 aa, Borrelia Burgdorferi
SAIVTAADAAEQDG

SEQ ID NO: 88984 - protein, 14 aa, Borrelia Burgdorferi
AIVTAADAAEQDGK

SEQ ID NO: 88985 - protein, 14 aa, Borrelia Burgdorferi
IVTAADAAEQDGKK

SEQ ID NO: 88986 - protein, 14 aa, Borrelia Burgdorferi
VTAADAAEQDGKKP

SEQ ID NO: 88987 - protein, 14 aa, Borrelia Burgdorferi
TAADAAEQDGKKPE

SEQ ID NO: 88988 - protein, 14 aa, Borrelia Burgdorferi
AADAAEQDGKKPEE

SEQ ID NO: 88989 - protein, 14 aa, Borrelia Burgdorferi
ADAAEQDGKKPEEA

SEQ ID NO: 88990 - protein, 14 aa, Borrelia Burgdorferi
DAAEQDGKKPEEAK

SEQ ID NO: 88991 - protein, 14 aa, Borrelia Burgdorferi
AAEQDGKKPEEAKN

SEQ ID NO: 88992 - protein, 14 aa, Borrelia Burgdorferi
AEQDGKKPEEAKNP

SEQ ID NO: 88993 - protein, 14 aa, Borrelia Burgdorferi
EQDGKKPEEAKNPI

SEQ ID NO: 88994 - protein, 14 aa, Borrelia Burgdorferi
QDGKKPEEAKNPIA

SEQ ID NO: 88995 - protein, 14 aa, Borrelia Burgdorferi
DGKKPEEAKNPIAA

SEQ ID NO: 88996 - protein, 14 aa, Borrelia Burgdorferi
GKKPEEAKNPIAAA

SEQ ID NO: 88997 - protein, 14 aa, Borrelia Burgdorferi
KKPEEAKNPIAAAI

SEQ ID NO: 88998 - protein, 14 aa, Borrelia Burgdorferi
KPEEAKNPIAAAIG

SEQ ID NO: 88999 - protein, 14 aa, Borrelia Burgdorferi
PEEAKNPIAAAIGD

SEQ ID NO: 89000 - protein, 14 aa, Borrelia Burgdorferi
EEAKNPIAAAIGDK

SEQ ID NO: 89001 - protein, 14 aa, Borrelia Burgdorferi
EAKNPIAAAIGDKD

SEQ ID NO: 89002 - protein, 14 aa, Borrelia Burgdorferi
AKNPIAAAIGDKDG

SEQ ID NO: 89003 - protein, 14 aa, Borrelia Burgdorferi
KNPIAAAIGDKDGG

SEQ ID NO: 89004 - protein, 14 aa, Borrelia Burgdorferi
NPIAAAIGDKDGGA

SEQ ID NO: 89005 - protein, 14 aa, Borrelia Burgdorferi
PIAAAIGDKDGGAE

SEQ ID NO: 89006 - protein, 14 aa, Borrelia Burgdorferi
IAAAIGDKDGGAEF

SEQ ID NO: 89007 - protein, 14 aa, Borrelia Burgdorferi
AAAIGDKDGGAEFG

SEQ ID NO: 89008 - protein, 14 aa, Borrelia Burgdorferi
AAIGDKDGGAEFGQ

SEQ ID NO: 89009 - protein, 14 aa, Borrelia Burgdorferi
AIGDKDGGAEFGQD

SEQ ID NO: 89010 - protein, 14 aa, Borrelia Burgdorferi
IGDKDGGAEFGQDE

SEQ ID NO: 89011 - protein, 14 aa, Borrelia Burgdorferi
  Xaa can be any naturally occurring amino acid
  VARIANT 14: Xaa = Any Amino Acid
GDKDGGAEFGQDEX

SEQ ID NO: 89012 - protein, 14 aa, Borrelia Burgdorferi
  Xaa can be any naturally occurring amino acid
  VARIANT 13: Xaa = Any Amino Acid
DKDGGAEFGQDEXK

SEQ ID NO: 89013 - protein, 14 aa, Borrelia Burgdorferi
  Xaa can be any naturally occurring amino acid
  VARIANT 12: Xaa = Any Amino Acid
KDGGAEFGQDEXKK

SEQ ID NO: 89014 - protein, 14 aa, Borrelia Burgdorferi
  Xaa can be any naturally occurring amino acid
  VARIANT 11: Xaa = Any Amino Acid
DGGAEFGQDEXKKD

SEQ ID NO: 89015 - protein, 14 aa, Borrelia Burgdorferi
  Xaa can be any naturally occurring amino acid
  VARIANT 10: Xaa = Any Amino Acid
GGAEFGQDEXKKDD

SEQ ID NO: 89016 - protein, 14 aa, Borrelia Burgdorferi
  Xaa can be any naturally occurring amino acid
  VARIANT 9: Xaa = Any Amino Acid
GAEFGQDEXKKDDQ

SEQ ID NO: 89017 - protein, 14 aa, Borrelia Burgdorferi
  Xaa can be any naturally occurring amino acid
  VARIANT 8: Xaa = Any Amino Acid
AEFGQDEXKKDDQI

SEQ ID NO: 89018 - protein, 14 aa, Borrelia Burgdorferi
  Xaa can be any naturally occurring amino acid
  VARIANT 7: Xaa = Any Amino Acid
EFGQDEXKKDDQIA

SEQ ID NO: 89019 - protein, 14 aa, Borrelia Burgdorferi
  Xaa can be any naturally occurring amino acid
  VARIANT 6: Xaa = Any Amino Acid
FGQDEXKKDDQIAA

SEQ ID NO: 89020 - protein, 14 aa, Borrelia Burgdorferi
  Xaa can be any naturally occurring amino acid
  VARIANT 5: Xaa = Any Amino Acid
GQDEXKKDDQIAAA

SEQ ID NO: 89021 - protein, 14 aa, Borrelia Burgdorferi
  Xaa can be any naturally occurring amino acid
  VARIANT 4: Xaa = Any Amino Acid
QDEXKKDDQIAAAI

SEQ ID NO: 89022 - protein, 14 aa, Borrelia Burgdorferi
  Xaa can be any naturally occurring amino acid
  VARIANT 3: Xaa = Any Amino Acid
DEXKKDDQIAAAIA

SEQ ID NO: 89023 - protein, 14 aa, Borrelia Burgdorferi
  Xaa can be any naturally occurring amino acid
  VARIANT 2: Xaa = Any Amino Acid
EXKKDDQIAAAIAL

SEQ ID NO: 89024 - protein, 14 aa, Borrelia Burgdorferi
  Xaa can be any naturally occurring amino acid
  VARIANT 1: Xaa = Any Amino Acid
XKKDDQIAAAIALR

SEQ ID NO: 89025 - protein, 14 aa, Borrelia Burgdorferi
KKDDQIAAAIALRG

SEQ ID NO: 89026 - protein, 14 aa, Borrelia Burgdorferi
  Xaa can be any naturally occurring amino acid
  VARIANT 14: Xaa = Any Amino Acid
KDDQIAAAIALRGX

SEQ ID NO: 89027 - protein, 14 aa, Borrelia Burgdorferi
  Xaa can be any naturally occurring amino acid
  VARIANT 13: Xaa = Any Amino Acid
DDQIAAAIALRGXA

SEQ ID NO: 89028 - protein, 14 aa, Borrelia Burgdorferi
  Xaa can be any naturally occurring amino acid
  VARIANT 12: Xaa = Any Amino Acid
DQIAAAIALRGXAK

SEQ ID NO: 89029 - protein, 14 aa, Borrelia Burgdorferi
  Xaa can be any naturally occurring amino acid
  VARIANT 11: Xaa = Any Amino Acid
QIAAAIALRGXAKD

SEQ ID NO: 89030 - protein, 14 aa, Borrelia Burgdorferi
  Xaa can be any naturally occurring amino acid
  VARIANT 10: Xaa = Any Amino Acid
IAAAIALRGXAKDG

SEQ ID NO: 89031 - protein, 14 aa, Borrelia Burgdorferi
  Xaa can be any naturally occurring amino acid
  VARIANT 9: Xaa = Any Amino Acid
AAAIALRGXAKDGK

SEQ ID NO: 89032 - protein, 14 aa, Borrelia Burgdorferi
  Xaa can be any naturally occurring amino acid
  VARIANT 8: Xaa = Any Amino Acid
AAIALRGXAKDGKF

SEQ ID NO: 89033 - protein, 14 aa, Borrelia Burgdorferi
  Xaa can be any naturally occurring amino acid
  VARIANT 7: Xaa = Any Amino Acid
AIALRGXAKDGKFA

SEQ ID NO: 89034 - protein, 14 aa, Borrelia Burgdorferi
  Xaa can be any naturally occurring amino acid
  VARIANT 6: Xaa = Any Amino Acid
IALRGXAKDGKFAV

SEQ ID NO: 89035 - protein, 14 aa, Borrelia Burgdorferi
  Xaa can be any naturally occurring amino acid
  VARIANT 5: Xaa = Any Amino Acid
ALRGXAKDGKFAVK

SEQ ID NO: 89036 - protein, 14 aa, Borrelia Burgdorferi
  Xaa can be any naturally occurring amino acid
  VARIANT 4: Xaa = Any Amino Acid
LRGXAKDGKFAVKD

SEQ ID NO: 89037 - protein, 14 aa, Borrelia Burgdorferi
  Xaa can be any naturally occurring amino acid
  VARIANT 3: Xaa = Any Amino Acid
RGXAKDGKFAVKDG

SEQ ID NO: 89038 - protein, 14 aa, Borrelia Burgdorferi
  Xaa can be any naturally occurring amino acid
  VARIANT 2: Xaa = Any Amino Acid
GXAKDGKFAVKDGE

SEQ ID NO: 89039 - protein, 14 aa, Borrelia Burgdorferi
  Xaa can be any naturally occurring amino acid
  VARIANT 1: Xaa = Any Amino Acid
XAKDGKFAVKDGEK

SEQ ID NO: 89040 - protein, 14 aa, Borrelia Burgdorferi
AKDGKFAVKDGEKE

SEQ ID NO: 89041 - protein, 14 aa, Borrelia Burgdorferi
KDGKFAVKDGEKEK

SEQ ID NO: 89042 - protein, 14 aa, Borrelia Burgdorferi
DGKFAVKDGEKEKA

SEQ ID NO: 89043 - protein, 14 aa, Borrelia Burgdorferi
GKFAVKDGEKEKAE

SEQ ID NO: 89044 - protein, 14 aa, Borrelia Burgdorferi
KFAVKDGEKEKAEG

SEQ ID NO: 89045 - protein, 14 aa, Borrelia Burgdorferi
FAVKDGEKEKAEGA

SEQ ID NO: 89046 - protein, 14 aa, Borrelia Burgdorferi
AVKDGEKEKAEGAI

SEQ ID NO: 89047 - protein, 14 aa, Borrelia Burgdorferi
VKDGEKEKAEGAIK

SEQ ID NO: 89048 - protein, 14 aa, Borrelia Burgdorferi
KDGEKEKAEGAIKG

SEQ ID NO: 89049 - protein, 14 aa, Borrelia Burgdorferi
DGEKEKAEGAIKGA

SEQ ID NO: 89050 - protein, 14 aa, Borrelia Burgdorferi
GEKEKAEGAIKGAA

SEQ ID NO: 89051 - protein, 14 aa, Borrelia Burgdorferi
EKEKAEGAIKGAAE

SEQ ID NO: 89052 - protein, 14 aa, Borrelia Burgdorferi
KEKAEGAIKGAAES

SEQ ID NO: 89053 - protein, 14 aa, Borrelia Burgdorferi
EKAEGAIKGAAESA

SEQ ID NO: 89054 - protein, 14 aa, Borrelia Burgdorferi
KAEGAIKGAAESAV

SEQ ID NO: 89055 - protein, 14 aa, Borrelia Burgdorferi
AEGAIKGAAESAVR

SEQ ID NO: 89056 - protein, 14 aa, Borrelia Burgdorferi
EGAIKGAAESAVRK

SEQ ID NO: 89057 - protein, 14 aa, Borrelia Burgdorferi
GAIKGAAESAVRKV

SEQ ID NO: 89058 - protein, 14 aa, Borrelia Burgdorferi
AIKGAAESAVRKVL

SEQ ID NO: 89059 - protein, 14 aa, Borrelia Burgdorferi
IKGAAESAVRKVLG

SEQ ID NO: 89060 - protein, 14 aa, Borrelia Burgdorferi
KGAAESAVRKVLGA

SEQ ID NO: 89061 - protein, 14 aa, Borrelia Burgdorferi
GAAESAVRKVLGAI

SEQ ID NO: 89062 - protein, 14 aa, Borrelia Burgdorferi
AAESAVRKVLGAIT

SEQ ID NO: 89063 - protein, 14 aa, Borrelia Burgdorferi
AESAVRKVLGAITG

SEQ ID NO: 89064 - protein, 14 aa, Borrelia Burgdorferi
ESAVRKVLGAITGL

SEQ ID NO: 89065 - protein, 14 aa, Borrelia Burgdorferi
SAVRKVLGAITGLI

SEQ ID NO: 89066 - protein, 14 aa, Borrelia Burgdorferi
AVRKVLGAITGLIG

SEQ ID NO: 89067 - protein, 14 aa, Borrelia Burgdorferi
VRKVLGAITGLIGD

SEQ ID NO: 89068 - protein, 14 aa, Borrelia Burgdorferi
RKVLGAITGLIGDA

SEQ ID NO: 89069 - protein, 14 aa, Borrelia Burgdorferi
KVLGAITGLIGDAV

SEQ ID NO: 89070 - protein, 14 aa, Borrelia Burgdorferi
VLGAITGLIGDAVS

SEQ ID NO: 89071 - protein, 14 aa, Borrelia Burgdorferi
LGAITGLIGDAVSS

SEQ ID NO: 89072 - protein, 14 aa, Borrelia Burgdorferi
GAITGLIGDAVSSG

SEQ ID NO: 89073 - protein, 14 aa, Borrelia Burgdorferi
AITGLIGDAVSSGL

SEQ ID NO: 89074 - protein, 14 aa, Borrelia Burgdorferi
ITGLIGDAVSSGLR

SEQ ID NO: 89075 - protein, 14 aa, Borrelia Burgdorferi
TGLIGDAVSSGLRK

SEQ ID NO: 89076 - protein, 14 aa, Borrelia Burgdorferi
GLIGDAVSSGLRKV

SEQ ID NO: 89077 - protein, 14 aa, Borrelia Burgdorferi
LIGDAVSSGLRKVG

SEQ ID NO: 89078 - protein, 14 aa, Borrelia Burgdorferi
IGDAVSSGLRKVGD

SEQ ID NO: 89079 - protein, 14 aa, Borrelia Burgdorferi
GDAVSSGLRKVGDS

SEQ ID NO: 89080 - protein, 14 aa, Borrelia Burgdorferi
DAVSSGLRKVGDSV

SEQ ID NO: 89081 - protein, 14 aa, Borrelia Burgdorferi
AVSSGLRKVGDSVK

SEQ ID NO: 89082 - protein, 14 aa, Borrelia Burgdorferi
VSSGLRKVGDSVKA

SEQ ID NO: 89083 - protein, 14 aa, Borrelia Burgdorferi
SSGLRKVGDSVKAA

SEQ ID NO: 89084 - protein, 14 aa, Borrelia Burgdorferi
SGLRKVGDSVKAAS

SEQ ID NO: 89085 - protein, 14 aa, Borrelia Burgdorferi
GLRKVGDSVKAASK

SEQ ID NO: 89086 - protein, 14 aa, Borrelia Burgdorferi
LRKVGDSVKAASKE

SEQ ID NO: 89087 - protein, 14 aa, Borrelia Burgdorferi
RKVGDSVKAASKET

SEQ ID NO: 89088 - protein, 14 aa, Borrelia Burgdorferi
KVGDSVKAASKETP

SEQ ID NO: 89089 - protein, 14 aa, Borrelia Burgdorferi
VGDSVKAASKETPP

SEQ ID NO: 89090 - protein, 14 aa, Borrelia Burgdorferi
GDSVKAASKETPPA

SEQ ID NO: 89091 - protein, 14 aa, Borrelia Burgdorferi
DSVKAASKETPPAL

SEQ ID NO: 89092 - protein, 14 aa, Borrelia Burgdorferi
SVKAASKETPPALN

SEQ ID NO: 89093 - protein, 14 aa, Borrelia Burgdorferi
VKAASKETPPALNK

SEQ ID NO: 89094 - protein, 15 aa, Borrelia Burgdorferi
MRGSHHHHHHGSSQV

SEQ ID NO: 89095 - protein, 15 aa, Borrelia Burgdorferi
RGSHHHHHHGSSQVA

SEQ ID NO: 89096 - protein, 15 aa, Borrelia Burgdorferi
GSHHHHHHGSSQVAD

SEQ ID NO: 89097 - protein, 15 aa, Borrelia Burgdorferi
SHHHHHHGSSQVADK

SEQ ID NO: 89098 - protein, 15 aa, Borrelia Burgdorferi
HHHHHHGSSQVADKD

SEQ ID NO: 89099 - protein, 15 aa, Borrelia Burgdorferi
HHHHHGSSQVADKDD

SEQ ID NO: 89100 - protein, 15 aa, Borrelia Burgdorferi
HHHHGSSQVADKDDP

SEQ ID NO: 89101 - protein, 15 aa, Borrelia Burgdorferi
HHHGSSQVADKDDPT

SEQ ID NO: 89102 - protein, 15 aa, Borrelia Burgdorferi
HHGSSQVADKDDPTN

SEQ ID NO: 89103 - protein, 15 aa, Borrelia Burgdorferi
HGSSQVADKDDPTNK

SEQ ID NO: 89104 - protein, 15 aa, Borrelia Burgdorferi
GSSQVADKDDPTNKF

SEQ ID NO: 89105 - protein, 15 aa, Borrelia Burgdorferi
SSQVADKDDPTNKFY

SEQ ID NO: 89106 - protein, 15 aa, Borrelia Burgdorferi
SQVADKDDPTNKFYQ

SEQ ID NO: 89107 - protein, 15 aa, Borrelia Burgdorferi
QVADKDDPTNKFYQS

SEQ ID NO: 89108 - protein, 15 aa, Borrelia Burgdorferi
VADKDDPTNKFYQSV

SEQ ID NO: 89109 - protein, 15 aa, Borrelia Burgdorferi
ADKDDPTNKFYQSVI

SEQ ID NO: 89110 - protein, 15 aa, Borrelia Burgdorferi
DKDDPTNKFYQSVIQ

SEQ ID NO: 89111 - protein, 15 aa, Borrelia Burgdorferi
KDDPTNKFYQSVIQL

SEQ ID NO: 89112 - protein, 15 aa, Borrelia Burgdorferi
DDPTNKFYQSVIQLG

SEQ ID NO: 89113 - protein, 15 aa, Borrelia Burgdorferi
DPTNKFYQSVIQLGN

SEQ ID NO: 89114 - protein, 15 aa, Borrelia Burgdorferi
PTNKFYQSVIQLGNG

SEQ ID NO: 89115 - protein, 15 aa, Borrelia Burgdorferi
TNKFYQSVIQLGNGF

SEQ ID NO: 89116 - protein, 15 aa, Borrelia Burgdorferi
NKFYQSVIQLGNGFL

SEQ ID NO: 89117 - protein, 15 aa, Borrelia Burgdorferi
KFYQSVIQLGNGFLD

SEQ ID NO: 89118 - protein, 15 aa, Borrelia Burgdorferi
FYQSVIQLGNGFLDV

SEQ ID NO: 89119 - protein, 15 aa, Borrelia Burgdorferi
YQSVIQLGNGFLDVF

SEQ ID NO: 89120 - protein, 15 aa, Borrelia Burgdorferi
QSVIQLGNGFLDVFT

SEQ ID NO: 89121 - protein, 15 aa, Borrelia Burgdorferi
SVIQLGNGFLDVFTS

SEQ ID NO: 89122 - protein, 15 aa, Borrelia Burgdorferi
VIQLGNGFLDVFTSF

SEQ ID NO: 89123 - protein, 15 aa, Borrelia Burgdorferi
IQLGNGFLDVFTSFG

SEQ ID NO: 89124 - protein, 15 aa, Borrelia Burgdorferi
QLGNGFLDVFTSFGG

SEQ ID NO: 89125 - protein, 15 aa, Borrelia Burgdorferi
LGNGFLDVFTSFGGL

SEQ ID NO: 89126 - protein, 15 aa, Borrelia Burgdorferi
GNGFLDVFTSFGGLV

SEQ ID NO: 89127 - protein, 15 aa, Borrelia Burgdorferi
NGFLDVFTSFGGLVA

SEQ ID NO: 89128 - protein, 15 aa, Borrelia Burgdorferi
GFLDVFTSFGGLVAE

SEQ ID NO: 89129 - protein, 15 aa, Borrelia Burgdorferi
FLDVFTSFGGLVAEA

SEQ ID NO: 89130 - protein, 15 aa, Borrelia Burgdorferi
LDVFTSFGGLVAEAF

SEQ ID NO: 89131 - protein, 15 aa, Borrelia Burgdorferi
DVFTSFGGLVAEAFG

SEQ ID NO: 89132 - protein, 15 aa, Borrelia Burgdorferi
VFTSFGGLVAEAFGF

SEQ ID NO: 89133 - protein, 15 aa, Borrelia Burgdorferi
FTSFGGLVAEAFGFK

SEQ ID NO: 89134 - protein, 15 aa, Borrelia Burgdorferi
TSFGGLVAEAFGFKS

SEQ ID NO: 89135 - protein, 15 aa, Borrelia Burgdorferi
SFGGLVAEAFGFKSD

SEQ ID NO: 89136 - protein, 15 aa, Borrelia Burgdorferi
FGGLVAEAFGFKSDP

SEQ ID NO: 89137 - protein, 15 aa, Borrelia Burgdorferi
GGLVAEAFGFKSDPK

SEQ ID NO: 89138 - protein, 15 aa, Borrelia Burgdorferi
GLVAEAFGFKSDPKK

SEQ ID NO: 89139 - protein, 15 aa, Borrelia Burgdorferi
LVAEAFGFKSDPKKS

SEQ ID NO: 89140 - protein, 15 aa, Borrelia Burgdorferi
VAEAFGFKSDPKKSD

SEQ ID NO: 89141 - protein, 15 aa, Borrelia Burgdorferi
AEAFGFKSDPKKSDV

SEQ ID NO: 89142 - protein, 15 aa, Borrelia Burgdorferi
EAFGFKSDPKKSDVK

SEQ ID NO: 89143 - protein, 15 aa, Borrelia Burgdorferi
AFGFKSDPKKSDVKT

SEQ ID NO: 89144 - protein, 15 aa, Borrelia Burgdorferi
FGFKSDPKKSDVKTY

SEQ ID NO: 89145 - protein, 15 aa, Borrelia Burgdorferi
GFKSDPKKSDVKTYF

SEQ ID NO: 89146 - protein, 15 aa, Borrelia Burgdorferi
FKSDPKKSDVKTYFT

SEQ ID NO: 89147 - protein, 15 aa, Borrelia Burgdorferi
KSDPKKSDVKTYFTT

SEQ ID NO: 89148 - protein, 15 aa, Borrelia Burgdorferi
SDPKKSDVKTYFTTV

SEQ ID NO: 89149 - protein, 15 aa, Borrelia Burgdorferi
DPKKSDVKTYFTTVA

SEQ ID NO: 89150 - protein, 15 aa, Borrelia Burgdorferi
PKKSDVKTYFTTVAA

SEQ ID NO: 89151 - protein, 15 aa, Borrelia Burgdorferi
KKSDVKTYFTTVAAK

SEQ ID NO: 89152 - protein, 15 aa, Borrelia Burgdorferi
KSDVKTYFTTVAAKL

SEQ ID NO: 89153 - protein, 15 aa, Borrelia Burgdorferi
SDVKTYFTTVAAKLE

SEQ ID NO: 89154 - protein, 15 aa, Borrelia Burgdorferi
DVKTYFTTVAAKLEK

SEQ ID NO: 89155 - protein, 15 aa, Borrelia Burgdorferi
VKTYFTTVAAKLEKT

SEQ ID NO: 89156 - protein, 15 aa, Borrelia Burgdorferi
KTYFTTVAAKLEKTK

SEQ ID NO: 89157 - protein, 15 aa, Borrelia Burgdorferi
TYFTTVAAKLEKTKT

SEQ ID NO: 89158 - protein, 15 aa, Borrelia Burgdorferi
YFTTVAAKLEKTKTD

SEQ ID NO: 89159 - protein, 15 aa, Borrelia Burgdorferi
FTTVAAKLEKTKTDL

SEQ ID NO: 89160 - protein, 15 aa, Borrelia Burgdorferi
TTVAAKLEKTKTDLN

SEQ ID NO: 89161 - protein, 15 aa, Borrelia Burgdorferi
TVAAKLEKTKTDLNS

SEQ ID NO: 89162 - protein, 15 aa, Borrelia Burgdorferi
VAAKLEKTKTDLNSL

SEQ ID NO: 89163 - protein, 15 aa, Borrelia Burgdorferi
AAKLEKTKTDLNSLP

SEQ ID NO: 89164 - protein, 15 aa, Borrelia Burgdorferi
AKLEKTKTDLNSLPK

SEQ ID NO: 89165 - protein, 15 aa, Borrelia Burgdorferi
KLEKTKTDLNSLPKE

SEQ ID NO: 89166 - protein, 15 aa, Borrelia Burgdorferi
LEKTKTDLNSLPKEK

SEQ ID NO: 89167 - protein, 15 aa, Borrelia Burgdorferi
EKTKTDLNSLPKEKS

SEQ ID NO: 89168 - protein, 15 aa, Borrelia Burgdorferi
KTKTDLNSLPKEKSD

SEQ ID NO: 89169 - protein, 15 aa, Borrelia Burgdorferi
TKTDLNSLPKEKSDI

SEQ ID NO: 89170 - protein, 15 aa, Borrelia Burgdorferi
KTDLNSLPKEKSDIS

SEQ ID NO: 89171 - protein, 15 aa, Borrelia Burgdorferi
TDLNSLPKEKSDISS

SEQ ID NO: 89172 - protein, 15 aa, Borrelia Burgdorferi
DLNSLPKEKSDISST

SEQ ID NO: 89173 - protein, 15 aa, Borrelia Burgdorferi
LNSLPKEKSDISSTT

SEQ ID NO: 89174 - protein, 15 aa, Borrelia Burgdorferi
NSLPKEKSDISSTTG

SEQ ID NO: 89175 - protein, 15 aa, Borrelia Burgdorferi
SLPKEKSDISSTTGK

SEQ ID NO: 89176 - protein, 15 aa, Borrelia Burgdorferi
LPKEKSDISSTTGKP

SEQ ID NO: 89177 - protein, 15 aa, Borrelia Burgdorferi
PKEKSDISSTTGKPD

SEQ ID NO: 89178 - protein, 15 aa, Borrelia Burgdorferi
KEKSDISSTTGKPDS

SEQ ID NO: 89179 - protein, 15 aa, Borrelia Burgdorferi
EKSDISSTTGKPDST

SEQ ID NO: 89180 - protein, 15 aa, Borrelia Burgdorferi
KSDISSTTGKPDSTG

SEQ ID NO: 89181 - protein, 15 aa, Borrelia Burgdorferi
SDISSTTGKPDSTGS

SEQ ID NO: 89182 - protein, 15 aa, Borrelia Burgdorferi
DISSTTGKPDSTGSV

SEQ ID NO: 89183 - protein, 15 aa, Borrelia Burgdorferi
ISSTTGKPDSTGSVG

SEQ ID NO: 89184 - protein, 15 aa, Borrelia Burgdorferi
SSTTGKPDSTGSVGT

SEQ ID NO: 89185 - protein, 15 aa, Borrelia Burgdorferi
STTGKPDSTGSVGTA

SEQ ID NO: 89186 - protein, 15 aa, Borrelia Burgdorferi
TTGKPDSTGSVGTAV

SEQ ID NO: 89187 - protein, 15 aa, Borrelia Burgdorferi
TGKPDSTGSVGTAVE

SEQ ID NO: 89188 - protein, 15 aa, Borrelia Burgdorferi
GKPDSTGSVGTAVEG

SEQ ID NO: 89189 - protein, 15 aa, Borrelia Burgdorferi
KPDSTGSVGTAVEGA

SEQ ID NO: 89190 - protein, 15 aa, Borrelia Burgdorferi
PDSTGSVGTAVEGAI

SEQ ID NO: 89191 - protein, 15 aa, Borrelia Burgdorferi
DSTGSVGTAVEGAIK

SEQ ID NO: 89192 - protein, 15 aa, Borrelia Burgdorferi
STGSVGTAVEGAIKE

SEQ ID NO: 89193 - protein, 15 aa, Borrelia Burgdorferi
TGSVGTAVEGAIKEV

SEQ ID NO: 89194 - protein, 15 aa, Borrelia Burgdorferi
GSVGTAVEGAIKEVS

SEQ ID NO: 89195 - protein, 15 aa, Borrelia Burgdorferi
SVGTAVEGAIKEVSE

SEQ ID NO: 89196 - protein, 15 aa, Borrelia Burgdorferi
VGTAVEGAIKEVSEL

SEQ ID NO: 89197 - protein, 15 aa, Borrelia Burgdorferi
GTAVEGAIKEVSELL

SEQ ID NO: 89198 - protein, 15 aa, Borrelia Burgdorferi
TAVEGAIKEVSELLD

SEQ ID NO: 89199 - protein, 15 aa, Borrelia Burgdorferi
AVEGAIKEVSELLDK

SEQ ID NO: 89200 - protein, 15 aa, Borrelia Burgdorferi
VEGAIKEVSELLDKL

SEQ ID NO: 89201 - protein, 15 aa, Borrelia Burgdorferi
EGAIKEVSELLDKLV

SEQ ID NO: 89202 - protein, 15 aa, Borrelia Burgdorferi
GAIKEVSELLDKLVK

SEQ ID NO: 89203 - protein, 15 aa, Borrelia Burgdorferi
AIKEVSELLDKLVKA

SEQ ID NO: 89204 - protein, 15 aa, Borrelia Burgdorferi
IKEVSELLDKLVKAV

SEQ ID NO: 89205 - protein, 15 aa, Borrelia Burgdorferi
KEVSELLDKLVKAVK

SEQ ID NO: 89206 - protein, 15 aa, Borrelia Burgdorferi
EVSELLDKLVKAVKT

SEQ ID NO: 89207 - protein, 15 aa, Borrelia Burgdorferi
VSELLDKLVKAVKTA

SEQ ID NO: 89208 - protein, 15 aa, Borrelia Burgdorferi
SELLDKLVKAVKTAE

SEQ ID NO: 89209 - protein, 15 aa, Borrelia Burgdorferi
ELLDKLVKAVKTAEG

SEQ ID NO: 89210 - protein, 15 aa, Borrelia Burgdorferi
LLDKLVKAVKTAEGA

SEQ ID NO: 89211 - protein, 15 aa, Borrelia Burgdorferi
LDKLVKAVKTAEGAS

SEQ ID NO: 89212 - protein, 15 aa, Borrelia Burgdorferi
DKLVKAVKTAEGASS

SEQ ID NO: 89213 - protein, 15 aa, Borrelia Burgdorferi
KLVKAVKTAEGASSG

SEQ ID NO: 89214 - protein, 15 aa, Borrelia Burgdorferi
LVKAVKTAEGASSGT

SEQ ID NO: 89215 - protein, 15 aa, Borrelia Burgdorferi
VKAVKTAEGASSGTA

SEQ ID NO: 89216 - protein, 15 aa, Borrelia Burgdorferi
KAVKTAEGASSGTAA

SEQ ID NO: 89217 - protein, 15 aa, Borrelia Burgdorferi
AVKTAEGASSGTAAI

SEQ ID NO: 89218 - protein, 15 aa, Borrelia Burgdorferi
VKTAEGASSGTAAIG

SEQ ID NO: 89219 - protein, 15 aa, Borrelia Burgdorferi
KTAEGASSGTAAIGE

SEQ ID NO: 89220 - protein, 15 aa, Borrelia Burgdorferi
TAEGASSGTAAIGEV

SEQ ID NO: 89221 - protein, 15 aa, Borrelia Burgdorferi
AEGASSGTAAIGEVV

SEQ ID NO: 89222 - protein, 15 aa, Borrelia Burgdorferi
EGASSGTAAIGEVVA

SEQ ID NO: 89223 - protein, 15 aa, Borrelia Burgdorferi
GASSGTAAIGEVVAD

SEQ ID NO: 89224 - protein, 15 aa, Borrelia Burgdorferi
ASSGTAAIGEVVADA

SEQ ID NO: 89225 - protein, 15 aa, Borrelia Burgdorferi
SSGTAAIGEVVADAD

SEQ ID NO: 89226 - protein, 15 aa, Borrelia Burgdorferi
SGTAAIGEVVADADA

SEQ ID NO: 89227 - protein, 15 aa, Borrelia Burgdorferi
GTAAIGEVVADADAA

SEQ ID NO: 89228 - protein, 15 aa, Borrelia Burgdorferi
TAAIGEVVADADAAK

SEQ ID NO: 89229 - protein, 15 aa, Borrelia Burgdorferi
AAIGEVVADADAAKV

SEQ ID NO: 89230 - protein, 15 aa, Borrelia Burgdorferi
AIGEVVADADAAKVA

SEQ ID NO: 89231 - protein, 15 aa, Borrelia Burgdorferi
IGEVVADADAAKVAD

SEQ ID NO: 89232 - protein, 15 aa, Borrelia Burgdorferi
GEVVADADAAKVADK

SEQ ID NO: 89233 - protein, 15 aa, Borrelia Burgdorferi
EVVADADAAKVADKA

SEQ ID NO: 89234 - protein, 15 aa, Borrelia Burgdorferi
VVADADAAKVADKAS

SEQ ID NO: 89235 - protein, 15 aa, Borrelia Burgdorferi
VADADAAKVADKASV

SEQ ID NO: 89236 - protein, 15 aa, Borrelia Burgdorferi
ADADAAKVADKASVK

SEQ ID NO: 89237 - protein, 15 aa, Borrelia Burgdorferi
DADAAKVADKASVKG

SEQ ID NO: 89238 - protein, 15 aa, Borrelia Burgdorferi
ADAAKVADKASVKGI

SEQ ID NO: 89239 - protein, 15 aa, Borrelia Burgdorferi
DAAKVADKASVKGIA

SEQ ID NO: 89240 - protein, 15 aa, Borrelia Burgdorferi
AAKVADKASVKGIAK

SEQ ID NO: 89241 - protein, 15 aa, Borrelia Burgdorferi
AKVADKASVKGIAKG

SEQ ID NO: 89242 - protein, 15 aa, Borrelia Burgdorferi
KVADKASVKGIAKGI

SEQ ID NO: 89243 - protein, 15 aa, Borrelia Burgdorferi
VADKASVKGIAKGIK

SEQ ID NO: 89244 - protein, 15 aa, Borrelia Burgdorferi
ADKASVKGIAKGIKE

SEQ ID NO: 89245 - protein, 15 aa, Borrelia Burgdorferi
DKASVKGIAKGIKEI

SEQ ID NO: 89246 - protein, 15 aa, Borrelia Burgdorferi
KASVKGIAKGIKEIV

SEQ ID NO: 89247 - protein, 15 aa, Borrelia Burgdorferi
ASVKGIAKGIKEIVE

SEQ ID NO: 89248 - protein, 15 aa, Borrelia Burgdorferi
SVKGIAKGIKEIVEA

SEQ ID NO: 89249 - protein, 15 aa, Borrelia Burgdorferi
VKGIAKGIKEIVEAA

SEQ ID NO: 89250 - protein, 15 aa, Borrelia Burgdorferi
KGIAKGIKEIVEAAG

SEQ ID NO: 89251 - protein, 15 aa, Borrelia Burgdorferi
GIAKGIKEIVEAAGG

SEQ ID NO: 89252 - protein, 15 aa, Borrelia Burgdorferi
IAKGIKEIVEAAGGS

SEQ ID NO: 89253 - protein, 15 aa, Borrelia Burgdorferi
AKGIKEIVEAAGGSE

SEQ ID NO: 89254 - protein, 15 aa, Borrelia Burgdorferi
KGIKEIVEAAGGSEK

SEQ ID NO: 89255 - protein, 15 aa, Borrelia Burgdorferi
GIKEIVEAAGGSEKL

SEQ ID NO: 89256 - protein, 15 aa, Borrelia Burgdorferi
IKEIVEAAGGSEKLK

SEQ ID NO: 89257 - protein, 15 aa, Borrelia Burgdorferi
KEIVEAAGGSEKLKA

SEQ ID NO: 89258 - protein, 15 aa, Borrelia Burgdorferi
EIVEAAGGSEKLKAV

SEQ ID NO: 89259 - protein, 15 aa, Borrelia Burgdorferi
IVEAAGGSEKLKAVA

SEQ ID NO: 89260 - protein, 15 aa, Borrelia Burgdorferi
VEAAGGSEKLKAVAA

SEQ ID NO: 89261 - protein, 15 aa, Borrelia Burgdorferi
EAAGGSEKLKAVAAA

SEQ ID NO: 89262 - protein, 15 aa, Borrelia Burgdorferi
AAGGSEKLKAVAAAK

SEQ ID NO: 89263 - protein, 15 aa, Borrelia Burgdorferi
AGGSEKLKAVAAAKG

SEQ ID NO: 89264 - protein, 15 aa, Borrelia Burgdorferi
GGSEKLKAVAAAKGE

SEQ ID NO: 89265 - protein, 15 aa, Borrelia Burgdorferi
GSEKLKAVAAAKGEN

SEQ ID NO: 89266 - protein, 15 aa, Borrelia Burgdorferi
SEKLKAVAAAKGENN

SEQ ID NO: 89267 - protein, 15 aa, Borrelia Burgdorferi
EKLKAVAAAKGENNK

SEQ ID NO: 89268 - protein, 15 aa, Borrelia Burgdorferi
KLKAVAAAKGENNKG

SEQ ID NO: 89269 - protein, 15 aa, Borrelia Burgdorferi
LKAVAAAKGENNKGA

SEQ ID NO: 89270 - protein, 15 aa, Borrelia Burgdorferi
KAVAAAKGENNKGAG

SEQ ID NO: 89271 - protein, 15 aa, Borrelia Burgdorferi
AVAAAKGENNKGAGK

SEQ ID NO: 89272 - protein, 15 aa, Borrelia Burgdorferi
VAAAKGENNKGAGKL

SEQ ID NO: 89273 - protein, 15 aa, Borrelia Burgdorferi
AAAKGENNKGAGKLF

SEQ ID NO: 89274 - protein, 15 aa, Borrelia Burgdorferi
AAKGENNKGAGKLFG

SEQ ID NO: 89275 - protein, 15 aa, Borrelia Burgdorferi
AKGENNKGAGKLFGK

SEQ ID NO: 89276 - protein, 15 aa, Borrelia Burgdorferi
KGENNKGAGKLFGKA

SEQ ID NO: 89277 - protein, 15 aa, Borrelia Burgdorferi
GENNKGAGKLFGKAG

SEQ ID NO: 89278 - protein, 15 aa, Borrelia Burgdorferi
ENNKGAGKLFGKAGA

SEQ ID NO: 89279 - protein, 15 aa, Borrelia Burgdorferi
NNKGAGKLFGKAGAA

SEQ ID NO: 89280 - protein, 15 aa, Borrelia Burgdorferi
NKGAGKLFGKAGAAA

SEQ ID NO: 89281 - protein, 15 aa, Borrelia Burgdorferi
KGAGKLFGKAGAAAH

SEQ ID NO: 89282 - protein, 15 aa, Borrelia Burgdorferi
GAGKLFGKAGAAAHG

SEQ ID NO: 89283 - protein, 15 aa, Borrelia Burgdorferi
AGKLFGKAGAAAHGD

SEQ ID NO: 89284 - protein, 15 aa, Borrelia Burgdorferi
GKLFGKAGAAAHGDS

SEQ ID NO: 89285 - protein, 15 aa, Borrelia Burgdorferi
KLFGKAGAAAHGDSE

SEQ ID NO: 89286 - protein, 15 aa, Borrelia Burgdorferi
LFGKAGAAAHGDSEA

SEQ ID NO: 89287 - protein, 15 aa, Borrelia Burgdorferi
FGKAGAAAHGDSEAA

SEQ ID NO: 89288 - protein, 15 aa, Borrelia Burgdorferi
GKAGAAAHGDSEAAS

SEQ ID NO: 89289 - protein, 15 aa, Borrelia Burgdorferi
KAGAAAHGDSEAASK

SEQ ID NO: 89290 - protein, 15 aa, Borrelia Burgdorferi
AGAAAHGDSEAASKA

SEQ ID NO: 89291 - protein, 15 aa, Borrelia Burgdorferi
GAAAHGDSEAASKAA

SEQ ID NO: 89292 - protein, 15 aa, Borrelia Burgdorferi
AAAHGDSEAASKAAG

SEQ ID NO: 89293 - protein, 15 aa, Borrelia Burgdorferi
AAHGDSEAASKAAGA

SEQ ID NO: 89294 - protein, 15 aa, Borrelia Burgdorferi
AHGDSEAASKAAGAV

SEQ ID NO: 89295 - protein, 15 aa, Borrelia Burgdorferi
HGDSEAASKAAGAVS

SEQ ID NO: 89296 - protein, 15 aa, Borrelia Burgdorferi
GDSEAASKAAGAVSA

SEQ ID NO: 89297 - protein, 15 aa, Borrelia Burgdorferi
DSEAASKAAGAVSAV

SEQ ID NO: 89298 - protein, 15 aa, Borrelia Burgdorferi
SEAASKAAGAVSAVS

SEQ ID NO: 89299 - protein, 15 aa, Borrelia Burgdorferi
EAASKAAGAVSAVSG

SEQ ID NO: 89300 - protein, 15 aa, Borrelia Burgdorferi
AASKAAGAVSAVSGE

SEQ ID NO: 89301 - protein, 15 aa, Borrelia Burgdorferi
ASKAAGAVSAVSGEQ

SEQ ID NO: 89302 - protein, 15 aa, Borrelia Burgdorferi
SKAAGAVSAVSGEQI

SEQ ID NO: 89303 - protein, 15 aa, Borrelia Burgdorferi
KAAGAVSAVSGEQIL

SEQ ID NO: 89304 - protein, 15 aa, Borrelia Burgdorferi
AAGAVSAVSGEQILS

SEQ ID NO: 89305 - protein, 15 aa, Borrelia Burgdorferi
AGAVSAVSGEQILSA

SEQ ID NO: 89306 - protein, 15 aa, Borrelia Burgdorferi
GAVSAVSGEQILSAI

SEQ ID NO: 89307 - protein, 15 aa, Borrelia Burgdorferi
AVSAVSGEQILSAIV

SEQ ID NO: 89308 - protein, 15 aa, Borrelia Burgdorferi
VSAVSGEQILSAIVT

SEQ ID NO: 89309 - protein, 15 aa, Borrelia Burgdorferi
SAVSGEQILSAIVTA

SEQ ID NO: 89310 - protein, 15 aa, Borrelia Burgdorferi
AVSGEQILSAIVTAA

SEQ ID NO: 89311 - protein, 15 aa, Borrelia Burgdorferi
VSGEQILSAIVTAAD

SEQ ID NO: 89312 - protein, 15 aa, Borrelia Burgdorferi
SGEQILSAIVTAADA

SEQ ID NO: 89313 - protein, 15 aa, Borrelia Burgdorferi
GEQILSAIVTAADAA

SEQ ID NO: 89314 - protein, 15 aa, Borrelia Burgdorferi
EQILSAIVTAADAAE

SEQ ID NO: 89315 - protein, 15 aa, Borrelia Burgdorferi
QILSAIVTAADAAEQ

SEQ ID NO: 89316 - protein, 15 aa, Borrelia Burgdorferi
ILSAIVTAADAAEQD

SEQ ID NO: 89317 - protein, 15 aa, Borrelia Burgdorferi
LSAIVTAADAAEQDG

SEQ ID NO: 89318 - protein, 15 aa, Borrelia Burgdorferi
SAIVTAADAAEQDGK

SEQ ID NO: 89319 - protein, 15 aa, Borrelia Burgdorferi
AIVTAADAAEQDGKK

SEQ ID NO: 89320 - protein, 15 aa, Borrelia Burgdorferi
IVTAADAAEQDGKKP

SEQ ID NO: 89321 - protein, 15 aa, Borrelia Burgdorferi
VTAADAAEQDGKKPE

SEQ ID NO: 89322 - protein, 15 aa, Borrelia Burgdorferi
TAADAAEQDGKKPEE

SEQ ID NO: 89323 - protein, 15 aa, Borrelia Burgdorferi
AADAAEQDGKKPEEA

SEQ ID NO: 89324 - protein, 15 aa, Borrelia Burgdorferi
ADAAEQDGKKPEEAK

SEQ ID NO: 89325 - protein, 15 aa, Borrelia Burgdorferi
DAAEQDGKKPEEAKN

SEQ ID NO: 89326 - protein, 15 aa, Borrelia Burgdorferi
AAEQDGKKPEEAKNP

SEQ ID NO: 89327 - protein, 15 aa, Borrelia Burgdorferi
AEQDGKKPEEAKNPI

SEQ ID NO: 89328 - protein, 15 aa, Borrelia Burgdorferi
EQDGKKPEEAKNPIA

SEQ ID NO: 89329 - protein, 15 aa, Borrelia Burgdorferi
QDGKKPEEAKNPIAA

SEQ ID NO: 89330 - protein, 15 aa, Borrelia Burgdorferi
DGKKPEEAKNPIAAA

SEQ ID NO: 89331 - protein, 15 aa, Borrelia Burgdorferi
GKKPEEAKNPIAAAI

SEQ ID NO: 89332 - protein, 15 aa, Borrelia Burgdorferi
KKPEEAKNPIAAAIG

SEQ ID NO: 89333 - protein, 15 aa, Borrelia Burgdorferi
KPEEAKNPIAAAIGD

SEQ ID NO: 89334 - protein, 15 aa, Borrelia Burgdorferi
PEEAKNPIAAAIGDK

SEQ ID NO: 89335 - protein, 15 aa, Borrelia Burgdorferi
EEAKNPIAAAIGDKD

SEQ ID NO: 89336 - protein, 15 aa, Borrelia Burgdorferi
EAKNPIAAAIGDKDG

SEQ ID NO: 89337 - protein, 15 aa, Borrelia Burgdorferi
AKNPIAAAIGDKDGG

SEQ ID NO: 89338 - protein, 15 aa, Borrelia Burgdorferi
KNPIAAAIGDKDGGA

SEQ ID NO: 89339 - protein, 15 aa, Borrelia Burgdorferi
NPIAAAIGDKDGGAE

SEQ ID NO: 89340 - protein, 15 aa, Borrelia Burgdorferi
PIAAAIGDKDGGAEF

SEQ ID NO: 89341 - protein, 15 aa, Borrelia Burgdorferi
IAAAIGDKDGGAEFG

SEQ ID NO: 89342 - protein, 15 aa, Borrelia Burgdorferi
AAAIGDKDGGAEFGQ

SEQ ID NO: 89343 - protein, 15 aa, Borrelia Burgdorferi
AAIGDKDGGAEFGQD

SEQ ID NO: 89344 - protein, 15 aa, Borrelia Burgdorferi
AIGDKDGGAEFGQDE

SEQ ID NO: 89345 - protein, 15 aa, Borrelia Burgdorferi
  Xaa can be any naturally occurring amino acid
  VARIANT 15: Xaa = Any Amino Acid
IGDKDGGAEFGQDEX

SEQ ID NO: 89346 - protein, 15 aa, Borrelia Burgdorferi
  Xaa can be any naturally occurring amino acid
  VARIANT 14: Xaa = Any Amino Acid
GDKDGGAEFGQDEXK

SEQ ID NO: 89347 - protein, 15 aa, Borrelia Burgdorferi
  Xaa can be any naturally occurring amino acid
  VARIANT 13: Xaa = Any Amino Acid
DKDGGAEFGQDEXKK

SEQ ID NO: 89348 - protein, 15 aa, Borrelia Burgdorferi
  Xaa can be any naturally occurring amino acid
  VARIANT 12: Xaa = Any Amino Acid
KDGGAEFGQDEXKKD

SEQ ID NO: 89349 - protein, 15 aa, Borrelia Burgdorferi
  Xaa can be any naturally occurring amino acid
  VARIANT 11: Xaa = Any Amino Acid
DGGAEFGQDEXKKDD

SEQ ID NO: 89350 - protein, 15 aa, Borrelia Burgdorferi
  Xaa can be any naturally occurring amino acid
  VARIANT 10: Xaa = Any Amino Acid
GGAEFGQDEXKKDDQ

SEQ ID NO: 89351 - protein, 15 aa, Borrelia Burgdorferi
  Xaa can be any naturally occurring amino acid
  VARIANT 9: Xaa = Any Amino Acid
GAEFGQDEXKKDDQI

SEQ ID NO: 89352 - protein, 15 aa, Borrelia Burgdorferi
  Xaa can be any naturally occurring amino acid
  VARIANT 8: Xaa = Any Amino Acid
AEFGQDEXKKDDQIA

SEQ ID NO: 89353 - protein, 15 aa, Borrelia Burgdorferi
  Xaa can be any naturally occurring amino acid
  VARIANT 7: Xaa = Any Amino Acid
EFGQDEXKKDDQIAA

SEQ ID NO: 89354 - protein, 15 aa, Borrelia Burgdorferi
  Xaa can be any naturally occurring amino acid
  VARIANT 6: Xaa = Any Amino Acid
FGQDEXKKDDQIAAA

SEQ ID NO: 89355 - protein, 15 aa, Borrelia Burgdorferi
  Xaa can be any naturally occurring amino acid
  VARIANT 5: Xaa = Any Amino Acid
GQDEXKKDDQIAAAI

SEQ ID NO: 89356 - protein, 15 aa, Borrelia Burgdorferi
  Xaa can be any naturally occurring amino acid
  VARIANT 4: Xaa = Any Amino Acid
QDEXKKDDQIAAAIA

SEQ ID NO: 89357 - protein, 15 aa, Borrelia Burgdorferi
  Xaa can be any naturally occurring amino acid
  VARIANT 3: Xaa = Any Amino Acid
DEXKKDDQIAAAIAL

SEQ ID NO: 89358 - protein, 15 aa, Borrelia Burgdorferi
  Xaa can be any naturally occurring amino acid
  VARIANT 2: Xaa = Any Amino Acid
EXKKDDQIAAAIALR

SEQ ID NO: 89359 - protein, 15 aa, Borrelia Burgdorferi
  Xaa can be any naturally occurring amino acid
  VARIANT 1: Xaa = Any Amino Acid
XKKDDQIAAAIALRG

SEQ ID NO: 89360 - protein, 15 aa, Borrelia Burgdorferi
  Xaa can be any naturally occurring amino acid
  VARIANT 15: Xaa = Any Amino Acid
KKDDQIAAAIALRGX

SEQ ID NO: 89361 - protein, 15 aa, Borrelia Burgdorferi
  Xaa can be any naturally occurring amino acid
  VARIANT 14: Xaa = Any Amino Acid
KDDQIAAAIALRGXA

SEQ ID NO: 89362 - protein, 15 aa, Borrelia Burgdorferi
  Xaa can be any naturally occurring amino acid
  VARIANT 13: Xaa = Any Amino Acid
DDQIAAAIALRGXAK

SEQ ID NO: 89363 - protein, 15 aa, Borrelia Burgdorferi
  Xaa can be any naturally occurring amino acid
  VARIANT 12: Xaa = Any Amino Acid
DQIAAAIALRGXAKD

SEQ ID NO: 89364 - protein, 15 aa, Borrelia Burgdorferi
  Xaa can be any naturally occurring amino acid
  VARIANT 11: Xaa = Any Amino Acid
QIAAAIALRGXAKDG

SEQ ID NO: 89365 - protein, 15 aa, Borrelia Burgdorferi
  Xaa can be any naturally occurring amino acid
  VARIANT 10: Xaa = Any Amino Acid
IAAAIALRGXAKDGK

SEQ ID NO: 89366 - protein, 15 aa, Borrelia Burgdorferi
  Xaa can be any naturally occurring amino acid
  VARIANT 9: Xaa = Any Amino Acid
AAAIALRGXAKDGKF

SEQ ID NO: 89367 - protein, 15 aa, Borrelia Burgdorferi
  Xaa can be any naturally occurring amino acid
  VARIANT 8: Xaa = Any Amino Acid
AAIALRGXAKDGKFA

SEQ ID NO: 89368 - protein, 15 aa, Borrelia Burgdorferi
  Xaa can be any naturally occurring amino acid
  VARIANT 7: Xaa = Any Amino Acid
AIALRGXAKDGKFAV

SEQ ID NO: 89369 - protein, 15 aa, Borrelia Burgdorferi
  Xaa can be any naturally occurring amino acid
  VARIANT 6: Xaa = Any Amino Acid
IALRGXAKDGKFAVK

SEQ ID NO: 89370 - protein, 15 aa, Borrelia Burgdorferi
  Xaa can be any naturally occurring amino acid
  VARIANT 5: Xaa = Any Amino Acid
ALRGXAKDGKFAVKD

SEQ ID NO: 89371 - protein, 15 aa, Borrelia Burgdorferi
  Xaa can be any naturally occurring amino acid
  VARIANT 4: Xaa = Any Amino Acid
LRGXAKDGKFAVKDG

SEQ ID NO: 89372 - protein, 15 aa, Borrelia Burgdorferi
  Xaa can be any naturally occurring amino acid
  VARIANT 3: Xaa = Any Amino Acid
RGXAKDGKFAVKDGE

SEQ ID NO: 89373 - protein, 15 aa, Borrelia Burgdorferi
  Xaa can be any naturally occurring amino acid
  VARIANT 2: Xaa = Any Amino Acid
GXAKDGKFAVKDGEK

SEQ ID NO: 89374 - protein, 15 aa, Borrelia Burgdorferi
  Xaa can be any naturally occurring amino acid
  VARIANT 1: Xaa = Any Amino Acid
XAKDGKFAVKDGEKE

SEQ ID NO: 89375 - protein, 15 aa, Borrelia Burgdorferi
AKDGKFAVKDGEKEK

SEQ ID NO: 89376 - protein, 15 aa, Borrelia Burgdorferi
KDGKFAVKDGEKEKA

SEQ ID NO: 89377 - protein, 15 aa, Borrelia Burgdorferi
DGKFAVKDGEKEKAE

SEQ ID NO: 89378 - protein, 15 aa, Borrelia Burgdorferi
GKFAVKDGEKEKAEG

SEQ ID NO: 89379 - protein, 15 aa, Borrelia Burgdorferi
KFAVKDGEKEKAEGA

SEQ ID NO: 89380 - protein, 15 aa, Borrelia Burgdorferi
FAVKDGEKEKAEGAI

SEQ ID NO: 89381 - protein, 15 aa, Borrelia Burgdorferi
AVKDGEKEKAEGAIK

SEQ ID NO: 89382 - protein, 15 aa, Borrelia Burgdorferi
VKDGEKEKAEGAIKG

SEQ ID NO: 89383 - protein, 15 aa, Borrelia Burgdorferi
KDGEKEKAEGAIKGA

SEQ ID NO: 89384 - protein, 15 aa, Borrelia Burgdorferi
DGEKEKAEGAIKGAA

SEQ ID NO: 89385 - protein, 15 aa, Borrelia Burgdorferi
GEKEKAEGAIKGAAE

SEQ ID NO: 89386 - protein, 15 aa, Borrelia Burgdorferi
EKEKAEGAIKGAAES

SEQ ID NO: 89387 - protein, 15 aa, Borrelia Burgdorferi
KEKAEGAIKGAAESA

SEQ ID NO: 89388 - protein, 15 aa, Borrelia Burgdorferi
EKAEGAIKGAAESAV

SEQ ID NO: 89389 - protein, 15 aa, Borrelia Burgdorferi
KAEGAIKGAAESAVR

SEQ ID NO: 89390 - protein, 15 aa, Borrelia Burgdorferi
AEGAIKGAAESAVRK

SEQ ID NO: 89391 - protein, 15 aa, Borrelia Burgdorferi
EGAIKGAAESAVRKV

SEQ ID NO: 89392 - protein, 15 aa, Borrelia Burgdorferi
GAIKGAAESAVRKVL

SEQ ID NO: 89393 - protein, 15 aa, Borrelia Burgdorferi
AIKGAAESAVRKVLG

SEQ ID NO: 89394 - protein, 15 aa, Borrelia Burgdorferi
IKGAAESAVRKVLGA

SEQ ID NO: 89395 - protein, 15 aa, Borrelia Burgdorferi
KGAAESAVRKVLGAI

SEQ ID NO: 89396 - protein, 15 aa, Borrelia Burgdorferi
GAAESAVRKVLGAIT

SEQ ID NO: 89397 - protein, 15 aa, Borrelia Burgdorferi
AAESAVRKVLGAITG

SEQ ID NO: 89398 - protein, 15 aa, Borrelia Burgdorferi
AESAVRKVLGAITGL

SEQ ID NO: 89399 - protein, 15 aa, Borrelia Burgdorferi
ESAVRKVLGAITGLI

SEQ ID NO: 89400 - protein, 15 aa, Borrelia Burgdorferi
SAVRKVLGAITGLIG

SEQ ID NO: 89401 - protein, 15 aa, Borrelia Burgdorferi
AVRKVLGAITGLIGD

SEQ ID NO: 89402 - protein, 15 aa, Borrelia Burgdorferi
VRKVLGAITGLIGDA

SEQ ID NO: 89403 - protein, 15 aa, Borrelia Burgdorferi
RKVLGAITGLIGDAV

SEQ ID NO: 89404 - protein, 15 aa, Borrelia Burgdorferi
KVLGAITGLIGDAVS

SEQ ID NO: 89405 - protein, 15 aa, Borrelia Burgdorferi
VLGAITGLIGDAVSS

SEQ ID NO: 89406 - protein, 15 aa, Borrelia Burgdorferi
LGAITGLIGDAVSSG

SEQ ID NO: 89407 - protein, 15 aa, Borrelia Burgdorferi
GAITGLIGDAVSSGL

SEQ ID NO: 89408 - protein, 15 aa, Borrelia Burgdorferi
AITGLIGDAVSSGLR

SEQ ID NO: 89409 - protein, 15 aa, Borrelia Burgdorferi
ITGLIGDAVSSGLRK

SEQ ID NO: 89410 - protein, 15 aa, Borrelia Burgdorferi
TGLIGDAVSSGLRKV

SEQ ID NO: 89411 - protein, 15 aa, Borrelia Burgdorferi
GLIGDAVSSGLRKVG

SEQ ID NO: 89412 - protein, 15 aa, Borrelia Burgdorferi
LIGDAVSSGLRKVGD

SEQ ID NO: 89413 - protein, 15 aa, Borrelia Burgdorferi
IGDAVSSGLRKVGDS

SEQ ID NO: 89414 - protein, 15 aa, Borrelia Burgdorferi
GDAVSSGLRKVGDSV

SEQ ID NO: 89415 - protein, 15 aa, Borrelia Burgdorferi
DAVSSGLRKVGDSVK

SEQ ID NO: 89416 - protein, 15 aa, Borrelia Burgdorferi
AVSSGLRKVGDSVKA

SEQ ID NO: 89417 - protein, 15 aa, Borrelia Burgdorferi
VSSGLRKVGDSVKAA

SEQ ID NO: 89418 - protein, 15 aa, Borrelia Burgdorferi
SSGLRKVGDSVKAAS

SEQ ID NO: 89419 - protein, 15 aa, Borrelia Burgdorferi
SGLRKVGDSVKAASK

SEQ ID NO: 89420 - protein, 15 aa, Borrelia Burgdorferi
GLRKVGDSVKAASKE

SEQ ID NO: 89421 - protein, 15 aa, Borrelia Burgdorferi
LRKVGDSVKAASKET

SEQ ID NO: 89422 - protein, 15 aa, Borrelia Burgdorferi
RKVGDSVKAASKETP

SEQ ID NO: 89423 - protein, 15 aa, Borrelia Burgdorferi
KVGDSVKAASKETPP

SEQ ID NO: 89424 - protein, 15 aa, Borrelia Burgdorferi
VGDSVKAASKETPPA

SEQ ID NO: 89425 - protein, 15 aa, Borrelia Burgdorferi
GDSVKAASKETPPAL

SEQ ID NO: 89426 - protein, 15 aa, Borrelia Burgdorferi
DSVKAASKETPPALN

SEQ ID NO: 89427 - protein, 15 aa, Borrelia Burgdorferi
SVKAASKETPPALNK

SEQ ID NO: 89428 - protein, 16 aa, Borrelia Burgdorferi
MRGSHHHHHHGSSQVA

SEQ ID NO: 89429 - protein, 16 aa, Borrelia Burgdorferi
RGSHHHHHHGSSQVAD

SEQ ID NO: 89430 - protein, 16 aa, Borrelia Burgdorferi
GSHHHHHHGSSQVADK

SEQ ID NO: 89431 - protein, 16 aa, Borrelia Burgdorferi
SHHHHHHGSSQVADKD

SEQ ID NO: 89432 - protein, 16 aa, Borrelia Burgdorferi
HHHHHHGSSQVADKDD

SEQ ID NO: 89433 - protein, 16 aa, Borrelia Burgdorferi
HHHHHGSSQVADKDDP

SEQ ID NO: 89434 - protein, 16 aa, Borrelia Burgdorferi
HHHHGSSQVADKDDPT

SEQ ID NO: 89435 - protein, 16 aa, Borrelia Burgdorferi
HHHGSSQVADKDDPTN

SEQ ID NO: 89436 - protein, 16 aa, Borrelia Burgdorferi
HHGSSQVADKDDPTNK

SEQ ID NO: 89437 - protein, 16 aa, Borrelia Burgdorferi
HGSSQVADKDDPTNKF

SEQ ID NO: 89438 - protein, 16 aa, Borrelia Burgdorferi
GSSQVADKDDPTNKFY

SEQ ID NO: 89439 - protein, 16 aa, Borrelia Burgdorferi
SSQVADKDDPTNKFYQ

SEQ ID NO: 89440 - protein, 16 aa, Borrelia Burgdorferi
SQVADKDDPTNKFYQS

SEQ ID NO: 89441 - protein, 16 aa, Borrelia Burgdorferi
QVADKDDPTNKFYQSV

SEQ ID NO: 89442 - protein, 16 aa, Borrelia Burgdorferi
VADKDDPTNKFYQSVI

SEQ ID NO: 89443 - protein, 16 aa, Borrelia Burgdorferi
ADKDDPTNKFYQSVIQ

SEQ ID NO: 89444 - protein, 16 aa, Borrelia Burgdorferi
DKDDPTNKFYQSVIQL

SEQ ID NO: 89445 - protein, 16 aa, Borrelia Burgdorferi
KDDPTNKFYQSVIQLG

SEQ ID NO: 89446 - protein, 16 aa, Borrelia Burgdorferi
DDPTNKFYQSVIQLGN

SEQ ID NO: 89447 - protein, 16 aa, Borrelia Burgdorferi
DPTNKFYQSVIQLGNG

SEQ ID NO: 89448 - protein, 16 aa, Borrelia Burgdorferi
PTNKFYQSVIQLGNGF

SEQ ID NO: 89449 - protein, 16 aa, Borrelia Burgdorferi
TNKFYQSVIQLGNGFL

SEQ ID NO: 89450 - protein, 16 aa, Borrelia Burgdorferi
NKFYQSVIQLGNGFLD

SEQ ID NO: 89451 - protein, 16 aa, Borrelia Burgdorferi
KFYQSVIQLGNGFLDV

SEQ ID NO: 89452 - protein, 16 aa, Borrelia Burgdorferi
FYQSVIQLGNGFLDVF

SEQ ID NO: 89453 - protein, 16 aa, Borrelia Burgdorferi
YQSVIQLGNGFLDVFT

SEQ ID NO: 89454 - protein, 16 aa, Borrelia Burgdorferi
QSVIQLGNGFLDVFTS

SEQ ID NO: 89455 - protein, 16 aa, Borrelia Burgdorferi
SVIQLGNGFLDVFTSF

SEQ ID NO: 89456 - protein, 16 aa, Borrelia Burgdorferi
VIQLGNGFLDVFTSFG

SEQ ID NO: 89457 - protein, 16 aa, Borrelia Burgdorferi
IQLGNGFLDVFTSFGG

SEQ ID NO: 89458 - protein, 16 aa, Borrelia Burgdorferi
QLGNGFLDVFTSFGGL

SEQ ID NO: 89459 - protein, 16 aa, Borrelia Burgdorferi
LGNGFLDVFTSFGGLV

SEQ ID NO: 89460 - protein, 16 aa, Borrelia Burgdorferi
GNGFLDVFTSFGGLVA

SEQ ID NO: 89461 - protein, 16 aa, Borrelia Burgdorferi
NGFLDVFTSFGGLVAE

SEQ ID NO: 89462 - protein, 16 aa, Borrelia Burgdorferi
GFLDVFTSFGGLVAEA

SEQ ID NO: 89463 - protein, 16 aa, Borrelia Burgdorferi
FLDVFTSFGGLVAEAF

SEQ ID NO: 89464 - protein, 16 aa, Borrelia Burgdorferi
LDVFTSFGGLVAEAFG

SEQ ID NO: 89465 - protein, 16 aa, Borrelia Burgdorferi
DVFTSFGGLVAEAFGF

SEQ ID NO: 89466 - protein, 16 aa, Borrelia Burgdorferi
VFTSFGGLVAEAFGFK

SEQ ID NO: 89467 - protein, 16 aa, Borrelia Burgdorferi
FTSFGGLVAEAFGFKS

SEQ ID NO: 89468 - protein, 16 aa, Borrelia Burgdorferi
TSFGGLVAEAFGFKSD

SEQ ID NO: 89469 - protein, 16 aa, Borrelia Burgdorferi
SFGGLVAEAFGFKSDP

SEQ ID NO: 89470 - protein, 16 aa, Borrelia Burgdorferi
FGGLVAEAFGFKSDPK

SEQ ID NO: 89471 - protein, 16 aa, Borrelia Burgdorferi
GGLVAEAFGFKSDPKK

SEQ ID NO: 89472 - protein, 16 aa, Borrelia Burgdorferi
GLVAEAFGFKSDPKKS

SEQ ID NO: 89473 - protein, 16 aa, Borrelia Burgdorferi
LVAEAFGFKSDPKKSD

SEQ ID NO: 89474 - protein, 16 aa, Borrelia Burgdorferi
VAEAFGFKSDPKKSDV

SEQ ID NO: 89475 - protein, 16 aa, Borrelia Burgdorferi
AEAFGFKSDPKKSDVK

SEQ ID NO: 89476 - protein, 16 aa, Borrelia Burgdorferi
EAFGFKSDPKKSDVKT

SEQ ID NO: 89477 - protein, 16 aa, Borrelia Burgdorferi
AFGFKSDPKKSDVKTY

SEQ ID NO: 89478 - protein, 16 aa, Borrelia Burgdorferi
FGFKSDPKKSDVKTYF

SEQ ID NO: 89479 - protein, 16 aa, Borrelia Burgdorferi
GFKSDPKKSDVKTYFT

SEQ ID NO: 89480 - protein, 16 aa, Borrelia Burgdorferi
FKSDPKKSDVKTYFTT

SEQ ID NO: 89481 - protein, 16 aa, Borrelia Burgdorferi
KSDPKKSDVKTYFTTV

SEQ ID NO: 89482 - protein, 16 aa, Borrelia Burgdorferi
SDPKKSDVKTYFTTVA

SEQ ID NO: 89483 - protein, 16 aa, Borrelia Burgdorferi
DPKKSDVKTYFTTVAA

SEQ ID NO: 89484 - protein, 16 aa, Borrelia Burgdorferi
PKKSDVKTYFTTVAAK

SEQ ID NO: 89485 - protein, 16 aa, Borrelia Burgdorferi
KKSDVKTYFTTVAAKL

SEQ ID NO: 89486 - protein, 16 aa, Borrelia Burgdorferi
KSDVKTYFTTVAAKLE

SEQ ID NO: 89487 - protein, 16 aa, Borrelia Burgdorferi
SDVKTYFTTVAAKLEK

SEQ ID NO: 89488 - protein, 16 aa, Borrelia Burgdorferi
DVKTYFTTVAAKLEKT

SEQ ID NO: 89489 - protein, 16 aa, Borrelia Burgdorferi
VKTYFTTVAAKLEKTK

SEQ ID NO: 89490 - protein, 16 aa, Borrelia Burgdorferi
KTYFTTVAAKLEKTKT

SEQ ID NO: 89491 - protein, 16 aa, Borrelia Burgdorferi
TYFTTVAAKLEKTKTD

SEQ ID NO: 89492 - protein, 16 aa, Borrelia Burgdorferi
YFTTVAAKLEKTKTDL

SEQ ID NO: 89493 - protein, 16 aa, Borrelia Burgdorferi
FTTVAAKLEKTKTDLN

SEQ ID NO: 89494 - protein, 16 aa, Borrelia Burgdorferi
TTVAAKLEKTKTDLNS

SEQ ID NO: 89495 - protein, 16 aa, Borrelia Burgdorferi
TVAAKLEKTKTDLNSL

SEQ ID NO: 89496 - protein, 16 aa, Borrelia Burgdorferi
VAAKLEKTKTDLNSLP

SEQ ID NO: 89497 - protein, 16 aa, Borrelia Burgdorferi
AAKLEKTKTDLNSLPK

SEQ ID NO: 89498 - protein, 16 aa, Borrelia Burgdorferi
AKLEKTKTDLNSLPKE

SEQ ID NO: 89499 - protein, 16 aa, Borrelia Burgdorferi
KLEKTKTDLNSLPKEK

SEQ ID NO: 89500 - protein, 16 aa, Borrelia Burgdorferi
LEKTKTDLNSLPKEKS

SEQ ID NO: 89501 - protein, 16 aa, Borrelia Burgdorferi
EKTKTDLNSLPKEKSD

SEQ ID NO: 89502 - protein, 16 aa, Borrelia Burgdorferi
KTKTDLNSLPKEKSDI

SEQ ID NO: 89503 - protein, 16 aa, Borrelia Burgdorferi
TKTDLNSLPKEKSDIS

SEQ ID NO: 89504 - protein, 16 aa, Borrelia Burgdorferi
KTDLNSLPKEKSDISS

SEQ ID NO: 89505 - protein, 16 aa, Borrelia Burgdorferi
TDLNSLPKEKSDISST

SEQ ID NO: 89506 - protein, 16 aa, Borrelia Burgdorferi
DLNSLPKEKSDISSTT

SEQ ID NO: 89507 - protein, 16 aa, Borrelia Burgdorferi
LNSLPKEKSDISSTTG

SEQ ID NO: 89508 - protein, 16 aa, Borrelia Burgdorferi
NSLPKEKSDISSTTGK

SEQ ID NO: 89509 - protein, 16 aa, Borrelia Burgdorferi
SLPKEKSDISSTTGKP

SEQ ID NO: 89510 - protein, 16 aa, Borrelia Burgdorferi
LPKEKSDISSTTGKPD

SEQ ID NO: 89511 - protein, 16 aa, Borrelia Burgdorferi
PKEKSDISSTTGKPDS

SEQ ID NO: 89512 - protein, 16 aa, Borrelia Burgdorferi
KEKSDISSTTGKPDST

SEQ ID NO: 89513 - protein, 16 aa, Borrelia Burgdorferi
EKSDISSTTGKPDSTG

SEQ ID NO: 89514 - protein, 16 aa, Borrelia Burgdorferi
KSDISSTTGKPDSTGS

SEQ ID NO: 89515 - protein, 16 aa, Borrelia Burgdorferi
SDISSTTGKPDSTGSV

SEQ ID NO: 89516 - protein, 16 aa, Borrelia Burgdorferi
DISSTTGKPDSTGSVG

SEQ ID NO: 89517 - protein, 16 aa, Borrelia Burgdorferi
ISSTTGKPDSTGSVGT

SEQ ID NO: 89518 - protein, 16 aa, Borrelia Burgdorferi
SSTTGKPDSTGSVGTA

SEQ ID NO: 89519 - protein, 16 aa, Borrelia Burgdorferi
STTGKPDSTGSVGTAV

SEQ ID NO: 89520 - protein, 16 aa, Borrelia Burgdorferi
TTGKPDSTGSVGTAVE

SEQ ID NO: 89521 - protein, 16 aa, Borrelia Burgdorferi
TGKPDSTGSVGTAVEG

SEQ ID NO: 89522 - protein, 16 aa, Borrelia Burgdorferi
GKPDSTGSVGTAVEGA

SEQ ID NO: 89523 - protein, 16 aa, Borrelia Burgdorferi
KPDSTGSVGTAVEGAI

SEQ ID NO: 89524 - protein, 16 aa, Borrelia Burgdorferi
PDSTGSVGTAVEGAIK

SEQ ID NO: 89525 - protein, 16 aa, Borrelia Burgdorferi
DSTGSVGTAVEGAIKE

SEQ ID NO: 89526 - protein, 16 aa, Borrelia Burgdorferi
STGSVGTAVEGAIKEV

SEQ ID NO: 89527 - protein, 16 aa, Borrelia Burgdorferi
TGSVGTAVEGAIKEVS

SEQ ID NO: 89528 - protein, 16 aa, Borrelia Burgdorferi
GSVGTAVEGAIKEVSE

SEQ ID NO: 89529 - protein, 16 aa, Borrelia Burgdorferi
SVGTAVEGAIKEVSEL

SEQ ID NO: 89530 - protein, 16 aa, Borrelia Burgdorferi
VGTAVEGAIKEVSELL

SEQ ID NO: 89531 - protein, 16 aa, Borrelia Burgdorferi
GTAVEGAIKEVSELLD

SEQ ID NO: 89532 - protein, 16 aa, Borrelia Burgdorferi
TAVEGAIKEVSELLDK

SEQ ID NO: 89533 - protein, 16 aa, Borrelia Burgdorferi
AVEGAIKEVSELLDKL

SEQ ID NO: 89534 - protein, 16 aa, Borrelia Burgdorferi
VEGAIKEVSELLDKLV

SEQ ID NO: 89535 - protein, 16 aa, Borrelia Burgdorferi
EGAIKEVSELLDKLVK

SEQ ID NO: 89536 - protein, 16 aa, Borrelia Burgdorferi
GAIKEVSELLDKLVKA

SEQ ID NO: 89537 - protein, 16 aa, Borrelia Burgdorferi
AIKEVSELLDKLVKAV

SEQ ID NO: 89538 - protein, 16 aa, Borrelia Burgdorferi
IKEVSELLDKLVKAVK

SEQ ID NO: 89539 - protein, 16 aa, Borrelia Burgdorferi
KEVSELLDKLVKAVKT

SEQ ID NO: 89540 - protein, 16 aa, Borrelia Burgdorferi
EVSELLDKLVKAVKTA

SEQ ID NO: 89541 - protein, 16 aa, Borrelia Burgdorferi
VSELLDKLVKAVKTAE

SEQ ID NO: 89542 - protein, 16 aa, Borrelia Burgdorferi
SELLDKLVKAVKTAEG

SEQ ID NO: 89543 - protein, 16 aa, Borrelia Burgdorferi
ELLDKLVKAVKTAEGA

SEQ ID NO: 89544 - protein, 16 aa, Borrelia Burgdorferi
LLDKLVKAVKTAEGAS

SEQ ID NO: 89545 - protein, 16 aa, Borrelia Burgdorferi
LDKLVKAVKTAEGASS

SEQ ID NO: 89546 - protein, 16 aa, Borrelia Burgdorferi
DKLVKAVKTAEGASSG

SEQ ID NO: 89547 - protein, 16 aa, Borrelia Burgdorferi
KLVKAVKTAEGASSGT

SEQ ID NO: 89548 - protein, 16 aa, Borrelia Burgdorferi
LVKAVKTAEGASSGTA

SEQ ID NO: 89549 - protein, 16 aa, Borrelia Burgdorferi
VKAVKTAEGASSGTAA

SEQ ID NO: 89550 - protein, 16 aa, Borrelia Burgdorferi
KAVKTAEGASSGTAAI

SEQ ID NO: 89551 - protein, 16 aa, Borrelia Burgdorferi
AVKTAEGASSGTAAIG

SEQ ID NO: 89552 - protein, 16 aa, Borrelia Burgdorferi
VKTAEGASSGTAAIGE

SEQ ID NO: 89553 - protein, 16 aa, Borrelia Burgdorferi
KTAEGASSGTAAIGEV

SEQ ID NO: 89554 - protein, 16 aa, Borrelia Burgdorferi
TAEGASSGTAAIGEVV

SEQ ID NO: 89555 - protein, 16 aa, Borrelia Burgdorferi
AEGASSGTAAIGEVVA

SEQ ID NO: 89556 - protein, 16 aa, Borrelia Burgdorferi
EGASSGTAAIGEVVAD

SEQ ID NO: 89557 - protein, 16 aa, Borrelia Burgdorferi
GASSGTAAIGEVVADA

SEQ ID NO: 89558 - protein, 16 aa, Borrelia Burgdorferi
ASSGTAAIGEVVADAD

SEQ ID NO: 89559 - protein, 16 aa, Borrelia Burgdorferi
SSGTAAIGEVVADADA

SEQ ID NO: 89560 - protein, 16 aa, Borrelia Burgdorferi
SGTAAIGEVVADADAA

SEQ ID NO: 89561 - protein, 16 aa, Borrelia Burgdorferi
GTAAIGEVVADADAAK

SEQ ID NO: 89562 - protein, 16 aa, Borrelia Burgdorferi
TAAIGEVVADADAAKV

SEQ ID NO: 89563 - protein, 16 aa, Borrelia Burgdorferi
AAIGEVVADADAAKVA

SEQ ID NO: 89564 - protein, 16 aa, Borrelia Burgdorferi
AIGEVVADADAAKVAD

SEQ ID NO: 89565 - protein, 16 aa, Borrelia Burgdorferi
IGEVVADADAAKVADK

SEQ ID NO: 89566 - protein, 16 aa, Borrelia Burgdorferi
GEVVADADAAKVADKA

SEQ ID NO: 89567 - protein, 16 aa, Borrelia Burgdorferi
EVVADADAAKVADKAS

SEQ ID NO: 89568 - protein, 16 aa, Borrelia Burgdorferi
VVADADAAKVADKASV

SEQ ID NO: 89569 - protein, 16 aa, Borrelia Burgdorferi
VADADAAKVADKASVK

SEQ ID NO: 89570 - protein, 16 aa, Borrelia Burgdorferi
ADADAAKVADKASVKG

SEQ ID NO: 89571 - protein, 16 aa, Borrelia Burgdorferi
DADAAKVADKASVKGI

SEQ ID NO: 89572 - protein, 16 aa, Borrelia Burgdorferi
ADAAKVADKASVKGIA

SEQ ID NO: 89573 - protein, 16 aa, Borrelia Burgdorferi
DAAKVADKASVKGIAK

SEQ ID NO: 89574 - protein, 16 aa, Borrelia Burgdorferi
AAKVADKASVKGIAKG

SEQ ID NO: 89575 - protein, 16 aa, Borrelia Burgdorferi
AKVADKASVKGIAKGI

SEQ ID NO: 89576 - protein, 16 aa, Borrelia Burgdorferi
KVADKASVKGIAKGIK

SEQ ID NO: 89577 - protein, 16 aa, Borrelia Burgdorferi
VADKASVKGIAKGIKE

SEQ ID NO: 89578 - protein, 16 aa, Borrelia Burgdorferi
ADKASVKGIAKGIKEI

SEQ ID NO: 89579 - protein, 16 aa, Borrelia Burgdorferi
DKASVKGIAKGIKEIV

SEQ ID NO: 89580 - protein, 16 aa, Borrelia Burgdorferi
KASVKGIAKGIKEIVE

SEQ ID NO: 89581 - protein, 16 aa, Borrelia Burgdorferi
ASVKGIAKGIKEIVEA

SEQ ID NO: 89582 - protein, 16 aa, Borrelia Burgdorferi
SVKGIAKGIKEIVEAA

SEQ ID NO: 89583 - protein, 16 aa, Borrelia Burgdorferi
VKGIAKGIKEIVEAAG

SEQ ID NO: 89584 - protein, 16 aa, Borrelia Burgdorferi
KGIAKGIKEIVEAAGG

SEQ ID NO: 89585 - protein, 16 aa, Borrelia Burgdorferi
GIAKGIKEIVEAAGGS

SEQ ID NO: 89586 - protein, 16 aa, Borrelia Burgdorferi
IAKGIKEIVEAAGGSE

SEQ ID NO: 89587 - protein, 16 aa, Borrelia Burgdorferi
AKGIKEIVEAAGGSEK

SEQ ID NO: 89588 - protein, 16 aa, Borrelia Burgdorferi
KGIKEIVEAAGGSEKL

SEQ ID NO: 89589 - protein, 16 aa, Borrelia Burgdorferi
GIKEIVEAAGGSEKLK

SEQ ID NO: 89590 - protein, 16 aa, Borrelia Burgdorferi
IKEIVEAAGGSEKLKA

SEQ ID NO: 89591 - protein, 16 aa, Borrelia Burgdorferi
KEIVEAAGGSEKLKAV

SEQ ID NO: 89592 - protein, 16 aa, Borrelia Burgdorferi
EIVEAAGGSEKLKAVA

SEQ ID NO: 89593 - protein, 16 aa, Borrelia Burgdorferi
IVEAAGGSEKLKAVAA

SEQ ID NO: 89594 - protein, 16 aa, Borrelia Burgdorferi
VEAAGGSEKLKAVAAA

SEQ ID NO: 89595 - protein, 16 aa, Borrelia Burgdorferi
EAAGGSEKLKAVAAAK

SEQ ID NO: 89596 - protein, 16 aa, Borrelia Burgdorferi
AAGGSEKLKAVAAAKG

SEQ ID NO: 89597 - protein, 16 aa, Borrelia Burgdorferi
AGGSEKLKAVAAAKGE

SEQ ID NO: 89598 - protein, 16 aa, Borrelia Burgdorferi
GGSEKLKAVAAAKGEN

SEQ ID NO: 89599 - protein, 16 aa, Borrelia Burgdorferi
GSEKLKAVAAAKGENN

SEQ ID NO: 89600 - protein, 16 aa, Borrelia Burgdorferi
SEKLKAVAAAKGENNK

SEQ ID NO: 89601 - protein, 16 aa, Borrelia Burgdorferi
EKLKAVAAAKGENNKG

SEQ ID NO: 89602 - protein, 16 aa, Borrelia Burgdorferi
KLKAVAAAKGENNKGA

SEQ ID NO: 89603 - protein, 16 aa, Borrelia Burgdorferi
LKAVAAAKGENNKGAG

SEQ ID NO: 89604 - protein, 16 aa, Borrelia Burgdorferi
KAVAAAKGENNKGAGK

SEQ ID NO: 89605 - protein, 16 aa, Borrelia Burgdorferi
AVAAAKGENNKGAGKL

SEQ ID NO: 89606 - protein, 16 aa, Borrelia Burgdorferi
VAAAKGENNKGAGKLF

SEQ ID NO: 89607 - protein, 16 aa, Borrelia Burgdorferi
AAAKGENNKGAGKLFG

SEQ ID NO: 89608 - protein, 16 aa, Borrelia Burgdorferi
AAKGENNKGAGKLFGK

SEQ ID NO: 89609 - protein, 16 aa, Borrelia Burgdorferi
AKGENNKGAGKLFGKA

SEQ ID NO: 89610 - protein, 16 aa, Borrelia Burgdorferi
KGENNKGAGKLFGKAG

SEQ ID NO: 89611 - protein, 16 aa, Borrelia Burgdorferi
GENNKGAGKLFGKAGA

SEQ ID NO: 89612 - protein, 16 aa, Borrelia Burgdorferi
ENNKGAGKLFGKAGAA

SEQ ID NO: 89613 - protein, 16 aa, Borrelia Burgdorferi
NNKGAGKLFGKAGAAA

SEQ ID NO: 89614 - protein, 16 aa, Borrelia Burgdorferi
NKGAGKLFGKAGAAAH

SEQ ID NO: 89615 - protein, 16 aa, Borrelia Burgdorferi
KGAGKLFGKAGAAAHG

SEQ ID NO: 89616 - protein, 16 aa, Borrelia Burgdorferi
GAGKLFGKAGAAAHGD

SEQ ID NO: 89617 - protein, 16 aa, Borrelia Burgdorferi
AGKLFGKAGAAAHGDS

SEQ ID NO: 89618 - protein, 16 aa, Borrelia Burgdorferi
GKLFGKAGAAAHGDSE

SEQ ID NO: 89619 - protein, 16 aa, Borrelia Burgdorferi
KLFGKAGAAAHGDSEA

SEQ ID NO: 89620 - protein, 16 aa, Borrelia Burgdorferi
LFGKAGAAAHGDSEAA

SEQ ID NO: 89621 - protein, 16 aa, Borrelia Burgdorferi
FGKAGAAAHGDSEAAS

SEQ ID NO: 89622 - protein, 16 aa, Borrelia Burgdorferi
GKAGAAAHGDSEAASK

SEQ ID NO: 89623 - protein, 16 aa, Borrelia Burgdorferi
KAGAAAHGDSEAASKA

SEQ ID NO: 89624 - protein, 16 aa, Borrelia Burgdorferi
AGAAAHGDSEAASKAA

SEQ ID NO: 89625 - protein, 16 aa, Borrelia Burgdorferi
GAAAHGDSEAASKAAG

SEQ ID NO: 89626 - protein, 16 aa, Borrelia Burgdorferi
AAAHGDSEAASKAAGA

SEQ ID NO: 89627 - protein, 16 aa, Borrelia Burgdorferi
AAHGDSEAASKAAGAV

SEQ ID NO: 89628 - protein, 16 aa, Borrelia Burgdorferi
AHGDSEAASKAAGAVS

SEQ ID NO: 89629 - protein, 16 aa, Borrelia Burgdorferi
HGDSEAASKAAGAVSA

SEQ ID NO: 89630 - protein, 16 aa, Borrelia Burgdorferi
GDSEAASKAAGAVSAV

SEQ ID NO: 89631 - protein, 16 aa, Borrelia Burgdorferi
DSEAASKAAGAVSAVS

SEQ ID NO: 89632 - protein, 16 aa, Borrelia Burgdorferi
SEAASKAAGAVSAVSG

SEQ ID NO: 89633 - protein, 16 aa, Borrelia Burgdorferi
EAASKAAGAVSAVSGE

SEQ ID NO: 89634 - protein, 16 aa, Borrelia Burgdorferi
AASKAAGAVSAVSGEQ

SEQ ID NO: 89635 - protein, 16 aa, Borrelia Burgdorferi
ASKAAGAVSAVSGEQI

SEQ ID NO: 89636 - protein, 16 aa, Borrelia Burgdorferi
SKAAGAVSAVSGEQIL

SEQ ID NO: 89637 - protein, 16 aa, Borrelia Burgdorferi
KAAGAVSAVSGEQILS

SEQ ID NO: 89638 - protein, 16 aa, Borrelia Burgdorferi
AAGAVSAVSGEQILSA

SEQ ID NO: 89639 - protein, 16 aa, Borrelia Burgdorferi
AGAVSAVSGEQILSAI

SEQ ID NO: 89640 - protein, 16 aa, Borrelia Burgdorferi
GAVSAVSGEQILSAIV

SEQ ID NO: 89641 - protein, 16 aa, Borrelia Burgdorferi
AVSAVSGEQILSAIVT

SEQ ID NO: 89642 - protein, 16 aa, Borrelia Burgdorferi
VSAVSGEQILSAIVTA

SEQ ID NO: 89643 - protein, 16 aa, Borrelia Burgdorferi
SAVSGEQILSAIVTAA

SEQ ID NO: 89644 - protein, 16 aa, Borrelia Burgdorferi
AVSGEQILSAIVTAAD

SEQ ID NO: 89645 - protein, 16 aa, Borrelia Burgdorferi
VSGEQILSAIVTAADA

SEQ ID NO: 89646 - protein, 16 aa, Borrelia Burgdorferi
SGEQILSAIVTAADAA

SEQ ID NO: 89647 - protein, 16 aa, Borrelia Burgdorferi
GEQILSAIVTAADAAE

SEQ ID NO: 89648 - protein, 16 aa, Borrelia Burgdorferi
EQILSAIVTAADAAEQ

SEQ ID NO: 89649 - protein, 16 aa, Borrelia Burgdorferi
QILSAIVTAADAAEQD

SEQ ID NO: 89650 - protein, 16 aa, Borrelia Burgdorferi
ILSAIVTAADAAEQDG

SEQ ID NO: 89651 - protein, 16 aa, Borrelia Burgdorferi
LSAIVTAADAAEQDGK

SEQ ID NO: 89652 - protein, 16 aa, Borrelia Burgdorferi
SAIVTAADAAEQDGKK

SEQ ID NO: 89653 - protein, 16 aa, Borrelia Burgdorferi
AIVTAADAAEQDGKKP

SEQ ID NO: 89654 - protein, 16 aa, Borrelia Burgdorferi
IVTAADAAEQDGKKPE

SEQ ID NO: 89655 - protein, 16 aa, Borrelia Burgdorferi
VTAADAAEQDGKKPEE

SEQ ID NO: 89656 - protein, 16 aa, Borrelia Burgdorferi
TAADAAEQDGKKPEEA

SEQ ID NO: 89657 - protein, 16 aa, Borrelia Burgdorferi
AADAAEQDGKKPEEAK

SEQ ID NO: 89658 - protein, 16 aa, Borrelia Burgdorferi
ADAAEQDGKKPEEAKN

SEQ ID NO: 89659 - protein, 16 aa, Borrelia Burgdorferi
DAAEQDGKKPEEAKNP

SEQ ID NO: 89660 - protein, 16 aa, Borrelia Burgdorferi
AAEQDGKKPEEAKNPI

SEQ ID NO: 89661 - protein, 16 aa, Borrelia Burgdorferi
AEQDGKKPEEAKNPIA

SEQ ID NO: 89662 - protein, 16 aa, Borrelia Burgdorferi
EQDGKKPEEAKNPIAA

SEQ ID NO: 89663 - protein, 16 aa, Borrelia Burgdorferi
QDGKKPEEAKNPIAAA

SEQ ID NO: 89664 - protein, 16 aa, Borrelia Burgdorferi
DGKKPEEAKNPIAAAI

SEQ ID NO: 89665 - protein, 16 aa, Borrelia Burgdorferi
GKKPEEAKNPIAAAIG

SEQ ID NO: 89666 - protein, 16 aa, Borrelia Burgdorferi
KKPEEAKNPIAAAIGD

SEQ ID NO: 89667 - protein, 16 aa, Borrelia Burgdorferi
KPEEAKNPIAAAIGDK

SEQ ID NO: 89668 - protein, 16 aa, Borrelia Burgdorferi
PEEAKNPIAAAIGDKD

SEQ ID NO: 89669 - protein, 16 aa, Borrelia Burgdorferi
EEAKNPIAAAIGDKDG

SEQ ID NO: 89670 - protein, 16 aa, Borrelia Burgdorferi
EAKNPIAAAIGDKDGG

SEQ ID NO: 89671 - protein, 16 aa, Borrelia Burgdorferi
AKNPIAAAIGDKDGGA

SEQ ID NO: 89672 - protein, 16 aa, Borrelia Burgdorferi
KNPIAAAIGDKDGGAE

SEQ ID NO: 89673 - protein, 16 aa, Borrelia Burgdorferi
NPIAAAIGDKDGGAEF

SEQ ID NO: 89674 - protein, 16 aa, Borrelia Burgdorferi
PIAAAIGDKDGGAEFG

SEQ ID NO: 89675 - protein, 16 aa, Borrelia Burgdorferi
IAAAIGDKDGGAEFGQ

SEQ ID NO: 89676 - protein, 16 aa, Borrelia Burgdorferi
AAAIGDKDGGAEFGQD

SEQ ID NO: 89677 - protein, 16 aa, Borrelia Burgdorferi
AAIGDKDGGAEFGQDE

SEQ ID NO: 89678 - protein, 16 aa, Borrelia Burgdorferi
  Xaa can be any naturally occurring amino acid
  VARIANT 16: Xaa = Any Amino Acid
AIGDKDGGAEFGQDEX

SEQ ID NO: 89679 - protein, 16 aa, Borrelia Burgdorferi
  Xaa can be any naturally occurring amino acid
  VARIANT 15: Xaa = Any Amino Acid
IGDKDGGAEFGQDEXK

SEQ ID NO: 89680 - protein, 16 aa, Borrelia Burgdorferi
  Xaa can be any naturally occurring amino acid
  VARIANT 14: Xaa = Any Amino Acid
GDKDGGAEFGQDEXKK

SEQ ID NO: 89681 - protein, 16 aa, Borrelia Burgdorferi
  Xaa can be any naturally occurring amino acid
  VARIANT 13: Xaa = Any Amino Acid
DKDGGAEFGQDEXKKD

SEQ ID NO: 89682 - protein, 16 aa, Borrelia Burgdorferi
  Xaa can be any naturally occurring amino acid
  VARIANT 12: Xaa = Any Amino Acid
KDGGAEFGQDEXKKDD

SEQ ID NO: 89683 - protein, 16 aa, Borrelia Burgdorferi
  Xaa can be any naturally occurring amino acid
  VARIANT 11: Xaa = Any Amino Acid
DGGAEFGQDEXKKDDQ

SEQ ID NO: 89684 - protein, 16 aa, Borrelia Burgdorferi
  Xaa can be any naturally occurring amino acid
  VARIANT 10: Xaa = Any Amino Acid
GGAEFGQDEXKKDDQI

SEQ ID NO: 89685 - protein, 16 aa, Borrelia Burgdorferi
  Xaa can be any naturally occurring amino acid
  VARIANT 9: Xaa = Any Amino Acid
GAEFGQDEXKKDDQIA

SEQ ID NO: 89686 - protein, 16 aa, Borrelia Burgdorferi
  Xaa can be any naturally occurring amino acid
  VARIANT 8: Xaa = Any Amino Acid
AEFGQDEXKKDDQIAA

SEQ ID NO: 89687 - protein, 16 aa, Borrelia Burgdorferi
  Xaa can be any naturally occurring amino acid
  VARIANT 7: Xaa = Any Amino Acid
EFGQDEXKKDDQIAAA

SEQ ID NO: 89688 - protein, 16 aa, Borrelia Burgdorferi
  Xaa can be any naturally occurring amino acid
  VARIANT 6: Xaa = Any Amino Acid
FGQDEXKKDDQIAAAI

SEQ ID NO: 89689 - protein, 16 aa, Borrelia Burgdorferi
  Xaa can be any naturally occurring amino acid
  VARIANT 5: Xaa = Any Amino Acid
GQDEXKKDDQIAAAIA

SEQ ID NO: 89690 - protein, 16 aa, Borrelia Burgdorferi
  Xaa can be any naturally occurring amino acid
  VARIANT 4: Xaa = Any Amino Acid
QDEXKKDDQIAAAIAL

SEQ ID NO: 89691 - protein, 16 aa, Borrelia Burgdorferi
  Xaa can be any naturally occurring amino acid
  VARIANT 3: Xaa = Any Amino Acid
DEXKKDDQIAAAIALR

SEQ ID NO: 89692 - protein, 16 aa, Borrelia Burgdorferi
  Xaa can be any naturally occurring amino acid
  VARIANT 2: Xaa = Any Amino Acid
EXKKDDQIAAAIALRG

SEQ ID NO: 89693 - protein, 16 aa, Borrelia Burgdorferi
  Xaa can be any naturally occurring amino acid
  VARIANT 1, 16: Xaa = Any Amino Acid
XKKDDQIAAAIALRGX

SEQ ID NO: 89694 - protein, 16 aa, Borrelia Burgdorferi
  Xaa can be any naturally occurring amino acid
  VARIANT 15: Xaa = Any Amino Acid
KKDDQIAAAIALRGXA

SEQ ID NO: 89695 - protein, 16 aa, Borrelia Burgdorferi
  Xaa can be any naturally occurring amino acid
  VARIANT 14: Xaa = Any Amino Acid
KDDQIAAAIALRGXAK

SEQ ID NO: 89696 - protein, 16 aa, Borrelia Burgdorferi
  Xaa can be any naturally occurring amino acid
  VARIANT 13: Xaa = Any Amino Acid
DDQIAAAIALRGXAKD

SEQ ID NO: 89697 - protein, 16 aa, Borrelia Burgdorferi
  Xaa can be any naturally occurring amino acid
  VARIANT 12: Xaa = Any Amino Acid
DQIAAAIALRGXAKDG

SEQ ID NO: 89698 - protein, 16 aa, Borrelia Burgdorferi
  Xaa can be any naturally occurring amino acid
  VARIANT 11: Xaa = Any Amino Acid
QIAAAIALRGXAKDGK

SEQ ID NO: 89699 - protein, 16 aa, Borrelia Burgdorferi
  Xaa can be any naturally occurring amino acid
  VARIANT 10: Xaa = Any Amino Acid
IAAAIALRGXAKDGKF

SEQ ID NO: 89700 - protein, 16 aa, Borrelia Burgdorferi
  Xaa can be any naturally occurring amino acid
  VARIANT 9: Xaa = Any Amino Acid
AAAIALRGXAKDGKFA

SEQ ID NO: 89701 - protein, 16 aa, Borrelia Burgdorferi
  Xaa can be any naturally occurring amino acid
  VARIANT 8: Xaa = Any Amino Acid
AAIALRGXAKDGKFAV

SEQ ID NO: 89702 - protein, 16 aa, Borrelia Burgdorferi
  Xaa can be any naturally occurring amino acid
  VARIANT 7: Xaa = Any Amino Acid
AIALRGXAKDGKFAVK

SEQ ID NO: 89703 - protein, 16 aa, Borrelia Burgdorferi
  Xaa can be any naturally occurring amino acid
  VARIANT 6: Xaa = Any Amino Acid
IALRGXAKDGKFAVKD

SEQ ID NO: 89704 - protein, 16 aa, Borrelia Burgdorferi
  Xaa can be any naturally occurring amino acid
  VARIANT 5: Xaa = Any Amino Acid
ALRGXAKDGKFAVKDG

SEQ ID NO: 89705 - protein, 16 aa, Borrelia Burgdorferi
  Xaa can be any naturally occurring amino acid
  VARIANT 4: Xaa = Any Amino Acid
LRGXAKDGKFAVKDGE

SEQ ID NO: 89706 - protein, 16 aa, Borrelia Burgdorferi
  Xaa can be any naturally occurring amino acid
  VARIANT 3: Xaa = Any Amino Acid
RGXAKDGKFAVKDGEK

SEQ ID NO: 89707 - protein, 16 aa, Borrelia Burgdorferi
  Xaa can be any naturally occurring amino acid
  VARIANT 2: Xaa = Any Amino Acid
GXAKDGKFAVKDGEKE

SEQ ID NO: 89708 - protein, 16 aa, Borrelia Burgdorferi
  Xaa can be any naturally occurring amino acid
  VARIANT 1: Xaa = Any Amino Acid
XAKDGKFAVKDGEKEK

SEQ ID NO: 89709 - protein, 16 aa, Borrelia Burgdorferi
AKDGKFAVKDGEKEKA

SEQ ID NO: 89710 - protein, 16 aa, Borrelia Burgdorferi
KDGKFAVKDGEKEKAE

SEQ ID NO: 89711 - protein, 16 aa, Borrelia Burgdorferi
DGKFAVKDGEKEKAEG

SEQ ID NO: 89712 - protein, 16 aa, Borrelia Burgdorferi
GKFAVKDGEKEKAEGA

SEQ ID NO: 89713 - protein, 16 aa, Borrelia Burgdorferi
KFAVKDGEKEKAEGAI

SEQ ID NO: 89714 - protein, 16 aa, Borrelia Burgdorferi
FAVKDGEKEKAEGAIK

SEQ ID NO: 89715 - protein, 16 aa, Borrelia Burgdorferi
AVKDGEKEKAEGAIKG

SEQ ID NO: 89716 - protein, 16 aa, Borrelia Burgdorferi
VKDGEKEKAEGAIKGA

SEQ ID NO: 89717 - protein, 16 aa, Borrelia Burgdorferi
KDGEKEKAEGAIKGAA

SEQ ID NO: 89718 - protein, 16 aa, Borrelia Burgdorferi
DGEKEKAEGAIKGAAE

SEQ ID NO: 89719 - protein, 16 aa, Borrelia Burgdorferi
GEKEKAEGAIKGAAES

SEQ ID NO: 89720 - protein, 16 aa, Borrelia Burgdorferi
EKEKAEGAIKGAAESA

SEQ ID NO: 89721 - protein, 16 aa, Borrelia Burgdorferi
KEKAEGAIKGAAESAV

SEQ ID NO: 89722 - protein, 16 aa, Borrelia Burgdorferi
EKAEGAIKGAAESAVR

SEQ ID NO: 89723 - protein, 16 aa, Borrelia Burgdorferi
KAEGAIKGAAESAVRK

SEQ ID NO: 89724 - protein, 16 aa, Borrelia Burgdorferi
AEGAIKGAAESAVRKV

SEQ ID NO: 89725 - protein, 16 aa, Borrelia Burgdorferi
EGAIKGAAESAVRKVL

SEQ ID NO: 89726 - protein, 16 aa, Borrelia Burgdorferi
GAIKGAAESAVRKVLG

SEQ ID NO: 89727 - protein, 16 aa, Borrelia Burgdorferi
AIKGAAESAVRKVLGA

SEQ ID NO: 89728 - protein, 16 aa, Borrelia Burgdorferi
IKGAAESAVRKVLGAI

SEQ ID NO: 89729 - protein, 16 aa, Borrelia Burgdorferi
KGAAESAVRKVLGAIT

SEQ ID NO: 89730 - protein, 16 aa, Borrelia Burgdorferi
GAAESAVRKVLGAITG

SEQ ID NO: 89731 - protein, 16 aa, Borrelia Burgdorferi
AAESAVRKVLGAITGL

SEQ ID NO: 89732 - protein, 16 aa, Borrelia Burgdorferi
AESAVRKVLGAITGLI

SEQ ID NO: 89733 - protein, 16 aa, Borrelia Burgdorferi
ESAVRKVLGAITGLIG

SEQ ID NO: 89734 - protein, 16 aa, Borrelia Burgdorferi
SAVRKVLGAITGLIGD

SEQ ID NO: 89735 - protein, 16 aa, Borrelia Burgdorferi
AVRKVLGAITGLIGDA

SEQ ID NO: 89736 - protein, 16 aa, Borrelia Burgdorferi
VRKVLGAITGLIGDAV

SEQ ID NO: 89737 - protein, 16 aa, Borrelia Burgdorferi
RKVLGAITGLIGDAVS

SEQ ID NO: 89738 - protein, 16 aa, Borrelia Burgdorferi
KVLGAITGLIGDAVSS

SEQ ID NO: 89739 - protein, 16 aa, Borrelia Burgdorferi
VLGAITGLIGDAVSSG

SEQ ID NO: 89740 - protein, 16 aa, Borrelia Burgdorferi
LGAITGLIGDAVSSGL

SEQ ID NO: 89741 - protein, 16 aa, Borrelia Burgdorferi
GAITGLIGDAVSSGLR

SEQ ID NO: 89742 - protein, 16 aa, Borrelia Burgdorferi
AITGLIGDAVSSGLRK

SEQ ID NO: 89743 - protein, 16 aa, Borrelia Burgdorferi
ITGLIGDAVSSGLRKV

SEQ ID NO: 89744 - protein, 16 aa, Borrelia Burgdorferi
TGLIGDAVSSGLRKVG

SEQ ID NO: 89745 - protein, 16 aa, Borrelia Burgdorferi
GLIGDAVSSGLRKVGD

SEQ ID NO: 89746 - protein, 16 aa, Borrelia Burgdorferi
LIGDAVSSGLRKVGDS

SEQ ID NO: 89747 - protein, 16 aa, Borrelia Burgdorferi
IGDAVSSGLRKVGDSV

SEQ ID NO: 89748 - protein, 16 aa, Borrelia Burgdorferi
GDAVSSGLRKVGDSVK

SEQ ID NO: 89749 - protein, 16 aa, Borrelia Burgdorferi
DAVSSGLRKVGDSVKA

SEQ ID NO: 89750 - protein, 16 aa, Borrelia Burgdorferi
AVSSGLRKVGDSVKAA

SEQ ID NO: 89751 - protein, 16 aa, Borrelia Burgdorferi
VSSGLRKVGDSVKAAS

SEQ ID NO: 89752 - protein, 16 aa, Borrelia Burgdorferi
SSGLRKVGDSVKAASK

SEQ ID NO: 89753 - protein, 16 aa, Borrelia Burgdorferi
SGLRKVGDSVKAASKE

SEQ ID NO: 89754 - protein, 16 aa, Borrelia Burgdorferi
GLRKVGDSVKAASKET

SEQ ID NO: 89755 - protein, 16 aa, Borrelia Burgdorferi
LRKVGDSVKAASKETP

SEQ ID NO: 89756 - protein, 16 aa, Borrelia Burgdorferi
RKVGDSVKAASKETPP

SEQ ID NO: 89757 - protein, 16 aa, Borrelia Burgdorferi
KVGDSVKAASKETPPA

SEQ ID NO: 89758 - protein, 16 aa, Borrelia Burgdorferi
VGDSVKAASKETPPAL

SEQ ID NO: 89759 - protein, 16 aa, Borrelia Burgdorferi
GDSVKAASKETPPALN

SEQ ID NO: 89760 - protein, 16 aa, Borrelia Burgdorferi
DSVKAASKETPPALNK

SEQ ID NO: 89761 - protein, 13 aa, Borrelia burgdorferi
MKKISLLIFLFLF

SEQ ID NO: 89762 - protein, 13 aa, Borrelia burgdorferi
KKISLLIFLFLFV

SEQ ID NO: 89763 - protein, 13 aa, Borrelia burgdorferi
KISLLIFLFLFVV

SEQ ID NO: 89764 - protein, 13 aa, Borrelia burgdorferi
ISLLIFLFLFVVS

SEQ ID NO: 89765 - protein, 13 aa, Borrelia burgdorferi
SLLIFLFLFVVSL

SEQ ID NO: 89766 - protein, 13 aa, Borrelia burgdorferi
LLIFLFLFVVSLS

SEQ ID NO: 89767 - protein, 13 aa, Borrelia burgdorferi
LIFLFLFVVSLSA

SEQ ID NO: 89768 - protein, 13 aa, Borrelia burgdorferi
IFLFLFVVSLSAN

SEQ ID NO: 89769 - protein, 13 aa, Borrelia burgdorferi
FLFLFVVSLSANI

SEQ ID NO: 89770 - protein, 13 aa, Borrelia burgdorferi
LFLFVVSLSANIE

SEQ ID NO: 89771 - protein, 13 aa, Borrelia burgdorferi
FLFVVSLSANIEE

SEQ ID NO: 89772 - protein, 13 aa, Borrelia burgdorferi
LFVVSLSANIEEN

SEQ ID NO: 89773 - protein, 13 aa, Borrelia burgdorferi
FVVSLSANIEENY

SEQ ID NO: 89774 - protein, 13 aa, Borrelia burgdorferi
VVSLSANIEENYT

SEQ ID NO: 89775 - protein, 13 aa, Borrelia burgdorferi
VSLSANIEENYTE

SEQ ID NO: 89776 - protein, 13 aa, Borrelia burgdorferi
SLSANIEENYTET

SEQ ID NO: 89777 - protein, 13 aa, Borrelia burgdorferi
LSANIEENYTETK

SEQ ID NO: 89778 - protein, 13 aa, Borrelia burgdorferi
SANIEENYTETKR

SEQ ID NO: 89779 - protein, 13 aa, Borrelia burgdorferi
ANIEENYTETKRA

SEQ ID NO: 89780 - protein, 13 aa, Borrelia burgdorferi
NIEENYTETKRAF

SEQ ID NO: 89781 - protein, 13 aa, Borrelia burgdorferi
IEENYTETKRAFS

SEQ ID NO: 89782 - protein, 13 aa, Borrelia burgdorferi
EENYTETKRAFSK

SEQ ID NO: 89783 - protein, 13 aa, Borrelia burgdorferi
ENYTETKRAFSKE

SEQ ID NO: 89784 - protein, 13 aa, Borrelia burgdorferi
NYTETKRAFSKED

SEQ ID NO: 89785 - protein, 13 aa, Borrelia burgdorferi
YTETKRAFSKEDF

SEQ ID NO: 89786 - protein, 13 aa, Borrelia burgdorferi
TETKRAFSKEDFN

SEQ ID NO: 89787 - protein, 13 aa, Borrelia burgdorferi
ETKRAFSKEDFNL

SEQ ID NO: 89788 - protein, 13 aa, Borrelia burgdorferi
TKRAFSKEDFNLI

SEQ ID NO: 89789 - protein, 13 aa, Borrelia burgdorferi
KRAFSKEDFNLIN

SEQ ID NO: 89790 - protein, 13 aa, Borrelia burgdorferi
RAFSKEDFNLINK

SEQ ID NO: 89791 - protein, 13 aa, Borrelia burgdorferi
AFSKEDFNLINKR

SEQ ID NO: 89792 - protein, 13 aa, Borrelia burgdorferi
FSKEDFNLINKRL

SEQ ID NO: 89793 - protein, 13 aa, Borrelia burgdorferi
SKEDFNLINKRLD

SEQ ID NO: 89794 - protein, 13 aa, Borrelia burgdorferi
KEDFNLINKRLDN

SEQ ID NO: 89795 - protein, 13 aa, Borrelia burgdorferi
EDFNLINKRLDNY

SEQ ID NO: 89796 - protein, 13 aa, Borrelia burgdorferi
DFNLINKRLDNYD

SEQ ID NO: 89797 - protein, 13 aa, Borrelia burgdorferi
FNLINKRLDNYDF

SEQ ID NO: 89798 - protein, 13 aa, Borrelia burgdorferi
NLINKRLDNYDFK

SEQ ID NO: 89799 - protein, 13 aa, Borrelia burgdorferi
LINKRLDNYDFKN

SEQ ID NO: 89800 - protein, 13 aa, Borrelia burgdorferi
INKRLDNYDFKNE

SEQ ID NO: 89801 - protein, 13 aa, Borrelia burgdorferi
NKRLDNYDFKNEY

SEQ ID NO: 89802 - protein, 13 aa, Borrelia burgdorferi
KRLDNYDFKNEYE

SEQ ID NO: 89803 - protein, 13 aa, Borrelia burgdorferi
RLDNYDFKNEYEK

SEQ ID NO: 89804 - protein, 13 aa, Borrelia burgdorferi
LDNYDFKNEYEKS

SEQ ID NO: 89805 - protein, 13 aa, Borrelia burgdorferi
DNYDFKNEYEKSH

SEQ ID NO: 89806 - protein, 13 aa, Borrelia burgdorferi
NYDFKNEYEKSHV

SEQ ID NO: 89807 - protein, 13 aa, Borrelia burgdorferi
YDFKNEYEKSHVF

SEQ ID NO: 89808 - protein, 13 aa, Borrelia burgdorferi
DFKNEYEKSHVFS

SEQ ID NO: 89809 - protein, 13 aa, Borrelia burgdorferi
FKNEYEKSHVFSD

SEQ ID NO: 89810 - protein, 13 aa, Borrelia burgdorferi
KNEYEKSHVFSDA

SEQ ID NO: 89811 - protein, 13 aa, Borrelia burgdorferi
NEYEKSHVFSDAP

SEQ ID NO: 89812 - protein, 13 aa, Borrelia burgdorferi
EYEKSHVFSDAPR

SEQ ID NO: 89813 - protein, 13 aa, Borrelia burgdorferi
YEKSHVFSDAPRI

SEQ ID NO: 89814 - protein, 13 aa, Borrelia burgdorferi
EKSHVFSDAPRIR

SEQ ID NO: 89815 - protein, 13 aa, Borrelia burgdorferi
KSHVFSDAPRIRG

SEQ ID NO: 89816 - protein, 13 aa, Borrelia burgdorferi
SHVFSDAPRIRGD

SEQ ID NO: 89817 - protein, 13 aa, Borrelia burgdorferi
HVFSDAPRIRGDL

SEQ ID NO: 89818 - protein, 13 aa, Borrelia burgdorferi
VFSDAPRIRGDLR

SEQ ID NO: 89819 - protein, 13 aa, Borrelia burgdorferi
FSDAPRIRGDLRK

SEQ ID NO: 89820 - protein, 13 aa, Borrelia burgdorferi
SDAPRIRGDLRKI

SEQ ID NO: 89821 - protein, 13 aa, Borrelia burgdorferi
DAPRIRGDLRKIG

SEQ ID NO: 89822 - protein, 13 aa, Borrelia burgdorferi
APRIRGDLRKIGI

SEQ ID NO: 89823 - protein, 13 aa, Borrelia burgdorferi
PRIRGDLRKIGIK

SEQ ID NO: 89824 - protein, 13 aa, Borrelia burgdorferi
RIRGDLRKIGIKE

SEQ ID NO: 89825 - protein, 13 aa, Borrelia burgdorferi
IRGDLRKIGIKEK

SEQ ID NO: 89826 - protein, 13 aa, Borrelia burgdorferi
RGDLRKIGIKEKS

SEQ ID NO: 89827 - protein, 13 aa, Borrelia burgdorferi
GDLRKIGIKEKSV

SEQ ID NO: 89828 - protein, 13 aa, Borrelia burgdorferi
DLRKIGIKEKSVF

SEQ ID NO: 89829 - protein, 13 aa, Borrelia burgdorferi
LRKIGIKEKSVFL

SEQ ID NO: 89830 - protein, 13 aa, Borrelia burgdorferi
RKIGIKEKSVFLD

SEQ ID NO: 89831 - protein, 13 aa, Borrelia burgdorferi
KIGIKEKSVFLDA

SEQ ID NO: 89832 - protein, 13 aa, Borrelia burgdorferi
IGIKEKSVFLDAL

SEQ ID NO: 89833 - protein, 13 aa, Borrelia burgdorferi
GIKEKSVFLDALE

SEQ ID NO: 89834 - protein, 13 aa, Borrelia burgdorferi
IKEKSVFLDALEA

SEQ ID NO: 89835 - protein, 13 aa, Borrelia burgdorferi
KEKSVFLDALEAI

SEQ ID NO: 89836 - protein, 13 aa, Borrelia burgdorferi
EKSVFLDALEAIE

SEQ ID NO: 89837 - protein, 13 aa, Borrelia burgdorferi
KSVFLDALEAIEY

SEQ ID NO: 89838 - protein, 13 aa, Borrelia burgdorferi
SVFLDALEAIEYL

SEQ ID NO: 89839 - protein, 13 aa, Borrelia burgdorferi
VFLDALEAIEYLI

SEQ ID NO: 89840 - protein, 13 aa, Borrelia burgdorferi
FLDALEAIEYLIK

SEQ ID NO: 89841 - protein, 13 aa, Borrelia burgdorferi
LDALEAIEYLIKI

SEQ ID NO: 89842 - protein, 13 aa, Borrelia burgdorferi
DALEAIEYLIKIK

SEQ ID NO: 89843 - protein, 13 aa, Borrelia burgdorferi
ALEAIEYLIKIKI

SEQ ID NO: 89844 - protein, 13 aa, Borrelia burgdorferi
LEAIEYLIKIKIS

SEQ ID NO: 89845 - protein, 13 aa, Borrelia burgdorferi
EAIEYLIKIKIST

SEQ ID NO: 89846 - protein, 13 aa, Borrelia burgdorferi
AIEYLIKIKISTD

SEQ ID NO: 89847 - protein, 13 aa, Borrelia burgdorferi
IEYLIKIKISTDS

SEQ ID NO: 89848 - protein, 13 aa, Borrelia burgdorferi
EYLIKIKISTDSI

SEQ ID NO: 89849 - protein, 13 aa, Borrelia burgdorferi
YLIKIKISTDSIF

SEQ ID NO: 89850 - protein, 13 aa, Borrelia burgdorferi
LIKIKISTDSIFL

SEQ ID NO: 89851 - protein, 13 aa, Borrelia burgdorferi
IKIKISTDSIFLS

SEQ ID NO: 89852 - protein, 13 aa, Borrelia burgdorferi
KIKISTDSIFLSE

SEQ ID NO: 89853 - protein, 13 aa, Borrelia burgdorferi
IKISTDSIFLSED

SEQ ID NO: 89854 - protein, 13 aa, Borrelia burgdorferi
KISTDSIFLSEDM

SEQ ID NO: 89855 - protein, 13 aa, Borrelia burgdorferi
ISTDSIFLSEDMI

SEQ ID NO: 89856 - protein, 13 aa, Borrelia burgdorferi
STDSIFLSEDMIR

SEQ ID NO: 89857 - protein, 13 aa, Borrelia burgdorferi
TDSIFLSEDMIRL

SEQ ID NO: 89858 - protein, 13 aa, Borrelia burgdorferi
DSIFLSEDMIRLI

SEQ ID NO: 89859 - protein, 13 aa, Borrelia burgdorferi
SIFLSEDMIRLIG

SEQ ID NO: 89860 - protein, 13 aa, Borrelia burgdorferi
IFLSEDMIRLIGS

SEQ ID NO: 89861 - protein, 13 aa, Borrelia burgdorferi
FLSEDMIRLIGSY

SEQ ID NO: 89862 - protein, 13 aa, Borrelia burgdorferi
LSEDMIRLIGSYP

SEQ ID NO: 89863 - protein, 13 aa, Borrelia burgdorferi
SEDMIRLIGSYPD

SEQ ID NO: 89864 - protein, 13 aa, Borrelia burgdorferi
EDMIRLIGSYPDS

SEQ ID NO: 89865 - protein, 13 aa, Borrelia burgdorferi
DMIRLIGSYPDSI

SEQ ID NO: 89866 - protein, 13 aa, Borrelia burgdorferi
MIRLIGSYPDSIF

SEQ ID NO: 89867 - protein, 13 aa, Borrelia burgdorferi
IRLIGSYPDSIFN

SEQ ID NO: 89868 - protein, 13 aa, Borrelia burgdorferi
RLIGSYPDSIFNY

SEQ ID NO: 89869 - protein, 13 aa, Borrelia burgdorferi
LIGSYPDSIFNYL

SEQ ID NO: 89870 - protein, 13 aa, Borrelia burgdorferi
IGSYPDSIFNYLI

SEQ ID NO: 89871 - protein, 13 aa, Borrelia burgdorferi
GSYPDSIFNYLIQ

SEQ ID NO: 89872 - protein, 13 aa, Borrelia burgdorferi
SYPDSIFNYLIQL

SEQ ID NO: 89873 - protein, 13 aa, Borrelia burgdorferi
YPDSIFNYLIQLN

SEQ ID NO: 89874 - protein, 13 aa, Borrelia burgdorferi
PDSIFNYLIQLNS

SEQ ID NO: 89875 - protein, 13 aa, Borrelia burgdorferi
DSIFNYLIQLNSD

SEQ ID NO: 89876 - protein, 13 aa, Borrelia burgdorferi
SIFNYLIQLNSDK

SEQ ID NO: 89877 - protein, 13 aa, Borrelia burgdorferi
IFNYLIQLNSDKI

SEQ ID NO: 89878 - protein, 13 aa, Borrelia burgdorferi
FNYLIQLNSDKID

SEQ ID NO: 89879 - protein, 13 aa, Borrelia burgdorferi
NYLIQLNSDKIDY

SEQ ID NO: 89880 - protein, 13 aa, Borrelia burgdorferi
YLIQLNSDKIDYA

SEQ ID NO: 89881 - protein, 13 aa, Borrelia burgdorferi
LIQLNSDKIDYAE

SEQ ID NO: 89882 - protein, 13 aa, Borrelia burgdorferi
IQLNSDKIDYAEK

SEQ ID NO: 89883 - protein, 13 aa, Borrelia burgdorferi
QLNSDKIDYAEKY

SEQ ID NO: 89884 - protein, 13 aa, Borrelia burgdorferi
LNSDKIDYAEKYG

SEQ ID NO: 89885 - protein, 13 aa, Borrelia burgdorferi
NSDKIDYAEKYGD

SEQ ID NO: 89886 - protein, 13 aa, Borrelia burgdorferi
SDKIDYAEKYGDN

SEQ ID NO: 89887 - protein, 13 aa, Borrelia burgdorferi
DKIDYAEKYGDNA

SEQ ID NO: 89888 - protein, 13 aa, Borrelia burgdorferi
KIDYAEKYGDNAR

SEQ ID NO: 89889 - protein, 13 aa, Borrelia burgdorferi
IDYAEKYGDNARN

SEQ ID NO: 89890 - protein, 13 aa, Borrelia burgdorferi
DYAEKYGDNARNN

SEQ ID NO: 89891 - protein, 13 aa, Borrelia burgdorferi
YAEKYGDNARNNF

SEQ ID NO: 89892 - protein, 13 aa, Borrelia burgdorferi
AEKYGDNARNNFK

SEQ ID NO: 89893 - protein, 13 aa, Borrelia burgdorferi
EKYGDNARNNFKK

SEQ ID NO: 89894 - protein, 13 aa, Borrelia burgdorferi
KYGDNARNNFKKD

SEQ ID NO: 89895 - protein, 13 aa, Borrelia burgdorferi
YGDNARNNFKKDY

SEQ ID NO: 89896 - protein, 13 aa, Borrelia burgdorferi
GDNARNNFKKDYS

SEQ ID NO: 89897 - protein, 13 aa, Borrelia burgdorferi
DNARNNFKKDYSE

SEQ ID NO: 89898 - protein, 13 aa, Borrelia burgdorferi
NARNNFKKDYSED

SEQ ID NO: 89899 - protein, 13 aa, Borrelia burgdorferi
ARNNFKKDYSEDK

SEQ ID NO: 89900 - protein, 13 aa, Borrelia burgdorferi
RNNFKKDYSEDKA

SEQ ID NO: 89901 - protein, 13 aa, Borrelia burgdorferi
NNFKKDYSEDKAN

SEQ ID NO: 89902 - protein, 13 aa, Borrelia burgdorferi
NFKKDYSEDKANT

SEQ ID NO: 89903 - protein, 13 aa, Borrelia burgdorferi
FKKDYSEDKANTV

SEQ ID NO: 89904 - protein, 13 aa, Borrelia burgdorferi
KKDYSEDKANTVK

SEQ ID NO: 89905 - protein, 13 aa, Borrelia burgdorferi
KDYSEDKANTVKQ

SEQ ID NO: 89906 - protein, 13 aa, Borrelia burgdorferi
DYSEDKANTVKQI

SEQ ID NO: 89907 - protein, 13 aa, Borrelia burgdorferi
YSEDKANTVKQIL

SEQ ID NO: 89908 - protein, 13 aa, Borrelia burgdorferi
SEDKANTVKQILK

SEQ ID NO: 89909 - protein, 13 aa, Borrelia burgdorferi
EDKANTVKQILKQ

SEQ ID NO: 89910 - protein, 13 aa, Borrelia burgdorferi
DKANTVKQILKQI

SEQ ID NO: 89911 - protein, 13 aa, Borrelia burgdorferi
KANTVKQILKQIL

SEQ ID NO: 89912 - protein, 13 aa, Borrelia burgdorferi
ANTVKQILKQILA

SEQ ID NO: 89913 - protein, 13 aa, Borrelia burgdorferi
NTVKQILKQILAD

SEQ ID NO: 89914 - protein, 13 aa, Borrelia burgdorferi
TVKQILKQILADL

SEQ ID NO: 89915 - protein, 13 aa, Borrelia burgdorferi
VKQILKQILADLP

SEQ ID NO: 89916 - protein, 13 aa, Borrelia burgdorferi
KQILKQILADLPK

SEQ ID NO: 89917 - protein, 13 aa, Borrelia burgdorferi
QILKQILADLPKD

SEQ ID NO: 89918 - protein, 14 aa, Borrelia burgdorferi
MKKISLLIFLFLFV

SEQ ID NO: 89919 - protein, 14 aa, Borrelia burgdorferi
KKISLLIFLFLFVV

SEQ ID NO: 89920 - protein, 14 aa, Borrelia burgdorferi
KISLLIFLFLFVVS

SEQ ID NO: 89921 - protein, 14 aa, Borrelia burgdorferi
ISLLIFLFLFVVSL

SEQ ID NO: 89922 - protein, 14 aa, Borrelia burgdorferi
SLLIFLFLFVVSLS

SEQ ID NO: 89923 - protein, 14 aa, Borrelia burgdorferi
LLIFLFLFVVSLSA

SEQ ID NO: 89924 - protein, 14 aa, Borrelia burgdorferi
LIFLFLFVVSLSAN

SEQ ID NO: 89925 - protein, 14 aa, Borrelia burgdorferi
IFLFLFVVSLSANI

SEQ ID NO: 89926 - protein, 14 aa, Borrelia burgdorferi
FLFLFVVSLSANIE

SEQ ID NO: 89927 - protein, 14 aa, Borrelia burgdorferi
LFLFVVSLSANIEE

SEQ ID NO: 89928 - protein, 14 aa, Borrelia burgdorferi
FLFVVSLSANIEEN

SEQ ID NO: 89929 - protein, 14 aa, Borrelia burgdorferi
LFVVSLSANIEENY

SEQ ID NO: 89930 - protein, 14 aa, Borrelia burgdorferi
FVVSLSANIEENYT

SEQ ID NO: 89931 - protein, 14 aa, Borrelia burgdorferi
VVSLSANIEENYTE

SEQ ID NO: 89932 - protein, 14 aa, Borrelia burgdorferi
VSLSANIEENYTET

SEQ ID NO: 89933 - protein, 14 aa, Borrelia burgdorferi
SLSANIEENYTETK

SEQ ID NO: 89934 - protein, 14 aa, Borrelia burgdorferi
LSANIEENYTETKR

SEQ ID NO: 89935 - protein, 14 aa, Borrelia burgdorferi
SANIEENYTETKRA

SEQ ID NO: 89936 - protein, 14 aa, Borrelia burgdorferi
ANIEENYTETKRAF

SEQ ID NO: 89937 - protein, 14 aa, Borrelia burgdorferi
NIEENYTETKRAFS

SEQ ID NO: 89938 - protein, 14 aa, Borrelia burgdorferi
IEENYTETKRAFSK

SEQ ID NO: 89939 - protein, 14 aa, Borrelia burgdorferi
EENYTETKRAFSKE

SEQ ID NO: 89940 - protein, 14 aa, Borrelia burgdorferi
ENYTETKRAFSKED

SEQ ID NO: 89941 - protein, 14 aa, Borrelia burgdorferi
NYTETKRAFSKEDF

SEQ ID NO: 89942 - protein, 14 aa, Borrelia burgdorferi
YTETKRAFSKEDFN

SEQ ID NO: 89943 - protein, 14 aa, Borrelia burgdorferi
TETKRAFSKEDFNL

SEQ ID NO: 89944 - protein, 14 aa, Borrelia burgdorferi
ETKRAFSKEDFNLI

SEQ ID NO: 89945 - protein, 14 aa, Borrelia burgdorferi
TKRAFSKEDFNLIN

SEQ ID NO: 89946 - protein, 14 aa, Borrelia burgdorferi
KRAFSKEDFNLINK

SEQ ID NO: 89947 - protein, 14 aa, Borrelia burgdorferi
RAFSKEDFNLINKR

SEQ ID NO: 89948 - protein, 14 aa, Borrelia burgdorferi
AFSKEDFNLINKRL

SEQ ID NO: 89949 - protein, 14 aa, Borrelia burgdorferi
FSKEDFNLINKRLD

SEQ ID NO: 89950 - protein, 14 aa, Borrelia burgdorferi
SKEDFNLINKRLDN

SEQ ID NO: 89951 - protein, 14 aa, Borrelia burgdorferi
KEDFNLINKRLDNY

SEQ ID NO: 89952 - protein, 14 aa, Borrelia burgdorferi
EDFNLINKRLDNYD

SEQ ID NO: 89953 - protein, 14 aa, Borrelia burgdorferi
DFNLINKRLDNYDF

SEQ ID NO: 89954 - protein, 14 aa, Borrelia burgdorferi
FNLINKRLDNYDFK

SEQ ID NO: 89955 - protein, 14 aa, Borrelia burgdorferi
NLINKRLDNYDFKN

SEQ ID NO: 89956 - protein, 14 aa, Borrelia burgdorferi
LINKRLDNYDFKNE

SEQ ID NO: 89957 - protein, 14 aa, Borrelia burgdorferi
INKRLDNYDFKNEY

SEQ ID NO: 89958 - protein, 14 aa, Borrelia burgdorferi
NKRLDNYDFKNEYE

SEQ ID NO: 89959 - protein, 14 aa, Borrelia burgdorferi
KRLDNYDFKNEYEK

SEQ ID NO: 89960 - protein, 14 aa, Borrelia burgdorferi
RLDNYDFKNEYEKS

SEQ ID NO: 89961 - protein, 14 aa, Borrelia burgdorferi
LDNYDFKNEYEKSH

SEQ ID NO: 89962 - protein, 14 aa, Borrelia burgdorferi
DNYDFKNEYEKSHV

SEQ ID NO: 89963 - protein, 14 aa, Borrelia burgdorferi
NYDFKNEYEKSHVF

SEQ ID NO: 89964 - protein, 14 aa, Borrelia burgdorferi
YDFKNEYEKSHVFS

SEQ ID NO: 89965 - protein, 14 aa, Borrelia burgdorferi
DFKNEYEKSHVFSD

SEQ ID NO: 89966 - protein, 14 aa, Borrelia burgdorferi
FKNEYEKSHVFSDA

SEQ ID NO: 89967 - protein, 14 aa, Borrelia burgdorferi
KNEYEKSHVFSDAP

SEQ ID NO: 89968 - protein, 14 aa, Borrelia burgdorferi
NEYEKSHVFSDAPR

SEQ ID NO: 89969 - protein, 14 aa, Borrelia burgdorferi
EYEKSHVFSDAPRI

SEQ ID NO: 89970 - protein, 14 aa, Borrelia burgdorferi
YEKSHVFSDAPRIR

SEQ ID NO: 89971 - protein, 14 aa, Borrelia burgdorferi
EKSHVFSDAPRIRG

SEQ ID NO: 89972 - protein, 14 aa, Borrelia burgdorferi
KSHVFSDAPRIRGD

SEQ ID NO: 89973 - protein, 14 aa, Borrelia burgdorferi
SHVFSDAPRIRGDL

SEQ ID NO: 89974 - protein, 14 aa, Borrelia burgdorferi
HVFSDAPRIRGDLR

SEQ ID NO: 89975 - protein, 14 aa, Borrelia burgdorferi
VFSDAPRIRGDLRK

SEQ ID NO: 89976 - protein, 14 aa, Borrelia burgdorferi
FSDAPRIRGDLRKI

SEQ ID NO: 89977 - protein, 14 aa, Borrelia burgdorferi
SDAPRIRGDLRKIG

SEQ ID NO: 89978 - protein, 14 aa, Borrelia burgdorferi
DAPRIRGDLRKIGI

SEQ ID NO: 89979 - protein, 14 aa, Borrelia burgdorferi
APRIRGDLRKIGIK

SEQ ID NO: 89980 - protein, 14 aa, Borrelia burgdorferi
PRIRGDLRKIGIKE

SEQ ID NO: 89981 - protein, 14 aa, Borrelia burgdorferi
RIRGDLRKIGIKEK

SEQ ID NO: 89982 - protein, 14 aa, Borrelia burgdorferi
IRGDLRKIGIKEKS

SEQ ID NO: 89983 - protein, 14 aa, Borrelia burgdorferi
RGDLRKIGIKEKSV

SEQ ID NO: 89984 - protein, 14 aa, Borrelia burgdorferi
GDLRKIGIKEKSVF

SEQ ID NO: 89985 - protein, 14 aa, Borrelia burgdorferi
DLRKIGIKEKSVFL

SEQ ID NO: 89986 - protein, 14 aa, Borrelia burgdorferi
LRKIGIKEKSVFLD

SEQ ID NO: 89987 - protein, 14 aa, Borrelia burgdorferi
RKIGIKEKSVFLDA

SEQ ID NO: 89988 - protein, 14 aa, Borrelia burgdorferi
KIGIKEKSVFLDAL

SEQ ID NO: 89989 - protein, 14 aa, Borrelia burgdorferi
IGIKEKSVFLDALE

SEQ ID NO: 89990 - protein, 14 aa, Borrelia burgdorferi
GIKEKSVFLDALEA

SEQ ID NO: 89991 - protein, 14 aa, Borrelia burgdorferi
IKEKSVFLDALEAI

SEQ ID NO: 89992 - protein, 14 aa, Borrelia burgdorferi
KEKSVFLDALEAIE

SEQ ID NO: 89993 - protein, 14 aa, Borrelia burgdorferi
EKSVFLDALEAIEY

SEQ ID NO: 89994 - protein, 14 aa, Borrelia burgdorferi
KSVFLDALEAIEYL

SEQ ID NO: 89995 - protein, 14 aa, Borrelia burgdorferi
SVFLDALEAIEYLI

SEQ ID NO: 89996 - protein, 14 aa, Borrelia burgdorferi
VFLDALEAIEYLIK

SEQ ID NO: 89997 - protein, 14 aa, Borrelia burgdorferi
FLDALEAIEYLIKI

SEQ ID NO: 89998 - protein, 14 aa, Borrelia burgdorferi
LDALEAIEYLIKIK

SEQ ID NO: 89999 - protein, 14 aa, Borrelia burgdorferi
DALEAIEYLIKIKI

SEQ ID NO: 90000 - protein, 14 aa, Borrelia burgdorferi
ALEAIEYLIKIKIS

SEQ ID NO: 90001 - protein, 14 aa, Borrelia burgdorferi
LEAIEYLIKIKIST

SEQ ID NO: 90002 - protein, 14 aa, Borrelia burgdorferi
EAIEYLIKIKISTD

SEQ ID NO: 90003 - protein, 14 aa, Borrelia burgdorferi
AIEYLIKIKISTDS

SEQ ID NO: 90004 - protein, 14 aa, Borrelia burgdorferi
IEYLIKIKISTDSI

SEQ ID NO: 90005 - protein, 14 aa, Borrelia burgdorferi
EYLIKIKISTDSIF

SEQ ID NO: 90006 - protein, 14 aa, Borrelia burgdorferi
YLIKIKISTDSIFL

SEQ ID NO: 90007 - protein, 14 aa, Borrelia burgdorferi
LIKIKISTDSIFLS

SEQ ID NO: 90008 - protein, 14 aa, Borrelia burgdorferi
IKIKISTDSIFLSE

SEQ ID NO: 90009 - protein, 14 aa, Borrelia burgdorferi
KIKISTDSIFLSED

SEQ ID NO: 90010 - protein, 14 aa, Borrelia burgdorferi
IKISTDSIFLSEDM

SEQ ID NO: 90011 - protein, 14 aa, Borrelia burgdorferi
KISTDSIFLSEDMI

SEQ ID NO: 90012 - protein, 14 aa, Borrelia burgdorferi
ISTDSIFLSEDMIR

SEQ ID NO: 90013 - protein, 14 aa, Borrelia burgdorferi
STDSIFLSEDMIRL

SEQ ID NO: 90014 - protein, 14 aa, Borrelia burgdorferi
TDSIFLSEDMIRLI

SEQ ID NO: 90015 - protein, 14 aa, Borrelia burgdorferi
DSIFLSEDMIRLIG

SEQ ID NO: 90016 - protein, 14 aa, Borrelia burgdorferi
SIFLSEDMIRLIGS

SEQ ID NO: 90017 - protein, 14 aa, Borrelia burgdorferi
IFLSEDMIRLIGSY

SEQ ID NO: 90018 - protein, 14 aa, Borrelia burgdorferi
FLSEDMIRLIGSYP

SEQ ID NO: 90019 - protein, 14 aa, Borrelia burgdorferi
LSEDMIRLIGSYPD

SEQ ID NO: 90020 - protein, 14 aa, Borrelia burgdorferi
SEDMIRLIGSYPDS

SEQ ID NO: 90021 - protein, 14 aa, Borrelia burgdorferi
EDMIRLIGSYPDSI

SEQ ID NO: 90022 - protein, 14 aa, Borrelia burgdorferi
DMIRLIGSYPDSIF

SEQ ID NO: 90023 - protein, 14 aa, Borrelia burgdorferi
MIRLIGSYPDSIFN

SEQ ID NO: 90024 - protein, 14 aa, Borrelia burgdorferi
IRLIGSYPDSIFNY

SEQ ID NO: 90025 - protein, 14 aa, Borrelia burgdorferi
RLIGSYPDSIFNYL

SEQ ID NO: 90026 - protein, 14 aa, Borrelia burgdorferi
LIGSYPDSIFNYLI

SEQ ID NO: 90027 - protein, 14 aa, Borrelia burgdorferi
IGSYPDSIFNYLIQ

SEQ ID NO: 90028 - protein, 14 aa, Borrelia burgdorferi
GSYPDSIFNYLIQL

SEQ ID NO: 90029 - protein, 14 aa, Borrelia burgdorferi
SYPDSIFNYLIQLN

SEQ ID NO: 90030 - protein, 14 aa, Borrelia burgdorferi
YPDSIFNYLIQLNS

SEQ ID NO: 90031 - protein, 14 aa, Borrelia burgdorferi
PDSIFNYLIQLNSD

SEQ ID NO: 90032 - protein, 14 aa, Borrelia burgdorferi
DSIFNYLIQLNSDK

SEQ ID NO: 90033 - protein, 14 aa, Borrelia burgdorferi
SIFNYLIQLNSDKI

SEQ ID NO: 90034 - protein, 14 aa, Borrelia burgdorferi
IFNYLIQLNSDKID

SEQ ID NO: 90035 - protein, 14 aa, Borrelia burgdorferi
FNYLIQLNSDKIDY

SEQ ID NO: 90036 - protein, 14 aa, Borrelia burgdorferi
NYLIQLNSDKIDYA

SEQ ID NO: 90037 - protein, 14 aa, Borrelia burgdorferi
YLIQLNSDKIDYAE

SEQ ID NO: 90038 - protein, 14 aa, Borrelia burgdorferi
LIQLNSDKIDYAEK

SEQ ID NO: 90039 - protein, 14 aa, Borrelia burgdorferi
IQLNSDKIDYAEKY

SEQ ID NO: 90040 - protein, 14 aa, Borrelia burgdorferi
QLNSDKIDYAEKYG

SEQ ID NO: 90041 - protein, 14 aa, Borrelia burgdorferi
LNSDKIDYAEKYGD

SEQ ID NO: 90042 - protein, 14 aa, Borrelia burgdorferi
NSDKIDYAEKYGDN

SEQ ID NO: 90043 - protein, 14 aa, Borrelia burgdorferi
SDKIDYAEKYGDNA

SEQ ID NO: 90044 - protein, 14 aa, Borrelia burgdorferi
DKIDYAEKYGDNAR

SEQ ID NO: 90045 - protein, 14 aa, Borrelia burgdorferi
KIDYAEKYGDNARN

SEQ ID NO: 90046 - protein, 14 aa, Borrelia burgdorferi
IDYAEKYGDNARNN

SEQ ID NO: 90047 - protein, 14 aa, Borrelia burgdorferi
DYAEKYGDNARNNF

SEQ ID NO: 90048 - protein, 14 aa, Borrelia burgdorferi
YAEKYGDNARNNFK

SEQ ID NO: 90049 - protein, 14 aa, Borrelia burgdorferi
AEKYGDNARNNFKK

SEQ ID NO: 90050 - protein, 14 aa, Borrelia burgdorferi
EKYGDNARNNFKKD

SEQ ID NO: 90051 - protein, 14 aa, Borrelia burgdorferi
KYGDNARNNFKKDY

SEQ ID NO: 90052 - protein, 14 aa, Borrelia burgdorferi
YGDNARNNFKKDYS

SEQ ID NO: 90053 - protein, 14 aa, Borrelia burgdorferi
GDNARNNFKKDYSE

SEQ ID NO: 90054 - protein, 14 aa, Borrelia burgdorferi
DNARNNFKKDYSED

SEQ ID NO: 90055 - protein, 14 aa, Borrelia burgdorferi
NARNNFKKDYSEDK

SEQ ID NO: 90056 - protein, 14 aa, Borrelia burgdorferi
ARNNFKKDYSEDKA

SEQ ID NO: 90057 - protein, 14 aa, Borrelia burgdorferi
RNNFKKDYSEDKAN

SEQ ID NO: 90058 - protein, 14 aa, Borrelia burgdorferi
NNFKKDYSEDKANT

SEQ ID NO: 90059 - protein, 14 aa, Borrelia burgdorferi
NFKKDYSEDKANTV

SEQ ID NO: 90060 - protein, 14 aa, Borrelia burgdorferi
FKKDYSEDKANTVK

SEQ ID NO: 90061 - protein, 14 aa, Borrelia burgdorferi
KKDYSEDKANTVKQ

SEQ ID NO: 90062 - protein, 14 aa, Borrelia burgdorferi
KDYSEDKANTVKQI

SEQ ID NO: 90063 - protein, 14 aa, Borrelia burgdorferi
DYSEDKANTVKQIL

SEQ ID NO: 90064 - protein, 14 aa, Borrelia burgdorferi
YSEDKANTVKQILK

SEQ ID NO: 90065 - protein, 14 aa, Borrelia burgdorferi
SEDKANTVKQILKQ

SEQ ID NO: 90066 - protein, 14 aa, Borrelia burgdorferi
EDKANTVKQILKQI

SEQ ID NO: 90067 - protein, 14 aa, Borrelia burgdorferi
DKANTVKQILKQIL

SEQ ID NO: 90068 - protein, 14 aa, Borrelia burgdorferi
KANTVKQILKQILA

SEQ ID NO: 90069 - protein, 14 aa, Borrelia burgdorferi
ANTVKQILKQILAD

SEQ ID NO: 90070 - protein, 14 aa, Borrelia burgdorferi
NTVKQILKQILADL

SEQ ID NO: 90071 - protein, 14 aa, Borrelia burgdorferi
TVKQILKQILADLP

SEQ ID NO: 90072 - protein, 14 aa, Borrelia burgdorferi
VKQILKQILADLPK

SEQ ID NO: 90073 - protein, 14 aa, Borrelia burgdorferi
KQILKQILADLPKD

SEQ ID NO: 90074 - protein, 15 aa, Borrelia burgdorferi
MKKISLLIFLFLFVV

SEQ ID NO: 90075 - protein, 15 aa, Borrelia burgdorferi
KKISLLIFLFLFVVS

SEQ ID NO: 90076 - protein, 15 aa, Borrelia burgdorferi
KISLLIFLFLFVVSL

SEQ ID NO: 90077 - protein, 15 aa, Borrelia burgdorferi
ISLLIFLFLFVVSLS

SEQ ID NO: 90078 - protein, 15 aa, Borrelia burgdorferi
SLLIFLFLFVVSLSA

SEQ ID NO: 90079 - protein, 15 aa, Borrelia burgdorferi
LLIFLFLFVVSLSAN

SEQ ID NO: 90080 - protein, 15 aa, Borrelia burgdorferi
LIFLFLFVVSLSANI

SEQ ID NO: 90081 - protein, 15 aa, Borrelia burgdorferi
IFLFLFVVSLSANIE

SEQ ID NO: 90082 - protein, 15 aa, Borrelia burgdorferi
FLFLFVVSLSANIEE

SEQ ID NO: 90083 - protein, 15 aa, Borrelia burgdorferi
LFLFVVSLSANIEEN

SEQ ID NO: 90084 - protein, 15 aa, Borrelia burgdorferi
FLFVVSLSANIEENY

SEQ ID NO: 90085 - protein, 15 aa, Borrelia burgdorferi
LFVVSLSANIEENYT

SEQ ID NO: 90086 - protein, 15 aa, Borrelia burgdorferi
FVVSLSANIEENYTE

SEQ ID NO: 90087 - protein, 15 aa, Borrelia burgdorferi
VVSLSANIEENYTET

SEQ ID NO: 90088 - protein, 15 aa, Borrelia burgdorferi
VSLSANIEENYTETK

SEQ ID NO: 90089 - protein, 15 aa, Borrelia burgdorferi
SLSANIEENYTETKR

SEQ ID NO: 90090 - protein, 15 aa, Borrelia burgdorferi
LSANIEENYTETKRA

SEQ ID NO: 90091 - protein, 15 aa, Borrelia burgdorferi
SANIEENYTETKRAF

SEQ ID NO: 90092 - protein, 15 aa, Borrelia burgdorferi
ANIEENYTETKRAFS

SEQ ID NO: 90093 - protein, 15 aa, Borrelia burgdorferi
NIEENYTETKRAFSK

SEQ ID NO: 90094 - protein, 15 aa, Borrelia burgdorferi
IEENYTETKRAFSKE

SEQ ID NO: 90095 - protein, 15 aa, Borrelia burgdorferi
EENYTETKRAFSKED

SEQ ID NO: 90096 - protein, 15 aa, Borrelia burgdorferi
ENYTETKRAFSKEDF

SEQ ID NO: 90097 - protein, 15 aa, Borrelia burgdorferi
NYTETKRAFSKEDFN

SEQ ID NO: 90098 - protein, 15 aa, Borrelia burgdorferi
YTETKRAFSKEDFNL

SEQ ID NO: 90099 - protein, 15 aa, Borrelia burgdorferi
TETKRAFSKEDFNLI

SEQ ID NO: 90100 - protein, 15 aa, Borrelia burgdorferi
ETKRAFSKEDFNLIN

SEQ ID NO: 90101 - protein, 15 aa, Borrelia burgdorferi
TKRAFSKEDFNLINK

SEQ ID NO: 90102 - protein, 15 aa, Borrelia burgdorferi
KRAFSKEDFNLINKR

SEQ ID NO: 90103 - protein, 15 aa, Borrelia burgdorferi
RAFSKEDFNLINKRL

SEQ ID NO: 90104 - protein, 15 aa, Borrelia burgdorferi
AFSKEDFNLINKRLD

SEQ ID NO: 90105 - protein, 15 aa, Borrelia burgdorferi
FSKEDFNLINKRLDN

SEQ ID NO: 90106 - protein, 15 aa, Borrelia burgdorferi
SKEDFNLINKRLDNY

SEQ ID NO: 90107 - protein, 15 aa, Borrelia burgdorferi
KEDFNLINKRLDNYD

SEQ ID NO: 90108 - protein, 15 aa, Borrelia burgdorferi
EDFNLINKRLDNYDF

SEQ ID NO: 90109 - protein, 15 aa, Borrelia burgdorferi
DFNLINKRLDNYDFK

SEQ ID NO: 90110 - protein, 15 aa, Borrelia burgdorferi
FNLINKRLDNYDFKN

SEQ ID NO: 90111 - protein, 15 aa, Borrelia burgdorferi
NLINKRLDNYDFKNE

SEQ ID NO: 90112 - protein, 15 aa, Borrelia burgdorferi
LINKRLDNYDFKNEY

SEQ ID NO: 90113 - protein, 15 aa, Borrelia burgdorferi
INKRLDNYDFKNEYE

SEQ ID NO: 90114 - protein, 15 aa, Borrelia burgdorferi
NKRLDNYDFKNEYEK

SEQ ID NO: 90115 - protein, 15 aa, Borrelia burgdorferi
KRLDNYDFKNEYEKS

SEQ ID NO: 90116 - protein, 15 aa, Borrelia burgdorferi
RLDNYDFKNEYEKSH

SEQ ID NO: 90117 - protein, 15 aa, Borrelia burgdorferi
LDNYDFKNEYEKSHV

SEQ ID NO: 90118 - protein, 15 aa, Borrelia burgdorferi
DNYDFKNEYEKSHVF

SEQ ID NO: 90119 - protein, 15 aa, Borrelia burgdorferi
NYDFKNEYEKSHVFS

SEQ ID NO: 90120 - protein, 15 aa, Borrelia burgdorferi
YDFKNEYEKSHVFSD

SEQ ID NO: 90121 - protein, 15 aa, Borrelia burgdorferi
DFKNEYEKSHVFSDA

SEQ ID NO: 90122 - protein, 15 aa, Borrelia burgdorferi
FKNEYEKSHVFSDAP

SEQ ID NO: 90123 - protein, 15 aa, Borrelia burgdorferi
KNEYEKSHVFSDAPR

SEQ ID NO: 90124 - protein, 15 aa, Borrelia burgdorferi
NEYEKSHVFSDAPRI

SEQ ID NO: 90125 - protein, 15 aa, Borrelia burgdorferi
EYEKSHVFSDAPRIR

SEQ ID NO: 90126 - protein, 15 aa, Borrelia burgdorferi
YEKSHVFSDAPRIRG

SEQ ID NO: 90127 - protein, 15 aa, Borrelia burgdorferi
EKSHVFSDAPRIRGD

SEQ ID NO: 90128 - protein, 15 aa, Borrelia burgdorferi
KSHVFSDAPRIRGDL

SEQ ID NO: 90129 - protein, 15 aa, Borrelia burgdorferi
SHVFSDAPRIRGDLR

SEQ ID NO: 90130 - protein, 15 aa, Borrelia burgdorferi
HVFSDAPRIRGDLRK

SEQ ID NO: 90131 - protein, 15 aa, Borrelia burgdorferi
VFSDAPRIRGDLRKI

SEQ ID NO: 90132 - protein, 15 aa, Borrelia burgdorferi
FSDAPRIRGDLRKIG

SEQ ID NO: 90133 - protein, 15 aa, Borrelia burgdorferi
SDAPRIRGDLRKIGI

SEQ ID NO: 90134 - protein, 15 aa, Borrelia burgdorferi
DAPRIRGDLRKIGIK

SEQ ID NO: 90135 - protein, 15 aa, Borrelia burgdorferi
APRIRGDLRKIGIKE

SEQ ID NO: 90136 - protein, 15 aa, Borrelia burgdorferi
PRIRGDLRKIGIKEK

SEQ ID NO: 90137 - protein, 15 aa, Borrelia burgdorferi
RIRGDLRKIGIKEKS

SEQ ID NO: 90138 - protein, 15 aa, Borrelia burgdorferi
IRGDLRKIGIKEKSV

SEQ ID NO: 90139 - protein, 15 aa, Borrelia burgdorferi
RGDLRKIGIKEKSVF

SEQ ID NO: 90140 - protein, 15 aa, Borrelia burgdorferi
GDLRKIGIKEKSVFL

SEQ ID NO: 90141 - protein, 15 aa, Borrelia burgdorferi
DLRKIGIKEKSVFLD

SEQ ID NO: 90142 - protein, 15 aa, Borrelia burgdorferi
LRKIGIKEKSVFLDA

SEQ ID NO: 90143 - protein, 15 aa, Borrelia burgdorferi
RKIGIKEKSVFLDAL

SEQ ID NO: 90144 - protein, 15 aa, Borrelia burgdorferi
KIGIKEKSVFLDALE

SEQ ID NO: 90145 - protein, 15 aa, Borrelia burgdorferi
IGIKEKSVFLDALEA

SEQ ID NO: 90146 - protein, 15 aa, Borrelia burgdorferi
GIKEKSVFLDALEAI

SEQ ID NO: 90147 - protein, 15 aa, Borrelia burgdorferi
IKEKSVFLDALEAIE

SEQ ID NO: 90148 - protein, 15 aa, Borrelia burgdorferi
KEKSVFLDALEAIEY

SEQ ID NO: 90149 - protein, 15 aa, Borrelia burgdorferi
EKSVFLDALEAIEYL

SEQ ID NO: 90150 - protein, 15 aa, Borrelia burgdorferi
KSVFLDALEAIEYLI

SEQ ID NO: 90151 - protein, 15 aa, Borrelia burgdorferi
SVFLDALEAIEYLIK

SEQ ID NO: 90152 - protein, 15 aa, Borrelia burgdorferi
VFLDALEAIEYLIKI

SEQ ID NO: 90153 - protein, 15 aa, Borrelia burgdorferi
FLDALEAIEYLIKIK

SEQ ID NO: 90154 - protein, 15 aa, Borrelia burgdorferi
LDALEAIEYLIKIKI

SEQ ID NO: 90155 - protein, 15 aa, Borrelia burgdorferi
DALEAIEYLIKIKIS

SEQ ID NO: 90156 - protein, 15 aa, Borrelia burgdorferi
ALEAIEYLIKIKIST

SEQ ID NO: 90157 - protein, 15 aa, Borrelia burgdorferi
LEAIEYLIKIKISTD

SEQ ID NO: 90158 - protein, 15 aa, Borrelia burgdorferi
EAIEYLIKIKISTDS

SEQ ID NO: 90159 - protein, 15 aa, Borrelia burgdorferi
AIEYLIKIKISTDSI

SEQ ID NO: 90160 - protein, 15 aa, Borrelia burgdorferi
IEYLIKIKISTDSIF

SEQ ID NO: 90161 - protein, 15 aa, Borrelia burgdorferi
EYLIKIKISTDSIFL

SEQ ID NO: 90162 - protein, 15 aa, Borrelia burgdorferi
YLIKIKISTDSIFLS

SEQ ID NO: 90163 - protein, 15 aa, Borrelia burgdorferi
LIKIKISTDSIFLSE

SEQ ID NO: 90164 - protein, 15 aa, Borrelia burgdorferi
IKIKISTDSIFLSED

SEQ ID NO: 90165 - protein, 15 aa, Borrelia burgdorferi
KIKISTDSIFLSEDM

SEQ ID NO: 90166 - protein, 15 aa, Borrelia burgdorferi
IKISTDSIFLSEDMI

SEQ ID NO: 90167 - protein, 15 aa, Borrelia burgdorferi
KISTDSIFLSEDMIR

SEQ ID NO: 90168 - protein, 15 aa, Borrelia burgdorferi
ISTDSIFLSEDMIRL

SEQ ID NO: 90169 - protein, 15 aa, Borrelia burgdorferi
STDSIFLSEDMIRLI

SEQ ID NO: 90170 - protein, 15 aa, Borrelia burgdorferi
TDSIFLSEDMIRLIG

SEQ ID NO: 90171 - protein, 15 aa, Borrelia burgdorferi
DSIFLSEDMIRLIGS

SEQ ID NO: 90172 - protein, 15 aa, Borrelia burgdorferi
SIFLSEDMIRLIGSY

SEQ ID NO: 90173 - protein, 15 aa, Borrelia burgdorferi
IFLSEDMIRLIGSYP

SEQ ID NO: 90174 - protein, 15 aa, Borrelia burgdorferi
FLSEDMIRLIGSYPD

SEQ ID NO: 90175 - protein, 15 aa, Borrelia burgdorferi
LSEDMIRLIGSYPDS

SEQ ID NO: 90176 - protein, 15 aa, Borrelia burgdorferi
SEDMIRLIGSYPDSI

SEQ ID NO: 90177 - protein, 15 aa, Borrelia burgdorferi
EDMIRLIGSYPDSIF

SEQ ID NO: 90178 - protein, 15 aa, Borrelia burgdorferi
DMIRLIGSYPDSIFN

SEQ ID NO: 90179 - protein, 15 aa, Borrelia burgdorferi
MIRLIGSYPDSIFNY

SEQ ID NO: 90180 - protein, 15 aa, Borrelia burgdorferi
IRLIGSYPDSIFNYL

SEQ ID NO: 90181 - protein, 15 aa, Borrelia burgdorferi
RLIGSYPDSIFNYLI

SEQ ID NO: 90182 - protein, 15 aa, Borrelia burgdorferi
LIGSYPDSIFNYLIQ

SEQ ID NO: 90183 - protein, 15 aa, Borrelia burgdorferi
IGSYPDSIFNYLIQL

SEQ ID NO: 90184 - protein, 15 aa, Borrelia burgdorferi
GSYPDSIFNYLIQLN

SEQ ID NO: 90185 - protein, 15 aa, Borrelia burgdorferi
SYPDSIFNYLIQLNS

SEQ ID NO: 90186 - protein, 15 aa, Borrelia burgdorferi
YPDSIFNYLIQLNSD

SEQ ID NO: 90187 - protein, 15 aa, Borrelia burgdorferi
PDSIFNYLIQLNSDK

SEQ ID NO: 90188 - protein, 15 aa, Borrelia burgdorferi
DSIFNYLIQLNSDKI

SEQ ID NO: 90189 - protein, 15 aa, Borrelia burgdorferi
SIFNYLIQLNSDKID

SEQ ID NO: 90190 - protein, 15 aa, Borrelia burgdorferi
IFNYLIQLNSDKIDY

SEQ ID NO: 90191 - protein, 15 aa, Borrelia burgdorferi
FNYLIQLNSDKIDYA

SEQ ID NO: 90192 - protein, 15 aa, Borrelia burgdorferi
NYLIQLNSDKIDYAE

SEQ ID NO: 90193 - protein, 15 aa, Borrelia burgdorferi
YLIQLNSDKIDYAEK

SEQ ID NO: 90194 - protein, 15 aa, Borrelia burgdorferi
LIQLNSDKIDYAEKY

SEQ ID NO: 90195 - protein, 15 aa, Borrelia burgdorferi
IQLNSDKIDYAEKYG

SEQ ID NO: 90196 - protein, 15 aa, Borrelia burgdorferi
QLNSDKIDYAEKYGD

SEQ ID NO: 90197 - protein, 15 aa, Borrelia burgdorferi
LNSDKIDYAEKYGDN

SEQ ID NO: 90198 - protein, 15 aa, Borrelia burgdorferi
NSDKIDYAEKYGDNA

SEQ ID NO: 90199 - protein, 15 aa, Borrelia burgdorferi
SDKIDYAEKYGDNAR

SEQ ID NO: 90200 - protein, 15 aa, Borrelia burgdorferi
DKIDYAEKYGDNARN

SEQ ID NO: 90201 - protein, 15 aa, Borrelia burgdorferi
KIDYAEKYGDNARNN

SEQ ID NO: 90202 - protein, 15 aa, Borrelia burgdorferi
IDYAEKYGDNARNNF

SEQ ID NO: 90203 - protein, 15 aa, Borrelia burgdorferi
DYAEKYGDNARNNFK

SEQ ID NO: 90204 - protein, 15 aa, Borrelia burgdorferi
YAEKYGDNARNNFKK

SEQ ID NO: 90205 - protein, 15 aa, Borrelia burgdorferi
AEKYGDNARNNFKKD

SEQ ID NO: 90206 - protein, 15 aa, Borrelia burgdorferi
EKYGDNARNNFKKDY

SEQ ID NO: 90207 - protein, 15 aa, Borrelia burgdorferi
KYGDNARNNFKKDYS

SEQ ID NO: 90208 - protein, 15 aa, Borrelia burgdorferi
YGDNARNNFKKDYSE

SEQ ID NO: 90209 - protein, 15 aa, Borrelia burgdorferi
GDNARNNFKKDYSED

SEQ ID NO: 90210 - protein, 15 aa, Borrelia burgdorferi
DNARNNFKKDYSEDK

SEQ ID NO: 90211 - protein, 15 aa, Borrelia burgdorferi
NARNNFKKDYSEDKA

SEQ ID NO: 90212 - protein, 15 aa, Borrelia burgdorferi
ARNNFKKDYSEDKAN

SEQ ID NO: 90213 - protein, 15 aa, Borrelia burgdorferi
RNNFKKDYSEDKANT

SEQ ID NO: 90214 - protein, 15 aa, Borrelia burgdorferi
NNFKKDYSEDKANTV

SEQ ID NO: 90215 - protein, 15 aa, Borrelia burgdorferi
NFKKDYSEDKANTVK

SEQ ID NO: 90216 - protein, 15 aa, Borrelia burgdorferi
FKKDYSEDKANTVKQ

SEQ ID NO: 90217 - protein, 15 aa, Borrelia burgdorferi
KKDYSEDKANTVKQI

SEQ ID NO: 90218 - protein, 15 aa, Borrelia burgdorferi
KDYSEDKANTVKQIL

SEQ ID NO: 90219 - protein, 15 aa, Borrelia burgdorferi
DYSEDKANTVKQILK

SEQ ID NO: 90220 - protein, 15 aa, Borrelia burgdorferi
YSEDKANTVKQILKQ

SEQ ID NO: 90221 - protein, 15 aa, Borrelia burgdorferi
SEDKANTVKQILKQI

SEQ ID NO: 90222 - protein, 15 aa, Borrelia burgdorferi
EDKANTVKQILKQIL

SEQ ID NO: 90223 - protein, 15 aa, Borrelia burgdorferi
DKANTVKQILKQILA

SEQ ID NO: 90224 - protein, 15 aa, Borrelia burgdorferi
KANTVKQILKQILAD

SEQ ID NO: 90225 - protein, 15 aa, Borrelia burgdorferi
ANTVKQILKQILADL

SEQ ID NO: 90226 - protein, 15 aa, Borrelia burgdorferi
NTVKQILKQILADLP

SEQ ID NO: 90227 - protein, 15 aa, Borrelia burgdorferi
TVKQILKQILADLPK

SEQ ID NO: 90228 - protein, 15 aa, Borrelia burgdorferi
VKQILKQILADLPKD

SEQ ID NO: 90229 - protein, 16 aa, Borrelia burgdorferi
MKKISLLIFLFLFVVS

SEQ ID NO: 90230 - protein, 16 aa, Borrelia burgdorferi
KKISLLIFLFLFVVSL

SEQ ID NO: 90231 - protein, 16 aa, Borrelia burgdorferi
KISLLIFLFLFVVSLS

SEQ ID NO: 90232 - protein, 16 aa, Borrelia burgdorferi
ISLLIFLFLFVVSLSA

SEQ ID NO: 90233 - protein, 16 aa, Borrelia burgdorferi
SLLIFLFLFVVSLSAN

SEQ ID NO: 90234 - protein, 16 aa, Borrelia burgdorferi
LLIFLFLFVVSLSANI

SEQ ID NO: 90235 - protein, 16 aa, Borrelia burgdorferi
LIFLFLFVVSLSANIE

SEQ ID NO: 90236 - protein, 16 aa, Borrelia burgdorferi
IFLFLFVVSLSANIEE

SEQ ID NO: 90237 - protein, 16 aa, Borrelia burgdorferi
FLFLFVVSLSANIEEN

SEQ ID NO: 90238 - protein, 16 aa, Borrelia burgdorferi
LFLFVVSLSANIEENY

SEQ ID NO: 90239 - protein, 16 aa, Borrelia burgdorferi
FLFVVSLSANIEENYT

SEQ ID NO: 90240 - protein, 16 aa, Borrelia burgdorferi
LFVVSLSANIEENYTE

SEQ ID NO: 90241 - protein, 16 aa, Borrelia burgdorferi
FVVSLSANIEENYTET

SEQ ID NO: 90242 - protein, 16 aa, Borrelia burgdorferi
VVSLSANIEENYTETK

SEQ ID NO: 90243 - protein, 16 aa, Borrelia burgdorferi
VSLSANIEENYTETKR

SEQ ID NO: 90244 - protein, 16 aa, Borrelia burgdorferi
SLSANIEENYTETKRA

SEQ ID NO: 90245 - protein, 16 aa, Borrelia burgdorferi
LSANIEENYTETKRAF

SEQ ID NO: 90246 - protein, 16 aa, Borrelia burgdorferi
SANIEENYTETKRAFS

SEQ ID NO: 90247 - protein, 16 aa, Borrelia burgdorferi
ANIEENYTETKRAFSK

SEQ ID NO: 90248 - protein, 16 aa, Borrelia burgdorferi
NIEENYTETKRAFSKE

SEQ ID NO: 90249 - protein, 16 aa, Borrelia burgdorferi
IEENYTETKRAFSKED

SEQ ID NO: 90250 - protein, 16 aa, Borrelia burgdorferi
EENYTETKRAFSKEDF

SEQ ID NO: 90251 - protein, 16 aa, Borrelia burgdorferi
ENYTETKRAFSKEDFN

SEQ ID NO: 90252 - protein, 16 aa, Borrelia burgdorferi
NYTETKRAFSKEDFNL

SEQ ID NO: 90253 - protein, 16 aa, Borrelia burgdorferi
YTETKRAFSKEDFNLI

SEQ ID NO: 90254 - protein, 16 aa, Borrelia burgdorferi
TETKRAFSKEDFNLIN

SEQ ID NO: 90255 - protein, 16 aa, Borrelia burgdorferi
ETKRAFSKEDFNLINK

SEQ ID NO: 90256 - protein, 16 aa, Borrelia burgdorferi
TKRAFSKEDFNLINKR

SEQ ID NO: 90257 - protein, 16 aa, Borrelia burgdorferi
KRAFSKEDFNLINKRL

SEQ ID NO: 90258 - protein, 16 aa, Borrelia burgdorferi
RAFSKEDFNLINKRLD

SEQ ID NO: 90259 - protein, 16 aa, Borrelia burgdorferi
AFSKEDFNLINKRLDN

SEQ ID NO: 90260 - protein, 16 aa, Borrelia burgdorferi
FSKEDFNLINKRLDNY

SEQ ID NO: 90261 - protein, 16 aa, Borrelia burgdorferi
SKEDFNLINKRLDNYD

SEQ ID NO: 90262 - protein, 16 aa, Borrelia burgdorferi
KEDFNLINKRLDNYDF

SEQ ID NO: 90263 - protein, 16 aa, Borrelia burgdorferi
EDFNLINKRLDNYDFK

SEQ ID NO: 90264 - protein, 16 aa, Borrelia burgdorferi
DFNLINKRLDNYDFKN

SEQ ID NO: 90265 - protein, 16 aa, Borrelia burgdorferi
FNLINKRLDNYDFKNE

SEQ ID NO: 90266 - protein, 16 aa, Borrelia burgdorferi
NLINKRLDNYDFKNEY

SEQ ID NO: 90267 - protein, 16 aa, Borrelia burgdorferi
LINKRLDNYDFKNEYE

SEQ ID NO: 90268 - protein, 16 aa, Borrelia burgdorferi
INKRLDNYDFKNEYEK

SEQ ID NO: 90269 - protein, 16 aa, Borrelia burgdorferi
NKRLDNYDFKNEYEKS

SEQ ID NO: 90270 - protein, 16 aa, Borrelia burgdorferi
KRLDNYDFKNEYEKSH

SEQ ID NO: 90271 - protein, 16 aa, Borrelia burgdorferi
RLDNYDFKNEYEKSHV

SEQ ID NO: 90272 - protein, 16 aa, Borrelia burgdorferi
LDNYDFKNEYEKSHVF

SEQ ID NO: 90273 - protein, 16 aa, Borrelia burgdorferi
DNYDFKNEYEKSHVFS

SEQ ID NO: 90274 - protein, 16 aa, Borrelia burgdorferi
NYDFKNEYEKSHVFSD

SEQ ID NO: 90275 - protein, 16 aa, Borrelia burgdorferi
YDFKNEYEKSHVFSDA

SEQ ID NO: 90276 - protein, 16 aa, Borrelia burgdorferi
DFKNEYEKSHVFSDAP

SEQ ID NO: 90277 - protein, 16 aa, Borrelia burgdorferi
FKNEYEKSHVFSDAPR

SEQ ID NO: 90278 - protein, 16 aa, Borrelia burgdorferi
KNEYEKSHVFSDAPRI

SEQ ID NO: 90279 - protein, 16 aa, Borrelia burgdorferi
NEYEKSHVFSDAPRIR

SEQ ID NO: 90280 - protein, 16 aa, Borrelia burgdorferi
EYEKSHVFSDAPRIRG

SEQ ID NO: 90281 - protein, 16 aa, Borrelia burgdorferi
YEKSHVFSDAPRIRGD

SEQ ID NO: 90282 - protein, 16 aa, Borrelia burgdorferi
EKSHVFSDAPRIRGDL

SEQ ID NO: 90283 - protein, 16 aa, Borrelia burgdorferi
KSHVFSDAPRIRGDLR

SEQ ID NO: 90284 - protein, 16 aa, Borrelia burgdorferi
SHVFSDAPRIRGDLRK

SEQ ID NO: 90285 - protein, 16 aa, Borrelia burgdorferi
HVFSDAPRIRGDLRKI

SEQ ID NO: 90286 - protein, 16 aa, Borrelia burgdorferi
VFSDAPRIRGDLRKIG

SEQ ID NO: 90287 - protein, 16 aa, Borrelia burgdorferi
FSDAPRIRGDLRKIGI

SEQ ID NO: 90288 - protein, 16 aa, Borrelia burgdorferi
SDAPRIRGDLRKIGIK

SEQ ID NO: 90289 - protein, 16 aa, Borrelia burgdorferi
DAPRIRGDLRKIGIKE

SEQ ID NO: 90290 - protein, 16 aa, Borrelia burgdorferi
APRIRGDLRKIGIKEK

SEQ ID NO: 90291 - protein, 16 aa, Borrelia burgdorferi
PRIRGDLRKIGIKEKS

SEQ ID NO: 90292 - protein, 16 aa, Borrelia burgdorferi
RIRGDLRKIGIKEKSV

SEQ ID NO: 90293 - protein, 16 aa, Borrelia burgdorferi
IRGDLRKIGIKEKSVF

SEQ ID NO: 90294 - protein, 16 aa, Borrelia burgdorferi
RGDLRKIGIKEKSVFL

SEQ ID NO: 90295 - protein, 16 aa, Borrelia burgdorferi
GDLRKIGIKEKSVFLD

SEQ ID NO: 90296 - protein, 16 aa, Borrelia burgdorferi
DLRKIGIKEKSVFLDA

SEQ ID NO: 90297 - protein, 16 aa, Borrelia burgdorferi
LRKIGIKEKSVFLDAL

SEQ ID NO: 90298 - protein, 16 aa, Borrelia burgdorferi
RKIGIKEKSVFLDALE

SEQ ID NO: 90299 - protein, 16 aa, Borrelia burgdorferi
KIGIKEKSVFLDALEA

SEQ ID NO: 90300 - protein, 16 aa, Borrelia burgdorferi
IGIKEKSVFLDALEAI

SEQ ID NO: 90301 - protein, 16 aa, Borrelia burgdorferi
GIKEKSVFLDALEAIE

SEQ ID NO: 90302 - protein, 16 aa, Borrelia burgdorferi
IKEKSVFLDALEAIEY

SEQ ID NO: 90303 - protein, 16 aa, Borrelia burgdorferi
KEKSVFLDALEAIEYL

SEQ ID NO: 90304 - protein, 16 aa, Borrelia burgdorferi
EKSVFLDALEAIEYLI

SEQ ID NO: 90305 - protein, 16 aa, Borrelia burgdorferi
KSVFLDALEAIEYLIK

SEQ ID NO: 90306 - protein, 16 aa, Borrelia burgdorferi
SVFLDALEAIEYLIKI

SEQ ID NO: 90307 - protein, 16 aa, Borrelia burgdorferi
VFLDALEAIEYLIKIK

SEQ ID NO: 90308 - protein, 16 aa, Borrelia burgdorferi
FLDALEAIEYLIKIKI

SEQ ID NO: 90309 - protein, 16 aa, Borrelia burgdorferi
LDALEAIEYLIKIKIS

SEQ ID NO: 90310 - protein, 16 aa, Borrelia burgdorferi
DALEAIEYLIKIKIST

SEQ ID NO: 90311 - protein, 16 aa, Borrelia burgdorferi
ALEAIEYLIKIKISTD

SEQ ID NO: 90312 - protein, 16 aa, Borrelia burgdorferi
LEAIEYLIKIKISTDS

SEQ ID NO: 90313 - protein, 16 aa, Borrelia burgdorferi
EAIEYLIKIKISTDSI

SEQ ID NO: 90314 - protein, 16 aa, Borrelia burgdorferi
AIEYLIKIKISTDSIF

SEQ ID NO: 90315 - protein, 16 aa, Borrelia burgdorferi
IEYLIKIKISTDSIFL

SEQ ID NO: 90316 - protein, 16 aa, Borrelia burgdorferi
EYLIKIKISTDSIFLS

SEQ ID NO: 90317 - protein, 16 aa, Borrelia burgdorferi
YLIKIKISTDSIFLSE

SEQ ID NO: 90318 - protein, 16 aa, Borrelia burgdorferi
LIKIKISTDSIFLSED

SEQ ID NO: 90319 - protein, 16 aa, Borrelia burgdorferi
IKIKISTDSIFLSEDM

SEQ ID NO: 90320 - protein, 16 aa, Borrelia burgdorferi
KIKISTDSIFLSEDMI

SEQ ID NO: 90321 - protein, 16 aa, Borrelia burgdorferi
IKISTDSIFLSEDMIR

SEQ ID NO: 90322 - protein, 16 aa, Borrelia burgdorferi
KISTDSIFLSEDMIRL

SEQ ID NO: 90323 - protein, 16 aa, Borrelia burgdorferi
ISTDSIFLSEDMIRLI

SEQ ID NO: 90324 - protein, 16 aa, Borrelia burgdorferi
STDSIFLSEDMIRLIG

SEQ ID NO: 90325 - protein, 16 aa, Borrelia burgdorferi
TDSIFLSEDMIRLIGS

SEQ ID NO: 90326 - protein, 16 aa, Borrelia burgdorferi
DSIFLSEDMIRLIGSY

SEQ ID NO: 90327 - protein, 16 aa, Borrelia burgdorferi
SIFLSEDMIRLIGSYP

SEQ ID NO: 90328 - protein, 16 aa, Borrelia burgdorferi
IFLSEDMIRLIGSYPD

SEQ ID NO: 90329 - protein, 16 aa, Borrelia burgdorferi
FLSEDMIRLIGSYPDS

SEQ ID NO: 90330 - protein, 16 aa, Borrelia burgdorferi
LSEDMIRLIGSYPDSI

SEQ ID NO: 90331 - protein, 16 aa, Borrelia burgdorferi
SEDMIRLIGSYPDSIF

SEQ ID NO: 90332 - protein, 16 aa, Borrelia burgdorferi
EDMIRLIGSYPDSIFN

SEQ ID NO: 90333 - protein, 16 aa, Borrelia burgdorferi
DMIRLIGSYPDSIFNY

SEQ ID NO: 90334 - protein, 16 aa, Borrelia burgdorferi
MIRLIGSYPDSIFNYL

SEQ ID NO: 90335 - protein, 16 aa, Borrelia burgdorferi
IRLIGSYPDSIFNYLI

SEQ ID NO: 90336 - protein, 16 aa, Borrelia burgdorferi
RLIGSYPDSIFNYLIQ

SEQ ID NO: 90337 - protein, 16 aa, Borrelia burgdorferi
LIGSYPDSIFNYLIQL

SEQ ID NO: 90338 - protein, 16 aa, Borrelia burgdorferi
IGSYPDSIFNYLIQLN

SEQ ID NO: 90339 - protein, 16 aa, Borrelia burgdorferi
GSYPDSIFNYLIQLNS

SEQ ID NO: 90340 - protein, 16 aa, Borrelia burgdorferi
SYPDSIFNYLIQLNSD

SEQ ID NO: 90341 - protein, 16 aa, Borrelia burgdorferi
YPDSIFNYLIQLNSDK

SEQ ID NO: 90342 - protein, 16 aa, Borrelia burgdorferi
PDSIFNYLIQLNSDKI

SEQ ID NO: 90343 - protein, 16 aa, Borrelia burgdorferi
DSIFNYLIQLNSDKID

SEQ ID NO: 90344 - protein, 16 aa, Borrelia burgdorferi
SIFNYLIQLNSDKIDY

SEQ ID NO: 90345 - protein, 16 aa, Borrelia burgdorferi
IFNYLIQLNSDKIDYA

SEQ ID NO: 90346 - protein, 16 aa, Borrelia burgdorferi
FNYLIQLNSDKIDYAE

SEQ ID NO: 90347 - protein, 16 aa, Borrelia burgdorferi
NYLIQLNSDKIDYAEK

SEQ ID NO: 90348 - protein, 16 aa, Borrelia burgdorferi
YLIQLNSDKIDYAEKY

SEQ ID NO: 90349 - protein, 16 aa, Borrelia burgdorferi
LIQLNSDKIDYAEKYG

SEQ ID NO: 90350 - protein, 16 aa, Borrelia burgdorferi
IQLNSDKIDYAEKYGD

SEQ ID NO: 90351 - protein, 16 aa, Borrelia burgdorferi
QLNSDKIDYAEKYGDN

SEQ ID NO: 90352 - protein, 16 aa, Borrelia burgdorferi
LNSDKIDYAEKYGDNA

SEQ ID NO: 90353 - protein, 16 aa, Borrelia burgdorferi
NSDKIDYAEKYGDNAR

SEQ ID NO: 90354 - protein, 16 aa, Borrelia burgdorferi
SDKIDYAEKYGDNARN

SEQ ID NO: 90355 - protein, 16 aa, Borrelia burgdorferi
DKIDYAEKYGDNARNN

SEQ ID NO: 90356 - protein, 16 aa, Borrelia burgdorferi
KIDYAEKYGDNARNNF

SEQ ID NO: 90357 - protein, 16 aa, Borrelia burgdorferi
IDYAEKYGDNARNNFK

SEQ ID NO: 90358 - protein, 16 aa, Borrelia burgdorferi
DYAEKYGDNARNNFKK

SEQ ID NO: 90359 - protein, 16 aa, Borrelia burgdorferi
YAEKYGDNARNNFKKD

SEQ ID NO: 90360 - protein, 16 aa, Borrelia burgdorferi
AEKYGDNARNNFKKDY

SEQ ID NO: 90361 - protein, 16 aa, Borrelia burgdorferi
EKYGDNARNNFKKDYS

SEQ ID NO: 90362 - protein, 16 aa, Borrelia burgdorferi
KYGDNARNNFKKDYSE

SEQ ID NO: 90363 - protein, 16 aa, Borrelia burgdorferi
YGDNARNNFKKDYSED

SEQ ID NO: 90364 - protein, 16 aa, Borrelia burgdorferi
GDNARNNFKKDYSEDK

SEQ ID NO: 90365 - protein, 16 aa, Borrelia burgdorferi
DNARNNFKKDYSEDKA

SEQ ID NO: 90366 - protein, 16 aa, Borrelia burgdorferi
NARNNFKKDYSEDKAN

SEQ ID NO: 90367 - protein, 16 aa, Borrelia burgdorferi
ARNNFKKDYSEDKANT

SEQ ID NO: 90368 - protein, 16 aa, Borrelia burgdorferi
RNNFKKDYSEDKANTV

SEQ ID NO: 90369 - protein, 16 aa, Borrelia burgdorferi
NNFKKDYSEDKANTVK

SEQ ID NO: 90370 - protein, 16 aa, Borrelia burgdorferi
NFKKDYSEDKANTVKQ

SEQ ID NO: 90371 - protein, 16 aa, Borrelia burgdorferi
FKKDYSEDKANTVKQI

SEQ ID NO: 90372 - protein, 16 aa, Borrelia burgdorferi
KKDYSEDKANTVKQIL

SEQ ID NO: 90373 - protein, 16 aa, Borrelia burgdorferi
KDYSEDKANTVKQILK

SEQ ID NO: 90374 - protein, 16 aa, Borrelia burgdorferi
DYSEDKANTVKQILKQ

SEQ ID NO: 90375 - protein, 16 aa, Borrelia burgdorferi
YSEDKANTVKQILKQI

SEQ ID NO: 90376 - protein, 16 aa, Borrelia burgdorferi
SEDKANTVKQILKQIL

SEQ ID NO: 90377 - protein, 16 aa, Borrelia burgdorferi
EDKANTVKQILKQILA

SEQ ID NO: 90378 - protein, 16 aa, Borrelia burgdorferi
DKANTVKQILKQILAD

SEQ ID NO: 90379 - protein, 16 aa, Borrelia burgdorferi
KANTVKQILKQILADL

SEQ ID NO: 90380 - protein, 16 aa, Borrelia burgdorferi
ANTVKQILKQILADLP

SEQ ID NO: 90381 - protein, 16 aa, Borrelia burgdorferi
NTVKQILKQILADLPK

SEQ ID NO: 90382 - protein, 16 aa, Borrelia burgdorferi
TVKQILKQILADLPKD

SEQ ID NO: 90383 - protein, 13 aa, Borrelia burgdorferi
MCAFLLLNLVNCK

SEQ ID NO: 90384 - protein, 13 aa, Borrelia burgdorferi
CAFLLLNLVNCKF

SEQ ID NO: 90385 - protein, 13 aa, Borrelia burgdorferi
AFLLLNLVNCKFD

SEQ ID NO: 90386 - protein, 13 aa, Borrelia burgdorferi
FLLLNLVNCKFDS

SEQ ID NO: 90387 - protein, 13 aa, Borrelia burgdorferi
LLLNLVNCKFDSL

SEQ ID NO: 90388 - protein, 13 aa, Borrelia burgdorferi
LLNLVNCKFDSLN

SEQ ID NO: 90389 - protein, 13 aa, Borrelia burgdorferi
LNLVNCKFDSLNL

SEQ ID NO: 90390 - protein, 13 aa, Borrelia burgdorferi
NLVNCKFDSLNLS

SEQ ID NO: 90391 - protein, 13 aa, Borrelia burgdorferi
LVNCKFDSLNLST

SEQ ID NO: 90392 - protein, 13 aa, Borrelia burgdorferi
VNCKFDSLNLSTK

SEQ ID NO: 90393 - protein, 13 aa, Borrelia burgdorferi
NCKFDSLNLSTKS

SEQ ID NO: 90394 - protein, 13 aa, Borrelia burgdorferi
CKFDSLNLSTKSV

SEQ ID NO: 90395 - protein, 13 aa, Borrelia burgdorferi
KFDSLNLSTKSVD

SEQ ID NO: 90396 - protein, 13 aa, Borrelia burgdorferi
FDSLNLSTKSVDD

SEQ ID NO: 90397 - protein, 13 aa, Borrelia burgdorferi
DSLNLSTKSVDDK

SEQ ID NO: 90398 - protein, 13 aa, Borrelia burgdorferi
SLNLSTKSVDDKN

SEQ ID NO: 90399 - protein, 13 aa, Borrelia burgdorferi
LNLSTKSVDDKNN

SEQ ID NO: 90400 - protein, 13 aa, Borrelia burgdorferi
NLSTKSVDDKNNS

SEQ ID NO: 90401 - protein, 13 aa, Borrelia burgdorferi
LSTKSVDDKNNSI

SEQ ID NO: 90402 - protein, 13 aa, Borrelia burgdorferi
STKSVDDKNNSIA

SEQ ID NO: 90403 - protein, 13 aa, Borrelia burgdorferi
TKSVDDKNNSIAK

SEQ ID NO: 90404 - protein, 13 aa, Borrelia burgdorferi
KSVDDKNNSIAKL

SEQ ID NO: 90405 - protein, 13 aa, Borrelia burgdorferi
SVDDKNNSIAKLL

SEQ ID NO: 90406 - protein, 13 aa, Borrelia burgdorferi
VDDKNNSIAKLLQ

SEQ ID NO: 90407 - protein, 13 aa, Borrelia burgdorferi
DDKNNSIAKLLQH

SEQ ID NO: 90408 - protein, 13 aa, Borrelia burgdorferi
DKNNSIAKLLQHL

SEQ ID NO: 90409 - protein, 13 aa, Borrelia burgdorferi
KNNSIAKLLQHLS

SEQ ID NO: 90410 - protein, 13 aa, Borrelia burgdorferi
NNSIAKLLQHLSK

SEQ ID NO: 90411 - protein, 13 aa, Borrelia burgdorferi
NSIAKLLQHLSKS

SEQ ID NO: 90412 - protein, 13 aa, Borrelia burgdorferi
SIAKLLQHLSKSE

SEQ ID NO: 90413 - protein, 13 aa, Borrelia burgdorferi
IAKLLQHLSKSED

SEQ ID NO: 90414 - protein, 13 aa, Borrelia burgdorferi
AKLLQHLSKSEDQ

SEQ ID NO: 90415 - protein, 13 aa, Borrelia burgdorferi
KLLQHLSKSEDQA

SEQ ID NO: 90416 - protein, 13 aa, Borrelia burgdorferi
LLQHLSKSEDQAN

SEQ ID NO: 90417 - protein, 13 aa, Borrelia burgdorferi
LQHLSKSEDQANK

SEQ ID NO: 90418 - protein, 13 aa, Borrelia burgdorferi
QHLSKSEDQANKT

SEQ ID NO: 90419 - protein, 13 aa, Borrelia burgdorferi
HLSKSEDQANKTS

SEQ ID NO: 90420 - protein, 13 aa, Borrelia burgdorferi
LSKSEDQANKTST

SEQ ID NO: 90421 - protein, 13 aa, Borrelia burgdorferi
SKSEDQANKTSTS

SEQ ID NO: 90422 - protein, 13 aa, Borrelia burgdorferi
KSEDQANKTSTSE

SEQ ID NO: 90423 - protein, 13 aa, Borrelia burgdorferi
SEDQANKTSTSED

SEQ ID NO: 90424 - protein, 13 aa, Borrelia burgdorferi
EDQANKTSTSEDQ

SEQ ID NO: 90425 - protein, 13 aa, Borrelia burgdorferi
DQANKTSTSEDQK

SEQ ID NO: 90426 - protein, 13 aa, Borrelia burgdorferi
QANKTSTSEDQKE

SEQ ID NO: 90427 - protein, 13 aa, Borrelia burgdorferi
ANKTSTSEDQKEL

SEQ ID NO: 90428 - protein, 13 aa, Borrelia burgdorferi
NKTSTSEDQKELE

SEQ ID NO: 90429 - protein, 13 aa, Borrelia burgdorferi
KTSTSEDQKELEI

SEQ ID NO: 90430 - protein, 13 aa, Borrelia burgdorferi
TSTSEDQKELEIT

SEQ ID NO: 90431 - protein, 13 aa, Borrelia burgdorferi
STSEDQKELEITE

SEQ ID NO: 90432 - protein, 13 aa, Borrelia burgdorferi
TSEDQKELEITEN

SEQ ID NO: 90433 - protein, 13 aa, Borrelia burgdorferi
SEDQKELEITENK

SEQ ID NO: 90434 - protein, 13 aa, Borrelia burgdorferi
EDQKELEITENKE

SEQ ID NO: 90435 - protein, 13 aa, Borrelia burgdorferi
DQKELEITENKEQ

SEQ ID NO: 90436 - protein, 13 aa, Borrelia burgdorferi
QKELEITENKEQE

SEQ ID NO: 90437 - protein, 13 aa, Borrelia burgdorferi
KELEITENKEQEH

SEQ ID NO: 90438 - protein, 13 aa, Borrelia burgdorferi
ELEITENKEQEHE

SEQ ID NO: 90439 - protein, 13 aa, Borrelia burgdorferi
LEITENKEQEHEK

SEQ ID NO: 90440 - protein, 13 aa, Borrelia burgdorferi
EITENKEQEHEKL

SEQ ID NO: 90441 - protein, 13 aa, Borrelia burgdorferi
ITENKEQEHEKLS

SEQ ID NO: 90442 - protein, 13 aa, Borrelia burgdorferi
TENKEQEHEKLSQ

SEQ ID NO: 90443 - protein, 13 aa, Borrelia burgdorferi
ENKEQEHEKLSQV

SEQ ID NO: 90444 - protein, 13 aa, Borrelia burgdorferi
NKEQEHEKLSQVA

SEQ ID NO: 90445 - protein, 13 aa, Borrelia burgdorferi
KEQEHEKLSQVAQ

SEQ ID NO: 90446 - protein, 13 aa, Borrelia burgdorferi
EQEHEKLSQVAQH

SEQ ID NO: 90447 - protein, 13 aa, Borrelia burgdorferi
QEHEKLSQVAQHA

SEQ ID NO: 90448 - protein, 13 aa, Borrelia burgdorferi
EHEKLSQVAQHAP

SEQ ID NO: 90449 - protein, 13 aa, Borrelia burgdorferi
HEKLSQVAQHAPN

SEQ ID NO: 90450 - protein, 13 aa, Borrelia burgdorferi
EKLSQVAQHAPNS

SEQ ID NO: 90451 - protein, 13 aa, Borrelia burgdorferi
KLSQVAQHAPNSK

SEQ ID NO: 90452 - protein, 13 aa, Borrelia burgdorferi
LSQVAQHAPNSKI

SEQ ID NO: 90453 - protein, 13 aa, Borrelia burgdorferi
SQVAQHAPNSKIE

SEQ ID NO: 90454 - protein, 13 aa, Borrelia burgdorferi
QVAQHAPNSKIEK

SEQ ID NO: 90455 - protein, 13 aa, Borrelia burgdorferi
VAQHAPNSKIEKV

SEQ ID NO: 90456 - protein, 13 aa, Borrelia burgdorferi
AQHAPNSKIEKVK

SEQ ID NO: 90457 - protein, 13 aa, Borrelia burgdorferi
QHAPNSKIEKVKS

SEQ ID NO: 90458 - protein, 13 aa, Borrelia burgdorferi
HAPNSKIEKVKSD

SEQ ID NO: 90459 - protein, 13 aa, Borrelia burgdorferi
APNSKIEKVKSDG

SEQ ID NO: 90460 - protein, 13 aa, Borrelia burgdorferi
PNSKIEKVKSDGK

SEQ ID NO: 90461 - protein, 13 aa, Borrelia burgdorferi
NSKIEKVKSDGKP

SEQ ID NO: 90462 - protein, 13 aa, Borrelia burgdorferi
SKIEKVKSDGKPV

SEQ ID NO: 90463 - protein, 13 aa, Borrelia burgdorferi
KIEKVKSDGKPVP

SEQ ID NO: 90464 - protein, 13 aa, Borrelia burgdorferi
IEKVKSDGKPVPG

SEQ ID NO: 90465 - protein, 13 aa, Borrelia burgdorferi
EKVKSDGKPVPGD

SEQ ID NO: 90466 - protein, 13 aa, Borrelia burgdorferi
KVKSDGKPVPGDK

SEQ ID NO: 90467 - protein, 13 aa, Borrelia burgdorferi
VKSDGKPVPGDKI

SEQ ID NO: 90468 - protein, 13 aa, Borrelia burgdorferi
KSDGKPVPGDKIL

SEQ ID NO: 90469 - protein, 13 aa, Borrelia burgdorferi
SDGKPVPGDKILS

SEQ ID NO: 90470 - protein, 13 aa, Borrelia burgdorferi
DGKPVPGDKILSS

SEQ ID NO: 90471 - protein, 13 aa, Borrelia burgdorferi
GKPVPGDKILSSN

SEQ ID NO: 90472 - protein, 13 aa, Borrelia burgdorferi
KPVPGDKILSSNK

SEQ ID NO: 90473 - protein, 13 aa, Borrelia burgdorferi
PVPGDKILSSNKD

SEQ ID NO: 90474 - protein, 13 aa, Borrelia burgdorferi
VPGDKILSSNKDI

SEQ ID NO: 90475 - protein, 13 aa, Borrelia burgdorferi
PGDKILSSNKDIY

SEQ ID NO: 90476 - protein, 13 aa, Borrelia burgdorferi
GDKILSSNKDIYN

SEQ ID NO: 90477 - protein, 13 aa, Borrelia burgdorferi
DKILSSNKDIYNS

SEQ ID NO: 90478 - protein, 13 aa, Borrelia burgdorferi
KILSSNKDIYNSY

SEQ ID NO: 90479 - protein, 13 aa, Borrelia burgdorferi
ILSSNKDIYNSYI

SEQ ID NO: 90480 - protein, 13 aa, Borrelia burgdorferi
LSSNKDIYNSYIP

SEQ ID NO: 90481 - protein, 13 aa, Borrelia burgdorferi
SSNKDIYNSYIPE

SEQ ID NO: 90482 - protein, 13 aa, Borrelia burgdorferi
SNKDIYNSYIPEV

SEQ ID NO: 90483 - protein, 13 aa, Borrelia burgdorferi
NKDIYNSYIPEVK

SEQ ID NO: 90484 - protein, 13 aa, Borrelia burgdorferi
KDIYNSYIPEVKE

SEQ ID NO: 90485 - protein, 13 aa, Borrelia burgdorferi
DIYNSYIPEVKEE

SEQ ID NO: 90486 - protein, 13 aa, Borrelia burgdorferi
IYNSYIPEVKEEI

SEQ ID NO: 90487 - protein, 13 aa, Borrelia burgdorferi
YNSYIPEVKEEIV

SEQ ID NO: 90488 - protein, 13 aa, Borrelia burgdorferi
NSYIPEVKEEIVY

SEQ ID NO: 90489 - protein, 13 aa, Borrelia burgdorferi
SYIPEVKEEIVYE

SEQ ID NO: 90490 - protein, 13 aa, Borrelia burgdorferi
YIPEVKEEIVYEI

SEQ ID NO: 90491 - protein, 13 aa, Borrelia burgdorferi
IPEVKEEIVYEIL

SEQ ID NO: 90492 - protein, 13 aa, Borrelia burgdorferi
PEVKEEIVYEILE

SEQ ID NO: 90493 - protein, 13 aa, Borrelia burgdorferi
EVKEEIVYEILEE

SEQ ID NO: 90494 - protein, 13 aa, Borrelia burgdorferi
VKEEIVYEILEEV

SEQ ID NO: 90495 - protein, 13 aa, Borrelia burgdorferi
KEEIVYEILEEVI

SEQ ID NO: 90496 - protein, 13 aa, Borrelia burgdorferi
EEIVYEILEEVII

SEQ ID NO: 90497 - protein, 13 aa, Borrelia burgdorferi
EIVYEILEEVIIP

SEQ ID NO: 90498 - protein, 13 aa, Borrelia burgdorferi
IVYEILEEVIIPE

SEQ ID NO: 90499 - protein, 13 aa, Borrelia burgdorferi
VYEILEEVIIPET

SEQ ID NO: 90500 - protein, 13 aa, Borrelia burgdorferi
YEILEEVIIPETK

SEQ ID NO: 90501 - protein, 13 aa, Borrelia burgdorferi
EILEEVIIPETKI

SEQ ID NO: 90502 - protein, 13 aa, Borrelia burgdorferi
ILEEVIIPETKIP

SEQ ID NO: 90503 - protein, 13 aa, Borrelia burgdorferi
LEEVIIPETKIPE

SEQ ID NO: 90504 - protein, 13 aa, Borrelia burgdorferi
EEVIIPETKIPEI

SEQ ID NO: 90505 - protein, 13 aa, Borrelia burgdorferi
EVIIPETKIPEIT

SEQ ID NO: 90506 - protein, 13 aa, Borrelia burgdorferi
VIIPETKIPEITE

SEQ ID NO: 90507 - protein, 13 aa, Borrelia burgdorferi
IIPETKIPEITEE

SEQ ID NO: 90508 - protein, 13 aa, Borrelia burgdorferi
IPETKIPEITEEV

SEQ ID NO: 90509 - protein, 13 aa, Borrelia burgdorferi
PETKIPEITEEVI

SEQ ID NO: 90510 - protein, 13 aa, Borrelia burgdorferi
ETKIPEITEEVIM

SEQ ID NO: 90511 - protein, 13 aa, Borrelia burgdorferi
TKIPEITEEVIMP

SEQ ID NO: 90512 - protein, 13 aa, Borrelia burgdorferi
KIPEITEEVIMPI

SEQ ID NO: 90513 - protein, 13 aa, Borrelia burgdorferi
IPEITEEVIMPIP

SEQ ID NO: 90514 - protein, 13 aa, Borrelia burgdorferi
PEITEEVIMPIPQ

SEQ ID NO: 90515 - protein, 13 aa, Borrelia burgdorferi
EITEEVIMPIPQT

SEQ ID NO: 90516 - protein, 13 aa, Borrelia burgdorferi
ITEEVIMPIPQTI

SEQ ID NO: 90517 - protein, 13 aa, Borrelia burgdorferi
TEEVIMPIPQTID

SEQ ID NO: 90518 - protein, 13 aa, Borrelia burgdorferi
EEVIMPIPQTIDF

SEQ ID NO: 90519 - protein, 13 aa, Borrelia burgdorferi
EVIMPIPQTIDFY

SEQ ID NO: 90520 - protein, 13 aa, Borrelia burgdorferi
VIMPIPQTIDFYI

SEQ ID NO: 90521 - protein, 13 aa, Borrelia burgdorferi
IMPIPQTIDFYIE

SEQ ID NO: 90522 - protein, 13 aa, Borrelia burgdorferi
MPIPQTIDFYIEP

SEQ ID NO: 90523 - protein, 13 aa, Borrelia burgdorferi
PIPQTIDFYIEPR

SEQ ID NO: 90524 - protein, 13 aa, Borrelia burgdorferi
IPQTIDFYIEPRP

SEQ ID NO: 90525 - protein, 13 aa, Borrelia burgdorferi
PQTIDFYIEPRPI

SEQ ID NO: 90526 - protein, 13 aa, Borrelia burgdorferi
QTIDFYIEPRPIS

SEQ ID NO: 90527 - protein, 13 aa, Borrelia burgdorferi
TIDFYIEPRPISS

SEQ ID NO: 90528 - protein, 13 aa, Borrelia burgdorferi
IDFYIEPRPISSF

SEQ ID NO: 90529 - protein, 13 aa, Borrelia burgdorferi
DFYIEPRPISSFL

SEQ ID NO: 90530 - protein, 13 aa, Borrelia burgdorferi
FYIEPRPISSFLT

SEQ ID NO: 90531 - protein, 13 aa, Borrelia burgdorferi
YIEPRPISSFLTQ

SEQ ID NO: 90532 - protein, 13 aa, Borrelia burgdorferi
IEPRPISSFLTQG

SEQ ID NO: 90533 - protein, 13 aa, Borrelia burgdorferi
EPRPISSFLTQGT

SEQ ID NO: 90534 - protein, 13 aa, Borrelia burgdorferi
PRPISSFLTQGTS

SEQ ID NO: 90535 - protein, 13 aa, Borrelia burgdorferi
RPISSFLTQGTSP

SEQ ID NO: 90536 - protein, 13 aa, Borrelia burgdorferi
PISSFLTQGTSPS

SEQ ID NO: 90537 - protein, 13 aa, Borrelia burgdorferi
ISSFLTQGTSPSI

SEQ ID NO: 90538 - protein, 13 aa, Borrelia burgdorferi
SSFLTQGTSPSIT

SEQ ID NO: 90539 - protein, 13 aa, Borrelia burgdorferi
SFLTQGTSPSITS

SEQ ID NO: 90540 - protein, 13 aa, Borrelia burgdorferi
FLTQGTSPSITST

SEQ ID NO: 90541 - protein, 13 aa, Borrelia burgdorferi
LTQGTSPSITSTI

SEQ ID NO: 90542 - protein, 13 aa, Borrelia burgdorferi
TQGTSPSITSTIK

SEQ ID NO: 90543 - protein, 13 aa, Borrelia burgdorferi
QGTSPSITSTIKS

SEQ ID NO: 90544 - protein, 13 aa, Borrelia burgdorferi
GTSPSITSTIKSY

SEQ ID NO: 90545 - protein, 13 aa, Borrelia burgdorferi
TSPSITSTIKSYK

SEQ ID NO: 90546 - protein, 13 aa, Borrelia burgdorferi
SPSITSTIKSYKE

SEQ ID NO: 90547 - protein, 13 aa, Borrelia burgdorferi
PSITSTIKSYKEL

SEQ ID NO: 90548 - protein, 13 aa, Borrelia burgdorferi
SITSTIKSYKELA

SEQ ID NO: 90549 - protein, 13 aa, Borrelia burgdorferi
ITSTIKSYKELAK

SEQ ID NO: 90550 - protein, 13 aa, Borrelia burgdorferi
TSTIKSYKELAKE

SEQ ID NO: 90551 - protein, 13 aa, Borrelia burgdorferi
STIKSYKELAKEK

SEQ ID NO: 90552 - protein, 13 aa, Borrelia burgdorferi
TIKSYKELAKEKI

SEQ ID NO: 90553 - protein, 13 aa, Borrelia burgdorferi
IKSYKELAKEKIN

SEQ ID NO: 90554 - protein, 13 aa, Borrelia burgdorferi
KSYKELAKEKINN

SEQ ID NO: 90555 - protein, 13 aa, Borrelia burgdorferi
SYKELAKEKINNG

SEQ ID NO: 90556 - protein, 13 aa, Borrelia burgdorferi
YKELAKEKINNGL

SEQ ID NO: 90557 - protein, 13 aa, Borrelia burgdorferi
KELAKEKINNGLN

SEQ ID NO: 90558 - protein, 13 aa, Borrelia burgdorferi
ELAKEKINNGLNI

SEQ ID NO: 90559 - protein, 13 aa, Borrelia burgdorferi
LAKEKINNGLNIV

SEQ ID NO: 90560 - protein, 13 aa, Borrelia burgdorferi
AKEKINNGLNIVQ

SEQ ID NO: 90561 - protein, 13 aa, Borrelia burgdorferi
KEKINNGLNIVQK

SEQ ID NO: 90562 - protein, 13 aa, Borrelia burgdorferi
EKINNGLNIVQKI

SEQ ID NO: 90563 - protein, 13 aa, Borrelia burgdorferi
KINNGLNIVQKIT

SEQ ID NO: 90564 - protein, 13 aa, Borrelia burgdorferi
INNGLNIVQKITQ

SEQ ID NO: 90565 - protein, 13 aa, Borrelia burgdorferi
NNGLNIVQKITQN

SEQ ID NO: 90566 - protein, 13 aa, Borrelia burgdorferi
NGLNIVQKITQNI

SEQ ID NO: 90567 - protein, 13 aa, Borrelia burgdorferi
GLNIVQKITQNID

SEQ ID NO: 90568 - protein, 13 aa, Borrelia burgdorferi
LNIVQKITQNIDN

SEQ ID NO: 90569 - protein, 13 aa, Borrelia burgdorferi
NIVQKITQNIDNI

SEQ ID NO: 90570 - protein, 13 aa, Borrelia burgdorferi
IVQKITQNIDNIT

SEQ ID NO: 90571 - protein, 13 aa, Borrelia burgdorferi
VQKITQNIDNITE

SEQ ID NO: 90572 - protein, 13 aa, Borrelia burgdorferi
QKITQNIDNITEN

SEQ ID NO: 90573 - protein, 13 aa, Borrelia burgdorferi
KITQNIDNITENL

SEQ ID NO: 90574 - protein, 13 aa, Borrelia burgdorferi
ITQNIDNITENLN

SEQ ID NO: 90575 - protein, 13 aa, Borrelia burgdorferi
TQNIDNITENLNS

SEQ ID NO: 90576 - protein, 13 aa, Borrelia burgdorferi
QNIDNITENLNSK

SEQ ID NO: 90577 - protein, 13 aa, Borrelia burgdorferi
NIDNITENLNSKE

SEQ ID NO: 90578 - protein, 13 aa, Borrelia burgdorferi
IDNITENLNSKET

SEQ ID NO: 90579 - protein, 13 aa, Borrelia burgdorferi
DNITENLNSKETP

SEQ ID NO: 90580 - protein, 13 aa, Borrelia burgdorferi
NITENLNSKETPK

SEQ ID NO: 90581 - protein, 13 aa, Borrelia burgdorferi
ITENLNSKETPKE

SEQ ID NO: 90582 - protein, 13 aa, Borrelia burgdorferi
TENLNSKETPKEI

SEQ ID NO: 90583 - protein, 13 aa, Borrelia burgdorferi
ENLNSKETPKEIS

SEQ ID NO: 90584 - protein, 13 aa, Borrelia burgdorferi
NLNSKETPKEISG

SEQ ID NO: 90585 - protein, 13 aa, Borrelia burgdorferi
LNSKETPKEISGK

SEQ ID NO: 90586 - protein, 13 aa, Borrelia burgdorferi
NSKETPKEISGKE

SEQ ID NO: 90587 - protein, 13 aa, Borrelia burgdorferi
SKETPKEISGKEV

SEQ ID NO: 90588 - protein, 13 aa, Borrelia burgdorferi
KETPKEISGKEVE

SEQ ID NO: 90589 - protein, 13 aa, Borrelia burgdorferi
ETPKEISGKEVEE

SEQ ID NO: 90590 - protein, 13 aa, Borrelia burgdorferi
TPKEISGKEVEEK

SEQ ID NO: 90591 - protein, 13 aa, Borrelia burgdorferi
PKEISGKEVEEKI

SEQ ID NO: 90592 - protein, 13 aa, Borrelia burgdorferi
KEISGKEVEEKIT

SEQ ID NO: 90593 - protein, 13 aa, Borrelia burgdorferi
EISGKEVEEKITH

SEQ ID NO: 90594 - protein, 13 aa, Borrelia burgdorferi
ISGKEVEEKITHP

SEQ ID NO: 90595 - protein, 13 aa, Borrelia burgdorferi
SGKEVEEKITHPI

SEQ ID NO: 90596 - protein, 13 aa, Borrelia burgdorferi
GKEVEEKITHPIF

SEQ ID NO: 90597 - protein, 13 aa, Borrelia burgdorferi
KEVEEKITHPIFD

SEQ ID NO: 90598 - protein, 13 aa, Borrelia burgdorferi
EVEEKITHPIFDH

SEQ ID NO: 90599 - protein, 13 aa, Borrelia burgdorferi
VEEKITHPIFDHI

SEQ ID NO: 90600 - protein, 13 aa, Borrelia burgdorferi
EEKITHPIFDHIT

SEQ ID NO: 90601 - protein, 13 aa, Borrelia burgdorferi
EKITHPIFDHITG

SEQ ID NO: 90602 - protein, 13 aa, Borrelia burgdorferi
KITHPIFDHITGS

SEQ ID NO: 90603 - protein, 13 aa, Borrelia burgdorferi
ITHPIFDHITGSG

SEQ ID NO: 90604 - protein, 13 aa, Borrelia burgdorferi
THPIFDHITGSGN

SEQ ID NO: 90605 - protein, 13 aa, Borrelia burgdorferi
HPIFDHITGSGNN

SEQ ID NO: 90606 - protein, 13 aa, Borrelia burgdorferi
PIFDHITGSGNNP

SEQ ID NO: 90607 - protein, 13 aa, Borrelia burgdorferi
IFDHITGSGNNPG

SEQ ID NO: 90608 - protein, 13 aa, Borrelia burgdorferi
FDHITGSGNNPGQ

SEQ ID NO: 90609 - protein, 13 aa, Borrelia burgdorferi
DHITGSGNNPGQD

SEQ ID NO: 90610 - protein, 13 aa, Borrelia burgdorferi
HITGSGNNPGQDS

SEQ ID NO: 90611 - protein, 13 aa, Borrelia burgdorferi
ITGSGNNPGQDSI

SEQ ID NO: 90612 - protein, 13 aa, Borrelia burgdorferi
TGSGNNPGQDSIS

SEQ ID NO: 90613 - protein, 13 aa, Borrelia burgdorferi
GSGNNPGQDSISN

SEQ ID NO: 90614 - protein, 13 aa, Borrelia burgdorferi
SGNNPGQDSISNT

SEQ ID NO: 90615 - protein, 13 aa, Borrelia burgdorferi
GNNPGQDSISNTW

SEQ ID NO: 90616 - protein, 13 aa, Borrelia burgdorferi
NNPGQDSISNTWG

SEQ ID NO: 90617 - protein, 13 aa, Borrelia burgdorferi
NPGQDSISNTWGE

SEQ ID NO: 90618 - protein, 13 aa, Borrelia burgdorferi
PGQDSISNTWGEG

SEQ ID NO: 90619 - protein, 13 aa, Borrelia burgdorferi
GQDSISNTWGEGL

SEQ ID NO: 90620 - protein, 13 aa, Borrelia burgdorferi
QDSISNTWGEGLE

SEQ ID NO: 90621 - protein, 13 aa, Borrelia burgdorferi
DSISNTWGEGLEI

SEQ ID NO: 90622 - protein, 13 aa, Borrelia burgdorferi
SISNTWGEGLEIG

SEQ ID NO: 90623 - protein, 13 aa, Borrelia burgdorferi
ISNTWGEGLEIGG

SEQ ID NO: 90624 - protein, 13 aa, Borrelia burgdorferi
SNTWGEGLEIGGD

SEQ ID NO: 90625 - protein, 13 aa, Borrelia burgdorferi
NTWGEGLEIGGDS

SEQ ID NO: 90626 - protein, 13 aa, Borrelia burgdorferi
TWGEGLEIGGDSN

SEQ ID NO: 90627 - protein, 13 aa, Borrelia burgdorferi
WGEGLEIGGDSNF

SEQ ID NO: 90628 - protein, 13 aa, Borrelia burgdorferi
GEGLEIGGDSNFF

SEQ ID NO: 90629 - protein, 13 aa, Borrelia burgdorferi
EGLEIGGDSNFFT

SEQ ID NO: 90630 - protein, 13 aa, Borrelia burgdorferi
GLEIGGDSNFFTN

SEQ ID NO: 90631 - protein, 13 aa, Borrelia burgdorferi
LEIGGDSNFFTNL

SEQ ID NO: 90632 - protein, 13 aa, Borrelia burgdorferi
EIGGDSNFFTNLE

SEQ ID NO: 90633 - protein, 13 aa, Borrelia burgdorferi
IGGDSNFFTNLEE

SEQ ID NO: 90634 - protein, 13 aa, Borrelia burgdorferi
GGDSNFFTNLEEV

SEQ ID NO: 90635 - protein, 13 aa, Borrelia burgdorferi
GDSNFFTNLEEVR

SEQ ID NO: 90636 - protein, 13 aa, Borrelia burgdorferi
DSNFFTNLEEVRS

SEQ ID NO: 90637 - protein, 13 aa, Borrelia burgdorferi
SNFFTNLEEVRSS

SEQ ID NO: 90638 - protein, 13 aa, Borrelia burgdorferi
NFFTNLEEVRSSI

SEQ ID NO: 90639 - protein, 13 aa, Borrelia burgdorferi
FFTNLEEVRSSIR

SEQ ID NO: 90640 - protein, 13 aa, Borrelia burgdorferi
FTNLEEVRSSIRT

SEQ ID NO: 90641 - protein, 13 aa, Borrelia burgdorferi
TNLEEVRSSIRTK

SEQ ID NO: 90642 - protein, 13 aa, Borrelia burgdorferi
NLEEVRSSIRTKI

SEQ ID NO: 90643 - protein, 13 aa, Borrelia burgdorferi
LEEVRSSIRTKIK

SEQ ID NO: 90644 - protein, 13 aa, Borrelia burgdorferi
EEVRSSIRTKIKV

SEQ ID NO: 90645 - protein, 13 aa, Borrelia burgdorferi
EVRSSIRTKIKVS

SEQ ID NO: 90646 - protein, 13 aa, Borrelia burgdorferi
VRSSIRTKIKVSD

SEQ ID NO: 90647 - protein, 13 aa, Borrelia burgdorferi
RSSIRTKIKVSDG

SEQ ID NO: 90648 - protein, 13 aa, Borrelia burgdorferi
SSIRTKIKVSDGT

SEQ ID NO: 90649 - protein, 13 aa, Borrelia burgdorferi
SIRTKIKVSDGTE

SEQ ID NO: 90650 - protein, 13 aa, Borrelia burgdorferi
IRTKIKVSDGTEQ

SEQ ID NO: 90651 - protein, 13 aa, Borrelia burgdorferi
RTKIKVSDGTEQT

SEQ ID NO: 90652 - protein, 13 aa, Borrelia burgdorferi
TKIKVSDGTEQTK

SEQ ID NO: 90653 - protein, 13 aa, Borrelia burgdorferi
KIKVSDGTEQTKD

SEQ ID NO: 90654 - protein, 13 aa, Borrelia burgdorferi
IKVSDGTEQTKDK

SEQ ID NO: 90655 - protein, 13 aa, Borrelia burgdorferi
KVSDGTEQTKDKV

SEQ ID NO: 90656 - protein, 13 aa, Borrelia burgdorferi
VSDGTEQTKDKVE

SEQ ID NO: 90657 - protein, 13 aa, Borrelia burgdorferi
SDGTEQTKDKVEI

SEQ ID NO: 90658 - protein, 13 aa, Borrelia burgdorferi
DGTEQTKDKVEID

SEQ ID NO: 90659 - protein, 13 aa, Borrelia burgdorferi
GTEQTKDKVEIDE

SEQ ID NO: 90660 - protein, 13 aa, Borrelia burgdorferi
TEQTKDKVEIDEI

SEQ ID NO: 90661 - protein, 13 aa, Borrelia burgdorferi
EQTKDKVEIDEII

SEQ ID NO: 90662 - protein, 13 aa, Borrelia burgdorferi
QTKDKVEIDEIIE

SEQ ID NO: 90663 - protein, 13 aa, Borrelia burgdorferi
TKDKVEIDEIIED

SEQ ID NO: 90664 - protein, 13 aa, Borrelia burgdorferi
KDKVEIDEIIEDL

SEQ ID NO: 90665 - protein, 13 aa, Borrelia burgdorferi
DKVEIDEIIEDLQ

SEQ ID NO: 90666 - protein, 13 aa, Borrelia burgdorferi
KVEIDEIIEDLQK

SEQ ID NO: 90667 - protein, 13 aa, Borrelia burgdorferi
VEIDEIIEDLQKL

SEQ ID NO: 90668 - protein, 13 aa, Borrelia burgdorferi
EIDEIIEDLQKLK

SEQ ID NO: 90669 - protein, 13 aa, Borrelia burgdorferi
IDEIIEDLQKLKE

SEQ ID NO: 90670 - protein, 13 aa, Borrelia burgdorferi
DEIIEDLQKLKEF

SEQ ID NO: 90671 - protein, 13 aa, Borrelia burgdorferi
EIIEDLQKLKEFL

SEQ ID NO: 90672 - protein, 13 aa, Borrelia burgdorferi
IIEDLQKLKEFLE

SEQ ID NO: 90673 - protein, 13 aa, Borrelia burgdorferi
IEDLQKLKEFLEK

SEQ ID NO: 90674 - protein, 13 aa, Borrelia burgdorferi
EDLQKLKEFLEKL

SEQ ID NO: 90675 - protein, 13 aa, Borrelia burgdorferi
DLQKLKEFLEKLK

SEQ ID NO: 90676 - protein, 13 aa, Borrelia burgdorferi
LQKLKEFLEKLKK

SEQ ID NO: 90677 - protein, 13 aa, Borrelia burgdorferi
QKLKEFLEKLKKY

SEQ ID NO: 90678 - protein, 13 aa, Borrelia burgdorferi
KLKEFLEKLKKYL

SEQ ID NO: 90679 - protein, 13 aa, Borrelia burgdorferi
LKEFLEKLKKYLK

SEQ ID NO: 90680 - protein, 13 aa, Borrelia burgdorferi
KEFLEKLKKYLKD

SEQ ID NO: 90681 - protein, 13 aa, Borrelia burgdorferi
EFLEKLKKYLKDT

SEQ ID NO: 90682 - protein, 13 aa, Borrelia burgdorferi
FLEKLKKYLKDTN

SEQ ID NO: 90683 - protein, 13 aa, Borrelia burgdorferi
LEKLKKYLKDTNN

SEQ ID NO: 90684 - protein, 13 aa, Borrelia burgdorferi
EKLKKYLKDTNNL

SEQ ID NO: 90685 - protein, 13 aa, Borrelia burgdorferi
KLKKYLKDTNNLS

SEQ ID NO: 90686 - protein, 13 aa, Borrelia burgdorferi
LKKYLKDTNNLSA

SEQ ID NO: 90687 - protein, 13 aa, Borrelia burgdorferi
KKYLKDTNNLSAI

SEQ ID NO: 90688 - protein, 13 aa, Borrelia burgdorferi
KYLKDTNNLSAIE

SEQ ID NO: 90689 - protein, 13 aa, Borrelia burgdorferi
YLKDTNNLSAIEE

SEQ ID NO: 90690 - protein, 13 aa, Borrelia burgdorferi
LKDTNNLSAIEES

SEQ ID NO: 90691 - protein, 13 aa, Borrelia burgdorferi
KDTNNLSAIEESV

SEQ ID NO: 90692 - protein, 13 aa, Borrelia burgdorferi
DTNNLSAIEESVK

SEQ ID NO: 90693 - protein, 13 aa, Borrelia burgdorferi
TNNLSAIEESVKG

SEQ ID NO: 90694 - protein, 13 aa, Borrelia burgdorferi
NNLSAIEESVKGL

SEQ ID NO: 90695 - protein, 13 aa, Borrelia burgdorferi
NLSAIEESVKGLS

SEQ ID NO: 90696 - protein, 14 aa, Borrelia burgdorferi
MCAFLLLNLVNCKF

SEQ ID NO: 90697 - protein, 14 aa, Borrelia burgdorferi
CAFLLLNLVNCKFD

SEQ ID NO: 90698 - protein, 14 aa, Borrelia burgdorferi
AFLLLNLVNCKFDS

SEQ ID NO: 90699 - protein, 14 aa, Borrelia burgdorferi
FLLLNLVNCKFDSL

SEQ ID NO: 90700 - protein, 14 aa, Borrelia burgdorferi
LLLNLVNCKFDSLN

SEQ ID NO: 90701 - protein, 14 aa, Borrelia burgdorferi
LLNLVNCKFDSLNL

SEQ ID NO: 90702 - protein, 14 aa, Borrelia burgdorferi
LNLVNCKFDSLNLS

SEQ ID NO: 90703 - protein, 14 aa, Borrelia burgdorferi
NLVNCKFDSLNLST

SEQ ID NO: 90704 - protein, 14 aa, Borrelia burgdorferi
LVNCKFDSLNLSTK

SEQ ID NO: 90705 - protein, 14 aa, Borrelia burgdorferi
VNCKFDSLNLSTKS

SEQ ID NO: 90706 - protein, 14 aa, Borrelia burgdorferi
NCKFDSLNLSTKSV

SEQ ID NO: 90707 - protein, 14 aa, Borrelia burgdorferi
CKFDSLNLSTKSVD

SEQ ID NO: 90708 - protein, 14 aa, Borrelia burgdorferi
KFDSLNLSTKSVDD

SEQ ID NO: 90709 - protein, 14 aa, Borrelia burgdorferi
FDSLNLSTKSVDDK

SEQ ID NO: 90710 - protein, 14 aa, Borrelia burgdorferi
DSLNLSTKSVDDKN

SEQ ID NO: 90711 - protein, 14 aa, Borrelia burgdorferi
SLNLSTKSVDDKNN

SEQ ID NO: 90712 - protein, 14 aa, Borrelia burgdorferi
LNLSTKSVDDKNNS

SEQ ID NO: 90713 - protein, 14 aa, Borrelia burgdorferi
NLSTKSVDDKNNSI

SEQ ID NO: 90714 - protein, 14 aa, Borrelia burgdorferi
LSTKSVDDKNNSIA

SEQ ID NO: 90715 - protein, 14 aa, Borrelia burgdorferi
STKSVDDKNNSIAK

SEQ ID NO: 90716 - protein, 14 aa, Borrelia burgdorferi
TKSVDDKNNSIAKL

SEQ ID NO: 90717 - protein, 14 aa, Borrelia burgdorferi
KSVDDKNNSIAKLL

SEQ ID NO: 90718 - protein, 14 aa, Borrelia burgdorferi
SVDDKNNSIAKLLQ

SEQ ID NO: 90719 - protein, 14 aa, Borrelia burgdorferi
VDDKNNSIAKLLQH

SEQ ID NO: 90720 - protein, 14 aa, Borrelia burgdorferi
DDKNNSIAKLLQHL

SEQ ID NO: 90721 - protein, 14 aa, Borrelia burgdorferi
DKNNSIAKLLQHLS

SEQ ID NO: 90722 - protein, 14 aa, Borrelia burgdorferi
KNNSIAKLLQHLSK

SEQ ID NO: 90723 - protein, 14 aa, Borrelia burgdorferi
NNSIAKLLQHLSKS

SEQ ID NO: 90724 - protein, 14 aa, Borrelia burgdorferi
NSIAKLLQHLSKSE

SEQ ID NO: 90725 - protein, 14 aa, Borrelia burgdorferi
SIAKLLQHLSKSED

SEQ ID NO: 90726 - protein, 14 aa, Borrelia burgdorferi
IAKLLQHLSKSEDQ

SEQ ID NO: 90727 - protein, 14 aa, Borrelia burgdorferi
AKLLQHLSKSEDQA

SEQ ID NO: 90728 - protein, 14 aa, Borrelia burgdorferi
KLLQHLSKSEDQAN

SEQ ID NO: 90729 - protein, 14 aa, Borrelia burgdorferi
LLQHLSKSEDQANK

SEQ ID NO: 90730 - protein, 14 aa, Borrelia burgdorferi
LQHLSKSEDQANKT

SEQ ID NO: 90731 - protein, 14 aa, Borrelia burgdorferi
QHLSKSEDQANKTS

SEQ ID NO: 90732 - protein, 14 aa, Borrelia burgdorferi
HLSKSEDQANKTST

SEQ ID NO: 90733 - protein, 14 aa, Borrelia burgdorferi
LSKSEDQANKTSTS

SEQ ID NO: 90734 - protein, 14 aa, Borrelia burgdorferi
SKSEDQANKTSTSE

SEQ ID NO: 90735 - protein, 14 aa, Borrelia burgdorferi
KSEDQANKTSTSED

SEQ ID NO: 90736 - protein, 14 aa, Borrelia burgdorferi
SEDQANKTSTSEDQ

SEQ ID NO: 90737 - protein, 14 aa, Borrelia burgdorferi
EDQANKTSTSEDQK

SEQ ID NO: 90738 - protein, 14 aa, Borrelia burgdorferi
DQANKTSTSEDQKE

SEQ ID NO: 90739 - protein, 14 aa, Borrelia burgdorferi
QANKTSTSEDQKEL

SEQ ID NO: 90740 - protein, 14 aa, Borrelia burgdorferi
ANKTSTSEDQKELE

SEQ ID NO: 90741 - protein, 14 aa, Borrelia burgdorferi
NKTSTSEDQKELEI

SEQ ID NO: 90742 - protein, 14 aa, Borrelia burgdorferi
KTSTSEDQKELEIT

SEQ ID NO: 90743 - protein, 14 aa, Borrelia burgdorferi
TSTSEDQKELEITE

SEQ ID NO: 90744 - protein, 14 aa, Borrelia burgdorferi
STSEDQKELEITEN

SEQ ID NO: 90745 - protein, 14 aa, Borrelia burgdorferi
TSEDQKELEITENK

SEQ ID NO: 90746 - protein, 14 aa, Borrelia burgdorferi
SEDQKELEITENKE

SEQ ID NO: 90747 - protein, 14 aa, Borrelia burgdorferi
EDQKELEITENKEQ

SEQ ID NO: 90748 - protein, 14 aa, Borrelia burgdorferi
DQKELEITENKEQE

SEQ ID NO: 90749 - protein, 14 aa, Borrelia burgdorferi
QKELEITENKEQEH

SEQ ID NO: 90750 - protein, 14 aa, Borrelia burgdorferi
KELEITENKEQEHE

SEQ ID NO: 90751 - protein, 14 aa, Borrelia burgdorferi
ELEITENKEQEHEK

SEQ ID NO: 90752 - protein, 14 aa, Borrelia burgdorferi
LEITENKEQEHEKL

SEQ ID NO: 90753 - protein, 14 aa, Borrelia burgdorferi
EITENKEQEHEKLS

SEQ ID NO: 90754 - protein, 14 aa, Borrelia burgdorferi
ITENKEQEHEKLSQ

SEQ ID NO: 90755 - protein, 14 aa, Borrelia burgdorferi
TENKEQEHEKLSQV

SEQ ID NO: 90756 - protein, 14 aa, Borrelia burgdorferi
ENKEQEHEKLSQVA

SEQ ID NO: 90757 - protein, 14 aa, Borrelia burgdorferi
NKEQEHEKLSQVAQ

SEQ ID NO: 90758 - protein, 14 aa, Borrelia burgdorferi
KEQEHEKLSQVAQH

SEQ ID NO: 90759 - protein, 14 aa, Borrelia burgdorferi
EQEHEKLSQVAQHA

SEQ ID NO: 90760 - protein, 14 aa, Borrelia burgdorferi
QEHEKLSQVAQHAP

SEQ ID NO: 90761 - protein, 14 aa, Borrelia burgdorferi
EHEKLSQVAQHAPN

SEQ ID NO: 90762 - protein, 14 aa, Borrelia burgdorferi
HEKLSQVAQHAPNS

SEQ ID NO: 90763 - protein, 14 aa, Borrelia burgdorferi
EKLSQVAQHAPNSK

SEQ ID NO: 90764 - protein, 14 aa, Borrelia burgdorferi
KLSQVAQHAPNSKI

SEQ ID NO: 90765 - protein, 14 aa, Borrelia burgdorferi
LSQVAQHAPNSKIE

SEQ ID NO: 90766 - protein, 14 aa, Borrelia burgdorferi
SQVAQHAPNSKIEK

SEQ ID NO: 90767 - protein, 14 aa, Borrelia burgdorferi
QVAQHAPNSKIEKV

SEQ ID NO: 90768 - protein, 14 aa, Borrelia burgdorferi
VAQHAPNSKIEKVK

SEQ ID NO: 90769 - protein, 14 aa, Borrelia burgdorferi
AQHAPNSKIEKVKS

SEQ ID NO: 90770 - protein, 14 aa, Borrelia burgdorferi
QHAPNSKIEKVKSD

SEQ ID NO: 90771 - protein, 14 aa, Borrelia burgdorferi
HAPNSKIEKVKSDG

SEQ ID NO: 90772 - protein, 14 aa, Borrelia burgdorferi
APNSKIEKVKSDGK

SEQ ID NO: 90773 - protein, 14 aa, Borrelia burgdorferi
PNSKIEKVKSDGKP

SEQ ID NO: 90774 - protein, 14 aa, Borrelia burgdorferi
NSKIEKVKSDGKPV

SEQ ID NO: 90775 - protein, 14 aa, Borrelia burgdorferi
SKIEKVKSDGKPVP

SEQ ID NO: 90776 - protein, 14 aa, Borrelia burgdorferi
KIEKVKSDGKPVPG

SEQ ID NO: 90777 - protein, 14 aa, Borrelia burgdorferi
IEKVKSDGKPVPGD

SEQ ID NO: 90778 - protein, 14 aa, Borrelia burgdorferi
EKVKSDGKPVPGDK

SEQ ID NO: 90779 - protein, 14 aa, Borrelia burgdorferi
KVKSDGKPVPGDKI

SEQ ID NO: 90780 - protein, 14 aa, Borrelia burgdorferi
VKSDGKPVPGDKIL

SEQ ID NO: 90781 - protein, 14 aa, Borrelia burgdorferi
KSDGKPVPGDKILS

SEQ ID NO: 90782 - protein, 14 aa, Borrelia burgdorferi
SDGKPVPGDKILSS

SEQ ID NO: 90783 - protein, 14 aa, Borrelia burgdorferi
DGKPVPGDKILSSN

SEQ ID NO: 90784 - protein, 14 aa, Borrelia burgdorferi
GKPVPGDKILSSNK

SEQ ID NO: 90785 - protein, 14 aa, Borrelia burgdorferi
KPVPGDKILSSNKD

SEQ ID NO: 90786 - protein, 14 aa, Borrelia burgdorferi
PVPGDKILSSNKDI

SEQ ID NO: 90787 - protein, 14 aa, Borrelia burgdorferi
VPGDKILSSNKDIY

SEQ ID NO: 90788 - protein, 14 aa, Borrelia burgdorferi
PGDKILSSNKDIYN

SEQ ID NO: 90789 - protein, 14 aa, Borrelia burgdorferi
GDKILSSNKDIYNS

SEQ ID NO: 90790 - protein, 14 aa, Borrelia burgdorferi
DKILSSNKDIYNSY

SEQ ID NO: 90791 - protein, 14 aa, Borrelia burgdorferi
KILSSNKDIYNSYI

SEQ ID NO: 90792 - protein, 14 aa, Borrelia burgdorferi
ILSSNKDIYNSYIP

SEQ ID NO: 90793 - protein, 14 aa, Borrelia burgdorferi
LSSNKDIYNSYIPE

SEQ ID NO: 90794 - protein, 14 aa, Borrelia burgdorferi
SSNKDIYNSYIPEV

SEQ ID NO: 90795 - protein, 14 aa, Borrelia burgdorferi
SNKDIYNSYIPEVK

SEQ ID NO: 90796 - protein, 14 aa, Borrelia burgdorferi
NKDIYNSYIPEVKE

SEQ ID NO: 90797 - protein, 14 aa, Borrelia burgdorferi
KDIYNSYIPEVKEE

SEQ ID NO: 90798 - protein, 14 aa, Borrelia burgdorferi
DIYNSYIPEVKEEI

SEQ ID NO: 90799 - protein, 14 aa, Borrelia burgdorferi
IYNSYIPEVKEEIV

SEQ ID NO: 90800 - protein, 14 aa, Borrelia burgdorferi
YNSYIPEVKEEIVY

SEQ ID NO: 90801 - protein, 14 aa, Borrelia burgdorferi
NSYIPEVKEEIVYE

SEQ ID NO: 90802 - protein, 14 aa, Borrelia burgdorferi
SYIPEVKEEIVYEI

SEQ ID NO: 90803 - protein, 14 aa, Borrelia burgdorferi
YIPEVKEEIVYEIL

SEQ ID NO: 90804 - protein, 14 aa, Borrelia burgdorferi
IPEVKEEIVYEILE

SEQ ID NO: 90805 - protein, 14 aa, Borrelia burgdorferi
PEVKEEIVYEILEE

SEQ ID NO: 90806 - protein, 14 aa, Borrelia burgdorferi
EVKEEIVYEILEEV

SEQ ID NO: 90807 - protein, 14 aa, Borrelia burgdorferi
VKEEIVYEILEEVI

SEQ ID NO: 90808 - protein, 14 aa, Borrelia burgdorferi
KEEIVYEILEEVII

SEQ ID NO: 90809 - protein, 14 aa, Borrelia burgdorferi
EEIVYEILEEVIIP

SEQ ID NO: 90810 - protein, 14 aa, Borrelia burgdorferi
EIVYEILEEVIIPE

SEQ ID NO: 90811 - protein, 14 aa, Borrelia burgdorferi
IVYEILEEVIIPET

SEQ ID NO: 90812 - protein, 14 aa, Borrelia burgdorferi
VYEILEEVIIPETK

SEQ ID NO: 90813 - protein, 14 aa, Borrelia burgdorferi
YEILEEVIIPETKI

SEQ ID NO: 90814 - protein, 14 aa, Borrelia burgdorferi
EILEEVIIPETKIP

SEQ ID NO: 90815 - protein, 14 aa, Borrelia burgdorferi
ILEEVIIPETKIPE

SEQ ID NO: 90816 - protein, 14 aa, Borrelia burgdorferi
LEEVIIPETKIPEI

SEQ ID NO: 90817 - protein, 14 aa, Borrelia burgdorferi
EEVIIPETKIPEIT

SEQ ID NO: 90818 - protein, 14 aa, Borrelia burgdorferi
EVIIPETKIPEITE

SEQ ID NO: 90819 - protein, 14 aa, Borrelia burgdorferi
VIIPETKIPEITEE

SEQ ID NO: 90820 - protein, 14 aa, Borrelia burgdorferi
IIPETKIPEITEEV

SEQ ID NO: 90821 - protein, 14 aa, Borrelia burgdorferi
IPETKIPEITEEVI

SEQ ID NO: 90822 - protein, 14 aa, Borrelia burgdorferi
PETKIPEITEEVIM

SEQ ID NO: 90823 - protein, 14 aa, Borrelia burgdorferi
ETKIPEITEEVIMP

SEQ ID NO: 90824 - protein, 14 aa, Borrelia burgdorferi
TKIPEITEEVIMPI

SEQ ID NO: 90825 - protein, 14 aa, Borrelia burgdorferi
KIPEITEEVIMPIP

SEQ ID NO: 90826 - protein, 14 aa, Borrelia burgdorferi
IPEITEEVIMPIPQ

SEQ ID NO: 90827 - protein, 14 aa, Borrelia burgdorferi
PEITEEVIMPIPQT

SEQ ID NO: 90828 - protein, 14 aa, Borrelia burgdorferi
EITEEVIMPIPQTI

SEQ ID NO: 90829 - protein, 14 aa, Borrelia burgdorferi
ITEEVIMPIPQTID

SEQ ID NO: 90830 - protein, 14 aa, Borrelia burgdorferi
TEEVIMPIPQTIDF

SEQ ID NO: 90831 - protein, 14 aa, Borrelia burgdorferi
EEVIMPIPQTIDFY

SEQ ID NO: 90832 - protein, 14 aa, Borrelia burgdorferi
EVIMPIPQTIDFYI

SEQ ID NO: 90833 - protein, 14 aa, Borrelia burgdorferi
VIMPIPQTIDFYIE

SEQ ID NO: 90834 - protein, 14 aa, Borrelia burgdorferi
IMPIPQTIDFYIEP

SEQ ID NO: 90835 - protein, 14 aa, Borrelia burgdorferi
MPIPQTIDFYIEPR

SEQ ID NO: 90836 - protein, 14 aa, Borrelia burgdorferi
PIPQTIDFYIEPRP

SEQ ID NO: 90837 - protein, 14 aa, Borrelia burgdorferi
IPQTIDFYIEPRPI

SEQ ID NO: 90838 - protein, 14 aa, Borrelia burgdorferi
PQTIDFYIEPRPIS

SEQ ID NO: 90839 - protein, 14 aa, Borrelia burgdorferi
QTIDFYIEPRPISS

SEQ ID NO: 90840 - protein, 14 aa, Borrelia burgdorferi
TIDFYIEPRPISSF

SEQ ID NO: 90841 - protein, 14 aa, Borrelia burgdorferi
IDFYIEPRPISSFL

SEQ ID NO: 90842 - protein, 14 aa, Borrelia burgdorferi
DFYIEPRPISSFLT

SEQ ID NO: 90843 - protein, 14 aa, Borrelia burgdorferi
FYIEPRPISSFLTQ

SEQ ID NO: 90844 - protein, 14 aa, Borrelia burgdorferi
YIEPRPISSFLTQG

SEQ ID NO: 90845 - protein, 14 aa, Borrelia burgdorferi
IEPRPISSFLTQGT

SEQ ID NO: 90846 - protein, 14 aa, Borrelia burgdorferi
EPRPISSFLTQGTS

SEQ ID NO: 90847 - protein, 14 aa, Borrelia burgdorferi
PRPISSFLTQGTSP

SEQ ID NO: 90848 - protein, 14 aa, Borrelia burgdorferi
RPISSFLTQGTSPS

SEQ ID NO: 90849 - protein, 14 aa, Borrelia burgdorferi
PISSFLTQGTSPSI

SEQ ID NO: 90850 - protein, 14 aa, Borrelia burgdorferi
ISSFLTQGTSPSIT

SEQ ID NO: 90851 - protein, 14 aa, Borrelia burgdorferi
SSFLTQGTSPSITS

SEQ ID NO: 90852 - protein, 14 aa, Borrelia burgdorferi
SFLTQGTSPSITST

SEQ ID NO: 90853 - protein, 14 aa, Borrelia burgdorferi
FLTQGTSPSITSTI

SEQ ID NO: 90854 - protein, 14 aa, Borrelia burgdorferi
LTQGTSPSITSTIK

SEQ ID NO: 90855 - protein, 14 aa, Borrelia burgdorferi
TQGTSPSITSTIKS

SEQ ID NO: 90856 - protein, 14 aa, Borrelia burgdorferi
QGTSPSITSTIKSY

SEQ ID NO: 90857 - protein, 14 aa, Borrelia burgdorferi
GTSPSITSTIKSYK

SEQ ID NO: 90858 - protein, 14 aa, Borrelia burgdorferi
TSPSITSTIKSYKE

SEQ ID NO: 90859 - protein, 14 aa, Borrelia burgdorferi
SPSITSTIKSYKEL

SEQ ID NO: 90860 - protein, 14 aa, Borrelia burgdorferi
PSITSTIKSYKELA

SEQ ID NO: 90861 - protein, 14 aa, Borrelia burgdorferi
SITSTIKSYKELAK

SEQ ID NO: 90862 - protein, 14 aa, Borrelia burgdorferi
ITSTIKSYKELAKE

SEQ ID NO: 90863 - protein, 14 aa, Borrelia burgdorferi
TSTIKSYKELAKEK

SEQ ID NO: 90864 - protein, 14 aa, Borrelia burgdorferi
STIKSYKELAKEKI

SEQ ID NO: 90865 - protein, 14 aa, Borrelia burgdorferi
TIKSYKELAKEKIN

SEQ ID NO: 90866 - protein, 14 aa, Borrelia burgdorferi
IKSYKELAKEKINN

SEQ ID NO: 90867 - protein, 14 aa, Borrelia burgdorferi
KSYKELAKEKINNG

SEQ ID NO: 90868 - protein, 14 aa, Borrelia burgdorferi
SYKELAKEKINNGL

SEQ ID NO: 90869 - protein, 14 aa, Borrelia burgdorferi
YKELAKEKINNGLN

SEQ ID NO: 90870 - protein, 14 aa, Borrelia burgdorferi
KELAKEKINNGLNI

SEQ ID NO: 90871 - protein, 14 aa, Borrelia burgdorferi
ELAKEKINNGLNIV

SEQ ID NO: 90872 - protein, 14 aa, Borrelia burgdorferi
LAKEKINNGLNIVQ

SEQ ID NO: 90873 - protein, 14 aa, Borrelia burgdorferi
AKEKINNGLNIVQK

SEQ ID NO: 90874 - protein, 14 aa, Borrelia burgdorferi
KEKINNGLNIVQKI

SEQ ID NO: 90875 - protein, 14 aa, Borrelia burgdorferi
EKINNGLNIVQKIT

SEQ ID NO: 90876 - protein, 14 aa, Borrelia burgdorferi
KINNGLNIVQKITQ

SEQ ID NO: 90877 - protein, 14 aa, Borrelia burgdorferi
INNGLNIVQKITQN

SEQ ID NO: 90878 - protein, 14 aa, Borrelia burgdorferi
NNGLNIVQKITQNI

SEQ ID NO: 90879 - protein, 14 aa, Borrelia burgdorferi
NGLNIVQKITQNID

SEQ ID NO: 90880 - protein, 14 aa, Borrelia burgdorferi
GLNIVQKITQNIDN

SEQ ID NO: 90881 - protein, 14 aa, Borrelia burgdorferi
LNIVQKITQNIDNI

SEQ ID NO: 90882 - protein, 14 aa, Borrelia burgdorferi
NIVQKITQNIDNIT

SEQ ID NO: 90883 - protein, 14 aa, Borrelia burgdorferi
IVQKITQNIDNITE

SEQ ID NO: 90884 - protein, 14 aa, Borrelia burgdorferi
VQKITQNIDNITEN

SEQ ID NO: 90885 - protein, 14 aa, Borrelia burgdorferi
QKITQNIDNITENL

SEQ ID NO: 90886 - protein, 14 aa, Borrelia burgdorferi
KITQNIDNITENLN

SEQ ID NO: 90887 - protein, 14 aa, Borrelia burgdorferi
ITQNIDNITENLNS

SEQ ID NO: 90888 - protein, 14 aa, Borrelia burgdorferi
TQNIDNITENLNSK

SEQ ID NO: 90889 - protein, 14 aa, Borrelia burgdorferi
QNIDNITENLNSKE

SEQ ID NO: 90890 - protein, 14 aa, Borrelia burgdorferi
NIDNITENLNSKET

SEQ ID NO: 90891 - protein, 14 aa, Borrelia burgdorferi
IDNITENLNSKETP

SEQ ID NO: 90892 - protein, 14 aa, Borrelia burgdorferi
DNITENLNSKETPK

SEQ ID NO: 90893 - protein, 14 aa, Borrelia burgdorferi
NITENLNSKETPKE

SEQ ID NO: 90894 - protein, 14 aa, Borrelia burgdorferi
ITENLNSKETPKEI

SEQ ID NO: 90895 - protein, 14 aa, Borrelia burgdorferi
TENLNSKETPKEIS

SEQ ID NO: 90896 - protein, 14 aa, Borrelia burgdorferi
ENLNSKETPKEISG

SEQ ID NO: 90897 - protein, 14 aa, Borrelia burgdorferi
NLNSKETPKEISGK

SEQ ID NO: 90898 - protein, 14 aa, Borrelia burgdorferi
LNSKETPKEISGKE

SEQ ID NO: 90899 - protein, 14 aa, Borrelia burgdorferi
NSKETPKEISGKEV

SEQ ID NO: 90900 - protein, 14 aa, Borrelia burgdorferi
SKETPKEISGKEVE

SEQ ID NO: 90901 - protein, 14 aa, Borrelia burgdorferi
KETPKEISGKEVEE

SEQ ID NO: 90902 - protein, 14 aa, Borrelia burgdorferi
ETPKEISGKEVEEK

SEQ ID NO: 90903 - protein, 14 aa, Borrelia burgdorferi
TPKEISGKEVEEKI

SEQ ID NO: 90904 - protein, 14 aa, Borrelia burgdorferi
PKEISGKEVEEKIT

SEQ ID NO: 90905 - protein, 14 aa, Borrelia burgdorferi
KEISGKEVEEKITH

SEQ ID NO: 90906 - protein, 14 aa, Borrelia burgdorferi
EISGKEVEEKITHP

SEQ ID NO: 90907 - protein, 14 aa, Borrelia burgdorferi
ISGKEVEEKITHPI

SEQ ID NO: 90908 - protein, 14 aa, Borrelia burgdorferi
SGKEVEEKITHPIF

SEQ ID NO: 90909 - protein, 14 aa, Borrelia burgdorferi
GKEVEEKITHPIFD

SEQ ID NO: 90910 - protein, 14 aa, Borrelia burgdorferi
KEVEEKITHPIFDH

SEQ ID NO: 90911 - protein, 14 aa, Borrelia burgdorferi
EVEEKITHPIFDHI

SEQ ID NO: 90912 - protein, 14 aa, Borrelia burgdorferi
VEEKITHPIFDHIT

SEQ ID NO: 90913 - protein, 14 aa, Borrelia burgdorferi
EEKITHPIFDHITG

SEQ ID NO: 90914 - protein, 14 aa, Borrelia burgdorferi
EKITHPIFDHITGS

SEQ ID NO: 90915 - protein, 14 aa, Borrelia burgdorferi
KITHPIFDHITGSG

SEQ ID NO: 90916 - protein, 14 aa, Borrelia burgdorferi
ITHPIFDHITGSGN

SEQ ID NO: 90917 - protein, 14 aa, Borrelia burgdorferi
THPIFDHITGSGNN

SEQ ID NO: 90918 - protein, 14 aa, Borrelia burgdorferi
HPIFDHITGSGNNP

SEQ ID NO: 90919 - protein, 14 aa, Borrelia burgdorferi
PIFDHITGSGNNPG

SEQ ID NO: 90920 - protein, 14 aa, Borrelia burgdorferi
IFDHITGSGNNPGQ

SEQ ID NO: 90921 - protein, 14 aa, Borrelia burgdorferi
FDHITGSGNNPGQD

SEQ ID NO: 90922 - protein, 14 aa, Borrelia burgdorferi
DHITGSGNNPGQDS

SEQ ID NO: 90923 - protein, 14 aa, Borrelia burgdorferi
HITGSGNNPGQDSI

SEQ ID NO: 90924 - protein, 14 aa, Borrelia burgdorferi
ITGSGNNPGQDSIS

SEQ ID NO: 90925 - protein, 14 aa, Borrelia burgdorferi
TGSGNNPGQDSISN

SEQ ID NO: 90926 - protein, 14 aa, Borrelia burgdorferi
GSGNNPGQDSISNT

SEQ ID NO: 90927 - protein, 14 aa, Borrelia burgdorferi
SGNNPGQDSISNTW

SEQ ID NO: 90928 - protein, 14 aa, Borrelia burgdorferi
GNNPGQDSISNTWG

SEQ ID NO: 90929 - protein, 14 aa, Borrelia burgdorferi
NNPGQDSISNTWGE

SEQ ID NO: 90930 - protein, 14 aa, Borrelia burgdorferi
NPGQDSISNTWGEG

SEQ ID NO: 90931 - protein, 14 aa, Borrelia burgdorferi
PGQDSISNTWGEGL

SEQ ID NO: 90932 - protein, 14 aa, Borrelia burgdorferi
GQDSISNTWGEGLE

SEQ ID NO: 90933 - protein, 14 aa, Borrelia burgdorferi
QDSISNTWGEGLEI

SEQ ID NO: 90934 - protein, 14 aa, Borrelia burgdorferi
DSISNTWGEGLEIG

SEQ ID NO: 90935 - protein, 14 aa, Borrelia burgdorferi
SISNTWGEGLEIGG

SEQ ID NO: 90936 - protein, 14 aa, Borrelia burgdorferi
ISNTWGEGLEIGGD

SEQ ID NO: 90937 - protein, 14 aa, Borrelia burgdorferi
SNTWGEGLEIGGDS

SEQ ID NO: 90938 - protein, 14 aa, Borrelia burgdorferi
NTWGEGLEIGGDSN

SEQ ID NO: 90939 - protein, 14 aa, Borrelia burgdorferi
TWGEGLEIGGDSNF

SEQ ID NO: 90940 - protein, 14 aa, Borrelia burgdorferi
WGEGLEIGGDSNFF

SEQ ID NO: 90941 - protein, 14 aa, Borrelia burgdorferi
GEGLEIGGDSNFFT

SEQ ID NO: 90942 - protein, 14 aa, Borrelia burgdorferi
EGLEIGGDSNFFTN

SEQ ID NO: 90943 - protein, 14 aa, Borrelia burgdorferi
GLEIGGDSNFFTNL

SEQ ID NO: 90944 - protein, 14 aa, Borrelia burgdorferi
LEIGGDSNFFTNLE

SEQ ID NO: 90945 - protein, 14 aa, Borrelia burgdorferi
EIGGDSNFFTNLEE

SEQ ID NO: 90946 - protein, 14 aa, Borrelia burgdorferi
IGGDSNFFTNLEEV

SEQ ID NO: 90947 - protein, 14 aa, Borrelia burgdorferi
GGDSNFFTNLEEVR

SEQ ID NO: 90948 - protein, 14 aa, Borrelia burgdorferi
GDSNFFTNLEEVRS

SEQ ID NO: 90949 - protein, 14 aa, Borrelia burgdorferi
DSNFFTNLEEVRSS

SEQ ID NO: 90950 - protein, 14 aa, Borrelia burgdorferi
SNFFTNLEEVRSSI

SEQ ID NO: 90951 - protein, 14 aa, Borrelia burgdorferi
NFFTNLEEVRSSIR

SEQ ID NO: 90952 - protein, 14 aa, Borrelia burgdorferi
FFTNLEEVRSSIRT

SEQ ID NO: 90953 - protein, 14 aa, Borrelia burgdorferi
FTNLEEVRSSIRTK

SEQ ID NO: 90954 - protein, 14 aa, Borrelia burgdorferi
TNLEEVRSSIRTKI

SEQ ID NO: 90955 - protein, 14 aa, Borrelia burgdorferi
NLEEVRSSIRTKIK

SEQ ID NO: 90956 - protein, 14 aa, Borrelia burgdorferi
LEEVRSSIRTKIKV

SEQ ID NO: 90957 - protein, 14 aa, Borrelia burgdorferi
EEVRSSIRTKIKVS

SEQ ID NO: 90958 - protein, 14 aa, Borrelia burgdorferi
EVRSSIRTKIKVSD

SEQ ID NO: 90959 - protein, 14 aa, Borrelia burgdorferi
VRSSIRTKIKVSDG

SEQ ID NO: 90960 - protein, 14 aa, Borrelia burgdorferi
RSSIRTKIKVSDGT

SEQ ID NO: 90961 - protein, 14 aa, Borrelia burgdorferi
SSIRTKIKVSDGTE

SEQ ID NO: 90962 - protein, 14 aa, Borrelia burgdorferi
SIRTKIKVSDGTEQ

SEQ ID NO: 90963 - protein, 14 aa, Borrelia burgdorferi
IRTKIKVSDGTEQT

SEQ ID NO: 90964 - protein, 14 aa, Borrelia burgdorferi
RTKIKVSDGTEQTK

SEQ ID NO: 90965 - protein, 14 aa, Borrelia burgdorferi
TKIKVSDGTEQTKD

SEQ ID NO: 90966 - protein, 14 aa, Borrelia burgdorferi
KIKVSDGTEQTKDK

SEQ ID NO: 90967 - protein, 14 aa, Borrelia burgdorferi
IKVSDGTEQTKDKV

SEQ ID NO: 90968 - protein, 14 aa, Borrelia burgdorferi
KVSDGTEQTKDKVE

SEQ ID NO: 90969 - protein, 14 aa, Borrelia burgdorferi
VSDGTEQTKDKVEI

SEQ ID NO: 90970 - protein, 14 aa, Borrelia burgdorferi
SDGTEQTKDKVEID

SEQ ID NO: 90971 - protein, 14 aa, Borrelia burgdorferi
DGTEQTKDKVEIDE

SEQ ID NO: 90972 - protein, 14 aa, Borrelia burgdorferi
GTEQTKDKVEIDEI

SEQ ID NO: 90973 - protein, 14 aa, Borrelia burgdorferi
TEQTKDKVEIDEII

SEQ ID NO: 90974 - protein, 14 aa, Borrelia burgdorferi
EQTKDKVEIDEIIE

SEQ ID NO: 90975 - protein, 14 aa, Borrelia burgdorferi
QTKDKVEIDEIIED

SEQ ID NO: 90976 - protein, 14 aa, Borrelia burgdorferi
TKDKVEIDEIIEDL

SEQ ID NO: 90977 - protein, 14 aa, Borrelia burgdorferi
KDKVEIDEIIEDLQ

SEQ ID NO: 90978 - protein, 14 aa, Borrelia burgdorferi
DKVEIDEIIEDLQK

SEQ ID NO: 90979 - protein, 14 aa, Borrelia burgdorferi
KVEIDEIIEDLQKL

SEQ ID NO: 90980 - protein, 14 aa, Borrelia burgdorferi
VEIDEIIEDLQKLK

SEQ ID NO: 90981 - protein, 14 aa, Borrelia burgdorferi
EIDEIIEDLQKLKE

SEQ ID NO: 90982 - protein, 14 aa, Borrelia burgdorferi
IDEIIEDLQKLKEF

SEQ ID NO: 90983 - protein, 14 aa, Borrelia burgdorferi
DEIIEDLQKLKEFL

SEQ ID NO: 90984 - protein, 14 aa, Borrelia burgdorferi
EIIEDLQKLKEFLE

SEQ ID NO: 90985 - protein, 14 aa, Borrelia burgdorferi
IIEDLQKLKEFLEK

SEQ ID NO: 90986 - protein, 14 aa, Borrelia burgdorferi
IEDLQKLKEFLEKL

SEQ ID NO: 90987 - protein, 14 aa, Borrelia burgdorferi
EDLQKLKEFLEKLK

SEQ ID NO: 90988 - protein, 14 aa, Borrelia burgdorferi
DLQKLKEFLEKLKK

SEQ ID NO: 90989 - protein, 14 aa, Borrelia burgdorferi
LQKLKEFLEKLKKY

SEQ ID NO: 90990 - protein, 14 aa, Borrelia burgdorferi
QKLKEFLEKLKKYL

SEQ ID NO: 90991 - protein, 14 aa, Borrelia burgdorferi
KLKEFLEKLKKYLK

SEQ ID NO: 90992 - protein, 14 aa, Borrelia burgdorferi
LKEFLEKLKKYLKD

SEQ ID NO: 90993 - protein, 14 aa, Borrelia burgdorferi
KEFLEKLKKYLKDT

SEQ ID NO: 90994 - protein, 14 aa, Borrelia burgdorferi
EFLEKLKKYLKDTN

SEQ ID NO: 90995 - protein, 14 aa, Borrelia burgdorferi
FLEKLKKYLKDTNN

SEQ ID NO: 90996 - protein, 14 aa, Borrelia burgdorferi
LEKLKKYLKDTNNL

SEQ ID NO: 90997 - protein, 14 aa, Borrelia burgdorferi
EKLKKYLKDTNNLS

SEQ ID NO: 90998 - protein, 14 aa, Borrelia burgdorferi
KLKKYLKDTNNLSA

SEQ ID NO: 90999 - protein, 14 aa, Borrelia burgdorferi
LKKYLKDTNNLSAI

SEQ ID NO: 91000 - protein, 14 aa, Borrelia burgdorferi
KKYLKDTNNLSAIE

SEQ ID NO: 91001 - protein, 14 aa, Borrelia burgdorferi
KYLKDTNNLSAIEE

SEQ ID NO: 91002 - protein, 14 aa, Borrelia burgdorferi
YLKDTNNLSAIEES

SEQ ID NO: 91003 - protein, 14 aa, Borrelia burgdorferi
LKDTNNLSAIEESV

SEQ ID NO: 91004 - protein, 14 aa, Borrelia burgdorferi
KDTNNLSAIEESVK

SEQ ID NO: 91005 - protein, 14 aa, Borrelia burgdorferi
DTNNLSAIEESVKG

SEQ ID NO: 91006 - protein, 14 aa, Borrelia burgdorferi
TNNLSAIEESVKGL

SEQ ID NO: 91007 - protein, 14 aa, Borrelia burgdorferi
NNLSAIEESVKGLS

SEQ ID NO: 91008 - protein, 15 aa, Borrelia burgdorferi
MCAFLLLNLVNCKFD

SEQ ID NO: 91009 - protein, 15 aa, Borrelia burgdorferi
CAFLLLNLVNCKFDS

SEQ ID NO: 91010 - protein, 15 aa, Borrelia burgdorferi
AFLLLNLVNCKFDSL

SEQ ID NO: 91011 - protein, 15 aa, Borrelia burgdorferi
FLLLNLVNCKFDSLN

SEQ ID NO: 91012 - protein, 15 aa, Borrelia burgdorferi
LLLNLVNCKFDSLNL

SEQ ID NO: 91013 - protein, 15 aa, Borrelia burgdorferi
LLNLVNCKFDSLNLS

SEQ ID NO: 91014 - protein, 15 aa, Borrelia burgdorferi
LNLVNCKFDSLNLST

SEQ ID NO: 91015 - protein, 15 aa, Borrelia burgdorferi
NLVNCKFDSLNLSTK

SEQ ID NO: 91016 - protein, 15 aa, Borrelia burgdorferi
LVNCKFDSLNLSTKS

SEQ ID NO: 91017 - protein, 15 aa, Borrelia burgdorferi
VNCKFDSLNLSTKSV

SEQ ID NO: 91018 - protein, 15 aa, Borrelia burgdorferi
NCKFDSLNLSTKSVD

SEQ ID NO: 91019 - protein, 15 aa, Borrelia burgdorferi
CKFDSLNLSTKSVDD

SEQ ID NO: 91020 - protein, 15 aa, Borrelia burgdorferi
KFDSLNLSTKSVDDK

SEQ ID NO: 91021 - protein, 15 aa, Borrelia burgdorferi
FDSLNLSTKSVDDKN

SEQ ID NO: 91022 - protein, 15 aa, Borrelia burgdorferi
DSLNLSTKSVDDKNN

SEQ ID NO: 91023 - protein, 15 aa, Borrelia burgdorferi
SLNLSTKSVDDKNNS

SEQ ID NO: 91024 - protein, 15 aa, Borrelia burgdorferi
LNLSTKSVDDKNNSI

SEQ ID NO: 91025 - protein, 15 aa, Borrelia burgdorferi
NLSTKSVDDKNNSIA

SEQ ID NO: 91026 - protein, 15 aa, Borrelia burgdorferi
LSTKSVDDKNNSIAK

SEQ ID NO: 91027 - protein, 15 aa, Borrelia burgdorferi
STKSVDDKNNSIAKL

SEQ ID NO: 91028 - protein, 15 aa, Borrelia burgdorferi
TKSVDDKNNSIAKLL

SEQ ID NO: 91029 - protein, 15 aa, Borrelia burgdorferi
KSVDDKNNSIAKLLQ

SEQ ID NO: 91030 - protein, 15 aa, Borrelia burgdorferi
SVDDKNNSIAKLLQH

SEQ ID NO: 91031 - protein, 15 aa, Borrelia burgdorferi
VDDKNNSIAKLLQHL

SEQ ID NO: 91032 - protein, 15 aa, Borrelia burgdorferi
DDKNNSIAKLLQHLS

SEQ ID NO: 91033 - protein, 15 aa, Borrelia burgdorferi
DKNNSIAKLLQHLSK

SEQ ID NO: 91034 - protein, 15 aa, Borrelia burgdorferi
KNNSIAKLLQHLSKS

SEQ ID NO: 91035 - protein, 15 aa, Borrelia burgdorferi
NNSIAKLLQHLSKSE

SEQ ID NO: 91036 - protein, 15 aa, Borrelia burgdorferi
NSIAKLLQHLSKSED

SEQ ID NO: 91037 - protein, 15 aa, Borrelia burgdorferi
SIAKLLQHLSKSEDQ

SEQ ID NO: 91038 - protein, 15 aa, Borrelia burgdorferi
IAKLLQHLSKSEDQA

SEQ ID NO: 91039 - protein, 15 aa, Borrelia burgdorferi
AKLLQHLSKSEDQAN

SEQ ID NO: 91040 - protein, 15 aa, Borrelia burgdorferi
KLLQHLSKSEDQANK

SEQ ID NO: 91041 - protein, 15 aa, Borrelia burgdorferi
LLQHLSKSEDQANKT

SEQ ID NO: 91042 - protein, 15 aa, Borrelia burgdorferi
LQHLSKSEDQANKTS

SEQ ID NO: 91043 - protein, 15 aa, Borrelia burgdorferi
QHLSKSEDQANKTST

SEQ ID NO: 91044 - protein, 15 aa, Borrelia burgdorferi
HLSKSEDQANKTSTS

SEQ ID NO: 91045 - protein, 15 aa, Borrelia burgdorferi
LSKSEDQANKTSTSE

SEQ ID NO: 91046 - protein, 15 aa, Borrelia burgdorferi
SKSEDQANKTSTSED

SEQ ID NO: 91047 - protein, 15 aa, Borrelia burgdorferi
KSEDQANKTSTSEDQ

SEQ ID NO: 91048 - protein, 15 aa, Borrelia burgdorferi
SEDQANKTSTSEDQK

SEQ ID NO: 91049 - protein, 15 aa, Borrelia burgdorferi
EDQANKTSTSEDQKE

SEQ ID NO: 91050 - protein, 15 aa, Borrelia burgdorferi
DQANKTSTSEDQKEL

SEQ ID NO: 91051 - protein, 15 aa, Borrelia burgdorferi
QANKTSTSEDQKELE

SEQ ID NO: 91052 - protein, 15 aa, Borrelia burgdorferi
ANKTSTSEDQKELEI

SEQ ID NO: 91053 - protein, 15 aa, Borrelia burgdorferi
NKTSTSEDQKELEIT

SEQ ID NO: 91054 - protein, 15 aa, Borrelia burgdorferi
KTSTSEDQKELEITE

SEQ ID NO: 91055 - protein, 15 aa, Borrelia burgdorferi
TSTSEDQKELEITEN

SEQ ID NO: 91056 - protein, 15 aa, Borrelia burgdorferi
STSEDQKELEITENK

SEQ ID NO: 91057 - protein, 15 aa, Borrelia burgdorferi
TSEDQKELEITENKE

SEQ ID NO: 91058 - protein, 15 aa, Borrelia burgdorferi
SEDQKELEITENKEQ

SEQ ID NO: 91059 - protein, 15 aa, Borrelia burgdorferi
EDQKELEITENKEQE

SEQ ID NO: 91060 - protein, 15 aa, Borrelia burgdorferi
DQKELEITENKEQEH

SEQ ID NO: 91061 - protein, 15 aa, Borrelia burgdorferi
QKELEITENKEQEHE

SEQ ID NO: 91062 - protein, 15 aa, Borrelia burgdorferi
KELEITENKEQEHEK

SEQ ID NO: 91063 - protein, 15 aa, Borrelia burgdorferi
ELEITENKEQEHEKL

SEQ ID NO: 91064 - protein, 15 aa, Borrelia burgdorferi
LEITENKEQEHEKLS

SEQ ID NO: 91065 - protein, 15 aa, Borrelia burgdorferi
EITENKEQEHEKLSQ

SEQ ID NO: 91066 - protein, 15 aa, Borrelia burgdorferi
ITENKEQEHEKLSQV

SEQ ID NO: 91067 - protein, 15 aa, Borrelia burgdorferi
TENKEQEHEKLSQVA

SEQ ID NO: 91068 - protein, 15 aa, Borrelia burgdorferi
ENKEQEHEKLSQVAQ

SEQ ID NO: 91069 - protein, 15 aa, Borrelia burgdorferi
NKEQEHEKLSQVAQH

SEQ ID NO: 91070 - protein, 15 aa, Borrelia burgdorferi
KEQEHEKLSQVAQHA

SEQ ID NO: 91071 - protein, 15 aa, Borrelia burgdorferi
EQEHEKLSQVAQHAP

SEQ ID NO: 91072 - protein, 15 aa, Borrelia burgdorferi
QEHEKLSQVAQHAPN

SEQ ID NO: 91073 - protein, 15 aa, Borrelia burgdorferi
EHEKLSQVAQHAPNS

SEQ ID NO: 91074 - protein, 15 aa, Borrelia burgdorferi
HEKLSQVAQHAPNSK

SEQ ID NO: 91075 - protein, 15 aa, Borrelia burgdorferi
EKLSQVAQHAPNSKI

SEQ ID NO: 91076 - protein, 15 aa, Borrelia burgdorferi
KLSQVAQHAPNSKIE

SEQ ID NO: 91077 - protein, 15 aa, Borrelia burgdorferi
LSQVAQHAPNSKIEK

SEQ ID NO: 91078 - protein, 15 aa, Borrelia burgdorferi
SQVAQHAPNSKIEKV

SEQ ID NO: 91079 - protein, 15 aa, Borrelia burgdorferi
QVAQHAPNSKIEKVK

SEQ ID NO: 91080 - protein, 15 aa, Borrelia burgdorferi
VAQHAPNSKIEKVKS

SEQ ID NO: 91081 - protein, 15 aa, Borrelia burgdorferi
AQHAPNSKIEKVKSD

SEQ ID NO: 91082 - protein, 15 aa, Borrelia burgdorferi
QHAPNSKIEKVKSDG

SEQ ID NO: 91083 - protein, 15 aa, Borrelia burgdorferi
HAPNSKIEKVKSDGK

SEQ ID NO: 91084 - protein, 15 aa, Borrelia burgdorferi
APNSKIEKVKSDGKP

SEQ ID NO: 91085 - protein, 15 aa, Borrelia burgdorferi
PNSKIEKVKSDGKPV

SEQ ID NO: 91086 - protein, 15 aa, Borrelia burgdorferi
NSKIEKVKSDGKPVP

SEQ ID NO: 91087 - protein, 15 aa, Borrelia burgdorferi
SKIEKVKSDGKPVPG

SEQ ID NO: 91088 - protein, 15 aa, Borrelia burgdorferi
KIEKVKSDGKPVPGD

SEQ ID NO: 91089 - protein, 15 aa, Borrelia burgdorferi
IEKVKSDGKPVPGDK

SEQ ID NO: 91090 - protein, 15 aa, Borrelia burgdorferi
EKVKSDGKPVPGDKI

SEQ ID NO: 91091 - protein, 15 aa, Borrelia burgdorferi
KVKSDGKPVPGDKIL

SEQ ID NO: 91092 - protein, 15 aa, Borrelia burgdorferi
VKSDGKPVPGDKILS

SEQ ID NO: 91093 - protein, 15 aa, Borrelia burgdorferi
KSDGKPVPGDKILSS

SEQ ID NO: 91094 - protein, 15 aa, Borrelia burgdorferi
SDGKPVPGDKILSSN

SEQ ID NO: 91095 - protein, 15 aa, Borrelia burgdorferi
DGKPVPGDKILSSNK

SEQ ID NO: 91096 - protein, 15 aa, Borrelia burgdorferi
GKPVPGDKILSSNKD

SEQ ID NO: 91097 - protein, 15 aa, Borrelia burgdorferi
KPVPGDKILSSNKDI

SEQ ID NO: 91098 - protein, 15 aa, Borrelia burgdorferi
PVPGDKILSSNKDIY

SEQ ID NO: 91099 - protein, 15 aa, Borrelia burgdorferi
VPGDKILSSNKDIYN

SEQ ID NO: 91100 - protein, 15 aa, Borrelia burgdorferi
PGDKILSSNKDIYNS

SEQ ID NO: 91101 - protein, 15 aa, Borrelia burgdorferi
GDKILSSNKDIYNSY

SEQ ID NO: 91102 - protein, 15 aa, Borrelia burgdorferi
DKILSSNKDIYNSYI

SEQ ID NO: 91103 - protein, 15 aa, Borrelia burgdorferi
KILSSNKDIYNSYIP

SEQ ID NO: 91104 - protein, 15 aa, Borrelia burgdorferi
ILSSNKDIYNSYIPE

SEQ ID NO: 91105 - protein, 15 aa, Borrelia burgdorferi
LSSNKDIYNSYIPEV

SEQ ID NO: 91106 - protein, 15 aa, Borrelia burgdorferi
SSNKDIYNSYIPEVK

SEQ ID NO: 91107 - protein, 15 aa, Borrelia burgdorferi
SNKDIYNSYIPEVKE

SEQ ID NO: 91108 - protein, 15 aa, Borrelia burgdorferi
NKDIYNSYIPEVKEE

SEQ ID NO: 91109 - protein, 15 aa, Borrelia burgdorferi
KDIYNSYIPEVKEEI

SEQ ID NO: 91110 - protein, 15 aa, Borrelia burgdorferi
DIYNSYIPEVKEEIV

SEQ ID NO: 91111 - protein, 15 aa, Borrelia burgdorferi
IYNSYIPEVKEEIVY

SEQ ID NO: 91112 - protein, 15 aa, Borrelia burgdorferi
YNSYIPEVKEEIVYE

SEQ ID NO: 91113 - protein, 15 aa, Borrelia burgdorferi
NSYIPEVKEEIVYEI

SEQ ID NO: 91114 - protein, 15 aa, Borrelia burgdorferi
SYIPEVKEEIVYEIL

SEQ ID NO: 91115 - protein, 15 aa, Borrelia burgdorferi
YIPEVKEEIVYEILE

SEQ ID NO: 91116 - protein, 15 aa, Borrelia burgdorferi
IPEVKEEIVYEILEE

SEQ ID NO: 91117 - protein, 15 aa, Borrelia burgdorferi
PEVKEEIVYEILEEV

SEQ ID NO: 91118 - protein, 15 aa, Borrelia burgdorferi
EVKEEIVYEILEEVI

SEQ ID NO: 91119 - protein, 15 aa, Borrelia burgdorferi
VKEEIVYEILEEVII

SEQ ID NO: 91120 - protein, 15 aa, Borrelia burgdorferi
KEEIVYEILEEVIIP

SEQ ID NO: 91121 - protein, 15 aa, Borrelia burgdorferi
EEIVYEILEEVIIPE

SEQ ID NO: 91122 - protein, 15 aa, Borrelia burgdorferi
EIVYEILEEVIIPET

SEQ ID NO: 91123 - protein, 15 aa, Borrelia burgdorferi
IVYEILEEVIIPETK

SEQ ID NO: 91124 - protein, 15 aa, Borrelia burgdorferi
VYEILEEVIIPETKI

SEQ ID NO: 91125 - protein, 15 aa, Borrelia burgdorferi
YEILEEVIIPETKIP

SEQ ID NO: 91126 - protein, 15 aa, Borrelia burgdorferi
EILEEVIIPETKIPE

SEQ ID NO: 91127 - protein, 15 aa, Borrelia burgdorferi
ILEEVIIPETKIPEI

SEQ ID NO: 91128 - protein, 15 aa, Borrelia burgdorferi
LEEVIIPETKIPEIT

SEQ ID NO: 91129 - protein, 15 aa, Borrelia burgdorferi
EEVIIPETKIPEITE

SEQ ID NO: 91130 - protein, 15 aa, Borrelia burgdorferi
EVIIPETKIPEITEE

SEQ ID NO: 91131 - protein, 15 aa, Borrelia burgdorferi
VIIPETKIPEITEEV

SEQ ID NO: 91132 - protein, 15 aa, Borrelia burgdorferi
IIPETKIPEITEEVI

SEQ ID NO: 91133 - protein, 15 aa, Borrelia burgdorferi
IPETKIPEITEEVIM

SEQ ID NO: 91134 - protein, 15 aa, Borrelia burgdorferi
PETKIPEITEEVIMP

SEQ ID NO: 91135 - protein, 15 aa, Borrelia burgdorferi
ETKIPEITEEVIMPI

SEQ ID NO: 91136 - protein, 15 aa, Borrelia burgdorferi
TKIPEITEEVIMPIP

SEQ ID NO: 91137 - protein, 15 aa, Borrelia burgdorferi
KIPEITEEVIMPIPQ

SEQ ID NO: 91138 - protein, 15 aa, Borrelia burgdorferi
IPEITEEVIMPIPQT

SEQ ID NO: 91139 - protein, 15 aa, Borrelia burgdorferi
PEITEEVIMPIPQTI

SEQ ID NO: 91140 - protein, 15 aa, Borrelia burgdorferi
EITEEVIMPIPQTID

SEQ ID NO: 91141 - protein, 15 aa, Borrelia burgdorferi
ITEEVIMPIPQTIDF

SEQ ID NO: 91142 - protein, 15 aa, Borrelia burgdorferi
TEEVIMPIPQTIDFY

SEQ ID NO: 91143 - protein, 15 aa, Borrelia burgdorferi
EEVIMPIPQTIDFYI

SEQ ID NO: 91144 - protein, 15 aa, Borrelia burgdorferi
EVIMPIPQTIDFYIE

SEQ ID NO: 91145 - protein, 15 aa, Borrelia burgdorferi
VIMPIPQTIDFYIEP

SEQ ID NO: 91146 - protein, 15 aa, Borrelia burgdorferi
IMPIPQTIDFYIEPR

SEQ ID NO: 91147 - protein, 15 aa, Borrelia burgdorferi
MPIPQTIDFYIEPRP

SEQ ID NO: 91148 - protein, 15 aa, Borrelia burgdorferi
PIPQTIDFYIEPRPI

SEQ ID NO: 91149 - protein, 15 aa, Borrelia burgdorferi
IPQTIDFYIEPRPIS

SEQ ID NO: 91150 - protein, 15 aa, Borrelia burgdorferi
PQTIDFYIEPRPISS

SEQ ID NO: 91151 - protein, 15 aa, Borrelia burgdorferi
QTIDFYIEPRPISSF

SEQ ID NO: 91152 - protein, 15 aa, Borrelia burgdorferi
TIDFYIEPRPISSFL

SEQ ID NO: 91153 - protein, 15 aa, Borrelia burgdorferi
IDFYIEPRPISSFLT

SEQ ID NO: 91154 - protein, 15 aa, Borrelia burgdorferi
DFYIEPRPISSFLTQ

SEQ ID NO: 91155 - protein, 15 aa, Borrelia burgdorferi
FYIEPRPISSFLTQG

SEQ ID NO: 91156 - protein, 15 aa, Borrelia burgdorferi
YIEPRPISSFLTQGT

SEQ ID NO: 91157 - protein, 15 aa, Borrelia burgdorferi
IEPRPISSFLTQGTS

SEQ ID NO: 91158 - protein, 15 aa, Borrelia burgdorferi
EPRPISSFLTQGTSP

SEQ ID NO: 91159 - protein, 15 aa, Borrelia burgdorferi
PRPISSFLTQGTSPS

SEQ ID NO: 91160 - protein, 15 aa, Borrelia burgdorferi
RPISSFLTQGTSPSI

SEQ ID NO: 91161 - protein, 15 aa, Borrelia burgdorferi
PISSFLTQGTSPSIT

SEQ ID NO: 91162 - protein, 15 aa, Borrelia burgdorferi
ISSFLTQGTSPSITS

SEQ ID NO: 91163 - protein, 15 aa, Borrelia burgdorferi
SSFLTQGTSPSITST

SEQ ID NO: 91164 - protein, 15 aa, Borrelia burgdorferi
SFLTQGTSPSITSTI

SEQ ID NO: 91165 - protein, 15 aa, Borrelia burgdorferi
FLTQGTSPSITSTIK

SEQ ID NO: 91166 - protein, 15 aa, Borrelia burgdorferi
LTQGTSPSITSTIKS

SEQ ID NO: 91167 - protein, 15 aa, Borrelia burgdorferi
TQGTSPSITSTIKSY

SEQ ID NO: 91168 - protein, 15 aa, Borrelia burgdorferi
QGTSPSITSTIKSYK

SEQ ID NO: 91169 - protein, 15 aa, Borrelia burgdorferi
GTSPSITSTIKSYKE

SEQ ID NO: 91170 - protein, 15 aa, Borrelia burgdorferi
TSPSITSTIKSYKEL

SEQ ID NO: 91171 - protein, 15 aa, Borrelia burgdorferi
SPSITSTIKSYKELA

SEQ ID NO: 91172 - protein, 15 aa, Borrelia burgdorferi
PSITSTIKSYKELAK

SEQ ID NO: 91173 - protein, 15 aa, Borrelia burgdorferi
SITSTIKSYKELAKE

SEQ ID NO: 91174 - protein, 15 aa, Borrelia burgdorferi
ITSTIKSYKELAKEK

SEQ ID NO: 91175 - protein, 15 aa, Borrelia burgdorferi
TSTIKSYKELAKEKI

SEQ ID NO: 91176 - protein, 15 aa, Borrelia burgdorferi
STIKSYKELAKEKIN

SEQ ID NO: 91177 - protein, 15 aa, Borrelia burgdorferi
TIKSYKELAKEKINN

SEQ ID NO: 91178 - protein, 15 aa, Borrelia burgdorferi
IKSYKELAKEKINNG

SEQ ID NO: 91179 - protein, 15 aa, Borrelia burgdorferi
KSYKELAKEKINNGL

SEQ ID NO: 91180 - protein, 15 aa, Borrelia burgdorferi
SYKELAKEKINNGLN

SEQ ID NO: 91181 - protein, 15 aa, Borrelia burgdorferi
YKELAKEKINNGLNI

SEQ ID NO: 91182 - protein, 15 aa, Borrelia burgdorferi
KELAKEKINNGLNIV

SEQ ID NO: 91183 - protein, 15 aa, Borrelia burgdorferi
ELAKEKINNGLNIVQ

SEQ ID NO: 91184 - protein, 15 aa, Borrelia burgdorferi
LAKEKINNGLNIVQK

SEQ ID NO: 91185 - protein, 15 aa, Borrelia burgdorferi
AKEKINNGLNIVQKI

SEQ ID NO: 91186 - protein, 15 aa, Borrelia burgdorferi
KEKINNGLNIVQKIT

SEQ ID NO: 91187 - protein, 15 aa, Borrelia burgdorferi
EKINNGLNIVQKITQ

SEQ ID NO: 91188 - protein, 15 aa, Borrelia burgdorferi
KINNGLNIVQKITQN

SEQ ID NO: 91189 - protein, 15 aa, Borrelia burgdorferi
INNGLNIVQKITQNI

SEQ ID NO: 91190 - protein, 15 aa, Borrelia burgdorferi
NNGLNIVQKITQNID

SEQ ID NO: 91191 - protein, 15 aa, Borrelia burgdorferi
NGLNIVQKITQNIDN

SEQ ID NO: 91192 - protein, 15 aa, Borrelia burgdorferi
GLNIVQKITQNIDNI

SEQ ID NO: 91193 - protein, 15 aa, Borrelia burgdorferi
LNIVQKITQNIDNIT

SEQ ID NO: 91194 - protein, 15 aa, Borrelia burgdorferi
NIVQKITQNIDNITE

SEQ ID NO: 91195 - protein, 15 aa, Borrelia burgdorferi
IVQKITQNIDNITEN

SEQ ID NO: 91196 - protein, 15 aa, Borrelia burgdorferi
VQKITQNIDNITENL

SEQ ID NO: 91197 - protein, 15 aa, Borrelia burgdorferi
QKITQNIDNITENLN

SEQ ID NO: 91198 - protein, 15 aa, Borrelia burgdorferi
KITQNIDNITENLNS

SEQ ID NO: 91199 - protein, 15 aa, Borrelia burgdorferi
ITQNIDNITENLNSK

SEQ ID NO: 91200 - protein, 15 aa, Borrelia burgdorferi
TQNIDNITENLNSKE

SEQ ID NO: 91201 - protein, 15 aa, Borrelia burgdorferi
QNIDNITENLNSKET

SEQ ID NO: 91202 - protein, 15 aa, Borrelia burgdorferi
NIDNITENLNSKETP

SEQ ID NO: 91203 - protein, 15 aa, Borrelia burgdorferi
IDNITENLNSKETPK

SEQ ID NO: 91204 - protein, 15 aa, Borrelia burgdorferi
DNITENLNSKETPKE

SEQ ID NO: 91205 - protein, 15 aa, Borrelia burgdorferi
NITENLNSKETPKEI

SEQ ID NO: 91206 - protein, 15 aa, Borrelia burgdorferi
ITENLNSKETPKEIS

SEQ ID NO: 91207 - protein, 15 aa, Borrelia burgdorferi
TENLNSKETPKEISG

SEQ ID NO: 91208 - protein, 15 aa, Borrelia burgdorferi
ENLNSKETPKEISGK

SEQ ID NO: 91209 - protein, 15 aa, Borrelia burgdorferi
NLNSKETPKEISGKE

SEQ ID NO: 91210 - protein, 15 aa, Borrelia burgdorferi
LNSKETPKEISGKEV

SEQ ID NO: 91211 - protein, 15 aa, Borrelia burgdorferi
NSKETPKEISGKEVE

SEQ ID NO: 91212 - protein, 15 aa, Borrelia burgdorferi
SKETPKEISGKEVEE

SEQ ID NO: 91213 - protein, 15 aa, Borrelia burgdorferi
KETPKEISGKEVEEK

SEQ ID NO: 91214 - protein, 15 aa, Borrelia burgdorferi
ETPKEISGKEVEEKI

SEQ ID NO: 91215 - protein, 15 aa, Borrelia burgdorferi
TPKEISGKEVEEKIT

SEQ ID NO: 91216 - protein, 15 aa, Borrelia burgdorferi
PKEISGKEVEEKITH

SEQ ID NO: 91217 - protein, 15 aa, Borrelia burgdorferi
KEISGKEVEEKITHP

SEQ ID NO: 91218 - protein, 15 aa, Borrelia burgdorferi
EISGKEVEEKITHPI

SEQ ID NO: 91219 - protein, 15 aa, Borrelia burgdorferi
ISGKEVEEKITHPIF

SEQ ID NO: 91220 - protein, 15 aa, Borrelia burgdorferi
SGKEVEEKITHPIFD

SEQ ID NO: 91221 - protein, 15 aa, Borrelia burgdorferi
GKEVEEKITHPIFDH

SEQ ID NO: 91222 - protein, 15 aa, Borrelia burgdorferi
KEVEEKITHPIFDHI

SEQ ID NO: 91223 - protein, 15 aa, Borrelia burgdorferi
EVEEKITHPIFDHIT

SEQ ID NO: 91224 - protein, 15 aa, Borrelia burgdorferi
VEEKITHPIFDHITG

SEQ ID NO: 91225 - protein, 15 aa, Borrelia burgdorferi
EEKITHPIFDHITGS

SEQ ID NO: 91226 - protein, 15 aa, Borrelia burgdorferi
EKITHPIFDHITGSG

SEQ ID NO: 91227 - protein, 15 aa, Borrelia burgdorferi
KITHPIFDHITGSGN

SEQ ID NO: 91228 - protein, 15 aa, Borrelia burgdorferi
ITHPIFDHITGSGNN

SEQ ID NO: 91229 - protein, 15 aa, Borrelia burgdorferi
THPIFDHITGSGNNP

SEQ ID NO: 91230 - protein, 15 aa, Borrelia burgdorferi
HPIFDHITGSGNNPG

SEQ ID NO: 91231 - protein, 15 aa, Borrelia burgdorferi
PIFDHITGSGNNPGQ

SEQ ID NO: 91232 - protein, 15 aa, Borrelia burgdorferi
IFDHITGSGNNPGQD

SEQ ID NO: 91233 - protein, 15 aa, Borrelia burgdorferi
FDHITGSGNNPGQDS

SEQ ID NO: 91234 - protein, 15 aa, Borrelia burgdorferi
DHITGSGNNPGQDSI

SEQ ID NO: 91235 - protein, 15 aa, Borrelia burgdorferi
HITGSGNNPGQDSIS

SEQ ID NO: 91236 - protein, 15 aa, Borrelia burgdorferi
ITGSGNNPGQDSISN

SEQ ID NO: 91237 - protein, 15 aa, Borrelia burgdorferi
TGSGNNPGQDSISNT

SEQ ID NO: 91238 - protein, 15 aa, Borrelia burgdorferi
GSGNNPGQDSISNTW

SEQ ID NO: 91239 - protein, 15 aa, Borrelia burgdorferi
SGNNPGQDSISNTWG

SEQ ID NO: 91240 - protein, 15 aa, Borrelia burgdorferi
GNNPGQDSISNTWGE

SEQ ID NO: 91241 - protein, 15 aa, Borrelia burgdorferi
NNPGQDSISNTWGEG

SEQ ID NO: 91242 - protein, 15 aa, Borrelia burgdorferi
NPGQDSISNTWGEGL

SEQ ID NO: 91243 - protein, 15 aa, Borrelia burgdorferi
PGQDSISNTWGEGLE

SEQ ID NO: 91244 - protein, 15 aa, Borrelia burgdorferi
GQDSISNTWGEGLEI

SEQ ID NO: 91245 - protein, 15 aa, Borrelia burgdorferi
QDSISNTWGEGLEIG

SEQ ID NO: 91246 - protein, 15 aa, Borrelia burgdorferi
DSISNTWGEGLEIGG

SEQ ID NO: 91247 - protein, 15 aa, Borrelia burgdorferi
SISNTWGEGLEIGGD

SEQ ID NO: 91248 - protein, 15 aa, Borrelia burgdorferi
ISNTWGEGLEIGGDS

SEQ ID NO: 91249 - protein, 15 aa, Borrelia burgdorferi
SNTWGEGLEIGGDSN

SEQ ID NO: 91250 - protein, 15 aa, Borrelia burgdorferi
NTWGEGLEIGGDSNF

SEQ ID NO: 91251 - protein, 15 aa, Borrelia burgdorferi
TWGEGLEIGGDSNFF

SEQ ID NO: 91252 - protein, 15 aa, Borrelia burgdorferi
WGEGLEIGGDSNFFT

SEQ ID NO: 91253 - protein, 15 aa, Borrelia burgdorferi
GEGLEIGGDSNFFTN

SEQ ID NO: 91254 - protein, 15 aa, Borrelia burgdorferi
EGLEIGGDSNFFTNL

SEQ ID NO: 91255 - protein, 15 aa, Borrelia burgdorferi
GLEIGGDSNFFTNLE

SEQ ID NO: 91256 - protein, 15 aa, Borrelia burgdorferi
LEIGGDSNFFTNLEE

SEQ ID NO: 91257 - protein, 15 aa, Borrelia burgdorferi
EIGGDSNFFTNLEEV

SEQ ID NO: 91258 - protein, 15 aa, Borrelia burgdorferi
IGGDSNFFTNLEEVR

SEQ ID NO: 91259 - protein, 15 aa, Borrelia burgdorferi
GGDSNFFTNLEEVRS

SEQ ID NO: 91260 - protein, 15 aa, Borrelia burgdorferi
GDSNFFTNLEEVRSS

SEQ ID NO: 91261 - protein, 15 aa, Borrelia burgdorferi
DSNFFTNLEEVRSSI

SEQ ID NO: 91262 - protein, 15 aa, Borrelia burgdorferi
SNFFTNLEEVRSSIR

SEQ ID NO: 91263 - protein, 15 aa, Borrelia burgdorferi
NFFTNLEEVRSSIRT

SEQ ID NO: 91264 - protein, 15 aa, Borrelia burgdorferi
FFTNLEEVRSSIRTK

SEQ ID NO: 91265 - protein, 15 aa, Borrelia burgdorferi
FTNLEEVRSSIRTKI

SEQ ID NO: 91266 - protein, 15 aa, Borrelia burgdorferi
TNLEEVRSSIRTKIK

SEQ ID NO: 91267 - protein, 15 aa, Borrelia burgdorferi
NLEEVRSSIRTKIKV

SEQ ID NO: 91268 - protein, 15 aa, Borrelia burgdorferi
LEEVRSSIRTKIKVS

SEQ ID NO: 91269 - protein, 15 aa, Borrelia burgdorferi
EEVRSSIRTKIKVSD

SEQ ID NO: 91270 - protein, 15 aa, Borrelia burgdorferi
EVRSSIRTKIKVSDG

SEQ ID NO: 91271 - protein, 15 aa, Borrelia burgdorferi
VRSSIRTKIKVSDGT

SEQ ID NO: 91272 - protein, 15 aa, Borrelia burgdorferi
RSSIRTKIKVSDGTE

SEQ ID NO: 91273 - protein, 15 aa, Borrelia burgdorferi
SSIRTKIKVSDGTEQ

SEQ ID NO: 91274 - protein, 15 aa, Borrelia burgdorferi
SIRTKIKVSDGTEQT

SEQ ID NO: 91275 - protein, 15 aa, Borrelia burgdorferi
IRTKIKVSDGTEQTK

SEQ ID NO: 91276 - protein, 15 aa, Borrelia burgdorferi
RTKIKVSDGTEQTKD

SEQ ID NO: 91277 - protein, 15 aa, Borrelia burgdorferi
TKIKVSDGTEQTKDK

SEQ ID NO: 91278 - protein, 15 aa, Borrelia burgdorferi
KIKVSDGTEQTKDKV

SEQ ID NO: 91279 - protein, 15 aa, Borrelia burgdorferi
IKVSDGTEQTKDKVE

SEQ ID NO: 91280 - protein, 15 aa, Borrelia burgdorferi
KVSDGTEQTKDKVEI

SEQ ID NO: 91281 - protein, 15 aa, Borrelia burgdorferi
VSDGTEQTKDKVEID

SEQ ID NO: 91282 - protein, 15 aa, Borrelia burgdorferi
SDGTEQTKDKVEIDE

SEQ ID NO: 91283 - protein, 15 aa, Borrelia burgdorferi
DGTEQTKDKVEIDEI

SEQ ID NO: 91284 - protein, 15 aa, Borrelia burgdorferi
GTEQTKDKVEIDEII

SEQ ID NO: 91285 - protein, 15 aa, Borrelia burgdorferi
TEQTKDKVEIDEIIE

SEQ ID NO: 91286 - protein, 15 aa, Borrelia burgdorferi
EQTKDKVEIDEIIED

SEQ ID NO: 91287 - protein, 15 aa, Borrelia burgdorferi
QTKDKVEIDEIIEDL

SEQ ID NO: 91288 - protein, 15 aa, Borrelia burgdorferi
TKDKVEIDEIIEDLQ

SEQ ID NO: 91289 - protein, 15 aa, Borrelia burgdorferi
KDKVEIDEIIEDLQK

SEQ ID NO: 91290 - protein, 15 aa, Borrelia burgdorferi
DKVEIDEIIEDLQKL

SEQ ID NO: 91291 - protein, 15 aa, Borrelia burgdorferi
KVEIDEIIEDLQKLK

SEQ ID NO: 91292 - protein, 15 aa, Borrelia burgdorferi
VEIDEIIEDLQKLKE

SEQ ID NO: 91293 - protein, 15 aa, Borrelia burgdorferi
EIDEIIEDLQKLKEF

SEQ ID NO: 91294 - protein, 15 aa, Borrelia burgdorferi
IDEIIEDLQKLKEFL

SEQ ID NO: 91295 - protein, 15 aa, Borrelia burgdorferi
DEIIEDLQKLKEFLE

SEQ ID NO: 91296 - protein, 15 aa, Borrelia burgdorferi
EIIEDLQKLKEFLEK

SEQ ID NO: 91297 - protein, 15 aa, Borrelia burgdorferi
IIEDLQKLKEFLEKL

SEQ ID NO: 91298 - protein, 15 aa, Borrelia burgdorferi
IEDLQKLKEFLEKLK

SEQ ID NO: 91299 - protein, 15 aa, Borrelia burgdorferi
EDLQKLKEFLEKLKK

SEQ ID NO: 91300 - protein, 15 aa, Borrelia burgdorferi
DLQKLKEFLEKLKKY

SEQ ID NO: 91301 - protein, 15 aa, Borrelia burgdorferi
LQKLKEFLEKLKKYL

SEQ ID NO: 91302 - protein, 15 aa, Borrelia burgdorferi
QKLKEFLEKLKKYLK

SEQ ID NO: 91303 - protein, 15 aa, Borrelia burgdorferi
KLKEFLEKLKKYLKD

SEQ ID NO: 91304 - protein, 15 aa, Borrelia burgdorferi
LKEFLEKLKKYLKDT

SEQ ID NO: 91305 - protein, 15 aa, Borrelia burgdorferi
KEFLEKLKKYLKDTN

SEQ ID NO: 91306 - protein, 15 aa, Borrelia burgdorferi
EFLEKLKKYLKDTNN

SEQ ID NO: 91307 - protein, 15 aa, Borrelia burgdorferi
FLEKLKKYLKDTNNL

SEQ ID NO: 91308 - protein, 15 aa, Borrelia burgdorferi
LEKLKKYLKDTNNLS

SEQ ID NO: 91309 - protein, 15 aa, Borrelia burgdorferi
EKLKKYLKDTNNLSA

SEQ ID NO: 91310 - protein, 15 aa, Borrelia burgdorferi
KLKKYLKDTNNLSAI

SEQ ID NO: 91311 - protein, 15 aa, Borrelia burgdorferi
LKKYLKDTNNLSAIE

SEQ ID NO: 91312 - protein, 15 aa, Borrelia burgdorferi
KKYLKDTNNLSAIEE

SEQ ID NO: 91313 - protein, 15 aa, Borrelia burgdorferi
KYLKDTNNLSAIEES

SEQ ID NO: 91314 - protein, 15 aa, Borrelia burgdorferi
YLKDTNNLSAIEESV

SEQ ID NO: 91315 - protein, 15 aa, Borrelia burgdorferi
LKDTNNLSAIEESVK

SEQ ID NO: 91316 - protein, 15 aa, Borrelia burgdorferi
KDTNNLSAIEESVKG

SEQ ID NO: 91317 - protein, 15 aa, Borrelia burgdorferi
DTNNLSAIEESVKGL

SEQ ID NO: 91318 - protein, 15 aa, Borrelia burgdorferi
TNNLSAIEESVKGLS

SEQ ID NO: 91319 - protein, 16 aa, Borrelia burgdorferi
MCAFLLLNLVNCKFDS

SEQ ID NO: 91320 - protein, 16 aa, Borrelia burgdorferi
CAFLLLNLVNCKFDSL

SEQ ID NO: 91321 - protein, 16 aa, Borrelia burgdorferi
AFLLLNLVNCKFDSLN

SEQ ID NO: 91322 - protein, 16 aa, Borrelia burgdorferi
FLLLNLVNCKFDSLNL

SEQ ID NO: 91323 - protein, 16 aa, Borrelia burgdorferi
LLLNLVNCKFDSLNLS

SEQ ID NO: 91324 - protein, 16 aa, Borrelia burgdorferi
LLNLVNCKFDSLNLST

SEQ ID NO: 91325 - protein, 16 aa, Borrelia burgdorferi
LNLVNCKFDSLNLSTK

SEQ ID NO: 91326 - protein, 16 aa, Borrelia burgdorferi
NLVNCKFDSLNLSTKS

SEQ ID NO: 91327 - protein, 16 aa, Borrelia burgdorferi
LVNCKFDSLNLSTKSV

SEQ ID NO: 91328 - protein, 16 aa, Borrelia burgdorferi
VNCKFDSLNLSTKSVD

SEQ ID NO: 91329 - protein, 16 aa, Borrelia burgdorferi
NCKFDSLNLSTKSVDD

SEQ ID NO: 91330 - protein, 16 aa, Borrelia burgdorferi
CKFDSLNLSTKSVDDK

SEQ ID NO: 91331 - protein, 16 aa, Borrelia burgdorferi
KFDSLNLSTKSVDDKN

SEQ ID NO: 91332 - protein, 16 aa, Borrelia burgdorferi
FDSLNLSTKSVDDKNN

SEQ ID NO: 91333 - protein, 16 aa, Borrelia burgdorferi
DSLNLSTKSVDDKNNS

SEQ ID NO: 91334 - protein, 16 aa, Borrelia burgdorferi
SLNLSTKSVDDKNNSI

SEQ ID NO: 91335 - protein, 16 aa, Borrelia burgdorferi
LNLSTKSVDDKNNSIA

SEQ ID NO: 91336 - protein, 16 aa, Borrelia burgdorferi
NLSTKSVDDKNNSIAK

SEQ ID NO: 91337 - protein, 16 aa, Borrelia burgdorferi
LSTKSVDDKNNSIAKL

SEQ ID NO: 91338 - protein, 16 aa, Borrelia burgdorferi
STKSVDDKNNSIAKLL

SEQ ID NO: 91339 - protein, 16 aa, Borrelia burgdorferi
TKSVDDKNNSIAKLLQ

SEQ ID NO: 91340 - protein, 16 aa, Borrelia burgdorferi
KSVDDKNNSIAKLLQH

SEQ ID NO: 91341 - protein, 16 aa, Borrelia burgdorferi
SVDDKNNSIAKLLQHL

SEQ ID NO: 91342 - protein, 16 aa, Borrelia burgdorferi
VDDKNNSIAKLLQHLS

SEQ ID NO: 91343 - protein, 16 aa, Borrelia burgdorferi
DDKNNSIAKLLQHLSK

SEQ ID NO: 91344 - protein, 16 aa, Borrelia burgdorferi
DKNNSIAKLLQHLSKS

SEQ ID NO: 91345 - protein, 16 aa, Borrelia burgdorferi
KNNSIAKLLQHLSKSE

SEQ ID NO: 91346 - protein, 16 aa, Borrelia burgdorferi
NNSIAKLLQHLSKSED

SEQ ID NO: 91347 - protein, 16 aa, Borrelia burgdorferi
NSIAKLLQHLSKSEDQ

SEQ ID NO: 91348 - protein, 16 aa, Borrelia burgdorferi
SIAKLLQHLSKSEDQA

SEQ ID NO: 91349 - protein, 16 aa, Borrelia burgdorferi
IAKLLQHLSKSEDQAN

SEQ ID NO: 91350 - protein, 16 aa, Borrelia burgdorferi
AKLLQHLSKSEDQANK

SEQ ID NO: 91351 - protein, 16 aa, Borrelia burgdorferi
KLLQHLSKSEDQANKT

SEQ ID NO: 91352 - protein, 16 aa, Borrelia burgdorferi
LLQHLSKSEDQANKTS

SEQ ID NO: 91353 - protein, 16 aa, Borrelia burgdorferi
LQHLSKSEDQANKTST

SEQ ID NO: 91354 - protein, 16 aa, Borrelia burgdorferi
QHLSKSEDQANKTSTS

SEQ ID NO: 91355 - protein, 16 aa, Borrelia burgdorferi
HLSKSEDQANKTSTSE

SEQ ID NO: 91356 - protein, 16 aa, Borrelia burgdorferi
LSKSEDQANKTSTSED

SEQ ID NO: 91357 - protein, 16 aa, Borrelia burgdorferi
SKSEDQANKTSTSEDQ

SEQ ID NO: 91358 - protein, 16 aa, Borrelia burgdorferi
KSEDQANKTSTSEDQK

SEQ ID NO: 91359 - protein, 16 aa, Borrelia burgdorferi
SEDQANKTSTSEDQKE

SEQ ID NO: 91360 - protein, 16 aa, Borrelia burgdorferi
EDQANKTSTSEDQKEL

SEQ ID NO: 91361 - protein, 16 aa, Borrelia burgdorferi
DQANKTSTSEDQKELE

SEQ ID NO: 91362 - protein, 16 aa, Borrelia burgdorferi
QANKTSTSEDQKELEI

SEQ ID NO: 91363 - protein, 16 aa, Borrelia burgdorferi
ANKTSTSEDQKELEIT

SEQ ID NO: 91364 - protein, 16 aa, Borrelia burgdorferi
NKTSTSEDQKELEITE

SEQ ID NO: 91365 - protein, 16 aa, Borrelia burgdorferi
KTSTSEDQKELEITEN

SEQ ID NO: 91366 - protein, 16 aa, Borrelia burgdorferi
TSTSEDQKELEITENK

SEQ ID NO: 91367 - protein, 16 aa, Borrelia burgdorferi
STSEDQKELEITENKE

SEQ ID NO: 91368 - protein, 16 aa, Borrelia burgdorferi
TSEDQKELEITENKEQ

SEQ ID NO: 91369 - protein, 16 aa, Borrelia burgdorferi
SEDQKELEITENKEQE

SEQ ID NO: 91370 - protein, 16 aa, Borrelia burgdorferi
EDQKELEITENKEQEH

SEQ ID NO: 91371 - protein, 16 aa, Borrelia burgdorferi
DQKELEITENKEQEHE

SEQ ID NO: 91372 - protein, 16 aa, Borrelia burgdorferi
QKELEITENKEQEHEK

SEQ ID NO: 91373 - protein, 16 aa, Borrelia burgdorferi
KELEITENKEQEHEKL

SEQ ID NO: 91374 - protein, 16 aa, Borrelia burgdorferi
ELEITENKEQEHEKLS

SEQ ID NO: 91375 - protein, 16 aa, Borrelia burgdorferi
LEITENKEQEHEKLSQ

SEQ ID NO: 91376 - protein, 16 aa, Borrelia burgdorferi
EITENKEQEHEKLSQV

SEQ ID NO: 91377 - protein, 16 aa, Borrelia burgdorferi
ITENKEQEHEKLSQVA

SEQ ID NO: 91378 - protein, 16 aa, Borrelia burgdorferi
TENKEQEHEKLSQVAQ

SEQ ID NO: 91379 - protein, 16 aa, Borrelia burgdorferi
ENKEQEHEKLSQVAQH

SEQ ID NO: 91380 - protein, 16 aa, Borrelia burgdorferi
NKEQEHEKLSQVAQHA

SEQ ID NO: 91381 - protein, 16 aa, Borrelia burgdorferi
KEQEHEKLSQVAQHAP

SEQ ID NO: 91382 - protein, 16 aa, Borrelia burgdorferi
EQEHEKLSQVAQHAPN

SEQ ID NO: 91383 - protein, 16 aa, Borrelia burgdorferi
QEHEKLSQVAQHAPNS

SEQ ID NO: 91384 - protein, 16 aa, Borrelia burgdorferi
EHEKLSQVAQHAPNSK

SEQ ID NO: 91385 - protein, 16 aa, Borrelia burgdorferi
HEKLSQVAQHAPNSKI

SEQ ID NO: 91386 - protein, 16 aa, Borrelia burgdorferi
EKLSQVAQHAPNSKIE

SEQ ID NO: 91387 - protein, 16 aa, Borrelia burgdorferi
KLSQVAQHAPNSKIEK

SEQ ID NO: 91388 - protein, 16 aa, Borrelia burgdorferi
LSQVAQHAPNSKIEKV

SEQ ID NO: 91389 - protein, 16 aa, Borrelia burgdorferi
SQVAQHAPNSKIEKVK

SEQ ID NO: 91390 - protein, 16 aa, Borrelia burgdorferi
QVAQHAPNSKIEKVKS

SEQ ID NO: 91391 - protein, 16 aa, Borrelia burgdorferi
VAQHAPNSKIEKVKSD

SEQ ID NO: 91392 - protein, 16 aa, Borrelia burgdorferi
AQHAPNSKIEKVKSDG

SEQ ID NO: 91393 - protein, 16 aa, Borrelia burgdorferi
QHAPNSKIEKVKSDGK

SEQ ID NO: 91394 - protein, 16 aa, Borrelia burgdorferi
HAPNSKIEKVKSDGKP

SEQ ID NO: 91395 - protein, 16 aa, Borrelia burgdorferi
APNSKIEKVKSDGKPV

SEQ ID NO: 91396 - protein, 16 aa, Borrelia burgdorferi
PNSKIEKVKSDGKPVP

SEQ ID NO: 91397 - protein, 16 aa, Borrelia burgdorferi
NSKIEKVKSDGKPVPG

SEQ ID NO: 91398 - protein, 16 aa, Borrelia burgdorferi
SKIEKVKSDGKPVPGD

SEQ ID NO: 91399 - protein, 16 aa, Borrelia burgdorferi
KIEKVKSDGKPVPGDK

SEQ ID NO: 91400 - protein, 16 aa, Borrelia burgdorferi
IEKVKSDGKPVPGDKI

SEQ ID NO: 91401 - protein, 16 aa, Borrelia burgdorferi
EKVKSDGKPVPGDKIL

SEQ ID NO: 91402 - protein, 16 aa, Borrelia burgdorferi
KVKSDGKPVPGDKILS

SEQ ID NO: 91403 - protein, 16 aa, Borrelia burgdorferi
VKSDGKPVPGDKILSS

SEQ ID NO: 91404 - protein, 16 aa, Borrelia burgdorferi
KSDGKPVPGDKILSSN

SEQ ID NO: 91405 - protein, 16 aa, Borrelia burgdorferi
SDGKPVPGDKILSSNK

SEQ ID NO: 91406 - protein, 16 aa, Borrelia burgdorferi
DGKPVPGDKILSSNKD

SEQ ID NO: 91407 - protein, 16 aa, Borrelia burgdorferi
GKPVPGDKILSSNKDI

SEQ ID NO: 91408 - protein, 16 aa, Borrelia burgdorferi
KPVPGDKILSSNKDIY

SEQ ID NO: 91409 - protein, 16 aa, Borrelia burgdorferi
PVPGDKILSSNKDIYN

SEQ ID NO: 91410 - protein, 16 aa, Borrelia burgdorferi
VPGDKILSSNKDIYNS

SEQ ID NO: 91411 - protein, 16 aa, Borrelia burgdorferi
PGDKILSSNKDIYNSY

SEQ ID NO: 91412 - protein, 16 aa, Borrelia burgdorferi
GDKILSSNKDIYNSYI

SEQ ID NO: 91413 - protein, 16 aa, Borrelia burgdorferi
DKILSSNKDIYNSYIP

SEQ ID NO: 91414 - protein, 16 aa, Borrelia burgdorferi
KILSSNKDIYNSYIPE

SEQ ID NO: 91415 - protein, 16 aa, Borrelia burgdorferi
ILSSNKDIYNSYIPEV

SEQ ID NO: 91416 - protein, 16 aa, Borrelia burgdorferi
LSSNKDIYNSYIPEVK

SEQ ID NO: 91417 - protein, 16 aa, Borrelia burgdorferi
SSNKDIYNSYIPEVKE

SEQ ID NO: 91418 - protein, 16 aa, Borrelia burgdorferi
SNKDIYNSYIPEVKEE

SEQ ID NO: 91419 - protein, 16 aa, Borrelia burgdorferi
NKDIYNSYIPEVKEEI

SEQ ID NO: 91420 - protein, 16 aa, Borrelia burgdorferi
KDIYNSYIPEVKEEIV

SEQ ID NO: 91421 - protein, 16 aa, Borrelia burgdorferi
DIYNSYIPEVKEEIVY

SEQ ID NO: 91422 - protein, 16 aa, Borrelia burgdorferi
IYNSYIPEVKEEIVYE

SEQ ID NO: 91423 - protein, 16 aa, Borrelia burgdorferi
YNSYIPEVKEEIVYEI

SEQ ID NO: 91424 - protein, 16 aa, Borrelia burgdorferi
NSYIPEVKEEIVYEIL

SEQ ID NO: 91425 - protein, 16 aa, Borrelia burgdorferi
SYIPEVKEEIVYEILE

SEQ ID NO: 91426 - protein, 16 aa, Borrelia burgdorferi
YIPEVKEEIVYEILEE

SEQ ID NO: 91427 - protein, 16 aa, Borrelia burgdorferi
IPEVKEEIVYEILEEV

SEQ ID NO: 91428 - protein, 16 aa, Borrelia burgdorferi
PEVKEEIVYEILEEVI

SEQ ID NO: 91429 - protein, 16 aa, Borrelia burgdorferi
EVKEEIVYEILEEVII

SEQ ID NO: 91430 - protein, 16 aa, Borrelia burgdorferi
VKEEIVYEILEEVIIP

SEQ ID NO: 91431 - protein, 16 aa, Borrelia burgdorferi
KEEIVYEILEEVIIPE

SEQ ID NO: 91432 - protein, 16 aa, Borrelia burgdorferi
EEIVYEILEEVIIPET

SEQ ID NO: 91433 - protein, 16 aa, Borrelia burgdorferi
EIVYEILEEVIIPETK

SEQ ID NO: 91434 - protein, 16 aa, Borrelia burgdorferi
IVYEILEEVIIPETKI

SEQ ID NO: 91435 - protein, 16 aa, Borrelia burgdorferi
VYEILEEVIIPETKIP

SEQ ID NO: 91436 - protein, 16 aa, Borrelia burgdorferi
YEILEEVIIPETKIPE

SEQ ID NO: 91437 - protein, 16 aa, Borrelia burgdorferi
EILEEVIIPETKIPEI

SEQ ID NO: 91438 - protein, 16 aa, Borrelia burgdorferi
ILEEVIIPETKIPEIT

SEQ ID NO: 91439 - protein, 16 aa, Borrelia burgdorferi
LEEVIIPETKIPEITE

SEQ ID NO: 91440 - protein, 16 aa, Borrelia burgdorferi
EEVIIPETKIPEITEE

SEQ ID NO: 91441 - protein, 16 aa, Borrelia burgdorferi
EVIIPETKIPEITEEV

SEQ ID NO: 91442 - protein, 16 aa, Borrelia burgdorferi
VIIPETKIPEITEEVI

SEQ ID NO: 91443 - protein, 16 aa, Borrelia burgdorferi
IIPETKIPEITEEVIM

SEQ ID NO: 91444 - protein, 16 aa, Borrelia burgdorferi
IPETKIPEITEEVIMP

SEQ ID NO: 91445 - protein, 16 aa, Borrelia burgdorferi
PETKIPEITEEVIMPI

SEQ ID NO: 91446 - protein, 16 aa, Borrelia burgdorferi
ETKIPEITEEVIMPIP

SEQ ID NO: 91447 - protein, 16 aa, Borrelia burgdorferi
TKIPEITEEVIMPIPQ

SEQ ID NO: 91448 - protein, 16 aa, Borrelia burgdorferi
KIPEITEEVIMPIPQT

SEQ ID NO: 91449 - protein, 16 aa, Borrelia burgdorferi
IPEITEEVIMPIPQTI

SEQ ID NO: 91450 - protein, 16 aa, Borrelia burgdorferi
PEITEEVIMPIPQTID

SEQ ID NO: 91451 - protein, 16 aa, Borrelia burgdorferi
EITEEVIMPIPQTIDF

SEQ ID NO: 91452 - protein, 16 aa, Borrelia burgdorferi
ITEEVIMPIPQTIDFY

SEQ ID NO: 91453 - protein, 16 aa, Borrelia burgdorferi
TEEVIMPIPQTIDFYI

SEQ ID NO: 91454 - protein, 16 aa, Borrelia burgdorferi
EEVIMPIPQTIDFYIE

SEQ ID NO: 91455 - protein, 16 aa, Borrelia burgdorferi
EVIMPIPQTIDFYIEP

SEQ ID NO: 91456 - protein, 16 aa, Borrelia burgdorferi
VIMPIPQTIDFYIEPR

SEQ ID NO: 91457 - protein, 16 aa, Borrelia burgdorferi
IMPIPQTIDFYIEPRP

SEQ ID NO: 91458 - protein, 16 aa, Borrelia burgdorferi
MPIPQTIDFYIEPRPI

SEQ ID NO: 91459 - protein, 16 aa, Borrelia burgdorferi
PIPQTIDFYIEPRPIS

SEQ ID NO: 91460 - protein, 16 aa, Borrelia burgdorferi
IPQTIDFYIEPRPISS

SEQ ID NO: 91461 - protein, 16 aa, Borrelia burgdorferi
PQTIDFYIEPRPISSF

SEQ ID NO: 91462 - protein, 16 aa, Borrelia burgdorferi
QTIDFYIEPRPISSFL

SEQ ID NO: 91463 - protein, 16 aa, Borrelia burgdorferi
TIDFYIEPRPISSFLT

SEQ ID NO: 91464 - protein, 16 aa, Borrelia burgdorferi
IDFYIEPRPISSFLTQ

SEQ ID NO: 91465 - protein, 16 aa, Borrelia burgdorferi
DFYIEPRPISSFLTQG

SEQ ID NO: 91466 - protein, 16 aa, Borrelia burgdorferi
FYIEPRPISSFLTQGT

SEQ ID NO: 91467 - protein, 16 aa, Borrelia burgdorferi
YIEPRPISSFLTQGTS

SEQ ID NO: 91468 - protein, 16 aa, Borrelia burgdorferi
IEPRPISSFLTQGTSP

SEQ ID NO: 91469 - protein, 16 aa, Borrelia burgdorferi
EPRPISSFLTQGTSPS

SEQ ID NO: 91470 - protein, 16 aa, Borrelia burgdorferi
PRPISSFLTQGTSPSI

SEQ ID NO: 91471 - protein, 16 aa, Borrelia burgdorferi
RPISSFLTQGTSPSIT

SEQ ID NO: 91472 - protein, 16 aa, Borrelia burgdorferi
PISSFLTQGTSPSITS

SEQ ID NO: 91473 - protein, 16 aa, Borrelia burgdorferi
ISSFLTQGTSPSITST

SEQ ID NO: 91474 - protein, 16 aa, Borrelia burgdorferi
SSFLTQGTSPSITSTI

SEQ ID NO: 91475 - protein, 16 aa, Borrelia burgdorferi
SFLTQGTSPSITSTIK

SEQ ID NO: 91476 - protein, 16 aa, Borrelia burgdorferi
FLTQGTSPSITSTIKS

SEQ ID NO: 91477 - protein, 16 aa, Borrelia burgdorferi
LTQGTSPSITSTIKSY

SEQ ID NO: 91478 - protein, 16 aa, Borrelia burgdorferi
TQGTSPSITSTIKSYK

SEQ ID NO: 91479 - protein, 16 aa, Borrelia burgdorferi
QGTSPSITSTIKSYKE

SEQ ID NO: 91480 - protein, 16 aa, Borrelia burgdorferi
GTSPSITSTIKSYKEL

SEQ ID NO: 91481 - protein, 16 aa, Borrelia burgdorferi
TSPSITSTIKSYKELA

SEQ ID NO: 91482 - protein, 16 aa, Borrelia burgdorferi
SPSITSTIKSYKELAK

SEQ ID NO: 91483 - protein, 16 aa, Borrelia burgdorferi
PSITSTIKSYKELAKE

SEQ ID NO: 91484 - protein, 16 aa, Borrelia burgdorferi
SITSTIKSYKELAKEK

SEQ ID NO: 91485 - protein, 16 aa, Borrelia burgdorferi
ITSTIKSYKELAKEKI

SEQ ID NO: 91486 - protein, 16 aa, Borrelia burgdorferi
TSTIKSYKELAKEKIN

SEQ ID NO: 91487 - protein, 16 aa, Borrelia burgdorferi
STIKSYKELAKEKINN

SEQ ID NO: 91488 - protein, 16 aa, Borrelia burgdorferi
TIKSYKELAKEKINNG

SEQ ID NO: 91489 - protein, 16 aa, Borrelia burgdorferi
IKSYKELAKEKINNGL

SEQ ID NO: 91490 - protein, 16 aa, Borrelia burgdorferi
KSYKELAKEKINNGLN

SEQ ID NO: 91491 - protein, 16 aa, Borrelia burgdorferi
SYKELAKEKINNGLNI

SEQ ID NO: 91492 - protein, 16 aa, Borrelia burgdorferi
YKELAKEKINNGLNIV

SEQ ID NO: 91493 - protein, 16 aa, Borrelia burgdorferi
KELAKEKINNGLNIVQ

SEQ ID NO: 91494 - protein, 16 aa, Borrelia burgdorferi
ELAKEKINNGLNIVQK

SEQ ID NO: 91495 - protein, 16 aa, Borrelia burgdorferi
LAKEKINNGLNIVQKI

SEQ ID NO: 91496 - protein, 16 aa, Borrelia burgdorferi
AKEKINNGLNIVQKIT

SEQ ID NO: 91497 - protein, 16 aa, Borrelia burgdorferi
KEKINNGLNIVQKITQ

SEQ ID NO: 91498 - protein, 16 aa, Borrelia burgdorferi
EKINNGLNIVQKITQN

SEQ ID NO: 91499 - protein, 16 aa, Borrelia burgdorferi
KINNGLNIVQKITQNI

SEQ ID NO: 91500 - protein, 16 aa, Borrelia burgdorferi
INNGLNIVQKITQNID

SEQ ID NO: 91501 - protein, 16 aa, Borrelia burgdorferi
NNGLNIVQKITQNIDN

SEQ ID NO: 91502 - protein, 16 aa, Borrelia burgdorferi
NGLNIVQKITQNIDNI

SEQ ID NO: 91503 - protein, 16 aa, Borrelia burgdorferi
GLNIVQKITQNIDNIT

SEQ ID NO: 91504 - protein, 16 aa, Borrelia burgdorferi
LNIVQKITQNIDNITE

SEQ ID NO: 91505 - protein, 16 aa, Borrelia burgdorferi
NIVQKITQNIDNITEN

SEQ ID NO: 91506 - protein, 16 aa, Borrelia burgdorferi
IVQKITQNIDNITENL

SEQ ID NO: 91507 - protein, 16 aa, Borrelia burgdorferi
VQKITQNIDNITENLN

SEQ ID NO: 91508 - protein, 16 aa, Borrelia burgdorferi
QKITQNIDNITENLNS

SEQ ID NO: 91509 - protein, 16 aa, Borrelia burgdorferi
KITQNIDNITENLNSK

SEQ ID NO: 91510 - protein, 16 aa, Borrelia burgdorferi
ITQNIDNITENLNSKE

SEQ ID NO: 91511 - protein, 16 aa, Borrelia burgdorferi
TQNIDNITENLNSKET

SEQ ID NO: 91512 - protein, 16 aa, Borrelia burgdorferi
QNIDNITENLNSKETP

SEQ ID NO: 91513 - protein, 16 aa, Borrelia burgdorferi
NIDNITENLNSKETPK

SEQ ID NO: 91514 - protein, 16 aa, Borrelia burgdorferi
IDNITENLNSKETPKE

SEQ ID NO: 91515 - protein, 16 aa, Borrelia burgdorferi
DNITENLNSKETPKEI

SEQ ID NO: 91516 - protein, 16 aa, Borrelia burgdorferi
NITENLNSKETPKEIS

SEQ ID NO: 91517 - protein, 16 aa, Borrelia burgdorferi
ITENLNSKETPKEISG

SEQ ID NO: 91518 - protein, 16 aa, Borrelia burgdorferi
TENLNSKETPKEISGK

SEQ ID NO: 91519 - protein, 16 aa, Borrelia burgdorferi
ENLNSKETPKEISGKE

SEQ ID NO: 91520 - protein, 16 aa, Borrelia burgdorferi
NLNSKETPKEISGKEV

SEQ ID NO: 91521 - protein, 16 aa, Borrelia burgdorferi
LNSKETPKEISGKEVE

SEQ ID NO: 91522 - protein, 16 aa, Borrelia burgdorferi
NSKETPKEISGKEVEE

SEQ ID NO: 91523 - protein, 16 aa, Borrelia burgdorferi
SKETPKEISGKEVEEK

SEQ ID NO: 91524 - protein, 16 aa, Borrelia burgdorferi
KETPKEISGKEVEEKI

SEQ ID NO: 91525 - protein, 16 aa, Borrelia burgdorferi
ETPKEISGKEVEEKIT

SEQ ID NO: 91526 - protein, 16 aa, Borrelia burgdorferi
TPKEISGKEVEEKITH

SEQ ID NO: 91527 - protein, 16 aa, Borrelia burgdorferi
PKEISGKEVEEKITHP

SEQ ID NO: 91528 - protein, 16 aa, Borrelia burgdorferi
KEISGKEVEEKITHPI

SEQ ID NO: 91529 - protein, 16 aa, Borrelia burgdorferi
EISGKEVEEKITHPIF

SEQ ID NO: 91530 - protein, 16 aa, Borrelia burgdorferi
ISGKEVEEKITHPIFD

SEQ ID NO: 91531 - protein, 16 aa, Borrelia burgdorferi
SGKEVEEKITHPIFDH

SEQ ID NO: 91532 - protein, 16 aa, Borrelia burgdorferi
GKEVEEKITHPIFDHI

SEQ ID NO: 91533 - protein, 16 aa, Borrelia burgdorferi
KEVEEKITHPIFDHIT

SEQ ID NO: 91534 - protein, 16 aa, Borrelia burgdorferi
EVEEKITHPIFDHITG

SEQ ID NO: 91535 - protein, 16 aa, Borrelia burgdorferi
VEEKITHPIFDHITGS

SEQ ID NO: 91536 - protein, 16 aa, Borrelia burgdorferi
EEKITHPIFDHITGSG

SEQ ID NO: 91537 - protein, 16 aa, Borrelia burgdorferi
EKITHPIFDHITGSGN

SEQ ID NO: 91538 - protein, 16 aa, Borrelia burgdorferi
KITHPIFDHITGSGNN

SEQ ID NO: 91539 - protein, 16 aa, Borrelia burgdorferi
ITHPIFDHITGSGNNP

SEQ ID NO: 91540 - protein, 16 aa, Borrelia burgdorferi
THPIFDHITGSGNNPG

SEQ ID NO: 91541 - protein, 16 aa, Borrelia burgdorferi
HPIFDHITGSGNNPGQ

SEQ ID NO: 91542 - protein, 16 aa, Borrelia burgdorferi
PIFDHITGSGNNPGQD

SEQ ID NO: 91543 - protein, 16 aa, Borrelia burgdorferi
IFDHITGSGNNPGQDS

SEQ ID NO: 91544 - protein, 16 aa, Borrelia burgdorferi
FDHITGSGNNPGQDSI

SEQ ID NO: 91545 - protein, 16 aa, Borrelia burgdorferi
DHITGSGNNPGQDSIS

SEQ ID NO: 91546 - protein, 16 aa, Borrelia burgdorferi
HITGSGNNPGQDSISN

SEQ ID NO: 91547 - protein, 16 aa, Borrelia burgdorferi
ITGSGNNPGQDSISNT

SEQ ID NO: 91548 - protein, 16 aa, Borrelia burgdorferi
TGSGNNPGQDSISNTW

SEQ ID NO: 91549 - protein, 16 aa, Borrelia burgdorferi
GSGNNPGQDSISNTWG

SEQ ID NO: 91550 - protein, 16 aa, Borrelia burgdorferi
SGNNPGQDSISNTWGE

SEQ ID NO: 91551 - protein, 16 aa, Borrelia burgdorferi
GNNPGQDSISNTWGEG

SEQ ID NO: 91552 - protein, 16 aa, Borrelia burgdorferi
NNPGQDSISNTWGEGL

SEQ ID NO: 91553 - protein, 16 aa, Borrelia burgdorferi
NPGQDSISNTWGEGLE

SEQ ID NO: 91554 - protein, 16 aa, Borrelia burgdorferi
PGQDSISNTWGEGLEI

SEQ ID NO: 91555 - protein, 16 aa, Borrelia burgdorferi
GQDSISNTWGEGLEIG

SEQ ID NO: 91556 - protein, 16 aa, Borrelia burgdorferi
QDSISNTWGEGLEIGG

SEQ ID NO: 91557 - protein, 16 aa, Borrelia burgdorferi
DSISNTWGEGLEIGGD

SEQ ID NO: 91558 - protein, 16 aa, Borrelia burgdorferi
SISNTWGEGLEIGGDS

SEQ ID NO: 91559 - protein, 16 aa, Borrelia burgdorferi
ISNTWGEGLEIGGDSN

SEQ ID NO: 91560 - protein, 16 aa, Borrelia burgdorferi
SNTWGEGLEIGGDSNF

SEQ ID NO: 91561 - protein, 16 aa, Borrelia burgdorferi
NTWGEGLEIGGDSNFF

SEQ ID NO: 91562 - protein, 16 aa, Borrelia burgdorferi
TWGEGLEIGGDSNFFT

SEQ ID NO: 91563 - protein, 16 aa, Borrelia burgdorferi
WGEGLEIGGDSNFFTN

SEQ ID NO: 91564 - protein, 16 aa, Borrelia burgdorferi
GEGLEIGGDSNFFTNL

SEQ ID NO: 91565 - protein, 16 aa, Borrelia burgdorferi
EGLEIGGDSNFFTNLE

SEQ ID NO: 91566 - protein, 16 aa, Borrelia burgdorferi
GLEIGGDSNFFTNLEE

SEQ ID NO: 91567 - protein, 16 aa, Borrelia burgdorferi
LEIGGDSNFFTNLEEV

SEQ ID NO: 91568 - protein, 16 aa, Borrelia burgdorferi
EIGGDSNFFTNLEEVR

SEQ ID NO: 91569 - protein, 16 aa, Borrelia burgdorferi
IGGDSNFFTNLEEVRS

SEQ ID NO: 91570 - protein, 16 aa, Borrelia burgdorferi
GGDSNFFTNLEEVRSS

SEQ ID NO: 91571 - protein, 16 aa, Borrelia burgdorferi
GDSNFFTNLEEVRSSI

SEQ ID NO: 91572 - protein, 16 aa, Borrelia burgdorferi
DSNFFTNLEEVRSSIR

SEQ ID NO: 91573 - protein, 16 aa, Borrelia burgdorferi
SNFFTNLEEVRSSIRT

SEQ ID NO: 91574 - protein, 16 aa, Borrelia burgdorferi
NFFTNLEEVRSSIRTK

SEQ ID NO: 91575 - protein, 16 aa, Borrelia burgdorferi
FFTNLEEVRSSIRTKI

SEQ ID NO: 91576 - protein, 16 aa, Borrelia burgdorferi
FTNLEEVRSSIRTKIK

SEQ ID NO: 91577 - protein, 16 aa, Borrelia burgdorferi
TNLEEVRSSIRTKIKV

SEQ ID NO: 91578 - protein, 16 aa, Borrelia burgdorferi
NLEEVRSSIRTKIKVS

SEQ ID NO: 91579 - protein, 16 aa, Borrelia burgdorferi
LEEVRSSIRTKIKVSD

SEQ ID NO: 91580 - protein, 16 aa, Borrelia burgdorferi
EEVRSSIRTKIKVSDG

SEQ ID NO: 91581 - protein, 16 aa, Borrelia burgdorferi
EVRSSIRTKIKVSDGT

SEQ ID NO: 91582 - protein, 16 aa, Borrelia burgdorferi
VRSSIRTKIKVSDGTE

SEQ ID NO: 91583 - protein, 16 aa, Borrelia burgdorferi
RSSIRTKIKVSDGTEQ

SEQ ID NO: 91584 - protein, 16 aa, Borrelia burgdorferi
SSIRTKIKVSDGTEQT

SEQ ID NO: 91585 - protein, 16 aa, Borrelia burgdorferi
SIRTKIKVSDGTEQTK

SEQ ID NO: 91586 - protein, 16 aa, Borrelia burgdorferi
IRTKIKVSDGTEQTKD

SEQ ID NO: 91587 - protein, 16 aa, Borrelia burgdorferi
RTKIKVSDGTEQTKDK

SEQ ID NO: 91588 - protein, 16 aa, Borrelia burgdorferi
TKIKVSDGTEQTKDKV

SEQ ID NO: 91589 - protein, 16 aa, Borrelia burgdorferi
KIKVSDGTEQTKDKVE

SEQ ID NO: 91590 - protein, 16 aa, Borrelia burgdorferi
IKVSDGTEQTKDKVEI

SEQ ID NO: 91591 - protein, 16 aa, Borrelia burgdorferi
KVSDGTEQTKDKVEID

SEQ ID NO: 91592 - protein, 16 aa, Borrelia burgdorferi
VSDGTEQTKDKVEIDE

SEQ ID NO: 91593 - protein, 16 aa, Borrelia burgdorferi
SDGTEQTKDKVEIDEI

SEQ ID NO: 91594 - protein, 16 aa, Borrelia burgdorferi
DGTEQTKDKVEIDEII

SEQ ID NO: 91595 - protein, 16 aa, Borrelia burgdorferi
GTEQTKDKVEIDEIIE

SEQ ID NO: 91596 - protein, 16 aa, Borrelia burgdorferi
TEQTKDKVEIDEIIED

SEQ ID NO: 91597 - protein, 16 aa, Borrelia burgdorferi
EQTKDKVEIDEIIEDL

SEQ ID NO: 91598 - protein, 16 aa, Borrelia burgdorferi
QTKDKVEIDEIIEDLQ

SEQ ID NO: 91599 - protein, 16 aa, Borrelia burgdorferi
TKDKVEIDEIIEDLQK

SEQ ID NO: 91600 - protein, 16 aa, Borrelia burgdorferi
KDKVEIDEIIEDLQKL

SEQ ID NO: 91601 - protein, 16 aa, Borrelia burgdorferi
DKVEIDEIIEDLQKLK

SEQ ID NO: 91602 - protein, 16 aa, Borrelia burgdorferi
KVEIDEIIEDLQKLKE

SEQ ID NO: 91603 - protein, 16 aa, Borrelia burgdorferi
VEIDEIIEDLQKLKEF

SEQ ID NO: 91604 - protein, 16 aa, Borrelia burgdorferi
EIDEIIEDLQKLKEFL

SEQ ID NO: 91605 - protein, 16 aa, Borrelia burgdorferi
IDEIIEDLQKLKEFLE

SEQ ID NO: 91606 - protein, 16 aa, Borrelia burgdorferi
DEIIEDLQKLKEFLEK

SEQ ID NO: 91607 - protein, 16 aa, Borrelia burgdorferi
EIIEDLQKLKEFLEKL

SEQ ID NO: 91608 - protein, 16 aa, Borrelia burgdorferi
IIEDLQKLKEFLEKLK

SEQ ID NO: 91609 - protein, 16 aa, Borrelia burgdorferi
IEDLQKLKEFLEKLKK

SEQ ID NO: 91610 - protein, 16 aa, Borrelia burgdorferi
EDLQKLKEFLEKLKKY

SEQ ID NO: 91611 - protein, 16 aa, Borrelia burgdorferi
DLQKLKEFLEKLKKYL

SEQ ID NO: 91612 - protein, 16 aa, Borrelia burgdorferi
LQKLKEFLEKLKKYLK

SEQ ID NO: 91613 - protein, 16 aa, Borrelia burgdorferi
QKLKEFLEKLKKYLKD

SEQ ID NO: 91614 - protein, 16 aa, Borrelia burgdorferi
KLKEFLEKLKKYLKDT

SEQ ID NO: 91615 - protein, 16 aa, Borrelia burgdorferi
LKEFLEKLKKYLKDTN

SEQ ID NO: 91616 - protein, 16 aa, Borrelia burgdorferi
KEFLEKLKKYLKDTNN

SEQ ID NO: 91617 - protein, 16 aa, Borrelia burgdorferi
EFLEKLKKYLKDTNNL

SEQ ID NO: 91618 - protein, 16 aa, Borrelia burgdorferi
FLEKLKKYLKDTNNLS

SEQ ID NO: 91619 - protein, 16 aa, Borrelia burgdorferi
LEKLKKYLKDTNNLSA

SEQ ID NO: 91620 - protein, 16 aa, Borrelia burgdorferi
EKLKKYLKDTNNLSAI

SEQ ID NO: 91621 - protein, 16 aa, Borrelia burgdorferi
KLKKYLKDTNNLSAIE

SEQ ID NO: 91622 - protein, 16 aa, Borrelia burgdorferi
LKKYLKDTNNLSAIEE

SEQ ID NO: 91623 - protein, 16 aa, Borrelia burgdorferi
KKYLKDTNNLSAIEES

SEQ ID NO: 91624 - protein, 16 aa, Borrelia burgdorferi
KYLKDTNNLSAIEESV

SEQ ID NO: 91625 - protein, 16 aa, Borrelia burgdorferi
YLKDTNNLSAIEESVK

SEQ ID NO: 91626 - protein, 16 aa, Borrelia burgdorferi
LKDTNNLSAIEESVKG

SEQ ID NO: 91627 - protein, 16 aa, Borrelia burgdorferi
KDTNNLSAIEESVKGL

SEQ ID NO: 91628 - protein, 16 aa, Borrelia burgdorferi
DTNNLSAIEESVKGLS

SEQ ID NO: 91629 - protein, 13 aa, Borrelia burgdorferi B31
MIKMSLNYTEINT

SEQ ID NO: 91630 - protein, 13 aa, Borrelia burgdorferi B31
IKMSLNYTEINTL

SEQ ID NO: 91631 - protein, 13 aa, Borrelia burgdorferi B31
KMSLNYTEINTLI

SEQ ID NO: 91632 - protein, 13 aa, Borrelia burgdorferi B31
MSLNYTEINTLIK

SEQ ID NO: 91633 - protein, 13 aa, Borrelia burgdorferi B31
SLNYTEINTLIKE

SEQ ID NO: 91634 - protein, 13 aa, Borrelia burgdorferi B31
LNYTEINTLIKEI

SEQ ID NO: 91635 - protein, 13 aa, Borrelia burgdorferi B31
NYTEINTLIKEIP

SEQ ID NO: 91636 - protein, 13 aa, Borrelia burgdorferi B31
YTEINTLIKEIPF

SEQ ID NO: 91637 - protein, 13 aa, Borrelia burgdorferi B31
TEINTLIKEIPFT

SEQ ID NO: 91638 - protein, 13 aa, Borrelia burgdorferi B31
EINTLIKEIPFTN

SEQ ID NO: 91639 - protein, 13 aa, Borrelia burgdorferi B31
INTLIKEIPFTNS

SEQ ID NO: 91640 - protein, 13 aa, Borrelia burgdorferi B31
NTLIKEIPFTNSL

SEQ ID NO: 91641 - protein, 13 aa, Borrelia burgdorferi B31
TLIKEIPFTNSLI

SEQ ID NO: 91642 - protein, 13 aa, Borrelia burgdorferi B31
LIKEIPFTNSLIT

SEQ ID NO: 91643 - protein, 13 aa, Borrelia burgdorferi B31
IKEIPFTNSLITK

SEQ ID NO: 91644 - protein, 13 aa, Borrelia burgdorferi B31
KEIPFTNSLITKI

SEQ ID NO: 91645 - protein, 13 aa, Borrelia burgdorferi B31
EIPFTNSLITKII

SEQ ID NO: 91646 - protein, 13 aa, Borrelia burgdorferi B31
IPFTNSLITKIIQ

SEQ ID NO: 91647 - protein, 13 aa, Borrelia burgdorferi B31
PFTNSLITKIIQP

SEQ ID NO: 91648 - protein, 13 aa, Borrelia burgdorferi B31
FTNSLITKIIQPD

SEQ ID NO: 91649 - protein, 13 aa, Borrelia burgdorferi B31
TNSLITKIIQPDY

SEQ ID NO: 91650 - protein, 13 aa, Borrelia burgdorferi B31
NSLITKIIQPDYK

SEQ ID NO: 91651 - protein, 13 aa, Borrelia burgdorferi B31
SLITKIIQPDYKS

SEQ ID NO: 91652 - protein, 13 aa, Borrelia burgdorferi B31
LITKIIQPDYKSL

SEQ ID NO: 91653 - protein, 13 aa, Borrelia burgdorferi B31
ITKIIQPDYKSLV

SEQ ID NO: 91654 - protein, 13 aa, Borrelia burgdorferi B31
TKIIQPDYKSLVL

SEQ ID NO: 91655 - protein, 13 aa, Borrelia burgdorferi B31
KIIQPDYKSLVLE

SEQ ID NO: 91656 - protein, 13 aa, Borrelia burgdorferi B31
IIQPDYKSLVLEI

SEQ ID NO: 91657 - protein, 13 aa, Borrelia burgdorferi B31
IQPDYKSLVLEIY

SEQ ID NO: 91658 - protein, 13 aa, Borrelia burgdorferi B31
QPDYKSLVLEIYN

SEQ ID NO: 91659 - protein, 13 aa, Borrelia burgdorferi B31
PDYKSLVLEIYNK

SEQ ID NO: 91660 - protein, 13 aa, Borrelia burgdorferi B31
DYKSLVLEIYNKI

SEQ ID NO: 91661 - protein, 13 aa, Borrelia burgdorferi B31
YKSLVLEIYNKID

SEQ ID NO: 91662 - protein, 13 aa, Borrelia burgdorferi B31
KSLVLEIYNKIDN

SEQ ID NO: 91663 - protein, 13 aa, Borrelia burgdorferi B31
SLVLEIYNKIDNK

SEQ ID NO: 91664 - protein, 13 aa, Borrelia burgdorferi B31
LVLEIYNKIDNKK

SEQ ID NO: 91665 - protein, 13 aa, Borrelia burgdorferi B31
VLEIYNKIDNKKF

SEQ ID NO: 91666 - protein, 13 aa, Borrelia burgdorferi B31
LEIYNKIDNKKFK

SEQ ID NO: 91667 - protein, 13 aa, Borrelia burgdorferi B31
EIYNKIDNKKFKI

SEQ ID NO: 91668 - protein, 13 aa, Borrelia burgdorferi B31
IYNKIDNKKFKIL

SEQ ID NO: 91669 - protein, 13 aa, Borrelia burgdorferi B31
YNKIDNKKFKILI

SEQ ID NO: 91670 - protein, 13 aa, Borrelia burgdorferi B31
NKIDNKKFKILIC

SEQ ID NO: 91671 - protein, 13 aa, Borrelia burgdorferi B31
KIDNKKFKILICL

SEQ ID NO: 91672 - protein, 13 aa, Borrelia burgdorferi B31
IDNKKFKILICLN

SEQ ID NO: 91673 - protein, 13 aa, Borrelia burgdorferi B31
DNKKFKILICLNP

SEQ ID NO: 91674 - protein, 13 aa, Borrelia burgdorferi B31
NKKFKILICLNPN

SEQ ID NO: 91675 - protein, 13 aa, Borrelia burgdorferi B31
KKFKILICLNPNT

SEQ ID NO: 91676 - protein, 13 aa, Borrelia burgdorferi B31
KFKILICLNPNTT

SEQ ID NO: 91677 - protein, 13 aa, Borrelia burgdorferi B31
FKILICLNPNTTR

SEQ ID NO: 91678 - protein, 13 aa, Borrelia burgdorferi B31
KILICLNPNTTRF

SEQ ID NO: 91679 - protein, 13 aa, Borrelia burgdorferi B31
ILICLNPNTTRFH

SEQ ID NO: 91680 - protein, 13 aa, Borrelia burgdorferi B31
LICLNPNTTRFHI

SEQ ID NO: 91681 - protein, 13 aa, Borrelia burgdorferi B31
ICLNPNTTRFHIT

SEQ ID NO: 91682 - protein, 13 aa, Borrelia burgdorferi B31
CLNPNTTRFHITK

SEQ ID NO: 91683 - protein, 13 aa, Borrelia burgdorferi B31
LNPNTTRFHITKK

SEQ ID NO: 91684 - protein, 13 aa, Borrelia burgdorferi B31
NPNTTRFHITKKN

SEQ ID NO: 91685 - protein, 13 aa, Borrelia burgdorferi B31
PNTTRFHITKKNF

SEQ ID NO: 91686 - protein, 13 aa, Borrelia burgdorferi B31
NTTRFHITKKNFK

SEQ ID NO: 91687 - protein, 13 aa, Borrelia burgdorferi B31
TTRFHITKKNFKK

SEQ ID NO: 91688 - protein, 13 aa, Borrelia burgdorferi B31
TRFHITKKNFKKN

SEQ ID NO: 91689 - protein, 13 aa, Borrelia burgdorferi B31
RFHITKKNFKKNA

SEQ ID NO: 91690 - protein, 13 aa, Borrelia burgdorferi B31
FHITKKNFKKNAL

SEQ ID NO: 91691 - protein, 13 aa, Borrelia burgdorferi B31
HITKKNFKKNALK

SEQ ID NO: 91692 - protein, 13 aa, Borrelia burgdorferi B31
ITKKNFKKNALKL

SEQ ID NO: 91693 - protein, 13 aa, Borrelia burgdorferi B31
TKKNFKKNALKLR

SEQ ID NO: 91694 - protein, 13 aa, Borrelia burgdorferi B31
KKNFKKNALKLRF

SEQ ID NO: 91695 - protein, 13 aa, Borrelia burgdorferi B31
KNFKKNALKLRFS

SEQ ID NO: 91696 - protein, 13 aa, Borrelia burgdorferi B31
NFKKNALKLRFSD

SEQ ID NO: 91697 - protein, 13 aa, Borrelia burgdorferi B31
FKKNALKLRFSDF

SEQ ID NO: 91698 - protein, 13 aa, Borrelia burgdorferi B31
KKNALKLRFSDFL

SEQ ID NO: 91699 - protein, 13 aa, Borrelia burgdorferi B31
KNALKLRFSDFLK

SEQ ID NO: 91700 - protein, 13 aa, Borrelia burgdorferi B31
NALKLRFSDFLKS

SEQ ID NO: 91701 - protein, 13 aa, Borrelia burgdorferi B31
ALKLRFSDFLKSK

SEQ ID NO: 91702 - protein, 13 aa, Borrelia burgdorferi B31
LKLRFSDFLKSKI

SEQ ID NO: 91703 - protein, 13 aa, Borrelia burgdorferi B31
KLRFSDFLKSKIQ

SEQ ID NO: 91704 - protein, 13 aa, Borrelia burgdorferi B31
LRFSDFLKSKIQN

SEQ ID NO: 91705 - protein, 13 aa, Borrelia burgdorferi B31
RFSDFLKSKIQNG

SEQ ID NO: 91706 - protein, 13 aa, Borrelia burgdorferi B31
FSDFLKSKIQNGK

SEQ ID NO: 91707 - protein, 13 aa, Borrelia burgdorferi B31
SDFLKSKIQNGKI

SEQ ID NO: 91708 - protein, 13 aa, Borrelia burgdorferi B31
DFLKSKIQNGKII

SEQ ID NO: 91709 - protein, 13 aa, Borrelia burgdorferi B31
FLKSKIQNGKIIK

SEQ ID NO: 91710 - protein, 13 aa, Borrelia burgdorferi B31
LKSKIQNGKIIKA

SEQ ID NO: 91711 - protein, 13 aa, Borrelia burgdorferi B31
KSKIQNGKIIKAF

SEQ ID NO: 91712 - protein, 13 aa, Borrelia burgdorferi B31
SKIQNGKIIKAFQ

SEQ ID NO: 91713 - protein, 13 aa, Borrelia burgdorferi B31
KIQNGKIIKAFQM

SEQ ID NO: 91714 - protein, 13 aa, Borrelia burgdorferi B31
IQNGKIIKAFQMK

SEQ ID NO: 91715 - protein, 13 aa, Borrelia burgdorferi B31
QNGKIIKAFQMKN

SEQ ID NO: 91716 - protein, 13 aa, Borrelia burgdorferi B31
NGKIIKAFQMKNE

SEQ ID NO: 91717 - protein, 13 aa, Borrelia burgdorferi B31
GKIIKAFQMKNER

SEQ ID NO: 91718 - protein, 13 aa, Borrelia burgdorferi B31
KIIKAFQMKNERI

SEQ ID NO: 91719 - protein, 13 aa, Borrelia burgdorferi B31
IIKAFQMKNERII

SEQ ID NO: 91720 - protein, 13 aa, Borrelia burgdorferi B31
IKAFQMKNERIIS

SEQ ID NO: 91721 - protein, 13 aa, Borrelia burgdorferi B31
KAFQMKNERIISL

SEQ ID NO: 91722 - protein, 13 aa, Borrelia burgdorferi B31
AFQMKNERIISLE

SEQ ID NO: 91723 - protein, 13 aa, Borrelia burgdorferi B31
FQMKNERIISLEI

SEQ ID NO: 91724 - protein, 13 aa, Borrelia burgdorferi B31
QMKNERIISLEIL

SEQ ID NO: 91725 - protein, 13 aa, Borrelia burgdorferi B31
MKNERIISLEILQ

SEQ ID NO: 91726 - protein, 13 aa, Borrelia burgdorferi B31
KNERIISLEILQK

SEQ ID NO: 91727 - protein, 13 aa, Borrelia burgdorferi B31
NERIISLEILQKD

SEQ ID NO: 91728 - protein, 13 aa, Borrelia burgdorferi B31
ERIISLEILQKDM

SEQ ID NO: 91729 - protein, 13 aa, Borrelia burgdorferi B31
RIISLEILQKDMI

SEQ ID NO: 91730 - protein, 13 aa, Borrelia burgdorferi B31
IISLEILQKDMII

SEQ ID NO: 91731 - protein, 13 aa, Borrelia burgdorferi B31
ISLEILQKDMIIL

SEQ ID NO: 91732 - protein, 13 aa, Borrelia burgdorferi B31
SLEILQKDMIILF

SEQ ID NO: 91733 - protein, 13 aa, Borrelia burgdorferi B31
LEILQKDMIILFI

SEQ ID NO: 91734 - protein, 13 aa, Borrelia burgdorferi B31
EILQKDMIILFIK

SEQ ID NO: 91735 - protein, 13 aa, Borrelia burgdorferi B31
ILQKDMIILFIKL

SEQ ID NO: 91736 - protein, 13 aa, Borrelia burgdorferi B31
LQKDMIILFIKLW

SEQ ID NO: 91737 - protein, 13 aa, Borrelia burgdorferi B31
QKDMIILFIKLWP

SEQ ID NO: 91738 - protein, 13 aa, Borrelia burgdorferi B31
KDMIILFIKLWPS

SEQ ID NO: 91739 - protein, 13 aa, Borrelia burgdorferi B31
DMIILFIKLWPSS

SEQ ID NO: 91740 - protein, 13 aa, Borrelia burgdorferi B31
MIILFIKLWPSSP

SEQ ID NO: 91741 - protein, 13 aa, Borrelia burgdorferi B31
IILFIKLWPSSPN

SEQ ID NO: 91742 - protein, 13 aa, Borrelia burgdorferi B31
ILFIKLWPSSPNI

SEQ ID NO: 91743 - protein, 13 aa, Borrelia burgdorferi B31
LFIKLWPSSPNII

SEQ ID NO: 91744 - protein, 13 aa, Borrelia burgdorferi B31
FIKLWPSSPNIIA

SEQ ID NO: 91745 - protein, 13 aa, Borrelia burgdorferi B31
IKLWPSSPNIIAT

SEQ ID NO: 91746 - protein, 13 aa, Borrelia burgdorferi B31
KLWPSSPNIIATN

SEQ ID NO: 91747 - protein, 13 aa, Borrelia burgdorferi B31
LWPSSPNIIATNS

SEQ ID NO: 91748 - protein, 13 aa, Borrelia burgdorferi B31
WPSSPNIIATNSN

SEQ ID NO: 91749 - protein, 13 aa, Borrelia burgdorferi B31
PSSPNIIATNSNF

SEQ ID NO: 91750 - protein, 13 aa, Borrelia burgdorferi B31
SSPNIIATNSNFK

SEQ ID NO: 91751 - protein, 13 aa, Borrelia burgdorferi B31
SPNIIATNSNFKI

SEQ ID NO: 91752 - protein, 13 aa, Borrelia burgdorferi B31
PNIIATNSNFKIL

SEQ ID NO: 91753 - protein, 13 aa, Borrelia burgdorferi B31
NIIATNSNFKILD

SEQ ID NO: 91754 - protein, 13 aa, Borrelia burgdorferi B31
IIATNSNFKILDA

SEQ ID NO: 91755 - protein, 13 aa, Borrelia burgdorferi B31
IATNSNFKILDAY

SEQ ID NO: 91756 - protein, 13 aa, Borrelia burgdorferi B31
ATNSNFKILDAYY

SEQ ID NO: 91757 - protein, 13 aa, Borrelia burgdorferi B31
TNSNFKILDAYYR

SEQ ID NO: 91758 - protein, 13 aa, Borrelia burgdorferi B31
NSNFKILDAYYRR

SEQ ID NO: 91759 - protein, 13 aa, Borrelia burgdorferi B31
SNFKILDAYYRRP

SEQ ID NO: 91760 - protein, 13 aa, Borrelia burgdorferi B31
NFKILDAYYRRPK

SEQ ID NO: 91761 - protein, 13 aa, Borrelia burgdorferi B31
FKILDAYYRRPKI

SEQ ID NO: 91762 - protein, 13 aa, Borrelia burgdorferi B31
KILDAYYRRPKIK

SEQ ID NO: 91763 - protein, 13 aa, Borrelia burgdorferi B31
ILDAYYRRPKIKE

SEQ ID NO: 91764 - protein, 13 aa, Borrelia burgdorferi B31
LDAYYRRPKIKET

SEQ ID NO: 91765 - protein, 13 aa, Borrelia burgdorferi B31
DAYYRRPKIKETT

SEQ ID NO: 91766 - protein, 13 aa, Borrelia burgdorferi B31
AYYRRPKIKETTG

SEQ ID NO: 91767 - protein, 13 aa, Borrelia burgdorferi B31
YYRRPKIKETTGE

SEQ ID NO: 91768 - protein, 13 aa, Borrelia burgdorferi B31
YRRPKIKETTGEI

SEQ ID NO: 91769 - protein, 13 aa, Borrelia burgdorferi B31
RRPKIKETTGEIF

SEQ ID NO: 91770 - protein, 13 aa, Borrelia burgdorferi B31
RPKIKETTGEIFL

SEQ ID NO: 91771 - protein, 13 aa, Borrelia burgdorferi B31
PKIKETTGEIFLK

SEQ ID NO: 91772 - protein, 13 aa, Borrelia burgdorferi B31
KIKETTGEIFLKA

SEQ ID NO: 91773 - protein, 13 aa, Borrelia burgdorferi B31
IKETTGEIFLKAK

SEQ ID NO: 91774 - protein, 13 aa, Borrelia burgdorferi B31
KETTGEIFLKAKE

SEQ ID NO: 91775 - protein, 13 aa, Borrelia burgdorferi B31
ETTGEIFLKAKEI

SEQ ID NO: 91776 - protein, 13 aa, Borrelia burgdorferi B31
TTGEIFLKAKEIH

SEQ ID NO: 91777 - protein, 13 aa, Borrelia burgdorferi B31
TGEIFLKAKEIHE

SEQ ID NO: 91778 - protein, 13 aa, Borrelia burgdorferi B31
GEIFLKAKEIHES

SEQ ID NO: 91779 - protein, 13 aa, Borrelia burgdorferi B31
EIFLKAKEIHESN

SEQ ID NO: 91780 - protein, 13 aa, Borrelia burgdorferi B31
IFLKAKEIHESNK

SEQ ID NO: 91781 - protein, 13 aa, Borrelia burgdorferi B31
FLKAKEIHESNKM

SEQ ID NO: 91782 - protein, 13 aa, Borrelia burgdorferi B31
LKAKEIHESNKMS

SEQ ID NO: 91783 - protein, 13 aa, Borrelia burgdorferi B31
KAKEIHESNKMSD

SEQ ID NO: 91784 - protein, 13 aa, Borrelia burgdorferi B31
AKEIHESNKMSDK

SEQ ID NO: 91785 - protein, 13 aa, Borrelia burgdorferi B31
KEIHESNKMSDKK

SEQ ID NO: 91786 - protein, 13 aa, Borrelia burgdorferi B31
EIHESNKMSDKKI

SEQ ID NO: 91787 - protein, 13 aa, Borrelia burgdorferi B31
IHESNKMSDKKIM

SEQ ID NO: 91788 - protein, 13 aa, Borrelia burgdorferi B31
HESNKMSDKKIME

SEQ ID NO: 91789 - protein, 13 aa, Borrelia burgdorferi B31
ESNKMSDKKIMEL

SEQ ID NO: 91790 - protein, 13 aa, Borrelia burgdorferi B31
SNKMSDKKIMELK

SEQ ID NO: 91791 - protein, 13 aa, Borrelia burgdorferi B31
NKMSDKKIMELKE

SEQ ID NO: 91792 - protein, 13 aa, Borrelia burgdorferi B31
KMSDKKIMELKEE

SEQ ID NO: 91793 - protein, 13 aa, Borrelia burgdorferi B31
MSDKKIMELKEEY

SEQ ID NO: 91794 - protein, 13 aa, Borrelia burgdorferi B31
SDKKIMELKEEYN

SEQ ID NO: 91795 - protein, 13 aa, Borrelia burgdorferi B31
DKKIMELKEEYNN

SEQ ID NO: 91796 - protein, 13 aa, Borrelia burgdorferi B31
KKIMELKEEYNNT

SEQ ID NO: 91797 - protein, 13 aa, Borrelia burgdorferi B31
KIMELKEEYNNTS

SEQ ID NO: 91798 - protein, 13 aa, Borrelia burgdorferi B31
IMELKEEYNNTSY

SEQ ID NO: 91799 - protein, 13 aa, Borrelia burgdorferi B31
MELKEEYNNTSYT

SEQ ID NO: 91800 - protein, 13 aa, Borrelia burgdorferi B31
ELKEEYNNTSYTS

SEQ ID NO: 91801 - protein, 13 aa, Borrelia burgdorferi B31
LKEEYNNTSYTSY

SEQ ID NO: 91802 - protein, 13 aa, Borrelia burgdorferi B31
KEEYNNTSYTSYS

SEQ ID NO: 91803 - protein, 13 aa, Borrelia burgdorferi B31
EEYNNTSYTSYSE

SEQ ID NO: 91804 - protein, 13 aa, Borrelia burgdorferi B31
EYNNTSYTSYSEF

SEQ ID NO: 91805 - protein, 13 aa, Borrelia burgdorferi B31
YNNTSYTSYSEFL

SEQ ID NO: 91806 - protein, 13 aa, Borrelia burgdorferi B31
NNTSYTSYSEFLE

SEQ ID NO: 91807 - protein, 13 aa, Borrelia burgdorferi B31
NTSYTSYSEFLEN

SEQ ID NO: 91808 - protein, 13 aa, Borrelia burgdorferi B31
TSYTSYSEFLENY

SEQ ID NO: 91809 - protein, 13 aa, Borrelia burgdorferi B31
SYTSYSEFLENYY

SEQ ID NO: 91810 - protein, 13 aa, Borrelia burgdorferi B31
YTSYSEFLENYYE

SEQ ID NO: 91811 - protein, 13 aa, Borrelia burgdorferi B31
TSYSEFLENYYES

SEQ ID NO: 91812 - protein, 13 aa, Borrelia burgdorferi B31
SYSEFLENYYESL

SEQ ID NO: 91813 - protein, 13 aa, Borrelia burgdorferi B31
YSEFLENYYESLN

SEQ ID NO: 91814 - protein, 13 aa, Borrelia burgdorferi B31
SEFLENYYESLND

SEQ ID NO: 91815 - protein, 13 aa, Borrelia burgdorferi B31
EFLENYYESLNDQ

SEQ ID NO: 91816 - protein, 13 aa, Borrelia burgdorferi B31
FLENYYESLNDQI

SEQ ID NO: 91817 - protein, 13 aa, Borrelia burgdorferi B31
LENYYESLNDQIK

SEQ ID NO: 91818 - protein, 13 aa, Borrelia burgdorferi B31
ENYYESLNDQIKK

SEQ ID NO: 91819 - protein, 13 aa, Borrelia burgdorferi B31
NYYESLNDQIKKT

SEQ ID NO: 91820 - protein, 13 aa, Borrelia burgdorferi B31
YYESLNDQIKKTN

SEQ ID NO: 91821 - protein, 13 aa, Borrelia burgdorferi B31
YESLNDQIKKTNI

SEQ ID NO: 91822 - protein, 13 aa, Borrelia burgdorferi B31
ESLNDQIKKTNIK

SEQ ID NO: 91823 - protein, 13 aa, Borrelia burgdorferi B31
SLNDQIKKTNIKE

SEQ ID NO: 91824 - protein, 13 aa, Borrelia burgdorferi B31
LNDQIKKTNIKEL

SEQ ID NO: 91825 - protein, 13 aa, Borrelia burgdorferi B31
NDQIKKTNIKELL

SEQ ID NO: 91826 - protein, 13 aa, Borrelia burgdorferi B31
DQIKKTNIKELLI

SEQ ID NO: 91827 - protein, 13 aa, Borrelia burgdorferi B31
QIKKTNIKELLIE

SEQ ID NO: 91828 - protein, 13 aa, Borrelia burgdorferi B31
IKKTNIKELLIEK

SEQ ID NO: 91829 - protein, 13 aa, Borrelia burgdorferi B31
KKTNIKELLIEKY

SEQ ID NO: 91830 - protein, 13 aa, Borrelia burgdorferi B31
KTNIKELLIEKYK

SEQ ID NO: 91831 - protein, 13 aa, Borrelia burgdorferi B31
TNIKELLIEKYKK

SEQ ID NO: 91832 - protein, 13 aa, Borrelia burgdorferi B31
NIKELLIEKYKKE

SEQ ID NO: 91833 - protein, 13 aa, Borrelia burgdorferi B31
IKELLIEKYKKEL

SEQ ID NO: 91834 - protein, 13 aa, Borrelia burgdorferi B31
KELLIEKYKKELI

SEQ ID NO: 91835 - protein, 13 aa, Borrelia burgdorferi B31
ELLIEKYKKELIV

SEQ ID NO: 91836 - protein, 13 aa, Borrelia burgdorferi B31
LLIEKYKKELIVL

SEQ ID NO: 91837 - protein, 13 aa, Borrelia burgdorferi B31
LIEKYKKELIVLE

SEQ ID NO: 91838 - protein, 13 aa, Borrelia burgdorferi B31
IEKYKKELIVLEK

SEQ ID NO: 91839 - protein, 13 aa, Borrelia burgdorferi B31
EKYKKELIVLEKR

SEQ ID NO: 91840 - protein, 13 aa, Borrelia burgdorferi B31
KYKKELIVLEKRI

SEQ ID NO: 91841 - protein, 13 aa, Borrelia burgdorferi B31
YKKELIVLEKRID

SEQ ID NO: 91842 - protein, 13 aa, Borrelia burgdorferi B31
KKELIVLEKRIDS

SEQ ID NO: 91843 - protein, 13 aa, Borrelia burgdorferi B31
KELIVLEKRIDSL

SEQ ID NO: 91844 - protein, 13 aa, Borrelia burgdorferi B31
ELIVLEKRIDSLK

SEQ ID NO: 91845 - protein, 13 aa, Borrelia burgdorferi B31
LIVLEKRIDSLKQ

SEQ ID NO: 91846 - protein, 13 aa, Borrelia burgdorferi B31
IVLEKRIDSLKQQ

SEQ ID NO: 91847 - protein, 13 aa, Borrelia burgdorferi B31
VLEKRIDSLKQQI

SEQ ID NO: 91848 - protein, 13 aa, Borrelia burgdorferi B31
LEKRIDSLKQQIK

SEQ ID NO: 91849 - protein, 13 aa, Borrelia burgdorferi B31
EKRIDSLKQQIKL

SEQ ID NO: 91850 - protein, 13 aa, Borrelia burgdorferi B31
KRIDSLKQQIKLL

SEQ ID NO: 91851 - protein, 13 aa, Borrelia burgdorferi B31
RIDSLKQQIKLLE

SEQ ID NO: 91852 - protein, 13 aa, Borrelia burgdorferi B31
IDSLKQQIKLLEN

SEQ ID NO: 91853 - protein, 13 aa, Borrelia burgdorferi B31
DSLKQQIKLLENI

SEQ ID NO: 91854 - protein, 13 aa, Borrelia burgdorferi B31
SLKQQIKLLENIE

SEQ ID NO: 91855 - protein, 13 aa, Borrelia burgdorferi B31
LKQQIKLLENIEN

SEQ ID NO: 91856 - protein, 13 aa, Borrelia burgdorferi B31
KQQIKLLENIENE

SEQ ID NO: 91857 - protein, 13 aa, Borrelia burgdorferi B31
QQIKLLENIENEK

SEQ ID NO: 91858 - protein, 13 aa, Borrelia burgdorferi B31
QIKLLENIENEKE

SEQ ID NO: 91859 - protein, 13 aa, Borrelia burgdorferi B31
IKLLENIENEKEK

SEQ ID NO: 91860 - protein, 13 aa, Borrelia burgdorferi B31
KLLENIENEKEKG

SEQ ID NO: 91861 - protein, 13 aa, Borrelia burgdorferi B31
LLENIENEKEKGE

SEQ ID NO: 91862 - protein, 13 aa, Borrelia burgdorferi B31
LENIENEKEKGEL

SEQ ID NO: 91863 - protein, 13 aa, Borrelia burgdorferi B31
ENIENEKEKGELI

SEQ ID NO: 91864 - protein, 13 aa, Borrelia burgdorferi B31
NIENEKEKGELIL

SEQ ID NO: 91865 - protein, 13 aa, Borrelia burgdorferi B31
IENEKEKGELILL

SEQ ID NO: 91866 - protein, 13 aa, Borrelia burgdorferi B31
ENEKEKGELILLN

SEQ ID NO: 91867 - protein, 13 aa, Borrelia burgdorferi B31
NEKEKGELILLNI

SEQ ID NO: 91868 - protein, 13 aa, Borrelia burgdorferi B31
EKEKGELILLNIN

SEQ ID NO: 91869 - protein, 13 aa, Borrelia burgdorferi B31
KEKGELILLNINK

SEQ ID NO: 91870 - protein, 13 aa, Borrelia burgdorferi B31
EKGELILLNINKI

SEQ ID NO: 91871 - protein, 13 aa, Borrelia burgdorferi B31
KGELILLNINKIQ

SEQ ID NO: 91872 - protein, 13 aa, Borrelia burgdorferi B31
GELILLNINKIQK

SEQ ID NO: 91873 - protein, 13 aa, Borrelia burgdorferi B31
ELILLNINKIQKG

SEQ ID NO: 91874 - protein, 13 aa, Borrelia burgdorferi B31
LILLNINKIQKGI

SEQ ID NO: 91875 - protein, 13 aa, Borrelia burgdorferi B31
ILLNINKIQKGIK

SEQ ID NO: 91876 - protein, 13 aa, Borrelia burgdorferi B31
LLNINKIQKGIKE

SEQ ID NO: 91877 - protein, 13 aa, Borrelia burgdorferi B31
LNINKIQKGIKEI

SEQ ID NO: 91878 - protein, 13 aa, Borrelia burgdorferi B31
NINKIQKGIKEIN

SEQ ID NO: 91879 - protein, 13 aa, Borrelia burgdorferi B31
INKIQKGIKEINL

SEQ ID NO: 91880 - protein, 13 aa, Borrelia burgdorferi B31
NKIQKGIKEINLL

SEQ ID NO: 91881 - protein, 13 aa, Borrelia burgdorferi B31
KIQKGIKEINLLN

SEQ ID NO: 91882 - protein, 13 aa, Borrelia burgdorferi B31
IQKGIKEINLLNY

SEQ ID NO: 91883 - protein, 13 aa, Borrelia burgdorferi B31
QKGIKEINLLNYK

SEQ ID NO: 91884 - protein, 13 aa, Borrelia burgdorferi B31
KGIKEINLLNYKE

SEQ ID NO: 91885 - protein, 13 aa, Borrelia burgdorferi B31
GIKEINLLNYKEE

SEQ ID NO: 91886 - protein, 13 aa, Borrelia burgdorferi B31
IKEINLLNYKEEK

SEQ ID NO: 91887 - protein, 13 aa, Borrelia burgdorferi B31
KEINLLNYKEEKI

SEQ ID NO: 91888 - protein, 13 aa, Borrelia burgdorferi B31
EINLLNYKEEKIK

SEQ ID NO: 91889 - protein, 13 aa, Borrelia burgdorferi B31
INLLNYKEEKIKI

SEQ ID NO: 91890 - protein, 13 aa, Borrelia burgdorferi B31
NLLNYKEEKIKIS

SEQ ID NO: 91891 - protein, 13 aa, Borrelia burgdorferi B31
LLNYKEEKIKISL

SEQ ID NO: 91892 - protein, 13 aa, Borrelia burgdorferi B31
LNYKEEKIKISLN

SEQ ID NO: 91893 - protein, 13 aa, Borrelia burgdorferi B31
NYKEEKIKISLNQ

SEQ ID NO: 91894 - protein, 13 aa, Borrelia burgdorferi B31
YKEEKIKISLNQS

SEQ ID NO: 91895 - protein, 13 aa, Borrelia burgdorferi B31
KEEKIKISLNQSL

SEQ ID NO: 91896 - protein, 13 aa, Borrelia burgdorferi B31
EEKIKISLNQSLS

SEQ ID NO: 91897 - protein, 13 aa, Borrelia burgdorferi B31
EKIKISLNQSLSP

SEQ ID NO: 91898 - protein, 13 aa, Borrelia burgdorferi B31
KIKISLNQSLSPK

SEQ ID NO: 91899 - protein, 13 aa, Borrelia burgdorferi B31
IKISLNQSLSPKE

SEQ ID NO: 91900 - protein, 13 aa, Borrelia burgdorferi B31
KISLNQSLSPKEN

SEQ ID NO: 91901 - protein, 13 aa, Borrelia burgdorferi B31
ISLNQSLSPKENA

SEQ ID NO: 91902 - protein, 13 aa, Borrelia burgdorferi B31
SLNQSLSPKENAL

SEQ ID NO: 91903 - protein, 13 aa, Borrelia burgdorferi B31
LNQSLSPKENALQ

SEQ ID NO: 91904 - protein, 13 aa, Borrelia burgdorferi B31
NQSLSPKENALQY

SEQ ID NO: 91905 - protein, 13 aa, Borrelia burgdorferi B31
QSLSPKENALQYF

SEQ ID NO: 91906 - protein, 13 aa, Borrelia burgdorferi B31
SLSPKENALQYFK

SEQ ID NO: 91907 - protein, 13 aa, Borrelia burgdorferi B31
LSPKENALQYFKA

SEQ ID NO: 91908 - protein, 13 aa, Borrelia burgdorferi B31
SPKENALQYFKAY

SEQ ID NO: 91909 - protein, 13 aa, Borrelia burgdorferi B31
PKENALQYFKAYK

SEQ ID NO: 91910 - protein, 13 aa, Borrelia burgdorferi B31
KENALQYFKAYKK

SEQ ID NO: 91911 - protein, 13 aa, Borrelia burgdorferi B31
ENALQYFKAYKKG

SEQ ID NO: 91912 - protein, 13 aa, Borrelia burgdorferi B31
NALQYFKAYKKGK

SEQ ID NO: 91913 - protein, 13 aa, Borrelia burgdorferi B31
ALQYFKAYKKGKN

SEQ ID NO: 91914 - protein, 13 aa, Borrelia burgdorferi B31
LQYFKAYKKGKNS

SEQ ID NO: 91915 - protein, 13 aa, Borrelia burgdorferi B31
QYFKAYKKGKNSF

SEQ ID NO: 91916 - protein, 13 aa, Borrelia burgdorferi B31
YFKAYKKGKNSFK

SEQ ID NO: 91917 - protein, 13 aa, Borrelia burgdorferi B31
FKAYKKGKNSFKT

SEQ ID NO: 91918 - protein, 13 aa, Borrelia burgdorferi B31
KAYKKGKNSFKTI

SEQ ID NO: 91919 - protein, 13 aa, Borrelia burgdorferi B31
AYKKGKNSFKTIQ

SEQ ID NO: 91920 - protein, 13 aa, Borrelia burgdorferi B31
YKKGKNSFKTIQN

SEQ ID NO: 91921 - protein, 13 aa, Borrelia burgdorferi B31
KKGKNSFKTIQNQ

SEQ ID NO: 91922 - protein, 13 aa, Borrelia burgdorferi B31
KGKNSFKTIQNQL

SEQ ID NO: 91923 - protein, 13 aa, Borrelia burgdorferi B31
GKNSFKTIQNQLK

SEQ ID NO: 91924 - protein, 13 aa, Borrelia burgdorferi B31
KNSFKTIQNQLKD

SEQ ID NO: 91925 - protein, 13 aa, Borrelia burgdorferi B31
NSFKTIQNQLKDN

SEQ ID NO: 91926 - protein, 13 aa, Borrelia burgdorferi B31
SFKTIQNQLKDNL

SEQ ID NO: 91927 - protein, 13 aa, Borrelia burgdorferi B31
FKTIQNQLKDNLD

SEQ ID NO: 91928 - protein, 13 aa, Borrelia burgdorferi B31
KTIQNQLKDNLDK

SEQ ID NO: 91929 - protein, 13 aa, Borrelia burgdorferi B31
TIQNQLKDNLDKF

SEQ ID NO: 91930 - protein, 13 aa, Borrelia burgdorferi B31
IQNQLKDNLDKFN

SEQ ID NO: 91931 - protein, 13 aa, Borrelia burgdorferi B31
QNQLKDNLDKFNL

SEQ ID NO: 91932 - protein, 13 aa, Borrelia burgdorferi B31
NQLKDNLDKFNLI

SEQ ID NO: 91933 - protein, 13 aa, Borrelia burgdorferi B31
QLKDNLDKFNLIQ

SEQ ID NO: 91934 - protein, 13 aa, Borrelia burgdorferi B31
LKDNLDKFNLIQS

SEQ ID NO: 91935 - protein, 13 aa, Borrelia burgdorferi B31
KDNLDKFNLIQSK

SEQ ID NO: 91936 - protein, 13 aa, Borrelia burgdorferi B31
DNLDKFNLIQSKI

SEQ ID NO: 91937 - protein, 13 aa, Borrelia burgdorferi B31
NLDKFNLIQSKIT

SEQ ID NO: 91938 - protein, 13 aa, Borrelia burgdorferi B31
LDKFNLIQSKITM

SEQ ID NO: 91939 - protein, 13 aa, Borrelia burgdorferi B31
DKFNLIQSKITML

SEQ ID NO: 91940 - protein, 13 aa, Borrelia burgdorferi B31
KFNLIQSKITMLK

SEQ ID NO: 91941 - protein, 13 aa, Borrelia burgdorferi B31
FNLIQSKITMLKV

SEQ ID NO: 91942 - protein, 13 aa, Borrelia burgdorferi B31
NLIQSKITMLKVE

SEQ ID NO: 91943 - protein, 13 aa, Borrelia burgdorferi B31
LIQSKITMLKVEN

SEQ ID NO: 91944 - protein, 13 aa, Borrelia burgdorferi B31
IQSKITMLKVENL

SEQ ID NO: 91945 - protein, 13 aa, Borrelia burgdorferi B31
QSKITMLKVENLI

SEQ ID NO: 91946 - protein, 13 aa, Borrelia burgdorferi B31
SKITMLKVENLIP

SEQ ID NO: 91947 - protein, 13 aa, Borrelia burgdorferi B31
KITMLKVENLIPE

SEQ ID NO: 91948 - protein, 13 aa, Borrelia burgdorferi B31
ITMLKVENLIPEE

SEQ ID NO: 91949 - protein, 13 aa, Borrelia burgdorferi B31
TMLKVENLIPEEE

SEQ ID NO: 91950 - protein, 13 aa, Borrelia burgdorferi B31
MLKVENLIPEEEY

SEQ ID NO: 91951 - protein, 13 aa, Borrelia burgdorferi B31
LKVENLIPEEEYN

SEQ ID NO: 91952 - protein, 13 aa, Borrelia burgdorferi B31
KVENLIPEEEYNQ

SEQ ID NO: 91953 - protein, 13 aa, Borrelia burgdorferi B31
VENLIPEEEYNQE

SEQ ID NO: 91954 - protein, 13 aa, Borrelia burgdorferi B31
ENLIPEEEYNQEK

SEQ ID NO: 91955 - protein, 13 aa, Borrelia burgdorferi B31
NLIPEEEYNQEKT

SEQ ID NO: 91956 - protein, 13 aa, Borrelia burgdorferi B31
LIPEEEYNQEKTA

SEQ ID NO: 91957 - protein, 13 aa, Borrelia burgdorferi B31
IPEEEYNQEKTAI

SEQ ID NO: 91958 - protein, 13 aa, Borrelia burgdorferi B31
PEEEYNQEKTAIK

SEQ ID NO: 91959 - protein, 13 aa, Borrelia burgdorferi B31
EEEYNQEKTAIKE

SEQ ID NO: 91960 - protein, 13 aa, Borrelia burgdorferi B31
EEYNQEKTAIKEK

SEQ ID NO: 91961 - protein, 13 aa, Borrelia burgdorferi B31
EYNQEKTAIKEKE

SEQ ID NO: 91962 - protein, 13 aa, Borrelia burgdorferi B31
YNQEKTAIKEKEK

SEQ ID NO: 91963 - protein, 13 aa, Borrelia burgdorferi B31
NQEKTAIKEKEKT

SEQ ID NO: 91964 - protein, 13 aa, Borrelia burgdorferi B31
QEKTAIKEKEKTP

SEQ ID NO: 91965 - protein, 13 aa, Borrelia burgdorferi B31
EKTAIKEKEKTPK

SEQ ID NO: 91966 - protein, 13 aa, Borrelia burgdorferi B31
KTAIKEKEKTPKI

SEQ ID NO: 91967 - protein, 13 aa, Borrelia burgdorferi B31
TAIKEKEKTPKIG

SEQ ID NO: 91968 - protein, 13 aa, Borrelia burgdorferi B31
AIKEKEKTPKIGL

SEQ ID NO: 91969 - protein, 13 aa, Borrelia burgdorferi B31
IKEKEKTPKIGLH

SEQ ID NO: 91970 - protein, 13 aa, Borrelia burgdorferi B31
KEKEKTPKIGLHF

SEQ ID NO: 91971 - protein, 13 aa, Borrelia burgdorferi B31
EKEKTPKIGLHFT

SEQ ID NO: 91972 - protein, 13 aa, Borrelia burgdorferi B31
KEKTPKIGLHFTY

SEQ ID NO: 91973 - protein, 13 aa, Borrelia burgdorferi B31
EKTPKIGLHFTYC

SEQ ID NO: 91974 - protein, 13 aa, Borrelia burgdorferi B31
KTPKIGLHFTYCG

SEQ ID NO: 91975 - protein, 13 aa, Borrelia burgdorferi B31
TPKIGLHFTYCGF

SEQ ID NO: 91976 - protein, 13 aa, Borrelia burgdorferi B31
PKIGLHFTYCGFE

SEQ ID NO: 91977 - protein, 13 aa, Borrelia burgdorferi B31
KIGLHFTYCGFEI

SEQ ID NO: 91978 - protein, 13 aa, Borrelia burgdorferi B31
IGLHFTYCGFEIL

SEQ ID NO: 91979 - protein, 13 aa, Borrelia burgdorferi B31
GLHFTYCGFEILI

SEQ ID NO: 91980 - protein, 13 aa, Borrelia burgdorferi B31
LHFTYCGFEILIG

SEQ ID NO: 91981 - protein, 13 aa, Borrelia burgdorferi B31
HFTYCGFEILIGR

SEQ ID NO: 91982 - protein, 13 aa, Borrelia burgdorferi B31
FTYCGFEILIGRN

SEQ ID NO: 91983 - protein, 13 aa, Borrelia burgdorferi B31
TYCGFEILIGRNA

SEQ ID NO: 91984 - protein, 13 aa, Borrelia burgdorferi B31
YCGFEILIGRNAK

SEQ ID NO: 91985 - protein, 13 aa, Borrelia burgdorferi B31
CGFEILIGRNAKE

SEQ ID NO: 91986 - protein, 13 aa, Borrelia burgdorferi B31
GFEILIGRNAKEN

SEQ ID NO: 91987 - protein, 13 aa, Borrelia burgdorferi B31
FEILIGRNAKEND

SEQ ID NO: 91988 - protein, 13 aa, Borrelia burgdorferi B31
EILIGRNAKENDK

SEQ ID NO: 91989 - protein, 13 aa, Borrelia burgdorferi B31
ILIGRNAKENDKL

SEQ ID NO: 91990 - protein, 13 aa, Borrelia burgdorferi B31
LIGRNAKENDKLL

SEQ ID NO: 91991 - protein, 13 aa, Borrelia burgdorferi B31
IGRNAKENDKLLR

SEQ ID NO: 91992 - protein, 13 aa, Borrelia burgdorferi B31
GRNAKENDKLLRH

SEQ ID NO: 91993 - protein, 13 aa, Borrelia burgdorferi B31
RNAKENDKLLRHC

SEQ ID NO: 91994 - protein, 13 aa, Borrelia burgdorferi B31
NAKENDKLLRHCV

SEQ ID NO: 91995 - protein, 13 aa, Borrelia burgdorferi B31
AKENDKLLRHCVK

SEQ ID NO: 91996 - protein, 13 aa, Borrelia burgdorferi B31
KENDKLLRHCVKG

SEQ ID NO: 91997 - protein, 13 aa, Borrelia burgdorferi B31
ENDKLLRHCVKGN

SEQ ID NO: 91998 - protein, 13 aa, Borrelia burgdorferi B31
NDKLLRHCVKGND

SEQ ID NO: 91999 - protein, 13 aa, Borrelia burgdorferi B31
DKLLRHCVKGNDY

SEQ ID NO: 92000 - protein, 13 aa, Borrelia burgdorferi B31
KLLRHCVKGNDYW

SEQ ID NO: 92001 - protein, 13 aa, Borrelia burgdorferi B31
LLRHCVKGNDYWL

SEQ ID NO: 92002 - protein, 13 aa, Borrelia burgdorferi B31
LRHCVKGNDYWLH

SEQ ID NO: 92003 - protein, 13 aa, Borrelia burgdorferi B31
RHCVKGNDYWLHT

SEQ ID NO: 92004 - protein, 13 aa, Borrelia burgdorferi B31
HCVKGNDYWLHTR

SEQ ID NO: 92005 - protein, 13 aa, Borrelia burgdorferi B31
CVKGNDYWLHTRD

SEQ ID NO: 92006 - protein, 13 aa, Borrelia burgdorferi B31
VKGNDYWLHTRDY

SEQ ID NO: 92007 - protein, 13 aa, Borrelia burgdorferi B31
KGNDYWLHTRDYP

SEQ ID NO: 92008 - protein, 13 aa, Borrelia burgdorferi B31
GNDYWLHTRDYPG

SEQ ID NO: 92009 - protein, 13 aa, Borrelia burgdorferi B31
NDYWLHTRDYPGA

SEQ ID NO: 92010 - protein, 13 aa, Borrelia burgdorferi B31
DYWLHTRDYPGAY

SEQ ID NO: 92011 - protein, 13 aa, Borrelia burgdorferi B31
YWLHTRDYPGAYV

SEQ ID NO: 92012 - protein, 13 aa, Borrelia burgdorferi B31
WLHTRDYPGAYVF

SEQ ID NO: 92013 - protein, 13 aa, Borrelia burgdorferi B31
LHTRDYPGAYVFI

SEQ ID NO: 92014 - protein, 13 aa, Borrelia burgdorferi B31
HTRDYPGAYVFIK

SEQ ID NO: 92015 - protein, 13 aa, Borrelia burgdorferi B31
TRDYPGAYVFIKN

SEQ ID NO: 92016 - protein, 13 aa, Borrelia burgdorferi B31
RDYPGAYVFIKNQ

SEQ ID NO: 92017 - protein, 13 aa, Borrelia burgdorferi B31
DYPGAYVFIKNQK

SEQ ID NO: 92018 - protein, 13 aa, Borrelia burgdorferi B31
YPGAYVFIKNQKN

SEQ ID NO: 92019 - protein, 13 aa, Borrelia burgdorferi B31
PGAYVFIKNQKNK

SEQ ID NO: 92020 - protein, 13 aa, Borrelia burgdorferi B31
GAYVFIKNQKNKT

SEQ ID NO: 92021 - protein, 13 aa, Borrelia burgdorferi B31
AYVFIKNQKNKTP

SEQ ID NO: 92022 - protein, 13 aa, Borrelia burgdorferi B31
YVFIKNQKNKTPS

SEQ ID NO: 92023 - protein, 13 aa, Borrelia burgdorferi B31
VFIKNQKNKTPSL

SEQ ID NO: 92024 - protein, 13 aa, Borrelia burgdorferi B31
FIKNQKNKTPSLD

SEQ ID NO: 92025 - protein, 13 aa, Borrelia burgdorferi B31
IKNQKNKTPSLDV

SEQ ID NO: 92026 - protein, 13 aa, Borrelia burgdorferi B31
KNQKNKTPSLDVL

SEQ ID NO: 92027 - protein, 13 aa, Borrelia burgdorferi B31
NQKNKTPSLDVLL

SEQ ID NO: 92028 - protein, 13 aa, Borrelia burgdorferi B31
QKNKTPSLDVLLG

SEQ ID NO: 92029 - protein, 13 aa, Borrelia burgdorferi B31
KNKTPSLDVLLGA

SEQ ID NO: 92030 - protein, 13 aa, Borrelia burgdorferi B31
NKTPSLDVLLGAG

SEQ ID NO: 92031 - protein, 13 aa, Borrelia burgdorferi B31
KTPSLDVLLGAGN

SEQ ID NO: 92032 - protein, 13 aa, Borrelia burgdorferi B31
TPSLDVLLGAGNL

SEQ ID NO: 92033 - protein, 13 aa, Borrelia burgdorferi B31
PSLDVLLGAGNLC

SEQ ID NO: 92034 - protein, 13 aa, Borrelia burgdorferi B31
SLDVLLGAGNLCV

SEQ ID NO: 92035 - protein, 13 aa, Borrelia burgdorferi B31
LDVLLGAGNLCVF

SEQ ID NO: 92036 - protein, 13 aa, Borrelia burgdorferi B31
DVLLGAGNLCVFY

SEQ ID NO: 92037 - protein, 13 aa, Borrelia burgdorferi B31
VLLGAGNLCVFYT

SEQ ID NO: 92038 - protein, 13 aa, Borrelia burgdorferi B31
LLGAGNLCVFYTK

SEQ ID NO: 92039 - protein, 13 aa, Borrelia burgdorferi B31
LGAGNLCVFYTKL

SEQ ID NO: 92040 - protein, 13 aa, Borrelia burgdorferi B31
GAGNLCVFYTKLA

SEQ ID NO: 92041 - protein, 13 aa, Borrelia burgdorferi B31
AGNLCVFYTKLAK

SEQ ID NO: 92042 - protein, 13 aa, Borrelia burgdorferi B31
GNLCVFYTKLAKK

SEQ ID NO: 92043 - protein, 13 aa, Borrelia burgdorferi B31
NLCVFYTKLAKKS

SEQ ID NO: 92044 - protein, 13 aa, Borrelia burgdorferi B31
LCVFYTKLAKKSG

SEQ ID NO: 92045 - protein, 13 aa, Borrelia burgdorferi B31
CVFYTKLAKKSGK

SEQ ID NO: 92046 - protein, 13 aa, Borrelia burgdorferi B31
VFYTKLAKKSGKA

SEQ ID NO: 92047 - protein, 13 aa, Borrelia burgdorferi B31
FYTKLAKKSGKAD

SEQ ID NO: 92048 - protein, 13 aa, Borrelia burgdorferi B31
YTKLAKKSGKADL

SEQ ID NO: 92049 - protein, 13 aa, Borrelia burgdorferi B31
TKLAKKSGKADLY

SEQ ID NO: 92050 - protein, 13 aa, Borrelia burgdorferi B31
KLAKKSGKADLYY

SEQ ID NO: 92051 - protein, 13 aa, Borrelia burgdorferi B31
LAKKSGKADLYYT

SEQ ID NO: 92052 - protein, 13 aa, Borrelia burgdorferi B31
AKKSGKADLYYTQ

SEQ ID NO: 92053 - protein, 13 aa, Borrelia burgdorferi B31
KKSGKADLYYTQV

SEQ ID NO: 92054 - protein, 13 aa, Borrelia burgdorferi B31
KSGKADLYYTQVK

SEQ ID NO: 92055 - protein, 13 aa, Borrelia burgdorferi B31
SGKADLYYTQVKN

SEQ ID NO: 92056 - protein, 13 aa, Borrelia burgdorferi B31
GKADLYYTQVKNL

SEQ ID NO: 92057 - protein, 13 aa, Borrelia burgdorferi B31
KADLYYTQVKNLR

SEQ ID NO: 92058 - protein, 13 aa, Borrelia burgdorferi B31
ADLYYTQVKNLRR

SEQ ID NO: 92059 - protein, 13 aa, Borrelia burgdorferi B31
DLYYTQVKNLRRV

SEQ ID NO: 92060 - protein, 13 aa, Borrelia burgdorferi B31
LYYTQVKNLRRVK

SEQ ID NO: 92061 - protein, 13 aa, Borrelia burgdorferi B31
YYTQVKNLRRVKN

SEQ ID NO: 92062 - protein, 13 aa, Borrelia burgdorferi B31
YTQVKNLRRVKNK

SEQ ID NO: 92063 - protein, 13 aa, Borrelia burgdorferi B31
TQVKNLRRVKNKK

SEQ ID NO: 92064 - protein, 13 aa, Borrelia burgdorferi B31
QVKNLRRVKNKKL

SEQ ID NO: 92065 - protein, 13 aa, Borrelia burgdorferi B31
VKNLRRVKNKKLG

SEQ ID NO: 92066 - protein, 13 aa, Borrelia burgdorferi B31
KNLRRVKNKKLGL

SEQ ID NO: 92067 - protein, 13 aa, Borrelia burgdorferi B31
NLRRVKNKKLGLV

SEQ ID NO: 92068 - protein, 13 aa, Borrelia burgdorferi B31
LRRVKNKKLGLVI

SEQ ID NO: 92069 - protein, 13 aa, Borrelia burgdorferi B31
RRVKNKKLGLVIP

SEQ ID NO: 92070 - protein, 13 aa, Borrelia burgdorferi B31
RVKNKKLGLVIPK

SEQ ID NO: 92071 - protein, 13 aa, Borrelia burgdorferi B31
VKNKKLGLVIPKA

SEQ ID NO: 92072 - protein, 13 aa, Borrelia burgdorferi B31
KNKKLGLVIPKAE

SEQ ID NO: 92073 - protein, 13 aa, Borrelia burgdorferi B31
NKKLGLVIPKAEK

SEQ ID NO: 92074 - protein, 13 aa, Borrelia burgdorferi B31
KKLGLVIPKAEKN

SEQ ID NO: 92075 - protein, 13 aa, Borrelia burgdorferi B31
KLGLVIPKAEKNL

SEQ ID NO: 92076 - protein, 13 aa, Borrelia burgdorferi B31
LGLVIPKAEKNLH

SEQ ID NO: 92077 - protein, 13 aa, Borrelia burgdorferi B31
GLVIPKAEKNLHI

SEQ ID NO: 92078 - protein, 13 aa, Borrelia burgdorferi B31
LVIPKAEKNLHIK

SEQ ID NO: 92079 - protein, 13 aa, Borrelia burgdorferi B31
VIPKAEKNLHIKL

SEQ ID NO: 92080 - protein, 13 aa, Borrelia burgdorferi B31
IPKAEKNLHIKLD

SEQ ID NO: 92081 - protein, 13 aa, Borrelia burgdorferi B31
PKAEKNLHIKLDE

SEQ ID NO: 92082 - protein, 13 aa, Borrelia burgdorferi B31
KAEKNLHIKLDEN

SEQ ID NO: 92083 - protein, 13 aa, Borrelia burgdorferi B31
AEKNLHIKLDENL

SEQ ID NO: 92084 - protein, 13 aa, Borrelia burgdorferi B31
EKNLHIKLDENLI

SEQ ID NO: 92085 - protein, 13 aa, Borrelia burgdorferi B31
KNLHIKLDENLIK

SEQ ID NO: 92086 - protein, 13 aa, Borrelia burgdorferi B31
NLHIKLDENLIKK

SEQ ID NO: 92087 - protein, 13 aa, Borrelia burgdorferi B31
LHIKLDENLIKKI

SEQ ID NO: 92088 - protein, 13 aa, Borrelia burgdorferi B31
HIKLDENLIKKIK

SEQ ID NO: 92089 - protein, 13 aa, Borrelia burgdorferi B31
IKLDENLIKKIKN

SEQ ID NO: 92090 - protein, 13 aa, Borrelia burgdorferi B31
KLDENLIKKIKNQ

SEQ ID NO: 92091 - protein, 13 aa, Borrelia burgdorferi B31
LDENLIKKIKNQT

SEQ ID NO: 92092 - protein, 14 aa, Borrelia burgdorferi B31
MIKMSLNYTEINTL

SEQ ID NO: 92093 - protein, 14 aa, Borrelia burgdorferi B31
IKMSLNYTEINTLI

SEQ ID NO: 92094 - protein, 14 aa, Borrelia burgdorferi B31
KMSLNYTEINTLIK

SEQ ID NO: 92095 - protein, 14 aa, Borrelia burgdorferi B31
MSLNYTEINTLIKE

SEQ ID NO: 92096 - protein, 14 aa, Borrelia burgdorferi B31
SLNYTEINTLIKEI

SEQ ID NO: 92097 - protein, 14 aa, Borrelia burgdorferi B31
LNYTEINTLIKEIP

SEQ ID NO: 92098 - protein, 14 aa, Borrelia burgdorferi B31
NYTEINTLIKEIPF

SEQ ID NO: 92099 - protein, 14 aa, Borrelia burgdorferi B31
YTEINTLIKEIPFT

SEQ ID NO: 92100 - protein, 14 aa, Borrelia burgdorferi B31
TEINTLIKEIPFTN

SEQ ID NO: 92101 - protein, 14 aa, Borrelia burgdorferi B31
EINTLIKEIPFTNS

SEQ ID NO: 92102 - protein, 14 aa, Borrelia burgdorferi B31
INTLIKEIPFTNSL

SEQ ID NO: 92103 - protein, 14 aa, Borrelia burgdorferi B31
NTLIKEIPFTNSLI

SEQ ID NO: 92104 - protein, 14 aa, Borrelia burgdorferi B31
TLIKEIPFTNSLIT

SEQ ID NO: 92105 - protein, 14 aa, Borrelia burgdorferi B31
LIKEIPFTNSLITK

SEQ ID NO: 92106 - protein, 14 aa, Borrelia burgdorferi B31
IKEIPFTNSLITKI

SEQ ID NO: 92107 - protein, 14 aa, Borrelia burgdorferi B31
KEIPFTNSLITKII

SEQ ID NO: 92108 - protein, 14 aa, Borrelia burgdorferi B31
EIPFTNSLITKIIQ

SEQ ID NO: 92109 - protein, 14 aa, Borrelia burgdorferi B31
IPFTNSLITKIIQP

SEQ ID NO: 92110 - protein, 14 aa, Borrelia burgdorferi B31
PFTNSLITKIIQPD

SEQ ID NO: 92111 - protein, 14 aa, Borrelia burgdorferi B31
FTNSLITKIIQPDY

SEQ ID NO: 92112 - protein, 14 aa, Borrelia burgdorferi B31
TNSLITKIIQPDYK

SEQ ID NO: 92113 - protein, 14 aa, Borrelia burgdorferi B31
NSLITKIIQPDYKS

SEQ ID NO: 92114 - protein, 14 aa, Borrelia burgdorferi B31
SLITKIIQPDYKSL

SEQ ID NO: 92115 - protein, 14 aa, Borrelia burgdorferi B31
LITKIIQPDYKSLV

SEQ ID NO: 92116 - protein, 14 aa, Borrelia burgdorferi B31
ITKIIQPDYKSLVL

SEQ ID NO: 92117 - protein, 14 aa, Borrelia burgdorferi B31
TKIIQPDYKSLVLE

SEQ ID NO: 92118 - protein, 14 aa, Borrelia burgdorferi B31
KIIQPDYKSLVLEI

SEQ ID NO: 92119 - protein, 14 aa, Borrelia burgdorferi B31
IIQPDYKSLVLEIY

SEQ ID NO: 92120 - protein, 14 aa, Borrelia burgdorferi B31
IQPDYKSLVLEIYN

SEQ ID NO: 92121 - protein, 14 aa, Borrelia burgdorferi B31
QPDYKSLVLEIYNK

SEQ ID NO: 92122 - protein, 14 aa, Borrelia burgdorferi B31
PDYKSLVLEIYNKI

SEQ ID NO: 92123 - protein, 14 aa, Borrelia burgdorferi B31
DYKSLVLEIYNKID

SEQ ID NO: 92124 - protein, 14 aa, Borrelia burgdorferi B31
YKSLVLEIYNKIDN

SEQ ID NO: 92125 - protein, 14 aa, Borrelia burgdorferi B31
KSLVLEIYNKIDNK

SEQ ID NO: 92126 - protein, 14 aa, Borrelia burgdorferi B31
SLVLEIYNKIDNKK

SEQ ID NO: 92127 - protein, 14 aa, Borrelia burgdorferi B31
LVLEIYNKIDNKKF

SEQ ID NO: 92128 - protein, 14 aa, Borrelia burgdorferi B31
VLEIYNKIDNKKFK

SEQ ID NO: 92129 - protein, 14 aa, Borrelia burgdorferi B31
LEIYNKIDNKKFKI

SEQ ID NO: 92130 - protein, 14 aa, Borrelia burgdorferi B31
EIYNKIDNKKFKIL

SEQ ID NO: 92131 - protein, 14 aa, Borrelia burgdorferi B31
IYNKIDNKKFKILI

SEQ ID NO: 92132 - protein, 14 aa, Borrelia burgdorferi B31
YNKIDNKKFKILIC

SEQ ID NO: 92133 - protein, 14 aa, Borrelia burgdorferi B31
NKIDNKKFKILICL

SEQ ID NO: 92134 - protein, 14 aa, Borrelia burgdorferi B31
KIDNKKFKILICLN

SEQ ID NO: 92135 - protein, 14 aa, Borrelia burgdorferi B31
IDNKKFKILICLNP

SEQ ID NO: 92136 - protein, 14 aa, Borrelia burgdorferi B31
DNKKFKILICLNPN

SEQ ID NO: 92137 - protein, 14 aa, Borrelia burgdorferi B31
NKKFKILICLNPNT

SEQ ID NO: 92138 - protein, 14 aa, Borrelia burgdorferi B31
KKFKILICLNPNTT

SEQ ID NO: 92139 - protein, 14 aa, Borrelia burgdorferi B31
KFKILICLNPNTTR

SEQ ID NO: 92140 - protein, 14 aa, Borrelia burgdorferi B31
FKILICLNPNTTRF

SEQ ID NO: 92141 - protein, 14 aa, Borrelia burgdorferi B31
KILICLNPNTTRFH

SEQ ID NO: 92142 - protein, 14 aa, Borrelia burgdorferi B31
ILICLNPNTTRFHI

SEQ ID NO: 92143 - protein, 14 aa, Borrelia burgdorferi B31
LICLNPNTTRFHIT

SEQ ID NO: 92144 - protein, 14 aa, Borrelia burgdorferi B31
ICLNPNTTRFHITK

SEQ ID NO: 92145 - protein, 14 aa, Borrelia burgdorferi B31
CLNPNTTRFHITKK

SEQ ID NO: 92146 - protein, 14 aa, Borrelia burgdorferi B31
LNPNTTRFHITKKN

SEQ ID NO: 92147 - protein, 14 aa, Borrelia burgdorferi B31
NPNTTRFHITKKNF

SEQ ID NO: 92148 - protein, 14 aa, Borrelia burgdorferi B31
PNTTRFHITKKNFK

SEQ ID NO: 92149 - protein, 14 aa, Borrelia burgdorferi B31
NTTRFHITKKNFKK

SEQ ID NO: 92150 - protein, 14 aa, Borrelia burgdorferi B31
TTRFHITKKNFKKN

SEQ ID NO: 92151 - protein, 14 aa, Borrelia burgdorferi B31
TRFHITKKNFKKNA

SEQ ID NO: 92152 - protein, 14 aa, Borrelia burgdorferi B31
RFHITKKNFKKNAL

SEQ ID NO: 92153 - protein, 14 aa, Borrelia burgdorferi B31
FHITKKNFKKNALK

SEQ ID NO: 92154 - protein, 14 aa, Borrelia burgdorferi B31
HITKKNFKKNALKL

SEQ ID NO: 92155 - protein, 14 aa, Borrelia burgdorferi B31
ITKKNFKKNALKLR

SEQ ID NO: 92156 - protein, 14 aa, Borrelia burgdorferi B31
TKKNFKKNALKLRF

SEQ ID NO: 92157 - protein, 14 aa, Borrelia burgdorferi B31
KKNFKKNALKLRFS

SEQ ID NO: 92158 - protein, 14 aa, Borrelia burgdorferi B31
KNFKKNALKLRFSD

SEQ ID NO: 92159 - protein, 14 aa, Borrelia burgdorferi B31
NFKKNALKLRFSDF

SEQ ID NO: 92160 - protein, 14 aa, Borrelia burgdorferi B31
FKKNALKLRFSDFL

SEQ ID NO: 92161 - protein, 14 aa, Borrelia burgdorferi B31
KKNALKLRFSDFLK

SEQ ID NO: 92162 - protein, 14 aa, Borrelia burgdorferi B31
KNALKLRFSDFLKS

SEQ ID NO: 92163 - protein, 14 aa, Borrelia burgdorferi B31
NALKLRFSDFLKSK

SEQ ID NO: 92164 - protein, 14 aa, Borrelia burgdorferi B31
ALKLRFSDFLKSKI

SEQ ID NO: 92165 - protein, 14 aa, Borrelia burgdorferi B31
LKLRFSDFLKSKIQ

SEQ ID NO: 92166 - protein, 14 aa, Borrelia burgdorferi B31
KLRFSDFLKSKIQN

SEQ ID NO: 92167 - protein, 14 aa, Borrelia burgdorferi B31
LRFSDFLKSKIQNG

SEQ ID NO: 92168 - protein, 14 aa, Borrelia burgdorferi B31
RFSDFLKSKIQNGK

SEQ ID NO: 92169 - protein, 14 aa, Borrelia burgdorferi B31
FSDFLKSKIQNGKI

SEQ ID NO: 92170 - protein, 14 aa, Borrelia burgdorferi B31
SDFLKSKIQNGKII

SEQ ID NO: 92171 - protein, 14 aa, Borrelia burgdorferi B31
DFLKSKIQNGKIIK

SEQ ID NO: 92172 - protein, 14 aa, Borrelia burgdorferi B31
FLKSKIQNGKIIKA

SEQ ID NO: 92173 - protein, 14 aa, Borrelia burgdorferi B31
LKSKIQNGKIIKAF

SEQ ID NO: 92174 - protein, 14 aa, Borrelia burgdorferi B31
KSKIQNGKIIKAFQ

SEQ ID NO: 92175 - protein, 14 aa, Borrelia burgdorferi B31
SKIQNGKIIKAFQM

SEQ ID NO: 92176 - protein, 14 aa, Borrelia burgdorferi B31
KIQNGKIIKAFQMK

SEQ ID NO: 92177 - protein, 14 aa, Borrelia burgdorferi B31
IQNGKIIKAFQMKN

SEQ ID NO: 92178 - protein, 14 aa, Borrelia burgdorferi B31
QNGKIIKAFQMKNE

SEQ ID NO: 92179 - protein, 14 aa, Borrelia burgdorferi B31
NGKIIKAFQMKNER

SEQ ID NO: 92180 - protein, 14 aa, Borrelia burgdorferi B31
GKIIKAFQMKNERI

SEQ ID NO: 92181 - protein, 14 aa, Borrelia burgdorferi B31
KIIKAFQMKNERII

SEQ ID NO: 92182 - protein, 14 aa, Borrelia burgdorferi B31
IIKAFQMKNERIIS

SEQ ID NO: 92183 - protein, 14 aa, Borrelia burgdorferi B31
IKAFQMKNERIISL

SEQ ID NO: 92184 - protein, 14 aa, Borrelia burgdorferi B31
KAFQMKNERIISLE

SEQ ID NO: 92185 - protein, 14 aa, Borrelia burgdorferi B31
AFQMKNERIISLEI

SEQ ID NO: 92186 - protein, 14 aa, Borrelia burgdorferi B31
FQMKNERIISLEIL

SEQ ID NO: 92187 - protein, 14 aa, Borrelia burgdorferi B31
QMKNERIISLEILQ

SEQ ID NO: 92188 - protein, 14 aa, Borrelia burgdorferi B31
MKNERIISLEILQK

SEQ ID NO: 92189 - protein, 14 aa, Borrelia burgdorferi B31
KNERIISLEILQKD

SEQ ID NO: 92190 - protein, 14 aa, Borrelia burgdorferi B31
NERIISLEILQKDM

SEQ ID NO: 92191 - protein, 14 aa, Borrelia burgdorferi B31
ERIISLEILQKDMI

SEQ ID NO: 92192 - protein, 14 aa, Borrelia burgdorferi B31
RIISLEILQKDMII

SEQ ID NO: 92193 - protein, 14 aa, Borrelia burgdorferi B31
IISLEILQKDMIIL

SEQ ID NO: 92194 - protein, 14 aa, Borrelia burgdorferi B31
ISLEILQKDMIILF

SEQ ID NO: 92195 - protein, 14 aa, Borrelia burgdorferi B31
SLEILQKDMIILFI

SEQ ID NO: 92196 - protein, 14 aa, Borrelia burgdorferi B31
LEILQKDMIILFIK

SEQ ID NO: 92197 - protein, 14 aa, Borrelia burgdorferi B31
EILQKDMIILFIKL

SEQ ID NO: 92198 - protein, 14 aa, Borrelia burgdorferi B31
ILQKDMIILFIKLW

SEQ ID NO: 92199 - protein, 14 aa, Borrelia burgdorferi B31
LQKDMIILFIKLWP

SEQ ID NO: 92200 - protein, 14 aa, Borrelia burgdorferi B31
QKDMIILFIKLWPS

SEQ ID NO: 92201 - protein, 14 aa, Borrelia burgdorferi B31
KDMIILFIKLWPSS

SEQ ID NO: 92202 - protein, 14 aa, Borrelia burgdorferi B31
DMIILFIKLWPSSP

SEQ ID NO: 92203 - protein, 14 aa, Borrelia burgdorferi B31
MIILFIKLWPSSPN

SEQ ID NO: 92204 - protein, 14 aa, Borrelia burgdorferi B31
IILFIKLWPSSPNI

SEQ ID NO: 92205 - protein, 14 aa, Borrelia burgdorferi B31
ILFIKLWPSSPNII

SEQ ID NO: 92206 - protein, 14 aa, Borrelia burgdorferi B31
LFIKLWPSSPNIIA

SEQ ID NO: 92207 - protein, 14 aa, Borrelia burgdorferi B31
FIKLWPSSPNIIAT

SEQ ID NO: 92208 - protein, 14 aa, Borrelia burgdorferi B31
IKLWPSSPNIIATN

SEQ ID NO: 92209 - protein, 14 aa, Borrelia burgdorferi B31
KLWPSSPNIIATNS

SEQ ID NO: 92210 - protein, 14 aa, Borrelia burgdorferi B31
LWPSSPNIIATNSN

SEQ ID NO: 92211 - protein, 14 aa, Borrelia burgdorferi B31
WPSSPNIIATNSNF

SEQ ID NO: 92212 - protein, 14 aa, Borrelia burgdorferi B31
PSSPNIIATNSNFK

SEQ ID NO: 92213 - protein, 14 aa, Borrelia burgdorferi B31
SSPNIIATNSNFKI

SEQ ID NO: 92214 - protein, 14 aa, Borrelia burgdorferi B31
SPNIIATNSNFKIL

SEQ ID NO: 92215 - protein, 14 aa, Borrelia burgdorferi B31
PNIIATNSNFKILD

SEQ ID NO: 92216 - protein, 14 aa, Borrelia burgdorferi B31
NIIATNSNFKILDA

SEQ ID NO: 92217 - protein, 14 aa, Borrelia burgdorferi B31
IIATNSNFKILDAY

SEQ ID NO: 92218 - protein, 14 aa, Borrelia burgdorferi B31
IATNSNFKILDAYY

SEQ ID NO: 92219 - protein, 14 aa, Borrelia burgdorferi B31
ATNSNFKILDAYYR

SEQ ID NO: 92220 - protein, 14 aa, Borrelia burgdorferi B31
TNSNFKILDAYYRR

SEQ ID NO: 92221 - protein, 14 aa, Borrelia burgdorferi B31
NSNFKILDAYYRRP

SEQ ID NO: 92222 - protein, 14 aa, Borrelia burgdorferi B31
SNFKILDAYYRRPK

SEQ ID NO: 92223 - protein, 14 aa, Borrelia burgdorferi B31
NFKILDAYYRRPKI

SEQ ID NO: 92224 - protein, 14 aa, Borrelia burgdorferi B31
FKILDAYYRRPKIK

SEQ ID NO: 92225 - protein, 14 aa, Borrelia burgdorferi B31
KILDAYYRRPKIKE

SEQ ID NO: 92226 - protein, 14 aa, Borrelia burgdorferi B31
ILDAYYRRPKIKET

SEQ ID NO: 92227 - protein, 14 aa, Borrelia burgdorferi B31
LDAYYRRPKIKETT

SEQ ID NO: 92228 - protein, 14 aa, Borrelia burgdorferi B31
DAYYRRPKIKETTG

SEQ ID NO: 92229 - protein, 14 aa, Borrelia burgdorferi B31
AYYRRPKIKETTGE

SEQ ID NO: 92230 - protein, 14 aa, Borrelia burgdorferi B31
YYRRPKIKETTGEI

SEQ ID NO: 92231 - protein, 14 aa, Borrelia burgdorferi B31
YRRPKIKETTGEIF

SEQ ID NO: 92232 - protein, 14 aa, Borrelia burgdorferi B31
RRPKIKETTGEIFL

SEQ ID NO: 92233 - protein, 14 aa, Borrelia burgdorferi B31
RPKIKETTGEIFLK

SEQ ID NO: 92234 - protein, 14 aa, Borrelia burgdorferi B31
PKIKETTGEIFLKA

SEQ ID NO: 92235 - protein, 14 aa, Borrelia burgdorferi B31
KIKETTGEIFLKAK

SEQ ID NO: 92236 - protein, 14 aa, Borrelia burgdorferi B31
IKETTGEIFLKAKE

SEQ ID NO: 92237 - protein, 14 aa, Borrelia burgdorferi B31
KETTGEIFLKAKEI

SEQ ID NO: 92238 - protein, 14 aa, Borrelia burgdorferi B31
ETTGEIFLKAKEIH

SEQ ID NO: 92239 - protein, 14 aa, Borrelia burgdorferi B31
TTGEIFLKAKEIHE

SEQ ID NO: 92240 - protein, 14 aa, Borrelia burgdorferi B31
TGEIFLKAKEIHES

SEQ ID NO: 92241 - protein, 14 aa, Borrelia burgdorferi B31
GEIFLKAKEIHESN

SEQ ID NO: 92242 - protein, 14 aa, Borrelia burgdorferi B31
EIFLKAKEIHESNK

SEQ ID NO: 92243 - protein, 14 aa, Borrelia burgdorferi B31
IFLKAKEIHESNKM

SEQ ID NO: 92244 - protein, 14 aa, Borrelia burgdorferi B31
FLKAKEIHESNKMS

SEQ ID NO: 92245 - protein, 14 aa, Borrelia burgdorferi B31
LKAKEIHESNKMSD

SEQ ID NO: 92246 - protein, 14 aa, Borrelia burgdorferi B31
KAKEIHESNKMSDK

SEQ ID NO: 92247 - protein, 14 aa, Borrelia burgdorferi B31
AKEIHESNKMSDKK

SEQ ID NO: 92248 - protein, 14 aa, Borrelia burgdorferi B31
KEIHESNKMSDKKI

SEQ ID NO: 92249 - protein, 14 aa, Borrelia burgdorferi B31
EIHESNKMSDKKIM

SEQ ID NO: 92250 - protein, 14 aa, Borrelia burgdorferi B31
IHESNKMSDKKIME

SEQ ID NO: 92251 - protein, 14 aa, Borrelia burgdorferi B31
HESNKMSDKKIMEL

SEQ ID NO: 92252 - protein, 14 aa, Borrelia burgdorferi B31
ESNKMSDKKIMELK

SEQ ID NO: 92253 - protein, 14 aa, Borrelia burgdorferi B31
SNKMSDKKIMELKE

SEQ ID NO: 92254 - protein, 14 aa, Borrelia burgdorferi B31
NKMSDKKIMELKEE

SEQ ID NO: 92255 - protein, 14 aa, Borrelia burgdorferi B31
KMSDKKIMELKEEY

SEQ ID NO: 92256 - protein, 14 aa, Borrelia burgdorferi B31
MSDKKIMELKEEYN

SEQ ID NO: 92257 - protein, 14 aa, Borrelia burgdorferi B31
SDKKIMELKEEYNN

SEQ ID NO: 92258 - protein, 14 aa, Borrelia burgdorferi B31
DKKIMELKEEYNNT

SEQ ID NO: 92259 - protein, 14 aa, Borrelia burgdorferi B31
KKIMELKEEYNNTS

SEQ ID NO: 92260 - protein, 14 aa, Borrelia burgdorferi B31
KIMELKEEYNNTSY

SEQ ID NO: 92261 - protein, 14 aa, Borrelia burgdorferi B31
IMELKEEYNNTSYT

SEQ ID NO: 92262 - protein, 14 aa, Borrelia burgdorferi B31
MELKEEYNNTSYTS

SEQ ID NO: 92263 - protein, 14 aa, Borrelia burgdorferi B31
ELKEEYNNTSYTSY

SEQ ID NO: 92264 - protein, 14 aa, Borrelia burgdorferi B31
LKEEYNNTSYTSYS

SEQ ID NO: 92265 - protein, 14 aa, Borrelia burgdorferi B31
KEEYNNTSYTSYSE

SEQ ID NO: 92266 - protein, 14 aa, Borrelia burgdorferi B31
EEYNNTSYTSYSEF

SEQ ID NO: 92267 - protein, 14 aa, Borrelia burgdorferi B31
EYNNTSYTSYSEFL

SEQ ID NO: 92268 - protein, 14 aa, Borrelia burgdorferi B31
YNNTSYTSYSEFLE

SEQ ID NO: 92269 - protein, 14 aa, Borrelia burgdorferi B31
NNTSYTSYSEFLEN

SEQ ID NO: 92270 - protein, 14 aa, Borrelia burgdorferi B31
NTSYTSYSEFLENY

SEQ ID NO: 92271 - protein, 14 aa, Borrelia burgdorferi B31
TSYTSYSEFLENYY

SEQ ID NO: 92272 - protein, 14 aa, Borrelia burgdorferi B31
SYTSYSEFLENYYE

SEQ ID NO: 92273 - protein, 14 aa, Borrelia burgdorferi B31
YTSYSEFLENYYES

SEQ ID NO: 92274 - protein, 14 aa, Borrelia burgdorferi B31
TSYSEFLENYYESL

SEQ ID NO: 92275 - protein, 14 aa, Borrelia burgdorferi B31
SYSEFLENYYESLN

SEQ ID NO: 92276 - protein, 14 aa, Borrelia burgdorferi B31
YSEFLENYYESLND

SEQ ID NO: 92277 - protein, 14 aa, Borrelia burgdorferi B31
SEFLENYYESLNDQ

SEQ ID NO: 92278 - protein, 14 aa, Borrelia burgdorferi B31
EFLENYYESLNDQI

SEQ ID NO: 92279 - protein, 14 aa, Borrelia burgdorferi B31
FLENYYESLNDQIK

SEQ ID NO: 92280 - protein, 14 aa, Borrelia burgdorferi B31
LENYYESLNDQIKK

SEQ ID NO: 92281 - protein, 14 aa, Borrelia burgdorferi B31
ENYYESLNDQIKKT

SEQ ID NO: 92282 - protein, 14 aa, Borrelia burgdorferi B31
NYYESLNDQIKKTN

SEQ ID NO: 92283 - protein, 14 aa, Borrelia burgdorferi B31
YYESLNDQIKKTNI

SEQ ID NO: 92284 - protein, 14 aa, Borrelia burgdorferi B31
YESLNDQIKKTNIK

SEQ ID NO: 92285 - protein, 14 aa, Borrelia burgdorferi B31
ESLNDQIKKTNIKE

SEQ ID NO: 92286 - protein, 14 aa, Borrelia burgdorferi B31
SLNDQIKKTNIKEL

SEQ ID NO: 92287 - protein, 14 aa, Borrelia burgdorferi B31
LNDQIKKTNIKELL

SEQ ID NO: 92288 - protein, 14 aa, Borrelia burgdorferi B31
NDQIKKTNIKELLI

SEQ ID NO: 92289 - protein, 14 aa, Borrelia burgdorferi B31
DQIKKTNIKELLIE

SEQ ID NO: 92290 - protein, 14 aa, Borrelia burgdorferi B31
QIKKTNIKELLIEK

SEQ ID NO: 92291 - protein, 14 aa, Borrelia burgdorferi B31
IKKTNIKELLIEKY

SEQ ID NO: 92292 - protein, 14 aa, Borrelia burgdorferi B31
KKTNIKELLIEKYK

SEQ ID NO: 92293 - protein, 14 aa, Borrelia burgdorferi B31
KTNIKELLIEKYKK

SEQ ID NO: 92294 - protein, 14 aa, Borrelia burgdorferi B31
TNIKELLIEKYKKE

SEQ ID NO: 92295 - protein, 14 aa, Borrelia burgdorferi B31
NIKELLIEKYKKEL

SEQ ID NO: 92296 - protein, 14 aa, Borrelia burgdorferi B31
IKELLIEKYKKELI

SEQ ID NO: 92297 - protein, 14 aa, Borrelia burgdorferi B31
KELLIEKYKKELIV

SEQ ID NO: 92298 - protein, 14 aa, Borrelia burgdorferi B31
ELLIEKYKKELIVL

SEQ ID NO: 92299 - protein, 14 aa, Borrelia burgdorferi B31
LLIEKYKKELIVLE

SEQ ID NO: 92300 - protein, 14 aa, Borrelia burgdorferi B31
LIEKYKKELIVLEK

SEQ ID NO: 92301 - protein, 14 aa, Borrelia burgdorferi B31
IEKYKKELIVLEKR

SEQ ID NO: 92302 - protein, 14 aa, Borrelia burgdorferi B31
EKYKKELIVLEKRI

SEQ ID NO: 92303 - protein, 14 aa, Borrelia burgdorferi B31
KYKKELIVLEKRID

SEQ ID NO: 92304 - protein, 14 aa, Borrelia burgdorferi B31
YKKELIVLEKRIDS

SEQ ID NO: 92305 - protein, 14 aa, Borrelia burgdorferi B31
KKELIVLEKRIDSL

SEQ ID NO: 92306 - protein, 14 aa, Borrelia burgdorferi B31
KELIVLEKRIDSLK

SEQ ID NO: 92307 - protein, 14 aa, Borrelia burgdorferi B31
ELIVLEKRIDSLKQ

SEQ ID NO: 92308 - protein, 14 aa, Borrelia burgdorferi B31
LIVLEKRIDSLKQQ

SEQ ID NO: 92309 - protein, 14 aa, Borrelia burgdorferi B31
IVLEKRIDSLKQQI

SEQ ID NO: 92310 - protein, 14 aa, Borrelia burgdorferi B31
VLEKRIDSLKQQIK

SEQ ID NO: 92311 - protein, 14 aa, Borrelia burgdorferi B31
LEKRIDSLKQQIKL

SEQ ID NO: 92312 - protein, 14 aa, Borrelia burgdorferi B31
EKRIDSLKQQIKLL

SEQ ID NO: 92313 - protein, 14 aa, Borrelia burgdorferi B31
KRIDSLKQQIKLLE

SEQ ID NO: 92314 - protein, 14 aa, Borrelia burgdorferi B31
RIDSLKQQIKLLEN

SEQ ID NO: 92315 - protein, 14 aa, Borrelia burgdorferi B31
IDSLKQQIKLLENI

SEQ ID NO: 92316 - protein, 14 aa, Borrelia burgdorferi B31
DSLKQQIKLLENIE

SEQ ID NO: 92317 - protein, 14 aa, Borrelia burgdorferi B31
SLKQQIKLLENIEN

SEQ ID NO: 92318 - protein, 14 aa, Borrelia burgdorferi B31
LKQQIKLLENIENE

SEQ ID NO: 92319 - protein, 14 aa, Borrelia burgdorferi B31
KQQIKLLENIENEK

SEQ ID NO: 92320 - protein, 14 aa, Borrelia burgdorferi B31
QQIKLLENIENEKE

SEQ ID NO: 92321 - protein, 14 aa, Borrelia burgdorferi B31
QIKLLENIENEKEK

SEQ ID NO: 92322 - protein, 14 aa, Borrelia burgdorferi B31
IKLLENIENEKEKG

SEQ ID NO: 92323 - protein, 14 aa, Borrelia burgdorferi B31
KLLENIENEKEKGE

SEQ ID NO: 92324 - protein, 14 aa, Borrelia burgdorferi B31
LLENIENEKEKGEL

SEQ ID NO: 92325 - protein, 14 aa, Borrelia burgdorferi B31
LENIENEKEKGELI

SEQ ID NO: 92326 - protein, 14 aa, Borrelia burgdorferi B31
ENIENEKEKGELIL

SEQ ID NO: 92327 - protein, 14 aa, Borrelia burgdorferi B31
NIENEKEKGELILL

SEQ ID NO: 92328 - protein, 14 aa, Borrelia burgdorferi B31
IENEKEKGELILLN

SEQ ID NO: 92329 - protein, 14 aa, Borrelia burgdorferi B31
ENEKEKGELILLNI

SEQ ID NO: 92330 - protein, 14 aa, Borrelia burgdorferi B31
NEKEKGELILLNIN

SEQ ID NO: 92331 - protein, 14 aa, Borrelia burgdorferi B31
EKEKGELILLNINK

SEQ ID NO: 92332 - protein, 14 aa, Borrelia burgdorferi B31
KEKGELILLNINKI

SEQ ID NO: 92333 - protein, 14 aa, Borrelia burgdorferi B31
EKGELILLNINKIQ

SEQ ID NO: 92334 - protein, 14 aa, Borrelia burgdorferi B31
KGELILLNINKIQK

SEQ ID NO: 92335 - protein, 14 aa, Borrelia burgdorferi B31
GELILLNINKIQKG

SEQ ID NO: 92336 - protein, 14 aa, Borrelia burgdorferi B31
ELILLNINKIQKGI

SEQ ID NO: 92337 - protein, 14 aa, Borrelia burgdorferi B31
LILLNINKIQKGIK

SEQ ID NO: 92338 - protein, 14 aa, Borrelia burgdorferi B31
ILLNINKIQKGIKE

SEQ ID NO: 92339 - protein, 14 aa, Borrelia burgdorferi B31
LLNINKIQKGIKEI

SEQ ID NO: 92340 - protein, 14 aa, Borrelia burgdorferi B31
LNINKIQKGIKEIN

SEQ ID NO: 92341 - protein, 14 aa, Borrelia burgdorferi B31
NINKIQKGIKEINL

SEQ ID NO: 92342 - protein, 14 aa, Borrelia burgdorferi B31
INKIQKGIKEINLL

SEQ ID NO: 92343 - protein, 14 aa, Borrelia burgdorferi B31
NKIQKGIKEINLLN

SEQ ID NO: 92344 - protein, 14 aa, Borrelia burgdorferi B31
KIQKGIKEINLLNY

SEQ ID NO: 92345 - protein, 14 aa, Borrelia burgdorferi B31
IQKGIKEINLLNYK

SEQ ID NO: 92346 - protein, 14 aa, Borrelia burgdorferi B31
QKGIKEINLLNYKE

SEQ ID NO: 92347 - protein, 14 aa, Borrelia burgdorferi B31
KGIKEINLLNYKEE

SEQ ID NO: 92348 - protein, 14 aa, Borrelia burgdorferi B31
GIKEINLLNYKEEK

SEQ ID NO: 92349 - protein, 14 aa, Borrelia burgdorferi B31
IKEINLLNYKEEKI

SEQ ID NO: 92350 - protein, 14 aa, Borrelia burgdorferi B31
KEINLLNYKEEKIK

SEQ ID NO: 92351 - protein, 14 aa, Borrelia burgdorferi B31
EINLLNYKEEKIKI

SEQ ID NO: 92352 - protein, 14 aa, Borrelia burgdorferi B31
INLLNYKEEKIKIS

SEQ ID NO: 92353 - protein, 14 aa, Borrelia burgdorferi B31
NLLNYKEEKIKISL

SEQ ID NO: 92354 - protein, 14 aa, Borrelia burgdorferi B31
LLNYKEEKIKISLN

SEQ ID NO: 92355 - protein, 14 aa, Borrelia burgdorferi B31
LNYKEEKIKISLNQ

SEQ ID NO: 92356 - protein, 14 aa, Borrelia burgdorferi B31
NYKEEKIKISLNQS

SEQ ID NO: 92357 - protein, 14 aa, Borrelia burgdorferi B31
YKEEKIKISLNQSL

SEQ ID NO: 92358 - protein, 14 aa, Borrelia burgdorferi B31
KEEKIKISLNQSLS

SEQ ID NO: 92359 - protein, 14 aa, Borrelia burgdorferi B31
EEKIKISLNQSLSP

SEQ ID NO: 92360 - protein, 14 aa, Borrelia burgdorferi B31
EKIKISLNQSLSPK

SEQ ID NO: 92361 - protein, 14 aa, Borrelia burgdorferi B31
KIKISLNQSLSPKE

SEQ ID NO: 92362 - protein, 14 aa, Borrelia burgdorferi B31
IKISLNQSLSPKEN

SEQ ID NO: 92363 - protein, 14 aa, Borrelia burgdorferi B31
KISLNQSLSPKENA

SEQ ID NO: 92364 - protein, 14 aa, Borrelia burgdorferi B31
ISLNQSLSPKENAL

SEQ ID NO: 92365 - protein, 14 aa, Borrelia burgdorferi B31
SLNQSLSPKENALQ

SEQ ID NO: 92366 - protein, 14 aa, Borrelia burgdorferi B31
LNQSLSPKENALQY

SEQ ID NO: 92367 - protein, 14 aa, Borrelia burgdorferi B31
NQSLSPKENALQYF

SEQ ID NO: 92368 - protein, 14 aa, Borrelia burgdorferi B31
QSLSPKENALQYFK

SEQ ID NO: 92369 - protein, 14 aa, Borrelia burgdorferi B31
SLSPKENALQYFKA

SEQ ID NO: 92370 - protein, 14 aa, Borrelia burgdorferi B31
LSPKENALQYFKAY

SEQ ID NO: 92371 - protein, 14 aa, Borrelia burgdorferi B31
SPKENALQYFKAYK

SEQ ID NO: 92372 - protein, 14 aa, Borrelia burgdorferi B31
PKENALQYFKAYKK

SEQ ID NO: 92373 - protein, 14 aa, Borrelia burgdorferi B31
KENALQYFKAYKKG

SEQ ID NO: 92374 - protein, 14 aa, Borrelia burgdorferi B31
ENALQYFKAYKKGK

SEQ ID NO: 92375 - protein, 14 aa, Borrelia burgdorferi B31
NALQYFKAYKKGKN

SEQ ID NO: 92376 - protein, 14 aa, Borrelia burgdorferi B31
ALQYFKAYKKGKNS

SEQ ID NO: 92377 - protein, 14 aa, Borrelia burgdorferi B31
LQYFKAYKKGKNSF

SEQ ID NO: 92378 - protein, 14 aa, Borrelia burgdorferi B31
QYFKAYKKGKNSFK

SEQ ID NO: 92379 - protein, 14 aa, Borrelia burgdorferi B31
YFKAYKKGKNSFKT

SEQ ID NO: 92380 - protein, 14 aa, Borrelia burgdorferi B31
FKAYKKGKNSFKTI

SEQ ID NO: 92381 - protein, 14 aa, Borrelia burgdorferi B31
KAYKKGKNSFKTIQ

SEQ ID NO: 92382 - protein, 14 aa, Borrelia burgdorferi B31
AYKKGKNSFKTIQN

SEQ ID NO: 92383 - protein, 14 aa, Borrelia burgdorferi B31
YKKGKNSFKTIQNQ

SEQ ID NO: 92384 - protein, 14 aa, Borrelia burgdorferi B31
KKGKNSFKTIQNQL

SEQ ID NO: 92385 - protein, 14 aa, Borrelia burgdorferi B31
KGKNSFKTIQNQLK

SEQ ID NO: 92386 - protein, 14 aa, Borrelia burgdorferi B31
GKNSFKTIQNQLKD

SEQ ID NO: 92387 - protein, 14 aa, Borrelia burgdorferi B31
KNSFKTIQNQLKDN

SEQ ID NO: 92388 - protein, 14 aa, Borrelia burgdorferi B31
NSFKTIQNQLKDNL

SEQ ID NO: 92389 - protein, 14 aa, Borrelia burgdorferi B31
SFKTIQNQLKDNLD

SEQ ID NO: 92390 - protein, 14 aa, Borrelia burgdorferi B31
FKTIQNQLKDNLDK

SEQ ID NO: 92391 - protein, 14 aa, Borrelia burgdorferi B31
KTIQNQLKDNLDKF

SEQ ID NO: 92392 - protein, 14 aa, Borrelia burgdorferi B31
TIQNQLKDNLDKFN

SEQ ID NO: 92393 - protein, 14 aa, Borrelia burgdorferi B31
IQNQLKDNLDKFNL

SEQ ID NO: 92394 - protein, 14 aa, Borrelia burgdorferi B31
QNQLKDNLDKFNLI

SEQ ID NO: 92395 - protein, 14 aa, Borrelia burgdorferi B31
NQLKDNLDKFNLIQ

SEQ ID NO: 92396 - protein, 14 aa, Borrelia burgdorferi B31
QLKDNLDKFNLIQS

SEQ ID NO: 92397 - protein, 14 aa, Borrelia burgdorferi B31
LKDNLDKFNLIQSK

SEQ ID NO: 92398 - protein, 14 aa, Borrelia burgdorferi B31
KDNLDKFNLIQSKI

SEQ ID NO: 92399 - protein, 14 aa, Borrelia burgdorferi B31
DNLDKFNLIQSKIT

SEQ ID NO: 92400 - protein, 14 aa, Borrelia burgdorferi B31
NLDKFNLIQSKITM

SEQ ID NO: 92401 - protein, 14 aa, Borrelia burgdorferi B31
LDKFNLIQSKITML

SEQ ID NO: 92402 - protein, 14 aa, Borrelia burgdorferi B31
DKFNLIQSKITMLK

SEQ ID NO: 92403 - protein, 14 aa, Borrelia burgdorferi B31
KFNLIQSKITMLKV

SEQ ID NO: 92404 - protein, 14 aa, Borrelia burgdorferi B31
FNLIQSKITMLKVE

SEQ ID NO: 92405 - protein, 14 aa, Borrelia burgdorferi B31
NLIQSKITMLKVEN

SEQ ID NO: 92406 - protein, 14 aa, Borrelia burgdorferi B31
LIQSKITMLKVENL

SEQ ID NO: 92407 - protein, 14 aa, Borrelia burgdorferi B31
IQSKITMLKVENLI

SEQ ID NO: 92408 - protein, 14 aa, Borrelia burgdorferi B31
QSKITMLKVENLIP

SEQ ID NO: 92409 - protein, 14 aa, Borrelia burgdorferi B31
SKITMLKVENLIPE

SEQ ID NO: 92410 - protein, 14 aa, Borrelia burgdorferi B31
KITMLKVENLIPEE

SEQ ID NO: 92411 - protein, 14 aa, Borrelia burgdorferi B31
ITMLKVENLIPEEE

SEQ ID NO: 92412 - protein, 14 aa, Borrelia burgdorferi B31
TMLKVENLIPEEEY

SEQ ID NO: 92413 - protein, 14 aa, Borrelia burgdorferi B31
MLKVENLIPEEEYN

SEQ ID NO: 92414 - protein, 14 aa, Borrelia burgdorferi B31
LKVENLIPEEEYNQ

SEQ ID NO: 92415 - protein, 14 aa, Borrelia burgdorferi B31
KVENLIPEEEYNQE

SEQ ID NO: 92416 - protein, 14 aa, Borrelia burgdorferi B31
VENLIPEEEYNQEK

SEQ ID NO: 92417 - protein, 14 aa, Borrelia burgdorferi B31
ENLIPEEEYNQEKT

SEQ ID NO: 92418 - protein, 14 aa, Borrelia burgdorferi B31
NLIPEEEYNQEKTA

SEQ ID NO: 92419 - protein, 14 aa, Borrelia burgdorferi B31
LIPEEEYNQEKTAI

SEQ ID NO: 92420 - protein, 14 aa, Borrelia burgdorferi B31
IPEEEYNQEKTAIK

SEQ ID NO: 92421 - protein, 14 aa, Borrelia burgdorferi B31
PEEEYNQEKTAIKE

SEQ ID NO: 92422 - protein, 14 aa, Borrelia burgdorferi B31
EEEYNQEKTAIKEK

SEQ ID NO: 92423 - protein, 14 aa, Borrelia burgdorferi B31
EEYNQEKTAIKEKE

SEQ ID NO: 92424 - protein, 14 aa, Borrelia burgdorferi B31
EYNQEKTAIKEKEK

SEQ ID NO: 92425 - protein, 14 aa, Borrelia burgdorferi B31
YNQEKTAIKEKEKT

SEQ ID NO: 92426 - protein, 14 aa, Borrelia burgdorferi B31
NQEKTAIKEKEKTP

SEQ ID NO: 92427 - protein, 14 aa, Borrelia burgdorferi B31
QEKTAIKEKEKTPK

SEQ ID NO: 92428 - protein, 14 aa, Borrelia burgdorferi B31
EKTAIKEKEKTPKI

SEQ ID NO: 92429 - protein, 14 aa, Borrelia burgdorferi B31
KTAIKEKEKTPKIG

SEQ ID NO: 92430 - protein, 14 aa, Borrelia burgdorferi B31
TAIKEKEKTPKIGL

SEQ ID NO: 92431 - protein, 14 aa, Borrelia burgdorferi B31
AIKEKEKTPKIGLH

SEQ ID NO: 92432 - protein, 14 aa, Borrelia burgdorferi B31
IKEKEKTPKIGLHF

SEQ ID NO: 92433 - protein, 14 aa, Borrelia burgdorferi B31
KEKEKTPKIGLHFT

SEQ ID NO: 92434 - protein, 14 aa, Borrelia burgdorferi B31
EKEKTPKIGLHFTY

SEQ ID NO: 92435 - protein, 14 aa, Borrelia burgdorferi B31
KEKTPKIGLHFTYC

SEQ ID NO: 92436 - protein, 14 aa, Borrelia burgdorferi B31
EKTPKIGLHFTYCG

SEQ ID NO: 92437 - protein, 14 aa, Borrelia burgdorferi B31
KTPKIGLHFTYCGF

SEQ ID NO: 92438 - protein, 14 aa, Borrelia burgdorferi B31
TPKIGLHFTYCGFE

SEQ ID NO: 92439 - protein, 14 aa, Borrelia burgdorferi B31
PKIGLHFTYCGFEI

SEQ ID NO: 92440 - protein, 14 aa, Borrelia burgdorferi B31
KIGLHFTYCGFEIL

SEQ ID NO: 92441 - protein, 14 aa, Borrelia burgdorferi B31
IGLHFTYCGFEILI

SEQ ID NO: 92442 - protein, 14 aa, Borrelia burgdorferi B31
GLHFTYCGFEILIG

SEQ ID NO: 92443 - protein, 14 aa, Borrelia burgdorferi B31
LHFTYCGFEILIGR

SEQ ID NO: 92444 - protein, 14 aa, Borrelia burgdorferi B31
HFTYCGFEILIGRN

SEQ ID NO: 92445 - protein, 14 aa, Borrelia burgdorferi B31
FTYCGFEILIGRNA

SEQ ID NO: 92446 - protein, 14 aa, Borrelia burgdorferi B31
TYCGFEILIGRNAK

SEQ ID NO: 92447 - protein, 14 aa, Borrelia burgdorferi B31
YCGFEILIGRNAKE

SEQ ID NO: 92448 - protein, 14 aa, Borrelia burgdorferi B31
CGFEILIGRNAKEN

SEQ ID NO: 92449 - protein, 14 aa, Borrelia burgdorferi B31
GFEILIGRNAKEND

SEQ ID NO: 92450 - protein, 14 aa, Borrelia burgdorferi B31
FEILIGRNAKENDK

SEQ ID NO: 92451 - protein, 14 aa, Borrelia burgdorferi B31
EILIGRNAKENDKL

SEQ ID NO: 92452 - protein, 14 aa, Borrelia burgdorferi B31
ILIGRNAKENDKLL

SEQ ID NO: 92453 - protein, 14 aa, Borrelia burgdorferi B31
LIGRNAKENDKLLR

SEQ ID NO: 92454 - protein, 14 aa, Borrelia burgdorferi B31
IGRNAKENDKLLRH

SEQ ID NO: 92455 - protein, 14 aa, Borrelia burgdorferi B31
GRNAKENDKLLRHC

SEQ ID NO: 92456 - protein, 14 aa, Borrelia burgdorferi B31
RNAKENDKLLRHCV

SEQ ID NO: 92457 - protein, 14 aa, Borrelia burgdorferi B31
NAKENDKLLRHCVK

SEQ ID NO: 92458 - protein, 14 aa, Borrelia burgdorferi B31
AKENDKLLRHCVKG

SEQ ID NO: 92459 - protein, 14 aa, Borrelia burgdorferi B31
KENDKLLRHCVKGN

SEQ ID NO: 92460 - protein, 14 aa, Borrelia burgdorferi B31
ENDKLLRHCVKGND

SEQ ID NO: 92461 - protein, 14 aa, Borrelia burgdorferi B31
NDKLLRHCVKGNDY

SEQ ID NO: 92462 - protein, 14 aa, Borrelia burgdorferi B31
DKLLRHCVKGNDYW

SEQ ID NO: 92463 - protein, 14 aa, Borrelia burgdorferi B31
KLLRHCVKGNDYWL

SEQ ID NO: 92464 - protein, 14 aa, Borrelia burgdorferi B31
LLRHCVKGNDYWLH

SEQ ID NO: 92465 - protein, 14 aa, Borrelia burgdorferi B31
LRHCVKGNDYWLHT

SEQ ID NO: 92466 - protein, 14 aa, Borrelia burgdorferi B31
RHCVKGNDYWLHTR

SEQ ID NO: 92467 - protein, 14 aa, Borrelia burgdorferi B31
HCVKGNDYWLHTRD

SEQ ID NO: 92468 - protein, 14 aa, Borrelia burgdorferi B31
CVKGNDYWLHTRDY

SEQ ID NO: 92469 - protein, 14 aa, Borrelia burgdorferi B31
VKGNDYWLHTRDYP

SEQ ID NO: 92470 - protein, 14 aa, Borrelia burgdorferi B31
KGNDYWLHTRDYPG

SEQ ID NO: 92471 - protein, 14 aa, Borrelia burgdorferi B31
GNDYWLHTRDYPGA

SEQ ID NO: 92472 - protein, 14 aa, Borrelia burgdorferi B31
NDYWLHTRDYPGAY

SEQ ID NO: 92473 - protein, 14 aa, Borrelia burgdorferi B31
DYWLHTRDYPGAYV

SEQ ID NO: 92474 - protein, 14 aa, Borrelia burgdorferi B31
YWLHTRDYPGAYVF

SEQ ID NO: 92475 - protein, 14 aa, Borrelia burgdorferi B31
WLHTRDYPGAYVFI

SEQ ID NO: 92476 - protein, 14 aa, Borrelia burgdorferi B31
LHTRDYPGAYVFIK

SEQ ID NO: 92477 - protein, 14 aa, Borrelia burgdorferi B31
HTRDYPGAYVFIKN

SEQ ID NO: 92478 - protein, 14 aa, Borrelia burgdorferi B31
TRDYPGAYVFIKNQ

SEQ ID NO: 92479 - protein, 14 aa, Borrelia burgdorferi B31
RDYPGAYVFIKNQK

SEQ ID NO: 92480 - protein, 14 aa, Borrelia burgdorferi B31
DYPGAYVFIKNQKN

SEQ ID NO: 92481 - protein, 14 aa, Borrelia burgdorferi B31
YPGAYVFIKNQKNK

SEQ ID NO: 92482 - protein, 14 aa, Borrelia burgdorferi B31
PGAYVFIKNQKNKT

SEQ ID NO: 92483 - protein, 14 aa, Borrelia burgdorferi B31
GAYVFIKNQKNKTP

SEQ ID NO: 92484 - protein, 14 aa, Borrelia burgdorferi B31
AYVFIKNQKNKTPS

SEQ ID NO: 92485 - protein, 14 aa, Borrelia burgdorferi B31
YVFIKNQKNKTPSL

SEQ ID NO: 92486 - protein, 14 aa, Borrelia burgdorferi B31
VFIKNQKNKTPSLD

SEQ ID NO: 92487 - protein, 14 aa, Borrelia burgdorferi B31
FIKNQKNKTPSLDV

SEQ ID NO: 92488 - protein, 14 aa, Borrelia burgdorferi B31
IKNQKNKTPSLDVL

SEQ ID NO: 92489 - protein, 14 aa, Borrelia burgdorferi B31
KNQKNKTPSLDVLL

SEQ ID NO: 92490 - protein, 14 aa, Borrelia burgdorferi B31
NQKNKTPSLDVLLG

SEQ ID NO: 92491 - protein, 14 aa, Borrelia burgdorferi B31
QKNKTPSLDVLLGA

SEQ ID NO: 92492 - protein, 14 aa, Borrelia burgdorferi B31
KNKTPSLDVLLGAG

SEQ ID NO: 92493 - protein, 14 aa, Borrelia burgdorferi B31
NKTPSLDVLLGAGN

SEQ ID NO: 92494 - protein, 14 aa, Borrelia burgdorferi B31
KTPSLDVLLGAGNL

SEQ ID NO: 92495 - protein, 14 aa, Borrelia burgdorferi B31
TPSLDVLLGAGNLC

SEQ ID NO: 92496 - protein, 14 aa, Borrelia burgdorferi B31
PSLDVLLGAGNLCV

SEQ ID NO: 92497 - protein, 14 aa, Borrelia burgdorferi B31
SLDVLLGAGNLCVF

SEQ ID NO: 92498 - protein, 14 aa, Borrelia burgdorferi B31
LDVLLGAGNLCVFY

SEQ ID NO: 92499 - protein, 14 aa, Borrelia burgdorferi B31
DVLLGAGNLCVFYT

SEQ ID NO: 92500 - protein, 14 aa, Borrelia burgdorferi B31
VLLGAGNLCVFYTK

SEQ ID NO: 92501 - protein, 14 aa, Borrelia burgdorferi B31
LLGAGNLCVFYTKL

SEQ ID NO: 92502 - protein, 14 aa, Borrelia burgdorferi B31
LGAGNLCVFYTKLA

SEQ ID NO: 92503 - protein, 14 aa, Borrelia burgdorferi B31
GAGNLCVFYTKLAK

SEQ ID NO: 92504 - protein, 14 aa, Borrelia burgdorferi B31
AGNLCVFYTKLAKK

SEQ ID NO: 92505 - protein, 14 aa, Borrelia burgdorferi B31
GNLCVFYTKLAKKS

SEQ ID NO: 92506 - protein, 14 aa, Borrelia burgdorferi B31
NLCVFYTKLAKKSG

SEQ ID NO: 92507 - protein, 14 aa, Borrelia burgdorferi B31
LCVFYTKLAKKSGK

SEQ ID NO: 92508 - protein, 14 aa, Borrelia burgdorferi B31
CVFYTKLAKKSGKA

SEQ ID NO: 92509 - protein, 14 aa, Borrelia burgdorferi B31
VFYTKLAKKSGKAD

SEQ ID NO: 92510 - protein, 14 aa, Borrelia burgdorferi B31
FYTKLAKKSGKADL

SEQ ID NO: 92511 - protein, 14 aa, Borrelia burgdorferi B31
YTKLAKKSGKADLY

SEQ ID NO: 92512 - protein, 14 aa, Borrelia burgdorferi B31
TKLAKKSGKADLYY

SEQ ID NO: 92513 - protein, 14 aa, Borrelia burgdorferi B31
KLAKKSGKADLYYT

SEQ ID NO: 92514 - protein, 14 aa, Borrelia burgdorferi B31
LAKKSGKADLYYTQ

SEQ ID NO: 92515 - protein, 14 aa, Borrelia burgdorferi B31
AKKSGKADLYYTQV

SEQ ID NO: 92516 - protein, 14 aa, Borrelia burgdorferi B31
KKSGKADLYYTQVK

SEQ ID NO: 92517 - protein, 14 aa, Borrelia burgdorferi B31
KSGKADLYYTQVKN

SEQ ID NO: 92518 - protein, 14 aa, Borrelia burgdorferi B31
SGKADLYYTQVKNL

SEQ ID NO: 92519 - protein, 14 aa, Borrelia burgdorferi B31
GKADLYYTQVKNLR

SEQ ID NO: 92520 - protein, 14 aa, Borrelia burgdorferi B31
KADLYYTQVKNLRR

SEQ ID NO: 92521 - protein, 14 aa, Borrelia burgdorferi B31
ADLYYTQVKNLRRV

SEQ ID NO: 92522 - protein, 14 aa, Borrelia burgdorferi B31
DLYYTQVKNLRRVK

SEQ ID NO: 92523 - protein, 14 aa, Borrelia burgdorferi B31
LYYTQVKNLRRVKN

SEQ ID NO: 92524 - protein, 14 aa, Borrelia burgdorferi B31
YYTQVKNLRRVKNK

SEQ ID NO: 92525 - protein, 14 aa, Borrelia burgdorferi B31
YTQVKNLRRVKNKK

SEQ ID NO: 92526 - protein, 14 aa, Borrelia burgdorferi B31
TQVKNLRRVKNKKL

SEQ ID NO: 92527 - protein, 14 aa, Borrelia burgdorferi B31
QVKNLRRVKNKKLG

SEQ ID NO: 92528 - protein, 14 aa, Borrelia burgdorferi B31
VKNLRRVKNKKLGL

SEQ ID NO: 92529 - protein, 14 aa, Borrelia burgdorferi B31
KNLRRVKNKKLGLV

SEQ ID NO: 92530 - protein, 14 aa, Borrelia burgdorferi B31
NLRRVKNKKLGLVI

SEQ ID NO: 92531 - protein, 14 aa, Borrelia burgdorferi B31
LRRVKNKKLGLVIP

SEQ ID NO: 92532 - protein, 14 aa, Borrelia burgdorferi B31
RRVKNKKLGLVIPK

SEQ ID NO: 92533 - protein, 14 aa, Borrelia burgdorferi B31
RVKNKKLGLVIPKA

SEQ ID NO: 92534 - protein, 14 aa, Borrelia burgdorferi B31
VKNKKLGLVIPKAE

SEQ ID NO: 92535 - protein, 14 aa, Borrelia burgdorferi B31
KNKKLGLVIPKAEK

SEQ ID NO: 92536 - protein, 14 aa, Borrelia burgdorferi B31
NKKLGLVIPKAEKN

SEQ ID NO: 92537 - protein, 14 aa, Borrelia burgdorferi B31
KKLGLVIPKAEKNL

SEQ ID NO: 92538 - protein, 14 aa, Borrelia burgdorferi B31
KLGLVIPKAEKNLH

SEQ ID NO: 92539 - protein, 14 aa, Borrelia burgdorferi B31
LGLVIPKAEKNLHI

SEQ ID NO: 92540 - protein, 14 aa, Borrelia burgdorferi B31
GLVIPKAEKNLHIK

SEQ ID NO: 92541 - protein, 14 aa, Borrelia burgdorferi B31
LVIPKAEKNLHIKL

SEQ ID NO: 92542 - protein, 14 aa, Borrelia burgdorferi B31
VIPKAEKNLHIKLD

SEQ ID NO: 92543 - protein, 14 aa, Borrelia burgdorferi B31
IPKAEKNLHIKLDE

SEQ ID NO: 92544 - protein, 14 aa, Borrelia burgdorferi B31
PKAEKNLHIKLDEN

SEQ ID NO: 92545 - protein, 14 aa, Borrelia burgdorferi B31
KAEKNLHIKLDENL

SEQ ID NO: 92546 - protein, 14 aa, Borrelia burgdorferi B31
AEKNLHIKLDENLI

SEQ ID NO: 92547 - protein, 14 aa, Borrelia burgdorferi B31
EKNLHIKLDENLIK

SEQ ID NO: 92548 - protein, 14 aa, Borrelia burgdorferi B31
KNLHIKLDENLIKK

SEQ ID NO: 92549 - protein, 14 aa, Borrelia burgdorferi B31
NLHIKLDENLIKKI

SEQ ID NO: 92550 - protein, 14 aa, Borrelia burgdorferi B31
LHIKLDENLIKKIK

SEQ ID NO: 92551 - protein, 14 aa, Borrelia burgdorferi B31
HIKLDENLIKKIKN

SEQ ID NO: 92552 - protein, 14 aa, Borrelia burgdorferi B31
IKLDENLIKKIKNQ

SEQ ID NO: 92553 - protein, 14 aa, Borrelia burgdorferi B31
KLDENLIKKIKNQT

SEQ ID NO: 92554 - protein, 15 aa, Borrelia burgdorferi B31
MIKMSLNYTEINTLI

SEQ ID NO: 92555 - protein, 15 aa, Borrelia burgdorferi B31
IKMSLNYTEINTLIK

SEQ ID NO: 92556 - protein, 15 aa, Borrelia burgdorferi B31
KMSLNYTEINTLIKE

SEQ ID NO: 92557 - protein, 15 aa, Borrelia burgdorferi B31
MSLNYTEINTLIKEI

SEQ ID NO: 92558 - protein, 15 aa, Borrelia burgdorferi B31
SLNYTEINTLIKEIP

SEQ ID NO: 92559 - protein, 15 aa, Borrelia burgdorferi B31
LNYTEINTLIKEIPF

SEQ ID NO: 92560 - protein, 15 aa, Borrelia burgdorferi B31
NYTEINTLIKEIPFT

SEQ ID NO: 92561 - protein, 15 aa, Borrelia burgdorferi B31
YTEINTLIKEIPFTN

SEQ ID NO: 92562 - protein, 15 aa, Borrelia burgdorferi B31
TEINTLIKEIPFTNS

SEQ ID NO: 92563 - protein, 15 aa, Borrelia burgdorferi B31
EINTLIKEIPFTNSL

SEQ ID NO: 92564 - protein, 15 aa, Borrelia burgdorferi B31
INTLIKEIPFTNSLI

SEQ ID NO: 92565 - protein, 15 aa, Borrelia burgdorferi B31
NTLIKEIPFTNSLIT

SEQ ID NO: 92566 - protein, 15 aa, Borrelia burgdorferi B31
TLIKEIPFTNSLITK

SEQ ID NO: 92567 - protein, 15 aa, Borrelia burgdorferi B31
LIKEIPFTNSLITKI

SEQ ID NO: 92568 - protein, 15 aa, Borrelia burgdorferi B31
IKEIPFTNSLITKII

SEQ ID NO: 92569 - protein, 15 aa, Borrelia burgdorferi B31
KEIPFTNSLITKIIQ

SEQ ID NO: 92570 - protein, 15 aa, Borrelia burgdorferi B31
EIPFTNSLITKIIQP

SEQ ID NO: 92571 - protein, 15 aa, Borrelia burgdorferi B31
IPFTNSLITKIIQPD

SEQ ID NO: 92572 - protein, 15 aa, Borrelia burgdorferi B31
PFTNSLITKIIQPDY

SEQ ID NO: 92573 - protein, 15 aa, Borrelia burgdorferi B31
FTNSLITKIIQPDYK

SEQ ID NO: 92574 - protein, 15 aa, Borrelia burgdorferi B31
TNSLITKIIQPDYKS

SEQ ID NO: 92575 - protein, 15 aa, Borrelia burgdorferi B31
NSLITKIIQPDYKSL

SEQ ID NO: 92576 - protein, 15 aa, Borrelia burgdorferi B31
SLITKIIQPDYKSLV

SEQ ID NO: 92577 - protein, 15 aa, Borrelia burgdorferi B31
LITKIIQPDYKSLVL

SEQ ID NO: 92578 - protein, 15 aa, Borrelia burgdorferi B31
ITKIIQPDYKSLVLE

SEQ ID NO: 92579 - protein, 15 aa, Borrelia burgdorferi B31
TKIIQPDYKSLVLEI

SEQ ID NO: 92580 - protein, 15 aa, Borrelia burgdorferi B31
KIIQPDYKSLVLEIY

SEQ ID NO: 92581 - protein, 15 aa, Borrelia burgdorferi B31
IIQPDYKSLVLEIYN

SEQ ID NO: 92582 - protein, 15 aa, Borrelia burgdorferi B31
IQPDYKSLVLEIYNK

SEQ ID NO: 92583 - protein, 15 aa, Borrelia burgdorferi B31
QPDYKSLVLEIYNKI

SEQ ID NO: 92584 - protein, 15 aa, Borrelia burgdorferi B31
PDYKSLVLEIYNKID

SEQ ID NO: 92585 - protein, 15 aa, Borrelia burgdorferi B31
DYKSLVLEIYNKIDN

SEQ ID NO: 92586 - protein, 15 aa, Borrelia burgdorferi B31
YKSLVLEIYNKIDNK

SEQ ID NO: 92587 - protein, 15 aa, Borrelia burgdorferi B31
KSLVLEIYNKIDNKK

SEQ ID NO: 92588 - protein, 15 aa, Borrelia burgdorferi B31
SLVLEIYNKIDNKKF

SEQ ID NO: 92589 - protein, 15 aa, Borrelia burgdorferi B31
LVLEIYNKIDNKKFK

SEQ ID NO: 92590 - protein, 15 aa, Borrelia burgdorferi B31
VLEIYNKIDNKKFKI

SEQ ID NO: 92591 - protein, 15 aa, Borrelia burgdorferi B31
LEIYNKIDNKKFKIL

SEQ ID NO: 92592 - protein, 15 aa, Borrelia burgdorferi B31
EIYNKIDNKKFKILI

SEQ ID NO: 92593 - protein, 15 aa, Borrelia burgdorferi B31
IYNKIDNKKFKILIC

SEQ ID NO: 92594 - protein, 15 aa, Borrelia burgdorferi B31
YNKIDNKKFKILICL

SEQ ID NO: 92595 - protein, 15 aa, Borrelia burgdorferi B31
NKIDNKKFKILICLN

SEQ ID NO: 92596 - protein, 15 aa, Borrelia burgdorferi B31
KIDNKKFKILICLNP

SEQ ID NO: 92597 - protein, 15 aa, Borrelia burgdorferi B31
IDNKKFKILICLNPN

SEQ ID NO: 92598 - protein, 15 aa, Borrelia burgdorferi B31
DNKKFKILICLNPNT

SEQ ID NO: 92599 - protein, 15 aa, Borrelia burgdorferi B31
NKKFKILICLNPNTT

SEQ ID NO: 92600 - protein, 15 aa, Borrelia burgdorferi B31
KKFKILICLNPNTTR

SEQ ID NO: 92601 - protein, 15 aa, Borrelia burgdorferi B31
KFKILICLNPNTTRF

SEQ ID NO: 92602 - protein, 15 aa, Borrelia burgdorferi B31
FKILICLNPNTTRFH

SEQ ID NO: 92603 - protein, 15 aa, Borrelia burgdorferi B31
KILICLNPNTTRFHI

SEQ ID NO: 92604 - protein, 15 aa, Borrelia burgdorferi B31
ILICLNPNTTRFHIT

SEQ ID NO: 92605 - protein, 15 aa, Borrelia burgdorferi B31
LICLNPNTTRFHITK

SEQ ID NO: 92606 - protein, 15 aa, Borrelia burgdorferi B31
ICLNPNTTRFHITKK

SEQ ID NO: 92607 - protein, 15 aa, Borrelia burgdorferi B31
CLNPNTTRFHITKKN

SEQ ID NO: 92608 - protein, 15 aa, Borrelia burgdorferi B31
LNPNTTRFHITKKNF

SEQ ID NO: 92609 - protein, 15 aa, Borrelia burgdorferi B31
NPNTTRFHITKKNFK

SEQ ID NO: 92610 - protein, 15 aa, Borrelia burgdorferi B31
PNTTRFHITKKNFKK

SEQ ID NO: 92611 - protein, 15 aa, Borrelia burgdorferi B31
NTTRFHITKKNFKKN

SEQ ID NO: 92612 - protein, 15 aa, Borrelia burgdorferi B31
TTRFHITKKNFKKNA

SEQ ID NO: 92613 - protein, 15 aa, Borrelia burgdorferi B31
TRFHITKKNFKKNAL

SEQ ID NO: 92614 - protein, 15 aa, Borrelia burgdorferi B31
RFHITKKNFKKNALK

SEQ ID NO: 92615 - protein, 15 aa, Borrelia burgdorferi B31
FHITKKNFKKNALKL

SEQ ID NO: 92616 - protein, 15 aa, Borrelia burgdorferi B31
HITKKNFKKNALKLR

SEQ ID NO: 92617 - protein, 15 aa, Borrelia burgdorferi B31
ITKKNFKKNALKLRF

SEQ ID NO: 92618 - protein, 15 aa, Borrelia burgdorferi B31
TKKNFKKNALKLRFS

SEQ ID NO: 92619 - protein, 15 aa, Borrelia burgdorferi B31
KKNFKKNALKLRFSD

SEQ ID NO: 92620 - protein, 15 aa, Borrelia burgdorferi B31
KNFKKNALKLRFSDF

SEQ ID NO: 92621 - protein, 15 aa, Borrelia burgdorferi B31
NFKKNALKLRFSDFL

SEQ ID NO: 92622 - protein, 15 aa, Borrelia burgdorferi B31
FKKNALKLRFSDFLK

SEQ ID NO: 92623 - protein, 15 aa, Borrelia burgdorferi B31
KKNALKLRFSDFLKS

SEQ ID NO: 92624 - protein, 15 aa, Borrelia burgdorferi B31
KNALKLRFSDFLKSK

SEQ ID NO: 92625 - protein, 15 aa, Borrelia burgdorferi B31
NALKLRFSDFLKSKI

SEQ ID NO: 92626 - protein, 15 aa, Borrelia burgdorferi B31
ALKLRFSDFLKSKIQ

SEQ ID NO: 92627 - protein, 15 aa, Borrelia burgdorferi B31
LKLRFSDFLKSKIQN

SEQ ID NO: 92628 - protein, 15 aa, Borrelia burgdorferi B31
KLRFSDFLKSKIQNG

SEQ ID NO: 92629 - protein, 15 aa, Borrelia burgdorferi B31
LRFSDFLKSKIQNGK

SEQ ID NO: 92630 - protein, 15 aa, Borrelia burgdorferi B31
RFSDFLKSKIQNGKI

SEQ ID NO: 92631 - protein, 15 aa, Borrelia burgdorferi B31
FSDFLKSKIQNGKII

SEQ ID NO: 92632 - protein, 15 aa, Borrelia burgdorferi B31
SDFLKSKIQNGKIIK

SEQ ID NO: 92633 - protein, 15 aa, Borrelia burgdorferi B31
DFLKSKIQNGKIIKA

SEQ ID NO: 92634 - protein, 15 aa, Borrelia burgdorferi B31
FLKSKIQNGKIIKAF

SEQ ID NO: 92635 - protein, 15 aa, Borrelia burgdorferi B31
LKSKIQNGKIIKAFQ

SEQ ID NO: 92636 - protein, 15 aa, Borrelia burgdorferi B31
KSKIQNGKIIKAFQM

SEQ ID NO: 92637 - protein, 15 aa, Borrelia burgdorferi B31
SKIQNGKIIKAFQMK

SEQ ID NO: 92638 - protein, 15 aa, Borrelia burgdorferi B31
KIQNGKIIKAFQMKN

SEQ ID NO: 92639 - protein, 15 aa, Borrelia burgdorferi B31
IQNGKIIKAFQMKNE

SEQ ID NO: 92640 - protein, 15 aa, Borrelia burgdorferi B31
QNGKIIKAFQMKNER

SEQ ID NO: 92641 - protein, 15 aa, Borrelia burgdorferi B31
NGKIIKAFQMKNERI

SEQ ID NO: 92642 - protein, 15 aa, Borrelia burgdorferi B31
GKIIKAFQMKNERII

SEQ ID NO: 92643 - protein, 15 aa, Borrelia burgdorferi B31
KIIKAFQMKNERIIS

SEQ ID NO: 92644 - protein, 15 aa, Borrelia burgdorferi B31
IIKAFQMKNERIISL

SEQ ID NO: 92645 - protein, 15 aa, Borrelia burgdorferi B31
IKAFQMKNERIISLE

SEQ ID NO: 92646 - protein, 15 aa, Borrelia burgdorferi B31
KAFQMKNERIISLEI

SEQ ID NO: 92647 - protein, 15 aa, Borrelia burgdorferi B31
AFQMKNERIISLEIL

SEQ ID NO: 92648 - protein, 15 aa, Borrelia burgdorferi B31
FQMKNERIISLEILQ

SEQ ID NO: 92649 - protein, 15 aa, Borrelia burgdorferi B31
QMKNERIISLEILQK

SEQ ID NO: 92650 - protein, 15 aa, Borrelia burgdorferi B31
MKNERIISLEILQKD

SEQ ID NO: 92651 - protein, 15 aa, Borrelia burgdorferi B31
KNERIISLEILQKDM

SEQ ID NO: 92652 - protein, 15 aa, Borrelia burgdorferi B31
NERIISLEILQKDMI

SEQ ID NO: 92653 - protein, 15 aa, Borrelia burgdorferi B31
ERIISLEILQKDMII

SEQ ID NO: 92654 - protein, 15 aa, Borrelia burgdorferi B31
RIISLEILQKDMIIL

SEQ ID NO: 92655 - protein, 15 aa, Borrelia burgdorferi B31
IISLEILQKDMIILF

SEQ ID NO: 92656 - protein, 15 aa, Borrelia burgdorferi B31
ISLEILQKDMIILFI

SEQ ID NO: 92657 - protein, 15 aa, Borrelia burgdorferi B31
SLEILQKDMIILFIK

SEQ ID NO: 92658 - protein, 15 aa, Borrelia burgdorferi B31
LEILQKDMIILFIKL

SEQ ID NO: 92659 - protein, 15 aa, Borrelia burgdorferi B31
EILQKDMIILFIKLW

SEQ ID NO: 92660 - protein, 15 aa, Borrelia burgdorferi B31
ILQKDMIILFIKLWP

SEQ ID NO: 92661 - protein, 15 aa, Borrelia burgdorferi B31
LQKDMIILFIKLWPS

SEQ ID NO: 92662 - protein, 15 aa, Borrelia burgdorferi B31
QKDMIILFIKLWPSS

SEQ ID NO: 92663 - protein, 15 aa, Borrelia burgdorferi B31
KDMIILFIKLWPSSP

SEQ ID NO: 92664 - protein, 15 aa, Borrelia burgdorferi B31
DMIILFIKLWPSSPN

SEQ ID NO: 92665 - protein, 15 aa, Borrelia burgdorferi B31
MIILFIKLWPSSPNI

SEQ ID NO: 92666 - protein, 15 aa, Borrelia burgdorferi B31
IILFIKLWPSSPNII

SEQ ID NO: 92667 - protein, 15 aa, Borrelia burgdorferi B31
ILFIKLWPSSPNIIA

SEQ ID NO: 92668 - protein, 15 aa, Borrelia burgdorferi B31
LFIKLWPSSPNIIAT

SEQ ID NO: 92669 - protein, 15 aa, Borrelia burgdorferi B31
FIKLWPSSPNIIATN

SEQ ID NO: 92670 - protein, 15 aa, Borrelia burgdorferi B31
IKLWPSSPNIIATNS

SEQ ID NO: 92671 - protein, 15 aa, Borrelia burgdorferi B31
KLWPSSPNIIATNSN

SEQ ID NO: 92672 - protein, 15 aa, Borrelia burgdorferi B31
LWPSSPNIIATNSNF

SEQ ID NO: 92673 - protein, 15 aa, Borrelia burgdorferi B31
WPSSPNIIATNSNFK

SEQ ID NO: 92674 - protein, 15 aa, Borrelia burgdorferi B31
PSSPNIIATNSNFKI

SEQ ID NO: 92675 - protein, 15 aa, Borrelia burgdorferi B31
SSPNIIATNSNFKIL

SEQ ID NO: 92676 - protein, 15 aa, Borrelia burgdorferi B31
SPNIIATNSNFKILD

SEQ ID NO: 92677 - protein, 15 aa, Borrelia burgdorferi B31
PNIIATNSNFKILDA

SEQ ID NO: 92678 - protein, 15 aa, Borrelia burgdorferi B31
NIIATNSNFKILDAY

SEQ ID NO: 92679 - protein, 15 aa, Borrelia burgdorferi B31
IIATNSNFKILDAYY

SEQ ID NO: 92680 - protein, 15 aa, Borrelia burgdorferi B31
IATNSNFKILDAYYR

SEQ ID NO: 92681 - protein, 15 aa, Borrelia burgdorferi B31
ATNSNFKILDAYYRR

SEQ ID NO: 92682 - protein, 15 aa, Borrelia burgdorferi B31
TNSNFKILDAYYRRP

SEQ ID NO: 92683 - protein, 15 aa, Borrelia burgdorferi B31
NSNFKILDAYYRRPK

SEQ ID NO: 92684 - protein, 15 aa, Borrelia burgdorferi B31
SNFKILDAYYRRPKI

SEQ ID NO: 92685 - protein, 15 aa, Borrelia burgdorferi B31
NFKILDAYYRRPKIK

SEQ ID NO: 92686 - protein, 15 aa, Borrelia burgdorferi B31
FKILDAYYRRPKIKE

SEQ ID NO: 92687 - protein, 15 aa, Borrelia burgdorferi B31
KILDAYYRRPKIKET

SEQ ID NO: 92688 - protein, 15 aa, Borrelia burgdorferi B31
ILDAYYRRPKIKETT

SEQ ID NO: 92689 - protein, 15 aa, Borrelia burgdorferi B31
LDAYYRRPKIKETTG

SEQ ID NO: 92690 - protein, 15 aa, Borrelia burgdorferi B31
DAYYRRPKIKETTGE

SEQ ID NO: 92691 - protein, 15 aa, Borrelia burgdorferi B31
AYYRRPKIKETTGEI

SEQ ID NO: 92692 - protein, 15 aa, Borrelia burgdorferi B31
YYRRPKIKETTGEIF

SEQ ID NO: 92693 - protein, 15 aa, Borrelia burgdorferi B31
YRRPKIKETTGEIFL

SEQ ID NO: 92694 - protein, 15 aa, Borrelia burgdorferi B31
RRPKIKETTGEIFLK

SEQ ID NO: 92695 - protein, 15 aa, Borrelia burgdorferi B31
RPKIKETTGEIFLKA

SEQ ID NO: 92696 - protein, 15 aa, Borrelia burgdorferi B31
PKIKETTGEIFLKAK

SEQ ID NO: 92697 - protein, 15 aa, Borrelia burgdorferi B31
KIKETTGEIFLKAKE

SEQ ID NO: 92698 - protein, 15 aa, Borrelia burgdorferi B31
IKETTGEIFLKAKEI

SEQ ID NO: 92699 - protein, 15 aa, Borrelia burgdorferi B31
KETTGEIFLKAKEIH

SEQ ID NO: 92700 - protein, 15 aa, Borrelia burgdorferi B31
ETTGEIFLKAKEIHE

SEQ ID NO: 92701 - protein, 15 aa, Borrelia burgdorferi B31
TTGEIFLKAKEIHES

SEQ ID NO: 92702 - protein, 15 aa, Borrelia burgdorferi B31
TGEIFLKAKEIHESN

SEQ ID NO: 92703 - protein, 15 aa, Borrelia burgdorferi B31
GEIFLKAKEIHESNK

SEQ ID NO: 92704 - protein, 15 aa, Borrelia burgdorferi B31
EIFLKAKEIHESNKM

SEQ ID NO: 92705 - protein, 15 aa, Borrelia burgdorferi B31
IFLKAKEIHESNKMS

SEQ ID NO: 92706 - protein, 15 aa, Borrelia burgdorferi B31
FLKAKEIHESNKMSD

SEQ ID NO: 92707 - protein, 15 aa, Borrelia burgdorferi B31
LKAKEIHESNKMSDK

SEQ ID NO: 92708 - protein, 15 aa, Borrelia burgdorferi B31
KAKEIHESNKMSDKK

SEQ ID NO: 92709 - protein, 15 aa, Borrelia burgdorferi B31
AKEIHESNKMSDKKI

SEQ ID NO: 92710 - protein, 15 aa, Borrelia burgdorferi B31
KEIHESNKMSDKKIM

SEQ ID NO: 92711 - protein, 15 aa, Borrelia burgdorferi B31
EIHESNKMSDKKIME

SEQ ID NO: 92712 - protein, 15 aa, Borrelia burgdorferi B31
IHESNKMSDKKIMEL

SEQ ID NO: 92713 - protein, 15 aa, Borrelia burgdorferi B31
HESNKMSDKKIMELK

SEQ ID NO: 92714 - protein, 15 aa, Borrelia burgdorferi B31
ESNKMSDKKIMELKE

SEQ ID NO: 92715 - protein, 15 aa, Borrelia burgdorferi B31
SNKMSDKKIMELKEE

SEQ ID NO: 92716 - protein, 15 aa, Borrelia burgdorferi B31
NKMSDKKIMELKEEY

SEQ ID NO: 92717 - protein, 15 aa, Borrelia burgdorferi B31
KMSDKKIMELKEEYN

SEQ ID NO: 92718 - protein, 15 aa, Borrelia burgdorferi B31
MSDKKIMELKEEYNN

SEQ ID NO: 92719 - protein, 15 aa, Borrelia burgdorferi B31
SDKKIMELKEEYNNT

SEQ ID NO: 92720 - protein, 15 aa, Borrelia burgdorferi B31
DKKIMELKEEYNNTS

SEQ ID NO: 92721 - protein, 15 aa, Borrelia burgdorferi B31
KKIMELKEEYNNTSY

SEQ ID NO: 92722 - protein, 15 aa, Borrelia burgdorferi B31
KIMELKEEYNNTSYT

SEQ ID NO: 92723 - protein, 15 aa, Borrelia burgdorferi B31
IMELKEEYNNTSYTS

SEQ ID NO: 92724 - protein, 15 aa, Borrelia burgdorferi B31
MELKEEYNNTSYTSY

SEQ ID NO: 92725 - protein, 15 aa, Borrelia burgdorferi B31
ELKEEYNNTSYTSYS

SEQ ID NO: 92726 - protein, 15 aa, Borrelia burgdorferi B31
LKEEYNNTSYTSYSE

SEQ ID NO: 92727 - protein, 15 aa, Borrelia burgdorferi B31
KEEYNNTSYTSYSEF

SEQ ID NO: 92728 - protein, 15 aa, Borrelia burgdorferi B31
EEYNNTSYTSYSEFL

SEQ ID NO: 92729 - protein, 15 aa, Borrelia burgdorferi B31
EYNNTSYTSYSEFLE

SEQ ID NO: 92730 - protein, 15 aa, Borrelia burgdorferi B31
YNNTSYTSYSEFLEN

SEQ ID NO: 92731 - protein, 15 aa, Borrelia burgdorferi B31
NNTSYTSYSEFLENY

SEQ ID NO: 92732 - protein, 15 aa, Borrelia burgdorferi B31
NTSYTSYSEFLENYY

SEQ ID NO: 92733 - protein, 15 aa, Borrelia burgdorferi B31
TSYTSYSEFLENYYE

SEQ ID NO: 92734 - protein, 15 aa, Borrelia burgdorferi B31
SYTSYSEFLENYYES

SEQ ID NO: 92735 - protein, 15 aa, Borrelia burgdorferi B31
YTSYSEFLENYYESL

SEQ ID NO: 92736 - protein, 15 aa, Borrelia burgdorferi B31
TSYSEFLENYYESLN

SEQ ID NO: 92737 - protein, 15 aa, Borrelia burgdorferi B31
SYSEFLENYYESLND

SEQ ID NO: 92738 - protein, 15 aa, Borrelia burgdorferi B31
YSEFLENYYESLNDQ

SEQ ID NO: 92739 - protein, 15 aa, Borrelia burgdorferi B31
SEFLENYYESLNDQI

SEQ ID NO: 92740 - protein, 15 aa, Borrelia burgdorferi B31
EFLENYYESLNDQIK

SEQ ID NO: 92741 - protein, 15 aa, Borrelia burgdorferi B31
FLENYYESLNDQIKK

SEQ ID NO: 92742 - protein, 15 aa, Borrelia burgdorferi B31
LENYYESLNDQIKKT

SEQ ID NO: 92743 - protein, 15 aa, Borrelia burgdorferi B31
ENYYESLNDQIKKTN

SEQ ID NO: 92744 - protein, 15 aa, Borrelia burgdorferi B31
NYYESLNDQIKKTNI

SEQ ID NO: 92745 - protein, 15 aa, Borrelia burgdorferi B31
YYESLNDQIKKTNIK

SEQ ID NO: 92746 - protein, 15 aa, Borrelia burgdorferi B31
YESLNDQIKKTNIKE

SEQ ID NO: 92747 - protein, 15 aa, Borrelia burgdorferi B31
ESLNDQIKKTNIKEL

SEQ ID NO: 92748 - protein, 15 aa, Borrelia burgdorferi B31
SLNDQIKKTNIKELL

SEQ ID NO: 92749 - protein, 15 aa, Borrelia burgdorferi B31
LNDQIKKTNIKELLI

SEQ ID NO: 92750 - protein, 15 aa, Borrelia burgdorferi B31
NDQIKKTNIKELLIE

SEQ ID NO: 92751 - protein, 15 aa, Borrelia burgdorferi B31
DQIKKTNIKELLIEK

SEQ ID NO: 92752 - protein, 15 aa, Borrelia burgdorferi B31
QIKKTNIKELLIEKY

SEQ ID NO: 92753 - protein, 15 aa, Borrelia burgdorferi B31
IKKTNIKELLIEKYK

SEQ ID NO: 92754 - protein, 15 aa, Borrelia burgdorferi B31
KKTNIKELLIEKYKK

SEQ ID NO: 92755 - protein, 15 aa, Borrelia burgdorferi B31
KTNIKELLIEKYKKE

SEQ ID NO: 92756 - protein, 15 aa, Borrelia burgdorferi B31
TNIKELLIEKYKKEL

SEQ ID NO: 92757 - protein, 15 aa, Borrelia burgdorferi B31
NIKELLIEKYKKELI

SEQ ID NO: 92758 - protein, 15 aa, Borrelia burgdorferi B31
IKELLIEKYKKELIV

SEQ ID NO: 92759 - protein, 15 aa, Borrelia burgdorferi B31
KELLIEKYKKELIVL

SEQ ID NO: 92760 - protein, 15 aa, Borrelia burgdorferi B31
ELLIEKYKKELIVLE

SEQ ID NO: 92761 - protein, 15 aa, Borrelia burgdorferi B31
LLIEKYKKELIVLEK

SEQ ID NO: 92762 - protein, 15 aa, Borrelia burgdorferi B31
LIEKYKKELIVLEKR

SEQ ID NO: 92763 - protein, 15 aa, Borrelia burgdorferi B31
IEKYKKELIVLEKRI

SEQ ID NO: 92764 - protein, 15 aa, Borrelia burgdorferi B31
EKYKKELIVLEKRID

SEQ ID NO: 92765 - protein, 15 aa, Borrelia burgdorferi B31
KYKKELIVLEKRIDS

SEQ ID NO: 92766 - protein, 15 aa, Borrelia burgdorferi B31
YKKELIVLEKRIDSL

SEQ ID NO: 92767 - protein, 15 aa, Borrelia burgdorferi B31
KKELIVLEKRIDSLK

SEQ ID NO: 92768 - protein, 15 aa, Borrelia burgdorferi B31
KELIVLEKRIDSLKQ

SEQ ID NO: 92769 - protein, 15 aa, Borrelia burgdorferi B31
ELIVLEKRIDSLKQQ

SEQ ID NO: 92770 - protein, 15 aa, Borrelia burgdorferi B31
LIVLEKRIDSLKQQI

SEQ ID NO: 92771 - protein, 15 aa, Borrelia burgdorferi B31
IVLEKRIDSLKQQIK

SEQ ID NO: 92772 - protein, 15 aa, Borrelia burgdorferi B31
VLEKRIDSLKQQIKL

SEQ ID NO: 92773 - protein, 15 aa, Borrelia burgdorferi B31
LEKRIDSLKQQIKLL

SEQ ID NO: 92774 - protein, 15 aa, Borrelia burgdorferi B31
EKRIDSLKQQIKLLE

SEQ ID NO: 92775 - protein, 15 aa, Borrelia burgdorferi B31
KRIDSLKQQIKLLEN

SEQ ID NO: 92776 - protein, 15 aa, Borrelia burgdorferi B31
RIDSLKQQIKLLENI

SEQ ID NO: 92777 - protein, 15 aa, Borrelia burgdorferi B31
IDSLKQQIKLLENIE

SEQ ID NO: 92778 - protein, 15 aa, Borrelia burgdorferi B31
DSLKQQIKLLENIEN

SEQ ID NO: 92779 - protein, 15 aa, Borrelia burgdorferi B31
SLKQQIKLLENIENE

SEQ ID NO: 92780 - protein, 15 aa, Borrelia burgdorferi B31
LKQQIKLLENIENEK

SEQ ID NO: 92781 - protein, 15 aa, Borrelia burgdorferi B31
KQQIKLLENIENEKE

SEQ ID NO: 92782 - protein, 15 aa, Borrelia burgdorferi B31
QQIKLLENIENEKEK

SEQ ID NO: 92783 - protein, 15 aa, Borrelia burgdorferi B31
QIKLLENIENEKEKG

SEQ ID NO: 92784 - protein, 15 aa, Borrelia burgdorferi B31
IKLLENIENEKEKGE

SEQ ID NO: 92785 - protein, 15 aa, Borrelia burgdorferi B31
KLLENIENEKEKGEL

SEQ ID NO: 92786 - protein, 15 aa, Borrelia burgdorferi B31
LLENIENEKEKGELI

SEQ ID NO: 92787 - protein, 15 aa, Borrelia burgdorferi B31
LENIENEKEKGELIL

SEQ ID NO: 92788 - protein, 15 aa, Borrelia burgdorferi B31
ENIENEKEKGELILL

SEQ ID NO: 92789 - protein, 15 aa, Borrelia burgdorferi B31
NIENEKEKGELILLN

SEQ ID NO: 92790 - protein, 15 aa, Borrelia burgdorferi B31
IENEKEKGELILLNI

SEQ ID NO: 92791 - protein, 15 aa, Borrelia burgdorferi B31
ENEKEKGELILLNIN

SEQ ID NO: 92792 - protein, 15 aa, Borrelia burgdorferi B31
NEKEKGELILLNINK

SEQ ID NO: 92793 - protein, 15 aa, Borrelia burgdorferi B31
EKEKGELILLNINKI

SEQ ID NO: 92794 - protein, 15 aa, Borrelia burgdorferi B31
KEKGELILLNINKIQ

SEQ ID NO: 92795 - protein, 15 aa, Borrelia burgdorferi B31
EKGELILLNINKIQK

SEQ ID NO: 92796 - protein, 15 aa, Borrelia burgdorferi B31
KGELILLNINKIQKG

SEQ ID NO: 92797 - protein, 15 aa, Borrelia burgdorferi B31
GELILLNINKIQKGI

SEQ ID NO: 92798 - protein, 15 aa, Borrelia burgdorferi B31
ELILLNINKIQKGIK

SEQ ID NO: 92799 - protein, 15 aa, Borrelia burgdorferi B31
LILLNINKIQKGIKE

SEQ ID NO: 92800 - protein, 15 aa, Borrelia burgdorferi B31
ILLNINKIQKGIKEI

SEQ ID NO: 92801 - protein, 15 aa, Borrelia burgdorferi B31
LLNINKIQKGIKEIN

SEQ ID NO: 92802 - protein, 15 aa, Borrelia burgdorferi B31
LNINKIQKGIKEINL

SEQ ID NO: 92803 - protein, 15 aa, Borrelia burgdorferi B31
NINKIQKGIKEINLL

SEQ ID NO: 92804 - protein, 15 aa, Borrelia burgdorferi B31
INKIQKGIKEINLLN

SEQ ID NO: 92805 - protein, 15 aa, Borrelia burgdorferi B31
NKIQKGIKEINLLNY

SEQ ID NO: 92806 - protein, 15 aa, Borrelia burgdorferi B31
KIQKGIKEINLLNYK

SEQ ID NO: 92807 - protein, 15 aa, Borrelia burgdorferi B31
IQKGIKEINLLNYKE

SEQ ID NO: 92808 - protein, 15 aa, Borrelia burgdorferi B31
QKGIKEINLLNYKEE

SEQ ID NO: 92809 - protein, 15 aa, Borrelia burgdorferi B31
KGIKEINLLNYKEEK

SEQ ID NO: 92810 - protein, 15 aa, Borrelia burgdorferi B31
GIKEINLLNYKEEKI

SEQ ID NO: 92811 - protein, 15 aa, Borrelia burgdorferi B31
IKEINLLNYKEEKIK

SEQ ID NO: 92812 - protein, 15 aa, Borrelia burgdorferi B31
KEINLLNYKEEKIKI

SEQ ID NO: 92813 - protein, 15 aa, Borrelia burgdorferi B31
EINLLNYKEEKIKIS

SEQ ID NO: 92814 - protein, 15 aa, Borrelia burgdorferi B31
INLLNYKEEKIKISL

SEQ ID NO: 92815 - protein, 15 aa, Borrelia burgdorferi B31
NLLNYKEEKIKISLN

SEQ ID NO: 92816 - protein, 15 aa, Borrelia burgdorferi B31
LLNYKEEKIKISLNQ

SEQ ID NO: 92817 - protein, 15 aa, Borrelia burgdorferi B31
LNYKEEKIKISLNQS

SEQ ID NO: 92818 - protein, 15 aa, Borrelia burgdorferi B31
NYKEEKIKISLNQSL

SEQ ID NO: 92819 - protein, 15 aa, Borrelia burgdorferi B31
YKEEKIKISLNQSLS

SEQ ID NO: 92820 - protein, 15 aa, Borrelia burgdorferi B31
KEEKIKISLNQSLSP

SEQ ID NO: 92821 - protein, 15 aa, Borrelia burgdorferi B31
EEKIKISLNQSLSPK

SEQ ID NO: 92822 - protein, 15 aa, Borrelia burgdorferi B31
EKIKISLNQSLSPKE

SEQ ID NO: 92823 - protein, 15 aa, Borrelia burgdorferi B31
KIKISLNQSLSPKEN

SEQ ID NO: 92824 - protein, 15 aa, Borrelia burgdorferi B31
IKISLNQSLSPKENA

SEQ ID NO: 92825 - protein, 15 aa, Borrelia burgdorferi B31
KISLNQSLSPKENAL

SEQ ID NO: 92826 - protein, 15 aa, Borrelia burgdorferi B31
ISLNQSLSPKENALQ

SEQ ID NO: 92827 - protein, 15 aa, Borrelia burgdorferi B31
SLNQSLSPKENALQY

SEQ ID NO: 92828 - protein, 15 aa, Borrelia burgdorferi B31
LNQSLSPKENALQYF

SEQ ID NO: 92829 - protein, 15 aa, Borrelia burgdorferi B31
NQSLSPKENALQYFK

SEQ ID NO: 92830 - protein, 15 aa, Borrelia burgdorferi B31
QSLSPKENALQYFKA

SEQ ID NO: 92831 - protein, 15 aa, Borrelia burgdorferi B31
SLSPKENALQYFKAY

SEQ ID NO: 92832 - protein, 15 aa, Borrelia burgdorferi B31
LSPKENALQYFKAYK

SEQ ID NO: 92833 - protein, 15 aa, Borrelia burgdorferi B31
SPKENALQYFKAYKK

SEQ ID NO: 92834 - protein, 15 aa, Borrelia burgdorferi B31
PKENALQYFKAYKKG

SEQ ID NO: 92835 - protein, 15 aa, Borrelia burgdorferi B31
KENALQYFKAYKKGK

SEQ ID NO: 92836 - protein, 15 aa, Borrelia burgdorferi B31
ENALQYFKAYKKGKN

SEQ ID NO: 92837 - protein, 15 aa, Borrelia burgdorferi B31
NALQYFKAYKKGKNS

SEQ ID NO: 92838 - protein, 15 aa, Borrelia burgdorferi B31
ALQYFKAYKKGKNSF

SEQ ID NO: 92839 - protein, 15 aa, Borrelia burgdorferi B31
LQYFKAYKKGKNSFK

SEQ ID NO: 92840 - protein, 15 aa, Borrelia burgdorferi B31
QYFKAYKKGKNSFKT

SEQ ID NO: 92841 - protein, 15 aa, Borrelia burgdorferi B31
YFKAYKKGKNSFKTI

SEQ ID NO: 92842 - protein, 15 aa, Borrelia burgdorferi B31
FKAYKKGKNSFKTIQ

SEQ ID NO: 92843 - protein, 15 aa, Borrelia burgdorferi B31
KAYKKGKNSFKTIQN

SEQ ID NO: 92844 - protein, 15 aa, Borrelia burgdorferi B31
AYKKGKNSFKTIQNQ

SEQ ID NO: 92845 - protein, 15 aa, Borrelia burgdorferi B31
YKKGKNSFKTIQNQL

SEQ ID NO: 92846 - protein, 15 aa, Borrelia burgdorferi B31
KKGKNSFKTIQNQLK

SEQ ID NO: 92847 - protein, 15 aa, Borrelia burgdorferi B31
KGKNSFKTIQNQLKD

SEQ ID NO: 92848 - protein, 15 aa, Borrelia burgdorferi B31
GKNSFKTIQNQLKDN

SEQ ID NO: 92849 - protein, 15 aa, Borrelia burgdorferi B31
KNSFKTIQNQLKDNL

SEQ ID NO: 92850 - protein, 15 aa, Borrelia burgdorferi B31
NSFKTIQNQLKDNLD

SEQ ID NO: 92851 - protein, 15 aa, Borrelia burgdorferi B31
SFKTIQNQLKDNLDK

SEQ ID NO: 92852 - protein, 15 aa, Borrelia burgdorferi B31
FKTIQNQLKDNLDKF

SEQ ID NO: 92853 - protein, 15 aa, Borrelia burgdorferi B31
KTIQNQLKDNLDKFN

SEQ ID NO: 92854 - protein, 15 aa, Borrelia burgdorferi B31
TIQNQLKDNLDKFNL

SEQ ID NO: 92855 - protein, 15 aa, Borrelia burgdorferi B31
IQNQLKDNLDKFNLI

SEQ ID NO: 92856 - protein, 15 aa, Borrelia burgdorferi B31
QNQLKDNLDKFNLIQ

SEQ ID NO: 92857 - protein, 15 aa, Borrelia burgdorferi B31
NQLKDNLDKFNLIQS

SEQ ID NO: 92858 - protein, 15 aa, Borrelia burgdorferi B31
QLKDNLDKFNLIQSK

SEQ ID NO: 92859 - protein, 15 aa, Borrelia burgdorferi B31
LKDNLDKFNLIQSKI

SEQ ID NO: 92860 - protein, 15 aa, Borrelia burgdorferi B31
KDNLDKFNLIQSKIT

SEQ ID NO: 92861 - protein, 15 aa, Borrelia burgdorferi B31
DNLDKFNLIQSKITM

SEQ ID NO: 92862 - protein, 15 aa, Borrelia burgdorferi B31
NLDKFNLIQSKITML

SEQ ID NO: 92863 - protein, 15 aa, Borrelia burgdorferi B31
LDKFNLIQSKITMLK

SEQ ID NO: 92864 - protein, 15 aa, Borrelia burgdorferi B31
DKFNLIQSKITMLKV

SEQ ID NO: 92865 - protein, 15 aa, Borrelia burgdorferi B31
KFNLIQSKITMLKVE

SEQ ID NO: 92866 - protein, 15 aa, Borrelia burgdorferi B31
FNLIQSKITMLKVEN

SEQ ID NO: 92867 - protein, 15 aa, Borrelia burgdorferi B31
NLIQSKITMLKVENL

SEQ ID NO: 92868 - protein, 15 aa, Borrelia burgdorferi B31
LIQSKITMLKVENLI

SEQ ID NO: 92869 - protein, 15 aa, Borrelia burgdorferi B31
IQSKITMLKVENLIP

SEQ ID NO: 92870 - protein, 15 aa, Borrelia burgdorferi B31
QSKITMLKVENLIPE

SEQ ID NO: 92871 - protein, 15 aa, Borrelia burgdorferi B31
SKITMLKVENLIPEE

SEQ ID NO: 92872 - protein, 15 aa, Borrelia burgdorferi B31
KITMLKVENLIPEEE

SEQ ID NO: 92873 - protein, 15 aa, Borrelia burgdorferi B31
ITMLKVENLIPEEEY

SEQ ID NO: 92874 - protein, 15 aa, Borrelia burgdorferi B31
TMLKVENLIPEEEYN

SEQ ID NO: 92875 - protein, 15 aa, Borrelia burgdorferi B31
MLKVENLIPEEEYNQ

SEQ ID NO: 92876 - protein, 15 aa, Borrelia burgdorferi B31
LKVENLIPEEEYNQE

SEQ ID NO: 92877 - protein, 15 aa, Borrelia burgdorferi B31
KVENLIPEEEYNQEK

SEQ ID NO: 92878 - protein, 15 aa, Borrelia burgdorferi B31
VENLIPEEEYNQEKT

SEQ ID NO: 92879 - protein, 15 aa, Borrelia burgdorferi B31
ENLIPEEEYNQEKTA

SEQ ID NO: 92880 - protein, 15 aa, Borrelia burgdorferi B31
NLIPEEEYNQEKTAI

SEQ ID NO: 92881 - protein, 15 aa, Borrelia burgdorferi B31
LIPEEEYNQEKTAIK

SEQ ID NO: 92882 - protein, 15 aa, Borrelia burgdorferi B31
IPEEEYNQEKTAIKE

SEQ ID NO: 92883 - protein, 15 aa, Borrelia burgdorferi B31
PEEEYNQEKTAIKEK

SEQ ID NO: 92884 - protein, 15 aa, Borrelia burgdorferi B31
EEEYNQEKTAIKEKE

SEQ ID NO: 92885 - protein, 15 aa, Borrelia burgdorferi B31
EEYNQEKTAIKEKEK

SEQ ID NO: 92886 - protein, 15 aa, Borrelia burgdorferi B31
EYNQEKTAIKEKEKT

SEQ ID NO: 92887 - protein, 15 aa, Borrelia burgdorferi B31
YNQEKTAIKEKEKTP

SEQ ID NO: 92888 - protein, 15 aa, Borrelia burgdorferi B31
NQEKTAIKEKEKTPK

SEQ ID NO: 92889 - protein, 15 aa, Borrelia burgdorferi B31
QEKTAIKEKEKTPKI

SEQ ID NO: 92890 - protein, 15 aa, Borrelia burgdorferi B31
EKTAIKEKEKTPKIG

SEQ ID NO: 92891 - protein, 15 aa, Borrelia burgdorferi B31
KTAIKEKEKTPKIGL

SEQ ID NO: 92892 - protein, 15 aa, Borrelia burgdorferi B31
TAIKEKEKTPKIGLH

SEQ ID NO: 92893 - protein, 15 aa, Borrelia burgdorferi B31
AIKEKEKTPKIGLHF

SEQ ID NO: 92894 - protein, 15 aa, Borrelia burgdorferi B31
IKEKEKTPKIGLHFT

SEQ ID NO: 92895 - protein, 15 aa, Borrelia burgdorferi B31
KEKEKTPKIGLHFTY

SEQ ID NO: 92896 - protein, 15 aa, Borrelia burgdorferi B31
EKEKTPKIGLHFTYC

SEQ ID NO: 92897 - protein, 15 aa, Borrelia burgdorferi B31
KEKTPKIGLHFTYCG

SEQ ID NO: 92898 - protein, 15 aa, Borrelia burgdorferi B31
EKTPKIGLHFTYCGF

SEQ ID NO: 92899 - protein, 15 aa, Borrelia burgdorferi B31
KTPKIGLHFTYCGFE

SEQ ID NO: 92900 - protein, 15 aa, Borrelia burgdorferi B31
TPKIGLHFTYCGFEI

SEQ ID NO: 92901 - protein, 15 aa, Borrelia burgdorferi B31
PKIGLHFTYCGFEIL

SEQ ID NO: 92902 - protein, 15 aa, Borrelia burgdorferi B31
KIGLHFTYCGFEILI

SEQ ID NO: 92903 - protein, 15 aa, Borrelia burgdorferi B31
IGLHFTYCGFEILIG

SEQ ID NO: 92904 - protein, 15 aa, Borrelia burgdorferi B31
GLHFTYCGFEILIGR

SEQ ID NO: 92905 - protein, 15 aa, Borrelia burgdorferi B31
LHFTYCGFEILIGRN

SEQ ID NO: 92906 - protein, 15 aa, Borrelia burgdorferi B31
HFTYCGFEILIGRNA

SEQ ID NO: 92907 - protein, 15 aa, Borrelia burgdorferi B31
FTYCGFEILIGRNAK

SEQ ID NO: 92908 - protein, 15 aa, Borrelia burgdorferi B31
TYCGFEILIGRNAKE

SEQ ID NO: 92909 - protein, 15 aa, Borrelia burgdorferi B31
YCGFEILIGRNAKEN

SEQ ID NO: 92910 - protein, 15 aa, Borrelia burgdorferi B31
CGFEILIGRNAKEND

SEQ ID NO: 92911 - protein, 15 aa, Borrelia burgdorferi B31
GFEILIGRNAKENDK

SEQ ID NO: 92912 - protein, 15 aa, Borrelia burgdorferi B31
FEILIGRNAKENDKL

SEQ ID NO: 92913 - protein, 15 aa, Borrelia burgdorferi B31
EILIGRNAKENDKLL

SEQ ID NO: 92914 - protein, 15 aa, Borrelia burgdorferi B31
ILIGRNAKENDKLLR

SEQ ID NO: 92915 - protein, 15 aa, Borrelia burgdorferi B31
LIGRNAKENDKLLRH

SEQ ID NO: 92916 - protein, 15 aa, Borrelia burgdorferi B31
IGRNAKENDKLLRHC

SEQ ID NO: 92917 - protein, 15 aa, Borrelia burgdorferi B31
GRNAKENDKLLRHCV

SEQ ID NO: 92918 - protein, 15 aa, Borrelia burgdorferi B31
RNAKENDKLLRHCVK

SEQ ID NO: 92919 - protein, 15 aa, Borrelia burgdorferi B31
NAKENDKLLRHCVKG

SEQ ID NO: 92920 - protein, 15 aa, Borrelia burgdorferi B31
AKENDKLLRHCVKGN

SEQ ID NO: 92921 - protein, 15 aa, Borrelia burgdorferi B31
KENDKLLRHCVKGND

SEQ ID NO: 92922 - protein, 15 aa, Borrelia burgdorferi B31
ENDKLLRHCVKGNDY

SEQ ID NO: 92923 - protein, 15 aa, Borrelia burgdorferi B31
NDKLLRHCVKGNDYW

SEQ ID NO: 92924 - protein, 15 aa, Borrelia burgdorferi B31
DKLLRHCVKGNDYWL

SEQ ID NO: 92925 - protein, 15 aa, Borrelia burgdorferi B31
KLLRHCVKGNDYWLH

SEQ ID NO: 92926 - protein, 15 aa, Borrelia burgdorferi B31
LLRHCVKGNDYWLHT

SEQ ID NO: 92927 - protein, 15 aa, Borrelia burgdorferi B31
LRHCVKGNDYWLHTR

SEQ ID NO: 92928 - protein, 15 aa, Borrelia burgdorferi B31
RHCVKGNDYWLHTRD

SEQ ID NO: 92929 - protein, 15 aa, Borrelia burgdorferi B31
HCVKGNDYWLHTRDY

SEQ ID NO: 92930 - protein, 15 aa, Borrelia burgdorferi B31
CVKGNDYWLHTRDYP

SEQ ID NO: 92931 - protein, 15 aa, Borrelia burgdorferi B31
VKGNDYWLHTRDYPG

SEQ ID NO: 92932 - protein, 15 aa, Borrelia burgdorferi B31
KGNDYWLHTRDYPGA

SEQ ID NO: 92933 - protein, 15 aa, Borrelia burgdorferi B31
GNDYWLHTRDYPGAY

SEQ ID NO: 92934 - protein, 15 aa, Borrelia burgdorferi B31
NDYWLHTRDYPGAYV

SEQ ID NO: 92935 - protein, 15 aa, Borrelia burgdorferi B31
DYWLHTRDYPGAYVF

SEQ ID NO: 92936 - protein, 15 aa, Borrelia burgdorferi B31
YWLHTRDYPGAYVFI

SEQ ID NO: 92937 - protein, 15 aa, Borrelia burgdorferi B31
WLHTRDYPGAYVFIK

SEQ ID NO: 92938 - protein, 15 aa, Borrelia burgdorferi B31
LHTRDYPGAYVFIKN

SEQ ID NO: 92939 - protein, 15 aa, Borrelia burgdorferi B31
HTRDYPGAYVFIKNQ

SEQ ID NO: 92940 - protein, 15 aa, Borrelia burgdorferi B31
TRDYPGAYVFIKNQK

SEQ ID NO: 92941 - protein, 15 aa, Borrelia burgdorferi B31
RDYPGAYVFIKNQKN

SEQ ID NO: 92942 - protein, 15 aa, Borrelia burgdorferi B31
DYPGAYVFIKNQKNK

SEQ ID NO: 92943 - protein, 15 aa, Borrelia burgdorferi B31
YPGAYVFIKNQKNKT

SEQ ID NO: 92944 - protein, 15 aa, Borrelia burgdorferi B31
PGAYVFIKNQKNKTP

SEQ ID NO: 92945 - protein, 15 aa, Borrelia burgdorferi B31
GAYVFIKNQKNKTPS

SEQ ID NO: 92946 - protein, 15 aa, Borrelia burgdorferi B31
AYVFIKNQKNKTPSL

SEQ ID NO: 92947 - protein, 15 aa, Borrelia burgdorferi B31
YVFIKNQKNKTPSLD

SEQ ID NO: 92948 - protein, 15 aa, Borrelia burgdorferi B31
VFIKNQKNKTPSLDV

SEQ ID NO: 92949 - protein, 15 aa, Borrelia burgdorferi B31
FIKNQKNKTPSLDVL

SEQ ID NO: 92950 - protein, 15 aa, Borrelia burgdorferi B31
IKNQKNKTPSLDVLL

SEQ ID NO: 92951 - protein, 15 aa, Borrelia burgdorferi B31
KNQKNKTPSLDVLLG

SEQ ID NO: 92952 - protein, 15 aa, Borrelia burgdorferi B31
NQKNKTPSLDVLLGA

SEQ ID NO: 92953 - protein, 15 aa, Borrelia burgdorferi B31
QKNKTPSLDVLLGAG

SEQ ID NO: 92954 - protein, 15 aa, Borrelia burgdorferi B31
KNKTPSLDVLLGAGN

SEQ ID NO: 92955 - protein, 15 aa, Borrelia burgdorferi B31
NKTPSLDVLLGAGNL

SEQ ID NO: 92956 - protein, 15 aa, Borrelia burgdorferi B31
KTPSLDVLLGAGNLC

SEQ ID NO: 92957 - protein, 15 aa, Borrelia burgdorferi B31
TPSLDVLLGAGNLCV

SEQ ID NO: 92958 - protein, 15 aa, Borrelia burgdorferi B31
PSLDVLLGAGNLCVF

SEQ ID NO: 92959 - protein, 15 aa, Borrelia burgdorferi B31
SLDVLLGAGNLCVFY

SEQ ID NO: 92960 - protein, 15 aa, Borrelia burgdorferi B31
LDVLLGAGNLCVFYT

SEQ ID NO: 92961 - protein, 15 aa, Borrelia burgdorferi B31
DVLLGAGNLCVFYTK

SEQ ID NO: 92962 - protein, 15 aa, Borrelia burgdorferi B31
VLLGAGNLCVFYTKL

SEQ ID NO: 92963 - protein, 15 aa, Borrelia burgdorferi B31
LLGAGNLCVFYTKLA

SEQ ID NO: 92964 - protein, 15 aa, Borrelia burgdorferi B31
LGAGNLCVFYTKLAK

SEQ ID NO: 92965 - protein, 15 aa, Borrelia burgdorferi B31
GAGNLCVFYTKLAKK

SEQ ID NO: 92966 - protein, 15 aa, Borrelia burgdorferi B31
AGNLCVFYTKLAKKS

SEQ ID NO: 92967 - protein, 15 aa, Borrelia burgdorferi B31
GNLCVFYTKLAKKSG

SEQ ID NO: 92968 - protein, 15 aa, Borrelia burgdorferi B31
NLCVFYTKLAKKSGK

SEQ ID NO: 92969 - protein, 15 aa, Borrelia burgdorferi B31
LCVFYTKLAKKSGKA

SEQ ID NO: 92970 - protein, 15 aa, Borrelia burgdorferi B31
CVFYTKLAKKSGKAD

SEQ ID NO: 92971 - protein, 15 aa, Borrelia burgdorferi B31
VFYTKLAKKSGKADL

SEQ ID NO: 92972 - protein, 15 aa, Borrelia burgdorferi B31
FYTKLAKKSGKADLY

SEQ ID NO: 92973 - protein, 15 aa, Borrelia burgdorferi B31
YTKLAKKSGKADLYY

SEQ ID NO: 92974 - protein, 15 aa, Borrelia burgdorferi B31
TKLAKKSGKADLYYT

SEQ ID NO: 92975 - protein, 15 aa, Borrelia burgdorferi B31
KLAKKSGKADLYYTQ

SEQ ID NO: 92976 - protein, 15 aa, Borrelia burgdorferi B31
LAKKSGKADLYYTQV

SEQ ID NO: 92977 - protein, 15 aa, Borrelia burgdorferi B31
AKKSGKADLYYTQVK

SEQ ID NO: 92978 - protein, 15 aa, Borrelia burgdorferi B31
KKSGKADLYYTQVKN

SEQ ID NO: 92979 - protein, 15 aa, Borrelia burgdorferi B31
KSGKADLYYTQVKNL

SEQ ID NO: 92980 - protein, 15 aa, Borrelia burgdorferi B31
SGKADLYYTQVKNLR

SEQ ID NO: 92981 - protein, 15 aa, Borrelia burgdorferi B31
GKADLYYTQVKNLRR

SEQ ID NO: 92982 - protein, 15 aa, Borrelia burgdorferi B31
KADLYYTQVKNLRRV

SEQ ID NO: 92983 - protein, 15 aa, Borrelia burgdorferi B31
ADLYYTQVKNLRRVK

SEQ ID NO: 92984 - protein, 15 aa, Borrelia burgdorferi B31
DLYYTQVKNLRRVKN

SEQ ID NO: 92985 - protein, 15 aa, Borrelia burgdorferi B31
LYYTQVKNLRRVKNK

SEQ ID NO: 92986 - protein, 15 aa, Borrelia burgdorferi B31
YYTQVKNLRRVKNKK

SEQ ID NO: 92987 - protein, 15 aa, Borrelia burgdorferi B31
YTQVKNLRRVKNKKL

SEQ ID NO: 92988 - protein, 15 aa, Borrelia burgdorferi B31
TQVKNLRRVKNKKLG

SEQ ID NO: 92989 - protein, 15 aa, Borrelia burgdorferi B31
QVKNLRRVKNKKLGL

SEQ ID NO: 92990 - protein, 15 aa, Borrelia burgdorferi B31
VKNLRRVKNKKLGLV

SEQ ID NO: 92991 - protein, 15 aa, Borrelia burgdorferi B31
KNLRRVKNKKLGLVI

SEQ ID NO: 92992 - protein, 15 aa, Borrelia burgdorferi B31
NLRRVKNKKLGLVIP

SEQ ID NO: 92993 - protein, 15 aa, Borrelia burgdorferi B31
LRRVKNKKLGLVIPK

SEQ ID NO: 92994 - protein, 15 aa, Borrelia burgdorferi B31
RRVKNKKLGLVIPKA

SEQ ID NO: 92995 - protein, 15 aa, Borrelia burgdorferi B31
RVKNKKLGLVIPKAE

SEQ ID NO: 92996 - protein, 15 aa, Borrelia burgdorferi B31
VKNKKLGLVIPKAEK

SEQ ID NO: 92997 - protein, 15 aa, Borrelia burgdorferi B31
KNKKLGLVIPKAEKN

SEQ ID NO: 92998 - protein, 15 aa, Borrelia burgdorferi B31
NKKLGLVIPKAEKNL

SEQ ID NO: 92999 - protein, 15 aa, Borrelia burgdorferi B31
KKLGLVIPKAEKNLH

SEQ ID NO: 93000 - protein, 15 aa, Borrelia burgdorferi B31
KLGLVIPKAEKNLHI

SEQ ID NO: 93001 - protein, 15 aa, Borrelia burgdorferi B31
LGLVIPKAEKNLHIK

SEQ ID NO: 93002 - protein, 15 aa, Borrelia burgdorferi B31
GLVIPKAEKNLHIKL

SEQ ID NO: 93003 - protein, 15 aa, Borrelia burgdorferi B31
LVIPKAEKNLHIKLD

SEQ ID NO: 93004 - protein, 15 aa, Borrelia burgdorferi B31
VIPKAEKNLHIKLDE

SEQ ID NO: 93005 - protein, 15 aa, Borrelia burgdorferi B31
IPKAEKNLHIKLDEN

SEQ ID NO: 93006 - protein, 15 aa, Borrelia burgdorferi B31
PKAEKNLHIKLDENL

SEQ ID NO: 93007 - protein, 15 aa, Borrelia burgdorferi B31
KAEKNLHIKLDENLI

SEQ ID NO: 93008 - protein, 15 aa, Borrelia burgdorferi B31
AEKNLHIKLDENLIK

SEQ ID NO: 93009 - protein, 15 aa, Borrelia burgdorferi B31
EKNLHIKLDENLIKK

SEQ ID NO: 93010 - protein, 15 aa, Borrelia burgdorferi B31
KNLHIKLDENLIKKI

SEQ ID NO: 93011 - protein, 15 aa, Borrelia burgdorferi B31
NLHIKLDENLIKKIK

SEQ ID NO: 93012 - protein, 15 aa, Borrelia burgdorferi B31
LHIKLDENLIKKIKN

SEQ ID NO: 93013 - protein, 15 aa, Borrelia burgdorferi B31
HIKLDENLIKKIKNQ

SEQ ID NO: 93014 - protein, 15 aa, Borrelia burgdorferi B31
IKLDENLIKKIKNQT

SEQ ID NO: 93015 - protein, 16 aa, Borrelia burgdorferi B31
MIKMSLNYTEINTLIK

SEQ ID NO: 93016 - protein, 16 aa, Borrelia burgdorferi B31
IKMSLNYTEINTLIKE

SEQ ID NO: 93017 - protein, 16 aa, Borrelia burgdorferi B31
KMSLNYTEINTLIKEI

SEQ ID NO: 93018 - protein, 16 aa, Borrelia burgdorferi B31
MSLNYTEINTLIKEIP

SEQ ID NO: 93019 - protein, 16 aa, Borrelia burgdorferi B31
SLNYTEINTLIKEIPF

SEQ ID NO: 93020 - protein, 16 aa, Borrelia burgdorferi B31
LNYTEINTLIKEIPFT

SEQ ID NO: 93021 - protein, 16 aa, Borrelia burgdorferi B31
NYTEINTLIKEIPFTN

SEQ ID NO: 93022 - protein, 16 aa, Borrelia burgdorferi B31
YTEINTLIKEIPFTNS

SEQ ID NO: 93023 - protein, 16 aa, Borrelia burgdorferi B31
TEINTLIKEIPFTNSL

SEQ ID NO: 93024 - protein, 16 aa, Borrelia burgdorferi B31
EINTLIKEIPFTNSLI

SEQ ID NO: 93025 - protein, 16 aa, Borrelia burgdorferi B31
INTLIKEIPFTNSLIT

SEQ ID NO: 93026 - protein, 16 aa, Borrelia burgdorferi B31
NTLIKEIPFTNSLITK

SEQ ID NO: 93027 - protein, 16 aa, Borrelia burgdorferi B31
TLIKEIPFTNSLITKI

SEQ ID NO: 93028 - protein, 16 aa, Borrelia burgdorferi B31
LIKEIPFTNSLITKII

SEQ ID NO: 93029 - protein, 16 aa, Borrelia burgdorferi B31
IKEIPFTNSLITKIIQ

SEQ ID NO: 93030 - protein, 16 aa, Borrelia burgdorferi B31
KEIPFTNSLITKIIQP

SEQ ID NO: 93031 - protein, 16 aa, Borrelia burgdorferi B31
EIPFTNSLITKIIQPD

SEQ ID NO: 93032 - protein, 16 aa, Borrelia burgdorferi B31
IPFTNSLITKIIQPDY

SEQ ID NO: 93033 - protein, 16 aa, Borrelia burgdorferi B31
PFTNSLITKIIQPDYK

SEQ ID NO: 93034 - protein, 16 aa, Borrelia burgdorferi B31
FTNSLITKIIQPDYKS

SEQ ID NO: 93035 - protein, 16 aa, Borrelia burgdorferi B31
TNSLITKIIQPDYKSL

SEQ ID NO: 93036 - protein, 16 aa, Borrelia burgdorferi B31
NSLITKIIQPDYKSLV

SEQ ID NO: 93037 - protein, 16 aa, Borrelia burgdorferi B31
SLITKIIQPDYKSLVL

SEQ ID NO: 93038 - protein, 16 aa, Borrelia burgdorferi B31
LITKIIQPDYKSLVLE

SEQ ID NO: 93039 - protein, 16 aa, Borrelia burgdorferi B31
ITKIIQPDYKSLVLEI

SEQ ID NO: 93040 - protein, 16 aa, Borrelia burgdorferi B31
TKIIQPDYKSLVLEIY

SEQ ID NO: 93041 - protein, 16 aa, Borrelia burgdorferi B31
KIIQPDYKSLVLEIYN

SEQ ID NO: 93042 - protein, 16 aa, Borrelia burgdorferi B31
IIQPDYKSLVLEIYNK

SEQ ID NO: 93043 - protein, 16 aa, Borrelia burgdorferi B31
IQPDYKSLVLEIYNKI

SEQ ID NO: 93044 - protein, 16 aa, Borrelia burgdorferi B31
QPDYKSLVLEIYNKID

SEQ ID NO: 93045 - protein, 16 aa, Borrelia burgdorferi B31
PDYKSLVLEIYNKIDN

SEQ ID NO: 93046 - protein, 16 aa, Borrelia burgdorferi B31
DYKSLVLEIYNKIDNK

SEQ ID NO: 93047 - protein, 16 aa, Borrelia burgdorferi B31
YKSLVLEIYNKIDNKK

SEQ ID NO: 93048 - protein, 16 aa, Borrelia burgdorferi B31
KSLVLEIYNKIDNKKF

SEQ ID NO: 93049 - protein, 16 aa, Borrelia burgdorferi B31
SLVLEIYNKIDNKKFK

SEQ ID NO: 93050 - protein, 16 aa, Borrelia burgdorferi B31
LVLEIYNKIDNKKFKI

SEQ ID NO: 93051 - protein, 16 aa, Borrelia burgdorferi B31
VLEIYNKIDNKKFKIL

SEQ ID NO: 93052 - protein, 16 aa, Borrelia burgdorferi B31
LEIYNKIDNKKFKILI

SEQ ID NO: 93053 - protein, 16 aa, Borrelia burgdorferi B31
EIYNKIDNKKFKILIC

SEQ ID NO: 93054 - protein, 16 aa, Borrelia burgdorferi B31
IYNKIDNKKFKILICL

SEQ ID NO: 93055 - protein, 16 aa, Borrelia burgdorferi B31
YNKIDNKKFKILICLN

SEQ ID NO: 93056 - protein, 16 aa, Borrelia burgdorferi B31
NKIDNKKFKILICLNP

SEQ ID NO: 93057 - protein, 16 aa, Borrelia burgdorferi B31
KIDNKKFKILICLNPN

SEQ ID NO: 93058 - protein, 16 aa, Borrelia burgdorferi B31
IDNKKFKILICLNPNT

SEQ ID NO: 93059 - protein, 16 aa, Borrelia burgdorferi B31
DNKKFKILICLNPNTT

SEQ ID NO: 93060 - protein, 16 aa, Borrelia burgdorferi B31
NKKFKILICLNPNTTR

SEQ ID NO: 93061 - protein, 16 aa, Borrelia burgdorferi B31
KKFKILICLNPNTTRF

SEQ ID NO: 93062 - protein, 16 aa, Borrelia burgdorferi B31
KFKILICLNPNTTRFH

SEQ ID NO: 93063 - protein, 16 aa, Borrelia burgdorferi B31
FKILICLNPNTTRFHI

SEQ ID NO: 93064 - protein, 16 aa, Borrelia burgdorferi B31
KILICLNPNTTRFHIT

SEQ ID NO: 93065 - protein, 16 aa, Borrelia burgdorferi B31
ILICLNPNTTRFHITK

SEQ ID NO: 93066 - protein, 16 aa, Borrelia burgdorferi B31
LICLNPNTTRFHITKK

SEQ ID NO: 93067 - protein, 16 aa, Borrelia burgdorferi B31
ICLNPNTTRFHITKKN

SEQ ID NO: 93068 - protein, 16 aa, Borrelia burgdorferi B31
CLNPNTTRFHITKKNF

SEQ ID NO: 93069 - protein, 16 aa, Borrelia burgdorferi B31
LNPNTTRFHITKKNFK

SEQ ID NO: 93070 - protein, 16 aa, Borrelia burgdorferi B31
NPNTTRFHITKKNFKK

SEQ ID NO: 93071 - protein, 16 aa, Borrelia burgdorferi B31
PNTTRFHITKKNFKKN

SEQ ID NO: 93072 - protein, 16 aa, Borrelia burgdorferi B31
NTTRFHITKKNFKKNA

SEQ ID NO: 93073 - protein, 16 aa, Borrelia burgdorferi B31
TTRFHITKKNFKKNAL

SEQ ID NO: 93074 - protein, 16 aa, Borrelia burgdorferi B31
TRFHITKKNFKKNALK

SEQ ID NO: 93075 - protein, 16 aa, Borrelia burgdorferi B31
RFHITKKNFKKNALKL

SEQ ID NO: 93076 - protein, 16 aa, Borrelia burgdorferi B31
FHITKKNFKKNALKLR

SEQ ID NO: 93077 - protein, 16 aa, Borrelia burgdorferi B31
HITKKNFKKNALKLRF

SEQ ID NO: 93078 - protein, 16 aa, Borrelia burgdorferi B31
ITKKNFKKNALKLRFS

SEQ ID NO: 93079 - protein, 16 aa, Borrelia burgdorferi B31
TKKNFKKNALKLRFSD

SEQ ID NO: 93080 - protein, 16 aa, Borrelia burgdorferi B31
KKNFKKNALKLRFSDF

SEQ ID NO: 93081 - protein, 16 aa, Borrelia burgdorferi B31
KNFKKNALKLRFSDFL

SEQ ID NO: 93082 - protein, 16 aa, Borrelia burgdorferi B31
NFKKNALKLRFSDFLK

SEQ ID NO: 93083 - protein, 16 aa, Borrelia burgdorferi B31
FKKNALKLRFSDFLKS

SEQ ID NO: 93084 - protein, 16 aa, Borrelia burgdorferi B31
KKNALKLRFSDFLKSK

SEQ ID NO: 93085 - protein, 16 aa, Borrelia burgdorferi B31
KNALKLRFSDFLKSKI

SEQ ID NO: 93086 - protein, 16 aa, Borrelia burgdorferi B31
NALKLRFSDFLKSKIQ

SEQ ID NO: 93087 - protein, 16 aa, Borrelia burgdorferi B31
ALKLRFSDFLKSKIQN

SEQ ID NO: 93088 - protein, 16 aa, Borrelia burgdorferi B31
LKLRFSDFLKSKIQNG

SEQ ID NO: 93089 - protein, 16 aa, Borrelia burgdorferi B31
KLRFSDFLKSKIQNGK

SEQ ID NO: 93090 - protein, 16 aa, Borrelia burgdorferi B31
LRFSDFLKSKIQNGKI

SEQ ID NO: 93091 - protein, 16 aa, Borrelia burgdorferi B31
RFSDFLKSKIQNGKII

SEQ ID NO: 93092 - protein, 16 aa, Borrelia burgdorferi B31
FSDFLKSKIQNGKIIK

SEQ ID NO: 93093 - protein, 16 aa, Borrelia burgdorferi B31
SDFLKSKIQNGKIIKA

SEQ ID NO: 93094 - protein, 16 aa, Borrelia burgdorferi B31
DFLKSKIQNGKIIKAF

SEQ ID NO: 93095 - protein, 16 aa, Borrelia burgdorferi B31
FLKSKIQNGKIIKAFQ

SEQ ID NO: 93096 - protein, 16 aa, Borrelia burgdorferi B31
LKSKIQNGKIIKAFQM

SEQ ID NO: 93097 - protein, 16 aa, Borrelia burgdorferi B31
KSKIQNGKIIKAFQMK

SEQ ID NO: 93098 - protein, 16 aa, Borrelia burgdorferi B31
SKIQNGKIIKAFQMKN

SEQ ID NO: 93099 - protein, 16 aa, Borrelia burgdorferi B31
KIQNGKIIKAFQMKNE

SEQ ID NO: 93100 - protein, 16 aa, Borrelia burgdorferi B31
IQNGKIIKAFQMKNER

SEQ ID NO: 93101 - protein, 16 aa, Borrelia burgdorferi B31
QNGKIIKAFQMKNERI

SEQ ID NO: 93102 - protein, 16 aa, Borrelia burgdorferi B31
NGKIIKAFQMKNERII

SEQ ID NO: 93103 - protein, 16 aa, Borrelia burgdorferi B31
GKIIKAFQMKNERIIS

SEQ ID NO: 93104 - protein, 16 aa, Borrelia burgdorferi B31
KIIKAFQMKNERIISL

SEQ ID NO: 93105 - protein, 16 aa, Borrelia burgdorferi B31
IIKAFQMKNERIISLE

SEQ ID NO: 93106 - protein, 16 aa, Borrelia burgdorferi B31
IKAFQMKNERIISLEI

SEQ ID NO: 93107 - protein, 16 aa, Borrelia burgdorferi B31
KAFQMKNERIISLEIL

SEQ ID NO: 93108 - protein, 16 aa, Borrelia burgdorferi B31
AFQMKNERIISLEILQ

SEQ ID NO: 93109 - protein, 16 aa, Borrelia burgdorferi B31
FQMKNERIISLEILQK

SEQ ID NO: 93110 - protein, 16 aa, Borrelia burgdorferi B31
QMKNERIISLEILQKD

SEQ ID NO: 93111 - protein, 16 aa, Borrelia burgdorferi B31
MKNERIISLEILQKDM

SEQ ID NO: 93112 - protein, 16 aa, Borrelia burgdorferi B31
KNERIISLEILQKDMI

SEQ ID NO: 93113 - protein, 16 aa, Borrelia burgdorferi B31
NERIISLEILQKDMII

SEQ ID NO: 93114 - protein, 16 aa, Borrelia burgdorferi B31
ERIISLEILQKDMIIL

SEQ ID NO: 93115 - protein, 16 aa, Borrelia burgdorferi B31
RIISLEILQKDMIILF

SEQ ID NO: 93116 - protein, 16 aa, Borrelia burgdorferi B31
IISLEILQKDMIILFI

SEQ ID NO: 93117 - protein, 16 aa, Borrelia burgdorferi B31
ISLEILQKDMIILFIK

SEQ ID NO: 93118 - protein, 16 aa, Borrelia burgdorferi B31
SLEILQKDMIILFIKL

SEQ ID NO: 93119 - protein, 16 aa, Borrelia burgdorferi B31
LEILQKDMIILFIKLW

SEQ ID NO: 93120 - protein, 16 aa, Borrelia burgdorferi B31
EILQKDMIILFIKLWP

SEQ ID NO: 93121 - protein, 16 aa, Borrelia burgdorferi B31
ILQKDMIILFIKLWPS

SEQ ID NO: 93122 - protein, 16 aa, Borrelia burgdorferi B31
LQKDMIILFIKLWPSS

SEQ ID NO: 93123 - protein, 16 aa, Borrelia burgdorferi B31
QKDMIILFIKLWPSSP

SEQ ID NO: 93124 - protein, 16 aa, Borrelia burgdorferi B31
KDMIILFIKLWPSSPN

SEQ ID NO: 93125 - protein, 16 aa, Borrelia burgdorferi B31
DMIILFIKLWPSSPNI

SEQ ID NO: 93126 - protein, 16 aa, Borrelia burgdorferi B31
MIILFIKLWPSSPNII

SEQ ID NO: 93127 - protein, 16 aa, Borrelia burgdorferi B31
IILFIKLWPSSPNIIA

SEQ ID NO: 93128 - protein, 16 aa, Borrelia burgdorferi B31
ILFIKLWPSSPNIIAT

SEQ ID NO: 93129 - protein, 16 aa, Borrelia burgdorferi B31
LFIKLWPSSPNIIATN

SEQ ID NO: 93130 - protein, 16 aa, Borrelia burgdorferi B31
FIKLWPSSPNIIATNS

SEQ ID NO: 93131 - protein, 16 aa, Borrelia burgdorferi B31
IKLWPSSPNIIATNSN

SEQ ID NO: 93132 - protein, 16 aa, Borrelia burgdorferi B31
KLWPSSPNIIATNSNF

SEQ ID NO: 93133 - protein, 16 aa, Borrelia burgdorferi B31
LWPSSPNIIATNSNFK

SEQ ID NO: 93134 - protein, 16 aa, Borrelia burgdorferi B31
WPSSPNIIATNSNFKI

SEQ ID NO: 93135 - protein, 16 aa, Borrelia burgdorferi B31
PSSPNIIATNSNFKIL

SEQ ID NO: 93136 - protein, 16 aa, Borrelia burgdorferi B31
SSPNIIATNSNFKILD

SEQ ID NO: 93137 - protein, 16 aa, Borrelia burgdorferi B31
SPNIIATNSNFKILDA

SEQ ID NO: 93138 - protein, 16 aa, Borrelia burgdorferi B31
PNIIATNSNFKILDAY

SEQ ID NO: 93139 - protein, 16 aa, Borrelia burgdorferi B31
NIIATNSNFKILDAYY

SEQ ID NO: 93140 - protein, 16 aa, Borrelia burgdorferi B31
IIATNSNFKILDAYYR

SEQ ID NO: 93141 - protein, 16 aa, Borrelia burgdorferi B31
IATNSNFKILDAYYRR

SEQ ID NO: 93142 - protein, 16 aa, Borrelia burgdorferi B31
ATNSNFKILDAYYRRP

SEQ ID NO: 93143 - protein, 16 aa, Borrelia burgdorferi B31
TNSNFKILDAYYRRPK

SEQ ID NO: 93144 - protein, 16 aa, Borrelia burgdorferi B31
NSNFKILDAYYRRPKI

SEQ ID NO: 93145 - protein, 16 aa, Borrelia burgdorferi B31
SNFKILDAYYRRPKIK

SEQ ID NO: 93146 - protein, 16 aa, Borrelia burgdorferi B31
NFKILDAYYRRPKIKE

SEQ ID NO: 93147 - protein, 16 aa, Borrelia burgdorferi B31
FKILDAYYRRPKIKET

SEQ ID NO: 93148 - protein, 16 aa, Borrelia burgdorferi B31
KILDAYYRRPKIKETT

SEQ ID NO: 93149 - protein, 16 aa, Borrelia burgdorferi B31
ILDAYYRRPKIKETTG

SEQ ID NO: 93150 - protein, 16 aa, Borrelia burgdorferi B31
LDAYYRRPKIKETTGE

SEQ ID NO: 93151 - protein, 16 aa, Borrelia burgdorferi B31
DAYYRRPKIKETTGEI

SEQ ID NO: 93152 - protein, 16 aa, Borrelia burgdorferi B31
AYYRRPKIKETTGEIF

SEQ ID NO: 93153 - protein, 16 aa, Borrelia burgdorferi B31
YYRRPKIKETTGEIFL

SEQ ID NO: 93154 - protein, 16 aa, Borrelia burgdorferi B31
YRRPKIKETTGEIFLK

SEQ ID NO: 93155 - protein, 16 aa, Borrelia burgdorferi B31
RRPKIKETTGEIFLKA

SEQ ID NO: 93156 - protein, 16 aa, Borrelia burgdorferi B31
RPKIKETTGEIFLKAK

SEQ ID NO: 93157 - protein, 16 aa, Borrelia burgdorferi B31
PKIKETTGEIFLKAKE

SEQ ID NO: 93158 - protein, 16 aa, Borrelia burgdorferi B31
KIKETTGEIFLKAKEI

SEQ ID NO: 93159 - protein, 16 aa, Borrelia burgdorferi B31
IKETTGEIFLKAKEIH

SEQ ID NO: 93160 - protein, 16 aa, Borrelia burgdorferi B31
KETTGEIFLKAKEIHE

SEQ ID NO: 93161 - protein, 16 aa, Borrelia burgdorferi B31
ETTGEIFLKAKEIHES

SEQ ID NO: 93162 - protein, 16 aa, Borrelia burgdorferi B31
TTGEIFLKAKEIHESN

SEQ ID NO: 93163 - protein, 16 aa, Borrelia burgdorferi B31
TGEIFLKAKEIHESNK

SEQ ID NO: 93164 - protein, 16 aa, Borrelia burgdorferi B31
GEIFLKAKEIHESNKM

SEQ ID NO: 93165 - protein, 16 aa, Borrelia burgdorferi B31
EIFLKAKEIHESNKMS

SEQ ID NO: 93166 - protein, 16 aa, Borrelia burgdorferi B31
IFLKAKEIHESNKMSD

SEQ ID NO: 93167 - protein, 16 aa, Borrelia burgdorferi B31
FLKAKEIHESNKMSDK

SEQ ID NO: 93168 - protein, 16 aa, Borrelia burgdorferi B31
LKAKEIHESNKMSDKK

SEQ ID NO: 93169 - protein, 16 aa, Borrelia burgdorferi B31
KAKEIHESNKMSDKKI

SEQ ID NO: 93170 - protein, 16 aa, Borrelia burgdorferi B31
AKEIHESNKMSDKKIM

SEQ ID NO: 93171 - protein, 16 aa, Borrelia burgdorferi B31
KEIHESNKMSDKKIME

SEQ ID NO: 93172 - protein, 16 aa, Borrelia burgdorferi B31
EIHESNKMSDKKIMEL

SEQ ID NO: 93173 - protein, 16 aa, Borrelia burgdorferi B31
IHESNKMSDKKIMELK

SEQ ID NO: 93174 - protein, 16 aa, Borrelia burgdorferi B31
HESNKMSDKKIMELKE

SEQ ID NO: 93175 - protein, 16 aa, Borrelia burgdorferi B31
ESNKMSDKKIMELKEE

SEQ ID NO: 93176 - protein, 16 aa, Borrelia burgdorferi B31
SNKMSDKKIMELKEEY

SEQ ID NO: 93177 - protein, 16 aa, Borrelia burgdorferi B31
NKMSDKKIMELKEEYN

SEQ ID NO: 93178 - protein, 16 aa, Borrelia burgdorferi B31
KMSDKKIMELKEEYNN

SEQ ID NO: 93179 - protein, 16 aa, Borrelia burgdorferi B31
MSDKKIMELKEEYNNT

SEQ ID NO: 93180 - protein, 16 aa, Borrelia burgdorferi B31
SDKKIMELKEEYNNTS

SEQ ID NO: 93181 - protein, 16 aa, Borrelia burgdorferi B31
DKKIMELKEEYNNTSY

SEQ ID NO: 93182 - protein, 16 aa, Borrelia burgdorferi B31
KKIMELKEEYNNTSYT

SEQ ID NO: 93183 - protein, 16 aa, Borrelia burgdorferi B31
KIMELKEEYNNTSYTS

SEQ ID NO: 93184 - protein, 16 aa, Borrelia burgdorferi B31
IMELKEEYNNTSYTSY

SEQ ID NO: 93185 - protein, 16 aa, Borrelia burgdorferi B31
MELKEEYNNTSYTSYS

SEQ ID NO: 93186 - protein, 16 aa, Borrelia burgdorferi B31
ELKEEYNNTSYTSYSE

SEQ ID NO: 93187 - protein, 16 aa, Borrelia burgdorferi B31
LKEEYNNTSYTSYSEF

SEQ ID NO: 93188 - protein, 16 aa, Borrelia burgdorferi B31
KEEYNNTSYTSYSEFL

SEQ ID NO: 93189 - protein, 16 aa, Borrelia burgdorferi B31
EEYNNTSYTSYSEFLE

SEQ ID NO: 93190 - protein, 16 aa, Borrelia burgdorferi B31
EYNNTSYTSYSEFLEN

SEQ ID NO: 93191 - protein, 16 aa, Borrelia burgdorferi B31
YNNTSYTSYSEFLENY

SEQ ID NO: 93192 - protein, 16 aa, Borrelia burgdorferi B31
NNTSYTSYSEFLENYY

SEQ ID NO: 93193 - protein, 16 aa, Borrelia burgdorferi B31
NTSYTSYSEFLENYYE

SEQ ID NO: 93194 - protein, 16 aa, Borrelia burgdorferi B31
TSYTSYSEFLENYYES

SEQ ID NO: 93195 - protein, 16 aa, Borrelia burgdorferi B31
SYTSYSEFLENYYESL

SEQ ID NO: 93196 - protein, 16 aa, Borrelia burgdorferi B31
YTSYSEFLENYYESLN

SEQ ID NO: 93197 - protein, 16 aa, Borrelia burgdorferi B31
TSYSEFLENYYESLND

SEQ ID NO: 93198 - protein, 16 aa, Borrelia burgdorferi B31
SYSEFLENYYESLNDQ

SEQ ID NO: 93199 - protein, 16 aa, Borrelia burgdorferi B31
YSEFLENYYESLNDQI

SEQ ID NO: 93200 - protein, 16 aa, Borrelia burgdorferi B31
SEFLENYYESLNDQIK

SEQ ID NO: 93201 - protein, 16 aa, Borrelia burgdorferi B31
EFLENYYESLNDQIKK

SEQ ID NO: 93202 - protein, 16 aa, Borrelia burgdorferi B31
FLENYYESLNDQIKKT

SEQ ID NO: 93203 - protein, 16 aa, Borrelia burgdorferi B31
LENYYESLNDQIKKTN

SEQ ID NO: 93204 - protein, 16 aa, Borrelia burgdorferi B31
ENYYESLNDQIKKTNI

SEQ ID NO: 93205 - protein, 16 aa, Borrelia burgdorferi B31
NYYESLNDQIKKTNIK

SEQ ID NO: 93206 - protein, 16 aa, Borrelia burgdorferi B31
YYESLNDQIKKTNIKE

SEQ ID NO: 93207 - protein, 16 aa, Borrelia burgdorferi B31
YESLNDQIKKTNIKEL

SEQ ID NO: 93208 - protein, 16 aa, Borrelia burgdorferi B31
ESLNDQIKKTNIKELL

SEQ ID NO: 93209 - protein, 16 aa, Borrelia burgdorferi B31
SLNDQIKKTNIKELLI

SEQ ID NO: 93210 - protein, 16 aa, Borrelia burgdorferi B31
LNDQIKKTNIKELLIE

SEQ ID NO: 93211 - protein, 16 aa, Borrelia burgdorferi B31
NDQIKKTNIKELLIEK

SEQ ID NO: 93212 - protein, 16 aa, Borrelia burgdorferi B31
DQIKKTNIKELLIEKY

SEQ ID NO: 93213 - protein, 16 aa, Borrelia burgdorferi B31
QIKKTNIKELLIEKYK

SEQ ID NO: 93214 - protein, 16 aa, Borrelia burgdorferi B31
IKKTNIKELLIEKYKK

SEQ ID NO: 93215 - protein, 16 aa, Borrelia burgdorferi B31
KKTNIKELLIEKYKKE

SEQ ID NO: 93216 - protein, 16 aa, Borrelia burgdorferi B31
KTNIKELLIEKYKKEL

SEQ ID NO: 93217 - protein, 16 aa, Borrelia burgdorferi B31
TNIKELLIEKYKKELI

SEQ ID NO: 93218 - protein, 16 aa, Borrelia burgdorferi B31
NIKELLIEKYKKELIV

SEQ ID NO: 93219 - protein, 16 aa, Borrelia burgdorferi B31
IKELLIEKYKKELIVL

SEQ ID NO: 93220 - protein, 16 aa, Borrelia burgdorferi B31
KELLIEKYKKELIVLE

SEQ ID NO: 93221 - protein, 16 aa, Borrelia burgdorferi B31
ELLIEKYKKELIVLEK

SEQ ID NO: 93222 - protein, 16 aa, Borrelia burgdorferi B31
LLIEKYKKELIVLEKR

SEQ ID NO: 93223 - protein, 16 aa, Borrelia burgdorferi B31
LIEKYKKELIVLEKRI

SEQ ID NO: 93224 - protein, 16 aa, Borrelia burgdorferi B31
IEKYKKELIVLEKRID

SEQ ID NO: 93225 - protein, 16 aa, Borrelia burgdorferi B31
EKYKKELIVLEKRIDS

SEQ ID NO: 93226 - protein, 16 aa, Borrelia burgdorferi B31
KYKKELIVLEKRIDSL

SEQ ID NO: 93227 - protein, 16 aa, Borrelia burgdorferi B31
YKKELIVLEKRIDSLK

SEQ ID NO: 93228 - protein, 16 aa, Borrelia burgdorferi B31
KKELIVLEKRIDSLKQ

SEQ ID NO: 93229 - protein, 16 aa, Borrelia burgdorferi B31
KELIVLEKRIDSLKQQ

SEQ ID NO: 93230 - protein, 16 aa, Borrelia burgdorferi B31
ELIVLEKRIDSLKQQI

SEQ ID NO: 93231 - protein, 16 aa, Borrelia burgdorferi B31
LIVLEKRIDSLKQQIK

SEQ ID NO: 93232 - protein, 16 aa, Borrelia burgdorferi B31
IVLEKRIDSLKQQIKL

SEQ ID NO: 93233 - protein, 16 aa, Borrelia burgdorferi B31
VLEKRIDSLKQQIKLL

SEQ ID NO: 93234 - protein, 16 aa, Borrelia burgdorferi B31
LEKRIDSLKQQIKLLE

SEQ ID NO: 93235 - protein, 16 aa, Borrelia burgdorferi B31
EKRIDSLKQQIKLLEN

SEQ ID NO: 93236 - protein, 16 aa, Borrelia burgdorferi B31
KRIDSLKQQIKLLENI

SEQ ID NO: 93237 - protein, 16 aa, Borrelia burgdorferi B31
RIDSLKQQIKLLENIE

SEQ ID NO: 93238 - protein, 16 aa, Borrelia burgdorferi B31
IDSLKQQIKLLENIEN

SEQ ID NO: 93239 - protein, 16 aa, Borrelia burgdorferi B31
DSLKQQIKLLENIENE

SEQ ID NO: 93240 - protein, 16 aa, Borrelia burgdorferi B31
SLKQQIKLLENIENEK

SEQ ID NO: 93241 - protein, 16 aa, Borrelia burgdorferi B31
LKQQIKLLENIENEKE

SEQ ID NO: 93242 - protein, 16 aa, Borrelia burgdorferi B31
KQQIKLLENIENEKEK

SEQ ID NO: 93243 - protein, 16 aa, Borrelia burgdorferi B31
QQIKLLENIENEKEKG

SEQ ID NO: 93244 - protein, 16 aa, Borrelia burgdorferi B31
QIKLLENIENEKEKGE

SEQ ID NO: 93245 - protein, 16 aa, Borrelia burgdorferi B31
IKLLENIENEKEKGEL

SEQ ID NO: 93246 - protein, 16 aa, Borrelia burgdorferi B31
KLLENIENEKEKGELI

SEQ ID NO: 93247 - protein, 16 aa, Borrelia burgdorferi B31
LLENIENEKEKGELIL

SEQ ID NO: 93248 - protein, 16 aa, Borrelia burgdorferi B31
LENIENEKEKGELILL

SEQ ID NO: 93249 - protein, 16 aa, Borrelia burgdorferi B31
ENIENEKEKGELILLN

SEQ ID NO: 93250 - protein, 16 aa, Borrelia burgdorferi B31
NIENEKEKGELILLNI

SEQ ID NO: 93251 - protein, 16 aa, Borrelia burgdorferi B31
IENEKEKGELILLNIN

SEQ ID NO: 93252 - protein, 16 aa, Borrelia burgdorferi B31
ENEKEKGELILLNINK

SEQ ID NO: 93253 - protein, 16 aa, Borrelia burgdorferi B31
NEKEKGELILLNINKI

SEQ ID NO: 93254 - protein, 16 aa, Borrelia burgdorferi B31
EKEKGELILLNINKIQ

SEQ ID NO: 93255 - protein, 16 aa, Borrelia burgdorferi B31
KEKGELILLNINKIQK

SEQ ID NO: 93256 - protein, 16 aa, Borrelia burgdorferi B31
EKGELILLNINKIQKG

SEQ ID NO: 93257 - protein, 16 aa, Borrelia burgdorferi B31
KGELILLNINKIQKGI

SEQ ID NO: 93258 - protein, 16 aa, Borrelia burgdorferi B31
GELILLNINKIQKGIK

SEQ ID NO: 93259 - protein, 16 aa, Borrelia burgdorferi B31
ELILLNINKIQKGIKE

SEQ ID NO: 93260 - protein, 16 aa, Borrelia burgdorferi B31
LILLNINKIQKGIKEI

SEQ ID NO: 93261 - protein, 16 aa, Borrelia burgdorferi B31
ILLNINKIQKGIKEIN

SEQ ID NO: 93262 - protein, 16 aa, Borrelia burgdorferi B31
LLNINKIQKGIKEINL

SEQ ID NO: 93263 - protein, 16 aa, Borrelia burgdorferi B31
LNINKIQKGIKEINLL

SEQ ID NO: 93264 - protein, 16 aa, Borrelia burgdorferi B31
NINKIQKGIKEINLLN

SEQ ID NO: 93265 - protein, 16 aa, Borrelia burgdorferi B31
INKIQKGIKEINLLNY

SEQ ID NO: 93266 - protein, 16 aa, Borrelia burgdorferi B31
NKIQKGIKEINLLNYK

SEQ ID NO: 93267 - protein, 16 aa, Borrelia burgdorferi B31
KIQKGIKEINLLNYKE

SEQ ID NO: 93268 - protein, 16 aa, Borrelia burgdorferi B31
IQKGIKEINLLNYKEE

SEQ ID NO: 93269 - protein, 16 aa, Borrelia burgdorferi B31
QKGIKEINLLNYKEEK

SEQ ID NO: 93270 - protein, 16 aa, Borrelia burgdorferi B31
KGIKEINLLNYKEEKI

SEQ ID NO: 93271 - protein, 16 aa, Borrelia burgdorferi B31
GIKEINLLNYKEEKIK

SEQ ID NO: 93272 - protein, 16 aa, Borrelia burgdorferi B31
IKEINLLNYKEEKIKI

SEQ ID NO: 93273 - protein, 16 aa, Borrelia burgdorferi B31
KEINLLNYKEEKIKIS

SEQ ID NO: 93274 - protein, 16 aa, Borrelia burgdorferi B31
EINLLNYKEEKIKISL

SEQ ID NO: 93275 - protein, 16 aa, Borrelia burgdorferi B31
INLLNYKEEKIKISLN

SEQ ID NO: 93276 - protein, 16 aa, Borrelia burgdorferi B31
NLLNYKEEKIKISLNQ

SEQ ID NO: 93277 - protein, 16 aa, Borrelia burgdorferi B31
LLNYKEEKIKISLNQS

SEQ ID NO: 93278 - protein, 16 aa, Borrelia burgdorferi B31
LNYKEEKIKISLNQSL

SEQ ID NO: 93279 - protein, 16 aa, Borrelia burgdorferi B31
NYKEEKIKISLNQSLS

SEQ ID NO: 93280 - protein, 16 aa, Borrelia burgdorferi B31
YKEEKIKISLNQSLSP

SEQ ID NO: 93281 - protein, 16 aa, Borrelia burgdorferi B31
KEEKIKISLNQSLSPK

SEQ ID NO: 93282 - protein, 16 aa, Borrelia burgdorferi B31
EEKIKISLNQSLSPKE

SEQ ID NO: 93283 - protein, 16 aa, Borrelia burgdorferi B31
EKIKISLNQSLSPKEN

SEQ ID NO: 93284 - protein, 16 aa, Borrelia burgdorferi B31
KIKISLNQSLSPKENA

SEQ ID NO: 93285 - protein, 16 aa, Borrelia burgdorferi B31
IKISLNQSLSPKENAL

SEQ ID NO: 93286 - protein, 16 aa, Borrelia burgdorferi B31
KISLNQSLSPKENALQ

SEQ ID NO: 93287 - protein, 16 aa, Borrelia burgdorferi B31
ISLNQSLSPKENALQY

SEQ ID NO: 93288 - protein, 16 aa, Borrelia burgdorferi B31
SLNQSLSPKENALQYF

SEQ ID NO: 93289 - protein, 16 aa, Borrelia burgdorferi B31
LNQSLSPKENALQYFK

SEQ ID NO: 93290 - protein, 16 aa, Borrelia burgdorferi B31
NQSLSPKENALQYFKA

SEQ ID NO: 93291 - protein, 16 aa, Borrelia burgdorferi B31
QSLSPKENALQYFKAY

SEQ ID NO: 93292 - protein, 16 aa, Borrelia burgdorferi B31
SLSPKENALQYFKAYK

SEQ ID NO: 93293 - protein, 16 aa, Borrelia burgdorferi B31
LSPKENALQYFKAYKK

SEQ ID NO: 93294 - protein, 16 aa, Borrelia burgdorferi B31
SPKENALQYFKAYKKG

SEQ ID NO: 93295 - protein, 16 aa, Borrelia burgdorferi B31
PKENALQYFKAYKKGK

SEQ ID NO: 93296 - protein, 16 aa, Borrelia burgdorferi B31
KENALQYFKAYKKGKN

SEQ ID NO: 93297 - protein, 16 aa, Borrelia burgdorferi B31
ENALQYFKAYKKGKNS

SEQ ID NO: 93298 - protein, 16 aa, Borrelia burgdorferi B31
NALQYFKAYKKGKNSF

SEQ ID NO: 93299 - protein, 16 aa, Borrelia burgdorferi B31
ALQYFKAYKKGKNSFK

SEQ ID NO: 93300 - protein, 16 aa, Borrelia burgdorferi B31
LQYFKAYKKGKNSFKT

SEQ ID NO: 93301 - protein, 16 aa, Borrelia burgdorferi B31
QYFKAYKKGKNSFKTI

SEQ ID NO: 93302 - protein, 16 aa, Borrelia burgdorferi B31
YFKAYKKGKNSFKTIQ

SEQ ID NO: 93303 - protein, 16 aa, Borrelia burgdorferi B31
FKAYKKGKNSFKTIQN

SEQ ID NO: 93304 - protein, 16 aa, Borrelia burgdorferi B31
KAYKKGKNSFKTIQNQ

SEQ ID NO: 93305 - protein, 16 aa, Borrelia burgdorferi B31
AYKKGKNSFKTIQNQL

SEQ ID NO: 93306 - protein, 16 aa, Borrelia burgdorferi B31
YKKGKNSFKTIQNQLK

SEQ ID NO: 93307 - protein, 16 aa, Borrelia burgdorferi B31
KKGKNSFKTIQNQLKD

SEQ ID NO: 93308 - protein, 16 aa, Borrelia burgdorferi B31
KGKNSFKTIQNQLKDN

SEQ ID NO: 93309 - protein, 16 aa, Borrelia burgdorferi B31
GKNSFKTIQNQLKDNL

SEQ ID NO: 93310 - protein, 16 aa, Borrelia burgdorferi B31
KNSFKTIQNQLKDNLD

SEQ ID NO: 93311 - protein, 16 aa, Borrelia burgdorferi B31
NSFKTIQNQLKDNLDK

SEQ ID NO: 93312 - protein, 16 aa, Borrelia burgdorferi B31
SFKTIQNQLKDNLDKF

SEQ ID NO: 93313 - protein, 16 aa, Borrelia burgdorferi B31
FKTIQNQLKDNLDKFN

SEQ ID NO: 93314 - protein, 16 aa, Borrelia burgdorferi B31
KTIQNQLKDNLDKFNL

SEQ ID NO: 93315 - protein, 16 aa, Borrelia burgdorferi B31
TIQNQLKDNLDKFNLI

SEQ ID NO: 93316 - protein, 16 aa, Borrelia burgdorferi B31
IQNQLKDNLDKFNLIQ

SEQ ID NO: 93317 - protein, 16 aa, Borrelia burgdorferi B31
QNQLKDNLDKFNLIQS

SEQ ID NO: 93318 - protein, 16 aa, Borrelia burgdorferi B31
NQLKDNLDKFNLIQSK

SEQ ID NO: 93319 - protein, 16 aa, Borrelia burgdorferi B31
QLKDNLDKFNLIQSKI

SEQ ID NO: 93320 - protein, 16 aa, Borrelia burgdorferi B31
LKDNLDKFNLIQSKIT

SEQ ID NO: 93321 - protein, 16 aa, Borrelia burgdorferi B31
KDNLDKFNLIQSKITM

SEQ ID NO: 93322 - protein, 16 aa, Borrelia burgdorferi B31
DNLDKFNLIQSKITML

SEQ ID NO: 93323 - protein, 16 aa, Borrelia burgdorferi B31
NLDKFNLIQSKITMLK

SEQ ID NO: 93324 - protein, 16 aa, Borrelia burgdorferi B31
LDKFNLIQSKITMLKV

SEQ ID NO: 93325 - protein, 16 aa, Borrelia burgdorferi B31
DKFNLIQSKITMLKVE

SEQ ID NO: 93326 - protein, 16 aa, Borrelia burgdorferi B31
KFNLIQSKITMLKVEN

SEQ ID NO: 93327 - protein, 16 aa, Borrelia burgdorferi B31
FNLIQSKITMLKVENL

SEQ ID NO: 93328 - protein, 16 aa, Borrelia burgdorferi B31
NLIQSKITMLKVENLI

SEQ ID NO: 93329 - protein, 16 aa, Borrelia burgdorferi B31
LIQSKITMLKVENLIP

SEQ ID NO: 93330 - protein, 16 aa, Borrelia burgdorferi B31
IQSKITMLKVENLIPE

SEQ ID NO: 93331 - protein, 16 aa, Borrelia burgdorferi B31
QSKITMLKVENLIPEE

SEQ ID NO: 93332 - protein, 16 aa, Borrelia burgdorferi B31
SKITMLKVENLIPEEE

SEQ ID NO: 93333 - protein, 16 aa, Borrelia burgdorferi B31
KITMLKVENLIPEEEY

SEQ ID NO: 93334 - protein, 16 aa, Borrelia burgdorferi B31
ITMLKVENLIPEEEYN

SEQ ID NO: 93335 - protein, 16 aa, Borrelia burgdorferi B31
TMLKVENLIPEEEYNQ

SEQ ID NO: 93336 - protein, 16 aa, Borrelia burgdorferi B31
MLKVENLIPEEEYNQE

SEQ ID NO: 93337 - protein, 16 aa, Borrelia burgdorferi B31
LKVENLIPEEEYNQEK

SEQ ID NO: 93338 - protein, 16 aa, Borrelia burgdorferi B31
KVENLIPEEEYNQEKT

SEQ ID NO: 93339 - protein, 16 aa, Borrelia burgdorferi B31
VENLIPEEEYNQEKTA

SEQ ID NO: 93340 - protein, 16 aa, Borrelia burgdorferi B31
ENLIPEEEYNQEKTAI

SEQ ID NO: 93341 - protein, 16 aa, Borrelia burgdorferi B31
NLIPEEEYNQEKTAIK

SEQ ID NO: 93342 - protein, 16 aa, Borrelia burgdorferi B31
LIPEEEYNQEKTAIKE

SEQ ID NO: 93343 - protein, 16 aa, Borrelia burgdorferi B31
IPEEEYNQEKTAIKEK

SEQ ID NO: 93344 - protein, 16 aa, Borrelia burgdorferi B31
PEEEYNQEKTAIKEKE

SEQ ID NO: 93345 - protein, 16 aa, Borrelia burgdorferi B31
EEEYNQEKTAIKEKEK

SEQ ID NO: 93346 - protein, 16 aa, Borrelia burgdorferi B31
EEYNQEKTAIKEKEKT

SEQ ID NO: 93347 - protein, 16 aa, Borrelia burgdorferi B31
EYNQEKTAIKEKEKTP

SEQ ID NO: 93348 - protein, 16 aa, Borrelia burgdorferi B31
YNQEKTAIKEKEKTPK

SEQ ID NO: 93349 - protein, 16 aa, Borrelia burgdorferi B31
NQEKTAIKEKEKTPKI

SEQ ID NO: 93350 - protein, 16 aa, Borrelia burgdorferi B31
QEKTAIKEKEKTPKIG

SEQ ID NO: 93351 - protein, 16 aa, Borrelia burgdorferi B31
EKTAIKEKEKTPKIGL

SEQ ID NO: 93352 - protein, 16 aa, Borrelia burgdorferi B31
KTAIKEKEKTPKIGLH

SEQ ID NO: 93353 - protein, 16 aa, Borrelia burgdorferi B31
TAIKEKEKTPKIGLHF

SEQ ID NO: 93354 - protein, 16 aa, Borrelia burgdorferi B31
AIKEKEKTPKIGLHFT

SEQ ID NO: 93355 - protein, 16 aa, Borrelia burgdorferi B31
IKEKEKTPKIGLHFTY

SEQ ID NO: 93356 - protein, 16 aa, Borrelia burgdorferi B31
KEKEKTPKIGLHFTYC

SEQ ID NO: 93357 - protein, 16 aa, Borrelia burgdorferi B31
EKEKTPKIGLHFTYCG

SEQ ID NO: 93358 - protein, 16 aa, Borrelia burgdorferi B31
KEKTPKIGLHFTYCGF

SEQ ID NO: 93359 - protein, 16 aa, Borrelia burgdorferi B31
EKTPKIGLHFTYCGFE

SEQ ID NO: 93360 - protein, 16 aa, Borrelia burgdorferi B31
KTPKIGLHFTYCGFEI

SEQ ID NO: 93361 - protein, 16 aa, Borrelia burgdorferi B31
TPKIGLHFTYCGFEIL

SEQ ID NO: 93362 - protein, 16 aa, Borrelia burgdorferi B31
PKIGLHFTYCGFEILI

SEQ ID NO: 93363 - protein, 16 aa, Borrelia burgdorferi B31
KIGLHFTYCGFEILIG

SEQ ID NO: 93364 - protein, 16 aa, Borrelia burgdorferi B31
IGLHFTYCGFEILIGR

SEQ ID NO: 93365 - protein, 16 aa, Borrelia burgdorferi B31
GLHFTYCGFEILIGRN

SEQ ID NO: 93366 - protein, 16 aa, Borrelia burgdorferi B31
LHFTYCGFEILIGRNA

SEQ ID NO: 93367 - protein, 16 aa, Borrelia burgdorferi B31
HFTYCGFEILIGRNAK

SEQ ID NO: 93368 - protein, 16 aa, Borrelia burgdorferi B31
FTYCGFEILIGRNAKE

SEQ ID NO: 93369 - protein, 16 aa, Borrelia burgdorferi B31
TYCGFEILIGRNAKEN

SEQ ID NO: 93370 - protein, 16 aa, Borrelia burgdorferi B31
YCGFEILIGRNAKEND

SEQ ID NO: 93371 - protein, 16 aa, Borrelia burgdorferi B31
CGFEILIGRNAKENDK

SEQ ID NO: 93372 - protein, 16 aa, Borrelia burgdorferi B31
GFEILIGRNAKENDKL

SEQ ID NO: 93373 - protein, 16 aa, Borrelia burgdorferi B31
FEILIGRNAKENDKLL

SEQ ID NO: 93374 - protein, 16 aa, Borrelia burgdorferi B31
EILIGRNAKENDKLLR

SEQ ID NO: 93375 - protein, 16 aa, Borrelia burgdorferi B31
ILIGRNAKENDKLLRH

SEQ ID NO: 93376 - protein, 16 aa, Borrelia burgdorferi B31
LIGRNAKENDKLLRHC

SEQ ID NO: 93377 - protein, 16 aa, Borrelia burgdorferi B31
IGRNAKENDKLLRHCV

SEQ ID NO: 93378 - protein, 16 aa, Borrelia burgdorferi B31
GRNAKENDKLLRHCVK

SEQ ID NO: 93379 - protein, 16 aa, Borrelia burgdorferi B31
RNAKENDKLLRHCVKG

SEQ ID NO: 93380 - protein, 16 aa, Borrelia burgdorferi B31
NAKENDKLLRHCVKGN

SEQ ID NO: 93381 - protein, 16 aa, Borrelia burgdorferi B31
AKENDKLLRHCVKGND

SEQ ID NO: 93382 - protein, 16 aa, Borrelia burgdorferi B31
KENDKLLRHCVKGNDY

SEQ ID NO: 93383 - protein, 16 aa, Borrelia burgdorferi B31
ENDKLLRHCVKGNDYW

SEQ ID NO: 93384 - protein, 16 aa, Borrelia burgdorferi B31
NDKLLRHCVKGNDYWL

SEQ ID NO: 93385 - protein, 16 aa, Borrelia burgdorferi B31
DKLLRHCVKGNDYWLH

SEQ ID NO: 93386 - protein, 16 aa, Borrelia burgdorferi B31
KLLRHCVKGNDYWLHT

SEQ ID NO: 93387 - protein, 16 aa, Borrelia burgdorferi B31
LLRHCVKGNDYWLHTR

SEQ ID NO: 93388 - protein, 16 aa, Borrelia burgdorferi B31
LRHCVKGNDYWLHTRD

SEQ ID NO: 93389 - protein, 16 aa, Borrelia burgdorferi B31
RHCVKGNDYWLHTRDY

SEQ ID NO: 93390 - protein, 16 aa, Borrelia burgdorferi B31
HCVKGNDYWLHTRDYP

SEQ ID NO: 93391 - protein, 16 aa, Borrelia burgdorferi B31
CVKGNDYWLHTRDYPG

SEQ ID NO: 93392 - protein, 16 aa, Borrelia burgdorferi B31
VKGNDYWLHTRDYPGA

SEQ ID NO: 93393 - protein, 16 aa, Borrelia burgdorferi B31
KGNDYWLHTRDYPGAY

SEQ ID NO: 93394 - protein, 16 aa, Borrelia burgdorferi B31
GNDYWLHTRDYPGAYV

SEQ ID NO: 93395 - protein, 16 aa, Borrelia burgdorferi B31
NDYWLHTRDYPGAYVF

SEQ ID NO: 93396 - protein, 16 aa, Borrelia burgdorferi B31
DYWLHTRDYPGAYVFI

SEQ ID NO: 93397 - protein, 16 aa, Borrelia burgdorferi B31
YWLHTRDYPGAYVFIK

SEQ ID NO: 93398 - protein, 16 aa, Borrelia burgdorferi B31
WLHTRDYPGAYVFIKN

SEQ ID NO: 93399 - protein, 16 aa, Borrelia burgdorferi B31
LHTRDYPGAYVFIKNQ

SEQ ID NO: 93400 - protein, 16 aa, Borrelia burgdorferi B31
HTRDYPGAYVFIKNQK

SEQ ID NO: 93401 - protein, 16 aa, Borrelia burgdorferi B31
TRDYPGAYVFIKNQKN

SEQ ID NO: 93402 - protein, 16 aa, Borrelia burgdorferi B31
RDYPGAYVFIKNQKNK

SEQ ID NO: 93403 - protein, 16 aa, Borrelia burgdorferi B31
DYPGAYVFIKNQKNKT

SEQ ID NO: 93404 - protein, 16 aa, Borrelia burgdorferi B31
YPGAYVFIKNQKNKTP

SEQ ID NO: 93405 - protein, 16 aa, Borrelia burgdorferi B31
PGAYVFIKNQKNKTPS

SEQ ID NO: 93406 - protein, 16 aa, Borrelia burgdorferi B31
GAYVFIKNQKNKTPSL

SEQ ID NO: 93407 - protein, 16 aa, Borrelia burgdorferi B31
AYVFIKNQKNKTPSLD

SEQ ID NO: 93408 - protein, 16 aa, Borrelia burgdorferi B31
YVFIKNQKNKTPSLDV

SEQ ID NO: 93409 - protein, 16 aa, Borrelia burgdorferi B31
VFIKNQKNKTPSLDVL

SEQ ID NO: 93410 - protein, 16 aa, Borrelia burgdorferi B31
FIKNQKNKTPSLDVLL

SEQ ID NO: 93411 - protein, 16 aa, Borrelia burgdorferi B31
IKNQKNKTPSLDVLLG

SEQ ID NO: 93412 - protein, 16 aa, Borrelia burgdorferi B31
KNQKNKTPSLDVLLGA

SEQ ID NO: 93413 - protein, 16 aa, Borrelia burgdorferi B31
NQKNKTPSLDVLLGAG

SEQ ID NO: 93414 - protein, 16 aa, Borrelia burgdorferi B31
QKNKTPSLDVLLGAGN

SEQ ID NO: 93415 - protein, 16 aa, Borrelia burgdorferi B31
KNKTPSLDVLLGAGNL

SEQ ID NO: 93416 - protein, 16 aa, Borrelia burgdorferi B31
NKTPSLDVLLGAGNLC

SEQ ID NO: 93417 - protein, 16 aa, Borrelia burgdorferi B31
KTPSLDVLLGAGNLCV

SEQ ID NO: 93418 - protein, 16 aa, Borrelia burgdorferi B31
TPSLDVLLGAGNLCVF

SEQ ID NO: 93419 - protein, 16 aa, Borrelia burgdorferi B31
PSLDVLLGAGNLCVFY

SEQ ID NO: 93420 - protein, 16 aa, Borrelia burgdorferi B31
SLDVLLGAGNLCVFYT

SEQ ID NO: 93421 - protein, 16 aa, Borrelia burgdorferi B31
LDVLLGAGNLCVFYTK

SEQ ID NO: 93422 - protein, 16 aa, Borrelia burgdorferi B31
DVLLGAGNLCVFYTKL

SEQ ID NO: 93423 - protein, 16 aa, Borrelia burgdorferi B31
VLLGAGNLCVFYTKLA

SEQ ID NO: 93424 - protein, 16 aa, Borrelia burgdorferi B31
LLGAGNLCVFYTKLAK

SEQ ID NO: 93425 - protein, 16 aa, Borrelia burgdorferi B31
LGAGNLCVFYTKLAKK

SEQ ID NO: 93426 - protein, 16 aa, Borrelia burgdorferi B31
GAGNLCVFYTKLAKKS

SEQ ID NO: 93427 - protein, 16 aa, Borrelia burgdorferi B31
AGNLCVFYTKLAKKSG

SEQ ID NO: 93428 - protein, 16 aa, Borrelia burgdorferi B31
GNLCVFYTKLAKKSGK

SEQ ID NO: 93429 - protein, 16 aa, Borrelia burgdorferi B31
NLCVFYTKLAKKSGKA

SEQ ID NO: 93430 - protein, 16 aa, Borrelia burgdorferi B31
LCVFYTKLAKKSGKAD

SEQ ID NO: 93431 - protein, 16 aa, Borrelia burgdorferi B31
CVFYTKLAKKSGKADL

SEQ ID NO: 93432 - protein, 16 aa, Borrelia burgdorferi B31
VFYTKLAKKSGKADLY

SEQ ID NO: 93433 - protein, 16 aa, Borrelia burgdorferi B31
FYTKLAKKSGKADLYY

SEQ ID NO: 93434 - protein, 16 aa, Borrelia burgdorferi B31
YTKLAKKSGKADLYYT

SEQ ID NO: 93435 - protein, 16 aa, Borrelia burgdorferi B31
TKLAKKSGKADLYYTQ

SEQ ID NO: 93436 - protein, 16 aa, Borrelia burgdorferi B31
KLAKKSGKADLYYTQV

SEQ ID NO: 93437 - protein, 16 aa, Borrelia burgdorferi B31
LAKKSGKADLYYTQVK

SEQ ID NO: 93438 - protein, 16 aa, Borrelia burgdorferi B31
AKKSGKADLYYTQVKN

SEQ ID NO: 93439 - protein, 16 aa, Borrelia burgdorferi B31
KKSGKADLYYTQVKNL

SEQ ID NO: 93440 - protein, 16 aa, Borrelia burgdorferi B31
KSGKADLYYTQVKNLR

SEQ ID NO: 93441 - protein, 16 aa, Borrelia burgdorferi B31
SGKADLYYTQVKNLRR

SEQ ID NO: 93442 - protein, 16 aa, Borrelia burgdorferi B31
GKADLYYTQVKNLRRV

SEQ ID NO: 93443 - protein, 16 aa, Borrelia burgdorferi B31
KADLYYTQVKNLRRVK

SEQ ID NO: 93444 - protein, 16 aa, Borrelia burgdorferi B31
ADLYYTQVKNLRRVKN

SEQ ID NO: 93445 - protein, 16 aa, Borrelia burgdorferi B31
DLYYTQVKNLRRVKNK

SEQ ID NO: 93446 - protein, 16 aa, Borrelia burgdorferi B31
LYYTQVKNLRRVKNKK

SEQ ID NO: 93447 - protein, 16 aa, Borrelia burgdorferi B31
YYTQVKNLRRVKNKKL

SEQ ID NO: 93448 - protein, 16 aa, Borrelia burgdorferi B31
YTQVKNLRRVKNKKLG

SEQ ID NO: 93449 - protein, 16 aa, Borrelia burgdorferi B31
TQVKNLRRVKNKKLGL

SEQ ID NO: 93450 - protein, 16 aa, Borrelia burgdorferi B31
QVKNLRRVKNKKLGLV

SEQ ID NO: 93451 - protein, 16 aa, Borrelia burgdorferi B31
VKNLRRVKNKKLGLVI

SEQ ID NO: 93452 - protein, 16 aa, Borrelia burgdorferi B31
KNLRRVKNKKLGLVIP

SEQ ID NO: 93453 - protein, 16 aa, Borrelia burgdorferi B31
NLRRVKNKKLGLVIPK

SEQ ID NO: 93454 - protein, 16 aa, Borrelia burgdorferi B31
LRRVKNKKLGLVIPKA

SEQ ID NO: 93455 - protein, 16 aa, Borrelia burgdorferi B31
RRVKNKKLGLVIPKAE

SEQ ID NO: 93456 - protein, 16 aa, Borrelia burgdorferi B31
RVKNKKLGLVIPKAEK

SEQ ID NO: 93457 - protein, 16 aa, Borrelia burgdorferi B31
VKNKKLGLVIPKAEKN

SEQ ID NO: 93458 - protein, 16 aa, Borrelia burgdorferi B31
KNKKLGLVIPKAEKNL

SEQ ID NO: 93459 - protein, 16 aa, Borrelia burgdorferi B31
NKKLGLVIPKAEKNLH

SEQ ID NO: 93460 - protein, 16 aa, Borrelia burgdorferi B31
KKLGLVIPKAEKNLHI

SEQ ID NO: 93461 - protein, 16 aa, Borrelia burgdorferi B31
KLGLVIPKAEKNLHIK

SEQ ID NO: 93462 - protein, 16 aa, Borrelia burgdorferi B31
LGLVIPKAEKNLHIKL

SEQ ID NO: 93463 - protein, 16 aa, Borrelia burgdorferi B31
GLVIPKAEKNLHIKLD

SEQ ID NO: 93464 - protein, 16 aa, Borrelia burgdorferi B31
LVIPKAEKNLHIKLDE

SEQ ID NO: 93465 - protein, 16 aa, Borrelia burgdorferi B31
VIPKAEKNLHIKLDEN

SEQ ID NO: 93466 - protein, 16 aa, Borrelia burgdorferi B31
IPKAEKNLHIKLDENL

SEQ ID NO: 93467 - protein, 16 aa, Borrelia burgdorferi B31
PKAEKNLHIKLDENLI

SEQ ID NO: 93468 - protein, 16 aa, Borrelia burgdorferi B31
KAEKNLHIKLDENLIK

SEQ ID NO: 93469 - protein, 16 aa, Borrelia burgdorferi B31
AEKNLHIKLDENLIKK

SEQ ID NO: 93470 - protein, 16 aa, Borrelia burgdorferi B31
EKNLHIKLDENLIKKI

SEQ ID NO: 93471 - protein, 16 aa, Borrelia burgdorferi B31
KNLHIKLDENLIKKIK

SEQ ID NO: 93472 - protein, 16 aa, Borrelia burgdorferi B31
NLHIKLDENLIKKIKN

SEQ ID NO: 93473 - protein, 16 aa, Borrelia burgdorferi B31
LHIKLDENLIKKIKNQ

SEQ ID NO: 93474 - protein, 16 aa, Borrelia burgdorferi B31
HIKLDENLIKKIKNQT

SEQ ID NO: 93475 - protein, 13 aa, Borrelia burgdorferi
MKLQRSLSLIIFS

SEQ ID NO: 93476 - protein, 13 aa, Borrelia burgdorferi
KLQRSLSLIIFSL

SEQ ID NO: 93477 - protein, 13 aa, Borrelia burgdorferi
LQRSLSLIIFSLT

SEQ ID NO: 93478 - protein, 13 aa, Borrelia burgdorferi
QRSLSLIIFSLTV

SEQ ID NO: 93479 - protein, 13 aa, Borrelia burgdorferi
RSLSLIIFSLTVL

SEQ ID NO: 93480 - protein, 13 aa, Borrelia burgdorferi
SLSLIIFSLTVLC

SEQ ID NO: 93481 - protein, 13 aa, Borrelia burgdorferi
LSLIIFSLTVLCC

SEQ ID NO: 93482 - protein, 13 aa, Borrelia burgdorferi
SLIIFSLTVLCCD

SEQ ID NO: 93483 - protein, 13 aa, Borrelia burgdorferi
LIIFSLTVLCCDN

SEQ ID NO: 93484 - protein, 13 aa, Borrelia burgdorferi
IIFSLTVLCCDNK

SEQ ID NO: 93485 - protein, 13 aa, Borrelia burgdorferi
IFSLTVLCCDNKE

SEQ ID NO: 93486 - protein, 13 aa, Borrelia burgdorferi
FSLTVLCCDNKER

SEQ ID NO: 93487 - protein, 13 aa, Borrelia burgdorferi
SLTVLCCDNKERK

SEQ ID NO: 93488 - protein, 13 aa, Borrelia burgdorferi
LTVLCCDNKERKE

SEQ ID NO: 93489 - protein, 13 aa, Borrelia burgdorferi
TVLCCDNKERKEG

SEQ ID NO: 93490 - protein, 13 aa, Borrelia burgdorferi
VLCCDNKERKEGV

SEQ ID NO: 93491 - protein, 13 aa, Borrelia burgdorferi
LCCDNKERKEGVS

SEQ ID NO: 93492 - protein, 13 aa, Borrelia burgdorferi
CCDNKERKEGVST

SEQ ID NO: 93493 - protein, 13 aa, Borrelia burgdorferi
CDNKERKEGVSTK

SEQ ID NO: 93494 - protein, 13 aa, Borrelia burgdorferi
DNKERKEGVSTKI

SEQ ID NO: 93495 - protein, 13 aa, Borrelia burgdorferi
NKERKEGVSTKIS

SEQ ID NO: 93496 - protein, 13 aa, Borrelia burgdorferi
KERKEGVSTKISL

SEQ ID NO: 93497 - protein, 13 aa, Borrelia burgdorferi
ERKEGVSTKISLG

SEQ ID NO: 93498 - protein, 13 aa, Borrelia burgdorferi
RKEGVSTKISLGA

SEQ ID NO: 93499 - protein, 13 aa, Borrelia burgdorferi
KEGVSTKISLGAE

SEQ ID NO: 93500 - protein, 13 aa, Borrelia burgdorferi
EGVSTKISLGAEP

SEQ ID NO: 93501 - protein, 13 aa, Borrelia burgdorferi
GVSTKISLGAEPR

SEQ ID NO: 93502 - protein, 13 aa, Borrelia burgdorferi
VSTKISLGAEPRS

SEQ ID NO: 93503 - protein, 13 aa, Borrelia burgdorferi
STKISLGAEPRSL

SEQ ID NO: 93504 - protein, 13 aa, Borrelia burgdorferi
TKISLGAEPRSLD

SEQ ID NO: 93505 - protein, 13 aa, Borrelia burgdorferi
KISLGAEPRSLDP

SEQ ID NO: 93506 - protein, 13 aa, Borrelia burgdorferi
ISLGAEPRSLDPQ

SEQ ID NO: 93507 - protein, 13 aa, Borrelia burgdorferi
SLGAEPRSLDPQL

SEQ ID NO: 93508 - protein, 13 aa, Borrelia burgdorferi
LGAEPRSLDPQLA

SEQ ID NO: 93509 - protein, 13 aa, Borrelia burgdorferi
GAEPRSLDPQLAE

SEQ ID NO: 93510 - protein, 13 aa, Borrelia burgdorferi
AEPRSLDPQLAED

SEQ ID NO: 93511 - protein, 13 aa, Borrelia burgdorferi
EPRSLDPQLAEDN

SEQ ID NO: 93512 - protein, 13 aa, Borrelia burgdorferi
PRSLDPQLAEDNV

SEQ ID NO: 93513 - protein, 13 aa, Borrelia burgdorferi
RSLDPQLAEDNVA

SEQ ID NO: 93514 - protein, 13 aa, Borrelia burgdorferi
SLDPQLAEDNVAS

SEQ ID NO: 93515 - protein, 13 aa, Borrelia burgdorferi
LDPQLAEDNVASK

SEQ ID NO: 93516 - protein, 13 aa, Borrelia burgdorferi
DPQLAEDNVASKM

SEQ ID NO: 93517 - protein, 13 aa, Borrelia burgdorferi
PQLAEDNVASKMI

SEQ ID NO: 93518 - protein, 13 aa, Borrelia burgdorferi
QLAEDNVASKMID

SEQ ID NO: 93519 - protein, 13 aa, Borrelia burgdorferi
LAEDNVASKMIDT

SEQ ID NO: 93520 - protein, 13 aa, Borrelia burgdorferi
AEDNVASKMIDTL

SEQ ID NO: 93521 - protein, 13 aa, Borrelia burgdorferi
EDNVASKMIDTLY

SEQ ID NO: 93522 - protein, 13 aa, Borrelia burgdorferi
DNVASKMIDTLYR

SEQ ID NO: 93523 - protein, 13 aa, Borrelia burgdorferi
NVASKMIDTLYRG

SEQ ID NO: 93524 - protein, 13 aa, Borrelia burgdorferi
VASKMIDTLYRGI

SEQ ID NO: 93525 - protein, 13 aa, Borrelia burgdorferi
ASKMIDTLYRGIV

SEQ ID NO: 93526 - protein, 13 aa, Borrelia burgdorferi
SKMIDTLYRGIVT

SEQ ID NO: 93527 - protein, 13 aa, Borrelia burgdorferi
KMIDTLYRGIVTG

SEQ ID NO: 93528 - protein, 13 aa, Borrelia burgdorferi
MIDTLYRGIVTGD

SEQ ID NO: 93529 - protein, 13 aa, Borrelia burgdorferi
IDTLYRGIVTGDP

SEQ ID NO: 93530 - protein, 13 aa, Borrelia burgdorferi
DTLYRGIVTGDPN

SEQ ID NO: 93531 - protein, 13 aa, Borrelia burgdorferi
TLYRGIVTGDPNT

SEQ ID NO: 93532 - protein, 13 aa, Borrelia burgdorferi
LYRGIVTGDPNTG

SEQ ID NO: 93533 - protein, 13 aa, Borrelia burgdorferi
YRGIVTGDPNTGG

SEQ ID NO: 93534 - protein, 13 aa, Borrelia burgdorferi
RGIVTGDPNTGGH

SEQ ID NO: 93535 - protein, 13 aa, Borrelia burgdorferi
GIVTGDPNTGGHK

SEQ ID NO: 93536 - protein, 13 aa, Borrelia burgdorferi
IVTGDPNTGGHKP

SEQ ID NO: 93537 - protein, 13 aa, Borrelia burgdorferi
VTGDPNTGGHKPG

SEQ ID NO: 93538 - protein, 13 aa, Borrelia burgdorferi
TGDPNTGGHKPGL

SEQ ID NO: 93539 - protein, 13 aa, Borrelia burgdorferi
GDPNTGGHKPGLA

SEQ ID NO: 93540 - protein, 13 aa, Borrelia burgdorferi
DPNTGGHKPGLAK

SEQ ID NO: 93541 - protein, 13 aa, Borrelia burgdorferi
PNTGGHKPGLAKG

SEQ ID NO: 93542 - protein, 13 aa, Borrelia burgdorferi
NTGGHKPGLAKGW

SEQ ID NO: 93543 - protein, 13 aa, Borrelia burgdorferi
TGGHKPGLAKGWE

SEQ ID NO: 93544 - protein, 13 aa, Borrelia burgdorferi
GGHKPGLAKGWET

SEQ ID NO: 93545 - protein, 13 aa, Borrelia burgdorferi
GHKPGLAKGWETS

SEQ ID NO: 93546 - protein, 13 aa, Borrelia burgdorferi
HKPGLAKGWETSS

SEQ ID NO: 93547 - protein, 13 aa, Borrelia burgdorferi
KPGLAKGWETSSD

SEQ ID NO: 93548 - protein, 13 aa, Borrelia burgdorferi
PGLAKGWETSSDG

SEQ ID NO: 93549 - protein, 13 aa, Borrelia burgdorferi
GLAKGWETSSDGT

SEQ ID NO: 93550 - protein, 13 aa, Borrelia burgdorferi
LAKGWETSSDGTA

SEQ ID NO: 93551 - protein, 13 aa, Borrelia burgdorferi
AKGWETSSDGTAY

SEQ ID NO: 93552 - protein, 13 aa, Borrelia burgdorferi
KGWETSSDGTAYP

SEQ ID NO: 93553 - protein, 13 aa, Borrelia burgdorferi
GWETSSDGTAYPF

SEQ ID NO: 93554 - protein, 13 aa, Borrelia burgdorferi
WETSSDGTAYPFY

SEQ ID NO: 93555 - protein, 13 aa, Borrelia burgdorferi
ETSSDGTAYPFYL

SEQ ID NO: 93556 - protein, 13 aa, Borrelia burgdorferi
TSSDGTAYPFYLR

SEQ ID NO: 93557 - protein, 13 aa, Borrelia burgdorferi
SSDGTAYPFYLRD

SEQ ID NO: 93558 - protein, 13 aa, Borrelia burgdorferi
SDGTAYPFYLRDN

SEQ ID NO: 93559 - protein, 13 aa, Borrelia burgdorferi
DGTAYPFYLRDNL

SEQ ID NO: 93560 - protein, 13 aa, Borrelia burgdorferi
GTAYPFYLRDNLT

SEQ ID NO: 93561 - protein, 13 aa, Borrelia burgdorferi
TAYPFYLRDNLTW

SEQ ID NO: 93562 - protein, 13 aa, Borrelia burgdorferi
AYPFYLRDNLTWS

SEQ ID NO: 93563 - protein, 13 aa, Borrelia burgdorferi
YPFYLRDNLTWSD

SEQ ID NO: 93564 - protein, 13 aa, Borrelia burgdorferi
PFYLRDNLTWSDG

SEQ ID NO: 93565 - protein, 13 aa, Borrelia burgdorferi
FYLRDNLTWSDGV

SEQ ID NO: 93566 - protein, 13 aa, Borrelia burgdorferi
YLRDNLTWSDGVA

SEQ ID NO: 93567 - protein, 13 aa, Borrelia burgdorferi
LRDNLTWSDGVAI

SEQ ID NO: 93568 - protein, 13 aa, Borrelia burgdorferi
RDNLTWSDGVAIT

SEQ ID NO: 93569 - protein, 13 aa, Borrelia burgdorferi
DNLTWSDGVAITA

SEQ ID NO: 93570 - protein, 13 aa, Borrelia burgdorferi
NLTWSDGVAITAE

SEQ ID NO: 93571 - protein, 13 aa, Borrelia burgdorferi
LTWSDGVAITAEG

SEQ ID NO: 93572 - protein, 13 aa, Borrelia burgdorferi
TWSDGVAITAEGI

SEQ ID NO: 93573 - protein, 13 aa, Borrelia burgdorferi
WSDGVAITAEGIR

SEQ ID NO: 93574 - protein, 13 aa, Borrelia burgdorferi
SDGVAITAEGIRK

SEQ ID NO: 93575 - protein, 13 aa, Borrelia burgdorferi
DGVAITAEGIRKS

SEQ ID NO: 93576 - protein, 13 aa, Borrelia burgdorferi
GVAITAEGIRKSY

SEQ ID NO: 93577 - protein, 13 aa, Borrelia burgdorferi
VAITAEGIRKSYL

SEQ ID NO: 93578 - protein, 13 aa, Borrelia burgdorferi
AITAEGIRKSYLR

SEQ ID NO: 93579 - protein, 13 aa, Borrelia burgdorferi
ITAEGIRKSYLRI

SEQ ID NO: 93580 - protein, 13 aa, Borrelia burgdorferi
TAEGIRKSYLRIL

SEQ ID NO: 93581 - protein, 13 aa, Borrelia burgdorferi
AEGIRKSYLRILN

SEQ ID NO: 93582 - protein, 13 aa, Borrelia burgdorferi
EGIRKSYLRILNK

SEQ ID NO: 93583 - protein, 13 aa, Borrelia burgdorferi
GIRKSYLRILNKE

SEQ ID NO: 93584 - protein, 13 aa, Borrelia burgdorferi
IRKSYLRILNKET

SEQ ID NO: 93585 - protein, 13 aa, Borrelia burgdorferi
RKSYLRILNKETG

SEQ ID NO: 93586 - protein, 13 aa, Borrelia burgdorferi
KSYLRILNKETGS

SEQ ID NO: 93587 - protein, 13 aa, Borrelia burgdorferi
SYLRILNKETGST

SEQ ID NO: 93588 - protein, 13 aa, Borrelia burgdorferi
YLRILNKETGSTY

SEQ ID NO: 93589 - protein, 13 aa, Borrelia burgdorferi
LRILNKETGSTYV

SEQ ID NO: 93590 - protein, 13 aa, Borrelia burgdorferi
RILNKETGSTYVD

SEQ ID NO: 93591 - protein, 13 aa, Borrelia burgdorferi
ILNKETGSTYVDM

SEQ ID NO: 93592 - protein, 13 aa, Borrelia burgdorferi
LNKETGSTYVDMV

SEQ ID NO: 93593 - protein, 13 aa, Borrelia burgdorferi
NKETGSTYVDMVK

SEQ ID NO: 93594 - protein, 13 aa, Borrelia burgdorferi
KETGSTYVDMVKS

SEQ ID NO: 93595 - protein, 13 aa, Borrelia burgdorferi
ETGSTYVDMVKSI

SEQ ID NO: 93596 - protein, 13 aa, Borrelia burgdorferi
TGSTYVDMVKSII

SEQ ID NO: 93597 - protein, 13 aa, Borrelia burgdorferi
GSTYVDMVKSIIK

SEQ ID NO: 93598 - protein, 13 aa, Borrelia burgdorferi
STYVDMVKSIIKN

SEQ ID NO: 93599 - protein, 13 aa, Borrelia burgdorferi
TYVDMVKSIIKNG

SEQ ID NO: 93600 - protein, 13 aa, Borrelia burgdorferi
YVDMVKSIIKNGQ

SEQ ID NO: 93601 - protein, 13 aa, Borrelia burgdorferi
VDMVKSIIKNGQE

SEQ ID NO: 93602 - protein, 13 aa, Borrelia burgdorferi
DMVKSIIKNGQEY

SEQ ID NO: 93603 - protein, 13 aa, Borrelia burgdorferi
MVKSIIKNGQEYF

SEQ ID NO: 93604 - protein, 13 aa, Borrelia burgdorferi
VKSIIKNGQEYFD

SEQ ID NO: 93605 - protein, 13 aa, Borrelia burgdorferi
KSIIKNGQEYFDG

SEQ ID NO: 93606 - protein, 13 aa, Borrelia burgdorferi
SIIKNGQEYFDGQ

SEQ ID NO: 93607 - protein, 13 aa, Borrelia burgdorferi
IIKNGQEYFDGQV

SEQ ID NO: 93608 - protein, 13 aa, Borrelia burgdorferi
IKNGQEYFDGQVT

SEQ ID NO: 93609 - protein, 13 aa, Borrelia burgdorferi
KNGQEYFDGQVTD

SEQ ID NO: 93610 - protein, 13 aa, Borrelia burgdorferi
NGQEYFDGQVTDS

SEQ ID NO: 93611 - protein, 13 aa, Borrelia burgdorferi
GQEYFDGQVTDSE

SEQ ID NO: 93612 - protein, 13 aa, Borrelia burgdorferi
QEYFDGQVTDSEL

SEQ ID NO: 93613 - protein, 13 aa, Borrelia burgdorferi
EYFDGQVTDSELG

SEQ ID NO: 93614 - protein, 13 aa, Borrelia burgdorferi
YFDGQVTDSELGI

SEQ ID NO: 93615 - protein, 13 aa, Borrelia burgdorferi
FDGQVTDSELGIR

SEQ ID NO: 93616 - protein, 13 aa, Borrelia burgdorferi
DGQVTDSELGIRA

SEQ ID NO: 93617 - protein, 13 aa, Borrelia burgdorferi
GQVTDSELGIRAI

SEQ ID NO: 93618 - protein, 13 aa, Borrelia burgdorferi
QVTDSELGIRAID

SEQ ID NO: 93619 - protein, 13 aa, Borrelia burgdorferi
VTDSELGIRAIDS

SEQ ID NO: 93620 - protein, 13 aa, Borrelia burgdorferi
TDSELGIRAIDSK

SEQ ID NO: 93621 - protein, 13 aa, Borrelia burgdorferi
DSELGIRAIDSKT

SEQ ID NO: 93622 - protein, 13 aa, Borrelia burgdorferi
SELGIRAIDSKTL

SEQ ID NO: 93623 - protein, 13 aa, Borrelia burgdorferi
ELGIRAIDSKTLE

SEQ ID NO: 93624 - protein, 13 aa, Borrelia burgdorferi
LGIRAIDSKTLEI

SEQ ID NO: 93625 - protein, 13 aa, Borrelia burgdorferi
GIRAIDSKTLEIT

SEQ ID NO: 93626 - protein, 13 aa, Borrelia burgdorferi
IRAIDSKTLEITL

SEQ ID NO: 93627 - protein, 13 aa, Borrelia burgdorferi
RAIDSKTLEITLA

SEQ ID NO: 93628 - protein, 13 aa, Borrelia burgdorferi
AIDSKTLEITLAS

SEQ ID NO: 93629 - protein, 13 aa, Borrelia burgdorferi
IDSKTLEITLASP

SEQ ID NO: 93630 - protein, 13 aa, Borrelia burgdorferi
DSKTLEITLASPK

SEQ ID NO: 93631 - protein, 13 aa, Borrelia burgdorferi
SKTLEITLASPKP

SEQ ID NO: 93632 - protein, 13 aa, Borrelia burgdorferi
KTLEITLASPKPY

SEQ ID NO: 93633 - protein, 13 aa, Borrelia burgdorferi
TLEITLASPKPYF

SEQ ID NO: 93634 - protein, 13 aa, Borrelia burgdorferi
LEITLASPKPYFI

SEQ ID NO: 93635 - protein, 13 aa, Borrelia burgdorferi
EITLASPKPYFID

SEQ ID NO: 93636 - protein, 13 aa, Borrelia burgdorferi
ITLASPKPYFIDL

SEQ ID NO: 93637 - protein, 13 aa, Borrelia burgdorferi
TLASPKPYFIDLL

SEQ ID NO: 93638 - protein, 13 aa, Borrelia burgdorferi
LASPKPYFIDLLV

SEQ ID NO: 93639 - protein, 13 aa, Borrelia burgdorferi
ASPKPYFIDLLVH

SEQ ID NO: 93640 - protein, 13 aa, Borrelia burgdorferi
SPKPYFIDLLVHQ

SEQ ID NO: 93641 - protein, 13 aa, Borrelia burgdorferi
PKPYFIDLLVHQS

SEQ ID NO: 93642 - protein, 13 aa, Borrelia burgdorferi
KPYFIDLLVHQSF

SEQ ID NO: 93643 - protein, 13 aa, Borrelia burgdorferi
PYFIDLLVHQSFI

SEQ ID NO: 93644 - protein, 13 aa, Borrelia burgdorferi
YFIDLLVHQSFIP

SEQ ID NO: 93645 - protein, 13 aa, Borrelia burgdorferi
FIDLLVHQSFIPV

SEQ ID NO: 93646 - protein, 13 aa, Borrelia burgdorferi
IDLLVHQSFIPVP

SEQ ID NO: 93647 - protein, 13 aa, Borrelia burgdorferi
DLLVHQSFIPVPV

SEQ ID NO: 93648 - protein, 13 aa, Borrelia burgdorferi
LLVHQSFIPVPVH

SEQ ID NO: 93649 - protein, 13 aa, Borrelia burgdorferi
LVHQSFIPVPVHV

SEQ ID NO: 93650 - protein, 13 aa, Borrelia burgdorferi
VHQSFIPVPVHVT

SEQ ID NO: 93651 - protein, 13 aa, Borrelia burgdorferi
HQSFIPVPVHVTD

SEQ ID NO: 93652 - protein, 13 aa, Borrelia burgdorferi
QSFIPVPVHVTDK

SEQ ID NO: 93653 - protein, 13 aa, Borrelia burgdorferi
SFIPVPVHVTDKY

SEQ ID NO: 93654 - protein, 13 aa, Borrelia burgdorferi
FIPVPVHVTDKYG

SEQ ID NO: 93655 - protein, 13 aa, Borrelia burgdorferi
IPVPVHVTDKYGQ

SEQ ID NO: 93656 - protein, 13 aa, Borrelia burgdorferi
PVPVHVTDKYGQN

SEQ ID NO: 93657 - protein, 13 aa, Borrelia burgdorferi
VPVHVTDKYGQNW

SEQ ID NO: 93658 - protein, 13 aa, Borrelia burgdorferi
PVHVTDKYGQNWT

SEQ ID NO: 93659 - protein, 13 aa, Borrelia burgdorferi
VHVTDKYGQNWTS

SEQ ID NO: 93660 - protein, 13 aa, Borrelia burgdorferi
HVTDKYGQNWTSP

SEQ ID NO: 93661 - protein, 13 aa, Borrelia burgdorferi
VTDKYGQNWTSPE

SEQ ID NO: 93662 - protein, 13 aa, Borrelia burgdorferi
TDKYGQNWTSPEN

SEQ ID NO: 93663 - protein, 13 aa, Borrelia burgdorferi
DKYGQNWTSPENM

SEQ ID NO: 93664 - protein, 13 aa, Borrelia burgdorferi
KYGQNWTSPENMV

SEQ ID NO: 93665 - protein, 13 aa, Borrelia burgdorferi
YGQNWTSPENMVT

SEQ ID NO: 93666 - protein, 13 aa, Borrelia burgdorferi
GQNWTSPENMVTS

SEQ ID NO: 93667 - protein, 13 aa, Borrelia burgdorferi
QNWTSPENMVTSG

SEQ ID NO: 93668 - protein, 13 aa, Borrelia burgdorferi
NWTSPENMVTSGP

SEQ ID NO: 93669 - protein, 13 aa, Borrelia burgdorferi
WTSPENMVTSGPF

SEQ ID NO: 93670 - protein, 13 aa, Borrelia burgdorferi
TSPENMVTSGPFK

SEQ ID NO: 93671 - protein, 13 aa, Borrelia burgdorferi
SPENMVTSGPFKL

SEQ ID NO: 93672 - protein, 13 aa, Borrelia burgdorferi
PENMVTSGPFKLK

SEQ ID NO: 93673 - protein, 13 aa, Borrelia burgdorferi
ENMVTSGPFKLKE

SEQ ID NO: 93674 - protein, 13 aa, Borrelia burgdorferi
NMVTSGPFKLKER

SEQ ID NO: 93675 - protein, 13 aa, Borrelia burgdorferi
MVTSGPFKLKERI

SEQ ID NO: 93676 - protein, 13 aa, Borrelia burgdorferi
VTSGPFKLKERIP

SEQ ID NO: 93677 - protein, 13 aa, Borrelia burgdorferi
TSGPFKLKERIPS

SEQ ID NO: 93678 - protein, 13 aa, Borrelia burgdorferi
SGPFKLKERIPSE

SEQ ID NO: 93679 - protein, 13 aa, Borrelia burgdorferi
GPFKLKERIPSEK

SEQ ID NO: 93680 - protein, 13 aa, Borrelia burgdorferi
PFKLKERIPSEKY

SEQ ID NO: 93681 - protein, 13 aa, Borrelia burgdorferi
FKLKERIPSEKYV

SEQ ID NO: 93682 - protein, 13 aa, Borrelia burgdorferi
KLKERIPSEKYVF

SEQ ID NO: 93683 - protein, 13 aa, Borrelia burgdorferi
LKERIPSEKYVFE

SEQ ID NO: 93684 - protein, 13 aa, Borrelia burgdorferi
KERIPSEKYVFEK

SEQ ID NO: 93685 - protein, 13 aa, Borrelia burgdorferi
ERIPSEKYVFEKD

SEQ ID NO: 93686 - protein, 13 aa, Borrelia burgdorferi
RIPSEKYVFEKDN

SEQ ID NO: 93687 - protein, 13 aa, Borrelia burgdorferi
IPSEKYVFEKDNK

SEQ ID NO: 93688 - protein, 13 aa, Borrelia burgdorferi
PSEKYVFEKDNKY

SEQ ID NO: 93689 - protein, 13 aa, Borrelia burgdorferi
SEKYVFEKDNKYY

SEQ ID NO: 93690 - protein, 13 aa, Borrelia burgdorferi
EKYVFEKDNKYYD

SEQ ID NO: 93691 - protein, 13 aa, Borrelia burgdorferi
KYVFEKDNKYYDS

SEQ ID NO: 93692 - protein, 13 aa, Borrelia burgdorferi
YVFEKDNKYYDSN

SEQ ID NO: 93693 - protein, 13 aa, Borrelia burgdorferi
VFEKDNKYYDSNE

SEQ ID NO: 93694 - protein, 13 aa, Borrelia burgdorferi
FEKDNKYYDSNEV

SEQ ID NO: 93695 - protein, 13 aa, Borrelia burgdorferi
EKDNKYYDSNEVE

SEQ ID NO: 93696 - protein, 13 aa, Borrelia burgdorferi
KDNKYYDSNEVEL

SEQ ID NO: 93697 - protein, 13 aa, Borrelia burgdorferi
DNKYYDSNEVELE

SEQ ID NO: 93698 - protein, 13 aa, Borrelia burgdorferi
NKYYDSNEVELEE

SEQ ID NO: 93699 - protein, 13 aa, Borrelia burgdorferi
KYYDSNEVELEEI

SEQ ID NO: 93700 - protein, 13 aa, Borrelia burgdorferi
YYDSNEVELEEIT

SEQ ID NO: 93701 - protein, 13 aa, Borrelia burgdorferi
YDSNEVELEEITF

SEQ ID NO: 93702 - protein, 13 aa, Borrelia burgdorferi
DSNEVELEEITFY

SEQ ID NO: 93703 - protein, 13 aa, Borrelia burgdorferi
SNEVELEEITFYT

SEQ ID NO: 93704 - protein, 13 aa, Borrelia burgdorferi
NEVELEEITFYTT

SEQ ID NO: 93705 - protein, 13 aa, Borrelia burgdorferi
EVELEEITFYTTN

SEQ ID NO: 93706 - protein, 13 aa, Borrelia burgdorferi
VELEEITFYTTND

SEQ ID NO: 93707 - protein, 13 aa, Borrelia burgdorferi
ELEEITFYTTNDS

SEQ ID NO: 93708 - protein, 13 aa, Borrelia burgdorferi
LEEITFYTTNDSS

SEQ ID NO: 93709 - protein, 13 aa, Borrelia burgdorferi
EEITFYTTNDSST

SEQ ID NO: 93710 - protein, 13 aa, Borrelia burgdorferi
EITFYTTNDSSTA

SEQ ID NO: 93711 - protein, 13 aa, Borrelia burgdorferi
ITFYTTNDSSTAY

SEQ ID NO: 93712 - protein, 13 aa, Borrelia burgdorferi
TFYTTNDSSTAYK

SEQ ID NO: 93713 - protein, 13 aa, Borrelia burgdorferi
FYTTNDSSTAYKM

SEQ ID NO: 93714 - protein, 13 aa, Borrelia burgdorferi
YTTNDSSTAYKMY

SEQ ID NO: 93715 - protein, 13 aa, Borrelia burgdorferi
TTNDSSTAYKMYV

SEQ ID NO: 93716 - protein, 13 aa, Borrelia burgdorferi
TNDSSTAYKMYVN

SEQ ID NO: 93717 - protein, 13 aa, Borrelia burgdorferi
NDSSTAYKMYVNE

SEQ ID NO: 93718 - protein, 13 aa, Borrelia burgdorferi
DSSTAYKMYVNEE

SEQ ID NO: 93719 - protein, 13 aa, Borrelia burgdorferi
SSTAYKMYVNEEL

SEQ ID NO: 93720 - protein, 13 aa, Borrelia burgdorferi
STAYKMYVNEELD

SEQ ID NO: 93721 - protein, 13 aa, Borrelia burgdorferi
TAYKMYVNEELDA

SEQ ID NO: 93722 - protein, 13 aa, Borrelia burgdorferi
AYKMYVNEELDAI

SEQ ID NO: 93723 - protein, 13 aa, Borrelia burgdorferi
YKMYVNEELDAIL

SEQ ID NO: 93724 - protein, 13 aa, Borrelia burgdorferi
KMYVNEELDAILV

SEQ ID NO: 93725 - protein, 13 aa, Borrelia burgdorferi
MYVNEELDAILVP

SEQ ID NO: 93726 - protein, 13 aa, Borrelia burgdorferi
YVNEELDAILVPY

SEQ ID NO: 93727 - protein, 13 aa, Borrelia burgdorferi
VNEELDAILVPYP

SEQ ID NO: 93728 - protein, 13 aa, Borrelia burgdorferi
NEELDAILVPYPQ

SEQ ID NO: 93729 - protein, 13 aa, Borrelia burgdorferi
EELDAILVPYPQI

SEQ ID NO: 93730 - protein, 14 aa, Borrelia burgdorferi
MKLQRSLSLIIFSL

SEQ ID NO: 93731 - protein, 14 aa, Borrelia burgdorferi
KLQRSLSLIIFSLT

SEQ ID NO: 93732 - protein, 14 aa, Borrelia burgdorferi
LQRSLSLIIFSLTV

SEQ ID NO: 93733 - protein, 14 aa, Borrelia burgdorferi
QRSLSLIIFSLTVL

SEQ ID NO: 93734 - protein, 14 aa, Borrelia burgdorferi
RSLSLIIFSLTVLC

SEQ ID NO: 93735 - protein, 14 aa, Borrelia burgdorferi
SLSLIIFSLTVLCC

SEQ ID NO: 93736 - protein, 14 aa, Borrelia burgdorferi
LSLIIFSLTVLCCD

SEQ ID NO: 93737 - protein, 14 aa, Borrelia burgdorferi
SLIIFSLTVLCCDN

SEQ ID NO: 93738 - protein, 14 aa, Borrelia burgdorferi
LIIFSLTVLCCDNK

SEQ ID NO: 93739 - protein, 14 aa, Borrelia burgdorferi
IIFSLTVLCCDNKE

SEQ ID NO: 93740 - protein, 14 aa, Borrelia burgdorferi
IFSLTVLCCDNKER

SEQ ID NO: 93741 - protein, 14 aa, Borrelia burgdorferi
FSLTVLCCDNKERK

SEQ ID NO: 93742 - protein, 14 aa, Borrelia burgdorferi
SLTVLCCDNKERKE

SEQ ID NO: 93743 - protein, 14 aa, Borrelia burgdorferi
LTVLCCDNKERKEG

SEQ ID NO: 93744 - protein, 14 aa, Borrelia burgdorferi
TVLCCDNKERKEGV

SEQ ID NO: 93745 - protein, 14 aa, Borrelia burgdorferi
VLCCDNKERKEGVS

SEQ ID NO: 93746 - protein, 14 aa, Borrelia burgdorferi
LCCDNKERKEGVST

SEQ ID NO: 93747 - protein, 14 aa, Borrelia burgdorferi
CCDNKERKEGVSTK

SEQ ID NO: 93748 - protein, 14 aa, Borrelia burgdorferi
CDNKERKEGVSTKI

SEQ ID NO: 93749 - protein, 14 aa, Borrelia burgdorferi
DNKERKEGVSTKIS

SEQ ID NO: 93750 - protein, 14 aa, Borrelia burgdorferi
NKERKEGVSTKISL

SEQ ID NO: 93751 - protein, 14 aa, Borrelia burgdorferi
KERKEGVSTKISLG

SEQ ID NO: 93752 - protein, 14 aa, Borrelia burgdorferi
ERKEGVSTKISLGA

SEQ ID NO: 93753 - protein, 14 aa, Borrelia burgdorferi
RKEGVSTKISLGAE

SEQ ID NO: 93754 - protein, 14 aa, Borrelia burgdorferi
KEGVSTKISLGAEP

SEQ ID NO: 93755 - protein, 14 aa, Borrelia burgdorferi
EGVSTKISLGAEPR

SEQ ID NO: 93756 - protein, 14 aa, Borrelia burgdorferi
GVSTKISLGAEPRS

SEQ ID NO: 93757 - protein, 14 aa, Borrelia burgdorferi
VSTKISLGAEPRSL

SEQ ID NO: 93758 - protein, 14 aa, Borrelia burgdorferi
STKISLGAEPRSLD

SEQ ID NO: 93759 - protein, 14 aa, Borrelia burgdorferi
TKISLGAEPRSLDP

SEQ ID NO: 93760 - protein, 14 aa, Borrelia burgdorferi
KISLGAEPRSLDPQ

SEQ ID NO: 93761 - protein, 14 aa, Borrelia burgdorferi
ISLGAEPRSLDPQL

SEQ ID NO: 93762 - protein, 14 aa, Borrelia burgdorferi
SLGAEPRSLDPQLA

SEQ ID NO: 93763 - protein, 14 aa, Borrelia burgdorferi
LGAEPRSLDPQLAE

SEQ ID NO: 93764 - protein, 14 aa, Borrelia burgdorferi
GAEPRSLDPQLAED

SEQ ID NO: 93765 - protein, 14 aa, Borrelia burgdorferi
AEPRSLDPQLAEDN

SEQ ID NO: 93766 - protein, 14 aa, Borrelia burgdorferi
EPRSLDPQLAEDNV

SEQ ID NO: 93767 - protein, 14 aa, Borrelia burgdorferi
PRSLDPQLAEDNVA

SEQ ID NO: 93768 - protein, 14 aa, Borrelia burgdorferi
RSLDPQLAEDNVAS

SEQ ID NO: 93769 - protein, 14 aa, Borrelia burgdorferi
SLDPQLAEDNVASK

SEQ ID NO: 93770 - protein, 14 aa, Borrelia burgdorferi
LDPQLAEDNVASKM

SEQ ID NO: 93771 - protein, 14 aa, Borrelia burgdorferi
DPQLAEDNVASKMI

SEQ ID NO: 93772 - protein, 14 aa, Borrelia burgdorferi
PQLAEDNVASKMID

SEQ ID NO: 93773 - protein, 14 aa, Borrelia burgdorferi
QLAEDNVASKMIDT

SEQ ID NO: 93774 - protein, 14 aa, Borrelia burgdorferi
LAEDNVASKMIDTL

SEQ ID NO: 93775 - protein, 14 aa, Borrelia burgdorferi
AEDNVASKMIDTLY

SEQ ID NO: 93776 - protein, 14 aa, Borrelia burgdorferi
EDNVASKMIDTLYR

SEQ ID NO: 93777 - protein, 14 aa, Borrelia burgdorferi
DNVASKMIDTLYRG

SEQ ID NO: 93778 - protein, 14 aa, Borrelia burgdorferi
NVASKMIDTLYRGI

SEQ ID NO: 93779 - protein, 14 aa, Borrelia burgdorferi
VASKMIDTLYRGIV

SEQ ID NO: 93780 - protein, 14 aa, Borrelia burgdorferi
ASKMIDTLYRGIVT

SEQ ID NO: 93781 - protein, 14 aa, Borrelia burgdorferi
SKMIDTLYRGIVTG

SEQ ID NO: 93782 - protein, 14 aa, Borrelia burgdorferi
KMIDTLYRGIVTGD

SEQ ID NO: 93783 - protein, 14 aa, Borrelia burgdorferi
MIDTLYRGIVTGDP

SEQ ID NO: 93784 - protein, 14 aa, Borrelia burgdorferi
IDTLYRGIVTGDPN

SEQ ID NO: 93785 - protein, 14 aa, Borrelia burgdorferi
DTLYRGIVTGDPNT

SEQ ID NO: 93786 - protein, 14 aa, Borrelia burgdorferi
TLYRGIVTGDPNTG

SEQ ID NO: 93787 - protein, 14 aa, Borrelia burgdorferi
LYRGIVTGDPNTGG

SEQ ID NO: 93788 - protein, 14 aa, Borrelia burgdorferi
YRGIVTGDPNTGGH

SEQ ID NO: 93789 - protein, 14 aa, Borrelia burgdorferi
RGIVTGDPNTGGHK

SEQ ID NO: 93790 - protein, 14 aa, Borrelia burgdorferi
GIVTGDPNTGGHKP

SEQ ID NO: 93791 - protein, 14 aa, Borrelia burgdorferi
IVTGDPNTGGHKPG

SEQ ID NO: 93792 - protein, 14 aa, Borrelia burgdorferi
VTGDPNTGGHKPGL

SEQ ID NO: 93793 - protein, 14 aa, Borrelia burgdorferi
TGDPNTGGHKPGLA

SEQ ID NO: 93794 - protein, 14 aa, Borrelia burgdorferi
GDPNTGGHKPGLAK

SEQ ID NO: 93795 - protein, 14 aa, Borrelia burgdorferi
DPNTGGHKPGLAKG

SEQ ID NO: 93796 - protein, 14 aa, Borrelia burgdorferi
PNTGGHKPGLAKGW

SEQ ID NO: 93797 - protein, 14 aa, Borrelia burgdorferi
NTGGHKPGLAKGWE

SEQ ID NO: 93798 - protein, 14 aa, Borrelia burgdorferi
TGGHKPGLAKGWET

SEQ ID NO: 93799 - protein, 14 aa, Borrelia burgdorferi
GGHKPGLAKGWETS

SEQ ID NO: 93800 - protein, 14 aa, Borrelia burgdorferi
GHKPGLAKGWETSS

SEQ ID NO: 93801 - protein, 14 aa, Borrelia burgdorferi
HKPGLAKGWETSSD

SEQ ID NO: 93802 - protein, 14 aa, Borrelia burgdorferi
KPGLAKGWETSSDG

SEQ ID NO: 93803 - protein, 14 aa, Borrelia burgdorferi
PGLAKGWETSSDGT

SEQ ID NO: 93804 - protein, 14 aa, Borrelia burgdorferi
GLAKGWETSSDGTA

SEQ ID NO: 93805 - protein, 14 aa, Borrelia burgdorferi
LAKGWETSSDGTAY

SEQ ID NO: 93806 - protein, 14 aa, Borrelia burgdorferi
AKGWETSSDGTAYP

SEQ ID NO: 93807 - protein, 14 aa, Borrelia burgdorferi
KGWETSSDGTAYPF

SEQ ID NO: 93808 - protein, 14 aa, Borrelia burgdorferi
GWETSSDGTAYPFY

SEQ ID NO: 93809 - protein, 14 aa, Borrelia burgdorferi
WETSSDGTAYPFYL

SEQ ID NO: 93810 - protein, 14 aa, Borrelia burgdorferi
ETSSDGTAYPFYLR

SEQ ID NO: 93811 - protein, 14 aa, Borrelia burgdorferi
TSSDGTAYPFYLRD

SEQ ID NO: 93812 - protein, 14 aa, Borrelia burgdorferi
SSDGTAYPFYLRDN

SEQ ID NO: 93813 - protein, 14 aa, Borrelia burgdorferi
SDGTAYPFYLRDNL

SEQ ID NO: 93814 - protein, 14 aa, Borrelia burgdorferi
DGTAYPFYLRDNLT

SEQ ID NO: 93815 - protein, 14 aa, Borrelia burgdorferi
GTAYPFYLRDNLTW

SEQ ID NO: 93816 - protein, 14 aa, Borrelia burgdorferi
TAYPFYLRDNLTWS

SEQ ID NO: 93817 - protein, 14 aa, Borrelia burgdorferi
AYPFYLRDNLTWSD

SEQ ID NO: 93818 - protein, 14 aa, Borrelia burgdorferi
YPFYLRDNLTWSDG

SEQ ID NO: 93819 - protein, 14 aa, Borrelia burgdorferi
PFYLRDNLTWSDGV

SEQ ID NO: 93820 - protein, 14 aa, Borrelia burgdorferi
FYLRDNLTWSDGVA

SEQ ID NO: 93821 - protein, 14 aa, Borrelia burgdorferi
YLRDNLTWSDGVAI

SEQ ID NO: 93822 - protein, 14 aa, Borrelia burgdorferi
LRDNLTWSDGVAIT

SEQ ID NO: 93823 - protein, 14 aa, Borrelia burgdorferi
RDNLTWSDGVAITA

SEQ ID NO: 93824 - protein, 14 aa, Borrelia burgdorferi
DNLTWSDGVAITAE

SEQ ID NO: 93825 - protein, 14 aa, Borrelia burgdorferi
NLTWSDGVAITAEG

SEQ ID NO: 93826 - protein, 14 aa, Borrelia burgdorferi
LTWSDGVAITAEGI

SEQ ID NO: 93827 - protein, 14 aa, Borrelia burgdorferi
TWSDGVAITAEGIR

SEQ ID NO: 93828 - protein, 14 aa, Borrelia burgdorferi
WSDGVAITAEGIRK

SEQ ID NO: 93829 - protein, 14 aa, Borrelia burgdorferi
SDGVAITAEGIRKS

SEQ ID NO: 93830 - protein, 14 aa, Borrelia burgdorferi
DGVAITAEGIRKSY

SEQ ID NO: 93831 - protein, 14 aa, Borrelia burgdorferi
GVAITAEGIRKSYL

SEQ ID NO: 93832 - protein, 14 aa, Borrelia burgdorferi
VAITAEGIRKSYLR

SEQ ID NO: 93833 - protein, 14 aa, Borrelia burgdorferi
AITAEGIRKSYLRI

SEQ ID NO: 93834 - protein, 14 aa, Borrelia burgdorferi
ITAEGIRKSYLRIL

SEQ ID NO: 93835 - protein, 14 aa, Borrelia burgdorferi
TAEGIRKSYLRILN

SEQ ID NO: 93836 - protein, 14 aa, Borrelia burgdorferi
AEGIRKSYLRILNK

SEQ ID NO: 93837 - protein, 14 aa, Borrelia burgdorferi
EGIRKSYLRILNKE

SEQ ID NO: 93838 - protein, 14 aa, Borrelia burgdorferi
GIRKSYLRILNKET

SEQ ID NO: 93839 - protein, 14 aa, Borrelia burgdorferi
IRKSYLRILNKETG

SEQ ID NO: 93840 - protein, 14 aa, Borrelia burgdorferi
RKSYLRILNKETGS

SEQ ID NO: 93841 - protein, 14 aa, Borrelia burgdorferi
KSYLRILNKETGST

SEQ ID NO: 93842 - protein, 14 aa, Borrelia burgdorferi
SYLRILNKETGSTY

SEQ ID NO: 93843 - protein, 14 aa, Borrelia burgdorferi
YLRILNKETGSTYV

SEQ ID NO: 93844 - protein, 14 aa, Borrelia burgdorferi
LRILNKETGSTYVD

SEQ ID NO: 93845 - protein, 14 aa, Borrelia burgdorferi
RILNKETGSTYVDM

SEQ ID NO: 93846 - protein, 14 aa, Borrelia burgdorferi
ILNKETGSTYVDMV

SEQ ID NO: 93847 - protein, 14 aa, Borrelia burgdorferi
LNKETGSTYVDMVK

SEQ ID NO: 93848 - protein, 14 aa, Borrelia burgdorferi
NKETGSTYVDMVKS

SEQ ID NO: 93849 - protein, 14 aa, Borrelia burgdorferi
KETGSTYVDMVKSI

SEQ ID NO: 93850 - protein, 14 aa, Borrelia burgdorferi
ETGSTYVDMVKSII

SEQ ID NO: 93851 - protein, 14 aa, Borrelia burgdorferi
TGSTYVDMVKSIIK

SEQ ID NO: 93852 - protein, 14 aa, Borrelia burgdorferi
GSTYVDMVKSIIKN

SEQ ID NO: 93853 - protein, 14 aa, Borrelia burgdorferi
STYVDMVKSIIKNG

SEQ ID NO: 93854 - protein, 14 aa, Borrelia burgdorferi
TYVDMVKSIIKNGQ

SEQ ID NO: 93855 - protein, 14 aa, Borrelia burgdorferi
YVDMVKSIIKNGQE

SEQ ID NO: 93856 - protein, 14 aa, Borrelia burgdorferi
VDMVKSIIKNGQEY

SEQ ID NO: 93857 - protein, 14 aa, Borrelia burgdorferi
DMVKSIIKNGQEYF

SEQ ID NO: 93858 - protein, 14 aa, Borrelia burgdorferi
MVKSIIKNGQEYFD

SEQ ID NO: 93859 - protein, 14 aa, Borrelia burgdorferi
VKSIIKNGQEYFDG

SEQ ID NO: 93860 - protein, 14 aa, Borrelia burgdorferi
KSIIKNGQEYFDGQ

SEQ ID NO: 93861 - protein, 14 aa, Borrelia burgdorferi
SIIKNGQEYFDGQV

SEQ ID NO: 93862 - protein, 14 aa, Borrelia burgdorferi
IIKNGQEYFDGQVT

SEQ ID NO: 93863 - protein, 14 aa, Borrelia burgdorferi
IKNGQEYFDGQVTD

SEQ ID NO: 93864 - protein, 14 aa, Borrelia burgdorferi
KNGQEYFDGQVTDS

SEQ ID NO: 93865 - protein, 14 aa, Borrelia burgdorferi
NGQEYFDGQVTDSE

SEQ ID NO: 93866 - protein, 14 aa, Borrelia burgdorferi
GQEYFDGQVTDSEL

SEQ ID NO: 93867 - protein, 14 aa, Borrelia burgdorferi
QEYFDGQVTDSELG

SEQ ID NO: 93868 - protein, 14 aa, Borrelia burgdorferi
EYFDGQVTDSELGI

SEQ ID NO: 93869 - protein, 14 aa, Borrelia burgdorferi
YFDGQVTDSELGIR

SEQ ID NO: 93870 - protein, 14 aa, Borrelia burgdorferi
FDGQVTDSELGIRA

SEQ ID NO: 93871 - protein, 14 aa, Borrelia burgdorferi
DGQVTDSELGIRAI

SEQ ID NO: 93872 - protein, 14 aa, Borrelia burgdorferi
GQVTDSELGIRAID

SEQ ID NO: 93873 - protein, 14 aa, Borrelia burgdorferi
QVTDSELGIRAIDS

SEQ ID NO: 93874 - protein, 14 aa, Borrelia burgdorferi
VTDSELGIRAIDSK

SEQ ID NO: 93875 - protein, 14 aa, Borrelia burgdorferi
TDSELGIRAIDSKT

SEQ ID NO: 93876 - protein, 14 aa, Borrelia burgdorferi
DSELGIRAIDSKTL

SEQ ID NO: 93877 - protein, 14 aa, Borrelia burgdorferi
SELGIRAIDSKTLE

SEQ ID NO: 93878 - protein, 14 aa, Borrelia burgdorferi
ELGIRAIDSKTLEI

SEQ ID NO: 93879 - protein, 14 aa, Borrelia burgdorferi
LGIRAIDSKTLEIT

SEQ ID NO: 93880 - protein, 14 aa, Borrelia burgdorferi
GIRAIDSKTLEITL

SEQ ID NO: 93881 - protein, 14 aa, Borrelia burgdorferi
IRAIDSKTLEITLA

SEQ ID NO: 93882 - protein, 14 aa, Borrelia burgdorferi
RAIDSKTLEITLAS

SEQ ID NO: 93883 - protein, 14 aa, Borrelia burgdorferi
AIDSKTLEITLASP

SEQ ID NO: 93884 - protein, 14 aa, Borrelia burgdorferi
IDSKTLEITLASPK

SEQ ID NO: 93885 - protein, 14 aa, Borrelia burgdorferi
DSKTLEITLASPKP

SEQ ID NO: 93886 - protein, 14 aa, Borrelia burgdorferi
SKTLEITLASPKPY

SEQ ID NO: 93887 - protein, 14 aa, Borrelia burgdorferi
KTLEITLASPKPYF

SEQ ID NO: 93888 - protein, 14 aa, Borrelia burgdorferi
TLEITLASPKPYFI

SEQ ID NO: 93889 - protein, 14 aa, Borrelia burgdorferi
LEITLASPKPYFID

SEQ ID NO: 93890 - protein, 14 aa, Borrelia burgdorferi
EITLASPKPYFIDL

SEQ ID NO: 93891 - protein, 14 aa, Borrelia burgdorferi
ITLASPKPYFIDLL

SEQ ID NO: 93892 - protein, 14 aa, Borrelia burgdorferi
TLASPKPYFIDLLV

SEQ ID NO: 93893 - protein, 14 aa, Borrelia burgdorferi
LASPKPYFIDLLVH

SEQ ID NO: 93894 - protein, 14 aa, Borrelia burgdorferi
ASPKPYFIDLLVHQ

SEQ ID NO: 93895 - protein, 14 aa, Borrelia burgdorferi
SPKPYFIDLLVHQS

SEQ ID NO: 93896 - protein, 14 aa, Borrelia burgdorferi
PKPYFIDLLVHQSF

SEQ ID NO: 93897 - protein, 14 aa, Borrelia burgdorferi
KPYFIDLLVHQSFI

SEQ ID NO: 93898 - protein, 14 aa, Borrelia burgdorferi
PYFIDLLVHQSFIP

SEQ ID NO: 93899 - protein, 14 aa, Borrelia burgdorferi
YFIDLLVHQSFIPV

SEQ ID NO: 93900 - protein, 14 aa, Borrelia burgdorferi
FIDLLVHQSFIPVP

SEQ ID NO: 93901 - protein, 14 aa, Borrelia burgdorferi
IDLLVHQSFIPVPV

SEQ ID NO: 93902 - protein, 14 aa, Borrelia burgdorferi
DLLVHQSFIPVPVH

SEQ ID NO: 93903 - protein, 14 aa, Borrelia burgdorferi
LLVHQSFIPVPVHV

SEQ ID NO: 93904 - protein, 14 aa, Borrelia burgdorferi
LVHQSFIPVPVHVT

SEQ ID NO: 93905 - protein, 14 aa, Borrelia burgdorferi
VHQSFIPVPVHVTD

SEQ ID NO: 93906 - protein, 14 aa, Borrelia burgdorferi
HQSFIPVPVHVTDK

SEQ ID NO: 93907 - protein, 14 aa, Borrelia burgdorferi
QSFIPVPVHVTDKY

SEQ ID NO: 93908 - protein, 14 aa, Borrelia burgdorferi
SFIPVPVHVTDKYG

SEQ ID NO: 93909 - protein, 14 aa, Borrelia burgdorferi
FIPVPVHVTDKYGQ

SEQ ID NO: 93910 - protein, 14 aa, Borrelia burgdorferi
IPVPVHVTDKYGQN

SEQ ID NO: 93911 - protein, 14 aa, Borrelia burgdorferi
PVPVHVTDKYGQNW

SEQ ID NO: 93912 - protein, 14 aa, Borrelia burgdorferi
VPVHVTDKYGQNWT

SEQ ID NO: 93913 - protein, 14 aa, Borrelia burgdorferi
PVHVTDKYGQNWTS

SEQ ID NO: 93914 - protein, 14 aa, Borrelia burgdorferi
VHVTDKYGQNWTSP

SEQ ID NO: 93915 - protein, 14 aa, Borrelia burgdorferi
HVTDKYGQNWTSPE

SEQ ID NO: 93916 - protein, 14 aa, Borrelia burgdorferi
VTDKYGQNWTSPEN

SEQ ID NO: 93917 - protein, 14 aa, Borrelia burgdorferi
TDKYGQNWTSPENM

SEQ ID NO: 93918 - protein, 14 aa, Borrelia burgdorferi
DKYGQNWTSPENMV

SEQ ID NO: 93919 - protein, 14 aa, Borrelia burgdorferi
KYGQNWTSPENMVT

SEQ ID NO: 93920 - protein, 14 aa, Borrelia burgdorferi
YGQNWTSPENMVTS

SEQ ID NO: 93921 - protein, 14 aa, Borrelia burgdorferi
GQNWTSPENMVTSG

SEQ ID NO: 93922 - protein, 14 aa, Borrelia burgdorferi
QNWTSPENMVTSGP

SEQ ID NO: 93923 - protein, 14 aa, Borrelia burgdorferi
NWTSPENMVTSGPF

SEQ ID NO: 93924 - protein, 14 aa, Borrelia burgdorferi
WTSPENMVTSGPFK

SEQ ID NO: 93925 - protein, 14 aa, Borrelia burgdorferi
TSPENMVTSGPFKL

SEQ ID NO: 93926 - protein, 14 aa, Borrelia burgdorferi
SPENMVTSGPFKLK

SEQ ID NO: 93927 - protein, 14 aa, Borrelia burgdorferi
PENMVTSGPFKLKE

SEQ ID NO: 93928 - protein, 14 aa, Borrelia burgdorferi
ENMVTSGPFKLKER

SEQ ID NO: 93929 - protein, 14 aa, Borrelia burgdorferi
NMVTSGPFKLKERI

SEQ ID NO: 93930 - protein, 14 aa, Borrelia burgdorferi
MVTSGPFKLKERIP

SEQ ID NO: 93931 - protein, 14 aa, Borrelia burgdorferi
VTSGPFKLKERIPS

SEQ ID NO: 93932 - protein, 14 aa, Borrelia burgdorferi
TSGPFKLKERIPSE

SEQ ID NO: 93933 - protein, 14 aa, Borrelia burgdorferi
SGPFKLKERIPSEK

SEQ ID NO: 93934 - protein, 14 aa, Borrelia burgdorferi
GPFKLKERIPSEKY

SEQ ID NO: 93935 - protein, 14 aa, Borrelia burgdorferi
PFKLKERIPSEKYV

SEQ ID NO: 93936 - protein, 14 aa, Borrelia burgdorferi
FKLKERIPSEKYVF

SEQ ID NO: 93937 - protein, 14 aa, Borrelia burgdorferi
KLKERIPSEKYVFE

SEQ ID NO: 93938 - protein, 14 aa, Borrelia burgdorferi
LKERIPSEKYVFEK

SEQ ID NO: 93939 - protein, 14 aa, Borrelia burgdorferi
KERIPSEKYVFEKD

SEQ ID NO: 93940 - protein, 14 aa, Borrelia burgdorferi
ERIPSEKYVFEKDN

SEQ ID NO: 93941 - protein, 14 aa, Borrelia burgdorferi
RIPSEKYVFEKDNK

SEQ ID NO: 93942 - protein, 14 aa, Borrelia burgdorferi
IPSEKYVFEKDNKY

SEQ ID NO: 93943 - protein, 14 aa, Borrelia burgdorferi
PSEKYVFEKDNKYY

SEQ ID NO: 93944 - protein, 14 aa, Borrelia burgdorferi
SEKYVFEKDNKYYD

SEQ ID NO: 93945 - protein, 14 aa, Borrelia burgdorferi
EKYVFEKDNKYYDS

SEQ ID NO: 93946 - protein, 14 aa, Borrelia burgdorferi
KYVFEKDNKYYDSN

SEQ ID NO: 93947 - protein, 14 aa, Borrelia burgdorferi
YVFEKDNKYYDSNE

SEQ ID NO: 93948 - protein, 14 aa, Borrelia burgdorferi
VFEKDNKYYDSNEV

SEQ ID NO: 93949 - protein, 14 aa, Borrelia burgdorferi
FEKDNKYYDSNEVE

SEQ ID NO: 93950 - protein, 14 aa, Borrelia burgdorferi
EKDNKYYDSNEVEL

SEQ ID NO: 93951 - protein, 14 aa, Borrelia burgdorferi
KDNKYYDSNEVELE

SEQ ID NO: 93952 - protein, 14 aa, Borrelia burgdorferi
DNKYYDSNEVELEE

SEQ ID NO: 93953 - protein, 14 aa, Borrelia burgdorferi
NKYYDSNEVELEEI

SEQ ID NO: 93954 - protein, 14 aa, Borrelia burgdorferi
KYYDSNEVELEEIT

SEQ ID NO: 93955 - protein, 14 aa, Borrelia burgdorferi
YYDSNEVELEEITF

SEQ ID NO: 93956 - protein, 14 aa, Borrelia burgdorferi
YDSNEVELEEITFY

SEQ ID NO: 93957 - protein, 14 aa, Borrelia burgdorferi
DSNEVELEEITFYT

SEQ ID NO: 93958 - protein, 14 aa, Borrelia burgdorferi
SNEVELEEITFYTT

SEQ ID NO: 93959 - protein, 14 aa, Borrelia burgdorferi
NEVELEEITFYTTN

SEQ ID NO: 93960 - protein, 14 aa, Borrelia burgdorferi
EVELEEITFYTTND

SEQ ID NO: 93961 - protein, 14 aa, Borrelia burgdorferi
VELEEITFYTTNDS

SEQ ID NO: 93962 - protein, 14 aa, Borrelia burgdorferi
ELEEITFYTTNDSS

SEQ ID NO: 93963 - protein, 14 aa, Borrelia burgdorferi
LEEITFYTTNDSST

SEQ ID NO: 93964 - protein, 14 aa, Borrelia burgdorferi
EEITFYTTNDSSTA

SEQ ID NO: 93965 - protein, 14 aa, Borrelia burgdorferi
EITFYTTNDSSTAY

SEQ ID NO: 93966 - protein, 14 aa, Borrelia burgdorferi
ITFYTTNDSSTAYK

SEQ ID NO: 93967 - protein, 14 aa, Borrelia burgdorferi
TFYTTNDSSTAYKM

SEQ ID NO: 93968 - protein, 14 aa, Borrelia burgdorferi
FYTTNDSSTAYKMY

SEQ ID NO: 93969 - protein, 14 aa, Borrelia burgdorferi
YTTNDSSTAYKMYV

SEQ ID NO: 93970 - protein, 14 aa, Borrelia burgdorferi
TTNDSSTAYKMYVN

SEQ ID NO: 93971 - protein, 14 aa, Borrelia burgdorferi
TNDSSTAYKMYVNE

SEQ ID NO: 93972 - protein, 14 aa, Borrelia burgdorferi
NDSSTAYKMYVNEE

SEQ ID NO: 93973 - protein, 14 aa, Borrelia burgdorferi
DSSTAYKMYVNEEL

SEQ ID NO: 93974 - protein, 14 aa, Borrelia burgdorferi
SSTAYKMYVNEELD

SEQ ID NO: 93975 - protein, 14 aa, Borrelia burgdorferi
STAYKMYVNEELDA

SEQ ID NO: 93976 - protein, 14 aa, Borrelia burgdorferi
TAYKMYVNEELDAI

SEQ ID NO: 93977 - protein, 14 aa, Borrelia burgdorferi
AYKMYVNEELDAIL

SEQ ID NO: 93978 - protein, 14 aa, Borrelia burgdorferi
YKMYVNEELDAILV

SEQ ID NO: 93979 - protein, 14 aa, Borrelia burgdorferi
KMYVNEELDAILVP

SEQ ID NO: 93980 - protein, 14 aa, Borrelia burgdorferi
MYVNEELDAILVPY

SEQ ID NO: 93981 - protein, 14 aa, Borrelia burgdorferi
YVNEELDAILVPYP

SEQ ID NO: 93982 - protein, 14 aa, Borrelia burgdorferi
VNEELDAILVPYPQ

SEQ ID NO: 93983 - protein, 14 aa, Borrelia burgdorferi
NEELDAILVPYPQI

SEQ ID NO: 93984 - protein, 15 aa, Borrelia burgdorferi
MKLQRSLSLIIFSLT

SEQ ID NO: 93985 - protein, 15 aa, Borrelia burgdorferi
KLQRSLSLIIFSLTV

SEQ ID NO: 93986 - protein, 15 aa, Borrelia burgdorferi
LQRSLSLIIFSLTVL

SEQ ID NO: 93987 - protein, 15 aa, Borrelia burgdorferi
QRSLSLIIFSLTVLC

SEQ ID NO: 93988 - protein, 15 aa, Borrelia burgdorferi
RSLSLIIFSLTVLCC

SEQ ID NO: 93989 - protein, 15 aa, Borrelia burgdorferi
SLSLIIFSLTVLCCD

SEQ ID NO: 93990 - protein, 15 aa, Borrelia burgdorferi
LSLIIFSLTVLCCDN

SEQ ID NO: 93991 - protein, 15 aa, Borrelia burgdorferi
SLIIFSLTVLCCDNK

SEQ ID NO: 93992 - protein, 15 aa, Borrelia burgdorferi
LIIFSLTVLCCDNKE

SEQ ID NO: 93993 - protein, 15 aa, Borrelia burgdorferi
IIFSLTVLCCDNKER

SEQ ID NO: 93994 - protein, 15 aa, Borrelia burgdorferi
IFSLTVLCCDNKERK

SEQ ID NO: 93995 - protein, 15 aa, Borrelia burgdorferi
FSLTVLCCDNKERKE

SEQ ID NO: 93996 - protein, 15 aa, Borrelia burgdorferi
SLTVLCCDNKERKEG

SEQ ID NO: 93997 - protein, 15 aa, Borrelia burgdorferi
LTVLCCDNKERKEGV

SEQ ID NO: 93998 - protein, 15 aa, Borrelia burgdorferi
TVLCCDNKERKEGVS

SEQ ID NO: 93999 - protein, 15 aa, Borrelia burgdorferi
VLCCDNKERKEGVST

SEQ ID NO: 94000 - protein, 15 aa, Borrelia burgdorferi
LCCDNKERKEGVSTK

SEQ ID NO: 94001 - protein, 15 aa, Borrelia burgdorferi
CCDNKERKEGVSTKI

SEQ ID NO: 94002 - protein, 15 aa, Borrelia burgdorferi
CDNKERKEGVSTKIS

SEQ ID NO: 94003 - protein, 15 aa, Borrelia burgdorferi
DNKERKEGVSTKISL

SEQ ID NO: 94004 - protein, 15 aa, Borrelia burgdorferi
NKERKEGVSTKISLG

SEQ ID NO: 94005 - protein, 15 aa, Borrelia burgdorferi
KERKEGVSTKISLGA

SEQ ID NO: 94006 - protein, 15 aa, Borrelia burgdorferi
ERKEGVSTKISLGAE

SEQ ID NO: 94007 - protein, 15 aa, Borrelia burgdorferi
RKEGVSTKISLGAEP

SEQ ID NO: 94008 - protein, 15 aa, Borrelia burgdorferi
KEGVSTKISLGAEPR

SEQ ID NO: 94009 - protein, 15 aa, Borrelia burgdorferi
EGVSTKISLGAEPRS

SEQ ID NO: 94010 - protein, 15 aa, Borrelia burgdorferi
GVSTKISLGAEPRSL

SEQ ID NO: 94011 - protein, 15 aa, Borrelia burgdorferi
VSTKISLGAEPRSLD

SEQ ID NO: 94012 - protein, 15 aa, Borrelia burgdorferi
STKISLGAEPRSLDP

SEQ ID NO: 94013 - protein, 15 aa, Borrelia burgdorferi
TKISLGAEPRSLDPQ

SEQ ID NO: 94014 - protein, 15 aa, Borrelia burgdorferi
KISLGAEPRSLDPQL

SEQ ID NO: 94015 - protein, 15 aa, Borrelia burgdorferi
ISLGAEPRSLDPQLA

SEQ ID NO: 94016 - protein, 15 aa, Borrelia burgdorferi
SLGAEPRSLDPQLAE

SEQ ID NO: 94017 - protein, 15 aa, Borrelia burgdorferi
LGAEPRSLDPQLAED

SEQ ID NO: 94018 - protein, 15 aa, Borrelia burgdorferi
GAEPRSLDPQLAEDN

SEQ ID NO: 94019 - protein, 15 aa, Borrelia burgdorferi
AEPRSLDPQLAEDNV

SEQ ID NO: 94020 - protein, 15 aa, Borrelia burgdorferi
EPRSLDPQLAEDNVA

SEQ ID NO: 94021 - protein, 15 aa, Borrelia burgdorferi
PRSLDPQLAEDNVAS

SEQ ID NO: 94022 - protein, 15 aa, Borrelia burgdorferi
RSLDPQLAEDNVASK

SEQ ID NO: 94023 - protein, 15 aa, Borrelia burgdorferi
SLDPQLAEDNVASKM

SEQ ID NO: 94024 - protein, 15 aa, Borrelia burgdorferi
LDPQLAEDNVASKMI

SEQ ID NO: 94025 - protein, 15 aa, Borrelia burgdorferi
DPQLAEDNVASKMID

SEQ ID NO: 94026 - protein, 15 aa, Borrelia burgdorferi
PQLAEDNVASKMIDT

SEQ ID NO: 94027 - protein, 15 aa, Borrelia burgdorferi
QLAEDNVASKMIDTL

SEQ ID NO: 94028 - protein, 15 aa, Borrelia burgdorferi
LAEDNVASKMIDTLY

SEQ ID NO: 94029 - protein, 15 aa, Borrelia burgdorferi
AEDNVASKMIDTLYR

SEQ ID NO: 94030 - protein, 15 aa, Borrelia burgdorferi
EDNVASKMIDTLYRG

SEQ ID NO: 94031 - protein, 15 aa, Borrelia burgdorferi
DNVASKMIDTLYRGI

SEQ ID NO: 94032 - protein, 15 aa, Borrelia burgdorferi
NVASKMIDTLYRGIV

SEQ ID NO: 94033 - protein, 15 aa, Borrelia burgdorferi
VASKMIDTLYRGIVT

SEQ ID NO: 94034 - protein, 15 aa, Borrelia burgdorferi
ASKMIDTLYRGIVTG

SEQ ID NO: 94035 - protein, 15 aa, Borrelia burgdorferi
SKMIDTLYRGIVTGD

SEQ ID NO: 94036 - protein, 15 aa, Borrelia burgdorferi
KMIDTLYRGIVTGDP

SEQ ID NO: 94037 - protein, 15 aa, Borrelia burgdorferi
MIDTLYRGIVTGDPN

SEQ ID NO: 94038 - protein, 15 aa, Borrelia burgdorferi
IDTLYRGIVTGDPNT

SEQ ID NO: 94039 - protein, 15 aa, Borrelia burgdorferi
DTLYRGIVTGDPNTG

SEQ ID NO: 94040 - protein, 15 aa, Borrelia burgdorferi
TLYRGIVTGDPNTGG

SEQ ID NO: 94041 - protein, 15 aa, Borrelia burgdorferi
LYRGIVTGDPNTGGH

SEQ ID NO: 94042 - protein, 15 aa, Borrelia burgdorferi
YRGIVTGDPNTGGHK

SEQ ID NO: 94043 - protein, 15 aa, Borrelia burgdorferi
RGIVTGDPNTGGHKP

SEQ ID NO: 94044 - protein, 15 aa, Borrelia burgdorferi
GIVTGDPNTGGHKPG

SEQ ID NO: 94045 - protein, 15 aa, Borrelia burgdorferi
IVTGDPNTGGHKPGL

SEQ ID NO: 94046 - protein, 15 aa, Borrelia burgdorferi
VTGDPNTGGHKPGLA

SEQ ID NO: 94047 - protein, 15 aa, Borrelia burgdorferi
TGDPNTGGHKPGLAK

SEQ ID NO: 94048 - protein, 15 aa, Borrelia burgdorferi
GDPNTGGHKPGLAKG

SEQ ID NO: 94049 - protein, 15 aa, Borrelia burgdorferi
DPNTGGHKPGLAKGW

SEQ ID NO: 94050 - protein, 15 aa, Borrelia burgdorferi
PNTGGHKPGLAKGWE

SEQ ID NO: 94051 - protein, 15 aa, Borrelia burgdorferi
NTGGHKPGLAKGWET

SEQ ID NO: 94052 - protein, 15 aa, Borrelia burgdorferi
TGGHKPGLAKGWETS

SEQ ID NO: 94053 - protein, 15 aa, Borrelia burgdorferi
GGHKPGLAKGWETSS

SEQ ID NO: 94054 - protein, 15 aa, Borrelia burgdorferi
GHKPGLAKGWETSSD

SEQ ID NO: 94055 - protein, 15 aa, Borrelia burgdorferi
HKPGLAKGWETSSDG

SEQ ID NO: 94056 - protein, 15 aa, Borrelia burgdorferi
KPGLAKGWETSSDGT

SEQ ID NO: 94057 - protein, 15 aa, Borrelia burgdorferi
PGLAKGWETSSDGTA

SEQ ID NO: 94058 - protein, 15 aa, Borrelia burgdorferi
GLAKGWETSSDGTAY

SEQ ID NO: 94059 - protein, 15 aa, Borrelia burgdorferi
LAKGWETSSDGTAYP

SEQ ID NO: 94060 - protein, 15 aa, Borrelia burgdorferi
AKGWETSSDGTAYPF

SEQ ID NO: 94061 - protein, 15 aa, Borrelia burgdorferi
KGWETSSDGTAYPFY

SEQ ID NO: 94062 - protein, 15 aa, Borrelia burgdorferi
GWETSSDGTAYPFYL

SEQ ID NO: 94063 - protein, 15 aa, Borrelia burgdorferi
WETSSDGTAYPFYLR

SEQ ID NO: 94064 - protein, 15 aa, Borrelia burgdorferi
ETSSDGTAYPFYLRD

SEQ ID NO: 94065 - protein, 15 aa, Borrelia burgdorferi
TSSDGTAYPFYLRDN

SEQ ID NO: 94066 - protein, 15 aa, Borrelia burgdorferi
SSDGTAYPFYLRDNL

SEQ ID NO: 94067 - protein, 15 aa, Borrelia burgdorferi
SDGTAYPFYLRDNLT

SEQ ID NO: 94068 - protein, 15 aa, Borrelia burgdorferi
DGTAYPFYLRDNLTW

SEQ ID NO: 94069 - protein, 15 aa, Borrelia burgdorferi
GTAYPFYLRDNLTWS

SEQ ID NO: 94070 - protein, 15 aa, Borrelia burgdorferi
TAYPFYLRDNLTWSD

SEQ ID NO: 94071 - protein, 15 aa, Borrelia burgdorferi
AYPFYLRDNLTWSDG

SEQ ID NO: 94072 - protein, 15 aa, Borrelia burgdorferi
YPFYLRDNLTWSDGV

SEQ ID NO: 94073 - protein, 15 aa, Borrelia burgdorferi
PFYLRDNLTWSDGVA

SEQ ID NO: 94074 - protein, 15 aa, Borrelia burgdorferi
FYLRDNLTWSDGVAI

SEQ ID NO: 94075 - protein, 15 aa, Borrelia burgdorferi
YLRDNLTWSDGVAIT

SEQ ID NO: 94076 - protein, 15 aa, Borrelia burgdorferi
LRDNLTWSDGVAITA

SEQ ID NO: 94077 - protein, 15 aa, Borrelia burgdorferi
RDNLTWSDGVAITAE

SEQ ID NO: 94078 - protein, 15 aa, Borrelia burgdorferi
DNLTWSDGVAITAEG

SEQ ID NO: 94079 - protein, 15 aa, Borrelia burgdorferi
NLTWSDGVAITAEGI

SEQ ID NO: 94080 - protein, 15 aa, Borrelia burgdorferi
LTWSDGVAITAEGIR

SEQ ID NO: 94081 - protein, 15 aa, Borrelia burgdorferi
TWSDGVAITAEGIRK

SEQ ID NO: 94082 - protein, 15 aa, Borrelia burgdorferi
WSDGVAITAEGIRKS

SEQ ID NO: 94083 - protein, 15 aa, Borrelia burgdorferi
SDGVAITAEGIRKSY

SEQ ID NO: 94084 - protein, 15 aa, Borrelia burgdorferi
DGVAITAEGIRKSYL

SEQ ID NO: 94085 - protein, 15 aa, Borrelia burgdorferi
GVAITAEGIRKSYLR

SEQ ID NO: 94086 - protein, 15 aa, Borrelia burgdorferi
VAITAEGIRKSYLRI

SEQ ID NO: 94087 - protein, 15 aa, Borrelia burgdorferi
AITAEGIRKSYLRIL

SEQ ID NO: 94088 - protein, 15 aa, Borrelia burgdorferi
ITAEGIRKSYLRILN

SEQ ID NO: 94089 - protein, 15 aa, Borrelia burgdorferi
TAEGIRKSYLRILNK

SEQ ID NO: 94090 - protein, 15 aa, Borrelia burgdorferi
AEGIRKSYLRILNKE

SEQ ID NO: 94091 - protein, 15 aa, Borrelia burgdorferi
EGIRKSYLRILNKET

SEQ ID NO: 94092 - protein, 15 aa, Borrelia burgdorferi
GIRKSYLRILNKETG

SEQ ID NO: 94093 - protein, 15 aa, Borrelia burgdorferi
IRKSYLRILNKETGS

SEQ ID NO: 94094 - protein, 15 aa, Borrelia burgdorferi
RKSYLRILNKETGST

SEQ ID NO: 94095 - protein, 15 aa, Borrelia burgdorferi
KSYLRILNKETGSTY

SEQ ID NO: 94096 - protein, 15 aa, Borrelia burgdorferi
SYLRILNKETGSTYV

SEQ ID NO: 94097 - protein, 15 aa, Borrelia burgdorferi
YLRILNKETGSTYVD

SEQ ID NO: 94098 - protein, 15 aa, Borrelia burgdorferi
LRILNKETGSTYVDM

SEQ ID NO: 94099 - protein, 15 aa, Borrelia burgdorferi
RILNKETGSTYVDMV

SEQ ID NO: 94100 - protein, 15 aa, Borrelia burgdorferi
ILNKETGSTYVDMVK

SEQ ID NO: 94101 - protein, 15 aa, Borrelia burgdorferi
LNKETGSTYVDMVKS

SEQ ID NO: 94102 - protein, 15 aa, Borrelia burgdorferi
NKETGSTYVDMVKSI

SEQ ID NO: 94103 - protein, 15 aa, Borrelia burgdorferi
KETGSTYVDMVKSII

SEQ ID NO: 94104 - protein, 15 aa, Borrelia burgdorferi
ETGSTYVDMVKSIIK

SEQ ID NO: 94105 - protein, 15 aa, Borrelia burgdorferi
TGSTYVDMVKSIIKN

SEQ ID NO: 94106 - protein, 15 aa, Borrelia burgdorferi
GSTYVDMVKSIIKNG

SEQ ID NO: 94107 - protein, 15 aa, Borrelia burgdorferi
STYVDMVKSIIKNGQ

SEQ ID NO: 94108 - protein, 15 aa, Borrelia burgdorferi
TYVDMVKSIIKNGQE

SEQ ID NO: 94109 - protein, 15 aa, Borrelia burgdorferi
YVDMVKSIIKNGQEY

SEQ ID NO: 94110 - protein, 15 aa, Borrelia burgdorferi
VDMVKSIIKNGQEYF

SEQ ID NO: 94111 - protein, 15 aa, Borrelia burgdorferi
DMVKSIIKNGQEYFD

SEQ ID NO: 94112 - protein, 15 aa, Borrelia burgdorferi
MVKSIIKNGQEYFDG

SEQ ID NO: 94113 - protein, 15 aa, Borrelia burgdorferi
VKSIIKNGQEYFDGQ

SEQ ID NO: 94114 - protein, 15 aa, Borrelia burgdorferi
KSIIKNGQEYFDGQV

SEQ ID NO: 94115 - protein, 15 aa, Borrelia burgdorferi
SIIKNGQEYFDGQVT

SEQ ID NO: 94116 - protein, 15 aa, Borrelia burgdorferi
IIKNGQEYFDGQVTD

SEQ ID NO: 94117 - protein, 15 aa, Borrelia burgdorferi
IKNGQEYFDGQVTDS

SEQ ID NO: 94118 - protein, 15 aa, Borrelia burgdorferi
KNGQEYFDGQVTDSE

SEQ ID NO: 94119 - protein, 15 aa, Borrelia burgdorferi
NGQEYFDGQVTDSEL

SEQ ID NO: 94120 - protein, 15 aa, Borrelia burgdorferi
GQEYFDGQVTDSELG

SEQ ID NO: 94121 - protein, 15 aa, Borrelia burgdorferi
QEYFDGQVTDSELGI

SEQ ID NO: 94122 - protein, 15 aa, Borrelia burgdorferi
EYFDGQVTDSELGIR

SEQ ID NO: 94123 - protein, 15 aa, Borrelia burgdorferi
YFDGQVTDSELGIRA

SEQ ID NO: 94124 - protein, 15 aa, Borrelia burgdorferi
FDGQVTDSELGIRAI

SEQ ID NO: 94125 - protein, 15 aa, Borrelia burgdorferi
DGQVTDSELGIRAID

SEQ ID NO: 94126 - protein, 15 aa, Borrelia burgdorferi
GQVTDSELGIRAIDS

SEQ ID NO: 94127 - protein, 15 aa, Borrelia burgdorferi
QVTDSELGIRAIDSK

SEQ ID NO: 94128 - protein, 15 aa, Borrelia burgdorferi
VTDSELGIRAIDSKT

SEQ ID NO: 94129 - protein, 15 aa, Borrelia burgdorferi
TDSELGIRAIDSKTL

SEQ ID NO: 94130 - protein, 15 aa, Borrelia burgdorferi
DSELGIRAIDSKTLE

SEQ ID NO: 94131 - protein, 15 aa, Borrelia burgdorferi
SELGIRAIDSKTLEI

SEQ ID NO: 94132 - protein, 15 aa, Borrelia burgdorferi
ELGIRAIDSKTLEIT

SEQ ID NO: 94133 - protein, 15 aa, Borrelia burgdorferi
LGIRAIDSKTLEITL

SEQ ID NO: 94134 - protein, 15 aa, Borrelia burgdorferi
GIRAIDSKTLEITLA

SEQ ID NO: 94135 - protein, 15 aa, Borrelia burgdorferi
IRAIDSKTLEITLAS

SEQ ID NO: 94136 - protein, 15 aa, Borrelia burgdorferi
RAIDSKTLEITLASP

SEQ ID NO: 94137 - protein, 15 aa, Borrelia burgdorferi
AIDSKTLEITLASPK

SEQ ID NO: 94138 - protein, 15 aa, Borrelia burgdorferi
IDSKTLEITLASPKP

SEQ ID NO: 94139 - protein, 15 aa, Borrelia burgdorferi
DSKTLEITLASPKPY

SEQ ID NO: 94140 - protein, 15 aa, Borrelia burgdorferi
SKTLEITLASPKPYF

SEQ ID NO: 94141 - protein, 15 aa, Borrelia burgdorferi
KTLEITLASPKPYFI

SEQ ID NO: 94142 - protein, 15 aa, Borrelia burgdorferi
TLEITLASPKPYFID

SEQ ID NO: 94143 - protein, 15 aa, Borrelia burgdorferi
LEITLASPKPYFIDL

SEQ ID NO: 94144 - protein, 15 aa, Borrelia burgdorferi
EITLASPKPYFIDLL

SEQ ID NO: 94145 - protein, 15 aa, Borrelia burgdorferi
ITLASPKPYFIDLLV

SEQ ID NO: 94146 - protein, 15 aa, Borrelia burgdorferi
TLASPKPYFIDLLVH

SEQ ID NO: 94147 - protein, 15 aa, Borrelia burgdorferi
LASPKPYFIDLLVHQ

SEQ ID NO: 94148 - protein, 15 aa, Borrelia burgdorferi
ASPKPYFIDLLVHQS

SEQ ID NO: 94149 - protein, 15 aa, Borrelia burgdorferi
SPKPYFIDLLVHQSF

SEQ ID NO: 94150 - protein, 15 aa, Borrelia burgdorferi
PKPYFIDLLVHQSFI

SEQ ID NO: 94151 - protein, 15 aa, Borrelia burgdorferi
KPYFIDLLVHQSFIP

SEQ ID NO: 94152 - protein, 15 aa, Borrelia burgdorferi
PYFIDLLVHQSFIPV

SEQ ID NO: 94153 - protein, 15 aa, Borrelia burgdorferi
YFIDLLVHQSFIPVP

SEQ ID NO: 94154 - protein, 15 aa, Borrelia burgdorferi
FIDLLVHQSFIPVPV

SEQ ID NO: 94155 - protein, 15 aa, Borrelia burgdorferi
IDLLVHQSFIPVPVH

SEQ ID NO: 94156 - protein, 15 aa, Borrelia burgdorferi
DLLVHQSFIPVPVHV

SEQ ID NO: 94157 - protein, 15 aa, Borrelia burgdorferi
LLVHQSFIPVPVHVT

SEQ ID NO: 94158 - protein, 15 aa, Borrelia burgdorferi
LVHQSFIPVPVHVTD

SEQ ID NO: 94159 - protein, 15 aa, Borrelia burgdorferi
VHQSFIPVPVHVTDK

SEQ ID NO: 94160 - protein, 15 aa, Borrelia burgdorferi
HQSFIPVPVHVTDKY

SEQ ID NO: 94161 - protein, 15 aa, Borrelia burgdorferi
QSFIPVPVHVTDKYG

SEQ ID NO: 94162 - protein, 15 aa, Borrelia burgdorferi
SFIPVPVHVTDKYGQ

SEQ ID NO: 94163 - protein, 15 aa, Borrelia burgdorferi
FIPVPVHVTDKYGQN

SEQ ID NO: 94164 - protein, 15 aa, Borrelia burgdorferi
IPVPVHVTDKYGQNW

SEQ ID NO: 94165 - protein, 15 aa, Borrelia burgdorferi
PVPVHVTDKYGQNWT

SEQ ID NO: 94166 - protein, 15 aa, Borrelia burgdorferi
VPVHVTDKYGQNWTS

SEQ ID NO: 94167 - protein, 15 aa, Borrelia burgdorferi
PVHVTDKYGQNWTSP

SEQ ID NO: 94168 - protein, 15 aa, Borrelia burgdorferi
VHVTDKYGQNWTSPE

SEQ ID NO: 94169 - protein, 15 aa, Borrelia burgdorferi
HVTDKYGQNWTSPEN

SEQ ID NO: 94170 - protein, 15 aa, Borrelia burgdorferi
VTDKYGQNWTSPENM

SEQ ID NO: 94171 - protein, 15 aa, Borrelia burgdorferi
TDKYGQNWTSPENMV

SEQ ID NO: 94172 - protein, 15 aa, Borrelia burgdorferi
DKYGQNWTSPENMVT

SEQ ID NO: 94173 - protein, 15 aa, Borrelia burgdorferi
KYGQNWTSPENMVTS

SEQ ID NO: 94174 - protein, 15 aa, Borrelia burgdorferi
YGQNWTSPENMVTSG

SEQ ID NO: 94175 - protein, 15 aa, Borrelia burgdorferi
GQNWTSPENMVTSGP

SEQ ID NO: 94176 - protein, 15 aa, Borrelia burgdorferi
QNWTSPENMVTSGPF

SEQ ID NO: 94177 - protein, 15 aa, Borrelia burgdorferi
NWTSPENMVTSGPFK

SEQ ID NO: 94178 - protein, 15 aa, Borrelia burgdorferi
WTSPENMVTSGPFKL

SEQ ID NO: 94179 - protein, 15 aa, Borrelia burgdorferi
TSPENMVTSGPFKLK

SEQ ID NO: 94180 - protein, 15 aa, Borrelia burgdorferi
SPENMVTSGPFKLKE

SEQ ID NO: 94181 - protein, 15 aa, Borrelia burgdorferi
PENMVTSGPFKLKER

SEQ ID NO: 94182 - protein, 15 aa, Borrelia burgdorferi
ENMVTSGPFKLKERI

SEQ ID NO: 94183 - protein, 15 aa, Borrelia burgdorferi
NMVTSGPFKLKERIP

SEQ ID NO: 94184 - protein, 15 aa, Borrelia burgdorferi
MVTSGPFKLKERIPS

SEQ ID NO: 94185 - protein, 15 aa, Borrelia burgdorferi
VTSGPFKLKERIPSE

SEQ ID NO: 94186 - protein, 15 aa, Borrelia burgdorferi
TSGPFKLKERIPSEK

SEQ ID NO: 94187 - protein, 15 aa, Borrelia burgdorferi
SGPFKLKERIPSEKY

SEQ ID NO: 94188 - protein, 15 aa, Borrelia burgdorferi
GPFKLKERIPSEKYV

SEQ ID NO: 94189 - protein, 15 aa, Borrelia burgdorferi
PFKLKERIPSEKYVF

SEQ ID NO: 94190 - protein, 15 aa, Borrelia burgdorferi
FKLKERIPSEKYVFE

SEQ ID NO: 94191 - protein, 15 aa, Borrelia burgdorferi
KLKERIPSEKYVFEK

SEQ ID NO: 94192 - protein, 15 aa, Borrelia burgdorferi
LKERIPSEKYVFEKD

SEQ ID NO: 94193 - protein, 15 aa, Borrelia burgdorferi
KERIPSEKYVFEKDN

SEQ ID NO: 94194 - protein, 15 aa, Borrelia burgdorferi
ERIPSEKYVFEKDNK

SEQ ID NO: 94195 - protein, 15 aa, Borrelia burgdorferi
RIPSEKYVFEKDNKY

SEQ ID NO: 94196 - protein, 15 aa, Borrelia burgdorferi
IPSEKYVFEKDNKYY

SEQ ID NO: 94197 - protein, 15 aa, Borrelia burgdorferi
PSEKYVFEKDNKYYD

SEQ ID NO: 94198 - protein, 15 aa, Borrelia burgdorferi
SEKYVFEKDNKYYDS

SEQ ID NO: 94199 - protein, 15 aa, Borrelia burgdorferi
EKYVFEKDNKYYDSN

SEQ ID NO: 94200 - protein, 15 aa, Borrelia burgdorferi
KYVFEKDNKYYDSNE

SEQ ID NO: 94201 - protein, 15 aa, Borrelia burgdorferi
YVFEKDNKYYDSNEV

SEQ ID NO: 94202 - protein, 15 aa, Borrelia burgdorferi
VFEKDNKYYDSNEVE

SEQ ID NO: 94203 - protein, 15 aa, Borrelia burgdorferi
FEKDNKYYDSNEVEL

SEQ ID NO: 94204 - protein, 15 aa, Borrelia burgdorferi
EKDNKYYDSNEVELE

SEQ ID NO: 94205 - protein, 15 aa, Borrelia burgdorferi
KDNKYYDSNEVELEE

SEQ ID NO: 94206 - protein, 15 aa, Borrelia burgdorferi
DNKYYDSNEVELEEI

SEQ ID NO: 94207 - protein, 15 aa, Borrelia burgdorferi
NKYYDSNEVELEEIT

SEQ ID NO: 94208 - protein, 15 aa, Borrelia burgdorferi
KYYDSNEVELEEITF

SEQ ID NO: 94209 - protein, 15 aa, Borrelia burgdorferi
YYDSNEVELEEITFY

SEQ ID NO: 94210 - protein, 15 aa, Borrelia burgdorferi
YDSNEVELEEITFYT

SEQ ID NO: 94211 - protein, 15 aa, Borrelia burgdorferi
DSNEVELEEITFYTT

SEQ ID NO: 94212 - protein, 15 aa, Borrelia burgdorferi
SNEVELEEITFYTTN

SEQ ID NO: 94213 - protein, 15 aa, Borrelia burgdorferi
NEVELEEITFYTTND

SEQ ID NO: 94214 - protein, 15 aa, Borrelia burgdorferi
EVELEEITFYTTNDS

SEQ ID NO: 94215 - protein, 15 aa, Borrelia burgdorferi
VELEEITFYTTNDSS

SEQ ID NO: 94216 - protein, 15 aa, Borrelia burgdorferi
ELEEITFYTTNDSST

SEQ ID NO: 94217 - protein, 15 aa, Borrelia burgdorferi
LEEITFYTTNDSSTA

SEQ ID NO: 94218 - protein, 15 aa, Borrelia burgdorferi
EEITFYTTNDSSTAY

SEQ ID NO: 94219 - protein, 15 aa, Borrelia burgdorferi
EITFYTTNDSSTAYK

SEQ ID NO: 94220 - protein, 15 aa, Borrelia burgdorferi
ITFYTTNDSSTAYKM

SEQ ID NO: 94221 - protein, 15 aa, Borrelia burgdorferi
TFYTTNDSSTAYKMY

SEQ ID NO: 94222 - protein, 15 aa, Borrelia burgdorferi
FYTTNDSSTAYKMYV

SEQ ID NO: 94223 - protein, 15 aa, Borrelia burgdorferi
YTTNDSSTAYKMYVN

SEQ ID NO: 94224 - protein, 15 aa, Borrelia burgdorferi
TTNDSSTAYKMYVNE

SEQ ID NO: 94225 - protein, 15 aa, Borrelia burgdorferi
TNDSSTAYKMYVNEE

SEQ ID NO: 94226 - protein, 15 aa, Borrelia burgdorferi
NDSSTAYKMYVNEEL

SEQ ID NO: 94227 - protein, 15 aa, Borrelia burgdorferi
DSSTAYKMYVNEELD

SEQ ID NO: 94228 - protein, 15 aa, Borrelia burgdorferi
SSTAYKMYVNEELDA

SEQ ID NO: 94229 - protein, 15 aa, Borrelia burgdorferi
STAYKMYVNEELDAI

SEQ ID NO: 94230 - protein, 15 aa, Borrelia burgdorferi
TAYKMYVNEELDAIL

SEQ ID NO: 94231 - protein, 15 aa, Borrelia burgdorferi
AYKMYVNEELDAILV

SEQ ID NO: 94232 - protein, 15 aa, Borrelia burgdorferi
YKMYVNEELDAILVP

SEQ ID NO: 94233 - protein, 15 aa, Borrelia burgdorferi
KMYVNEELDAILVPY

SEQ ID NO: 94234 - protein, 15 aa, Borrelia burgdorferi
MYVNEELDAILVPYP

SEQ ID NO: 94235 - protein, 15 aa, Borrelia burgdorferi
YVNEELDAILVPYPQ

SEQ ID NO: 94236 - protein, 15 aa, Borrelia burgdorferi
VNEELDAILVPYPQI

SEQ ID NO: 94237 - protein, 16 aa, Borrelia burgdorferi
MKLQRSLSLIIFSLTV

SEQ ID NO: 94238 - protein, 16 aa, Borrelia burgdorferi
KLQRSLSLIIFSLTVL

SEQ ID NO: 94239 - protein, 16 aa, Borrelia burgdorferi
LQRSLSLIIFSLTVLC

SEQ ID NO: 94240 - protein, 16 aa, Borrelia burgdorferi
QRSLSLIIFSLTVLCC

SEQ ID NO: 94241 - protein, 16 aa, Borrelia burgdorferi
RSLSLIIFSLTVLCCD

SEQ ID NO: 94242 - protein, 16 aa, Borrelia burgdorferi
SLSLIIFSLTVLCCDN

SEQ ID NO: 94243 - protein, 16 aa, Borrelia burgdorferi
LSLIIFSLTVLCCDNK

SEQ ID NO: 94244 - protein, 16 aa, Borrelia burgdorferi
SLIIFSLTVLCCDNKE

SEQ ID NO: 94245 - protein, 16 aa, Borrelia burgdorferi
LIIFSLTVLCCDNKER

SEQ ID NO: 94246 - protein, 16 aa, Borrelia burgdorferi
IIFSLTVLCCDNKERK

SEQ ID NO: 94247 - protein, 16 aa, Borrelia burgdorferi
IFSLTVLCCDNKERKE

SEQ ID NO: 94248 - protein, 16 aa, Borrelia burgdorferi
FSLTVLCCDNKERKEG

SEQ ID NO: 94249 - protein, 16 aa, Borrelia burgdorferi
SLTVLCCDNKERKEGV

SEQ ID NO: 94250 - protein, 16 aa, Borrelia burgdorferi
LTVLCCDNKERKEGVS

SEQ ID NO: 94251 - protein, 16 aa, Borrelia burgdorferi
TVLCCDNKERKEGVST

SEQ ID NO: 94252 - protein, 16 aa, Borrelia burgdorferi
VLCCDNKERKEGVSTK

SEQ ID NO: 94253 - protein, 16 aa, Borrelia burgdorferi
LCCDNKERKEGVSTKI

SEQ ID NO: 94254 - protein, 16 aa, Borrelia burgdorferi
CCDNKERKEGVSTKIS

SEQ ID NO: 94255 - protein, 16 aa, Borrelia burgdorferi
CDNKERKEGVSTKISL

SEQ ID NO: 94256 - protein, 16 aa, Borrelia burgdorferi
DNKERKEGVSTKISLG

SEQ ID NO: 94257 - protein, 16 aa, Borrelia burgdorferi
NKERKEGVSTKISLGA

SEQ ID NO: 94258 - protein, 16 aa, Borrelia burgdorferi
KERKEGVSTKISLGAE

SEQ ID NO: 94259 - protein, 16 aa, Borrelia burgdorferi
ERKEGVSTKISLGAEP

SEQ ID NO: 94260 - protein, 16 aa, Borrelia burgdorferi
RKEGVSTKISLGAEPR

SEQ ID NO: 94261 - protein, 16 aa, Borrelia burgdorferi
KEGVSTKISLGAEPRS

SEQ ID NO: 94262 - protein, 16 aa, Borrelia burgdorferi
EGVSTKISLGAEPRSL

SEQ ID NO: 94263 - protein, 16 aa, Borrelia burgdorferi
GVSTKISLGAEPRSLD

SEQ ID NO: 94264 - protein, 16 aa, Borrelia burgdorferi
VSTKISLGAEPRSLDP

SEQ ID NO: 94265 - protein, 16 aa, Borrelia burgdorferi
STKISLGAEPRSLDPQ

SEQ ID NO: 94266 - protein, 16 aa, Borrelia burgdorferi
TKISLGAEPRSLDPQL

SEQ ID NO: 94267 - protein, 16 aa, Borrelia burgdorferi
KISLGAEPRSLDPQLA

SEQ ID NO: 94268 - protein, 16 aa, Borrelia burgdorferi
ISLGAEPRSLDPQLAE

SEQ ID NO: 94269 - protein, 16 aa, Borrelia burgdorferi
SLGAEPRSLDPQLAED

SEQ ID NO: 94270 - protein, 16 aa, Borrelia burgdorferi
LGAEPRSLDPQLAEDN

SEQ ID NO: 94271 - protein, 16 aa, Borrelia burgdorferi
GAEPRSLDPQLAEDNV

SEQ ID NO: 94272 - protein, 16 aa, Borrelia burgdorferi
AEPRSLDPQLAEDNVA

SEQ ID NO: 94273 - protein, 16 aa, Borrelia burgdorferi
EPRSLDPQLAEDNVAS

SEQ ID NO: 94274 - protein, 16 aa, Borrelia burgdorferi
PRSLDPQLAEDNVASK

SEQ ID NO: 94275 - protein, 16 aa, Borrelia burgdorferi
RSLDPQLAEDNVASKM

SEQ ID NO: 94276 - protein, 16 aa, Borrelia burgdorferi
SLDPQLAEDNVASKMI

SEQ ID NO: 94277 - protein, 16 aa, Borrelia burgdorferi
LDPQLAEDNVASKMID

SEQ ID NO: 94278 - protein, 16 aa, Borrelia burgdorferi
DPQLAEDNVASKMIDT

SEQ ID NO: 94279 - protein, 16 aa, Borrelia burgdorferi
PQLAEDNVASKMIDTL

SEQ ID NO: 94280 - protein, 16 aa, Borrelia burgdorferi
QLAEDNVASKMIDTLY

SEQ ID NO: 94281 - protein, 16 aa, Borrelia burgdorferi
LAEDNVASKMIDTLYR

SEQ ID NO: 94282 - protein, 16 aa, Borrelia burgdorferi
AEDNVASKMIDTLYRG

SEQ ID NO: 94283 - protein, 16 aa, Borrelia burgdorferi
EDNVASKMIDTLYRGI

SEQ ID NO: 94284 - protein, 16 aa, Borrelia burgdorferi
DNVASKMIDTLYRGIV

SEQ ID NO: 94285 - protein, 16 aa, Borrelia burgdorferi
NVASKMIDTLYRGIVT

SEQ ID NO: 94286 - protein, 16 aa, Borrelia burgdorferi
VASKMIDTLYRGIVTG

SEQ ID NO: 94287 - protein, 16 aa, Borrelia burgdorferi
ASKMIDTLYRGIVTGD

SEQ ID NO: 94288 - protein, 16 aa, Borrelia burgdorferi
SKMIDTLYRGIVTGDP

SEQ ID NO: 94289 - protein, 16 aa, Borrelia burgdorferi
KMIDTLYRGIVTGDPN

SEQ ID NO: 94290 - protein, 16 aa, Borrelia burgdorferi
MIDTLYRGIVTGDPNT

SEQ ID NO: 94291 - protein, 16 aa, Borrelia burgdorferi
IDTLYRGIVTGDPNTG

SEQ ID NO: 94292 - protein, 16 aa, Borrelia burgdorferi
DTLYRGIVTGDPNTGG

SEQ ID NO: 94293 - protein, 16 aa, Borrelia burgdorferi
TLYRGIVTGDPNTGGH

SEQ ID NO: 94294 - protein, 16 aa, Borrelia burgdorferi
LYRGIVTGDPNTGGHK

SEQ ID NO: 94295 - protein, 16 aa, Borrelia burgdorferi
YRGIVTGDPNTGGHKP

SEQ ID NO: 94296 - protein, 16 aa, Borrelia burgdorferi
RGIVTGDPNTGGHKPG

SEQ ID NO: 94297 - protein, 16 aa, Borrelia burgdorferi
GIVTGDPNTGGHKPGL

SEQ ID NO: 94298 - protein, 16 aa, Borrelia burgdorferi
IVTGDPNTGGHKPGLA

SEQ ID NO: 94299 - protein, 16 aa, Borrelia burgdorferi
VTGDPNTGGHKPGLAK

SEQ ID NO: 94300 - protein, 16 aa, Borrelia burgdorferi
TGDPNTGGHKPGLAKG

SEQ ID NO: 94301 - protein, 16 aa, Borrelia burgdorferi
GDPNTGGHKPGLAKGW

SEQ ID NO: 94302 - protein, 16 aa, Borrelia burgdorferi
DPNTGGHKPGLAKGWE

SEQ ID NO: 94303 - protein, 16 aa, Borrelia burgdorferi
PNTGGHKPGLAKGWET

SEQ ID NO: 94304 - protein, 16 aa, Borrelia burgdorferi
NTGGHKPGLAKGWETS

SEQ ID NO: 94305 - protein, 16 aa, Borrelia burgdorferi
TGGHKPGLAKGWETSS

SEQ ID NO: 94306 - protein, 16 aa, Borrelia burgdorferi
GGHKPGLAKGWETSSD

SEQ ID NO: 94307 - protein, 16 aa, Borrelia burgdorferi
GHKPGLAKGWETSSDG

SEQ ID NO: 94308 - protein, 16 aa, Borrelia burgdorferi
HKPGLAKGWETSSDGT

SEQ ID NO: 94309 - protein, 16 aa, Borrelia burgdorferi
KPGLAKGWETSSDGTA

SEQ ID NO: 94310 - protein, 16 aa, Borrelia burgdorferi
PGLAKGWETSSDGTAY

SEQ ID NO: 94311 - protein, 16 aa, Borrelia burgdorferi
GLAKGWETSSDGTAYP

SEQ ID NO: 94312 - protein, 16 aa, Borrelia burgdorferi
LAKGWETSSDGTAYPF

SEQ ID NO: 94313 - protein, 16 aa, Borrelia burgdorferi
AKGWETSSDGTAYPFY

SEQ ID NO: 94314 - protein, 16 aa, Borrelia burgdorferi
KGWETSSDGTAYPFYL

SEQ ID NO: 94315 - protein, 16 aa, Borrelia burgdorferi
GWETSSDGTAYPFYLR

SEQ ID NO: 94316 - protein, 16 aa, Borrelia burgdorferi
WETSSDGTAYPFYLRD

SEQ ID NO: 94317 - protein, 16 aa, Borrelia burgdorferi
ETSSDGTAYPFYLRDN

SEQ ID NO: 94318 - protein, 16 aa, Borrelia burgdorferi
TSSDGTAYPFYLRDNL

SEQ ID NO: 94319 - protein, 16 aa, Borrelia burgdorferi
SSDGTAYPFYLRDNLT

SEQ ID NO: 94320 - protein, 16 aa, Borrelia burgdorferi
SDGTAYPFYLRDNLTW

SEQ ID NO: 94321 - protein, 16 aa, Borrelia burgdorferi
DGTAYPFYLRDNLTWS

SEQ ID NO: 94322 - protein, 16 aa, Borrelia burgdorferi
GTAYPFYLRDNLTWSD

SEQ ID NO: 94323 - protein, 16 aa, Borrelia burgdorferi
TAYPFYLRDNLTWSDG

SEQ ID NO: 94324 - protein, 16 aa, Borrelia burgdorferi
AYPFYLRDNLTWSDGV

SEQ ID NO: 94325 - protein, 16 aa, Borrelia burgdorferi
YPFYLRDNLTWSDGVA

SEQ ID NO: 94326 - protein, 16 aa, Borrelia burgdorferi
PFYLRDNLTWSDGVAI

SEQ ID NO: 94327 - protein, 16 aa, Borrelia burgdorferi
FYLRDNLTWSDGVAIT

SEQ ID NO: 94328 - protein, 16 aa, Borrelia burgdorferi
YLRDNLTWSDGVAITA

SEQ ID NO: 94329 - protein, 16 aa, Borrelia burgdorferi
LRDNLTWSDGVAITAE

SEQ ID NO: 94330 - protein, 16 aa, Borrelia burgdorferi
RDNLTWSDGVAITAEG

SEQ ID NO: 94331 - protein, 16 aa, Borrelia burgdorferi
DNLTWSDGVAITAEGI

SEQ ID NO: 94332 - protein, 16 aa, Borrelia burgdorferi
NLTWSDGVAITAEGIR

SEQ ID NO: 94333 - protein, 16 aa, Borrelia burgdorferi
LTWSDGVAITAEGIRK

SEQ ID NO: 94334 - protein, 16 aa, Borrelia burgdorferi
TWSDGVAITAEGIRKS

SEQ ID NO: 94335 - protein, 16 aa, Borrelia burgdorferi
WSDGVAITAEGIRKSY

SEQ ID NO: 94336 - protein, 16 aa, Borrelia burgdorferi
SDGVAITAEGIRKSYL

SEQ ID NO: 94337 - protein, 16 aa, Borrelia burgdorferi
DGVAITAEGIRKSYLR

SEQ ID NO: 94338 - protein, 16 aa, Borrelia burgdorferi
GVAITAEGIRKSYLRI

SEQ ID NO: 94339 - protein, 16 aa, Borrelia burgdorferi
VAITAEGIRKSYLRIL

SEQ ID NO: 94340 - protein, 16 aa, Borrelia burgdorferi
AITAEGIRKSYLRILN

SEQ ID NO: 94341 - protein, 16 aa, Borrelia burgdorferi
ITAEGIRKSYLRILNK

SEQ ID NO: 94342 - protein, 16 aa, Borrelia burgdorferi
TAEGIRKSYLRILNKE

SEQ ID NO: 94343 - protein, 16 aa, Borrelia burgdorferi
AEGIRKSYLRILNKET

SEQ ID NO: 94344 - protein, 16 aa, Borrelia burgdorferi
EGIRKSYLRILNKETG

SEQ ID NO: 94345 - protein, 16 aa, Borrelia burgdorferi
GIRKSYLRILNKETGS

SEQ ID NO: 94346 - protein, 16 aa, Borrelia burgdorferi
IRKSYLRILNKETGST

SEQ ID NO: 94347 - protein, 16 aa, Borrelia burgdorferi
RKSYLRILNKETGSTY

SEQ ID NO: 94348 - protein, 16 aa, Borrelia burgdorferi
KSYLRILNKETGSTYV

SEQ ID NO: 94349 - protein, 16 aa, Borrelia burgdorferi
SYLRILNKETGSTYVD

SEQ ID NO: 94350 - protein, 16 aa, Borrelia burgdorferi
YLRILNKETGSTYVDM

SEQ ID NO: 94351 - protein, 16 aa, Borrelia burgdorferi
LRILNKETGSTYVDMV

SEQ ID NO: 94352 - protein, 16 aa, Borrelia burgdorferi
RILNKETGSTYVDMVK

SEQ ID NO: 94353 - protein, 16 aa, Borrelia burgdorferi
ILNKETGSTYVDMVKS

SEQ ID NO: 94354 - protein, 16 aa, Borrelia burgdorferi
LNKETGSTYVDMVKSI

SEQ ID NO: 94355 - protein, 16 aa, Borrelia burgdorferi
NKETGSTYVDMVKSII

SEQ ID NO: 94356 - protein, 16 aa, Borrelia burgdorferi
KETGSTYVDMVKSIIK

SEQ ID NO: 94357 - protein, 16 aa, Borrelia burgdorferi
ETGSTYVDMVKSIIKN

SEQ ID NO: 94358 - protein, 16 aa, Borrelia burgdorferi
TGSTYVDMVKSIIKNG

SEQ ID NO: 94359 - protein, 16 aa, Borrelia burgdorferi
GSTYVDMVKSIIKNGQ

SEQ ID NO: 94360 - protein, 16 aa, Borrelia burgdorferi
STYVDMVKSIIKNGQE

SEQ ID NO: 94361 - protein, 16 aa, Borrelia burgdorferi
TYVDMVKSIIKNGQEY

SEQ ID NO: 94362 - protein, 16 aa, Borrelia burgdorferi
YVDMVKSIIKNGQEYF

SEQ ID NO: 94363 - protein, 16 aa, Borrelia burgdorferi
VDMVKSIIKNGQEYFD

SEQ ID NO: 94364 - protein, 16 aa, Borrelia burgdorferi
DMVKSIIKNGQEYFDG

SEQ ID NO: 94365 - protein, 16 aa, Borrelia burgdorferi
MVKSIIKNGQEYFDGQ

SEQ ID NO: 94366 - protein, 16 aa, Borrelia burgdorferi
VKSIIKNGQEYFDGQV

SEQ ID NO: 94367 - protein, 16 aa, Borrelia burgdorferi
KSIIKNGQEYFDGQVT

SEQ ID NO: 94368 - protein, 16 aa, Borrelia burgdorferi
SIIKNGQEYFDGQVTD

SEQ ID NO: 94369 - protein, 16 aa, Borrelia burgdorferi
IIKNGQEYFDGQVTDS

SEQ ID NO: 94370 - protein, 16 aa, Borrelia burgdorferi
IKNGQEYFDGQVTDSE

SEQ ID NO: 94371 - protein, 16 aa, Borrelia burgdorferi
KNGQEYFDGQVTDSEL

SEQ ID NO: 94372 - protein, 16 aa, Borrelia burgdorferi
NGQEYFDGQVTDSELG

SEQ ID NO: 94373 - protein, 16 aa, Borrelia burgdorferi
GQEYFDGQVTDSELGI

SEQ ID NO: 94374 - protein, 16 aa, Borrelia burgdorferi
QEYFDGQVTDSELGIR

SEQ ID NO: 94375 - protein, 16 aa, Borrelia burgdorferi
EYFDGQVTDSELGIRA

SEQ ID NO: 94376 - protein, 16 aa, Borrelia burgdorferi
YFDGQVTDSELGIRAI

SEQ ID NO: 94377 - protein, 16 aa, Borrelia burgdorferi
FDGQVTDSELGIRAID

SEQ ID NO: 94378 - protein, 16 aa, Borrelia burgdorferi
DGQVTDSELGIRAIDS

SEQ ID NO: 94379 - protein, 16 aa, Borrelia burgdorferi
GQVTDSELGIRAIDSK

SEQ ID NO: 94380 - protein, 16 aa, Borrelia burgdorferi
QVTDSELGIRAIDSKT

SEQ ID NO: 94381 - protein, 16 aa, Borrelia burgdorferi
VTDSELGIRAIDSKTL

SEQ ID NO: 94382 - protein, 16 aa, Borrelia burgdorferi
TDSELGIRAIDSKTLE

SEQ ID NO: 94383 - protein, 16 aa, Borrelia burgdorferi
DSELGIRAIDSKTLEI

SEQ ID NO: 94384 - protein, 16 aa, Borrelia burgdorferi
SELGIRAIDSKTLEIT

SEQ ID NO: 94385 - protein, 16 aa, Borrelia burgdorferi
ELGIRAIDSKTLEITL

SEQ ID NO: 94386 - protein, 16 aa, Borrelia burgdorferi
LGIRAIDSKTLEITLA

SEQ ID NO: 94387 - protein, 16 aa, Borrelia burgdorferi
GIRAIDSKTLEITLAS

SEQ ID NO: 94388 - protein, 16 aa, Borrelia burgdorferi
IRAIDSKTLEITLASP

SEQ ID NO: 94389 - protein, 16 aa, Borrelia burgdorferi
RAIDSKTLEITLASPK

SEQ ID NO: 94390 - protein, 16 aa, Borrelia burgdorferi
AIDSKTLEITLASPKP

SEQ ID NO: 94391 - protein, 16 aa, Borrelia burgdorferi
IDSKTLEITLASPKPY

SEQ ID NO: 94392 - protein, 16 aa, Borrelia burgdorferi
DSKTLEITLASPKPYF

SEQ ID NO: 94393 - protein, 16 aa, Borrelia burgdorferi
SKTLEITLASPKPYFI

SEQ ID NO: 94394 - protein, 16 aa, Borrelia burgdorferi
KTLEITLASPKPYFID

SEQ ID NO: 94395 - protein, 16 aa, Borrelia burgdorferi
TLEITLASPKPYFIDL

SEQ ID NO: 94396 - protein, 16 aa, Borrelia burgdorferi
LEITLASPKPYFIDLL

SEQ ID NO: 94397 - protein, 16 aa, Borrelia burgdorferi
EITLASPKPYFIDLLV

SEQ ID NO: 94398 - protein, 16 aa, Borrelia burgdorferi
ITLASPKPYFIDLLVH

SEQ ID NO: 94399 - protein, 16 aa, Borrelia burgdorferi
TLASPKPYFIDLLVHQ

SEQ ID NO: 94400 - protein, 16 aa, Borrelia burgdorferi
LASPKPYFIDLLVHQS

SEQ ID NO: 94401 - protein, 16 aa, Borrelia burgdorferi
ASPKPYFIDLLVHQSF

SEQ ID NO: 94402 - protein, 16 aa, Borrelia burgdorferi
SPKPYFIDLLVHQSFI

SEQ ID NO: 94403 - protein, 16 aa, Borrelia burgdorferi
PKPYFIDLLVHQSFIP

SEQ ID NO: 94404 - protein, 16 aa, Borrelia burgdorferi
KPYFIDLLVHQSFIPV

SEQ ID NO: 94405 - protein, 16 aa, Borrelia burgdorferi
PYFIDLLVHQSFIPVP

SEQ ID NO: 94406 - protein, 16 aa, Borrelia burgdorferi
YFIDLLVHQSFIPVPV

SEQ ID NO: 94407 - protein, 16 aa, Borrelia burgdorferi
FIDLLVHQSFIPVPVH

SEQ ID NO: 94408 - protein, 16 aa, Borrelia burgdorferi
IDLLVHQSFIPVPVHV

SEQ ID NO: 94409 - protein, 16 aa, Borrelia burgdorferi
DLLVHQSFIPVPVHVT

SEQ ID NO: 94410 - protein, 16 aa, Borrelia burgdorferi
LLVHQSFIPVPVHVTD

SEQ ID NO: 94411 - protein, 16 aa, Borrelia burgdorferi
LVHQSFIPVPVHVTDK

SEQ ID NO: 94412 - protein, 16 aa, Borrelia burgdorferi
VHQSFIPVPVHVTDKY

SEQ ID NO: 94413 - protein, 16 aa, Borrelia burgdorferi
HQSFIPVPVHVTDKYG

SEQ ID NO: 94414 - protein, 16 aa, Borrelia burgdorferi
QSFIPVPVHVTDKYGQ

SEQ ID NO: 94415 - protein, 16 aa, Borrelia burgdorferi
SFIPVPVHVTDKYGQN

SEQ ID NO: 94416 - protein, 16 aa, Borrelia burgdorferi
FIPVPVHVTDKYGQNW

SEQ ID NO: 94417 - protein, 16 aa, Borrelia burgdorferi
IPVPVHVTDKYGQNWT

SEQ ID NO: 94418 - protein, 16 aa, Borrelia burgdorferi
PVPVHVTDKYGQNWTS

SEQ ID NO: 94419 - protein, 16 aa, Borrelia burgdorferi
VPVHVTDKYGQNWTSP

SEQ ID NO: 94420 - protein, 16 aa, Borrelia burgdorferi
PVHVTDKYGQNWTSPE

SEQ ID NO: 94421 - protein, 16 aa, Borrelia burgdorferi
VHVTDKYGQNWTSPEN

SEQ ID NO: 94422 - protein, 16 aa, Borrelia burgdorferi
HVTDKYGQNWTSPENM

SEQ ID NO: 94423 - protein, 16 aa, Borrelia burgdorferi
VTDKYGQNWTSPENMV

SEQ ID NO: 94424 - protein, 16 aa, Borrelia burgdorferi
TDKYGQNWTSPENMVT

SEQ ID NO: 94425 - protein, 16 aa, Borrelia burgdorferi
DKYGQNWTSPENMVTS

SEQ ID NO: 94426 - protein, 16 aa, Borrelia burgdorferi
KYGQNWTSPENMVTSG

SEQ ID NO: 94427 - protein, 16 aa, Borrelia burgdorferi
YGQNWTSPENMVTSGP

SEQ ID NO: 94428 - protein, 16 aa, Borrelia burgdorferi
GQNWTSPENMVTSGPF

SEQ ID NO: 94429 - protein, 16 aa, Borrelia burgdorferi
QNWTSPENMVTSGPFK

SEQ ID NO: 94430 - protein, 16 aa, Borrelia burgdorferi
NWTSPENMVTSGPFKL

SEQ ID NO: 94431 - protein, 16 aa, Borrelia burgdorferi
WTSPENMVTSGPFKLK

SEQ ID NO: 94432 - protein, 16 aa, Borrelia burgdorferi
TSPENMVTSGPFKLKE

SEQ ID NO: 94433 - protein, 16 aa, Borrelia burgdorferi
SPENMVTSGPFKLKER

SEQ ID NO: 94434 - protein, 16 aa, Borrelia burgdorferi
PENMVTSGPFKLKERI

SEQ ID NO: 94435 - protein, 16 aa, Borrelia burgdorferi
ENMVTSGPFKLKERIP

SEQ ID NO: 94436 - protein, 16 aa, Borrelia burgdorferi
NMVTSGPFKLKERIPS

SEQ ID NO: 94437 - protein, 16 aa, Borrelia burgdorferi
MVTSGPFKLKERIPSE

SEQ ID NO: 94438 - protein, 16 aa, Borrelia burgdorferi
VTSGPFKLKERIPSEK

SEQ ID NO: 94439 - protein, 16 aa, Borrelia burgdorferi
TSGPFKLKERIPSEKY

SEQ ID NO: 94440 - protein, 16 aa, Borrelia burgdorferi
SGPFKLKERIPSEKYV

SEQ ID NO: 94441 - protein, 16 aa, Borrelia burgdorferi
GPFKLKERIPSEKYVF

SEQ ID NO: 94442 - protein, 16 aa, Borrelia burgdorferi
PFKLKERIPSEKYVFE

SEQ ID NO: 94443 - protein, 16 aa, Borrelia burgdorferi
FKLKERIPSEKYVFEK

SEQ ID NO: 94444 - protein, 16 aa, Borrelia burgdorferi
KLKERIPSEKYVFEKD

SEQ ID NO: 94445 - protein, 16 aa, Borrelia burgdorferi
LKERIPSEKYVFEKDN

SEQ ID NO: 94446 - protein, 16 aa, Borrelia burgdorferi
KERIPSEKYVFEKDNK

SEQ ID NO: 94447 - protein, 16 aa, Borrelia burgdorferi
ERIPSEKYVFEKDNKY

SEQ ID NO: 94448 - protein, 16 aa, Borrelia burgdorferi
RIPSEKYVFEKDNKYY

SEQ ID NO: 94449 - protein, 16 aa, Borrelia burgdorferi
IPSEKYVFEKDNKYYD

SEQ ID NO: 94450 - protein, 16 aa, Borrelia burgdorferi
PSEKYVFEKDNKYYDS

SEQ ID NO: 94451 - protein, 16 aa, Borrelia burgdorferi
SEKYVFEKDNKYYDSN

SEQ ID NO: 94452 - protein, 16 aa, Borrelia burgdorferi
EKYVFEKDNKYYDSNE

SEQ ID NO: 94453 - protein, 16 aa, Borrelia burgdorferi
KYVFEKDNKYYDSNEV

SEQ ID NO: 94454 - protein, 16 aa, Borrelia burgdorferi
YVFEKDNKYYDSNEVE

SEQ ID NO: 94455 - protein, 16 aa, Borrelia burgdorferi
VFEKDNKYYDSNEVEL

SEQ ID NO: 94456 - protein, 16 aa, Borrelia burgdorferi
FEKDNKYYDSNEVELE

SEQ ID NO: 94457 - protein, 16 aa, Borrelia burgdorferi
EKDNKYYDSNEVELEE

SEQ ID NO: 94458 - protein, 16 aa, Borrelia burgdorferi
KDNKYYDSNEVELEEI

SEQ ID NO: 94459 - protein, 16 aa, Borrelia burgdorferi
DNKYYDSNEVELEEIT

SEQ ID NO: 94460 - protein, 16 aa, Borrelia burgdorferi
NKYYDSNEVELEEITF

SEQ ID NO: 94461 - protein, 16 aa, Borrelia burgdorferi
KYYDSNEVELEEITFY

SEQ ID NO: 94462 - protein, 16 aa, Borrelia burgdorferi
YYDSNEVELEEITFYT

SEQ ID NO: 94463 - protein, 16 aa, Borrelia burgdorferi
YDSNEVELEEITFYTT

SEQ ID NO: 94464 - protein, 16 aa, Borrelia burgdorferi
DSNEVELEEITFYTTN

SEQ ID NO: 94465 - protein, 16 aa, Borrelia burgdorferi
SNEVELEEITFYTTND

SEQ ID NO: 94466 - protein, 16 aa, Borrelia burgdorferi
NEVELEEITFYTTNDS

SEQ ID NO: 94467 - protein, 16 aa, Borrelia burgdorferi
EVELEEITFYTTNDSS

SEQ ID NO: 94468 - protein, 16 aa, Borrelia burgdorferi
VELEEITFYTTNDSST

SEQ ID NO: 94469 - protein, 16 aa, Borrelia burgdorferi
ELEEITFYTTNDSSTA

SEQ ID NO: 94470 - protein, 16 aa, Borrelia burgdorferi
LEEITFYTTNDSSTAY

SEQ ID NO: 94471 - protein, 16 aa, Borrelia burgdorferi
EEITFYTTNDSSTAYK

SEQ ID NO: 94472 - protein, 16 aa, Borrelia burgdorferi
EITFYTTNDSSTAYKM

SEQ ID NO: 94473 - protein, 16 aa, Borrelia burgdorferi
ITFYTTNDSSTAYKMY

SEQ ID NO: 94474 - protein, 16 aa, Borrelia burgdorferi
TFYTTNDSSTAYKMYV

SEQ ID NO: 94475 - protein, 16 aa, Borrelia burgdorferi
FYTTNDSSTAYKMYVN

SEQ ID NO: 94476 - protein, 16 aa, Borrelia burgdorferi
YTTNDSSTAYKMYVNE

SEQ ID NO: 94477 - protein, 16 aa, Borrelia burgdorferi
TTNDSSTAYKMYVNEE

SEQ ID NO: 94478 - protein, 16 aa, Borrelia burgdorferi
TNDSSTAYKMYVNEEL

SEQ ID NO: 94479 - protein, 16 aa, Borrelia burgdorferi
NDSSTAYKMYVNEELD

SEQ ID NO: 94480 - protein, 16 aa, Borrelia burgdorferi
DSSTAYKMYVNEELDA

SEQ ID NO: 94481 - protein, 16 aa, Borrelia burgdorferi
SSTAYKMYVNEELDAI

SEQ ID NO: 94482 - protein, 16 aa, Borrelia burgdorferi
STAYKMYVNEELDAIL

SEQ ID NO: 94483 - protein, 16 aa, Borrelia burgdorferi
TAYKMYVNEELDAILV

SEQ ID NO: 94484 - protein, 16 aa, Borrelia burgdorferi
AYKMYVNEELDAILVP

SEQ ID NO: 94485 - protein, 16 aa, Borrelia burgdorferi
YKMYVNEELDAILVPY

SEQ ID NO: 94486 - protein, 16 aa, Borrelia burgdorferi
KMYVNEELDAILVPYP

SEQ ID NO: 94487 - protein, 16 aa, Borrelia burgdorferi
MYVNEELDAILVPYPQ

SEQ ID NO: 94488 - protein, 16 aa, Borrelia burgdorferi
YVNEELDAILVPYPQI

SEQ ID NO: 94489 - protein, 13 aa, Borrelia burgdorferi B31
MNLINKLFILTIL

SEQ ID NO: 94490 - protein, 13 aa, Borrelia burgdorferi B31
NLINKLFILTILF

SEQ ID NO: 94491 - protein, 13 aa, Borrelia burgdorferi B31
LINKLFILTILFS

SEQ ID NO: 94492 - protein, 13 aa, Borrelia burgdorferi B31
INKLFILTILFSS

SEQ ID NO: 94493 - protein, 13 aa, Borrelia burgdorferi B31
NKLFILTILFSSV

SEQ ID NO: 94494 - protein, 13 aa, Borrelia burgdorferi B31
KLFILTILFSSVI

SEQ ID NO: 94495 - protein, 13 aa, Borrelia burgdorferi B31
LFILTILFSSVIS

SEQ ID NO: 94496 - protein, 13 aa, Borrelia burgdorferi B31
FILTILFSSVISC

SEQ ID NO: 94497 - protein, 13 aa, Borrelia burgdorferi B31
ILTILFSSVISCK

SEQ ID NO: 94498 - protein, 13 aa, Borrelia burgdorferi B31
LTILFSSVISCKL

SEQ ID NO: 94499 - protein, 13 aa, Borrelia burgdorferi B31
TILFSSVISCKLY

SEQ ID NO: 94500 - protein, 13 aa, Borrelia burgdorferi B31
ILFSSVISCKLYK

SEQ ID NO: 94501 - protein, 13 aa, Borrelia burgdorferi B31
LFSSVISCKLYKK

SEQ ID NO: 94502 - protein, 13 aa, Borrelia burgdorferi B31
FSSVISCKLYKKI

SEQ ID NO: 94503 - protein, 13 aa, Borrelia burgdorferi B31
SSVISCKLYKKIT

SEQ ID NO: 94504 - protein, 13 aa, Borrelia burgdorferi B31
SVISCKLYKKITY

SEQ ID NO: 94505 - protein, 13 aa, Borrelia burgdorferi B31
VISCKLYKKITYN

SEQ ID NO: 94506 - protein, 13 aa, Borrelia burgdorferi B31
ISCKLYKKITYNA

SEQ ID NO: 94507 - protein, 13 aa, Borrelia burgdorferi B31
SCKLYKKITYNAD

SEQ ID NO: 94508 - protein, 13 aa, Borrelia burgdorferi B31
CKLYKKITYNADQ

SEQ ID NO: 94509 - protein, 13 aa, Borrelia burgdorferi B31
KLYKKITYNADQV

SEQ ID NO: 94510 - protein, 13 aa, Borrelia burgdorferi B31
LYKKITYNADQVI

SEQ ID NO: 94511 - protein, 13 aa, Borrelia burgdorferi B31
YKKITYNADQVID

SEQ ID NO: 94512 - protein, 13 aa, Borrelia burgdorferi B31
KKITYNADQVIDK

SEQ ID NO: 94513 - protein, 13 aa, Borrelia burgdorferi B31
KITYNADQVIDKL

SEQ ID NO: 94514 - protein, 13 aa, Borrelia burgdorferi B31
ITYNADQVIDKLK

SEQ ID NO: 94515 - protein, 13 aa, Borrelia burgdorferi B31
TYNADQVIDKLKS

SEQ ID NO: 94516 - protein, 13 aa, Borrelia burgdorferi B31
YNADQVIDKLKSN

SEQ ID NO: 94517 - protein, 13 aa, Borrelia burgdorferi B31
NADQVIDKLKSNN

SEQ ID NO: 94518 - protein, 13 aa, Borrelia burgdorferi B31
ADQVIDKLKSNNG

SEQ ID NO: 94519 - protein, 13 aa, Borrelia burgdorferi B31
DQVIDKLKSNNGS

SEQ ID NO: 94520 - protein, 13 aa, Borrelia burgdorferi B31
QVIDKLKSNNGSF

SEQ ID NO: 94521 - protein, 13 aa, Borrelia burgdorferi B31
VIDKLKSNNGSFN

SEQ ID NO: 94522 - protein, 13 aa, Borrelia burgdorferi B31
IDKLKSNNGSFNT

SEQ ID NO: 94523 - protein, 13 aa, Borrelia burgdorferi B31
DKLKSNNGSFNTL

SEQ ID NO: 94524 - protein, 13 aa, Borrelia burgdorferi B31
KLKSNNGSFNTLK

SEQ ID NO: 94525 - protein, 13 aa, Borrelia burgdorferi B31
LKSNNGSFNTLKS

SEQ ID NO: 94526 - protein, 13 aa, Borrelia burgdorferi B31
KSNNGSFNTLKSN

SEQ ID NO: 94527 - protein, 13 aa, Borrelia burgdorferi B31
SNNGSFNTLKSND

SEQ ID NO: 94528 - protein, 13 aa, Borrelia burgdorferi B31
NNGSFNTLKSNDD

SEQ ID NO: 94529 - protein, 13 aa, Borrelia burgdorferi B31
NGSFNTLKSNDDS

SEQ ID NO: 94530 - protein, 13 aa, Borrelia burgdorferi B31
GSFNTLKSNDDSK

SEQ ID NO: 94531 - protein, 13 aa, Borrelia burgdorferi B31
SFNTLKSNDDSKR

SEQ ID NO: 94532 - protein, 13 aa, Borrelia burgdorferi B31
FNTLKSNDDSKRS

SEQ ID NO: 94533 - protein, 13 aa, Borrelia burgdorferi B31
NTLKSNDDSKRSG

SEQ ID NO: 94534 - protein, 13 aa, Borrelia burgdorferi B31
TLKSNDDSKRSGR

SEQ ID NO: 94535 - protein, 13 aa, Borrelia burgdorferi B31
LKSNDDSKRSGRK

SEQ ID NO: 94536 - protein, 13 aa, Borrelia burgdorferi B31
KSNDDSKRSGRKP

SEQ ID NO: 94537 - protein, 13 aa, Borrelia burgdorferi B31
SNDDSKRSGRKPR

SEQ ID NO: 94538 - protein, 13 aa, Borrelia burgdorferi B31
NDDSKRSGRKPRS

SEQ ID NO: 94539 - protein, 13 aa, Borrelia burgdorferi B31
DDSKRSGRKPRSV

SEQ ID NO: 94540 - protein, 13 aa, Borrelia burgdorferi B31
DSKRSGRKPRSVD

SEQ ID NO: 94541 - protein, 13 aa, Borrelia burgdorferi B31
SKRSGRKPRSVDN

SEQ ID NO: 94542 - protein, 13 aa, Borrelia burgdorferi B31
KRSGRKPRSVDNT

SEQ ID NO: 94543 - protein, 13 aa, Borrelia burgdorferi B31
RSGRKPRSVDNTY

SEQ ID NO: 94544 - protein, 13 aa, Borrelia burgdorferi B31
SGRKPRSVDNTYM

SEQ ID NO: 94545 - protein, 13 aa, Borrelia burgdorferi B31
GRKPRSVDNTYMD

SEQ ID NO: 94546 - protein, 13 aa, Borrelia burgdorferi B31
RKPRSVDNTYMDQ

SEQ ID NO: 94547 - protein, 13 aa, Borrelia burgdorferi B31
KPRSVDNTYMDQD

SEQ ID NO: 94548 - protein, 13 aa, Borrelia burgdorferi B31
PRSVDNTYMDQDT

SEQ ID NO: 94549 - protein, 13 aa, Borrelia burgdorferi B31
RSVDNTYMDQDTG

SEQ ID NO: 94550 - protein, 13 aa, Borrelia burgdorferi B31
SVDNTYMDQDTGK

SEQ ID NO: 94551 - protein, 13 aa, Borrelia burgdorferi B31
VDNTYMDQDTGKK

SEQ ID NO: 94552 - protein, 13 aa, Borrelia burgdorferi B31
DNTYMDQDTGKKP

SEQ ID NO: 94553 - protein, 13 aa, Borrelia burgdorferi B31
NTYMDQDTGKKPL

SEQ ID NO: 94554 - protein, 13 aa, Borrelia burgdorferi B31
TYMDQDTGKKPLM

SEQ ID NO: 94555 - protein, 13 aa, Borrelia burgdorferi B31
YMDQDTGKKPLMA

SEQ ID NO: 94556 - protein, 13 aa, Borrelia burgdorferi B31
MDQDTGKKPLMAD

SEQ ID NO: 94557 - protein, 13 aa, Borrelia burgdorferi B31
DQDTGKKPLMADM

SEQ ID NO: 94558 - protein, 13 aa, Borrelia burgdorferi B31
QDTGKKPLMADMQ

SEQ ID NO: 94559 - protein, 13 aa, Borrelia burgdorferi B31
DTGKKPLMADMQP

SEQ ID NO: 94560 - protein, 13 aa, Borrelia burgdorferi B31
TGKKPLMADMQPD

SEQ ID NO: 94561 - protein, 13 aa, Borrelia burgdorferi B31
GKKPLMADMQPDM

SEQ ID NO: 94562 - protein, 13 aa, Borrelia burgdorferi B31
KKPLMADMQPDMQ

SEQ ID NO: 94563 - protein, 13 aa, Borrelia burgdorferi B31
KPLMADMQPDMQN

SEQ ID NO: 94564 - protein, 13 aa, Borrelia burgdorferi B31
PLMADMQPDMQND

SEQ ID NO: 94565 - protein, 13 aa, Borrelia burgdorferi B31
LMADMQPDMQNDN

SEQ ID NO: 94566 - protein, 13 aa, Borrelia burgdorferi B31
MADMQPDMQNDNS

SEQ ID NO: 94567 - protein, 13 aa, Borrelia burgdorferi B31
ADMQPDMQNDNSS

SEQ ID NO: 94568 - protein, 13 aa, Borrelia burgdorferi B31
DMQPDMQNDNSSS

SEQ ID NO: 94569 - protein, 13 aa, Borrelia burgdorferi B31
MQPDMQNDNSSSN

SEQ ID NO: 94570 - protein, 13 aa, Borrelia burgdorferi B31
QPDMQNDNSSSNH

SEQ ID NO: 94571 - protein, 13 aa, Borrelia burgdorferi B31
PDMQNDNSSSNHT

SEQ ID NO: 94572 - protein, 13 aa, Borrelia burgdorferi B31
DMQNDNSSSNHTL

SEQ ID NO: 94573 - protein, 13 aa, Borrelia burgdorferi B31
MQNDNSSSNHTLQ

SEQ ID NO: 94574 - protein, 13 aa, Borrelia burgdorferi B31
QNDNSSSNHTLQV

SEQ ID NO: 94575 - protein, 13 aa, Borrelia burgdorferi B31
NDNSSSNHTLQVN

SEQ ID NO: 94576 - protein, 13 aa, Borrelia burgdorferi B31
DNSSSNHTLQVNI

SEQ ID NO: 94577 - protein, 13 aa, Borrelia burgdorferi B31
NSSSNHTLQVNIQ

SEQ ID NO: 94578 - protein, 13 aa, Borrelia burgdorferi B31
SSSNHTLQVNIQD

SEQ ID NO: 94579 - protein, 13 aa, Borrelia burgdorferi B31
SSNHTLQVNIQDN

SEQ ID NO: 94580 - protein, 13 aa, Borrelia burgdorferi B31
SNHTLQVNIQDNE

SEQ ID NO: 94581 - protein, 13 aa, Borrelia burgdorferi B31
NHTLQVNIQDNEA

SEQ ID NO: 94582 - protein, 13 aa, Borrelia burgdorferi B31
HTLQVNIQDNEAS

SEQ ID NO: 94583 - protein, 13 aa, Borrelia burgdorferi B31
TLQVNIQDNEASE

SEQ ID NO: 94584 - protein, 13 aa, Borrelia burgdorferi B31
LQVNIQDNEASEA

SEQ ID NO: 94585 - protein, 13 aa, Borrelia burgdorferi B31
QVNIQDNEASEAR

SEQ ID NO: 94586 - protein, 13 aa, Borrelia burgdorferi B31
VNIQDNEASEARN

SEQ ID NO: 94587 - protein, 13 aa, Borrelia burgdorferi B31
NIQDNEASEARNI

SEQ ID NO: 94588 - protein, 13 aa, Borrelia burgdorferi B31
IQDNEASEARNIM

SEQ ID NO: 94589 - protein, 13 aa, Borrelia burgdorferi B31
QDNEASEARNIMT

SEQ ID NO: 94590 - protein, 13 aa, Borrelia burgdorferi B31
DNEASEARNIMTE

SEQ ID NO: 94591 - protein, 13 aa, Borrelia burgdorferi B31
NEASEARNIMTEI

SEQ ID NO: 94592 - protein, 13 aa, Borrelia burgdorferi B31
EASEARNIMTEIE

SEQ ID NO: 94593 - protein, 13 aa, Borrelia burgdorferi B31
ASEARNIMTEIES

SEQ ID NO: 94594 - protein, 13 aa, Borrelia burgdorferi B31
SEARNIMTEIESS

SEQ ID NO: 94595 - protein, 13 aa, Borrelia burgdorferi B31
EARNIMTEIESSK

SEQ ID NO: 94596 - protein, 13 aa, Borrelia burgdorferi B31
ARNIMTEIESSKE

SEQ ID NO: 94597 - protein, 13 aa, Borrelia burgdorferi B31
RNIMTEIESSKEE

SEQ ID NO: 94598 - protein, 13 aa, Borrelia burgdorferi B31
NIMTEIESSKEEY

SEQ ID NO: 94599 - protein, 13 aa, Borrelia burgdorferi B31
IMTEIESSKEEYN

SEQ ID NO: 94600 - protein, 13 aa, Borrelia burgdorferi B31
MTEIESSKEEYNR

SEQ ID NO: 94601 - protein, 13 aa, Borrelia burgdorferi B31
TEIESSKEEYNRI

SEQ ID NO: 94602 - protein, 13 aa, Borrelia burgdorferi B31
EIESSKEEYNRIN

SEQ ID NO: 94603 - protein, 13 aa, Borrelia burgdorferi B31
IESSKEEYNRINE

SEQ ID NO: 94604 - protein, 13 aa, Borrelia burgdorferi B31
ESSKEEYNRINED

SEQ ID NO: 94605 - protein, 13 aa, Borrelia burgdorferi B31
SSKEEYNRINEDL

SEQ ID NO: 94606 - protein, 13 aa, Borrelia burgdorferi B31
SKEEYNRINEDLA

SEQ ID NO: 94607 - protein, 13 aa, Borrelia burgdorferi B31
KEEYNRINEDLAK

SEQ ID NO: 94608 - protein, 13 aa, Borrelia burgdorferi B31
EEYNRINEDLAKV

SEQ ID NO: 94609 - protein, 13 aa, Borrelia burgdorferi B31
EYNRINEDLAKVK

SEQ ID NO: 94610 - protein, 13 aa, Borrelia burgdorferi B31
YNRINEDLAKVKA

SEQ ID NO: 94611 - protein, 13 aa, Borrelia burgdorferi B31
NRINEDLAKVKAS

SEQ ID NO: 94612 - protein, 13 aa, Borrelia burgdorferi B31
RINEDLAKVKASL

SEQ ID NO: 94613 - protein, 13 aa, Borrelia burgdorferi B31
INEDLAKVKASLD

SEQ ID NO: 94614 - protein, 13 aa, Borrelia burgdorferi B31
NEDLAKVKASLDK

SEQ ID NO: 94615 - protein, 13 aa, Borrelia burgdorferi B31
EDLAKVKASLDKI

SEQ ID NO: 94616 - protein, 13 aa, Borrelia burgdorferi B31
DLAKVKASLDKIK

SEQ ID NO: 94617 - protein, 13 aa, Borrelia burgdorferi B31
LAKVKASLDKIKS

SEQ ID NO: 94618 - protein, 13 aa, Borrelia burgdorferi B31
AKVKASLDKIKSL

SEQ ID NO: 94619 - protein, 13 aa, Borrelia burgdorferi B31
KVKASLDKIKSLL

SEQ ID NO: 94620 - protein, 13 aa, Borrelia burgdorferi B31
VKASLDKIKSLLS

SEQ ID NO: 94621 - protein, 13 aa, Borrelia burgdorferi B31
KASLDKIKSLLST

SEQ ID NO: 94622 - protein, 13 aa, Borrelia burgdorferi B31
ASLDKIKSLLSTA

SEQ ID NO: 94623 - protein, 13 aa, Borrelia burgdorferi B31
SLDKIKSLLSTAK

SEQ ID NO: 94624 - protein, 13 aa, Borrelia burgdorferi B31
LDKIKSLLSTAKS

SEQ ID NO: 94625 - protein, 13 aa, Borrelia burgdorferi B31
DKIKSLLSTAKSY

SEQ ID NO: 94626 - protein, 13 aa, Borrelia burgdorferi B31
KIKSLLSTAKSYL

SEQ ID NO: 94627 - protein, 13 aa, Borrelia burgdorferi B31
IKSLLSTAKSYLE

SEQ ID NO: 94628 - protein, 13 aa, Borrelia burgdorferi B31
KSLLSTAKSYLEQ

SEQ ID NO: 94629 - protein, 13 aa, Borrelia burgdorferi B31
SLLSTAKSYLEQT

SEQ ID NO: 94630 - protein, 13 aa, Borrelia burgdorferi B31
LLSTAKSYLEQTR

SEQ ID NO: 94631 - protein, 13 aa, Borrelia burgdorferi B31
LSTAKSYLEQTRR

SEQ ID NO: 94632 - protein, 13 aa, Borrelia burgdorferi B31
STAKSYLEQTRRG

SEQ ID NO: 94633 - protein, 13 aa, Borrelia burgdorferi B31
TAKSYLEQTRRGV

SEQ ID NO: 94634 - protein, 13 aa, Borrelia burgdorferi B31
AKSYLEQTRRGVG

SEQ ID NO: 94635 - protein, 13 aa, Borrelia burgdorferi B31
KSYLEQTRRGVGS

SEQ ID NO: 94636 - protein, 13 aa, Borrelia burgdorferi B31
SYLEQTRRGVGSS

SEQ ID NO: 94637 - protein, 13 aa, Borrelia burgdorferi B31
YLEQTRRGVGSSK

SEQ ID NO: 94638 - protein, 13 aa, Borrelia burgdorferi B31
LEQTRRGVGSSKA

SEQ ID NO: 94639 - protein, 13 aa, Borrelia burgdorferi B31
EQTRRGVGSSKAN

SEQ ID NO: 94640 - protein, 13 aa, Borrelia burgdorferi B31
QTRRGVGSSKANL

SEQ ID NO: 94641 - protein, 13 aa, Borrelia burgdorferi B31
TRRGVGSSKANLA

SEQ ID NO: 94642 - protein, 13 aa, Borrelia burgdorferi B31
RRGVGSSKANLAL

SEQ ID NO: 94643 - protein, 13 aa, Borrelia burgdorferi B31
RGVGSSKANLALL

SEQ ID NO: 94644 - protein, 13 aa, Borrelia burgdorferi B31
GVGSSKANLALLP

SEQ ID NO: 94645 - protein, 13 aa, Borrelia burgdorferi B31
VGSSKANLALLPS

SEQ ID NO: 94646 - protein, 13 aa, Borrelia burgdorferi B31
GSSKANLALLPSL

SEQ ID NO: 94647 - protein, 13 aa, Borrelia burgdorferi B31
SSKANLALLPSLE

SEQ ID NO: 94648 - protein, 13 aa, Borrelia burgdorferi B31
SKANLALLPSLEE

SEQ ID NO: 94649 - protein, 13 aa, Borrelia burgdorferi B31
KANLALLPSLEEA

SEQ ID NO: 94650 - protein, 13 aa, Borrelia burgdorferi B31
ANLALLPSLEEAI

SEQ ID NO: 94651 - protein, 13 aa, Borrelia burgdorferi B31
NLALLPSLEEAIA

SEQ ID NO: 94652 - protein, 13 aa, Borrelia burgdorferi B31
LALLPSLEEAIAK

SEQ ID NO: 94653 - protein, 13 aa, Borrelia burgdorferi B31
ALLPSLEEAIAKV

SEQ ID NO: 94654 - protein, 13 aa, Borrelia burgdorferi B31
LLPSLEEAIAKVK

SEQ ID NO: 94655 - protein, 13 aa, Borrelia burgdorferi B31
LPSLEEAIAKVKS

SEQ ID NO: 94656 - protein, 13 aa, Borrelia burgdorferi B31
PSLEEAIAKVKSN

SEQ ID NO: 94657 - protein, 13 aa, Borrelia burgdorferi B31
SLEEAIAKVKSNH

SEQ ID NO: 94658 - protein, 13 aa, Borrelia burgdorferi B31
LEEAIAKVKSNHA

SEQ ID NO: 94659 - protein, 13 aa, Borrelia burgdorferi B31
EEAIAKVKSNHAS

SEQ ID NO: 94660 - protein, 13 aa, Borrelia burgdorferi B31
EAIAKVKSNHASA

SEQ ID NO: 94661 - protein, 13 aa, Borrelia burgdorferi B31
AIAKVKSNHASAD

SEQ ID NO: 94662 - protein, 13 aa, Borrelia burgdorferi B31
IAKVKSNHASADT

SEQ ID NO: 94663 - protein, 13 aa, Borrelia burgdorferi B31
AKVKSNHASADTH

SEQ ID NO: 94664 - protein, 13 aa, Borrelia burgdorferi B31
KVKSNHASADTHC

SEQ ID NO: 94665 - protein, 13 aa, Borrelia burgdorferi B31
VKSNHASADTHCN

SEQ ID NO: 94666 - protein, 13 aa, Borrelia burgdorferi B31
KSNHASADTHCND

SEQ ID NO: 94667 - protein, 13 aa, Borrelia burgdorferi B31
SNHASADTHCNDA

SEQ ID NO: 94668 - protein, 13 aa, Borrelia burgdorferi B31
NHASADTHCNDAI

SEQ ID NO: 94669 - protein, 13 aa, Borrelia burgdorferi B31
HASADTHCNDAIA

SEQ ID NO: 94670 - protein, 13 aa, Borrelia burgdorferi B31
ASADTHCNDAIAA

SEQ ID NO: 94671 - protein, 13 aa, Borrelia burgdorferi B31
SADTHCNDAIAAL

SEQ ID NO: 94672 - protein, 13 aa, Borrelia burgdorferi B31
ADTHCNDAIAALK

SEQ ID NO: 94673 - protein, 13 aa, Borrelia burgdorferi B31
DTHCNDAIAALKR

SEQ ID NO: 94674 - protein, 13 aa, Borrelia burgdorferi B31
THCNDAIAALKRA

SEQ ID NO: 94675 - protein, 13 aa, Borrelia burgdorferi B31
HCNDAIAALKRAK

SEQ ID NO: 94676 - protein, 13 aa, Borrelia burgdorferi B31
CNDAIAALKRAKN

SEQ ID NO: 94677 - protein, 13 aa, Borrelia burgdorferi B31
NDAIAALKRAKND

SEQ ID NO: 94678 - protein, 13 aa, Borrelia burgdorferi B31
DAIAALKRAKNDF

SEQ ID NO: 94679 - protein, 13 aa, Borrelia burgdorferi B31
AIAALKRAKNDFE

SEQ ID NO: 94680 - protein, 13 aa, Borrelia burgdorferi B31
IAALKRAKNDFEY

SEQ ID NO: 94681 - protein, 13 aa, Borrelia burgdorferi B31
AALKRAKNDFEYA

SEQ ID NO: 94682 - protein, 13 aa, Borrelia burgdorferi B31
ALKRAKNDFEYAQ

SEQ ID NO: 94683 - protein, 13 aa, Borrelia burgdorferi B31
LKRAKNDFEYAQR

SEQ ID NO: 94684 - protein, 13 aa, Borrelia burgdorferi B31
KRAKNDFEYAQRK

SEQ ID NO: 94685 - protein, 13 aa, Borrelia burgdorferi B31
RAKNDFEYAQRKA

SEQ ID NO: 94686 - protein, 13 aa, Borrelia burgdorferi B31
AKNDFEYAQRKAD

SEQ ID NO: 94687 - protein, 13 aa, Borrelia burgdorferi B31
KNDFEYAQRKADR

SEQ ID NO: 94688 - protein, 13 aa, Borrelia burgdorferi B31
NDFEYAQRKADRA

SEQ ID NO: 94689 - protein, 13 aa, Borrelia burgdorferi B31
DFEYAQRKADRAL

SEQ ID NO: 94690 - protein, 13 aa, Borrelia burgdorferi B31
FEYAQRKADRALE

SEQ ID NO: 94691 - protein, 13 aa, Borrelia burgdorferi B31
EYAQRKADRALEE

SEQ ID NO: 94692 - protein, 13 aa, Borrelia burgdorferi B31
YAQRKADRALEEA

SEQ ID NO: 94693 - protein, 13 aa, Borrelia burgdorferi B31
AQRKADRALEEAL

SEQ ID NO: 94694 - protein, 13 aa, Borrelia burgdorferi B31
QRKADRALEEALS

SEQ ID NO: 94695 - protein, 13 aa, Borrelia burgdorferi B31
RKADRALEEALSN

SEQ ID NO: 94696 - protein, 13 aa, Borrelia burgdorferi B31
KADRALEEALSNS

SEQ ID NO: 94697 - protein, 13 aa, Borrelia burgdorferi B31
ADRALEEALSNSN

SEQ ID NO: 94698 - protein, 13 aa, Borrelia burgdorferi B31
DRALEEALSNSNA

SEQ ID NO: 94699 - protein, 13 aa, Borrelia burgdorferi B31
RALEEALSNSNAS

SEQ ID NO: 94700 - protein, 13 aa, Borrelia burgdorferi B31
ALEEALSNSNASR

SEQ ID NO: 94701 - protein, 13 aa, Borrelia burgdorferi B31
LEEALSNSNASRH

SEQ ID NO: 94702 - protein, 13 aa, Borrelia burgdorferi B31
EEALSNSNASRHE

SEQ ID NO: 94703 - protein, 13 aa, Borrelia burgdorferi B31
EALSNSNASRHES

SEQ ID NO: 94704 - protein, 13 aa, Borrelia burgdorferi B31
ALSNSNASRHESY

SEQ ID NO: 94705 - protein, 13 aa, Borrelia burgdorferi B31
LSNSNASRHESYY

SEQ ID NO: 94706 - protein, 13 aa, Borrelia burgdorferi B31
SNSNASRHESYYY

SEQ ID NO: 94707 - protein, 13 aa, Borrelia burgdorferi B31
NSNASRHESYYYA

SEQ ID NO: 94708 - protein, 13 aa, Borrelia burgdorferi B31
SNASRHESYYYAG

SEQ ID NO: 94709 - protein, 13 aa, Borrelia burgdorferi B31
NASRHESYYYAGY

SEQ ID NO: 94710 - protein, 13 aa, Borrelia burgdorferi B31
ASRHESYYYAGYH

SEQ ID NO: 94711 - protein, 13 aa, Borrelia burgdorferi B31
SRHESYYYAGYHQ

SEQ ID NO: 94712 - protein, 13 aa, Borrelia burgdorferi B31
RHESYYYAGYHQF

SEQ ID NO: 94713 - protein, 13 aa, Borrelia burgdorferi B31
HESYYYAGYHQFM

SEQ ID NO: 94714 - protein, 13 aa, Borrelia burgdorferi B31
ESYYYAGYHQFMA

SEQ ID NO: 94715 - protein, 13 aa, Borrelia burgdorferi B31
SYYYAGYHQFMAD

SEQ ID NO: 94716 - protein, 13 aa, Borrelia burgdorferi B31
YYYAGYHQFMADA

SEQ ID NO: 94717 - protein, 13 aa, Borrelia burgdorferi B31
YYAGYHQFMADAK

SEQ ID NO: 94718 - protein, 13 aa, Borrelia burgdorferi B31
YAGYHQFMADAKA

SEQ ID NO: 94719 - protein, 13 aa, Borrelia burgdorferi B31
AGYHQFMADAKAS

SEQ ID NO: 94720 - protein, 13 aa, Borrelia burgdorferi B31
GYHQFMADAKASM

SEQ ID NO: 94721 - protein, 13 aa, Borrelia burgdorferi B31
YHQFMADAKASMS

SEQ ID NO: 94722 - protein, 13 aa, Borrelia burgdorferi B31
HQFMADAKASMSS

SEQ ID NO: 94723 - protein, 13 aa, Borrelia burgdorferi B31
QFMADAKASMSST

SEQ ID NO: 94724 - protein, 13 aa, Borrelia burgdorferi B31
FMADAKASMSSTK

SEQ ID NO: 94725 - protein, 13 aa, Borrelia burgdorferi B31
MADAKASMSSTKS

SEQ ID NO: 94726 - protein, 13 aa, Borrelia burgdorferi B31
ADAKASMSSTKSL

SEQ ID NO: 94727 - protein, 13 aa, Borrelia burgdorferi B31
DAKASMSSTKSLL

SEQ ID NO: 94728 - protein, 13 aa, Borrelia burgdorferi B31
AKASMSSTKSLLE

SEQ ID NO: 94729 - protein, 13 aa, Borrelia burgdorferi B31
KASMSSTKSLLEV

SEQ ID NO: 94730 - protein, 13 aa, Borrelia burgdorferi B31
ASMSSTKSLLEVA

SEQ ID NO: 94731 - protein, 13 aa, Borrelia burgdorferi B31
SMSSTKSLLEVAK

SEQ ID NO: 94732 - protein, 13 aa, Borrelia burgdorferi B31
MSSTKSLLEVAKN

SEQ ID NO: 94733 - protein, 13 aa, Borrelia burgdorferi B31
SSTKSLLEVAKNK

SEQ ID NO: 94734 - protein, 13 aa, Borrelia burgdorferi B31
STKSLLEVAKNKQ

SEQ ID NO: 94735 - protein, 13 aa, Borrelia burgdorferi B31
TKSLLEVAKNKQK

SEQ ID NO: 94736 - protein, 13 aa, Borrelia burgdorferi B31
KSLLEVAKNKQKE

SEQ ID NO: 94737 - protein, 13 aa, Borrelia burgdorferi B31
SLLEVAKNKQKEL

SEQ ID NO: 94738 - protein, 13 aa, Borrelia burgdorferi B31
LLEVAKNKQKELN

SEQ ID NO: 94739 - protein, 13 aa, Borrelia burgdorferi B31
LEVAKNKQKELNE

SEQ ID NO: 94740 - protein, 13 aa, Borrelia burgdorferi B31
EVAKNKQKELNEN

SEQ ID NO: 94741 - protein, 13 aa, Borrelia burgdorferi B31
VAKNKQKELNENM

SEQ ID NO: 94742 - protein, 13 aa, Borrelia burgdorferi B31
AKNKQKELNENMT

SEQ ID NO: 94743 - protein, 13 aa, Borrelia burgdorferi B31
KNKQKELNENMTK

SEQ ID NO: 94744 - protein, 13 aa, Borrelia burgdorferi B31
NKQKELNENMTKT

SEQ ID NO: 94745 - protein, 13 aa, Borrelia burgdorferi B31
KQKELNENMTKTN

SEQ ID NO: 94746 - protein, 13 aa, Borrelia burgdorferi B31
QKELNENMTKTNK

SEQ ID NO: 94747 - protein, 13 aa, Borrelia burgdorferi B31
KELNENMTKTNKD

SEQ ID NO: 94748 - protein, 13 aa, Borrelia burgdorferi B31
ELNENMTKTNKDF

SEQ ID NO: 94749 - protein, 13 aa, Borrelia burgdorferi B31
LNENMTKTNKDFQ

SEQ ID NO: 94750 - protein, 13 aa, Borrelia burgdorferi B31
NENMTKTNKDFQE

SEQ ID NO: 94751 - protein, 13 aa, Borrelia burgdorferi B31
ENMTKTNKDFQEL

SEQ ID NO: 94752 - protein, 13 aa, Borrelia burgdorferi B31
NMTKTNKDFQELN

SEQ ID NO: 94753 - protein, 13 aa, Borrelia burgdorferi B31
MTKTNKDFQELND

SEQ ID NO: 94754 - protein, 13 aa, Borrelia burgdorferi B31
TKTNKDFQELNDI

SEQ ID NO: 94755 - protein, 13 aa, Borrelia burgdorferi B31
KTNKDFQELNDIY

SEQ ID NO: 94756 - protein, 13 aa, Borrelia burgdorferi B31
TNKDFQELNDIYK

SEQ ID NO: 94757 - protein, 13 aa, Borrelia burgdorferi B31
NKDFQELNDIYKK

SEQ ID NO: 94758 - protein, 13 aa, Borrelia burgdorferi B31
KDFQELNDIYKKL

SEQ ID NO: 94759 - protein, 13 aa, Borrelia burgdorferi B31
DFQELNDIYKKLQ

SEQ ID NO: 94760 - protein, 13 aa, Borrelia burgdorferi B31
FQELNDIYKKLQD

SEQ ID NO: 94761 - protein, 13 aa, Borrelia burgdorferi B31
QELNDIYKKLQDM

SEQ ID NO: 94762 - protein, 13 aa, Borrelia burgdorferi B31
ELNDIYKKLQDMD

SEQ ID NO: 94763 - protein, 13 aa, Borrelia burgdorferi B31
LNDIYKKLQDMDS

SEQ ID NO: 94764 - protein, 13 aa, Borrelia burgdorferi B31
NDIYKKLQDMDSR

SEQ ID NO: 94765 - protein, 14 aa, Borrelia burgdorferi B31
MNLINKLFILTILF

SEQ ID NO: 94766 - protein, 14 aa, Borrelia burgdorferi B31
NLINKLFILTILFS

SEQ ID NO: 94767 - protein, 14 aa, Borrelia burgdorferi B31
LINKLFILTILFSS

SEQ ID NO: 94768 - protein, 14 aa, Borrelia burgdorferi B31
INKLFILTILFSSV

SEQ ID NO: 94769 - protein, 14 aa, Borrelia burgdorferi B31
NKLFILTILFSSVI

SEQ ID NO: 94770 - protein, 14 aa, Borrelia burgdorferi B31
KLFILTILFSSVIS

SEQ ID NO: 94771 - protein, 14 aa, Borrelia burgdorferi B31
LFILTILFSSVISC

SEQ ID NO: 94772 - protein, 14 aa, Borrelia burgdorferi B31
FILTILFSSVISCK

SEQ ID NO: 94773 - protein, 14 aa, Borrelia burgdorferi B31
ILTILFSSVISCKL

SEQ ID NO: 94774 - protein, 14 aa, Borrelia burgdorferi B31
LTILFSSVISCKLY

SEQ ID NO: 94775 - protein, 14 aa, Borrelia burgdorferi B31
TILFSSVISCKLYK

SEQ ID NO: 94776 - protein, 14 aa, Borrelia burgdorferi B31
ILFSSVISCKLYKK

SEQ ID NO: 94777 - protein, 14 aa, Borrelia burgdorferi B31
LFSSVISCKLYKKI

SEQ ID NO: 94778 - protein, 14 aa, Borrelia burgdorferi B31
FSSVISCKLYKKIT

SEQ ID NO: 94779 - protein, 14 aa, Borrelia burgdorferi B31
SSVISCKLYKKITY

SEQ ID NO: 94780 - protein, 14 aa, Borrelia burgdorferi B31
SVISCKLYKKITYN

SEQ ID NO: 94781 - protein, 14 aa, Borrelia burgdorferi B31
VISCKLYKKITYNA

SEQ ID NO: 94782 - protein, 14 aa, Borrelia burgdorferi B31
ISCKLYKKITYNAD

SEQ ID NO: 94783 - protein, 14 aa, Borrelia burgdorferi B31
SCKLYKKITYNADQ

SEQ ID NO: 94784 - protein, 14 aa, Borrelia burgdorferi B31
CKLYKKITYNADQV

SEQ ID NO: 94785 - protein, 14 aa, Borrelia burgdorferi B31
KLYKKITYNADQVI

SEQ ID NO: 94786 - protein, 14 aa, Borrelia burgdorferi B31
LYKKITYNADQVID

SEQ ID NO: 94787 - protein, 14 aa, Borrelia burgdorferi B31
YKKITYNADQVIDK

SEQ ID NO: 94788 - protein, 14 aa, Borrelia burgdorferi B31
KKITYNADQVIDKL

SEQ ID NO: 94789 - protein, 14 aa, Borrelia burgdorferi B31
KITYNADQVIDKLK

SEQ ID NO: 94790 - protein, 14 aa, Borrelia burgdorferi B31
ITYNADQVIDKLKS

SEQ ID NO: 94791 - protein, 14 aa, Borrelia burgdorferi B31
TYNADQVIDKLKSN

SEQ ID NO: 94792 - protein, 14 aa, Borrelia burgdorferi B31
YNADQVIDKLKSNN

SEQ ID NO: 94793 - protein, 14 aa, Borrelia burgdorferi B31
NADQVIDKLKSNNG

SEQ ID NO: 94794 - protein, 14 aa, Borrelia burgdorferi B31
ADQVIDKLKSNNGS

SEQ ID NO: 94795 - protein, 14 aa, Borrelia burgdorferi B31
DQVIDKLKSNNGSF

SEQ ID NO: 94796 - protein, 14 aa, Borrelia burgdorferi B31
QVIDKLKSNNGSFN

SEQ ID NO: 94797 - protein, 14 aa, Borrelia burgdorferi B31
VIDKLKSNNGSFNT

SEQ ID NO: 94798 - protein, 14 aa, Borrelia burgdorferi B31
IDKLKSNNGSFNTL

SEQ ID NO: 94799 - protein, 14 aa, Borrelia burgdorferi B31
DKLKSNNGSFNTLK

SEQ ID NO: 94800 - protein, 14 aa, Borrelia burgdorferi B31
KLKSNNGSFNTLKS

SEQ ID NO: 94801 - protein, 14 aa, Borrelia burgdorferi B31
LKSNNGSFNTLKSN

SEQ ID NO: 94802 - protein, 14 aa, Borrelia burgdorferi B31
KSNNGSFNTLKSND

SEQ ID NO: 94803 - protein, 14 aa, Borrelia burgdorferi B31
SNNGSFNTLKSNDD

SEQ ID NO: 94804 - protein, 14 aa, Borrelia burgdorferi B31
NNGSFNTLKSNDDS

SEQ ID NO: 94805 - protein, 14 aa, Borrelia burgdorferi B31
NGSFNTLKSNDDSK

SEQ ID NO: 94806 - protein, 14 aa, Borrelia burgdorferi B31
GSFNTLKSNDDSKR

SEQ ID NO: 94807 - protein, 14 aa, Borrelia burgdorferi B31
SFNTLKSNDDSKRS

SEQ ID NO: 94808 - protein, 14 aa, Borrelia burgdorferi B31
FNTLKSNDDSKRSG

SEQ ID NO: 94809 - protein, 14 aa, Borrelia burgdorferi B31
NTLKSNDDSKRSGR

SEQ ID NO: 94810 - protein, 14 aa, Borrelia burgdorferi B31
TLKSNDDSKRSGRK

SEQ ID NO: 94811 - protein, 14 aa, Borrelia burgdorferi B31
LKSNDDSKRSGRKP

SEQ ID NO: 94812 - protein, 14 aa, Borrelia burgdorferi B31
KSNDDSKRSGRKPR

SEQ ID NO: 94813 - protein, 14 aa, Borrelia burgdorferi B31
SNDDSKRSGRKPRS

SEQ ID NO: 94814 - protein, 14 aa, Borrelia burgdorferi B31
NDDSKRSGRKPRSV

SEQ ID NO: 94815 - protein, 14 aa, Borrelia burgdorferi B31
DDSKRSGRKPRSVD

SEQ ID NO: 94816 - protein, 14 aa, Borrelia burgdorferi B31
DSKRSGRKPRSVDN

SEQ ID NO: 94817 - protein, 14 aa, Borrelia burgdorferi B31
SKRSGRKPRSVDNT

SEQ ID NO: 94818 - protein, 14 aa, Borrelia burgdorferi B31
KRSGRKPRSVDNTY

SEQ ID NO: 94819 - protein, 14 aa, Borrelia burgdorferi B31
RSGRKPRSVDNTYM

SEQ ID NO: 94820 - protein, 14 aa, Borrelia burgdorferi B31
SGRKPRSVDNTYMD

SEQ ID NO: 94821 - protein, 14 aa, Borrelia burgdorferi B31
GRKPRSVDNTYMDQ

SEQ ID NO: 94822 - protein, 14 aa, Borrelia burgdorferi B31
RKPRSVDNTYMDQD

SEQ ID NO: 94823 - protein, 14 aa, Borrelia burgdorferi B31
KPRSVDNTYMDQDT

SEQ ID NO: 94824 - protein, 14 aa, Borrelia burgdorferi B31
PRSVDNTYMDQDTG

SEQ ID NO: 94825 - protein, 14 aa, Borrelia burgdorferi B31
RSVDNTYMDQDTGK

SEQ ID NO: 94826 - protein, 14 aa, Borrelia burgdorferi B31
SVDNTYMDQDTGKK

SEQ ID NO: 94827 - protein, 14 aa, Borrelia burgdorferi B31
VDNTYMDQDTGKKP

SEQ ID NO: 94828 - protein, 14 aa, Borrelia burgdorferi B31
DNTYMDQDTGKKPL

SEQ ID NO: 94829 - protein, 14 aa, Borrelia burgdorferi B31
NTYMDQDTGKKPLM

SEQ ID NO: 94830 - protein, 14 aa, Borrelia burgdorferi B31
TYMDQDTGKKPLMA

SEQ ID NO: 94831 - protein, 14 aa, Borrelia burgdorferi B31
YMDQDTGKKPLMAD

SEQ ID NO: 94832 - protein, 14 aa, Borrelia burgdorferi B31
MDQDTGKKPLMADM

SEQ ID NO: 94833 - protein, 14 aa, Borrelia burgdorferi B31
DQDTGKKPLMADMQ

SEQ ID NO: 94834 - protein, 14 aa, Borrelia burgdorferi B31
QDTGKKPLMADMQP

SEQ ID NO: 94835 - protein, 14 aa, Borrelia burgdorferi B31
DTGKKPLMADMQPD

SEQ ID NO: 94836 - protein, 14 aa, Borrelia burgdorferi B31
TGKKPLMADMQPDM

SEQ ID NO: 94837 - protein, 14 aa, Borrelia burgdorferi B31
GKKPLMADMQPDMQ

SEQ ID NO: 94838 - protein, 14 aa, Borrelia burgdorferi B31
KKPLMADMQPDMQN

SEQ ID NO: 94839 - protein, 14 aa, Borrelia burgdorferi B31
KPLMADMQPDMQND

SEQ ID NO: 94840 - protein, 14 aa, Borrelia burgdorferi B31
PLMADMQPDMQNDN

SEQ ID NO: 94841 - protein, 14 aa, Borrelia burgdorferi B31
LMADMQPDMQNDNS

SEQ ID NO: 94842 - protein, 14 aa, Borrelia burgdorferi B31
MADMQPDMQNDNSS

SEQ ID NO: 94843 - protein, 14 aa, Borrelia burgdorferi B31
ADMQPDMQNDNSSS

SEQ ID NO: 94844 - protein, 14 aa, Borrelia burgdorferi B31
DMQPDMQNDNSSSN

SEQ ID NO: 94845 - protein, 14 aa, Borrelia burgdorferi B31
MQPDMQNDNSSSNH

SEQ ID NO: 94846 - protein, 14 aa, Borrelia burgdorferi B31
QPDMQNDNSSSNHT

SEQ ID NO: 94847 - protein, 14 aa, Borrelia burgdorferi B31
PDMQNDNSSSNHTL

SEQ ID NO: 94848 - protein, 14 aa, Borrelia burgdorferi B31
DMQNDNSSSNHTLQ

SEQ ID NO: 94849 - protein, 14 aa, Borrelia burgdorferi B31
MQNDNSSSNHTLQV

SEQ ID NO: 94850 - protein, 14 aa, Borrelia burgdorferi B31
QNDNSSSNHTLQVN

SEQ ID NO: 94851 - protein, 14 aa, Borrelia burgdorferi B31
NDNSSSNHTLQVNI

SEQ ID NO: 94852 - protein, 14 aa, Borrelia burgdorferi B31
DNSSSNHTLQVNIQ

SEQ ID NO: 94853 - protein, 14 aa, Borrelia burgdorferi B31
NSSSNHTLQVNIQD

SEQ ID NO: 94854 - protein, 14 aa, Borrelia burgdorferi B31
SSSNHTLQVNIQDN

SEQ ID NO: 94855 - protein, 14 aa, Borrelia burgdorferi B31
SSNHTLQVNIQDNE

SEQ ID NO: 94856 - protein, 14 aa, Borrelia burgdorferi B31
SNHTLQVNIQDNEA

SEQ ID NO: 94857 - protein, 14 aa, Borrelia burgdorferi B31
NHTLQVNIQDNEAS

SEQ ID NO: 94858 - protein, 14 aa, Borrelia burgdorferi B31
HTLQVNIQDNEASE

SEQ ID NO: 94859 - protein, 14 aa, Borrelia burgdorferi B31
TLQVNIQDNEASEA

SEQ ID NO: 94860 - protein, 14 aa, Borrelia burgdorferi B31
LQVNIQDNEASEAR

SEQ ID NO: 94861 - protein, 14 aa, Borrelia burgdorferi B31
QVNIQDNEASEARN

SEQ ID NO: 94862 - protein, 14 aa, Borrelia burgdorferi B31
VNIQDNEASEARNI

SEQ ID NO: 94863 - protein, 14 aa, Borrelia burgdorferi B31
NIQDNEASEARNIM

SEQ ID NO: 94864 - protein, 14 aa, Borrelia burgdorferi B31
IQDNEASEARNIMT

SEQ ID NO: 94865 - protein, 14 aa, Borrelia burgdorferi B31
QDNEASEARNIMTE

SEQ ID NO: 94866 - protein, 14 aa, Borrelia burgdorferi B31
DNEASEARNIMTEI

SEQ ID NO: 94867 - protein, 14 aa, Borrelia burgdorferi B31
NEASEARNIMTEIE

SEQ ID NO: 94868 - protein, 14 aa, Borrelia burgdorferi B31
EASEARNIMTEIES

SEQ ID NO: 94869 - protein, 14 aa, Borrelia burgdorferi B31
ASEARNIMTEIESS

SEQ ID NO: 94870 - protein, 14 aa, Borrelia burgdorferi B31
SEARNIMTEIESSK

SEQ ID NO: 94871 - protein, 14 aa, Borrelia burgdorferi B31
EARNIMTEIESSKE

SEQ ID NO: 94872 - protein, 14 aa, Borrelia burgdorferi B31
ARNIMTEIESSKEE

SEQ ID NO: 94873 - protein, 14 aa, Borrelia burgdorferi B31
RNIMTEIESSKEEY

SEQ ID NO: 94874 - protein, 14 aa, Borrelia burgdorferi B31
NIMTEIESSKEEYN

SEQ ID NO: 94875 - protein, 14 aa, Borrelia burgdorferi B31
IMTEIESSKEEYNR

SEQ ID NO: 94876 - protein, 14 aa, Borrelia burgdorferi B31
MTEIESSKEEYNRI

SEQ ID NO: 94877 - protein, 14 aa, Borrelia burgdorferi B31
TEIESSKEEYNRIN

SEQ ID NO: 94878 - protein, 14 aa, Borrelia burgdorferi B31
EIESSKEEYNRINE

SEQ ID NO: 94879 - protein, 14 aa, Borrelia burgdorferi B31
IESSKEEYNRINED

SEQ ID NO: 94880 - protein, 14 aa, Borrelia burgdorferi B31
ESSKEEYNRINEDL

SEQ ID NO: 94881 - protein, 14 aa, Borrelia burgdorferi B31
SSKEEYNRINEDLA

SEQ ID NO: 94882 - protein, 14 aa, Borrelia burgdorferi B31
SKEEYNRINEDLAK

SEQ ID NO: 94883 - protein, 14 aa, Borrelia burgdorferi B31
KEEYNRINEDLAKV

SEQ ID NO: 94884 - protein, 14 aa, Borrelia burgdorferi B31
EEYNRINEDLAKVK

SEQ ID NO: 94885 - protein, 14 aa, Borrelia burgdorferi B31
EYNRINEDLAKVKA

SEQ ID NO: 94886 - protein, 14 aa, Borrelia burgdorferi B31
YNRINEDLAKVKAS

SEQ ID NO: 94887 - protein, 14 aa, Borrelia burgdorferi B31
NRINEDLAKVKASL

SEQ ID NO: 94888 - protein, 14 aa, Borrelia burgdorferi B31
RINEDLAKVKASLD

SEQ ID NO: 94889 - protein, 14 aa, Borrelia burgdorferi B31
INEDLAKVKASLDK

SEQ ID NO: 94890 - protein, 14 aa, Borrelia burgdorferi B31
NEDLAKVKASLDKI

SEQ ID NO: 94891 - protein, 14 aa, Borrelia burgdorferi B31
EDLAKVKASLDKIK

SEQ ID NO: 94892 - protein, 14 aa, Borrelia burgdorferi B31
DLAKVKASLDKIKS

SEQ ID NO: 94893 - protein, 14 aa, Borrelia burgdorferi B31
LAKVKASLDKIKSL

SEQ ID NO: 94894 - protein, 14 aa, Borrelia burgdorferi B31
AKVKASLDKIKSLL

SEQ ID NO: 94895 - protein, 14 aa, Borrelia burgdorferi B31
KVKASLDKIKSLLS

SEQ ID NO: 94896 - protein, 14 aa, Borrelia burgdorferi B31
VKASLDKIKSLLST

SEQ ID NO: 94897 - protein, 14 aa, Borrelia burgdorferi B31
KASLDKIKSLLSTA

SEQ ID NO: 94898 - protein, 14 aa, Borrelia burgdorferi B31
ASLDKIKSLLSTAK

SEQ ID NO: 94899 - protein, 14 aa, Borrelia burgdorferi B31
SLDKIKSLLSTAKS

SEQ ID NO: 94900 - protein, 14 aa, Borrelia burgdorferi B31
LDKIKSLLSTAKSY

SEQ ID NO: 94901 - protein, 14 aa, Borrelia burgdorferi B31
DKIKSLLSTAKSYL

SEQ ID NO: 94902 - protein, 14 aa, Borrelia burgdorferi B31
KIKSLLSTAKSYLE

SEQ ID NO: 94903 - protein, 14 aa, Borrelia burgdorferi B31
IKSLLSTAKSYLEQ

SEQ ID NO: 94904 - protein, 14 aa, Borrelia burgdorferi B31
KSLLSTAKSYLEQT

SEQ ID NO: 94905 - protein, 14 aa, Borrelia burgdorferi B31
SLLSTAKSYLEQTR

SEQ ID NO: 94906 - protein, 14 aa, Borrelia burgdorferi B31
LLSTAKSYLEQTRR

SEQ ID NO: 94907 - protein, 14 aa, Borrelia burgdorferi B31
LSTAKSYLEQTRRG

SEQ ID NO: 94908 - protein, 14 aa, Borrelia burgdorferi B31
STAKSYLEQTRRGV

SEQ ID NO: 94909 - protein, 14 aa, Borrelia burgdorferi B31
TAKSYLEQTRRGVG

SEQ ID NO: 94910 - protein, 14 aa, Borrelia burgdorferi B31
AKSYLEQTRRGVGS

SEQ ID NO: 94911 - protein, 14 aa, Borrelia burgdorferi B31
KSYLEQTRRGVGSS

SEQ ID NO: 94912 - protein, 14 aa, Borrelia burgdorferi B31
SYLEQTRRGVGSSK

SEQ ID NO: 94913 - protein, 14 aa, Borrelia burgdorferi B31
YLEQTRRGVGSSKA

SEQ ID NO: 94914 - protein, 14 aa, Borrelia burgdorferi B31
LEQTRRGVGSSKAN

SEQ ID NO: 94915 - protein, 14 aa, Borrelia burgdorferi B31
EQTRRGVGSSKANL

SEQ ID NO: 94916 - protein, 14 aa, Borrelia burgdorferi B31
QTRRGVGSSKANLA

SEQ ID NO: 94917 - protein, 14 aa, Borrelia burgdorferi B31
TRRGVGSSKANLAL

SEQ ID NO: 94918 - protein, 14 aa, Borrelia burgdorferi B31
RRGVGSSKANLALL

SEQ ID NO: 94919 - protein, 14 aa, Borrelia burgdorferi B31
RGVGSSKANLALLP

SEQ ID NO: 94920 - protein, 14 aa, Borrelia burgdorferi B31
GVGSSKANLALLPS

SEQ ID NO: 94921 - protein, 14 aa, Borrelia burgdorferi B31
VGSSKANLALLPSL

SEQ ID NO: 94922 - protein, 14 aa, Borrelia burgdorferi B31
GSSKANLALLPSLE

SEQ ID NO: 94923 - protein, 14 aa, Borrelia burgdorferi B31
SSKANLALLPSLEE

SEQ ID NO: 94924 - protein, 14 aa, Borrelia burgdorferi B31
SKANLALLPSLEEA

SEQ ID NO: 94925 - protein, 14 aa, Borrelia burgdorferi B31
KANLALLPSLEEAI

SEQ ID NO: 94926 - protein, 14 aa, Borrelia burgdorferi B31
ANLALLPSLEEAIA

SEQ ID NO: 94927 - protein, 14 aa, Borrelia burgdorferi B31
NLALLPSLEEAIAK

SEQ ID NO: 94928 - protein, 14 aa, Borrelia burgdorferi B31
LALLPSLEEAIAKV

SEQ ID NO: 94929 - protein, 14 aa, Borrelia burgdorferi B31
ALLPSLEEAIAKVK

SEQ ID NO: 94930 - protein, 14 aa, Borrelia burgdorferi B31
LLPSLEEAIAKVKS

SEQ ID NO: 94931 - protein, 14 aa, Borrelia burgdorferi B31
LPSLEEAIAKVKSN

SEQ ID NO: 94932 - protein, 14 aa, Borrelia burgdorferi B31
PSLEEAIAKVKSNH

SEQ ID NO: 94933 - protein, 14 aa, Borrelia burgdorferi B31
SLEEAIAKVKSNHA

SEQ ID NO: 94934 - protein, 14 aa, Borrelia burgdorferi B31
LEEAIAKVKSNHAS

SEQ ID NO: 94935 - protein, 14 aa, Borrelia burgdorferi B31
EEAIAKVKSNHASA

SEQ ID NO: 94936 - protein, 14 aa, Borrelia burgdorferi B31
EAIAKVKSNHASAD

SEQ ID NO: 94937 - protein, 14 aa, Borrelia burgdorferi B31
AIAKVKSNHASADT

SEQ ID NO: 94938 - protein, 14 aa, Borrelia burgdorferi B31
IAKVKSNHASADTH

SEQ ID NO: 94939 - protein, 14 aa, Borrelia burgdorferi B31
AKVKSNHASADTHC

SEQ ID NO: 94940 - protein, 14 aa, Borrelia burgdorferi B31
KVKSNHASADTHCN

SEQ ID NO: 94941 - protein, 14 aa, Borrelia burgdorferi B31
VKSNHASADTHCND

SEQ ID NO: 94942 - protein, 14 aa, Borrelia burgdorferi B31
KSNHASADTHCNDA

SEQ ID NO: 94943 - protein, 14 aa, Borrelia burgdorferi B31
SNHASADTHCNDAI

SEQ ID NO: 94944 - protein, 14 aa, Borrelia burgdorferi B31
NHASADTHCNDAIA

SEQ ID NO: 94945 - protein, 14 aa, Borrelia burgdorferi B31
HASADTHCNDAIAA

SEQ ID NO: 94946 - protein, 14 aa, Borrelia burgdorferi B31
ASADTHCNDAIAAL

SEQ ID NO: 94947 - protein, 14 aa, Borrelia burgdorferi B31
SADTHCNDAIAALK

SEQ ID NO: 94948 - protein, 14 aa, Borrelia burgdorferi B31
ADTHCNDAIAALKR

SEQ ID NO: 94949 - protein, 14 aa, Borrelia burgdorferi B31
DTHCNDAIAALKRA

SEQ ID NO: 94950 - protein, 14 aa, Borrelia burgdorferi B31
THCNDAIAALKRAK

SEQ ID NO: 94951 - protein, 14 aa, Borrelia burgdorferi B31
HCNDAIAALKRAKN

SEQ ID NO: 94952 - protein, 14 aa, Borrelia burgdorferi B31
CNDAIAALKRAKND

SEQ ID NO: 94953 - protein, 14 aa, Borrelia burgdorferi B31
NDAIAALKRAKNDF

SEQ ID NO: 94954 - protein, 14 aa, Borrelia burgdorferi B31
DAIAALKRAKNDFE

SEQ ID NO: 94955 - protein, 14 aa, Borrelia burgdorferi B31
AIAALKRAKNDFEY

SEQ ID NO: 94956 - protein, 14 aa, Borrelia burgdorferi B31
IAALKRAKNDFEYA

SEQ ID NO: 94957 - protein, 14 aa, Borrelia burgdorferi B31
AALKRAKNDFEYAQ

SEQ ID NO: 94958 - protein, 14 aa, Borrelia burgdorferi B31
ALKRAKNDFEYAQR

SEQ ID NO: 94959 - protein, 14 aa, Borrelia burgdorferi B31
LKRAKNDFEYAQRK

SEQ ID NO: 94960 - protein, 14 aa, Borrelia burgdorferi B31
KRAKNDFEYAQRKA

SEQ ID NO: 94961 - protein, 14 aa, Borrelia burgdorferi B31
RAKNDFEYAQRKAD

SEQ ID NO: 94962 - protein, 14 aa, Borrelia burgdorferi B31
AKNDFEYAQRKADR

SEQ ID NO: 94963 - protein, 14 aa, Borrelia burgdorferi B31
KNDFEYAQRKADRA

SEQ ID NO: 94964 - protein, 14 aa, Borrelia burgdorferi B31
NDFEYAQRKADRAL

SEQ ID NO: 94965 - protein, 14 aa, Borrelia burgdorferi B31
DFEYAQRKADRALE

SEQ ID NO: 94966 - protein, 14 aa, Borrelia burgdorferi B31
FEYAQRKADRALEE

SEQ ID NO: 94967 - protein, 14 aa, Borrelia burgdorferi B31
EYAQRKADRALEEA

SEQ ID NO: 94968 - protein, 14 aa, Borrelia burgdorferi B31
YAQRKADRALEEAL

SEQ ID NO: 94969 - protein, 14 aa, Borrelia burgdorferi B31
AQRKADRALEEALS

SEQ ID NO: 94970 - protein, 14 aa, Borrelia burgdorferi B31
QRKADRALEEALSN

SEQ ID NO: 94971 - protein, 14 aa, Borrelia burgdorferi B31
RKADRALEEALSNS

SEQ ID NO: 94972 - protein, 14 aa, Borrelia burgdorferi B31
KADRALEEALSNSN

SEQ ID NO: 94973 - protein, 14 aa, Borrelia burgdorferi B31
ADRALEEALSNSNA

SEQ ID NO: 94974 - protein, 14 aa, Borrelia burgdorferi B31
DRALEEALSNSNAS

SEQ ID NO: 94975 - protein, 14 aa, Borrelia burgdorferi B31
RALEEALSNSNASR

SEQ ID NO: 94976 - protein, 14 aa, Borrelia burgdorferi B31
ALEEALSNSNASRH

SEQ ID NO: 94977 - protein, 14 aa, Borrelia burgdorferi B31
LEEALSNSNASRHE

SEQ ID NO: 94978 - protein, 14 aa, Borrelia burgdorferi B31
EEALSNSNASRHES

SEQ ID NO: 94979 - protein, 14 aa, Borrelia burgdorferi B31
EALSNSNASRHESY

SEQ ID NO: 94980 - protein, 14 aa, Borrelia burgdorferi B31
ALSNSNASRHESYY

SEQ ID NO: 94981 - protein, 14 aa, Borrelia burgdorferi B31
LSNSNASRHESYYY

SEQ ID NO: 94982 - protein, 14 aa, Borrelia burgdorferi B31
SNSNASRHESYYYA

SEQ ID NO: 94983 - protein, 14 aa, Borrelia burgdorferi B31
NSNASRHESYYYAG

SEQ ID NO: 94984 - protein, 14 aa, Borrelia burgdorferi B31
SNASRHESYYYAGY

SEQ ID NO: 94985 - protein, 14 aa, Borrelia burgdorferi B31
NASRHESYYYAGYH

SEQ ID NO: 94986 - protein, 14 aa, Borrelia burgdorferi B31
ASRHESYYYAGYHQ

SEQ ID NO: 94987 - protein, 14 aa, Borrelia burgdorferi B31
SRHESYYYAGYHQF

SEQ ID NO: 94988 - protein, 14 aa, Borrelia burgdorferi B31
RHESYYYAGYHQFM

SEQ ID NO: 94989 - protein, 14 aa, Borrelia burgdorferi B31
HESYYYAGYHQFMA

SEQ ID NO: 94990 - protein, 14 aa, Borrelia burgdorferi B31
ESYYYAGYHQFMAD

SEQ ID NO: 94991 - protein, 14 aa, Borrelia burgdorferi B31
SYYYAGYHQFMADA

SEQ ID NO: 94992 - protein, 14 aa, Borrelia burgdorferi B31
YYYAGYHQFMADAK

SEQ ID NO: 94993 - protein, 14 aa, Borrelia burgdorferi B31
YYAGYHQFMADAKA

SEQ ID NO: 94994 - protein, 14 aa, Borrelia burgdorferi B31
YAGYHQFMADAKAS

SEQ ID NO: 94995 - protein, 14 aa, Borrelia burgdorferi B31
AGYHQFMADAKASM

SEQ ID NO: 94996 - protein, 14 aa, Borrelia burgdorferi B31
GYHQFMADAKASMS

SEQ ID NO: 94997 - protein, 14 aa, Borrelia burgdorferi B31
YHQFMADAKASMSS

SEQ ID NO: 94998 - protein, 14 aa, Borrelia burgdorferi B31
HQFMADAKASMSST

SEQ ID NO: 94999 - protein, 14 aa, Borrelia burgdorferi B31
QFMADAKASMSSTK

SEQ ID NO: 95000 - protein, 14 aa, Borrelia burgdorferi B31
FMADAKASMSSTKS

SEQ ID NO: 95001 - protein, 14 aa, Borrelia burgdorferi B31
MADAKASMSSTKSL

SEQ ID NO: 95002 - protein, 14 aa, Borrelia burgdorferi B31
ADAKASMSSTKSLL

SEQ ID NO: 95003 - protein, 14 aa, Borrelia burgdorferi B31
DAKASMSSTKSLLE

SEQ ID NO: 95004 - protein, 14 aa, Borrelia burgdorferi B31
AKASMSSTKSLLEV

SEQ ID NO: 95005 - protein, 14 aa, Borrelia burgdorferi B31
KASMSSTKSLLEVA

SEQ ID NO: 95006 - protein, 14 aa, Borrelia burgdorferi B31
ASMSSTKSLLEVAK

SEQ ID NO: 95007 - protein, 14 aa, Borrelia burgdorferi B31
SMSSTKSLLEVAKN

SEQ ID NO: 95008 - protein, 14 aa, Borrelia burgdorferi B31
MSSTKSLLEVAKNK

SEQ ID NO: 95009 - protein, 14 aa, Borrelia burgdorferi B31
SSTKSLLEVAKNKQ

SEQ ID NO: 95010 - protein, 14 aa, Borrelia burgdorferi B31
STKSLLEVAKNKQK

SEQ ID NO: 95011 - protein, 14 aa, Borrelia burgdorferi B31
TKSLLEVAKNKQKE

SEQ ID NO: 95012 - protein, 14 aa, Borrelia burgdorferi B31
KSLLEVAKNKQKEL

SEQ ID NO: 95013 - protein, 14 aa, Borrelia burgdorferi B31
SLLEVAKNKQKELN

SEQ ID NO: 95014 - protein, 14 aa, Borrelia burgdorferi B31
LLEVAKNKQKELNE

SEQ ID NO: 95015 - protein, 14 aa, Borrelia burgdorferi B31
LEVAKNKQKELNEN

SEQ ID NO: 95016 - protein, 14 aa, Borrelia burgdorferi B31
EVAKNKQKELNENM

SEQ ID NO: 95017 - protein, 14 aa, Borrelia burgdorferi B31
VAKNKQKELNENMT

SEQ ID NO: 95018 - protein, 14 aa, Borrelia burgdorferi B31
AKNKQKELNENMTK

SEQ ID NO: 95019 - protein, 14 aa, Borrelia burgdorferi B31
KNKQKELNENMTKT

SEQ ID NO: 95020 - protein, 14 aa, Borrelia burgdorferi B31
NKQKELNENMTKTN

SEQ ID NO: 95021 - protein, 14 aa, Borrelia burgdorferi B31
KQKELNENMTKTNK

SEQ ID NO: 95022 - protein, 14 aa, Borrelia burgdorferi B31
QKELNENMTKTNKD

SEQ ID NO: 95023 - protein, 14 aa, Borrelia burgdorferi B31
KELNENMTKTNKDF

SEQ ID NO: 95024 - protein, 14 aa, Borrelia burgdorferi B31
ELNENMTKTNKDFQ

SEQ ID NO: 95025 - protein, 14 aa, Borrelia burgdorferi B31
LNENMTKTNKDFQE

SEQ ID NO: 95026 - protein, 14 aa, Borrelia burgdorferi B31
NENMTKTNKDFQEL

SEQ ID NO: 95027 - protein, 14 aa, Borrelia burgdorferi B31
ENMTKTNKDFQELN

SEQ ID NO: 95028 - protein, 14 aa, Borrelia burgdorferi B31
NMTKTNKDFQELND

SEQ ID NO: 95029 - protein, 14 aa, Borrelia burgdorferi B31
MTKTNKDFQELNDI

SEQ ID NO: 95030 - protein, 14 aa, Borrelia burgdorferi B31
TKTNKDFQELNDIY

SEQ ID NO: 95031 - protein, 14 aa, Borrelia burgdorferi B31
KTNKDFQELNDIYK

SEQ ID NO: 95032 - protein, 14 aa, Borrelia burgdorferi B31
TNKDFQELNDIYKK

SEQ ID NO: 95033 - protein, 14 aa, Borrelia burgdorferi B31
NKDFQELNDIYKKL

SEQ ID NO: 95034 - protein, 14 aa, Borrelia burgdorferi B31
KDFQELNDIYKKLQ

SEQ ID NO: 95035 - protein, 14 aa, Borrelia burgdorferi B31
DFQELNDIYKKLQD

SEQ ID NO: 95036 - protein, 14 aa, Borrelia burgdorferi B31
FQELNDIYKKLQDM

SEQ ID NO: 95037 - protein, 14 aa, Borrelia burgdorferi B31
QELNDIYKKLQDMD

SEQ ID NO: 95038 - protein, 14 aa, Borrelia burgdorferi B31
ELNDIYKKLQDMDS

SEQ ID NO: 95039 - protein, 14 aa, Borrelia burgdorferi B31
LNDIYKKLQDMDSR

SEQ ID NO: 95040 - protein, 15 aa, Borrelia burgdorferi B31
MNLINKLFILTILFS

SEQ ID NO: 95041 - protein, 15 aa, Borrelia burgdorferi B31
NLINKLFILTILFSS

SEQ ID NO: 95042 - protein, 15 aa, Borrelia burgdorferi B31
LINKLFILTILFSSV

SEQ ID NO: 95043 - protein, 15 aa, Borrelia burgdorferi B31
INKLFILTILFSSVI

SEQ ID NO: 95044 - protein, 15 aa, Borrelia burgdorferi B31
NKLFILTILFSSVIS

SEQ ID NO: 95045 - protein, 15 aa, Borrelia burgdorferi B31
KLFILTILFSSVISC

SEQ ID NO: 95046 - protein, 15 aa, Borrelia burgdorferi B31
LFILTILFSSVISCK

SEQ ID NO: 95047 - protein, 15 aa, Borrelia burgdorferi B31
FILTILFSSVISCKL

SEQ ID NO: 95048 - protein, 15 aa, Borrelia burgdorferi B31
ILTILFSSVISCKLY

SEQ ID NO: 95049 - protein, 15 aa, Borrelia burgdorferi B31
LTILFSSVISCKLYK

SEQ ID NO: 95050 - protein, 15 aa, Borrelia burgdorferi B31
TILFSSVISCKLYKK

SEQ ID NO: 95051 - protein, 15 aa, Borrelia burgdorferi B31
ILFSSVISCKLYKKI

SEQ ID NO: 95052 - protein, 15 aa, Borrelia burgdorferi B31
LFSSVISCKLYKKIT

SEQ ID NO: 95053 - protein, 15 aa, Borrelia burgdorferi B31
FSSVISCKLYKKITY

SEQ ID NO: 95054 - protein, 15 aa, Borrelia burgdorferi B31
SSVISCKLYKKITYN

SEQ ID NO: 95055 - protein, 15 aa, Borrelia burgdorferi B31
SVISCKLYKKITYNA

SEQ ID NO: 95056 - protein, 15 aa, Borrelia burgdorferi B31
VISCKLYKKITYNAD

SEQ ID NO: 95057 - protein, 15 aa, Borrelia burgdorferi B31
ISCKLYKKITYNADQ

SEQ ID NO: 95058 - protein, 15 aa, Borrelia burgdorferi B31
SCKLYKKITYNADQV

SEQ ID NO: 95059 - protein, 15 aa, Borrelia burgdorferi B31
CKLYKKITYNADQVI

SEQ ID NO: 95060 - protein, 15 aa, Borrelia burgdorferi B31
KLYKKITYNADQVID

SEQ ID NO: 95061 - protein, 15 aa, Borrelia burgdorferi B31
LYKKITYNADQVIDK

SEQ ID NO: 95062 - protein, 15 aa, Borrelia burgdorferi B31
YKKITYNADQVIDKL

SEQ ID NO: 95063 - protein, 15 aa, Borrelia burgdorferi B31
KKITYNADQVIDKLK

SEQ ID NO: 95064 - protein, 15 aa, Borrelia burgdorferi B31
KITYNADQVIDKLKS

SEQ ID NO: 95065 - protein, 15 aa, Borrelia burgdorferi B31
ITYNADQVIDKLKSN

SEQ ID NO: 95066 - protein, 15 aa, Borrelia burgdorferi B31
TYNADQVIDKLKSNN

SEQ ID NO: 95067 - protein, 15 aa, Borrelia burgdorferi B31
YNADQVIDKLKSNNG

SEQ ID NO: 95068 - protein, 15 aa, Borrelia burgdorferi B31
NADQVIDKLKSNNGS

SEQ ID NO: 95069 - protein, 15 aa, Borrelia burgdorferi B31
ADQVIDKLKSNNGSF

SEQ ID NO: 95070 - protein, 15 aa, Borrelia burgdorferi B31
DQVIDKLKSNNGSFN

SEQ ID NO: 95071 - protein, 15 aa, Borrelia burgdorferi B31
QVIDKLKSNNGSFNT

SEQ ID NO: 95072 - protein, 15 aa, Borrelia burgdorferi B31
VIDKLKSNNGSFNTL

SEQ ID NO: 95073 - protein, 15 aa, Borrelia burgdorferi B31
IDKLKSNNGSFNTLK

SEQ ID NO: 95074 - protein, 15 aa, Borrelia burgdorferi B31
DKLKSNNGSFNTLKS

SEQ ID NO: 95075 - protein, 15 aa, Borrelia burgdorferi B31
KLKSNNGSFNTLKSN

SEQ ID NO: 95076 - protein, 15 aa, Borrelia burgdorferi B31
LKSNNGSFNTLKSND

SEQ ID NO: 95077 - protein, 15 aa, Borrelia burgdorferi B31
KSNNGSFNTLKSNDD

SEQ ID NO: 95078 - protein, 15 aa, Borrelia burgdorferi B31
SNNGSFNTLKSNDDS

SEQ ID NO: 95079 - protein, 15 aa, Borrelia burgdorferi B31
NNGSFNTLKSNDDSK

SEQ ID NO: 95080 - protein, 15 aa, Borrelia burgdorferi B31
NGSFNTLKSNDDSKR

SEQ ID NO: 95081 - protein, 15 aa, Borrelia burgdorferi B31
GSFNTLKSNDDSKRS

SEQ ID NO: 95082 - protein, 15 aa, Borrelia burgdorferi B31
SFNTLKSNDDSKRSG

SEQ ID NO: 95083 - protein, 15 aa, Borrelia burgdorferi B31
FNTLKSNDDSKRSGR

SEQ ID NO: 95084 - protein, 15 aa, Borrelia burgdorferi B31
NTLKSNDDSKRSGRK

SEQ ID NO: 95085 - protein, 15 aa, Borrelia burgdorferi B31
TLKSNDDSKRSGRKP

SEQ ID NO: 95086 - protein, 15 aa, Borrelia burgdorferi B31
LKSNDDSKRSGRKPR

SEQ ID NO: 95087 - protein, 15 aa, Borrelia burgdorferi B31
KSNDDSKRSGRKPRS

SEQ ID NO: 95088 - protein, 15 aa, Borrelia burgdorferi B31
SNDDSKRSGRKPRSV

SEQ ID NO: 95089 - protein, 15 aa, Borrelia burgdorferi B31
NDDSKRSGRKPRSVD

SEQ ID NO: 95090 - protein, 15 aa, Borrelia burgdorferi B31
DDSKRSGRKPRSVDN

SEQ ID NO: 95091 - protein, 15 aa, Borrelia burgdorferi B31
DSKRSGRKPRSVDNT

SEQ ID NO: 95092 - protein, 15 aa, Borrelia burgdorferi B31
SKRSGRKPRSVDNTY

SEQ ID NO: 95093 - protein, 15 aa, Borrelia burgdorferi B31
KRSGRKPRSVDNTYM

SEQ ID NO: 95094 - protein, 15 aa, Borrelia burgdorferi B31
RSGRKPRSVDNTYMD

SEQ ID NO: 95095 - protein, 15 aa, Borrelia burgdorferi B31
SGRKPRSVDNTYMDQ

SEQ ID NO: 95096 - protein, 15 aa, Borrelia burgdorferi B31
GRKPRSVDNTYMDQD

SEQ ID NO: 95097 - protein, 15 aa, Borrelia burgdorferi B31
RKPRSVDNTYMDQDT

SEQ ID NO: 95098 - protein, 15 aa, Borrelia burgdorferi B31
KPRSVDNTYMDQDTG

SEQ ID NO: 95099 - protein, 15 aa, Borrelia burgdorferi B31
PRSVDNTYMDQDTGK

SEQ ID NO: 95100 - protein, 15 aa, Borrelia burgdorferi B31
RSVDNTYMDQDTGKK

SEQ ID NO: 95101 - protein, 15 aa, Borrelia burgdorferi B31
SVDNTYMDQDTGKKP

SEQ ID NO: 95102 - protein, 15 aa, Borrelia burgdorferi B31
VDNTYMDQDTGKKPL

SEQ ID NO: 95103 - protein, 15 aa, Borrelia burgdorferi B31
DNTYMDQDTGKKPLM

SEQ ID NO: 95104 - protein, 15 aa, Borrelia burgdorferi B31
NTYMDQDTGKKPLMA

SEQ ID NO: 95105 - protein, 15 aa, Borrelia burgdorferi B31
TYMDQDTGKKPLMAD

SEQ ID NO: 95106 - protein, 15 aa, Borrelia burgdorferi B31
YMDQDTGKKPLMADM

SEQ ID NO: 95107 - protein, 15 aa, Borrelia burgdorferi B31
MDQDTGKKPLMADMQ

SEQ ID NO: 95108 - protein, 15 aa, Borrelia burgdorferi B31
DQDTGKKPLMADMQP

SEQ ID NO: 95109 - protein, 15 aa, Borrelia burgdorferi B31
QDTGKKPLMADMQPD

SEQ ID NO: 95110 - protein, 15 aa, Borrelia burgdorferi B31
DTGKKPLMADMQPDM

SEQ ID NO: 95111 - protein, 15 aa, Borrelia burgdorferi B31
TGKKPLMADMQPDMQ

SEQ ID NO: 95112 - protein, 15 aa, Borrelia burgdorferi B31
GKKPLMADMQPDMQN

SEQ ID NO: 95113 - protein, 15 aa, Borrelia burgdorferi B31
KKPLMADMQPDMQND

SEQ ID NO: 95114 - protein, 15 aa, Borrelia burgdorferi B31
KPLMADMQPDMQNDN

SEQ ID NO: 95115 - protein, 15 aa, Borrelia burgdorferi B31
PLMADMQPDMQNDNS

SEQ ID NO: 95116 - protein, 15 aa, Borrelia burgdorferi B31
LMADMQPDMQNDNSS

SEQ ID NO: 95117 - protein, 15 aa, Borrelia burgdorferi B31
MADMQPDMQNDNSSS

SEQ ID NO: 95118 - protein, 15 aa, Borrelia burgdorferi B31
ADMQPDMQNDNSSSN

SEQ ID NO: 95119 - protein, 15 aa, Borrelia burgdorferi B31
DMQPDMQNDNSSSNH

SEQ ID NO: 95120 - protein, 15 aa, Borrelia burgdorferi B31
MQPDMQNDNSSSNHT

SEQ ID NO: 95121 - protein, 15 aa, Borrelia burgdorferi B31
QPDMQNDNSSSNHTL

SEQ ID NO: 95122 - protein, 15 aa, Borrelia burgdorferi B31
PDMQNDNSSSNHTLQ

SEQ ID NO: 95123 - protein, 15 aa, Borrelia burgdorferi B31
DMQNDNSSSNHTLQV

SEQ ID NO: 95124 - protein, 15 aa, Borrelia burgdorferi B31
MQNDNSSSNHTLQVN

SEQ ID NO: 95125 - protein, 15 aa, Borrelia burgdorferi B31
QNDNSSSNHTLQVNI

SEQ ID NO: 95126 - protein, 15 aa, Borrelia burgdorferi B31
NDNSSSNHTLQVNIQ

SEQ ID NO: 95127 - protein, 15 aa, Borrelia burgdorferi B31
DNSSSNHTLQVNIQD

SEQ ID NO: 95128 - protein, 15 aa, Borrelia burgdorferi B31
NSSSNHTLQVNIQDN

SEQ ID NO: 95129 - protein, 15 aa, Borrelia burgdorferi B31
SSSNHTLQVNIQDNE

SEQ ID NO: 95130 - protein, 15 aa, Borrelia burgdorferi B31
SSNHTLQVNIQDNEA

SEQ ID NO: 95131 - protein, 15 aa, Borrelia burgdorferi B31
SNHTLQVNIQDNEAS

SEQ ID NO: 95132 - protein, 15 aa, Borrelia burgdorferi B31
NHTLQVNIQDNEASE

SEQ ID NO: 95133 - protein, 15 aa, Borrelia burgdorferi B31
HTLQVNIQDNEASEA

SEQ ID NO: 95134 - protein, 15 aa, Borrelia burgdorferi B31
TLQVNIQDNEASEAR

SEQ ID NO: 95135 - protein, 15 aa, Borrelia burgdorferi B31
LQVNIQDNEASEARN

SEQ ID NO: 95136 - protein, 15 aa, Borrelia burgdorferi B31
QVNIQDNEASEARNI

SEQ ID NO: 95137 - protein, 15 aa, Borrelia burgdorferi B31
VNIQDNEASEARNIM

SEQ ID NO: 95138 - protein, 15 aa, Borrelia burgdorferi B31
NIQDNEASEARNIMT

SEQ ID NO: 95139 - protein, 15 aa, Borrelia burgdorferi B31
IQDNEASEARNIMTE

SEQ ID NO: 95140 - protein, 15 aa, Borrelia burgdorferi B31
QDNEASEARNIMTEI

SEQ ID NO: 95141 - protein, 15 aa, Borrelia burgdorferi B31
DNEASEARNIMTEIE

SEQ ID NO: 95142 - protein, 15 aa, Borrelia burgdorferi B31
NEASEARNIMTEIES

SEQ ID NO: 95143 - protein, 15 aa, Borrelia burgdorferi B31
EASEARNIMTEIESS

SEQ ID NO: 95144 - protein, 15 aa, Borrelia burgdorferi B31
ASEARNIMTEIESSK

SEQ ID NO: 95145 - protein, 15 aa, Borrelia burgdorferi B31
SEARNIMTEIESSKE

SEQ ID NO: 95146 - protein, 15 aa, Borrelia burgdorferi B31
EARNIMTEIESSKEE

SEQ ID NO: 95147 - protein, 15 aa, Borrelia burgdorferi B31
ARNIMTEIESSKEEY

SEQ ID NO: 95148 - protein, 15 aa, Borrelia burgdorferi B31
RNIMTEIESSKEEYN

SEQ ID NO: 95149 - protein, 15 aa, Borrelia burgdorferi B31
NIMTEIESSKEEYNR

SEQ ID NO: 95150 - protein, 15 aa, Borrelia burgdorferi B31
IMTEIESSKEEYNRI

SEQ ID NO: 95151 - protein, 15 aa, Borrelia burgdorferi B31
MTEIESSKEEYNRIN

SEQ ID NO: 95152 - protein, 15 aa, Borrelia burgdorferi B31
TEIESSKEEYNRINE

SEQ ID NO: 95153 - protein, 15 aa, Borrelia burgdorferi B31
EIESSKEEYNRINED

SEQ ID NO: 95154 - protein, 15 aa, Borrelia burgdorferi B31
IESSKEEYNRINEDL

SEQ ID NO: 95155 - protein, 15 aa, Borrelia burgdorferi B31
ESSKEEYNRINEDLA

SEQ ID NO: 95156 - protein, 15 aa, Borrelia burgdorferi B31
SSKEEYNRINEDLAK

SEQ ID NO: 95157 - protein, 15 aa, Borrelia burgdorferi B31
SKEEYNRINEDLAKV

SEQ ID NO: 95158 - protein, 15 aa, Borrelia burgdorferi B31
KEEYNRINEDLAKVK

SEQ ID NO: 95159 - protein, 15 aa, Borrelia burgdorferi B31
EEYNRINEDLAKVKA

SEQ ID NO: 95160 - protein, 15 aa, Borrelia burgdorferi B31
EYNRINEDLAKVKAS

SEQ ID NO: 95161 - protein, 15 aa, Borrelia burgdorferi B31
YNRINEDLAKVKASL

SEQ ID NO: 95162 - protein, 15 aa, Borrelia burgdorferi B31
NRINEDLAKVKASLD

SEQ ID NO: 95163 - protein, 15 aa, Borrelia burgdorferi B31
RINEDLAKVKASLDK

SEQ ID NO: 95164 - protein, 15 aa, Borrelia burgdorferi B31
INEDLAKVKASLDKI

SEQ ID NO: 95165 - protein, 15 aa, Borrelia burgdorferi B31
NEDLAKVKASLDKIK

SEQ ID NO: 95166 - protein, 15 aa, Borrelia burgdorferi B31
EDLAKVKASLDKIKS

SEQ ID NO: 95167 - protein, 15 aa, Borrelia burgdorferi B31
DLAKVKASLDKIKSL

SEQ ID NO: 95168 - protein, 15 aa, Borrelia burgdorferi B31
LAKVKASLDKIKSLL

SEQ ID NO: 95169 - protein, 15 aa, Borrelia burgdorferi B31
AKVKASLDKIKSLLS

SEQ ID NO: 95170 - protein, 15 aa, Borrelia burgdorferi B31
KVKASLDKIKSLLST

SEQ ID NO: 95171 - protein, 15 aa, Borrelia burgdorferi B31
VKASLDKIKSLLSTA

SEQ ID NO: 95172 - protein, 15 aa, Borrelia burgdorferi B31
KASLDKIKSLLSTAK

SEQ ID NO: 95173 - protein, 15 aa, Borrelia burgdorferi B31
ASLDKIKSLLSTAKS

SEQ ID NO: 95174 - protein, 15 aa, Borrelia burgdorferi B31
SLDKIKSLLSTAKSY

SEQ ID NO: 95175 - protein, 15 aa, Borrelia burgdorferi B31
LDKIKSLLSTAKSYL

SEQ ID NO: 95176 - protein, 15 aa, Borrelia burgdorferi B31
DKIKSLLSTAKSYLE

SEQ ID NO: 95177 - protein, 15 aa, Borrelia burgdorferi B31
KIKSLLSTAKSYLEQ

SEQ ID NO: 95178 - protein, 15 aa, Borrelia burgdorferi B31
IKSLLSTAKSYLEQT

SEQ ID NO: 95179 - protein, 15 aa, Borrelia burgdorferi B31
KSLLSTAKSYLEQTR

SEQ ID NO: 95180 - protein, 15 aa, Borrelia burgdorferi B31
SLLSTAKSYLEQTRR

SEQ ID NO: 95181 - protein, 15 aa, Borrelia burgdorferi B31
LLSTAKSYLEQTRRG

SEQ ID NO: 95182 - protein, 15 aa, Borrelia burgdorferi B31
LSTAKSYLEQTRRGV

SEQ ID NO: 95183 - protein, 15 aa, Borrelia burgdorferi B31
STAKSYLEQTRRGVG

SEQ ID NO: 95184 - protein, 15 aa, Borrelia burgdorferi B31
TAKSYLEQTRRGVGS

SEQ ID NO: 95185 - protein, 15 aa, Borrelia burgdorferi B31
AKSYLEQTRRGVGSS

SEQ ID NO: 95186 - protein, 15 aa, Borrelia burgdorferi B31
KSYLEQTRRGVGSSK

SEQ ID NO: 95187 - protein, 15 aa, Borrelia burgdorferi B31
SYLEQTRRGVGSSKA

SEQ ID NO: 95188 - protein, 15 aa, Borrelia burgdorferi B31
YLEQTRRGVGSSKAN

SEQ ID NO: 95189 - protein, 15 aa, Borrelia burgdorferi B31
LEQTRRGVGSSKANL

SEQ ID NO: 95190 - protein, 15 aa, Borrelia burgdorferi B31
EQTRRGVGSSKANLA

SEQ ID NO: 95191 - protein, 15 aa, Borrelia burgdorferi B31
QTRRGVGSSKANLAL

SEQ ID NO: 95192 - protein, 15 aa, Borrelia burgdorferi B31
TRRGVGSSKANLALL

SEQ ID NO: 95193 - protein, 15 aa, Borrelia burgdorferi B31
RRGVGSSKANLALLP

SEQ ID NO: 95194 - protein, 15 aa, Borrelia burgdorferi B31
RGVGSSKANLALLPS

SEQ ID NO: 95195 - protein, 15 aa, Borrelia burgdorferi B31
GVGSSKANLALLPSL

SEQ ID NO: 95196 - protein, 15 aa, Borrelia burgdorferi B31
VGSSKANLALLPSLE

SEQ ID NO: 95197 - protein, 15 aa, Borrelia burgdorferi B31
GSSKANLALLPSLEE

SEQ ID NO: 95198 - protein, 15 aa, Borrelia burgdorferi B31
SSKANLALLPSLEEA

SEQ ID NO: 95199 - protein, 15 aa, Borrelia burgdorferi B31
SKANLALLPSLEEAI

SEQ ID NO: 95200 - protein, 15 aa, Borrelia burgdorferi B31
KANLALLPSLEEAIA

SEQ ID NO: 95201 - protein, 15 aa, Borrelia burgdorferi B31
ANLALLPSLEEAIAK

SEQ ID NO: 95202 - protein, 15 aa, Borrelia burgdorferi B31
NLALLPSLEEAIAKV

SEQ ID NO: 95203 - protein, 15 aa, Borrelia burgdorferi B31
LALLPSLEEAIAKVK

SEQ ID NO: 95204 - protein, 15 aa, Borrelia burgdorferi B31
ALLPSLEEAIAKVKS

SEQ ID NO: 95205 - protein, 15 aa, Borrelia burgdorferi B31
LLPSLEEAIAKVKSN

SEQ ID NO: 95206 - protein, 15 aa, Borrelia burgdorferi B31
LPSLEEAIAKVKSNH

SEQ ID NO: 95207 - protein, 15 aa, Borrelia burgdorferi B31
PSLEEAIAKVKSNHA

SEQ ID NO: 95208 - protein, 15 aa, Borrelia burgdorferi B31
SLEEAIAKVKSNHAS

SEQ ID NO: 95209 - protein, 15 aa, Borrelia burgdorferi B31
LEEAIAKVKSNHASA

SEQ ID NO: 95210 - protein, 15 aa, Borrelia burgdorferi B31
EEAIAKVKSNHASAD

SEQ ID NO: 95211 - protein, 15 aa, Borrelia burgdorferi B31
EAIAKVKSNHASADT

SEQ ID NO: 95212 - protein, 15 aa, Borrelia burgdorferi B31
AIAKVKSNHASADTH

SEQ ID NO: 95213 - protein, 15 aa, Borrelia burgdorferi B31
IAKVKSNHASADTHC

SEQ ID NO: 95214 - protein, 15 aa, Borrelia burgdorferi B31
AKVKSNHASADTHCN

SEQ ID NO: 95215 - protein, 15 aa, Borrelia burgdorferi B31
KVKSNHASADTHCND

SEQ ID NO: 95216 - protein, 15 aa, Borrelia burgdorferi B31
VKSNHASADTHCNDA

SEQ ID NO: 95217 - protein, 15 aa, Borrelia burgdorferi B31
KSNHASADTHCNDAI

SEQ ID NO: 95218 - protein, 15 aa, Borrelia burgdorferi B31
SNHASADTHCNDAIA

SEQ ID NO: 95219 - protein, 15 aa, Borrelia burgdorferi B31
NHASADTHCNDAIAA

SEQ ID NO: 95220 - protein, 15 aa, Borrelia burgdorferi B31
HASADTHCNDAIAAL

SEQ ID NO: 95221 - protein, 15 aa, Borrelia burgdorferi B31
ASADTHCNDAIAALK

SEQ ID NO: 95222 - protein, 15 aa, Borrelia burgdorferi B31
SADTHCNDAIAALKR

SEQ ID NO: 95223 - protein, 15 aa, Borrelia burgdorferi B31
ADTHCNDAIAALKRA

SEQ ID NO: 95224 - protein, 15 aa, Borrelia burgdorferi B31
DTHCNDAIAALKRAK

SEQ ID NO: 95225 - protein, 15 aa, Borrelia burgdorferi B31
THCNDAIAALKRAKN

SEQ ID NO: 95226 - protein, 15 aa, Borrelia burgdorferi B31
HCNDAIAALKRAKND

SEQ ID NO: 95227 - protein, 15 aa, Borrelia burgdorferi B31
CNDAIAALKRAKNDF

SEQ ID NO: 95228 - protein, 15 aa, Borrelia burgdorferi B31
NDAIAALKRAKNDFE

SEQ ID NO: 95229 - protein, 15 aa, Borrelia burgdorferi B31
DAIAALKRAKNDFEY

SEQ ID NO: 95230 - protein, 15 aa, Borrelia burgdorferi B31
AIAALKRAKNDFEYA

SEQ ID NO: 95231 - protein, 15 aa, Borrelia burgdorferi B31
IAALKRAKNDFEYAQ

SEQ ID NO: 95232 - protein, 15 aa, Borrelia burgdorferi B31
AALKRAKNDFEYAQR

SEQ ID NO: 95233 - protein, 15 aa, Borrelia burgdorferi B31
ALKRAKNDFEYAQRK

SEQ ID NO: 95234 - protein, 15 aa, Borrelia burgdorferi B31
LKRAKNDFEYAQRKA

SEQ ID NO: 95235 - protein, 15 aa, Borrelia burgdorferi B31
KRAKNDFEYAQRKAD

SEQ ID NO: 95236 - protein, 15 aa, Borrelia burgdorferi B31
RAKNDFEYAQRKADR

SEQ ID NO: 95237 - protein, 15 aa, Borrelia burgdorferi B31
AKNDFEYAQRKADRA

SEQ ID NO: 95238 - protein, 15 aa, Borrelia burgdorferi B31
KNDFEYAQRKADRAL

SEQ ID NO: 95239 - protein, 15 aa, Borrelia burgdorferi B31
NDFEYAQRKADRALE

SEQ ID NO: 95240 - protein, 15 aa, Borrelia burgdorferi B31
DFEYAQRKADRALEE

SEQ ID NO: 95241 - protein, 15 aa, Borrelia burgdorferi B31
FEYAQRKADRALEEA

SEQ ID NO: 95242 - protein, 15 aa, Borrelia burgdorferi B31
EYAQRKADRALEEAL

SEQ ID NO: 95243 - protein, 15 aa, Borrelia burgdorferi B31
YAQRKADRALEEALS

SEQ ID NO: 95244 - protein, 15 aa, Borrelia burgdorferi B31
AQRKADRALEEALSN

SEQ ID NO: 95245 - protein, 15 aa, Borrelia burgdorferi B31
QRKADRALEEALSNS

SEQ ID NO: 95246 - protein, 15 aa, Borrelia burgdorferi B31
RKADRALEEALSNSN

SEQ ID NO: 95247 - protein, 15 aa, Borrelia burgdorferi B31
KADRALEEALSNSNA

SEQ ID NO: 95248 - protein, 15 aa, Borrelia burgdorferi B31
ADRALEEALSNSNAS

SEQ ID NO: 95249 - protein, 15 aa, Borrelia burgdorferi B31
DRALEEALSNSNASR

SEQ ID NO: 95250 - protein, 15 aa, Borrelia burgdorferi B31
RALEEALSNSNASRH

SEQ ID NO: 95251 - protein, 15 aa, Borrelia burgdorferi B31
ALEEALSNSNASRHE

SEQ ID NO: 95252 - protein, 15 aa, Borrelia burgdorferi B31
LEEALSNSNASRHES

SEQ ID NO: 95253 - protein, 15 aa, Borrelia burgdorferi B31
EEALSNSNASRHESY

SEQ ID NO: 95254 - protein, 15 aa, Borrelia burgdorferi B31
EALSNSNASRHESYY

SEQ ID NO: 95255 - protein, 15 aa, Borrelia burgdorferi B31
ALSNSNASRHESYYY

SEQ ID NO: 95256 - protein, 15 aa, Borrelia burgdorferi B31
LSNSNASRHESYYYA

SEQ ID NO: 95257 - protein, 15 aa, Borrelia burgdorferi B31
SNSNASRHESYYYAG

SEQ ID NO: 95258 - protein, 15 aa, Borrelia burgdorferi B31
NSNASRHESYYYAGY

SEQ ID NO: 95259 - protein, 15 aa, Borrelia burgdorferi B31
SNASRHESYYYAGYH

SEQ ID NO: 95260 - protein, 15 aa, Borrelia burgdorferi B31
NASRHESYYYAGYHQ

SEQ ID NO: 95261 - protein, 15 aa, Borrelia burgdorferi B31
ASRHESYYYAGYHQF

SEQ ID NO: 95262 - protein, 15 aa, Borrelia burgdorferi B31
SRHESYYYAGYHQFM

SEQ ID NO: 95263 - protein, 15 aa, Borrelia burgdorferi B31
RHESYYYAGYHQFMA

SEQ ID NO: 95264 - protein, 15 aa, Borrelia burgdorferi B31
HESYYYAGYHQFMAD

SEQ ID NO: 95265 - protein, 15 aa, Borrelia burgdorferi B31
ESYYYAGYHQFMADA

SEQ ID NO: 95266 - protein, 15 aa, Borrelia burgdorferi B31
SYYYAGYHQFMADAK

SEQ ID NO: 95267 - protein, 15 aa, Borrelia burgdorferi B31
YYYAGYHQFMADAKA

SEQ ID NO: 95268 - protein, 15 aa, Borrelia burgdorferi B31
YYAGYHQFMADAKAS

SEQ ID NO: 95269 - protein, 15 aa, Borrelia burgdorferi B31
YAGYHQFMADAKASM

SEQ ID NO: 95270 - protein, 15 aa, Borrelia burgdorferi B31
AGYHQFMADAKASMS

SEQ ID NO: 95271 - protein, 15 aa, Borrelia burgdorferi B31
GYHQFMADAKASMSS

SEQ ID NO: 95272 - protein, 15 aa, Borrelia burgdorferi B31
YHQFMADAKASMSST

SEQ ID NO: 95273 - protein, 15 aa, Borrelia burgdorferi B31
HQFMADAKASMSSTK

SEQ ID NO: 95274 - protein, 15 aa, Borrelia burgdorferi B31
QFMADAKASMSSTKS

SEQ ID NO: 95275 - protein, 15 aa, Borrelia burgdorferi B31
FMADAKASMSSTKSL

SEQ ID NO: 95276 - protein, 15 aa, Borrelia burgdorferi B31
MADAKASMSSTKSLL

SEQ ID NO: 95277 - protein, 15 aa, Borrelia burgdorferi B31
ADAKASMSSTKSLLE

SEQ ID NO: 95278 - protein, 15 aa, Borrelia burgdorferi B31
DAKASMSSTKSLLEV

SEQ ID NO: 95279 - protein, 15 aa, Borrelia burgdorferi B31
AKASMSSTKSLLEVA

SEQ ID NO: 95280 - protein, 15 aa, Borrelia burgdorferi B31
KASMSSTKSLLEVAK

SEQ ID NO: 95281 - protein, 15 aa, Borrelia burgdorferi B31
ASMSSTKSLLEVAKN

SEQ ID NO: 95282 - protein, 15 aa, Borrelia burgdorferi B31
SMSSTKSLLEVAKNK

SEQ ID NO: 95283 - protein, 15 aa, Borrelia burgdorferi B31
MSSTKSLLEVAKNKQ

SEQ ID NO: 95284 - protein, 15 aa, Borrelia burgdorferi B31
SSTKSLLEVAKNKQK

SEQ ID NO: 95285 - protein, 15 aa, Borrelia burgdorferi B31
STKSLLEVAKNKQKE

SEQ ID NO: 95286 - protein, 15 aa, Borrelia burgdorferi B31
TKSLLEVAKNKQKEL

SEQ ID NO: 95287 - protein, 15 aa, Borrelia burgdorferi B31
KSLLEVAKNKQKELN

SEQ ID NO: 95288 - protein, 15 aa, Borrelia burgdorferi B31
SLLEVAKNKQKELNE

SEQ ID NO: 95289 - protein, 15 aa, Borrelia burgdorferi B31
LLEVAKNKQKELNEN

SEQ ID NO: 95290 - protein, 15 aa, Borrelia burgdorferi B31
LEVAKNKQKELNENM

SEQ ID NO: 95291 - protein, 15 aa, Borrelia burgdorferi B31
EVAKNKQKELNENMT

SEQ ID NO: 95292 - protein, 15 aa, Borrelia burgdorferi B31
VAKNKQKELNENMTK

SEQ ID NO: 95293 - protein, 15 aa, Borrelia burgdorferi B31
AKNKQKELNENMTKT

SEQ ID NO: 95294 - protein, 15 aa, Borrelia burgdorferi B31
KNKQKELNENMTKTN

SEQ ID NO: 95295 - protein, 15 aa, Borrelia burgdorferi B31
NKQKELNENMTKTNK

SEQ ID NO: 95296 - protein, 15 aa, Borrelia burgdorferi B31
KQKELNENMTKTNKD

SEQ ID NO: 95297 - protein, 15 aa, Borrelia burgdorferi B31
QKELNENMTKTNKDF

SEQ ID NO: 95298 - protein, 15 aa, Borrelia burgdorferi B31
KELNENMTKTNKDFQ

SEQ ID NO: 95299 - protein, 15 aa, Borrelia burgdorferi B31
ELNENMTKTNKDFQE

SEQ ID NO: 95300 - protein, 15 aa, Borrelia burgdorferi B31
LNENMTKTNKDFQEL

SEQ ID NO: 95301 - protein, 15 aa, Borrelia burgdorferi B31
NENMTKTNKDFQELN

SEQ ID NO: 95302 - protein, 15 aa, Borrelia burgdorferi B31
ENMTKTNKDFQELND

SEQ ID NO: 95303 - protein, 15 aa, Borrelia burgdorferi B31
NMTKTNKDFQELNDI

SEQ ID NO: 95304 - protein, 15 aa, Borrelia burgdorferi B31
MTKTNKDFQELNDIY

SEQ ID NO: 95305 - protein, 15 aa, Borrelia burgdorferi B31
TKTNKDFQELNDIYK

SEQ ID NO: 95306 - protein, 15 aa, Borrelia burgdorferi B31
KTNKDFQELNDIYKK

SEQ ID NO: 95307 - protein, 15 aa, Borrelia burgdorferi B31
TNKDFQELNDIYKKL

SEQ ID NO: 95308 - protein, 15 aa, Borrelia burgdorferi B31
NKDFQELNDIYKKLQ

SEQ ID NO: 95309 - protein, 15 aa, Borrelia burgdorferi B31
KDFQELNDIYKKLQD

SEQ ID NO: 95310 - protein, 15 aa, Borrelia burgdorferi B31
DFQELNDIYKKLQDM

SEQ ID NO: 95311 - protein, 15 aa, Borrelia burgdorferi B31
FQELNDIYKKLQDMD

SEQ ID NO: 95312 - protein, 15 aa, Borrelia burgdorferi B31
QELNDIYKKLQDMDS

SEQ ID NO: 95313 - protein, 15 aa, Borrelia burgdorferi B31
ELNDIYKKLQDMDSR

SEQ ID NO: 95314 - protein, 16 aa, Borrelia burgdorferi B31
MNLINKLFILTILFSS

SEQ ID NO: 95315 - protein, 16 aa, Borrelia burgdorferi B31
NLINKLFILTILFSSV

SEQ ID NO: 95316 - protein, 16 aa, Borrelia burgdorferi B31
LINKLFILTILFSSVI

SEQ ID NO: 95317 - protein, 16 aa, Borrelia burgdorferi B31
INKLFILTILFSSVIS

SEQ ID NO: 95318 - protein, 16 aa, Borrelia burgdorferi B31
NKLFILTILFSSVISC

SEQ ID NO: 95319 - protein, 16 aa, Borrelia burgdorferi B31
KLFILTILFSSVISCK

SEQ ID NO: 95320 - protein, 16 aa, Borrelia burgdorferi B31
LFILTILFSSVISCKL

SEQ ID NO: 95321 - protein, 16 aa, Borrelia burgdorferi B31
FILTILFSSVISCKLY

SEQ ID NO: 95322 - protein, 16 aa, Borrelia burgdorferi B31
ILTILFSSVISCKLYK

SEQ ID NO: 95323 - protein, 16 aa, Borrelia burgdorferi B31
LTILFSSVISCKLYKK

SEQ ID NO: 95324 - protein, 16 aa, Borrelia burgdorferi B31
TILFSSVISCKLYKKI

SEQ ID NO: 95325 - protein, 16 aa, Borrelia burgdorferi B31
ILFSSVISCKLYKKIT

SEQ ID NO: 95326 - protein, 16 aa, Borrelia burgdorferi B31
LFSSVISCKLYKKITY

SEQ ID NO: 95327 - protein, 16 aa, Borrelia burgdorferi B31
FSSVISCKLYKKITYN

SEQ ID NO: 95328 - protein, 16 aa, Borrelia burgdorferi B31
SSVISCKLYKKITYNA

SEQ ID NO: 95329 - protein, 16 aa, Borrelia burgdorferi B31
SVISCKLYKKITYNAD

SEQ ID NO: 95330 - protein, 16 aa, Borrelia burgdorferi B31
VISCKLYKKITYNADQ

SEQ ID NO: 95331 - protein, 16 aa, Borrelia burgdorferi B31
ISCKLYKKITYNADQV

SEQ ID NO: 95332 - protein, 16 aa, Borrelia burgdorferi B31
SCKLYKKITYNADQVI

SEQ ID NO: 95333 - protein, 16 aa, Borrelia burgdorferi B31
CKLYKKITYNADQVID

SEQ ID NO: 95334 - protein, 16 aa, Borrelia burgdorferi B31
KLYKKITYNADQVIDK

SEQ ID NO: 95335 - protein, 16 aa, Borrelia burgdorferi B31
LYKKITYNADQVIDKL

SEQ ID NO: 95336 - protein, 16 aa, Borrelia burgdorferi B31
YKKITYNADQVIDKLK

SEQ ID NO: 95337 - protein, 16 aa, Borrelia burgdorferi B31
KKITYNADQVIDKLKS

SEQ ID NO: 95338 - protein, 16 aa, Borrelia burgdorferi B31
KITYNADQVIDKLKSN

SEQ ID NO: 95339 - protein, 16 aa, Borrelia burgdorferi B31
ITYNADQVIDKLKSNN

SEQ ID NO: 95340 - protein, 16 aa, Borrelia burgdorferi B31
TYNADQVIDKLKSNNG

SEQ ID NO: 95341 - protein, 16 aa, Borrelia burgdorferi B31
YNADQVIDKLKSNNGS

SEQ ID NO: 95342 - protein, 16 aa, Borrelia burgdorferi B31
NADQVIDKLKSNNGSF

SEQ ID NO: 95343 - protein, 16 aa, Borrelia burgdorferi B31
ADQVIDKLKSNNGSFN

SEQ ID NO: 95344 - protein, 16 aa, Borrelia burgdorferi B31
DQVIDKLKSNNGSFNT

SEQ ID NO: 95345 - protein, 16 aa, Borrelia burgdorferi B31
QVIDKLKSNNGSFNTL

SEQ ID NO: 95346 - protein, 16 aa, Borrelia burgdorferi B31
VIDKLKSNNGSFNTLK

SEQ ID NO: 95347 - protein, 16 aa, Borrelia burgdorferi B31
IDKLKSNNGSFNTLKS

SEQ ID NO: 95348 - protein, 16 aa, Borrelia burgdorferi B31
DKLKSNNGSFNTLKSN

SEQ ID NO: 95349 - protein, 16 aa, Borrelia burgdorferi B31
KLKSNNGSFNTLKSND

SEQ ID NO: 95350 - protein, 16 aa, Borrelia burgdorferi B31
LKSNNGSFNTLKSNDD

SEQ ID NO: 95351 - protein, 16 aa, Borrelia burgdorferi B31
KSNNGSFNTLKSNDDS

SEQ ID NO: 95352 - protein, 16 aa, Borrelia burgdorferi B31
SNNGSFNTLKSNDDSK

SEQ ID NO: 95353 - protein, 16 aa, Borrelia burgdorferi B31
NNGSFNTLKSNDDSKR

SEQ ID NO: 95354 - protein, 16 aa, Borrelia burgdorferi B31
NGSFNTLKSNDDSKRS

SEQ ID NO: 95355 - protein, 16 aa, Borrelia burgdorferi B31
GSFNTLKSNDDSKRSG

SEQ ID NO: 95356 - protein, 16 aa, Borrelia burgdorferi B31
SFNTLKSNDDSKRSGR

SEQ ID NO: 95357 - protein, 16 aa, Borrelia burgdorferi B31
FNTLKSNDDSKRSGRK

SEQ ID NO: 95358 - protein, 16 aa, Borrelia burgdorferi B31
NTLKSNDDSKRSGRKP

SEQ ID NO: 95359 - protein, 16 aa, Borrelia burgdorferi B31
TLKSNDDSKRSGRKPR

SEQ ID NO: 95360 - protein, 16 aa, Borrelia burgdorferi B31
LKSNDDSKRSGRKPRS

SEQ ID NO: 95361 - protein, 16 aa, Borrelia burgdorferi B31
KSNDDSKRSGRKPRSV

SEQ ID NO: 95362 - protein, 16 aa, Borrelia burgdorferi B31
SNDDSKRSGRKPRSVD

SEQ ID NO: 95363 - protein, 16 aa, Borrelia burgdorferi B31
NDDSKRSGRKPRSVDN

SEQ ID NO: 95364 - protein, 16 aa, Borrelia burgdorferi B31
DDSKRSGRKPRSVDNT

SEQ ID NO: 95365 - protein, 16 aa, Borrelia burgdorferi B31
DSKRSGRKPRSVDNTY

SEQ ID NO: 95366 - protein, 16 aa, Borrelia burgdorferi B31
SKRSGRKPRSVDNTYM

SEQ ID NO: 95367 - protein, 16 aa, Borrelia burgdorferi B31
KRSGRKPRSVDNTYMD

SEQ ID NO: 95368 - protein, 16 aa, Borrelia burgdorferi B31
RSGRKPRSVDNTYMDQ

SEQ ID NO: 95369 - protein, 16 aa, Borrelia burgdorferi B31
SGRKPRSVDNTYMDQD

SEQ ID NO: 95370 - protein, 16 aa, Borrelia burgdorferi B31
GRKPRSVDNTYMDQDT

SEQ ID NO: 95371 - protein, 16 aa, Borrelia burgdorferi B31
RKPRSVDNTYMDQDTG

SEQ ID NO: 95372 - protein, 16 aa, Borrelia burgdorferi B31
KPRSVDNTYMDQDTGK

SEQ ID NO: 95373 - protein, 16 aa, Borrelia burgdorferi B31
PRSVDNTYMDQDTGKK

SEQ ID NO: 95374 - protein, 16 aa, Borrelia burgdorferi B31
RSVDNTYMDQDTGKKP

SEQ ID NO: 95375 - protein, 16 aa, Borrelia burgdorferi B31
SVDNTYMDQDTGKKPL

SEQ ID NO: 95376 - protein, 16 aa, Borrelia burgdorferi B31
VDNTYMDQDTGKKPLM

SEQ ID NO: 95377 - protein, 16 aa, Borrelia burgdorferi B31
DNTYMDQDTGKKPLMA

SEQ ID NO: 95378 - protein, 16 aa, Borrelia burgdorferi B31
NTYMDQDTGKKPLMAD

SEQ ID NO: 95379 - protein, 16 aa, Borrelia burgdorferi B31
TYMDQDTGKKPLMADM

SEQ ID NO: 95380 - protein, 16 aa, Borrelia burgdorferi B31
YMDQDTGKKPLMADMQ

SEQ ID NO: 95381 - protein, 16 aa, Borrelia burgdorferi B31
MDQDTGKKPLMADMQP

SEQ ID NO: 95382 - protein, 16 aa, Borrelia burgdorferi B31
DQDTGKKPLMADMQPD

SEQ ID NO: 95383 - protein, 16 aa, Borrelia burgdorferi B31
QDTGKKPLMADMQPDM

SEQ ID NO: 95384 - protein, 16 aa, Borrelia burgdorferi B31
DTGKKPLMADMQPDMQ

SEQ ID NO: 95385 - protein, 16 aa, Borrelia burgdorferi B31
TGKKPLMADMQPDMQN

SEQ ID NO: 95386 - protein, 16 aa, Borrelia burgdorferi B31
GKKPLMADMQPDMQND

SEQ ID NO: 95387 - protein, 16 aa, Borrelia burgdorferi B31
KKPLMADMQPDMQNDN

SEQ ID NO: 95388 - protein, 16 aa, Borrelia burgdorferi B31
KPLMADMQPDMQNDNS

SEQ ID NO: 95389 - protein, 16 aa, Borrelia burgdorferi B31
PLMADMQPDMQNDNSS

SEQ ID NO: 95390 - protein, 16 aa, Borrelia burgdorferi B31
LMADMQPDMQNDNSSS

SEQ ID NO: 95391 - protein, 16 aa, Borrelia burgdorferi B31
MADMQPDMQNDNSSSN

SEQ ID NO: 95392 - protein, 16 aa, Borrelia burgdorferi B31
ADMQPDMQNDNSSSNH

SEQ ID NO: 95393 - protein, 16 aa, Borrelia burgdorferi B31
DMQPDMQNDNSSSNHT

SEQ ID NO: 95394 - protein, 16 aa, Borrelia burgdorferi B31
MQPDMQNDNSSSNHTL

SEQ ID NO: 95395 - protein, 16 aa, Borrelia burgdorferi B31
QPDMQNDNSSSNHTLQ

SEQ ID NO: 95396 - protein, 16 aa, Borrelia burgdorferi B31
PDMQNDNSSSNHTLQV

SEQ ID NO: 95397 - protein, 16 aa, Borrelia burgdorferi B31
DMQNDNSSSNHTLQVN

SEQ ID NO: 95398 - protein, 16 aa, Borrelia burgdorferi B31
MQNDNSSSNHTLQVNI

SEQ ID NO: 95399 - protein, 16 aa, Borrelia burgdorferi B31
QNDNSSSNHTLQVNIQ

SEQ ID NO: 95400 - protein, 16 aa, Borrelia burgdorferi B31
NDNSSSNHTLQVNIQD

SEQ ID NO: 95401 - protein, 16 aa, Borrelia burgdorferi B31
DNSSSNHTLQVNIQDN

SEQ ID NO: 95402 - protein, 16 aa, Borrelia burgdorferi B31
NSSSNHTLQVNIQDNE

SEQ ID NO: 95403 - protein, 16 aa, Borrelia burgdorferi B31
SSSNHTLQVNIQDNEA

SEQ ID NO: 95404 - protein, 16 aa, Borrelia burgdorferi B31
SSNHTLQVNIQDNEAS

SEQ ID NO: 95405 - protein, 16 aa, Borrelia burgdorferi B31
SNHTLQVNIQDNEASE

SEQ ID NO: 95406 - protein, 16 aa, Borrelia burgdorferi B31
NHTLQVNIQDNEASEA

SEQ ID NO: 95407 - protein, 16 aa, Borrelia burgdorferi B31
HTLQVNIQDNEASEAR

SEQ ID NO: 95408 - protein, 16 aa, Borrelia burgdorferi B31
TLQVNIQDNEASEARN

SEQ ID NO: 95409 - protein, 16 aa, Borrelia burgdorferi B31
LQVNIQDNEASEARNI

SEQ ID NO: 95410 - protein, 16 aa, Borrelia burgdorferi B31
QVNIQDNEASEARNIM

SEQ ID NO: 95411 - protein, 16 aa, Borrelia burgdorferi B31
VNIQDNEASEARNIMT

SEQ ID NO: 95412 - protein, 16 aa, Borrelia burgdorferi B31
NIQDNEASEARNIMTE

SEQ ID NO: 95413 - protein, 16 aa, Borrelia burgdorferi B31
IQDNEASEARNIMTEI

SEQ ID NO: 95414 - protein, 16 aa, Borrelia burgdorferi B31
QDNEASEARNIMTEIE

SEQ ID NO: 95415 - protein, 16 aa, Borrelia burgdorferi B31
DNEASEARNIMTEIES

SEQ ID NO: 95416 - protein, 16 aa, Borrelia burgdorferi B31
NEASEARNIMTEIESS

SEQ ID NO: 95417 - protein, 16 aa, Borrelia burgdorferi B31
EASEARNIMTEIESSK

SEQ ID NO: 95418 - protein, 16 aa, Borrelia burgdorferi B31
ASEARNIMTEIESSKE

SEQ ID NO: 95419 - protein, 16 aa, Borrelia burgdorferi B31
SEARNIMTEIESSKEE

SEQ ID NO: 95420 - protein, 16 aa, Borrelia burgdorferi B31
EARNIMTEIESSKEEY

SEQ ID NO: 95421 - protein, 16 aa, Borrelia burgdorferi B31
ARNIMTEIESSKEEYN

SEQ ID NO: 95422 - protein, 16 aa, Borrelia burgdorferi B31
RNIMTEIESSKEEYNR

SEQ ID NO: 95423 - protein, 16 aa, Borrelia burgdorferi B31
NIMTEIESSKEEYNRI

SEQ ID NO: 95424 - protein, 16 aa, Borrelia burgdorferi B31
IMTEIESSKEEYNRIN

SEQ ID NO: 95425 - protein, 16 aa, Borrelia burgdorferi B31
MTEIESSKEEYNRINE

SEQ ID NO: 95426 - protein, 16 aa, Borrelia burgdorferi B31
TEIESSKEEYNRINED

SEQ ID NO: 95427 - protein, 16 aa, Borrelia burgdorferi B31
EIESSKEEYNRINEDL

SEQ ID NO: 95428 - protein, 16 aa, Borrelia burgdorferi B31
IESSKEEYNRINEDLA

SEQ ID NO: 95429 - protein, 16 aa, Borrelia burgdorferi B31
ESSKEEYNRINEDLAK

SEQ ID NO: 95430 - protein, 16 aa, Borrelia burgdorferi B31
SSKEEYNRINEDLAKV

SEQ ID NO: 95431 - protein, 16 aa, Borrelia burgdorferi B31
SKEEYNRINEDLAKVK

SEQ ID NO: 95432 - protein, 16 aa, Borrelia burgdorferi B31
KEEYNRINEDLAKVKA

SEQ ID NO: 95433 - protein, 16 aa, Borrelia burgdorferi B31
EEYNRINEDLAKVKAS

SEQ ID NO: 95434 - protein, 16 aa, Borrelia burgdorferi B31
EYNRINEDLAKVKASL

SEQ ID NO: 95435 - protein, 16 aa, Borrelia burgdorferi B31
YNRINEDLAKVKASLD

SEQ ID NO: 95436 - protein, 16 aa, Borrelia burgdorferi B31
NRINEDLAKVKASLDK

SEQ ID NO: 95437 - protein, 16 aa, Borrelia burgdorferi B31
RINEDLAKVKASLDKI

SEQ ID NO: 95438 - protein, 16 aa, Borrelia burgdorferi B31
INEDLAKVKASLDKIK

SEQ ID NO: 95439 - protein, 16 aa, Borrelia burgdorferi B31
NEDLAKVKASLDKIKS

SEQ ID NO: 95440 - protein, 16 aa, Borrelia burgdorferi B31
EDLAKVKASLDKIKSL

SEQ ID NO: 95441 - protein, 16 aa, Borrelia burgdorferi B31
DLAKVKASLDKIKSLL

SEQ ID NO: 95442 - protein, 16 aa, Borrelia burgdorferi B31
LAKVKASLDKIKSLLS

SEQ ID NO: 95443 - protein, 16 aa, Borrelia burgdorferi B31
AKVKASLDKIKSLLST

SEQ ID NO: 95444 - protein, 16 aa, Borrelia burgdorferi B31
KVKASLDKIKSLLSTA

SEQ ID NO: 95445 - protein, 16 aa, Borrelia burgdorferi B31
VKASLDKIKSLLSTAK

SEQ ID NO: 95446 - protein, 16 aa, Borrelia burgdorferi B31
KASLDKIKSLLSTAKS

SEQ ID NO: 95447 - protein, 16 aa, Borrelia burgdorferi B31
ASLDKIKSLLSTAKSY

SEQ ID NO: 95448 - protein, 16 aa, Borrelia burgdorferi B31
SLDKIKSLLSTAKSYL

SEQ ID NO: 95449 - protein, 16 aa, Borrelia burgdorferi B31
LDKIKSLLSTAKSYLE

SEQ ID NO: 95450 - protein, 16 aa, Borrelia burgdorferi B31
DKIKSLLSTAKSYLEQ

SEQ ID NO: 95451 - protein, 16 aa, Borrelia burgdorferi B31
KIKSLLSTAKSYLEQT

SEQ ID NO: 95452 - protein, 16 aa, Borrelia burgdorferi B31
IKSLLSTAKSYLEQTR

SEQ ID NO: 95453 - protein, 16 aa, Borrelia burgdorferi B31
KSLLSTAKSYLEQTRR

SEQ ID NO: 95454 - protein, 16 aa, Borrelia burgdorferi B31
SLLSTAKSYLEQTRRG

SEQ ID NO: 95455 - protein, 16 aa, Borrelia burgdorferi B31
LLSTAKSYLEQTRRGV

SEQ ID NO: 95456 - protein, 16 aa, Borrelia burgdorferi B31
LSTAKSYLEQTRRGVG

SEQ ID NO: 95457 - protein, 16 aa, Borrelia burgdorferi B31
STAKSYLEQTRRGVGS

SEQ ID NO: 95458 - protein, 16 aa, Borrelia burgdorferi B31
TAKSYLEQTRRGVGSS

SEQ ID NO: 95459 - protein, 16 aa, Borrelia burgdorferi B31
AKSYLEQTRRGVGSSK

SEQ ID NO: 95460 - protein, 16 aa, Borrelia burgdorferi B31
KSYLEQTRRGVGSSKA

SEQ ID NO: 95461 - protein, 16 aa, Borrelia burgdorferi B31
SYLEQTRRGVGSSKAN

SEQ ID NO: 95462 - protein, 16 aa, Borrelia burgdorferi B31
YLEQTRRGVGSSKANL

SEQ ID NO: 95463 - protein, 16 aa, Borrelia burgdorferi B31
LEQTRRGVGSSKANLA

SEQ ID NO: 95464 - protein, 16 aa, Borrelia burgdorferi B31
EQTRRGVGSSKANLAL

SEQ ID NO: 95465 - protein, 16 aa, Borrelia burgdorferi B31
QTRRGVGSSKANLALL

SEQ ID NO: 95466 - protein, 16 aa, Borrelia burgdorferi B31
TRRGVGSSKANLALLP

SEQ ID NO: 95467 - protein, 16 aa, Borrelia burgdorferi B31
RRGVGSSKANLALLPS

SEQ ID NO: 95468 - protein, 16 aa, Borrelia burgdorferi B31
RGVGSSKANLALLPSL

SEQ ID NO: 95469 - protein, 16 aa, Borrelia burgdorferi B31
GVGSSKANLALLPSLE

SEQ ID NO: 95470 - protein, 16 aa, Borrelia burgdorferi B31
VGSSKANLALLPSLEE

SEQ ID NO: 95471 - protein, 16 aa, Borrelia burgdorferi B31
GSSKANLALLPSLEEA

SEQ ID NO: 95472 - protein, 16 aa, Borrelia burgdorferi B31
SSKANLALLPSLEEAI

SEQ ID NO: 95473 - protein, 16 aa, Borrelia burgdorferi B31
SKANLALLPSLEEAIA

SEQ ID NO: 95474 - protein, 16 aa, Borrelia burgdorferi B31
KANLALLPSLEEAIAK

SEQ ID NO: 95475 - protein, 16 aa, Borrelia burgdorferi B31
ANLALLPSLEEAIAKV

SEQ ID NO: 95476 - protein, 16 aa, Borrelia burgdorferi B31
NLALLPSLEEAIAKVK

SEQ ID NO: 95477 - protein, 16 aa, Borrelia burgdorferi B31
LALLPSLEEAIAKVKS

SEQ ID NO: 95478 - protein, 16 aa, Borrelia burgdorferi B31
ALLPSLEEAIAKVKSN

SEQ ID NO: 95479 - protein, 16 aa, Borrelia burgdorferi B31
LLPSLEEAIAKVKSNH

SEQ ID NO: 95480 - protein, 16 aa, Borrelia burgdorferi B31
LPSLEEAIAKVKSNHA

SEQ ID NO: 95481 - protein, 16 aa, Borrelia burgdorferi B31
PSLEEAIAKVKSNHAS

SEQ ID NO: 95482 - protein, 16 aa, Borrelia burgdorferi B31
SLEEAIAKVKSNHASA

SEQ ID NO: 95483 - protein, 16 aa, Borrelia burgdorferi B31
LEEAIAKVKSNHASAD

SEQ ID NO: 95484 - protein, 16 aa, Borrelia burgdorferi B31
EEAIAKVKSNHASADT

SEQ ID NO: 95485 - protein, 16 aa, Borrelia burgdorferi B31
EAIAKVKSNHASADTH

SEQ ID NO: 95486 - protein, 16 aa, Borrelia burgdorferi B31
AIAKVKSNHASADTHC

SEQ ID NO: 95487 - protein, 16 aa, Borrelia burgdorferi B31
IAKVKSNHASADTHCN

SEQ ID NO: 95488 - protein, 16 aa, Borrelia burgdorferi B31
AKVKSNHASADTHCND

SEQ ID NO: 95489 - protein, 16 aa, Borrelia burgdorferi B31
KVKSNHASADTHCNDA

SEQ ID NO: 95490 - protein, 16 aa, Borrelia burgdorferi B31
VKSNHASADTHCNDAI

SEQ ID NO: 95491 - protein, 16 aa, Borrelia burgdorferi B31
KSNHASADTHCNDAIA

SEQ ID NO: 95492 - protein, 16 aa, Borrelia burgdorferi B31
SNHASADTHCNDAIAA

SEQ ID NO: 95493 - protein, 16 aa, Borrelia burgdorferi B31
NHASADTHCNDAIAAL

SEQ ID NO: 95494 - protein, 16 aa, Borrelia burgdorferi B31
HASADTHCNDAIAALK

SEQ ID NO: 95495 - protein, 16 aa, Borrelia burgdorferi B31
ASADTHCNDAIAALKR

SEQ ID NO: 95496 - protein, 16 aa, Borrelia burgdorferi B31
SADTHCNDAIAALKRA

SEQ ID NO: 95497 - protein, 16 aa, Borrelia burgdorferi B31
ADTHCNDAIAALKRAK

SEQ ID NO: 95498 - protein, 16 aa, Borrelia burgdorferi B31
DTHCNDAIAALKRAKN

SEQ ID NO: 95499 - protein, 16 aa, Borrelia burgdorferi B31
THCNDAIAALKRAKND

SEQ ID NO: 95500 - protein, 16 aa, Borrelia burgdorferi B31
HCNDAIAALKRAKNDF

SEQ ID NO: 95501 - protein, 16 aa, Borrelia burgdorferi B31
CNDAIAALKRAKNDFE

SEQ ID NO: 95502 - protein, 16 aa, Borrelia burgdorferi B31
NDAIAALKRAKNDFEY

SEQ ID NO: 95503 - protein, 16 aa, Borrelia burgdorferi B31
DAIAALKRAKNDFEYA

SEQ ID NO: 95504 - protein, 16 aa, Borrelia burgdorferi B31
AIAALKRAKNDFEYAQ

SEQ ID NO: 95505 - protein, 16 aa, Borrelia burgdorferi B31
IAALKRAKNDFEYAQR

SEQ ID NO: 95506 - protein, 16 aa, Borrelia burgdorferi B31
AALKRAKNDFEYAQRK

SEQ ID NO: 95507 - protein, 16 aa, Borrelia burgdorferi B31
ALKRAKNDFEYAQRKA

SEQ ID NO: 95508 - protein, 16 aa, Borrelia burgdorferi B31
LKRAKNDFEYAQRKAD

SEQ ID NO: 95509 - protein, 16 aa, Borrelia burgdorferi B31
KRAKNDFEYAQRKADR

SEQ ID NO: 95510 - protein, 16 aa, Borrelia burgdorferi B31
RAKNDFEYAQRKADRA

SEQ ID NO: 95511 - protein, 16 aa, Borrelia burgdorferi B31
AKNDFEYAQRKADRAL

SEQ ID NO: 95512 - protein, 16 aa, Borrelia burgdorferi B31
KNDFEYAQRKADRALE

SEQ ID NO: 95513 - protein, 16 aa, Borrelia burgdorferi B31
NDFEYAQRKADRALEE

SEQ ID NO: 95514 - protein, 16 aa, Borrelia burgdorferi B31
DFEYAQRKADRALEEA

SEQ ID NO: 95515 - protein, 16 aa, Borrelia burgdorferi B31
FEYAQRKADRALEEAL

SEQ ID NO: 95516 - protein, 16 aa, Borrelia burgdorferi B31
EYAQRKADRALEEALS

SEQ ID NO: 95517 - protein, 16 aa, Borrelia burgdorferi B31
YAQRKADRALEEALSN

SEQ ID NO: 95518 - protein, 16 aa, Borrelia burgdorferi B31
AQRKADRALEEALSNS

SEQ ID NO: 95519 - protein, 16 aa, Borrelia burgdorferi B31
QRKADRALEEALSNSN

SEQ ID NO: 95520 - protein, 16 aa, Borrelia burgdorferi B31
RKADRALEEALSNSNA

SEQ ID NO: 95521 - protein, 16 aa, Borrelia burgdorferi B31
KADRALEEALSNSNAS

SEQ ID NO: 95522 - protein, 16 aa, Borrelia burgdorferi B31
ADRALEEALSNSNASR

SEQ ID NO: 95523 - protein, 16 aa, Borrelia burgdorferi B31
DRALEEALSNSNASRH

SEQ ID NO: 95524 - protein, 16 aa, Borrelia burgdorferi B31
RALEEALSNSNASRHE

SEQ ID NO: 95525 - protein, 16 aa, Borrelia burgdorferi B31
ALEEALSNSNASRHES

SEQ ID NO: 95526 - protein, 16 aa, Borrelia burgdorferi B31
LEEALSNSNASRHESY

SEQ ID NO: 95527 - protein, 16 aa, Borrelia burgdorferi B31
EEALSNSNASRHESYY

SEQ ID NO: 95528 - protein, 16 aa, Borrelia burgdorferi B31
EALSNSNASRHESYYY

SEQ ID NO: 95529 - protein, 16 aa, Borrelia burgdorferi B31
ALSNSNASRHESYYYA

SEQ ID NO: 95530 - protein, 16 aa, Borrelia burgdorferi B31
LSNSNASRHESYYYAG

SEQ ID NO: 95531 - protein, 16 aa, Borrelia burgdorferi B31
SNSNASRHESYYYAGY

SEQ ID NO: 95532 - protein, 16 aa, Borrelia burgdorferi B31
NSNASRHESYYYAGYH

SEQ ID NO: 95533 - protein, 16 aa, Borrelia burgdorferi B31
SNASRHESYYYAGYHQ

SEQ ID NO: 95534 - protein, 16 aa, Borrelia burgdorferi B31
NASRHESYYYAGYHQF

SEQ ID NO: 95535 - protein, 16 aa, Borrelia burgdorferi B31
ASRHESYYYAGYHQFM

SEQ ID NO: 95536 - protein, 16 aa, Borrelia burgdorferi B31
SRHESYYYAGYHQFMA

SEQ ID NO: 95537 - protein, 16 aa, Borrelia burgdorferi B31
RHESYYYAGYHQFMAD

SEQ ID NO: 95538 - protein, 16 aa, Borrelia burgdorferi B31
HESYYYAGYHQFMADA

SEQ ID NO: 95539 - protein, 16 aa, Borrelia burgdorferi B31
ESYYYAGYHQFMADAK

SEQ ID NO: 95540 - protein, 16 aa, Borrelia burgdorferi B31
SYYYAGYHQFMADAKA

SEQ ID NO: 95541 - protein, 16 aa, Borrelia burgdorferi B31
YYYAGYHQFMADAKAS

SEQ ID NO: 95542 - protein, 16 aa, Borrelia burgdorferi B31
YYAGYHQFMADAKASM

SEQ ID NO: 95543 - protein, 16 aa, Borrelia burgdorferi B31
YAGYHQFMADAKASMS

SEQ ID NO: 95544 - protein, 16 aa, Borrelia burgdorferi B31
AGYHQFMADAKASMSS

SEQ ID NO: 95545 - protein, 16 aa, Borrelia burgdorferi B31
GYHQFMADAKASMSST

SEQ ID NO: 95546 - protein, 16 aa, Borrelia burgdorferi B31
YHQFMADAKASMSSTK

SEQ ID NO: 95547 - protein, 16 aa, Borrelia burgdorferi B31
HQFMADAKASMSSTKS

SEQ ID NO: 95548 - protein, 16 aa, Borrelia burgdorferi B31
QFMADAKASMSSTKSL

SEQ ID NO: 95549 - protein, 16 aa, Borrelia burgdorferi B31
FMADAKASMSSTKSLL

SEQ ID NO: 95550 - protein, 16 aa, Borrelia burgdorferi B31
MADAKASMSSTKSLLE

SEQ ID NO: 95551 - protein, 16 aa, Borrelia burgdorferi B31
ADAKASMSSTKSLLEV

SEQ ID NO: 95552 - protein, 16 aa, Borrelia burgdorferi B31
DAKASMSSTKSLLEVA

SEQ ID NO: 95553 - protein, 16 aa, Borrelia burgdorferi B31
AKASMSSTKSLLEVAK

SEQ ID NO: 95554 - protein, 16 aa, Borrelia burgdorferi B31
KASMSSTKSLLEVAKN

SEQ ID NO: 95555 - protein, 16 aa, Borrelia burgdorferi B31
ASMSSTKSLLEVAKNK

SEQ ID NO: 95556 - protein, 16 aa, Borrelia burgdorferi B31
SMSSTKSLLEVAKNKQ

SEQ ID NO: 95557 - protein, 16 aa, Borrelia burgdorferi B31
MSSTKSLLEVAKNKQK

SEQ ID NO: 95558 - protein, 16 aa, Borrelia burgdorferi B31
SSTKSLLEVAKNKQKE

SEQ ID NO: 95559 - protein, 16 aa, Borrelia burgdorferi B31
STKSLLEVAKNKQKEL

SEQ ID NO: 95560 - protein, 16 aa, Borrelia burgdorferi B31
TKSLLEVAKNKQKELN

SEQ ID NO: 95561 - protein, 16 aa, Borrelia burgdorferi B31
KSLLEVAKNKQKELNE

SEQ ID NO: 95562 - protein, 16 aa, Borrelia burgdorferi B31
SLLEVAKNKQKELNEN

SEQ ID NO: 95563 - protein, 16 aa, Borrelia burgdorferi B31
LLEVAKNKQKELNENM

SEQ ID NO: 95564 - protein, 16 aa, Borrelia burgdorferi B31
LEVAKNKQKELNENMT

SEQ ID NO: 95565 - protein, 16 aa, Borrelia burgdorferi B31
EVAKNKQKELNENMTK

SEQ ID NO: 95566 - protein, 16 aa, Borrelia burgdorferi B31
VAKNKQKELNENMTKT

SEQ ID NO: 95567 - protein, 16 aa, Borrelia burgdorferi B31
AKNKQKELNENMTKTN

SEQ ID NO: 95568 - protein, 16 aa, Borrelia burgdorferi B31
KNKQKELNENMTKTNK

SEQ ID NO: 95569 - protein, 16 aa, Borrelia burgdorferi B31
NKQKELNENMTKTNKD

SEQ ID NO: 95570 - protein, 16 aa, Borrelia burgdorferi B31
KQKELNENMTKTNKDF

SEQ ID NO: 95571 - protein, 16 aa, Borrelia burgdorferi B31
QKELNENMTKTNKDFQ

SEQ ID NO: 95572 - protein, 16 aa, Borrelia burgdorferi B31
KELNENMTKTNKDFQE

SEQ ID NO: 95573 - protein, 16 aa, Borrelia burgdorferi B31
ELNENMTKTNKDFQEL

SEQ ID NO: 95574 - protein, 16 aa, Borrelia burgdorferi B31
LNENMTKTNKDFQELN

SEQ ID NO: 95575 - protein, 16 aa, Borrelia burgdorferi B31
NENMTKTNKDFQELND

SEQ ID NO: 95576 - protein, 16 aa, Borrelia burgdorferi B31
ENMTKTNKDFQELNDI

SEQ ID NO: 95577 - protein, 16 aa, Borrelia burgdorferi B31
NMTKTNKDFQELNDIY

SEQ ID NO: 95578 - protein, 16 aa, Borrelia burgdorferi B31
MTKTNKDFQELNDIYK

SEQ ID NO: 95579 - protein, 16 aa, Borrelia burgdorferi B31
TKTNKDFQELNDIYKK

SEQ ID NO: 95580 - protein, 16 aa, Borrelia burgdorferi B31
KTNKDFQELNDIYKKL

SEQ ID NO: 95581 - protein, 16 aa, Borrelia burgdorferi B31
TNKDFQELNDIYKKLQ

SEQ ID NO: 95582 - protein, 16 aa, Borrelia burgdorferi B31
NKDFQELNDIYKKLQD

SEQ ID NO: 95583 - protein, 16 aa, Borrelia burgdorferi B31
KDFQELNDIYKKLQDM

SEQ ID NO: 95584 - protein, 16 aa, Borrelia burgdorferi B31
DFQELNDIYKKLQDMD

SEQ ID NO: 95585 - protein, 16 aa, Borrelia burgdorferi B31
FQELNDIYKKLQDMDS

SEQ ID NO: 95586 - protein, 16 aa, Borrelia burgdorferi B31
QELNDIYKKLQDMDSR

SEQ ID NO: 95587 - protein, 13 aa, Borrelia burgdorferi B31
MIINHNTSAINAS

SEQ ID NO: 95588 - protein, 13 aa, Borrelia burgdorferi B31
IINHNTSAINASR

SEQ ID NO: 95589 - protein, 13 aa, Borrelia burgdorferi B31
INHNTSAINASRN

SEQ ID NO: 95590 - protein, 13 aa, Borrelia burgdorferi B31
NHNTSAINASRNN

SEQ ID NO: 95591 - protein, 13 aa, Borrelia burgdorferi B31
HNTSAINASRNNG

SEQ ID NO: 95592 - protein, 13 aa, Borrelia burgdorferi B31
NTSAINASRNNGI

SEQ ID NO: 95593 - protein, 13 aa, Borrelia burgdorferi B31
TSAINASRNNGIN

SEQ ID NO: 95594 - protein, 13 aa, Borrelia burgdorferi B31
SAINASRNNGINA

SEQ ID NO: 95595 - protein, 13 aa, Borrelia burgdorferi B31
AINASRNNGINAA

SEQ ID NO: 95596 - protein, 13 aa, Borrelia burgdorferi B31
INASRNNGINAAN

SEQ ID NO: 95597 - protein, 13 aa, Borrelia burgdorferi B31
NASRNNGINAANL

SEQ ID NO: 95598 - protein, 13 aa, Borrelia burgdorferi B31
ASRNNGINAANLS

SEQ ID NO: 95599 - protein, 13 aa, Borrelia burgdorferi B31
SRNNGINAANLSK

SEQ ID NO: 95600 - protein, 13 aa, Borrelia burgdorferi B31
RNNGINAANLSKT

SEQ ID NO: 95601 - protein, 13 aa, Borrelia burgdorferi B31
NNGINAANLSKTQ

SEQ ID NO: 95602 - protein, 13 aa, Borrelia burgdorferi B31
NGINAANLSKTQE

SEQ ID NO: 95603 - protein, 13 aa, Borrelia burgdorferi B31
GINAANLSKTQEK

SEQ ID NO: 95604 - protein, 13 aa, Borrelia burgdorferi B31
INAANLSKTQEKL

SEQ ID NO: 95605 - protein, 13 aa, Borrelia burgdorferi B31
NAANLSKTQEKLS

SEQ ID NO: 95606 - protein, 13 aa, Borrelia burgdorferi B31
AANLSKTQEKLSS

SEQ ID NO: 95607 - protein, 13 aa, Borrelia burgdorferi B31
ANLSKTQEKLSSG

SEQ ID NO: 95608 - protein, 13 aa, Borrelia burgdorferi B31
NLSKTQEKLSSGY

SEQ ID NO: 95609 - protein, 13 aa, Borrelia burgdorferi B31
LSKTQEKLSSGYR

SEQ ID NO: 95610 - protein, 13 aa, Borrelia burgdorferi B31
SKTQEKLSSGYRI

SEQ ID NO: 95611 - protein, 13 aa, Borrelia burgdorferi B31
KTQEKLSSGYRIN

SEQ ID NO: 95612 - protein, 13 aa, Borrelia burgdorferi B31
TQEKLSSGYRINR

SEQ ID NO: 95613 - protein, 13 aa, Borrelia burgdorferi B31
QEKLSSGYRINRA

SEQ ID NO: 95614 - protein, 13 aa, Borrelia burgdorferi B31
EKLSSGYRINRAS

SEQ ID NO: 95615 - protein, 13 aa, Borrelia burgdorferi B31
KLSSGYRINRASD

SEQ ID NO: 95616 - protein, 13 aa, Borrelia burgdorferi B31
LSSGYRINRASDD

SEQ ID NO: 95617 - protein, 13 aa, Borrelia burgdorferi B31
SSGYRINRASDDA

SEQ ID NO: 95618 - protein, 13 aa, Borrelia burgdorferi B31
SGYRINRASDDAA

SEQ ID NO: 95619 - protein, 13 aa, Borrelia burgdorferi B31
GYRINRASDDAAG

SEQ ID NO: 95620 - protein, 13 aa, Borrelia burgdorferi B31
YRINRASDDAAGM

SEQ ID NO: 95621 - protein, 13 aa, Borrelia burgdorferi B31
RINRASDDAAGMG

SEQ ID NO: 95622 - protein, 13 aa, Borrelia burgdorferi B31
INRASDDAAGMGV

SEQ ID NO: 95623 - protein, 13 aa, Borrelia burgdorferi B31
NRASDDAAGMGVS

SEQ ID NO: 95624 - protein, 13 aa, Borrelia burgdorferi B31
RASDDAAGMGVSG

SEQ ID NO: 95625 - protein, 13 aa, Borrelia burgdorferi B31
ASDDAAGMGVSGK

SEQ ID NO: 95626 - protein, 13 aa, Borrelia burgdorferi B31
SDDAAGMGVSGKI

SEQ ID NO: 95627 - protein, 13 aa, Borrelia burgdorferi B31
DDAAGMGVSGKIN

SEQ ID NO: 95628 - protein, 13 aa, Borrelia burgdorferi B31
DAAGMGVSGKINA

SEQ ID NO: 95629 - protein, 13 aa, Borrelia burgdorferi B31
AAGMGVSGKINAQ

SEQ ID NO: 95630 - protein, 13 aa, Borrelia burgdorferi B31
AGMGVSGKINAQI

SEQ ID NO: 95631 - protein, 13 aa, Borrelia burgdorferi B31
GMGVSGKINAQIR

SEQ ID NO: 95632 - protein, 13 aa, Borrelia burgdorferi B31
MGVSGKINAQIRG

SEQ ID NO: 95633 - protein, 13 aa, Borrelia burgdorferi B31
GVSGKINAQIRGL

SEQ ID NO: 95634 - protein, 13 aa, Borrelia burgdorferi B31
VSGKINAQIRGLS

SEQ ID NO: 95635 - protein, 13 aa, Borrelia burgdorferi B31
SGKINAQIRGLSQ

SEQ ID NO: 95636 - protein, 13 aa, Borrelia burgdorferi B31
GKINAQIRGLSQA

SEQ ID NO: 95637 - protein, 13 aa, Borrelia burgdorferi B31
KINAQIRGLSQAS

SEQ ID NO: 95638 - protein, 13 aa, Borrelia burgdorferi B31
INAQIRGLSQASR

SEQ ID NO: 95639 - protein, 13 aa, Borrelia burgdorferi B31
NAQIRGLSQASRN

SEQ ID NO: 95640 - protein, 13 aa, Borrelia burgdorferi B31
AQIRGLSQASRNT

SEQ ID NO: 95641 - protein, 13 aa, Borrelia burgdorferi B31
QIRGLSQASRNTS

SEQ ID NO: 95642 - protein, 13 aa, Borrelia burgdorferi B31
IRGLSQASRNTSK

SEQ ID NO: 95643 - protein, 13 aa, Borrelia burgdorferi B31
RGLSQASRNTSKA

SEQ ID NO: 95644 - protein, 13 aa, Borrelia burgdorferi B31
GLSQASRNTSKAI

SEQ ID NO: 95645 - protein, 13 aa, Borrelia burgdorferi B31
LSQASRNTSKAIN

SEQ ID NO: 95646 - protein, 13 aa, Borrelia burgdorferi B31
SQASRNTSKAINF

SEQ ID NO: 95647 - protein, 13 aa, Borrelia burgdorferi B31
QASRNTSKAINFI

SEQ ID NO: 95648 - protein, 13 aa, Borrelia burgdorferi B31
ASRNTSKAINFIQ

SEQ ID NO: 95649 - protein, 13 aa, Borrelia burgdorferi B31
SRNTSKAINFIQT

SEQ ID NO: 95650 - protein, 13 aa, Borrelia burgdorferi B31
RNTSKAINFIQTT

SEQ ID NO: 95651 - protein, 13 aa, Borrelia burgdorferi B31
NTSKAINFIQTTE

SEQ ID NO: 95652 - protein, 13 aa, Borrelia burgdorferi B31
TSKAINFIQTTEG

SEQ ID NO: 95653 - protein, 13 aa, Borrelia burgdorferi B31
SKAINFIQTTEGN

SEQ ID NO: 95654 - protein, 13 aa, Borrelia burgdorferi B31
KAINFIQTTEGNL

SEQ ID NO: 95655 - protein, 13 aa, Borrelia burgdorferi B31
AINFIQTTEGNLN

SEQ ID NO: 95656 - protein, 13 aa, Borrelia burgdorferi B31
INFIQTTEGNLNE

SEQ ID NO: 95657 - protein, 13 aa, Borrelia burgdorferi B31
NFIQTTEGNLNEV

SEQ ID NO: 95658 - protein, 13 aa, Borrelia burgdorferi B31
FIQTTEGNLNEVE

SEQ ID NO: 95659 - protein, 13 aa, Borrelia burgdorferi B31
IQTTEGNLNEVEK

SEQ ID NO: 95660 - protein, 13 aa, Borrelia burgdorferi B31
QTTEGNLNEVEKV

SEQ ID NO: 95661 - protein, 13 aa, Borrelia burgdorferi B31
TTEGNLNEVEKVL

SEQ ID NO: 95662 - protein, 13 aa, Borrelia burgdorferi B31
TEGNLNEVEKVLV

SEQ ID NO: 95663 - protein, 13 aa, Borrelia burgdorferi B31
EGNLNEVEKVLVR

SEQ ID NO: 95664 - protein, 13 aa, Borrelia burgdorferi B31
GNLNEVEKVLVRM

SEQ ID NO: 95665 - protein, 13 aa, Borrelia burgdorferi B31
NLNEVEKVLVRMK

SEQ ID NO: 95666 - protein, 13 aa, Borrelia burgdorferi B31
LNEVEKVLVRMKE

SEQ ID NO: 95667 - protein, 13 aa, Borrelia burgdorferi B31
NEVEKVLVRMKEL

SEQ ID NO: 95668 - protein, 13 aa, Borrelia burgdorferi B31
EVEKVLVRMKELA

SEQ ID NO: 95669 - protein, 13 aa, Borrelia burgdorferi B31
VEKVLVRMKELAV

SEQ ID NO: 95670 - protein, 13 aa, Borrelia burgdorferi B31
EKVLVRMKELAVQ

SEQ ID NO: 95671 - protein, 13 aa, Borrelia burgdorferi B31
KVLVRMKELAVQS

SEQ ID NO: 95672 - protein, 13 aa, Borrelia burgdorferi B31
VLVRMKELAVQSG

SEQ ID NO: 95673 - protein, 13 aa, Borrelia burgdorferi B31
LVRMKELAVQSGN

SEQ ID NO: 95674 - protein, 13 aa, Borrelia burgdorferi B31
VRMKELAVQSGNG

SEQ ID NO: 95675 - protein, 13 aa, Borrelia burgdorferi B31
RMKELAVQSGNGT

SEQ ID NO: 95676 - protein, 13 aa, Borrelia burgdorferi B31
MKELAVQSGNGTY

SEQ ID NO: 95677 - protein, 13 aa, Borrelia burgdorferi B31
KELAVQSGNGTYS

SEQ ID NO: 95678 - protein, 13 aa, Borrelia burgdorferi B31
ELAVQSGNGTYSD

SEQ ID NO: 95679 - protein, 13 aa, Borrelia burgdorferi B31
LAVQSGNGTYSDA

SEQ ID NO: 95680 - protein, 13 aa, Borrelia burgdorferi B31
AVQSGNGTYSDAD

SEQ ID NO: 95681 - protein, 13 aa, Borrelia burgdorferi B31
VQSGNGTYSDADR

SEQ ID NO: 95682 - protein, 13 aa, Borrelia burgdorferi B31
QSGNGTYSDADRG

SEQ ID NO: 95683 - protein, 13 aa, Borrelia burgdorferi B31
SGNGTYSDADRGS

SEQ ID NO: 95684 - protein, 13 aa, Borrelia burgdorferi B31
GNGTYSDADRGSI

SEQ ID NO: 95685 - protein, 13 aa, Borrelia burgdorferi B31
NGTYSDADRGSIQ

SEQ ID NO: 95686 - protein, 13 aa, Borrelia burgdorferi B31
GTYSDADRGSIQI

SEQ ID NO: 95687 - protein, 13 aa, Borrelia burgdorferi B31
TYSDADRGSIQIE

SEQ ID NO: 95688 - protein, 13 aa, Borrelia burgdorferi B31
YSDADRGSIQIEI

SEQ ID NO: 95689 - protein, 13 aa, Borrelia burgdorferi B31
SDADRGSIQIEIE

SEQ ID NO: 95690 - protein, 13 aa, Borrelia burgdorferi B31
DADRGSIQIEIEQ

SEQ ID NO: 95691 - protein, 13 aa, Borrelia burgdorferi B31
ADRGSIQIEIEQL

SEQ ID NO: 95692 - protein, 13 aa, Borrelia burgdorferi B31
DRGSIQIEIEQLT

SEQ ID NO: 95693 - protein, 13 aa, Borrelia burgdorferi B31
RGSIQIEIEQLTD

SEQ ID NO: 95694 - protein, 13 aa, Borrelia burgdorferi B31
GSIQIEIEQLTDE

SEQ ID NO: 95695 - protein, 13 aa, Borrelia burgdorferi B31
SIQIEIEQLTDEI

SEQ ID NO: 95696 - protein, 13 aa, Borrelia burgdorferi B31
IQIEIEQLTDEIN

SEQ ID NO: 95697 - protein, 13 aa, Borrelia burgdorferi B31
QIEIEQLTDEINR

SEQ ID NO: 95698 - protein, 13 aa, Borrelia burgdorferi B31
IEIEQLTDEINRI

SEQ ID NO: 95699 - protein, 13 aa, Borrelia burgdorferi B31
EIEQLTDEINRIA

SEQ ID NO: 95700 - protein, 13 aa, Borrelia burgdorferi B31
IEQLTDEINRIAD

SEQ ID NO: 95701 - protein, 13 aa, Borrelia burgdorferi B31
EQLTDEINRIADQ

SEQ ID NO: 95702 - protein, 13 aa, Borrelia burgdorferi B31
QLTDEINRIADQA

SEQ ID NO: 95703 - protein, 13 aa, Borrelia burgdorferi B31
LTDEINRIADQAQ

SEQ ID NO: 95704 - protein, 13 aa, Borrelia burgdorferi B31
TDEINRIADQAQY

SEQ ID NO: 95705 - protein, 13 aa, Borrelia burgdorferi B31
DEINRIADQAQYN

SEQ ID NO: 95706 - protein, 13 aa, Borrelia burgdorferi B31
EINRIADQAQYNQ

SEQ ID NO: 95707 - protein, 13 aa, Borrelia burgdorferi B31
INRIADQAQYNQM

SEQ ID NO: 95708 - protein, 13 aa, Borrelia burgdorferi B31
NRIADQAQYNQMH

SEQ ID NO: 95709 - protein, 13 aa, Borrelia burgdorferi B31
RIADQAQYNQMHM

SEQ ID NO: 95710 - protein, 13 aa, Borrelia burgdorferi B31
IADQAQYNQMHML

SEQ ID NO: 95711 - protein, 13 aa, Borrelia burgdorferi B31
ADQAQYNQMHMLS

SEQ ID NO: 95712 - protein, 13 aa, Borrelia burgdorferi B31
DQAQYNQMHMLSN

SEQ ID NO: 95713 - protein, 13 aa, Borrelia burgdorferi B31
QAQYNQMHMLSNK

SEQ ID NO: 95714 - protein, 13 aa, Borrelia burgdorferi B31
AQYNQMHMLSNKS

SEQ ID NO: 95715 - protein, 13 aa, Borrelia burgdorferi B31
QYNQMHMLSNKSA

SEQ ID NO: 95716 - protein, 13 aa, Borrelia burgdorferi B31
YNQMHMLSNKSAS

SEQ ID NO: 95717 - protein, 13 aa, Borrelia burgdorferi B31
NQMHMLSNKSASQ

SEQ ID NO: 95718 - protein, 13 aa, Borrelia burgdorferi B31
QMHMLSNKSASQN

SEQ ID NO: 95719 - protein, 13 aa, Borrelia burgdorferi B31
MHMLSNKSASQNV

SEQ ID NO: 95720 - protein, 13 aa, Borrelia burgdorferi B31
HMLSNKSASQNVR

SEQ ID NO: 95721 - protein, 13 aa, Borrelia burgdorferi B31
MLSNKSASQNVRT

SEQ ID NO: 95722 - protein, 13 aa, Borrelia burgdorferi B31
LSNKSASQNVRTA

SEQ ID NO: 95723 - protein, 13 aa, Borrelia burgdorferi B31
SNKSASQNVRTAE

SEQ ID NO: 95724 - protein, 13 aa, Borrelia burgdorferi B31
NKSASQNVRTAEE

SEQ ID NO: 95725 - protein, 13 aa, Borrelia burgdorferi B31
KSASQNVRTAEEL

SEQ ID NO: 95726 - protein, 13 aa, Borrelia burgdorferi B31
SASQNVRTAEELG

SEQ ID NO: 95727 - protein, 13 aa, Borrelia burgdorferi B31
ASQNVRTAEELGM

SEQ ID NO: 95728 - protein, 13 aa, Borrelia burgdorferi B31
SQNVRTAEELGMQ

SEQ ID NO: 95729 - protein, 13 aa, Borrelia burgdorferi B31
QNVRTAEELGMQP

SEQ ID NO: 95730 - protein, 13 aa, Borrelia burgdorferi B31
NVRTAEELGMQPA

SEQ ID NO: 95731 - protein, 13 aa, Borrelia burgdorferi B31
VRTAEELGMQPAK

SEQ ID NO: 95732 - protein, 13 aa, Borrelia burgdorferi B31
RTAEELGMQPAKI

SEQ ID NO: 95733 - protein, 13 aa, Borrelia burgdorferi B31
TAEELGMQPAKIN

SEQ ID NO: 95734 - protein, 13 aa, Borrelia burgdorferi B31
AEELGMQPAKINT

SEQ ID NO: 95735 - protein, 13 aa, Borrelia burgdorferi B31
EELGMQPAKINTP

SEQ ID NO: 95736 - protein, 13 aa, Borrelia burgdorferi B31
ELGMQPAKINTPA

SEQ ID NO: 95737 - protein, 13 aa, Borrelia burgdorferi B31
LGMQPAKINTPAS

SEQ ID NO: 95738 - protein, 13 aa, Borrelia burgdorferi B31
GMQPAKINTPASL

SEQ ID NO: 95739 - protein, 13 aa, Borrelia burgdorferi B31
MQPAKINTPASLS

SEQ ID NO: 95740 - protein, 13 aa, Borrelia burgdorferi B31
QPAKINTPASLSG

SEQ ID NO: 95741 - protein, 13 aa, Borrelia burgdorferi B31
PAKINTPASLSGS

SEQ ID NO: 95742 - protein, 13 aa, Borrelia burgdorferi B31
AKINTPASLSGSQ

SEQ ID NO: 95743 - protein, 13 aa, Borrelia burgdorferi B31
KINTPASLSGSQA

SEQ ID NO: 95744 - protein, 13 aa, Borrelia burgdorferi B31
INTPASLSGSQAS

SEQ ID NO: 95745 - protein, 13 aa, Borrelia burgdorferi B31
NTPASLSGSQASW

SEQ ID NO: 95746 - protein, 13 aa, Borrelia burgdorferi B31
TPASLSGSQASWT

SEQ ID NO: 95747 - protein, 13 aa, Borrelia burgdorferi B31
PASLSGSQASWTL

SEQ ID NO: 95748 - protein, 13 aa, Borrelia burgdorferi B31
ASLSGSQASWTLR

SEQ ID NO: 95749 - protein, 13 aa, Borrelia burgdorferi B31
SLSGSQASWTLRV

SEQ ID NO: 95750 - protein, 13 aa, Borrelia burgdorferi B31
LSGSQASWTLRVH

SEQ ID NO: 95751 - protein, 13 aa, Borrelia burgdorferi B31
SGSQASWTLRVHV

SEQ ID NO: 95752 - protein, 13 aa, Borrelia burgdorferi B31
GSQASWTLRVHVG

SEQ ID NO: 95753 - protein, 13 aa, Borrelia burgdorferi B31
SQASWTLRVHVGA

SEQ ID NO: 95754 - protein, 13 aa, Borrelia burgdorferi B31
QASWTLRVHVGAN

SEQ ID NO: 95755 - protein, 13 aa, Borrelia burgdorferi B31
ASWTLRVHVGANQ

SEQ ID NO: 95756 - protein, 13 aa, Borrelia burgdorferi B31
SWTLRVHVGANQD

SEQ ID NO: 95757 - protein, 13 aa, Borrelia burgdorferi B31
WTLRVHVGANQDE

SEQ ID NO: 95758 - protein, 13 aa, Borrelia burgdorferi B31
TLRVHVGANQDEA

SEQ ID NO: 95759 - protein, 13 aa, Borrelia burgdorferi B31
LRVHVGANQDEAI

SEQ ID NO: 95760 - protein, 13 aa, Borrelia burgdorferi B31
RVHVGANQDEAIA

SEQ ID NO: 95761 - protein, 13 aa, Borrelia burgdorferi B31
VHVGANQDEAIAV

SEQ ID NO: 95762 - protein, 13 aa, Borrelia burgdorferi B31
HVGANQDEAIAVN

SEQ ID NO: 95763 - protein, 13 aa, Borrelia burgdorferi B31
VGANQDEAIAVNI

SEQ ID NO: 95764 - protein, 13 aa, Borrelia burgdorferi B31
GANQDEAIAVNIY

SEQ ID NO: 95765 - protein, 13 aa, Borrelia burgdorferi B31
ANQDEAIAVNIYA

SEQ ID NO: 95766 - protein, 13 aa, Borrelia burgdorferi B31
NQDEAIAVNIYAA

SEQ ID NO: 95767 - protein, 13 aa, Borrelia burgdorferi B31
QDEAIAVNIYAAN

SEQ ID NO: 95768 - protein, 13 aa, Borrelia burgdorferi B31
DEAIAVNIYAANV

SEQ ID NO: 95769 - protein, 13 aa, Borrelia burgdorferi B31
EAIAVNIYAANVA

SEQ ID NO: 95770 - protein, 13 aa, Borrelia burgdorferi B31
AIAVNIYAANVAN

SEQ ID NO: 95771 - protein, 13 aa, Borrelia burgdorferi B31
IAVNIYAANVANL

SEQ ID NO: 95772 - protein, 13 aa, Borrelia burgdorferi B31
AVNIYAANVANLF

SEQ ID NO: 95773 - protein, 13 aa, Borrelia burgdorferi B31
VNIYAANVANLFS

SEQ ID NO: 95774 - protein, 13 aa, Borrelia burgdorferi B31
NIYAANVANLFSG

SEQ ID NO: 95775 - protein, 13 aa, Borrelia burgdorferi B31
IYAANVANLFSGE

SEQ ID NO: 95776 - protein, 13 aa, Borrelia burgdorferi B31
YAANVANLFSGEG

SEQ ID NO: 95777 - protein, 13 aa, Borrelia burgdorferi B31
AANVANLFSGEGA

SEQ ID NO: 95778 - protein, 13 aa, Borrelia burgdorferi B31
ANVANLFSGEGAQ

SEQ ID NO: 95779 - protein, 13 aa, Borrelia burgdorferi B31
NVANLFSGEGAQT

SEQ ID NO: 95780 - protein, 13 aa, Borrelia burgdorferi B31
VANLFSGEGAQTA

SEQ ID NO: 95781 - protein, 13 aa, Borrelia burgdorferi B31
ANLFSGEGAQTAQ

SEQ ID NO: 95782 - protein, 13 aa, Borrelia burgdorferi B31
NLFSGEGAQTAQA

SEQ ID NO: 95783 - protein, 13 aa, Borrelia burgdorferi B31
LFSGEGAQTAQAA

SEQ ID NO: 95784 - protein, 13 aa, Borrelia burgdorferi B31
FSGEGAQTAQAAP

SEQ ID NO: 95785 - protein, 13 aa, Borrelia burgdorferi B31
SGEGAQTAQAAPV

SEQ ID NO: 95786 - protein, 13 aa, Borrelia burgdorferi B31
GEGAQTAQAAPVQ

SEQ ID NO: 95787 - protein, 13 aa, Borrelia burgdorferi B31
EGAQTAQAAPVQE

SEQ ID NO: 95788 - protein, 13 aa, Borrelia burgdorferi B31
GAQTAQAAPVQEG

SEQ ID NO: 95789 - protein, 13 aa, Borrelia burgdorferi B31
AQTAQAAPVQEGV

SEQ ID NO: 95790 - protein, 13 aa, Borrelia burgdorferi B31
QTAQAAPVQEGVQ

SEQ ID NO: 95791 - protein, 13 aa, Borrelia burgdorferi B31
TAQAAPVQEGVQQ

SEQ ID NO: 95792 - protein, 13 aa, Borrelia burgdorferi B31
AQAAPVQEGVQQE

SEQ ID NO: 95793 - protein, 13 aa, Borrelia burgdorferi B31
QAAPVQEGVQQEG

SEQ ID NO: 95794 - protein, 13 aa, Borrelia burgdorferi B31
AAPVQEGVQQEGA

SEQ ID NO: 95795 - protein, 13 aa, Borrelia burgdorferi B31
APVQEGVQQEGAQ

SEQ ID NO: 95796 - protein, 13 aa, Borrelia burgdorferi B31
PVQEGVQQEGAQQ

SEQ ID NO: 95797 - protein, 13 aa, Borrelia burgdorferi B31
VQEGVQQEGAQQP

SEQ ID NO: 95798 - protein, 13 aa, Borrelia burgdorferi B31
QEGVQQEGAQQPA

SEQ ID NO: 95799 - protein, 13 aa, Borrelia burgdorferi B31
EGVQQEGAQQPAP

SEQ ID NO: 95800 - protein, 13 aa, Borrelia burgdorferi B31
GVQQEGAQQPAPA

SEQ ID NO: 95801 - protein, 13 aa, Borrelia burgdorferi B31
VQQEGAQQPAPAT

SEQ ID NO: 95802 - protein, 13 aa, Borrelia burgdorferi B31
QQEGAQQPAPATA

SEQ ID NO: 95803 - protein, 13 aa, Borrelia burgdorferi B31
QEGAQQPAPATAP

SEQ ID NO: 95804 - protein, 13 aa, Borrelia burgdorferi B31
EGAQQPAPATAPS

SEQ ID NO: 95805 - protein, 13 aa, Borrelia burgdorferi B31
GAQQPAPATAPSQ

SEQ ID NO: 95806 - protein, 13 aa, Borrelia burgdorferi B31
AQQPAPATAPSQG

SEQ ID NO: 95807 - protein, 13 aa, Borrelia burgdorferi B31
QQPAPATAPSQGG

SEQ ID NO: 95808 - protein, 13 aa, Borrelia burgdorferi B31
QPAPATAPSQGGV

SEQ ID NO: 95809 - protein, 13 aa, Borrelia burgdorferi B31
PAPATAPSQGGVN

SEQ ID NO: 95810 - protein, 13 aa, Borrelia burgdorferi B31
APATAPSQGGVNS

SEQ ID NO: 95811 - protein, 13 aa, Borrelia burgdorferi B31
PATAPSQGGVNSP

SEQ ID NO: 95812 - protein, 13 aa, Borrelia burgdorferi B31
ATAPSQGGVNSPV

SEQ ID NO: 95813 - protein, 13 aa, Borrelia burgdorferi B31
TAPSQGGVNSPVN

SEQ ID NO: 95814 - protein, 13 aa, Borrelia burgdorferi B31
APSQGGVNSPVNV

SEQ ID NO: 95815 - protein, 13 aa, Borrelia burgdorferi B31
PSQGGVNSPVNVT

SEQ ID NO: 95816 - protein, 13 aa, Borrelia burgdorferi B31
SQGGVNSPVNVTT

SEQ ID NO: 95817 - protein, 13 aa, Borrelia burgdorferi B31
QGGVNSPVNVTTT

SEQ ID NO: 95818 - protein, 13 aa, Borrelia burgdorferi B31
GGVNSPVNVTTTV

SEQ ID NO: 95819 - protein, 13 aa, Borrelia burgdorferi B31
GVNSPVNVTTTVD

SEQ ID NO: 95820 - protein, 13 aa, Borrelia burgdorferi B31
VNSPVNVTTTVDA

SEQ ID NO: 95821 - protein, 13 aa, Borrelia burgdorferi B31
NSPVNVTTTVDAN

SEQ ID NO: 95822 - protein, 13 aa, Borrelia burgdorferi B31
SPVNVTTTVDANT

SEQ ID NO: 95823 - protein, 13 aa, Borrelia burgdorferi B31
PVNVTTTVDANTS

SEQ ID NO: 95824 - protein, 13 aa, Borrelia burgdorferi B31
VNVTTTVDANTSL

SEQ ID NO: 95825 - protein, 13 aa, Borrelia burgdorferi B31
NVTTTVDANTSLA

SEQ ID NO: 95826 - protein, 13 aa, Borrelia burgdorferi B31
VTTTVDANTSLAK

SEQ ID NO: 95827 - protein, 13 aa, Borrelia burgdorferi B31
TTTVDANTSLAKI

SEQ ID NO: 95828 - protein, 13 aa, Borrelia burgdorferi B31
TTVDANTSLAKIE

SEQ ID NO: 95829 - protein, 13 aa, Borrelia burgdorferi B31
TVDANTSLAKIEN

SEQ ID NO: 95830 - protein, 13 aa, Borrelia burgdorferi B31
VDANTSLAKIENA

SEQ ID NO: 95831 - protein, 13 aa, Borrelia burgdorferi B31
DANTSLAKIENAI

SEQ ID NO: 95832 - protein, 13 aa, Borrelia burgdorferi B31
ANTSLAKIENAIR

SEQ ID NO: 95833 - protein, 13 aa, Borrelia burgdorferi B31
NTSLAKIENAIRM

SEQ ID NO: 95834 - protein, 13 aa, Borrelia burgdorferi B31
TSLAKIENAIRMI

SEQ ID NO: 95835 - protein, 13 aa, Borrelia burgdorferi B31
SLAKIENAIRMIS

SEQ ID NO: 95836 - protein, 13 aa, Borrelia burgdorferi B31
LAKIENAIRMISD

SEQ ID NO: 95837 - protein, 13 aa, Borrelia burgdorferi B31
AKIENAIRMISDQ

SEQ ID NO: 95838 - protein, 13 aa, Borrelia burgdorferi B31
KIENAIRMISDQR

SEQ ID NO: 95839 - protein, 13 aa, Borrelia burgdorferi B31
IENAIRMISDQRA

SEQ ID NO: 95840 - protein, 13 aa, Borrelia burgdorferi B31
ENAIRMISDQRAN

SEQ ID NO: 95841 - protein, 13 aa, Borrelia burgdorferi B31
NAIRMISDQRANL

SEQ ID NO: 95842 - protein, 13 aa, Borrelia burgdorferi B31
AIRMISDQRANLG

SEQ ID NO: 95843 - protein, 13 aa, Borrelia burgdorferi B31
IRMISDQRANLGA

SEQ ID NO: 95844 - protein, 13 aa, Borrelia burgdorferi B31
RMISDQRANLGAF

SEQ ID NO: 95845 - protein, 13 aa, Borrelia burgdorferi B31
MISDQRANLGAFQ

SEQ ID NO: 95846 - protein, 13 aa, Borrelia burgdorferi B31
ISDQRANLGAFQN

SEQ ID NO: 95847 - protein, 13 aa, Borrelia burgdorferi B31
SDQRANLGAFQNR

SEQ ID NO: 95848 - protein, 13 aa, Borrelia burgdorferi B31
DQRANLGAFQNRL

SEQ ID NO: 95849 - protein, 13 aa, Borrelia burgdorferi B31
QRANLGAFQNRLE

SEQ ID NO: 95850 - protein, 13 aa, Borrelia burgdorferi B31
RANLGAFQNRLES

SEQ ID NO: 95851 - protein, 13 aa, Borrelia burgdorferi B31
ANLGAFQNRLESI

SEQ ID NO: 95852 - protein, 13 aa, Borrelia burgdorferi B31
NLGAFQNRLESIK

SEQ ID NO: 95853 - protein, 13 aa, Borrelia burgdorferi B31
LGAFQNRLESIKN

SEQ ID NO: 95854 - protein, 13 aa, Borrelia burgdorferi B31
GAFQNRLESIKNS

SEQ ID NO: 95855 - protein, 13 aa, Borrelia burgdorferi B31
AFQNRLESIKNST

SEQ ID NO: 95856 - protein, 13 aa, Borrelia burgdorferi B31
FQNRLESIKNSTE

SEQ ID NO: 95857 - protein, 13 aa, Borrelia burgdorferi B31
QNRLESIKNSTEY

SEQ ID NO: 95858 - protein, 13 aa, Borrelia burgdorferi B31
NRLESIKNSTEYA

SEQ ID NO: 95859 - protein, 13 aa, Borrelia burgdorferi B31
RLESIKNSTEYAI

SEQ ID NO: 95860 - protein, 13 aa, Borrelia burgdorferi B31
LESIKNSTEYAIE

SEQ ID NO: 95861 - protein, 13 aa, Borrelia burgdorferi B31
ESIKNSTEYAIEN

SEQ ID NO: 95862 - protein, 13 aa, Borrelia burgdorferi B31
SIKNSTEYAIENL

SEQ ID NO: 95863 - protein, 13 aa, Borrelia burgdorferi B31
IKNSTEYAIENLK

SEQ ID NO: 95864 - protein, 13 aa, Borrelia burgdorferi B31
KNSTEYAIENLKA

SEQ ID NO: 95865 - protein, 13 aa, Borrelia burgdorferi B31
NSTEYAIENLKAS

SEQ ID NO: 95866 - protein, 13 aa, Borrelia burgdorferi B31
STEYAIENLKASY

SEQ ID NO: 95867 - protein, 13 aa, Borrelia burgdorferi B31
TEYAIENLKASYA

SEQ ID NO: 95868 - protein, 13 aa, Borrelia burgdorferi B31
EYAIENLKASYAQ

SEQ ID NO: 95869 - protein, 13 aa, Borrelia burgdorferi B31
YAIENLKASYAQI

SEQ ID NO: 95870 - protein, 13 aa, Borrelia burgdorferi B31
AIENLKASYAQIK

SEQ ID NO: 95871 - protein, 13 aa, Borrelia burgdorferi B31
IENLKASYAQIKD

SEQ ID NO: 95872 - protein, 13 aa, Borrelia burgdorferi B31
ENLKASYAQIKDA

SEQ ID NO: 95873 - protein, 13 aa, Borrelia burgdorferi B31
NLKASYAQIKDAT

SEQ ID NO: 95874 - protein, 13 aa, Borrelia burgdorferi B31
LKASYAQIKDATM

SEQ ID NO: 95875 - protein, 13 aa, Borrelia burgdorferi B31
KASYAQIKDATMT

SEQ ID NO: 95876 - protein, 13 aa, Borrelia burgdorferi B31
ASYAQIKDATMTD

SEQ ID NO: 95877 - protein, 13 aa, Borrelia burgdorferi B31
SYAQIKDATMTDE

SEQ ID NO: 95878 - protein, 13 aa, Borrelia burgdorferi B31
YAQIKDATMTDEV

SEQ ID NO: 95879 - protein, 13 aa, Borrelia burgdorferi B31
AQIKDATMTDEVV

SEQ ID NO: 95880 - protein, 13 aa, Borrelia burgdorferi B31
QIKDATMTDEVVA

SEQ ID NO: 95881 - protein, 13 aa, Borrelia burgdorferi B31
IKDATMTDEVVAA

SEQ ID NO: 95882 - protein, 13 aa, Borrelia burgdorferi B31
KDATMTDEVVAAT

SEQ ID NO: 95883 - protein, 13 aa, Borrelia burgdorferi B31
DATMTDEVVAATT

SEQ ID NO: 95884 - protein, 13 aa, Borrelia burgdorferi B31
ATMTDEVVAATTN

SEQ ID NO: 95885 - protein, 13 aa, Borrelia burgdorferi B31
TMTDEVVAATTNS

SEQ ID NO: 95886 - protein, 13 aa, Borrelia burgdorferi B31
MTDEVVAATTNSI

SEQ ID NO: 95887 - protein, 13 aa, Borrelia burgdorferi B31
TDEVVAATTNSIL

SEQ ID NO: 95888 - protein, 13 aa, Borrelia burgdorferi B31
DEVVAATTNSILT

SEQ ID NO: 95889 - protein, 13 aa, Borrelia burgdorferi B31
EVVAATTNSILTQ

SEQ ID NO: 95890 - protein, 13 aa, Borrelia burgdorferi B31
VVAATTNSILTQS

SEQ ID NO: 95891 - protein, 13 aa, Borrelia burgdorferi B31
VAATTNSILTQSA

SEQ ID NO: 95892 - protein, 13 aa, Borrelia burgdorferi B31
AATTNSILTQSAM

SEQ ID NO: 95893 - protein, 13 aa, Borrelia burgdorferi B31
ATTNSILTQSAMA

SEQ ID NO: 95894 - protein, 13 aa, Borrelia burgdorferi B31
TTNSILTQSAMAM

SEQ ID NO: 95895 - protein, 13 aa, Borrelia burgdorferi B31
TNSILTQSAMAMI

SEQ ID NO: 95896 - protein, 13 aa, Borrelia burgdorferi B31
NSILTQSAMAMIA

SEQ ID NO: 95897 - protein, 13 aa, Borrelia burgdorferi B31
SILTQSAMAMIAQ

SEQ ID NO: 95898 - protein, 13 aa, Borrelia burgdorferi B31
ILTQSAMAMIAQA

SEQ ID NO: 95899 - protein, 13 aa, Borrelia burgdorferi B31
LTQSAMAMIAQAN

SEQ ID NO: 95900 - protein, 13 aa, Borrelia burgdorferi B31
TQSAMAMIAQANQ

SEQ ID NO: 95901 - protein, 13 aa, Borrelia burgdorferi B31
QSAMAMIAQANQV

SEQ ID NO: 95902 - protein, 13 aa, Borrelia burgdorferi B31
SAMAMIAQANQVP

SEQ ID NO: 95903 - protein, 13 aa, Borrelia burgdorferi B31
AMAMIAQANQVPQ

SEQ ID NO: 95904 - protein, 13 aa, Borrelia burgdorferi B31
MAMIAQANQVPQY

SEQ ID NO: 95905 - protein, 13 aa, Borrelia burgdorferi B31
AMIAQANQVPQYV

SEQ ID NO: 95906 - protein, 13 aa, Borrelia burgdorferi B31
MIAQANQVPQYVL

SEQ ID NO: 95907 - protein, 13 aa, Borrelia burgdorferi B31
IAQANQVPQYVLS

SEQ ID NO: 95908 - protein, 13 aa, Borrelia burgdorferi B31
AQANQVPQYVLSL

SEQ ID NO: 95909 - protein, 13 aa, Borrelia burgdorferi B31
QANQVPQYVLSLL

SEQ ID NO: 95910 - protein, 13 aa, Borrelia burgdorferi B31
ANQVPQYVLSLLR

SEQ ID NO: 95911 - protein, 14 aa, Borrelia burgdorferi B31
MIINHNTSAINASR

SEQ ID NO: 95912 - protein, 14 aa, Borrelia burgdorferi B31
IINHNTSAINASRN

SEQ ID NO: 95913 - protein, 14 aa, Borrelia burgdorferi B31
INHNTSAINASRNN

SEQ ID NO: 95914 - protein, 14 aa, Borrelia burgdorferi B31
NHNTSAINASRNNG

SEQ ID NO: 95915 - protein, 14 aa, Borrelia burgdorferi B31
HNTSAINASRNNGI

SEQ ID NO: 95916 - protein, 14 aa, Borrelia burgdorferi B31
NTSAINASRNNGIN

SEQ ID NO: 95917 - protein, 14 aa, Borrelia burgdorferi B31
TSAINASRNNGINA

SEQ ID NO: 95918 - protein, 14 aa, Borrelia burgdorferi B31
SAINASRNNGINAA

SEQ ID NO: 95919 - protein, 14 aa, Borrelia burgdorferi B31
AINASRNNGINAAN

SEQ ID NO: 95920 - protein, 14 aa, Borrelia burgdorferi B31
INASRNNGINAANL

SEQ ID NO: 95921 - protein, 14 aa, Borrelia burgdorferi B31
NASRNNGINAANLS

SEQ ID NO: 95922 - protein, 14 aa, Borrelia burgdorferi B31
ASRNNGINAANLSK

SEQ ID NO: 95923 - protein, 14 aa, Borrelia burgdorferi B31
SRNNGINAANLSKT

SEQ ID NO: 95924 - protein, 14 aa, Borrelia burgdorferi B31
RNNGINAANLSKTQ

SEQ ID NO: 95925 - protein, 14 aa, Borrelia burgdorferi B31
NNGINAANLSKTQE

SEQ ID NO: 95926 - protein, 14 aa, Borrelia burgdorferi B31
NGINAANLSKTQEK

SEQ ID NO: 95927 - protein, 14 aa, Borrelia burgdorferi B31
GINAANLSKTQEKL

SEQ ID NO: 95928 - protein, 14 aa, Borrelia burgdorferi B31
INAANLSKTQEKLS

SEQ ID NO: 95929 - protein, 14 aa, Borrelia burgdorferi B31
NAANLSKTQEKLSS

SEQ ID NO: 95930 - protein, 14 aa, Borrelia burgdorferi B31
AANLSKTQEKLSSG

SEQ ID NO: 95931 - protein, 14 aa, Borrelia burgdorferi B31
ANLSKTQEKLSSGY

SEQ ID NO: 95932 - protein, 14 aa, Borrelia burgdorferi B31
NLSKTQEKLSSGYR

SEQ ID NO: 95933 - protein, 14 aa, Borrelia burgdorferi B31
LSKTQEKLSSGYRI

SEQ ID NO: 95934 - protein, 14 aa, Borrelia burgdorferi B31
SKTQEKLSSGYRIN

SEQ ID NO: 95935 - protein, 14 aa, Borrelia burgdorferi B31
KTQEKLSSGYRINR

SEQ ID NO: 95936 - protein, 14 aa, Borrelia burgdorferi B31
TQEKLSSGYRINRA

SEQ ID NO: 95937 - protein, 14 aa, Borrelia burgdorferi B31
QEKLSSGYRINRAS

SEQ ID NO: 95938 - protein, 14 aa, Borrelia burgdorferi B31
EKLSSGYRINRASD

SEQ ID NO: 95939 - protein, 14 aa, Borrelia burgdorferi B31
KLSSGYRINRASDD

SEQ ID NO: 95940 - protein, 14 aa, Borrelia burgdorferi B31
LSSGYRINRASDDA

SEQ ID NO: 95941 - protein, 14 aa, Borrelia burgdorferi B31
SSGYRINRASDDAA

SEQ ID NO: 95942 - protein, 14 aa, Borrelia burgdorferi B31
SGYRINRASDDAAG

SEQ ID NO: 95943 - protein, 14 aa, Borrelia burgdorferi B31
GYRINRASDDAAGM

SEQ ID NO: 95944 - protein, 14 aa, Borrelia burgdorferi B31
YRINRASDDAAGMG

SEQ ID NO: 95945 - protein, 14 aa, Borrelia burgdorferi B31
RINRASDDAAGMGV

SEQ ID NO: 95946 - protein, 14 aa, Borrelia burgdorferi B31
INRASDDAAGMGVS

SEQ ID NO: 95947 - protein, 14 aa, Borrelia burgdorferi B31
NRASDDAAGMGVSG

SEQ ID NO: 95948 - protein, 14 aa, Borrelia burgdorferi B31
RASDDAAGMGVSGK

SEQ ID NO: 95949 - protein, 14 aa, Borrelia burgdorferi B31
ASDDAAGMGVSGKI

SEQ ID NO: 95950 - protein, 14 aa, Borrelia burgdorferi B31
SDDAAGMGVSGKIN

SEQ ID NO: 95951 - protein, 14 aa, Borrelia burgdorferi B31
DDAAGMGVSGKINA

SEQ ID NO: 95952 - protein, 14 aa, Borrelia burgdorferi B31
DAAGMGVSGKINAQ

SEQ ID NO: 95953 - protein, 14 aa, Borrelia burgdorferi B31
AAGMGVSGKINAQI

SEQ ID NO: 95954 - protein, 14 aa, Borrelia burgdorferi B31
AGMGVSGKINAQIR

SEQ ID NO: 95955 - protein, 14 aa, Borrelia burgdorferi B31
GMGVSGKINAQIRG

SEQ ID NO: 95956 - protein, 14 aa, Borrelia burgdorferi B31
MGVSGKINAQIRGL

SEQ ID NO: 95957 - protein, 14 aa, Borrelia burgdorferi B31
GVSGKINAQIRGLS

SEQ ID NO: 95958 - protein, 14 aa, Borrelia burgdorferi B31
VSGKINAQIRGLSQ

SEQ ID NO: 95959 - protein, 14 aa, Borrelia burgdorferi B31
SGKINAQIRGLSQA

SEQ ID NO: 95960 - protein, 14 aa, Borrelia burgdorferi B31
GKINAQIRGLSQAS

SEQ ID NO: 95961 - protein, 14 aa, Borrelia burgdorferi B31
KINAQIRGLSQASR

SEQ ID NO: 95962 - protein, 14 aa, Borrelia burgdorferi B31
INAQIRGLSQASRN

SEQ ID NO: 95963 - protein, 14 aa, Borrelia burgdorferi B31
NAQIRGLSQASRNT

SEQ ID NO: 95964 - protein, 14 aa, Borrelia burgdorferi B31
AQIRGLSQASRNTS

SEQ ID NO: 95965 - protein, 14 aa, Borrelia burgdorferi B31
QIRGLSQASRNTSK

SEQ ID NO: 95966 - protein, 14 aa, Borrelia burgdorferi B31
IRGLSQASRNTSKA

SEQ ID NO: 95967 - protein, 14 aa, Borrelia burgdorferi B31
RGLSQASRNTSKAI

SEQ ID NO: 95968 - protein, 14 aa, Borrelia burgdorferi B31
GLSQASRNTSKAIN

SEQ ID NO: 95969 - protein, 14 aa, Borrelia burgdorferi B31
LSQASRNTSKAINF

SEQ ID NO: 95970 - protein, 14 aa, Borrelia burgdorferi B31
SQASRNTSKAINFI

SEQ ID NO: 95971 - protein, 14 aa, Borrelia burgdorferi B31
QASRNTSKAINFIQ

SEQ ID NO: 95972 - protein, 14 aa, Borrelia burgdorferi B31
ASRNTSKAINFIQT

SEQ ID NO: 95973 - protein, 14 aa, Borrelia burgdorferi B31
SRNTSKAINFIQTT

SEQ ID NO: 95974 - protein, 14 aa, Borrelia burgdorferi B31
RNTSKAINFIQTTE

SEQ ID NO: 95975 - protein, 14 aa, Borrelia burgdorferi B31
NTSKAINFIQTTEG

SEQ ID NO: 95976 - protein, 14 aa, Borrelia burgdorferi B31
TSKAINFIQTTEGN

SEQ ID NO: 95977 - protein, 14 aa, Borrelia burgdorferi B31
SKAINFIQTTEGNL

SEQ ID NO: 95978 - protein, 14 aa, Borrelia burgdorferi B31
KAINFIQTTEGNLN

SEQ ID NO: 95979 - protein, 14 aa, Borrelia burgdorferi B31
AINFIQTTEGNLNE

SEQ ID NO: 95980 - protein, 14 aa, Borrelia burgdorferi B31
INFIQTTEGNLNEV

SEQ ID NO: 95981 - protein, 14 aa, Borrelia burgdorferi B31
NFIQTTEGNLNEVE

SEQ ID NO: 95982 - protein, 14 aa, Borrelia burgdorferi B31
FIQTTEGNLNEVEK

SEQ ID NO: 95983 - protein, 14 aa, Borrelia burgdorferi B31
IQTTEGNLNEVEKV

SEQ ID NO: 95984 - protein, 14 aa, Borrelia burgdorferi B31
QTTEGNLNEVEKVL

SEQ ID NO: 95985 - protein, 14 aa, Borrelia burgdorferi B31
TTEGNLNEVEKVLV

SEQ ID NO: 95986 - protein, 14 aa, Borrelia burgdorferi B31
TEGNLNEVEKVLVR

SEQ ID NO: 95987 - protein, 14 aa, Borrelia burgdorferi B31
EGNLNEVEKVLVRM

SEQ ID NO: 95988 - protein, 14 aa, Borrelia burgdorferi B31
GNLNEVEKVLVRMK

SEQ ID NO: 95989 - protein, 14 aa, Borrelia burgdorferi B31
NLNEVEKVLVRMKE

SEQ ID NO: 95990 - protein, 14 aa, Borrelia burgdorferi B31
LNEVEKVLVRMKEL

SEQ ID NO: 95991 - protein, 14 aa, Borrelia burgdorferi B31
NEVEKVLVRMKELA

SEQ ID NO: 95992 - protein, 14 aa, Borrelia burgdorferi B31
EVEKVLVRMKELAV

SEQ ID NO: 95993 - protein, 14 aa, Borrelia burgdorferi B31
VEKVLVRMKELAVQ

SEQ ID NO: 95994 - protein, 14 aa, Borrelia burgdorferi B31
EKVLVRMKELAVQS

SEQ ID NO: 95995 - protein, 14 aa, Borrelia burgdorferi B31
KVLVRMKELAVQSG

SEQ ID NO: 95996 - protein, 14 aa, Borrelia burgdorferi B31
VLVRMKELAVQSGN

SEQ ID NO: 95997 - protein, 14 aa, Borrelia burgdorferi B31
LVRMKELAVQSGNG

SEQ ID NO: 95998 - protein, 14 aa, Borrelia burgdorferi B31
VRMKELAVQSGNGT

SEQ ID NO: 95999 - protein, 14 aa, Borrelia burgdorferi B31
RMKELAVQSGNGTY

SEQ ID NO: 96000 - protein, 14 aa, Borrelia burgdorferi B31
MKELAVQSGNGTYS

SEQ ID NO: 96001 - protein, 14 aa, Borrelia burgdorferi B31
KELAVQSGNGTYSD

SEQ ID NO: 96002 - protein, 14 aa, Borrelia burgdorferi B31
ELAVQSGNGTYSDA

SEQ ID NO: 96003 - protein, 14 aa, Borrelia burgdorferi B31
LAVQSGNGTYSDAD

SEQ ID NO: 96004 - protein, 14 aa, Borrelia burgdorferi B31
AVQSGNGTYSDADR

SEQ ID NO: 96005 - protein, 14 aa, Borrelia burgdorferi B31
VQSGNGTYSDADRG

SEQ ID NO: 96006 - protein, 14 aa, Borrelia burgdorferi B31
QSGNGTYSDADRGS

SEQ ID NO: 96007 - protein, 14 aa, Borrelia burgdorferi B31
SGNGTYSDADRGSI

SEQ ID NO: 96008 - protein, 14 aa, Borrelia burgdorferi B31
GNGTYSDADRGSIQ

SEQ ID NO: 96009 - protein, 14 aa, Borrelia burgdorferi B31
NGTYSDADRGSIQI

SEQ ID NO: 96010 - protein, 14 aa, Borrelia burgdorferi B31
GTYSDADRGSIQIE

SEQ ID NO: 96011 - protein, 14 aa, Borrelia burgdorferi B31
TYSDADRGSIQIEI

SEQ ID NO: 96012 - protein, 14 aa, Borrelia burgdorferi B31
YSDADRGSIQIEIE

SEQ ID NO: 96013 - protein, 14 aa, Borrelia burgdorferi B31
SDADRGSIQIEIEQ

SEQ ID NO: 96014 - protein, 14 aa, Borrelia burgdorferi B31
DADRGSIQIEIEQL

SEQ ID NO: 96015 - protein, 14 aa, Borrelia burgdorferi B31
ADRGSIQIEIEQLT

SEQ ID NO: 96016 - protein, 14 aa, Borrelia burgdorferi B31
DRGSIQIEIEQLTD

SEQ ID NO: 96017 - protein, 14 aa, Borrelia burgdorferi B31
RGSIQIEIEQLTDE

SEQ ID NO: 96018 - protein, 14 aa, Borrelia burgdorferi B31
GSIQIEIEQLTDEI

SEQ ID NO: 96019 - protein, 14 aa, Borrelia burgdorferi B31
SIQIEIEQLTDEIN

SEQ ID NO: 96020 - protein, 14 aa, Borrelia burgdorferi B31
IQIEIEQLTDEINR

SEQ ID NO: 96021 - protein, 14 aa, Borrelia burgdorferi B31
QIEIEQLTDEINRI

SEQ ID NO: 96022 - protein, 14 aa, Borrelia burgdorferi B31
IEIEQLTDEINRIA

SEQ ID NO: 96023 - protein, 14 aa, Borrelia burgdorferi B31
EIEQLTDEINRIAD

SEQ ID NO: 96024 - protein, 14 aa, Borrelia burgdorferi B31
IEQLTDEINRIADQ

SEQ ID NO: 96025 - protein, 14 aa, Borrelia burgdorferi B31
EQLTDEINRIADQA

SEQ ID NO: 96026 - protein, 14 aa, Borrelia burgdorferi B31
QLTDEINRIADQAQ

SEQ ID NO: 96027 - protein, 14 aa, Borrelia burgdorferi B31
LTDEINRIADQAQY

SEQ ID NO: 96028 - protein, 14 aa, Borrelia burgdorferi B31
TDEINRIADQAQYN

SEQ ID NO: 96029 - protein, 14 aa, Borrelia burgdorferi B31
DEINRIADQAQYNQ

SEQ ID NO: 96030 - protein, 14 aa, Borrelia burgdorferi B31
EINRIADQAQYNQM

SEQ ID NO: 96031 - protein, 14 aa, Borrelia burgdorferi B31
INRIADQAQYNQMH

SEQ ID NO: 96032 - protein, 14 aa, Borrelia burgdorferi B31
NRIADQAQYNQMHM

SEQ ID NO: 96033 - protein, 14 aa, Borrelia burgdorferi B31
RIADQAQYNQMHML

SEQ ID NO: 96034 - protein, 14 aa, Borrelia burgdorferi B31
IADQAQYNQMHMLS

SEQ ID NO: 96035 - protein, 14 aa, Borrelia burgdorferi B31
ADQAQYNQMHMLSN

SEQ ID NO: 96036 - protein, 14 aa, Borrelia burgdorferi B31
DQAQYNQMHMLSNK

SEQ ID NO: 96037 - protein, 14 aa, Borrelia burgdorferi B31
QAQYNQMHMLSNKS

SEQ ID NO: 96038 - protein, 14 aa, Borrelia burgdorferi B31
AQYNQMHMLSNKSA

SEQ ID NO: 96039 - protein, 14 aa, Borrelia burgdorferi B31
QYNQMHMLSNKSAS

SEQ ID NO: 96040 - protein, 14 aa, Borrelia burgdorferi B31
YNQMHMLSNKSASQ

SEQ ID NO: 96041 - protein, 14 aa, Borrelia burgdorferi B31
NQMHMLSNKSASQN

SEQ ID NO: 96042 - protein, 14 aa, Borrelia burgdorferi B31
QMHMLSNKSASQNV

SEQ ID NO: 96043 - protein, 14 aa, Borrelia burgdorferi B31
MHMLSNKSASQNVR

SEQ ID NO: 96044 - protein, 14 aa, Borrelia burgdorferi B31
HMLSNKSASQNVRT

SEQ ID NO: 96045 - protein, 14 aa, Borrelia burgdorferi B31
MLSNKSASQNVRTA

SEQ ID NO: 96046 - protein, 14 aa, Borrelia burgdorferi B31
LSNKSASQNVRTAE

SEQ ID NO: 96047 - protein, 14 aa, Borrelia burgdorferi B31
SNKSASQNVRTAEE

SEQ ID NO: 96048 - protein, 14 aa, Borrelia burgdorferi B31
NKSASQNVRTAEEL

SEQ ID NO: 96049 - protein, 14 aa, Borrelia burgdorferi B31
KSASQNVRTAEELG

SEQ ID NO: 96050 - protein, 14 aa, Borrelia burgdorferi B31
SASQNVRTAEELGM

SEQ ID NO: 96051 - protein, 14 aa, Borrelia burgdorferi B31
ASQNVRTAEELGMQ

SEQ ID NO: 96052 - protein, 14 aa, Borrelia burgdorferi B31
SQNVRTAEELGMQP

SEQ ID NO: 96053 - protein, 14 aa, Borrelia burgdorferi B31
QNVRTAEELGMQPA

SEQ ID NO: 96054 - protein, 14 aa, Borrelia burgdorferi B31
NVRTAEELGMQPAK

SEQ ID NO: 96055 - protein, 14 aa, Borrelia burgdorferi B31
VRTAEELGMQPAKI

SEQ ID NO: 96056 - protein, 14 aa, Borrelia burgdorferi B31
RTAEELGMQPAKIN

SEQ ID NO: 96057 - protein, 14 aa, Borrelia burgdorferi B31
TAEELGMQPAKINT

SEQ ID NO: 96058 - protein, 14 aa, Borrelia burgdorferi B31
AEELGMQPAKINTP

SEQ ID NO: 96059 - protein, 14 aa, Borrelia burgdorferi B31
EELGMQPAKINTPA

SEQ ID NO: 96060 - protein, 14 aa, Borrelia burgdorferi B31
ELGMQPAKINTPAS

SEQ ID NO: 96061 - protein, 14 aa, Borrelia burgdorferi B31
LGMQPAKINTPASL

SEQ ID NO: 96062 - protein, 14 aa, Borrelia burgdorferi B31
GMQPAKINTPASLS

SEQ ID NO: 96063 - protein, 14 aa, Borrelia burgdorferi B31
MQPAKINTPASLSG

SEQ ID NO: 96064 - protein, 14 aa, Borrelia burgdorferi B31
QPAKINTPASLSGS

SEQ ID NO: 96065 - protein, 14 aa, Borrelia burgdorferi B31
PAKINTPASLSGSQ

SEQ ID NO: 96066 - protein, 14 aa, Borrelia burgdorferi B31
AKINTPASLSGSQA

SEQ ID NO: 96067 - protein, 14 aa, Borrelia burgdorferi B31
KINTPASLSGSQAS

SEQ ID NO: 96068 - protein, 14 aa, Borrelia burgdorferi B31
INTPASLSGSQASW

SEQ ID NO: 96069 - protein, 14 aa, Borrelia burgdorferi B31
NTPASLSGSQASWT

SEQ ID NO: 96070 - protein, 14 aa, Borrelia burgdorferi B31
TPASLSGSQASWTL

SEQ ID NO: 96071 - protein, 14 aa, Borrelia burgdorferi B31
PASLSGSQASWTLR

SEQ ID NO: 96072 - protein, 14 aa, Borrelia burgdorferi B31
ASLSGSQASWTLRV

SEQ ID NO: 96073 - protein, 14 aa, Borrelia burgdorferi B31
SLSGSQASWTLRVH

SEQ ID NO: 96074 - protein, 14 aa, Borrelia burgdorferi B31
LSGSQASWTLRVHV

SEQ ID NO: 96075 - protein, 14 aa, Borrelia burgdorferi B31
SGSQASWTLRVHVG

SEQ ID NO: 96076 - protein, 14 aa, Borrelia burgdorferi B31
GSQASWTLRVHVGA

SEQ ID NO: 96077 - protein, 14 aa, Borrelia burgdorferi B31
SQASWTLRVHVGAN

SEQ ID NO: 96078 - protein, 14 aa, Borrelia burgdorferi B31
QASWTLRVHVGANQ

SEQ ID NO: 96079 - protein, 14 aa, Borrelia burgdorferi B31
ASWTLRVHVGANQD

SEQ ID NO: 96080 - protein, 14 aa, Borrelia burgdorferi B31
SWTLRVHVGANQDE

SEQ ID NO: 96081 - protein, 14 aa, Borrelia burgdorferi B31
WTLRVHVGANQDEA

SEQ ID NO: 96082 - protein, 14 aa, Borrelia burgdorferi B31
TLRVHVGANQDEAI

SEQ ID NO: 96083 - protein, 14 aa, Borrelia burgdorferi B31
LRVHVGANQDEAIA

SEQ ID NO: 96084 - protein, 14 aa, Borrelia burgdorferi B31
RVHVGANQDEAIAV

SEQ ID NO: 96085 - protein, 14 aa, Borrelia burgdorferi B31
VHVGANQDEAIAVN

SEQ ID NO: 96086 - protein, 14 aa, Borrelia burgdorferi B31
HVGANQDEAIAVNI

SEQ ID NO: 96087 - protein, 14 aa, Borrelia burgdorferi B31
VGANQDEAIAVNIY

SEQ ID NO: 96088 - protein, 14 aa, Borrelia burgdorferi B31
GANQDEAIAVNIYA

SEQ ID NO: 96089 - protein, 14 aa, Borrelia burgdorferi B31
ANQDEAIAVNIYAA

SEQ ID NO: 96090 - protein, 14 aa, Borrelia burgdorferi B31
NQDEAIAVNIYAAN

SEQ ID NO: 96091 - protein, 14 aa, Borrelia burgdorferi B31
QDEAIAVNIYAANV

SEQ ID NO: 96092 - protein, 14 aa, Borrelia burgdorferi B31
DEAIAVNIYAANVA

SEQ ID NO: 96093 - protein, 14 aa, Borrelia burgdorferi B31
EAIAVNIYAANVAN

SEQ ID NO: 96094 - protein, 14 aa, Borrelia burgdorferi B31
AIAVNIYAANVANL

SEQ ID NO: 96095 - protein, 14 aa, Borrelia burgdorferi B31
IAVNIYAANVANLF

SEQ ID NO: 96096 - protein, 14 aa, Borrelia burgdorferi B31
AVNIYAANVANLFS

SEQ ID NO: 96097 - protein, 14 aa, Borrelia burgdorferi B31
VNIYAANVANLFSG

SEQ ID NO: 96098 - protein, 14 aa, Borrelia burgdorferi B31
NIYAANVANLFSGE

SEQ ID NO: 96099 - protein, 14 aa, Borrelia burgdorferi B31
IYAANVANLFSGEG

SEQ ID NO: 96100 - protein, 14 aa, Borrelia burgdorferi B31
YAANVANLFSGEGA

SEQ ID NO: 96101 - protein, 14 aa, Borrelia burgdorferi B31
AANVANLFSGEGAQ

SEQ ID NO: 96102 - protein, 14 aa, Borrelia burgdorferi B31
ANVANLFSGEGAQT

SEQ ID NO: 96103 - protein, 14 aa, Borrelia burgdorferi B31
NVANLFSGEGAQTA

SEQ ID NO: 96104 - protein, 14 aa, Borrelia burgdorferi B31
VANLFSGEGAQTAQ

SEQ ID NO: 96105 - protein, 14 aa, Borrelia burgdorferi B31
ANLFSGEGAQTAQA

SEQ ID NO: 96106 - protein, 14 aa, Borrelia burgdorferi B31
NLFSGEGAQTAQAA

SEQ ID NO: 96107 - protein, 14 aa, Borrelia burgdorferi B31
LFSGEGAQTAQAAP

SEQ ID NO: 96108 - protein, 14 aa, Borrelia burgdorferi B31
FSGEGAQTAQAAPV

SEQ ID NO: 96109 - protein, 14 aa, Borrelia burgdorferi B31
SGEGAQTAQAAPVQ

SEQ ID NO: 96110 - protein, 14 aa, Borrelia burgdorferi B31
GEGAQTAQAAPVQE

SEQ ID NO: 96111 - protein, 14 aa, Borrelia burgdorferi B31
EGAQTAQAAPVQEG

SEQ ID NO: 96112 - protein, 14 aa, Borrelia burgdorferi B31
GAQTAQAAPVQEGV

SEQ ID NO: 96113 - protein, 14 aa, Borrelia burgdorferi B31
AQTAQAAPVQEGVQ

SEQ ID NO: 96114 - protein, 14 aa, Borrelia burgdorferi B31
QTAQAAPVQEGVQQ

SEQ ID NO: 96115 - protein, 14 aa, Borrelia burgdorferi B31
TAQAAPVQEGVQQE

SEQ ID NO: 96116 - protein, 14 aa, Borrelia burgdorferi B31
AQAAPVQEGVQQEG

SEQ ID NO: 96117 - protein, 14 aa, Borrelia burgdorferi B31
QAAPVQEGVQQEGA

SEQ ID NO: 96118 - protein, 14 aa, Borrelia burgdorferi B31
AAPVQEGVQQEGAQ

SEQ ID NO: 96119 - protein, 14 aa, Borrelia burgdorferi B31
APVQEGVQQEGAQQ

SEQ ID NO: 96120 - protein, 14 aa, Borrelia burgdorferi B31
PVQEGVQQEGAQQP

SEQ ID NO: 96121 - protein, 14 aa, Borrelia burgdorferi B31
VQEGVQQEGAQQPA

SEQ ID NO: 96122 - protein, 14 aa, Borrelia burgdorferi B31
QEGVQQEGAQQPAP

SEQ ID NO: 96123 - protein, 14 aa, Borrelia burgdorferi B31
EGVQQEGAQQPAPA

SEQ ID NO: 96124 - protein, 14 aa, Borrelia burgdorferi B31
GVQQEGAQQPAPAT

SEQ ID NO: 96125 - protein, 14 aa, Borrelia burgdorferi B31
VQQEGAQQPAPATA

SEQ ID NO: 96126 - protein, 14 aa, Borrelia burgdorferi B31
QQEGAQQPAPATAP

SEQ ID NO: 96127 - protein, 14 aa, Borrelia burgdorferi B31
QEGAQQPAPATAPS

SEQ ID NO: 96128 - protein, 14 aa, Borrelia burgdorferi B31
EGAQQPAPATAPSQ

SEQ ID NO: 96129 - protein, 14 aa, Borrelia burgdorferi B31
GAQQPAPATAPSQG

SEQ ID NO: 96130 - protein, 14 aa, Borrelia burgdorferi B31
AQQPAPATAPSQGG

SEQ ID NO: 96131 - protein, 14 aa, Borrelia burgdorferi B31
QQPAPATAPSQGGV

SEQ ID NO: 96132 - protein, 14 aa, Borrelia burgdorferi B31
QPAPATAPSQGGVN

SEQ ID NO: 96133 - protein, 14 aa, Borrelia burgdorferi B31
PAPATAPSQGGVNS

SEQ ID NO: 96134 - protein, 14 aa, Borrelia burgdorferi B31
APATAPSQGGVNSP

SEQ ID NO: 96135 - protein, 14 aa, Borrelia burgdorferi B31
PATAPSQGGVNSPV

SEQ ID NO: 96136 - protein, 14 aa, Borrelia burgdorferi B31
ATAPSQGGVNSPVN

SEQ ID NO: 96137 - protein, 14 aa, Borrelia burgdorferi B31
TAPSQGGVNSPVNV

SEQ ID NO: 96138 - protein, 14 aa, Borrelia burgdorferi B31
APSQGGVNSPVNVT

SEQ ID NO: 96139 - protein, 14 aa, Borrelia burgdorferi B31
PSQGGVNSPVNVTT

SEQ ID NO: 96140 - protein, 14 aa, Borrelia burgdorferi B31
SQGGVNSPVNVTTT

SEQ ID NO: 96141 - protein, 14 aa, Borrelia burgdorferi B31
QGGVNSPVNVTTTV

SEQ ID NO: 96142 - protein, 14 aa, Borrelia burgdorferi B31
GGVNSPVNVTTTVD

SEQ ID NO: 96143 - protein, 14 aa, Borrelia burgdorferi B31
GVNSPVNVTTTVDA

SEQ ID NO: 96144 - protein, 14 aa, Borrelia burgdorferi B31
VNSPVNVTTTVDAN

SEQ ID NO: 96145 - protein, 14 aa, Borrelia burgdorferi B31
NSPVNVTTTVDANT

SEQ ID NO: 96146 - protein, 14 aa, Borrelia burgdorferi B31
SPVNVTTTVDANTS

SEQ ID NO: 96147 - protein, 14 aa, Borrelia burgdorferi B31
PVNVTTTVDANTSL

SEQ ID NO: 96148 - protein, 14 aa, Borrelia burgdorferi B31
VNVTTTVDANTSLA

SEQ ID NO: 96149 - protein, 14 aa, Borrelia burgdorferi B31
NVTTTVDANTSLAK

SEQ ID NO: 96150 - protein, 14 aa, Borrelia burgdorferi B31
VTTTVDANTSLAKI

SEQ ID NO: 96151 - protein, 14 aa, Borrelia burgdorferi B31
TTTVDANTSLAKIE

SEQ ID NO: 96152 - protein, 14 aa, Borrelia burgdorferi B31
TTVDANTSLAKIEN

SEQ ID NO: 96153 - protein, 14 aa, Borrelia burgdorferi B31
TVDANTSLAKIENA

SEQ ID NO: 96154 - protein, 14 aa, Borrelia burgdorferi B31
VDANTSLAKIENAI

SEQ ID NO: 96155 - protein, 14 aa, Borrelia burgdorferi B31
DANTSLAKIENAIR

SEQ ID NO: 96156 - protein, 14 aa, Borrelia burgdorferi B31
ANTSLAKIENAIRM

SEQ ID NO: 96157 - protein, 14 aa, Borrelia burgdorferi B31
NTSLAKIENAIRMI

SEQ ID NO: 96158 - protein, 14 aa, Borrelia burgdorferi B31
TSLAKIENAIRMIS

SEQ ID NO: 96159 - protein, 14 aa, Borrelia burgdorferi B31
SLAKIENAIRMISD

SEQ ID NO: 96160 - protein, 14 aa, Borrelia burgdorferi B31
LAKIENAIRMISDQ

SEQ ID NO: 96161 - protein, 14 aa, Borrelia burgdorferi B31
AKIENAIRMISDQR

SEQ ID NO: 96162 - protein, 14 aa, Borrelia burgdorferi B31
KIENAIRMISDQRA

SEQ ID NO: 96163 - protein, 14 aa, Borrelia burgdorferi B31
IENAIRMISDQRAN

SEQ ID NO: 96164 - protein, 14 aa, Borrelia burgdorferi B31
ENAIRMISDQRANL

SEQ ID NO: 96165 - protein, 14 aa, Borrelia burgdorferi B31
NAIRMISDQRANLG

SEQ ID NO: 96166 - protein, 14 aa, Borrelia burgdorferi B31
AIRMISDQRANLGA

SEQ ID NO: 96167 - protein, 14 aa, Borrelia burgdorferi B31
IRMISDQRANLGAF

SEQ ID NO: 96168 - protein, 14 aa, Borrelia burgdorferi B31
RMISDQRANLGAFQ

SEQ ID NO: 96169 - protein, 14 aa, Borrelia burgdorferi B31
MISDQRANLGAFQN

SEQ ID NO: 96170 - protein, 14 aa, Borrelia burgdorferi B31
ISDQRANLGAFQNR

SEQ ID NO: 96171 - protein, 14 aa, Borrelia burgdorferi B31
SDQRANLGAFQNRL

SEQ ID NO: 96172 - protein, 14 aa, Borrelia burgdorferi B31
DQRANLGAFQNRLE

SEQ ID NO: 96173 - protein, 14 aa, Borrelia burgdorferi B31
QRANLGAFQNRLES

SEQ ID NO: 96174 - protein, 14 aa, Borrelia burgdorferi B31
RANLGAFQNRLESI

SEQ ID NO: 96175 - protein, 14 aa, Borrelia burgdorferi B31
ANLGAFQNRLESIK

SEQ ID NO: 96176 - protein, 14 aa, Borrelia burgdorferi B31
NLGAFQNRLESIKN

SEQ ID NO: 96177 - protein, 14 aa, Borrelia burgdorferi B31
LGAFQNRLESIKNS

SEQ ID NO: 96178 - protein, 14 aa, Borrelia burgdorferi B31
GAFQNRLESIKNST

SEQ ID NO: 96179 - protein, 14 aa, Borrelia burgdorferi B31
AFQNRLESIKNSTE

SEQ ID NO: 96180 - protein, 14 aa, Borrelia burgdorferi B31
FQNRLESIKNSTEY

SEQ ID NO: 96181 - protein, 14 aa, Borrelia burgdorferi B31
QNRLESIKNSTEYA

SEQ ID NO: 96182 - protein, 14 aa, Borrelia burgdorferi B31
NRLESIKNSTEYAI

SEQ ID NO: 96183 - protein, 14 aa, Borrelia burgdorferi B31
RLESIKNSTEYAIE

SEQ ID NO: 96184 - protein, 14 aa, Borrelia burgdorferi B31
LESIKNSTEYAIEN

SEQ ID NO: 96185 - protein, 14 aa, Borrelia burgdorferi B31
ESIKNSTEYAIENL

SEQ ID NO: 96186 - protein, 14 aa, Borrelia burgdorferi B31
SIKNSTEYAIENLK

SEQ ID NO: 96187 - protein, 14 aa, Borrelia burgdorferi B31
IKNSTEYAIENLKA

SEQ ID NO: 96188 - protein, 14 aa, Borrelia burgdorferi B31
KNSTEYAIENLKAS

SEQ ID NO: 96189 - protein, 14 aa, Borrelia burgdorferi B31
NSTEYAIENLKASY

SEQ ID NO: 96190 - protein, 14 aa, Borrelia burgdorferi B31
STEYAIENLKASYA

SEQ ID NO: 96191 - protein, 14 aa, Borrelia burgdorferi B31
TEYAIENLKASYAQ

SEQ ID NO: 96192 - protein, 14 aa, Borrelia burgdorferi B31
EYAIENLKASYAQI

SEQ ID NO: 96193 - protein, 14 aa, Borrelia burgdorferi B31
YAIENLKASYAQIK

SEQ ID NO: 96194 - protein, 14 aa, Borrelia burgdorferi B31
AIENLKASYAQIKD

SEQ ID NO: 96195 - protein, 14 aa, Borrelia burgdorferi B31
IENLKASYAQIKDA

SEQ ID NO: 96196 - protein, 14 aa, Borrelia burgdorferi B31
ENLKASYAQIKDAT

SEQ ID NO: 96197 - protein, 14 aa, Borrelia burgdorferi B31
NLKASYAQIKDATM

SEQ ID NO: 96198 - protein, 14 aa, Borrelia burgdorferi B31
LKASYAQIKDATMT

SEQ ID NO: 96199 - protein, 14 aa, Borrelia burgdorferi B31
KASYAQIKDATMTD

SEQ ID NO: 96200 - protein, 14 aa, Borrelia burgdorferi B31
ASYAQIKDATMTDE

SEQ ID NO: 96201 - protein, 14 aa, Borrelia burgdorferi B31
SYAQIKDATMTDEV

SEQ ID NO: 96202 - protein, 14 aa, Borrelia burgdorferi B31
YAQIKDATMTDEVV

SEQ ID NO: 96203 - protein, 14 aa, Borrelia burgdorferi B31
AQIKDATMTDEVVA

SEQ ID NO: 96204 - protein, 14 aa, Borrelia burgdorferi B31
QIKDATMTDEVVAA

SEQ ID NO: 96205 - protein, 14 aa, Borrelia burgdorferi B31
IKDATMTDEVVAAT

SEQ ID NO: 96206 - protein, 14 aa, Borrelia burgdorferi B31
KDATMTDEVVAATT

SEQ ID NO: 96207 - protein, 14 aa, Borrelia burgdorferi B31
DATMTDEVVAATTN

SEQ ID NO: 96208 - protein, 14 aa, Borrelia burgdorferi B31
ATMTDEVVAATTNS

SEQ ID NO: 96209 - protein, 14 aa, Borrelia burgdorferi B31
TMTDEVVAATTNSI

SEQ ID NO: 96210 - protein, 14 aa, Borrelia burgdorferi B31
MTDEVVAATTNSIL

SEQ ID NO: 96211 - protein, 14 aa, Borrelia burgdorferi B31
TDEVVAATTNSILT

SEQ ID NO: 96212 - protein, 14 aa, Borrelia burgdorferi B31
DEVVAATTNSILTQ

SEQ ID NO: 96213 - protein, 14 aa, Borrelia burgdorferi B31
EVVAATTNSILTQS

SEQ ID NO: 96214 - protein, 14 aa, Borrelia burgdorferi B31
VVAATTNSILTQSA

SEQ ID NO: 96215 - protein, 14 aa, Borrelia burgdorferi B31
VAATTNSILTQSAM

SEQ ID NO: 96216 - protein, 14 aa, Borrelia burgdorferi B31
AATTNSILTQSAMA

SEQ ID NO: 96217 - protein, 14 aa, Borrelia burgdorferi B31
ATTNSILTQSAMAM

SEQ ID NO: 96218 - protein, 14 aa, Borrelia burgdorferi B31
TTNSILTQSAMAMI

SEQ ID NO: 96219 - protein, 14 aa, Borrelia burgdorferi B31
TNSILTQSAMAMIA

SEQ ID NO: 96220 - protein, 14 aa, Borrelia burgdorferi B31
NSILTQSAMAMIAQ

SEQ ID NO: 96221 - protein, 14 aa, Borrelia burgdorferi B31
SILTQSAMAMIAQA

SEQ ID NO: 96222 - protein, 14 aa, Borrelia burgdorferi B31
ILTQSAMAMIAQAN

SEQ ID NO: 96223 - protein, 14 aa, Borrelia burgdorferi B31
LTQSAMAMIAQANQ

SEQ ID NO: 96224 - protein, 14 aa, Borrelia burgdorferi B31
TQSAMAMIAQANQV

SEQ ID NO: 96225 - protein, 14 aa, Borrelia burgdorferi B31
QSAMAMIAQANQVP

SEQ ID NO: 96226 - protein, 14 aa, Borrelia burgdorferi B31
SAMAMIAQANQVPQ

SEQ ID NO: 96227 - protein, 14 aa, Borrelia burgdorferi B31
AMAMIAQANQVPQY

SEQ ID NO: 96228 - protein, 14 aa, Borrelia burgdorferi B31
MAMIAQANQVPQYV

SEQ ID NO: 96229 - protein, 14 aa, Borrelia burgdorferi B31
AMIAQANQVPQYVL

SEQ ID NO: 96230 - protein, 14 aa, Borrelia burgdorferi B31
MIAQANQVPQYVLS

SEQ ID NO: 96231 - protein, 14 aa, Borrelia burgdorferi B31
IAQANQVPQYVLSL

SEQ ID NO: 96232 - protein, 14 aa, Borrelia burgdorferi B31
AQANQVPQYVLSLL

SEQ ID NO: 96233 - protein, 14 aa, Borrelia burgdorferi B31
QANQVPQYVLSLLR

SEQ ID NO: 96234 - protein, 15 aa, Borrelia burgdorferi B31
MIINHNTSAINASRN

SEQ ID NO: 96235 - protein, 15 aa, Borrelia burgdorferi B31
IINHNTSAINASRNN

SEQ ID NO: 96236 - protein, 15 aa, Borrelia burgdorferi B31
INHNTSAINASRNNG

SEQ ID NO: 96237 - protein, 15 aa, Borrelia burgdorferi B31
NHNTSAINASRNNGI

SEQ ID NO: 96238 - protein, 15 aa, Borrelia burgdorferi B31
HNTSAINASRNNGIN

SEQ ID NO: 96239 - protein, 15 aa, Borrelia burgdorferi B31
NTSAINASRNNGINA

SEQ ID NO: 96240 - protein, 15 aa, Borrelia burgdorferi B31
TSAINASRNNGINAA

SEQ ID NO: 96241 - protein, 15 aa, Borrelia burgdorferi B31
SAINASRNNGINAAN

SEQ ID NO: 96242 - protein, 15 aa, Borrelia burgdorferi B31
AINASRNNGINAANL

SEQ ID NO: 96243 - protein, 15 aa, Borrelia burgdorferi B31
INASRNNGINAANLS

SEQ ID NO: 96244 - protein, 15 aa, Borrelia burgdorferi B31
NASRNNGINAANLSK

SEQ ID NO: 96245 - protein, 15 aa, Borrelia burgdorferi B31
ASRNNGINAANLSKT

SEQ ID NO: 96246 - protein, 15 aa, Borrelia burgdorferi B31
SRNNGINAANLSKTQ

SEQ ID NO: 96247 - protein, 15 aa, Borrelia burgdorferi B31
RNNGINAANLSKTQE

SEQ ID NO: 96248 - protein, 15 aa, Borrelia burgdorferi B31
NNGINAANLSKTQEK

SEQ ID NO: 96249 - protein, 15 aa, Borrelia burgdorferi B31
NGINAANLSKTQEKL

SEQ ID NO: 96250 - protein, 15 aa, Borrelia burgdorferi B31
GINAANLSKTQEKLS

SEQ ID NO: 96251 - protein, 15 aa, Borrelia burgdorferi B31
INAANLSKTQEKLSS

SEQ ID NO: 96252 - protein, 15 aa, Borrelia burgdorferi B31
NAANLSKTQEKLSSG

SEQ ID NO: 96253 - protein, 15 aa, Borrelia burgdorferi B31
AANLSKTQEKLSSGY

SEQ ID NO: 96254 - protein, 15 aa, Borrelia burgdorferi B31
ANLSKTQEKLSSGYR

SEQ ID NO: 96255 - protein, 15 aa, Borrelia burgdorferi B31
NLSKTQEKLSSGYRI

SEQ ID NO: 96256 - protein, 15 aa, Borrelia burgdorferi B31
LSKTQEKLSSGYRIN

SEQ ID NO: 96257 - protein, 15 aa, Borrelia burgdorferi B31
SKTQEKLSSGYRINR

SEQ ID NO: 96258 - protein, 15 aa, Borrelia burgdorferi B31
KTQEKLSSGYRINRA

SEQ ID NO: 96259 - protein, 15 aa, Borrelia burgdorferi B31
TQEKLSSGYRINRAS

SEQ ID NO: 96260 - protein, 15 aa, Borrelia burgdorferi B31
QEKLSSGYRINRASD

SEQ ID NO: 96261 - protein, 15 aa, Borrelia burgdorferi B31
EKLSSGYRINRASDD

SEQ ID NO: 96262 - protein, 15 aa, Borrelia burgdorferi B31
KLSSGYRINRASDDA

SEQ ID NO: 96263 - protein, 15 aa, Borrelia burgdorferi B31
LSSGYRINRASDDAA

SEQ ID NO: 96264 - protein, 15 aa, Borrelia burgdorferi B31
SSGYRINRASDDAAG

SEQ ID NO: 96265 - protein, 15 aa, Borrelia burgdorferi B31
SGYRINRASDDAAGM

SEQ ID NO: 96266 - protein, 15 aa, Borrelia burgdorferi B31
GYRINRASDDAAGMG

SEQ ID NO: 96267 - protein, 15 aa, Borrelia burgdorferi B31
YRINRASDDAAGMGV

SEQ ID NO: 96268 - protein, 15 aa, Borrelia burgdorferi B31
RINRASDDAAGMGVS

SEQ ID NO: 96269 - protein, 15 aa, Borrelia burgdorferi B31
INRASDDAAGMGVSG

SEQ ID NO: 96270 - protein, 15 aa, Borrelia burgdorferi B31
NRASDDAAGMGVSGK

SEQ ID NO: 96271 - protein, 15 aa, Borrelia burgdorferi B31
RASDDAAGMGVSGKI

SEQ ID NO: 96272 - protein, 15 aa, Borrelia burgdorferi B31
ASDDAAGMGVSGKIN

SEQ ID NO: 96273 - protein, 15 aa, Borrelia burgdorferi B31
SDDAAGMGVSGKINA

SEQ ID NO: 96274 - protein, 15 aa, Borrelia burgdorferi B31
DDAAGMGVSGKINAQ

SEQ ID NO: 96275 - protein, 15 aa, Borrelia burgdorferi B31
DAAGMGVSGKINAQI

SEQ ID NO: 96276 - protein, 15 aa, Borrelia burgdorferi B31
AAGMGVSGKINAQIR

SEQ ID NO: 96277 - protein, 15 aa, Borrelia burgdorferi B31
AGMGVSGKINAQIRG

SEQ ID NO: 96278 - protein, 15 aa, Borrelia burgdorferi B31
GMGVSGKINAQIRGL

SEQ ID NO: 96279 - protein, 15 aa, Borrelia burgdorferi B31
MGVSGKINAQIRGLS

SEQ ID NO: 96280 - protein, 15 aa, Borrelia burgdorferi B31
GVSGKINAQIRGLSQ

SEQ ID NO: 96281 - protein, 15 aa, Borrelia burgdorferi B31
VSGKINAQIRGLSQA

SEQ ID NO: 96282 - protein, 15 aa, Borrelia burgdorferi B31
SGKINAQIRGLSQAS

SEQ ID NO: 96283 - protein, 15 aa, Borrelia burgdorferi B31
GKINAQIRGLSQASR

SEQ ID NO: 96284 - protein, 15 aa, Borrelia burgdorferi B31
KINAQIRGLSQASRN

SEQ ID NO: 96285 - protein, 15 aa, Borrelia burgdorferi B31
INAQIRGLSQASRNT

SEQ ID NO: 96286 - protein, 15 aa, Borrelia burgdorferi B31
NAQIRGLSQASRNTS

SEQ ID NO: 96287 - protein, 15 aa, Borrelia burgdorferi B31
AQIRGLSQASRNTSK

SEQ ID NO: 96288 - protein, 15 aa, Borrelia burgdorferi B31
QIRGLSQASRNTSKA

SEQ ID NO: 96289 - protein, 15 aa, Borrelia burgdorferi B31
IRGLSQASRNTSKAI

SEQ ID NO: 96290 - protein, 15 aa, Borrelia burgdorferi B31
RGLSQASRNTSKAIN

SEQ ID NO: 96291 - protein, 15 aa, Borrelia burgdorferi B31
GLSQASRNTSKAINF

SEQ ID NO: 96292 - protein, 15 aa, Borrelia burgdorferi B31
LSQASRNTSKAINFI

SEQ ID NO: 96293 - protein, 15 aa, Borrelia burgdorferi B31
SQASRNTSKAINFIQ

SEQ ID NO: 96294 - protein, 15 aa, Borrelia burgdorferi B31
QASRNTSKAINFIQT

SEQ ID NO: 96295 - protein, 15 aa, Borrelia burgdorferi B31
ASRNTSKAINFIQTT

SEQ ID NO: 96296 - protein, 15 aa, Borrelia burgdorferi B31
SRNTSKAINFIQTTE

SEQ ID NO: 96297 - protein, 15 aa, Borrelia burgdorferi B31
RNTSKAINFIQTTEG

SEQ ID NO: 96298 - protein, 15 aa, Borrelia burgdorferi B31
NTSKAINFIQTTEGN

SEQ ID NO: 96299 - protein, 15 aa, Borrelia burgdorferi B31
TSKAINFIQTTEGNL

SEQ ID NO: 96300 - protein, 15 aa, Borrelia burgdorferi B31
SKAINFIQTTEGNLN

SEQ ID NO: 96301 - protein, 15 aa, Borrelia burgdorferi B31
KAINFIQTTEGNLNE

SEQ ID NO: 96302 - protein, 15 aa, Borrelia burgdorferi B31
AINFIQTTEGNLNEV

SEQ ID NO: 96303 - protein, 15 aa, Borrelia burgdorferi B31
INFIQTTEGNLNEVE

SEQ ID NO: 96304 - protein, 15 aa, Borrelia burgdorferi B31
NFIQTTEGNLNEVEK

SEQ ID NO: 96305 - protein, 15 aa, Borrelia burgdorferi B31
FIQTTEGNLNEVEKV

SEQ ID NO: 96306 - protein, 15 aa, Borrelia burgdorferi B31
IQTTEGNLNEVEKVL

SEQ ID NO: 96307 - protein, 15 aa, Borrelia burgdorferi B31
QTTEGNLNEVEKVLV

SEQ ID NO: 96308 - protein, 15 aa, Borrelia burgdorferi B31
TTEGNLNEVEKVLVR

SEQ ID NO: 96309 - protein, 15 aa, Borrelia burgdorferi B31
TEGNLNEVEKVLVRM

SEQ ID NO: 96310 - protein, 15 aa, Borrelia burgdorferi B31
EGNLNEVEKVLVRMK

SEQ ID NO: 96311 - protein, 15 aa, Borrelia burgdorferi B31
GNLNEVEKVLVRMKE

SEQ ID NO: 96312 - protein, 15 aa, Borrelia burgdorferi B31
NLNEVEKVLVRMKEL

SEQ ID NO: 96313 - protein, 15 aa, Borrelia burgdorferi B31
LNEVEKVLVRMKELA

SEQ ID NO: 96314 - protein, 15 aa, Borrelia burgdorferi B31
NEVEKVLVRMKELAV

SEQ ID NO: 96315 - protein, 15 aa, Borrelia burgdorferi B31
EVEKVLVRMKELAVQ

SEQ ID NO: 96316 - protein, 15 aa, Borrelia burgdorferi B31
VEKVLVRMKELAVQS

SEQ ID NO: 96317 - protein, 15 aa, Borrelia burgdorferi B31
EKVLVRMKELAVQSG

SEQ ID NO: 96318 - protein, 15 aa, Borrelia burgdorferi B31
KVLVRMKELAVQSGN

SEQ ID NO: 96319 - protein, 15 aa, Borrelia burgdorferi B31
VLVRMKELAVQSGNG

SEQ ID NO: 96320 - protein, 15 aa, Borrelia burgdorferi B31
LVRMKELAVQSGNGT

SEQ ID NO: 96321 - protein, 15 aa, Borrelia burgdorferi B31
VRMKELAVQSGNGTY

SEQ ID NO: 96322 - protein, 15 aa, Borrelia burgdorferi B31
RMKELAVQSGNGTYS

SEQ ID NO: 96323 - protein, 15 aa, Borrelia burgdorferi B31
MKELAVQSGNGTYSD

SEQ ID NO: 96324 - protein, 15 aa, Borrelia burgdorferi B31
KELAVQSGNGTYSDA

SEQ ID NO: 96325 - protein, 15 aa, Borrelia burgdorferi B31
ELAVQSGNGTYSDAD

SEQ ID NO: 96326 - protein, 15 aa, Borrelia burgdorferi B31
LAVQSGNGTYSDADR

SEQ ID NO: 96327 - protein, 15 aa, Borrelia burgdorferi B31
AVQSGNGTYSDADRG

SEQ ID NO: 96328 - protein, 15 aa, Borrelia burgdorferi B31
VQSGNGTYSDADRGS

SEQ ID NO: 96329 - protein, 15 aa, Borrelia burgdorferi B31
QSGNGTYSDADRGSI

SEQ ID NO: 96330 - protein, 15 aa, Borrelia burgdorferi B31
SGNGTYSDADRGSIQ

SEQ ID NO: 96331 - protein, 15 aa, Borrelia burgdorferi B31
GNGTYSDADRGSIQI

SEQ ID NO: 96332 - protein, 15 aa, Borrelia burgdorferi B31
NGTYSDADRGSIQIE

SEQ ID NO: 96333 - protein, 15 aa, Borrelia burgdorferi B31
GTYSDADRGSIQIEI

SEQ ID NO: 96334 - protein, 15 aa, Borrelia burgdorferi B31
TYSDADRGSIQIEIE

SEQ ID NO: 96335 - protein, 15 aa, Borrelia burgdorferi B31
YSDADRGSIQIEIEQ

SEQ ID NO: 96336 - protein, 15 aa, Borrelia burgdorferi B31
SDADRGSIQIEIEQL

SEQ ID NO: 96337 - protein, 15 aa, Borrelia burgdorferi B31
DADRGSIQIEIEQLT

SEQ ID NO: 96338 - protein, 15 aa, Borrelia burgdorferi B31
ADRGSIQIEIEQLTD

SEQ ID NO: 96339 - protein, 15 aa, Borrelia burgdorferi B31
DRGSIQIEIEQLTDE

SEQ ID NO: 96340 - protein, 15 aa, Borrelia burgdorferi B31
RGSIQIEIEQLTDEI

SEQ ID NO: 96341 - protein, 15 aa, Borrelia burgdorferi B31
GSIQIEIEQLTDEIN

SEQ ID NO: 96342 - protein, 15 aa, Borrelia burgdorferi B31
SIQIEIEQLTDEINR

SEQ ID NO: 96343 - protein, 15 aa, Borrelia burgdorferi B31
IQIEIEQLTDEINRI

SEQ ID NO: 96344 - protein, 15 aa, Borrelia burgdorferi B31
QIEIEQLTDEINRIA

SEQ ID NO: 96345 - protein, 15 aa, Borrelia burgdorferi B31
IEIEQLTDEINRIAD

SEQ ID NO: 96346 - protein, 15 aa, Borrelia burgdorferi B31
EIEQLTDEINRIADQ

SEQ ID NO: 96347 - protein, 15 aa, Borrelia burgdorferi B31
IEQLTDEINRIADQA

SEQ ID NO: 96348 - protein, 15 aa, Borrelia burgdorferi B31
EQLTDEINRIADQAQ

SEQ ID NO: 96349 - protein, 15 aa, Borrelia burgdorferi B31
QLTDEINRIADQAQY

SEQ ID NO: 96350 - protein, 15 aa, Borrelia burgdorferi B31
LTDEINRIADQAQYN

SEQ ID NO: 96351 - protein, 15 aa, Borrelia burgdorferi B31
TDEINRIADQAQYNQ

SEQ ID NO: 96352 - protein, 15 aa, Borrelia burgdorferi B31
DEINRIADQAQYNQM

SEQ ID NO: 96353 - protein, 15 aa, Borrelia burgdorferi B31
EINRIADQAQYNQMH

SEQ ID NO: 96354 - protein, 15 aa, Borrelia burgdorferi B31
INRIADQAQYNQMHM

SEQ ID NO: 96355 - protein, 15 aa, Borrelia burgdorferi B31
NRIADQAQYNQMHML

SEQ ID NO: 96356 - protein, 15 aa, Borrelia burgdorferi B31
RIADQAQYNQMHMLS

SEQ ID NO: 96357 - protein, 15 aa, Borrelia burgdorferi B31
IADQAQYNQMHMLSN

SEQ ID NO: 96358 - protein, 15 aa, Borrelia burgdorferi B31
ADQAQYNQMHMLSNK

SEQ ID NO: 96359 - protein, 15 aa, Borrelia burgdorferi B31
DQAQYNQMHMLSNKS

SEQ ID NO: 96360 - protein, 15 aa, Borrelia burgdorferi B31
QAQYNQMHMLSNKSA

SEQ ID NO: 96361 - protein, 15 aa, Borrelia burgdorferi B31
AQYNQMHMLSNKSAS

SEQ ID NO: 96362 - protein, 15 aa, Borrelia burgdorferi B31
QYNQMHMLSNKSASQ

SEQ ID NO: 96363 - protein, 15 aa, Borrelia burgdorferi B31
YNQMHMLSNKSASQN

SEQ ID NO: 96364 - protein, 15 aa, Borrelia burgdorferi B31
NQMHMLSNKSASQNV

SEQ ID NO: 96365 - protein, 15 aa, Borrelia burgdorferi B31
QMHMLSNKSASQNVR

SEQ ID NO: 96366 - protein, 15 aa, Borrelia burgdorferi B31
MHMLSNKSASQNVRT

SEQ ID NO: 96367 - protein, 15 aa, Borrelia burgdorferi B31
HMLSNKSASQNVRTA

SEQ ID NO: 96368 - protein, 15 aa, Borrelia burgdorferi B31
MLSNKSASQNVRTAE

SEQ ID NO: 96369 - protein, 15 aa, Borrelia burgdorferi B31
LSNKSASQNVRTAEE

SEQ ID NO: 96370 - protein, 15 aa, Borrelia burgdorferi B31
SNKSASQNVRTAEEL

SEQ ID NO: 96371 - protein, 15 aa, Borrelia burgdorferi B31
NKSASQNVRTAEELG

SEQ ID NO: 96372 - protein, 15 aa, Borrelia burgdorferi B31
KSASQNVRTAEELGM

SEQ ID NO: 96373 - protein, 15 aa, Borrelia burgdorferi B31
SASQNVRTAEELGMQ

SEQ ID NO: 96374 - protein, 15 aa, Borrelia burgdorferi B31
ASQNVRTAEELGMQP

SEQ ID NO: 96375 - protein, 15 aa, Borrelia burgdorferi B31
SQNVRTAEELGMQPA

SEQ ID NO: 96376 - protein, 15 aa, Borrelia burgdorferi B31
QNVRTAEELGMQPAK

SEQ ID NO: 96377 - protein, 15 aa, Borrelia burgdorferi B31
NVRTAEELGMQPAKI

SEQ ID NO: 96378 - protein, 15 aa, Borrelia burgdorferi B31
VRTAEELGMQPAKIN

SEQ ID NO: 96379 - protein, 15 aa, Borrelia burgdorferi B31
RTAEELGMQPAKINT

SEQ ID NO: 96380 - protein, 15 aa, Borrelia burgdorferi B31
TAEELGMQPAKINTP

SEQ ID NO: 96381 - protein, 15 aa, Borrelia burgdorferi B31
AEELGMQPAKINTPA

SEQ ID NO: 96382 - protein, 15 aa, Borrelia burgdorferi B31
EELGMQPAKINTPAS

SEQ ID NO: 96383 - protein, 15 aa, Borrelia burgdorferi B31
ELGMQPAKINTPASL

SEQ ID NO: 96384 - protein, 15 aa, Borrelia burgdorferi B31
LGMQPAKINTPASLS

SEQ ID NO: 96385 - protein, 15 aa, Borrelia burgdorferi B31
GMQPAKINTPASLSG

SEQ ID NO: 96386 - protein, 15 aa, Borrelia burgdorferi B31
MQPAKINTPASLSGS

SEQ ID NO: 96387 - protein, 15 aa, Borrelia burgdorferi B31
QPAKINTPASLSGSQ

SEQ ID NO: 96388 - protein, 15 aa, Borrelia burgdorferi B31
PAKINTPASLSGSQA

SEQ ID NO: 96389 - protein, 15 aa, Borrelia burgdorferi B31
AKINTPASLSGSQAS

SEQ ID NO: 96390 - protein, 15 aa, Borrelia burgdorferi B31
KINTPASLSGSQASW

SEQ ID NO: 96391 - protein, 15 aa, Borrelia burgdorferi B31
INTPASLSGSQASWT

SEQ ID NO: 96392 - protein, 15 aa, Borrelia burgdorferi B31
NTPASLSGSQASWTL

SEQ ID NO: 96393 - protein, 15 aa, Borrelia burgdorferi B31
TPASLSGSQASWTLR

SEQ ID NO: 96394 - protein, 15 aa, Borrelia burgdorferi B31
PASLSGSQASWTLRV

SEQ ID NO: 96395 - protein, 15 aa, Borrelia burgdorferi B31
ASLSGSQASWTLRVH

SEQ ID NO: 96396 - protein, 15 aa, Borrelia burgdorferi B31
SLSGSQASWTLRVHV

SEQ ID NO: 96397 - protein, 15 aa, Borrelia burgdorferi B31
LSGSQASWTLRVHVG

SEQ ID NO: 96398 - protein, 15 aa, Borrelia burgdorferi B31
SGSQASWTLRVHVGA

SEQ ID NO: 96399 - protein, 15 aa, Borrelia burgdorferi B31
GSQASWTLRVHVGAN

SEQ ID NO: 96400 - protein, 15 aa, Borrelia burgdorferi B31
SQASWTLRVHVGANQ

SEQ ID NO: 96401 - protein, 15 aa, Borrelia burgdorferi B31
QASWTLRVHVGANQD

SEQ ID NO: 96402 - protein, 15 aa, Borrelia burgdorferi B31
ASWTLRVHVGANQDE

SEQ ID NO: 96403 - protein, 15 aa, Borrelia burgdorferi B31
SWTLRVHVGANQDEA

SEQ ID NO: 96404 - protein, 15 aa, Borrelia burgdorferi B31
WTLRVHVGANQDEAI

SEQ ID NO: 96405 - protein, 15 aa, Borrelia burgdorferi B31
TLRVHVGANQDEAIA

SEQ ID NO: 96406 - protein, 15 aa, Borrelia burgdorferi B31
LRVHVGANQDEAIAV

SEQ ID NO: 96407 - protein, 15 aa, Borrelia burgdorferi B31
RVHVGANQDEAIAVN

SEQ ID NO: 96408 - protein, 15 aa, Borrelia burgdorferi B31
VHVGANQDEAIAVNI

SEQ ID NO: 96409 - protein, 15 aa, Borrelia burgdorferi B31
HVGANQDEAIAVNIY

SEQ ID NO: 96410 - protein, 15 aa, Borrelia burgdorferi B31
VGANQDEAIAVNIYA

SEQ ID NO: 96411 - protein, 15 aa, Borrelia burgdorferi B31
GANQDEAIAVNIYAA

SEQ ID NO: 96412 - protein, 15 aa, Borrelia burgdorferi B31
ANQDEAIAVNIYAAN

SEQ ID NO: 96413 - protein, 15 aa, Borrelia burgdorferi B31
NQDEAIAVNIYAANV

SEQ ID NO: 96414 - protein, 15 aa, Borrelia burgdorferi B31
QDEAIAVNIYAANVA

SEQ ID NO: 96415 - protein, 15 aa, Borrelia burgdorferi B31
DEAIAVNIYAANVAN

SEQ ID NO: 96416 - protein, 15 aa, Borrelia burgdorferi B31
EAIAVNIYAANVANL

SEQ ID NO: 96417 - protein, 15 aa, Borrelia burgdorferi B31
AIAVNIYAANVANLF

SEQ ID NO: 96418 - protein, 15 aa, Borrelia burgdorferi B31
IAVNIYAANVANLFS

SEQ ID NO: 96419 - protein, 15 aa, Borrelia burgdorferi B31
AVNIYAANVANLFSG

SEQ ID NO: 96420 - protein, 15 aa, Borrelia burgdorferi B31
VNIYAANVANLFSGE

SEQ ID NO: 96421 - protein, 15 aa, Borrelia burgdorferi B31
NIYAANVANLFSGEG

SEQ ID NO: 96422 - protein, 15 aa, Borrelia burgdorferi B31
IYAANVANLFSGEGA

SEQ ID NO: 96423 - protein, 15 aa, Borrelia burgdorferi B31
YAANVANLFSGEGAQ

SEQ ID NO: 96424 - protein, 15 aa, Borrelia burgdorferi B31
AANVANLFSGEGAQT

SEQ ID NO: 96425 - protein, 15 aa, Borrelia burgdorferi B31
ANVANLFSGEGAQTA

SEQ ID NO: 96426 - protein, 15 aa, Borrelia burgdorferi B31
NVANLFSGEGAQTAQ

SEQ ID NO: 96427 - protein, 15 aa, Borrelia burgdorferi B31
VANLFSGEGAQTAQA

SEQ ID NO: 96428 - protein, 15 aa, Borrelia burgdorferi B31
ANLFSGEGAQTAQAA

SEQ ID NO: 96429 - protein, 15 aa, Borrelia burgdorferi B31
NLFSGEGAQTAQAAP

SEQ ID NO: 96430 - protein, 15 aa, Borrelia burgdorferi B31
LFSGEGAQTAQAAPV

SEQ ID NO: 96431 - protein, 15 aa, Borrelia burgdorferi B31
FSGEGAQTAQAAPVQ

SEQ ID NO: 96432 - protein, 15 aa, Borrelia burgdorferi B31
SGEGAQTAQAAPVQE

SEQ ID NO: 96433 - protein, 15 aa, Borrelia burgdorferi B31
GEGAQTAQAAPVQEG

SEQ ID NO: 96434 - protein, 15 aa, Borrelia burgdorferi B31
EGAQTAQAAPVQEGV

SEQ ID NO: 96435 - protein, 15 aa, Borrelia burgdorferi B31
GAQTAQAAPVQEGVQ

SEQ ID NO: 96436 - protein, 15 aa, Borrelia burgdorferi B31
AQTAQAAPVQEGVQQ

SEQ ID NO: 96437 - protein, 15 aa, Borrelia burgdorferi B31
QTAQAAPVQEGVQQE

SEQ ID NO: 96438 - protein, 15 aa, Borrelia burgdorferi B31
TAQAAPVQEGVQQEG

SEQ ID NO: 96439 - protein, 15 aa, Borrelia burgdorferi B31
AQAAPVQEGVQQEGA

SEQ ID NO: 96440 - protein, 15 aa, Borrelia burgdorferi B31
QAAPVQEGVQQEGAQ

SEQ ID NO: 96441 - protein, 15 aa, Borrelia burgdorferi B31
AAPVQEGVQQEGAQQ

SEQ ID NO: 96442 - protein, 15 aa, Borrelia burgdorferi B31
APVQEGVQQEGAQQP

SEQ ID NO: 96443 - protein, 15 aa, Borrelia burgdorferi B31
PVQEGVQQEGAQQPA

SEQ ID NO: 96444 - protein, 15 aa, Borrelia burgdorferi B31
VQEGVQQEGAQQPAP

SEQ ID NO: 96445 - protein, 15 aa, Borrelia burgdorferi B31
QEGVQQEGAQQPAPA

SEQ ID NO: 96446 - protein, 15 aa, Borrelia burgdorferi B31
EGVQQEGAQQPAPAT

SEQ ID NO: 96447 - protein, 15 aa, Borrelia burgdorferi B31
GVQQEGAQQPAPATA

SEQ ID NO: 96448 - protein, 15 aa, Borrelia burgdorferi B31
VQQEGAQQPAPATAP

SEQ ID NO: 96449 - protein, 15 aa, Borrelia burgdorferi B31
QQEGAQQPAPATAPS

SEQ ID NO: 96450 - protein, 15 aa, Borrelia burgdorferi B31
QEGAQQPAPATAPSQ

SEQ ID NO: 96451 - protein, 15 aa, Borrelia burgdorferi B31
EGAQQPAPATAPSQG

SEQ ID NO: 96452 - protein, 15 aa, Borrelia burgdorferi B31
GAQQPAPATAPSQGG

SEQ ID NO: 96453 - protein, 15 aa, Borrelia burgdorferi B31
AQQPAPATAPSQGGV

SEQ ID NO: 96454 - protein, 15 aa, Borrelia burgdorferi B31
QQPAPATAPSQGGVN

SEQ ID NO: 96455 - protein, 15 aa, Borrelia burgdorferi B31
QPAPATAPSQGGVNS

SEQ ID NO: 96456 - protein, 15 aa, Borrelia burgdorferi B31
PAPATAPSQGGVNSP

SEQ ID NO: 96457 - protein, 15 aa, Borrelia burgdorferi B31
APATAPSQGGVNSPV

SEQ ID NO: 96458 - protein, 15 aa, Borrelia burgdorferi B31
PATAPSQGGVNSPVN

SEQ ID NO: 96459 - protein, 15 aa, Borrelia burgdorferi B31
ATAPSQGGVNSPVNV

SEQ ID NO: 96460 - protein, 15 aa, Borrelia burgdorferi B31
TAPSQGGVNSPVNVT

SEQ ID NO: 96461 - protein, 15 aa, Borrelia burgdorferi B31
APSQGGVNSPVNVTT

SEQ ID NO: 96462 - protein, 15 aa, Borrelia burgdorferi B31
PSQGGVNSPVNVTTT

SEQ ID NO: 96463 - protein, 15 aa, Borrelia burgdorferi B31
SQGGVNSPVNVTTTV

SEQ ID NO: 96464 - protein, 15 aa, Borrelia burgdorferi B31
QGGVNSPVNVTTTVD

SEQ ID NO: 96465 - protein, 15 aa, Borrelia burgdorferi B31
GGVNSPVNVTTTVDA

SEQ ID NO: 96466 - protein, 15 aa, Borrelia burgdorferi B31
GVNSPVNVTTTVDAN

SEQ ID NO: 96467 - protein, 15 aa, Borrelia burgdorferi B31
VNSPVNVTTTVDANT

SEQ ID NO: 96468 - protein, 15 aa, Borrelia burgdorferi B31
NSPVNVTTTVDANTS

SEQ ID NO: 96469 - protein, 15 aa, Borrelia burgdorferi B31
SPVNVTTTVDANTSL

SEQ ID NO: 96470 - protein, 15 aa, Borrelia burgdorferi B31
PVNVTTTVDANTSLA

SEQ ID NO: 96471 - protein, 15 aa, Borrelia burgdorferi B31
VNVTTTVDANTSLAK

SEQ ID NO: 96472 - protein, 15 aa, Borrelia burgdorferi B31
NVTTTVDANTSLAKI

SEQ ID NO: 96473 - protein, 15 aa, Borrelia burgdorferi B31
VTTTVDANTSLAKIE

SEQ ID NO: 96474 - protein, 15 aa, Borrelia burgdorferi B31
TTTVDANTSLAKIEN

SEQ ID NO: 96475 - protein, 15 aa, Borrelia burgdorferi B31
TTVDANTSLAKIENA

SEQ ID NO: 96476 - protein, 15 aa, Borrelia burgdorferi B31
TVDANTSLAKIENAI

SEQ ID NO: 96477 - protein, 15 aa, Borrelia burgdorferi B31
VDANTSLAKIENAIR

SEQ ID NO: 96478 - protein, 15 aa, Borrelia burgdorferi B31
DANTSLAKIENAIRM

SEQ ID NO: 96479 - protein, 15 aa, Borrelia burgdorferi B31
ANTSLAKIENAIRMI

SEQ ID NO: 96480 - protein, 15 aa, Borrelia burgdorferi B31
NTSLAKIENAIRMIS

SEQ ID NO: 96481 - protein, 15 aa, Borrelia burgdorferi B31
TSLAKIENAIRMISD

SEQ ID NO: 96482 - protein, 15 aa, Borrelia burgdorferi B31
SLAKIENAIRMISDQ

SEQ ID NO: 96483 - protein, 15 aa, Borrelia burgdorferi B31
LAKIENAIRMISDQR

SEQ ID NO: 96484 - protein, 15 aa, Borrelia burgdorferi B31
AKIENAIRMISDQRA

SEQ ID NO: 96485 - protein, 15 aa, Borrelia burgdorferi B31
KIENAIRMISDQRAN

SEQ ID NO: 96486 - protein, 15 aa, Borrelia burgdorferi B31
IENAIRMISDQRANL

SEQ ID NO: 96487 - protein, 15 aa, Borrelia burgdorferi B31
ENAIRMISDQRANLG

SEQ ID NO: 96488 - protein, 15 aa, Borrelia burgdorferi B31
NAIRMISDQRANLGA

SEQ ID NO: 96489 - protein, 15 aa, Borrelia burgdorferi B31
AIRMISDQRANLGAF

SEQ ID NO: 96490 - protein, 15 aa, Borrelia burgdorferi B31
IRMISDQRANLGAFQ

SEQ ID NO: 96491 - protein, 15 aa, Borrelia burgdorferi B31
RMISDQRANLGAFQN

SEQ ID NO: 96492 - protein, 15 aa, Borrelia burgdorferi B31
MISDQRANLGAFQNR

SEQ ID NO: 96493 - protein, 15 aa, Borrelia burgdorferi B31
ISDQRANLGAFQNRL

SEQ ID NO: 96494 - protein, 15 aa, Borrelia burgdorferi B31
SDQRANLGAFQNRLE

SEQ ID NO: 96495 - protein, 15 aa, Borrelia burgdorferi B31
DQRANLGAFQNRLES

SEQ ID NO: 96496 - protein, 15 aa, Borrelia burgdorferi B31
QRANLGAFQNRLESI

SEQ ID NO: 96497 - protein, 15 aa, Borrelia burgdorferi B31
RANLGAFQNRLESIK

SEQ ID NO: 96498 - protein, 15 aa, Borrelia burgdorferi B31
ANLGAFQNRLESIKN

SEQ ID NO: 96499 - protein, 15 aa, Borrelia burgdorferi B31
NLGAFQNRLESIKNS

SEQ ID NO: 96500 - protein, 15 aa, Borrelia burgdorferi B31
LGAFQNRLESIKNST

SEQ ID NO: 96501 - protein, 15 aa, Borrelia burgdorferi B31
GAFQNRLESIKNSTE

SEQ ID NO: 96502 - protein, 15 aa, Borrelia burgdorferi B31
AFQNRLESIKNSTEY

SEQ ID NO: 96503 - protein, 15 aa, Borrelia burgdorferi B31
FQNRLESIKNSTEYA

SEQ ID NO: 96504 - protein, 15 aa, Borrelia burgdorferi B31
QNRLESIKNSTEYAI

SEQ ID NO: 96505 - protein, 15 aa, Borrelia burgdorferi B31
NRLESIKNSTEYAIE

SEQ ID NO: 96506 - protein, 15 aa, Borrelia burgdorferi B31
RLESIKNSTEYAIEN

SEQ ID NO: 96507 - protein, 15 aa, Borrelia burgdorferi B31
LESIKNSTEYAIENL

SEQ ID NO: 96508 - protein, 15 aa, Borrelia burgdorferi B31
ESIKNSTEYAIENLK

SEQ ID NO: 96509 - protein, 15 aa, Borrelia burgdorferi B31
SIKNSTEYAIENLKA

SEQ ID NO: 96510 - protein, 15 aa, Borrelia burgdorferi B31
IKNSTEYAIENLKAS

SEQ ID NO: 96511 - protein, 15 aa, Borrelia burgdorferi B31
KNSTEYAIENLKASY

SEQ ID NO: 96512 - protein, 15 aa, Borrelia burgdorferi B31
NSTEYAIENLKASYA

SEQ ID NO: 96513 - protein, 15 aa, Borrelia burgdorferi B31
STEYAIENLKASYAQ

SEQ ID NO: 96514 - protein, 15 aa, Borrelia burgdorferi B31
TEYAIENLKASYAQI

SEQ ID NO: 96515 - protein, 15 aa, Borrelia burgdorferi B31
EYAIENLKASYAQIK

SEQ ID NO: 96516 - protein, 15 aa, Borrelia burgdorferi B31
YAIENLKASYAQIKD

SEQ ID NO: 96517 - protein, 15 aa, Borrelia burgdorferi B31
AIENLKASYAQIKDA

SEQ ID NO: 96518 - protein, 15 aa, Borrelia burgdorferi B31
IENLKASYAQIKDAT

SEQ ID NO: 96519 - protein, 15 aa, Borrelia burgdorferi B31
ENLKASYAQIKDATM

SEQ ID NO: 96520 - protein, 15 aa, Borrelia burgdorferi B31
NLKASYAQIKDATMT

SEQ ID NO: 96521 - protein, 15 aa, Borrelia burgdorferi B31
LKASYAQIKDATMTD

SEQ ID NO: 96522 - protein, 15 aa, Borrelia burgdorferi B31
KASYAQIKDATMTDE

SEQ ID NO: 96523 - protein, 15 aa, Borrelia burgdorferi B31
ASYAQIKDATMTDEV

SEQ ID NO: 96524 - protein, 15 aa, Borrelia burgdorferi B31
SYAQIKDATMTDEVV

SEQ ID NO: 96525 - protein, 15 aa, Borrelia burgdorferi B31
YAQIKDATMTDEVVA

SEQ ID NO: 96526 - protein, 15 aa, Borrelia burgdorferi B31
AQIKDATMTDEVVAA

SEQ ID NO: 96527 - protein, 15 aa, Borrelia burgdorferi B31
QIKDATMTDEVVAAT

SEQ ID NO: 96528 - protein, 15 aa, Borrelia burgdorferi B31
IKDATMTDEVVAATT

SEQ ID NO: 96529 - protein, 15 aa, Borrelia burgdorferi B31
KDATMTDEVVAATTN

SEQ ID NO: 96530 - protein, 15 aa, Borrelia burgdorferi B31
DATMTDEVVAATTNS

SEQ ID NO: 96531 - protein, 15 aa, Borrelia burgdorferi B31
ATMTDEVVAATTNSI

SEQ ID NO: 96532 - protein, 15 aa, Borrelia burgdorferi B31
TMTDEVVAATTNSIL

SEQ ID NO: 96533 - protein, 15 aa, Borrelia burgdorferi B31
MTDEVVAATTNSILT

SEQ ID NO: 96534 - protein, 15 aa, Borrelia burgdorferi B31
TDEVVAATTNSILTQ

SEQ ID NO: 96535 - protein, 15 aa, Borrelia burgdorferi B31
DEVVAATTNSILTQS

SEQ ID NO: 96536 - protein, 15 aa, Borrelia burgdorferi B31
EVVAATTNSILTQSA

SEQ ID NO: 96537 - protein, 15 aa, Borrelia burgdorferi B31
VVAATTNSILTQSAM

SEQ ID NO: 96538 - protein, 15 aa, Borrelia burgdorferi B31
VAATTNSILTQSAMA

SEQ ID NO: 96539 - protein, 15 aa, Borrelia burgdorferi B31
AATTNSILTQSAMAM

SEQ ID NO: 96540 - protein, 15 aa, Borrelia burgdorferi B31
ATTNSILTQSAMAMI

SEQ ID NO: 96541 - protein, 15 aa, Borrelia burgdorferi B31
TTNSILTQSAMAMIA

SEQ ID NO: 96542 - protein, 15 aa, Borrelia burgdorferi B31
TNSILTQSAMAMIAQ

SEQ ID NO: 96543 - protein, 15 aa, Borrelia burgdorferi B31
NSILTQSAMAMIAQA

SEQ ID NO: 96544 - protein, 15 aa, Borrelia burgdorferi B31
SILTQSAMAMIAQAN

SEQ ID NO: 96545 - protein, 15 aa, Borrelia burgdorferi B31
ILTQSAMAMIAQANQ

SEQ ID NO: 96546 - protein, 15 aa, Borrelia burgdorferi B31
LTQSAMAMIAQANQV

SEQ ID NO: 96547 - protein, 15 aa, Borrelia burgdorferi B31
TQSAMAMIAQANQVP

SEQ ID NO: 96548 - protein, 15 aa, Borrelia burgdorferi B31
QSAMAMIAQANQVPQ

SEQ ID NO: 96549 - protein, 15 aa, Borrelia burgdorferi B31
SAMAMIAQANQVPQY

SEQ ID NO: 96550 - protein, 15 aa, Borrelia burgdorferi B31
AMAMIAQANQVPQYV

SEQ ID NO: 96551 - protein, 15 aa, Borrelia burgdorferi B31
MAMIAQANQVPQYVL

SEQ ID NO: 96552 - protein, 15 aa, Borrelia burgdorferi B31
AMIAQANQVPQYVLS

SEQ ID NO: 96553 - protein, 15 aa, Borrelia burgdorferi B31
MIAQANQVPQYVLSL

SEQ ID NO: 96554 - protein, 15 aa, Borrelia burgdorferi B31
IAQANQVPQYVLSLL

SEQ ID NO: 96555 - protein, 15 aa, Borrelia burgdorferi B31
AQANQVPQYVLSLLR

SEQ ID NO: 96556 - protein, 16 aa, Borrelia burgdorferi B31
MIINHNTSAINASRNN

SEQ ID NO: 96557 - protein, 16 aa, Borrelia burgdorferi B31
IINHNTSAINASRNNG

SEQ ID NO: 96558 - protein, 16 aa, Borrelia burgdorferi B31
INHNTSAINASRNNGI

SEQ ID NO: 96559 - protein, 16 aa, Borrelia burgdorferi B31
NHNTSAINASRNNGIN

SEQ ID NO: 96560 - protein, 16 aa, Borrelia burgdorferi B31
HNTSAINASRNNGINA

SEQ ID NO: 96561 - protein, 16 aa, Borrelia burgdorferi B31
NTSAINASRNNGINAA

SEQ ID NO: 96562 - protein, 16 aa, Borrelia burgdorferi B31
TSAINASRNNGINAAN

SEQ ID NO: 96563 - protein, 16 aa, Borrelia burgdorferi B31
SAINASRNNGINAANL

SEQ ID NO: 96564 - protein, 16 aa, Borrelia burgdorferi B31
AINASRNNGINAANLS

SEQ ID NO: 96565 - protein, 16 aa, Borrelia burgdorferi B31
INASRNNGINAANLSK

SEQ ID NO: 96566 - protein, 16 aa, Borrelia burgdorferi B31
NASRNNGINAANLSKT

SEQ ID NO: 96567 - protein, 16 aa, Borrelia burgdorferi B31
ASRNNGINAANLSKTQ

SEQ ID NO: 96568 - protein, 16 aa, Borrelia burgdorferi B31
SRNNGINAANLSKTQE

SEQ ID NO: 96569 - protein, 16 aa, Borrelia burgdorferi B31
RNNGINAANLSKTQEK

SEQ ID NO: 96570 - protein, 16 aa, Borrelia burgdorferi B31
NNGINAANLSKTQEKL

SEQ ID NO: 96571 - protein, 16 aa, Borrelia burgdorferi B31
NGINAANLSKTQEKLS

SEQ ID NO: 96572 - protein, 16 aa, Borrelia burgdorferi B31
GINAANLSKTQEKLSS

SEQ ID NO: 96573 - protein, 16 aa, Borrelia burgdorferi B31
INAANLSKTQEKLSSG

SEQ ID NO: 96574 - protein, 16 aa, Borrelia burgdorferi B31
NAANLSKTQEKLSSGY

SEQ ID NO: 96575 - protein, 16 aa, Borrelia burgdorferi B31
AANLSKTQEKLSSGYR

SEQ ID NO: 96576 - protein, 16 aa, Borrelia burgdorferi B31
ANLSKTQEKLSSGYRI

SEQ ID NO: 96577 - protein, 16 aa, Borrelia burgdorferi B31
NLSKTQEKLSSGYRIN

SEQ ID NO: 96578 - protein, 16 aa, Borrelia burgdorferi B31
LSKTQEKLSSGYRINR

SEQ ID NO: 96579 - protein, 16 aa, Borrelia burgdorferi B31
SKTQEKLSSGYRINRA

SEQ ID NO: 96580 - protein, 16 aa, Borrelia burgdorferi B31
KTQEKLSSGYRINRAS

SEQ ID NO: 96581 - protein, 16 aa, Borrelia burgdorferi B31
TQEKLSSGYRINRASD

SEQ ID NO: 96582 - protein, 16 aa, Borrelia burgdorferi B31
QEKLSSGYRINRASDD

SEQ ID NO: 96583 - protein, 16 aa, Borrelia burgdorferi B31
EKLSSGYRINRASDDA

SEQ ID NO: 96584 - protein, 16 aa, Borrelia burgdorferi B31
KLSSGYRINRASDDAA

SEQ ID NO: 96585 - protein, 16 aa, Borrelia burgdorferi B31
LSSGYRINRASDDAAG

SEQ ID NO: 96586 - protein, 16 aa, Borrelia burgdorferi B31
SSGYRINRASDDAAGM

SEQ ID NO: 96587 - protein, 16 aa, Borrelia burgdorferi B31
SGYRINRASDDAAGMG

SEQ ID NO: 96588 - protein, 16 aa, Borrelia burgdorferi B31
GYRINRASDDAAGMGV

SEQ ID NO: 96589 - protein, 16 aa, Borrelia burgdorferi B31
YRINRASDDAAGMGVS

SEQ ID NO: 96590 - protein, 16 aa, Borrelia burgdorferi B31
RINRASDDAAGMGVSG

SEQ ID NO: 96591 - protein, 16 aa, Borrelia burgdorferi B31
INRASDDAAGMGVSGK

SEQ ID NO: 96592 - protein, 16 aa, Borrelia burgdorferi B31
NRASDDAAGMGVSGKI

SEQ ID NO: 96593 - protein, 16 aa, Borrelia burgdorferi B31
RASDDAAGMGVSGKIN

SEQ ID NO: 96594 - protein, 16 aa, Borrelia burgdorferi B31
ASDDAAGMGVSGKINA

SEQ ID NO: 96595 - protein, 16 aa, Borrelia burgdorferi B31
SDDAAGMGVSGKINAQ

SEQ ID NO: 96596 - protein, 16 aa, Borrelia burgdorferi B31
DDAAGMGVSGKINAQI

SEQ ID NO: 96597 - protein, 16 aa, Borrelia burgdorferi B31
DAAGMGVSGKINAQIR

SEQ ID NO: 96598 - protein, 16 aa, Borrelia burgdorferi B31
AAGMGVSGKINAQIRG

SEQ ID NO: 96599 - protein, 16 aa, Borrelia burgdorferi B31
AGMGVSGKINAQIRGL

SEQ ID NO: 96600 - protein, 16 aa, Borrelia burgdorferi B31
GMGVSGKINAQIRGLS

SEQ ID NO: 96601 - protein, 16 aa, Borrelia burgdorferi B31
MGVSGKINAQIRGLSQ

SEQ ID NO: 96602 - protein, 16 aa, Borrelia burgdorferi B31
GVSGKINAQIRGLSQA

SEQ ID NO: 96603 - protein, 16 aa, Borrelia burgdorferi B31
VSGKINAQIRGLSQAS

SEQ ID NO: 96604 - protein, 16 aa, Borrelia burgdorferi B31
SGKINAQIRGLSQASR

SEQ ID NO: 96605 - protein, 16 aa, Borrelia burgdorferi B31
GKINAQIRGLSQASRN

SEQ ID NO: 96606 - protein, 16 aa, Borrelia burgdorferi B31
KINAQIRGLSQASRNT

SEQ ID NO: 96607 - protein, 16 aa, Borrelia burgdorferi B31
INAQIRGLSQASRNTS

SEQ ID NO: 96608 - protein, 16 aa, Borrelia burgdorferi B31
NAQIRGLSQASRNTSK

SEQ ID NO: 96609 - protein, 16 aa, Borrelia burgdorferi B31
AQIRGLSQASRNTSKA

SEQ ID NO: 96610 - protein, 16 aa, Borrelia burgdorferi B31
QIRGLSQASRNTSKAI

SEQ ID NO: 96611 - protein, 16 aa, Borrelia burgdorferi B31
IRGLSQASRNTSKAIN

SEQ ID NO: 96612 - protein, 16 aa, Borrelia burgdorferi B31
RGLSQASRNTSKAINF

SEQ ID NO: 96613 - protein, 16 aa, Borrelia burgdorferi B31
GLSQASRNTSKAINFI

SEQ ID NO: 96614 - protein, 16 aa, Borrelia burgdorferi B31
LSQASRNTSKAINFIQ

SEQ ID NO: 96615 - protein, 16 aa, Borrelia burgdorferi B31
SQASRNTSKAINFIQT

SEQ ID NO: 96616 - protein, 16 aa, Borrelia burgdorferi B31
QASRNTSKAINFIQTT

SEQ ID NO: 96617 - protein, 16 aa, Borrelia burgdorferi B31
ASRNTSKAINFIQTTE

SEQ ID NO: 96618 - protein, 16 aa, Borrelia burgdorferi B31
SRNTSKAINFIQTTEG

SEQ ID NO: 96619 - protein, 16 aa, Borrelia burgdorferi B31
RNTSKAINFIQTTEGN

SEQ ID NO: 96620 - protein, 16 aa, Borrelia burgdorferi B31
NTSKAINFIQTTEGNL

SEQ ID NO: 96621 - protein, 16 aa, Borrelia burgdorferi B31
TSKAINFIQTTEGNLN

SEQ ID NO: 96622 - protein, 16 aa, Borrelia burgdorferi B31
SKAINFIQTTEGNLNE

SEQ ID NO: 96623 - protein, 16 aa, Borrelia burgdorferi B31
KAINFIQTTEGNLNEV

SEQ ID NO: 96624 - protein, 16 aa, Borrelia burgdorferi B31
AINFIQTTEGNLNEVE

SEQ ID NO: 96625 - protein, 16 aa, Borrelia burgdorferi B31
INFIQTTEGNLNEVEK

SEQ ID NO: 96626 - protein, 16 aa, Borrelia burgdorferi B31
NFIQTTEGNLNEVEKV

SEQ ID NO: 96627 - protein, 16 aa, Borrelia burgdorferi B31
FIQTTEGNLNEVEKVL

SEQ ID NO: 96628 - protein, 16 aa, Borrelia burgdorferi B31
IQTTEGNLNEVEKVLV

SEQ ID NO: 96629 - protein, 16 aa, Borrelia burgdorferi B31
QTTEGNLNEVEKVLVR

SEQ ID NO: 96630 - protein, 16 aa, Borrelia burgdorferi B31
TTEGNLNEVEKVLVRM

SEQ ID NO: 96631 - protein, 16 aa, Borrelia burgdorferi B31
TEGNLNEVEKVLVRMK

SEQ ID NO: 96632 - protein, 16 aa, Borrelia burgdorferi B31
EGNLNEVEKVLVRMKE

SEQ ID NO: 96633 - protein, 16 aa, Borrelia burgdorferi B31
GNLNEVEKVLVRMKEL

SEQ ID NO: 96634 - protein, 16 aa, Borrelia burgdorferi B31
NLNEVEKVLVRMKELA

SEQ ID NO: 96635 - protein, 16 aa, Borrelia burgdorferi B31
LNEVEKVLVRMKELAV

SEQ ID NO: 96636 - protein, 16 aa, Borrelia burgdorferi B31
NEVEKVLVRMKELAVQ

SEQ ID NO: 96637 - protein, 16 aa, Borrelia burgdorferi B31
EVEKVLVRMKELAVQS

SEQ ID NO: 96638 - protein, 16 aa, Borrelia burgdorferi B31
VEKVLVRMKELAVQSG

SEQ ID NO: 96639 - protein, 16 aa, Borrelia burgdorferi B31
EKVLVRMKELAVQSGN

SEQ ID NO: 96640 - protein, 16 aa, Borrelia burgdorferi B31
KVLVRMKELAVQSGNG

SEQ ID NO: 96641 - protein, 16 aa, Borrelia burgdorferi B31
VLVRMKELAVQSGNGT

SEQ ID NO: 96642 - protein, 16 aa, Borrelia burgdorferi B31
LVRMKELAVQSGNGTY

SEQ ID NO: 96643 - protein, 16 aa, Borrelia burgdorferi B31
VRMKELAVQSGNGTYS

SEQ ID NO: 96644 - protein, 16 aa, Borrelia burgdorferi B31
RMKELAVQSGNGTYSD

SEQ ID NO: 96645 - protein, 16 aa, Borrelia burgdorferi B31
MKELAVQSGNGTYSDA

SEQ ID NO: 96646 - protein, 16 aa, Borrelia burgdorferi B31
KELAVQSGNGTYSDAD

SEQ ID NO: 96647 - protein, 16 aa, Borrelia burgdorferi B31
ELAVQSGNGTYSDADR

SEQ ID NO: 96648 - protein, 16 aa, Borrelia burgdorferi B31
LAVQSGNGTYSDADRG

SEQ ID NO: 96649 - protein, 16 aa, Borrelia burgdorferi B31
AVQSGNGTYSDADRGS

SEQ ID NO: 96650 - protein, 16 aa, Borrelia burgdorferi B31
VQSGNGTYSDADRGSI

SEQ ID NO: 96651 - protein, 16 aa, Borrelia burgdorferi B31
QSGNGTYSDADRGSIQ

SEQ ID NO: 96652 - protein, 16 aa, Borrelia burgdorferi B31
SGNGTYSDADRGSIQI

SEQ ID NO: 96653 - protein, 16 aa, Borrelia burgdorferi B31
GNGTYSDADRGSIQIE

SEQ ID NO: 96654 - protein, 16 aa, Borrelia burgdorferi B31
NGTYSDADRGSIQIEI

SEQ ID NO: 96655 - protein, 16 aa, Borrelia burgdorferi B31
GTYSDADRGSIQIEIE

SEQ ID NO: 96656 - protein, 16 aa, Borrelia burgdorferi B31
TYSDADRGSIQIEIEQ

SEQ ID NO: 96657 - protein, 16 aa, Borrelia burgdorferi B31
YSDADRGSIQIEIEQL

SEQ ID NO: 96658 - protein, 16 aa, Borrelia burgdorferi B31
SDADRGSIQIEIEQLT

SEQ ID NO: 96659 - protein, 16 aa, Borrelia burgdorferi B31
DADRGSIQIEIEQLTD

SEQ ID NO: 96660 - protein, 16 aa, Borrelia burgdorferi B31
ADRGSIQIEIEQLTDE

SEQ ID NO: 96661 - protein, 16 aa, Borrelia burgdorferi B31
DRGSIQIEIEQLTDEI

SEQ ID NO: 96662 - protein, 16 aa, Borrelia burgdorferi B31
RGSIQIEIEQLTDEIN

SEQ ID NO: 96663 - protein, 16 aa, Borrelia burgdorferi B31
GSIQIEIEQLTDEINR

SEQ ID NO: 96664 - protein, 16 aa, Borrelia burgdorferi B31
SIQIEIEQLTDEINRI

SEQ ID NO: 96665 - protein, 16 aa, Borrelia burgdorferi B31
IQIEIEQLTDEINRIA

SEQ ID NO: 96666 - protein, 16 aa, Borrelia burgdorferi B31
QIEIEQLTDEINRIAD

SEQ ID NO: 96667 - protein, 16 aa, Borrelia burgdorferi B31
IEIEQLTDEINRIADQ

SEQ ID NO: 96668 - protein, 16 aa, Borrelia burgdorferi B31
EIEQLTDEINRIADQA

SEQ ID NO: 96669 - protein, 16 aa, Borrelia burgdorferi B31
IEQLTDEINRIADQAQ

SEQ ID NO: 96670 - protein, 16 aa, Borrelia burgdorferi B31
EQLTDEINRIADQAQY

SEQ ID NO: 96671 - protein, 16 aa, Borrelia burgdorferi B31
QLTDEINRIADQAQYN

SEQ ID NO: 96672 - protein, 16 aa, Borrelia burgdorferi B31
LTDEINRIADQAQYNQ

SEQ ID NO: 96673 - protein, 16 aa, Borrelia burgdorferi B31
TDEINRIADQAQYNQM

SEQ ID NO: 96674 - protein, 16 aa, Borrelia burgdorferi B31
DEINRIADQAQYNQMH

SEQ ID NO: 96675 - protein, 16 aa, Borrelia burgdorferi B31
EINRIADQAQYNQMHM

SEQ ID NO: 96676 - protein, 16 aa, Borrelia burgdorferi B31
INRIADQAQYNQMHML

SEQ ID NO: 96677 - protein, 16 aa, Borrelia burgdorferi B31
NRIADQAQYNQMHMLS

SEQ ID NO: 96678 - protein, 16 aa, Borrelia burgdorferi B31
RIADQAQYNQMHMLSN

SEQ ID NO: 96679 - protein, 16 aa, Borrelia burgdorferi B31
IADQAQYNQMHMLSNK

SEQ ID NO: 96680 - protein, 16 aa, Borrelia burgdorferi B31
ADQAQYNQMHMLSNKS

SEQ ID NO: 96681 - protein, 16 aa, Borrelia burgdorferi B31
DQAQYNQMHMLSNKSA

SEQ ID NO: 96682 - protein, 16 aa, Borrelia burgdorferi B31
QAQYNQMHMLSNKSAS

SEQ ID NO: 96683 - protein, 16 aa, Borrelia burgdorferi B31
AQYNQMHMLSNKSASQ

SEQ ID NO: 96684 - protein, 16 aa, Borrelia burgdorferi B31
QYNQMHMLSNKSASQN

SEQ ID NO: 96685 - protein, 16 aa, Borrelia burgdorferi B31
YNQMHMLSNKSASQNV

SEQ ID NO: 96686 - protein, 16 aa, Borrelia burgdorferi B31
NQMHMLSNKSASQNVR

SEQ ID NO: 96687 - protein, 16 aa, Borrelia burgdorferi B31
QMHMLSNKSASQNVRT

SEQ ID NO: 96688 - protein, 16 aa, Borrelia burgdorferi B31
MHMLSNKSASQNVRTA

SEQ ID NO: 96689 - protein, 16 aa, Borrelia burgdorferi B31
HMLSNKSASQNVRTAE

SEQ ID NO: 96690 - protein, 16 aa, Borrelia burgdorferi B31
MLSNKSASQNVRTAEE

SEQ ID NO: 96691 - protein, 16 aa, Borrelia burgdorferi B31
LSNKSASQNVRTAEEL

SEQ ID NO: 96692 - protein, 16 aa, Borrelia burgdorferi B31
SNKSASQNVRTAEELG

SEQ ID NO: 96693 - protein, 16 aa, Borrelia burgdorferi B31
NKSASQNVRTAEELGM

SEQ ID NO: 96694 - protein, 16 aa, Borrelia burgdorferi B31
KSASQNVRTAEELGMQ

SEQ ID NO: 96695 - protein, 16 aa, Borrelia burgdorferi B31
SASQNVRTAEELGMQP

SEQ ID NO: 96696 - protein, 16 aa, Borrelia burgdorferi B31
ASQNVRTAEELGMQPA

SEQ ID NO: 96697 - protein, 16 aa, Borrelia burgdorferi B31
SQNVRTAEELGMQPAK

SEQ ID NO: 96698 - protein, 16 aa, Borrelia burgdorferi B31
QNVRTAEELGMQPAKI

SEQ ID NO: 96699 - protein, 16 aa, Borrelia burgdorferi B31
NVRTAEELGMQPAKIN

SEQ ID NO: 96700 - protein, 16 aa, Borrelia burgdorferi B31
VRTAEELGMQPAKINT

SEQ ID NO: 96701 - protein, 16 aa, Borrelia burgdorferi B31
RTAEELGMQPAKINTP

SEQ ID NO: 96702 - protein, 16 aa, Borrelia burgdorferi B31
TAEELGMQPAKINTPA

SEQ ID NO: 96703 - protein, 16 aa, Borrelia burgdorferi B31
AEELGMQPAKINTPAS

SEQ ID NO: 96704 - protein, 16 aa, Borrelia burgdorferi B31
EELGMQPAKINTPASL

SEQ ID NO: 96705 - protein, 16 aa, Borrelia burgdorferi B31
ELGMQPAKINTPASLS

SEQ ID NO: 96706 - protein, 16 aa, Borrelia burgdorferi B31
LGMQPAKINTPASLSG

SEQ ID NO: 96707 - protein, 16 aa, Borrelia burgdorferi B31
GMQPAKINTPASLSGS

SEQ ID NO: 96708 - protein, 16 aa, Borrelia burgdorferi B31
MQPAKINTPASLSGSQ

SEQ ID NO: 96709 - protein, 16 aa, Borrelia burgdorferi B31
QPAKINTPASLSGSQA

SEQ ID NO: 96710 - protein, 16 aa, Borrelia burgdorferi B31
PAKINTPASLSGSQAS

SEQ ID NO: 96711 - protein, 16 aa, Borrelia burgdorferi B31
AKINTPASLSGSQASW

SEQ ID NO: 96712 - protein, 16 aa, Borrelia burgdorferi B31
KINTPASLSGSQASWT

SEQ ID NO: 96713 - protein, 16 aa, Borrelia burgdorferi B31
INTPASLSGSQASWTL

SEQ ID NO: 96714 - protein, 16 aa, Borrelia burgdorferi B31
NTPASLSGSQASWTLR

SEQ ID NO: 96715 - protein, 16 aa, Borrelia burgdorferi B31
TPASLSGSQASWTLRV

SEQ ID NO: 96716 - protein, 16 aa, Borrelia burgdorferi B31
PASLSGSQASWTLRVH

SEQ ID NO: 96717 - protein, 16 aa, Borrelia burgdorferi B31
ASLSGSQASWTLRVHV

SEQ ID NO: 96718 - protein, 16 aa, Borrelia burgdorferi B31
SLSGSQASWTLRVHVG

SEQ ID NO: 96719 - protein, 16 aa, Borrelia burgdorferi B31
LSGSQASWTLRVHVGA

SEQ ID NO: 96720 - protein, 16 aa, Borrelia burgdorferi B31
SGSQASWTLRVHVGAN

SEQ ID NO: 96721 - protein, 16 aa, Borrelia burgdorferi B31
GSQASWTLRVHVGANQ

SEQ ID NO: 96722 - protein, 16 aa, Borrelia burgdorferi B31
SQASWTLRVHVGANQD

SEQ ID NO: 96723 - protein, 16 aa, Borrelia burgdorferi B31
QASWTLRVHVGANQDE

SEQ ID NO: 96724 - protein, 16 aa, Borrelia burgdorferi B31
ASWTLRVHVGANQDEA

SEQ ID NO: 96725 - protein, 16 aa, Borrelia burgdorferi B31
SWTLRVHVGANQDEAI

SEQ ID NO: 96726 - protein, 16 aa, Borrelia burgdorferi B31
WTLRVHVGANQDEAIA

SEQ ID NO: 96727 - protein, 16 aa, Borrelia burgdorferi B31
TLRVHVGANQDEAIAV

SEQ ID NO: 96728 - protein, 16 aa, Borrelia burgdorferi B31
LRVHVGANQDEAIAVN

SEQ ID NO: 96729 - protein, 16 aa, Borrelia burgdorferi B31
RVHVGANQDEAIAVNI

SEQ ID NO: 96730 - protein, 16 aa, Borrelia burgdorferi B31
VHVGANQDEAIAVNIY

SEQ ID NO: 96731 - protein, 16 aa, Borrelia burgdorferi B31
HVGANQDEAIAVNIYA

SEQ ID NO: 96732 - protein, 16 aa, Borrelia burgdorferi B31
VGANQDEAIAVNIYAA

SEQ ID NO: 96733 - protein, 16 aa, Borrelia burgdorferi B31
GANQDEAIAVNIYAAN

SEQ ID NO: 96734 - protein, 16 aa, Borrelia burgdorferi B31
ANQDEAIAVNIYAANV

SEQ ID NO: 96735 - protein, 16 aa, Borrelia burgdorferi B31
NQDEAIAVNIYAANVA

SEQ ID NO: 96736 - protein, 16 aa, Borrelia burgdorferi B31
QDEAIAVNIYAANVAN

SEQ ID NO: 96737 - protein, 16 aa, Borrelia burgdorferi B31
DEAIAVNIYAANVANL

SEQ ID NO: 96738 - protein, 16 aa, Borrelia burgdorferi B31
EAIAVNIYAANVANLF

SEQ ID NO: 96739 - protein, 16 aa, Borrelia burgdorferi B31
AIAVNIYAANVANLFS

SEQ ID NO: 96740 - protein, 16 aa, Borrelia burgdorferi B31
IAVNIYAANVANLFSG

SEQ ID NO: 96741 - protein, 16 aa, Borrelia burgdorferi B31
AVNIYAANVANLFSGE

SEQ ID NO: 96742 - protein, 16 aa, Borrelia burgdorferi B31
VNIYAANVANLFSGEG

SEQ ID NO: 96743 - protein, 16 aa, Borrelia burgdorferi B31
NIYAANVANLFSGEGA

SEQ ID NO: 96744 - protein, 16 aa, Borrelia burgdorferi B31
IYAANVANLFSGEGAQ

SEQ ID NO: 96745 - protein, 16 aa, Borrelia burgdorferi B31
YAANVANLFSGEGAQT

SEQ ID NO: 96746 - protein, 16 aa, Borrelia burgdorferi B31
AANVANLFSGEGAQTA

SEQ ID NO: 96747 - protein, 16 aa, Borrelia burgdorferi B31
ANVANLFSGEGAQTAQ

SEQ ID NO: 96748 - protein, 16 aa, Borrelia burgdorferi B31
NVANLFSGEGAQTAQA

SEQ ID NO: 96749 - protein, 16 aa, Borrelia burgdorferi B31
VANLFSGEGAQTAQAA

SEQ ID NO: 96750 - protein, 16 aa, Borrelia burgdorferi B31
ANLFSGEGAQTAQAAP

SEQ ID NO: 96751 - protein, 16 aa, Borrelia burgdorferi B31
NLFSGEGAQTAQAAPV

SEQ ID NO: 96752 - protein, 16 aa, Borrelia burgdorferi B31
LFSGEGAQTAQAAPVQ

SEQ ID NO: 96753 - protein, 16 aa, Borrelia burgdorferi B31
FSGEGAQTAQAAPVQE

SEQ ID NO: 96754 - protein, 16 aa, Borrelia burgdorferi B31
SGEGAQTAQAAPVQEG

SEQ ID NO: 96755 - protein, 16 aa, Borrelia burgdorferi B31
GEGAQTAQAAPVQEGV

SEQ ID NO: 96756 - protein, 16 aa, Borrelia burgdorferi B31
EGAQTAQAAPVQEGVQ

SEQ ID NO: 96757 - protein, 16 aa, Borrelia burgdorferi B31
GAQTAQAAPVQEGVQQ

SEQ ID NO: 96758 - protein, 16 aa, Borrelia burgdorferi B31
AQTAQAAPVQEGVQQE

SEQ ID NO: 96759 - protein, 16 aa, Borrelia burgdorferi B31
QTAQAAPVQEGVQQEG

SEQ ID NO: 96760 - protein, 16 aa, Borrelia burgdorferi B31
TAQAAPVQEGVQQEGA

SEQ ID NO: 96761 - protein, 16 aa, Borrelia burgdorferi B31
AQAAPVQEGVQQEGAQ

SEQ ID NO: 96762 - protein, 16 aa, Borrelia burgdorferi B31
QAAPVQEGVQQEGAQQ

SEQ ID NO: 96763 - protein, 16 aa, Borrelia burgdorferi B31
AAPVQEGVQQEGAQQP

SEQ ID NO: 96764 - protein, 16 aa, Borrelia burgdorferi B31
APVQEGVQQEGAQQPA

SEQ ID NO: 96765 - protein, 16 aa, Borrelia burgdorferi B31
PVQEGVQQEGAQQPAP

SEQ ID NO: 96766 - protein, 16 aa, Borrelia burgdorferi B31
VQEGVQQEGAQQPAPA

SEQ ID NO: 96767 - protein, 16 aa, Borrelia burgdorferi B31
QEGVQQEGAQQPAPAT

SEQ ID NO: 96768 - protein, 16 aa, Borrelia burgdorferi B31
EGVQQEGAQQPAPATA

SEQ ID NO: 96769 - protein, 16 aa, Borrelia burgdorferi B31
GVQQEGAQQPAPATAP

SEQ ID NO: 96770 - protein, 16 aa, Borrelia burgdorferi B31
VQQEGAQQPAPATAPS

SEQ ID NO: 96771 - protein, 16 aa, Borrelia burgdorferi B31
QQEGAQQPAPATAPSQ

SEQ ID NO: 96772 - protein, 16 aa, Borrelia burgdorferi B31
QEGAQQPAPATAPSQG

SEQ ID NO: 96773 - protein, 16 aa, Borrelia burgdorferi B31
EGAQQPAPATAPSQGG

SEQ ID NO: 96774 - protein, 16 aa, Borrelia burgdorferi B31
GAQQPAPATAPSQGGV

SEQ ID NO: 96775 - protein, 16 aa, Borrelia burgdorferi B31
AQQPAPATAPSQGGVN

SEQ ID NO: 96776 - protein, 16 aa, Borrelia burgdorferi B31
QQPAPATAPSQGGVNS

SEQ ID NO: 96777 - protein, 16 aa, Borrelia burgdorferi B31
QPAPATAPSQGGVNSP

SEQ ID NO: 96778 - protein, 16 aa, Borrelia burgdorferi B31
PAPATAPSQGGVNSPV

SEQ ID NO: 96779 - protein, 16 aa, Borrelia burgdorferi B31
APATAPSQGGVNSPVN

SEQ ID NO: 96780 - protein, 16 aa, Borrelia burgdorferi B31
PATAPSQGGVNSPVNV

SEQ ID NO: 96781 - protein, 16 aa, Borrelia burgdorferi B31
ATAPSQGGVNSPVNVT

SEQ ID NO: 96782 - protein, 16 aa, Borrelia burgdorferi B31
TAPSQGGVNSPVNVTT

SEQ ID NO: 96783 - protein, 16 aa, Borrelia burgdorferi B31
APSQGGVNSPVNVTTT

SEQ ID NO: 96784 - protein, 16 aa, Borrelia burgdorferi B31
PSQGGVNSPVNVTTTV

SEQ ID NO: 96785 - protein, 16 aa, Borrelia burgdorferi B31
SQGGVNSPVNVTTTVD

SEQ ID NO: 96786 - protein, 16 aa, Borrelia burgdorferi B31
QGGVNSPVNVTTTVDA

SEQ ID NO: 96787 - protein, 16 aa, Borrelia burgdorferi B31
GGVNSPVNVTTTVDAN

SEQ ID NO: 96788 - protein, 16 aa, Borrelia burgdorferi B31
GVNSPVNVTTTVDANT

SEQ ID NO: 96789 - protein, 16 aa, Borrelia burgdorferi B31
VNSPVNVTTTVDANTS

SEQ ID NO: 96790 - protein, 16 aa, Borrelia burgdorferi B31
NSPVNVTTTVDANTSL

SEQ ID NO: 96791 - protein, 16 aa, Borrelia burgdorferi B31
SPVNVTTTVDANTSLA

SEQ ID NO: 96792 - protein, 16 aa, Borrelia burgdorferi B31
PVNVTTTVDANTSLAK

SEQ ID NO: 96793 - protein, 16 aa, Borrelia burgdorferi B31
VNVTTTVDANTSLAKI

SEQ ID NO: 96794 - protein, 16 aa, Borrelia burgdorferi B31
NVTTTVDANTSLAKIE

SEQ ID NO: 96795 - protein, 16 aa, Borrelia burgdorferi B31
VTTTVDANTSLAKIEN

SEQ ID NO: 96796 - protein, 16 aa, Borrelia burgdorferi B31
TTTVDANTSLAKIENA

SEQ ID NO: 96797 - protein, 16 aa, Borrelia burgdorferi B31
TTVDANTSLAKIENAI

SEQ ID NO: 96798 - protein, 16 aa, Borrelia burgdorferi B31
TVDANTSLAKIENAIR

SEQ ID NO: 96799 - protein, 16 aa, Borrelia burgdorferi B31
VDANTSLAKIENAIRM

SEQ ID NO: 96800 - protein, 16 aa, Borrelia burgdorferi B31
DANTSLAKIENAIRMI

SEQ ID NO: 96801 - protein, 16 aa, Borrelia burgdorferi B31
ANTSLAKIENAIRMIS

SEQ ID NO: 96802 - protein, 16 aa, Borrelia burgdorferi B31
NTSLAKIENAIRMISD

SEQ ID NO: 96803 - protein, 16 aa, Borrelia burgdorferi B31
TSLAKIENAIRMISDQ

SEQ ID NO: 96804 - protein, 16 aa, Borrelia burgdorferi B31
SLAKIENAIRMISDQR

SEQ ID NO: 96805 - protein, 16 aa, Borrelia burgdorferi B31
LAKIENAIRMISDQRA

SEQ ID NO: 96806 - protein, 16 aa, Borrelia burgdorferi B31
AKIENAIRMISDQRAN

SEQ ID NO: 96807 - protein, 16 aa, Borrelia burgdorferi B31
KIENAIRMISDQRANL

SEQ ID NO: 96808 - protein, 16 aa, Borrelia burgdorferi B31
IENAIRMISDQRANLG

SEQ ID NO: 96809 - protein, 16 aa, Borrelia burgdorferi B31
ENAIRMISDQRANLGA

SEQ ID NO: 96810 - protein, 16 aa, Borrelia burgdorferi B31
NAIRMISDQRANLGAF

SEQ ID NO: 96811 - protein, 16 aa, Borrelia burgdorferi B31
AIRMISDQRANLGAFQ

SEQ ID NO: 96812 - protein, 16 aa, Borrelia burgdorferi B31
IRMISDQRANLGAFQN

SEQ ID NO: 96813 - protein, 16 aa, Borrelia burgdorferi B31
RMISDQRANLGAFQNR

SEQ ID NO: 96814 - protein, 16 aa, Borrelia burgdorferi B31
MISDQRANLGAFQNRL

SEQ ID NO: 96815 - protein, 16 aa, Borrelia burgdorferi B31
ISDQRANLGAFQNRLE

SEQ ID NO: 96816 - protein, 16 aa, Borrelia burgdorferi B31
SDQRANLGAFQNRLES

SEQ ID NO: 96817 - protein, 16 aa, Borrelia burgdorferi B31
DQRANLGAFQNRLESI

SEQ ID NO: 96818 - protein, 16 aa, Borrelia burgdorferi B31
QRANLGAFQNRLESIK

SEQ ID NO: 96819 - protein, 16 aa, Borrelia burgdorferi B31
RANLGAFQNRLESIKN

SEQ ID NO: 96820 - protein, 16 aa, Borrelia burgdorferi B31
ANLGAFQNRLESIKNS

SEQ ID NO: 96821 - protein, 16 aa, Borrelia burgdorferi B31
NLGAFQNRLESIKNST

SEQ ID NO: 96822 - protein, 16 aa, Borrelia burgdorferi B31
LGAFQNRLESIKNSTE

SEQ ID NO: 96823 - protein, 16 aa, Borrelia burgdorferi B31
GAFQNRLESIKNSTEY

SEQ ID NO: 96824 - protein, 16 aa, Borrelia burgdorferi B31
AFQNRLESIKNSTEYA

SEQ ID NO: 96825 - protein, 16 aa, Borrelia burgdorferi B31
FQNRLESIKNSTEYAI

SEQ ID NO: 96826 - protein, 16 aa, Borrelia burgdorferi B31
QNRLESIKNSTEYAIE

SEQ ID NO: 96827 - protein, 16 aa, Borrelia burgdorferi B31
NRLESIKNSTEYAIEN

SEQ ID NO: 96828 - protein, 16 aa, Borrelia burgdorferi B31
RLESIKNSTEYAIENL

SEQ ID NO: 96829 - protein, 16 aa, Borrelia burgdorferi B31
LESIKNSTEYAIENLK

SEQ ID NO: 96830 - protein, 16 aa, Borrelia burgdorferi B31
ESIKNSTEYAIENLKA

SEQ ID NO: 96831 - protein, 16 aa, Borrelia burgdorferi B31
SIKNSTEYAIENLKAS

SEQ ID NO: 96832 - protein, 16 aa, Borrelia burgdorferi B31
IKNSTEYAIENLKASY

SEQ ID NO: 96833 - protein, 16 aa, Borrelia burgdorferi B31
KNSTEYAIENLKASYA

SEQ ID NO: 96834 - protein, 16 aa, Borrelia burgdorferi B31
NSTEYAIENLKASYAQ

SEQ ID NO: 96835 - protein, 16 aa, Borrelia burgdorferi B31
STEYAIENLKASYAQI

SEQ ID NO: 96836 - protein, 16 aa, Borrelia burgdorferi B31
TEYAIENLKASYAQIK

SEQ ID NO: 96837 - protein, 16 aa, Borrelia burgdorferi B31
EYAIENLKASYAQIKD

SEQ ID NO: 96838 - protein, 16 aa, Borrelia burgdorferi B31
YAIENLKASYAQIKDA

SEQ ID NO: 96839 - protein, 16 aa, Borrelia burgdorferi B31
AIENLKASYAQIKDAT

SEQ ID NO: 96840 - protein, 16 aa, Borrelia burgdorferi B31
IENLKASYAQIKDATM

SEQ ID NO: 96841 - protein, 16 aa, Borrelia burgdorferi B31
ENLKASYAQIKDATMT

SEQ ID NO: 96842 - protein, 16 aa, Borrelia burgdorferi B31
NLKASYAQIKDATMTD

SEQ ID NO: 96843 - protein, 16 aa, Borrelia burgdorferi B31
LKASYAQIKDATMTDE

SEQ ID NO: 96844 - protein, 16 aa, Borrelia burgdorferi B31
KASYAQIKDATMTDEV

SEQ ID NO: 96845 - protein, 16 aa, Borrelia burgdorferi B31
ASYAQIKDATMTDEVV

SEQ ID NO: 96846 - protein, 16 aa, Borrelia burgdorferi B31
SYAQIKDATMTDEVVA

SEQ ID NO: 96847 - protein, 16 aa, Borrelia burgdorferi B31
YAQIKDATMTDEVVAA

SEQ ID NO: 96848 - protein, 16 aa, Borrelia burgdorferi B31
AQIKDATMTDEVVAAT

SEQ ID NO: 96849 - protein, 16 aa, Borrelia burgdorferi B31
QIKDATMTDEVVAATT

SEQ ID NO: 96850 - protein, 16 aa, Borrelia burgdorferi B31
IKDATMTDEVVAATTN

SEQ ID NO: 96851 - protein, 16 aa, Borrelia burgdorferi B31
KDATMTDEVVAATTNS

SEQ ID NO: 96852 - protein, 16 aa, Borrelia burgdorferi B31
DATMTDEVVAATTNSI

SEQ ID NO: 96853 - protein, 16 aa, Borrelia burgdorferi B31
ATMTDEVVAATTNSIL

SEQ ID NO: 96854 - protein, 16 aa, Borrelia burgdorferi B31
TMTDEVVAATTNSILT

SEQ ID NO: 96855 - protein, 16 aa, Borrelia burgdorferi B31
MTDEVVAATTNSILTQ

SEQ ID NO: 96856 - protein, 16 aa, Borrelia burgdorferi B31
TDEVVAATTNSILTQS

SEQ ID NO: 96857 - protein, 16 aa, Borrelia burgdorferi B31
DEVVAATTNSILTQSA

SEQ ID NO: 96858 - protein, 16 aa, Borrelia burgdorferi B31
EVVAATTNSILTQSAM

SEQ ID NO: 96859 - protein, 16 aa, Borrelia burgdorferi B31
VVAATTNSILTQSAMA

SEQ ID NO: 96860 - protein, 16 aa, Borrelia burgdorferi B31
VAATTNSILTQSAMAM

SEQ ID NO: 96861 - protein, 16 aa, Borrelia burgdorferi B31
AATTNSILTQSAMAMI

SEQ ID NO: 96862 - protein, 16 aa, Borrelia burgdorferi B31
ATTNSILTQSAMAMIA

SEQ ID NO: 96863 - protein, 16 aa, Borrelia burgdorferi B31
TTNSILTQSAMAMIAQ

SEQ ID NO: 96864 - protein, 16 aa, Borrelia burgdorferi B31
TNSILTQSAMAMIAQA

SEQ ID NO: 96865 - protein, 16 aa, Borrelia burgdorferi B31
NSILTQSAMAMIAQAN

SEQ ID NO: 96866 - protein, 16 aa, Borrelia burgdorferi B31
SILTQSAMAMIAQANQ

SEQ ID NO: 96867 - protein, 16 aa, Borrelia burgdorferi B31
ILTQSAMAMIAQANQV

SEQ ID NO: 96868 - protein, 16 aa, Borrelia burgdorferi B31
LTQSAMAMIAQANQVP

SEQ ID NO: 96869 - protein, 16 aa, Borrelia burgdorferi B31
TQSAMAMIAQANQVPQ

SEQ ID NO: 96870 - protein, 16 aa, Borrelia burgdorferi B31
QSAMAMIAQANQVPQY

SEQ ID NO: 96871 - protein, 16 aa, Borrelia burgdorferi B31
SAMAMIAQANQVPQYV

SEQ ID NO: 96872 - protein, 16 aa, Borrelia burgdorferi B31
AMAMIAQANQVPQYVL

SEQ ID NO: 96873 - protein, 16 aa, Borrelia burgdorferi B31
MAMIAQANQVPQYVLS

SEQ ID NO: 96874 - protein, 16 aa, Borrelia burgdorferi B31
AMIAQANQVPQYVLSL

SEQ ID NO: 96875 - protein, 16 aa, Borrelia burgdorferi B31
MIAQANQVPQYVLSLL

SEQ ID NO: 96876 - protein, 16 aa, Borrelia burgdorferi B31
IAQANQVPQYVLSLLR

SEQ ID NO: 96877 - protein, 13 aa, Borrelia burgdorferi B31
MKLQRSLFLIIFF

SEQ ID NO: 96878 - protein, 13 aa, Borrelia burgdorferi B31
KLQRSLFLIIFFL

SEQ ID NO: 96879 - protein, 13 aa, Borrelia burgdorferi B31
LQRSLFLIIFFLT

SEQ ID NO: 96880 - protein, 13 aa, Borrelia burgdorferi B31
QRSLFLIIFFLTF

SEQ ID NO: 96881 - protein, 13 aa, Borrelia burgdorferi B31
RSLFLIIFFLTFL

SEQ ID NO: 96882 - protein, 13 aa, Borrelia burgdorferi B31
SLFLIIFFLTFLC

SEQ ID NO: 96883 - protein, 13 aa, Borrelia burgdorferi B31
LFLIIFFLTFLCC

SEQ ID NO: 96884 - protein, 13 aa, Borrelia burgdorferi B31
FLIIFFLTFLCCN

SEQ ID NO: 96885 - protein, 13 aa, Borrelia burgdorferi B31
LIIFFLTFLCCNN

SEQ ID NO: 96886 - protein, 13 aa, Borrelia burgdorferi B31
IIFFLTFLCCNNK

SEQ ID NO: 96887 - protein, 13 aa, Borrelia burgdorferi B31
IFFLTFLCCNNKE

SEQ ID NO: 96888 - protein, 13 aa, Borrelia burgdorferi B31
FFLTFLCCNNKER

SEQ ID NO: 96889 - protein, 13 aa, Borrelia burgdorferi B31
FLTFLCCNNKERK

SEQ ID NO: 96890 - protein, 13 aa, Borrelia burgdorferi B31
LTFLCCNNKERKE

SEQ ID NO: 96891 - protein, 13 aa, Borrelia burgdorferi B31
TFLCCNNKERKEG

SEQ ID NO: 96892 - protein, 13 aa, Borrelia burgdorferi B31
FLCCNNKERKEGV

SEQ ID NO: 96893 - protein, 13 aa, Borrelia burgdorferi B31
LCCNNKERKEGVS

SEQ ID NO: 96894 - protein, 13 aa, Borrelia burgdorferi B31
CCNNKERKEGVSF

SEQ ID NO: 96895 - protein, 13 aa, Borrelia burgdorferi B31
CNNKERKEGVSFK

SEQ ID NO: 96896 - protein, 13 aa, Borrelia burgdorferi B31
NNKERKEGVSFKI

SEQ ID NO: 96897 - protein, 13 aa, Borrelia burgdorferi B31
NKERKEGVSFKIS

SEQ ID NO: 96898 - protein, 13 aa, Borrelia burgdorferi B31
KERKEGVSFKISL

SEQ ID NO: 96899 - protein, 13 aa, Borrelia burgdorferi B31
ERKEGVSFKISLG

SEQ ID NO: 96900 - protein, 13 aa, Borrelia burgdorferi B31
RKEGVSFKISLGA

SEQ ID NO: 96901 - protein, 13 aa, Borrelia burgdorferi B31
KEGVSFKISLGAE

SEQ ID NO: 96902 - protein, 13 aa, Borrelia burgdorferi B31
EGVSFKISLGAEP

SEQ ID NO: 96903 - protein, 13 aa, Borrelia burgdorferi B31
GVSFKISLGAEPS

SEQ ID NO: 96904 - protein, 13 aa, Borrelia burgdorferi B31
VSFKISLGAEPSS

SEQ ID NO: 96905 - protein, 13 aa, Borrelia burgdorferi B31
SFKISLGAEPSSL

SEQ ID NO: 96906 - protein, 13 aa, Borrelia burgdorferi B31
FKISLGAEPSSLD

SEQ ID NO: 96907 - protein, 13 aa, Borrelia burgdorferi B31
KISLGAEPSSLDP

SEQ ID NO: 96908 - protein, 13 aa, Borrelia burgdorferi B31
ISLGAEPSSLDPQ

SEQ ID NO: 96909 - protein, 13 aa, Borrelia burgdorferi B31
SLGAEPSSLDPQL

SEQ ID NO: 96910 - protein, 13 aa, Borrelia burgdorferi B31
LGAEPSSLDPQLA

SEQ ID NO: 96911 - protein, 13 aa, Borrelia burgdorferi B31
GAEPSSLDPQLAE

SEQ ID NO: 96912 - protein, 13 aa, Borrelia burgdorferi B31
AEPSSLDPQLAED

SEQ ID NO: 96913 - protein, 13 aa, Borrelia burgdorferi B31
EPSSLDPQLAEDN

SEQ ID NO: 96914 - protein, 13 aa, Borrelia burgdorferi B31
PSSLDPQLAEDNV

SEQ ID NO: 96915 - protein, 13 aa, Borrelia burgdorferi B31
SSLDPQLAEDNVA

SEQ ID NO: 96916 - protein, 13 aa, Borrelia burgdorferi B31
SLDPQLAEDNVAS

SEQ ID NO: 96917 - protein, 13 aa, Borrelia burgdorferi B31
LDPQLAEDNVASK

SEQ ID NO: 96918 - protein, 13 aa, Borrelia burgdorferi B31
DPQLAEDNVASKM

SEQ ID NO: 96919 - protein, 13 aa, Borrelia burgdorferi B31
PQLAEDNVASKMI

SEQ ID NO: 96920 - protein, 13 aa, Borrelia burgdorferi B31
QLAEDNVASKMID

SEQ ID NO: 96921 - protein, 13 aa, Borrelia burgdorferi B31
LAEDNVASKMIDT

SEQ ID NO: 96922 - protein, 13 aa, Borrelia burgdorferi B31
AEDNVASKMIDTM

SEQ ID NO: 96923 - protein, 13 aa, Borrelia burgdorferi B31
EDNVASKMIDTMF

SEQ ID NO: 96924 - protein, 13 aa, Borrelia burgdorferi B31
DNVASKMIDTMFR

SEQ ID NO: 96925 - protein, 13 aa, Borrelia burgdorferi B31
NVASKMIDTMFRG

SEQ ID NO: 96926 - protein, 13 aa, Borrelia burgdorferi B31
VASKMIDTMFRGI

SEQ ID NO: 96927 - protein, 13 aa, Borrelia burgdorferi B31
ASKMIDTMFRGIV

SEQ ID NO: 96928 - protein, 13 aa, Borrelia burgdorferi B31
SKMIDTMFRGIVT

SEQ ID NO: 96929 - protein, 13 aa, Borrelia burgdorferi B31
KMIDTMFRGIVTG

SEQ ID NO: 96930 - protein, 13 aa, Borrelia burgdorferi B31
MIDTMFRGIVTGD

SEQ ID NO: 96931 - protein, 13 aa, Borrelia burgdorferi B31
IDTMFRGIVTGDP

SEQ ID NO: 96932 - protein, 13 aa, Borrelia burgdorferi B31
DTMFRGIVTGDPN

SEQ ID NO: 96933 - protein, 13 aa, Borrelia burgdorferi B31
TMFRGIVTGDPNT

SEQ ID NO: 96934 - protein, 13 aa, Borrelia burgdorferi B31
MFRGIVTGDPNTG

SEQ ID NO: 96935 - protein, 13 aa, Borrelia burgdorferi B31
FRGIVTGDPNTGG

SEQ ID NO: 96936 - protein, 13 aa, Borrelia burgdorferi B31
RGIVTGDPNTGGN

SEQ ID NO: 96937 - protein, 13 aa, Borrelia burgdorferi B31
GIVTGDPNTGGNK

SEQ ID NO: 96938 - protein, 13 aa, Borrelia burgdorferi B31
IVTGDPNTGGNKP

SEQ ID NO: 96939 - protein, 13 aa, Borrelia burgdorferi B31
VTGDPNTGGNKPG

SEQ ID NO: 96940 - protein, 13 aa, Borrelia burgdorferi B31
TGDPNTGGNKPGL

SEQ ID NO: 96941 - protein, 13 aa, Borrelia burgdorferi B31
GDPNTGGNKPGLA

SEQ ID NO: 96942 - protein, 13 aa, Borrelia burgdorferi B31
DPNTGGNKPGLAK

SEQ ID NO: 96943 - protein, 13 aa, Borrelia burgdorferi B31
PNTGGNKPGLAKG

SEQ ID NO: 96944 - protein, 13 aa, Borrelia burgdorferi B31
NTGGNKPGLAKGW

SEQ ID NO: 96945 - protein, 13 aa, Borrelia burgdorferi B31
TGGNKPGLAKGWD

SEQ ID NO: 96946 - protein, 13 aa, Borrelia burgdorferi B31
GGNKPGLAKGWDI

SEQ ID NO: 96947 - protein, 13 aa, Borrelia burgdorferi B31
GNKPGLAKGWDIS

SEQ ID NO: 96948 - protein, 13 aa, Borrelia burgdorferi B31
NKPGLAKGWDISS

SEQ ID NO: 96949 - protein, 13 aa, Borrelia burgdorferi B31
KPGLAKGWDISSD

SEQ ID NO: 96950 - protein, 13 aa, Borrelia burgdorferi B31
PGLAKGWDISSDG

SEQ ID NO: 96951 - protein, 13 aa, Borrelia burgdorferi B31
GLAKGWDISSDGT

SEQ ID NO: 96952 - protein, 13 aa, Borrelia burgdorferi B31
LAKGWDISSDGTV

SEQ ID NO: 96953 - protein, 13 aa, Borrelia burgdorferi B31
AKGWDISSDGTVY

SEQ ID NO: 96954 - protein, 13 aa, Borrelia burgdorferi B31
KGWDISSDGTVYT

SEQ ID NO: 96955 - protein, 13 aa, Borrelia burgdorferi B31
GWDISSDGTVYTF

SEQ ID NO: 96956 - protein, 13 aa, Borrelia burgdorferi B31
WDISSDGTVYTFN

SEQ ID NO: 96957 - protein, 13 aa, Borrelia burgdorferi B31
DISSDGTVYTFNL

SEQ ID NO: 96958 - protein, 13 aa, Borrelia burgdorferi B31
ISSDGTVYTFNLR

SEQ ID NO: 96959 - protein, 13 aa, Borrelia burgdorferi B31
SSDGTVYTFNLRE

SEQ ID NO: 96960 - protein, 13 aa, Borrelia burgdorferi B31
SDGTVYTFNLREK

SEQ ID NO: 96961 - protein, 13 aa, Borrelia burgdorferi B31
DGTVYTFNLREKI

SEQ ID NO: 96962 - protein, 13 aa, Borrelia burgdorferi B31
GTVYTFNLREKIT

SEQ ID NO: 96963 - protein, 13 aa, Borrelia burgdorferi B31
TVYTFNLREKITW

SEQ ID NO: 96964 - protein, 13 aa, Borrelia burgdorferi B31
VYTFNLREKITWS

SEQ ID NO: 96965 - protein, 13 aa, Borrelia burgdorferi B31
YTFNLREKITWSD

SEQ ID NO: 96966 - protein, 13 aa, Borrelia burgdorferi B31
TFNLREKITWSDG

SEQ ID NO: 96967 - protein, 13 aa, Borrelia burgdorferi B31
FNLREKITWSDGV

SEQ ID NO: 96968 - protein, 13 aa, Borrelia burgdorferi B31
NLREKITWSDGVA

SEQ ID NO: 96969 - protein, 13 aa, Borrelia burgdorferi B31
LREKITWSDGVAI

SEQ ID NO: 96970 - protein, 13 aa, Borrelia burgdorferi B31
REKITWSDGVAIT

SEQ ID NO: 96971 - protein, 13 aa, Borrelia burgdorferi B31
EKITWSDGVAITA

SEQ ID NO: 96972 - protein, 13 aa, Borrelia burgdorferi B31
KITWSDGVAITAE

SEQ ID NO: 96973 - protein, 13 aa, Borrelia burgdorferi B31
ITWSDGVAITAEG

SEQ ID NO: 96974 - protein, 13 aa, Borrelia burgdorferi B31
TWSDGVAITAEGI

SEQ ID NO: 96975 - protein, 13 aa, Borrelia burgdorferi B31
WSDGVAITAEGIR

SEQ ID NO: 96976 - protein, 13 aa, Borrelia burgdorferi B31
SDGVAITAEGIRK

SEQ ID NO: 96977 - protein, 13 aa, Borrelia burgdorferi B31
DGVAITAEGIRKS

SEQ ID NO: 96978 - protein, 13 aa, Borrelia burgdorferi B31
GVAITAEGIRKSY

SEQ ID NO: 96979 - protein, 13 aa, Borrelia burgdorferi B31
VAITAEGIRKSYL

SEQ ID NO: 96980 - protein, 13 aa, Borrelia burgdorferi B31
AITAEGIRKSYLR

SEQ ID NO: 96981 - protein, 13 aa, Borrelia burgdorferi B31
ITAEGIRKSYLRI

SEQ ID NO: 96982 - protein, 13 aa, Borrelia burgdorferi B31
TAEGIRKSYLRIL

SEQ ID NO: 96983 - protein, 13 aa, Borrelia burgdorferi B31
AEGIRKSYLRILN

SEQ ID NO: 96984 - protein, 13 aa, Borrelia burgdorferi B31
EGIRKSYLRILNK

SEQ ID NO: 96985 - protein, 13 aa, Borrelia burgdorferi B31
GIRKSYLRILNKE

SEQ ID NO: 96986 - protein, 13 aa, Borrelia burgdorferi B31
IRKSYLRILNKET

SEQ ID NO: 96987 - protein, 13 aa, Borrelia burgdorferi B31
RKSYLRILNKETG

SEQ ID NO: 96988 - protein, 13 aa, Borrelia burgdorferi B31
KSYLRILNKETGS

SEQ ID NO: 96989 - protein, 13 aa, Borrelia burgdorferi B31
SYLRILNKETGSK

SEQ ID NO: 96990 - protein, 13 aa, Borrelia burgdorferi B31
YLRILNKETGSKY

SEQ ID NO: 96991 - protein, 13 aa, Borrelia burgdorferi B31
LRILNKETGSKYV

SEQ ID NO: 96992 - protein, 13 aa, Borrelia burgdorferi B31
RILNKETGSKYVE

SEQ ID NO: 96993 - protein, 13 aa, Borrelia burgdorferi B31
ILNKETGSKYVEM

SEQ ID NO: 96994 - protein, 13 aa, Borrelia burgdorferi B31
LNKETGSKYVEMV

SEQ ID NO: 96995 - protein, 13 aa, Borrelia burgdorferi B31
NKETGSKYVEMVK

SEQ ID NO: 96996 - protein, 13 aa, Borrelia burgdorferi B31
KETGSKYVEMVKS

SEQ ID NO: 96997 - protein, 13 aa, Borrelia burgdorferi B31
ETGSKYVEMVKSV

SEQ ID NO: 96998 - protein, 13 aa, Borrelia burgdorferi B31
TGSKYVEMVKSVI

SEQ ID NO: 96999 - protein, 13 aa, Borrelia burgdorferi B31
GSKYVEMVKSVIK

SEQ ID NO: 97000 - protein, 13 aa, Borrelia burgdorferi B31
SKYVEMVKSVIKN

SEQ ID NO: 97001 - protein, 13 aa, Borrelia burgdorferi B31
KYVEMVKSVIKNG

SEQ ID NO: 97002 - protein, 13 aa, Borrelia burgdorferi B31
YVEMVKSVIKNGQ

SEQ ID NO: 97003 - protein, 13 aa, Borrelia burgdorferi B31
VEMVKSVIKNGQK

SEQ ID NO: 97004 - protein, 13 aa, Borrelia burgdorferi B31
EMVKSVIKNGQKY

SEQ ID NO: 97005 - protein, 13 aa, Borrelia burgdorferi B31
MVKSVIKNGQKYF

SEQ ID NO: 97006 - protein, 13 aa, Borrelia burgdorferi B31
VKSVIKNGQKYFD

SEQ ID NO: 97007 - protein, 13 aa, Borrelia burgdorferi B31
KSVIKNGQKYFDG

SEQ ID NO: 97008 - protein, 13 aa, Borrelia burgdorferi B31
SVIKNGQKYFDGQ

SEQ ID NO: 97009 - protein, 13 aa, Borrelia burgdorferi B31
VIKNGQKYFDGQV

SEQ ID NO: 97010 - protein, 13 aa, Borrelia burgdorferi B31
IKNGQKYFDGQVT

SEQ ID NO: 97011 - protein, 13 aa, Borrelia burgdorferi B31
KNGQKYFDGQVTD

SEQ ID NO: 97012 - protein, 13 aa, Borrelia burgdorferi B31
NGQKYFDGQVTDS

SEQ ID NO: 97013 - protein, 13 aa, Borrelia burgdorferi B31
GQKYFDGQVTDSE

SEQ ID NO: 97014 - protein, 13 aa, Borrelia burgdorferi B31
QKYFDGQVTDSEL

SEQ ID NO: 97015 - protein, 13 aa, Borrelia burgdorferi B31
KYFDGQVTDSELG

SEQ ID NO: 97016 - protein, 13 aa, Borrelia burgdorferi B31
YFDGQVTDSELGI

SEQ ID NO: 97017 - protein, 13 aa, Borrelia burgdorferi B31
FDGQVTDSELGIR

SEQ ID NO: 97018 - protein, 13 aa, Borrelia burgdorferi B31
DGQVTDSELGIRA

SEQ ID NO: 97019 - protein, 13 aa, Borrelia burgdorferi B31
GQVTDSELGIRAI

SEQ ID NO: 97020 - protein, 13 aa, Borrelia burgdorferi B31
QVTDSELGIRAID

SEQ ID NO: 97021 - protein, 13 aa, Borrelia burgdorferi B31
VTDSELGIRAIDE

SEQ ID NO: 97022 - protein, 13 aa, Borrelia burgdorferi B31
TDSELGIRAIDEK

SEQ ID NO: 97023 - protein, 13 aa, Borrelia burgdorferi B31
DSELGIRAIDEKT

SEQ ID NO: 97024 - protein, 13 aa, Borrelia burgdorferi B31
SELGIRAIDEKTL

SEQ ID NO: 97025 - protein, 13 aa, Borrelia burgdorferi B31
ELGIRAIDEKTLE

SEQ ID NO: 97026 - protein, 13 aa, Borrelia burgdorferi B31
LGIRAIDEKTLEI

SEQ ID NO: 97027 - protein, 13 aa, Borrelia burgdorferi B31
GIRAIDEKTLEIT

SEQ ID NO: 97028 - protein, 13 aa, Borrelia burgdorferi B31
IRAIDEKTLEITL

SEQ ID NO: 97029 - protein, 13 aa, Borrelia burgdorferi B31
RAIDEKTLEITLE

SEQ ID NO: 97030 - protein, 13 aa, Borrelia burgdorferi B31
AIDEKTLEITLES

SEQ ID NO: 97031 - protein, 13 aa, Borrelia burgdorferi B31
IDEKTLEITLESP

SEQ ID NO: 97032 - protein, 13 aa, Borrelia burgdorferi B31
DEKTLEITLESPK

SEQ ID NO: 97033 - protein, 13 aa, Borrelia burgdorferi B31
EKTLEITLESPKP

SEQ ID NO: 97034 - protein, 13 aa, Borrelia burgdorferi B31
KTLEITLESPKPY

SEQ ID NO: 97035 - protein, 13 aa, Borrelia burgdorferi B31
TLEITLESPKPYF

SEQ ID NO: 97036 - protein, 13 aa, Borrelia burgdorferi B31
LEITLESPKPYFI

SEQ ID NO: 97037 - protein, 13 aa, Borrelia burgdorferi B31
EITLESPKPYFID

SEQ ID NO: 97038 - protein, 13 aa, Borrelia burgdorferi B31
ITLESPKPYFIDM

SEQ ID NO: 97039 - protein, 13 aa, Borrelia burgdorferi B31
TLESPKPYFIDML

SEQ ID NO: 97040 - protein, 13 aa, Borrelia burgdorferi B31
LESPKPYFIDMLV

SEQ ID NO: 97041 - protein, 13 aa, Borrelia burgdorferi B31
ESPKPYFIDMLVH

SEQ ID NO: 97042 - protein, 13 aa, Borrelia burgdorferi B31
SPKPYFIDMLVHQ

SEQ ID NO: 97043 - protein, 13 aa, Borrelia burgdorferi B31
PKPYFIDMLVHQS

SEQ ID NO: 97044 - protein, 13 aa, Borrelia burgdorferi B31
KPYFIDMLVHQSF

SEQ ID NO: 97045 - protein, 13 aa, Borrelia burgdorferi B31
PYFIDMLVHQSFI

SEQ ID NO: 97046 - protein, 13 aa, Borrelia burgdorferi B31
YFIDMLVHQSFIP

SEQ ID NO: 97047 - protein, 13 aa, Borrelia burgdorferi B31
FIDMLVHQSFIPV

SEQ ID NO: 97048 - protein, 13 aa, Borrelia burgdorferi B31
IDMLVHQSFIPVP

SEQ ID NO: 97049 - protein, 13 aa, Borrelia burgdorferi B31
DMLVHQSFIPVPV

SEQ ID NO: 97050 - protein, 13 aa, Borrelia burgdorferi B31
MLVHQSFIPVPVH

SEQ ID NO: 97051 - protein, 13 aa, Borrelia burgdorferi B31
LVHQSFIPVPVHV

SEQ ID NO: 97052 - protein, 13 aa, Borrelia burgdorferi B31
VHQSFIPVPVHVT

SEQ ID NO: 97053 - protein, 13 aa, Borrelia burgdorferi B31
HQSFIPVPVHVTE

SEQ ID NO: 97054 - protein, 13 aa, Borrelia burgdorferi B31
QSFIPVPVHVTEK

SEQ ID NO: 97055 - protein, 13 aa, Borrelia burgdorferi B31
SFIPVPVHVTEKY

SEQ ID NO: 97056 - protein, 13 aa, Borrelia burgdorferi B31
FIPVPVHVTEKYG

SEQ ID NO: 97057 - protein, 13 aa, Borrelia burgdorferi B31
IPVPVHVTEKYGQ

SEQ ID NO: 97058 - protein, 13 aa, Borrelia burgdorferi B31
PVPVHVTEKYGQN

SEQ ID NO: 97059 - protein, 13 aa, Borrelia burgdorferi B31
VPVHVTEKYGQNW

SEQ ID NO: 97060 - protein, 13 aa, Borrelia burgdorferi B31
PVHVTEKYGQNWT

SEQ ID NO: 97061 - protein, 13 aa, Borrelia burgdorferi B31
VHVTEKYGQNWTS

SEQ ID NO: 97062 - protein, 13 aa, Borrelia burgdorferi B31
HVTEKYGQNWTSP

SEQ ID NO: 97063 - protein, 13 aa, Borrelia burgdorferi B31
VTEKYGQNWTSPE

SEQ ID NO: 97064 - protein, 13 aa, Borrelia burgdorferi B31
TEKYGQNWTSPEN

SEQ ID NO: 97065 - protein, 13 aa, Borrelia burgdorferi B31
EKYGQNWTSPENM

SEQ ID NO: 97066 - protein, 13 aa, Borrelia burgdorferi B31
KYGQNWTSPENMV

SEQ ID NO: 97067 - protein, 13 aa, Borrelia burgdorferi B31
YGQNWTSPENMVT

SEQ ID NO: 97068 - protein, 13 aa, Borrelia burgdorferi B31
GQNWTSPENMVTS

SEQ ID NO: 97069 - protein, 13 aa, Borrelia burgdorferi B31
QNWTSPENMVTSG

SEQ ID NO: 97070 - protein, 13 aa, Borrelia burgdorferi B31
NWTSPENMVTSGP

SEQ ID NO: 97071 - protein, 13 aa, Borrelia burgdorferi B31
WTSPENMVTSGPF

SEQ ID NO: 97072 - protein, 13 aa, Borrelia burgdorferi B31
TSPENMVTSGPFK

SEQ ID NO: 97073 - protein, 13 aa, Borrelia burgdorferi B31
SPENMVTSGPFKL

SEQ ID NO: 97074 - protein, 13 aa, Borrelia burgdorferi B31
PENMVTSGPFKLK

SEQ ID NO: 97075 - protein, 13 aa, Borrelia burgdorferi B31
ENMVTSGPFKLKE

SEQ ID NO: 97076 - protein, 13 aa, Borrelia burgdorferi B31
NMVTSGPFKLKER

SEQ ID NO: 97077 - protein, 13 aa, Borrelia burgdorferi B31
MVTSGPFKLKERI

SEQ ID NO: 97078 - protein, 13 aa, Borrelia burgdorferi B31
VTSGPFKLKERIP

SEQ ID NO: 97079 - protein, 13 aa, Borrelia burgdorferi B31
TSGPFKLKERIPN

SEQ ID NO: 97080 - protein, 13 aa, Borrelia burgdorferi B31
SGPFKLKERIPNE

SEQ ID NO: 97081 - protein, 13 aa, Borrelia burgdorferi B31
GPFKLKERIPNEK

SEQ ID NO: 97082 - protein, 13 aa, Borrelia burgdorferi B31
PFKLKERIPNEKY

SEQ ID NO: 97083 - protein, 13 aa, Borrelia burgdorferi B31
FKLKERIPNEKYV

SEQ ID NO: 97084 - protein, 13 aa, Borrelia burgdorferi B31
KLKERIPNEKYVF

SEQ ID NO: 97085 - protein, 13 aa, Borrelia burgdorferi B31
LKERIPNEKYVFE

SEQ ID NO: 97086 - protein, 13 aa, Borrelia burgdorferi B31
KERIPNEKYVFEK

SEQ ID NO: 97087 - protein, 13 aa, Borrelia burgdorferi B31
ERIPNEKYVFEKN

SEQ ID NO: 97088 - protein, 13 aa, Borrelia burgdorferi B31
RIPNEKYVFEKNN

SEQ ID NO: 97089 - protein, 13 aa, Borrelia burgdorferi B31
IPNEKYVFEKNNK

SEQ ID NO: 97090 - protein, 13 aa, Borrelia burgdorferi B31
PNEKYVFEKNNKY

SEQ ID NO: 97091 - protein, 13 aa, Borrelia burgdorferi B31
NEKYVFEKNNKYY

SEQ ID NO: 97092 - protein, 13 aa, Borrelia burgdorferi B31
EKYVFEKNNKYYD

SEQ ID NO: 97093 - protein, 13 aa, Borrelia burgdorferi B31
KYVFEKNNKYYDS

SEQ ID NO: 97094 - protein, 13 aa, Borrelia burgdorferi B31
YVFEKNNKYYDSN

SEQ ID NO: 97095 - protein, 13 aa, Borrelia burgdorferi B31
VFEKNNKYYDSNE

SEQ ID NO: 97096 - protein, 13 aa, Borrelia burgdorferi B31
FEKNNKYYDSNEV

SEQ ID NO: 97097 - protein, 13 aa, Borrelia burgdorferi B31
EKNNKYYDSNEVE

SEQ ID NO: 97098 - protein, 13 aa, Borrelia burgdorferi B31
KNNKYYDSNEVEL

SEQ ID NO: 97099 - protein, 13 aa, Borrelia burgdorferi B31
NNKYYDSNEVELE

SEQ ID NO: 97100 - protein, 13 aa, Borrelia burgdorferi B31
NKYYDSNEVELEE

SEQ ID NO: 97101 - protein, 13 aa, Borrelia burgdorferi B31
KYYDSNEVELEEI

SEQ ID NO: 97102 - protein, 13 aa, Borrelia burgdorferi B31
YYDSNEVELEEIT

SEQ ID NO: 97103 - protein, 13 aa, Borrelia burgdorferi B31
YDSNEVELEEITF

SEQ ID NO: 97104 - protein, 13 aa, Borrelia burgdorferi B31
DSNEVELEEITFY

SEQ ID NO: 97105 - protein, 13 aa, Borrelia burgdorferi B31
SNEVELEEITFYT

SEQ ID NO: 97106 - protein, 13 aa, Borrelia burgdorferi B31
NEVELEEITFYTT

SEQ ID NO: 97107 - protein, 13 aa, Borrelia burgdorferi B31
EVELEEITFYTTN

SEQ ID NO: 97108 - protein, 13 aa, Borrelia burgdorferi B31
VELEEITFYTTND

SEQ ID NO: 97109 - protein, 13 aa, Borrelia burgdorferi B31
ELEEITFYTTNDS

SEQ ID NO: 97110 - protein, 13 aa, Borrelia burgdorferi B31
LEEITFYTTNDSS

SEQ ID NO: 97111 - protein, 13 aa, Borrelia burgdorferi B31
EEITFYTTNDSST

SEQ ID NO: 97112 - protein, 13 aa, Borrelia burgdorferi B31
EITFYTTNDSSTA

SEQ ID NO: 97113 - protein, 13 aa, Borrelia burgdorferi B31
ITFYTTNDSSTAY

SEQ ID NO: 97114 - protein, 13 aa, Borrelia burgdorferi B31
TFYTTNDSSTAYK

SEQ ID NO: 97115 - protein, 13 aa, Borrelia burgdorferi B31
FYTTNDSSTAYKM

SEQ ID NO: 97116 - protein, 13 aa, Borrelia burgdorferi B31
YTTNDSSTAYKMY

SEQ ID NO: 97117 - protein, 13 aa, Borrelia burgdorferi B31
TTNDSSTAYKMYE

SEQ ID NO: 97118 - protein, 13 aa, Borrelia burgdorferi B31
TNDSSTAYKMYEN

SEQ ID NO: 97119 - protein, 13 aa, Borrelia burgdorferi B31
NDSSTAYKMYENE

SEQ ID NO: 97120 - protein, 13 aa, Borrelia burgdorferi B31
DSSTAYKMYENEE

SEQ ID NO: 97121 - protein, 13 aa, Borrelia burgdorferi B31
SSTAYKMYENEEL

SEQ ID NO: 97122 - protein, 13 aa, Borrelia burgdorferi B31
STAYKMYENEELD

SEQ ID NO: 97123 - protein, 13 aa, Borrelia burgdorferi B31
TAYKMYENEELDA

SEQ ID NO: 97124 - protein, 13 aa, Borrelia burgdorferi B31
AYKMYENEELDAI

SEQ ID NO: 97125 - protein, 13 aa, Borrelia burgdorferi B31
YKMYENEELDAIF

SEQ ID NO: 97126 - protein, 13 aa, Borrelia burgdorferi B31
KMYENEELDAIFG

SEQ ID NO: 97127 - protein, 13 aa, Borrelia burgdorferi B31
MYENEELDAIFGS

SEQ ID NO: 97128 - protein, 13 aa, Borrelia burgdorferi B31
YENEELDAIFGSI

SEQ ID NO: 97129 - protein, 13 aa, Borrelia burgdorferi B31
ENEELDAIFGSIP

SEQ ID NO: 97130 - protein, 13 aa, Borrelia burgdorferi B31
NEELDAIFGSIPP

SEQ ID NO: 97131 - protein, 13 aa, Borrelia burgdorferi B31
EELDAIFGSIPPD

SEQ ID NO: 97132 - protein, 13 aa, Borrelia burgdorferi B31
ELDAIFGSIPPDL

SEQ ID NO: 97133 - protein, 13 aa, Borrelia burgdorferi B31
LDAIFGSIPPDLI

SEQ ID NO: 97134 - protein, 13 aa, Borrelia burgdorferi B31
DAIFGSIPPDLIK

SEQ ID NO: 97135 - protein, 13 aa, Borrelia burgdorferi B31
AIFGSIPPDLIKN

SEQ ID NO: 97136 - protein, 13 aa, Borrelia burgdorferi B31
IFGSIPPDLIKNL

SEQ ID NO: 97137 - protein, 13 aa, Borrelia burgdorferi B31
FGSIPPDLIKNLK

SEQ ID NO: 97138 - protein, 13 aa, Borrelia burgdorferi B31
GSIPPDLIKNLKL

SEQ ID NO: 97139 - protein, 13 aa, Borrelia burgdorferi B31
SIPPDLIKNLKLR

SEQ ID NO: 97140 - protein, 13 aa, Borrelia burgdorferi B31
IPPDLIKNLKLRS

SEQ ID NO: 97141 - protein, 13 aa, Borrelia burgdorferi B31
PPDLIKNLKLRSD

SEQ ID NO: 97142 - protein, 13 aa, Borrelia burgdorferi B31
PDLIKNLKLRSDY

SEQ ID NO: 97143 - protein, 13 aa, Borrelia burgdorferi B31
DLIKNLKLRSDYY

SEQ ID NO: 97144 - protein, 13 aa, Borrelia burgdorferi B31
LIKNLKLRSDYYS

SEQ ID NO: 97145 - protein, 13 aa, Borrelia burgdorferi B31
IKNLKLRSDYYSS

SEQ ID NO: 97146 - protein, 13 aa, Borrelia burgdorferi B31
KNLKLRSDYYSSA

SEQ ID NO: 97147 - protein, 13 aa, Borrelia burgdorferi B31
NLKLRSDYYSSAV

SEQ ID NO: 97148 - protein, 13 aa, Borrelia burgdorferi B31
LKLRSDYYSSAVN

SEQ ID NO: 97149 - protein, 13 aa, Borrelia burgdorferi B31
KLRSDYYSSAVNA

SEQ ID NO: 97150 - protein, 13 aa, Borrelia burgdorferi B31
LRSDYYSSAVNAI

SEQ ID NO: 97151 - protein, 13 aa, Borrelia burgdorferi B31
RSDYYSSAVNAIY

SEQ ID NO: 97152 - protein, 13 aa, Borrelia burgdorferi B31
SDYYSSAVNAIYF

SEQ ID NO: 97153 - protein, 13 aa, Borrelia burgdorferi B31
DYYSSAVNAIYFY

SEQ ID NO: 97154 - protein, 13 aa, Borrelia burgdorferi B31
YYSSAVNAIYFYA

SEQ ID NO: 97155 - protein, 13 aa, Borrelia burgdorferi B31
YSSAVNAIYFYAF

SEQ ID NO: 97156 - protein, 13 aa, Borrelia burgdorferi B31
SSAVNAIYFYAFN

SEQ ID NO: 97157 - protein, 13 aa, Borrelia burgdorferi B31
SAVNAIYFYAFNT

SEQ ID NO: 97158 - protein, 13 aa, Borrelia burgdorferi B31
AVNAIYFYAFNTH

SEQ ID NO: 97159 - protein, 13 aa, Borrelia burgdorferi B31
VNAIYFYAFNTHI

SEQ ID NO: 97160 - protein, 13 aa, Borrelia burgdorferi B31
NAIYFYAFNTHIK

SEQ ID NO: 97161 - protein, 13 aa, Borrelia burgdorferi B31
AIYFYAFNTHIKP

SEQ ID NO: 97162 - protein, 13 aa, Borrelia burgdorferi B31
IYFYAFNTHIKPL

SEQ ID NO: 97163 - protein, 13 aa, Borrelia burgdorferi B31
YFYAFNTHIKPLD

SEQ ID NO: 97164 - protein, 13 aa, Borrelia burgdorferi B31
FYAFNTHIKPLDN

SEQ ID NO: 97165 - protein, 13 aa, Borrelia burgdorferi B31
YAFNTHIKPLDNV

SEQ ID NO: 97166 - protein, 13 aa, Borrelia burgdorferi B31
AFNTHIKPLDNVK

SEQ ID NO: 97167 - protein, 13 aa, Borrelia burgdorferi B31
FNTHIKPLDNVKI

SEQ ID NO: 97168 - protein, 13 aa, Borrelia burgdorferi B31
NTHIKPLDNVKIR

SEQ ID NO: 97169 - protein, 13 aa, Borrelia burgdorferi B31
THIKPLDNVKIRK

SEQ ID NO: 97170 - protein, 13 aa, Borrelia burgdorferi B31
HIKPLDNVKIRKA

SEQ ID NO: 97171 - protein, 13 aa, Borrelia burgdorferi B31
IKPLDNVKIRKAL

SEQ ID NO: 97172 - protein, 13 aa, Borrelia burgdorferi B31
KPLDNVKIRKALT

SEQ ID NO: 97173 - protein, 13 aa, Borrelia burgdorferi B31
PLDNVKIRKALTL

SEQ ID NO: 97174 - protein, 13 aa, Borrelia burgdorferi B31
LDNVKIRKALTLA

SEQ ID NO: 97175 - protein, 13 aa, Borrelia burgdorferi B31
DNVKIRKALTLAI

SEQ ID NO: 97176 - protein, 13 aa, Borrelia burgdorferi B31
NVKIRKALTLAID

SEQ ID NO: 97177 - protein, 13 aa, Borrelia burgdorferi B31
VKIRKALTLAIDR

SEQ ID NO: 97178 - protein, 13 aa, Borrelia burgdorferi B31
KIRKALTLAIDRE

SEQ ID NO: 97179 - protein, 13 aa, Borrelia burgdorferi B31
IRKALTLAIDRET

SEQ ID NO: 97180 - protein, 13 aa, Borrelia burgdorferi B31
RKALTLAIDRETL

SEQ ID NO: 97181 - protein, 13 aa, Borrelia burgdorferi B31
KALTLAIDRETLT

SEQ ID NO: 97182 - protein, 13 aa, Borrelia burgdorferi B31
ALTLAIDRETLTY

SEQ ID NO: 97183 - protein, 13 aa, Borrelia burgdorferi B31
LTLAIDRETLTYK

SEQ ID NO: 97184 - protein, 13 aa, Borrelia burgdorferi B31
TLAIDRETLTYKV

SEQ ID NO: 97185 - protein, 13 aa, Borrelia burgdorferi B31
LAIDRETLTYKVL

SEQ ID NO: 97186 - protein, 13 aa, Borrelia burgdorferi B31
AIDRETLTYKVLD

SEQ ID NO: 97187 - protein, 13 aa, Borrelia burgdorferi B31
IDRETLTYKVLDN

SEQ ID NO: 97188 - protein, 13 aa, Borrelia burgdorferi B31
DRETLTYKVLDNG

SEQ ID NO: 97189 - protein, 13 aa, Borrelia burgdorferi B31
RETLTYKVLDNGT

SEQ ID NO: 97190 - protein, 13 aa, Borrelia burgdorferi B31
ETLTYKVLDNGTT

SEQ ID NO: 97191 - protein, 13 aa, Borrelia burgdorferi B31
TLTYKVLDNGTTP

SEQ ID NO: 97192 - protein, 13 aa, Borrelia burgdorferi B31
LTYKVLDNGTTPT

SEQ ID NO: 97193 - protein, 13 aa, Borrelia burgdorferi B31
TYKVLDNGTTPTR

SEQ ID NO: 97194 - protein, 13 aa, Borrelia burgdorferi B31
YKVLDNGTTPTRR

SEQ ID NO: 97195 - protein, 13 aa, Borrelia burgdorferi B31
KVLDNGTTPTRRA

SEQ ID NO: 97196 - protein, 13 aa, Borrelia burgdorferi B31
VLDNGTTPTRRAT

SEQ ID NO: 97197 - protein, 13 aa, Borrelia burgdorferi B31
LDNGTTPTRRATP

SEQ ID NO: 97198 - protein, 13 aa, Borrelia burgdorferi B31
DNGTTPTRRATPN

SEQ ID NO: 97199 - protein, 13 aa, Borrelia burgdorferi B31
NGTTPTRRATPNF

SEQ ID NO: 97200 - protein, 13 aa, Borrelia burgdorferi B31
GTTPTRRATPNFS

SEQ ID NO: 97201 - protein, 13 aa, Borrelia burgdorferi B31
TTPTRRATPNFSS

SEQ ID NO: 97202 - protein, 13 aa, Borrelia burgdorferi B31
TPTRRATPNFSSY

SEQ ID NO: 97203 - protein, 13 aa, Borrelia burgdorferi B31
PTRRATPNFSSYS

SEQ ID NO: 97204 - protein, 13 aa, Borrelia burgdorferi B31
TRRATPNFSSYSY

SEQ ID NO: 97205 - protein, 13 aa, Borrelia burgdorferi B31
RRATPNFSSYSYA

SEQ ID NO: 97206 - protein, 13 aa, Borrelia burgdorferi B31
RATPNFSSYSYAK

SEQ ID NO: 97207 - protein, 13 aa, Borrelia burgdorferi B31
ATPNFSSYSYAKS

SEQ ID NO: 97208 - protein, 13 aa, Borrelia burgdorferi B31
TPNFSSYSYAKSL

SEQ ID NO: 97209 - protein, 13 aa, Borrelia burgdorferi B31
PNFSSYSYAKSLE

SEQ ID NO: 97210 - protein, 13 aa, Borrelia burgdorferi B31
NFSSYSYAKSLEL

SEQ ID NO: 97211 - protein, 13 aa, Borrelia burgdorferi B31
FSSYSYAKSLELF

SEQ ID NO: 97212 - protein, 13 aa, Borrelia burgdorferi B31
SSYSYAKSLELFN

SEQ ID NO: 97213 - protein, 13 aa, Borrelia burgdorferi B31
SYSYAKSLELFNP

SEQ ID NO: 97214 - protein, 13 aa, Borrelia burgdorferi B31
YSYAKSLELFNPE

SEQ ID NO: 97215 - protein, 13 aa, Borrelia burgdorferi B31
SYAKSLELFNPEI

SEQ ID NO: 97216 - protein, 13 aa, Borrelia burgdorferi B31
YAKSLELFNPEIA

SEQ ID NO: 97217 - protein, 13 aa, Borrelia burgdorferi B31
AKSLELFNPEIAK

SEQ ID NO: 97218 - protein, 13 aa, Borrelia burgdorferi B31
KSLELFNPEIAKT

SEQ ID NO: 97219 - protein, 13 aa, Borrelia burgdorferi B31
SLELFNPEIAKTL

SEQ ID NO: 97220 - protein, 13 aa, Borrelia burgdorferi B31
LELFNPEIAKTLL

SEQ ID NO: 97221 - protein, 13 aa, Borrelia burgdorferi B31
ELFNPEIAKTLLA

SEQ ID NO: 97222 - protein, 13 aa, Borrelia burgdorferi B31
LFNPEIAKTLLAE

SEQ ID NO: 97223 - protein, 13 aa, Borrelia burgdorferi B31
FNPEIAKTLLAEA

SEQ ID NO: 97224 - protein, 13 aa, Borrelia burgdorferi B31
NPEIAKTLLAEAG

SEQ ID NO: 97225 - protein, 13 aa, Borrelia burgdorferi B31
PEIAKTLLAEAGY

SEQ ID NO: 97226 - protein, 13 aa, Borrelia burgdorferi B31
EIAKTLLAEAGYP

SEQ ID NO: 97227 - protein, 13 aa, Borrelia burgdorferi B31
IAKTLLAEAGYPN

SEQ ID NO: 97228 - protein, 13 aa, Borrelia burgdorferi B31
AKTLLAEAGYPNG

SEQ ID NO: 97229 - protein, 13 aa, Borrelia burgdorferi B31
KTLLAEAGYPNGN

SEQ ID NO: 97230 - protein, 13 aa, Borrelia burgdorferi B31
TLLAEAGYPNGNG

SEQ ID NO: 97231 - protein, 13 aa, Borrelia burgdorferi B31
LLAEAGYPNGNGF

SEQ ID NO: 97232 - protein, 13 aa, Borrelia burgdorferi B31
LAEAGYPNGNGFP

SEQ ID NO: 97233 - protein, 13 aa, Borrelia burgdorferi B31
AEAGYPNGNGFPI

SEQ ID NO: 97234 - protein, 13 aa, Borrelia burgdorferi B31
EAGYPNGNGFPIL

SEQ ID NO: 97235 - protein, 13 aa, Borrelia burgdorferi B31
AGYPNGNGFPILK

SEQ ID NO: 97236 - protein, 13 aa, Borrelia burgdorferi B31
GYPNGNGFPILKL

SEQ ID NO: 97237 - protein, 13 aa, Borrelia burgdorferi B31
YPNGNGFPILKLK

SEQ ID NO: 97238 - protein, 13 aa, Borrelia burgdorferi B31
PNGNGFPILKLKY

SEQ ID NO: 97239 - protein, 13 aa, Borrelia burgdorferi B31
NGNGFPILKLKYN

SEQ ID NO: 97240 - protein, 13 aa, Borrelia burgdorferi B31
GNGFPILKLKYNT

SEQ ID NO: 97241 - protein, 13 aa, Borrelia burgdorferi B31
NGFPILKLKYNTN

SEQ ID NO: 97242 - protein, 13 aa, Borrelia burgdorferi B31
GFPILKLKYNTNE

SEQ ID NO: 97243 - protein, 13 aa, Borrelia burgdorferi B31
FPILKLKYNTNEA

SEQ ID NO: 97244 - protein, 13 aa, Borrelia burgdorferi B31
PILKLKYNTNEAN

SEQ ID NO: 97245 - protein, 13 aa, Borrelia burgdorferi B31
ILKLKYNTNEANK

SEQ ID NO: 97246 - protein, 13 aa, Borrelia burgdorferi B31
LKLKYNTNEANKK

SEQ ID NO: 97247 - protein, 13 aa, Borrelia burgdorferi B31
KLKYNTNEANKKI

SEQ ID NO: 97248 - protein, 13 aa, Borrelia burgdorferi B31
LKYNTNEANKKIC

SEQ ID NO: 97249 - protein, 13 aa, Borrelia burgdorferi B31
KYNTNEANKKICE

SEQ ID NO: 97250 - protein, 13 aa, Borrelia burgdorferi B31
YNTNEANKKICEF

SEQ ID NO: 97251 - protein, 13 aa, Borrelia burgdorferi B31
NTNEANKKICEFI

SEQ ID NO: 97252 - protein, 13 aa, Borrelia burgdorferi B31
TNEANKKICEFIQ

SEQ ID NO: 97253 - protein, 13 aa, Borrelia burgdorferi B31
NEANKKICEFIQN

SEQ ID NO: 97254 - protein, 13 aa, Borrelia burgdorferi B31
EANKKICEFIQNQ

SEQ ID NO: 97255 - protein, 13 aa, Borrelia burgdorferi B31
ANKKICEFIQNQW

SEQ ID NO: 97256 - protein, 13 aa, Borrelia burgdorferi B31
NKKICEFIQNQWK

SEQ ID NO: 97257 - protein, 13 aa, Borrelia burgdorferi B31
KKICEFIQNQWKK

SEQ ID NO: 97258 - protein, 13 aa, Borrelia burgdorferi B31
KICEFIQNQWKKN

SEQ ID NO: 97259 - protein, 13 aa, Borrelia burgdorferi B31
ICEFIQNQWKKNL

SEQ ID NO: 97260 - protein, 13 aa, Borrelia burgdorferi B31
CEFIQNQWKKNLN

SEQ ID NO: 97261 - protein, 13 aa, Borrelia burgdorferi B31
EFIQNQWKKNLNI

SEQ ID NO: 97262 - protein, 13 aa, Borrelia burgdorferi B31
FIQNQWKKNLNID

SEQ ID NO: 97263 - protein, 13 aa, Borrelia burgdorferi B31
IQNQWKKNLNIDV

SEQ ID NO: 97264 - protein, 13 aa, Borrelia burgdorferi B31
QNQWKKNLNIDVE

SEQ ID NO: 97265 - protein, 13 aa, Borrelia burgdorferi B31
NQWKKNLNIDVEL

SEQ ID NO: 97266 - protein, 13 aa, Borrelia burgdorferi B31
QWKKNLNIDVELE

SEQ ID NO: 97267 - protein, 13 aa, Borrelia burgdorferi B31
WKKNLNIDVELEN

SEQ ID NO: 97268 - protein, 13 aa, Borrelia burgdorferi B31
KKNLNIDVELENE

SEQ ID NO: 97269 - protein, 13 aa, Borrelia burgdorferi B31
KNLNIDVELENEE

SEQ ID NO: 97270 - protein, 13 aa, Borrelia burgdorferi B31
NLNIDVELENEEW

SEQ ID NO: 97271 - protein, 13 aa, Borrelia burgdorferi B31
LNIDVELENEEWT

SEQ ID NO: 97272 - protein, 13 aa, Borrelia burgdorferi B31
NIDVELENEEWTT

SEQ ID NO: 97273 - protein, 13 aa, Borrelia burgdorferi B31
IDVELENEEWTTY

SEQ ID NO: 97274 - protein, 13 aa, Borrelia burgdorferi B31
DVELENEEWTTYL

SEQ ID NO: 97275 - protein, 13 aa, Borrelia burgdorferi B31
VELENEEWTTYLN

SEQ ID NO: 97276 - protein, 13 aa, Borrelia burgdorferi B31
ELENEEWTTYLNT

SEQ ID NO: 97277 - protein, 13 aa, Borrelia burgdorferi B31
LENEEWTTYLNTK

SEQ ID NO: 97278 - protein, 13 aa, Borrelia burgdorferi B31
ENEEWTTYLNTKA

SEQ ID NO: 97279 - protein, 13 aa, Borrelia burgdorferi B31
NEEWTTYLNTKAN

SEQ ID NO: 97280 - protein, 13 aa, Borrelia burgdorferi B31
EEWTTYLNTKANG

SEQ ID NO: 97281 - protein, 13 aa, Borrelia burgdorferi B31
EWTTYLNTKANGN

SEQ ID NO: 97282 - protein, 13 aa, Borrelia burgdorferi B31
WTTYLNTKANGNY

SEQ ID NO: 97283 - protein, 13 aa, Borrelia burgdorferi B31
TTYLNTKANGNYE

SEQ ID NO: 97284 - protein, 13 aa, Borrelia burgdorferi B31
TYLNTKANGNYEI

SEQ ID NO: 97285 - protein, 13 aa, Borrelia burgdorferi B31
YLNTKANGNYEIA

SEQ ID NO: 97286 - protein, 13 aa, Borrelia burgdorferi B31
LNTKANGNYEIAR

SEQ ID NO: 97287 - protein, 13 aa, Borrelia burgdorferi B31
NTKANGNYEIARA

SEQ ID NO: 97288 - protein, 13 aa, Borrelia burgdorferi B31
TKANGNYEIARAG

SEQ ID NO: 97289 - protein, 13 aa, Borrelia burgdorferi B31
KANGNYEIARAGW

SEQ ID NO: 97290 - protein, 13 aa, Borrelia burgdorferi B31
ANGNYEIARAGWI

SEQ ID NO: 97291 - protein, 13 aa, Borrelia burgdorferi B31
NGNYEIARAGWIG

SEQ ID NO: 97292 - protein, 13 aa, Borrelia burgdorferi B31
GNYEIARAGWIGD

SEQ ID NO: 97293 - protein, 13 aa, Borrelia burgdorferi B31
NYEIARAGWIGDY

SEQ ID NO: 97294 - protein, 13 aa, Borrelia burgdorferi B31
YEIARAGWIGDYA

SEQ ID NO: 97295 - protein, 13 aa, Borrelia burgdorferi B31
EIARAGWIGDYAD

SEQ ID NO: 97296 - protein, 13 aa, Borrelia burgdorferi B31
IARAGWIGDYADP

SEQ ID NO: 97297 - protein, 13 aa, Borrelia burgdorferi B31
ARAGWIGDYADPL

SEQ ID NO: 97298 - protein, 13 aa, Borrelia burgdorferi B31
RAGWIGDYADPLT

SEQ ID NO: 97299 - protein, 13 aa, Borrelia burgdorferi B31
AGWIGDYADPLTF

SEQ ID NO: 97300 - protein, 13 aa, Borrelia burgdorferi B31
GWIGDYADPLTFL

SEQ ID NO: 97301 - protein, 13 aa, Borrelia burgdorferi B31
WIGDYADPLTFLS

SEQ ID NO: 97302 - protein, 13 aa, Borrelia burgdorferi B31
IGDYADPLTFLSI

SEQ ID NO: 97303 - protein, 13 aa, Borrelia burgdorferi B31
GDYADPLTFLSIF

SEQ ID NO: 97304 - protein, 13 aa, Borrelia burgdorferi B31
DYADPLTFLSIFT

SEQ ID NO: 97305 - protein, 13 aa, Borrelia burgdorferi B31
YADPLTFLSIFTQ

SEQ ID NO: 97306 - protein, 13 aa, Borrelia burgdorferi B31
ADPLTFLSIFTQG

SEQ ID NO: 97307 - protein, 13 aa, Borrelia burgdorferi B31
DPLTFLSIFTQGY

SEQ ID NO: 97308 - protein, 13 aa, Borrelia burgdorferi B31
PLTFLSIFTQGYT

SEQ ID NO: 97309 - protein, 13 aa, Borrelia burgdorferi B31
LTFLSIFTQGYTQ

SEQ ID NO: 97310 - protein, 13 aa, Borrelia burgdorferi B31
TFLSIFTQGYTQF

SEQ ID NO: 97311 - protein, 13 aa, Borrelia burgdorferi B31
FLSIFTQGYTQFS

SEQ ID NO: 97312 - protein, 13 aa, Borrelia burgdorferi B31
LSIFTQGYTQFSS

SEQ ID NO: 97313 - protein, 13 aa, Borrelia burgdorferi B31
SIFTQGYTQFSSH

SEQ ID NO: 97314 - protein, 13 aa, Borrelia burgdorferi B31
IFTQGYTQFSSHN

SEQ ID NO: 97315 - protein, 13 aa, Borrelia burgdorferi B31
FTQGYTQFSSHNY

SEQ ID NO: 97316 - protein, 13 aa, Borrelia burgdorferi B31
TQGYTQFSSHNYS

SEQ ID NO: 97317 - protein, 13 aa, Borrelia burgdorferi B31
QGYTQFSSHNYSN

SEQ ID NO: 97318 - protein, 13 aa, Borrelia burgdorferi B31
GYTQFSSHNYSNP

SEQ ID NO: 97319 - protein, 13 aa, Borrelia burgdorferi B31
YTQFSSHNYSNPE

SEQ ID NO: 97320 - protein, 13 aa, Borrelia burgdorferi B31
TQFSSHNYSNPEY

SEQ ID NO: 97321 - protein, 13 aa, Borrelia burgdorferi B31
QFSSHNYSNPEYN

SEQ ID NO: 97322 - protein, 13 aa, Borrelia burgdorferi B31
FSSHNYSNPEYNE

SEQ ID NO: 97323 - protein, 13 aa, Borrelia burgdorferi B31
SSHNYSNPEYNEL

SEQ ID NO: 97324 - protein, 13 aa, Borrelia burgdorferi B31
SHNYSNPEYNELI

SEQ ID NO: 97325 - protein, 13 aa, Borrelia burgdorferi B31
HNYSNPEYNELIK

SEQ ID NO: 97326 - protein, 13 aa, Borrelia burgdorferi B31
NYSNPEYNELIKK

SEQ ID NO: 97327 - protein, 13 aa, Borrelia burgdorferi B31
YSNPEYNELIKKS

SEQ ID NO: 97328 - protein, 13 aa, Borrelia burgdorferi B31
SNPEYNELIKKSD

SEQ ID NO: 97329 - protein, 13 aa, Borrelia burgdorferi B31
NPEYNELIKKSDL

SEQ ID NO: 97330 - protein, 13 aa, Borrelia burgdorferi B31
PEYNELIKKSDLE

SEQ ID NO: 97331 - protein, 13 aa, Borrelia burgdorferi B31
EYNELIKKSDLEL

SEQ ID NO: 97332 - protein, 13 aa, Borrelia burgdorferi B31
YNELIKKSDLELD

SEQ ID NO: 97333 - protein, 13 aa, Borrelia burgdorferi B31
NELIKKSDLELDP

SEQ ID NO: 97334 - protein, 13 aa, Borrelia burgdorferi B31
ELIKKSDLELDPI

SEQ ID NO: 97335 - protein, 13 aa, Borrelia burgdorferi B31
LIKKSDLELDPIK

SEQ ID NO: 97336 - protein, 13 aa, Borrelia burgdorferi B31
IKKSDLELDPIKR

SEQ ID NO: 97337 - protein, 13 aa, Borrelia burgdorferi B31
KKSDLELDPIKRQ

SEQ ID NO: 97338 - protein, 13 aa, Borrelia burgdorferi B31
KSDLELDPIKRQD

SEQ ID NO: 97339 - protein, 13 aa, Borrelia burgdorferi B31
SDLELDPIKRQDI

SEQ ID NO: 97340 - protein, 13 aa, Borrelia burgdorferi B31
DLELDPIKRQDIL

SEQ ID NO: 97341 - protein, 13 aa, Borrelia burgdorferi B31
LELDPIKRQDILR

SEQ ID NO: 97342 - protein, 13 aa, Borrelia burgdorferi B31
ELDPIKRQDILRQ

SEQ ID NO: 97343 - protein, 13 aa, Borrelia burgdorferi B31
LDPIKRQDILRQA

SEQ ID NO: 97344 - protein, 13 aa, Borrelia burgdorferi B31
DPIKRQDILRQAE

SEQ ID NO: 97345 - protein, 13 aa, Borrelia burgdorferi B31
PIKRQDILRQAEE

SEQ ID NO: 97346 - protein, 13 aa, Borrelia burgdorferi B31
IKRQDILRQAEEI

SEQ ID NO: 97347 - protein, 13 aa, Borrelia burgdorferi B31
KRQDILRQAEEII

SEQ ID NO: 97348 - protein, 13 aa, Borrelia burgdorferi B31
RQDILRQAEEIII

SEQ ID NO: 97349 - protein, 13 aa, Borrelia burgdorferi B31
QDILRQAEEIIIE

SEQ ID NO: 97350 - protein, 13 aa, Borrelia burgdorferi B31
DILRQAEEIIIEK

SEQ ID NO: 97351 - protein, 13 aa, Borrelia burgdorferi B31
ILRQAEEIIIEKD

SEQ ID NO: 97352 - protein, 13 aa, Borrelia burgdorferi B31
LRQAEEIIIEKDF

SEQ ID NO: 97353 - protein, 13 aa, Borrelia burgdorferi B31
RQAEEIIIEKDFP

SEQ ID NO: 97354 - protein, 13 aa, Borrelia burgdorferi B31
QAEEIIIEKDFPI

SEQ ID NO: 97355 - protein, 13 aa, Borrelia burgdorferi B31
AEEIIIEKDFPIA

SEQ ID NO: 97356 - protein, 13 aa, Borrelia burgdorferi B31
EEIIIEKDFPIAP

SEQ ID NO: 97357 - protein, 13 aa, Borrelia burgdorferi B31
EIIIEKDFPIAPI

SEQ ID NO: 97358 - protein, 13 aa, Borrelia burgdorferi B31
IIIEKDFPIAPIY

SEQ ID NO: 97359 - protein, 13 aa, Borrelia burgdorferi B31
IIEKDFPIAPIYI

SEQ ID NO: 97360 - protein, 13 aa, Borrelia burgdorferi B31
IEKDFPIAPIYIY

SEQ ID NO: 97361 - protein, 13 aa, Borrelia burgdorferi B31
EKDFPIAPIYIYG

SEQ ID NO: 97362 - protein, 13 aa, Borrelia burgdorferi B31
KDFPIAPIYIYGN

SEQ ID NO: 97363 - protein, 13 aa, Borrelia burgdorferi B31
DFPIAPIYIYGNS

SEQ ID NO: 97364 - protein, 13 aa, Borrelia burgdorferi B31
FPIAPIYIYGNSY

SEQ ID NO: 97365 - protein, 13 aa, Borrelia burgdorferi B31
PIAPIYIYGNSYL

SEQ ID NO: 97366 - protein, 13 aa, Borrelia burgdorferi B31
IAPIYIYGNSYLF

SEQ ID NO: 97367 - protein, 13 aa, Borrelia burgdorferi B31
APIYIYGNSYLFR

SEQ ID NO: 97368 - protein, 13 aa, Borrelia burgdorferi B31
PIYIYGNSYLFRN

SEQ ID NO: 97369 - protein, 13 aa, Borrelia burgdorferi B31
IYIYGNSYLFRND

SEQ ID NO: 97370 - protein, 13 aa, Borrelia burgdorferi B31
YIYGNSYLFRNDK

SEQ ID NO: 97371 - protein, 13 aa, Borrelia burgdorferi B31
IYGNSYLFRNDKW

SEQ ID NO: 97372 - protein, 13 aa, Borrelia burgdorferi B31
YGNSYLFRNDKWT

SEQ ID NO: 97373 - protein, 13 aa, Borrelia burgdorferi B31
GNSYLFRNDKWTG

SEQ ID NO: 97374 - protein, 13 aa, Borrelia burgdorferi B31
NSYLFRNDKWTGW

SEQ ID NO: 97375 - protein, 13 aa, Borrelia burgdorferi B31
SYLFRNDKWTGWN

SEQ ID NO: 97376 - protein, 13 aa, Borrelia burgdorferi B31
YLFRNDKWTGWNT

SEQ ID NO: 97377 - protein, 13 aa, Borrelia burgdorferi B31
LFRNDKWTGWNTN

SEQ ID NO: 97378 - protein, 13 aa, Borrelia burgdorferi B31
FRNDKWTGWNTNI

SEQ ID NO: 97379 - protein, 13 aa, Borrelia burgdorferi B31
RNDKWTGWNTNIL

SEQ ID NO: 97380 - protein, 13 aa, Borrelia burgdorferi B31
NDKWTGWNTNILE

SEQ ID NO: 97381 - protein, 13 aa, Borrelia burgdorferi B31
DKWTGWNTNILER

SEQ ID NO: 97382 - protein, 13 aa, Borrelia burgdorferi B31
KWTGWNTNILERF

SEQ ID NO: 97383 - protein, 13 aa, Borrelia burgdorferi B31
WTGWNTNILERFD

SEQ ID NO: 97384 - protein, 13 aa, Borrelia burgdorferi B31
TGWNTNILERFDL

SEQ ID NO: 97385 - protein, 13 aa, Borrelia burgdorferi B31
GWNTNILERFDLS

SEQ ID NO: 97386 - protein, 13 aa, Borrelia burgdorferi B31
WNTNILERFDLSQ

SEQ ID NO: 97387 - protein, 13 aa, Borrelia burgdorferi B31
NTNILERFDLSQL

SEQ ID NO: 97388 - protein, 13 aa, Borrelia burgdorferi B31
TNILERFDLSQLK

SEQ ID NO: 97389 - protein, 13 aa, Borrelia burgdorferi B31
NILERFDLSQLKL

SEQ ID NO: 97390 - protein, 13 aa, Borrelia burgdorferi B31
ILERFDLSQLKLK

SEQ ID NO: 97391 - protein, 13 aa, Borrelia burgdorferi B31
LERFDLSQLKLKN

SEQ ID NO: 97392 - protein, 13 aa, Borrelia burgdorferi B31
ERFDLSQLKLKNK

SEQ ID NO: 97393 - protein, 14 aa, Borrelia burgdorferi B31
MKLQRSLFLIIFFL

SEQ ID NO: 97394 - protein, 14 aa, Borrelia burgdorferi B31
KLQRSLFLIIFFLT

SEQ ID NO: 97395 - protein, 14 aa, Borrelia burgdorferi B31
LQRSLFLIIFFLTF

SEQ ID NO: 97396 - protein, 14 aa, Borrelia burgdorferi B31
QRSLFLIIFFLTFL

SEQ ID NO: 97397 - protein, 14 aa, Borrelia burgdorferi B31
RSLFLIIFFLTFLC

SEQ ID NO: 97398 - protein, 14 aa, Borrelia burgdorferi B31
SLFLIIFFLTFLCC

SEQ ID NO: 97399 - protein, 14 aa, Borrelia burgdorferi B31
LFLIIFFLTFLCCN

SEQ ID NO: 97400 - protein, 14 aa, Borrelia burgdorferi B31
FLIIFFLTFLCCNN

SEQ ID NO: 97401 - protein, 14 aa, Borrelia burgdorferi B31
LIIFFLTFLCCNNK

SEQ ID NO: 97402 - protein, 14 aa, Borrelia burgdorferi B31
IIFFLTFLCCNNKE

SEQ ID NO: 97403 - protein, 14 aa, Borrelia burgdorferi B31
IFFLTFLCCNNKER

SEQ ID NO: 97404 - protein, 14 aa, Borrelia burgdorferi B31
FFLTFLCCNNKERK

SEQ ID NO: 97405 - protein, 14 aa, Borrelia burgdorferi B31
FLTFLCCNNKERKE

SEQ ID NO: 97406 - protein, 14 aa, Borrelia burgdorferi B31
LTFLCCNNKERKEG

SEQ ID NO: 97407 - protein, 14 aa, Borrelia burgdorferi B31
TFLCCNNKERKEGV

SEQ ID NO: 97408 - protein, 14 aa, Borrelia burgdorferi B31
FLCCNNKERKEGVS

SEQ ID NO: 97409 - protein, 14 aa, Borrelia burgdorferi B31
LCCNNKERKEGVSF

SEQ ID NO: 97410 - protein, 14 aa, Borrelia burgdorferi B31
CCNNKERKEGVSFK

SEQ ID NO: 97411 - protein, 14 aa, Borrelia burgdorferi B31
CNNKERKEGVSFKI

SEQ ID NO: 97412 - protein, 14 aa, Borrelia burgdorferi B31
NNKERKEGVSFKIS

SEQ ID NO: 97413 - protein, 14 aa, Borrelia burgdorferi B31
NKERKEGVSFKISL

SEQ ID NO: 97414 - protein, 14 aa, Borrelia burgdorferi B31
KERKEGVSFKISLG

SEQ ID NO: 97415 - protein, 14 aa, Borrelia burgdorferi B31
ERKEGVSFKISLGA

SEQ ID NO: 97416 - protein, 14 aa, Borrelia burgdorferi B31
RKEGVSFKISLGAE

SEQ ID NO: 97417 - protein, 14 aa, Borrelia burgdorferi B31
KEGVSFKISLGAEP

SEQ ID NO: 97418 - protein, 14 aa, Borrelia burgdorferi B31
EGVSFKISLGAEPS

SEQ ID NO: 97419 - protein, 14 aa, Borrelia burgdorferi B31
GVSFKISLGAEPSS

SEQ ID NO: 97420 - protein, 14 aa, Borrelia burgdorferi B31
VSFKISLGAEPSSL

SEQ ID NO: 97421 - protein, 14 aa, Borrelia burgdorferi B31
SFKISLGAEPSSLD

SEQ ID NO: 97422 - protein, 14 aa, Borrelia burgdorferi B31
FKISLGAEPSSLDP

SEQ ID NO: 97423 - protein, 14 aa, Borrelia burgdorferi B31
KISLGAEPSSLDPQ

SEQ ID NO: 97424 - protein, 14 aa, Borrelia burgdorferi B31
ISLGAEPSSLDPQL

SEQ ID NO: 97425 - protein, 14 aa, Borrelia burgdorferi B31
SLGAEPSSLDPQLA

SEQ ID NO: 97426 - protein, 14 aa, Borrelia burgdorferi B31
LGAEPSSLDPQLAE

SEQ ID NO: 97427 - protein, 14 aa, Borrelia burgdorferi B31
GAEPSSLDPQLAED

SEQ ID NO: 97428 - protein, 14 aa, Borrelia burgdorferi B31
AEPSSLDPQLAEDN

SEQ ID NO: 97429 - protein, 14 aa, Borrelia burgdorferi B31
EPSSLDPQLAEDNV

SEQ ID NO: 97430 - protein, 14 aa, Borrelia burgdorferi B31
PSSLDPQLAEDNVA

SEQ ID NO: 97431 - protein, 14 aa, Borrelia burgdorferi B31
SSLDPQLAEDNVAS

SEQ ID NO: 97432 - protein, 14 aa, Borrelia burgdorferi B31
SLDPQLAEDNVASK

SEQ ID NO: 97433 - protein, 14 aa, Borrelia burgdorferi B31
LDPQLAEDNVASKM

SEQ ID NO: 97434 - protein, 14 aa, Borrelia burgdorferi B31
DPQLAEDNVASKMI

SEQ ID NO: 97435 - protein, 14 aa, Borrelia burgdorferi B31
PQLAEDNVASKMID

SEQ ID NO: 97436 - protein, 14 aa, Borrelia burgdorferi B31
QLAEDNVASKMIDT

SEQ ID NO: 97437 - protein, 14 aa, Borrelia burgdorferi B31
LAEDNVASKMIDTM

SEQ ID NO: 97438 - protein, 14 aa, Borrelia burgdorferi B31
AEDNVASKMIDTMF

SEQ ID NO: 97439 - protein, 14 aa, Borrelia burgdorferi B31
EDNVASKMIDTMFR

SEQ ID NO: 97440 - protein, 14 aa, Borrelia burgdorferi B31
DNVASKMIDTMFRG

SEQ ID NO: 97441 - protein, 14 aa, Borrelia burgdorferi B31
NVASKMIDTMFRGI

SEQ ID NO: 97442 - protein, 14 aa, Borrelia burgdorferi B31
VASKMIDTMFRGIV

SEQ ID NO: 97443 - protein, 14 aa, Borrelia burgdorferi B31
ASKMIDTMFRGIVT

SEQ ID NO: 97444 - protein, 14 aa, Borrelia burgdorferi B31
SKMIDTMFRGIVTG

SEQ ID NO: 97445 - protein, 14 aa, Borrelia burgdorferi B31
KMIDTMFRGIVTGD

SEQ ID NO: 97446 - protein, 14 aa, Borrelia burgdorferi B31
MIDTMFRGIVTGDP

SEQ ID NO: 97447 - protein, 14 aa, Borrelia burgdorferi B31
IDTMFRGIVTGDPN

SEQ ID NO: 97448 - protein, 14 aa, Borrelia burgdorferi B31
DTMFRGIVTGDPNT

SEQ ID NO: 97449 - protein, 14 aa, Borrelia burgdorferi B31
TMFRGIVTGDPNTG

SEQ ID NO: 97450 - protein, 14 aa, Borrelia burgdorferi B31
MFRGIVTGDPNTGG

SEQ ID NO: 97451 - protein, 14 aa, Borrelia burgdorferi B31
FRGIVTGDPNTGGN

SEQ ID NO: 97452 - protein, 14 aa, Borrelia burgdorferi B31
RGIVTGDPNTGGNK

SEQ ID NO: 97453 - protein, 14 aa, Borrelia burgdorferi B31
GIVTGDPNTGGNKP

SEQ ID NO: 97454 - protein, 14 aa, Borrelia burgdorferi B31
IVTGDPNTGGNKPG

SEQ ID NO: 97455 - protein, 14 aa, Borrelia burgdorferi B31
VTGDPNTGGNKPGL

SEQ ID NO: 97456 - protein, 14 aa, Borrelia burgdorferi B31
TGDPNTGGNKPGLA

SEQ ID NO: 97457 - protein, 14 aa, Borrelia burgdorferi B31
GDPNTGGNKPGLAK

SEQ ID NO: 97458 - protein, 14 aa, Borrelia burgdorferi B31
DPNTGGNKPGLAKG

SEQ ID NO: 97459 - protein, 14 aa, Borrelia burgdorferi B31
PNTGGNKPGLAKGW

SEQ ID NO: 97460 - protein, 14 aa, Borrelia burgdorferi B31
NTGGNKPGLAKGWD

SEQ ID NO: 97461 - protein, 14 aa, Borrelia burgdorferi B31
TGGNKPGLAKGWDI

SEQ ID NO: 97462 - protein, 14 aa, Borrelia burgdorferi B31
GGNKPGLAKGWDIS

SEQ ID NO: 97463 - protein, 14 aa, Borrelia burgdorferi B31
GNKPGLAKGWDISS

SEQ ID NO: 97464 - protein, 14 aa, Borrelia burgdorferi B31
NKPGLAKGWDISSD

SEQ ID NO: 97465 - protein, 14 aa, Borrelia burgdorferi B31
KPGLAKGWDISSDG

SEQ ID NO: 97466 - protein, 14 aa, Borrelia burgdorferi B31
PGLAKGWDISSDGT

SEQ ID NO: 97467 - protein, 14 aa, Borrelia burgdorferi B31
GLAKGWDISSDGTV

SEQ ID NO: 97468 - protein, 14 aa, Borrelia burgdorferi B31
LAKGWDISSDGTVY

SEQ ID NO: 97469 - protein, 14 aa, Borrelia burgdorferi B31
AKGWDISSDGTVYT

SEQ ID NO: 97470 - protein, 14 aa, Borrelia burgdorferi B31
KGWDISSDGTVYTF

SEQ ID NO: 97471 - protein, 14 aa, Borrelia burgdorferi B31
GWDISSDGTVYTFN

SEQ ID NO: 97472 - protein, 14 aa, Borrelia burgdorferi B31
WDISSDGTVYTFNL

SEQ ID NO: 97473 - protein, 14 aa, Borrelia burgdorferi B31
DISSDGTVYTFNLR

SEQ ID NO: 97474 - protein, 14 aa, Borrelia burgdorferi B31
ISSDGTVYTFNLRE

SEQ ID NO: 97475 - protein, 14 aa, Borrelia burgdorferi B31
SSDGTVYTFNLREK

SEQ ID NO: 97476 - protein, 14 aa, Borrelia burgdorferi B31
SDGTVYTFNLREKI

SEQ ID NO: 97477 - protein, 14 aa, Borrelia burgdorferi B31
DGTVYTFNLREKIT

SEQ ID NO: 97478 - protein, 14 aa, Borrelia burgdorferi B31
GTVYTFNLREKITW

SEQ ID NO: 97479 - protein, 14 aa, Borrelia burgdorferi B31
TVYTFNLREKITWS

SEQ ID NO: 97480 - protein, 14 aa, Borrelia burgdorferi B31
VYTFNLREKITWSD

SEQ ID NO: 97481 - protein, 14 aa, Borrelia burgdorferi B31
YTFNLREKITWSDG

SEQ ID NO: 97482 - protein, 14 aa, Borrelia burgdorferi B31
TFNLREKITWSDGV

SEQ ID NO: 97483 - protein, 14 aa, Borrelia burgdorferi B31
FNLREKITWSDGVA

SEQ ID NO: 97484 - protein, 14 aa, Borrelia burgdorferi B31
NLREKITWSDGVAI

SEQ ID NO: 97485 - protein, 14 aa, Borrelia burgdorferi B31
LREKITWSDGVAIT

SEQ ID NO: 97486 - protein, 14 aa, Borrelia burgdorferi B31
REKITWSDGVAITA

SEQ ID NO: 97487 - protein, 14 aa, Borrelia burgdorferi B31
EKITWSDGVAITAE

SEQ ID NO: 97488 - protein, 14 aa, Borrelia burgdorferi B31
KITWSDGVAITAEG

SEQ ID NO: 97489 - protein, 14 aa, Borrelia burgdorferi B31
ITWSDGVAITAEGI

SEQ ID NO: 97490 - protein, 14 aa, Borrelia burgdorferi B31
TWSDGVAITAEGIR

SEQ ID NO: 97491 - protein, 14 aa, Borrelia burgdorferi B31
WSDGVAITAEGIRK

SEQ ID NO: 97492 - protein, 14 aa, Borrelia burgdorferi B31
SDGVAITAEGIRKS

SEQ ID NO: 97493 - protein, 14 aa, Borrelia burgdorferi B31
DGVAITAEGIRKSY

SEQ ID NO: 97494 - protein, 14 aa, Borrelia burgdorferi B31
GVAITAEGIRKSYL

SEQ ID NO: 97495 - protein, 14 aa, Borrelia burgdorferi B31
VAITAEGIRKSYLR

SEQ ID NO: 97496 - protein, 14 aa, Borrelia burgdorferi B31
AITAEGIRKSYLRI

SEQ ID NO: 97497 - protein, 14 aa, Borrelia burgdorferi B31
ITAEGIRKSYLRIL

SEQ ID NO: 97498 - protein, 14 aa, Borrelia burgdorferi B31
TAEGIRKSYLRILN

SEQ ID NO: 97499 - protein, 14 aa, Borrelia burgdorferi B31
AEGIRKSYLRILNK

SEQ ID NO: 97500 - protein, 14 aa, Borrelia burgdorferi B31
EGIRKSYLRILNKE

SEQ ID NO: 97501 - protein, 14 aa, Borrelia burgdorferi B31
GIRKSYLRILNKET

SEQ ID NO: 97502 - protein, 14 aa, Borrelia burgdorferi B31
IRKSYLRILNKETG

SEQ ID NO: 97503 - protein, 14 aa, Borrelia burgdorferi B31
RKSYLRILNKETGS

SEQ ID NO: 97504 - protein, 14 aa, Borrelia burgdorferi B31
KSYLRILNKETGSK

SEQ ID NO: 97505 - protein, 14 aa, Borrelia burgdorferi B31
SYLRILNKETGSKY

SEQ ID NO: 97506 - protein, 14 aa, Borrelia burgdorferi B31
YLRILNKETGSKYV

SEQ ID NO: 97507 - protein, 14 aa, Borrelia burgdorferi B31
LRILNKETGSKYVE

SEQ ID NO: 97508 - protein, 14 aa, Borrelia burgdorferi B31
RILNKETGSKYVEM

SEQ ID NO: 97509 - protein, 14 aa, Borrelia burgdorferi B31
ILNKETGSKYVEMV

SEQ ID NO: 97510 - protein, 14 aa, Borrelia burgdorferi B31
LNKETGSKYVEMVK

SEQ ID NO: 97511 - protein, 14 aa, Borrelia burgdorferi B31
NKETGSKYVEMVKS

SEQ ID NO: 97512 - protein, 14 aa, Borrelia burgdorferi B31
KETGSKYVEMVKSV

SEQ ID NO: 97513 - protein, 14 aa, Borrelia burgdorferi B31
ETGSKYVEMVKSVI

SEQ ID NO: 97514 - protein, 14 aa, Borrelia burgdorferi B31
TGSKYVEMVKSVIK

SEQ ID NO: 97515 - protein, 14 aa, Borrelia burgdorferi B31
GSKYVEMVKSVIKN

SEQ ID NO: 97516 - protein, 14 aa, Borrelia burgdorferi B31
SKYVEMVKSVIKNG

SEQ ID NO: 97517 - protein, 14 aa, Borrelia burgdorferi B31
KYVEMVKSVIKNGQ

SEQ ID NO: 97518 - protein, 14 aa, Borrelia burgdorferi B31
YVEMVKSVIKNGQK

SEQ ID NO: 97519 - protein, 14 aa, Borrelia burgdorferi B31
VEMVKSVIKNGQKY

SEQ ID NO: 97520 - protein, 14 aa, Borrelia burgdorferi B31
EMVKSVIKNGQKYF

SEQ ID NO: 97521 - protein, 14 aa, Borrelia burgdorferi B31
MVKSVIKNGQKYFD

SEQ ID NO: 97522 - protein, 14 aa, Borrelia burgdorferi B31
VKSVIKNGQKYFDG

SEQ ID NO: 97523 - protein, 14 aa, Borrelia burgdorferi B31
KSVIKNGQKYFDGQ

SEQ ID NO: 97524 - protein, 14 aa, Borrelia burgdorferi B31
SVIKNGQKYFDGQV

SEQ ID NO: 97525 - protein, 14 aa, Borrelia burgdorferi B31
VIKNGQKYFDGQVT

SEQ ID NO: 97526 - protein, 14 aa, Borrelia burgdorferi B31
IKNGQKYFDGQVTD

SEQ ID NO: 97527 - protein, 14 aa, Borrelia burgdorferi B31
KNGQKYFDGQVTDS

SEQ ID NO: 97528 - protein, 14 aa, Borrelia burgdorferi B31
NGQKYFDGQVTDSE

SEQ ID NO: 97529 - protein, 14 aa, Borrelia burgdorferi B31
GQKYFDGQVTDSEL

SEQ ID NO: 97530 - protein, 14 aa, Borrelia burgdorferi B31
QKYFDGQVTDSELG

SEQ ID NO: 97531 - protein, 14 aa, Borrelia burgdorferi B31
KYFDGQVTDSELGI

SEQ ID NO: 97532 - protein, 14 aa, Borrelia burgdorferi B31
YFDGQVTDSELGIR

SEQ ID NO: 97533 - protein, 14 aa, Borrelia burgdorferi B31
FDGQVTDSELGIRA

SEQ ID NO: 97534 - protein, 14 aa, Borrelia burgdorferi B31
DGQVTDSELGIRAI

SEQ ID NO: 97535 - protein, 14 aa, Borrelia burgdorferi B31
GQVTDSELGIRAID

SEQ ID NO: 97536 - protein, 14 aa, Borrelia burgdorferi B31
QVTDSELGIRAIDE

SEQ ID NO: 97537 - protein, 14 aa, Borrelia burgdorferi B31
VTDSELGIRAIDEK

SEQ ID NO: 97538 - protein, 14 aa, Borrelia burgdorferi B31
TDSELGIRAIDEKT

SEQ ID NO: 97539 - protein, 14 aa, Borrelia burgdorferi B31
DSELGIRAIDEKTL

SEQ ID NO: 97540 - protein, 14 aa, Borrelia burgdorferi B31
SELGIRAIDEKTLE

SEQ ID NO: 97541 - protein, 14 aa, Borrelia burgdorferi B31
ELGIRAIDEKTLEI

SEQ ID NO: 97542 - protein, 14 aa, Borrelia burgdorferi B31
LGIRAIDEKTLEIT

SEQ ID NO: 97543 - protein, 14 aa, Borrelia burgdorferi B31
GIRAIDEKTLEITL

SEQ ID NO: 97544 - protein, 14 aa, Borrelia burgdorferi B31
IRAIDEKTLEITLE

SEQ ID NO: 97545 - protein, 14 aa, Borrelia burgdorferi B31
RAIDEKTLEITLES

SEQ ID NO: 97546 - protein, 14 aa, Borrelia burgdorferi B31
AIDEKTLEITLESP

SEQ ID NO: 97547 - protein, 14 aa, Borrelia burgdorferi B31
IDEKTLEITLESPK

SEQ ID NO: 97548 - protein, 14 aa, Borrelia burgdorferi B31
DEKTLEITLESPKP

SEQ ID NO: 97549 - protein, 14 aa, Borrelia burgdorferi B31
EKTLEITLESPKPY

SEQ ID NO: 97550 - protein, 14 aa, Borrelia burgdorferi B31
KTLEITLESPKPYF

SEQ ID NO: 97551 - protein, 14 aa, Borrelia burgdorferi B31
TLEITLESPKPYFI

SEQ ID NO: 97552 - protein, 14 aa, Borrelia burgdorferi B31
LEITLESPKPYFID

SEQ ID NO: 97553 - protein, 14 aa, Borrelia burgdorferi B31
EITLESPKPYFIDM

SEQ ID NO: 97554 - protein, 14 aa, Borrelia burgdorferi B31
ITLESPKPYFIDML

SEQ ID NO: 97555 - protein, 14 aa, Borrelia burgdorferi B31
TLESPKPYFIDMLV

SEQ ID NO: 97556 - protein, 14 aa, Borrelia burgdorferi B31
LESPKPYFIDMLVH

SEQ ID NO: 97557 - protein, 14 aa, Borrelia burgdorferi B31
ESPKPYFIDMLVHQ

SEQ ID NO: 97558 - protein, 14 aa, Borrelia burgdorferi B31
SPKPYFIDMLVHQS

SEQ ID NO: 97559 - protein, 14 aa, Borrelia burgdorferi B31
PKPYFIDMLVHQSF

SEQ ID NO: 97560 - protein, 14 aa, Borrelia burgdorferi B31
KPYFIDMLVHQSFI

SEQ ID NO: 97561 - protein, 14 aa, Borrelia burgdorferi B31
PYFIDMLVHQSFIP

SEQ ID NO: 97562 - protein, 14 aa, Borrelia burgdorferi B31
YFIDMLVHQSFIPV

SEQ ID NO: 97563 - protein, 14 aa, Borrelia burgdorferi B31
FIDMLVHQSFIPVP

SEQ ID NO: 97564 - protein, 14 aa, Borrelia burgdorferi B31
IDMLVHQSFIPVPV

SEQ ID NO: 97565 - protein, 14 aa, Borrelia burgdorferi B31
DMLVHQSFIPVPVH

SEQ ID NO: 97566 - protein, 14 aa, Borrelia burgdorferi B31
MLVHQSFIPVPVHV

SEQ ID NO: 97567 - protein, 14 aa, Borrelia burgdorferi B31
LVHQSFIPVPVHVT

SEQ ID NO: 97568 - protein, 14 aa, Borrelia burgdorferi B31
VHQSFIPVPVHVTE

SEQ ID NO: 97569 - protein, 14 aa, Borrelia burgdorferi B31
HQSFIPVPVHVTEK

SEQ ID NO: 97570 - protein, 14 aa, Borrelia burgdorferi B31
QSFIPVPVHVTEKY

SEQ ID NO: 97571 - protein, 14 aa, Borrelia burgdorferi B31
SFIPVPVHVTEKYG

SEQ ID NO: 97572 - protein, 14 aa, Borrelia burgdorferi B31
FIPVPVHVTEKYGQ

SEQ ID NO: 97573 - protein, 14 aa, Borrelia burgdorferi B31
IPVPVHVTEKYGQN

SEQ ID NO: 97574 - protein, 14 aa, Borrelia burgdorferi B31
PVPVHVTEKYGQNW

SEQ ID NO: 97575 - protein, 14 aa, Borrelia burgdorferi B31
VPVHVTEKYGQNWT

SEQ ID NO: 97576 - protein, 14 aa, Borrelia burgdorferi B31
PVHVTEKYGQNWTS

SEQ ID NO: 97577 - protein, 14 aa, Borrelia burgdorferi B31
VHVTEKYGQNWTSP

SEQ ID NO: 97578 - protein, 14 aa, Borrelia burgdorferi B31
HVTEKYGQNWTSPE

SEQ ID NO: 97579 - protein, 14 aa, Borrelia burgdorferi B31
VTEKYGQNWTSPEN

SEQ ID NO: 97580 - protein, 14 aa, Borrelia burgdorferi B31
TEKYGQNWTSPENM

SEQ ID NO: 97581 - protein, 14 aa, Borrelia burgdorferi B31
EKYGQNWTSPENMV

SEQ ID NO: 97582 - protein, 14 aa, Borrelia burgdorferi B31
KYGQNWTSPENMVT

SEQ ID NO: 97583 - protein, 14 aa, Borrelia burgdorferi B31
YGQNWTSPENMVTS

SEQ ID NO: 97584 - protein, 14 aa, Borrelia burgdorferi B31
GQNWTSPENMVTSG

SEQ ID NO: 97585 - protein, 14 aa, Borrelia burgdorferi B31
QNWTSPENMVTSGP

SEQ ID NO: 97586 - protein, 14 aa, Borrelia burgdorferi B31
NWTSPENMVTSGPF

SEQ ID NO: 97587 - protein, 14 aa, Borrelia burgdorferi B31
WTSPENMVTSGPFK

SEQ ID NO: 97588 - protein, 14 aa, Borrelia burgdorferi B31
TSPENMVTSGPFKL

SEQ ID NO: 97589 - protein, 14 aa, Borrelia burgdorferi B31
SPENMVTSGPFKLK

SEQ ID NO: 97590 - protein, 14 aa, Borrelia burgdorferi B31
PENMVTSGPFKLKE

SEQ ID NO: 97591 - protein, 14 aa, Borrelia burgdorferi B31
ENMVTSGPFKLKER

SEQ ID NO: 97592 - protein, 14 aa, Borrelia burgdorferi B31
NMVTSGPFKLKERI

SEQ ID NO: 97593 - protein, 14 aa, Borrelia burgdorferi B31
MVTSGPFKLKERIP

SEQ ID NO: 97594 - protein, 14 aa, Borrelia burgdorferi B31
VTSGPFKLKERIPN

SEQ ID NO: 97595 - protein, 14 aa, Borrelia burgdorferi B31
TSGPFKLKERIPNE

SEQ ID NO: 97596 - protein, 14 aa, Borrelia burgdorferi B31
SGPFKLKERIPNEK

SEQ ID NO: 97597 - protein, 14 aa, Borrelia burgdorferi B31
GPFKLKERIPNEKY

SEQ ID NO: 97598 - protein, 14 aa, Borrelia burgdorferi B31
PFKLKERIPNEKYV

SEQ ID NO: 97599 - protein, 14 aa, Borrelia burgdorferi B31
FKLKERIPNEKYVF

SEQ ID NO: 97600 - protein, 14 aa, Borrelia burgdorferi B31
KLKERIPNEKYVFE

SEQ ID NO: 97601 - protein, 14 aa, Borrelia burgdorferi B31
LKERIPNEKYVFEK

SEQ ID NO: 97602 - protein, 14 aa, Borrelia burgdorferi B31
KERIPNEKYVFEKN

SEQ ID NO: 97603 - protein, 14 aa, Borrelia burgdorferi B31
ERIPNEKYVFEKNN

SEQ ID NO: 97604 - protein, 14 aa, Borrelia burgdorferi B31
RIPNEKYVFEKNNK

SEQ ID NO: 97605 - protein, 14 aa, Borrelia burgdorferi B31
IPNEKYVFEKNNKY

SEQ ID NO: 97606 - protein, 14 aa, Borrelia burgdorferi B31
PNEKYVFEKNNKYY

SEQ ID NO: 97607 - protein, 14 aa, Borrelia burgdorferi B31
NEKYVFEKNNKYYD

SEQ ID NO: 97608 - protein, 14 aa, Borrelia burgdorferi B31
EKYVFEKNNKYYDS

SEQ ID NO: 97609 - protein, 14 aa, Borrelia burgdorferi B31
KYVFEKNNKYYDSN

SEQ ID NO: 97610 - protein, 14 aa, Borrelia burgdorferi B31
YVFEKNNKYYDSNE

SEQ ID NO: 97611 - protein, 14 aa, Borrelia burgdorferi B31
VFEKNNKYYDSNEV

SEQ ID NO: 97612 - protein, 14 aa, Borrelia burgdorferi B31
FEKNNKYYDSNEVE

SEQ ID NO: 97613 - protein, 14 aa, Borrelia burgdorferi B31
EKNNKYYDSNEVEL

SEQ ID NO: 97614 - protein, 14 aa, Borrelia burgdorferi B31
KNNKYYDSNEVELE

SEQ ID NO: 97615 - protein, 14 aa, Borrelia burgdorferi B31
NNKYYDSNEVELEE

SEQ ID NO: 97616 - protein, 14 aa, Borrelia burgdorferi B31
NKYYDSNEVELEEI

SEQ ID NO: 97617 - protein, 14 aa, Borrelia burgdorferi B31
KYYDSNEVELEEIT

SEQ ID NO: 97618 - protein, 14 aa, Borrelia burgdorferi B31
YYDSNEVELEEITF

SEQ ID NO: 97619 - protein, 14 aa, Borrelia burgdorferi B31
YDSNEVELEEITFY

SEQ ID NO: 97620 - protein, 14 aa, Borrelia burgdorferi B31
DSNEVELEEITFYT

SEQ ID NO: 97621 - protein, 14 aa, Borrelia burgdorferi B31
SNEVELEEITFYTT

SEQ ID NO: 97622 - protein, 14 aa, Borrelia burgdorferi B31
NEVELEEITFYTTN

SEQ ID NO: 97623 - protein, 14 aa, Borrelia burgdorferi B31
EVELEEITFYTTND

SEQ ID NO: 97624 - protein, 14 aa, Borrelia burgdorferi B31
VELEEITFYTTNDS

SEQ ID NO: 97625 - protein, 14 aa, Borrelia burgdorferi B31
ELEEITFYTTNDSS

SEQ ID NO: 97626 - protein, 14 aa, Borrelia burgdorferi B31
LEEITFYTTNDSST

SEQ ID NO: 97627 - protein, 14 aa, Borrelia burgdorferi B31
EEITFYTTNDSSTA

SEQ ID NO: 97628 - protein, 14 aa, Borrelia burgdorferi B31
EITFYTTNDSSTAY

SEQ ID NO: 97629 - protein, 14 aa, Borrelia burgdorferi B31
ITFYTTNDSSTAYK

SEQ ID NO: 97630 - protein, 14 aa, Borrelia burgdorferi B31
TFYTTNDSSTAYKM

SEQ ID NO: 97631 - protein, 14 aa, Borrelia burgdorferi B31
FYTTNDSSTAYKMY

SEQ ID NO: 97632 - protein, 14 aa, Borrelia burgdorferi B31
YTTNDSSTAYKMYE

SEQ ID NO: 97633 - protein, 14 aa, Borrelia burgdorferi B31
TTNDSSTAYKMYEN

SEQ ID NO: 97634 - protein, 14 aa, Borrelia burgdorferi B31
TNDSSTAYKMYENE

SEQ ID NO: 97635 - protein, 14 aa, Borrelia burgdorferi B31
NDSSTAYKMYENEE

SEQ ID NO: 97636 - protein, 14 aa, Borrelia burgdorferi B31
DSSTAYKMYENEEL

SEQ ID NO: 97637 - protein, 14 aa, Borrelia burgdorferi B31
SSTAYKMYENEELD

SEQ ID NO: 97638 - protein, 14 aa, Borrelia burgdorferi B31
STAYKMYENEELDA

SEQ ID NO: 97639 - protein, 14 aa, Borrelia burgdorferi B31
TAYKMYENEELDAI

SEQ ID NO: 97640 - protein, 14 aa, Borrelia burgdorferi B31
AYKMYENEELDAIF

SEQ ID NO: 97641 - protein, 14 aa, Borrelia burgdorferi B31
YKMYENEELDAIFG

SEQ ID NO: 97642 - protein, 14 aa, Borrelia burgdorferi B31
KMYENEELDAIFGS

SEQ ID NO: 97643 - protein, 14 aa, Borrelia burgdorferi B31
MYENEELDAIFGSI

SEQ ID NO: 97644 - protein, 14 aa, Borrelia burgdorferi B31
YENEELDAIFGSIP

SEQ ID NO: 97645 - protein, 14 aa, Borrelia burgdorferi B31
ENEELDAIFGSIPP

SEQ ID NO: 97646 - protein, 14 aa, Borrelia burgdorferi B31
NEELDAIFGSIPPD

SEQ ID NO: 97647 - protein, 14 aa, Borrelia burgdorferi B31
EELDAIFGSIPPDL

SEQ ID NO: 97648 - protein, 14 aa, Borrelia burgdorferi B31
ELDAIFGSIPPDLI

SEQ ID NO: 97649 - protein, 14 aa, Borrelia burgdorferi B31
LDAIFGSIPPDLIK

SEQ ID NO: 97650 - protein, 14 aa, Borrelia burgdorferi B31
DAIFGSIPPDLIKN

SEQ ID NO: 97651 - protein, 14 aa, Borrelia burgdorferi B31
AIFGSIPPDLIKNL

SEQ ID NO: 97652 - protein, 14 aa, Borrelia burgdorferi B31
IFGSIPPDLIKNLK

SEQ ID NO: 97653 - protein, 14 aa, Borrelia burgdorferi B31
FGSIPPDLIKNLKL

SEQ ID NO: 97654 - protein, 14 aa, Borrelia burgdorferi B31
GSIPPDLIKNLKLR

SEQ ID NO: 97655 - protein, 14 aa, Borrelia burgdorferi B31
SIPPDLIKNLKLRS

SEQ ID NO: 97656 - protein, 14 aa, Borrelia burgdorferi B31
IPPDLIKNLKLRSD

SEQ ID NO: 97657 - protein, 14 aa, Borrelia burgdorferi B31
PPDLIKNLKLRSDY

SEQ ID NO: 97658 - protein, 14 aa, Borrelia burgdorferi B31
PDLIKNLKLRSDYY

SEQ ID NO: 97659 - protein, 14 aa, Borrelia burgdorferi B31
DLIKNLKLRSDYYS

SEQ ID NO: 97660 - protein, 14 aa, Borrelia burgdorferi B31
LIKNLKLRSDYYSS

SEQ ID NO: 97661 - protein, 14 aa, Borrelia burgdorferi B31
IKNLKLRSDYYSSA

SEQ ID NO: 97662 - protein, 14 aa, Borrelia burgdorferi B31
KNLKLRSDYYSSAV

SEQ ID NO: 97663 - protein, 14 aa, Borrelia burgdorferi B31
NLKLRSDYYSSAVN

SEQ ID NO: 97664 - protein, 14 aa, Borrelia burgdorferi B31
LKLRSDYYSSAVNA

SEQ ID NO: 97665 - protein, 14 aa, Borrelia burgdorferi B31
KLRSDYYSSAVNAI

SEQ ID NO: 97666 - protein, 14 aa, Borrelia burgdorferi B31
LRSDYYSSAVNAIY

SEQ ID NO: 97667 - protein, 14 aa, Borrelia burgdorferi B31
RSDYYSSAVNAIYF

SEQ ID NO: 97668 - protein, 14 aa, Borrelia burgdorferi B31
SDYYSSAVNAIYFY

SEQ ID NO: 97669 - protein, 14 aa, Borrelia burgdorferi B31
DYYSSAVNAIYFYA

SEQ ID NO: 97670 - protein, 14 aa, Borrelia burgdorferi B31
YYSSAVNAIYFYAF

SEQ ID NO: 97671 - protein, 14 aa, Borrelia burgdorferi B31
YSSAVNAIYFYAFN

SEQ ID NO: 97672 - protein, 14 aa, Borrelia burgdorferi B31
SSAVNAIYFYAFNT

SEQ ID NO: 97673 - protein, 14 aa, Borrelia burgdorferi B31
SAVNAIYFYAFNTH

SEQ ID NO: 97674 - protein, 14 aa, Borrelia burgdorferi B31
AVNAIYFYAFNTHI

SEQ ID NO: 97675 - protein, 14 aa, Borrelia burgdorferi B31
VNAIYFYAFNTHIK

SEQ ID NO: 97676 - protein, 14 aa, Borrelia burgdorferi B31
NAIYFYAFNTHIKP

SEQ ID NO: 97677 - protein, 14 aa, Borrelia burgdorferi B31
AIYFYAFNTHIKPL

SEQ ID NO: 97678 - protein, 14 aa, Borrelia burgdorferi B31
IYFYAFNTHIKPLD

SEQ ID NO: 97679 - protein, 14 aa, Borrelia burgdorferi B31
YFYAFNTHIKPLDN

SEQ ID NO: 97680 - protein, 14 aa, Borrelia burgdorferi B31
FYAFNTHIKPLDNV

SEQ ID NO: 97681 - protein, 14 aa, Borrelia burgdorferi B31
YAFNTHIKPLDNVK

SEQ ID NO: 97682 - protein, 14 aa, Borrelia burgdorferi B31
AFNTHIKPLDNVKI

SEQ ID NO: 97683 - protein, 14 aa, Borrelia burgdorferi B31
FNTHIKPLDNVKIR

SEQ ID NO: 97684 - protein, 14 aa, Borrelia burgdorferi B31
NTHIKPLDNVKIRK

SEQ ID NO: 97685 - protein, 14 aa, Borrelia burgdorferi B31
THIKPLDNVKIRKA

SEQ ID NO: 97686 - protein, 14 aa, Borrelia burgdorferi B31
HIKPLDNVKIRKAL

SEQ ID NO: 97687 - protein, 14 aa, Borrelia burgdorferi B31
IKPLDNVKIRKALT

SEQ ID NO: 97688 - protein, 14 aa, Borrelia burgdorferi B31
KPLDNVKIRKALTL

SEQ ID NO: 97689 - protein, 14 aa, Borrelia burgdorferi B31
PLDNVKIRKALTLA

SEQ ID NO: 97690 - protein, 14 aa, Borrelia burgdorferi B31
LDNVKIRKALTLAI

SEQ ID NO: 97691 - protein, 14 aa, Borrelia burgdorferi B31
DNVKIRKALTLAID

SEQ ID NO: 97692 - protein, 14 aa, Borrelia burgdorferi B31
NVKIRKALTLAIDR

SEQ ID NO: 97693 - protein, 14 aa, Borrelia burgdorferi B31
VKIRKALTLAIDRE

SEQ ID NO: 97694 - protein, 14 aa, Borrelia burgdorferi B31
KIRKALTLAIDRET

SEQ ID NO: 97695 - protein, 14 aa, Borrelia burgdorferi B31
IRKALTLAIDRETL

SEQ ID NO: 97696 - protein, 14 aa, Borrelia burgdorferi B31
RKALTLAIDRETLT

SEQ ID NO: 97697 - protein, 14 aa, Borrelia burgdorferi B31
KALTLAIDRETLTY

SEQ ID NO: 97698 - protein, 14 aa, Borrelia burgdorferi B31
ALTLAIDRETLTYK

SEQ ID NO: 97699 - protein, 14 aa, Borrelia burgdorferi B31
LTLAIDRETLTYKV

SEQ ID NO: 97700 - protein, 14 aa, Borrelia burgdorferi B31
TLAIDRETLTYKVL

SEQ ID NO: 97701 - protein, 14 aa, Borrelia burgdorferi B31
LAIDRETLTYKVLD

SEQ ID NO: 97702 - protein, 14 aa, Borrelia burgdorferi B31
AIDRETLTYKVLDN

SEQ ID NO: 97703 - protein, 14 aa, Borrelia burgdorferi B31
IDRETLTYKVLDNG

SEQ ID NO: 97704 - protein, 14 aa, Borrelia burgdorferi B31
DRETLTYKVLDNGT

SEQ ID NO: 97705 - protein, 14 aa, Borrelia burgdorferi B31
RETLTYKVLDNGTT

SEQ ID NO: 97706 - protein, 14 aa, Borrelia burgdorferi B31
ETLTYKVLDNGTTP

SEQ ID NO: 97707 - protein, 14 aa, Borrelia burgdorferi B31
TLTYKVLDNGTTPT

SEQ ID NO: 97708 - protein, 14 aa, Borrelia burgdorferi B31
LTYKVLDNGTTPTR

SEQ ID NO: 97709 - protein, 14 aa, Borrelia burgdorferi B31
TYKVLDNGTTPTRR

SEQ ID NO: 97710 - protein, 14 aa, Borrelia burgdorferi B31
YKVLDNGTTPTRRA

SEQ ID NO: 97711 - protein, 14 aa, Borrelia burgdorferi B31
KVLDNGTTPTRRAT

SEQ ID NO: 97712 - protein, 14 aa, Borrelia burgdorferi B31
VLDNGTTPTRRATP

SEQ ID NO: 97713 - protein, 14 aa, Borrelia burgdorferi B31
LDNGTTPTRRATPN

SEQ ID NO: 97714 - protein, 14 aa, Borrelia burgdorferi B31
DNGTTPTRRATPNF

SEQ ID NO: 97715 - protein, 14 aa, Borrelia burgdorferi B31
NGTTPTRRATPNFS

SEQ ID NO: 97716 - protein, 14 aa, Borrelia burgdorferi B31
GTTPTRRATPNFSS

SEQ ID NO: 97717 - protein, 14 aa, Borrelia burgdorferi B31
TTPTRRATPNFSSY

SEQ ID NO: 97718 - protein, 14 aa, Borrelia burgdorferi B31
TPTRRATPNFSSYS

SEQ ID NO: 97719 - protein, 14 aa, Borrelia burgdorferi B31
PTRRATPNFSSYSY

SEQ ID NO: 97720 - protein, 14 aa, Borrelia burgdorferi B31
TRRATPNFSSYSYA

SEQ ID NO: 97721 - protein, 14 aa, Borrelia burgdorferi B31
RRATPNFSSYSYAK

SEQ ID NO: 97722 - protein, 14 aa, Borrelia burgdorferi B31
RATPNFSSYSYAKS

SEQ ID NO: 97723 - protein, 14 aa, Borrelia burgdorferi B31
ATPNFSSYSYAKSL

SEQ ID NO: 97724 - protein, 14 aa, Borrelia burgdorferi B31
TPNFSSYSYAKSLE

SEQ ID NO: 97725 - protein, 14 aa, Borrelia burgdorferi B31
PNFSSYSYAKSLEL

SEQ ID NO: 97726 - protein, 14 aa, Borrelia burgdorferi B31
NFSSYSYAKSLELF

SEQ ID NO: 97727 - protein, 14 aa, Borrelia burgdorferi B31
FSSYSYAKSLELFN

SEQ ID NO: 97728 - protein, 14 aa, Borrelia burgdorferi B31
SSYSYAKSLELFNP

SEQ ID NO: 97729 - protein, 14 aa, Borrelia burgdorferi B31
SYSYAKSLELFNPE

SEQ ID NO: 97730 - protein, 14 aa, Borrelia burgdorferi B31
YSYAKSLELFNPEI

SEQ ID NO: 97731 - protein, 14 aa, Borrelia burgdorferi B31
SYAKSLELFNPEIA

SEQ ID NO: 97732 - protein, 14 aa, Borrelia burgdorferi B31
YAKSLELFNPEIAK

SEQ ID NO: 97733 - protein, 14 aa, Borrelia burgdorferi B31
AKSLELFNPEIAKT

SEQ ID NO: 97734 - protein, 14 aa, Borrelia burgdorferi B31
KSLELFNPEIAKTL

SEQ ID NO: 97735 - protein, 14 aa, Borrelia burgdorferi B31
SLELFNPEIAKTLL

SEQ ID NO: 97736 - protein, 14 aa, Borrelia burgdorferi B31
LELFNPEIAKTLLA

SEQ ID NO: 97737 - protein, 14 aa, Borrelia burgdorferi B31
ELFNPEIAKTLLAE

SEQ ID NO: 97738 - protein, 14 aa, Borrelia burgdorferi B31
LFNPEIAKTLLAEA

SEQ ID NO: 97739 - protein, 14 aa, Borrelia burgdorferi B31
FNPEIAKTLLAEAG

SEQ ID NO: 97740 - protein, 14 aa, Borrelia burgdorferi B31
NPEIAKTLLAEAGY

SEQ ID NO: 97741 - protein, 14 aa, Borrelia burgdorferi B31
PEIAKTLLAEAGYP

SEQ ID NO: 97742 - protein, 14 aa, Borrelia burgdorferi B31
EIAKTLLAEAGYPN

SEQ ID NO: 97743 - protein, 14 aa, Borrelia burgdorferi B31
IAKTLLAEAGYPNG

SEQ ID NO: 97744 - protein, 14 aa, Borrelia burgdorferi B31
AKTLLAEAGYPNGN

SEQ ID NO: 97745 - protein, 14 aa, Borrelia burgdorferi B31
KTLLAEAGYPNGNG

SEQ ID NO: 97746 - protein, 14 aa, Borrelia burgdorferi B31
TLLAEAGYPNGNGF

SEQ ID NO: 97747 - protein, 14 aa, Borrelia burgdorferi B31
LLAEAGYPNGNGFP

SEQ ID NO: 97748 - protein, 14 aa, Borrelia burgdorferi B31
LAEAGYPNGNGFPI

SEQ ID NO: 97749 - protein, 14 aa, Borrelia burgdorferi B31
AEAGYPNGNGFPIL

SEQ ID NO: 97750 - protein, 14 aa, Borrelia burgdorferi B31
EAGYPNGNGFPILK

SEQ ID NO: 97751 - protein, 14 aa, Borrelia burgdorferi B31
AGYPNGNGFPILKL

SEQ ID NO: 97752 - protein, 14 aa, Borrelia burgdorferi B31
GYPNGNGFPILKLK

SEQ ID NO: 97753 - protein, 14 aa, Borrelia burgdorferi B31
YPNGNGFPILKLKY

SEQ ID NO: 97754 - protein, 14 aa, Borrelia burgdorferi B31
PNGNGFPILKLKYN

SEQ ID NO: 97755 - protein, 14 aa, Borrelia burgdorferi B31
NGNGFPILKLKYNT

SEQ ID NO: 97756 - protein, 14 aa, Borrelia burgdorferi B31
GNGFPILKLKYNTN

SEQ ID NO: 97757 - protein, 14 aa, Borrelia burgdorferi B31
NGFPILKLKYNTNE

SEQ ID NO: 97758 - protein, 14 aa, Borrelia burgdorferi B31
GFPILKLKYNTNEA

SEQ ID NO: 97759 - protein, 14 aa, Borrelia burgdorferi B31
FPILKLKYNTNEAN

SEQ ID NO: 97760 - protein, 14 aa, Borrelia burgdorferi B31
PILKLKYNTNEANK

SEQ ID NO: 97761 - protein, 14 aa, Borrelia burgdorferi B31
ILKLKYNTNEANKK

SEQ ID NO: 97762 - protein, 14 aa, Borrelia burgdorferi B31
LKLKYNTNEANKKI

SEQ ID NO: 97763 - protein, 14 aa, Borrelia burgdorferi B31
KLKYNTNEANKKIC

SEQ ID NO: 97764 - protein, 14 aa, Borrelia burgdorferi B31
LKYNTNEANKKICE

SEQ ID NO: 97765 - protein, 14 aa, Borrelia burgdorferi B31
KYNTNEANKKICEF

SEQ ID NO: 97766 - protein, 14 aa, Borrelia burgdorferi B31
YNTNEANKKICEFI

SEQ ID NO: 97767 - protein, 14 aa, Borrelia burgdorferi B31
NTNEANKKICEFIQ

SEQ ID NO: 97768 - protein, 14 aa, Borrelia burgdorferi B31
TNEANKKICEFIQN

SEQ ID NO: 97769 - protein, 14 aa, Borrelia burgdorferi B31
NEANKKICEFIQNQ

SEQ ID NO: 97770 - protein, 14 aa, Borrelia burgdorferi B31
EANKKICEFIQNQW

SEQ ID NO: 97771 - protein, 14 aa, Borrelia burgdorferi B31
ANKKICEFIQNQWK

SEQ ID NO: 97772 - protein, 14 aa, Borrelia burgdorferi B31
NKKICEFIQNQWKK

SEQ ID NO: 97773 - protein, 14 aa, Borrelia burgdorferi B31
KKICEFIQNQWKKN

SEQ ID NO: 97774 - protein, 14 aa, Borrelia burgdorferi B31
KICEFIQNQWKKNL

SEQ ID NO: 97775 - protein, 14 aa, Borrelia burgdorferi B31
ICEFIQNQWKKNLN

SEQ ID NO: 97776 - protein, 14 aa, Borrelia burgdorferi B31
CEFIQNQWKKNLNI

SEQ ID NO: 97777 - protein, 14 aa, Borrelia burgdorferi B31
EFIQNQWKKNLNID

SEQ ID NO: 97778 - protein, 14 aa, Borrelia burgdorferi B31
FIQNQWKKNLNIDV

SEQ ID NO: 97779 - protein, 14 aa, Borrelia burgdorferi B31
IQNQWKKNLNIDVE

SEQ ID NO: 97780 - protein, 14 aa, Borrelia burgdorferi B31
QNQWKKNLNIDVEL

SEQ ID NO: 97781 - protein, 14 aa, Borrelia burgdorferi B31
NQWKKNLNIDVELE

SEQ ID NO: 97782 - protein, 14 aa, Borrelia burgdorferi B31
QWKKNLNIDVELEN

SEQ ID NO: 97783 - protein, 14 aa, Borrelia burgdorferi B31
WKKNLNIDVELENE

SEQ ID NO: 97784 - protein, 14 aa, Borrelia burgdorferi B31
KKNLNIDVELENEE

SEQ ID NO: 97785 - protein, 14 aa, Borrelia burgdorferi B31
KNLNIDVELENEEW

SEQ ID NO: 97786 - protein, 14 aa, Borrelia burgdorferi B31
NLNIDVELENEEWT

SEQ ID NO: 97787 - protein, 14 aa, Borrelia burgdorferi B31
LNIDVELENEEWTT

SEQ ID NO: 97788 - protein, 14 aa, Borrelia burgdorferi B31
NIDVELENEEWTTY

SEQ ID NO: 97789 - protein, 14 aa, Borrelia burgdorferi B31
IDVELENEEWTTYL

SEQ ID NO: 97790 - protein, 14 aa, Borrelia burgdorferi B31
DVELENEEWTTYLN

SEQ ID NO: 97791 - protein, 14 aa, Borrelia burgdorferi B31
VELENEEWTTYLNT

SEQ ID NO: 97792 - protein, 14 aa, Borrelia burgdorferi B31
ELENEEWTTYLNTK

SEQ ID NO: 97793 - protein, 14 aa, Borrelia burgdorferi B31
LENEEWTTYLNTKA

SEQ ID NO: 97794 - protein, 14 aa, Borrelia burgdorferi B31
ENEEWTTYLNTKAN

SEQ ID NO: 97795 - protein, 14 aa, Borrelia burgdorferi B31
NEEWTTYLNTKANG

SEQ ID NO: 97796 - protein, 14 aa, Borrelia burgdorferi B31
EEWTTYLNTKANGN

SEQ ID NO: 97797 - protein, 14 aa, Borrelia burgdorferi B31
EWTTYLNTKANGNY

SEQ ID NO: 97798 - protein, 14 aa, Borrelia burgdorferi B31
WTTYLNTKANGNYE

SEQ ID NO: 97799 - protein, 14 aa, Borrelia burgdorferi B31
TTYLNTKANGNYEI

SEQ ID NO: 97800 - protein, 14 aa, Borrelia burgdorferi B31
TYLNTKANGNYEIA

SEQ ID NO: 97801 - protein, 14 aa, Borrelia burgdorferi B31
YLNTKANGNYEIAR

SEQ ID NO: 97802 - protein, 14 aa, Borrelia burgdorferi B31
LNTKANGNYEIARA

SEQ ID NO: 97803 - protein, 14 aa, Borrelia burgdorferi B31
NTKANGNYEIARAG

SEQ ID NO: 97804 - protein, 14 aa, Borrelia burgdorferi B31
TKANGNYEIARAGW

SEQ ID NO: 97805 - protein, 14 aa, Borrelia burgdorferi B31
KANGNYEIARAGWI

SEQ ID NO: 97806 - protein, 14 aa, Borrelia burgdorferi B31
ANGNYEIARAGWIG

SEQ ID NO: 97807 - protein, 14 aa, Borrelia burgdorferi B31
NGNYEIARAGWIGD

SEQ ID NO: 97808 - protein, 14 aa, Borrelia burgdorferi B31
GNYEIARAGWIGDY

SEQ ID NO: 97809 - protein, 14 aa, Borrelia burgdorferi B31
NYEIARAGWIGDYA

SEQ ID NO: 97810 - protein, 14 aa, Borrelia burgdorferi B31
YEIARAGWIGDYAD

SEQ ID NO: 97811 - protein, 14 aa, Borrelia burgdorferi B31
EIARAGWIGDYADP

SEQ ID NO: 97812 - protein, 14 aa, Borrelia burgdorferi B31
IARAGWIGDYADPL

SEQ ID NO: 97813 - protein, 14 aa, Borrelia burgdorferi B31
ARAGWIGDYADPLT

SEQ ID NO: 97814 - protein, 14 aa, Borrelia burgdorferi B31
RAGWIGDYADPLTF

SEQ ID NO: 97815 - protein, 14 aa, Borrelia burgdorferi B31
AGWIGDYADPLTFL

SEQ ID NO: 97816 - protein, 14 aa, Borrelia burgdorferi B31
GWIGDYADPLTFLS

SEQ ID NO: 97817 - protein, 14 aa, Borrelia burgdorferi B31
WIGDYADPLTFLSI

SEQ ID NO: 97818 - protein, 14 aa, Borrelia burgdorferi B31
IGDYADPLTFLSIF

SEQ ID NO: 97819 - protein, 14 aa, Borrelia burgdorferi B31
GDYADPLTFLSIFT

SEQ ID NO: 97820 - protein, 14 aa, Borrelia burgdorferi B31
DYADPLTFLSIFTQ

SEQ ID NO: 97821 - protein, 14 aa, Borrelia burgdorferi B31
YADPLTFLSIFTQG

SEQ ID NO: 97822 - protein, 14 aa, Borrelia burgdorferi B31
ADPLTFLSIFTQGY

SEQ ID NO: 97823 - protein, 14 aa, Borrelia burgdorferi B31
DPLTFLSIFTQGYT

SEQ ID NO: 97824 - protein, 14 aa, Borrelia burgdorferi B31
PLTFLSIFTQGYTQ

SEQ ID NO: 97825 - protein, 14 aa, Borrelia burgdorferi B31
LTFLSIFTQGYTQF

SEQ ID NO: 97826 - protein, 14 aa, Borrelia burgdorferi B31
TFLSIFTQGYTQFS

SEQ ID NO: 97827 - protein, 14 aa, Borrelia burgdorferi B31
FLSIFTQGYTQFSS

SEQ ID NO: 97828 - protein, 14 aa, Borrelia burgdorferi B31
LSIFTQGYTQFSSH

SEQ ID NO: 97829 - protein, 14 aa, Borrelia burgdorferi B31
SIFTQGYTQFSSHN

SEQ ID NO: 97830 - protein, 14 aa, Borrelia burgdorferi B31
IFTQGYTQFSSHNY

SEQ ID NO: 97831 - protein, 14 aa, Borrelia burgdorferi B31
FTQGYTQFSSHNYS

SEQ ID NO: 97832 - protein, 14 aa, Borrelia burgdorferi B31
TQGYTQFSSHNYSN

SEQ ID NO: 97833 - protein, 14 aa, Borrelia burgdorferi B31
QGYTQFSSHNYSNP

SEQ ID NO: 97834 - protein, 14 aa, Borrelia burgdorferi B31
GYTQFSSHNYSNPE

SEQ ID NO: 97835 - protein, 14 aa, Borrelia burgdorferi B31
YTQFSSHNYSNPEY

SEQ ID NO: 97836 - protein, 14 aa, Borrelia burgdorferi B31
TQFSSHNYSNPEYN

SEQ ID NO: 97837 - protein, 14 aa, Borrelia burgdorferi B31
QFSSHNYSNPEYNE

SEQ ID NO: 97838 - protein, 14 aa, Borrelia burgdorferi B31
FSSHNYSNPEYNEL

SEQ ID NO: 97839 - protein, 14 aa, Borrelia burgdorferi B31
SSHNYSNPEYNELI

SEQ ID NO: 97840 - protein, 14 aa, Borrelia burgdorferi B31
SHNYSNPEYNELIK

SEQ ID NO: 97841 - protein, 14 aa, Borrelia burgdorferi B31
HNYSNPEYNELIKK

SEQ ID NO: 97842 - protein, 14 aa, Borrelia burgdorferi B31
NYSNPEYNELIKKS

SEQ ID NO: 97843 - protein, 14 aa, Borrelia burgdorferi B31
YSNPEYNELIKKSD

SEQ ID NO: 97844 - protein, 14 aa, Borrelia burgdorferi B31
SNPEYNELIKKSDL

SEQ ID NO: 97845 - protein, 14 aa, Borrelia burgdorferi B31
NPEYNELIKKSDLE

SEQ ID NO: 97846 - protein, 14 aa, Borrelia burgdorferi B31
PEYNELIKKSDLEL

SEQ ID NO: 97847 - protein, 14 aa, Borrelia burgdorferi B31
EYNELIKKSDLELD

SEQ ID NO: 97848 - protein, 14 aa, Borrelia burgdorferi B31
YNELIKKSDLELDP

SEQ ID NO: 97849 - protein, 14 aa, Borrelia burgdorferi B31
NELIKKSDLELDPI

SEQ ID NO: 97850 - protein, 14 aa, Borrelia burgdorferi B31
ELIKKSDLELDPIK

SEQ ID NO: 97851 - protein, 14 aa, Borrelia burgdorferi B31
LIKKSDLELDPIKR

SEQ ID NO: 97852 - protein, 14 aa, Borrelia burgdorferi B31
IKKSDLELDPIKRQ

SEQ ID NO: 97853 - protein, 14 aa, Borrelia burgdorferi B31
KKSDLELDPIKRQD

SEQ ID NO: 97854 - protein, 14 aa, Borrelia burgdorferi B31
KSDLELDPIKRQDI

SEQ ID NO: 97855 - protein, 14 aa, Borrelia burgdorferi B31
SDLELDPIKRQDIL

SEQ ID NO: 97856 - protein, 14 aa, Borrelia burgdorferi B31
DLELDPIKRQDILR

SEQ ID NO: 97857 - protein, 14 aa, Borrelia burgdorferi B31
LELDPIKRQDILRQ

SEQ ID NO: 97858 - protein, 14 aa, Borrelia burgdorferi B31
ELDPIKRQDILRQA

SEQ ID NO: 97859 - protein, 14 aa, Borrelia burgdorferi B31
LDPIKRQDILRQAE

SEQ ID NO: 97860 - protein, 14 aa, Borrelia burgdorferi B31
DPIKRQDILRQAEE

SEQ ID NO: 97861 - protein, 14 aa, Borrelia burgdorferi B31
PIKRQDILRQAEEI

SEQ ID NO: 97862 - protein, 14 aa, Borrelia burgdorferi B31
IKRQDILRQAEEII

SEQ ID NO: 97863 - protein, 14 aa, Borrelia burgdorferi B31
KRQDILRQAEEIII

SEQ ID NO: 97864 - protein, 14 aa, Borrelia burgdorferi B31
RQDILRQAEEIIIE

SEQ ID NO: 97865 - protein, 14 aa, Borrelia burgdorferi B31
QDILRQAEEIIIEK

SEQ ID NO: 97866 - protein, 14 aa, Borrelia burgdorferi B31
DILRQAEEIIIEKD

SEQ ID NO: 97867 - protein, 14 aa, Borrelia burgdorferi B31
ILRQAEEIIIEKDF

SEQ ID NO: 97868 - protein, 14 aa, Borrelia burgdorferi B31
LRQAEEIIIEKDFP

SEQ ID NO: 97869 - protein, 14 aa, Borrelia burgdorferi B31
RQAEEIIIEKDFPI

SEQ ID NO: 97870 - protein, 14 aa, Borrelia burgdorferi B31
QAEEIIIEKDFPIA

SEQ ID NO: 97871 - protein, 14 aa, Borrelia burgdorferi B31
AEEIIIEKDFPIAP

SEQ ID NO: 97872 - protein, 14 aa, Borrelia burgdorferi B31
EEIIIEKDFPIAPI

SEQ ID NO: 97873 - protein, 14 aa, Borrelia burgdorferi B31
EIIIEKDFPIAPIY

SEQ ID NO: 97874 - protein, 14 aa, Borrelia burgdorferi B31
IIIEKDFPIAPIYI

SEQ ID NO: 97875 - protein, 14 aa, Borrelia burgdorferi B31
IIEKDFPIAPIYIY

SEQ ID NO: 97876 - protein, 14 aa, Borrelia burgdorferi B31
IEKDFPIAPIYIYG

SEQ ID NO: 97877 - protein, 14 aa, Borrelia burgdorferi B31
EKDFPIAPIYIYGN

SEQ ID NO: 97878 - protein, 14 aa, Borrelia burgdorferi B31
KDFPIAPIYIYGNS

SEQ ID NO: 97879 - protein, 14 aa, Borrelia burgdorferi B31
DFPIAPIYIYGNSY

SEQ ID NO: 97880 - protein, 14 aa, Borrelia burgdorferi B31
FPIAPIYIYGNSYL

SEQ ID NO: 97881 - protein, 14 aa, Borrelia burgdorferi B31
PIAPIYIYGNSYLF

SEQ ID NO: 97882 - protein, 14 aa, Borrelia burgdorferi B31
IAPIYIYGNSYLFR

SEQ ID NO: 97883 - protein, 14 aa, Borrelia burgdorferi B31
APIYIYGNSYLFRN

SEQ ID NO: 97884 - protein, 14 aa, Borrelia burgdorferi B31
PIYIYGNSYLFRND

SEQ ID NO: 97885 - protein, 14 aa, Borrelia burgdorferi B31
IYIYGNSYLFRNDK

SEQ ID NO: 97886 - protein, 14 aa, Borrelia burgdorferi B31
YIYGNSYLFRNDKW

SEQ ID NO: 97887 - protein, 14 aa, Borrelia burgdorferi B31
IYGNSYLFRNDKWT

SEQ ID NO: 97888 - protein, 14 aa, Borrelia burgdorferi B31
YGNSYLFRNDKWTG

SEQ ID NO: 97889 - protein, 14 aa, Borrelia burgdorferi B31
GNSYLFRNDKWTGW

SEQ ID NO: 97890 - protein, 14 aa, Borrelia burgdorferi B31
NSYLFRNDKWTGWN

SEQ ID NO: 97891 - protein, 14 aa, Borrelia burgdorferi B31
SYLFRNDKWTGWNT

SEQ ID NO: 97892 - protein, 14 aa, Borrelia burgdorferi B31
YLFRNDKWTGWNTN

SEQ ID NO: 97893 - protein, 14 aa, Borrelia burgdorferi B31
LFRNDKWTGWNTNI

SEQ ID NO: 97894 - protein, 14 aa, Borrelia burgdorferi B31
FRNDKWTGWNTNIL

SEQ ID NO: 97895 - protein, 14 aa, Borrelia burgdorferi B31
RNDKWTGWNTNILE

SEQ ID NO: 97896 - protein, 14 aa, Borrelia burgdorferi B31
NDKWTGWNTNILER

SEQ ID NO: 97897 - protein, 14 aa, Borrelia burgdorferi B31
DKWTGWNTNILERF

SEQ ID NO: 97898 - protein, 14 aa, Borrelia burgdorferi B31
KWTGWNTNILERFD

SEQ ID NO: 97899 - protein, 14 aa, Borrelia burgdorferi B31
WTGWNTNILERFDL

SEQ ID NO: 97900 - protein, 14 aa, Borrelia burgdorferi B31
TGWNTNILERFDLS

SEQ ID NO: 97901 - protein, 14 aa, Borrelia burgdorferi B31
GWNTNILERFDLSQ

SEQ ID NO: 97902 - protein, 14 aa, Borrelia burgdorferi B31
WNTNILERFDLSQL

SEQ ID NO: 97903 - protein, 14 aa, Borrelia burgdorferi B31
NTNILERFDLSQLK

SEQ ID NO: 97904 - protein, 14 aa, Borrelia burgdorferi B31
TNILERFDLSQLKL

SEQ ID NO: 97905 - protein, 14 aa, Borrelia burgdorferi B31
NILERFDLSQLKLK

SEQ ID NO: 97906 - protein, 14 aa, Borrelia burgdorferi B31
ILERFDLSQLKLKN

SEQ ID NO: 97907 - protein, 14 aa, Borrelia burgdorferi B31
LERFDLSQLKLKNK

SEQ ID NO: 97908 - protein, 15 aa, Borrelia burgdorferi B31
MKLQRSLFLIIFFLT

SEQ ID NO: 97909 - protein, 15 aa, Borrelia burgdorferi B31
KLQRSLFLIIFFLTF

SEQ ID NO: 97910 - protein, 15 aa, Borrelia burgdorferi B31
LQRSLFLIIFFLTFL

SEQ ID NO: 97911 - protein, 15 aa, Borrelia burgdorferi B31
QRSLFLIIFFLTFLC

SEQ ID NO: 97912 - protein, 15 aa, Borrelia burgdorferi B31
RSLFLIIFFLTFLCC

SEQ ID NO: 97913 - protein, 15 aa, Borrelia burgdorferi B31
SLFLIIFFLTFLCCN

SEQ ID NO: 97914 - protein, 15 aa, Borrelia burgdorferi B31
LFLIIFFLTFLCCNN

SEQ ID NO: 97915 - protein, 15 aa, Borrelia burgdorferi B31
FLIIFFLTFLCCNNK

SEQ ID NO: 97916 - protein, 15 aa, Borrelia burgdorferi B31
LIIFFLTFLCCNNKE

SEQ ID NO: 97917 - protein, 15 aa, Borrelia burgdorferi B31
IIFFLTFLCCNNKER

SEQ ID NO: 97918 - protein, 15 aa, Borrelia burgdorferi B31
IFFLTFLCCNNKERK

SEQ ID NO: 97919 - protein, 15 aa, Borrelia burgdorferi B31
FFLTFLCCNNKERKE

SEQ ID NO: 97920 - protein, 15 aa, Borrelia burgdorferi B31
FLTFLCCNNKERKEG

SEQ ID NO: 97921 - protein, 15 aa, Borrelia burgdorferi B31
LTFLCCNNKERKEGV

SEQ ID NO: 97922 - protein, 15 aa, Borrelia burgdorferi B31
TFLCCNNKERKEGVS

SEQ ID NO: 97923 - protein, 15 aa, Borrelia burgdorferi B31
FLCCNNKERKEGVSF

SEQ ID NO: 97924 - protein, 15 aa, Borrelia burgdorferi B31
LCCNNKERKEGVSFK

SEQ ID NO: 97925 - protein, 15 aa, Borrelia burgdorferi B31
CCNNKERKEGVSFKI

SEQ ID NO: 97926 - protein, 15 aa, Borrelia burgdorferi B31
CNNKERKEGVSFKIS

SEQ ID NO: 97927 - protein, 15 aa, Borrelia burgdorferi B31
NNKERKEGVSFKISL

SEQ ID NO: 97928 - protein, 15 aa, Borrelia burgdorferi B31
NKERKEGVSFKISLG

SEQ ID NO: 97929 - protein, 15 aa, Borrelia burgdorferi B31
KERKEGVSFKISLGA

SEQ ID NO: 97930 - protein, 15 aa, Borrelia burgdorferi B31
ERKEGVSFKISLGAE

SEQ ID NO: 97931 - protein, 15 aa, Borrelia burgdorferi B31
RKEGVSFKISLGAEP

SEQ ID NO: 97932 - protein, 15 aa, Borrelia burgdorferi B31
KEGVSFKISLGAEPS

SEQ ID NO: 97933 - protein, 15 aa, Borrelia burgdorferi B31
EGVSFKISLGAEPSS

SEQ ID NO: 97934 - protein, 15 aa, Borrelia burgdorferi B31
GVSFKISLGAEPSSL

SEQ ID NO: 97935 - protein, 15 aa, Borrelia burgdorferi B31
VSFKISLGAEPSSLD

SEQ ID NO: 97936 - protein, 15 aa, Borrelia burgdorferi B31
SFKISLGAEPSSLDP

SEQ ID NO: 97937 - protein, 15 aa, Borrelia burgdorferi B31
FKISLGAEPSSLDPQ

SEQ ID NO: 97938 - protein, 15 aa, Borrelia burgdorferi B31
KISLGAEPSSLDPQL

SEQ ID NO: 97939 - protein, 15 aa, Borrelia burgdorferi B31
ISLGAEPSSLDPQLA

SEQ ID NO: 97940 - protein, 15 aa, Borrelia burgdorferi B31
SLGAEPSSLDPQLAE

SEQ ID NO: 97941 - protein, 15 aa, Borrelia burgdorferi B31
LGAEPSSLDPQLAED

SEQ ID NO: 97942 - protein, 15 aa, Borrelia burgdorferi B31
GAEPSSLDPQLAEDN

SEQ ID NO: 97943 - protein, 15 aa, Borrelia burgdorferi B31
AEPSSLDPQLAEDNV

SEQ ID NO: 97944 - protein, 15 aa, Borrelia burgdorferi B31
EPSSLDPQLAEDNVA

SEQ ID NO: 97945 - protein, 15 aa, Borrelia burgdorferi B31
PSSLDPQLAEDNVAS

SEQ ID NO: 97946 - protein, 15 aa, Borrelia burgdorferi B31
SSLDPQLAEDNVASK

SEQ ID NO: 97947 - protein, 15 aa, Borrelia burgdorferi B31
SLDPQLAEDNVASKM

SEQ ID NO: 97948 - protein, 15 aa, Borrelia burgdorferi B31
LDPQLAEDNVASKMI

SEQ ID NO: 97949 - protein, 15 aa, Borrelia burgdorferi B31
DPQLAEDNVASKMID

SEQ ID NO: 97950 - protein, 15 aa, Borrelia burgdorferi B31
PQLAEDNVASKMIDT

SEQ ID NO: 97951 - protein, 15 aa, Borrelia burgdorferi B31
QLAEDNVASKMIDTM

SEQ ID NO: 97952 - protein, 15 aa, Borrelia burgdorferi B31
LAEDNVASKMIDTMF

SEQ ID NO: 97953 - protein, 15 aa, Borrelia burgdorferi B31
AEDNVASKMIDTMFR

SEQ ID NO: 97954 - protein, 15 aa, Borrelia burgdorferi B31
EDNVASKMIDTMFRG

SEQ ID NO: 97955 - protein, 15 aa, Borrelia burgdorferi B31
DNVASKMIDTMFRGI

SEQ ID NO: 97956 - protein, 15 aa, Borrelia burgdorferi B31
NVASKMIDTMFRGIV

SEQ ID NO: 97957 - protein, 15 aa, Borrelia burgdorferi B31
VASKMIDTMFRGIVT

SEQ ID NO: 97958 - protein, 15 aa, Borrelia burgdorferi B31
ASKMIDTMFRGIVTG

SEQ ID NO: 97959 - protein, 15 aa, Borrelia burgdorferi B31
SKMIDTMFRGIVTGD

SEQ ID NO: 97960 - protein, 15 aa, Borrelia burgdorferi B31
KMIDTMFRGIVTGDP

SEQ ID NO: 97961 - protein, 15 aa, Borrelia burgdorferi B31
MIDTMFRGIVTGDPN

SEQ ID NO: 97962 - protein, 15 aa, Borrelia burgdorferi B31
IDTMFRGIVTGDPNT

SEQ ID NO: 97963 - protein, 15 aa, Borrelia burgdorferi B31
DTMFRGIVTGDPNTG

SEQ ID NO: 97964 - protein, 15 aa, Borrelia burgdorferi B31
TMFRGIVTGDPNTGG

SEQ ID NO: 97965 - protein, 15 aa, Borrelia burgdorferi B31
MFRGIVTGDPNTGGN

SEQ ID NO: 97966 - protein, 15 aa, Borrelia burgdorferi B31
FRGIVTGDPNTGGNK

SEQ ID NO: 97967 - protein, 15 aa, Borrelia burgdorferi B31
RGIVTGDPNTGGNKP

SEQ ID NO: 97968 - protein, 15 aa, Borrelia burgdorferi B31
GIVTGDPNTGGNKPG

SEQ ID NO: 97969 - protein, 15 aa, Borrelia burgdorferi B31
IVTGDPNTGGNKPGL

SEQ ID NO: 97970 - protein, 15 aa, Borrelia burgdorferi B31
VTGDPNTGGNKPGLA

SEQ ID NO: 97971 - protein, 15 aa, Borrelia burgdorferi B31
TGDPNTGGNKPGLAK

SEQ ID NO: 97972 - protein, 15 aa, Borrelia burgdorferi B31
GDPNTGGNKPGLAKG

SEQ ID NO: 97973 - protein, 15 aa, Borrelia burgdorferi B31
DPNTGGNKPGLAKGW

SEQ ID NO: 97974 - protein, 15 aa, Borrelia burgdorferi B31
PNTGGNKPGLAKGWD

SEQ ID NO: 97975 - protein, 15 aa, Borrelia burgdorferi B31
NTGGNKPGLAKGWDI

SEQ ID NO: 97976 - protein, 15 aa, Borrelia burgdorferi B31
TGGNKPGLAKGWDIS

SEQ ID NO: 97977 - protein, 15 aa, Borrelia burgdorferi B31
GGNKPGLAKGWDISS

SEQ ID NO: 97978 - protein, 15 aa, Borrelia burgdorferi B31
GNKPGLAKGWDISSD

SEQ ID NO: 97979 - protein, 15 aa, Borrelia burgdorferi B31
NKPGLAKGWDISSDG

SEQ ID NO: 97980 - protein, 15 aa, Borrelia burgdorferi B31
KPGLAKGWDISSDGT

SEQ ID NO: 97981 - protein, 15 aa, Borrelia burgdorferi B31
PGLAKGWDISSDGTV

SEQ ID NO: 97982 - protein, 15 aa, Borrelia burgdorferi B31
GLAKGWDISSDGTVY

SEQ ID NO: 97983 - protein, 15 aa, Borrelia burgdorferi B31
LAKGWDISSDGTVYT

SEQ ID NO: 97984 - protein, 15 aa, Borrelia burgdorferi B31
AKGWDISSDGTVYTF

SEQ ID NO: 97985 - protein, 15 aa, Borrelia burgdorferi B31
KGWDISSDGTVYTFN

SEQ ID NO: 97986 - protein, 15 aa, Borrelia burgdorferi B31
GWDISSDGTVYTFNL

SEQ ID NO: 97987 - protein, 15 aa, Borrelia burgdorferi B31
WDISSDGTVYTFNLR

SEQ ID NO: 97988 - protein, 15 aa, Borrelia burgdorferi B31
DISSDGTVYTFNLRE

SEQ ID NO: 97989 - protein, 15 aa, Borrelia burgdorferi B31
ISSDGTVYTFNLREK

SEQ ID NO: 97990 - protein, 15 aa, Borrelia burgdorferi B31
SSDGTVYTFNLREKI

SEQ ID NO: 97991 - protein, 15 aa, Borrelia burgdorferi B31
SDGTVYTFNLREKIT

SEQ ID NO: 97992 - protein, 15 aa, Borrelia burgdorferi B31
DGTVYTFNLREKITW

SEQ ID NO: 97993 - protein, 15 aa, Borrelia burgdorferi B31
GTVYTFNLREKITWS

SEQ ID NO: 97994 - protein, 15 aa, Borrelia burgdorferi B31
TVYTFNLREKITWSD

SEQ ID NO: 97995 - protein, 15 aa, Borrelia burgdorferi B31
VYTFNLREKITWSDG

SEQ ID NO: 97996 - protein, 15 aa, Borrelia burgdorferi B31
YTFNLREKITWSDGV

SEQ ID NO: 97997 - protein, 15 aa, Borrelia burgdorferi B31
TFNLREKITWSDGVA

SEQ ID NO: 97998 - protein, 15 aa, Borrelia burgdorferi B31
FNLREKITWSDGVAI

SEQ ID NO: 97999 - protein, 15 aa, Borrelia burgdorferi B31
NLREKITWSDGVAIT

SEQ ID NO: 98000 - protein, 15 aa, Borrelia burgdorferi B31
LREKITWSDGVAITA

SEQ ID NO: 98001 - protein, 15 aa, Borrelia burgdorferi B31
REKITWSDGVAITAE

SEQ ID NO: 98002 - protein, 15 aa, Borrelia burgdorferi B31
EKITWSDGVAITAEG

SEQ ID NO: 98003 - protein, 15 aa, Borrelia burgdorferi B31
KITWSDGVAITAEGI

SEQ ID NO: 98004 - protein, 15 aa, Borrelia burgdorferi B31
ITWSDGVAITAEGIR

SEQ ID NO: 98005 - protein, 15 aa, Borrelia burgdorferi B31
TWSDGVAITAEGIRK

SEQ ID NO: 98006 - protein, 15 aa, Borrelia burgdorferi B31
WSDGVAITAEGIRKS

SEQ ID NO: 98007 - protein, 15 aa, Borrelia burgdorferi B31
SDGVAITAEGIRKSY

SEQ ID NO: 98008 - protein, 15 aa, Borrelia burgdorferi B31
DGVAITAEGIRKSYL

SEQ ID NO: 98009 - protein, 15 aa, Borrelia burgdorferi B31
GVAITAEGIRKSYLR

SEQ ID NO: 98010 - protein, 15 aa, Borrelia burgdorferi B31
VAITAEGIRKSYLRI

SEQ ID NO: 98011 - protein, 15 aa, Borrelia burgdorferi B31
AITAEGIRKSYLRIL

SEQ ID NO: 98012 - protein, 15 aa, Borrelia burgdorferi B31
ITAEGIRKSYLRILN

SEQ ID NO: 98013 - protein, 15 aa, Borrelia burgdorferi B31
TAEGIRKSYLRILNK

SEQ ID NO: 98014 - protein, 15 aa, Borrelia burgdorferi B31
AEGIRKSYLRILNKE

SEQ ID NO: 98015 - protein, 15 aa, Borrelia burgdorferi B31
EGIRKSYLRILNKET

SEQ ID NO: 98016 - protein, 15 aa, Borrelia burgdorferi B31
GIRKSYLRILNKETG

SEQ ID NO: 98017 - protein, 15 aa, Borrelia burgdorferi B31
IRKSYLRILNKETGS

SEQ ID NO: 98018 - protein, 15 aa, Borrelia burgdorferi B31
RKSYLRILNKETGSK

SEQ ID NO: 98019 - protein, 15 aa, Borrelia burgdorferi B31
KSYLRILNKETGSKY

SEQ ID NO: 98020 - protein, 15 aa, Borrelia burgdorferi B31
SYLRILNKETGSKYV

SEQ ID NO: 98021 - protein, 15 aa, Borrelia burgdorferi B31
YLRILNKETGSKYVE

SEQ ID NO: 98022 - protein, 15 aa, Borrelia burgdorferi B31
LRILNKETGSKYVEM

SEQ ID NO: 98023 - protein, 15 aa, Borrelia burgdorferi B31
RILNKETGSKYVEMV

SEQ ID NO: 98024 - protein, 15 aa, Borrelia burgdorferi B31
ILNKETGSKYVEMVK

SEQ ID NO: 98025 - protein, 15 aa, Borrelia burgdorferi B31
LNKETGSKYVEMVKS

SEQ ID NO: 98026 - protein, 15 aa, Borrelia burgdorferi B31
NKETGSKYVEMVKSV

SEQ ID NO: 98027 - protein, 15 aa, Borrelia burgdorferi B31
KETGSKYVEMVKSVI

SEQ ID NO: 98028 - protein, 15 aa, Borrelia burgdorferi B31
ETGSKYVEMVKSVIK

SEQ ID NO: 98029 - protein, 15 aa, Borrelia burgdorferi B31
TGSKYVEMVKSVIKN

SEQ ID NO: 98030 - protein, 15 aa, Borrelia burgdorferi B31
GSKYVEMVKSVIKNG

SEQ ID NO: 98031 - protein, 15 aa, Borrelia burgdorferi B31
SKYVEMVKSVIKNGQ

SEQ ID NO: 98032 - protein, 15 aa, Borrelia burgdorferi B31
KYVEMVKSVIKNGQK

SEQ ID NO: 98033 - protein, 15 aa, Borrelia burgdorferi B31
YVEMVKSVIKNGQKY

SEQ ID NO: 98034 - protein, 15 aa, Borrelia burgdorferi B31
VEMVKSVIKNGQKYF

SEQ ID NO: 98035 - protein, 15 aa, Borrelia burgdorferi B31
EMVKSVIKNGQKYFD

SEQ ID NO: 98036 - protein, 15 aa, Borrelia burgdorferi B31
MVKSVIKNGQKYFDG

SEQ ID NO: 98037 - protein, 15 aa, Borrelia burgdorferi B31
VKSVIKNGQKYFDGQ

SEQ ID NO: 98038 - protein, 15 aa, Borrelia burgdorferi B31
KSVIKNGQKYFDGQV

SEQ ID NO: 98039 - protein, 15 aa, Borrelia burgdorferi B31
SVIKNGQKYFDGQVT

SEQ ID NO: 98040 - protein, 15 aa, Borrelia burgdorferi B31
VIKNGQKYFDGQVTD

SEQ ID NO: 98041 - protein, 15 aa, Borrelia burgdorferi B31
IKNGQKYFDGQVTDS

SEQ ID NO: 98042 - protein, 15 aa, Borrelia burgdorferi B31
KNGQKYFDGQVTDSE

SEQ ID NO: 98043 - protein, 15 aa, Borrelia burgdorferi B31
NGQKYFDGQVTDSEL

SEQ ID NO: 98044 - protein, 15 aa, Borrelia burgdorferi B31
GQKYFDGQVTDSELG

SEQ ID NO: 98045 - protein, 15 aa, Borrelia burgdorferi B31
QKYFDGQVTDSELGI

SEQ ID NO: 98046 - protein, 15 aa, Borrelia burgdorferi B31
KYFDGQVTDSELGIR

SEQ ID NO: 98047 - protein, 15 aa, Borrelia burgdorferi B31
YFDGQVTDSELGIRA

SEQ ID NO: 98048 - protein, 15 aa, Borrelia burgdorferi B31
FDGQVTDSELGIRAI

SEQ ID NO: 98049 - protein, 15 aa, Borrelia burgdorferi B31
DGQVTDSELGIRAID

SEQ ID NO: 98050 - protein, 15 aa, Borrelia burgdorferi B31
GQVTDSELGIRAIDE

SEQ ID NO: 98051 - protein, 15 aa, Borrelia burgdorferi B31
QVTDSELGIRAIDEK

SEQ ID NO: 98052 - protein, 15 aa, Borrelia burgdorferi B31
VTDSELGIRAIDEKT

SEQ ID NO: 98053 - protein, 15 aa, Borrelia burgdorferi B31
TDSELGIRAIDEKTL

SEQ ID NO: 98054 - protein, 15 aa, Borrelia burgdorferi B31
DSELGIRAIDEKTLE

SEQ ID NO: 98055 - protein, 15 aa, Borrelia burgdorferi B31
SELGIRAIDEKTLEI

SEQ ID NO: 98056 - protein, 15 aa, Borrelia burgdorferi B31
ELGIRAIDEKTLEIT

SEQ ID NO: 98057 - protein, 15 aa, Borrelia burgdorferi B31
LGIRAIDEKTLEITL

SEQ ID NO: 98058 - protein, 15 aa, Borrelia burgdorferi B31
GIRAIDEKTLEITLE

SEQ ID NO: 98059 - protein, 15 aa, Borrelia burgdorferi B31
IRAIDEKTLEITLES

SEQ ID NO: 98060 - protein, 15 aa, Borrelia burgdorferi B31
RAIDEKTLEITLESP

SEQ ID NO: 98061 - protein, 15 aa, Borrelia burgdorferi B31
AIDEKTLEITLESPK

SEQ ID NO: 98062 - protein, 15 aa, Borrelia burgdorferi B31
IDEKTLEITLESPKP

SEQ ID NO: 98063 - protein, 15 aa, Borrelia burgdorferi B31
DEKTLEITLESPKPY

SEQ ID NO: 98064 - protein, 15 aa, Borrelia burgdorferi B31
EKTLEITLESPKPYF

SEQ ID NO: 98065 - protein, 15 aa, Borrelia burgdorferi B31
KTLEITLESPKPYFI

SEQ ID NO: 98066 - protein, 15 aa, Borrelia burgdorferi B31
TLEITLESPKPYFID

SEQ ID NO: 98067 - protein, 15 aa, Borrelia burgdorferi B31
LEITLESPKPYFIDM

SEQ ID NO: 98068 - protein, 15 aa, Borrelia burgdorferi B31
EITLESPKPYFIDML

SEQ ID NO: 98069 - protein, 15 aa, Borrelia burgdorferi B31
ITLESPKPYFIDMLV

SEQ ID NO: 98070 - protein, 15 aa, Borrelia burgdorferi B31
TLESPKPYFIDMLVH

SEQ ID NO: 98071 - protein, 15 aa, Borrelia burgdorferi B31
LESPKPYFIDMLVHQ

SEQ ID NO: 98072 - protein, 15 aa, Borrelia burgdorferi B31
ESPKPYFIDMLVHQS

SEQ ID NO: 98073 - protein, 15 aa, Borrelia burgdorferi B31
SPKPYFIDMLVHQSF

SEQ ID NO: 98074 - protein, 15 aa, Borrelia burgdorferi B31
PKPYFIDMLVHQSFI

SEQ ID NO: 98075 - protein, 15 aa, Borrelia burgdorferi B31
KPYFIDMLVHQSFIP

SEQ ID NO: 98076 - protein, 15 aa, Borrelia burgdorferi B31
PYFIDMLVHQSFIPV

SEQ ID NO: 98077 - protein, 15 aa, Borrelia burgdorferi B31
YFIDMLVHQSFIPVP

SEQ ID NO: 98078 - protein, 15 aa, Borrelia burgdorferi B31
FIDMLVHQSFIPVPV

SEQ ID NO: 98079 - protein, 15 aa, Borrelia burgdorferi B31
IDMLVHQSFIPVPVH

SEQ ID NO: 98080 - protein, 15 aa, Borrelia burgdorferi B31
DMLVHQSFIPVPVHV

SEQ ID NO: 98081 - protein, 15 aa, Borrelia burgdorferi B31
MLVHQSFIPVPVHVT

SEQ ID NO: 98082 - protein, 15 aa, Borrelia burgdorferi B31
LVHQSFIPVPVHVTE

SEQ ID NO: 98083 - protein, 15 aa, Borrelia burgdorferi B31
VHQSFIPVPVHVTEK

SEQ ID NO: 98084 - protein, 15 aa, Borrelia burgdorferi B31
HQSFIPVPVHVTEKY

SEQ ID NO: 98085 - protein, 15 aa, Borrelia burgdorferi B31
QSFIPVPVHVTEKYG

SEQ ID NO: 98086 - protein, 15 aa, Borrelia burgdorferi B31
SFIPVPVHVTEKYGQ

SEQ ID NO: 98087 - protein, 15 aa, Borrelia burgdorferi B31
FIPVPVHVTEKYGQN

SEQ ID NO: 98088 - protein, 15 aa, Borrelia burgdorferi B31
IPVPVHVTEKYGQNW

SEQ ID NO: 98089 - protein, 15 aa, Borrelia burgdorferi B31
PVPVHVTEKYGQNWT

SEQ ID NO: 98090 - protein, 15 aa, Borrelia burgdorferi B31
VPVHVTEKYGQNWTS

SEQ ID NO: 98091 - protein, 15 aa, Borrelia burgdorferi B31
PVHVTEKYGQNWTSP

SEQ ID NO: 98092 - protein, 15 aa, Borrelia burgdorferi B31
VHVTEKYGQNWTSPE

SEQ ID NO: 98093 - protein, 15 aa, Borrelia burgdorferi B31
HVTEKYGQNWTSPEN

SEQ ID NO: 98094 - protein, 15 aa, Borrelia burgdorferi B31
VTEKYGQNWTSPENM

SEQ ID NO: 98095 - protein, 15 aa, Borrelia burgdorferi B31
TEKYGQNWTSPENMV

SEQ ID NO: 98096 - protein, 15 aa, Borrelia burgdorferi B31
EKYGQNWTSPENMVT

SEQ ID NO: 98097 - protein, 15 aa, Borrelia burgdorferi B31
KYGQNWTSPENMVTS

SEQ ID NO: 98098 - protein, 15 aa, Borrelia burgdorferi B31
YGQNWTSPENMVTSG

SEQ ID NO: 98099 - protein, 15 aa, Borrelia burgdorferi B31
GQNWTSPENMVTSGP

SEQ ID NO: 98100 - protein, 15 aa, Borrelia burgdorferi B31
QNWTSPENMVTSGPF

SEQ ID NO: 98101 - protein, 15 aa, Borrelia burgdorferi B31
NWTSPENMVTSGPFK

SEQ ID NO: 98102 - protein, 15 aa, Borrelia burgdorferi B31
WTSPENMVTSGPFKL

SEQ ID NO: 98103 - protein, 15 aa, Borrelia burgdorferi B31
TSPENMVTSGPFKLK

SEQ ID NO: 98104 - protein, 15 aa, Borrelia burgdorferi B31
SPENMVTSGPFKLKE

SEQ ID NO: 98105 - protein, 15 aa, Borrelia burgdorferi B31
PENMVTSGPFKLKER

SEQ ID NO: 98106 - protein, 15 aa, Borrelia burgdorferi B31
ENMVTSGPFKLKERI

SEQ ID NO: 98107 - protein, 15 aa, Borrelia burgdorferi B31
NMVTSGPFKLKERIP

SEQ ID NO: 98108 - protein, 15 aa, Borrelia burgdorferi B31
MVTSGPFKLKERIPN

SEQ ID NO: 98109 - protein, 15 aa, Borrelia burgdorferi B31
VTSGPFKLKERIPNE

SEQ ID NO: 98110 - protein, 15 aa, Borrelia burgdorferi B31
TSGPFKLKERIPNEK

SEQ ID NO: 98111 - protein, 15 aa, Borrelia burgdorferi B31
SGPFKLKERIPNEKY

SEQ ID NO: 98112 - protein, 15 aa, Borrelia burgdorferi B31
GPFKLKERIPNEKYV

SEQ ID NO: 98113 - protein, 15 aa, Borrelia burgdorferi B31
PFKLKERIPNEKYVF

SEQ ID NO: 98114 - protein, 15 aa, Borrelia burgdorferi B31
FKLKERIPNEKYVFE

SEQ ID NO: 98115 - protein, 15 aa, Borrelia burgdorferi B31
KLKERIPNEKYVFEK

SEQ ID NO: 98116 - protein, 15 aa, Borrelia burgdorferi B31
LKERIPNEKYVFEKN

SEQ ID NO: 98117 - protein, 15 aa, Borrelia burgdorferi B31
KERIPNEKYVFEKNN

SEQ ID NO: 98118 - protein, 15 aa, Borrelia burgdorferi B31
ERIPNEKYVFEKNNK

SEQ ID NO: 98119 - protein, 15 aa, Borrelia burgdorferi B31
RIPNEKYVFEKNNKY

SEQ ID NO: 98120 - protein, 15 aa, Borrelia burgdorferi B31
IPNEKYVFEKNNKYY

SEQ ID NO: 98121 - protein, 15 aa, Borrelia burgdorferi B31
PNEKYVFEKNNKYYD

SEQ ID NO: 98122 - protein, 15 aa, Borrelia burgdorferi B31
NEKYVFEKNNKYYDS

SEQ ID NO: 98123 - protein, 15 aa, Borrelia burgdorferi B31
EKYVFEKNNKYYDSN

SEQ ID NO: 98124 - protein, 15 aa, Borrelia burgdorferi B31
KYVFEKNNKYYDSNE

SEQ ID NO: 98125 - protein, 15 aa, Borrelia burgdorferi B31
YVFEKNNKYYDSNEV

SEQ ID NO: 98126 - protein, 15 aa, Borrelia burgdorferi B31
VFEKNNKYYDSNEVE

SEQ ID NO: 98127 - protein, 15 aa, Borrelia burgdorferi B31
FEKNNKYYDSNEVEL

SEQ ID NO: 98128 - protein, 15 aa, Borrelia burgdorferi B31
EKNNKYYDSNEVELE

SEQ ID NO: 98129 - protein, 15 aa, Borrelia burgdorferi B31
KNNKYYDSNEVELEE

SEQ ID NO: 98130 - protein, 15 aa, Borrelia burgdorferi B31
NNKYYDSNEVELEEI

SEQ ID NO: 98131 - protein, 15 aa, Borrelia burgdorferi B31
NKYYDSNEVELEEIT

SEQ ID NO: 98132 - protein, 15 aa, Borrelia burgdorferi B31
KYYDSNEVELEEITF

SEQ ID NO: 98133 - protein, 15 aa, Borrelia burgdorferi B31
YYDSNEVELEEITFY

SEQ ID NO: 98134 - protein, 15 aa, Borrelia burgdorferi B31
YDSNEVELEEITFYT

SEQ ID NO: 98135 - protein, 15 aa, Borrelia burgdorferi B31
DSNEVELEEITFYTT

SEQ ID NO: 98136 - protein, 15 aa, Borrelia burgdorferi B31
SNEVELEEITFYTTN

SEQ ID NO: 98137 - protein, 15 aa, Borrelia burgdorferi B31
NEVELEEITFYTTND

SEQ ID NO: 98138 - protein, 15 aa, Borrelia burgdorferi B31
EVELEEITFYTTNDS

SEQ ID NO: 98139 - protein, 15 aa, Borrelia burgdorferi B31
VELEEITFYTTNDSS

SEQ ID NO: 98140 - protein, 15 aa, Borrelia burgdorferi B31
ELEEITFYTTNDSST

SEQ ID NO: 98141 - protein, 15 aa, Borrelia burgdorferi B31
LEEITFYTTNDSSTA

SEQ ID NO: 98142 - protein, 15 aa, Borrelia burgdorferi B31
EEITFYTTNDSSTAY

SEQ ID NO: 98143 - protein, 15 aa, Borrelia burgdorferi B31
EITFYTTNDSSTAYK

SEQ ID NO: 98144 - protein, 15 aa, Borrelia burgdorferi B31
ITFYTTNDSSTAYKM

SEQ ID NO: 98145 - protein, 15 aa, Borrelia burgdorferi B31
TFYTTNDSSTAYKMY

SEQ ID NO: 98146 - protein, 15 aa, Borrelia burgdorferi B31
FYTTNDSSTAYKMYE

SEQ ID NO: 98147 - protein, 15 aa, Borrelia burgdorferi B31
YTTNDSSTAYKMYEN

SEQ ID NO: 98148 - protein, 15 aa, Borrelia burgdorferi B31
TTNDSSTAYKMYENE

SEQ ID NO: 98149 - protein, 15 aa, Borrelia burgdorferi B31
TNDSSTAYKMYENEE

SEQ ID NO: 98150 - protein, 15 aa, Borrelia burgdorferi B31
NDSSTAYKMYENEEL

SEQ ID NO: 98151 - protein, 15 aa, Borrelia burgdorferi B31
DSSTAYKMYENEELD

SEQ ID NO: 98152 - protein, 15 aa, Borrelia burgdorferi B31
SSTAYKMYENEELDA

SEQ ID NO: 98153 - protein, 15 aa, Borrelia burgdorferi B31
STAYKMYENEELDAI

SEQ ID NO: 98154 - protein, 15 aa, Borrelia burgdorferi B31
TAYKMYENEELDAIF

SEQ ID NO: 98155 - protein, 15 aa, Borrelia burgdorferi B31
AYKMYENEELDAIFG

SEQ ID NO: 98156 - protein, 15 aa, Borrelia burgdorferi B31
YKMYENEELDAIFGS

SEQ ID NO: 98157 - protein, 15 aa, Borrelia burgdorferi B31
KMYENEELDAIFGSI

SEQ ID NO: 98158 - protein, 15 aa, Borrelia burgdorferi B31
MYENEELDAIFGSIP

SEQ ID NO: 98159 - protein, 15 aa, Borrelia burgdorferi B31
YENEELDAIFGSIPP

SEQ ID NO: 98160 - protein, 15 aa, Borrelia burgdorferi B31
ENEELDAIFGSIPPD

SEQ ID NO: 98161 - protein, 15 aa, Borrelia burgdorferi B31
NEELDAIFGSIPPDL

SEQ ID NO: 98162 - protein, 15 aa, Borrelia burgdorferi B31
EELDAIFGSIPPDLI

SEQ ID NO: 98163 - protein, 15 aa, Borrelia burgdorferi B31
ELDAIFGSIPPDLIK

SEQ ID NO: 98164 - protein, 15 aa, Borrelia burgdorferi B31
LDAIFGSIPPDLIKN

SEQ ID NO: 98165 - protein, 15 aa, Borrelia burgdorferi B31
DAIFGSIPPDLIKNL

SEQ ID NO: 98166 - protein, 15 aa, Borrelia burgdorferi B31
AIFGSIPPDLIKNLK

SEQ ID NO: 98167 - protein, 15 aa, Borrelia burgdorferi B31
IFGSIPPDLIKNLKL

SEQ ID NO: 98168 - protein, 15 aa, Borrelia burgdorferi B31
FGSIPPDLIKNLKLR

SEQ ID NO: 98169 - protein, 15 aa, Borrelia burgdorferi B31
GSIPPDLIKNLKLRS

SEQ ID NO: 98170 - protein, 15 aa, Borrelia burgdorferi B31
SIPPDLIKNLKLRSD

SEQ ID NO: 98171 - protein, 15 aa, Borrelia burgdorferi B31
IPPDLIKNLKLRSDY

SEQ ID NO: 98172 - protein, 15 aa, Borrelia burgdorferi B31
PPDLIKNLKLRSDYY

SEQ ID NO: 98173 - protein, 15 aa, Borrelia burgdorferi B31
PDLIKNLKLRSDYYS

SEQ ID NO: 98174 - protein, 15 aa, Borrelia burgdorferi B31
DLIKNLKLRSDYYSS

SEQ ID NO: 98175 - protein, 15 aa, Borrelia burgdorferi B31
LIKNLKLRSDYYSSA

SEQ ID NO: 98176 - protein, 15 aa, Borrelia burgdorferi B31
IKNLKLRSDYYSSAV

SEQ ID NO: 98177 - protein, 15 aa, Borrelia burgdorferi B31
KNLKLRSDYYSSAVN

SEQ ID NO: 98178 - protein, 15 aa, Borrelia burgdorferi B31
NLKLRSDYYSSAVNA

SEQ ID NO: 98179 - protein, 15 aa, Borrelia burgdorferi B31
LKLRSDYYSSAVNAI

SEQ ID NO: 98180 - protein, 15 aa, Borrelia burgdorferi B31
KLRSDYYSSAVNAIY

SEQ ID NO: 98181 - protein, 15 aa, Borrelia burgdorferi B31
LRSDYYSSAVNAIYF

SEQ ID NO: 98182 - protein, 15 aa, Borrelia burgdorferi B31
RSDYYSSAVNAIYFY

SEQ ID NO: 98183 - protein, 15 aa, Borrelia burgdorferi B31
SDYYSSAVNAIYFYA

SEQ ID NO: 98184 - protein, 15 aa, Borrelia burgdorferi B31
DYYSSAVNAIYFYAF

SEQ ID NO: 98185 - protein, 15 aa, Borrelia burgdorferi B31
YYSSAVNAIYFYAFN

SEQ ID NO: 98186 - protein, 15 aa, Borrelia burgdorferi B31
YSSAVNAIYFYAFNT

SEQ ID NO: 98187 - protein, 15 aa, Borrelia burgdorferi B31
SSAVNAIYFYAFNTH

SEQ ID NO: 98188 - protein, 15 aa, Borrelia burgdorferi B31
SAVNAIYFYAFNTHI

SEQ ID NO: 98189 - protein, 15 aa, Borrelia burgdorferi B31
AVNAIYFYAFNTHIK

SEQ ID NO: 98190 - protein, 15 aa, Borrelia burgdorferi B31
VNAIYFYAFNTHIKP

SEQ ID NO: 98191 - protein, 15 aa, Borrelia burgdorferi B31
NAIYFYAFNTHIKPL

SEQ ID NO: 98192 - protein, 15 aa, Borrelia burgdorferi B31
AIYFYAFNTHIKPLD

SEQ ID NO: 98193 - protein, 15 aa, Borrelia burgdorferi B31
IYFYAFNTHIKPLDN

SEQ ID NO: 98194 - protein, 15 aa, Borrelia burgdorferi B31
YFYAFNTHIKPLDNV

SEQ ID NO: 98195 - protein, 15 aa, Borrelia burgdorferi B31
FYAFNTHIKPLDNVK

SEQ ID NO: 98196 - protein, 15 aa, Borrelia burgdorferi B31
YAFNTHIKPLDNVKI

SEQ ID NO: 98197 - protein, 15 aa, Borrelia burgdorferi B31
AFNTHIKPLDNVKIR

SEQ ID NO: 98198 - protein, 15 aa, Borrelia burgdorferi B31
FNTHIKPLDNVKIRK

SEQ ID NO: 98199 - protein, 15 aa, Borrelia burgdorferi B31
NTHIKPLDNVKIRKA

SEQ ID NO: 98200 - protein, 15 aa, Borrelia burgdorferi B31
THIKPLDNVKIRKAL

SEQ ID NO: 98201 - protein, 15 aa, Borrelia burgdorferi B31
HIKPLDNVKIRKALT

SEQ ID NO: 98202 - protein, 15 aa, Borrelia burgdorferi B31
IKPLDNVKIRKALTL

SEQ ID NO: 98203 - protein, 15 aa, Borrelia burgdorferi B31
KPLDNVKIRKALTLA

SEQ ID NO: 98204 - protein, 15 aa, Borrelia burgdorferi B31
PLDNVKIRKALTLAI

SEQ ID NO: 98205 - protein, 15 aa, Borrelia burgdorferi B31
LDNVKIRKALTLAID

SEQ ID NO: 98206 - protein, 15 aa, Borrelia burgdorferi B31
DNVKIRKALTLAIDR

SEQ ID NO: 98207 - protein, 15 aa, Borrelia burgdorferi B31
NVKIRKALTLAIDRE

SEQ ID NO: 98208 - protein, 15 aa, Borrelia burgdorferi B31
VKIRKALTLAIDRET

SEQ ID NO: 98209 - protein, 15 aa, Borrelia burgdorferi B31
KIRKALTLAIDRETL

SEQ ID NO: 98210 - protein, 15 aa, Borrelia burgdorferi B31
IRKALTLAIDRETLT

SEQ ID NO: 98211 - protein, 15 aa, Borrelia burgdorferi B31
RKALTLAIDRETLTY

SEQ ID NO: 98212 - protein, 15 aa, Borrelia burgdorferi B31
KALTLAIDRETLTYK

SEQ ID NO: 98213 - protein, 15 aa, Borrelia burgdorferi B31
ALTLAIDRETLTYKV

SEQ ID NO: 98214 - protein, 15 aa, Borrelia burgdorferi B31
LTLAIDRETLTYKVL

SEQ ID NO: 98215 - protein, 15 aa, Borrelia burgdorferi B31
TLAIDRETLTYKVLD

SEQ ID NO: 98216 - protein, 15 aa, Borrelia burgdorferi B31
LAIDRETLTYKVLDN

SEQ ID NO: 98217 - protein, 15 aa, Borrelia burgdorferi B31
AIDRETLTYKVLDNG

SEQ ID NO: 98218 - protein, 15 aa, Borrelia burgdorferi B31
IDRETLTYKVLDNGT

SEQ ID NO: 98219 - protein, 15 aa, Borrelia burgdorferi B31
DRETLTYKVLDNGTT

SEQ ID NO: 98220 - protein, 15 aa, Borrelia burgdorferi B31
RETLTYKVLDNGTTP

SEQ ID NO: 98221 - protein, 15 aa, Borrelia burgdorferi B31
ETLTYKVLDNGTTPT

SEQ ID NO: 98222 - protein, 15 aa, Borrelia burgdorferi B31
TLTYKVLDNGTTPTR

SEQ ID NO: 98223 - protein, 15 aa, Borrelia burgdorferi B31
LTYKVLDNGTTPTRR

SEQ ID NO: 98224 - protein, 15 aa, Borrelia burgdorferi B31
TYKVLDNGTTPTRRA

SEQ ID NO: 98225 - protein, 15 aa, Borrelia burgdorferi B31
YKVLDNGTTPTRRAT

SEQ ID NO: 98226 - protein, 15 aa, Borrelia burgdorferi B31
KVLDNGTTPTRRATP

SEQ ID NO: 98227 - protein, 15 aa, Borrelia burgdorferi B31
VLDNGTTPTRRATPN

SEQ ID NO: 98228 - protein, 15 aa, Borrelia burgdorferi B31
LDNGTTPTRRATPNF

SEQ ID NO: 98229 - protein, 15 aa, Borrelia burgdorferi B31
DNGTTPTRRATPNFS

SEQ ID NO: 98230 - protein, 15 aa, Borrelia burgdorferi B31
NGTTPTRRATPNFSS

SEQ ID NO: 98231 - protein, 15 aa, Borrelia burgdorferi B31
GTTPTRRATPNFSSY

SEQ ID NO: 98232 - protein, 15 aa, Borrelia burgdorferi B31
TTPTRRATPNFSSYS

SEQ ID NO: 98233 - protein, 15 aa, Borrelia burgdorferi B31
TPTRRATPNFSSYSY

SEQ ID NO: 98234 - protein, 15 aa, Borrelia burgdorferi B31
PTRRATPNFSSYSYA

SEQ ID NO: 98235 - protein, 15 aa, Borrelia burgdorferi B31
TRRATPNFSSYSYAK

SEQ ID NO: 98236 - protein, 15 aa, Borrelia burgdorferi B31
RRATPNFSSYSYAKS

SEQ ID NO: 98237 - protein, 15 aa, Borrelia burgdorferi B31
RATPNFSSYSYAKSL

SEQ ID NO: 98238 - protein, 15 aa, Borrelia burgdorferi B31
ATPNFSSYSYAKSLE

SEQ ID NO: 98239 - protein, 15 aa, Borrelia burgdorferi B31
TPNFSSYSYAKSLEL

SEQ ID NO: 98240 - protein, 15 aa, Borrelia burgdorferi B31
PNFSSYSYAKSLELF

SEQ ID NO: 98241 - protein, 15 aa, Borrelia burgdorferi B31
NFSSYSYAKSLELFN

SEQ ID NO: 98242 - protein, 15 aa, Borrelia burgdorferi B31
FSSYSYAKSLELFNP

SEQ ID NO: 98243 - protein, 15 aa, Borrelia burgdorferi B31
SSYSYAKSLELFNPE

SEQ ID NO: 98244 - protein, 15 aa, Borrelia burgdorferi B31
SYSYAKSLELFNPEI

SEQ ID NO: 98245 - protein, 15 aa, Borrelia burgdorferi B31
YSYAKSLELFNPEIA

SEQ ID NO: 98246 - protein, 15 aa, Borrelia burgdorferi B31
SYAKSLELFNPEIAK

SEQ ID NO: 98247 - protein, 15 aa, Borrelia burgdorferi B31
YAKSLELFNPEIAKT

SEQ ID NO: 98248 - protein, 15 aa, Borrelia burgdorferi B31
AKSLELFNPEIAKTL

SEQ ID NO: 98249 - protein, 15 aa, Borrelia burgdorferi B31
KSLELFNPEIAKTLL

SEQ ID NO: 98250 - protein, 15 aa, Borrelia burgdorferi B31
SLELFNPEIAKTLLA

SEQ ID NO: 98251 - protein, 15 aa, Borrelia burgdorferi B31
LELFNPEIAKTLLAE

SEQ ID NO: 98252 - protein, 15 aa, Borrelia burgdorferi B31
ELFNPEIAKTLLAEA

SEQ ID NO: 98253 - protein, 15 aa, Borrelia burgdorferi B31
LFNPEIAKTLLAEAG

SEQ ID NO: 98254 - protein, 15 aa, Borrelia burgdorferi B31
FNPEIAKTLLAEAGY

SEQ ID NO: 98255 - protein, 15 aa, Borrelia burgdorferi B31
NPEIAKTLLAEAGYP

SEQ ID NO: 98256 - protein, 15 aa, Borrelia burgdorferi B31
PEIAKTLLAEAGYPN

SEQ ID NO: 98257 - protein, 15 aa, Borrelia burgdorferi B31
EIAKTLLAEAGYPNG

SEQ ID NO: 98258 - protein, 15 aa, Borrelia burgdorferi B31
IAKTLLAEAGYPNGN

SEQ ID NO: 98259 - protein, 15 aa, Borrelia burgdorferi B31
AKTLLAEAGYPNGNG

SEQ ID NO: 98260 - protein, 15 aa, Borrelia burgdorferi B31
KTLLAEAGYPNGNGF

SEQ ID NO: 98261 - protein, 15 aa, Borrelia burgdorferi B31
TLLAEAGYPNGNGFP

SEQ ID NO: 98262 - protein, 15 aa, Borrelia burgdorferi B31
LLAEAGYPNGNGFPI

SEQ ID NO: 98263 - protein, 15 aa, Borrelia burgdorferi B31
LAEAGYPNGNGFPIL

SEQ ID NO: 98264 - protein, 15 aa, Borrelia burgdorferi B31
AEAGYPNGNGFPILK

SEQ ID NO: 98265 - protein, 15 aa, Borrelia burgdorferi B31
EAGYPNGNGFPILKL

SEQ ID NO: 98266 - protein, 15 aa, Borrelia burgdorferi B31
AGYPNGNGFPILKLK

SEQ ID NO: 98267 - protein, 15 aa, Borrelia burgdorferi B31
GYPNGNGFPILKLKY

SEQ ID NO: 98268 - protein, 15 aa, Borrelia burgdorferi B31
YPNGNGFPILKLKYN

SEQ ID NO: 98269 - protein, 15 aa, Borrelia burgdorferi B31
PNGNGFPILKLKYNT

SEQ ID NO: 98270 - protein, 15 aa, Borrelia burgdorferi B31
NGNGFPILKLKYNTN

SEQ ID NO: 98271 - protein, 15 aa, Borrelia burgdorferi B31
GNGFPILKLKYNTNE

SEQ ID NO: 98272 - protein, 15 aa, Borrelia burgdorferi B31
NGFPILKLKYNTNEA

SEQ ID NO: 98273 - protein, 15 aa, Borrelia burgdorferi B31
GFPILKLKYNTNEAN

SEQ ID NO: 98274 - protein, 15 aa, Borrelia burgdorferi B31
FPILKLKYNTNEANK

SEQ ID NO: 98275 - protein, 15 aa, Borrelia burgdorferi B31
PILKLKYNTNEANKK

SEQ ID NO: 98276 - protein, 15 aa, Borrelia burgdorferi B31
ILKLKYNTNEANKKI

SEQ ID NO: 98277 - protein, 15 aa, Borrelia burgdorferi B31
LKLKYNTNEANKKIC

SEQ ID NO: 98278 - protein, 15 aa, Borrelia burgdorferi B31
KLKYNTNEANKKICE

SEQ ID NO: 98279 - protein, 15 aa, Borrelia burgdorferi B31
LKYNTNEANKKICEF

SEQ ID NO: 98280 - protein, 15 aa, Borrelia burgdorferi B31
KYNTNEANKKICEFI

SEQ ID NO: 98281 - protein, 15 aa, Borrelia burgdorferi B31
YNTNEANKKICEFIQ

SEQ ID NO: 98282 - protein, 15 aa, Borrelia burgdorferi B31
NTNEANKKICEFIQN

SEQ ID NO: 98283 - protein, 15 aa, Borrelia burgdorferi B31
TNEANKKICEFIQNQ

SEQ ID NO: 98284 - protein, 15 aa, Borrelia burgdorferi B31
NEANKKICEFIQNQW

SEQ ID NO: 98285 - protein, 15 aa, Borrelia burgdorferi B31
EANKKICEFIQNQWK

SEQ ID NO: 98286 - protein, 15 aa, Borrelia burgdorferi B31
ANKKICEFIQNQWKK

SEQ ID NO: 98287 - protein, 15 aa, Borrelia burgdorferi B31
NKKICEFIQNQWKKN

SEQ ID NO: 98288 - protein, 15 aa, Borrelia burgdorferi B31
KKICEFIQNQWKKNL

SEQ ID NO: 98289 - protein, 15 aa, Borrelia burgdorferi B31
KICEFIQNQWKKNLN

SEQ ID NO: 98290 - protein, 15 aa, Borrelia burgdorferi B31
ICEFIQNQWKKNLNI

SEQ ID NO: 98291 - protein, 15 aa, Borrelia burgdorferi B31
CEFIQNQWKKNLNID

SEQ ID NO: 98292 - protein, 15 aa, Borrelia burgdorferi B31
EFIQNQWKKNLNIDV

SEQ ID NO: 98293 - protein, 15 aa, Borrelia burgdorferi B31
FIQNQWKKNLNIDVE

SEQ ID NO: 98294 - protein, 15 aa, Borrelia burgdorferi B31
IQNQWKKNLNIDVEL

SEQ ID NO: 98295 - protein, 15 aa, Borrelia burgdorferi B31
QNQWKKNLNIDVELE

SEQ ID NO: 98296 - protein, 15 aa, Borrelia burgdorferi B31
NQWKKNLNIDVELEN

SEQ ID NO: 98297 - protein, 15 aa, Borrelia burgdorferi B31
QWKKNLNIDVELENE

SEQ ID NO: 98298 - protein, 15 aa, Borrelia burgdorferi B31
WKKNLNIDVELENEE

SEQ ID NO: 98299 - protein, 15 aa, Borrelia burgdorferi B31
KKNLNIDVELENEEW

SEQ ID NO: 98300 - protein, 15 aa, Borrelia burgdorferi B31
KNLNIDVELENEEWT

SEQ ID NO: 98301 - protein, 15 aa, Borrelia burgdorferi B31
NLNIDVELENEEWTT

SEQ ID NO: 98302 - protein, 15 aa, Borrelia burgdorferi B31
LNIDVELENEEWTTY

SEQ ID NO: 98303 - protein, 15 aa, Borrelia burgdorferi B31
NIDVELENEEWTTYL

SEQ ID NO: 98304 - protein, 15 aa, Borrelia burgdorferi B31
IDVELENEEWTTYLN

SEQ ID NO: 98305 - protein, 15 aa, Borrelia burgdorferi B31
DVELENEEWTTYLNT

SEQ ID NO: 98306 - protein, 15 aa, Borrelia burgdorferi B31
VELENEEWTTYLNTK

SEQ ID NO: 98307 - protein, 15 aa, Borrelia burgdorferi B31
ELENEEWTTYLNTKA

SEQ ID NO: 98308 - protein, 15 aa, Borrelia burgdorferi B31
LENEEWTTYLNTKAN

SEQ ID NO: 98309 - protein, 15 aa, Borrelia burgdorferi B31
ENEEWTTYLNTKANG

SEQ ID NO: 98310 - protein, 15 aa, Borrelia burgdorferi B31
NEEWTTYLNTKANGN

SEQ ID NO: 98311 - protein, 15 aa, Borrelia burgdorferi B31
EEWTTYLNTKANGNY

SEQ ID NO: 98312 - protein, 15 aa, Borrelia burgdorferi B31
EWTTYLNTKANGNYE

SEQ ID NO: 98313 - protein, 15 aa, Borrelia burgdorferi B31
WTTYLNTKANGNYEI

SEQ ID NO: 98314 - protein, 15 aa, Borrelia burgdorferi B31
TTYLNTKANGNYEIA

SEQ ID NO: 98315 - protein, 15 aa, Borrelia burgdorferi B31
TYLNTKANGNYEIAR

SEQ ID NO: 98316 - protein, 15 aa, Borrelia burgdorferi B31
YLNTKANGNYEIARA

SEQ ID NO: 98317 - protein, 15 aa, Borrelia burgdorferi B31
LNTKANGNYEIARAG

SEQ ID NO: 98318 - protein, 15 aa, Borrelia burgdorferi B31
NTKANGNYEIARAGW

SEQ ID NO: 98319 - protein, 15 aa, Borrelia burgdorferi B31
TKANGNYEIARAGWI

SEQ ID NO: 98320 - protein, 15 aa, Borrelia burgdorferi B31
KANGNYEIARAGWIG

SEQ ID NO: 98321 - protein, 15 aa, Borrelia burgdorferi B31
ANGNYEIARAGWIGD

SEQ ID NO: 98322 - protein, 15 aa, Borrelia burgdorferi B31
NGNYEIARAGWIGDY

SEQ ID NO: 98323 - protein, 15 aa, Borrelia burgdorferi B31
GNYEIARAGWIGDYA

SEQ ID NO: 98324 - protein, 15 aa, Borrelia burgdorferi B31
NYEIARAGWIGDYAD

SEQ ID NO: 98325 - protein, 15 aa, Borrelia burgdorferi B31
YEIARAGWIGDYADP

SEQ ID NO: 98326 - protein, 15 aa, Borrelia burgdorferi B31
EIARAGWIGDYADPL

SEQ ID NO: 98327 - protein, 15 aa, Borrelia burgdorferi B31
IARAGWIGDYADPLT

SEQ ID NO: 98328 - protein, 15 aa, Borrelia burgdorferi B31
ARAGWIGDYADPLTF

SEQ ID NO: 98329 - protein, 15 aa, Borrelia burgdorferi B31
RAGWIGDYADPLTFL

SEQ ID NO: 98330 - protein, 15 aa, Borrelia burgdorferi B31
AGWIGDYADPLTFLS

SEQ ID NO: 98331 - protein, 15 aa, Borrelia burgdorferi B31
GWIGDYADPLTFLSI

SEQ ID NO: 98332 - protein, 15 aa, Borrelia burgdorferi B31
WIGDYADPLTFLSIF

SEQ ID NO: 98333 - protein, 15 aa, Borrelia burgdorferi B31
IGDYADPLTFLSIFT

SEQ ID NO: 98334 - protein, 15 aa, Borrelia burgdorferi B31
GDYADPLTFLSIFTQ

SEQ ID NO: 98335 - protein, 15 aa, Borrelia burgdorferi B31
DYADPLTFLSIFTQG

SEQ ID NO: 98336 - protein, 15 aa, Borrelia burgdorferi B31
YADPLTFLSIFTQGY

SEQ ID NO: 98337 - protein, 15 aa, Borrelia burgdorferi B31
ADPLTFLSIFTQGYT

SEQ ID NO: 98338 - protein, 15 aa, Borrelia burgdorferi B31
DPLTFLSIFTQGYTQ

SEQ ID NO: 98339 - protein, 15 aa, Borrelia burgdorferi B31
PLTFLSIFTQGYTQF

SEQ ID NO: 98340 - protein, 15 aa, Borrelia burgdorferi B31
LTFLSIFTQGYTQFS

SEQ ID NO: 98341 - protein, 15 aa, Borrelia burgdorferi B31
TFLSIFTQGYTQFSS

SEQ ID NO: 98342 - protein, 15 aa, Borrelia burgdorferi B31
FLSIFTQGYTQFSSH

SEQ ID NO: 98343 - protein, 15 aa, Borrelia burgdorferi B31
LSIFTQGYTQFSSHN

SEQ ID NO: 98344 - protein, 15 aa, Borrelia burgdorferi B31
SIFTQGYTQFSSHNY

SEQ ID NO: 98345 - protein, 15 aa, Borrelia burgdorferi B31
IFTQGYTQFSSHNYS

SEQ ID NO: 98346 - protein, 15 aa, Borrelia burgdorferi B31
FTQGYTQFSSHNYSN

SEQ ID NO: 98347 - protein, 15 aa, Borrelia burgdorferi B31
TQGYTQFSSHNYSNP

SEQ ID NO: 98348 - protein, 15 aa, Borrelia burgdorferi B31
QGYTQFSSHNYSNPE

SEQ ID NO: 98349 - protein, 15 aa, Borrelia burgdorferi B31
GYTQFSSHNYSNPEY

SEQ ID NO: 98350 - protein, 15 aa, Borrelia burgdorferi B31
YTQFSSHNYSNPEYN

SEQ ID NO: 98351 - protein, 15 aa, Borrelia burgdorferi B31
TQFSSHNYSNPEYNE

SEQ ID NO: 98352 - protein, 15 aa, Borrelia burgdorferi B31
QFSSHNYSNPEYNEL

SEQ ID NO: 98353 - protein, 15 aa, Borrelia burgdorferi B31
FSSHNYSNPEYNELI

SEQ ID NO: 98354 - protein, 15 aa, Borrelia burgdorferi B31
SSHNYSNPEYNELIK

SEQ ID NO: 98355 - protein, 15 aa, Borrelia burgdorferi B31
SHNYSNPEYNELIKK

SEQ ID NO: 98356 - protein, 15 aa, Borrelia burgdorferi B31
HNYSNPEYNELIKKS

SEQ ID NO: 98357 - protein, 15 aa, Borrelia burgdorferi B31
NYSNPEYNELIKKSD

SEQ ID NO: 98358 - protein, 15 aa, Borrelia burgdorferi B31
YSNPEYNELIKKSDL

SEQ ID NO: 98359 - protein, 15 aa, Borrelia burgdorferi B31
SNPEYNELIKKSDLE

SEQ ID NO: 98360 - protein, 15 aa, Borrelia burgdorferi B31
NPEYNELIKKSDLEL

SEQ ID NO: 98361 - protein, 15 aa, Borrelia burgdorferi B31
PEYNELIKKSDLELD

SEQ ID NO: 98362 - protein, 15 aa, Borrelia burgdorferi B31
EYNELIKKSDLELDP

SEQ ID NO: 98363 - protein, 15 aa, Borrelia burgdorferi B31
YNELIKKSDLELDPI

SEQ ID NO: 98364 - protein, 15 aa, Borrelia burgdorferi B31
NELIKKSDLELDPIK

SEQ ID NO: 98365 - protein, 15 aa, Borrelia burgdorferi B31
ELIKKSDLELDPIKR

SEQ ID NO: 98366 - protein, 15 aa, Borrelia burgdorferi B31
LIKKSDLELDPIKRQ

SEQ ID NO: 98367 - protein, 15 aa, Borrelia burgdorferi B31
IKKSDLELDPIKRQD

SEQ ID NO: 98368 - protein, 15 aa, Borrelia burgdorferi B31
KKSDLELDPIKRQDI

SEQ ID NO: 98369 - protein, 15 aa, Borrelia burgdorferi B31
KSDLELDPIKRQDIL

SEQ ID NO: 98370 - protein, 15 aa, Borrelia burgdorferi B31
SDLELDPIKRQDILR

SEQ ID NO: 98371 - protein, 15 aa, Borrelia burgdorferi B31
DLELDPIKRQDILRQ

SEQ ID NO: 98372 - protein, 15 aa, Borrelia burgdorferi B31
LELDPIKRQDILRQA

SEQ ID NO: 98373 - protein, 15 aa, Borrelia burgdorferi B31
ELDPIKRQDILRQAE

SEQ ID NO: 98374 - protein, 15 aa, Borrelia burgdorferi B31
LDPIKRQDILRQAEE

SEQ ID NO: 98375 - protein, 15 aa, Borrelia burgdorferi B31
DPIKRQDILRQAEEI

SEQ ID NO: 98376 - protein, 15 aa, Borrelia burgdorferi B31
PIKRQDILRQAEEII

SEQ ID NO: 98377 - protein, 15 aa, Borrelia burgdorferi B31
IKRQDILRQAEEIII

SEQ ID NO: 98378 - protein, 15 aa, Borrelia burgdorferi B31
KRQDILRQAEEIIIE

SEQ ID NO: 98379 - protein, 15 aa, Borrelia burgdorferi B31
RQDILRQAEEIIIEK

SEQ ID NO: 98380 - protein, 15 aa, Borrelia burgdorferi B31
QDILRQAEEIIIEKD

SEQ ID NO: 98381 - protein, 15 aa, Borrelia burgdorferi B31
DILRQAEEIIIEKDF

SEQ ID NO: 98382 - protein, 15 aa, Borrelia burgdorferi B31
ILRQAEEIIIEKDFP

SEQ ID NO: 98383 - protein, 15 aa, Borrelia burgdorferi B31
LRQAEEIIIEKDFPI

SEQ ID NO: 98384 - protein, 15 aa, Borrelia burgdorferi B31
RQAEEIIIEKDFPIA

SEQ ID NO: 98385 - protein, 15 aa, Borrelia burgdorferi B31
QAEEIIIEKDFPIAP

SEQ ID NO: 98386 - protein, 15 aa, Borrelia burgdorferi B31
AEEIIIEKDFPIAPI

SEQ ID NO: 98387 - protein, 15 aa, Borrelia burgdorferi B31
EEIIIEKDFPIAPIY

SEQ ID NO: 98388 - protein, 15 aa, Borrelia burgdorferi B31
EIIIEKDFPIAPIYI

SEQ ID NO: 98389 - protein, 15 aa, Borrelia burgdorferi B31
IIIEKDFPIAPIYIY

SEQ ID NO: 98390 - protein, 15 aa, Borrelia burgdorferi B31
IIEKDFPIAPIYIYG

SEQ ID NO: 98391 - protein, 15 aa, Borrelia burgdorferi B31
IEKDFPIAPIYIYGN

SEQ ID NO: 98392 - protein, 15 aa, Borrelia burgdorferi B31
EKDFPIAPIYIYGNS

SEQ ID NO: 98393 - protein, 15 aa, Borrelia burgdorferi B31
KDFPIAPIYIYGNSY

SEQ ID NO: 98394 - protein, 15 aa, Borrelia burgdorferi B31
DFPIAPIYIYGNSYL

SEQ ID NO: 98395 - protein, 15 aa, Borrelia burgdorferi B31
FPIAPIYIYGNSYLF

SEQ ID NO: 98396 - protein, 15 aa, Borrelia burgdorferi B31
PIAPIYIYGNSYLFR

SEQ ID NO: 98397 - protein, 15 aa, Borrelia burgdorferi B31
IAPIYIYGNSYLFRN

SEQ ID NO: 98398 - protein, 15 aa, Borrelia burgdorferi B31
APIYIYGNSYLFRND

SEQ ID NO: 98399 - protein, 15 aa, Borrelia burgdorferi B31
PIYIYGNSYLFRNDK

SEQ ID NO: 98400 - protein, 15 aa, Borrelia burgdorferi B31
IYIYGNSYLFRNDKW

SEQ ID NO: 98401 - protein, 15 aa, Borrelia burgdorferi B31
YIYGNSYLFRNDKWT

SEQ ID NO: 98402 - protein, 15 aa, Borrelia burgdorferi B31
IYGNSYLFRNDKWTG

SEQ ID NO: 98403 - protein, 15 aa, Borrelia burgdorferi B31
YGNSYLFRNDKWTGW

SEQ ID NO: 98404 - protein, 15 aa, Borrelia burgdorferi B31
GNSYLFRNDKWTGWN

SEQ ID NO: 98405 - protein, 15 aa, Borrelia burgdorferi B31
NSYLFRNDKWTGWNT

SEQ ID NO: 98406 - protein, 15 aa, Borrelia burgdorferi B31
SYLFRNDKWTGWNTN

SEQ ID NO: 98407 - protein, 15 aa, Borrelia burgdorferi B31
YLFRNDKWTGWNTNI

SEQ ID NO: 98408 - protein, 15 aa, Borrelia burgdorferi B31
LFRNDKWTGWNTNIL

SEQ ID NO: 98409 - protein, 15 aa, Borrelia burgdorferi B31
FRNDKWTGWNTNILE

SEQ ID NO: 98410 - protein, 15 aa, Borrelia burgdorferi B31
RNDKWTGWNTNILER

SEQ ID NO: 98411 - protein, 15 aa, Borrelia burgdorferi B31
NDKWTGWNTNILERF

SEQ ID NO: 98412 - protein, 15 aa, Borrelia burgdorferi B31
DKWTGWNTNILERFD

SEQ ID NO: 98413 - protein, 15 aa, Borrelia burgdorferi B31
KWTGWNTNILERFDL

SEQ ID NO: 98414 - protein, 15 aa, Borrelia burgdorferi B31
WTGWNTNILERFDLS

SEQ ID NO: 98415 - protein, 15 aa, Borrelia burgdorferi B31
TGWNTNILERFDLSQ

SEQ ID NO: 98416 - protein, 15 aa, Borrelia burgdorferi B31
GWNTNILERFDLSQL

SEQ ID NO: 98417 - protein, 15 aa, Borrelia burgdorferi B31
WNTNILERFDLSQLK

SEQ ID NO: 98418 - protein, 15 aa, Borrelia burgdorferi B31
NTNILERFDLSQLKL

SEQ ID NO: 98419 - protein, 15 aa, Borrelia burgdorferi B31
TNILERFDLSQLKLK

SEQ ID NO: 98420 - protein, 15 aa, Borrelia burgdorferi B31
NILERFDLSQLKLKN

SEQ ID NO: 98421 - protein, 15 aa, Borrelia burgdorferi B31
ILERFDLSQLKLKNK

SEQ ID NO: 98422 - protein, 16 aa, Borrelia burgdorferi B31
MKLQRSLFLIIFFLTF

SEQ ID NO: 98423 - protein, 16 aa, Borrelia burgdorferi B31
KLQRSLFLIIFFLTFL

SEQ ID NO: 98424 - protein, 16 aa, Borrelia burgdorferi B31
LQRSLFLIIFFLTFLC

SEQ ID NO: 98425 - protein, 16 aa, Borrelia burgdorferi B31
QRSLFLIIFFLTFLCC

SEQ ID NO: 98426 - protein, 16 aa, Borrelia burgdorferi B31
RSLFLIIFFLTFLCCN

SEQ ID NO: 98427 - protein, 16 aa, Borrelia burgdorferi B31
SLFLIIFFLTFLCCNN

SEQ ID NO: 98428 - protein, 16 aa, Borrelia burgdorferi B31
LFLIIFFLTFLCCNNK

SEQ ID NO: 98429 - protein, 16 aa, Borrelia burgdorferi B31
FLIIFFLTFLCCNNKE

SEQ ID NO: 98430 - protein, 16 aa, Borrelia burgdorferi B31
LIIFFLTFLCCNNKER

SEQ ID NO: 98431 - protein, 16 aa, Borrelia burgdorferi B31
IIFFLTFLCCNNKERK

SEQ ID NO: 98432 - protein, 16 aa, Borrelia burgdorferi B31
IFFLTFLCCNNKERKE

SEQ ID NO: 98433 - protein, 16 aa, Borrelia burgdorferi B31
FFLTFLCCNNKERKEG

SEQ ID NO: 98434 - protein, 16 aa, Borrelia burgdorferi B31
FLTFLCCNNKERKEGV

SEQ ID NO: 98435 - protein, 16 aa, Borrelia burgdorferi B31
LTFLCCNNKERKEGVS

SEQ ID NO: 98436 - protein, 16 aa, Borrelia burgdorferi B31
TFLCCNNKERKEGVSF

SEQ ID NO: 98437 - protein, 16 aa, Borrelia burgdorferi B31
FLCCNNKERKEGVSFK

SEQ ID NO: 98438 - protein, 16 aa, Borrelia burgdorferi B31
LCCNNKERKEGVSFKI

SEQ ID NO: 98439 - protein, 16 aa, Borrelia burgdorferi B31
CCNNKERKEGVSFKIS

SEQ ID NO: 98440 - protein, 16 aa, Borrelia burgdorferi B31
CNNKERKEGVSFKISL

SEQ ID NO: 98441 - protein, 16 aa, Borrelia burgdorferi B31
NNKERKEGVSFKISLG

SEQ ID NO: 98442 - protein, 16 aa, Borrelia burgdorferi B31
NKERKEGVSFKISLGA

SEQ ID NO: 98443 - protein, 16 aa, Borrelia burgdorferi B31
KERKEGVSFKISLGAE

SEQ ID NO: 98444 - protein, 16 aa, Borrelia burgdorferi B31
ERKEGVSFKISLGAEP

SEQ ID NO: 98445 - protein, 16 aa, Borrelia burgdorferi B31
RKEGVSFKISLGAEPS

SEQ ID NO: 98446 - protein, 16 aa, Borrelia burgdorferi B31
KEGVSFKISLGAEPSS

SEQ ID NO: 98447 - protein, 16 aa, Borrelia burgdorferi B31
EGVSFKISLGAEPSSL

SEQ ID NO: 98448 - protein, 16 aa, Borrelia burgdorferi B31
GVSFKISLGAEPSSLD

SEQ ID NO: 98449 - protein, 16 aa, Borrelia burgdorferi B31
VSFKISLGAEPSSLDP

SEQ ID NO: 98450 - protein, 16 aa, Borrelia burgdorferi B31
SFKISLGAEPSSLDPQ

SEQ ID NO: 98451 - protein, 16 aa, Borrelia burgdorferi B31
FKISLGAEPSSLDPQL

SEQ ID NO: 98452 - protein, 16 aa, Borrelia burgdorferi B31
KISLGAEPSSLDPQLA

SEQ ID NO: 98453 - protein, 16 aa, Borrelia burgdorferi B31
ISLGAEPSSLDPQLAE

SEQ ID NO: 98454 - protein, 16 aa, Borrelia burgdorferi B31
SLGAEPSSLDPQLAED

SEQ ID NO: 98455 - protein, 16 aa, Borrelia burgdorferi B31
LGAEPSSLDPQLAEDN

SEQ ID NO: 98456 - protein, 16 aa, Borrelia burgdorferi B31
GAEPSSLDPQLAEDNV

SEQ ID NO: 98457 - protein, 16 aa, Borrelia burgdorferi B31
AEPSSLDPQLAEDNVA

SEQ ID NO: 98458 - protein, 16 aa, Borrelia burgdorferi B31
EPSSLDPQLAEDNVAS

SEQ ID NO: 98459 - protein, 16 aa, Borrelia burgdorferi B31
PSSLDPQLAEDNVASK

SEQ ID NO: 98460 - protein, 16 aa, Borrelia burgdorferi B31
SSLDPQLAEDNVASKM

SEQ ID NO: 98461 - protein, 16 aa, Borrelia burgdorferi B31
SLDPQLAEDNVASKMI

SEQ ID NO: 98462 - protein, 16 aa, Borrelia burgdorferi B31
LDPQLAEDNVASKMID

SEQ ID NO: 98463 - protein, 16 aa, Borrelia burgdorferi B31
DPQLAEDNVASKMIDT

SEQ ID NO: 98464 - protein, 16 aa, Borrelia burgdorferi B31
PQLAEDNVASKMIDTM

SEQ ID NO: 98465 - protein, 16 aa, Borrelia burgdorferi B31
QLAEDNVASKMIDTMF

SEQ ID NO: 98466 - protein, 16 aa, Borrelia burgdorferi B31
LAEDNVASKMIDTMFR

SEQ ID NO: 98467 - protein, 16 aa, Borrelia burgdorferi B31
AEDNVASKMIDTMFRG

SEQ ID NO: 98468 - protein, 16 aa, Borrelia burgdorferi B31
EDNVASKMIDTMFRGI

SEQ ID NO: 98469 - protein, 16 aa, Borrelia burgdorferi B31
DNVASKMIDTMFRGIV

SEQ ID NO: 98470 - protein, 16 aa, Borrelia burgdorferi B31
NVASKMIDTMFRGIVT

SEQ ID NO: 98471 - protein, 16 aa, Borrelia burgdorferi B31
VASKMIDTMFRGIVTG

SEQ ID NO: 98472 - protein, 16 aa, Borrelia burgdorferi B31
ASKMIDTMFRGIVTGD

SEQ ID NO: 98473 - protein, 16 aa, Borrelia burgdorferi B31
SKMIDTMFRGIVTGDP

SEQ ID NO: 98474 - protein, 16 aa, Borrelia burgdorferi B31
KMIDTMFRGIVTGDPN

SEQ ID NO: 98475 - protein, 16 aa, Borrelia burgdorferi B31
MIDTMFRGIVTGDPNT

SEQ ID NO: 98476 - protein, 16 aa, Borrelia burgdorferi B31
IDTMFRGIVTGDPNTG

SEQ ID NO: 98477 - protein, 16 aa, Borrelia burgdorferi B31
DTMFRGIVTGDPNTGG

SEQ ID NO: 98478 - protein, 16 aa, Borrelia burgdorferi B31
TMFRGIVTGDPNTGGN

SEQ ID NO: 98479 - protein, 16 aa, Borrelia burgdorferi B31
MFRGIVTGDPNTGGNK

SEQ ID NO: 98480 - protein, 16 aa, Borrelia burgdorferi B31
FRGIVTGDPNTGGNKP

SEQ ID NO: 98481 - protein, 16 aa, Borrelia burgdorferi B31
RGIVTGDPNTGGNKPG

SEQ ID NO: 98482 - protein, 16 aa, Borrelia burgdorferi B31
GIVTGDPNTGGNKPGL

SEQ ID NO: 98483 - protein, 16 aa, Borrelia burgdorferi B31
IVTGDPNTGGNKPGLA

SEQ ID NO: 98484 - protein, 16 aa, Borrelia burgdorferi B31
VTGDPNTGGNKPGLAK

SEQ ID NO: 98485 - protein, 16 aa, Borrelia burgdorferi B31
TGDPNTGGNKPGLAKG

SEQ ID NO: 98486 - protein, 16 aa, Borrelia burgdorferi B31
GDPNTGGNKPGLAKGW

SEQ ID NO: 98487 - protein, 16 aa, Borrelia burgdorferi B31
DPNTGGNKPGLAKGWD

SEQ ID NO: 98488 - protein, 16 aa, Borrelia burgdorferi B31
PNTGGNKPGLAKGWDI

SEQ ID NO: 98489 - protein, 16 aa, Borrelia burgdorferi B31
NTGGNKPGLAKGWDIS

SEQ ID NO: 98490 - protein, 16 aa, Borrelia burgdorferi B31
TGGNKPGLAKGWDISS

SEQ ID NO: 98491 - protein, 16 aa, Borrelia burgdorferi B31
GGNKPGLAKGWDISSD

SEQ ID NO: 98492 - protein, 16 aa, Borrelia burgdorferi B31
GNKPGLAKGWDISSDG

SEQ ID NO: 98493 - protein, 16 aa, Borrelia burgdorferi B31
NKPGLAKGWDISSDGT

SEQ ID NO: 98494 - protein, 16 aa, Borrelia burgdorferi B31
KPGLAKGWDISSDGTV

SEQ ID NO: 98495 - protein, 16 aa, Borrelia burgdorferi B31
PGLAKGWDISSDGTVY

SEQ ID NO: 98496 - protein, 16 aa, Borrelia burgdorferi B31
GLAKGWDISSDGTVYT

SEQ ID NO: 98497 - protein, 16 aa, Borrelia burgdorferi B31
LAKGWDISSDGTVYTF

SEQ ID NO: 98498 - protein, 16 aa, Borrelia burgdorferi B31
AKGWDISSDGTVYTFN

SEQ ID NO: 98499 - protein, 16 aa, Borrelia burgdorferi B31
KGWDISSDGTVYTFNL

SEQ ID NO: 98500 - protein, 16 aa, Borrelia burgdorferi B31
GWDISSDGTVYTFNLR

SEQ ID NO: 98501 - protein, 16 aa, Borrelia burgdorferi B31
WDISSDGTVYTFNLRE

SEQ ID NO: 98502 - protein, 16 aa, Borrelia burgdorferi B31
DISSDGTVYTFNLREK

SEQ ID NO: 98503 - protein, 16 aa, Borrelia burgdorferi B31
ISSDGTVYTFNLREKI

SEQ ID NO: 98504 - protein, 16 aa, Borrelia burgdorferi B31
SSDGTVYTFNLREKIT

SEQ ID NO: 98505 - protein, 16 aa, Borrelia burgdorferi B31
SDGTVYTFNLREKITW

SEQ ID NO: 98506 - protein, 16 aa, Borrelia burgdorferi B31
DGTVYTFNLREKITWS

SEQ ID NO: 98507 - protein, 16 aa, Borrelia burgdorferi B31
GTVYTFNLREKITWSD

SEQ ID NO: 98508 - protein, 16 aa, Borrelia burgdorferi B31
TVYTFNLREKITWSDG

SEQ ID NO: 98509 - protein, 16 aa, Borrelia burgdorferi B31
VYTFNLREKITWSDGV

SEQ ID NO: 98510 - protein, 16 aa, Borrelia burgdorferi B31
YTFNLREKITWSDGVA

SEQ ID NO: 98511 - protein, 16 aa, Borrelia burgdorferi B31
TFNLREKITWSDGVAI

SEQ ID NO: 98512 - protein, 16 aa, Borrelia burgdorferi B31
FNLREKITWSDGVAIT

SEQ ID NO: 98513 - protein, 16 aa, Borrelia burgdorferi B31
NLREKITWSDGVAITA

SEQ ID NO: 98514 - protein, 16 aa, Borrelia burgdorferi B31
LREKITWSDGVAITAE

SEQ ID NO: 98515 - protein, 16 aa, Borrelia burgdorferi B31
REKITWSDGVAITAEG

SEQ ID NO: 98516 - protein, 16 aa, Borrelia burgdorferi B31
EKITWSDGVAITAEGI

SEQ ID NO: 98517 - protein, 16 aa, Borrelia burgdorferi B31
KITWSDGVAITAEGIR

SEQ ID NO: 98518 - protein, 16 aa, Borrelia burgdorferi B31
ITWSDGVAITAEGIRK

SEQ ID NO: 98519 - protein, 16 aa, Borrelia burgdorferi B31
TWSDGVAITAEGIRKS

SEQ ID NO: 98520 - protein, 16 aa, Borrelia burgdorferi B31
WSDGVAITAEGIRKSY

SEQ ID NO: 98521 - protein, 16 aa, Borrelia burgdorferi B31
SDGVAITAEGIRKSYL

SEQ ID NO: 98522 - protein, 16 aa, Borrelia burgdorferi B31
DGVAITAEGIRKSYLR

SEQ ID NO: 98523 - protein, 16 aa, Borrelia burgdorferi B31
GVAITAEGIRKSYLRI

SEQ ID NO: 98524 - protein, 16 aa, Borrelia burgdorferi B31
VAITAEGIRKSYLRIL

SEQ ID NO: 98525 - protein, 16 aa, Borrelia burgdorferi B31
AITAEGIRKSYLRILN

SEQ ID NO: 98526 - protein, 16 aa, Borrelia burgdorferi B31
ITAEGIRKSYLRILNK

SEQ ID NO: 98527 - protein, 16 aa, Borrelia burgdorferi B31
TAEGIRKSYLRILNKE

SEQ ID NO: 98528 - protein, 16 aa, Borrelia burgdorferi B31
AEGIRKSYLRILNKET

SEQ ID NO: 98529 - protein, 16 aa, Borrelia burgdorferi B31
EGIRKSYLRILNKETG

SEQ ID NO: 98530 - protein, 16 aa, Borrelia burgdorferi B31
GIRKSYLRILNKETGS

SEQ ID NO: 98531 - protein, 16 aa, Borrelia burgdorferi B31
IRKSYLRILNKETGSK

SEQ ID NO: 98532 - protein, 16 aa, Borrelia burgdorferi B31
RKSYLRILNKETGSKY

SEQ ID NO: 98533 - protein, 16 aa, Borrelia burgdorferi B31
KSYLRILNKETGSKYV

SEQ ID NO: 98534 - protein, 16 aa, Borrelia burgdorferi B31
SYLRILNKETGSKYVE

SEQ ID NO: 98535 - protein, 16 aa, Borrelia burgdorferi B31
YLRILNKETGSKYVEM

SEQ ID NO: 98536 - protein, 16 aa, Borrelia burgdorferi B31
LRILNKETGSKYVEMV

SEQ ID NO: 98537 - protein, 16 aa, Borrelia burgdorferi B31
RILNKETGSKYVEMVK

SEQ ID NO: 98538 - protein, 16 aa, Borrelia burgdorferi B31
ILNKETGSKYVEMVKS

SEQ ID NO: 98539 - protein, 16 aa, Borrelia burgdorferi B31
LNKETGSKYVEMVKSV

SEQ ID NO: 98540 - protein, 16 aa, Borrelia burgdorferi B31
NKETGSKYVEMVKSVI

SEQ ID NO: 98541 - protein, 16 aa, Borrelia burgdorferi B31
KETGSKYVEMVKSVIK

SEQ ID NO: 98542 - protein, 16 aa, Borrelia burgdorferi B31
ETGSKYVEMVKSVIKN

SEQ ID NO: 98543 - protein, 16 aa, Borrelia burgdorferi B31
TGSKYVEMVKSVIKNG

SEQ ID NO: 98544 - protein, 16 aa, Borrelia burgdorferi B31
GSKYVEMVKSVIKNGQ

SEQ ID NO: 98545 - protein, 16 aa, Borrelia burgdorferi B31
SKYVEMVKSVIKNGQK

SEQ ID NO: 98546 - protein, 16 aa, Borrelia burgdorferi B31
KYVEMVKSVIKNGQKY

SEQ ID NO: 98547 - protein, 16 aa, Borrelia burgdorferi B31
YVEMVKSVIKNGQKYF

SEQ ID NO: 98548 - protein, 16 aa, Borrelia burgdorferi B31
VEMVKSVIKNGQKYFD

SEQ ID NO: 98549 - protein, 16 aa, Borrelia burgdorferi B31
EMVKSVIKNGQKYFDG

SEQ ID NO: 98550 - protein, 16 aa, Borrelia burgdorferi B31
MVKSVIKNGQKYFDGQ

SEQ ID NO: 98551 - protein, 16 aa, Borrelia burgdorferi B31
VKSVIKNGQKYFDGQV

SEQ ID NO: 98552 - protein, 16 aa, Borrelia burgdorferi B31
KSVIKNGQKYFDGQVT

SEQ ID NO: 98553 - protein, 16 aa, Borrelia burgdorferi B31
SVIKNGQKYFDGQVTD

SEQ ID NO: 98554 - protein, 16 aa, Borrelia burgdorferi B31
VIKNGQKYFDGQVTDS

SEQ ID NO: 98555 - protein, 16 aa, Borrelia burgdorferi B31
IKNGQKYFDGQVTDSE

SEQ ID NO: 98556 - protein, 16 aa, Borrelia burgdorferi B31
KNGQKYFDGQVTDSEL

SEQ ID NO: 98557 - protein, 16 aa, Borrelia burgdorferi B31
NGQKYFDGQVTDSELG

SEQ ID NO: 98558 - protein, 16 aa, Borrelia burgdorferi B31
GQKYFDGQVTDSELGI

SEQ ID NO: 98559 - protein, 16 aa, Borrelia burgdorferi B31
QKYFDGQVTDSELGIR

SEQ ID NO: 98560 - protein, 16 aa, Borrelia burgdorferi B31
KYFDGQVTDSELGIRA

SEQ ID NO: 98561 - protein, 16 aa, Borrelia burgdorferi B31
YFDGQVTDSELGIRAI

SEQ ID NO: 98562 - protein, 16 aa, Borrelia burgdorferi B31
FDGQVTDSELGIRAID

SEQ ID NO: 98563 - protein, 16 aa, Borrelia burgdorferi B31
DGQVTDSELGIRAIDE

SEQ ID NO: 98564 - protein, 16 aa, Borrelia burgdorferi B31
GQVTDSELGIRAIDEK

SEQ ID NO: 98565 - protein, 16 aa, Borrelia burgdorferi B31
QVTDSELGIRAIDEKT

SEQ ID NO: 98566 - protein, 16 aa, Borrelia burgdorferi B31
VTDSELGIRAIDEKTL

SEQ ID NO: 98567 - protein, 16 aa, Borrelia burgdorferi B31
TDSELGIRAIDEKTLE

SEQ ID NO: 98568 - protein, 16 aa, Borrelia burgdorferi B31
DSELGIRAIDEKTLEI

SEQ ID NO: 98569 - protein, 16 aa, Borrelia burgdorferi B31
SELGIRAIDEKTLEIT

SEQ ID NO: 98570 - protein, 16 aa, Borrelia burgdorferi B31
ELGIRAIDEKTLEITL

SEQ ID NO: 98571 - protein, 16 aa, Borrelia burgdorferi B31
LGIRAIDEKTLEITLE

SEQ ID NO: 98572 - protein, 16 aa, Borrelia burgdorferi B31
GIRAIDEKTLEITLES

SEQ ID NO: 98573 - protein, 16 aa, Borrelia burgdorferi B31
IRAIDEKTLEITLESP

SEQ ID NO: 98574 - protein, 16 aa, Borrelia burgdorferi B31
RAIDEKTLEITLESPK

SEQ ID NO: 98575 - protein, 16 aa, Borrelia burgdorferi B31
AIDEKTLEITLESPKP

SEQ ID NO: 98576 - protein, 16 aa, Borrelia burgdorferi B31
IDEKTLEITLESPKPY

SEQ ID NO: 98577 - protein, 16 aa, Borrelia burgdorferi B31
DEKTLEITLESPKPYF

SEQ ID NO: 98578 - protein, 16 aa, Borrelia burgdorferi B31
EKTLEITLESPKPYFI

SEQ ID NO: 98579 - protein, 16 aa, Borrelia burgdorferi B31
KTLEITLESPKPYFID

SEQ ID NO: 98580 - protein, 16 aa, Borrelia burgdorferi B31
TLEITLESPKPYFIDM

SEQ ID NO: 98581 - protein, 16 aa, Borrelia burgdorferi B31
LEITLESPKPYFIDML

SEQ ID NO: 98582 - protein, 16 aa, Borrelia burgdorferi B31
EITLESPKPYFIDMLV

SEQ ID NO: 98583 - protein, 16 aa, Borrelia burgdorferi B31
ITLESPKPYFIDMLVH

SEQ ID NO: 98584 - protein, 16 aa, Borrelia burgdorferi B31
TLESPKPYFIDMLVHQ

SEQ ID NO: 98585 - protein, 16 aa, Borrelia burgdorferi B31
LESPKPYFIDMLVHQS

SEQ ID NO: 98586 - protein, 16 aa, Borrelia burgdorferi B31
ESPKPYFIDMLVHQSF

SEQ ID NO: 98587 - protein, 16 aa, Borrelia burgdorferi B31
SPKPYFIDMLVHQSFI

SEQ ID NO: 98588 - protein, 16 aa, Borrelia burgdorferi B31
PKPYFIDMLVHQSFIP

SEQ ID NO: 98589 - protein, 16 aa, Borrelia burgdorferi B31
KPYFIDMLVHQSFIPV

SEQ ID NO: 98590 - protein, 16 aa, Borrelia burgdorferi B31
PYFIDMLVHQSFIPVP

SEQ ID NO: 98591 - protein, 16 aa, Borrelia burgdorferi B31
YFIDMLVHQSFIPVPV

SEQ ID NO: 98592 - protein, 16 aa, Borrelia burgdorferi B31
FIDMLVHQSFIPVPVH

SEQ ID NO: 98593 - protein, 16 aa, Borrelia burgdorferi B31
IDMLVHQSFIPVPVHV

SEQ ID NO: 98594 - protein, 16 aa, Borrelia burgdorferi B31
DMLVHQSFIPVPVHVT

SEQ ID NO: 98595 - protein, 16 aa, Borrelia burgdorferi B31
MLVHQSFIPVPVHVTE

SEQ ID NO: 98596 - protein, 16 aa, Borrelia burgdorferi B31
LVHQSFIPVPVHVTEK

SEQ ID NO: 98597 - protein, 16 aa, Borrelia burgdorferi B31
VHQSFIPVPVHVTEKY

SEQ ID NO: 98598 - protein, 16 aa, Borrelia burgdorferi B31
HQSFIPVPVHVTEKYG

SEQ ID NO: 98599 - protein, 16 aa, Borrelia burgdorferi B31
QSFIPVPVHVTEKYGQ

SEQ ID NO: 98600 - protein, 16 aa, Borrelia burgdorferi B31
SFIPVPVHVTEKYGQN

SEQ ID NO: 98601 - protein, 16 aa, Borrelia burgdorferi B31
FIPVPVHVTEKYGQNW

SEQ ID NO: 98602 - protein, 16 aa, Borrelia burgdorferi B31
IPVPVHVTEKYGQNWT

SEQ ID NO: 98603 - protein, 16 aa, Borrelia burgdorferi B31
PVPVHVTEKYGQNWTS

SEQ ID NO: 98604 - protein, 16 aa, Borrelia burgdorferi B31
VPVHVTEKYGQNWTSP

SEQ ID NO: 98605 - protein, 16 aa, Borrelia burgdorferi B31
PVHVTEKYGQNWTSPE

SEQ ID NO: 98606 - protein, 16 aa, Borrelia burgdorferi B31
VHVTEKYGQNWTSPEN

SEQ ID NO: 98607 - protein, 16 aa, Borrelia burgdorferi B31
HVTEKYGQNWTSPENM

SEQ ID NO: 98608 - protein, 16 aa, Borrelia burgdorferi B31
VTEKYGQNWTSPENMV

SEQ ID NO: 98609 - protein, 16 aa, Borrelia burgdorferi B31
TEKYGQNWTSPENMVT

SEQ ID NO: 98610 - protein, 16 aa, Borrelia burgdorferi B31
EKYGQNWTSPENMVTS

SEQ ID NO: 98611 - protein, 16 aa, Borrelia burgdorferi B31
KYGQNWTSPENMVTSG

SEQ ID NO: 98612 - protein, 16 aa, Borrelia burgdorferi B31
YGQNWTSPENMVTSGP

SEQ ID NO: 98613 - protein, 16 aa, Borrelia burgdorferi B31
GQNWTSPENMVTSGPF

SEQ ID NO: 98614 - protein, 16 aa, Borrelia burgdorferi B31
QNWTSPENMVTSGPFK

SEQ ID NO: 98615 - protein, 16 aa, Borrelia burgdorferi B31
NWTSPENMVTSGPFKL

SEQ ID NO: 98616 - protein, 16 aa, Borrelia burgdorferi B31
WTSPENMVTSGPFKLK

SEQ ID NO: 98617 - protein, 16 aa, Borrelia burgdorferi B31
TSPENMVTSGPFKLKE

SEQ ID NO: 98618 - protein, 16 aa, Borrelia burgdorferi B31
SPENMVTSGPFKLKER

SEQ ID NO: 98619 - protein, 16 aa, Borrelia burgdorferi B31
PENMVTSGPFKLKERI

SEQ ID NO: 98620 - protein, 16 aa, Borrelia burgdorferi B31
ENMVTSGPFKLKERIP

SEQ ID NO: 98621 - protein, 16 aa, Borrelia burgdorferi B31
NMVTSGPFKLKERIPN

SEQ ID NO: 98622 - protein, 16 aa, Borrelia burgdorferi B31
MVTSGPFKLKERIPNE

SEQ ID NO: 98623 - protein, 16 aa, Borrelia burgdorferi B31
VTSGPFKLKERIPNEK

SEQ ID NO: 98624 - protein, 16 aa, Borrelia burgdorferi B31
TSGPFKLKERIPNEKY

SEQ ID NO: 98625 - protein, 16 aa, Borrelia burgdorferi B31
SGPFKLKERIPNEKYV

SEQ ID NO: 98626 - protein, 16 aa, Borrelia burgdorferi B31
GPFKLKERIPNEKYVF

SEQ ID NO: 98627 - protein, 16 aa, Borrelia burgdorferi B31
PFKLKERIPNEKYVFE

SEQ ID NO: 98628 - protein, 16 aa, Borrelia burgdorferi B31
FKLKERIPNEKYVFEK

SEQ ID NO: 98629 - protein, 16 aa, Borrelia burgdorferi B31
KLKERIPNEKYVFEKN

SEQ ID NO: 98630 - protein, 16 aa, Borrelia burgdorferi B31
LKERIPNEKYVFEKNN

SEQ ID NO: 98631 - protein, 16 aa, Borrelia burgdorferi B31
KERIPNEKYVFEKNNK

SEQ ID NO: 98632 - protein, 16 aa, Borrelia burgdorferi B31
ERIPNEKYVFEKNNKY

SEQ ID NO: 98633 - protein, 16 aa, Borrelia burgdorferi B31
RIPNEKYVFEKNNKYY

SEQ ID NO: 98634 - protein, 16 aa, Borrelia burgdorferi B31
IPNEKYVFEKNNKYYD

SEQ ID NO: 98635 - protein, 16 aa, Borrelia burgdorferi B31
PNEKYVFEKNNKYYDS

SEQ ID NO: 98636 - protein, 16 aa, Borrelia burgdorferi B31
NEKYVFEKNNKYYDSN

SEQ ID NO: 98637 - protein, 16 aa, Borrelia burgdorferi B31
EKYVFEKNNKYYDSNE

SEQ ID NO: 98638 - protein, 16 aa, Borrelia burgdorferi B31
KYVFEKNNKYYDSNEV

SEQ ID NO: 98639 - protein, 16 aa, Borrelia burgdorferi B31
YVFEKNNKYYDSNEVE

SEQ ID NO: 98640 - protein, 16 aa, Borrelia burgdorferi B31
VFEKNNKYYDSNEVEL

SEQ ID NO: 98641 - protein, 16 aa, Borrelia burgdorferi B31
FEKNNKYYDSNEVELE

SEQ ID NO: 98642 - protein, 16 aa, Borrelia burgdorferi B31
EKNNKYYDSNEVELEE

SEQ ID NO: 98643 - protein, 16 aa, Borrelia burgdorferi B31
KNNKYYDSNEVELEEI

SEQ ID NO: 98644 - protein, 16 aa, Borrelia burgdorferi B31
NNKYYDSNEVELEEIT

SEQ ID NO: 98645 - protein, 16 aa, Borrelia burgdorferi B31
NKYYDSNEVELEEITF

SEQ ID NO: 98646 - protein, 16 aa, Borrelia burgdorferi B31
KYYDSNEVELEEITFY

SEQ ID NO: 98647 - protein, 16 aa, Borrelia burgdorferi B31
YYDSNEVELEEITFYT

SEQ ID NO: 98648 - protein, 16 aa, Borrelia burgdorferi B31
YDSNEVELEEITFYTT

SEQ ID NO: 98649 - protein, 16 aa, Borrelia burgdorferi B31
DSNEVELEEITFYTTN

SEQ ID NO: 98650 - protein, 16 aa, Borrelia burgdorferi B31
SNEVELEEITFYTTND

SEQ ID NO: 98651 - protein, 16 aa, Borrelia burgdorferi B31
NEVELEEITFYTTNDS

SEQ ID NO: 98652 - protein, 16 aa, Borrelia burgdorferi B31
EVELEEITFYTTNDSS

SEQ ID NO: 98653 - protein, 16 aa, Borrelia burgdorferi B31
VELEEITFYTTNDSST

SEQ ID NO: 98654 - protein, 16 aa, Borrelia burgdorferi B31
ELEEITFYTTNDSSTA

SEQ ID NO: 98655 - protein, 16 aa, Borrelia burgdorferi B31
LEEITFYTTNDSSTAY

SEQ ID NO: 98656 - protein, 16 aa, Borrelia burgdorferi B31
EEITFYTTNDSSTAYK

SEQ ID NO: 98657 - protein, 16 aa, Borrelia burgdorferi B31
EITFYTTNDSSTAYKM

SEQ ID NO: 98658 - protein, 16 aa, Borrelia burgdorferi B31
ITFYTTNDSSTAYKMY

SEQ ID NO: 98659 - protein, 16 aa, Borrelia burgdorferi B31
TFYTTNDSSTAYKMYE

SEQ ID NO: 98660 - protein, 16 aa, Borrelia burgdorferi B31
FYTTNDSSTAYKMYEN

SEQ ID NO: 98661 - protein, 16 aa, Borrelia burgdorferi B31
YTTNDSSTAYKMYENE

SEQ ID NO: 98662 - protein, 16 aa, Borrelia burgdorferi B31
TTNDSSTAYKMYENEE

SEQ ID NO: 98663 - protein, 16 aa, Borrelia burgdorferi B31
TNDSSTAYKMYENEEL

SEQ ID NO: 98664 - protein, 16 aa, Borrelia burgdorferi B31
NDSSTAYKMYENEELD

SEQ ID NO: 98665 - protein, 16 aa, Borrelia burgdorferi B31
DSSTAYKMYENEELDA

SEQ ID NO: 98666 - protein, 16 aa, Borrelia burgdorferi B31
SSTAYKMYENEELDAI

SEQ ID NO: 98667 - protein, 16 aa, Borrelia burgdorferi B31
STAYKMYENEELDAIF

SEQ ID NO: 98668 - protein, 16 aa, Borrelia burgdorferi B31
TAYKMYENEELDAIFG

SEQ ID NO: 98669 - protein, 16 aa, Borrelia burgdorferi B31
AYKMYENEELDAIFGS

SEQ ID NO: 98670 - protein, 16 aa, Borrelia burgdorferi B31
YKMYENEELDAIFGSI

SEQ ID NO: 98671 - protein, 16 aa, Borrelia burgdorferi B31
KMYENEELDAIFGSIP

SEQ ID NO: 98672 - protein, 16 aa, Borrelia burgdorferi B31
MYENEELDAIFGSIPP

SEQ ID NO: 98673 - protein, 16 aa, Borrelia burgdorferi B31
YENEELDAIFGSIPPD

SEQ ID NO: 98674 - protein, 16 aa, Borrelia burgdorferi B31
ENEELDAIFGSIPPDL

SEQ ID NO: 98675 - protein, 16 aa, Borrelia burgdorferi B31
NEELDAIFGSIPPDLI

SEQ ID NO: 98676 - protein, 16 aa, Borrelia burgdorferi B31
EELDAIFGSIPPDLIK

SEQ ID NO: 98677 - protein, 16 aa, Borrelia burgdorferi B31
ELDAIFGSIPPDLIKN

SEQ ID NO: 98678 - protein, 16 aa, Borrelia burgdorferi B31
LDAIFGSIPPDLIKNL

SEQ ID NO: 98679 - protein, 16 aa, Borrelia burgdorferi B31
DAIFGSIPPDLIKNLK

SEQ ID NO: 98680 - protein, 16 aa, Borrelia burgdorferi B31
AIFGSIPPDLIKNLKL

SEQ ID NO: 98681 - protein, 16 aa, Borrelia burgdorferi B31
IFGSIPPDLIKNLKLR

SEQ ID NO: 98682 - protein, 16 aa, Borrelia burgdorferi B31
FGSIPPDLIKNLKLRS

SEQ ID NO: 98683 - protein, 16 aa, Borrelia burgdorferi B31
GSIPPDLIKNLKLRSD

SEQ ID NO: 98684 - protein, 16 aa, Borrelia burgdorferi B31
SIPPDLIKNLKLRSDY

SEQ ID NO: 98685 - protein, 16 aa, Borrelia burgdorferi B31
IPPDLIKNLKLRSDYY

SEQ ID NO: 98686 - protein, 16 aa, Borrelia burgdorferi B31
PPDLIKNLKLRSDYYS

SEQ ID NO: 98687 - protein, 16 aa, Borrelia burgdorferi B31
PDLIKNLKLRSDYYSS

SEQ ID NO: 98688 - protein, 16 aa, Borrelia burgdorferi B31
DLIKNLKLRSDYYSSA

SEQ ID NO: 98689 - protein, 16 aa, Borrelia burgdorferi B31
LIKNLKLRSDYYSSAV

SEQ ID NO: 98690 - protein, 16 aa, Borrelia burgdorferi B31
IKNLKLRSDYYSSAVN

SEQ ID NO: 98691 - protein, 16 aa, Borrelia burgdorferi B31
KNLKLRSDYYSSAVNA

SEQ ID NO: 98692 - protein, 16 aa, Borrelia burgdorferi B31
NLKLRSDYYSSAVNAI

SEQ ID NO: 98693 - protein, 16 aa, Borrelia burgdorferi B31
LKLRSDYYSSAVNAIY

SEQ ID NO: 98694 - protein, 16 aa, Borrelia burgdorferi B31
KLRSDYYSSAVNAIYF

SEQ ID NO: 98695 - protein, 16 aa, Borrelia burgdorferi B31
LRSDYYSSAVNAIYFY

SEQ ID NO: 98696 - protein, 16 aa, Borrelia burgdorferi B31
RSDYYSSAVNAIYFYA

SEQ ID NO: 98697 - protein, 16 aa, Borrelia burgdorferi B31
SDYYSSAVNAIYFYAF

SEQ ID NO: 98698 - protein, 16 aa, Borrelia burgdorferi B31
DYYSSAVNAIYFYAFN

SEQ ID NO: 98699 - protein, 16 aa, Borrelia burgdorferi B31
YYSSAVNAIYFYAFNT

SEQ ID NO: 98700 - protein, 16 aa, Borrelia burgdorferi B31
YSSAVNAIYFYAFNTH

SEQ ID NO: 98701 - protein, 16 aa, Borrelia burgdorferi B31
SSAVNAIYFYAFNTHI

SEQ ID NO: 98702 - protein, 16 aa, Borrelia burgdorferi B31
SAVNAIYFYAFNTHIK

SEQ ID NO: 98703 - protein, 16 aa, Borrelia burgdorferi B31
AVNAIYFYAFNTHIKP

SEQ ID NO: 98704 - protein, 16 aa, Borrelia burgdorferi B31
VNAIYFYAFNTHIKPL

SEQ ID NO: 98705 - protein, 16 aa, Borrelia burgdorferi B31
NAIYFYAFNTHIKPLD

SEQ ID NO: 98706 - protein, 16 aa, Borrelia burgdorferi B31
AIYFYAFNTHIKPLDN

SEQ ID NO: 98707 - protein, 16 aa, Borrelia burgdorferi B31
IYFYAFNTHIKPLDNV

SEQ ID NO: 98708 - protein, 16 aa, Borrelia burgdorferi B31
YFYAFNTHIKPLDNVK

SEQ ID NO: 98709 - protein, 16 aa, Borrelia burgdorferi B31
FYAFNTHIKPLDNVKI

SEQ ID NO: 98710 - protein, 16 aa, Borrelia burgdorferi B31
YAFNTHIKPLDNVKIR

SEQ ID NO: 98711 - protein, 16 aa, Borrelia burgdorferi B31
AFNTHIKPLDNVKIRK

SEQ ID NO: 98712 - protein, 16 aa, Borrelia burgdorferi B31
FNTHIKPLDNVKIRKA

SEQ ID NO: 98713 - protein, 16 aa, Borrelia burgdorferi B31
NTHIKPLDNVKIRKAL

SEQ ID NO: 98714 - protein, 16 aa, Borrelia burgdorferi B31
THIKPLDNVKIRKALT

SEQ ID NO: 98715 - protein, 16 aa, Borrelia burgdorferi B31
HIKPLDNVKIRKALTL

SEQ ID NO: 98716 - protein, 16 aa, Borrelia burgdorferi B31
IKPLDNVKIRKALTLA

SEQ ID NO: 98717 - protein, 16 aa, Borrelia burgdorferi B31
KPLDNVKIRKALTLAI

SEQ ID NO: 98718 - protein, 16 aa, Borrelia burgdorferi B31
PLDNVKIRKALTLAID

SEQ ID NO: 98719 - protein, 16 aa, Borrelia burgdorferi B31
LDNVKIRKALTLAIDR

SEQ ID NO: 98720 - protein, 16 aa, Borrelia burgdorferi B31
DNVKIRKALTLAIDRE

SEQ ID NO: 98721 - protein, 16 aa, Borrelia burgdorferi B31
NVKIRKALTLAIDRET

SEQ ID NO: 98722 - protein, 16 aa, Borrelia burgdorferi B31
VKIRKALTLAIDRETL

SEQ ID NO: 98723 - protein, 16 aa, Borrelia burgdorferi B31
KIRKALTLAIDRETLT

SEQ ID NO: 98724 - protein, 16 aa, Borrelia burgdorferi B31
IRKALTLAIDRETLTY

SEQ ID NO: 98725 - protein, 16 aa, Borrelia burgdorferi B31
RKALTLAIDRETLTYK

SEQ ID NO: 98726 - protein, 16 aa, Borrelia burgdorferi B31
KALTLAIDRETLTYKV

SEQ ID NO: 98727 - protein, 16 aa, Borrelia burgdorferi B31
ALTLAIDRETLTYKVL

SEQ ID NO: 98728 - protein, 16 aa, Borrelia burgdorferi B31
LTLAIDRETLTYKVLD

SEQ ID NO: 98729 - protein, 16 aa, Borrelia burgdorferi B31
TLAIDRETLTYKVLDN

SEQ ID NO: 98730 - protein, 16 aa, Borrelia burgdorferi B31
LAIDRETLTYKVLDNG

SEQ ID NO: 98731 - protein, 16 aa, Borrelia burgdorferi B31
AIDRETLTYKVLDNGT

SEQ ID NO: 98732 - protein, 16 aa, Borrelia burgdorferi B31
IDRETLTYKVLDNGTT

SEQ ID NO: 98733 - protein, 16 aa, Borrelia burgdorferi B31
DRETLTYKVLDNGTTP

SEQ ID NO: 98734 - protein, 16 aa, Borrelia burgdorferi B31
RETLTYKVLDNGTTPT

SEQ ID NO: 98735 - protein, 16 aa, Borrelia burgdorferi B31
ETLTYKVLDNGTTPTR

SEQ ID NO: 98736 - protein, 16 aa, Borrelia burgdorferi B31
TLTYKVLDNGTTPTRR

SEQ ID NO: 98737 - protein, 16 aa, Borrelia burgdorferi B31
LTYKVLDNGTTPTRRA

SEQ ID NO: 98738 - protein, 16 aa, Borrelia burgdorferi B31
TYKVLDNGTTPTRRAT

SEQ ID NO: 98739 - protein, 16 aa, Borrelia burgdorferi B31
YKVLDNGTTPTRRATP

SEQ ID NO: 98740 - protein, 16 aa, Borrelia burgdorferi B31
KVLDNGTTPTRRATPN

SEQ ID NO: 98741 - protein, 16 aa, Borrelia burgdorferi B31
VLDNGTTPTRRATPNF

SEQ ID NO: 98742 - protein, 16 aa, Borrelia burgdorferi B31
LDNGTTPTRRATPNFS

SEQ ID NO: 98743 - protein, 16 aa, Borrelia burgdorferi B31
DNGTTPTRRATPNFSS

SEQ ID NO: 98744 - protein, 16 aa, Borrelia burgdorferi B31
NGTTPTRRATPNFSSY

SEQ ID NO: 98745 - protein, 16 aa, Borrelia burgdorferi B31
GTTPTRRATPNFSSYS

SEQ ID NO: 98746 - protein, 16 aa, Borrelia burgdorferi B31
TTPTRRATPNFSSYSY

SEQ ID NO: 98747 - protein, 16 aa, Borrelia burgdorferi B31
TPTRRATPNFSSYSYA

SEQ ID NO: 98748 - protein, 16 aa, Borrelia burgdorferi B31
PTRRATPNFSSYSYAK

SEQ ID NO: 98749 - protein, 16 aa, Borrelia burgdorferi B31
TRRATPNFSSYSYAKS

SEQ ID NO: 98750 - protein, 16 aa, Borrelia burgdorferi B31
RRATPNFSSYSYAKSL

SEQ ID NO: 98751 - protein, 16 aa, Borrelia burgdorferi B31
RATPNFSSYSYAKSLE

SEQ ID NO: 98752 - protein, 16 aa, Borrelia burgdorferi B31
ATPNFSSYSYAKSLEL

SEQ ID NO: 98753 - protein, 16 aa, Borrelia burgdorferi B31
TPNFSSYSYAKSLELF

SEQ ID NO: 98754 - protein, 16 aa, Borrelia burgdorferi B31
PNFSSYSYAKSLELFN

SEQ ID NO: 98755 - protein, 16 aa, Borrelia burgdorferi B31
NFSSYSYAKSLELFNP

SEQ ID NO: 98756 - protein, 16 aa, Borrelia burgdorferi B31
FSSYSYAKSLELFNPE

SEQ ID NO: 98757 - protein, 16 aa, Borrelia burgdorferi B31
SSYSYAKSLELFNPEI

SEQ ID NO: 98758 - protein, 16 aa, Borrelia burgdorferi B31
SYSYAKSLELFNPEIA

SEQ ID NO: 98759 - protein, 16 aa, Borrelia burgdorferi B31
YSYAKSLELFNPEIAK

SEQ ID NO: 98760 - protein, 16 aa, Borrelia burgdorferi B31
SYAKSLELFNPEIAKT

SEQ ID NO: 98761 - protein, 16 aa, Borrelia burgdorferi B31
YAKSLELFNPEIAKTL

SEQ ID NO: 98762 - protein, 16 aa, Borrelia burgdorferi B31
AKSLELFNPEIAKTLL

SEQ ID NO: 98763 - protein, 16 aa, Borrelia burgdorferi B31
KSLELFNPEIAKTLLA

SEQ ID NO: 98764 - protein, 16 aa, Borrelia burgdorferi B31
SLELFNPEIAKTLLAE

SEQ ID NO: 98765 - protein, 16 aa, Borrelia burgdorferi B31
LELFNPEIAKTLLAEA

SEQ ID NO: 98766 - protein, 16 aa, Borrelia burgdorferi B31
ELFNPEIAKTLLAEAG

SEQ ID NO: 98767 - protein, 16 aa, Borrelia burgdorferi B31
LFNPEIAKTLLAEAGY

SEQ ID NO: 98768 - protein, 16 aa, Borrelia burgdorferi B31
FNPEIAKTLLAEAGYP

SEQ ID NO: 98769 - protein, 16 aa, Borrelia burgdorferi B31
NPEIAKTLLAEAGYPN

SEQ ID NO: 98770 - protein, 16 aa, Borrelia burgdorferi B31
PEIAKTLLAEAGYPNG

SEQ ID NO: 98771 - protein, 16 aa, Borrelia burgdorferi B31
EIAKTLLAEAGYPNGN

SEQ ID NO: 98772 - protein, 16 aa, Borrelia burgdorferi B31
IAKTLLAEAGYPNGNG

SEQ ID NO: 98773 - protein, 16 aa, Borrelia burgdorferi B31
AKTLLAEAGYPNGNGF

SEQ ID NO: 98774 - protein, 16 aa, Borrelia burgdorferi B31
KTLLAEAGYPNGNGFP

SEQ ID NO: 98775 - protein, 16 aa, Borrelia burgdorferi B31
TLLAEAGYPNGNGFPI

SEQ ID NO: 98776 - protein, 16 aa, Borrelia burgdorferi B31
LLAEAGYPNGNGFPIL

SEQ ID NO: 98777 - protein, 16 aa, Borrelia burgdorferi B31
LAEAGYPNGNGFPILK

SEQ ID NO: 98778 - protein, 16 aa, Borrelia burgdorferi B31
AEAGYPNGNGFPILKL

SEQ ID NO: 98779 - protein, 16 aa, Borrelia burgdorferi B31
EAGYPNGNGFPILKLK

SEQ ID NO: 98780 - protein, 16 aa, Borrelia burgdorferi B31
AGYPNGNGFPILKLKY

SEQ ID NO: 98781 - protein, 16 aa, Borrelia burgdorferi B31
GYPNGNGFPILKLKYN

SEQ ID NO: 98782 - protein, 16 aa, Borrelia burgdorferi B31
YPNGNGFPILKLKYNT

SEQ ID NO: 98783 - protein, 16 aa, Borrelia burgdorferi B31
PNGNGFPILKLKYNTN

SEQ ID NO: 98784 - protein, 16 aa, Borrelia burgdorferi B31
NGNGFPILKLKYNTNE

SEQ ID NO: 98785 - protein, 16 aa, Borrelia burgdorferi B31
GNGFPILKLKYNTNEA

SEQ ID NO: 98786 - protein, 16 aa, Borrelia burgdorferi B31
NGFPILKLKYNTNEAN

SEQ ID NO: 98787 - protein, 16 aa, Borrelia burgdorferi B31
GFPILKLKYNTNEANK

SEQ ID NO: 98788 - protein, 16 aa, Borrelia burgdorferi B31
FPILKLKYNTNEANKK

SEQ ID NO: 98789 - protein, 16 aa, Borrelia burgdorferi B31
PILKLKYNTNEANKKI

SEQ ID NO: 98790 - protein, 16 aa, Borrelia burgdorferi B31
ILKLKYNTNEANKKIC

SEQ ID NO: 98791 - protein, 16 aa, Borrelia burgdorferi B31
LKLKYNTNEANKKICE

SEQ ID NO: 98792 - protein, 16 aa, Borrelia burgdorferi B31
KLKYNTNEANKKICEF

SEQ ID NO: 98793 - protein, 16 aa, Borrelia burgdorferi B31
LKYNTNEANKKICEFI

SEQ ID NO: 98794 - protein, 16 aa, Borrelia burgdorferi B31
KYNTNEANKKICEFIQ

SEQ ID NO: 98795 - protein, 16 aa, Borrelia burgdorferi B31
YNTNEANKKICEFIQN

SEQ ID NO: 98796 - protein, 16 aa, Borrelia burgdorferi B31
NTNEANKKICEFIQNQ

SEQ ID NO: 98797 - protein, 16 aa, Borrelia burgdorferi B31
TNEANKKICEFIQNQW

SEQ ID NO: 98798 - protein, 16 aa, Borrelia burgdorferi B31
NEANKKICEFIQNQWK

SEQ ID NO: 98799 - protein, 16 aa, Borrelia burgdorferi B31
EANKKICEFIQNQWKK

SEQ ID NO: 98800 - protein, 16 aa, Borrelia burgdorferi B31
ANKKICEFIQNQWKKN

SEQ ID NO: 98801 - protein, 16 aa, Borrelia burgdorferi B31
NKKICEFIQNQWKKNL

SEQ ID NO: 98802 - protein, 16 aa, Borrelia burgdorferi B31
KKICEFIQNQWKKNLN

SEQ ID NO: 98803 - protein, 16 aa, Borrelia burgdorferi B31
KICEFIQNQWKKNLNI

SEQ ID NO: 98804 - protein, 16 aa, Borrelia burgdorferi B31
ICEFIQNQWKKNLNID

SEQ ID NO: 98805 - protein, 16 aa, Borrelia burgdorferi B31
CEFIQNQWKKNLNIDV

SEQ ID NO: 98806 - protein, 16 aa, Borrelia burgdorferi B31
EFIQNQWKKNLNIDVE

SEQ ID NO: 98807 - protein, 16 aa, Borrelia burgdorferi B31
FIQNQWKKNLNIDVEL

SEQ ID NO: 98808 - protein, 16 aa, Borrelia burgdorferi B31
IQNQWKKNLNIDVELE

SEQ ID NO: 98809 - protein, 16 aa, Borrelia burgdorferi B31
QNQWKKNLNIDVELEN

SEQ ID NO: 98810 - protein, 16 aa, Borrelia burgdorferi B31
NQWKKNLNIDVELENE

SEQ ID NO: 98811 - protein, 16 aa, Borrelia burgdorferi B31
QWKKNLNIDVELENEE

SEQ ID NO: 98812 - protein, 16 aa, Borrelia burgdorferi B31
WKKNLNIDVELENEEW

SEQ ID NO: 98813 - protein, 16 aa, Borrelia burgdorferi B31
KKNLNIDVELENEEWT

SEQ ID NO: 98814 - protein, 16 aa, Borrelia burgdorferi B31
KNLNIDVELENEEWTT

SEQ ID NO: 98815 - protein, 16 aa, Borrelia burgdorferi B31
NLNIDVELENEEWTTY

SEQ ID NO: 98816 - protein, 16 aa, Borrelia burgdorferi B31
LNIDVELENEEWTTYL

SEQ ID NO: 98817 - protein, 16 aa, Borrelia burgdorferi B31
NIDVELENEEWTTYLN

SEQ ID NO: 98818 - protein, 16 aa, Borrelia burgdorferi B31
IDVELENEEWTTYLNT

SEQ ID NO: 98819 - protein, 16 aa, Borrelia burgdorferi B31
DVELENEEWTTYLNTK

SEQ ID NO: 98820 - protein, 16 aa, Borrelia burgdorferi B31
VELENEEWTTYLNTKA

SEQ ID NO: 98821 - protein, 16 aa, Borrelia burgdorferi B31
ELENEEWTTYLNTKAN

SEQ ID NO: 98822 - protein, 16 aa, Borrelia burgdorferi B31
LENEEWTTYLNTKANG

SEQ ID NO: 98823 - protein, 16 aa, Borrelia burgdorferi B31
ENEEWTTYLNTKANGN

SEQ ID NO: 98824 - protein, 16 aa, Borrelia burgdorferi B31
NEEWTTYLNTKANGNY

SEQ ID NO: 98825 - protein, 16 aa, Borrelia burgdorferi B31
EEWTTYLNTKANGNYE

SEQ ID NO: 98826 - protein, 16 aa, Borrelia burgdorferi B31
EWTTYLNTKANGNYEI

SEQ ID NO: 98827 - protein, 16 aa, Borrelia burgdorferi B31
WTTYLNTKANGNYEIA

SEQ ID NO: 98828 - protein, 16 aa, Borrelia burgdorferi B31
TTYLNTKANGNYEIAR

SEQ ID NO: 98829 - protein, 16 aa, Borrelia burgdorferi B31
TYLNTKANGNYEIARA

SEQ ID NO: 98830 - protein, 16 aa, Borrelia burgdorferi B31
YLNTKANGNYEIARAG

SEQ ID NO: 98831 - protein, 16 aa, Borrelia burgdorferi B31
LNTKANGNYEIARAGW

SEQ ID NO: 98832 - protein, 16 aa, Borrelia burgdorferi B31
NTKANGNYEIARAGWI

SEQ ID NO: 98833 - protein, 16 aa, Borrelia burgdorferi B31
TKANGNYEIARAGWIG

SEQ ID NO: 98834 - protein, 16 aa, Borrelia burgdorferi B31
KANGNYEIARAGWIGD

SEQ ID NO: 98835 - protein, 16 aa, Borrelia burgdorferi B31
ANGNYEIARAGWIGDY

SEQ ID NO: 98836 - protein, 16 aa, Borrelia burgdorferi B31
NGNYEIARAGWIGDYA

SEQ ID NO: 98837 - protein, 16 aa, Borrelia burgdorferi B31
GNYEIARAGWIGDYAD

SEQ ID NO: 98838 - protein, 16 aa, Borrelia burgdorferi B31
NYEIARAGWIGDYADP

SEQ ID NO: 98839 - protein, 16 aa, Borrelia burgdorferi B31
YEIARAGWIGDYADPL

SEQ ID NO: 98840 - protein, 16 aa, Borrelia burgdorferi B31
EIARAGWIGDYADPLT

SEQ ID NO: 98841 - protein, 16 aa, Borrelia burgdorferi B31
IARAGWIGDYADPLTF

SEQ ID NO: 98842 - protein, 16 aa, Borrelia burgdorferi B31
ARAGWIGDYADPLTFL

SEQ ID NO: 98843 - protein, 16 aa, Borrelia burgdorferi B31
RAGWIGDYADPLTFLS

SEQ ID NO: 98844 - protein, 16 aa, Borrelia burgdorferi B31
AGWIGDYADPLTFLSI

SEQ ID NO: 98845 - protein, 16 aa, Borrelia burgdorferi B31
GWIGDYADPLTFLSIF

SEQ ID NO: 98846 - protein, 16 aa, Borrelia burgdorferi B31
WIGDYADPLTFLSIFT

SEQ ID NO: 98847 - protein, 16 aa, Borrelia burgdorferi B31
IGDYADPLTFLSIFTQ

SEQ ID NO: 98848 - protein, 16 aa, Borrelia burgdorferi B31
GDYADPLTFLSIFTQG

SEQ ID NO: 98849 - protein, 16 aa, Borrelia burgdorferi B31
DYADPLTFLSIFTQGY

SEQ ID NO: 98850 - protein, 16 aa, Borrelia burgdorferi B31
YADPLTFLSIFTQGYT

SEQ ID NO: 98851 - protein, 16 aa, Borrelia burgdorferi B31
ADPLTFLSIFTQGYTQ

SEQ ID NO: 98852 - protein, 16 aa, Borrelia burgdorferi B31
DPLTFLSIFTQGYTQF

SEQ ID NO: 98853 - protein, 16 aa, Borrelia burgdorferi B31
PLTFLSIFTQGYTQFS

SEQ ID NO: 98854 - protein, 16 aa, Borrelia burgdorferi B31
LTFLSIFTQGYTQFSS

SEQ ID NO: 98855 - protein, 16 aa, Borrelia burgdorferi B31
TFLSIFTQGYTQFSSH

SEQ ID NO: 98856 - protein, 16 aa, Borrelia burgdorferi B31
FLSIFTQGYTQFSSHN

SEQ ID NO: 98857 - protein, 16 aa, Borrelia burgdorferi B31
LSIFTQGYTQFSSHNY

SEQ ID NO: 98858 - protein, 16 aa, Borrelia burgdorferi B31
SIFTQGYTQFSSHNYS

SEQ ID NO: 98859 - protein, 16 aa, Borrelia burgdorferi B31
IFTQGYTQFSSHNYSN

SEQ ID NO: 98860 - protein, 16 aa, Borrelia burgdorferi B31
FTQGYTQFSSHNYSNP

SEQ ID NO: 98861 - protein, 16 aa, Borrelia burgdorferi B31
TQGYTQFSSHNYSNPE

SEQ ID NO: 98862 - protein, 16 aa, Borrelia burgdorferi B31
QGYTQFSSHNYSNPEY

SEQ ID NO: 98863 - protein, 16 aa, Borrelia burgdorferi B31
GYTQFSSHNYSNPEYN

SEQ ID NO: 98864 - protein, 16 aa, Borrelia burgdorferi B31
YTQFSSHNYSNPEYNE

SEQ ID NO: 98865 - protein, 16 aa, Borrelia burgdorferi B31
TQFSSHNYSNPEYNEL

SEQ ID NO: 98866 - protein, 16 aa, Borrelia burgdorferi B31
QFSSHNYSNPEYNELI

SEQ ID NO: 98867 - protein, 16 aa, Borrelia burgdorferi B31
FSSHNYSNPEYNELIK

SEQ ID NO: 98868 - protein, 16 aa, Borrelia burgdorferi B31
SSHNYSNPEYNELIKK

SEQ ID NO: 98869 - protein, 16 aa, Borrelia burgdorferi B31
SHNYSNPEYNELIKKS

SEQ ID NO: 98870 - protein, 16 aa, Borrelia burgdorferi B31
HNYSNPEYNELIKKSD

SEQ ID NO: 98871 - protein, 16 aa, Borrelia burgdorferi B31
NYSNPEYNELIKKSDL

SEQ ID NO: 98872 - protein, 16 aa, Borrelia burgdorferi B31
YSNPEYNELIKKSDLE

SEQ ID NO: 98873 - protein, 16 aa, Borrelia burgdorferi B31
SNPEYNELIKKSDLEL

SEQ ID NO: 98874 - protein, 16 aa, Borrelia burgdorferi B31
NPEYNELIKKSDLELD

SEQ ID NO: 98875 - protein, 16 aa, Borrelia burgdorferi B31
PEYNELIKKSDLELDP

SEQ ID NO: 98876 - protein, 16 aa, Borrelia burgdorferi B31
EYNELIKKSDLELDPI

SEQ ID NO: 98877 - protein, 16 aa, Borrelia burgdorferi B31
YNELIKKSDLELDPIK

SEQ ID NO: 98878 - protein, 16 aa, Borrelia burgdorferi B31
NELIKKSDLELDPIKR

SEQ ID NO: 98879 - protein, 16 aa, Borrelia burgdorferi B31
ELIKKSDLELDPIKRQ

SEQ ID NO: 98880 - protein, 16 aa, Borrelia burgdorferi B31
LIKKSDLELDPIKRQD

SEQ ID NO: 98881 - protein, 16 aa, Borrelia burgdorferi B31
IKKSDLELDPIKRQDI

SEQ ID NO: 98882 - protein, 16 aa, Borrelia burgdorferi B31
KKSDLELDPIKRQDIL

SEQ ID NO: 98883 - protein, 16 aa, Borrelia burgdorferi B31
KSDLELDPIKRQDILR

SEQ ID NO: 98884 - protein, 16 aa, Borrelia burgdorferi B31
SDLELDPIKRQDILRQ

SEQ ID NO: 98885 - protein, 16 aa, Borrelia burgdorferi B31
DLELDPIKRQDILRQA

SEQ ID NO: 98886 - protein, 16 aa, Borrelia burgdorferi B31
LELDPIKRQDILRQAE

SEQ ID NO: 98887 - protein, 16 aa, Borrelia burgdorferi B31
ELDPIKRQDILRQAEE

SEQ ID NO: 98888 - protein, 16 aa, Borrelia burgdorferi B31
LDPIKRQDILRQAEEI

SEQ ID NO: 98889 - protein, 16 aa, Borrelia burgdorferi B31
DPIKRQDILRQAEEII

SEQ ID NO: 98890 - protein, 16 aa, Borrelia burgdorferi B31
PIKRQDILRQAEEIII

SEQ ID NO: 98891 - protein, 16 aa, Borrelia burgdorferi B31
IKRQDILRQAEEIIIE

SEQ ID NO: 98892 - protein, 16 aa, Borrelia burgdorferi B31
KRQDILRQAEEIIIEK

SEQ ID NO: 98893 - protein, 16 aa, Borrelia burgdorferi B31
RQDILRQAEEIIIEKD

SEQ ID NO: 98894 - protein, 16 aa, Borrelia burgdorferi B31
QDILRQAEEIIIEKDF

SEQ ID NO: 98895 - protein, 16 aa, Borrelia burgdorferi B31
DILRQAEEIIIEKDFP

SEQ ID NO: 98896 - protein, 16 aa, Borrelia burgdorferi B31
ILRQAEEIIIEKDFPI

SEQ ID NO: 98897 - protein, 16 aa, Borrelia burgdorferi B31
LRQAEEIIIEKDFPIA

SEQ ID NO: 98898 - protein, 16 aa, Borrelia burgdorferi B31
RQAEEIIIEKDFPIAP

SEQ ID NO: 98899 - protein, 16 aa, Borrelia burgdorferi B31
QAEEIIIEKDFPIAPI

SEQ ID NO: 98900 - protein, 16 aa, Borrelia burgdorferi B31
AEEIIIEKDFPIAPIY

SEQ ID NO: 98901 - protein, 16 aa, Borrelia burgdorferi B31
EEIIIEKDFPIAPIYI

SEQ ID NO: 98902 - protein, 16 aa, Borrelia burgdorferi B31
EIIIEKDFPIAPIYIY

SEQ ID NO: 98903 - protein, 16 aa, Borrelia burgdorferi B31
IIIEKDFPIAPIYIYG

SEQ ID NO: 98904 - protein, 16 aa, Borrelia burgdorferi B31
IIEKDFPIAPIYIYGN

SEQ ID NO: 98905 - protein, 16 aa, Borrelia burgdorferi B31
IEKDFPIAPIYIYGNS

SEQ ID NO: 98906 - protein, 16 aa, Borrelia burgdorferi B31
EKDFPIAPIYIYGNSY

SEQ ID NO: 98907 - protein, 16 aa, Borrelia burgdorferi B31
KDFPIAPIYIYGNSYL

SEQ ID NO: 98908 - protein, 16 aa, Borrelia burgdorferi B31
DFPIAPIYIYGNSYLF

SEQ ID NO: 98909 - protein, 16 aa, Borrelia burgdorferi B31
FPIAPIYIYGNSYLFR

SEQ ID NO: 98910 - protein, 16 aa, Borrelia burgdorferi B31
PIAPIYIYGNSYLFRN

SEQ ID NO: 98911 - protein, 16 aa, Borrelia burgdorferi B31
IAPIYIYGNSYLFRND

SEQ ID NO: 98912 - protein, 16 aa, Borrelia burgdorferi B31
APIYIYGNSYLFRNDK

SEQ ID NO: 98913 - protein, 16 aa, Borrelia burgdorferi B31
PIYIYGNSYLFRNDKW

SEQ ID NO: 98914 - protein, 16 aa, Borrelia burgdorferi B31
IYIYGNSYLFRNDKWT

SEQ ID NO: 98915 - protein, 16 aa, Borrelia burgdorferi B31
YIYGNSYLFRNDKWTG

SEQ ID NO: 98916 - protein, 16 aa, Borrelia burgdorferi B31
IYGNSYLFRNDKWTGW

SEQ ID NO: 98917 - protein, 16 aa, Borrelia burgdorferi B31
YGNSYLFRNDKWTGWN

SEQ ID NO: 98918 - protein, 16 aa, Borrelia burgdorferi B31
GNSYLFRNDKWTGWNT

SEQ ID NO: 98919 - protein, 16 aa, Borrelia burgdorferi B31
NSYLFRNDKWTGWNTN

SEQ ID NO: 98920 - protein, 16 aa, Borrelia burgdorferi B31
SYLFRNDKWTGWNTNI

SEQ ID NO: 98921 - protein, 16 aa, Borrelia burgdorferi B31
YLFRNDKWTGWNTNIL

SEQ ID NO: 98922 - protein, 16 aa, Borrelia burgdorferi B31
LFRNDKWTGWNTNILE

SEQ ID NO: 98923 - protein, 16 aa, Borrelia burgdorferi B31
FRNDKWTGWNTNILER

SEQ ID NO: 98924 - protein, 16 aa, Borrelia burgdorferi B31
RNDKWTGWNTNILERF

SEQ ID NO: 98925 - protein, 16 aa, Borrelia burgdorferi B31
NDKWTGWNTNILERFD

SEQ ID NO: 98926 - protein, 16 aa, Borrelia burgdorferi B31
DKWTGWNTNILERFDL

SEQ ID NO: 98927 - protein, 16 aa, Borrelia burgdorferi B31
KWTGWNTNILERFDLS

SEQ ID NO: 98928 - protein, 16 aa, Borrelia burgdorferi B31
WTGWNTNILERFDLSQ

SEQ ID NO: 98929 - protein, 16 aa, Borrelia burgdorferi B31
TGWNTNILERFDLSQL

SEQ ID NO: 98930 - protein, 16 aa, Borrelia burgdorferi B31
GWNTNILERFDLSQLK

SEQ ID NO: 98931 - protein, 16 aa, Borrelia burgdorferi B31
WNTNILERFDLSQLKL

SEQ ID NO: 98932 - protein, 16 aa, Borrelia burgdorferi B31
NTNILERFDLSQLKLK

SEQ ID NO: 98933 - protein, 16 aa, Borrelia burgdorferi B31
TNILERFDLSQLKLKN

SEQ ID NO: 98934 - protein, 16 aa, Borrelia burgdorferi B31
NILERFDLSQLKLKNK

SEQ ID NO: 98935 - protein, 13 aa, Borrelia
MTKIFSNLIINGL

SEQ ID NO: 98936 - protein, 13 aa, Borrelia
TKIFSNLIINGLL

SEQ ID NO: 98937 - protein, 13 aa, Borrelia
KIFSNLIINGLLF

SEQ ID NO: 98938 - protein, 13 aa, Borrelia
IFSNLIINGLLFG

SEQ ID NO: 98939 - protein, 13 aa, Borrelia
FSNLIINGLLFGF

SEQ ID NO: 98940 - protein, 13 aa, Borrelia
SNLIINGLLFGFV

SEQ ID NO: 98941 - protein, 13 aa, Borrelia
NLIINGLLFGFVS

SEQ ID NO: 98942 - protein, 13 aa, Borrelia
LIINGLLFGFVSL

SEQ ID NO: 98943 - protein, 13 aa, Borrelia
IINGLLFGFVSLN

SEQ ID NO: 98944 - protein, 13 aa, Borrelia
INGLLFGFVSLNV

SEQ ID NO: 98945 - protein, 13 aa, Borrelia
NGLLFGFVSLNVF

SEQ ID NO: 98946 - protein, 13 aa, Borrelia
GLLFGFVSLNVFA

SEQ ID NO: 98947 - protein, 13 aa, Borrelia
LLFGFVSLNVFAD

SEQ ID NO: 98948 - protein, 13 aa, Borrelia
LFGFVSLNVFADS

SEQ ID NO: 98949 - protein, 13 aa, Borrelia
FGFVSLNVFADSN

SEQ ID NO: 98950 - protein, 13 aa, Borrelia
GFVSLNVFADSNN

SEQ ID NO: 98951 - protein, 13 aa, Borrelia
FVSLNVFADSNNA

SEQ ID NO: 98952 - protein, 13 aa, Borrelia
VSLNVFADSNNAN

SEQ ID NO: 98953 - protein, 13 aa, Borrelia
SLNVFADSNNANI

SEQ ID NO: 98954 - protein, 13 aa, Borrelia
LNVFADSNNANIL

SEQ ID NO: 98955 - protein, 13 aa, Borrelia
NVFADSNNANILK

SEQ ID NO: 98956 - protein, 13 aa, Borrelia
VFADSNNANILKP

SEQ ID NO: 98957 - protein, 13 aa, Borrelia
FADSNNANILKPQ

SEQ ID NO: 98958 - protein, 13 aa, Borrelia
ADSNNANILKPQS

SEQ ID NO: 98959 - protein, 13 aa, Borrelia
DSNNANILKPQSN

SEQ ID NO: 98960 - protein, 13 aa, Borrelia
SNNANILKPQSNV

SEQ ID NO: 98961 - protein, 13 aa, Borrelia
NNANILKPQSNVL

SEQ ID NO: 98962 - protein, 13 aa, Borrelia
NANILKPQSNVLE

SEQ ID NO: 98963 - protein, 13 aa, Borrelia
ANILKPQSNVLEH

SEQ ID NO: 98964 - protein, 13 aa, Borrelia
NILKPQSNVLEHS

SEQ ID NO: 98965 - protein, 13 aa, Borrelia
ILKPQSNVLEHSD

SEQ ID NO: 98966 - protein, 13 aa, Borrelia
LKPQSNVLEHSDQ

SEQ ID NO: 98967 - protein, 13 aa, Borrelia
KPQSNVLEHSDQK

SEQ ID NO: 98968 - protein, 13 aa, Borrelia
PQSNVLEHSDQKD

SEQ ID NO: 98969 - protein, 13 aa, Borrelia
QSNVLEHSDQKDN

SEQ ID NO: 98970 - protein, 13 aa, Borrelia
SNVLEHSDQKDNK

SEQ ID NO: 98971 - protein, 13 aa, Borrelia
NVLEHSDQKDNKK

SEQ ID NO: 98972 - protein, 13 aa, Borrelia
VLEHSDQKDNKKL

SEQ ID NO: 98973 - protein, 13 aa, Borrelia
LEHSDQKDNKKLD

SEQ ID NO: 98974 - protein, 13 aa, Borrelia
EHSDQKDNKKLDQ

SEQ ID NO: 98975 - protein, 13 aa, Borrelia
HSDQKDNKKLDQK

SEQ ID NO: 98976 - protein, 13 aa, Borrelia
SDQKDNKKLDQKD

SEQ ID NO: 98977 - protein, 13 aa, Borrelia
DQKDNKKLDQKDQ

SEQ ID NO: 98978 - protein, 13 aa, Borrelia
QKDNKKLDQKDQV

SEQ ID NO: 98979 - protein, 13 aa, Borrelia
KDNKKLDQKDQVN

SEQ ID NO: 98980 - protein, 13 aa, Borrelia
DNKKLDQKDQVNQ

SEQ ID NO: 98981 - protein, 13 aa, Borrelia
NKKLDQKDQVNQA

SEQ ID NO: 98982 - protein, 13 aa, Borrelia
KKLDQKDQVNQAL

SEQ ID NO: 98983 - protein, 13 aa, Borrelia
KLDQKDQVNQALD

SEQ ID NO: 98984 - protein, 13 aa, Borrelia
LDQKDQVNQALDT

SEQ ID NO: 98985 - protein, 13 aa, Borrelia
DQKDQVNQALDTI

SEQ ID NO: 98986 - protein, 13 aa, Borrelia
QKDQVNQALDTIN

SEQ ID NO: 98987 - protein, 13 aa, Borrelia
KDQVNQALDTINK

SEQ ID NO: 98988 - protein, 13 aa, Borrelia
DQVNQALDTINKV

SEQ ID NO: 98989 - protein, 13 aa, Borrelia
QVNQALDTINKVT

SEQ ID NO: 98990 - protein, 13 aa, Borrelia
VNQALDTINKVTE

SEQ ID NO: 98991 - protein, 13 aa, Borrelia
NQALDTINKVTED

SEQ ID NO: 98992 - protein, 13 aa, Borrelia
QALDTINKVTEDV

SEQ ID NO: 98993 - protein, 13 aa, Borrelia
ALDTINKVTEDVS

SEQ ID NO: 98994 - protein, 13 aa, Borrelia
LDTINKVTEDVSS

SEQ ID NO: 98995 - protein, 13 aa, Borrelia
DTINKVTEDVSSK

SEQ ID NO: 98996 - protein, 13 aa, Borrelia
TINKVTEDVSSKL

SEQ ID NO: 98997 - protein, 13 aa, Borrelia
INKVTEDVSSKLE

SEQ ID NO: 98998 - protein, 13 aa, Borrelia
NKVTEDVSSKLEG

SEQ ID NO: 98999 - protein, 13 aa, Borrelia
KVTEDVSSKLEGV

SEQ ID NO: 99000 - protein, 13 aa, Borrelia
VTEDVSSKLEGVR

SEQ ID NO: 99001 - protein, 13 aa, Borrelia
TEDVSSKLEGVRE

SEQ ID NO: 99002 - protein, 13 aa, Borrelia
EDVSSKLEGVRES

SEQ ID NO: 99003 - protein, 13 aa, Borrelia
DVSSKLEGVRESS

SEQ ID NO: 99004 - protein, 13 aa, Borrelia
VSSKLEGVRESSL

SEQ ID NO: 99005 - protein, 13 aa, Borrelia
SSKLEGVRESSLE

SEQ ID NO: 99006 - protein, 13 aa, Borrelia
SKLEGVRESSLEL

SEQ ID NO: 99007 - protein, 13 aa, Borrelia
KLEGVRESSLELV

SEQ ID NO: 99008 - protein, 13 aa, Borrelia
LEGVRESSLELVE

SEQ ID NO: 99009 - protein, 13 aa, Borrelia
EGVRESSLELVES

SEQ ID NO: 99010 - protein, 13 aa, Borrelia
GVRESSLELVESN

SEQ ID NO: 99011 - protein, 13 aa, Borrelia
VRESSLELVESND

SEQ ID NO: 99012 - protein, 13 aa, Borrelia
RESSLELVESNDA

SEQ ID NO: 99013 - protein, 13 aa, Borrelia
ESSLELVESNDAG

SEQ ID NO: 99014 - protein, 13 aa, Borrelia
SSLELVESNDAGV

SEQ ID NO: 99015 - protein, 13 aa, Borrelia
SLELVESNDAGVV

SEQ ID NO: 99016 - protein, 13 aa, Borrelia
LELVESNDAGVVK

SEQ ID NO: 99017 - protein, 13 aa, Borrelia
ELVESNDAGVVKK

SEQ ID NO: 99018 - protein, 13 aa, Borrelia
LVESNDAGVVKKF

SEQ ID NO: 99019 - protein, 13 aa, Borrelia
VESNDAGVVKKFV

SEQ ID NO: 99020 - protein, 13 aa, Borrelia
ESNDAGVVKKFVG

SEQ ID NO: 99021 - protein, 13 aa, Borrelia
SNDAGVVKKFVGS

SEQ ID NO: 99022 - protein, 13 aa, Borrelia
NDAGVVKKFVGSM

SEQ ID NO: 99023 - protein, 13 aa, Borrelia
DAGVVKKFVGSMS

SEQ ID NO: 99024 - protein, 13 aa, Borrelia
AGVVKKFVGSMSL

SEQ ID NO: 99025 - protein, 13 aa, Borrelia
GVVKKFVGSMSLM

SEQ ID NO: 99026 - protein, 13 aa, Borrelia
VVKKFVGSMSLMS

SEQ ID NO: 99027 - protein, 13 aa, Borrelia
VKKFVGSMSLMSD

SEQ ID NO: 99028 - protein, 13 aa, Borrelia
KKFVGSMSLMSDV

SEQ ID NO: 99029 - protein, 13 aa, Borrelia
KFVGSMSLMSDVA

SEQ ID NO: 99030 - protein, 13 aa, Borrelia
FVGSMSLMSDVAK

SEQ ID NO: 99031 - protein, 13 aa, Borrelia
VGSMSLMSDVAKG

SEQ ID NO: 99032 - protein, 13 aa, Borrelia
GSMSLMSDVAKGT

SEQ ID NO: 99033 - protein, 13 aa, Borrelia
SMSLMSDVAKGTV

SEQ ID NO: 99034 - protein, 13 aa, Borrelia
MSLMSDVAKGTVV

SEQ ID NO: 99035 - protein, 13 aa, Borrelia
SLMSDVAKGTVVA

SEQ ID NO: 99036 - protein, 13 aa, Borrelia
LMSDVAKGTVVAS

SEQ ID NO: 99037 - protein, 13 aa, Borrelia
MSDVAKGTVVASQ

SEQ ID NO: 99038 - protein, 13 aa, Borrelia
SDVAKGTVVASQE

SEQ ID NO: 99039 - protein, 13 aa, Borrelia
DVAKGTVVASQEA

SEQ ID NO: 99040 - protein, 13 aa, Borrelia
VAKGTVVASQEAT

SEQ ID NO: 99041 - protein, 13 aa, Borrelia
AKGTVVASQEATI

SEQ ID NO: 99042 - protein, 13 aa, Borrelia
KGTVVASQEATIV

SEQ ID NO: 99043 - protein, 13 aa, Borrelia
GTVVASQEATIVA

SEQ ID NO: 99044 - protein, 13 aa, Borrelia
TVVASQEATIVAK

SEQ ID NO: 99045 - protein, 13 aa, Borrelia
VVASQEATIVAKC

SEQ ID NO: 99046 - protein, 13 aa, Borrelia
VASQEATIVAKCS

SEQ ID NO: 99047 - protein, 13 aa, Borrelia
ASQEATIVAKCSG

SEQ ID NO: 99048 - protein, 13 aa, Borrelia
SQEATIVAKCSGM

SEQ ID NO: 99049 - protein, 13 aa, Borrelia
QEATIVAKCSGMV

SEQ ID NO: 99050 - protein, 13 aa, Borrelia
EATIVAKCSGMVA

SEQ ID NO: 99051 - protein, 13 aa, Borrelia
ATIVAKCSGMVAE

SEQ ID NO: 99052 - protein, 13 aa, Borrelia
TIVAKCSGMVAEG

SEQ ID NO: 99053 - protein, 13 aa, Borrelia
IVAKCSGMVAEGA

SEQ ID NO: 99054 - protein, 13 aa, Borrelia
VAKCSGMVAEGAN

SEQ ID NO: 99055 - protein, 13 aa, Borrelia
AKCSGMVAEGANK

SEQ ID NO: 99056 - protein, 13 aa, Borrelia
KCSGMVAEGANKV

SEQ ID NO: 99057 - protein, 13 aa, Borrelia
CSGMVAEGANKVV

SEQ ID NO: 99058 - protein, 13 aa, Borrelia
SGMVAEGANKVVE

SEQ ID NO: 99059 - protein, 13 aa, Borrelia
GMVAEGANKVVEM

SEQ ID NO: 99060 - protein, 13 aa, Borrelia
MVAEGANKVVEMS

SEQ ID NO: 99061 - protein, 13 aa, Borrelia
VAEGANKVVEMSK

SEQ ID NO: 99062 - protein, 13 aa, Borrelia
AEGANKVVEMSKK

SEQ ID NO: 99063 - protein, 13 aa, Borrelia
EGANKVVEMSKKA

SEQ ID NO: 99064 - protein, 13 aa, Borrelia
GANKVVEMSKKAV

SEQ ID NO: 99065 - protein, 13 aa, Borrelia
ANKVVEMSKKAVQ

SEQ ID NO: 99066 - protein, 13 aa, Borrelia
NKVVEMSKKAVQE

SEQ ID NO: 99067 - protein, 13 aa, Borrelia
KVVEMSKKAVQET

SEQ ID NO: 99068 - protein, 13 aa, Borrelia
VVEMSKKAVQETQ

SEQ ID NO: 99069 - protein, 13 aa, Borrelia
VEMSKKAVQETQK

SEQ ID NO: 99070 - protein, 13 aa, Borrelia
EMSKKAVQETQKA

SEQ ID NO: 99071 - protein, 13 aa, Borrelia
MSKKAVQETQKAV

SEQ ID NO: 99072 - protein, 13 aa, Borrelia
SKKAVQETQKAVS

SEQ ID NO: 99073 - protein, 13 aa, Borrelia
KKAVQETQKAVSV

SEQ ID NO: 99074 - protein, 13 aa, Borrelia
KAVQETQKAVSVA

SEQ ID NO: 99075 - protein, 13 aa, Borrelia
AVQETQKAVSVAG

SEQ ID NO: 99076 - protein, 13 aa, Borrelia
VQETQKAVSVAGE

SEQ ID NO: 99077 - protein, 13 aa, Borrelia
QETQKAVSVAGEA

SEQ ID NO: 99078 - protein, 13 aa, Borrelia
ETQKAVSVAGEAT

SEQ ID NO: 99079 - protein, 13 aa, Borrelia
TQKAVSVAGEATF

SEQ ID NO: 99080 - protein, 13 aa, Borrelia
QKAVSVAGEATFL

SEQ ID NO: 99081 - protein, 13 aa, Borrelia
KAVSVAGEATFLI

SEQ ID NO: 99082 - protein, 13 aa, Borrelia
AVSVAGEATFLIE

SEQ ID NO: 99083 - protein, 13 aa, Borrelia
VSVAGEATFLIEK

SEQ ID NO: 99084 - protein, 13 aa, Borrelia
SVAGEATFLIEKQ

SEQ ID NO: 99085 - protein, 13 aa, Borrelia
VAGEATFLIEKQI

SEQ ID NO: 99086 - protein, 13 aa, Borrelia
AGEATFLIEKQIM

SEQ ID NO: 99087 - protein, 13 aa, Borrelia
GEATFLIEKQIML

SEQ ID NO: 99088 - protein, 13 aa, Borrelia
EATFLIEKQIMLN

SEQ ID NO: 99089 - protein, 13 aa, Borrelia
ATFLIEKQIMLNK

SEQ ID NO: 99090 - protein, 13 aa, Borrelia
TFLIEKQIMLNKS

SEQ ID NO: 99091 - protein, 13 aa, Borrelia
FLIEKQIMLNKSP

SEQ ID NO: 99092 - protein, 13 aa, Borrelia
LIEKQIMLNKSPN

SEQ ID NO: 99093 - protein, 13 aa, Borrelia
IEKQIMLNKSPNN

SEQ ID NO: 99094 - protein, 13 aa, Borrelia
EKQIMLNKSPNNK

SEQ ID NO: 99095 - protein, 13 aa, Borrelia
KQIMLNKSPNNKE

SEQ ID NO: 99096 - protein, 13 aa, Borrelia
QIMLNKSPNNKEL

SEQ ID NO: 99097 - protein, 13 aa, Borrelia
IMLNKSPNNKELE

SEQ ID NO: 99098 - protein, 13 aa, Borrelia
MLNKSPNNKELEL

SEQ ID NO: 99099 - protein, 13 aa, Borrelia
LNKSPNNKELELT

SEQ ID NO: 99100 - protein, 13 aa, Borrelia
NKSPNNKELELTK

SEQ ID NO: 99101 - protein, 13 aa, Borrelia
KSPNNKELELTKE

SEQ ID NO: 99102 - protein, 13 aa, Borrelia
SPNNKELELTKEE

SEQ ID NO: 99103 - protein, 13 aa, Borrelia
PNNKELELTKEEF

SEQ ID NO: 99104 - protein, 13 aa, Borrelia
NNKELELTKEEFA

SEQ ID NO: 99105 - protein, 13 aa, Borrelia
NKELELTKEEFAK

SEQ ID NO: 99106 - protein, 13 aa, Borrelia
KELELTKEEFAKV

SEQ ID NO: 99107 - protein, 13 aa, Borrelia
ELELTKEEFAKVD

SEQ ID NO: 99108 - protein, 13 aa, Borrelia
LELTKEEFAKVDE

SEQ ID NO: 99109 - protein, 13 aa, Borrelia
ELTKEEFAKVDEV

SEQ ID NO: 99110 - protein, 13 aa, Borrelia
LTKEEFAKVDEVK

SEQ ID NO: 99111 - protein, 13 aa, Borrelia
TKEEFAKVDEVKE

SEQ ID NO: 99112 - protein, 13 aa, Borrelia
KEEFAKVDEVKET

SEQ ID NO: 99113 - protein, 13 aa, Borrelia
EEFAKVDEVKETL

SEQ ID NO: 99114 - protein, 13 aa, Borrelia
EFAKVDEVKETLM

SEQ ID NO: 99115 - protein, 13 aa, Borrelia
FAKVDEVKETLMA

SEQ ID NO: 99116 - protein, 13 aa, Borrelia
AKVDEVKETLMAS

SEQ ID NO: 99117 - protein, 13 aa, Borrelia
KVDEVKETLMASE

SEQ ID NO: 99118 - protein, 13 aa, Borrelia
VDEVKETLMASER

SEQ ID NO: 99119 - protein, 13 aa, Borrelia
DEVKETLMASERA

SEQ ID NO: 99120 - protein, 13 aa, Borrelia
EVKETLMASERAL

SEQ ID NO: 99121 - protein, 13 aa, Borrelia
VKETLMASERALD

SEQ ID NO: 99122 - protein, 13 aa, Borrelia
KETLMASERALDE

SEQ ID NO: 99123 - protein, 13 aa, Borrelia
ETLMASERALDET

SEQ ID NO: 99124 - protein, 13 aa, Borrelia
TLMASERALDETV

SEQ ID NO: 99125 - protein, 13 aa, Borrelia
LMASERALDETVQ

SEQ ID NO: 99126 - protein, 13 aa, Borrelia
MASERALDETVQE

SEQ ID NO: 99127 - protein, 13 aa, Borrelia
ASERALDETVQEA

SEQ ID NO: 99128 - protein, 13 aa, Borrelia
SERALDETVQEAQ

SEQ ID NO: 99129 - protein, 13 aa, Borrelia
ERALDETVQEAQK

SEQ ID NO: 99130 - protein, 13 aa, Borrelia
RALDETVQEAQKV

SEQ ID NO: 99131 - protein, 13 aa, Borrelia
ALDETVQEAQKVL

SEQ ID NO: 99132 - protein, 13 aa, Borrelia
LDETVQEAQKVLN

SEQ ID NO: 99133 - protein, 13 aa, Borrelia
DETVQEAQKVLNM

SEQ ID NO: 99134 - protein, 13 aa, Borrelia
ETVQEAQKVLNMV

SEQ ID NO: 99135 - protein, 13 aa, Borrelia
TVQEAQKVLNMVN

SEQ ID NO: 99136 - protein, 13 aa, Borrelia
VQEAQKVLNMVNG

SEQ ID NO: 99137 - protein, 13 aa, Borrelia
QEAQKVLNMVNGL

SEQ ID NO: 99138 - protein, 13 aa, Borrelia
EAQKVLNMVNGLN

SEQ ID NO: 99139 - protein, 13 aa, Borrelia
AQKVLNMVNGLNP

SEQ ID NO: 99140 - protein, 13 aa, Borrelia
QKVLNMVNGLNPS

SEQ ID NO: 99141 - protein, 13 aa, Borrelia
KVLNMVNGLNPSN

SEQ ID NO: 99142 - protein, 13 aa, Borrelia
VLNMVNGLNPSNK

SEQ ID NO: 99143 - protein, 13 aa, Borrelia
LNMVNGLNPSNKD

SEQ ID NO: 99144 - protein, 13 aa, Borrelia
NMVNGLNPSNKDQ

SEQ ID NO: 99145 - protein, 13 aa, Borrelia
MVNGLNPSNKDQV

SEQ ID NO: 99146 - protein, 13 aa, Borrelia
VNGLNPSNKDQVL

SEQ ID NO: 99147 - protein, 13 aa, Borrelia
NGLNPSNKDQVLA

SEQ ID NO: 99148 - protein, 13 aa, Borrelia
GLNPSNKDQVLAK

SEQ ID NO: 99149 - protein, 13 aa, Borrelia
LNPSNKDQVLAKK

SEQ ID NO: 99150 - protein, 13 aa, Borrelia
NPSNKDQVLAKKD

SEQ ID NO: 99151 - protein, 13 aa, Borrelia
PSNKDQVLAKKDV

SEQ ID NO: 99152 - protein, 13 aa, Borrelia
SNKDQVLAKKDVR

SEQ ID NO: 99153 - protein, 13 aa, Borrelia
NKDQVLAKKDVRK

SEQ ID NO: 99154 - protein, 13 aa, Borrelia
KDQVLAKKDVRKA

SEQ ID NO: 99155 - protein, 13 aa, Borrelia
DQVLAKKDVRKAI

SEQ ID NO: 99156 - protein, 13 aa, Borrelia
QVLAKKDVRKAIS

SEQ ID NO: 99157 - protein, 13 aa, Borrelia
VLAKKDVRKAISN

SEQ ID NO: 99158 - protein, 13 aa, Borrelia
LAKKDVRKAISNV

SEQ ID NO: 99159 - protein, 13 aa, Borrelia
AKKDVRKAISNVV

SEQ ID NO: 99160 - protein, 13 aa, Borrelia
KKDVRKAISNVVK

SEQ ID NO: 99161 - protein, 13 aa, Borrelia
KDVRKAISNVVKV

SEQ ID NO: 99162 - protein, 13 aa, Borrelia
DVRKAISNVVKVA

SEQ ID NO: 99163 - protein, 13 aa, Borrelia
VRKAISNVVKVAQ

SEQ ID NO: 99164 - protein, 13 aa, Borrelia
RKAISNVVKVAQG

SEQ ID NO: 99165 - protein, 13 aa, Borrelia
KAISNVVKVAQGA

SEQ ID NO: 99166 - protein, 13 aa, Borrelia
AISNVVKVAQGAR

SEQ ID NO: 99167 - protein, 13 aa, Borrelia
ISNVVKVAQGARD

SEQ ID NO: 99168 - protein, 13 aa, Borrelia
SNVVKVAQGARDL

SEQ ID NO: 99169 - protein, 13 aa, Borrelia
NVVKVAQGARDLT

SEQ ID NO: 99170 - protein, 13 aa, Borrelia
VVKVAQGARDLTK

SEQ ID NO: 99171 - protein, 13 aa, Borrelia
VKVAQGARDLTKV

SEQ ID NO: 99172 - protein, 13 aa, Borrelia
KVAQGARDLTKVM

SEQ ID NO: 99173 - protein, 13 aa, Borrelia
VAQGARDLTKVMA

SEQ ID NO: 99174 - protein, 13 aa, Borrelia
AQGARDLTKVMAI

SEQ ID NO: 99175 - protein, 13 aa, Borrelia
QGARDLTKVMAIS

SEQ ID NO: 99176 - protein, 13 aa, Borrelia
GARDLTKVMAISL

SEQ ID NO: 99177 - protein, 13 aa, Borrelia
ARDLTKVMAISLY

SEQ ID NO: 99178 - protein, 13 aa, Borrelia
RDLTKVMAISLYM

SEQ ID NO: 99179 - protein, 13 aa, Borrelia
DLTKVMAISLYMR

SEQ ID NO: 99180 - protein, 14 aa, Borrelia
MTKIFSNLIINGLL

SEQ ID NO: 99181 - protein, 14 aa, Borrelia
TKIFSNLIINGLLF

SEQ ID NO: 99182 - protein, 14 aa, Borrelia
KIFSNLIINGLLFG

SEQ ID NO: 99183 - protein, 14 aa, Borrelia
IFSNLIINGLLFGF

SEQ ID NO: 99184 - protein, 14 aa, Borrelia
FSNLIINGLLFGFV

SEQ ID NO: 99185 - protein, 14 aa, Borrelia
SNLIINGLLFGFVS

SEQ ID NO: 99186 - protein, 14 aa, Borrelia
NLIINGLLFGFVSL

SEQ ID NO: 99187 - protein, 14 aa, Borrelia
LIINGLLFGFVSLN

SEQ ID NO: 99188 - protein, 14 aa, Borrelia
IINGLLFGFVSLNV

SEQ ID NO: 99189 - protein, 14 aa, Borrelia
INGLLFGFVSLNVF

SEQ ID NO: 99190 - protein, 14 aa, Borrelia
NGLLFGFVSLNVFA

SEQ ID NO: 99191 - protein, 14 aa, Borrelia
GLLFGFVSLNVFAD

SEQ ID NO: 99192 - protein, 14 aa, Borrelia
LLFGFVSLNVFADS

SEQ ID NO: 99193 - protein, 14 aa, Borrelia
LFGFVSLNVFADSN

SEQ ID NO: 99194 - protein, 14 aa, Borrelia
FGFVSLNVFADSNN

SEQ ID NO: 99195 - protein, 14 aa, Borrelia
GFVSLNVFADSNNA

SEQ ID NO: 99196 - protein, 14 aa, Borrelia
FVSLNVFADSNNAN

SEQ ID NO: 99197 - protein, 14 aa, Borrelia
VSLNVFADSNNANI

SEQ ID NO: 99198 - protein, 14 aa, Borrelia
SLNVFADSNNANIL

SEQ ID NO: 99199 - protein, 14 aa, Borrelia
LNVFADSNNANILK

SEQ ID NO: 99200 - protein, 14 aa, Borrelia
NVFADSNNANILKP

SEQ ID NO: 99201 - protein, 14 aa, Borrelia
VFADSNNANILKPQ

SEQ ID NO: 99202 - protein, 14 aa, Borrelia
FADSNNANILKPQS

SEQ ID NO: 99203 - protein, 14 aa, Borrelia
ADSNNANILKPQSN

SEQ ID NO: 99204 - protein, 14 aa, Borrelia
DSNNANILKPQSNV

SEQ ID NO: 99205 - protein, 14 aa, Borrelia
SNNANILKPQSNVL

SEQ ID NO: 99206 - protein, 14 aa, Borrelia
NNANILKPQSNVLE

SEQ ID NO: 99207 - protein, 14 aa, Borrelia
NANILKPQSNVLEH

SEQ ID NO: 99208 - protein, 14 aa, Borrelia
ANILKPQSNVLEHS

SEQ ID NO: 99209 - protein, 14 aa, Borrelia
NILKPQSNVLEHSD

SEQ ID NO: 99210 - protein, 14 aa, Borrelia
ILKPQSNVLEHSDQ

SEQ ID NO: 99211 - protein, 14 aa, Borrelia
LKPQSNVLEHSDQK

SEQ ID NO: 99212 - protein, 14 aa, Borrelia
KPQSNVLEHSDQKD

SEQ ID NO: 99213 - protein, 14 aa, Borrelia
PQSNVLEHSDQKDN

SEQ ID NO: 99214 - protein, 14 aa, Borrelia
QSNVLEHSDQKDNK

SEQ ID NO: 99215 - protein, 14 aa, Borrelia
SNVLEHSDQKDNKK

SEQ ID NO: 99216 - protein, 14 aa, Borrelia
NVLEHSDQKDNKKL

SEQ ID NO: 99217 - protein, 14 aa, Borrelia
VLEHSDQKDNKKLD

SEQ ID NO: 99218 - protein, 14 aa, Borrelia
LEHSDQKDNKKLDQ

SEQ ID NO: 99219 - protein, 14 aa, Borrelia
EHSDQKDNKKLDQK

SEQ ID NO: 99220 - protein, 14 aa, Borrelia
HSDQKDNKKLDQKD

SEQ ID NO: 99221 - protein, 14 aa, Borrelia
SDQKDNKKLDQKDQ

SEQ ID NO: 99222 - protein, 14 aa, Borrelia
DQKDNKKLDQKDQV

SEQ ID NO: 99223 - protein, 14 aa, Borrelia
QKDNKKLDQKDQVN

SEQ ID NO: 99224 - protein, 14 aa, Borrelia
KDNKKLDQKDQVNQ

SEQ ID NO: 99225 - protein, 14 aa, Borrelia
DNKKLDQKDQVNQA

SEQ ID NO: 99226 - protein, 14 aa, Borrelia
NKKLDQKDQVNQAL

SEQ ID NO: 99227 - protein, 14 aa, Borrelia
KKLDQKDQVNQALD

SEQ ID NO: 99228 - protein, 14 aa, Borrelia
KLDQKDQVNQALDT

SEQ ID NO: 99229 - protein, 14 aa, Borrelia
LDQKDQVNQALDTI

SEQ ID NO: 99230 - protein, 14 aa, Borrelia
DQKDQVNQALDTIN

SEQ ID NO: 99231 - protein, 14 aa, Borrelia
QKDQVNQALDTINK

SEQ ID NO: 99232 - protein, 14 aa, Borrelia
KDQVNQALDTINKV

SEQ ID NO: 99233 - protein, 14 aa, Borrelia
DQVNQALDTINKVT

SEQ ID NO: 99234 - protein, 14 aa, Borrelia
QVNQALDTINKVTE

SEQ ID NO: 99235 - protein, 14 aa, Borrelia
VNQALDTINKVTED

SEQ ID NO: 99236 - protein, 14 aa, Borrelia
NQALDTINKVTEDV

SEQ ID NO: 99237 - protein, 14 aa, Borrelia
QALDTINKVTEDVS

SEQ ID NO: 99238 - protein, 14 aa, Borrelia
ALDTINKVTEDVSS

SEQ ID NO: 99239 - protein, 14 aa, Borrelia
LDTINKVTEDVSSK

SEQ ID NO: 99240 - protein, 14 aa, Borrelia
DTINKVTEDVSSKL

SEQ ID NO: 99241 - protein, 14 aa, Borrelia
TINKVTEDVSSKLE

SEQ ID NO: 99242 - protein, 14 aa, Borrelia
INKVTEDVSSKLEG

SEQ ID NO: 99243 - protein, 14 aa, Borrelia
NKVTEDVSSKLEGV

SEQ ID NO: 99244 - protein, 14 aa, Borrelia
KVTEDVSSKLEGVR

SEQ ID NO: 99245 - protein, 14 aa, Borrelia
VTEDVSSKLEGVRE

SEQ ID NO: 99246 - protein, 14 aa, Borrelia
TEDVSSKLEGVRES

SEQ ID NO: 99247 - protein, 14 aa, Borrelia
EDVSSKLEGVRESS

SEQ ID NO: 99248 - protein, 14 aa, Borrelia
DVSSKLEGVRESSL

SEQ ID NO: 99249 - protein, 14 aa, Borrelia
VSSKLEGVRESSLE

SEQ ID NO: 99250 - protein, 14 aa, Borrelia
SSKLEGVRESSLEL

SEQ ID NO: 99251 - protein, 14 aa, Borrelia
SKLEGVRESSLELV

SEQ ID NO: 99252 - protein, 14 aa, Borrelia
KLEGVRESSLELVE

SEQ ID NO: 99253 - protein, 14 aa, Borrelia
LEGVRESSLELVES

SEQ ID NO: 99254 - protein, 14 aa, Borrelia
EGVRESSLELVESN

SEQ ID NO: 99255 - protein, 14 aa, Borrelia
GVRESSLELVESND

SEQ ID NO: 99256 - protein, 14 aa, Borrelia
VRESSLELVESNDA

SEQ ID NO: 99257 - protein, 14 aa, Borrelia
RESSLELVESNDAG

SEQ ID NO: 99258 - protein, 14 aa, Borrelia
ESSLELVESNDAGV

SEQ ID NO: 99259 - protein, 14 aa, Borrelia
SSLELVESNDAGVV

SEQ ID NO: 99260 - protein, 14 aa, Borrelia
SLELVESNDAGVVK

SEQ ID NO: 99261 - protein, 14 aa, Borrelia
LELVESNDAGVVKK

SEQ ID NO: 99262 - protein, 14 aa, Borrelia
ELVESNDAGVVKKF

SEQ ID NO: 99263 - protein, 14 aa, Borrelia
LVESNDAGVVKKFV

SEQ ID NO: 99264 - protein, 14 aa, Borrelia
VESNDAGVVKKFVG

SEQ ID NO: 99265 - protein, 14 aa, Borrelia
ESNDAGVVKKFVGS

SEQ ID NO: 99266 - protein, 14 aa, Borrelia
SNDAGVVKKFVGSM

SEQ ID NO: 99267 - protein, 14 aa, Borrelia
NDAGVVKKFVGSMS

SEQ ID NO: 99268 - protein, 14 aa, Borrelia
DAGVVKKFVGSMSL

SEQ ID NO: 99269 - protein, 14 aa, Borrelia
AGVVKKFVGSMSLM

SEQ ID NO: 99270 - protein, 14 aa, Borrelia
GVVKKFVGSMSLMS

SEQ ID NO: 99271 - protein, 14 aa, Borrelia
VVKKFVGSMSLMSD

SEQ ID NO: 99272 - protein, 14 aa, Borrelia
VKKFVGSMSLMSDV

SEQ ID NO: 99273 - protein, 14 aa, Borrelia
KKFVGSMSLMSDVA

SEQ ID NO: 99274 - protein, 14 aa, Borrelia
KFVGSMSLMSDVAK

SEQ ID NO: 99275 - protein, 14 aa, Borrelia
FVGSMSLMSDVAKG

SEQ ID NO: 99276 - protein, 14 aa, Borrelia
VGSMSLMSDVAKGT

SEQ ID NO: 99277 - protein, 14 aa, Borrelia
GSMSLMSDVAKGTV

SEQ ID NO: 99278 - protein, 14 aa, Borrelia
SMSLMSDVAKGTVV

SEQ ID NO: 99279 - protein, 14 aa, Borrelia
MSLMSDVAKGTVVA

SEQ ID NO: 99280 - protein, 14 aa, Borrelia
SLMSDVAKGTVVAS

SEQ ID NO: 99281 - protein, 14 aa, Borrelia
LMSDVAKGTVVASQ

SEQ ID NO: 99282 - protein, 14 aa, Borrelia
MSDVAKGTVVASQE

SEQ ID NO: 99283 - protein, 14 aa, Borrelia
SDVAKGTVVASQEA

SEQ ID NO: 99284 - protein, 14 aa, Borrelia
DVAKGTVVASQEAT

SEQ ID NO: 99285 - protein, 14 aa, Borrelia
VAKGTVVASQEATI

SEQ ID NO: 99286 - protein, 14 aa, Borrelia
AKGTVVASQEATIV

SEQ ID NO: 99287 - protein, 14 aa, Borrelia
KGTVVASQEATIVA

SEQ ID NO: 99288 - protein, 14 aa, Borrelia
GTVVASQEATIVAK

SEQ ID NO: 99289 - protein, 14 aa, Borrelia
TVVASQEATIVAKC

SEQ ID NO: 99290 - protein, 14 aa, Borrelia
VVASQEATIVAKCS

SEQ ID NO: 99291 - protein, 14 aa, Borrelia
VASQEATIVAKCSG

SEQ ID NO: 99292 - protein, 14 aa, Borrelia
ASQEATIVAKCSGM

SEQ ID NO: 99293 - protein, 14 aa, Borrelia
SQEATIVAKCSGMV

SEQ ID NO: 99294 - protein, 14 aa, Borrelia
QEATIVAKCSGMVA

SEQ ID NO: 99295 - protein, 14 aa, Borrelia
EATIVAKCSGMVAE

SEQ ID NO: 99296 - protein, 14 aa, Borrelia
ATIVAKCSGMVAEG

SEQ ID NO: 99297 - protein, 14 aa, Borrelia
TIVAKCSGMVAEGA

SEQ ID NO: 99298 - protein, 14 aa, Borrelia
IVAKCSGMVAEGAN

SEQ ID NO: 99299 - protein, 14 aa, Borrelia
VAKCSGMVAEGANK

SEQ ID NO: 99300 - protein, 14 aa, Borrelia
AKCSGMVAEGANKV

SEQ ID NO: 99301 - protein, 14 aa, Borrelia
KCSGMVAEGANKVV

SEQ ID NO: 99302 - protein, 14 aa, Borrelia
CSGMVAEGANKVVE

SEQ ID NO: 99303 - protein, 14 aa, Borrelia
SGMVAEGANKVVEM

SEQ ID NO: 99304 - protein, 14 aa, Borrelia
GMVAEGANKVVEMS

SEQ ID NO: 99305 - protein, 14 aa, Borrelia
MVAEGANKVVEMSK

SEQ ID NO: 99306 - protein, 14 aa, Borrelia
VAEGANKVVEMSKK

SEQ ID NO: 99307 - protein, 14 aa, Borrelia
AEGANKVVEMSKKA

SEQ ID NO: 99308 - protein, 14 aa, Borrelia
EGANKVVEMSKKAV

SEQ ID NO: 99309 - protein, 14 aa, Borrelia
GANKVVEMSKKAVQ

SEQ ID NO: 99310 - protein, 14 aa, Borrelia
ANKVVEMSKKAVQE

SEQ ID NO: 99311 - protein, 14 aa, Borrelia
NKVVEMSKKAVQET

SEQ ID NO: 99312 - protein, 14 aa, Borrelia
KVVEMSKKAVQETQ

SEQ ID NO: 99313 - protein, 14 aa, Borrelia
VVEMSKKAVQETQK

SEQ ID NO: 99314 - protein, 14 aa, Borrelia
VEMSKKAVQETQKA

SEQ ID NO: 99315 - protein, 14 aa, Borrelia
EMSKKAVQETQKAV

SEQ ID NO: 99316 - protein, 14 aa, Borrelia
MSKKAVQETQKAVS

SEQ ID NO: 99317 - protein, 14 aa, Borrelia
SKKAVQETQKAVSV

SEQ ID NO: 99318 - protein, 14 aa, Borrelia
KKAVQETQKAVSVA

SEQ ID NO: 99319 - protein, 14 aa, Borrelia
KAVQETQKAVSVAG

SEQ ID NO: 99320 - protein, 14 aa, Borrelia
AVQETQKAVSVAGE

SEQ ID NO: 99321 - protein, 14 aa, Borrelia
VQETQKAVSVAGEA

SEQ ID NO: 99322 - protein, 14 aa, Borrelia
QETQKAVSVAGEAT

SEQ ID NO: 99323 - protein, 14 aa, Borrelia
ETQKAVSVAGEATF

SEQ ID NO: 99324 - protein, 14 aa, Borrelia
TQKAVSVAGEATFL

SEQ ID NO: 99325 - protein, 14 aa, Borrelia
QKAVSVAGEATFLI

SEQ ID NO: 99326 - protein, 14 aa, Borrelia
KAVSVAGEATFLIE

SEQ ID NO: 99327 - protein, 14 aa, Borrelia
AVSVAGEATFLIEK

SEQ ID NO: 99328 - protein, 14 aa, Borrelia
VSVAGEATFLIEKQ

SEQ ID NO: 99329 - protein, 14 aa, Borrelia
SVAGEATFLIEKQI

SEQ ID NO: 99330 - protein, 14 aa, Borrelia
VAGEATFLIEKQIM

SEQ ID NO: 99331 - protein, 14 aa, Borrelia
AGEATFLIEKQIML

SEQ ID NO: 99332 - protein, 14 aa, Borrelia
GEATFLIEKQIMLN

SEQ ID NO: 99333 - protein, 14 aa, Borrelia
EATFLIEKQIMLNK

SEQ ID NO: 99334 - protein, 14 aa, Borrelia
ATFLIEKQIMLNKS

SEQ ID NO: 99335 - protein, 14 aa, Borrelia
TFLIEKQIMLNKSP

SEQ ID NO: 99336 - protein, 14 aa, Borrelia
FLIEKQIMLNKSPN

SEQ ID NO: 99337 - protein, 14 aa, Borrelia
LIEKQIMLNKSPNN

SEQ ID NO: 99338 - protein, 14 aa, Borrelia
IEKQIMLNKSPNNK

SEQ ID NO: 99339 - protein, 14 aa, Borrelia
EKQIMLNKSPNNKE

SEQ ID NO: 99340 - protein, 14 aa, Borrelia
KQIMLNKSPNNKEL

SEQ ID NO: 99341 - protein, 14 aa, Borrelia
QIMLNKSPNNKELE

SEQ ID NO: 99342 - protein, 14 aa, Borrelia
IMLNKSPNNKELEL

SEQ ID NO: 99343 - protein, 14 aa, Borrelia
MLNKSPNNKELELT

SEQ ID NO: 99344 - protein, 14 aa, Borrelia
LNKSPNNKELELTK

SEQ ID NO: 99345 - protein, 14 aa, Borrelia
NKSPNNKELELTKE

SEQ ID NO: 99346 - protein, 14 aa, Borrelia
KSPNNKELELTKEE

SEQ ID NO: 99347 - protein, 14 aa, Borrelia
SPNNKELELTKEEF

SEQ ID NO: 99348 - protein, 14 aa, Borrelia
PNNKELELTKEEFA

SEQ ID NO: 99349 - protein, 14 aa, Borrelia
NNKELELTKEEFAK

SEQ ID NO: 99350 - protein, 14 aa, Borrelia
NKELELTKEEFAKV

SEQ ID NO: 99351 - protein, 14 aa, Borrelia
KELELTKEEFAKVD

SEQ ID NO: 99352 - protein, 14 aa, Borrelia
ELELTKEEFAKVDE

SEQ ID NO: 99353 - protein, 14 aa, Borrelia
LELTKEEFAKVDEV

SEQ ID NO: 99354 - protein, 14 aa, Borrelia
ELTKEEFAKVDEVK

SEQ ID NO: 99355 - protein, 14 aa, Borrelia
LTKEEFAKVDEVKE

SEQ ID NO: 99356 - protein, 14 aa, Borrelia
TKEEFAKVDEVKET

SEQ ID NO: 99357 - protein, 14 aa, Borrelia
KEEFAKVDEVKETL

SEQ ID NO: 99358 - protein, 14 aa, Borrelia
EEFAKVDEVKETLM

SEQ ID NO: 99359 - protein, 14 aa, Borrelia
EFAKVDEVKETLMA

SEQ ID NO: 99360 - protein, 14 aa, Borrelia
FAKVDEVKETLMAS

SEQ ID NO: 99361 - protein, 14 aa, Borrelia
AKVDEVKETLMASE

SEQ ID NO: 99362 - protein, 14 aa, Borrelia
KVDEVKETLMASER

SEQ ID NO: 99363 - protein, 14 aa, Borrelia
VDEVKETLMASERA

SEQ ID NO: 99364 - protein, 14 aa, Borrelia
DEVKETLMASERAL

SEQ ID NO: 99365 - protein, 14 aa, Borrelia
EVKETLMASERALD

SEQ ID NO: 99366 - protein, 14 aa, Borrelia
VKETLMASERALDE

SEQ ID NO: 99367 - protein, 14 aa, Borrelia
KETLMASERALDET

SEQ ID NO: 99368 - protein, 14 aa, Borrelia
ETLMASERALDETV

SEQ ID NO: 99369 - protein, 14 aa, Borrelia
TLMASERALDETVQ

SEQ ID NO: 99370 - protein, 14 aa, Borrelia
LMASERALDETVQE

SEQ ID NO: 99371 - protein, 14 aa, Borrelia
MASERALDETVQEA

SEQ ID NO: 99372 - protein, 14 aa, Borrelia
ASERALDETVQEAQ

SEQ ID NO: 99373 - protein, 14 aa, Borrelia
SERALDETVQEAQK

SEQ ID NO: 99374 - protein, 14 aa, Borrelia
ERALDETVQEAQKV

SEQ ID NO: 99375 - protein, 14 aa, Borrelia
RALDETVQEAQKVL

SEQ ID NO: 99376 - protein, 14 aa, Borrelia
ALDETVQEAQKVLN

SEQ ID NO: 99377 - protein, 14 aa, Borrelia
LDETVQEAQKVLNM

SEQ ID NO: 99378 - protein, 14 aa, Borrelia
DETVQEAQKVLNMV

SEQ ID NO: 99379 - protein, 14 aa, Borrelia
ETVQEAQKVLNMVN

SEQ ID NO: 99380 - protein, 14 aa, Borrelia
TVQEAQKVLNMVNG

SEQ ID NO: 99381 - protein, 14 aa, Borrelia
VQEAQKVLNMVNGL

SEQ ID NO: 99382 - protein, 14 aa, Borrelia
QEAQKVLNMVNGLN

SEQ ID NO: 99383 - protein, 14 aa, Borrelia
EAQKVLNMVNGLNP

SEQ ID NO: 99384 - protein, 14 aa, Borrelia
AQKVLNMVNGLNPS

SEQ ID NO: 99385 - protein, 14 aa, Borrelia
QKVLNMVNGLNPSN

SEQ ID NO: 99386 - protein, 14 aa, Borrelia
KVLNMVNGLNPSNK

SEQ ID NO: 99387 - protein, 14 aa, Borrelia
VLNMVNGLNPSNKD

SEQ ID NO: 99388 - protein, 14 aa, Borrelia
LNMVNGLNPSNKDQ

SEQ ID NO: 99389 - protein, 14 aa, Borrelia
NMVNGLNPSNKDQV

SEQ ID NO: 99390 - protein, 14 aa, Borrelia
MVNGLNPSNKDQVL

SEQ ID NO: 99391 - protein, 14 aa, Borrelia
VNGLNPSNKDQVLA

SEQ ID NO: 99392 - protein, 14 aa, Borrelia
NGLNPSNKDQVLAK

SEQ ID NO: 99393 - protein, 14 aa, Borrelia
GLNPSNKDQVLAKK

SEQ ID NO: 99394 - protein, 14 aa, Borrelia
LNPSNKDQVLAKKD

SEQ ID NO: 99395 - protein, 14 aa, Borrelia
NPSNKDQVLAKKDV

SEQ ID NO: 99396 - protein, 14 aa, Borrelia
PSNKDQVLAKKDVR

SEQ ID NO: 99397 - protein, 14 aa, Borrelia
SNKDQVLAKKDVRK

SEQ ID NO: 99398 - protein, 14 aa, Borrelia
NKDQVLAKKDVRKA

SEQ ID NO: 99399 - protein, 14 aa, Borrelia
KDQVLAKKDVRKAI

SEQ ID NO: 99400 - protein, 14 aa, Borrelia
DQVLAKKDVRKAIS

SEQ ID NO: 99401 - protein, 14 aa, Borrelia
QVLAKKDVRKAISN

SEQ ID NO: 99402 - protein, 14 aa, Borrelia
VLAKKDVRKAISNV

SEQ ID NO: 99403 - protein, 14 aa, Borrelia
LAKKDVRKAISNVV

SEQ ID NO: 99404 - protein, 14 aa, Borrelia
AKKDVRKAISNVVK

SEQ ID NO: 99405 - protein, 14 aa, Borrelia
KKDVRKAISNVVKV

SEQ ID NO: 99406 - protein, 14 aa, Borrelia
KDVRKAISNVVKVA

SEQ ID NO: 99407 - protein, 14 aa, Borrelia
DVRKAISNVVKVAQ

SEQ ID NO: 99408 - protein, 14 aa, Borrelia
VRKAISNVVKVAQG

SEQ ID NO: 99409 - protein, 14 aa, Borrelia
RKAISNVVKVAQGA

SEQ ID NO: 99410 - protein, 14 aa, Borrelia
KAISNVVKVAQGAR

SEQ ID NO: 99411 - protein, 14 aa, Borrelia
AISNVVKVAQGARD

SEQ ID NO: 99412 - protein, 14 aa, Borrelia
ISNVVKVAQGARDL

SEQ ID NO: 99413 - protein, 14 aa, Borrelia
SNVVKVAQGARDLT

SEQ ID NO: 99414 - protein, 14 aa, Borrelia
NVVKVAQGARDLTK

SEQ ID NO: 99415 - protein, 14 aa, Borrelia
VVKVAQGARDLTKV

SEQ ID NO: 99416 - protein, 14 aa, Borrelia
VKVAQGARDLTKVM

SEQ ID NO: 99417 - protein, 14 aa, Borrelia
KVAQGARDLTKVMA

SEQ ID NO: 99418 - protein, 14 aa, Borrelia
VAQGARDLTKVMAI

SEQ ID NO: 99419 - protein, 14 aa, Borrelia
AQGARDLTKVMAIS

SEQ ID NO: 99420 - protein, 14 aa, Borrelia
QGARDLTKVMAISL

SEQ ID NO: 99421 - protein, 14 aa, Borrelia
GARDLTKVMAISLY

SEQ ID NO: 99422 - protein, 14 aa, Borrelia
ARDLTKVMAISLYM

SEQ ID NO: 99423 - protein, 14 aa, Borrelia
RDLTKVMAISLYMR

SEQ ID NO: 99424 - protein, 15 aa, Borrelia
MTKIFSNLIINGLLF

SEQ ID NO: 99425 - protein, 15 aa, Borrelia
TKIFSNLIINGLLFG

SEQ ID NO: 99426 - protein, 15 aa, Borrelia
KIFSNLIINGLLFGF

SEQ ID NO: 99427 - protein, 15 aa, Borrelia
IFSNLIINGLLFGFV

SEQ ID NO: 99428 - protein, 15 aa, Borrelia
FSNLIINGLLFGFVS

SEQ ID NO: 99429 - protein, 15 aa, Borrelia
SNLIINGLLFGFVSL

SEQ ID NO: 99430 - protein, 15 aa, Borrelia
NLIINGLLFGFVSLN

SEQ ID NO: 99431 - protein, 15 aa, Borrelia
LIINGLLFGFVSLNV

SEQ ID NO: 99432 - protein, 15 aa, Borrelia
IINGLLFGFVSLNVF

SEQ ID NO: 99433 - protein, 15 aa, Borrelia
INGLLFGFVSLNVFA

SEQ ID NO: 99434 - protein, 15 aa, Borrelia
NGLLFGFVSLNVFAD

SEQ ID NO: 99435 - protein, 15 aa, Borrelia
GLLFGFVSLNVFADS

SEQ ID NO: 99436 - protein, 15 aa, Borrelia
LLFGFVSLNVFADSN

SEQ ID NO: 99437 - protein, 15 aa, Borrelia
LFGFVSLNVFADSNN

SEQ ID NO: 99438 - protein, 15 aa, Borrelia
FGFVSLNVFADSNNA

SEQ ID NO: 99439 - protein, 15 aa, Borrelia
GFVSLNVFADSNNAN

SEQ ID NO: 99440 - protein, 15 aa, Borrelia
FVSLNVFADSNNANI

SEQ ID NO: 99441 - protein, 15 aa, Borrelia
VSLNVFADSNNANIL

SEQ ID NO: 99442 - protein, 15 aa, Borrelia
SLNVFADSNNANILK

SEQ ID NO: 99443 - protein, 15 aa, Borrelia
LNVFADSNNANILKP

SEQ ID NO: 99444 - protein, 15 aa, Borrelia
NVFADSNNANILKPQ

SEQ ID NO: 99445 - protein, 15 aa, Borrelia
VFADSNNANILKPQS

SEQ ID NO: 99446 - protein, 15 aa, Borrelia
FADSNNANILKPQSN

SEQ ID NO: 99447 - protein, 15 aa, Borrelia
ADSNNANILKPQSNV

SEQ ID NO: 99448 - protein, 15 aa, Borrelia
DSNNANILKPQSNVL

SEQ ID NO: 99449 - protein, 15 aa, Borrelia
SNNANILKPQSNVLE

SEQ ID NO: 99450 - protein, 15 aa, Borrelia
NNANILKPQSNVLEH

SEQ ID NO: 99451 - protein, 15 aa, Borrelia
NANILKPQSNVLEHS

SEQ ID NO: 99452 - protein, 15 aa, Borrelia
ANILKPQSNVLEHSD

SEQ ID NO: 99453 - protein, 15 aa, Borrelia
NILKPQSNVLEHSDQ

SEQ ID NO: 99454 - protein, 15 aa, Borrelia
ILKPQSNVLEHSDQK

SEQ ID NO: 99455 - protein, 15 aa, Borrelia
LKPQSNVLEHSDQKD

SEQ ID NO: 99456 - protein, 15 aa, Borrelia
KPQSNVLEHSDQKDN

SEQ ID NO: 99457 - protein, 15 aa, Borrelia
PQSNVLEHSDQKDNK

SEQ ID NO: 99458 - protein, 15 aa, Borrelia
QSNVLEHSDQKDNKK

SEQ ID NO: 99459 - protein, 15 aa, Borrelia
SNVLEHSDQKDNKKL

SEQ ID NO: 99460 - protein, 15 aa, Borrelia
NVLEHSDQKDNKKLD

SEQ ID NO: 99461 - protein, 15 aa, Borrelia
VLEHSDQKDNKKLDQ

SEQ ID NO: 99462 - protein, 15 aa, Borrelia
LEHSDQKDNKKLDQK

SEQ ID NO: 99463 - protein, 15 aa, Borrelia
EHSDQKDNKKLDQKD

SEQ ID NO: 99464 - protein, 15 aa, Borrelia
HSDQKDNKKLDQKDQ

SEQ ID NO: 99465 - protein, 15 aa, Borrelia
SDQKDNKKLDQKDQV

SEQ ID NO: 99466 - protein, 15 aa, Borrelia
DQKDNKKLDQKDQVN

SEQ ID NO: 99467 - protein, 15 aa, Borrelia
QKDNKKLDQKDQVNQ

SEQ ID NO: 99468 - protein, 15 aa, Borrelia
KDNKKLDQKDQVNQA

SEQ ID NO: 99469 - protein, 15 aa, Borrelia
DNKKLDQKDQVNQAL

SEQ ID NO: 99470 - protein, 15 aa, Borrelia
NKKLDQKDQVNQALD

SEQ ID NO: 99471 - protein, 15 aa, Borrelia
KKLDQKDQVNQALDT

SEQ ID NO: 99472 - protein, 15 aa, Borrelia
KLDQKDQVNQALDTI

SEQ ID NO: 99473 - protein, 15 aa, Borrelia
LDQKDQVNQALDTIN

SEQ ID NO: 99474 - protein, 15 aa, Borrelia
DQKDQVNQALDTINK

SEQ ID NO: 99475 - protein, 15 aa, Borrelia
QKDQVNQALDTINKV

SEQ ID NO: 99476 - protein, 15 aa, Borrelia
KDQVNQALDTINKVT

SEQ ID NO: 99477 - protein, 15 aa, Borrelia
DQVNQALDTINKVTE

SEQ ID NO: 99478 - protein, 15 aa, Borrelia
QVNQALDTINKVTED

SEQ ID NO: 99479 - protein, 15 aa, Borrelia
VNQALDTINKVTEDV

SEQ ID NO: 99480 - protein, 15 aa, Borrelia
NQALDTINKVTEDVS

SEQ ID NO: 99481 - protein, 15 aa, Borrelia
QALDTINKVTEDVSS

SEQ ID NO: 99482 - protein, 15 aa, Borrelia
ALDTINKVTEDVSSK

SEQ ID NO: 99483 - protein, 15 aa, Borrelia
LDTINKVTEDVSSKL

SEQ ID NO: 99484 - protein, 15 aa, Borrelia
DTINKVTEDVSSKLE

SEQ ID NO: 99485 - protein, 15 aa, Borrelia
TINKVTEDVSSKLEG

SEQ ID NO: 99486 - protein, 15 aa, Borrelia
INKVTEDVSSKLEGV

SEQ ID NO: 99487 - protein, 15 aa, Borrelia
NKVTEDVSSKLEGVR

SEQ ID NO: 99488 - protein, 15 aa, Borrelia
KVTEDVSSKLEGVRE

SEQ ID NO: 99489 - protein, 15 aa, Borrelia
VTEDVSSKLEGVRES

SEQ ID NO: 99490 - protein, 15 aa, Borrelia
TEDVSSKLEGVRESS

SEQ ID NO: 99491 - protein, 15 aa, Borrelia
EDVSSKLEGVRESSL

SEQ ID NO: 99492 - protein, 15 aa, Borrelia
DVSSKLEGVRESSLE

SEQ ID NO: 99493 - protein, 15 aa, Borrelia
VSSKLEGVRESSLEL

SEQ ID NO: 99494 - protein, 15 aa, Borrelia
SSKLEGVRESSLELV

SEQ ID NO: 99495 - protein, 15 aa, Borrelia
SKLEGVRESSLELVE

SEQ ID NO: 99496 - protein, 15 aa, Borrelia
KLEGVRESSLELVES

SEQ ID NO: 99497 - protein, 15 aa, Borrelia
LEGVRESSLELVESN

SEQ ID NO: 99498 - protein, 15 aa, Borrelia
EGVRESSLELVESND

SEQ ID NO: 99499 - protein, 15 aa, Borrelia
GVRESSLELVESNDA

SEQ ID NO: 99500 - protein, 15 aa, Borrelia
VRESSLELVESNDAG

SEQ ID NO: 99501 - protein, 15 aa, Borrelia
RESSLELVESNDAGV

SEQ ID NO: 99502 - protein, 15 aa, Borrelia
ESSLELVESNDAGVV

SEQ ID NO: 99503 - protein, 15 aa, Borrelia
SSLELVESNDAGVVK

SEQ ID NO: 99504 - protein, 15 aa, Borrelia
SLELVESNDAGVVKK

SEQ ID NO: 99505 - protein, 15 aa, Borrelia
LELVESNDAGVVKKF

SEQ ID NO: 99506 - protein, 15 aa, Borrelia
ELVESNDAGVVKKFV

SEQ ID NO: 99507 - protein, 15 aa, Borrelia
LVESNDAGVVKKFVG

SEQ ID NO: 99508 - protein, 15 aa, Borrelia
VESNDAGVVKKFVGS

SEQ ID NO: 99509 - protein, 15 aa, Borrelia
ESNDAGVVKKFVGSM

SEQ ID NO: 99510 - protein, 15 aa, Borrelia
SNDAGVVKKFVGSMS

SEQ ID NO: 99511 - protein, 15 aa, Borrelia
NDAGVVKKFVGSMSL

SEQ ID NO: 99512 - protein, 15 aa, Borrelia
DAGVVKKFVGSMSLM

SEQ ID NO: 99513 - protein, 15 aa, Borrelia
AGVVKKFVGSMSLMS

SEQ ID NO: 99514 - protein, 15 aa, Borrelia
GVVKKFVGSMSLMSD

SEQ ID NO: 99515 - protein, 15 aa, Borrelia
VVKKFVGSMSLMSDV

SEQ ID NO: 99516 - protein, 15 aa, Borrelia
VKKFVGSMSLMSDVA

SEQ ID NO: 99517 - protein, 15 aa, Borrelia
KKFVGSMSLMSDVAK

SEQ ID NO: 99518 - protein, 15 aa, Borrelia
KFVGSMSLMSDVAKG

SEQ ID NO: 99519 - protein, 15 aa, Borrelia
FVGSMSLMSDVAKGT

SEQ ID NO: 99520 - protein, 15 aa, Borrelia
VGSMSLMSDVAKGTV

SEQ ID NO: 99521 - protein, 15 aa, Borrelia
GSMSLMSDVAKGTVV

SEQ ID NO: 99522 - protein, 15 aa, Borrelia
SMSLMSDVAKGTVVA

SEQ ID NO: 99523 - protein, 15 aa, Borrelia
MSLMSDVAKGTVVAS

SEQ ID NO: 99524 - protein, 15 aa, Borrelia
SLMSDVAKGTVVASQ

SEQ ID NO: 99525 - protein, 15 aa, Borrelia
LMSDVAKGTVVASQE

SEQ ID NO: 99526 - protein, 15 aa, Borrelia
MSDVAKGTVVASQEA

SEQ ID NO: 99527 - protein, 15 aa, Borrelia
SDVAKGTVVASQEAT

SEQ ID NO: 99528 - protein, 15 aa, Borrelia
DVAKGTVVASQEATI

SEQ ID NO: 99529 - protein, 15 aa, Borrelia
VAKGTVVASQEATIV

SEQ ID NO: 99530 - protein, 15 aa, Borrelia
AKGTVVASQEATIVA

SEQ ID NO: 99531 - protein, 15 aa, Borrelia
KGTVVASQEATIVAK

SEQ ID NO: 99532 - protein, 15 aa, Borrelia
GTVVASQEATIVAKC

SEQ ID NO: 99533 - protein, 15 aa, Borrelia
TVVASQEATIVAKCS

SEQ ID NO: 99534 - protein, 15 aa, Borrelia
VVASQEATIVAKCSG

SEQ ID NO: 99535 - protein, 15 aa, Borrelia
VASQEATIVAKCSGM

SEQ ID NO: 99536 - protein, 15 aa, Borrelia
ASQEATIVAKCSGMV

SEQ ID NO: 99537 - protein, 15 aa, Borrelia
SQEATIVAKCSGMVA

SEQ ID NO: 99538 - protein, 15 aa, Borrelia
QEATIVAKCSGMVAE

SEQ ID NO: 99539 - protein, 15 aa, Borrelia
EATIVAKCSGMVAEG

SEQ ID NO: 99540 - protein, 15 aa, Borrelia
ATIVAKCSGMVAEGA

SEQ ID NO: 99541 - protein, 15 aa, Borrelia
TIVAKCSGMVAEGAN

SEQ ID NO: 99542 - protein, 15 aa, Borrelia
IVAKCSGMVAEGANK

SEQ ID NO: 99543 - protein, 15 aa, Borrelia
VAKCSGMVAEGANKV

SEQ ID NO: 99544 - protein, 15 aa, Borrelia
AKCSGMVAEGANKVV

SEQ ID NO: 99545 - protein, 15 aa, Borrelia
KCSGMVAEGANKVVE

SEQ ID NO: 99546 - protein, 15 aa, Borrelia
CSGMVAEGANKVVEM

SEQ ID NO: 99547 - protein, 15 aa, Borrelia
SGMVAEGANKVVEMS

SEQ ID NO: 99548 - protein, 15 aa, Borrelia
GMVAEGANKVVEMSK

SEQ ID NO: 99549 - protein, 15 aa, Borrelia
MVAEGANKVVEMSKK

SEQ ID NO: 99550 - protein, 15 aa, Borrelia
VAEGANKVVEMSKKA

SEQ ID NO: 99551 - protein, 15 aa, Borrelia
AEGANKVVEMSKKAV

SEQ ID NO: 99552 - protein, 15 aa, Borrelia
EGANKVVEMSKKAVQ

SEQ ID NO: 99553 - protein, 15 aa, Borrelia
GANKVVEMSKKAVQE

SEQ ID NO: 99554 - protein, 15 aa, Borrelia
ANKVVEMSKKAVQET

SEQ ID NO: 99555 - protein, 15 aa, Borrelia
NKVVEMSKKAVQETQ

SEQ ID NO: 99556 - protein, 15 aa, Borrelia
KVVEMSKKAVQETQK

SEQ ID NO: 99557 - protein, 15 aa, Borrelia
VVEMSKKAVQETQKA

SEQ ID NO: 99558 - protein, 15 aa, Borrelia
VEMSKKAVQETQKAV

SEQ ID NO: 99559 - protein, 15 aa, Borrelia
EMSKKAVQETQKAVS

SEQ ID NO: 99560 - protein, 15 aa, Borrelia
MSKKAVQETQKAVSV

SEQ ID NO: 99561 - protein, 15 aa, Borrelia
SKKAVQETQKAVSVA

SEQ ID NO: 99562 - protein, 15 aa, Borrelia
KKAVQETQKAVSVAG

SEQ ID NO: 99563 - protein, 15 aa, Borrelia
KAVQETQKAVSVAGE

SEQ ID NO: 99564 - protein, 15 aa, Borrelia
AVQETQKAVSVAGEA

SEQ ID NO: 99565 - protein, 15 aa, Borrelia
VQETQKAVSVAGEAT

SEQ ID NO: 99566 - protein, 15 aa, Borrelia
QETQKAVSVAGEATF

SEQ ID NO: 99567 - protein, 15 aa, Borrelia
ETQKAVSVAGEATFL

SEQ ID NO: 99568 - protein, 15 aa, Borrelia
TQKAVSVAGEATFLI

SEQ ID NO: 99569 - protein, 15 aa, Borrelia
QKAVSVAGEATFLIE

SEQ ID NO: 99570 - protein, 15 aa, Borrelia
KAVSVAGEATFLIEK

SEQ ID NO: 99571 - protein, 15 aa, Borrelia
AVSVAGEATFLIEKQ

SEQ ID NO: 99572 - protein, 15 aa, Borrelia
VSVAGEATFLIEKQI

SEQ ID NO: 99573 - protein, 15 aa, Borrelia
SVAGEATFLIEKQIM

SEQ ID NO: 99574 - protein, 15 aa, Borrelia
VAGEATFLIEKQIML

SEQ ID NO: 99575 - protein, 15 aa, Borrelia
AGEATFLIEKQIMLN

SEQ ID NO: 99576 - protein, 15 aa, Borrelia
GEATFLIEKQIMLNK

SEQ ID NO: 99577 - protein, 15 aa, Borrelia
EATFLIEKQIMLNKS

SEQ ID NO: 99578 - protein, 15 aa, Borrelia
ATFLIEKQIMLNKSP

SEQ ID NO: 99579 - protein, 15 aa, Borrelia
TFLIEKQIMLNKSPN

SEQ ID NO: 99580 - protein, 15 aa, Borrelia
FLIEKQIMLNKSPNN

SEQ ID NO: 99581 - protein, 15 aa, Borrelia
LIEKQIMLNKSPNNK

SEQ ID NO: 99582 - protein, 15 aa, Borrelia
IEKQIMLNKSPNNKE

SEQ ID NO: 99583 - protein, 15 aa, Borrelia
EKQIMLNKSPNNKEL

SEQ ID NO: 99584 - protein, 15 aa, Borrelia
KQIMLNKSPNNKELE

SEQ ID NO: 99585 - protein, 15 aa, Borrelia
QIMLNKSPNNKELEL

SEQ ID NO: 99586 - protein, 15 aa, Borrelia
IMLNKSPNNKELELT

SEQ ID NO: 99587 - protein, 15 aa, Borrelia
MLNKSPNNKELELTK

SEQ ID NO: 99588 - protein, 15 aa, Borrelia
LNKSPNNKELELTKE

SEQ ID NO: 99589 - protein, 15 aa, Borrelia
NKSPNNKELELTKEE

SEQ ID NO: 99590 - protein, 15 aa, Borrelia
KSPNNKELELTKEEF

SEQ ID NO: 99591 - protein, 15 aa, Borrelia
SPNNKELELTKEEFA

SEQ ID NO: 99592 - protein, 15 aa, Borrelia
PNNKELELTKEEFAK

SEQ ID NO: 99593 - protein, 15 aa, Borrelia
NNKELELTKEEFAKV

SEQ ID NO: 99594 - protein, 15 aa, Borrelia
NKELELTKEEFAKVD

SEQ ID NO: 99595 - protein, 15 aa, Borrelia
KELELTKEEFAKVDE

SEQ ID NO: 99596 - protein, 15 aa, Borrelia
ELELTKEEFAKVDEV

SEQ ID NO: 99597 - protein, 15 aa, Borrelia
LELTKEEFAKVDEVK

SEQ ID NO: 99598 - protein, 15 aa, Borrelia
ELTKEEFAKVDEVKE

SEQ ID NO: 99599 - protein, 15 aa, Borrelia
LTKEEFAKVDEVKET

SEQ ID NO: 99600 - protein, 15 aa, Borrelia
TKEEFAKVDEVKETL

SEQ ID NO: 99601 - protein, 15 aa, Borrelia
KEEFAKVDEVKETLM

SEQ ID NO: 99602 - protein, 15 aa, Borrelia
EEFAKVDEVKETLMA

SEQ ID NO: 99603 - protein, 15 aa, Borrelia
EFAKVDEVKETLMAS

SEQ ID NO: 99604 - protein, 15 aa, Borrelia
FAKVDEVKETLMASE

SEQ ID NO: 99605 - protein, 15 aa, Borrelia
AKVDEVKETLMASER

SEQ ID NO: 99606 - protein, 15 aa, Borrelia
KVDEVKETLMASERA

SEQ ID NO: 99607 - protein, 15 aa, Borrelia
VDEVKETLMASERAL

SEQ ID NO: 99608 - protein, 15 aa, Borrelia
DEVKETLMASERALD

SEQ ID NO: 99609 - protein, 15 aa, Borrelia
EVKETLMASERALDE

SEQ ID NO: 99610 - protein, 15 aa, Borrelia
VKETLMASERALDET

SEQ ID NO: 99611 - protein, 15 aa, Borrelia
KETLMASERALDETV

SEQ ID NO: 99612 - protein, 15 aa, Borrelia
ETLMASERALDETVQ

SEQ ID NO: 99613 - protein, 15 aa, Borrelia
TLMASERALDETVQE

SEQ ID NO: 99614 - protein, 15 aa, Borrelia
LMASERALDETVQEA

SEQ ID NO: 99615 - protein, 15 aa, Borrelia
MASERALDETVQEAQ

SEQ ID NO: 99616 - protein, 15 aa, Borrelia
ASERALDETVQEAQK

SEQ ID NO: 99617 - protein, 15 aa, Borrelia
SERALDETVQEAQKV

SEQ ID NO: 99618 - protein, 15 aa, Borrelia
ERALDETVQEAQKVL

SEQ ID NO: 99619 - protein, 15 aa, Borrelia
RALDETVQEAQKVLN

SEQ ID NO: 99620 - protein, 15 aa, Borrelia
ALDETVQEAQKVLNM

SEQ ID NO: 99621 - protein, 15 aa, Borrelia
LDETVQEAQKVLNMV

SEQ ID NO: 99622 - protein, 15 aa, Borrelia
DETVQEAQKVLNMVN

SEQ ID NO: 99623 - protein, 15 aa, Borrelia
ETVQEAQKVLNMVNG

SEQ ID NO: 99624 - protein, 15 aa, Borrelia
TVQEAQKVLNMVNGL

SEQ ID NO: 99625 - protein, 15 aa, Borrelia
VQEAQKVLNMVNGLN

SEQ ID NO: 99626 - protein, 15 aa, Borrelia
QEAQKVLNMVNGLNP

SEQ ID NO: 99627 - protein, 15 aa, Borrelia
EAQKVLNMVNGLNPS

SEQ ID NO: 99628 - protein, 15 aa, Borrelia
AQKVLNMVNGLNPSN

SEQ ID NO: 99629 - protein, 15 aa, Borrelia
QKVLNMVNGLNPSNK

SEQ ID NO: 99630 - protein, 15 aa, Borrelia
KVLNMVNGLNPSNKD

SEQ ID NO: 99631 - protein, 15 aa, Borrelia
VLNMVNGLNPSNKDQ

SEQ ID NO: 99632 - protein, 15 aa, Borrelia
LNMVNGLNPSNKDQV

SEQ ID NO: 99633 - protein, 15 aa, Borrelia
NMVNGLNPSNKDQVL

SEQ ID NO: 99634 - protein, 15 aa, Borrelia
MVNGLNPSNKDQVLA

SEQ ID NO: 99635 - protein, 15 aa, Borrelia
VNGLNPSNKDQVLAK

SEQ ID NO: 99636 - protein, 15 aa, Borrelia
NGLNPSNKDQVLAKK

SEQ ID NO: 99637 - protein, 15 aa, Borrelia
GLNPSNKDQVLAKKD

SEQ ID NO: 99638 - protein, 15 aa, Borrelia
LNPSNKDQVLAKKDV

SEQ ID NO: 99639 - protein, 15 aa, Borrelia
NPSNKDQVLAKKDVR

SEQ ID NO: 99640 - protein, 15 aa, Borrelia
PSNKDQVLAKKDVRK

SEQ ID NO: 99641 - protein, 15 aa, Borrelia
SNKDQVLAKKDVRKA

SEQ ID NO: 99642 - protein, 15 aa, Borrelia
NKDQVLAKKDVRKAI

SEQ ID NO: 99643 - protein, 15 aa, Borrelia
KDQVLAKKDVRKAIS

SEQ ID NO: 99644 - protein, 15 aa, Borrelia
DQVLAKKDVRKAISN

SEQ ID NO: 99645 - protein, 15 aa, Borrelia
QVLAKKDVRKAISNV

SEQ ID NO: 99646 - protein, 15 aa, Borrelia
VLAKKDVRKAISNVV

SEQ ID NO: 99647 - protein, 15 aa, Borrelia
LAKKDVRKAISNVVK

SEQ ID NO: 99648 - protein, 15 aa, Borrelia
AKKDVRKAISNVVKV

SEQ ID NO: 99649 - protein, 15 aa, Borrelia
KKDVRKAISNVVKVA

SEQ ID NO: 99650 - protein, 15 aa, Borrelia
KDVRKAISNVVKVAQ

SEQ ID NO: 99651 - protein, 15 aa, Borrelia
DVRKAISNVVKVAQG

SEQ ID NO: 99652 - protein, 15 aa, Borrelia
VRKAISNVVKVAQGA

SEQ ID NO: 99653 - protein, 15 aa, Borrelia
RKAISNVVKVAQGAR

SEQ ID NO: 99654 - protein, 15 aa, Borrelia
KAISNVVKVAQGARD

SEQ ID NO: 99655 - protein, 15 aa, Borrelia
AISNVVKVAQGARDL

SEQ ID NO: 99656 - protein, 15 aa, Borrelia
ISNVVKVAQGARDLT

SEQ ID NO: 99657 - protein, 15 aa, Borrelia
SNVVKVAQGARDLTK

SEQ ID NO: 99658 - protein, 15 aa, Borrelia
NVVKVAQGARDLTKV

SEQ ID NO: 99659 - protein, 15 aa, Borrelia
VVKVAQGARDLTKVM

SEQ ID NO: 99660 - protein, 15 aa, Borrelia
VKVAQGARDLTKVMA

SEQ ID NO: 99661 - protein, 15 aa, Borrelia
KVAQGARDLTKVMAI

SEQ ID NO: 99662 - protein, 15 aa, Borrelia
VAQGARDLTKVMAIS

SEQ ID NO: 99663 - protein, 15 aa, Borrelia
AQGARDLTKVMAISL

SEQ ID NO: 99664 - protein, 15 aa, Borrelia
QGARDLTKVMAISLY

SEQ ID NO: 99665 - protein, 15 aa, Borrelia
GARDLTKVMAISLYM

SEQ ID NO: 99666 - protein, 15 aa, Borrelia
ARDLTKVMAISLYMR

SEQ ID NO: 99667 - protein, 16 aa, Borrelia
MTKIFSNLIINGLLFG

SEQ ID NO: 99668 - protein, 16 aa, Borrelia
TKIFSNLIINGLLFGF

SEQ ID NO: 99669 - protein, 16 aa, Borrelia
KIFSNLIINGLLFGFV

SEQ ID NO: 99670 - protein, 16 aa, Borrelia
IFSNLIINGLLFGFVS

SEQ ID NO: 99671 - protein, 16 aa, Borrelia
FSNLIINGLLFGFVSL

SEQ ID NO: 99672 - protein, 16 aa, Borrelia
SNLIINGLLFGFVSLN

SEQ ID NO: 99673 - protein, 16 aa, Borrelia
NLIINGLLFGFVSLNV

SEQ ID NO: 99674 - protein, 16 aa, Borrelia
LIINGLLFGFVSLNVF

SEQ ID NO: 99675 - protein, 16 aa, Borrelia
IINGLLFGFVSLNVFA

SEQ ID NO: 99676 - protein, 16 aa, Borrelia
INGLLFGFVSLNVFAD

SEQ ID NO: 99677 - protein, 16 aa, Borrelia
NGLLFGFVSLNVFADS

SEQ ID NO: 99678 - protein, 16 aa, Borrelia
GLLFGFVSLNVFADSN

SEQ ID NO: 99679 - protein, 16 aa, Borrelia
LLFGFVSLNVFADSNN

SEQ ID NO: 99680 - protein, 16 aa, Borrelia
LFGFVSLNVFADSNNA

SEQ ID NO: 99681 - protein, 16 aa, Borrelia
FGFVSLNVFADSNNAN

SEQ ID NO: 99682 - protein, 16 aa, Borrelia
GFVSLNVFADSNNANI

SEQ ID NO: 99683 - protein, 16 aa, Borrelia
FVSLNVFADSNNANIL

SEQ ID NO: 99684 - protein, 16 aa, Borrelia
VSLNVFADSNNANILK

SEQ ID NO: 99685 - protein, 16 aa, Borrelia
SLNVFADSNNANILKP

SEQ ID NO: 99686 - protein, 16 aa, Borrelia
LNVFADSNNANILKPQ

SEQ ID NO: 99687 - protein, 16 aa, Borrelia
NVFADSNNANILKPQS

SEQ ID NO: 99688 - protein, 16 aa, Borrelia
VFADSNNANILKPQSN

SEQ ID NO: 99689 - protein, 16 aa, Borrelia
FADSNNANILKPQSNV

SEQ ID NO: 99690 - protein, 16 aa, Borrelia
ADSNNANILKPQSNVL

SEQ ID NO: 99691 - protein, 16 aa, Borrelia
DSNNANILKPQSNVLE

SEQ ID NO: 99692 - protein, 16 aa, Borrelia
SNNANILKPQSNVLEH

SEQ ID NO: 99693 - protein, 16 aa, Borrelia
NNANILKPQSNVLEHS

SEQ ID NO: 99694 - protein, 16 aa, Borrelia
NANILKPQSNVLEHSD

SEQ ID NO: 99695 - protein, 16 aa, Borrelia
ANILKPQSNVLEHSDQ

SEQ ID NO: 99696 - protein, 16 aa, Borrelia
NILKPQSNVLEHSDQK

SEQ ID NO: 99697 - protein, 16 aa, Borrelia
ILKPQSNVLEHSDQKD

SEQ ID NO: 99698 - protein, 16 aa, Borrelia
LKPQSNVLEHSDQKDN

SEQ ID NO: 99699 - protein, 16 aa, Borrelia
KPQSNVLEHSDQKDNK

SEQ ID NO: 99700 - protein, 16 aa, Borrelia
PQSNVLEHSDQKDNKK

SEQ ID NO: 99701 - protein, 16 aa, Borrelia
QSNVLEHSDQKDNKKL

SEQ ID NO: 99702 - protein, 16 aa, Borrelia
SNVLEHSDQKDNKKLD

SEQ ID NO: 99703 - protein, 16 aa, Borrelia
NVLEHSDQKDNKKLDQ

SEQ ID NO: 99704 - protein, 16 aa, Borrelia
VLEHSDQKDNKKLDQK

SEQ ID NO: 99705 - protein, 16 aa, Borrelia
LEHSDQKDNKKLDQKD

SEQ ID NO: 99706 - protein, 16 aa, Borrelia
EHSDQKDNKKLDQKDQ

SEQ ID NO: 99707 - protein, 16 aa, Borrelia
HSDQKDNKKLDQKDQV

SEQ ID NO: 99708 - protein, 16 aa, Borrelia
SDQKDNKKLDQKDQVN

SEQ ID NO: 99709 - protein, 16 aa, Borrelia
DQKDNKKLDQKDQVNQ

SEQ ID NO: 99710 - protein, 16 aa, Borrelia
QKDNKKLDQKDQVNQA

SEQ ID NO: 99711 - protein, 16 aa, Borrelia
KDNKKLDQKDQVNQAL

SEQ ID NO: 99712 - protein, 16 aa, Borrelia
DNKKLDQKDQVNQALD

SEQ ID NO: 99713 - protein, 16 aa, Borrelia
NKKLDQKDQVNQALDT

SEQ ID NO: 99714 - protein, 16 aa, Borrelia
KKLDQKDQVNQALDTI

SEQ ID NO: 99715 - protein, 16 aa, Borrelia
KLDQKDQVNQALDTIN

SEQ ID NO: 99716 - protein, 16 aa, Borrelia
LDQKDQVNQALDTINK

SEQ ID NO: 99717 - protein, 16 aa, Borrelia
DQKDQVNQALDTINKV

SEQ ID NO: 99718 - protein, 16 aa, Borrelia
QKDQVNQALDTINKVT

SEQ ID NO: 99719 - protein, 16 aa, Borrelia
KDQVNQALDTINKVTE

SEQ ID NO: 99720 - protein, 16 aa, Borrelia
DQVNQALDTINKVTED

SEQ ID NO: 99721 - protein, 16 aa, Borrelia
QVNQALDTINKVTEDV

SEQ ID NO: 99722 - protein, 16 aa, Borrelia
VNQALDTINKVTEDVS

SEQ ID NO: 99723 - protein, 16 aa, Borrelia
NQALDTINKVTEDVSS

SEQ ID NO: 99724 - protein, 16 aa, Borrelia
QALDTINKVTEDVSSK

SEQ ID NO: 99725 - protein, 16 aa, Borrelia
ALDTINKVTEDVSSKL

SEQ ID NO: 99726 - protein, 16 aa, Borrelia
LDTINKVTEDVSSKLE

SEQ ID NO: 99727 - protein, 16 aa, Borrelia
DTINKVTEDVSSKLEG

SEQ ID NO: 99728 - protein, 16 aa, Borrelia
TINKVTEDVSSKLEGV

SEQ ID NO: 99729 - protein, 16 aa, Borrelia
INKVTEDVSSKLEGVR

SEQ ID NO: 99730 - protein, 16 aa, Borrelia
NKVTEDVSSKLEGVRE

SEQ ID NO: 99731 - protein, 16 aa, Borrelia
KVTEDVSSKLEGVRES

SEQ ID NO: 99732 - protein, 16 aa, Borrelia
VTEDVSSKLEGVRESS

SEQ ID NO: 99733 - protein, 16 aa, Borrelia
TEDVSSKLEGVRESSL

SEQ ID NO: 99734 - protein, 16 aa, Borrelia
EDVSSKLEGVRESSLE

SEQ ID NO: 99735 - protein, 16 aa, Borrelia
DVSSKLEGVRESSLEL

SEQ ID NO: 99736 - protein, 16 aa, Borrelia
VSSKLEGVRESSLELV

SEQ ID NO: 99737 - protein, 16 aa, Borrelia
SSKLEGVRESSLELVE

SEQ ID NO: 99738 - protein, 16 aa, Borrelia
SKLEGVRESSLELVES

SEQ ID NO: 99739 - protein, 16 aa, Borrelia
KLEGVRESSLELVESN

SEQ ID NO: 99740 - protein, 16 aa, Borrelia
LEGVRESSLELVESND

SEQ ID NO: 99741 - protein, 16 aa, Borrelia
EGVRESSLELVESNDA

SEQ ID NO: 99742 - protein, 16 aa, Borrelia
GVRESSLELVESNDAG

SEQ ID NO: 99743 - protein, 16 aa, Borrelia
VRESSLELVESNDAGV

SEQ ID NO: 99744 - protein, 16 aa, Borrelia
RESSLELVESNDAGVV

SEQ ID NO: 99745 - protein, 16 aa, Borrelia
ESSLELVESNDAGVVK

SEQ ID NO: 99746 - protein, 16 aa, Borrelia
SSLELVESNDAGVVKK

SEQ ID NO: 99747 - protein, 16 aa, Borrelia
SLELVESNDAGVVKKF

SEQ ID NO: 99748 - protein, 16 aa, Borrelia
LELVESNDAGVVKKFV

SEQ ID NO: 99749 - protein, 16 aa, Borrelia
ELVESNDAGVVKKFVG

SEQ ID NO: 99750 - protein, 16 aa, Borrelia
LVESNDAGVVKKFVGS

SEQ ID NO: 99751 - protein, 16 aa, Borrelia
VESNDAGVVKKFVGSM

SEQ ID NO: 99752 - protein, 16 aa, Borrelia
ESNDAGVVKKFVGSMS

SEQ ID NO: 99753 - protein, 16 aa, Borrelia
SNDAGVVKKFVGSMSL

SEQ ID NO: 99754 - protein, 16 aa, Borrelia
NDAGVVKKFVGSMSLM

SEQ ID NO: 99755 - protein, 16 aa, Borrelia
DAGVVKKFVGSMSLMS

SEQ ID NO: 99756 - protein, 16 aa, Borrelia
AGVVKKFVGSMSLMSD

SEQ ID NO: 99757 - protein, 16 aa, Borrelia
GVVKKFVGSMSLMSDV

SEQ ID NO: 99758 - protein, 16 aa, Borrelia
VVKKFVGSMSLMSDVA

SEQ ID NO: 99759 - protein, 16 aa, Borrelia
VKKFVGSMSLMSDVAK

SEQ ID NO: 99760 - protein, 16 aa, Borrelia
KKFVGSMSLMSDVAKG

SEQ ID NO: 99761 - protein, 16 aa, Borrelia
KFVGSMSLMSDVAKGT

SEQ ID NO: 99762 - protein, 16 aa, Borrelia
FVGSMSLMSDVAKGTV

SEQ ID NO: 99763 - protein, 16 aa, Borrelia
VGSMSLMSDVAKGTVV

SEQ ID NO: 99764 - protein, 16 aa, Borrelia
GSMSLMSDVAKGTVVA

SEQ ID NO: 99765 - protein, 16 aa, Borrelia
SMSLMSDVAKGTVVAS

SEQ ID NO: 99766 - protein, 16 aa, Borrelia
MSLMSDVAKGTVVASQ

SEQ ID NO: 99767 - protein, 16 aa, Borrelia
SLMSDVAKGTVVASQE

SEQ ID NO: 99768 - protein, 16 aa, Borrelia
LMSDVAKGTVVASQEA

SEQ ID NO: 99769 - protein, 16 aa, Borrelia
MSDVAKGTVVASQEAT

SEQ ID NO: 99770 - protein, 16 aa, Borrelia
SDVAKGTVVASQEATI

SEQ ID NO: 99771 - protein, 16 aa, Borrelia
DVAKGTVVASQEATIV

SEQ ID NO: 99772 - protein, 16 aa, Borrelia
VAKGTVVASQEATIVA

SEQ ID NO: 99773 - protein, 16 aa, Borrelia
AKGTVVASQEATIVAK

SEQ ID NO: 99774 - protein, 16 aa, Borrelia
KGTVVASQEATIVAKC

SEQ ID NO: 99775 - protein, 16 aa, Borrelia
GTVVASQEATIVAKCS

SEQ ID NO: 99776 - protein, 16 aa, Borrelia
TVVASQEATIVAKCSG

SEQ ID NO: 99777 - protein, 16 aa, Borrelia
VVASQEATIVAKCSGM

SEQ ID NO: 99778 - protein, 16 aa, Borrelia
VASQEATIVAKCSGMV

SEQ ID NO: 99779 - protein, 16 aa, Borrelia
ASQEATIVAKCSGMVA

SEQ ID NO: 99780 - protein, 16 aa, Borrelia
SQEATIVAKCSGMVAE

SEQ ID NO: 99781 - protein, 16 aa, Borrelia
QEATIVAKCSGMVAEG

SEQ ID NO: 99782 - protein, 16 aa, Borrelia
EATIVAKCSGMVAEGA

SEQ ID NO: 99783 - protein, 16 aa, Borrelia
ATIVAKCSGMVAEGAN

SEQ ID NO: 99784 - protein, 16 aa, Borrelia
TIVAKCSGMVAEGANK

SEQ ID NO: 99785 - protein, 16 aa, Borrelia
IVAKCSGMVAEGANKV

SEQ ID NO: 99786 - protein, 16 aa, Borrelia
VAKCSGMVAEGANKVV

SEQ ID NO: 99787 - protein, 16 aa, Borrelia
AKCSGMVAEGANKVVE

SEQ ID NO: 99788 - protein, 16 aa, Borrelia
KCSGMVAEGANKVVEM

SEQ ID NO: 99789 - protein, 16 aa, Borrelia
CSGMVAEGANKVVEMS

SEQ ID NO: 99790 - protein, 16 aa, Borrelia
SGMVAEGANKVVEMSK

SEQ ID NO: 99791 - protein, 16 aa, Borrelia
GMVAEGANKVVEMSKK

SEQ ID NO: 99792 - protein, 16 aa, Borrelia
MVAEGANKVVEMSKKA

SEQ ID NO: 99793 - protein, 16 aa, Borrelia
VAEGANKVVEMSKKAV

SEQ ID NO: 99794 - protein, 16 aa, Borrelia
AEGANKVVEMSKKAVQ

SEQ ID NO: 99795 - protein, 16 aa, Borrelia
EGANKVVEMSKKAVQE

SEQ ID NO: 99796 - protein, 16 aa, Borrelia
GANKVVEMSKKAVQET

SEQ ID NO: 99797 - protein, 16 aa, Borrelia
ANKVVEMSKKAVQETQ

SEQ ID NO: 99798 - protein, 16 aa, Borrelia
NKVVEMSKKAVQETQK

SEQ ID NO: 99799 - protein, 16 aa, Borrelia
KVVEMSKKAVQETQKA

SEQ ID NO: 99800 - protein, 16 aa, Borrelia
VVEMSKKAVQETQKAV

SEQ ID NO: 99801 - protein, 16 aa, Borrelia
VEMSKKAVQETQKAVS

SEQ ID NO: 99802 - protein, 16 aa, Borrelia
EMSKKAVQETQKAVSV

SEQ ID NO: 99803 - protein, 16 aa, Borrelia
MSKKAVQETQKAVSVA

SEQ ID NO: 99804 - protein, 16 aa, Borrelia
SKKAVQETQKAVSVAG

SEQ ID NO: 99805 - protein, 16 aa, Borrelia
KKAVQETQKAVSVAGE

SEQ ID NO: 99806 - protein, 16 aa, Borrelia
KAVQETQKAVSVAGEA

SEQ ID NO: 99807 - protein, 16 aa, Borrelia
AVQETQKAVSVAGEAT

SEQ ID NO: 99808 - protein, 16 aa, Borrelia
VQETQKAVSVAGEATF

SEQ ID NO: 99809 - protein, 16 aa, Borrelia
QETQKAVSVAGEATFL

SEQ ID NO: 99810 - protein, 16 aa, Borrelia
ETQKAVSVAGEATFLI

SEQ ID NO: 99811 - protein, 16 aa, Borrelia
TQKAVSVAGEATFLIE

SEQ ID NO: 99812 - protein, 16 aa, Borrelia
QKAVSVAGEATFLIEK

SEQ ID NO: 99813 - protein, 16 aa, Borrelia
KAVSVAGEATFLIEKQ

SEQ ID NO: 99814 - protein, 16 aa, Borrelia
AVSVAGEATFLIEKQI

SEQ ID NO: 99815 - protein, 16 aa, Borrelia
VSVAGEATFLIEKQIM

SEQ ID NO: 99816 - protein, 16 aa, Borrelia
SVAGEATFLIEKQIML

SEQ ID NO: 99817 - protein, 16 aa, Borrelia
VAGEATFLIEKQIMLN

SEQ ID NO: 99818 - protein, 16 aa, Borrelia
AGEATFLIEKQIMLNK

SEQ ID NO: 99819 - protein, 16 aa, Borrelia
GEATFLIEKQIMLNKS

SEQ ID NO: 99820 - protein, 16 aa, Borrelia
EATFLIEKQIMLNKSP

SEQ ID NO: 99821 - protein, 16 aa, Borrelia
ATFLIEKQIMLNKSPN

SEQ ID NO: 99822 - protein, 16 aa, Borrelia
TFLIEKQIMLNKSPNN

SEQ ID NO: 99823 - protein, 16 aa, Borrelia
FLIEKQIMLNKSPNNK

SEQ ID NO: 99824 - protein, 16 aa, Borrelia
LIEKQIMLNKSPNNKE

SEQ ID NO: 99825 - protein, 16 aa, Borrelia
IEKQIMLNKSPNNKEL

SEQ ID NO: 99826 - protein, 16 aa, Borrelia
EKQIMLNKSPNNKELE

SEQ ID NO: 99827 - protein, 16 aa, Borrelia
KQIMLNKSPNNKELEL

SEQ ID NO: 99828 - protein, 16 aa, Borrelia
QIMLNKSPNNKELELT

SEQ ID NO: 99829 - protein, 16 aa, Borrelia
IMLNKSPNNKELELTK

SEQ ID NO: 99830 - protein, 16 aa, Borrelia
MLNKSPNNKELELTKE

SEQ ID NO: 99831 - protein, 16 aa, Borrelia
LNKSPNNKELELTKEE

SEQ ID NO: 99832 - protein, 16 aa, Borrelia
NKSPNNKELELTKEEF

SEQ ID NO: 99833 - protein, 16 aa, Borrelia
KSPNNKELELTKEEFA

SEQ ID NO: 99834 - protein, 16 aa, Borrelia
SPNNKELELTKEEFAK

SEQ ID NO: 99835 - protein, 16 aa, Borrelia
PNNKELELTKEEFAKV

SEQ ID NO: 99836 - protein, 16 aa, Borrelia
NNKELELTKEEFAKVD

SEQ ID NO: 99837 - protein, 16 aa, Borrelia
NKELELTKEEFAKVDE

SEQ ID NO: 99838 - protein, 16 aa, Borrelia
KELELTKEEFAKVDEV

SEQ ID NO: 99839 - protein, 16 aa, Borrelia
ELELTKEEFAKVDEVK

SEQ ID NO: 99840 - protein, 16 aa, Borrelia
LELTKEEFAKVDEVKE

SEQ ID NO: 99841 - protein, 16 aa, Borrelia
ELTKEEFAKVDEVKET

SEQ ID NO: 99842 - protein, 16 aa, Borrelia
LTKEEFAKVDEVKETL

SEQ ID NO: 99843 - protein, 16 aa, Borrelia
TKEEFAKVDEVKETLM

SEQ ID NO: 99844 - protein, 16 aa, Borrelia
KEEFAKVDEVKETLMA

SEQ ID NO: 99845 - protein, 16 aa, Borrelia
EEFAKVDEVKETLMAS

SEQ ID NO: 99846 - protein, 16 aa, Borrelia
EFAKVDEVKETLMASE

SEQ ID NO: 99847 - protein, 16 aa, Borrelia
FAKVDEVKETLMASER

SEQ ID NO: 99848 - protein, 16 aa, Borrelia
AKVDEVKETLMASERA

SEQ ID NO: 99849 - protein, 16 aa, Borrelia
KVDEVKETLMASERAL

SEQ ID NO: 99850 - protein, 16 aa, Borrelia
VDEVKETLMASERALD

SEQ ID NO: 99851 - protein, 16 aa, Borrelia
DEVKETLMASERALDE

SEQ ID NO: 99852 - protein, 16 aa, Borrelia
EVKETLMASERALDET

SEQ ID NO: 99853 - protein, 16 aa, Borrelia
VKETLMASERALDETV

SEQ ID NO: 99854 - protein, 16 aa, Borrelia
KETLMASERALDETVQ

SEQ ID NO: 99855 - protein, 16 aa, Borrelia
ETLMASERALDETVQE

SEQ ID NO: 99856 - protein, 16 aa, Borrelia
TLMASERALDETVQEA

SEQ ID NO: 99857 - protein, 16 aa, Borrelia
LMASERALDETVQEAQ

SEQ ID NO: 99858 - protein, 16 aa, Borrelia
MASERALDETVQEAQK

SEQ ID NO: 99859 - protein, 16 aa, Borrelia
ASERALDETVQEAQKV

SEQ ID NO: 99860 - protein, 16 aa, Borrelia
SERALDETVQEAQKVL

SEQ ID NO: 99861 - protein, 16 aa, Borrelia
ERALDETVQEAQKVLN

SEQ ID NO: 99862 - protein, 16 aa, Borrelia
RALDETVQEAQKVLNM

SEQ ID NO: 99863 - protein, 16 aa, Borrelia
ALDETVQEAQKVLNMV

SEQ ID NO: 99864 - protein, 16 aa, Borrelia
LDETVQEAQKVLNMVN

SEQ ID NO: 99865 - protein, 16 aa, Borrelia
DETVQEAQKVLNMVNG

SEQ ID NO: 99866 - protein, 16 aa, Borrelia
ETVQEAQKVLNMVNGL

SEQ ID NO: 99867 - protein, 16 aa, Borrelia
TVQEAQKVLNMVNGLN

SEQ ID NO: 99868 - protein, 16 aa, Borrelia
VQEAQKVLNMVNGLNP

SEQ ID NO: 99869 - protein, 16 aa, Borrelia
QEAQKVLNMVNGLNPS

SEQ ID NO: 99870 - protein, 16 aa, Borrelia
EAQKVLNMVNGLNPSN

SEQ ID NO: 99871 - protein, 16 aa, Borrelia
AQKVLNMVNGLNPSNK

SEQ ID NO: 99872 - protein, 16 aa, Borrelia
QKVLNMVNGLNPSNKD

SEQ ID NO: 99873 - protein, 16 aa, Borrelia
KVLNMVNGLNPSNKDQ

SEQ ID NO: 99874 - protein, 16 aa, Borrelia
VLNMVNGLNPSNKDQV

SEQ ID NO: 99875 - protein, 16 aa, Borrelia
LNMVNGLNPSNKDQVL

SEQ ID NO: 99876 - protein, 16 aa, Borrelia
NMVNGLNPSNKDQVLA

SEQ ID NO: 99877 - protein, 16 aa, Borrelia
MVNGLNPSNKDQVLAK

SEQ ID NO: 99878 - protein, 16 aa, Borrelia
VNGLNPSNKDQVLAKK

SEQ ID NO: 99879 - protein, 16 aa, Borrelia
NGLNPSNKDQVLAKKD

SEQ ID NO: 99880 - protein, 16 aa, Borrelia
GLNPSNKDQVLAKKDV

SEQ ID NO: 99881 - protein, 16 aa, Borrelia
LNPSNKDQVLAKKDVR

SEQ ID NO: 99882 - protein, 16 aa, Borrelia
NPSNKDQVLAKKDVRK

SEQ ID NO: 99883 - protein, 16 aa, Borrelia
PSNKDQVLAKKDVRKA

SEQ ID NO: 99884 - protein, 16 aa, Borrelia
SNKDQVLAKKDVRKAI

SEQ ID NO: 99885 - protein, 16 aa, Borrelia
NKDQVLAKKDVRKAIS

SEQ ID NO: 99886 - protein, 16 aa, Borrelia
KDQVLAKKDVRKAISN

SEQ ID NO: 99887 - protein, 16 aa, Borrelia
DQVLAKKDVRKAISNV

SEQ ID NO: 99888 - protein, 16 aa, Borrelia
QVLAKKDVRKAISNVV

SEQ ID NO: 99889 - protein, 16 aa, Borrelia
VLAKKDVRKAISNVVK

SEQ ID NO: 99890 - protein, 16 aa, Borrelia
LAKKDVRKAISNVVKV

SEQ ID NO: 99891 - protein, 16 aa, Borrelia
AKKDVRKAISNVVKVA

SEQ ID NO: 99892 - protein, 16 aa, Borrelia
KKDVRKAISNVVKVAQ

SEQ ID NO: 99893 - protein, 16 aa, Borrelia
KDVRKAISNVVKVAQG

SEQ ID NO: 99894 - protein, 16 aa, Borrelia
DVRKAISNVVKVAQGA

SEQ ID NO: 99895 - protein, 16 aa, Borrelia
VRKAISNVVKVAQGAR

SEQ ID NO: 99896 - protein, 16 aa, Borrelia
RKAISNVVKVAQGARD

SEQ ID NO: 99897 - protein, 16 aa, Borrelia
KAISNVVKVAQGARDL

SEQ ID NO: 99898 - protein, 16 aa, Borrelia
AISNVVKVAQGARDLT

SEQ ID NO: 99899 - protein, 16 aa, Borrelia
ISNVVKVAQGARDLTK

SEQ ID NO: 99900 - protein, 16 aa, Borrelia
SNVVKVAQGARDLTKV

SEQ ID NO: 99901 - protein, 16 aa, Borrelia
NVVKVAQGARDLTKVM

SEQ ID NO: 99902 - protein, 16 aa, Borrelia
VVKVAQGARDLTKVMA

SEQ ID NO: 99903 - protein, 16 aa, Borrelia
VKVAQGARDLTKVMAI

SEQ ID NO: 99904 - protein, 16 aa, Borrelia
KVAQGARDLTKVMAIS

SEQ ID NO: 99905 - protein, 16 aa, Borrelia
VAQGARDLTKVMAISL

SEQ ID NO: 99906 - protein, 16 aa, Borrelia
AQGARDLTKVMAISLY

SEQ ID NO: 99907 - protein, 16 aa, Borrelia
QGARDLTKVMAISLYM

SEQ ID NO: 99908 - protein, 16 aa, Borrelia
GARDLTKVMAISLYMR

SEQ ID NO: 99909 - protein, 13 aa, Borrelia burgdorferi
MKKMLLIFSFFLI

SEQ ID NO: 99910 - protein, 13 aa, Borrelia burgdorferi
KKMLLIFSFFLIF

SEQ ID NO: 99911 - protein, 13 aa, Borrelia burgdorferi
KMLLIFSFFLIFL

SEQ ID NO: 99912 - protein, 13 aa, Borrelia burgdorferi
MLLIFSFFLIFLN

SEQ ID NO: 99913 - protein, 13 aa, Borrelia burgdorferi
LLIFSFFLIFLNG

SEQ ID NO: 99914 - protein, 13 aa, Borrelia burgdorferi
LIFSFFLIFLNGF

SEQ ID NO: 99915 - protein, 13 aa, Borrelia burgdorferi
IFSFFLIFLNGFP

SEQ ID NO: 99916 - protein, 13 aa, Borrelia burgdorferi
FSFFLIFLNGFPL

SEQ ID NO: 99917 - protein, 13 aa, Borrelia burgdorferi
SFFLIFLNGFPLN

SEQ ID NO: 99918 - protein, 13 aa, Borrelia burgdorferi
FFLIFLNGFPLNA

SEQ ID NO: 99919 - protein, 13 aa, Borrelia burgdorferi
FLIFLNGFPLNAR

SEQ ID NO: 99920 - protein, 13 aa, Borrelia burgdorferi
LIFLNGFPLNARK

SEQ ID NO: 99921 - protein, 13 aa, Borrelia burgdorferi
IFLNGFPLNARKV

SEQ ID NO: 99922 - protein, 13 aa, Borrelia burgdorferi
FLNGFPLNARKVD

SEQ ID NO: 99923 - protein, 13 aa, Borrelia burgdorferi
LNGFPLNARKVDK

SEQ ID NO: 99924 - protein, 13 aa, Borrelia burgdorferi
NGFPLNARKVDKE

SEQ ID NO: 99925 - protein, 13 aa, Borrelia burgdorferi
GFPLNARKVDKEK

SEQ ID NO: 99926 - protein, 13 aa, Borrelia burgdorferi
FPLNARKVDKEKL

SEQ ID NO: 99927 - protein, 13 aa, Borrelia burgdorferi
PLNARKVDKEKLK

SEQ ID NO: 99928 - protein, 13 aa, Borrelia burgdorferi
LNARKVDKEKLKD

SEQ ID NO: 99929 - protein, 13 aa, Borrelia burgdorferi
NARKVDKEKLKDF

SEQ ID NO: 99930 - protein, 13 aa, Borrelia burgdorferi
ARKVDKEKLKDFV

SEQ ID NO: 99931 - protein, 13 aa, Borrelia burgdorferi
RKVDKEKLKDFVN

SEQ ID NO: 99932 - protein, 13 aa, Borrelia burgdorferi
KVDKEKLKDFVNM

SEQ ID NO: 99933 - protein, 13 aa, Borrelia burgdorferi
VDKEKLKDFVNMD

SEQ ID NO: 99934 - protein, 13 aa, Borrelia burgdorferi
DKEKLKDFVNMDL

SEQ ID NO: 99935 - protein, 13 aa, Borrelia burgdorferi
KEKLKDFVNMDLE

SEQ ID NO: 99936 - protein, 13 aa, Borrelia burgdorferi
EKLKDFVNMDLEF

SEQ ID NO: 99937 - protein, 13 aa, Borrelia burgdorferi
KLKDFVNMDLEFV

SEQ ID NO: 99938 - protein, 13 aa, Borrelia burgdorferi
LKDFVNMDLEFVN

SEQ ID NO: 99939 - protein, 13 aa, Borrelia burgdorferi
KDFVNMDLEFVNY

SEQ ID NO: 99940 - protein, 13 aa, Borrelia burgdorferi
DFVNMDLEFVNYK

SEQ ID NO: 99941 - protein, 13 aa, Borrelia burgdorferi
FVNMDLEFVNYKG

SEQ ID NO: 99942 - protein, 13 aa, Borrelia burgdorferi
VNMDLEFVNYKGP

SEQ ID NO: 99943 - protein, 13 aa, Borrelia burgdorferi
NMDLEFVNYKGPY

SEQ ID NO: 99944 - protein, 13 aa, Borrelia burgdorferi
MDLEFVNYKGPYD

SEQ ID NO: 99945 - protein, 13 aa, Borrelia burgdorferi
DLEFVNYKGPYDS

SEQ ID NO: 99946 - protein, 13 aa, Borrelia burgdorferi
LEFVNYKGPYDST

SEQ ID NO: 99947 - protein, 13 aa, Borrelia burgdorferi
EFVNYKGPYDSTN

SEQ ID NO: 99948 - protein, 13 aa, Borrelia burgdorferi
FVNYKGPYDSTNT

SEQ ID NO: 99949 - protein, 13 aa, Borrelia burgdorferi
VNYKGPYDSTNTY

SEQ ID NO: 99950 - protein, 13 aa, Borrelia burgdorferi
NYKGPYDSTNTYE

SEQ ID NO: 99951 - protein, 13 aa, Borrelia burgdorferi
YKGPYDSTNTYEQ

SEQ ID NO: 99952 - protein, 13 aa, Borrelia burgdorferi
KGPYDSTNTYEQI

SEQ ID NO: 99953 - protein, 13 aa, Borrelia burgdorferi
GPYDSTNTYEQIV

SEQ ID NO: 99954 - protein, 13 aa, Borrelia burgdorferi
PYDSTNTYEQIVG

SEQ ID NO: 99955 - protein, 13 aa, Borrelia burgdorferi
YDSTNTYEQIVGI

SEQ ID NO: 99956 - protein, 13 aa, Borrelia burgdorferi
DSTNTYEQIVGIG

SEQ ID NO: 99957 - protein, 13 aa, Borrelia burgdorferi
STNTYEQIVGIGE

SEQ ID NO: 99958 - protein, 13 aa, Borrelia burgdorferi
TNTYEQIVGIGEF

SEQ ID NO: 99959 - protein, 13 aa, Borrelia burgdorferi
NTYEQIVGIGEFL

SEQ ID NO: 99960 - protein, 13 aa, Borrelia burgdorferi
TYEQIVGIGEFLA

SEQ ID NO: 99961 - protein, 13 aa, Borrelia burgdorferi
YEQIVGIGEFLAR

SEQ ID NO: 99962 - protein, 13 aa, Borrelia burgdorferi
EQIVGIGEFLARP

SEQ ID NO: 99963 - protein, 13 aa, Borrelia burgdorferi
QIVGIGEFLARPL

SEQ ID NO: 99964 - protein, 13 aa, Borrelia burgdorferi
IVGIGEFLARPLT

SEQ ID NO: 99965 - protein, 13 aa, Borrelia burgdorferi
VGIGEFLARPLTN

SEQ ID NO: 99966 - protein, 13 aa, Borrelia burgdorferi
GIGEFLARPLTNS

SEQ ID NO: 99967 - protein, 13 aa, Borrelia burgdorferi
IGEFLARPLTNSN

SEQ ID NO: 99968 - protein, 13 aa, Borrelia burgdorferi
GEFLARPLTNSNS

SEQ ID NO: 99969 - protein, 13 aa, Borrelia burgdorferi
EFLARPLTNSNSN

SEQ ID NO: 99970 - protein, 13 aa, Borrelia burgdorferi
FLARPLTNSNSNS

SEQ ID NO: 99971 - protein, 13 aa, Borrelia burgdorferi
LARPLTNSNSNSS

SEQ ID NO: 99972 - protein, 13 aa, Borrelia burgdorferi
ARPLTNSNSNSSY

SEQ ID NO: 99973 - protein, 13 aa, Borrelia burgdorferi
RPLTNSNSNSSYY

SEQ ID NO: 99974 - protein, 13 aa, Borrelia burgdorferi
PLTNSNSNSSYYG

SEQ ID NO: 99975 - protein, 13 aa, Borrelia burgdorferi
LTNSNSNSSYYGK

SEQ ID NO: 99976 - protein, 13 aa, Borrelia burgdorferi
TNSNSNSSYYGKY

SEQ ID NO: 99977 - protein, 13 aa, Borrelia burgdorferi
NSNSNSSYYGKYF

SEQ ID NO: 99978 - protein, 13 aa, Borrelia burgdorferi
SNSNSSYYGKYFI

SEQ ID NO: 99979 - protein, 13 aa, Borrelia burgdorferi
NSNSSYYGKYFIN

SEQ ID NO: 99980 - protein, 13 aa, Borrelia burgdorferi
SNSSYYGKYFINR

SEQ ID NO: 99981 - protein, 13 aa, Borrelia burgdorferi
NSSYYGKYFINRF

SEQ ID NO: 99982 - protein, 13 aa, Borrelia burgdorferi
SSYYGKYFINRFI

SEQ ID NO: 99983 - protein, 13 aa, Borrelia burgdorferi
SYYGKYFINRFID

SEQ ID NO: 99984 - protein, 13 aa, Borrelia burgdorferi
YYGKYFINRFIDD

SEQ ID NO: 99985 - protein, 13 aa, Borrelia burgdorferi
YGKYFINRFIDDQ

SEQ ID NO: 99986 - protein, 13 aa, Borrelia burgdorferi
GKYFINRFIDDQD

SEQ ID NO: 99987 - protein, 13 aa, Borrelia burgdorferi
KYFINRFIDDQDK

SEQ ID NO: 99988 - protein, 13 aa, Borrelia burgdorferi
YFINRFIDDQDKK

SEQ ID NO: 99989 - protein, 13 aa, Borrelia burgdorferi
FINRFIDDQDKKA

SEQ ID NO: 99990 - protein, 13 aa, Borrelia burgdorferi
INRFIDDQDKKAS

SEQ ID NO: 99991 - protein, 13 aa, Borrelia burgdorferi
NRFIDDQDKKASV

SEQ ID NO: 99992 - protein, 13 aa, Borrelia burgdorferi
RFIDDQDKKASVD

SEQ ID NO: 99993 - protein, 13 aa, Borrelia burgdorferi
FIDDQDKKASVDV

SEQ ID NO: 99994 - protein, 13 aa, Borrelia burgdorferi
IDDQDKKASVDVF

SEQ ID NO: 99995 - protein, 13 aa, Borrelia burgdorferi
DDQDKKASVDVFS

SEQ ID NO: 99996 - protein, 13 aa, Borrelia burgdorferi
DQDKKASVDVFSI

SEQ ID NO: 99997 - protein, 13 aa, Borrelia burgdorferi
QDKKASVDVFSIS

SEQ ID NO: 99998 - protein, 13 aa, Borrelia burgdorferi
DKKASVDVFSISS

SEQ ID NO: 99999 - protein, 13 aa, Borrelia burgdorferi
KKASVDVFSISSK

SEQ ID NO: 100000 - protein, 13 aa, Borrelia burgdorferi
KASVDVFSISSKS

SEQ ID NO: 100001 - protein, 13 aa, Borrelia burgdorferi
ASVDVFSISSKSE

SEQ ID NO: 100002 - protein, 13 aa, Borrelia burgdorferi
SVDVFSISSKSEL

SEQ ID NO: 100003 - protein, 13 aa, Borrelia burgdorferi
VDVFSISSKSELD

SEQ ID NO: 100004 - protein, 13 aa, Borrelia burgdorferi
DVFSISSKSELDS

SEQ ID NO: 100005 - protein, 13 aa, Borrelia burgdorferi
VFSISSKSELDSI

SEQ ID NO: 100006 - protein, 13 aa, Borrelia burgdorferi
FSISSKSELDSIL

SEQ ID NO: 100007 - protein, 13 aa, Borrelia burgdorferi
SISSKSELDSILN

SEQ ID NO: 100008 - protein, 13 aa, Borrelia burgdorferi
ISSKSELDSILNL

SEQ ID NO: 100009 - protein, 13 aa, Borrelia burgdorferi
SSKSELDSILNLR

SEQ ID NO: 100010 - protein, 13 aa, Borrelia burgdorferi
SKSELDSILNLRR

SEQ ID NO: 100011 - protein, 13 aa, Borrelia burgdorferi
KSELDSILNLRRI

SEQ ID NO: 100012 - protein, 13 aa, Borrelia burgdorferi
SELDSILNLRRIL

SEQ ID NO: 100013 - protein, 13 aa, Borrelia burgdorferi
ELDSILNLRRILT

SEQ ID NO: 100014 - protein, 13 aa, Borrelia burgdorferi
LDSILNLRRILTG

SEQ ID NO: 100015 - protein, 13 aa, Borrelia burgdorferi
DSILNLRRILTGY

SEQ ID NO: 100016 - protein, 13 aa, Borrelia burgdorferi
SILNLRRILTGYI

SEQ ID NO: 100017 - protein, 13 aa, Borrelia burgdorferi
ILNLRRILTGYII

SEQ ID NO: 100018 - protein, 13 aa, Borrelia burgdorferi
LNLRRILTGYIIK

SEQ ID NO: 100019 - protein, 13 aa, Borrelia burgdorferi
NLRRILTGYIIKS

SEQ ID NO: 100020 - protein, 13 aa, Borrelia burgdorferi
LRRILTGYIIKSF

SEQ ID NO: 100021 - protein, 13 aa, Borrelia burgdorferi
RRILTGYIIKSFD

SEQ ID NO: 100022 - protein, 13 aa, Borrelia burgdorferi
RILTGYIIKSFDY

SEQ ID NO: 100023 - protein, 13 aa, Borrelia burgdorferi
ILTGYIIKSFDYD

SEQ ID NO: 100024 - protein, 13 aa, Borrelia burgdorferi
LTGYIIKSFDYDR

SEQ ID NO: 100025 - protein, 13 aa, Borrelia burgdorferi
TGYIIKSFDYDRS

SEQ ID NO: 100026 - protein, 13 aa, Borrelia burgdorferi
GYIIKSFDYDRSS

SEQ ID NO: 100027 - protein, 13 aa, Borrelia burgdorferi
YIIKSFDYDRSSA

SEQ ID NO: 100028 - protein, 13 aa, Borrelia burgdorferi
IIKSFDYDRSSAE

SEQ ID NO: 100029 - protein, 13 aa, Borrelia burgdorferi
IKSFDYDRSSAEL

SEQ ID NO: 100030 - protein, 13 aa, Borrelia burgdorferi
KSFDYDRSSAELI

SEQ ID NO: 100031 - protein, 13 aa, Borrelia burgdorferi
SFDYDRSSAELIA

SEQ ID NO: 100032 - protein, 13 aa, Borrelia burgdorferi
FDYDRSSAELIAK

SEQ ID NO: 100033 - protein, 13 aa, Borrelia burgdorferi
DYDRSSAELIAKV

SEQ ID NO: 100034 - protein, 13 aa, Borrelia burgdorferi
YDRSSAELIAKVI

SEQ ID NO: 100035 - protein, 13 aa, Borrelia burgdorferi
DRSSAELIAKVIT

SEQ ID NO: 100036 - protein, 13 aa, Borrelia burgdorferi
RSSAELIAKVITI

SEQ ID NO: 100037 - protein, 13 aa, Borrelia burgdorferi
SSAELIAKVITIY

SEQ ID NO: 100038 - protein, 13 aa, Borrelia burgdorferi
SAELIAKVITIYN

SEQ ID NO: 100039 - protein, 13 aa, Borrelia burgdorferi
AELIAKVITIYNA

SEQ ID NO: 100040 - protein, 13 aa, Borrelia burgdorferi
ELIAKVITIYNAV

SEQ ID NO: 100041 - protein, 13 aa, Borrelia burgdorferi
LIAKVITIYNAVY

SEQ ID NO: 100042 - protein, 13 aa, Borrelia burgdorferi
IAKVITIYNAVYR

SEQ ID NO: 100043 - protein, 13 aa, Borrelia burgdorferi
AKVITIYNAVYRG

SEQ ID NO: 100044 - protein, 13 aa, Borrelia burgdorferi
KVITIYNAVYRGD

SEQ ID NO: 100045 - protein, 13 aa, Borrelia burgdorferi
VITIYNAVYRGDL

SEQ ID NO: 100046 - protein, 13 aa, Borrelia burgdorferi
ITIYNAVYRGDLD

SEQ ID NO: 100047 - protein, 13 aa, Borrelia burgdorferi
TIYNAVYRGDLDY

SEQ ID NO: 100048 - protein, 13 aa, Borrelia burgdorferi
IYNAVYRGDLDYY

SEQ ID NO: 100049 - protein, 13 aa, Borrelia burgdorferi
YNAVYRGDLDYYK

SEQ ID NO: 100050 - protein, 13 aa, Borrelia burgdorferi
NAVYRGDLDYYKG

SEQ ID NO: 100051 - protein, 13 aa, Borrelia burgdorferi
AVYRGDLDYYKGF

SEQ ID NO: 100052 - protein, 13 aa, Borrelia burgdorferi
VYRGDLDYYKGFY

SEQ ID NO: 100053 - protein, 13 aa, Borrelia burgdorferi
YRGDLDYYKGFYI

SEQ ID NO: 100054 - protein, 13 aa, Borrelia burgdorferi
RGDLDYYKGFYIE

SEQ ID NO: 100055 - protein, 13 aa, Borrelia burgdorferi
GDLDYYKGFYIEP

SEQ ID NO: 100056 - protein, 13 aa, Borrelia burgdorferi
DLDYYKGFYIEPA

SEQ ID NO: 100057 - protein, 13 aa, Borrelia burgdorferi
LDYYKGFYIEPAL

SEQ ID NO: 100058 - protein, 13 aa, Borrelia burgdorferi
DYYKGFYIEPALK

SEQ ID NO: 100059 - protein, 13 aa, Borrelia burgdorferi
YYKGFYIEPALKS

SEQ ID NO: 100060 - protein, 13 aa, Borrelia burgdorferi
YKGFYIEPALKSL

SEQ ID NO: 100061 - protein, 13 aa, Borrelia burgdorferi
KGFYIEPALKSLT

SEQ ID NO: 100062 - protein, 13 aa, Borrelia burgdorferi
GFYIEPALKSLTK

SEQ ID NO: 100063 - protein, 13 aa, Borrelia burgdorferi
FYIEPALKSLTKE

SEQ ID NO: 100064 - protein, 13 aa, Borrelia burgdorferi
YIEPALKSLTKEN

SEQ ID NO: 100065 - protein, 13 aa, Borrelia burgdorferi
IEPALKSLTKENA

SEQ ID NO: 100066 - protein, 13 aa, Borrelia burgdorferi
EPALKSLTKENAG

SEQ ID NO: 100067 - protein, 13 aa, Borrelia burgdorferi
PALKSLTKENAGL

SEQ ID NO: 100068 - protein, 13 aa, Borrelia burgdorferi
ALKSLTKENAGLS

SEQ ID NO: 100069 - protein, 13 aa, Borrelia burgdorferi
LKSLTKENAGLSR

SEQ ID NO: 100070 - protein, 13 aa, Borrelia burgdorferi
KSLTKENAGLSRV

SEQ ID NO: 100071 - protein, 13 aa, Borrelia burgdorferi
SLTKENAGLSRVY

SEQ ID NO: 100072 - protein, 13 aa, Borrelia burgdorferi
LTKENAGLSRVYS

SEQ ID NO: 100073 - protein, 13 aa, Borrelia burgdorferi
TKENAGLSRVYSQ

SEQ ID NO: 100074 - protein, 13 aa, Borrelia burgdorferi
KENAGLSRVYSQW

SEQ ID NO: 100075 - protein, 13 aa, Borrelia burgdorferi
ENAGLSRVYSQWA

SEQ ID NO: 100076 - protein, 13 aa, Borrelia burgdorferi
NAGLSRVYSQWAG

SEQ ID NO: 100077 - protein, 13 aa, Borrelia burgdorferi
AGLSRVYSQWAGK

SEQ ID NO: 100078 - protein, 13 aa, Borrelia burgdorferi
GLSRVYSQWAGKT

SEQ ID NO: 100079 - protein, 13 aa, Borrelia burgdorferi
LSRVYSQWAGKTQ

SEQ ID NO: 100080 - protein, 13 aa, Borrelia burgdorferi
SRVYSQWAGKTQI

SEQ ID NO: 100081 - protein, 13 aa, Borrelia burgdorferi
RVYSQWAGKTQIF

SEQ ID NO: 100082 - protein, 13 aa, Borrelia burgdorferi
VYSQWAGKTQIFI

SEQ ID NO: 100083 - protein, 13 aa, Borrelia burgdorferi
YSQWAGKTQIFIP

SEQ ID NO: 100084 - protein, 13 aa, Borrelia burgdorferi
SQWAGKTQIFIPL

SEQ ID NO: 100085 - protein, 13 aa, Borrelia burgdorferi
QWAGKTQIFIPLK

SEQ ID NO: 100086 - protein, 13 aa, Borrelia burgdorferi
WAGKTQIFIPLKK

SEQ ID NO: 100087 - protein, 13 aa, Borrelia burgdorferi
AGKTQIFIPLKKD

SEQ ID NO: 100088 - protein, 13 aa, Borrelia burgdorferi
GKTQIFIPLKKDI

SEQ ID NO: 100089 - protein, 13 aa, Borrelia burgdorferi
KTQIFIPLKKDIL

SEQ ID NO: 100090 - protein, 13 aa, Borrelia burgdorferi
TQIFIPLKKDILS

SEQ ID NO: 100091 - protein, 13 aa, Borrelia burgdorferi
QIFIPLKKDILSG

SEQ ID NO: 100092 - protein, 13 aa, Borrelia burgdorferi
IFIPLKKDILSGN

SEQ ID NO: 100093 - protein, 13 aa, Borrelia burgdorferi
FIPLKKDILSGNI

SEQ ID NO: 100094 - protein, 13 aa, Borrelia burgdorferi
IPLKKDILSGNIE

SEQ ID NO: 100095 - protein, 13 aa, Borrelia burgdorferi
PLKKDILSGNIES

SEQ ID NO: 100096 - protein, 13 aa, Borrelia burgdorferi
LKKDILSGNIESD

SEQ ID NO: 100097 - protein, 13 aa, Borrelia burgdorferi
KKDILSGNIESDI

SEQ ID NO: 100098 - protein, 13 aa, Borrelia burgdorferi
KDILSGNIESDID

SEQ ID NO: 100099 - protein, 13 aa, Borrelia burgdorferi
DILSGNIESDIDI

SEQ ID NO: 100100 - protein, 13 aa, Borrelia burgdorferi
ILSGNIESDIDID

SEQ ID NO: 100101 - protein, 13 aa, Borrelia burgdorferi
LSGNIESDIDIDS

SEQ ID NO: 100102 - protein, 13 aa, Borrelia burgdorferi
SGNIESDIDIDSL

SEQ ID NO: 100103 - protein, 13 aa, Borrelia burgdorferi
GNIESDIDIDSLV

SEQ ID NO: 100104 - protein, 13 aa, Borrelia burgdorferi
NIESDIDIDSLVT

SEQ ID NO: 100105 - protein, 13 aa, Borrelia burgdorferi
IESDIDIDSLVTD

SEQ ID NO: 100106 - protein, 13 aa, Borrelia burgdorferi
ESDIDIDSLVTDK

SEQ ID NO: 100107 - protein, 13 aa, Borrelia burgdorferi
SDIDIDSLVTDKV

SEQ ID NO: 100108 - protein, 13 aa, Borrelia burgdorferi
DIDIDSLVTDKVI

SEQ ID NO: 100109 - protein, 13 aa, Borrelia burgdorferi
IDIDSLVTDKVIA

SEQ ID NO: 100110 - protein, 13 aa, Borrelia burgdorferi
DIDSLVTDKVIAA

SEQ ID NO: 100111 - protein, 13 aa, Borrelia burgdorferi
IDSLVTDKVIAAL

SEQ ID NO: 100112 - protein, 13 aa, Borrelia burgdorferi
DSLVTDKVIAALL

SEQ ID NO: 100113 - protein, 13 aa, Borrelia burgdorferi
SLVTDKVIAALLS

SEQ ID NO: 100114 - protein, 13 aa, Borrelia burgdorferi
LVTDKVIAALLSE

SEQ ID NO: 100115 - protein, 13 aa, Borrelia burgdorferi
VTDKVIAALLSEN

SEQ ID NO: 100116 - protein, 13 aa, Borrelia burgdorferi
TDKVIAALLSENE

SEQ ID NO: 100117 - protein, 13 aa, Borrelia burgdorferi
DKVIAALLSENEA

SEQ ID NO: 100118 - protein, 13 aa, Borrelia burgdorferi
KVIAALLSENEAG

SEQ ID NO: 100119 - protein, 13 aa, Borrelia burgdorferi
VIAALLSENEAGV

SEQ ID NO: 100120 - protein, 13 aa, Borrelia burgdorferi
IAALLSENEAGVN

SEQ ID NO: 100121 - protein, 13 aa, Borrelia burgdorferi
AALLSENEAGVNF

SEQ ID NO: 100122 - protein, 13 aa, Borrelia burgdorferi
ALLSENEAGVNFA

SEQ ID NO: 100123 - protein, 13 aa, Borrelia burgdorferi
LLSENEAGVNFAR

SEQ ID NO: 100124 - protein, 13 aa, Borrelia burgdorferi
LSENEAGVNFARD

SEQ ID NO: 100125 - protein, 13 aa, Borrelia burgdorferi
SENEAGVNFARDI

SEQ ID NO: 100126 - protein, 13 aa, Borrelia burgdorferi
ENEAGVNFARDIT

SEQ ID NO: 100127 - protein, 13 aa, Borrelia burgdorferi
NEAGVNFARDITD

SEQ ID NO: 100128 - protein, 13 aa, Borrelia burgdorferi
EAGVNFARDITDI

SEQ ID NO: 100129 - protein, 13 aa, Borrelia burgdorferi
AGVNFARDITDIQ

SEQ ID NO: 100130 - protein, 13 aa, Borrelia burgdorferi
GVNFARDITDIQG

SEQ ID NO: 100131 - protein, 13 aa, Borrelia burgdorferi
VNFARDITDIQGE

SEQ ID NO: 100132 - protein, 13 aa, Borrelia burgdorferi
NFARDITDIQGET

SEQ ID NO: 100133 - protein, 13 aa, Borrelia burgdorferi
FARDITDIQGETH

SEQ ID NO: 100134 - protein, 13 aa, Borrelia burgdorferi
ARDITDIQGETHK

SEQ ID NO: 100135 - protein, 13 aa, Borrelia burgdorferi
RDITDIQGETHKA

SEQ ID NO: 100136 - protein, 13 aa, Borrelia burgdorferi
DITDIQGETHKAD

SEQ ID NO: 100137 - protein, 13 aa, Borrelia burgdorferi
ITDIQGETHKADQ

SEQ ID NO: 100138 - protein, 13 aa, Borrelia burgdorferi
TDIQGETHKADQD

SEQ ID NO: 100139 - protein, 13 aa, Borrelia burgdorferi
DIQGETHKADQDK

SEQ ID NO: 100140 - protein, 13 aa, Borrelia burgdorferi
IQGETHKADQDKI

SEQ ID NO: 100141 - protein, 13 aa, Borrelia burgdorferi
QGETHKADQDKID

SEQ ID NO: 100142 - protein, 13 aa, Borrelia burgdorferi
GETHKADQDKIDT

SEQ ID NO: 100143 - protein, 13 aa, Borrelia burgdorferi
ETHKADQDKIDTE

SEQ ID NO: 100144 - protein, 13 aa, Borrelia burgdorferi
THKADQDKIDTEL

SEQ ID NO: 100145 - protein, 13 aa, Borrelia burgdorferi
HKADQDKIDTELD

SEQ ID NO: 100146 - protein, 13 aa, Borrelia burgdorferi
KADQDKIDTELDN

SEQ ID NO: 100147 - protein, 13 aa, Borrelia burgdorferi
ADQDKIDTELDNI

SEQ ID NO: 100148 - protein, 13 aa, Borrelia burgdorferi
DQDKIDTELDNIH

SEQ ID NO: 100149 - protein, 13 aa, Borrelia burgdorferi
QDKIDTELDNIHE

SEQ ID NO: 100150 - protein, 13 aa, Borrelia burgdorferi
DKIDTELDNIHES

SEQ ID NO: 100151 - protein, 13 aa, Borrelia burgdorferi
KIDTELDNIHESD

SEQ ID NO: 100152 - protein, 13 aa, Borrelia burgdorferi
IDTELDNIHESDS

SEQ ID NO: 100153 - protein, 13 aa, Borrelia burgdorferi
DTELDNIHESDSN

SEQ ID NO: 100154 - protein, 13 aa, Borrelia burgdorferi
TELDNIHESDSNI

SEQ ID NO: 100155 - protein, 13 aa, Borrelia burgdorferi
ELDNIHESDSNIT

SEQ ID NO: 100156 - protein, 13 aa, Borrelia burgdorferi
LDNIHESDSNITE

SEQ ID NO: 100157 - protein, 13 aa, Borrelia burgdorferi
DNIHESDSNITET

SEQ ID NO: 100158 - protein, 13 aa, Borrelia burgdorferi
NIHESDSNITETI

SEQ ID NO: 100159 - protein, 13 aa, Borrelia burgdorferi
IHESDSNITETIE

SEQ ID NO: 100160 - protein, 13 aa, Borrelia burgdorferi
HESDSNITETIEN

SEQ ID NO: 100161 - protein, 13 aa, Borrelia burgdorferi
ESDSNITETIENL

SEQ ID NO: 100162 - protein, 13 aa, Borrelia burgdorferi
SDSNITETIENLR

SEQ ID NO: 100163 - protein, 13 aa, Borrelia burgdorferi
DSNITETIENLRD

SEQ ID NO: 100164 - protein, 13 aa, Borrelia burgdorferi
SNITETIENLRDQ

SEQ ID NO: 100165 - protein, 13 aa, Borrelia burgdorferi
NITETIENLRDQL

SEQ ID NO: 100166 - protein, 13 aa, Borrelia burgdorferi
ITETIENLRDQLE

SEQ ID NO: 100167 - protein, 13 aa, Borrelia burgdorferi
TETIENLRDQLEK

SEQ ID NO: 100168 - protein, 13 aa, Borrelia burgdorferi
ETIENLRDQLEKA

SEQ ID NO: 100169 - protein, 13 aa, Borrelia burgdorferi
TIENLRDQLEKAT

SEQ ID NO: 100170 - protein, 13 aa, Borrelia burgdorferi
IENLRDQLEKATD

SEQ ID NO: 100171 - protein, 13 aa, Borrelia burgdorferi
ENLRDQLEKATDE

SEQ ID NO: 100172 - protein, 13 aa, Borrelia burgdorferi
NLRDQLEKATDEE

SEQ ID NO: 100173 - protein, 13 aa, Borrelia burgdorferi
LRDQLEKATDEEH

SEQ ID NO: 100174 - protein, 13 aa, Borrelia burgdorferi
RDQLEKATDEEHK

SEQ ID NO: 100175 - protein, 13 aa, Borrelia burgdorferi
DQLEKATDEEHKK

SEQ ID NO: 100176 - protein, 13 aa, Borrelia burgdorferi
QLEKATDEEHKKE

SEQ ID NO: 100177 - protein, 13 aa, Borrelia burgdorferi
LEKATDEEHKKEI

SEQ ID NO: 100178 - protein, 13 aa, Borrelia burgdorferi
EKATDEEHKKEIE

SEQ ID NO: 100179 - protein, 13 aa, Borrelia burgdorferi
KATDEEHKKEIES

SEQ ID NO: 100180 - protein, 13 aa, Borrelia burgdorferi
ATDEEHKKEIESQ

SEQ ID NO: 100181 - protein, 13 aa, Borrelia burgdorferi
TDEEHKKEIESQV

SEQ ID NO: 100182 - protein, 13 aa, Borrelia burgdorferi
DEEHKKEIESQVD

SEQ ID NO: 100183 - protein, 13 aa, Borrelia burgdorferi
EEHKKEIESQVDA

SEQ ID NO: 100184 - protein, 13 aa, Borrelia burgdorferi
EHKKEIESQVDAK

SEQ ID NO: 100185 - protein, 13 aa, Borrelia burgdorferi
HKKEIESQVDAKK

SEQ ID NO: 100186 - protein, 13 aa, Borrelia burgdorferi
KKEIESQVDAKKK

SEQ ID NO: 100187 - protein, 13 aa, Borrelia burgdorferi
KEIESQVDAKKKE

SEQ ID NO: 100188 - protein, 13 aa, Borrelia burgdorferi
EIESQVDAKKKEK

SEQ ID NO: 100189 - protein, 13 aa, Borrelia burgdorferi
IESQVDAKKKEKE

SEQ ID NO: 100190 - protein, 13 aa, Borrelia burgdorferi
ESQVDAKKKEKEE

SEQ ID NO: 100191 - protein, 13 aa, Borrelia burgdorferi
SQVDAKKKEKEEL

SEQ ID NO: 100192 - protein, 13 aa, Borrelia burgdorferi
QVDAKKKEKEELD

SEQ ID NO: 100193 - protein, 13 aa, Borrelia burgdorferi
VDAKKKEKEELDK

SEQ ID NO: 100194 - protein, 13 aa, Borrelia burgdorferi
DAKKKEKEELDKK

SEQ ID NO: 100195 - protein, 13 aa, Borrelia burgdorferi
AKKKEKEELDKKA

SEQ ID NO: 100196 - protein, 13 aa, Borrelia burgdorferi
KKKEKEELDKKAI

SEQ ID NO: 100197 - protein, 13 aa, Borrelia burgdorferi
KKEKEELDKKAIN

SEQ ID NO: 100198 - protein, 13 aa, Borrelia burgdorferi
KEKEELDKKAINL

SEQ ID NO: 100199 - protein, 13 aa, Borrelia burgdorferi
EKEELDKKAINLD

SEQ ID NO: 100200 - protein, 13 aa, Borrelia burgdorferi
KEELDKKAINLDK

SEQ ID NO: 100201 - protein, 13 aa, Borrelia burgdorferi
EELDKKAINLDKA

SEQ ID NO: 100202 - protein, 13 aa, Borrelia burgdorferi
ELDKKAINLDKAQ

SEQ ID NO: 100203 - protein, 13 aa, Borrelia burgdorferi
LDKKAINLDKAQQ

SEQ ID NO: 100204 - protein, 13 aa, Borrelia burgdorferi
DKKAINLDKAQQK

SEQ ID NO: 100205 - protein, 13 aa, Borrelia burgdorferi
KKAINLDKAQQKL

SEQ ID NO: 100206 - protein, 13 aa, Borrelia burgdorferi
KAINLDKAQQKLD

SEQ ID NO: 100207 - protein, 13 aa, Borrelia burgdorferi
AINLDKAQQKLDS

SEQ ID NO: 100208 - protein, 13 aa, Borrelia burgdorferi
INLDKAQQKLDSA

SEQ ID NO: 100209 - protein, 13 aa, Borrelia burgdorferi
NLDKAQQKLDSAE

SEQ ID NO: 100210 - protein, 13 aa, Borrelia burgdorferi
LDKAQQKLDSAED

SEQ ID NO: 100211 - protein, 13 aa, Borrelia burgdorferi
DKAQQKLDSAEDN

SEQ ID NO: 100212 - protein, 13 aa, Borrelia burgdorferi
KAQQKLDSAEDNL

SEQ ID NO: 100213 - protein, 13 aa, Borrelia burgdorferi
AQQKLDSAEDNLD

SEQ ID NO: 100214 - protein, 13 aa, Borrelia burgdorferi
QQKLDSAEDNLDV

SEQ ID NO: 100215 - protein, 13 aa, Borrelia burgdorferi
QKLDSAEDNLDVQ

SEQ ID NO: 100216 - protein, 13 aa, Borrelia burgdorferi
KLDSAEDNLDVQR

SEQ ID NO: 100217 - protein, 13 aa, Borrelia burgdorferi
LDSAEDNLDVQRD

SEQ ID NO: 100218 - protein, 13 aa, Borrelia burgdorferi
DSAEDNLDVQRDT

SEQ ID NO: 100219 - protein, 13 aa, Borrelia burgdorferi
SAEDNLDVQRDTV

SEQ ID NO: 100220 - protein, 13 aa, Borrelia burgdorferi
AEDNLDVQRDTVR

SEQ ID NO: 100221 - protein, 13 aa, Borrelia burgdorferi
EDNLDVQRDTVRE

SEQ ID NO: 100222 - protein, 13 aa, Borrelia burgdorferi
DNLDVQRDTVREK

SEQ ID NO: 100223 - protein, 13 aa, Borrelia burgdorferi
NLDVQRDTVREKI

SEQ ID NO: 100224 - protein, 13 aa, Borrelia burgdorferi
LDVQRDTVREKIQ

SEQ ID NO: 100225 - protein, 13 aa, Borrelia burgdorferi
DVQRDTVREKIQE

SEQ ID NO: 100226 - protein, 13 aa, Borrelia burgdorferi
VQRDTVREKIQED

SEQ ID NO: 100227 - protein, 13 aa, Borrelia burgdorferi
QRDTVREKIQEDI

SEQ ID NO: 100228 - protein, 13 aa, Borrelia burgdorferi
RDTVREKIQEDIN

SEQ ID NO: 100229 - protein, 13 aa, Borrelia burgdorferi
DTVREKIQEDINE

SEQ ID NO: 100230 - protein, 13 aa, Borrelia burgdorferi
TVREKIQEDINEI

SEQ ID NO: 100231 - protein, 13 aa, Borrelia burgdorferi
VREKIQEDINEIN

SEQ ID NO: 100232 - protein, 13 aa, Borrelia burgdorferi
REKIQEDINEINK

SEQ ID NO: 100233 - protein, 13 aa, Borrelia burgdorferi
EKIQEDINEINKE

SEQ ID NO: 100234 - protein, 13 aa, Borrelia burgdorferi
KIQEDINEINKEK

SEQ ID NO: 100235 - protein, 13 aa, Borrelia burgdorferi
IQEDINEINKEKN

SEQ ID NO: 100236 - protein, 13 aa, Borrelia burgdorferi
QEDINEINKEKNL

SEQ ID NO: 100237 - protein, 13 aa, Borrelia burgdorferi
EDINEINKEKNLP

SEQ ID NO: 100238 - protein, 13 aa, Borrelia burgdorferi
DINEINKEKNLPK

SEQ ID NO: 100239 - protein, 13 aa, Borrelia burgdorferi
INEINKEKNLPKP

SEQ ID NO: 100240 - protein, 13 aa, Borrelia burgdorferi
NEINKEKNLPKPG

SEQ ID NO: 100241 - protein, 13 aa, Borrelia burgdorferi
EINKEKNLPKPGD

SEQ ID NO: 100242 - protein, 13 aa, Borrelia burgdorferi
INKEKNLPKPGDV

SEQ ID NO: 100243 - protein, 13 aa, Borrelia burgdorferi
NKEKNLPKPGDVS

SEQ ID NO: 100244 - protein, 13 aa, Borrelia burgdorferi
KEKNLPKPGDVSS

SEQ ID NO: 100245 - protein, 13 aa, Borrelia burgdorferi
EKNLPKPGDVSSP

SEQ ID NO: 100246 - protein, 13 aa, Borrelia burgdorferi
KNLPKPGDVSSPK

SEQ ID NO: 100247 - protein, 13 aa, Borrelia burgdorferi
NLPKPGDVSSPKV

SEQ ID NO: 100248 - protein, 13 aa, Borrelia burgdorferi
LPKPGDVSSPKVD

SEQ ID NO: 100249 - protein, 13 aa, Borrelia burgdorferi
PKPGDVSSPKVDK

SEQ ID NO: 100250 - protein, 13 aa, Borrelia burgdorferi
KPGDVSSPKVDKQ

SEQ ID NO: 100251 - protein, 13 aa, Borrelia burgdorferi
PGDVSSPKVDKQL

SEQ ID NO: 100252 - protein, 13 aa, Borrelia burgdorferi
GDVSSPKVDKQLQ

SEQ ID NO: 100253 - protein, 13 aa, Borrelia burgdorferi
DVSSPKVDKQLQI

SEQ ID NO: 100254 - protein, 13 aa, Borrelia burgdorferi
VSSPKVDKQLQIK

SEQ ID NO: 100255 - protein, 13 aa, Borrelia burgdorferi
SSPKVDKQLQIKE

SEQ ID NO: 100256 - protein, 13 aa, Borrelia burgdorferi
SPKVDKQLQIKES

SEQ ID NO: 100257 - protein, 13 aa, Borrelia burgdorferi
PKVDKQLQIKESL

SEQ ID NO: 100258 - protein, 13 aa, Borrelia burgdorferi
KVDKQLQIKESLE

SEQ ID NO: 100259 - protein, 13 aa, Borrelia burgdorferi
VDKQLQIKESLED

SEQ ID NO: 100260 - protein, 13 aa, Borrelia burgdorferi
DKQLQIKESLEDL

SEQ ID NO: 100261 - protein, 13 aa, Borrelia burgdorferi
KQLQIKESLEDLQ

SEQ ID NO: 100262 - protein, 13 aa, Borrelia burgdorferi
QLQIKESLEDLQE

SEQ ID NO: 100263 - protein, 13 aa, Borrelia burgdorferi
LQIKESLEDLQEQ

SEQ ID NO: 100264 - protein, 13 aa, Borrelia burgdorferi
QIKESLEDLQEQL

SEQ ID NO: 100265 - protein, 13 aa, Borrelia burgdorferi
IKESLEDLQEQLK

SEQ ID NO: 100266 - protein, 13 aa, Borrelia burgdorferi
KESLEDLQEQLKE

SEQ ID NO: 100267 - protein, 13 aa, Borrelia burgdorferi
ESLEDLQEQLKEA

SEQ ID NO: 100268 - protein, 13 aa, Borrelia burgdorferi
SLEDLQEQLKEAG

SEQ ID NO: 100269 - protein, 13 aa, Borrelia burgdorferi
LEDLQEQLKEAGD

SEQ ID NO: 100270 - protein, 13 aa, Borrelia burgdorferi
EDLQEQLKEAGDE

SEQ ID NO: 100271 - protein, 13 aa, Borrelia burgdorferi
DLQEQLKEAGDEN

SEQ ID NO: 100272 - protein, 13 aa, Borrelia burgdorferi
LQEQLKEAGDENQ

SEQ ID NO: 100273 - protein, 13 aa, Borrelia burgdorferi
QEQLKEAGDENQK

SEQ ID NO: 100274 - protein, 13 aa, Borrelia burgdorferi
EQLKEAGDENQKR

SEQ ID NO: 100275 - protein, 13 aa, Borrelia burgdorferi
QLKEAGDENQKRE

SEQ ID NO: 100276 - protein, 13 aa, Borrelia burgdorferi
LKEAGDENQKREI

SEQ ID NO: 100277 - protein, 13 aa, Borrelia burgdorferi
KEAGDENQKREIE

SEQ ID NO: 100278 - protein, 13 aa, Borrelia burgdorferi
EAGDENQKREIEK

SEQ ID NO: 100279 - protein, 13 aa, Borrelia burgdorferi
AGDENQKREIEKQ

SEQ ID NO: 100280 - protein, 13 aa, Borrelia burgdorferi
GDENQKREIEKQI

SEQ ID NO: 100281 - protein, 13 aa, Borrelia burgdorferi
DENQKREIEKQIE

SEQ ID NO: 100282 - protein, 13 aa, Borrelia burgdorferi
ENQKREIEKQIEI

SEQ ID NO: 100283 - protein, 13 aa, Borrelia burgdorferi
NQKREIEKQIEIK

SEQ ID NO: 100284 - protein, 13 aa, Borrelia burgdorferi
QKREIEKQIEIKK

SEQ ID NO: 100285 - protein, 13 aa, Borrelia burgdorferi
KREIEKQIEIKKR

SEQ ID NO: 100286 - protein, 13 aa, Borrelia burgdorferi
REIEKQIEIKKRD

SEQ ID NO: 100287 - protein, 13 aa, Borrelia burgdorferi
EIEKQIEIKKRDE

SEQ ID NO: 100288 - protein, 13 aa, Borrelia burgdorferi
IEKQIEIKKRDEE

SEQ ID NO: 100289 - protein, 13 aa, Borrelia burgdorferi
EKQIEIKKRDEEL

SEQ ID NO: 100290 - protein, 13 aa, Borrelia burgdorferi
KQIEIKKRDEELL

SEQ ID NO: 100291 - protein, 13 aa, Borrelia burgdorferi
QIEIKKRDEELLK

SEQ ID NO: 100292 - protein, 13 aa, Borrelia burgdorferi
IEIKKRDEELLKS

SEQ ID NO: 100293 - protein, 13 aa, Borrelia burgdorferi
EIKKRDEELLKSK

SEQ ID NO: 100294 - protein, 13 aa, Borrelia burgdorferi
IKKRDEELLKSKD

SEQ ID NO: 100295 - protein, 13 aa, Borrelia burgdorferi
KKRDEELLKSKDG

SEQ ID NO: 100296 - protein, 13 aa, Borrelia burgdorferi
KRDEELLKSKDGK

SEQ ID NO: 100297 - protein, 13 aa, Borrelia burgdorferi
RDEELLKSKDGKV

SEQ ID NO: 100298 - protein, 13 aa, Borrelia burgdorferi
DEELLKSKDGKVS

SEQ ID NO: 100299 - protein, 13 aa, Borrelia burgdorferi
EELLKSKDGKVSK

SEQ ID NO: 100300 - protein, 13 aa, Borrelia burgdorferi
ELLKSKDGKVSKD

SEQ ID NO: 100301 - protein, 13 aa, Borrelia burgdorferi
LLKSKDGKVSKDY

SEQ ID NO: 100302 - protein, 13 aa, Borrelia burgdorferi
LKSKDGKVSKDYE

SEQ ID NO: 100303 - protein, 13 aa, Borrelia burgdorferi
KSKDGKVSKDYEA

SEQ ID NO: 100304 - protein, 13 aa, Borrelia burgdorferi
SKDGKVSKDYEAL

SEQ ID NO: 100305 - protein, 13 aa, Borrelia burgdorferi
KDGKVSKDYEALD

SEQ ID NO: 100306 - protein, 13 aa, Borrelia burgdorferi
DGKVSKDYEALDL

SEQ ID NO: 100307 - protein, 13 aa, Borrelia burgdorferi
GKVSKDYEALDLD

SEQ ID NO: 100308 - protein, 13 aa, Borrelia burgdorferi
KVSKDYEALDLDR

SEQ ID NO: 100309 - protein, 13 aa, Borrelia burgdorferi
VSKDYEALDLDRE

SEQ ID NO: 100310 - protein, 13 aa, Borrelia burgdorferi
SKDYEALDLDREL

SEQ ID NO: 100311 - protein, 13 aa, Borrelia burgdorferi
KDYEALDLDRELS

SEQ ID NO: 100312 - protein, 13 aa, Borrelia burgdorferi
DYEALDLDRELSK

SEQ ID NO: 100313 - protein, 13 aa, Borrelia burgdorferi
YEALDLDRELSKA

SEQ ID NO: 100314 - protein, 13 aa, Borrelia burgdorferi
EALDLDRELSKAS

SEQ ID NO: 100315 - protein, 13 aa, Borrelia burgdorferi
ALDLDRELSKASS

SEQ ID NO: 100316 - protein, 13 aa, Borrelia burgdorferi
LDLDRELSKASSK

SEQ ID NO: 100317 - protein, 13 aa, Borrelia burgdorferi
DLDRELSKASSKE

SEQ ID NO: 100318 - protein, 13 aa, Borrelia burgdorferi
LDRELSKASSKEK

SEQ ID NO: 100319 - protein, 13 aa, Borrelia burgdorferi
DRELSKASSKEKS

SEQ ID NO: 100320 - protein, 13 aa, Borrelia burgdorferi
RELSKASSKEKSK

SEQ ID NO: 100321 - protein, 13 aa, Borrelia burgdorferi
ELSKASSKEKSKV

SEQ ID NO: 100322 - protein, 13 aa, Borrelia burgdorferi
LSKASSKEKSKVK

SEQ ID NO: 100323 - protein, 13 aa, Borrelia burgdorferi
SKASSKEKSKVKE

SEQ ID NO: 100324 - protein, 13 aa, Borrelia burgdorferi
KASSKEKSKVKEE

SEQ ID NO: 100325 - protein, 13 aa, Borrelia burgdorferi
ASSKEKSKVKEEE

SEQ ID NO: 100326 - protein, 13 aa, Borrelia burgdorferi
SSKEKSKVKEEEI

SEQ ID NO: 100327 - protein, 13 aa, Borrelia burgdorferi
SKEKSKVKEEEIT

SEQ ID NO: 100328 - protein, 13 aa, Borrelia burgdorferi
KEKSKVKEEEITK

SEQ ID NO: 100329 - protein, 13 aa, Borrelia burgdorferi
EKSKVKEEEITKG

SEQ ID NO: 100330 - protein, 13 aa, Borrelia burgdorferi
KSKVKEEEITKGK

SEQ ID NO: 100331 - protein, 13 aa, Borrelia burgdorferi
SKVKEEEITKGKS

SEQ ID NO: 100332 - protein, 13 aa, Borrelia burgdorferi
KVKEEEITKGKSR

SEQ ID NO: 100333 - protein, 13 aa, Borrelia burgdorferi
VKEEEITKGKSRA

SEQ ID NO: 100334 - protein, 13 aa, Borrelia burgdorferi
KEEEITKGKSRAS

SEQ ID NO: 100335 - protein, 13 aa, Borrelia burgdorferi
EEEITKGKSRASL

SEQ ID NO: 100336 - protein, 13 aa, Borrelia burgdorferi
EEITKGKSRASLG

SEQ ID NO: 100337 - protein, 13 aa, Borrelia burgdorferi
EITKGKSRASLGD

SEQ ID NO: 100338 - protein, 13 aa, Borrelia burgdorferi
ITKGKSRASLGDL

SEQ ID NO: 100339 - protein, 13 aa, Borrelia burgdorferi
TKGKSRASLGDLN

SEQ ID NO: 100340 - protein, 13 aa, Borrelia burgdorferi
KGKSRASLGDLNN

SEQ ID NO: 100341 - protein, 13 aa, Borrelia burgdorferi
GKSRASLGDLNND

SEQ ID NO: 100342 - protein, 13 aa, Borrelia burgdorferi
KSRASLGDLNNDK

SEQ ID NO: 100343 - protein, 13 aa, Borrelia burgdorferi
SRASLGDLNNDKN

SEQ ID NO: 100344 - protein, 13 aa, Borrelia burgdorferi
RASLGDLNNDKNL

SEQ ID NO: 100345 - protein, 13 aa, Borrelia burgdorferi
ASLGDLNNDKNLM

SEQ ID NO: 100346 - protein, 13 aa, Borrelia burgdorferi
SLGDLNNDKNLML

SEQ ID NO: 100347 - protein, 13 aa, Borrelia burgdorferi
LGDLNNDKNLMLP

SEQ ID NO: 100348 - protein, 13 aa, Borrelia burgdorferi
GDLNNDKNLMLPE

SEQ ID NO: 100349 - protein, 13 aa, Borrelia burgdorferi
DLNNDKNLMLPED

SEQ ID NO: 100350 - protein, 13 aa, Borrelia burgdorferi
LNNDKNLMLPEDQ

SEQ ID NO: 100351 - protein, 13 aa, Borrelia burgdorferi
NNDKNLMLPEDQK

SEQ ID NO: 100352 - protein, 13 aa, Borrelia burgdorferi
NDKNLMLPEDQKL

SEQ ID NO: 100353 - protein, 13 aa, Borrelia burgdorferi
DKNLMLPEDQKLP

SEQ ID NO: 100354 - protein, 13 aa, Borrelia burgdorferi
KNLMLPEDQKLPE

SEQ ID NO: 100355 - protein, 13 aa, Borrelia burgdorferi
NLMLPEDQKLPED

SEQ ID NO: 100356 - protein, 13 aa, Borrelia burgdorferi
LMLPEDQKLPEDK

SEQ ID NO: 100357 - protein, 13 aa, Borrelia burgdorferi
MLPEDQKLPEDKK

SEQ ID NO: 100358 - protein, 13 aa, Borrelia burgdorferi
LPEDQKLPEDKKL

SEQ ID NO: 100359 - protein, 13 aa, Borrelia burgdorferi
PEDQKLPEDKKLD

SEQ ID NO: 100360 - protein, 13 aa, Borrelia burgdorferi
EDQKLPEDKKLDS

SEQ ID NO: 100361 - protein, 13 aa, Borrelia burgdorferi
DQKLPEDKKLDSK

SEQ ID NO: 100362 - protein, 13 aa, Borrelia burgdorferi
QKLPEDKKLDSKL

SEQ ID NO: 100363 - protein, 13 aa, Borrelia burgdorferi
KLPEDKKLDSKLD

SEQ ID NO: 100364 - protein, 13 aa, Borrelia burgdorferi
LPEDKKLDSKLDG

SEQ ID NO: 100365 - protein, 13 aa, Borrelia burgdorferi
PEDKKLDSKLDGK

SEQ ID NO: 100366 - protein, 13 aa, Borrelia burgdorferi
EDKKLDSKLDGKK

SEQ ID NO: 100367 - protein, 13 aa, Borrelia burgdorferi
DKKLDSKLDGKKE

SEQ ID NO: 100368 - protein, 13 aa, Borrelia burgdorferi
KKLDSKLDGKKEF

SEQ ID NO: 100369 - protein, 13 aa, Borrelia burgdorferi
KLDSKLDGKKEFK

SEQ ID NO: 100370 - protein, 13 aa, Borrelia burgdorferi
LDSKLDGKKEFKP

SEQ ID NO: 100371 - protein, 13 aa, Borrelia burgdorferi
DSKLDGKKEFKPV

SEQ ID NO: 100372 - protein, 13 aa, Borrelia burgdorferi
SKLDGKKEFKPVS

SEQ ID NO: 100373 - protein, 13 aa, Borrelia burgdorferi
KLDGKKEFKPVSE

SEQ ID NO: 100374 - protein, 13 aa, Borrelia burgdorferi
LDGKKEFKPVSEV

SEQ ID NO: 100375 - protein, 13 aa, Borrelia burgdorferi
DGKKEFKPVSEVE

SEQ ID NO: 100376 - protein, 13 aa, Borrelia burgdorferi
GKKEFKPVSEVEK

SEQ ID NO: 100377 - protein, 13 aa, Borrelia burgdorferi
KKEFKPVSEVEKL

SEQ ID NO: 100378 - protein, 13 aa, Borrelia burgdorferi
KEFKPVSEVEKLD

SEQ ID NO: 100379 - protein, 13 aa, Borrelia burgdorferi
EFKPVSEVEKLDK

SEQ ID NO: 100380 - protein, 13 aa, Borrelia burgdorferi
FKPVSEVEKLDKI

SEQ ID NO: 100381 - protein, 13 aa, Borrelia burgdorferi
KPVSEVEKLDKIS

SEQ ID NO: 100382 - protein, 13 aa, Borrelia burgdorferi
PVSEVEKLDKISK

SEQ ID NO: 100383 - protein, 13 aa, Borrelia burgdorferi
VSEVEKLDKISKS

SEQ ID NO: 100384 - protein, 13 aa, Borrelia burgdorferi
SEVEKLDKISKSN

SEQ ID NO: 100385 - protein, 13 aa, Borrelia burgdorferi
EVEKLDKISKSNN

SEQ ID NO: 100386 - protein, 13 aa, Borrelia burgdorferi
VEKLDKISKSNNN

SEQ ID NO: 100387 - protein, 13 aa, Borrelia burgdorferi
EKLDKISKSNNNE

SEQ ID NO: 100388 - protein, 13 aa, Borrelia burgdorferi
KLDKISKSNNNEV

SEQ ID NO: 100389 - protein, 13 aa, Borrelia burgdorferi
LDKISKSNNNEVG

SEQ ID NO: 100390 - protein, 13 aa, Borrelia burgdorferi
DKISKSNNNEVGK

SEQ ID NO: 100391 - protein, 13 aa, Borrelia burgdorferi
KISKSNNNEVGKL

SEQ ID NO: 100392 - protein, 13 aa, Borrelia burgdorferi
ISKSNNNEVGKLS

SEQ ID NO: 100393 - protein, 13 aa, Borrelia burgdorferi
SKSNNNEVGKLSP

SEQ ID NO: 100394 - protein, 13 aa, Borrelia burgdorferi
KSNNNEVGKLSPL

SEQ ID NO: 100395 - protein, 13 aa, Borrelia burgdorferi
SNNNEVGKLSPLD

SEQ ID NO: 100396 - protein, 13 aa, Borrelia burgdorferi
NNNEVGKLSPLDK

SEQ ID NO: 100397 - protein, 13 aa, Borrelia burgdorferi
NNEVGKLSPLDKP

SEQ ID NO: 100398 - protein, 13 aa, Borrelia burgdorferi
NEVGKLSPLDKPS

SEQ ID NO: 100399 - protein, 13 aa, Borrelia burgdorferi
EVGKLSPLDKPSY

SEQ ID NO: 100400 - protein, 13 aa, Borrelia burgdorferi
VGKLSPLDKPSYD

SEQ ID NO: 100401 - protein, 13 aa, Borrelia burgdorferi
GKLSPLDKPSYDD

SEQ ID NO: 100402 - protein, 13 aa, Borrelia burgdorferi
KLSPLDKPSYDDI

SEQ ID NO: 100403 - protein, 13 aa, Borrelia burgdorferi
LSPLDKPSYDDID

SEQ ID NO: 100404 - protein, 13 aa, Borrelia burgdorferi
SPLDKPSYDDIDS

SEQ ID NO: 100405 - protein, 13 aa, Borrelia burgdorferi
PLDKPSYDDIDSK

SEQ ID NO: 100406 - protein, 13 aa, Borrelia burgdorferi
LDKPSYDDIDSKE

SEQ ID NO: 100407 - protein, 13 aa, Borrelia burgdorferi
DKPSYDDIDSKEE

SEQ ID NO: 100408 - protein, 13 aa, Borrelia burgdorferi
KPSYDDIDSKEEV

SEQ ID NO: 100409 - protein, 13 aa, Borrelia burgdorferi
PSYDDIDSKEEVD

SEQ ID NO: 100410 - protein, 13 aa, Borrelia burgdorferi
SYDDIDSKEEVDN

SEQ ID NO: 100411 - protein, 13 aa, Borrelia burgdorferi
YDDIDSKEEVDNK

SEQ ID NO: 100412 - protein, 13 aa, Borrelia burgdorferi
DDIDSKEEVDNKA

SEQ ID NO: 100413 - protein, 13 aa, Borrelia burgdorferi
DIDSKEEVDNKAI

SEQ ID NO: 100414 - protein, 13 aa, Borrelia burgdorferi
IDSKEEVDNKAIN

SEQ ID NO: 100415 - protein, 13 aa, Borrelia burgdorferi
DSKEEVDNKAINL

SEQ ID NO: 100416 - protein, 13 aa, Borrelia burgdorferi
SKEEVDNKAINLQ

SEQ ID NO: 100417 - protein, 13 aa, Borrelia burgdorferi
KEEVDNKAINLQK

SEQ ID NO: 100418 - protein, 13 aa, Borrelia burgdorferi
EEVDNKAINLQKI

SEQ ID NO: 100419 - protein, 13 aa, Borrelia burgdorferi
EVDNKAINLQKID

SEQ ID NO: 100420 - protein, 13 aa, Borrelia burgdorferi
VDNKAINLQKIDP

SEQ ID NO: 100421 - protein, 13 aa, Borrelia burgdorferi
DNKAINLQKIDPK

SEQ ID NO: 100422 - protein, 13 aa, Borrelia burgdorferi
NKAINLQKIDPKV

SEQ ID NO: 100423 - protein, 13 aa, Borrelia burgdorferi
KAINLQKIDPKVK

SEQ ID NO: 100424 - protein, 13 aa, Borrelia burgdorferi
AINLQKIDPKVKD

SEQ ID NO: 100425 - protein, 13 aa, Borrelia burgdorferi
INLQKIDPKVKDQ

SEQ ID NO: 100426 - protein, 13 aa, Borrelia burgdorferi
NLQKIDPKVKDQT

SEQ ID NO: 100427 - protein, 13 aa, Borrelia burgdorferi
LQKIDPKVKDQTT

SEQ ID NO: 100428 - protein, 13 aa, Borrelia burgdorferi
QKIDPKVKDQTTS

SEQ ID NO: 100429 - protein, 13 aa, Borrelia burgdorferi
KIDPKVKDQTTSL

SEQ ID NO: 100430 - protein, 13 aa, Borrelia burgdorferi
IDPKVKDQTTSLN

SEQ ID NO: 100431 - protein, 13 aa, Borrelia burgdorferi
DPKVKDQTTSLNE

SEQ ID NO: 100432 - protein, 13 aa, Borrelia burgdorferi
PKVKDQTTSLNED

SEQ ID NO: 100433 - protein, 13 aa, Borrelia burgdorferi
KVKDQTTSLNEDL

SEQ ID NO: 100434 - protein, 13 aa, Borrelia burgdorferi
VKDQTTSLNEDLD

SEQ ID NO: 100435 - protein, 13 aa, Borrelia burgdorferi
KDQTTSLNEDLDK

SEQ ID NO: 100436 - protein, 13 aa, Borrelia burgdorferi
DQTTSLNEDLDKD

SEQ ID NO: 100437 - protein, 13 aa, Borrelia burgdorferi
QTTSLNEDLDKDL

SEQ ID NO: 100438 - protein, 13 aa, Borrelia burgdorferi
TTSLNEDLDKDLT

SEQ ID NO: 100439 - protein, 13 aa, Borrelia burgdorferi
TSLNEDLDKDLTT

SEQ ID NO: 100440 - protein, 13 aa, Borrelia burgdorferi
SLNEDLDKDLTTM

SEQ ID NO: 100441 - protein, 13 aa, Borrelia burgdorferi
LNEDLDKDLTTMS

SEQ ID NO: 100442 - protein, 13 aa, Borrelia burgdorferi
NEDLDKDLTTMSI

SEQ ID NO: 100443 - protein, 13 aa, Borrelia burgdorferi
EDLDKDLTTMSID

SEQ ID NO: 100444 - protein, 13 aa, Borrelia burgdorferi
DLDKDLTTMSIDS

SEQ ID NO: 100445 - protein, 13 aa, Borrelia burgdorferi
LDKDLTTMSIDSS

SEQ ID NO: 100446 - protein, 13 aa, Borrelia burgdorferi
DKDLTTMSIDSSS

SEQ ID NO: 100447 - protein, 13 aa, Borrelia burgdorferi
KDLTTMSIDSSSP

SEQ ID NO: 100448 - protein, 13 aa, Borrelia burgdorferi
DLTTMSIDSSSPV

SEQ ID NO: 100449 - protein, 13 aa, Borrelia burgdorferi
LTTMSIDSSSPVF

SEQ ID NO: 100450 - protein, 13 aa, Borrelia burgdorferi
TTMSIDSSSPVFL

SEQ ID NO: 100451 - protein, 13 aa, Borrelia burgdorferi
TMSIDSSSPVFLE

SEQ ID NO: 100452 - protein, 13 aa, Borrelia burgdorferi
MSIDSSSPVFLEV

SEQ ID NO: 100453 - protein, 13 aa, Borrelia burgdorferi
SIDSSSPVFLEVI

SEQ ID NO: 100454 - protein, 13 aa, Borrelia burgdorferi
IDSSSPVFLEVID

SEQ ID NO: 100455 - protein, 13 aa, Borrelia burgdorferi
DSSSPVFLEVIDP

SEQ ID NO: 100456 - protein, 13 aa, Borrelia burgdorferi
SSSPVFLEVIDPI

SEQ ID NO: 100457 - protein, 13 aa, Borrelia burgdorferi
SSPVFLEVIDPIT

SEQ ID NO: 100458 - protein, 13 aa, Borrelia burgdorferi
SPVFLEVIDPITN

SEQ ID NO: 100459 - protein, 13 aa, Borrelia burgdorferi
PVFLEVIDPITNL

SEQ ID NO: 100460 - protein, 13 aa, Borrelia burgdorferi
VFLEVIDPITNLG

SEQ ID NO: 100461 - protein, 13 aa, Borrelia burgdorferi
FLEVIDPITNLGT

SEQ ID NO: 100462 - protein, 13 aa, Borrelia burgdorferi
LEVIDPITNLGTL

SEQ ID NO: 100463 - protein, 13 aa, Borrelia burgdorferi
EVIDPITNLGTLQ

SEQ ID NO: 100464 - protein, 13 aa, Borrelia burgdorferi
VIDPITNLGTLQL

SEQ ID NO: 100465 - protein, 13 aa, Borrelia burgdorferi
IDPITNLGTLQLI

SEQ ID NO: 100466 - protein, 13 aa, Borrelia burgdorferi
DPITNLGTLQLID

SEQ ID NO: 100467 - protein, 13 aa, Borrelia burgdorferi
PITNLGTLQLIDL

SEQ ID NO: 100468 - protein, 13 aa, Borrelia burgdorferi
ITNLGTLQLIDLN

SEQ ID NO: 100469 - protein, 13 aa, Borrelia burgdorferi
TNLGTLQLIDLNT

SEQ ID NO: 100470 - protein, 13 aa, Borrelia burgdorferi
NLGTLQLIDLNTG

SEQ ID NO: 100471 - protein, 13 aa, Borrelia burgdorferi
LGTLQLIDLNTGV

SEQ ID NO: 100472 - protein, 13 aa, Borrelia burgdorferi
GTLQLIDLNTGVR

SEQ ID NO: 100473 - protein, 13 aa, Borrelia burgdorferi
TLQLIDLNTGVRL

SEQ ID NO: 100474 - protein, 13 aa, Borrelia burgdorferi
LQLIDLNTGVRLK

SEQ ID NO: 100475 - protein, 13 aa, Borrelia burgdorferi
QLIDLNTGVRLKE

SEQ ID NO: 100476 - protein, 13 aa, Borrelia burgdorferi
LIDLNTGVRLKES

SEQ ID NO: 100477 - protein, 13 aa, Borrelia burgdorferi
IDLNTGVRLKEST

SEQ ID NO: 100478 - protein, 13 aa, Borrelia burgdorferi
DLNTGVRLKESTQ

SEQ ID NO: 100479 - protein, 13 aa, Borrelia burgdorferi
LNTGVRLKESTQQ

SEQ ID NO: 100480 - protein, 13 aa, Borrelia burgdorferi
NTGVRLKESTQQG

SEQ ID NO: 100481 - protein, 13 aa, Borrelia burgdorferi
TGVRLKESTQQGI

SEQ ID NO: 100482 - protein, 13 aa, Borrelia burgdorferi
GVRLKESTQQGIQ

SEQ ID NO: 100483 - protein, 13 aa, Borrelia burgdorferi
VRLKESTQQGIQR

SEQ ID NO: 100484 - protein, 13 aa, Borrelia burgdorferi
RLKESTQQGIQRY

SEQ ID NO: 100485 - protein, 13 aa, Borrelia burgdorferi
LKESTQQGIQRYG

SEQ ID NO: 100486 - protein, 13 aa, Borrelia burgdorferi
KESTQQGIQRYGI

SEQ ID NO: 100487 - protein, 13 aa, Borrelia burgdorferi
ESTQQGIQRYGIY

SEQ ID NO: 100488 - protein, 13 aa, Borrelia burgdorferi
STQQGIQRYGIYE

SEQ ID NO: 100489 - protein, 13 aa, Borrelia burgdorferi
TQQGIQRYGIYER

SEQ ID NO: 100490 - protein, 13 aa, Borrelia burgdorferi
QQGIQRYGIYERE

SEQ ID NO: 100491 - protein, 13 aa, Borrelia burgdorferi
QGIQRYGIYEREK

SEQ ID NO: 100492 - protein, 13 aa, Borrelia burgdorferi
GIQRYGIYEREKD

SEQ ID NO: 100493 - protein, 13 aa, Borrelia burgdorferi
IQRYGIYEREKDL

SEQ ID NO: 100494 - protein, 13 aa, Borrelia burgdorferi
QRYGIYEREKDLV

SEQ ID NO: 100495 - protein, 13 aa, Borrelia burgdorferi
RYGIYEREKDLVV

SEQ ID NO: 100496 - protein, 13 aa, Borrelia burgdorferi
YGIYEREKDLVVI

SEQ ID NO: 100497 - protein, 13 aa, Borrelia burgdorferi
GIYEREKDLVVIK

SEQ ID NO: 100498 - protein, 13 aa, Borrelia burgdorferi
IYEREKDLVVIKM

SEQ ID NO: 100499 - protein, 13 aa, Borrelia burgdorferi
YEREKDLVVIKMD

SEQ ID NO: 100500 - protein, 13 aa, Borrelia burgdorferi
EREKDLVVIKMDS

SEQ ID NO: 100501 - protein, 13 aa, Borrelia burgdorferi
REKDLVVIKMDSG

SEQ ID NO: 100502 - protein, 13 aa, Borrelia burgdorferi
EKDLVVIKMDSGK

SEQ ID NO: 100503 - protein, 13 aa, Borrelia burgdorferi
KDLVVIKMDSGKA

SEQ ID NO: 100504 - protein, 13 aa, Borrelia burgdorferi
DLVVIKMDSGKAK

SEQ ID NO: 100505 - protein, 13 aa, Borrelia burgdorferi
LVVIKMDSGKAKL

SEQ ID NO: 100506 - protein, 13 aa, Borrelia burgdorferi
VVIKMDSGKAKLQ

SEQ ID NO: 100507 - protein, 13 aa, Borrelia burgdorferi
VIKMDSGKAKLQI

SEQ ID NO: 100508 - protein, 13 aa, Borrelia burgdorferi
IKMDSGKAKLQIL

SEQ ID NO: 100509 - protein, 13 aa, Borrelia burgdorferi
KMDSGKAKLQILN

SEQ ID NO: 100510 - protein, 13 aa, Borrelia burgdorferi
MDSGKAKLQILNK

SEQ ID NO: 100511 - protein, 13 aa, Borrelia burgdorferi
DSGKAKLQILNKL

SEQ ID NO: 100512 - protein, 13 aa, Borrelia burgdorferi
SGKAKLQILNKLE

SEQ ID NO: 100513 - protein, 13 aa, Borrelia burgdorferi
GKAKLQILNKLEN

SEQ ID NO: 100514 - protein, 13 aa, Borrelia burgdorferi
KAKLQILNKLENL

SEQ ID NO: 100515 - protein, 13 aa, Borrelia burgdorferi
AKLQILNKLENLK

SEQ ID NO: 100516 - protein, 13 aa, Borrelia burgdorferi
KLQILNKLENLKV

SEQ ID NO: 100517 - protein, 13 aa, Borrelia burgdorferi
LQILNKLENLKVV

SEQ ID NO: 100518 - protein, 13 aa, Borrelia burgdorferi
QILNKLENLKVVS

SEQ ID NO: 100519 - protein, 13 aa, Borrelia burgdorferi
ILNKLENLKVVSE

SEQ ID NO: 100520 - protein, 13 aa, Borrelia burgdorferi
LNKLENLKVVSES

SEQ ID NO: 100521 - protein, 13 aa, Borrelia burgdorferi
NKLENLKVVSESN

SEQ ID NO: 100522 - protein, 13 aa, Borrelia burgdorferi
KLENLKVVSESNF

SEQ ID NO: 100523 - protein, 13 aa, Borrelia burgdorferi
LENLKVVSESNFE

SEQ ID NO: 100524 - protein, 13 aa, Borrelia burgdorferi
ENLKVVSESNFEI

SEQ ID NO: 100525 - protein, 13 aa, Borrelia burgdorferi
NLKVVSESNFEIN

SEQ ID NO: 100526 - protein, 13 aa, Borrelia burgdorferi
LKVVSESNFEINK

SEQ ID NO: 100527 - protein, 13 aa, Borrelia burgdorferi
KVVSESNFEINKN

SEQ ID NO: 100528 - protein, 13 aa, Borrelia burgdorferi
VVSESNFEINKNS

SEQ ID NO: 100529 - protein, 13 aa, Borrelia burgdorferi
VSESNFEINKNSS

SEQ ID NO: 100530 - protein, 13 aa, Borrelia burgdorferi
SESNFEINKNSSL

SEQ ID NO: 100531 - protein, 13 aa, Borrelia burgdorferi
ESNFEINKNSSLY

SEQ ID NO: 100532 - protein, 13 aa, Borrelia burgdorferi
SNFEINKNSSLYV

SEQ ID NO: 100533 - protein, 13 aa, Borrelia burgdorferi
NFEINKNSSLYVD

SEQ ID NO: 100534 - protein, 13 aa, Borrelia burgdorferi
FEINKNSSLYVDS

SEQ ID NO: 100535 - protein, 13 aa, Borrelia burgdorferi
EINKNSSLYVDSK

SEQ ID NO: 100536 - protein, 13 aa, Borrelia burgdorferi
INKNSSLYVDSKM

SEQ ID NO: 100537 - protein, 13 aa, Borrelia burgdorferi
NKNSSLYVDSKMI

SEQ ID NO: 100538 - protein, 13 aa, Borrelia burgdorferi
KNSSLYVDSKMIL

SEQ ID NO: 100539 - protein, 13 aa, Borrelia burgdorferi
NSSLYVDSKMILA

SEQ ID NO: 100540 - protein, 13 aa, Borrelia burgdorferi
SSLYVDSKMILAA

SEQ ID NO: 100541 - protein, 13 aa, Borrelia burgdorferi
SLYVDSKMILAAV

SEQ ID NO: 100542 - protein, 13 aa, Borrelia burgdorferi
LYVDSKMILAAVR

SEQ ID NO: 100543 - protein, 13 aa, Borrelia burgdorferi
YVDSKMILAAVRD

SEQ ID NO: 100544 - protein, 13 aa, Borrelia burgdorferi
VDSKMILAAVRDK

SEQ ID NO: 100545 - protein, 13 aa, Borrelia burgdorferi
DSKMILAAVRDKD

SEQ ID NO: 100546 - protein, 13 aa, Borrelia burgdorferi
SKMILAAVRDKDD

SEQ ID NO: 100547 - protein, 13 aa, Borrelia burgdorferi
KMILAAVRDKDDS

SEQ ID NO: 100548 - protein, 13 aa, Borrelia burgdorferi
MILAAVRDKDDSN

SEQ ID NO: 100549 - protein, 13 aa, Borrelia burgdorferi
ILAAVRDKDDSNA

SEQ ID NO: 100550 - protein, 13 aa, Borrelia burgdorferi
LAAVRDKDDSNAW

SEQ ID NO: 100551 - protein, 13 aa, Borrelia burgdorferi
AAVRDKDDSNAWR

SEQ ID NO: 100552 - protein, 13 aa, Borrelia burgdorferi
AVRDKDDSNAWRL

SEQ ID NO: 100553 - protein, 13 aa, Borrelia burgdorferi
VRDKDDSNAWRLA

SEQ ID NO: 100554 - protein, 13 aa, Borrelia burgdorferi
RDKDDSNAWRLAK

SEQ ID NO: 100555 - protein, 13 aa, Borrelia burgdorferi
DKDDSNAWRLAKF

SEQ ID NO: 100556 - protein, 13 aa, Borrelia burgdorferi
KDDSNAWRLAKFS

SEQ ID NO: 100557 - protein, 13 aa, Borrelia burgdorferi
DDSNAWRLAKFSP

SEQ ID NO: 100558 - protein, 13 aa, Borrelia burgdorferi
DSNAWRLAKFSPK

SEQ ID NO: 100559 - protein, 13 aa, Borrelia burgdorferi
SNAWRLAKFSPKN

SEQ ID NO: 100560 - protein, 13 aa, Borrelia burgdorferi
NAWRLAKFSPKNL

SEQ ID NO: 100561 - protein, 13 aa, Borrelia burgdorferi
AWRLAKFSPKNLD

SEQ ID NO: 100562 - protein, 13 aa, Borrelia burgdorferi
WRLAKFSPKNLDE

SEQ ID NO: 100563 - protein, 13 aa, Borrelia burgdorferi
RLAKFSPKNLDEF

SEQ ID NO: 100564 - protein, 13 aa, Borrelia burgdorferi
LAKFSPKNLDEFI

SEQ ID NO: 100565 - protein, 13 aa, Borrelia burgdorferi
AKFSPKNLDEFIL

SEQ ID NO: 100566 - protein, 13 aa, Borrelia burgdorferi
KFSPKNLDEFILS

SEQ ID NO: 100567 - protein, 13 aa, Borrelia burgdorferi
FSPKNLDEFILSE

SEQ ID NO: 100568 - protein, 13 aa, Borrelia burgdorferi
SPKNLDEFILSEN

SEQ ID NO: 100569 - protein, 13 aa, Borrelia burgdorferi
PKNLDEFILSENK

SEQ ID NO: 100570 - protein, 13 aa, Borrelia burgdorferi
KNLDEFILSENKI

SEQ ID NO: 100571 - protein, 13 aa, Borrelia burgdorferi
NLDEFILSENKIL

SEQ ID NO: 100572 - protein, 13 aa, Borrelia burgdorferi
LDEFILSENKILP

SEQ ID NO: 100573 - protein, 13 aa, Borrelia burgdorferi
DEFILSENKILPF

SEQ ID NO: 100574 - protein, 13 aa, Borrelia burgdorferi
EFILSENKILPFT

SEQ ID NO: 100575 - protein, 13 aa, Borrelia burgdorferi
FILSENKILPFTS

SEQ ID NO: 100576 - protein, 13 aa, Borrelia burgdorferi
ILSENKILPFTSF

SEQ ID NO: 100577 - protein, 13 aa, Borrelia burgdorferi
LSENKILPFTSFS

SEQ ID NO: 100578 - protein, 13 aa, Borrelia burgdorferi
SENKILPFTSFSV

SEQ ID NO: 100579 - protein, 13 aa, Borrelia burgdorferi
ENKILPFTSFSVR

SEQ ID NO: 100580 - protein, 13 aa, Borrelia burgdorferi
NKILPFTSFSVRK

SEQ ID NO: 100581 - protein, 13 aa, Borrelia burgdorferi
KILPFTSFSVRKN

SEQ ID NO: 100582 - protein, 13 aa, Borrelia burgdorferi
ILPFTSFSVRKNF

SEQ ID NO: 100583 - protein, 13 aa, Borrelia burgdorferi
LPFTSFSVRKNFI

SEQ ID NO: 100584 - protein, 13 aa, Borrelia burgdorferi
PFTSFSVRKNFIY

SEQ ID NO: 100585 - protein, 13 aa, Borrelia burgdorferi
FTSFSVRKNFIYL

SEQ ID NO: 100586 - protein, 13 aa, Borrelia burgdorferi
TSFSVRKNFIYLQ

SEQ ID NO: 100587 - protein, 13 aa, Borrelia burgdorferi
SFSVRKNFIYLQD

SEQ ID NO: 100588 - protein, 13 aa, Borrelia burgdorferi
FSVRKNFIYLQDE

SEQ ID NO: 100589 - protein, 13 aa, Borrelia burgdorferi
SVRKNFIYLQDEL

SEQ ID NO: 100590 - protein, 13 aa, Borrelia burgdorferi
VRKNFIYLQDELK

SEQ ID NO: 100591 - protein, 13 aa, Borrelia burgdorferi
RKNFIYLQDELKN

SEQ ID NO: 100592 - protein, 13 aa, Borrelia burgdorferi
KNFIYLQDELKNL

SEQ ID NO: 100593 - protein, 13 aa, Borrelia burgdorferi
NFIYLQDELKNLV

SEQ ID NO: 100594 - protein, 13 aa, Borrelia burgdorferi
FIYLQDELKNLVI

SEQ ID NO: 100595 - protein, 13 aa, Borrelia burgdorferi
IYLQDELKNLVIL

SEQ ID NO: 100596 - protein, 13 aa, Borrelia burgdorferi
YLQDELKNLVILD

SEQ ID NO: 100597 - protein, 13 aa, Borrelia burgdorferi
LQDELKNLVILDV

SEQ ID NO: 100598 - protein, 13 aa, Borrelia burgdorferi
QDELKNLVILDVN

SEQ ID NO: 100599 - protein, 13 aa, Borrelia burgdorferi
DELKNLVILDVNT

SEQ ID NO: 100600 - protein, 13 aa, Borrelia burgdorferi
ELKNLVILDVNTL

SEQ ID NO: 100601 - protein, 13 aa, Borrelia burgdorferi
LKNLVILDVNTLK

SEQ ID NO: 100602 - protein, 13 aa, Borrelia burgdorferi
KNLVILDVNTLKK

SEQ ID NO: 100603 - protein, 13 aa, Borrelia burgdorferi
NLVILDVNTLKKV

SEQ ID NO: 100604 - protein, 13 aa, Borrelia burgdorferi
LVILDVNTLKKVK

SEQ ID NO: 100605 - protein, 14 aa, Borrelia burgdorferi
MKKMLLIFSFFLIF

SEQ ID NO: 100606 - protein, 14 aa, Borrelia burgdorferi
KKMLLIFSFFLIFL

SEQ ID NO: 100607 - protein, 14 aa, Borrelia burgdorferi
KMLLIFSFFLIFLN

SEQ ID NO: 100608 - protein, 14 aa, Borrelia burgdorferi
MLLIFSFFLIFLNG

SEQ ID NO: 100609 - protein, 14 aa, Borrelia burgdorferi
LLIFSFFLIFLNGF

SEQ ID NO: 100610 - protein, 14 aa, Borrelia burgdorferi
LIFSFFLIFLNGFP

SEQ ID NO: 100611 - protein, 14 aa, Borrelia burgdorferi
IFSFFLIFLNGFPL

SEQ ID NO: 100612 - protein, 14 aa, Borrelia burgdorferi
FSFFLIFLNGFPLN

SEQ ID NO: 100613 - protein, 14 aa, Borrelia burgdorferi
SFFLIFLNGFPLNA

SEQ ID NO: 100614 - protein, 14 aa, Borrelia burgdorferi
FFLIFLNGFPLNAR

SEQ ID NO: 100615 - protein, 14 aa, Borrelia burgdorferi
FLIFLNGFPLNARK

SEQ ID NO: 100616 - protein, 14 aa, Borrelia burgdorferi
LIFLNGFPLNARKV

SEQ ID NO: 100617 - protein, 14 aa, Borrelia burgdorferi
IFLNGFPLNARKVD

SEQ ID NO: 100618 - protein, 14 aa, Borrelia burgdorferi
FLNGFPLNARKVDK

SEQ ID NO: 100619 - protein, 14 aa, Borrelia burgdorferi
LNGFPLNARKVDKE

SEQ ID NO: 100620 - protein, 14 aa, Borrelia burgdorferi
NGFPLNARKVDKEK

SEQ ID NO: 100621 - protein, 14 aa, Borrelia burgdorferi
GFPLNARKVDKEKL

SEQ ID NO: 100622 - protein, 14 aa, Borrelia burgdorferi
FPLNARKVDKEKLK

SEQ ID NO: 100623 - protein, 14 aa, Borrelia burgdorferi
PLNARKVDKEKLKD

SEQ ID NO: 100624 - protein, 14 aa, Borrelia burgdorferi
LNARKVDKEKLKDF

SEQ ID NO: 100625 - protein, 14 aa, Borrelia burgdorferi
NARKVDKEKLKDFV

SEQ ID NO: 100626 - protein, 14 aa, Borrelia burgdorferi
ARKVDKEKLKDFVN

SEQ ID NO: 100627 - protein, 14 aa, Borrelia burgdorferi
RKVDKEKLKDFVNM

SEQ ID NO: 100628 - protein, 14 aa, Borrelia burgdorferi
KVDKEKLKDFVNMD

SEQ ID NO: 100629 - protein, 14 aa, Borrelia burgdorferi
VDKEKLKDFVNMDL

SEQ ID NO: 100630 - protein, 14 aa, Borrelia burgdorferi
DKEKLKDFVNMDLE

SEQ ID NO: 100631 - protein, 14 aa, Borrelia burgdorferi
KEKLKDFVNMDLEF

SEQ ID NO: 100632 - protein, 14 aa, Borrelia burgdorferi
EKLKDFVNMDLEFV

SEQ ID NO: 100633 - protein, 14 aa, Borrelia burgdorferi
KLKDFVNMDLEFVN

SEQ ID NO: 100634 - protein, 14 aa, Borrelia burgdorferi
LKDFVNMDLEFVNY

SEQ ID NO: 100635 - protein, 14 aa, Borrelia burgdorferi
KDFVNMDLEFVNYK

SEQ ID NO: 100636 - protein, 14 aa, Borrelia burgdorferi
DFVNMDLEFVNYKG

SEQ ID NO: 100637 - protein, 14 aa, Borrelia burgdorferi
FVNMDLEFVNYKGP

SEQ ID NO: 100638 - protein, 14 aa, Borrelia burgdorferi
VNMDLEFVNYKGPY

SEQ ID NO: 100639 - protein, 14 aa, Borrelia burgdorferi
NMDLEFVNYKGPYD

SEQ ID NO: 100640 - protein, 14 aa, Borrelia burgdorferi
MDLEFVNYKGPYDS

SEQ ID NO: 100641 - protein, 14 aa, Borrelia burgdorferi
DLEFVNYKGPYDST

SEQ ID NO: 100642 - protein, 14 aa, Borrelia burgdorferi
LEFVNYKGPYDSTN

SEQ ID NO: 100643 - protein, 14 aa, Borrelia burgdorferi
EFVNYKGPYDSTNT

SEQ ID NO: 100644 - protein, 14 aa, Borrelia burgdorferi
FVNYKGPYDSTNTY

SEQ ID NO: 100645 - protein, 14 aa, Borrelia burgdorferi
VNYKGPYDSTNTYE

SEQ ID NO: 100646 - protein, 14 aa, Borrelia burgdorferi
NYKGPYDSTNTYEQ

SEQ ID NO: 100647 - protein, 14 aa, Borrelia burgdorferi
YKGPYDSTNTYEQI

SEQ ID NO: 100648 - protein, 14 aa, Borrelia burgdorferi
KGPYDSTNTYEQIV

SEQ ID NO: 100649 - protein, 14 aa, Borrelia burgdorferi
GPYDSTNTYEQIVG

SEQ ID NO: 100650 - protein, 14 aa, Borrelia burgdorferi
PYDSTNTYEQIVGI

SEQ ID NO: 100651 - protein, 14 aa, Borrelia burgdorferi
YDSTNTYEQIVGIG

SEQ ID NO: 100652 - protein, 14 aa, Borrelia burgdorferi
DSTNTYEQIVGIGE

SEQ ID NO: 100653 - protein, 14 aa, Borrelia burgdorferi
STNTYEQIVGIGEF

SEQ ID NO: 100654 - protein, 14 aa, Borrelia burgdorferi
TNTYEQIVGIGEFL

SEQ ID NO: 100655 - protein, 14 aa, Borrelia burgdorferi
NTYEQIVGIGEFLA

SEQ ID NO: 100656 - protein, 14 aa, Borrelia burgdorferi
TYEQIVGIGEFLAR

SEQ ID NO: 100657 - protein, 14 aa, Borrelia burgdorferi
YEQIVGIGEFLARP

SEQ ID NO: 100658 - protein, 14 aa, Borrelia burgdorferi
EQIVGIGEFLARPL

SEQ ID NO: 100659 - protein, 14 aa, Borrelia burgdorferi
QIVGIGEFLARPLT

SEQ ID NO: 100660 - protein, 14 aa, Borrelia burgdorferi
IVGIGEFLARPLTN

SEQ ID NO: 100661 - protein, 14 aa, Borrelia burgdorferi
VGIGEFLARPLTNS

SEQ ID NO: 100662 - protein, 14 aa, Borrelia burgdorferi
GIGEFLARPLTNSN

SEQ ID NO: 100663 - protein, 14 aa, Borrelia burgdorferi
IGEFLARPLTNSNS

SEQ ID NO: 100664 - protein, 14 aa, Borrelia burgdorferi
GEFLARPLTNSNSN

SEQ ID NO: 100665 - protein, 14 aa, Borrelia burgdorferi
EFLARPLTNSNSNS

SEQ ID NO: 100666 - protein, 14 aa, Borrelia burgdorferi
FLARPLTNSNSNSS

SEQ ID NO: 100667 - protein, 14 aa, Borrelia burgdorferi
LARPLTNSNSNSSY

SEQ ID NO: 100668 - protein, 14 aa, Borrelia burgdorferi
ARPLTNSNSNSSYY

SEQ ID NO: 100669 - protein, 14 aa, Borrelia burgdorferi
RPLTNSNSNSSYYG

SEQ ID NO: 100670 - protein, 14 aa, Borrelia burgdorferi
PLTNSNSNSSYYGK

SEQ ID NO: 100671 - protein, 14 aa, Borrelia burgdorferi
LTNSNSNSSYYGKY

SEQ ID NO: 100672 - protein, 14 aa, Borrelia burgdorferi
TNSNSNSSYYGKYF

SEQ ID NO: 100673 - protein, 14 aa, Borrelia burgdorferi
NSNSNSSYYGKYFI

SEQ ID NO: 100674 - protein, 14 aa, Borrelia burgdorferi
SNSNSSYYGKYFIN

SEQ ID NO: 100675 - protein, 14 aa, Borrelia burgdorferi
NSNSSYYGKYFINR

SEQ ID NO: 100676 - protein, 14 aa, Borrelia burgdorferi
SNSSYYGKYFINRF

SEQ ID NO: 100677 - protein, 14 aa, Borrelia burgdorferi
NSSYYGKYFINRFI

SEQ ID NO: 100678 - protein, 14 aa, Borrelia burgdorferi
SSYYGKYFINRFID

SEQ ID NO: 100679 - protein, 14 aa, Borrelia burgdorferi
SYYGKYFINRFIDD

SEQ ID NO: 100680 - protein, 14 aa, Borrelia burgdorferi
YYGKYFINRFIDDQ

SEQ ID NO: 100681 - protein, 14 aa, Borrelia burgdorferi
YGKYFINRFIDDQD

SEQ ID NO: 100682 - protein, 14 aa, Borrelia burgdorferi
GKYFINRFIDDQDK

SEQ ID NO: 100683 - protein, 14 aa, Borrelia burgdorferi
KYFINRFIDDQDKK

SEQ ID NO: 100684 - protein, 14 aa, Borrelia burgdorferi
YFINRFIDDQDKKA

SEQ ID NO: 100685 - protein, 14 aa, Borrelia burgdorferi
FINRFIDDQDKKAS

SEQ ID NO: 100686 - protein, 14 aa, Borrelia burgdorferi
INRFIDDQDKKASV

SEQ ID NO: 100687 - protein, 14 aa, Borrelia burgdorferi
NRFIDDQDKKASVD

SEQ ID NO: 100688 - protein, 14 aa, Borrelia burgdorferi
RFIDDQDKKASVDV

SEQ ID NO: 100689 - protein, 14 aa, Borrelia burgdorferi
FIDDQDKKASVDVF

SEQ ID NO: 100690 - protein, 14 aa, Borrelia burgdorferi
IDDQDKKASVDVFS

SEQ ID NO: 100691 - protein, 14 aa, Borrelia burgdorferi
DDQDKKASVDVFSI

SEQ ID NO: 100692 - protein, 14 aa, Borrelia burgdorferi
DQDKKASVDVFSIS

SEQ ID NO: 100693 - protein, 14 aa, Borrelia burgdorferi
QDKKASVDVFSISS

SEQ ID NO: 100694 - protein, 14 aa, Borrelia burgdorferi
DKKASVDVFSISSK

SEQ ID NO: 100695 - protein, 14 aa, Borrelia burgdorferi
KKASVDVFSISSKS

SEQ ID NO: 100696 - protein, 14 aa, Borrelia burgdorferi
KASVDVFSISSKSE

SEQ ID NO: 100697 - protein, 14 aa, Borrelia burgdorferi
ASVDVFSISSKSEL

SEQ ID NO: 100698 - protein, 14 aa, Borrelia burgdorferi
SVDVFSISSKSELD

SEQ ID NO: 100699 - protein, 14 aa, Borrelia burgdorferi
VDVFSISSKSELDS

SEQ ID NO: 100700 - protein, 14 aa, Borrelia burgdorferi
DVFSISSKSELDSI

SEQ ID NO: 100701 - protein, 14 aa, Borrelia burgdorferi
VFSISSKSELDSIL

SEQ ID NO: 100702 - protein, 14 aa, Borrelia burgdorferi
FSISSKSELDSILN

SEQ ID NO: 100703 - protein, 14 aa, Borrelia burgdorferi
SISSKSELDSILNL

SEQ ID NO: 100704 - protein, 14 aa, Borrelia burgdorferi
ISSKSELDSILNLR

SEQ ID NO: 100705 - protein, 14 aa, Borrelia burgdorferi
SSKSELDSILNLRR

SEQ ID NO: 100706 - protein, 14 aa, Borrelia burgdorferi
SKSELDSILNLRRI

SEQ ID NO: 100707 - protein, 14 aa, Borrelia burgdorferi
KSELDSILNLRRIL

SEQ ID NO: 100708 - protein, 14 aa, Borrelia burgdorferi
SELDSILNLRRILT

SEQ ID NO: 100709 - protein, 14 aa, Borrelia burgdorferi
ELDSILNLRRILTG

SEQ ID NO: 100710 - protein, 14 aa, Borrelia burgdorferi
LDSILNLRRILTGY

SEQ ID NO: 100711 - protein, 14 aa, Borrelia burgdorferi
DSILNLRRILTGYI

SEQ ID NO: 100712 - protein, 14 aa, Borrelia burgdorferi
SILNLRRILTGYII

SEQ ID NO: 100713 - protein, 14 aa, Borrelia burgdorferi
ILNLRRILTGYIIK

SEQ ID NO: 100714 - protein, 14 aa, Borrelia burgdorferi
LNLRRILTGYIIKS

SEQ ID NO: 100715 - protein, 14 aa, Borrelia burgdorferi
NLRRILTGYIIKSF

SEQ ID NO: 100716 - protein, 14 aa, Borrelia burgdorferi
LRRILTGYIIKSFD

SEQ ID NO: 100717 - protein, 14 aa, Borrelia burgdorferi
RRILTGYIIKSFDY

SEQ ID NO: 100718 - protein, 14 aa, Borrelia burgdorferi
RILTGYIIKSFDYD

SEQ ID NO: 100719 - protein, 14 aa, Borrelia burgdorferi
ILTGYIIKSFDYDR

SEQ ID NO: 100720 - protein, 14 aa, Borrelia burgdorferi
LTGYIIKSFDYDRS

SEQ ID NO: 100721 - protein, 14 aa, Borrelia burgdorferi
TGYIIKSFDYDRSS

SEQ ID NO: 100722 - protein, 14 aa, Borrelia burgdorferi
GYIIKSFDYDRSSA

SEQ ID NO: 100723 - protein, 14 aa, Borrelia burgdorferi
YIIKSFDYDRSSAE

SEQ ID NO: 100724 - protein, 14 aa, Borrelia burgdorferi
IIKSFDYDRSSAEL

SEQ ID NO: 100725 - protein, 14 aa, Borrelia burgdorferi
IKSFDYDRSSAELI

SEQ ID NO: 100726 - protein, 14 aa, Borrelia burgdorferi
KSFDYDRSSAELIA

SEQ ID NO: 100727 - protein, 14 aa, Borrelia burgdorferi
SFDYDRSSAELIAK

SEQ ID NO: 100728 - protein, 14 aa, Borrelia burgdorferi
FDYDRSSAELIAKV

SEQ ID NO: 100729 - protein, 14 aa, Borrelia burgdorferi
DYDRSSAELIAKVI

SEQ ID NO: 100730 - protein, 14 aa, Borrelia burgdorferi
YDRSSAELIAKVIT

SEQ ID NO: 100731 - protein, 14 aa, Borrelia burgdorferi
DRSSAELIAKVITI

SEQ ID NO: 100732 - protein, 14 aa, Borrelia burgdorferi
RSSAELIAKVITIY

SEQ ID NO: 100733 - protein, 14 aa, Borrelia burgdorferi
SSAELIAKVITIYN

SEQ ID NO: 100734 - protein, 14 aa, Borrelia burgdorferi
SAELIAKVITIYNA

SEQ ID NO: 100735 - protein, 14 aa, Borrelia burgdorferi
AELIAKVITIYNAV

SEQ ID NO: 100736 - protein, 14 aa, Borrelia burgdorferi
ELIAKVITIYNAVY

SEQ ID NO: 100737 - protein, 14 aa, Borrelia burgdorferi
LIAKVITIYNAVYR

SEQ ID NO: 100738 - protein, 14 aa, Borrelia burgdorferi
IAKVITIYNAVYRG

SEQ ID NO: 100739 - protein, 14 aa, Borrelia burgdorferi
AKVITIYNAVYRGD

SEQ ID NO: 100740 - protein, 14 aa, Borrelia burgdorferi
KVITIYNAVYRGDL

SEQ ID NO: 100741 - protein, 14 aa, Borrelia burgdorferi
VITIYNAVYRGDLD

SEQ ID NO: 100742 - protein, 14 aa, Borrelia burgdorferi
ITIYNAVYRGDLDY

SEQ ID NO: 100743 - protein, 14 aa, Borrelia burgdorferi
TIYNAVYRGDLDYY

SEQ ID NO: 100744 - protein, 14 aa, Borrelia burgdorferi
IYNAVYRGDLDYYK

SEQ ID NO: 100745 - protein, 14 aa, Borrelia burgdorferi
YNAVYRGDLDYYKG

SEQ ID NO: 100746 - protein, 14 aa, Borrelia burgdorferi
NAVYRGDLDYYKGF

SEQ ID NO: 100747 - protein, 14 aa, Borrelia burgdorferi
AVYRGDLDYYKGFY

SEQ ID NO: 100748 - protein, 14 aa, Borrelia burgdorferi
VYRGDLDYYKGFYI

SEQ ID NO: 100749 - protein, 14 aa, Borrelia burgdorferi
YRGDLDYYKGFYIE

SEQ ID NO: 100750 - protein, 14 aa, Borrelia burgdorferi
RGDLDYYKGFYIEP

SEQ ID NO: 100751 - protein, 14 aa, Borrelia burgdorferi
GDLDYYKGFYIEPA

SEQ ID NO: 100752 - protein, 14 aa, Borrelia burgdorferi
DLDYYKGFYIEPAL

SEQ ID NO: 100753 - protein, 14 aa, Borrelia burgdorferi
LDYYKGFYIEPALK

SEQ ID NO: 100754 - protein, 14 aa, Borrelia burgdorferi
DYYKGFYIEPALKS

SEQ ID NO: 100755 - protein, 14 aa, Borrelia burgdorferi
YYKGFYIEPALKSL

SEQ ID NO: 100756 - protein, 14 aa, Borrelia burgdorferi
YKGFYIEPALKSLT

SEQ ID NO: 100757 - protein, 14 aa, Borrelia burgdorferi
KGFYIEPALKSLTK

SEQ ID NO: 100758 - protein, 14 aa, Borrelia burgdorferi
GFYIEPALKSLTKE

SEQ ID NO: 100759 - protein, 14 aa, Borrelia burgdorferi
FYIEPALKSLTKEN

SEQ ID NO: 100760 - protein, 14 aa, Borrelia burgdorferi
YIEPALKSLTKENA

SEQ ID NO: 100761 - protein, 14 aa, Borrelia burgdorferi
IEPALKSLTKENAG

SEQ ID NO: 100762 - protein, 14 aa, Borrelia burgdorferi
EPALKSLTKENAGL

SEQ ID NO: 100763 - protein, 14 aa, Borrelia burgdorferi
PALKSLTKENAGLS

SEQ ID NO: 100764 - protein, 14 aa, Borrelia burgdorferi
ALKSLTKENAGLSR

SEQ ID NO: 100765 - protein, 14 aa, Borrelia burgdorferi
LKSLTKENAGLSRV

SEQ ID NO: 100766 - protein, 14 aa, Borrelia burgdorferi
KSLTKENAGLSRVY

SEQ ID NO: 100767 - protein, 14 aa, Borrelia burgdorferi
SLTKENAGLSRVYS

SEQ ID NO: 100768 - protein, 14 aa, Borrelia burgdorferi
LTKENAGLSRVYSQ

SEQ ID NO: 100769 - protein, 14 aa, Borrelia burgdorferi
TKENAGLSRVYSQW

SEQ ID NO: 100770 - protein, 14 aa, Borrelia burgdorferi
KENAGLSRVYSQWA

SEQ ID NO: 100771 - protein, 14 aa, Borrelia burgdorferi
ENAGLSRVYSQWAG

SEQ ID NO: 100772 - protein, 14 aa, Borrelia burgdorferi
NAGLSRVYSQWAGK

SEQ ID NO: 100773 - protein, 14 aa, Borrelia burgdorferi
AGLSRVYSQWAGKT

SEQ ID NO: 100774 - protein, 14 aa, Borrelia burgdorferi
GLSRVYSQWAGKTQ

SEQ ID NO: 100775 - protein, 14 aa, Borrelia burgdorferi
LSRVYSQWAGKTQI

SEQ ID NO: 100776 - protein, 14 aa, Borrelia burgdorferi
SRVYSQWAGKTQIF

SEQ ID NO: 100777 - protein, 14 aa, Borrelia burgdorferi
RVYSQWAGKTQIFI

SEQ ID NO: 100778 - protein, 14 aa, Borrelia burgdorferi
VYSQWAGKTQIFIP

SEQ ID NO: 100779 - protein, 14 aa, Borrelia burgdorferi
YSQWAGKTQIFIPL

SEQ ID NO: 100780 - protein, 14 aa, Borrelia burgdorferi
SQWAGKTQIFIPLK

SEQ ID NO: 100781 - protein, 14 aa, Borrelia burgdorferi
QWAGKTQIFIPLKK

SEQ ID NO: 100782 - protein, 14 aa, Borrelia burgdorferi
WAGKTQIFIPLKKD

SEQ ID NO: 100783 - protein, 14 aa, Borrelia burgdorferi
AGKTQIFIPLKKDI

SEQ ID NO: 100784 - protein, 14 aa, Borrelia burgdorferi
GKTQIFIPLKKDIL

SEQ ID NO: 100785 - protein, 14 aa, Borrelia burgdorferi
KTQIFIPLKKDILS

SEQ ID NO: 100786 - protein, 14 aa, Borrelia burgdorferi
TQIFIPLKKDILSG

SEQ ID NO: 100787 - protein, 14 aa, Borrelia burgdorferi
QIFIPLKKDILSGN

SEQ ID NO: 100788 - protein, 14 aa, Borrelia burgdorferi
IFIPLKKDILSGNI

SEQ ID NO: 100789 - protein, 14 aa, Borrelia burgdorferi
FIPLKKDILSGNIE

SEQ ID NO: 100790 - protein, 14 aa, Borrelia burgdorferi
IPLKKDILSGNIES

SEQ ID NO: 100791 - protein, 14 aa, Borrelia burgdorferi
PLKKDILSGNIESD

SEQ ID NO: 100792 - protein, 14 aa, Borrelia burgdorferi
LKKDILSGNIESDI

SEQ ID NO: 100793 - protein, 14 aa, Borrelia burgdorferi
KKDILSGNIESDID

SEQ ID NO: 100794 - protein, 14 aa, Borrelia burgdorferi
KDILSGNIESDIDI

SEQ ID NO: 100795 - protein, 14 aa, Borrelia burgdorferi
DILSGNIESDIDID

SEQ ID NO: 100796 - protein, 14 aa, Borrelia burgdorferi
ILSGNIESDIDIDS

SEQ ID NO: 100797 - protein, 14 aa, Borrelia burgdorferi
LSGNIESDIDIDSL

SEQ ID NO: 100798 - protein, 14 aa, Borrelia burgdorferi
SGNIESDIDIDSLV

SEQ ID NO: 100799 - protein, 14 aa, Borrelia burgdorferi
GNIESDIDIDSLVT

SEQ ID NO: 100800 - protein, 14 aa, Borrelia burgdorferi
NIESDIDIDSLVTD

SEQ ID NO: 100801 - protein, 14 aa, Borrelia burgdorferi
IESDIDIDSLVTDK

SEQ ID NO: 100802 - protein, 14 aa, Borrelia burgdorferi
ESDIDIDSLVTDKV

SEQ ID NO: 100803 - protein, 14 aa, Borrelia burgdorferi
SDIDIDSLVTDKVI

SEQ ID NO: 100804 - protein, 14 aa, Borrelia burgdorferi
DIDIDSLVTDKVIA

SEQ ID NO: 100805 - protein, 14 aa, Borrelia burgdorferi
IDIDSLVTDKVIAA

SEQ ID NO: 100806 - protein, 14 aa, Borrelia burgdorferi
DIDSLVTDKVIAAL

SEQ ID NO: 100807 - protein, 14 aa, Borrelia burgdorferi
IDSLVTDKVIAALL

SEQ ID NO: 100808 - protein, 14 aa, Borrelia burgdorferi
DSLVTDKVIAALLS

SEQ ID NO: 100809 - protein, 14 aa, Borrelia burgdorferi
SLVTDKVIAALLSE

SEQ ID NO: 100810 - protein, 14 aa, Borrelia burgdorferi
LVTDKVIAALLSEN

SEQ ID NO: 100811 - protein, 14 aa, Borrelia burgdorferi
VTDKVIAALLSENE

SEQ ID NO: 100812 - protein, 14 aa, Borrelia burgdorferi
TDKVIAALLSENEA

SEQ ID NO: 100813 - protein, 14 aa, Borrelia burgdorferi
DKVIAALLSENEAG

SEQ ID NO: 100814 - protein, 14 aa, Borrelia burgdorferi
KVIAALLSENEAGV

SEQ ID NO: 100815 - protein, 14 aa, Borrelia burgdorferi
VIAALLSENEAGVN

SEQ ID NO: 100816 - protein, 14 aa, Borrelia burgdorferi
IAALLSENEAGVNF

SEQ ID NO: 100817 - protein, 14 aa, Borrelia burgdorferi
AALLSENEAGVNFA

SEQ ID NO: 100818 - protein, 14 aa, Borrelia burgdorferi
ALLSENEAGVNFAR

SEQ ID NO: 100819 - protein, 14 aa, Borrelia burgdorferi
LLSENEAGVNFARD

SEQ ID NO: 100820 - protein, 14 aa, Borrelia burgdorferi
LSENEAGVNFARDI

SEQ ID NO: 100821 - protein, 14 aa, Borrelia burgdorferi
SENEAGVNFARDIT

SEQ ID NO: 100822 - protein, 14 aa, Borrelia burgdorferi
ENEAGVNFARDITD

SEQ ID NO: 100823 - protein, 14 aa, Borrelia burgdorferi
NEAGVNFARDITDI

SEQ ID NO: 100824 - protein, 14 aa, Borrelia burgdorferi
EAGVNFARDITDIQ

SEQ ID NO: 100825 - protein, 14 aa, Borrelia burgdorferi
AGVNFARDITDIQG

SEQ ID NO: 100826 - protein, 14 aa, Borrelia burgdorferi
GVNFARDITDIQGE

SEQ ID NO: 100827 - protein, 14 aa, Borrelia burgdorferi
VNFARDITDIQGET

SEQ ID NO: 100828 - protein, 14 aa, Borrelia burgdorferi
NFARDITDIQGETH

SEQ ID NO: 100829 - protein, 14 aa, Borrelia burgdorferi
FARDITDIQGETHK

SEQ ID NO: 100830 - protein, 14 aa, Borrelia burgdorferi
ARDITDIQGETHKA

SEQ ID NO: 100831 - protein, 14 aa, Borrelia burgdorferi
RDITDIQGETHKAD

SEQ ID NO: 100832 - protein, 14 aa, Borrelia burgdorferi
DITDIQGETHKADQ

SEQ ID NO: 100833 - protein, 14 aa, Borrelia burgdorferi
ITDIQGETHKADQD

SEQ ID NO: 100834 - protein, 14 aa, Borrelia burgdorferi
TDIQGETHKADQDK

SEQ ID NO: 100835 - protein, 14 aa, Borrelia burgdorferi
DIQGETHKADQDKI

SEQ ID NO: 100836 - protein, 14 aa, Borrelia burgdorferi
IQGETHKADQDKID

SEQ ID NO: 100837 - protein, 14 aa, Borrelia burgdorferi
QGETHKADQDKIDT

SEQ ID NO: 100838 - protein, 14 aa, Borrelia burgdorferi
GETHKADQDKIDTE

SEQ ID NO: 100839 - protein, 14 aa, Borrelia burgdorferi
ETHKADQDKIDTEL

SEQ ID NO: 100840 - protein, 14 aa, Borrelia burgdorferi
THKADQDKIDTELD

SEQ ID NO: 100841 - protein, 14 aa, Borrelia burgdorferi
HKADQDKIDTELDN

SEQ ID NO: 100842 - protein, 14 aa, Borrelia burgdorferi
KADQDKIDTELDNI

SEQ ID NO: 100843 - protein, 14 aa, Borrelia burgdorferi
ADQDKIDTELDNIH

SEQ ID NO: 100844 - protein, 14 aa, Borrelia burgdorferi
DQDKIDTELDNIHE

SEQ ID NO: 100845 - protein, 14 aa, Borrelia burgdorferi
QDKIDTELDNIHES

SEQ ID NO: 100846 - protein, 14 aa, Borrelia burgdorferi
DKIDTELDNIHESD

SEQ ID NO: 100847 - protein, 14 aa, Borrelia burgdorferi
KIDTELDNIHESDS

SEQ ID NO: 100848 - protein, 14 aa, Borrelia burgdorferi
IDTELDNIHESDSN

SEQ ID NO: 100849 - protein, 14 aa, Borrelia burgdorferi
DTELDNIHESDSNI

SEQ ID NO: 100850 - protein, 14 aa, Borrelia burgdorferi
TELDNIHESDSNIT

SEQ ID NO: 100851 - protein, 14 aa, Borrelia burgdorferi
ELDNIHESDSNITE

SEQ ID NO: 100852 - protein, 14 aa, Borrelia burgdorferi
LDNIHESDSNITET

SEQ ID NO: 100853 - protein, 14 aa, Borrelia burgdorferi
DNIHESDSNITETI

SEQ ID NO: 100854 - protein, 14 aa, Borrelia burgdorferi
NIHESDSNITETIE

SEQ ID NO: 100855 - protein, 14 aa, Borrelia burgdorferi
IHESDSNITETIEN

SEQ ID NO: 100856 - protein, 14 aa, Borrelia burgdorferi
HESDSNITETIENL

SEQ ID NO: 100857 - protein, 14 aa, Borrelia burgdorferi
ESDSNITETIENLR

SEQ ID NO: 100858 - protein, 14 aa, Borrelia burgdorferi
SDSNITETIENLRD

SEQ ID NO: 100859 - protein, 14 aa, Borrelia burgdorferi
DSNITETIENLRDQ

SEQ ID NO: 100860 - protein, 14 aa, Borrelia burgdorferi
SNITETIENLRDQL

SEQ ID NO: 100861 - protein, 14 aa, Borrelia burgdorferi
NITETIENLRDQLE

SEQ ID NO: 100862 - protein, 14 aa, Borrelia burgdorferi
ITETIENLRDQLEK

SEQ ID NO: 100863 - protein, 14 aa, Borrelia burgdorferi
TETIENLRDQLEKA

SEQ ID NO: 100864 - protein, 14 aa, Borrelia burgdorferi
ETIENLRDQLEKAT

SEQ ID NO: 100865 - protein, 14 aa, Borrelia burgdorferi
TIENLRDQLEKATD

SEQ ID NO: 100866 - protein, 14 aa, Borrelia burgdorferi
IENLRDQLEKATDE

SEQ ID NO: 100867 - protein, 14 aa, Borrelia burgdorferi
ENLRDQLEKATDEE

SEQ ID NO: 100868 - protein, 14 aa, Borrelia burgdorferi
NLRDQLEKATDEEH

SEQ ID NO: 100869 - protein, 14 aa, Borrelia burgdorferi
LRDQLEKATDEEHK

SEQ ID NO: 100870 - protein, 14 aa, Borrelia burgdorferi
RDQLEKATDEEHKK

SEQ ID NO: 100871 - protein, 14 aa, Borrelia burgdorferi
DQLEKATDEEHKKE

SEQ ID NO: 100872 - protein, 14 aa, Borrelia burgdorferi
QLEKATDEEHKKEI

SEQ ID NO: 100873 - protein, 14 aa, Borrelia burgdorferi
LEKATDEEHKKEIE

SEQ ID NO: 100874 - protein, 14 aa, Borrelia burgdorferi
EKATDEEHKKEIES

SEQ ID NO: 100875 - protein, 14 aa, Borrelia burgdorferi
KATDEEHKKEIESQ

SEQ ID NO: 100876 - protein, 14 aa, Borrelia burgdorferi
ATDEEHKKEIESQV

SEQ ID NO: 100877 - protein, 14 aa, Borrelia burgdorferi
TDEEHKKEIESQVD

SEQ ID NO: 100878 - protein, 14 aa, Borrelia burgdorferi
DEEHKKEIESQVDA

SEQ ID NO: 100879 - protein, 14 aa, Borrelia burgdorferi
EEHKKEIESQVDAK

SEQ ID NO: 100880 - protein, 14 aa, Borrelia burgdorferi
EHKKEIESQVDAKK

SEQ ID NO: 100881 - protein, 14 aa, Borrelia burgdorferi
HKKEIESQVDAKKK

SEQ ID NO: 100882 - protein, 14 aa, Borrelia burgdorferi
KKEIESQVDAKKKE

SEQ ID NO: 100883 - protein, 14 aa, Borrelia burgdorferi
KEIESQVDAKKKEK

SEQ ID NO: 100884 - protein, 14 aa, Borrelia burgdorferi
EIESQVDAKKKEKE

SEQ ID NO: 100885 - protein, 14 aa, Borrelia burgdorferi
IESQVDAKKKEKEE

SEQ ID NO: 100886 - protein, 14 aa, Borrelia burgdorferi
ESQVDAKKKEKEEL

SEQ ID NO: 100887 - protein, 14 aa, Borrelia burgdorferi
SQVDAKKKEKEELD

SEQ ID NO: 100888 - protein, 14 aa, Borrelia burgdorferi
QVDAKKKEKEELDK

SEQ ID NO: 100889 - protein, 14 aa, Borrelia burgdorferi
VDAKKKEKEELDKK

SEQ ID NO: 100890 - protein, 14 aa, Borrelia burgdorferi
DAKKKEKEELDKKA

SEQ ID NO: 100891 - protein, 14 aa, Borrelia burgdorferi
AKKKEKEELDKKAI

SEQ ID NO: 100892 - protein, 14 aa, Borrelia burgdorferi
KKKEKEELDKKAIN

SEQ ID NO: 100893 - protein, 14 aa, Borrelia burgdorferi
KKEKEELDKKAINL

SEQ ID NO: 100894 - protein, 14 aa, Borrelia burgdorferi
KEKEELDKKAINLD

SEQ ID NO: 100895 - protein, 14 aa, Borrelia burgdorferi
EKEELDKKAINLDK

SEQ ID NO: 100896 - protein, 14 aa, Borrelia burgdorferi
KEELDKKAINLDKA

SEQ ID NO: 100897 - protein, 14 aa, Borrelia burgdorferi
EELDKKAINLDKAQ

SEQ ID NO: 100898 - protein, 14 aa, Borrelia burgdorferi
ELDKKAINLDKAQQ

SEQ ID NO: 100899 - protein, 14 aa, Borrelia burgdorferi
LDKKAINLDKAQQK

SEQ ID NO: 100900 - protein, 14 aa, Borrelia burgdorferi
DKKAINLDKAQQKL

SEQ ID NO: 100901 - protein, 14 aa, Borrelia burgdorferi
KKAINLDKAQQKLD

SEQ ID NO: 100902 - protein, 14 aa, Borrelia burgdorferi
KAINLDKAQQKLDS

SEQ ID NO: 100903 - protein, 14 aa, Borrelia burgdorferi
AINLDKAQQKLDSA

SEQ ID NO: 100904 - protein, 14 aa, Borrelia burgdorferi
INLDKAQQKLDSAE

SEQ ID NO: 100905 - protein, 14 aa, Borrelia burgdorferi
NLDKAQQKLDSAED

SEQ ID NO: 100906 - protein, 14 aa, Borrelia burgdorferi
LDKAQQKLDSAEDN

SEQ ID NO: 100907 - protein, 14 aa, Borrelia burgdorferi
DKAQQKLDSAEDNL

SEQ ID NO: 100908 - protein, 14 aa, Borrelia burgdorferi
KAQQKLDSAEDNLD

SEQ ID NO: 100909 - protein, 14 aa, Borrelia burgdorferi
AQQKLDSAEDNLDV

SEQ ID NO: 100910 - protein, 14 aa, Borrelia burgdorferi
QQKLDSAEDNLDVQ

SEQ ID NO: 100911 - protein, 14 aa, Borrelia burgdorferi
QKLDSAEDNLDVQR

SEQ ID NO: 100912 - protein, 14 aa, Borrelia burgdorferi
KLDSAEDNLDVQRD

SEQ ID NO: 100913 - protein, 14 aa, Borrelia burgdorferi
LDSAEDNLDVQRDT

SEQ ID NO: 100914 - protein, 14 aa, Borrelia burgdorferi
DSAEDNLDVQRDTV

SEQ ID NO: 100915 - protein, 14 aa, Borrelia burgdorferi
SAEDNLDVQRDTVR

SEQ ID NO: 100916 - protein, 14 aa, Borrelia burgdorferi
AEDNLDVQRDTVRE

SEQ ID NO: 100917 - protein, 14 aa, Borrelia burgdorferi
EDNLDVQRDTVREK

SEQ ID NO: 100918 - protein, 14 aa, Borrelia burgdorferi
DNLDVQRDTVREKI

SEQ ID NO: 100919 - protein, 14 aa, Borrelia burgdorferi
NLDVQRDTVREKIQ

SEQ ID NO: 100920 - protein, 14 aa, Borrelia burgdorferi
LDVQRDTVREKIQE

SEQ ID NO: 100921 - protein, 14 aa, Borrelia burgdorferi
DVQRDTVREKIQED

SEQ ID NO: 100922 - protein, 14 aa, Borrelia burgdorferi
VQRDTVREKIQEDI

SEQ ID NO: 100923 - protein, 14 aa, Borrelia burgdorferi
QRDTVREKIQEDIN

SEQ ID NO: 100924 - protein, 14 aa, Borrelia burgdorferi
RDTVREKIQEDINE

SEQ ID NO: 100925 - protein, 14 aa, Borrelia burgdorferi
DTVREKIQEDINEI

SEQ ID NO: 100926 - protein, 14 aa, Borrelia burgdorferi
TVREKIQEDINEIN

SEQ ID NO: 100927 - protein, 14 aa, Borrelia burgdorferi
VREKIQEDINEINK

SEQ ID NO: 100928 - protein, 14 aa, Borrelia burgdorferi
REKIQEDINEINKE

SEQ ID NO: 100929 - protein, 14 aa, Borrelia burgdorferi
EKIQEDINEINKEK

SEQ ID NO: 100930 - protein, 14 aa, Borrelia burgdorferi
KIQEDINEINKEKN

SEQ ID NO: 100931 - protein, 14 aa, Borrelia burgdorferi
IQEDINEINKEKNL

SEQ ID NO: 100932 - protein, 14 aa, Borrelia burgdorferi
QEDINEINKEKNLP

SEQ ID NO: 100933 - protein, 14 aa, Borrelia burgdorferi
EDINEINKEKNLPK

SEQ ID NO: 100934 - protein, 14 aa, Borrelia burgdorferi
DINEINKEKNLPKP

SEQ ID NO: 100935 - protein, 14 aa, Borrelia burgdorferi
INEINKEKNLPKPG

SEQ ID NO: 100936 - protein, 14 aa, Borrelia burgdorferi
NEINKEKNLPKPGD

SEQ ID NO: 100937 - protein, 14 aa, Borrelia burgdorferi
EINKEKNLPKPGDV

SEQ ID NO: 100938 - protein, 14 aa, Borrelia burgdorferi
INKEKNLPKPGDVS

SEQ ID NO: 100939 - protein, 14 aa, Borrelia burgdorferi
NKEKNLPKPGDVSS

SEQ ID NO: 100940 - protein, 14 aa, Borrelia burgdorferi
KEKNLPKPGDVSSP

SEQ ID NO: 100941 - protein, 14 aa, Borrelia burgdorferi
EKNLPKPGDVSSPK

SEQ ID NO: 100942 - protein, 14 aa, Borrelia burgdorferi
KNLPKPGDVSSPKV

SEQ ID NO: 100943 - protein, 14 aa, Borrelia burgdorferi
NLPKPGDVSSPKVD

SEQ ID NO: 100944 - protein, 14 aa, Borrelia burgdorferi
LPKPGDVSSPKVDK

SEQ ID NO: 100945 - protein, 14 aa, Borrelia burgdorferi
PKPGDVSSPKVDKQ

SEQ ID NO: 100946 - protein, 14 aa, Borrelia burgdorferi
KPGDVSSPKVDKQL

SEQ ID NO: 100947 - protein, 14 aa, Borrelia burgdorferi
PGDVSSPKVDKQLQ

SEQ ID NO: 100948 - protein, 14 aa, Borrelia burgdorferi
GDVSSPKVDKQLQI

SEQ ID NO: 100949 - protein, 14 aa, Borrelia burgdorferi
DVSSPKVDKQLQIK

SEQ ID NO: 100950 - protein, 14 aa, Borrelia burgdorferi
VSSPKVDKQLQIKE

SEQ ID NO: 100951 - protein, 14 aa, Borrelia burgdorferi
SSPKVDKQLQIKES

SEQ ID NO: 100952 - protein, 14 aa, Borrelia burgdorferi
SPKVDKQLQIKESL

SEQ ID NO: 100953 - protein, 14 aa, Borrelia burgdorferi
PKVDKQLQIKESLE

SEQ ID NO: 100954 - protein, 14 aa, Borrelia burgdorferi
KVDKQLQIKESLED

SEQ ID NO: 100955 - protein, 14 aa, Borrelia burgdorferi
VDKQLQIKESLEDL

SEQ ID NO: 100956 - protein, 14 aa, Borrelia burgdorferi
DKQLQIKESLEDLQ

SEQ ID NO: 100957 - protein, 14 aa, Borrelia burgdorferi
KQLQIKESLEDLQE

SEQ ID NO: 100958 - protein, 14 aa, Borrelia burgdorferi
QLQIKESLEDLQEQ

SEQ ID NO: 100959 - protein, 14 aa, Borrelia burgdorferi
LQIKESLEDLQEQL

SEQ ID NO: 100960 - protein, 14 aa, Borrelia burgdorferi
QIKESLEDLQEQLK

SEQ ID NO: 100961 - protein, 14 aa, Borrelia burgdorferi
IKESLEDLQEQLKE

SEQ ID NO: 100962 - protein, 14 aa, Borrelia burgdorferi
KESLEDLQEQLKEA

SEQ ID NO: 100963 - protein, 14 aa, Borrelia burgdorferi
ESLEDLQEQLKEAG

SEQ ID NO: 100964 - protein, 14 aa, Borrelia burgdorferi
SLEDLQEQLKEAGD

SEQ ID NO: 100965 - protein, 14 aa, Borrelia burgdorferi
LEDLQEQLKEAGDE

SEQ ID NO: 100966 - protein, 14 aa, Borrelia burgdorferi
EDLQEQLKEAGDEN

SEQ ID NO: 100967 - protein, 14 aa, Borrelia burgdorferi
DLQEQLKEAGDENQ

SEQ ID NO: 100968 - protein, 14 aa, Borrelia burgdorferi
LQEQLKEAGDENQK

SEQ ID NO: 100969 - protein, 14 aa, Borrelia burgdorferi
QEQLKEAGDENQKR

SEQ ID NO: 100970 - protein, 14 aa, Borrelia burgdorferi
EQLKEAGDENQKRE

SEQ ID NO: 100971 - protein, 14 aa, Borrelia burgdorferi
QLKEAGDENQKREI

SEQ ID NO: 100972 - protein, 14 aa, Borrelia burgdorferi
LKEAGDENQKREIE

SEQ ID NO: 100973 - protein, 14 aa, Borrelia burgdorferi
KEAGDENQKREIEK

SEQ ID NO: 100974 - protein, 14 aa, Borrelia burgdorferi
EAGDENQKREIEKQ

SEQ ID NO: 100975 - protein, 14 aa, Borrelia burgdorferi
AGDENQKREIEKQI

SEQ ID NO: 100976 - protein, 14 aa, Borrelia burgdorferi
GDENQKREIEKQIE

SEQ ID NO: 100977 - protein, 14 aa, Borrelia burgdorferi
DENQKREIEKQIEI

SEQ ID NO: 100978 - protein, 14 aa, Borrelia burgdorferi
ENQKREIEKQIEIK

SEQ ID NO: 100979 - protein, 14 aa, Borrelia burgdorferi
NQKREIEKQIEIKK

SEQ ID NO: 100980 - protein, 14 aa, Borrelia burgdorferi
QKREIEKQIEIKKR

SEQ ID NO: 100981 - protein, 14 aa, Borrelia burgdorferi
KREIEKQIEIKKRD

SEQ ID NO: 100982 - protein, 14 aa, Borrelia burgdorferi
REIEKQIEIKKRDE

SEQ ID NO: 100983 - protein, 14 aa, Borrelia burgdorferi
EIEKQIEIKKRDEE

SEQ ID NO: 100984 - protein, 14 aa, Borrelia burgdorferi
IEKQIEIKKRDEEL

SEQ ID NO: 100985 - protein, 14 aa, Borrelia burgdorferi
EKQIEIKKRDEELL

SEQ ID NO: 100986 - protein, 14 aa, Borrelia burgdorferi
KQIEIKKRDEELLK

SEQ ID NO: 100987 - protein, 14 aa, Borrelia burgdorferi
QIEIKKRDEELLKS

SEQ ID NO: 100988 - protein, 14 aa, Borrelia burgdorferi
IEIKKRDEELLKSK

SEQ ID NO: 100989 - protein, 14 aa, Borrelia burgdorferi
EIKKRDEELLKSKD

SEQ ID NO: 100990 - protein, 14 aa, Borrelia burgdorferi
IKKRDEELLKSKDG

SEQ ID NO: 100991 - protein, 14 aa, Borrelia burgdorferi
KKRDEELLKSKDGK

SEQ ID NO: 100992 - protein, 14 aa, Borrelia burgdorferi
KRDEELLKSKDGKV

SEQ ID NO: 100993 - protein, 14 aa, Borrelia burgdorferi
RDEELLKSKDGKVS

SEQ ID NO: 100994 - protein, 14 aa, Borrelia burgdorferi
DEELLKSKDGKVSK

SEQ ID NO: 100995 - protein, 14 aa, Borrelia burgdorferi
EELLKSKDGKVSKD

SEQ ID NO: 100996 - protein, 14 aa, Borrelia burgdorferi
ELLKSKDGKVSKDY

SEQ ID NO: 100997 - protein, 14 aa, Borrelia burgdorferi
LLKSKDGKVSKDYE

SEQ ID NO: 100998 - protein, 14 aa, Borrelia burgdorferi
LKSKDGKVSKDYEA

SEQ ID NO: 100999 - protein, 14 aa, Borrelia burgdorferi
KSKDGKVSKDYEAL

SEQ ID NO: 101000 - protein, 14 aa, Borrelia burgdorferi
SKDGKVSKDYEALD

SEQ ID NO: 101001 - protein, 14 aa, Borrelia burgdorferi
KDGKVSKDYEALDL

SEQ ID NO: 101002 - protein, 14 aa, Borrelia burgdorferi
DGKVSKDYEALDLD

SEQ ID NO: 101003 - protein, 14 aa, Borrelia burgdorferi
GKVSKDYEALDLDR

SEQ ID NO: 101004 - protein, 14 aa, Borrelia burgdorferi
KVSKDYEALDLDRE

SEQ ID NO: 101005 - protein, 14 aa, Borrelia burgdorferi
VSKDYEALDLDREL

SEQ ID NO: 101006 - protein, 14 aa, Borrelia burgdorferi
SKDYEALDLDRELS

SEQ ID NO: 101007 - protein, 14 aa, Borrelia burgdorferi
KDYEALDLDRELSK

SEQ ID NO: 101008 - protein, 14 aa, Borrelia burgdorferi
DYEALDLDRELSKA

SEQ ID NO: 101009 - protein, 14 aa, Borrelia burgdorferi
YEALDLDRELSKAS

SEQ ID NO: 101010 - protein, 14 aa, Borrelia burgdorferi
EALDLDRELSKASS

SEQ ID NO: 101011 - protein, 14 aa, Borrelia burgdorferi
ALDLDRELSKASSK

SEQ ID NO: 101012 - protein, 14 aa, Borrelia burgdorferi
LDLDRELSKASSKE

SEQ ID NO: 101013 - protein, 14 aa, Borrelia burgdorferi
DLDRELSKASSKEK

SEQ ID NO: 101014 - protein, 14 aa, Borrelia burgdorferi
LDRELSKASSKEKS

SEQ ID NO: 101015 - protein, 14 aa, Borrelia burgdorferi
DRELSKASSKEKSK

SEQ ID NO: 101016 - protein, 14 aa, Borrelia burgdorferi
RELSKASSKEKSKV

SEQ ID NO: 101017 - protein, 14 aa, Borrelia burgdorferi
ELSKASSKEKSKVK

SEQ ID NO: 101018 - protein, 14 aa, Borrelia burgdorferi
LSKASSKEKSKVKE

SEQ ID NO: 101019 - protein, 14 aa, Borrelia burgdorferi
SKASSKEKSKVKEE

SEQ ID NO: 101020 - protein, 14 aa, Borrelia burgdorferi
KASSKEKSKVKEEE

SEQ ID NO: 101021 - protein, 14 aa, Borrelia burgdorferi
ASSKEKSKVKEEEI

SEQ ID NO: 101022 - protein, 14 aa, Borrelia burgdorferi
SSKEKSKVKEEEIT

SEQ ID NO: 101023 - protein, 14 aa, Borrelia burgdorferi
SKEKSKVKEEEITK

SEQ ID NO: 101024 - protein, 14 aa, Borrelia burgdorferi
KEKSKVKEEEITKG

SEQ ID NO: 101025 - protein, 14 aa, Borrelia burgdorferi
EKSKVKEEEITKGK

SEQ ID NO: 101026 - protein, 14 aa, Borrelia burgdorferi
KSKVKEEEITKGKS

SEQ ID NO: 101027 - protein, 14 aa, Borrelia burgdorferi
SKVKEEEITKGKSR

SEQ ID NO: 101028 - protein, 14 aa, Borrelia burgdorferi
KVKEEEITKGKSRA

SEQ ID NO: 101029 - protein, 14 aa, Borrelia burgdorferi
VKEEEITKGKSRAS

SEQ ID NO: 101030 - protein, 14 aa, Borrelia burgdorferi
KEEEITKGKSRASL

SEQ ID NO: 101031 - protein, 14 aa, Borrelia burgdorferi
EEEITKGKSRASLG

SEQ ID NO: 101032 - protein, 14 aa, Borrelia burgdorferi
EEITKGKSRASLGD

SEQ ID NO: 101033 - protein, 14 aa, Borrelia burgdorferi
EITKGKSRASLGDL

SEQ ID NO: 101034 - protein, 14 aa, Borrelia burgdorferi
ITKGKSRASLGDLN

SEQ ID NO: 101035 - protein, 14 aa, Borrelia burgdorferi
TKGKSRASLGDLNN

SEQ ID NO: 101036 - protein, 14 aa, Borrelia burgdorferi
KGKSRASLGDLNND

SEQ ID NO: 101037 - protein, 14 aa, Borrelia burgdorferi
GKSRASLGDLNNDK

SEQ ID NO: 101038 - protein, 14 aa, Borrelia burgdorferi
KSRASLGDLNNDKN

SEQ ID NO: 101039 - protein, 14 aa, Borrelia burgdorferi
SRASLGDLNNDKNL

SEQ ID NO: 101040 - protein, 14 aa, Borrelia burgdorferi
RASLGDLNNDKNLM

SEQ ID NO: 101041 - protein, 14 aa, Borrelia burgdorferi
ASLGDLNNDKNLML

SEQ ID NO: 101042 - protein, 14 aa, Borrelia burgdorferi
SLGDLNNDKNLMLP

SEQ ID NO: 101043 - protein, 14 aa, Borrelia burgdorferi
LGDLNNDKNLMLPE

SEQ ID NO: 101044 - protein, 14 aa, Borrelia burgdorferi
GDLNNDKNLMLPED

SEQ ID NO: 101045 - protein, 14 aa, Borrelia burgdorferi
DLNNDKNLMLPEDQ

SEQ ID NO: 101046 - protein, 14 aa, Borrelia burgdorferi
LNNDKNLMLPEDQK

SEQ ID NO: 101047 - protein, 14 aa, Borrelia burgdorferi
NNDKNLMLPEDQKL

SEQ ID NO: 101048 - protein, 14 aa, Borrelia burgdorferi
NDKNLMLPEDQKLP

SEQ ID NO: 101049 - protein, 14 aa, Borrelia burgdorferi
DKNLMLPEDQKLPE

SEQ ID NO: 101050 - protein, 14 aa, Borrelia burgdorferi
KNLMLPEDQKLPED

SEQ ID NO: 101051 - protein, 14 aa, Borrelia burgdorferi
NLMLPEDQKLPEDK

SEQ ID NO: 101052 - protein, 14 aa, Borrelia burgdorferi
LMLPEDQKLPEDKK

SEQ ID NO: 101053 - protein, 14 aa, Borrelia burgdorferi
MLPEDQKLPEDKKL

SEQ ID NO: 101054 - protein, 14 aa, Borrelia burgdorferi
LPEDQKLPEDKKLD

SEQ ID NO: 101055 - protein, 14 aa, Borrelia burgdorferi
PEDQKLPEDKKLDS

SEQ ID NO: 101056 - protein, 14 aa, Borrelia burgdorferi
EDQKLPEDKKLDSK

SEQ ID NO: 101057 - protein, 14 aa, Borrelia burgdorferi
DQKLPEDKKLDSKL

SEQ ID NO: 101058 - protein, 14 aa, Borrelia burgdorferi
QKLPEDKKLDSKLD

SEQ ID NO: 101059 - protein, 14 aa, Borrelia burgdorferi
KLPEDKKLDSKLDG

SEQ ID NO: 101060 - protein, 14 aa, Borrelia burgdorferi
LPEDKKLDSKLDGK

SEQ ID NO: 101061 - protein, 14 aa, Borrelia burgdorferi
PEDKKLDSKLDGKK

SEQ ID NO: 101062 - protein, 14 aa, Borrelia burgdorferi
EDKKLDSKLDGKKE

SEQ ID NO: 101063 - protein, 14 aa, Borrelia burgdorferi
DKKLDSKLDGKKEF

SEQ ID NO: 101064 - protein, 14 aa, Borrelia burgdorferi
KKLDSKLDGKKEFK

SEQ ID NO: 101065 - protein, 14 aa, Borrelia burgdorferi
KLDSKLDGKKEFKP

SEQ ID NO: 101066 - protein, 14 aa, Borrelia burgdorferi
LDSKLDGKKEFKPV

SEQ ID NO: 101067 - protein, 14 aa, Borrelia burgdorferi
DSKLDGKKEFKPVS

SEQ ID NO: 101068 - protein, 14 aa, Borrelia burgdorferi
SKLDGKKEFKPVSE

SEQ ID NO: 101069 - protein, 14 aa, Borrelia burgdorferi
KLDGKKEFKPVSEV

SEQ ID NO: 101070 - protein, 14 aa, Borrelia burgdorferi
LDGKKEFKPVSEVE

SEQ ID NO: 101071 - protein, 14 aa, Borrelia burgdorferi
DGKKEFKPVSEVEK

SEQ ID NO: 101072 - protein, 14 aa, Borrelia burgdorferi
GKKEFKPVSEVEKL

SEQ ID NO: 101073 - protein, 14 aa, Borrelia burgdorferi
KKEFKPVSEVEKLD

SEQ ID NO: 101074 - protein, 14 aa, Borrelia burgdorferi
KEFKPVSEVEKLDK

SEQ ID NO: 101075 - protein, 14 aa, Borrelia burgdorferi
EFKPVSEVEKLDKI

SEQ ID NO: 101076 - protein, 14 aa, Borrelia burgdorferi
FKPVSEVEKLDKIS

SEQ ID NO: 101077 - protein, 14 aa, Borrelia burgdorferi
KPVSEVEKLDKISK

SEQ ID NO: 101078 - protein, 14 aa, Borrelia burgdorferi
PVSEVEKLDKISKS

SEQ ID NO: 101079 - protein, 14 aa, Borrelia burgdorferi
VSEVEKLDKISKSN

SEQ ID NO: 101080 - protein, 14 aa, Borrelia burgdorferi
SEVEKLDKISKSNN

SEQ ID NO: 101081 - protein, 14 aa, Borrelia burgdorferi
EVEKLDKISKSNNN

SEQ ID NO: 101082 - protein, 14 aa, Borrelia burgdorferi
VEKLDKISKSNNNE

SEQ ID NO: 101083 - protein, 14 aa, Borrelia burgdorferi
EKLDKISKSNNNEV

SEQ ID NO: 101084 - protein, 14 aa, Borrelia burgdorferi
KLDKISKSNNNEVG

SEQ ID NO: 101085 - protein, 14 aa, Borrelia burgdorferi
LDKISKSNNNEVGK

SEQ ID NO: 101086 - protein, 14 aa, Borrelia burgdorferi
DKISKSNNNEVGKL

SEQ ID NO: 101087 - protein, 14 aa, Borrelia burgdorferi
KISKSNNNEVGKLS

SEQ ID NO: 101088 - protein, 14 aa, Borrelia burgdorferi
ISKSNNNEVGKLSP

SEQ ID NO: 101089 - protein, 14 aa, Borrelia burgdorferi
SKSNNNEVGKLSPL

SEQ ID NO: 101090 - protein, 14 aa, Borrelia burgdorferi
KSNNNEVGKLSPLD

SEQ ID NO: 101091 - protein, 14 aa, Borrelia burgdorferi
SNNNEVGKLSPLDK

SEQ ID NO: 101092 - protein, 14 aa, Borrelia burgdorferi
NNNEVGKLSPLDKP

SEQ ID NO: 101093 - protein, 14 aa, Borrelia burgdorferi
NNEVGKLSPLDKPS

SEQ ID NO: 101094 - protein, 14 aa, Borrelia burgdorferi
NEVGKLSPLDKPSY

SEQ ID NO: 101095 - protein, 14 aa, Borrelia burgdorferi
EVGKLSPLDKPSYD

SEQ ID NO: 101096 - protein, 14 aa, Borrelia burgdorferi
VGKLSPLDKPSYDD

SEQ ID NO: 101097 - protein, 14 aa, Borrelia burgdorferi
GKLSPLDKPSYDDI

SEQ ID NO: 101098 - protein, 14 aa, Borrelia burgdorferi
KLSPLDKPSYDDID

SEQ ID NO: 101099 - protein, 14 aa, Borrelia burgdorferi
LSPLDKPSYDDIDS

SEQ ID NO: 101100 - protein, 14 aa, Borrelia burgdorferi
SPLDKPSYDDIDSK

SEQ ID NO: 101101 - protein, 14 aa, Borrelia burgdorferi
PLDKPSYDDIDSKE

SEQ ID NO: 101102 - protein, 14 aa, Borrelia burgdorferi
LDKPSYDDIDSKEE

SEQ ID NO: 101103 - protein, 14 aa, Borrelia burgdorferi
DKPSYDDIDSKEEV

SEQ ID NO: 101104 - protein, 14 aa, Borrelia burgdorferi
KPSYDDIDSKEEVD

SEQ ID NO: 101105 - protein, 14 aa, Borrelia burgdorferi
PSYDDIDSKEEVDN

SEQ ID NO: 101106 - protein, 14 aa, Borrelia burgdorferi
SYDDIDSKEEVDNK

SEQ ID NO: 101107 - protein, 14 aa, Borrelia burgdorferi
YDDIDSKEEVDNKA

SEQ ID NO: 101108 - protein, 14 aa, Borrelia burgdorferi
DDIDSKEEVDNKAI

SEQ ID NO: 101109 - protein, 14 aa, Borrelia burgdorferi
DIDSKEEVDNKAIN

SEQ ID NO: 101110 - protein, 14 aa, Borrelia burgdorferi
IDSKEEVDNKAINL

SEQ ID NO: 101111 - protein, 14 aa, Borrelia burgdorferi
DSKEEVDNKAINLQ

SEQ ID NO: 101112 - protein, 14 aa, Borrelia burgdorferi
SKEEVDNKAINLQK

SEQ ID NO: 101113 - protein, 14 aa, Borrelia burgdorferi
KEEVDNKAINLQKI

SEQ ID NO: 101114 - protein, 14 aa, Borrelia burgdorferi
EEVDNKAINLQKID

SEQ ID NO: 101115 - protein, 14 aa, Borrelia burgdorferi
EVDNKAINLQKIDP

SEQ ID NO: 101116 - protein, 14 aa, Borrelia burgdorferi
VDNKAINLQKIDPK

SEQ ID NO: 101117 - protein, 14 aa, Borrelia burgdorferi
DNKAINLQKIDPKV

SEQ ID NO: 101118 - protein, 14 aa, Borrelia burgdorferi
NKAINLQKIDPKVK

SEQ ID NO: 101119 - protein, 14 aa, Borrelia burgdorferi
KAINLQKIDPKVKD

SEQ ID NO: 101120 - protein, 14 aa, Borrelia burgdorferi
AINLQKIDPKVKDQ

SEQ ID NO: 101121 - protein, 14 aa, Borrelia burgdorferi
INLQKIDPKVKDQT

SEQ ID NO: 101122 - protein, 14 aa, Borrelia burgdorferi
NLQKIDPKVKDQTT

SEQ ID NO: 101123 - protein, 14 aa, Borrelia burgdorferi
LQKIDPKVKDQTTS

SEQ ID NO: 101124 - protein, 14 aa, Borrelia burgdorferi
QKIDPKVKDQTTSL

SEQ ID NO: 101125 - protein, 14 aa, Borrelia burgdorferi
KIDPKVKDQTTSLN

SEQ ID NO: 101126 - protein, 14 aa, Borrelia burgdorferi
IDPKVKDQTTSLNE

SEQ ID NO: 101127 - protein, 14 aa, Borrelia burgdorferi
DPKVKDQTTSLNED

SEQ ID NO: 101128 - protein, 14 aa, Borrelia burgdorferi
PKVKDQTTSLNEDL

SEQ ID NO: 101129 - protein, 14 aa, Borrelia burgdorferi
KVKDQTTSLNEDLD

SEQ ID NO: 101130 - protein, 14 aa, Borrelia burgdorferi
VKDQTTSLNEDLDK

SEQ ID NO: 101131 - protein, 14 aa, Borrelia burgdorferi
KDQTTSLNEDLDKD

SEQ ID NO: 101132 - protein, 14 aa, Borrelia burgdorferi
DQTTSLNEDLDKDL

SEQ ID NO: 101133 - protein, 14 aa, Borrelia burgdorferi
QTTSLNEDLDKDLT

SEQ ID NO: 101134 - protein, 14 aa, Borrelia burgdorferi
TTSLNEDLDKDLTT

SEQ ID NO: 101135 - protein, 14 aa, Borrelia burgdorferi
TSLNEDLDKDLTTM

SEQ ID NO: 101136 - protein, 14 aa, Borrelia burgdorferi
SLNEDLDKDLTTMS

SEQ ID NO: 101137 - protein, 14 aa, Borrelia burgdorferi
LNEDLDKDLTTMSI

SEQ ID NO: 101138 - protein, 14 aa, Borrelia burgdorferi
NEDLDKDLTTMSID

SEQ ID NO: 101139 - protein, 14 aa, Borrelia burgdorferi
EDLDKDLTTMSIDS

SEQ ID NO: 101140 - protein, 14 aa, Borrelia burgdorferi
DLDKDLTTMSIDSS

SEQ ID NO: 101141 - protein, 14 aa, Borrelia burgdorferi
LDKDLTTMSIDSSS

SEQ ID NO: 101142 - protein, 14 aa, Borrelia burgdorferi
DKDLTTMSIDSSSP

SEQ ID NO: 101143 - protein, 14 aa, Borrelia burgdorferi
KDLTTMSIDSSSPV

SEQ ID NO: 101144 - protein, 14 aa, Borrelia burgdorferi
DLTTMSIDSSSPVF

SEQ ID NO: 101145 - protein, 14 aa, Borrelia burgdorferi
LTTMSIDSSSPVFL

SEQ ID NO: 101146 - protein, 14 aa, Borrelia burgdorferi
TTMSIDSSSPVFLE

SEQ ID NO: 101147 - protein, 14 aa, Borrelia burgdorferi
TMSIDSSSPVFLEV

SEQ ID NO: 101148 - protein, 14 aa, Borrelia burgdorferi
MSIDSSSPVFLEVI

SEQ ID NO: 101149 - protein, 14 aa, Borrelia burgdorferi
SIDSSSPVFLEVID

SEQ ID NO: 101150 - protein, 14 aa, Borrelia burgdorferi
IDSSSPVFLEVIDP

SEQ ID NO: 101151 - protein, 14 aa, Borrelia burgdorferi
DSSSPVFLEVIDPI

SEQ ID NO: 101152 - protein, 14 aa, Borrelia burgdorferi
SSSPVFLEVIDPIT

SEQ ID NO: 101153 - protein, 14 aa, Borrelia burgdorferi
SSPVFLEVIDPITN

SEQ ID NO: 101154 - protein, 14 aa, Borrelia burgdorferi
SPVFLEVIDPITNL

SEQ ID NO: 101155 - protein, 14 aa, Borrelia burgdorferi
PVFLEVIDPITNLG

SEQ ID NO: 101156 - protein, 14 aa, Borrelia burgdorferi
VFLEVIDPITNLGT

SEQ ID NO: 101157 - protein, 14 aa, Borrelia burgdorferi
FLEVIDPITNLGTL

SEQ ID NO: 101158 - protein, 14 aa, Borrelia burgdorferi
LEVIDPITNLGTLQ

SEQ ID NO: 101159 - protein, 14 aa, Borrelia burgdorferi
EVIDPITNLGTLQL

SEQ ID NO: 101160 - protein, 14 aa, Borrelia burgdorferi
VIDPITNLGTLQLI

SEQ ID NO: 101161 - protein, 14 aa, Borrelia burgdorferi
IDPITNLGTLQLID

SEQ ID NO: 101162 - protein, 14 aa, Borrelia burgdorferi
DPITNLGTLQLIDL

SEQ ID NO: 101163 - protein, 14 aa, Borrelia burgdorferi
PITNLGTLQLIDLN

SEQ ID NO: 101164 - protein, 14 aa, Borrelia burgdorferi
ITNLGTLQLIDLNT

SEQ ID NO: 101165 - protein, 14 aa, Borrelia burgdorferi
TNLGTLQLIDLNTG

SEQ ID NO: 101166 - protein, 14 aa, Borrelia burgdorferi
NLGTLQLIDLNTGV

SEQ ID NO: 101167 - protein, 14 aa, Borrelia burgdorferi
LGTLQLIDLNTGVR

SEQ ID NO: 101168 - protein, 14 aa, Borrelia burgdorferi
GTLQLIDLNTGVRL

SEQ ID NO: 101169 - protein, 14 aa, Borrelia burgdorferi
TLQLIDLNTGVRLK

SEQ ID NO: 101170 - protein, 14 aa, Borrelia burgdorferi
LQLIDLNTGVRLKE

SEQ ID NO: 101171 - protein, 14 aa, Borrelia burgdorferi
QLIDLNTGVRLKES

SEQ ID NO: 101172 - protein, 14 aa, Borrelia burgdorferi
LIDLNTGVRLKEST

SEQ ID NO: 101173 - protein, 14 aa, Borrelia burgdorferi
IDLNTGVRLKESTQ

SEQ ID NO: 101174 - protein, 14 aa, Borrelia burgdorferi
DLNTGVRLKESTQQ

SEQ ID NO: 101175 - protein, 14 aa, Borrelia burgdorferi
LNTGVRLKESTQQG

SEQ ID NO: 101176 - protein, 14 aa, Borrelia burgdorferi
NTGVRLKESTQQGI

SEQ ID NO: 101177 - protein, 14 aa, Borrelia burgdorferi
TGVRLKESTQQGIQ

SEQ ID NO: 101178 - protein, 14 aa, Borrelia burgdorferi
GVRLKESTQQGIQR

SEQ ID NO: 101179 - protein, 14 aa, Borrelia burgdorferi
VRLKESTQQGIQRY

SEQ ID NO: 101180 - protein, 14 aa, Borrelia burgdorferi
RLKESTQQGIQRYG

SEQ ID NO: 101181 - protein, 14 aa, Borrelia burgdorferi
LKESTQQGIQRYGI

SEQ ID NO: 101182 - protein, 14 aa, Borrelia burgdorferi
KESTQQGIQRYGIY

SEQ ID NO: 101183 - protein, 14 aa, Borrelia burgdorferi
ESTQQGIQRYGIYE

SEQ ID NO: 101184 - protein, 14 aa, Borrelia burgdorferi
STQQGIQRYGIYER

SEQ ID NO: 101185 - protein, 14 aa, Borrelia burgdorferi
TQQGIQRYGIYERE

SEQ ID NO: 101186 - protein, 14 aa, Borrelia burgdorferi
QQGIQRYGIYEREK

SEQ ID NO: 101187 - protein, 14 aa, Borrelia burgdorferi
QGIQRYGIYEREKD

SEQ ID NO: 101188 - protein, 14 aa, Borrelia burgdorferi
GIQRYGIYEREKDL

SEQ ID NO: 101189 - protein, 14 aa, Borrelia burgdorferi
IQRYGIYEREKDLV

SEQ ID NO: 101190 - protein, 14 aa, Borrelia burgdorferi
QRYGIYEREKDLVV

SEQ ID NO: 101191 - protein, 14 aa, Borrelia burgdorferi
RYGIYEREKDLVVI

SEQ ID NO: 101192 - protein, 14 aa, Borrelia burgdorferi
YGIYEREKDLVVIK

SEQ ID NO: 101193 - protein, 14 aa, Borrelia burgdorferi
GIYEREKDLVVIKM

SEQ ID NO: 101194 - protein, 14 aa, Borrelia burgdorferi
IYEREKDLVVIKMD

SEQ ID NO: 101195 - protein, 14 aa, Borrelia burgdorferi
YEREKDLVVIKMDS

SEQ ID NO: 101196 - protein, 14 aa, Borrelia burgdorferi
EREKDLVVIKMDSG

SEQ ID NO: 101197 - protein, 14 aa, Borrelia burgdorferi
REKDLVVIKMDSGK

SEQ ID NO: 101198 - protein, 14 aa, Borrelia burgdorferi
EKDLVVIKMDSGKA

SEQ ID NO: 101199 - protein, 14 aa, Borrelia burgdorferi
KDLVVIKMDSGKAK

SEQ ID NO: 101200 - protein, 14 aa, Borrelia burgdorferi
DLVVIKMDSGKAKL

SEQ ID NO: 101201 - protein, 14 aa, Borrelia burgdorferi
LVVIKMDSGKAKLQ

SEQ ID NO: 101202 - protein, 14 aa, Borrelia burgdorferi
VVIKMDSGKAKLQI

SEQ ID NO: 101203 - protein, 14 aa, Borrelia burgdorferi
VIKMDSGKAKLQIL

SEQ ID NO: 101204 - protein, 14 aa, Borrelia burgdorferi
IKMDSGKAKLQILN

SEQ ID NO: 101205 - protein, 14 aa, Borrelia burgdorferi
KMDSGKAKLQILNK

SEQ ID NO: 101206 - protein, 14 aa, Borrelia burgdorferi
MDSGKAKLQILNKL

SEQ ID NO: 101207 - protein, 14 aa, Borrelia burgdorferi
DSGKAKLQILNKLE

SEQ ID NO: 101208 - protein, 14 aa, Borrelia burgdorferi
SGKAKLQILNKLEN

SEQ ID NO: 101209 - protein, 14 aa, Borrelia burgdorferi
GKAKLQILNKLENL

SEQ ID NO: 101210 - protein, 14 aa, Borrelia burgdorferi
KAKLQILNKLENLK

SEQ ID NO: 101211 - protein, 14 aa, Borrelia burgdorferi
AKLQILNKLENLKV

SEQ ID NO: 101212 - protein, 14 aa, Borrelia burgdorferi
KLQILNKLENLKVV

SEQ ID NO: 101213 - protein, 14 aa, Borrelia burgdorferi
LQILNKLENLKVVS

SEQ ID NO: 101214 - protein, 14 aa, Borrelia burgdorferi
QILNKLENLKVVSE

SEQ ID NO: 101215 - protein, 14 aa, Borrelia burgdorferi
ILNKLENLKVVSES

SEQ ID NO: 101216 - protein, 14 aa, Borrelia burgdorferi
LNKLENLKVVSESN

SEQ ID NO: 101217 - protein, 14 aa, Borrelia burgdorferi
NKLENLKVVSESNF

SEQ ID NO: 101218 - protein, 14 aa, Borrelia burgdorferi
KLENLKVVSESNFE

SEQ ID NO: 101219 - protein, 14 aa, Borrelia burgdorferi
LENLKVVSESNFEI

SEQ ID NO: 101220 - protein, 14 aa, Borrelia burgdorferi
ENLKVVSESNFEIN

SEQ ID NO: 101221 - protein, 14 aa, Borrelia burgdorferi
NLKVVSESNFEINK

SEQ ID NO: 101222 - protein, 14 aa, Borrelia burgdorferi
LKVVSESNFEINKN

SEQ ID NO: 101223 - protein, 14 aa, Borrelia burgdorferi
KVVSESNFEINKNS

SEQ ID NO: 101224 - protein, 14 aa, Borrelia burgdorferi
VVSESNFEINKNSS

SEQ ID NO: 101225 - protein, 14 aa, Borrelia burgdorferi
VSESNFEINKNSSL

SEQ ID NO: 101226 - protein, 14 aa, Borrelia burgdorferi
SESNFEINKNSSLY

SEQ ID NO: 101227 - protein, 14 aa, Borrelia burgdorferi
ESNFEINKNSSLYV

SEQ ID NO: 101228 - protein, 14 aa, Borrelia burgdorferi
SNFEINKNSSLYVD

SEQ ID NO: 101229 - protein, 14 aa, Borrelia burgdorferi
NFEINKNSSLYVDS

SEQ ID NO: 101230 - protein, 14 aa, Borrelia burgdorferi
FEINKNSSLYVDSK

SEQ ID NO: 101231 - protein, 14 aa, Borrelia burgdorferi
EINKNSSLYVDSKM

SEQ ID NO: 101232 - protein, 14 aa, Borrelia burgdorferi
INKNSSLYVDSKMI

SEQ ID NO: 101233 - protein, 14 aa, Borrelia burgdorferi
NKNSSLYVDSKMIL

SEQ ID NO: 101234 - protein, 14 aa, Borrelia burgdorferi
KNSSLYVDSKMILA

SEQ ID NO: 101235 - protein, 14 aa, Borrelia burgdorferi
NSSLYVDSKMILAA

SEQ ID NO: 101236 - protein, 14 aa, Borrelia burgdorferi
SSLYVDSKMILAAV

SEQ ID NO: 101237 - protein, 14 aa, Borrelia burgdorferi
SLYVDSKMILAAVR

SEQ ID NO: 101238 - protein, 14 aa, Borrelia burgdorferi
LYVDSKMILAAVRD

SEQ ID NO: 101239 - protein, 14 aa, Borrelia burgdorferi
YVDSKMILAAVRDK

SEQ ID NO: 101240 - protein, 14 aa, Borrelia burgdorferi
VDSKMILAAVRDKD

SEQ ID NO: 101241 - protein, 14 aa, Borrelia burgdorferi
DSKMILAAVRDKDD

SEQ ID NO: 101242 - protein, 14 aa, Borrelia burgdorferi
SKMILAAVRDKDDS

SEQ ID NO: 101243 - protein, 14 aa, Borrelia burgdorferi
KMILAAVRDKDDSN

SEQ ID NO: 101244 - protein, 14 aa, Borrelia burgdorferi
MILAAVRDKDDSNA

SEQ ID NO: 101245 - protein, 14 aa, Borrelia burgdorferi
ILAAVRDKDDSNAW

SEQ ID NO: 101246 - protein, 14 aa, Borrelia burgdorferi
LAAVRDKDDSNAWR

SEQ ID NO: 101247 - protein, 14 aa, Borrelia burgdorferi
AAVRDKDDSNAWRL

SEQ ID NO: 101248 - protein, 14 aa, Borrelia burgdorferi
AVRDKDDSNAWRLA

SEQ ID NO: 101249 - protein, 14 aa, Borrelia burgdorferi
VRDKDDSNAWRLAK

SEQ ID NO: 101250 - protein, 14 aa, Borrelia burgdorferi
RDKDDSNAWRLAKF

SEQ ID NO: 101251 - protein, 14 aa, Borrelia burgdorferi
DKDDSNAWRLAKFS

SEQ ID NO: 101252 - protein, 14 aa, Borrelia burgdorferi
KDDSNAWRLAKFSP

SEQ ID NO: 101253 - protein, 14 aa, Borrelia burgdorferi
DDSNAWRLAKFSPK

SEQ ID NO: 101254 - protein, 14 aa, Borrelia burgdorferi
DSNAWRLAKFSPKN

SEQ ID NO: 101255 - protein, 14 aa, Borrelia burgdorferi
SNAWRLAKFSPKNL

SEQ ID NO: 101256 - protein, 14 aa, Borrelia burgdorferi
NAWRLAKFSPKNLD

SEQ ID NO: 101257 - protein, 14 aa, Borrelia burgdorferi
AWRLAKFSPKNLDE

SEQ ID NO: 101258 - protein, 14 aa, Borrelia burgdorferi
WRLAKFSPKNLDEF

SEQ ID NO: 101259 - protein, 14 aa, Borrelia burgdorferi
RLAKFSPKNLDEFI

SEQ ID NO: 101260 - protein, 14 aa, Borrelia burgdorferi
LAKFSPKNLDEFIL

SEQ ID NO: 101261 - protein, 14 aa, Borrelia burgdorferi
AKFSPKNLDEFILS

SEQ ID NO: 101262 - protein, 14 aa, Borrelia burgdorferi
KFSPKNLDEFILSE

SEQ ID NO: 101263 - protein, 14 aa, Borrelia burgdorferi
FSPKNLDEFILSEN

SEQ ID NO: 101264 - protein, 14 aa, Borrelia burgdorferi
SPKNLDEFILSENK

SEQ ID NO: 101265 - protein, 14 aa, Borrelia burgdorferi
PKNLDEFILSENKI

SEQ ID NO: 101266 - protein, 14 aa, Borrelia burgdorferi
KNLDEFILSENKIL

SEQ ID NO: 101267 - protein, 14 aa, Borrelia burgdorferi
NLDEFILSENKILP

SEQ ID NO: 101268 - protein, 14 aa, Borrelia burgdorferi
LDEFILSENKILPF

SEQ ID NO: 101269 - protein, 14 aa, Borrelia burgdorferi
DEFILSENKILPFT

SEQ ID NO: 101270 - protein, 14 aa, Borrelia burgdorferi
EFILSENKILPFTS

SEQ ID NO: 101271 - protein, 14 aa, Borrelia burgdorferi
FILSENKILPFTSF

SEQ ID NO: 101272 - protein, 14 aa, Borrelia burgdorferi
ILSENKILPFTSFS

SEQ ID NO: 101273 - protein, 14 aa, Borrelia burgdorferi
LSENKILPFTSFSV

SEQ ID NO: 101274 - protein, 14 aa, Borrelia burgdorferi
SENKILPFTSFSVR

SEQ ID NO: 101275 - protein, 14 aa, Borrelia burgdorferi
ENKILPFTSFSVRK

SEQ ID NO: 101276 - protein, 14 aa, Borrelia burgdorferi
NKILPFTSFSVRKN

SEQ ID NO: 101277 - protein, 14 aa, Borrelia burgdorferi
KILPFTSFSVRKNF

SEQ ID NO: 101278 - protein, 14 aa, Borrelia burgdorferi
ILPFTSFSVRKNFI

SEQ ID NO: 101279 - protein, 14 aa, Borrelia burgdorferi
LPFTSFSVRKNFIY

SEQ ID NO: 101280 - protein, 14 aa, Borrelia burgdorferi
PFTSFSVRKNFIYL

SEQ ID NO: 101281 - protein, 14 aa, Borrelia burgdorferi
FTSFSVRKNFIYLQ

SEQ ID NO: 101282 - protein, 14 aa, Borrelia burgdorferi
TSFSVRKNFIYLQD

SEQ ID NO: 101283 - protein, 14 aa, Borrelia burgdorferi
SFSVRKNFIYLQDE

SEQ ID NO: 101284 - protein, 14 aa, Borrelia burgdorferi
FSVRKNFIYLQDEL

SEQ ID NO: 101285 - protein, 14 aa, Borrelia burgdorferi
SVRKNFIYLQDELK

SEQ ID NO: 101286 - protein, 14 aa, Borrelia burgdorferi
VRKNFIYLQDELKN

SEQ ID NO: 101287 - protein, 14 aa, Borrelia burgdorferi
RKNFIYLQDELKNL

SEQ ID NO: 101288 - protein, 14 aa, Borrelia burgdorferi
KNFIYLQDELKNLV

SEQ ID NO: 101289 - protein, 14 aa, Borrelia burgdorferi
NFIYLQDELKNLVI

SEQ ID NO: 101290 - protein, 14 aa, Borrelia burgdorferi
FIYLQDELKNLVIL

SEQ ID NO: 101291 - protein, 14 aa, Borrelia burgdorferi
IYLQDELKNLVILD

SEQ ID NO: 101292 - protein, 14 aa, Borrelia burgdorferi
YLQDELKNLVILDV

SEQ ID NO: 101293 - protein, 14 aa, Borrelia burgdorferi
LQDELKNLVILDVN

SEQ ID NO: 101294 - protein, 14 aa, Borrelia burgdorferi
QDELKNLVILDVNT

SEQ ID NO: 101295 - protein, 14 aa, Borrelia burgdorferi
DELKNLVILDVNTL

SEQ ID NO: 101296 - protein, 14 aa, Borrelia burgdorferi
ELKNLVILDVNTLK

SEQ ID NO: 101297 - protein, 14 aa, Borrelia burgdorferi
LKNLVILDVNTLKK

SEQ ID NO: 101298 - protein, 14 aa, Borrelia burgdorferi
KNLVILDVNTLKKV

SEQ ID NO: 101299 - protein, 14 aa, Borrelia burgdorferi
NLVILDVNTLKKVK

SEQ ID NO: 101300 - protein, 15 aa, Borrelia burgdorferi
MKKMLLIFSFFLIFL

SEQ ID NO: 101301 - protein, 15 aa, Borrelia burgdorferi
KKMLLIFSFFLIFLN

SEQ ID NO: 101302 - protein, 15 aa, Borrelia burgdorferi
KMLLIFSFFLIFLNG

SEQ ID NO: 101303 - protein, 15 aa, Borrelia burgdorferi
MLLIFSFFLIFLNGF

SEQ ID NO: 101304 - protein, 15 aa, Borrelia burgdorferi
LLIFSFFLIFLNGFP

SEQ ID NO: 101305 - protein, 15 aa, Borrelia burgdorferi
LIFSFFLIFLNGFPL

SEQ ID NO: 101306 - protein, 15 aa, Borrelia burgdorferi
IFSFFLIFLNGFPLN

SEQ ID NO: 101307 - protein, 15 aa, Borrelia burgdorferi
FSFFLIFLNGFPLNA

SEQ ID NO: 101308 - protein, 15 aa, Borrelia burgdorferi
SFFLIFLNGFPLNAR

SEQ ID NO: 101309 - protein, 15 aa, Borrelia burgdorferi
FFLIFLNGFPLNARK

SEQ ID NO: 101310 - protein, 15 aa, Borrelia burgdorferi
FLIFLNGFPLNARKV

SEQ ID NO: 101311 - protein, 15 aa, Borrelia burgdorferi
LIFLNGFPLNARKVD

SEQ ID NO: 101312 - protein, 15 aa, Borrelia burgdorferi
IFLNGFPLNARKVDK

SEQ ID NO: 101313 - protein, 15 aa, Borrelia burgdorferi
FLNGFPLNARKVDKE

SEQ ID NO: 101314 - protein, 15 aa, Borrelia burgdorferi
LNGFPLNARKVDKEK

SEQ ID NO: 101315 - protein, 15 aa, Borrelia burgdorferi
NGFPLNARKVDKEKL

SEQ ID NO: 101316 - protein, 15 aa, Borrelia burgdorferi
GFPLNARKVDKEKLK

SEQ ID NO: 101317 - protein, 15 aa, Borrelia burgdorferi
FPLNARKVDKEKLKD

SEQ ID NO: 101318 - protein, 15 aa, Borrelia burgdorferi
PLNARKVDKEKLKDF

SEQ ID NO: 101319 - protein, 15 aa, Borrelia burgdorferi
LNARKVDKEKLKDFV

SEQ ID NO: 101320 - protein, 15 aa, Borrelia burgdorferi
NARKVDKEKLKDFVN

SEQ ID NO: 101321 - protein, 15 aa, Borrelia burgdorferi
ARKVDKEKLKDFVNM

SEQ ID NO: 101322 - protein, 15 aa, Borrelia burgdorferi
RKVDKEKLKDFVNMD

SEQ ID NO: 101323 - protein, 15 aa, Borrelia burgdorferi
KVDKEKLKDFVNMDL

SEQ ID NO: 101324 - protein, 15 aa, Borrelia burgdorferi
VDKEKLKDFVNMDLE

SEQ ID NO: 101325 - protein, 15 aa, Borrelia burgdorferi
DKEKLKDFVNMDLEF

SEQ ID NO: 101326 - protein, 15 aa, Borrelia burgdorferi
KEKLKDFVNMDLEFV

SEQ ID NO: 101327 - protein, 15 aa, Borrelia burgdorferi
EKLKDFVNMDLEFVN

SEQ ID NO: 101328 - protein, 15 aa, Borrelia burgdorferi
KLKDFVNMDLEFVNY

SEQ ID NO: 101329 - protein, 15 aa, Borrelia burgdorferi
LKDFVNMDLEFVNYK

SEQ ID NO: 101330 - protein, 15 aa, Borrelia burgdorferi
KDFVNMDLEFVNYKG

SEQ ID NO: 101331 - protein, 15 aa, Borrelia burgdorferi
DFVNMDLEFVNYKGP

SEQ ID NO: 101332 - protein, 15 aa, Borrelia burgdorferi
FVNMDLEFVNYKGPY

SEQ ID NO: 101333 - protein, 15 aa, Borrelia burgdorferi
VNMDLEFVNYKGPYD

SEQ ID NO: 101334 - protein, 15 aa, Borrelia burgdorferi
NMDLEFVNYKGPYDS

SEQ ID NO: 101335 - protein, 15 aa, Borrelia burgdorferi
MDLEFVNYKGPYDST

SEQ ID NO: 101336 - protein, 15 aa, Borrelia burgdorferi
DLEFVNYKGPYDSTN

SEQ ID NO: 101337 - protein, 15 aa, Borrelia burgdorferi
LEFVNYKGPYDSTNT

SEQ ID NO: 101338 - protein, 15 aa, Borrelia burgdorferi
EFVNYKGPYDSTNTY

SEQ ID NO: 101339 - protein, 15 aa, Borrelia burgdorferi
FVNYKGPYDSTNTYE

SEQ ID NO: 101340 - protein, 15 aa, Borrelia burgdorferi
VNYKGPYDSTNTYEQ

SEQ ID NO: 101341 - protein, 15 aa, Borrelia burgdorferi
NYKGPYDSTNTYEQI

SEQ ID NO: 101342 - protein, 15 aa, Borrelia burgdorferi
YKGPYDSTNTYEQIV

SEQ ID NO: 101343 - protein, 15 aa, Borrelia burgdorferi
KGPYDSTNTYEQIVG

SEQ ID NO: 101344 - protein, 15 aa, Borrelia burgdorferi
GPYDSTNTYEQIVGI

SEQ ID NO: 101345 - protein, 15 aa, Borrelia burgdorferi
PYDSTNTYEQIVGIG

SEQ ID NO: 101346 - protein, 15 aa, Borrelia burgdorferi
YDSTNTYEQIVGIGE

SEQ ID NO: 101347 - protein, 15 aa, Borrelia burgdorferi
DSTNTYEQIVGIGEF

SEQ ID NO: 101348 - protein, 15 aa, Borrelia burgdorferi
STNTYEQIVGIGEFL

SEQ ID NO: 101349 - protein, 15 aa, Borrelia burgdorferi
TNTYEQIVGIGEFLA

SEQ ID NO: 101350 - protein, 15 aa, Borrelia burgdorferi
NTYEQIVGIGEFLAR

SEQ ID NO: 101351 - protein, 15 aa, Borrelia burgdorferi
TYEQIVGIGEFLARP

SEQ ID NO: 101352 - protein, 15 aa, Borrelia burgdorferi
YEQIVGIGEFLARPL

SEQ ID NO: 101353 - protein, 15 aa, Borrelia burgdorferi
EQIVGIGEFLARPLT

SEQ ID NO: 101354 - protein, 15 aa, Borrelia burgdorferi
QIVGIGEFLARPLTN

SEQ ID NO: 101355 - protein, 15 aa, Borrelia burgdorferi
IVGIGEFLARPLTNS

SEQ ID NO: 101356 - protein, 15 aa, Borrelia burgdorferi
VGIGEFLARPLTNSN

SEQ ID NO: 101357 - protein, 15 aa, Borrelia burgdorferi
GIGEFLARPLTNSNS

SEQ ID NO: 101358 - protein, 15 aa, Borrelia burgdorferi
IGEFLARPLTNSNSN

SEQ ID NO: 101359 - protein, 15 aa, Borrelia burgdorferi
GEFLARPLTNSNSNS

SEQ ID NO: 101360 - protein, 15 aa, Borrelia burgdorferi
EFLARPLTNSNSNSS

SEQ ID NO: 101361 - protein, 15 aa, Borrelia burgdorferi
FLARPLTNSNSNSSY

SEQ ID NO: 101362 - protein, 15 aa, Borrelia burgdorferi
LARPLTNSNSNSSYY

SEQ ID NO: 101363 - protein, 15 aa, Borrelia burgdorferi
ARPLTNSNSNSSYYG

SEQ ID NO: 101364 - protein, 15 aa, Borrelia burgdorferi
RPLTNSNSNSSYYGK

SEQ ID NO: 101365 - protein, 15 aa, Borrelia burgdorferi
PLTNSNSNSSYYGKY

SEQ ID NO: 101366 - protein, 15 aa, Borrelia burgdorferi
LTNSNSNSSYYGKYF

SEQ ID NO: 101367 - protein, 15 aa, Borrelia burgdorferi
TNSNSNSSYYGKYFI

SEQ ID NO: 101368 - protein, 15 aa, Borrelia burgdorferi
NSNSNSSYYGKYFIN

SEQ ID NO: 101369 - protein, 15 aa, Borrelia burgdorferi
SNSNSSYYGKYFINR

SEQ ID NO: 101370 - protein, 15 aa, Borrelia burgdorferi
NSNSSYYGKYFINRF

SEQ ID NO: 101371 - protein, 15 aa, Borrelia burgdorferi
SNSSYYGKYFINRFI

SEQ ID NO: 101372 - protein, 15 aa, Borrelia burgdorferi
NSSYYGKYFINRFID

SEQ ID NO: 101373 - protein, 15 aa, Borrelia burgdorferi
SSYYGKYFINRFIDD

SEQ ID NO: 101374 - protein, 15 aa, Borrelia burgdorferi
SYYGKYFINRFIDDQ

SEQ ID NO: 101375 - protein, 15 aa, Borrelia burgdorferi
YYGKYFINRFIDDQD

SEQ ID NO: 101376 - protein, 15 aa, Borrelia burgdorferi
YGKYFINRFIDDQDK

SEQ ID NO: 101377 - protein, 15 aa, Borrelia burgdorferi
GKYFINRFIDDQDKK

SEQ ID NO: 101378 - protein, 15 aa, Borrelia burgdorferi
KYFINRFIDDQDKKA

SEQ ID NO: 101379 - protein, 15 aa, Borrelia burgdorferi
YFINRFIDDQDKKAS

SEQ ID NO: 101380 - protein, 15 aa, Borrelia burgdorferi
FINRFIDDQDKKASV

SEQ ID NO: 101381 - protein, 15 aa, Borrelia burgdorferi
INRFIDDQDKKASVD

SEQ ID NO: 101382 - protein, 15 aa, Borrelia burgdorferi
NRFIDDQDKKASVDV

SEQ ID NO: 101383 - protein, 15 aa, Borrelia burgdorferi
RFIDDQDKKASVDVF

SEQ ID NO: 101384 - protein, 15 aa, Borrelia burgdorferi
FIDDQDKKASVDVFS

SEQ ID NO: 101385 - protein, 15 aa, Borrelia burgdorferi
IDDQDKKASVDVFSI

SEQ ID NO: 101386 - protein, 15 aa, Borrelia burgdorferi
DDQDKKASVDVFSIS

SEQ ID NO: 101387 - protein, 15 aa, Borrelia burgdorferi
DQDKKASVDVFSISS

SEQ ID NO: 101388 - protein, 15 aa, Borrelia burgdorferi
QDKKASVDVFSISSK

SEQ ID NO: 101389 - protein, 15 aa, Borrelia burgdorferi
DKKASVDVFSISSKS

SEQ ID NO: 101390 - protein, 15 aa, Borrelia burgdorferi
KKASVDVFSISSKSE

SEQ ID NO: 101391 - protein, 15 aa, Borrelia burgdorferi
KASVDVFSISSKSEL

SEQ ID NO: 101392 - protein, 15 aa, Borrelia burgdorferi
ASVDVFSISSKSELD

SEQ ID NO: 101393 - protein, 15 aa, Borrelia burgdorferi
SVDVFSISSKSELDS

SEQ ID NO: 101394 - protein, 15 aa, Borrelia burgdorferi
VDVFSISSKSELDSI

SEQ ID NO: 101395 - protein, 15 aa, Borrelia burgdorferi
DVFSISSKSELDSIL

SEQ ID NO: 101396 - protein, 15 aa, Borrelia burgdorferi
VFSISSKSELDSILN

SEQ ID NO: 101397 - protein, 15 aa, Borrelia burgdorferi
FSISSKSELDSILNL

SEQ ID NO: 101398 - protein, 15 aa, Borrelia burgdorferi
SISSKSELDSILNLR

SEQ ID NO: 101399 - protein, 15 aa, Borrelia burgdorferi
ISSKSELDSILNLRR

SEQ ID NO: 101400 - protein, 15 aa, Borrelia burgdorferi
SSKSELDSILNLRRI

SEQ ID NO: 101401 - protein, 15 aa, Borrelia burgdorferi
SKSELDSILNLRRIL

SEQ ID NO: 101402 - protein, 15 aa, Borrelia burgdorferi
KSELDSILNLRRILT

SEQ ID NO: 101403 - protein, 15 aa, Borrelia burgdorferi
SELDSILNLRRILTG

SEQ ID NO: 101404 - protein, 15 aa, Borrelia burgdorferi
ELDSILNLRRILTGY

SEQ ID NO: 101405 - protein, 15 aa, Borrelia burgdorferi
LDSILNLRRILTGYI

SEQ ID NO: 101406 - protein, 15 aa, Borrelia burgdorferi
DSILNLRRILTGYII

SEQ ID NO: 101407 - protein, 15 aa, Borrelia burgdorferi
SILNLRRILTGYIIK

SEQ ID NO: 101408 - protein, 15 aa, Borrelia burgdorferi
ILNLRRILTGYIIKS

SEQ ID NO: 101409 - protein, 15 aa, Borrelia burgdorferi
LNLRRILTGYIIKSF

SEQ ID NO: 101410 - protein, 15 aa, Borrelia burgdorferi
NLRRILTGYIIKSFD

SEQ ID NO: 101411 - protein, 15 aa, Borrelia burgdorferi
LRRILTGYIIKSFDY

SEQ ID NO: 101412 - protein, 15 aa, Borrelia burgdorferi
RRILTGYIIKSFDYD

SEQ ID NO: 101413 - protein, 15 aa, Borrelia burgdorferi
RILTGYIIKSFDYDR

SEQ ID NO: 101414 - protein, 15 aa, Borrelia burgdorferi
ILTGYIIKSFDYDRS

SEQ ID NO: 101415 - protein, 15 aa, Borrelia burgdorferi
LTGYIIKSFDYDRSS

SEQ ID NO: 101416 - protein, 15 aa, Borrelia burgdorferi
TGYIIKSFDYDRSSA

SEQ ID NO: 101417 - protein, 15 aa, Borrelia burgdorferi
GYIIKSFDYDRSSAE

SEQ ID NO: 101418 - protein, 15 aa, Borrelia burgdorferi
YIIKSFDYDRSSAEL

SEQ ID NO: 101419 - protein, 15 aa, Borrelia burgdorferi
IIKSFDYDRSSAELI

SEQ ID NO: 101420 - protein, 15 aa, Borrelia burgdorferi
IKSFDYDRSSAELIA

SEQ ID NO: 101421 - protein, 15 aa, Borrelia burgdorferi
KSFDYDRSSAELIAK

SEQ ID NO: 101422 - protein, 15 aa, Borrelia burgdorferi
SFDYDRSSAELIAKV

SEQ ID NO: 101423 - protein, 15 aa, Borrelia burgdorferi
FDYDRSSAELIAKVI

SEQ ID NO: 101424 - protein, 15 aa, Borrelia burgdorferi
DYDRSSAELIAKVIT

SEQ ID NO: 101425 - protein, 15 aa, Borrelia burgdorferi
YDRSSAELIAKVITI

SEQ ID NO: 101426 - protein, 15 aa, Borrelia burgdorferi
DRSSAELIAKVITIY

SEQ ID NO: 101427 - protein, 15 aa, Borrelia burgdorferi
RSSAELIAKVITIYN

SEQ ID NO: 101428 - protein, 15 aa, Borrelia burgdorferi
SSAELIAKVITIYNA

SEQ ID NO: 101429 - protein, 15 aa, Borrelia burgdorferi
SAELIAKVITIYNAV

SEQ ID NO: 101430 - protein, 15 aa, Borrelia burgdorferi
AELIAKVITIYNAVY

SEQ ID NO: 101431 - protein, 15 aa, Borrelia burgdorferi
ELIAKVITIYNAVYR

SEQ ID NO: 101432 - protein, 15 aa, Borrelia burgdorferi
LIAKVITIYNAVYRG

SEQ ID NO: 101433 - protein, 15 aa, Borrelia burgdorferi
IAKVITIYNAVYRGD

SEQ ID NO: 101434 - protein, 15 aa, Borrelia burgdorferi
AKVITIYNAVYRGDL

SEQ ID NO: 101435 - protein, 15 aa, Borrelia burgdorferi
KVITIYNAVYRGDLD

SEQ ID NO: 101436 - protein, 15 aa, Borrelia burgdorferi
VITIYNAVYRGDLDY

SEQ ID NO: 101437 - protein, 15 aa, Borrelia burgdorferi
ITIYNAVYRGDLDYY

SEQ ID NO: 101438 - protein, 15 aa, Borrelia burgdorferi
TIYNAVYRGDLDYYK

SEQ ID NO: 101439 - protein, 15 aa, Borrelia burgdorferi
IYNAVYRGDLDYYKG

SEQ ID NO: 101440 - protein, 15 aa, Borrelia burgdorferi
YNAVYRGDLDYYKGF

SEQ ID NO: 101441 - protein, 15 aa, Borrelia burgdorferi
NAVYRGDLDYYKGFY

SEQ ID NO: 101442 - protein, 15 aa, Borrelia burgdorferi
AVYRGDLDYYKGFYI

SEQ ID NO: 101443 - protein, 15 aa, Borrelia burgdorferi
VYRGDLDYYKGFYIE

SEQ ID NO: 101444 - protein, 15 aa, Borrelia burgdorferi
YRGDLDYYKGFYIEP

SEQ ID NO: 101445 - protein, 15 aa, Borrelia burgdorferi
RGDLDYYKGFYIEPA

SEQ ID NO: 101446 - protein, 15 aa, Borrelia burgdorferi
GDLDYYKGFYIEPAL

SEQ ID NO: 101447 - protein, 15 aa, Borrelia burgdorferi
DLDYYKGFYIEPALK

SEQ ID NO: 101448 - protein, 15 aa, Borrelia burgdorferi
LDYYKGFYIEPALKS

SEQ ID NO: 101449 - protein, 15 aa, Borrelia burgdorferi
DYYKGFYIEPALKSL

SEQ ID NO: 101450 - protein, 15 aa, Borrelia burgdorferi
YYKGFYIEPALKSLT

SEQ ID NO: 101451 - protein, 15 aa, Borrelia burgdorferi
YKGFYIEPALKSLTK

SEQ ID NO: 101452 - protein, 15 aa, Borrelia burgdorferi
KGFYIEPALKSLTKE

SEQ ID NO: 101453 - protein, 15 aa, Borrelia burgdorferi
GFYIEPALKSLTKEN

SEQ ID NO: 101454 - protein, 15 aa, Borrelia burgdorferi
FYIEPALKSLTKENA

SEQ ID NO: 101455 - protein, 15 aa, Borrelia burgdorferi
YIEPALKSLTKENAG

SEQ ID NO: 101456 - protein, 15 aa, Borrelia burgdorferi
IEPALKSLTKENAGL

SEQ ID NO: 101457 - protein, 15 aa, Borrelia burgdorferi
EPALKSLTKENAGLS

SEQ ID NO: 101458 - protein, 15 aa, Borrelia burgdorferi
PALKSLTKENAGLSR

SEQ ID NO: 101459 - protein, 15 aa, Borrelia burgdorferi
ALKSLTKENAGLSRV

SEQ ID NO: 101460 - protein, 15 aa, Borrelia burgdorferi
LKSLTKENAGLSRVY

SEQ ID NO: 101461 - protein, 15 aa, Borrelia burgdorferi
KSLTKENAGLSRVYS

SEQ ID NO: 101462 - protein, 15 aa, Borrelia burgdorferi
SLTKENAGLSRVYSQ

SEQ ID NO: 101463 - protein, 15 aa, Borrelia burgdorferi
LTKENAGLSRVYSQW

SEQ ID NO: 101464 - protein, 15 aa, Borrelia burgdorferi
TKENAGLSRVYSQWA

SEQ ID NO: 101465 - protein, 15 aa, Borrelia burgdorferi
KENAGLSRVYSQWAG

SEQ ID NO: 101466 - protein, 15 aa, Borrelia burgdorferi
ENAGLSRVYSQWAGK

SEQ ID NO: 101467 - protein, 15 aa, Borrelia burgdorferi
NAGLSRVYSQWAGKT

SEQ ID NO: 101468 - protein, 15 aa, Borrelia burgdorferi
AGLSRVYSQWAGKTQ

SEQ ID NO: 101469 - protein, 15 aa, Borrelia burgdorferi
GLSRVYSQWAGKTQI

SEQ ID NO: 101470 - protein, 15 aa, Borrelia burgdorferi
LSRVYSQWAGKTQIF

SEQ ID NO: 101471 - protein, 15 aa, Borrelia burgdorferi
SRVYSQWAGKTQIFI

SEQ ID NO: 101472 - protein, 15 aa, Borrelia burgdorferi
RVYSQWAGKTQIFIP

SEQ ID NO: 101473 - protein, 15 aa, Borrelia burgdorferi
VYSQWAGKTQIFIPL

SEQ ID NO: 101474 - protein, 15 aa, Borrelia burgdorferi
YSQWAGKTQIFIPLK

SEQ ID NO: 101475 - protein, 15 aa, Borrelia burgdorferi
SQWAGKTQIFIPLKK

SEQ ID NO: 101476 - protein, 15 aa, Borrelia burgdorferi
QWAGKTQIFIPLKKD

SEQ ID NO: 101477 - protein, 15 aa, Borrelia burgdorferi
WAGKTQIFIPLKKDI

SEQ ID NO: 101478 - protein, 15 aa, Borrelia burgdorferi
AGKTQIFIPLKKDIL

SEQ ID NO: 101479 - protein, 15 aa, Borrelia burgdorferi
GKTQIFIPLKKDILS

SEQ ID NO: 101480 - protein, 15 aa, Borrelia burgdorferi
KTQIFIPLKKDILSG

SEQ ID NO: 101481 - protein, 15 aa, Borrelia burgdorferi
TQIFIPLKKDILSGN

SEQ ID NO: 101482 - protein, 15 aa, Borrelia burgdorferi
QIFIPLKKDILSGNI

SEQ ID NO: 101483 - protein, 15 aa, Borrelia burgdorferi
IFIPLKKDILSGNIE

SEQ ID NO: 101484 - protein, 15 aa, Borrelia burgdorferi
FIPLKKDILSGNIES

SEQ ID NO: 101485 - protein, 15 aa, Borrelia burgdorferi
IPLKKDILSGNIESD

SEQ ID NO: 101486 - protein, 15 aa, Borrelia burgdorferi
PLKKDILSGNIESDI

SEQ ID NO: 101487 - protein, 15 aa, Borrelia burgdorferi
LKKDILSGNIESDID

SEQ ID NO: 101488 - protein, 15 aa, Borrelia burgdorferi
KKDILSGNIESDIDI

SEQ ID NO: 101489 - protein, 15 aa, Borrelia burgdorferi
KDILSGNIESDIDID

SEQ ID NO: 101490 - protein, 15 aa, Borrelia burgdorferi
DILSGNIESDIDIDS

SEQ ID NO: 101491 - protein, 15 aa, Borrelia burgdorferi
ILSGNIESDIDIDSL

SEQ ID NO: 101492 - protein, 15 aa, Borrelia burgdorferi
LSGNIESDIDIDSLV

SEQ ID NO: 101493 - protein, 15 aa, Borrelia burgdorferi
SGNIESDIDIDSLVT

SEQ ID NO: 101494 - protein, 15 aa, Borrelia burgdorferi
GNIESDIDIDSLVTD

SEQ ID NO: 101495 - protein, 15 aa, Borrelia burgdorferi
NIESDIDIDSLVTDK

SEQ ID NO: 101496 - protein, 15 aa, Borrelia burgdorferi
IESDIDIDSLVTDKV

SEQ ID NO: 101497 - protein, 15 aa, Borrelia burgdorferi
ESDIDIDSLVTDKVI

SEQ ID NO: 101498 - protein, 15 aa, Borrelia burgdorferi
SDIDIDSLVTDKVIA

SEQ ID NO: 101499 - protein, 15 aa, Borrelia burgdorferi
DIDIDSLVTDKVIAA

SEQ ID NO: 101500 - protein, 15 aa, Borrelia burgdorferi
IDIDSLVTDKVIAAL

SEQ ID NO: 101501 - protein, 15 aa, Borrelia burgdorferi
DIDSLVTDKVIAALL

SEQ ID NO: 101502 - protein, 15 aa, Borrelia burgdorferi
IDSLVTDKVIAALLS

SEQ ID NO: 101503 - protein, 15 aa, Borrelia burgdorferi
DSLVTDKVIAALLSE

SEQ ID NO: 101504 - protein, 15 aa, Borrelia burgdorferi
SLVTDKVIAALLSEN

SEQ ID NO: 101505 - protein, 15 aa, Borrelia burgdorferi
LVTDKVIAALLSENE

SEQ ID NO: 101506 - protein, 15 aa, Borrelia burgdorferi
VTDKVIAALLSENEA

SEQ ID NO: 101507 - protein, 15 aa, Borrelia burgdorferi
TDKVIAALLSENEAG

SEQ ID NO: 101508 - protein, 15 aa, Borrelia burgdorferi
DKVIAALLSENEAGV

SEQ ID NO: 101509 - protein, 15 aa, Borrelia burgdorferi
KVIAALLSENEAGVN

SEQ ID NO: 101510 - protein, 15 aa, Borrelia burgdorferi
VIAALLSENEAGVNF

SEQ ID NO: 101511 - protein, 15 aa, Borrelia burgdorferi
IAALLSENEAGVNFA

SEQ ID NO: 101512 - protein, 15 aa, Borrelia burgdorferi
AALLSENEAGVNFAR

SEQ ID NO: 101513 - protein, 15 aa, Borrelia burgdorferi
ALLSENEAGVNFARD

SEQ ID NO: 101514 - protein, 15 aa, Borrelia burgdorferi
LLSENEAGVNFARDI

SEQ ID NO: 101515 - protein, 15 aa, Borrelia burgdorferi
LSENEAGVNFARDIT

SEQ ID NO: 101516 - protein, 15 aa, Borrelia burgdorferi
SENEAGVNFARDITD

SEQ ID NO: 101517 - protein, 15 aa, Borrelia burgdorferi
ENEAGVNFARDITDI

SEQ ID NO: 101518 - protein, 15 aa, Borrelia burgdorferi
NEAGVNFARDITDIQ

SEQ ID NO: 101519 - protein, 15 aa, Borrelia burgdorferi
EAGVNFARDITDIQG

SEQ ID NO: 101520 - protein, 15 aa, Borrelia burgdorferi
AGVNFARDITDIQGE

SEQ ID NO: 101521 - protein, 15 aa, Borrelia burgdorferi
GVNFARDITDIQGET

SEQ ID NO: 101522 - protein, 15 aa, Borrelia burgdorferi
VNFARDITDIQGETH

SEQ ID NO: 101523 - protein, 15 aa, Borrelia burgdorferi
NFARDITDIQGETHK

SEQ ID NO: 101524 - protein, 15 aa, Borrelia burgdorferi
FARDITDIQGETHKA

SEQ ID NO: 101525 - protein, 15 aa, Borrelia burgdorferi
ARDITDIQGETHKAD

SEQ ID NO: 101526 - protein, 15 aa, Borrelia burgdorferi
RDITDIQGETHKADQ

SEQ ID NO: 101527 - protein, 15 aa, Borrelia burgdorferi
DITDIQGETHKADQD

SEQ ID NO: 101528 - protein, 15 aa, Borrelia burgdorferi
ITDIQGETHKADQDK

SEQ ID NO: 101529 - protein, 15 aa, Borrelia burgdorferi
TDIQGETHKADQDKI

SEQ ID NO: 101530 - protein, 15 aa, Borrelia burgdorferi
DIQGETHKADQDKID

SEQ ID NO: 101531 - protein, 15 aa, Borrelia burgdorferi
IQGETHKADQDKIDT

SEQ ID NO: 101532 - protein, 15 aa, Borrelia burgdorferi
QGETHKADQDKIDTE

SEQ ID NO: 101533 - protein, 15 aa, Borrelia burgdorferi
GETHKADQDKIDTEL

SEQ ID NO: 101534 - protein, 15 aa, Borrelia burgdorferi
ETHKADQDKIDTELD

SEQ ID NO: 101535 - protein, 15 aa, Borrelia burgdorferi
THKADQDKIDTELDN

SEQ ID NO: 101536 - protein, 15 aa, Borrelia burgdorferi
HKADQDKIDTELDNI

SEQ ID NO: 101537 - protein, 15 aa, Borrelia burgdorferi
KADQDKIDTELDNIH

SEQ ID NO: 101538 - protein, 15 aa, Borrelia burgdorferi
ADQDKIDTELDNIHE

SEQ ID NO: 101539 - protein, 15 aa, Borrelia burgdorferi
DQDKIDTELDNIHES

SEQ ID NO: 101540 - protein, 15 aa, Borrelia burgdorferi
QDKIDTELDNIHESD

SEQ ID NO: 101541 - protein, 15 aa, Borrelia burgdorferi
DKIDTELDNIHESDS

SEQ ID NO: 101542 - protein, 15 aa, Borrelia burgdorferi
KIDTELDNIHESDSN

SEQ ID NO: 101543 - protein, 15 aa, Borrelia burgdorferi
IDTELDNIHESDSNI

SEQ ID NO: 101544 - protein, 15 aa, Borrelia burgdorferi
DTELDNIHESDSNIT

SEQ ID NO: 101545 - protein, 15 aa, Borrelia burgdorferi
TELDNIHESDSNITE

SEQ ID NO: 101546 - protein, 15 aa, Borrelia burgdorferi
ELDNIHESDSNITET

SEQ ID NO: 101547 - protein, 15 aa, Borrelia burgdorferi
LDNIHESDSNITETI

SEQ ID NO: 101548 - protein, 15 aa, Borrelia burgdorferi
DNIHESDSNITETIE

SEQ ID NO: 101549 - protein, 15 aa, Borrelia burgdorferi
NIHESDSNITETIEN

SEQ ID NO: 101550 - protein, 15 aa, Borrelia burgdorferi
IHESDSNITETIENL

SEQ ID NO: 101551 - protein, 15 aa, Borrelia burgdorferi
HESDSNITETIENLR

SEQ ID NO: 101552 - protein, 15 aa, Borrelia burgdorferi
ESDSNITETIENLRD

SEQ ID NO: 101553 - protein, 15 aa, Borrelia burgdorferi
SDSNITETIENLRDQ

SEQ ID NO: 101554 - protein, 15 aa, Borrelia burgdorferi
DSNITETIENLRDQL

SEQ ID NO: 101555 - protein, 15 aa, Borrelia burgdorferi
SNITETIENLRDQLE

SEQ ID NO: 101556 - protein, 15 aa, Borrelia burgdorferi
NITETIENLRDQLEK

SEQ ID NO: 101557 - protein, 15 aa, Borrelia burgdorferi
ITETIENLRDQLEKA

SEQ ID NO: 101558 - protein, 15 aa, Borrelia burgdorferi
TETIENLRDQLEKAT

SEQ ID NO: 101559 - protein, 15 aa, Borrelia burgdorferi
ETIENLRDQLEKATD

SEQ ID NO: 101560 - protein, 15 aa, Borrelia burgdorferi
TIENLRDQLEKATDE

SEQ ID NO: 101561 - protein, 15 aa, Borrelia burgdorferi
IENLRDQLEKATDEE

SEQ ID NO: 101562 - protein, 15 aa, Borrelia burgdorferi
ENLRDQLEKATDEEH

SEQ ID NO: 101563 - protein, 15 aa, Borrelia burgdorferi
NLRDQLEKATDEEHK

SEQ ID NO: 101564 - protein, 15 aa, Borrelia burgdorferi
LRDQLEKATDEEHKK

SEQ ID NO: 101565 - protein, 15 aa, Borrelia burgdorferi
RDQLEKATDEEHKKE

SEQ ID NO: 101566 - protein, 15 aa, Borrelia burgdorferi
DQLEKATDEEHKKEI

SEQ ID NO: 101567 - protein, 15 aa, Borrelia burgdorferi
QLEKATDEEHKKEIE

SEQ ID NO: 101568 - protein, 15 aa, Borrelia burgdorferi
LEKATDEEHKKEIES

SEQ ID NO: 101569 - protein, 15 aa, Borrelia burgdorferi
EKATDEEHKKEIESQ

SEQ ID NO: 101570 - protein, 15 aa, Borrelia burgdorferi
KATDEEHKKEIESQV

SEQ ID NO: 101571 - protein, 15 aa, Borrelia burgdorferi
ATDEEHKKEIESQVD

SEQ ID NO: 101572 - protein, 15 aa, Borrelia burgdorferi
TDEEHKKEIESQVDA

SEQ ID NO: 101573 - protein, 15 aa, Borrelia burgdorferi
DEEHKKEIESQVDAK

SEQ ID NO: 101574 - protein, 15 aa, Borrelia burgdorferi
EEHKKEIESQVDAKK

SEQ ID NO: 101575 - protein, 15 aa, Borrelia burgdorferi
EHKKEIESQVDAKKK

SEQ ID NO: 101576 - protein, 15 aa, Borrelia burgdorferi
HKKEIESQVDAKKKE

SEQ ID NO: 101577 - protein, 15 aa, Borrelia burgdorferi
KKEIESQVDAKKKEK

SEQ ID NO: 101578 - protein, 15 aa, Borrelia burgdorferi
KEIESQVDAKKKEKE

SEQ ID NO: 101579 - protein, 15 aa, Borrelia burgdorferi
EIESQVDAKKKEKEE

SEQ ID NO: 101580 - protein, 15 aa, Borrelia burgdorferi
IESQVDAKKKEKEEL

SEQ ID NO: 101581 - protein, 15 aa, Borrelia burgdorferi
ESQVDAKKKEKEELD

SEQ ID NO: 101582 - protein, 15 aa, Borrelia burgdorferi
SQVDAKKKEKEELDK

SEQ ID NO: 101583 - protein, 15 aa, Borrelia burgdorferi
QVDAKKKEKEELDKK

SEQ ID NO: 101584 - protein, 15 aa, Borrelia burgdorferi
VDAKKKEKEELDKKA

SEQ ID NO: 101585 - protein, 15 aa, Borrelia burgdorferi
DAKKKEKEELDKKAI

SEQ ID NO: 101586 - protein, 15 aa, Borrelia burgdorferi
AKKKEKEELDKKAIN

SEQ ID NO: 101587 - protein, 15 aa, Borrelia burgdorferi
KKKEKEELDKKAINL

SEQ ID NO: 101588 - protein, 15 aa, Borrelia burgdorferi
KKEKEELDKKAINLD

SEQ ID NO: 101589 - protein, 15 aa, Borrelia burgdorferi
KEKEELDKKAINLDK

SEQ ID NO: 101590 - protein, 15 aa, Borrelia burgdorferi
EKEELDKKAINLDKA

SEQ ID NO: 101591 - protein, 15 aa, Borrelia burgdorferi
KEELDKKAINLDKAQ

SEQ ID NO: 101592 - protein, 15 aa, Borrelia burgdorferi
EELDKKAINLDKAQQ

SEQ ID NO: 101593 - protein, 15 aa, Borrelia burgdorferi
ELDKKAINLDKAQQK

SEQ ID NO: 101594 - protein, 15 aa, Borrelia burgdorferi
LDKKAINLDKAQQKL

SEQ ID NO: 101595 - protein, 15 aa, Borrelia burgdorferi
DKKAINLDKAQQKLD

SEQ ID NO: 101596 - protein, 15 aa, Borrelia burgdorferi
KKAINLDKAQQKLDS

SEQ ID NO: 101597 - protein, 15 aa, Borrelia burgdorferi
KAINLDKAQQKLDSA

SEQ ID NO: 101598 - protein, 15 aa, Borrelia burgdorferi
AINLDKAQQKLDSAE

SEQ ID NO: 101599 - protein, 15 aa, Borrelia burgdorferi
INLDKAQQKLDSAED

SEQ ID NO: 101600 - protein, 15 aa, Borrelia burgdorferi
NLDKAQQKLDSAEDN

SEQ ID NO: 101601 - protein, 15 aa, Borrelia burgdorferi
LDKAQQKLDSAEDNL

SEQ ID NO: 101602 - protein, 15 aa, Borrelia burgdorferi
DKAQQKLDSAEDNLD

SEQ ID NO: 101603 - protein, 15 aa, Borrelia burgdorferi
KAQQKLDSAEDNLDV

SEQ ID NO: 101604 - protein, 15 aa, Borrelia burgdorferi
AQQKLDSAEDNLDVQ

SEQ ID NO: 101605 - protein, 15 aa, Borrelia burgdorferi
QQKLDSAEDNLDVQR

SEQ ID NO: 101606 - protein, 15 aa, Borrelia burgdorferi
QKLDSAEDNLDVQRD

SEQ ID NO: 101607 - protein, 15 aa, Borrelia burgdorferi
KLDSAEDNLDVQRDT

SEQ ID NO: 101608 - protein, 15 aa, Borrelia burgdorferi
LDSAEDNLDVQRDTV

SEQ ID NO: 101609 - protein, 15 aa, Borrelia burgdorferi
DSAEDNLDVQRDTVR

SEQ ID NO: 101610 - protein, 15 aa, Borrelia burgdorferi
SAEDNLDVQRDTVRE

SEQ ID NO: 101611 - protein, 15 aa, Borrelia burgdorferi
AEDNLDVQRDTVREK

SEQ ID NO: 101612 - protein, 15 aa, Borrelia burgdorferi
EDNLDVQRDTVREKI

SEQ ID NO: 101613 - protein, 15 aa, Borrelia burgdorferi
DNLDVQRDTVREKIQ

SEQ ID NO: 101614 - protein, 15 aa, Borrelia burgdorferi
NLDVQRDTVREKIQE

SEQ ID NO: 101615 - protein, 15 aa, Borrelia burgdorferi
LDVQRDTVREKIQED

SEQ ID NO: 101616 - protein, 15 aa, Borrelia burgdorferi
DVQRDTVREKIQEDI

SEQ ID NO: 101617 - protein, 15 aa, Borrelia burgdorferi
VQRDTVREKIQEDIN

SEQ ID NO: 101618 - protein, 15 aa, Borrelia burgdorferi
QRDTVREKIQEDINE

SEQ ID NO: 101619 - protein, 15 aa, Borrelia burgdorferi
RDTVREKIQEDINEI

SEQ ID NO: 101620 - protein, 15 aa, Borrelia burgdorferi
DTVREKIQEDINEIN

SEQ ID NO: 101621 - protein, 15 aa, Borrelia burgdorferi
TVREKIQEDINEINK

SEQ ID NO: 101622 - protein, 15 aa, Borrelia burgdorferi
VREKIQEDINEINKE

SEQ ID NO: 101623 - protein, 15 aa, Borrelia burgdorferi
REKIQEDINEINKEK

SEQ ID NO: 101624 - protein, 15 aa, Borrelia burgdorferi
EKIQEDINEINKEKN

SEQ ID NO: 101625 - protein, 15 aa, Borrelia burgdorferi
KIQEDINEINKEKNL

SEQ ID NO: 101626 - protein, 15 aa, Borrelia burgdorferi
IQEDINEINKEKNLP

SEQ ID NO: 101627 - protein, 15 aa, Borrelia burgdorferi
QEDINEINKEKNLPK

SEQ ID NO: 101628 - protein, 15 aa, Borrelia burgdorferi
EDINEINKEKNLPKP

SEQ ID NO: 101629 - protein, 15 aa, Borrelia burgdorferi
DINEINKEKNLPKPG

SEQ ID NO: 101630 - protein, 15 aa, Borrelia burgdorferi
INEINKEKNLPKPGD

SEQ ID NO: 101631 - protein, 15 aa, Borrelia burgdorferi
NEINKEKNLPKPGDV

SEQ ID NO: 101632 - protein, 15 aa, Borrelia burgdorferi
EINKEKNLPKPGDVS

SEQ ID NO: 101633 - protein, 15 aa, Borrelia burgdorferi
INKEKNLPKPGDVSS

SEQ ID NO: 101634 - protein, 15 aa, Borrelia burgdorferi
NKEKNLPKPGDVSSP

SEQ ID NO: 101635 - protein, 15 aa, Borrelia burgdorferi
KEKNLPKPGDVSSPK

SEQ ID NO: 101636 - protein, 15 aa, Borrelia burgdorferi
EKNLPKPGDVSSPKV

SEQ ID NO: 101637 - protein, 15 aa, Borrelia burgdorferi
KNLPKPGDVSSPKVD

SEQ ID NO: 101638 - protein, 15 aa, Borrelia burgdorferi
NLPKPGDVSSPKVDK

SEQ ID NO: 101639 - protein, 15 aa, Borrelia burgdorferi
LPKPGDVSSPKVDKQ

SEQ ID NO: 101640 - protein, 15 aa, Borrelia burgdorferi
PKPGDVSSPKVDKQL

SEQ ID NO: 101641 - protein, 15 aa, Borrelia burgdorferi
KPGDVSSPKVDKQLQ

SEQ ID NO: 101642 - protein, 15 aa, Borrelia burgdorferi
PGDVSSPKVDKQLQI

SEQ ID NO: 101643 - protein, 15 aa, Borrelia burgdorferi
GDVSSPKVDKQLQIK

SEQ ID NO: 101644 - protein, 15 aa, Borrelia burgdorferi
DVSSPKVDKQLQIKE

SEQ ID NO: 101645 - protein, 15 aa, Borrelia burgdorferi
VSSPKVDKQLQIKES

SEQ ID NO: 101646 - protein, 15 aa, Borrelia burgdorferi
SSPKVDKQLQIKESL

SEQ ID NO: 101647 - protein, 15 aa, Borrelia burgdorferi
SPKVDKQLQIKESLE

SEQ ID NO: 101648 - protein, 15 aa, Borrelia burgdorferi
PKVDKQLQIKESLED

SEQ ID NO: 101649 - protein, 15 aa, Borrelia burgdorferi
KVDKQLQIKESLEDL

SEQ ID NO: 101650 - protein, 15 aa, Borrelia burgdorferi
VDKQLQIKESLEDLQ

SEQ ID NO: 101651 - protein, 15 aa, Borrelia burgdorferi
DKQLQIKESLEDLQE

SEQ ID NO: 101652 - protein, 15 aa, Borrelia burgdorferi
KQLQIKESLEDLQEQ

SEQ ID NO: 101653 - protein, 15 aa, Borrelia burgdorferi
QLQIKESLEDLQEQL

SEQ ID NO: 101654 - protein, 15 aa, Borrelia burgdorferi
LQIKESLEDLQEQLK

SEQ ID NO: 101655 - protein, 15 aa, Borrelia burgdorferi
QIKESLEDLQEQLKE

SEQ ID NO: 101656 - protein, 15 aa, Borrelia burgdorferi
IKESLEDLQEQLKEA

SEQ ID NO: 101657 - protein, 15 aa, Borrelia burgdorferi
KESLEDLQEQLKEAG

SEQ ID NO: 101658 - protein, 15 aa, Borrelia burgdorferi
ESLEDLQEQLKEAGD

SEQ ID NO: 101659 - protein, 15 aa, Borrelia burgdorferi
SLEDLQEQLKEAGDE

SEQ ID NO: 101660 - protein, 15 aa, Borrelia burgdorferi
LEDLQEQLKEAGDEN

SEQ ID NO: 101661 - protein, 15 aa, Borrelia burgdorferi
EDLQEQLKEAGDENQ

SEQ ID NO: 101662 - protein, 15 aa, Borrelia burgdorferi
DLQEQLKEAGDENQK

SEQ ID NO: 101663 - protein, 15 aa, Borrelia burgdorferi
LQEQLKEAGDENQKR

SEQ ID NO: 101664 - protein, 15 aa, Borrelia burgdorferi
QEQLKEAGDENQKRE

SEQ ID NO: 101665 - protein, 15 aa, Borrelia burgdorferi
EQLKEAGDENQKREI

SEQ ID NO: 101666 - protein, 15 aa, Borrelia burgdorferi
QLKEAGDENQKREIE

SEQ ID NO: 101667 - protein, 15 aa, Borrelia burgdorferi
LKEAGDENQKREIEK

SEQ ID NO: 101668 - protein, 15 aa, Borrelia burgdorferi
KEAGDENQKREIEKQ

SEQ ID NO: 101669 - protein, 15 aa, Borrelia burgdorferi
EAGDENQKREIEKQI

SEQ ID NO: 101670 - protein, 15 aa, Borrelia burgdorferi
AGDENQKREIEKQIE

SEQ ID NO: 101671 - protein, 15 aa, Borrelia burgdorferi
GDENQKREIEKQIEI

SEQ ID NO: 101672 - protein, 15 aa, Borrelia burgdorferi
DENQKREIEKQIEIK

SEQ ID NO: 101673 - protein, 15 aa, Borrelia burgdorferi
ENQKREIEKQIEIKK

SEQ ID NO: 101674 - protein, 15 aa, Borrelia burgdorferi
NQKREIEKQIEIKKR

SEQ ID NO: 101675 - protein, 15 aa, Borrelia burgdorferi
QKREIEKQIEIKKRD

SEQ ID NO: 101676 - protein, 15 aa, Borrelia burgdorferi
KREIEKQIEIKKRDE

SEQ ID NO: 101677 - protein, 15 aa, Borrelia burgdorferi
REIEKQIEIKKRDEE

SEQ ID NO: 101678 - protein, 15 aa, Borrelia burgdorferi
EIEKQIEIKKRDEEL

SEQ ID NO: 101679 - protein, 15 aa, Borrelia burgdorferi
IEKQIEIKKRDEELL

SEQ ID NO: 101680 - protein, 15 aa, Borrelia burgdorferi
EKQIEIKKRDEELLK

SEQ ID NO: 101681 - protein, 15 aa, Borrelia burgdorferi
KQIEIKKRDEELLKS

SEQ ID NO: 101682 - protein, 15 aa, Borrelia burgdorferi
QIEIKKRDEELLKSK

SEQ ID NO: 101683 - protein, 15 aa, Borrelia burgdorferi
IEIKKRDEELLKSKD

SEQ ID NO: 101684 - protein, 15 aa, Borrelia burgdorferi
EIKKRDEELLKSKDG

SEQ ID NO: 101685 - protein, 15 aa, Borrelia burgdorferi
IKKRDEELLKSKDGK

SEQ ID NO: 101686 - protein, 15 aa, Borrelia burgdorferi
KKRDEELLKSKDGKV

SEQ ID NO: 101687 - protein, 15 aa, Borrelia burgdorferi
KRDEELLKSKDGKVS

SEQ ID NO: 101688 - protein, 15 aa, Borrelia burgdorferi
RDEELLKSKDGKVSK

SEQ ID NO: 101689 - protein, 15 aa, Borrelia burgdorferi
DEELLKSKDGKVSKD

SEQ ID NO: 101690 - protein, 15 aa, Borrelia burgdorferi
EELLKSKDGKVSKDY

SEQ ID NO: 101691 - protein, 15 aa, Borrelia burgdorferi
ELLKSKDGKVSKDYE

SEQ ID NO: 101692 - protein, 15 aa, Borrelia burgdorferi
LLKSKDGKVSKDYEA

SEQ ID NO: 101693 - protein, 15 aa, Borrelia burgdorferi
LKSKDGKVSKDYEAL

SEQ ID NO: 101694 - protein, 15 aa, Borrelia burgdorferi
KSKDGKVSKDYEALD

SEQ ID NO: 101695 - protein, 15 aa, Borrelia burgdorferi
SKDGKVSKDYEALDL

SEQ ID NO: 101696 - protein, 15 aa, Borrelia burgdorferi
KDGKVSKDYEALDLD

SEQ ID NO: 101697 - protein, 15 aa, Borrelia burgdorferi
DGKVSKDYEALDLDR

SEQ ID NO: 101698 - protein, 15 aa, Borrelia burgdorferi
GKVSKDYEALDLDRE

SEQ ID NO: 101699 - protein, 15 aa, Borrelia burgdorferi
KVSKDYEALDLDREL

SEQ ID NO: 101700 - protein, 15 aa, Borrelia burgdorferi
VSKDYEALDLDRELS

SEQ ID NO: 101701 - protein, 15 aa, Borrelia burgdorferi
SKDYEALDLDRELSK

SEQ ID NO: 101702 - protein, 15 aa, Borrelia burgdorferi
KDYEALDLDRELSKA

SEQ ID NO: 101703 - protein, 15 aa, Borrelia burgdorferi
DYEALDLDRELSKAS

SEQ ID NO: 101704 - protein, 15 aa, Borrelia burgdorferi
YEALDLDRELSKASS

SEQ ID NO: 101705 - protein, 15 aa, Borrelia burgdorferi
EALDLDRELSKASSK

SEQ ID NO: 101706 - protein, 15 aa, Borrelia burgdorferi
ALDLDRELSKASSKE

SEQ ID NO: 101707 - protein, 15 aa, Borrelia burgdorferi
LDLDRELSKASSKEK

SEQ ID NO: 101708 - protein, 15 aa, Borrelia burgdorferi
DLDRELSKASSKEKS

SEQ ID NO: 101709 - protein, 15 aa, Borrelia burgdorferi
LDRELSKASSKEKSK

SEQ ID NO: 101710 - protein, 15 aa, Borrelia burgdorferi
DRELSKASSKEKSKV

SEQ ID NO: 101711 - protein, 15 aa, Borrelia burgdorferi
RELSKASSKEKSKVK

SEQ ID NO: 101712 - protein, 15 aa, Borrelia burgdorferi
ELSKASSKEKSKVKE

SEQ ID NO: 101713 - protein, 15 aa, Borrelia burgdorferi
LSKASSKEKSKVKEE

SEQ ID NO: 101714 - protein, 15 aa, Borrelia burgdorferi
SKASSKEKSKVKEEE

SEQ ID NO: 101715 - protein, 15 aa, Borrelia burgdorferi
KASSKEKSKVKEEEI

SEQ ID NO: 101716 - protein, 15 aa, Borrelia burgdorferi
ASSKEKSKVKEEEIT

SEQ ID NO: 101717 - protein, 15 aa, Borrelia burgdorferi
SSKEKSKVKEEEITK

SEQ ID NO: 101718 - protein, 15 aa, Borrelia burgdorferi
SKEKSKVKEEEITKG

SEQ ID NO: 101719 - protein, 15 aa, Borrelia burgdorferi
KEKSKVKEEEITKGK

SEQ ID NO: 101720 - protein, 15 aa, Borrelia burgdorferi
EKSKVKEEEITKGKS

SEQ ID NO: 101721 - protein, 15 aa, Borrelia burgdorferi
KSKVKEEEITKGKSR

SEQ ID NO: 101722 - protein, 15 aa, Borrelia burgdorferi
SKVKEEEITKGKSRA

SEQ ID NO: 101723 - protein, 15 aa, Borrelia burgdorferi
KVKEEEITKGKSRAS

SEQ ID NO: 101724 - protein, 15 aa, Borrelia burgdorferi
VKEEEITKGKSRASL

SEQ ID NO: 101725 - protein, 15 aa, Borrelia burgdorferi
KEEEITKGKSRASLG

SEQ ID NO: 101726 - protein, 15 aa, Borrelia burgdorferi
EEEITKGKSRASLGD

SEQ ID NO: 101727 - protein, 15 aa, Borrelia burgdorferi
EEITKGKSRASLGDL

SEQ ID NO: 101728 - protein, 15 aa, Borrelia burgdorferi
EITKGKSRASLGDLN

SEQ ID NO: 101729 - protein, 15 aa, Borrelia burgdorferi
ITKGKSRASLGDLNN

SEQ ID NO: 101730 - protein, 15 aa, Borrelia burgdorferi
TKGKSRASLGDLNND

SEQ ID NO: 101731 - protein, 15 aa, Borrelia burgdorferi
KGKSRASLGDLNNDK

SEQ ID NO: 101732 - protein, 15 aa, Borrelia burgdorferi
GKSRASLGDLNNDKN

SEQ ID NO: 101733 - protein, 15 aa, Borrelia burgdorferi
KSRASLGDLNNDKNL

SEQ ID NO: 101734 - protein, 15 aa, Borrelia burgdorferi
SRASLGDLNNDKNLM

SEQ ID NO: 101735 - protein, 15 aa, Borrelia burgdorferi
RASLGDLNNDKNLML

SEQ ID NO: 101736 - protein, 15 aa, Borrelia burgdorferi
ASLGDLNNDKNLMLP

SEQ ID NO: 101737 - protein, 15 aa, Borrelia burgdorferi
SLGDLNNDKNLMLPE

SEQ ID NO: 101738 - protein, 15 aa, Borrelia burgdorferi
LGDLNNDKNLMLPED

SEQ ID NO: 101739 - protein, 15 aa, Borrelia burgdorferi
GDLNNDKNLMLPEDQ

SEQ ID NO: 101740 - protein, 15 aa, Borrelia burgdorferi
DLNNDKNLMLPEDQK

SEQ ID NO: 101741 - protein, 15 aa, Borrelia burgdorferi
LNNDKNLMLPEDQKL

SEQ ID NO: 101742 - protein, 15 aa, Borrelia burgdorferi
NNDKNLMLPEDQKLP

SEQ ID NO: 101743 - protein, 15 aa, Borrelia burgdorferi
NDKNLMLPEDQKLPE

SEQ ID NO: 101744 - protein, 15 aa, Borrelia burgdorferi
DKNLMLPEDQKLPED

SEQ ID NO: 101745 - protein, 15 aa, Borrelia burgdorferi
KNLMLPEDQKLPEDK

SEQ ID NO: 101746 - protein, 15 aa, Borrelia burgdorferi
NLMLPEDQKLPEDKK

SEQ ID NO: 101747 - protein, 15 aa, Borrelia burgdorferi
LMLPEDQKLPEDKKL

SEQ ID NO: 101748 - protein, 15 aa, Borrelia burgdorferi
MLPEDQKLPEDKKLD

SEQ ID NO: 101749 - protein, 15 aa, Borrelia burgdorferi
LPEDQKLPEDKKLDS

SEQ ID NO: 101750 - protein, 15 aa, Borrelia burgdorferi
PEDQKLPEDKKLDSK

SEQ ID NO: 101751 - protein, 15 aa, Borrelia burgdorferi
EDQKLPEDKKLDSKL

SEQ ID NO: 101752 - protein, 15 aa, Borrelia burgdorferi
DQKLPEDKKLDSKLD

SEQ ID NO: 101753 - protein, 15 aa, Borrelia burgdorferi
QKLPEDKKLDSKLDG

SEQ ID NO: 101754 - protein, 15 aa, Borrelia burgdorferi
KLPEDKKLDSKLDGK

SEQ ID NO: 101755 - protein, 15 aa, Borrelia burgdorferi
LPEDKKLDSKLDGKK

SEQ ID NO: 101756 - protein, 15 aa, Borrelia burgdorferi
PEDKKLDSKLDGKKE

SEQ ID NO: 101757 - protein, 15 aa, Borrelia burgdorferi
EDKKLDSKLDGKKEF

SEQ ID NO: 101758 - protein, 15 aa, Borrelia burgdorferi
DKKLDSKLDGKKEFK

SEQ ID NO: 101759 - protein, 15 aa, Borrelia burgdorferi
KKLDSKLDGKKEFKP

SEQ ID NO: 101760 - protein, 15 aa, Borrelia burgdorferi
KLDSKLDGKKEFKPV

SEQ ID NO: 101761 - protein, 15 aa, Borrelia burgdorferi
LDSKLDGKKEFKPVS

SEQ ID NO: 101762 - protein, 15 aa, Borrelia burgdorferi
DSKLDGKKEFKPVSE

SEQ ID NO: 101763 - protein, 15 aa, Borrelia burgdorferi
SKLDGKKEFKPVSEV

SEQ ID NO: 101764 - protein, 15 aa, Borrelia burgdorferi
KLDGKKEFKPVSEVE

SEQ ID NO: 101765 - protein, 15 aa, Borrelia burgdorferi
LDGKKEFKPVSEVEK

SEQ ID NO: 101766 - protein, 15 aa, Borrelia burgdorferi
DGKKEFKPVSEVEKL

SEQ ID NO: 101767 - protein, 15 aa, Borrelia burgdorferi
GKKEFKPVSEVEKLD

SEQ ID NO: 101768 - protein, 15 aa, Borrelia burgdorferi
KKEFKPVSEVEKLDK

SEQ ID NO: 101769 - protein, 15 aa, Borrelia burgdorferi
KEFKPVSEVEKLDKI

SEQ ID NO: 101770 - protein, 15 aa, Borrelia burgdorferi
EFKPVSEVEKLDKIS

SEQ ID NO: 101771 - protein, 15 aa, Borrelia burgdorferi
FKPVSEVEKLDKISK

SEQ ID NO: 101772 - protein, 15 aa, Borrelia burgdorferi
KPVSEVEKLDKISKS

SEQ ID NO: 101773 - protein, 15 aa, Borrelia burgdorferi
PVSEVEKLDKISKSN

SEQ ID NO: 101774 - protein, 15 aa, Borrelia burgdorferi
VSEVEKLDKISKSNN

SEQ ID NO: 101775 - protein, 15 aa, Borrelia burgdorferi
SEVEKLDKISKSNNN

SEQ ID NO: 101776 - protein, 15 aa, Borrelia burgdorferi
EVEKLDKISKSNNNE

SEQ ID NO: 101777 - protein, 15 aa, Borrelia burgdorferi
VEKLDKISKSNNNEV

SEQ ID NO: 101778 - protein, 15 aa, Borrelia burgdorferi
EKLDKISKSNNNEVG

SEQ ID NO: 101779 - protein, 15 aa, Borrelia burgdorferi
KLDKISKSNNNEVGK

SEQ ID NO: 101780 - protein, 15 aa, Borrelia burgdorferi
LDKISKSNNNEVGKL

SEQ ID NO: 101781 - protein, 15 aa, Borrelia burgdorferi
DKISKSNNNEVGKLS

SEQ ID NO: 101782 - protein, 15 aa, Borrelia burgdorferi
KISKSNNNEVGKLSP

SEQ ID NO: 101783 - protein, 15 aa, Borrelia burgdorferi
ISKSNNNEVGKLSPL

SEQ ID NO: 101784 - protein, 15 aa, Borrelia burgdorferi
SKSNNNEVGKLSPLD

SEQ ID NO: 101785 - protein, 15 aa, Borrelia burgdorferi
KSNNNEVGKLSPLDK

SEQ ID NO: 101786 - protein, 15 aa, Borrelia burgdorferi
SNNNEVGKLSPLDKP

SEQ ID NO: 101787 - protein, 15 aa, Borrelia burgdorferi
NNNEVGKLSPLDKPS

SEQ ID NO: 101788 - protein, 15 aa, Borrelia burgdorferi
NNEVGKLSPLDKPSY

SEQ ID NO: 101789 - protein, 15 aa, Borrelia burgdorferi
NEVGKLSPLDKPSYD

SEQ ID NO: 101790 - protein, 15 aa, Borrelia burgdorferi
EVGKLSPLDKPSYDD

SEQ ID NO: 101791 - protein, 15 aa, Borrelia burgdorferi
VGKLSPLDKPSYDDI

SEQ ID NO: 101792 - protein, 15 aa, Borrelia burgdorferi
GKLSPLDKPSYDDID

SEQ ID NO: 101793 - protein, 15 aa, Borrelia burgdorferi
KLSPLDKPSYDDIDS

SEQ ID NO: 101794 - protein, 15 aa, Borrelia burgdorferi
LSPLDKPSYDDIDSK

SEQ ID NO: 101795 - protein, 15 aa, Borrelia burgdorferi
SPLDKPSYDDIDSKE

SEQ ID NO: 101796 - protein, 15 aa, Borrelia burgdorferi
PLDKPSYDDIDSKEE

SEQ ID NO: 101797 - protein, 15 aa, Borrelia burgdorferi
LDKPSYDDIDSKEEV

SEQ ID NO: 101798 - protein, 15 aa, Borrelia burgdorferi
DKPSYDDIDSKEEVD

SEQ ID NO: 101799 - protein, 15 aa, Borrelia burgdorferi
KPSYDDIDSKEEVDN

SEQ ID NO: 101800 - protein, 15 aa, Borrelia burgdorferi
PSYDDIDSKEEVDNK

SEQ ID NO: 101801 - protein, 15 aa, Borrelia burgdorferi
SYDDIDSKEEVDNKA

SEQ ID NO: 101802 - protein, 15 aa, Borrelia burgdorferi
YDDIDSKEEVDNKAI

SEQ ID NO: 101803 - protein, 15 aa, Borrelia burgdorferi
DDIDSKEEVDNKAIN

SEQ ID NO: 101804 - protein, 15 aa, Borrelia burgdorferi
DIDSKEEVDNKAINL

SEQ ID NO: 101805 - protein, 15 aa, Borrelia burgdorferi
IDSKEEVDNKAINLQ

SEQ ID NO: 101806 - protein, 15 aa, Borrelia burgdorferi
DSKEEVDNKAINLQK

SEQ ID NO: 101807 - protein, 15 aa, Borrelia burgdorferi
SKEEVDNKAINLQKI

SEQ ID NO: 101808 - protein, 15 aa, Borrelia burgdorferi
KEEVDNKAINLQKID

SEQ ID NO: 101809 - protein, 15 aa, Borrelia burgdorferi
EEVDNKAINLQKIDP

SEQ ID NO: 101810 - protein, 15 aa, Borrelia burgdorferi
EVDNKAINLQKIDPK

SEQ ID NO: 101811 - protein, 15 aa, Borrelia burgdorferi
VDNKAINLQKIDPKV

SEQ ID NO: 101812 - protein, 15 aa, Borrelia burgdorferi
DNKAINLQKIDPKVK

SEQ ID NO: 101813 - protein, 15 aa, Borrelia burgdorferi
NKAINLQKIDPKVKD

SEQ ID NO: 101814 - protein, 15 aa, Borrelia burgdorferi
KAINLQKIDPKVKDQ

SEQ ID NO: 101815 - protein, 15 aa, Borrelia burgdorferi
AINLQKIDPKVKDQT

SEQ ID NO: 101816 - protein, 15 aa, Borrelia burgdorferi
INLQKIDPKVKDQTT

SEQ ID NO: 101817 - protein, 15 aa, Borrelia burgdorferi
NLQKIDPKVKDQTTS

SEQ ID NO: 101818 - protein, 15 aa, Borrelia burgdorferi
LQKIDPKVKDQTTSL

SEQ ID NO: 101819 - protein, 15 aa, Borrelia burgdorferi
QKIDPKVKDQTTSLN

SEQ ID NO: 101820 - protein, 15 aa, Borrelia burgdorferi
KIDPKVKDQTTSLNE

SEQ ID NO: 101821 - protein, 15 aa, Borrelia burgdorferi
IDPKVKDQTTSLNED

SEQ ID NO: 101822 - protein, 15 aa, Borrelia burgdorferi
DPKVKDQTTSLNEDL

SEQ ID NO: 101823 - protein, 15 aa, Borrelia burgdorferi
PKVKDQTTSLNEDLD

SEQ ID NO: 101824 - protein, 15 aa, Borrelia burgdorferi
KVKDQTTSLNEDLDK

SEQ ID NO: 101825 - protein, 15 aa, Borrelia burgdorferi
VKDQTTSLNEDLDKD

SEQ ID NO: 101826 - protein, 15 aa, Borrelia burgdorferi
KDQTTSLNEDLDKDL

SEQ ID NO: 101827 - protein, 15 aa, Borrelia burgdorferi
DQTTSLNEDLDKDLT

SEQ ID NO: 101828 - protein, 15 aa, Borrelia burgdorferi
QTTSLNEDLDKDLTT

SEQ ID NO: 101829 - protein, 15 aa, Borrelia burgdorferi
TTSLNEDLDKDLTTM

SEQ ID NO: 101830 - protein, 15 aa, Borrelia burgdorferi
TSLNEDLDKDLTTMS

SEQ ID NO: 101831 - protein, 15 aa, Borrelia burgdorferi
SLNEDLDKDLTTMSI

SEQ ID NO: 101832 - protein, 15 aa, Borrelia burgdorferi
LNEDLDKDLTTMSID

SEQ ID NO: 101833 - protein, 15 aa, Borrelia burgdorferi
NEDLDKDLTTMSIDS

SEQ ID NO: 101834 - protein, 15 aa, Borrelia burgdorferi
EDLDKDLTTMSIDSS

SEQ ID NO: 101835 - protein, 15 aa, Borrelia burgdorferi
DLDKDLTTMSIDSSS

SEQ ID NO: 101836 - protein, 15 aa, Borrelia burgdorferi
LDKDLTTMSIDSSSP

SEQ ID NO: 101837 - protein, 15 aa, Borrelia burgdorferi
DKDLTTMSIDSSSPV

SEQ ID NO: 101838 - protein, 15 aa, Borrelia burgdorferi
KDLTTMSIDSSSPVF

SEQ ID NO: 101839 - protein, 15 aa, Borrelia burgdorferi
DLTTMSIDSSSPVFL

SEQ ID NO: 101840 - protein, 15 aa, Borrelia burgdorferi
LTTMSIDSSSPVFLE

SEQ ID NO: 101841 - protein, 15 aa, Borrelia burgdorferi
TTMSIDSSSPVFLEV

SEQ ID NO: 101842 - protein, 15 aa, Borrelia burgdorferi
TMSIDSSSPVFLEVI

SEQ ID NO: 101843 - protein, 15 aa, Borrelia burgdorferi
MSIDSSSPVFLEVID

SEQ ID NO: 101844 - protein, 15 aa, Borrelia burgdorferi
SIDSSSPVFLEVIDP

SEQ ID NO: 101845 - protein, 15 aa, Borrelia burgdorferi
IDSSSPVFLEVIDPI

SEQ ID NO: 101846 - protein, 15 aa, Borrelia burgdorferi
DSSSPVFLEVIDPIT

SEQ ID NO: 101847 - protein, 15 aa, Borrelia burgdorferi
SSSPVFLEVIDPITN

SEQ ID NO: 101848 - protein, 15 aa, Borrelia burgdorferi
SSPVFLEVIDPITNL

SEQ ID NO: 101849 - protein, 15 aa, Borrelia burgdorferi
SPVFLEVIDPITNLG

SEQ ID NO: 101850 - protein, 15 aa, Borrelia burgdorferi
PVFLEVIDPITNLGT

SEQ ID NO: 101851 - protein, 15 aa, Borrelia burgdorferi
VFLEVIDPITNLGTL

SEQ ID NO: 101852 - protein, 15 aa, Borrelia burgdorferi
FLEVIDPITNLGTLQ

SEQ ID NO: 101853 - protein, 15 aa, Borrelia burgdorferi
LEVIDPITNLGTLQL

SEQ ID NO: 101854 - protein, 15 aa, Borrelia burgdorferi
EVIDPITNLGTLQLI

SEQ ID NO: 101855 - protein, 15 aa, Borrelia burgdorferi
VIDPITNLGTLQLID

SEQ ID NO: 101856 - protein, 15 aa, Borrelia burgdorferi
IDPITNLGTLQLIDL

SEQ ID NO: 101857 - protein, 15 aa, Borrelia burgdorferi
DPITNLGTLQLIDLN

SEQ ID NO: 101858 - protein, 15 aa, Borrelia burgdorferi
PITNLGTLQLIDLNT

SEQ ID NO: 101859 - protein, 15 aa, Borrelia burgdorferi
ITNLGTLQLIDLNTG

SEQ ID NO: 101860 - protein, 15 aa, Borrelia burgdorferi
TNLGTLQLIDLNTGV

SEQ ID NO: 101861 - protein, 15 aa, Borrelia burgdorferi
NLGTLQLIDLNTGVR

SEQ ID NO: 101862 - protein, 15 aa, Borrelia burgdorferi
LGTLQLIDLNTGVRL

SEQ ID NO: 101863 - protein, 15 aa, Borrelia burgdorferi
GTLQLIDLNTGVRLK

SEQ ID NO: 101864 - protein, 15 aa, Borrelia burgdorferi
TLQLIDLNTGVRLKE

SEQ ID NO: 101865 - protein, 15 aa, Borrelia burgdorferi
LQLIDLNTGVRLKES

SEQ ID NO: 101866 - protein, 15 aa, Borrelia burgdorferi
QLIDLNTGVRLKEST

SEQ ID NO: 101867 - protein, 15 aa, Borrelia burgdorferi
LIDLNTGVRLKESTQ

SEQ ID NO: 101868 - protein, 15 aa, Borrelia burgdorferi
IDLNTGVRLKESTQQ

SEQ ID NO: 101869 - protein, 15 aa, Borrelia burgdorferi
DLNTGVRLKESTQQG

SEQ ID NO: 101870 - protein, 15 aa, Borrelia burgdorferi
LNTGVRLKESTQQGI

SEQ ID NO: 101871 - protein, 15 aa, Borrelia burgdorferi
NTGVRLKESTQQGIQ

SEQ ID NO: 101872 - protein, 15 aa, Borrelia burgdorferi
TGVRLKESTQQGIQR

SEQ ID NO: 101873 - protein, 15 aa, Borrelia burgdorferi
GVRLKESTQQGIQRY

SEQ ID NO: 101874 - protein, 15 aa, Borrelia burgdorferi
VRLKESTQQGIQRYG

SEQ ID NO: 101875 - protein, 15 aa, Borrelia burgdorferi
RLKESTQQGIQRYGI

SEQ ID NO: 101876 - protein, 15 aa, Borrelia burgdorferi
LKESTQQGIQRYGIY

SEQ ID NO: 101877 - protein, 15 aa, Borrelia burgdorferi
KESTQQGIQRYGIYE

SEQ ID NO: 101878 - protein, 15 aa, Borrelia burgdorferi
ESTQQGIQRYGIYER

SEQ ID NO: 101879 - protein, 15 aa, Borrelia burgdorferi
STQQGIQRYGIYERE

SEQ ID NO: 101880 - protein, 15 aa, Borrelia burgdorferi
TQQGIQRYGIYEREK

SEQ ID NO: 101881 - protein, 15 aa, Borrelia burgdorferi
QQGIQRYGIYEREKD

SEQ ID NO: 101882 - protein, 15 aa, Borrelia burgdorferi
QGIQRYGIYEREKDL

SEQ ID NO: 101883 - protein, 15 aa, Borrelia burgdorferi
GIQRYGIYEREKDLV

SEQ ID NO: 101884 - protein, 15 aa, Borrelia burgdorferi
IQRYGIYEREKDLVV

SEQ ID NO: 101885 - protein, 15 aa, Borrelia burgdorferi
QRYGIYEREKDLVVI

SEQ ID NO: 101886 - protein, 15 aa, Borrelia burgdorferi
RYGIYEREKDLVVIK

SEQ ID NO: 101887 - protein, 15 aa, Borrelia burgdorferi
YGIYEREKDLVVIKM

SEQ ID NO: 101888 - protein, 15 aa, Borrelia burgdorferi
GIYEREKDLVVIKMD

SEQ ID NO: 101889 - protein, 15 aa, Borrelia burgdorferi
IYEREKDLVVIKMDS

SEQ ID NO: 101890 - protein, 15 aa, Borrelia burgdorferi
YEREKDLVVIKMDSG

SEQ ID NO: 101891 - protein, 15 aa, Borrelia burgdorferi
EREKDLVVIKMDSGK

SEQ ID NO: 101892 - protein, 15 aa, Borrelia burgdorferi
REKDLVVIKMDSGKA

SEQ ID NO: 101893 - protein, 15 aa, Borrelia burgdorferi
EKDLVVIKMDSGKAK

SEQ ID NO: 101894 - protein, 15 aa, Borrelia burgdorferi
KDLVVIKMDSGKAKL

SEQ ID NO: 101895 - protein, 15 aa, Borrelia burgdorferi
DLVVIKMDSGKAKLQ

SEQ ID NO: 101896 - protein, 15 aa, Borrelia burgdorferi
LVVIKMDSGKAKLQI

SEQ ID NO: 101897 - protein, 15 aa, Borrelia burgdorferi
VVIKMDSGKAKLQIL

SEQ ID NO: 101898 - protein, 15 aa, Borrelia burgdorferi
VIKMDSGKAKLQILN

SEQ ID NO: 101899 - protein, 15 aa, Borrelia burgdorferi
IKMDSGKAKLQILNK

SEQ ID NO: 101900 - protein, 15 aa, Borrelia burgdorferi
KMDSGKAKLQILNKL

SEQ ID NO: 101901 - protein, 15 aa, Borrelia burgdorferi
MDSGKAKLQILNKLE

SEQ ID NO: 101902 - protein, 15 aa, Borrelia burgdorferi
DSGKAKLQILNKLEN

SEQ ID NO: 101903 - protein, 15 aa, Borrelia burgdorferi
SGKAKLQILNKLENL

SEQ ID NO: 101904 - protein, 15 aa, Borrelia burgdorferi
GKAKLQILNKLENLK

SEQ ID NO: 101905 - protein, 15 aa, Borrelia burgdorferi
KAKLQILNKLENLKV

SEQ ID NO: 101906 - protein, 15 aa, Borrelia burgdorferi
AKLQILNKLENLKVV

SEQ ID NO: 101907 - protein, 15 aa, Borrelia burgdorferi
KLQILNKLENLKVVS

SEQ ID NO: 101908 - protein, 15 aa, Borrelia burgdorferi
LQILNKLENLKVVSE

SEQ ID NO: 101909 - protein, 15 aa, Borrelia burgdorferi
QILNKLENLKVVSES

SEQ ID NO: 101910 - protein, 15 aa, Borrelia burgdorferi
ILNKLENLKVVSESN

SEQ ID NO: 101911 - protein, 15 aa, Borrelia burgdorferi
LNKLENLKVVSESNF

SEQ ID NO: 101912 - protein, 15 aa, Borrelia burgdorferi
NKLENLKVVSESNFE

SEQ ID NO: 101913 - protein, 15 aa, Borrelia burgdorferi
KLENLKVVSESNFEI

SEQ ID NO: 101914 - protein, 15 aa, Borrelia burgdorferi
LENLKVVSESNFEIN

SEQ ID NO: 101915 - protein, 15 aa, Borrelia burgdorferi
ENLKVVSESNFEINK

SEQ ID NO: 101916 - protein, 15 aa, Borrelia burgdorferi
NLKVVSESNFEINKN

SEQ ID NO: 101917 - protein, 15 aa, Borrelia burgdorferi
LKVVSESNFEINKNS

SEQ ID NO: 101918 - protein, 15 aa, Borrelia burgdorferi
KVVSESNFEINKNSS

SEQ ID NO: 101919 - protein, 15 aa, Borrelia burgdorferi
VVSESNFEINKNSSL

SEQ ID NO: 101920 - protein, 15 aa, Borrelia burgdorferi
VSESNFEINKNSSLY

SEQ ID NO: 101921 - protein, 15 aa, Borrelia burgdorferi
SESNFEINKNSSLYV

SEQ ID NO: 101922 - protein, 15 aa, Borrelia burgdorferi
ESNFEINKNSSLYVD

SEQ ID NO: 101923 - protein, 15 aa, Borrelia burgdorferi
SNFEINKNSSLYVDS

SEQ ID NO: 101924 - protein, 15 aa, Borrelia burgdorferi
NFEINKNSSLYVDSK

SEQ ID NO: 101925 - protein, 15 aa, Borrelia burgdorferi
FEINKNSSLYVDSKM

SEQ ID NO: 101926 - protein, 15 aa, Borrelia burgdorferi
EINKNSSLYVDSKMI

SEQ ID NO: 101927 - protein, 15 aa, Borrelia burgdorferi
INKNSSLYVDSKMIL

SEQ ID NO: 101928 - protein, 15 aa, Borrelia burgdorferi
NKNSSLYVDSKMILA

SEQ ID NO: 101929 - protein, 15 aa, Borrelia burgdorferi
KNSSLYVDSKMILAA

SEQ ID NO: 101930 - protein, 15 aa, Borrelia burgdorferi
NSSLYVDSKMILAAV

SEQ ID NO: 101931 - protein, 15 aa, Borrelia burgdorferi
SSLYVDSKMILAAVR

SEQ ID NO: 101932 - protein, 15 aa, Borrelia burgdorferi
SLYVDSKMILAAVRD

SEQ ID NO: 101933 - protein, 15 aa, Borrelia burgdorferi
LYVDSKMILAAVRDK

SEQ ID NO: 101934 - protein, 15 aa, Borrelia burgdorferi
YVDSKMILAAVRDKD

SEQ ID NO: 101935 - protein, 15 aa, Borrelia burgdorferi
VDSKMILAAVRDKDD

SEQ ID NO: 101936 - protein, 15 aa, Borrelia burgdorferi
DSKMILAAVRDKDDS

SEQ ID NO: 101937 - protein, 15 aa, Borrelia burgdorferi
SKMILAAVRDKDDSN

SEQ ID NO: 101938 - protein, 15 aa, Borrelia burgdorferi
KMILAAVRDKDDSNA

SEQ ID NO: 101939 - protein, 15 aa, Borrelia burgdorferi
MILAAVRDKDDSNAW

SEQ ID NO: 101940 - protein, 15 aa, Borrelia burgdorferi
ILAAVRDKDDSNAWR

SEQ ID NO: 101941 - protein, 15 aa, Borrelia burgdorferi
LAAVRDKDDSNAWRL

SEQ ID NO: 101942 - protein, 15 aa, Borrelia burgdorferi
AAVRDKDDSNAWRLA

SEQ ID NO: 101943 - protein, 15 aa, Borrelia burgdorferi
AVRDKDDSNAWRLAK

SEQ ID NO: 101944 - protein, 15 aa, Borrelia burgdorferi
VRDKDDSNAWRLAKF

SEQ ID NO: 101945 - protein, 15 aa, Borrelia burgdorferi
RDKDDSNAWRLAKFS

SEQ ID NO: 101946 - protein, 15 aa, Borrelia burgdorferi
DKDDSNAWRLAKFSP

SEQ ID NO: 101947 - protein, 15 aa, Borrelia burgdorferi
KDDSNAWRLAKFSPK

SEQ ID NO: 101948 - protein, 15 aa, Borrelia burgdorferi
DDSNAWRLAKFSPKN

SEQ ID NO: 101949 - protein, 15 aa, Borrelia burgdorferi
DSNAWRLAKFSPKNL

SEQ ID NO: 101950 - protein, 15 aa, Borrelia burgdorferi
SNAWRLAKFSPKNLD

SEQ ID NO: 101951 - protein, 15 aa, Borrelia burgdorferi
NAWRLAKFSPKNLDE

SEQ ID NO: 101952 - protein, 15 aa, Borrelia burgdorferi
AWRLAKFSPKNLDEF

SEQ ID NO: 101953 - protein, 15 aa, Borrelia burgdorferi
WRLAKFSPKNLDEFI

SEQ ID NO: 101954 - protein, 15 aa, Borrelia burgdorferi
RLAKFSPKNLDEFIL

SEQ ID NO: 101955 - protein, 15 aa, Borrelia burgdorferi
LAKFSPKNLDEFILS

SEQ ID NO: 101956 - protein, 15 aa, Borrelia burgdorferi
AKFSPKNLDEFILSE

SEQ ID NO: 101957 - protein, 15 aa, Borrelia burgdorferi
KFSPKNLDEFILSEN

SEQ ID NO: 101958 - protein, 15 aa, Borrelia burgdorferi
FSPKNLDEFILSENK

SEQ ID NO: 101959 - protein, 15 aa, Borrelia burgdorferi
SPKNLDEFILSENKI

SEQ ID NO: 101960 - protein, 15 aa, Borrelia burgdorferi
PKNLDEFILSENKIL

SEQ ID NO: 101961 - protein, 15 aa, Borrelia burgdorferi
KNLDEFILSENKILP

SEQ ID NO: 101962 - protein, 15 aa, Borrelia burgdorferi
NLDEFILSENKILPF

SEQ ID NO: 101963 - protein, 15 aa, Borrelia burgdorferi
LDEFILSENKILPFT

SEQ ID NO: 101964 - protein, 15 aa, Borrelia burgdorferi
DEFILSENKILPFTS

SEQ ID NO: 101965 - protein, 15 aa, Borrelia burgdorferi
EFILSENKILPFTSF

SEQ ID NO: 101966 - protein, 15 aa, Borrelia burgdorferi
FILSENKILPFTSFS

SEQ ID NO: 101967 - protein, 15 aa, Borrelia burgdorferi
ILSENKILPFTSFSV

SEQ ID NO: 101968 - protein, 15 aa, Borrelia burgdorferi
LSENKILPFTSFSVR

SEQ ID NO: 101969 - protein, 15 aa, Borrelia burgdorferi
SENKILPFTSFSVRK

SEQ ID NO: 101970 - protein, 15 aa, Borrelia burgdorferi
ENKILPFTSFSVRKN

SEQ ID NO: 101971 - protein, 15 aa, Borrelia burgdorferi
NKILPFTSFSVRKNF

SEQ ID NO: 101972 - protein, 15 aa, Borrelia burgdorferi
KILPFTSFSVRKNFI

SEQ ID NO: 101973 - protein, 15 aa, Borrelia burgdorferi
ILPFTSFSVRKNFIY

SEQ ID NO: 101974 - protein, 15 aa, Borrelia burgdorferi
LPFTSFSVRKNFIYL

SEQ ID NO: 101975 - protein, 15 aa, Borrelia burgdorferi
PFTSFSVRKNFIYLQ

SEQ ID NO: 101976 - protein, 15 aa, Borrelia burgdorferi
FTSFSVRKNFIYLQD

SEQ ID NO: 101977 - protein, 15 aa, Borrelia burgdorferi
TSFSVRKNFIYLQDE

SEQ ID NO: 101978 - protein, 15 aa, Borrelia burgdorferi
SFSVRKNFIYLQDEL

SEQ ID NO: 101979 - protein, 15 aa, Borrelia burgdorferi
FSVRKNFIYLQDELK

SEQ ID NO: 101980 - protein, 15 aa, Borrelia burgdorferi
SVRKNFIYLQDELKN

SEQ ID NO: 101981 - protein, 15 aa, Borrelia burgdorferi
VRKNFIYLQDELKNL

SEQ ID NO: 101982 - protein, 15 aa, Borrelia burgdorferi
RKNFIYLQDELKNLV

SEQ ID NO: 101983 - protein, 15 aa, Borrelia burgdorferi
KNFIYLQDELKNLVI

SEQ ID NO: 101984 - protein, 15 aa, Borrelia burgdorferi
NFIYLQDELKNLVIL

SEQ ID NO: 101985 - protein, 15 aa, Borrelia burgdorferi
FIYLQDELKNLVILD

SEQ ID NO: 101986 - protein, 15 aa, Borrelia burgdorferi
IYLQDELKNLVILDV

SEQ ID NO: 101987 - protein, 15 aa, Borrelia burgdorferi
YLQDELKNLVILDVN

SEQ ID NO: 101988 - protein, 15 aa, Borrelia burgdorferi
LQDELKNLVILDVNT

SEQ ID NO: 101989 - protein, 15 aa, Borrelia burgdorferi
QDELKNLVILDVNTL

SEQ ID NO: 101990 - protein, 15 aa, Borrelia burgdorferi
DELKNLVILDVNTLK

SEQ ID NO: 101991 - protein, 15 aa, Borrelia burgdorferi
ELKNLVILDVNTLKK

SEQ ID NO: 101992 - protein, 15 aa, Borrelia burgdorferi
LKNLVILDVNTLKKV

SEQ ID NO: 101993 - protein, 15 aa, Borrelia burgdorferi
KNLVILDVNTLKKVK

SEQ ID NO: 101994 - protein, 16 aa, Borrelia burgdorferi
MKKMLLIFSFFLIFLN

SEQ ID NO: 101995 - protein, 16 aa, Borrelia burgdorferi
KKMLLIFSFFLIFLNG

SEQ ID NO: 101996 - protein, 16 aa, Borrelia burgdorferi
KMLLIFSFFLIFLNGF

SEQ ID NO: 101997 - protein, 16 aa, Borrelia burgdorferi
MLLIFSFFLIFLNGFP

SEQ ID NO: 101998 - protein, 16 aa, Borrelia burgdorferi
LLIFSFFLIFLNGFPL

SEQ ID NO: 101999 - protein, 16 aa, Borrelia burgdorferi
LIFSFFLIFLNGFPLN

SEQ ID NO: 102000 - protein, 16 aa, Borrelia burgdorferi
IFSFFLIFLNGFPLNA

SEQ ID NO: 102001 - protein, 16 aa, Borrelia burgdorferi
FSFFLIFLNGFPLNAR

SEQ ID NO: 102002 - protein, 16 aa, Borrelia burgdorferi
SFFLIFLNGFPLNARK

SEQ ID NO: 102003 - protein, 16 aa, Borrelia burgdorferi
FFLIFLNGFPLNARKV

SEQ ID NO: 102004 - protein, 16 aa, Borrelia burgdorferi
FLIFLNGFPLNARKVD

SEQ ID NO: 102005 - protein, 16 aa, Borrelia burgdorferi
LIFLNGFPLNARKVDK

SEQ ID NO: 102006 - protein, 16 aa, Borrelia burgdorferi
IFLNGFPLNARKVDKE

SEQ ID NO: 102007 - protein, 16 aa, Borrelia burgdorferi
FLNGFPLNARKVDKEK

SEQ ID NO: 102008 - protein, 16 aa, Borrelia burgdorferi
LNGFPLNARKVDKEKL

SEQ ID NO: 102009 - protein, 16 aa, Borrelia burgdorferi
NGFPLNARKVDKEKLK

SEQ ID NO: 102010 - protein, 16 aa, Borrelia burgdorferi
GFPLNARKVDKEKLKD

SEQ ID NO: 102011 - protein, 16 aa, Borrelia burgdorferi
FPLNARKVDKEKLKDF

SEQ ID NO: 102012 - protein, 16 aa, Borrelia burgdorferi
PLNARKVDKEKLKDFV

SEQ ID NO: 102013 - protein, 16 aa, Borrelia burgdorferi
LNARKVDKEKLKDFVN

SEQ ID NO: 102014 - protein, 16 aa, Borrelia burgdorferi
NARKVDKEKLKDFVNM

SEQ ID NO: 102015 - protein, 16 aa, Borrelia burgdorferi
ARKVDKEKLKDFVNMD

SEQ ID NO: 102016 - protein, 16 aa, Borrelia burgdorferi
RKVDKEKLKDFVNMDL

SEQ ID NO: 102017 - protein, 16 aa, Borrelia burgdorferi
KVDKEKLKDFVNMDLE

SEQ ID NO: 102018 - protein, 16 aa, Borrelia burgdorferi
VDKEKLKDFVNMDLEF

SEQ ID NO: 102019 - protein, 16 aa, Borrelia burgdorferi
DKEKLKDFVNMDLEFV

SEQ ID NO: 102020 - protein, 16 aa, Borrelia burgdorferi
KEKLKDFVNMDLEFVN

SEQ ID NO: 102021 - protein, 16 aa, Borrelia burgdorferi
EKLKDFVNMDLEFVNY

SEQ ID NO: 102022 - protein, 16 aa, Borrelia burgdorferi
KLKDFVNMDLEFVNYK

SEQ ID NO: 102023 - protein, 16 aa, Borrelia burgdorferi
LKDFVNMDLEFVNYKG

SEQ ID NO: 102024 - protein, 16 aa, Borrelia burgdorferi
KDFVNMDLEFVNYKGP

SEQ ID NO: 102025 - protein, 16 aa, Borrelia burgdorferi
DFVNMDLEFVNYKGPY

SEQ ID NO: 102026 - protein, 16 aa, Borrelia burgdorferi
FVNMDLEFVNYKGPYD

SEQ ID NO: 102027 - protein, 16 aa, Borrelia burgdorferi
VNMDLEFVNYKGPYDS

SEQ ID NO: 102028 - protein, 16 aa, Borrelia burgdorferi
NMDLEFVNYKGPYDST

SEQ ID NO: 102029 - protein, 16 aa, Borrelia burgdorferi
MDLEFVNYKGPYDSTN

SEQ ID NO: 102030 - protein, 16 aa, Borrelia burgdorferi
DLEFVNYKGPYDSTNT

SEQ ID NO: 102031 - protein, 16 aa, Borrelia burgdorferi
LEFVNYKGPYDSTNTY

SEQ ID NO: 102032 - protein, 16 aa, Borrelia burgdorferi
EFVNYKGPYDSTNTYE

SEQ ID NO: 102033 - protein, 16 aa, Borrelia burgdorferi
FVNYKGPYDSTNTYEQ

SEQ ID NO: 102034 - protein, 16 aa, Borrelia burgdorferi
VNYKGPYDSTNTYEQI

SEQ ID NO: 102035 - protein, 16 aa, Borrelia burgdorferi
NYKGPYDSTNTYEQIV

SEQ ID NO: 102036 - protein, 16 aa, Borrelia burgdorferi
YKGPYDSTNTYEQIVG

SEQ ID NO: 102037 - protein, 16 aa, Borrelia burgdorferi
KGPYDSTNTYEQIVGI

SEQ ID NO: 102038 - protein, 16 aa, Borrelia burgdorferi
GPYDSTNTYEQIVGIG

SEQ ID NO: 102039 - protein, 16 aa, Borrelia burgdorferi
PYDSTNTYEQIVGIGE

SEQ ID NO: 102040 - protein, 16 aa, Borrelia burgdorferi
YDSTNTYEQIVGIGEF

SEQ ID NO: 102041 - protein, 16 aa, Borrelia burgdorferi
DSTNTYEQIVGIGEFL

SEQ ID NO: 102042 - protein, 16 aa, Borrelia burgdorferi
STNTYEQIVGIGEFLA

SEQ ID NO: 102043 - protein, 16 aa, Borrelia burgdorferi
TNTYEQIVGIGEFLAR

SEQ ID NO: 102044 - protein, 16 aa, Borrelia burgdorferi
NTYEQIVGIGEFLARP

SEQ ID NO: 102045 - protein, 16 aa, Borrelia burgdorferi
TYEQIVGIGEFLARPL

SEQ ID NO: 102046 - protein, 16 aa, Borrelia burgdorferi
YEQIVGIGEFLARPLT

SEQ ID NO: 102047 - protein, 16 aa, Borrelia burgdorferi
EQIVGIGEFLARPLTN

SEQ ID NO: 102048 - protein, 16 aa, Borrelia burgdorferi
QIVGIGEFLARPLTNS

SEQ ID NO: 102049 - protein, 16 aa, Borrelia burgdorferi
IVGIGEFLARPLTNSN

SEQ ID NO: 102050 - protein, 16 aa, Borrelia burgdorferi
VGIGEFLARPLTNSNS

SEQ ID NO: 102051 - protein, 16 aa, Borrelia burgdorferi
GIGEFLARPLTNSNSN

SEQ ID NO: 102052 - protein, 16 aa, Borrelia burgdorferi
IGEFLARPLTNSNSNS

SEQ ID NO: 102053 - protein, 16 aa, Borrelia burgdorferi
GEFLARPLTNSNSNSS

SEQ ID NO: 102054 - protein, 16 aa, Borrelia burgdorferi
EFLARPLTNSNSNSSY

SEQ ID NO: 102055 - protein, 16 aa, Borrelia burgdorferi
FLARPLTNSNSNSSYY

SEQ ID NO: 102056 - protein, 16 aa, Borrelia burgdorferi
LARPLTNSNSNSSYYG

SEQ ID NO: 102057 - protein, 16 aa, Borrelia burgdorferi
ARPLTNSNSNSSYYGK

SEQ ID NO: 102058 - protein, 16 aa, Borrelia burgdorferi
RPLTNSNSNSSYYGKY

SEQ ID NO: 102059 - protein, 16 aa, Borrelia burgdorferi
PLTNSNSNSSYYGKYF

SEQ ID NO: 102060 - protein, 16 aa, Borrelia burgdorferi
LTNSNSNSSYYGKYFI

SEQ ID NO: 102061 - protein, 16 aa, Borrelia burgdorferi
TNSNSNSSYYGKYFIN

SEQ ID NO: 102062 - protein, 16 aa, Borrelia burgdorferi
NSNSNSSYYGKYFINR

SEQ ID NO: 102063 - protein, 16 aa, Borrelia burgdorferi
SNSNSSYYGKYFINRF

SEQ ID NO: 102064 - protein, 16 aa, Borrelia burgdorferi
NSNSSYYGKYFINRFI

SEQ ID NO: 102065 - protein, 16 aa, Borrelia burgdorferi
SNSSYYGKYFINRFID

SEQ ID NO: 102066 - protein, 16 aa, Borrelia burgdorferi
NSSYYGKYFINRFIDD

SEQ ID NO: 102067 - protein, 16 aa, Borrelia burgdorferi
SSYYGKYFINRFIDDQ

SEQ ID NO: 102068 - protein, 16 aa, Borrelia burgdorferi
SYYGKYFINRFIDDQD

SEQ ID NO: 102069 - protein, 16 aa, Borrelia burgdorferi
YYGKYFINRFIDDQDK

SEQ ID NO: 102070 - protein, 16 aa, Borrelia burgdorferi
YGKYFINRFIDDQDKK

SEQ ID NO: 102071 - protein, 16 aa, Borrelia burgdorferi
GKYFINRFIDDQDKKA

SEQ ID NO: 102072 - protein, 16 aa, Borrelia burgdorferi
KYFINRFIDDQDKKAS

SEQ ID NO: 102073 - protein, 16 aa, Borrelia burgdorferi
YFINRFIDDQDKKASV

SEQ ID NO: 102074 - protein, 16 aa, Borrelia burgdorferi
FINRFIDDQDKKASVD

SEQ ID NO: 102075 - protein, 16 aa, Borrelia burgdorferi
INRFIDDQDKKASVDV

SEQ ID NO: 102076 - protein, 16 aa, Borrelia burgdorferi
NRFIDDQDKKASVDVF

SEQ ID NO: 102077 - protein, 16 aa, Borrelia burgdorferi
RFIDDQDKKASVDVFS

SEQ ID NO: 102078 - protein, 16 aa, Borrelia burgdorferi
FIDDQDKKASVDVFSI

SEQ ID NO: 102079 - protein, 16 aa, Borrelia burgdorferi
IDDQDKKASVDVFSIS

SEQ ID NO: 102080 - protein, 16 aa, Borrelia burgdorferi
DDQDKKASVDVFSISS

SEQ ID NO: 102081 - protein, 16 aa, Borrelia burgdorferi
DQDKKASVDVFSISSK

SEQ ID NO: 102082 - protein, 16 aa, Borrelia burgdorferi
QDKKASVDVFSISSKS

SEQ ID NO: 102083 - protein, 16 aa, Borrelia burgdorferi
DKKASVDVFSISSKSE

SEQ ID NO: 102084 - protein, 16 aa, Borrelia burgdorferi
KKASVDVFSISSKSEL

SEQ ID NO: 102085 - protein, 16 aa, Borrelia burgdorferi
KASVDVFSISSKSELD

SEQ ID NO: 102086 - protein, 16 aa, Borrelia burgdorferi
ASVDVFSISSKSELDS

SEQ ID NO: 102087 - protein, 16 aa, Borrelia burgdorferi
SVDVFSISSKSELDSI

SEQ ID NO: 102088 - protein, 16 aa, Borrelia burgdorferi
VDVFSISSKSELDSIL

SEQ ID NO: 102089 - protein, 16 aa, Borrelia burgdorferi
DVFSISSKSELDSILN

SEQ ID NO: 102090 - protein, 16 aa, Borrelia burgdorferi
VFSISSKSELDSILNL

SEQ ID NO: 102091 - protein, 16 aa, Borrelia burgdorferi
FSISSKSELDSILNLR

SEQ ID NO: 102092 - protein, 16 aa, Borrelia burgdorferi
SISSKSELDSILNLRR

SEQ ID NO: 102093 - protein, 16 aa, Borrelia burgdorferi
ISSKSELDSILNLRRI

SEQ ID NO: 102094 - protein, 16 aa, Borrelia burgdorferi
SSKSELDSILNLRRIL

SEQ ID NO: 102095 - protein, 16 aa, Borrelia burgdorferi
SKSELDSILNLRRILT

SEQ ID NO: 102096 - protein, 16 aa, Borrelia burgdorferi
KSELDSILNLRRILTG

SEQ ID NO: 102097 - protein, 16 aa, Borrelia burgdorferi
SELDSILNLRRILTGY

SEQ ID NO: 102098 - protein, 16 aa, Borrelia burgdorferi
ELDSILNLRRILTGYI

SEQ ID NO: 102099 - protein, 16 aa, Borrelia burgdorferi
LDSILNLRRILTGYII

SEQ ID NO: 102100 - protein, 16 aa, Borrelia burgdorferi
DSILNLRRILTGYIIK

SEQ ID NO: 102101 - protein, 16 aa, Borrelia burgdorferi
SILNLRRILTGYIIKS

SEQ ID NO: 102102 - protein, 16 aa, Borrelia burgdorferi
ILNLRRILTGYIIKSF

SEQ ID NO: 102103 - protein, 16 aa, Borrelia burgdorferi
LNLRRILTGYIIKSFD

SEQ ID NO: 102104 - protein, 16 aa, Borrelia burgdorferi
NLRRILTGYIIKSFDY

SEQ ID NO: 102105 - protein, 16 aa, Borrelia burgdorferi
LRRILTGYIIKSFDYD

SEQ ID NO: 102106 - protein, 16 aa, Borrelia burgdorferi
RRILTGYIIKSFDYDR

SEQ ID NO: 102107 - protein, 16 aa, Borrelia burgdorferi
RILTGYIIKSFDYDRS

SEQ ID NO: 102108 - protein, 16 aa, Borrelia burgdorferi
ILTGYIIKSFDYDRSS

SEQ ID NO: 102109 - protein, 16 aa, Borrelia burgdorferi
LTGYIIKSFDYDRSSA

SEQ ID NO: 102110 - protein, 16 aa, Borrelia burgdorferi
TGYIIKSFDYDRSSAE

SEQ ID NO: 102111 - protein, 16 aa, Borrelia burgdorferi
GYIIKSFDYDRSSAEL

SEQ ID NO: 102112 - protein, 16 aa, Borrelia burgdorferi
YIIKSFDYDRSSAELI

SEQ ID NO: 102113 - protein, 16 aa, Borrelia burgdorferi
IIKSFDYDRSSAELIA

SEQ ID NO: 102114 - protein, 16 aa, Borrelia burgdorferi
IKSFDYDRSSAELIAK

SEQ ID NO: 102115 - protein, 16 aa, Borrelia burgdorferi
KSFDYDRSSAELIAKV

SEQ ID NO: 102116 - protein, 16 aa, Borrelia burgdorferi
SFDYDRSSAELIAKVI

SEQ ID NO: 102117 - protein, 16 aa, Borrelia burgdorferi
FDYDRSSAELIAKVIT

SEQ ID NO: 102118 - protein, 16 aa, Borrelia burgdorferi
DYDRSSAELIAKVITI

SEQ ID NO: 102119 - protein, 16 aa, Borrelia burgdorferi
YDRSSAELIAKVITIY

SEQ ID NO: 102120 - protein, 16 aa, Borrelia burgdorferi
DRSSAELIAKVITIYN

SEQ ID NO: 102121 - protein, 16 aa, Borrelia burgdorferi
RSSAELIAKVITIYNA

SEQ ID NO: 102122 - protein, 16 aa, Borrelia burgdorferi
SSAELIAKVITIYNAV

SEQ ID NO: 102123 - protein, 16 aa, Borrelia burgdorferi
SAELIAKVITIYNAVY

SEQ ID NO: 102124 - protein, 16 aa, Borrelia burgdorferi
AELIAKVITIYNAVYR

SEQ ID NO: 102125 - protein, 16 aa, Borrelia burgdorferi
ELIAKVITIYNAVYRG

SEQ ID NO: 102126 - protein, 16 aa, Borrelia burgdorferi
LIAKVITIYNAVYRGD

SEQ ID NO: 102127 - protein, 16 aa, Borrelia burgdorferi
IAKVITIYNAVYRGDL

SEQ ID NO: 102128 - protein, 16 aa, Borrelia burgdorferi
AKVITIYNAVYRGDLD

SEQ ID NO: 102129 - protein, 16 aa, Borrelia burgdorferi
KVITIYNAVYRGDLDY

SEQ ID NO: 102130 - protein, 16 aa, Borrelia burgdorferi
VITIYNAVYRGDLDYY

SEQ ID NO: 102131 - protein, 16 aa, Borrelia burgdorferi
ITIYNAVYRGDLDYYK

SEQ ID NO: 102132 - protein, 16 aa, Borrelia burgdorferi
TIYNAVYRGDLDYYKG

SEQ ID NO: 102133 - protein, 16 aa, Borrelia burgdorferi
IYNAVYRGDLDYYKGF

SEQ ID NO: 102134 - protein, 16 aa, Borrelia burgdorferi
YNAVYRGDLDYYKGFY

SEQ ID NO: 102135 - protein, 16 aa, Borrelia burgdorferi
NAVYRGDLDYYKGFYI

SEQ ID NO: 102136 - protein, 16 aa, Borrelia burgdorferi
AVYRGDLDYYKGFYIE

SEQ ID NO: 102137 - protein, 16 aa, Borrelia burgdorferi
VYRGDLDYYKGFYIEP

SEQ ID NO: 102138 - protein, 16 aa, Borrelia burgdorferi
YRGDLDYYKGFYIEPA

SEQ ID NO: 102139 - protein, 16 aa, Borrelia burgdorferi
RGDLDYYKGFYIEPAL

SEQ ID NO: 102140 - protein, 16 aa, Borrelia burgdorferi
GDLDYYKGFYIEPALK

SEQ ID NO: 102141 - protein, 16 aa, Borrelia burgdorferi
DLDYYKGFYIEPALKS

SEQ ID NO: 102142 - protein, 16 aa, Borrelia burgdorferi
LDYYKGFYIEPALKSL

SEQ ID NO: 102143 - protein, 16 aa, Borrelia burgdorferi
DYYKGFYIEPALKSLT

SEQ ID NO: 102144 - protein, 16 aa, Borrelia burgdorferi
YYKGFYIEPALKSLTK

SEQ ID NO: 102145 - protein, 16 aa, Borrelia burgdorferi
YKGFYIEPALKSLTKE

SEQ ID NO: 102146 - protein, 16 aa, Borrelia burgdorferi
KGFYIEPALKSLTKEN

SEQ ID NO: 102147 - protein, 16 aa, Borrelia burgdorferi
GFYIEPALKSLTKENA

SEQ ID NO: 102148 - protein, 16 aa, Borrelia burgdorferi
FYIEPALKSLTKENAG

SEQ ID NO: 102149 - protein, 16 aa, Borrelia burgdorferi
YIEPALKSLTKENAGL

SEQ ID NO: 102150 - protein, 16 aa, Borrelia burgdorferi
IEPALKSLTKENAGLS

SEQ ID NO: 102151 - protein, 16 aa, Borrelia burgdorferi
EPALKSLTKENAGLSR

SEQ ID NO: 102152 - protein, 16 aa, Borrelia burgdorferi
PALKSLTKENAGLSRV

SEQ ID NO: 102153 - protein, 16 aa, Borrelia burgdorferi
ALKSLTKENAGLSRVY

SEQ ID NO: 102154 - protein, 16 aa, Borrelia burgdorferi
LKSLTKENAGLSRVYS

SEQ ID NO: 102155 - protein, 16 aa, Borrelia burgdorferi
KSLTKENAGLSRVYSQ

SEQ ID NO: 102156 - protein, 16 aa, Borrelia burgdorferi
SLTKENAGLSRVYSQW

SEQ ID NO: 102157 - protein, 16 aa, Borrelia burgdorferi
LTKENAGLSRVYSQWA

SEQ ID NO: 102158 - protein, 16 aa, Borrelia burgdorferi
TKENAGLSRVYSQWAG

SEQ ID NO: 102159 - protein, 16 aa, Borrelia burgdorferi
KENAGLSRVYSQWAGK

SEQ ID NO: 102160 - protein, 16 aa, Borrelia burgdorferi
ENAGLSRVYSQWAGKT

SEQ ID NO: 102161 - protein, 16 aa, Borrelia burgdorferi
NAGLSRVYSQWAGKTQ

SEQ ID NO: 102162 - protein, 16 aa, Borrelia burgdorferi
AGLSRVYSQWAGKTQI

SEQ ID NO: 102163 - protein, 16 aa, Borrelia burgdorferi
GLSRVYSQWAGKTQIF

SEQ ID NO: 102164 - protein, 16 aa, Borrelia burgdorferi
LSRVYSQWAGKTQIFI

SEQ ID NO: 102165 - protein, 16 aa, Borrelia burgdorferi
SRVYSQWAGKTQIFIP

SEQ ID NO: 102166 - protein, 16 aa, Borrelia burgdorferi
RVYSQWAGKTQIFIPL

SEQ ID NO: 102167 - protein, 16 aa, Borrelia burgdorferi
VYSQWAGKTQIFIPLK

SEQ ID NO: 102168 - protein, 16 aa, Borrelia burgdorferi
YSQWAGKTQIFIPLKK

SEQ ID NO: 102169 - protein, 16 aa, Borrelia burgdorferi
SQWAGKTQIFIPLKKD

SEQ ID NO: 102170 - protein, 16 aa, Borrelia burgdorferi
QWAGKTQIFIPLKKDI

SEQ ID NO: 102171 - protein, 16 aa, Borrelia burgdorferi
WAGKTQIFIPLKKDIL

SEQ ID NO: 102172 - protein, 16 aa, Borrelia burgdorferi
AGKTQIFIPLKKDILS

SEQ ID NO: 102173 - protein, 16 aa, Borrelia burgdorferi
GKTQIFIPLKKDILSG

SEQ ID NO: 102174 - protein, 16 aa, Borrelia burgdorferi
KTQIFIPLKKDILSGN

SEQ ID NO: 102175 - protein, 16 aa, Borrelia burgdorferi
TQIFIPLKKDILSGNI

SEQ ID NO: 102176 - protein, 16 aa, Borrelia burgdorferi
QIFIPLKKDILSGNIE

SEQ ID NO: 102177 - protein, 16 aa, Borrelia burgdorferi
IFIPLKKDILSGNIES

SEQ ID NO: 102178 - protein, 16 aa, Borrelia burgdorferi
FIPLKKDILSGNIESD

SEQ ID NO: 102179 - protein, 16 aa, Borrelia burgdorferi
IPLKKDILSGNIESDI

SEQ ID NO: 102180 - protein, 16 aa, Borrelia burgdorferi
PLKKDILSGNIESDID

SEQ ID NO: 102181 - protein, 16 aa, Borrelia burgdorferi
LKKDILSGNIESDIDI

SEQ ID NO: 102182 - protein, 16 aa, Borrelia burgdorferi
KKDILSGNIESDIDID

SEQ ID NO: 102183 - protein, 16 aa, Borrelia burgdorferi
KDILSGNIESDIDIDS

SEQ ID NO: 102184 - protein, 16 aa, Borrelia burgdorferi
DILSGNIESDIDIDSL

SEQ ID NO: 102185 - protein, 16 aa, Borrelia burgdorferi
ILSGNIESDIDIDSLV

SEQ ID NO: 102186 - protein, 16 aa, Borrelia burgdorferi
LSGNIESDIDIDSLVT

SEQ ID NO: 102187 - protein, 16 aa, Borrelia burgdorferi
SGNIESDIDIDSLVTD

SEQ ID NO: 102188 - protein, 16 aa, Borrelia burgdorferi
GNIESDIDIDSLVTDK

SEQ ID NO: 102189 - protein, 16 aa, Borrelia burgdorferi
NIESDIDIDSLVTDKV

SEQ ID NO: 102190 - protein, 16 aa, Borrelia burgdorferi
IESDIDIDSLVTDKVI

SEQ ID NO: 102191 - protein, 16 aa, Borrelia burgdorferi
ESDIDIDSLVTDKVIA

SEQ ID NO: 102192 - protein, 16 aa, Borrelia burgdorferi
SDIDIDSLVTDKVIAA

SEQ ID NO: 102193 - protein, 16 aa, Borrelia burgdorferi
DIDIDSLVTDKVIAAL

SEQ ID NO: 102194 - protein, 16 aa, Borrelia burgdorferi
IDIDSLVTDKVIAALL

SEQ ID NO: 102195 - protein, 16 aa, Borrelia burgdorferi
DIDSLVTDKVIAALLS

SEQ ID NO: 102196 - protein, 16 aa, Borrelia burgdorferi
IDSLVTDKVIAALLSE

SEQ ID NO: 102197 - protein, 16 aa, Borrelia burgdorferi
DSLVTDKVIAALLSEN

SEQ ID NO: 102198 - protein, 16 aa, Borrelia burgdorferi
SLVTDKVIAALLSENE

SEQ ID NO: 102199 - protein, 16 aa, Borrelia burgdorferi
LVTDKVIAALLSENEA

SEQ ID NO: 102200 - protein, 16 aa, Borrelia burgdorferi
VTDKVIAALLSENEAG

SEQ ID NO: 102201 - protein, 16 aa, Borrelia burgdorferi
TDKVIAALLSENEAGV

SEQ ID NO: 102202 - protein, 16 aa, Borrelia burgdorferi
DKVIAALLSENEAGVN

SEQ ID NO: 102203 - protein, 16 aa, Borrelia burgdorferi
KVIAALLSENEAGVNF

SEQ ID NO: 102204 - protein, 16 aa, Borrelia burgdorferi
VIAALLSENEAGVNFA

SEQ ID NO: 102205 - protein, 16 aa, Borrelia burgdorferi
IAALLSENEAGVNFAR

SEQ ID NO: 102206 - protein, 16 aa, Borrelia burgdorferi
AALLSENEAGVNFARD

SEQ ID NO: 102207 - protein, 16 aa, Borrelia burgdorferi
ALLSENEAGVNFARDI

SEQ ID NO: 102208 - protein, 16 aa, Borrelia burgdorferi
LLSENEAGVNFARDIT

SEQ ID NO: 102209 - protein, 16 aa, Borrelia burgdorferi
LSENEAGVNFARDITD

SEQ ID NO: 102210 - protein, 16 aa, Borrelia burgdorferi
SENEAGVNFARDITDI

SEQ ID NO: 102211 - protein, 16 aa, Borrelia burgdorferi
ENEAGVNFARDITDIQ

SEQ ID NO: 102212 - protein, 16 aa, Borrelia burgdorferi
NEAGVNFARDITDIQG

SEQ ID NO: 102213 - protein, 16 aa, Borrelia burgdorferi
EAGVNFARDITDIQGE

SEQ ID NO: 102214 - protein, 16 aa, Borrelia burgdorferi
AGVNFARDITDIQGET

SEQ ID NO: 102215 - protein, 16 aa, Borrelia burgdorferi
GVNFARDITDIQGETH

SEQ ID NO: 102216 - protein, 16 aa, Borrelia burgdorferi
VNFARDITDIQGETHK

SEQ ID NO: 102217 - protein, 16 aa, Borrelia burgdorferi
NFARDITDIQGETHKA

SEQ ID NO: 102218 - protein, 16 aa, Borrelia burgdorferi
FARDITDIQGETHKAD

SEQ ID NO: 102219 - protein, 16 aa, Borrelia burgdorferi
ARDITDIQGETHKADQ

SEQ ID NO: 102220 - protein, 16 aa, Borrelia burgdorferi
RDITDIQGETHKADQD

SEQ ID NO: 102221 - protein, 16 aa, Borrelia burgdorferi
DITDIQGETHKADQDK

SEQ ID NO: 102222 - protein, 16 aa, Borrelia burgdorferi
ITDIQGETHKADQDKI

SEQ ID NO: 102223 - protein, 16 aa, Borrelia burgdorferi
TDIQGETHKADQDKID

SEQ ID NO: 102224 - protein, 16 aa, Borrelia burgdorferi
DIQGETHKADQDKIDT

SEQ ID NO: 102225 - protein, 16 aa, Borrelia burgdorferi
IQGETHKADQDKIDTE

SEQ ID NO: 102226 - protein, 16 aa, Borrelia burgdorferi
QGETHKADQDKIDTEL

SEQ ID NO: 102227 - protein, 16 aa, Borrelia burgdorferi
GETHKADQDKIDTELD

SEQ ID NO: 102228 - protein, 16 aa, Borrelia burgdorferi
ETHKADQDKIDTELDN

SEQ ID NO: 102229 - protein, 16 aa, Borrelia burgdorferi
THKADQDKIDTELDNI

SEQ ID NO: 102230 - protein, 16 aa, Borrelia burgdorferi
HKADQDKIDTELDNIH

SEQ ID NO: 102231 - protein, 16 aa, Borrelia burgdorferi
KADQDKIDTELDNIHE

SEQ ID NO: 102232 - protein, 16 aa, Borrelia burgdorferi
ADQDKIDTELDNIHES

SEQ ID NO: 102233 - protein, 16 aa, Borrelia burgdorferi
DQDKIDTELDNIHESD

SEQ ID NO: 102234 - protein, 16 aa, Borrelia burgdorferi
QDKIDTELDNIHESDS

SEQ ID NO: 102235 - protein, 16 aa, Borrelia burgdorferi
DKIDTELDNIHESDSN

SEQ ID NO: 102236 - protein, 16 aa, Borrelia burgdorferi
KIDTELDNIHESDSNI

SEQ ID NO: 102237 - protein, 16 aa, Borrelia burgdorferi
IDTELDNIHESDSNIT

SEQ ID NO: 102238 - protein, 16 aa, Borrelia burgdorferi
DTELDNIHESDSNITE

SEQ ID NO: 102239 - protein, 16 aa, Borrelia burgdorferi
TELDNIHESDSNITET

SEQ ID NO: 102240 - protein, 16 aa, Borrelia burgdorferi
ELDNIHESDSNITETI

SEQ ID NO: 102241 - protein, 16 aa, Borrelia burgdorferi
LDNIHESDSNITETIE

SEQ ID NO: 102242 - protein, 16 aa, Borrelia burgdorferi
DNIHESDSNITETIEN

SEQ ID NO: 102243 - protein, 16 aa, Borrelia burgdorferi
NIHESDSNITETIENL

SEQ ID NO: 102244 - protein, 16 aa, Borrelia burgdorferi
IHESDSNITETIENLR

SEQ ID NO: 102245 - protein, 16 aa, Borrelia burgdorferi
HESDSNITETIENLRD

SEQ ID NO: 102246 - protein, 16 aa, Borrelia burgdorferi
ESDSNITETIENLRDQ

SEQ ID NO: 102247 - protein, 16 aa, Borrelia burgdorferi
SDSNITETIENLRDQL

SEQ ID NO: 102248 - protein, 16 aa, Borrelia burgdorferi
DSNITETIENLRDQLE

SEQ ID NO: 102249 - protein, 16 aa, Borrelia burgdorferi
SNITETIENLRDQLEK

SEQ ID NO: 102250 - protein, 16 aa, Borrelia burgdorferi
NITETIENLRDQLEKA

SEQ ID NO: 102251 - protein, 16 aa, Borrelia burgdorferi
ITETIENLRDQLEKAT

SEQ ID NO: 102252 - protein, 16 aa, Borrelia burgdorferi
TETIENLRDQLEKATD

SEQ ID NO: 102253 - protein, 16 aa, Borrelia burgdorferi
ETIENLRDQLEKATDE

SEQ ID NO: 102254 - protein, 16 aa, Borrelia burgdorferi
TIENLRDQLEKATDEE

SEQ ID NO: 102255 - protein, 16 aa, Borrelia burgdorferi
IENLRDQLEKATDEEH

SEQ ID NO: 102256 - protein, 16 aa, Borrelia burgdorferi
ENLRDQLEKATDEEHK

SEQ ID NO: 102257 - protein, 16 aa, Borrelia burgdorferi
NLRDQLEKATDEEHKK

SEQ ID NO: 102258 - protein, 16 aa, Borrelia burgdorferi
LRDQLEKATDEEHKKE

SEQ ID NO: 102259 - protein, 16 aa, Borrelia burgdorferi
RDQLEKATDEEHKKEI

SEQ ID NO: 102260 - protein, 16 aa, Borrelia burgdorferi
DQLEKATDEEHKKEIE

SEQ ID NO: 102261 - protein, 16 aa, Borrelia burgdorferi
QLEKATDEEHKKEIES

SEQ ID NO: 102262 - protein, 16 aa, Borrelia burgdorferi
LEKATDEEHKKEIESQ

SEQ ID NO: 102263 - protein, 16 aa, Borrelia burgdorferi
EKATDEEHKKEIESQV

SEQ ID NO: 102264 - protein, 16 aa, Borrelia burgdorferi
KATDEEHKKEIESQVD

SEQ ID NO: 102265 - protein, 16 aa, Borrelia burgdorferi
ATDEEHKKEIESQVDA

SEQ ID NO: 102266 - protein, 16 aa, Borrelia burgdorferi
TDEEHKKEIESQVDAK

SEQ ID NO: 102267 - protein, 16 aa, Borrelia burgdorferi
DEEHKKEIESQVDAKK

SEQ ID NO: 102268 - protein, 16 aa, Borrelia burgdorferi
EEHKKEIESQVDAKKK

SEQ ID NO: 102269 - protein, 16 aa, Borrelia burgdorferi
EHKKEIESQVDAKKKE

SEQ ID NO: 102270 - protein, 16 aa, Borrelia burgdorferi
HKKEIESQVDAKKKEK

SEQ ID NO: 102271 - protein, 16 aa, Borrelia burgdorferi
KKEIESQVDAKKKEKE

SEQ ID NO: 102272 - protein, 16 aa, Borrelia burgdorferi
KEIESQVDAKKKEKEE

SEQ ID NO: 102273 - protein, 16 aa, Borrelia burgdorferi
EIESQVDAKKKEKEEL

SEQ ID NO: 102274 - protein, 16 aa, Borrelia burgdorferi
IESQVDAKKKEKEELD

SEQ ID NO: 102275 - protein, 16 aa, Borrelia burgdorferi
ESQVDAKKKEKEELDK

SEQ ID NO: 102276 - protein, 16 aa, Borrelia burgdorferi
SQVDAKKKEKEELDKK

SEQ ID NO: 102277 - protein, 16 aa, Borrelia burgdorferi
QVDAKKKEKEELDKKA

SEQ ID NO: 102278 - protein, 16 aa, Borrelia burgdorferi
VDAKKKEKEELDKKAI

SEQ ID NO: 102279 - protein, 16 aa, Borrelia burgdorferi
DAKKKEKEELDKKAIN

SEQ ID NO: 102280 - protein, 16 aa, Borrelia burgdorferi
AKKKEKEELDKKAINL

SEQ ID NO: 102281 - protein, 16 aa, Borrelia burgdorferi
KKKEKEELDKKAINLD

SEQ ID NO: 102282 - protein, 16 aa, Borrelia burgdorferi
KKEKEELDKKAINLDK

SEQ ID NO: 102283 - protein, 16 aa, Borrelia burgdorferi
KEKEELDKKAINLDKA

SEQ ID NO: 102284 - protein, 16 aa, Borrelia burgdorferi
EKEELDKKAINLDKAQ

SEQ ID NO: 102285 - protein, 16 aa, Borrelia burgdorferi
KEELDKKAINLDKAQQ

SEQ ID NO: 102286 - protein, 16 aa, Borrelia burgdorferi
EELDKKAINLDKAQQK

SEQ ID NO: 102287 - protein, 16 aa, Borrelia burgdorferi
ELDKKAINLDKAQQKL

SEQ ID NO: 102288 - protein, 16 aa, Borrelia burgdorferi
LDKKAINLDKAQQKLD

SEQ ID NO: 102289 - protein, 16 aa, Borrelia burgdorferi
DKKAINLDKAQQKLDS

SEQ ID NO: 102290 - protein, 16 aa, Borrelia burgdorferi
KKAINLDKAQQKLDSA

SEQ ID NO: 102291 - protein, 16 aa, Borrelia burgdorferi
KAINLDKAQQKLDSAE

SEQ ID NO: 102292 - protein, 16 aa, Borrelia burgdorferi
AINLDKAQQKLDSAED

SEQ ID NO: 102293 - protein, 16 aa, Borrelia burgdorferi
INLDKAQQKLDSAEDN

SEQ ID NO: 102294 - protein, 16 aa, Borrelia burgdorferi
NLDKAQQKLDSAEDNL

SEQ ID NO: 102295 - protein, 16 aa, Borrelia burgdorferi
LDKAQQKLDSAEDNLD

SEQ ID NO: 102296 - protein, 16 aa, Borrelia burgdorferi
DKAQQKLDSAEDNLDV

SEQ ID NO: 102297 - protein, 16 aa, Borrelia burgdorferi
KAQQKLDSAEDNLDVQ

SEQ ID NO: 102298 - protein, 16 aa, Borrelia burgdorferi
AQQKLDSAEDNLDVQR

SEQ ID NO: 102299 - protein, 16 aa, Borrelia burgdorferi
QQKLDSAEDNLDVQRD

SEQ ID NO: 102300 - protein, 16 aa, Borrelia burgdorferi
QKLDSAEDNLDVQRDT

SEQ ID NO: 102301 - protein, 16 aa, Borrelia burgdorferi
KLDSAEDNLDVQRDTV

SEQ ID NO: 102302 - protein, 16 aa, Borrelia burgdorferi
LDSAEDNLDVQRDTVR

SEQ ID NO: 102303 - protein, 16 aa, Borrelia burgdorferi
DSAEDNLDVQRDTVRE

SEQ ID NO: 102304 - protein, 16 aa, Borrelia burgdorferi
SAEDNLDVQRDTVREK

SEQ ID NO: 102305 - protein, 16 aa, Borrelia burgdorferi
AEDNLDVQRDTVREKI

SEQ ID NO: 102306 - protein, 16 aa, Borrelia burgdorferi
EDNLDVQRDTVREKIQ

SEQ ID NO: 102307 - protein, 16 aa, Borrelia burgdorferi
DNLDVQRDTVREKIQE

SEQ ID NO: 102308 - protein, 16 aa, Borrelia burgdorferi
NLDVQRDTVREKIQED

SEQ ID NO: 102309 - protein, 16 aa, Borrelia burgdorferi
LDVQRDTVREKIQEDI

SEQ ID NO: 102310 - protein, 16 aa, Borrelia burgdorferi
DVQRDTVREKIQEDIN

SEQ ID NO: 102311 - protein, 16 aa, Borrelia burgdorferi
VQRDTVREKIQEDINE

SEQ ID NO: 102312 - protein, 16 aa, Borrelia burgdorferi
QRDTVREKIQEDINEI

SEQ ID NO: 102313 - protein, 16 aa, Borrelia burgdorferi
RDTVREKIQEDINEIN

SEQ ID NO: 102314 - protein, 16 aa, Borrelia burgdorferi
DTVREKIQEDINEINK

SEQ ID NO: 102315 - protein, 16 aa, Borrelia burgdorferi
TVREKIQEDINEINKE

SEQ ID NO: 102316 - protein, 16 aa, Borrelia burgdorferi
VREKIQEDINEINKEK

SEQ ID NO: 102317 - protein, 16 aa, Borrelia burgdorferi
REKIQEDINEINKEKN

SEQ ID NO: 102318 - protein, 16 aa, Borrelia burgdorferi
EKIQEDINEINKEKNL

SEQ ID NO: 102319 - protein, 16 aa, Borrelia burgdorferi
KIQEDINEINKEKNLP

SEQ ID NO: 102320 - protein, 16 aa, Borrelia burgdorferi
IQEDINEINKEKNLPK

SEQ ID NO: 102321 - protein, 16 aa, Borrelia burgdorferi
QEDINEINKEKNLPKP

SEQ ID NO: 102322 - protein, 16 aa, Borrelia burgdorferi
EDINEINKEKNLPKPG

SEQ ID NO: 102323 - protein, 16 aa, Borrelia burgdorferi
DINEINKEKNLPKPGD

SEQ ID NO: 102324 - protein, 16 aa, Borrelia burgdorferi
INEINKEKNLPKPGDV

SEQ ID NO: 102325 - protein, 16 aa, Borrelia burgdorferi
NEINKEKNLPKPGDVS

SEQ ID NO: 102326 - protein, 16 aa, Borrelia burgdorferi
EINKEKNLPKPGDVSS

SEQ ID NO: 102327 - protein, 16 aa, Borrelia burgdorferi
INKEKNLPKPGDVSSP

SEQ ID NO: 102328 - protein, 16 aa, Borrelia burgdorferi
NKEKNLPKPGDVSSPK

SEQ ID NO: 102329 - protein, 16 aa, Borrelia burgdorferi
KEKNLPKPGDVSSPKV

SEQ ID NO: 102330 - protein, 16 aa, Borrelia burgdorferi
EKNLPKPGDVSSPKVD

SEQ ID NO: 102331 - protein, 16 aa, Borrelia burgdorferi
KNLPKPGDVSSPKVDK

SEQ ID NO: 102332 - protein, 16 aa, Borrelia burgdorferi
NLPKPGDVSSPKVDKQ

SEQ ID NO: 102333 - protein, 16 aa, Borrelia burgdorferi
LPKPGDVSSPKVDKQL

SEQ ID NO: 102334 - protein, 16 aa, Borrelia burgdorferi
PKPGDVSSPKVDKQLQ

SEQ ID NO: 102335 - protein, 16 aa, Borrelia burgdorferi
KPGDVSSPKVDKQLQI

SEQ ID NO: 102336 - protein, 16 aa, Borrelia burgdorferi
PGDVSSPKVDKQLQIK

SEQ ID NO: 102337 - protein, 16 aa, Borrelia burgdorferi
GDVSSPKVDKQLQIKE

SEQ ID NO: 102338 - protein, 16 aa, Borrelia burgdorferi
DVSSPKVDKQLQIKES

SEQ ID NO: 102339 - protein, 16 aa, Borrelia burgdorferi
VSSPKVDKQLQIKESL

SEQ ID NO: 102340 - protein, 16 aa, Borrelia burgdorferi
SSPKVDKQLQIKESLE

SEQ ID NO: 102341 - protein, 16 aa, Borrelia burgdorferi
SPKVDKQLQIKESLED

SEQ ID NO: 102342 - protein, 16 aa, Borrelia burgdorferi
PKVDKQLQIKESLEDL

SEQ ID NO: 102343 - protein, 16 aa, Borrelia burgdorferi
KVDKQLQIKESLEDLQ

SEQ ID NO: 102344 - protein, 16 aa, Borrelia burgdorferi
VDKQLQIKESLEDLQE

SEQ ID NO: 102345 - protein, 16 aa, Borrelia burgdorferi
DKQLQIKESLEDLQEQ

SEQ ID NO: 102346 - protein, 16 aa, Borrelia burgdorferi
KQLQIKESLEDLQEQL

SEQ ID NO: 102347 - protein, 16 aa, Borrelia burgdorferi
QLQIKESLEDLQEQLK

SEQ ID NO: 102348 - protein, 16 aa, Borrelia burgdorferi
LQIKESLEDLQEQLKE

SEQ ID NO: 102349 - protein, 16 aa, Borrelia burgdorferi
QIKESLEDLQEQLKEA

SEQ ID NO: 102350 - protein, 16 aa, Borrelia burgdorferi
IKESLEDLQEQLKEAG

SEQ ID NO: 102351 - protein, 16 aa, Borrelia burgdorferi
KESLEDLQEQLKEAGD

SEQ ID NO: 102352 - protein, 16 aa, Borrelia burgdorferi
ESLEDLQEQLKEAGDE

SEQ ID NO: 102353 - protein, 16 aa, Borrelia burgdorferi
SLEDLQEQLKEAGDEN

SEQ ID NO: 102354 - protein, 16 aa, Borrelia burgdorferi
LEDLQEQLKEAGDENQ

SEQ ID NO: 102355 - protein, 16 aa, Borrelia burgdorferi
EDLQEQLKEAGDENQK

SEQ ID NO: 102356 - protein, 16 aa, Borrelia burgdorferi
DLQEQLKEAGDENQKR

SEQ ID NO: 102357 - protein, 16 aa, Borrelia burgdorferi
LQEQLKEAGDENQKRE

SEQ ID NO: 102358 - protein, 16 aa, Borrelia burgdorferi
QEQLKEAGDENQKREI

SEQ ID NO: 102359 - protein, 16 aa, Borrelia burgdorferi
EQLKEAGDENQKREIE

SEQ ID NO: 102360 - protein, 16 aa, Borrelia burgdorferi
QLKEAGDENQKREIEK

SEQ ID NO: 102361 - protein, 16 aa, Borrelia burgdorferi
LKEAGDENQKREIEKQ

SEQ ID NO: 102362 - protein, 16 aa, Borrelia burgdorferi
KEAGDENQKREIEKQI

SEQ ID NO: 102363 - protein, 16 aa, Borrelia burgdorferi
EAGDENQKREIEKQIE

SEQ ID NO: 102364 - protein, 16 aa, Borrelia burgdorferi
AGDENQKREIEKQIEI

SEQ ID NO: 102365 - protein, 16 aa, Borrelia burgdorferi
GDENQKREIEKQIEIK

SEQ ID NO: 102366 - protein, 16 aa, Borrelia burgdorferi
DENQKREIEKQIEIKK

SEQ ID NO: 102367 - protein, 16 aa, Borrelia burgdorferi
ENQKREIEKQIEIKKR

SEQ ID NO: 102368 - protein, 16 aa, Borrelia burgdorferi
NQKREIEKQIEIKKRD

SEQ ID NO: 102369 - protein, 16 aa, Borrelia burgdorferi
QKREIEKQIEIKKRDE

SEQ ID NO: 102370 - protein, 16 aa, Borrelia burgdorferi
KREIEKQIEIKKRDEE

SEQ ID NO: 102371 - protein, 16 aa, Borrelia burgdorferi
REIEKQIEIKKRDEEL

SEQ ID NO: 102372 - protein, 16 aa, Borrelia burgdorferi
EIEKQIEIKKRDEELL

SEQ ID NO: 102373 - protein, 16 aa, Borrelia burgdorferi
IEKQIEIKKRDEELLK

SEQ ID NO: 102374 - protein, 16 aa, Borrelia burgdorferi
EKQIEIKKRDEELLKS

SEQ ID NO: 102375 - protein, 16 aa, Borrelia burgdorferi
KQIEIKKRDEELLKSK

SEQ ID NO: 102376 - protein, 16 aa, Borrelia burgdorferi
QIEIKKRDEELLKSKD

SEQ ID NO: 102377 - protein, 16 aa, Borrelia burgdorferi
IEIKKRDEELLKSKDG

SEQ ID NO: 102378 - protein, 16 aa, Borrelia burgdorferi
EIKKRDEELLKSKDGK

SEQ ID NO: 102379 - protein, 16 aa, Borrelia burgdorferi
IKKRDEELLKSKDGKV

SEQ ID NO: 102380 - protein, 16 aa, Borrelia burgdorferi
KKRDEELLKSKDGKVS

SEQ ID NO: 102381 - protein, 16 aa, Borrelia burgdorferi
KRDEELLKSKDGKVSK

SEQ ID NO: 102382 - protein, 16 aa, Borrelia burgdorferi
RDEELLKSKDGKVSKD

SEQ ID NO: 102383 - protein, 16 aa, Borrelia burgdorferi
DEELLKSKDGKVSKDY

SEQ ID NO: 102384 - protein, 16 aa, Borrelia burgdorferi
EELLKSKDGKVSKDYE

SEQ ID NO: 102385 - protein, 16 aa, Borrelia burgdorferi
ELLKSKDGKVSKDYEA

SEQ ID NO: 102386 - protein, 16 aa, Borrelia burgdorferi
LLKSKDGKVSKDYEAL

SEQ ID NO: 102387 - protein, 16 aa, Borrelia burgdorferi
LKSKDGKVSKDYEALD

SEQ ID NO: 102388 - protein, 16 aa, Borrelia burgdorferi
KSKDGKVSKDYEALDL

SEQ ID NO: 102389 - protein, 16 aa, Borrelia burgdorferi
SKDGKVSKDYEALDLD

SEQ ID NO: 102390 - protein, 16 aa, Borrelia burgdorferi
KDGKVSKDYEALDLDR

SEQ ID NO: 102391 - protein, 16 aa, Borrelia burgdorferi
DGKVSKDYEALDLDRE

SEQ ID NO: 102392 - protein, 16 aa, Borrelia burgdorferi
GKVSKDYEALDLDREL

SEQ ID NO: 102393 - protein, 16 aa, Borrelia burgdorferi
KVSKDYEALDLDRELS

SEQ ID NO: 102394 - protein, 16 aa, Borrelia burgdorferi
VSKDYEALDLDRELSK

SEQ ID NO: 102395 - protein, 16 aa, Borrelia burgdorferi
SKDYEALDLDRELSKA

SEQ ID NO: 102396 - protein, 16 aa, Borrelia burgdorferi
KDYEALDLDRELSKAS

SEQ ID NO: 102397 - protein, 16 aa, Borrelia burgdorferi
DYEALDLDRELSKASS

SEQ ID NO: 102398 - protein, 16 aa, Borrelia burgdorferi
YEALDLDRELSKASSK

SEQ ID NO: 102399 - protein, 16 aa, Borrelia burgdorferi
EALDLDRELSKASSKE

SEQ ID NO: 102400 - protein, 16 aa, Borrelia burgdorferi
ALDLDRELSKASSKEK

SEQ ID NO: 102401 - protein, 16 aa, Borrelia burgdorferi
LDLDRELSKASSKEKS

SEQ ID NO: 102402 - protein, 16 aa, Borrelia burgdorferi
DLDRELSKASSKEKSK

SEQ ID NO: 102403 - protein, 16 aa, Borrelia burgdorferi
LDRELSKASSKEKSKV

SEQ ID NO: 102404 - protein, 16 aa, Borrelia burgdorferi
DRELSKASSKEKSKVK

SEQ ID NO: 102405 - protein, 16 aa, Borrelia burgdorferi
RELSKASSKEKSKVKE

SEQ ID NO: 102406 - protein, 16 aa, Borrelia burgdorferi
ELSKASSKEKSKVKEE

SEQ ID NO: 102407 - protein, 16 aa, Borrelia burgdorferi
LSKASSKEKSKVKEEE

SEQ ID NO: 102408 - protein, 16 aa, Borrelia burgdorferi
SKASSKEKSKVKEEEI

SEQ ID NO: 102409 - protein, 16 aa, Borrelia burgdorferi
KASSKEKSKVKEEEIT

SEQ ID NO: 102410 - protein, 16 aa, Borrelia burgdorferi
ASSKEKSKVKEEEITK

SEQ ID NO: 102411 - protein, 16 aa, Borrelia burgdorferi
SSKEKSKVKEEEITKG

SEQ ID NO: 102412 - protein, 16 aa, Borrelia burgdorferi
SKEKSKVKEEEITKGK

SEQ ID NO: 102413 - protein, 16 aa, Borrelia burgdorferi
KEKSKVKEEEITKGKS

SEQ ID NO: 102414 - protein, 16 aa, Borrelia burgdorferi
EKSKVKEEEITKGKSR

SEQ ID NO: 102415 - protein, 16 aa, Borrelia burgdorferi
KSKVKEEEITKGKSRA

SEQ ID NO: 102416 - protein, 16 aa, Borrelia burgdorferi
SKVKEEEITKGKSRAS

SEQ ID NO: 102417 - protein, 16 aa, Borrelia burgdorferi
KVKEEEITKGKSRASL

SEQ ID NO: 102418 - protein, 16 aa, Borrelia burgdorferi
VKEEEITKGKSRASLG

SEQ ID NO: 102419 - protein, 16 aa, Borrelia burgdorferi
KEEEITKGKSRASLGD

SEQ ID NO: 102420 - protein, 16 aa, Borrelia burgdorferi
EEEITKGKSRASLGDL

SEQ ID NO: 102421 - protein, 16 aa, Borrelia burgdorferi
EEITKGKSRASLGDLN

SEQ ID NO: 102422 - protein, 16 aa, Borrelia burgdorferi
EITKGKSRASLGDLNN

SEQ ID NO: 102423 - protein, 16 aa, Borrelia burgdorferi
ITKGKSRASLGDLNND

SEQ ID NO: 102424 - protein, 16 aa, Borrelia burgdorferi
TKGKSRASLGDLNNDK

SEQ ID NO: 102425 - protein, 16 aa, Borrelia burgdorferi
KGKSRASLGDLNNDKN

SEQ ID NO: 102426 - protein, 16 aa, Borrelia burgdorferi
GKSRASLGDLNNDKNL

SEQ ID NO: 102427 - protein, 16 aa, Borrelia burgdorferi
KSRASLGDLNNDKNLM

SEQ ID NO: 102428 - protein, 16 aa, Borrelia burgdorferi
SRASLGDLNNDKNLML

SEQ ID NO: 102429 - protein, 16 aa, Borrelia burgdorferi
RASLGDLNNDKNLMLP

SEQ ID NO: 102430 - protein, 16 aa, Borrelia burgdorferi
ASLGDLNNDKNLMLPE

SEQ ID NO: 102431 - protein, 16 aa, Borrelia burgdorferi
SLGDLNNDKNLMLPED

SEQ ID NO: 102432 - protein, 16 aa, Borrelia burgdorferi
LGDLNNDKNLMLPEDQ

SEQ ID NO: 102433 - protein, 16 aa, Borrelia burgdorferi
GDLNNDKNLMLPEDQK

SEQ ID NO: 102434 - protein, 16 aa, Borrelia burgdorferi
DLNNDKNLMLPEDQKL

SEQ ID NO: 102435 - protein, 16 aa, Borrelia burgdorferi
LNNDKNLMLPEDQKLP

SEQ ID NO: 102436 - protein, 16 aa, Borrelia burgdorferi
NNDKNLMLPEDQKLPE

SEQ ID NO: 102437 - protein, 16 aa, Borrelia burgdorferi
NDKNLMLPEDQKLPED

SEQ ID NO: 102438 - protein, 16 aa, Borrelia burgdorferi
DKNLMLPEDQKLPEDK

SEQ ID NO: 102439 - protein, 16 aa, Borrelia burgdorferi
KNLMLPEDQKLPEDKK

SEQ ID NO: 102440 - protein, 16 aa, Borrelia burgdorferi
NLMLPEDQKLPEDKKL

SEQ ID NO: 102441 - protein, 16 aa, Borrelia burgdorferi
LMLPEDQKLPEDKKLD

SEQ ID NO: 102442 - protein, 16 aa, Borrelia burgdorferi
MLPEDQKLPEDKKLDS

SEQ ID NO: 102443 - protein, 16 aa, Borrelia burgdorferi
LPEDQKLPEDKKLDSK

SEQ ID NO: 102444 - protein, 16 aa, Borrelia burgdorferi
PEDQKLPEDKKLDSKL

SEQ ID NO: 102445 - protein, 16 aa, Borrelia burgdorferi
EDQKLPEDKKLDSKLD

SEQ ID NO: 102446 - protein, 16 aa, Borrelia burgdorferi
DQKLPEDKKLDSKLDG

SEQ ID NO: 102447 - protein, 16 aa, Borrelia burgdorferi
QKLPEDKKLDSKLDGK

SEQ ID NO: 102448 - protein, 16 aa, Borrelia burgdorferi
KLPEDKKLDSKLDGKK

SEQ ID NO: 102449 - protein, 16 aa, Borrelia burgdorferi
LPEDKKLDSKLDGKKE

SEQ ID NO: 102450 - protein, 16 aa, Borrelia burgdorferi
PEDKKLDSKLDGKKEF

SEQ ID NO: 102451 - protein, 16 aa, Borrelia burgdorferi
EDKKLDSKLDGKKEFK

SEQ ID NO: 102452 - protein, 16 aa, Borrelia burgdorferi
DKKLDSKLDGKKEFKP

SEQ ID NO: 102453 - protein, 16 aa, Borrelia burgdorferi
KKLDSKLDGKKEFKPV

SEQ ID NO: 102454 - protein, 16 aa, Borrelia burgdorferi
KLDSKLDGKKEFKPVS

SEQ ID NO: 102455 - protein, 16 aa, Borrelia burgdorferi
LDSKLDGKKEFKPVSE

SEQ ID NO: 102456 - protein, 16 aa, Borrelia burgdorferi
DSKLDGKKEFKPVSEV

SEQ ID NO: 102457 - protein, 16 aa, Borrelia burgdorferi
SKLDGKKEFKPVSEVE

SEQ ID NO: 102458 - protein, 16 aa, Borrelia burgdorferi
KLDGKKEFKPVSEVEK

SEQ ID NO: 102459 - protein, 16 aa, Borrelia burgdorferi
LDGKKEFKPVSEVEKL

SEQ ID NO: 102460 - protein, 16 aa, Borrelia burgdorferi
DGKKEFKPVSEVEKLD

SEQ ID NO: 102461 - protein, 16 aa, Borrelia burgdorferi
GKKEFKPVSEVEKLDK

SEQ ID NO: 102462 - protein, 16 aa, Borrelia burgdorferi
KKEFKPVSEVEKLDKI

SEQ ID NO: 102463 - protein, 16 aa, Borrelia burgdorferi
KEFKPVSEVEKLDKIS

SEQ ID NO: 102464 - protein, 16 aa, Borrelia burgdorferi
EFKPVSEVEKLDKISK

SEQ ID NO: 102465 - protein, 16 aa, Borrelia burgdorferi
FKPVSEVEKLDKISKS

SEQ ID NO: 102466 - protein, 16 aa, Borrelia burgdorferi
KPVSEVEKLDKISKSN

SEQ ID NO: 102467 - protein, 16 aa, Borrelia burgdorferi
PVSEVEKLDKISKSNN

SEQ ID NO: 102468 - protein, 16 aa, Borrelia burgdorferi
VSEVEKLDKISKSNNN

SEQ ID NO: 102469 - protein, 16 aa, Borrelia burgdorferi
SEVEKLDKISKSNNNE

SEQ ID NO: 102470 - protein, 16 aa, Borrelia burgdorferi
EVEKLDKISKSNNNEV

SEQ ID NO: 102471 - protein, 16 aa, Borrelia burgdorferi
VEKLDKISKSNNNEVG

SEQ ID NO: 102472 - protein, 16 aa, Borrelia burgdorferi
EKLDKISKSNNNEVGK

SEQ ID NO: 102473 - protein, 16 aa, Borrelia burgdorferi
KLDKISKSNNNEVGKL

SEQ ID NO: 102474 - protein, 16 aa, Borrelia burgdorferi
LDKISKSNNNEVGKLS

SEQ ID NO: 102475 - protein, 16 aa, Borrelia burgdorferi
DKISKSNNNEVGKLSP

SEQ ID NO: 102476 - protein, 16 aa, Borrelia burgdorferi
KISKSNNNEVGKLSPL

SEQ ID NO: 102477 - protein, 16 aa, Borrelia burgdorferi
ISKSNNNEVGKLSPLD

SEQ ID NO: 102478 - protein, 16 aa, Borrelia burgdorferi
SKSNNNEVGKLSPLDK

SEQ ID NO: 102479 - protein, 16 aa, Borrelia burgdorferi
KSNNNEVGKLSPLDKP

SEQ ID NO: 102480 - protein, 16 aa, Borrelia burgdorferi
SNNNEVGKLSPLDKPS

SEQ ID NO: 102481 - protein, 16 aa, Borrelia burgdorferi
NNNEVGKLSPLDKPSY

SEQ ID NO: 102482 - protein, 16 aa, Borrelia burgdorferi
NNEVGKLSPLDKPSYD

SEQ ID NO: 102483 - protein, 16 aa, Borrelia burgdorferi
NEVGKLSPLDKPSYDD

SEQ ID NO: 102484 - protein, 16 aa, Borrelia burgdorferi
EVGKLSPLDKPSYDDI

SEQ ID NO: 102485 - protein, 16 aa, Borrelia burgdorferi
VGKLSPLDKPSYDDID

SEQ ID NO: 102486 - protein, 16 aa, Borrelia burgdorferi
GKLSPLDKPSYDDIDS

SEQ ID NO: 102487 - protein, 16 aa, Borrelia burgdorferi
KLSPLDKPSYDDIDSK

SEQ ID NO: 102488 - protein, 16 aa, Borrelia burgdorferi
LSPLDKPSYDDIDSKE

SEQ ID NO: 102489 - protein, 16 aa, Borrelia burgdorferi
SPLDKPSYDDIDSKEE

SEQ ID NO: 102490 - protein, 16 aa, Borrelia burgdorferi
PLDKPSYDDIDSKEEV

SEQ ID NO: 102491 - protein, 16 aa, Borrelia burgdorferi
LDKPSYDDIDSKEEVD

SEQ ID NO: 102492 - protein, 16 aa, Borrelia burgdorferi
DKPSYDDIDSKEEVDN

SEQ ID NO: 102493 - protein, 16 aa, Borrelia burgdorferi
KPSYDDIDSKEEVDNK

SEQ ID NO: 102494 - protein, 16 aa, Borrelia burgdorferi
PSYDDIDSKEEVDNKA

SEQ ID NO: 102495 - protein, 16 aa, Borrelia burgdorferi
SYDDIDSKEEVDNKAI

SEQ ID NO: 102496 - protein, 16 aa, Borrelia burgdorferi
YDDIDSKEEVDNKAIN

SEQ ID NO: 102497 - protein, 16 aa, Borrelia burgdorferi
DDIDSKEEVDNKAINL

SEQ ID NO: 102498 - protein, 16 aa, Borrelia burgdorferi
DIDSKEEVDNKAINLQ

SEQ ID NO: 102499 - protein, 16 aa, Borrelia burgdorferi
IDSKEEVDNKAINLQK

SEQ ID NO: 102500 - protein, 16 aa, Borrelia burgdorferi
DSKEEVDNKAINLQKI

SEQ ID NO: 102501 - protein, 16 aa, Borrelia burgdorferi
SKEEVDNKAINLQKID

SEQ ID NO: 102502 - protein, 16 aa, Borrelia burgdorferi
KEEVDNKAINLQKIDP

SEQ ID NO: 102503 - protein, 16 aa, Borrelia burgdorferi
EEVDNKAINLQKIDPK

SEQ ID NO: 102504 - protein, 16 aa, Borrelia burgdorferi
EVDNKAINLQKIDPKV

SEQ ID NO: 102505 - protein, 16 aa, Borrelia burgdorferi
VDNKAINLQKIDPKVK

SEQ ID NO: 102506 - protein, 16 aa, Borrelia burgdorferi
DNKAINLQKIDPKVKD

SEQ ID NO: 102507 - protein, 16 aa, Borrelia burgdorferi
NKAINLQKIDPKVKDQ

SEQ ID NO: 102508 - protein, 16 aa, Borrelia burgdorferi
KAINLQKIDPKVKDQT

SEQ ID NO: 102509 - protein, 16 aa, Borrelia burgdorferi
AINLQKIDPKVKDQTT

SEQ ID NO: 102510 - protein, 16 aa, Borrelia burgdorferi
INLQKIDPKVKDQTTS

SEQ ID NO: 102511 - protein, 16 aa, Borrelia burgdorferi
NLQKIDPKVKDQTTSL

SEQ ID NO: 102512 - protein, 16 aa, Borrelia burgdorferi
LQKIDPKVKDQTTSLN

SEQ ID NO: 102513 - protein, 16 aa, Borrelia burgdorferi
QKIDPKVKDQTTSLNE

SEQ ID NO: 102514 - protein, 16 aa, Borrelia burgdorferi
KIDPKVKDQTTSLNED

SEQ ID NO: 102515 - protein, 16 aa, Borrelia burgdorferi
IDPKVKDQTTSLNEDL

SEQ ID NO: 102516 - protein, 16 aa, Borrelia burgdorferi
DPKVKDQTTSLNEDLD

SEQ ID NO: 102517 - protein, 16 aa, Borrelia burgdorferi
PKVKDQTTSLNEDLDK

SEQ ID NO: 102518 - protein, 16 aa, Borrelia burgdorferi
KVKDQTTSLNEDLDKD

SEQ ID NO: 102519 - protein, 16 aa, Borrelia burgdorferi
VKDQTTSLNEDLDKDL

SEQ ID NO: 102520 - protein, 16 aa, Borrelia burgdorferi
KDQTTSLNEDLDKDLT

SEQ ID NO: 102521 - protein, 16 aa, Borrelia burgdorferi
DQTTSLNEDLDKDLTT

SEQ ID NO: 102522 - protein, 16 aa, Borrelia burgdorferi
QTTSLNEDLDKDLTTM

SEQ ID NO: 102523 - protein, 16 aa, Borrelia burgdorferi
TTSLNEDLDKDLTTMS

SEQ ID NO: 102524 - protein, 16 aa, Borrelia burgdorferi
TSLNEDLDKDLTTMSI

SEQ ID NO: 102525 - protein, 16 aa, Borrelia burgdorferi
SLNEDLDKDLTTMSID

SEQ ID NO: 102526 - protein, 16 aa, Borrelia burgdorferi
LNEDLDKDLTTMSIDS

SEQ ID NO: 102527 - protein, 16 aa, Borrelia burgdorferi
NEDLDKDLTTMSIDSS

SEQ ID NO: 102528 - protein, 16 aa, Borrelia burgdorferi
EDLDKDLTTMSIDSSS

SEQ ID NO: 102529 - protein, 16 aa, Borrelia burgdorferi
DLDKDLTTMSIDSSSP

SEQ ID NO: 102530 - protein, 16 aa, Borrelia burgdorferi
LDKDLTTMSIDSSSPV

SEQ ID NO: 102531 - protein, 16 aa, Borrelia burgdorferi
DKDLTTMSIDSSSPVF

SEQ ID NO: 102532 - protein, 16 aa, Borrelia burgdorferi
KDLTTMSIDSSSPVFL

SEQ ID NO: 102533 - protein, 16 aa, Borrelia burgdorferi
DLTTMSIDSSSPVFLE

SEQ ID NO: 102534 - protein, 16 aa, Borrelia burgdorferi
LTTMSIDSSSPVFLEV

SEQ ID NO: 102535 - protein, 16 aa, Borrelia burgdorferi
TTMSIDSSSPVFLEVI

SEQ ID NO: 102536 - protein, 16 aa, Borrelia burgdorferi
TMSIDSSSPVFLEVID

SEQ ID NO: 102537 - protein, 16 aa, Borrelia burgdorferi
MSIDSSSPVFLEVIDP

SEQ ID NO: 102538 - protein, 16 aa, Borrelia burgdorferi
SIDSSSPVFLEVIDPI

SEQ ID NO: 102539 - protein, 16 aa, Borrelia burgdorferi
IDSSSPVFLEVIDPIT

SEQ ID NO: 102540 - protein, 16 aa, Borrelia burgdorferi
DSSSPVFLEVIDPITN

SEQ ID NO: 102541 - protein, 16 aa, Borrelia burgdorferi
SSSPVFLEVIDPITNL

SEQ ID NO: 102542 - protein, 16 aa, Borrelia burgdorferi
SSPVFLEVIDPITNLG

SEQ ID NO: 102543 - protein, 16 aa, Borrelia burgdorferi
SPVFLEVIDPITNLGT

SEQ ID NO: 102544 - protein, 16 aa, Borrelia burgdorferi
PVFLEVIDPITNLGTL

SEQ ID NO: 102545 - protein, 16 aa, Borrelia burgdorferi
VFLEVIDPITNLGTLQ

SEQ ID NO: 102546 - protein, 16 aa, Borrelia burgdorferi
FLEVIDPITNLGTLQL

SEQ ID NO: 102547 - protein, 16 aa, Borrelia burgdorferi
LEVIDPITNLGTLQLI

SEQ ID NO: 102548 - protein, 16 aa, Borrelia burgdorferi
EVIDPITNLGTLQLID

SEQ ID NO: 102549 - protein, 16 aa, Borrelia burgdorferi
VIDPITNLGTLQLIDL

SEQ ID NO: 102550 - protein, 16 aa, Borrelia burgdorferi
IDPITNLGTLQLIDLN

SEQ ID NO: 102551 - protein, 16 aa, Borrelia burgdorferi
DPITNLGTLQLIDLNT

SEQ ID NO: 102552 - protein, 16 aa, Borrelia burgdorferi
PITNLGTLQLIDLNTG

SEQ ID NO: 102553 - protein, 16 aa, Borrelia burgdorferi
ITNLGTLQLIDLNTGV

SEQ ID NO: 102554 - protein, 16 aa, Borrelia burgdorferi
TNLGTLQLIDLNTGVR

SEQ ID NO: 102555 - protein, 16 aa, Borrelia burgdorferi
NLGTLQLIDLNTGVRL

SEQ ID NO: 102556 - protein, 16 aa, Borrelia burgdorferi
LGTLQLIDLNTGVRLK

SEQ ID NO: 102557 - protein, 16 aa, Borrelia burgdorferi
GTLQLIDLNTGVRLKE

SEQ ID NO: 102558 - protein, 16 aa, Borrelia burgdorferi
TLQLIDLNTGVRLKES

SEQ ID NO: 102559 - protein, 16 aa, Borrelia burgdorferi
LQLIDLNTGVRLKEST

SEQ ID NO: 102560 - protein, 16 aa, Borrelia burgdorferi
QLIDLNTGVRLKESTQ

SEQ ID NO: 102561 - protein, 16 aa, Borrelia burgdorferi
LIDLNTGVRLKESTQQ

SEQ ID NO: 102562 - protein, 16 aa, Borrelia burgdorferi
IDLNTGVRLKESTQQG

SEQ ID NO: 102563 - protein, 16 aa, Borrelia burgdorferi
DLNTGVRLKESTQQGI

SEQ ID NO: 102564 - protein, 16 aa, Borrelia burgdorferi
LNTGVRLKESTQQGIQ

SEQ ID NO: 102565 - protein, 16 aa, Borrelia burgdorferi
NTGVRLKESTQQGIQR

SEQ ID NO: 102566 - protein, 16 aa, Borrelia burgdorferi
TGVRLKESTQQGIQRY

SEQ ID NO: 102567 - protein, 16 aa, Borrelia burgdorferi
GVRLKESTQQGIQRYG

SEQ ID NO: 102568 - protein, 16 aa, Borrelia burgdorferi
VRLKESTQQGIQRYGI

SEQ ID NO: 102569 - protein, 16 aa, Borrelia burgdorferi
RLKESTQQGIQRYGIY

SEQ ID NO: 102570 - protein, 16 aa, Borrelia burgdorferi
LKESTQQGIQRYGIYE

SEQ ID NO: 102571 - protein, 16 aa, Borrelia burgdorferi
KESTQQGIQRYGIYER

SEQ ID NO: 102572 - protein, 16 aa, Borrelia burgdorferi
ESTQQGIQRYGIYERE

SEQ ID NO: 102573 - protein, 16 aa, Borrelia burgdorferi
STQQGIQRYGIYEREK

SEQ ID NO: 102574 - protein, 16 aa, Borrelia burgdorferi
TQQGIQRYGIYEREKD

SEQ ID NO: 102575 - protein, 16 aa, Borrelia burgdorferi
QQGIQRYGIYEREKDL

SEQ ID NO: 102576 - protein, 16 aa, Borrelia burgdorferi
QGIQRYGIYEREKDLV

SEQ ID NO: 102577 - protein, 16 aa, Borrelia burgdorferi
GIQRYGIYEREKDLVV

SEQ ID NO: 102578 - protein, 16 aa, Borrelia burgdorferi
IQRYGIYEREKDLVVI

SEQ ID NO: 102579 - protein, 16 aa, Borrelia burgdorferi
QRYGIYEREKDLVVIK

SEQ ID NO: 102580 - protein, 16 aa, Borrelia burgdorferi
RYGIYEREKDLVVIKM

SEQ ID NO: 102581 - protein, 16 aa, Borrelia burgdorferi
YGIYEREKDLVVIKMD

SEQ ID NO: 102582 - protein, 16 aa, Borrelia burgdorferi
GIYEREKDLVVIKMDS

SEQ ID NO: 102583 - protein, 16 aa, Borrelia burgdorferi
IYEREKDLVVIKMDSG

SEQ ID NO: 102584 - protein, 16 aa, Borrelia burgdorferi
YEREKDLVVIKMDSGK

SEQ ID NO: 102585 - protein, 16 aa, Borrelia burgdorferi
EREKDLVVIKMDSGKA

SEQ ID NO: 102586 - protein, 16 aa, Borrelia burgdorferi
REKDLVVIKMDSGKAK

SEQ ID NO: 102587 - protein, 16 aa, Borrelia burgdorferi
EKDLVVIKMDSGKAKL

SEQ ID NO: 102588 - protein, 16 aa, Borrelia burgdorferi
KDLVVIKMDSGKAKLQ

SEQ ID NO: 102589 - protein, 16 aa, Borrelia burgdorferi
DLVVIKMDSGKAKLQI

SEQ ID NO: 102590 - protein, 16 aa, Borrelia burgdorferi
LVVIKMDSGKAKLQIL

SEQ ID NO: 102591 - protein, 16 aa, Borrelia burgdorferi
VVIKMDSGKAKLQILN

SEQ ID NO: 102592 - protein, 16 aa, Borrelia burgdorferi
VIKMDSGKAKLQILNK

SEQ ID NO: 102593 - protein, 16 aa, Borrelia burgdorferi
IKMDSGKAKLQILNKL

SEQ ID NO: 102594 - protein, 16 aa, Borrelia burgdorferi
KMDSGKAKLQILNKLE

SEQ ID NO: 102595 - protein, 16 aa, Borrelia burgdorferi
MDSGKAKLQILNKLEN

SEQ ID NO: 102596 - protein, 16 aa, Borrelia burgdorferi
DSGKAKLQILNKLENL

SEQ ID NO: 102597 - protein, 16 aa, Borrelia burgdorferi
SGKAKLQILNKLENLK

SEQ ID NO: 102598 - protein, 16 aa, Borrelia burgdorferi
GKAKLQILNKLENLKV

SEQ ID NO: 102599 - protein, 16 aa, Borrelia burgdorferi
KAKLQILNKLENLKVV

SEQ ID NO: 102600 - protein, 16 aa, Borrelia burgdorferi
AKLQILNKLENLKVVS

SEQ ID NO: 102601 - protein, 16 aa, Borrelia burgdorferi
KLQILNKLENLKVVSE

SEQ ID NO: 102602 - protein, 16 aa, Borrelia burgdorferi
LQILNKLENLKVVSES

SEQ ID NO: 102603 - protein, 16 aa, Borrelia burgdorferi
QILNKLENLKVVSESN

SEQ ID NO: 102604 - protein, 16 aa, Borrelia burgdorferi
ILNKLENLKVVSESNF

SEQ ID NO: 102605 - protein, 16 aa, Borrelia burgdorferi
LNKLENLKVVSESNFE

SEQ ID NO: 102606 - protein, 16 aa, Borrelia burgdorferi
NKLENLKVVSESNFEI

SEQ ID NO: 102607 - protein, 16 aa, Borrelia burgdorferi
KLENLKVVSESNFEIN

SEQ ID NO: 102608 - protein, 16 aa, Borrelia burgdorferi
LENLKVVSESNFEINK

SEQ ID NO: 102609 - protein, 16 aa, Borrelia burgdorferi
ENLKVVSESNFEINKN

SEQ ID NO: 102610 - protein, 16 aa, Borrelia burgdorferi
NLKVVSESNFEINKNS

SEQ ID NO: 102611 - protein, 16 aa, Borrelia burgdorferi
LKVVSESNFEINKNSS

SEQ ID NO: 102612 - protein, 16 aa, Borrelia burgdorferi
KVVSESNFEINKNSSL

SEQ ID NO: 102613 - protein, 16 aa, Borrelia burgdorferi
VVSESNFEINKNSSLY

SEQ ID NO: 102614 - protein, 16 aa, Borrelia burgdorferi
VSESNFEINKNSSLYV

SEQ ID NO: 102615 - protein, 16 aa, Borrelia burgdorferi
SESNFEINKNSSLYVD

SEQ ID NO: 102616 - protein, 16 aa, Borrelia burgdorferi
ESNFEINKNSSLYVDS

SEQ ID NO: 102617 - protein, 16 aa, Borrelia burgdorferi
SNFEINKNSSLYVDSK

SEQ ID NO: 102618 - protein, 16 aa, Borrelia burgdorferi
NFEINKNSSLYVDSKM

SEQ ID NO: 102619 - protein, 16 aa, Borrelia burgdorferi
FEINKNSSLYVDSKMI

SEQ ID NO: 102620 - protein, 16 aa, Borrelia burgdorferi
EINKNSSLYVDSKMIL

SEQ ID NO: 102621 - protein, 16 aa, Borrelia burgdorferi
INKNSSLYVDSKMILA

SEQ ID NO: 102622 - protein, 16 aa, Borrelia burgdorferi
NKNSSLYVDSKMILAA

SEQ ID NO: 102623 - protein, 16 aa, Borrelia burgdorferi
KNSSLYVDSKMILAAV

SEQ ID NO: 102624 - protein, 16 aa, Borrelia burgdorferi
NSSLYVDSKMILAAVR

SEQ ID NO: 102625 - protein, 16 aa, Borrelia burgdorferi
SSLYVDSKMILAAVRD

SEQ ID NO: 102626 - protein, 16 aa, Borrelia burgdorferi
SLYVDSKMILAAVRDK

SEQ ID NO: 102627 - protein, 16 aa, Borrelia burgdorferi
LYVDSKMILAAVRDKD

SEQ ID NO: 102628 - protein, 16 aa, Borrelia burgdorferi
YVDSKMILAAVRDKDD

SEQ ID NO: 102629 - protein, 16 aa, Borrelia burgdorferi
VDSKMILAAVRDKDDS

SEQ ID NO: 102630 - protein, 16 aa, Borrelia burgdorferi
DSKMILAAVRDKDDSN

SEQ ID NO: 102631 - protein, 16 aa, Borrelia burgdorferi
SKMILAAVRDKDDSNA

SEQ ID NO: 102632 - protein, 16 aa, Borrelia burgdorferi
KMILAAVRDKDDSNAW

SEQ ID NO: 102633 - protein, 16 aa, Borrelia burgdorferi
MILAAVRDKDDSNAWR

SEQ ID NO: 102634 - protein, 16 aa, Borrelia burgdorferi
ILAAVRDKDDSNAWRL

SEQ ID NO: 102635 - protein, 16 aa, Borrelia burgdorferi
LAAVRDKDDSNAWRLA

SEQ ID NO: 102636 - protein, 16 aa, Borrelia burgdorferi
AAVRDKDDSNAWRLAK

SEQ ID NO: 102637 - protein, 16 aa, Borrelia burgdorferi
AVRDKDDSNAWRLAKF

SEQ ID NO: 102638 - protein, 16 aa, Borrelia burgdorferi
VRDKDDSNAWRLAKFS

SEQ ID NO: 102639 - protein, 16 aa, Borrelia burgdorferi
RDKDDSNAWRLAKFSP

SEQ ID NO: 102640 - protein, 16 aa, Borrelia burgdorferi
DKDDSNAWRLAKFSPK

SEQ ID NO: 102641 - protein, 16 aa, Borrelia burgdorferi
KDDSNAWRLAKFSPKN

SEQ ID NO: 102642 - protein, 16 aa, Borrelia burgdorferi
DDSNAWRLAKFSPKNL

SEQ ID NO: 102643 - protein, 16 aa, Borrelia burgdorferi
DSNAWRLAKFSPKNLD

SEQ ID NO: 102644 - protein, 16 aa, Borrelia burgdorferi
SNAWRLAKFSPKNLDE

SEQ ID NO: 102645 - protein, 16 aa, Borrelia burgdorferi
NAWRLAKFSPKNLDEF

SEQ ID NO: 102646 - protein, 16 aa, Borrelia burgdorferi
AWRLAKFSPKNLDEFI

SEQ ID NO: 102647 - protein, 16 aa, Borrelia burgdorferi
WRLAKFSPKNLDEFIL

SEQ ID NO: 102648 - protein, 16 aa, Borrelia burgdorferi
RLAKFSPKNLDEFILS

SEQ ID NO: 102649 - protein, 16 aa, Borrelia burgdorferi
LAKFSPKNLDEFILSE

SEQ ID NO: 102650 - protein, 16 aa, Borrelia burgdorferi
AKFSPKNLDEFILSEN

SEQ ID NO: 102651 - protein, 16 aa, Borrelia burgdorferi
KFSPKNLDEFILSENK

SEQ ID NO: 102652 - protein, 16 aa, Borrelia burgdorferi
FSPKNLDEFILSENKI

SEQ ID NO: 102653 - protein, 16 aa, Borrelia burgdorferi
SPKNLDEFILSENKIL

SEQ ID NO: 102654 - protein, 16 aa, Borrelia burgdorferi
PKNLDEFILSENKILP

SEQ ID NO: 102655 - protein, 16 aa, Borrelia burgdorferi
KNLDEFILSENKILPF

SEQ ID NO: 102656 - protein, 16 aa, Borrelia burgdorferi
NLDEFILSENKILPFT

SEQ ID NO: 102657 - protein, 16 aa, Borrelia burgdorferi
LDEFILSENKILPFTS

SEQ ID NO: 102658 - protein, 16 aa, Borrelia burgdorferi
DEFILSENKILPFTSF

SEQ ID NO: 102659 - protein, 16 aa, Borrelia burgdorferi
EFILSENKILPFTSFS

SEQ ID NO: 102660 - protein, 16 aa, Borrelia burgdorferi
FILSENKILPFTSFSV

SEQ ID NO: 102661 - protein, 16 aa, Borrelia burgdorferi
ILSENKILPFTSFSVR

SEQ ID NO: 102662 - protein, 16 aa, Borrelia burgdorferi
LSENKILPFTSFSVRK

SEQ ID NO: 102663 - protein, 16 aa, Borrelia burgdorferi
SENKILPFTSFSVRKN

SEQ ID NO: 102664 - protein, 16 aa, Borrelia burgdorferi
ENKILPFTSFSVRKNF

SEQ ID NO: 102665 - protein, 16 aa, Borrelia burgdorferi
NKILPFTSFSVRKNFI

SEQ ID NO: 102666 - protein, 16 aa, Borrelia burgdorferi
KILPFTSFSVRKNFIY

SEQ ID NO: 102667 - protein, 16 aa, Borrelia burgdorferi
ILPFTSFSVRKNFIYL

SEQ ID NO: 102668 - protein, 16 aa, Borrelia burgdorferi
LPFTSFSVRKNFIYLQ

SEQ ID NO: 102669 - protein, 16 aa, Borrelia burgdorferi
PFTSFSVRKNFIYLQD

SEQ ID NO: 102670 - protein, 16 aa, Borrelia burgdorferi
FTSFSVRKNFIYLQDE

SEQ ID NO: 102671 - protein, 16 aa, Borrelia burgdorferi
TSFSVRKNFIYLQDEL

SEQ ID NO: 102672 - protein, 16 aa, Borrelia burgdorferi
SFSVRKNFIYLQDELK

SEQ ID NO: 102673 - protein, 16 aa, Borrelia burgdorferi
FSVRKNFIYLQDELKN

SEQ ID NO: 102674 - protein, 16 aa, Borrelia burgdorferi
SVRKNFIYLQDELKNL

SEQ ID NO: 102675 - protein, 16 aa, Borrelia burgdorferi
VRKNFIYLQDELKNLV

SEQ ID NO: 102676 - protein, 16 aa, Borrelia burgdorferi
RKNFIYLQDELKNLVI

SEQ ID NO: 102677 - protein, 16 aa, Borrelia burgdorferi
KNFIYLQDELKNLVIL

SEQ ID NO: 102678 - protein, 16 aa, Borrelia burgdorferi
NFIYLQDELKNLVILD

SEQ ID NO: 102679 - protein, 16 aa, Borrelia burgdorferi
FIYLQDELKNLVILDV

SEQ ID NO: 102680 - protein, 16 aa, Borrelia burgdorferi
IYLQDELKNLVILDVN

SEQ ID NO: 102681 - protein, 16 aa, Borrelia burgdorferi
YLQDELKNLVILDVNT

SEQ ID NO: 102682 - protein, 16 aa, Borrelia burgdorferi
LQDELKNLVILDVNTL

SEQ ID NO: 102683 - protein, 16 aa, Borrelia burgdorferi
QDELKNLVILDVNTLK

SEQ ID NO: 102684 - protein, 16 aa, Borrelia burgdorferi
DELKNLVILDVNTLKK

SEQ ID NO: 102685 - protein, 16 aa, Borrelia burgdorferi
ELKNLVILDVNTLKKV

SEQ ID NO: 102686 - protein, 16 aa, Borrelia burgdorferi
LKNLVILDVNTLKKVK

SEQ ID NO: 102687 - protein, 13 aa, Borrelia burgdorferi B31
MKYILSIDQGTTS

SEQ ID NO: 102688 - protein, 13 aa, Borrelia burgdorferi B31
KYILSIDQGTTSS

SEQ ID NO: 102689 - protein, 13 aa, Borrelia burgdorferi B31
YILSIDQGTTSSR

SEQ ID NO: 102690 - protein, 13 aa, Borrelia burgdorferi B31
ILSIDQGTTSSRA

SEQ ID NO: 102691 - protein, 13 aa, Borrelia burgdorferi B31
LSIDQGTTSSRAM

SEQ ID NO: 102692 - protein, 13 aa, Borrelia burgdorferi B31
SIDQGTTSSRAMV

SEQ ID NO: 102693 - protein, 13 aa, Borrelia burgdorferi B31
IDQGTTSSRAMVF

SEQ ID NO: 102694 - protein, 13 aa, Borrelia burgdorferi B31
DQGTTSSRAMVFD

SEQ ID NO: 102695 - protein, 13 aa, Borrelia burgdorferi B31
QGTTSSRAMVFDK

SEQ ID NO: 102696 - protein, 13 aa, Borrelia burgdorferi B31
GTTSSRAMVFDKN

SEQ ID NO: 102697 - protein, 13 aa, Borrelia burgdorferi B31
TTSSRAMVFDKNA

SEQ ID NO: 102698 - protein, 13 aa, Borrelia burgdorferi B31
TSSRAMVFDKNAN

SEQ ID NO: 102699 - protein, 13 aa, Borrelia burgdorferi B31
SSRAMVFDKNANI

SEQ ID NO: 102700 - protein, 13 aa, Borrelia burgdorferi B31
SRAMVFDKNANIK

SEQ ID NO: 102701 - protein, 13 aa, Borrelia burgdorferi B31
RAMVFDKNANIKG

SEQ ID NO: 102702 - protein, 13 aa, Borrelia burgdorferi B31
AMVFDKNANIKGF

SEQ ID NO: 102703 - protein, 13 aa, Borrelia burgdorferi B31
MVFDKNANIKGFA

SEQ ID NO: 102704 - protein, 13 aa, Borrelia burgdorferi B31
VFDKNANIKGFAQ

SEQ ID NO: 102705 - protein, 13 aa, Borrelia burgdorferi B31
FDKNANIKGFAQK

SEQ ID NO: 102706 - protein, 13 aa, Borrelia burgdorferi B31
DKNANIKGFAQKE

SEQ ID NO: 102707 - protein, 13 aa, Borrelia burgdorferi B31
KNANIKGFAQKEF

SEQ ID NO: 102708 - protein, 13 aa, Borrelia burgdorferi B31
NANIKGFAQKEFT

SEQ ID NO: 102709 - protein, 13 aa, Borrelia burgdorferi B31
ANIKGFAQKEFTQ

SEQ ID NO: 102710 - protein, 13 aa, Borrelia burgdorferi B31
NIKGFAQKEFTQI

SEQ ID NO: 102711 - protein, 13 aa, Borrelia burgdorferi B31
IKGFAQKEFTQIY

SEQ ID NO: 102712 - protein, 13 aa, Borrelia burgdorferi B31
KGFAQKEFTQIYP

SEQ ID NO: 102713 - protein, 13 aa, Borrelia burgdorferi B31
GFAQKEFTQIYPQ

SEQ ID NO: 102714 - protein, 13 aa, Borrelia burgdorferi B31
FAQKEFTQIYPQP

SEQ ID NO: 102715 - protein, 13 aa, Borrelia burgdorferi B31
AQKEFTQIYPQPS

SEQ ID NO: 102716 - protein, 13 aa, Borrelia burgdorferi B31
QKEFTQIYPQPSW

SEQ ID NO: 102717 - protein, 13 aa, Borrelia burgdorferi B31
KEFTQIYPQPSWV

SEQ ID NO: 102718 - protein, 13 aa, Borrelia burgdorferi B31
EFTQIYPQPSWVE

SEQ ID NO: 102719 - protein, 13 aa, Borrelia burgdorferi B31
FTQIYPQPSWVEH

SEQ ID NO: 102720 - protein, 13 aa, Borrelia burgdorferi B31
TQIYPQPSWVEHD

SEQ ID NO: 102721 - protein, 13 aa, Borrelia burgdorferi B31
QIYPQPSWVEHDP

SEQ ID NO: 102722 - protein, 13 aa, Borrelia burgdorferi B31
IYPQPSWVEHDPT

SEQ ID NO: 102723 - protein, 13 aa, Borrelia burgdorferi B31
YPQPSWVEHDPTE

SEQ ID NO: 102724 - protein, 13 aa, Borrelia burgdorferi B31
PQPSWVEHDPTEI

SEQ ID NO: 102725 - protein, 13 aa, Borrelia burgdorferi B31
QPSWVEHDPTEIW

SEQ ID NO: 102726 - protein, 13 aa, Borrelia burgdorferi B31
PSWVEHDPTEIWG

SEQ ID NO: 102727 - protein, 13 aa, Borrelia burgdorferi B31
SWVEHDPTEIWGS

SEQ ID NO: 102728 - protein, 13 aa, Borrelia burgdorferi B31
WVEHDPTEIWGSQ

SEQ ID NO: 102729 - protein, 13 aa, Borrelia burgdorferi B31
VEHDPTEIWGSQL

SEQ ID NO: 102730 - protein, 13 aa, Borrelia burgdorferi B31
EHDPTEIWGSQLG

SEQ ID NO: 102731 - protein, 13 aa, Borrelia burgdorferi B31
HDPTEIWGSQLGV

SEQ ID NO: 102732 - protein, 13 aa, Borrelia burgdorferi B31
DPTEIWGSQLGVI

SEQ ID NO: 102733 - protein, 13 aa, Borrelia burgdorferi B31
PTEIWGSQLGVIT

SEQ ID NO: 102734 - protein, 13 aa, Borrelia burgdorferi B31
TEIWGSQLGVITE

SEQ ID NO: 102735 - protein, 13 aa, Borrelia burgdorferi B31
EIWGSQLGVITEA

SEQ ID NO: 102736 - protein, 13 aa, Borrelia burgdorferi B31
IWGSQLGVITEAM

SEQ ID NO: 102737 - protein, 13 aa, Borrelia burgdorferi B31
WGSQLGVITEAMA

SEQ ID NO: 102738 - protein, 13 aa, Borrelia burgdorferi B31
GSQLGVITEAMAN

SEQ ID NO: 102739 - protein, 13 aa, Borrelia burgdorferi B31
SQLGVITEAMANA

SEQ ID NO: 102740 - protein, 13 aa, Borrelia burgdorferi B31
QLGVITEAMANAR

SEQ ID NO: 102741 - protein, 13 aa, Borrelia burgdorferi B31
LGVITEAMANARI

SEQ ID NO: 102742 - protein, 13 aa, Borrelia burgdorferi B31
GVITEAMANARIL

SEQ ID NO: 102743 - protein, 13 aa, Borrelia burgdorferi B31
VITEAMANARILP

SEQ ID NO: 102744 - protein, 13 aa, Borrelia burgdorferi B31
ITEAMANARILPN

SEQ ID NO: 102745 - protein, 13 aa, Borrelia burgdorferi B31
TEAMANARILPNE

SEQ ID NO: 102746 - protein, 13 aa, Borrelia burgdorferi B31
EAMANARILPNEI

SEQ ID NO: 102747 - protein, 13 aa, Borrelia burgdorferi B31
AMANARILPNEID

SEQ ID NO: 102748 - protein, 13 aa, Borrelia burgdorferi B31
MANARILPNEIDA

SEQ ID NO: 102749 - protein, 13 aa, Borrelia burgdorferi B31
ANARILPNEIDAI

SEQ ID NO: 102750 - protein, 13 aa, Borrelia burgdorferi B31
NARILPNEIDAIG

SEQ ID NO: 102751 - protein, 13 aa, Borrelia burgdorferi B31
ARILPNEIDAIGI

SEQ ID NO: 102752 - protein, 13 aa, Borrelia burgdorferi B31
RILPNEIDAIGIT

SEQ ID NO: 102753 - protein, 13 aa, Borrelia burgdorferi B31
ILPNEIDAIGITN

SEQ ID NO: 102754 - protein, 13 aa, Borrelia burgdorferi B31
LPNEIDAIGITNQ

SEQ ID NO: 102755 - protein, 13 aa, Borrelia burgdorferi B31
PNEIDAIGITNQR

SEQ ID NO: 102756 - protein, 13 aa, Borrelia burgdorferi B31
NEIDAIGITNQRE

SEQ ID NO: 102757 - protein, 13 aa, Borrelia burgdorferi B31
EIDAIGITNQRET

SEQ ID NO: 102758 - protein, 13 aa, Borrelia burgdorferi B31
IDAIGITNQRETT

SEQ ID NO: 102759 - protein, 13 aa, Borrelia burgdorferi B31
DAIGITNQRETTV

SEQ ID NO: 102760 - protein, 13 aa, Borrelia burgdorferi B31
AIGITNQRETTVI

SEQ ID NO: 102761 - protein, 13 aa, Borrelia burgdorferi B31
IGITNQRETTVIW

SEQ ID NO: 102762 - protein, 13 aa, Borrelia burgdorferi B31
GITNQRETTVIWE

SEQ ID NO: 102763 - protein, 13 aa, Borrelia burgdorferi B31
ITNQRETTVIWEK

SEQ ID NO: 102764 - protein, 13 aa, Borrelia burgdorferi B31
TNQRETTVIWEKN

SEQ ID NO: 102765 - protein, 13 aa, Borrelia burgdorferi B31
NQRETTVIWEKNT

SEQ ID NO: 102766 - protein, 13 aa, Borrelia burgdorferi B31
QRETTVIWEKNTG

SEQ ID NO: 102767 - protein, 13 aa, Borrelia burgdorferi B31
RETTVIWEKNTGK

SEQ ID NO: 102768 - protein, 13 aa, Borrelia burgdorferi B31
ETTVIWEKNTGKP

SEQ ID NO: 102769 - protein, 13 aa, Borrelia burgdorferi B31
TTVIWEKNTGKPI

SEQ ID NO: 102770 - protein, 13 aa, Borrelia burgdorferi B31
TVIWEKNTGKPIY

SEQ ID NO: 102771 - protein, 13 aa, Borrelia burgdorferi B31
VIWEKNTGKPIYN

SEQ ID NO: 102772 - protein, 13 aa, Borrelia burgdorferi B31
IWEKNTGKPIYNA

SEQ ID NO: 102773 - protein, 13 aa, Borrelia burgdorferi B31
WEKNTGKPIYNAI

SEQ ID NO: 102774 - protein, 13 aa, Borrelia burgdorferi B31
EKNTGKPIYNAIV

SEQ ID NO: 102775 - protein, 13 aa, Borrelia burgdorferi B31
KNTGKPIYNAIVW

SEQ ID NO: 102776 - protein, 13 aa, Borrelia burgdorferi B31
NTGKPIYNAIVWQ

SEQ ID NO: 102777 - protein, 13 aa, Borrelia burgdorferi B31
TGKPIYNAIVWQD

SEQ ID NO: 102778 - protein, 13 aa, Borrelia burgdorferi B31
GKPIYNAIVWQDR

SEQ ID NO: 102779 - protein, 13 aa, Borrelia burgdorferi B31
KPIYNAIVWQDRR

SEQ ID NO: 102780 - protein, 13 aa, Borrelia burgdorferi B31
PIYNAIVWQDRRT

SEQ ID NO: 102781 - protein, 13 aa, Borrelia burgdorferi B31
IYNAIVWQDRRTA

SEQ ID NO: 102782 - protein, 13 aa, Borrelia burgdorferi B31
YNAIVWQDRRTAK

SEQ ID NO: 102783 - protein, 13 aa, Borrelia burgdorferi B31
NAIVWQDRRTAKI

SEQ ID NO: 102784 - protein, 13 aa, Borrelia burgdorferi B31
AIVWQDRRTAKIC

SEQ ID NO: 102785 - protein, 13 aa, Borrelia burgdorferi B31
IVWQDRRTAKICD

SEQ ID NO: 102786 - protein, 13 aa, Borrelia burgdorferi B31
VWQDRRTAKICDQ

SEQ ID NO: 102787 - protein, 13 aa, Borrelia burgdorferi B31
WQDRRTAKICDQL

SEQ ID NO: 102788 - protein, 13 aa, Borrelia burgdorferi B31
QDRRTAKICDQLK

SEQ ID NO: 102789 - protein, 13 aa, Borrelia burgdorferi B31
DRRTAKICDQLKK

SEQ ID NO: 102790 - protein, 13 aa, Borrelia burgdorferi B31
RRTAKICDQLKKE

SEQ ID NO: 102791 - protein, 13 aa, Borrelia burgdorferi B31
RTAKICDQLKKEG

SEQ ID NO: 102792 - protein, 13 aa, Borrelia burgdorferi B31
TAKICDQLKKEGK

SEQ ID NO: 102793 - protein, 13 aa, Borrelia burgdorferi B31
AKICDQLKKEGKD

SEQ ID NO: 102794 - protein, 13 aa, Borrelia burgdorferi B31
KICDQLKKEGKDK

SEQ ID NO: 102795 - protein, 13 aa, Borrelia burgdorferi B31
ICDQLKKEGKDKI

SEQ ID NO: 102796 - protein, 13 aa, Borrelia burgdorferi B31
CDQLKKEGKDKII

SEQ ID NO: 102797 - protein, 13 aa, Borrelia burgdorferi B31
DQLKKEGKDKIIL

SEQ ID NO: 102798 - protein, 13 aa, Borrelia burgdorferi B31
QLKKEGKDKIILE

SEQ ID NO: 102799 - protein, 13 aa, Borrelia burgdorferi B31
LKKEGKDKIILEK

SEQ ID NO: 102800 - protein, 13 aa, Borrelia burgdorferi B31
KKEGKDKIILEKT

SEQ ID NO: 102801 - protein, 13 aa, Borrelia burgdorferi B31
KEGKDKIILEKTG

SEQ ID NO: 102802 - protein, 13 aa, Borrelia burgdorferi B31
EGKDKIILEKTGL

SEQ ID NO: 102803 - protein, 13 aa, Borrelia burgdorferi B31
GKDKIILEKTGLV

SEQ ID NO: 102804 - protein, 13 aa, Borrelia burgdorferi B31
KDKIILEKTGLVL

SEQ ID NO: 102805 - protein, 13 aa, Borrelia burgdorferi B31
DKIILEKTGLVLD

SEQ ID NO: 102806 - protein, 13 aa, Borrelia burgdorferi B31
KIILEKTGLVLDS

SEQ ID NO: 102807 - protein, 13 aa, Borrelia burgdorferi B31
IILEKTGLVLDSY

SEQ ID NO: 102808 - protein, 13 aa, Borrelia burgdorferi B31
ILEKTGLVLDSYF

SEQ ID NO: 102809 - protein, 13 aa, Borrelia burgdorferi B31
LEKTGLVLDSYFS

SEQ ID NO: 102810 - protein, 13 aa, Borrelia burgdorferi B31
EKTGLVLDSYFSG

SEQ ID NO: 102811 - protein, 13 aa, Borrelia burgdorferi B31
KTGLVLDSYFSGT

SEQ ID NO: 102812 - protein, 13 aa, Borrelia burgdorferi B31
TGLVLDSYFSGTK

SEQ ID NO: 102813 - protein, 13 aa, Borrelia burgdorferi B31
GLVLDSYFSGTKI

SEQ ID NO: 102814 - protein, 13 aa, Borrelia burgdorferi B31
LVLDSYFSGTKIM

SEQ ID NO: 102815 - protein, 13 aa, Borrelia burgdorferi B31
VLDSYFSGTKIMW

SEQ ID NO: 102816 - protein, 13 aa, Borrelia burgdorferi B31
LDSYFSGTKIMWI

SEQ ID NO: 102817 - protein, 13 aa, Borrelia burgdorferi B31
DSYFSGTKIMWIL

SEQ ID NO: 102818 - protein, 13 aa, Borrelia burgdorferi B31
SYFSGTKIMWILD

SEQ ID NO: 102819 - protein, 13 aa, Borrelia burgdorferi B31
YFSGTKIMWILDN

SEQ ID NO: 102820 - protein, 13 aa, Borrelia burgdorferi B31
FSGTKIMWILDNV

SEQ ID NO: 102821 - protein, 13 aa, Borrelia burgdorferi B31
SGTKIMWILDNVE

SEQ ID NO: 102822 - protein, 13 aa, Borrelia burgdorferi B31
GTKIMWILDNVEG

SEQ ID NO: 102823 - protein, 13 aa, Borrelia burgdorferi B31
TKIMWILDNVEGA

SEQ ID NO: 102824 - protein, 13 aa, Borrelia burgdorferi B31
KIMWILDNVEGAR

SEQ ID NO: 102825 - protein, 13 aa, Borrelia burgdorferi B31
IMWILDNVEGARQ

SEQ ID NO: 102826 - protein, 13 aa, Borrelia burgdorferi B31
MWILDNVEGARQR

SEQ ID NO: 102827 - protein, 13 aa, Borrelia burgdorferi B31
WILDNVEGARQRA

SEQ ID NO: 102828 - protein, 13 aa, Borrelia burgdorferi B31
ILDNVEGARQRAE

SEQ ID NO: 102829 - protein, 13 aa, Borrelia burgdorferi B31
LDNVEGARQRAEN

SEQ ID NO: 102830 - protein, 13 aa, Borrelia burgdorferi B31
DNVEGARQRAENG

SEQ ID NO: 102831 - protein, 13 aa, Borrelia burgdorferi B31
NVEGARQRAENGE

SEQ ID NO: 102832 - protein, 13 aa, Borrelia burgdorferi B31
VEGARQRAENGEL

SEQ ID NO: 102833 - protein, 13 aa, Borrelia burgdorferi B31
EGARQRAENGELC

SEQ ID NO: 102834 - protein, 13 aa, Borrelia burgdorferi B31
GARQRAENGELCF

SEQ ID NO: 102835 - protein, 13 aa, Borrelia burgdorferi B31
ARQRAENGELCFG

SEQ ID NO: 102836 - protein, 13 aa, Borrelia burgdorferi B31
RQRAENGELCFGT

SEQ ID NO: 102837 - protein, 13 aa, Borrelia burgdorferi B31
QRAENGELCFGTI

SEQ ID NO: 102838 - protein, 13 aa, Borrelia burgdorferi B31
RAENGELCFGTID

SEQ ID NO: 102839 - protein, 13 aa, Borrelia burgdorferi B31
AENGELCFGTIDT

SEQ ID NO: 102840 - protein, 13 aa, Borrelia burgdorferi B31
ENGELCFGTIDTW

SEQ ID NO: 102841 - protein, 13 aa, Borrelia burgdorferi B31
NGELCFGTIDTWI

SEQ ID NO: 102842 - protein, 13 aa, Borrelia burgdorferi B31
GELCFGTIDTWIL

SEQ ID NO: 102843 - protein, 13 aa, Borrelia burgdorferi B31
ELCFGTIDTWILW

SEQ ID NO: 102844 - protein, 13 aa, Borrelia burgdorferi B31
LCFGTIDTWILWN

SEQ ID NO: 102845 - protein, 13 aa, Borrelia burgdorferi B31
CFGTIDTWILWNL

SEQ ID NO: 102846 - protein, 13 aa, Borrelia burgdorferi B31
FGTIDTWILWNLT

SEQ ID NO: 102847 - protein, 13 aa, Borrelia burgdorferi B31
GTIDTWILWNLTQ

SEQ ID NO: 102848 - protein, 13 aa, Borrelia burgdorferi B31
TIDTWILWNLTQK

SEQ ID NO: 102849 - protein, 13 aa, Borrelia burgdorferi B31
IDTWILWNLTQKK

SEQ ID NO: 102850 - protein, 13 aa, Borrelia burgdorferi B31
DTWILWNLTQKKE

SEQ ID NO: 102851 - protein, 13 aa, Borrelia burgdorferi B31
TWILWNLTQKKEH

SEQ ID NO: 102852 - protein, 13 aa, Borrelia burgdorferi B31
WILWNLTQKKEHA

SEQ ID NO: 102853 - protein, 13 aa, Borrelia burgdorferi B31
ILWNLTQKKEHAT

SEQ ID NO: 102854 - protein, 13 aa, Borrelia burgdorferi B31
LWNLTQKKEHATD

SEQ ID NO: 102855 - protein, 13 aa, Borrelia burgdorferi B31
WNLTQKKEHATDY

SEQ ID NO: 102856 - protein, 13 aa, Borrelia burgdorferi B31
NLTQKKEHATDYS

SEQ ID NO: 102857 - protein, 13 aa, Borrelia burgdorferi B31
LTQKKEHATDYSN

SEQ ID NO: 102858 - protein, 13 aa, Borrelia burgdorferi B31
TQKKEHATDYSNA

SEQ ID NO: 102859 - protein, 13 aa, Borrelia burgdorferi B31
QKKEHATDYSNAS

SEQ ID NO: 102860 - protein, 13 aa, Borrelia burgdorferi B31
KKEHATDYSNASR

SEQ ID NO: 102861 - protein, 13 aa, Borrelia burgdorferi B31
KEHATDYSNASRT

SEQ ID NO: 102862 - protein, 13 aa, Borrelia burgdorferi B31
EHATDYSNASRTL

SEQ ID NO: 102863 - protein, 13 aa, Borrelia burgdorferi B31
HATDYSNASRTLL

SEQ ID NO: 102864 - protein, 13 aa, Borrelia burgdorferi B31
ATDYSNASRTLLL

SEQ ID NO: 102865 - protein, 13 aa, Borrelia burgdorferi B31
TDYSNASRTLLLN

SEQ ID NO: 102866 - protein, 13 aa, Borrelia burgdorferi B31
DYSNASRTLLLNI

SEQ ID NO: 102867 - protein, 13 aa, Borrelia burgdorferi B31
YSNASRTLLLNIK

SEQ ID NO: 102868 - protein, 13 aa, Borrelia burgdorferi B31
SNASRTLLLNIKT

SEQ ID NO: 102869 - protein, 13 aa, Borrelia burgdorferi B31
NASRTLLLNIKTL

SEQ ID NO: 102870 - protein, 13 aa, Borrelia burgdorferi B31
ASRTLLLNIKTLE

SEQ ID NO: 102871 - protein, 13 aa, Borrelia burgdorferi B31
SRTLLLNIKTLEW

SEQ ID NO: 102872 - protein, 13 aa, Borrelia burgdorferi B31
RTLLLNIKTLEWD

SEQ ID NO: 102873 - protein, 13 aa, Borrelia burgdorferi B31
TLLLNIKTLEWDD

SEQ ID NO: 102874 - protein, 13 aa, Borrelia burgdorferi B31
LLLNIKTLEWDDE

SEQ ID NO: 102875 - protein, 13 aa, Borrelia burgdorferi B31
LLNIKTLEWDDEL

SEQ ID NO: 102876 - protein, 13 aa, Borrelia burgdorferi B31
LNIKTLEWDDELL

SEQ ID NO: 102877 - protein, 13 aa, Borrelia burgdorferi B31
NIKTLEWDDELLS

SEQ ID NO: 102878 - protein, 13 aa, Borrelia burgdorferi B31
IKTLEWDDELLSI

SEQ ID NO: 102879 - protein, 13 aa, Borrelia burgdorferi B31
KTLEWDDELLSIL

SEQ ID NO: 102880 - protein, 13 aa, Borrelia burgdorferi B31
TLEWDDELLSILN

SEQ ID NO: 102881 - protein, 13 aa, Borrelia burgdorferi B31
LEWDDELLSILNV

SEQ ID NO: 102882 - protein, 13 aa, Borrelia burgdorferi B31
EWDDELLSILNVP

SEQ ID NO: 102883 - protein, 13 aa, Borrelia burgdorferi B31
WDDELLSILNVPR

SEQ ID NO: 102884 - protein, 13 aa, Borrelia burgdorferi B31
DDELLSILNVPRA

SEQ ID NO: 102885 - protein, 13 aa, Borrelia burgdorferi B31
DELLSILNVPRAI

SEQ ID NO: 102886 - protein, 13 aa, Borrelia burgdorferi B31
ELLSILNVPRAIL

SEQ ID NO: 102887 - protein, 13 aa, Borrelia burgdorferi B31
LLSILNVPRAILP

SEQ ID NO: 102888 - protein, 13 aa, Borrelia burgdorferi B31
LSILNVPRAILPE

SEQ ID NO: 102889 - protein, 13 aa, Borrelia burgdorferi B31
SILNVPRAILPEL

SEQ ID NO: 102890 - protein, 13 aa, Borrelia burgdorferi B31
ILNVPRAILPELK

SEQ ID NO: 102891 - protein, 13 aa, Borrelia burgdorferi B31
LNVPRAILPELKE

SEQ ID NO: 102892 - protein, 13 aa, Borrelia burgdorferi B31
NVPRAILPELKES

SEQ ID NO: 102893 - protein, 13 aa, Borrelia burgdorferi B31
VPRAILPELKESS

SEQ ID NO: 102894 - protein, 13 aa, Borrelia burgdorferi B31
PRAILPELKESST

SEQ ID NO: 102895 - protein, 13 aa, Borrelia burgdorferi B31
RAILPELKESSTI

SEQ ID NO: 102896 - protein, 13 aa, Borrelia burgdorferi B31
AILPELKESSTIY

SEQ ID NO: 102897 - protein, 13 aa, Borrelia burgdorferi B31
ILPELKESSTIYG

SEQ ID NO: 102898 - protein, 13 aa, Borrelia burgdorferi B31
LPELKESSTIYGK

SEQ ID NO: 102899 - protein, 13 aa, Borrelia burgdorferi B31
PELKESSTIYGKT

SEQ ID NO: 102900 - protein, 13 aa, Borrelia burgdorferi B31
ELKESSTIYGKTD

SEQ ID NO: 102901 - protein, 13 aa, Borrelia burgdorferi B31
LKESSTIYGKTDK

SEQ ID NO: 102902 - protein, 13 aa, Borrelia burgdorferi B31
KESSTIYGKTDKA

SEQ ID NO: 102903 - protein, 13 aa, Borrelia burgdorferi B31
ESSTIYGKTDKAL

SEQ ID NO: 102904 - protein, 13 aa, Borrelia burgdorferi B31
SSTIYGKTDKALF

SEQ ID NO: 102905 - protein, 13 aa, Borrelia burgdorferi B31
STIYGKTDKALFG

SEQ ID NO: 102906 - protein, 13 aa, Borrelia burgdorferi B31
TIYGKTDKALFGA

SEQ ID NO: 102907 - protein, 13 aa, Borrelia burgdorferi B31
IYGKTDKALFGAE

SEQ ID NO: 102908 - protein, 13 aa, Borrelia burgdorferi B31
YGKTDKALFGAEI

SEQ ID NO: 102909 - protein, 13 aa, Borrelia burgdorferi B31
GKTDKALFGAEIP

SEQ ID NO: 102910 - protein, 13 aa, Borrelia burgdorferi B31
KTDKALFGAEIPI

SEQ ID NO: 102911 - protein, 13 aa, Borrelia burgdorferi B31
TDKALFGAEIPIA

SEQ ID NO: 102912 - protein, 13 aa, Borrelia burgdorferi B31
DKALFGAEIPIAG

SEQ ID NO: 102913 - protein, 13 aa, Borrelia burgdorferi B31
KALFGAEIPIAGI

SEQ ID NO: 102914 - protein, 13 aa, Borrelia burgdorferi B31
ALFGAEIPIAGIA

SEQ ID NO: 102915 - protein, 13 aa, Borrelia burgdorferi B31
LFGAEIPIAGIAG

SEQ ID NO: 102916 - protein, 13 aa, Borrelia burgdorferi B31
FGAEIPIAGIAGD

SEQ ID NO: 102917 - protein, 13 aa, Borrelia burgdorferi B31
GAEIPIAGIAGDQ

SEQ ID NO: 102918 - protein, 13 aa, Borrelia burgdorferi B31
AEIPIAGIAGDQF

SEQ ID NO: 102919 - protein, 13 aa, Borrelia burgdorferi B31
EIPIAGIAGDQFA

SEQ ID NO: 102920 - protein, 13 aa, Borrelia burgdorferi B31
IPIAGIAGDQFAA

SEQ ID NO: 102921 - protein, 13 aa, Borrelia burgdorferi B31
PIAGIAGDQFAAT

SEQ ID NO: 102922 - protein, 13 aa, Borrelia burgdorferi B31
IAGIAGDQFAATF

SEQ ID NO: 102923 - protein, 13 aa, Borrelia burgdorferi B31
AGIAGDQFAATFG

SEQ ID NO: 102924 - protein, 13 aa, Borrelia burgdorferi B31
GIAGDQFAATFGQ

SEQ ID NO: 102925 - protein, 13 aa, Borrelia burgdorferi B31
IAGDQFAATFGQA

SEQ ID NO: 102926 - protein, 13 aa, Borrelia burgdorferi B31
AGDQFAATFGQAC

SEQ ID NO: 102927 - protein, 13 aa, Borrelia burgdorferi B31
GDQFAATFGQACL

SEQ ID NO: 102928 - protein, 13 aa, Borrelia burgdorferi B31
DQFAATFGQACLK

SEQ ID NO: 102929 - protein, 13 aa, Borrelia burgdorferi B31
QFAATFGQACLKK

SEQ ID NO: 102930 - protein, 13 aa, Borrelia burgdorferi B31
FAATFGQACLKKG

SEQ ID NO: 102931 - protein, 13 aa, Borrelia burgdorferi B31
AATFGQACLKKGM

SEQ ID NO: 102932 - protein, 13 aa, Borrelia burgdorferi B31
ATFGQACLKKGMA

SEQ ID NO: 102933 - protein, 13 aa, Borrelia burgdorferi B31
TFGQACLKKGMAK

SEQ ID NO: 102934 - protein, 13 aa, Borrelia burgdorferi B31
FGQACLKKGMAKN

SEQ ID NO: 102935 - protein, 13 aa, Borrelia burgdorferi B31
GQACLKKGMAKNT

SEQ ID NO: 102936 - protein, 13 aa, Borrelia burgdorferi B31
QACLKKGMAKNTY

SEQ ID NO: 102937 - protein, 13 aa, Borrelia burgdorferi B31
ACLKKGMAKNTYG

SEQ ID NO: 102938 - protein, 13 aa, Borrelia burgdorferi B31
CLKKGMAKNTYGT

SEQ ID NO: 102939 - protein, 13 aa, Borrelia burgdorferi B31
LKKGMAKNTYGTG

SEQ ID NO: 102940 - protein, 13 aa, Borrelia burgdorferi B31
KKGMAKNTYGTGC

SEQ ID NO: 102941 - protein, 13 aa, Borrelia burgdorferi B31
KGMAKNTYGTGCF

SEQ ID NO: 102942 - protein, 13 aa, Borrelia burgdorferi B31
GMAKNTYGTGCFL

SEQ ID NO: 102943 - protein, 13 aa, Borrelia burgdorferi B31
MAKNTYGTGCFLT

SEQ ID NO: 102944 - protein, 13 aa, Borrelia burgdorferi B31
AKNTYGTGCFLTV

SEQ ID NO: 102945 - protein, 13 aa, Borrelia burgdorferi B31
KNTYGTGCFLTVN

SEQ ID NO: 102946 - protein, 13 aa, Borrelia burgdorferi B31
NTYGTGCFLTVNI

SEQ ID NO: 102947 - protein, 13 aa, Borrelia burgdorferi B31
TYGTGCFLTVNIG

SEQ ID NO: 102948 - protein, 13 aa, Borrelia burgdorferi B31
YGTGCFLTVNIGK

SEQ ID NO: 102949 - protein, 13 aa, Borrelia burgdorferi B31
GTGCFLTVNIGKE

SEQ ID NO: 102950 - protein, 13 aa, Borrelia burgdorferi B31
TGCFLTVNIGKEP

SEQ ID NO: 102951 - protein, 13 aa, Borrelia burgdorferi B31
GCFLTVNIGKEPI

SEQ ID NO: 102952 - protein, 13 aa, Borrelia burgdorferi B31
CFLTVNIGKEPII

SEQ ID NO: 102953 - protein, 13 aa, Borrelia burgdorferi B31
FLTVNIGKEPIIS

SEQ ID NO: 102954 - protein, 13 aa, Borrelia burgdorferi B31
LTVNIGKEPIISH

SEQ ID NO: 102955 - protein, 13 aa, Borrelia burgdorferi B31
TVNIGKEPIISHD

SEQ ID NO: 102956 - protein, 13 aa, Borrelia burgdorferi B31
VNIGKEPIISHDK

SEQ ID NO: 102957 - protein, 13 aa, Borrelia burgdorferi B31
NIGKEPIISHDKL

SEQ ID NO: 102958 - protein, 13 aa, Borrelia burgdorferi B31
IGKEPIISHDKLL

SEQ ID NO: 102959 - protein, 13 aa, Borrelia burgdorferi B31
GKEPIISHDKLLT

SEQ ID NO: 102960 - protein, 13 aa, Borrelia burgdorferi B31
KEPIISHDKLLTS

SEQ ID NO: 102961 - protein, 13 aa, Borrelia burgdorferi B31
EPIISHDKLLTSI

SEQ ID NO: 102962 - protein, 13 aa, Borrelia burgdorferi B31
PIISHDKLLTSIA

SEQ ID NO: 102963 - protein, 13 aa, Borrelia burgdorferi B31
IISHDKLLTSIAW

SEQ ID NO: 102964 - protein, 13 aa, Borrelia burgdorferi B31
ISHDKLLTSIAWG

SEQ ID NO: 102965 - protein, 13 aa, Borrelia burgdorferi B31
SHDKLLTSIAWGR

SEQ ID NO: 102966 - protein, 13 aa, Borrelia burgdorferi B31
HDKLLTSIAWGRK

SEQ ID NO: 102967 - protein, 13 aa, Borrelia burgdorferi B31
DKLLTSIAWGRKK

SEQ ID NO: 102968 - protein, 13 aa, Borrelia burgdorferi B31
KLLTSIAWGRKKS

SEQ ID NO: 102969 - protein, 13 aa, Borrelia burgdorferi B31
LLTSIAWGRKKSV

SEQ ID NO: 102970 - protein, 13 aa, Borrelia burgdorferi B31
LTSIAWGRKKSVT

SEQ ID NO: 102971 - protein, 13 aa, Borrelia burgdorferi B31
TSIAWGRKKSVTY

SEQ ID NO: 102972 - protein, 13 aa, Borrelia burgdorferi B31
SIAWGRKKSVTYV

SEQ ID NO: 102973 - protein, 13 aa, Borrelia burgdorferi B31
IAWGRKKSVTYVL

SEQ ID NO: 102974 - protein, 13 aa, Borrelia burgdorferi B31
AWGRKKSVTYVLE

SEQ ID NO: 102975 - protein, 13 aa, Borrelia burgdorferi B31
WGRKKSVTYVLEG

SEQ ID NO: 102976 - protein, 13 aa, Borrelia burgdorferi B31
GRKKSVTYVLEGS

SEQ ID NO: 102977 - protein, 13 aa, Borrelia burgdorferi B31
RKKSVTYVLEGSV

SEQ ID NO: 102978 - protein, 13 aa, Borrelia burgdorferi B31
KKSVTYVLEGSVF

SEQ ID NO: 102979 - protein, 13 aa, Borrelia burgdorferi B31
KSVTYVLEGSVFI

SEQ ID NO: 102980 - protein, 13 aa, Borrelia burgdorferi B31
SVTYVLEGSVFIG

SEQ ID NO: 102981 - protein, 13 aa, Borrelia burgdorferi B31
VTYVLEGSVFIGG

SEQ ID NO: 102982 - protein, 13 aa, Borrelia burgdorferi B31
TYVLEGSVFIGGA

SEQ ID NO: 102983 - protein, 13 aa, Borrelia burgdorferi B31
YVLEGSVFIGGAV

SEQ ID NO: 102984 - protein, 13 aa, Borrelia burgdorferi B31
VLEGSVFIGGAVI

SEQ ID NO: 102985 - protein, 13 aa, Borrelia burgdorferi B31
LEGSVFIGGAVIQ

SEQ ID NO: 102986 - protein, 13 aa, Borrelia burgdorferi B31
EGSVFIGGAVIQW

SEQ ID NO: 102987 - protein, 13 aa, Borrelia burgdorferi B31
GSVFIGGAVIQWL

SEQ ID NO: 102988 - protein, 13 aa, Borrelia burgdorferi B31
SVFIGGAVIQWLR

SEQ ID NO: 102989 - protein, 13 aa, Borrelia burgdorferi B31
VFIGGAVIQWLRD

SEQ ID NO: 102990 - protein, 13 aa, Borrelia burgdorferi B31
FIGGAVIQWLRDG

SEQ ID NO: 102991 - protein, 13 aa, Borrelia burgdorferi B31
IGGAVIQWLRDGL

SEQ ID NO: 102992 - protein, 13 aa, Borrelia burgdorferi B31
GGAVIQWLRDGLE

SEQ ID NO: 102993 - protein, 13 aa, Borrelia burgdorferi B31
GAVIQWLRDGLEF

SEQ ID NO: 102994 - protein, 13 aa, Borrelia burgdorferi B31
AVIQWLRDGLEFF

SEQ ID NO: 102995 - protein, 13 aa, Borrelia burgdorferi B31
VIQWLRDGLEFFR

SEQ ID NO: 102996 - protein, 13 aa, Borrelia burgdorferi B31
IQWLRDGLEFFRK

SEQ ID NO: 102997 - protein, 13 aa, Borrelia burgdorferi B31
QWLRDGLEFFRKS

SEQ ID NO: 102998 - protein, 13 aa, Borrelia burgdorferi B31
WLRDGLEFFRKSS

SEQ ID NO: 102999 - protein, 13 aa, Borrelia burgdorferi B31
LRDGLEFFRKSSD

SEQ ID NO: 103000 - protein, 13 aa, Borrelia burgdorferi B31
RDGLEFFRKSSDA

SEQ ID NO: 103001 - protein, 13 aa, Borrelia burgdorferi B31
DGLEFFRKSSDAE

SEQ ID NO: 103002 - protein, 13 aa, Borrelia burgdorferi B31
GLEFFRKSSDAEA

SEQ ID NO: 103003 - protein, 13 aa, Borrelia burgdorferi B31
LEFFRKSSDAEAL

SEQ ID NO: 103004 - protein, 13 aa, Borrelia burgdorferi B31
EFFRKSSDAEALA

SEQ ID NO: 103005 - protein, 13 aa, Borrelia burgdorferi B31
FFRKSSDAEALAS

SEQ ID NO: 103006 - protein, 13 aa, Borrelia burgdorferi B31
FRKSSDAEALASS

SEQ ID NO: 103007 - protein, 13 aa, Borrelia burgdorferi B31
RKSSDAEALASSV

SEQ ID NO: 103008 - protein, 13 aa, Borrelia burgdorferi B31
KSSDAEALASSVS

SEQ ID NO: 103009 - protein, 13 aa, Borrelia burgdorferi B31
SSDAEALASSVSD

SEQ ID NO: 103010 - protein, 13 aa, Borrelia burgdorferi B31
SDAEALASSVSDN

SEQ ID NO: 103011 - protein, 13 aa, Borrelia burgdorferi B31
DAEALASSVSDNG

SEQ ID NO: 103012 - protein, 13 aa, Borrelia burgdorferi B31
AEALASSVSDNGG

SEQ ID NO: 103013 - protein, 13 aa, Borrelia burgdorferi B31
EALASSVSDNGGV

SEQ ID NO: 103014 - protein, 13 aa, Borrelia burgdorferi B31
ALASSVSDNGGVY

SEQ ID NO: 103015 - protein, 13 aa, Borrelia burgdorferi B31
LASSVSDNGGVYF

SEQ ID NO: 103016 - protein, 13 aa, Borrelia burgdorferi B31
ASSVSDNGGVYFV

SEQ ID NO: 103017 - protein, 13 aa, Borrelia burgdorferi B31
SSVSDNGGVYFVP

SEQ ID NO: 103018 - protein, 13 aa, Borrelia burgdorferi B31
SVSDNGGVYFVPA

SEQ ID NO: 103019 - protein, 13 aa, Borrelia burgdorferi B31
VSDNGGVYFVPAF

SEQ ID NO: 103020 - protein, 13 aa, Borrelia burgdorferi B31
SDNGGVYFVPAFV

SEQ ID NO: 103021 - protein, 13 aa, Borrelia burgdorferi B31
DNGGVYFVPAFVG

SEQ ID NO: 103022 - protein, 13 aa, Borrelia burgdorferi B31
NGGVYFVPAFVGL

SEQ ID NO: 103023 - protein, 13 aa, Borrelia burgdorferi B31
GGVYFVPAFVGLG

SEQ ID NO: 103024 - protein, 13 aa, Borrelia burgdorferi B31
GVYFVPAFVGLGA

SEQ ID NO: 103025 - protein, 13 aa, Borrelia burgdorferi B31
VYFVPAFVGLGAP

SEQ ID NO: 103026 - protein, 13 aa, Borrelia burgdorferi B31
YFVPAFVGLGAPH

SEQ ID NO: 103027 - protein, 13 aa, Borrelia burgdorferi B31
FVPAFVGLGAPHW

SEQ ID NO: 103028 - protein, 13 aa, Borrelia burgdorferi B31
VPAFVGLGAPHWD

SEQ ID NO: 103029 - protein, 13 aa, Borrelia burgdorferi B31
PAFVGLGAPHWDS

SEQ ID NO: 103030 - protein, 13 aa, Borrelia burgdorferi B31
AFVGLGAPHWDSY

SEQ ID NO: 103031 - protein, 13 aa, Borrelia burgdorferi B31
FVGLGAPHWDSYA

SEQ ID NO: 103032 - protein, 13 aa, Borrelia burgdorferi B31
VGLGAPHWDSYAR

SEQ ID NO: 103033 - protein, 13 aa, Borrelia burgdorferi B31
GLGAPHWDSYARG

SEQ ID NO: 103034 - protein, 13 aa, Borrelia burgdorferi B31
LGAPHWDSYARGT

SEQ ID NO: 103035 - protein, 13 aa, Borrelia burgdorferi B31
GAPHWDSYARGTI

SEQ ID NO: 103036 - protein, 13 aa, Borrelia burgdorferi B31
APHWDSYARGTII

SEQ ID NO: 103037 - protein, 13 aa, Borrelia burgdorferi B31
PHWDSYARGTIIG

SEQ ID NO: 103038 - protein, 13 aa, Borrelia burgdorferi B31
HWDSYARGTIIGI

SEQ ID NO: 103039 - protein, 13 aa, Borrelia burgdorferi B31
WDSYARGTIIGIT

SEQ ID NO: 103040 - protein, 13 aa, Borrelia burgdorferi B31
DSYARGTIIGITR

SEQ ID NO: 103041 - protein, 13 aa, Borrelia burgdorferi B31
SYARGTIIGITRG

SEQ ID NO: 103042 - protein, 13 aa, Borrelia burgdorferi B31
YARGTIIGITRGS

SEQ ID NO: 103043 - protein, 13 aa, Borrelia burgdorferi B31
ARGTIIGITRGST

SEQ ID NO: 103044 - protein, 13 aa, Borrelia burgdorferi B31
RGTIIGITRGSTK

SEQ ID NO: 103045 - protein, 13 aa, Borrelia burgdorferi B31
GTIIGITRGSTKA

SEQ ID NO: 103046 - protein, 13 aa, Borrelia burgdorferi B31
TIIGITRGSTKAH

SEQ ID NO: 103047 - protein, 13 aa, Borrelia burgdorferi B31
IIGITRGSTKAHI

SEQ ID NO: 103048 - protein, 13 aa, Borrelia burgdorferi B31
IGITRGSTKAHIT

SEQ ID NO: 103049 - protein, 13 aa, Borrelia burgdorferi B31
GITRGSTKAHITR

SEQ ID NO: 103050 - protein, 13 aa, Borrelia burgdorferi B31
ITRGSTKAHITRA

SEQ ID NO: 103051 - protein, 13 aa, Borrelia burgdorferi B31
TRGSTKAHITRAA

SEQ ID NO: 103052 - protein, 13 aa, Borrelia burgdorferi B31
RGSTKAHITRAAL

SEQ ID NO: 103053 - protein, 13 aa, Borrelia burgdorferi B31
GSTKAHITRAALE

SEQ ID NO: 103054 - protein, 13 aa, Borrelia burgdorferi B31
STKAHITRAALES

SEQ ID NO: 103055 - protein, 13 aa, Borrelia burgdorferi B31
TKAHITRAALESI

SEQ ID NO: 103056 - protein, 13 aa, Borrelia burgdorferi B31
KAHITRAALESIA

SEQ ID NO: 103057 - protein, 13 aa, Borrelia burgdorferi B31
AHITRAALESIAF

SEQ ID NO: 103058 - protein, 13 aa, Borrelia burgdorferi B31
HITRAALESIAFQ

SEQ ID NO: 103059 - protein, 13 aa, Borrelia burgdorferi B31
ITRAALESIAFQS

SEQ ID NO: 103060 - protein, 13 aa, Borrelia burgdorferi B31
TRAALESIAFQSF

SEQ ID NO: 103061 - protein, 13 aa, Borrelia burgdorferi B31
RAALESIAFQSFD

SEQ ID NO: 103062 - protein, 13 aa, Borrelia burgdorferi B31
AALESIAFQSFDI

SEQ ID NO: 103063 - protein, 13 aa, Borrelia burgdorferi B31
ALESIAFQSFDIL

SEQ ID NO: 103064 - protein, 13 aa, Borrelia burgdorferi B31
LESIAFQSFDILN

SEQ ID NO: 103065 - protein, 13 aa, Borrelia burgdorferi B31
ESIAFQSFDILNT

SEQ ID NO: 103066 - protein, 13 aa, Borrelia burgdorferi B31
SIAFQSFDILNTM

SEQ ID NO: 103067 - protein, 13 aa, Borrelia burgdorferi B31
IAFQSFDILNTMK

SEQ ID NO: 103068 - protein, 13 aa, Borrelia burgdorferi B31
AFQSFDILNTMKK

SEQ ID NO: 103069 - protein, 13 aa, Borrelia burgdorferi B31
FQSFDILNTMKKS

SEQ ID NO: 103070 - protein, 13 aa, Borrelia burgdorferi B31
QSFDILNTMKKSI

SEQ ID NO: 103071 - protein, 13 aa, Borrelia burgdorferi B31
SFDILNTMKKSIP

SEQ ID NO: 103072 - protein, 13 aa, Borrelia burgdorferi B31
FDILNTMKKSIPN

SEQ ID NO: 103073 - protein, 13 aa, Borrelia burgdorferi B31
DILNTMKKSIPNF

SEQ ID NO: 103074 - protein, 13 aa, Borrelia burgdorferi B31
ILNTMKKSIPNFE

SEQ ID NO: 103075 - protein, 13 aa, Borrelia burgdorferi B31
LNTMKKSIPNFEI

SEQ ID NO: 103076 - protein, 13 aa, Borrelia burgdorferi B31
NTMKKSIPNFEIQ

SEQ ID NO: 103077 - protein, 13 aa, Borrelia burgdorferi B31
TMKKSIPNFEIQE

SEQ ID NO: 103078 - protein, 13 aa, Borrelia burgdorferi B31
MKKSIPNFEIQEL

SEQ ID NO: 103079 - protein, 13 aa, Borrelia burgdorferi B31
KKSIPNFEIQELR

SEQ ID NO: 103080 - protein, 13 aa, Borrelia burgdorferi B31
KSIPNFEIQELRV

SEQ ID NO: 103081 - protein, 13 aa, Borrelia burgdorferi B31
SIPNFEIQELRVD

SEQ ID NO: 103082 - protein, 13 aa, Borrelia burgdorferi B31
IPNFEIQELRVDG

SEQ ID NO: 103083 - protein, 13 aa, Borrelia burgdorferi B31
PNFEIQELRVDGG

SEQ ID NO: 103084 - protein, 13 aa, Borrelia burgdorferi B31
NFEIQELRVDGGA

SEQ ID NO: 103085 - protein, 13 aa, Borrelia burgdorferi B31
FEIQELRVDGGAS

SEQ ID NO: 103086 - protein, 13 aa, Borrelia burgdorferi B31
EIQELRVDGGASQ

SEQ ID NO: 103087 - protein, 13 aa, Borrelia burgdorferi B31
IQELRVDGGASQN

SEQ ID NO: 103088 - protein, 13 aa, Borrelia burgdorferi B31
QELRVDGGASQNN

SEQ ID NO: 103089 - protein, 13 aa, Borrelia burgdorferi B31
ELRVDGGASQNNL

SEQ ID NO: 103090 - protein, 13 aa, Borrelia burgdorferi B31
LRVDGGASQNNLL

SEQ ID NO: 103091 - protein, 13 aa, Borrelia burgdorferi B31
RVDGGASQNNLLM

SEQ ID NO: 103092 - protein, 13 aa, Borrelia burgdorferi B31
VDGGASQNNLLMQ

SEQ ID NO: 103093 - protein, 13 aa, Borrelia burgdorferi B31
DGGASQNNLLMQF

SEQ ID NO: 103094 - protein, 13 aa, Borrelia burgdorferi B31
GGASQNNLLMQFQ

SEQ ID NO: 103095 - protein, 13 aa, Borrelia burgdorferi B31
GASQNNLLMQFQA

SEQ ID NO: 103096 - protein, 13 aa, Borrelia burgdorferi B31
ASQNNLLMQFQAD

SEQ ID NO: 103097 - protein, 13 aa, Borrelia burgdorferi B31
SQNNLLMQFQADL

SEQ ID NO: 103098 - protein, 13 aa, Borrelia burgdorferi B31
QNNLLMQFQADLL

SEQ ID NO: 103099 - protein, 13 aa, Borrelia burgdorferi B31
NNLLMQFQADLLE

SEQ ID NO: 103100 - protein, 13 aa, Borrelia burgdorferi B31
NLLMQFQADLLEC

SEQ ID NO: 103101 - protein, 13 aa, Borrelia burgdorferi B31
LLMQFQADLLECK

SEQ ID NO: 103102 - protein, 13 aa, Borrelia burgdorferi B31
LMQFQADLLECKV

SEQ ID NO: 103103 - protein, 13 aa, Borrelia burgdorferi B31
MQFQADLLECKVV

SEQ ID NO: 103104 - protein, 13 aa, Borrelia burgdorferi B31
QFQADLLECKVVR

SEQ ID NO: 103105 - protein, 13 aa, Borrelia burgdorferi B31
FQADLLECKVVRP

SEQ ID NO: 103106 - protein, 13 aa, Borrelia burgdorferi B31
QADLLECKVVRPK

SEQ ID NO: 103107 - protein, 13 aa, Borrelia burgdorferi B31
ADLLECKVVRPKI

SEQ ID NO: 103108 - protein, 13 aa, Borrelia burgdorferi B31
DLLECKVVRPKIT

SEQ ID NO: 103109 - protein, 13 aa, Borrelia burgdorferi B31
LLECKVVRPKITE

SEQ ID NO: 103110 - protein, 13 aa, Borrelia burgdorferi B31
LECKVVRPKITET

SEQ ID NO: 103111 - protein, 13 aa, Borrelia burgdorferi B31
ECKVVRPKITETT

SEQ ID NO: 103112 - protein, 13 aa, Borrelia burgdorferi B31
CKVVRPKITETTA

SEQ ID NO: 103113 - protein, 13 aa, Borrelia burgdorferi B31
KVVRPKITETTAL

SEQ ID NO: 103114 - protein, 13 aa, Borrelia burgdorferi B31
VVRPKITETTALG

SEQ ID NO: 103115 - protein, 13 aa, Borrelia burgdorferi B31
VRPKITETTALGA

SEQ ID NO: 103116 - protein, 13 aa, Borrelia burgdorferi B31
RPKITETTALGAA

SEQ ID NO: 103117 - protein, 13 aa, Borrelia burgdorferi B31
PKITETTALGAAY

SEQ ID NO: 103118 - protein, 13 aa, Borrelia burgdorferi B31
KITETTALGAAYL

SEQ ID NO: 103119 - protein, 13 aa, Borrelia burgdorferi B31
ITETTALGAAYLA

SEQ ID NO: 103120 - protein, 13 aa, Borrelia burgdorferi B31
TETTALGAAYLAG

SEQ ID NO: 103121 - protein, 13 aa, Borrelia burgdorferi B31
ETTALGAAYLAGL

SEQ ID NO: 103122 - protein, 13 aa, Borrelia burgdorferi B31
TTALGAAYLAGLA

SEQ ID NO: 103123 - protein, 13 aa, Borrelia burgdorferi B31
TALGAAYLAGLAT

SEQ ID NO: 103124 - protein, 13 aa, Borrelia burgdorferi B31
ALGAAYLAGLATG

SEQ ID NO: 103125 - protein, 13 aa, Borrelia burgdorferi B31
LGAAYLAGLATGY

SEQ ID NO: 103126 - protein, 13 aa, Borrelia burgdorferi B31
GAAYLAGLATGYW

SEQ ID NO: 103127 - protein, 13 aa, Borrelia burgdorferi B31
AAYLAGLATGYWQ

SEQ ID NO: 103128 - protein, 13 aa, Borrelia burgdorferi B31
AYLAGLATGYWQS

SEQ ID NO: 103129 - protein, 13 aa, Borrelia burgdorferi B31
YLAGLATGYWQSA

SEQ ID NO: 103130 - protein, 13 aa, Borrelia burgdorferi B31
LAGLATGYWQSAE

SEQ ID NO: 103131 - protein, 13 aa, Borrelia burgdorferi B31
AGLATGYWQSAEE

SEQ ID NO: 103132 - protein, 13 aa, Borrelia burgdorferi B31
GLATGYWQSAEEI

SEQ ID NO: 103133 - protein, 13 aa, Borrelia burgdorferi B31
LATGYWQSAEEIV

SEQ ID NO: 103134 - protein, 13 aa, Borrelia burgdorferi B31
ATGYWQSAEEIVS

SEQ ID NO: 103135 - protein, 13 aa, Borrelia burgdorferi B31
TGYWQSAEEIVSL

SEQ ID NO: 103136 - protein, 13 aa, Borrelia burgdorferi B31
GYWQSAEEIVSLW

SEQ ID NO: 103137 - protein, 13 aa, Borrelia burgdorferi B31
YWQSAEEIVSLWQ

SEQ ID NO: 103138 - protein, 13 aa, Borrelia burgdorferi B31
WQSAEEIVSLWQV

SEQ ID NO: 103139 - protein, 13 aa, Borrelia burgdorferi B31
QSAEEIVSLWQVD

SEQ ID NO: 103140 - protein, 13 aa, Borrelia burgdorferi B31
SAEEIVSLWQVDK

SEQ ID NO: 103141 - protein, 13 aa, Borrelia burgdorferi B31
AEEIVSLWQVDKI

SEQ ID NO: 103142 - protein, 13 aa, Borrelia burgdorferi B31
EEIVSLWQVDKIF

SEQ ID NO: 103143 - protein, 13 aa, Borrelia burgdorferi B31
EIVSLWQVDKIFE

SEQ ID NO: 103144 - protein, 13 aa, Borrelia burgdorferi B31
IVSLWQVDKIFEP

SEQ ID NO: 103145 - protein, 13 aa, Borrelia burgdorferi B31
VSLWQVDKIFEPS

SEQ ID NO: 103146 - protein, 13 aa, Borrelia burgdorferi B31
SLWQVDKIFEPSM

SEQ ID NO: 103147 - protein, 13 aa, Borrelia burgdorferi B31
LWQVDKIFEPSMP

SEQ ID NO: 103148 - protein, 13 aa, Borrelia burgdorferi B31
WQVDKIFEPSMPK

SEQ ID NO: 103149 - protein, 13 aa, Borrelia burgdorferi B31
QVDKIFEPSMPKN

SEQ ID NO: 103150 - protein, 13 aa, Borrelia burgdorferi B31
VDKIFEPSMPKNQ

SEQ ID NO: 103151 - protein, 13 aa, Borrelia burgdorferi B31
DKIFEPSMPKNQK

SEQ ID NO: 103152 - protein, 13 aa, Borrelia burgdorferi B31
KIFEPSMPKNQKE

SEQ ID NO: 103153 - protein, 13 aa, Borrelia burgdorferi B31
IFEPSMPKNQKEK

SEQ ID NO: 103154 - protein, 13 aa, Borrelia burgdorferi B31
FEPSMPKNQKEKL

SEQ ID NO: 103155 - protein, 13 aa, Borrelia burgdorferi B31
EPSMPKNQKEKLL

SEQ ID NO: 103156 - protein, 13 aa, Borrelia burgdorferi B31
PSMPKNQKEKLLE

SEQ ID NO: 103157 - protein, 13 aa, Borrelia burgdorferi B31
SMPKNQKEKLLEN

SEQ ID NO: 103158 - protein, 13 aa, Borrelia burgdorferi B31
MPKNQKEKLLENW

SEQ ID NO: 103159 - protein, 13 aa, Borrelia burgdorferi B31
PKNQKEKLLENWN

SEQ ID NO: 103160 - protein, 13 aa, Borrelia burgdorferi B31
KNQKEKLLENWNK

SEQ ID NO: 103161 - protein, 13 aa, Borrelia burgdorferi B31
NQKEKLLENWNKA

SEQ ID NO: 103162 - protein, 13 aa, Borrelia burgdorferi B31
QKEKLLENWNKAV

SEQ ID NO: 103163 - protein, 13 aa, Borrelia burgdorferi B31
KEKLLENWNKAVG

SEQ ID NO: 103164 - protein, 13 aa, Borrelia burgdorferi B31
EKLLENWNKAVGK

SEQ ID NO: 103165 - protein, 13 aa, Borrelia burgdorferi B31
KLLENWNKAVGKA

SEQ ID NO: 103166 - protein, 13 aa, Borrelia burgdorferi B31
LLENWNKAVGKAK

SEQ ID NO: 103167 - protein, 13 aa, Borrelia burgdorferi B31
LENWNKAVGKAKS

SEQ ID NO: 103168 - protein, 13 aa, Borrelia burgdorferi B31
ENWNKAVGKAKSW

SEQ ID NO: 103169 - protein, 13 aa, Borrelia burgdorferi B31
NWNKAVGKAKSWI

SEQ ID NO: 103170 - protein, 13 aa, Borrelia burgdorferi B31
WNKAVGKAKSWIQ

SEQ ID NO: 103171 - protein, 13 aa, Borrelia burgdorferi B31
NKAVGKAKSWIQN

SEQ ID NO: 103172 - protein, 13 aa, Borrelia burgdorferi B31
KAVGKAKSWIQNS

SEQ ID NO: 103173 - protein, 13 aa, Borrelia burgdorferi B31
AVGKAKSWIQNSH

SEQ ID NO: 103174 - protein, 13 aa, Borrelia burgdorferi B31
VGKAKSWIQNSHS

SEQ ID NO: 103175 - protein, 13 aa, Borrelia burgdorferi B31
GKAKSWIQNSHSS

SEQ ID NO: 103176 - protein, 14 aa, Borrelia burgdorferi B31
MKYILSIDQGTTSS

SEQ ID NO: 103177 - protein, 14 aa, Borrelia burgdorferi B31
KYILSIDQGTTSSR

SEQ ID NO: 103178 - protein, 14 aa, Borrelia burgdorferi B31
YILSIDQGTTSSRA

SEQ ID NO: 103179 - protein, 14 aa, Borrelia burgdorferi B31
ILSIDQGTTSSRAM

SEQ ID NO: 103180 - protein, 14 aa, Borrelia burgdorferi B31
LSIDQGTTSSRAMV

SEQ ID NO: 103181 - protein, 14 aa, Borrelia burgdorferi B31
SIDQGTTSSRAMVF

SEQ ID NO: 103182 - protein, 14 aa, Borrelia burgdorferi B31
IDQGTTSSRAMVFD

SEQ ID NO: 103183 - protein, 14 aa, Borrelia burgdorferi B31
DQGTTSSRAMVFDK

SEQ ID NO: 103184 - protein, 14 aa, Borrelia burgdorferi B31
QGTTSSRAMVFDKN

SEQ ID NO: 103185 - protein, 14 aa, Borrelia burgdorferi B31
GTTSSRAMVFDKNA

SEQ ID NO: 103186 - protein, 14 aa, Borrelia burgdorferi B31
TTSSRAMVFDKNAN

SEQ ID NO: 103187 - protein, 14 aa, Borrelia burgdorferi B31
TSSRAMVFDKNANI

SEQ ID NO: 103188 - protein, 14 aa, Borrelia burgdorferi B31
SSRAMVFDKNANIK

SEQ ID NO: 103189 - protein, 14 aa, Borrelia burgdorferi B31
SRAMVFDKNANIKG

SEQ ID NO: 103190 - protein, 14 aa, Borrelia burgdorferi B31
RAMVFDKNANIKGF

SEQ ID NO: 103191 - protein, 14 aa, Borrelia burgdorferi B31
AMVFDKNANIKGFA

SEQ ID NO: 103192 - protein, 14 aa, Borrelia burgdorferi B31
MVFDKNANIKGFAQ

SEQ ID NO: 103193 - protein, 14 aa, Borrelia burgdorferi B31
VFDKNANIKGFAQK

SEQ ID NO: 103194 - protein, 14 aa, Borrelia burgdorferi B31
FDKNANIKGFAQKE

SEQ ID NO: 103195 - protein, 14 aa, Borrelia burgdorferi B31
DKNANIKGFAQKEF

SEQ ID NO: 103196 - protein, 14 aa, Borrelia burgdorferi B31
KNANIKGFAQKEFT

SEQ ID NO: 103197 - protein, 14 aa, Borrelia burgdorferi B31
NANIKGFAQKEFTQ

SEQ ID NO: 103198 - protein, 14 aa, Borrelia burgdorferi B31
ANIKGFAQKEFTQI

SEQ ID NO: 103199 - protein, 14 aa, Borrelia burgdorferi B31
NIKGFAQKEFTQIY

SEQ ID NO: 103200 - protein, 14 aa, Borrelia burgdorferi B31
IKGFAQKEFTQIYP

SEQ ID NO: 103201 - protein, 14 aa, Borrelia burgdorferi B31
KGFAQKEFTQIYPQ

SEQ ID NO: 103202 - protein, 14 aa, Borrelia burgdorferi B31
GFAQKEFTQIYPQP

SEQ ID NO: 103203 - protein, 14 aa, Borrelia burgdorferi B31
FAQKEFTQIYPQPS

SEQ ID NO: 103204 - protein, 14 aa, Borrelia burgdorferi B31
AQKEFTQIYPQPSW

SEQ ID NO: 103205 - protein, 14 aa, Borrelia burgdorferi B31
QKEFTQIYPQPSWV

SEQ ID NO: 103206 - protein, 14 aa, Borrelia burgdorferi B31
KEFTQIYPQPSWVE

SEQ ID NO: 103207 - protein, 14 aa, Borrelia burgdorferi B31
EFTQIYPQPSWVEH

SEQ ID NO: 103208 - protein, 14 aa, Borrelia burgdorferi B31
FTQIYPQPSWVEHD

SEQ ID NO: 103209 - protein, 14 aa, Borrelia burgdorferi B31
TQIYPQPSWVEHDP

SEQ ID NO: 103210 - protein, 14 aa, Borrelia burgdorferi B31
QIYPQPSWVEHDPT

SEQ ID NO: 103211 - protein, 14 aa, Borrelia burgdorferi B31
IYPQPSWVEHDPTE

SEQ ID NO: 103212 - protein, 14 aa, Borrelia burgdorferi B31
YPQPSWVEHDPTEI

SEQ ID NO: 103213 - protein, 14 aa, Borrelia burgdorferi B31
PQPSWVEHDPTEIW

SEQ ID NO: 103214 - protein, 14 aa, Borrelia burgdorferi B31
QPSWVEHDPTEIWG

SEQ ID NO: 103215 - protein, 14 aa, Borrelia burgdorferi B31
PSWVEHDPTEIWGS

SEQ ID NO: 103216 - protein, 14 aa, Borrelia burgdorferi B31
SWVEHDPTEIWGSQ

SEQ ID NO: 103217 - protein, 14 aa, Borrelia burgdorferi B31
WVEHDPTEIWGSQL

SEQ ID NO: 103218 - protein, 14 aa, Borrelia burgdorferi B31
VEHDPTEIWGSQLG

SEQ ID NO: 103219 - protein, 14 aa, Borrelia burgdorferi B31
EHDPTEIWGSQLGV

SEQ ID NO: 103220 - protein, 14 aa, Borrelia burgdorferi B31
HDPTEIWGSQLGVI

SEQ ID NO: 103221 - protein, 14 aa, Borrelia burgdorferi B31
DPTEIWGSQLGVIT

SEQ ID NO: 103222 - protein, 14 aa, Borrelia burgdorferi B31
PTEIWGSQLGVITE

SEQ ID NO: 103223 - protein, 14 aa, Borrelia burgdorferi B31
TEIWGSQLGVITEA

SEQ ID NO: 103224 - protein, 14 aa, Borrelia burgdorferi B31
EIWGSQLGVITEAM

SEQ ID NO: 103225 - protein, 14 aa, Borrelia burgdorferi B31
IWGSQLGVITEAMA

SEQ ID NO: 103226 - protein, 14 aa, Borrelia burgdorferi B31
WGSQLGVITEAMAN

SEQ ID NO: 103227 - protein, 14 aa, Borrelia burgdorferi B31
GSQLGVITEAMANA

SEQ ID NO: 103228 - protein, 14 aa, Borrelia burgdorferi B31
SQLGVITEAMANAR

SEQ ID NO: 103229 - protein, 14 aa, Borrelia burgdorferi B31
QLGVITEAMANARI

SEQ ID NO: 103230 - protein, 14 aa, Borrelia burgdorferi B31
LGVITEAMANARIL

SEQ ID NO: 103231 - protein, 14 aa, Borrelia burgdorferi B31
GVITEAMANARILP

SEQ ID NO: 103232 - protein, 14 aa, Borrelia burgdorferi B31
VITEAMANARILPN

SEQ ID NO: 103233 - protein, 14 aa, Borrelia burgdorferi B31
ITEAMANARILPNE

SEQ ID NO: 103234 - protein, 14 aa, Borrelia burgdorferi B31
TEAMANARILPNEI

SEQ ID NO: 103235 - protein, 14 aa, Borrelia burgdorferi B31
EAMANARILPNEID

SEQ ID NO: 103236 - protein, 14 aa, Borrelia burgdorferi B31
AMANARILPNEIDA

SEQ ID NO: 103237 - protein, 14 aa, Borrelia burgdorferi B31
MANARILPNEIDAI

SEQ ID NO: 103238 - protein, 14 aa, Borrelia burgdorferi B31
ANARILPNEIDAIG

SEQ ID NO: 103239 - protein, 14 aa, Borrelia burgdorferi B31
NARILPNEIDAIGI

SEQ ID NO: 103240 - protein, 14 aa, Borrelia burgdorferi B31
ARILPNEIDAIGIT

SEQ ID NO: 103241 - protein, 14 aa, Borrelia burgdorferi B31
RILPNEIDAIGITN

SEQ ID NO: 103242 - protein, 14 aa, Borrelia burgdorferi B31
ILPNEIDAIGITNQ

SEQ ID NO: 103243 - protein, 14 aa, Borrelia burgdorferi B31
LPNEIDAIGITNQR

SEQ ID NO: 103244 - protein, 14 aa, Borrelia burgdorferi B31
PNEIDAIGITNQRE

SEQ ID NO: 103245 - protein, 14 aa, Borrelia burgdorferi B31
NEIDAIGITNQRET

SEQ ID NO: 103246 - protein, 14 aa, Borrelia burgdorferi B31
EIDAIGITNQRETT

SEQ ID NO: 103247 - protein, 14 aa, Borrelia burgdorferi B31
IDAIGITNQRETTV

SEQ ID NO: 103248 - protein, 14 aa, Borrelia burgdorferi B31
DAIGITNQRETTVI

SEQ ID NO: 103249 - protein, 14 aa, Borrelia burgdorferi B31
AIGITNQRETTVIW

SEQ ID NO: 103250 - protein, 14 aa, Borrelia burgdorferi B31
IGITNQRETTVIWE

SEQ ID NO: 103251 - protein, 14 aa, Borrelia burgdorferi B31
GITNQRETTVIWEK

SEQ ID NO: 103252 - protein, 14 aa, Borrelia burgdorferi B31
ITNQRETTVIWEKN

SEQ ID NO: 103253 - protein, 14 aa, Borrelia burgdorferi B31
TNQRETTVIWEKNT

SEQ ID NO: 103254 - protein, 14 aa, Borrelia burgdorferi B31
NQRETTVIWEKNTG

SEQ ID NO: 103255 - protein, 14 aa, Borrelia burgdorferi B31
QRETTVIWEKNTGK

SEQ ID NO: 103256 - protein, 14 aa, Borrelia burgdorferi B31
RETTVIWEKNTGKP

SEQ ID NO: 103257 - protein, 14 aa, Borrelia burgdorferi B31
ETTVIWEKNTGKPI

SEQ ID NO: 103258 - protein, 14 aa, Borrelia burgdorferi B31
TTVIWEKNTGKPIY

SEQ ID NO: 103259 - protein, 14 aa, Borrelia burgdorferi B31
TVIWEKNTGKPIYN

SEQ ID NO: 103260 - protein, 14 aa, Borrelia burgdorferi B31
VIWEKNTGKPIYNA

SEQ ID NO: 103261 - protein, 14 aa, Borrelia burgdorferi B31
IWEKNTGKPIYNAI

SEQ ID NO: 103262 - protein, 14 aa, Borrelia burgdorferi B31
WEKNTGKPIYNAIV

SEQ ID NO: 103263 - protein, 14 aa, Borrelia burgdorferi B31
EKNTGKPIYNAIVW

SEQ ID NO: 103264 - protein, 14 aa, Borrelia burgdorferi B31
KNTGKPIYNAIVWQ

SEQ ID NO: 103265 - protein, 14 aa, Borrelia burgdorferi B31
NTGKPIYNAIVWQD

SEQ ID NO: 103266 - protein, 14 aa, Borrelia burgdorferi B31
TGKPIYNAIVWQDR

SEQ ID NO: 103267 - protein, 14 aa, Borrelia burgdorferi B31
GKPIYNAIVWQDRR

SEQ ID NO: 103268 - protein, 14 aa, Borrelia burgdorferi B31
KPIYNAIVWQDRRT

SEQ ID NO: 103269 - protein, 14 aa, Borrelia burgdorferi B31
PIYNAIVWQDRRTA

SEQ ID NO: 103270 - protein, 14 aa, Borrelia burgdorferi B31
IYNAIVWQDRRTAK

SEQ ID NO: 103271 - protein, 14 aa, Borrelia burgdorferi B31
YNAIVWQDRRTAKI

SEQ ID NO: 103272 - protein, 14 aa, Borrelia burgdorferi B31
NAIVWQDRRTAKIC

SEQ ID NO: 103273 - protein, 14 aa, Borrelia burgdorferi B31
AIVWQDRRTAKICD

SEQ ID NO: 103274 - protein, 14 aa, Borrelia burgdorferi B31
IVWQDRRTAKICDQ

SEQ ID NO: 103275 - protein, 14 aa, Borrelia burgdorferi B31
VWQDRRTAKICDQL

SEQ ID NO: 103276 - protein, 14 aa, Borrelia burgdorferi B31
WQDRRTAKICDQLK

SEQ ID NO: 103277 - protein, 14 aa, Borrelia burgdorferi B31
QDRRTAKICDQLKK

SEQ ID NO: 103278 - protein, 14 aa, Borrelia burgdorferi B31
DRRTAKICDQLKKE

SEQ ID NO: 103279 - protein, 14 aa, Borrelia burgdorferi B31
RRTAKICDQLKKEG

SEQ ID NO: 103280 - protein, 14 aa, Borrelia burgdorferi B31
RTAKICDQLKKEGK

SEQ ID NO: 103281 - protein, 14 aa, Borrelia burgdorferi B31
TAKICDQLKKEGKD

SEQ ID NO: 103282 - protein, 14 aa, Borrelia burgdorferi B31
AKICDQLKKEGKDK

SEQ ID NO: 103283 - protein, 14 aa, Borrelia burgdorferi B31
KICDQLKKEGKDKI

SEQ ID NO: 103284 - protein, 14 aa, Borrelia burgdorferi B31
ICDQLKKEGKDKII

SEQ ID NO: 103285 - protein, 14 aa, Borrelia burgdorferi B31
CDQLKKEGKDKIIL

SEQ ID NO: 103286 - protein, 14 aa, Borrelia burgdorferi B31
DQLKKEGKDKIILE

SEQ ID NO: 103287 - protein, 14 aa, Borrelia burgdorferi B31
QLKKEGKDKIILEK

SEQ ID NO: 103288 - protein, 14 aa, Borrelia burgdorferi B31
LKKEGKDKIILEKT

SEQ ID NO: 103289 - protein, 14 aa, Borrelia burgdorferi B31
KKEGKDKIILEKTG

SEQ ID NO: 103290 - protein, 14 aa, Borrelia burgdorferi B31
KEGKDKIILEKTGL

SEQ ID NO: 103291 - protein, 14 aa, Borrelia burgdorferi B31
EGKDKIILEKTGLV

SEQ ID NO: 103292 - protein, 14 aa, Borrelia burgdorferi B31
GKDKIILEKTGLVL

SEQ ID NO: 103293 - protein, 14 aa, Borrelia burgdorferi B31
KDKIILEKTGLVLD

SEQ ID NO: 103294 - protein, 14 aa, Borrelia burgdorferi B31
DKIILEKTGLVLDS

SEQ ID NO: 103295 - protein, 14 aa, Borrelia burgdorferi B31
KIILEKTGLVLDSY

SEQ ID NO: 103296 - protein, 14 aa, Borrelia burgdorferi B31
IILEKTGLVLDSYF

SEQ ID NO: 103297 - protein, 14 aa, Borrelia burgdorferi B31
ILEKTGLVLDSYFS

SEQ ID NO: 103298 - protein, 14 aa, Borrelia burgdorferi B31
LEKTGLVLDSYFSG

SEQ ID NO: 103299 - protein, 14 aa, Borrelia burgdorferi B31
EKTGLVLDSYFSGT

SEQ ID NO: 103300 - protein, 14 aa, Borrelia burgdorferi B31
KTGLVLDSYFSGTK

SEQ ID NO: 103301 - protein, 14 aa, Borrelia burgdorferi B31
TGLVLDSYFSGTKI

SEQ ID NO: 103302 - protein, 14 aa, Borrelia burgdorferi B31
GLVLDSYFSGTKIM

SEQ ID NO: 103303 - protein, 14 aa, Borrelia burgdorferi B31
LVLDSYFSGTKIMW

SEQ ID NO: 103304 - protein, 14 aa, Borrelia burgdorferi B31
VLDSYFSGTKIMWI

SEQ ID NO: 103305 - protein, 14 aa, Borrelia burgdorferi B31
LDSYFSGTKIMWIL

SEQ ID NO: 103306 - protein, 14 aa, Borrelia burgdorferi B31
DSYFSGTKIMWILD

SEQ ID NO: 103307 - protein, 14 aa, Borrelia burgdorferi B31
SYFSGTKIMWILDN

SEQ ID NO: 103308 - protein, 14 aa, Borrelia burgdorferi B31
YFSGTKIMWILDNV

SEQ ID NO: 103309 - protein, 14 aa, Borrelia burgdorferi B31
FSGTKIMWILDNVE

SEQ ID NO: 103310 - protein, 14 aa, Borrelia burgdorferi B31
SGTKIMWILDNVEG

SEQ ID NO: 103311 - protein, 14 aa, Borrelia burgdorferi B31
GTKIMWILDNVEGA

SEQ ID NO: 103312 - protein, 14 aa, Borrelia burgdorferi B31
TKIMWILDNVEGAR

SEQ ID NO: 103313 - protein, 14 aa, Borrelia burgdorferi B31
KIMWILDNVEGARQ

SEQ ID NO: 103314 - protein, 14 aa, Borrelia burgdorferi B31
IMWILDNVEGARQR

SEQ ID NO: 103315 - protein, 14 aa, Borrelia burgdorferi B31
MWILDNVEGARQRA

SEQ ID NO: 103316 - protein, 14 aa, Borrelia burgdorferi B31
WILDNVEGARQRAE

SEQ ID NO: 103317 - protein, 14 aa, Borrelia burgdorferi B31
ILDNVEGARQRAEN

SEQ ID NO: 103318 - protein, 14 aa, Borrelia burgdorferi B31
LDNVEGARQRAENG

SEQ ID NO: 103319 - protein, 14 aa, Borrelia burgdorferi B31
DNVEGARQRAENGE

SEQ ID NO: 103320 - protein, 14 aa, Borrelia burgdorferi B31
NVEGARQRAENGEL

SEQ ID NO: 103321 - protein, 14 aa, Borrelia burgdorferi B31
VEGARQRAENGELC

SEQ ID NO: 103322 - protein, 14 aa, Borrelia burgdorferi B31
EGARQRAENGELCF

SEQ ID NO: 103323 - protein, 14 aa, Borrelia burgdorferi B31
GARQRAENGELCFG

SEQ ID NO: 103324 - protein, 14 aa, Borrelia burgdorferi B31
ARQRAENGELCFGT

SEQ ID NO: 103325 - protein, 14 aa, Borrelia burgdorferi B31
RQRAENGELCFGTI

SEQ ID NO: 103326 - protein, 14 aa, Borrelia burgdorferi B31
QRAENGELCFGTID

SEQ ID NO: 103327 - protein, 14 aa, Borrelia burgdorferi B31
RAENGELCFGTIDT

SEQ ID NO: 103328 - protein, 14 aa, Borrelia burgdorferi B31
AENGELCFGTIDTW

SEQ ID NO: 103329 - protein, 14 aa, Borrelia burgdorferi B31
ENGELCFGTIDTWI

SEQ ID NO: 103330 - protein, 14 aa, Borrelia burgdorferi B31
NGELCFGTIDTWIL

SEQ ID NO: 103331 - protein, 14 aa, Borrelia burgdorferi B31
GELCFGTIDTWILW

SEQ ID NO: 103332 - protein, 14 aa, Borrelia burgdorferi B31
ELCFGTIDTWILWN

SEQ ID NO: 103333 - protein, 14 aa, Borrelia burgdorferi B31
LCFGTIDTWILWNL

SEQ ID NO: 103334 - protein, 14 aa, Borrelia burgdorferi B31
CFGTIDTWILWNLT

SEQ ID NO: 103335 - protein, 14 aa, Borrelia burgdorferi B31
FGTIDTWILWNLTQ

SEQ ID NO: 103336 - protein, 14 aa, Borrelia burgdorferi B31
GTIDTWILWNLTQK

SEQ ID NO: 103337 - protein, 14 aa, Borrelia burgdorferi B31
TIDTWILWNLTQKK

SEQ ID NO: 103338 - protein, 14 aa, Borrelia burgdorferi B31
IDTWILWNLTQKKE

SEQ ID NO: 103339 - protein, 14 aa, Borrelia burgdorferi B31
DTWILWNLTQKKEH

SEQ ID NO: 103340 - protein, 14 aa, Borrelia burgdorferi B31
TWILWNLTQKKEHA

SEQ ID NO: 103341 - protein, 14 aa, Borrelia burgdorferi B31
WILWNLTQKKEHAT

SEQ ID NO: 103342 - protein, 14 aa, Borrelia burgdorferi B31
ILWNLTQKKEHATD

SEQ ID NO: 103343 - protein, 14 aa, Borrelia burgdorferi B31
LWNLTQKKEHATDY

SEQ ID NO: 103344 - protein, 14 aa, Borrelia burgdorferi B31
WNLTQKKEHATDYS

SEQ ID NO: 103345 - protein, 14 aa, Borrelia burgdorferi B31
NLTQKKEHATDYSN

SEQ ID NO: 103346 - protein, 14 aa, Borrelia burgdorferi B31
LTQKKEHATDYSNA

SEQ ID NO: 103347 - protein, 14 aa, Borrelia burgdorferi B31
TQKKEHATDYSNAS

SEQ ID NO: 103348 - protein, 14 aa, Borrelia burgdorferi B31
QKKEHATDYSNASR

SEQ ID NO: 103349 - protein, 14 aa, Borrelia burgdorferi B31
KKEHATDYSNASRT

SEQ ID NO: 103350 - protein, 14 aa, Borrelia burgdorferi B31
KEHATDYSNASRTL

SEQ ID NO: 103351 - protein, 14 aa, Borrelia burgdorferi B31
EHATDYSNASRTLL

SEQ ID NO: 103352 - protein, 14 aa, Borrelia burgdorferi B31
HATDYSNASRTLLL

SEQ ID NO: 103353 - protein, 14 aa, Borrelia burgdorferi B31
ATDYSNASRTLLLN

SEQ ID NO: 103354 - protein, 14 aa, Borrelia burgdorferi B31
TDYSNASRTLLLNI

SEQ ID NO: 103355 - protein, 14 aa, Borrelia burgdorferi B31
DYSNASRTLLLNIK

SEQ ID NO: 103356 - protein, 14 aa, Borrelia burgdorferi B31
YSNASRTLLLNIKT

SEQ ID NO: 103357 - protein, 14 aa, Borrelia burgdorferi B31
SNASRTLLLNIKTL

SEQ ID NO: 103358 - protein, 14 aa, Borrelia burgdorferi B31
NASRTLLLNIKTLE

SEQ ID NO: 103359 - protein, 14 aa, Borrelia burgdorferi B31
ASRTLLLNIKTLEW

SEQ ID NO: 103360 - protein, 14 aa, Borrelia burgdorferi B31
SRTLLLNIKTLEWD

SEQ ID NO: 103361 - protein, 14 aa, Borrelia burgdorferi B31
RTLLLNIKTLEWDD

SEQ ID NO: 103362 - protein, 14 aa, Borrelia burgdorferi B31
TLLLNIKTLEWDDE

SEQ ID NO: 103363 - protein, 14 aa, Borrelia burgdorferi B31
LLLNIKTLEWDDEL

SEQ ID NO: 103364 - protein, 14 aa, Borrelia burgdorferi B31
LLNIKTLEWDDELL

SEQ ID NO: 103365 - protein, 14 aa, Borrelia burgdorferi B31
LNIKTLEWDDELLS

SEQ ID NO: 103366 - protein, 14 aa, Borrelia burgdorferi B31
NIKTLEWDDELLSI

SEQ ID NO: 103367 - protein, 14 aa, Borrelia burgdorferi B31
IKTLEWDDELLSIL

SEQ ID NO: 103368 - protein, 14 aa, Borrelia burgdorferi B31
KTLEWDDELLSILN

SEQ ID NO: 103369 - protein, 14 aa, Borrelia burgdorferi B31
TLEWDDELLSILNV

SEQ ID NO: 103370 - protein, 14 aa, Borrelia burgdorferi B31
LEWDDELLSILNVP

SEQ ID NO: 103371 - protein, 14 aa, Borrelia burgdorferi B31
EWDDELLSILNVPR

SEQ ID NO: 103372 - protein, 14 aa, Borrelia burgdorferi B31
WDDELLSILNVPRA

SEQ ID NO: 103373 - protein, 14 aa, Borrelia burgdorferi B31
DDELLSILNVPRAI

SEQ ID NO: 103374 - protein, 14 aa, Borrelia burgdorferi B31
DELLSILNVPRAIL

SEQ ID NO: 103375 - protein, 14 aa, Borrelia burgdorferi B31
ELLSILNVPRAILP

SEQ ID NO: 103376 - protein, 14 aa, Borrelia burgdorferi B31
LLSILNVPRAILPE

SEQ ID NO: 103377 - protein, 14 aa, Borrelia burgdorferi B31
LSILNVPRAILPEL

SEQ ID NO: 103378 - protein, 14 aa, Borrelia burgdorferi B31
SILNVPRAILPELK

SEQ ID NO: 103379 - protein, 14 aa, Borrelia burgdorferi B31
ILNVPRAILPELKE

SEQ ID NO: 103380 - protein, 14 aa, Borrelia burgdorferi B31
LNVPRAILPELKES

SEQ ID NO: 103381 - protein, 14 aa, Borrelia burgdorferi B31
NVPRAILPELKESS

SEQ ID NO: 103382 - protein, 14 aa, Borrelia burgdorferi B31
VPRAILPELKESST

SEQ ID NO: 103383 - protein, 14 aa, Borrelia burgdorferi B31
PRAILPELKESSTI

SEQ ID NO: 103384 - protein, 14 aa, Borrelia burgdorferi B31
RAILPELKESSTIY

SEQ ID NO: 103385 - protein, 14 aa, Borrelia burgdorferi B31
AILPELKESSTIYG

SEQ ID NO: 103386 - protein, 14 aa, Borrelia burgdorferi B31
ILPELKESSTIYGK

SEQ ID NO: 103387 - protein, 14 aa, Borrelia burgdorferi B31
LPELKESSTIYGKT

SEQ ID NO: 103388 - protein, 14 aa, Borrelia burgdorferi B31
PELKESSTIYGKTD

SEQ ID NO: 103389 - protein, 14 aa, Borrelia burgdorferi B31
ELKESSTIYGKTDK

SEQ ID NO: 103390 - protein, 14 aa, Borrelia burgdorferi B31
LKESSTIYGKTDKA

SEQ ID NO: 103391 - protein, 14 aa, Borrelia burgdorferi B31
KESSTIYGKTDKAL

SEQ ID NO: 103392 - protein, 14 aa, Borrelia burgdorferi B31
ESSTIYGKTDKALF

SEQ ID NO: 103393 - protein, 14 aa, Borrelia burgdorferi B31
SSTIYGKTDKALFG

SEQ ID NO: 103394 - protein, 14 aa, Borrelia burgdorferi B31
STIYGKTDKALFGA

SEQ ID NO: 103395 - protein, 14 aa, Borrelia burgdorferi B31
TIYGKTDKALFGAE

SEQ ID NO: 103396 - protein, 14 aa, Borrelia burgdorferi B31
IYGKTDKALFGAEI

SEQ ID NO: 103397 - protein, 14 aa, Borrelia burgdorferi B31
YGKTDKALFGAEIP

SEQ ID NO: 103398 - protein, 14 aa, Borrelia burgdorferi B31
GKTDKALFGAEIPI

SEQ ID NO: 103399 - protein, 14 aa, Borrelia burgdorferi B31
KTDKALFGAEIPIA

SEQ ID NO: 103400 - protein, 14 aa, Borrelia burgdorferi B31
TDKALFGAEIPIAG

SEQ ID NO: 103401 - protein, 14 aa, Borrelia burgdorferi B31
DKALFGAEIPIAGI

SEQ ID NO: 103402 - protein, 14 aa, Borrelia burgdorferi B31
KALFGAEIPIAGIA

SEQ ID NO: 103403 - protein, 14 aa, Borrelia burgdorferi B31
ALFGAEIPIAGIAG

SEQ ID NO: 103404 - protein, 14 aa, Borrelia burgdorferi B31
LFGAEIPIAGIAGD

SEQ ID NO: 103405 - protein, 14 aa, Borrelia burgdorferi B31
FGAEIPIAGIAGDQ

SEQ ID NO: 103406 - protein, 14 aa, Borrelia burgdorferi B31
GAEIPIAGIAGDQF

SEQ ID NO: 103407 - protein, 14 aa, Borrelia burgdorferi B31
AEIPIAGIAGDQFA

SEQ ID NO: 103408 - protein, 14 aa, Borrelia burgdorferi B31
EIPIAGIAGDQFAA

SEQ ID NO: 103409 - protein, 14 aa, Borrelia burgdorferi B31
IPIAGIAGDQFAAT

SEQ ID NO: 103410 - protein, 14 aa, Borrelia burgdorferi B31
PIAGIAGDQFAATF

SEQ ID NO: 103411 - protein, 14 aa, Borrelia burgdorferi B31
IAGIAGDQFAATFG

SEQ ID NO: 103412 - protein, 14 aa, Borrelia burgdorferi B31
AGIAGDQFAATFGQ

SEQ ID NO: 103413 - protein, 14 aa, Borrelia burgdorferi B31
GIAGDQFAATFGQA

SEQ ID NO: 103414 - protein, 14 aa, Borrelia burgdorferi B31
IAGDQFAATFGQAC

SEQ ID NO: 103415 - protein, 14 aa, Borrelia burgdorferi B31
AGDQFAATFGQACL

SEQ ID NO: 103416 - protein, 14 aa, Borrelia burgdorferi B31
GDQFAATFGQACLK

SEQ ID NO: 103417 - protein, 14 aa, Borrelia burgdorferi B31
DQFAATFGQACLKK

SEQ ID NO: 103418 - protein, 14 aa, Borrelia burgdorferi B31
QFAATFGQACLKKG

SEQ ID NO: 103419 - protein, 14 aa, Borrelia burgdorferi B31
FAATFGQACLKKGM

SEQ ID NO: 103420 - protein, 14 aa, Borrelia burgdorferi B31
AATFGQACLKKGMA

SEQ ID NO: 103421 - protein, 14 aa, Borrelia burgdorferi B31
ATFGQACLKKGMAK

SEQ ID NO: 103422 - protein, 14 aa, Borrelia burgdorferi B31
TFGQACLKKGMAKN

SEQ ID NO: 103423 - protein, 14 aa, Borrelia burgdorferi B31
FGQACLKKGMAKNT

SEQ ID NO: 103424 - protein, 14 aa, Borrelia burgdorferi B31
GQACLKKGMAKNTY

SEQ ID NO: 103425 - protein, 14 aa, Borrelia burgdorferi B31
QACLKKGMAKNTYG

SEQ ID NO: 103426 - protein, 14 aa, Borrelia burgdorferi B31
ACLKKGMAKNTYGT

SEQ ID NO: 103427 - protein, 14 aa, Borrelia burgdorferi B31
CLKKGMAKNTYGTG

SEQ ID NO: 103428 - protein, 14 aa, Borrelia burgdorferi B31
LKKGMAKNTYGTGC

SEQ ID NO: 103429 - protein, 14 aa, Borrelia burgdorferi B31
KKGMAKNTYGTGCF

SEQ ID NO: 103430 - protein, 14 aa, Borrelia burgdorferi B31
KGMAKNTYGTGCFL

SEQ ID NO: 103431 - protein, 14 aa, Borrelia burgdorferi B31
GMAKNTYGTGCFLT

SEQ ID NO: 103432 - protein, 14 aa, Borrelia burgdorferi B31
MAKNTYGTGCFLTV

SEQ ID NO: 103433 - protein, 14 aa, Borrelia burgdorferi B31
AKNTYGTGCFLTVN

SEQ ID NO: 103434 - protein, 14 aa, Borrelia burgdorferi B31
KNTYGTGCFLTVNI

SEQ ID NO: 103435 - protein, 14 aa, Borrelia burgdorferi B31
NTYGTGCFLTVNIG

SEQ ID NO: 103436 - protein, 14 aa, Borrelia burgdorferi B31
TYGTGCFLTVNIGK

SEQ ID NO: 103437 - protein, 14 aa, Borrelia burgdorferi B31
YGTGCFLTVNIGKE

SEQ ID NO: 103438 - protein, 14 aa, Borrelia burgdorferi B31
GTGCFLTVNIGKEP

SEQ ID NO: 103439 - protein, 14 aa, Borrelia burgdorferi B31
TGCFLTVNIGKEPI

SEQ ID NO: 103440 - protein, 14 aa, Borrelia burgdorferi B31
GCFLTVNIGKEPII

SEQ ID NO: 103441 - protein, 14 aa, Borrelia burgdorferi B31
CFLTVNIGKEPIIS

SEQ ID NO: 103442 - protein, 14 aa, Borrelia burgdorferi B31
FLTVNIGKEPIISH

SEQ ID NO: 103443 - protein, 14 aa, Borrelia burgdorferi B31
LTVNIGKEPIISHD

SEQ ID NO: 103444 - protein, 14 aa, Borrelia burgdorferi B31
TVNIGKEPIISHDK

SEQ ID NO: 103445 - protein, 14 aa, Borrelia burgdorferi B31
VNIGKEPIISHDKL

SEQ ID NO: 103446 - protein, 14 aa, Borrelia burgdorferi B31
NIGKEPIISHDKLL

SEQ ID NO: 103447 - protein, 14 aa, Borrelia burgdorferi B31
IGKEPIISHDKLLT

SEQ ID NO: 103448 - protein, 14 aa, Borrelia burgdorferi B31
GKEPIISHDKLLTS

SEQ ID NO: 103449 - protein, 14 aa, Borrelia burgdorferi B31
KEPIISHDKLLTSI

SEQ ID NO: 103450 - protein, 14 aa, Borrelia burgdorferi B31
EPIISHDKLLTSIA

SEQ ID NO: 103451 - protein, 14 aa, Borrelia burgdorferi B31
PIISHDKLLTSIAW

SEQ ID NO: 103452 - protein, 14 aa, Borrelia burgdorferi B31
IISHDKLLTSIAWG

SEQ ID NO: 103453 - protein, 14 aa, Borrelia burgdorferi B31
ISHDKLLTSIAWGR

SEQ ID NO: 103454 - protein, 14 aa, Borrelia burgdorferi B31
SHDKLLTSIAWGRK

SEQ ID NO: 103455 - protein, 14 aa, Borrelia burgdorferi B31
HDKLLTSIAWGRKK

SEQ ID NO: 103456 - protein, 14 aa, Borrelia burgdorferi B31
DKLLTSIAWGRKKS

SEQ ID NO: 103457 - protein, 14 aa, Borrelia burgdorferi B31
KLLTSIAWGRKKSV

SEQ ID NO: 103458 - protein, 14 aa, Borrelia burgdorferi B31
LLTSIAWGRKKSVT

SEQ ID NO: 103459 - protein, 14 aa, Borrelia burgdorferi B31
LTSIAWGRKKSVTY

SEQ ID NO: 103460 - protein, 14 aa, Borrelia burgdorferi B31
TSIAWGRKKSVTYV

SEQ ID NO: 103461 - protein, 14 aa, Borrelia burgdorferi B31
SIAWGRKKSVTYVL

SEQ ID NO: 103462 - protein, 14 aa, Borrelia burgdorferi B31
IAWGRKKSVTYVLE

SEQ ID NO: 103463 - protein, 14 aa, Borrelia burgdorferi B31
AWGRKKSVTYVLEG

SEQ ID NO: 103464 - protein, 14 aa, Borrelia burgdorferi B31
WGRKKSVTYVLEGS

SEQ ID NO: 103465 - protein, 14 aa, Borrelia burgdorferi B31
GRKKSVTYVLEGSV

SEQ ID NO: 103466 - protein, 14 aa, Borrelia burgdorferi B31
RKKSVTYVLEGSVF

SEQ ID NO: 103467 - protein, 14 aa, Borrelia burgdorferi B31
KKSVTYVLEGSVFI

SEQ ID NO: 103468 - protein, 14 aa, Borrelia burgdorferi B31
KSVTYVLEGSVFIG

SEQ ID NO: 103469 - protein, 14 aa, Borrelia burgdorferi B31
SVTYVLEGSVFIGG

SEQ ID NO: 103470 - protein, 14 aa, Borrelia burgdorferi B31
VTYVLEGSVFIGGA

SEQ ID NO: 103471 - protein, 14 aa, Borrelia burgdorferi B31
TYVLEGSVFIGGAV

SEQ ID NO: 103472 - protein, 14 aa, Borrelia burgdorferi B31
YVLEGSVFIGGAVI

SEQ ID NO: 103473 - protein, 14 aa, Borrelia burgdorferi B31
VLEGSVFIGGAVIQ

SEQ ID NO: 103474 - protein, 14 aa, Borrelia burgdorferi B31
LEGSVFIGGAVIQW

SEQ ID NO: 103475 - protein, 14 aa, Borrelia burgdorferi B31
EGSVFIGGAVIQWL

SEQ ID NO: 103476 - protein, 14 aa, Borrelia burgdorferi B31
GSVFIGGAVIQWLR

SEQ ID NO: 103477 - protein, 14 aa, Borrelia burgdorferi B31
SVFIGGAVIQWLRD

SEQ ID NO: 103478 - protein, 14 aa, Borrelia burgdorferi B31
VFIGGAVIQWLRDG

SEQ ID NO: 103479 - protein, 14 aa, Borrelia burgdorferi B31
FIGGAVIQWLRDGL

SEQ ID NO: 103480 - protein, 14 aa, Borrelia burgdorferi B31
IGGAVIQWLRDGLE

SEQ ID NO: 103481 - protein, 14 aa, Borrelia burgdorferi B31
GGAVIQWLRDGLEF

SEQ ID NO: 103482 - protein, 14 aa, Borrelia burgdorferi B31
GAVIQWLRDGLEFF

SEQ ID NO: 103483 - protein, 14 aa, Borrelia burgdorferi B31
AVIQWLRDGLEFFR

SEQ ID NO: 103484 - protein, 14 aa, Borrelia burgdorferi B31
VIQWLRDGLEFFRK

SEQ ID NO: 103485 - protein, 14 aa, Borrelia burgdorferi B31
IQWLRDGLEFFRKS

SEQ ID NO: 103486 - protein, 14 aa, Borrelia burgdorferi B31
QWLRDGLEFFRKSS

SEQ ID NO: 103487 - protein, 14 aa, Borrelia burgdorferi B31
WLRDGLEFFRKSSD

SEQ ID NO: 103488 - protein, 14 aa, Borrelia burgdorferi B31
LRDGLEFFRKSSDA

SEQ ID NO: 103489 - protein, 14 aa, Borrelia burgdorferi B31
RDGLEFFRKSSDAE

SEQ ID NO: 103490 - protein, 14 aa, Borrelia burgdorferi B31
DGLEFFRKSSDAEA

SEQ ID NO: 103491 - protein, 14 aa, Borrelia burgdorferi B31
GLEFFRKSSDAEAL

SEQ ID NO: 103492 - protein, 14 aa, Borrelia burgdorferi B31
LEFFRKSSDAEALA

SEQ ID NO: 103493 - protein, 14 aa, Borrelia burgdorferi B31
EFFRKSSDAEALAS

SEQ ID NO: 103494 - protein, 14 aa, Borrelia burgdorferi B31
FFRKSSDAEALASS

SEQ ID NO: 103495 - protein, 14 aa, Borrelia burgdorferi B31
FRKSSDAEALASSV

SEQ ID NO: 103496 - protein, 14 aa, Borrelia burgdorferi B31
RKSSDAEALASSVS

SEQ ID NO: 103497 - protein, 14 aa, Borrelia burgdorferi B31
KSSDAEALASSVSD

SEQ ID NO: 103498 - protein, 14 aa, Borrelia burgdorferi B31
SSDAEALASSVSDN

SEQ ID NO: 103499 - protein, 14 aa, Borrelia burgdorferi B31
SDAEALASSVSDNG

SEQ ID NO: 103500 - protein, 14 aa, Borrelia burgdorferi B31
DAEALASSVSDNGG

SEQ ID NO: 103501 - protein, 14 aa, Borrelia burgdorferi B31
AEALASSVSDNGGV

SEQ ID NO: 103502 - protein, 14 aa, Borrelia burgdorferi B31
EALASSVSDNGGVY

SEQ ID NO: 103503 - protein, 14 aa, Borrelia burgdorferi B31
ALASSVSDNGGVYF

SEQ ID NO: 103504 - protein, 14 aa, Borrelia burgdorferi B31
LASSVSDNGGVYFV

SEQ ID NO: 103505 - protein, 14 aa, Borrelia burgdorferi B31
ASSVSDNGGVYFVP

SEQ ID NO: 103506 - protein, 14 aa, Borrelia burgdorferi B31
SSVSDNGGVYFVPA

SEQ ID NO: 103507 - protein, 14 aa, Borrelia burgdorferi B31
SVSDNGGVYFVPAF

SEQ ID NO: 103508 - protein, 14 aa, Borrelia burgdorferi B31
VSDNGGVYFVPAFV

SEQ ID NO: 103509 - protein, 14 aa, Borrelia burgdorferi B31
SDNGGVYFVPAFVG

SEQ ID NO: 103510 - protein, 14 aa, Borrelia burgdorferi B31
DNGGVYFVPAFVGL

SEQ ID NO: 103511 - protein, 14 aa, Borrelia burgdorferi B31
NGGVYFVPAFVGLG

SEQ ID NO: 103512 - protein, 14 aa, Borrelia burgdorferi B31
GGVYFVPAFVGLGA

SEQ ID NO: 103513 - protein, 14 aa, Borrelia burgdorferi B31
GVYFVPAFVGLGAP

SEQ ID NO: 103514 - protein, 14 aa, Borrelia burgdorferi B31
VYFVPAFVGLGAPH

SEQ ID NO: 103515 - protein, 14 aa, Borrelia burgdorferi B31
YFVPAFVGLGAPHW

SEQ ID NO: 103516 - protein, 14 aa, Borrelia burgdorferi B31
FVPAFVGLGAPHWD

SEQ ID NO: 103517 - protein, 14 aa, Borrelia burgdorferi B31
VPAFVGLGAPHWDS

SEQ ID NO: 103518 - protein, 14 aa, Borrelia burgdorferi B31
PAFVGLGAPHWDSY

SEQ ID NO: 103519 - protein, 14 aa, Borrelia burgdorferi B31
AFVGLGAPHWDSYA

SEQ ID NO: 103520 - protein, 14 aa, Borrelia burgdorferi B31
FVGLGAPHWDSYAR

SEQ ID NO: 103521 - protein, 14 aa, Borrelia burgdorferi B31
VGLGAPHWDSYARG

SEQ ID NO: 103522 - protein, 14 aa, Borrelia burgdorferi B31
GLGAPHWDSYARGT

SEQ ID NO: 103523 - protein, 14 aa, Borrelia burgdorferi B31
LGAPHWDSYARGTI

SEQ ID NO: 103524 - protein, 14 aa, Borrelia burgdorferi B31
GAPHWDSYARGTII

SEQ ID NO: 103525 - protein, 14 aa, Borrelia burgdorferi B31
APHWDSYARGTIIG

SEQ ID NO: 103526 - protein, 14 aa, Borrelia burgdorferi B31
PHWDSYARGTIIGI

SEQ ID NO: 103527 - protein, 14 aa, Borrelia burgdorferi B31
HWDSYARGTIIGIT

SEQ ID NO: 103528 - protein, 14 aa, Borrelia burgdorferi B31
WDSYARGTIIGITR

SEQ ID NO: 103529 - protein, 14 aa, Borrelia burgdorferi B31
DSYARGTIIGITRG

SEQ ID NO: 103530 - protein, 14 aa, Borrelia burgdorferi B31
SYARGTIIGITRGS

SEQ ID NO: 103531 - protein, 14 aa, Borrelia burgdorferi B31
YARGTIIGITRGST

SEQ ID NO: 103532 - protein, 14 aa, Borrelia burgdorferi B31
ARGTIIGITRGSTK

SEQ ID NO: 103533 - protein, 14 aa, Borrelia burgdorferi B31
RGTIIGITRGSTKA

SEQ ID NO: 103534 - protein, 14 aa, Borrelia burgdorferi B31
GTIIGITRGSTKAH

SEQ ID NO: 103535 - protein, 14 aa, Borrelia burgdorferi B31
TIIGITRGSTKAHI

SEQ ID NO: 103536 - protein, 14 aa, Borrelia burgdorferi B31
IIGITRGSTKAHIT

SEQ ID NO: 103537 - protein, 14 aa, Borrelia burgdorferi B31
IGITRGSTKAHITR

SEQ ID NO: 103538 - protein, 14 aa, Borrelia burgdorferi B31
GITRGSTKAHITRA

SEQ ID NO: 103539 - protein, 14 aa, Borrelia burgdorferi B31
ITRGSTKAHITRAA

SEQ ID NO: 103540 - protein, 14 aa, Borrelia burgdorferi B31
TRGSTKAHITRAAL

SEQ ID NO: 103541 - protein, 14 aa, Borrelia burgdorferi B31
RGSTKAHITRAALE

SEQ ID NO: 103542 - protein, 14 aa, Borrelia burgdorferi B31
GSTKAHITRAALES

SEQ ID NO: 103543 - protein, 14 aa, Borrelia burgdorferi B31
STKAHITRAALESI

SEQ ID NO: 103544 - protein, 14 aa, Borrelia burgdorferi B31
TKAHITRAALESIA

SEQ ID NO: 103545 - protein, 14 aa, Borrelia burgdorferi B31
KAHITRAALESIAF

SEQ ID NO: 103546 - protein, 14 aa, Borrelia burgdorferi B31
AHITRAALESIAFQ

SEQ ID NO: 103547 - protein, 14 aa, Borrelia burgdorferi B31
HITRAALESIAFQS

SEQ ID NO: 103548 - protein, 14 aa, Borrelia burgdorferi B31
ITRAALESIAFQSF

SEQ ID NO: 103549 - protein, 14 aa, Borrelia burgdorferi B31
TRAALESIAFQSFD

SEQ ID NO: 103550 - protein, 14 aa, Borrelia burgdorferi B31
RAALESIAFQSFDI

SEQ ID NO: 103551 - protein, 14 aa, Borrelia burgdorferi B31
AALESIAFQSFDIL

SEQ ID NO: 103552 - protein, 14 aa, Borrelia burgdorferi B31
ALESIAFQSFDILN

SEQ ID NO: 103553 - protein, 14 aa, Borrelia burgdorferi B31
LESIAFQSFDILNT

SEQ ID NO: 103554 - protein, 14 aa, Borrelia burgdorferi B31
ESIAFQSFDILNTM

SEQ ID NO: 103555 - protein, 14 aa, Borrelia burgdorferi B31
SIAFQSFDILNTMK

SEQ ID NO: 103556 - protein, 14 aa, Borrelia burgdorferi B31
IAFQSFDILNTMKK

SEQ ID NO: 103557 - protein, 14 aa, Borrelia burgdorferi B31
AFQSFDILNTMKKS

SEQ ID NO: 103558 - protein, 14 aa, Borrelia burgdorferi B31
FQSFDILNTMKKSI

SEQ ID NO: 103559 - protein, 14 aa, Borrelia burgdorferi B31
QSFDILNTMKKSIP

SEQ ID NO: 103560 - protein, 14 aa, Borrelia burgdorferi B31
SFDILNTMKKSIPN

SEQ ID NO: 103561 - protein, 14 aa, Borrelia burgdorferi B31
FDILNTMKKSIPNF

SEQ ID NO: 103562 - protein, 14 aa, Borrelia burgdorferi B31
DILNTMKKSIPNFE

SEQ ID NO: 103563 - protein, 14 aa, Borrelia burgdorferi B31
ILNTMKKSIPNFEI

SEQ ID NO: 103564 - protein, 14 aa, Borrelia burgdorferi B31
LNTMKKSIPNFEIQ

SEQ ID NO: 103565 - protein, 14 aa, Borrelia burgdorferi B31
NTMKKSIPNFEIQE

SEQ ID NO: 103566 - protein, 14 aa, Borrelia burgdorferi B31
TMKKSIPNFEIQEL

SEQ ID NO: 103567 - protein, 14 aa, Borrelia burgdorferi B31
MKKSIPNFEIQELR

SEQ ID NO: 103568 - protein, 14 aa, Borrelia burgdorferi B31
KKSIPNFEIQELRV

SEQ ID NO: 103569 - protein, 14 aa, Borrelia burgdorferi B31
KSIPNFEIQELRVD

SEQ ID NO: 103570 - protein, 14 aa, Borrelia burgdorferi B31
SIPNFEIQELRVDG

SEQ ID NO: 103571 - protein, 14 aa, Borrelia burgdorferi B31
IPNFEIQELRVDGG

SEQ ID NO: 103572 - protein, 14 aa, Borrelia burgdorferi B31
PNFEIQELRVDGGA

SEQ ID NO: 103573 - protein, 14 aa, Borrelia burgdorferi B31
NFEIQELRVDGGAS

SEQ ID NO: 103574 - protein, 14 aa, Borrelia burgdorferi B31
FEIQELRVDGGASQ

SEQ ID NO: 103575 - protein, 14 aa, Borrelia burgdorferi B31
EIQELRVDGGASQN

SEQ ID NO: 103576 - protein, 14 aa, Borrelia burgdorferi B31
IQELRVDGGASQNN

SEQ ID NO: 103577 - protein, 14 aa, Borrelia burgdorferi B31
QELRVDGGASQNNL

SEQ ID NO: 103578 - protein, 14 aa, Borrelia burgdorferi B31
ELRVDGGASQNNLL

SEQ ID NO: 103579 - protein, 14 aa, Borrelia burgdorferi B31
LRVDGGASQNNLLM

SEQ ID NO: 103580 - protein, 14 aa, Borrelia burgdorferi B31
RVDGGASQNNLLMQ

SEQ ID NO: 103581 - protein, 14 aa, Borrelia burgdorferi B31
VDGGASQNNLLMQF

SEQ ID NO: 103582 - protein, 14 aa, Borrelia burgdorferi B31
DGGASQNNLLMQFQ

SEQ ID NO: 103583 - protein, 14 aa, Borrelia burgdorferi B31
GGASQNNLLMQFQA

SEQ ID NO: 103584 - protein, 14 aa, Borrelia burgdorferi B31
GASQNNLLMQFQAD

SEQ ID NO: 103585 - protein, 14 aa, Borrelia burgdorferi B31
ASQNNLLMQFQADL

SEQ ID NO: 103586 - protein, 14 aa, Borrelia burgdorferi B31
SQNNLLMQFQADLL

SEQ ID NO: 103587 - protein, 14 aa, Borrelia burgdorferi B31
QNNLLMQFQADLLE

SEQ ID NO: 103588 - protein, 14 aa, Borrelia burgdorferi B31
NNLLMQFQADLLEC

SEQ ID NO: 103589 - protein, 14 aa, Borrelia burgdorferi B31
NLLMQFQADLLECK

SEQ ID NO: 103590 - protein, 14 aa, Borrelia burgdorferi B31
LLMQFQADLLECKV

SEQ ID NO: 103591 - protein, 14 aa, Borrelia burgdorferi B31
LMQFQADLLECKVV

SEQ ID NO: 103592 - protein, 14 aa, Borrelia burgdorferi B31
MQFQADLLECKVVR

SEQ ID NO: 103593 - protein, 14 aa, Borrelia burgdorferi B31
QFQADLLECKVVRP

SEQ ID NO: 103594 - protein, 14 aa, Borrelia burgdorferi B31
FQADLLECKVVRPK

SEQ ID NO: 103595 - protein, 14 aa, Borrelia burgdorferi B31
QADLLECKVVRPKI

SEQ ID NO: 103596 - protein, 14 aa, Borrelia burgdorferi B31
ADLLECKVVRPKIT

SEQ ID NO: 103597 - protein, 14 aa, Borrelia burgdorferi B31
DLLECKVVRPKITE

SEQ ID NO: 103598 - protein, 14 aa, Borrelia burgdorferi B31
LLECKVVRPKITET

SEQ ID NO: 103599 - protein, 14 aa, Borrelia burgdorferi B31
LECKVVRPKITETT

SEQ ID NO: 103600 - protein, 14 aa, Borrelia burgdorferi B31
ECKVVRPKITETTA

SEQ ID NO: 103601 - protein, 14 aa, Borrelia burgdorferi B31
CKVVRPKITETTAL

SEQ ID NO: 103602 - protein, 14 aa, Borrelia burgdorferi B31
KVVRPKITETTALG

SEQ ID NO: 103603 - protein, 14 aa, Borrelia burgdorferi B31
VVRPKITETTALGA

SEQ ID NO: 103604 - protein, 14 aa, Borrelia burgdorferi B31
VRPKITETTALGAA

SEQ ID NO: 103605 - protein, 14 aa, Borrelia burgdorferi B31
RPKITETTALGAAY

SEQ ID NO: 103606 - protein, 14 aa, Borrelia burgdorferi B31
PKITETTALGAAYL

SEQ ID NO: 103607 - protein, 14 aa, Borrelia burgdorferi B31
KITETTALGAAYLA

SEQ ID NO: 103608 - protein, 14 aa, Borrelia burgdorferi B31
ITETTALGAAYLAG

SEQ ID NO: 103609 - protein, 14 aa, Borrelia burgdorferi B31
TETTALGAAYLAGL

SEQ ID NO: 103610 - protein, 14 aa, Borrelia burgdorferi B31
ETTALGAAYLAGLA

SEQ ID NO: 103611 - protein, 14 aa, Borrelia burgdorferi B31
TTALGAAYLAGLAT

SEQ ID NO: 103612 - protein, 14 aa, Borrelia burgdorferi B31
TALGAAYLAGLATG

SEQ ID NO: 103613 - protein, 14 aa, Borrelia burgdorferi B31
ALGAAYLAGLATGY

SEQ ID NO: 103614 - protein, 14 aa, Borrelia burgdorferi B31
LGAAYLAGLATGYW

SEQ ID NO: 103615 - protein, 14 aa, Borrelia burgdorferi B31
GAAYLAGLATGYWQ

SEQ ID NO: 103616 - protein, 14 aa, Borrelia burgdorferi B31
AAYLAGLATGYWQS

SEQ ID NO: 103617 - protein, 14 aa, Borrelia burgdorferi B31
AYLAGLATGYWQSA

SEQ ID NO: 103618 - protein, 14 aa, Borrelia burgdorferi B31
YLAGLATGYWQSAE

SEQ ID NO: 103619 - protein, 14 aa, Borrelia burgdorferi B31
LAGLATGYWQSAEE

SEQ ID NO: 103620 - protein, 14 aa, Borrelia burgdorferi B31
AGLATGYWQSAEEI

SEQ ID NO: 103621 - protein, 14 aa, Borrelia burgdorferi B31
GLATGYWQSAEEIV

SEQ ID NO: 103622 - protein, 14 aa, Borrelia burgdorferi B31
LATGYWQSAEEIVS

SEQ ID NO: 103623 - protein, 14 aa, Borrelia burgdorferi B31
ATGYWQSAEEIVSL

SEQ ID NO: 103624 - protein, 14 aa, Borrelia burgdorferi B31
TGYWQSAEEIVSLW

SEQ ID NO: 103625 - protein, 14 aa, Borrelia burgdorferi B31
GYWQSAEEIVSLWQ

SEQ ID NO: 103626 - protein, 14 aa, Borrelia burgdorferi B31
YWQSAEEIVSLWQV

SEQ ID NO: 103627 - protein, 14 aa, Borrelia burgdorferi B31
WQSAEEIVSLWQVD

SEQ ID NO: 103628 - protein, 14 aa, Borrelia burgdorferi B31
QSAEEIVSLWQVDK

SEQ ID NO: 103629 - protein, 14 aa, Borrelia burgdorferi B31
SAEEIVSLWQVDKI

SEQ ID NO: 103630 - protein, 14 aa, Borrelia burgdorferi B31
AEEIVSLWQVDKIF

SEQ ID NO: 103631 - protein, 14 aa, Borrelia burgdorferi B31
EEIVSLWQVDKIFE

SEQ ID NO: 103632 - protein, 14 aa, Borrelia burgdorferi B31
EIVSLWQVDKIFEP

SEQ ID NO: 103633 - protein, 14 aa, Borrelia burgdorferi B31
IVSLWQVDKIFEPS

SEQ ID NO: 103634 - protein, 14 aa, Borrelia burgdorferi B31
VSLWQVDKIFEPSM

SEQ ID NO: 103635 - protein, 14 aa, Borrelia burgdorferi B31
SLWQVDKIFEPSMP

SEQ ID NO: 103636 - protein, 14 aa, Borrelia burgdorferi B31
LWQVDKIFEPSMPK

SEQ ID NO: 103637 - protein, 14 aa, Borrelia burgdorferi B31
WQVDKIFEPSMPKN

SEQ ID NO: 103638 - protein, 14 aa, Borrelia burgdorferi B31
QVDKIFEPSMPKNQ

SEQ ID NO: 103639 - protein, 14 aa, Borrelia burgdorferi B31
VDKIFEPSMPKNQK

SEQ ID NO: 103640 - protein, 14 aa, Borrelia burgdorferi B31
DKIFEPSMPKNQKE

SEQ ID NO: 103641 - protein, 14 aa, Borrelia burgdorferi B31
KIFEPSMPKNQKEK

SEQ ID NO: 103642 - protein, 14 aa, Borrelia burgdorferi B31
IFEPSMPKNQKEKL

SEQ ID NO: 103643 - protein, 14 aa, Borrelia burgdorferi B31
FEPSMPKNQKEKLL

SEQ ID NO: 103644 - protein, 14 aa, Borrelia burgdorferi B31
EPSMPKNQKEKLLE

SEQ ID NO: 103645 - protein, 14 aa, Borrelia burgdorferi B31
PSMPKNQKEKLLEN

SEQ ID NO: 103646 - protein, 14 aa, Borrelia burgdorferi B31
SMPKNQKEKLLENW

SEQ ID NO: 103647 - protein, 14 aa, Borrelia burgdorferi B31
MPKNQKEKLLENWN

SEQ ID NO: 103648 - protein, 14 aa, Borrelia burgdorferi B31
PKNQKEKLLENWNK

SEQ ID NO: 103649 - protein, 14 aa, Borrelia burgdorferi B31
KNQKEKLLENWNKA

SEQ ID NO: 103650 - protein, 14 aa, Borrelia burgdorferi B31
NQKEKLLENWNKAV

SEQ ID NO: 103651 - protein, 14 aa, Borrelia burgdorferi B31
QKEKLLENWNKAVG

SEQ ID NO: 103652 - protein, 14 aa, Borrelia burgdorferi B31
KEKLLENWNKAVGK

SEQ ID NO: 103653 - protein, 14 aa, Borrelia burgdorferi B31
EKLLENWNKAVGKA

SEQ ID NO: 103654 - protein, 14 aa, Borrelia burgdorferi B31
KLLENWNKAVGKAK

SEQ ID NO: 103655 - protein, 14 aa, Borrelia burgdorferi B31
LLENWNKAVGKAKS

SEQ ID NO: 103656 - protein, 14 aa, Borrelia burgdorferi B31
LENWNKAVGKAKSW

SEQ ID NO: 103657 - protein, 14 aa, Borrelia burgdorferi B31
ENWNKAVGKAKSWI

SEQ ID NO: 103658 - protein, 14 aa, Borrelia burgdorferi B31
NWNKAVGKAKSWIQ

SEQ ID NO: 103659 - protein, 14 aa, Borrelia burgdorferi B31
WNKAVGKAKSWIQN

SEQ ID NO: 103660 - protein, 14 aa, Borrelia burgdorferi B31
NKAVGKAKSWIQNS

SEQ ID NO: 103661 - protein, 14 aa, Borrelia burgdorferi B31
KAVGKAKSWIQNSH

SEQ ID NO: 103662 - protein, 14 aa, Borrelia burgdorferi B31
AVGKAKSWIQNSHS

SEQ ID NO: 103663 - protein, 14 aa, Borrelia burgdorferi B31
VGKAKSWIQNSHSS

SEQ ID NO: 103664 - protein, 15 aa, Borrelia burgdorferi B31
MKYILSIDQGTTSSR

SEQ ID NO: 103665 - protein, 15 aa, Borrelia burgdorferi B31
KYILSIDQGTTSSRA

SEQ ID NO: 103666 - protein, 15 aa, Borrelia burgdorferi B31
YILSIDQGTTSSRAM

SEQ ID NO: 103667 - protein, 15 aa, Borrelia burgdorferi B31
ILSIDQGTTSSRAMV

SEQ ID NO: 103668 - protein, 15 aa, Borrelia burgdorferi B31
LSIDQGTTSSRAMVF

SEQ ID NO: 103669 - protein, 15 aa, Borrelia burgdorferi B31
SIDQGTTSSRAMVFD

SEQ ID NO: 103670 - protein, 15 aa, Borrelia burgdorferi B31
IDQGTTSSRAMVFDK

SEQ ID NO: 103671 - protein, 15 aa, Borrelia burgdorferi B31
DQGTTSSRAMVFDKN

SEQ ID NO: 103672 - protein, 15 aa, Borrelia burgdorferi B31
QGTTSSRAMVFDKNA

SEQ ID NO: 103673 - protein, 15 aa, Borrelia burgdorferi B31
GTTSSRAMVFDKNAN

SEQ ID NO: 103674 - protein, 15 aa, Borrelia burgdorferi B31
TTSSRAMVFDKNANI

SEQ ID NO: 103675 - protein, 15 aa, Borrelia burgdorferi B31
TSSRAMVFDKNANIK

SEQ ID NO: 103676 - protein, 15 aa, Borrelia burgdorferi B31
SSRAMVFDKNANIKG

SEQ ID NO: 103677 - protein, 15 aa, Borrelia burgdorferi B31
SRAMVFDKNANIKGF

SEQ ID NO: 103678 - protein, 15 aa, Borrelia burgdorferi B31
RAMVFDKNANIKGFA

SEQ ID NO: 103679 - protein, 15 aa, Borrelia burgdorferi B31
AMVFDKNANIKGFAQ

SEQ ID NO: 103680 - protein, 15 aa, Borrelia burgdorferi B31
MVFDKNANIKGFAQK

SEQ ID NO: 103681 - protein, 15 aa, Borrelia burgdorferi B31
VFDKNANIKGFAQKE

SEQ ID NO: 103682 - protein, 15 aa, Borrelia burgdorferi B31
FDKNANIKGFAQKEF

SEQ ID NO: 103683 - protein, 15 aa, Borrelia burgdorferi B31
DKNANIKGFAQKEFT

SEQ ID NO: 103684 - protein, 15 aa, Borrelia burgdorferi B31
KNANIKGFAQKEFTQ

SEQ ID NO: 103685 - protein, 15 aa, Borrelia burgdorferi B31
NANIKGFAQKEFTQI

SEQ ID NO: 103686 - protein, 15 aa, Borrelia burgdorferi B31
ANIKGFAQKEFTQIY

SEQ ID NO: 103687 - protein, 15 aa, Borrelia burgdorferi B31
NIKGFAQKEFTQIYP

SEQ ID NO: 103688 - protein, 15 aa, Borrelia burgdorferi B31
IKGFAQKEFTQIYPQ

SEQ ID NO: 103689 - protein, 15 aa, Borrelia burgdorferi B31
KGFAQKEFTQIYPQP

SEQ ID NO: 103690 - protein, 15 aa, Borrelia burgdorferi B31
GFAQKEFTQIYPQPS

SEQ ID NO: 103691 - protein, 15 aa, Borrelia burgdorferi B31
FAQKEFTQIYPQPSW

SEQ ID NO: 103692 - protein, 15 aa, Borrelia burgdorferi B31
AQKEFTQIYPQPSWV

SEQ ID NO: 103693 - protein, 15 aa, Borrelia burgdorferi B31
QKEFTQIYPQPSWVE

SEQ ID NO: 103694 - protein, 15 aa, Borrelia burgdorferi B31
KEFTQIYPQPSWVEH

SEQ ID NO: 103695 - protein, 15 aa, Borrelia burgdorferi B31
EFTQIYPQPSWVEHD

SEQ ID NO: 103696 - protein, 15 aa, Borrelia burgdorferi B31
FTQIYPQPSWVEHDP

SEQ ID NO: 103697 - protein, 15 aa, Borrelia burgdorferi B31
TQIYPQPSWVEHDPT

SEQ ID NO: 103698 - protein, 15 aa, Borrelia burgdorferi B31
QIYPQPSWVEHDPTE

SEQ ID NO: 103699 - protein, 15 aa, Borrelia burgdorferi B31
IYPQPSWVEHDPTEI

SEQ ID NO: 103700 - protein, 15 aa, Borrelia burgdorferi B31
YPQPSWVEHDPTEIW

SEQ ID NO: 103701 - protein, 15 aa, Borrelia burgdorferi B31
PQPSWVEHDPTEIWG

SEQ ID NO: 103702 - protein, 15 aa, Borrelia burgdorferi B31
QPSWVEHDPTEIWGS

SEQ ID NO: 103703 - protein, 15 aa, Borrelia burgdorferi B31
PSWVEHDPTEIWGSQ

SEQ ID NO: 103704 - protein, 15 aa, Borrelia burgdorferi B31
SWVEHDPTEIWGSQL

SEQ ID NO: 103705 - protein, 15 aa, Borrelia burgdorferi B31
WVEHDPTEIWGSQLG

SEQ ID NO: 103706 - protein, 15 aa, Borrelia burgdorferi B31
VEHDPTEIWGSQLGV

SEQ ID NO: 103707 - protein, 15 aa, Borrelia burgdorferi B31
EHDPTEIWGSQLGVI

SEQ ID NO: 103708 - protein, 15 aa, Borrelia burgdorferi B31
HDPTEIWGSQLGVIT

SEQ ID NO: 103709 - protein, 15 aa, Borrelia burgdorferi B31
DPTEIWGSQLGVITE

SEQ ID NO: 103710 - protein, 15 aa, Borrelia burgdorferi B31
PTEIWGSQLGVITEA

SEQ ID NO: 103711 - protein, 15 aa, Borrelia burgdorferi B31
TEIWGSQLGVITEAM

SEQ ID NO: 103712 - protein, 15 aa, Borrelia burgdorferi B31
EIWGSQLGVITEAMA

SEQ ID NO: 103713 - protein, 15 aa, Borrelia burgdorferi B31
IWGSQLGVITEAMAN

SEQ ID NO: 103714 - protein, 15 aa, Borrelia burgdorferi B31
WGSQLGVITEAMANA

SEQ ID NO: 103715 - protein, 15 aa, Borrelia burgdorferi B31
GSQLGVITEAMANAR

SEQ ID NO: 103716 - protein, 15 aa, Borrelia burgdorferi B31
SQLGVITEAMANARI

SEQ ID NO: 103717 - protein, 15 aa, Borrelia burgdorferi B31
QLGVITEAMANARIL

SEQ ID NO: 103718 - protein, 15 aa, Borrelia burgdorferi B31
LGVITEAMANARILP

SEQ ID NO: 103719 - protein, 15 aa, Borrelia burgdorferi B31
GVITEAMANARILPN

SEQ ID NO: 103720 - protein, 15 aa, Borrelia burgdorferi B31
VITEAMANARILPNE

SEQ ID NO: 103721 - protein, 15 aa, Borrelia burgdorferi B31
ITEAMANARILPNEI

SEQ ID NO: 103722 - protein, 15 aa, Borrelia burgdorferi B31
TEAMANARILPNEID

SEQ ID NO: 103723 - protein, 15 aa, Borrelia burgdorferi B31
EAMANARILPNEIDA

SEQ ID NO: 103724 - protein, 15 aa, Borrelia burgdorferi B31
AMANARILPNEIDAI

SEQ ID NO: 103725 - protein, 15 aa, Borrelia burgdorferi B31
MANARILPNEIDAIG

SEQ ID NO: 103726 - protein, 15 aa, Borrelia burgdorferi B31
ANARILPNEIDAIGI

SEQ ID NO: 103727 - protein, 15 aa, Borrelia burgdorferi B31
NARILPNEIDAIGIT

SEQ ID NO: 103728 - protein, 15 aa, Borrelia burgdorferi B31
ARILPNEIDAIGITN

SEQ ID NO: 103729 - protein, 15 aa, Borrelia burgdorferi B31
RILPNEIDAIGITNQ

SEQ ID NO: 103730 - protein, 15 aa, Borrelia burgdorferi B31
ILPNEIDAIGITNQR

SEQ ID NO: 103731 - protein, 15 aa, Borrelia burgdorferi B31
LPNEIDAIGITNQRE

SEQ ID NO: 103732 - protein, 15 aa, Borrelia burgdorferi B31
PNEIDAIGITNQRET

SEQ ID NO: 103733 - protein, 15 aa, Borrelia burgdorferi B31
NEIDAIGITNQRETT

SEQ ID NO: 103734 - protein, 15 aa, Borrelia burgdorferi B31
EIDAIGITNQRETTV

SEQ ID NO: 103735 - protein, 15 aa, Borrelia burgdorferi B31
IDAIGITNQRETTVI

SEQ ID NO: 103736 - protein, 15 aa, Borrelia burgdorferi B31
DAIGITNQRETTVIW

SEQ ID NO: 103737 - protein, 15 aa, Borrelia burgdorferi B31
AIGITNQRETTVIWE

SEQ ID NO: 103738 - protein, 15 aa, Borrelia burgdorferi B31
IGITNQRETTVIWEK

SEQ ID NO: 103739 - protein, 15 aa, Borrelia burgdorferi B31
GITNQRETTVIWEKN

SEQ ID NO: 103740 - protein, 15 aa, Borrelia burgdorferi B31
ITNQRETTVIWEKNT

SEQ ID NO: 103741 - protein, 15 aa, Borrelia burgdorferi B31
TNQRETTVIWEKNTG

SEQ ID NO: 103742 - protein, 15 aa, Borrelia burgdorferi B31
NQRETTVIWEKNTGK

SEQ ID NO: 103743 - protein, 15 aa, Borrelia burgdorferi B31
QRETTVIWEKNTGKP

SEQ ID NO: 103744 - protein, 15 aa, Borrelia burgdorferi B31
RETTVIWEKNTGKPI

SEQ ID NO: 103745 - protein, 15 aa, Borrelia burgdorferi B31
ETTVIWEKNTGKPIY

SEQ ID NO: 103746 - protein, 15 aa, Borrelia burgdorferi B31
TTVIWEKNTGKPIYN

SEQ ID NO: 103747 - protein, 15 aa, Borrelia burgdorferi B31
TVIWEKNTGKPIYNA

SEQ ID NO: 103748 - protein, 15 aa, Borrelia burgdorferi B31
VIWEKNTGKPIYNAI

SEQ ID NO: 103749 - protein, 15 aa, Borrelia burgdorferi B31
IWEKNTGKPIYNAIV

SEQ ID NO: 103750 - protein, 15 aa, Borrelia burgdorferi B31
WEKNTGKPIYNAIVW

SEQ ID NO: 103751 - protein, 15 aa, Borrelia burgdorferi B31
EKNTGKPIYNAIVWQ

SEQ ID NO: 103752 - protein, 15 aa, Borrelia burgdorferi B31
KNTGKPIYNAIVWQD

SEQ ID NO: 103753 - protein, 15 aa, Borrelia burgdorferi B31
NTGKPIYNAIVWQDR

SEQ ID NO: 103754 - protein, 15 aa, Borrelia burgdorferi B31
TGKPIYNAIVWQDRR

SEQ ID NO: 103755 - protein, 15 aa, Borrelia burgdorferi B31
GKPIYNAIVWQDRRT

SEQ ID NO: 103756 - protein, 15 aa, Borrelia burgdorferi B31
KPIYNAIVWQDRRTA

SEQ ID NO: 103757 - protein, 15 aa, Borrelia burgdorferi B31
PIYNAIVWQDRRTAK

SEQ ID NO: 103758 - protein, 15 aa, Borrelia burgdorferi B31
IYNAIVWQDRRTAKI

SEQ ID NO: 103759 - protein, 15 aa, Borrelia burgdorferi B31
YNAIVWQDRRTAKIC

SEQ ID NO: 103760 - protein, 15 aa, Borrelia burgdorferi B31
NAIVWQDRRTAKICD

SEQ ID NO: 103761 - protein, 15 aa, Borrelia burgdorferi B31
AIVWQDRRTAKICDQ

SEQ ID NO: 103762 - protein, 15 aa, Borrelia burgdorferi B31
IVWQDRRTAKICDQL

SEQ ID NO: 103763 - protein, 15 aa, Borrelia burgdorferi B31
VWQDRRTAKICDQLK

SEQ ID NO: 103764 - protein, 15 aa, Borrelia burgdorferi B31
WQDRRTAKICDQLKK

SEQ ID NO: 103765 - protein, 15 aa, Borrelia burgdorferi B31
QDRRTAKICDQLKKE

SEQ ID NO: 103766 - protein, 15 aa, Borrelia burgdorferi B31
DRRTAKICDQLKKEG

SEQ ID NO: 103767 - protein, 15 aa, Borrelia burgdorferi B31
RRTAKICDQLKKEGK

SEQ ID NO: 103768 - protein, 15 aa, Borrelia burgdorferi B31
RTAKICDQLKKEGKD

SEQ ID NO: 103769 - protein, 15 aa, Borrelia burgdorferi B31
TAKICDQLKKEGKDK

SEQ ID NO: 103770 - protein, 15 aa, Borrelia burgdorferi B31
AKICDQLKKEGKDKI

SEQ ID NO: 103771 - protein, 15 aa, Borrelia burgdorferi B31
KICDQLKKEGKDKII

SEQ ID NO: 103772 - protein, 15 aa, Borrelia burgdorferi B31
ICDQLKKEGKDKIIL

SEQ ID NO: 103773 - protein, 15 aa, Borrelia burgdorferi B31
CDQLKKEGKDKIILE

SEQ ID NO: 103774 - protein, 15 aa, Borrelia burgdorferi B31
DQLKKEGKDKIILEK

SEQ ID NO: 103775 - protein, 15 aa, Borrelia burgdorferi B31
QLKKEGKDKIILEKT

SEQ ID NO: 103776 - protein, 15 aa, Borrelia burgdorferi B31
LKKEGKDKIILEKTG

SEQ ID NO: 103777 - protein, 15 aa, Borrelia burgdorferi B31
KKEGKDKIILEKTGL

SEQ ID NO: 103778 - protein, 15 aa, Borrelia burgdorferi B31
KEGKDKIILEKTGLV

SEQ ID NO: 103779 - protein, 15 aa, Borrelia burgdorferi B31
EGKDKIILEKTGLVL

SEQ ID NO: 103780 - protein, 15 aa, Borrelia burgdorferi B31
GKDKIILEKTGLVLD

SEQ ID NO: 103781 - protein, 15 aa, Borrelia burgdorferi B31
KDKIILEKTGLVLDS

SEQ ID NO: 103782 - protein, 15 aa, Borrelia burgdorferi B31
DKIILEKTGLVLDSY

SEQ ID NO: 103783 - protein, 15 aa, Borrelia burgdorferi B31
KIILEKTGLVLDSYF

SEQ ID NO: 103784 - protein, 15 aa, Borrelia burgdorferi B31
IILEKTGLVLDSYFS

SEQ ID NO: 103785 - protein, 15 aa, Borrelia burgdorferi B31
ILEKTGLVLDSYFSG

SEQ ID NO: 103786 - protein, 15 aa, Borrelia burgdorferi B31
LEKTGLVLDSYFSGT

SEQ ID NO: 103787 - protein, 15 aa, Borrelia burgdorferi B31
EKTGLVLDSYFSGTK

SEQ ID NO: 103788 - protein, 15 aa, Borrelia burgdorferi B31
KTGLVLDSYFSGTKI

SEQ ID NO: 103789 - protein, 15 aa, Borrelia burgdorferi B31
TGLVLDSYFSGTKIM

SEQ ID NO: 103790 - protein, 15 aa, Borrelia burgdorferi B31
GLVLDSYFSGTKIMW

SEQ ID NO: 103791 - protein, 15 aa, Borrelia burgdorferi B31
LVLDSYFSGTKIMWI

SEQ ID NO: 103792 - protein, 15 aa, Borrelia burgdorferi B31
VLDSYFSGTKIMWIL

SEQ ID NO: 103793 - protein, 15 aa, Borrelia burgdorferi B31
LDSYFSGTKIMWILD

SEQ ID NO: 103794 - protein, 15 aa, Borrelia burgdorferi B31
DSYFSGTKIMWILDN

SEQ ID NO: 103795 - protein, 15 aa, Borrelia burgdorferi B31
SYFSGTKIMWILDNV

SEQ ID NO: 103796 - protein, 15 aa, Borrelia burgdorferi B31
YFSGTKIMWILDNVE

SEQ ID NO: 103797 - protein, 15 aa, Borrelia burgdorferi B31
FSGTKIMWILDNVEG

SEQ ID NO: 103798 - protein, 15 aa, Borrelia burgdorferi B31
SGTKIMWILDNVEGA

SEQ ID NO: 103799 - protein, 15 aa, Borrelia burgdorferi B31
GTKIMWILDNVEGAR

SEQ ID NO: 103800 - protein, 15 aa, Borrelia burgdorferi B31
TKIMWILDNVEGARQ

SEQ ID NO: 103801 - protein, 15 aa, Borrelia burgdorferi B31
KIMWILDNVEGARQR

SEQ ID NO: 103802 - protein, 15 aa, Borrelia burgdorferi B31
IMWILDNVEGARQRA

SEQ ID NO: 103803 - protein, 15 aa, Borrelia burgdorferi B31
MWILDNVEGARQRAE

SEQ ID NO: 103804 - protein, 15 aa, Borrelia burgdorferi B31
WILDNVEGARQRAEN

SEQ ID NO: 103805 - protein, 15 aa, Borrelia burgdorferi B31
ILDNVEGARQRAENG

SEQ ID NO: 103806 - protein, 15 aa, Borrelia burgdorferi B31
LDNVEGARQRAENGE

SEQ ID NO: 103807 - protein, 15 aa, Borrelia burgdorferi B31
DNVEGARQRAENGEL

SEQ ID NO: 103808 - protein, 15 aa, Borrelia burgdorferi B31
NVEGARQRAENGELC

SEQ ID NO: 103809 - protein, 15 aa, Borrelia burgdorferi B31
VEGARQRAENGELCF

SEQ ID NO: 103810 - protein, 15 aa, Borrelia burgdorferi B31
EGARQRAENGELCFG

SEQ ID NO: 103811 - protein, 15 aa, Borrelia burgdorferi B31
GARQRAENGELCFGT

SEQ ID NO: 103812 - protein, 15 aa, Borrelia burgdorferi B31
ARQRAENGELCFGTI

SEQ ID NO: 103813 - protein, 15 aa, Borrelia burgdorferi B31
RQRAENGELCFGTID

SEQ ID NO: 103814 - protein, 15 aa, Borrelia burgdorferi B31
QRAENGELCFGTIDT

SEQ ID NO: 103815 - protein, 15 aa, Borrelia burgdorferi B31
RAENGELCFGTIDTW

SEQ ID NO: 103816 - protein, 15 aa, Borrelia burgdorferi B31
AENGELCFGTIDTWI

SEQ ID NO: 103817 - protein, 15 aa, Borrelia burgdorferi B31
ENGELCFGTIDTWIL

SEQ ID NO: 103818 - protein, 15 aa, Borrelia burgdorferi B31
NGELCFGTIDTWILW

SEQ ID NO: 103819 - protein, 15 aa, Borrelia burgdorferi B31
GELCFGTIDTWILWN

SEQ ID NO: 103820 - protein, 15 aa, Borrelia burgdorferi B31
ELCFGTIDTWILWNL

SEQ ID NO: 103821 - protein, 15 aa, Borrelia burgdorferi B31
LCFGTIDTWILWNLT

SEQ ID NO: 103822 - protein, 15 aa, Borrelia burgdorferi B31
CFGTIDTWILWNLTQ

SEQ ID NO: 103823 - protein, 15 aa, Borrelia burgdorferi B31
FGTIDTWILWNLTQK

SEQ ID NO: 103824 - protein, 15 aa, Borrelia burgdorferi B31
GTIDTWILWNLTQKK

SEQ ID NO: 103825 - protein, 15 aa, Borrelia burgdorferi B31
TIDTWILWNLTQKKE

SEQ ID NO: 103826 - protein, 15 aa, Borrelia burgdorferi B31
IDTWILWNLTQKKEH

SEQ ID NO: 103827 - protein, 15 aa, Borrelia burgdorferi B31
DTWILWNLTQKKEHA

SEQ ID NO: 103828 - protein, 15 aa, Borrelia burgdorferi B31
TWILWNLTQKKEHAT

SEQ ID NO: 103829 - protein, 15 aa, Borrelia burgdorferi B31
WILWNLTQKKEHATD

SEQ ID NO: 103830 - protein, 15 aa, Borrelia burgdorferi B31
ILWNLTQKKEHATDY

SEQ ID NO: 103831 - protein, 15 aa, Borrelia burgdorferi B31
LWNLTQKKEHATDYS

SEQ ID NO: 103832 - protein, 15 aa, Borrelia burgdorferi B31
WNLTQKKEHATDYSN

SEQ ID NO: 103833 - protein, 15 aa, Borrelia burgdorferi B31
NLTQKKEHATDYSNA

SEQ ID NO: 103834 - protein, 15 aa, Borrelia burgdorferi B31
LTQKKEHATDYSNAS

SEQ ID NO: 103835 - protein, 15 aa, Borrelia burgdorferi B31
TQKKEHATDYSNASR

SEQ ID NO: 103836 - protein, 15 aa, Borrelia burgdorferi B31
QKKEHATDYSNASRT

SEQ ID NO: 103837 - protein, 15 aa, Borrelia burgdorferi B31
KKEHATDYSNASRTL

SEQ ID NO: 103838 - protein, 15 aa, Borrelia burgdorferi B31
KEHATDYSNASRTLL

SEQ ID NO: 103839 - protein, 15 aa, Borrelia burgdorferi B31
EHATDYSNASRTLLL

SEQ ID NO: 103840 - protein, 15 aa, Borrelia burgdorferi B31
HATDYSNASRTLLLN

SEQ ID NO: 103841 - protein, 15 aa, Borrelia burgdorferi B31
ATDYSNASRTLLLNI

SEQ ID NO: 103842 - protein, 15 aa, Borrelia burgdorferi B31
TDYSNASRTLLLNIK

SEQ ID NO: 103843 - protein, 15 aa, Borrelia burgdorferi B31
DYSNASRTLLLNIKT

SEQ ID NO: 103844 - protein, 15 aa, Borrelia burgdorferi B31
YSNASRTLLLNIKTL

SEQ ID NO: 103845 - protein, 15 aa, Borrelia burgdorferi B31
SNASRTLLLNIKTLE

SEQ ID NO: 103846 - protein, 15 aa, Borrelia burgdorferi B31
NASRTLLLNIKTLEW

SEQ ID NO: 103847 - protein, 15 aa, Borrelia burgdorferi B31
ASRTLLLNIKTLEWD

SEQ ID NO: 103848 - protein, 15 aa, Borrelia burgdorferi B31
SRTLLLNIKTLEWDD

SEQ ID NO: 103849 - protein, 15 aa, Borrelia burgdorferi B31
RTLLLNIKTLEWDDE

SEQ ID NO: 103850 - protein, 15 aa, Borrelia burgdorferi B31
TLLLNIKTLEWDDEL

SEQ ID NO: 103851 - protein, 15 aa, Borrelia burgdorferi B31
LLLNIKTLEWDDELL

SEQ ID NO: 103852 - protein, 15 aa, Borrelia burgdorferi B31
LLNIKTLEWDDELLS

SEQ ID NO: 103853 - protein, 15 aa, Borrelia burgdorferi B31
LNIKTLEWDDELLSI

SEQ ID NO: 103854 - protein, 15 aa, Borrelia burgdorferi B31
NIKTLEWDDELLSIL

SEQ ID NO: 103855 - protein, 15 aa, Borrelia burgdorferi B31
IKTLEWDDELLSILN

SEQ ID NO: 103856 - protein, 15 aa, Borrelia burgdorferi B31
KTLEWDDELLSILNV

SEQ ID NO: 103857 - protein, 15 aa, Borrelia burgdorferi B31
TLEWDDELLSILNVP

SEQ ID NO: 103858 - protein, 15 aa, Borrelia burgdorferi B31
LEWDDELLSILNVPR

SEQ ID NO: 103859 - protein, 15 aa, Borrelia burgdorferi B31
EWDDELLSILNVPRA

SEQ ID NO: 103860 - protein, 15 aa, Borrelia burgdorferi B31
WDDELLSILNVPRAI

SEQ ID NO: 103861 - protein, 15 aa, Borrelia burgdorferi B31
DDELLSILNVPRAIL

SEQ ID NO: 103862 - protein, 15 aa, Borrelia burgdorferi B31
DELLSILNVPRAILP

SEQ ID NO: 103863 - protein, 15 aa, Borrelia burgdorferi B31
ELLSILNVPRAILPE

SEQ ID NO: 103864 - protein, 15 aa, Borrelia burgdorferi B31
LLSILNVPRAILPEL

SEQ ID NO: 103865 - protein, 15 aa, Borrelia burgdorferi B31
LSILNVPRAILPELK

SEQ ID NO: 103866 - protein, 15 aa, Borrelia burgdorferi B31
SILNVPRAILPELKE

SEQ ID NO: 103867 - protein, 15 aa, Borrelia burgdorferi B31
ILNVPRAILPELKES

SEQ ID NO: 103868 - protein, 15 aa, Borrelia burgdorferi B31
LNVPRAILPELKESS

SEQ ID NO: 103869 - protein, 15 aa, Borrelia burgdorferi B31
NVPRAILPELKESST

SEQ ID NO: 103870 - protein, 15 aa, Borrelia burgdorferi B31
VPRAILPELKESSTI

SEQ ID NO: 103871 - protein, 15 aa, Borrelia burgdorferi B31
PRAILPELKESSTIY

SEQ ID NO: 103872 - protein, 15 aa, Borrelia burgdorferi B31
RAILPELKESSTIYG

SEQ ID NO: 103873 - protein, 15 aa, Borrelia burgdorferi B31
AILPELKESSTIYGK

SEQ ID NO: 103874 - protein, 15 aa, Borrelia burgdorferi B31
ILPELKESSTIYGKT

SEQ ID NO: 103875 - protein, 15 aa, Borrelia burgdorferi B31
LPELKESSTIYGKTD

SEQ ID NO: 103876 - protein, 15 aa, Borrelia burgdorferi B31
PELKESSTIYGKTDK

SEQ ID NO: 103877 - protein, 15 aa, Borrelia burgdorferi B31
ELKESSTIYGKTDKA

SEQ ID NO: 103878 - protein, 15 aa, Borrelia burgdorferi B31
LKESSTIYGKTDKAL

SEQ ID NO: 103879 - protein, 15 aa, Borrelia burgdorferi B31
KESSTIYGKTDKALF

SEQ ID NO: 103880 - protein, 15 aa, Borrelia burgdorferi B31
ESSTIYGKTDKALFG

SEQ ID NO: 103881 - protein, 15 aa, Borrelia burgdorferi B31
SSTIYGKTDKALFGA

SEQ ID NO: 103882 - protein, 15 aa, Borrelia burgdorferi B31
STIYGKTDKALFGAE

SEQ ID NO: 103883 - protein, 15 aa, Borrelia burgdorferi B31
TIYGKTDKALFGAEI

SEQ ID NO: 103884 - protein, 15 aa, Borrelia burgdorferi B31
IYGKTDKALFGAEIP

SEQ ID NO: 103885 - protein, 15 aa, Borrelia burgdorferi B31
YGKTDKALFGAEIPI

SEQ ID NO: 103886 - protein, 15 aa, Borrelia burgdorferi B31
GKTDKALFGAEIPIA

SEQ ID NO: 103887 - protein, 15 aa, Borrelia burgdorferi B31
KTDKALFGAEIPIAG

SEQ ID NO: 103888 - protein, 15 aa, Borrelia burgdorferi B31
TDKALFGAEIPIAGI

SEQ ID NO: 103889 - protein, 15 aa, Borrelia burgdorferi B31
DKALFGAEIPIAGIA

SEQ ID NO: 103890 - protein, 15 aa, Borrelia burgdorferi B31
KALFGAEIPIAGIAG

SEQ ID NO: 103891 - protein, 15 aa, Borrelia burgdorferi B31
ALFGAEIPIAGIAGD

SEQ ID NO: 103892 - protein, 15 aa, Borrelia burgdorferi B31
LFGAEIPIAGIAGDQ

SEQ ID NO: 103893 - protein, 15 aa, Borrelia burgdorferi B31
FGAEIPIAGIAGDQF

SEQ ID NO: 103894 - protein, 15 aa, Borrelia burgdorferi B31
GAEIPIAGIAGDQFA

SEQ ID NO: 103895 - protein, 15 aa, Borrelia burgdorferi B31
AEIPIAGIAGDQFAA

SEQ ID NO: 103896 - protein, 15 aa, Borrelia burgdorferi B31
EIPIAGIAGDQFAAT

SEQ ID NO: 103897 - protein, 15 aa, Borrelia burgdorferi B31
IPIAGIAGDQFAATF

SEQ ID NO: 103898 - protein, 15 aa, Borrelia burgdorferi B31
PIAGIAGDQFAATFG

SEQ ID NO: 103899 - protein, 15 aa, Borrelia burgdorferi B31
IAGIAGDQFAATFGQ

SEQ ID NO: 103900 - protein, 15 aa, Borrelia burgdorferi B31
AGIAGDQFAATFGQA

SEQ ID NO: 103901 - protein, 15 aa, Borrelia burgdorferi B31
GIAGDQFAATFGQAC

SEQ ID NO: 103902 - protein, 15 aa, Borrelia burgdorferi B31
IAGDQFAATFGQACL

SEQ ID NO: 103903 - protein, 15 aa, Borrelia burgdorferi B31
AGDQFAATFGQACLK

SEQ ID NO: 103904 - protein, 15 aa, Borrelia burgdorferi B31
GDQFAATFGQACLKK

SEQ ID NO: 103905 - protein, 15 aa, Borrelia burgdorferi B31
DQFAATFGQACLKKG

SEQ ID NO: 103906 - protein, 15 aa, Borrelia burgdorferi B31
QFAATFGQACLKKGM

SEQ ID NO: 103907 - protein, 15 aa, Borrelia burgdorferi B31
FAATFGQACLKKGMA

SEQ ID NO: 103908 - protein, 15 aa, Borrelia burgdorferi B31
AATFGQACLKKGMAK

SEQ ID NO: 103909 - protein, 15 aa, Borrelia burgdorferi B31
ATFGQACLKKGMAKN

SEQ ID NO: 103910 - protein, 15 aa, Borrelia burgdorferi B31
TFGQACLKKGMAKNT

SEQ ID NO: 103911 - protein, 15 aa, Borrelia burgdorferi B31
FGQACLKKGMAKNTY

SEQ ID NO: 103912 - protein, 15 aa, Borrelia burgdorferi B31
GQACLKKGMAKNTYG

SEQ ID NO: 103913 - protein, 15 aa, Borrelia burgdorferi B31
QACLKKGMAKNTYGT

SEQ ID NO: 103914 - protein, 15 aa, Borrelia burgdorferi B31
ACLKKGMAKNTYGTG

SEQ ID NO: 103915 - protein, 15 aa, Borrelia burgdorferi B31
CLKKGMAKNTYGTGC

SEQ ID NO: 103916 - protein, 15 aa, Borrelia burgdorferi B31
LKKGMAKNTYGTGCF

SEQ ID NO: 103917 - protein, 15 aa, Borrelia burgdorferi B31
KKGMAKNTYGTGCFL

SEQ ID NO: 103918 - protein, 15 aa, Borrelia burgdorferi B31
KGMAKNTYGTGCFLT

SEQ ID NO: 103919 - protein, 15 aa, Borrelia burgdorferi B31
GMAKNTYGTGCFLTV

SEQ ID NO: 103920 - protein, 15 aa, Borrelia burgdorferi B31
MAKNTYGTGCFLTVN

SEQ ID NO: 103921 - protein, 15 aa, Borrelia burgdorferi B31
AKNTYGTGCFLTVNI

SEQ ID NO: 103922 - protein, 15 aa, Borrelia burgdorferi B31
KNTYGTGCFLTVNIG

SEQ ID NO: 103923 - protein, 15 aa, Borrelia burgdorferi B31
NTYGTGCFLTVNIGK

SEQ ID NO: 103924 - protein, 15 aa, Borrelia burgdorferi B31
TYGTGCFLTVNIGKE

SEQ ID NO: 103925 - protein, 15 aa, Borrelia burgdorferi B31
YGTGCFLTVNIGKEP

SEQ ID NO: 103926 - protein, 15 aa, Borrelia burgdorferi B31
GTGCFLTVNIGKEPI

SEQ ID NO: 103927 - protein, 15 aa, Borrelia burgdorferi B31
TGCFLTVNIGKEPII

SEQ ID NO: 103928 - protein, 15 aa, Borrelia burgdorferi B31
GCFLTVNIGKEPIIS

SEQ ID NO: 103929 - protein, 15 aa, Borrelia burgdorferi B31
CFLTVNIGKEPIISH

SEQ ID NO: 103930 - protein, 15 aa, Borrelia burgdorferi B31
FLTVNIGKEPIISHD

SEQ ID NO: 103931 - protein, 15 aa, Borrelia burgdorferi B31
LTVNIGKEPIISHDK

SEQ ID NO: 103932 - protein, 15 aa, Borrelia burgdorferi B31
TVNIGKEPIISHDKL

SEQ ID NO: 103933 - protein, 15 aa, Borrelia burgdorferi B31
VNIGKEPIISHDKLL

SEQ ID NO: 103934 - protein, 15 aa, Borrelia burgdorferi B31
NIGKEPIISHDKLLT

SEQ ID NO: 103935 - protein, 15 aa, Borrelia burgdorferi B31
IGKEPIISHDKLLTS

SEQ ID NO: 103936 - protein, 15 aa, Borrelia burgdorferi B31
GKEPIISHDKLLTSI

SEQ ID NO: 103937 - protein, 15 aa, Borrelia burgdorferi B31
KEPIISHDKLLTSIA

SEQ ID NO: 103938 - protein, 15 aa, Borrelia burgdorferi B31
EPIISHDKLLTSIAW

SEQ ID NO: 103939 - protein, 15 aa, Borrelia burgdorferi B31
PIISHDKLLTSIAWG

SEQ ID NO: 103940 - protein, 15 aa, Borrelia burgdorferi B31
IISHDKLLTSIAWGR

SEQ ID NO: 103941 - protein, 15 aa, Borrelia burgdorferi B31
ISHDKLLTSIAWGRK

SEQ ID NO: 103942 - protein, 15 aa, Borrelia burgdorferi B31
SHDKLLTSIAWGRKK

SEQ ID NO: 103943 - protein, 15 aa, Borrelia burgdorferi B31
HDKLLTSIAWGRKKS

SEQ ID NO: 103944 - protein, 15 aa, Borrelia burgdorferi B31
DKLLTSIAWGRKKSV

SEQ ID NO: 103945 - protein, 15 aa, Borrelia burgdorferi B31
KLLTSIAWGRKKSVT

SEQ ID NO: 103946 - protein, 15 aa, Borrelia burgdorferi B31
LLTSIAWGRKKSVTY

SEQ ID NO: 103947 - protein, 15 aa, Borrelia burgdorferi B31
LTSIAWGRKKSVTYV

SEQ ID NO: 103948 - protein, 15 aa, Borrelia burgdorferi B31
TSIAWGRKKSVTYVL

SEQ ID NO: 103949 - protein, 15 aa, Borrelia burgdorferi B31
SIAWGRKKSVTYVLE

SEQ ID NO: 103950 - protein, 15 aa, Borrelia burgdorferi B31
IAWGRKKSVTYVLEG

SEQ ID NO: 103951 - protein, 15 aa, Borrelia burgdorferi B31
AWGRKKSVTYVLEGS

SEQ ID NO: 103952 - protein, 15 aa, Borrelia burgdorferi B31
WGRKKSVTYVLEGSV

SEQ ID NO: 103953 - protein, 15 aa, Borrelia burgdorferi B31
GRKKSVTYVLEGSVF

SEQ ID NO: 103954 - protein, 15 aa, Borrelia burgdorferi B31
RKKSVTYVLEGSVFI

SEQ ID NO: 103955 - protein, 15 aa, Borrelia burgdorferi B31
KKSVTYVLEGSVFIG

SEQ ID NO: 103956 - protein, 15 aa, Borrelia burgdorferi B31
KSVTYVLEGSVFIGG

SEQ ID NO: 103957 - protein, 15 aa, Borrelia burgdorferi B31
SVTYVLEGSVFIGGA

SEQ ID NO: 103958 - protein, 15 aa, Borrelia burgdorferi B31
VTYVLEGSVFIGGAV

SEQ ID NO: 103959 - protein, 15 aa, Borrelia burgdorferi B31
TYVLEGSVFIGGAVI

SEQ ID NO: 103960 - protein, 15 aa, Borrelia burgdorferi B31
YVLEGSVFIGGAVIQ

SEQ ID NO: 103961 - protein, 15 aa, Borrelia burgdorferi B31
VLEGSVFIGGAVIQW

SEQ ID NO: 103962 - protein, 15 aa, Borrelia burgdorferi B31
LEGSVFIGGAVIQWL

SEQ ID NO: 103963 - protein, 15 aa, Borrelia burgdorferi B31
EGSVFIGGAVIQWLR

SEQ ID NO: 103964 - protein, 15 aa, Borrelia burgdorferi B31
GSVFIGGAVIQWLRD

SEQ ID NO: 103965 - protein, 15 aa, Borrelia burgdorferi B31
SVFIGGAVIQWLRDG

SEQ ID NO: 103966 - protein, 15 aa, Borrelia burgdorferi B31
VFIGGAVIQWLRDGL

SEQ ID NO: 103967 - protein, 15 aa, Borrelia burgdorferi B31
FIGGAVIQWLRDGLE

SEQ ID NO: 103968 - protein, 15 aa, Borrelia burgdorferi B31
IGGAVIQWLRDGLEF

SEQ ID NO: 103969 - protein, 15 aa, Borrelia burgdorferi B31
GGAVIQWLRDGLEFF

SEQ ID NO: 103970 - protein, 15 aa, Borrelia burgdorferi B31
GAVIQWLRDGLEFFR

SEQ ID NO: 103971 - protein, 15 aa, Borrelia burgdorferi B31
AVIQWLRDGLEFFRK

SEQ ID NO: 103972 - protein, 15 aa, Borrelia burgdorferi B31
VIQWLRDGLEFFRKS

SEQ ID NO: 103973 - protein, 15 aa, Borrelia burgdorferi B31
IQWLRDGLEFFRKSS

SEQ ID NO: 103974 - protein, 15 aa, Borrelia burgdorferi B31
QWLRDGLEFFRKSSD

SEQ ID NO: 103975 - protein, 15 aa, Borrelia burgdorferi B31
WLRDGLEFFRKSSDA

SEQ ID NO: 103976 - protein, 15 aa, Borrelia burgdorferi B31
LRDGLEFFRKSSDAE

SEQ ID NO: 103977 - protein, 15 aa, Borrelia burgdorferi B31
RDGLEFFRKSSDAEA

SEQ ID NO: 103978 - protein, 15 aa, Borrelia burgdorferi B31
DGLEFFRKSSDAEAL

SEQ ID NO: 103979 - protein, 15 aa, Borrelia burgdorferi B31
GLEFFRKSSDAEALA

SEQ ID NO: 103980 - protein, 15 aa, Borrelia burgdorferi B31
LEFFRKSSDAEALAS

SEQ ID NO: 103981 - protein, 15 aa, Borrelia burgdorferi B31
EFFRKSSDAEALASS

SEQ ID NO: 103982 - protein, 15 aa, Borrelia burgdorferi B31
FFRKSSDAEALASSV

SEQ ID NO: 103983 - protein, 15 aa, Borrelia burgdorferi B31
FRKSSDAEALASSVS

SEQ ID NO: 103984 - protein, 15 aa, Borrelia burgdorferi B31
RKSSDAEALASSVSD

SEQ ID NO: 103985 - protein, 15 aa, Borrelia burgdorferi B31
KSSDAEALASSVSDN

SEQ ID NO: 103986 - protein, 15 aa, Borrelia burgdorferi B31
SSDAEALASSVSDNG

SEQ ID NO: 103987 - protein, 15 aa, Borrelia burgdorferi B31
SDAEALASSVSDNGG

SEQ ID NO: 103988 - protein, 15 aa, Borrelia burgdorferi B31
DAEALASSVSDNGGV

SEQ ID NO: 103989 - protein, 15 aa, Borrelia burgdorferi B31
AEALASSVSDNGGVY

SEQ ID NO: 103990 - protein, 15 aa, Borrelia burgdorferi B31
EALASSVSDNGGVYF

SEQ ID NO: 103991 - protein, 15 aa, Borrelia burgdorferi B31
ALASSVSDNGGVYFV

SEQ ID NO: 103992 - protein, 15 aa, Borrelia burgdorferi B31
LASSVSDNGGVYFVP

SEQ ID NO: 103993 - protein, 15 aa, Borrelia burgdorferi B31
ASSVSDNGGVYFVPA

SEQ ID NO: 103994 - protein, 15 aa, Borrelia burgdorferi B31
SSVSDNGGVYFVPAF

SEQ ID NO: 103995 - protein, 15 aa, Borrelia burgdorferi B31
SVSDNGGVYFVPAFV

SEQ ID NO: 103996 - protein, 15 aa, Borrelia burgdorferi B31
VSDNGGVYFVPAFVG

SEQ ID NO: 103997 - protein, 15 aa, Borrelia burgdorferi B31
SDNGGVYFVPAFVGL

SEQ ID NO: 103998 - protein, 15 aa, Borrelia burgdorferi B31
DNGGVYFVPAFVGLG

SEQ ID NO: 103999 - protein, 15 aa, Borrelia burgdorferi B31
NGGVYFVPAFVGLGA

SEQ ID NO: 104000 - protein, 15 aa, Borrelia burgdorferi B31
GGVYFVPAFVGLGAP

SEQ ID NO: 104001 - protein, 15 aa, Borrelia burgdorferi B31
GVYFVPAFVGLGAPH

SEQ ID NO: 104002 - protein, 15 aa, Borrelia burgdorferi B31
VYFVPAFVGLGAPHW

SEQ ID NO: 104003 - protein, 15 aa, Borrelia burgdorferi B31
YFVPAFVGLGAPHWD

SEQ ID NO: 104004 - protein, 15 aa, Borrelia burgdorferi B31
FVPAFVGLGAPHWDS

SEQ ID NO: 104005 - protein, 15 aa, Borrelia burgdorferi B31
VPAFVGLGAPHWDSY

SEQ ID NO: 104006 - protein, 15 aa, Borrelia burgdorferi B31
PAFVGLGAPHWDSYA

SEQ ID NO: 104007 - protein, 15 aa, Borrelia burgdorferi B31
AFVGLGAPHWDSYAR

SEQ ID NO: 104008 - protein, 15 aa, Borrelia burgdorferi B31
FVGLGAPHWDSYARG

SEQ ID NO: 104009 - protein, 15 aa, Borrelia burgdorferi B31
VGLGAPHWDSYARGT

SEQ ID NO: 104010 - protein, 15 aa, Borrelia burgdorferi B31
GLGAPHWDSYARGTI

SEQ ID NO: 104011 - protein, 15 aa, Borrelia burgdorferi B31
LGAPHWDSYARGTII

SEQ ID NO: 104012 - protein, 15 aa, Borrelia burgdorferi B31
GAPHWDSYARGTIIG

SEQ ID NO: 104013 - protein, 15 aa, Borrelia burgdorferi B31
APHWDSYARGTIIGI

SEQ ID NO: 104014 - protein, 15 aa, Borrelia burgdorferi B31
PHWDSYARGTIIGIT

SEQ ID NO: 104015 - protein, 15 aa, Borrelia burgdorferi B31
HWDSYARGTIIGITR

SEQ ID NO: 104016 - protein, 15 aa, Borrelia burgdorferi B31
WDSYARGTIIGITRG

SEQ ID NO: 104017 - protein, 15 aa, Borrelia burgdorferi B31
DSYARGTIIGITRGS

SEQ ID NO: 104018 - protein, 15 aa, Borrelia burgdorferi B31
SYARGTIIGITRGST

SEQ ID NO: 104019 - protein, 15 aa, Borrelia burgdorferi B31
YARGTIIGITRGSTK

SEQ ID NO: 104020 - protein, 15 aa, Borrelia burgdorferi B31
ARGTIIGITRGSTKA

SEQ ID NO: 104021 - protein, 15 aa, Borrelia burgdorferi B31
RGTIIGITRGSTKAH

SEQ ID NO: 104022 - protein, 15 aa, Borrelia burgdorferi B31
GTIIGITRGSTKAHI

SEQ ID NO: 104023 - protein, 15 aa, Borrelia burgdorferi B31
TIIGITRGSTKAHIT

SEQ ID NO: 104024 - protein, 15 aa, Borrelia burgdorferi B31
IIGITRGSTKAHITR

SEQ ID NO: 104025 - protein, 15 aa, Borrelia burgdorferi B31
IGITRGSTKAHITRA

SEQ ID NO: 104026 - protein, 15 aa, Borrelia burgdorferi B31
GITRGSTKAHITRAA

SEQ ID NO: 104027 - protein, 15 aa, Borrelia burgdorferi B31
ITRGSTKAHITRAAL

SEQ ID NO: 104028 - protein, 15 aa, Borrelia burgdorferi B31
TRGSTKAHITRAALE

SEQ ID NO: 104029 - protein, 15 aa, Borrelia burgdorferi B31
RGSTKAHITRAALES

SEQ ID NO: 104030 - protein, 15 aa, Borrelia burgdorferi B31
GSTKAHITRAALESI

SEQ ID NO: 104031 - protein, 15 aa, Borrelia burgdorferi B31
STKAHITRAALESIA

SEQ ID NO: 104032 - protein, 15 aa, Borrelia burgdorferi B31
TKAHITRAALESIAF

SEQ ID NO: 104033 - protein, 15 aa, Borrelia burgdorferi B31
KAHITRAALESIAFQ

SEQ ID NO: 104034 - protein, 15 aa, Borrelia burgdorferi B31
AHITRAALESIAFQS

SEQ ID NO: 104035 - protein, 15 aa, Borrelia burgdorferi B31
HITRAALESIAFQSF

SEQ ID NO: 104036 - protein, 15 aa, Borrelia burgdorferi B31
ITRAALESIAFQSFD

SEQ ID NO: 104037 - protein, 15 aa, Borrelia burgdorferi B31
TRAALESIAFQSFDI

SEQ ID NO: 104038 - protein, 15 aa, Borrelia burgdorferi B31
RAALESIAFQSFDIL

SEQ ID NO: 104039 - protein, 15 aa, Borrelia burgdorferi B31
AALESIAFQSFDILN

SEQ ID NO: 104040 - protein, 15 aa, Borrelia burgdorferi B31
ALESIAFQSFDILNT

SEQ ID NO: 104041 - protein, 15 aa, Borrelia burgdorferi B31
LESIAFQSFDILNTM

SEQ ID NO: 104042 - protein, 15 aa, Borrelia burgdorferi B31
ESIAFQSFDILNTMK

SEQ ID NO: 104043 - protein, 15 aa, Borrelia burgdorferi B31
SIAFQSFDILNTMKK

SEQ ID NO: 104044 - protein, 15 aa, Borrelia burgdorferi B31
IAFQSFDILNTMKKS

SEQ ID NO: 104045 - protein, 15 aa, Borrelia burgdorferi B31
AFQSFDILNTMKKSI

SEQ ID NO: 104046 - protein, 15 aa, Borrelia burgdorferi B31
FQSFDILNTMKKSIP

SEQ ID NO: 104047 - protein, 15 aa, Borrelia burgdorferi B31
QSFDILNTMKKSIPN

SEQ ID NO: 104048 - protein, 15 aa, Borrelia burgdorferi B31
SFDILNTMKKSIPNF

SEQ ID NO: 104049 - protein, 15 aa, Borrelia burgdorferi B31
FDILNTMKKSIPNFE

SEQ ID NO: 104050 - protein, 15 aa, Borrelia burgdorferi B31
DILNTMKKSIPNFEI

SEQ ID NO: 104051 - protein, 15 aa, Borrelia burgdorferi B31
ILNTMKKSIPNFEIQ

SEQ ID NO: 104052 - protein, 15 aa, Borrelia burgdorferi B31
LNTMKKSIPNFEIQE

SEQ ID NO: 104053 - protein, 15 aa, Borrelia burgdorferi B31
NTMKKSIPNFEIQEL

SEQ ID NO: 104054 - protein, 15 aa, Borrelia burgdorferi B31
TMKKSIPNFEIQELR

SEQ ID NO: 104055 - protein, 15 aa, Borrelia burgdorferi B31
MKKSIPNFEIQELRV

SEQ ID NO: 104056 - protein, 15 aa, Borrelia burgdorferi B31
KKSIPNFEIQELRVD

SEQ ID NO: 104057 - protein, 15 aa, Borrelia burgdorferi B31
KSIPNFEIQELRVDG

SEQ ID NO: 104058 - protein, 15 aa, Borrelia burgdorferi B31
SIPNFEIQELRVDGG

SEQ ID NO: 104059 - protein, 15 aa, Borrelia burgdorferi B31
IPNFEIQELRVDGGA

SEQ ID NO: 104060 - protein, 15 aa, Borrelia burgdorferi B31
PNFEIQELRVDGGAS

SEQ ID NO: 104061 - protein, 15 aa, Borrelia burgdorferi B31
NFEIQELRVDGGASQ

SEQ ID NO: 104062 - protein, 15 aa, Borrelia burgdorferi B31
FEIQELRVDGGASQN

SEQ ID NO: 104063 - protein, 15 aa, Borrelia burgdorferi B31
EIQELRVDGGASQNN

SEQ ID NO: 104064 - protein, 15 aa, Borrelia burgdorferi B31
IQELRVDGGASQNNL

SEQ ID NO: 104065 - protein, 15 aa, Borrelia burgdorferi B31
QELRVDGGASQNNLL

SEQ ID NO: 104066 - protein, 15 aa, Borrelia burgdorferi B31
ELRVDGGASQNNLLM

SEQ ID NO: 104067 - protein, 15 aa, Borrelia burgdorferi B31
LRVDGGASQNNLLMQ

SEQ ID NO: 104068 - protein, 15 aa, Borrelia burgdorferi B31
RVDGGASQNNLLMQF

SEQ ID NO: 104069 - protein, 15 aa, Borrelia burgdorferi B31
VDGGASQNNLLMQFQ

SEQ ID NO: 104070 - protein, 15 aa, Borrelia burgdorferi B31
DGGASQNNLLMQFQA

SEQ ID NO: 104071 - protein, 15 aa, Borrelia burgdorferi B31
GGASQNNLLMQFQAD

SEQ ID NO: 104072 - protein, 15 aa, Borrelia burgdorferi B31
GASQNNLLMQFQADL

SEQ ID NO: 104073 - protein, 15 aa, Borrelia burgdorferi B31
ASQNNLLMQFQADLL

SEQ ID NO: 104074 - protein, 15 aa, Borrelia burgdorferi B31
SQNNLLMQFQADLLE

SEQ ID NO: 104075 - protein, 15 aa, Borrelia burgdorferi B31
QNNLLMQFQADLLEC

SEQ ID NO: 104076 - protein, 15 aa, Borrelia burgdorferi B31
NNLLMQFQADLLECK

SEQ ID NO: 104077 - protein, 15 aa, Borrelia burgdorferi B31
NLLMQFQADLLECKV

SEQ ID NO: 104078 - protein, 15 aa, Borrelia burgdorferi B31
LLMQFQADLLECKVV

SEQ ID NO: 104079 - protein, 15 aa, Borrelia burgdorferi B31
LMQFQADLLECKVVR

SEQ ID NO: 104080 - protein, 15 aa, Borrelia burgdorferi B31
MQFQADLLECKVVRP

SEQ ID NO: 104081 - protein, 15 aa, Borrelia burgdorferi B31
QFQADLLECKVVRPK

SEQ ID NO: 104082 - protein, 15 aa, Borrelia burgdorferi B31
FQADLLECKVVRPKI

SEQ ID NO: 104083 - protein, 15 aa, Borrelia burgdorferi B31
QADLLECKVVRPKIT

SEQ ID NO: 104084 - protein, 15 aa, Borrelia burgdorferi B31
ADLLECKVVRPKITE

SEQ ID NO: 104085 - protein, 15 aa, Borrelia burgdorferi B31
DLLECKVVRPKITET

SEQ ID NO: 104086 - protein, 15 aa, Borrelia burgdorferi B31
LLECKVVRPKITETT

SEQ ID NO: 104087 - protein, 15 aa, Borrelia burgdorferi B31
LECKVVRPKITETTA

SEQ ID NO: 104088 - protein, 15 aa, Borrelia burgdorferi B31
ECKVVRPKITETTAL

SEQ ID NO: 104089 - protein, 15 aa, Borrelia burgdorferi B31
CKVVRPKITETTALG

SEQ ID NO: 104090 - protein, 15 aa, Borrelia burgdorferi B31
KVVRPKITETTALGA

SEQ ID NO: 104091 - protein, 15 aa, Borrelia burgdorferi B31
VVRPKITETTALGAA

SEQ ID NO: 104092 - protein, 15 aa, Borrelia burgdorferi B31
VRPKITETTALGAAY

SEQ ID NO: 104093 - protein, 15 aa, Borrelia burgdorferi B31
RPKITETTALGAAYL

SEQ ID NO: 104094 - protein, 15 aa, Borrelia burgdorferi B31
PKITETTALGAAYLA

SEQ ID NO: 104095 - protein, 15 aa, Borrelia burgdorferi B31
KITETTALGAAYLAG

SEQ ID NO: 104096 - protein, 15 aa, Borrelia burgdorferi B31
ITETTALGAAYLAGL

SEQ ID NO: 104097 - protein, 15 aa, Borrelia burgdorferi B31
TETTALGAAYLAGLA

SEQ ID NO: 104098 - protein, 15 aa, Borrelia burgdorferi B31
ETTALGAAYLAGLAT

SEQ ID NO: 104099 - protein, 15 aa, Borrelia burgdorferi B31
TTALGAAYLAGLATG

SEQ ID NO: 104100 - protein, 15 aa, Borrelia burgdorferi B31
TALGAAYLAGLATGY

SEQ ID NO: 104101 - protein, 15 aa, Borrelia burgdorferi B31
ALGAAYLAGLATGYW

SEQ ID NO: 104102 - protein, 15 aa, Borrelia burgdorferi B31
LGAAYLAGLATGYWQ

SEQ ID NO: 104103 - protein, 15 aa, Borrelia burgdorferi B31
GAAYLAGLATGYWQS

SEQ ID NO: 104104 - protein, 15 aa, Borrelia burgdorferi B31
AAYLAGLATGYWQSA

SEQ ID NO: 104105 - protein, 15 aa, Borrelia burgdorferi B31
AYLAGLATGYWQSAE

SEQ ID NO: 104106 - protein, 15 aa, Borrelia burgdorferi B31
YLAGLATGYWQSAEE

SEQ ID NO: 104107 - protein, 15 aa, Borrelia burgdorferi B31
LAGLATGYWQSAEEI

SEQ ID NO: 104108 - protein, 15 aa, Borrelia burgdorferi B31
AGLATGYWQSAEEIV

SEQ ID NO: 104109 - protein, 15 aa, Borrelia burgdorferi B31
GLATGYWQSAEEIVS

SEQ ID NO: 104110 - protein, 15 aa, Borrelia burgdorferi B31
LATGYWQSAEEIVSL

SEQ ID NO: 104111 - protein, 15 aa, Borrelia burgdorferi B31
ATGYWQSAEEIVSLW

SEQ ID NO: 104112 - protein, 15 aa, Borrelia burgdorferi B31
TGYWQSAEEIVSLWQ

SEQ ID NO: 104113 - protein, 15 aa, Borrelia burgdorferi B31
GYWQSAEEIVSLWQV

SEQ ID NO: 104114 - protein, 15 aa, Borrelia burgdorferi B31
YWQSAEEIVSLWQVD

SEQ ID NO: 104115 - protein, 15 aa, Borrelia burgdorferi B31
WQSAEEIVSLWQVDK

SEQ ID NO: 104116 - protein, 15 aa, Borrelia burgdorferi B31
QSAEEIVSLWQVDKI

SEQ ID NO: 104117 - protein, 15 aa, Borrelia burgdorferi B31
SAEEIVSLWQVDKIF

SEQ ID NO: 104118 - protein, 15 aa, Borrelia burgdorferi B31
AEEIVSLWQVDKIFE

SEQ ID NO: 104119 - protein, 15 aa, Borrelia burgdorferi B31
EEIVSLWQVDKIFEP

SEQ ID NO: 104120 - protein, 15 aa, Borrelia burgdorferi B31
EIVSLWQVDKIFEPS

SEQ ID NO: 104121 - protein, 15 aa, Borrelia burgdorferi B31
IVSLWQVDKIFEPSM

SEQ ID NO: 104122 - protein, 15 aa, Borrelia burgdorferi B31
VSLWQVDKIFEPSMP

SEQ ID NO: 104123 - protein, 15 aa, Borrelia burgdorferi B31
SLWQVDKIFEPSMPK

SEQ ID NO: 104124 - protein, 15 aa, Borrelia burgdorferi B31
LWQVDKIFEPSMPKN

SEQ ID NO: 104125 - protein, 15 aa, Borrelia burgdorferi B31
WQVDKIFEPSMPKNQ

SEQ ID NO: 104126 - protein, 15 aa, Borrelia burgdorferi B31
QVDKIFEPSMPKNQK

SEQ ID NO: 104127 - protein, 15 aa, Borrelia burgdorferi B31
VDKIFEPSMPKNQKE

SEQ ID NO: 104128 - protein, 15 aa, Borrelia burgdorferi B31
DKIFEPSMPKNQKEK

SEQ ID NO: 104129 - protein, 15 aa, Borrelia burgdorferi B31
KIFEPSMPKNQKEKL

SEQ ID NO: 104130 - protein, 15 aa, Borrelia burgdorferi B31
IFEPSMPKNQKEKLL

SEQ ID NO: 104131 - protein, 15 aa, Borrelia burgdorferi B31
FEPSMPKNQKEKLLE

SEQ ID NO: 104132 - protein, 15 aa, Borrelia burgdorferi B31
EPSMPKNQKEKLLEN

SEQ ID NO: 104133 - protein, 15 aa, Borrelia burgdorferi B31
PSMPKNQKEKLLENW

SEQ ID NO: 104134 - protein, 15 aa, Borrelia burgdorferi B31
SMPKNQKEKLLENWN

SEQ ID NO: 104135 - protein, 15 aa, Borrelia burgdorferi B31
MPKNQKEKLLENWNK

SEQ ID NO: 104136 - protein, 15 aa, Borrelia burgdorferi B31
PKNQKEKLLENWNKA

SEQ ID NO: 104137 - protein, 15 aa, Borrelia burgdorferi B31
KNQKEKLLENWNKAV

SEQ ID NO: 104138 - protein, 15 aa, Borrelia burgdorferi B31
NQKEKLLENWNKAVG

SEQ ID NO: 104139 - protein, 15 aa, Borrelia burgdorferi B31
QKEKLLENWNKAVGK

SEQ ID NO: 104140 - protein, 15 aa, Borrelia burgdorferi B31
KEKLLENWNKAVGKA

SEQ ID NO: 104141 - protein, 15 aa, Borrelia burgdorferi B31
EKLLENWNKAVGKAK

SEQ ID NO: 104142 - protein, 15 aa, Borrelia burgdorferi B31
KLLENWNKAVGKAKS

SEQ ID NO: 104143 - protein, 15 aa, Borrelia burgdorferi B31
LLENWNKAVGKAKSW

SEQ ID NO: 104144 - protein, 15 aa, Borrelia burgdorferi B31
LENWNKAVGKAKSWI

SEQ ID NO: 104145 - protein, 15 aa, Borrelia burgdorferi B31
ENWNKAVGKAKSWIQ

SEQ ID NO: 104146 - protein, 15 aa, Borrelia burgdorferi B31
NWNKAVGKAKSWIQN

SEQ ID NO: 104147 - protein, 15 aa, Borrelia burgdorferi B31
WNKAVGKAKSWIQNS

SEQ ID NO: 104148 - protein, 15 aa, Borrelia burgdorferi B31
NKAVGKAKSWIQNSH

SEQ ID NO: 104149 - protein, 15 aa, Borrelia burgdorferi B31
KAVGKAKSWIQNSHS

SEQ ID NO: 104150 - protein, 15 aa, Borrelia burgdorferi B31
AVGKAKSWIQNSHSS

SEQ ID NO: 104151 - protein, 16 aa, Borrelia burgdorferi B31
MKYILSIDQGTTSSRA

SEQ ID NO: 104152 - protein, 16 aa, Borrelia burgdorferi B31
KYILSIDQGTTSSRAM

SEQ ID NO: 104153 - protein, 16 aa, Borrelia burgdorferi B31
YILSIDQGTTSSRAMV

SEQ ID NO: 104154 - protein, 16 aa, Borrelia burgdorferi B31
ILSIDQGTTSSRAMVF

SEQ ID NO: 104155 - protein, 16 aa, Borrelia burgdorferi B31
LSIDQGTTSSRAMVFD

SEQ ID NO: 104156 - protein, 16 aa, Borrelia burgdorferi B31
SIDQGTTSSRAMVFDK

SEQ ID NO: 104157 - protein, 16 aa, Borrelia burgdorferi B31
IDQGTTSSRAMVFDKN

SEQ ID NO: 104158 - protein, 16 aa, Borrelia burgdorferi B31
DQGTTSSRAMVFDKNA

SEQ ID NO: 104159 - protein, 16 aa, Borrelia burgdorferi B31
QGTTSSRAMVFDKNAN

SEQ ID NO: 104160 - protein, 16 aa, Borrelia burgdorferi B31
GTTSSRAMVFDKNANI

SEQ ID NO: 104161 - protein, 16 aa, Borrelia burgdorferi B31
TTSSRAMVFDKNANIK

SEQ ID NO: 104162 - protein, 16 aa, Borrelia burgdorferi B31
TSSRAMVFDKNANIKG

SEQ ID NO: 104163 - protein, 16 aa, Borrelia burgdorferi B31
SSRAMVFDKNANIKGF

SEQ ID NO: 104164 - protein, 16 aa, Borrelia burgdorferi B31
SRAMVFDKNANIKGFA

SEQ ID NO: 104165 - protein, 16 aa, Borrelia burgdorferi B31
RAMVFDKNANIKGFAQ

SEQ ID NO: 104166 - protein, 16 aa, Borrelia burgdorferi B31
AMVFDKNANIKGFAQK

SEQ ID NO: 104167 - protein, 16 aa, Borrelia burgdorferi B31
MVFDKNANIKGFAQKE

SEQ ID NO: 104168 - protein, 16 aa, Borrelia burgdorferi B31
VFDKNANIKGFAQKEF

SEQ ID NO: 104169 - protein, 16 aa, Borrelia burgdorferi B31
FDKNANIKGFAQKEFT

SEQ ID NO: 104170 - protein, 16 aa, Borrelia burgdorferi B31
DKNANIKGFAQKEFTQ

SEQ ID NO: 104171 - protein, 16 aa, Borrelia burgdorferi B31
KNANIKGFAQKEFTQI

SEQ ID NO: 104172 - protein, 16 aa, Borrelia burgdorferi B31
NANIKGFAQKEFTQIY

SEQ ID NO: 104173 - protein, 16 aa, Borrelia burgdorferi B31
ANIKGFAQKEFTQIYP

SEQ ID NO: 104174 - protein, 16 aa, Borrelia burgdorferi B31
NIKGFAQKEFTQIYPQ

SEQ ID NO: 104175 - protein, 16 aa, Borrelia burgdorferi B31
IKGFAQKEFTQIYPQP

SEQ ID NO: 104176 - protein, 16 aa, Borrelia burgdorferi B31
KGFAQKEFTQIYPQPS

SEQ ID NO: 104177 - protein, 16 aa, Borrelia burgdorferi B31
GFAQKEFTQIYPQPSW

SEQ ID NO: 104178 - protein, 16 aa, Borrelia burgdorferi B31
FAQKEFTQIYPQPSWV

SEQ ID NO: 104179 - protein, 16 aa, Borrelia burgdorferi B31
AQKEFTQIYPQPSWVE

SEQ ID NO: 104180 - protein, 16 aa, Borrelia burgdorferi B31
QKEFTQIYPQPSWVEH

SEQ ID NO: 104181 - protein, 16 aa, Borrelia burgdorferi B31
KEFTQIYPQPSWVEHD

SEQ ID NO: 104182 - protein, 16 aa, Borrelia burgdorferi B31
EFTQIYPQPSWVEHDP

SEQ ID NO: 104183 - protein, 16 aa, Borrelia burgdorferi B31
FTQIYPQPSWVEHDPT

SEQ ID NO: 104184 - protein, 16 aa, Borrelia burgdorferi B31
TQIYPQPSWVEHDPTE

SEQ ID NO: 104185 - protein, 16 aa, Borrelia burgdorferi B31
QIYPQPSWVEHDPTEI

SEQ ID NO: 104186 - protein, 16 aa, Borrelia burgdorferi B31
IYPQPSWVEHDPTEIW

SEQ ID NO: 104187 - protein, 16 aa, Borrelia burgdorferi B31
YPQPSWVEHDPTEIWG

SEQ ID NO: 104188 - protein, 16 aa, Borrelia burgdorferi B31
PQPSWVEHDPTEIWGS

SEQ ID NO: 104189 - protein, 16 aa, Borrelia burgdorferi B31
QPSWVEHDPTEIWGSQ

SEQ ID NO: 104190 - protein, 16 aa, Borrelia burgdorferi B31
PSWVEHDPTEIWGSQL

SEQ ID NO: 104191 - protein, 16 aa, Borrelia burgdorferi B31
SWVEHDPTEIWGSQLG

SEQ ID NO: 104192 - protein, 16 aa, Borrelia burgdorferi B31
WVEHDPTEIWGSQLGV

SEQ ID NO: 104193 - protein, 16 aa, Borrelia burgdorferi B31
VEHDPTEIWGSQLGVI

SEQ ID NO: 104194 - protein, 16 aa, Borrelia burgdorferi B31
EHDPTEIWGSQLGVIT

SEQ ID NO: 104195 - protein, 16 aa, Borrelia burgdorferi B31
HDPTEIWGSQLGVITE

SEQ ID NO: 104196 - protein, 16 aa, Borrelia burgdorferi B31
DPTEIWGSQLGVITEA

SEQ ID NO: 104197 - protein, 16 aa, Borrelia burgdorferi B31
PTEIWGSQLGVITEAM

SEQ ID NO: 104198 - protein, 16 aa, Borrelia burgdorferi B31
TEIWGSQLGVITEAMA

SEQ ID NO: 104199 - protein, 16 aa, Borrelia burgdorferi B31
EIWGSQLGVITEAMAN

SEQ ID NO: 104200 - protein, 16 aa, Borrelia burgdorferi B31
IWGSQLGVITEAMANA

SEQ ID NO: 104201 - protein, 16 aa, Borrelia burgdorferi B31
WGSQLGVITEAMANAR

SEQ ID NO: 104202 - protein, 16 aa, Borrelia burgdorferi B31
GSQLGVITEAMANARI

SEQ ID NO: 104203 - protein, 16 aa, Borrelia burgdorferi B31
SQLGVITEAMANARIL

SEQ ID NO: 104204 - protein, 16 aa, Borrelia burgdorferi B31
QLGVITEAMANARILP

SEQ ID NO: 104205 - protein, 16 aa, Borrelia burgdorferi B31
LGVITEAMANARILPN

SEQ ID NO: 104206 - protein, 16 aa, Borrelia burgdorferi B31
GVITEAMANARILPNE

SEQ ID NO: 104207 - protein, 16 aa, Borrelia burgdorferi B31
VITEAMANARILPNEI

SEQ ID NO: 104208 - protein, 16 aa, Borrelia burgdorferi B31
ITEAMANARILPNEID

SEQ ID NO: 104209 - protein, 16 aa, Borrelia burgdorferi B31
TEAMANARILPNEIDA

SEQ ID NO: 104210 - protein, 16 aa, Borrelia burgdorferi B31
EAMANARILPNEIDAI

SEQ ID NO: 104211 - protein, 16 aa, Borrelia burgdorferi B31
AMANARILPNEIDAIG

SEQ ID NO: 104212 - protein, 16 aa, Borrelia burgdorferi B31
MANARILPNEIDAIGI

SEQ ID NO: 104213 - protein, 16 aa, Borrelia burgdorferi B31
ANARILPNEIDAIGIT

SEQ ID NO: 104214 - protein, 16 aa, Borrelia burgdorferi B31
NARILPNEIDAIGITN

SEQ ID NO: 104215 - protein, 16 aa, Borrelia burgdorferi B31
ARILPNEIDAIGITNQ

SEQ ID NO: 104216 - protein, 16 aa, Borrelia burgdorferi B31
RILPNEIDAIGITNQR

SEQ ID NO: 104217 - protein, 16 aa, Borrelia burgdorferi B31
ILPNEIDAIGITNQRE

SEQ ID NO: 104218 - protein, 16 aa, Borrelia burgdorferi B31
LPNEIDAIGITNQRET

SEQ ID NO: 104219 - protein, 16 aa, Borrelia burgdorferi B31
PNEIDAIGITNQRETT

SEQ ID NO: 104220 - protein, 16 aa, Borrelia burgdorferi B31
NEIDAIGITNQRETTV

SEQ ID NO: 104221 - protein, 16 aa, Borrelia burgdorferi B31
EIDAIGITNQRETTVI

SEQ ID NO: 104222 - protein, 16 aa, Borrelia burgdorferi B31
IDAIGITNQRETTVIW

SEQ ID NO: 104223 - protein, 16 aa, Borrelia burgdorferi B31
DAIGITNQRETTVIWE

SEQ ID NO: 104224 - protein, 16 aa, Borrelia burgdorferi B31
AIGITNQRETTVIWEK

SEQ ID NO: 104225 - protein, 16 aa, Borrelia burgdorferi B31
IGITNQRETTVIWEKN

SEQ ID NO: 104226 - protein, 16 aa, Borrelia burgdorferi B31
GITNQRETTVIWEKNT

SEQ ID NO: 104227 - protein, 16 aa, Borrelia burgdorferi B31
ITNQRETTVIWEKNTG

SEQ ID NO: 104228 - protein, 16 aa, Borrelia burgdorferi B31
TNQRETTVIWEKNTGK

SEQ ID NO: 104229 - protein, 16 aa, Borrelia burgdorferi B31
NQRETTVIWEKNTGKP

SEQ ID NO: 104230 - protein, 16 aa, Borrelia burgdorferi B31
QRETTVIWEKNTGKPI

SEQ ID NO: 104231 - protein, 16 aa, Borrelia burgdorferi B31
RETTVIWEKNTGKPIY

SEQ ID NO: 104232 - protein, 16 aa, Borrelia burgdorferi B31
ETTVIWEKNTGKPIYN

SEQ ID NO: 104233 - protein, 16 aa, Borrelia burgdorferi B31
TTVIWEKNTGKPIYNA

SEQ ID NO: 104234 - protein, 16 aa, Borrelia burgdorferi B31
TVIWEKNTGKPIYNAI

SEQ ID NO: 104235 - protein, 16 aa, Borrelia burgdorferi B31
VIWEKNTGKPIYNAIV

SEQ ID NO: 104236 - protein, 16 aa, Borrelia burgdorferi B31
IWEKNTGKPIYNAIVW

SEQ ID NO: 104237 - protein, 16 aa, Borrelia burgdorferi B31
WEKNTGKPIYNAIVWQ

SEQ ID NO: 104238 - protein, 16 aa, Borrelia burgdorferi B31
EKNTGKPIYNAIVWQD

SEQ ID NO: 104239 - protein, 16 aa, Borrelia burgdorferi B31
KNTGKPIYNAIVWQDR

SEQ ID NO: 104240 - protein, 16 aa, Borrelia burgdorferi B31
NTGKPIYNAIVWQDRR

SEQ ID NO: 104241 - protein, 16 aa, Borrelia burgdorferi B31
TGKPIYNAIVWQDRRT

SEQ ID NO: 104242 - protein, 16 aa, Borrelia burgdorferi B31
GKPIYNAIVWQDRRTA

SEQ ID NO: 104243 - protein, 16 aa, Borrelia burgdorferi B31
KPIYNAIVWQDRRTAK

SEQ ID NO: 104244 - protein, 16 aa, Borrelia burgdorferi B31
PIYNAIVWQDRRTAKI

SEQ ID NO: 104245 - protein, 16 aa, Borrelia burgdorferi B31
IYNAIVWQDRRTAKIC

SEQ ID NO: 104246 - protein, 16 aa, Borrelia burgdorferi B31
YNAIVWQDRRTAKICD

SEQ ID NO: 104247 - protein, 16 aa, Borrelia burgdorferi B31
NAIVWQDRRTAKICDQ

SEQ ID NO: 104248 - protein, 16 aa, Borrelia burgdorferi B31
AIVWQDRRTAKICDQL

SEQ ID NO: 104249 - protein, 16 aa, Borrelia burgdorferi B31
IVWQDRRTAKICDQLK

SEQ ID NO: 104250 - protein, 16 aa, Borrelia burgdorferi B31
VWQDRRTAKICDQLKK

SEQ ID NO: 104251 - protein, 16 aa, Borrelia burgdorferi B31
WQDRRTAKICDQLKKE

SEQ ID NO: 104252 - protein, 16 aa, Borrelia burgdorferi B31
QDRRTAKICDQLKKEG

SEQ ID NO: 104253 - protein, 16 aa, Borrelia burgdorferi B31
DRRTAKICDQLKKEGK

SEQ ID NO: 104254 - protein, 16 aa, Borrelia burgdorferi B31
RRTAKICDQLKKEGKD

SEQ ID NO: 104255 - protein, 16 aa, Borrelia burgdorferi B31
RTAKICDQLKKEGKDK

SEQ ID NO: 104256 - protein, 16 aa, Borrelia burgdorferi B31
TAKICDQLKKEGKDKI

SEQ ID NO: 104257 - protein, 16 aa, Borrelia burgdorferi B31
AKICDQLKKEGKDKII

SEQ ID NO: 104258 - protein, 16 aa, Borrelia burgdorferi B31
KICDQLKKEGKDKIIL

SEQ ID NO: 104259 - protein, 16 aa, Borrelia burgdorferi B31
ICDQLKKEGKDKIILE

SEQ ID NO: 104260 - protein, 16 aa, Borrelia burgdorferi B31
CDQLKKEGKDKIILEK

SEQ ID NO: 104261 - protein, 16 aa, Borrelia burgdorferi B31
DQLKKEGKDKIILEKT

SEQ ID NO: 104262 - protein, 16 aa, Borrelia burgdorferi B31
QLKKEGKDKIILEKTG

SEQ ID NO: 104263 - protein, 16 aa, Borrelia burgdorferi B31
LKKEGKDKIILEKTGL

SEQ ID NO: 104264 - protein, 16 aa, Borrelia burgdorferi B31
KKEGKDKIILEKTGLV

SEQ ID NO: 104265 - protein, 16 aa, Borrelia burgdorferi B31
KEGKDKIILEKTGLVL

SEQ ID NO: 104266 - protein, 16 aa, Borrelia burgdorferi B31
EGKDKIILEKTGLVLD

SEQ ID NO: 104267 - protein, 16 aa, Borrelia burgdorferi B31
GKDKIILEKTGLVLDS

SEQ ID NO: 104268 - protein, 16 aa, Borrelia burgdorferi B31
KDKIILEKTGLVLDSY

SEQ ID NO: 104269 - protein, 16 aa, Borrelia burgdorferi B31
DKIILEKTGLVLDSYF

SEQ ID NO: 104270 - protein, 16 aa, Borrelia burgdorferi B31
KIILEKTGLVLDSYFS

SEQ ID NO: 104271 - protein, 16 aa, Borrelia burgdorferi B31
IILEKTGLVLDSYFSG

SEQ ID NO: 104272 - protein, 16 aa, Borrelia burgdorferi B31
ILEKTGLVLDSYFSGT

SEQ ID NO: 104273 - protein, 16 aa, Borrelia burgdorferi B31
LEKTGLVLDSYFSGTK

SEQ ID NO: 104274 - protein, 16 aa, Borrelia burgdorferi B31
EKTGLVLDSYFSGTKI

SEQ ID NO: 104275 - protein, 16 aa, Borrelia burgdorferi B31
KTGLVLDSYFSGTKIM

SEQ ID NO: 104276 - protein, 16 aa, Borrelia burgdorferi B31
TGLVLDSYFSGTKIMW

SEQ ID NO: 104277 - protein, 16 aa, Borrelia burgdorferi B31
GLVLDSYFSGTKIMWI

SEQ ID NO: 104278 - protein, 16 aa, Borrelia burgdorferi B31
LVLDSYFSGTKIMWIL

SEQ ID NO: 104279 - protein, 16 aa, Borrelia burgdorferi B31
VLDSYFSGTKIMWILD

SEQ ID NO: 104280 - protein, 16 aa, Borrelia burgdorferi B31
LDSYFSGTKIMWILDN

SEQ ID NO: 104281 - protein, 16 aa, Borrelia burgdorferi B31
DSYFSGTKIMWILDNV

SEQ ID NO: 104282 - protein, 16 aa, Borrelia burgdorferi B31
SYFSGTKIMWILDNVE

SEQ ID NO: 104283 - protein, 16 aa, Borrelia burgdorferi B31
YFSGTKIMWILDNVEG

SEQ ID NO: 104284 - protein, 16 aa, Borrelia burgdorferi B31
FSGTKIMWILDNVEGA

SEQ ID NO: 104285 - protein, 16 aa, Borrelia burgdorferi B31
SGTKIMWILDNVEGAR

SEQ ID NO: 104286 - protein, 16 aa, Borrelia burgdorferi B31
GTKIMWILDNVEGARQ

SEQ ID NO: 104287 - protein, 16 aa, Borrelia burgdorferi B31
TKIMWILDNVEGARQR

SEQ ID NO: 104288 - protein, 16 aa, Borrelia burgdorferi B31
KIMWILDNVEGARQRA

SEQ ID NO: 104289 - protein, 16 aa, Borrelia burgdorferi B31
IMWILDNVEGARQRAE

SEQ ID NO: 104290 - protein, 16 aa, Borrelia burgdorferi B31
MWILDNVEGARQRAEN

SEQ ID NO: 104291 - protein, 16 aa, Borrelia burgdorferi B31
WILDNVEGARQRAENG

SEQ ID NO: 104292 - protein, 16 aa, Borrelia burgdorferi B31
ILDNVEGARQRAENGE

SEQ ID NO: 104293 - protein, 16 aa, Borrelia burgdorferi B31
LDNVEGARQRAENGEL

SEQ ID NO: 104294 - protein, 16 aa, Borrelia burgdorferi B31
DNVEGARQRAENGELC

SEQ ID NO: 104295 - protein, 16 aa, Borrelia burgdorferi B31
NVEGARQRAENGELCF

SEQ ID NO: 104296 - protein, 16 aa, Borrelia burgdorferi B31
VEGARQRAENGELCFG

SEQ ID NO: 104297 - protein, 16 aa, Borrelia burgdorferi B31
EGARQRAENGELCFGT

SEQ ID NO: 104298 - protein, 16 aa, Borrelia burgdorferi B31
GARQRAENGELCFGTI

SEQ ID NO: 104299 - protein, 16 aa, Borrelia burgdorferi B31
ARQRAENGELCFGTID

SEQ ID NO: 104300 - protein, 16 aa, Borrelia burgdorferi B31
RQRAENGELCFGTIDT

SEQ ID NO: 104301 - protein, 16 aa, Borrelia burgdorferi B31
QRAENGELCFGTIDTW

SEQ ID NO: 104302 - protein, 16 aa, Borrelia burgdorferi B31
RAENGELCFGTIDTWI

SEQ ID NO: 104303 - protein, 16 aa, Borrelia burgdorferi B31
AENGELCFGTIDTWIL

SEQ ID NO: 104304 - protein, 16 aa, Borrelia burgdorferi B31
ENGELCFGTIDTWILW

SEQ ID NO: 104305 - protein, 16 aa, Borrelia burgdorferi B31
NGELCFGTIDTWILWN

SEQ ID NO: 104306 - protein, 16 aa, Borrelia burgdorferi B31
GELCFGTIDTWILWNL

SEQ ID NO: 104307 - protein, 16 aa, Borrelia burgdorferi B31
ELCFGTIDTWILWNLT

SEQ ID NO: 104308 - protein, 16 aa, Borrelia burgdorferi B31
LCFGTIDTWILWNLTQ

SEQ ID NO: 104309 - protein, 16 aa, Borrelia burgdorferi B31
CFGTIDTWILWNLTQK

SEQ ID NO: 104310 - protein, 16 aa, Borrelia burgdorferi B31
FGTIDTWILWNLTQKK

SEQ ID NO: 104311 - protein, 16 aa, Borrelia burgdorferi B31
GTIDTWILWNLTQKKE

SEQ ID NO: 104312 - protein, 16 aa, Borrelia burgdorferi B31
TIDTWILWNLTQKKEH

SEQ ID NO: 104313 - protein, 16 aa, Borrelia burgdorferi B31
IDTWILWNLTQKKEHA

SEQ ID NO: 104314 - protein, 16 aa, Borrelia burgdorferi B31
DTWILWNLTQKKEHAT

SEQ ID NO: 104315 - protein, 16 aa, Borrelia burgdorferi B31
TWILWNLTQKKEHATD

SEQ ID NO: 104316 - protein, 16 aa, Borrelia burgdorferi B31
WILWNLTQKKEHATDY

SEQ ID NO: 104317 - protein, 16 aa, Borrelia burgdorferi B31
ILWNLTQKKEHATDYS

SEQ ID NO: 104318 - protein, 16 aa, Borrelia burgdorferi B31
LWNLTQKKEHATDYSN

SEQ ID NO: 104319 - protein, 16 aa, Borrelia burgdorferi B31
WNLTQKKEHATDYSNA

SEQ ID NO: 104320 - protein, 16 aa, Borrelia burgdorferi B31
NLTQKKEHATDYSNAS

SEQ ID NO: 104321 - protein, 16 aa, Borrelia burgdorferi B31
LTQKKEHATDYSNASR

SEQ ID NO: 104322 - protein, 16 aa, Borrelia burgdorferi B31
TQKKEHATDYSNASRT

SEQ ID NO: 104323 - protein, 16 aa, Borrelia burgdorferi B31
QKKEHATDYSNASRTL

SEQ ID NO: 104324 - protein, 16 aa, Borrelia burgdorferi B31
KKEHATDYSNASRTLL

SEQ ID NO: 104325 - protein, 16 aa, Borrelia burgdorferi B31
KEHATDYSNASRTLLL

SEQ ID NO: 104326 - protein, 16 aa, Borrelia burgdorferi B31
EHATDYSNASRTLLLN

SEQ ID NO: 104327 - protein, 16 aa, Borrelia burgdorferi B31
HATDYSNASRTLLLNI

SEQ ID NO: 104328 - protein, 16 aa, Borrelia burgdorferi B31
ATDYSNASRTLLLNIK

SEQ ID NO: 104329 - protein, 16 aa, Borrelia burgdorferi B31
TDYSNASRTLLLNIKT

SEQ ID NO: 104330 - protein, 16 aa, Borrelia burgdorferi B31
DYSNASRTLLLNIKTL

SEQ ID NO: 104331 - protein, 16 aa, Borrelia burgdorferi B31
YSNASRTLLLNIKTLE

SEQ ID NO: 104332 - protein, 16 aa, Borrelia burgdorferi B31
SNASRTLLLNIKTLEW

SEQ ID NO: 104333 - protein, 16 aa, Borrelia burgdorferi B31
NASRTLLLNIKTLEWD

SEQ ID NO: 104334 - protein, 16 aa, Borrelia burgdorferi B31
ASRTLLLNIKTLEWDD

SEQ ID NO: 104335 - protein, 16 aa, Borrelia burgdorferi B31
SRTLLLNIKTLEWDDE

SEQ ID NO: 104336 - protein, 16 aa, Borrelia burgdorferi B31
RTLLLNIKTLEWDDEL

SEQ ID NO: 104337 - protein, 16 aa, Borrelia burgdorferi B31
TLLLNIKTLEWDDELL

SEQ ID NO: 104338 - protein, 16 aa, Borrelia burgdorferi B31
LLLNIKTLEWDDELLS

SEQ ID NO: 104339 - protein, 16 aa, Borrelia burgdorferi B31
LLNIKTLEWDDELLSI

SEQ ID NO: 104340 - protein, 16 aa, Borrelia burgdorferi B31
LNIKTLEWDDELLSIL

SEQ ID NO: 104341 - protein, 16 aa, Borrelia burgdorferi B31
NIKTLEWDDELLSILN

SEQ ID NO: 104342 - protein, 16 aa, Borrelia burgdorferi B31
IKTLEWDDELLSILNV

SEQ ID NO: 104343 - protein, 16 aa, Borrelia burgdorferi B31
KTLEWDDELLSILNVP

SEQ ID NO: 104344 - protein, 16 aa, Borrelia burgdorferi B31
TLEWDDELLSILNVPR

SEQ ID NO: 104345 - protein, 16 aa, Borrelia burgdorferi B31
LEWDDELLSILNVPRA

SEQ ID NO: 104346 - protein, 16 aa, Borrelia burgdorferi B31
EWDDELLSILNVPRAI

SEQ ID NO: 104347 - protein, 16 aa, Borrelia burgdorferi B31
WDDELLSILNVPRAIL

SEQ ID NO: 104348 - protein, 16 aa, Borrelia burgdorferi B31
DDELLSILNVPRAILP

SEQ ID NO: 104349 - protein, 16 aa, Borrelia burgdorferi B31
DELLSILNVPRAILPE

SEQ ID NO: 104350 - protein, 16 aa, Borrelia burgdorferi B31
ELLSILNVPRAILPEL

SEQ ID NO: 104351 - protein, 16 aa, Borrelia burgdorferi B31
LLSILNVPRAILPELK

SEQ ID NO: 104352 - protein, 16 aa, Borrelia burgdorferi B31
LSILNVPRAILPELKE

SEQ ID NO: 104353 - protein, 16 aa, Borrelia burgdorferi B31
SILNVPRAILPELKES

SEQ ID NO: 104354 - protein, 16 aa, Borrelia burgdorferi B31
ILNVPRAILPELKESS

SEQ ID NO: 104355 - protein, 16 aa, Borrelia burgdorferi B31
LNVPRAILPELKESST

SEQ ID NO: 104356 - protein, 16 aa, Borrelia burgdorferi B31
NVPRAILPELKESSTI

SEQ ID NO: 104357 - protein, 16 aa, Borrelia burgdorferi B31
VPRAILPELKESSTIY

SEQ ID NO: 104358 - protein, 16 aa, Borrelia burgdorferi B31
PRAILPELKESSTIYG

SEQ ID NO: 104359 - protein, 16 aa, Borrelia burgdorferi B31
RAILPELKESSTIYGK

SEQ ID NO: 104360 - protein, 16 aa, Borrelia burgdorferi B31
AILPELKESSTIYGKT

SEQ ID NO: 104361 - protein, 16 aa, Borrelia burgdorferi B31
ILPELKESSTIYGKTD

SEQ ID NO: 104362 - protein, 16 aa, Borrelia burgdorferi B31
LPELKESSTIYGKTDK

SEQ ID NO: 104363 - protein, 16 aa, Borrelia burgdorferi B31
PELKESSTIYGKTDKA

SEQ ID NO: 104364 - protein, 16 aa, Borrelia burgdorferi B31
ELKESSTIYGKTDKAL

SEQ ID NO: 104365 - protein, 16 aa, Borrelia burgdorferi B31
LKESSTIYGKTDKALF

SEQ ID NO: 104366 - protein, 16 aa, Borrelia burgdorferi B31
KESSTIYGKTDKALFG

SEQ ID NO: 104367 - protein, 16 aa, Borrelia burgdorferi B31
ESSTIYGKTDKALFGA

SEQ ID NO: 104368 - protein, 16 aa, Borrelia burgdorferi B31
SSTIYGKTDKALFGAE

SEQ ID NO: 104369 - protein, 16 aa, Borrelia burgdorferi B31
STIYGKTDKALFGAEI

SEQ ID NO: 104370 - protein, 16 aa, Borrelia burgdorferi B31
TIYGKTDKALFGAEIP

SEQ ID NO: 104371 - protein, 16 aa, Borrelia burgdorferi B31
IYGKTDKALFGAEIPI

SEQ ID NO: 104372 - protein, 16 aa, Borrelia burgdorferi B31
YGKTDKALFGAEIPIA

SEQ ID NO: 104373 - protein, 16 aa, Borrelia burgdorferi B31
GKTDKALFGAEIPIAG

SEQ ID NO: 104374 - protein, 16 aa, Borrelia burgdorferi B31
KTDKALFGAEIPIAGI

SEQ ID NO: 104375 - protein, 16 aa, Borrelia burgdorferi B31
TDKALFGAEIPIAGIA

SEQ ID NO: 104376 - protein, 16 aa, Borrelia burgdorferi B31
DKALFGAEIPIAGIAG

SEQ ID NO: 104377 - protein, 16 aa, Borrelia burgdorferi B31
KALFGAEIPIAGIAGD

SEQ ID NO: 104378 - protein, 16 aa, Borrelia burgdorferi B31
ALFGAEIPIAGIAGDQ

SEQ ID NO: 104379 - protein, 16 aa, Borrelia burgdorferi B31
LFGAEIPIAGIAGDQF

SEQ ID NO: 104380 - protein, 16 aa, Borrelia burgdorferi B31
FGAEIPIAGIAGDQFA

SEQ ID NO: 104381 - protein, 16 aa, Borrelia burgdorferi B31
GAEIPIAGIAGDQFAA

SEQ ID NO: 104382 - protein, 16 aa, Borrelia burgdorferi B31
AEIPIAGIAGDQFAAT

SEQ ID NO: 104383 - protein, 16 aa, Borrelia burgdorferi B31
EIPIAGIAGDQFAATF

SEQ ID NO: 104384 - protein, 16 aa, Borrelia burgdorferi B31
IPIAGIAGDQFAATFG

SEQ ID NO: 104385 - protein, 16 aa, Borrelia burgdorferi B31
PIAGIAGDQFAATFGQ

SEQ ID NO: 104386 - protein, 16 aa, Borrelia burgdorferi B31
IAGIAGDQFAATFGQA

SEQ ID NO: 104387 - protein, 16 aa, Borrelia burgdorferi B31
AGIAGDQFAATFGQAC

SEQ ID NO: 104388 - protein, 16 aa, Borrelia burgdorferi B31
GIAGDQFAATFGQACL

SEQ ID NO: 104389 - protein, 16 aa, Borrelia burgdorferi B31
IAGDQFAATFGQACLK

SEQ ID NO: 104390 - protein, 16 aa, Borrelia burgdorferi B31
AGDQFAATFGQACLKK

SEQ ID NO: 104391 - protein, 16 aa, Borrelia burgdorferi B31
GDQFAATFGQACLKKG

SEQ ID NO: 104392 - protein, 16 aa, Borrelia burgdorferi B31
DQFAATFGQACLKKGM

SEQ ID NO: 104393 - protein, 16 aa, Borrelia burgdorferi B31
QFAATFGQACLKKGMA

SEQ ID NO: 104394 - protein, 16 aa, Borrelia burgdorferi B31
FAATFGQACLKKGMAK

SEQ ID NO: 104395 - protein, 16 aa, Borrelia burgdorferi B31
AATFGQACLKKGMAKN

SEQ ID NO: 104396 - protein, 16 aa, Borrelia burgdorferi B31
ATFGQACLKKGMAKNT

SEQ ID NO: 104397 - protein, 16 aa, Borrelia burgdorferi B31
TFGQACLKKGMAKNTY

SEQ ID NO: 104398 - protein, 16 aa, Borrelia burgdorferi B31
FGQACLKKGMAKNTYG

SEQ ID NO: 104399 - protein, 16 aa, Borrelia burgdorferi B31
GQACLKKGMAKNTYGT

SEQ ID NO: 104400 - protein, 16 aa, Borrelia burgdorferi B31
QACLKKGMAKNTYGTG

SEQ ID NO: 104401 - protein, 16 aa, Borrelia burgdorferi B31
ACLKKGMAKNTYGTGC

SEQ ID NO: 104402 - protein, 16 aa, Borrelia burgdorferi B31
CLKKGMAKNTYGTGCF

SEQ ID NO: 104403 - protein, 16 aa, Borrelia burgdorferi B31
LKKGMAKNTYGTGCFL

SEQ ID NO: 104404 - protein, 16 aa, Borrelia burgdorferi B31
KKGMAKNTYGTGCFLT

SEQ ID NO: 104405 - protein, 16 aa, Borrelia burgdorferi B31
KGMAKNTYGTGCFLTV

SEQ ID NO: 104406 - protein, 16 aa, Borrelia burgdorferi B31
GMAKNTYGTGCFLTVN

SEQ ID NO: 104407 - protein, 16 aa, Borrelia burgdorferi B31
MAKNTYGTGCFLTVNI

SEQ ID NO: 104408 - protein, 16 aa, Borrelia burgdorferi B31
AKNTYGTGCFLTVNIG

SEQ ID NO: 104409 - protein, 16 aa, Borrelia burgdorferi B31
KNTYGTGCFLTVNIGK

SEQ ID NO: 104410 - protein, 16 aa, Borrelia burgdorferi B31
NTYGTGCFLTVNIGKE

SEQ ID NO: 104411 - protein, 16 aa, Borrelia burgdorferi B31
TYGTGCFLTVNIGKEP

SEQ ID NO: 104412 - protein, 16 aa, Borrelia burgdorferi B31
YGTGCFLTVNIGKEPI

SEQ ID NO: 104413 - protein, 16 aa, Borrelia burgdorferi B31
GTGCFLTVNIGKEPII

SEQ ID NO: 104414 - protein, 16 aa, Borrelia burgdorferi B31
TGCFLTVNIGKEPIIS

SEQ ID NO: 104415 - protein, 16 aa, Borrelia burgdorferi B31
GCFLTVNIGKEPIISH

SEQ ID NO: 104416 - protein, 16 aa, Borrelia burgdorferi B31
CFLTVNIGKEPIISHD

SEQ ID NO: 104417 - protein, 16 aa, Borrelia burgdorferi B31
FLTVNIGKEPIISHDK

SEQ ID NO: 104418 - protein, 16 aa, Borrelia burgdorferi B31
LTVNIGKEPIISHDKL

SEQ ID NO: 104419 - protein, 16 aa, Borrelia burgdorferi B31
TVNIGKEPIISHDKLL

SEQ ID NO: 104420 - protein, 16 aa, Borrelia burgdorferi B31
VNIGKEPIISHDKLLT

SEQ ID NO: 104421 - protein, 16 aa, Borrelia burgdorferi B31
NIGKEPIISHDKLLTS

SEQ ID NO: 104422 - protein, 16 aa, Borrelia burgdorferi B31
IGKEPIISHDKLLTSI

SEQ ID NO: 104423 - protein, 16 aa, Borrelia burgdorferi B31
GKEPIISHDKLLTSIA

SEQ ID NO: 104424 - protein, 16 aa, Borrelia burgdorferi B31
KEPIISHDKLLTSIAW

SEQ ID NO: 104425 - protein, 16 aa, Borrelia burgdorferi B31
EPIISHDKLLTSIAWG

SEQ ID NO: 104426 - protein, 16 aa, Borrelia burgdorferi B31
PIISHDKLLTSIAWGR

SEQ ID NO: 104427 - protein, 16 aa, Borrelia burgdorferi B31
IISHDKLLTSIAWGRK

SEQ ID NO: 104428 - protein, 16 aa, Borrelia burgdorferi B31
ISHDKLLTSIAWGRKK

SEQ ID NO: 104429 - protein, 16 aa, Borrelia burgdorferi B31
SHDKLLTSIAWGRKKS

SEQ ID NO: 104430 - protein, 16 aa, Borrelia burgdorferi B31
HDKLLTSIAWGRKKSV

SEQ ID NO: 104431 - protein, 16 aa, Borrelia burgdorferi B31
DKLLTSIAWGRKKSVT

SEQ ID NO: 104432 - protein, 16 aa, Borrelia burgdorferi B31
KLLTSIAWGRKKSVTY

SEQ ID NO: 104433 - protein, 16 aa, Borrelia burgdorferi B31
LLTSIAWGRKKSVTYV

SEQ ID NO: 104434 - protein, 16 aa, Borrelia burgdorferi B31
LTSIAWGRKKSVTYVL

SEQ ID NO: 104435 - protein, 16 aa, Borrelia burgdorferi B31
TSIAWGRKKSVTYVLE

SEQ ID NO: 104436 - protein, 16 aa, Borrelia burgdorferi B31
SIAWGRKKSVTYVLEG

SEQ ID NO: 104437 - protein, 16 aa, Borrelia burgdorferi B31
IAWGRKKSVTYVLEGS

SEQ ID NO: 104438 - protein, 16 aa, Borrelia burgdorferi B31
AWGRKKSVTYVLEGSV

SEQ ID NO: 104439 - protein, 16 aa, Borrelia burgdorferi B31
WGRKKSVTYVLEGSVF

SEQ ID NO: 104440 - protein, 16 aa, Borrelia burgdorferi B31
GRKKSVTYVLEGSVFI

SEQ ID NO: 104441 - protein, 16 aa, Borrelia burgdorferi B31
RKKSVTYVLEGSVFIG

SEQ ID NO: 104442 - protein, 16 aa, Borrelia burgdorferi B31
KKSVTYVLEGSVFIGG

SEQ ID NO: 104443 - protein, 16 aa, Borrelia burgdorferi B31
KSVTYVLEGSVFIGGA

SEQ ID NO: 104444 - protein, 16 aa, Borrelia burgdorferi B31
SVTYVLEGSVFIGGAV

SEQ ID NO: 104445 - protein, 16 aa, Borrelia burgdorferi B31
VTYVLEGSVFIGGAVI

SEQ ID NO: 104446 - protein, 16 aa, Borrelia burgdorferi B31
TYVLEGSVFIGGAVIQ

SEQ ID NO: 104447 - protein, 16 aa, Borrelia burgdorferi B31
YVLEGSVFIGGAVIQW

SEQ ID NO: 104448 - protein, 16 aa, Borrelia burgdorferi B31
VLEGSVFIGGAVIQWL

SEQ ID NO: 104449 - protein, 16 aa, Borrelia burgdorferi B31
LEGSVFIGGAVIQWLR

SEQ ID NO: 104450 - protein, 16 aa, Borrelia burgdorferi B31
EGSVFIGGAVIQWLRD

SEQ ID NO: 104451 - protein, 16 aa, Borrelia burgdorferi B31
GSVFIGGAVIQWLRDG

SEQ ID NO: 104452 - protein, 16 aa, Borrelia burgdorferi B31
SVFIGGAVIQWLRDGL

SEQ ID NO: 104453 - protein, 16 aa, Borrelia burgdorferi B31
VFIGGAVIQWLRDGLE

SEQ ID NO: 104454 - protein, 16 aa, Borrelia burgdorferi B31
FIGGAVIQWLRDGLEF

SEQ ID NO: 104455 - protein, 16 aa, Borrelia burgdorferi B31
IGGAVIQWLRDGLEFF

SEQ ID NO: 104456 - protein, 16 aa, Borrelia burgdorferi B31
GGAVIQWLRDGLEFFR

SEQ ID NO: 104457 - protein, 16 aa, Borrelia burgdorferi B31
GAVIQWLRDGLEFFRK

SEQ ID NO: 104458 - protein, 16 aa, Borrelia burgdorferi B31
AVIQWLRDGLEFFRKS

SEQ ID NO: 104459 - protein, 16 aa, Borrelia burgdorferi B31
VIQWLRDGLEFFRKSS

SEQ ID NO: 104460 - protein, 16 aa, Borrelia burgdorferi B31
IQWLRDGLEFFRKSSD

SEQ ID NO: 104461 - protein, 16 aa, Borrelia burgdorferi B31
QWLRDGLEFFRKSSDA

SEQ ID NO: 104462 - protein, 16 aa, Borrelia burgdorferi B31
WLRDGLEFFRKSSDAE

SEQ ID NO: 104463 - protein, 16 aa, Borrelia burgdorferi B31
LRDGLEFFRKSSDAEA

SEQ ID NO: 104464 - protein, 16 aa, Borrelia burgdorferi B31
RDGLEFFRKSSDAEAL

SEQ ID NO: 104465 - protein, 16 aa, Borrelia burgdorferi B31
DGLEFFRKSSDAEALA

SEQ ID NO: 104466 - protein, 16 aa, Borrelia burgdorferi B31
GLEFFRKSSDAEALAS

SEQ ID NO: 104467 - protein, 16 aa, Borrelia burgdorferi B31
LEFFRKSSDAEALASS

SEQ ID NO: 104468 - protein, 16 aa, Borrelia burgdorferi B31
EFFRKSSDAEALASSV

SEQ ID NO: 104469 - protein, 16 aa, Borrelia burgdorferi B31
FFRKSSDAEALASSVS

SEQ ID NO: 104470 - protein, 16 aa, Borrelia burgdorferi B31
FRKSSDAEALASSVSD

SEQ ID NO: 104471 - protein, 16 aa, Borrelia burgdorferi B31
RKSSDAEALASSVSDN

SEQ ID NO: 104472 - protein, 16 aa, Borrelia burgdorferi B31
KSSDAEALASSVSDNG

SEQ ID NO: 104473 - protein, 16 aa, Borrelia burgdorferi B31
SSDAEALASSVSDNGG

SEQ ID NO: 104474 - protein, 16 aa, Borrelia burgdorferi B31
SDAEALASSVSDNGGV

SEQ ID NO: 104475 - protein, 16 aa, Borrelia burgdorferi B31
DAEALASSVSDNGGVY

SEQ ID NO: 104476 - protein, 16 aa, Borrelia burgdorferi B31
AEALASSVSDNGGVYF

SEQ ID NO: 104477 - protein, 16 aa, Borrelia burgdorferi B31
EALASSVSDNGGVYFV

SEQ ID NO: 104478 - protein, 16 aa, Borrelia burgdorferi B31
ALASSVSDNGGVYFVP

SEQ ID NO: 104479 - protein, 16 aa, Borrelia burgdorferi B31
LASSVSDNGGVYFVPA

SEQ ID NO: 104480 - protein, 16 aa, Borrelia burgdorferi B31
ASSVSDNGGVYFVPAF

SEQ ID NO: 104481 - protein, 16 aa, Borrelia burgdorferi B31
SSVSDNGGVYFVPAFV

SEQ ID NO: 104482 - protein, 16 aa, Borrelia burgdorferi B31
SVSDNGGVYFVPAFVG

SEQ ID NO: 104483 - protein, 16 aa, Borrelia burgdorferi B31
VSDNGGVYFVPAFVGL

SEQ ID NO: 104484 - protein, 16 aa, Borrelia burgdorferi B31
SDNGGVYFVPAFVGLG

SEQ ID NO: 104485 - protein, 16 aa, Borrelia burgdorferi B31
DNGGVYFVPAFVGLGA

SEQ ID NO: 104486 - protein, 16 aa, Borrelia burgdorferi B31
NGGVYFVPAFVGLGAP

SEQ ID NO: 104487 - protein, 16 aa, Borrelia burgdorferi B31
GGVYFVPAFVGLGAPH

SEQ ID NO: 104488 - protein, 16 aa, Borrelia burgdorferi B31
GVYFVPAFVGLGAPHW

SEQ ID NO: 104489 - protein, 16 aa, Borrelia burgdorferi B31
VYFVPAFVGLGAPHWD

SEQ ID NO: 104490 - protein, 16 aa, Borrelia burgdorferi B31
YFVPAFVGLGAPHWDS

SEQ ID NO: 104491 - protein, 16 aa, Borrelia burgdorferi B31
FVPAFVGLGAPHWDSY

SEQ ID NO: 104492 - protein, 16 aa, Borrelia burgdorferi B31
VPAFVGLGAPHWDSYA

SEQ ID NO: 104493 - protein, 16 aa, Borrelia burgdorferi B31
PAFVGLGAPHWDSYAR

SEQ ID NO: 104494 - protein, 16 aa, Borrelia burgdorferi B31
AFVGLGAPHWDSYARG

SEQ ID NO: 104495 - protein, 16 aa, Borrelia burgdorferi B31
FVGLGAPHWDSYARGT

SEQ ID NO: 104496 - protein, 16 aa, Borrelia burgdorferi B31
VGLGAPHWDSYARGTI

SEQ ID NO: 104497 - protein, 16 aa, Borrelia burgdorferi B31
GLGAPHWDSYARGTII

SEQ ID NO: 104498 - protein, 16 aa, Borrelia burgdorferi B31
LGAPHWDSYARGTIIG

SEQ ID NO: 104499 - protein, 16 aa, Borrelia burgdorferi B31
GAPHWDSYARGTIIGI

SEQ ID NO: 104500 - protein, 16 aa, Borrelia burgdorferi B31
APHWDSYARGTIIGIT

SEQ ID NO: 104501 - protein, 16 aa, Borrelia burgdorferi B31
PHWDSYARGTIIGITR

SEQ ID NO: 104502 - protein, 16 aa, Borrelia burgdorferi B31
HWDSYARGTIIGITRG

SEQ ID NO: 104503 - protein, 16 aa, Borrelia burgdorferi B31
WDSYARGTIIGITRGS

SEQ ID NO: 104504 - protein, 16 aa, Borrelia burgdorferi B31
DSYARGTIIGITRGST

SEQ ID NO: 104505 - protein, 16 aa, Borrelia burgdorferi B31
SYARGTIIGITRGSTK

SEQ ID NO: 104506 - protein, 16 aa, Borrelia burgdorferi B31
YARGTIIGITRGSTKA

SEQ ID NO: 104507 - protein, 16 aa, Borrelia burgdorferi B31
ARGTIIGITRGSTKAH

SEQ ID NO: 104508 - protein, 16 aa, Borrelia burgdorferi B31
RGTIIGITRGSTKAHI

SEQ ID NO: 104509 - protein, 16 aa, Borrelia burgdorferi B31
GTIIGITRGSTKAHIT

SEQ ID NO: 104510 - protein, 16 aa, Borrelia burgdorferi B31
TIIGITRGSTKAHITR

SEQ ID NO: 104511 - protein, 16 aa, Borrelia burgdorferi B31
IIGITRGSTKAHITRA

SEQ ID NO: 104512 - protein, 16 aa, Borrelia burgdorferi B31
IGITRGSTKAHITRAA

SEQ ID NO: 104513 - protein, 16 aa, Borrelia burgdorferi B31
GITRGSTKAHITRAAL

SEQ ID NO: 104514 - protein, 16 aa, Borrelia burgdorferi B31
ITRGSTKAHITRAALE

SEQ ID NO: 104515 - protein, 16 aa, Borrelia burgdorferi B31
TRGSTKAHITRAALES

SEQ ID NO: 104516 - protein, 16 aa, Borrelia burgdorferi B31
RGSTKAHITRAALESI

SEQ ID NO: 104517 - protein, 16 aa, Borrelia burgdorferi B31
GSTKAHITRAALESIA

SEQ ID NO: 104518 - protein, 16 aa, Borrelia burgdorferi B31
STKAHITRAALESIAF

SEQ ID NO: 104519 - protein, 16 aa, Borrelia burgdorferi B31
TKAHITRAALESIAFQ

SEQ ID NO: 104520 - protein, 16 aa, Borrelia burgdorferi B31
KAHITRAALESIAFQS

SEQ ID NO: 104521 - protein, 16 aa, Borrelia burgdorferi B31
AHITRAALESIAFQSF

SEQ ID NO: 104522 - protein, 16 aa, Borrelia burgdorferi B31
HITRAALESIAFQSFD

SEQ ID NO: 104523 - protein, 16 aa, Borrelia burgdorferi B31
ITRAALESIAFQSFDI

SEQ ID NO: 104524 - protein, 16 aa, Borrelia burgdorferi B31
TRAALESIAFQSFDIL

SEQ ID NO: 104525 - protein, 16 aa, Borrelia burgdorferi B31
RAALESIAFQSFDILN

SEQ ID NO: 104526 - protein, 16 aa, Borrelia burgdorferi B31
AALESIAFQSFDILNT

SEQ ID NO: 104527 - protein, 16 aa, Borrelia burgdorferi B31
ALESIAFQSFDILNTM

SEQ ID NO: 104528 - protein, 16 aa, Borrelia burgdorferi B31
LESIAFQSFDILNTMK

SEQ ID NO: 104529 - protein, 16 aa, Borrelia burgdorferi B31
ESIAFQSFDILNTMKK

SEQ ID NO: 104530 - protein, 16 aa, Borrelia burgdorferi B31
SIAFQSFDILNTMKKS

SEQ ID NO: 104531 - protein, 16 aa, Borrelia burgdorferi B31
IAFQSFDILNTMKKSI

SEQ ID NO: 104532 - protein, 16 aa, Borrelia burgdorferi B31
AFQSFDILNTMKKSIP

SEQ ID NO: 104533 - protein, 16 aa, Borrelia burgdorferi B31
FQSFDILNTMKKSIPN

SEQ ID NO: 104534 - protein, 16 aa, Borrelia burgdorferi B31
QSFDILNTMKKSIPNF

SEQ ID NO: 104535 - protein, 16 aa, Borrelia burgdorferi B31
SFDILNTMKKSIPNFE

SEQ ID NO: 104536 - protein, 16 aa, Borrelia burgdorferi B31
FDILNTMKKSIPNFEI

SEQ ID NO: 104537 - protein, 16 aa, Borrelia burgdorferi B31
DILNTMKKSIPNFEIQ

SEQ ID NO: 104538 - protein, 16 aa, Borrelia burgdorferi B31
ILNTMKKSIPNFEIQE

SEQ ID NO: 104539 - protein, 16 aa, Borrelia burgdorferi B31
LNTMKKSIPNFEIQEL

SEQ ID NO: 104540 - protein, 16 aa, Borrelia burgdorferi B31
NTMKKSIPNFEIQELR

SEQ ID NO: 104541 - protein, 16 aa, Borrelia burgdorferi B31
TMKKSIPNFEIQELRV

SEQ ID NO: 104542 - protein, 16 aa, Borrelia burgdorferi B31
MKKSIPNFEIQELRVD

SEQ ID NO: 104543 - protein, 16 aa, Borrelia burgdorferi B31
KKSIPNFEIQELRVDG

SEQ ID NO: 104544 - protein, 16 aa, Borrelia burgdorferi B31
KSIPNFEIQELRVDGG

SEQ ID NO: 104545 - protein, 16 aa, Borrelia burgdorferi B31
SIPNFEIQELRVDGGA

SEQ ID NO: 104546 - protein, 16 aa, Borrelia burgdorferi B31
IPNFEIQELRVDGGAS

SEQ ID NO: 104547 - protein, 16 aa, Borrelia burgdorferi B31
PNFEIQELRVDGGASQ

SEQ ID NO: 104548 - protein, 16 aa, Borrelia burgdorferi B31
NFEIQELRVDGGASQN

SEQ ID NO: 104549 - protein, 16 aa, Borrelia burgdorferi B31
FEIQELRVDGGASQNN

SEQ ID NO: 104550 - protein, 16 aa, Borrelia burgdorferi B31
EIQELRVDGGASQNNL

SEQ ID NO: 104551 - protein, 16 aa, Borrelia burgdorferi B31
IQELRVDGGASQNNLL

SEQ ID NO: 104552 - protein, 16 aa, Borrelia burgdorferi B31
QELRVDGGASQNNLLM

SEQ ID NO: 104553 - protein, 16 aa, Borrelia burgdorferi B31
ELRVDGGASQNNLLMQ

SEQ ID NO: 104554 - protein, 16 aa, Borrelia burgdorferi B31
LRVDGGASQNNLLMQF

SEQ ID NO: 104555 - protein, 16 aa, Borrelia burgdorferi B31
RVDGGASQNNLLMQFQ

SEQ ID NO: 104556 - protein, 16 aa, Borrelia burgdorferi B31
VDGGASQNNLLMQFQA

SEQ ID NO: 104557 - protein, 16 aa, Borrelia burgdorferi B31
DGGASQNNLLMQFQAD

SEQ ID NO: 104558 - protein, 16 aa, Borrelia burgdorferi B31
GGASQNNLLMQFQADL

SEQ ID NO: 104559 - protein, 16 aa, Borrelia burgdorferi B31
GASQNNLLMQFQADLL

SEQ ID NO: 104560 - protein, 16 aa, Borrelia burgdorferi B31
ASQNNLLMQFQADLLE

SEQ ID NO: 104561 - protein, 16 aa, Borrelia burgdorferi B31
SQNNLLMQFQADLLEC

SEQ ID NO: 104562 - protein, 16 aa, Borrelia burgdorferi B31
QNNLLMQFQADLLECK

SEQ ID NO: 104563 - protein, 16 aa, Borrelia burgdorferi B31
NNLLMQFQADLLECKV

SEQ ID NO: 104564 - protein, 16 aa, Borrelia burgdorferi B31
NLLMQFQADLLECKVV

SEQ ID NO: 104565 - protein, 16 aa, Borrelia burgdorferi B31
LLMQFQADLLECKVVR

SEQ ID NO: 104566 - protein, 16 aa, Borrelia burgdorferi B31
LMQFQADLLECKVVRP

SEQ ID NO: 104567 - protein, 16 aa, Borrelia burgdorferi B31
MQFQADLLECKVVRPK

SEQ ID NO: 104568 - protein, 16 aa, Borrelia burgdorferi B31
QFQADLLECKVVRPKI

SEQ ID NO: 104569 - protein, 16 aa, Borrelia burgdorferi B31
FQADLLECKVVRPKIT

SEQ ID NO: 104570 - protein, 16 aa, Borrelia burgdorferi B31
QADLLECKVVRPKITE

SEQ ID NO: 104571 - protein, 16 aa, Borrelia burgdorferi B31
ADLLECKVVRPKITET

SEQ ID NO: 104572 - protein, 16 aa, Borrelia burgdorferi B31
DLLECKVVRPKITETT

SEQ ID NO: 104573 - protein, 16 aa, Borrelia burgdorferi B31
LLECKVVRPKITETTA

SEQ ID NO: 104574 - protein, 16 aa, Borrelia burgdorferi B31
LECKVVRPKITETTAL

SEQ ID NO: 104575 - protein, 16 aa, Borrelia burgdorferi B31
ECKVVRPKITETTALG

SEQ ID NO: 104576 - protein, 16 aa, Borrelia burgdorferi B31
CKVVRPKITETTALGA

SEQ ID NO: 104577 - protein, 16 aa, Borrelia burgdorferi B31
KVVRPKITETTALGAA

SEQ ID NO: 104578 - protein, 16 aa, Borrelia burgdorferi B31
VVRPKITETTALGAAY

SEQ ID NO: 104579 - protein, 16 aa, Borrelia burgdorferi B31
VRPKITETTALGAAYL

SEQ ID NO: 104580 - protein, 16 aa, Borrelia burgdorferi B31
RPKITETTALGAAYLA

SEQ ID NO: 104581 - protein, 16 aa, Borrelia burgdorferi B31
PKITETTALGAAYLAG

SEQ ID NO: 104582 - protein, 16 aa, Borrelia burgdorferi B31
KITETTALGAAYLAGL

SEQ ID NO: 104583 - protein, 16 aa, Borrelia burgdorferi B31
ITETTALGAAYLAGLA

SEQ ID NO: 104584 - protein, 16 aa, Borrelia burgdorferi B31
TETTALGAAYLAGLAT

SEQ ID NO: 104585 - protein, 16 aa, Borrelia burgdorferi B31
ETTALGAAYLAGLATG

SEQ ID NO: 104586 - protein, 16 aa, Borrelia burgdorferi B31
TTALGAAYLAGLATGY

SEQ ID NO: 104587 - protein, 16 aa, Borrelia burgdorferi B31
TALGAAYLAGLATGYW

SEQ ID NO: 104588 - protein, 16 aa, Borrelia burgdorferi B31
ALGAAYLAGLATGYWQ

SEQ ID NO: 104589 - protein, 16 aa, Borrelia burgdorferi B31
LGAAYLAGLATGYWQS

SEQ ID NO: 104590 - protein, 16 aa, Borrelia burgdorferi B31
GAAYLAGLATGYWQSA

SEQ ID NO: 104591 - protein, 16 aa, Borrelia burgdorferi B31
AAYLAGLATGYWQSAE

SEQ ID NO: 104592 - protein, 16 aa, Borrelia burgdorferi B31
AYLAGLATGYWQSAEE

SEQ ID NO: 104593 - protein, 16 aa, Borrelia burgdorferi B31
YLAGLATGYWQSAEEI

SEQ ID NO: 104594 - protein, 16 aa, Borrelia burgdorferi B31
LAGLATGYWQSAEEIV

SEQ ID NO: 104595 - protein, 16 aa, Borrelia burgdorferi B31
AGLATGYWQSAEEIVS

SEQ ID NO: 104596 - protein, 16 aa, Borrelia burgdorferi B31
GLATGYWQSAEEIVSL

SEQ ID NO: 104597 - protein, 16 aa, Borrelia burgdorferi B31
LATGYWQSAEEIVSLW

SEQ ID NO: 104598 - protein, 16 aa, Borrelia burgdorferi B31
ATGYWQSAEEIVSLWQ

SEQ ID NO: 104599 - protein, 16 aa, Borrelia burgdorferi B31
TGYWQSAEEIVSLWQV

SEQ ID NO: 104600 - protein, 16 aa, Borrelia burgdorferi B31
GYWQSAEEIVSLWQVD

SEQ ID NO: 104601 - protein, 16 aa, Borrelia burgdorferi B31
YWQSAEEIVSLWQVDK

SEQ ID NO: 104602 - protein, 16 aa, Borrelia burgdorferi B31
WQSAEEIVSLWQVDKI

SEQ ID NO: 104603 - protein, 16 aa, Borrelia burgdorferi B31
QSAEEIVSLWQVDKIF

SEQ ID NO: 104604 - protein, 16 aa, Borrelia burgdorferi B31
SAEEIVSLWQVDKIFE

SEQ ID NO: 104605 - protein, 16 aa, Borrelia burgdorferi B31
AEEIVSLWQVDKIFEP

SEQ ID NO: 104606 - protein, 16 aa, Borrelia burgdorferi B31
EEIVSLWQVDKIFEPS

SEQ ID NO: 104607 - protein, 16 aa, Borrelia burgdorferi B31
EIVSLWQVDKIFEPSM

SEQ ID NO: 104608 - protein, 16 aa, Borrelia burgdorferi B31
IVSLWQVDKIFEPSMP

SEQ ID NO: 104609 - protein, 16 aa, Borrelia burgdorferi B31
VSLWQVDKIFEPSMPK

SEQ ID NO: 104610 - protein, 16 aa, Borrelia burgdorferi B31
SLWQVDKIFEPSMPKN

SEQ ID NO: 104611 - protein, 16 aa, Borrelia burgdorferi B31
LWQVDKIFEPSMPKNQ

SEQ ID NO: 104612 - protein, 16 aa, Borrelia burgdorferi B31
WQVDKIFEPSMPKNQK

SEQ ID NO: 104613 - protein, 16 aa, Borrelia burgdorferi B31
QVDKIFEPSMPKNQKE

SEQ ID NO: 104614 - protein, 16 aa, Borrelia burgdorferi B31
VDKIFEPSMPKNQKEK

SEQ ID NO: 104615 - protein, 16 aa, Borrelia burgdorferi B31
DKIFEPSMPKNQKEKL

SEQ ID NO: 104616 - protein, 16 aa, Borrelia burgdorferi B31
KIFEPSMPKNQKEKLL

SEQ ID NO: 104617 - protein, 16 aa, Borrelia burgdorferi B31
IFEPSMPKNQKEKLLE

SEQ ID NO: 104618 - protein, 16 aa, Borrelia burgdorferi B31
FEPSMPKNQKEKLLEN

SEQ ID NO: 104619 - protein, 16 aa, Borrelia burgdorferi B31
EPSMPKNQKEKLLENW

SEQ ID NO: 104620 - protein, 16 aa, Borrelia burgdorferi B31
PSMPKNQKEKLLENWN

SEQ ID NO: 104621 - protein, 16 aa, Borrelia burgdorferi B31
SMPKNQKEKLLENWNK

SEQ ID NO: 104622 - protein, 16 aa, Borrelia burgdorferi B31
MPKNQKEKLLENWNKA

SEQ ID NO: 104623 - protein, 16 aa, Borrelia burgdorferi B31
PKNQKEKLLENWNKAV

SEQ ID NO: 104624 - protein, 16 aa, Borrelia burgdorferi B31
KNQKEKLLENWNKAVG

SEQ ID NO: 104625 - protein, 16 aa, Borrelia burgdorferi B31
NQKEKLLENWNKAVGK

SEQ ID NO: 104626 - protein, 16 aa, Borrelia burgdorferi B31
QKEKLLENWNKAVGKA

SEQ ID NO: 104627 - protein, 16 aa, Borrelia burgdorferi B31
KEKLLENWNKAVGKAK

SEQ ID NO: 104628 - protein, 16 aa, Borrelia burgdorferi B31
EKLLENWNKAVGKAKS

SEQ ID NO: 104629 - protein, 16 aa, Borrelia burgdorferi B31
KLLENWNKAVGKAKSW

SEQ ID NO: 104630 - protein, 16 aa, Borrelia burgdorferi B31
LLENWNKAVGKAKSWI

SEQ ID NO: 104631 - protein, 16 aa, Borrelia burgdorferi B31
LENWNKAVGKAKSWIQ

SEQ ID NO: 104632 - protein, 16 aa, Borrelia burgdorferi B31
ENWNKAVGKAKSWIQN

SEQ ID NO: 104633 - protein, 16 aa, Borrelia burgdorferi B31
NWNKAVGKAKSWIQNS

SEQ ID NO: 104634 - protein, 16 aa, Borrelia burgdorferi B31
WNKAVGKAKSWIQNSH

SEQ ID NO: 104635 - protein, 16 aa, Borrelia burgdorferi B31
NKAVGKAKSWIQNSHS

SEQ ID NO: 104636 - protein, 16 aa, Borrelia burgdorferi B31
KAVGKAKSWIQNSHSS

SEQ ID NO: 104637 - protein, 13 aa, Borrelia burgdorferi B31
MKTIKKDSEFYDS

SEQ ID NO: 104638 - protein, 13 aa, Borrelia burgdorferi B31
KTIKKDSEFYDSL

SEQ ID NO: 104639 - protein, 13 aa, Borrelia burgdorferi B31
TIKKDSEFYDSLA

SEQ ID NO: 104640 - protein, 13 aa, Borrelia burgdorferi B31
IKKDSEFYDSLAT

SEQ ID NO: 104641 - protein, 13 aa, Borrelia burgdorferi B31
KKDSEFYDSLATL

SEQ ID NO: 104642 - protein, 13 aa, Borrelia burgdorferi B31
KDSEFYDSLATLK

SEQ ID NO: 104643 - protein, 13 aa, Borrelia burgdorferi B31
DSEFYDSLATLKK

SEQ ID NO: 104644 - protein, 13 aa, Borrelia burgdorferi B31
SEFYDSLATLKKH

SEQ ID NO: 104645 - protein, 13 aa, Borrelia burgdorferi B31
EFYDSLATLKKHI

SEQ ID NO: 104646 - protein, 13 aa, Borrelia burgdorferi B31
FYDSLATLKKHIN

SEQ ID NO: 104647 - protein, 13 aa, Borrelia burgdorferi B31
YDSLATLKKHINK

SEQ ID NO: 104648 - protein, 13 aa, Borrelia burgdorferi B31
DSLATLKKHINKY

SEQ ID NO: 104649 - protein, 13 aa, Borrelia burgdorferi B31
SLATLKKHINKYI

SEQ ID NO: 104650 - protein, 13 aa, Borrelia burgdorferi B31
LATLKKHINKYIE

SEQ ID NO: 104651 - protein, 13 aa, Borrelia burgdorferi B31
ATLKKHINKYIEE

SEQ ID NO: 104652 - protein, 13 aa, Borrelia burgdorferi B31
TLKKHINKYIEEK

SEQ ID NO: 104653 - protein, 13 aa, Borrelia burgdorferi B31
LKKHINKYIEEKV

SEQ ID NO: 104654 - protein, 13 aa, Borrelia burgdorferi B31
KKHINKYIEEKVL

SEQ ID NO: 104655 - protein, 13 aa, Borrelia burgdorferi B31
KHINKYIEEKVLK

SEQ ID NO: 104656 - protein, 13 aa, Borrelia burgdorferi B31
HINKYIEEKVLKY

SEQ ID NO: 104657 - protein, 13 aa, Borrelia burgdorferi B31
INKYIEEKVLKYS

SEQ ID NO: 104658 - protein, 13 aa, Borrelia burgdorferi B31
NKYIEEKVLKYSI

SEQ ID NO: 104659 - protein, 13 aa, Borrelia burgdorferi B31
KYIEEKVLKYSIS

SEQ ID NO: 104660 - protein, 13 aa, Borrelia burgdorferi B31
YIEEKVLKYSISS

SEQ ID NO: 104661 - protein, 13 aa, Borrelia burgdorferi B31
IEEKVLKYSISSQ

SEQ ID NO: 104662 - protein, 13 aa, Borrelia burgdorferi B31
EEKVLKYSISSQL

SEQ ID NO: 104663 - protein, 13 aa, Borrelia burgdorferi B31
EKVLKYSISSQLY

SEQ ID NO: 104664 - protein, 13 aa, Borrelia burgdorferi B31
KVLKYSISSQLYK

SEQ ID NO: 104665 - protein, 13 aa, Borrelia burgdorferi B31
VLKYSISSQLYKL

SEQ ID NO: 104666 - protein, 13 aa, Borrelia burgdorferi B31
LKYSISSQLYKLE

SEQ ID NO: 104667 - protein, 13 aa, Borrelia burgdorferi B31
KYSISSQLYKLEK

SEQ ID NO: 104668 - protein, 13 aa, Borrelia burgdorferi B31
YSISSQLYKLEKP

SEQ ID NO: 104669 - protein, 13 aa, Borrelia burgdorferi B31
SISSQLYKLEKPE

SEQ ID NO: 104670 - protein, 13 aa, Borrelia burgdorferi B31
ISSQLYKLEKPEI

SEQ ID NO: 104671 - protein, 13 aa, Borrelia burgdorferi B31
SSQLYKLEKPEII

SEQ ID NO: 104672 - protein, 13 aa, Borrelia burgdorferi B31
SQLYKLEKPEIIE

SEQ ID NO: 104673 - protein, 13 aa, Borrelia burgdorferi B31
QLYKLEKPEIIEL

SEQ ID NO: 104674 - protein, 13 aa, Borrelia burgdorferi B31
LYKLEKPEIIELI

SEQ ID NO: 104675 - protein, 13 aa, Borrelia burgdorferi B31
YKLEKPEIIELIK

SEQ ID NO: 104676 - protein, 13 aa, Borrelia burgdorferi B31
KLEKPEIIELIKI

SEQ ID NO: 104677 - protein, 13 aa, Borrelia burgdorferi B31
LEKPEIIELIKIS

SEQ ID NO: 104678 - protein, 13 aa, Borrelia burgdorferi B31
EKPEIIELIKISN

SEQ ID NO: 104679 - protein, 13 aa, Borrelia burgdorferi B31
KPEIIELIKISND

SEQ ID NO: 104680 - protein, 13 aa, Borrelia burgdorferi B31
PEIIELIKISNDY

SEQ ID NO: 104681 - protein, 13 aa, Borrelia burgdorferi B31
EIIELIKISNDYE

SEQ ID NO: 104682 - protein, 13 aa, Borrelia burgdorferi B31
IIELIKISNDYEK

SEQ ID NO: 104683 - protein, 13 aa, Borrelia burgdorferi B31
IELIKISNDYEKE

SEQ ID NO: 104684 - protein, 13 aa, Borrelia burgdorferi B31
ELIKISNDYEKEK

SEQ ID NO: 104685 - protein, 13 aa, Borrelia burgdorferi B31
LIKISNDYEKEKN

SEQ ID NO: 104686 - protein, 13 aa, Borrelia burgdorferi B31
IKISNDYEKEKNA

SEQ ID NO: 104687 - protein, 13 aa, Borrelia burgdorferi B31
KISNDYEKEKNAF

SEQ ID NO: 104688 - protein, 13 aa, Borrelia burgdorferi B31
ISNDYEKEKNAFN

SEQ ID NO: 104689 - protein, 13 aa, Borrelia burgdorferi B31
SNDYEKEKNAFNT

SEQ ID NO: 104690 - protein, 13 aa, Borrelia burgdorferi B31
NDYEKEKNAFNTS

SEQ ID NO: 104691 - protein, 13 aa, Borrelia burgdorferi B31
DYEKEKNAFNTSL

SEQ ID NO: 104692 - protein, 13 aa, Borrelia burgdorferi B31
YEKEKNAFNTSLE

SEQ ID NO: 104693 - protein, 13 aa, Borrelia burgdorferi B31
EKEKNAFNTSLEE

SEQ ID NO: 104694 - protein, 13 aa, Borrelia burgdorferi B31
KEKNAFNTSLEEC

SEQ ID NO: 104695 - protein, 13 aa, Borrelia burgdorferi B31
EKNAFNTSLEECY

SEQ ID NO: 104696 - protein, 13 aa, Borrelia burgdorferi B31
KNAFNTSLEECYY

SEQ ID NO: 104697 - protein, 13 aa, Borrelia burgdorferi B31
NAFNTSLEECYYK

SEQ ID NO: 104698 - protein, 13 aa, Borrelia burgdorferi B31
AFNTSLEECYYKN

SEQ ID NO: 104699 - protein, 13 aa, Borrelia burgdorferi B31
FNTSLEECYYKNT

SEQ ID NO: 104700 - protein, 13 aa, Borrelia burgdorferi B31
NTSLEECYYKNTQ

SEQ ID NO: 104701 - protein, 13 aa, Borrelia burgdorferi B31
TSLEECYYKNTQN

SEQ ID NO: 104702 - protein, 13 aa, Borrelia burgdorferi B31
SLEECYYKNTQNE

SEQ ID NO: 104703 - protein, 13 aa, Borrelia burgdorferi B31
LEECYYKNTQNEA

SEQ ID NO: 104704 - protein, 13 aa, Borrelia burgdorferi B31
EECYYKNTQNEAI

SEQ ID NO: 104705 - protein, 13 aa, Borrelia burgdorferi B31
ECYYKNTQNEAIK

SEQ ID NO: 104706 - protein, 13 aa, Borrelia burgdorferi B31
CYYKNTQNEAIKK

SEQ ID NO: 104707 - protein, 13 aa, Borrelia burgdorferi B31
YYKNTQNEAIKKW

SEQ ID NO: 104708 - protein, 13 aa, Borrelia burgdorferi B31
YKNTQNEAIKKWI

SEQ ID NO: 104709 - protein, 13 aa, Borrelia burgdorferi B31
KNTQNEAIKKWIL

SEQ ID NO: 104710 - protein, 13 aa, Borrelia burgdorferi B31
NTQNEAIKKWILE

SEQ ID NO: 104711 - protein, 13 aa, Borrelia burgdorferi B31
TQNEAIKKWILEI

SEQ ID NO: 104712 - protein, 13 aa, Borrelia burgdorferi B31
QNEAIKKWILEIV

SEQ ID NO: 104713 - protein, 13 aa, Borrelia burgdorferi B31
NEAIKKWILEIVR

SEQ ID NO: 104714 - protein, 13 aa, Borrelia burgdorferi B31
EAIKKWILEIVRN

SEQ ID NO: 104715 - protein, 13 aa, Borrelia burgdorferi B31
AIKKWILEIVRNK

SEQ ID NO: 104716 - protein, 13 aa, Borrelia burgdorferi B31
IKKWILEIVRNKN

SEQ ID NO: 104717 - protein, 13 aa, Borrelia burgdorferi B31
KKWILEIVRNKNF

SEQ ID NO: 104718 - protein, 13 aa, Borrelia burgdorferi B31
KWILEIVRNKNFI

SEQ ID NO: 104719 - protein, 13 aa, Borrelia burgdorferi B31
WILEIVRNKNFIQ

SEQ ID NO: 104720 - protein, 13 aa, Borrelia burgdorferi B31
ILEIVRNKNFIQI

SEQ ID NO: 104721 - protein, 13 aa, Borrelia burgdorferi B31
LEIVRNKNFIQIS

SEQ ID NO: 104722 - protein, 13 aa, Borrelia burgdorferi B31
EIVRNKNFIQISK

SEQ ID NO: 104723 - protein, 13 aa, Borrelia burgdorferi B31
IVRNKNFIQISKE

SEQ ID NO: 104724 - protein, 13 aa, Borrelia burgdorferi B31
VRNKNFIQISKEA

SEQ ID NO: 104725 - protein, 13 aa, Borrelia burgdorferi B31
RNKNFIQISKEAN

SEQ ID NO: 104726 - protein, 13 aa, Borrelia burgdorferi B31
NKNFIQISKEANL

SEQ ID NO: 104727 - protein, 13 aa, Borrelia burgdorferi B31
KNFIQISKEANLN

SEQ ID NO: 104728 - protein, 13 aa, Borrelia burgdorferi B31
NFIQISKEANLNT

SEQ ID NO: 104729 - protein, 13 aa, Borrelia burgdorferi B31
FIQISKEANLNTK

SEQ ID NO: 104730 - protein, 13 aa, Borrelia burgdorferi B31
IQISKEANLNTKK

SEQ ID NO: 104731 - protein, 13 aa, Borrelia burgdorferi B31
QISKEANLNTKKL

SEQ ID NO: 104732 - protein, 13 aa, Borrelia burgdorferi B31
ISKEANLNTKKLG

SEQ ID NO: 104733 - protein, 13 aa, Borrelia burgdorferi B31
SKEANLNTKKLGT

SEQ ID NO: 104734 - protein, 13 aa, Borrelia burgdorferi B31
KEANLNTKKLGTT

SEQ ID NO: 104735 - protein, 13 aa, Borrelia burgdorferi B31
EANLNTKKLGTTY

SEQ ID NO: 104736 - protein, 13 aa, Borrelia burgdorferi B31
ANLNTKKLGTTYK

SEQ ID NO: 104737 - protein, 13 aa, Borrelia burgdorferi B31
NLNTKKLGTTYKL

SEQ ID NO: 104738 - protein, 13 aa, Borrelia burgdorferi B31
LNTKKLGTTYKLK

SEQ ID NO: 104739 - protein, 13 aa, Borrelia burgdorferi B31
NTKKLGTTYKLKS

SEQ ID NO: 104740 - protein, 13 aa, Borrelia burgdorferi B31
TKKLGTTYKLKSS

SEQ ID NO: 104741 - protein, 13 aa, Borrelia burgdorferi B31
KKLGTTYKLKSSN

SEQ ID NO: 104742 - protein, 13 aa, Borrelia burgdorferi B31
KLGTTYKLKSSNF

SEQ ID NO: 104743 - protein, 13 aa, Borrelia burgdorferi B31
LGTTYKLKSSNFL

SEQ ID NO: 104744 - protein, 13 aa, Borrelia burgdorferi B31
GTTYKLKSSNFLK

SEQ ID NO: 104745 - protein, 13 aa, Borrelia burgdorferi B31
TTYKLKSSNFLKL

SEQ ID NO: 104746 - protein, 13 aa, Borrelia burgdorferi B31
TYKLKSSNFLKLI

SEQ ID NO: 104747 - protein, 13 aa, Borrelia burgdorferi B31
YKLKSSNFLKLIE

SEQ ID NO: 104748 - protein, 13 aa, Borrelia burgdorferi B31
KLKSSNFLKLIEI

SEQ ID NO: 104749 - protein, 13 aa, Borrelia burgdorferi B31
LKSSNFLKLIEIQ

SEQ ID NO: 104750 - protein, 13 aa, Borrelia burgdorferi B31
KSSNFLKLIEIQN

SEQ ID NO: 104751 - protein, 13 aa, Borrelia burgdorferi B31
SSNFLKLIEIQNS

SEQ ID NO: 104752 - protein, 13 aa, Borrelia burgdorferi B31
SNFLKLIEIQNSP

SEQ ID NO: 104753 - protein, 13 aa, Borrelia burgdorferi B31
NFLKLIEIQNSPY

SEQ ID NO: 104754 - protein, 13 aa, Borrelia burgdorferi B31
FLKLIEIQNSPYY

SEQ ID NO: 104755 - protein, 13 aa, Borrelia burgdorferi B31
LKLIEIQNSPYYS

SEQ ID NO: 104756 - protein, 13 aa, Borrelia burgdorferi B31
KLIEIQNSPYYSQ

SEQ ID NO: 104757 - protein, 13 aa, Borrelia burgdorferi B31
LIEIQNSPYYSQE

SEQ ID NO: 104758 - protein, 13 aa, Borrelia burgdorferi B31
IEIQNSPYYSQEK

SEQ ID NO: 104759 - protein, 13 aa, Borrelia burgdorferi B31
EIQNSPYYSQEKK

SEQ ID NO: 104760 - protein, 13 aa, Borrelia burgdorferi B31
IQNSPYYSQEKKD

SEQ ID NO: 104761 - protein, 13 aa, Borrelia burgdorferi B31
QNSPYYSQEKKDI

SEQ ID NO: 104762 - protein, 13 aa, Borrelia burgdorferi B31
NSPYYSQEKKDIY

SEQ ID NO: 104763 - protein, 13 aa, Borrelia burgdorferi B31
SPYYSQEKKDIYK

SEQ ID NO: 104764 - protein, 13 aa, Borrelia burgdorferi B31
PYYSQEKKDIYKQ

SEQ ID NO: 104765 - protein, 13 aa, Borrelia burgdorferi B31
YYSQEKKDIYKQI

SEQ ID NO: 104766 - protein, 13 aa, Borrelia burgdorferi B31
YSQEKKDIYKQII

SEQ ID NO: 104767 - protein, 13 aa, Borrelia burgdorferi B31
SQEKKDIYKQIIL

SEQ ID NO: 104768 - protein, 13 aa, Borrelia burgdorferi B31
QEKKDIYKQIILN

SEQ ID NO: 104769 - protein, 13 aa, Borrelia burgdorferi B31
EKKDIYKQIILNF

SEQ ID NO: 104770 - protein, 13 aa, Borrelia burgdorferi B31
KKDIYKQIILNFS

SEQ ID NO: 104771 - protein, 13 aa, Borrelia burgdorferi B31
KDIYKQIILNFSS

SEQ ID NO: 104772 - protein, 13 aa, Borrelia burgdorferi B31
DIYKQIILNFSSN

SEQ ID NO: 104773 - protein, 13 aa, Borrelia burgdorferi B31
IYKQIILNFSSNI

SEQ ID NO: 104774 - protein, 13 aa, Borrelia burgdorferi B31
YKQIILNFSSNIN

SEQ ID NO: 104775 - protein, 13 aa, Borrelia burgdorferi B31
KQIILNFSSNINI

SEQ ID NO: 104776 - protein, 13 aa, Borrelia burgdorferi B31
QIILNFSSNINID

SEQ ID NO: 104777 - protein, 13 aa, Borrelia burgdorferi B31
IILNFSSNINIDS

SEQ ID NO: 104778 - protein, 13 aa, Borrelia burgdorferi B31
ILNFSSNINIDSL

SEQ ID NO: 104779 - protein, 13 aa, Borrelia burgdorferi B31
LNFSSNINIDSLE

SEQ ID NO: 104780 - protein, 13 aa, Borrelia burgdorferi B31
NFSSNINIDSLEQ

SEQ ID NO: 104781 - protein, 13 aa, Borrelia burgdorferi B31
FSSNINIDSLEQT

SEQ ID NO: 104782 - protein, 13 aa, Borrelia burgdorferi B31
SSNINIDSLEQTI

SEQ ID NO: 104783 - protein, 13 aa, Borrelia burgdorferi B31
SNINIDSLEQTID

SEQ ID NO: 104784 - protein, 13 aa, Borrelia burgdorferi B31
NINIDSLEQTIDI

SEQ ID NO: 104785 - protein, 13 aa, Borrelia burgdorferi B31
INIDSLEQTIDIL

SEQ ID NO: 104786 - protein, 13 aa, Borrelia burgdorferi B31
NIDSLEQTIDILV

SEQ ID NO: 104787 - protein, 13 aa, Borrelia burgdorferi B31
IDSLEQTIDILVA

SEQ ID NO: 104788 - protein, 13 aa, Borrelia burgdorferi B31
DSLEQTIDILVAV

SEQ ID NO: 104789 - protein, 13 aa, Borrelia burgdorferi B31
SLEQTIDILVAVR

SEQ ID NO: 104790 - protein, 13 aa, Borrelia burgdorferi B31
LEQTIDILVAVRN

SEQ ID NO: 104791 - protein, 13 aa, Borrelia burgdorferi B31
EQTIDILVAVRNR

SEQ ID NO: 104792 - protein, 13 aa, Borrelia burgdorferi B31
QTIDILVAVRNRN

SEQ ID NO: 104793 - protein, 13 aa, Borrelia burgdorferi B31
TIDILVAVRNRNK

SEQ ID NO: 104794 - protein, 13 aa, Borrelia burgdorferi B31
IDILVAVRNRNKI

SEQ ID NO: 104795 - protein, 13 aa, Borrelia burgdorferi B31
DILVAVRNRNKIK

SEQ ID NO: 104796 - protein, 13 aa, Borrelia burgdorferi B31
ILVAVRNRNKIKI

SEQ ID NO: 104797 - protein, 13 aa, Borrelia burgdorferi B31
LVAVRNRNKIKIL

SEQ ID NO: 104798 - protein, 13 aa, Borrelia burgdorferi B31
VAVRNRNKIKILN

SEQ ID NO: 104799 - protein, 13 aa, Borrelia burgdorferi B31
AVRNRNKIKILNI

SEQ ID NO: 104800 - protein, 13 aa, Borrelia burgdorferi B31
VRNRNKIKILNIL

SEQ ID NO: 104801 - protein, 13 aa, Borrelia burgdorferi B31
RNRNKIKILNILN

SEQ ID NO: 104802 - protein, 13 aa, Borrelia burgdorferi B31
NRNKIKILNILNK

SEQ ID NO: 104803 - protein, 13 aa, Borrelia burgdorferi B31
RNKIKILNILNKN

SEQ ID NO: 104804 - protein, 13 aa, Borrelia burgdorferi B31
NKIKILNILNKNL

SEQ ID NO: 104805 - protein, 13 aa, Borrelia burgdorferi B31
KIKILNILNKNLK

SEQ ID NO: 104806 - protein, 13 aa, Borrelia burgdorferi B31
IKILNILNKNLKY

SEQ ID NO: 104807 - protein, 13 aa, Borrelia burgdorferi B31
KILNILNKNLKYR

SEQ ID NO: 104808 - protein, 13 aa, Borrelia burgdorferi B31
ILNILNKNLKYRP

SEQ ID NO: 104809 - protein, 13 aa, Borrelia burgdorferi B31
LNILNKNLKYRPE

SEQ ID NO: 104810 - protein, 13 aa, Borrelia burgdorferi B31
NILNKNLKYRPEN

SEQ ID NO: 104811 - protein, 13 aa, Borrelia burgdorferi B31
ILNKNLKYRPENQ

SEQ ID NO: 104812 - protein, 13 aa, Borrelia burgdorferi B31
LNKNLKYRPENQK

SEQ ID NO: 104813 - protein, 13 aa, Borrelia burgdorferi B31
NKNLKYRPENQKV

SEQ ID NO: 104814 - protein, 13 aa, Borrelia burgdorferi B31
KNLKYRPENQKVF

SEQ ID NO: 104815 - protein, 13 aa, Borrelia burgdorferi B31
NLKYRPENQKVFK

SEQ ID NO: 104816 - protein, 13 aa, Borrelia burgdorferi B31
LKYRPENQKVFKS

SEQ ID NO: 104817 - protein, 13 aa, Borrelia burgdorferi B31
KYRPENQKVFKSS

SEQ ID NO: 104818 - protein, 13 aa, Borrelia burgdorferi B31
YRPENQKVFKSSL

SEQ ID NO: 104819 - protein, 13 aa, Borrelia burgdorferi B31
RPENQKVFKSSLT

SEQ ID NO: 104820 - protein, 13 aa, Borrelia burgdorferi B31
PENQKVFKSSLTN

SEQ ID NO: 104821 - protein, 13 aa, Borrelia burgdorferi B31
ENQKVFKSSLTNK

SEQ ID NO: 104822 - protein, 13 aa, Borrelia burgdorferi B31
NQKVFKSSLTNKE

SEQ ID NO: 104823 - protein, 13 aa, Borrelia burgdorferi B31
QKVFKSSLTNKES

SEQ ID NO: 104824 - protein, 13 aa, Borrelia burgdorferi B31
KVFKSSLTNKESR

SEQ ID NO: 104825 - protein, 13 aa, Borrelia burgdorferi B31
VFKSSLTNKESRL

SEQ ID NO: 104826 - protein, 13 aa, Borrelia burgdorferi B31
FKSSLTNKESRLI

SEQ ID NO: 104827 - protein, 13 aa, Borrelia burgdorferi B31
KSSLTNKESRLIK

SEQ ID NO: 104828 - protein, 13 aa, Borrelia burgdorferi B31
SSLTNKESRLIKL

SEQ ID NO: 104829 - protein, 13 aa, Borrelia burgdorferi B31
SLTNKESRLIKLK

SEQ ID NO: 104830 - protein, 13 aa, Borrelia burgdorferi B31
LTNKESRLIKLKR

SEQ ID NO: 104831 - protein, 13 aa, Borrelia burgdorferi B31
TNKESRLIKLKRM

SEQ ID NO: 104832 - protein, 13 aa, Borrelia burgdorferi B31
NKESRLIKLKRML

SEQ ID NO: 104833 - protein, 13 aa, Borrelia burgdorferi B31
KESRLIKLKRMLI

SEQ ID NO: 104834 - protein, 13 aa, Borrelia burgdorferi B31
ESRLIKLKRMLIL

SEQ ID NO: 104835 - protein, 13 aa, Borrelia burgdorferi B31
SRLIKLKRMLILT

SEQ ID NO: 104836 - protein, 13 aa, Borrelia burgdorferi B31
RLIKLKRMLILTY

SEQ ID NO: 104837 - protein, 13 aa, Borrelia burgdorferi B31
LIKLKRMLILTYW

SEQ ID NO: 104838 - protein, 13 aa, Borrelia burgdorferi B31
IKLKRMLILTYWP

SEQ ID NO: 104839 - protein, 13 aa, Borrelia burgdorferi B31
KLKRMLILTYWPV

SEQ ID NO: 104840 - protein, 13 aa, Borrelia burgdorferi B31
LKRMLILTYWPVG

SEQ ID NO: 104841 - protein, 13 aa, Borrelia burgdorferi B31
KRMLILTYWPVGC

SEQ ID NO: 104842 - protein, 13 aa, Borrelia burgdorferi B31
RMLILTYWPVGCL

SEQ ID NO: 104843 - protein, 13 aa, Borrelia burgdorferi B31
MLILTYWPVGCLS

SEQ ID NO: 104844 - protein, 13 aa, Borrelia burgdorferi B31
LILTYWPVGCLSK

SEQ ID NO: 104845 - protein, 13 aa, Borrelia burgdorferi B31
ILTYWPVGCLSKN

SEQ ID NO: 104846 - protein, 13 aa, Borrelia burgdorferi B31
LTYWPVGCLSKNI

SEQ ID NO: 104847 - protein, 13 aa, Borrelia burgdorferi B31
TYWPVGCLSKNIF

SEQ ID NO: 104848 - protein, 13 aa, Borrelia burgdorferi B31
YWPVGCLSKNIFI

SEQ ID NO: 104849 - protein, 13 aa, Borrelia burgdorferi B31
WPVGCLSKNIFIK

SEQ ID NO: 104850 - protein, 13 aa, Borrelia burgdorferi B31
PVGCLSKNIFIKI

SEQ ID NO: 104851 - protein, 13 aa, Borrelia burgdorferi B31
VGCLSKNIFIKIL

SEQ ID NO: 104852 - protein, 13 aa, Borrelia burgdorferi B31
GCLSKNIFIKILI

SEQ ID NO: 104853 - protein, 13 aa, Borrelia burgdorferi B31
CLSKNIFIKILIK

SEQ ID NO: 104854 - protein, 13 aa, Borrelia burgdorferi B31
  Xaa can be any naturally occurring amino acid
  VARIANT 13: Xaa = Any Amino Acid
LSKNIFIKILIKX

SEQ ID NO: 104855 - protein, 13 aa, Borrelia burgdorferi B31
  Xaa can be any naturally occurring amino acid
  VARIANT 12: Xaa = Any Amino Acid
SKNIFIKILIKXY

SEQ ID NO: 104856 - protein, 13 aa, Borrelia burgdorferi B31
  Xaa can be any naturally occurring amino acid
  VARIANT 11: Xaa = Any Amino Acid
KNIFIKILIKXYK

SEQ ID NO: 104857 - protein, 13 aa, Borrelia burgdorferi B31
  Xaa can be any naturally occurring amino acid
  VARIANT 10: Xaa = Any Amino Acid
NIFIKILIKXYKY

SEQ ID NO: 104858 - protein, 13 aa, Borrelia burgdorferi B31
  Xaa can be any naturally occurring amino acid
  VARIANT 9: Xaa = Any Amino Acid
IFIKILIKXYKYL

SEQ ID NO: 104859 - protein, 13 aa, Borrelia burgdorferi B31
  Xaa can be any naturally occurring amino acid
  VARIANT 8: Xaa = Any Amino Acid
FIKILIKXYKYLE

SEQ ID NO: 104860 - protein, 13 aa, Borrelia burgdorferi B31
  Xaa can be any naturally occurring amino acid
  VARIANT 7: Xaa = Any Amino Acid
IKILIKXYKYLEE

SEQ ID NO: 104861 - protein, 13 aa, Borrelia burgdorferi B31
  Xaa can be any naturally occurring amino acid
  VARIANT 6: Xaa = Any Amino Acid
KILIKXYKYLEEE

SEQ ID NO: 104862 - protein, 13 aa, Borrelia burgdorferi B31
  Xaa can be any naturally occurring amino acid
  VARIANT 5: Xaa = Any Amino Acid
ILIKXYKYLEEEI

SEQ ID NO: 104863 - protein, 13 aa, Borrelia burgdorferi B31
  Xaa can be any naturally occurring amino acid
  VARIANT 4: Xaa = Any Amino Acid
LIKXYKYLEEEIL

SEQ ID NO: 104864 - protein, 13 aa, Borrelia burgdorferi B31
  Xaa can be any naturally occurring amino acid
  VARIANT 3: Xaa = Any Amino Acid
IKXYKYLEEEILA

SEQ ID NO: 104865 - protein, 13 aa, Borrelia burgdorferi B31
  Xaa can be any naturally occurring amino acid
  VARIANT 2: Xaa = Any Amino Acid
KXYKYLEEEILAL

SEQ ID NO: 104866 - protein, 13 aa, Borrelia burgdorferi B31
  Xaa can be any naturally occurring amino acid
  VARIANT 1: Xaa = Any Amino Acid
XYKYLEEEILALK

SEQ ID NO: 104867 - protein, 13 aa, Borrelia burgdorferi B31
YKYLEEEILALKY

SEQ ID NO: 104868 - protein, 13 aa, Borrelia burgdorferi B31
KYLEEEILALKYN

SEQ ID NO: 104869 - protein, 13 aa, Borrelia burgdorferi B31
YLEEEILALKYNE

SEQ ID NO: 104870 - protein, 13 aa, Borrelia burgdorferi B31
LEEEILALKYNEI

SEQ ID NO: 104871 - protein, 13 aa, Borrelia burgdorferi B31
EEEILALKYNEIL

SEQ ID NO: 104872 - protein, 13 aa, Borrelia burgdorferi B31
EEILALKYNEILN

SEQ ID NO: 104873 - protein, 13 aa, Borrelia burgdorferi B31
EILALKYNEILNY

SEQ ID NO: 104874 - protein, 13 aa, Borrelia burgdorferi B31
ILALKYNEILNYL

SEQ ID NO: 104875 - protein, 13 aa, Borrelia burgdorferi B31
LALKYNEILNYLR

SEQ ID NO: 104876 - protein, 13 aa, Borrelia burgdorferi B31
ALKYNEILNYLRA

SEQ ID NO: 104877 - protein, 13 aa, Borrelia burgdorferi B31
LKYNEILNYLRAL

SEQ ID NO: 104878 - protein, 13 aa, Borrelia burgdorferi B31
KYNEILNYLRALK

SEQ ID NO: 104879 - protein, 13 aa, Borrelia burgdorferi B31
YNEILNYLRALKT

SEQ ID NO: 104880 - protein, 13 aa, Borrelia burgdorferi B31
NEILNYLRALKTL

SEQ ID NO: 104881 - protein, 13 aa, Borrelia burgdorferi B31
EILNYLRALKTLS

SEQ ID NO: 104882 - protein, 13 aa, Borrelia burgdorferi B31
ILNYLRALKTLSL

SEQ ID NO: 104883 - protein, 13 aa, Borrelia burgdorferi B31
LNYLRALKTLSLN

SEQ ID NO: 104884 - protein, 13 aa, Borrelia burgdorferi B31
NYLRALKTLSLNE

SEQ ID NO: 104885 - protein, 13 aa, Borrelia burgdorferi B31
YLRALKTLSLNEI

SEQ ID NO: 104886 - protein, 13 aa, Borrelia burgdorferi B31
LRALKTLSLNEIF

SEQ ID NO: 104887 - protein, 13 aa, Borrelia burgdorferi B31
RALKTLSLNEIFY

SEQ ID NO: 104888 - protein, 13 aa, Borrelia burgdorferi B31
ALKTLSLNEIFYK

SEQ ID NO: 104889 - protein, 13 aa, Borrelia burgdorferi B31
LKTLSLNEIFYKG

SEQ ID NO: 104890 - protein, 13 aa, Borrelia burgdorferi B31
KTLSLNEIFYKGS

SEQ ID NO: 104891 - protein, 13 aa, Borrelia burgdorferi B31
TLSLNEIFYKGSS

SEQ ID NO: 104892 - protein, 13 aa, Borrelia burgdorferi B31
LSLNEIFYKGSSK

SEQ ID NO: 104893 - protein, 13 aa, Borrelia burgdorferi B31
SLNEIFYKGSSKN

SEQ ID NO: 104894 - protein, 13 aa, Borrelia burgdorferi B31
LNEIFYKGSSKNI

SEQ ID NO: 104895 - protein, 13 aa, Borrelia burgdorferi B31
NEIFYKGSSKNIS

SEQ ID NO: 104896 - protein, 13 aa, Borrelia burgdorferi B31
EIFYKGSSKNISF

SEQ ID NO: 104897 - protein, 13 aa, Borrelia burgdorferi B31
IFYKGSSKNISFN

SEQ ID NO: 104898 - protein, 13 aa, Borrelia burgdorferi B31
FYKGSSKNISFNY

SEQ ID NO: 104899 - protein, 13 aa, Borrelia burgdorferi B31
YKGSSKNISFNYF

SEQ ID NO: 104900 - protein, 13 aa, Borrelia burgdorferi B31
KGSSKNISFNYFF

SEQ ID NO: 104901 - protein, 13 aa, Borrelia burgdorferi B31
GSSKNISFNYFFS

SEQ ID NO: 104902 - protein, 13 aa, Borrelia burgdorferi B31
SSKNISFNYFFSD

SEQ ID NO: 104903 - protein, 13 aa, Borrelia burgdorferi B31
SKNISFNYFFSDF

SEQ ID NO: 104904 - protein, 13 aa, Borrelia burgdorferi B31
KNISFNYFFSDFT

SEQ ID NO: 104905 - protein, 13 aa, Borrelia burgdorferi B31
NISFNYFFSDFTQ

SEQ ID NO: 104906 - protein, 13 aa, Borrelia burgdorferi B31
ISFNYFFSDFTQY

SEQ ID NO: 104907 - protein, 13 aa, Borrelia burgdorferi B31
SFNYFFSDFTQYA

SEQ ID NO: 104908 - protein, 13 aa, Borrelia burgdorferi B31
FNYFFSDFTQYAP

SEQ ID NO: 104909 - protein, 13 aa, Borrelia burgdorferi B31
NYFFSDFTQYAPK

SEQ ID NO: 104910 - protein, 13 aa, Borrelia burgdorferi B31
YFFSDFTQYAPKD

SEQ ID NO: 104911 - protein, 13 aa, Borrelia burgdorferi B31
FFSDFTQYAPKDF

SEQ ID NO: 104912 - protein, 13 aa, Borrelia burgdorferi B31
FSDFTQYAPKDFQ

SEQ ID NO: 104913 - protein, 13 aa, Borrelia burgdorferi B31
SDFTQYAPKDFQD

SEQ ID NO: 104914 - protein, 13 aa, Borrelia burgdorferi B31
DFTQYAPKDFQDT

SEQ ID NO: 104915 - protein, 13 aa, Borrelia burgdorferi B31
FTQYAPKDFQDTL

SEQ ID NO: 104916 - protein, 13 aa, Borrelia burgdorferi B31
TQYAPKDFQDTLK

SEQ ID NO: 104917 - protein, 13 aa, Borrelia burgdorferi B31
QYAPKDFQDTLKC

SEQ ID NO: 104918 - protein, 13 aa, Borrelia burgdorferi B31
YAPKDFQDTLKCY

SEQ ID NO: 104919 - protein, 13 aa, Borrelia burgdorferi B31
APKDFQDTLKCYL

SEQ ID NO: 104920 - protein, 13 aa, Borrelia burgdorferi B31
PKDFQDTLKCYLY

SEQ ID NO: 104921 - protein, 13 aa, Borrelia burgdorferi B31
KDFQDTLKCYLYV

SEQ ID NO: 104922 - protein, 13 aa, Borrelia burgdorferi B31
DFQDTLKCYLYVI

SEQ ID NO: 104923 - protein, 13 aa, Borrelia burgdorferi B31
FQDTLKCYLYVIE

SEQ ID NO: 104924 - protein, 13 aa, Borrelia burgdorferi B31
QDTLKCYLYVIEK

SEQ ID NO: 104925 - protein, 13 aa, Borrelia burgdorferi B31
DTLKCYLYVIEKT

SEQ ID NO: 104926 - protein, 13 aa, Borrelia burgdorferi B31
TLKCYLYVIEKTI

SEQ ID NO: 104927 - protein, 13 aa, Borrelia burgdorferi B31
LKCYLYVIEKTIT

SEQ ID NO: 104928 - protein, 13 aa, Borrelia burgdorferi B31
KCYLYVIEKTITK

SEQ ID NO: 104929 - protein, 13 aa, Borrelia burgdorferi B31
CYLYVIEKTITKK

SEQ ID NO: 104930 - protein, 13 aa, Borrelia burgdorferi B31
YLYVIEKTITKKY

SEQ ID NO: 104931 - protein, 13 aa, Borrelia burgdorferi B31
LYVIEKTITKKYL

SEQ ID NO: 104932 - protein, 13 aa, Borrelia burgdorferi B31
YVIEKTITKKYLT

SEQ ID NO: 104933 - protein, 13 aa, Borrelia burgdorferi B31
VIEKTITKKYLTW

SEQ ID NO: 104934 - protein, 13 aa, Borrelia burgdorferi B31
IEKTITKKYLTWF

SEQ ID NO: 104935 - protein, 13 aa, Borrelia burgdorferi B31
EKTITKKYLTWFF

SEQ ID NO: 104936 - protein, 13 aa, Borrelia burgdorferi B31
KTITKKYLTWFFK

SEQ ID NO: 104937 - protein, 13 aa, Borrelia burgdorferi B31
TITKKYLTWFFKD

SEQ ID NO: 104938 - protein, 13 aa, Borrelia burgdorferi B31
ITKKYLTWFFKDK

SEQ ID NO: 104939 - protein, 13 aa, Borrelia burgdorferi B31
TKKYLTWFFKDKI

SEQ ID NO: 104940 - protein, 13 aa, Borrelia burgdorferi B31
KKYLTWFFKDKIS

SEQ ID NO: 104941 - protein, 13 aa, Borrelia burgdorferi B31
KYLTWFFKDKISN

SEQ ID NO: 104942 - protein, 13 aa, Borrelia burgdorferi B31
YLTWFFKDKISNN

SEQ ID NO: 104943 - protein, 13 aa, Borrelia burgdorferi B31
LTWFFKDKISNNW

SEQ ID NO: 104944 - protein, 13 aa, Borrelia burgdorferi B31
TWFFKDKISNNWE

SEQ ID NO: 104945 - protein, 13 aa, Borrelia burgdorferi B31
WFFKDKISNNWES

SEQ ID NO: 104946 - protein, 13 aa, Borrelia burgdorferi B31
FFKDKISNNWESF

SEQ ID NO: 104947 - protein, 13 aa, Borrelia burgdorferi B31
FKDKISNNWESFI

SEQ ID NO: 104948 - protein, 13 aa, Borrelia burgdorferi B31
KDKISNNWESFID

SEQ ID NO: 104949 - protein, 13 aa, Borrelia burgdorferi B31
DKISNNWESFIDA

SEQ ID NO: 104950 - protein, 13 aa, Borrelia burgdorferi B31
KISNNWESFIDAL

SEQ ID NO: 104951 - protein, 13 aa, Borrelia burgdorferi B31
ISNNWESFIDALE

SEQ ID NO: 104952 - protein, 13 aa, Borrelia burgdorferi B31
SNNWESFIDALEY

SEQ ID NO: 104953 - protein, 13 aa, Borrelia burgdorferi B31
NNWESFIDALEYI

SEQ ID NO: 104954 - protein, 13 aa, Borrelia burgdorferi B31
NWESFIDALEYIE

SEQ ID NO: 104955 - protein, 13 aa, Borrelia burgdorferi B31
WESFIDALEYIEK

SEQ ID NO: 104956 - protein, 13 aa, Borrelia burgdorferi B31
ESFIDALEYIEKH

SEQ ID NO: 104957 - protein, 13 aa, Borrelia burgdorferi B31
SFIDALEYIEKHK

SEQ ID NO: 104958 - protein, 13 aa, Borrelia burgdorferi B31
FIDALEYIEKHKL

SEQ ID NO: 104959 - protein, 13 aa, Borrelia burgdorferi B31
IDALEYIEKHKLI

SEQ ID NO: 104960 - protein, 13 aa, Borrelia burgdorferi B31
DALEYIEKHKLIN

SEQ ID NO: 104961 - protein, 13 aa, Borrelia burgdorferi B31
ALEYIEKHKLINI

SEQ ID NO: 104962 - protein, 13 aa, Borrelia burgdorferi B31
LEYIEKHKLINIK

SEQ ID NO: 104963 - protein, 13 aa, Borrelia burgdorferi B31
EYIEKHKLINIKE

SEQ ID NO: 104964 - protein, 13 aa, Borrelia burgdorferi B31
YIEKHKLINIKEK

SEQ ID NO: 104965 - protein, 13 aa, Borrelia burgdorferi B31
IEKHKLINIKEKI

SEQ ID NO: 104966 - protein, 13 aa, Borrelia burgdorferi B31
EKHKLINIKEKIK

SEQ ID NO: 104967 - protein, 13 aa, Borrelia burgdorferi B31
KHKLINIKEKIKE

SEQ ID NO: 104968 - protein, 13 aa, Borrelia burgdorferi B31
HKLINIKEKIKEI

SEQ ID NO: 104969 - protein, 13 aa, Borrelia burgdorferi B31
KLINIKEKIKEII

SEQ ID NO: 104970 - protein, 13 aa, Borrelia burgdorferi B31
LINIKEKIKEIIT

SEQ ID NO: 104971 - protein, 13 aa, Borrelia burgdorferi B31
INIKEKIKEIITA

SEQ ID NO: 104972 - protein, 13 aa, Borrelia burgdorferi B31
NIKEKIKEIITAK

SEQ ID NO: 104973 - protein, 13 aa, Borrelia burgdorferi B31
IKEKIKEIITAKF

SEQ ID NO: 104974 - protein, 13 aa, Borrelia burgdorferi B31
KEKIKEIITAKFQ

SEQ ID NO: 104975 - protein, 13 aa, Borrelia burgdorferi B31
EKIKEIITAKFQT

SEQ ID NO: 104976 - protein, 13 aa, Borrelia burgdorferi B31
KIKEIITAKFQTE

SEQ ID NO: 104977 - protein, 13 aa, Borrelia burgdorferi B31
IKEIITAKFQTED

SEQ ID NO: 104978 - protein, 13 aa, Borrelia burgdorferi B31
KEIITAKFQTEDF

SEQ ID NO: 104979 - protein, 13 aa, Borrelia burgdorferi B31
EIITAKFQTEDFF

SEQ ID NO: 104980 - protein, 13 aa, Borrelia burgdorferi B31
IITAKFQTEDFFI

SEQ ID NO: 104981 - protein, 13 aa, Borrelia burgdorferi B31
ITAKFQTEDFFIS

SEQ ID NO: 104982 - protein, 13 aa, Borrelia burgdorferi B31
TAKFQTEDFFISF

SEQ ID NO: 104983 - protein, 13 aa, Borrelia burgdorferi B31
AKFQTEDFFISFD

SEQ ID NO: 104984 - protein, 13 aa, Borrelia burgdorferi B31
KFQTEDFFISFDK

SEQ ID NO: 104985 - protein, 13 aa, Borrelia burgdorferi B31
FQTEDFFISFDKT

SEQ ID NO: 104986 - protein, 13 aa, Borrelia burgdorferi B31
QTEDFFISFDKTN

SEQ ID NO: 104987 - protein, 13 aa, Borrelia burgdorferi B31
TEDFFISFDKTNF

SEQ ID NO: 104988 - protein, 13 aa, Borrelia burgdorferi B31
EDFFISFDKTNFN

SEQ ID NO: 104989 - protein, 13 aa, Borrelia burgdorferi B31
DFFISFDKTNFNP

SEQ ID NO: 104990 - protein, 13 aa, Borrelia burgdorferi B31
FFISFDKTNFNPY

SEQ ID NO: 104991 - protein, 13 aa, Borrelia burgdorferi B31
FISFDKTNFNPYE

SEQ ID NO: 104992 - protein, 13 aa, Borrelia burgdorferi B31
ISFDKTNFNPYES

SEQ ID NO: 104993 - protein, 13 aa, Borrelia burgdorferi B31
SFDKTNFNPYESS

SEQ ID NO: 104994 - protein, 13 aa, Borrelia burgdorferi B31
FDKTNFNPYESSI

SEQ ID NO: 104995 - protein, 13 aa, Borrelia burgdorferi B31
DKTNFNPYESSIF

SEQ ID NO: 104996 - protein, 13 aa, Borrelia burgdorferi B31
KTNFNPYESSIFK

SEQ ID NO: 104997 - protein, 13 aa, Borrelia burgdorferi B31
TNFNPYESSIFKE

SEQ ID NO: 104998 - protein, 13 aa, Borrelia burgdorferi B31
NFNPYESSIFKER

SEQ ID NO: 104999 - protein, 13 aa, Borrelia burgdorferi B31
FNPYESSIFKERY

SEQ ID NO: 105000 - protein, 13 aa, Borrelia burgdorferi B31
NPYESSIFKERYI

SEQ ID NO: 105001 - protein, 13 aa, Borrelia burgdorferi B31
PYESSIFKERYIK

SEQ ID NO: 105002 - protein, 13 aa, Borrelia burgdorferi B31
YESSIFKERYIKS

SEQ ID NO: 105003 - protein, 13 aa, Borrelia burgdorferi B31
ESSIFKERYIKSA

SEQ ID NO: 105004 - protein, 13 aa, Borrelia burgdorferi B31
SSIFKERYIKSAF

SEQ ID NO: 105005 - protein, 13 aa, Borrelia burgdorferi B31
SIFKERYIKSAFL

SEQ ID NO: 105006 - protein, 13 aa, Borrelia burgdorferi B31
IFKERYIKSAFLE

SEQ ID NO: 105007 - protein, 13 aa, Borrelia burgdorferi B31
FKERYIKSAFLEI

SEQ ID NO: 105008 - protein, 13 aa, Borrelia burgdorferi B31
KERYIKSAFLEII

SEQ ID NO: 105009 - protein, 13 aa, Borrelia burgdorferi B31
ERYIKSAFLEIIM

SEQ ID NO: 105010 - protein, 13 aa, Borrelia burgdorferi B31
RYIKSAFLEIIMH

SEQ ID NO: 105011 - protein, 13 aa, Borrelia burgdorferi B31
YIKSAFLEIIMHY

SEQ ID NO: 105012 - protein, 13 aa, Borrelia burgdorferi B31
IKSAFLEIIMHYV

SEQ ID NO: 105013 - protein, 13 aa, Borrelia burgdorferi B31
KSAFLEIIMHYVK

SEQ ID NO: 105014 - protein, 13 aa, Borrelia burgdorferi B31
SAFLEIIMHYVKK

SEQ ID NO: 105015 - protein, 13 aa, Borrelia burgdorferi B31
AFLEIIMHYVKKN

SEQ ID NO: 105016 - protein, 13 aa, Borrelia burgdorferi B31
FLEIIMHYVKKNS

SEQ ID NO: 105017 - protein, 13 aa, Borrelia burgdorferi B31
LEIIMHYVKKNSQ

SEQ ID NO: 105018 - protein, 13 aa, Borrelia burgdorferi B31
EIIMHYVKKNSQN

SEQ ID NO: 105019 - protein, 13 aa, Borrelia burgdorferi B31
IIMHYVKKNSQNI

SEQ ID NO: 105020 - protein, 13 aa, Borrelia burgdorferi B31
IMHYVKKNSQNIE

SEQ ID NO: 105021 - protein, 13 aa, Borrelia burgdorferi B31
MHYVKKNSQNIET

SEQ ID NO: 105022 - protein, 13 aa, Borrelia burgdorferi B31
HYVKKNSQNIETY

SEQ ID NO: 105023 - protein, 13 aa, Borrelia burgdorferi B31
YVKKNSQNIETYG

SEQ ID NO: 105024 - protein, 13 aa, Borrelia burgdorferi B31
VKKNSQNIETYGW

SEQ ID NO: 105025 - protein, 13 aa, Borrelia burgdorferi B31
KKNSQNIETYGWI

SEQ ID NO: 105026 - protein, 13 aa, Borrelia burgdorferi B31
KNSQNIETYGWIA

SEQ ID NO: 105027 - protein, 13 aa, Borrelia burgdorferi B31
NSQNIETYGWIAF

SEQ ID NO: 105028 - protein, 13 aa, Borrelia burgdorferi B31
SQNIETYGWIAFY

SEQ ID NO: 105029 - protein, 13 aa, Borrelia burgdorferi B31
QNIETYGWIAFYI

SEQ ID NO: 105030 - protein, 13 aa, Borrelia burgdorferi B31
NIETYGWIAFYIY

SEQ ID NO: 105031 - protein, 13 aa, Borrelia burgdorferi B31
IETYGWIAFYIYA

SEQ ID NO: 105032 - protein, 13 aa, Borrelia burgdorferi B31
ETYGWIAFYIYAD

SEQ ID NO: 105033 - protein, 13 aa, Borrelia burgdorferi B31
TYGWIAFYIYADN

SEQ ID NO: 105034 - protein, 13 aa, Borrelia burgdorferi B31
YGWIAFYIYADNK

SEQ ID NO: 105035 - protein, 13 aa, Borrelia burgdorferi B31
GWIAFYIYADNKD

SEQ ID NO: 105036 - protein, 13 aa, Borrelia burgdorferi B31
WIAFYIYADNKDK

SEQ ID NO: 105037 - protein, 13 aa, Borrelia burgdorferi B31
IAFYIYADNKDKK

SEQ ID NO: 105038 - protein, 13 aa, Borrelia burgdorferi B31
AFYIYADNKDKKI

SEQ ID NO: 105039 - protein, 13 aa, Borrelia burgdorferi B31
FYIYADNKDKKIF

SEQ ID NO: 105040 - protein, 13 aa, Borrelia burgdorferi B31
YIYADNKDKKIFC

SEQ ID NO: 105041 - protein, 13 aa, Borrelia burgdorferi B31
IYADNKDKKIFCQ

SEQ ID NO: 105042 - protein, 13 aa, Borrelia burgdorferi B31
YADNKDKKIFCQR

SEQ ID NO: 105043 - protein, 13 aa, Borrelia burgdorferi B31
ADNKDKKIFCQRM

SEQ ID NO: 105044 - protein, 13 aa, Borrelia burgdorferi B31
DNKDKKIFCQRMK

SEQ ID NO: 105045 - protein, 13 aa, Borrelia burgdorferi B31
NKDKKIFCQRMKE

SEQ ID NO: 105046 - protein, 13 aa, Borrelia burgdorferi B31
KDKKIFCQRMKEF

SEQ ID NO: 105047 - protein, 13 aa, Borrelia burgdorferi B31
DKKIFCQRMKEFF

SEQ ID NO: 105048 - protein, 13 aa, Borrelia burgdorferi B31
KKIFCQRMKEFFK

SEQ ID NO: 105049 - protein, 13 aa, Borrelia burgdorferi B31
KIFCQRMKEFFKS

SEQ ID NO: 105050 - protein, 13 aa, Borrelia burgdorferi B31
IFCQRMKEFFKSK

SEQ ID NO: 105051 - protein, 13 aa, Borrelia burgdorferi B31
FCQRMKEFFKSKT

SEQ ID NO: 105052 - protein, 13 aa, Borrelia burgdorferi B31
CQRMKEFFKSKTF

SEQ ID NO: 105053 - protein, 13 aa, Borrelia burgdorferi B31
QRMKEFFKSKTFE

SEQ ID NO: 105054 - protein, 13 aa, Borrelia burgdorferi B31
RMKEFFKSKTFEI

SEQ ID NO: 105055 - protein, 13 aa, Borrelia burgdorferi B31
MKEFFKSKTFEIQ

SEQ ID NO: 105056 - protein, 13 aa, Borrelia burgdorferi B31
KEFFKSKTFEIQN

SEQ ID NO: 105057 - protein, 13 aa, Borrelia burgdorferi B31
EFFKSKTFEIQNQ

SEQ ID NO: 105058 - protein, 13 aa, Borrelia burgdorferi B31
FFKSKTFEIQNQI

SEQ ID NO: 105059 - protein, 13 aa, Borrelia burgdorferi B31
FKSKTFEIQNQIF

SEQ ID NO: 105060 - protein, 13 aa, Borrelia burgdorferi B31
KSKTFEIQNQIFV

SEQ ID NO: 105061 - protein, 13 aa, Borrelia burgdorferi B31
SKTFEIQNQIFVY

SEQ ID NO: 105062 - protein, 13 aa, Borrelia burgdorferi B31
KTFEIQNQIFVYF

SEQ ID NO: 105063 - protein, 13 aa, Borrelia burgdorferi B31
TFEIQNQIFVYFL

SEQ ID NO: 105064 - protein, 13 aa, Borrelia burgdorferi B31
FEIQNQIFVYFLS

SEQ ID NO: 105065 - protein, 13 aa, Borrelia burgdorferi B31
EIQNQIFVYFLSF

SEQ ID NO: 105066 - protein, 13 aa, Borrelia burgdorferi B31
IQNQIFVYFLSFY

SEQ ID NO: 105067 - protein, 13 aa, Borrelia burgdorferi B31
QNQIFVYFLSFYP

SEQ ID NO: 105068 - protein, 13 aa, Borrelia burgdorferi B31
NQIFVYFLSFYPN

SEQ ID NO: 105069 - protein, 13 aa, Borrelia burgdorferi B31
QIFVYFLSFYPNI

SEQ ID NO: 105070 - protein, 13 aa, Borrelia burgdorferi B31
IFVYFLSFYPNIE

SEQ ID NO: 105071 - protein, 13 aa, Borrelia burgdorferi B31
FVYFLSFYPNIEY

SEQ ID NO: 105072 - protein, 13 aa, Borrelia burgdorferi B31
VYFLSFYPNIEYK

SEQ ID NO: 105073 - protein, 13 aa, Borrelia burgdorferi B31
YFLSFYPNIEYKH

SEQ ID NO: 105074 - protein, 13 aa, Borrelia burgdorferi B31
FLSFYPNIEYKHF

SEQ ID NO: 105075 - protein, 13 aa, Borrelia burgdorferi B31
LSFYPNIEYKHFK

SEQ ID NO: 105076 - protein, 13 aa, Borrelia burgdorferi B31
SFYPNIEYKHFKF

SEQ ID NO: 105077 - protein, 13 aa, Borrelia burgdorferi B31
FYPNIEYKHFKFI

SEQ ID NO: 105078 - protein, 13 aa, Borrelia burgdorferi B31
YPNIEYKHFKFIS

SEQ ID NO: 105079 - protein, 13 aa, Borrelia burgdorferi B31
PNIEYKHFKFISD

SEQ ID NO: 105080 - protein, 13 aa, Borrelia burgdorferi B31
NIEYKHFKFISDI

SEQ ID NO: 105081 - protein, 13 aa, Borrelia burgdorferi B31
IEYKHFKFISDIL

SEQ ID NO: 105082 - protein, 13 aa, Borrelia burgdorferi B31
EYKHFKFISDILL

SEQ ID NO: 105083 - protein, 13 aa, Borrelia burgdorferi B31
YKHFKFISDILLY

SEQ ID NO: 105084 - protein, 13 aa, Borrelia burgdorferi B31
KHFKFISDILLYL

SEQ ID NO: 105085 - protein, 13 aa, Borrelia burgdorferi B31
HFKFISDILLYLD

SEQ ID NO: 105086 - protein, 13 aa, Borrelia burgdorferi B31
FKFISDILLYLDE

SEQ ID NO: 105087 - protein, 13 aa, Borrelia burgdorferi B31
KFISDILLYLDEN

SEQ ID NO: 105088 - protein, 13 aa, Borrelia burgdorferi B31
FISDILLYLDENK

SEQ ID NO: 105089 - protein, 13 aa, Borrelia burgdorferi B31
ISDILLYLDENKI

SEQ ID NO: 105090 - protein, 13 aa, Borrelia burgdorferi B31
SDILLYLDENKIT

SEQ ID NO: 105091 - protein, 13 aa, Borrelia burgdorferi B31
DILLYLDENKITI

SEQ ID NO: 105092 - protein, 13 aa, Borrelia burgdorferi B31
ILLYLDENKITIP

SEQ ID NO: 105093 - protein, 13 aa, Borrelia burgdorferi B31
LLYLDENKITIPK

SEQ ID NO: 105094 - protein, 13 aa, Borrelia burgdorferi B31
LYLDENKITIPKK

SEQ ID NO: 105095 - protein, 13 aa, Borrelia burgdorferi B31
YLDENKITIPKKI

SEQ ID NO: 105096 - protein, 13 aa, Borrelia burgdorferi B31
LDENKITIPKKII

SEQ ID NO: 105097 - protein, 13 aa, Borrelia burgdorferi B31
DENKITIPKKIIK

SEQ ID NO: 105098 - protein, 13 aa, Borrelia burgdorferi B31
ENKITIPKKIIKI

SEQ ID NO: 105099 - protein, 13 aa, Borrelia burgdorferi B31
NKITIPKKIIKIQ

SEQ ID NO: 105100 - protein, 13 aa, Borrelia burgdorferi B31
KITIPKKIIKIQK

SEQ ID NO: 105101 - protein, 13 aa, Borrelia burgdorferi B31
ITIPKKIIKIQKI

SEQ ID NO: 105102 - protein, 13 aa, Borrelia burgdorferi B31
TIPKKIIKIQKIN

SEQ ID NO: 105103 - protein, 13 aa, Borrelia burgdorferi B31
IPKKIIKIQKINP

SEQ ID NO: 105104 - protein, 13 aa, Borrelia burgdorferi B31
PKKIIKIQKINPN

SEQ ID NO: 105105 - protein, 13 aa, Borrelia burgdorferi B31
KKIIKIQKINPNQ

SEQ ID NO: 105106 - protein, 13 aa, Borrelia burgdorferi B31
KIIKIQKINPNQL

SEQ ID NO: 105107 - protein, 13 aa, Borrelia burgdorferi B31
IIKIQKINPNQLD

SEQ ID NO: 105108 - protein, 13 aa, Borrelia burgdorferi B31
IKIQKINPNQLDY

SEQ ID NO: 105109 - protein, 13 aa, Borrelia burgdorferi B31
KIQKINPNQLDYQ

SEQ ID NO: 105110 - protein, 13 aa, Borrelia burgdorferi B31
IQKINPNQLDYQK

SEQ ID NO: 105111 - protein, 13 aa, Borrelia burgdorferi B31
QKINPNQLDYQKS

SEQ ID NO: 105112 - protein, 13 aa, Borrelia burgdorferi B31
KINPNQLDYQKSY

SEQ ID NO: 105113 - protein, 13 aa, Borrelia burgdorferi B31
INPNQLDYQKSYL

SEQ ID NO: 105114 - protein, 13 aa, Borrelia burgdorferi B31
NPNQLDYQKSYLL

SEQ ID NO: 105115 - protein, 13 aa, Borrelia burgdorferi B31
PNQLDYQKSYLLI

SEQ ID NO: 105116 - protein, 13 aa, Borrelia burgdorferi B31
NQLDYQKSYLLIK

SEQ ID NO: 105117 - protein, 13 aa, Borrelia burgdorferi B31
QLDYQKSYLLIKS

SEQ ID NO: 105118 - protein, 13 aa, Borrelia burgdorferi B31
LDYQKSYLLIKSL

SEQ ID NO: 105119 - protein, 13 aa, Borrelia burgdorferi B31
DYQKSYLLIKSLK

SEQ ID NO: 105120 - protein, 13 aa, Borrelia burgdorferi B31
YQKSYLLIKSLKT

SEQ ID NO: 105121 - protein, 13 aa, Borrelia burgdorferi B31
QKSYLLIKSLKTR

SEQ ID NO: 105122 - protein, 13 aa, Borrelia burgdorferi B31
KSYLLIKSLKTRS

SEQ ID NO: 105123 - protein, 13 aa, Borrelia burgdorferi B31
SYLLIKSLKTRSR

SEQ ID NO: 105124 - protein, 13 aa, Borrelia burgdorferi B31
YLLIKSLKTRSRI

SEQ ID NO: 105125 - protein, 13 aa, Borrelia burgdorferi B31
LLIKSLKTRSRIL

SEQ ID NO: 105126 - protein, 13 aa, Borrelia burgdorferi B31
LIKSLKTRSRILK

SEQ ID NO: 105127 - protein, 13 aa, Borrelia burgdorferi B31
IKSLKTRSRILKI

SEQ ID NO: 105128 - protein, 13 aa, Borrelia burgdorferi B31
KSLKTRSRILKII

SEQ ID NO: 105129 - protein, 13 aa, Borrelia burgdorferi B31
SLKTRSRILKIII

SEQ ID NO: 105130 - protein, 13 aa, Borrelia burgdorferi B31
LKTRSRILKIIIK

SEQ ID NO: 105131 - protein, 13 aa, Borrelia burgdorferi B31
KTRSRILKIIIKN

SEQ ID NO: 105132 - protein, 13 aa, Borrelia burgdorferi B31
TRSRILKIIIKNI

SEQ ID NO: 105133 - protein, 13 aa, Borrelia burgdorferi B31
RSRILKIIIKNIR

SEQ ID NO: 105134 - protein, 13 aa, Borrelia burgdorferi B31
SRILKIIIKNIRF

SEQ ID NO: 105135 - protein, 13 aa, Borrelia burgdorferi B31
RILKIIIKNIRFN

SEQ ID NO: 105136 - protein, 13 aa, Borrelia burgdorferi B31
ILKIIIKNIRFNL

SEQ ID NO: 105137 - protein, 13 aa, Borrelia burgdorferi B31
LKIIIKNIRFNLI

SEQ ID NO: 105138 - protein, 13 aa, Borrelia burgdorferi B31
KIIIKNIRFNLIE

SEQ ID NO: 105139 - protein, 13 aa, Borrelia burgdorferi B31
IIIKNIRFNLIEK

SEQ ID NO: 105140 - protein, 13 aa, Borrelia burgdorferi B31
IIKNIRFNLIEKL

SEQ ID NO: 105141 - protein, 13 aa, Borrelia burgdorferi B31
IKNIRFNLIEKLE

SEQ ID NO: 105142 - protein, 13 aa, Borrelia burgdorferi B31
KNIRFNLIEKLED

SEQ ID NO: 105143 - protein, 13 aa, Borrelia burgdorferi B31
NIRFNLIEKLEDE

SEQ ID NO: 105144 - protein, 13 aa, Borrelia burgdorferi B31
IRFNLIEKLEDEN

SEQ ID NO: 105145 - protein, 13 aa, Borrelia burgdorferi B31
RFNLIEKLEDENE

SEQ ID NO: 105146 - protein, 13 aa, Borrelia burgdorferi B31
FNLIEKLEDENEK

SEQ ID NO: 105147 - protein, 13 aa, Borrelia burgdorferi B31
NLIEKLEDENEKK

SEQ ID NO: 105148 - protein, 13 aa, Borrelia burgdorferi B31
LIEKLEDENEKKL

SEQ ID NO: 105149 - protein, 13 aa, Borrelia burgdorferi B31
IEKLEDENEKKLL

SEQ ID NO: 105150 - protein, 13 aa, Borrelia burgdorferi B31
EKLEDENEKKLLP

SEQ ID NO: 105151 - protein, 13 aa, Borrelia burgdorferi B31
KLEDENEKKLLPA

SEQ ID NO: 105152 - protein, 13 aa, Borrelia burgdorferi B31
LEDENEKKLLPAM

SEQ ID NO: 105153 - protein, 13 aa, Borrelia burgdorferi B31
EDENEKKLLPAMC

SEQ ID NO: 105154 - protein, 13 aa, Borrelia burgdorferi B31
DENEKKLLPAMCY

SEQ ID NO: 105155 - protein, 13 aa, Borrelia burgdorferi B31
ENEKKLLPAMCYL

SEQ ID NO: 105156 - protein, 13 aa, Borrelia burgdorferi B31
NEKKLLPAMCYLI

SEQ ID NO: 105157 - protein, 13 aa, Borrelia burgdorferi B31
EKKLLPAMCYLIY

SEQ ID NO: 105158 - protein, 13 aa, Borrelia burgdorferi B31
KKLLPAMCYLIYC

SEQ ID NO: 105159 - protein, 13 aa, Borrelia burgdorferi B31
KLLPAMCYLIYCE

SEQ ID NO: 105160 - protein, 13 aa, Borrelia burgdorferi B31
LLPAMCYLIYCEN

SEQ ID NO: 105161 - protein, 13 aa, Borrelia burgdorferi B31
LPAMCYLIYCENL

SEQ ID NO: 105162 - protein, 13 aa, Borrelia burgdorferi B31
PAMCYLIYCENLV

SEQ ID NO: 105163 - protein, 13 aa, Borrelia burgdorferi B31
AMCYLIYCENLVE

SEQ ID NO: 105164 - protein, 13 aa, Borrelia burgdorferi B31
MCYLIYCENLVEL

SEQ ID NO: 105165 - protein, 13 aa, Borrelia burgdorferi B31
CYLIYCENLVELK

SEQ ID NO: 105166 - protein, 13 aa, Borrelia burgdorferi B31
YLIYCENLVELKN

SEQ ID NO: 105167 - protein, 13 aa, Borrelia burgdorferi B31
LIYCENLVELKNN

SEQ ID NO: 105168 - protein, 13 aa, Borrelia burgdorferi B31
IYCENLVELKNNR

SEQ ID NO: 105169 - protein, 13 aa, Borrelia burgdorferi B31
YCENLVELKNNRK

SEQ ID NO: 105170 - protein, 13 aa, Borrelia burgdorferi B31
CENLVELKNNRKI

SEQ ID NO: 105171 - protein, 13 aa, Borrelia burgdorferi B31
ENLVELKNNRKIK

SEQ ID NO: 105172 - protein, 13 aa, Borrelia burgdorferi B31
NLVELKNNRKIKS

SEQ ID NO: 105173 - protein, 13 aa, Borrelia burgdorferi B31
LVELKNNRKIKSN

SEQ ID NO: 105174 - protein, 13 aa, Borrelia burgdorferi B31
VELKNNRKIKSNE

SEQ ID NO: 105175 - protein, 13 aa, Borrelia burgdorferi B31
ELKNNRKIKSNEK

SEQ ID NO: 105176 - protein, 13 aa, Borrelia burgdorferi B31
LKNNRKIKSNEKN

SEQ ID NO: 105177 - protein, 13 aa, Borrelia burgdorferi B31
KNNRKIKSNEKNS

SEQ ID NO: 105178 - protein, 13 aa, Borrelia burgdorferi B31
NNRKIKSNEKNSL

SEQ ID NO: 105179 - protein, 13 aa, Borrelia burgdorferi B31
NRKIKSNEKNSLL

SEQ ID NO: 105180 - protein, 13 aa, Borrelia burgdorferi B31
RKIKSNEKNSLLE

SEQ ID NO: 105181 - protein, 13 aa, Borrelia burgdorferi B31
KIKSNEKNSLLEF

SEQ ID NO: 105182 - protein, 13 aa, Borrelia burgdorferi B31
IKSNEKNSLLEFI

SEQ ID NO: 105183 - protein, 13 aa, Borrelia burgdorferi B31
KSNEKNSLLEFIS

SEQ ID NO: 105184 - protein, 13 aa, Borrelia burgdorferi B31
SNEKNSLLEFISF

SEQ ID NO: 105185 - protein, 13 aa, Borrelia burgdorferi B31
NEKNSLLEFISFF

SEQ ID NO: 105186 - protein, 13 aa, Borrelia burgdorferi B31
EKNSLLEFISFFK

SEQ ID NO: 105187 - protein, 13 aa, Borrelia burgdorferi B31
KNSLLEFISFFKT

SEQ ID NO: 105188 - protein, 13 aa, Borrelia burgdorferi B31
NSLLEFISFFKTK

SEQ ID NO: 105189 - protein, 13 aa, Borrelia burgdorferi B31
SLLEFISFFKTKL

SEQ ID NO: 105190 - protein, 13 aa, Borrelia burgdorferi B31
LLEFISFFKTKLK

SEQ ID NO: 105191 - protein, 13 aa, Borrelia burgdorferi B31
LEFISFFKTKLKQ

SEQ ID NO: 105192 - protein, 13 aa, Borrelia burgdorferi B31
EFISFFKTKLKQK

SEQ ID NO: 105193 - protein, 13 aa, Borrelia burgdorferi B31
FISFFKTKLKQKI

SEQ ID NO: 105194 - protein, 13 aa, Borrelia burgdorferi B31
ISFFKTKLKQKIN

SEQ ID NO: 105195 - protein, 13 aa, Borrelia burgdorferi B31
SFFKTKLKQKINF

SEQ ID NO: 105196 - protein, 13 aa, Borrelia burgdorferi B31
FFKTKLKQKINFK

SEQ ID NO: 105197 - protein, 13 aa, Borrelia burgdorferi B31
FKTKLKQKINFKK

SEQ ID NO: 105198 - protein, 13 aa, Borrelia burgdorferi B31
KTKLKQKINFKKE

SEQ ID NO: 105199 - protein, 13 aa, Borrelia burgdorferi B31
TKLKQKINFKKEL

SEQ ID NO: 105200 - protein, 13 aa, Borrelia burgdorferi B31
KLKQKINFKKELM

SEQ ID NO: 105201 - protein, 13 aa, Borrelia burgdorferi B31
LKQKINFKKELMK

SEQ ID NO: 105202 - protein, 13 aa, Borrelia burgdorferi B31
KQKINFKKELMKS

SEQ ID NO: 105203 - protein, 13 aa, Borrelia burgdorferi B31
QKINFKKELMKSK

SEQ ID NO: 105204 - protein, 13 aa, Borrelia burgdorferi B31
KINFKKELMKSKG

SEQ ID NO: 105205 - protein, 13 aa, Borrelia burgdorferi B31
INFKKELMKSKGI

SEQ ID NO: 105206 - protein, 14 aa, Borrelia burgdorferi B31
MKTIKKDSEFYDSL

SEQ ID NO: 105207 - protein, 14 aa, Borrelia burgdorferi B31
KTIKKDSEFYDSLA

SEQ ID NO: 105208 - protein, 14 aa, Borrelia burgdorferi B31
TIKKDSEFYDSLAT

SEQ ID NO: 105209 - protein, 14 aa, Borrelia burgdorferi B31
IKKDSEFYDSLATL

SEQ ID NO: 105210 - protein, 14 aa, Borrelia burgdorferi B31
KKDSEFYDSLATLK

SEQ ID NO: 105211 - protein, 14 aa, Borrelia burgdorferi B31
KDSEFYDSLATLKK

SEQ ID NO: 105212 - protein, 14 aa, Borrelia burgdorferi B31
DSEFYDSLATLKKH

SEQ ID NO: 105213 - protein, 14 aa, Borrelia burgdorferi B31
SEFYDSLATLKKHI

SEQ ID NO: 105214 - protein, 14 aa, Borrelia burgdorferi B31
EFYDSLATLKKHIN

SEQ ID NO: 105215 - protein, 14 aa, Borrelia burgdorferi B31
FYDSLATLKKHINK

SEQ ID NO: 105216 - protein, 14 aa, Borrelia burgdorferi B31
YDSLATLKKHINKY

SEQ ID NO: 105217 - protein, 14 aa, Borrelia burgdorferi B31
DSLATLKKHINKYI

SEQ ID NO: 105218 - protein, 14 aa, Borrelia burgdorferi B31
SLATLKKHINKYIE

SEQ ID NO: 105219 - protein, 14 aa, Borrelia burgdorferi B31
LATLKKHINKYIEE

SEQ ID NO: 105220 - protein, 14 aa, Borrelia burgdorferi B31
ATLKKHINKYIEEK

SEQ ID NO: 105221 - protein, 14 aa, Borrelia burgdorferi B31
TLKKHINKYIEEKV

SEQ ID NO: 105222 - protein, 14 aa, Borrelia burgdorferi B31
LKKHINKYIEEKVL

SEQ ID NO: 105223 - protein, 14 aa, Borrelia burgdorferi B31
KKHINKYIEEKVLK

SEQ ID NO: 105224 - protein, 14 aa, Borrelia burgdorferi B31
KHINKYIEEKVLKY

SEQ ID NO: 105225 - protein, 14 aa, Borrelia burgdorferi B31
HINKYIEEKVLKYS

SEQ ID NO: 105226 - protein, 14 aa, Borrelia burgdorferi B31
INKYIEEKVLKYSI

SEQ ID NO: 105227 - protein, 14 aa, Borrelia burgdorferi B31
NKYIEEKVLKYSIS

SEQ ID NO: 105228 - protein, 14 aa, Borrelia burgdorferi B31
KYIEEKVLKYSISS

SEQ ID NO: 105229 - protein, 14 aa, Borrelia burgdorferi B31
YIEEKVLKYSISSQ

SEQ ID NO: 105230 - protein, 14 aa, Borrelia burgdorferi B31
IEEKVLKYSISSQL

SEQ ID NO: 105231 - protein, 14 aa, Borrelia burgdorferi B31
EEKVLKYSISSQLY

SEQ ID NO: 105232 - protein, 14 aa, Borrelia burgdorferi B31
EKVLKYSISSQLYK

SEQ ID NO: 105233 - protein, 14 aa, Borrelia burgdorferi B31
KVLKYSISSQLYKL

SEQ ID NO: 105234 - protein, 14 aa, Borrelia burgdorferi B31
VLKYSISSQLYKLE

SEQ ID NO: 105235 - protein, 14 aa, Borrelia burgdorferi B31
LKYSISSQLYKLEK

SEQ ID NO: 105236 - protein, 14 aa, Borrelia burgdorferi B31
KYSISSQLYKLEKP

SEQ ID NO: 105237 - protein, 14 aa, Borrelia burgdorferi B31
YSISSQLYKLEKPE

SEQ ID NO: 105238 - protein, 14 aa, Borrelia burgdorferi B31
SISSQLYKLEKPEI

SEQ ID NO: 105239 - protein, 14 aa, Borrelia burgdorferi B31
ISSQLYKLEKPEII

SEQ ID NO: 105240 - protein, 14 aa, Borrelia burgdorferi B31
SSQLYKLEKPEIIE

SEQ ID NO: 105241 - protein, 14 aa, Borrelia burgdorferi B31
SQLYKLEKPEIIEL

SEQ ID NO: 105242 - protein, 14 aa, Borrelia burgdorferi B31
QLYKLEKPEIIELI

SEQ ID NO: 105243 - protein, 14 aa, Borrelia burgdorferi B31
LYKLEKPEIIELIK

SEQ ID NO: 105244 - protein, 14 aa, Borrelia burgdorferi B31
YKLEKPEIIELIKI

SEQ ID NO: 105245 - protein, 14 aa, Borrelia burgdorferi B31
KLEKPEIIELIKIS

SEQ ID NO: 105246 - protein, 14 aa, Borrelia burgdorferi B31
LEKPEIIELIKISN

SEQ ID NO: 105247 - protein, 14 aa, Borrelia burgdorferi B31
EKPEIIELIKISND

SEQ ID NO: 105248 - protein, 14 aa, Borrelia burgdorferi B31
KPEIIELIKISNDY

SEQ ID NO: 105249 - protein, 14 aa, Borrelia burgdorferi B31
PEIIELIKISNDYE

SEQ ID NO: 105250 - protein, 14 aa, Borrelia burgdorferi B31
EIIELIKISNDYEK

SEQ ID NO: 105251 - protein, 14 aa, Borrelia burgdorferi B31
IIELIKISNDYEKE

SEQ ID NO: 105252 - protein, 14 aa, Borrelia burgdorferi B31
IELIKISNDYEKEK

SEQ ID NO: 105253 - protein, 14 aa, Borrelia burgdorferi B31
ELIKISNDYEKEKN

SEQ ID NO: 105254 - protein, 14 aa, Borrelia burgdorferi B31
LIKISNDYEKEKNA

SEQ ID NO: 105255 - protein, 14 aa, Borrelia burgdorferi B31
IKISNDYEKEKNAF

SEQ ID NO: 105256 - protein, 14 aa, Borrelia burgdorferi B31
KISNDYEKEKNAFN

SEQ ID NO: 105257 - protein, 14 aa, Borrelia burgdorferi B31
ISNDYEKEKNAFNT

SEQ ID NO: 105258 - protein, 14 aa, Borrelia burgdorferi B31
SNDYEKEKNAFNTS

SEQ ID NO: 105259 - protein, 14 aa, Borrelia burgdorferi B31
NDYEKEKNAFNTSL

SEQ ID NO: 105260 - protein, 14 aa, Borrelia burgdorferi B31
DYEKEKNAFNTSLE

SEQ ID NO: 105261 - protein, 14 aa, Borrelia burgdorferi B31
YEKEKNAFNTSLEE

SEQ ID NO: 105262 - protein, 14 aa, Borrelia burgdorferi B31
EKEKNAFNTSLEEC

SEQ ID NO: 105263 - protein, 14 aa, Borrelia burgdorferi B31
KEKNAFNTSLEECY

SEQ ID NO: 105264 - protein, 14 aa, Borrelia burgdorferi B31
EKNAFNTSLEECYY

SEQ ID NO: 105265 - protein, 14 aa, Borrelia burgdorferi B31
KNAFNTSLEECYYK

SEQ ID NO: 105266 - protein, 14 aa, Borrelia burgdorferi B31
NAFNTSLEECYYKN

SEQ ID NO: 105267 - protein, 14 aa, Borrelia burgdorferi B31
AFNTSLEECYYKNT

SEQ ID NO: 105268 - protein, 14 aa, Borrelia burgdorferi B31
FNTSLEECYYKNTQ

SEQ ID NO: 105269 - protein, 14 aa, Borrelia burgdorferi B31
NTSLEECYYKNTQN

SEQ ID NO: 105270 - protein, 14 aa, Borrelia burgdorferi B31
TSLEECYYKNTQNE

SEQ ID NO: 105271 - protein, 14 aa, Borrelia burgdorferi B31
SLEECYYKNTQNEA

SEQ ID NO: 105272 - protein, 14 aa, Borrelia burgdorferi B31
LEECYYKNTQNEAI

SEQ ID NO: 105273 - protein, 14 aa, Borrelia burgdorferi B31
EECYYKNTQNEAIK

SEQ ID NO: 105274 - protein, 14 aa, Borrelia burgdorferi B31
ECYYKNTQNEAIKK

SEQ ID NO: 105275 - protein, 14 aa, Borrelia burgdorferi B31
CYYKNTQNEAIKKW

SEQ ID NO: 105276 - protein, 14 aa, Borrelia burgdorferi B31
YYKNTQNEAIKKWI

SEQ ID NO: 105277 - protein, 14 aa, Borrelia burgdorferi B31
YKNTQNEAIKKWIL

SEQ ID NO: 105278 - protein, 14 aa, Borrelia burgdorferi B31
KNTQNEAIKKWILE

SEQ ID NO: 105279 - protein, 14 aa, Borrelia burgdorferi B31
NTQNEAIKKWILEI

SEQ ID NO: 105280 - protein, 14 aa, Borrelia burgdorferi B31
TQNEAIKKWILEIV

SEQ ID NO: 105281 - protein, 14 aa, Borrelia burgdorferi B31
QNEAIKKWILEIVR

SEQ ID NO: 105282 - protein, 14 aa, Borrelia burgdorferi B31
NEAIKKWILEIVRN

SEQ ID NO: 105283 - protein, 14 aa, Borrelia burgdorferi B31
EAIKKWILEIVRNK

SEQ ID NO: 105284 - protein, 14 aa, Borrelia burgdorferi B31
AIKKWILEIVRNKN

SEQ ID NO: 105285 - protein, 14 aa, Borrelia burgdorferi B31
IKKWILEIVRNKNF

SEQ ID NO: 105286 - protein, 14 aa, Borrelia burgdorferi B31
KKWILEIVRNKNFI

SEQ ID NO: 105287 - protein, 14 aa, Borrelia burgdorferi B31
KWILEIVRNKNFIQ

SEQ ID NO: 105288 - protein, 14 aa, Borrelia burgdorferi B31
WILEIVRNKNFIQI

SEQ ID NO: 105289 - protein, 14 aa, Borrelia burgdorferi B31
ILEIVRNKNFIQIS

SEQ ID NO: 105290 - protein, 14 aa, Borrelia burgdorferi B31
LEIVRNKNFIQISK

SEQ ID NO: 105291 - protein, 14 aa, Borrelia burgdorferi B31
EIVRNKNFIQISKE

SEQ ID NO: 105292 - protein, 14 aa, Borrelia burgdorferi B31
IVRNKNFIQISKEA

SEQ ID NO: 105293 - protein, 14 aa, Borrelia burgdorferi B31
VRNKNFIQISKEAN

SEQ ID NO: 105294 - protein, 14 aa, Borrelia burgdorferi B31
RNKNFIQISKEANL

SEQ ID NO: 105295 - protein, 14 aa, Borrelia burgdorferi B31
NKNFIQISKEANLN

SEQ ID NO: 105296 - protein, 14 aa, Borrelia burgdorferi B31
KNFIQISKEANLNT

SEQ ID NO: 105297 - protein, 14 aa, Borrelia burgdorferi B31
NFIQISKEANLNTK

SEQ ID NO: 105298 - protein, 14 aa, Borrelia burgdorferi B31
FIQISKEANLNTKK

SEQ ID NO: 105299 - protein, 14 aa, Borrelia burgdorferi B31
IQISKEANLNTKKL

SEQ ID NO: 105300 - protein, 14 aa, Borrelia burgdorferi B31
QISKEANLNTKKLG

SEQ ID NO: 105301 - protein, 14 aa, Borrelia burgdorferi B31
ISKEANLNTKKLGT

SEQ ID NO: 105302 - protein, 14 aa, Borrelia burgdorferi B31
SKEANLNTKKLGTT

SEQ ID NO: 105303 - protein, 14 aa, Borrelia burgdorferi B31
KEANLNTKKLGTTY

SEQ ID NO: 105304 - protein, 14 aa, Borrelia burgdorferi B31
EANLNTKKLGTTYK

SEQ ID NO: 105305 - protein, 14 aa, Borrelia burgdorferi B31
ANLNTKKLGTTYKL

SEQ ID NO: 105306 - protein, 14 aa, Borrelia burgdorferi B31
NLNTKKLGTTYKLK

SEQ ID NO: 105307 - protein, 14 aa, Borrelia burgdorferi B31
LNTKKLGTTYKLKS

SEQ ID NO: 105308 - protein, 14 aa, Borrelia burgdorferi B31
NTKKLGTTYKLKSS

SEQ ID NO: 105309 - protein, 14 aa, Borrelia burgdorferi B31
TKKLGTTYKLKSSN

SEQ ID NO: 105310 - protein, 14 aa, Borrelia burgdorferi B31
KKLGTTYKLKSSNF

SEQ ID NO: 105311 - protein, 14 aa, Borrelia burgdorferi B31
KLGTTYKLKSSNFL

SEQ ID NO: 105312 - protein, 14 aa, Borrelia burgdorferi B31
LGTTYKLKSSNFLK

SEQ ID NO: 105313 - protein, 14 aa, Borrelia burgdorferi B31
GTTYKLKSSNFLKL

SEQ ID NO: 105314 - protein, 14 aa, Borrelia burgdorferi B31
TTYKLKSSNFLKLI

SEQ ID NO: 105315 - protein, 14 aa, Borrelia burgdorferi B31
TYKLKSSNFLKLIE

SEQ ID NO: 105316 - protein, 14 aa, Borrelia burgdorferi B31
YKLKSSNFLKLIEI

SEQ ID NO: 105317 - protein, 14 aa, Borrelia burgdorferi B31
KLKSSNFLKLIEIQ

SEQ ID NO: 105318 - protein, 14 aa, Borrelia burgdorferi B31
LKSSNFLKLIEIQN

SEQ ID NO: 105319 - protein, 14 aa, Borrelia burgdorferi B31
KSSNFLKLIEIQNS

SEQ ID NO: 105320 - protein, 14 aa, Borrelia burgdorferi B31
SSNFLKLIEIQNSP

SEQ ID NO: 105321 - protein, 14 aa, Borrelia burgdorferi B31
SNFLKLIEIQNSPY

SEQ ID NO: 105322 - protein, 14 aa, Borrelia burgdorferi B31
NFLKLIEIQNSPYY

SEQ ID NO: 105323 - protein, 14 aa, Borrelia burgdorferi B31
FLKLIEIQNSPYYS

SEQ ID NO: 105324 - protein, 14 aa, Borrelia burgdorferi B31
LKLIEIQNSPYYSQ

SEQ ID NO: 105325 - protein, 14 aa, Borrelia burgdorferi B31
KLIEIQNSPYYSQE

SEQ ID NO: 105326 - protein, 14 aa, Borrelia burgdorferi B31
LIEIQNSPYYSQEK

SEQ ID NO: 105327 - protein, 14 aa, Borrelia burgdorferi B31
IEIQNSPYYSQEKK

SEQ ID NO: 105328 - protein, 14 aa, Borrelia burgdorferi B31
EIQNSPYYSQEKKD

SEQ ID NO: 105329 - protein, 14 aa, Borrelia burgdorferi B31
IQNSPYYSQEKKDI

SEQ ID NO: 105330 - protein, 14 aa, Borrelia burgdorferi B31
QNSPYYSQEKKDIY

SEQ ID NO: 105331 - protein, 14 aa, Borrelia burgdorferi B31
NSPYYSQEKKDIYK

SEQ ID NO: 105332 - protein, 14 aa, Borrelia burgdorferi B31
SPYYSQEKKDIYKQ

SEQ ID NO: 105333 - protein, 14 aa, Borrelia burgdorferi B31
PYYSQEKKDIYKQI

SEQ ID NO: 105334 - protein, 14 aa, Borrelia burgdorferi B31
YYSQEKKDIYKQII

SEQ ID NO: 105335 - protein, 14 aa, Borrelia burgdorferi B31
YSQEKKDIYKQIIL

SEQ ID NO: 105336 - protein, 14 aa, Borrelia burgdorferi B31
SQEKKDIYKQIILN

SEQ ID NO: 105337 - protein, 14 aa, Borrelia burgdorferi B31
QEKKDIYKQIILNF

SEQ ID NO: 105338 - protein, 14 aa, Borrelia burgdorferi B31
EKKDIYKQIILNFS

SEQ ID NO: 105339 - protein, 14 aa, Borrelia burgdorferi B31
KKDIYKQIILNFSS

SEQ ID NO: 105340 - protein, 14 aa, Borrelia burgdorferi B31
KDIYKQIILNFSSN

SEQ ID NO: 105341 - protein, 14 aa, Borrelia burgdorferi B31
DIYKQIILNFSSNI

SEQ ID NO: 105342 - protein, 14 aa, Borrelia burgdorferi B31
IYKQIILNFSSNIN

SEQ ID NO: 105343 - protein, 14 aa, Borrelia burgdorferi B31
YKQIILNFSSNINI

SEQ ID NO: 105344 - protein, 14 aa, Borrelia burgdorferi B31
KQIILNFSSNINID

SEQ ID NO: 105345 - protein, 14 aa, Borrelia burgdorferi B31
QIILNFSSNINIDS

SEQ ID NO: 105346 - protein, 14 aa, Borrelia burgdorferi B31
IILNFSSNINIDSL

SEQ ID NO: 105347 - protein, 14 aa, Borrelia burgdorferi B31
ILNFSSNINIDSLE

SEQ ID NO: 105348 - protein, 14 aa, Borrelia burgdorferi B31
LNFSSNINIDSLEQ

SEQ ID NO: 105349 - protein, 14 aa, Borrelia burgdorferi B31
NFSSNINIDSLEQT

SEQ ID NO: 105350 - protein, 14 aa, Borrelia burgdorferi B31
FSSNINIDSLEQTI

SEQ ID NO: 105351 - protein, 14 aa, Borrelia burgdorferi B31
SSNINIDSLEQTID

SEQ ID NO: 105352 - protein, 14 aa, Borrelia burgdorferi B31
SNINIDSLEQTIDI

SEQ ID NO: 105353 - protein, 14 aa, Borrelia burgdorferi B31
NINIDSLEQTIDIL

SEQ ID NO: 105354 - protein, 14 aa, Borrelia burgdorferi B31
INIDSLEQTIDILV

SEQ ID NO: 105355 - protein, 14 aa, Borrelia burgdorferi B31
NIDSLEQTIDILVA

SEQ ID NO: 105356 - protein, 14 aa, Borrelia burgdorferi B31
IDSLEQTIDILVAV

SEQ ID NO: 105357 - protein, 14 aa, Borrelia burgdorferi B31
DSLEQTIDILVAVR

SEQ ID NO: 105358 - protein, 14 aa, Borrelia burgdorferi B31
SLEQTIDILVAVRN

SEQ ID NO: 105359 - protein, 14 aa, Borrelia burgdorferi B31
LEQTIDILVAVRNR

SEQ ID NO: 105360 - protein, 14 aa, Borrelia burgdorferi B31
EQTIDILVAVRNRN

SEQ ID NO: 105361 - protein, 14 aa, Borrelia burgdorferi B31
QTIDILVAVRNRNK

SEQ ID NO: 105362 - protein, 14 aa, Borrelia burgdorferi B31
TIDILVAVRNRNKI

SEQ ID NO: 105363 - protein, 14 aa, Borrelia burgdorferi B31
IDILVAVRNRNKIK

SEQ ID NO: 105364 - protein, 14 aa, Borrelia burgdorferi B31
DILVAVRNRNKIKI

SEQ ID NO: 105365 - protein, 14 aa, Borrelia burgdorferi B31
ILVAVRNRNKIKIL

SEQ ID NO: 105366 - protein, 14 aa, Borrelia burgdorferi B31
LVAVRNRNKIKILN

SEQ ID NO: 105367 - protein, 14 aa, Borrelia burgdorferi B31
VAVRNRNKIKILNI

SEQ ID NO: 105368 - protein, 14 aa, Borrelia burgdorferi B31
AVRNRNKIKILNIL

SEQ ID NO: 105369 - protein, 14 aa, Borrelia burgdorferi B31
VRNRNKIKILNILN

SEQ ID NO: 105370 - protein, 14 aa, Borrelia burgdorferi B31
RNRNKIKILNILNK

SEQ ID NO: 105371 - protein, 14 aa, Borrelia burgdorferi B31
NRNKIKILNILNKN

SEQ ID NO: 105372 - protein, 14 aa, Borrelia burgdorferi B31
RNKIKILNILNKNL

SEQ ID NO: 105373 - protein, 14 aa, Borrelia burgdorferi B31
NKIKILNILNKNLK

SEQ ID NO: 105374 - protein, 14 aa, Borrelia burgdorferi B31
KIKILNILNKNLKY

SEQ ID NO: 105375 - protein, 14 aa, Borrelia burgdorferi B31
IKILNILNKNLKYR

SEQ ID NO: 105376 - protein, 14 aa, Borrelia burgdorferi B31
KILNILNKNLKYRP

SEQ ID NO: 105377 - protein, 14 aa, Borrelia burgdorferi B31
ILNILNKNLKYRPE

SEQ ID NO: 105378 - protein, 14 aa, Borrelia burgdorferi B31
LNILNKNLKYRPEN

SEQ ID NO: 105379 - protein, 14 aa, Borrelia burgdorferi B31
NILNKNLKYRPENQ

SEQ ID NO: 105380 - protein, 14 aa, Borrelia burgdorferi B31
ILNKNLKYRPENQK

SEQ ID NO: 105381 - protein, 14 aa, Borrelia burgdorferi B31
LNKNLKYRPENQKV

SEQ ID NO: 105382 - protein, 14 aa, Borrelia burgdorferi B31
NKNLKYRPENQKVF

SEQ ID NO: 105383 - protein, 14 aa, Borrelia burgdorferi B31
KNLKYRPENQKVFK

SEQ ID NO: 105384 - protein, 14 aa, Borrelia burgdorferi B31
NLKYRPENQKVFKS

SEQ ID NO: 105385 - protein, 14 aa, Borrelia burgdorferi B31
LKYRPENQKVFKSS

SEQ ID NO: 105386 - protein, 14 aa, Borrelia burgdorferi B31
KYRPENQKVFKSSL

SEQ ID NO: 105387 - protein, 14 aa, Borrelia burgdorferi B31
YRPENQKVFKSSLT

SEQ ID NO: 105388 - protein, 14 aa, Borrelia burgdorferi B31
RPENQKVFKSSLTN

SEQ ID NO: 105389 - protein, 14 aa, Borrelia burgdorferi B31
PENQKVFKSSLTNK

SEQ ID NO: 105390 - protein, 14 aa, Borrelia burgdorferi B31
ENQKVFKSSLTNKE

SEQ ID NO: 105391 - protein, 14 aa, Borrelia burgdorferi B31
NQKVFKSSLTNKES

SEQ ID NO: 105392 - protein, 14 aa, Borrelia burgdorferi B31
QKVFKSSLTNKESR

SEQ ID NO: 105393 - protein, 14 aa, Borrelia burgdorferi B31
KVFKSSLTNKESRL

SEQ ID NO: 105394 - protein, 14 aa, Borrelia burgdorferi B31
VFKSSLTNKESRLI

SEQ ID NO: 105395 - protein, 14 aa, Borrelia burgdorferi B31
FKSSLTNKESRLIK

SEQ ID NO: 105396 - protein, 14 aa, Borrelia burgdorferi B31
KSSLTNKESRLIKL

SEQ ID NO: 105397 - protein, 14 aa, Borrelia burgdorferi B31
SSLTNKESRLIKLK

SEQ ID NO: 105398 - protein, 14 aa, Borrelia burgdorferi B31
SLTNKESRLIKLKR

SEQ ID NO: 105399 - protein, 14 aa, Borrelia burgdorferi B31
LTNKESRLIKLKRM

SEQ ID NO: 105400 - protein, 14 aa, Borrelia burgdorferi B31
TNKESRLIKLKRML

SEQ ID NO: 105401 - protein, 14 aa, Borrelia burgdorferi B31
NKESRLIKLKRMLI

SEQ ID NO: 105402 - protein, 14 aa, Borrelia burgdorferi B31
KESRLIKLKRMLIL

SEQ ID NO: 105403 - protein, 14 aa, Borrelia burgdorferi B31
ESRLIKLKRMLILT

SEQ ID NO: 105404 - protein, 14 aa, Borrelia burgdorferi B31
SRLIKLKRMLILTY

SEQ ID NO: 105405 - protein, 14 aa, Borrelia burgdorferi B31
RLIKLKRMLILTYW

SEQ ID NO: 105406 - protein, 14 aa, Borrelia burgdorferi B31
LIKLKRMLILTYWP

SEQ ID NO: 105407 - protein, 14 aa, Borrelia burgdorferi B31
IKLKRMLILTYWPV

SEQ ID NO: 105408 - protein, 14 aa, Borrelia burgdorferi B31
KLKRMLILTYWPVG

SEQ ID NO: 105409 - protein, 14 aa, Borrelia burgdorferi B31
LKRMLILTYWPVGC

SEQ ID NO: 105410 - protein, 14 aa, Borrelia burgdorferi B31
KRMLILTYWPVGCL

SEQ ID NO: 105411 - protein, 14 aa, Borrelia burgdorferi B31
RMLILTYWPVGCLS

SEQ ID NO: 105412 - protein, 14 aa, Borrelia burgdorferi B31
MLILTYWPVGCLSK

SEQ ID NO: 105413 - protein, 14 aa, Borrelia burgdorferi B31
LILTYWPVGCLSKN

SEQ ID NO: 105414 - protein, 14 aa, Borrelia burgdorferi B31
ILTYWPVGCLSKNI

SEQ ID NO: 105415 - protein, 14 aa, Borrelia burgdorferi B31
LTYWPVGCLSKNIF

SEQ ID NO: 105416 - protein, 14 aa, Borrelia burgdorferi B31
TYWPVGCLSKNIFI

SEQ ID NO: 105417 - protein, 14 aa, Borrelia burgdorferi B31
YWPVGCLSKNIFIK

SEQ ID NO: 105418 - protein, 14 aa, Borrelia burgdorferi B31
WPVGCLSKNIFIKI

SEQ ID NO: 105419 - protein, 14 aa, Borrelia burgdorferi B31
PVGCLSKNIFIKIL

SEQ ID NO: 105420 - protein, 14 aa, Borrelia burgdorferi B31
VGCLSKNIFIKILI

SEQ ID NO: 105421 - protein, 14 aa, Borrelia burgdorferi B31
GCLSKNIFIKILIK

SEQ ID NO: 105422 - protein, 14 aa, Borrelia burgdorferi B31
  Xaa can be any naturally occurring amino acid
  VARIANT 14: Xaa = Any Amino Acid
CLSKNIFIKILIKX

SEQ ID NO: 105423 - protein, 14 aa, Borrelia burgdorferi B31
  Xaa can be any naturally occurring amino acid
  VARIANT 13: Xaa = Any Amino Acid
LSKNIFIKILIKXY

SEQ ID NO: 105424 - protein, 14 aa, Borrelia burgdorferi B31
  Xaa can be any naturally occurring amino acid
  VARIANT 12: Xaa = Any Amino Acid
SKNIFIKILIKXYK

SEQ ID NO: 105425 - protein, 14 aa, Borrelia burgdorferi B31
  Xaa can be any naturally occurring amino acid
  VARIANT 11: Xaa = Any Amino Acid
KNIFIKILIKXYKY

SEQ ID NO: 105426 - protein, 14 aa, Borrelia burgdorferi B31
  Xaa can be any naturally occurring amino acid
  VARIANT 10: Xaa = Any Amino Acid
NIFIKILIKXYKYL

SEQ ID NO: 105427 - protein, 14 aa, Borrelia burgdorferi B31
  Xaa can be any naturally occurring amino acid
  VARIANT 9: Xaa = Any Amino Acid
IFIKILIKXYKYLE

SEQ ID NO: 105428 - protein, 14 aa, Borrelia burgdorferi B31
  Xaa can be any naturally occurring amino acid
  VARIANT 8: Xaa = Any Amino Acid
FIKILIKXYKYLEE

SEQ ID NO: 105429 - protein, 14 aa, Borrelia burgdorferi B31
  Xaa can be any naturally occurring amino acid
  VARIANT 7: Xaa = Any Amino Acid
IKILIKXYKYLEEE

SEQ ID NO: 105430 - protein, 14 aa, Borrelia burgdorferi B31
  Xaa can be any naturally occurring amino acid
  VARIANT 6: Xaa = Any Amino Acid
KILIKXYKYLEEEI

SEQ ID NO: 105431 - protein, 14 aa, Borrelia burgdorferi B31
  Xaa can be any naturally occurring amino acid
  VARIANT 5: Xaa = Any Amino Acid
ILIKXYKYLEEEIL

SEQ ID NO: 105432 - protein, 14 aa, Borrelia burgdorferi B31
  Xaa can be any naturally occurring amino acid
  VARIANT 4: Xaa = Any Amino Acid
LIKXYKYLEEEILA

SEQ ID NO: 105433 - protein, 14 aa, Borrelia burgdorferi B31
  Xaa can be any naturally occurring amino acid
  VARIANT 3: Xaa = Any Amino Acid
IKXYKYLEEEILAL

SEQ ID NO: 105434 - protein, 14 aa, Borrelia burgdorferi B31
  Xaa can be any naturally occurring amino acid
  VARIANT 2: Xaa = Any Amino Acid
KXYKYLEEEILALK

SEQ ID NO: 105435 - protein, 14 aa, Borrelia burgdorferi B31
  Xaa can be any naturally occurring amino acid
  VARIANT 1: Xaa = Any Amino Acid
XYKYLEEEILALKY

SEQ ID NO: 105436 - protein, 14 aa, Borrelia burgdorferi B31
YKYLEEEILALKYN

SEQ ID NO: 105437 - protein, 14 aa, Borrelia burgdorferi B31
KYLEEEILALKYNE

SEQ ID NO: 105438 - protein, 14 aa, Borrelia burgdorferi B31
YLEEEILALKYNEI

SEQ ID NO: 105439 - protein, 14 aa, Borrelia burgdorferi B31
LEEEILALKYNEIL

SEQ ID NO: 105440 - protein, 14 aa, Borrelia burgdorferi B31
EEEILALKYNEILN

SEQ ID NO: 105441 - protein, 14 aa, Borrelia burgdorferi B31
EEILALKYNEILNY

SEQ ID NO: 105442 - protein, 14 aa, Borrelia burgdorferi B31
EILALKYNEILNYL

SEQ ID NO: 105443 - protein, 14 aa, Borrelia burgdorferi B31
ILALKYNEILNYLR

SEQ ID NO: 105444 - protein, 14 aa, Borrelia burgdorferi B31
LALKYNEILNYLRA

SEQ ID NO: 105445 - protein, 14 aa, Borrelia burgdorferi B31
ALKYNEILNYLRAL

SEQ ID NO: 105446 - protein, 14 aa, Borrelia burgdorferi B31
LKYNEILNYLRALK

SEQ ID NO: 105447 - protein, 14 aa, Borrelia burgdorferi B31
KYNEILNYLRALKT

SEQ ID NO: 105448 - protein, 14 aa, Borrelia burgdorferi B31
YNEILNYLRALKTL

SEQ ID NO: 105449 - protein, 14 aa, Borrelia burgdorferi B31
NEILNYLRALKTLS

SEQ ID NO: 105450 - protein, 14 aa, Borrelia burgdorferi B31
EILNYLRALKTLSL

SEQ ID NO: 105451 - protein, 14 aa, Borrelia burgdorferi B31
ILNYLRALKTLSLN

SEQ ID NO: 105452 - protein, 14 aa, Borrelia burgdorferi B31
LNYLRALKTLSLNE

SEQ ID NO: 105453 - protein, 14 aa, Borrelia burgdorferi B31
NYLRALKTLSLNEI

SEQ ID NO: 105454 - protein, 14 aa, Borrelia burgdorferi B31
YLRALKTLSLNEIF

SEQ ID NO: 105455 - protein, 14 aa, Borrelia burgdorferi B31
LRALKTLSLNEIFY

SEQ ID NO: 105456 - protein, 14 aa, Borrelia burgdorferi B31
RALKTLSLNEIFYK

SEQ ID NO: 105457 - protein, 14 aa, Borrelia burgdorferi B31
ALKTLSLNEIFYKG

SEQ ID NO: 105458 - protein, 14 aa, Borrelia burgdorferi B31
LKTLSLNEIFYKGS

SEQ ID NO: 105459 - protein, 14 aa, Borrelia burgdorferi B31
KTLSLNEIFYKGSS

SEQ ID NO: 105460 - protein, 14 aa, Borrelia burgdorferi B31
TLSLNEIFYKGSSK

SEQ ID NO: 105461 - protein, 14 aa, Borrelia burgdorferi B31
LSLNEIFYKGSSKN

SEQ ID NO: 105462 - protein, 14 aa, Borrelia burgdorferi B31
SLNEIFYKGSSKNI

SEQ ID NO: 105463 - protein, 14 aa, Borrelia burgdorferi B31
LNEIFYKGSSKNIS

SEQ ID NO: 105464 - protein, 14 aa, Borrelia burgdorferi B31
NEIFYKGSSKNISF

SEQ ID NO: 105465 - protein, 14 aa, Borrelia burgdorferi B31
EIFYKGSSKNISFN

SEQ ID NO: 105466 - protein, 14 aa, Borrelia burgdorferi B31
IFYKGSSKNISFNY

SEQ ID NO: 105467 - protein, 14 aa, Borrelia burgdorferi B31
FYKGSSKNISFNYF

SEQ ID NO: 105468 - protein, 14 aa, Borrelia burgdorferi B31
YKGSSKNISFNYFF

SEQ ID NO: 105469 - protein, 14 aa, Borrelia burgdorferi B31
KGSSKNISFNYFFS

SEQ ID NO: 105470 - protein, 14 aa, Borrelia burgdorferi B31
GSSKNISFNYFFSD

SEQ ID NO: 105471 - protein, 14 aa, Borrelia burgdorferi B31
SSKNISFNYFFSDF

SEQ ID NO: 105472 - protein, 14 aa, Borrelia burgdorferi B31
SKNISFNYFFSDFT

SEQ ID NO: 105473 - protein, 14 aa, Borrelia burgdorferi B31
KNISFNYFFSDFTQ

SEQ ID NO: 105474 - protein, 14 aa, Borrelia burgdorferi B31
NISFNYFFSDFTQY

SEQ ID NO: 105475 - protein, 14 aa, Borrelia burgdorferi B31
ISFNYFFSDFTQYA

SEQ ID NO: 105476 - protein, 14 aa, Borrelia burgdorferi B31
SFNYFFSDFTQYAP

SEQ ID NO: 105477 - protein, 14 aa, Borrelia burgdorferi B31
FNYFFSDFTQYAPK

SEQ ID NO: 105478 - protein, 14 aa, Borrelia burgdorferi B31
NYFFSDFTQYAPKD

SEQ ID NO: 105479 - protein, 14 aa, Borrelia burgdorferi B31
YFFSDFTQYAPKDF

SEQ ID NO: 105480 - protein, 14 aa, Borrelia burgdorferi B31
FFSDFTQYAPKDFQ

SEQ ID NO: 105481 - protein, 14 aa, Borrelia burgdorferi B31
FSDFTQYAPKDFQD

SEQ ID NO: 105482 - protein, 14 aa, Borrelia burgdorferi B31
SDFTQYAPKDFQDT

SEQ ID NO: 105483 - protein, 14 aa, Borrelia burgdorferi B31
DFTQYAPKDFQDTL

SEQ ID NO: 105484 - protein, 14 aa, Borrelia burgdorferi B31
FTQYAPKDFQDTLK

SEQ ID NO: 105485 - protein, 14 aa, Borrelia burgdorferi B31
TQYAPKDFQDTLKC

SEQ ID NO: 105486 - protein, 14 aa, Borrelia burgdorferi B31
QYAPKDFQDTLKCY

SEQ ID NO: 105487 - protein, 14 aa, Borrelia burgdorferi B31
YAPKDFQDTLKCYL

SEQ ID NO: 105488 - protein, 14 aa, Borrelia burgdorferi B31
APKDFQDTLKCYLY

SEQ ID NO: 105489 - protein, 14 aa, Borrelia burgdorferi B31
PKDFQDTLKCYLYV

SEQ ID NO: 105490 - protein, 14 aa, Borrelia burgdorferi B31
KDFQDTLKCYLYVI

SEQ ID NO: 105491 - protein, 14 aa, Borrelia burgdorferi B31
DFQDTLKCYLYVIE

SEQ ID NO: 105492 - protein, 14 aa, Borrelia burgdorferi B31
FQDTLKCYLYVIEK

SEQ ID NO: 105493 - protein, 14 aa, Borrelia burgdorferi B31
QDTLKCYLYVIEKT

SEQ ID NO: 105494 - protein, 14 aa, Borrelia burgdorferi B31
DTLKCYLYVIEKTI

SEQ ID NO: 105495 - protein, 14 aa, Borrelia burgdorferi B31
TLKCYLYVIEKTIT

SEQ ID NO: 105496 - protein, 14 aa, Borrelia burgdorferi B31
LKCYLYVIEKTITK

SEQ ID NO: 105497 - protein, 14 aa, Borrelia burgdorferi B31
KCYLYVIEKTITKK

SEQ ID NO: 105498 - protein, 14 aa, Borrelia burgdorferi B31
CYLYVIEKTITKKY

SEQ ID NO: 105499 - protein, 14 aa, Borrelia burgdorferi B31
YLYVIEKTITKKYL

SEQ ID NO: 105500 - protein, 14 aa, Borrelia burgdorferi B31
LYVIEKTITKKYLT

SEQ ID NO: 105501 - protein, 14 aa, Borrelia burgdorferi B31
YVIEKTITKKYLTW

SEQ ID NO: 105502 - protein, 14 aa, Borrelia burgdorferi B31
VIEKTITKKYLTWF

SEQ ID NO: 105503 - protein, 14 aa, Borrelia burgdorferi B31
IEKTITKKYLTWFF

SEQ ID NO: 105504 - protein, 14 aa, Borrelia burgdorferi B31
EKTITKKYLTWFFK

SEQ ID NO: 105505 - protein, 14 aa, Borrelia burgdorferi B31
KTITKKYLTWFFKD

SEQ ID NO: 105506 - protein, 14 aa, Borrelia burgdorferi B31
TITKKYLTWFFKDK

SEQ ID NO: 105507 - protein, 14 aa, Borrelia burgdorferi B31
ITKKYLTWFFKDKI

SEQ ID NO: 105508 - protein, 14 aa, Borrelia burgdorferi B31
TKKYLTWFFKDKIS

SEQ ID NO: 105509 - protein, 14 aa, Borrelia burgdorferi B31
KKYLTWFFKDKISN

SEQ ID NO: 105510 - protein, 14 aa, Borrelia burgdorferi B31
KYLTWFFKDKISNN

SEQ ID NO: 105511 - protein, 14 aa, Borrelia burgdorferi B31
YLTWFFKDKISNNW

SEQ ID NO: 105512 - protein, 14 aa, Borrelia burgdorferi B31
LTWFFKDKISNNWE

SEQ ID NO: 105513 - protein, 14 aa, Borrelia burgdorferi B31
TWFFKDKISNNWES

SEQ ID NO: 105514 - protein, 14 aa, Borrelia burgdorferi B31
WFFKDKISNNWESF

SEQ ID NO: 105515 - protein, 14 aa, Borrelia burgdorferi B31
FFKDKISNNWESFI

SEQ ID NO: 105516 - protein, 14 aa, Borrelia burgdorferi B31
FKDKISNNWESFID

SEQ ID NO: 105517 - protein, 14 aa, Borrelia burgdorferi B31
KDKISNNWESFIDA

SEQ ID NO: 105518 - protein, 14 aa, Borrelia burgdorferi B31
DKISNNWESFIDAL

SEQ ID NO: 105519 - protein, 14 aa, Borrelia burgdorferi B31
KISNNWESFIDALE

SEQ ID NO: 105520 - protein, 14 aa, Borrelia burgdorferi B31
ISNNWESFIDALEY

SEQ ID NO: 105521 - protein, 14 aa, Borrelia burgdorferi B31
SNNWESFIDALEYI

SEQ ID NO: 105522 - protein, 14 aa, Borrelia burgdorferi B31
NNWESFIDALEYIE

SEQ ID NO: 105523 - protein, 14 aa, Borrelia burgdorferi B31
NWESFIDALEYIEK

SEQ ID NO: 105524 - protein, 14 aa, Borrelia burgdorferi B31
WESFIDALEYIEKH

SEQ ID NO: 105525 - protein, 14 aa, Borrelia burgdorferi B31
ESFIDALEYIEKHK

SEQ ID NO: 105526 - protein, 14 aa, Borrelia burgdorferi B31
SFIDALEYIEKHKL

SEQ ID NO: 105527 - protein, 14 aa, Borrelia burgdorferi B31
FIDALEYIEKHKLI

SEQ ID NO: 105528 - protein, 14 aa, Borrelia burgdorferi B31
IDALEYIEKHKLIN

SEQ ID NO: 105529 - protein, 14 aa, Borrelia burgdorferi B31
DALEYIEKHKLINI

SEQ ID NO: 105530 - protein, 14 aa, Borrelia burgdorferi B31
ALEYIEKHKLINIK

SEQ ID NO: 105531 - protein, 14 aa, Borrelia burgdorferi B31
LEYIEKHKLINIKE

SEQ ID NO: 105532 - protein, 14 aa, Borrelia burgdorferi B31
EYIEKHKLINIKEK

SEQ ID NO: 105533 - protein, 14 aa, Borrelia burgdorferi B31
YIEKHKLINIKEKI

SEQ ID NO: 105534 - protein, 14 aa, Borrelia burgdorferi B31
IEKHKLINIKEKIK

SEQ ID NO: 105535 - protein, 14 aa, Borrelia burgdorferi B31
EKHKLINIKEKIKE

SEQ ID NO: 105536 - protein, 14 aa, Borrelia burgdorferi B31
KHKLINIKEKIKEI

SEQ ID NO: 105537 - protein, 14 aa, Borrelia burgdorferi B31
HKLINIKEKIKEII

SEQ ID NO: 105538 - protein, 14 aa, Borrelia burgdorferi B31
KLINIKEKIKEIIT

SEQ ID NO: 105539 - protein, 14 aa, Borrelia burgdorferi B31
LINIKEKIKEIITA

SEQ ID NO: 105540 - protein, 14 aa, Borrelia burgdorferi B31
INIKEKIKEIITAK

SEQ ID NO: 105541 - protein, 14 aa, Borrelia burgdorferi B31
NIKEKIKEIITAKF

SEQ ID NO: 105542 - protein, 14 aa, Borrelia burgdorferi B31
IKEKIKEIITAKFQ

SEQ ID NO: 105543 - protein, 14 aa, Borrelia burgdorferi B31
KEKIKEIITAKFQT

SEQ ID NO: 105544 - protein, 14 aa, Borrelia burgdorferi B31
EKIKEIITAKFQTE

SEQ ID NO: 105545 - protein, 14 aa, Borrelia burgdorferi B31
KIKEIITAKFQTED

SEQ ID NO: 105546 - protein, 14 aa, Borrelia burgdorferi B31
IKEIITAKFQTEDF

SEQ ID NO: 105547 - protein, 14 aa, Borrelia burgdorferi B31
KEIITAKFQTEDFF

SEQ ID NO: 105548 - protein, 14 aa, Borrelia burgdorferi B31
EIITAKFQTEDFFI

SEQ ID NO: 105549 - protein, 14 aa, Borrelia burgdorferi B31
IITAKFQTEDFFIS

SEQ ID NO: 105550 - protein, 14 aa, Borrelia burgdorferi B31
ITAKFQTEDFFISF

SEQ ID NO: 105551 - protein, 14 aa, Borrelia burgdorferi B31
TAKFQTEDFFISFD

SEQ ID NO: 105552 - protein, 14 aa, Borrelia burgdorferi B31
AKFQTEDFFISFDK

SEQ ID NO: 105553 - protein, 14 aa, Borrelia burgdorferi B31
KFQTEDFFISFDKT

SEQ ID NO: 105554 - protein, 14 aa, Borrelia burgdorferi B31
FQTEDFFISFDKTN

SEQ ID NO: 105555 - protein, 14 aa, Borrelia burgdorferi B31
QTEDFFISFDKTNF

SEQ ID NO: 105556 - protein, 14 aa, Borrelia burgdorferi B31
TEDFFISFDKTNFN

SEQ ID NO: 105557 - protein, 14 aa, Borrelia burgdorferi B31
EDFFISFDKTNFNP

SEQ ID NO: 105558 - protein, 14 aa, Borrelia burgdorferi B31
DFFISFDKTNFNPY

SEQ ID NO: 105559 - protein, 14 aa, Borrelia burgdorferi B31
FFISFDKTNFNPYE

SEQ ID NO: 105560 - protein, 14 aa, Borrelia burgdorferi B31
FISFDKTNFNPYES

SEQ ID NO: 105561 - protein, 14 aa, Borrelia burgdorferi B31
ISFDKTNFNPYESS

SEQ ID NO: 105562 - protein, 14 aa, Borrelia burgdorferi B31
SFDKTNFNPYESSI

SEQ ID NO: 105563 - protein, 14 aa, Borrelia burgdorferi B31
FDKTNFNPYESSIF

SEQ ID NO: 105564 - protein, 14 aa, Borrelia burgdorferi B31
DKTNFNPYESSIFK

SEQ ID NO: 105565 - protein, 14 aa, Borrelia burgdorferi B31
KTNFNPYESSIFKE

SEQ ID NO: 105566 - protein, 14 aa, Borrelia burgdorferi B31
TNFNPYESSIFKER

SEQ ID NO: 105567 - protein, 14 aa, Borrelia burgdorferi B31
NFNPYESSIFKERY

SEQ ID NO: 105568 - protein, 14 aa, Borrelia burgdorferi B31
FNPYESSIFKERYI

SEQ ID NO: 105569 - protein, 14 aa, Borrelia burgdorferi B31
NPYESSIFKERYIK

SEQ ID NO: 105570 - protein, 14 aa, Borrelia burgdorferi B31
PYESSIFKERYIKS

SEQ ID NO: 105571 - protein, 14 aa, Borrelia burgdorferi B31
YESSIFKERYIKSA

SEQ ID NO: 105572 - protein, 14 aa, Borrelia burgdorferi B31
ESSIFKERYIKSAF

SEQ ID NO: 105573 - protein, 14 aa, Borrelia burgdorferi B31
SSIFKERYIKSAFL

SEQ ID NO: 105574 - protein, 14 aa, Borrelia burgdorferi B31
SIFKERYIKSAFLE

SEQ ID NO: 105575 - protein, 14 aa, Borrelia burgdorferi B31
IFKERYIKSAFLEI

SEQ ID NO: 105576 - protein, 14 aa, Borrelia burgdorferi B31
FKERYIKSAFLEII

SEQ ID NO: 105577 - protein, 14 aa, Borrelia burgdorferi B31
KERYIKSAFLEIIM

SEQ ID NO: 105578 - protein, 14 aa, Borrelia burgdorferi B31
ERYIKSAFLEIIMH

SEQ ID NO: 105579 - protein, 14 aa, Borrelia burgdorferi B31
RYIKSAFLEIIMHY

SEQ ID NO: 105580 - protein, 14 aa, Borrelia burgdorferi B31
YIKSAFLEIIMHYV

SEQ ID NO: 105581 - protein, 14 aa, Borrelia burgdorferi B31
IKSAFLEIIMHYVK

SEQ ID NO: 105582 - protein, 14 aa, Borrelia burgdorferi B31
KSAFLEIIMHYVKK

SEQ ID NO: 105583 - protein, 14 aa, Borrelia burgdorferi B31
SAFLEIIMHYVKKN

SEQ ID NO: 105584 - protein, 14 aa, Borrelia burgdorferi B31
AFLEIIMHYVKKNS

SEQ ID NO: 105585 - protein, 14 aa, Borrelia burgdorferi B31
FLEIIMHYVKKNSQ

SEQ ID NO: 105586 - protein, 14 aa, Borrelia burgdorferi B31
LEIIMHYVKKNSQN

SEQ ID NO: 105587 - protein, 14 aa, Borrelia burgdorferi B31
EIIMHYVKKNSQNI

SEQ ID NO: 105588 - protein, 14 aa, Borrelia burgdorferi B31
IIMHYVKKNSQNIE

SEQ ID NO: 105589 - protein, 14 aa, Borrelia burgdorferi B31
IMHYVKKNSQNIET

SEQ ID NO: 105590 - protein, 14 aa, Borrelia burgdorferi B31
MHYVKKNSQNIETY

SEQ ID NO: 105591 - protein, 14 aa, Borrelia burgdorferi B31
HYVKKNSQNIETYG

SEQ ID NO: 105592 - protein, 14 aa, Borrelia burgdorferi B31
YVKKNSQNIETYGW

SEQ ID NO: 105593 - protein, 14 aa, Borrelia burgdorferi B31
VKKNSQNIETYGWI

SEQ ID NO: 105594 - protein, 14 aa, Borrelia burgdorferi B31
KKNSQNIETYGWIA

SEQ ID NO: 105595 - protein, 14 aa, Borrelia burgdorferi B31
KNSQNIETYGWIAF

SEQ ID NO: 105596 - protein, 14 aa, Borrelia burgdorferi B31
NSQNIETYGWIAFY

SEQ ID NO: 105597 - protein, 14 aa, Borrelia burgdorferi B31
SQNIETYGWIAFYI

SEQ ID NO: 105598 - protein, 14 aa, Borrelia burgdorferi B31
QNIETYGWIAFYIY

SEQ ID NO: 105599 - protein, 14 aa, Borrelia burgdorferi B31
NIETYGWIAFYIYA

SEQ ID NO: 105600 - protein, 14 aa, Borrelia burgdorferi B31
IETYGWIAFYIYAD

SEQ ID NO: 105601 - protein, 14 aa, Borrelia burgdorferi B31
ETYGWIAFYIYADN

SEQ ID NO: 105602 - protein, 14 aa, Borrelia burgdorferi B31
TYGWIAFYIYADNK

SEQ ID NO: 105603 - protein, 14 aa, Borrelia burgdorferi B31
YGWIAFYIYADNKD

SEQ ID NO: 105604 - protein, 14 aa, Borrelia burgdorferi B31
GWIAFYIYADNKDK

SEQ ID NO: 105605 - protein, 14 aa, Borrelia burgdorferi B31
WIAFYIYADNKDKK

SEQ ID NO: 105606 - protein, 14 aa, Borrelia burgdorferi B31
IAFYIYADNKDKKI

SEQ ID NO: 105607 - protein, 14 aa, Borrelia burgdorferi B31
AFYIYADNKDKKIF

SEQ ID NO: 105608 - protein, 14 aa, Borrelia burgdorferi B31
FYIYADNKDKKIFC

SEQ ID NO: 105609 - protein, 14 aa, Borrelia burgdorferi B31
YIYADNKDKKIFCQ

SEQ ID NO: 105610 - protein, 14 aa, Borrelia burgdorferi B31
IYADNKDKKIFCQR

SEQ ID NO: 105611 - protein, 14 aa, Borrelia burgdorferi B31
YADNKDKKIFCQRM

SEQ ID NO: 105612 - protein, 14 aa, Borrelia burgdorferi B31
ADNKDKKIFCQRMK

SEQ ID NO: 105613 - protein, 14 aa, Borrelia burgdorferi B31
DNKDKKIFCQRMKE

SEQ ID NO: 105614 - protein, 14 aa, Borrelia burgdorferi B31
NKDKKIFCQRMKEF

SEQ ID NO: 105615 - protein, 14 aa, Borrelia burgdorferi B31
KDKKIFCQRMKEFF

SEQ ID NO: 105616 - protein, 14 aa, Borrelia burgdorferi B31
DKKIFCQRMKEFFK

SEQ ID NO: 105617 - protein, 14 aa, Borrelia burgdorferi B31
KKIFCQRMKEFFKS

SEQ ID NO: 105618 - protein, 14 aa, Borrelia burgdorferi B31
KIFCQRMKEFFKSK

SEQ ID NO: 105619 - protein, 14 aa, Borrelia burgdorferi B31
IFCQRMKEFFKSKT

SEQ ID NO: 105620 - protein, 14 aa, Borrelia burgdorferi B31
FCQRMKEFFKSKTF

SEQ ID NO: 105621 - protein, 14 aa, Borrelia burgdorferi B31
CQRMKEFFKSKTFE

SEQ ID NO: 105622 - protein, 14 aa, Borrelia burgdorferi B31
QRMKEFFKSKTFEI

SEQ ID NO: 105623 - protein, 14 aa, Borrelia burgdorferi B31
RMKEFFKSKTFEIQ

SEQ ID NO: 105624 - protein, 14 aa, Borrelia burgdorferi B31
MKEFFKSKTFEIQN

SEQ ID NO: 105625 - protein, 14 aa, Borrelia burgdorferi B31
KEFFKSKTFEIQNQ

SEQ ID NO: 105626 - protein, 14 aa, Borrelia burgdorferi B31
EFFKSKTFEIQNQI

SEQ ID NO: 105627 - protein, 14 aa, Borrelia burgdorferi B31
FFKSKTFEIQNQIF

SEQ ID NO: 105628 - protein, 14 aa, Borrelia burgdorferi B31
FKSKTFEIQNQIFV

SEQ ID NO: 105629 - protein, 14 aa, Borrelia burgdorferi B31
KSKTFEIQNQIFVY

SEQ ID NO: 105630 - protein, 14 aa, Borrelia burgdorferi B31
SKTFEIQNQIFVYF

SEQ ID NO: 105631 - protein, 14 aa, Borrelia burgdorferi B31
KTFEIQNQIFVYFL

SEQ ID NO: 105632 - protein, 14 aa, Borrelia burgdorferi B31
TFEIQNQIFVYFLS

SEQ ID NO: 105633 - protein, 14 aa, Borrelia burgdorferi B31
FEIQNQIFVYFLSF

SEQ ID NO: 105634 - protein, 14 aa, Borrelia burgdorferi B31
EIQNQIFVYFLSFY

SEQ ID NO: 105635 - protein, 14 aa, Borrelia burgdorferi B31
IQNQIFVYFLSFYP

SEQ ID NO: 105636 - protein, 14 aa, Borrelia burgdorferi B31
QNQIFVYFLSFYPN

SEQ ID NO: 105637 - protein, 14 aa, Borrelia burgdorferi B31
NQIFVYFLSFYPNI

SEQ ID NO: 105638 - protein, 14 aa, Borrelia burgdorferi B31
QIFVYFLSFYPNIE

SEQ ID NO: 105639 - protein, 14 aa, Borrelia burgdorferi B31
IFVYFLSFYPNIEY

SEQ ID NO: 105640 - protein, 14 aa, Borrelia burgdorferi B31
FVYFLSFYPNIEYK

SEQ ID NO: 105641 - protein, 14 aa, Borrelia burgdorferi B31
VYFLSFYPNIEYKH

SEQ ID NO: 105642 - protein, 14 aa, Borrelia burgdorferi B31
YFLSFYPNIEYKHF

SEQ ID NO: 105643 - protein, 14 aa, Borrelia burgdorferi B31
FLSFYPNIEYKHFK

SEQ ID NO: 105644 - protein, 14 aa, Borrelia burgdorferi B31
LSFYPNIEYKHFKF

SEQ ID NO: 105645 - protein, 14 aa, Borrelia burgdorferi B31
SFYPNIEYKHFKFI

SEQ ID NO: 105646 - protein, 14 aa, Borrelia burgdorferi B31
FYPNIEYKHFKFIS

SEQ ID NO: 105647 - protein, 14 aa, Borrelia burgdorferi B31
YPNIEYKHFKFISD

SEQ ID NO: 105648 - protein, 14 aa, Borrelia burgdorferi B31
PNIEYKHFKFISDI

SEQ ID NO: 105649 - protein, 14 aa, Borrelia burgdorferi B31
NIEYKHFKFISDIL

SEQ ID NO: 105650 - protein, 14 aa, Borrelia burgdorferi B31
IEYKHFKFISDILL

SEQ ID NO: 105651 - protein, 14 aa, Borrelia burgdorferi B31
EYKHFKFISDILLY

SEQ ID NO: 105652 - protein, 14 aa, Borrelia burgdorferi B31
YKHFKFISDILLYL

SEQ ID NO: 105653 - protein, 14 aa, Borrelia burgdorferi B31
KHFKFISDILLYLD

SEQ ID NO: 105654 - protein, 14 aa, Borrelia burgdorferi B31
HFKFISDILLYLDE

SEQ ID NO: 105655 - protein, 14 aa, Borrelia burgdorferi B31
FKFISDILLYLDEN

SEQ ID NO: 105656 - protein, 14 aa, Borrelia burgdorferi B31
KFISDILLYLDENK

SEQ ID NO: 105657 - protein, 14 aa, Borrelia burgdorferi B31
FISDILLYLDENKI

SEQ ID NO: 105658 - protein, 14 aa, Borrelia burgdorferi B31
ISDILLYLDENKIT

SEQ ID NO: 105659 - protein, 14 aa, Borrelia burgdorferi B31
SDILLYLDENKITI

SEQ ID NO: 105660 - protein, 14 aa, Borrelia burgdorferi B31
DILLYLDENKITIP

SEQ ID NO: 105661 - protein, 14 aa, Borrelia burgdorferi B31
ILLYLDENKITIPK

SEQ ID NO: 105662 - protein, 14 aa, Borrelia burgdorferi B31
LLYLDENKITIPKK

SEQ ID NO: 105663 - protein, 14 aa, Borrelia burgdorferi B31
LYLDENKITIPKKI

SEQ ID NO: 105664 - protein, 14 aa, Borrelia burgdorferi B31
YLDENKITIPKKII

SEQ ID NO: 105665 - protein, 14 aa, Borrelia burgdorferi B31
LDENKITIPKKIIK

SEQ ID NO: 105666 - protein, 14 aa, Borrelia burgdorferi B31
DENKITIPKKIIKI

SEQ ID NO: 105667 - protein, 14 aa, Borrelia burgdorferi B31
ENKITIPKKIIKIQ

SEQ ID NO: 105668 - protein, 14 aa, Borrelia burgdorferi B31
NKITIPKKIIKIQK

SEQ ID NO: 105669 - protein, 14 aa, Borrelia burgdorferi B31
KITIPKKIIKIQKI

SEQ ID NO: 105670 - protein, 14 aa, Borrelia burgdorferi B31
ITIPKKIIKIQKIN

SEQ ID NO: 105671 - protein, 14 aa, Borrelia burgdorferi B31
TIPKKIIKIQKINP

SEQ ID NO: 105672 - protein, 14 aa, Borrelia burgdorferi B31
IPKKIIKIQKINPN

SEQ ID NO: 105673 - protein, 14 aa, Borrelia burgdorferi B31
PKKIIKIQKINPNQ

SEQ ID NO: 105674 - protein, 14 aa, Borrelia burgdorferi B31
KKIIKIQKINPNQL

SEQ ID NO: 105675 - protein, 14 aa, Borrelia burgdorferi B31
KIIKIQKINPNQLD

SEQ ID NO: 105676 - protein, 14 aa, Borrelia burgdorferi B31
IIKIQKINPNQLDY

SEQ ID NO: 105677 - protein, 14 aa, Borrelia burgdorferi B31
IKIQKINPNQLDYQ

SEQ ID NO: 105678 - protein, 14 aa, Borrelia burgdorferi B31
KIQKINPNQLDYQK

SEQ ID NO: 105679 - protein, 14 aa, Borrelia burgdorferi B31
IQKINPNQLDYQKS

SEQ ID NO: 105680 - protein, 14 aa, Borrelia burgdorferi B31
QKINPNQLDYQKSY

SEQ ID NO: 105681 - protein, 14 aa, Borrelia burgdorferi B31
KINPNQLDYQKSYL

SEQ ID NO: 105682 - protein, 14 aa, Borrelia burgdorferi B31
INPNQLDYQKSYLL

SEQ ID NO: 105683 - protein, 14 aa, Borrelia burgdorferi B31
NPNQLDYQKSYLLI

SEQ ID NO: 105684 - protein, 14 aa, Borrelia burgdorferi B31
PNQLDYQKSYLLIK

SEQ ID NO: 105685 - protein, 14 aa, Borrelia burgdorferi B31
NQLDYQKSYLLIKS

SEQ ID NO: 105686 - protein, 14 aa, Borrelia burgdorferi B31
QLDYQKSYLLIKSL

SEQ ID NO: 105687 - protein, 14 aa, Borrelia burgdorferi B31
LDYQKSYLLIKSLK

SEQ ID NO: 105688 - protein, 14 aa, Borrelia burgdorferi B31
DYQKSYLLIKSLKT

SEQ ID NO: 105689 - protein, 14 aa, Borrelia burgdorferi B31
YQKSYLLIKSLKTR

SEQ ID NO: 105690 - protein, 14 aa, Borrelia burgdorferi B31
QKSYLLIKSLKTRS

SEQ ID NO: 105691 - protein, 14 aa, Borrelia burgdorferi B31
KSYLLIKSLKTRSR

SEQ ID NO: 105692 - protein, 14 aa, Borrelia burgdorferi B31
SYLLIKSLKTRSRI

SEQ ID NO: 105693 - protein, 14 aa, Borrelia burgdorferi B31
YLLIKSLKTRSRIL

SEQ ID NO: 105694 - protein, 14 aa, Borrelia burgdorferi B31
LLIKSLKTRSRILK

SEQ ID NO: 105695 - protein, 14 aa, Borrelia burgdorferi B31
LIKSLKTRSRILKI

SEQ ID NO: 105696 - protein, 14 aa, Borrelia burgdorferi B31
IKSLKTRSRILKII

SEQ ID NO: 105697 - protein, 14 aa, Borrelia burgdorferi B31
KSLKTRSRILKIII

SEQ ID NO: 105698 - protein, 14 aa, Borrelia burgdorferi B31
SLKTRSRILKIIIK

SEQ ID NO: 105699 - protein, 14 aa, Borrelia burgdorferi B31
LKTRSRILKIIIKN

SEQ ID NO: 105700 - protein, 14 aa, Borrelia burgdorferi B31
KTRSRILKIIIKNI

SEQ ID NO: 105701 - protein, 14 aa, Borrelia burgdorferi B31
TRSRILKIIIKNIR

SEQ ID NO: 105702 - protein, 14 aa, Borrelia burgdorferi B31
RSRILKIIIKNIRF

SEQ ID NO: 105703 - protein, 14 aa, Borrelia burgdorferi B31
SRILKIIIKNIRFN

SEQ ID NO: 105704 - protein, 14 aa, Borrelia burgdorferi B31
RILKIIIKNIRFNL

SEQ ID NO: 105705 - protein, 14 aa, Borrelia burgdorferi B31
ILKIIIKNIRFNLI

SEQ ID NO: 105706 - protein, 14 aa, Borrelia burgdorferi B31
LKIIIKNIRFNLIE

SEQ ID NO: 105707 - protein, 14 aa, Borrelia burgdorferi B31
KIIIKNIRFNLIEK

SEQ ID NO: 105708 - protein, 14 aa, Borrelia burgdorferi B31
IIIKNIRFNLIEKL

SEQ ID NO: 105709 - protein, 14 aa, Borrelia burgdorferi B31
IIKNIRFNLIEKLE

SEQ ID NO: 105710 - protein, 14 aa, Borrelia burgdorferi B31
IKNIRFNLIEKLED

SEQ ID NO: 105711 - protein, 14 aa, Borrelia burgdorferi B31
KNIRFNLIEKLEDE

SEQ ID NO: 105712 - protein, 14 aa, Borrelia burgdorferi B31
NIRFNLIEKLEDEN

SEQ ID NO: 105713 - protein, 14 aa, Borrelia burgdorferi B31
IRFNLIEKLEDENE

SEQ ID NO: 105714 - protein, 14 aa, Borrelia burgdorferi B31
RFNLIEKLEDENEK

SEQ ID NO: 105715 - protein, 14 aa, Borrelia burgdorferi B31
FNLIEKLEDENEKK

SEQ ID NO: 105716 - protein, 14 aa, Borrelia burgdorferi B31
NLIEKLEDENEKKL

SEQ ID NO: 105717 - protein, 14 aa, Borrelia burgdorferi B31
LIEKLEDENEKKLL

SEQ ID NO: 105718 - protein, 14 aa, Borrelia burgdorferi B31
IEKLEDENEKKLLP

SEQ ID NO: 105719 - protein, 14 aa, Borrelia burgdorferi B31
EKLEDENEKKLLPA

SEQ ID NO: 105720 - protein, 14 aa, Borrelia burgdorferi B31
KLEDENEKKLLPAM

SEQ ID NO: 105721 - protein, 14 aa, Borrelia burgdorferi B31
LEDENEKKLLPAMC

SEQ ID NO: 105722 - protein, 14 aa, Borrelia burgdorferi B31
EDENEKKLLPAMCY

SEQ ID NO: 105723 - protein, 14 aa, Borrelia burgdorferi B31
DENEKKLLPAMCYL

SEQ ID NO: 105724 - protein, 14 aa, Borrelia burgdorferi B31
ENEKKLLPAMCYLI

SEQ ID NO: 105725 - protein, 14 aa, Borrelia burgdorferi B31
NEKKLLPAMCYLIY

SEQ ID NO: 105726 - protein, 14 aa, Borrelia burgdorferi B31
EKKLLPAMCYLIYC

SEQ ID NO: 105727 - protein, 14 aa, Borrelia burgdorferi B31
KKLLPAMCYLIYCE

SEQ ID NO: 105728 - protein, 14 aa, Borrelia burgdorferi B31
KLLPAMCYLIYCEN

SEQ ID NO: 105729 - protein, 14 aa, Borrelia burgdorferi B31
LLPAMCYLIYCENL

SEQ ID NO: 105730 - protein, 14 aa, Borrelia burgdorferi B31
LPAMCYLIYCENLV

SEQ ID NO: 105731 - protein, 14 aa, Borrelia burgdorferi B31
PAMCYLIYCENLVE

SEQ ID NO: 105732 - protein, 14 aa, Borrelia burgdorferi B31
AMCYLIYCENLVEL

SEQ ID NO: 105733 - protein, 14 aa, Borrelia burgdorferi B31
MCYLIYCENLVELK

SEQ ID NO: 105734 - protein, 14 aa, Borrelia burgdorferi B31
CYLIYCENLVELKN

SEQ ID NO: 105735 - protein, 14 aa, Borrelia burgdorferi B31
YLIYCENLVELKNN

SEQ ID NO: 105736 - protein, 14 aa, Borrelia burgdorferi B31
LIYCENLVELKNNR

SEQ ID NO: 105737 - protein, 14 aa, Borrelia burgdorferi B31
IYCENLVELKNNRK

SEQ ID NO: 105738 - protein, 14 aa, Borrelia burgdorferi B31
YCENLVELKNNRKI

SEQ ID NO: 105739 - protein, 14 aa, Borrelia burgdorferi B31
CENLVELKNNRKIK

SEQ ID NO: 105740 - protein, 14 aa, Borrelia burgdorferi B31
ENLVELKNNRKIKS

SEQ ID NO: 105741 - protein, 14 aa, Borrelia burgdorferi B31
NLVELKNNRKIKSN

SEQ ID NO: 105742 - protein, 14 aa, Borrelia burgdorferi B31
LVELKNNRKIKSNE

SEQ ID NO: 105743 - protein, 14 aa, Borrelia burgdorferi B31
VELKNNRKIKSNEK

SEQ ID NO: 105744 - protein, 14 aa, Borrelia burgdorferi B31
ELKNNRKIKSNEKN

SEQ ID NO: 105745 - protein, 14 aa, Borrelia burgdorferi B31
LKNNRKIKSNEKNS

SEQ ID NO: 105746 - protein, 14 aa, Borrelia burgdorferi B31
KNNRKIKSNEKNSL

SEQ ID NO: 105747 - protein, 14 aa, Borrelia burgdorferi B31
NNRKIKSNEKNSLL

SEQ ID NO: 105748 - protein, 14 aa, Borrelia burgdorferi B31
NRKIKSNEKNSLLE

SEQ ID NO: 105749 - protein, 14 aa, Borrelia burgdorferi B31
RKIKSNEKNSLLEF

SEQ ID NO: 105750 - protein, 14 aa, Borrelia burgdorferi B31
KIKSNEKNSLLEFI

SEQ ID NO: 105751 - protein, 14 aa, Borrelia burgdorferi B31
IKSNEKNSLLEFIS

SEQ ID NO: 105752 - protein, 14 aa, Borrelia burgdorferi B31
KSNEKNSLLEFISF

SEQ ID NO: 105753 - protein, 14 aa, Borrelia burgdorferi B31
SNEKNSLLEFISFF

SEQ ID NO: 105754 - protein, 14 aa, Borrelia burgdorferi B31
NEKNSLLEFISFFK

SEQ ID NO: 105755 - protein, 14 aa, Borrelia burgdorferi B31
EKNSLLEFISFFKT

SEQ ID NO: 105756 - protein, 14 aa, Borrelia burgdorferi B31
KNSLLEFISFFKTK

SEQ ID NO: 105757 - protein, 14 aa, Borrelia burgdorferi B31
NSLLEFISFFKTKL

SEQ ID NO: 105758 - protein, 14 aa, Borrelia burgdorferi B31
SLLEFISFFKTKLK

SEQ ID NO: 105759 - protein, 14 aa, Borrelia burgdorferi B31
LLEFISFFKTKLKQ

SEQ ID NO: 105760 - protein, 14 aa, Borrelia burgdorferi B31
LEFISFFKTKLKQK

SEQ ID NO: 105761 - protein, 14 aa, Borrelia burgdorferi B31
EFISFFKTKLKQKI

SEQ ID NO: 105762 - protein, 14 aa, Borrelia burgdorferi B31
FISFFKTKLKQKIN

SEQ ID NO: 105763 - protein, 14 aa, Borrelia burgdorferi B31
ISFFKTKLKQKINF

SEQ ID NO: 105764 - protein, 14 aa, Borrelia burgdorferi B31
SFFKTKLKQKINFK

SEQ ID NO: 105765 - protein, 14 aa, Borrelia burgdorferi B31
FFKTKLKQKINFKK

SEQ ID NO: 105766 - protein, 14 aa, Borrelia burgdorferi B31
FKTKLKQKINFKKE

SEQ ID NO: 105767 - protein, 14 aa, Borrelia burgdorferi B31
KTKLKQKINFKKEL

SEQ ID NO: 105768 - protein, 14 aa, Borrelia burgdorferi B31
TKLKQKINFKKELM

SEQ ID NO: 105769 - protein, 14 aa, Borrelia burgdorferi B31
KLKQKINFKKELMK

SEQ ID NO: 105770 - protein, 14 aa, Borrelia burgdorferi B31
LKQKINFKKELMKS

SEQ ID NO: 105771 - protein, 14 aa, Borrelia burgdorferi B31
KQKINFKKELMKSK

SEQ ID NO: 105772 - protein, 14 aa, Borrelia burgdorferi B31
QKINFKKELMKSKG

SEQ ID NO: 105773 - protein, 14 aa, Borrelia burgdorferi B31
KINFKKELMKSKGI

SEQ ID NO: 105774 - protein, 15 aa, Borrelia burgdorferi B31
MKTIKKDSEFYDSLA

SEQ ID NO: 105775 - protein, 15 aa, Borrelia burgdorferi B31
KTIKKDSEFYDSLAT

SEQ ID NO: 105776 - protein, 15 aa, Borrelia burgdorferi B31
TIKKDSEFYDSLATL

SEQ ID NO: 105777 - protein, 15 aa, Borrelia burgdorferi B31
IKKDSEFYDSLATLK

SEQ ID NO: 105778 - protein, 15 aa, Borrelia burgdorferi B31
KKDSEFYDSLATLKK

SEQ ID NO: 105779 - protein, 15 aa, Borrelia burgdorferi B31
KDSEFYDSLATLKKH

SEQ ID NO: 105780 - protein, 15 aa, Borrelia burgdorferi B31
DSEFYDSLATLKKHI

SEQ ID NO: 105781 - protein, 15 aa, Borrelia burgdorferi B31
SEFYDSLATLKKHIN

SEQ ID NO: 105782 - protein, 15 aa, Borrelia burgdorferi B31
EFYDSLATLKKHINK

SEQ ID NO: 105783 - protein, 15 aa, Borrelia burgdorferi B31
FYDSLATLKKHINKY

SEQ ID NO: 105784 - protein, 15 aa, Borrelia burgdorferi B31
YDSLATLKKHINKYI

SEQ ID NO: 105785 - protein, 15 aa, Borrelia burgdorferi B31
DSLATLKKHINKYIE

SEQ ID NO: 105786 - protein, 15 aa, Borrelia burgdorferi B31
SLATLKKHINKYIEE

SEQ ID NO: 105787 - protein, 15 aa, Borrelia burgdorferi B31
LATLKKHINKYIEEK

SEQ ID NO: 105788 - protein, 15 aa, Borrelia burgdorferi B31
ATLKKHINKYIEEKV

SEQ ID NO: 105789 - protein, 15 aa, Borrelia burgdorferi B31
TLKKHINKYIEEKVL

SEQ ID NO: 105790 - protein, 15 aa, Borrelia burgdorferi B31
LKKHINKYIEEKVLK

SEQ ID NO: 105791 - protein, 15 aa, Borrelia burgdorferi B31
KKHINKYIEEKVLKY

SEQ ID NO: 105792 - protein, 15 aa, Borrelia burgdorferi B31
KHINKYIEEKVLKYS

SEQ ID NO: 105793 - protein, 15 aa, Borrelia burgdorferi B31
HINKYIEEKVLKYSI

SEQ ID NO: 105794 - protein, 15 aa, Borrelia burgdorferi B31
INKYIEEKVLKYSIS

SEQ ID NO: 105795 - protein, 15 aa, Borrelia burgdorferi B31
NKYIEEKVLKYSISS

SEQ ID NO: 105796 - protein, 15 aa, Borrelia burgdorferi B31
KYIEEKVLKYSISSQ

SEQ ID NO: 105797 - protein, 15 aa, Borrelia burgdorferi B31
YIEEKVLKYSISSQL

SEQ ID NO: 105798 - protein, 15 aa, Borrelia burgdorferi B31
IEEKVLKYSISSQLY

SEQ ID NO: 105799 - protein, 15 aa, Borrelia burgdorferi B31
EEKVLKYSISSQLYK

SEQ ID NO: 105800 - protein, 15 aa, Borrelia burgdorferi B31
EKVLKYSISSQLYKL

SEQ ID NO: 105801 - protein, 15 aa, Borrelia burgdorferi B31
KVLKYSISSQLYKLE

SEQ ID NO: 105802 - protein, 15 aa, Borrelia burgdorferi B31
VLKYSISSQLYKLEK

SEQ ID NO: 105803 - protein, 15 aa, Borrelia burgdorferi B31
LKYSISSQLYKLEKP

SEQ ID NO: 105804 - protein, 15 aa, Borrelia burgdorferi B31
KYSISSQLYKLEKPE

SEQ ID NO: 105805 - protein, 15 aa, Borrelia burgdorferi B31
YSISSQLYKLEKPEI

SEQ ID NO: 105806 - protein, 15 aa, Borrelia burgdorferi B31
SISSQLYKLEKPEII

SEQ ID NO: 105807 - protein, 15 aa, Borrelia burgdorferi B31
ISSQLYKLEKPEIIE

SEQ ID NO: 105808 - protein, 15 aa, Borrelia burgdorferi B31
SSQLYKLEKPEIIEL

SEQ ID NO: 105809 - protein, 15 aa, Borrelia burgdorferi B31
SQLYKLEKPEIIELI

SEQ ID NO: 105810 - protein, 15 aa, Borrelia burgdorferi B31
QLYKLEKPEIIELIK

SEQ ID NO: 105811 - protein, 15 aa, Borrelia burgdorferi B31
LYKLEKPEIIELIKI

SEQ ID NO: 105812 - protein, 15 aa, Borrelia burgdorferi B31
YKLEKPEIIELIKIS

SEQ ID NO: 105813 - protein, 15 aa, Borrelia burgdorferi B31
KLEKPEIIELIKISN

SEQ ID NO: 105814 - protein, 15 aa, Borrelia burgdorferi B31
LEKPEIIELIKISND

SEQ ID NO: 105815 - protein, 15 aa, Borrelia burgdorferi B31
EKPEIIELIKISNDY

SEQ ID NO: 105816 - protein, 15 aa, Borrelia burgdorferi B31
KPEIIELIKISNDYE

SEQ ID NO: 105817 - protein, 15 aa, Borrelia burgdorferi B31
PEIIELIKISNDYEK

SEQ ID NO: 105818 - protein, 15 aa, Borrelia burgdorferi B31
EIIELIKISNDYEKE

SEQ ID NO: 105819 - protein, 15 aa, Borrelia burgdorferi B31
IIELIKISNDYEKEK

SEQ ID NO: 105820 - protein, 15 aa, Borrelia burgdorferi B31
IELIKISNDYEKEKN

SEQ ID NO: 105821 - protein, 15 aa, Borrelia burgdorferi B31
ELIKISNDYEKEKNA

SEQ ID NO: 105822 - protein, 15 aa, Borrelia burgdorferi B31
LIKISNDYEKEKNAF

SEQ ID NO: 105823 - protein, 15 aa, Borrelia burgdorferi B31
IKISNDYEKEKNAFN

SEQ ID NO: 105824 - protein, 15 aa, Borrelia burgdorferi B31
KISNDYEKEKNAFNT

SEQ ID NO: 105825 - protein, 15 aa, Borrelia burgdorferi B31
ISNDYEKEKNAFNTS

SEQ ID NO: 105826 - protein, 15 aa, Borrelia burgdorferi B31
SNDYEKEKNAFNTSL

SEQ ID NO: 105827 - protein, 15 aa, Borrelia burgdorferi B31
NDYEKEKNAFNTSLE

SEQ ID NO: 105828 - protein, 15 aa, Borrelia burgdorferi B31
DYEKEKNAFNTSLEE

SEQ ID NO: 105829 - protein, 15 aa, Borrelia burgdorferi B31
YEKEKNAFNTSLEEC

SEQ ID NO: 105830 - protein, 15 aa, Borrelia burgdorferi B31
EKEKNAFNTSLEECY

SEQ ID NO: 105831 - protein, 15 aa, Borrelia burgdorferi B31
KEKNAFNTSLEECYY

SEQ ID NO: 105832 - protein, 15 aa, Borrelia burgdorferi B31
EKNAFNTSLEECYYK

SEQ ID NO: 105833 - protein, 15 aa, Borrelia burgdorferi B31
KNAFNTSLEECYYKN

SEQ ID NO: 105834 - protein, 15 aa, Borrelia burgdorferi B31
NAFNTSLEECYYKNT

SEQ ID NO: 105835 - protein, 15 aa, Borrelia burgdorferi B31
AFNTSLEECYYKNTQ

SEQ ID NO: 105836 - protein, 15 aa, Borrelia burgdorferi B31
FNTSLEECYYKNTQN

SEQ ID NO: 105837 - protein, 15 aa, Borrelia burgdorferi B31
NTSLEECYYKNTQNE

SEQ ID NO: 105838 - protein, 15 aa, Borrelia burgdorferi B31
TSLEECYYKNTQNEA

SEQ ID NO: 105839 - protein, 15 aa, Borrelia burgdorferi B31
SLEECYYKNTQNEAI

SEQ ID NO: 105840 - protein, 15 aa, Borrelia burgdorferi B31
LEECYYKNTQNEAIK

SEQ ID NO: 105841 - protein, 15 aa, Borrelia burgdorferi B31
EECYYKNTQNEAIKK

SEQ ID NO: 105842 - protein, 15 aa, Borrelia burgdorferi B31
ECYYKNTQNEAIKKW

SEQ ID NO: 105843 - protein, 15 aa, Borrelia burgdorferi B31
CYYKNTQNEAIKKWI

SEQ ID NO: 105844 - protein, 15 aa, Borrelia burgdorferi B31
YYKNTQNEAIKKWIL

SEQ ID NO: 105845 - protein, 15 aa, Borrelia burgdorferi B31
YKNTQNEAIKKWILE

SEQ ID NO: 105846 - protein, 15 aa, Borrelia burgdorferi B31
KNTQNEAIKKWILEI

SEQ ID NO: 105847 - protein, 15 aa, Borrelia burgdorferi B31
NTQNEAIKKWILEIV

SEQ ID NO: 105848 - protein, 15 aa, Borrelia burgdorferi B31
TQNEAIKKWILEIVR

SEQ ID NO: 105849 - protein, 15 aa, Borrelia burgdorferi B31
QNEAIKKWILEIVRN

SEQ ID NO: 105850 - protein, 15 aa, Borrelia burgdorferi B31
NEAIKKWILEIVRNK

SEQ ID NO: 105851 - protein, 15 aa, Borrelia burgdorferi B31
EAIKKWILEIVRNKN

SEQ ID NO: 105852 - protein, 15 aa, Borrelia burgdorferi B31
AIKKWILEIVRNKNF

SEQ ID NO: 105853 - protein, 15 aa, Borrelia burgdorferi B31
IKKWILEIVRNKNFI

SEQ ID NO: 105854 - protein, 15 aa, Borrelia burgdorferi B31
KKWILEIVRNKNFIQ

SEQ ID NO: 105855 - protein, 15 aa, Borrelia burgdorferi B31
KWILEIVRNKNFIQI

SEQ ID NO: 105856 - protein, 15 aa, Borrelia burgdorferi B31
WILEIVRNKNFIQIS

SEQ ID NO: 105857 - protein, 15 aa, Borrelia burgdorferi B31
ILEIVRNKNFIQISK

SEQ ID NO: 105858 - protein, 15 aa, Borrelia burgdorferi B31
LEIVRNKNFIQISKE

SEQ ID NO: 105859 - protein, 15 aa, Borrelia burgdorferi B31
EIVRNKNFIQISKEA

SEQ ID NO: 105860 - protein, 15 aa, Borrelia burgdorferi B31
IVRNKNFIQISKEAN

SEQ ID NO: 105861 - protein, 15 aa, Borrelia burgdorferi B31
VRNKNFIQISKEANL

SEQ ID NO: 105862 - protein, 15 aa, Borrelia burgdorferi B31
RNKNFIQISKEANLN

SEQ ID NO: 105863 - protein, 15 aa, Borrelia burgdorferi B31
NKNFIQISKEANLNT

SEQ ID NO: 105864 - protein, 15 aa, Borrelia burgdorferi B31
KNFIQISKEANLNTK

SEQ ID NO: 105865 - protein, 15 aa, Borrelia burgdorferi B31
NFIQISKEANLNTKK

SEQ ID NO: 105866 - protein, 15 aa, Borrelia burgdorferi B31
FIQISKEANLNTKKL

SEQ ID NO: 105867 - protein, 15 aa, Borrelia burgdorferi B31
IQISKEANLNTKKLG

SEQ ID NO: 105868 - protein, 15 aa, Borrelia burgdorferi B31
QISKEANLNTKKLGT

SEQ ID NO: 105869 - protein, 15 aa, Borrelia burgdorferi B31
ISKEANLNTKKLGTT

SEQ ID NO: 105870 - protein, 15 aa, Borrelia burgdorferi B31
SKEANLNTKKLGTTY

SEQ ID NO: 105871 - protein, 15 aa, Borrelia burgdorferi B31
KEANLNTKKLGTTYK

SEQ ID NO: 105872 - protein, 15 aa, Borrelia burgdorferi B31
EANLNTKKLGTTYKL

SEQ ID NO: 105873 - protein, 15 aa, Borrelia burgdorferi B31
ANLNTKKLGTTYKLK

SEQ ID NO: 105874 - protein, 15 aa, Borrelia burgdorferi B31
NLNTKKLGTTYKLKS

SEQ ID NO: 105875 - protein, 15 aa, Borrelia burgdorferi B31
LNTKKLGTTYKLKSS

SEQ ID NO: 105876 - protein, 15 aa, Borrelia burgdorferi B31
NTKKLGTTYKLKSSN

SEQ ID NO: 105877 - protein, 15 aa, Borrelia burgdorferi B31
TKKLGTTYKLKSSNF

SEQ ID NO: 105878 - protein, 15 aa, Borrelia burgdorferi B31
KKLGTTYKLKSSNFL

SEQ ID NO: 105879 - protein, 15 aa, Borrelia burgdorferi B31
KLGTTYKLKSSNFLK

SEQ ID NO: 105880 - protein, 15 aa, Borrelia burgdorferi B31
LGTTYKLKSSNFLKL

SEQ ID NO: 105881 - protein, 15 aa, Borrelia burgdorferi B31
GTTYKLKSSNFLKLI

SEQ ID NO: 105882 - protein, 15 aa, Borrelia burgdorferi B31
TTYKLKSSNFLKLIE

SEQ ID NO: 105883 - protein, 15 aa, Borrelia burgdorferi B31
TYKLKSSNFLKLIEI

SEQ ID NO: 105884 - protein, 15 aa, Borrelia burgdorferi B31
YKLKSSNFLKLIEIQ

SEQ ID NO: 105885 - protein, 15 aa, Borrelia burgdorferi B31
KLKSSNFLKLIEIQN

SEQ ID NO: 105886 - protein, 15 aa, Borrelia burgdorferi B31
LKSSNFLKLIEIQNS

SEQ ID NO: 105887 - protein, 15 aa, Borrelia burgdorferi B31
KSSNFLKLIEIQNSP

SEQ ID NO: 105888 - protein, 15 aa, Borrelia burgdorferi B31
SSNFLKLIEIQNSPY

SEQ ID NO: 105889 - protein, 15 aa, Borrelia burgdorferi B31
SNFLKLIEIQNSPYY

SEQ ID NO: 105890 - protein, 15 aa, Borrelia burgdorferi B31
NFLKLIEIQNSPYYS

SEQ ID NO: 105891 - protein, 15 aa, Borrelia burgdorferi B31
FLKLIEIQNSPYYSQ

SEQ ID NO: 105892 - protein, 15 aa, Borrelia burgdorferi B31
LKLIEIQNSPYYSQE

SEQ ID NO: 105893 - protein, 15 aa, Borrelia burgdorferi B31
KLIEIQNSPYYSQEK

SEQ ID NO: 105894 - protein, 15 aa, Borrelia burgdorferi B31
LIEIQNSPYYSQEKK

SEQ ID NO: 105895 - protein, 15 aa, Borrelia burgdorferi B31
IEIQNSPYYSQEKKD

SEQ ID NO: 105896 - protein, 15 aa, Borrelia burgdorferi B31
EIQNSPYYSQEKKDI

SEQ ID NO: 105897 - protein, 15 aa, Borrelia burgdorferi B31
IQNSPYYSQEKKDIY

SEQ ID NO: 105898 - protein, 15 aa, Borrelia burgdorferi B31
QNSPYYSQEKKDIYK

SEQ ID NO: 105899 - protein, 15 aa, Borrelia burgdorferi B31
NSPYYSQEKKDIYKQ

SEQ ID NO: 105900 - protein, 15 aa, Borrelia burgdorferi B31
SPYYSQEKKDIYKQI

SEQ ID NO: 105901 - protein, 15 aa, Borrelia burgdorferi B31
PYYSQEKKDIYKQII

SEQ ID NO: 105902 - protein, 15 aa, Borrelia burgdorferi B31
YYSQEKKDIYKQIIL

SEQ ID NO: 105903 - protein, 15 aa, Borrelia burgdorferi B31
YSQEKKDIYKQIILN

SEQ ID NO: 105904 - protein, 15 aa, Borrelia burgdorferi B31
SQEKKDIYKQIILNF

SEQ ID NO: 105905 - protein, 15 aa, Borrelia burgdorferi B31
QEKKDIYKQIILNFS

SEQ ID NO: 105906 - protein, 15 aa, Borrelia burgdorferi B31
EKKDIYKQIILNFSS

SEQ ID NO: 105907 - protein, 15 aa, Borrelia burgdorferi B31
KKDIYKQIILNFSSN

SEQ ID NO: 105908 - protein, 15 aa, Borrelia burgdorferi B31
KDIYKQIILNFSSNI

SEQ ID NO: 105909 - protein, 15 aa, Borrelia burgdorferi B31
DIYKQIILNFSSNIN

SEQ ID NO: 105910 - protein, 15 aa, Borrelia burgdorferi B31
IYKQIILNFSSNINI

SEQ ID NO: 105911 - protein, 15 aa, Borrelia burgdorferi B31
YKQIILNFSSNINID

SEQ ID NO: 105912 - protein, 15 aa, Borrelia burgdorferi B31
KQIILNFSSNINIDS

SEQ ID NO: 105913 - protein, 15 aa, Borrelia burgdorferi B31
QIILNFSSNINIDSL

SEQ ID NO: 105914 - protein, 15 aa, Borrelia burgdorferi B31
IILNFSSNINIDSLE

SEQ ID NO: 105915 - protein, 15 aa, Borrelia burgdorferi B31
ILNFSSNINIDSLEQ

SEQ ID NO: 105916 - protein, 15 aa, Borrelia burgdorferi B31
LNFSSNINIDSLEQT

SEQ ID NO: 105917 - protein, 15 aa, Borrelia burgdorferi B31
NFSSNINIDSLEQTI

SEQ ID NO: 105918 - protein, 15 aa, Borrelia burgdorferi B31
FSSNINIDSLEQTID

SEQ ID NO: 105919 - protein, 15 aa, Borrelia burgdorferi B31
SSNINIDSLEQTIDI

SEQ ID NO: 105920 - protein, 15 aa, Borrelia burgdorferi B31
SNINIDSLEQTIDIL

SEQ ID NO: 105921 - protein, 15 aa, Borrelia burgdorferi B31
NINIDSLEQTIDILV

SEQ ID NO: 105922 - protein, 15 aa, Borrelia burgdorferi B31
INIDSLEQTIDILVA

SEQ ID NO: 105923 - protein, 15 aa, Borrelia burgdorferi B31
NIDSLEQTIDILVAV

SEQ ID NO: 105924 - protein, 15 aa, Borrelia burgdorferi B31
IDSLEQTIDILVAVR

SEQ ID NO: 105925 - protein, 15 aa, Borrelia burgdorferi B31
DSLEQTIDILVAVRN

SEQ ID NO: 105926 - protein, 15 aa, Borrelia burgdorferi B31
SLEQTIDILVAVRNR

SEQ ID NO: 105927 - protein, 15 aa, Borrelia burgdorferi B31
LEQTIDILVAVRNRN

SEQ ID NO: 105928 - protein, 15 aa, Borrelia burgdorferi B31
EQTIDILVAVRNRNK

SEQ ID NO: 105929 - protein, 15 aa, Borrelia burgdorferi B31
QTIDILVAVRNRNKI

SEQ ID NO: 105930 - protein, 15 aa, Borrelia burgdorferi B31
TIDILVAVRNRNKIK

SEQ ID NO: 105931 - protein, 15 aa, Borrelia burgdorferi B31
IDILVAVRNRNKIKI

SEQ ID NO: 105932 - protein, 15 aa, Borrelia burgdorferi B31
DILVAVRNRNKIKIL

SEQ ID NO: 105933 - protein, 15 aa, Borrelia burgdorferi B31
ILVAVRNRNKIKILN

SEQ ID NO: 105934 - protein, 15 aa, Borrelia burgdorferi B31
LVAVRNRNKIKILNI

SEQ ID NO: 105935 - protein, 15 aa, Borrelia burgdorferi B31
VAVRNRNKIKILNIL

SEQ ID NO: 105936 - protein, 15 aa, Borrelia burgdorferi B31
AVRNRNKIKILNILN

SEQ ID NO: 105937 - protein, 15 aa, Borrelia burgdorferi B31
VRNRNKIKILNILNK

SEQ ID NO: 105938 - protein, 15 aa, Borrelia burgdorferi B31
RNRNKIKILNILNKN

SEQ ID NO: 105939 - protein, 15 aa, Borrelia burgdorferi B31
NRNKIKILNILNKNL

SEQ ID NO: 105940 - protein, 15 aa, Borrelia burgdorferi B31
RNKIKILNILNKNLK

SEQ ID NO: 105941 - protein, 15 aa, Borrelia burgdorferi B31
NKIKILNILNKNLKY

SEQ ID NO: 105942 - protein, 15 aa, Borrelia burgdorferi B31
KIKILNILNKNLKYR

SEQ ID NO: 105943 - protein, 15 aa, Borrelia burgdorferi B31
IKILNILNKNLKYRP

SEQ ID NO: 105944 - protein, 15 aa, Borrelia burgdorferi B31
KILNILNKNLKYRPE

SEQ ID NO: 105945 - protein, 15 aa, Borrelia burgdorferi B31
ILNILNKNLKYRPEN

SEQ ID NO: 105946 - protein, 15 aa, Borrelia burgdorferi B31
LNILNKNLKYRPENQ

SEQ ID NO: 105947 - protein, 15 aa, Borrelia burgdorferi B31
NILNKNLKYRPENQK

SEQ ID NO: 105948 - protein, 15 aa, Borrelia burgdorferi B31
ILNKNLKYRPENQKV

SEQ ID NO: 105949 - protein, 15 aa, Borrelia burgdorferi B31
LNKNLKYRPENQKVF

SEQ ID NO: 105950 - protein, 15 aa, Borrelia burgdorferi B31
NKNLKYRPENQKVFK

SEQ ID NO: 105951 - protein, 15 aa, Borrelia burgdorferi B31
KNLKYRPENQKVFKS

SEQ ID NO: 105952 - protein, 15 aa, Borrelia burgdorferi B31
NLKYRPENQKVFKSS

SEQ ID NO: 105953 - protein, 15 aa, Borrelia burgdorferi B31
LKYRPENQKVFKSSL

SEQ ID NO: 105954 - protein, 15 aa, Borrelia burgdorferi B31
KYRPENQKVFKSSLT

SEQ ID NO: 105955 - protein, 15 aa, Borrelia burgdorferi B31
YRPENQKVFKSSLTN

SEQ ID NO: 105956 - protein, 15 aa, Borrelia burgdorferi B31
RPENQKVFKSSLTNK

SEQ ID NO: 105957 - protein, 15 aa, Borrelia burgdorferi B31
PENQKVFKSSLTNKE

SEQ ID NO: 105958 - protein, 15 aa, Borrelia burgdorferi B31
ENQKVFKSSLTNKES

SEQ ID NO: 105959 - protein, 15 aa, Borrelia burgdorferi B31
NQKVFKSSLTNKESR

SEQ ID NO: 105960 - protein, 15 aa, Borrelia burgdorferi B31
QKVFKSSLTNKESRL

SEQ ID NO: 105961 - protein, 15 aa, Borrelia burgdorferi B31
KVFKSSLTNKESRLI

SEQ ID NO: 105962 - protein, 15 aa, Borrelia burgdorferi B31
VFKSSLTNKESRLIK

SEQ ID NO: 105963 - protein, 15 aa, Borrelia burgdorferi B31
FKSSLTNKESRLIKL

SEQ ID NO: 105964 - protein, 15 aa, Borrelia burgdorferi B31
KSSLTNKESRLIKLK

SEQ ID NO: 105965 - protein, 15 aa, Borrelia burgdorferi B31
SSLTNKESRLIKLKR

SEQ ID NO: 105966 - protein, 15 aa, Borrelia burgdorferi B31
SLTNKESRLIKLKRM

SEQ ID NO: 105967 - protein, 15 aa, Borrelia burgdorferi B31
LTNKESRLIKLKRML

SEQ ID NO: 105968 - protein, 15 aa, Borrelia burgdorferi B31
TNKESRLIKLKRMLI

SEQ ID NO: 105969 - protein, 15 aa, Borrelia burgdorferi B31
NKESRLIKLKRMLIL

SEQ ID NO: 105970 - protein, 15 aa, Borrelia burgdorferi B31
KESRLIKLKRMLILT

SEQ ID NO: 105971 - protein, 15 aa, Borrelia burgdorferi B31
ESRLIKLKRMLILTY

SEQ ID NO: 105972 - protein, 15 aa, Borrelia burgdorferi B31
SRLIKLKRMLILTYW

SEQ ID NO: 105973 - protein, 15 aa, Borrelia burgdorferi B31
RLIKLKRMLILTYWP

SEQ ID NO: 105974 - protein, 15 aa, Borrelia burgdorferi B31
LIKLKRMLILTYWPV

SEQ ID NO: 105975 - protein, 15 aa, Borrelia burgdorferi B31
IKLKRMLILTYWPVG

SEQ ID NO: 105976 - protein, 15 aa, Borrelia burgdorferi B31
KLKRMLILTYWPVGC

SEQ ID NO: 105977 - protein, 15 aa, Borrelia burgdorferi B31
LKRMLILTYWPVGCL

SEQ ID NO: 105978 - protein, 15 aa, Borrelia burgdorferi B31
KRMLILTYWPVGCLS

SEQ ID NO: 105979 - protein, 15 aa, Borrelia burgdorferi B31
RMLILTYWPVGCLSK

SEQ ID NO: 105980 - protein, 15 aa, Borrelia burgdorferi B31
MLILTYWPVGCLSKN

SEQ ID NO: 105981 - protein, 15 aa, Borrelia burgdorferi B31
LILTYWPVGCLSKNI

SEQ ID NO: 105982 - protein, 15 aa, Borrelia burgdorferi B31
ILTYWPVGCLSKNIF

SEQ ID NO: 105983 - protein, 15 aa, Borrelia burgdorferi B31
LTYWPVGCLSKNIFI

SEQ ID NO: 105984 - protein, 15 aa, Borrelia burgdorferi B31
TYWPVGCLSKNIFIK

SEQ ID NO: 105985 - protein, 15 aa, Borrelia burgdorferi B31
YWPVGCLSKNIFIKI

SEQ ID NO: 105986 - protein, 15 aa, Borrelia burgdorferi B31
WPVGCLSKNIFIKIL

SEQ ID NO: 105987 - protein, 15 aa, Borrelia burgdorferi B31
PVGCLSKNIFIKILI

SEQ ID NO: 105988 - protein, 15 aa, Borrelia burgdorferi B31
VGCLSKNIFIKILIK

SEQ ID NO: 105989 - protein, 15 aa, Borrelia burgdorferi B31
  Xaa can be any naturally occurring amino acid
  VARIANT 15: Xaa = Any Amino Acid
GCLSKNIFIKILIKX

SEQ ID NO: 105990 - protein, 15 aa, Borrelia burgdorferi B31
  Xaa can be any naturally occurring amino acid
  VARIANT 14: Xaa = Any Amino Acid
CLSKNIFIKILIKXY

SEQ ID NO: 105991 - protein, 15 aa, Borrelia burgdorferi B31
  Xaa can be any naturally occurring amino acid
  VARIANT 13: Xaa = Any Amino Acid
LSKNIFIKILIKXYK

SEQ ID NO: 105992 - protein, 15 aa, Borrelia burgdorferi B31
  Xaa can be any naturally occurring amino acid
  VARIANT 12: Xaa = Any Amino Acid
SKNIFIKILIKXYKY

SEQ ID NO: 105993 - protein, 15 aa, Borrelia burgdorferi B31
  Xaa can be any naturally occurring amino acid
  VARIANT 11: Xaa = Any Amino Acid
KNIFIKILIKXYKYL

SEQ ID NO: 105994 - protein, 15 aa, Borrelia burgdorferi B31
  Xaa can be any naturally occurring amino acid
  VARIANT 10: Xaa = Any Amino Acid
NIFIKILIKXYKYLE

SEQ ID NO: 105995 - protein, 15 aa, Borrelia burgdorferi B31
  Xaa can be any naturally occurring amino acid
  VARIANT 9: Xaa = Any Amino Acid
IFIKILIKXYKYLEE

SEQ ID NO: 105996 - protein, 15 aa, Borrelia burgdorferi B31
  Xaa can be any naturally occurring amino acid
  VARIANT 8: Xaa = Any Amino Acid
FIKILIKXYKYLEEE

SEQ ID NO: 105997 - protein, 15 aa, Borrelia burgdorferi B31
  Xaa can be any naturally occurring amino acid
  VARIANT 7: Xaa = Any Amino Acid
IKILIKXYKYLEEEI

SEQ ID NO: 105998 - protein, 15 aa, Borrelia burgdorferi B31
  Xaa can be any naturally occurring amino acid
  VARIANT 6: Xaa = Any Amino Acid
KILIKXYKYLEEEIL

SEQ ID NO: 105999 - protein, 15 aa, Borrelia burgdorferi B31
  Xaa can be any naturally occurring amino acid
  VARIANT 5: Xaa = Any Amino Acid
ILIKXYKYLEEEILA

SEQ ID NO: 106000 - protein, 15 aa, Borrelia burgdorferi B31
  Xaa can be any naturally occurring amino acid
  VARIANT 4: Xaa = Any Amino Acid
LIKXYKYLEEEILAL

SEQ ID NO: 106001 - protein, 15 aa, Borrelia burgdorferi B31
  Xaa can be any naturally occurring amino acid
  VARIANT 3: Xaa = Any Amino Acid
IKXYKYLEEEILALK

SEQ ID NO: 106002 - protein, 15 aa, Borrelia burgdorferi B31
  Xaa can be any naturally occurring amino acid
  VARIANT 2: Xaa = Any Amino Acid
KXYKYLEEEILALKY

SEQ ID NO: 106003 - protein, 15 aa, Borrelia burgdorferi B31
  Xaa can be any naturally occurring amino acid
  VARIANT 1: Xaa = Any Amino Acid
XYKYLEEEILALKYN

SEQ ID NO: 106004 - protein, 15 aa, Borrelia burgdorferi B31
YKYLEEEILALKYNE

SEQ ID NO: 106005 - protein, 15 aa, Borrelia burgdorferi B31
KYLEEEILALKYNEI

SEQ ID NO: 106006 - protein, 15 aa, Borrelia burgdorferi B31
YLEEEILALKYNEIL

SEQ ID NO: 106007 - protein, 15 aa, Borrelia burgdorferi B31
LEEEILALKYNEILN

SEQ ID NO: 106008 - protein, 15 aa, Borrelia burgdorferi B31
EEEILALKYNEILNY

SEQ ID NO: 106009 - protein, 15 aa, Borrelia burgdorferi B31
EEILALKYNEILNYL

SEQ ID NO: 106010 - protein, 15 aa, Borrelia burgdorferi B31
EILALKYNEILNYLR

SEQ ID NO: 106011 - protein, 15 aa, Borrelia burgdorferi B31
ILALKYNEILNYLRA

SEQ ID NO: 106012 - protein, 15 aa, Borrelia burgdorferi B31
LALKYNEILNYLRAL

SEQ ID NO: 106013 - protein, 15 aa, Borrelia burgdorferi B31
ALKYNEILNYLRALK

SEQ ID NO: 106014 - protein, 15 aa, Borrelia burgdorferi B31
LKYNEILNYLRALKT

SEQ ID NO: 106015 - protein, 15 aa, Borrelia burgdorferi B31
KYNEILNYLRALKTL

SEQ ID NO: 106016 - protein, 15 aa, Borrelia burgdorferi B31
YNEILNYLRALKTLS

SEQ ID NO: 106017 - protein, 15 aa, Borrelia burgdorferi B31
NEILNYLRALKTLSL

SEQ ID NO: 106018 - protein, 15 aa, Borrelia burgdorferi B31
EILNYLRALKTLSLN

SEQ ID NO: 106019 - protein, 15 aa, Borrelia burgdorferi B31
ILNYLRALKTLSLNE

SEQ ID NO: 106020 - protein, 15 aa, Borrelia burgdorferi B31
LNYLRALKTLSLNEI

SEQ ID NO: 106021 - protein, 15 aa, Borrelia burgdorferi B31
NYLRALKTLSLNEIF

SEQ ID NO: 106022 - protein, 15 aa, Borrelia burgdorferi B31
YLRALKTLSLNEIFY

SEQ ID NO: 106023 - protein, 15 aa, Borrelia burgdorferi B31
LRALKTLSLNEIFYK

SEQ ID NO: 106024 - protein, 15 aa, Borrelia burgdorferi B31
RALKTLSLNEIFYKG

SEQ ID NO: 106025 - protein, 15 aa, Borrelia burgdorferi B31
ALKTLSLNEIFYKGS

SEQ ID NO: 106026 - protein, 15 aa, Borrelia burgdorferi B31
LKTLSLNEIFYKGSS

SEQ ID NO: 106027 - protein, 15 aa, Borrelia burgdorferi B31
KTLSLNEIFYKGSSK

SEQ ID NO: 106028 - protein, 15 aa, Borrelia burgdorferi B31
TLSLNEIFYKGSSKN

SEQ ID NO: 106029 - protein, 15 aa, Borrelia burgdorferi B31
LSLNEIFYKGSSKNI

SEQ ID NO: 106030 - protein, 15 aa, Borrelia burgdorferi B31
SLNEIFYKGSSKNIS

SEQ ID NO: 106031 - protein, 15 aa, Borrelia burgdorferi B31
LNEIFYKGSSKNISF

SEQ ID NO: 106032 - protein, 15 aa, Borrelia burgdorferi B31
NEIFYKGSSKNISFN

SEQ ID NO: 106033 - protein, 15 aa, Borrelia burgdorferi B31
EIFYKGSSKNISFNY

SEQ ID NO: 106034 - protein, 15 aa, Borrelia burgdorferi B31
IFYKGSSKNISFNYF

SEQ ID NO: 106035 - protein, 15 aa, Borrelia burgdorferi B31
FYKGSSKNISFNYFF

SEQ ID NO: 106036 - protein, 15 aa, Borrelia burgdorferi B31
YKGSSKNISFNYFFS

SEQ ID NO: 106037 - protein, 15 aa, Borrelia burgdorferi B31
KGSSKNISFNYFFSD

SEQ ID NO: 106038 - protein, 15 aa, Borrelia burgdorferi B31
GSSKNISFNYFFSDF

SEQ ID NO: 106039 - protein, 15 aa, Borrelia burgdorferi B31
SSKNISFNYFFSDFT

SEQ ID NO: 106040 - protein, 15 aa, Borrelia burgdorferi B31
SKNISFNYFFSDFTQ

SEQ ID NO: 106041 - protein, 15 aa, Borrelia burgdorferi B31
KNISFNYFFSDFTQY

SEQ ID NO: 106042 - protein, 15 aa, Borrelia burgdorferi B31
NISFNYFFSDFTQYA

SEQ ID NO: 106043 - protein, 15 aa, Borrelia burgdorferi B31
ISFNYFFSDFTQYAP

SEQ ID NO: 106044 - protein, 15 aa, Borrelia burgdorferi B31
SFNYFFSDFTQYAPK

SEQ ID NO: 106045 - protein, 15 aa, Borrelia burgdorferi B31
FNYFFSDFTQYAPKD

SEQ ID NO: 106046 - protein, 15 aa, Borrelia burgdorferi B31
NYFFSDFTQYAPKDF

SEQ ID NO: 106047 - protein, 15 aa, Borrelia burgdorferi B31
YFFSDFTQYAPKDFQ

SEQ ID NO: 106048 - protein, 15 aa, Borrelia burgdorferi B31
FFSDFTQYAPKDFQD

SEQ ID NO: 106049 - protein, 15 aa, Borrelia burgdorferi B31
FSDFTQYAPKDFQDT

SEQ ID NO: 106050 - protein, 15 aa, Borrelia burgdorferi B31
SDFTQYAPKDFQDTL

SEQ ID NO: 106051 - protein, 15 aa, Borrelia burgdorferi B31
DFTQYAPKDFQDTLK

SEQ ID NO: 106052 - protein, 15 aa, Borrelia burgdorferi B31
FTQYAPKDFQDTLKC

SEQ ID NO: 106053 - protein, 15 aa, Borrelia burgdorferi B31
TQYAPKDFQDTLKCY

SEQ ID NO: 106054 - protein, 15 aa, Borrelia burgdorferi B31
QYAPKDFQDTLKCYL

SEQ ID NO: 106055 - protein, 15 aa, Borrelia burgdorferi B31
YAPKDFQDTLKCYLY

SEQ ID NO: 106056 - protein, 15 aa, Borrelia burgdorferi B31
APKDFQDTLKCYLYV

SEQ ID NO: 106057 - protein, 15 aa, Borrelia burgdorferi B31
PKDFQDTLKCYLYVI

SEQ ID NO: 106058 - protein, 15 aa, Borrelia burgdorferi B31
KDFQDTLKCYLYVIE

SEQ ID NO: 106059 - protein, 15 aa, Borrelia burgdorferi B31
DFQDTLKCYLYVIEK

SEQ ID NO: 106060 - protein, 15 aa, Borrelia burgdorferi B31
FQDTLKCYLYVIEKT

SEQ ID NO: 106061 - protein, 15 aa, Borrelia burgdorferi B31
QDTLKCYLYVIEKTI

SEQ ID NO: 106062 - protein, 15 aa, Borrelia burgdorferi B31
DTLKCYLYVIEKTIT

SEQ ID NO: 106063 - protein, 15 aa, Borrelia burgdorferi B31
TLKCYLYVIEKTITK

SEQ ID NO: 106064 - protein, 15 aa, Borrelia burgdorferi B31
LKCYLYVIEKTITKK

SEQ ID NO: 106065 - protein, 15 aa, Borrelia burgdorferi B31
KCYLYVIEKTITKKY

SEQ ID NO: 106066 - protein, 15 aa, Borrelia burgdorferi B31
CYLYVIEKTITKKYL

SEQ ID NO: 106067 - protein, 15 aa, Borrelia burgdorferi B31
YLYVIEKTITKKYLT

SEQ ID NO: 106068 - protein, 15 aa, Borrelia burgdorferi B31
LYVIEKTITKKYLTW

SEQ ID NO: 106069 - protein, 15 aa, Borrelia burgdorferi B31
YVIEKTITKKYLTWF

SEQ ID NO: 106070 - protein, 15 aa, Borrelia burgdorferi B31
VIEKTITKKYLTWFF

SEQ ID NO: 106071 - protein, 15 aa, Borrelia burgdorferi B31
IEKTITKKYLTWFFK

SEQ ID NO: 106072 - protein, 15 aa, Borrelia burgdorferi B31
EKTITKKYLTWFFKD

SEQ ID NO: 106073 - protein, 15 aa, Borrelia burgdorferi B31
KTITKKYLTWFFKDK

SEQ ID NO: 106074 - protein, 15 aa, Borrelia burgdorferi B31
TITKKYLTWFFKDKI

SEQ ID NO: 106075 - protein, 15 aa, Borrelia burgdorferi B31
ITKKYLTWFFKDKIS

SEQ ID NO: 106076 - protein, 15 aa, Borrelia burgdorferi B31
TKKYLTWFFKDKISN

SEQ ID NO: 106077 - protein, 15 aa, Borrelia burgdorferi B31
KKYLTWFFKDKISNN

SEQ ID NO: 106078 - protein, 15 aa, Borrelia burgdorferi B31
KYLTWFFKDKISNNW

SEQ ID NO: 106079 - protein, 15 aa, Borrelia burgdorferi B31
YLTWFFKDKISNNWE

SEQ ID NO: 106080 - protein, 15 aa, Borrelia burgdorferi B31
LTWFFKDKISNNWES

SEQ ID NO: 106081 - protein, 15 aa, Borrelia burgdorferi B31
TWFFKDKISNNWESF

SEQ ID NO: 106082 - protein, 15 aa, Borrelia burgdorferi B31
WFFKDKISNNWESFI

SEQ ID NO: 106083 - protein, 15 aa, Borrelia burgdorferi B31
FFKDKISNNWESFID

SEQ ID NO: 106084 - protein, 15 aa, Borrelia burgdorferi B31
FKDKISNNWESFIDA

SEQ ID NO: 106085 - protein, 15 aa, Borrelia burgdorferi B31
KDKISNNWESFIDAL

SEQ ID NO: 106086 - protein, 15 aa, Borrelia burgdorferi B31
DKISNNWESFIDALE

SEQ ID NO: 106087 - protein, 15 aa, Borrelia burgdorferi B31
KISNNWESFIDALEY

SEQ ID NO: 106088 - protein, 15 aa, Borrelia burgdorferi B31
ISNNWESFIDALEYI

SEQ ID NO: 106089 - protein, 15 aa, Borrelia burgdorferi B31
SNNWESFIDALEYIE

SEQ ID NO: 106090 - protein, 15 aa, Borrelia burgdorferi B31
NNWESFIDALEYIEK

SEQ ID NO: 106091 - protein, 15 aa, Borrelia burgdorferi B31
NWESFIDALEYIEKH

SEQ ID NO: 106092 - protein, 15 aa, Borrelia burgdorferi B31
WESFIDALEYIEKHK

SEQ ID NO: 106093 - protein, 15 aa, Borrelia burgdorferi B31
ESFIDALEYIEKHKL

SEQ ID NO: 106094 - protein, 15 aa, Borrelia burgdorferi B31
SFIDALEYIEKHKLI

SEQ ID NO: 106095 - protein, 15 aa, Borrelia burgdorferi B31
FIDALEYIEKHKLIN

SEQ ID NO: 106096 - protein, 15 aa, Borrelia burgdorferi B31
IDALEYIEKHKLINI

SEQ ID NO: 106097 - protein, 15 aa, Borrelia burgdorferi B31
DALEYIEKHKLINIK

SEQ ID NO: 106098 - protein, 15 aa, Borrelia burgdorferi B31
ALEYIEKHKLINIKE

SEQ ID NO: 106099 - protein, 15 aa, Borrelia burgdorferi B31
LEYIEKHKLINIKEK

SEQ ID NO: 106100 - protein, 15 aa, Borrelia burgdorferi B31
EYIEKHKLINIKEKI

SEQ ID NO: 106101 - protein, 15 aa, Borrelia burgdorferi B31
YIEKHKLINIKEKIK

SEQ ID NO: 106102 - protein, 15 aa, Borrelia burgdorferi B31
IEKHKLINIKEKIKE

SEQ ID NO: 106103 - protein, 15 aa, Borrelia burgdorferi B31
EKHKLINIKEKIKEI

SEQ ID NO: 106104 - protein, 15 aa, Borrelia burgdorferi B31
KHKLINIKEKIKEII

SEQ ID NO: 106105 - protein, 15 aa, Borrelia burgdorferi B31
HKLINIKEKIKEIIT

SEQ ID NO: 106106 - protein, 15 aa, Borrelia burgdorferi B31
KLINIKEKIKEIITA

SEQ ID NO: 106107 - protein, 15 aa, Borrelia burgdorferi B31
LINIKEKIKEIITAK

SEQ ID NO: 106108 - protein, 15 aa, Borrelia burgdorferi B31
INIKEKIKEIITAKF

SEQ ID NO: 106109 - protein, 15 aa, Borrelia burgdorferi B31
NIKEKIKEIITAKFQ

SEQ ID NO: 106110 - protein, 15 aa, Borrelia burgdorferi B31
IKEKIKEIITAKFQT

SEQ ID NO: 106111 - protein, 15 aa, Borrelia burgdorferi B31
KEKIKEIITAKFQTE

SEQ ID NO: 106112 - protein, 15 aa, Borrelia burgdorferi B31
EKIKEIITAKFQTED

SEQ ID NO: 106113 - protein, 15 aa, Borrelia burgdorferi B31
KIKEIITAKFQTEDF

SEQ ID NO: 106114 - protein, 15 aa, Borrelia burgdorferi B31
IKEIITAKFQTEDFF

SEQ ID NO: 106115 - protein, 15 aa, Borrelia burgdorferi B31
KEIITAKFQTEDFFI

SEQ ID NO: 106116 - protein, 15 aa, Borrelia burgdorferi B31
EIITAKFQTEDFFIS

SEQ ID NO: 106117 - protein, 15 aa, Borrelia burgdorferi B31
IITAKFQTEDFFISF

SEQ ID NO: 106118 - protein, 15 aa, Borrelia burgdorferi B31
ITAKFQTEDFFISFD

SEQ ID NO: 106119 - protein, 15 aa, Borrelia burgdorferi B31
TAKFQTEDFFISFDK

SEQ ID NO: 106120 - protein, 15 aa, Borrelia burgdorferi B31
AKFQTEDFFISFDKT

SEQ ID NO: 106121 - protein, 15 aa, Borrelia burgdorferi B31
KFQTEDFFISFDKTN

SEQ ID NO: 106122 - protein, 15 aa, Borrelia burgdorferi B31
FQTEDFFISFDKTNF

SEQ ID NO: 106123 - protein, 15 aa, Borrelia burgdorferi B31
QTEDFFISFDKTNFN

SEQ ID NO: 106124 - protein, 15 aa, Borrelia burgdorferi B31
TEDFFISFDKTNFNP

SEQ ID NO: 106125 - protein, 15 aa, Borrelia burgdorferi B31
EDFFISFDKTNFNPY

SEQ ID NO: 106126 - protein, 15 aa, Borrelia burgdorferi B31
DFFISFDKTNFNPYE

SEQ ID NO: 106127 - protein, 15 aa, Borrelia burgdorferi B31
FFISFDKTNFNPYES

SEQ ID NO: 106128 - protein, 15 aa, Borrelia burgdorferi B31
FISFDKTNFNPYESS

SEQ ID NO: 106129 - protein, 15 aa, Borrelia burgdorferi B31
ISFDKTNFNPYESSI

SEQ ID NO: 106130 - protein, 15 aa, Borrelia burgdorferi B31
SFDKTNFNPYESSIF

SEQ ID NO: 106131 - protein, 15 aa, Borrelia burgdorferi B31
FDKTNFNPYESSIFK

SEQ ID NO: 106132 - protein, 15 aa, Borrelia burgdorferi B31
DKTNFNPYESSIFKE

SEQ ID NO: 106133 - protein, 15 aa, Borrelia burgdorferi B31
KTNFNPYESSIFKER

SEQ ID NO: 106134 - protein, 15 aa, Borrelia burgdorferi B31
TNFNPYESSIFKERY

SEQ ID NO: 106135 - protein, 15 aa, Borrelia burgdorferi B31
NFNPYESSIFKERYI

SEQ ID NO: 106136 - protein, 15 aa, Borrelia burgdorferi B31
FNPYESSIFKERYIK

SEQ ID NO: 106137 - protein, 15 aa, Borrelia burgdorferi B31
NPYESSIFKERYIKS

SEQ ID NO: 106138 - protein, 15 aa, Borrelia burgdorferi B31
PYESSIFKERYIKSA

SEQ ID NO: 106139 - protein, 15 aa, Borrelia burgdorferi B31
YESSIFKERYIKSAF

SEQ ID NO: 106140 - protein, 15 aa, Borrelia burgdorferi B31
ESSIFKERYIKSAFL

SEQ ID NO: 106141 - protein, 15 aa, Borrelia burgdorferi B31
SSIFKERYIKSAFLE

SEQ ID NO: 106142 - protein, 15 aa, Borrelia burgdorferi B31
SIFKERYIKSAFLEI

SEQ ID NO: 106143 - protein, 15 aa, Borrelia burgdorferi B31
IFKERYIKSAFLEII

SEQ ID NO: 106144 - protein, 15 aa, Borrelia burgdorferi B31
FKERYIKSAFLEIIM

SEQ ID NO: 106145 - protein, 15 aa, Borrelia burgdorferi B31
KERYIKSAFLEIIMH

SEQ ID NO: 106146 - protein, 15 aa, Borrelia burgdorferi B31
ERYIKSAFLEIIMHY

SEQ ID NO: 106147 - protein, 15 aa, Borrelia burgdorferi B31
RYIKSAFLEIIMHYV

SEQ ID NO: 106148 - protein, 15 aa, Borrelia burgdorferi B31
YIKSAFLEIIMHYVK

SEQ ID NO: 106149 - protein, 15 aa, Borrelia burgdorferi B31
IKSAFLEIIMHYVKK

SEQ ID NO: 106150 - protein, 15 aa, Borrelia burgdorferi B31
KSAFLEIIMHYVKKN

SEQ ID NO: 106151 - protein, 15 aa, Borrelia burgdorferi B31
SAFLEIIMHYVKKNS

SEQ ID NO: 106152 - protein, 15 aa, Borrelia burgdorferi B31
AFLEIIMHYVKKNSQ

SEQ ID NO: 106153 - protein, 15 aa, Borrelia burgdorferi B31
FLEIIMHYVKKNSQN

SEQ ID NO: 106154 - protein, 15 aa, Borrelia burgdorferi B31
LEIIMHYVKKNSQNI

SEQ ID NO: 106155 - protein, 15 aa, Borrelia burgdorferi B31
EIIMHYVKKNSQNIE

SEQ ID NO: 106156 - protein, 15 aa, Borrelia burgdorferi B31
IIMHYVKKNSQNIET

SEQ ID NO: 106157 - protein, 15 aa, Borrelia burgdorferi B31
IMHYVKKNSQNIETY

SEQ ID NO: 106158 - protein, 15 aa, Borrelia burgdorferi B31
MHYVKKNSQNIETYG

SEQ ID NO: 106159 - protein, 15 aa, Borrelia burgdorferi B31
HYVKKNSQNIETYGW

SEQ ID NO: 106160 - protein, 15 aa, Borrelia burgdorferi B31
YVKKNSQNIETYGWI

SEQ ID NO: 106161 - protein, 15 aa, Borrelia burgdorferi B31
VKKNSQNIETYGWIA

SEQ ID NO: 106162 - protein, 15 aa, Borrelia burgdorferi B31
KKNSQNIETYGWIAF

SEQ ID NO: 106163 - protein, 15 aa, Borrelia burgdorferi B31
KNSQNIETYGWIAFY

SEQ ID NO: 106164 - protein, 15 aa, Borrelia burgdorferi B31
NSQNIETYGWIAFYI

SEQ ID NO: 106165 - protein, 15 aa, Borrelia burgdorferi B31
SQNIETYGWIAFYIY

SEQ ID NO: 106166 - protein, 15 aa, Borrelia burgdorferi B31
QNIETYGWIAFYIYA

SEQ ID NO: 106167 - protein, 15 aa, Borrelia burgdorferi B31
NIETYGWIAFYIYAD

SEQ ID NO: 106168 - protein, 15 aa, Borrelia burgdorferi B31
IETYGWIAFYIYADN

SEQ ID NO: 106169 - protein, 15 aa, Borrelia burgdorferi B31
ETYGWIAFYIYADNK

SEQ ID NO: 106170 - protein, 15 aa, Borrelia burgdorferi B31
TYGWIAFYIYADNKD

SEQ ID NO: 106171 - protein, 15 aa, Borrelia burgdorferi B31
YGWIAFYIYADNKDK

SEQ ID NO: 106172 - protein, 15 aa, Borrelia burgdorferi B31
GWIAFYIYADNKDKK

SEQ ID NO: 106173 - protein, 15 aa, Borrelia burgdorferi B31
WIAFYIYADNKDKKI

SEQ ID NO: 106174 - protein, 15 aa, Borrelia burgdorferi B31
IAFYIYADNKDKKIF

SEQ ID NO: 106175 - protein, 15 aa, Borrelia burgdorferi B31
AFYIYADNKDKKIFC

SEQ ID NO: 106176 - protein, 15 aa, Borrelia burgdorferi B31
FYIYADNKDKKIFCQ

SEQ ID NO: 106177 - protein, 15 aa, Borrelia burgdorferi B31
YIYADNKDKKIFCQR

SEQ ID NO: 106178 - protein, 15 aa, Borrelia burgdorferi B31
IYADNKDKKIFCQRM

SEQ ID NO: 106179 - protein, 15 aa, Borrelia burgdorferi B31
YADNKDKKIFCQRMK

SEQ ID NO: 106180 - protein, 15 aa, Borrelia burgdorferi B31
ADNKDKKIFCQRMKE

SEQ ID NO: 106181 - protein, 15 aa, Borrelia burgdorferi B31
DNKDKKIFCQRMKEF

SEQ ID NO: 106182 - protein, 15 aa, Borrelia burgdorferi B31
NKDKKIFCQRMKEFF

SEQ ID NO: 106183 - protein, 15 aa, Borrelia burgdorferi B31
KDKKIFCQRMKEFFK

SEQ ID NO: 106184 - protein, 15 aa, Borrelia burgdorferi B31
DKKIFCQRMKEFFKS

SEQ ID NO: 106185 - protein, 15 aa, Borrelia burgdorferi B31
KKIFCQRMKEFFKSK

SEQ ID NO: 106186 - protein, 15 aa, Borrelia burgdorferi B31
KIFCQRMKEFFKSKT

SEQ ID NO: 106187 - protein, 15 aa, Borrelia burgdorferi B31
IFCQRMKEFFKSKTF

SEQ ID NO: 106188 - protein, 15 aa, Borrelia burgdorferi B31
FCQRMKEFFKSKTFE

SEQ ID NO: 106189 - protein, 15 aa, Borrelia burgdorferi B31
CQRMKEFFKSKTFEI

SEQ ID NO: 106190 - protein, 15 aa, Borrelia burgdorferi B31
QRMKEFFKSKTFEIQ

SEQ ID NO: 106191 - protein, 15 aa, Borrelia burgdorferi B31
RMKEFFKSKTFEIQN

SEQ ID NO: 106192 - protein, 15 aa, Borrelia burgdorferi B31
MKEFFKSKTFEIQNQ

SEQ ID NO: 106193 - protein, 15 aa, Borrelia burgdorferi B31
KEFFKSKTFEIQNQI

SEQ ID NO: 106194 - protein, 15 aa, Borrelia burgdorferi B31
EFFKSKTFEIQNQIF

SEQ ID NO: 106195 - protein, 15 aa, Borrelia burgdorferi B31
FFKSKTFEIQNQIFV

SEQ ID NO: 106196 - protein, 15 aa, Borrelia burgdorferi B31
FKSKTFEIQNQIFVY

SEQ ID NO: 106197 - protein, 15 aa, Borrelia burgdorferi B31
KSKTFEIQNQIFVYF

SEQ ID NO: 106198 - protein, 15 aa, Borrelia burgdorferi B31
SKTFEIQNQIFVYFL

SEQ ID NO: 106199 - protein, 15 aa, Borrelia burgdorferi B31
KTFEIQNQIFVYFLS

SEQ ID NO: 106200 - protein, 15 aa, Borrelia burgdorferi B31
TFEIQNQIFVYFLSF

SEQ ID NO: 106201 - protein, 15 aa, Borrelia burgdorferi B31
FEIQNQIFVYFLSFY

SEQ ID NO: 106202 - protein, 15 aa, Borrelia burgdorferi B31
EIQNQIFVYFLSFYP

SEQ ID NO: 106203 - protein, 15 aa, Borrelia burgdorferi B31
IQNQIFVYFLSFYPN

SEQ ID NO: 106204 - protein, 15 aa, Borrelia burgdorferi B31
QNQIFVYFLSFYPNI

SEQ ID NO: 106205 - protein, 15 aa, Borrelia burgdorferi B31
NQIFVYFLSFYPNIE

SEQ ID NO: 106206 - protein, 15 aa, Borrelia burgdorferi B31
QIFVYFLSFYPNIEY

SEQ ID NO: 106207 - protein, 15 aa, Borrelia burgdorferi B31
IFVYFLSFYPNIEYK

SEQ ID NO: 106208 - protein, 15 aa, Borrelia burgdorferi B31
FVYFLSFYPNIEYKH

SEQ ID NO: 106209 - protein, 15 aa, Borrelia burgdorferi B31
VYFLSFYPNIEYKHF

SEQ ID NO: 106210 - protein, 15 aa, Borrelia burgdorferi B31
YFLSFYPNIEYKHFK

SEQ ID NO: 106211 - protein, 15 aa, Borrelia burgdorferi B31
FLSFYPNIEYKHFKF

SEQ ID NO: 106212 - protein, 15 aa, Borrelia burgdorferi B31
LSFYPNIEYKHFKFI

SEQ ID NO: 106213 - protein, 15 aa, Borrelia burgdorferi B31
SFYPNIEYKHFKFIS

SEQ ID NO: 106214 - protein, 15 aa, Borrelia burgdorferi B31
FYPNIEYKHFKFISD

SEQ ID NO: 106215 - protein, 15 aa, Borrelia burgdorferi B31
YPNIEYKHFKFISDI

SEQ ID NO: 106216 - protein, 15 aa, Borrelia burgdorferi B31
PNIEYKHFKFISDIL

SEQ ID NO: 106217 - protein, 15 aa, Borrelia burgdorferi B31
NIEYKHFKFISDILL

SEQ ID NO: 106218 - protein, 15 aa, Borrelia burgdorferi B31
IEYKHFKFISDILLY

SEQ ID NO: 106219 - protein, 15 aa, Borrelia burgdorferi B31
EYKHFKFISDILLYL

SEQ ID NO: 106220 - protein, 15 aa, Borrelia burgdorferi B31
YKHFKFISDILLYLD

SEQ ID NO: 106221 - protein, 15 aa, Borrelia burgdorferi B31
KHFKFISDILLYLDE

SEQ ID NO: 106222 - protein, 15 aa, Borrelia burgdorferi B31
HFKFISDILLYLDEN

SEQ ID NO: 106223 - protein, 15 aa, Borrelia burgdorferi B31
FKFISDILLYLDENK

SEQ ID NO: 106224 - protein, 15 aa, Borrelia burgdorferi B31
KFISDILLYLDENKI

SEQ ID NO: 106225 - protein, 15 aa, Borrelia burgdorferi B31
FISDILLYLDENKIT

SEQ ID NO: 106226 - protein, 15 aa, Borrelia burgdorferi B31
ISDILLYLDENKITI

SEQ ID NO: 106227 - protein, 15 aa, Borrelia burgdorferi B31
SDILLYLDENKITIP

SEQ ID NO: 106228 - protein, 15 aa, Borrelia burgdorferi B31
DILLYLDENKITIPK

SEQ ID NO: 106229 - protein, 15 aa, Borrelia burgdorferi B31
ILLYLDENKITIPKK

SEQ ID NO: 106230 - protein, 15 aa, Borrelia burgdorferi B31
LLYLDENKITIPKKI

SEQ ID NO: 106231 - protein, 15 aa, Borrelia burgdorferi B31
LYLDENKITIPKKII

SEQ ID NO: 106232 - protein, 15 aa, Borrelia burgdorferi B31
YLDENKITIPKKIIK

SEQ ID NO: 106233 - protein, 15 aa, Borrelia burgdorferi B31
LDENKITIPKKIIKI

SEQ ID NO: 106234 - protein, 15 aa, Borrelia burgdorferi B31
DENKITIPKKIIKIQ

SEQ ID NO: 106235 - protein, 15 aa, Borrelia burgdorferi B31
ENKITIPKKIIKIQK

SEQ ID NO: 106236 - protein, 15 aa, Borrelia burgdorferi B31
NKITIPKKIIKIQKI

SEQ ID NO: 106237 - protein, 15 aa, Borrelia burgdorferi B31
KITIPKKIIKIQKIN

SEQ ID NO: 106238 - protein, 15 aa, Borrelia burgdorferi B31
ITIPKKIIKIQKINP

SEQ ID NO: 106239 - protein, 15 aa, Borrelia burgdorferi B31
TIPKKIIKIQKINPN

SEQ ID NO: 106240 - protein, 15 aa, Borrelia burgdorferi B31
IPKKIIKIQKINPNQ

SEQ ID NO: 106241 - protein, 15 aa, Borrelia burgdorferi B31
PKKIIKIQKINPNQL

SEQ ID NO: 106242 - protein, 15 aa, Borrelia burgdorferi B31
KKIIKIQKINPNQLD

SEQ ID NO: 106243 - protein, 15 aa, Borrelia burgdorferi B31
KIIKIQKINPNQLDY

SEQ ID NO: 106244 - protein, 15 aa, Borrelia burgdorferi B31
IIKIQKINPNQLDYQ

SEQ ID NO: 106245 - protein, 15 aa, Borrelia burgdorferi B31
IKIQKINPNQLDYQK

SEQ ID NO: 106246 - protein, 15 aa, Borrelia burgdorferi B31
KIQKINPNQLDYQKS

SEQ ID NO: 106247 - protein, 15 aa, Borrelia burgdorferi B31
IQKINPNQLDYQKSY

SEQ ID NO: 106248 - protein, 15 aa, Borrelia burgdorferi B31
QKINPNQLDYQKSYL

SEQ ID NO: 106249 - protein, 15 aa, Borrelia burgdorferi B31
KINPNQLDYQKSYLL

SEQ ID NO: 106250 - protein, 15 aa, Borrelia burgdorferi B31
INPNQLDYQKSYLLI

SEQ ID NO: 106251 - protein, 15 aa, Borrelia burgdorferi B31
NPNQLDYQKSYLLIK

SEQ ID NO: 106252 - protein, 15 aa, Borrelia burgdorferi B31
PNQLDYQKSYLLIKS

SEQ ID NO: 106253 - protein, 15 aa, Borrelia burgdorferi B31
NQLDYQKSYLLIKSL

SEQ ID NO: 106254 - protein, 15 aa, Borrelia burgdorferi B31
QLDYQKSYLLIKSLK

SEQ ID NO: 106255 - protein, 15 aa, Borrelia burgdorferi B31
LDYQKSYLLIKSLKT

SEQ ID NO: 106256 - protein, 15 aa, Borrelia burgdorferi B31
DYQKSYLLIKSLKTR

SEQ ID NO: 106257 - protein, 15 aa, Borrelia burgdorferi B31
YQKSYLLIKSLKTRS

SEQ ID NO: 106258 - protein, 15 aa, Borrelia burgdorferi B31
QKSYLLIKSLKTRSR

SEQ ID NO: 106259 - protein, 15 aa, Borrelia burgdorferi B31
KSYLLIKSLKTRSRI

SEQ ID NO: 106260 - protein, 15 aa, Borrelia burgdorferi B31
SYLLIKSLKTRSRIL

SEQ ID NO: 106261 - protein, 15 aa, Borrelia burgdorferi B31
YLLIKSLKTRSRILK

SEQ ID NO: 106262 - protein, 15 aa, Borrelia burgdorferi B31
LLIKSLKTRSRILKI

SEQ ID NO: 106263 - protein, 15 aa, Borrelia burgdorferi B31
LIKSLKTRSRILKII

SEQ ID NO: 106264 - protein, 15 aa, Borrelia burgdorferi B31
IKSLKTRSRILKIII

SEQ ID NO: 106265 - protein, 15 aa, Borrelia burgdorferi B31
KSLKTRSRILKIIIK

SEQ ID NO: 106266 - protein, 15 aa, Borrelia burgdorferi B31
SLKTRSRILKIIIKN

SEQ ID NO: 106267 - protein, 15 aa, Borrelia burgdorferi B31
LKTRSRILKIIIKNI

SEQ ID NO: 106268 - protein, 15 aa, Borrelia burgdorferi B31
KTRSRILKIIIKNIR

SEQ ID NO: 106269 - protein, 15 aa, Borrelia burgdorferi B31
TRSRILKIIIKNIRF

SEQ ID NO: 106270 - protein, 15 aa, Borrelia burgdorferi B31
RSRILKIIIKNIRFN

SEQ ID NO: 106271 - protein, 15 aa, Borrelia burgdorferi B31
SRILKIIIKNIRFNL

SEQ ID NO: 106272 - protein, 15 aa, Borrelia burgdorferi B31
RILKIIIKNIRFNLI

SEQ ID NO: 106273 - protein, 15 aa, Borrelia burgdorferi B31
ILKIIIKNIRFNLIE

SEQ ID NO: 106274 - protein, 15 aa, Borrelia burgdorferi B31
LKIIIKNIRFNLIEK

SEQ ID NO: 106275 - protein, 15 aa, Borrelia burgdorferi B31
KIIIKNIRFNLIEKL

SEQ ID NO: 106276 - protein, 15 aa, Borrelia burgdorferi B31
IIIKNIRFNLIEKLE

SEQ ID NO: 106277 - protein, 15 aa, Borrelia burgdorferi B31
IIKNIRFNLIEKLED

SEQ ID NO: 106278 - protein, 15 aa, Borrelia burgdorferi B31
IKNIRFNLIEKLEDE

SEQ ID NO: 106279 - protein, 15 aa, Borrelia burgdorferi B31
KNIRFNLIEKLEDEN

SEQ ID NO: 106280 - protein, 15 aa, Borrelia burgdorferi B31
NIRFNLIEKLEDENE

SEQ ID NO: 106281 - protein, 15 aa, Borrelia burgdorferi B31
IRFNLIEKLEDENEK

SEQ ID NO: 106282 - protein, 15 aa, Borrelia burgdorferi B31
RFNLIEKLEDENEKK

SEQ ID NO: 106283 - protein, 15 aa, Borrelia burgdorferi B31
FNLIEKLEDENEKKL

SEQ ID NO: 106284 - protein, 15 aa, Borrelia burgdorferi B31
NLIEKLEDENEKKLL

SEQ ID NO: 106285 - protein, 15 aa, Borrelia burgdorferi B31
LIEKLEDENEKKLLP

SEQ ID NO: 106286 - protein, 15 aa, Borrelia burgdorferi B31
IEKLEDENEKKLLPA

SEQ ID NO: 106287 - protein, 15 aa, Borrelia burgdorferi B31
EKLEDENEKKLLPAM

SEQ ID NO: 106288 - protein, 15 aa, Borrelia burgdorferi B31
KLEDENEKKLLPAMC

SEQ ID NO: 106289 - protein, 15 aa, Borrelia burgdorferi B31
LEDENEKKLLPAMCY

SEQ ID NO: 106290 - protein, 15 aa, Borrelia burgdorferi B31
EDENEKKLLPAMCYL

SEQ ID NO: 106291 - protein, 15 aa, Borrelia burgdorferi B31
DENEKKLLPAMCYLI

SEQ ID NO: 106292 - protein, 15 aa, Borrelia burgdorferi B31
ENEKKLLPAMCYLIY

SEQ ID NO: 106293 - protein, 15 aa, Borrelia burgdorferi B31
NEKKLLPAMCYLIYC

SEQ ID NO: 106294 - protein, 15 aa, Borrelia burgdorferi B31
EKKLLPAMCYLIYCE

SEQ ID NO: 106295 - protein, 15 aa, Borrelia burgdorferi B31
KKLLPAMCYLIYCEN

SEQ ID NO: 106296 - protein, 15 aa, Borrelia burgdorferi B31
KLLPAMCYLIYCENL

SEQ ID NO: 106297 - protein, 15 aa, Borrelia burgdorferi B31
LLPAMCYLIYCENLV

SEQ ID NO: 106298 - protein, 15 aa, Borrelia burgdorferi B31
LPAMCYLIYCENLVE

SEQ ID NO: 106299 - protein, 15 aa, Borrelia burgdorferi B31
PAMCYLIYCENLVEL

SEQ ID NO: 106300 - protein, 15 aa, Borrelia burgdorferi B31
AMCYLIYCENLVELK

SEQ ID NO: 106301 - protein, 15 aa, Borrelia burgdorferi B31
MCYLIYCENLVELKN

SEQ ID NO: 106302 - protein, 15 aa, Borrelia burgdorferi B31
CYLIYCENLVELKNN

SEQ ID NO: 106303 - protein, 15 aa, Borrelia burgdorferi B31
YLIYCENLVELKNNR

SEQ ID NO: 106304 - protein, 15 aa, Borrelia burgdorferi B31
LIYCENLVELKNNRK

SEQ ID NO: 106305 - protein, 15 aa, Borrelia burgdorferi B31
IYCENLVELKNNRKI

SEQ ID NO: 106306 - protein, 15 aa, Borrelia burgdorferi B31
YCENLVELKNNRKIK

SEQ ID NO: 106307 - protein, 15 aa, Borrelia burgdorferi B31
CENLVELKNNRKIKS

SEQ ID NO: 106308 - protein, 15 aa, Borrelia burgdorferi B31
ENLVELKNNRKIKSN

SEQ ID NO: 106309 - protein, 15 aa, Borrelia burgdorferi B31
NLVELKNNRKIKSNE

SEQ ID NO: 106310 - protein, 15 aa, Borrelia burgdorferi B31
LVELKNNRKIKSNEK

SEQ ID NO: 106311 - protein, 15 aa, Borrelia burgdorferi B31
VELKNNRKIKSNEKN

SEQ ID NO: 106312 - protein, 15 aa, Borrelia burgdorferi B31
ELKNNRKIKSNEKNS

SEQ ID NO: 106313 - protein, 15 aa, Borrelia burgdorferi B31
LKNNRKIKSNEKNSL

SEQ ID NO: 106314 - protein, 15 aa, Borrelia burgdorferi B31
KNNRKIKSNEKNSLL

SEQ ID NO: 106315 - protein, 15 aa, Borrelia burgdorferi B31
NNRKIKSNEKNSLLE

SEQ ID NO: 106316 - protein, 15 aa, Borrelia burgdorferi B31
NRKIKSNEKNSLLEF

SEQ ID NO: 106317 - protein, 15 aa, Borrelia burgdorferi B31
RKIKSNEKNSLLEFI

SEQ ID NO: 106318 - protein, 15 aa, Borrelia burgdorferi B31
KIKSNEKNSLLEFIS

SEQ ID NO: 106319 - protein, 15 aa, Borrelia burgdorferi B31
IKSNEKNSLLEFISF

SEQ ID NO: 106320 - protein, 15 aa, Borrelia burgdorferi B31
KSNEKNSLLEFISFF

SEQ ID NO: 106321 - protein, 15 aa, Borrelia burgdorferi B31
SNEKNSLLEFISFFK

SEQ ID NO: 106322 - protein, 15 aa, Borrelia burgdorferi B31
NEKNSLLEFISFFKT

SEQ ID NO: 106323 - protein, 15 aa, Borrelia burgdorferi B31
EKNSLLEFISFFKTK

SEQ ID NO: 106324 - protein, 15 aa, Borrelia burgdorferi B31
KNSLLEFISFFKTKL

SEQ ID NO: 106325 - protein, 15 aa, Borrelia burgdorferi B31
NSLLEFISFFKTKLK

SEQ ID NO: 106326 - protein, 15 aa, Borrelia burgdorferi B31
SLLEFISFFKTKLKQ

SEQ ID NO: 106327 - protein, 15 aa, Borrelia burgdorferi B31
LLEFISFFKTKLKQK

SEQ ID NO: 106328 - protein, 15 aa, Borrelia burgdorferi B31
LEFISFFKTKLKQKI

SEQ ID NO: 106329 - protein, 15 aa, Borrelia burgdorferi B31
EFISFFKTKLKQKIN

SEQ ID NO: 106330 - protein, 15 aa, Borrelia burgdorferi B31
FISFFKTKLKQKINF

SEQ ID NO: 106331 - protein, 15 aa, Borrelia burgdorferi B31
ISFFKTKLKQKINFK

SEQ ID NO: 106332 - protein, 15 aa, Borrelia burgdorferi B31
SFFKTKLKQKINFKK

SEQ ID NO: 106333 - protein, 15 aa, Borrelia burgdorferi B31
FFKTKLKQKINFKKE

SEQ ID NO: 106334 - protein, 15 aa, Borrelia burgdorferi B31
FKTKLKQKINFKKEL

SEQ ID NO: 106335 - protein, 15 aa, Borrelia burgdorferi B31
KTKLKQKINFKKELM

SEQ ID NO: 106336 - protein, 15 aa, Borrelia burgdorferi B31
TKLKQKINFKKELMK

SEQ ID NO: 106337 - protein, 15 aa, Borrelia burgdorferi B31
KLKQKINFKKELMKS

SEQ ID NO: 106338 - protein, 15 aa, Borrelia burgdorferi B31
LKQKINFKKELMKSK

SEQ ID NO: 106339 - protein, 15 aa, Borrelia burgdorferi B31
KQKINFKKELMKSKG

SEQ ID NO: 106340 - protein, 15 aa, Borrelia burgdorferi B31
QKINFKKELMKSKGI

SEQ ID NO: 106341 - protein, 16 aa, Borrelia burgdorferi B31
MKTIKKDSEFYDSLAT

SEQ ID NO: 106342 - protein, 16 aa, Borrelia burgdorferi B31
KTIKKDSEFYDSLATL

SEQ ID NO: 106343 - protein, 16 aa, Borrelia burgdorferi B31
TIKKDSEFYDSLATLK

SEQ ID NO: 106344 - protein, 16 aa, Borrelia burgdorferi B31
IKKDSEFYDSLATLKK

SEQ ID NO: 106345 - protein, 16 aa, Borrelia burgdorferi B31
KKDSEFYDSLATLKKH

SEQ ID NO: 106346 - protein, 16 aa, Borrelia burgdorferi B31
KDSEFYDSLATLKKHI

SEQ ID NO: 106347 - protein, 16 aa, Borrelia burgdorferi B31
DSEFYDSLATLKKHIN

SEQ ID NO: 106348 - protein, 16 aa, Borrelia burgdorferi B31
SEFYDSLATLKKHINK

SEQ ID NO: 106349 - protein, 16 aa, Borrelia burgdorferi B31
EFYDSLATLKKHINKY

SEQ ID NO: 106350 - protein, 16 aa, Borrelia burgdorferi B31
FYDSLATLKKHINKYI

SEQ ID NO: 106351 - protein, 16 aa, Borrelia burgdorferi B31
YDSLATLKKHINKYIE

SEQ ID NO: 106352 - protein, 16 aa, Borrelia burgdorferi B31
DSLATLKKHINKYIEE

SEQ ID NO: 106353 - protein, 16 aa, Borrelia burgdorferi B31
SLATLKKHINKYIEEK

SEQ ID NO: 106354 - protein, 16 aa, Borrelia burgdorferi B31
LATLKKHINKYIEEKV

SEQ ID NO: 106355 - protein, 16 aa, Borrelia burgdorferi B31
ATLKKHINKYIEEKVL

SEQ ID NO: 106356 - protein, 16 aa, Borrelia burgdorferi B31
TLKKHINKYIEEKVLK

SEQ ID NO: 106357 - protein, 16 aa, Borrelia burgdorferi B31
LKKHINKYIEEKVLKY

SEQ ID NO: 106358 - protein, 16 aa, Borrelia burgdorferi B31
KKHINKYIEEKVLKYS

SEQ ID NO: 106359 - protein, 16 aa, Borrelia burgdorferi B31
KHINKYIEEKVLKYSI

SEQ ID NO: 106360 - protein, 16 aa, Borrelia burgdorferi B31
HINKYIEEKVLKYSIS

SEQ ID NO: 106361 - protein, 16 aa, Borrelia burgdorferi B31
INKYIEEKVLKYSISS

SEQ ID NO: 106362 - protein, 16 aa, Borrelia burgdorferi B31
NKYIEEKVLKYSISSQ

SEQ ID NO: 106363 - protein, 16 aa, Borrelia burgdorferi B31
KYIEEKVLKYSISSQL

SEQ ID NO: 106364 - protein, 16 aa, Borrelia burgdorferi B31
YIEEKVLKYSISSQLY

SEQ ID NO: 106365 - protein, 16 aa, Borrelia burgdorferi B31
IEEKVLKYSISSQLYK

SEQ ID NO: 106366 - protein, 16 aa, Borrelia burgdorferi B31
EEKVLKYSISSQLYKL

SEQ ID NO: 106367 - protein, 16 aa, Borrelia burgdorferi B31
EKVLKYSISSQLYKLE

SEQ ID NO: 106368 - protein, 16 aa, Borrelia burgdorferi B31
KVLKYSISSQLYKLEK

SEQ ID NO: 106369 - protein, 16 aa, Borrelia burgdorferi B31
VLKYSISSQLYKLEKP

SEQ ID NO: 106370 - protein, 16 aa, Borrelia burgdorferi B31
LKYSISSQLYKLEKPE

SEQ ID NO: 106371 - protein, 16 aa, Borrelia burgdorferi B31
KYSISSQLYKLEKPEI

SEQ ID NO: 106372 - protein, 16 aa, Borrelia burgdorferi B31
YSISSQLYKLEKPEII

SEQ ID NO: 106373 - protein, 16 aa, Borrelia burgdorferi B31
SISSQLYKLEKPEIIE

SEQ ID NO: 106374 - protein, 16 aa, Borrelia burgdorferi B31
ISSQLYKLEKPEIIEL

SEQ ID NO: 106375 - protein, 16 aa, Borrelia burgdorferi B31
SSQLYKLEKPEIIELI

SEQ ID NO: 106376 - protein, 16 aa, Borrelia burgdorferi B31
SQLYKLEKPEIIELIK

SEQ ID NO: 106377 - protein, 16 aa, Borrelia burgdorferi B31
QLYKLEKPEIIELIKI

SEQ ID NO: 106378 - protein, 16 aa, Borrelia burgdorferi B31
LYKLEKPEIIELIKIS

SEQ ID NO: 106379 - protein, 16 aa, Borrelia burgdorferi B31
YKLEKPEIIELIKISN

SEQ ID NO: 106380 - protein, 16 aa, Borrelia burgdorferi B31
KLEKPEIIELIKISND

SEQ ID NO: 106381 - protein, 16 aa, Borrelia burgdorferi B31
LEKPEIIELIKISNDY

SEQ ID NO: 106382 - protein, 16 aa, Borrelia burgdorferi B31
EKPEIIELIKISNDYE

SEQ ID NO: 106383 - protein, 16 aa, Borrelia burgdorferi B31
KPEIIELIKISNDYEK

SEQ ID NO: 106384 - protein, 16 aa, Borrelia burgdorferi B31
PEIIELIKISNDYEKE

SEQ ID NO: 106385 - protein, 16 aa, Borrelia burgdorferi B31
EIIELIKISNDYEKEK

SEQ ID NO: 106386 - protein, 16 aa, Borrelia burgdorferi B31
IIELIKISNDYEKEKN

SEQ ID NO: 106387 - protein, 16 aa, Borrelia burgdorferi B31
IELIKISNDYEKEKNA

SEQ ID NO: 106388 - protein, 16 aa, Borrelia burgdorferi B31
ELIKISNDYEKEKNAF

SEQ ID NO: 106389 - protein, 16 aa, Borrelia burgdorferi B31
LIKISNDYEKEKNAFN

SEQ ID NO: 106390 - protein, 16 aa, Borrelia burgdorferi B31
IKISNDYEKEKNAFNT

SEQ ID NO: 106391 - protein, 16 aa, Borrelia burgdorferi B31
KISNDYEKEKNAFNTS

SEQ ID NO: 106392 - protein, 16 aa, Borrelia burgdorferi B31
ISNDYEKEKNAFNTSL

SEQ ID NO: 106393 - protein, 16 aa, Borrelia burgdorferi B31
SNDYEKEKNAFNTSLE

SEQ ID NO: 106394 - protein, 16 aa, Borrelia burgdorferi B31
NDYEKEKNAFNTSLEE

SEQ ID NO: 106395 - protein, 16 aa, Borrelia burgdorferi B31
DYEKEKNAFNTSLEEC

SEQ ID NO: 106396 - protein, 16 aa, Borrelia burgdorferi B31
YEKEKNAFNTSLEECY

SEQ ID NO: 106397 - protein, 16 aa, Borrelia burgdorferi B31
EKEKNAFNTSLEECYY

SEQ ID NO: 106398 - protein, 16 aa, Borrelia burgdorferi B31
KEKNAFNTSLEECYYK

SEQ ID NO: 106399 - protein, 16 aa, Borrelia burgdorferi B31
EKNAFNTSLEECYYKN

SEQ ID NO: 106400 - protein, 16 aa, Borrelia burgdorferi B31
KNAFNTSLEECYYKNT

SEQ ID NO: 106401 - protein, 16 aa, Borrelia burgdorferi B31
NAFNTSLEECYYKNTQ

SEQ ID NO: 106402 - protein, 16 aa, Borrelia burgdorferi B31
AFNTSLEECYYKNTQN

SEQ ID NO: 106403 - protein, 16 aa, Borrelia burgdorferi B31
FNTSLEECYYKNTQNE

SEQ ID NO: 106404 - protein, 16 aa, Borrelia burgdorferi B31
NTSLEECYYKNTQNEA

SEQ ID NO: 106405 - protein, 16 aa, Borrelia burgdorferi B31
TSLEECYYKNTQNEAI

SEQ ID NO: 106406 - protein, 16 aa, Borrelia burgdorferi B31
SLEECYYKNTQNEAIK

SEQ ID NO: 106407 - protein, 16 aa, Borrelia burgdorferi B31
LEECYYKNTQNEAIKK

SEQ ID NO: 106408 - protein, 16 aa, Borrelia burgdorferi B31
EECYYKNTQNEAIKKW

SEQ ID NO: 106409 - protein, 16 aa, Borrelia burgdorferi B31
ECYYKNTQNEAIKKWI

SEQ ID NO: 106410 - protein, 16 aa, Borrelia burgdorferi B31
CYYKNTQNEAIKKWIL

SEQ ID NO: 106411 - protein, 16 aa, Borrelia burgdorferi B31
YYKNTQNEAIKKWILE

SEQ ID NO: 106412 - protein, 16 aa, Borrelia burgdorferi B31
YKNTQNEAIKKWILEI

SEQ ID NO: 106413 - protein, 16 aa, Borrelia burgdorferi B31
KNTQNEAIKKWILEIV

SEQ ID NO: 106414 - protein, 16 aa, Borrelia burgdorferi B31
NTQNEAIKKWILEIVR

SEQ ID NO: 106415 - protein, 16 aa, Borrelia burgdorferi B31
TQNEAIKKWILEIVRN

SEQ ID NO: 106416 - protein, 16 aa, Borrelia burgdorferi B31
QNEAIKKWILEIVRNK

SEQ ID NO: 106417 - protein, 16 aa, Borrelia burgdorferi B31
NEAIKKWILEIVRNKN

SEQ ID NO: 106418 - protein, 16 aa, Borrelia burgdorferi B31
EAIKKWILEIVRNKNF

SEQ ID NO: 106419 - protein, 16 aa, Borrelia burgdorferi B31
AIKKWILEIVRNKNFI

SEQ ID NO: 106420 - protein, 16 aa, Borrelia burgdorferi B31
IKKWILEIVRNKNFIQ

SEQ ID NO: 106421 - protein, 16 aa, Borrelia burgdorferi B31
KKWILEIVRNKNFIQI

SEQ ID NO: 106422 - protein, 16 aa, Borrelia burgdorferi B31
KWILEIVRNKNFIQIS

SEQ ID NO: 106423 - protein, 16 aa, Borrelia burgdorferi B31
WILEIVRNKNFIQISK

SEQ ID NO: 106424 - protein, 16 aa, Borrelia burgdorferi B31
ILEIVRNKNFIQISKE

SEQ ID NO: 106425 - protein, 16 aa, Borrelia burgdorferi B31
LEIVRNKNFIQISKEA

SEQ ID NO: 106426 - protein, 16 aa, Borrelia burgdorferi B31
EIVRNKNFIQISKEAN

SEQ ID NO: 106427 - protein, 16 aa, Borrelia burgdorferi B31
IVRNKNFIQISKEANL

SEQ ID NO: 106428 - protein, 16 aa, Borrelia burgdorferi B31
VRNKNFIQISKEANLN

SEQ ID NO: 106429 - protein, 16 aa, Borrelia burgdorferi B31
RNKNFIQISKEANLNT

SEQ ID NO: 106430 - protein, 16 aa, Borrelia burgdorferi B31
NKNFIQISKEANLNTK

SEQ ID NO: 106431 - protein, 16 aa, Borrelia burgdorferi B31
KNFIQISKEANLNTKK

SEQ ID NO: 106432 - protein, 16 aa, Borrelia burgdorferi B31
NFIQISKEANLNTKKL

SEQ ID NO: 106433 - protein, 16 aa, Borrelia burgdorferi B31
FIQISKEANLNTKKLG

SEQ ID NO: 106434 - protein, 16 aa, Borrelia burgdorferi B31
IQISKEANLNTKKLGT

SEQ ID NO: 106435 - protein, 16 aa, Borrelia burgdorferi B31
QISKEANLNTKKLGTT

SEQ ID NO: 106436 - protein, 16 aa, Borrelia burgdorferi B31
ISKEANLNTKKLGTTY

SEQ ID NO: 106437 - protein, 16 aa, Borrelia burgdorferi B31
SKEANLNTKKLGTTYK

SEQ ID NO: 106438 - protein, 16 aa, Borrelia burgdorferi B31
KEANLNTKKLGTTYKL

SEQ ID NO: 106439 - protein, 16 aa, Borrelia burgdorferi B31
EANLNTKKLGTTYKLK

SEQ ID NO: 106440 - protein, 16 aa, Borrelia burgdorferi B31
ANLNTKKLGTTYKLKS

SEQ ID NO: 106441 - protein, 16 aa, Borrelia burgdorferi B31
NLNTKKLGTTYKLKSS

SEQ ID NO: 106442 - protein, 16 aa, Borrelia burgdorferi B31
LNTKKLGTTYKLKSSN

SEQ ID NO: 106443 - protein, 16 aa, Borrelia burgdorferi B31
NTKKLGTTYKLKSSNF

SEQ ID NO: 106444 - protein, 16 aa, Borrelia burgdorferi B31
TKKLGTTYKLKSSNFL

SEQ ID NO: 106445 - protein, 16 aa, Borrelia burgdorferi B31
KKLGTTYKLKSSNFLK

SEQ ID NO: 106446 - protein, 16 aa, Borrelia burgdorferi B31
KLGTTYKLKSSNFLKL

SEQ ID NO: 106447 - protein, 16 aa, Borrelia burgdorferi B31
LGTTYKLKSSNFLKLI

SEQ ID NO: 106448 - protein, 16 aa, Borrelia burgdorferi B31
GTTYKLKSSNFLKLIE

SEQ ID NO: 106449 - protein, 16 aa, Borrelia burgdorferi B31
TTYKLKSSNFLKLIEI

SEQ ID NO: 106450 - protein, 16 aa, Borrelia burgdorferi B31
TYKLKSSNFLKLIEIQ

SEQ ID NO: 106451 - protein, 16 aa, Borrelia burgdorferi B31
YKLKSSNFLKLIEIQN

SEQ ID NO: 106452 - protein, 16 aa, Borrelia burgdorferi B31
KLKSSNFLKLIEIQNS

SEQ ID NO: 106453 - protein, 16 aa, Borrelia burgdorferi B31
LKSSNFLKLIEIQNSP

SEQ ID NO: 106454 - protein, 16 aa, Borrelia burgdorferi B31
KSSNFLKLIEIQNSPY

SEQ ID NO: 106455 - protein, 16 aa, Borrelia burgdorferi B31
SSNFLKLIEIQNSPYY

SEQ ID NO: 106456 - protein, 16 aa, Borrelia burgdorferi B31
SNFLKLIEIQNSPYYS

SEQ ID NO: 106457 - protein, 16 aa, Borrelia burgdorferi B31
NFLKLIEIQNSPYYSQ

SEQ ID NO: 106458 - protein, 16 aa, Borrelia burgdorferi B31
FLKLIEIQNSPYYSQE

SEQ ID NO: 106459 - protein, 16 aa, Borrelia burgdorferi B31
LKLIEIQNSPYYSQEK

SEQ ID NO: 106460 - protein, 16 aa, Borrelia burgdorferi B31
KLIEIQNSPYYSQEKK

SEQ ID NO: 106461 - protein, 16 aa, Borrelia burgdorferi B31
LIEIQNSPYYSQEKKD

SEQ ID NO: 106462 - protein, 16 aa, Borrelia burgdorferi B31
IEIQNSPYYSQEKKDI

SEQ ID NO: 106463 - protein, 16 aa, Borrelia burgdorferi B31
EIQNSPYYSQEKKDIY

SEQ ID NO: 106464 - protein, 16 aa, Borrelia burgdorferi B31
IQNSPYYSQEKKDIYK

SEQ ID NO: 106465 - protein, 16 aa, Borrelia burgdorferi B31
QNSPYYSQEKKDIYKQ

SEQ ID NO: 106466 - protein, 16 aa, Borrelia burgdorferi B31
NSPYYSQEKKDIYKQI

SEQ ID NO: 106467 - protein, 16 aa, Borrelia burgdorferi B31
SPYYSQEKKDIYKQII

SEQ ID NO: 106468 - protein, 16 aa, Borrelia burgdorferi B31
PYYSQEKKDIYKQIIL

SEQ ID NO: 106469 - protein, 16 aa, Borrelia burgdorferi B31
YYSQEKKDIYKQIILN

SEQ ID NO: 106470 - protein, 16 aa, Borrelia burgdorferi B31
YSQEKKDIYKQIILNF

SEQ ID NO: 106471 - protein, 16 aa, Borrelia burgdorferi B31
SQEKKDIYKQIILNFS

SEQ ID NO: 106472 - protein, 16 aa, Borrelia burgdorferi B31
QEKKDIYKQIILNFSS

SEQ ID NO: 106473 - protein, 16 aa, Borrelia burgdorferi B31
EKKDIYKQIILNFSSN

SEQ ID NO: 106474 - protein, 16 aa, Borrelia burgdorferi B31
KKDIYKQIILNFSSNI

SEQ ID NO: 106475 - protein, 16 aa, Borrelia burgdorferi B31
KDIYKQIILNFSSNIN

SEQ ID NO: 106476 - protein, 16 aa, Borrelia burgdorferi B31
DIYKQIILNFSSNINI

SEQ ID NO: 106477 - protein, 16 aa, Borrelia burgdorferi B31
IYKQIILNFSSNINID

SEQ ID NO: 106478 - protein, 16 aa, Borrelia burgdorferi B31
YKQIILNFSSNINIDS

SEQ ID NO: 106479 - protein, 16 aa, Borrelia burgdorferi B31
KQIILNFSSNINIDSL

SEQ ID NO: 106480 - protein, 16 aa, Borrelia burgdorferi B31
QIILNFSSNINIDSLE

SEQ ID NO: 106481 - protein, 16 aa, Borrelia burgdorferi B31
IILNFSSNINIDSLEQ

SEQ ID NO: 106482 - protein, 16 aa, Borrelia burgdorferi B31
ILNFSSNINIDSLEQT

SEQ ID NO: 106483 - protein, 16 aa, Borrelia burgdorferi B31
LNFSSNINIDSLEQTI

SEQ ID NO: 106484 - protein, 16 aa, Borrelia burgdorferi B31
NFSSNINIDSLEQTID

SEQ ID NO: 106485 - protein, 16 aa, Borrelia burgdorferi B31
FSSNINIDSLEQTIDI

SEQ ID NO: 106486 - protein, 16 aa, Borrelia burgdorferi B31
SSNINIDSLEQTIDIL

SEQ ID NO: 106487 - protein, 16 aa, Borrelia burgdorferi B31
SNINIDSLEQTIDILV

SEQ ID NO: 106488 - protein, 16 aa, Borrelia burgdorferi B31
NINIDSLEQTIDILVA

SEQ ID NO: 106489 - protein, 16 aa, Borrelia burgdorferi B31
INIDSLEQTIDILVAV

SEQ ID NO: 106490 - protein, 16 aa, Borrelia burgdorferi B31
NIDSLEQTIDILVAVR

SEQ ID NO: 106491 - protein, 16 aa, Borrelia burgdorferi B31
IDSLEQTIDILVAVRN

SEQ ID NO: 106492 - protein, 16 aa, Borrelia burgdorferi B31
DSLEQTIDILVAVRNR

SEQ ID NO: 106493 - protein, 16 aa, Borrelia burgdorferi B31
SLEQTIDILVAVRNRN

SEQ ID NO: 106494 - protein, 16 aa, Borrelia burgdorferi B31
LEQTIDILVAVRNRNK

SEQ ID NO: 106495 - protein, 16 aa, Borrelia burgdorferi B31
EQTIDILVAVRNRNKI

SEQ ID NO: 106496 - protein, 16 aa, Borrelia burgdorferi B31
QTIDILVAVRNRNKIK

SEQ ID NO: 106497 - protein, 16 aa, Borrelia burgdorferi B31
TIDILVAVRNRNKIKI

SEQ ID NO: 106498 - protein, 16 aa, Borrelia burgdorferi B31
IDILVAVRNRNKIKIL

SEQ ID NO: 106499 - protein, 16 aa, Borrelia burgdorferi B31
DILVAVRNRNKIKILN

SEQ ID NO: 106500 - protein, 16 aa, Borrelia burgdorferi B31
ILVAVRNRNKIKILNI

SEQ ID NO: 106501 - protein, 16 aa, Borrelia burgdorferi B31
LVAVRNRNKIKILNIL

SEQ ID NO: 106502 - protein, 16 aa, Borrelia burgdorferi B31
VAVRNRNKIKILNILN

SEQ ID NO: 106503 - protein, 16 aa, Borrelia burgdorferi B31
AVRNRNKIKILNILNK

SEQ ID NO: 106504 - protein, 16 aa, Borrelia burgdorferi B31
VRNRNKIKILNILNKN

SEQ ID NO: 106505 - protein, 16 aa, Borrelia burgdorferi B31
RNRNKIKILNILNKNL

SEQ ID NO: 106506 - protein, 16 aa, Borrelia burgdorferi B31
NRNKIKILNILNKNLK

SEQ ID NO: 106507 - protein, 16 aa, Borrelia burgdorferi B31
RNKIKILNILNKNLKY

SEQ ID NO: 106508 - protein, 16 aa, Borrelia burgdorferi B31
NKIKILNILNKNLKYR

SEQ ID NO: 106509 - protein, 16 aa, Borrelia burgdorferi B31
KIKILNILNKNLKYRP

SEQ ID NO: 106510 - protein, 16 aa, Borrelia burgdorferi B31
IKILNILNKNLKYRPE

SEQ ID NO: 106511 - protein, 16 aa, Borrelia burgdorferi B31
KILNILNKNLKYRPEN

SEQ ID NO: 106512 - protein, 16 aa, Borrelia burgdorferi B31
ILNILNKNLKYRPENQ

SEQ ID NO: 106513 - protein, 16 aa, Borrelia burgdorferi B31
LNILNKNLKYRPENQK

SEQ ID NO: 106514 - protein, 16 aa, Borrelia burgdorferi B31
NILNKNLKYRPENQKV

SEQ ID NO: 106515 - protein, 16 aa, Borrelia burgdorferi B31
ILNKNLKYRPENQKVF

SEQ ID NO: 106516 - protein, 16 aa, Borrelia burgdorferi B31
LNKNLKYRPENQKVFK

SEQ ID NO: 106517 - protein, 16 aa, Borrelia burgdorferi B31
NKNLKYRPENQKVFKS

SEQ ID NO: 106518 - protein, 16 aa, Borrelia burgdorferi B31
KNLKYRPENQKVFKSS

SEQ ID NO: 106519 - protein, 16 aa, Borrelia burgdorferi B31
NLKYRPENQKVFKSSL

SEQ ID NO: 106520 - protein, 16 aa, Borrelia burgdorferi B31
LKYRPENQKVFKSSLT

SEQ ID NO: 106521 - protein, 16 aa, Borrelia burgdorferi B31
KYRPENQKVFKSSLTN

SEQ ID NO: 106522 - protein, 16 aa, Borrelia burgdorferi B31
YRPENQKVFKSSLTNK

SEQ ID NO: 106523 - protein, 16 aa, Borrelia burgdorferi B31
RPENQKVFKSSLTNKE

SEQ ID NO: 106524 - protein, 16 aa, Borrelia burgdorferi B31
PENQKVFKSSLTNKES

SEQ ID NO: 106525 - protein, 16 aa, Borrelia burgdorferi B31
ENQKVFKSSLTNKESR

SEQ ID NO: 106526 - protein, 16 aa, Borrelia burgdorferi B31
NQKVFKSSLTNKESRL

SEQ ID NO: 106527 - protein, 16 aa, Borrelia burgdorferi B31
QKVFKSSLTNKESRLI

SEQ ID NO: 106528 - protein, 16 aa, Borrelia burgdorferi B31
KVFKSSLTNKESRLIK

SEQ ID NO: 106529 - protein, 16 aa, Borrelia burgdorferi B31
VFKSSLTNKESRLIKL

SEQ ID NO: 106530 - protein, 16 aa, Borrelia burgdorferi B31
FKSSLTNKESRLIKLK

SEQ ID NO: 106531 - protein, 16 aa, Borrelia burgdorferi B31
KSSLTNKESRLIKLKR

SEQ ID NO: 106532 - protein, 16 aa, Borrelia burgdorferi B31
SSLTNKESRLIKLKRM

SEQ ID NO: 106533 - protein, 16 aa, Borrelia burgdorferi B31
SLTNKESRLIKLKRML

SEQ ID NO: 106534 - protein, 16 aa, Borrelia burgdorferi B31
LTNKESRLIKLKRMLI

SEQ ID NO: 106535 - protein, 16 aa, Borrelia burgdorferi B31
TNKESRLIKLKRMLIL

SEQ ID NO: 106536 - protein, 16 aa, Borrelia burgdorferi B31
NKESRLIKLKRMLILT

SEQ ID NO: 106537 - protein, 16 aa, Borrelia burgdorferi B31
KESRLIKLKRMLILTY

SEQ ID NO: 106538 - protein, 16 aa, Borrelia burgdorferi B31
ESRLIKLKRMLILTYW

SEQ ID NO: 106539 - protein, 16 aa, Borrelia burgdorferi B31
SRLIKLKRMLILTYWP

SEQ ID NO: 106540 - protein, 16 aa, Borrelia burgdorferi B31
RLIKLKRMLILTYWPV

SEQ ID NO: 106541 - protein, 16 aa, Borrelia burgdorferi B31
LIKLKRMLILTYWPVG

SEQ ID NO: 106542 - protein, 16 aa, Borrelia burgdorferi B31
IKLKRMLILTYWPVGC

SEQ ID NO: 106543 - protein, 16 aa, Borrelia burgdorferi B31
KLKRMLILTYWPVGCL

SEQ ID NO: 106544 - protein, 16 aa, Borrelia burgdorferi B31
LKRMLILTYWPVGCLS

SEQ ID NO: 106545 - protein, 16 aa, Borrelia burgdorferi B31
KRMLILTYWPVGCLSK

SEQ ID NO: 106546 - protein, 16 aa, Borrelia burgdorferi B31
RMLILTYWPVGCLSKN

SEQ ID NO: 106547 - protein, 16 aa, Borrelia burgdorferi B31
MLILTYWPVGCLSKNI

SEQ ID NO: 106548 - protein, 16 aa, Borrelia burgdorferi B31
LILTYWPVGCLSKNIF

SEQ ID NO: 106549 - protein, 16 aa, Borrelia burgdorferi B31
ILTYWPVGCLSKNIFI

SEQ ID NO: 106550 - protein, 16 aa, Borrelia burgdorferi B31
LTYWPVGCLSKNIFIK

SEQ ID NO: 106551 - protein, 16 aa, Borrelia burgdorferi B31
TYWPVGCLSKNIFIKI

SEQ ID NO: 106552 - protein, 16 aa, Borrelia burgdorferi B31
YWPVGCLSKNIFIKIL

SEQ ID NO: 106553 - protein, 16 aa, Borrelia burgdorferi B31
WPVGCLSKNIFIKILI

SEQ ID NO: 106554 - protein, 16 aa, Borrelia burgdorferi B31
PVGCLSKNIFIKILIK

SEQ ID NO: 106555 - protein, 16 aa, Borrelia burgdorferi B31
  Xaa can be any naturally occurring amino acid
  VARIANT 16: Xaa = Any Amino Acid
VGCLSKNIFIKILIKX

SEQ ID NO: 106556 - protein, 16 aa, Borrelia burgdorferi B31
  Xaa can be any naturally occurring amino acid
  VARIANT 15: Xaa = Any Amino Acid
GCLSKNIFIKILIKXY

SEQ ID NO: 106557 - protein, 16 aa, Borrelia burgdorferi B31
  Xaa can be any naturally occurring amino acid
  VARIANT 14: Xaa = Any Amino Acid
CLSKNIFIKILIKXYK

SEQ ID NO: 106558 - protein, 16 aa, Borrelia burgdorferi B31
  Xaa can be any naturally occurring amino acid
  VARIANT 13: Xaa = Any Amino Acid
LSKNIFIKILIKXYKY

SEQ ID NO: 106559 - protein, 16 aa, Borrelia burgdorferi B31
  Xaa can be any naturally occurring amino acid
  VARIANT 12: Xaa = Any Amino Acid
SKNIFIKILIKXYKYL

SEQ ID NO: 106560 - protein, 16 aa, Borrelia burgdorferi B31
  Xaa can be any naturally occurring amino acid
  VARIANT 11: Xaa = Any Amino Acid
KNIFIKILIKXYKYLE

SEQ ID NO: 106561 - protein, 16 aa, Borrelia burgdorferi B31
  Xaa can be any naturally occurring amino acid
  VARIANT 10: Xaa = Any Amino Acid
NIFIKILIKXYKYLEE

SEQ ID NO: 106562 - protein, 16 aa, Borrelia burgdorferi B31
  Xaa can be any naturally occurring amino acid
  VARIANT 9: Xaa = Any Amino Acid
IFIKILIKXYKYLEEE

SEQ ID NO: 106563 - protein, 16 aa, Borrelia burgdorferi B31
  Xaa can be any naturally occurring amino acid
  VARIANT 8: Xaa = Any Amino Acid
FIKILIKXYKYLEEEI

SEQ ID NO: 106564 - protein, 16 aa, Borrelia burgdorferi B31
  Xaa can be any naturally occurring amino acid
  VARIANT 7: Xaa = Any Amino Acid
IKILIKXYKYLEEEIL

SEQ ID NO: 106565 - protein, 16 aa, Borrelia burgdorferi B31
  Xaa can be any naturally occurring amino acid
  VARIANT 6: Xaa = Any Amino Acid
KILIKXYKYLEEEILA

SEQ ID NO: 106566 - protein, 16 aa, Borrelia burgdorferi B31
  Xaa can be any naturally occurring amino acid
  VARIANT 5: Xaa = Any Amino Acid
ILIKXYKYLEEEILAL

SEQ ID NO: 106567 - protein, 16 aa, Borrelia burgdorferi B31
  Xaa can be any naturally occurring amino acid
  VARIANT 4: Xaa = Any Amino Acid
LIKXYKYLEEEILALK

SEQ ID NO: 106568 - protein, 16 aa, Borrelia burgdorferi B31
  Xaa can be any naturally occurring amino acid
  VARIANT 3: Xaa = Any Amino Acid
IKXYKYLEEEILALKY

SEQ ID NO: 106569 - protein, 16 aa, Borrelia burgdorferi B31
  Xaa can be any naturally occurring amino acid
  VARIANT 2: Xaa = Any Amino Acid
KXYKYLEEEILALKYN

SEQ ID NO: 106570 - protein, 16 aa, Borrelia burgdorferi B31
  Xaa can be any naturally occurring amino acid
  VARIANT 1: Xaa = Any Amino Acid
XYKYLEEEILALKYNE

SEQ ID NO: 106571 - protein, 16 aa, Borrelia burgdorferi B31
YKYLEEEILALKYNEI

SEQ ID NO: 106572 - protein, 16 aa, Borrelia burgdorferi B31
KYLEEEILALKYNEIL

SEQ ID NO: 106573 - protein, 16 aa, Borrelia burgdorferi B31
YLEEEILALKYNEILN

SEQ ID NO: 106574 - protein, 16 aa, Borrelia burgdorferi B31
LEEEILALKYNEILNY

SEQ ID NO: 106575 - protein, 16 aa, Borrelia burgdorferi B31
EEEILALKYNEILNYL

SEQ ID NO: 106576 - protein, 16 aa, Borrelia burgdorferi B31
EEILALKYNEILNYLR

SEQ ID NO: 106577 - protein, 16 aa, Borrelia burgdorferi B31
EILALKYNEILNYLRA

SEQ ID NO: 106578 - protein, 16 aa, Borrelia burgdorferi B31
ILALKYNEILNYLRAL

SEQ ID NO: 106579 - protein, 16 aa, Borrelia burgdorferi B31
LALKYNEILNYLRALK

SEQ ID NO: 106580 - protein, 16 aa, Borrelia burgdorferi B31
ALKYNEILNYLRALKT

SEQ ID NO: 106581 - protein, 16 aa, Borrelia burgdorferi B31
LKYNEILNYLRALKTL

SEQ ID NO: 106582 - protein, 16 aa, Borrelia burgdorferi B31
KYNEILNYLRALKTLS

SEQ ID NO: 106583 - protein, 16 aa, Borrelia burgdorferi B31
YNEILNYLRALKTLSL

SEQ ID NO: 106584 - protein, 16 aa, Borrelia burgdorferi B31
NEILNYLRALKTLSLN

SEQ ID NO: 106585 - protein, 16 aa, Borrelia burgdorferi B31
EILNYLRALKTLSLNE

SEQ ID NO: 106586 - protein, 16 aa, Borrelia burgdorferi B31
ILNYLRALKTLSLNEI

SEQ ID NO: 106587 - protein, 16 aa, Borrelia burgdorferi B31
LNYLRALKTLSLNEIF

SEQ ID NO: 106588 - protein, 16 aa, Borrelia burgdorferi B31
NYLRALKTLSLNEIFY

SEQ ID NO: 106589 - protein, 16 aa, Borrelia burgdorferi B31
YLRALKTLSLNEIFYK

SEQ ID NO: 106590 - protein, 16 aa, Borrelia burgdorferi B31
LRALKTLSLNEIFYKG

SEQ ID NO: 106591 - protein, 16 aa, Borrelia burgdorferi B31
RALKTLSLNEIFYKGS

SEQ ID NO: 106592 - protein, 16 aa, Borrelia burgdorferi B31
ALKTLSLNEIFYKGSS

SEQ ID NO: 106593 - protein, 16 aa, Borrelia burgdorferi B31
LKTLSLNEIFYKGSSK

SEQ ID NO: 106594 - protein, 16 aa, Borrelia burgdorferi B31
KTLSLNEIFYKGSSKN

SEQ ID NO: 106595 - protein, 16 aa, Borrelia burgdorferi B31
TLSLNEIFYKGSSKNI

SEQ ID NO: 106596 - protein, 16 aa, Borrelia burgdorferi B31
LSLNEIFYKGSSKNIS

SEQ ID NO: 106597 - protein, 16 aa, Borrelia burgdorferi B31
SLNEIFYKGSSKNISF

SEQ ID NO: 106598 - protein, 16 aa, Borrelia burgdorferi B31
LNEIFYKGSSKNISFN

SEQ ID NO: 106599 - protein, 16 aa, Borrelia burgdorferi B31
NEIFYKGSSKNISFNY

SEQ ID NO: 106600 - protein, 16 aa, Borrelia burgdorferi B31
EIFYKGSSKNISFNYF

SEQ ID NO: 106601 - protein, 16 aa, Borrelia burgdorferi B31
IFYKGSSKNISFNYFF

SEQ ID NO: 106602 - protein, 16 aa, Borrelia burgdorferi B31
FYKGSSKNISFNYFFS

SEQ ID NO: 106603 - protein, 16 aa, Borrelia burgdorferi B31
YKGSSKNISFNYFFSD

SEQ ID NO: 106604 - protein, 16 aa, Borrelia burgdorferi B31
KGSSKNISFNYFFSDF

SEQ ID NO: 106605 - protein, 16 aa, Borrelia burgdorferi B31
GSSKNISFNYFFSDFT

SEQ ID NO: 106606 - protein, 16 aa, Borrelia burgdorferi B31
SSKNISFNYFFSDFTQ

SEQ ID NO: 106607 - protein, 16 aa, Borrelia burgdorferi B31
SKNISFNYFFSDFTQY

SEQ ID NO: 106608 - protein, 16 aa, Borrelia burgdorferi B31
KNISFNYFFSDFTQYA

SEQ ID NO: 106609 - protein, 16 aa, Borrelia burgdorferi B31
NISFNYFFSDFTQYAP

SEQ ID NO: 106610 - protein, 16 aa, Borrelia burgdorferi B31
ISFNYFFSDFTQYAPK

SEQ ID NO: 106611 - protein, 16 aa, Borrelia burgdorferi B31
SFNYFFSDFTQYAPKD

SEQ ID NO: 106612 - protein, 16 aa, Borrelia burgdorferi B31
FNYFFSDFTQYAPKDF

SEQ ID NO: 106613 - protein, 16 aa, Borrelia burgdorferi B31
NYFFSDFTQYAPKDFQ

SEQ ID NO: 106614 - protein, 16 aa, Borrelia burgdorferi B31
YFFSDFTQYAPKDFQD

SEQ ID NO: 106615 - protein, 16 aa, Borrelia burgdorferi B31
FFSDFTQYAPKDFQDT

SEQ ID NO: 106616 - protein, 16 aa, Borrelia burgdorferi B31
FSDFTQYAPKDFQDTL

SEQ ID NO: 106617 - protein, 16 aa, Borrelia burgdorferi B31
SDFTQYAPKDFQDTLK

SEQ ID NO: 106618 - protein, 16 aa, Borrelia burgdorferi B31
DFTQYAPKDFQDTLKC

SEQ ID NO: 106619 - protein, 16 aa, Borrelia burgdorferi B31
FTQYAPKDFQDTLKCY

SEQ ID NO: 106620 - protein, 16 aa, Borrelia burgdorferi B31
TQYAPKDFQDTLKCYL

SEQ ID NO: 106621 - protein, 16 aa, Borrelia burgdorferi B31
QYAPKDFQDTLKCYLY

SEQ ID NO: 106622 - protein, 16 aa, Borrelia burgdorferi B31
YAPKDFQDTLKCYLYV

SEQ ID NO: 106623 - protein, 16 aa, Borrelia burgdorferi B31
APKDFQDTLKCYLYVI

SEQ ID NO: 106624 - protein, 16 aa, Borrelia burgdorferi B31
PKDFQDTLKCYLYVIE

SEQ ID NO: 106625 - protein, 16 aa, Borrelia burgdorferi B31
KDFQDTLKCYLYVIEK

SEQ ID NO: 106626 - protein, 16 aa, Borrelia burgdorferi B31
DFQDTLKCYLYVIEKT

SEQ ID NO: 106627 - protein, 16 aa, Borrelia burgdorferi B31
FQDTLKCYLYVIEKTI

SEQ ID NO: 106628 - protein, 16 aa, Borrelia burgdorferi B31
QDTLKCYLYVIEKTIT

SEQ ID NO: 106629 - protein, 16 aa, Borrelia burgdorferi B31
DTLKCYLYVIEKTITK

SEQ ID NO: 106630 - protein, 16 aa, Borrelia burgdorferi B31
TLKCYLYVIEKTITKK

SEQ ID NO: 106631 - protein, 16 aa, Borrelia burgdorferi B31
LKCYLYVIEKTITKKY

SEQ ID NO: 106632 - protein, 16 aa, Borrelia burgdorferi B31
KCYLYVIEKTITKKYL

SEQ ID NO: 106633 - protein, 16 aa, Borrelia burgdorferi B31
CYLYVIEKTITKKYLT

SEQ ID NO: 106634 - protein, 16 aa, Borrelia burgdorferi B31
YLYVIEKTITKKYLTW

SEQ ID NO: 106635 - protein, 16 aa, Borrelia burgdorferi B31
LYVIEKTITKKYLTWF

SEQ ID NO: 106636 - protein, 16 aa, Borrelia burgdorferi B31
YVIEKTITKKYLTWFF

SEQ ID NO: 106637 - protein, 16 aa, Borrelia burgdorferi B31
VIEKTITKKYLTWFFK

SEQ ID NO: 106638 - protein, 16 aa, Borrelia burgdorferi B31
IEKTITKKYLTWFFKD

SEQ ID NO: 106639 - protein, 16 aa, Borrelia burgdorferi B31
EKTITKKYLTWFFKDK

SEQ ID NO: 106640 - protein, 16 aa, Borrelia burgdorferi B31
KTITKKYLTWFFKDKI

SEQ ID NO: 106641 - protein, 16 aa, Borrelia burgdorferi B31
TITKKYLTWFFKDKIS

SEQ ID NO: 106642 - protein, 16 aa, Borrelia burgdorferi B31
ITKKYLTWFFKDKISN

SEQ ID NO: 106643 - protein, 16 aa, Borrelia burgdorferi B31
TKKYLTWFFKDKISNN

SEQ ID NO: 106644 - protein, 16 aa, Borrelia burgdorferi B31
KKYLTWFFKDKISNNW

SEQ ID NO: 106645 - protein, 16 aa, Borrelia burgdorferi B31
KYLTWFFKDKISNNWE

SEQ ID NO: 106646 - protein, 16 aa, Borrelia burgdorferi B31
YLTWFFKDKISNNWES

SEQ ID NO: 106647 - protein, 16 aa, Borrelia burgdorferi B31
LTWFFKDKISNNWESF

SEQ ID NO: 106648 - protein, 16 aa, Borrelia burgdorferi B31
TWFFKDKISNNWESFI

SEQ ID NO: 106649 - protein, 16 aa, Borrelia burgdorferi B31
WFFKDKISNNWESFID

SEQ ID NO: 106650 - protein, 16 aa, Borrelia burgdorferi B31
FFKDKISNNWESFIDA

SEQ ID NO: 106651 - protein, 16 aa, Borrelia burgdorferi B31
FKDKISNNWESFIDAL

SEQ ID NO: 106652 - protein, 16 aa, Borrelia burgdorferi B31
KDKISNNWESFIDALE

SEQ ID NO: 106653 - protein, 16 aa, Borrelia burgdorferi B31
DKISNNWESFIDALEY

SEQ ID NO: 106654 - protein, 16 aa, Borrelia burgdorferi B31
KISNNWESFIDALEYI

SEQ ID NO: 106655 - protein, 16 aa, Borrelia burgdorferi B31
ISNNWESFIDALEYIE

SEQ ID NO: 106656 - protein, 16 aa, Borrelia burgdorferi B31
SNNWESFIDALEYIEK

SEQ ID NO: 106657 - protein, 16 aa, Borrelia burgdorferi B31
NNWESFIDALEYIEKH

SEQ ID NO: 106658 - protein, 16 aa, Borrelia burgdorferi B31
NWESFIDALEYIEKHK

SEQ ID NO: 106659 - protein, 16 aa, Borrelia burgdorferi B31
WESFIDALEYIEKHKL

SEQ ID NO: 106660 - protein, 16 aa, Borrelia burgdorferi B31
ESFIDALEYIEKHKLI

SEQ ID NO: 106661 - protein, 16 aa, Borrelia burgdorferi B31
SFIDALEYIEKHKLIN

SEQ ID NO: 106662 - protein, 16 aa, Borrelia burgdorferi B31
FIDALEYIEKHKLINI

SEQ ID NO: 106663 - protein, 16 aa, Borrelia burgdorferi B31
IDALEYIEKHKLINIK

SEQ ID NO: 106664 - protein, 16 aa, Borrelia burgdorferi B31
DALEYIEKHKLINIKE

SEQ ID NO: 106665 - protein, 16 aa, Borrelia burgdorferi B31
ALEYIEKHKLINIKEK

SEQ ID NO: 106666 - protein, 16 aa, Borrelia burgdorferi B31
LEYIEKHKLINIKEKI

SEQ ID NO: 106667 - protein, 16 aa, Borrelia burgdorferi B31
EYIEKHKLINIKEKIK

SEQ ID NO: 106668 - protein, 16 aa, Borrelia burgdorferi B31
YIEKHKLINIKEKIKE

SEQ ID NO: 106669 - protein, 16 aa, Borrelia burgdorferi B31
IEKHKLINIKEKIKEI

SEQ ID NO: 106670 - protein, 16 aa, Borrelia burgdorferi B31
EKHKLINIKEKIKEII

SEQ ID NO: 106671 - protein, 16 aa, Borrelia burgdorferi B31
KHKLINIKEKIKEIIT

SEQ ID NO: 106672 - protein, 16 aa, Borrelia burgdorferi B31
HKLINIKEKIKEIITA

SEQ ID NO: 106673 - protein, 16 aa, Borrelia burgdorferi B31
KLINIKEKIKEIITAK

SEQ ID NO: 106674 - protein, 16 aa, Borrelia burgdorferi B31
LINIKEKIKEIITAKF

SEQ ID NO: 106675 - protein, 16 aa, Borrelia burgdorferi B31
INIKEKIKEIITAKFQ

SEQ ID NO: 106676 - protein, 16 aa, Borrelia burgdorferi B31
NIKEKIKEIITAKFQT

SEQ ID NO: 106677 - protein, 16 aa, Borrelia burgdorferi B31
IKEKIKEIITAKFQTE

SEQ ID NO: 106678 - protein, 16 aa, Borrelia burgdorferi B31
KEKIKEIITAKFQTED

SEQ ID NO: 106679 - protein, 16 aa, Borrelia burgdorferi B31
EKIKEIITAKFQTEDF

SEQ ID NO: 106680 - protein, 16 aa, Borrelia burgdorferi B31
KIKEIITAKFQTEDFF

SEQ ID NO: 106681 - protein, 16 aa, Borrelia burgdorferi B31
IKEIITAKFQTEDFFI

SEQ ID NO: 106682 - protein, 16 aa, Borrelia burgdorferi B31
KEIITAKFQTEDFFIS

SEQ ID NO: 106683 - protein, 16 aa, Borrelia burgdorferi B31
EIITAKFQTEDFFISF

SEQ ID NO: 106684 - protein, 16 aa, Borrelia burgdorferi B31
IITAKFQTEDFFISFD

SEQ ID NO: 106685 - protein, 16 aa, Borrelia burgdorferi B31
ITAKFQTEDFFISFDK

SEQ ID NO: 106686 - protein, 16 aa, Borrelia burgdorferi B31
TAKFQTEDFFISFDKT

SEQ ID NO: 106687 - protein, 16 aa, Borrelia burgdorferi B31
AKFQTEDFFISFDKTN

SEQ ID NO: 106688 - protein, 16 aa, Borrelia burgdorferi B31
KFQTEDFFISFDKTNF

SEQ ID NO: 106689 - protein, 16 aa, Borrelia burgdorferi B31
FQTEDFFISFDKTNFN

SEQ ID NO: 106690 - protein, 16 aa, Borrelia burgdorferi B31
QTEDFFISFDKTNFNP

SEQ ID NO: 106691 - protein, 16 aa, Borrelia burgdorferi B31
TEDFFISFDKTNFNPY

SEQ ID NO: 106692 - protein, 16 aa, Borrelia burgdorferi B31
EDFFISFDKTNFNPYE

SEQ ID NO: 106693 - protein, 16 aa, Borrelia burgdorferi B31
DFFISFDKTNFNPYES

SEQ ID NO: 106694 - protein, 16 aa, Borrelia burgdorferi B31
FFISFDKTNFNPYESS

SEQ ID NO: 106695 - protein, 16 aa, Borrelia burgdorferi B31
FISFDKTNFNPYESSI

SEQ ID NO: 106696 - protein, 16 aa, Borrelia burgdorferi B31
ISFDKTNFNPYESSIF

SEQ ID NO: 106697 - protein, 16 aa, Borrelia burgdorferi B31
SFDKTNFNPYESSIFK

SEQ ID NO: 106698 - protein, 16 aa, Borrelia burgdorferi B31
FDKTNFNPYESSIFKE

SEQ ID NO: 106699 - protein, 16 aa, Borrelia burgdorferi B31
DKTNFNPYESSIFKER

SEQ ID NO: 106700 - protein, 16 aa, Borrelia burgdorferi B31
KTNFNPYESSIFKERY

SEQ ID NO: 106701 - protein, 16 aa, Borrelia burgdorferi B31
TNFNPYESSIFKERYI

SEQ ID NO: 106702 - protein, 16 aa, Borrelia burgdorferi B31
NFNPYESSIFKERYIK

SEQ ID NO: 106703 - protein, 16 aa, Borrelia burgdorferi B31
FNPYESSIFKERYIKS

SEQ ID NO: 106704 - protein, 16 aa, Borrelia burgdorferi B31
NPYESSIFKERYIKSA

SEQ ID NO: 106705 - protein, 16 aa, Borrelia burgdorferi B31
PYESSIFKERYIKSAF

SEQ ID NO: 106706 - protein, 16 aa, Borrelia burgdorferi B31
YESSIFKERYIKSAFL

SEQ ID NO: 106707 - protein, 16 aa, Borrelia burgdorferi B31
ESSIFKERYIKSAFLE

SEQ ID NO: 106708 - protein, 16 aa, Borrelia burgdorferi B31
SSIFKERYIKSAFLEI

SEQ ID NO: 106709 - protein, 16 aa, Borrelia burgdorferi B31
SIFKERYIKSAFLEII

SEQ ID NO: 106710 - protein, 16 aa, Borrelia burgdorferi B31
IFKERYIKSAFLEIIM

SEQ ID NO: 106711 - protein, 16 aa, Borrelia burgdorferi B31
FKERYIKSAFLEIIMH

SEQ ID NO: 106712 - protein, 16 aa, Borrelia burgdorferi B31
KERYIKSAFLEIIMHY

SEQ ID NO: 106713 - protein, 16 aa, Borrelia burgdorferi B31
ERYIKSAFLEIIMHYV

SEQ ID NO: 106714 - protein, 16 aa, Borrelia burgdorferi B31
RYIKSAFLEIIMHYVK

SEQ ID NO: 106715 - protein, 16 aa, Borrelia burgdorferi B31
YIKSAFLEIIMHYVKK

SEQ ID NO: 106716 - protein, 16 aa, Borrelia burgdorferi B31
IKSAFLEIIMHYVKKN

SEQ ID NO: 106717 - protein, 16 aa, Borrelia burgdorferi B31
KSAFLEIIMHYVKKNS

SEQ ID NO: 106718 - protein, 16 aa, Borrelia burgdorferi B31
SAFLEIIMHYVKKNSQ

SEQ ID NO: 106719 - protein, 16 aa, Borrelia burgdorferi B31
AFLEIIMHYVKKNSQN

SEQ ID NO: 106720 - protein, 16 aa, Borrelia burgdorferi B31
FLEIIMHYVKKNSQNI

SEQ ID NO: 106721 - protein, 16 aa, Borrelia burgdorferi B31
LEIIMHYVKKNSQNIE

SEQ ID NO: 106722 - protein, 16 aa, Borrelia burgdorferi B31
EIIMHYVKKNSQNIET

SEQ ID NO: 106723 - protein, 16 aa, Borrelia burgdorferi B31
IIMHYVKKNSQNIETY

SEQ ID NO: 106724 - protein, 16 aa, Borrelia burgdorferi B31
IMHYVKKNSQNIETYG

SEQ ID NO: 106725 - protein, 16 aa, Borrelia burgdorferi B31
MHYVKKNSQNIETYGW

SEQ ID NO: 106726 - protein, 16 aa, Borrelia burgdorferi B31
HYVKKNSQNIETYGWI

SEQ ID NO: 106727 - protein, 16 aa, Borrelia burgdorferi B31
YVKKNSQNIETYGWIA

SEQ ID NO: 106728 - protein, 16 aa, Borrelia burgdorferi B31
VKKNSQNIETYGWIAF

SEQ ID NO: 106729 - protein, 16 aa, Borrelia burgdorferi B31
KKNSQNIETYGWIAFY

SEQ ID NO: 106730 - protein, 16 aa, Borrelia burgdorferi B31
KNSQNIETYGWIAFYI

SEQ ID NO: 106731 - protein, 16 aa, Borrelia burgdorferi B31
NSQNIETYGWIAFYIY

SEQ ID NO: 106732 - protein, 16 aa, Borrelia burgdorferi B31
SQNIETYGWIAFYIYA

SEQ ID NO: 106733 - protein, 16 aa, Borrelia burgdorferi B31
QNIETYGWIAFYIYAD

SEQ ID NO: 106734 - protein, 16 aa, Borrelia burgdorferi B31
NIETYGWIAFYIYADN

SEQ ID NO: 106735 - protein, 16 aa, Borrelia burgdorferi B31
IETYGWIAFYIYADNK

SEQ ID NO: 106736 - protein, 16 aa, Borrelia burgdorferi B31
ETYGWIAFYIYADNKD

SEQ ID NO: 106737 - protein, 16 aa, Borrelia burgdorferi B31
TYGWIAFYIYADNKDK

SEQ ID NO: 106738 - protein, 16 aa, Borrelia burgdorferi B31
YGWIAFYIYADNKDKK

SEQ ID NO: 106739 - protein, 16 aa, Borrelia burgdorferi B31
GWIAFYIYADNKDKKI

SEQ ID NO: 106740 - protein, 16 aa, Borrelia burgdorferi B31
WIAFYIYADNKDKKIF

SEQ ID NO: 106741 - protein, 16 aa, Borrelia burgdorferi B31
IAFYIYADNKDKKIFC

SEQ ID NO: 106742 - protein, 16 aa, Borrelia burgdorferi B31
AFYIYADNKDKKIFCQ

SEQ ID NO: 106743 - protein, 16 aa, Borrelia burgdorferi B31
FYIYADNKDKKIFCQR

SEQ ID NO: 106744 - protein, 16 aa, Borrelia burgdorferi B31
YIYADNKDKKIFCQRM

SEQ ID NO: 106745 - protein, 16 aa, Borrelia burgdorferi B31
IYADNKDKKIFCQRMK

SEQ ID NO: 106746 - protein, 16 aa, Borrelia burgdorferi B31
YADNKDKKIFCQRMKE

SEQ ID NO: 106747 - protein, 16 aa, Borrelia burgdorferi B31
ADNKDKKIFCQRMKEF

SEQ ID NO: 106748 - protein, 16 aa, Borrelia burgdorferi B31
DNKDKKIFCQRMKEFF

SEQ ID NO: 106749 - protein, 16 aa, Borrelia burgdorferi B31
NKDKKIFCQRMKEFFK

SEQ ID NO: 106750 - protein, 16 aa, Borrelia burgdorferi B31
KDKKIFCQRMKEFFKS

SEQ ID NO: 106751 - protein, 16 aa, Borrelia burgdorferi B31
DKKIFCQRMKEFFKSK

SEQ ID NO: 106752 - protein, 16 aa, Borrelia burgdorferi B31
KKIFCQRMKEFFKSKT

SEQ ID NO: 106753 - protein, 16 aa, Borrelia burgdorferi B31
KIFCQRMKEFFKSKTF

SEQ ID NO: 106754 - protein, 16 aa, Borrelia burgdorferi B31
IFCQRMKEFFKSKTFE

SEQ ID NO: 106755 - protein, 16 aa, Borrelia burgdorferi B31
FCQRMKEFFKSKTFEI

SEQ ID NO: 106756 - protein, 16 aa, Borrelia burgdorferi B31
CQRMKEFFKSKTFEIQ

SEQ ID NO: 106757 - protein, 16 aa, Borrelia burgdorferi B31
QRMKEFFKSKTFEIQN

SEQ ID NO: 106758 - protein, 16 aa, Borrelia burgdorferi B31
RMKEFFKSKTFEIQNQ

SEQ ID NO: 106759 - protein, 16 aa, Borrelia burgdorferi B31
MKEFFKSKTFEIQNQI

SEQ ID NO: 106760 - protein, 16 aa, Borrelia burgdorferi B31
KEFFKSKTFEIQNQIF

SEQ ID NO: 106761 - protein, 16 aa, Borrelia burgdorferi B31
EFFKSKTFEIQNQIFV

SEQ ID NO: 106762 - protein, 16 aa, Borrelia burgdorferi B31
FFKSKTFEIQNQIFVY

SEQ ID NO: 106763 - protein, 16 aa, Borrelia burgdorferi B31
FKSKTFEIQNQIFVYF

SEQ ID NO: 106764 - protein, 16 aa, Borrelia burgdorferi B31
KSKTFEIQNQIFVYFL

SEQ ID NO: 106765 - protein, 16 aa, Borrelia burgdorferi B31
SKTFEIQNQIFVYFLS

SEQ ID NO: 106766 - protein, 16 aa, Borrelia burgdorferi B31
KTFEIQNQIFVYFLSF

SEQ ID NO: 106767 - protein, 16 aa, Borrelia burgdorferi B31
TFEIQNQIFVYFLSFY

SEQ ID NO: 106768 - protein, 16 aa, Borrelia burgdorferi B31
FEIQNQIFVYFLSFYP

SEQ ID NO: 106769 - protein, 16 aa, Borrelia burgdorferi B31
EIQNQIFVYFLSFYPN

SEQ ID NO: 106770 - protein, 16 aa, Borrelia burgdorferi B31
IQNQIFVYFLSFYPNI

SEQ ID NO: 106771 - protein, 16 aa, Borrelia burgdorferi B31
QNQIFVYFLSFYPNIE

SEQ ID NO: 106772 - protein, 16 aa, Borrelia burgdorferi B31
NQIFVYFLSFYPNIEY

SEQ ID NO: 106773 - protein, 16 aa, Borrelia burgdorferi B31
QIFVYFLSFYPNIEYK

SEQ ID NO: 106774 - protein, 16 aa, Borrelia burgdorferi B31
IFVYFLSFYPNIEYKH

SEQ ID NO: 106775 - protein, 16 aa, Borrelia burgdorferi B31
FVYFLSFYPNIEYKHF

SEQ ID NO: 106776 - protein, 16 aa, Borrelia burgdorferi B31
VYFLSFYPNIEYKHFK

SEQ ID NO: 106777 - protein, 16 aa, Borrelia burgdorferi B31
YFLSFYPNIEYKHFKF

SEQ ID NO: 106778 - protein, 16 aa, Borrelia burgdorferi B31
FLSFYPNIEYKHFKFI

SEQ ID NO: 106779 - protein, 16 aa, Borrelia burgdorferi B31
LSFYPNIEYKHFKFIS

SEQ ID NO: 106780 - protein, 16 aa, Borrelia burgdorferi B31
SFYPNIEYKHFKFISD

SEQ ID NO: 106781 - protein, 16 aa, Borrelia burgdorferi B31
FYPNIEYKHFKFISDI

SEQ ID NO: 106782 - protein, 16 aa, Borrelia burgdorferi B31
YPNIEYKHFKFISDIL

SEQ ID NO: 106783 - protein, 16 aa, Borrelia burgdorferi B31
PNIEYKHFKFISDILL

SEQ ID NO: 106784 - protein, 16 aa, Borrelia burgdorferi B31
NIEYKHFKFISDILLY

SEQ ID NO: 106785 - protein, 16 aa, Borrelia burgdorferi B31
IEYKHFKFISDILLYL

SEQ ID NO: 106786 - protein, 16 aa, Borrelia burgdorferi B31
EYKHFKFISDILLYLD

SEQ ID NO: 106787 - protein, 16 aa, Borrelia burgdorferi B31
YKHFKFISDILLYLDE

SEQ ID NO: 106788 - protein, 16 aa, Borrelia burgdorferi B31
KHFKFISDILLYLDEN

SEQ ID NO: 106789 - protein, 16 aa, Borrelia burgdorferi B31
HFKFISDILLYLDENK

SEQ ID NO: 106790 - protein, 16 aa, Borrelia burgdorferi B31
FKFISDILLYLDENKI

SEQ ID NO: 106791 - protein, 16 aa, Borrelia burgdorferi B31
KFISDILLYLDENKIT

SEQ ID NO: 106792 - protein, 16 aa, Borrelia burgdorferi B31
FISDILLYLDENKITI

SEQ ID NO: 106793 - protein, 16 aa, Borrelia burgdorferi B31
ISDILLYLDENKITIP

SEQ ID NO: 106794 - protein, 16 aa, Borrelia burgdorferi B31
SDILLYLDENKITIPK

SEQ ID NO: 106795 - protein, 16 aa, Borrelia burgdorferi B31
DILLYLDENKITIPKK

SEQ ID NO: 106796 - protein, 16 aa, Borrelia burgdorferi B31
ILLYLDENKITIPKKI

SEQ ID NO: 106797 - protein, 16 aa, Borrelia burgdorferi B31
LLYLDENKITIPKKII

SEQ ID NO: 106798 - protein, 16 aa, Borrelia burgdorferi B31
LYLDENKITIPKKIIK

SEQ ID NO: 106799 - protein, 16 aa, Borrelia burgdorferi B31
YLDENKITIPKKIIKI

SEQ ID NO: 106800 - protein, 16 aa, Borrelia burgdorferi B31
LDENKITIPKKIIKIQ

SEQ ID NO: 106801 - protein, 16 aa, Borrelia burgdorferi B31
DENKITIPKKIIKIQK

SEQ ID NO: 106802 - protein, 16 aa, Borrelia burgdorferi B31
ENKITIPKKIIKIQKI

SEQ ID NO: 106803 - protein, 16 aa, Borrelia burgdorferi B31
NKITIPKKIIKIQKIN

SEQ ID NO: 106804 - protein, 16 aa, Borrelia burgdorferi B31
KITIPKKIIKIQKINP

SEQ ID NO: 106805 - protein, 16 aa, Borrelia burgdorferi B31
ITIPKKIIKIQKINPN

SEQ ID NO: 106806 - protein, 16 aa, Borrelia burgdorferi B31
TIPKKIIKIQKINPNQ

SEQ ID NO: 106807 - protein, 16 aa, Borrelia burgdorferi B31
IPKKIIKIQKINPNQL

SEQ ID NO: 106808 - protein, 16 aa, Borrelia burgdorferi B31
PKKIIKIQKINPNQLD

SEQ ID NO: 106809 - protein, 16 aa, Borrelia burgdorferi B31
KKIIKIQKINPNQLDY

SEQ ID NO: 106810 - protein, 16 aa, Borrelia burgdorferi B31
KIIKIQKINPNQLDYQ

SEQ ID NO: 106811 - protein, 16 aa, Borrelia burgdorferi B31
IIKIQKINPNQLDYQK

SEQ ID NO: 106812 - protein, 16 aa, Borrelia burgdorferi B31
IKIQKINPNQLDYQKS

SEQ ID NO: 106813 - protein, 16 aa, Borrelia burgdorferi B31
KIQKINPNQLDYQKSY

SEQ ID NO: 106814 - protein, 16 aa, Borrelia burgdorferi B31
IQKINPNQLDYQKSYL

SEQ ID NO: 106815 - protein, 16 aa, Borrelia burgdorferi B31
QKINPNQLDYQKSYLL

SEQ ID NO: 106816 - protein, 16 aa, Borrelia burgdorferi B31
KINPNQLDYQKSYLLI

SEQ ID NO: 106817 - protein, 16 aa, Borrelia burgdorferi B31
INPNQLDYQKSYLLIK

SEQ ID NO: 106818 - protein, 16 aa, Borrelia burgdorferi B31
NPNQLDYQKSYLLIKS

SEQ ID NO: 106819 - protein, 16 aa, Borrelia burgdorferi B31
PNQLDYQKSYLLIKSL

SEQ ID NO: 106820 - protein, 16 aa, Borrelia burgdorferi B31
NQLDYQKSYLLIKSLK

SEQ ID NO: 106821 - protein, 16 aa, Borrelia burgdorferi B31
QLDYQKSYLLIKSLKT

SEQ ID NO: 106822 - protein, 16 aa, Borrelia burgdorferi B31
LDYQKSYLLIKSLKTR

SEQ ID NO: 106823 - protein, 16 aa, Borrelia burgdorferi B31
DYQKSYLLIKSLKTRS

SEQ ID NO: 106824 - protein, 16 aa, Borrelia burgdorferi B31
YQKSYLLIKSLKTRSR

SEQ ID NO: 106825 - protein, 16 aa, Borrelia burgdorferi B31
QKSYLLIKSLKTRSRI

SEQ ID NO: 106826 - protein, 16 aa, Borrelia burgdorferi B31
KSYLLIKSLKTRSRIL

SEQ ID NO: 106827 - protein, 16 aa, Borrelia burgdorferi B31
SYLLIKSLKTRSRILK

SEQ ID NO: 106828 - protein, 16 aa, Borrelia burgdorferi B31
YLLIKSLKTRSRILKI

SEQ ID NO: 106829 - protein, 16 aa, Borrelia burgdorferi B31
LLIKSLKTRSRILKII

SEQ ID NO: 106830 - protein, 16 aa, Borrelia burgdorferi B31
LIKSLKTRSRILKIII

SEQ ID NO: 106831 - protein, 16 aa, Borrelia burgdorferi B31
IKSLKTRSRILKIIIK

SEQ ID NO: 106832 - protein, 16 aa, Borrelia burgdorferi B31
KSLKTRSRILKIIIKN

SEQ ID NO: 106833 - protein, 16 aa, Borrelia burgdorferi B31
SLKTRSRILKIIIKNI

SEQ ID NO: 106834 - protein, 16 aa, Borrelia burgdorferi B31
LKTRSRILKIIIKNIR

SEQ ID NO: 106835 - protein, 16 aa, Borrelia burgdorferi B31
KTRSRILKIIIKNIRF

SEQ ID NO: 106836 - protein, 16 aa, Borrelia burgdorferi B31
TRSRILKIIIKNIRFN

SEQ ID NO: 106837 - protein, 16 aa, Borrelia burgdorferi B31
RSRILKIIIKNIRFNL

SEQ ID NO: 106838 - protein, 16 aa, Borrelia burgdorferi B31
SRILKIIIKNIRFNLI

SEQ ID NO: 106839 - protein, 16 aa, Borrelia burgdorferi B31
RILKIIIKNIRFNLIE

SEQ ID NO: 106840 - protein, 16 aa, Borrelia burgdorferi B31
ILKIIIKNIRFNLIEK

SEQ ID NO: 106841 - protein, 16 aa, Borrelia burgdorferi B31
LKIIIKNIRFNLIEKL

SEQ ID NO: 106842 - protein, 16 aa, Borrelia burgdorferi B31
KIIIKNIRFNLIEKLE

SEQ ID NO: 106843 - protein, 16 aa, Borrelia burgdorferi B31
IIIKNIRFNLIEKLED

SEQ ID NO: 106844 - protein, 16 aa, Borrelia burgdorferi B31
IIKNIRFNLIEKLEDE

SEQ ID NO: 106845 - protein, 16 aa, Borrelia burgdorferi B31
IKNIRFNLIEKLEDEN

SEQ ID NO: 106846 - protein, 16 aa, Borrelia burgdorferi B31
KNIRFNLIEKLEDENE

SEQ ID NO: 106847 - protein, 16 aa, Borrelia burgdorferi B31
NIRFNLIEKLEDENEK

SEQ ID NO: 106848 - protein, 16 aa, Borrelia burgdorferi B31
IRFNLIEKLEDENEKK

SEQ ID NO: 106849 - protein, 16 aa, Borrelia burgdorferi B31
RFNLIEKLEDENEKKL

SEQ ID NO: 106850 - protein, 16 aa, Borrelia burgdorferi B31
FNLIEKLEDENEKKLL

SEQ ID NO: 106851 - protein, 16 aa, Borrelia burgdorferi B31
NLIEKLEDENEKKLLP

SEQ ID NO: 106852 - protein, 16 aa, Borrelia burgdorferi B31
LIEKLEDENEKKLLPA

SEQ ID NO: 106853 - protein, 16 aa, Borrelia burgdorferi B31
IEKLEDENEKKLLPAM

SEQ ID NO: 106854 - protein, 16 aa, Borrelia burgdorferi B31
EKLEDENEKKLLPAMC

SEQ ID NO: 106855 - protein, 16 aa, Borrelia burgdorferi B31
KLEDENEKKLLPAMCY

SEQ ID NO: 106856 - protein, 16 aa, Borrelia burgdorferi B31
LEDENEKKLLPAMCYL

SEQ ID NO: 106857 - protein, 16 aa, Borrelia burgdorferi B31
EDENEKKLLPAMCYLI

SEQ ID NO: 106858 - protein, 16 aa, Borrelia burgdorferi B31
DENEKKLLPAMCYLIY

SEQ ID NO: 106859 - protein, 16 aa, Borrelia burgdorferi B31
ENEKKLLPAMCYLIYC

SEQ ID NO: 106860 - protein, 16 aa, Borrelia burgdorferi B31
NEKKLLPAMCYLIYCE

SEQ ID NO: 106861 - protein, 16 aa, Borrelia burgdorferi B31
EKKLLPAMCYLIYCEN

SEQ ID NO: 106862 - protein, 16 aa, Borrelia burgdorferi B31
KKLLPAMCYLIYCENL

SEQ ID NO: 106863 - protein, 16 aa, Borrelia burgdorferi B31
KLLPAMCYLIYCENLV

SEQ ID NO: 106864 - protein, 16 aa, Borrelia burgdorferi B31
LLPAMCYLIYCENLVE

SEQ ID NO: 106865 - protein, 16 aa, Borrelia burgdorferi B31
LPAMCYLIYCENLVEL

SEQ ID NO: 106866 - protein, 16 aa, Borrelia burgdorferi B31
PAMCYLIYCENLVELK

SEQ ID NO: 106867 - protein, 16 aa, Borrelia burgdorferi B31
AMCYLIYCENLVELKN

SEQ ID NO: 106868 - protein, 16 aa, Borrelia burgdorferi B31
MCYLIYCENLVELKNN

SEQ ID NO: 106869 - protein, 16 aa, Borrelia burgdorferi B31
CYLIYCENLVELKNNR

SEQ ID NO: 106870 - protein, 16 aa, Borrelia burgdorferi B31
YLIYCENLVELKNNRK

SEQ ID NO: 106871 - protein, 16 aa, Borrelia burgdorferi B31
LIYCENLVELKNNRKI

SEQ ID NO: 106872 - protein, 16 aa, Borrelia burgdorferi B31
IYCENLVELKNNRKIK

SEQ ID NO: 106873 - protein, 16 aa, Borrelia burgdorferi B31
YCENLVELKNNRKIKS

SEQ ID NO: 106874 - protein, 16 aa, Borrelia burgdorferi B31
CENLVELKNNRKIKSN

SEQ ID NO: 106875 - protein, 16 aa, Borrelia burgdorferi B31
ENLVELKNNRKIKSNE

SEQ ID NO: 106876 - protein, 16 aa, Borrelia burgdorferi B31
NLVELKNNRKIKSNEK

SEQ ID NO: 106877 - protein, 16 aa, Borrelia burgdorferi B31
LVELKNNRKIKSNEKN

SEQ ID NO: 106878 - protein, 16 aa, Borrelia burgdorferi B31
VELKNNRKIKSNEKNS

SEQ ID NO: 106879 - protein, 16 aa, Borrelia burgdorferi B31
ELKNNRKIKSNEKNSL

SEQ ID NO: 106880 - protein, 16 aa, Borrelia burgdorferi B31
LKNNRKIKSNEKNSLL

SEQ ID NO: 106881 - protein, 16 aa, Borrelia burgdorferi B31
KNNRKIKSNEKNSLLE

SEQ ID NO: 106882 - protein, 16 aa, Borrelia burgdorferi B31
NNRKIKSNEKNSLLEF

SEQ ID NO: 106883 - protein, 16 aa, Borrelia burgdorferi B31
NRKIKSNEKNSLLEFI

SEQ ID NO: 106884 - protein, 16 aa, Borrelia burgdorferi B31
RKIKSNEKNSLLEFIS

SEQ ID NO: 106885 - protein, 16 aa, Borrelia burgdorferi B31
KIKSNEKNSLLEFISF

SEQ ID NO: 106886 - protein, 16 aa, Borrelia burgdorferi B31
IKSNEKNSLLEFISFF

SEQ ID NO: 106887 - protein, 16 aa, Borrelia burgdorferi B31
KSNEKNSLLEFISFFK

SEQ ID NO: 106888 - protein, 16 aa, Borrelia burgdorferi B31
SNEKNSLLEFISFFKT

SEQ ID NO: 106889 - protein, 16 aa, Borrelia burgdorferi B31
NEKNSLLEFISFFKTK

SEQ ID NO: 106890 - protein, 16 aa, Borrelia burgdorferi B31
EKNSLLEFISFFKTKL

SEQ ID NO: 106891 - protein, 16 aa, Borrelia burgdorferi B31
KNSLLEFISFFKTKLK

SEQ ID NO: 106892 - protein, 16 aa, Borrelia burgdorferi B31
NSLLEFISFFKTKLKQ

SEQ ID NO: 106893 - protein, 16 aa, Borrelia burgdorferi B31
SLLEFISFFKTKLKQK

SEQ ID NO: 106894 - protein, 16 aa, Borrelia burgdorferi B31
LLEFISFFKTKLKQKI

SEQ ID NO: 106895 - protein, 16 aa, Borrelia burgdorferi B31
LEFISFFKTKLKQKIN

SEQ ID NO: 106896 - protein, 16 aa, Borrelia burgdorferi B31
EFISFFKTKLKQKINF

SEQ ID NO: 106897 - protein, 16 aa, Borrelia burgdorferi B31
FISFFKTKLKQKINFK

SEQ ID NO: 106898 - protein, 16 aa, Borrelia burgdorferi B31
ISFFKTKLKQKINFKK

SEQ ID NO: 106899 - protein, 16 aa, Borrelia burgdorferi B31
SFFKTKLKQKINFKKE

SEQ ID NO: 106900 - protein, 16 aa, Borrelia burgdorferi B31
FFKTKLKQKINFKKEL

SEQ ID NO: 106901 - protein, 16 aa, Borrelia burgdorferi B31
FKTKLKQKINFKKELM

SEQ ID NO: 106902 - protein, 16 aa, Borrelia burgdorferi B31
KTKLKQKINFKKELMK

SEQ ID NO: 106903 - protein, 16 aa, Borrelia burgdorferi B31
TKLKQKINFKKELMKS

SEQ ID NO: 106904 - protein, 16 aa, Borrelia burgdorferi B31
KLKQKINFKKELMKSK

SEQ ID NO: 106905 - protein, 16 aa, Borrelia burgdorferi B31
LKQKINFKKELMKSKG

SEQ ID NO: 106906 - protein, 16 aa, Borrelia burgdorferi B31
KQKINFKKELMKSKGI

SEQ ID NO: 106907 - protein, 13 aa, Borrelia burgdorferi B31
MITQQDYTEIKKK

SEQ ID NO: 106908 - protein, 13 aa, Borrelia burgdorferi B31
ITQQDYTEIKKKL

SEQ ID NO: 106909 - protein, 13 aa, Borrelia burgdorferi B31
TQQDYTEIKKKLE

SEQ ID NO: 106910 - protein, 13 aa, Borrelia burgdorferi B31
QQDYTEIKKKLEN

SEQ ID NO: 106911 - protein, 13 aa, Borrelia burgdorferi B31
QDYTEIKKKLENT

SEQ ID NO: 106912 - protein, 13 aa, Borrelia burgdorferi B31
DYTEIKKKLENTK

SEQ ID NO: 106913 - protein, 13 aa, Borrelia burgdorferi B31
YTEIKKKLENTKT

SEQ ID NO: 106914 - protein, 13 aa, Borrelia burgdorferi B31
TEIKKKLENTKTR

SEQ ID NO: 106915 - protein, 13 aa, Borrelia burgdorferi B31
EIKKKLENTKTRI

SEQ ID NO: 106916 - protein, 13 aa, Borrelia burgdorferi B31
IKKKLENTKTRIQ

SEQ ID NO: 106917 - protein, 13 aa, Borrelia burgdorferi B31
KKKLENTKTRIQF

SEQ ID NO: 106918 - protein, 13 aa, Borrelia burgdorferi B31
KKLENTKTRIQFR

SEQ ID NO: 106919 - protein, 13 aa, Borrelia burgdorferi B31
KLENTKTRIQFRN

SEQ ID NO: 106920 - protein, 13 aa, Borrelia burgdorferi B31
LENTKTRIQFRNG

SEQ ID NO: 106921 - protein, 13 aa, Borrelia burgdorferi B31
ENTKTRIQFRNGN

SEQ ID NO: 106922 - protein, 13 aa, Borrelia burgdorferi B31
NTKTRIQFRNGNK

SEQ ID NO: 106923 - protein, 13 aa, Borrelia burgdorferi B31
TKTRIQFRNGNKI

SEQ ID NO: 106924 - protein, 13 aa, Borrelia burgdorferi B31
KTRIQFRNGNKID

SEQ ID NO: 106925 - protein, 13 aa, Borrelia burgdorferi B31
TRIQFRNGNKIDS

SEQ ID NO: 106926 - protein, 13 aa, Borrelia burgdorferi B31
RIQFRNGNKIDSL

SEQ ID NO: 106927 - protein, 13 aa, Borrelia burgdorferi B31
IQFRNGNKIDSLG

SEQ ID NO: 106928 - protein, 13 aa, Borrelia burgdorferi B31
QFRNGNKIDSLGY

SEQ ID NO: 106929 - protein, 13 aa, Borrelia burgdorferi B31
FRNGNKIDSLGYQ

SEQ ID NO: 106930 - protein, 13 aa, Borrelia burgdorferi B31
RNGNKIDSLGYQG

SEQ ID NO: 106931 - protein, 13 aa, Borrelia burgdorferi B31
NGNKIDSLGYQGS

SEQ ID NO: 106932 - protein, 13 aa, Borrelia burgdorferi B31
GNKIDSLGYQGSL

SEQ ID NO: 106933 - protein, 13 aa, Borrelia burgdorferi B31
NKIDSLGYQGSLG

SEQ ID NO: 106934 - protein, 13 aa, Borrelia burgdorferi B31
KIDSLGYQGSLGE

SEQ ID NO: 106935 - protein, 13 aa, Borrelia burgdorferi B31
IDSLGYQGSLGEP

SEQ ID NO: 106936 - protein, 13 aa, Borrelia burgdorferi B31
DSLGYQGSLGEPI

SEQ ID NO: 106937 - protein, 13 aa, Borrelia burgdorferi B31
SLGYQGSLGEPIL

SEQ ID NO: 106938 - protein, 13 aa, Borrelia burgdorferi B31
LGYQGSLGEPILL

SEQ ID NO: 106939 - protein, 13 aa, Borrelia burgdorferi B31
GYQGSLGEPILLK

SEQ ID NO: 106940 - protein, 13 aa, Borrelia burgdorferi B31
YQGSLGEPILLKD

SEQ ID NO: 106941 - protein, 13 aa, Borrelia burgdorferi B31
QGSLGEPILLKDK

SEQ ID NO: 106942 - protein, 13 aa, Borrelia burgdorferi B31
GSLGEPILLKDKL

SEQ ID NO: 106943 - protein, 13 aa, Borrelia burgdorferi B31
SLGEPILLKDKLT

SEQ ID NO: 106944 - protein, 13 aa, Borrelia burgdorferi B31
LGEPILLKDKLTF

SEQ ID NO: 106945 - protein, 13 aa, Borrelia burgdorferi B31
GEPILLKDKLTFS

SEQ ID NO: 106946 - protein, 13 aa, Borrelia burgdorferi B31
EPILLKDKLTFSI

SEQ ID NO: 106947 - protein, 13 aa, Borrelia burgdorferi B31
PILLKDKLTFSIC

SEQ ID NO: 106948 - protein, 13 aa, Borrelia burgdorferi B31
ILLKDKLTFSICD

SEQ ID NO: 106949 - protein, 13 aa, Borrelia burgdorferi B31
LLKDKLTFSICDG

SEQ ID NO: 106950 - protein, 13 aa, Borrelia burgdorferi B31
LKDKLTFSICDGK

SEQ ID NO: 106951 - protein, 13 aa, Borrelia burgdorferi B31
KDKLTFSICDGKN

SEQ ID NO: 106952 - protein, 13 aa, Borrelia burgdorferi B31
DKLTFSICDGKNI

SEQ ID NO: 106953 - protein, 13 aa, Borrelia burgdorferi B31
KLTFSICDGKNID

SEQ ID NO: 106954 - protein, 13 aa, Borrelia burgdorferi B31
LTFSICDGKNIDN

SEQ ID NO: 106955 - protein, 13 aa, Borrelia burgdorferi B31
TFSICDGKNIDNR

SEQ ID NO: 106956 - protein, 13 aa, Borrelia burgdorferi B31
FSICDGKNIDNRK

SEQ ID NO: 106957 - protein, 13 aa, Borrelia burgdorferi B31
SICDGKNIDNRKE

SEQ ID NO: 106958 - protein, 13 aa, Borrelia burgdorferi B31
ICDGKNIDNRKEY

SEQ ID NO: 106959 - protein, 13 aa, Borrelia burgdorferi B31
CDGKNIDNRKEYE

SEQ ID NO: 106960 - protein, 13 aa, Borrelia burgdorferi B31
DGKNIDNRKEYEI

SEQ ID NO: 106961 - protein, 13 aa, Borrelia burgdorferi B31
GKNIDNRKEYEIT

SEQ ID NO: 106962 - protein, 13 aa, Borrelia burgdorferi B31
KNIDNRKEYEITK

SEQ ID NO: 106963 - protein, 13 aa, Borrelia burgdorferi B31
NIDNRKEYEITKN

SEQ ID NO: 106964 - protein, 13 aa, Borrelia burgdorferi B31
IDNRKEYEITKNA

SEQ ID NO: 106965 - protein, 13 aa, Borrelia burgdorferi B31
DNRKEYEITKNAP

SEQ ID NO: 106966 - protein, 13 aa, Borrelia burgdorferi B31
NRKEYEITKNAPS

SEQ ID NO: 106967 - protein, 13 aa, Borrelia burgdorferi B31
RKEYEITKNAPSL

SEQ ID NO: 106968 - protein, 13 aa, Borrelia burgdorferi B31
KEYEITKNAPSLD

SEQ ID NO: 106969 - protein, 13 aa, Borrelia burgdorferi B31
EYEITKNAPSLDS

SEQ ID NO: 106970 - protein, 13 aa, Borrelia burgdorferi B31
YEITKNAPSLDSL

SEQ ID NO: 106971 - protein, 13 aa, Borrelia burgdorferi B31
EITKNAPSLDSLI

SEQ ID NO: 106972 - protein, 13 aa, Borrelia burgdorferi B31
ITKNAPSLDSLIE

SEQ ID NO: 106973 - protein, 13 aa, Borrelia burgdorferi B31
TKNAPSLDSLIEY

SEQ ID NO: 106974 - protein, 13 aa, Borrelia burgdorferi B31
KNAPSLDSLIEYL

SEQ ID NO: 106975 - protein, 13 aa, Borrelia burgdorferi B31
NAPSLDSLIEYLE

SEQ ID NO: 106976 - protein, 13 aa, Borrelia burgdorferi B31
APSLDSLIEYLEH

SEQ ID NO: 106977 - protein, 13 aa, Borrelia burgdorferi B31
PSLDSLIEYLEHM

SEQ ID NO: 106978 - protein, 13 aa, Borrelia burgdorferi B31
SLDSLIEYLEHMI

SEQ ID NO: 106979 - protein, 13 aa, Borrelia burgdorferi B31
LDSLIEYLEHMIL

SEQ ID NO: 106980 - protein, 13 aa, Borrelia burgdorferi B31
DSLIEYLEHMILF

SEQ ID NO: 106981 - protein, 13 aa, Borrelia burgdorferi B31
SLIEYLEHMILFF

SEQ ID NO: 106982 - protein, 13 aa, Borrelia burgdorferi B31
LIEYLEHMILFFL

SEQ ID NO: 106983 - protein, 13 aa, Borrelia burgdorferi B31
IEYLEHMILFFLE

SEQ ID NO: 106984 - protein, 13 aa, Borrelia burgdorferi B31
EYLEHMILFFLEK

SEQ ID NO: 106985 - protein, 13 aa, Borrelia burgdorferi B31
YLEHMILFFLEKT

SEQ ID NO: 106986 - protein, 13 aa, Borrelia burgdorferi B31
LEHMILFFLEKTP

SEQ ID NO: 106987 - protein, 13 aa, Borrelia burgdorferi B31
EHMILFFLEKTPV

SEQ ID NO: 106988 - protein, 13 aa, Borrelia burgdorferi B31
HMILFFLEKTPVG

SEQ ID NO: 106989 - protein, 13 aa, Borrelia burgdorferi B31
MILFFLEKTPVGT

SEQ ID NO: 106990 - protein, 13 aa, Borrelia burgdorferi B31
ILFFLEKTPVGTL

SEQ ID NO: 106991 - protein, 13 aa, Borrelia burgdorferi B31
LFFLEKTPVGTLT

SEQ ID NO: 106992 - protein, 13 aa, Borrelia burgdorferi B31
FFLEKTPVGTLTA

SEQ ID NO: 106993 - protein, 13 aa, Borrelia burgdorferi B31
FLEKTPVGTLTAK

SEQ ID NO: 106994 - protein, 13 aa, Borrelia burgdorferi B31
LEKTPVGTLTAKF

SEQ ID NO: 106995 - protein, 13 aa, Borrelia burgdorferi B31
EKTPVGTLTAKFA

SEQ ID NO: 106996 - protein, 13 aa, Borrelia burgdorferi B31
KTPVGTLTAKFAM

SEQ ID NO: 106997 - protein, 13 aa, Borrelia burgdorferi B31
TPVGTLTAKFAME

SEQ ID NO: 106998 - protein, 13 aa, Borrelia burgdorferi B31
PVGTLTAKFAMEG

SEQ ID NO: 106999 - protein, 13 aa, Borrelia burgdorferi B31
VGTLTAKFAMEGS

SEQ ID NO: 107000 - protein, 13 aa, Borrelia burgdorferi B31
GTLTAKFAMEGSI

SEQ ID NO: 107001 - protein, 13 aa, Borrelia burgdorferi B31
TLTAKFAMEGSIL

SEQ ID NO: 107002 - protein, 13 aa, Borrelia burgdorferi B31
LTAKFAMEGSILT

SEQ ID NO: 107003 - protein, 13 aa, Borrelia burgdorferi B31
TAKFAMEGSILTR

SEQ ID NO: 107004 - protein, 13 aa, Borrelia burgdorferi B31
AKFAMEGSILTRS

SEQ ID NO: 107005 - protein, 13 aa, Borrelia burgdorferi B31
KFAMEGSILTRSK

SEQ ID NO: 107006 - protein, 13 aa, Borrelia burgdorferi B31
FAMEGSILTRSKL

SEQ ID NO: 107007 - protein, 13 aa, Borrelia burgdorferi B31
AMEGSILTRSKLI

SEQ ID NO: 107008 - protein, 13 aa, Borrelia burgdorferi B31
MEGSILTRSKLIQ

SEQ ID NO: 107009 - protein, 13 aa, Borrelia burgdorferi B31
EGSILTRSKLIQA

SEQ ID NO: 107010 - protein, 13 aa, Borrelia burgdorferi B31
GSILTRSKLIQAF

SEQ ID NO: 107011 - protein, 13 aa, Borrelia burgdorferi B31
SILTRSKLIQAFT

SEQ ID NO: 107012 - protein, 13 aa, Borrelia burgdorferi B31
ILTRSKLIQAFTN

SEQ ID NO: 107013 - protein, 13 aa, Borrelia burgdorferi B31
LTRSKLIQAFTNT

SEQ ID NO: 107014 - protein, 13 aa, Borrelia burgdorferi B31
TRSKLIQAFTNTN

SEQ ID NO: 107015 - protein, 13 aa, Borrelia burgdorferi B31
RSKLIQAFTNTNK

SEQ ID NO: 107016 - protein, 13 aa, Borrelia burgdorferi B31
SKLIQAFTNTNKF

SEQ ID NO: 107017 - protein, 13 aa, Borrelia burgdorferi B31
KLIQAFTNTNKFC

SEQ ID NO: 107018 - protein, 13 aa, Borrelia burgdorferi B31
LIQAFTNTNKFCI

SEQ ID NO: 107019 - protein, 13 aa, Borrelia burgdorferi B31
IQAFTNTNKFCIP

SEQ ID NO: 107020 - protein, 13 aa, Borrelia burgdorferi B31
QAFTNTNKFCIPD

SEQ ID NO: 107021 - protein, 13 aa, Borrelia burgdorferi B31
AFTNTNKFCIPDG

SEQ ID NO: 107022 - protein, 13 aa, Borrelia burgdorferi B31
FTNTNKFCIPDGR

SEQ ID NO: 107023 - protein, 13 aa, Borrelia burgdorferi B31
TNTNKFCIPDGRS

SEQ ID NO: 107024 - protein, 13 aa, Borrelia burgdorferi B31
NTNKFCIPDGRSL

SEQ ID NO: 107025 - protein, 13 aa, Borrelia burgdorferi B31
TNKFCIPDGRSLP

SEQ ID NO: 107026 - protein, 13 aa, Borrelia burgdorferi B31
NKFCIPDGRSLPS

SEQ ID NO: 107027 - protein, 13 aa, Borrelia burgdorferi B31
KFCIPDGRSLPSN

SEQ ID NO: 107028 - protein, 13 aa, Borrelia burgdorferi B31
FCIPDGRSLPSNC

SEQ ID NO: 107029 - protein, 13 aa, Borrelia burgdorferi B31
CIPDGRSLPSNCY

SEQ ID NO: 107030 - protein, 13 aa, Borrelia burgdorferi B31
IPDGRSLPSNCYA

SEQ ID NO: 107031 - protein, 13 aa, Borrelia burgdorferi B31
PDGRSLPSNCYAY

SEQ ID NO: 107032 - protein, 13 aa, Borrelia burgdorferi B31
DGRSLPSNCYAYK

SEQ ID NO: 107033 - protein, 13 aa, Borrelia burgdorferi B31
GRSLPSNCYAYKV

SEQ ID NO: 107034 - protein, 13 aa, Borrelia burgdorferi B31
RSLPSNCYAYKVL

SEQ ID NO: 107035 - protein, 13 aa, Borrelia burgdorferi B31
SLPSNCYAYKVLG

SEQ ID NO: 107036 - protein, 13 aa, Borrelia burgdorferi B31
LPSNCYAYKVLGI

SEQ ID NO: 107037 - protein, 13 aa, Borrelia burgdorferi B31
PSNCYAYKVLGIS

SEQ ID NO: 107038 - protein, 13 aa, Borrelia burgdorferi B31
SNCYAYKVLGISS

SEQ ID NO: 107039 - protein, 13 aa, Borrelia burgdorferi B31
NCYAYKVLGISSA

SEQ ID NO: 107040 - protein, 13 aa, Borrelia burgdorferi B31
CYAYKVLGISSAP

SEQ ID NO: 107041 - protein, 13 aa, Borrelia burgdorferi B31
YAYKVLGISSAPK

SEQ ID NO: 107042 - protein, 13 aa, Borrelia burgdorferi B31
AYKVLGISSAPKL

SEQ ID NO: 107043 - protein, 13 aa, Borrelia burgdorferi B31
YKVLGISSAPKLS

SEQ ID NO: 107044 - protein, 13 aa, Borrelia burgdorferi B31
KVLGISSAPKLSG

SEQ ID NO: 107045 - protein, 13 aa, Borrelia burgdorferi B31
VLGISSAPKLSGR

SEQ ID NO: 107046 - protein, 13 aa, Borrelia burgdorferi B31
LGISSAPKLSGRF

SEQ ID NO: 107047 - protein, 13 aa, Borrelia burgdorferi B31
GISSAPKLSGRFL

SEQ ID NO: 107048 - protein, 13 aa, Borrelia burgdorferi B31
ISSAPKLSGRFLR

SEQ ID NO: 107049 - protein, 13 aa, Borrelia burgdorferi B31
SSAPKLSGRFLRH

SEQ ID NO: 107050 - protein, 13 aa, Borrelia burgdorferi B31
SAPKLSGRFLRHY

SEQ ID NO: 107051 - protein, 13 aa, Borrelia burgdorferi B31
APKLSGRFLRHYD

SEQ ID NO: 107052 - protein, 13 aa, Borrelia burgdorferi B31
PKLSGRFLRHYDS

SEQ ID NO: 107053 - protein, 13 aa, Borrelia burgdorferi B31
KLSGRFLRHYDSG

SEQ ID NO: 107054 - protein, 13 aa, Borrelia burgdorferi B31
LSGRFLRHYDSGG

SEQ ID NO: 107055 - protein, 13 aa, Borrelia burgdorferi B31
SGRFLRHYDSGGS

SEQ ID NO: 107056 - protein, 13 aa, Borrelia burgdorferi B31
GRFLRHYDSGGST

SEQ ID NO: 107057 - protein, 13 aa, Borrelia burgdorferi B31
RFLRHYDSGGSTD

SEQ ID NO: 107058 - protein, 13 aa, Borrelia burgdorferi B31
FLRHYDSGGSTDS

SEQ ID NO: 107059 - protein, 13 aa, Borrelia burgdorferi B31
LRHYDSGGSTDSD

SEQ ID NO: 107060 - protein, 13 aa, Borrelia burgdorferi B31
RHYDSGGSTDSDG

SEQ ID NO: 107061 - protein, 13 aa, Borrelia burgdorferi B31
HYDSGGSTDSDGT

SEQ ID NO: 107062 - protein, 13 aa, Borrelia burgdorferi B31
YDSGGSTDSDGTR

SEQ ID NO: 107063 - protein, 13 aa, Borrelia burgdorferi B31
DSGGSTDSDGTRS

SEQ ID NO: 107064 - protein, 13 aa, Borrelia burgdorferi B31
SGGSTDSDGTRSL

SEQ ID NO: 107065 - protein, 13 aa, Borrelia burgdorferi B31
GGSTDSDGTRSLG

SEQ ID NO: 107066 - protein, 13 aa, Borrelia burgdorferi B31
GSTDSDGTRSLGH

SEQ ID NO: 107067 - protein, 13 aa, Borrelia burgdorferi B31
STDSDGTRSLGHT

SEQ ID NO: 107068 - protein, 13 aa, Borrelia burgdorferi B31
TDSDGTRSLGHTQ

SEQ ID NO: 107069 - protein, 13 aa, Borrelia burgdorferi B31
DSDGTRSLGHTQE

SEQ ID NO: 107070 - protein, 13 aa, Borrelia burgdorferi B31
SDGTRSLGHTQED

SEQ ID NO: 107071 - protein, 13 aa, Borrelia burgdorferi B31
DGTRSLGHTQEDS

SEQ ID NO: 107072 - protein, 13 aa, Borrelia burgdorferi B31
GTRSLGHTQEDSY

SEQ ID NO: 107073 - protein, 13 aa, Borrelia burgdorferi B31
TRSLGHTQEDSYK

SEQ ID NO: 107074 - protein, 13 aa, Borrelia burgdorferi B31
RSLGHTQEDSYKN

SEQ ID NO: 107075 - protein, 13 aa, Borrelia burgdorferi B31
SLGHTQEDSYKNH

SEQ ID NO: 107076 - protein, 13 aa, Borrelia burgdorferi B31
LGHTQEDSYKNHD

SEQ ID NO: 107077 - protein, 13 aa, Borrelia burgdorferi B31
GHTQEDSYKNHDH

SEQ ID NO: 107078 - protein, 13 aa, Borrelia burgdorferi B31
HTQEDSYKNHDHD

SEQ ID NO: 107079 - protein, 13 aa, Borrelia burgdorferi B31
TQEDSYKNHDHDL

SEQ ID NO: 107080 - protein, 13 aa, Borrelia burgdorferi B31
QEDSYKNHDHDLD

SEQ ID NO: 107081 - protein, 13 aa, Borrelia burgdorferi B31
EDSYKNHDHDLDF

SEQ ID NO: 107082 - protein, 13 aa, Borrelia burgdorferi B31
DSYKNHDHDLDFS

SEQ ID NO: 107083 - protein, 13 aa, Borrelia burgdorferi B31
SYKNHDHDLDFSR

SEQ ID NO: 107084 - protein, 13 aa, Borrelia burgdorferi B31
YKNHDHDLDFSRI

SEQ ID NO: 107085 - protein, 13 aa, Borrelia burgdorferi B31
KNHDHDLDFSRIN

SEQ ID NO: 107086 - protein, 13 aa, Borrelia burgdorferi B31
NHDHDLDFSRINF

SEQ ID NO: 107087 - protein, 13 aa, Borrelia burgdorferi B31
HDHDLDFSRINFK

SEQ ID NO: 107088 - protein, 13 aa, Borrelia burgdorferi B31
DHDLDFSRINFKG

SEQ ID NO: 107089 - protein, 13 aa, Borrelia burgdorferi B31
HDLDFSRINFKGK

SEQ ID NO: 107090 - protein, 13 aa, Borrelia burgdorferi B31
DLDFSRINFKGKL

SEQ ID NO: 107091 - protein, 13 aa, Borrelia burgdorferi B31
LDFSRINFKGKLV

SEQ ID NO: 107092 - protein, 13 aa, Borrelia burgdorferi B31
DFSRINFKGKLVK

SEQ ID NO: 107093 - protein, 13 aa, Borrelia burgdorferi B31
FSRINFKGKLVKR

SEQ ID NO: 107094 - protein, 13 aa, Borrelia burgdorferi B31
SRINFKGKLVKRM

SEQ ID NO: 107095 - protein, 13 aa, Borrelia burgdorferi B31
RINFKGKLVKRMT

SEQ ID NO: 107096 - protein, 13 aa, Borrelia burgdorferi B31
INFKGKLVKRMTM

SEQ ID NO: 107097 - protein, 13 aa, Borrelia burgdorferi B31
NFKGKLVKRMTMI

SEQ ID NO: 107098 - protein, 13 aa, Borrelia burgdorferi B31
FKGKLVKRMTMIY

SEQ ID NO: 107099 - protein, 13 aa, Borrelia burgdorferi B31
KGKLVKRMTMIYR

SEQ ID NO: 107100 - protein, 13 aa, Borrelia burgdorferi B31
GKLVKRMTMIYRS

SEQ ID NO: 107101 - protein, 13 aa, Borrelia burgdorferi B31
KLVKRMTMIYRSA

SEQ ID NO: 107102 - protein, 13 aa, Borrelia burgdorferi B31
LVKRMTMIYRSAD

SEQ ID NO: 107103 - protein, 13 aa, Borrelia burgdorferi B31
VKRMTMIYRSADT

SEQ ID NO: 107104 - protein, 13 aa, Borrelia burgdorferi B31
KRMTMIYRSADTW

SEQ ID NO: 107105 - protein, 13 aa, Borrelia burgdorferi B31
RMTMIYRSADTWY

SEQ ID NO: 107106 - protein, 13 aa, Borrelia burgdorferi B31
MTMIYRSADTWYT

SEQ ID NO: 107107 - protein, 13 aa, Borrelia burgdorferi B31
TMIYRSADTWYTW

SEQ ID NO: 107108 - protein, 13 aa, Borrelia burgdorferi B31
MIYRSADTWYTWY

SEQ ID NO: 107109 - protein, 13 aa, Borrelia burgdorferi B31
IYRSADTWYTWYW

SEQ ID NO: 107110 - protein, 13 aa, Borrelia burgdorferi B31
YRSADTWYTWYWA

SEQ ID NO: 107111 - protein, 13 aa, Borrelia burgdorferi B31
RSADTWYTWYWAE

SEQ ID NO: 107112 - protein, 13 aa, Borrelia burgdorferi B31
SADTWYTWYWAEE

SEQ ID NO: 107113 - protein, 13 aa, Borrelia burgdorferi B31
ADTWYTWYWAEEI

SEQ ID NO: 107114 - protein, 13 aa, Borrelia burgdorferi B31
DTWYTWYWAEEIM

SEQ ID NO: 107115 - protein, 13 aa, Borrelia burgdorferi B31
TWYTWYWAEEIMS

SEQ ID NO: 107116 - protein, 13 aa, Borrelia burgdorferi B31
WYTWYWAEEIMSP

SEQ ID NO: 107117 - protein, 13 aa, Borrelia burgdorferi B31
YTWYWAEEIMSPF

SEQ ID NO: 107118 - protein, 13 aa, Borrelia burgdorferi B31
TWYWAEEIMSPFI

SEQ ID NO: 107119 - protein, 13 aa, Borrelia burgdorferi B31
WYWAEEIMSPFIT

SEQ ID NO: 107120 - protein, 13 aa, Borrelia burgdorferi B31
YWAEEIMSPFITG

SEQ ID NO: 107121 - protein, 13 aa, Borrelia burgdorferi B31
WAEEIMSPFITGY

SEQ ID NO: 107122 - protein, 13 aa, Borrelia burgdorferi B31
AEEIMSPFITGYS

SEQ ID NO: 107123 - protein, 13 aa, Borrelia burgdorferi B31
EEIMSPFITGYSY

SEQ ID NO: 107124 - protein, 13 aa, Borrelia burgdorferi B31
EIMSPFITGYSYE

SEQ ID NO: 107125 - protein, 13 aa, Borrelia burgdorferi B31
IMSPFITGYSYEE

SEQ ID NO: 107126 - protein, 13 aa, Borrelia burgdorferi B31
MSPFITGYSYEEI

SEQ ID NO: 107127 - protein, 13 aa, Borrelia burgdorferi B31
SPFITGYSYEEID

SEQ ID NO: 107128 - protein, 13 aa, Borrelia burgdorferi B31
PFITGYSYEEIDP

SEQ ID NO: 107129 - protein, 13 aa, Borrelia burgdorferi B31
FITGYSYEEIDPE

SEQ ID NO: 107130 - protein, 13 aa, Borrelia burgdorferi B31
ITGYSYEEIDPEY

SEQ ID NO: 107131 - protein, 13 aa, Borrelia burgdorferi B31
TGYSYEEIDPEYL

SEQ ID NO: 107132 - protein, 13 aa, Borrelia burgdorferi B31
GYSYEEIDPEYLL

SEQ ID NO: 107133 - protein, 13 aa, Borrelia burgdorferi B31
YSYEEIDPEYLLP

SEQ ID NO: 107134 - protein, 13 aa, Borrelia burgdorferi B31
SYEEIDPEYLLPP

SEQ ID NO: 107135 - protein, 13 aa, Borrelia burgdorferi B31
YEEIDPEYLLPPF

SEQ ID NO: 107136 - protein, 13 aa, Borrelia burgdorferi B31
EEIDPEYLLPPFT

SEQ ID NO: 107137 - protein, 13 aa, Borrelia burgdorferi B31
EIDPEYLLPPFTS

SEQ ID NO: 107138 - protein, 13 aa, Borrelia burgdorferi B31
IDPEYLLPPFTSQ

SEQ ID NO: 107139 - protein, 13 aa, Borrelia burgdorferi B31
DPEYLLPPFTSQS

SEQ ID NO: 107140 - protein, 13 aa, Borrelia burgdorferi B31
PEYLLPPFTSQSG

SEQ ID NO: 107141 - protein, 13 aa, Borrelia burgdorferi B31
EYLLPPFTSQSGS

SEQ ID NO: 107142 - protein, 13 aa, Borrelia burgdorferi B31
YLLPPFTSQSGSK

SEQ ID NO: 107143 - protein, 13 aa, Borrelia burgdorferi B31
LLPPFTSQSGSKE

SEQ ID NO: 107144 - protein, 13 aa, Borrelia burgdorferi B31
LPPFTSQSGSKET

SEQ ID NO: 107145 - protein, 13 aa, Borrelia burgdorferi B31
PPFTSQSGSKETK

SEQ ID NO: 107146 - protein, 13 aa, Borrelia burgdorferi B31
PFTSQSGSKETKP

SEQ ID NO: 107147 - protein, 13 aa, Borrelia burgdorferi B31
FTSQSGSKETKPK

SEQ ID NO: 107148 - protein, 13 aa, Borrelia burgdorferi B31
TSQSGSKETKPKN

SEQ ID NO: 107149 - protein, 13 aa, Borrelia burgdorferi B31
SQSGSKETKPKNT

SEQ ID NO: 107150 - protein, 13 aa, Borrelia burgdorferi B31
QSGSKETKPKNTC

SEQ ID NO: 107151 - protein, 13 aa, Borrelia burgdorferi B31
SGSKETKPKNTCY

SEQ ID NO: 107152 - protein, 13 aa, Borrelia burgdorferi B31
GSKETKPKNTCYI

SEQ ID NO: 107153 - protein, 13 aa, Borrelia burgdorferi B31
SKETKPKNTCYIS

SEQ ID NO: 107154 - protein, 13 aa, Borrelia burgdorferi B31
KETKPKNTCYISF

SEQ ID NO: 107155 - protein, 13 aa, Borrelia burgdorferi B31
ETKPKNTCYISFY

SEQ ID NO: 107156 - protein, 13 aa, Borrelia burgdorferi B31
TKPKNTCYISFYR

SEQ ID NO: 107157 - protein, 13 aa, Borrelia burgdorferi B31
KPKNTCYISFYRY

SEQ ID NO: 107158 - protein, 13 aa, Borrelia burgdorferi B31
PKNTCYISFYRYD

SEQ ID NO: 107159 - protein, 13 aa, Borrelia burgdorferi B31
KNTCYISFYRYDL

SEQ ID NO: 107160 - protein, 14 aa, Borrelia burgdorferi B31
MITQQDYTEIKKKL

SEQ ID NO: 107161 - protein, 14 aa, Borrelia burgdorferi B31
ITQQDYTEIKKKLE

SEQ ID NO: 107162 - protein, 14 aa, Borrelia burgdorferi B31
TQQDYTEIKKKLEN

SEQ ID NO: 107163 - protein, 14 aa, Borrelia burgdorferi B31
QQDYTEIKKKLENT

SEQ ID NO: 107164 - protein, 14 aa, Borrelia burgdorferi B31
QDYTEIKKKLENTK

SEQ ID NO: 107165 - protein, 14 aa, Borrelia burgdorferi B31
DYTEIKKKLENTKT

SEQ ID NO: 107166 - protein, 14 aa, Borrelia burgdorferi B31
YTEIKKKLENTKTR

SEQ ID NO: 107167 - protein, 14 aa, Borrelia burgdorferi B31
TEIKKKLENTKTRI

SEQ ID NO: 107168 - protein, 14 aa, Borrelia burgdorferi B31
EIKKKLENTKTRIQ

SEQ ID NO: 107169 - protein, 14 aa, Borrelia burgdorferi B31
IKKKLENTKTRIQF

SEQ ID NO: 107170 - protein, 14 aa, Borrelia burgdorferi B31
KKKLENTKTRIQFR

SEQ ID NO: 107171 - protein, 14 aa, Borrelia burgdorferi B31
KKLENTKTRIQFRN

SEQ ID NO: 107172 - protein, 14 aa, Borrelia burgdorferi B31
KLENTKTRIQFRNG

SEQ ID NO: 107173 - protein, 14 aa, Borrelia burgdorferi B31
LENTKTRIQFRNGN

SEQ ID NO: 107174 - protein, 14 aa, Borrelia burgdorferi B31
ENTKTRIQFRNGNK

SEQ ID NO: 107175 - protein, 14 aa, Borrelia burgdorferi B31
NTKTRIQFRNGNKI

SEQ ID NO: 107176 - protein, 14 aa, Borrelia burgdorferi B31
TKTRIQFRNGNKID

SEQ ID NO: 107177 - protein, 14 aa, Borrelia burgdorferi B31
KTRIQFRNGNKIDS

SEQ ID NO: 107178 - protein, 14 aa, Borrelia burgdorferi B31
TRIQFRNGNKIDSL

SEQ ID NO: 107179 - protein, 14 aa, Borrelia burgdorferi B31
RIQFRNGNKIDSLG

SEQ ID NO: 107180 - protein, 14 aa, Borrelia burgdorferi B31
IQFRNGNKIDSLGY

SEQ ID NO: 107181 - protein, 14 aa, Borrelia burgdorferi B31
QFRNGNKIDSLGYQ

SEQ ID NO: 107182 - protein, 14 aa, Borrelia burgdorferi B31
FRNGNKIDSLGYQG

SEQ ID NO: 107183 - protein, 14 aa, Borrelia burgdorferi B31
RNGNKIDSLGYQGS

SEQ ID NO: 107184 - protein, 14 aa, Borrelia burgdorferi B31
NGNKIDSLGYQGSL

SEQ ID NO: 107185 - protein, 14 aa, Borrelia burgdorferi B31
GNKIDSLGYQGSLG

SEQ ID NO: 107186 - protein, 14 aa, Borrelia burgdorferi B31
NKIDSLGYQGSLGE

SEQ ID NO: 107187 - protein, 14 aa, Borrelia burgdorferi B31
KIDSLGYQGSLGEP

SEQ ID NO: 107188 - protein, 14 aa, Borrelia burgdorferi B31
IDSLGYQGSLGEPI

SEQ ID NO: 107189 - protein, 14 aa, Borrelia burgdorferi B31
DSLGYQGSLGEPIL

SEQ ID NO: 107190 - protein, 14 aa, Borrelia burgdorferi B31
SLGYQGSLGEPILL

SEQ ID NO: 107191 - protein, 14 aa, Borrelia burgdorferi B31
LGYQGSLGEPILLK

SEQ ID NO: 107192 - protein, 14 aa, Borrelia burgdorferi B31
GYQGSLGEPILLKD

SEQ ID NO: 107193 - protein, 14 aa, Borrelia burgdorferi B31
YQGSLGEPILLKDK

SEQ ID NO: 107194 - protein, 14 aa, Borrelia burgdorferi B31
QGSLGEPILLKDKL

SEQ ID NO: 107195 - protein, 14 aa, Borrelia burgdorferi B31
GSLGEPILLKDKLT

SEQ ID NO: 107196 - protein, 14 aa, Borrelia burgdorferi B31
SLGEPILLKDKLTF

SEQ ID NO: 107197 - protein, 14 aa, Borrelia burgdorferi B31
LGEPILLKDKLTFS

SEQ ID NO: 107198 - protein, 14 aa, Borrelia burgdorferi B31
GEPILLKDKLTFSI

SEQ ID NO: 107199 - protein, 14 aa, Borrelia burgdorferi B31
EPILLKDKLTFSIC

SEQ ID NO: 107200 - protein, 14 aa, Borrelia burgdorferi B31
PILLKDKLTFSICD

SEQ ID NO: 107201 - protein, 14 aa, Borrelia burgdorferi B31
ILLKDKLTFSICDG

SEQ ID NO: 107202 - protein, 14 aa, Borrelia burgdorferi B31
LLKDKLTFSICDGK

SEQ ID NO: 107203 - protein, 14 aa, Borrelia burgdorferi B31
LKDKLTFSICDGKN

SEQ ID NO: 107204 - protein, 14 aa, Borrelia burgdorferi B31
KDKLTFSICDGKNI

SEQ ID NO: 107205 - protein, 14 aa, Borrelia burgdorferi B31
DKLTFSICDGKNID

SEQ ID NO: 107206 - protein, 14 aa, Borrelia burgdorferi B31
KLTFSICDGKNIDN

SEQ ID NO: 107207 - protein, 14 aa, Borrelia burgdorferi B31
LTFSICDGKNIDNR

SEQ ID NO: 107208 - protein, 14 aa, Borrelia burgdorferi B31
TFSICDGKNIDNRK

SEQ ID NO: 107209 - protein, 14 aa, Borrelia burgdorferi B31
FSICDGKNIDNRKE

SEQ ID NO: 107210 - protein, 14 aa, Borrelia burgdorferi B31
SICDGKNIDNRKEY

SEQ ID NO: 107211 - protein, 14 aa, Borrelia burgdorferi B31
ICDGKNIDNRKEYE

SEQ ID NO: 107212 - protein, 14 aa, Borrelia burgdorferi B31
CDGKNIDNRKEYEI

SEQ ID NO: 107213 - protein, 14 aa, Borrelia burgdorferi B31
DGKNIDNRKEYEIT

SEQ ID NO: 107214 - protein, 14 aa, Borrelia burgdorferi B31
GKNIDNRKEYEITK

SEQ ID NO: 107215 - protein, 14 aa, Borrelia burgdorferi B31
KNIDNRKEYEITKN

SEQ ID NO: 107216 - protein, 14 aa, Borrelia burgdorferi B31
NIDNRKEYEITKNA

SEQ ID NO: 107217 - protein, 14 aa, Borrelia burgdorferi B31
IDNRKEYEITKNAP

SEQ ID NO: 107218 - protein, 14 aa, Borrelia burgdorferi B31
DNRKEYEITKNAPS

SEQ ID NO: 107219 - protein, 14 aa, Borrelia burgdorferi B31
NRKEYEITKNAPSL

SEQ ID NO: 107220 - protein, 14 aa, Borrelia burgdorferi B31
RKEYEITKNAPSLD

SEQ ID NO: 107221 - protein, 14 aa, Borrelia burgdorferi B31
KEYEITKNAPSLDS

SEQ ID NO: 107222 - protein, 14 aa, Borrelia burgdorferi B31
EYEITKNAPSLDSL

SEQ ID NO: 107223 - protein, 14 aa, Borrelia burgdorferi B31
YEITKNAPSLDSLI

SEQ ID NO: 107224 - protein, 14 aa, Borrelia burgdorferi B31
EITKNAPSLDSLIE

SEQ ID NO: 107225 - protein, 14 aa, Borrelia burgdorferi B31
ITKNAPSLDSLIEY

SEQ ID NO: 107226 - protein, 14 aa, Borrelia burgdorferi B31
TKNAPSLDSLIEYL

SEQ ID NO: 107227 - protein, 14 aa, Borrelia burgdorferi B31
KNAPSLDSLIEYLE

SEQ ID NO: 107228 - protein, 14 aa, Borrelia burgdorferi B31
NAPSLDSLIEYLEH

SEQ ID NO: 107229 - protein, 14 aa, Borrelia burgdorferi B31
APSLDSLIEYLEHM

SEQ ID NO: 107230 - protein, 14 aa, Borrelia burgdorferi B31
PSLDSLIEYLEHMI

SEQ ID NO: 107231 - protein, 14 aa, Borrelia burgdorferi B31
SLDSLIEYLEHMIL

SEQ ID NO: 107232 - protein, 14 aa, Borrelia burgdorferi B31
LDSLIEYLEHMILF

SEQ ID NO: 107233 - protein, 14 aa, Borrelia burgdorferi B31
DSLIEYLEHMILFF

SEQ ID NO: 107234 - protein, 14 aa, Borrelia burgdorferi B31
SLIEYLEHMILFFL

SEQ ID NO: 107235 - protein, 14 aa, Borrelia burgdorferi B31
LIEYLEHMILFFLE

SEQ ID NO: 107236 - protein, 14 aa, Borrelia burgdorferi B31
IEYLEHMILFFLEK

SEQ ID NO: 107237 - protein, 14 aa, Borrelia burgdorferi B31
EYLEHMILFFLEKT

SEQ ID NO: 107238 - protein, 14 aa, Borrelia burgdorferi B31
YLEHMILFFLEKTP

SEQ ID NO: 107239 - protein, 14 aa, Borrelia burgdorferi B31
LEHMILFFLEKTPV

SEQ ID NO: 107240 - protein, 14 aa, Borrelia burgdorferi B31
EHMILFFLEKTPVG

SEQ ID NO: 107241 - protein, 14 aa, Borrelia burgdorferi B31
HMILFFLEKTPVGT

SEQ ID NO: 107242 - protein, 14 aa, Borrelia burgdorferi B31
MILFFLEKTPVGTL

SEQ ID NO: 107243 - protein, 14 aa, Borrelia burgdorferi B31
ILFFLEKTPVGTLT

SEQ ID NO: 107244 - protein, 14 aa, Borrelia burgdorferi B31
LFFLEKTPVGTLTA

SEQ ID NO: 107245 - protein, 14 aa, Borrelia burgdorferi B31
FFLEKTPVGTLTAK

SEQ ID NO: 107246 - protein, 14 aa, Borrelia burgdorferi B31
FLEKTPVGTLTAKF

SEQ ID NO: 107247 - protein, 14 aa, Borrelia burgdorferi B31
LEKTPVGTLTAKFA

SEQ ID NO: 107248 - protein, 14 aa, Borrelia burgdorferi B31
EKTPVGTLTAKFAM

SEQ ID NO: 107249 - protein, 14 aa, Borrelia burgdorferi B31
KTPVGTLTAKFAME

SEQ ID NO: 107250 - protein, 14 aa, Borrelia burgdorferi B31
TPVGTLTAKFAMEG

SEQ ID NO: 107251 - protein, 14 aa, Borrelia burgdorferi B31
PVGTLTAKFAMEGS

SEQ ID NO: 107252 - protein, 14 aa, Borrelia burgdorferi B31
VGTLTAKFAMEGSI

SEQ ID NO: 107253 - protein, 14 aa, Borrelia burgdorferi B31
GTLTAKFAMEGSIL

SEQ ID NO: 107254 - protein, 14 aa, Borrelia burgdorferi B31
TLTAKFAMEGSILT

SEQ ID NO: 107255 - protein, 14 aa, Borrelia burgdorferi B31
LTAKFAMEGSILTR

SEQ ID NO: 107256 - protein, 14 aa, Borrelia burgdorferi B31
TAKFAMEGSILTRS

SEQ ID NO: 107257 - protein, 14 aa, Borrelia burgdorferi B31
AKFAMEGSILTRSK

SEQ ID NO: 107258 - protein, 14 aa, Borrelia burgdorferi B31
KFAMEGSILTRSKL

SEQ ID NO: 107259 - protein, 14 aa, Borrelia burgdorferi B31
FAMEGSILTRSKLI

SEQ ID NO: 107260 - protein, 14 aa, Borrelia burgdorferi B31
AMEGSILTRSKLIQ

SEQ ID NO: 107261 - protein, 14 aa, Borrelia burgdorferi B31
MEGSILTRSKLIQA

SEQ ID NO: 107262 - protein, 14 aa, Borrelia burgdorferi B31
EGSILTRSKLIQAF

SEQ ID NO: 107263 - protein, 14 aa, Borrelia burgdorferi B31
GSILTRSKLIQAFT

SEQ ID NO: 107264 - protein, 14 aa, Borrelia burgdorferi B31
SILTRSKLIQAFTN

SEQ ID NO: 107265 - protein, 14 aa, Borrelia burgdorferi B31
ILTRSKLIQAFTNT

SEQ ID NO: 107266 - protein, 14 aa, Borrelia burgdorferi B31
LTRSKLIQAFTNTN

SEQ ID NO: 107267 - protein, 14 aa, Borrelia burgdorferi B31
TRSKLIQAFTNTNK

SEQ ID NO: 107268 - protein, 14 aa, Borrelia burgdorferi B31
RSKLIQAFTNTNKF

SEQ ID NO: 107269 - protein, 14 aa, Borrelia burgdorferi B31
SKLIQAFTNTNKFC

SEQ ID NO: 107270 - protein, 14 aa, Borrelia burgdorferi B31
KLIQAFTNTNKFCI

SEQ ID NO: 107271 - protein, 14 aa, Borrelia burgdorferi B31
LIQAFTNTNKFCIP

SEQ ID NO: 107272 - protein, 14 aa, Borrelia burgdorferi B31
IQAFTNTNKFCIPD

SEQ ID NO: 107273 - protein, 14 aa, Borrelia burgdorferi B31
QAFTNTNKFCIPDG

SEQ ID NO: 107274 - protein, 14 aa, Borrelia burgdorferi B31
AFTNTNKFCIPDGR

SEQ ID NO: 107275 - protein, 14 aa, Borrelia burgdorferi B31
FTNTNKFCIPDGRS

SEQ ID NO: 107276 - protein, 14 aa, Borrelia burgdorferi B31
TNTNKFCIPDGRSL

SEQ ID NO: 107277 - protein, 14 aa, Borrelia burgdorferi B31
NTNKFCIPDGRSLP

SEQ ID NO: 107278 - protein, 14 aa, Borrelia burgdorferi B31
TNKFCIPDGRSLPS

SEQ ID NO: 107279 - protein, 14 aa, Borrelia burgdorferi B31
NKFCIPDGRSLPSN

SEQ ID NO: 107280 - protein, 14 aa, Borrelia burgdorferi B31
KFCIPDGRSLPSNC

SEQ ID NO: 107281 - protein, 14 aa, Borrelia burgdorferi B31
FCIPDGRSLPSNCY

SEQ ID NO: 107282 - protein, 14 aa, Borrelia burgdorferi B31
CIPDGRSLPSNCYA

SEQ ID NO: 107283 - protein, 14 aa, Borrelia burgdorferi B31
IPDGRSLPSNCYAY

SEQ ID NO: 107284 - protein, 14 aa, Borrelia burgdorferi B31
PDGRSLPSNCYAYK

SEQ ID NO: 107285 - protein, 14 aa, Borrelia burgdorferi B31
DGRSLPSNCYAYKV

SEQ ID NO: 107286 - protein, 14 aa, Borrelia burgdorferi B31
GRSLPSNCYAYKVL

SEQ ID NO: 107287 - protein, 14 aa, Borrelia burgdorferi B31
RSLPSNCYAYKVLG

SEQ ID NO: 107288 - protein, 14 aa, Borrelia burgdorferi B31
SLPSNCYAYKVLGI

SEQ ID NO: 107289 - protein, 14 aa, Borrelia burgdorferi B31
LPSNCYAYKVLGIS

SEQ ID NO: 107290 - protein, 14 aa, Borrelia burgdorferi B31
PSNCYAYKVLGISS

SEQ ID NO: 107291 - protein, 14 aa, Borrelia burgdorferi B31
SNCYAYKVLGISSA

SEQ ID NO: 107292 - protein, 14 aa, Borrelia burgdorferi B31
NCYAYKVLGISSAP

SEQ ID NO: 107293 - protein, 14 aa, Borrelia burgdorferi B31
CYAYKVLGISSAPK

SEQ ID NO: 107294 - protein, 14 aa, Borrelia burgdorferi B31
YAYKVLGISSAPKL

SEQ ID NO: 107295 - protein, 14 aa, Borrelia burgdorferi B31
AYKVLGISSAPKLS

SEQ ID NO: 107296 - protein, 14 aa, Borrelia burgdorferi B31
YKVLGISSAPKLSG

SEQ ID NO: 107297 - protein, 14 aa, Borrelia burgdorferi B31
KVLGISSAPKLSGR

SEQ ID NO: 107298 - protein, 14 aa, Borrelia burgdorferi B31
VLGISSAPKLSGRF

SEQ ID NO: 107299 - protein, 14 aa, Borrelia burgdorferi B31
LGISSAPKLSGRFL

SEQ ID NO: 107300 - protein, 14 aa, Borrelia burgdorferi B31
GISSAPKLSGRFLR

SEQ ID NO: 107301 - protein, 14 aa, Borrelia burgdorferi B31
ISSAPKLSGRFLRH

SEQ ID NO: 107302 - protein, 14 aa, Borrelia burgdorferi B31
SSAPKLSGRFLRHY

SEQ ID NO: 107303 - protein, 14 aa, Borrelia burgdorferi B31
SAPKLSGRFLRHYD

SEQ ID NO: 107304 - protein, 14 aa, Borrelia burgdorferi B31
APKLSGRFLRHYDS

SEQ ID NO: 107305 - protein, 14 aa, Borrelia burgdorferi B31
PKLSGRFLRHYDSG

SEQ ID NO: 107306 - protein, 14 aa, Borrelia burgdorferi B31
KLSGRFLRHYDSGG

SEQ ID NO: 107307 - protein, 14 aa, Borrelia burgdorferi B31
LSGRFLRHYDSGGS

SEQ ID NO: 107308 - protein, 14 aa, Borrelia burgdorferi B31
SGRFLRHYDSGGST

SEQ ID NO: 107309 - protein, 14 aa, Borrelia burgdorferi B31
GRFLRHYDSGGSTD

SEQ ID NO: 107310 - protein, 14 aa, Borrelia burgdorferi B31
RFLRHYDSGGSTDS

SEQ ID NO: 107311 - protein, 14 aa, Borrelia burgdorferi B31
FLRHYDSGGSTDSD

SEQ ID NO: 107312 - protein, 14 aa, Borrelia burgdorferi B31
LRHYDSGGSTDSDG

SEQ ID NO: 107313 - protein, 14 aa, Borrelia burgdorferi B31
RHYDSGGSTDSDGT

SEQ ID NO: 107314 - protein, 14 aa, Borrelia burgdorferi B31
HYDSGGSTDSDGTR

SEQ ID NO: 107315 - protein, 14 aa, Borrelia burgdorferi B31
YDSGGSTDSDGTRS

SEQ ID NO: 107316 - protein, 14 aa, Borrelia burgdorferi B31
DSGGSTDSDGTRSL

SEQ ID NO: 107317 - protein, 14 aa, Borrelia burgdorferi B31
SGGSTDSDGTRSLG

SEQ ID NO: 107318 - protein, 14 aa, Borrelia burgdorferi B31
GGSTDSDGTRSLGH

SEQ ID NO: 107319 - protein, 14 aa, Borrelia burgdorferi B31
GSTDSDGTRSLGHT

SEQ ID NO: 107320 - protein, 14 aa, Borrelia burgdorferi B31
STDSDGTRSLGHTQ

SEQ ID NO: 107321 - protein, 14 aa, Borrelia burgdorferi B31
TDSDGTRSLGHTQE

SEQ ID NO: 107322 - protein, 14 aa, Borrelia burgdorferi B31
DSDGTRSLGHTQED

SEQ ID NO: 107323 - protein, 14 aa, Borrelia burgdorferi B31
SDGTRSLGHTQEDS

SEQ ID NO: 107324 - protein, 14 aa, Borrelia burgdorferi B31
DGTRSLGHTQEDSY

SEQ ID NO: 107325 - protein, 14 aa, Borrelia burgdorferi B31
GTRSLGHTQEDSYK

SEQ ID NO: 107326 - protein, 14 aa, Borrelia burgdorferi B31
TRSLGHTQEDSYKN

SEQ ID NO: 107327 - protein, 14 aa, Borrelia burgdorferi B31
RSLGHTQEDSYKNH

SEQ ID NO: 107328 - protein, 14 aa, Borrelia burgdorferi B31
SLGHTQEDSYKNHD

SEQ ID NO: 107329 - protein, 14 aa, Borrelia burgdorferi B31
LGHTQEDSYKNHDH

SEQ ID NO: 107330 - protein, 14 aa, Borrelia burgdorferi B31
GHTQEDSYKNHDHD

SEQ ID NO: 107331 - protein, 14 aa, Borrelia burgdorferi B31
HTQEDSYKNHDHDL

SEQ ID NO: 107332 - protein, 14 aa, Borrelia burgdorferi B31
TQEDSYKNHDHDLD

SEQ ID NO: 107333 - protein, 14 aa, Borrelia burgdorferi B31
QEDSYKNHDHDLDF

SEQ ID NO: 107334 - protein, 14 aa, Borrelia burgdorferi B31
EDSYKNHDHDLDFS

SEQ ID NO: 107335 - protein, 14 aa, Borrelia burgdorferi B31
DSYKNHDHDLDFSR

SEQ ID NO: 107336 - protein, 14 aa, Borrelia burgdorferi B31
SYKNHDHDLDFSRI

SEQ ID NO: 107337 - protein, 14 aa, Borrelia burgdorferi B31
YKNHDHDLDFSRIN

SEQ ID NO: 107338 - protein, 14 aa, Borrelia burgdorferi B31
KNHDHDLDFSRINF

SEQ ID NO: 107339 - protein, 14 aa, Borrelia burgdorferi B31
NHDHDLDFSRINFK

SEQ ID NO: 107340 - protein, 14 aa, Borrelia burgdorferi B31
HDHDLDFSRINFKG

SEQ ID NO: 107341 - protein, 14 aa, Borrelia burgdorferi B31
DHDLDFSRINFKGK

SEQ ID NO: 107342 - protein, 14 aa, Borrelia burgdorferi B31
HDLDFSRINFKGKL

SEQ ID NO: 107343 - protein, 14 aa, Borrelia burgdorferi B31
DLDFSRINFKGKLV

SEQ ID NO: 107344 - protein, 14 aa, Borrelia burgdorferi B31
LDFSRINFKGKLVK

SEQ ID NO: 107345 - protein, 14 aa, Borrelia burgdorferi B31
DFSRINFKGKLVKR

SEQ ID NO: 107346 - protein, 14 aa, Borrelia burgdorferi B31
FSRINFKGKLVKRM

SEQ ID NO: 107347 - protein, 14 aa, Borrelia burgdorferi B31
SRINFKGKLVKRMT

SEQ ID NO: 107348 - protein, 14 aa, Borrelia burgdorferi B31
RINFKGKLVKRMTM

SEQ ID NO: 107349 - protein, 14 aa, Borrelia burgdorferi B31
INFKGKLVKRMTMI

SEQ ID NO: 107350 - protein, 14 aa, Borrelia burgdorferi B31
NFKGKLVKRMTMIY

SEQ ID NO: 107351 - protein, 14 aa, Borrelia burgdorferi B31
FKGKLVKRMTMIYR

SEQ ID NO: 107352 - protein, 14 aa, Borrelia burgdorferi B31
KGKLVKRMTMIYRS

SEQ ID NO: 107353 - protein, 14 aa, Borrelia burgdorferi B31
GKLVKRMTMIYRSA

SEQ ID NO: 107354 - protein, 14 aa, Borrelia burgdorferi B31
KLVKRMTMIYRSAD

SEQ ID NO: 107355 - protein, 14 aa, Borrelia burgdorferi B31
LVKRMTMIYRSADT

SEQ ID NO: 107356 - protein, 14 aa, Borrelia burgdorferi B31
VKRMTMIYRSADTW

SEQ ID NO: 107357 - protein, 14 aa, Borrelia burgdorferi B31
KRMTMIYRSADTWY

SEQ ID NO: 107358 - protein, 14 aa, Borrelia burgdorferi B31
RMTMIYRSADTWYT

SEQ ID NO: 107359 - protein, 14 aa, Borrelia burgdorferi B31
MTMIYRSADTWYTW

SEQ ID NO: 107360 - protein, 14 aa, Borrelia burgdorferi B31
TMIYRSADTWYTWY

SEQ ID NO: 107361 - protein, 14 aa, Borrelia burgdorferi B31
MIYRSADTWYTWYW

SEQ ID NO: 107362 - protein, 14 aa, Borrelia burgdorferi B31
IYRSADTWYTWYWA

SEQ ID NO: 107363 - protein, 14 aa, Borrelia burgdorferi B31
YRSADTWYTWYWAE

SEQ ID NO: 107364 - protein, 14 aa, Borrelia burgdorferi B31
RSADTWYTWYWAEE

SEQ ID NO: 107365 - protein, 14 aa, Borrelia burgdorferi B31
SADTWYTWYWAEEI

SEQ ID NO: 107366 - protein, 14 aa, Borrelia burgdorferi B31
ADTWYTWYWAEEIM

SEQ ID NO: 107367 - protein, 14 aa, Borrelia burgdorferi B31
DTWYTWYWAEEIMS

SEQ ID NO: 107368 - protein, 14 aa, Borrelia burgdorferi B31
TWYTWYWAEEIMSP

SEQ ID NO: 107369 - protein, 14 aa, Borrelia burgdorferi B31
WYTWYWAEEIMSPF

SEQ ID NO: 107370 - protein, 14 aa, Borrelia burgdorferi B31
YTWYWAEEIMSPFI

SEQ ID NO: 107371 - protein, 14 aa, Borrelia burgdorferi B31
TWYWAEEIMSPFIT

SEQ ID NO: 107372 - protein, 14 aa, Borrelia burgdorferi B31
WYWAEEIMSPFITG

SEQ ID NO: 107373 - protein, 14 aa, Borrelia burgdorferi B31
YWAEEIMSPFITGY

SEQ ID NO: 107374 - protein, 14 aa, Borrelia burgdorferi B31
WAEEIMSPFITGYS

SEQ ID NO: 107375 - protein, 14 aa, Borrelia burgdorferi B31
AEEIMSPFITGYSY

SEQ ID NO: 107376 - protein, 14 aa, Borrelia burgdorferi B31
EEIMSPFITGYSYE

SEQ ID NO: 107377 - protein, 14 aa, Borrelia burgdorferi B31
EIMSPFITGYSYEE

SEQ ID NO: 107378 - protein, 14 aa, Borrelia burgdorferi B31
IMSPFITGYSYEEI

SEQ ID NO: 107379 - protein, 14 aa, Borrelia burgdorferi B31
MSPFITGYSYEEID

SEQ ID NO: 107380 - protein, 14 aa, Borrelia burgdorferi B31
SPFITGYSYEEIDP

SEQ ID NO: 107381 - protein, 14 aa, Borrelia burgdorferi B31
PFITGYSYEEIDPE

SEQ ID NO: 107382 - protein, 14 aa, Borrelia burgdorferi B31
FITGYSYEEIDPEY

SEQ ID NO: 107383 - protein, 14 aa, Borrelia burgdorferi B31
ITGYSYEEIDPEYL

SEQ ID NO: 107384 - protein, 14 aa, Borrelia burgdorferi B31
TGYSYEEIDPEYLL

SEQ ID NO: 107385 - protein, 14 aa, Borrelia burgdorferi B31
GYSYEEIDPEYLLP

SEQ ID NO: 107386 - protein, 14 aa, Borrelia burgdorferi B31
YSYEEIDPEYLLPP

SEQ ID NO: 107387 - protein, 14 aa, Borrelia burgdorferi B31
SYEEIDPEYLLPPF

SEQ ID NO: 107388 - protein, 14 aa, Borrelia burgdorferi B31
YEEIDPEYLLPPFT

SEQ ID NO: 107389 - protein, 14 aa, Borrelia burgdorferi B31
EEIDPEYLLPPFTS

SEQ ID NO: 107390 - protein, 14 aa, Borrelia burgdorferi B31
EIDPEYLLPPFTSQ

SEQ ID NO: 107391 - protein, 14 aa, Borrelia burgdorferi B31
IDPEYLLPPFTSQS

SEQ ID NO: 107392 - protein, 14 aa, Borrelia burgdorferi B31
DPEYLLPPFTSQSG

SEQ ID NO: 107393 - protein, 14 aa, Borrelia burgdorferi B31
PEYLLPPFTSQSGS

SEQ ID NO: 107394 - protein, 14 aa, Borrelia burgdorferi B31
EYLLPPFTSQSGSK

SEQ ID NO: 107395 - protein, 14 aa, Borrelia burgdorferi B31
YLLPPFTSQSGSKE

SEQ ID NO: 107396 - protein, 14 aa, Borrelia burgdorferi B31
LLPPFTSQSGSKET

SEQ ID NO: 107397 - protein, 14 aa, Borrelia burgdorferi B31
LPPFTSQSGSKETK

SEQ ID NO: 107398 - protein, 14 aa, Borrelia burgdorferi B31
PPFTSQSGSKETKP

SEQ ID NO: 107399 - protein, 14 aa, Borrelia burgdorferi B31
PFTSQSGSKETKPK

SEQ ID NO: 107400 - protein, 14 aa, Borrelia burgdorferi B31
FTSQSGSKETKPKN

SEQ ID NO: 107401 - protein, 14 aa, Borrelia burgdorferi B31
TSQSGSKETKPKNT

SEQ ID NO: 107402 - protein, 14 aa, Borrelia burgdorferi B31
SQSGSKETKPKNTC

SEQ ID NO: 107403 - protein, 14 aa, Borrelia burgdorferi B31
QSGSKETKPKNTCY

SEQ ID NO: 107404 - protein, 14 aa, Borrelia burgdorferi B31
SGSKETKPKNTCYI

SEQ ID NO: 107405 - protein, 14 aa, Borrelia burgdorferi B31
GSKETKPKNTCYIS

SEQ ID NO: 107406 - protein, 14 aa, Borrelia burgdorferi B31
SKETKPKNTCYISF

SEQ ID NO: 107407 - protein, 14 aa, Borrelia burgdorferi B31
KETKPKNTCYISFY

SEQ ID NO: 107408 - protein, 14 aa, Borrelia burgdorferi B31
ETKPKNTCYISFYR

SEQ ID NO: 107409 - protein, 14 aa, Borrelia burgdorferi B31
TKPKNTCYISFYRY

SEQ ID NO: 107410 - protein, 14 aa, Borrelia burgdorferi B31
KPKNTCYISFYRYD

SEQ ID NO: 107411 - protein, 14 aa, Borrelia burgdorferi B31
PKNTCYISFYRYDL

SEQ ID NO: 107412 - protein, 15 aa, Borrelia burgdorferi B31
MITQQDYTEIKKKLE

SEQ ID NO: 107413 - protein, 15 aa, Borrelia burgdorferi B31
ITQQDYTEIKKKLEN

SEQ ID NO: 107414 - protein, 15 aa, Borrelia burgdorferi B31
TQQDYTEIKKKLENT

SEQ ID NO: 107415 - protein, 15 aa, Borrelia burgdorferi B31
QQDYTEIKKKLENTK

SEQ ID NO: 107416 - protein, 15 aa, Borrelia burgdorferi B31
QDYTEIKKKLENTKT

SEQ ID NO: 107417 - protein, 15 aa, Borrelia burgdorferi B31
DYTEIKKKLENTKTR

SEQ ID NO: 107418 - protein, 15 aa, Borrelia burgdorferi B31
YTEIKKKLENTKTRI

SEQ ID NO: 107419 - protein, 15 aa, Borrelia burgdorferi B31
TEIKKKLENTKTRIQ

SEQ ID NO: 107420 - protein, 15 aa, Borrelia burgdorferi B31
EIKKKLENTKTRIQF

SEQ ID NO: 107421 - protein, 15 aa, Borrelia burgdorferi B31
IKKKLENTKTRIQFR

SEQ ID NO: 107422 - protein, 15 aa, Borrelia burgdorferi B31
KKKLENTKTRIQFRN

SEQ ID NO: 107423 - protein, 15 aa, Borrelia burgdorferi B31
KKLENTKTRIQFRNG

SEQ ID NO: 107424 - protein, 15 aa, Borrelia burgdorferi B31
KLENTKTRIQFRNGN

SEQ ID NO: 107425 - protein, 15 aa, Borrelia burgdorferi B31
LENTKTRIQFRNGNK

SEQ ID NO: 107426 - protein, 15 aa, Borrelia burgdorferi B31
ENTKTRIQFRNGNKI

SEQ ID NO: 107427 - protein, 15 aa, Borrelia burgdorferi B31
NTKTRIQFRNGNKID

SEQ ID NO: 107428 - protein, 15 aa, Borrelia burgdorferi B31
TKTRIQFRNGNKIDS

SEQ ID NO: 107429 - protein, 15 aa, Borrelia burgdorferi B31
KTRIQFRNGNKIDSL

SEQ ID NO: 107430 - protein, 15 aa, Borrelia burgdorferi B31
TRIQFRNGNKIDSLG

SEQ ID NO: 107431 - protein, 15 aa, Borrelia burgdorferi B31
RIQFRNGNKIDSLGY

SEQ ID NO: 107432 - protein, 15 aa, Borrelia burgdorferi B31
IQFRNGNKIDSLGYQ

SEQ ID NO: 107433 - protein, 15 aa, Borrelia burgdorferi B31
QFRNGNKIDSLGYQG

SEQ ID NO: 107434 - protein, 15 aa, Borrelia burgdorferi B31
FRNGNKIDSLGYQGS

SEQ ID NO: 107435 - protein, 15 aa, Borrelia burgdorferi B31
RNGNKIDSLGYQGSL

SEQ ID NO: 107436 - protein, 15 aa, Borrelia burgdorferi B31
NGNKIDSLGYQGSLG

SEQ ID NO: 107437 - protein, 15 aa, Borrelia burgdorferi B31
GNKIDSLGYQGSLGE

SEQ ID NO: 107438 - protein, 15 aa, Borrelia burgdorferi B31
NKIDSLGYQGSLGEP

SEQ ID NO: 107439 - protein, 15 aa, Borrelia burgdorferi B31
KIDSLGYQGSLGEPI

SEQ ID NO: 107440 - protein, 15 aa, Borrelia burgdorferi B31
IDSLGYQGSLGEPIL

SEQ ID NO: 107441 - protein, 15 aa, Borrelia burgdorferi B31
DSLGYQGSLGEPILL

SEQ ID NO: 107442 - protein, 15 aa, Borrelia burgdorferi B31
SLGYQGSLGEPILLK

SEQ ID NO: 107443 - protein, 15 aa, Borrelia burgdorferi B31
LGYQGSLGEPILLKD

SEQ ID NO: 107444 - protein, 15 aa, Borrelia burgdorferi B31
GYQGSLGEPILLKDK

SEQ ID NO: 107445 - protein, 15 aa, Borrelia burgdorferi B31
YQGSLGEPILLKDKL

SEQ ID NO: 107446 - protein, 15 aa, Borrelia burgdorferi B31
QGSLGEPILLKDKLT

SEQ ID NO: 107447 - protein, 15 aa, Borrelia burgdorferi B31
GSLGEPILLKDKLTF

SEQ ID NO: 107448 - protein, 15 aa, Borrelia burgdorferi B31
SLGEPILLKDKLTFS

SEQ ID NO: 107449 - protein, 15 aa, Borrelia burgdorferi B31
LGEPILLKDKLTFSI

SEQ ID NO: 107450 - protein, 15 aa, Borrelia burgdorferi B31
GEPILLKDKLTFSIC

SEQ ID NO: 107451 - protein, 15 aa, Borrelia burgdorferi B31
EPILLKDKLTFSICD

SEQ ID NO: 107452 - protein, 15 aa, Borrelia burgdorferi B31
PILLKDKLTFSICDG

SEQ ID NO: 107453 - protein, 15 aa, Borrelia burgdorferi B31
ILLKDKLTFSICDGK

SEQ ID NO: 107454 - protein, 15 aa, Borrelia burgdorferi B31
LLKDKLTFSICDGKN

SEQ ID NO: 107455 - protein, 15 aa, Borrelia burgdorferi B31
LKDKLTFSICDGKNI

SEQ ID NO: 107456 - protein, 15 aa, Borrelia burgdorferi B31
KDKLTFSICDGKNID

SEQ ID NO: 107457 - protein, 15 aa, Borrelia burgdorferi B31
DKLTFSICDGKNIDN

SEQ ID NO: 107458 - protein, 15 aa, Borrelia burgdorferi B31
KLTFSICDGKNIDNR

SEQ ID NO: 107459 - protein, 15 aa, Borrelia burgdorferi B31
LTFSICDGKNIDNRK

SEQ ID NO: 107460 - protein, 15 aa, Borrelia burgdorferi B31
TFSICDGKNIDNRKE

SEQ ID NO: 107461 - protein, 15 aa, Borrelia burgdorferi B31
FSICDGKNIDNRKEY

SEQ ID NO: 107462 - protein, 15 aa, Borrelia burgdorferi B31
SICDGKNIDNRKEYE

SEQ ID NO: 107463 - protein, 15 aa, Borrelia burgdorferi B31
ICDGKNIDNRKEYEI

SEQ ID NO: 107464 - protein, 15 aa, Borrelia burgdorferi B31
CDGKNIDNRKEYEIT

SEQ ID NO: 107465 - protein, 15 aa, Borrelia burgdorferi B31
DGKNIDNRKEYEITK

SEQ ID NO: 107466 - protein, 15 aa, Borrelia burgdorferi B31
GKNIDNRKEYEITKN

SEQ ID NO: 107467 - protein, 15 aa, Borrelia burgdorferi B31
KNIDNRKEYEITKNA

SEQ ID NO: 107468 - protein, 15 aa, Borrelia burgdorferi B31
NIDNRKEYEITKNAP

SEQ ID NO: 107469 - protein, 15 aa, Borrelia burgdorferi B31
IDNRKEYEITKNAPS

SEQ ID NO: 107470 - protein, 15 aa, Borrelia burgdorferi B31
DNRKEYEITKNAPSL

SEQ ID NO: 107471 - protein, 15 aa, Borrelia burgdorferi B31
NRKEYEITKNAPSLD

SEQ ID NO: 107472 - protein, 15 aa, Borrelia burgdorferi B31
RKEYEITKNAPSLDS

SEQ ID NO: 107473 - protein, 15 aa, Borrelia burgdorferi B31
KEYEITKNAPSLDSL

SEQ ID NO: 107474 - protein, 15 aa, Borrelia burgdorferi B31
EYEITKNAPSLDSLI

SEQ ID NO: 107475 - protein, 15 aa, Borrelia burgdorferi B31
YEITKNAPSLDSLIE

SEQ ID NO: 107476 - protein, 15 aa, Borrelia burgdorferi B31
EITKNAPSLDSLIEY

SEQ ID NO: 107477 - protein, 15 aa, Borrelia burgdorferi B31
ITKNAPSLDSLIEYL

SEQ ID NO: 107478 - protein, 15 aa, Borrelia burgdorferi B31
TKNAPSLDSLIEYLE

SEQ ID NO: 107479 - protein, 15 aa, Borrelia burgdorferi B31
KNAPSLDSLIEYLEH

SEQ ID NO: 107480 - protein, 15 aa, Borrelia burgdorferi B31
NAPSLDSLIEYLEHM

SEQ ID NO: 107481 - protein, 15 aa, Borrelia burgdorferi B31
APSLDSLIEYLEHMI

SEQ ID NO: 107482 - protein, 15 aa, Borrelia burgdorferi B31
PSLDSLIEYLEHMIL

SEQ ID NO: 107483 - protein, 15 aa, Borrelia burgdorferi B31
SLDSLIEYLEHMILF

SEQ ID NO: 107484 - protein, 15 aa, Borrelia burgdorferi B31
LDSLIEYLEHMILFF

SEQ ID NO: 107485 - protein, 15 aa, Borrelia burgdorferi B31
DSLIEYLEHMILFFL

SEQ ID NO: 107486 - protein, 15 aa, Borrelia burgdorferi B31
SLIEYLEHMILFFLE

SEQ ID NO: 107487 - protein, 15 aa, Borrelia burgdorferi B31
LIEYLEHMILFFLEK

SEQ ID NO: 107488 - protein, 15 aa, Borrelia burgdorferi B31
IEYLEHMILFFLEKT

SEQ ID NO: 107489 - protein, 15 aa, Borrelia burgdorferi B31
EYLEHMILFFLEKTP

SEQ ID NO: 107490 - protein, 15 aa, Borrelia burgdorferi B31
YLEHMILFFLEKTPV

SEQ ID NO: 107491 - protein, 15 aa, Borrelia burgdorferi B31
LEHMILFFLEKTPVG

SEQ ID NO: 107492 - protein, 15 aa, Borrelia burgdorferi B31
EHMILFFLEKTPVGT

SEQ ID NO: 107493 - protein, 15 aa, Borrelia burgdorferi B31
HMILFFLEKTPVGTL

SEQ ID NO: 107494 - protein, 15 aa, Borrelia burgdorferi B31
MILFFLEKTPVGTLT

SEQ ID NO: 107495 - protein, 15 aa, Borrelia burgdorferi B31
ILFFLEKTPVGTLTA

SEQ ID NO: 107496 - protein, 15 aa, Borrelia burgdorferi B31
LFFLEKTPVGTLTAK

SEQ ID NO: 107497 - protein, 15 aa, Borrelia burgdorferi B31
FFLEKTPVGTLTAKF

SEQ ID NO: 107498 - protein, 15 aa, Borrelia burgdorferi B31
FLEKTPVGTLTAKFA

SEQ ID NO: 107499 - protein, 15 aa, Borrelia burgdorferi B31
LEKTPVGTLTAKFAM

SEQ ID NO: 107500 - protein, 15 aa, Borrelia burgdorferi B31
EKTPVGTLTAKFAME

SEQ ID NO: 107501 - protein, 15 aa, Borrelia burgdorferi B31
KTPVGTLTAKFAMEG

SEQ ID NO: 107502 - protein, 15 aa, Borrelia burgdorferi B31
TPVGTLTAKFAMEGS

SEQ ID NO: 107503 - protein, 15 aa, Borrelia burgdorferi B31
PVGTLTAKFAMEGSI

SEQ ID NO: 107504 - protein, 15 aa, Borrelia burgdorferi B31
VGTLTAKFAMEGSIL

SEQ ID NO: 107505 - protein, 15 aa, Borrelia burgdorferi B31
GTLTAKFAMEGSILT

SEQ ID NO: 107506 - protein, 15 aa, Borrelia burgdorferi B31
TLTAKFAMEGSILTR

SEQ ID NO: 107507 - protein, 15 aa, Borrelia burgdorferi B31
LTAKFAMEGSILTRS

SEQ ID NO: 107508 - protein, 15 aa, Borrelia burgdorferi B31
TAKFAMEGSILTRSK

SEQ ID NO: 107509 - protein, 15 aa, Borrelia burgdorferi B31
AKFAMEGSILTRSKL

SEQ ID NO: 107510 - protein, 15 aa, Borrelia burgdorferi B31
KFAMEGSILTRSKLI

SEQ ID NO: 107511 - protein, 15 aa, Borrelia burgdorferi B31
FAMEGSILTRSKLIQ

SEQ ID NO: 107512 - protein, 15 aa, Borrelia burgdorferi B31
AMEGSILTRSKLIQA

SEQ ID NO: 107513 - protein, 15 aa, Borrelia burgdorferi B31
MEGSILTRSKLIQAF

SEQ ID NO: 107514 - protein, 15 aa, Borrelia burgdorferi B31
EGSILTRSKLIQAFT

SEQ ID NO: 107515 - protein, 15 aa, Borrelia burgdorferi B31
GSILTRSKLIQAFTN

SEQ ID NO: 107516 - protein, 15 aa, Borrelia burgdorferi B31
SILTRSKLIQAFTNT

SEQ ID NO: 107517 - protein, 15 aa, Borrelia burgdorferi B31
ILTRSKLIQAFTNTN

SEQ ID NO: 107518 - protein, 15 aa, Borrelia burgdorferi B31
LTRSKLIQAFTNTNK

SEQ ID NO: 107519 - protein, 15 aa, Borrelia burgdorferi B31
TRSKLIQAFTNTNKF

SEQ ID NO: 107520 - protein, 15 aa, Borrelia burgdorferi B31
RSKLIQAFTNTNKFC

SEQ ID NO: 107521 - protein, 15 aa, Borrelia burgdorferi B31
SKLIQAFTNTNKFCI

SEQ ID NO: 107522 - protein, 15 aa, Borrelia burgdorferi B31
KLIQAFTNTNKFCIP

SEQ ID NO: 107523 - protein, 15 aa, Borrelia burgdorferi B31
LIQAFTNTNKFCIPD

SEQ ID NO: 107524 - protein, 15 aa, Borrelia burgdorferi B31
IQAFTNTNKFCIPDG

SEQ ID NO: 107525 - protein, 15 aa, Borrelia burgdorferi B31
QAFTNTNKFCIPDGR

SEQ ID NO: 107526 - protein, 15 aa, Borrelia burgdorferi B31
AFTNTNKFCIPDGRS

SEQ ID NO: 107527 - protein, 15 aa, Borrelia burgdorferi B31
FTNTNKFCIPDGRSL

SEQ ID NO: 107528 - protein, 15 aa, Borrelia burgdorferi B31
TNTNKFCIPDGRSLP

SEQ ID NO: 107529 - protein, 15 aa, Borrelia burgdorferi B31
NTNKFCIPDGRSLPS

SEQ ID NO: 107530 - protein, 15 aa, Borrelia burgdorferi B31
TNKFCIPDGRSLPSN

SEQ ID NO: 107531 - protein, 15 aa, Borrelia burgdorferi B31
NKFCIPDGRSLPSNC

SEQ ID NO: 107532 - protein, 15 aa, Borrelia burgdorferi B31
KFCIPDGRSLPSNCY

SEQ ID NO: 107533 - protein, 15 aa, Borrelia burgdorferi B31
FCIPDGRSLPSNCYA

SEQ ID NO: 107534 - protein, 15 aa, Borrelia burgdorferi B31
CIPDGRSLPSNCYAY

SEQ ID NO: 107535 - protein, 15 aa, Borrelia burgdorferi B31
IPDGRSLPSNCYAYK

SEQ ID NO: 107536 - protein, 15 aa, Borrelia burgdorferi B31
PDGRSLPSNCYAYKV

SEQ ID NO: 107537 - protein, 15 aa, Borrelia burgdorferi B31
DGRSLPSNCYAYKVL

SEQ ID NO: 107538 - protein, 15 aa, Borrelia burgdorferi B31
GRSLPSNCYAYKVLG

SEQ ID NO: 107539 - protein, 15 aa, Borrelia burgdorferi B31
RSLPSNCYAYKVLGI

SEQ ID NO: 107540 - protein, 15 aa, Borrelia burgdorferi B31
SLPSNCYAYKVLGIS

SEQ ID NO: 107541 - protein, 15 aa, Borrelia burgdorferi B31
LPSNCYAYKVLGISS

SEQ ID NO: 107542 - protein, 15 aa, Borrelia burgdorferi B31
PSNCYAYKVLGISSA

SEQ ID NO: 107543 - protein, 15 aa, Borrelia burgdorferi B31
SNCYAYKVLGISSAP

SEQ ID NO: 107544 - protein, 15 aa, Borrelia burgdorferi B31
NCYAYKVLGISSAPK

SEQ ID NO: 107545 - protein, 15 aa, Borrelia burgdorferi B31
CYAYKVLGISSAPKL

SEQ ID NO: 107546 - protein, 15 aa, Borrelia burgdorferi B31
YAYKVLGISSAPKLS

SEQ ID NO: 107547 - protein, 15 aa, Borrelia burgdorferi B31
AYKVLGISSAPKLSG

SEQ ID NO: 107548 - protein, 15 aa, Borrelia burgdorferi B31
YKVLGISSAPKLSGR

SEQ ID NO: 107549 - protein, 15 aa, Borrelia burgdorferi B31
KVLGISSAPKLSGRF

SEQ ID NO: 107550 - protein, 15 aa, Borrelia burgdorferi B31
VLGISSAPKLSGRFL

SEQ ID NO: 107551 - protein, 15 aa, Borrelia burgdorferi B31
LGISSAPKLSGRFLR

SEQ ID NO: 107552 - protein, 15 aa, Borrelia burgdorferi B31
GISSAPKLSGRFLRH

SEQ ID NO: 107553 - protein, 15 aa, Borrelia burgdorferi B31
ISSAPKLSGRFLRHY

SEQ ID NO: 107554 - protein, 15 aa, Borrelia burgdorferi B31
SSAPKLSGRFLRHYD

SEQ ID NO: 107555 - protein, 15 aa, Borrelia burgdorferi B31
SAPKLSGRFLRHYDS

SEQ ID NO: 107556 - protein, 15 aa, Borrelia burgdorferi B31
APKLSGRFLRHYDSG

SEQ ID NO: 107557 - protein, 15 aa, Borrelia burgdorferi B31
PKLSGRFLRHYDSGG

SEQ ID NO: 107558 - protein, 15 aa, Borrelia burgdorferi B31
KLSGRFLRHYDSGGS

SEQ ID NO: 107559 - protein, 15 aa, Borrelia burgdorferi B31
LSGRFLRHYDSGGST

SEQ ID NO: 107560 - protein, 15 aa, Borrelia burgdorferi B31
SGRFLRHYDSGGSTD

SEQ ID NO: 107561 - protein, 15 aa, Borrelia burgdorferi B31
GRFLRHYDSGGSTDS

SEQ ID NO: 107562 - protein, 15 aa, Borrelia burgdorferi B31
RFLRHYDSGGSTDSD

SEQ ID NO: 107563 - protein, 15 aa, Borrelia burgdorferi B31
FLRHYDSGGSTDSDG

SEQ ID NO: 107564 - protein, 15 aa, Borrelia burgdorferi B31
LRHYDSGGSTDSDGT

SEQ ID NO: 107565 - protein, 15 aa, Borrelia burgdorferi B31
RHYDSGGSTDSDGTR

SEQ ID NO: 107566 - protein, 15 aa, Borrelia burgdorferi B31
HYDSGGSTDSDGTRS

SEQ ID NO: 107567 - protein, 15 aa, Borrelia burgdorferi B31
YDSGGSTDSDGTRSL

SEQ ID NO: 107568 - protein, 15 aa, Borrelia burgdorferi B31
DSGGSTDSDGTRSLG

SEQ ID NO: 107569 - protein, 15 aa, Borrelia burgdorferi B31
SGGSTDSDGTRSLGH

SEQ ID NO: 107570 - protein, 15 aa, Borrelia burgdorferi B31
GGSTDSDGTRSLGHT

SEQ ID NO: 107571 - protein, 15 aa, Borrelia burgdorferi B31
GSTDSDGTRSLGHTQ

SEQ ID NO: 107572 - protein, 15 aa, Borrelia burgdorferi B31
STDSDGTRSLGHTQE

SEQ ID NO: 107573 - protein, 15 aa, Borrelia burgdorferi B31
TDSDGTRSLGHTQED

SEQ ID NO: 107574 - protein, 15 aa, Borrelia burgdorferi B31
DSDGTRSLGHTQEDS

SEQ ID NO: 107575 - protein, 15 aa, Borrelia burgdorferi B31
SDGTRSLGHTQEDSY

SEQ ID NO: 107576 - protein, 15 aa, Borrelia burgdorferi B31
DGTRSLGHTQEDSYK

SEQ ID NO: 107577 - protein, 15 aa, Borrelia burgdorferi B31
GTRSLGHTQEDSYKN

SEQ ID NO: 107578 - protein, 15 aa, Borrelia burgdorferi B31
TRSLGHTQEDSYKNH

SEQ ID NO: 107579 - protein, 15 aa, Borrelia burgdorferi B31
RSLGHTQEDSYKNHD

SEQ ID NO: 107580 - protein, 15 aa, Borrelia burgdorferi B31
SLGHTQEDSYKNHDH

SEQ ID NO: 107581 - protein, 15 aa, Borrelia burgdorferi B31
LGHTQEDSYKNHDHD

SEQ ID NO: 107582 - protein, 15 aa, Borrelia burgdorferi B31
GHTQEDSYKNHDHDL

SEQ ID NO: 107583 - protein, 15 aa, Borrelia burgdorferi B31
HTQEDSYKNHDHDLD

SEQ ID NO: 107584 - protein, 15 aa, Borrelia burgdorferi B31
TQEDSYKNHDHDLDF

SEQ ID NO: 107585 - protein, 15 aa, Borrelia burgdorferi B31
QEDSYKNHDHDLDFS

SEQ ID NO: 107586 - protein, 15 aa, Borrelia burgdorferi B31
EDSYKNHDHDLDFSR

SEQ ID NO: 107587 - protein, 15 aa, Borrelia burgdorferi B31
DSYKNHDHDLDFSRI

SEQ ID NO: 107588 - protein, 15 aa, Borrelia burgdorferi B31
SYKNHDHDLDFSRIN

SEQ ID NO: 107589 - protein, 15 aa, Borrelia burgdorferi B31
YKNHDHDLDFSRINF

SEQ ID NO: 107590 - protein, 15 aa, Borrelia burgdorferi B31
KNHDHDLDFSRINFK

SEQ ID NO: 107591 - protein, 15 aa, Borrelia burgdorferi B31
NHDHDLDFSRINFKG

SEQ ID NO: 107592 - protein, 15 aa, Borrelia burgdorferi B31
HDHDLDFSRINFKGK

SEQ ID NO: 107593 - protein, 15 aa, Borrelia burgdorferi B31
DHDLDFSRINFKGKL

SEQ ID NO: 107594 - protein, 15 aa, Borrelia burgdorferi B31
HDLDFSRINFKGKLV

SEQ ID NO: 107595 - protein, 15 aa, Borrelia burgdorferi B31
DLDFSRINFKGKLVK

SEQ ID NO: 107596 - protein, 15 aa, Borrelia burgdorferi B31
LDFSRINFKGKLVKR

SEQ ID NO: 107597 - protein, 15 aa, Borrelia burgdorferi B31
DFSRINFKGKLVKRM

SEQ ID NO: 107598 - protein, 15 aa, Borrelia burgdorferi B31
FSRINFKGKLVKRMT

SEQ ID NO: 107599 - protein, 15 aa, Borrelia burgdorferi B31
SRINFKGKLVKRMTM

SEQ ID NO: 107600 - protein, 15 aa, Borrelia burgdorferi B31
RINFKGKLVKRMTMI

SEQ ID NO: 107601 - protein, 15 aa, Borrelia burgdorferi B31
INFKGKLVKRMTMIY

SEQ ID NO: 107602 - protein, 15 aa, Borrelia burgdorferi B31
NFKGKLVKRMTMIYR

SEQ ID NO: 107603 - protein, 15 aa, Borrelia burgdorferi B31
FKGKLVKRMTMIYRS

SEQ ID NO: 107604 - protein, 15 aa, Borrelia burgdorferi B31
KGKLVKRMTMIYRSA

SEQ ID NO: 107605 - protein, 15 aa, Borrelia burgdorferi B31
GKLVKRMTMIYRSAD

SEQ ID NO: 107606 - protein, 15 aa, Borrelia burgdorferi B31
KLVKRMTMIYRSADT

SEQ ID NO: 107607 - protein, 15 aa, Borrelia burgdorferi B31
LVKRMTMIYRSADTW

SEQ ID NO: 107608 - protein, 15 aa, Borrelia burgdorferi B31
VKRMTMIYRSADTWY

SEQ ID NO: 107609 - protein, 15 aa, Borrelia burgdorferi B31
KRMTMIYRSADTWYT

SEQ ID NO: 107610 - protein, 15 aa, Borrelia burgdorferi B31
RMTMIYRSADTWYTW

SEQ ID NO: 107611 - protein, 15 aa, Borrelia burgdorferi B31
MTMIYRSADTWYTWY

SEQ ID NO: 107612 - protein, 15 aa, Borrelia burgdorferi B31
TMIYRSADTWYTWYW

SEQ ID NO: 107613 - protein, 15 aa, Borrelia burgdorferi B31
MIYRSADTWYTWYWA

SEQ ID NO: 107614 - protein, 15 aa, Borrelia burgdorferi B31
IYRSADTWYTWYWAE

SEQ ID NO: 107615 - protein, 15 aa, Borrelia burgdorferi B31
YRSADTWYTWYWAEE

SEQ ID NO: 107616 - protein, 15 aa, Borrelia burgdorferi B31
RSADTWYTWYWAEEI

SEQ ID NO: 107617 - protein, 15 aa, Borrelia burgdorferi B31
SADTWYTWYWAEEIM

SEQ ID NO: 107618 - protein, 15 aa, Borrelia burgdorferi B31
ADTWYTWYWAEEIMS

SEQ ID NO: 107619 - protein, 15 aa, Borrelia burgdorferi B31
DTWYTWYWAEEIMSP

SEQ ID NO: 107620 - protein, 15 aa, Borrelia burgdorferi B31
TWYTWYWAEEIMSPF

SEQ ID NO: 107621 - protein, 15 aa, Borrelia burgdorferi B31
WYTWYWAEEIMSPFI

SEQ ID NO: 107622 - protein, 15 aa, Borrelia burgdorferi B31
YTWYWAEEIMSPFIT

SEQ ID NO: 107623 - protein, 15 aa, Borrelia burgdorferi B31
TWYWAEEIMSPFITG

SEQ ID NO: 107624 - protein, 15 aa, Borrelia burgdorferi B31
WYWAEEIMSPFITGY

SEQ ID NO: 107625 - protein, 15 aa, Borrelia burgdorferi B31
YWAEEIMSPFITGYS

SEQ ID NO: 107626 - protein, 15 aa, Borrelia burgdorferi B31
WAEEIMSPFITGYSY

SEQ ID NO: 107627 - protein, 15 aa, Borrelia burgdorferi B31
AEEIMSPFITGYSYE

SEQ ID NO: 107628 - protein, 15 aa, Borrelia burgdorferi B31
EEIMSPFITGYSYEE

SEQ ID NO: 107629 - protein, 15 aa, Borrelia burgdorferi B31
EIMSPFITGYSYEEI

SEQ ID NO: 107630 - protein, 15 aa, Borrelia burgdorferi B31
IMSPFITGYSYEEID

SEQ ID NO: 107631 - protein, 15 aa, Borrelia burgdorferi B31
MSPFITGYSYEEIDP

SEQ ID NO: 107632 - protein, 15 aa, Borrelia burgdorferi B31
SPFITGYSYEEIDPE

SEQ ID NO: 107633 - protein, 15 aa, Borrelia burgdorferi B31
PFITGYSYEEIDPEY

SEQ ID NO: 107634 - protein, 15 aa, Borrelia burgdorferi B31
FITGYSYEEIDPEYL

SEQ ID NO: 107635 - protein, 15 aa, Borrelia burgdorferi B31
ITGYSYEEIDPEYLL

SEQ ID NO: 107636 - protein, 15 aa, Borrelia burgdorferi B31
TGYSYEEIDPEYLLP

SEQ ID NO: 107637 - protein, 15 aa, Borrelia burgdorferi B31
GYSYEEIDPEYLLPP

SEQ ID NO: 107638 - protein, 15 aa, Borrelia burgdorferi B31
YSYEEIDPEYLLPPF

SEQ ID NO: 107639 - protein, 15 aa, Borrelia burgdorferi B31
SYEEIDPEYLLPPFT

SEQ ID NO: 107640 - protein, 15 aa, Borrelia burgdorferi B31
YEEIDPEYLLPPFTS

SEQ ID NO: 107641 - protein, 15 aa, Borrelia burgdorferi B31
EEIDPEYLLPPFTSQ

SEQ ID NO: 107642 - protein, 15 aa, Borrelia burgdorferi B31
EIDPEYLLPPFTSQS

SEQ ID NO: 107643 - protein, 15 aa, Borrelia burgdorferi B31
IDPEYLLPPFTSQSG

SEQ ID NO: 107644 - protein, 15 aa, Borrelia burgdorferi B31
DPEYLLPPFTSQSGS

SEQ ID NO: 107645 - protein, 15 aa, Borrelia burgdorferi B31
PEYLLPPFTSQSGSK

SEQ ID NO: 107646 - protein, 15 aa, Borrelia burgdorferi B31
EYLLPPFTSQSGSKE

SEQ ID NO: 107647 - protein, 15 aa, Borrelia burgdorferi B31
YLLPPFTSQSGSKET

SEQ ID NO: 107648 - protein, 15 aa, Borrelia burgdorferi B31
LLPPFTSQSGSKETK

SEQ ID NO: 107649 - protein, 15 aa, Borrelia burgdorferi B31
LPPFTSQSGSKETKP

SEQ ID NO: 107650 - protein, 15 aa, Borrelia burgdorferi B31
PPFTSQSGSKETKPK

SEQ ID NO: 107651 - protein, 15 aa, Borrelia burgdorferi B31
PFTSQSGSKETKPKN

SEQ ID NO: 107652 - protein, 15 aa, Borrelia burgdorferi B31
FTSQSGSKETKPKNT

SEQ ID NO: 107653 - protein, 15 aa, Borrelia burgdorferi B31
TSQSGSKETKPKNTC

SEQ ID NO: 107654 - protein, 15 aa, Borrelia burgdorferi B31
SQSGSKETKPKNTCY

SEQ ID NO: 107655 - protein, 15 aa, Borrelia burgdorferi B31
QSGSKETKPKNTCYI

SEQ ID NO: 107656 - protein, 15 aa, Borrelia burgdorferi B31
SGSKETKPKNTCYIS

SEQ ID NO: 107657 - protein, 15 aa, Borrelia burgdorferi B31
GSKETKPKNTCYISF

SEQ ID NO: 107658 - protein, 15 aa, Borrelia burgdorferi B31
SKETKPKNTCYISFY

SEQ ID NO: 107659 - protein, 15 aa, Borrelia burgdorferi B31
KETKPKNTCYISFYR

SEQ ID NO: 107660 - protein, 15 aa, Borrelia burgdorferi B31
ETKPKNTCYISFYRY

SEQ ID NO: 107661 - protein, 15 aa, Borrelia burgdorferi B31
TKPKNTCYISFYRYD

SEQ ID NO: 107662 - protein, 15 aa, Borrelia burgdorferi B31
KPKNTCYISFYRYDL

SEQ ID NO: 107663 - protein, 16 aa, Borrelia burgdorferi B31
MITQQDYTEIKKKLEN

SEQ ID NO: 107664 - protein, 16 aa, Borrelia burgdorferi B31
ITQQDYTEIKKKLENT

SEQ ID NO: 107665 - protein, 16 aa, Borrelia burgdorferi B31
TQQDYTEIKKKLENTK

SEQ ID NO: 107666 - protein, 16 aa, Borrelia burgdorferi B31
QQDYTEIKKKLENTKT

SEQ ID NO: 107667 - protein, 16 aa, Borrelia burgdorferi B31
QDYTEIKKKLENTKTR

SEQ ID NO: 107668 - protein, 16 aa, Borrelia burgdorferi B31
DYTEIKKKLENTKTRI

SEQ ID NO: 107669 - protein, 16 aa, Borrelia burgdorferi B31
YTEIKKKLENTKTRIQ

SEQ ID NO: 107670 - protein, 16 aa, Borrelia burgdorferi B31
TEIKKKLENTKTRIQF

SEQ ID NO: 107671 - protein, 16 aa, Borrelia burgdorferi B31
EIKKKLENTKTRIQFR

SEQ ID NO: 107672 - protein, 16 aa, Borrelia burgdorferi B31
IKKKLENTKTRIQFRN

SEQ ID NO: 107673 - protein, 16 aa, Borrelia burgdorferi B31
KKKLENTKTRIQFRNG

SEQ ID NO: 107674 - protein, 16 aa, Borrelia burgdorferi B31
KKLENTKTRIQFRNGN

SEQ ID NO: 107675 - protein, 16 aa, Borrelia burgdorferi B31
KLENTKTRIQFRNGNK

SEQ ID NO: 107676 - protein, 16 aa, Borrelia burgdorferi B31
LENTKTRIQFRNGNKI

SEQ ID NO: 107677 - protein, 16 aa, Borrelia burgdorferi B31
ENTKTRIQFRNGNKID

SEQ ID NO: 107678 - protein, 16 aa, Borrelia burgdorferi B31
NTKTRIQFRNGNKIDS

SEQ ID NO: 107679 - protein, 16 aa, Borrelia burgdorferi B31
TKTRIQFRNGNKIDSL

SEQ ID NO: 107680 - protein, 16 aa, Borrelia burgdorferi B31
KTRIQFRNGNKIDSLG

SEQ ID NO: 107681 - protein, 16 aa, Borrelia burgdorferi B31
TRIQFRNGNKIDSLGY

SEQ ID NO: 107682 - protein, 16 aa, Borrelia burgdorferi B31
RIQFRNGNKIDSLGYQ

SEQ ID NO: 107683 - protein, 16 aa, Borrelia burgdorferi B31
IQFRNGNKIDSLGYQG

SEQ ID NO: 107684 - protein, 16 aa, Borrelia burgdorferi B31
QFRNGNKIDSLGYQGS

SEQ ID NO: 107685 - protein, 16 aa, Borrelia burgdorferi B31
FRNGNKIDSLGYQGSL

SEQ ID NO: 107686 - protein, 16 aa, Borrelia burgdorferi B31
RNGNKIDSLGYQGSLG

SEQ ID NO: 107687 - protein, 16 aa, Borrelia burgdorferi B31
NGNKIDSLGYQGSLGE

SEQ ID NO: 107688 - protein, 16 aa, Borrelia burgdorferi B31
GNKIDSLGYQGSLGEP

SEQ ID NO: 107689 - protein, 16 aa, Borrelia burgdorferi B31
NKIDSLGYQGSLGEPI

SEQ ID NO: 107690 - protein, 16 aa, Borrelia burgdorferi B31
KIDSLGYQGSLGEPIL

SEQ ID NO: 107691 - protein, 16 aa, Borrelia burgdorferi B31
IDSLGYQGSLGEPILL

SEQ ID NO: 107692 - protein, 16 aa, Borrelia burgdorferi B31
DSLGYQGSLGEPILLK

SEQ ID NO: 107693 - protein, 16 aa, Borrelia burgdorferi B31
SLGYQGSLGEPILLKD

SEQ ID NO: 107694 - protein, 16 aa, Borrelia burgdorferi B31
LGYQGSLGEPILLKDK

SEQ ID NO: 107695 - protein, 16 aa, Borrelia burgdorferi B31
GYQGSLGEPILLKDKL

SEQ ID NO: 107696 - protein, 16 aa, Borrelia burgdorferi B31
YQGSLGEPILLKDKLT

SEQ ID NO: 107697 - protein, 16 aa, Borrelia burgdorferi B31
QGSLGEPILLKDKLTF

SEQ ID NO: 107698 - protein, 16 aa, Borrelia burgdorferi B31
GSLGEPILLKDKLTFS

SEQ ID NO: 107699 - protein, 16 aa, Borrelia burgdorferi B31
SLGEPILLKDKLTFSI

SEQ ID NO: 107700 - protein, 16 aa, Borrelia burgdorferi B31
LGEPILLKDKLTFSIC

SEQ ID NO: 107701 - protein, 16 aa, Borrelia burgdorferi B31
GEPILLKDKLTFSICD

SEQ ID NO: 107702 - protein, 16 aa, Borrelia burgdorferi B31
EPILLKDKLTFSICDG

SEQ ID NO: 107703 - protein, 16 aa, Borrelia burgdorferi B31
PILLKDKLTFSICDGK

SEQ ID NO: 107704 - protein, 16 aa, Borrelia burgdorferi B31
ILLKDKLTFSICDGKN

SEQ ID NO: 107705 - protein, 16 aa, Borrelia burgdorferi B31
LLKDKLTFSICDGKNI

SEQ ID NO: 107706 - protein, 16 aa, Borrelia burgdorferi B31
LKDKLTFSICDGKNID

SEQ ID NO: 107707 - protein, 16 aa, Borrelia burgdorferi B31
KDKLTFSICDGKNIDN

SEQ ID NO: 107708 - protein, 16 aa, Borrelia burgdorferi B31
DKLTFSICDGKNIDNR

SEQ ID NO: 107709 - protein, 16 aa, Borrelia burgdorferi B31
KLTFSICDGKNIDNRK

SEQ ID NO: 107710 - protein, 16 aa, Borrelia burgdorferi B31
LTFSICDGKNIDNRKE

SEQ ID NO: 107711 - protein, 16 aa, Borrelia burgdorferi B31
TFSICDGKNIDNRKEY

SEQ ID NO: 107712 - protein, 16 aa, Borrelia burgdorferi B31
FSICDGKNIDNRKEYE

SEQ ID NO: 107713 - protein, 16 aa, Borrelia burgdorferi B31
SICDGKNIDNRKEYEI

SEQ ID NO: 107714 - protein, 16 aa, Borrelia burgdorferi B31
ICDGKNIDNRKEYEIT

SEQ ID NO: 107715 - protein, 16 aa, Borrelia burgdorferi B31
CDGKNIDNRKEYEITK

SEQ ID NO: 107716 - protein, 16 aa, Borrelia burgdorferi B31
DGKNIDNRKEYEITKN

SEQ ID NO: 107717 - protein, 16 aa, Borrelia burgdorferi B31
GKNIDNRKEYEITKNA

SEQ ID NO: 107718 - protein, 16 aa, Borrelia burgdorferi B31
KNIDNRKEYEITKNAP

SEQ ID NO: 107719 - protein, 16 aa, Borrelia burgdorferi B31
NIDNRKEYEITKNAPS

SEQ ID NO: 107720 - protein, 16 aa, Borrelia burgdorferi B31
IDNRKEYEITKNAPSL

SEQ ID NO: 107721 - protein, 16 aa, Borrelia burgdorferi B31
DNRKEYEITKNAPSLD

SEQ ID NO: 107722 - protein, 16 aa, Borrelia burgdorferi B31
NRKEYEITKNAPSLDS

SEQ ID NO: 107723 - protein, 16 aa, Borrelia burgdorferi B31
RKEYEITKNAPSLDSL

SEQ ID NO: 107724 - protein, 16 aa, Borrelia burgdorferi B31
KEYEITKNAPSLDSLI

SEQ ID NO: 107725 - protein, 16 aa, Borrelia burgdorferi B31
EYEITKNAPSLDSLIE

SEQ ID NO: 107726 - protein, 16 aa, Borrelia burgdorferi B31
YEITKNAPSLDSLIEY

SEQ ID NO: 107727 - protein, 16 aa, Borrelia burgdorferi B31
EITKNAPSLDSLIEYL

SEQ ID NO: 107728 - protein, 16 aa, Borrelia burgdorferi B31
ITKNAPSLDSLIEYLE

SEQ ID NO: 107729 - protein, 16 aa, Borrelia burgdorferi B31
TKNAPSLDSLIEYLEH

SEQ ID NO: 107730 - protein, 16 aa, Borrelia burgdorferi B31
KNAPSLDSLIEYLEHM

SEQ ID NO: 107731 - protein, 16 aa, Borrelia burgdorferi B31
NAPSLDSLIEYLEHMI

SEQ ID NO: 107732 - protein, 16 aa, Borrelia burgdorferi B31
APSLDSLIEYLEHMIL

SEQ ID NO: 107733 - protein, 16 aa, Borrelia burgdorferi B31
PSLDSLIEYLEHMILF

SEQ ID NO: 107734 - protein, 16 aa, Borrelia burgdorferi B31
SLDSLIEYLEHMILFF

SEQ ID NO: 107735 - protein, 16 aa, Borrelia burgdorferi B31
LDSLIEYLEHMILFFL

SEQ ID NO: 107736 - protein, 16 aa, Borrelia burgdorferi B31
DSLIEYLEHMILFFLE

SEQ ID NO: 107737 - protein, 16 aa, Borrelia burgdorferi B31
SLIEYLEHMILFFLEK

SEQ ID NO: 107738 - protein, 16 aa, Borrelia burgdorferi B31
LIEYLEHMILFFLEKT

SEQ ID NO: 107739 - protein, 16 aa, Borrelia burgdorferi B31
IEYLEHMILFFLEKTP

SEQ ID NO: 107740 - protein, 16 aa, Borrelia burgdorferi B31
EYLEHMILFFLEKTPV

SEQ ID NO: 107741 - protein, 16 aa, Borrelia burgdorferi B31
YLEHMILFFLEKTPVG

SEQ ID NO: 107742 - protein, 16 aa, Borrelia burgdorferi B31
LEHMILFFLEKTPVGT

SEQ ID NO: 107743 - protein, 16 aa, Borrelia burgdorferi B31
EHMILFFLEKTPVGTL

SEQ ID NO: 107744 - protein, 16 aa, Borrelia burgdorferi B31
HMILFFLEKTPVGTLT

SEQ ID NO: 107745 - protein, 16 aa, Borrelia burgdorferi B31
MILFFLEKTPVGTLTA

SEQ ID NO: 107746 - protein, 16 aa, Borrelia burgdorferi B31
ILFFLEKTPVGTLTAK

SEQ ID NO: 107747 - protein, 16 aa, Borrelia burgdorferi B31
LFFLEKTPVGTLTAKF

SEQ ID NO: 107748 - protein, 16 aa, Borrelia burgdorferi B31
FFLEKTPVGTLTAKFA

SEQ ID NO: 107749 - protein, 16 aa, Borrelia burgdorferi B31
FLEKTPVGTLTAKFAM

SEQ ID NO: 107750 - protein, 16 aa, Borrelia burgdorferi B31
LEKTPVGTLTAKFAME

SEQ ID NO: 107751 - protein, 16 aa, Borrelia burgdorferi B31
EKTPVGTLTAKFAMEG

SEQ ID NO: 107752 - protein, 16 aa, Borrelia burgdorferi B31
KTPVGTLTAKFAMEGS

SEQ ID NO: 107753 - protein, 16 aa, Borrelia burgdorferi B31
TPVGTLTAKFAMEGSI

SEQ ID NO: 107754 - protein, 16 aa, Borrelia burgdorferi B31
PVGTLTAKFAMEGSIL

SEQ ID NO: 107755 - protein, 16 aa, Borrelia burgdorferi B31
VGTLTAKFAMEGSILT

SEQ ID NO: 107756 - protein, 16 aa, Borrelia burgdorferi B31
GTLTAKFAMEGSILTR

SEQ ID NO: 107757 - protein, 16 aa, Borrelia burgdorferi B31
TLTAKFAMEGSILTRS

SEQ ID NO: 107758 - protein, 16 aa, Borrelia burgdorferi B31
LTAKFAMEGSILTRSK

SEQ ID NO: 107759 - protein, 16 aa, Borrelia burgdorferi B31
TAKFAMEGSILTRSKL

SEQ ID NO: 107760 - protein, 16 aa, Borrelia burgdorferi B31
AKFAMEGSILTRSKLI

SEQ ID NO: 107761 - protein, 16 aa, Borrelia burgdorferi B31
KFAMEGSILTRSKLIQ

SEQ ID NO: 107762 - protein, 16 aa, Borrelia burgdorferi B31
FAMEGSILTRSKLIQA

SEQ ID NO: 107763 - protein, 16 aa, Borrelia burgdorferi B31
AMEGSILTRSKLIQAF

SEQ ID NO: 107764 - protein, 16 aa, Borrelia burgdorferi B31
MEGSILTRSKLIQAFT

SEQ ID NO: 107765 - protein, 16 aa, Borrelia burgdorferi B31
EGSILTRSKLIQAFTN

SEQ ID NO: 107766 - protein, 16 aa, Borrelia burgdorferi B31
GSILTRSKLIQAFTNT

SEQ ID NO: 107767 - protein, 16 aa, Borrelia burgdorferi B31
SILTRSKLIQAFTNTN

SEQ ID NO: 107768 - protein, 16 aa, Borrelia burgdorferi B31
ILTRSKLIQAFTNTNK

SEQ ID NO: 107769 - protein, 16 aa, Borrelia burgdorferi B31
LTRSKLIQAFTNTNKF

SEQ ID NO: 107770 - protein, 16 aa, Borrelia burgdorferi B31
TRSKLIQAFTNTNKFC

SEQ ID NO: 107771 - protein, 16 aa, Borrelia burgdorferi B31
RSKLIQAFTNTNKFCI

SEQ ID NO: 107772 - protein, 16 aa, Borrelia burgdorferi B31
SKLIQAFTNTNKFCIP

SEQ ID NO: 107773 - protein, 16 aa, Borrelia burgdorferi B31
KLIQAFTNTNKFCIPD

SEQ ID NO: 107774 - protein, 16 aa, Borrelia burgdorferi B31
LIQAFTNTNKFCIPDG

SEQ ID NO: 107775 - protein, 16 aa, Borrelia burgdorferi B31
IQAFTNTNKFCIPDGR

SEQ ID NO: 107776 - protein, 16 aa, Borrelia burgdorferi B31
QAFTNTNKFCIPDGRS

SEQ ID NO: 107777 - protein, 16 aa, Borrelia burgdorferi B31
AFTNTNKFCIPDGRSL

SEQ ID NO: 107778 - protein, 16 aa, Borrelia burgdorferi B31
FTNTNKFCIPDGRSLP

SEQ ID NO: 107779 - protein, 16 aa, Borrelia burgdorferi B31
TNTNKFCIPDGRSLPS

SEQ ID NO: 107780 - protein, 16 aa, Borrelia burgdorferi B31
NTNKFCIPDGRSLPSN

SEQ ID NO: 107781 - protein, 16 aa, Borrelia burgdorferi B31
TNKFCIPDGRSLPSNC

SEQ ID NO: 107782 - protein, 16 aa, Borrelia burgdorferi B31
NKFCIPDGRSLPSNCY

SEQ ID NO: 107783 - protein, 16 aa, Borrelia burgdorferi B31
KFCIPDGRSLPSNCYA

SEQ ID NO: 107784 - protein, 16 aa, Borrelia burgdorferi B31
FCIPDGRSLPSNCYAY

SEQ ID NO: 107785 - protein, 16 aa, Borrelia burgdorferi B31
CIPDGRSLPSNCYAYK

SEQ ID NO: 107786 - protein, 16 aa, Borrelia burgdorferi B31
IPDGRSLPSNCYAYKV

SEQ ID NO: 107787 - protein, 16 aa, Borrelia burgdorferi B31
PDGRSLPSNCYAYKVL

SEQ ID NO: 107788 - protein, 16 aa, Borrelia burgdorferi B31
DGRSLPSNCYAYKVLG

SEQ ID NO: 107789 - protein, 16 aa, Borrelia burgdorferi B31
GRSLPSNCYAYKVLGI

SEQ ID NO: 107790 - protein, 16 aa, Borrelia burgdorferi B31
RSLPSNCYAYKVLGIS

SEQ ID NO: 107791 - protein, 16 aa, Borrelia burgdorferi B31
SLPSNCYAYKVLGISS

SEQ ID NO: 107792 - protein, 16 aa, Borrelia burgdorferi B31
LPSNCYAYKVLGISSA

SEQ ID NO: 107793 - protein, 16 aa, Borrelia burgdorferi B31
PSNCYAYKVLGISSAP

SEQ ID NO: 107794 - protein, 16 aa, Borrelia burgdorferi B31
SNCYAYKVLGISSAPK

SEQ ID NO: 107795 - protein, 16 aa, Borrelia burgdorferi B31
NCYAYKVLGISSAPKL

SEQ ID NO: 107796 - protein, 16 aa, Borrelia burgdorferi B31
CYAYKVLGISSAPKLS

SEQ ID NO: 107797 - protein, 16 aa, Borrelia burgdorferi B31
YAYKVLGISSAPKLSG

SEQ ID NO: 107798 - protein, 16 aa, Borrelia burgdorferi B31
AYKVLGISSAPKLSGR

SEQ ID NO: 107799 - protein, 16 aa, Borrelia burgdorferi B31
YKVLGISSAPKLSGRF

SEQ ID NO: 107800 - protein, 16 aa, Borrelia burgdorferi B31
KVLGISSAPKLSGRFL

SEQ ID NO: 107801 - protein, 16 aa, Borrelia burgdorferi B31
VLGISSAPKLSGRFLR

SEQ ID NO: 107802 - protein, 16 aa, Borrelia burgdorferi B31
LGISSAPKLSGRFLRH

SEQ ID NO: 107803 - protein, 16 aa, Borrelia burgdorferi B31
GISSAPKLSGRFLRHY

SEQ ID NO: 107804 - protein, 16 aa, Borrelia burgdorferi B31
ISSAPKLSGRFLRHYD

SEQ ID NO: 107805 - protein, 16 aa, Borrelia burgdorferi B31
SSAPKLSGRFLRHYDS

SEQ ID NO: 107806 - protein, 16 aa, Borrelia burgdorferi B31
SAPKLSGRFLRHYDSG

SEQ ID NO: 107807 - protein, 16 aa, Borrelia burgdorferi B31
APKLSGRFLRHYDSGG

SEQ ID NO: 107808 - protein, 16 aa, Borrelia burgdorferi B31
PKLSGRFLRHYDSGGS

SEQ ID NO: 107809 - protein, 16 aa, Borrelia burgdorferi B31
KLSGRFLRHYDSGGST

SEQ ID NO: 107810 - protein, 16 aa, Borrelia burgdorferi B31
LSGRFLRHYDSGGSTD

SEQ ID NO: 107811 - protein, 16 aa, Borrelia burgdorferi B31
SGRFLRHYDSGGSTDS

SEQ ID NO: 107812 - protein, 16 aa, Borrelia burgdorferi B31
GRFLRHYDSGGSTDSD

SEQ ID NO: 107813 - protein, 16 aa, Borrelia burgdorferi B31
RFLRHYDSGGSTDSDG

SEQ ID NO: 107814 - protein, 16 aa, Borrelia burgdorferi B31
FLRHYDSGGSTDSDGT

SEQ ID NO: 107815 - protein, 16 aa, Borrelia burgdorferi B31
LRHYDSGGSTDSDGTR

SEQ ID NO: 107816 - protein, 16 aa, Borrelia burgdorferi B31
RHYDSGGSTDSDGTRS

SEQ ID NO: 107817 - protein, 16 aa, Borrelia burgdorferi B31
HYDSGGSTDSDGTRSL

SEQ ID NO: 107818 - protein, 16 aa, Borrelia burgdorferi B31
YDSGGSTDSDGTRSLG

SEQ ID NO: 107819 - protein, 16 aa, Borrelia burgdorferi B31
DSGGSTDSDGTRSLGH

SEQ ID NO: 107820 - protein, 16 aa, Borrelia burgdorferi B31
SGGSTDSDGTRSLGHT

SEQ ID NO: 107821 - protein, 16 aa, Borrelia burgdorferi B31
GGSTDSDGTRSLGHTQ

SEQ ID NO: 107822 - protein, 16 aa, Borrelia burgdorferi B31
GSTDSDGTRSLGHTQE

SEQ ID NO: 107823 - protein, 16 aa, Borrelia burgdorferi B31
STDSDGTRSLGHTQED

SEQ ID NO: 107824 - protein, 16 aa, Borrelia burgdorferi B31
TDSDGTRSLGHTQEDS

SEQ ID NO: 107825 - protein, 16 aa, Borrelia burgdorferi B31
DSDGTRSLGHTQEDSY

SEQ ID NO: 107826 - protein, 16 aa, Borrelia burgdorferi B31
SDGTRSLGHTQEDSYK

SEQ ID NO: 107827 - protein, 16 aa, Borrelia burgdorferi B31
DGTRSLGHTQEDSYKN

SEQ ID NO: 107828 - protein, 16 aa, Borrelia burgdorferi B31
GTRSLGHTQEDSYKNH

SEQ ID NO: 107829 - protein, 16 aa, Borrelia burgdorferi B31
TRSLGHTQEDSYKNHD

SEQ ID NO: 107830 - protein, 16 aa, Borrelia burgdorferi B31
RSLGHTQEDSYKNHDH

SEQ ID NO: 107831 - protein, 16 aa, Borrelia burgdorferi B31
SLGHTQEDSYKNHDHD

SEQ ID NO: 107832 - protein, 16 aa, Borrelia burgdorferi B31
LGHTQEDSYKNHDHDL

SEQ ID NO: 107833 - protein, 16 aa, Borrelia burgdorferi B31
GHTQEDSYKNHDHDLD

SEQ ID NO: 107834 - protein, 16 aa, Borrelia burgdorferi B31
HTQEDSYKNHDHDLDF

SEQ ID NO: 107835 - protein, 16 aa, Borrelia burgdorferi B31
TQEDSYKNHDHDLDFS

SEQ ID NO: 107836 - protein, 16 aa, Borrelia burgdorferi B31
QEDSYKNHDHDLDFSR

SEQ ID NO: 107837 - protein, 16 aa, Borrelia burgdorferi B31
EDSYKNHDHDLDFSRI

SEQ ID NO: 107838 - protein, 16 aa, Borrelia burgdorferi B31
DSYKNHDHDLDFSRIN

SEQ ID NO: 107839 - protein, 16 aa, Borrelia burgdorferi B31
SYKNHDHDLDFSRINF

SEQ ID NO: 107840 - protein, 16 aa, Borrelia burgdorferi B31
YKNHDHDLDFSRINFK

SEQ ID NO: 107841 - protein, 16 aa, Borrelia burgdorferi B31
KNHDHDLDFSRINFKG

SEQ ID NO: 107842 - protein, 16 aa, Borrelia burgdorferi B31
NHDHDLDFSRINFKGK

SEQ ID NO: 107843 - protein, 16 aa, Borrelia burgdorferi B31
HDHDLDFSRINFKGKL

SEQ ID NO: 107844 - protein, 16 aa, Borrelia burgdorferi B31
DHDLDFSRINFKGKLV

SEQ ID NO: 107845 - protein, 16 aa, Borrelia burgdorferi B31
HDLDFSRINFKGKLVK

SEQ ID NO: 107846 - protein, 16 aa, Borrelia burgdorferi B31
DLDFSRINFKGKLVKR

SEQ ID NO: 107847 - protein, 16 aa, Borrelia burgdorferi B31
LDFSRINFKGKLVKRM

SEQ ID NO: 107848 - protein, 16 aa, Borrelia burgdorferi B31
DFSRINFKGKLVKRMT

SEQ ID NO: 107849 - protein, 16 aa, Borrelia burgdorferi B31
FSRINFKGKLVKRMTM

SEQ ID NO: 107850 - protein, 16 aa, Borrelia burgdorferi B31
SRINFKGKLVKRMTMI

SEQ ID NO: 107851 - protein, 16 aa, Borrelia burgdorferi B31
RINFKGKLVKRMTMIY

SEQ ID NO: 107852 - protein, 16 aa, Borrelia burgdorferi B31
INFKGKLVKRMTMIYR

SEQ ID NO: 107853 - protein, 16 aa, Borrelia burgdorferi B31
NFKGKLVKRMTMIYRS

SEQ ID NO: 107854 - protein, 16 aa, Borrelia burgdorferi B31
FKGKLVKRMTMIYRSA

SEQ ID NO: 107855 - protein, 16 aa, Borrelia burgdorferi B31
KGKLVKRMTMIYRSAD

SEQ ID NO: 107856 - protein, 16 aa, Borrelia burgdorferi B31
GKLVKRMTMIYRSADT

SEQ ID NO: 107857 - protein, 16 aa, Borrelia burgdorferi B31
KLVKRMTMIYRSADTW

SEQ ID NO: 107858 - protein, 16 aa, Borrelia burgdorferi B31
LVKRMTMIYRSADTWY

SEQ ID NO: 107859 - protein, 16 aa, Borrelia burgdorferi B31
VKRMTMIYRSADTWYT

SEQ ID NO: 107860 - protein, 16 aa, Borrelia burgdorferi B31
KRMTMIYRSADTWYTW

SEQ ID NO: 107861 - protein, 16 aa, Borrelia burgdorferi B31
RMTMIYRSADTWYTWY

SEQ ID NO: 107862 - protein, 16 aa, Borrelia burgdorferi B31
MTMIYRSADTWYTWYW

SEQ ID NO: 107863 - protein, 16 aa, Borrelia burgdorferi B31
TMIYRSADTWYTWYWA

SEQ ID NO: 107864 - protein, 16 aa, Borrelia burgdorferi B31
MIYRSADTWYTWYWAE

SEQ ID NO: 107865 - protein, 16 aa, Borrelia burgdorferi B31
IYRSADTWYTWYWAEE

SEQ ID NO: 107866 - protein, 16 aa, Borrelia burgdorferi B31
YRSADTWYTWYWAEEI

SEQ ID NO: 107867 - protein, 16 aa, Borrelia burgdorferi B31
RSADTWYTWYWAEEIM

SEQ ID NO: 107868 - protein, 16 aa, Borrelia burgdorferi B31
SADTWYTWYWAEEIMS

SEQ ID NO: 107869 - protein, 16 aa, Borrelia burgdorferi B31
ADTWYTWYWAEEIMSP

SEQ ID NO: 107870 - protein, 16 aa, Borrelia burgdorferi B31
DTWYTWYWAEEIMSPF

SEQ ID NO: 107871 - protein, 16 aa, Borrelia burgdorferi B31
TWYTWYWAEEIMSPFI

SEQ ID NO: 107872 - protein, 16 aa, Borrelia burgdorferi B31
WYTWYWAEEIMSPFIT

SEQ ID NO: 107873 - protein, 16 aa, Borrelia burgdorferi B31
YTWYWAEEIMSPFITG

SEQ ID NO: 107874 - protein, 16 aa, Borrelia burgdorferi B31
TWYWAEEIMSPFITGY

SEQ ID NO: 107875 - protein, 16 aa, Borrelia burgdorferi B31
WYWAEEIMSPFITGYS

SEQ ID NO: 107876 - protein, 16 aa, Borrelia burgdorferi B31
YWAEEIMSPFITGYSY

SEQ ID NO: 107877 - protein, 16 aa, Borrelia burgdorferi B31
WAEEIMSPFITGYSYE

SEQ ID NO: 107878 - protein, 16 aa, Borrelia burgdorferi B31
AEEIMSPFITGYSYEE

SEQ ID NO: 107879 - protein, 16 aa, Borrelia burgdorferi B31
EEIMSPFITGYSYEEI

SEQ ID NO: 107880 - protein, 16 aa, Borrelia burgdorferi B31
EIMSPFITGYSYEEID

SEQ ID NO: 107881 - protein, 16 aa, Borrelia burgdorferi B31
IMSPFITGYSYEEIDP

SEQ ID NO: 107882 - protein, 16 aa, Borrelia burgdorferi B31
MSPFITGYSYEEIDPE

SEQ ID NO: 107883 - protein, 16 aa, Borrelia burgdorferi B31
SPFITGYSYEEIDPEY

SEQ ID NO: 107884 - protein, 16 aa, Borrelia burgdorferi B31
PFITGYSYEEIDPEYL

SEQ ID NO: 107885 - protein, 16 aa, Borrelia burgdorferi B31
FITGYSYEEIDPEYLL

SEQ ID NO: 107886 - protein, 16 aa, Borrelia burgdorferi B31
ITGYSYEEIDPEYLLP

SEQ ID NO: 107887 - protein, 16 aa, Borrelia burgdorferi B31
TGYSYEEIDPEYLLPP

SEQ ID NO: 107888 - protein, 16 aa, Borrelia burgdorferi B31
GYSYEEIDPEYLLPPF

SEQ ID NO: 107889 - protein, 16 aa, Borrelia burgdorferi B31
YSYEEIDPEYLLPPFT

SEQ ID NO: 107890 - protein, 16 aa, Borrelia burgdorferi B31
SYEEIDPEYLLPPFTS

SEQ ID NO: 107891 - protein, 16 aa, Borrelia burgdorferi B31
YEEIDPEYLLPPFTSQ

SEQ ID NO: 107892 - protein, 16 aa, Borrelia burgdorferi B31
EEIDPEYLLPPFTSQS

SEQ ID NO: 107893 - protein, 16 aa, Borrelia burgdorferi B31
EIDPEYLLPPFTSQSG

SEQ ID NO: 107894 - protein, 16 aa, Borrelia burgdorferi B31
IDPEYLLPPFTSQSGS

SEQ ID NO: 107895 - protein, 16 aa, Borrelia burgdorferi B31
DPEYLLPPFTSQSGSK

SEQ ID NO: 107896 - protein, 16 aa, Borrelia burgdorferi B31
PEYLLPPFTSQSGSKE

SEQ ID NO: 107897 - protein, 16 aa, Borrelia burgdorferi B31
EYLLPPFTSQSGSKET

SEQ ID NO: 107898 - protein, 16 aa, Borrelia burgdorferi B31
YLLPPFTSQSGSKETK

SEQ ID NO: 107899 - protein, 16 aa, Borrelia burgdorferi B31
LLPPFTSQSGSKETKP

SEQ ID NO: 107900 - protein, 16 aa, Borrelia burgdorferi B31
LPPFTSQSGSKETKPK

SEQ ID NO: 107901 - protein, 16 aa, Borrelia burgdorferi B31
PPFTSQSGSKETKPKN

SEQ ID NO: 107902 - protein, 16 aa, Borrelia burgdorferi B31
PFTSQSGSKETKPKNT

SEQ ID NO: 107903 - protein, 16 aa, Borrelia burgdorferi B31
FTSQSGSKETKPKNTC

SEQ ID NO: 107904 - protein, 16 aa, Borrelia burgdorferi B31
TSQSGSKETKPKNTCY

SEQ ID NO: 107905 - protein, 16 aa, Borrelia burgdorferi B31
SQSGSKETKPKNTCYI

SEQ ID NO: 107906 - protein, 16 aa, Borrelia burgdorferi B31
QSGSKETKPKNTCYIS

SEQ ID NO: 107907 - protein, 16 aa, Borrelia burgdorferi B31
SGSKETKPKNTCYISF

SEQ ID NO: 107908 - protein, 16 aa, Borrelia burgdorferi B31
GSKETKPKNTCYISFY

SEQ ID NO: 107909 - protein, 16 aa, Borrelia burgdorferi B31
SKETKPKNTCYISFYR

SEQ ID NO: 107910 - protein, 16 aa, Borrelia burgdorferi B31
KETKPKNTCYISFYRY

SEQ ID NO: 107911 - protein, 16 aa, Borrelia burgdorferi B31
ETKPKNTCYISFYRYD

SEQ ID NO: 107912 - protein, 16 aa, Borrelia burgdorferi B31
TKPKNTCYISFYRYDL

SEQ ID NO: 107913 - protein, 13 aa, Borrelia burgdorferi B31
MDLLDLLEKEKQI

SEQ ID NO: 107914 - protein, 13 aa, Borrelia burgdorferi B31
DLLDLLEKEKQIN

SEQ ID NO: 107915 - protein, 13 aa, Borrelia burgdorferi B31
LLDLLEKEKQINK

SEQ ID NO: 107916 - protein, 13 aa, Borrelia burgdorferi B31
LDLLEKEKQINKN

SEQ ID NO: 107917 - protein, 13 aa, Borrelia burgdorferi B31
DLLEKEKQINKNK

SEQ ID NO: 107918 - protein, 13 aa, Borrelia burgdorferi B31
LLEKEKQINKNKG

SEQ ID NO: 107919 - protein, 13 aa, Borrelia burgdorferi B31
LEKEKQINKNKGV

SEQ ID NO: 107920 - protein, 13 aa, Borrelia burgdorferi B31
EKEKQINKNKGVF

SEQ ID NO: 107921 - protein, 13 aa, Borrelia burgdorferi B31
KEKQINKNKGVFM

SEQ ID NO: 107922 - protein, 13 aa, Borrelia burgdorferi B31
EKQINKNKGVFMT

SEQ ID NO: 107923 - protein, 13 aa, Borrelia burgdorferi B31
KQINKNKGVFMTK

SEQ ID NO: 107924 - protein, 13 aa, Borrelia burgdorferi B31
QINKNKGVFMTKP

SEQ ID NO: 107925 - protein, 13 aa, Borrelia burgdorferi B31
INKNKGVFMTKPK

SEQ ID NO: 107926 - protein, 13 aa, Borrelia burgdorferi B31
NKNKGVFMTKPKI

SEQ ID NO: 107927 - protein, 13 aa, Borrelia burgdorferi B31
KNKGVFMTKPKIF

SEQ ID NO: 107928 - protein, 13 aa, Borrelia burgdorferi B31
NKGVFMTKPKIFS

SEQ ID NO: 107929 - protein, 13 aa, Borrelia burgdorferi B31
KGVFMTKPKIFSI

SEQ ID NO: 107930 - protein, 13 aa, Borrelia burgdorferi B31
GVFMTKPKIFSIN

SEQ ID NO: 107931 - protein, 13 aa, Borrelia burgdorferi B31
VFMTKPKIFSINK

SEQ ID NO: 107932 - protein, 13 aa, Borrelia burgdorferi B31
FMTKPKIFSINKE

SEQ ID NO: 107933 - protein, 13 aa, Borrelia burgdorferi B31
MTKPKIFSINKEK

SEQ ID NO: 107934 - protein, 13 aa, Borrelia burgdorferi B31
TKPKIFSINKEKI

SEQ ID NO: 107935 - protein, 13 aa, Borrelia burgdorferi B31
KPKIFSINKEKIK

SEQ ID NO: 107936 - protein, 13 aa, Borrelia burgdorferi B31
PKIFSINKEKIKI

SEQ ID NO: 107937 - protein, 13 aa, Borrelia burgdorferi B31
KIFSINKEKIKIL

SEQ ID NO: 107938 - protein, 13 aa, Borrelia burgdorferi B31
IFSINKEKIKILI

SEQ ID NO: 107939 - protein, 13 aa, Borrelia burgdorferi B31
FSINKEKIKILII

SEQ ID NO: 107940 - protein, 13 aa, Borrelia burgdorferi B31
SINKEKIKILIIV

SEQ ID NO: 107941 - protein, 13 aa, Borrelia burgdorferi B31
INKEKIKILIIVV

SEQ ID NO: 107942 - protein, 13 aa, Borrelia burgdorferi B31
NKEKIKILIIVVL

SEQ ID NO: 107943 - protein, 13 aa, Borrelia burgdorferi B31
KEKIKILIIVVLT

SEQ ID NO: 107944 - protein, 13 aa, Borrelia burgdorferi B31
EKIKILIIVVLTS

SEQ ID NO: 107945 - protein, 13 aa, Borrelia burgdorferi B31
KIKILIIVVLTST

SEQ ID NO: 107946 - protein, 13 aa, Borrelia burgdorferi B31
IKILIIVVLTSTF

SEQ ID NO: 107947 - protein, 13 aa, Borrelia burgdorferi B31
KILIIVVLTSTFL

SEQ ID NO: 107948 - protein, 13 aa, Borrelia burgdorferi B31
ILIIVVLTSTFLL

SEQ ID NO: 107949 - protein, 13 aa, Borrelia burgdorferi B31
LIIVVLTSTFLLG

SEQ ID NO: 107950 - protein, 13 aa, Borrelia burgdorferi B31
IIVVLTSTFLLGI

SEQ ID NO: 107951 - protein, 13 aa, Borrelia burgdorferi B31
IVVLTSTFLLGII

SEQ ID NO: 107952 - protein, 13 aa, Borrelia burgdorferi B31
VVLTSTFLLGIIF

SEQ ID NO: 107953 - protein, 13 aa, Borrelia burgdorferi B31
VLTSTFLLGIIFS

SEQ ID NO: 107954 - protein, 13 aa, Borrelia burgdorferi B31
LTSTFLLGIIFSN

SEQ ID NO: 107955 - protein, 13 aa, Borrelia burgdorferi B31
TSTFLLGIIFSNE

SEQ ID NO: 107956 - protein, 13 aa, Borrelia burgdorferi B31
STFLLGIIFSNEN

SEQ ID NO: 107957 - protein, 13 aa, Borrelia burgdorferi B31
TFLLGIIFSNENK

SEQ ID NO: 107958 - protein, 13 aa, Borrelia burgdorferi B31
FLLGIIFSNENKV

SEQ ID NO: 107959 - protein, 13 aa, Borrelia burgdorferi B31
LLGIIFSNENKVA

SEQ ID NO: 107960 - protein, 13 aa, Borrelia burgdorferi B31
LGIIFSNENKVAR

SEQ ID NO: 107961 - protein, 13 aa, Borrelia burgdorferi B31
GIIFSNENKVARI

SEQ ID NO: 107962 - protein, 13 aa, Borrelia burgdorferi B31
IIFSNENKVARIL

SEQ ID NO: 107963 - protein, 13 aa, Borrelia burgdorferi B31
IFSNENKVARILE

SEQ ID NO: 107964 - protein, 13 aa, Borrelia burgdorferi B31
FSNENKVARILEE

SEQ ID NO: 107965 - protein, 13 aa, Borrelia burgdorferi B31
SNENKVARILEEK

SEQ ID NO: 107966 - protein, 13 aa, Borrelia burgdorferi B31
NENKVARILEEKF

SEQ ID NO: 107967 - protein, 13 aa, Borrelia burgdorferi B31
ENKVARILEEKFF

SEQ ID NO: 107968 - protein, 13 aa, Borrelia burgdorferi B31
NKVARILEEKFFD

SEQ ID NO: 107969 - protein, 13 aa, Borrelia burgdorferi B31
KVARILEEKFFDF

SEQ ID NO: 107970 - protein, 13 aa, Borrelia burgdorferi B31
VARILEEKFFDFD

SEQ ID NO: 107971 - protein, 13 aa, Borrelia burgdorferi B31
ARILEEKFFDFDF

SEQ ID NO: 107972 - protein, 13 aa, Borrelia burgdorferi B31
RILEEKFFDFDFN

SEQ ID NO: 107973 - protein, 13 aa, Borrelia burgdorferi B31
ILEEKFFDFDFNL

SEQ ID NO: 107974 - protein, 13 aa, Borrelia burgdorferi B31
LEEKFFDFDFNLI

SEQ ID NO: 107975 - protein, 13 aa, Borrelia burgdorferi B31
EEKFFDFDFNLIS

SEQ ID NO: 107976 - protein, 13 aa, Borrelia burgdorferi B31
EKFFDFDFNLISK

SEQ ID NO: 107977 - protein, 13 aa, Borrelia burgdorferi B31
KFFDFDFNLISKI

SEQ ID NO: 107978 - protein, 13 aa, Borrelia burgdorferi B31
FFDFDFNLISKIE

SEQ ID NO: 107979 - protein, 13 aa, Borrelia burgdorferi B31
FDFDFNLISKIET

SEQ ID NO: 107980 - protein, 13 aa, Borrelia burgdorferi B31
DFDFNLISKIETE

SEQ ID NO: 107981 - protein, 13 aa, Borrelia burgdorferi B31
FDFNLISKIETEL

SEQ ID NO: 107982 - protein, 13 aa, Borrelia burgdorferi B31
DFNLISKIETELE

SEQ ID NO: 107983 - protein, 13 aa, Borrelia burgdorferi B31
FNLISKIETELEG

SEQ ID NO: 107984 - protein, 13 aa, Borrelia burgdorferi B31
NLISKIETELEGT

SEQ ID NO: 107985 - protein, 13 aa, Borrelia burgdorferi B31
LISKIETELEGTL

SEQ ID NO: 107986 - protein, 13 aa, Borrelia burgdorferi B31
ISKIETELEGTLT

SEQ ID NO: 107987 - protein, 13 aa, Borrelia burgdorferi B31
SKIETELEGTLTK

SEQ ID NO: 107988 - protein, 13 aa, Borrelia burgdorferi B31
KIETELEGTLTKL

SEQ ID NO: 107989 - protein, 13 aa, Borrelia burgdorferi B31
IETELEGTLTKLG

SEQ ID NO: 107990 - protein, 13 aa, Borrelia burgdorferi B31
ETELEGTLTKLGK

SEQ ID NO: 107991 - protein, 13 aa, Borrelia burgdorferi B31
TELEGTLTKLGKD

SEQ ID NO: 107992 - protein, 13 aa, Borrelia burgdorferi B31
ELEGTLTKLGKDW

SEQ ID NO: 107993 - protein, 13 aa, Borrelia burgdorferi B31
LEGTLTKLGKDWI

SEQ ID NO: 107994 - protein, 13 aa, Borrelia burgdorferi B31
EGTLTKLGKDWIL

SEQ ID NO: 107995 - protein, 13 aa, Borrelia burgdorferi B31
GTLTKLGKDWILT

SEQ ID NO: 107996 - protein, 13 aa, Borrelia burgdorferi B31
TLTKLGKDWILTY

SEQ ID NO: 107997 - protein, 13 aa, Borrelia burgdorferi B31
LTKLGKDWILTYN

SEQ ID NO: 107998 - protein, 13 aa, Borrelia burgdorferi B31
TKLGKDWILTYNK

SEQ ID NO: 107999 - protein, 13 aa, Borrelia burgdorferi B31
KLGKDWILTYNKQ

SEQ ID NO: 108000 - protein, 13 aa, Borrelia burgdorferi B31
LGKDWILTYNKQN

SEQ ID NO: 108001 - protein, 13 aa, Borrelia burgdorferi B31
GKDWILTYNKQNI

SEQ ID NO: 108002 - protein, 13 aa, Borrelia burgdorferi B31
KDWILTYNKQNIP

SEQ ID NO: 108003 - protein, 13 aa, Borrelia burgdorferi B31
DWILTYNKQNIPV

SEQ ID NO: 108004 - protein, 13 aa, Borrelia burgdorferi B31
WILTYNKQNIPVD

SEQ ID NO: 108005 - protein, 13 aa, Borrelia burgdorferi B31
ILTYNKQNIPVDN

SEQ ID NO: 108006 - protein, 13 aa, Borrelia burgdorferi B31
LTYNKQNIPVDNK

SEQ ID NO: 108007 - protein, 13 aa, Borrelia burgdorferi B31
TYNKQNIPVDNKK

SEQ ID NO: 108008 - protein, 13 aa, Borrelia burgdorferi B31
YNKQNIPVDNKKV

SEQ ID NO: 108009 - protein, 13 aa, Borrelia burgdorferi B31
NKQNIPVDNKKVN

SEQ ID NO: 108010 - protein, 13 aa, Borrelia burgdorferi B31
KQNIPVDNKKVNS

SEQ ID NO: 108011 - protein, 13 aa, Borrelia burgdorferi B31
QNIPVDNKKVNSL

SEQ ID NO: 108012 - protein, 13 aa, Borrelia burgdorferi B31
NIPVDNKKVNSLI

SEQ ID NO: 108013 - protein, 13 aa, Borrelia burgdorferi B31
IPVDNKKVNSLIK

SEQ ID NO: 108014 - protein, 13 aa, Borrelia burgdorferi B31
PVDNKKVNSLIKA

SEQ ID NO: 108015 - protein, 13 aa, Borrelia burgdorferi B31
VDNKKVNSLIKAL

SEQ ID NO: 108016 - protein, 13 aa, Borrelia burgdorferi B31
DNKKVNSLIKALD

SEQ ID NO: 108017 - protein, 13 aa, Borrelia burgdorferi B31
NKKVNSLIKALDE

SEQ ID NO: 108018 - protein, 13 aa, Borrelia burgdorferi B31
KKVNSLIKALDEL

SEQ ID NO: 108019 - protein, 13 aa, Borrelia burgdorferi B31
KVNSLIKALDELQ

SEQ ID NO: 108020 - protein, 13 aa, Borrelia burgdorferi B31
VNSLIKALDELQK

SEQ ID NO: 108021 - protein, 13 aa, Borrelia burgdorferi B31
NSLIKALDELQKN

SEQ ID NO: 108022 - protein, 13 aa, Borrelia burgdorferi B31
SLIKALDELQKNK

SEQ ID NO: 108023 - protein, 13 aa, Borrelia burgdorferi B31
LIKALDELQKNKL

SEQ ID NO: 108024 - protein, 13 aa, Borrelia burgdorferi B31
IKALDELQKNKLV

SEQ ID NO: 108025 - protein, 13 aa, Borrelia burgdorferi B31
KALDELQKNKLVS

SEQ ID NO: 108026 - protein, 13 aa, Borrelia burgdorferi B31
ALDELQKNKLVSR

SEQ ID NO: 108027 - protein, 13 aa, Borrelia burgdorferi B31
LDELQKNKLVSRD

SEQ ID NO: 108028 - protein, 13 aa, Borrelia burgdorferi B31
DELQKNKLVSRDQ

SEQ ID NO: 108029 - protein, 13 aa, Borrelia burgdorferi B31
ELQKNKLVSRDQK

SEQ ID NO: 108030 - protein, 13 aa, Borrelia burgdorferi B31
LQKNKLVSRDQKK

SEQ ID NO: 108031 - protein, 13 aa, Borrelia burgdorferi B31
QKNKLVSRDQKKH

SEQ ID NO: 108032 - protein, 13 aa, Borrelia burgdorferi B31
KNKLVSRDQKKHK

SEQ ID NO: 108033 - protein, 13 aa, Borrelia burgdorferi B31
NKLVSRDQKKHKE

SEQ ID NO: 108034 - protein, 13 aa, Borrelia burgdorferi B31
KLVSRDQKKHKEL

SEQ ID NO: 108035 - protein, 13 aa, Borrelia burgdorferi B31
LVSRDQKKHKELG

SEQ ID NO: 108036 - protein, 13 aa, Borrelia burgdorferi B31
VSRDQKKHKELGI

SEQ ID NO: 108037 - protein, 13 aa, Borrelia burgdorferi B31
SRDQKKHKELGIG

SEQ ID NO: 108038 - protein, 13 aa, Borrelia burgdorferi B31
RDQKKHKELGIGE

SEQ ID NO: 108039 - protein, 13 aa, Borrelia burgdorferi B31
DQKKHKELGIGEN

SEQ ID NO: 108040 - protein, 13 aa, Borrelia burgdorferi B31
QKKHKELGIGENP

SEQ ID NO: 108041 - protein, 13 aa, Borrelia burgdorferi B31
KKHKELGIGENPS

SEQ ID NO: 108042 - protein, 13 aa, Borrelia burgdorferi B31
KHKELGIGENPSF

SEQ ID NO: 108043 - protein, 13 aa, Borrelia burgdorferi B31
HKELGIGENPSFK

SEQ ID NO: 108044 - protein, 13 aa, Borrelia burgdorferi B31
KELGIGENPSFKL

SEQ ID NO: 108045 - protein, 13 aa, Borrelia burgdorferi B31
ELGIGENPSFKLF

SEQ ID NO: 108046 - protein, 13 aa, Borrelia burgdorferi B31
LGIGENPSFKLFD

SEQ ID NO: 108047 - protein, 13 aa, Borrelia burgdorferi B31
GIGENPSFKLFDN

SEQ ID NO: 108048 - protein, 13 aa, Borrelia burgdorferi B31
IGENPSFKLFDNN

SEQ ID NO: 108049 - protein, 13 aa, Borrelia burgdorferi B31
GENPSFKLFDNNN

SEQ ID NO: 108050 - protein, 13 aa, Borrelia burgdorferi B31
ENPSFKLFDNNNK

SEQ ID NO: 108051 - protein, 13 aa, Borrelia burgdorferi B31
NPSFKLFDNNNKL

SEQ ID NO: 108052 - protein, 13 aa, Borrelia burgdorferi B31
PSFKLFDNNNKLL

SEQ ID NO: 108053 - protein, 13 aa, Borrelia burgdorferi B31
SFKLFDNNNKLLT

SEQ ID NO: 108054 - protein, 13 aa, Borrelia burgdorferi B31
FKLFDNNNKLLTE

SEQ ID NO: 108055 - protein, 13 aa, Borrelia burgdorferi B31
KLFDNNNKLLTEI

SEQ ID NO: 108056 - protein, 13 aa, Borrelia burgdorferi B31
LFDNNNKLLTEIF

SEQ ID NO: 108057 - protein, 13 aa, Borrelia burgdorferi B31
FDNNNKLLTEIFV

SEQ ID NO: 108058 - protein, 13 aa, Borrelia burgdorferi B31
DNNNKLLTEIFVG

SEQ ID NO: 108059 - protein, 13 aa, Borrelia burgdorferi B31
NNNKLLTEIFVGK

SEQ ID NO: 108060 - protein, 13 aa, Borrelia burgdorferi B31
NNKLLTEIFVGKS

SEQ ID NO: 108061 - protein, 13 aa, Borrelia burgdorferi B31
NKLLTEIFVGKSG

SEQ ID NO: 108062 - protein, 13 aa, Borrelia burgdorferi B31
KLLTEIFVGKSGE

SEQ ID NO: 108063 - protein, 13 aa, Borrelia burgdorferi B31
LLTEIFVGKSGEG

SEQ ID NO: 108064 - protein, 13 aa, Borrelia burgdorferi B31
LTEIFVGKSGEGD

SEQ ID NO: 108065 - protein, 13 aa, Borrelia burgdorferi B31
TEIFVGKSGEGDS

SEQ ID NO: 108066 - protein, 13 aa, Borrelia burgdorferi B31
EIFVGKSGEGDSR

SEQ ID NO: 108067 - protein, 13 aa, Borrelia burgdorferi B31
IFVGKSGEGDSRL

SEQ ID NO: 108068 - protein, 13 aa, Borrelia burgdorferi B31
FVGKSGEGDSRLA

SEQ ID NO: 108069 - protein, 13 aa, Borrelia burgdorferi B31
VGKSGEGDSRLAY

SEQ ID NO: 108070 - protein, 13 aa, Borrelia burgdorferi B31
GKSGEGDSRLAYI

SEQ ID NO: 108071 - protein, 13 aa, Borrelia burgdorferi B31
KSGEGDSRLAYIK

SEQ ID NO: 108072 - protein, 13 aa, Borrelia burgdorferi B31
SGEGDSRLAYIKG

SEQ ID NO: 108073 - protein, 13 aa, Borrelia burgdorferi B31
GEGDSRLAYIKGS

SEQ ID NO: 108074 - protein, 13 aa, Borrelia burgdorferi B31
EGDSRLAYIKGSD

SEQ ID NO: 108075 - protein, 13 aa, Borrelia burgdorferi B31
GDSRLAYIKGSDE

SEQ ID NO: 108076 - protein, 13 aa, Borrelia burgdorferi B31
DSRLAYIKGSDEN

SEQ ID NO: 108077 - protein, 13 aa, Borrelia burgdorferi B31
SRLAYIKGSDENV

SEQ ID NO: 108078 - protein, 13 aa, Borrelia burgdorferi B31
RLAYIKGSDENVY

SEQ ID NO: 108079 - protein, 13 aa, Borrelia burgdorferi B31
LAYIKGSDENVYL

SEQ ID NO: 108080 - protein, 13 aa, Borrelia burgdorferi B31
AYIKGSDENVYLT

SEQ ID NO: 108081 - protein, 13 aa, Borrelia burgdorferi B31
YIKGSDENVYLTK

SEQ ID NO: 108082 - protein, 13 aa, Borrelia burgdorferi B31
IKGSDENVYLTKN

SEQ ID NO: 108083 - protein, 13 aa, Borrelia burgdorferi B31
KGSDENVYLTKNI

SEQ ID NO: 108084 - protein, 13 aa, Borrelia burgdorferi B31
GSDENVYLTKNIF

SEQ ID NO: 108085 - protein, 13 aa, Borrelia burgdorferi B31
SDENVYLTKNIFL

SEQ ID NO: 108086 - protein, 13 aa, Borrelia burgdorferi B31
DENVYLTKNIFLS

SEQ ID NO: 108087 - protein, 13 aa, Borrelia burgdorferi B31
ENVYLTKNIFLSY

SEQ ID NO: 108088 - protein, 13 aa, Borrelia burgdorferi B31
NVYLTKNIFLSYK

SEQ ID NO: 108089 - protein, 13 aa, Borrelia burgdorferi B31
VYLTKNIFLSYKG

SEQ ID NO: 108090 - protein, 13 aa, Borrelia burgdorferi B31
YLTKNIFLSYKGN

SEQ ID NO: 108091 - protein, 13 aa, Borrelia burgdorferi B31
LTKNIFLSYKGNS

SEQ ID NO: 108092 - protein, 13 aa, Borrelia burgdorferi B31
TKNIFLSYKGNSY

SEQ ID NO: 108093 - protein, 13 aa, Borrelia burgdorferi B31
KNIFLSYKGNSYN

SEQ ID NO: 108094 - protein, 13 aa, Borrelia burgdorferi B31
NIFLSYKGNSYNT

SEQ ID NO: 108095 - protein, 13 aa, Borrelia burgdorferi B31
IFLSYKGNSYNTF

SEQ ID NO: 108096 - protein, 13 aa, Borrelia burgdorferi B31
FLSYKGNSYNTFS

SEQ ID NO: 108097 - protein, 13 aa, Borrelia burgdorferi B31
LSYKGNSYNTFSD

SEQ ID NO: 108098 - protein, 13 aa, Borrelia burgdorferi B31
SYKGNSYNTFSDT

SEQ ID NO: 108099 - protein, 13 aa, Borrelia burgdorferi B31
YKGNSYNTFSDTT

SEQ ID NO: 108100 - protein, 13 aa, Borrelia burgdorferi B31
KGNSYNTFSDTTL

SEQ ID NO: 108101 - protein, 13 aa, Borrelia burgdorferi B31
GNSYNTFSDTTLF

SEQ ID NO: 108102 - protein, 13 aa, Borrelia burgdorferi B31
NSYNTFSDTTLFQ

SEQ ID NO: 108103 - protein, 13 aa, Borrelia burgdorferi B31
SYNTFSDTTLFQE

SEQ ID NO: 108104 - protein, 13 aa, Borrelia burgdorferi B31
YNTFSDTTLFQEK

SEQ ID NO: 108105 - protein, 13 aa, Borrelia burgdorferi B31
NTFSDTTLFQEKN

SEQ ID NO: 108106 - protein, 13 aa, Borrelia burgdorferi B31
TFSDTTLFQEKNT

SEQ ID NO: 108107 - protein, 13 aa, Borrelia burgdorferi B31
FSDTTLFQEKNTK

SEQ ID NO: 108108 - protein, 13 aa, Borrelia burgdorferi B31
SDTTLFQEKNTKL

SEQ ID NO: 108109 - protein, 13 aa, Borrelia burgdorferi B31
DTTLFQEKNTKLE

SEQ ID NO: 108110 - protein, 13 aa, Borrelia burgdorferi B31
TTLFQEKNTKLEN

SEQ ID NO: 108111 - protein, 13 aa, Borrelia burgdorferi B31
TLFQEKNTKLENL

SEQ ID NO: 108112 - protein, 13 aa, Borrelia burgdorferi B31
LFQEKNTKLENLS

SEQ ID NO: 108113 - protein, 13 aa, Borrelia burgdorferi B31
FQEKNTKLENLSF

SEQ ID NO: 108114 - protein, 13 aa, Borrelia burgdorferi B31
QEKNTKLENLSFK

SEQ ID NO: 108115 - protein, 13 aa, Borrelia burgdorferi B31
EKNTKLENLSFKI

SEQ ID NO: 108116 - protein, 13 aa, Borrelia burgdorferi B31
KNTKLENLSFKII

SEQ ID NO: 108117 - protein, 13 aa, Borrelia burgdorferi B31
NTKLENLSFKIIR

SEQ ID NO: 108118 - protein, 13 aa, Borrelia burgdorferi B31
TKLENLSFKIIRK

SEQ ID NO: 108119 - protein, 13 aa, Borrelia burgdorferi B31
KLENLSFKIIRKL

SEQ ID NO: 108120 - protein, 13 aa, Borrelia burgdorferi B31
LENLSFKIIRKLN

SEQ ID NO: 108121 - protein, 13 aa, Borrelia burgdorferi B31
ENLSFKIIRKLNK

SEQ ID NO: 108122 - protein, 13 aa, Borrelia burgdorferi B31
NLSFKIIRKLNKE

SEQ ID NO: 108123 - protein, 13 aa, Borrelia burgdorferi B31
LSFKIIRKLNKEN

SEQ ID NO: 108124 - protein, 13 aa, Borrelia burgdorferi B31
SFKIIRKLNKENE

SEQ ID NO: 108125 - protein, 13 aa, Borrelia burgdorferi B31
FKIIRKLNKENEN

SEQ ID NO: 108126 - protein, 13 aa, Borrelia burgdorferi B31
KIIRKLNKENENN

SEQ ID NO: 108127 - protein, 13 aa, Borrelia burgdorferi B31
IIRKLNKENENNI

SEQ ID NO: 108128 - protein, 13 aa, Borrelia burgdorferi B31
IRKLNKENENNIN

SEQ ID NO: 108129 - protein, 13 aa, Borrelia burgdorferi B31
RKLNKENENNINN

SEQ ID NO: 108130 - protein, 13 aa, Borrelia burgdorferi B31
KLNKENENNINNN

SEQ ID NO: 108131 - protein, 13 aa, Borrelia burgdorferi B31
LNKENENNINNNY

SEQ ID NO: 108132 - protein, 13 aa, Borrelia burgdorferi B31
NKENENNINNNYE

SEQ ID NO: 108133 - protein, 13 aa, Borrelia burgdorferi B31
KENENNINNNYEI

SEQ ID NO: 108134 - protein, 13 aa, Borrelia burgdorferi B31
ENENNINNNYEII

SEQ ID NO: 108135 - protein, 13 aa, Borrelia burgdorferi B31
NENNINNNYEIIS

SEQ ID NO: 108136 - protein, 13 aa, Borrelia burgdorferi B31
ENNINNNYEIISK

SEQ ID NO: 108137 - protein, 13 aa, Borrelia burgdorferi B31
NNINNNYEIISKD

SEQ ID NO: 108138 - protein, 13 aa, Borrelia burgdorferi B31
NINNNYEIISKDG

SEQ ID NO: 108139 - protein, 13 aa, Borrelia burgdorferi B31
INNNYEIISKDGL

SEQ ID NO: 108140 - protein, 13 aa, Borrelia burgdorferi B31
NNNYEIISKDGLY

SEQ ID NO: 108141 - protein, 13 aa, Borrelia burgdorferi B31
NNYEIISKDGLYF

SEQ ID NO: 108142 - protein, 13 aa, Borrelia burgdorferi B31
NYEIISKDGLYFL

SEQ ID NO: 108143 - protein, 13 aa, Borrelia burgdorferi B31
YEIISKDGLYFLN

SEQ ID NO: 108144 - protein, 13 aa, Borrelia burgdorferi B31
EIISKDGLYFLNN

SEQ ID NO: 108145 - protein, 13 aa, Borrelia burgdorferi B31
IISKDGLYFLNNQ

SEQ ID NO: 108146 - protein, 13 aa, Borrelia burgdorferi B31
ISKDGLYFLNNQK

SEQ ID NO: 108147 - protein, 13 aa, Borrelia burgdorferi B31
SKDGLYFLNNQKM

SEQ ID NO: 108148 - protein, 13 aa, Borrelia burgdorferi B31
KDGLYFLNNQKMT

SEQ ID NO: 108149 - protein, 13 aa, Borrelia burgdorferi B31
DGLYFLNNQKMTK

SEQ ID NO: 108150 - protein, 13 aa, Borrelia burgdorferi B31
GLYFLNNQKMTKE

SEQ ID NO: 108151 - protein, 13 aa, Borrelia burgdorferi B31
LYFLNNQKMTKER

SEQ ID NO: 108152 - protein, 13 aa, Borrelia burgdorferi B31
YFLNNQKMTKERP

SEQ ID NO: 108153 - protein, 13 aa, Borrelia burgdorferi B31
FLNNQKMTKERPL

SEQ ID NO: 108154 - protein, 13 aa, Borrelia burgdorferi B31
LNNQKMTKERPLN

SEQ ID NO: 108155 - protein, 13 aa, Borrelia burgdorferi B31
NNQKMTKERPLNI

SEQ ID NO: 108156 - protein, 13 aa, Borrelia burgdorferi B31
NQKMTKERPLNII

SEQ ID NO: 108157 - protein, 13 aa, Borrelia burgdorferi B31
QKMTKERPLNIIA

SEQ ID NO: 108158 - protein, 13 aa, Borrelia burgdorferi B31
KMTKERPLNIIAE

SEQ ID NO: 108159 - protein, 13 aa, Borrelia burgdorferi B31
MTKERPLNIIAEF

SEQ ID NO: 108160 - protein, 13 aa, Borrelia burgdorferi B31
TKERPLNIIAEFK

SEQ ID NO: 108161 - protein, 13 aa, Borrelia burgdorferi B31
KERPLNIIAEFKA

SEQ ID NO: 108162 - protein, 13 aa, Borrelia burgdorferi B31
ERPLNIIAEFKAD

SEQ ID NO: 108163 - protein, 13 aa, Borrelia burgdorferi B31
RPLNIIAEFKADG

SEQ ID NO: 108164 - protein, 13 aa, Borrelia burgdorferi B31
PLNIIAEFKADGL

SEQ ID NO: 108165 - protein, 13 aa, Borrelia burgdorferi B31
LNIIAEFKADGLE

SEQ ID NO: 108166 - protein, 13 aa, Borrelia burgdorferi B31
NIIAEFKADGLEI

SEQ ID NO: 108167 - protein, 13 aa, Borrelia burgdorferi B31
IIAEFKADGLEID

SEQ ID NO: 108168 - protein, 13 aa, Borrelia burgdorferi B31
IAEFKADGLEIDK

SEQ ID NO: 108169 - protein, 13 aa, Borrelia burgdorferi B31
AEFKADGLEIDKS

SEQ ID NO: 108170 - protein, 13 aa, Borrelia burgdorferi B31
EFKADGLEIDKSK

SEQ ID NO: 108171 - protein, 13 aa, Borrelia burgdorferi B31
FKADGLEIDKSKI

SEQ ID NO: 108172 - protein, 13 aa, Borrelia burgdorferi B31
KADGLEIDKSKID

SEQ ID NO: 108173 - protein, 13 aa, Borrelia burgdorferi B31
ADGLEIDKSKIDD

SEQ ID NO: 108174 - protein, 13 aa, Borrelia burgdorferi B31
DGLEIDKSKIDDY

SEQ ID NO: 108175 - protein, 13 aa, Borrelia burgdorferi B31
GLEIDKSKIDDYN

SEQ ID NO: 108176 - protein, 13 aa, Borrelia burgdorferi B31
LEIDKSKIDDYNL

SEQ ID NO: 108177 - protein, 13 aa, Borrelia burgdorferi B31
EIDKSKIDDYNLQ

SEQ ID NO: 108178 - protein, 13 aa, Borrelia burgdorferi B31
IDKSKIDDYNLQY

SEQ ID NO: 108179 - protein, 13 aa, Borrelia burgdorferi B31
DKSKIDDYNLQYK

SEQ ID NO: 108180 - protein, 13 aa, Borrelia burgdorferi B31
KSKIDDYNLQYKI

SEQ ID NO: 108181 - protein, 13 aa, Borrelia burgdorferi B31
SKIDDYNLQYKIE

SEQ ID NO: 108182 - protein, 13 aa, Borrelia burgdorferi B31
KIDDYNLQYKIEV

SEQ ID NO: 108183 - protein, 13 aa, Borrelia burgdorferi B31
IDDYNLQYKIEVK

SEQ ID NO: 108184 - protein, 13 aa, Borrelia burgdorferi B31
DDYNLQYKIEVKW

SEQ ID NO: 108185 - protein, 13 aa, Borrelia burgdorferi B31
DYNLQYKIEVKWS

SEQ ID NO: 108186 - protein, 13 aa, Borrelia burgdorferi B31
YNLQYKIEVKWSN

SEQ ID NO: 108187 - protein, 13 aa, Borrelia burgdorferi B31
NLQYKIEVKWSNK

SEQ ID NO: 108188 - protein, 13 aa, Borrelia burgdorferi B31
LQYKIEVKWSNKS

SEQ ID NO: 108189 - protein, 13 aa, Borrelia burgdorferi B31
QYKIEVKWSNKSV

SEQ ID NO: 108190 - protein, 13 aa, Borrelia burgdorferi B31
YKIEVKWSNKSVN

SEQ ID NO: 108191 - protein, 13 aa, Borrelia burgdorferi B31
KIEVKWSNKSVNN

SEQ ID NO: 108192 - protein, 13 aa, Borrelia burgdorferi B31
IEVKWSNKSVNNI

SEQ ID NO: 108193 - protein, 13 aa, Borrelia burgdorferi B31
EVKWSNKSVNNIE

SEQ ID NO: 108194 - protein, 13 aa, Borrelia burgdorferi B31
VKWSNKSVNNIEV

SEQ ID NO: 108195 - protein, 13 aa, Borrelia burgdorferi B31
KWSNKSVNNIEVY

SEQ ID NO: 108196 - protein, 13 aa, Borrelia burgdorferi B31
WSNKSVNNIEVYF

SEQ ID NO: 108197 - protein, 13 aa, Borrelia burgdorferi B31
SNKSVNNIEVYFN

SEQ ID NO: 108198 - protein, 13 aa, Borrelia burgdorferi B31
NKSVNNIEVYFNK

SEQ ID NO: 108199 - protein, 13 aa, Borrelia burgdorferi B31
KSVNNIEVYFNKN

SEQ ID NO: 108200 - protein, 13 aa, Borrelia burgdorferi B31
SVNNIEVYFNKNE

SEQ ID NO: 108201 - protein, 13 aa, Borrelia burgdorferi B31
VNNIEVYFNKNEE

SEQ ID NO: 108202 - protein, 13 aa, Borrelia burgdorferi B31
NNIEVYFNKNEEN

SEQ ID NO: 108203 - protein, 13 aa, Borrelia burgdorferi B31
NIEVYFNKNEEND

SEQ ID NO: 108204 - protein, 13 aa, Borrelia burgdorferi B31
IEVYFNKNEENDK

SEQ ID NO: 108205 - protein, 13 aa, Borrelia burgdorferi B31
EVYFNKNEENDKD

SEQ ID NO: 108206 - protein, 13 aa, Borrelia burgdorferi B31
VYFNKNEENDKDI

SEQ ID NO: 108207 - protein, 13 aa, Borrelia burgdorferi B31
YFNKNEENDKDIL

SEQ ID NO: 108208 - protein, 13 aa, Borrelia burgdorferi B31
FNKNEENDKDILI

SEQ ID NO: 108209 - protein, 13 aa, Borrelia burgdorferi B31
NKNEENDKDILIK

SEQ ID NO: 108210 - protein, 13 aa, Borrelia burgdorferi B31
KNEENDKDILIKK

SEQ ID NO: 108211 - protein, 13 aa, Borrelia burgdorferi B31
NEENDKDILIKKD

SEQ ID NO: 108212 - protein, 13 aa, Borrelia burgdorferi B31
EENDKDILIKKDK

SEQ ID NO: 108213 - protein, 13 aa, Borrelia burgdorferi B31
ENDKDILIKKDKD

SEQ ID NO: 108214 - protein, 13 aa, Borrelia burgdorferi B31
NDKDILIKKDKDE

SEQ ID NO: 108215 - protein, 13 aa, Borrelia burgdorferi B31
DKDILIKKDKDEY

SEQ ID NO: 108216 - protein, 13 aa, Borrelia burgdorferi B31
KDILIKKDKDEYY

SEQ ID NO: 108217 - protein, 13 aa, Borrelia burgdorferi B31
DILIKKDKDEYYY

SEQ ID NO: 108218 - protein, 13 aa, Borrelia burgdorferi B31
ILIKKDKDEYYYT

SEQ ID NO: 108219 - protein, 13 aa, Borrelia burgdorferi B31
LIKKDKDEYYYTT

SEQ ID NO: 108220 - protein, 13 aa, Borrelia burgdorferi B31
IKKDKDEYYYTTS

SEQ ID NO: 108221 - protein, 13 aa, Borrelia burgdorferi B31
KKDKDEYYYTTSK

SEQ ID NO: 108222 - protein, 13 aa, Borrelia burgdorferi B31
KDKDEYYYTTSKW

SEQ ID NO: 108223 - protein, 13 aa, Borrelia burgdorferi B31
DKDEYYYTTSKWT

SEQ ID NO: 108224 - protein, 13 aa, Borrelia burgdorferi B31
KDEYYYTTSKWTF

SEQ ID NO: 108225 - protein, 13 aa, Borrelia burgdorferi B31
DEYYYTTSKWTFF

SEQ ID NO: 108226 - protein, 13 aa, Borrelia burgdorferi B31
EYYYTTSKWTFFD

SEQ ID NO: 108227 - protein, 13 aa, Borrelia burgdorferi B31
YYYTTSKWTFFDV

SEQ ID NO: 108228 - protein, 13 aa, Borrelia burgdorferi B31
YYTTSKWTFFDVF

SEQ ID NO: 108229 - protein, 13 aa, Borrelia burgdorferi B31
YTTSKWTFFDVFD

SEQ ID NO: 108230 - protein, 13 aa, Borrelia burgdorferi B31
TTSKWTFFDVFDL

SEQ ID NO: 108231 - protein, 13 aa, Borrelia burgdorferi B31
TSKWTFFDVFDLE

SEQ ID NO: 108232 - protein, 13 aa, Borrelia burgdorferi B31
SKWTFFDVFDLEK

SEQ ID NO: 108233 - protein, 13 aa, Borrelia burgdorferi B31
KWTFFDVFDLEKK

SEQ ID NO: 108234 - protein, 13 aa, Borrelia burgdorferi B31
WTFFDVFDLEKKL

SEQ ID NO: 108235 - protein, 13 aa, Borrelia burgdorferi B31
TFFDVFDLEKKLT

SEQ ID NO: 108236 - protein, 13 aa, Borrelia burgdorferi B31
FFDVFDLEKKLTE

SEQ ID NO: 108237 - protein, 13 aa, Borrelia burgdorferi B31
FDVFDLEKKLTEK

SEQ ID NO: 108238 - protein, 13 aa, Borrelia burgdorferi B31
DVFDLEKKLTEKD

SEQ ID NO: 108239 - protein, 13 aa, Borrelia burgdorferi B31
VFDLEKKLTEKDD

SEQ ID NO: 108240 - protein, 13 aa, Borrelia burgdorferi B31
FDLEKKLTEKDDI

SEQ ID NO: 108241 - protein, 13 aa, Borrelia burgdorferi B31
DLEKKLTEKDDIS

SEQ ID NO: 108242 - protein, 13 aa, Borrelia burgdorferi B31
LEKKLTEKDDISS

SEQ ID NO: 108243 - protein, 13 aa, Borrelia burgdorferi B31
EKKLTEKDDISSN

SEQ ID NO: 108244 - protein, 13 aa, Borrelia burgdorferi B31
KKLTEKDDISSND

SEQ ID NO: 108245 - protein, 13 aa, Borrelia burgdorferi B31
KLTEKDDISSNDN

SEQ ID NO: 108246 - protein, 13 aa, Borrelia burgdorferi B31
LTEKDDISSNDNQ

SEQ ID NO: 108247 - protein, 13 aa, Borrelia burgdorferi B31
TEKDDISSNDNQE

SEQ ID NO: 108248 - protein, 13 aa, Borrelia burgdorferi B31
EKDDISSNDNQED

SEQ ID NO: 108249 - protein, 13 aa, Borrelia burgdorferi B31
KDDISSNDNQEDH

SEQ ID NO: 108250 - protein, 13 aa, Borrelia burgdorferi B31
DDISSNDNQEDHH

SEQ ID NO: 108251 - protein, 13 aa, Borrelia burgdorferi B31
DISSNDNQEDHHE

SEQ ID NO: 108252 - protein, 13 aa, Borrelia burgdorferi B31
ISSNDNQEDHHEH

SEQ ID NO: 108253 - protein, 13 aa, Borrelia burgdorferi B31
SSNDNQEDHHEHH

SEQ ID NO: 108254 - protein, 13 aa, Borrelia burgdorferi B31
SNDNQEDHHEHHN

SEQ ID NO: 108255 - protein, 13 aa, Borrelia burgdorferi B31
NDNQEDHHEHHNN

SEQ ID NO: 108256 - protein, 13 aa, Borrelia burgdorferi B31
DNQEDHHEHHNNA

SEQ ID NO: 108257 - protein, 13 aa, Borrelia burgdorferi B31
NQEDHHEHHNNAD

SEQ ID NO: 108258 - protein, 14 aa, Borrelia burgdorferi B31
MDLLDLLEKEKQIN

SEQ ID NO: 108259 - protein, 14 aa, Borrelia burgdorferi B31
DLLDLLEKEKQINK

SEQ ID NO: 108260 - protein, 14 aa, Borrelia burgdorferi B31
LLDLLEKEKQINKN

SEQ ID NO: 108261 - protein, 14 aa, Borrelia burgdorferi B31
LDLLEKEKQINKNK

SEQ ID NO: 108262 - protein, 14 aa, Borrelia burgdorferi B31
DLLEKEKQINKNKG

SEQ ID NO: 108263 - protein, 14 aa, Borrelia burgdorferi B31
LLEKEKQINKNKGV

SEQ ID NO: 108264 - protein, 14 aa, Borrelia burgdorferi B31
LEKEKQINKNKGVF

SEQ ID NO: 108265 - protein, 14 aa, Borrelia burgdorferi B31
EKEKQINKNKGVFM

SEQ ID NO: 108266 - protein, 14 aa, Borrelia burgdorferi B31
KEKQINKNKGVFMT

SEQ ID NO: 108267 - protein, 14 aa, Borrelia burgdorferi B31
EKQINKNKGVFMTK

SEQ ID NO: 108268 - protein, 14 aa, Borrelia burgdorferi B31
KQINKNKGVFMTKP

SEQ ID NO: 108269 - protein, 14 aa, Borrelia burgdorferi B31
QINKNKGVFMTKPK

SEQ ID NO: 108270 - protein, 14 aa, Borrelia burgdorferi B31
INKNKGVFMTKPKI

SEQ ID NO: 108271 - protein, 14 aa, Borrelia burgdorferi B31
NKNKGVFMTKPKIF

SEQ ID NO: 108272 - protein, 14 aa, Borrelia burgdorferi B31
KNKGVFMTKPKIFS

SEQ ID NO: 108273 - protein, 14 aa, Borrelia burgdorferi B31
NKGVFMTKPKIFSI

SEQ ID NO: 108274 - protein, 14 aa, Borrelia burgdorferi B31
KGVFMTKPKIFSIN

SEQ ID NO: 108275 - protein, 14 aa, Borrelia burgdorferi B31
GVFMTKPKIFSINK

SEQ ID NO: 108276 - protein, 14 aa, Borrelia burgdorferi B31
VFMTKPKIFSINKE

SEQ ID NO: 108277 - protein, 14 aa, Borrelia burgdorferi B31
FMTKPKIFSINKEK

SEQ ID NO: 108278 - protein, 14 aa, Borrelia burgdorferi B31
MTKPKIFSINKEKI

SEQ ID NO: 108279 - protein, 14 aa, Borrelia burgdorferi B31
TKPKIFSINKEKIK

SEQ ID NO: 108280 - protein, 14 aa, Borrelia burgdorferi B31
KPKIFSINKEKIKI

SEQ ID NO: 108281 - protein, 14 aa, Borrelia burgdorferi B31
PKIFSINKEKIKIL

SEQ ID NO: 108282 - protein, 14 aa, Borrelia burgdorferi B31
KIFSINKEKIKILI

SEQ ID NO: 108283 - protein, 14 aa, Borrelia burgdorferi B31
IFSINKEKIKILII

SEQ ID NO: 108284 - protein, 14 aa, Borrelia burgdorferi B31
FSINKEKIKILIIV

SEQ ID NO: 108285 - protein, 14 aa, Borrelia burgdorferi B31
SINKEKIKILIIVV

SEQ ID NO: 108286 - protein, 14 aa, Borrelia burgdorferi B31
INKEKIKILIIVVL

SEQ ID NO: 108287 - protein, 14 aa, Borrelia burgdorferi B31
NKEKIKILIIVVLT

SEQ ID NO: 108288 - protein, 14 aa, Borrelia burgdorferi B31
KEKIKILIIVVLTS

SEQ ID NO: 108289 - protein, 14 aa, Borrelia burgdorferi B31
EKIKILIIVVLTST

SEQ ID NO: 108290 - protein, 14 aa, Borrelia burgdorferi B31
KIKILIIVVLTSTF

SEQ ID NO: 108291 - protein, 14 aa, Borrelia burgdorferi B31
IKILIIVVLTSTFL

SEQ ID NO: 108292 - protein, 14 aa, Borrelia burgdorferi B31
KILIIVVLTSTFLL

SEQ ID NO: 108293 - protein, 14 aa, Borrelia burgdorferi B31
ILIIVVLTSTFLLG

SEQ ID NO: 108294 - protein, 14 aa, Borrelia burgdorferi B31
LIIVVLTSTFLLGI

SEQ ID NO: 108295 - protein, 14 aa, Borrelia burgdorferi B31
IIVVLTSTFLLGII

SEQ ID NO: 108296 - protein, 14 aa, Borrelia burgdorferi B31
IVVLTSTFLLGIIF

SEQ ID NO: 108297 - protein, 14 aa, Borrelia burgdorferi B31
VVLTSTFLLGIIFS

SEQ ID NO: 108298 - protein, 14 aa, Borrelia burgdorferi B31
VLTSTFLLGIIFSN

SEQ ID NO: 108299 - protein, 14 aa, Borrelia burgdorferi B31
LTSTFLLGIIFSNE

SEQ ID NO: 108300 - protein, 14 aa, Borrelia burgdorferi B31
TSTFLLGIIFSNEN

SEQ ID NO: 108301 - protein, 14 aa, Borrelia burgdorferi B31
STFLLGIIFSNENK

SEQ ID NO: 108302 - protein, 14 aa, Borrelia burgdorferi B31
TFLLGIIFSNENKV

SEQ ID NO: 108303 - protein, 14 aa, Borrelia burgdorferi B31
FLLGIIFSNENKVA

SEQ ID NO: 108304 - protein, 14 aa, Borrelia burgdorferi B31
LLGIIFSNENKVAR

SEQ ID NO: 108305 - protein, 14 aa, Borrelia burgdorferi B31
LGIIFSNENKVARI

SEQ ID NO: 108306 - protein, 14 aa, Borrelia burgdorferi B31
GIIFSNENKVARIL

SEQ ID NO: 108307 - protein, 14 aa, Borrelia burgdorferi B31
IIFSNENKVARILE

SEQ ID NO: 108308 - protein, 14 aa, Borrelia burgdorferi B31
IFSNENKVARILEE

SEQ ID NO: 108309 - protein, 14 aa, Borrelia burgdorferi B31
FSNENKVARILEEK

SEQ ID NO: 108310 - protein, 14 aa, Borrelia burgdorferi B31
SNENKVARILEEKF

SEQ ID NO: 108311 - protein, 14 aa, Borrelia burgdorferi B31
NENKVARILEEKFF

SEQ ID NO: 108312 - protein, 14 aa, Borrelia burgdorferi B31
ENKVARILEEKFFD

SEQ ID NO: 108313 - protein, 14 aa, Borrelia burgdorferi B31
NKVARILEEKFFDF

SEQ ID NO: 108314 - protein, 14 aa, Borrelia burgdorferi B31
KVARILEEKFFDFD

SEQ ID NO: 108315 - protein, 14 aa, Borrelia burgdorferi B31
VARILEEKFFDFDF

SEQ ID NO: 108316 - protein, 14 aa, Borrelia burgdorferi B31
ARILEEKFFDFDFN

SEQ ID NO: 108317 - protein, 14 aa, Borrelia burgdorferi B31
RILEEKFFDFDFNL

SEQ ID NO: 108318 - protein, 14 aa, Borrelia burgdorferi B31
ILEEKFFDFDFNLI

SEQ ID NO: 108319 - protein, 14 aa, Borrelia burgdorferi B31
LEEKFFDFDFNLIS

SEQ ID NO: 108320 - protein, 14 aa, Borrelia burgdorferi B31
EEKFFDFDFNLISK

SEQ ID NO: 108321 - protein, 14 aa, Borrelia burgdorferi B31
EKFFDFDFNLISKI

SEQ ID NO: 108322 - protein, 14 aa, Borrelia burgdorferi B31
KFFDFDFNLISKIE

SEQ ID NO: 108323 - protein, 14 aa, Borrelia burgdorferi B31
FFDFDFNLISKIET

SEQ ID NO: 108324 - protein, 14 aa, Borrelia burgdorferi B31
FDFDFNLISKIETE

SEQ ID NO: 108325 - protein, 14 aa, Borrelia burgdorferi B31
DFDFNLISKIETEL

SEQ ID NO: 108326 - protein, 14 aa, Borrelia burgdorferi B31
FDFNLISKIETELE

SEQ ID NO: 108327 - protein, 14 aa, Borrelia burgdorferi B31
DFNLISKIETELEG

SEQ ID NO: 108328 - protein, 14 aa, Borrelia burgdorferi B31
FNLISKIETELEGT

SEQ ID NO: 108329 - protein, 14 aa, Borrelia burgdorferi B31
NLISKIETELEGTL

SEQ ID NO: 108330 - protein, 14 aa, Borrelia burgdorferi B31
LISKIETELEGTLT

SEQ ID NO: 108331 - protein, 14 aa, Borrelia burgdorferi B31
ISKIETELEGTLTK

SEQ ID NO: 108332 - protein, 14 aa, Borrelia burgdorferi B31
SKIETELEGTLTKL

SEQ ID NO: 108333 - protein, 14 aa, Borrelia burgdorferi B31
KIETELEGTLTKLG

SEQ ID NO: 108334 - protein, 14 aa, Borrelia burgdorferi B31
IETELEGTLTKLGK

SEQ ID NO: 108335 - protein, 14 aa, Borrelia burgdorferi B31
ETELEGTLTKLGKD

SEQ ID NO: 108336 - protein, 14 aa, Borrelia burgdorferi B31
TELEGTLTKLGKDW

SEQ ID NO: 108337 - protein, 14 aa, Borrelia burgdorferi B31
ELEGTLTKLGKDWI

SEQ ID NO: 108338 - protein, 14 aa, Borrelia burgdorferi B31
LEGTLTKLGKDWIL

SEQ ID NO: 108339 - protein, 14 aa, Borrelia burgdorferi B31
EGTLTKLGKDWILT

SEQ ID NO: 108340 - protein, 14 aa, Borrelia burgdorferi B31
GTLTKLGKDWILTY

SEQ ID NO: 108341 - protein, 14 aa, Borrelia burgdorferi B31
TLTKLGKDWILTYN

SEQ ID NO: 108342 - protein, 14 aa, Borrelia burgdorferi B31
LTKLGKDWILTYNK

SEQ ID NO: 108343 - protein, 14 aa, Borrelia burgdorferi B31
TKLGKDWILTYNKQ

SEQ ID NO: 108344 - protein, 14 aa, Borrelia burgdorferi B31
KLGKDWILTYNKQN

SEQ ID NO: 108345 - protein, 14 aa, Borrelia burgdorferi B31
LGKDWILTYNKQNI

SEQ ID NO: 108346 - protein, 14 aa, Borrelia burgdorferi B31
GKDWILTYNKQNIP

SEQ ID NO: 108347 - protein, 14 aa, Borrelia burgdorferi B31
KDWILTYNKQNIPV

SEQ ID NO: 108348 - protein, 14 aa, Borrelia burgdorferi B31
DWILTYNKQNIPVD

SEQ ID NO: 108349 - protein, 14 aa, Borrelia burgdorferi B31
WILTYNKQNIPVDN

SEQ ID NO: 108350 - protein, 14 aa, Borrelia burgdorferi B31
ILTYNKQNIPVDNK

SEQ ID NO: 108351 - protein, 14 aa, Borrelia burgdorferi B31
LTYNKQNIPVDNKK

SEQ ID NO: 108352 - protein, 14 aa, Borrelia burgdorferi B31
TYNKQNIPVDNKKV

SEQ ID NO: 108353 - protein, 14 aa, Borrelia burgdorferi B31
YNKQNIPVDNKKVN

SEQ ID NO: 108354 - protein, 14 aa, Borrelia burgdorferi B31
NKQNIPVDNKKVNS

SEQ ID NO: 108355 - protein, 14 aa, Borrelia burgdorferi B31
KQNIPVDNKKVNSL

SEQ ID NO: 108356 - protein, 14 aa, Borrelia burgdorferi B31
QNIPVDNKKVNSLI

SEQ ID NO: 108357 - protein, 14 aa, Borrelia burgdorferi B31
NIPVDNKKVNSLIK

SEQ ID NO: 108358 - protein, 14 aa, Borrelia burgdorferi B31
IPVDNKKVNSLIKA

SEQ ID NO: 108359 - protein, 14 aa, Borrelia burgdorferi B31
PVDNKKVNSLIKAL

SEQ ID NO: 108360 - protein, 14 aa, Borrelia burgdorferi B31
VDNKKVNSLIKALD

SEQ ID NO: 108361 - protein, 14 aa, Borrelia burgdorferi B31
DNKKVNSLIKALDE

SEQ ID NO: 108362 - protein, 14 aa, Borrelia burgdorferi B31
NKKVNSLIKALDEL

SEQ ID NO: 108363 - protein, 14 aa, Borrelia burgdorferi B31
KKVNSLIKALDELQ

SEQ ID NO: 108364 - protein, 14 aa, Borrelia burgdorferi B31
KVNSLIKALDELQK

SEQ ID NO: 108365 - protein, 14 aa, Borrelia burgdorferi B31
VNSLIKALDELQKN

SEQ ID NO: 108366 - protein, 14 aa, Borrelia burgdorferi B31
NSLIKALDELQKNK

SEQ ID NO: 108367 - protein, 14 aa, Borrelia burgdorferi B31
SLIKALDELQKNKL

SEQ ID NO: 108368 - protein, 14 aa, Borrelia burgdorferi B31
LIKALDELQKNKLV

SEQ ID NO: 108369 - protein, 14 aa, Borrelia burgdorferi B31
IKALDELQKNKLVS

SEQ ID NO: 108370 - protein, 14 aa, Borrelia burgdorferi B31
KALDELQKNKLVSR

SEQ ID NO: 108371 - protein, 14 aa, Borrelia burgdorferi B31
ALDELQKNKLVSRD

SEQ ID NO: 108372 - protein, 14 aa, Borrelia burgdorferi B31
LDELQKNKLVSRDQ

SEQ ID NO: 108373 - protein, 14 aa, Borrelia burgdorferi B31
DELQKNKLVSRDQK

SEQ ID NO: 108374 - protein, 14 aa, Borrelia burgdorferi B31
ELQKNKLVSRDQKK

SEQ ID NO: 108375 - protein, 14 aa, Borrelia burgdorferi B31
LQKNKLVSRDQKKH

SEQ ID NO: 108376 - protein, 14 aa, Borrelia burgdorferi B31
QKNKLVSRDQKKHK

SEQ ID NO: 108377 - protein, 14 aa, Borrelia burgdorferi B31
KNKLVSRDQKKHKE

SEQ ID NO: 108378 - protein, 14 aa, Borrelia burgdorferi B31
NKLVSRDQKKHKEL

SEQ ID NO: 108379 - protein, 14 aa, Borrelia burgdorferi B31
KLVSRDQKKHKELG

SEQ ID NO: 108380 - protein, 14 aa, Borrelia burgdorferi B31
LVSRDQKKHKELGI

SEQ ID NO: 108381 - protein, 14 aa, Borrelia burgdorferi B31
VSRDQKKHKELGIG

SEQ ID NO: 108382 - protein, 14 aa, Borrelia burgdorferi B31
SRDQKKHKELGIGE

SEQ ID NO: 108383 - protein, 14 aa, Borrelia burgdorferi B31
RDQKKHKELGIGEN

SEQ ID NO: 108384 - protein, 14 aa, Borrelia burgdorferi B31
DQKKHKELGIGENP

SEQ ID NO: 108385 - protein, 14 aa, Borrelia burgdorferi B31
QKKHKELGIGENPS

SEQ ID NO: 108386 - protein, 14 aa, Borrelia burgdorferi B31
KKHKELGIGENPSF

SEQ ID NO: 108387 - protein, 14 aa, Borrelia burgdorferi B31
KHKELGIGENPSFK

SEQ ID NO: 108388 - protein, 14 aa, Borrelia burgdorferi B31
HKELGIGENPSFKL

SEQ ID NO: 108389 - protein, 14 aa, Borrelia burgdorferi B31
KELGIGENPSFKLF

SEQ ID NO: 108390 - protein, 14 aa, Borrelia burgdorferi B31
ELGIGENPSFKLFD

SEQ ID NO: 108391 - protein, 14 aa, Borrelia burgdorferi B31
LGIGENPSFKLFDN

SEQ ID NO: 108392 - protein, 14 aa, Borrelia burgdorferi B31
GIGENPSFKLFDNN

SEQ ID NO: 108393 - protein, 14 aa, Borrelia burgdorferi B31
IGENPSFKLFDNNN

SEQ ID NO: 108394 - protein, 14 aa, Borrelia burgdorferi B31
GENPSFKLFDNNNK

SEQ ID NO: 108395 - protein, 14 aa, Borrelia burgdorferi B31
ENPSFKLFDNNNKL

SEQ ID NO: 108396 - protein, 14 aa, Borrelia burgdorferi B31
NPSFKLFDNNNKLL

SEQ ID NO: 108397 - protein, 14 aa, Borrelia burgdorferi B31
PSFKLFDNNNKLLT

SEQ ID NO: 108398 - protein, 14 aa, Borrelia burgdorferi B31
SFKLFDNNNKLLTE

SEQ ID NO: 108399 - protein, 14 aa, Borrelia burgdorferi B31
FKLFDNNNKLLTEI

SEQ ID NO: 108400 - protein, 14 aa, Borrelia burgdorferi B31
KLFDNNNKLLTEIF

SEQ ID NO: 108401 - protein, 14 aa, Borrelia burgdorferi B31
LFDNNNKLLTEIFV

SEQ ID NO: 108402 - protein, 14 aa, Borrelia burgdorferi B31
FDNNNKLLTEIFVG

SEQ ID NO: 108403 - protein, 14 aa, Borrelia burgdorferi B31
DNNNKLLTEIFVGK

SEQ ID NO: 108404 - protein, 14 aa, Borrelia burgdorferi B31
NNNKLLTEIFVGKS

SEQ ID NO: 108405 - protein, 14 aa, Borrelia burgdorferi B31
NNKLLTEIFVGKSG

SEQ ID NO: 108406 - protein, 14 aa, Borrelia burgdorferi B31
NKLLTEIFVGKSGE

SEQ ID NO: 108407 - protein, 14 aa, Borrelia burgdorferi B31
KLLTEIFVGKSGEG

SEQ ID NO: 108408 - protein, 14 aa, Borrelia burgdorferi B31
LLTEIFVGKSGEGD

SEQ ID NO: 108409 - protein, 14 aa, Borrelia burgdorferi B31
LTEIFVGKSGEGDS

SEQ ID NO: 108410 - protein, 14 aa, Borrelia burgdorferi B31
TEIFVGKSGEGDSR

SEQ ID NO: 108411 - protein, 14 aa, Borrelia burgdorferi B31
EIFVGKSGEGDSRL

SEQ ID NO: 108412 - protein, 14 aa, Borrelia burgdorferi B31
IFVGKSGEGDSRLA

SEQ ID NO: 108413 - protein, 14 aa, Borrelia burgdorferi B31
FVGKSGEGDSRLAY

SEQ ID NO: 108414 - protein, 14 aa, Borrelia burgdorferi B31
VGKSGEGDSRLAYI

SEQ ID NO: 108415 - protein, 14 aa, Borrelia burgdorferi B31
GKSGEGDSRLAYIK

SEQ ID NO: 108416 - protein, 14 aa, Borrelia burgdorferi B31
KSGEGDSRLAYIKG

SEQ ID NO: 108417 - protein, 14 aa, Borrelia burgdorferi B31
SGEGDSRLAYIKGS

SEQ ID NO: 108418 - protein, 14 aa, Borrelia burgdorferi B31
GEGDSRLAYIKGSD

SEQ ID NO: 108419 - protein, 14 aa, Borrelia burgdorferi B31
EGDSRLAYIKGSDE

SEQ ID NO: 108420 - protein, 14 aa, Borrelia burgdorferi B31
GDSRLAYIKGSDEN

SEQ ID NO: 108421 - protein, 14 aa, Borrelia burgdorferi B31
DSRLAYIKGSDENV

SEQ ID NO: 108422 - protein, 14 aa, Borrelia burgdorferi B31
SRLAYIKGSDENVY

SEQ ID NO: 108423 - protein, 14 aa, Borrelia burgdorferi B31
RLAYIKGSDENVYL

SEQ ID NO: 108424 - protein, 14 aa, Borrelia burgdorferi B31
LAYIKGSDENVYLT

SEQ ID NO: 108425 - protein, 14 aa, Borrelia burgdorferi B31
AYIKGSDENVYLTK

SEQ ID NO: 108426 - protein, 14 aa, Borrelia burgdorferi B31
YIKGSDENVYLTKN

SEQ ID NO: 108427 - protein, 14 aa, Borrelia burgdorferi B31
IKGSDENVYLTKNI

SEQ ID NO: 108428 - protein, 14 aa, Borrelia burgdorferi B31
KGSDENVYLTKNIF

SEQ ID NO: 108429 - protein, 14 aa, Borrelia burgdorferi B31
GSDENVYLTKNIFL

SEQ ID NO: 108430 - protein, 14 aa, Borrelia burgdorferi B31
SDENVYLTKNIFLS

SEQ ID NO: 108431 - protein, 14 aa, Borrelia burgdorferi B31
DENVYLTKNIFLSY

SEQ ID NO: 108432 - protein, 14 aa, Borrelia burgdorferi B31
ENVYLTKNIFLSYK

SEQ ID NO: 108433 - protein, 14 aa, Borrelia burgdorferi B31
NVYLTKNIFLSYKG

SEQ ID NO: 108434 - protein, 14 aa, Borrelia burgdorferi B31
VYLTKNIFLSYKGN

SEQ ID NO: 108435 - protein, 14 aa, Borrelia burgdorferi B31
YLTKNIFLSYKGNS

SEQ ID NO: 108436 - protein, 14 aa, Borrelia burgdorferi B31
LTKNIFLSYKGNSY

SEQ ID NO: 108437 - protein, 14 aa, Borrelia burgdorferi B31
TKNIFLSYKGNSYN

SEQ ID NO: 108438 - protein, 14 aa, Borrelia burgdorferi B31
KNIFLSYKGNSYNT

SEQ ID NO: 108439 - protein, 14 aa, Borrelia burgdorferi B31
NIFLSYKGNSYNTF

SEQ ID NO: 108440 - protein, 14 aa, Borrelia burgdorferi B31
IFLSYKGNSYNTFS

SEQ ID NO: 108441 - protein, 14 aa, Borrelia burgdorferi B31
FLSYKGNSYNTFSD

SEQ ID NO: 108442 - protein, 14 aa, Borrelia burgdorferi B31
LSYKGNSYNTFSDT

SEQ ID NO: 108443 - protein, 14 aa, Borrelia burgdorferi B31
SYKGNSYNTFSDTT

SEQ ID NO: 108444 - protein, 14 aa, Borrelia burgdorferi B31
YKGNSYNTFSDTTL

SEQ ID NO: 108445 - protein, 14 aa, Borrelia burgdorferi B31
KGNSYNTFSDTTLF

SEQ ID NO: 108446 - protein, 14 aa, Borrelia burgdorferi B31
GNSYNTFSDTTLFQ

SEQ ID NO: 108447 - protein, 14 aa, Borrelia burgdorferi B31
NSYNTFSDTTLFQE

SEQ ID NO: 108448 - protein, 14 aa, Borrelia burgdorferi B31
SYNTFSDTTLFQEK

SEQ ID NO: 108449 - protein, 14 aa, Borrelia burgdorferi B31
YNTFSDTTLFQEKN

SEQ ID NO: 108450 - protein, 14 aa, Borrelia burgdorferi B31
NTFSDTTLFQEKNT

SEQ ID NO: 108451 - protein, 14 aa, Borrelia burgdorferi B31
TFSDTTLFQEKNTK

SEQ ID NO: 108452 - protein, 14 aa, Borrelia burgdorferi B31
FSDTTLFQEKNTKL

SEQ ID NO: 108453 - protein, 14 aa, Borrelia burgdorferi B31
SDTTLFQEKNTKLE

SEQ ID NO: 108454 - protein, 14 aa, Borrelia burgdorferi B31
DTTLFQEKNTKLEN

SEQ ID NO: 108455 - protein, 14 aa, Borrelia burgdorferi B31
TTLFQEKNTKLENL

SEQ ID NO: 108456 - protein, 14 aa, Borrelia burgdorferi B31
TLFQEKNTKLENLS

SEQ ID NO: 108457 - protein, 14 aa, Borrelia burgdorferi B31
LFQEKNTKLENLSF

SEQ ID NO: 108458 - protein, 14 aa, Borrelia burgdorferi B31
FQEKNTKLENLSFK

SEQ ID NO: 108459 - protein, 14 aa, Borrelia burgdorferi B31
QEKNTKLENLSFKI

SEQ ID NO: 108460 - protein, 14 aa, Borrelia burgdorferi B31
EKNTKLENLSFKII

SEQ ID NO: 108461 - protein, 14 aa, Borrelia burgdorferi B31
KNTKLENLSFKIIR

SEQ ID NO: 108462 - protein, 14 aa, Borrelia burgdorferi B31
NTKLENLSFKIIRK

SEQ ID NO: 108463 - protein, 14 aa, Borrelia burgdorferi B31
TKLENLSFKIIRKL

SEQ ID NO: 108464 - protein, 14 aa, Borrelia burgdorferi B31
KLENLSFKIIRKLN

SEQ ID NO: 108465 - protein, 14 aa, Borrelia burgdorferi B31
LENLSFKIIRKLNK

SEQ ID NO: 108466 - protein, 14 aa, Borrelia burgdorferi B31
ENLSFKIIRKLNKE

SEQ ID NO: 108467 - protein, 14 aa, Borrelia burgdorferi B31
NLSFKIIRKLNKEN

SEQ ID NO: 108468 - protein, 14 aa, Borrelia burgdorferi B31
LSFKIIRKLNKENE

SEQ ID NO: 108469 - protein, 14 aa, Borrelia burgdorferi B31
SFKIIRKLNKENEN

SEQ ID NO: 108470 - protein, 14 aa, Borrelia burgdorferi B31
FKIIRKLNKENENN

SEQ ID NO: 108471 - protein, 14 aa, Borrelia burgdorferi B31
KIIRKLNKENENNI

SEQ ID NO: 108472 - protein, 14 aa, Borrelia burgdorferi B31
IIRKLNKENENNIN

SEQ ID NO: 108473 - protein, 14 aa, Borrelia burgdorferi B31
IRKLNKENENNINN

SEQ ID NO: 108474 - protein, 14 aa, Borrelia burgdorferi B31
RKLNKENENNINNN

SEQ ID NO: 108475 - protein, 14 aa, Borrelia burgdorferi B31
KLNKENENNINNNY

SEQ ID NO: 108476 - protein, 14 aa, Borrelia burgdorferi B31
LNKENENNINNNYE

SEQ ID NO: 108477 - protein, 14 aa, Borrelia burgdorferi B31
NKENENNINNNYEI

SEQ ID NO: 108478 - protein, 14 aa, Borrelia burgdorferi B31
KENENNINNNYEII

SEQ ID NO: 108479 - protein, 14 aa, Borrelia burgdorferi B31
ENENNINNNYEIIS

SEQ ID NO: 108480 - protein, 14 aa, Borrelia burgdorferi B31
NENNINNNYEIISK

SEQ ID NO: 108481 - protein, 14 aa, Borrelia burgdorferi B31
ENNINNNYEIISKD

SEQ ID NO: 108482 - protein, 14 aa, Borrelia burgdorferi B31
NNINNNYEIISKDG

SEQ ID NO: 108483 - protein, 14 aa, Borrelia burgdorferi B31
NINNNYEIISKDGL

SEQ ID NO: 108484 - protein, 14 aa, Borrelia burgdorferi B31
INNNYEIISKDGLY

SEQ ID NO: 108485 - protein, 14 aa, Borrelia burgdorferi B31
NNNYEIISKDGLYF

SEQ ID NO: 108486 - protein, 14 aa, Borrelia burgdorferi B31
NNYEIISKDGLYFL

SEQ ID NO: 108487 - protein, 14 aa, Borrelia burgdorferi B31
NYEIISKDGLYFLN

SEQ ID NO: 108488 - protein, 14 aa, Borrelia burgdorferi B31
YEIISKDGLYFLNN

SEQ ID NO: 108489 - protein, 14 aa, Borrelia burgdorferi B31
EIISKDGLYFLNNQ

SEQ ID NO: 108490 - protein, 14 aa, Borrelia burgdorferi B31
IISKDGLYFLNNQK

SEQ ID NO: 108491 - protein, 14 aa, Borrelia burgdorferi B31
ISKDGLYFLNNQKM

SEQ ID NO: 108492 - protein, 14 aa, Borrelia burgdorferi B31
SKDGLYFLNNQKMT

SEQ ID NO: 108493 - protein, 14 aa, Borrelia burgdorferi B31
KDGLYFLNNQKMTK

SEQ ID NO: 108494 - protein, 14 aa, Borrelia burgdorferi B31
DGLYFLNNQKMTKE

SEQ ID NO: 108495 - protein, 14 aa, Borrelia burgdorferi B31
GLYFLNNQKMTKER

SEQ ID NO: 108496 - protein, 14 aa, Borrelia burgdorferi B31
LYFLNNQKMTKERP

SEQ ID NO: 108497 - protein, 14 aa, Borrelia burgdorferi B31
YFLNNQKMTKERPL

SEQ ID NO: 108498 - protein, 14 aa, Borrelia burgdorferi B31
FLNNQKMTKERPLN

SEQ ID NO: 108499 - protein, 14 aa, Borrelia burgdorferi B31
LNNQKMTKERPLNI

SEQ ID NO: 108500 - protein, 14 aa, Borrelia burgdorferi B31
NNQKMTKERPLNII

SEQ ID NO: 108501 - protein, 14 aa, Borrelia burgdorferi B31
NQKMTKERPLNIIA

SEQ ID NO: 108502 - protein, 14 aa, Borrelia burgdorferi B31
QKMTKERPLNIIAE

SEQ ID NO: 108503 - protein, 14 aa, Borrelia burgdorferi B31
KMTKERPLNIIAEF

SEQ ID NO: 108504 - protein, 14 aa, Borrelia burgdorferi B31
MTKERPLNIIAEFK

SEQ ID NO: 108505 - protein, 14 aa, Borrelia burgdorferi B31
TKERPLNIIAEFKA

SEQ ID NO: 108506 - protein, 14 aa, Borrelia burgdorferi B31
KERPLNIIAEFKAD

SEQ ID NO: 108507 - protein, 14 aa, Borrelia burgdorferi B31
ERPLNIIAEFKADG

SEQ ID NO: 108508 - protein, 14 aa, Borrelia burgdorferi B31
RPLNIIAEFKADGL

SEQ ID NO: 108509 - protein, 14 aa, Borrelia burgdorferi B31
PLNIIAEFKADGLE

SEQ ID NO: 108510 - protein, 14 aa, Borrelia burgdorferi B31
LNIIAEFKADGLEI

SEQ ID NO: 108511 - protein, 14 aa, Borrelia burgdorferi B31
NIIAEFKADGLEID

SEQ ID NO: 108512 - protein, 14 aa, Borrelia burgdorferi B31
IIAEFKADGLEIDK

SEQ ID NO: 108513 - protein, 14 aa, Borrelia burgdorferi B31
IAEFKADGLEIDKS

SEQ ID NO: 108514 - protein, 14 aa, Borrelia burgdorferi B31
AEFKADGLEIDKSK

SEQ ID NO: 108515 - protein, 14 aa, Borrelia burgdorferi B31
EFKADGLEIDKSKI

SEQ ID NO: 108516 - protein, 14 aa, Borrelia burgdorferi B31
FKADGLEIDKSKID

SEQ ID NO: 108517 - protein, 14 aa, Borrelia burgdorferi B31
KADGLEIDKSKIDD

SEQ ID NO: 108518 - protein, 14 aa, Borrelia burgdorferi B31
ADGLEIDKSKIDDY

SEQ ID NO: 108519 - protein, 14 aa, Borrelia burgdorferi B31
DGLEIDKSKIDDYN

SEQ ID NO: 108520 - protein, 14 aa, Borrelia burgdorferi B31
GLEIDKSKIDDYNL

SEQ ID NO: 108521 - protein, 14 aa, Borrelia burgdorferi B31
LEIDKSKIDDYNLQ

SEQ ID NO: 108522 - protein, 14 aa, Borrelia burgdorferi B31
EIDKSKIDDYNLQY

SEQ ID NO: 108523 - protein, 14 aa, Borrelia burgdorferi B31
IDKSKIDDYNLQYK

SEQ ID NO: 108524 - protein, 14 aa, Borrelia burgdorferi B31
DKSKIDDYNLQYKI

SEQ ID NO: 108525 - protein, 14 aa, Borrelia burgdorferi B31
KSKIDDYNLQYKIE

SEQ ID NO: 108526 - protein, 14 aa, Borrelia burgdorferi B31
SKIDDYNLQYKIEV

SEQ ID NO: 108527 - protein, 14 aa, Borrelia burgdorferi B31
KIDDYNLQYKIEVK

SEQ ID NO: 108528 - protein, 14 aa, Borrelia burgdorferi B31
IDDYNLQYKIEVKW

SEQ ID NO: 108529 - protein, 14 aa, Borrelia burgdorferi B31
DDYNLQYKIEVKWS

SEQ ID NO: 108530 - protein, 14 aa, Borrelia burgdorferi B31
DYNLQYKIEVKWSN

SEQ ID NO: 108531 - protein, 14 aa, Borrelia burgdorferi B31
YNLQYKIEVKWSNK

SEQ ID NO: 108532 - protein, 14 aa, Borrelia burgdorferi B31
NLQYKIEVKWSNKS

SEQ ID NO: 108533 - protein, 14 aa, Borrelia burgdorferi B31
LQYKIEVKWSNKSV

SEQ ID NO: 108534 - protein, 14 aa, Borrelia burgdorferi B31
QYKIEVKWSNKSVN

SEQ ID NO: 108535 - protein, 14 aa, Borrelia burgdorferi B31
YKIEVKWSNKSVNN

SEQ ID NO: 108536 - protein, 14 aa, Borrelia burgdorferi B31
KIEVKWSNKSVNNI

SEQ ID NO: 108537 - protein, 14 aa, Borrelia burgdorferi B31
IEVKWSNKSVNNIE

SEQ ID NO: 108538 - protein, 14 aa, Borrelia burgdorferi B31
EVKWSNKSVNNIEV

SEQ ID NO: 108539 - protein, 14 aa, Borrelia burgdorferi B31
VKWSNKSVNNIEVY

SEQ ID NO: 108540 - protein, 14 aa, Borrelia burgdorferi B31
KWSNKSVNNIEVYF

SEQ ID NO: 108541 - protein, 14 aa, Borrelia burgdorferi B31
WSNKSVNNIEVYFN

SEQ ID NO: 108542 - protein, 14 aa, Borrelia burgdorferi B31
SNKSVNNIEVYFNK

SEQ ID NO: 108543 - protein, 14 aa, Borrelia burgdorferi B31
NKSVNNIEVYFNKN

SEQ ID NO: 108544 - protein, 14 aa, Borrelia burgdorferi B31
KSVNNIEVYFNKNE

SEQ ID NO: 108545 - protein, 14 aa, Borrelia burgdorferi B31
SVNNIEVYFNKNEE

SEQ ID NO: 108546 - protein, 14 aa, Borrelia burgdorferi B31
VNNIEVYFNKNEEN

SEQ ID NO: 108547 - protein, 14 aa, Borrelia burgdorferi B31
NNIEVYFNKNEEND

SEQ ID NO: 108548 - protein, 14 aa, Borrelia burgdorferi B31
NIEVYFNKNEENDK

SEQ ID NO: 108549 - protein, 14 aa, Borrelia burgdorferi B31
IEVYFNKNEENDKD

SEQ ID NO: 108550 - protein, 14 aa, Borrelia burgdorferi B31
EVYFNKNEENDKDI

SEQ ID NO: 108551 - protein, 14 aa, Borrelia burgdorferi B31
VYFNKNEENDKDIL

SEQ ID NO: 108552 - protein, 14 aa, Borrelia burgdorferi B31
YFNKNEENDKDILI

SEQ ID NO: 108553 - protein, 14 aa, Borrelia burgdorferi B31
FNKNEENDKDILIK

SEQ ID NO: 108554 - protein, 14 aa, Borrelia burgdorferi B31
NKNEENDKDILIKK

SEQ ID NO: 108555 - protein, 14 aa, Borrelia burgdorferi B31
KNEENDKDILIKKD

SEQ ID NO: 108556 - protein, 14 aa, Borrelia burgdorferi B31
NEENDKDILIKKDK

SEQ ID NO: 108557 - protein, 14 aa, Borrelia burgdorferi B31
EENDKDILIKKDKD

SEQ ID NO: 108558 - protein, 14 aa, Borrelia burgdorferi B31
ENDKDILIKKDKDE

SEQ ID NO: 108559 - protein, 14 aa, Borrelia burgdorferi B31
NDKDILIKKDKDEY

SEQ ID NO: 108560 - protein, 14 aa, Borrelia burgdorferi B31
DKDILIKKDKDEYY

SEQ ID NO: 108561 - protein, 14 aa, Borrelia burgdorferi B31
KDILIKKDKDEYYY

SEQ ID NO: 108562 - protein, 14 aa, Borrelia burgdorferi B31
DILIKKDKDEYYYT

SEQ ID NO: 108563 - protein, 14 aa, Borrelia burgdorferi B31
ILIKKDKDEYYYTT

SEQ ID NO: 108564 - protein, 14 aa, Borrelia burgdorferi B31
LIKKDKDEYYYTTS

SEQ ID NO: 108565 - protein, 14 aa, Borrelia burgdorferi B31
IKKDKDEYYYTTSK

SEQ ID NO: 108566 - protein, 14 aa, Borrelia burgdorferi B31
KKDKDEYYYTTSKW

SEQ ID NO: 108567 - protein, 14 aa, Borrelia burgdorferi B31
KDKDEYYYTTSKWT

SEQ ID NO: 108568 - protein, 14 aa, Borrelia burgdorferi B31
DKDEYYYTTSKWTF

SEQ ID NO: 108569 - protein, 14 aa, Borrelia burgdorferi B31
KDEYYYTTSKWTFF

SEQ ID NO: 108570 - protein, 14 aa, Borrelia burgdorferi B31
DEYYYTTSKWTFFD

SEQ ID NO: 108571 - protein, 14 aa, Borrelia burgdorferi B31
EYYYTTSKWTFFDV

SEQ ID NO: 108572 - protein, 14 aa, Borrelia burgdorferi B31
YYYTTSKWTFFDVF

SEQ ID NO: 108573 - protein, 14 aa, Borrelia burgdorferi B31
YYTTSKWTFFDVFD

SEQ ID NO: 108574 - protein, 14 aa, Borrelia burgdorferi B31
YTTSKWTFFDVFDL

SEQ ID NO: 108575 - protein, 14 aa, Borrelia burgdorferi B31
TTSKWTFFDVFDLE

SEQ ID NO: 108576 - protein, 14 aa, Borrelia burgdorferi B31
TSKWTFFDVFDLEK

SEQ ID NO: 108577 - protein, 14 aa, Borrelia burgdorferi B31
SKWTFFDVFDLEKK

SEQ ID NO: 108578 - protein, 14 aa, Borrelia burgdorferi B31
KWTFFDVFDLEKKL

SEQ ID NO: 108579 - protein, 14 aa, Borrelia burgdorferi B31
WTFFDVFDLEKKLT

SEQ ID NO: 108580 - protein, 14 aa, Borrelia burgdorferi B31
TFFDVFDLEKKLTE

SEQ ID NO: 108581 - protein, 14 aa, Borrelia burgdorferi B31
FFDVFDLEKKLTEK

SEQ ID NO: 108582 - protein, 14 aa, Borrelia burgdorferi B31
FDVFDLEKKLTEKD

SEQ ID NO: 108583 - protein, 14 aa, Borrelia burgdorferi B31
DVFDLEKKLTEKDD

SEQ ID NO: 108584 - protein, 14 aa, Borrelia burgdorferi B31
VFDLEKKLTEKDDI

SEQ ID NO: 108585 - protein, 14 aa, Borrelia burgdorferi B31
FDLEKKLTEKDDIS

SEQ ID NO: 108586 - protein, 14 aa, Borrelia burgdorferi B31
DLEKKLTEKDDISS

SEQ ID NO: 108587 - protein, 14 aa, Borrelia burgdorferi B31
LEKKLTEKDDISSN

SEQ ID NO: 108588 - protein, 14 aa, Borrelia burgdorferi B31
EKKLTEKDDISSND

SEQ ID NO: 108589 - protein, 14 aa, Borrelia burgdorferi B31
KKLTEKDDISSNDN

SEQ ID NO: 108590 - protein, 14 aa, Borrelia burgdorferi B31
KLTEKDDISSNDNQ

SEQ ID NO: 108591 - protein, 14 aa, Borrelia burgdorferi B31
LTEKDDISSNDNQE

SEQ ID NO: 108592 - protein, 14 aa, Borrelia burgdorferi B31
TEKDDISSNDNQED

SEQ ID NO: 108593 - protein, 14 aa, Borrelia burgdorferi B31
EKDDISSNDNQEDH

SEQ ID NO: 108594 - protein, 14 aa, Borrelia burgdorferi B31
KDDISSNDNQEDHH

SEQ ID NO: 108595 - protein, 14 aa, Borrelia burgdorferi B31
DDISSNDNQEDHHE

SEQ ID NO: 108596 - protein, 14 aa, Borrelia burgdorferi B31
DISSNDNQEDHHEH

SEQ ID NO: 108597 - protein, 14 aa, Borrelia burgdorferi B31
ISSNDNQEDHHEHH

SEQ ID NO: 108598 - protein, 14 aa, Borrelia burgdorferi B31
SSNDNQEDHHEHHN

SEQ ID NO: 108599 - protein, 14 aa, Borrelia burgdorferi B31
SNDNQEDHHEHHNN

SEQ ID NO: 108600 - protein, 14 aa, Borrelia burgdorferi B31
NDNQEDHHEHHNNA

SEQ ID NO: 108601 - protein, 14 aa, Borrelia burgdorferi B31
DNQEDHHEHHNNAD

SEQ ID NO: 108602 - protein, 15 aa, Borrelia burgdorferi B31
MDLLDLLEKEKQINK

SEQ ID NO: 108603 - protein, 15 aa, Borrelia burgdorferi B31
DLLDLLEKEKQINKN

SEQ ID NO: 108604 - protein, 15 aa, Borrelia burgdorferi B31
LLDLLEKEKQINKNK

SEQ ID NO: 108605 - protein, 15 aa, Borrelia burgdorferi B31
LDLLEKEKQINKNKG

SEQ ID NO: 108606 - protein, 15 aa, Borrelia burgdorferi B31
DLLEKEKQINKNKGV

SEQ ID NO: 108607 - protein, 15 aa, Borrelia burgdorferi B31
LLEKEKQINKNKGVF

SEQ ID NO: 108608 - protein, 15 aa, Borrelia burgdorferi B31
LEKEKQINKNKGVFM

SEQ ID NO: 108609 - protein, 15 aa, Borrelia burgdorferi B31
EKEKQINKNKGVFMT

SEQ ID NO: 108610 - protein, 15 aa, Borrelia burgdorferi B31
KEKQINKNKGVFMTK

SEQ ID NO: 108611 - protein, 15 aa, Borrelia burgdorferi B31
EKQINKNKGVFMTKP

SEQ ID NO: 108612 - protein, 15 aa, Borrelia burgdorferi B31
KQINKNKGVFMTKPK

SEQ ID NO: 108613 - protein, 15 aa, Borrelia burgdorferi B31
QINKNKGVFMTKPKI

SEQ ID NO: 108614 - protein, 15 aa, Borrelia burgdorferi B31
INKNKGVFMTKPKIF

SEQ ID NO: 108615 - protein, 15 aa, Borrelia burgdorferi B31
NKNKGVFMTKPKIFS

SEQ ID NO: 108616 - protein, 15 aa, Borrelia burgdorferi B31
KNKGVFMTKPKIFSI

SEQ ID NO: 108617 - protein, 15 aa, Borrelia burgdorferi B31
NKGVFMTKPKIFSIN

SEQ ID NO: 108618 - protein, 15 aa, Borrelia burgdorferi B31
KGVFMTKPKIFSINK

SEQ ID NO: 108619 - protein, 15 aa, Borrelia burgdorferi B31
GVFMTKPKIFSINKE

SEQ ID NO: 108620 - protein, 15 aa, Borrelia burgdorferi B31
VFMTKPKIFSINKEK

SEQ ID NO: 108621 - protein, 15 aa, Borrelia burgdorferi B31
FMTKPKIFSINKEKI

SEQ ID NO: 108622 - protein, 15 aa, Borrelia burgdorferi B31
MTKPKIFSINKEKIK

SEQ ID NO: 108623 - protein, 15 aa, Borrelia burgdorferi B31
TKPKIFSINKEKIKI

SEQ ID NO: 108624 - protein, 15 aa, Borrelia burgdorferi B31
KPKIFSINKEKIKIL

SEQ ID NO: 108625 - protein, 15 aa, Borrelia burgdorferi B31
PKIFSINKEKIKILI

SEQ ID NO: 108626 - protein, 15 aa, Borrelia burgdorferi B31
KIFSINKEKIKILII

SEQ ID NO: 108627 - protein, 15 aa, Borrelia burgdorferi B31
IFSINKEKIKILIIV

SEQ ID NO: 108628 - protein, 15 aa, Borrelia burgdorferi B31
FSINKEKIKILIIVV

SEQ ID NO: 108629 - protein, 15 aa, Borrelia burgdorferi B31
SINKEKIKILIIVVL

SEQ ID NO: 108630 - protein, 15 aa, Borrelia burgdorferi B31
INKEKIKILIIVVLT

SEQ ID NO: 108631 - protein, 15 aa, Borrelia burgdorferi B31
NKEKIKILIIVVLTS

SEQ ID NO: 108632 - protein, 15 aa, Borrelia burgdorferi B31
KEKIKILIIVVLTST

SEQ ID NO: 108633 - protein, 15 aa, Borrelia burgdorferi B31
EKIKILIIVVLTSTF

SEQ ID NO: 108634 - protein, 15 aa, Borrelia burgdorferi B31
KIKILIIVVLTSTFL

SEQ ID NO: 108635 - protein, 15 aa, Borrelia burgdorferi B31
IKILIIVVLTSTFLL

SEQ ID NO: 108636 - protein, 15 aa, Borrelia burgdorferi B31
KILIIVVLTSTFLLG

SEQ ID NO: 108637 - protein, 15 aa, Borrelia burgdorferi B31
ILIIVVLTSTFLLGI

SEQ ID NO: 108638 - protein, 15 aa, Borrelia burgdorferi B31
LIIVVLTSTFLLGII

SEQ ID NO: 108639 - protein, 15 aa, Borrelia burgdorferi B31
IIVVLTSTFLLGIIF

SEQ ID NO: 108640 - protein, 15 aa, Borrelia burgdorferi B31
IVVLTSTFLLGIIFS

SEQ ID NO: 108641 - protein, 15 aa, Borrelia burgdorferi B31
VVLTSTFLLGIIFSN

SEQ ID NO: 108642 - protein, 15 aa, Borrelia burgdorferi B31
VLTSTFLLGIIFSNE

SEQ ID NO: 108643 - protein, 15 aa, Borrelia burgdorferi B31
LTSTFLLGIIFSNEN

SEQ ID NO: 108644 - protein, 15 aa, Borrelia burgdorferi B31
TSTFLLGIIFSNENK

SEQ ID NO: 108645 - protein, 15 aa, Borrelia burgdorferi B31
STFLLGIIFSNENKV

SEQ ID NO: 108646 - protein, 15 aa, Borrelia burgdorferi B31
TFLLGIIFSNENKVA

SEQ ID NO: 108647 - protein, 15 aa, Borrelia burgdorferi B31
FLLGIIFSNENKVAR

SEQ ID NO: 108648 - protein, 15 aa, Borrelia burgdorferi B31
LLGIIFSNENKVARI

SEQ ID NO: 108649 - protein, 15 aa, Borrelia burgdorferi B31
LGIIFSNENKVARIL

SEQ ID NO: 108650 - protein, 15 aa, Borrelia burgdorferi B31
GIIFSNENKVARILE

SEQ ID NO: 108651 - protein, 15 aa, Borrelia burgdorferi B31
IIFSNENKVARILEE

SEQ ID NO: 108652 - protein, 15 aa, Borrelia burgdorferi B31
IFSNENKVARILEEK

SEQ ID NO: 108653 - protein, 15 aa, Borrelia burgdorferi B31
FSNENKVARILEEKF

SEQ ID NO: 108654 - protein, 15 aa, Borrelia burgdorferi B31
SNENKVARILEEKFF

SEQ ID NO: 108655 - protein, 15 aa, Borrelia burgdorferi B31
NENKVARILEEKFFD

SEQ ID NO: 108656 - protein, 15 aa, Borrelia burgdorferi B31
ENKVARILEEKFFDF

SEQ ID NO: 108657 - protein, 15 aa, Borrelia burgdorferi B31
NKVARILEEKFFDFD

SEQ ID NO: 108658 - protein, 15 aa, Borrelia burgdorferi B31
KVARILEEKFFDFDF

SEQ ID NO: 108659 - protein, 15 aa, Borrelia burgdorferi B31
VARILEEKFFDFDFN

SEQ ID NO: 108660 - protein, 15 aa, Borrelia burgdorferi B31
ARILEEKFFDFDFNL

SEQ ID NO: 108661 - protein, 15 aa, Borrelia burgdorferi B31
RILEEKFFDFDFNLI

SEQ ID NO: 108662 - protein, 15 aa, Borrelia burgdorferi B31
ILEEKFFDFDFNLIS

SEQ ID NO: 108663 - protein, 15 aa, Borrelia burgdorferi B31
LEEKFFDFDFNLISK

SEQ ID NO: 108664 - protein, 15 aa, Borrelia burgdorferi B31
EEKFFDFDFNLISKI

SEQ ID NO: 108665 - protein, 15 aa, Borrelia burgdorferi B31
EKFFDFDFNLISKIE

SEQ ID NO: 108666 - protein, 15 aa, Borrelia burgdorferi B31
KFFDFDFNLISKIET

SEQ ID NO: 108667 - protein, 15 aa, Borrelia burgdorferi B31
FFDFDFNLISKIETE

SEQ ID NO: 108668 - protein, 15 aa, Borrelia burgdorferi B31
FDFDFNLISKIETEL

SEQ ID NO: 108669 - protein, 15 aa, Borrelia burgdorferi B31
DFDFNLISKIETELE

SEQ ID NO: 108670 - protein, 15 aa, Borrelia burgdorferi B31
FDFNLISKIETELEG

SEQ ID NO: 108671 - protein, 15 aa, Borrelia burgdorferi B31
DFNLISKIETELEGT

SEQ ID NO: 108672 - protein, 15 aa, Borrelia burgdorferi B31
FNLISKIETELEGTL

SEQ ID NO: 108673 - protein, 15 aa, Borrelia burgdorferi B31
NLISKIETELEGTLT

SEQ ID NO: 108674 - protein, 15 aa, Borrelia burgdorferi B31
LISKIETELEGTLTK

SEQ ID NO: 108675 - protein, 15 aa, Borrelia burgdorferi B31
ISKIETELEGTLTKL

SEQ ID NO: 108676 - protein, 15 aa, Borrelia burgdorferi B31
SKIETELEGTLTKLG

SEQ ID NO: 108677 - protein, 15 aa, Borrelia burgdorferi B31
KIETELEGTLTKLGK

SEQ ID NO: 108678 - protein, 15 aa, Borrelia burgdorferi B31
IETELEGTLTKLGKD

SEQ ID NO: 108679 - protein, 15 aa, Borrelia burgdorferi B31
ETELEGTLTKLGKDW

SEQ ID NO: 108680 - protein, 15 aa, Borrelia burgdorferi B31
TELEGTLTKLGKDWI

SEQ ID NO: 108681 - protein, 15 aa, Borrelia burgdorferi B31
ELEGTLTKLGKDWIL

SEQ ID NO: 108682 - protein, 15 aa, Borrelia burgdorferi B31
LEGTLTKLGKDWILT

SEQ ID NO: 108683 - protein, 15 aa, Borrelia burgdorferi B31
EGTLTKLGKDWILTY

SEQ ID NO: 108684 - protein, 15 aa, Borrelia burgdorferi B31
GTLTKLGKDWILTYN

SEQ ID NO: 108685 - protein, 15 aa, Borrelia burgdorferi B31
TLTKLGKDWILTYNK

SEQ ID NO: 108686 - protein, 15 aa, Borrelia burgdorferi B31
LTKLGKDWILTYNKQ

SEQ ID NO: 108687 - protein, 15 aa, Borrelia burgdorferi B31
TKLGKDWILTYNKQN

SEQ ID NO: 108688 - protein, 15 aa, Borrelia burgdorferi B31
KLGKDWILTYNKQNI

SEQ ID NO: 108689 - protein, 15 aa, Borrelia burgdorferi B31
LGKDWILTYNKQNIP

SEQ ID NO: 108690 - protein, 15 aa, Borrelia burgdorferi B31
GKDWILTYNKQNIPV

SEQ ID NO: 108691 - protein, 15 aa, Borrelia burgdorferi B31
KDWILTYNKQNIPVD

SEQ ID NO: 108692 - protein, 15 aa, Borrelia burgdorferi B31
DWILTYNKQNIPVDN

SEQ ID NO: 108693 - protein, 15 aa, Borrelia burgdorferi B31
WILTYNKQNIPVDNK

SEQ ID NO: 108694 - protein, 15 aa, Borrelia burgdorferi B31
ILTYNKQNIPVDNKK

SEQ ID NO: 108695 - protein, 15 aa, Borrelia burgdorferi B31
LTYNKQNIPVDNKKV

SEQ ID NO: 108696 - protein, 15 aa, Borrelia burgdorferi B31
TYNKQNIPVDNKKVN

SEQ ID NO: 108697 - protein, 15 aa, Borrelia burgdorferi B31
YNKQNIPVDNKKVNS

SEQ ID NO: 108698 - protein, 15 aa, Borrelia burgdorferi B31
NKQNIPVDNKKVNSL

SEQ ID NO: 108699 - protein, 15 aa, Borrelia burgdorferi B31
KQNIPVDNKKVNSLI

SEQ ID NO: 108700 - protein, 15 aa, Borrelia burgdorferi B31
QNIPVDNKKVNSLIK

SEQ ID NO: 108701 - protein, 15 aa, Borrelia burgdorferi B31
NIPVDNKKVNSLIKA

SEQ ID NO: 108702 - protein, 15 aa, Borrelia burgdorferi B31
IPVDNKKVNSLIKAL

SEQ ID NO: 108703 - protein, 15 aa, Borrelia burgdorferi B31
PVDNKKVNSLIKALD

SEQ ID NO: 108704 - protein, 15 aa, Borrelia burgdorferi B31
VDNKKVNSLIKALDE

SEQ ID NO: 108705 - protein, 15 aa, Borrelia burgdorferi B31
DNKKVNSLIKALDEL

SEQ ID NO: 108706 - protein, 15 aa, Borrelia burgdorferi B31
NKKVNSLIKALDELQ

SEQ ID NO: 108707 - protein, 15 aa, Borrelia burgdorferi B31
KKVNSLIKALDELQK

SEQ ID NO: 108708 - protein, 15 aa, Borrelia burgdorferi B31
KVNSLIKALDELQKN

SEQ ID NO: 108709 - protein, 15 aa, Borrelia burgdorferi B31
VNSLIKALDELQKNK

SEQ ID NO: 108710 - protein, 15 aa, Borrelia burgdorferi B31
NSLIKALDELQKNKL

SEQ ID NO: 108711 - protein, 15 aa, Borrelia burgdorferi B31
SLIKALDELQKNKLV

SEQ ID NO: 108712 - protein, 15 aa, Borrelia burgdorferi B31
LIKALDELQKNKLVS

SEQ ID NO: 108713 - protein, 15 aa, Borrelia burgdorferi B31
IKALDELQKNKLVSR

SEQ ID NO: 108714 - protein, 15 aa, Borrelia burgdorferi B31
KALDELQKNKLVSRD

SEQ ID NO: 108715 - protein, 15 aa, Borrelia burgdorferi B31
ALDELQKNKLVSRDQ

SEQ ID NO: 108716 - protein, 15 aa, Borrelia burgdorferi B31
LDELQKNKLVSRDQK

SEQ ID NO: 108717 - protein, 15 aa, Borrelia burgdorferi B31
DELQKNKLVSRDQKK

SEQ ID NO: 108718 - protein, 15 aa, Borrelia burgdorferi B31
ELQKNKLVSRDQKKH

SEQ ID NO: 108719 - protein, 15 aa, Borrelia burgdorferi B31
LQKNKLVSRDQKKHK

SEQ ID NO: 108720 - protein, 15 aa, Borrelia burgdorferi B31
QKNKLVSRDQKKHKE

SEQ ID NO: 108721 - protein, 15 aa, Borrelia burgdorferi B31
KNKLVSRDQKKHKEL

SEQ ID NO: 108722 - protein, 15 aa, Borrelia burgdorferi B31
NKLVSRDQKKHKELG

SEQ ID NO: 108723 - protein, 15 aa, Borrelia burgdorferi B31
KLVSRDQKKHKELGI

SEQ ID NO: 108724 - protein, 15 aa, Borrelia burgdorferi B31
LVSRDQKKHKELGIG

SEQ ID NO: 108725 - protein, 15 aa, Borrelia burgdorferi B31
VSRDQKKHKELGIGE

SEQ ID NO: 108726 - protein, 15 aa, Borrelia burgdorferi B31
SRDQKKHKELGIGEN

SEQ ID NO: 108727 - protein, 15 aa, Borrelia burgdorferi B31
RDQKKHKELGIGENP

SEQ ID NO: 108728 - protein, 15 aa, Borrelia burgdorferi B31
DQKKHKELGIGENPS

SEQ ID NO: 108729 - protein, 15 aa, Borrelia burgdorferi B31
QKKHKELGIGENPSF

SEQ ID NO: 108730 - protein, 15 aa, Borrelia burgdorferi B31
KKHKELGIGENPSFK

SEQ ID NO: 108731 - protein, 15 aa, Borrelia burgdorferi B31
KHKELGIGENPSFKL

SEQ ID NO: 108732 - protein, 15 aa, Borrelia burgdorferi B31
HKELGIGENPSFKLF

SEQ ID NO: 108733 - protein, 15 aa, Borrelia burgdorferi B31
KELGIGENPSFKLFD

SEQ ID NO: 108734 - protein, 15 aa, Borrelia burgdorferi B31
ELGIGENPSFKLFDN

SEQ ID NO: 108735 - protein, 15 aa, Borrelia burgdorferi B31
LGIGENPSFKLFDNN

SEQ ID NO: 108736 - protein, 15 aa, Borrelia burgdorferi B31
GIGENPSFKLFDNNN

SEQ ID NO: 108737 - protein, 15 aa, Borrelia burgdorferi B31
IGENPSFKLFDNNNK

SEQ ID NO: 108738 - protein, 15 aa, Borrelia burgdorferi B31
GENPSFKLFDNNNKL

SEQ ID NO: 108739 - protein, 15 aa, Borrelia burgdorferi B31
ENPSFKLFDNNNKLL

SEQ ID NO: 108740 - protein, 15 aa, Borrelia burgdorferi B31
NPSFKLFDNNNKLLT

SEQ ID NO: 108741 - protein, 15 aa, Borrelia burgdorferi B31
PSFKLFDNNNKLLTE

SEQ ID NO: 108742 - protein, 15 aa, Borrelia burgdorferi B31
SFKLFDNNNKLLTEI

SEQ ID NO: 108743 - protein, 15 aa, Borrelia burgdorferi B31
FKLFDNNNKLLTEIF

SEQ ID NO: 108744 - protein, 15 aa, Borrelia burgdorferi B31
KLFDNNNKLLTEIFV

SEQ ID NO: 108745 - protein, 15 aa, Borrelia burgdorferi B31
LFDNNNKLLTEIFVG

SEQ ID NO: 108746 - protein, 15 aa, Borrelia burgdorferi B31
FDNNNKLLTEIFVGK

SEQ ID NO: 108747 - protein, 15 aa, Borrelia burgdorferi B31
DNNNKLLTEIFVGKS

SEQ ID NO: 108748 - protein, 15 aa, Borrelia burgdorferi B31
NNNKLLTEIFVGKSG

SEQ ID NO: 108749 - protein, 15 aa, Borrelia burgdorferi B31
NNKLLTEIFVGKSGE

SEQ ID NO: 108750 - protein, 15 aa, Borrelia burgdorferi B31
NKLLTEIFVGKSGEG

SEQ ID NO: 108751 - protein, 15 aa, Borrelia burgdorferi B31
KLLTEIFVGKSGEGD

SEQ ID NO: 108752 - protein, 15 aa, Borrelia burgdorferi B31
LLTEIFVGKSGEGDS

SEQ ID NO: 108753 - protein, 15 aa, Borrelia burgdorferi B31
LTEIFVGKSGEGDSR

SEQ ID NO: 108754 - protein, 15 aa, Borrelia burgdorferi B31
TEIFVGKSGEGDSRL

SEQ ID NO: 108755 - protein, 15 aa, Borrelia burgdorferi B31
EIFVGKSGEGDSRLA

SEQ ID NO: 108756 - protein, 15 aa, Borrelia burgdorferi B31
IFVGKSGEGDSRLAY

SEQ ID NO: 108757 - protein, 15 aa, Borrelia burgdorferi B31
FVGKSGEGDSRLAYI

SEQ ID NO: 108758 - protein, 15 aa, Borrelia burgdorferi B31
VGKSGEGDSRLAYIK

SEQ ID NO: 108759 - protein, 15 aa, Borrelia burgdorferi B31
GKSGEGDSRLAYIKG

SEQ ID NO: 108760 - protein, 15 aa, Borrelia burgdorferi B31
KSGEGDSRLAYIKGS

SEQ ID NO: 108761 - protein, 15 aa, Borrelia burgdorferi B31
SGEGDSRLAYIKGSD

SEQ ID NO: 108762 - protein, 15 aa, Borrelia burgdorferi B31
GEGDSRLAYIKGSDE

SEQ ID NO: 108763 - protein, 15 aa, Borrelia burgdorferi B31
EGDSRLAYIKGSDEN

SEQ ID NO: 108764 - protein, 15 aa, Borrelia burgdorferi B31
GDSRLAYIKGSDENV

SEQ ID NO: 108765 - protein, 15 aa, Borrelia burgdorferi B31
DSRLAYIKGSDENVY

SEQ ID NO: 108766 - protein, 15 aa, Borrelia burgdorferi B31
SRLAYIKGSDENVYL

SEQ ID NO: 108767 - protein, 15 aa, Borrelia burgdorferi B31
RLAYIKGSDENVYLT

SEQ ID NO: 108768 - protein, 15 aa, Borrelia burgdorferi B31
LAYIKGSDENVYLTK

SEQ ID NO: 108769 - protein, 15 aa, Borrelia burgdorferi B31
AYIKGSDENVYLTKN

SEQ ID NO: 108770 - protein, 15 aa, Borrelia burgdorferi B31
YIKGSDENVYLTKNI

SEQ ID NO: 108771 - protein, 15 aa, Borrelia burgdorferi B31
IKGSDENVYLTKNIF

SEQ ID NO: 108772 - protein, 15 aa, Borrelia burgdorferi B31
KGSDENVYLTKNIFL

SEQ ID NO: 108773 - protein, 15 aa, Borrelia burgdorferi B31
GSDENVYLTKNIFLS

SEQ ID NO: 108774 - protein, 15 aa, Borrelia burgdorferi B31
SDENVYLTKNIFLSY

SEQ ID NO: 108775 - protein, 15 aa, Borrelia burgdorferi B31
DENVYLTKNIFLSYK

SEQ ID NO: 108776 - protein, 15 aa, Borrelia burgdorferi B31
ENVYLTKNIFLSYKG

SEQ ID NO: 108777 - protein, 15 aa, Borrelia burgdorferi B31
NVYLTKNIFLSYKGN

SEQ ID NO: 108778 - protein, 15 aa, Borrelia burgdorferi B31
VYLTKNIFLSYKGNS

SEQ ID NO: 108779 - protein, 15 aa, Borrelia burgdorferi B31
YLTKNIFLSYKGNSY

SEQ ID NO: 108780 - protein, 15 aa, Borrelia burgdorferi B31
LTKNIFLSYKGNSYN

SEQ ID NO: 108781 - protein, 15 aa, Borrelia burgdorferi B31
TKNIFLSYKGNSYNT

SEQ ID NO: 108782 - protein, 15 aa, Borrelia burgdorferi B31
KNIFLSYKGNSYNTF

SEQ ID NO: 108783 - protein, 15 aa, Borrelia burgdorferi B31
NIFLSYKGNSYNTFS

SEQ ID NO: 108784 - protein, 15 aa, Borrelia burgdorferi B31
IFLSYKGNSYNTFSD

SEQ ID NO: 108785 - protein, 15 aa, Borrelia burgdorferi B31
FLSYKGNSYNTFSDT

SEQ ID NO: 108786 - protein, 15 aa, Borrelia burgdorferi B31
LSYKGNSYNTFSDTT

SEQ ID NO: 108787 - protein, 15 aa, Borrelia burgdorferi B31
SYKGNSYNTFSDTTL

SEQ ID NO: 108788 - protein, 15 aa, Borrelia burgdorferi B31
YKGNSYNTFSDTTLF

SEQ ID NO: 108789 - protein, 15 aa, Borrelia burgdorferi B31
KGNSYNTFSDTTLFQ

SEQ ID NO: 108790 - protein, 15 aa, Borrelia burgdorferi B31
GNSYNTFSDTTLFQE

SEQ ID NO: 108791 - protein, 15 aa, Borrelia burgdorferi B31
NSYNTFSDTTLFQEK

SEQ ID NO: 108792 - protein, 15 aa, Borrelia burgdorferi B31
SYNTFSDTTLFQEKN

SEQ ID NO: 108793 - protein, 15 aa, Borrelia burgdorferi B31
YNTFSDTTLFQEKNT

SEQ ID NO: 108794 - protein, 15 aa, Borrelia burgdorferi B31
NTFSDTTLFQEKNTK

SEQ ID NO: 108795 - protein, 15 aa, Borrelia burgdorferi B31
TFSDTTLFQEKNTKL

SEQ ID NO: 108796 - protein, 15 aa, Borrelia burgdorferi B31
FSDTTLFQEKNTKLE

SEQ ID NO: 108797 - protein, 15 aa, Borrelia burgdorferi B31
SDTTLFQEKNTKLEN

SEQ ID NO: 108798 - protein, 15 aa, Borrelia burgdorferi B31
DTTLFQEKNTKLENL

SEQ ID NO: 108799 - protein, 15 aa, Borrelia burgdorferi B31
TTLFQEKNTKLENLS

SEQ ID NO: 108800 - protein, 15 aa, Borrelia burgdorferi B31
TLFQEKNTKLENLSF

SEQ ID NO: 108801 - protein, 15 aa, Borrelia burgdorferi B31
LFQEKNTKLENLSFK

SEQ ID NO: 108802 - protein, 15 aa, Borrelia burgdorferi B31
FQEKNTKLENLSFKI

SEQ ID NO: 108803 - protein, 15 aa, Borrelia burgdorferi B31
QEKNTKLENLSFKII

SEQ ID NO: 108804 - protein, 15 aa, Borrelia burgdorferi B31
EKNTKLENLSFKIIR

SEQ ID NO: 108805 - protein, 15 aa, Borrelia burgdorferi B31
KNTKLENLSFKIIRK

SEQ ID NO: 108806 - protein, 15 aa, Borrelia burgdorferi B31
NTKLENLSFKIIRKL

SEQ ID NO: 108807 - protein, 15 aa, Borrelia burgdorferi B31
TKLENLSFKIIRKLN

SEQ ID NO: 108808 - protein, 15 aa, Borrelia burgdorferi B31
KLENLSFKIIRKLNK

SEQ ID NO: 108809 - protein, 15 aa, Borrelia burgdorferi B31
LENLSFKIIRKLNKE

SEQ ID NO: 108810 - protein, 15 aa, Borrelia burgdorferi B31
ENLSFKIIRKLNKEN

SEQ ID NO: 108811 - protein, 15 aa, Borrelia burgdorferi B31
NLSFKIIRKLNKENE

SEQ ID NO: 108812 - protein, 15 aa, Borrelia burgdorferi B31
LSFKIIRKLNKENEN

SEQ ID NO: 108813 - protein, 15 aa, Borrelia burgdorferi B31
SFKIIRKLNKENENN

SEQ ID NO: 108814 - protein, 15 aa, Borrelia burgdorferi B31
FKIIRKLNKENENNI

SEQ ID NO: 108815 - protein, 15 aa, Borrelia burgdorferi B31
KIIRKLNKENENNIN

SEQ ID NO: 108816 - protein, 15 aa, Borrelia burgdorferi B31
IIRKLNKENENNINN

SEQ ID NO: 108817 - protein, 15 aa, Borrelia burgdorferi B31
IRKLNKENENNINNN

SEQ ID NO: 108818 - protein, 15 aa, Borrelia burgdorferi B31
RKLNKENENNINNNY

SEQ ID NO: 108819 - protein, 15 aa, Borrelia burgdorferi B31
KLNKENENNINNNYE

SEQ ID NO: 108820 - protein, 15 aa, Borrelia burgdorferi B31
LNKENENNINNNYEI

SEQ ID NO: 108821 - protein, 15 aa, Borrelia burgdorferi B31
NKENENNINNNYEII

SEQ ID NO: 108822 - protein, 15 aa, Borrelia burgdorferi B31
KENENNINNNYEIIS

SEQ ID NO: 108823 - protein, 15 aa, Borrelia burgdorferi B31
ENENNINNNYEIISK

SEQ ID NO: 108824 - protein, 15 aa, Borrelia burgdorferi B31
NENNINNNYEIISKD

SEQ ID NO: 108825 - protein, 15 aa, Borrelia burgdorferi B31
ENNINNNYEIISKDG

SEQ ID NO: 108826 - protein, 15 aa, Borrelia burgdorferi B31
NNINNNYEIISKDGL

SEQ ID NO: 108827 - protein, 15 aa, Borrelia burgdorferi B31
NINNNYEIISKDGLY

SEQ ID NO: 108828 - protein, 15 aa, Borrelia burgdorferi B31
INNNYEIISKDGLYF

SEQ ID NO: 108829 - protein, 15 aa, Borrelia burgdorferi B31
NNNYEIISKDGLYFL

SEQ ID NO: 108830 - protein, 15 aa, Borrelia burgdorferi B31
NNYEIISKDGLYFLN

SEQ ID NO: 108831 - protein, 15 aa, Borrelia burgdorferi B31
NYEIISKDGLYFLNN

SEQ ID NO: 108832 - protein, 15 aa, Borrelia burgdorferi B31
YEIISKDGLYFLNNQ

SEQ ID NO: 108833 - protein, 15 aa, Borrelia burgdorferi B31
EIISKDGLYFLNNQK

SEQ ID NO: 108834 - protein, 15 aa, Borrelia burgdorferi B31
IISKDGLYFLNNQKM

SEQ ID NO: 108835 - protein, 15 aa, Borrelia burgdorferi B31
ISKDGLYFLNNQKMT

SEQ ID NO: 108836 - protein, 15 aa, Borrelia burgdorferi B31
SKDGLYFLNNQKMTK

SEQ ID NO: 108837 - protein, 15 aa, Borrelia burgdorferi B31
KDGLYFLNNQKMTKE

SEQ ID NO: 108838 - protein, 15 aa, Borrelia burgdorferi B31
DGLYFLNNQKMTKER

SEQ ID NO: 108839 - protein, 15 aa, Borrelia burgdorferi B31
GLYFLNNQKMTKERP

SEQ ID NO: 108840 - protein, 15 aa, Borrelia burgdorferi B31
LYFLNNQKMTKERPL

SEQ ID NO: 108841 - protein, 15 aa, Borrelia burgdorferi B31
YFLNNQKMTKERPLN

SEQ ID NO: 108842 - protein, 15 aa, Borrelia burgdorferi B31
FLNNQKMTKERPLNI

SEQ ID NO: 108843 - protein, 15 aa, Borrelia burgdorferi B31
LNNQKMTKERPLNII

SEQ ID NO: 108844 - protein, 15 aa, Borrelia burgdorferi B31
NNQKMTKERPLNIIA

SEQ ID NO: 108845 - protein, 15 aa, Borrelia burgdorferi B31
NQKMTKERPLNIIAE

SEQ ID NO: 108846 - protein, 15 aa, Borrelia burgdorferi B31
QKMTKERPLNIIAEF

SEQ ID NO: 108847 - protein, 15 aa, Borrelia burgdorferi B31
KMTKERPLNIIAEFK

SEQ ID NO: 108848 - protein, 15 aa, Borrelia burgdorferi B31
MTKERPLNIIAEFKA

SEQ ID NO: 108849 - protein, 15 aa, Borrelia burgdorferi B31
TKERPLNIIAEFKAD

SEQ ID NO: 108850 - protein, 15 aa, Borrelia burgdorferi B31
KERPLNIIAEFKADG

SEQ ID NO: 108851 - protein, 15 aa, Borrelia burgdorferi B31
ERPLNIIAEFKADGL

SEQ ID NO: 108852 - protein, 15 aa, Borrelia burgdorferi B31
RPLNIIAEFKADGLE

SEQ ID NO: 108853 - protein, 15 aa, Borrelia burgdorferi B31
PLNIIAEFKADGLEI

SEQ ID NO: 108854 - protein, 15 aa, Borrelia burgdorferi B31
LNIIAEFKADGLEID

SEQ ID NO: 108855 - protein, 15 aa, Borrelia burgdorferi B31
NIIAEFKADGLEIDK

SEQ ID NO: 108856 - protein, 15 aa, Borrelia burgdorferi B31
IIAEFKADGLEIDKS

SEQ ID NO: 108857 - protein, 15 aa, Borrelia burgdorferi B31
IAEFKADGLEIDKSK

SEQ ID NO: 108858 - protein, 15 aa, Borrelia burgdorferi B31
AEFKADGLEIDKSKI

SEQ ID NO: 108859 - protein, 15 aa, Borrelia burgdorferi B31
EFKADGLEIDKSKID

SEQ ID NO: 108860 - protein, 15 aa, Borrelia burgdorferi B31
FKADGLEIDKSKIDD

SEQ ID NO: 108861 - protein, 15 aa, Borrelia burgdorferi B31
KADGLEIDKSKIDDY

SEQ ID NO: 108862 - protein, 15 aa, Borrelia burgdorferi B31
ADGLEIDKSKIDDYN

SEQ ID NO: 108863 - protein, 15 aa, Borrelia burgdorferi B31
DGLEIDKSKIDDYNL

SEQ ID NO: 108864 - protein, 15 aa, Borrelia burgdorferi B31
GLEIDKSKIDDYNLQ

SEQ ID NO: 108865 - protein, 15 aa, Borrelia burgdorferi B31
LEIDKSKIDDYNLQY

SEQ ID NO: 108866 - protein, 15 aa, Borrelia burgdorferi B31
EIDKSKIDDYNLQYK

SEQ ID NO: 108867 - protein, 15 aa, Borrelia burgdorferi B31
IDKSKIDDYNLQYKI

SEQ ID NO: 108868 - protein, 15 aa, Borrelia burgdorferi B31
DKSKIDDYNLQYKIE

SEQ ID NO: 108869 - protein, 15 aa, Borrelia burgdorferi B31
KSKIDDYNLQYKIEV

SEQ ID NO: 108870 - protein, 15 aa, Borrelia burgdorferi B31
SKIDDYNLQYKIEVK

SEQ ID NO: 108871 - protein, 15 aa, Borrelia burgdorferi B31
KIDDYNLQYKIEVKW

SEQ ID NO: 108872 - protein, 15 aa, Borrelia burgdorferi B31
IDDYNLQYKIEVKWS

SEQ ID NO: 108873 - protein, 15 aa, Borrelia burgdorferi B31
DDYNLQYKIEVKWSN

SEQ ID NO: 108874 - protein, 15 aa, Borrelia burgdorferi B31
DYNLQYKIEVKWSNK

SEQ ID NO: 108875 - protein, 15 aa, Borrelia burgdorferi B31
YNLQYKIEVKWSNKS

SEQ ID NO: 108876 - protein, 15 aa, Borrelia burgdorferi B31
NLQYKIEVKWSNKSV

SEQ ID NO: 108877 - protein, 15 aa, Borrelia burgdorferi B31
LQYKIEVKWSNKSVN

SEQ ID NO: 108878 - protein, 15 aa, Borrelia burgdorferi B31
QYKIEVKWSNKSVNN

SEQ ID NO: 108879 - protein, 15 aa, Borrelia burgdorferi B31
YKIEVKWSNKSVNNI

SEQ ID NO: 108880 - protein, 15 aa, Borrelia burgdorferi B31
KIEVKWSNKSVNNIE

SEQ ID NO: 108881 - protein, 15 aa, Borrelia burgdorferi B31
IEVKWSNKSVNNIEV

SEQ ID NO: 108882 - protein, 15 aa, Borrelia burgdorferi B31
EVKWSNKSVNNIEVY

SEQ ID NO: 108883 - protein, 15 aa, Borrelia burgdorferi B31
VKWSNKSVNNIEVYF

SEQ ID NO: 108884 - protein, 15 aa, Borrelia burgdorferi B31
KWSNKSVNNIEVYFN

SEQ ID NO: 108885 - protein, 15 aa, Borrelia burgdorferi B31
WSNKSVNNIEVYFNK

SEQ ID NO: 108886 - protein, 15 aa, Borrelia burgdorferi B31
SNKSVNNIEVYFNKN

SEQ ID NO: 108887 - protein, 15 aa, Borrelia burgdorferi B31
NKSVNNIEVYFNKNE

SEQ ID NO: 108888 - protein, 15 aa, Borrelia burgdorferi B31
KSVNNIEVYFNKNEE

SEQ ID NO: 108889 - protein, 15 aa, Borrelia burgdorferi B31
SVNNIEVYFNKNEEN

SEQ ID NO: 108890 - protein, 15 aa, Borrelia burgdorferi B31
VNNIEVYFNKNEEND

SEQ ID NO: 108891 - protein, 15 aa, Borrelia burgdorferi B31
NNIEVYFNKNEENDK

SEQ ID NO: 108892 - protein, 15 aa, Borrelia burgdorferi B31
NIEVYFNKNEENDKD

SEQ ID NO: 108893 - protein, 15 aa, Borrelia burgdorferi B31
IEVYFNKNEENDKDI

SEQ ID NO: 108894 - protein, 15 aa, Borrelia burgdorferi B31
EVYFNKNEENDKDIL

SEQ ID NO: 108895 - protein, 15 aa, Borrelia burgdorferi B31
VYFNKNEENDKDILI

SEQ ID NO: 108896 - protein, 15 aa, Borrelia burgdorferi B31
YFNKNEENDKDILIK

SEQ ID NO: 108897 - protein, 15 aa, Borrelia burgdorferi B31
FNKNEENDKDILIKK

SEQ ID NO: 108898 - protein, 15 aa, Borrelia burgdorferi B31
NKNEENDKDILIKKD

SEQ ID NO: 108899 - protein, 15 aa, Borrelia burgdorferi B31
KNEENDKDILIKKDK

SEQ ID NO: 108900 - protein, 15 aa, Borrelia burgdorferi B31
NEENDKDILIKKDKD

SEQ ID NO: 108901 - protein, 15 aa, Borrelia burgdorferi B31
EENDKDILIKKDKDE

SEQ ID NO: 108902 - protein, 15 aa, Borrelia burgdorferi B31
ENDKDILIKKDKDEY

SEQ ID NO: 108903 - protein, 15 aa, Borrelia burgdorferi B31
NDKDILIKKDKDEYY

SEQ ID NO: 108904 - protein, 15 aa, Borrelia burgdorferi B31
DKDILIKKDKDEYYY

SEQ ID NO: 108905 - protein, 15 aa, Borrelia burgdorferi B31
KDILIKKDKDEYYYT

SEQ ID NO: 108906 - protein, 15 aa, Borrelia burgdorferi B31
DILIKKDKDEYYYTT

SEQ ID NO: 108907 - protein, 15 aa, Borrelia burgdorferi B31
ILIKKDKDEYYYTTS

SEQ ID NO: 108908 - protein, 15 aa, Borrelia burgdorferi B31
LIKKDKDEYYYTTSK

SEQ ID NO: 108909 - protein, 15 aa, Borrelia burgdorferi B31
IKKDKDEYYYTTSKW

SEQ ID NO: 108910 - protein, 15 aa, Borrelia burgdorferi B31
KKDKDEYYYTTSKWT

SEQ ID NO: 108911 - protein, 15 aa, Borrelia burgdorferi B31
KDKDEYYYTTSKWTF

SEQ ID NO: 108912 - protein, 15 aa, Borrelia burgdorferi B31
DKDEYYYTTSKWTFF

SEQ ID NO: 108913 - protein, 15 aa, Borrelia burgdorferi B31
KDEYYYTTSKWTFFD

SEQ ID NO: 108914 - protein, 15 aa, Borrelia burgdorferi B31
DEYYYTTSKWTFFDV

SEQ ID NO: 108915 - protein, 15 aa, Borrelia burgdorferi B31
EYYYTTSKWTFFDVF

SEQ ID NO: 108916 - protein, 15 aa, Borrelia burgdorferi B31
YYYTTSKWTFFDVFD

SEQ ID NO: 108917 - protein, 15 aa, Borrelia burgdorferi B31
YYTTSKWTFFDVFDL

SEQ ID NO: 108918 - protein, 15 aa, Borrelia burgdorferi B31
YTTSKWTFFDVFDLE

SEQ ID NO: 108919 - protein, 15 aa, Borrelia burgdorferi B31
TTSKWTFFDVFDLEK

SEQ ID NO: 108920 - protein, 15 aa, Borrelia burgdorferi B31
TSKWTFFDVFDLEKK

SEQ ID NO: 108921 - protein, 15 aa, Borrelia burgdorferi B31
SKWTFFDVFDLEKKL

SEQ ID NO: 108922 - protein, 15 aa, Borrelia burgdorferi B31
KWTFFDVFDLEKKLT

SEQ ID NO: 108923 - protein, 15 aa, Borrelia burgdorferi B31
WTFFDVFDLEKKLTE

SEQ ID NO: 108924 - protein, 15 aa, Borrelia burgdorferi B31
TFFDVFDLEKKLTEK

SEQ ID NO: 108925 - protein, 15 aa, Borrelia burgdorferi B31
FFDVFDLEKKLTEKD

SEQ ID NO: 108926 - protein, 15 aa, Borrelia burgdorferi B31
FDVFDLEKKLTEKDD

SEQ ID NO: 108927 - protein, 15 aa, Borrelia burgdorferi B31
DVFDLEKKLTEKDDI

SEQ ID NO: 108928 - protein, 15 aa, Borrelia burgdorferi B31
VFDLEKKLTEKDDIS

SEQ ID NO: 108929 - protein, 15 aa, Borrelia burgdorferi B31
FDLEKKLTEKDDISS

SEQ ID NO: 108930 - protein, 15 aa, Borrelia burgdorferi B31
DLEKKLTEKDDISSN

SEQ ID NO: 108931 - protein, 15 aa, Borrelia burgdorferi B31
LEKKLTEKDDISSND

SEQ ID NO: 108932 - protein, 15 aa, Borrelia burgdorferi B31
EKKLTEKDDISSNDN

SEQ ID NO: 108933 - protein, 15 aa, Borrelia burgdorferi B31
KKLTEKDDISSNDNQ

SEQ ID NO: 108934 - protein, 15 aa, Borrelia burgdorferi B31
KLTEKDDISSNDNQE

SEQ ID NO: 108935 - protein, 15 aa, Borrelia burgdorferi B31
LTEKDDISSNDNQED

SEQ ID NO: 108936 - protein, 15 aa, Borrelia burgdorferi B31
TEKDDISSNDNQEDH

SEQ ID NO: 108937 - protein, 15 aa, Borrelia burgdorferi B31
EKDDISSNDNQEDHH

SEQ ID NO: 108938 - protein, 15 aa, Borrelia burgdorferi B31
KDDISSNDNQEDHHE

SEQ ID NO: 108939 - protein, 15 aa, Borrelia burgdorferi B31
DDISSNDNQEDHHEH

SEQ ID NO: 108940 - protein, 15 aa, Borrelia burgdorferi B31
DISSNDNQEDHHEHH

SEQ ID NO: 108941 - protein, 15 aa, Borrelia burgdorferi B31
ISSNDNQEDHHEHHN

SEQ ID NO: 108942 - protein, 15 aa, Borrelia burgdorferi B31
SSNDNQEDHHEHHNN

SEQ ID NO: 108943 - protein, 15 aa, Borrelia burgdorferi B31
SNDNQEDHHEHHNNA

SEQ ID NO: 108944 - protein, 15 aa, Borrelia burgdorferi B31
NDNQEDHHEHHNNAD

SEQ ID NO: 108945 - protein, 16 aa, Borrelia burgdorferi B31
MDLLDLLEKEKQINKN

SEQ ID NO: 108946 - protein, 16 aa, Borrelia burgdorferi B31
DLLDLLEKEKQINKNK

SEQ ID NO: 108947 - protein, 16 aa, Borrelia burgdorferi B31
LLDLLEKEKQINKNKG

SEQ ID NO: 108948 - protein, 16 aa, Borrelia burgdorferi B31
LDLLEKEKQINKNKGV

SEQ ID NO: 108949 - protein, 16 aa, Borrelia burgdorferi B31
DLLEKEKQINKNKGVF

SEQ ID NO: 108950 - protein, 16 aa, Borrelia burgdorferi B31
LLEKEKQINKNKGVFM

SEQ ID NO: 108951 - protein, 16 aa, Borrelia burgdorferi B31
LEKEKQINKNKGVFMT

SEQ ID NO: 108952 - protein, 16 aa, Borrelia burgdorferi B31
EKEKQINKNKGVFMTK

SEQ ID NO: 108953 - protein, 16 aa, Borrelia burgdorferi B31
KEKQINKNKGVFMTKP

SEQ ID NO: 108954 - protein, 16 aa, Borrelia burgdorferi B31
EKQINKNKGVFMTKPK

SEQ ID NO: 108955 - protein, 16 aa, Borrelia burgdorferi B31
KQINKNKGVFMTKPKI

SEQ ID NO: 108956 - protein, 16 aa, Borrelia burgdorferi B31
QINKNKGVFMTKPKIF

SEQ ID NO: 108957 - protein, 16 aa, Borrelia burgdorferi B31
INKNKGVFMTKPKIFS

SEQ ID NO: 108958 - protein, 16 aa, Borrelia burgdorferi B31
NKNKGVFMTKPKIFSI

SEQ ID NO: 108959 - protein, 16 aa, Borrelia burgdorferi B31
KNKGVFMTKPKIFSIN

SEQ ID NO: 108960 - protein, 16 aa, Borrelia burgdorferi B31
NKGVFMTKPKIFSINK

SEQ ID NO: 108961 - protein, 16 aa, Borrelia burgdorferi B31
KGVFMTKPKIFSINKE

SEQ ID NO: 108962 - protein, 16 aa, Borrelia burgdorferi B31
GVFMTKPKIFSINKEK

SEQ ID NO: 108963 - protein, 16 aa, Borrelia burgdorferi B31
VFMTKPKIFSINKEKI

SEQ ID NO: 108964 - protein, 16 aa, Borrelia burgdorferi B31
FMTKPKIFSINKEKIK

SEQ ID NO: 108965 - protein, 16 aa, Borrelia burgdorferi B31
MTKPKIFSINKEKIKI

SEQ ID NO: 108966 - protein, 16 aa, Borrelia burgdorferi B31
TKPKIFSINKEKIKIL

SEQ ID NO: 108967 - protein, 16 aa, Borrelia burgdorferi B31
KPKIFSINKEKIKILI

SEQ ID NO: 108968 - protein, 16 aa, Borrelia burgdorferi B31
PKIFSINKEKIKILII

SEQ ID NO: 108969 - protein, 16 aa, Borrelia burgdorferi B31
KIFSINKEKIKILIIV

SEQ ID NO: 108970 - protein, 16 aa, Borrelia burgdorferi B31
IFSINKEKIKILIIVV

SEQ ID NO: 108971 - protein, 16 aa, Borrelia burgdorferi B31
FSINKEKIKILIIVVL

SEQ ID NO: 108972 - protein, 16 aa, Borrelia burgdorferi B31
SINKEKIKILIIVVLT

SEQ ID NO: 108973 - protein, 16 aa, Borrelia burgdorferi B31
INKEKIKILIIVVLTS

SEQ ID NO: 108974 - protein, 16 aa, Borrelia burgdorferi B31
NKEKIKILIIVVLTST

SEQ ID NO: 108975 - protein, 16 aa, Borrelia burgdorferi B31
KEKIKILIIVVLTSTF

SEQ ID NO: 108976 - protein, 16 aa, Borrelia burgdorferi B31
EKIKILIIVVLTSTFL

SEQ ID NO: 108977 - protein, 16 aa, Borrelia burgdorferi B31
KIKILIIVVLTSTFLL

SEQ ID NO: 108978 - protein, 16 aa, Borrelia burgdorferi B31
IKILIIVVLTSTFLLG

SEQ ID NO: 108979 - protein, 16 aa, Borrelia burgdorferi B31
KILIIVVLTSTFLLGI

SEQ ID NO: 108980 - protein, 16 aa, Borrelia burgdorferi B31
ILIIVVLTSTFLLGII

SEQ ID NO: 108981 - protein, 16 aa, Borrelia burgdorferi B31
LIIVVLTSTFLLGIIF

SEQ ID NO: 108982 - protein, 16 aa, Borrelia burgdorferi B31
IIVVLTSTFLLGIIFS

SEQ ID NO: 108983 - protein, 16 aa, Borrelia burgdorferi B31
IVVLTSTFLLGIIFSN

SEQ ID NO: 108984 - protein, 16 aa, Borrelia burgdorferi B31
VVLTSTFLLGIIFSNE

SEQ ID NO: 108985 - protein, 16 aa, Borrelia burgdorferi B31
VLTSTFLLGIIFSNEN

SEQ ID NO: 108986 - protein, 16 aa, Borrelia burgdorferi B31
LTSTFLLGIIFSNENK

SEQ ID NO: 108987 - protein, 16 aa, Borrelia burgdorferi B31
TSTFLLGIIFSNENKV

SEQ ID NO: 108988 - protein, 16 aa, Borrelia burgdorferi B31
STFLLGIIFSNENKVA

SEQ ID NO: 108989 - protein, 16 aa, Borrelia burgdorferi B31
TFLLGIIFSNENKVAR

SEQ ID NO: 108990 - protein, 16 aa, Borrelia burgdorferi B31
FLLGIIFSNENKVARI

SEQ ID NO: 108991 - protein, 16 aa, Borrelia burgdorferi B31
LLGIIFSNENKVARIL

SEQ ID NO: 108992 - protein, 16 aa, Borrelia burgdorferi B31
LGIIFSNENKVARILE

SEQ ID NO: 108993 - protein, 16 aa, Borrelia burgdorferi B31
GIIFSNENKVARILEE

SEQ ID NO: 108994 - protein, 16 aa, Borrelia burgdorferi B31
IIFSNENKVARILEEK

SEQ ID NO: 108995 - protein, 16 aa, Borrelia burgdorferi B31
IFSNENKVARILEEKF

SEQ ID NO: 108996 - protein, 16 aa, Borrelia burgdorferi B31
FSNENKVARILEEKFF

SEQ ID NO: 108997 - protein, 16 aa, Borrelia burgdorferi B31
SNENKVARILEEKFFD

SEQ ID NO: 108998 - protein, 16 aa, Borrelia burgdorferi B31
NENKVARILEEKFFDF

SEQ ID NO: 108999 - protein, 16 aa, Borrelia burgdorferi B31
ENKVARILEEKFFDFD

SEQ ID NO: 109000 - protein, 16 aa, Borrelia burgdorferi B31
NKVARILEEKFFDFDF

SEQ ID NO: 109001 - protein, 16 aa, Borrelia burgdorferi B31
KVARILEEKFFDFDFN

SEQ ID NO: 109002 - protein, 16 aa, Borrelia burgdorferi B31
VARILEEKFFDFDFNL

SEQ ID NO: 109003 - protein, 16 aa, Borrelia burgdorferi B31
ARILEEKFFDFDFNLI

SEQ ID NO: 109004 - protein, 16 aa, Borrelia burgdorferi B31
RILEEKFFDFDFNLIS

SEQ ID NO: 109005 - protein, 16 aa, Borrelia burgdorferi B31
ILEEKFFDFDFNLISK

SEQ ID NO: 109006 - protein, 16 aa, Borrelia burgdorferi B31
LEEKFFDFDFNLISKI

SEQ ID NO: 109007 - protein, 16 aa, Borrelia burgdorferi B31
EEKFFDFDFNLISKIE

SEQ ID NO: 109008 - protein, 16 aa, Borrelia burgdorferi B31
EKFFDFDFNLISKIET

SEQ ID NO: 109009 - protein, 16 aa, Borrelia burgdorferi B31
KFFDFDFNLISKIETE

SEQ ID NO: 109010 - protein, 16 aa, Borrelia burgdorferi B31
FFDFDFNLISKIETEL

SEQ ID NO: 109011 - protein, 16 aa, Borrelia burgdorferi B31
FDFDFNLISKIETELE

SEQ ID NO: 109012 - protein, 16 aa, Borrelia burgdorferi B31
DFDFNLISKIETELEG

SEQ ID NO: 109013 - protein, 16 aa, Borrelia burgdorferi B31
FDFNLISKIETELEGT

SEQ ID NO: 109014 - protein, 16 aa, Borrelia burgdorferi B31
DFNLISKIETELEGTL

SEQ ID NO: 109015 - protein, 16 aa, Borrelia burgdorferi B31
FNLISKIETELEGTLT

SEQ ID NO: 109016 - protein, 16 aa, Borrelia burgdorferi B31
NLISKIETELEGTLTK

SEQ ID NO: 109017 - protein, 16 aa, Borrelia burgdorferi B31
LISKIETELEGTLTKL

SEQ ID NO: 109018 - protein, 16 aa, Borrelia burgdorferi B31
ISKIETELEGTLTKLG

SEQ ID NO: 109019 - protein, 16 aa, Borrelia burgdorferi B31
SKIETELEGTLTKLGK

SEQ ID NO: 109020 - protein, 16 aa, Borrelia burgdorferi B31
KIETELEGTLTKLGKD

SEQ ID NO: 109021 - protein, 16 aa, Borrelia burgdorferi B31
IETELEGTLTKLGKDW

SEQ ID NO: 109022 - protein, 16 aa, Borrelia burgdorferi B31
ETELEGTLTKLGKDWI

SEQ ID NO: 109023 - protein, 16 aa, Borrelia burgdorferi B31
TELEGTLTKLGKDWIL

SEQ ID NO: 109024 - protein, 16 aa, Borrelia burgdorferi B31
ELEGTLTKLGKDWILT

SEQ ID NO: 109025 - protein, 16 aa, Borrelia burgdorferi B31
LEGTLTKLGKDWILTY

SEQ ID NO: 109026 - protein, 16 aa, Borrelia burgdorferi B31
EGTLTKLGKDWILTYN

SEQ ID NO: 109027 - protein, 16 aa, Borrelia burgdorferi B31
GTLTKLGKDWILTYNK

SEQ ID NO: 109028 - protein, 16 aa, Borrelia burgdorferi B31
TLTKLGKDWILTYNKQ

SEQ ID NO: 109029 - protein, 16 aa, Borrelia burgdorferi B31
LTKLGKDWILTYNKQN

SEQ ID NO: 109030 - protein, 16 aa, Borrelia burgdorferi B31
TKLGKDWILTYNKQNI

SEQ ID NO: 109031 - protein, 16 aa, Borrelia burgdorferi B31
KLGKDWILTYNKQNIP

SEQ ID NO: 109032 - protein, 16 aa, Borrelia burgdorferi B31
LGKDWILTYNKQNIPV

SEQ ID NO: 109033 - protein, 16 aa, Borrelia burgdorferi B31
GKDWILTYNKQNIPVD

SEQ ID NO: 109034 - protein, 16 aa, Borrelia burgdorferi B31
KDWILTYNKQNIPVDN

SEQ ID NO: 109035 - protein, 16 aa, Borrelia burgdorferi B31
DWILTYNKQNIPVDNK

SEQ ID NO: 109036 - protein, 16 aa, Borrelia burgdorferi B31
WILTYNKQNIPVDNKK

SEQ ID NO: 109037 - protein, 16 aa, Borrelia burgdorferi B31
ILTYNKQNIPVDNKKV

SEQ ID NO: 109038 - protein, 16 aa, Borrelia burgdorferi B31
LTYNKQNIPVDNKKVN

SEQ ID NO: 109039 - protein, 16 aa, Borrelia burgdorferi B31
TYNKQNIPVDNKKVNS

SEQ ID NO: 109040 - protein, 16 aa, Borrelia burgdorferi B31
YNKQNIPVDNKKVNSL

SEQ ID NO: 109041 - protein, 16 aa, Borrelia burgdorferi B31
NKQNIPVDNKKVNSLI

SEQ ID NO: 109042 - protein, 16 aa, Borrelia burgdorferi B31
KQNIPVDNKKVNSLIK

SEQ ID NO: 109043 - protein, 16 aa, Borrelia burgdorferi B31
QNIPVDNKKVNSLIKA

SEQ ID NO: 109044 - protein, 16 aa, Borrelia burgdorferi B31
NIPVDNKKVNSLIKAL

SEQ ID NO: 109045 - protein, 16 aa, Borrelia burgdorferi B31
IPVDNKKVNSLIKALD

SEQ ID NO: 109046 - protein, 16 aa, Borrelia burgdorferi B31
PVDNKKVNSLIKALDE

SEQ ID NO: 109047 - protein, 16 aa, Borrelia burgdorferi B31
VDNKKVNSLIKALDEL

SEQ ID NO: 109048 - protein, 16 aa, Borrelia burgdorferi B31
DNKKVNSLIKALDELQ

SEQ ID NO: 109049 - protein, 16 aa, Borrelia burgdorferi B31
NKKVNSLIKALDELQK

SEQ ID NO: 109050 - protein, 16 aa, Borrelia burgdorferi B31
KKVNSLIKALDELQKN

SEQ ID NO: 109051 - protein, 16 aa, Borrelia burgdorferi B31
KVNSLIKALDELQKNK

SEQ ID NO: 109052 - protein, 16 aa, Borrelia burgdorferi B31
VNSLIKALDELQKNKL

SEQ ID NO: 109053 - protein, 16 aa, Borrelia burgdorferi B31
NSLIKALDELQKNKLV

SEQ ID NO: 109054 - protein, 16 aa, Borrelia burgdorferi B31
SLIKALDELQKNKLVS

SEQ ID NO: 109055 - protein, 16 aa, Borrelia burgdorferi B31
LIKALDELQKNKLVSR

SEQ ID NO: 109056 - protein, 16 aa, Borrelia burgdorferi B31
IKALDELQKNKLVSRD

SEQ ID NO: 109057 - protein, 16 aa, Borrelia burgdorferi B31
KALDELQKNKLVSRDQ

SEQ ID NO: 109058 - protein, 16 aa, Borrelia burgdorferi B31
ALDELQKNKLVSRDQK

SEQ ID NO: 109059 - protein, 16 aa, Borrelia burgdorferi B31
LDELQKNKLVSRDQKK

SEQ ID NO: 109060 - protein, 16 aa, Borrelia burgdorferi B31
DELQKNKLVSRDQKKH

SEQ ID NO: 109061 - protein, 16 aa, Borrelia burgdorferi B31
ELQKNKLVSRDQKKHK

SEQ ID NO: 109062 - protein, 16 aa, Borrelia burgdorferi B31
LQKNKLVSRDQKKHKE

SEQ ID NO: 109063 - protein, 16 aa, Borrelia burgdorferi B31
QKNKLVSRDQKKHKEL

SEQ ID NO: 109064 - protein, 16 aa, Borrelia burgdorferi B31
KNKLVSRDQKKHKELG

SEQ ID NO: 109065 - protein, 16 aa, Borrelia burgdorferi B31
NKLVSRDQKKHKELGI

SEQ ID NO: 109066 - protein, 16 aa, Borrelia burgdorferi B31
KLVSRDQKKHKELGIG

SEQ ID NO: 109067 - protein, 16 aa, Borrelia burgdorferi B31
LVSRDQKKHKELGIGE

SEQ ID NO: 109068 - protein, 16 aa, Borrelia burgdorferi B31
VSRDQKKHKELGIGEN

SEQ ID NO: 109069 - protein, 16 aa, Borrelia burgdorferi B31
SRDQKKHKELGIGENP

SEQ ID NO: 109070 - protein, 16 aa, Borrelia burgdorferi B31
RDQKKHKELGIGENPS

SEQ ID NO: 109071 - protein, 16 aa, Borrelia burgdorferi B31
DQKKHKELGIGENPSF

SEQ ID NO: 109072 - protein, 16 aa, Borrelia burgdorferi B31
QKKHKELGIGENPSFK

SEQ ID NO: 109073 - protein, 16 aa, Borrelia burgdorferi B31
KKHKELGIGENPSFKL

SEQ ID NO: 109074 - protein, 16 aa, Borrelia burgdorferi B31
KHKELGIGENPSFKLF

SEQ ID NO: 109075 - protein, 16 aa, Borrelia burgdorferi B31
HKELGIGENPSFKLFD

SEQ ID NO: 109076 - protein, 16 aa, Borrelia burgdorferi B31
KELGIGENPSFKLFDN

SEQ ID NO: 109077 - protein, 16 aa, Borrelia burgdorferi B31
ELGIGENPSFKLFDNN

SEQ ID NO: 109078 - protein, 16 aa, Borrelia burgdorferi B31
LGIGENPSFKLFDNNN

SEQ ID NO: 109079 - protein, 16 aa, Borrelia burgdorferi B31
GIGENPSFKLFDNNNK

SEQ ID NO: 109080 - protein, 16 aa, Borrelia burgdorferi B31
IGENPSFKLFDNNNKL

SEQ ID NO: 109081 - protein, 16 aa, Borrelia burgdorferi B31
GENPSFKLFDNNNKLL

SEQ ID NO: 109082 - protein, 16 aa, Borrelia burgdorferi B31
ENPSFKLFDNNNKLLT

SEQ ID NO: 109083 - protein, 16 aa, Borrelia burgdorferi B31
NPSFKLFDNNNKLLTE

SEQ ID NO: 109084 - protein, 16 aa, Borrelia burgdorferi B31
PSFKLFDNNNKLLTEI

SEQ ID NO: 109085 - protein, 16 aa, Borrelia burgdorferi B31
SFKLFDNNNKLLTEIF

SEQ ID NO: 109086 - protein, 16 aa, Borrelia burgdorferi B31
FKLFDNNNKLLTEIFV

SEQ ID NO: 109087 - protein, 16 aa, Borrelia burgdorferi B31
KLFDNNNKLLTEIFVG

SEQ ID NO: 109088 - protein, 16 aa, Borrelia burgdorferi B31
LFDNNNKLLTEIFVGK

SEQ ID NO: 109089 - protein, 16 aa, Borrelia burgdorferi B31
FDNNNKLLTEIFVGKS

SEQ ID NO: 109090 - protein, 16 aa, Borrelia burgdorferi B31
DNNNKLLTEIFVGKSG

SEQ ID NO: 109091 - protein, 16 aa, Borrelia burgdorferi B31
NNNKLLTEIFVGKSGE

SEQ ID NO: 109092 - protein, 16 aa, Borrelia burgdorferi B31
NNKLLTEIFVGKSGEG

SEQ ID NO: 109093 - protein, 16 aa, Borrelia burgdorferi B31
NKLLTEIFVGKSGEGD

SEQ ID NO: 109094 - protein, 16 aa, Borrelia burgdorferi B31
KLLTEIFVGKSGEGDS

SEQ ID NO: 109095 - protein, 16 aa, Borrelia burgdorferi B31
LLTEIFVGKSGEGDSR

SEQ ID NO: 109096 - protein, 16 aa, Borrelia burgdorferi B31
LTEIFVGKSGEGDSRL

SEQ ID NO: 109097 - protein, 16 aa, Borrelia burgdorferi B31
TEIFVGKSGEGDSRLA

SEQ ID NO: 109098 - protein, 16 aa, Borrelia burgdorferi B31
EIFVGKSGEGDSRLAY

SEQ ID NO: 109099 - protein, 16 aa, Borrelia burgdorferi B31
IFVGKSGEGDSRLAYI

SEQ ID NO: 109100 - protein, 16 aa, Borrelia burgdorferi B31
FVGKSGEGDSRLAYIK

SEQ ID NO: 109101 - protein, 16 aa, Borrelia burgdorferi B31
VGKSGEGDSRLAYIKG

SEQ ID NO: 109102 - protein, 16 aa, Borrelia burgdorferi B31
GKSGEGDSRLAYIKGS

SEQ ID NO: 109103 - protein, 16 aa, Borrelia burgdorferi B31
KSGEGDSRLAYIKGSD

SEQ ID NO: 109104 - protein, 16 aa, Borrelia burgdorferi B31
SGEGDSRLAYIKGSDE

SEQ ID NO: 109105 - protein, 16 aa, Borrelia burgdorferi B31
GEGDSRLAYIKGSDEN

SEQ ID NO: 109106 - protein, 16 aa, Borrelia burgdorferi B31
EGDSRLAYIKGSDENV

SEQ ID NO: 109107 - protein, 16 aa, Borrelia burgdorferi B31
GDSRLAYIKGSDENVY

SEQ ID NO: 109108 - protein, 16 aa, Borrelia burgdorferi B31
DSRLAYIKGSDENVYL

SEQ ID NO: 109109 - protein, 16 aa, Borrelia burgdorferi B31
SRLAYIKGSDENVYLT

SEQ ID NO: 109110 - protein, 16 aa, Borrelia burgdorferi B31
RLAYIKGSDENVYLTK

SEQ ID NO: 109111 - protein, 16 aa, Borrelia burgdorferi B31
LAYIKGSDENVYLTKN

SEQ ID NO: 109112 - protein, 16 aa, Borrelia burgdorferi B31
AYIKGSDENVYLTKNI

SEQ ID NO: 109113 - protein, 16 aa, Borrelia burgdorferi B31
YIKGSDENVYLTKNIF

SEQ ID NO: 109114 - protein, 16 aa, Borrelia burgdorferi B31
IKGSDENVYLTKNIFL

SEQ ID NO: 109115 - protein, 16 aa, Borrelia burgdorferi B31
KGSDENVYLTKNIFLS

SEQ ID NO: 109116 - protein, 16 aa, Borrelia burgdorferi B31
GSDENVYLTKNIFLSY

SEQ ID NO: 109117 - protein, 16 aa, Borrelia burgdorferi B31
SDENVYLTKNIFLSYK

SEQ ID NO: 109118 - protein, 16 aa, Borrelia burgdorferi B31
DENVYLTKNIFLSYKG

SEQ ID NO: 109119 - protein, 16 aa, Borrelia burgdorferi B31
ENVYLTKNIFLSYKGN

SEQ ID NO: 109120 - protein, 16 aa, Borrelia burgdorferi B31
NVYLTKNIFLSYKGNS

SEQ ID NO: 109121 - protein, 16 aa, Borrelia burgdorferi B31
VYLTKNIFLSYKGNSY

SEQ ID NO: 109122 - protein, 16 aa, Borrelia burgdorferi B31
YLTKNIFLSYKGNSYN

SEQ ID NO: 109123 - protein, 16 aa, Borrelia burgdorferi B31
LTKNIFLSYKGNSYNT

SEQ ID NO: 109124 - protein, 16 aa, Borrelia burgdorferi B31
TKNIFLSYKGNSYNTF

SEQ ID NO: 109125 - protein, 16 aa, Borrelia burgdorferi B31
KNIFLSYKGNSYNTFS

SEQ ID NO: 109126 - protein, 16 aa, Borrelia burgdorferi B31
NIFLSYKGNSYNTFSD

SEQ ID NO: 109127 - protein, 16 aa, Borrelia burgdorferi B31
IFLSYKGNSYNTFSDT

SEQ ID NO: 109128 - protein, 16 aa, Borrelia burgdorferi B31
FLSYKGNSYNTFSDTT

SEQ ID NO: 109129 - protein, 16 aa, Borrelia burgdorferi B31
LSYKGNSYNTFSDTTL

SEQ ID NO: 109130 - protein, 16 aa, Borrelia burgdorferi B31
SYKGNSYNTFSDTTLF

SEQ ID NO: 109131 - protein, 16 aa, Borrelia burgdorferi B31
YKGNSYNTFSDTTLFQ

SEQ ID NO: 109132 - protein, 16 aa, Borrelia burgdorferi B31
KGNSYNTFSDTTLFQE

SEQ ID NO: 109133 - protein, 16 aa, Borrelia burgdorferi B31
GNSYNTFSDTTLFQEK

SEQ ID NO: 109134 - protein, 16 aa, Borrelia burgdorferi B31
NSYNTFSDTTLFQEKN

SEQ ID NO: 109135 - protein, 16 aa, Borrelia burgdorferi B31
SYNTFSDTTLFQEKNT

SEQ ID NO: 109136 - protein, 16 aa, Borrelia burgdorferi B31
YNTFSDTTLFQEKNTK

SEQ ID NO: 109137 - protein, 16 aa, Borrelia burgdorferi B31
NTFSDTTLFQEKNTKL

SEQ ID NO: 109138 - protein, 16 aa, Borrelia burgdorferi B31
TFSDTTLFQEKNTKLE

SEQ ID NO: 109139 - protein, 16 aa, Borrelia burgdorferi B31
FSDTTLFQEKNTKLEN

SEQ ID NO: 109140 - protein, 16 aa, Borrelia burgdorferi B31
SDTTLFQEKNTKLENL

SEQ ID NO: 109141 - protein, 16 aa, Borrelia burgdorferi B31
DTTLFQEKNTKLENLS

SEQ ID NO: 109142 - protein, 16 aa, Borrelia burgdorferi B31
TTLFQEKNTKLENLSF

SEQ ID NO: 109143 - protein, 16 aa, Borrelia burgdorferi B31
TLFQEKNTKLENLSFK

SEQ ID NO: 109144 - protein, 16 aa, Borrelia burgdorferi B31
LFQEKNTKLENLSFKI

SEQ ID NO: 109145 - protein, 16 aa, Borrelia burgdorferi B31
FQEKNTKLENLSFKII

SEQ ID NO: 109146 - protein, 16 aa, Borrelia burgdorferi B31
QEKNTKLENLSFKIIR

SEQ ID NO: 109147 - protein, 16 aa, Borrelia burgdorferi B31
EKNTKLENLSFKIIRK

SEQ ID NO: 109148 - protein, 16 aa, Borrelia burgdorferi B31
KNTKLENLSFKIIRKL

SEQ ID NO: 109149 - protein, 16 aa, Borrelia burgdorferi B31
NTKLENLSFKIIRKLN

SEQ ID NO: 109150 - protein, 16 aa, Borrelia burgdorferi B31
TKLENLSFKIIRKLNK

SEQ ID NO: 109151 - protein, 16 aa, Borrelia burgdorferi B31
KLENLSFKIIRKLNKE

SEQ ID NO: 109152 - protein, 16 aa, Borrelia burgdorferi B31
LENLSFKIIRKLNKEN

SEQ ID NO: 109153 - protein, 16 aa, Borrelia burgdorferi B31
ENLSFKIIRKLNKENE

SEQ ID NO: 109154 - protein, 16 aa, Borrelia burgdorferi B31
NLSFKIIRKLNKENEN

SEQ ID NO: 109155 - protein, 16 aa, Borrelia burgdorferi B31
LSFKIIRKLNKENENN

SEQ ID NO: 109156 - protein, 16 aa, Borrelia burgdorferi B31
SFKIIRKLNKENENNI

SEQ ID NO: 109157 - protein, 16 aa, Borrelia burgdorferi B31
FKIIRKLNKENENNIN

SEQ ID NO: 109158 - protein, 16 aa, Borrelia burgdorferi B31
KIIRKLNKENENNINN

SEQ ID NO: 109159 - protein, 16 aa, Borrelia burgdorferi B31
IIRKLNKENENNINNN

SEQ ID NO: 109160 - protein, 16 aa, Borrelia burgdorferi B31
IRKLNKENENNINNNY

SEQ ID NO: 109161 - protein, 16 aa, Borrelia burgdorferi B31
RKLNKENENNINNNYE

SEQ ID NO: 109162 - protein, 16 aa, Borrelia burgdorferi B31
KLNKENENNINNNYEI

SEQ ID NO: 109163 - protein, 16 aa, Borrelia burgdorferi B31
LNKENENNINNNYEII

SEQ ID NO: 109164 - protein, 16 aa, Borrelia burgdorferi B31
NKENENNINNNYEIIS

SEQ ID NO: 109165 - protein, 16 aa, Borrelia burgdorferi B31
KENENNINNNYEIISK

SEQ ID NO: 109166 - protein, 16 aa, Borrelia burgdorferi B31
ENENNINNNYEIISKD

SEQ ID NO: 109167 - protein, 16 aa, Borrelia burgdorferi B31
NENNINNNYEIISKDG

SEQ ID NO: 109168 - protein, 16 aa, Borrelia burgdorferi B31
ENNINNNYEIISKDGL

SEQ ID NO: 109169 - protein, 16 aa, Borrelia burgdorferi B31
NNINNNYEIISKDGLY

SEQ ID NO: 109170 - protein, 16 aa, Borrelia burgdorferi B31
NINNNYEIISKDGLYF

SEQ ID NO: 109171 - protein, 16 aa, Borrelia burgdorferi B31
INNNYEIISKDGLYFL

SEQ ID NO: 109172 - protein, 16 aa, Borrelia burgdorferi B31
NNNYEIISKDGLYFLN

SEQ ID NO: 109173 - protein, 16 aa, Borrelia burgdorferi B31
NNYEIISKDGLYFLNN

SEQ ID NO: 109174 - protein, 16 aa, Borrelia burgdorferi B31
NYEIISKDGLYFLNNQ

SEQ ID NO: 109175 - protein, 16 aa, Borrelia burgdorferi B31
YEIISKDGLYFLNNQK

SEQ ID NO: 109176 - protein, 16 aa, Borrelia burgdorferi B31
EIISKDGLYFLNNQKM

SEQ ID NO: 109177 - protein, 16 aa, Borrelia burgdorferi B31
IISKDGLYFLNNQKMT

SEQ ID NO: 109178 - protein, 16 aa, Borrelia burgdorferi B31
ISKDGLYFLNNQKMTK

SEQ ID NO: 109179 - protein, 16 aa, Borrelia burgdorferi B31
SKDGLYFLNNQKMTKE

SEQ ID NO: 109180 - protein, 16 aa, Borrelia burgdorferi B31
KDGLYFLNNQKMTKER

SEQ ID NO: 109181 - protein, 16 aa, Borrelia burgdorferi B31
DGLYFLNNQKMTKERP

SEQ ID NO: 109182 - protein, 16 aa, Borrelia burgdorferi B31
GLYFLNNQKMTKERPL

SEQ ID NO: 109183 - protein, 16 aa, Borrelia burgdorferi B31
LYFLNNQKMTKERPLN

SEQ ID NO: 109184 - protein, 16 aa, Borrelia burgdorferi B31
YFLNNQKMTKERPLNI

SEQ ID NO: 109185 - protein, 16 aa, Borrelia burgdorferi B31
FLNNQKMTKERPLNII

SEQ ID NO: 109186 - protein, 16 aa, Borrelia burgdorferi B31
LNNQKMTKERPLNIIA

SEQ ID NO: 109187 - protein, 16 aa, Borrelia burgdorferi B31
NNQKMTKERPLNIIAE

SEQ ID NO: 109188 - protein, 16 aa, Borrelia burgdorferi B31
NQKMTKERPLNIIAEF

SEQ ID NO: 109189 - protein, 16 aa, Borrelia burgdorferi B31
QKMTKERPLNIIAEFK

SEQ ID NO: 109190 - protein, 16 aa, Borrelia burgdorferi B31
KMTKERPLNIIAEFKA

SEQ ID NO: 109191 - protein, 16 aa, Borrelia burgdorferi B31
MTKERPLNIIAEFKAD

SEQ ID NO: 109192 - protein, 16 aa, Borrelia burgdorferi B31
TKERPLNIIAEFKADG

SEQ ID NO: 109193 - protein, 16 aa, Borrelia burgdorferi B31
KERPLNIIAEFKADGL

SEQ ID NO: 109194 - protein, 16 aa, Borrelia burgdorferi B31
ERPLNIIAEFKADGLE

SEQ ID NO: 109195 - protein, 16 aa, Borrelia burgdorferi B31
RPLNIIAEFKADGLEI

SEQ ID NO: 109196 - protein, 16 aa, Borrelia burgdorferi B31
PLNIIAEFKADGLEID

SEQ ID NO: 109197 - protein, 16 aa, Borrelia burgdorferi B31
LNIIAEFKADGLEIDK

SEQ ID NO: 109198 - protein, 16 aa, Borrelia burgdorferi B31
NIIAEFKADGLEIDKS

SEQ ID NO: 109199 - protein, 16 aa, Borrelia burgdorferi B31
IIAEFKADGLEIDKSK

SEQ ID NO: 109200 - protein, 16 aa, Borrelia burgdorferi B31
IAEFKADGLEIDKSKI

SEQ ID NO: 109201 - protein, 16 aa, Borrelia burgdorferi B31
AEFKADGLEIDKSKID

SEQ ID NO: 109202 - protein, 16 aa, Borrelia burgdorferi B31
EFKADGLEIDKSKIDD

SEQ ID NO: 109203 - protein, 16 aa, Borrelia burgdorferi B31
FKADGLEIDKSKIDDY

SEQ ID NO: 109204 - protein, 16 aa, Borrelia burgdorferi B31
KADGLEIDKSKIDDYN

SEQ ID NO: 109205 - protein, 16 aa, Borrelia burgdorferi B31
ADGLEIDKSKIDDYNL

SEQ ID NO: 109206 - protein, 16 aa, Borrelia burgdorferi B31
DGLEIDKSKIDDYNLQ

SEQ ID NO: 109207 - protein, 16 aa, Borrelia burgdorferi B31
GLEIDKSKIDDYNLQY

SEQ ID NO: 109208 - protein, 16 aa, Borrelia burgdorferi B31
LEIDKSKIDDYNLQYK

SEQ ID NO: 109209 - protein, 16 aa, Borrelia burgdorferi B31
EIDKSKIDDYNLQYKI

SEQ ID NO: 109210 - protein, 16 aa, Borrelia burgdorferi B31
IDKSKIDDYNLQYKIE

SEQ ID NO: 109211 - protein, 16 aa, Borrelia burgdorferi B31
DKSKIDDYNLQYKIEV

SEQ ID NO: 109212 - protein, 16 aa, Borrelia burgdorferi B31
KSKIDDYNLQYKIEVK

SEQ ID NO: 109213 - protein, 16 aa, Borrelia burgdorferi B31
SKIDDYNLQYKIEVKW

SEQ ID NO: 109214 - protein, 16 aa, Borrelia burgdorferi B31
KIDDYNLQYKIEVKWS

SEQ ID NO: 109215 - protein, 16 aa, Borrelia burgdorferi B31
IDDYNLQYKIEVKWSN

SEQ ID NO: 109216 - protein, 16 aa, Borrelia burgdorferi B31
DDYNLQYKIEVKWSNK

SEQ ID NO: 109217 - protein, 16 aa, Borrelia burgdorferi B31
DYNLQYKIEVKWSNKS

SEQ ID NO: 109218 - protein, 16 aa, Borrelia burgdorferi B31
YNLQYKIEVKWSNKSV

SEQ ID NO: 109219 - protein, 16 aa, Borrelia burgdorferi B31
NLQYKIEVKWSNKSVN

SEQ ID NO: 109220 - protein, 16 aa, Borrelia burgdorferi B31
LQYKIEVKWSNKSVNN

SEQ ID NO: 109221 - protein, 16 aa, Borrelia burgdorferi B31
QYKIEVKWSNKSVNNI

SEQ ID NO: 109222 - protein, 16 aa, Borrelia burgdorferi B31
YKIEVKWSNKSVNNIE

SEQ ID NO: 109223 - protein, 16 aa, Borrelia burgdorferi B31
KIEVKWSNKSVNNIEV

SEQ ID NO: 109224 - protein, 16 aa, Borrelia burgdorferi B31
IEVKWSNKSVNNIEVY

SEQ ID NO: 109225 - protein, 16 aa, Borrelia burgdorferi B31
EVKWSNKSVNNIEVYF

SEQ ID NO: 109226 - protein, 16 aa, Borrelia burgdorferi B31
VKWSNKSVNNIEVYFN

SEQ ID NO: 109227 - protein, 16 aa, Borrelia burgdorferi B31
KWSNKSVNNIEVYFNK

SEQ ID NO: 109228 - protein, 16 aa, Borrelia burgdorferi B31
WSNKSVNNIEVYFNKN

SEQ ID NO: 109229 - protein, 16 aa, Borrelia burgdorferi B31
SNKSVNNIEVYFNKNE

SEQ ID NO: 109230 - protein, 16 aa, Borrelia burgdorferi B31
NKSVNNIEVYFNKNEE

SEQ ID NO: 109231 - protein, 16 aa, Borrelia burgdorferi B31
KSVNNIEVYFNKNEEN

SEQ ID NO: 109232 - protein, 16 aa, Borrelia burgdorferi B31
SVNNIEVYFNKNEEND

SEQ ID NO: 109233 - protein, 16 aa, Borrelia burgdorferi B31
VNNIEVYFNKNEENDK

SEQ ID NO: 109234 - protein, 16 aa, Borrelia burgdorferi B31
NNIEVYFNKNEENDKD

SEQ ID NO: 109235 - protein, 16 aa, Borrelia burgdorferi B31
NIEVYFNKNEENDKDI

SEQ ID NO: 109236 - protein, 16 aa, Borrelia burgdorferi B31
IEVYFNKNEENDKDIL

SEQ ID NO: 109237 - protein, 16 aa, Borrelia burgdorferi B31
EVYFNKNEENDKDILI

SEQ ID NO: 109238 - protein, 16 aa, Borrelia burgdorferi B31
VYFNKNEENDKDILIK

SEQ ID NO: 109239 - protein, 16 aa, Borrelia burgdorferi B31
YFNKNEENDKDILIKK

SEQ ID NO: 109240 - protein, 16 aa, Borrelia burgdorferi B31
FNKNEENDKDILIKKD

SEQ ID NO: 109241 - protein, 16 aa, Borrelia burgdorferi B31
NKNEENDKDILIKKDK

SEQ ID NO: 109242 - protein, 16 aa, Borrelia burgdorferi B31
KNEENDKDILIKKDKD

SEQ ID NO: 109243 - protein, 16 aa, Borrelia burgdorferi B31
NEENDKDILIKKDKDE

SEQ ID NO: 109244 - protein, 16 aa, Borrelia burgdorferi B31
EENDKDILIKKDKDEY

SEQ ID NO: 109245 - protein, 16 aa, Borrelia burgdorferi B31
ENDKDILIKKDKDEYY

SEQ ID NO: 109246 - protein, 16 aa, Borrelia burgdorferi B31
NDKDILIKKDKDEYYY

SEQ ID NO: 109247 - protein, 16 aa, Borrelia burgdorferi B31
DKDILIKKDKDEYYYT

SEQ ID NO: 109248 - protein, 16 aa, Borrelia burgdorferi B31
KDILIKKDKDEYYYTT

SEQ ID NO: 109249 - protein, 16 aa, Borrelia burgdorferi B31
DILIKKDKDEYYYTTS

SEQ ID NO: 109250 - protein, 16 aa, Borrelia burgdorferi B31
ILIKKDKDEYYYTTSK

SEQ ID NO: 109251 - protein, 16 aa, Borrelia burgdorferi B31
LIKKDKDEYYYTTSKW

SEQ ID NO: 109252 - protein, 16 aa, Borrelia burgdorferi B31
IKKDKDEYYYTTSKWT

SEQ ID NO: 109253 - protein, 16 aa, Borrelia burgdorferi B31
KKDKDEYYYTTSKWTF

SEQ ID NO: 109254 - protein, 16 aa, Borrelia burgdorferi B31
KDKDEYYYTTSKWTFF

SEQ ID NO: 109255 - protein, 16 aa, Borrelia burgdorferi B31
DKDEYYYTTSKWTFFD

SEQ ID NO: 109256 - protein, 16 aa, Borrelia burgdorferi B31
KDEYYYTTSKWTFFDV

SEQ ID NO: 109257 - protein, 16 aa, Borrelia burgdorferi B31
DEYYYTTSKWTFFDVF

SEQ ID NO: 109258 - protein, 16 aa, Borrelia burgdorferi B31
EYYYTTSKWTFFDVFD

SEQ ID NO: 109259 - protein, 16 aa, Borrelia burgdorferi B31
YYYTTSKWTFFDVFDL

SEQ ID NO: 109260 - protein, 16 aa, Borrelia burgdorferi B31
YYTTSKWTFFDVFDLE

SEQ ID NO: 109261 - protein, 16 aa, Borrelia burgdorferi B31
YTTSKWTFFDVFDLEK

SEQ ID NO: 109262 - protein, 16 aa, Borrelia burgdorferi B31
TTSKWTFFDVFDLEKK

SEQ ID NO: 109263 - protein, 16 aa, Borrelia burgdorferi B31
TSKWTFFDVFDLEKKL

SEQ ID NO: 109264 - protein, 16 aa, Borrelia burgdorferi B31
SKWTFFDVFDLEKKLT

SEQ ID NO: 109265 - protein, 16 aa, Borrelia burgdorferi B31
KWTFFDVFDLEKKLTE

SEQ ID NO: 109266 - protein, 16 aa, Borrelia burgdorferi B31
WTFFDVFDLEKKLTEK

SEQ ID NO: 109267 - protein, 16 aa, Borrelia burgdorferi B31
TFFDVFDLEKKLTEKD

SEQ ID NO: 109268 - protein, 16 aa, Borrelia burgdorferi B31
FFDVFDLEKKLTEKDD

SEQ ID NO: 109269 - protein, 16 aa, Borrelia burgdorferi B31
FDVFDLEKKLTEKDDI

SEQ ID NO: 109270 - protein, 16 aa, Borrelia burgdorferi B31
DVFDLEKKLTEKDDIS

SEQ ID NO: 109271 - protein, 16 aa, Borrelia burgdorferi B31
VFDLEKKLTEKDDISS

SEQ ID NO: 109272 - protein, 16 aa, Borrelia burgdorferi B31
FDLEKKLTEKDDISSN

SEQ ID NO: 109273 - protein, 16 aa, Borrelia burgdorferi B31
DLEKKLTEKDDISSND

SEQ ID NO: 109274 - protein, 16 aa, Borrelia burgdorferi B31
LEKKLTEKDDISSNDN

SEQ ID NO: 109275 - protein, 16 aa, Borrelia burgdorferi B31
EKKLTEKDDISSNDNQ

SEQ ID NO: 109276 - protein, 16 aa, Borrelia burgdorferi B31
KKLTEKDDISSNDNQE

SEQ ID NO: 109277 - protein, 16 aa, Borrelia burgdorferi B31
KLTEKDDISSNDNQED

SEQ ID NO: 109278 - protein, 16 aa, Borrelia burgdorferi B31
LTEKDDISSNDNQEDH

SEQ ID NO: 109279 - protein, 16 aa, Borrelia burgdorferi B31
TEKDDISSNDNQEDHH

SEQ ID NO: 109280 - protein, 16 aa, Borrelia burgdorferi B31
EKDDISSNDNQEDHHE

SEQ ID NO: 109281 - protein, 16 aa, Borrelia burgdorferi B31
KDDISSNDNQEDHHEH

SEQ ID NO: 109282 - protein, 16 aa, Borrelia burgdorferi B31
DDISSNDNQEDHHEHH

SEQ ID NO: 109283 - protein, 16 aa, Borrelia burgdorferi B31
DISSNDNQEDHHEHHN

SEQ ID NO: 109284 - protein, 16 aa, Borrelia burgdorferi B31
ISSNDNQEDHHEHHNN

SEQ ID NO: 109285 - protein, 16 aa, Borrelia burgdorferi B31
SSNDNQEDHHEHHNNA

SEQ ID NO: 109286 - protein, 16 aa, Borrelia burgdorferi B31
SNDNQEDHHEHHNNAD

SEQ ID NO: 109287 - protein, 13 aa, Borrelia burgdorferi B31
MKKLIIIFTLFLS

SEQ ID NO: 109288 - protein, 13 aa, Borrelia burgdorferi B31
KKLIIIFTLFLSQ

SEQ ID NO: 109289 - protein, 13 aa, Borrelia burgdorferi B31
KLIIIFTLFLSQA

SEQ ID NO: 109290 - protein, 13 aa, Borrelia burgdorferi B31
LIIIFTLFLSQAC

SEQ ID NO: 109291 - protein, 13 aa, Borrelia burgdorferi B31
IIIFTLFLSQACN

SEQ ID NO: 109292 - protein, 13 aa, Borrelia burgdorferi B31
IIFTLFLSQACNL

SEQ ID NO: 109293 - protein, 13 aa, Borrelia burgdorferi B31
IFTLFLSQACNLS

SEQ ID NO: 109294 - protein, 13 aa, Borrelia burgdorferi B31
FTLFLSQACNLST

SEQ ID NO: 109295 - protein, 13 aa, Borrelia burgdorferi B31
TLFLSQACNLSTM

SEQ ID NO: 109296 - protein, 13 aa, Borrelia burgdorferi B31
LFLSQACNLSTMH

SEQ ID NO: 109297 - protein, 13 aa, Borrelia burgdorferi B31
FLSQACNLSTMHK

SEQ ID NO: 109298 - protein, 13 aa, Borrelia burgdorferi B31
LSQACNLSTMHKI

SEQ ID NO: 109299 - protein, 13 aa, Borrelia burgdorferi B31
SQACNLSTMHKID

SEQ ID NO: 109300 - protein, 13 aa, Borrelia burgdorferi B31
QACNLSTMHKIDT

SEQ ID NO: 109301 - protein, 13 aa, Borrelia burgdorferi B31
ACNLSTMHKIDTK

SEQ ID NO: 109302 - protein, 13 aa, Borrelia burgdorferi B31
CNLSTMHKIDTKE

SEQ ID NO: 109303 - protein, 13 aa, Borrelia burgdorferi B31
NLSTMHKIDTKED

SEQ ID NO: 109304 - protein, 13 aa, Borrelia burgdorferi B31
LSTMHKIDTKEDM

SEQ ID NO: 109305 - protein, 13 aa, Borrelia burgdorferi B31
STMHKIDTKEDMK

SEQ ID NO: 109306 - protein, 13 aa, Borrelia burgdorferi B31
TMHKIDTKEDMKI

SEQ ID NO: 109307 - protein, 13 aa, Borrelia burgdorferi B31
MHKIDTKEDMKIL

SEQ ID NO: 109308 - protein, 13 aa, Borrelia burgdorferi B31
HKIDTKEDMKILY

SEQ ID NO: 109309 - protein, 13 aa, Borrelia burgdorferi B31
KIDTKEDMKILYS

SEQ ID NO: 109310 - protein, 13 aa, Borrelia burgdorferi B31
IDTKEDMKILYSE

SEQ ID NO: 109311 - protein, 13 aa, Borrelia burgdorferi B31
DTKEDMKILYSEI

SEQ ID NO: 109312 - protein, 13 aa, Borrelia burgdorferi B31
TKEDMKILYSEIA

SEQ ID NO: 109313 - protein, 13 aa, Borrelia burgdorferi B31
KEDMKILYSEIAE

SEQ ID NO: 109314 - protein, 13 aa, Borrelia burgdorferi B31
EDMKILYSEIAEL

SEQ ID NO: 109315 - protein, 13 aa, Borrelia burgdorferi B31
DMKILYSEIAELR

SEQ ID NO: 109316 - protein, 13 aa, Borrelia burgdorferi B31
MKILYSEIAELRK

SEQ ID NO: 109317 - protein, 13 aa, Borrelia burgdorferi B31
KILYSEIAELRKK

SEQ ID NO: 109318 - protein, 13 aa, Borrelia burgdorferi B31
ILYSEIAELRKKL

SEQ ID NO: 109319 - protein, 13 aa, Borrelia burgdorferi B31
LYSEIAELRKKLN

SEQ ID NO: 109320 - protein, 13 aa, Borrelia burgdorferi B31
YSEIAELRKKLNL

SEQ ID NO: 109321 - protein, 13 aa, Borrelia burgdorferi B31
SEIAELRKKLNLN

SEQ ID NO: 109322 - protein, 13 aa, Borrelia burgdorferi B31
EIAELRKKLNLNH

SEQ ID NO: 109323 - protein, 13 aa, Borrelia burgdorferi B31
IAELRKKLNLNHL

SEQ ID NO: 109324 - protein, 13 aa, Borrelia burgdorferi B31
AELRKKLNLNHLE

SEQ ID NO: 109325 - protein, 13 aa, Borrelia burgdorferi B31
ELRKKLNLNHLEI

SEQ ID NO: 109326 - protein, 13 aa, Borrelia burgdorferi B31
LRKKLNLNHLEID

SEQ ID NO: 109327 - protein, 13 aa, Borrelia burgdorferi B31
RKKLNLNHLEIDD

SEQ ID NO: 109328 - protein, 13 aa, Borrelia burgdorferi B31
KKLNLNHLEIDDT

SEQ ID NO: 109329 - protein, 13 aa, Borrelia burgdorferi B31
KLNLNHLEIDDTL

SEQ ID NO: 109330 - protein, 13 aa, Borrelia burgdorferi B31
LNLNHLEIDDTLE

SEQ ID NO: 109331 - protein, 13 aa, Borrelia burgdorferi B31
NLNHLEIDDTLEK

SEQ ID NO: 109332 - protein, 13 aa, Borrelia burgdorferi B31
LNHLEIDDTLEKV

SEQ ID NO: 109333 - protein, 13 aa, Borrelia burgdorferi B31
NHLEIDDTLEKVA

SEQ ID NO: 109334 - protein, 13 aa, Borrelia burgdorferi B31
HLEIDDTLEKVAK

SEQ ID NO: 109335 - protein, 13 aa, Borrelia burgdorferi B31
LEIDDTLEKVAKE

SEQ ID NO: 109336 - protein, 13 aa, Borrelia burgdorferi B31
EIDDTLEKVAKEY

SEQ ID NO: 109337 - protein, 13 aa, Borrelia burgdorferi B31
IDDTLEKVAKEYA

SEQ ID NO: 109338 - protein, 13 aa, Borrelia burgdorferi B31
DDTLEKVAKEYAI

SEQ ID NO: 109339 - protein, 13 aa, Borrelia burgdorferi B31
DTLEKVAKEYAIK

SEQ ID NO: 109340 - protein, 13 aa, Borrelia burgdorferi B31
TLEKVAKEYAIKL

SEQ ID NO: 109341 - protein, 13 aa, Borrelia burgdorferi B31
LEKVAKEYAIKLG

SEQ ID NO: 109342 - protein, 13 aa, Borrelia burgdorferi B31
EKVAKEYAIKLGE

SEQ ID NO: 109343 - protein, 13 aa, Borrelia burgdorferi B31
KVAKEYAIKLGEN

SEQ ID NO: 109344 - protein, 13 aa, Borrelia burgdorferi B31
VAKEYAIKLGENR

SEQ ID NO: 109345 - protein, 13 aa, Borrelia burgdorferi B31
AKEYAIKLGENRT

SEQ ID NO: 109346 - protein, 13 aa, Borrelia burgdorferi B31
KEYAIKLGENRTI

SEQ ID NO: 109347 - protein, 13 aa, Borrelia burgdorferi B31
EYAIKLGENRTIT

SEQ ID NO: 109348 - protein, 13 aa, Borrelia burgdorferi B31
YAIKLGENRTITH

SEQ ID NO: 109349 - protein, 13 aa, Borrelia burgdorferi B31
AIKLGENRTITHT

SEQ ID NO: 109350 - protein, 13 aa, Borrelia burgdorferi B31
IKLGENRTITHTL

SEQ ID NO: 109351 - protein, 13 aa, Borrelia burgdorferi B31
KLGENRTITHTLF

SEQ ID NO: 109352 - protein, 13 aa, Borrelia burgdorferi B31
LGENRTITHTLFG

SEQ ID NO: 109353 - protein, 13 aa, Borrelia burgdorferi B31
GENRTITHTLFGT

SEQ ID NO: 109354 - protein, 13 aa, Borrelia burgdorferi B31
ENRTITHTLFGTT

SEQ ID NO: 109355 - protein, 13 aa, Borrelia burgdorferi B31
NRTITHTLFGTTP

SEQ ID NO: 109356 - protein, 13 aa, Borrelia burgdorferi B31
RTITHTLFGTTPM

SEQ ID NO: 109357 - protein, 13 aa, Borrelia burgdorferi B31
TITHTLFGTTPMQ

SEQ ID NO: 109358 - protein, 13 aa, Borrelia burgdorferi B31
ITHTLFGTTPMQR

SEQ ID NO: 109359 - protein, 13 aa, Borrelia burgdorferi B31
THTLFGTTPMQRI

SEQ ID NO: 109360 - protein, 13 aa, Borrelia burgdorferi B31
HTLFGTTPMQRIH

SEQ ID NO: 109361 - protein, 13 aa, Borrelia burgdorferi B31
TLFGTTPMQRIHK

SEQ ID NO: 109362 - protein, 13 aa, Borrelia burgdorferi B31
LFGTTPMQRIHKY

SEQ ID NO: 109363 - protein, 13 aa, Borrelia burgdorferi B31
FGTTPMQRIHKYD

SEQ ID NO: 109364 - protein, 13 aa, Borrelia burgdorferi B31
GTTPMQRIHKYDQ

SEQ ID NO: 109365 - protein, 13 aa, Borrelia burgdorferi B31
TTPMQRIHKYDQS

SEQ ID NO: 109366 - protein, 13 aa, Borrelia burgdorferi B31
TPMQRIHKYDQSF

SEQ ID NO: 109367 - protein, 13 aa, Borrelia burgdorferi B31
PMQRIHKYDQSFN

SEQ ID NO: 109368 - protein, 13 aa, Borrelia burgdorferi B31
MQRIHKYDQSFNL

SEQ ID NO: 109369 - protein, 13 aa, Borrelia burgdorferi B31
QRIHKYDQSFNLT

SEQ ID NO: 109370 - protein, 13 aa, Borrelia burgdorferi B31
RIHKYDQSFNLTR

SEQ ID NO: 109371 - protein, 13 aa, Borrelia burgdorferi B31
IHKYDQSFNLTRE

SEQ ID NO: 109372 - protein, 13 aa, Borrelia burgdorferi B31
HKYDQSFNLTREI

SEQ ID NO: 109373 - protein, 13 aa, Borrelia burgdorferi B31
KYDQSFNLTREIL

SEQ ID NO: 109374 - protein, 13 aa, Borrelia burgdorferi B31
YDQSFNLTREILA

SEQ ID NO: 109375 - protein, 13 aa, Borrelia burgdorferi B31
DQSFNLTREILAS

SEQ ID NO: 109376 - protein, 13 aa, Borrelia burgdorferi B31
QSFNLTREILASG

SEQ ID NO: 109377 - protein, 13 aa, Borrelia burgdorferi B31
SFNLTREILASGI

SEQ ID NO: 109378 - protein, 13 aa, Borrelia burgdorferi B31
FNLTREILASGIE

SEQ ID NO: 109379 - protein, 13 aa, Borrelia burgdorferi B31
NLTREILASGIEL

SEQ ID NO: 109380 - protein, 13 aa, Borrelia burgdorferi B31
LTREILASGIELN

SEQ ID NO: 109381 - protein, 13 aa, Borrelia burgdorferi B31
TREILASGIELNR

SEQ ID NO: 109382 - protein, 13 aa, Borrelia burgdorferi B31
REILASGIELNRV

SEQ ID NO: 109383 - protein, 13 aa, Borrelia burgdorferi B31
EILASGIELNRVV

SEQ ID NO: 109384 - protein, 13 aa, Borrelia burgdorferi B31
ILASGIELNRVVN

SEQ ID NO: 109385 - protein, 13 aa, Borrelia burgdorferi B31
LASGIELNRVVNA

SEQ ID NO: 109386 - protein, 13 aa, Borrelia burgdorferi B31
ASGIELNRVVNAW

SEQ ID NO: 109387 - protein, 13 aa, Borrelia burgdorferi B31
SGIELNRVVNAWL

SEQ ID NO: 109388 - protein, 13 aa, Borrelia burgdorferi B31
GIELNRVVNAWLN

SEQ ID NO: 109389 - protein, 13 aa, Borrelia burgdorferi B31
IELNRVVNAWLNS

SEQ ID NO: 109390 - protein, 13 aa, Borrelia burgdorferi B31
ELNRVVNAWLNSP

SEQ ID NO: 109391 - protein, 13 aa, Borrelia burgdorferi B31
LNRVVNAWLNSPS

SEQ ID NO: 109392 - protein, 13 aa, Borrelia burgdorferi B31
NRVVNAWLNSPSH

SEQ ID NO: 109393 - protein, 13 aa, Borrelia burgdorferi B31
RVVNAWLNSPSHK

SEQ ID NO: 109394 - protein, 13 aa, Borrelia burgdorferi B31
VVNAWLNSPSHKE

SEQ ID NO: 109395 - protein, 13 aa, Borrelia burgdorferi B31
VNAWLNSPSHKEA

SEQ ID NO: 109396 - protein, 13 aa, Borrelia burgdorferi B31
NAWLNSPSHKEAL

SEQ ID NO: 109397 - protein, 13 aa, Borrelia burgdorferi B31
AWLNSPSHKEALI

SEQ ID NO: 109398 - protein, 13 aa, Borrelia burgdorferi B31
WLNSPSHKEALIN

SEQ ID NO: 109399 - protein, 13 aa, Borrelia burgdorferi B31
LNSPSHKEALINT

SEQ ID NO: 109400 - protein, 13 aa, Borrelia burgdorferi B31
NSPSHKEALINTD

SEQ ID NO: 109401 - protein, 13 aa, Borrelia burgdorferi B31
SPSHKEALINTDT

SEQ ID NO: 109402 - protein, 13 aa, Borrelia burgdorferi B31
PSHKEALINTDTD

SEQ ID NO: 109403 - protein, 13 aa, Borrelia burgdorferi B31
SHKEALINTDTDK

SEQ ID NO: 109404 - protein, 13 aa, Borrelia burgdorferi B31
HKEALINTDTDKI

SEQ ID NO: 109405 - protein, 13 aa, Borrelia burgdorferi B31
KEALINTDTDKIG

SEQ ID NO: 109406 - protein, 13 aa, Borrelia burgdorferi B31
EALINTDTDKIGG

SEQ ID NO: 109407 - protein, 13 aa, Borrelia burgdorferi B31
ALINTDTDKIGGY

SEQ ID NO: 109408 - protein, 13 aa, Borrelia burgdorferi B31
LINTDTDKIGGYR

SEQ ID NO: 109409 - protein, 13 aa, Borrelia burgdorferi B31
INTDTDKIGGYRL

SEQ ID NO: 109410 - protein, 13 aa, Borrelia burgdorferi B31
NTDTDKIGGYRLK

SEQ ID NO: 109411 - protein, 13 aa, Borrelia burgdorferi B31
TDTDKIGGYRLKT

SEQ ID NO: 109412 - protein, 13 aa, Borrelia burgdorferi B31
DTDKIGGYRLKTT

SEQ ID NO: 109413 - protein, 13 aa, Borrelia burgdorferi B31
TDKIGGYRLKTTD

SEQ ID NO: 109414 - protein, 13 aa, Borrelia burgdorferi B31
DKIGGYRLKTTDN

SEQ ID NO: 109415 - protein, 13 aa, Borrelia burgdorferi B31
KIGGYRLKTTDNI

SEQ ID NO: 109416 - protein, 13 aa, Borrelia burgdorferi B31
IGGYRLKTTDNID

SEQ ID NO: 109417 - protein, 13 aa, Borrelia burgdorferi B31
GGYRLKTTDNIDI

SEQ ID NO: 109418 - protein, 13 aa, Borrelia burgdorferi B31
GYRLKTTDNIDIF

SEQ ID NO: 109419 - protein, 13 aa, Borrelia burgdorferi B31
YRLKTTDNIDIFV

SEQ ID NO: 109420 - protein, 13 aa, Borrelia burgdorferi B31
RLKTTDNIDIFVV

SEQ ID NO: 109421 - protein, 13 aa, Borrelia burgdorferi B31
LKTTDNIDIFVVL

SEQ ID NO: 109422 - protein, 13 aa, Borrelia burgdorferi B31
KTTDNIDIFVVLF

SEQ ID NO: 109423 - protein, 13 aa, Borrelia burgdorferi B31
TTDNIDIFVVLFG

SEQ ID NO: 109424 - protein, 13 aa, Borrelia burgdorferi B31
TDNIDIFVVLFGK

SEQ ID NO: 109425 - protein, 13 aa, Borrelia burgdorferi B31
DNIDIFVVLFGKR

SEQ ID NO: 109426 - protein, 13 aa, Borrelia burgdorferi B31
NIDIFVVLFGKRK

SEQ ID NO: 109427 - protein, 13 aa, Borrelia burgdorferi B31
IDIFVVLFGKRKY

SEQ ID NO: 109428 - protein, 13 aa, Borrelia burgdorferi B31
DIFVVLFGKRKYK

SEQ ID NO: 109429 - protein, 13 aa, Borrelia burgdorferi B31
IFVVLFGKRKYKN

SEQ ID NO: 109430 - protein, 14 aa, Borrelia burgdorferi B31
MKKLIIIFTLFLSQ

SEQ ID NO: 109431 - protein, 14 aa, Borrelia burgdorferi B31
KKLIIIFTLFLSQA

SEQ ID NO: 109432 - protein, 14 aa, Borrelia burgdorferi B31
KLIIIFTLFLSQAC

SEQ ID NO: 109433 - protein, 14 aa, Borrelia burgdorferi B31
LIIIFTLFLSQACN

SEQ ID NO: 109434 - protein, 14 aa, Borrelia burgdorferi B31
IIIFTLFLSQACNL

SEQ ID NO: 109435 - protein, 14 aa, Borrelia burgdorferi B31
IIFTLFLSQACNLS

SEQ ID NO: 109436 - protein, 14 aa, Borrelia burgdorferi B31
IFTLFLSQACNLST

SEQ ID NO: 109437 - protein, 14 aa, Borrelia burgdorferi B31
FTLFLSQACNLSTM

SEQ ID NO: 109438 - protein, 14 aa, Borrelia burgdorferi B31
TLFLSQACNLSTMH

SEQ ID NO: 109439 - protein, 14 aa, Borrelia burgdorferi B31
LFLSQACNLSTMHK

SEQ ID NO: 109440 - protein, 14 aa, Borrelia burgdorferi B31
FLSQACNLSTMHKI

SEQ ID NO: 109441 - protein, 14 aa, Borrelia burgdorferi B31
LSQACNLSTMHKID

SEQ ID NO: 109442 - protein, 14 aa, Borrelia burgdorferi B31
SQACNLSTMHKIDT

SEQ ID NO: 109443 - protein, 14 aa, Borrelia burgdorferi B31
QACNLSTMHKIDTK

SEQ ID NO: 109444 - protein, 14 aa, Borrelia burgdorferi B31
ACNLSTMHKIDTKE

SEQ ID NO: 109445 - protein, 14 aa, Borrelia burgdorferi B31
CNLSTMHKIDTKED

SEQ ID NO: 109446 - protein, 14 aa, Borrelia burgdorferi B31
NLSTMHKIDTKEDM

SEQ ID NO: 109447 - protein, 14 aa, Borrelia burgdorferi B31
LSTMHKIDTKEDMK

SEQ ID NO: 109448 - protein, 14 aa, Borrelia burgdorferi B31
STMHKIDTKEDMKI

SEQ ID NO: 109449 - protein, 14 aa, Borrelia burgdorferi B31
TMHKIDTKEDMKIL

SEQ ID NO: 109450 - protein, 14 aa, Borrelia burgdorferi B31
MHKIDTKEDMKILY

SEQ ID NO: 109451 - protein, 14 aa, Borrelia burgdorferi B31
HKIDTKEDMKILYS

SEQ ID NO: 109452 - protein, 14 aa, Borrelia burgdorferi B31
KIDTKEDMKILYSE

SEQ ID NO: 109453 - protein, 14 aa, Borrelia burgdorferi B31
IDTKEDMKILYSEI

SEQ ID NO: 109454 - protein, 14 aa, Borrelia burgdorferi B31
DTKEDMKILYSEIA

SEQ ID NO: 109455 - protein, 14 aa, Borrelia burgdorferi B31
TKEDMKILYSEIAE

SEQ ID NO: 109456 - protein, 14 aa, Borrelia burgdorferi B31
KEDMKILYSEIAEL

SEQ ID NO: 109457 - protein, 14 aa, Borrelia burgdorferi B31
EDMKILYSEIAELR

SEQ ID NO: 109458 - protein, 14 aa, Borrelia burgdorferi B31
DMKILYSEIAELRK

SEQ ID NO: 109459 - protein, 14 aa, Borrelia burgdorferi B31
MKILYSEIAELRKK

SEQ ID NO: 109460 - protein, 14 aa, Borrelia burgdorferi B31
KILYSEIAELRKKL

SEQ ID NO: 109461 - protein, 14 aa, Borrelia burgdorferi B31
ILYSEIAELRKKLN

SEQ ID NO: 109462 - protein, 14 aa, Borrelia burgdorferi B31
LYSEIAELRKKLNL

SEQ ID NO: 109463 - protein, 14 aa, Borrelia burgdorferi B31
YSEIAELRKKLNLN

SEQ ID NO: 109464 - protein, 14 aa, Borrelia burgdorferi B31
SEIAELRKKLNLNH

SEQ ID NO: 109465 - protein, 14 aa, Borrelia burgdorferi B31
EIAELRKKLNLNHL

SEQ ID NO: 109466 - protein, 14 aa, Borrelia burgdorferi B31
IAELRKKLNLNHLE

SEQ ID NO: 109467 - protein, 14 aa, Borrelia burgdorferi B31
AELRKKLNLNHLEI

SEQ ID NO: 109468 - protein, 14 aa, Borrelia burgdorferi B31
ELRKKLNLNHLEID

SEQ ID NO: 109469 - protein, 14 aa, Borrelia burgdorferi B31
LRKKLNLNHLEIDD

SEQ ID NO: 109470 - protein, 14 aa, Borrelia burgdorferi B31
RKKLNLNHLEIDDT

SEQ ID NO: 109471 - protein, 14 aa, Borrelia burgdorferi B31
KKLNLNHLEIDDTL

SEQ ID NO: 109472 - protein, 14 aa, Borrelia burgdorferi B31
KLNLNHLEIDDTLE

SEQ ID NO: 109473 - protein, 14 aa, Borrelia burgdorferi B31
LNLNHLEIDDTLEK

SEQ ID NO: 109474 - protein, 14 aa, Borrelia burgdorferi B31
NLNHLEIDDTLEKV

SEQ ID NO: 109475 - protein, 14 aa, Borrelia burgdorferi B31
LNHLEIDDTLEKVA

SEQ ID NO: 109476 - protein, 14 aa, Borrelia burgdorferi B31
NHLEIDDTLEKVAK

SEQ ID NO: 109477 - protein, 14 aa, Borrelia burgdorferi B31
HLEIDDTLEKVAKE

SEQ ID NO: 109478 - protein, 14 aa, Borrelia burgdorferi B31
LEIDDTLEKVAKEY

SEQ ID NO: 109479 - protein, 14 aa, Borrelia burgdorferi B31
EIDDTLEKVAKEYA

SEQ ID NO: 109480 - protein, 14 aa, Borrelia burgdorferi B31
IDDTLEKVAKEYAI

SEQ ID NO: 109481 - protein, 14 aa, Borrelia burgdorferi B31
DDTLEKVAKEYAIK

SEQ ID NO: 109482 - protein, 14 aa, Borrelia burgdorferi B31
DTLEKVAKEYAIKL

SEQ ID NO: 109483 - protein, 14 aa, Borrelia burgdorferi B31
TLEKVAKEYAIKLG

SEQ ID NO: 109484 - protein, 14 aa, Borrelia burgdorferi B31
LEKVAKEYAIKLGE

SEQ ID NO: 109485 - protein, 14 aa, Borrelia burgdorferi B31
EKVAKEYAIKLGEN

SEQ ID NO: 109486 - protein, 14 aa, Borrelia burgdorferi B31
KVAKEYAIKLGENR

SEQ ID NO: 109487 - protein, 14 aa, Borrelia burgdorferi B31
VAKEYAIKLGENRT

SEQ ID NO: 109488 - protein, 14 aa, Borrelia burgdorferi B31
AKEYAIKLGENRTI

SEQ ID NO: 109489 - protein, 14 aa, Borrelia burgdorferi B31
KEYAIKLGENRTIT

SEQ ID NO: 109490 - protein, 14 aa, Borrelia burgdorferi B31
EYAIKLGENRTITH

SEQ ID NO: 109491 - protein, 14 aa, Borrelia burgdorferi B31
YAIKLGENRTITHT

SEQ ID NO: 109492 - protein, 14 aa, Borrelia burgdorferi B31
AIKLGENRTITHTL

SEQ ID NO: 109493 - protein, 14 aa, Borrelia burgdorferi B31
IKLGENRTITHTLF

SEQ ID NO: 109494 - protein, 14 aa, Borrelia burgdorferi B31
KLGENRTITHTLFG

SEQ ID NO: 109495 - protein, 14 aa, Borrelia burgdorferi B31
LGENRTITHTLFGT

SEQ ID NO: 109496 - protein, 14 aa, Borrelia burgdorferi B31
GENRTITHTLFGTT

SEQ ID NO: 109497 - protein, 14 aa, Borrelia burgdorferi B31
ENRTITHTLFGTTP

SEQ ID NO: 109498 - protein, 14 aa, Borrelia burgdorferi B31
NRTITHTLFGTTPM

SEQ ID NO: 109499 - protein, 14 aa, Borrelia burgdorferi B31
RTITHTLFGTTPMQ

SEQ ID NO: 109500 - protein, 14 aa, Borrelia burgdorferi B31
TITHTLFGTTPMQR

SEQ ID NO: 109501 - protein, 14 aa, Borrelia burgdorferi B31
ITHTLFGTTPMQRI

SEQ ID NO: 109502 - protein, 14 aa, Borrelia burgdorferi B31
THTLFGTTPMQRIH

SEQ ID NO: 109503 - protein, 14 aa, Borrelia burgdorferi B31
HTLFGTTPMQRIHK

SEQ ID NO: 109504 - protein, 14 aa, Borrelia burgdorferi B31
TLFGTTPMQRIHKY

SEQ ID NO: 109505 - protein, 14 aa, Borrelia burgdorferi B31
LFGTTPMQRIHKYD

SEQ ID NO: 109506 - protein, 14 aa, Borrelia burgdorferi B31
FGTTPMQRIHKYDQ

SEQ ID NO: 109507 - protein, 14 aa, Borrelia burgdorferi B31
GTTPMQRIHKYDQS

SEQ ID NO: 109508 - protein, 14 aa, Borrelia burgdorferi B31
TTPMQRIHKYDQSF

SEQ ID NO: 109509 - protein, 14 aa, Borrelia burgdorferi B31
TPMQRIHKYDQSFN

SEQ ID NO: 109510 - protein, 14 aa, Borrelia burgdorferi B31
PMQRIHKYDQSFNL

SEQ ID NO: 109511 - protein, 14 aa, Borrelia burgdorferi B31
MQRIHKYDQSFNLT

SEQ ID NO: 109512 - protein, 14 aa, Borrelia burgdorferi B31
QRIHKYDQSFNLTR

SEQ ID NO: 109513 - protein, 14 aa, Borrelia burgdorferi B31
RIHKYDQSFNLTRE

SEQ ID NO: 109514 - protein, 14 aa, Borrelia burgdorferi B31
IHKYDQSFNLTREI

SEQ ID NO: 109515 - protein, 14 aa, Borrelia burgdorferi B31
HKYDQSFNLTREIL

SEQ ID NO: 109516 - protein, 14 aa, Borrelia burgdorferi B31
KYDQSFNLTREILA

SEQ ID NO: 109517 - protein, 14 aa, Borrelia burgdorferi B31
YDQSFNLTREILAS

SEQ ID NO: 109518 - protein, 14 aa, Borrelia burgdorferi B31
DQSFNLTREILASG

SEQ ID NO: 109519 - protein, 14 aa, Borrelia burgdorferi B31
QSFNLTREILASGI

SEQ ID NO: 109520 - protein, 14 aa, Borrelia burgdorferi B31
SFNLTREILASGIE

SEQ ID NO: 109521 - protein, 14 aa, Borrelia burgdorferi B31
FNLTREILASGIEL

SEQ ID NO: 109522 - protein, 14 aa, Borrelia burgdorferi B31
NLTREILASGIELN

SEQ ID NO: 109523 - protein, 14 aa, Borrelia burgdorferi B31
LTREILASGIELNR

SEQ ID NO: 109524 - protein, 14 aa, Borrelia burgdorferi B31
TREILASGIELNRV

SEQ ID NO: 109525 - protein, 14 aa, Borrelia burgdorferi B31
REILASGIELNRVV

SEQ ID NO: 109526 - protein, 14 aa, Borrelia burgdorferi B31
EILASGIELNRVVN

SEQ ID NO: 109527 - protein, 14 aa, Borrelia burgdorferi B31
ILASGIELNRVVNA

SEQ ID NO: 109528 - protein, 14 aa, Borrelia burgdorferi B31
LASGIELNRVVNAW

SEQ ID NO: 109529 - protein, 14 aa, Borrelia burgdorferi B31
ASGIELNRVVNAWL

SEQ ID NO: 109530 - protein, 14 aa, Borrelia burgdorferi B31
SGIELNRVVNAWLN

SEQ ID NO: 109531 - protein, 14 aa, Borrelia burgdorferi B31
GIELNRVVNAWLNS

SEQ ID NO: 109532 - protein, 14 aa, Borrelia burgdorferi B31
IELNRVVNAWLNSP

SEQ ID NO: 109533 - protein, 14 aa, Borrelia burgdorferi B31
ELNRVVNAWLNSPS

SEQ ID NO: 109534 - protein, 14 aa, Borrelia burgdorferi B31
LNRVVNAWLNSPSH

SEQ ID NO: 109535 - protein, 14 aa, Borrelia burgdorferi B31
NRVVNAWLNSPSHK

SEQ ID NO: 109536 - protein, 14 aa, Borrelia burgdorferi B31
RVVNAWLNSPSHKE

SEQ ID NO: 109537 - protein, 14 aa, Borrelia burgdorferi B31
VVNAWLNSPSHKEA

SEQ ID NO: 109538 - protein, 14 aa, Borrelia burgdorferi B31
VNAWLNSPSHKEAL

SEQ ID NO: 109539 - protein, 14 aa, Borrelia burgdorferi B31
NAWLNSPSHKEALI

SEQ ID NO: 109540 - protein, 14 aa, Borrelia burgdorferi B31
AWLNSPSHKEALIN

SEQ ID NO: 109541 - protein, 14 aa, Borrelia burgdorferi B31
WLNSPSHKEALINT

SEQ ID NO: 109542 - protein, 14 aa, Borrelia burgdorferi B31
LNSPSHKEALINTD

SEQ ID NO: 109543 - protein, 14 aa, Borrelia burgdorferi B31
NSPSHKEALINTDT

SEQ ID NO: 109544 - protein, 14 aa, Borrelia burgdorferi B31
SPSHKEALINTDTD

SEQ ID NO: 109545 - protein, 14 aa, Borrelia burgdorferi B31
PSHKEALINTDTDK

SEQ ID NO: 109546 - protein, 14 aa, Borrelia burgdorferi B31
SHKEALINTDTDKI

SEQ ID NO: 109547 - protein, 14 aa, Borrelia burgdorferi B31
HKEALINTDTDKIG

SEQ ID NO: 109548 - protein, 14 aa, Borrelia burgdorferi B31
KEALINTDTDKIGG

SEQ ID NO: 109549 - protein, 14 aa, Borrelia burgdorferi B31
EALINTDTDKIGGY

SEQ ID NO: 109550 - protein, 14 aa, Borrelia burgdorferi B31
ALINTDTDKIGGYR

SEQ ID NO: 109551 - protein, 14 aa, Borrelia burgdorferi B31
LINTDTDKIGGYRL

SEQ ID NO: 109552 - protein, 14 aa, Borrelia burgdorferi B31
INTDTDKIGGYRLK

SEQ ID NO: 109553 - protein, 14 aa, Borrelia burgdorferi B31
NTDTDKIGGYRLKT

SEQ ID NO: 109554 - protein, 14 aa, Borrelia burgdorferi B31
TDTDKIGGYRLKTT

SEQ ID NO: 109555 - protein, 14 aa, Borrelia burgdorferi B31
DTDKIGGYRLKTTD

SEQ ID NO: 109556 - protein, 14 aa, Borrelia burgdorferi B31
TDKIGGYRLKTTDN

SEQ ID NO: 109557 - protein, 14 aa, Borrelia burgdorferi B31
DKIGGYRLKTTDNI

SEQ ID NO: 109558 - protein, 14 aa, Borrelia burgdorferi B31
KIGGYRLKTTDNID

SEQ ID NO: 109559 - protein, 14 aa, Borrelia burgdorferi B31
IGGYRLKTTDNIDI

SEQ ID NO: 109560 - protein, 14 aa, Borrelia burgdorferi B31
GGYRLKTTDNIDIF

SEQ ID NO: 109561 - protein, 14 aa, Borrelia burgdorferi B31
GYRLKTTDNIDIFV

SEQ ID NO: 109562 - protein, 14 aa, Borrelia burgdorferi B31
YRLKTTDNIDIFVV

SEQ ID NO: 109563 - protein, 14 aa, Borrelia burgdorferi B31
RLKTTDNIDIFVVL

SEQ ID NO: 109564 - protein, 14 aa, Borrelia burgdorferi B31
LKTTDNIDIFVVLF

SEQ ID NO: 109565 - protein, 14 aa, Borrelia burgdorferi B31
KTTDNIDIFVVLFG

SEQ ID NO: 109566 - protein, 14 aa, Borrelia burgdorferi B31
TTDNIDIFVVLFGK

SEQ ID NO: 109567 - protein, 14 aa, Borrelia burgdorferi B31
TDNIDIFVVLFGKR

SEQ ID NO: 109568 - protein, 14 aa, Borrelia burgdorferi B31
DNIDIFVVLFGKRK

SEQ ID NO: 109569 - protein, 14 aa, Borrelia burgdorferi B31
NIDIFVVLFGKRKY

SEQ ID NO: 109570 - protein, 14 aa, Borrelia burgdorferi B31
IDIFVVLFGKRKYK

SEQ ID NO: 109571 - protein, 14 aa, Borrelia burgdorferi B31
DIFVVLFGKRKYKN

SEQ ID NO: 109572 - protein, 15 aa, Borrelia burgdorferi B31
MKKLIIIFTLFLSQA

SEQ ID NO: 109573 - protein, 15 aa, Borrelia burgdorferi B31
KKLIIIFTLFLSQAC

SEQ ID NO: 109574 - protein, 15 aa, Borrelia burgdorferi B31
KLIIIFTLFLSQACN

SEQ ID NO: 109575 - protein, 15 aa, Borrelia burgdorferi B31
LIIIFTLFLSQACNL

SEQ ID NO: 109576 - protein, 15 aa, Borrelia burgdorferi B31
IIIFTLFLSQACNLS

SEQ ID NO: 109577 - protein, 15 aa, Borrelia burgdorferi B31
IIFTLFLSQACNLST

SEQ ID NO: 109578 - protein, 15 aa, Borrelia burgdorferi B31
IFTLFLSQACNLSTM

SEQ ID NO: 109579 - protein, 15 aa, Borrelia burgdorferi B31
FTLFLSQACNLSTMH

SEQ ID NO: 109580 - protein, 15 aa, Borrelia burgdorferi B31
TLFLSQACNLSTMHK

SEQ ID NO: 109581 - protein, 15 aa, Borrelia burgdorferi B31
LFLSQACNLSTMHKI

SEQ ID NO: 109582 - protein, 15 aa, Borrelia burgdorferi B31
FLSQACNLSTMHKID

SEQ ID NO: 109583 - protein, 15 aa, Borrelia burgdorferi B31
LSQACNLSTMHKIDT

SEQ ID NO: 109584 - protein, 15 aa, Borrelia burgdorferi B31
SQACNLSTMHKIDTK

SEQ ID NO: 109585 - protein, 15 aa, Borrelia burgdorferi B31
QACNLSTMHKIDTKE

SEQ ID NO: 109586 - protein, 15 aa, Borrelia burgdorferi B31
ACNLSTMHKIDTKED

SEQ ID NO: 109587 - protein, 15 aa, Borrelia burgdorferi B31
CNLSTMHKIDTKEDM

SEQ ID NO: 109588 - protein, 15 aa, Borrelia burgdorferi B31
NLSTMHKIDTKEDMK

SEQ ID NO: 109589 - protein, 15 aa, Borrelia burgdorferi B31
LSTMHKIDTKEDMKI

SEQ ID NO: 109590 - protein, 15 aa, Borrelia burgdorferi B31
STMHKIDTKEDMKIL

SEQ ID NO: 109591 - protein, 15 aa, Borrelia burgdorferi B31
TMHKIDTKEDMKILY

SEQ ID NO: 109592 - protein, 15 aa, Borrelia burgdorferi B31
MHKIDTKEDMKILYS

SEQ ID NO: 109593 - protein, 15 aa, Borrelia burgdorferi B31
HKIDTKEDMKILYSE

SEQ ID NO: 109594 - protein, 15 aa, Borrelia burgdorferi B31
KIDTKEDMKILYSEI

SEQ ID NO: 109595 - protein, 15 aa, Borrelia burgdorferi B31
IDTKEDMKILYSEIA

SEQ ID NO: 109596 - protein, 15 aa, Borrelia burgdorferi B31
DTKEDMKILYSEIAE

SEQ ID NO: 109597 - protein, 15 aa, Borrelia burgdorferi B31
TKEDMKILYSEIAEL

SEQ ID NO: 109598 - protein, 15 aa, Borrelia burgdorferi B31
KEDMKILYSEIAELR

SEQ ID NO: 109599 - protein, 15 aa, Borrelia burgdorferi B31
EDMKILYSEIAELRK

SEQ ID NO: 109600 - protein, 15 aa, Borrelia burgdorferi B31
DMKILYSEIAELRKK

SEQ ID NO: 109601 - protein, 15 aa, Borrelia burgdorferi B31
MKILYSEIAELRKKL

SEQ ID NO: 109602 - protein, 15 aa, Borrelia burgdorferi B31
KILYSEIAELRKKLN

SEQ ID NO: 109603 - protein, 15 aa, Borrelia burgdorferi B31
ILYSEIAELRKKLNL

SEQ ID NO: 109604 - protein, 15 aa, Borrelia burgdorferi B31
LYSEIAELRKKLNLN

SEQ ID NO: 109605 - protein, 15 aa, Borrelia burgdorferi B31
YSEIAELRKKLNLNH

SEQ ID NO: 109606 - protein, 15 aa, Borrelia burgdorferi B31
SEIAELRKKLNLNHL

SEQ ID NO: 109607 - protein, 15 aa, Borrelia burgdorferi B31
EIAELRKKLNLNHLE

SEQ ID NO: 109608 - protein, 15 aa, Borrelia burgdorferi B31
IAELRKKLNLNHLEI

SEQ ID NO: 109609 - protein, 15 aa, Borrelia burgdorferi B31
AELRKKLNLNHLEID

SEQ ID NO: 109610 - protein, 15 aa, Borrelia burgdorferi B31
ELRKKLNLNHLEIDD

SEQ ID NO: 109611 - protein, 15 aa, Borrelia burgdorferi B31
LRKKLNLNHLEIDDT

SEQ ID NO: 109612 - protein, 15 aa, Borrelia burgdorferi B31
RKKLNLNHLEIDDTL

SEQ ID NO: 109613 - protein, 15 aa, Borrelia burgdorferi B31
KKLNLNHLEIDDTLE

SEQ ID NO: 109614 - protein, 15 aa, Borrelia burgdorferi B31
KLNLNHLEIDDTLEK

SEQ ID NO: 109615 - protein, 15 aa, Borrelia burgdorferi B31
LNLNHLEIDDTLEKV

SEQ ID NO: 109616 - protein, 15 aa, Borrelia burgdorferi B31
NLNHLEIDDTLEKVA

SEQ ID NO: 109617 - protein, 15 aa, Borrelia burgdorferi B31
LNHLEIDDTLEKVAK

SEQ ID NO: 109618 - protein, 15 aa, Borrelia burgdorferi B31
NHLEIDDTLEKVAKE

SEQ ID NO: 109619 - protein, 15 aa, Borrelia burgdorferi B31
HLEIDDTLEKVAKEY

SEQ ID NO: 109620 - protein, 15 aa, Borrelia burgdorferi B31
LEIDDTLEKVAKEYA

SEQ ID NO: 109621 - protein, 15 aa, Borrelia burgdorferi B31
EIDDTLEKVAKEYAI

SEQ ID NO: 109622 - protein, 15 aa, Borrelia burgdorferi B31
IDDTLEKVAKEYAIK

SEQ ID NO: 109623 - protein, 15 aa, Borrelia burgdorferi B31
DDTLEKVAKEYAIKL

SEQ ID NO: 109624 - protein, 15 aa, Borrelia burgdorferi B31
DTLEKVAKEYAIKLG

SEQ ID NO: 109625 - protein, 15 aa, Borrelia burgdorferi B31
TLEKVAKEYAIKLGE

SEQ ID NO: 109626 - protein, 15 aa, Borrelia burgdorferi B31
LEKVAKEYAIKLGEN

SEQ ID NO: 109627 - protein, 15 aa, Borrelia burgdorferi B31
EKVAKEYAIKLGENR

SEQ ID NO: 109628 - protein, 15 aa, Borrelia burgdorferi B31
KVAKEYAIKLGENRT

SEQ ID NO: 109629 - protein, 15 aa, Borrelia burgdorferi B31
VAKEYAIKLGENRTI

SEQ ID NO: 109630 - protein, 15 aa, Borrelia burgdorferi B31
AKEYAIKLGENRTIT

SEQ ID NO: 109631 - protein, 15 aa, Borrelia burgdorferi B31
KEYAIKLGENRTITH

SEQ ID NO: 109632 - protein, 15 aa, Borrelia burgdorferi B31
EYAIKLGENRTITHT

SEQ ID NO: 109633 - protein, 15 aa, Borrelia burgdorferi B31
YAIKLGENRTITHTL

SEQ ID NO: 109634 - protein, 15 aa, Borrelia burgdorferi B31
AIKLGENRTITHTLF

SEQ ID NO: 109635 - protein, 15 aa, Borrelia burgdorferi B31
IKLGENRTITHTLFG

SEQ ID NO: 109636 - protein, 15 aa, Borrelia burgdorferi B31
KLGENRTITHTLFGT

SEQ ID NO: 109637 - protein, 15 aa, Borrelia burgdorferi B31
LGENRTITHTLFGTT

SEQ ID NO: 109638 - protein, 15 aa, Borrelia burgdorferi B31
GENRTITHTLFGTTP

SEQ ID NO: 109639 - protein, 15 aa, Borrelia burgdorferi B31
ENRTITHTLFGTTPM

SEQ ID NO: 109640 - protein, 15 aa, Borrelia burgdorferi B31
NRTITHTLFGTTPMQ

SEQ ID NO: 109641 - protein, 15 aa, Borrelia burgdorferi B31
RTITHTLFGTTPMQR

SEQ ID NO: 109642 - protein, 15 aa, Borrelia burgdorferi B31
TITHTLFGTTPMQRI

SEQ ID NO: 109643 - protein, 15 aa, Borrelia burgdorferi B31
ITHTLFGTTPMQRIH

SEQ ID NO: 109644 - protein, 15 aa, Borrelia burgdorferi B31
THTLFGTTPMQRIHK

SEQ ID NO: 109645 - protein, 15 aa, Borrelia burgdorferi B31
HTLFGTTPMQRIHKY

SEQ ID NO: 109646 - protein, 15 aa, Borrelia burgdorferi B31
TLFGTTPMQRIHKYD

SEQ ID NO: 109647 - protein, 15 aa, Borrelia burgdorferi B31
LFGTTPMQRIHKYDQ

SEQ ID NO: 109648 - protein, 15 aa, Borrelia burgdorferi B31
FGTTPMQRIHKYDQS

SEQ ID NO: 109649 - protein, 15 aa, Borrelia burgdorferi B31
GTTPMQRIHKYDQSF

SEQ ID NO: 109650 - protein, 15 aa, Borrelia burgdorferi B31
TTPMQRIHKYDQSFN

SEQ ID NO: 109651 - protein, 15 aa, Borrelia burgdorferi B31
TPMQRIHKYDQSFNL

SEQ ID NO: 109652 - protein, 15 aa, Borrelia burgdorferi B31
PMQRIHKYDQSFNLT

SEQ ID NO: 109653 - protein, 15 aa, Borrelia burgdorferi B31
MQRIHKYDQSFNLTR

SEQ ID NO: 109654 - protein, 15 aa, Borrelia burgdorferi B31
QRIHKYDQSFNLTRE

SEQ ID NO: 109655 - protein, 15 aa, Borrelia burgdorferi B31
RIHKYDQSFNLTREI

SEQ ID NO: 109656 - protein, 15 aa, Borrelia burgdorferi B31
IHKYDQSFNLTREIL

SEQ ID NO: 109657 - protein, 15 aa, Borrelia burgdorferi B31
HKYDQSFNLTREILA

SEQ ID NO: 109658 - protein, 15 aa, Borrelia burgdorferi B31
KYDQSFNLTREILAS

SEQ ID NO: 109659 - protein, 15 aa, Borrelia burgdorferi B31
YDQSFNLTREILASG

SEQ ID NO: 109660 - protein, 15 aa, Borrelia burgdorferi B31
DQSFNLTREILASGI

SEQ ID NO: 109661 - protein, 15 aa, Borrelia burgdorferi B31
QSFNLTREILASGIE

SEQ ID NO: 109662 - protein, 15 aa, Borrelia burgdorferi B31
SFNLTREILASGIEL

SEQ ID NO: 109663 - protein, 15 aa, Borrelia burgdorferi B31
FNLTREILASGIELN

SEQ ID NO: 109664 - protein, 15 aa, Borrelia burgdorferi B31
NLTREILASGIELNR

SEQ ID NO: 109665 - protein, 15 aa, Borrelia burgdorferi B31
LTREILASGIELNRV

SEQ ID NO: 109666 - protein, 15 aa, Borrelia burgdorferi B31
TREILASGIELNRVV

SEQ ID NO: 109667 - protein, 15 aa, Borrelia burgdorferi B31
REILASGIELNRVVN

SEQ ID NO: 109668 - protein, 15 aa, Borrelia burgdorferi B31
EILASGIELNRVVNA

SEQ ID NO: 109669 - protein, 15 aa, Borrelia burgdorferi B31
ILASGIELNRVVNAW

SEQ ID NO: 109670 - protein, 15 aa, Borrelia burgdorferi B31
LASGIELNRVVNAWL

SEQ ID NO: 109671 - protein, 15 aa, Borrelia burgdorferi B31
ASGIELNRVVNAWLN

SEQ ID NO: 109672 - protein, 15 aa, Borrelia burgdorferi B31
SGIELNRVVNAWLNS

SEQ ID NO: 109673 - protein, 15 aa, Borrelia burgdorferi B31
GIELNRVVNAWLNSP

SEQ ID NO: 109674 - protein, 15 aa, Borrelia burgdorferi B31
IELNRVVNAWLNSPS

SEQ ID NO: 109675 - protein, 15 aa, Borrelia burgdorferi B31
ELNRVVNAWLNSPSH

SEQ ID NO: 109676 - protein, 15 aa, Borrelia burgdorferi B31
LNRVVNAWLNSPSHK

SEQ ID NO: 109677 - protein, 15 aa, Borrelia burgdorferi B31
NRVVNAWLNSPSHKE

SEQ ID NO: 109678 - protein, 15 aa, Borrelia burgdorferi B31
RVVNAWLNSPSHKEA

SEQ ID NO: 109679 - protein, 15 aa, Borrelia burgdorferi B31
VVNAWLNSPSHKEAL

SEQ ID NO: 109680 - protein, 15 aa, Borrelia burgdorferi B31
VNAWLNSPSHKEALI

SEQ ID NO: 109681 - protein, 15 aa, Borrelia burgdorferi B31
NAWLNSPSHKEALIN

SEQ ID NO: 109682 - protein, 15 aa, Borrelia burgdorferi B31
AWLNSPSHKEALINT

SEQ ID NO: 109683 - protein, 15 aa, Borrelia burgdorferi B31
WLNSPSHKEALINTD

SEQ ID NO: 109684 - protein, 15 aa, Borrelia burgdorferi B31
LNSPSHKEALINTDT

SEQ ID NO: 109685 - protein, 15 aa, Borrelia burgdorferi B31
NSPSHKEALINTDTD

SEQ ID NO: 109686 - protein, 15 aa, Borrelia burgdorferi B31
SPSHKEALINTDTDK

SEQ ID NO: 109687 - protein, 15 aa, Borrelia burgdorferi B31
PSHKEALINTDTDKI

SEQ ID NO: 109688 - protein, 15 aa, Borrelia burgdorferi B31
SHKEALINTDTDKIG

SEQ ID NO: 109689 - protein, 15 aa, Borrelia burgdorferi B31
HKEALINTDTDKIGG

SEQ ID NO: 109690 - protein, 15 aa, Borrelia burgdorferi B31
KEALINTDTDKIGGY

SEQ ID NO: 109691 - protein, 15 aa, Borrelia burgdorferi B31
EALINTDTDKIGGYR

SEQ ID NO: 109692 - protein, 15 aa, Borrelia burgdorferi B31
ALINTDTDKIGGYRL

SEQ ID NO: 109693 - protein, 15 aa, Borrelia burgdorferi B31
LINTDTDKIGGYRLK

SEQ ID NO: 109694 - protein, 15 aa, Borrelia burgdorferi B31
INTDTDKIGGYRLKT

SEQ ID NO: 109695 - protein, 15 aa, Borrelia burgdorferi B31
NTDTDKIGGYRLKTT

SEQ ID NO: 109696 - protein, 15 aa, Borrelia burgdorferi B31
TDTDKIGGYRLKTTD

SEQ ID NO: 109697 - protein, 15 aa, Borrelia burgdorferi B31
DTDKIGGYRLKTTDN

SEQ ID NO: 109698 - protein, 15 aa, Borrelia burgdorferi B31
TDKIGGYRLKTTDNI

SEQ ID NO: 109699 - protein, 15 aa, Borrelia burgdorferi B31
DKIGGYRLKTTDNID

SEQ ID NO: 109700 - protein, 15 aa, Borrelia burgdorferi B31
KIGGYRLKTTDNIDI

SEQ ID NO: 109701 - protein, 15 aa, Borrelia burgdorferi B31
IGGYRLKTTDNIDIF

SEQ ID NO: 109702 - protein, 15 aa, Borrelia burgdorferi B31
GGYRLKTTDNIDIFV

SEQ ID NO: 109703 - protein, 15 aa, Borrelia burgdorferi B31
GYRLKTTDNIDIFVV

SEQ ID NO: 109704 - protein, 15 aa, Borrelia burgdorferi B31
YRLKTTDNIDIFVVL

SEQ ID NO: 109705 - protein, 15 aa, Borrelia burgdorferi B31
RLKTTDNIDIFVVLF

SEQ ID NO: 109706 - protein, 15 aa, Borrelia burgdorferi B31
LKTTDNIDIFVVLFG

SEQ ID NO: 109707 - protein, 15 aa, Borrelia burgdorferi B31
KTTDNIDIFVVLFGK

SEQ ID NO: 109708 - protein, 15 aa, Borrelia burgdorferi B31
TTDNIDIFVVLFGKR

SEQ ID NO: 109709 - protein, 15 aa, Borrelia burgdorferi B31
TDNIDIFVVLFGKRK

SEQ ID NO: 109710 - protein, 15 aa, Borrelia burgdorferi B31
DNIDIFVVLFGKRKY

SEQ ID NO: 109711 - protein, 15 aa, Borrelia burgdorferi B31
NIDIFVVLFGKRKYK

SEQ ID NO: 109712 - protein, 15 aa, Borrelia burgdorferi B31
IDIFVVLFGKRKYKN

SEQ ID NO: 109713 - protein, 16 aa, Borrelia burgdorferi B31
MKKLIIIFTLFLSQAC

SEQ ID NO: 109714 - protein, 16 aa, Borrelia burgdorferi B31
KKLIIIFTLFLSQACN

SEQ ID NO: 109715 - protein, 16 aa, Borrelia burgdorferi B31
KLIIIFTLFLSQACNL

SEQ ID NO: 109716 - protein, 16 aa, Borrelia burgdorferi B31
LIIIFTLFLSQACNLS

SEQ ID NO: 109717 - protein, 16 aa, Borrelia burgdorferi B31
IIIFTLFLSQACNLST

SEQ ID NO: 109718 - protein, 16 aa, Borrelia burgdorferi B31
IIFTLFLSQACNLSTM

SEQ ID NO: 109719 - protein, 16 aa, Borrelia burgdorferi B31
IFTLFLSQACNLSTMH

SEQ ID NO: 109720 - protein, 16 aa, Borrelia burgdorferi B31
FTLFLSQACNLSTMHK

SEQ ID NO: 109721 - protein, 16 aa, Borrelia burgdorferi B31
TLFLSQACNLSTMHKI

SEQ ID NO: 109722 - protein, 16 aa, Borrelia burgdorferi B31
LFLSQACNLSTMHKID

SEQ ID NO: 109723 - protein, 16 aa, Borrelia burgdorferi B31
FLSQACNLSTMHKIDT

SEQ ID NO: 109724 - protein, 16 aa, Borrelia burgdorferi B31
LSQACNLSTMHKIDTK

SEQ ID NO: 109725 - protein, 16 aa, Borrelia burgdorferi B31
SQACNLSTMHKIDTKE

SEQ ID NO: 109726 - protein, 16 aa, Borrelia burgdorferi B31
QACNLSTMHKIDTKED

SEQ ID NO: 109727 - protein, 16 aa, Borrelia burgdorferi B31
ACNLSTMHKIDTKEDM

SEQ ID NO: 109728 - protein, 16 aa, Borrelia burgdorferi B31
CNLSTMHKIDTKEDMK

SEQ ID NO: 109729 - protein, 16 aa, Borrelia burgdorferi B31
NLSTMHKIDTKEDMKI

SEQ ID NO: 109730 - protein, 16 aa, Borrelia burgdorferi B31
LSTMHKIDTKEDMKIL

SEQ ID NO: 109731 - protein, 16 aa, Borrelia burgdorferi B31
STMHKIDTKEDMKILY

SEQ ID NO: 109732 - protein, 16 aa, Borrelia burgdorferi B31
TMHKIDTKEDMKILYS

SEQ ID NO: 109733 - protein, 16 aa, Borrelia burgdorferi B31
MHKIDTKEDMKILYSE

SEQ ID NO: 109734 - protein, 16 aa, Borrelia burgdorferi B31
HKIDTKEDMKILYSEI

SEQ ID NO: 109735 - protein, 16 aa, Borrelia burgdorferi B31
KIDTKEDMKILYSEIA

SEQ ID NO: 109736 - protein, 16 aa, Borrelia burgdorferi B31
IDTKEDMKILYSEIAE

SEQ ID NO: 109737 - protein, 16 aa, Borrelia burgdorferi B31
DTKEDMKILYSEIAEL

SEQ ID NO: 109738 - protein, 16 aa, Borrelia burgdorferi B31
TKEDMKILYSEIAELR

SEQ ID NO: 109739 - protein, 16 aa, Borrelia burgdorferi B31
KEDMKILYSEIAELRK

SEQ ID NO: 109740 - protein, 16 aa, Borrelia burgdorferi B31
EDMKILYSEIAELRKK

SEQ ID NO: 109741 - protein, 16 aa, Borrelia burgdorferi B31
DMKILYSEIAELRKKL

SEQ ID NO: 109742 - protein, 16 aa, Borrelia burgdorferi B31
MKILYSEIAELRKKLN

SEQ ID NO: 109743 - protein, 16 aa, Borrelia burgdorferi B31
KILYSEIAELRKKLNL

SEQ ID NO: 109744 - protein, 16 aa, Borrelia burgdorferi B31
ILYSEIAELRKKLNLN

SEQ ID NO: 109745 - protein, 16 aa, Borrelia burgdorferi B31
LYSEIAELRKKLNLNH

SEQ ID NO: 109746 - protein, 16 aa, Borrelia burgdorferi B31
YSEIAELRKKLNLNHL

SEQ ID NO: 109747 - protein, 16 aa, Borrelia burgdorferi B31
SEIAELRKKLNLNHLE

SEQ ID NO: 109748 - protein, 16 aa, Borrelia burgdorferi B31
EIAELRKKLNLNHLEI

SEQ ID NO: 109749 - protein, 16 aa, Borrelia burgdorferi B31
IAELRKKLNLNHLEID

SEQ ID NO: 109750 - protein, 16 aa, Borrelia burgdorferi B31
AELRKKLNLNHLEIDD

SEQ ID NO: 109751 - protein, 16 aa, Borrelia burgdorferi B31
ELRKKLNLNHLEIDDT

SEQ ID NO: 109752 - protein, 16 aa, Borrelia burgdorferi B31
LRKKLNLNHLEIDDTL

SEQ ID NO: 109753 - protein, 16 aa, Borrelia burgdorferi B31
RKKLNLNHLEIDDTLE

SEQ ID NO: 109754 - protein, 16 aa, Borrelia burgdorferi B31
KKLNLNHLEIDDTLEK

SEQ ID NO: 109755 - protein, 16 aa, Borrelia burgdorferi B31
KLNLNHLEIDDTLEKV

SEQ ID NO: 109756 - protein, 16 aa, Borrelia burgdorferi B31
LNLNHLEIDDTLEKVA

SEQ ID NO: 109757 - protein, 16 aa, Borrelia burgdorferi B31
NLNHLEIDDTLEKVAK

SEQ ID NO: 109758 - protein, 16 aa, Borrelia burgdorferi B31
LNHLEIDDTLEKVAKE

SEQ ID NO: 109759 - protein, 16 aa, Borrelia burgdorferi B31
NHLEIDDTLEKVAKEY

SEQ ID NO: 109760 - protein, 16 aa, Borrelia burgdorferi B31
HLEIDDTLEKVAKEYA

SEQ ID NO: 109761 - protein, 16 aa, Borrelia burgdorferi B31
LEIDDTLEKVAKEYAI

SEQ ID NO: 109762 - protein, 16 aa, Borrelia burgdorferi B31
EIDDTLEKVAKEYAIK

SEQ ID NO: 109763 - protein, 16 aa, Borrelia burgdorferi B31
IDDTLEKVAKEYAIKL

SEQ ID NO: 109764 - protein, 16 aa, Borrelia burgdorferi B31
DDTLEKVAKEYAIKLG

SEQ ID NO: 109765 - protein, 16 aa, Borrelia burgdorferi B31
DTLEKVAKEYAIKLGE

SEQ ID NO: 109766 - protein, 16 aa, Borrelia burgdorferi B31
TLEKVAKEYAIKLGEN

SEQ ID NO: 109767 - protein, 16 aa, Borrelia burgdorferi B31
LEKVAKEYAIKLGENR

SEQ ID NO: 109768 - protein, 16 aa, Borrelia burgdorferi B31
EKVAKEYAIKLGENRT

SEQ ID NO: 109769 - protein, 16 aa, Borrelia burgdorferi B31
KVAKEYAIKLGENRTI

SEQ ID NO: 109770 - protein, 16 aa, Borrelia burgdorferi B31
VAKEYAIKLGENRTIT

SEQ ID NO: 109771 - protein, 16 aa, Borrelia burgdorferi B31
AKEYAIKLGENRTITH

SEQ ID NO: 109772 - protein, 16 aa, Borrelia burgdorferi B31
KEYAIKLGENRTITHT

SEQ ID NO: 109773 - protein, 16 aa, Borrelia burgdorferi B31
EYAIKLGENRTITHTL

SEQ ID NO: 109774 - protein, 16 aa, Borrelia burgdorferi B31
YAIKLGENRTITHTLF

SEQ ID NO: 109775 - protein, 16 aa, Borrelia burgdorferi B31
AIKLGENRTITHTLFG

SEQ ID NO: 109776 - protein, 16 aa, Borrelia burgdorferi B31
IKLGENRTITHTLFGT

SEQ ID NO: 109777 - protein, 16 aa, Borrelia burgdorferi B31
KLGENRTITHTLFGTT

SEQ ID NO: 109778 - protein, 16 aa, Borrelia burgdorferi B31
LGENRTITHTLFGTTP

SEQ ID NO: 109779 - protein, 16 aa, Borrelia burgdorferi B31
GENRTITHTLFGTTPM

SEQ ID NO: 109780 - protein, 16 aa, Borrelia burgdorferi B31
ENRTITHTLFGTTPMQ

SEQ ID NO: 109781 - protein, 16 aa, Borrelia burgdorferi B31
NRTITHTLFGTTPMQR

SEQ ID NO: 109782 - protein, 16 aa, Borrelia burgdorferi B31
RTITHTLFGTTPMQRI

SEQ ID NO: 109783 - protein, 16 aa, Borrelia burgdorferi B31
TITHTLFGTTPMQRIH

SEQ ID NO: 109784 - protein, 16 aa, Borrelia burgdorferi B31
ITHTLFGTTPMQRIHK

SEQ ID NO: 109785 - protein, 16 aa, Borrelia burgdorferi B31
THTLFGTTPMQRIHKY

SEQ ID NO: 109786 - protein, 16 aa, Borrelia burgdorferi B31
HTLFGTTPMQRIHKYD

SEQ ID NO: 109787 - protein, 16 aa, Borrelia burgdorferi B31
TLFGTTPMQRIHKYDQ

SEQ ID NO: 109788 - protein, 16 aa, Borrelia burgdorferi B31
LFGTTPMQRIHKYDQS

SEQ ID NO: 109789 - protein, 16 aa, Borrelia burgdorferi B31
FGTTPMQRIHKYDQSF

SEQ ID NO: 109790 - protein, 16 aa, Borrelia burgdorferi B31
GTTPMQRIHKYDQSFN

SEQ ID NO: 109791 - protein, 16 aa, Borrelia burgdorferi B31
TTPMQRIHKYDQSFNL

SEQ ID NO: 109792 - protein, 16 aa, Borrelia burgdorferi B31
TPMQRIHKYDQSFNLT

SEQ ID NO: 109793 - protein, 16 aa, Borrelia burgdorferi B31
PMQRIHKYDQSFNLTR

SEQ ID NO: 109794 - protein, 16 aa, Borrelia burgdorferi B31
MQRIHKYDQSFNLTRE

SEQ ID NO: 109795 - protein, 16 aa, Borrelia burgdorferi B31
QRIHKYDQSFNLTREI

SEQ ID NO: 109796 - protein, 16 aa, Borrelia burgdorferi B31
RIHKYDQSFNLTREIL

SEQ ID NO: 109797 - protein, 16 aa, Borrelia burgdorferi B31
IHKYDQSFNLTREILA

SEQ ID NO: 109798 - protein, 16 aa, Borrelia burgdorferi B31
HKYDQSFNLTREILAS

SEQ ID NO: 109799 - protein, 16 aa, Borrelia burgdorferi B31
KYDQSFNLTREILASG

SEQ ID NO: 109800 - protein, 16 aa, Borrelia burgdorferi B31
YDQSFNLTREILASGI

SEQ ID NO: 109801 - protein, 16 aa, Borrelia burgdorferi B31
DQSFNLTREILASGIE

SEQ ID NO: 109802 - protein, 16 aa, Borrelia burgdorferi B31
QSFNLTREILASGIEL

SEQ ID NO: 109803 - protein, 16 aa, Borrelia burgdorferi B31
SFNLTREILASGIELN

SEQ ID NO: 109804 - protein, 16 aa, Borrelia burgdorferi B31
FNLTREILASGIELNR

SEQ ID NO: 109805 - protein, 16 aa, Borrelia burgdorferi B31
NLTREILASGIELNRV

SEQ ID NO: 109806 - protein, 16 aa, Borrelia burgdorferi B31
LTREILASGIELNRVV

SEQ ID NO: 109807 - protein, 16 aa, Borrelia burgdorferi B31
TREILASGIELNRVVN

SEQ ID NO: 109808 - protein, 16 aa, Borrelia burgdorferi B31
REILASGIELNRVVNA

SEQ ID NO: 109809 - protein, 16 aa, Borrelia burgdorferi B31
EILASGIELNRVVNAW

SEQ ID NO: 109810 - protein, 16 aa, Borrelia burgdorferi B31
ILASGIELNRVVNAWL

SEQ ID NO: 109811 - protein, 16 aa, Borrelia burgdorferi B31
LASGIELNRVVNAWLN

SEQ ID NO: 109812 - protein, 16 aa, Borrelia burgdorferi B31
ASGIELNRVVNAWLNS

SEQ ID NO: 109813 - protein, 16 aa, Borrelia burgdorferi B31
SGIELNRVVNAWLNSP

SEQ ID NO: 109814 - protein, 16 aa, Borrelia burgdorferi B31
GIELNRVVNAWLNSPS

SEQ ID NO: 109815 - protein, 16 aa, Borrelia burgdorferi B31
IELNRVVNAWLNSPSH

SEQ ID NO: 109816 - protein, 16 aa, Borrelia burgdorferi B31
ELNRVVNAWLNSPSHK

SEQ ID NO: 109817 - protein, 16 aa, Borrelia burgdorferi B31
LNRVVNAWLNSPSHKE

SEQ ID NO: 109818 - protein, 16 aa, Borrelia burgdorferi B31
NRVVNAWLNSPSHKEA

SEQ ID NO: 109819 - protein, 16 aa, Borrelia burgdorferi B31
RVVNAWLNSPSHKEAL

SEQ ID NO: 109820 - protein, 16 aa, Borrelia burgdorferi B31
VVNAWLNSPSHKEALI

SEQ ID NO: 109821 - protein, 16 aa, Borrelia burgdorferi B31
VNAWLNSPSHKEALIN

SEQ ID NO: 109822 - protein, 16 aa, Borrelia burgdorferi B31
NAWLNSPSHKEALINT

SEQ ID NO: 109823 - protein, 16 aa, Borrelia burgdorferi B31
AWLNSPSHKEALINTD

SEQ ID NO: 109824 - protein, 16 aa, Borrelia burgdorferi B31
WLNSPSHKEALINTDT

SEQ ID NO: 109825 - protein, 16 aa, Borrelia burgdorferi B31
LNSPSHKEALINTDTD

SEQ ID NO: 109826 - protein, 16 aa, Borrelia burgdorferi B31
NSPSHKEALINTDTDK

SEQ ID NO: 109827 - protein, 16 aa, Borrelia burgdorferi B31
SPSHKEALINTDTDKI

SEQ ID NO: 109828 - protein, 16 aa, Borrelia burgdorferi B31
PSHKEALINTDTDKIG

SEQ ID NO: 109829 - protein, 16 aa, Borrelia burgdorferi B31
SHKEALINTDTDKIGG

SEQ ID NO: 109830 - protein, 16 aa, Borrelia burgdorferi B31
HKEALINTDTDKIGGY

SEQ ID NO: 109831 - protein, 16 aa, Borrelia burgdorferi B31
KEALINTDTDKIGGYR

SEQ ID NO: 109832 - protein, 16 aa, Borrelia burgdorferi B31
EALINTDTDKIGGYRL

SEQ ID NO: 109833 - protein, 16 aa, Borrelia burgdorferi B31
ALINTDTDKIGGYRLK

SEQ ID NO: 109834 - protein, 16 aa, Borrelia burgdorferi B31
LINTDTDKIGGYRLKT

SEQ ID NO: 109835 - protein, 16 aa, Borrelia burgdorferi B31
INTDTDKIGGYRLKTT

SEQ ID NO: 109836 - protein, 16 aa, Borrelia burgdorferi B31
NTDTDKIGGYRLKTTD

SEQ ID NO: 109837 - protein, 16 aa, Borrelia burgdorferi B31
TDTDKIGGYRLKTTDN

SEQ ID NO: 109838 - protein, 16 aa, Borrelia burgdorferi B31
DTDKIGGYRLKTTDNI

SEQ ID NO: 109839 - protein, 16 aa, Borrelia burgdorferi B31
TDKIGGYRLKTTDNID

SEQ ID NO: 109840 - protein, 16 aa, Borrelia burgdorferi B31
DKIGGYRLKTTDNIDI

SEQ ID NO: 109841 - protein, 16 aa, Borrelia burgdorferi B31
KIGGYRLKTTDNIDIF

SEQ ID NO: 109842 - protein, 16 aa, Borrelia burgdorferi B31
IGGYRLKTTDNIDIFV

SEQ ID NO: 109843 - protein, 16 aa, Borrelia burgdorferi B31
GGYRLKTTDNIDIFVV

SEQ ID NO: 109844 - protein, 16 aa, Borrelia burgdorferi B31
GYRLKTTDNIDIFVVL

SEQ ID NO: 109845 - protein, 16 aa, Borrelia burgdorferi B31
YRLKTTDNIDIFVVLF

SEQ ID NO: 109846 - protein, 16 aa, Borrelia burgdorferi B31
RLKTTDNIDIFVVLFG

SEQ ID NO: 109847 - protein, 16 aa, Borrelia burgdorferi B31
LKTTDNIDIFVVLFGK

SEQ ID NO: 109848 - protein, 16 aa, Borrelia burgdorferi B31
KTTDNIDIFVVLFGKR

SEQ ID NO: 109849 - protein, 16 aa, Borrelia burgdorferi B31
TTDNIDIFVVLFGKRK

SEQ ID NO: 109850 - protein, 16 aa, Borrelia burgdorferi B31
TDNIDIFVVLFGKRKY

SEQ ID NO: 109851 - protein, 16 aa, Borrelia burgdorferi B31
DNIDIFVVLFGKRKYK

SEQ ID NO: 109852 - protein, 16 aa, Borrelia burgdorferi B31
NIDIFVVLFGKRKYKN

SEQ ID NO: 109853 - protein, 13 aa, Borrelia burgdorferi B31
MMQRISILLMLLA

SEQ ID NO: 109854 - protein, 13 aa, Borrelia burgdorferi B31
MQRISILLMLLAV

SEQ ID NO: 109855 - protein, 13 aa, Borrelia burgdorferi B31
QRISILLMLLAVF

SEQ ID NO: 109856 - protein, 13 aa, Borrelia burgdorferi B31
RISILLMLLAVFS

SEQ ID NO: 109857 - protein, 13 aa, Borrelia burgdorferi B31
ISILLMLLAVFSC

SEQ ID NO: 109858 - protein, 13 aa, Borrelia burgdorferi B31
SILLMLLAVFSCK

SEQ ID NO: 109859 - protein, 13 aa, Borrelia burgdorferi B31
ILLMLLAVFSCKQ

SEQ ID NO: 109860 - protein, 13 aa, Borrelia burgdorferi B31
LLMLLAVFSCKQF

SEQ ID NO: 109861 - protein, 13 aa, Borrelia burgdorferi B31
LMLLAVFSCKQFG

SEQ ID NO: 109862 - protein, 13 aa, Borrelia burgdorferi B31
MLLAVFSCKQFGD

SEQ ID NO: 109863 - protein, 13 aa, Borrelia burgdorferi B31
LLAVFSCKQFGDV

SEQ ID NO: 109864 - protein, 13 aa, Borrelia burgdorferi B31
LAVFSCKQFGDVK

SEQ ID NO: 109865 - protein, 13 aa, Borrelia burgdorferi B31
AVFSCKQFGDVKS

SEQ ID NO: 109866 - protein, 13 aa, Borrelia burgdorferi B31
VFSCKQFGDVKSL

SEQ ID NO: 109867 - protein, 13 aa, Borrelia burgdorferi B31
FSCKQFGDVKSLT

SEQ ID NO: 109868 - protein, 13 aa, Borrelia burgdorferi B31
SCKQFGDVKSLTE

SEQ ID NO: 109869 - protein, 13 aa, Borrelia burgdorferi B31
CKQFGDVKSLTEI

SEQ ID NO: 109870 - protein, 13 aa, Borrelia burgdorferi B31
KQFGDVKSLTEID

SEQ ID NO: 109871 - protein, 13 aa, Borrelia burgdorferi B31
QFGDVKSLTEIDS

SEQ ID NO: 109872 - protein, 13 aa, Borrelia burgdorferi B31
FGDVKSLTEIDSG

SEQ ID NO: 109873 - protein, 13 aa, Borrelia burgdorferi B31
GDVKSLTEIDSGN

SEQ ID NO: 109874 - protein, 13 aa, Borrelia burgdorferi B31
DVKSLTEIDSGNG

SEQ ID NO: 109875 - protein, 13 aa, Borrelia burgdorferi B31
VKSLTEIDSGNGI

SEQ ID NO: 109876 - protein, 13 aa, Borrelia burgdorferi B31
KSLTEIDSGNGIP

SEQ ID NO: 109877 - protein, 13 aa, Borrelia burgdorferi B31
SLTEIDSGNGIPL

SEQ ID NO: 109878 - protein, 13 aa, Borrelia burgdorferi B31
LTEIDSGNGIPLV

SEQ ID NO: 109879 - protein, 13 aa, Borrelia burgdorferi B31
TEIDSGNGIPLVV

SEQ ID NO: 109880 - protein, 13 aa, Borrelia burgdorferi B31
EIDSGNGIPLVVS

SEQ ID NO: 109881 - protein, 13 aa, Borrelia burgdorferi B31
IDSGNGIPLVVSD

SEQ ID NO: 109882 - protein, 13 aa, Borrelia burgdorferi B31
DSGNGIPLVVSDV

SEQ ID NO: 109883 - protein, 13 aa, Borrelia burgdorferi B31
SGNGIPLVVSDVV

SEQ ID NO: 109884 - protein, 13 aa, Borrelia burgdorferi B31
GNGIPLVVSDVVK

SEQ ID NO: 109885 - protein, 13 aa, Borrelia burgdorferi B31
NGIPLVVSDVVKD

SEQ ID NO: 109886 - protein, 13 aa, Borrelia burgdorferi B31
GIPLVVSDVVKDL

SEQ ID NO: 109887 - protein, 13 aa, Borrelia burgdorferi B31
IPLVVSDVVKDLI

SEQ ID NO: 109888 - protein, 13 aa, Borrelia burgdorferi B31
PLVVSDVVKDLIP

SEQ ID NO: 109889 - protein, 13 aa, Borrelia burgdorferi B31
LVVSDVVKDLIPK

SEQ ID NO: 109890 - protein, 13 aa, Borrelia burgdorferi B31
VVSDVVKDLIPKE

SEQ ID NO: 109891 - protein, 13 aa, Borrelia burgdorferi B31
VSDVVKDLIPKEI

SEQ ID NO: 109892 - protein, 13 aa, Borrelia burgdorferi B31
SDVVKDLIPKEIS

SEQ ID NO: 109893 - protein, 13 aa, Borrelia burgdorferi B31
DVVKDLIPKEISL

SEQ ID NO: 109894 - protein, 13 aa, Borrelia burgdorferi B31
VVKDLIPKEISLT

SEQ ID NO: 109895 - protein, 13 aa, Borrelia burgdorferi B31
VKDLIPKEISLTP

SEQ ID NO: 109896 - protein, 13 aa, Borrelia burgdorferi B31
KDLIPKEISLTPE

SEQ ID NO: 109897 - protein, 13 aa, Borrelia burgdorferi B31
DLIPKEISLTPEE

SEQ ID NO: 109898 - protein, 13 aa, Borrelia burgdorferi B31
LIPKEISLTPEEA

SEQ ID NO: 109899 - protein, 13 aa, Borrelia burgdorferi B31
IPKEISLTPEEAE

SEQ ID NO: 109900 - protein, 13 aa, Borrelia burgdorferi B31
PKEISLTPEEAEK

SEQ ID NO: 109901 - protein, 13 aa, Borrelia burgdorferi B31
KEISLTPEEAEKL

SEQ ID NO: 109902 - protein, 13 aa, Borrelia burgdorferi B31
EISLTPEEAEKLE

SEQ ID NO: 109903 - protein, 13 aa, Borrelia burgdorferi B31
ISLTPEEAEKLES

SEQ ID NO: 109904 - protein, 13 aa, Borrelia burgdorferi B31
SLTPEEAEKLESL

SEQ ID NO: 109905 - protein, 13 aa, Borrelia burgdorferi B31
LTPEEAEKLESLK

SEQ ID NO: 109906 - protein, 13 aa, Borrelia burgdorferi B31
TPEEAEKLESLKV

SEQ ID NO: 109907 - protein, 13 aa, Borrelia burgdorferi B31
PEEAEKLESLKVF

SEQ ID NO: 109908 - protein, 13 aa, Borrelia burgdorferi B31
EEAEKLESLKVFL

SEQ ID NO: 109909 - protein, 13 aa, Borrelia burgdorferi B31
EAEKLESLKVFLK

SEQ ID NO: 109910 - protein, 13 aa, Borrelia burgdorferi B31
AEKLESLKVFLKD

SEQ ID NO: 109911 - protein, 13 aa, Borrelia burgdorferi B31
EKLESLKVFLKDA

SEQ ID NO: 109912 - protein, 13 aa, Borrelia burgdorferi B31
KLESLKVFLKDAM

SEQ ID NO: 109913 - protein, 13 aa, Borrelia burgdorferi B31
LESLKVFLKDAMS

SEQ ID NO: 109914 - protein, 13 aa, Borrelia burgdorferi B31
ESLKVFLKDAMSV

SEQ ID NO: 109915 - protein, 13 aa, Borrelia burgdorferi B31
SLKVFLKDAMSVN

SEQ ID NO: 109916 - protein, 13 aa, Borrelia burgdorferi B31
LKVFLKDAMSVNG

SEQ ID NO: 109917 - protein, 13 aa, Borrelia burgdorferi B31
KVFLKDAMSVNGR

SEQ ID NO: 109918 - protein, 13 aa, Borrelia burgdorferi B31
VFLKDAMSVNGRE

SEQ ID NO: 109919 - protein, 13 aa, Borrelia burgdorferi B31
FLKDAMSVNGREE

SEQ ID NO: 109920 - protein, 13 aa, Borrelia burgdorferi B31
LKDAMSVNGREEA

SEQ ID NO: 109921 - protein, 13 aa, Borrelia burgdorferi B31
KDAMSVNGREEAL

SEQ ID NO: 109922 - protein, 13 aa, Borrelia burgdorferi B31
DAMSVNGREEALK

SEQ ID NO: 109923 - protein, 13 aa, Borrelia burgdorferi B31
AMSVNGREEALKA

SEQ ID NO: 109924 - protein, 13 aa, Borrelia burgdorferi B31
MSVNGREEALKAE

SEQ ID NO: 109925 - protein, 13 aa, Borrelia burgdorferi B31
SVNGREEALKAEY

SEQ ID NO: 109926 - protein, 13 aa, Borrelia burgdorferi B31
VNGREEALKAEYE

SEQ ID NO: 109927 - protein, 13 aa, Borrelia burgdorferi B31
NGREEALKAEYEK

SEQ ID NO: 109928 - protein, 13 aa, Borrelia burgdorferi B31
GREEALKAEYEKS

SEQ ID NO: 109929 - protein, 13 aa, Borrelia burgdorferi B31
REEALKAEYEKSY

SEQ ID NO: 109930 - protein, 13 aa, Borrelia burgdorferi B31
EEALKAEYEKSYK

SEQ ID NO: 109931 - protein, 13 aa, Borrelia burgdorferi B31
EALKAEYEKSYKE

SEQ ID NO: 109932 - protein, 13 aa, Borrelia burgdorferi B31
ALKAEYEKSYKEF

SEQ ID NO: 109933 - protein, 13 aa, Borrelia burgdorferi B31
LKAEYEKSYKEFF

SEQ ID NO: 109934 - protein, 13 aa, Borrelia burgdorferi B31
KAEYEKSYKEFFD

SEQ ID NO: 109935 - protein, 13 aa, Borrelia burgdorferi B31
AEYEKSYKEFFDW

SEQ ID NO: 109936 - protein, 13 aa, Borrelia burgdorferi B31
EYEKSYKEFFDWL

SEQ ID NO: 109937 - protein, 13 aa, Borrelia burgdorferi B31
YEKSYKEFFDWLS

SEQ ID NO: 109938 - protein, 13 aa, Borrelia burgdorferi B31
EKSYKEFFDWLSK

SEQ ID NO: 109939 - protein, 13 aa, Borrelia burgdorferi B31
KSYKEFFDWLSKD

SEQ ID NO: 109940 - protein, 13 aa, Borrelia burgdorferi B31
SYKEFFDWLSKDV

SEQ ID NO: 109941 - protein, 13 aa, Borrelia burgdorferi B31
YKEFFDWLSKDVN

SEQ ID NO: 109942 - protein, 13 aa, Borrelia burgdorferi B31
KEFFDWLSKDVNR

SEQ ID NO: 109943 - protein, 13 aa, Borrelia burgdorferi B31
EFFDWLSKDVNRQ

SEQ ID NO: 109944 - protein, 13 aa, Borrelia burgdorferi B31
FFDWLSKDVNRQK

SEQ ID NO: 109945 - protein, 13 aa, Borrelia burgdorferi B31
FDWLSKDVNRQKE

SEQ ID NO: 109946 - protein, 13 aa, Borrelia burgdorferi B31
DWLSKDVNRQKEF

SEQ ID NO: 109947 - protein, 13 aa, Borrelia burgdorferi B31
WLSKDVNRQKEFI

SEQ ID NO: 109948 - protein, 13 aa, Borrelia burgdorferi B31
LSKDVNRQKEFIS

SEQ ID NO: 109949 - protein, 13 aa, Borrelia burgdorferi B31
SKDVNRQKEFISS

SEQ ID NO: 109950 - protein, 13 aa, Borrelia burgdorferi B31
KDVNRQKEFISSF

SEQ ID NO: 109951 - protein, 13 aa, Borrelia burgdorferi B31
DVNRQKEFISSFD

SEQ ID NO: 109952 - protein, 13 aa, Borrelia burgdorferi B31
VNRQKEFISSFDN

SEQ ID NO: 109953 - protein, 13 aa, Borrelia burgdorferi B31
NRQKEFISSFDNI

SEQ ID NO: 109954 - protein, 13 aa, Borrelia burgdorferi B31
RQKEFISSFDNIS

SEQ ID NO: 109955 - protein, 13 aa, Borrelia burgdorferi B31
QKEFISSFDNISS

SEQ ID NO: 109956 - protein, 13 aa, Borrelia burgdorferi B31
KEFISSFDNISSI

SEQ ID NO: 109957 - protein, 13 aa, Borrelia burgdorferi B31
EFISSFDNISSIV

SEQ ID NO: 109958 - protein, 13 aa, Borrelia burgdorferi B31
FISSFDNISSIVS

SEQ ID NO: 109959 - protein, 13 aa, Borrelia burgdorferi B31
ISSFDNISSIVSK

SEQ ID NO: 109960 - protein, 13 aa, Borrelia burgdorferi B31
SSFDNISSIVSKA

SEQ ID NO: 109961 - protein, 13 aa, Borrelia burgdorferi B31
SFDNISSIVSKAV

SEQ ID NO: 109962 - protein, 13 aa, Borrelia burgdorferi B31
FDNISSIVSKAVD

SEQ ID NO: 109963 - protein, 13 aa, Borrelia burgdorferi B31
DNISSIVSKAVDA

SEQ ID NO: 109964 - protein, 13 aa, Borrelia burgdorferi B31
NISSIVSKAVDAS

SEQ ID NO: 109965 - protein, 13 aa, Borrelia burgdorferi B31
ISSIVSKAVDASK

SEQ ID NO: 109966 - protein, 13 aa, Borrelia burgdorferi B31
SSIVSKAVDASKK

SEQ ID NO: 109967 - protein, 13 aa, Borrelia burgdorferi B31
SIVSKAVDASKKR

SEQ ID NO: 109968 - protein, 13 aa, Borrelia burgdorferi B31
IVSKAVDASKKRR

SEQ ID NO: 109969 - protein, 13 aa, Borrelia burgdorferi B31
VSKAVDASKKRRP

SEQ ID NO: 109970 - protein, 13 aa, Borrelia burgdorferi B31
SKAVDASKKRRPT

SEQ ID NO: 109971 - protein, 13 aa, Borrelia burgdorferi B31
KAVDASKKRRPTE

SEQ ID NO: 109972 - protein, 13 aa, Borrelia burgdorferi B31
AVDASKKRRPTEQ

SEQ ID NO: 109973 - protein, 13 aa, Borrelia burgdorferi B31
VDASKKRRPTEQQ

SEQ ID NO: 109974 - protein, 13 aa, Borrelia burgdorferi B31
DASKKRRPTEQQS

SEQ ID NO: 109975 - protein, 13 aa, Borrelia burgdorferi B31
ASKKRRPTEQQSL

SEQ ID NO: 109976 - protein, 13 aa, Borrelia burgdorferi B31
SKKRRPTEQQSLG

SEQ ID NO: 109977 - protein, 13 aa, Borrelia burgdorferi B31
KKRRPTEQQSLGF

SEQ ID NO: 109978 - protein, 13 aa, Borrelia burgdorferi B31
KRRPTEQQSLGFK

SEQ ID NO: 109979 - protein, 13 aa, Borrelia burgdorferi B31
RRPTEQQSLGFKE

SEQ ID NO: 109980 - protein, 13 aa, Borrelia burgdorferi B31
RPTEQQSLGFKEY

SEQ ID NO: 109981 - protein, 13 aa, Borrelia burgdorferi B31
PTEQQSLGFKEYV

SEQ ID NO: 109982 - protein, 13 aa, Borrelia burgdorferi B31
TEQQSLGFKEYVC

SEQ ID NO: 109983 - protein, 13 aa, Borrelia burgdorferi B31
EQQSLGFKEYVCY

SEQ ID NO: 109984 - protein, 13 aa, Borrelia burgdorferi B31
QQSLGFKEYVCYK

SEQ ID NO: 109985 - protein, 13 aa, Borrelia burgdorferi B31
QSLGFKEYVCYKI

SEQ ID NO: 109986 - protein, 13 aa, Borrelia burgdorferi B31
SLGFKEYVCYKIK

SEQ ID NO: 109987 - protein, 13 aa, Borrelia burgdorferi B31
LGFKEYVCYKIKN

SEQ ID NO: 109988 - protein, 13 aa, Borrelia burgdorferi B31
GFKEYVCYKIKNS

SEQ ID NO: 109989 - protein, 13 aa, Borrelia burgdorferi B31
FKEYVCYKIKNSK

SEQ ID NO: 109990 - protein, 13 aa, Borrelia burgdorferi B31
KEYVCYKIKNSKG

SEQ ID NO: 109991 - protein, 13 aa, Borrelia burgdorferi B31
EYVCYKIKNSKGE

SEQ ID NO: 109992 - protein, 13 aa, Borrelia burgdorferi B31
YVCYKIKNSKGEA

SEQ ID NO: 109993 - protein, 13 aa, Borrelia burgdorferi B31
VCYKIKNSKGEAL

SEQ ID NO: 109994 - protein, 13 aa, Borrelia burgdorferi B31
CYKIKNSKGEALS

SEQ ID NO: 109995 - protein, 13 aa, Borrelia burgdorferi B31
YKIKNSKGEALSL

SEQ ID NO: 109996 - protein, 13 aa, Borrelia burgdorferi B31
KIKNSKGEALSLF

SEQ ID NO: 109997 - protein, 13 aa, Borrelia burgdorferi B31
IKNSKGEALSLFF

SEQ ID NO: 109998 - protein, 13 aa, Borrelia burgdorferi B31
KNSKGEALSLFFQ

SEQ ID NO: 109999 - protein, 13 aa, Borrelia burgdorferi B31
NSKGEALSLFFQK

SEQ ID NO: 110000 - protein, 13 aa, Borrelia burgdorferi B31
SKGEALSLFFQKV

SEQ ID NO: 110001 - protein, 13 aa, Borrelia burgdorferi B31
KGEALSLFFQKVV

SEQ ID NO: 110002 - protein, 13 aa, Borrelia burgdorferi B31
GEALSLFFQKVVD

SEQ ID NO: 110003 - protein, 13 aa, Borrelia burgdorferi B31
EALSLFFQKVVDA

SEQ ID NO: 110004 - protein, 13 aa, Borrelia burgdorferi B31
ALSLFFQKVVDAF

SEQ ID NO: 110005 - protein, 13 aa, Borrelia burgdorferi B31
LSLFFQKVVDAFG

SEQ ID NO: 110006 - protein, 13 aa, Borrelia burgdorferi B31
SLFFQKVVDAFGA

SEQ ID NO: 110007 - protein, 13 aa, Borrelia burgdorferi B31
LFFQKVVDAFGAD

SEQ ID NO: 110008 - protein, 13 aa, Borrelia burgdorferi B31
FFQKVVDAFGADP

SEQ ID NO: 110009 - protein, 13 aa, Borrelia burgdorferi B31
FQKVVDAFGADPY

SEQ ID NO: 110010 - protein, 13 aa, Borrelia burgdorferi B31
QKVVDAFGADPYK

SEQ ID NO: 110011 - protein, 13 aa, Borrelia burgdorferi B31
KVVDAFGADPYKK

SEQ ID NO: 110012 - protein, 13 aa, Borrelia burgdorferi B31
VVDAFGADPYKKD

SEQ ID NO: 110013 - protein, 13 aa, Borrelia burgdorferi B31
VDAFGADPYKKDN

SEQ ID NO: 110014 - protein, 13 aa, Borrelia burgdorferi B31
DAFGADPYKKDND

SEQ ID NO: 110015 - protein, 13 aa, Borrelia burgdorferi B31
AFGADPYKKDNDE

SEQ ID NO: 110016 - protein, 13 aa, Borrelia burgdorferi B31
FGADPYKKDNDES

SEQ ID NO: 110017 - protein, 13 aa, Borrelia burgdorferi B31
GADPYKKDNDESV

SEQ ID NO: 110018 - protein, 13 aa, Borrelia burgdorferi B31
ADPYKKDNDESVQ

SEQ ID NO: 110019 - protein, 13 aa, Borrelia burgdorferi B31
DPYKKDNDESVQK

SEQ ID NO: 110020 - protein, 13 aa, Borrelia burgdorferi B31
PYKKDNDESVQKP

SEQ ID NO: 110021 - protein, 13 aa, Borrelia burgdorferi B31
YKKDNDESVQKPV

SEQ ID NO: 110022 - protein, 13 aa, Borrelia burgdorferi B31
KKDNDESVQKPVK

SEQ ID NO: 110023 - protein, 13 aa, Borrelia burgdorferi B31
KDNDESVQKPVKC

SEQ ID NO: 110024 - protein, 13 aa, Borrelia burgdorferi B31
DNDESVQKPVKCN

SEQ ID NO: 110025 - protein, 13 aa, Borrelia burgdorferi B31
NDESVQKPVKCNE

SEQ ID NO: 110026 - protein, 13 aa, Borrelia burgdorferi B31
DESVQKPVKCNEE

SEQ ID NO: 110027 - protein, 13 aa, Borrelia burgdorferi B31
ESVQKPVKCNEEI

SEQ ID NO: 110028 - protein, 13 aa, Borrelia burgdorferi B31
SVQKPVKCNEEIF

SEQ ID NO: 110029 - protein, 13 aa, Borrelia burgdorferi B31
VQKPVKCNEEIFK

SEQ ID NO: 110030 - protein, 13 aa, Borrelia burgdorferi B31
QKPVKCNEEIFKV

SEQ ID NO: 110031 - protein, 13 aa, Borrelia burgdorferi B31
KPVKCNEEIFKVI

SEQ ID NO: 110032 - protein, 13 aa, Borrelia burgdorferi B31
PVKCNEEIFKVIK

SEQ ID NO: 110033 - protein, 13 aa, Borrelia burgdorferi B31
VKCNEEIFKVIKK

SEQ ID NO: 110034 - protein, 13 aa, Borrelia burgdorferi B31
KCNEEIFKVIKKV

SEQ ID NO: 110035 - protein, 13 aa, Borrelia burgdorferi B31
CNEEIFKVIKKVL

SEQ ID NO: 110036 - protein, 13 aa, Borrelia burgdorferi B31
NEEIFKVIKKVLT

SEQ ID NO: 110037 - protein, 13 aa, Borrelia burgdorferi B31
EEIFKVIKKVLTE

SEQ ID NO: 110038 - protein, 13 aa, Borrelia burgdorferi B31
EIFKVIKKVLTES

SEQ ID NO: 110039 - protein, 13 aa, Borrelia burgdorferi B31
IFKVIKKVLTESE

SEQ ID NO: 110040 - protein, 13 aa, Borrelia burgdorferi B31
FKVIKKVLTESES

SEQ ID NO: 110041 - protein, 13 aa, Borrelia burgdorferi B31
KVIKKVLTESESN

SEQ ID NO: 110042 - protein, 13 aa, Borrelia burgdorferi B31
VIKKVLTESESNN

SEQ ID NO: 110043 - protein, 13 aa, Borrelia burgdorferi B31
IKKVLTESESNNE

SEQ ID NO: 110044 - protein, 13 aa, Borrelia burgdorferi B31
KKVLTESESNNEL

SEQ ID NO: 110045 - protein, 13 aa, Borrelia burgdorferi B31
KVLTESESNNELK

SEQ ID NO: 110046 - protein, 13 aa, Borrelia burgdorferi B31
VLTESESNNELKN

SEQ ID NO: 110047 - protein, 13 aa, Borrelia burgdorferi B31
LTESESNNELKNL

SEQ ID NO: 110048 - protein, 13 aa, Borrelia burgdorferi B31
TESESNNELKNLK

SEQ ID NO: 110049 - protein, 13 aa, Borrelia burgdorferi B31
ESESNNELKNLKN

SEQ ID NO: 110050 - protein, 13 aa, Borrelia burgdorferi B31
SESNNELKNLKNY

SEQ ID NO: 110051 - protein, 13 aa, Borrelia burgdorferi B31
ESNNELKNLKNYG

SEQ ID NO: 110052 - protein, 13 aa, Borrelia burgdorferi B31
SNNELKNLKNYGN

SEQ ID NO: 110053 - protein, 13 aa, Borrelia burgdorferi B31
NNELKNLKNYGNV

SEQ ID NO: 110054 - protein, 14 aa, Borrelia burgdorferi B31
MMQRISILLMLLAV

SEQ ID NO: 110055 - protein, 14 aa, Borrelia burgdorferi B31
MQRISILLMLLAVF

SEQ ID NO: 110056 - protein, 14 aa, Borrelia burgdorferi B31
QRISILLMLLAVFS

SEQ ID NO: 110057 - protein, 14 aa, Borrelia burgdorferi B31
RISILLMLLAVFSC

SEQ ID NO: 110058 - protein, 14 aa, Borrelia burgdorferi B31
ISILLMLLAVFSCK

SEQ ID NO: 110059 - protein, 14 aa, Borrelia burgdorferi B31
SILLMLLAVFSCKQ

SEQ ID NO: 110060 - protein, 14 aa, Borrelia burgdorferi B31
ILLMLLAVFSCKQF

SEQ ID NO: 110061 - protein, 14 aa, Borrelia burgdorferi B31
LLMLLAVFSCKQFG

SEQ ID NO: 110062 - protein, 14 aa, Borrelia burgdorferi B31
LMLLAVFSCKQFGD

SEQ ID NO: 110063 - protein, 14 aa, Borrelia burgdorferi B31
MLLAVFSCKQFGDV

SEQ ID NO: 110064 - protein, 14 aa, Borrelia burgdorferi B31
LLAVFSCKQFGDVK

SEQ ID NO: 110065 - protein, 14 aa, Borrelia burgdorferi B31
LAVFSCKQFGDVKS

SEQ ID NO: 110066 - protein, 14 aa, Borrelia burgdorferi B31
AVFSCKQFGDVKSL

SEQ ID NO: 110067 - protein, 14 aa, Borrelia burgdorferi B31
VFSCKQFGDVKSLT

SEQ ID NO: 110068 - protein, 14 aa, Borrelia burgdorferi B31
FSCKQFGDVKSLTE

SEQ ID NO: 110069 - protein, 14 aa, Borrelia burgdorferi B31
SCKQFGDVKSLTEI

SEQ ID NO: 110070 - protein, 14 aa, Borrelia burgdorferi B31
CKQFGDVKSLTEID

SEQ ID NO: 110071 - protein, 14 aa, Borrelia burgdorferi B31
KQFGDVKSLTEIDS

SEQ ID NO: 110072 - protein, 14 aa, Borrelia burgdorferi B31
QFGDVKSLTEIDSG

SEQ ID NO: 110073 - protein, 14 aa, Borrelia burgdorferi B31
FGDVKSLTEIDSGN

SEQ ID NO: 110074 - protein, 14 aa, Borrelia burgdorferi B31
GDVKSLTEIDSGNG

SEQ ID NO: 110075 - protein, 14 aa, Borrelia burgdorferi B31
DVKSLTEIDSGNGI

SEQ ID NO: 110076 - protein, 14 aa, Borrelia burgdorferi B31
VKSLTEIDSGNGIP

SEQ ID NO: 110077 - protein, 14 aa, Borrelia burgdorferi B31
KSLTEIDSGNGIPL

SEQ ID NO: 110078 - protein, 14 aa, Borrelia burgdorferi B31
SLTEIDSGNGIPLV

SEQ ID NO: 110079 - protein, 14 aa, Borrelia burgdorferi B31
LTEIDSGNGIPLVV

SEQ ID NO: 110080 - protein, 14 aa, Borrelia burgdorferi B31
TEIDSGNGIPLVVS

SEQ ID NO: 110081 - protein, 14 aa, Borrelia burgdorferi B31
EIDSGNGIPLVVSD

SEQ ID NO: 110082 - protein, 14 aa, Borrelia burgdorferi B31
IDSGNGIPLVVSDV

SEQ ID NO: 110083 - protein, 14 aa, Borrelia burgdorferi B31
DSGNGIPLVVSDVV

SEQ ID NO: 110084 - protein, 14 aa, Borrelia burgdorferi B31
SGNGIPLVVSDVVK

SEQ ID NO: 110085 - protein, 14 aa, Borrelia burgdorferi B31
GNGIPLVVSDVVKD

SEQ ID NO: 110086 - protein, 14 aa, Borrelia burgdorferi B31
NGIPLVVSDVVKDL

SEQ ID NO: 110087 - protein, 14 aa, Borrelia burgdorferi B31
GIPLVVSDVVKDLI

SEQ ID NO: 110088 - protein, 14 aa, Borrelia burgdorferi B31
IPLVVSDVVKDLIP

SEQ ID NO: 110089 - protein, 14 aa, Borrelia burgdorferi B31
PLVVSDVVKDLIPK

SEQ ID NO: 110090 - protein, 14 aa, Borrelia burgdorferi B31
LVVSDVVKDLIPKE

SEQ ID NO: 110091 - protein, 14 aa, Borrelia burgdorferi B31
VVSDVVKDLIPKEI

SEQ ID NO: 110092 - protein, 14 aa, Borrelia burgdorferi B31
VSDVVKDLIPKEIS

SEQ ID NO: 110093 - protein, 14 aa, Borrelia burgdorferi B31
SDVVKDLIPKEISL

SEQ ID NO: 110094 - protein, 14 aa, Borrelia burgdorferi B31
DVVKDLIPKEISLT

SEQ ID NO: 110095 - protein, 14 aa, Borrelia burgdorferi B31
VVKDLIPKEISLTP

SEQ ID NO: 110096 - protein, 14 aa, Borrelia burgdorferi B31
VKDLIPKEISLTPE

SEQ ID NO: 110097 - protein, 14 aa, Borrelia burgdorferi B31
KDLIPKEISLTPEE

SEQ ID NO: 110098 - protein, 14 aa, Borrelia burgdorferi B31
DLIPKEISLTPEEA

SEQ ID NO: 110099 - protein, 14 aa, Borrelia burgdorferi B31
LIPKEISLTPEEAE

SEQ ID NO: 110100 - protein, 14 aa, Borrelia burgdorferi B31
IPKEISLTPEEAEK

SEQ ID NO: 110101 - protein, 14 aa, Borrelia burgdorferi B31
PKEISLTPEEAEKL

SEQ ID NO: 110102 - protein, 14 aa, Borrelia burgdorferi B31
KEISLTPEEAEKLE

SEQ ID NO: 110103 - protein, 14 aa, Borrelia burgdorferi B31
EISLTPEEAEKLES

SEQ ID NO: 110104 - protein, 14 aa, Borrelia burgdorferi B31
ISLTPEEAEKLESL

SEQ ID NO: 110105 - protein, 14 aa, Borrelia burgdorferi B31
SLTPEEAEKLESLK

SEQ ID NO: 110106 - protein, 14 aa, Borrelia burgdorferi B31
LTPEEAEKLESLKV

SEQ ID NO: 110107 - protein, 14 aa, Borrelia burgdorferi B31
TPEEAEKLESLKVF

SEQ ID NO: 110108 - protein, 14 aa, Borrelia burgdorferi B31
PEEAEKLESLKVFL

SEQ ID NO: 110109 - protein, 14 aa, Borrelia burgdorferi B31
EEAEKLESLKVFLK

SEQ ID NO: 110110 - protein, 14 aa, Borrelia burgdorferi B31
EAEKLESLKVFLKD

SEQ ID NO: 110111 - protein, 14 aa, Borrelia burgdorferi B31
AEKLESLKVFLKDA

SEQ ID NO: 110112 - protein, 14 aa, Borrelia burgdorferi B31
EKLESLKVFLKDAM

SEQ ID NO: 110113 - protein, 14 aa, Borrelia burgdorferi B31
KLESLKVFLKDAMS

SEQ ID NO: 110114 - protein, 14 aa, Borrelia burgdorferi B31
LESLKVFLKDAMSV

SEQ ID NO: 110115 - protein, 14 aa, Borrelia burgdorferi B31
ESLKVFLKDAMSVN

SEQ ID NO: 110116 - protein, 14 aa, Borrelia burgdorferi B31
SLKVFLKDAMSVNG

SEQ ID NO: 110117 - protein, 14 aa, Borrelia burgdorferi B31
LKVFLKDAMSVNGR

SEQ ID NO: 110118 - protein, 14 aa, Borrelia burgdorferi B31
KVFLKDAMSVNGRE

SEQ ID NO: 110119 - protein, 14 aa, Borrelia burgdorferi B31
VFLKDAMSVNGREE

SEQ ID NO: 110120 - protein, 14 aa, Borrelia burgdorferi B31
FLKDAMSVNGREEA

SEQ ID NO: 110121 - protein, 14 aa, Borrelia burgdorferi B31
LKDAMSVNGREEAL

SEQ ID NO: 110122 - protein, 14 aa, Borrelia burgdorferi B31
KDAMSVNGREEALK

SEQ ID NO: 110123 - protein, 14 aa, Borrelia burgdorferi B31
DAMSVNGREEALKA

SEQ ID NO: 110124 - protein, 14 aa, Borrelia burgdorferi B31
AMSVNGREEALKAE

SEQ ID NO: 110125 - protein, 14 aa, Borrelia burgdorferi B31
MSVNGREEALKAEY

SEQ ID NO: 110126 - protein, 14 aa, Borrelia burgdorferi B31
SVNGREEALKAEYE

SEQ ID NO: 110127 - protein, 14 aa, Borrelia burgdorferi B31
VNGREEALKAEYEK

SEQ ID NO: 110128 - protein, 14 aa, Borrelia burgdorferi B31
NGREEALKAEYEKS

SEQ ID NO: 110129 - protein, 14 aa, Borrelia burgdorferi B31
GREEALKAEYEKSY

SEQ ID NO: 110130 - protein, 14 aa, Borrelia burgdorferi B31
REEALKAEYEKSYK

SEQ ID NO: 110131 - protein, 14 aa, Borrelia burgdorferi B31
EEALKAEYEKSYKE

SEQ ID NO: 110132 - protein, 14 aa, Borrelia burgdorferi B31
EALKAEYEKSYKEF

SEQ ID NO: 110133 - protein, 14 aa, Borrelia burgdorferi B31
ALKAEYEKSYKEFF

SEQ ID NO: 110134 - protein, 14 aa, Borrelia burgdorferi B31
LKAEYEKSYKEFFD

SEQ ID NO: 110135 - protein, 14 aa, Borrelia burgdorferi B31
KAEYEKSYKEFFDW

SEQ ID NO: 110136 - protein, 14 aa, Borrelia burgdorferi B31
AEYEKSYKEFFDWL

SEQ ID NO: 110137 - protein, 14 aa, Borrelia burgdorferi B31
EYEKSYKEFFDWLS

SEQ ID NO: 110138 - protein, 14 aa, Borrelia burgdorferi B31
YEKSYKEFFDWLSK

SEQ ID NO: 110139 - protein, 14 aa, Borrelia burgdorferi B31
EKSYKEFFDWLSKD

SEQ ID NO: 110140 - protein, 14 aa, Borrelia burgdorferi B31
KSYKEFFDWLSKDV

SEQ ID NO: 110141 - protein, 14 aa, Borrelia burgdorferi B31
SYKEFFDWLSKDVN

SEQ ID NO: 110142 - protein, 14 aa, Borrelia burgdorferi B31
YKEFFDWLSKDVNR

SEQ ID NO: 110143 - protein, 14 aa, Borrelia burgdorferi B31
KEFFDWLSKDVNRQ

SEQ ID NO: 110144 - protein, 14 aa, Borrelia burgdorferi B31
EFFDWLSKDVNRQK

SEQ ID NO: 110145 - protein, 14 aa, Borrelia burgdorferi B31
FFDWLSKDVNRQKE

SEQ ID NO: 110146 - protein, 14 aa, Borrelia burgdorferi B31
FDWLSKDVNRQKEF

SEQ ID NO: 110147 - protein, 14 aa, Borrelia burgdorferi B31
DWLSKDVNRQKEFI

SEQ ID NO: 110148 - protein, 14 aa, Borrelia burgdorferi B31
WLSKDVNRQKEFIS

SEQ ID NO: 110149 - protein, 14 aa, Borrelia burgdorferi B31
LSKDVNRQKEFISS

SEQ ID NO: 110150 - protein, 14 aa, Borrelia burgdorferi B31
SKDVNRQKEFISSF

SEQ ID NO: 110151 - protein, 14 aa, Borrelia burgdorferi B31
KDVNRQKEFISSFD

SEQ ID NO: 110152 - protein, 14 aa, Borrelia burgdorferi B31
DVNRQKEFISSFDN

SEQ ID NO: 110153 - protein, 14 aa, Borrelia burgdorferi B31
VNRQKEFISSFDNI

SEQ ID NO: 110154 - protein, 14 aa, Borrelia burgdorferi B31
NRQKEFISSFDNIS

SEQ ID NO: 110155 - protein, 14 aa, Borrelia burgdorferi B31
RQKEFISSFDNISS

SEQ ID NO: 110156 - protein, 14 aa, Borrelia burgdorferi B31
QKEFISSFDNISSI

SEQ ID NO: 110157 - protein, 14 aa, Borrelia burgdorferi B31
KEFISSFDNISSIV

SEQ ID NO: 110158 - protein, 14 aa, Borrelia burgdorferi B31
EFISSFDNISSIVS

SEQ ID NO: 110159 - protein, 14 aa, Borrelia burgdorferi B31
FISSFDNISSIVSK

SEQ ID NO: 110160 - protein, 14 aa, Borrelia burgdorferi B31
ISSFDNISSIVSKA

SEQ ID NO: 110161 - protein, 14 aa, Borrelia burgdorferi B31
SSFDNISSIVSKAV

SEQ ID NO: 110162 - protein, 14 aa, Borrelia burgdorferi B31
SFDNISSIVSKAVD

SEQ ID NO: 110163 - protein, 14 aa, Borrelia burgdorferi B31
FDNISSIVSKAVDA

SEQ ID NO: 110164 - protein, 14 aa, Borrelia burgdorferi B31
DNISSIVSKAVDAS

SEQ ID NO: 110165 - protein, 14 aa, Borrelia burgdorferi B31
NISSIVSKAVDASK

SEQ ID NO: 110166 - protein, 14 aa, Borrelia burgdorferi B31
ISSIVSKAVDASKK

SEQ ID NO: 110167 - protein, 14 aa, Borrelia burgdorferi B31
SSIVSKAVDASKKR

SEQ ID NO: 110168 - protein, 14 aa, Borrelia burgdorferi B31
SIVSKAVDASKKRR

SEQ ID NO: 110169 - protein, 14 aa, Borrelia burgdorferi B31
IVSKAVDASKKRRP

SEQ ID NO: 110170 - protein, 14 aa, Borrelia burgdorferi B31
VSKAVDASKKRRPT

SEQ ID NO: 110171 - protein, 14 aa, Borrelia burgdorferi B31
SKAVDASKKRRPTE

SEQ ID NO: 110172 - protein, 14 aa, Borrelia burgdorferi B31
KAVDASKKRRPTEQ

SEQ ID NO: 110173 - protein, 14 aa, Borrelia burgdorferi B31
AVDASKKRRPTEQQ

SEQ ID NO: 110174 - protein, 14 aa, Borrelia burgdorferi B31
VDASKKRRPTEQQS

SEQ ID NO: 110175 - protein, 14 aa, Borrelia burgdorferi B31
DASKKRRPTEQQSL

SEQ ID NO: 110176 - protein, 14 aa, Borrelia burgdorferi B31
ASKKRRPTEQQSLG

SEQ ID NO: 110177 - protein, 14 aa, Borrelia burgdorferi B31
SKKRRPTEQQSLGF

SEQ ID NO: 110178 - protein, 14 aa, Borrelia burgdorferi B31
KKRRPTEQQSLGFK

SEQ ID NO: 110179 - protein, 14 aa, Borrelia burgdorferi B31
KRRPTEQQSLGFKE

SEQ ID NO: 110180 - protein, 14 aa, Borrelia burgdorferi B31
RRPTEQQSLGFKEY

SEQ ID NO: 110181 - protein, 14 aa, Borrelia burgdorferi B31
RPTEQQSLGFKEYV

SEQ ID NO: 110182 - protein, 14 aa, Borrelia burgdorferi B31
PTEQQSLGFKEYVC

SEQ ID NO: 110183 - protein, 14 aa, Borrelia burgdorferi B31
TEQQSLGFKEYVCY

SEQ ID NO: 110184 - protein, 14 aa, Borrelia burgdorferi B31
EQQSLGFKEYVCYK

SEQ ID NO: 110185 - protein, 14 aa, Borrelia burgdorferi B31
QQSLGFKEYVCYKI

SEQ ID NO: 110186 - protein, 14 aa, Borrelia burgdorferi B31
QSLGFKEYVCYKIK

SEQ ID NO: 110187 - protein, 14 aa, Borrelia burgdorferi B31
SLGFKEYVCYKIKN

SEQ ID NO: 110188 - protein, 14 aa, Borrelia burgdorferi B31
LGFKEYVCYKIKNS

SEQ ID NO: 110189 - protein, 14 aa, Borrelia burgdorferi B31
GFKEYVCYKIKNSK

SEQ ID NO: 110190 - protein, 14 aa, Borrelia burgdorferi B31
FKEYVCYKIKNSKG

SEQ ID NO: 110191 - protein, 14 aa, Borrelia burgdorferi B31
KEYVCYKIKNSKGE

SEQ ID NO: 110192 - protein, 14 aa, Borrelia burgdorferi B31
EYVCYKIKNSKGEA

SEQ ID NO: 110193 - protein, 14 aa, Borrelia burgdorferi B31
YVCYKIKNSKGEAL

SEQ ID NO: 110194 - protein, 14 aa, Borrelia burgdorferi B31
VCYKIKNSKGEALS

SEQ ID NO: 110195 - protein, 14 aa, Borrelia burgdorferi B31
CYKIKNSKGEALSL

SEQ ID NO: 110196 - protein, 14 aa, Borrelia burgdorferi B31
YKIKNSKGEALSLF

SEQ ID NO: 110197 - protein, 14 aa, Borrelia burgdorferi B31
KIKNSKGEALSLFF

SEQ ID NO: 110198 - protein, 14 aa, Borrelia burgdorferi B31
IKNSKGEALSLFFQ

SEQ ID NO: 110199 - protein, 14 aa, Borrelia burgdorferi B31
KNSKGEALSLFFQK

SEQ ID NO: 110200 - protein, 14 aa, Borrelia burgdorferi B31
NSKGEALSLFFQKV

SEQ ID NO: 110201 - protein, 14 aa, Borrelia burgdorferi B31
SKGEALSLFFQKVV

SEQ ID NO: 110202 - protein, 14 aa, Borrelia burgdorferi B31
KGEALSLFFQKVVD

SEQ ID NO: 110203 - protein, 14 aa, Borrelia burgdorferi B31
GEALSLFFQKVVDA

SEQ ID NO: 110204 - protein, 14 aa, Borrelia burgdorferi B31
EALSLFFQKVVDAF

SEQ ID NO: 110205 - protein, 14 aa, Borrelia burgdorferi B31
ALSLFFQKVVDAFG

SEQ ID NO: 110206 - protein, 14 aa, Borrelia burgdorferi B31
LSLFFQKVVDAFGA

SEQ ID NO: 110207 - protein, 14 aa, Borrelia burgdorferi B31
SLFFQKVVDAFGAD

SEQ ID NO: 110208 - protein, 14 aa, Borrelia burgdorferi B31
LFFQKVVDAFGADP

SEQ ID NO: 110209 - protein, 14 aa, Borrelia burgdorferi B31
FFQKVVDAFGADPY

SEQ ID NO: 110210 - protein, 14 aa, Borrelia burgdorferi B31
FQKVVDAFGADPYK

SEQ ID NO: 110211 - protein, 14 aa, Borrelia burgdorferi B31
QKVVDAFGADPYKK

SEQ ID NO: 110212 - protein, 14 aa, Borrelia burgdorferi B31
KVVDAFGADPYKKD

SEQ ID NO: 110213 - protein, 14 aa, Borrelia burgdorferi B31
VVDAFGADPYKKDN

SEQ ID NO: 110214 - protein, 14 aa, Borrelia burgdorferi B31
VDAFGADPYKKDND

SEQ ID NO: 110215 - protein, 14 aa, Borrelia burgdorferi B31
DAFGADPYKKDNDE

SEQ ID NO: 110216 - protein, 14 aa, Borrelia burgdorferi B31
AFGADPYKKDNDES

SEQ ID NO: 110217 - protein, 14 aa, Borrelia burgdorferi B31
FGADPYKKDNDESV

SEQ ID NO: 110218 - protein, 14 aa, Borrelia burgdorferi B31
GADPYKKDNDESVQ

SEQ ID NO: 110219 - protein, 14 aa, Borrelia burgdorferi B31
ADPYKKDNDESVQK

SEQ ID NO: 110220 - protein, 14 aa, Borrelia burgdorferi B31
DPYKKDNDESVQKP

SEQ ID NO: 110221 - protein, 14 aa, Borrelia burgdorferi B31
PYKKDNDESVQKPV

SEQ ID NO: 110222 - protein, 14 aa, Borrelia burgdorferi B31
YKKDNDESVQKPVK

SEQ ID NO: 110223 - protein, 14 aa, Borrelia burgdorferi B31
KKDNDESVQKPVKC

SEQ ID NO: 110224 - protein, 14 aa, Borrelia burgdorferi B31
KDNDESVQKPVKCN

SEQ ID NO: 110225 - protein, 14 aa, Borrelia burgdorferi B31
DNDESVQKPVKCNE

SEQ ID NO: 110226 - protein, 14 aa, Borrelia burgdorferi B31
NDESVQKPVKCNEE

SEQ ID NO: 110227 - protein, 14 aa, Borrelia burgdorferi B31
DESVQKPVKCNEEI

SEQ ID NO: 110228 - protein, 14 aa, Borrelia burgdorferi B31
ESVQKPVKCNEEIF

SEQ ID NO: 110229 - protein, 14 aa, Borrelia burgdorferi B31
SVQKPVKCNEEIFK

SEQ ID NO: 110230 - protein, 14 aa, Borrelia burgdorferi B31
VQKPVKCNEEIFKV

SEQ ID NO: 110231 - protein, 14 aa, Borrelia burgdorferi B31
QKPVKCNEEIFKVI

SEQ ID NO: 110232 - protein, 14 aa, Borrelia burgdorferi B31
KPVKCNEEIFKVIK

SEQ ID NO: 110233 - protein, 14 aa, Borrelia burgdorferi B31
PVKCNEEIFKVIKK

SEQ ID NO: 110234 - protein, 14 aa, Borrelia burgdorferi B31
VKCNEEIFKVIKKV

SEQ ID NO: 110235 - protein, 14 aa, Borrelia burgdorferi B31
KCNEEIFKVIKKVL

SEQ ID NO: 110236 - protein, 14 aa, Borrelia burgdorferi B31
CNEEIFKVIKKVLT

SEQ ID NO: 110237 - protein, 14 aa, Borrelia burgdorferi B31
NEEIFKVIKKVLTE

SEQ ID NO: 110238 - protein, 14 aa, Borrelia burgdorferi B31
EEIFKVIKKVLTES

SEQ ID NO: 110239 - protein, 14 aa, Borrelia burgdorferi B31
EIFKVIKKVLTESE

SEQ ID NO: 110240 - protein, 14 aa, Borrelia burgdorferi B31
IFKVIKKVLTESES

SEQ ID NO: 110241 - protein, 14 aa, Borrelia burgdorferi B31
FKVIKKVLTESESN

SEQ ID NO: 110242 - protein, 14 aa, Borrelia burgdorferi B31
KVIKKVLTESESNN

SEQ ID NO: 110243 - protein, 14 aa, Borrelia burgdorferi B31
VIKKVLTESESNNE

SEQ ID NO: 110244 - protein, 14 aa, Borrelia burgdorferi B31
IKKVLTESESNNEL

SEQ ID NO: 110245 - protein, 14 aa, Borrelia burgdorferi B31
KKVLTESESNNELK

SEQ ID NO: 110246 - protein, 14 aa, Borrelia burgdorferi B31
KVLTESESNNELKN

SEQ ID NO: 110247 - protein, 14 aa, Borrelia burgdorferi B31
VLTESESNNELKNL

SEQ ID NO: 110248 - protein, 14 aa, Borrelia burgdorferi B31
LTESESNNELKNLK

SEQ ID NO: 110249 - protein, 14 aa, Borrelia burgdorferi B31
TESESNNELKNLKN

SEQ ID NO: 110250 - protein, 14 aa, Borrelia burgdorferi B31
ESESNNELKNLKNY

SEQ ID NO: 110251 - protein, 14 aa, Borrelia burgdorferi B31
SESNNELKNLKNYG

SEQ ID NO: 110252 - protein, 14 aa, Borrelia burgdorferi B31
ESNNELKNLKNYGN

SEQ ID NO: 110253 - protein, 14 aa, Borrelia burgdorferi B31
SNNELKNLKNYGNV

SEQ ID NO: 110254 - protein, 15 aa, Borrelia burgdorferi B31
MMQRISILLMLLAVF

SEQ ID NO: 110255 - protein, 15 aa, Borrelia burgdorferi B31
MQRISILLMLLAVFS

SEQ ID NO: 110256 - protein, 15 aa, Borrelia burgdorferi B31
QRISILLMLLAVFSC

SEQ ID NO: 110257 - protein, 15 aa, Borrelia burgdorferi B31
RISILLMLLAVFSCK

SEQ ID NO: 110258 - protein, 15 aa, Borrelia burgdorferi B31
ISILLMLLAVFSCKQ

SEQ ID NO: 110259 - protein, 15 aa, Borrelia burgdorferi B31
SILLMLLAVFSCKQF

SEQ ID NO: 110260 - protein, 15 aa, Borrelia burgdorferi B31
ILLMLLAVFSCKQFG

SEQ ID NO: 110261 - protein, 15 aa, Borrelia burgdorferi B31
LLMLLAVFSCKQFGD

SEQ ID NO: 110262 - protein, 15 aa, Borrelia burgdorferi B31
LMLLAVFSCKQFGDV

SEQ ID NO: 110263 - protein, 15 aa, Borrelia burgdorferi B31
MLLAVFSCKQFGDVK

SEQ ID NO: 110264 - protein, 15 aa, Borrelia burgdorferi B31
LLAVFSCKQFGDVKS

SEQ ID NO: 110265 - protein, 15 aa, Borrelia burgdorferi B31
LAVFSCKQFGDVKSL

SEQ ID NO: 110266 - protein, 15 aa, Borrelia burgdorferi B31
AVFSCKQFGDVKSLT

SEQ ID NO: 110267 - protein, 15 aa, Borrelia burgdorferi B31
VFSCKQFGDVKSLTE

SEQ ID NO: 110268 - protein, 15 aa, Borrelia burgdorferi B31
FSCKQFGDVKSLTEI

SEQ ID NO: 110269 - protein, 15 aa, Borrelia burgdorferi B31
SCKQFGDVKSLTEID

SEQ ID NO: 110270 - protein, 15 aa, Borrelia burgdorferi B31
CKQFGDVKSLTEIDS

SEQ ID NO: 110271 - protein, 15 aa, Borrelia burgdorferi B31
KQFGDVKSLTEIDSG

SEQ ID NO: 110272 - protein, 15 aa, Borrelia burgdorferi B31
QFGDVKSLTEIDSGN

SEQ ID NO: 110273 - protein, 15 aa, Borrelia burgdorferi B31
FGDVKSLTEIDSGNG

SEQ ID NO: 110274 - protein, 15 aa, Borrelia burgdorferi B31
GDVKSLTEIDSGNGI

SEQ ID NO: 110275 - protein, 15 aa, Borrelia burgdorferi B31
DVKSLTEIDSGNGIP

SEQ ID NO: 110276 - protein, 15 aa, Borrelia burgdorferi B31
VKSLTEIDSGNGIPL

SEQ ID NO: 110277 - protein, 15 aa, Borrelia burgdorferi B31
KSLTEIDSGNGIPLV

SEQ ID NO: 110278 - protein, 15 aa, Borrelia burgdorferi B31
SLTEIDSGNGIPLVV

SEQ ID NO: 110279 - protein, 15 aa, Borrelia burgdorferi B31
LTEIDSGNGIPLVVS

SEQ ID NO: 110280 - protein, 15 aa, Borrelia burgdorferi B31
TEIDSGNGIPLVVSD

SEQ ID NO: 110281 - protein, 15 aa, Borrelia burgdorferi B31
EIDSGNGIPLVVSDV

SEQ ID NO: 110282 - protein, 15 aa, Borrelia burgdorferi B31
IDSGNGIPLVVSDVV

SEQ ID NO: 110283 - protein, 15 aa, Borrelia burgdorferi B31
DSGNGIPLVVSDVVK

SEQ ID NO: 110284 - protein, 15 aa, Borrelia burgdorferi B31
SGNGIPLVVSDVVKD

SEQ ID NO: 110285 - protein, 15 aa, Borrelia burgdorferi B31
GNGIPLVVSDVVKDL

SEQ ID NO: 110286 - protein, 15 aa, Borrelia burgdorferi B31
NGIPLVVSDVVKDLI

SEQ ID NO: 110287 - protein, 15 aa, Borrelia burgdorferi B31
GIPLVVSDVVKDLIP

SEQ ID NO: 110288 - protein, 15 aa, Borrelia burgdorferi B31
IPLVVSDVVKDLIPK

SEQ ID NO: 110289 - protein, 15 aa, Borrelia burgdorferi B31
PLVVSDVVKDLIPKE

SEQ ID NO: 110290 - protein, 15 aa, Borrelia burgdorferi B31
LVVSDVVKDLIPKEI

SEQ ID NO: 110291 - protein, 15 aa, Borrelia burgdorferi B31
VVSDVVKDLIPKEIS

SEQ ID NO: 110292 - protein, 15 aa, Borrelia burgdorferi B31
VSDVVKDLIPKEISL

SEQ ID NO: 110293 - protein, 15 aa, Borrelia burgdorferi B31
SDVVKDLIPKEISLT

SEQ ID NO: 110294 - protein, 15 aa, Borrelia burgdorferi B31
DVVKDLIPKEISLTP

SEQ ID NO: 110295 - protein, 15 aa, Borrelia burgdorferi B31
VVKDLIPKEISLTPE

SEQ ID NO: 110296 - protein, 15 aa, Borrelia burgdorferi B31
VKDLIPKEISLTPEE

SEQ ID NO: 110297 - protein, 15 aa, Borrelia burgdorferi B31
KDLIPKEISLTPEEA

SEQ ID NO: 110298 - protein, 15 aa, Borrelia burgdorferi B31
DLIPKEISLTPEEAE

SEQ ID NO: 110299 - protein, 15 aa, Borrelia burgdorferi B31
LIPKEISLTPEEAEK

SEQ ID NO: 110300 - protein, 15 aa, Borrelia burgdorferi B31
IPKEISLTPEEAEKL

SEQ ID NO: 110301 - protein, 15 aa, Borrelia burgdorferi B31
PKEISLTPEEAEKLE

SEQ ID NO: 110302 - protein, 15 aa, Borrelia burgdorferi B31
KEISLTPEEAEKLES

SEQ ID NO: 110303 - protein, 15 aa, Borrelia burgdorferi B31
EISLTPEEAEKLESL

SEQ ID NO: 110304 - protein, 15 aa, Borrelia burgdorferi B31
ISLTPEEAEKLESLK

SEQ ID NO: 110305 - protein, 15 aa, Borrelia burgdorferi B31
SLTPEEAEKLESLKV

SEQ ID NO: 110306 - protein, 15 aa, Borrelia burgdorferi B31
LTPEEAEKLESLKVF

SEQ ID NO: 110307 - protein, 15 aa, Borrelia burgdorferi B31
TPEEAEKLESLKVFL

SEQ ID NO: 110308 - protein, 15 aa, Borrelia burgdorferi B31
PEEAEKLESLKVFLK

SEQ ID NO: 110309 - protein, 15 aa, Borrelia burgdorferi B31
EEAEKLESLKVFLKD

SEQ ID NO: 110310 - protein, 15 aa, Borrelia burgdorferi B31
EAEKLESLKVFLKDA

SEQ ID NO: 110311 - protein, 15 aa, Borrelia burgdorferi B31
AEKLESLKVFLKDAM

SEQ ID NO: 110312 - protein, 15 aa, Borrelia burgdorferi B31
EKLESLKVFLKDAMS

SEQ ID NO: 110313 - protein, 15 aa, Borrelia burgdorferi B31
KLESLKVFLKDAMSV

SEQ ID NO: 110314 - protein, 15 aa, Borrelia burgdorferi B31
LESLKVFLKDAMSVN

SEQ ID NO: 110315 - protein, 15 aa, Borrelia burgdorferi B31
ESLKVFLKDAMSVNG

SEQ ID NO: 110316 - protein, 15 aa, Borrelia burgdorferi B31
SLKVFLKDAMSVNGR

SEQ ID NO: 110317 - protein, 15 aa, Borrelia burgdorferi B31
LKVFLKDAMSVNGRE

SEQ ID NO: 110318 - protein, 15 aa, Borrelia burgdorferi B31
KVFLKDAMSVNGREE

SEQ ID NO: 110319 - protein, 15 aa, Borrelia burgdorferi B31
VFLKDAMSVNGREEA

SEQ ID NO: 110320 - protein, 15 aa, Borrelia burgdorferi B31
FLKDAMSVNGREEAL

SEQ ID NO: 110321 - protein, 15 aa, Borrelia burgdorferi B31
LKDAMSVNGREEALK

SEQ ID NO: 110322 - protein, 15 aa, Borrelia burgdorferi B31
KDAMSVNGREEALKA

SEQ ID NO: 110323 - protein, 15 aa, Borrelia burgdorferi B31
DAMSVNGREEALKAE

SEQ ID NO: 110324 - protein, 15 aa, Borrelia burgdorferi B31
AMSVNGREEALKAEY

SEQ ID NO: 110325 - protein, 15 aa, Borrelia burgdorferi B31
MSVNGREEALKAEYE

SEQ ID NO: 110326 - protein, 15 aa, Borrelia burgdorferi B31
SVNGREEALKAEYEK

SEQ ID NO: 110327 - protein, 15 aa, Borrelia burgdorferi B31
VNGREEALKAEYEKS

SEQ ID NO: 110328 - protein, 15 aa, Borrelia burgdorferi B31
NGREEALKAEYEKSY

SEQ ID NO: 110329 - protein, 15 aa, Borrelia burgdorferi B31
GREEALKAEYEKSYK

SEQ ID NO: 110330 - protein, 15 aa, Borrelia burgdorferi B31
REEALKAEYEKSYKE

SEQ ID NO: 110331 - protein, 15 aa, Borrelia burgdorferi B31
EEALKAEYEKSYKEF

SEQ ID NO: 110332 - protein, 15 aa, Borrelia burgdorferi B31
EALKAEYEKSYKEFF

SEQ ID NO: 110333 - protein, 15 aa, Borrelia burgdorferi B31
ALKAEYEKSYKEFFD

SEQ ID NO: 110334 - protein, 15 aa, Borrelia burgdorferi B31
LKAEYEKSYKEFFDW

SEQ ID NO: 110335 - protein, 15 aa, Borrelia burgdorferi B31
KAEYEKSYKEFFDWL

SEQ ID NO: 110336 - protein, 15 aa, Borrelia burgdorferi B31
AEYEKSYKEFFDWLS

SEQ ID NO: 110337 - protein, 15 aa, Borrelia burgdorferi B31
EYEKSYKEFFDWLSK

SEQ ID NO: 110338 - protein, 15 aa, Borrelia burgdorferi B31
YEKSYKEFFDWLSKD

SEQ ID NO: 110339 - protein, 15 aa, Borrelia burgdorferi B31
EKSYKEFFDWLSKDV

SEQ ID NO: 110340 - protein, 15 aa, Borrelia burgdorferi B31
KSYKEFFDWLSKDVN

SEQ ID NO: 110341 - protein, 15 aa, Borrelia burgdorferi B31
SYKEFFDWLSKDVNR

SEQ ID NO: 110342 - protein, 15 aa, Borrelia burgdorferi B31
YKEFFDWLSKDVNRQ

SEQ ID NO: 110343 - protein, 15 aa, Borrelia burgdorferi B31
KEFFDWLSKDVNRQK

SEQ ID NO: 110344 - protein, 15 aa, Borrelia burgdorferi B31
EFFDWLSKDVNRQKE

SEQ ID NO: 110345 - protein, 15 aa, Borrelia burgdorferi B31
FFDWLSKDVNRQKEF

SEQ ID NO: 110346 - protein, 15 aa, Borrelia burgdorferi B31
FDWLSKDVNRQKEFI

SEQ ID NO: 110347 - protein, 15 aa, Borrelia burgdorferi B31
DWLSKDVNRQKEFIS

SEQ ID NO: 110348 - protein, 15 aa, Borrelia burgdorferi B31
WLSKDVNRQKEFISS

SEQ ID NO: 110349 - protein, 15 aa, Borrelia burgdorferi B31
LSKDVNRQKEFISSF

SEQ ID NO: 110350 - protein, 15 aa, Borrelia burgdorferi B31
SKDVNRQKEFISSFD

SEQ ID NO: 110351 - protein, 15 aa, Borrelia burgdorferi B31
KDVNRQKEFISSFDN

SEQ ID NO: 110352 - protein, 15 aa, Borrelia burgdorferi B31
DVNRQKEFISSFDNI

SEQ ID NO: 110353 - protein, 15 aa, Borrelia burgdorferi B31
VNRQKEFISSFDNIS

SEQ ID NO: 110354 - protein, 15 aa, Borrelia burgdorferi B31
NRQKEFISSFDNISS

SEQ ID NO: 110355 - protein, 15 aa, Borrelia burgdorferi B31
RQKEFISSFDNISSI

SEQ ID NO: 110356 - protein, 15 aa, Borrelia burgdorferi B31
QKEFISSFDNISSIV

SEQ ID NO: 110357 - protein, 15 aa, Borrelia burgdorferi B31
KEFISSFDNISSIVS

SEQ ID NO: 110358 - protein, 15 aa, Borrelia burgdorferi B31
EFISSFDNISSIVSK

SEQ ID NO: 110359 - protein, 15 aa, Borrelia burgdorferi B31
FISSFDNISSIVSKA

SEQ ID NO: 110360 - protein, 15 aa, Borrelia burgdorferi B31
ISSFDNISSIVSKAV

SEQ ID NO: 110361 - protein, 15 aa, Borrelia burgdorferi B31
SSFDNISSIVSKAVD

SEQ ID NO: 110362 - protein, 15 aa, Borrelia burgdorferi B31
SFDNISSIVSKAVDA

SEQ ID NO: 110363 - protein, 15 aa, Borrelia burgdorferi B31
FDNISSIVSKAVDAS

SEQ ID NO: 110364 - protein, 15 aa, Borrelia burgdorferi B31
DNISSIVSKAVDASK

SEQ ID NO: 110365 - protein, 15 aa, Borrelia burgdorferi B31
NISSIVSKAVDASKK

SEQ ID NO: 110366 - protein, 15 aa, Borrelia burgdorferi B31
ISSIVSKAVDASKKR

SEQ ID NO: 110367 - protein, 15 aa, Borrelia burgdorferi B31
SSIVSKAVDASKKRR

SEQ ID NO: 110368 - protein, 15 aa, Borrelia burgdorferi B31
SIVSKAVDASKKRRP

SEQ ID NO: 110369 - protein, 15 aa, Borrelia burgdorferi B31
IVSKAVDASKKRRPT

SEQ ID NO: 110370 - protein, 15 aa, Borrelia burgdorferi B31
VSKAVDASKKRRPTE

SEQ ID NO: 110371 - protein, 15 aa, Borrelia burgdorferi B31
SKAVDASKKRRPTEQ

SEQ ID NO: 110372 - protein, 15 aa, Borrelia burgdorferi B31
KAVDASKKRRPTEQQ

SEQ ID NO: 110373 - protein, 15 aa, Borrelia burgdorferi B31
AVDASKKRRPTEQQS

SEQ ID NO: 110374 - protein, 15 aa, Borrelia burgdorferi B31
VDASKKRRPTEQQSL

SEQ ID NO: 110375 - protein, 15 aa, Borrelia burgdorferi B31
DASKKRRPTEQQSLG

SEQ ID NO: 110376 - protein, 15 aa, Borrelia burgdorferi B31
ASKKRRPTEQQSLGF

SEQ ID NO: 110377 - protein, 15 aa, Borrelia burgdorferi B31
SKKRRPTEQQSLGFK

SEQ ID NO: 110378 - protein, 15 aa, Borrelia burgdorferi B31
KKRRPTEQQSLGFKE

SEQ ID NO: 110379 - protein, 15 aa, Borrelia burgdorferi B31
KRRPTEQQSLGFKEY

SEQ ID NO: 110380 - protein, 15 aa, Borrelia burgdorferi B31
RRPTEQQSLGFKEYV

SEQ ID NO: 110381 - protein, 15 aa, Borrelia burgdorferi B31
RPTEQQSLGFKEYVC

SEQ ID NO: 110382 - protein, 15 aa, Borrelia burgdorferi B31
PTEQQSLGFKEYVCY

SEQ ID NO: 110383 - protein, 15 aa, Borrelia burgdorferi B31
TEQQSLGFKEYVCYK

SEQ ID NO: 110384 - protein, 15 aa, Borrelia burgdorferi B31
EQQSLGFKEYVCYKI

SEQ ID NO: 110385 - protein, 15 aa, Borrelia burgdorferi B31
QQSLGFKEYVCYKIK

SEQ ID NO: 110386 - protein, 15 aa, Borrelia burgdorferi B31
QSLGFKEYVCYKIKN

SEQ ID NO: 110387 - protein, 15 aa, Borrelia burgdorferi B31
SLGFKEYVCYKIKNS

SEQ ID NO: 110388 - protein, 15 aa, Borrelia burgdorferi B31
LGFKEYVCYKIKNSK

SEQ ID NO: 110389 - protein, 15 aa, Borrelia burgdorferi B31
GFKEYVCYKIKNSKG

SEQ ID NO: 110390 - protein, 15 aa, Borrelia burgdorferi B31
FKEYVCYKIKNSKGE

SEQ ID NO: 110391 - protein, 15 aa, Borrelia burgdorferi B31
KEYVCYKIKNSKGEA

SEQ ID NO: 110392 - protein, 15 aa, Borrelia burgdorferi B31
EYVCYKIKNSKGEAL

SEQ ID NO: 110393 - protein, 15 aa, Borrelia burgdorferi B31
YVCYKIKNSKGEALS

SEQ ID NO: 110394 - protein, 15 aa, Borrelia burgdorferi B31
VCYKIKNSKGEALSL

SEQ ID NO: 110395 - protein, 15 aa, Borrelia burgdorferi B31
CYKIKNSKGEALSLF

SEQ ID NO: 110396 - protein, 15 aa, Borrelia burgdorferi B31
YKIKNSKGEALSLFF

SEQ ID NO: 110397 - protein, 15 aa, Borrelia burgdorferi B31
KIKNSKGEALSLFFQ

SEQ ID NO: 110398 - protein, 15 aa, Borrelia burgdorferi B31
IKNSKGEALSLFFQK

SEQ ID NO: 110399 - protein, 15 aa, Borrelia burgdorferi B31
KNSKGEALSLFFQKV

SEQ ID NO: 110400 - protein, 15 aa, Borrelia burgdorferi B31
NSKGEALSLFFQKVV

SEQ ID NO: 110401 - protein, 15 aa, Borrelia burgdorferi B31
SKGEALSLFFQKVVD

SEQ ID NO: 110402 - protein, 15 aa, Borrelia burgdorferi B31
KGEALSLFFQKVVDA

SEQ ID NO: 110403 - protein, 15 aa, Borrelia burgdorferi B31
GEALSLFFQKVVDAF

SEQ ID NO: 110404 - protein, 15 aa, Borrelia burgdorferi B31
EALSLFFQKVVDAFG

SEQ ID NO: 110405 - protein, 15 aa, Borrelia burgdorferi B31
ALSLFFQKVVDAFGA

SEQ ID NO: 110406 - protein, 15 aa, Borrelia burgdorferi B31
LSLFFQKVVDAFGAD

SEQ ID NO: 110407 - protein, 15 aa, Borrelia burgdorferi B31
SLFFQKVVDAFGADP

SEQ ID NO: 110408 - protein, 15 aa, Borrelia burgdorferi B31
LFFQKVVDAFGADPY

SEQ ID NO: 110409 - protein, 15 aa, Borrelia burgdorferi B31
FFQKVVDAFGADPYK

SEQ ID NO: 110410 - protein, 15 aa, Borrelia burgdorferi B31
FQKVVDAFGADPYKK

SEQ ID NO: 110411 - protein, 15 aa, Borrelia burgdorferi B31
QKVVDAFGADPYKKD

SEQ ID NO: 110412 - protein, 15 aa, Borrelia burgdorferi B31
KVVDAFGADPYKKDN

SEQ ID NO: 110413 - protein, 15 aa, Borrelia burgdorferi B31
VVDAFGADPYKKDND

SEQ ID NO: 110414 - protein, 15 aa, Borrelia burgdorferi B31
VDAFGADPYKKDNDE

SEQ ID NO: 110415 - protein, 15 aa, Borrelia burgdorferi B31
DAFGADPYKKDNDES

SEQ ID NO: 110416 - protein, 15 aa, Borrelia burgdorferi B31
AFGADPYKKDNDESV

SEQ ID NO: 110417 - protein, 15 aa, Borrelia burgdorferi B31
FGADPYKKDNDESVQ

SEQ ID NO: 110418 - protein, 15 aa, Borrelia burgdorferi B31
GADPYKKDNDESVQK

SEQ ID NO: 110419 - protein, 15 aa, Borrelia burgdorferi B31
ADPYKKDNDESVQKP

SEQ ID NO: 110420 - protein, 15 aa, Borrelia burgdorferi B31
DPYKKDNDESVQKPV

SEQ ID NO: 110421 - protein, 15 aa, Borrelia burgdorferi B31
PYKKDNDESVQKPVK

SEQ ID NO: 110422 - protein, 15 aa, Borrelia burgdorferi B31
YKKDNDESVQKPVKC

SEQ ID NO: 110423 - protein, 15 aa, Borrelia burgdorferi B31
KKDNDESVQKPVKCN

SEQ ID NO: 110424 - protein, 15 aa, Borrelia burgdorferi B31
KDNDESVQKPVKCNE

SEQ ID NO: 110425 - protein, 15 aa, Borrelia burgdorferi B31
DNDESVQKPVKCNEE

SEQ ID NO: 110426 - protein, 15 aa, Borrelia burgdorferi B31
NDESVQKPVKCNEEI

SEQ ID NO: 110427 - protein, 15 aa, Borrelia burgdorferi B31
DESVQKPVKCNEEIF

SEQ ID NO: 110428 - protein, 15 aa, Borrelia burgdorferi B31
ESVQKPVKCNEEIFK

SEQ ID NO: 110429 - protein, 15 aa, Borrelia burgdorferi B31
SVQKPVKCNEEIFKV

SEQ ID NO: 110430 - protein, 15 aa, Borrelia burgdorferi B31
VQKPVKCNEEIFKVI

SEQ ID NO: 110431 - protein, 15 aa, Borrelia burgdorferi B31
QKPVKCNEEIFKVIK

SEQ ID NO: 110432 - protein, 15 aa, Borrelia burgdorferi B31
KPVKCNEEIFKVIKK

SEQ ID NO: 110433 - protein, 15 aa, Borrelia burgdorferi B31
PVKCNEEIFKVIKKV

SEQ ID NO: 110434 - protein, 15 aa, Borrelia burgdorferi B31
VKCNEEIFKVIKKVL

SEQ ID NO: 110435 - protein, 15 aa, Borrelia burgdorferi B31
KCNEEIFKVIKKVLT

SEQ ID NO: 110436 - protein, 15 aa, Borrelia burgdorferi B31
CNEEIFKVIKKVLTE

SEQ ID NO: 110437 - protein, 15 aa, Borrelia burgdorferi B31
NEEIFKVIKKVLTES

SEQ ID NO: 110438 - protein, 15 aa, Borrelia burgdorferi B31
EEIFKVIKKVLTESE

SEQ ID NO: 110439 - protein, 15 aa, Borrelia burgdorferi B31
EIFKVIKKVLTESES

SEQ ID NO: 110440 - protein, 15 aa, Borrelia burgdorferi B31
IFKVIKKVLTESESN

SEQ ID NO: 110441 - protein, 15 aa, Borrelia burgdorferi B31
FKVIKKVLTESESNN

SEQ ID NO: 110442 - protein, 15 aa, Borrelia burgdorferi B31
KVIKKVLTESESNNE

SEQ ID NO: 110443 - protein, 15 aa, Borrelia burgdorferi B31
VIKKVLTESESNNEL

SEQ ID NO: 110444 - protein, 15 aa, Borrelia burgdorferi B31
IKKVLTESESNNELK

SEQ ID NO: 110445 - protein, 15 aa, Borrelia burgdorferi B31
KKVLTESESNNELKN

SEQ ID NO: 110446 - protein, 15 aa, Borrelia burgdorferi B31
KVLTESESNNELKNL

SEQ ID NO: 110447 - protein, 15 aa, Borrelia burgdorferi B31
VLTESESNNELKNLK

SEQ ID NO: 110448 - protein, 15 aa, Borrelia burgdorferi B31
LTESESNNELKNLKN

SEQ ID NO: 110449 - protein, 15 aa, Borrelia burgdorferi B31
TESESNNELKNLKNY

SEQ ID NO: 110450 - protein, 15 aa, Borrelia burgdorferi B31
ESESNNELKNLKNYG

SEQ ID NO: 110451 - protein, 15 aa, Borrelia burgdorferi B31
SESNNELKNLKNYGN

SEQ ID NO: 110452 - protein, 15 aa, Borrelia burgdorferi B31
ESNNELKNLKNYGNV

SEQ ID NO: 110453 - protein, 16 aa, Borrelia burgdorferi B31
MMQRISILLMLLAVFS

SEQ ID NO: 110454 - protein, 16 aa, Borrelia burgdorferi B31
MQRISILLMLLAVFSC

SEQ ID NO: 110455 - protein, 16 aa, Borrelia burgdorferi B31
QRISILLMLLAVFSCK

SEQ ID NO: 110456 - protein, 16 aa, Borrelia burgdorferi B31
RISILLMLLAVFSCKQ

SEQ ID NO: 110457 - protein, 16 aa, Borrelia burgdorferi B31
ISILLMLLAVFSCKQF

SEQ ID NO: 110458 - protein, 16 aa, Borrelia burgdorferi B31
SILLMLLAVFSCKQFG

SEQ ID NO: 110459 - protein, 16 aa, Borrelia burgdorferi B31
ILLMLLAVFSCKQFGD

SEQ ID NO: 110460 - protein, 16 aa, Borrelia burgdorferi B31
LLMLLAVFSCKQFGDV

SEQ ID NO: 110461 - protein, 16 aa, Borrelia burgdorferi B31
LMLLAVFSCKQFGDVK

SEQ ID NO: 110462 - protein, 16 aa, Borrelia burgdorferi B31
MLLAVFSCKQFGDVKS

SEQ ID NO: 110463 - protein, 16 aa, Borrelia burgdorferi B31
LLAVFSCKQFGDVKSL

SEQ ID NO: 110464 - protein, 16 aa, Borrelia burgdorferi B31
LAVFSCKQFGDVKSLT

SEQ ID NO: 110465 - protein, 16 aa, Borrelia burgdorferi B31
AVFSCKQFGDVKSLTE

SEQ ID NO: 110466 - protein, 16 aa, Borrelia burgdorferi B31
VFSCKQFGDVKSLTEI

SEQ ID NO: 110467 - protein, 16 aa, Borrelia burgdorferi B31
FSCKQFGDVKSLTEID

SEQ ID NO: 110468 - protein, 16 aa, Borrelia burgdorferi B31
SCKQFGDVKSLTEIDS

SEQ ID NO: 110469 - protein, 16 aa, Borrelia burgdorferi B31
CKQFGDVKSLTEIDSG

SEQ ID NO: 110470 - protein, 16 aa, Borrelia burgdorferi B31
KQFGDVKSLTEIDSGN

SEQ ID NO: 110471 - protein, 16 aa, Borrelia burgdorferi B31
QFGDVKSLTEIDSGNG

SEQ ID NO: 110472 - protein, 16 aa, Borrelia burgdorferi B31
FGDVKSLTEIDSGNGI

SEQ ID NO: 110473 - protein, 16 aa, Borrelia burgdorferi B31
GDVKSLTEIDSGNGIP

SEQ ID NO: 110474 - protein, 16 aa, Borrelia burgdorferi B31
DVKSLTEIDSGNGIPL

SEQ ID NO: 110475 - protein, 16 aa, Borrelia burgdorferi B31
VKSLTEIDSGNGIPLV

SEQ ID NO: 110476 - protein, 16 aa, Borrelia burgdorferi B31
KSLTEIDSGNGIPLVV

SEQ ID NO: 110477 - protein, 16 aa, Borrelia burgdorferi B31
SLTEIDSGNGIPLVVS

SEQ ID NO: 110478 - protein, 16 aa, Borrelia burgdorferi B31
LTEIDSGNGIPLVVSD

SEQ ID NO: 110479 - protein, 16 aa, Borrelia burgdorferi B31
TEIDSGNGIPLVVSDV

SEQ ID NO: 110480 - protein, 16 aa, Borrelia burgdorferi B31
EIDSGNGIPLVVSDVV

SEQ ID NO: 110481 - protein, 16 aa, Borrelia burgdorferi B31
IDSGNGIPLVVSDVVK

SEQ ID NO: 110482 - protein, 16 aa, Borrelia burgdorferi B31
DSGNGIPLVVSDVVKD

SEQ ID NO: 110483 - protein, 16 aa, Borrelia burgdorferi B31
SGNGIPLVVSDVVKDL

SEQ ID NO: 110484 - protein, 16 aa, Borrelia burgdorferi B31
GNGIPLVVSDVVKDLI

SEQ ID NO: 110485 - protein, 16 aa, Borrelia burgdorferi B31
NGIPLVVSDVVKDLIP

SEQ ID NO: 110486 - protein, 16 aa, Borrelia burgdorferi B31
GIPLVVSDVVKDLIPK

SEQ ID NO: 110487 - protein, 16 aa, Borrelia burgdorferi B31
IPLVVSDVVKDLIPKE

SEQ ID NO: 110488 - protein, 16 aa, Borrelia burgdorferi B31
PLVVSDVVKDLIPKEI

SEQ ID NO: 110489 - protein, 16 aa, Borrelia burgdorferi B31
LVVSDVVKDLIPKEIS

SEQ ID NO: 110490 - protein, 16 aa, Borrelia burgdorferi B31
VVSDVVKDLIPKEISL

SEQ ID NO: 110491 - protein, 16 aa, Borrelia burgdorferi B31
VSDVVKDLIPKEISLT

SEQ ID NO: 110492 - protein, 16 aa, Borrelia burgdorferi B31
SDVVKDLIPKEISLTP

SEQ ID NO: 110493 - protein, 16 aa, Borrelia burgdorferi B31
DVVKDLIPKEISLTPE

SEQ ID NO: 110494 - protein, 16 aa, Borrelia burgdorferi B31
VVKDLIPKEISLTPEE

SEQ ID NO: 110495 - protein, 16 aa, Borrelia burgdorferi B31
VKDLIPKEISLTPEEA

SEQ ID NO: 110496 - protein, 16 aa, Borrelia burgdorferi B31
KDLIPKEISLTPEEAE

SEQ ID NO: 110497 - protein, 16 aa, Borrelia burgdorferi B31
DLIPKEISLTPEEAEK

SEQ ID NO: 110498 - protein, 16 aa, Borrelia burgdorferi B31
LIPKEISLTPEEAEKL

SEQ ID NO: 110499 - protein, 16 aa, Borrelia burgdorferi B31
IPKEISLTPEEAEKLE

SEQ ID NO: 110500 - protein, 16 aa, Borrelia burgdorferi B31
PKEISLTPEEAEKLES

SEQ ID NO: 110501 - protein, 16 aa, Borrelia burgdorferi B31
KEISLTPEEAEKLESL

SEQ ID NO: 110502 - protein, 16 aa, Borrelia burgdorferi B31
EISLTPEEAEKLESLK

SEQ ID NO: 110503 - protein, 16 aa, Borrelia burgdorferi B31
ISLTPEEAEKLESLKV

SEQ ID NO: 110504 - protein, 16 aa, Borrelia burgdorferi B31
SLTPEEAEKLESLKVF

SEQ ID NO: 110505 - protein, 16 aa, Borrelia burgdorferi B31
LTPEEAEKLESLKVFL

SEQ ID NO: 110506 - protein, 16 aa, Borrelia burgdorferi B31
TPEEAEKLESLKVFLK

SEQ ID NO: 110507 - protein, 16 aa, Borrelia burgdorferi B31
PEEAEKLESLKVFLKD

SEQ ID NO: 110508 - protein, 16 aa, Borrelia burgdorferi B31
EEAEKLESLKVFLKDA

SEQ ID NO: 110509 - protein, 16 aa, Borrelia burgdorferi B31
EAEKLESLKVFLKDAM

SEQ ID NO: 110510 - protein, 16 aa, Borrelia burgdorferi B31
AEKLESLKVFLKDAMS

SEQ ID NO: 110511 - protein, 16 aa, Borrelia burgdorferi B31
EKLESLKVFLKDAMSV

SEQ ID NO: 110512 - protein, 16 aa, Borrelia burgdorferi B31
KLESLKVFLKDAMSVN

SEQ ID NO: 110513 - protein, 16 aa, Borrelia burgdorferi B31
LESLKVFLKDAMSVNG

SEQ ID NO: 110514 - protein, 16 aa, Borrelia burgdorferi B31
ESLKVFLKDAMSVNGR

SEQ ID NO: 110515 - protein, 16 aa, Borrelia burgdorferi B31
SLKVFLKDAMSVNGRE

SEQ ID NO: 110516 - protein, 16 aa, Borrelia burgdorferi B31
LKVFLKDAMSVNGREE

SEQ ID NO: 110517 - protein, 16 aa, Borrelia burgdorferi B31
KVFLKDAMSVNGREEA

SEQ ID NO: 110518 - protein, 16 aa, Borrelia burgdorferi B31
VFLKDAMSVNGREEAL

SEQ ID NO: 110519 - protein, 16 aa, Borrelia burgdorferi B31
FLKDAMSVNGREEALK

SEQ ID NO: 110520 - protein, 16 aa, Borrelia burgdorferi B31
LKDAMSVNGREEALKA

SEQ ID NO: 110521 - protein, 16 aa, Borrelia burgdorferi B31
KDAMSVNGREEALKAE

SEQ ID NO: 110522 - protein, 16 aa, Borrelia burgdorferi B31
DAMSVNGREEALKAEY

SEQ ID NO: 110523 - protein, 16 aa, Borrelia burgdorferi B31
AMSVNGREEALKAEYE

SEQ ID NO: 110524 - protein, 16 aa, Borrelia burgdorferi B31
MSVNGREEALKAEYEK

SEQ ID NO: 110525 - protein, 16 aa, Borrelia burgdorferi B31
SVNGREEALKAEYEKS

SEQ ID NO: 110526 - protein, 16 aa, Borrelia burgdorferi B31
VNGREEALKAEYEKSY

SEQ ID NO: 110527 - protein, 16 aa, Borrelia burgdorferi B31
NGREEALKAEYEKSYK

SEQ ID NO: 110528 - protein, 16 aa, Borrelia burgdorferi B31
GREEALKAEYEKSYKE

SEQ ID NO: 110529 - protein, 16 aa, Borrelia burgdorferi B31
REEALKAEYEKSYKEF

SEQ ID NO: 110530 - protein, 16 aa, Borrelia burgdorferi B31
EEALKAEYEKSYKEFF

SEQ ID NO: 110531 - protein, 16 aa, Borrelia burgdorferi B31
EALKAEYEKSYKEFFD

SEQ ID NO: 110532 - protein, 16 aa, Borrelia burgdorferi B31
ALKAEYEKSYKEFFDW

SEQ ID NO: 110533 - protein, 16 aa, Borrelia burgdorferi B31
LKAEYEKSYKEFFDWL

SEQ ID NO: 110534 - protein, 16 aa, Borrelia burgdorferi B31
KAEYEKSYKEFFDWLS

SEQ ID NO: 110535 - protein, 16 aa, Borrelia burgdorferi B31
AEYEKSYKEFFDWLSK

SEQ ID NO: 110536 - protein, 16 aa, Borrelia burgdorferi B31
EYEKSYKEFFDWLSKD

SEQ ID NO: 110537 - protein, 16 aa, Borrelia burgdorferi B31
YEKSYKEFFDWLSKDV

SEQ ID NO: 110538 - protein, 16 aa, Borrelia burgdorferi B31
EKSYKEFFDWLSKDVN

SEQ ID NO: 110539 - protein, 16 aa, Borrelia burgdorferi B31
KSYKEFFDWLSKDVNR

SEQ ID NO: 110540 - protein, 16 aa, Borrelia burgdorferi B31
SYKEFFDWLSKDVNRQ

SEQ ID NO: 110541 - protein, 16 aa, Borrelia burgdorferi B31
YKEFFDWLSKDVNRQK

SEQ ID NO: 110542 - protein, 16 aa, Borrelia burgdorferi B31
KEFFDWLSKDVNRQKE

SEQ ID NO: 110543 - protein, 16 aa, Borrelia burgdorferi B31
EFFDWLSKDVNRQKEF

SEQ ID NO: 110544 - protein, 16 aa, Borrelia burgdorferi B31
FFDWLSKDVNRQKEFI

SEQ ID NO: 110545 - protein, 16 aa, Borrelia burgdorferi B31
FDWLSKDVNRQKEFIS

SEQ ID NO: 110546 - protein, 16 aa, Borrelia burgdorferi B31
DWLSKDVNRQKEFISS

SEQ ID NO: 110547 - protein, 16 aa, Borrelia burgdorferi B31
WLSKDVNRQKEFISSF

SEQ ID NO: 110548 - protein, 16 aa, Borrelia burgdorferi B31
LSKDVNRQKEFISSFD

SEQ ID NO: 110549 - protein, 16 aa, Borrelia burgdorferi B31
SKDVNRQKEFISSFDN

SEQ ID NO: 110550 - protein, 16 aa, Borrelia burgdorferi B31
KDVNRQKEFISSFDNI

SEQ ID NO: 110551 - protein, 16 aa, Borrelia burgdorferi B31
DVNRQKEFISSFDNIS

SEQ ID NO: 110552 - protein, 16 aa, Borrelia burgdorferi B31
VNRQKEFISSFDNISS

SEQ ID NO: 110553 - protein, 16 aa, Borrelia burgdorferi B31
NRQKEFISSFDNISSI

SEQ ID NO: 110554 - protein, 16 aa, Borrelia burgdorferi B31
RQKEFISSFDNISSIV

SEQ ID NO: 110555 - protein, 16 aa, Borrelia burgdorferi B31
QKEFISSFDNISSIVS

SEQ ID NO: 110556 - protein, 16 aa, Borrelia burgdorferi B31
KEFISSFDNISSIVSK

SEQ ID NO: 110557 - protein, 16 aa, Borrelia burgdorferi B31
EFISSFDNISSIVSKA

SEQ ID NO: 110558 - protein, 16 aa, Borrelia burgdorferi B31
FISSFDNISSIVSKAV

SEQ ID NO: 110559 - protein, 16 aa, Borrelia burgdorferi B31
ISSFDNISSIVSKAVD

SEQ ID NO: 110560 - protein, 16 aa, Borrelia burgdorferi B31
SSFDNISSIVSKAVDA

SEQ ID NO: 110561 - protein, 16 aa, Borrelia burgdorferi B31
SFDNISSIVSKAVDAS

SEQ ID NO: 110562 - protein, 16 aa, Borrelia burgdorferi B31
FDNISSIVSKAVDASK

SEQ ID NO: 110563 - protein, 16 aa, Borrelia burgdorferi B31
DNISSIVSKAVDASKK

SEQ ID NO: 110564 - protein, 16 aa, Borrelia burgdorferi B31
NISSIVSKAVDASKKR

SEQ ID NO: 110565 - protein, 16 aa, Borrelia burgdorferi B31
ISSIVSKAVDASKKRR

SEQ ID NO: 110566 - protein, 16 aa, Borrelia burgdorferi B31
SSIVSKAVDASKKRRP

SEQ ID NO: 110567 - protein, 16 aa, Borrelia burgdorferi B31
SIVSKAVDASKKRRPT

SEQ ID NO: 110568 - protein, 16 aa, Borrelia burgdorferi B31
IVSKAVDASKKRRPTE

SEQ ID NO: 110569 - protein, 16 aa, Borrelia burgdorferi B31
VSKAVDASKKRRPTEQ

SEQ ID NO: 110570 - protein, 16 aa, Borrelia burgdorferi B31
SKAVDASKKRRPTEQQ

SEQ ID NO: 110571 - protein, 16 aa, Borrelia burgdorferi B31
KAVDASKKRRPTEQQS

SEQ ID NO: 110572 - protein, 16 aa, Borrelia burgdorferi B31
AVDASKKRRPTEQQSL

SEQ ID NO: 110573 - protein, 16 aa, Borrelia burgdorferi B31
VDASKKRRPTEQQSLG

SEQ ID NO: 110574 - protein, 16 aa, Borrelia burgdorferi B31
DASKKRRPTEQQSLGF

SEQ ID NO: 110575 - protein, 16 aa, Borrelia burgdorferi B31
ASKKRRPTEQQSLGFK

SEQ ID NO: 110576 - protein, 16 aa, Borrelia burgdorferi B31
SKKRRPTEQQSLGFKE

SEQ ID NO: 110577 - protein, 16 aa, Borrelia burgdorferi B31
KKRRPTEQQSLGFKEY

SEQ ID NO: 110578 - protein, 16 aa, Borrelia burgdorferi B31
KRRPTEQQSLGFKEYV

SEQ ID NO: 110579 - protein, 16 aa, Borrelia burgdorferi B31
RRPTEQQSLGFKEYVC

SEQ ID NO: 110580 - protein, 16 aa, Borrelia burgdorferi B31
RPTEQQSLGFKEYVCY

SEQ ID NO: 110581 - protein, 16 aa, Borrelia burgdorferi B31
PTEQQSLGFKEYVCYK

SEQ ID NO: 110582 - protein, 16 aa, Borrelia burgdorferi B31
TEQQSLGFKEYVCYKI

SEQ ID NO: 110583 - protein, 16 aa, Borrelia burgdorferi B31
EQQSLGFKEYVCYKIK

SEQ ID NO: 110584 - protein, 16 aa, Borrelia burgdorferi B31
QQSLGFKEYVCYKIKN

SEQ ID NO: 110585 - protein, 16 aa, Borrelia burgdorferi B31
QSLGFKEYVCYKIKNS

SEQ ID NO: 110586 - protein, 16 aa, Borrelia burgdorferi B31
SLGFKEYVCYKIKNSK

SEQ ID NO: 110587 - protein, 16 aa, Borrelia burgdorferi B31
LGFKEYVCYKIKNSKG

SEQ ID NO: 110588 - protein, 16 aa, Borrelia burgdorferi B31
GFKEYVCYKIKNSKGE

SEQ ID NO: 110589 - protein, 16 aa, Borrelia burgdorferi B31
FKEYVCYKIKNSKGEA

SEQ ID NO: 110590 - protein, 16 aa, Borrelia burgdorferi B31
KEYVCYKIKNSKGEAL

SEQ ID NO: 110591 - protein, 16 aa, Borrelia burgdorferi B31
EYVCYKIKNSKGEALS

SEQ ID NO: 110592 - protein, 16 aa, Borrelia burgdorferi B31
YVCYKIKNSKGEALSL

SEQ ID NO: 110593 - protein, 16 aa, Borrelia burgdorferi B31
VCYKIKNSKGEALSLF

SEQ ID NO: 110594 - protein, 16 aa, Borrelia burgdorferi B31
CYKIKNSKGEALSLFF

SEQ ID NO: 110595 - protein, 16 aa, Borrelia burgdorferi B31
YKIKNSKGEALSLFFQ

SEQ ID NO: 110596 - protein, 16 aa, Borrelia burgdorferi B31
KIKNSKGEALSLFFQK

SEQ ID NO: 110597 - protein, 16 aa, Borrelia burgdorferi B31
IKNSKGEALSLFFQKV

SEQ ID NO: 110598 - protein, 16 aa, Borrelia burgdorferi B31
KNSKGEALSLFFQKVV

SEQ ID NO: 110599 - protein, 16 aa, Borrelia burgdorferi B31
NSKGEALSLFFQKVVD

SEQ ID NO: 110600 - protein, 16 aa, Borrelia burgdorferi B31
SKGEALSLFFQKVVDA

SEQ ID NO: 110601 - protein, 16 aa, Borrelia burgdorferi B31
KGEALSLFFQKVVDAF

SEQ ID NO: 110602 - protein, 16 aa, Borrelia burgdorferi B31
GEALSLFFQKVVDAFG

SEQ ID NO: 110603 - protein, 16 aa, Borrelia burgdorferi B31
EALSLFFQKVVDAFGA

SEQ ID NO: 110604 - protein, 16 aa, Borrelia burgdorferi B31
ALSLFFQKVVDAFGAD

SEQ ID NO: 110605 - protein, 16 aa, Borrelia burgdorferi B31
LSLFFQKVVDAFGADP

SEQ ID NO: 110606 - protein, 16 aa, Borrelia burgdorferi B31
SLFFQKVVDAFGADPY

SEQ ID NO: 110607 - protein, 16 aa, Borrelia burgdorferi B31
LFFQKVVDAFGADPYK

SEQ ID NO: 110608 - protein, 16 aa, Borrelia burgdorferi B31
FFQKVVDAFGADPYKK

SEQ ID NO: 110609 - protein, 16 aa, Borrelia burgdorferi B31
FQKVVDAFGADPYKKD

SEQ ID NO: 110610 - protein, 16 aa, Borrelia burgdorferi B31
QKVVDAFGADPYKKDN

SEQ ID NO: 110611 - protein, 16 aa, Borrelia burgdorferi B31
KVVDAFGADPYKKDND

SEQ ID NO: 110612 - protein, 16 aa, Borrelia burgdorferi B31
VVDAFGADPYKKDNDE

SEQ ID NO: 110613 - protein, 16 aa, Borrelia burgdorferi B31
VDAFGADPYKKDNDES

SEQ ID NO: 110614 - protein, 16 aa, Borrelia burgdorferi B31
DAFGADPYKKDNDESV

SEQ ID NO: 110615 - protein, 16 aa, Borrelia burgdorferi B31
AFGADPYKKDNDESVQ

SEQ ID NO: 110616 - protein, 16 aa, Borrelia burgdorferi B31
FGADPYKKDNDESVQK

SEQ ID NO: 110617 - protein, 16 aa, Borrelia burgdorferi B31
GADPYKKDNDESVQKP

SEQ ID NO: 110618 - protein, 16 aa, Borrelia burgdorferi B31
ADPYKKDNDESVQKPV

SEQ ID NO: 110619 - protein, 16 aa, Borrelia burgdorferi B31
DPYKKDNDESVQKPVK

SEQ ID NO: 110620 - protein, 16 aa, Borrelia burgdorferi B31
PYKKDNDESVQKPVKC

SEQ ID NO: 110621 - protein, 16 aa, Borrelia burgdorferi B31
YKKDNDESVQKPVKCN

SEQ ID NO: 110622 - protein, 16 aa, Borrelia burgdorferi B31
KKDNDESVQKPVKCNE

SEQ ID NO: 110623 - protein, 16 aa, Borrelia burgdorferi B31
KDNDESVQKPVKCNEE

SEQ ID NO: 110624 - protein, 16 aa, Borrelia burgdorferi B31
DNDESVQKPVKCNEEI

SEQ ID NO: 110625 - protein, 16 aa, Borrelia burgdorferi B31
NDESVQKPVKCNEEIF

SEQ ID NO: 110626 - protein, 16 aa, Borrelia burgdorferi B31
DESVQKPVKCNEEIFK

SEQ ID NO: 110627 - protein, 16 aa, Borrelia burgdorferi B31
ESVQKPVKCNEEIFKV

SEQ ID NO: 110628 - protein, 16 aa, Borrelia burgdorferi B31
SVQKPVKCNEEIFKVI

SEQ ID NO: 110629 - protein, 16 aa, Borrelia burgdorferi B31
VQKPVKCNEEIFKVIK

SEQ ID NO: 110630 - protein, 16 aa, Borrelia burgdorferi B31
QKPVKCNEEIFKVIKK

SEQ ID NO: 110631 - protein, 16 aa, Borrelia burgdorferi B31
KPVKCNEEIFKVIKKV

SEQ ID NO: 110632 - protein, 16 aa, Borrelia burgdorferi B31
PVKCNEEIFKVIKKVL

SEQ ID NO: 110633 - protein, 16 aa, Borrelia burgdorferi B31
VKCNEEIFKVIKKVLT

SEQ ID NO: 110634 - protein, 16 aa, Borrelia burgdorferi B31
KCNEEIFKVIKKVLTE

SEQ ID NO: 110635 - protein, 16 aa, Borrelia burgdorferi B31
CNEEIFKVIKKVLTES

SEQ ID NO: 110636 - protein, 16 aa, Borrelia burgdorferi B31
NEEIFKVIKKVLTESE

SEQ ID NO: 110637 - protein, 16 aa, Borrelia burgdorferi B31
EEIFKVIKKVLTESES

SEQ ID NO: 110638 - protein, 16 aa, Borrelia burgdorferi B31
EIFKVIKKVLTESESN

SEQ ID NO: 110639 - protein, 16 aa, Borrelia burgdorferi B31
IFKVIKKVLTESESNN

SEQ ID NO: 110640 - protein, 16 aa, Borrelia burgdorferi B31
FKVIKKVLTESESNNE

SEQ ID NO: 110641 - protein, 16 aa, Borrelia burgdorferi B31
KVIKKVLTESESNNEL

SEQ ID NO: 110642 - protein, 16 aa, Borrelia burgdorferi B31
VIKKVLTESESNNELK

SEQ ID NO: 110643 - protein, 16 aa, Borrelia burgdorferi B31
IKKVLTESESNNELKN

SEQ ID NO: 110644 - protein, 16 aa, Borrelia burgdorferi B31
KKVLTESESNNELKNL

SEQ ID NO: 110645 - protein, 16 aa, Borrelia burgdorferi B31
KVLTESESNNELKNLK

SEQ ID NO: 110646 - protein, 16 aa, Borrelia burgdorferi B31
VLTESESNNELKNLKN

SEQ ID NO: 110647 - protein, 16 aa, Borrelia burgdorferi B31
LTESESNNELKNLKNY

SEQ ID NO: 110648 - protein, 16 aa, Borrelia burgdorferi B31
TESESNNELKNLKNYG

SEQ ID NO: 110649 - protein, 16 aa, Borrelia burgdorferi B31
ESESNNELKNLKNYGN

SEQ ID NO: 110650 - protein, 16 aa, Borrelia burgdorferi B31
SESNNELKNLKNYGNV

SEQ ID NO: 110651 - protein, 13 aa, Borrelia garinii PBi
MKRISILSILLLL

SEQ ID NO: 110652 - protein, 13 aa, Borrelia garinii PBi
KRISILSILLLLL

SEQ ID NO: 110653 - protein, 13 aa, Borrelia garinii PBi
RISILSILLLLLL

SEQ ID NO: 110654 - protein, 13 aa, Borrelia garinii PBi
ISILSILLLLLLF

SEQ ID NO: 110655 - protein, 13 aa, Borrelia garinii PBi
SILSILLLLLLFS

SEQ ID NO: 110656 - protein, 13 aa, Borrelia garinii PBi
ILSILLLLLLFSC

SEQ ID NO: 110657 - protein, 13 aa, Borrelia garinii PBi
LSILLLLLLFSCK

SEQ ID NO: 110658 - protein, 13 aa, Borrelia garinii PBi
SILLLLLLFSCKQ

SEQ ID NO: 110659 - protein, 13 aa, Borrelia garinii PBi
ILLLLLLFSCKQY

SEQ ID NO: 110660 - protein, 13 aa, Borrelia garinii PBi
LLLLLLFSCKQYG

SEQ ID NO: 110661 - protein, 13 aa, Borrelia garinii PBi
LLLLLFSCKQYGD

SEQ ID NO: 110662 - protein, 13 aa, Borrelia garinii PBi
LLLLFSCKQYGDV

SEQ ID NO: 110663 - protein, 13 aa, Borrelia garinii PBi
LLLFSCKQYGDVK

SEQ ID NO: 110664 - protein, 13 aa, Borrelia garinii PBi
LLFSCKQYGDVKS

SEQ ID NO: 110665 - protein, 13 aa, Borrelia garinii PBi
LFSCKQYGDVKSL

SEQ ID NO: 110666 - protein, 13 aa, Borrelia garinii PBi
FSCKQYGDVKSLT

SEQ ID NO: 110667 - protein, 13 aa, Borrelia garinii PBi
SCKQYGDVKSLTE

SEQ ID NO: 110668 - protein, 13 aa, Borrelia garinii PBi
CKQYGDVKSLTEV

SEQ ID NO: 110669 - protein, 13 aa, Borrelia garinii PBi
KQYGDVKSLTEVA

SEQ ID NO: 110670 - protein, 13 aa, Borrelia garinii PBi
QYGDVKSLTEVAT

SEQ ID NO: 110671 - protein, 13 aa, Borrelia garinii PBi
YGDVKSLTEVATD

SEQ ID NO: 110672 - protein, 13 aa, Borrelia garinii PBi
GDVKSLTEVATDL

SEQ ID NO: 110673 - protein, 13 aa, Borrelia garinii PBi
DVKSLTEVATDLE

SEQ ID NO: 110674 - protein, 13 aa, Borrelia garinii PBi
VKSLTEVATDLED

SEQ ID NO: 110675 - protein, 13 aa, Borrelia garinii PBi
KSLTEVATDLEDD

SEQ ID NO: 110676 - protein, 13 aa, Borrelia garinii PBi
SLTEVATDLEDDN

SEQ ID NO: 110677 - protein, 13 aa, Borrelia garinii PBi
LTEVATDLEDDNS

SEQ ID NO: 110678 - protein, 13 aa, Borrelia garinii PBi
TEVATDLEDDNSF

SEQ ID NO: 110679 - protein, 13 aa, Borrelia garinii PBi
EVATDLEDDNSFA

SEQ ID NO: 110680 - protein, 13 aa, Borrelia garinii PBi
VATDLEDDNSFAS

SEQ ID NO: 110681 - protein, 13 aa, Borrelia garinii PBi
ATDLEDDNSFASG

SEQ ID NO: 110682 - protein, 13 aa, Borrelia garinii PBi
TDLEDDNSFASGS

SEQ ID NO: 110683 - protein, 13 aa, Borrelia garinii PBi
DLEDDNSFASGSV

SEQ ID NO: 110684 - protein, 13 aa, Borrelia garinii PBi
LEDDNSFASGSVE

SEQ ID NO: 110685 - protein, 13 aa, Borrelia garinii PBi
EDDNSFASGSVES

SEQ ID NO: 110686 - protein, 13 aa, Borrelia garinii PBi
DDNSFASGSVESK

SEQ ID NO: 110687 - protein, 13 aa, Borrelia garinii PBi
DNSFASGSVESKD

SEQ ID NO: 110688 - protein, 13 aa, Borrelia garinii PBi
NSFASGSVESKDQ

SEQ ID NO: 110689 - protein, 13 aa, Borrelia garinii PBi
SFASGSVESKDQI

SEQ ID NO: 110690 - protein, 13 aa, Borrelia garinii PBi
FASGSVESKDQII

SEQ ID NO: 110691 - protein, 13 aa, Borrelia garinii PBi
ASGSVESKDQIIE

SEQ ID NO: 110692 - protein, 13 aa, Borrelia garinii PBi
SGSVESKDQIIEK

SEQ ID NO: 110693 - protein, 13 aa, Borrelia garinii PBi
GSVESKDQIIEKG

SEQ ID NO: 110694 - protein, 13 aa, Borrelia garinii PBi
SVESKDQIIEKGP

SEQ ID NO: 110695 - protein, 13 aa, Borrelia garinii PBi
VESKDQIIEKGPV

SEQ ID NO: 110696 - protein, 13 aa, Borrelia garinii PBi
ESKDQIIEKGPVL

SEQ ID NO: 110697 - protein, 13 aa, Borrelia garinii PBi
SKDQIIEKGPVLT

SEQ ID NO: 110698 - protein, 13 aa, Borrelia garinii PBi
KDQIIEKGPVLTS

SEQ ID NO: 110699 - protein, 13 aa, Borrelia garinii PBi
DQIIEKGPVLTSE

SEQ ID NO: 110700 - protein, 13 aa, Borrelia garinii PBi
QIIEKGPVLTSEE

SEQ ID NO: 110701 - protein, 13 aa, Borrelia garinii PBi
IIEKGPVLTSEEF

SEQ ID NO: 110702 - protein, 13 aa, Borrelia garinii PBi
IEKGPVLTSEEFE

SEQ ID NO: 110703 - protein, 13 aa, Borrelia garinii PBi
EKGPVLTSEEFER

SEQ ID NO: 110704 - protein, 13 aa, Borrelia garinii PBi
KGPVLTSEEFERL

SEQ ID NO: 110705 - protein, 13 aa, Borrelia garinii PBi
GPVLTSEEFERLE

SEQ ID NO: 110706 - protein, 13 aa, Borrelia garinii PBi
PVLTSEEFERLEA

SEQ ID NO: 110707 - protein, 13 aa, Borrelia garinii PBi
VLTSEEFERLEAL

SEQ ID NO: 110708 - protein, 13 aa, Borrelia garinii PBi
LTSEEFERLEALK

SEQ ID NO: 110709 - protein, 13 aa, Borrelia garinii PBi
TSEEFERLEALKT

SEQ ID NO: 110710 - protein, 13 aa, Borrelia garinii PBi
SEEFERLEALKTF

SEQ ID NO: 110711 - protein, 13 aa, Borrelia garinii PBi
EEFERLEALKTFL

SEQ ID NO: 110712 - protein, 13 aa, Borrelia garinii PBi
EFERLEALKTFLK

SEQ ID NO: 110713 - protein, 13 aa, Borrelia garinii PBi
FERLEALKTFLKD

SEQ ID NO: 110714 - protein, 13 aa, Borrelia garinii PBi
ERLEALKTFLKDA

SEQ ID NO: 110715 - protein, 13 aa, Borrelia garinii PBi
RLEALKTFLKDAM

SEQ ID NO: 110716 - protein, 13 aa, Borrelia garinii PBi
LEALKTFLKDAMG

SEQ ID NO: 110717 - protein, 13 aa, Borrelia garinii PBi
EALKTFLKDAMGV

SEQ ID NO: 110718 - protein, 13 aa, Borrelia garinii PBi
ALKTFLKDAMGVN

SEQ ID NO: 110719 - protein, 13 aa, Borrelia garinii PBi
LKTFLKDAMGVNG

SEQ ID NO: 110720 - protein, 13 aa, Borrelia garinii PBi
KTFLKDAMGVNGR

SEQ ID NO: 110721 - protein, 13 aa, Borrelia garinii PBi
TFLKDAMGVNGRE

SEQ ID NO: 110722 - protein, 13 aa, Borrelia garinii PBi
FLKDAMGVNGREG

SEQ ID NO: 110723 - protein, 13 aa, Borrelia garinii PBi
LKDAMGVNGREGD

SEQ ID NO: 110724 - protein, 13 aa, Borrelia garinii PBi
KDAMGVNGREGDT

SEQ ID NO: 110725 - protein, 13 aa, Borrelia garinii PBi
DAMGVNGREGDTK

SEQ ID NO: 110726 - protein, 13 aa, Borrelia garinii PBi
AMGVNGREGDTKA

SEQ ID NO: 110727 - protein, 13 aa, Borrelia garinii PBi
MGVNGREGDTKAE

SEQ ID NO: 110728 - protein, 13 aa, Borrelia garinii PBi
GVNGREGDTKAEY

SEQ ID NO: 110729 - protein, 13 aa, Borrelia garinii PBi
VNGREGDTKAEYE

SEQ ID NO: 110730 - protein, 13 aa, Borrelia garinii PBi
NGREGDTKAEYEK

SEQ ID NO: 110731 - protein, 13 aa, Borrelia garinii PBi
GREGDTKAEYEKS

SEQ ID NO: 110732 - protein, 13 aa, Borrelia garinii PBi
REGDTKAEYEKSY

SEQ ID NO: 110733 - protein, 13 aa, Borrelia garinii PBi
EGDTKAEYEKSYK

SEQ ID NO: 110734 - protein, 13 aa, Borrelia garinii PBi
GDTKAEYEKSYKE

SEQ ID NO: 110735 - protein, 13 aa, Borrelia garinii PBi
DTKAEYEKSYKEF

SEQ ID NO: 110736 - protein, 13 aa, Borrelia garinii PBi
TKAEYEKSYKEFF

SEQ ID NO: 110737 - protein, 13 aa, Borrelia garinii PBi
KAEYEKSYKEFFD

SEQ ID NO: 110738 - protein, 13 aa, Borrelia garinii PBi
AEYEKSYKEFFDW

SEQ ID NO: 110739 - protein, 13 aa, Borrelia garinii PBi
EYEKSYKEFFDWL

SEQ ID NO: 110740 - protein, 13 aa, Borrelia garinii PBi
YEKSYKEFFDWLS

SEQ ID NO: 110741 - protein, 13 aa, Borrelia garinii PBi
EKSYKEFFDWLSK

SEQ ID NO: 110742 - protein, 13 aa, Borrelia garinii PBi
KSYKEFFDWLSKD

SEQ ID NO: 110743 - protein, 13 aa, Borrelia garinii PBi
SYKEFFDWLSKDV

SEQ ID NO: 110744 - protein, 13 aa, Borrelia garinii PBi
YKEFFDWLSKDVN

SEQ ID NO: 110745 - protein, 13 aa, Borrelia garinii PBi
KEFFDWLSKDVNR

SEQ ID NO: 110746 - protein, 13 aa, Borrelia garinii PBi
EFFDWLSKDVNRQ

SEQ ID NO: 110747 - protein, 13 aa, Borrelia garinii PBi
FFDWLSKDVNRQK

SEQ ID NO: 110748 - protein, 13 aa, Borrelia garinii PBi
FDWLSKDVNRQKE

SEQ ID NO: 110749 - protein, 13 aa, Borrelia garinii PBi
DWLSKDVNRQKEF

SEQ ID NO: 110750 - protein, 13 aa, Borrelia garinii PBi
WLSKDVNRQKEFV

SEQ ID NO: 110751 - protein, 13 aa, Borrelia garinii PBi
LSKDVNRQKEFVS

SEQ ID NO: 110752 - protein, 13 aa, Borrelia garinii PBi
SKDVNRQKEFVSF

SEQ ID NO: 110753 - protein, 13 aa, Borrelia garinii PBi
KDVNRQKEFVSFF

SEQ ID NO: 110754 - protein, 13 aa, Borrelia garinii PBi
DVNRQKEFVSFFN

SEQ ID NO: 110755 - protein, 13 aa, Borrelia garinii PBi
VNRQKEFVSFFNN

SEQ ID NO: 110756 - protein, 13 aa, Borrelia garinii PBi
NRQKEFVSFFNNI

SEQ ID NO: 110757 - protein, 13 aa, Borrelia garinii PBi
RQKEFVSFFNNIC

SEQ ID NO: 110758 - protein, 13 aa, Borrelia garinii PBi
QKEFVSFFNNICG

SEQ ID NO: 110759 - protein, 13 aa, Borrelia garinii PBi
KEFVSFFNNICGI

SEQ ID NO: 110760 - protein, 13 aa, Borrelia garinii PBi
EFVSFFNNICGII

SEQ ID NO: 110761 - protein, 13 aa, Borrelia garinii PBi
FVSFFNNICGIIT

SEQ ID NO: 110762 - protein, 13 aa, Borrelia garinii PBi
VSFFNNICGIITK

SEQ ID NO: 110763 - protein, 13 aa, Borrelia garinii PBi
SFFNNICGIITKA

SEQ ID NO: 110764 - protein, 13 aa, Borrelia garinii PBi
FFNNICGIITKAV

SEQ ID NO: 110765 - protein, 13 aa, Borrelia garinii PBi
FNNICGIITKAVD

SEQ ID NO: 110766 - protein, 13 aa, Borrelia garinii PBi
NNICGIITKAVDA

SEQ ID NO: 110767 - protein, 13 aa, Borrelia garinii PBi
NICGIITKAVDAS

SEQ ID NO: 110768 - protein, 13 aa, Borrelia garinii PBi
ICGIITKAVDASK

SEQ ID NO: 110769 - protein, 13 aa, Borrelia garinii PBi
CGIITKAVDASKK

SEQ ID NO: 110770 - protein, 13 aa, Borrelia garinii PBi
GIITKAVDASKKR

SEQ ID NO: 110771 - protein, 13 aa, Borrelia garinii PBi
IITKAVDASKKRY

SEQ ID NO: 110772 - protein, 13 aa, Borrelia garinii PBi
ITKAVDASKKRYN

SEQ ID NO: 110773 - protein, 13 aa, Borrelia garinii PBi
TKAVDASKKRYNS

SEQ ID NO: 110774 - protein, 13 aa, Borrelia garinii PBi
KAVDASKKRYNSN

SEQ ID NO: 110775 - protein, 13 aa, Borrelia garinii PBi
AVDASKKRYNSNP

SEQ ID NO: 110776 - protein, 13 aa, Borrelia garinii PBi
VDASKKRYNSNPK

SEQ ID NO: 110777 - protein, 13 aa, Borrelia garinii PBi
DASKKRYNSNPKS

SEQ ID NO: 110778 - protein, 13 aa, Borrelia garinii PBi
ASKKRYNSNPKSL

SEQ ID NO: 110779 - protein, 13 aa, Borrelia garinii PBi
SKKRYNSNPKSLG

SEQ ID NO: 110780 - protein, 13 aa, Borrelia garinii PBi
KKRYNSNPKSLGF

SEQ ID NO: 110781 - protein, 13 aa, Borrelia garinii PBi
KRYNSNPKSLGFN

SEQ ID NO: 110782 - protein, 13 aa, Borrelia garinii PBi
RYNSNPKSLGFNE

SEQ ID NO: 110783 - protein, 13 aa, Borrelia garinii PBi
YNSNPKSLGFNEY

SEQ ID NO: 110784 - protein, 13 aa, Borrelia garinii PBi
NSNPKSLGFNEYV

SEQ ID NO: 110785 - protein, 13 aa, Borrelia garinii PBi
SNPKSLGFNEYVC

SEQ ID NO: 110786 - protein, 13 aa, Borrelia garinii PBi
NPKSLGFNEYVCY

SEQ ID NO: 110787 - protein, 13 aa, Borrelia garinii PBi
PKSLGFNEYVCYD

SEQ ID NO: 110788 - protein, 13 aa, Borrelia garinii PBi
KSLGFNEYVCYDI

SEQ ID NO: 110789 - protein, 13 aa, Borrelia garinii PBi
SLGFNEYVCYDIK

SEQ ID NO: 110790 - protein, 13 aa, Borrelia garinii PBi
LGFNEYVCYDIKT

SEQ ID NO: 110791 - protein, 13 aa, Borrelia garinii PBi
GFNEYVCYDIKTR

SEQ ID NO: 110792 - protein, 13 aa, Borrelia garinii PBi
FNEYVCYDIKTRT

SEQ ID NO: 110793 - protein, 13 aa, Borrelia garinii PBi
NEYVCYDIKTRTG

SEQ ID NO: 110794 - protein, 13 aa, Borrelia garinii PBi
EYVCYDIKTRTGD

SEQ ID NO: 110795 - protein, 13 aa, Borrelia garinii PBi
YVCYDIKTRTGDD

SEQ ID NO: 110796 - protein, 13 aa, Borrelia garinii PBi
VCYDIKTRTGDDL

SEQ ID NO: 110797 - protein, 13 aa, Borrelia garinii PBi
CYDIKTRTGDDLS

SEQ ID NO: 110798 - protein, 13 aa, Borrelia garinii PBi
YDIKTRTGDDLSL

SEQ ID NO: 110799 - protein, 13 aa, Borrelia garinii PBi
DIKTRTGDDLSLF

SEQ ID NO: 110800 - protein, 13 aa, Borrelia garinii PBi
IKTRTGDDLSLFF

SEQ ID NO: 110801 - protein, 13 aa, Borrelia garinii PBi
KTRTGDDLSLFFQ

SEQ ID NO: 110802 - protein, 13 aa, Borrelia garinii PBi
TRTGDDLSLFFQK

SEQ ID NO: 110803 - protein, 13 aa, Borrelia garinii PBi
RTGDDLSLFFQKV

SEQ ID NO: 110804 - protein, 13 aa, Borrelia garinii PBi
TGDDLSLFFQKVA

SEQ ID NO: 110805 - protein, 13 aa, Borrelia garinii PBi
GDDLSLFFQKVAD

SEQ ID NO: 110806 - protein, 13 aa, Borrelia garinii PBi
DDLSLFFQKVADA

SEQ ID NO: 110807 - protein, 13 aa, Borrelia garinii PBi
DLSLFFQKVADAF

SEQ ID NO: 110808 - protein, 13 aa, Borrelia garinii PBi
LSLFFQKVADAFG

SEQ ID NO: 110809 - protein, 13 aa, Borrelia garinii PBi
SLFFQKVADAFGT

SEQ ID NO: 110810 - protein, 13 aa, Borrelia garinii PBi
LFFQKVADAFGTQ

SEQ ID NO: 110811 - protein, 13 aa, Borrelia garinii PBi
FFQKVADAFGTQE

SEQ ID NO: 110812 - protein, 13 aa, Borrelia garinii PBi
FQKVADAFGTQEY

SEQ ID NO: 110813 - protein, 13 aa, Borrelia garinii PBi
QKVADAFGTQEYK

SEQ ID NO: 110814 - protein, 13 aa, Borrelia garinii PBi
KVADAFGTQEYKN

SEQ ID NO: 110815 - protein, 13 aa, Borrelia garinii PBi
VADAFGTQEYKNK

SEQ ID NO: 110816 - protein, 13 aa, Borrelia garinii PBi
ADAFGTQEYKNKD

SEQ ID NO: 110817 - protein, 13 aa, Borrelia garinii PBi
DAFGTQEYKNKDE

SEQ ID NO: 110818 - protein, 13 aa, Borrelia garinii PBi
AFGTQEYKNKDED

SEQ ID NO: 110819 - protein, 13 aa, Borrelia garinii PBi
FGTQEYKNKDEDD

SEQ ID NO: 110820 - protein, 13 aa, Borrelia garinii PBi
GTQEYKNKDEDDE

SEQ ID NO: 110821 - protein, 13 aa, Borrelia garinii PBi
TQEYKNKDEDDEN

SEQ ID NO: 110822 - protein, 13 aa, Borrelia garinii PBi
QEYKNKDEDDENN

SEQ ID NO: 110823 - protein, 13 aa, Borrelia garinii PBi
EYKNKDEDDENNQ

SEQ ID NO: 110824 - protein, 13 aa, Borrelia garinii PBi
YKNKDEDDENNQK

SEQ ID NO: 110825 - protein, 13 aa, Borrelia garinii PBi
KNKDEDDENNQKP

SEQ ID NO: 110826 - protein, 13 aa, Borrelia garinii PBi
NKDEDDENNQKPE

SEQ ID NO: 110827 - protein, 13 aa, Borrelia garinii PBi
KDEDDENNQKPEK

SEQ ID NO: 110828 - protein, 13 aa, Borrelia garinii PBi
DEDDENNQKPEKC

SEQ ID NO: 110829 - protein, 13 aa, Borrelia garinii PBi
EDDENNQKPEKCN

SEQ ID NO: 110830 - protein, 13 aa, Borrelia garinii PBi
DDENNQKPEKCNE

SEQ ID NO: 110831 - protein, 13 aa, Borrelia garinii PBi
DENNQKPEKCNEE

SEQ ID NO: 110832 - protein, 13 aa, Borrelia garinii PBi
ENNQKPEKCNEEI

SEQ ID NO: 110833 - protein, 13 aa, Borrelia garinii PBi
NNQKPEKCNEEIF

SEQ ID NO: 110834 - protein, 13 aa, Borrelia garinii PBi
NQKPEKCNEEIFK

SEQ ID NO: 110835 - protein, 13 aa, Borrelia garinii PBi
QKPEKCNEEIFKV

SEQ ID NO: 110836 - protein, 13 aa, Borrelia garinii PBi
KPEKCNEEIFKVI

SEQ ID NO: 110837 - protein, 13 aa, Borrelia garinii PBi
PEKCNEEIFKVIK

SEQ ID NO: 110838 - protein, 13 aa, Borrelia garinii PBi
EKCNEEIFKVIKR

SEQ ID NO: 110839 - protein, 13 aa, Borrelia garinii PBi
KCNEEIFKVIKRV

SEQ ID NO: 110840 - protein, 13 aa, Borrelia garinii PBi
CNEEIFKVIKRVF

SEQ ID NO: 110841 - protein, 13 aa, Borrelia garinii PBi
NEEIFKVIKRVFT

SEQ ID NO: 110842 - protein, 13 aa, Borrelia garinii PBi
EEIFKVIKRVFTE

SEQ ID NO: 110843 - protein, 13 aa, Borrelia garinii PBi
EIFKVIKRVFTES

SEQ ID NO: 110844 - protein, 13 aa, Borrelia garinii PBi
IFKVIKRVFTESE

SEQ ID NO: 110845 - protein, 13 aa, Borrelia garinii PBi
FKVIKRVFTESEN

SEQ ID NO: 110846 - protein, 13 aa, Borrelia garinii PBi
KVIKRVFTESENN

SEQ ID NO: 110847 - protein, 13 aa, Borrelia garinii PBi
VIKRVFTESENNN

SEQ ID NO: 110848 - protein, 13 aa, Borrelia garinii PBi
IKRVFTESENNNE

SEQ ID NO: 110849 - protein, 13 aa, Borrelia garinii PBi
KRVFTESENNNEL

SEQ ID NO: 110850 - protein, 13 aa, Borrelia garinii PBi
RVFTESENNNELA

SEQ ID NO: 110851 - protein, 13 aa, Borrelia garinii PBi
VFTESENNNELAN

SEQ ID NO: 110852 - protein, 13 aa, Borrelia garinii PBi
FTESENNNELANL

SEQ ID NO: 110853 - protein, 13 aa, Borrelia garinii PBi
TESENNNELANLK

SEQ ID NO: 110854 - protein, 13 aa, Borrelia garinii PBi
ESENNNELANLKN

SEQ ID NO: 110855 - protein, 13 aa, Borrelia garinii PBi
SENNNELANLKNL

SEQ ID NO: 110856 - protein, 13 aa, Borrelia garinii PBi
ENNNELANLKNLN

SEQ ID NO: 110857 - protein, 13 aa, Borrelia garinii PBi
NNNELANLKNLNS

SEQ ID NO: 110858 - protein, 13 aa, Borrelia garinii PBi
NNELANLKNLNSY

SEQ ID NO: 110859 - protein, 13 aa, Borrelia garinii PBi
NELANLKNLNSYN

SEQ ID NO: 110860 - protein, 13 aa, Borrelia garinii PBi
ELANLKNLNSYNL

SEQ ID NO: 110861 - protein, 13 aa, Borrelia garinii PBi
LANLKNLNSYNLN

SEQ ID NO: 110862 - protein, 13 aa, Borrelia garinii PBi
ANLKNLNSYNLNS

SEQ ID NO: 110863 - protein, 13 aa, Borrelia garinii PBi
NLKNLNSYNLNSN

SEQ ID NO: 110864 - protein, 13 aa, Borrelia garinii PBi
LKNLNSYNLNSNN

SEQ ID NO: 110865 - protein, 13 aa, Borrelia garinii PBi
KNLNSYNLNSNNK

SEQ ID NO: 110866 - protein, 14 aa, Borrelia garinii PBi
MKRISILSILLLLL

SEQ ID NO: 110867 - protein, 14 aa, Borrelia garinii PBi
KRISILSILLLLLL

SEQ ID NO: 110868 - protein, 14 aa, Borrelia garinii PBi
RISILSILLLLLLF

SEQ ID NO: 110869 - protein, 14 aa, Borrelia garinii PBi
ISILSILLLLLLFS

SEQ ID NO: 110870 - protein, 14 aa, Borrelia garinii PBi
SILSILLLLLLFSC

SEQ ID NO: 110871 - protein, 14 aa, Borrelia garinii PBi
ILSILLLLLLFSCK

SEQ ID NO: 110872 - protein, 14 aa, Borrelia garinii PBi
LSILLLLLLFSCKQ

SEQ ID NO: 110873 - protein, 14 aa, Borrelia garinii PBi
SILLLLLLFSCKQY

SEQ ID NO: 110874 - protein, 14 aa, Borrelia garinii PBi
ILLLLLLFSCKQYG

SEQ ID NO: 110875 - protein, 14 aa, Borrelia garinii PBi
LLLLLLFSCKQYGD

SEQ ID NO: 110876 - protein, 14 aa, Borrelia garinii PBi
LLLLLFSCKQYGDV

SEQ ID NO: 110877 - protein, 14 aa, Borrelia garinii PBi
LLLLFSCKQYGDVK

SEQ ID NO: 110878 - protein, 14 aa, Borrelia garinii PBi
LLLFSCKQYGDVKS

SEQ ID NO: 110879 - protein, 14 aa, Borrelia garinii PBi
LLFSCKQYGDVKSL

SEQ ID NO: 110880 - protein, 14 aa, Borrelia garinii PBi
LFSCKQYGDVKSLT

SEQ ID NO: 110881 - protein, 14 aa, Borrelia garinii PBi
FSCKQYGDVKSLTE

SEQ ID NO: 110882 - protein, 14 aa, Borrelia garinii PBi
SCKQYGDVKSLTEV

SEQ ID NO: 110883 - protein, 14 aa, Borrelia garinii PBi
CKQYGDVKSLTEVA

SEQ ID NO: 110884 - protein, 14 aa, Borrelia garinii PBi
KQYGDVKSLTEVAT

SEQ ID NO: 110885 - protein, 14 aa, Borrelia garinii PBi
QYGDVKSLTEVATD

SEQ ID NO: 110886 - protein, 14 aa, Borrelia garinii PBi
YGDVKSLTEVATDL

SEQ ID NO: 110887 - protein, 14 aa, Borrelia garinii PBi
GDVKSLTEVATDLE

SEQ ID NO: 110888 - protein, 14 aa, Borrelia garinii PBi
DVKSLTEVATDLED

SEQ ID NO: 110889 - protein, 14 aa, Borrelia garinii PBi
VKSLTEVATDLEDD

SEQ ID NO: 110890 - protein, 14 aa, Borrelia garinii PBi
KSLTEVATDLEDDN

SEQ ID NO: 110891 - protein, 14 aa, Borrelia garinii PBi
SLTEVATDLEDDNS

SEQ ID NO: 110892 - protein, 14 aa, Borrelia garinii PBi
LTEVATDLEDDNSF

SEQ ID NO: 110893 - protein, 14 aa, Borrelia garinii PBi
TEVATDLEDDNSFA

SEQ ID NO: 110894 - protein, 14 aa, Borrelia garinii PBi
EVATDLEDDNSFAS

SEQ ID NO: 110895 - protein, 14 aa, Borrelia garinii PBi
VATDLEDDNSFASG

SEQ ID NO: 110896 - protein, 14 aa, Borrelia garinii PBi
ATDLEDDNSFASGS

SEQ ID NO: 110897 - protein, 14 aa, Borrelia garinii PBi
TDLEDDNSFASGSV

SEQ ID NO: 110898 - protein, 14 aa, Borrelia garinii PBi
DLEDDNSFASGSVE

SEQ ID NO: 110899 - protein, 14 aa, Borrelia garinii PBi
LEDDNSFASGSVES

SEQ ID NO: 110900 - protein, 14 aa, Borrelia garinii PBi
EDDNSFASGSVESK

SEQ ID NO: 110901 - protein, 14 aa, Borrelia garinii PBi
DDNSFASGSVESKD

SEQ ID NO: 110902 - protein, 14 aa, Borrelia garinii PBi
DNSFASGSVESKDQ

SEQ ID NO: 110903 - protein, 14 aa, Borrelia garinii PBi
NSFASGSVESKDQI

SEQ ID NO: 110904 - protein, 14 aa, Borrelia garinii PBi
SFASGSVESKDQII

SEQ ID NO: 110905 - protein, 14 aa, Borrelia garinii PBi
FASGSVESKDQIIE

SEQ ID NO: 110906 - protein, 14 aa, Borrelia garinii PBi
ASGSVESKDQIIEK

SEQ ID NO: 110907 - protein, 14 aa, Borrelia garinii PBi
SGSVESKDQIIEKG

SEQ ID NO: 110908 - protein, 14 aa, Borrelia garinii PBi
GSVESKDQIIEKGP

SEQ ID NO: 110909 - protein, 14 aa, Borrelia garinii PBi
SVESKDQIIEKGPV

SEQ ID NO: 110910 - protein, 14 aa, Borrelia garinii PBi
VESKDQIIEKGPVL

SEQ ID NO: 110911 - protein, 14 aa, Borrelia garinii PBi
ESKDQIIEKGPVLT

SEQ ID NO: 110912 - protein, 14 aa, Borrelia garinii PBi
SKDQIIEKGPVLTS

SEQ ID NO: 110913 - protein, 14 aa, Borrelia garinii PBi
KDQIIEKGPVLTSE

SEQ ID NO: 110914 - protein, 14 aa, Borrelia garinii PBi
DQIIEKGPVLTSEE

SEQ ID NO: 110915 - protein, 14 aa, Borrelia garinii PBi
QIIEKGPVLTSEEF

SEQ ID NO: 110916 - protein, 14 aa, Borrelia garinii PBi
IIEKGPVLTSEEFE

SEQ ID NO: 110917 - protein, 14 aa, Borrelia garinii PBi
IEKGPVLTSEEFER

SEQ ID NO: 110918 - protein, 14 aa, Borrelia garinii PBi
EKGPVLTSEEFERL

SEQ ID NO: 110919 - protein, 14 aa, Borrelia garinii PBi
KGPVLTSEEFERLE

SEQ ID NO: 110920 - protein, 14 aa, Borrelia garinii PBi
GPVLTSEEFERLEA

SEQ ID NO: 110921 - protein, 14 aa, Borrelia garinii PBi
PVLTSEEFERLEAL

SEQ ID NO: 110922 - protein, 14 aa, Borrelia garinii PBi
VLTSEEFERLEALK

SEQ ID NO: 110923 - protein, 14 aa, Borrelia garinii PBi
LTSEEFERLEALKT

SEQ ID NO: 110924 - protein, 14 aa, Borrelia garinii PBi
TSEEFERLEALKTF

SEQ ID NO: 110925 - protein, 14 aa, Borrelia garinii PBi
SEEFERLEALKTFL

SEQ ID NO: 110926 - protein, 14 aa, Borrelia garinii PBi
EEFERLEALKTFLK

SEQ ID NO: 110927 - protein, 14 aa, Borrelia garinii PBi
EFERLEALKTFLKD

SEQ ID NO: 110928 - protein, 14 aa, Borrelia garinii PBi
FERLEALKTFLKDA

SEQ ID NO: 110929 - protein, 14 aa, Borrelia garinii PBi
ERLEALKTFLKDAM

SEQ ID NO: 110930 - protein, 14 aa, Borrelia garinii PBi
RLEALKTFLKDAMG

SEQ ID NO: 110931 - protein, 14 aa, Borrelia garinii PBi
LEALKTFLKDAMGV

SEQ ID NO: 110932 - protein, 14 aa, Borrelia garinii PBi
EALKTFLKDAMGVN

SEQ ID NO: 110933 - protein, 14 aa, Borrelia garinii PBi
ALKTFLKDAMGVNG

SEQ ID NO: 110934 - protein, 14 aa, Borrelia garinii PBi
LKTFLKDAMGVNGR

SEQ ID NO: 110935 - protein, 14 aa, Borrelia garinii PBi
KTFLKDAMGVNGRE

SEQ ID NO: 110936 - protein, 14 aa, Borrelia garinii PBi
TFLKDAMGVNGREG

SEQ ID NO: 110937 - protein, 14 aa, Borrelia garinii PBi
FLKDAMGVNGREGD

SEQ ID NO: 110938 - protein, 14 aa, Borrelia garinii PBi
LKDAMGVNGREGDT

SEQ ID NO: 110939 - protein, 14 aa, Borrelia garinii PBi
KDAMGVNGREGDTK

SEQ ID NO: 110940 - protein, 14 aa, Borrelia garinii PBi
DAMGVNGREGDTKA

SEQ ID NO: 110941 - protein, 14 aa, Borrelia garinii PBi
AMGVNGREGDTKAE

SEQ ID NO: 110942 - protein, 14 aa, Borrelia garinii PBi
MGVNGREGDTKAEY

SEQ ID NO: 110943 - protein, 14 aa, Borrelia garinii PBi
GVNGREGDTKAEYE

SEQ ID NO: 110944 - protein, 14 aa, Borrelia garinii PBi
VNGREGDTKAEYEK

SEQ ID NO: 110945 - protein, 14 aa, Borrelia garinii PBi
NGREGDTKAEYEKS

SEQ ID NO: 110946 - protein, 14 aa, Borrelia garinii PBi
GREGDTKAEYEKSY

SEQ ID NO: 110947 - protein, 14 aa, Borrelia garinii PBi
REGDTKAEYEKSYK

SEQ ID NO: 110948 - protein, 14 aa, Borrelia garinii PBi
EGDTKAEYEKSYKE

SEQ ID NO: 110949 - protein, 14 aa, Borrelia garinii PBi
GDTKAEYEKSYKEF

SEQ ID NO: 110950 - protein, 14 aa, Borrelia garinii PBi
DTKAEYEKSYKEFF

SEQ ID NO: 110951 - protein, 14 aa, Borrelia garinii PBi
TKAEYEKSYKEFFD

SEQ ID NO: 110952 - protein, 14 aa, Borrelia garinii PBi
KAEYEKSYKEFFDW

SEQ ID NO: 110953 - protein, 14 aa, Borrelia garinii PBi
AEYEKSYKEFFDWL

SEQ ID NO: 110954 - protein, 14 aa, Borrelia garinii PBi
EYEKSYKEFFDWLS

SEQ ID NO: 110955 - protein, 14 aa, Borrelia garinii PBi
YEKSYKEFFDWLSK

SEQ ID NO: 110956 - protein, 14 aa, Borrelia garinii PBi
EKSYKEFFDWLSKD

SEQ ID NO: 110957 - protein, 14 aa, Borrelia garinii PBi
KSYKEFFDWLSKDV

SEQ ID NO: 110958 - protein, 14 aa, Borrelia garinii PBi
SYKEFFDWLSKDVN

SEQ ID NO: 110959 - protein, 14 aa, Borrelia garinii PBi
YKEFFDWLSKDVNR

SEQ ID NO: 110960 - protein, 14 aa, Borrelia garinii PBi
KEFFDWLSKDVNRQ

SEQ ID NO: 110961 - protein, 14 aa, Borrelia garinii PBi
EFFDWLSKDVNRQK

SEQ ID NO: 110962 - protein, 14 aa, Borrelia garinii PBi
FFDWLSKDVNRQKE

SEQ ID NO: 110963 - protein, 14 aa, Borrelia garinii PBi
FDWLSKDVNRQKEF

SEQ ID NO: 110964 - protein, 14 aa, Borrelia garinii PBi
DWLSKDVNRQKEFV

SEQ ID NO: 110965 - protein, 14 aa, Borrelia garinii PBi
WLSKDVNRQKEFVS

SEQ ID NO: 110966 - protein, 14 aa, Borrelia garinii PBi
LSKDVNRQKEFVSF

SEQ ID NO: 110967 - protein, 14 aa, Borrelia garinii PBi
SKDVNRQKEFVSFF

SEQ ID NO: 110968 - protein, 14 aa, Borrelia garinii PBi
KDVNRQKEFVSFFN

SEQ ID NO: 110969 - protein, 14 aa, Borrelia garinii PBi
DVNRQKEFVSFFNN

SEQ ID NO: 110970 - protein, 14 aa, Borrelia garinii PBi
VNRQKEFVSFFNNI

SEQ ID NO: 110971 - protein, 14 aa, Borrelia garinii PBi
NRQKEFVSFFNNIC

SEQ ID NO: 110972 - protein, 14 aa, Borrelia garinii PBi
RQKEFVSFFNNICG

SEQ ID NO: 110973 - protein, 14 aa, Borrelia garinii PBi
QKEFVSFFNNICGI

SEQ ID NO: 110974 - protein, 14 aa, Borrelia garinii PBi
KEFVSFFNNICGII

SEQ ID NO: 110975 - protein, 14 aa, Borrelia garinii PBi
EFVSFFNNICGIIT

SEQ ID NO: 110976 - protein, 14 aa, Borrelia garinii PBi
FVSFFNNICGIITK

SEQ ID NO: 110977 - protein, 14 aa, Borrelia garinii PBi
VSFFNNICGIITKA

SEQ ID NO: 110978 - protein, 14 aa, Borrelia garinii PBi
SFFNNICGIITKAV

SEQ ID NO: 110979 - protein, 14 aa, Borrelia garinii PBi
FFNNICGIITKAVD

SEQ ID NO: 110980 - protein, 14 aa, Borrelia garinii PBi
FNNICGIITKAVDA

SEQ ID NO: 110981 - protein, 14 aa, Borrelia garinii PBi
NNICGIITKAVDAS

SEQ ID NO: 110982 - protein, 14 aa, Borrelia garinii PBi
NICGIITKAVDASK

SEQ ID NO: 110983 - protein, 14 aa, Borrelia garinii PBi
ICGIITKAVDASKK

SEQ ID NO: 110984 - protein, 14 aa, Borrelia garinii PBi
CGIITKAVDASKKR

SEQ ID NO: 110985 - protein, 14 aa, Borrelia garinii PBi
GIITKAVDASKKRY

SEQ ID NO: 110986 - protein, 14 aa, Borrelia garinii PBi
IITKAVDASKKRYN

SEQ ID NO: 110987 - protein, 14 aa, Borrelia garinii PBi
ITKAVDASKKRYNS

SEQ ID NO: 110988 - protein, 14 aa, Borrelia garinii PBi
TKAVDASKKRYNSN

SEQ ID NO: 110989 - protein, 14 aa, Borrelia garinii PBi
KAVDASKKRYNSNP

SEQ ID NO: 110990 - protein, 14 aa, Borrelia garinii PBi
AVDASKKRYNSNPK

SEQ ID NO: 110991 - protein, 14 aa, Borrelia garinii PBi
VDASKKRYNSNPKS

SEQ ID NO: 110992 - protein, 14 aa, Borrelia garinii PBi
DASKKRYNSNPKSL

SEQ ID NO: 110993 - protein, 14 aa, Borrelia garinii PBi
ASKKRYNSNPKSLG

SEQ ID NO: 110994 - protein, 14 aa, Borrelia garinii PBi
SKKRYNSNPKSLGF

SEQ ID NO: 110995 - protein, 14 aa, Borrelia garinii PBi
KKRYNSNPKSLGFN

SEQ ID NO: 110996 - protein, 14 aa, Borrelia garinii PBi
KRYNSNPKSLGFNE

SEQ ID NO: 110997 - protein, 14 aa, Borrelia garinii PBi
RYNSNPKSLGFNEY

SEQ ID NO: 110998 - protein, 14 aa, Borrelia garinii PBi
YNSNPKSLGFNEYV

SEQ ID NO: 110999 - protein, 14 aa, Borrelia garinii PBi
NSNPKSLGFNEYVC

SEQ ID NO: 111000 - protein, 14 aa, Borrelia garinii PBi
SNPKSLGFNEYVCY

SEQ ID NO: 111001 - protein, 14 aa, Borrelia garinii PBi
NPKSLGFNEYVCYD

SEQ ID NO: 111002 - protein, 14 aa, Borrelia garinii PBi
PKSLGFNEYVCYDI

SEQ ID NO: 111003 - protein, 14 aa, Borrelia garinii PBi
KSLGFNEYVCYDIK

SEQ ID NO: 111004 - protein, 14 aa, Borrelia garinii PBi
SLGFNEYVCYDIKT

SEQ ID NO: 111005 - protein, 14 aa, Borrelia garinii PBi
LGFNEYVCYDIKTR

SEQ ID NO: 111006 - protein, 14 aa, Borrelia garinii PBi
GFNEYVCYDIKTRT

SEQ ID NO: 111007 - protein, 14 aa, Borrelia garinii PBi
FNEYVCYDIKTRTG

SEQ ID NO: 111008 - protein, 14 aa, Borrelia garinii PBi
NEYVCYDIKTRTGD

SEQ ID NO: 111009 - protein, 14 aa, Borrelia garinii PBi
EYVCYDIKTRTGDD

SEQ ID NO: 111010 - protein, 14 aa, Borrelia garinii PBi
YVCYDIKTRTGDDL

SEQ ID NO: 111011 - protein, 14 aa, Borrelia garinii PBi
VCYDIKTRTGDDLS

SEQ ID NO: 111012 - protein, 14 aa, Borrelia garinii PBi
CYDIKTRTGDDLSL

SEQ ID NO: 111013 - protein, 14 aa, Borrelia garinii PBi
YDIKTRTGDDLSLF

SEQ ID NO: 111014 - protein, 14 aa, Borrelia garinii PBi
DIKTRTGDDLSLFF

SEQ ID NO: 111015 - protein, 14 aa, Borrelia garinii PBi
IKTRTGDDLSLFFQ

SEQ ID NO: 111016 - protein, 14 aa, Borrelia garinii PBi
KTRTGDDLSLFFQK

SEQ ID NO: 111017 - protein, 14 aa, Borrelia garinii PBi
TRTGDDLSLFFQKV

SEQ ID NO: 111018 - protein, 14 aa, Borrelia garinii PBi
RTGDDLSLFFQKVA

SEQ ID NO: 111019 - protein, 14 aa, Borrelia garinii PBi
TGDDLSLFFQKVAD

SEQ ID NO: 111020 - protein, 14 aa, Borrelia garinii PBi
GDDLSLFFQKVADA

SEQ ID NO: 111021 - protein, 14 aa, Borrelia garinii PBi
DDLSLFFQKVADAF

SEQ ID NO: 111022 - protein, 14 aa, Borrelia garinii PBi
DLSLFFQKVADAFG

SEQ ID NO: 111023 - protein, 14 aa, Borrelia garinii PBi
LSLFFQKVADAFGT

SEQ ID NO: 111024 - protein, 14 aa, Borrelia garinii PBi
SLFFQKVADAFGTQ

SEQ ID NO: 111025 - protein, 14 aa, Borrelia garinii PBi
LFFQKVADAFGTQE

SEQ ID NO: 111026 - protein, 14 aa, Borrelia garinii PBi
FFQKVADAFGTQEY

SEQ ID NO: 111027 - protein, 14 aa, Borrelia garinii PBi
FQKVADAFGTQEYK

SEQ ID NO: 111028 - protein, 14 aa, Borrelia garinii PBi
QKVADAFGTQEYKN

SEQ ID NO: 111029 - protein, 14 aa, Borrelia garinii PBi
KVADAFGTQEYKNK

SEQ ID NO: 111030 - protein, 14 aa, Borrelia garinii PBi
VADAFGTQEYKNKD

SEQ ID NO: 111031 - protein, 14 aa, Borrelia garinii PBi
ADAFGTQEYKNKDE

SEQ ID NO: 111032 - protein, 14 aa, Borrelia garinii PBi
DAFGTQEYKNKDED

SEQ ID NO: 111033 - protein, 14 aa, Borrelia garinii PBi
AFGTQEYKNKDEDD

SEQ ID NO: 111034 - protein, 14 aa, Borrelia garinii PBi
FGTQEYKNKDEDDE

SEQ ID NO: 111035 - protein, 14 aa, Borrelia garinii PBi
GTQEYKNKDEDDEN

SEQ ID NO: 111036 - protein, 14 aa, Borrelia garinii PBi
TQEYKNKDEDDENN

SEQ ID NO: 111037 - protein, 14 aa, Borrelia garinii PBi
QEYKNKDEDDENNQ

SEQ ID NO: 111038 - protein, 14 aa, Borrelia garinii PBi
EYKNKDEDDENNQK

SEQ ID NO: 111039 - protein, 14 aa, Borrelia garinii PBi
YKNKDEDDENNQKP

SEQ ID NO: 111040 - protein, 14 aa, Borrelia garinii PBi
KNKDEDDENNQKPE

SEQ ID NO: 111041 - protein, 14 aa, Borrelia garinii PBi
NKDEDDENNQKPEK

SEQ ID NO: 111042 - protein, 14 aa, Borrelia garinii PBi
KDEDDENNQKPEKC

SEQ ID NO: 111043 - protein, 14 aa, Borrelia garinii PBi
DEDDENNQKPEKCN

SEQ ID NO: 111044 - protein, 14 aa, Borrelia garinii PBi
EDDENNQKPEKCNE

SEQ ID NO: 111045 - protein, 14 aa, Borrelia garinii PBi
DDENNQKPEKCNEE

SEQ ID NO: 111046 - protein, 14 aa, Borrelia garinii PBi
DENNQKPEKCNEEI

SEQ ID NO: 111047 - protein, 14 aa, Borrelia garinii PBi
ENNQKPEKCNEEIF

SEQ ID NO: 111048 - protein, 14 aa, Borrelia garinii PBi
NNQKPEKCNEEIFK

SEQ ID NO: 111049 - protein, 14 aa, Borrelia garinii PBi
NQKPEKCNEEIFKV

SEQ ID NO: 111050 - protein, 14 aa, Borrelia garinii PBi
QKPEKCNEEIFKVI

SEQ ID NO: 111051 - protein, 14 aa, Borrelia garinii PBi
KPEKCNEEIFKVIK

SEQ ID NO: 111052 - protein, 14 aa, Borrelia garinii PBi
PEKCNEEIFKVIKR

SEQ ID NO: 111053 - protein, 14 aa, Borrelia garinii PBi
EKCNEEIFKVIKRV

SEQ ID NO: 111054 - protein, 14 aa, Borrelia garinii PBi
KCNEEIFKVIKRVF

SEQ ID NO: 111055 - protein, 14 aa, Borrelia garinii PBi
CNEEIFKVIKRVFT

SEQ ID NO: 111056 - protein, 14 aa, Borrelia garinii PBi
NEEIFKVIKRVFTE

SEQ ID NO: 111057 - protein, 14 aa, Borrelia garinii PBi
EEIFKVIKRVFTES

SEQ ID NO: 111058 - protein, 14 aa, Borrelia garinii PBi
EIFKVIKRVFTESE

SEQ ID NO: 111059 - protein, 14 aa, Borrelia garinii PBi
IFKVIKRVFTESEN

SEQ ID NO: 111060 - protein, 14 aa, Borrelia garinii PBi
FKVIKRVFTESENN

SEQ ID NO: 111061 - protein, 14 aa, Borrelia garinii PBi
KVIKRVFTESENNN

SEQ ID NO: 111062 - protein, 14 aa, Borrelia garinii PBi
VIKRVFTESENNNE

SEQ ID NO: 111063 - protein, 14 aa, Borrelia garinii PBi
IKRVFTESENNNEL

SEQ ID NO: 111064 - protein, 14 aa, Borrelia garinii PBi
KRVFTESENNNELA

SEQ ID NO: 111065 - protein, 14 aa, Borrelia garinii PBi
RVFTESENNNELAN

SEQ ID NO: 111066 - protein, 14 aa, Borrelia garinii PBi
VFTESENNNELANL

SEQ ID NO: 111067 - protein, 14 aa, Borrelia garinii PBi
FTESENNNELANLK

SEQ ID NO: 111068 - protein, 14 aa, Borrelia garinii PBi
TESENNNELANLKN

SEQ ID NO: 111069 - protein, 14 aa, Borrelia garinii PBi
ESENNNELANLKNL

SEQ ID NO: 111070 - protein, 14 aa, Borrelia garinii PBi
SENNNELANLKNLN

SEQ ID NO: 111071 - protein, 14 aa, Borrelia garinii PBi
ENNNELANLKNLNS

SEQ ID NO: 111072 - protein, 14 aa, Borrelia garinii PBi
NNNELANLKNLNSY

SEQ ID NO: 111073 - protein, 14 aa, Borrelia garinii PBi
NNELANLKNLNSYN

SEQ ID NO: 111074 - protein, 14 aa, Borrelia garinii PBi
NELANLKNLNSYNL

SEQ ID NO: 111075 - protein, 14 aa, Borrelia garinii PBi
ELANLKNLNSYNLN

SEQ ID NO: 111076 - protein, 14 aa, Borrelia garinii PBi
LANLKNLNSYNLNS

SEQ ID NO: 111077 - protein, 14 aa, Borrelia garinii PBi
ANLKNLNSYNLNSN

SEQ ID NO: 111078 - protein, 14 aa, Borrelia garinii PBi
NLKNLNSYNLNSNN

SEQ ID NO: 111079 - protein, 14 aa, Borrelia garinii PBi
LKNLNSYNLNSNNK

SEQ ID NO: 111080 - protein, 15 aa, Borrelia garinii PBi
MKRISILSILLLLLL

SEQ ID NO: 111081 - protein, 15 aa, Borrelia garinii PBi
KRISILSILLLLLLF

SEQ ID NO: 111082 - protein, 15 aa, Borrelia garinii PBi
RISILSILLLLLLFS

SEQ ID NO: 111083 - protein, 15 aa, Borrelia garinii PBi
ISILSILLLLLLFSC

SEQ ID NO: 111084 - protein, 15 aa, Borrelia garinii PBi
SILSILLLLLLFSCK

SEQ ID NO: 111085 - protein, 15 aa, Borrelia garinii PBi
ILSILLLLLLFSCKQ

SEQ ID NO: 111086 - protein, 15 aa, Borrelia garinii PBi
LSILLLLLLFSCKQY

SEQ ID NO: 111087 - protein, 15 aa, Borrelia garinii PBi
SILLLLLLFSCKQYG

SEQ ID NO: 111088 - protein, 15 aa, Borrelia garinii PBi
ILLLLLLFSCKQYGD

SEQ ID NO: 111089 - protein, 15 aa, Borrelia garinii PBi
LLLLLLFSCKQYGDV

SEQ ID NO: 111090 - protein, 15 aa, Borrelia garinii PBi
LLLLLFSCKQYGDVK

SEQ ID NO: 111091 - protein, 15 aa, Borrelia garinii PBi
LLLLFSCKQYGDVKS

SEQ ID NO: 111092 - protein, 15 aa, Borrelia garinii PBi
LLLFSCKQYGDVKSL

SEQ ID NO: 111093 - protein, 15 aa, Borrelia garinii PBi
LLFSCKQYGDVKSLT

SEQ ID NO: 111094 - protein, 15 aa, Borrelia garinii PBi
LFSCKQYGDVKSLTE

SEQ ID NO: 111095 - protein, 15 aa, Borrelia garinii PBi
FSCKQYGDVKSLTEV

SEQ ID NO: 111096 - protein, 15 aa, Borrelia garinii PBi
SCKQYGDVKSLTEVA

SEQ ID NO: 111097 - protein, 15 aa, Borrelia garinii PBi
CKQYGDVKSLTEVAT

SEQ ID NO: 111098 - protein, 15 aa, Borrelia garinii PBi
KQYGDVKSLTEVATD

SEQ ID NO: 111099 - protein, 15 aa, Borrelia garinii PBi
QYGDVKSLTEVATDL

SEQ ID NO: 111100 - protein, 15 aa, Borrelia garinii PBi
YGDVKSLTEVATDLE

SEQ ID NO: 111101 - protein, 15 aa, Borrelia garinii PBi
GDVKSLTEVATDLED

SEQ ID NO: 111102 - protein, 15 aa, Borrelia garinii PBi
DVKSLTEVATDLEDD

SEQ ID NO: 111103 - protein, 15 aa, Borrelia garinii PBi
VKSLTEVATDLEDDN

SEQ ID NO: 111104 - protein, 15 aa, Borrelia garinii PBi
KSLTEVATDLEDDNS

SEQ ID NO: 111105 - protein, 15 aa, Borrelia garinii PBi
SLTEVATDLEDDNSF

SEQ ID NO: 111106 - protein, 15 aa, Borrelia garinii PBi
LTEVATDLEDDNSFA

SEQ ID NO: 111107 - protein, 15 aa, Borrelia garinii PBi
TEVATDLEDDNSFAS

SEQ ID NO: 111108 - protein, 15 aa, Borrelia garinii PBi
EVATDLEDDNSFASG

SEQ ID NO: 111109 - protein, 15 aa, Borrelia garinii PBi
VATDLEDDNSFASGS

SEQ ID NO: 111110 - protein, 15 aa, Borrelia garinii PBi
ATDLEDDNSFASGSV

SEQ ID NO: 111111 - protein, 15 aa, Borrelia garinii PBi
TDLEDDNSFASGSVE

SEQ ID NO: 111112 - protein, 15 aa, Borrelia garinii PBi
DLEDDNSFASGSVES

SEQ ID NO: 111113 - protein, 15 aa, Borrelia garinii PBi
LEDDNSFASGSVESK

SEQ ID NO: 111114 - protein, 15 aa, Borrelia garinii PBi
EDDNSFASGSVESKD

SEQ ID NO: 111115 - protein, 15 aa, Borrelia garinii PBi
DDNSFASGSVESKDQ

SEQ ID NO: 111116 - protein, 15 aa, Borrelia garinii PBi
DNSFASGSVESKDQI

SEQ ID NO: 111117 - protein, 15 aa, Borrelia garinii PBi
NSFASGSVESKDQII

SEQ ID NO: 111118 - protein, 15 aa, Borrelia garinii PBi
SFASGSVESKDQIIE

SEQ ID NO: 111119 - protein, 15 aa, Borrelia garinii PBi
FASGSVESKDQIIEK

SEQ ID NO: 111120 - protein, 15 aa, Borrelia garinii PBi
ASGSVESKDQIIEKG

SEQ ID NO: 111121 - protein, 15 aa, Borrelia garinii PBi
SGSVESKDQIIEKGP

SEQ ID NO: 111122 - protein, 15 aa, Borrelia garinii PBi
GSVESKDQIIEKGPV

SEQ ID NO: 111123 - protein, 15 aa, Borrelia garinii PBi
SVESKDQIIEKGPVL

SEQ ID NO: 111124 - protein, 15 aa, Borrelia garinii PBi
VESKDQIIEKGPVLT

SEQ ID NO: 111125 - protein, 15 aa, Borrelia garinii PBi
ESKDQIIEKGPVLTS

SEQ ID NO: 111126 - protein, 15 aa, Borrelia garinii PBi
SKDQIIEKGPVLTSE

SEQ ID NO: 111127 - protein, 15 aa, Borrelia garinii PBi
KDQIIEKGPVLTSEE

SEQ ID NO: 111128 - protein, 15 aa, Borrelia garinii PBi
DQIIEKGPVLTSEEF

SEQ ID NO: 111129 - protein, 15 aa, Borrelia garinii PBi
QIIEKGPVLTSEEFE

SEQ ID NO: 111130 - protein, 15 aa, Borrelia garinii PBi
IIEKGPVLTSEEFER

SEQ ID NO: 111131 - protein, 15 aa, Borrelia garinii PBi
IEKGPVLTSEEFERL

SEQ ID NO: 111132 - protein, 15 aa, Borrelia garinii PBi
EKGPVLTSEEFERLE

SEQ ID NO: 111133 - protein, 15 aa, Borrelia garinii PBi
KGPVLTSEEFERLEA

SEQ ID NO: 111134 - protein, 15 aa, Borrelia garinii PBi
GPVLTSEEFERLEAL

SEQ ID NO: 111135 - protein, 15 aa, Borrelia garinii PBi
PVLTSEEFERLEALK

SEQ ID NO: 111136 - protein, 15 aa, Borrelia garinii PBi
VLTSEEFERLEALKT

SEQ ID NO: 111137 - protein, 15 aa, Borrelia garinii PBi
LTSEEFERLEALKTF

SEQ ID NO: 111138 - protein, 15 aa, Borrelia garinii PBi
TSEEFERLEALKTFL

SEQ ID NO: 111139 - protein, 15 aa, Borrelia garinii PBi
SEEFERLEALKTFLK

SEQ ID NO: 111140 - protein, 15 aa, Borrelia garinii PBi
EEFERLEALKTFLKD

SEQ ID NO: 111141 - protein, 15 aa, Borrelia garinii PBi
EFERLEALKTFLKDA

SEQ ID NO: 111142 - protein, 15 aa, Borrelia garinii PBi
FERLEALKTFLKDAM

SEQ ID NO: 111143 - protein, 15 aa, Borrelia garinii PBi
ERLEALKTFLKDAMG

SEQ ID NO: 111144 - protein, 15 aa, Borrelia garinii PBi
RLEALKTFLKDAMGV

SEQ ID NO: 111145 - protein, 15 aa, Borrelia garinii PBi
LEALKTFLKDAMGVN

SEQ ID NO: 111146 - protein, 15 aa, Borrelia garinii PBi
EALKTFLKDAMGVNG

SEQ ID NO: 111147 - protein, 15 aa, Borrelia garinii PBi
ALKTFLKDAMGVNGR

SEQ ID NO: 111148 - protein, 15 aa, Borrelia garinii PBi
LKTFLKDAMGVNGRE

SEQ ID NO: 111149 - protein, 15 aa, Borrelia garinii PBi
KTFLKDAMGVNGREG

SEQ ID NO: 111150 - protein, 15 aa, Borrelia garinii PBi
TFLKDAMGVNGREGD

SEQ ID NO: 111151 - protein, 15 aa, Borrelia garinii PBi
FLKDAMGVNGREGDT

SEQ ID NO: 111152 - protein, 15 aa, Borrelia garinii PBi
LKDAMGVNGREGDTK

SEQ ID NO: 111153 - protein, 15 aa, Borrelia garinii PBi
KDAMGVNGREGDTKA

SEQ ID NO: 111154 - protein, 15 aa, Borrelia garinii PBi
DAMGVNGREGDTKAE

SEQ ID NO: 111155 - protein, 15 aa, Borrelia garinii PBi
AMGVNGREGDTKAEY

SEQ ID NO: 111156 - protein, 15 aa, Borrelia garinii PBi
MGVNGREGDTKAEYE

SEQ ID NO: 111157 - protein, 15 aa, Borrelia garinii PBi
GVNGREGDTKAEYEK

SEQ ID NO: 111158 - protein, 15 aa, Borrelia garinii PBi
VNGREGDTKAEYEKS

SEQ ID NO: 111159 - protein, 15 aa, Borrelia garinii PBi
NGREGDTKAEYEKSY

SEQ ID NO: 111160 - protein, 15 aa, Borrelia garinii PBi
GREGDTKAEYEKSYK

SEQ ID NO: 111161 - protein, 15 aa, Borrelia garinii PBi
REGDTKAEYEKSYKE

SEQ ID NO: 111162 - protein, 15 aa, Borrelia garinii PBi
EGDTKAEYEKSYKEF

SEQ ID NO: 111163 - protein, 15 aa, Borrelia garinii PBi
GDTKAEYEKSYKEFF

SEQ ID NO: 111164 - protein, 15 aa, Borrelia garinii PBi
DTKAEYEKSYKEFFD

SEQ ID NO: 111165 - protein, 15 aa, Borrelia garinii PBi
TKAEYEKSYKEFFDW

SEQ ID NO: 111166 - protein, 15 aa, Borrelia garinii PBi
KAEYEKSYKEFFDWL

SEQ ID NO: 111167 - protein, 15 aa, Borrelia garinii PBi
AEYEKSYKEFFDWLS

SEQ ID NO: 111168 - protein, 15 aa, Borrelia garinii PBi
EYEKSYKEFFDWLSK

SEQ ID NO: 111169 - protein, 15 aa, Borrelia garinii PBi
YEKSYKEFFDWLSKD

SEQ ID NO: 111170 - protein, 15 aa, Borrelia garinii PBi
EKSYKEFFDWLSKDV

SEQ ID NO: 111171 - protein, 15 aa, Borrelia garinii PBi
KSYKEFFDWLSKDVN

SEQ ID NO: 111172 - protein, 15 aa, Borrelia garinii PBi
SYKEFFDWLSKDVNR

SEQ ID NO: 111173 - protein, 15 aa, Borrelia garinii PBi
YKEFFDWLSKDVNRQ

SEQ ID NO: 111174 - protein, 15 aa, Borrelia garinii PBi
KEFFDWLSKDVNRQK

SEQ ID NO: 111175 - protein, 15 aa, Borrelia garinii PBi
EFFDWLSKDVNRQKE

SEQ ID NO: 111176 - protein, 15 aa, Borrelia garinii PBi
FFDWLSKDVNRQKEF

SEQ ID NO: 111177 - protein, 15 aa, Borrelia garinii PBi
FDWLSKDVNRQKEFV

SEQ ID NO: 111178 - protein, 15 aa, Borrelia garinii PBi
DWLSKDVNRQKEFVS

SEQ ID NO: 111179 - protein, 15 aa, Borrelia garinii PBi
WLSKDVNRQKEFVSF

SEQ ID NO: 111180 - protein, 15 aa, Borrelia garinii PBi
LSKDVNRQKEFVSFF

SEQ ID NO: 111181 - protein, 15 aa, Borrelia garinii PBi
SKDVNRQKEFVSFFN

SEQ ID NO: 111182 - protein, 15 aa, Borrelia garinii PBi
KDVNRQKEFVSFFNN

SEQ ID NO: 111183 - protein, 15 aa, Borrelia garinii PBi
DVNRQKEFVSFFNNI

SEQ ID NO: 111184 - protein, 15 aa, Borrelia garinii PBi
VNRQKEFVSFFNNIC

SEQ ID NO: 111185 - protein, 15 aa, Borrelia garinii PBi
NRQKEFVSFFNNICG

SEQ ID NO: 111186 - protein, 15 aa, Borrelia garinii PBi
RQKEFVSFFNNICGI

SEQ ID NO: 111187 - protein, 15 aa, Borrelia garinii PBi
QKEFVSFFNNICGII

SEQ ID NO: 111188 - protein, 15 aa, Borrelia garinii PBi
KEFVSFFNNICGIIT

SEQ ID NO: 111189 - protein, 15 aa, Borrelia garinii PBi
EFVSFFNNICGIITK

SEQ ID NO: 111190 - protein, 15 aa, Borrelia garinii PBi
FVSFFNNICGIITKA

SEQ ID NO: 111191 - protein, 15 aa, Borrelia garinii PBi
VSFFNNICGIITKAV

SEQ ID NO: 111192 - protein, 15 aa, Borrelia garinii PBi
SFFNNICGIITKAVD

SEQ ID NO: 111193 - protein, 15 aa, Borrelia garinii PBi
FFNNICGIITKAVDA

SEQ ID NO: 111194 - protein, 15 aa, Borrelia garinii PBi
FNNICGIITKAVDAS

SEQ ID NO: 111195 - protein, 15 aa, Borrelia garinii PBi
NNICGIITKAVDASK

SEQ ID NO: 111196 - protein, 15 aa, Borrelia garinii PBi
NICGIITKAVDASKK

SEQ ID NO: 111197 - protein, 15 aa, Borrelia garinii PBi
ICGIITKAVDASKKR

SEQ ID NO: 111198 - protein, 15 aa, Borrelia garinii PBi
CGIITKAVDASKKRY

SEQ ID NO: 111199 - protein, 15 aa, Borrelia garinii PBi
GIITKAVDASKKRYN

SEQ ID NO: 111200 - protein, 15 aa, Borrelia garinii PBi
IITKAVDASKKRYNS

SEQ ID NO: 111201 - protein, 15 aa, Borrelia garinii PBi
ITKAVDASKKRYNSN

SEQ ID NO: 111202 - protein, 15 aa, Borrelia garinii PBi
TKAVDASKKRYNSNP

SEQ ID NO: 111203 - protein, 15 aa, Borrelia garinii PBi
KAVDASKKRYNSNPK

SEQ ID NO: 111204 - protein, 15 aa, Borrelia garinii PBi
AVDASKKRYNSNPKS

SEQ ID NO: 111205 - protein, 15 aa, Borrelia garinii PBi
VDASKKRYNSNPKSL

SEQ ID NO: 111206 - protein, 15 aa, Borrelia garinii PBi
DASKKRYNSNPKSLG

SEQ ID NO: 111207 - protein, 15 aa, Borrelia garinii PBi
ASKKRYNSNPKSLGF

SEQ ID NO: 111208 - protein, 15 aa, Borrelia garinii PBi
SKKRYNSNPKSLGFN

SEQ ID NO: 111209 - protein, 15 aa, Borrelia garinii PBi
KKRYNSNPKSLGFNE

SEQ ID NO: 111210 - protein, 15 aa, Borrelia garinii PBi
KRYNSNPKSLGFNEY

SEQ ID NO: 111211 - protein, 15 aa, Borrelia garinii PBi
RYNSNPKSLGFNEYV

SEQ ID NO: 111212 - protein, 15 aa, Borrelia garinii PBi
YNSNPKSLGFNEYVC

SEQ ID NO: 111213 - protein, 15 aa, Borrelia garinii PBi
NSNPKSLGFNEYVCY

SEQ ID NO: 111214 - protein, 15 aa, Borrelia garinii PBi
SNPKSLGFNEYVCYD

SEQ ID NO: 111215 - protein, 15 aa, Borrelia garinii PBi
NPKSLGFNEYVCYDI

SEQ ID NO: 111216 - protein, 15 aa, Borrelia garinii PBi
PKSLGFNEYVCYDIK

SEQ ID NO: 111217 - protein, 15 aa, Borrelia garinii PBi
KSLGFNEYVCYDIKT

SEQ ID NO: 111218 - protein, 15 aa, Borrelia garinii PBi
SLGFNEYVCYDIKTR

SEQ ID NO: 111219 - protein, 15 aa, Borrelia garinii PBi
LGFNEYVCYDIKTRT

SEQ ID NO: 111220 - protein, 15 aa, Borrelia garinii PBi
GFNEYVCYDIKTRTG

SEQ ID NO: 111221 - protein, 15 aa, Borrelia garinii PBi
FNEYVCYDIKTRTGD

SEQ ID NO: 111222 - protein, 15 aa, Borrelia garinii PBi
NEYVCYDIKTRTGDD

SEQ ID NO: 111223 - protein, 15 aa, Borrelia garinii PBi
EYVCYDIKTRTGDDL

SEQ ID NO: 111224 - protein, 15 aa, Borrelia garinii PBi
YVCYDIKTRTGDDLS

SEQ ID NO: 111225 - protein, 15 aa, Borrelia garinii PBi
VCYDIKTRTGDDLSL

SEQ ID NO: 111226 - protein, 15 aa, Borrelia garinii PBi
CYDIKTRTGDDLSLF

SEQ ID NO: 111227 - protein, 15 aa, Borrelia garinii PBi
YDIKTRTGDDLSLFF

SEQ ID NO: 111228 - protein, 15 aa, Borrelia garinii PBi
DIKTRTGDDLSLFFQ

SEQ ID NO: 111229 - protein, 15 aa, Borrelia garinii PBi
IKTRTGDDLSLFFQK

SEQ ID NO: 111230 - protein, 15 aa, Borrelia garinii PBi
KTRTGDDLSLFFQKV

SEQ ID NO: 111231 - protein, 15 aa, Borrelia garinii PBi
TRTGDDLSLFFQKVA

SEQ ID NO: 111232 - protein, 15 aa, Borrelia garinii PBi
RTGDDLSLFFQKVAD

SEQ ID NO: 111233 - protein, 15 aa, Borrelia garinii PBi
TGDDLSLFFQKVADA

SEQ ID NO: 111234 - protein, 15 aa, Borrelia garinii PBi
GDDLSLFFQKVADAF

SEQ ID NO: 111235 - protein, 15 aa, Borrelia garinii PBi
DDLSLFFQKVADAFG

SEQ ID NO: 111236 - protein, 15 aa, Borrelia garinii PBi
DLSLFFQKVADAFGT

SEQ ID NO: 111237 - protein, 15 aa, Borrelia garinii PBi
LSLFFQKVADAFGTQ

SEQ ID NO: 111238 - protein, 15 aa, Borrelia garinii PBi
SLFFQKVADAFGTQE

SEQ ID NO: 111239 - protein, 15 aa, Borrelia garinii PBi
LFFQKVADAFGTQEY

SEQ ID NO: 111240 - protein, 15 aa, Borrelia garinii PBi
FFQKVADAFGTQEYK

SEQ ID NO: 111241 - protein, 15 aa, Borrelia garinii PBi
FQKVADAFGTQEYKN

SEQ ID NO: 111242 - protein, 15 aa, Borrelia garinii PBi
QKVADAFGTQEYKNK

SEQ ID NO: 111243 - protein, 15 aa, Borrelia garinii PBi
KVADAFGTQEYKNKD

SEQ ID NO: 111244 - protein, 15 aa, Borrelia garinii PBi
VADAFGTQEYKNKDE

SEQ ID NO: 111245 - protein, 15 aa, Borrelia garinii PBi
ADAFGTQEYKNKDED

SEQ ID NO: 111246 - protein, 15 aa, Borrelia garinii PBi
DAFGTQEYKNKDEDD

SEQ ID NO: 111247 - protein, 15 aa, Borrelia garinii PBi
AFGTQEYKNKDEDDE

SEQ ID NO: 111248 - protein, 15 aa, Borrelia garinii PBi
FGTQEYKNKDEDDEN

SEQ ID NO: 111249 - protein, 15 aa, Borrelia garinii PBi
GTQEYKNKDEDDENN

SEQ ID NO: 111250 - protein, 15 aa, Borrelia garinii PBi
TQEYKNKDEDDENNQ

SEQ ID NO: 111251 - protein, 15 aa, Borrelia garinii PBi
QEYKNKDEDDENNQK

SEQ ID NO: 111252 - protein, 15 aa, Borrelia garinii PBi
EYKNKDEDDENNQKP

SEQ ID NO: 111253 - protein, 15 aa, Borrelia garinii PBi
YKNKDEDDENNQKPE

SEQ ID NO: 111254 - protein, 15 aa, Borrelia garinii PBi
KNKDEDDENNQKPEK

SEQ ID NO: 111255 - protein, 15 aa, Borrelia garinii PBi
NKDEDDENNQKPEKC

SEQ ID NO: 111256 - protein, 15 aa, Borrelia garinii PBi
KDEDDENNQKPEKCN

SEQ ID NO: 111257 - protein, 15 aa, Borrelia garinii PBi
DEDDENNQKPEKCNE

SEQ ID NO: 111258 - protein, 15 aa, Borrelia garinii PBi
EDDENNQKPEKCNEE

SEQ ID NO: 111259 - protein, 15 aa, Borrelia garinii PBi
DDENNQKPEKCNEEI

SEQ ID NO: 111260 - protein, 15 aa, Borrelia garinii PBi
DENNQKPEKCNEEIF

SEQ ID NO: 111261 - protein, 15 aa, Borrelia garinii PBi
ENNQKPEKCNEEIFK

SEQ ID NO: 111262 - protein, 15 aa, Borrelia garinii PBi
NNQKPEKCNEEIFKV

SEQ ID NO: 111263 - protein, 15 aa, Borrelia garinii PBi
NQKPEKCNEEIFKVI

SEQ ID NO: 111264 - protein, 15 aa, Borrelia garinii PBi
QKPEKCNEEIFKVIK

SEQ ID NO: 111265 - protein, 15 aa, Borrelia garinii PBi
KPEKCNEEIFKVIKR

SEQ ID NO: 111266 - protein, 15 aa, Borrelia garinii PBi
PEKCNEEIFKVIKRV

SEQ ID NO: 111267 - protein, 15 aa, Borrelia garinii PBi
EKCNEEIFKVIKRVF

SEQ ID NO: 111268 - protein, 15 aa, Borrelia garinii PBi
KCNEEIFKVIKRVFT

SEQ ID NO: 111269 - protein, 15 aa, Borrelia garinii PBi
CNEEIFKVIKRVFTE

SEQ ID NO: 111270 - protein, 15 aa, Borrelia garinii PBi
NEEIFKVIKRVFTES

SEQ ID NO: 111271 - protein, 15 aa, Borrelia garinii PBi
EEIFKVIKRVFTESE

SEQ ID NO: 111272 - protein, 15 aa, Borrelia garinii PBi
EIFKVIKRVFTESEN

SEQ ID NO: 111273 - protein, 15 aa, Borrelia garinii PBi
IFKVIKRVFTESENN

SEQ ID NO: 111274 - protein, 15 aa, Borrelia garinii PBi
FKVIKRVFTESENNN

SEQ ID NO: 111275 - protein, 15 aa, Borrelia garinii PBi
KVIKRVFTESENNNE

SEQ ID NO: 111276 - protein, 15 aa, Borrelia garinii PBi
VIKRVFTESENNNEL

SEQ ID NO: 111277 - protein, 15 aa, Borrelia garinii PBi
IKRVFTESENNNELA

SEQ ID NO: 111278 - protein, 15 aa, Borrelia garinii PBi
KRVFTESENNNELAN

SEQ ID NO: 111279 - protein, 15 aa, Borrelia garinii PBi
RVFTESENNNELANL

SEQ ID NO: 111280 - protein, 15 aa, Borrelia garinii PBi
VFTESENNNELANLK

SEQ ID NO: 111281 - protein, 15 aa, Borrelia garinii PBi
FTESENNNELANLKN

SEQ ID NO: 111282 - protein, 15 aa, Borrelia garinii PBi
TESENNNELANLKNL

SEQ ID NO: 111283 - protein, 15 aa, Borrelia garinii PBi
ESENNNELANLKNLN

SEQ ID NO: 111284 - protein, 15 aa, Borrelia garinii PBi
SENNNELANLKNLNS

SEQ ID NO: 111285 - protein, 15 aa, Borrelia garinii PBi
ENNNELANLKNLNSY

SEQ ID NO: 111286 - protein, 15 aa, Borrelia garinii PBi
NNNELANLKNLNSYN

SEQ ID NO: 111287 - protein, 15 aa, Borrelia garinii PBi
NNELANLKNLNSYNL

SEQ ID NO: 111288 - protein, 15 aa, Borrelia garinii PBi
NELANLKNLNSYNLN

SEQ ID NO: 111289 - protein, 15 aa, Borrelia garinii PBi
ELANLKNLNSYNLNS

SEQ ID NO: 111290 - protein, 15 aa, Borrelia garinii PBi
LANLKNLNSYNLNSN

SEQ ID NO: 111291 - protein, 15 aa, Borrelia garinii PBi
ANLKNLNSYNLNSNN

SEQ ID NO: 111292 - protein, 15 aa, Borrelia garinii PBi
NLKNLNSYNLNSNNK

SEQ ID NO: 111293 - protein, 16 aa, Borrelia garinii PBi
MKRISILSILLLLLLF

SEQ ID NO: 111294 - protein, 16 aa, Borrelia garinii PBi
KRISILSILLLLLLFS

SEQ ID NO: 111295 - protein, 16 aa, Borrelia garinii PBi
RISILSILLLLLLFSC

SEQ ID NO: 111296 - protein, 16 aa, Borrelia garinii PBi
ISILSILLLLLLFSCK

SEQ ID NO: 111297 - protein, 16 aa, Borrelia garinii PBi
SILSILLLLLLFSCKQ

SEQ ID NO: 111298 - protein, 16 aa, Borrelia garinii PBi
ILSILLLLLLFSCKQY

SEQ ID NO: 111299 - protein, 16 aa, Borrelia garinii PBi
LSILLLLLLFSCKQYG

SEQ ID NO: 111300 - protein, 16 aa, Borrelia garinii PBi
SILLLLLLFSCKQYGD

SEQ ID NO: 111301 - protein, 16 aa, Borrelia garinii PBi
ILLLLLLFSCKQYGDV

SEQ ID NO: 111302 - protein, 16 aa, Borrelia garinii PBi
LLLLLLFSCKQYGDVK

SEQ ID NO: 111303 - protein, 16 aa, Borrelia garinii PBi
LLLLLFSCKQYGDVKS

SEQ ID NO: 111304 - protein, 16 aa, Borrelia garinii PBi
LLLLFSCKQYGDVKSL

SEQ ID NO: 111305 - protein, 16 aa, Borrelia garinii PBi
LLLFSCKQYGDVKSLT

SEQ ID NO: 111306 - protein, 16 aa, Borrelia garinii PBi
LLFSCKQYGDVKSLTE

SEQ ID NO: 111307 - protein, 16 aa, Borrelia garinii PBi
LFSCKQYGDVKSLTEV

SEQ ID NO: 111308 - protein, 16 aa, Borrelia garinii PBi
FSCKQYGDVKSLTEVA

SEQ ID NO: 111309 - protein, 16 aa, Borrelia garinii PBi
SCKQYGDVKSLTEVAT

SEQ ID NO: 111310 - protein, 16 aa, Borrelia garinii PBi
CKQYGDVKSLTEVATD

SEQ ID NO: 111311 - protein, 16 aa, Borrelia garinii PBi
KQYGDVKSLTEVATDL

SEQ ID NO: 111312 - protein, 16 aa, Borrelia garinii PBi
QYGDVKSLTEVATDLE

SEQ ID NO: 111313 - protein, 16 aa, Borrelia garinii PBi
YGDVKSLTEVATDLED

SEQ ID NO: 111314 - protein, 16 aa, Borrelia garinii PBi
GDVKSLTEVATDLEDD

SEQ ID NO: 111315 - protein, 16 aa, Borrelia garinii PBi
DVKSLTEVATDLEDDN

SEQ ID NO: 111316 - protein, 16 aa, Borrelia garinii PBi
VKSLTEVATDLEDDNS

SEQ ID NO: 111317 - protein, 16 aa, Borrelia garinii PBi
KSLTEVATDLEDDNSF

SEQ ID NO: 111318 - protein, 16 aa, Borrelia garinii PBi
SLTEVATDLEDDNSFA

SEQ ID NO: 111319 - protein, 16 aa, Borrelia garinii PBi
LTEVATDLEDDNSFAS

SEQ ID NO: 111320 - protein, 16 aa, Borrelia garinii PBi
TEVATDLEDDNSFASG

SEQ ID NO: 111321 - protein, 16 aa, Borrelia garinii PBi
EVATDLEDDNSFASGS

SEQ ID NO: 111322 - protein, 16 aa, Borrelia garinii PBi
VATDLEDDNSFASGSV

SEQ ID NO: 111323 - protein, 16 aa, Borrelia garinii PBi
ATDLEDDNSFASGSVE

SEQ ID NO: 111324 - protein, 16 aa, Borrelia garinii PBi
TDLEDDNSFASGSVES

SEQ ID NO: 111325 - protein, 16 aa, Borrelia garinii PBi
DLEDDNSFASGSVESK

SEQ ID NO: 111326 - protein, 16 aa, Borrelia garinii PBi
LEDDNSFASGSVESKD

SEQ ID NO: 111327 - protein, 16 aa, Borrelia garinii PBi
EDDNSFASGSVESKDQ

SEQ ID NO: 111328 - protein, 16 aa, Borrelia garinii PBi
DDNSFASGSVESKDQI

SEQ ID NO: 111329 - protein, 16 aa, Borrelia garinii PBi
DNSFASGSVESKDQII

SEQ ID NO: 111330 - protein, 16 aa, Borrelia garinii PBi
NSFASGSVESKDQIIE

SEQ ID NO: 111331 - protein, 16 aa, Borrelia garinii PBi
SFASGSVESKDQIIEK

SEQ ID NO: 111332 - protein, 16 aa, Borrelia garinii PBi
FASGSVESKDQIIEKG

SEQ ID NO: 111333 - protein, 16 aa, Borrelia garinii PBi
ASGSVESKDQIIEKGP

SEQ ID NO: 111334 - protein, 16 aa, Borrelia garinii PBi
SGSVESKDQIIEKGPV

SEQ ID NO: 111335 - protein, 16 aa, Borrelia garinii PBi
GSVESKDQIIEKGPVL

SEQ ID NO: 111336 - protein, 16 aa, Borrelia garinii PBi
SVESKDQIIEKGPVLT

SEQ ID NO: 111337 - protein, 16 aa, Borrelia garinii PBi
VESKDQIIEKGPVLTS

SEQ ID NO: 111338 - protein, 16 aa, Borrelia garinii PBi
ESKDQIIEKGPVLTSE

SEQ ID NO: 111339 - protein, 16 aa, Borrelia garinii PBi
SKDQIIEKGPVLTSEE

SEQ ID NO: 111340 - protein, 16 aa, Borrelia garinii PBi
KDQIIEKGPVLTSEEF

SEQ ID NO: 111341 - protein, 16 aa, Borrelia garinii PBi
DQIIEKGPVLTSEEFE

SEQ ID NO: 111342 - protein, 16 aa, Borrelia garinii PBi
QIIEKGPVLTSEEFER

SEQ ID NO: 111343 - protein, 16 aa, Borrelia garinii PBi
IIEKGPVLTSEEFERL

SEQ ID NO: 111344 - protein, 16 aa, Borrelia garinii PBi
IEKGPVLTSEEFERLE

SEQ ID NO: 111345 - protein, 16 aa, Borrelia garinii PBi
EKGPVLTSEEFERLEA

SEQ ID NO: 111346 - protein, 16 aa, Borrelia garinii PBi
KGPVLTSEEFERLEAL

SEQ ID NO: 111347 - protein, 16 aa, Borrelia garinii PBi
GPVLTSEEFERLEALK

SEQ ID NO: 111348 - protein, 16 aa, Borrelia garinii PBi
PVLTSEEFERLEALKT

SEQ ID NO: 111349 - protein, 16 aa, Borrelia garinii PBi
VLTSEEFERLEALKTF

SEQ ID NO: 111350 - protein, 16 aa, Borrelia garinii PBi
LTSEEFERLEALKTFL

SEQ ID NO: 111351 - protein, 16 aa, Borrelia garinii PBi
TSEEFERLEALKTFLK

SEQ ID NO: 111352 - protein, 16 aa, Borrelia garinii PBi
SEEFERLEALKTFLKD

SEQ ID NO: 111353 - protein, 16 aa, Borrelia garinii PBi
EEFERLEALKTFLKDA

SEQ ID NO: 111354 - protein, 16 aa, Borrelia garinii PBi
EFERLEALKTFLKDAM

SEQ ID NO: 111355 - protein, 16 aa, Borrelia garinii PBi
FERLEALKTFLKDAMG

SEQ ID NO: 111356 - protein, 16 aa, Borrelia garinii PBi
ERLEALKTFLKDAMGV

SEQ ID NO: 111357 - protein, 16 aa, Borrelia garinii PBi
RLEALKTFLKDAMGVN

SEQ ID NO: 111358 - protein, 16 aa, Borrelia garinii PBi
LEALKTFLKDAMGVNG

SEQ ID NO: 111359 - protein, 16 aa, Borrelia garinii PBi
EALKTFLKDAMGVNGR

SEQ ID NO: 111360 - protein, 16 aa, Borrelia garinii PBi
ALKTFLKDAMGVNGRE

SEQ ID NO: 111361 - protein, 16 aa, Borrelia garinii PBi
LKTFLKDAMGVNGREG

SEQ ID NO: 111362 - protein, 16 aa, Borrelia garinii PBi
KTFLKDAMGVNGREGD

SEQ ID NO: 111363 - protein, 16 aa, Borrelia garinii PBi
TFLKDAMGVNGREGDT

SEQ ID NO: 111364 - protein, 16 aa, Borrelia garinii PBi
FLKDAMGVNGREGDTK

SEQ ID NO: 111365 - protein, 16 aa, Borrelia garinii PBi
LKDAMGVNGREGDTKA

SEQ ID NO: 111366 - protein, 16 aa, Borrelia garinii PBi
KDAMGVNGREGDTKAE

SEQ ID NO: 111367 - protein, 16 aa, Borrelia garinii PBi
DAMGVNGREGDTKAEY

SEQ ID NO: 111368 - protein, 16 aa, Borrelia garinii PBi
AMGVNGREGDTKAEYE

SEQ ID NO: 111369 - protein, 16 aa, Borrelia garinii PBi
MGVNGREGDTKAEYEK

SEQ ID NO: 111370 - protein, 16 aa, Borrelia garinii PBi
GVNGREGDTKAEYEKS

SEQ ID NO: 111371 - protein, 16 aa, Borrelia garinii PBi
VNGREGDTKAEYEKSY

SEQ ID NO: 111372 - protein, 16 aa, Borrelia garinii PBi
NGREGDTKAEYEKSYK

SEQ ID NO: 111373 - protein, 16 aa, Borrelia garinii PBi
GREGDTKAEYEKSYKE

SEQ ID NO: 111374 - protein, 16 aa, Borrelia garinii PBi
REGDTKAEYEKSYKEF

SEQ ID NO: 111375 - protein, 16 aa, Borrelia garinii PBi
EGDTKAEYEKSYKEFF

SEQ ID NO: 111376 - protein, 16 aa, Borrelia garinii PBi
GDTKAEYEKSYKEFFD

SEQ ID NO: 111377 - protein, 16 aa, Borrelia garinii PBi
DTKAEYEKSYKEFFDW

SEQ ID NO: 111378 - protein, 16 aa, Borrelia garinii PBi
TKAEYEKSYKEFFDWL

SEQ ID NO: 111379 - protein, 16 aa, Borrelia garinii PBi
KAEYEKSYKEFFDWLS

SEQ ID NO: 111380 - protein, 16 aa, Borrelia garinii PBi
AEYEKSYKEFFDWLSK

SEQ ID NO: 111381 - protein, 16 aa, Borrelia garinii PBi
EYEKSYKEFFDWLSKD

SEQ ID NO: 111382 - protein, 16 aa, Borrelia garinii PBi
YEKSYKEFFDWLSKDV

SEQ ID NO: 111383 - protein, 16 aa, Borrelia garinii PBi
EKSYKEFFDWLSKDVN

SEQ ID NO: 111384 - protein, 16 aa, Borrelia garinii PBi
KSYKEFFDWLSKDVNR

SEQ ID NO: 111385 - protein, 16 aa, Borrelia garinii PBi
SYKEFFDWLSKDVNRQ

SEQ ID NO: 111386 - protein, 16 aa, Borrelia garinii PBi
YKEFFDWLSKDVNRQK

SEQ ID NO: 111387 - protein, 16 aa, Borrelia garinii PBi
KEFFDWLSKDVNRQKE

SEQ ID NO: 111388 - protein, 16 aa, Borrelia garinii PBi
EFFDWLSKDVNRQKEF

SEQ ID NO: 111389 - protein, 16 aa, Borrelia garinii PBi
FFDWLSKDVNRQKEFV

SEQ ID NO: 111390 - protein, 16 aa, Borrelia garinii PBi
FDWLSKDVNRQKEFVS

SEQ ID NO: 111391 - protein, 16 aa, Borrelia garinii PBi
DWLSKDVNRQKEFVSF

SEQ ID NO: 111392 - protein, 16 aa, Borrelia garinii PBi
WLSKDVNRQKEFVSFF

SEQ ID NO: 111393 - protein, 16 aa, Borrelia garinii PBi
LSKDVNRQKEFVSFFN

SEQ ID NO: 111394 - protein, 16 aa, Borrelia garinii PBi
SKDVNRQKEFVSFFNN

SEQ ID NO: 111395 - protein, 16 aa, Borrelia garinii PBi
KDVNRQKEFVSFFNNI

SEQ ID NO: 111396 - protein, 16 aa, Borrelia garinii PBi
DVNRQKEFVSFFNNIC

SEQ ID NO: 111397 - protein, 16 aa, Borrelia garinii PBi
VNRQKEFVSFFNNICG

SEQ ID NO: 111398 - protein, 16 aa, Borrelia garinii PBi
NRQKEFVSFFNNICGI

SEQ ID NO: 111399 - protein, 16 aa, Borrelia garinii PBi
RQKEFVSFFNNICGII

SEQ ID NO: 111400 - protein, 16 aa, Borrelia garinii PBi
QKEFVSFFNNICGIIT

SEQ ID NO: 111401 - protein, 16 aa, Borrelia garinii PBi
KEFVSFFNNICGIITK

SEQ ID NO: 111402 - protein, 16 aa, Borrelia garinii PBi
EFVSFFNNICGIITKA

SEQ ID NO: 111403 - protein, 16 aa, Borrelia garinii PBi
FVSFFNNICGIITKAV

SEQ ID NO: 111404 - protein, 16 aa, Borrelia garinii PBi
VSFFNNICGIITKAVD

SEQ ID NO: 111405 - protein, 16 aa, Borrelia garinii PBi
SFFNNICGIITKAVDA

SEQ ID NO: 111406 - protein, 16 aa, Borrelia garinii PBi
FFNNICGIITKAVDAS

SEQ ID NO: 111407 - protein, 16 aa, Borrelia garinii PBi
FNNICGIITKAVDASK

SEQ ID NO: 111408 - protein, 16 aa, Borrelia garinii PBi
NNICGIITKAVDASKK

SEQ ID NO: 111409 - protein, 16 aa, Borrelia garinii PBi
NICGIITKAVDASKKR

SEQ ID NO: 111410 - protein, 16 aa, Borrelia garinii PBi
ICGIITKAVDASKKRY

SEQ ID NO: 111411 - protein, 16 aa, Borrelia garinii PBi
CGIITKAVDASKKRYN

SEQ ID NO: 111412 - protein, 16 aa, Borrelia garinii PBi
GIITKAVDASKKRYNS

SEQ ID NO: 111413 - protein, 16 aa, Borrelia garinii PBi
IITKAVDASKKRYNSN

SEQ ID NO: 111414 - protein, 16 aa, Borrelia garinii PBi
ITKAVDASKKRYNSNP

SEQ ID NO: 111415 - protein, 16 aa, Borrelia garinii PBi
TKAVDASKKRYNSNPK

SEQ ID NO: 111416 - protein, 16 aa, Borrelia garinii PBi
KAVDASKKRYNSNPKS

SEQ ID NO: 111417 - protein, 16 aa, Borrelia garinii PBi
AVDASKKRYNSNPKSL

SEQ ID NO: 111418 - protein, 16 aa, Borrelia garinii PBi
VDASKKRYNSNPKSLG

SEQ ID NO: 111419 - protein, 16 aa, Borrelia garinii PBi
DASKKRYNSNPKSLGF

SEQ ID NO: 111420 - protein, 16 aa, Borrelia garinii PBi
ASKKRYNSNPKSLGFN

SEQ ID NO: 111421 - protein, 16 aa, Borrelia garinii PBi
SKKRYNSNPKSLGFNE

SEQ ID NO: 111422 - protein, 16 aa, Borrelia garinii PBi
KKRYNSNPKSLGFNEY

SEQ ID NO: 111423 - protein, 16 aa, Borrelia garinii PBi
KRYNSNPKSLGFNEYV

SEQ ID NO: 111424 - protein, 16 aa, Borrelia garinii PBi
RYNSNPKSLGFNEYVC

SEQ ID NO: 111425 - protein, 16 aa, Borrelia garinii PBi
YNSNPKSLGFNEYVCY

SEQ ID NO: 111426 - protein, 16 aa, Borrelia garinii PBi
NSNPKSLGFNEYVCYD

SEQ ID NO: 111427 - protein, 16 aa, Borrelia garinii PBi
SNPKSLGFNEYVCYDI

SEQ ID NO: 111428 - protein, 16 aa, Borrelia garinii PBi
NPKSLGFNEYVCYDIK

SEQ ID NO: 111429 - protein, 16 aa, Borrelia garinii PBi
PKSLGFNEYVCYDIKT

SEQ ID NO: 111430 - protein, 16 aa, Borrelia garinii PBi
KSLGFNEYVCYDIKTR

SEQ ID NO: 111431 - protein, 16 aa, Borrelia garinii PBi
SLGFNEYVCYDIKTRT

SEQ ID NO: 111432 - protein, 16 aa, Borrelia garinii PBi
LGFNEYVCYDIKTRTG

SEQ ID NO: 111433 - protein, 16 aa, Borrelia garinii PBi
GFNEYVCYDIKTRTGD

SEQ ID NO: 111434 - protein, 16 aa, Borrelia garinii PBi
FNEYVCYDIKTRTGDD

SEQ ID NO: 111435 - protein, 16 aa, Borrelia garinii PBi
NEYVCYDIKTRTGDDL

SEQ ID NO: 111436 - protein, 16 aa, Borrelia garinii PBi
EYVCYDIKTRTGDDLS

SEQ ID NO: 111437 - protein, 16 aa, Borrelia garinii PBi
YVCYDIKTRTGDDLSL

SEQ ID NO: 111438 - protein, 16 aa, Borrelia garinii PBi
VCYDIKTRTGDDLSLF

SEQ ID NO: 111439 - protein, 16 aa, Borrelia garinii PBi
CYDIKTRTGDDLSLFF

SEQ ID NO: 111440 - protein, 16 aa, Borrelia garinii PBi
YDIKTRTGDDLSLFFQ

SEQ ID NO: 111441 - protein, 16 aa, Borrelia garinii PBi
DIKTRTGDDLSLFFQK

SEQ ID NO: 111442 - protein, 16 aa, Borrelia garinii PBi
IKTRTGDDLSLFFQKV

SEQ ID NO: 111443 - protein, 16 aa, Borrelia garinii PBi
KTRTGDDLSLFFQKVA

SEQ ID NO: 111444 - protein, 16 aa, Borrelia garinii PBi
TRTGDDLSLFFQKVAD

SEQ ID NO: 111445 - protein, 16 aa, Borrelia garinii PBi
RTGDDLSLFFQKVADA

SEQ ID NO: 111446 - protein, 16 aa, Borrelia garinii PBi
TGDDLSLFFQKVADAF

SEQ ID NO: 111447 - protein, 16 aa, Borrelia garinii PBi
GDDLSLFFQKVADAFG

SEQ ID NO: 111448 - protein, 16 aa, Borrelia garinii PBi
DDLSLFFQKVADAFGT

SEQ ID NO: 111449 - protein, 16 aa, Borrelia garinii PBi
DLSLFFQKVADAFGTQ

SEQ ID NO: 111450 - protein, 16 aa, Borrelia garinii PBi
LSLFFQKVADAFGTQE

SEQ ID NO: 111451 - protein, 16 aa, Borrelia garinii PBi
SLFFQKVADAFGTQEY

SEQ ID NO: 111452 - protein, 16 aa, Borrelia garinii PBi
LFFQKVADAFGTQEYK

SEQ ID NO: 111453 - protein, 16 aa, Borrelia garinii PBi
FFQKVADAFGTQEYKN

SEQ ID NO: 111454 - protein, 16 aa, Borrelia garinii PBi
FQKVADAFGTQEYKNK

SEQ ID NO: 111455 - protein, 16 aa, Borrelia garinii PBi
QKVADAFGTQEYKNKD

SEQ ID NO: 111456 - protein, 16 aa, Borrelia garinii PBi
KVADAFGTQEYKNKDE

SEQ ID NO: 111457 - protein, 16 aa, Borrelia garinii PBi
VADAFGTQEYKNKDED

SEQ ID NO: 111458 - protein, 16 aa, Borrelia garinii PBi
ADAFGTQEYKNKDEDD

SEQ ID NO: 111459 - protein, 16 aa, Borrelia garinii PBi
DAFGTQEYKNKDEDDE

SEQ ID NO: 111460 - protein, 16 aa, Borrelia garinii PBi
AFGTQEYKNKDEDDEN

SEQ ID NO: 111461 - protein, 16 aa, Borrelia garinii PBi
FGTQEYKNKDEDDENN

SEQ ID NO: 111462 - protein, 16 aa, Borrelia garinii PBi
GTQEYKNKDEDDENNQ

SEQ ID NO: 111463 - protein, 16 aa, Borrelia garinii PBi
TQEYKNKDEDDENNQK

SEQ ID NO: 111464 - protein, 16 aa, Borrelia garinii PBi
QEYKNKDEDDENNQKP

SEQ ID NO: 111465 - protein, 16 aa, Borrelia garinii PBi
EYKNKDEDDENNQKPE

SEQ ID NO: 111466 - protein, 16 aa, Borrelia garinii PBi
YKNKDEDDENNQKPEK

SEQ ID NO: 111467 - protein, 16 aa, Borrelia garinii PBi
KNKDEDDENNQKPEKC

SEQ ID NO: 111468 - protein, 16 aa, Borrelia garinii PBi
NKDEDDENNQKPEKCN

SEQ ID NO: 111469 - protein, 16 aa, Borrelia garinii PBi
KDEDDENNQKPEKCNE

SEQ ID NO: 111470 - protein, 16 aa, Borrelia garinii PBi
DEDDENNQKPEKCNEE

SEQ ID NO: 111471 - protein, 16 aa, Borrelia garinii PBi
EDDENNQKPEKCNEEI

SEQ ID NO: 111472 - protein, 16 aa, Borrelia garinii PBi
DDENNQKPEKCNEEIF

SEQ ID NO: 111473 - protein, 16 aa, Borrelia garinii PBi
DENNQKPEKCNEEIFK

SEQ ID NO: 111474 - protein, 16 aa, Borrelia garinii PBi
ENNQKPEKCNEEIFKV

SEQ ID NO: 111475 - protein, 16 aa, Borrelia garinii PBi
NNQKPEKCNEEIFKVI

SEQ ID NO: 111476 - protein, 16 aa, Borrelia garinii PBi
NQKPEKCNEEIFKVIK

SEQ ID NO: 111477 - protein, 16 aa, Borrelia garinii PBi
QKPEKCNEEIFKVIKR

SEQ ID NO: 111478 - protein, 16 aa, Borrelia garinii PBi
KPEKCNEEIFKVIKRV

SEQ ID NO: 111479 - protein, 16 aa, Borrelia garinii PBi
PEKCNEEIFKVIKRVF

SEQ ID NO: 111480 - protein, 16 aa, Borrelia garinii PBi
EKCNEEIFKVIKRVFT

SEQ ID NO: 111481 - protein, 16 aa, Borrelia garinii PBi
KCNEEIFKVIKRVFTE

SEQ ID NO: 111482 - protein, 16 aa, Borrelia garinii PBi
CNEEIFKVIKRVFTES

SEQ ID NO: 111483 - protein, 16 aa, Borrelia garinii PBi
NEEIFKVIKRVFTESE

SEQ ID NO: 111484 - protein, 16 aa, Borrelia garinii PBi
EEIFKVIKRVFTESEN

SEQ ID NO: 111485 - protein, 16 aa, Borrelia garinii PBi
EIFKVIKRVFTESENN

SEQ ID NO: 111486 - protein, 16 aa, Borrelia garinii PBi
IFKVIKRVFTESENNN

SEQ ID NO: 111487 - protein, 16 aa, Borrelia garinii PBi
FKVIKRVFTESENNNE

SEQ ID NO: 111488 - protein, 16 aa, Borrelia garinii PBi
KVIKRVFTESENNNEL

SEQ ID NO: 111489 - protein, 16 aa, Borrelia garinii PBi
VIKRVFTESENNNELA

SEQ ID NO: 111490 - protein, 16 aa, Borrelia garinii PBi
IKRVFTESENNNELAN

SEQ ID NO: 111491 - protein, 16 aa, Borrelia garinii PBi
KRVFTESENNNELANL

SEQ ID NO: 111492 - protein, 16 aa, Borrelia garinii PBi
RVFTESENNNELANLK

SEQ ID NO: 111493 - protein, 16 aa, Borrelia garinii PBi
VFTESENNNELANLKN

SEQ ID NO: 111494 - protein, 16 aa, Borrelia garinii PBi
FTESENNNELANLKNL

SEQ ID NO: 111495 - protein, 16 aa, Borrelia garinii PBi
TESENNNELANLKNLN

SEQ ID NO: 111496 - protein, 16 aa, Borrelia garinii PBi
ESENNNELANLKNLNS

SEQ ID NO: 111497 - protein, 16 aa, Borrelia garinii PBi
SENNNELANLKNLNSY

SEQ ID NO: 111498 - protein, 16 aa, Borrelia garinii PBi
ENNNELANLKNLNSYN

SEQ ID NO: 111499 - protein, 16 aa, Borrelia garinii PBi
NNNELANLKNLNSYNL

SEQ ID NO: 111500 - protein, 16 aa, Borrelia garinii PBi
NNELANLKNLNSYNLN

SEQ ID NO: 111501 - protein, 16 aa, Borrelia garinii PBi
NELANLKNLNSYNLNS

SEQ ID NO: 111502 - protein, 16 aa, Borrelia garinii PBi
ELANLKNLNSYNLNSN

SEQ ID NO: 111503 - protein, 16 aa, Borrelia garinii PBi
LANLKNLNSYNLNSNN

SEQ ID NO: 111504 - protein, 16 aa, Borrelia garinii PBi
ANLKNLNSYNLNSNNK

SEQ ID NO: 111505 - protein, 13 aa, Borrelia burgdorferi B31
MKIKPLIQLKLLG

SEQ ID NO: 111506 - protein, 13 aa, Borrelia burgdorferi B31
KIKPLIQLKLLGL

SEQ ID NO: 111507 - protein, 13 aa, Borrelia burgdorferi B31
IKPLIQLKLLGLF

SEQ ID NO: 111508 - protein, 13 aa, Borrelia burgdorferi B31
KPLIQLKLLGLFL

SEQ ID NO: 111509 - protein, 13 aa, Borrelia burgdorferi B31
PLIQLKLLGLFLF

SEQ ID NO: 111510 - protein, 13 aa, Borrelia burgdorferi B31
LIQLKLLGLFLFS

SEQ ID NO: 111511 - protein, 13 aa, Borrelia burgdorferi B31
IQLKLLGLFLFSC

SEQ ID NO: 111512 - protein, 13 aa, Borrelia burgdorferi B31
QLKLLGLFLFSCT

SEQ ID NO: 111513 - protein, 13 aa, Borrelia burgdorferi B31
LKLLGLFLFSCTI

SEQ ID NO: 111514 - protein, 13 aa, Borrelia burgdorferi B31
KLLGLFLFSCTID

SEQ ID NO: 111515 - protein, 13 aa, Borrelia burgdorferi B31
LLGLFLFSCTIDA

SEQ ID NO: 111516 - protein, 13 aa, Borrelia burgdorferi B31
LGLFLFSCTIDAN

SEQ ID NO: 111517 - protein, 13 aa, Borrelia burgdorferi B31
GLFLFSCTIDANL

SEQ ID NO: 111518 - protein, 13 aa, Borrelia burgdorferi B31
LFLFSCTIDANLN

SEQ ID NO: 111519 - protein, 13 aa, Borrelia burgdorferi B31
FLFSCTIDANLNE

SEQ ID NO: 111520 - protein, 13 aa, Borrelia burgdorferi B31
LFSCTIDANLNED

SEQ ID NO: 111521 - protein, 13 aa, Borrelia burgdorferi B31
FSCTIDANLNEDY

SEQ ID NO: 111522 - protein, 13 aa, Borrelia burgdorferi B31
SCTIDANLNEDYK

SEQ ID NO: 111523 - protein, 13 aa, Borrelia burgdorferi B31
CTIDANLNEDYKN

SEQ ID NO: 111524 - protein, 13 aa, Borrelia burgdorferi B31
TIDANLNEDYKNK

SEQ ID NO: 111525 - protein, 13 aa, Borrelia burgdorferi B31
IDANLNEDYKNKV

SEQ ID NO: 111526 - protein, 13 aa, Borrelia burgdorferi B31
DANLNEDYKNKVK

SEQ ID NO: 111527 - protein, 13 aa, Borrelia burgdorferi B31
ANLNEDYKNKVKG

SEQ ID NO: 111528 - protein, 13 aa, Borrelia burgdorferi B31
NLNEDYKNKVKGI

SEQ ID NO: 111529 - protein, 13 aa, Borrelia burgdorferi B31
LNEDYKNKVKGIL

SEQ ID NO: 111530 - protein, 13 aa, Borrelia burgdorferi B31
NEDYKNKVKGILN

SEQ ID NO: 111531 - protein, 13 aa, Borrelia burgdorferi B31
EDYKNKVKGILNK

SEQ ID NO: 111532 - protein, 13 aa, Borrelia burgdorferi B31
DYKNKVKGILNKA

SEQ ID NO: 111533 - protein, 13 aa, Borrelia burgdorferi B31
YKNKVKGILNKAA

SEQ ID NO: 111534 - protein, 13 aa, Borrelia burgdorferi B31
KNKVKGILNKAAD

SEQ ID NO: 111535 - protein, 13 aa, Borrelia burgdorferi B31
NKVKGILNKAADD

SEQ ID NO: 111536 - protein, 13 aa, Borrelia burgdorferi B31
KVKGILNKAADDQ

SEQ ID NO: 111537 - protein, 13 aa, Borrelia burgdorferi B31
VKGILNKAADDQE

SEQ ID NO: 111538 - protein, 13 aa, Borrelia burgdorferi B31
KGILNKAADDQET

SEQ ID NO: 111539 - protein, 13 aa, Borrelia burgdorferi B31
GILNKAADDQETT

SEQ ID NO: 111540 - protein, 13 aa, Borrelia burgdorferi B31
ILNKAADDQETTS

SEQ ID NO: 111541 - protein, 13 aa, Borrelia burgdorferi B31
LNKAADDQETTSA

SEQ ID NO: 111542 - protein, 13 aa, Borrelia burgdorferi B31
NKAADDQETTSAD

SEQ ID NO: 111543 - protein, 13 aa, Borrelia burgdorferi B31
KAADDQETTSADT

SEQ ID NO: 111544 - protein, 13 aa, Borrelia burgdorferi B31
AADDQETTSADTN

SEQ ID NO: 111545 - protein, 13 aa, Borrelia burgdorferi B31
ADDQETTSADTNS

SEQ ID NO: 111546 - protein, 13 aa, Borrelia burgdorferi B31
DDQETTSADTNSN

SEQ ID NO: 111547 - protein, 13 aa, Borrelia burgdorferi B31
DQETTSADTNSNA

SEQ ID NO: 111548 - protein, 13 aa, Borrelia burgdorferi B31
QETTSADTNSNAA

SEQ ID NO: 111549 - protein, 13 aa, Borrelia burgdorferi B31
ETTSADTNSNAAK

SEQ ID NO: 111550 - protein, 13 aa, Borrelia burgdorferi B31
TTSADTNSNAAKN

SEQ ID NO: 111551 - protein, 13 aa, Borrelia burgdorferi B31
TSADTNSNAAKNI

SEQ ID NO: 111552 - protein, 13 aa, Borrelia burgdorferi B31
SADTNSNAAKNIP

SEQ ID NO: 111553 - protein, 13 aa, Borrelia burgdorferi B31
ADTNSNAAKNIPI

SEQ ID NO: 111554 - protein, 13 aa, Borrelia burgdorferi B31
DTNSNAAKNIPIA

SEQ ID NO: 111555 - protein, 13 aa, Borrelia burgdorferi B31
TNSNAAKNIPIAD

SEQ ID NO: 111556 - protein, 13 aa, Borrelia burgdorferi B31
NSNAAKNIPIADN

SEQ ID NO: 111557 - protein, 13 aa, Borrelia burgdorferi B31
SNAAKNIPIADND

SEQ ID NO: 111558 - protein, 13 aa, Borrelia burgdorferi B31
NAAKNIPIADNDK

SEQ ID NO: 111559 - protein, 13 aa, Borrelia burgdorferi B31
AAKNIPIADNDKV

SEQ ID NO: 111560 - protein, 13 aa, Borrelia burgdorferi B31
AKNIPIADNDKVA

SEQ ID NO: 111561 - protein, 13 aa, Borrelia burgdorferi B31
KNIPIADNDKVAA

SEQ ID NO: 111562 - protein, 13 aa, Borrelia burgdorferi B31
NIPIADNDKVAAE

SEQ ID NO: 111563 - protein, 13 aa, Borrelia burgdorferi B31
IPIADNDKVAAEL

SEQ ID NO: 111564 - protein, 13 aa, Borrelia burgdorferi B31
PIADNDKVAAELK

SEQ ID NO: 111565 - protein, 13 aa, Borrelia burgdorferi B31
IADNDKVAAELKK

SEQ ID NO: 111566 - protein, 13 aa, Borrelia burgdorferi B31
ADNDKVAAELKKQ

SEQ ID NO: 111567 - protein, 13 aa, Borrelia burgdorferi B31
DNDKVAAELKKQS

SEQ ID NO: 111568 - protein, 13 aa, Borrelia burgdorferi B31
NDKVAAELKKQSQ

SEQ ID NO: 111569 - protein, 13 aa, Borrelia burgdorferi B31
DKVAAELKKQSQA

SEQ ID NO: 111570 - protein, 13 aa, Borrelia burgdorferi B31
KVAAELKKQSQAA

SEQ ID NO: 111571 - protein, 13 aa, Borrelia burgdorferi B31
VAAELKKQSQAAK

SEQ ID NO: 111572 - protein, 13 aa, Borrelia burgdorferi B31
AAELKKQSQAAKT

SEQ ID NO: 111573 - protein, 13 aa, Borrelia burgdorferi B31
AELKKQSQAAKTV

SEQ ID NO: 111574 - protein, 13 aa, Borrelia burgdorferi B31
ELKKQSQAAKTVA

SEQ ID NO: 111575 - protein, 13 aa, Borrelia burgdorferi B31
LKKQSQAAKTVAA

SEQ ID NO: 111576 - protein, 13 aa, Borrelia burgdorferi B31
KKQSQAAKTVAAA

SEQ ID NO: 111577 - protein, 13 aa, Borrelia burgdorferi B31
KQSQAAKTVAAAP

SEQ ID NO: 111578 - protein, 13 aa, Borrelia burgdorferi B31
QSQAAKTVAAAPN

SEQ ID NO: 111579 - protein, 13 aa, Borrelia burgdorferi B31
SQAAKTVAAAPNK

SEQ ID NO: 111580 - protein, 13 aa, Borrelia burgdorferi B31
QAAKTVAAAPNKG

SEQ ID NO: 111581 - protein, 13 aa, Borrelia burgdorferi B31
AAKTVAAAPNKGS

SEQ ID NO: 111582 - protein, 13 aa, Borrelia burgdorferi B31
AKTVAAAPNKGSQ

SEQ ID NO: 111583 - protein, 13 aa, Borrelia burgdorferi B31
KTVAAAPNKGSQN

SEQ ID NO: 111584 - protein, 13 aa, Borrelia burgdorferi B31
TVAAAPNKGSQNQ

SEQ ID NO: 111585 - protein, 13 aa, Borrelia burgdorferi B31
VAAAPNKGSQNQP

SEQ ID NO: 111586 - protein, 13 aa, Borrelia burgdorferi B31
AAAPNKGSQNQPQ

SEQ ID NO: 111587 - protein, 13 aa, Borrelia burgdorferi B31
AAPNKGSQNQPQT

SEQ ID NO: 111588 - protein, 13 aa, Borrelia burgdorferi B31
APNKGSQNQPQTT

SEQ ID NO: 111589 - protein, 13 aa, Borrelia burgdorferi B31
PNKGSQNQPQTTP

SEQ ID NO: 111590 - protein, 13 aa, Borrelia burgdorferi B31
NKGSQNQPQTTPN

SEQ ID NO: 111591 - protein, 13 aa, Borrelia burgdorferi B31
KGSQNQPQTTPNK

SEQ ID NO: 111592 - protein, 13 aa, Borrelia burgdorferi B31
GSQNQPQTTPNKG

SEQ ID NO: 111593 - protein, 13 aa, Borrelia burgdorferi B31
SQNQPQTTPNKGS

SEQ ID NO: 111594 - protein, 13 aa, Borrelia burgdorferi B31
QNQPQTTPNKGSQ

SEQ ID NO: 111595 - protein, 13 aa, Borrelia burgdorferi B31
NQPQTTPNKGSQN

SEQ ID NO: 111596 - protein, 13 aa, Borrelia burgdorferi B31
QPQTTPNKGSQNQ

SEQ ID NO: 111597 - protein, 13 aa, Borrelia burgdorferi B31
PQTTPNKGSQNQQ

SEQ ID NO: 111598 - protein, 13 aa, Borrelia burgdorferi B31
QTTPNKGSQNQQA

SEQ ID NO: 111599 - protein, 13 aa, Borrelia burgdorferi B31
TTPNKGSQNQQAA

SEQ ID NO: 111600 - protein, 13 aa, Borrelia burgdorferi B31
TPNKGSQNQQAAP

SEQ ID NO: 111601 - protein, 13 aa, Borrelia burgdorferi B31
PNKGSQNQQAAPS

SEQ ID NO: 111602 - protein, 13 aa, Borrelia burgdorferi B31
NKGSQNQQAAPSP

SEQ ID NO: 111603 - protein, 13 aa, Borrelia burgdorferi B31
KGSQNQQAAPSPQ

SEQ ID NO: 111604 - protein, 13 aa, Borrelia burgdorferi B31
GSQNQQAAPSPQL

SEQ ID NO: 111605 - protein, 13 aa, Borrelia burgdorferi B31
SQNQQAAPSPQLQ

SEQ ID NO: 111606 - protein, 13 aa, Borrelia burgdorferi B31
QNQQAAPSPQLQS

SEQ ID NO: 111607 - protein, 13 aa, Borrelia burgdorferi B31
NQQAAPSPQLQSL

SEQ ID NO: 111608 - protein, 13 aa, Borrelia burgdorferi B31
QQAAPSPQLQSLS

SEQ ID NO: 111609 - protein, 13 aa, Borrelia burgdorferi B31
QAAPSPQLQSLSF

SEQ ID NO: 111610 - protein, 13 aa, Borrelia burgdorferi B31
AAPSPQLQSLSFS

SEQ ID NO: 111611 - protein, 13 aa, Borrelia burgdorferi B31
APSPQLQSLSFSA

SEQ ID NO: 111612 - protein, 13 aa, Borrelia burgdorferi B31
PSPQLQSLSFSAD

SEQ ID NO: 111613 - protein, 13 aa, Borrelia burgdorferi B31
SPQLQSLSFSADL

SEQ ID NO: 111614 - protein, 13 aa, Borrelia burgdorferi B31
PQLQSLSFSADLS

SEQ ID NO: 111615 - protein, 13 aa, Borrelia burgdorferi B31
QLQSLSFSADLSN

SEQ ID NO: 111616 - protein, 13 aa, Borrelia burgdorferi B31
LQSLSFSADLSNL

SEQ ID NO: 111617 - protein, 13 aa, Borrelia burgdorferi B31
QSLSFSADLSNLP

SEQ ID NO: 111618 - protein, 13 aa, Borrelia burgdorferi B31
SLSFSADLSNLPK

SEQ ID NO: 111619 - protein, 13 aa, Borrelia burgdorferi B31
LSFSADLSNLPKT

SEQ ID NO: 111620 - protein, 13 aa, Borrelia burgdorferi B31
SFSADLSNLPKTT

SEQ ID NO: 111621 - protein, 13 aa, Borrelia burgdorferi B31
FSADLSNLPKTTA

SEQ ID NO: 111622 - protein, 13 aa, Borrelia burgdorferi B31
SADLSNLPKTTAA

SEQ ID NO: 111623 - protein, 13 aa, Borrelia burgdorferi B31
ADLSNLPKTTAAR

SEQ ID NO: 111624 - protein, 13 aa, Borrelia burgdorferi B31
DLSNLPKTTAARA

SEQ ID NO: 111625 - protein, 13 aa, Borrelia burgdorferi B31
LSNLPKTTAARAA

SEQ ID NO: 111626 - protein, 13 aa, Borrelia burgdorferi B31
SNLPKTTAARAAS

SEQ ID NO: 111627 - protein, 13 aa, Borrelia burgdorferi B31
NLPKTTAARAASL

SEQ ID NO: 111628 - protein, 13 aa, Borrelia burgdorferi B31
LPKTTAARAASLT

SEQ ID NO: 111629 - protein, 13 aa, Borrelia burgdorferi B31
PKTTAARAASLTK

SEQ ID NO: 111630 - protein, 13 aa, Borrelia burgdorferi B31
KTTAARAASLTKQ

SEQ ID NO: 111631 - protein, 13 aa, Borrelia burgdorferi B31
TTAARAASLTKQR

SEQ ID NO: 111632 - protein, 13 aa, Borrelia burgdorferi B31
TAARAASLTKQRI

SEQ ID NO: 111633 - protein, 13 aa, Borrelia burgdorferi B31
AARAASLTKQRIP

SEQ ID NO: 111634 - protein, 13 aa, Borrelia burgdorferi B31
ARAASLTKQRIPI

SEQ ID NO: 111635 - protein, 13 aa, Borrelia burgdorferi B31
RAASLTKQRIPIQ

SEQ ID NO: 111636 - protein, 13 aa, Borrelia burgdorferi B31
AASLTKQRIPIQA

SEQ ID NO: 111637 - protein, 13 aa, Borrelia burgdorferi B31
ASLTKQRIPIQAV

SEQ ID NO: 111638 - protein, 13 aa, Borrelia burgdorferi B31
SLTKQRIPIQAVT

SEQ ID NO: 111639 - protein, 13 aa, Borrelia burgdorferi B31
LTKQRIPIQAVTT

SEQ ID NO: 111640 - protein, 13 aa, Borrelia burgdorferi B31
TKQRIPIQAVTTV

SEQ ID NO: 111641 - protein, 13 aa, Borrelia burgdorferi B31
KQRIPIQAVTTVP

SEQ ID NO: 111642 - protein, 13 aa, Borrelia burgdorferi B31
QRIPIQAVTTVPG

SEQ ID NO: 111643 - protein, 13 aa, Borrelia burgdorferi B31
RIPIQAVTTVPGN

SEQ ID NO: 111644 - protein, 13 aa, Borrelia burgdorferi B31
IPIQAVTTVPGNT

SEQ ID NO: 111645 - protein, 13 aa, Borrelia burgdorferi B31
PIQAVTTVPGNTR

SEQ ID NO: 111646 - protein, 13 aa, Borrelia burgdorferi B31
IQAVTTVPGNTRT

SEQ ID NO: 111647 - protein, 13 aa, Borrelia burgdorferi B31
QAVTTVPGNTRTF

SEQ ID NO: 111648 - protein, 13 aa, Borrelia burgdorferi B31
AVTTVPGNTRTFN

SEQ ID NO: 111649 - protein, 13 aa, Borrelia burgdorferi B31
VTTVPGNTRTFNS

SEQ ID NO: 111650 - protein, 13 aa, Borrelia burgdorferi B31
TTVPGNTRTFNSR

SEQ ID NO: 111651 - protein, 13 aa, Borrelia burgdorferi B31
TVPGNTRTFNSRN

SEQ ID NO: 111652 - protein, 13 aa, Borrelia burgdorferi B31
VPGNTRTFNSRNS

SEQ ID NO: 111653 - protein, 13 aa, Borrelia burgdorferi B31
PGNTRTFNSRNSG

SEQ ID NO: 111654 - protein, 13 aa, Borrelia burgdorferi B31
GNTRTFNSRNSGL

SEQ ID NO: 111655 - protein, 13 aa, Borrelia burgdorferi B31
NTRTFNSRNSGLP

SEQ ID NO: 111656 - protein, 13 aa, Borrelia burgdorferi B31
TRTFNSRNSGLPT

SEQ ID NO: 111657 - protein, 13 aa, Borrelia burgdorferi B31
RTFNSRNSGLPTF

SEQ ID NO: 111658 - protein, 13 aa, Borrelia burgdorferi B31
TFNSRNSGLPTFA

SEQ ID NO: 111659 - protein, 13 aa, Borrelia burgdorferi B31
FNSRNSGLPTFAL

SEQ ID NO: 111660 - protein, 13 aa, Borrelia burgdorferi B31
NSRNSGLPTFALN

SEQ ID NO: 111661 - protein, 13 aa, Borrelia burgdorferi B31
SRNSGLPTFALNY

SEQ ID NO: 111662 - protein, 13 aa, Borrelia burgdorferi B31
RNSGLPTFALNYS

SEQ ID NO: 111663 - protein, 13 aa, Borrelia burgdorferi B31
NSGLPTFALNYSF

SEQ ID NO: 111664 - protein, 13 aa, Borrelia burgdorferi B31
SGLPTFALNYSFS

SEQ ID NO: 111665 - protein, 13 aa, Borrelia burgdorferi B31
GLPTFALNYSFSQ

SEQ ID NO: 111666 - protein, 13 aa, Borrelia burgdorferi B31
LPTFALNYSFSQP

SEQ ID NO: 111667 - protein, 13 aa, Borrelia burgdorferi B31
PTFALNYSFSQPT

SEQ ID NO: 111668 - protein, 13 aa, Borrelia burgdorferi B31
TFALNYSFSQPTR

SEQ ID NO: 111669 - protein, 13 aa, Borrelia burgdorferi B31
FALNYSFSQPTRQ

SEQ ID NO: 111670 - protein, 13 aa, Borrelia burgdorferi B31
ALNYSFSQPTRQQ

SEQ ID NO: 111671 - protein, 13 aa, Borrelia burgdorferi B31
LNYSFSQPTRQQT

SEQ ID NO: 111672 - protein, 13 aa, Borrelia burgdorferi B31
NYSFSQPTRQQTN

SEQ ID NO: 111673 - protein, 13 aa, Borrelia burgdorferi B31
YSFSQPTRQQTNS

SEQ ID NO: 111674 - protein, 13 aa, Borrelia burgdorferi B31
SFSQPTRQQTNSS

SEQ ID NO: 111675 - protein, 13 aa, Borrelia burgdorferi B31
FSQPTRQQTNSSS

SEQ ID NO: 111676 - protein, 13 aa, Borrelia burgdorferi B31
SQPTRQQTNSSSA

SEQ ID NO: 111677 - protein, 13 aa, Borrelia burgdorferi B31
QPTRQQTNSSSAV

SEQ ID NO: 111678 - protein, 13 aa, Borrelia burgdorferi B31
PTRQQTNSSSAVQ

SEQ ID NO: 111679 - protein, 13 aa, Borrelia burgdorferi B31
TRQQTNSSSAVQT

SEQ ID NO: 111680 - protein, 13 aa, Borrelia burgdorferi B31
RQQTNSSSAVQTT

SEQ ID NO: 111681 - protein, 13 aa, Borrelia burgdorferi B31
QQTNSSSAVQTTT

SEQ ID NO: 111682 - protein, 13 aa, Borrelia burgdorferi B31
QTNSSSAVQTTTS

SEQ ID NO: 111683 - protein, 13 aa, Borrelia burgdorferi B31
TNSSSAVQTTTSS

SEQ ID NO: 111684 - protein, 13 aa, Borrelia burgdorferi B31
NSSSAVQTTTSSG

SEQ ID NO: 111685 - protein, 13 aa, Borrelia burgdorferi B31
SSSAVQTTTSSGS

SEQ ID NO: 111686 - protein, 13 aa, Borrelia burgdorferi B31
SSAVQTTTSSGSK

SEQ ID NO: 111687 - protein, 13 aa, Borrelia burgdorferi B31
SAVQTTTSSGSKL

SEQ ID NO: 111688 - protein, 13 aa, Borrelia burgdorferi B31
AVQTTTSSGSKLQ

SEQ ID NO: 111689 - protein, 13 aa, Borrelia burgdorferi B31
VQTTTSSGSKLQT

SEQ ID NO: 111690 - protein, 13 aa, Borrelia burgdorferi B31
QTTTSSGSKLQTL

SEQ ID NO: 111691 - protein, 13 aa, Borrelia burgdorferi B31
TTTSSGSKLQTLK

SEQ ID NO: 111692 - protein, 13 aa, Borrelia burgdorferi B31
TTSSGSKLQTLKN

SEQ ID NO: 111693 - protein, 13 aa, Borrelia burgdorferi B31
TSSGSKLQTLKNE

SEQ ID NO: 111694 - protein, 13 aa, Borrelia burgdorferi B31
SSGSKLQTLKNEL

SEQ ID NO: 111695 - protein, 13 aa, Borrelia burgdorferi B31
SGSKLQTLKNELI

SEQ ID NO: 111696 - protein, 13 aa, Borrelia burgdorferi B31
GSKLQTLKNELIR

SEQ ID NO: 111697 - protein, 13 aa, Borrelia burgdorferi B31
SKLQTLKNELIRA

SEQ ID NO: 111698 - protein, 13 aa, Borrelia burgdorferi B31
KLQTLKNELIRAI

SEQ ID NO: 111699 - protein, 13 aa, Borrelia burgdorferi B31
LQTLKNELIRAIS

SEQ ID NO: 111700 - protein, 13 aa, Borrelia burgdorferi B31
QTLKNELIRAISE

SEQ ID NO: 111701 - protein, 13 aa, Borrelia burgdorferi B31
TLKNELIRAISEE

SEQ ID NO: 111702 - protein, 13 aa, Borrelia burgdorferi B31
LKNELIRAISEEK

SEQ ID NO: 111703 - protein, 13 aa, Borrelia burgdorferi B31
KNELIRAISEEKN

SEQ ID NO: 111704 - protein, 13 aa, Borrelia burgdorferi B31
NELIRAISEEKNK

SEQ ID NO: 111705 - protein, 13 aa, Borrelia burgdorferi B31
ELIRAISEEKNKT

SEQ ID NO: 111706 - protein, 13 aa, Borrelia burgdorferi B31
LIRAISEEKNKTQ

SEQ ID NO: 111707 - protein, 13 aa, Borrelia burgdorferi B31
IRAISEEKNKTQN

SEQ ID NO: 111708 - protein, 13 aa, Borrelia burgdorferi B31
RAISEEKNKTQNN

SEQ ID NO: 111709 - protein, 13 aa, Borrelia burgdorferi B31
AISEEKNKTQNNF

SEQ ID NO: 111710 - protein, 13 aa, Borrelia burgdorferi B31
ISEEKNKTQNNFG

SEQ ID NO: 111711 - protein, 13 aa, Borrelia burgdorferi B31
SEEKNKTQNNFGF

SEQ ID NO: 111712 - protein, 13 aa, Borrelia burgdorferi B31
EEKNKTQNNFGFR

SEQ ID NO: 111713 - protein, 13 aa, Borrelia burgdorferi B31
EKNKTQNNFGFRE

SEQ ID NO: 111714 - protein, 13 aa, Borrelia burgdorferi B31
KNKTQNNFGFRET

SEQ ID NO: 111715 - protein, 13 aa, Borrelia burgdorferi B31
NKTQNNFGFRETY

SEQ ID NO: 111716 - protein, 13 aa, Borrelia burgdorferi B31
KTQNNFGFRETYD

SEQ ID NO: 111717 - protein, 13 aa, Borrelia burgdorferi B31
TQNNFGFRETYDQ

SEQ ID NO: 111718 - protein, 13 aa, Borrelia burgdorferi B31
QNNFGFRETYDQF

SEQ ID NO: 111719 - protein, 13 aa, Borrelia burgdorferi B31
NNFGFRETYDQFK

SEQ ID NO: 111720 - protein, 13 aa, Borrelia burgdorferi B31
NFGFRETYDQFKM

SEQ ID NO: 111721 - protein, 13 aa, Borrelia burgdorferi B31
FGFRETYDQFKMK

SEQ ID NO: 111722 - protein, 13 aa, Borrelia burgdorferi B31
GFRETYDQFKMKD

SEQ ID NO: 111723 - protein, 13 aa, Borrelia burgdorferi B31
FRETYDQFKMKDS

SEQ ID NO: 111724 - protein, 13 aa, Borrelia burgdorferi B31
RETYDQFKMKDSA

SEQ ID NO: 111725 - protein, 13 aa, Borrelia burgdorferi B31
ETYDQFKMKDSAF

SEQ ID NO: 111726 - protein, 13 aa, Borrelia burgdorferi B31
TYDQFKMKDSAFE

SEQ ID NO: 111727 - protein, 13 aa, Borrelia burgdorferi B31
YDQFKMKDSAFEL

SEQ ID NO: 111728 - protein, 13 aa, Borrelia burgdorferi B31
DQFKMKDSAFELL

SEQ ID NO: 111729 - protein, 13 aa, Borrelia burgdorferi B31
QFKMKDSAFELLD

SEQ ID NO: 111730 - protein, 13 aa, Borrelia burgdorferi B31
FKMKDSAFELLDV

SEQ ID NO: 111731 - protein, 13 aa, Borrelia burgdorferi B31
KMKDSAFELLDVI

SEQ ID NO: 111732 - protein, 13 aa, Borrelia burgdorferi B31
MKDSAFELLDVIS

SEQ ID NO: 111733 - protein, 13 aa, Borrelia burgdorferi B31
KDSAFELLDVISS

SEQ ID NO: 111734 - protein, 13 aa, Borrelia burgdorferi B31
DSAFELLDVISSA

SEQ ID NO: 111735 - protein, 13 aa, Borrelia burgdorferi B31
SAFELLDVISSAK

SEQ ID NO: 111736 - protein, 13 aa, Borrelia burgdorferi B31
AFELLDVISSAKV

SEQ ID NO: 111737 - protein, 13 aa, Borrelia burgdorferi B31
FELLDVISSAKVY

SEQ ID NO: 111738 - protein, 13 aa, Borrelia burgdorferi B31
ELLDVISSAKVYD

SEQ ID NO: 111739 - protein, 13 aa, Borrelia burgdorferi B31
LLDVISSAKVYDR

SEQ ID NO: 111740 - protein, 13 aa, Borrelia burgdorferi B31
LDVISSAKVYDRS

SEQ ID NO: 111741 - protein, 13 aa, Borrelia burgdorferi B31
DVISSAKVYDRSY

SEQ ID NO: 111742 - protein, 13 aa, Borrelia burgdorferi B31
VISSAKVYDRSYA

SEQ ID NO: 111743 - protein, 13 aa, Borrelia burgdorferi B31
ISSAKVYDRSYAP

SEQ ID NO: 111744 - protein, 13 aa, Borrelia burgdorferi B31
SSAKVYDRSYAPQ

SEQ ID NO: 111745 - protein, 13 aa, Borrelia burgdorferi B31
SAKVYDRSYAPQL

SEQ ID NO: 111746 - protein, 13 aa, Borrelia burgdorferi B31
AKVYDRSYAPQLN

SEQ ID NO: 111747 - protein, 13 aa, Borrelia burgdorferi B31
KVYDRSYAPQLNS

SEQ ID NO: 111748 - protein, 13 aa, Borrelia burgdorferi B31
VYDRSYAPQLNSN

SEQ ID NO: 111749 - protein, 13 aa, Borrelia burgdorferi B31
YDRSYAPQLNSNT

SEQ ID NO: 111750 - protein, 13 aa, Borrelia burgdorferi B31
DRSYAPQLNSNTP

SEQ ID NO: 111751 - protein, 13 aa, Borrelia burgdorferi B31
RSYAPQLNSNTPE

SEQ ID NO: 111752 - protein, 13 aa, Borrelia burgdorferi B31
SYAPQLNSNTPEA

SEQ ID NO: 111753 - protein, 13 aa, Borrelia burgdorferi B31
YAPQLNSNTPEAE

SEQ ID NO: 111754 - protein, 13 aa, Borrelia burgdorferi B31
APQLNSNTPEAEN

SEQ ID NO: 111755 - protein, 13 aa, Borrelia burgdorferi B31
PQLNSNTPEAENE

SEQ ID NO: 111756 - protein, 13 aa, Borrelia burgdorferi B31
QLNSNTPEAENER

SEQ ID NO: 111757 - protein, 13 aa, Borrelia burgdorferi B31
LNSNTPEAENERN

SEQ ID NO: 111758 - protein, 13 aa, Borrelia burgdorferi B31
NSNTPEAENERNK

SEQ ID NO: 111759 - protein, 13 aa, Borrelia burgdorferi B31
SNTPEAENERNKF

SEQ ID NO: 111760 - protein, 13 aa, Borrelia burgdorferi B31
NTPEAENERNKFY

SEQ ID NO: 111761 - protein, 13 aa, Borrelia burgdorferi B31
TPEAENERNKFYA

SEQ ID NO: 111762 - protein, 13 aa, Borrelia burgdorferi B31
PEAENERNKFYAL

SEQ ID NO: 111763 - protein, 13 aa, Borrelia burgdorferi B31
EAENERNKFYALM

SEQ ID NO: 111764 - protein, 13 aa, Borrelia burgdorferi B31
AENERNKFYALMD

SEQ ID NO: 111765 - protein, 13 aa, Borrelia burgdorferi B31
ENERNKFYALMDF

SEQ ID NO: 111766 - protein, 13 aa, Borrelia burgdorferi B31
NERNKFYALMDFD

SEQ ID NO: 111767 - protein, 13 aa, Borrelia burgdorferi B31
ERNKFYALMDFDQ

SEQ ID NO: 111768 - protein, 13 aa, Borrelia burgdorferi B31
RNKFYALMDFDQY

SEQ ID NO: 111769 - protein, 13 aa, Borrelia burgdorferi B31
NKFYALMDFDQYK

SEQ ID NO: 111770 - protein, 13 aa, Borrelia burgdorferi B31
KFYALMDFDQYKI

SEQ ID NO: 111771 - protein, 13 aa, Borrelia burgdorferi B31
FYALMDFDQYKIE

SEQ ID NO: 111772 - protein, 13 aa, Borrelia burgdorferi B31
YALMDFDQYKIEQ

SEQ ID NO: 111773 - protein, 13 aa, Borrelia burgdorferi B31
ALMDFDQYKIEQF

SEQ ID NO: 111774 - protein, 13 aa, Borrelia burgdorferi B31
LMDFDQYKIEQFG

SEQ ID NO: 111775 - protein, 13 aa, Borrelia burgdorferi B31
MDFDQYKIEQFGS

SEQ ID NO: 111776 - protein, 13 aa, Borrelia burgdorferi B31
DFDQYKIEQFGSI

SEQ ID NO: 111777 - protein, 13 aa, Borrelia burgdorferi B31
FDQYKIEQFGSIM

SEQ ID NO: 111778 - protein, 13 aa, Borrelia burgdorferi B31
DQYKIEQFGSIME

SEQ ID NO: 111779 - protein, 13 aa, Borrelia burgdorferi B31
QYKIEQFGSIMEA

SEQ ID NO: 111780 - protein, 13 aa, Borrelia burgdorferi B31
YKIEQFGSIMEAL

SEQ ID NO: 111781 - protein, 13 aa, Borrelia burgdorferi B31
KIEQFGSIMEALY

SEQ ID NO: 111782 - protein, 13 aa, Borrelia burgdorferi B31
IEQFGSIMEALYN

SEQ ID NO: 111783 - protein, 13 aa, Borrelia burgdorferi B31
EQFGSIMEALYNE

SEQ ID NO: 111784 - protein, 13 aa, Borrelia burgdorferi B31
QFGSIMEALYNEN

SEQ ID NO: 111785 - protein, 13 aa, Borrelia burgdorferi B31
FGSIMEALYNENQ

SEQ ID NO: 111786 - protein, 13 aa, Borrelia burgdorferi B31
GSIMEALYNENQN

SEQ ID NO: 111787 - protein, 13 aa, Borrelia burgdorferi B31
SIMEALYNENQNH

SEQ ID NO: 111788 - protein, 13 aa, Borrelia burgdorferi B31
IMEALYNENQNHS

SEQ ID NO: 111789 - protein, 13 aa, Borrelia burgdorferi B31
MEALYNENQNHSL

SEQ ID NO: 111790 - protein, 13 aa, Borrelia burgdorferi B31
EALYNENQNHSLI

SEQ ID NO: 111791 - protein, 13 aa, Borrelia burgdorferi B31
ALYNENQNHSLIR

SEQ ID NO: 111792 - protein, 13 aa, Borrelia burgdorferi B31
LYNENQNHSLIRE

SEQ ID NO: 111793 - protein, 13 aa, Borrelia burgdorferi B31
YNENQNHSLIREL

SEQ ID NO: 111794 - protein, 13 aa, Borrelia burgdorferi B31
NENQNHSLIRELM

SEQ ID NO: 111795 - protein, 13 aa, Borrelia burgdorferi B31
ENQNHSLIRELMI

SEQ ID NO: 111796 - protein, 13 aa, Borrelia burgdorferi B31
NQNHSLIRELMIS

SEQ ID NO: 111797 - protein, 13 aa, Borrelia burgdorferi B31
QNHSLIRELMISG

SEQ ID NO: 111798 - protein, 13 aa, Borrelia burgdorferi B31
NHSLIRELMISGL

SEQ ID NO: 111799 - protein, 13 aa, Borrelia burgdorferi B31
HSLIRELMISGLG

SEQ ID NO: 111800 - protein, 13 aa, Borrelia burgdorferi B31
SLIRELMISGLGT

SEQ ID NO: 111801 - protein, 13 aa, Borrelia burgdorferi B31
LIRELMISGLGTQ

SEQ ID NO: 111802 - protein, 13 aa, Borrelia burgdorferi B31
IRELMISGLGTQI

SEQ ID NO: 111803 - protein, 13 aa, Borrelia burgdorferi B31
RELMISGLGTQIS

SEQ ID NO: 111804 - protein, 13 aa, Borrelia burgdorferi B31
ELMISGLGTQISF

SEQ ID NO: 111805 - protein, 13 aa, Borrelia burgdorferi B31
LMISGLGTQISFE

SEQ ID NO: 111806 - protein, 13 aa, Borrelia burgdorferi B31
MISGLGTQISFEL

SEQ ID NO: 111807 - protein, 13 aa, Borrelia burgdorferi B31
ISGLGTQISFELA

SEQ ID NO: 111808 - protein, 13 aa, Borrelia burgdorferi B31
SGLGTQISFELAL

SEQ ID NO: 111809 - protein, 13 aa, Borrelia burgdorferi B31
GLGTQISFELALE

SEQ ID NO: 111810 - protein, 13 aa, Borrelia burgdorferi B31
LGTQISFELALEE

SEQ ID NO: 111811 - protein, 13 aa, Borrelia burgdorferi B31
GTQISFELALEEI

SEQ ID NO: 111812 - protein, 13 aa, Borrelia burgdorferi B31
TQISFELALEEIN

SEQ ID NO: 111813 - protein, 13 aa, Borrelia burgdorferi B31
QISFELALEEINK

SEQ ID NO: 111814 - protein, 13 aa, Borrelia burgdorferi B31
ISFELALEEINKK

SEQ ID NO: 111815 - protein, 13 aa, Borrelia burgdorferi B31
SFELALEEINKKI

SEQ ID NO: 111816 - protein, 13 aa, Borrelia burgdorferi B31
FELALEEINKKIE

SEQ ID NO: 111817 - protein, 13 aa, Borrelia burgdorferi B31
ELALEEINKKIEI

SEQ ID NO: 111818 - protein, 13 aa, Borrelia burgdorferi B31
LALEEINKKIEIF

SEQ ID NO: 111819 - protein, 13 aa, Borrelia burgdorferi B31
ALEEINKKIEIFN

SEQ ID NO: 111820 - protein, 13 aa, Borrelia burgdorferi B31
LEEINKKIEIFNQ

SEQ ID NO: 111821 - protein, 13 aa, Borrelia burgdorferi B31
EEINKKIEIFNQD

SEQ ID NO: 111822 - protein, 13 aa, Borrelia burgdorferi B31
EINKKIEIFNQDY

SEQ ID NO: 111823 - protein, 13 aa, Borrelia burgdorferi B31
INKKIEIFNQDYL

SEQ ID NO: 111824 - protein, 13 aa, Borrelia burgdorferi B31
NKKIEIFNQDYLN

SEQ ID NO: 111825 - protein, 13 aa, Borrelia burgdorferi B31
KKIEIFNQDYLNA

SEQ ID NO: 111826 - protein, 13 aa, Borrelia burgdorferi B31
KIEIFNQDYLNAK

SEQ ID NO: 111827 - protein, 13 aa, Borrelia burgdorferi B31
IEIFNQDYLNAKI

SEQ ID NO: 111828 - protein, 13 aa, Borrelia burgdorferi B31
EIFNQDYLNAKIN

SEQ ID NO: 111829 - protein, 13 aa, Borrelia burgdorferi B31
IFNQDYLNAKINS

SEQ ID NO: 111830 - protein, 13 aa, Borrelia burgdorferi B31
FNQDYLNAKINSF

SEQ ID NO: 111831 - protein, 13 aa, Borrelia burgdorferi B31
NQDYLNAKINSFD

SEQ ID NO: 111832 - protein, 13 aa, Borrelia burgdorferi B31
QDYLNAKINSFDF

SEQ ID NO: 111833 - protein, 13 aa, Borrelia burgdorferi B31
DYLNAKINSFDFT

SEQ ID NO: 111834 - protein, 13 aa, Borrelia burgdorferi B31
YLNAKINSFDFTM

SEQ ID NO: 111835 - protein, 13 aa, Borrelia burgdorferi B31
LNAKINSFDFTMK

SEQ ID NO: 111836 - protein, 13 aa, Borrelia burgdorferi B31
NAKINSFDFTMKL

SEQ ID NO: 111837 - protein, 13 aa, Borrelia burgdorferi B31
AKINSFDFTMKLK

SEQ ID NO: 111838 - protein, 13 aa, Borrelia burgdorferi B31
KINSFDFTMKLKE

SEQ ID NO: 111839 - protein, 13 aa, Borrelia burgdorferi B31
INSFDFTMKLKEL

SEQ ID NO: 111840 - protein, 13 aa, Borrelia burgdorferi B31
NSFDFTMKLKELK

SEQ ID NO: 111841 - protein, 13 aa, Borrelia burgdorferi B31
SFDFTMKLKELKS

SEQ ID NO: 111842 - protein, 13 aa, Borrelia burgdorferi B31
FDFTMKLKELKSK

SEQ ID NO: 111843 - protein, 13 aa, Borrelia burgdorferi B31
DFTMKLKELKSKL

SEQ ID NO: 111844 - protein, 13 aa, Borrelia burgdorferi B31
FTMKLKELKSKLN

SEQ ID NO: 111845 - protein, 13 aa, Borrelia burgdorferi B31
TMKLKELKSKLNQ

SEQ ID NO: 111846 - protein, 13 aa, Borrelia burgdorferi B31
MKLKELKSKLNQI

SEQ ID NO: 111847 - protein, 13 aa, Borrelia burgdorferi B31
KLKELKSKLNQIL

SEQ ID NO: 111848 - protein, 13 aa, Borrelia burgdorferi B31
LKELKSKLNQILD

SEQ ID NO: 111849 - protein, 13 aa, Borrelia burgdorferi B31
KELKSKLNQILDK

SEQ ID NO: 111850 - protein, 13 aa, Borrelia burgdorferi B31
ELKSKLNQILDKR

SEQ ID NO: 111851 - protein, 13 aa, Borrelia burgdorferi B31
LKSKLNQILDKRK

SEQ ID NO: 111852 - protein, 13 aa, Borrelia burgdorferi B31
KSKLNQILDKRKE

SEQ ID NO: 111853 - protein, 13 aa, Borrelia burgdorferi B31
SKLNQILDKRKEW

SEQ ID NO: 111854 - protein, 13 aa, Borrelia burgdorferi B31
KLNQILDKRKEWS

SEQ ID NO: 111855 - protein, 13 aa, Borrelia burgdorferi B31
LNQILDKRKEWSR

SEQ ID NO: 111856 - protein, 13 aa, Borrelia burgdorferi B31
NQILDKRKEWSRQ

SEQ ID NO: 111857 - protein, 13 aa, Borrelia burgdorferi B31
QILDKRKEWSRQA

SEQ ID NO: 111858 - protein, 13 aa, Borrelia burgdorferi B31
ILDKRKEWSRQAD

SEQ ID NO: 111859 - protein, 13 aa, Borrelia burgdorferi B31
LDKRKEWSRQADG

SEQ ID NO: 111860 - protein, 13 aa, Borrelia burgdorferi B31
DKRKEWSRQADGL

SEQ ID NO: 111861 - protein, 13 aa, Borrelia burgdorferi B31
KRKEWSRQADGLI

SEQ ID NO: 111862 - protein, 13 aa, Borrelia burgdorferi B31
RKEWSRQADGLIA

SEQ ID NO: 111863 - protein, 13 aa, Borrelia burgdorferi B31
KEWSRQADGLIAN

SEQ ID NO: 111864 - protein, 13 aa, Borrelia burgdorferi B31
EWSRQADGLIANA

SEQ ID NO: 111865 - protein, 13 aa, Borrelia burgdorferi B31
WSRQADGLIANAS

SEQ ID NO: 111866 - protein, 13 aa, Borrelia burgdorferi B31
SRQADGLIANASS

SEQ ID NO: 111867 - protein, 13 aa, Borrelia burgdorferi B31
RQADGLIANASSN

SEQ ID NO: 111868 - protein, 13 aa, Borrelia burgdorferi B31
QADGLIANASSNS

SEQ ID NO: 111869 - protein, 13 aa, Borrelia burgdorferi B31
ADGLIANASSNSS

SEQ ID NO: 111870 - protein, 13 aa, Borrelia burgdorferi B31
DGLIANASSNSSL

SEQ ID NO: 111871 - protein, 13 aa, Borrelia burgdorferi B31
GLIANASSNSSLS

SEQ ID NO: 111872 - protein, 13 aa, Borrelia burgdorferi B31
LIANASSNSSLSD

SEQ ID NO: 111873 - protein, 13 aa, Borrelia burgdorferi B31
IANASSNSSLSDS

SEQ ID NO: 111874 - protein, 13 aa, Borrelia burgdorferi B31
ANASSNSSLSDSK

SEQ ID NO: 111875 - protein, 13 aa, Borrelia burgdorferi B31
NASSNSSLSDSKS

SEQ ID NO: 111876 - protein, 13 aa, Borrelia burgdorferi B31
ASSNSSLSDSKSL

SEQ ID NO: 111877 - protein, 13 aa, Borrelia burgdorferi B31
SSNSSLSDSKSLA

SEQ ID NO: 111878 - protein, 13 aa, Borrelia burgdorferi B31
SNSSLSDSKSLAE

SEQ ID NO: 111879 - protein, 13 aa, Borrelia burgdorferi B31
NSSLSDSKSLAEY

SEQ ID NO: 111880 - protein, 13 aa, Borrelia burgdorferi B31
SSLSDSKSLAEYI

SEQ ID NO: 111881 - protein, 13 aa, Borrelia burgdorferi B31
SLSDSKSLAEYIK

SEQ ID NO: 111882 - protein, 13 aa, Borrelia burgdorferi B31
LSDSKSLAEYIKK

SEQ ID NO: 111883 - protein, 13 aa, Borrelia burgdorferi B31
SDSKSLAEYIKKR

SEQ ID NO: 111884 - protein, 13 aa, Borrelia burgdorferi B31
DSKSLAEYIKKRY

SEQ ID NO: 111885 - protein, 13 aa, Borrelia burgdorferi B31
SKSLAEYIKKRYL

SEQ ID NO: 111886 - protein, 13 aa, Borrelia burgdorferi B31
KSLAEYIKKRYLD

SEQ ID NO: 111887 - protein, 13 aa, Borrelia burgdorferi B31
SLAEYIKKRYLDN

SEQ ID NO: 111888 - protein, 13 aa, Borrelia burgdorferi B31
LAEYIKKRYLDNM

SEQ ID NO: 111889 - protein, 13 aa, Borrelia burgdorferi B31
AEYIKKRYLDNMQ

SEQ ID NO: 111890 - protein, 13 aa, Borrelia burgdorferi B31
EYIKKRYLDNMQN

SEQ ID NO: 111891 - protein, 13 aa, Borrelia burgdorferi B31
YIKKRYLDNMQNA

SEQ ID NO: 111892 - protein, 13 aa, Borrelia burgdorferi B31
IKKRYLDNMQNAR

SEQ ID NO: 111893 - protein, 13 aa, Borrelia burgdorferi B31
KKRYLDNMQNARQ

SEQ ID NO: 111894 - protein, 13 aa, Borrelia burgdorferi B31
KRYLDNMQNARQS

SEQ ID NO: 111895 - protein, 13 aa, Borrelia burgdorferi B31
RYLDNMQNARQSV

SEQ ID NO: 111896 - protein, 13 aa, Borrelia burgdorferi B31
YLDNMQNARQSVL

SEQ ID NO: 111897 - protein, 13 aa, Borrelia burgdorferi B31
LDNMQNARQSVLE

SEQ ID NO: 111898 - protein, 13 aa, Borrelia burgdorferi B31
DNMQNARQSVLEA

SEQ ID NO: 111899 - protein, 13 aa, Borrelia burgdorferi B31
NMQNARQSVLEAY

SEQ ID NO: 111900 - protein, 13 aa, Borrelia burgdorferi B31
MQNARQSVLEAYI

SEQ ID NO: 111901 - protein, 13 aa, Borrelia burgdorferi B31
QNARQSVLEAYIS

SEQ ID NO: 111902 - protein, 13 aa, Borrelia burgdorferi B31
NARQSVLEAYISI

SEQ ID NO: 111903 - protein, 13 aa, Borrelia burgdorferi B31
ARQSVLEAYISIM

SEQ ID NO: 111904 - protein, 14 aa, Borrelia burgdorferi B31
MKIKPLIQLKLLGL

SEQ ID NO: 111905 - protein, 14 aa, Borrelia burgdorferi B31
KIKPLIQLKLLGLF

SEQ ID NO: 111906 - protein, 14 aa, Borrelia burgdorferi B31
IKPLIQLKLLGLFL

SEQ ID NO: 111907 - protein, 14 aa, Borrelia burgdorferi B31
KPLIQLKLLGLFLF

SEQ ID NO: 111908 - protein, 14 aa, Borrelia burgdorferi B31
PLIQLKLLGLFLFS

SEQ ID NO: 111909 - protein, 14 aa, Borrelia burgdorferi B31
LIQLKLLGLFLFSC

SEQ ID NO: 111910 - protein, 14 aa, Borrelia burgdorferi B31
IQLKLLGLFLFSCT

SEQ ID NO: 111911 - protein, 14 aa, Borrelia burgdorferi B31
QLKLLGLFLFSCTI

SEQ ID NO: 111912 - protein, 14 aa, Borrelia burgdorferi B31
LKLLGLFLFSCTID

SEQ ID NO: 111913 - protein, 14 aa, Borrelia burgdorferi B31
KLLGLFLFSCTIDA

SEQ ID NO: 111914 - protein, 14 aa, Borrelia burgdorferi B31
LLGLFLFSCTIDAN

SEQ ID NO: 111915 - protein, 14 aa, Borrelia burgdorferi B31
LGLFLFSCTIDANL

SEQ ID NO: 111916 - protein, 14 aa, Borrelia burgdorferi B31
GLFLFSCTIDANLN

SEQ ID NO: 111917 - protein, 14 aa, Borrelia burgdorferi B31
LFLFSCTIDANLNE

SEQ ID NO: 111918 - protein, 14 aa, Borrelia burgdorferi B31
FLFSCTIDANLNED

SEQ ID NO: 111919 - protein, 14 aa, Borrelia burgdorferi B31
LFSCTIDANLNEDY

SEQ ID NO: 111920 - protein, 14 aa, Borrelia burgdorferi B31
FSCTIDANLNEDYK

SEQ ID NO: 111921 - protein, 14 aa, Borrelia burgdorferi B31
SCTIDANLNEDYKN

SEQ ID NO: 111922 - protein, 14 aa, Borrelia burgdorferi B31
CTIDANLNEDYKNK

SEQ ID NO: 111923 - protein, 14 aa, Borrelia burgdorferi B31
TIDANLNEDYKNKV

SEQ ID NO: 111924 - protein, 14 aa, Borrelia burgdorferi B31
IDANLNEDYKNKVK

SEQ ID NO: 111925 - protein, 14 aa, Borrelia burgdorferi B31
DANLNEDYKNKVKG

SEQ ID NO: 111926 - protein, 14 aa, Borrelia burgdorferi B31
ANLNEDYKNKVKGI

SEQ ID NO: 111927 - protein, 14 aa, Borrelia burgdorferi B31
NLNEDYKNKVKGIL

SEQ ID NO: 111928 - protein, 14 aa, Borrelia burgdorferi B31
LNEDYKNKVKGILN

SEQ ID NO: 111929 - protein, 14 aa, Borrelia burgdorferi B31
NEDYKNKVKGILNK

SEQ ID NO: 111930 - protein, 14 aa, Borrelia burgdorferi B31
EDYKNKVKGILNKA

SEQ ID NO: 111931 - protein, 14 aa, Borrelia burgdorferi B31
DYKNKVKGILNKAA

SEQ ID NO: 111932 - protein, 14 aa, Borrelia burgdorferi B31
YKNKVKGILNKAAD

SEQ ID NO: 111933 - protein, 14 aa, Borrelia burgdorferi B31
KNKVKGILNKAADD

SEQ ID NO: 111934 - protein, 14 aa, Borrelia burgdorferi B31
NKVKGILNKAADDQ

SEQ ID NO: 111935 - protein, 14 aa, Borrelia burgdorferi B31
KVKGILNKAADDQE

SEQ ID NO: 111936 - protein, 14 aa, Borrelia burgdorferi B31
VKGILNKAADDQET

SEQ ID NO: 111937 - protein, 14 aa, Borrelia burgdorferi B31
KGILNKAADDQETT

SEQ ID NO: 111938 - protein, 14 aa, Borrelia burgdorferi B31
GILNKAADDQETTS

SEQ ID NO: 111939 - protein, 14 aa, Borrelia burgdorferi B31
ILNKAADDQETTSA

SEQ ID NO: 111940 - protein, 14 aa, Borrelia burgdorferi B31
LNKAADDQETTSAD

SEQ ID NO: 111941 - protein, 14 aa, Borrelia burgdorferi B31
NKAADDQETTSADT

SEQ ID NO: 111942 - protein, 14 aa, Borrelia burgdorferi B31
KAADDQETTSADTN

SEQ ID NO: 111943 - protein, 14 aa, Borrelia burgdorferi B31
AADDQETTSADTNS

SEQ ID NO: 111944 - protein, 14 aa, Borrelia burgdorferi B31
ADDQETTSADTNSN

SEQ ID NO: 111945 - protein, 14 aa, Borrelia burgdorferi B31
DDQETTSADTNSNA

SEQ ID NO: 111946 - protein, 14 aa, Borrelia burgdorferi B31
DQETTSADTNSNAA

SEQ ID NO: 111947 - protein, 14 aa, Borrelia burgdorferi B31
QETTSADTNSNAAK

SEQ ID NO: 111948 - protein, 14 aa, Borrelia burgdorferi B31
ETTSADTNSNAAKN

SEQ ID NO: 111949 - protein, 14 aa, Borrelia burgdorferi B31
TTSADTNSNAAKNI

SEQ ID NO: 111950 - protein, 14 aa, Borrelia burgdorferi B31
TSADTNSNAAKNIP

SEQ ID NO: 111951 - protein, 14 aa, Borrelia burgdorferi B31
SADTNSNAAKNIPI

SEQ ID NO: 111952 - protein, 14 aa, Borrelia burgdorferi B31
ADTNSNAAKNIPIA

SEQ ID NO: 111953 - protein, 14 aa, Borrelia burgdorferi B31
DTNSNAAKNIPIAD

SEQ ID NO: 111954 - protein, 14 aa, Borrelia burgdorferi B31
TNSNAAKNIPIADN

SEQ ID NO: 111955 - protein, 14 aa, Borrelia burgdorferi B31
NSNAAKNIPIADND

SEQ ID NO: 111956 - protein, 14 aa, Borrelia burgdorferi B31
SNAAKNIPIADNDK

SEQ ID NO: 111957 - protein, 14 aa, Borrelia burgdorferi B31
NAAKNIPIADNDKV

SEQ ID NO: 111958 - protein, 14 aa, Borrelia burgdorferi B31
AAKNIPIADNDKVA

SEQ ID NO: 111959 - protein, 14 aa, Borrelia burgdorferi B31
AKNIPIADNDKVAA

SEQ ID NO: 111960 - protein, 14 aa, Borrelia burgdorferi B31
KNIPIADNDKVAAE

SEQ ID NO: 111961 - protein, 14 aa, Borrelia burgdorferi B31
NIPIADNDKVAAEL

SEQ ID NO: 111962 - protein, 14 aa, Borrelia burgdorferi B31
IPIADNDKVAAELK

SEQ ID NO: 111963 - protein, 14 aa, Borrelia burgdorferi B31
PIADNDKVAAELKK

SEQ ID NO: 111964 - protein, 14 aa, Borrelia burgdorferi B31
IADNDKVAAELKKQ

SEQ ID NO: 111965 - protein, 14 aa, Borrelia burgdorferi B31
ADNDKVAAELKKQS

SEQ ID NO: 111966 - protein, 14 aa, Borrelia burgdorferi B31
DNDKVAAELKKQSQ

SEQ ID NO: 111967 - protein, 14 aa, Borrelia burgdorferi B31
NDKVAAELKKQSQA

SEQ ID NO: 111968 - protein, 14 aa, Borrelia burgdorferi B31
DKVAAELKKQSQAA

SEQ ID NO: 111969 - protein, 14 aa, Borrelia burgdorferi B31
KVAAELKKQSQAAK

SEQ ID NO: 111970 - protein, 14 aa, Borrelia burgdorferi B31
VAAELKKQSQAAKT

SEQ ID NO: 111971 - protein, 14 aa, Borrelia burgdorferi B31
AAELKKQSQAAKTV

SEQ ID NO: 111972 - protein, 14 aa, Borrelia burgdorferi B31
AELKKQSQAAKTVA

SEQ ID NO: 111973 - protein, 14 aa, Borrelia burgdorferi B31
ELKKQSQAAKTVAA

SEQ ID NO: 111974 - protein, 14 aa, Borrelia burgdorferi B31
LKKQSQAAKTVAAA

SEQ ID NO: 111975 - protein, 14 aa, Borrelia burgdorferi B31
KKQSQAAKTVAAAP

SEQ ID NO: 111976 - protein, 14 aa, Borrelia burgdorferi B31
KQSQAAKTVAAAPN

SEQ ID NO: 111977 - protein, 14 aa, Borrelia burgdorferi B31
QSQAAKTVAAAPNK

SEQ ID NO: 111978 - protein, 14 aa, Borrelia burgdorferi B31
SQAAKTVAAAPNKG

SEQ ID NO: 111979 - protein, 14 aa, Borrelia burgdorferi B31
QAAKTVAAAPNKGS

SEQ ID NO: 111980 - protein, 14 aa, Borrelia burgdorferi B31
AAKTVAAAPNKGSQ

SEQ ID NO: 111981 - protein, 14 aa, Borrelia burgdorferi B31
AKTVAAAPNKGSQN

SEQ ID NO: 111982 - protein, 14 aa, Borrelia burgdorferi B31
KTVAAAPNKGSQNQ

SEQ ID NO: 111983 - protein, 14 aa, Borrelia burgdorferi B31
TVAAAPNKGSQNQP

SEQ ID NO: 111984 - protein, 14 aa, Borrelia burgdorferi B31
VAAAPNKGSQNQPQ

SEQ ID NO: 111985 - protein, 14 aa, Borrelia burgdorferi B31
AAAPNKGSQNQPQT

SEQ ID NO: 111986 - protein, 14 aa, Borrelia burgdorferi B31
AAPNKGSQNQPQTT

SEQ ID NO: 111987 - protein, 14 aa, Borrelia burgdorferi B31
APNKGSQNQPQTTP

SEQ ID NO: 111988 - protein, 14 aa, Borrelia burgdorferi B31
PNKGSQNQPQTTPN

SEQ ID NO: 111989 - protein, 14 aa, Borrelia burgdorferi B31
NKGSQNQPQTTPNK

SEQ ID NO: 111990 - protein, 14 aa, Borrelia burgdorferi B31
KGSQNQPQTTPNKG

SEQ ID NO: 111991 - protein, 14 aa, Borrelia burgdorferi B31
GSQNQPQTTPNKGS

SEQ ID NO: 111992 - protein, 14 aa, Borrelia burgdorferi B31
SQNQPQTTPNKGSQ

SEQ ID NO: 111993 - protein, 14 aa, Borrelia burgdorferi B31
QNQPQTTPNKGSQN

SEQ ID NO: 111994 - protein, 14 aa, Borrelia burgdorferi B31
NQPQTTPNKGSQNQ

SEQ ID NO: 111995 - protein, 14 aa, Borrelia burgdorferi B31
QPQTTPNKGSQNQQ

SEQ ID NO: 111996 - protein, 14 aa, Borrelia burgdorferi B31
PQTTPNKGSQNQQA

SEQ ID NO: 111997 - protein, 14 aa, Borrelia burgdorferi B31
QTTPNKGSQNQQAA

SEQ ID NO: 111998 - protein, 14 aa, Borrelia burgdorferi B31
TTPNKGSQNQQAAP

SEQ ID NO: 111999 - protein, 14 aa, Borrelia burgdorferi B31
TPNKGSQNQQAAPS

SEQ ID NO: 112000 - protein, 14 aa, Borrelia burgdorferi B31
PNKGSQNQQAAPSP

SEQ ID NO: 112001 - protein, 14 aa, Borrelia burgdorferi B31
NKGSQNQQAAPSPQ

SEQ ID NO: 112002 - protein, 14 aa, Borrelia burgdorferi B31
KGSQNQQAAPSPQL

SEQ ID NO: 112003 - protein, 14 aa, Borrelia burgdorferi B31
GSQNQQAAPSPQLQ

SEQ ID NO: 112004 - protein, 14 aa, Borrelia burgdorferi B31
SQNQQAAPSPQLQS

SEQ ID NO: 112005 - protein, 14 aa, Borrelia burgdorferi B31
QNQQAAPSPQLQSL

SEQ ID NO: 112006 - protein, 14 aa, Borrelia burgdorferi B31
NQQAAPSPQLQSLS

SEQ ID NO: 112007 - protein, 14 aa, Borrelia burgdorferi B31
QQAAPSPQLQSLSF

SEQ ID NO: 112008 - protein, 14 aa, Borrelia burgdorferi B31
QAAPSPQLQSLSFS

SEQ ID NO: 112009 - protein, 14 aa, Borrelia burgdorferi B31
AAPSPQLQSLSFSA

SEQ ID NO: 112010 - protein, 14 aa, Borrelia burgdorferi B31
APSPQLQSLSFSAD

SEQ ID NO: 112011 - protein, 14 aa, Borrelia burgdorferi B31
PSPQLQSLSFSADL

SEQ ID NO: 112012 - protein, 14 aa, Borrelia burgdorferi B31
SPQLQSLSFSADLS

SEQ ID NO: 112013 - protein, 14 aa, Borrelia burgdorferi B31
PQLQSLSFSADLSN

SEQ ID NO: 112014 - protein, 14 aa, Borrelia burgdorferi B31
QLQSLSFSADLSNL

SEQ ID NO: 112015 - protein, 14 aa, Borrelia burgdorferi B31
LQSLSFSADLSNLP

SEQ ID NO: 112016 - protein, 14 aa, Borrelia burgdorferi B31
QSLSFSADLSNLPK

SEQ ID NO: 112017 - protein, 14 aa, Borrelia burgdorferi B31
SLSFSADLSNLPKT

SEQ ID NO: 112018 - protein, 14 aa, Borrelia burgdorferi B31
LSFSADLSNLPKTT

SEQ ID NO: 112019 - protein, 14 aa, Borrelia burgdorferi B31
SFSADLSNLPKTTA

SEQ ID NO: 112020 - protein, 14 aa, Borrelia burgdorferi B31
FSADLSNLPKTTAA

SEQ ID NO: 112021 - protein, 14 aa, Borrelia burgdorferi B31
SADLSNLPKTTAAR

SEQ ID NO: 112022 - protein, 14 aa, Borrelia burgdorferi B31
ADLSNLPKTTAARA

SEQ ID NO: 112023 - protein, 14 aa, Borrelia burgdorferi B31
DLSNLPKTTAARAA

SEQ ID NO: 112024 - protein, 14 aa, Borrelia burgdorferi B31
LSNLPKTTAARAAS

SEQ ID NO: 112025 - protein, 14 aa, Borrelia burgdorferi B31
SNLPKTTAARAASL

SEQ ID NO: 112026 - protein, 14 aa, Borrelia burgdorferi B31
NLPKTTAARAASLT

SEQ ID NO: 112027 - protein, 14 aa, Borrelia burgdorferi B31
LPKTTAARAASLTK

SEQ ID NO: 112028 - protein, 14 aa, Borrelia burgdorferi B31
PKTTAARAASLTKQ

SEQ ID NO: 112029 - protein, 14 aa, Borrelia burgdorferi B31
KTTAARAASLTKQR

SEQ ID NO: 112030 - protein, 14 aa, Borrelia burgdorferi B31
TTAARAASLTKQRI

SEQ ID NO: 112031 - protein, 14 aa, Borrelia burgdorferi B31
TAARAASLTKQRIP

SEQ ID NO: 112032 - protein, 14 aa, Borrelia burgdorferi B31
AARAASLTKQRIPI

SEQ ID NO: 112033 - protein, 14 aa, Borrelia burgdorferi B31
ARAASLTKQRIPIQ

SEQ ID NO: 112034 - protein, 14 aa, Borrelia burgdorferi B31
RAASLTKQRIPIQA

SEQ ID NO: 112035 - protein, 14 aa, Borrelia burgdorferi B31
AASLTKQRIPIQAV

SEQ ID NO: 112036 - protein, 14 aa, Borrelia burgdorferi B31
ASLTKQRIPIQAVT

SEQ ID NO: 112037 - protein, 14 aa, Borrelia burgdorferi B31
SLTKQRIPIQAVTT

SEQ ID NO: 112038 - protein, 14 aa, Borrelia burgdorferi B31
LTKQRIPIQAVTTV

SEQ ID NO: 112039 - protein, 14 aa, Borrelia burgdorferi B31
TKQRIPIQAVTTVP

SEQ ID NO: 112040 - protein, 14 aa, Borrelia burgdorferi B31
KQRIPIQAVTTVPG

SEQ ID NO: 112041 - protein, 14 aa, Borrelia burgdorferi B31
QRIPIQAVTTVPGN

SEQ ID NO: 112042 - protein, 14 aa, Borrelia burgdorferi B31
RIPIQAVTTVPGNT

SEQ ID NO: 112043 - protein, 14 aa, Borrelia burgdorferi B31
IPIQAVTTVPGNTR

SEQ ID NO: 112044 - protein, 14 aa, Borrelia burgdorferi B31
PIQAVTTVPGNTRT

SEQ ID NO: 112045 - protein, 14 aa, Borrelia burgdorferi B31
IQAVTTVPGNTRTF

SEQ ID NO: 112046 - protein, 14 aa, Borrelia burgdorferi B31
QAVTTVPGNTRTFN

SEQ ID NO: 112047 - protein, 14 aa, Borrelia burgdorferi B31
AVTTVPGNTRTFNS

SEQ ID NO: 112048 - protein, 14 aa, Borrelia burgdorferi B31
VTTVPGNTRTFNSR

SEQ ID NO: 112049 - protein, 14 aa, Borrelia burgdorferi B31
TTVPGNTRTFNSRN

SEQ ID NO: 112050 - protein, 14 aa, Borrelia burgdorferi B31
TVPGNTRTFNSRNS

SEQ ID NO: 112051 - protein, 14 aa, Borrelia burgdorferi B31
VPGNTRTFNSRNSG

SEQ ID NO: 112052 - protein, 14 aa, Borrelia burgdorferi B31
PGNTRTFNSRNSGL

SEQ ID NO: 112053 - protein, 14 aa, Borrelia burgdorferi B31
GNTRTFNSRNSGLP

SEQ ID NO: 112054 - protein, 14 aa, Borrelia burgdorferi B31
NTRTFNSRNSGLPT

SEQ ID NO: 112055 - protein, 14 aa, Borrelia burgdorferi B31
TRTFNSRNSGLPTF

SEQ ID NO: 112056 - protein, 14 aa, Borrelia burgdorferi B31
RTFNSRNSGLPTFA

SEQ ID NO: 112057 - protein, 14 aa, Borrelia burgdorferi B31
TFNSRNSGLPTFAL

SEQ ID NO: 112058 - protein, 14 aa, Borrelia burgdorferi B31
FNSRNSGLPTFALN

SEQ ID NO: 112059 - protein, 14 aa, Borrelia burgdorferi B31
NSRNSGLPTFALNY

SEQ ID NO: 112060 - protein, 14 aa, Borrelia burgdorferi B31
SRNSGLPTFALNYS

SEQ ID NO: 112061 - protein, 14 aa, Borrelia burgdorferi B31
RNSGLPTFALNYSF

SEQ ID NO: 112062 - protein, 14 aa, Borrelia burgdorferi B31
NSGLPTFALNYSFS

SEQ ID NO: 112063 - protein, 14 aa, Borrelia burgdorferi B31
SGLPTFALNYSFSQ

SEQ ID NO: 112064 - protein, 14 aa, Borrelia burgdorferi B31
GLPTFALNYSFSQP

SEQ ID NO: 112065 - protein, 14 aa, Borrelia burgdorferi B31
LPTFALNYSFSQPT

SEQ ID NO: 112066 - protein, 14 aa, Borrelia burgdorferi B31
PTFALNYSFSQPTR

SEQ ID NO: 112067 - protein, 14 aa, Borrelia burgdorferi B31
TFALNYSFSQPTRQ

SEQ ID NO: 112068 - protein, 14 aa, Borrelia burgdorferi B31
FALNYSFSQPTRQQ

SEQ ID NO: 112069 - protein, 14 aa, Borrelia burgdorferi B31
ALNYSFSQPTRQQT

SEQ ID NO: 112070 - protein, 14 aa, Borrelia burgdorferi B31
LNYSFSQPTRQQTN

SEQ ID NO: 112071 - protein, 14 aa, Borrelia burgdorferi B31
NYSFSQPTRQQTNS

SEQ ID NO: 112072 - protein, 14 aa, Borrelia burgdorferi B31
YSFSQPTRQQTNSS

SEQ ID NO: 112073 - protein, 14 aa, Borrelia burgdorferi B31
SFSQPTRQQTNSSS

SEQ ID NO: 112074 - protein, 14 aa, Borrelia burgdorferi B31
FSQPTRQQTNSSSA

SEQ ID NO: 112075 - protein, 14 aa, Borrelia burgdorferi B31
SQPTRQQTNSSSAV

SEQ ID NO: 112076 - protein, 14 aa, Borrelia burgdorferi B31
QPTRQQTNSSSAVQ

SEQ ID NO: 112077 - protein, 14 aa, Borrelia burgdorferi B31
PTRQQTNSSSAVQT

SEQ ID NO: 112078 - protein, 14 aa, Borrelia burgdorferi B31
TRQQTNSSSAVQTT

SEQ ID NO: 112079 - protein, 14 aa, Borrelia burgdorferi B31
RQQTNSSSAVQTTT

SEQ ID NO: 112080 - protein, 14 aa, Borrelia burgdorferi B31
QQTNSSSAVQTTTS

SEQ ID NO: 112081 - protein, 14 aa, Borrelia burgdorferi B31
QTNSSSAVQTTTSS

SEQ ID NO: 112082 - protein, 14 aa, Borrelia burgdorferi B31
TNSSSAVQTTTSSG

SEQ ID NO: 112083 - protein, 14 aa, Borrelia burgdorferi B31
NSSSAVQTTTSSGS

SEQ ID NO: 112084 - protein, 14 aa, Borrelia burgdorferi B31
SSSAVQTTTSSGSK

SEQ ID NO: 112085 - protein, 14 aa, Borrelia burgdorferi B31
SSAVQTTTSSGSKL

SEQ ID NO: 112086 - protein, 14 aa, Borrelia burgdorferi B31
SAVQTTTSSGSKLQ

SEQ ID NO: 112087 - protein, 14 aa, Borrelia burgdorferi B31
AVQTTTSSGSKLQT

SEQ ID NO: 112088 - protein, 14 aa, Borrelia burgdorferi B31
VQTTTSSGSKLQTL

SEQ ID NO: 112089 - protein, 14 aa, Borrelia burgdorferi B31
QTTTSSGSKLQTLK

SEQ ID NO: 112090 - protein, 14 aa, Borrelia burgdorferi B31
TTTSSGSKLQTLKN

SEQ ID NO: 112091 - protein, 14 aa, Borrelia burgdorferi B31
TTSSGSKLQTLKNE

SEQ ID NO: 112092 - protein, 14 aa, Borrelia burgdorferi B31
TSSGSKLQTLKNEL

SEQ ID NO: 112093 - protein, 14 aa, Borrelia burgdorferi B31
SSGSKLQTLKNELI

SEQ ID NO: 112094 - protein, 14 aa, Borrelia burgdorferi B31
SGSKLQTLKNELIR

SEQ ID NO: 112095 - protein, 14 aa, Borrelia burgdorferi B31
GSKLQTLKNELIRA

SEQ ID NO: 112096 - protein, 14 aa, Borrelia burgdorferi B31
SKLQTLKNELIRAI

SEQ ID NO: 112097 - protein, 14 aa, Borrelia burgdorferi B31
KLQTLKNELIRAIS

SEQ ID NO: 112098 - protein, 14 aa, Borrelia burgdorferi B31
LQTLKNELIRAISE

SEQ ID NO: 112099 - protein, 14 aa, Borrelia burgdorferi B31
QTLKNELIRAISEE

SEQ ID NO: 112100 - protein, 14 aa, Borrelia burgdorferi B31
TLKNELIRAISEEK

SEQ ID NO: 112101 - protein, 14 aa, Borrelia burgdorferi B31
LKNELIRAISEEKN

SEQ ID NO: 112102 - protein, 14 aa, Borrelia burgdorferi B31
KNELIRAISEEKNK

SEQ ID NO: 112103 - protein, 14 aa, Borrelia burgdorferi B31
NELIRAISEEKNKT

SEQ ID NO: 112104 - protein, 14 aa, Borrelia burgdorferi B31
ELIRAISEEKNKTQ

SEQ ID NO: 112105 - protein, 14 aa, Borrelia burgdorferi B31
LIRAISEEKNKTQN

SEQ ID NO: 112106 - protein, 14 aa, Borrelia burgdorferi B31
IRAISEEKNKTQNN

SEQ ID NO: 112107 - protein, 14 aa, Borrelia burgdorferi B31
RAISEEKNKTQNNF

SEQ ID NO: 112108 - protein, 14 aa, Borrelia burgdorferi B31
AISEEKNKTQNNFG

SEQ ID NO: 112109 - protein, 14 aa, Borrelia burgdorferi B31
ISEEKNKTQNNFGF

SEQ ID NO: 112110 - protein, 14 aa, Borrelia burgdorferi B31
SEEKNKTQNNFGFR

SEQ ID NO: 112111 - protein, 14 aa, Borrelia burgdorferi B31
EEKNKTQNNFGFRE

SEQ ID NO: 112112 - protein, 14 aa, Borrelia burgdorferi B31
EKNKTQNNFGFRET

SEQ ID NO: 112113 - protein, 14 aa, Borrelia burgdorferi B31
KNKTQNNFGFRETY

SEQ ID NO: 112114 - protein, 14 aa, Borrelia burgdorferi B31
NKTQNNFGFRETYD

SEQ ID NO: 112115 - protein, 14 aa, Borrelia burgdorferi B31
KTQNNFGFRETYDQ

SEQ ID NO: 112116 - protein, 14 aa, Borrelia burgdorferi B31
TQNNFGFRETYDQF

SEQ ID NO: 112117 - protein, 14 aa, Borrelia burgdorferi B31
QNNFGFRETYDQFK

SEQ ID NO: 112118 - protein, 14 aa, Borrelia burgdorferi B31
NNFGFRETYDQFKM

SEQ ID NO: 112119 - protein, 14 aa, Borrelia burgdorferi B31
NFGFRETYDQFKMK

SEQ ID NO: 112120 - protein, 14 aa, Borrelia burgdorferi B31
FGFRETYDQFKMKD

SEQ ID NO: 112121 - protein, 14 aa, Borrelia burgdorferi B31
GFRETYDQFKMKDS

SEQ ID NO: 112122 - protein, 14 aa, Borrelia burgdorferi B31
FRETYDQFKMKDSA

SEQ ID NO: 112123 - protein, 14 aa, Borrelia burgdorferi B31
RETYDQFKMKDSAF

SEQ ID NO: 112124 - protein, 14 aa, Borrelia burgdorferi B31
ETYDQFKMKDSAFE

SEQ ID NO: 112125 - protein, 14 aa, Borrelia burgdorferi B31
TYDQFKMKDSAFEL

SEQ ID NO: 112126 - protein, 14 aa, Borrelia burgdorferi B31
YDQFKMKDSAFELL

SEQ ID NO: 112127 - protein, 14 aa, Borrelia burgdorferi B31
DQFKMKDSAFELLD

SEQ ID NO: 112128 - protein, 14 aa, Borrelia burgdorferi B31
QFKMKDSAFELLDV

SEQ ID NO: 112129 - protein, 14 aa, Borrelia burgdorferi B31
FKMKDSAFELLDVI

SEQ ID NO: 112130 - protein, 14 aa, Borrelia burgdorferi B31
KMKDSAFELLDVIS

SEQ ID NO: 112131 - protein, 14 aa, Borrelia burgdorferi B31
MKDSAFELLDVISS

SEQ ID NO: 112132 - protein, 14 aa, Borrelia burgdorferi B31
KDSAFELLDVISSA

SEQ ID NO: 112133 - protein, 14 aa, Borrelia burgdorferi B31
DSAFELLDVISSAK

SEQ ID NO: 112134 - protein, 14 aa, Borrelia burgdorferi B31
SAFELLDVISSAKV

SEQ ID NO: 112135 - protein, 14 aa, Borrelia burgdorferi B31
AFELLDVISSAKVY

SEQ ID NO: 112136 - protein, 14 aa, Borrelia burgdorferi B31
FELLDVISSAKVYD

SEQ ID NO: 112137 - protein, 14 aa, Borrelia burgdorferi B31
ELLDVISSAKVYDR

SEQ ID NO: 112138 - protein, 14 aa, Borrelia burgdorferi B31
LLDVISSAKVYDRS

SEQ ID NO: 112139 - protein, 14 aa, Borrelia burgdorferi B31
LDVISSAKVYDRSY

SEQ ID NO: 112140 - protein, 14 aa, Borrelia burgdorferi B31
DVISSAKVYDRSYA

SEQ ID NO: 112141 - protein, 14 aa, Borrelia burgdorferi B31
VISSAKVYDRSYAP

SEQ ID NO: 112142 - protein, 14 aa, Borrelia burgdorferi B31
ISSAKVYDRSYAPQ

SEQ ID NO: 112143 - protein, 14 aa, Borrelia burgdorferi B31
SSAKVYDRSYAPQL

SEQ ID NO: 112144 - protein, 14 aa, Borrelia burgdorferi B31
SAKVYDRSYAPQLN

SEQ ID NO: 112145 - protein, 14 aa, Borrelia burgdorferi B31
AKVYDRSYAPQLNS

SEQ ID NO: 112146 - protein, 14 aa, Borrelia burgdorferi B31
KVYDRSYAPQLNSN

SEQ ID NO: 112147 - protein, 14 aa, Borrelia burgdorferi B31
VYDRSYAPQLNSNT

SEQ ID NO: 112148 - protein, 14 aa, Borrelia burgdorferi B31
YDRSYAPQLNSNTP

SEQ ID NO: 112149 - protein, 14 aa, Borrelia burgdorferi B31
DRSYAPQLNSNTPE

SEQ ID NO: 112150 - protein, 14 aa, Borrelia burgdorferi B31
RSYAPQLNSNTPEA

SEQ ID NO: 112151 - protein, 14 aa, Borrelia burgdorferi B31
SYAPQLNSNTPEAE

SEQ ID NO: 112152 - protein, 14 aa, Borrelia burgdorferi B31
YAPQLNSNTPEAEN

SEQ ID NO: 112153 - protein, 14 aa, Borrelia burgdorferi B31
APQLNSNTPEAENE

SEQ ID NO: 112154 - protein, 14 aa, Borrelia burgdorferi B31
PQLNSNTPEAENER

SEQ ID NO: 112155 - protein, 14 aa, Borrelia burgdorferi B31
QLNSNTPEAENERN

SEQ ID NO: 112156 - protein, 14 aa, Borrelia burgdorferi B31
LNSNTPEAENERNK

SEQ ID NO: 112157 - protein, 14 aa, Borrelia burgdorferi B31
NSNTPEAENERNKF

SEQ ID NO: 112158 - protein, 14 aa, Borrelia burgdorferi B31
SNTPEAENERNKFY

SEQ ID NO: 112159 - protein, 14 aa, Borrelia burgdorferi B31
NTPEAENERNKFYA

SEQ ID NO: 112160 - protein, 14 aa, Borrelia burgdorferi B31
TPEAENERNKFYAL

SEQ ID NO: 112161 - protein, 14 aa, Borrelia burgdorferi B31
PEAENERNKFYALM

SEQ ID NO: 112162 - protein, 14 aa, Borrelia burgdorferi B31
EAENERNKFYALMD

SEQ ID NO: 112163 - protein, 14 aa, Borrelia burgdorferi B31
AENERNKFYALMDF

SEQ ID NO: 112164 - protein, 14 aa, Borrelia burgdorferi B31
ENERNKFYALMDFD

SEQ ID NO: 112165 - protein, 14 aa, Borrelia burgdorferi B31
NERNKFYALMDFDQ

SEQ ID NO: 112166 - protein, 14 aa, Borrelia burgdorferi B31
ERNKFYALMDFDQY

SEQ ID NO: 112167 - protein, 14 aa, Borrelia burgdorferi B31
RNKFYALMDFDQYK

SEQ ID NO: 112168 - protein, 14 aa, Borrelia burgdorferi B31
NKFYALMDFDQYKI

SEQ ID NO: 112169 - protein, 14 aa, Borrelia burgdorferi B31
KFYALMDFDQYKIE

SEQ ID NO: 112170 - protein, 14 aa, Borrelia burgdorferi B31
FYALMDFDQYKIEQ

SEQ ID NO: 112171 - protein, 14 aa, Borrelia burgdorferi B31
YALMDFDQYKIEQF

SEQ ID NO: 112172 - protein, 14 aa, Borrelia burgdorferi B31
ALMDFDQYKIEQFG

SEQ ID NO: 112173 - protein, 14 aa, Borrelia burgdorferi B31
LMDFDQYKIEQFGS

SEQ ID NO: 112174 - protein, 14 aa, Borrelia burgdorferi B31
MDFDQYKIEQFGSI

SEQ ID NO: 112175 - protein, 14 aa, Borrelia burgdorferi B31
DFDQYKIEQFGSIM

SEQ ID NO: 112176 - protein, 14 aa, Borrelia burgdorferi B31
FDQYKIEQFGSIME

SEQ ID NO: 112177 - protein, 14 aa, Borrelia burgdorferi B31
DQYKIEQFGSIMEA

SEQ ID NO: 112178 - protein, 14 aa, Borrelia burgdorferi B31
QYKIEQFGSIMEAL

SEQ ID NO: 112179 - protein, 14 aa, Borrelia burgdorferi B31
YKIEQFGSIMEALY

SEQ ID NO: 112180 - protein, 14 aa, Borrelia burgdorferi B31
KIEQFGSIMEALYN

SEQ ID NO: 112181 - protein, 14 aa, Borrelia burgdorferi B31
IEQFGSIMEALYNE

SEQ ID NO: 112182 - protein, 14 aa, Borrelia burgdorferi B31
EQFGSIMEALYNEN

SEQ ID NO: 112183 - protein, 14 aa, Borrelia burgdorferi B31
QFGSIMEALYNENQ

SEQ ID NO: 112184 - protein, 14 aa, Borrelia burgdorferi B31
FGSIMEALYNENQN

SEQ ID NO: 112185 - protein, 14 aa, Borrelia burgdorferi B31
GSIMEALYNENQNH

SEQ ID NO: 112186 - protein, 14 aa, Borrelia burgdorferi B31
SIMEALYNENQNHS

SEQ ID NO: 112187 - protein, 14 aa, Borrelia burgdorferi B31
IMEALYNENQNHSL

SEQ ID NO: 112188 - protein, 14 aa, Borrelia burgdorferi B31
MEALYNENQNHSLI

SEQ ID NO: 112189 - protein, 14 aa, Borrelia burgdorferi B31
EALYNENQNHSLIR

SEQ ID NO: 112190 - protein, 14 aa, Borrelia burgdorferi B31
ALYNENQNHSLIRE

SEQ ID NO: 112191 - protein, 14 aa, Borrelia burgdorferi B31
LYNENQNHSLIREL

SEQ ID NO: 112192 - protein, 14 aa, Borrelia burgdorferi B31
YNENQNHSLIRELM

SEQ ID NO: 112193 - protein, 14 aa, Borrelia burgdorferi B31
NENQNHSLIRELMI

SEQ ID NO: 112194 - protein, 14 aa, Borrelia burgdorferi B31
ENQNHSLIRELMIS

SEQ ID NO: 112195 - protein, 14 aa, Borrelia burgdorferi B31
NQNHSLIRELMISG

SEQ ID NO: 112196 - protein, 14 aa, Borrelia burgdorferi B31
QNHSLIRELMISGL

SEQ ID NO: 112197 - protein, 14 aa, Borrelia burgdorferi B31
NHSLIRELMISGLG

SEQ ID NO: 112198 - protein, 14 aa, Borrelia burgdorferi B31
HSLIRELMISGLGT

SEQ ID NO: 112199 - protein, 14 aa, Borrelia burgdorferi B31
SLIRELMISGLGTQ

SEQ ID NO: 112200 - protein, 14 aa, Borrelia burgdorferi B31
LIRELMISGLGTQI

SEQ ID NO: 112201 - protein, 14 aa, Borrelia burgdorferi B31
IRELMISGLGTQIS

SEQ ID NO: 112202 - protein, 14 aa, Borrelia burgdorferi B31
RELMISGLGTQISF

SEQ ID NO: 112203 - protein, 14 aa, Borrelia burgdorferi B31
ELMISGLGTQISFE

SEQ ID NO: 112204 - protein, 14 aa, Borrelia burgdorferi B31
LMISGLGTQISFEL

SEQ ID NO: 112205 - protein, 14 aa, Borrelia burgdorferi B31
MISGLGTQISFELA

SEQ ID NO: 112206 - protein, 14 aa, Borrelia burgdorferi B31
ISGLGTQISFELAL

SEQ ID NO: 112207 - protein, 14 aa, Borrelia burgdorferi B31
SGLGTQISFELALE

SEQ ID NO: 112208 - protein, 14 aa, Borrelia burgdorferi B31
GLGTQISFELALEE

SEQ ID NO: 112209 - protein, 14 aa, Borrelia burgdorferi B31
LGTQISFELALEEI

SEQ ID NO: 112210 - protein, 14 aa, Borrelia burgdorferi B31
GTQISFELALEEIN

SEQ ID NO: 112211 - protein, 14 aa, Borrelia burgdorferi B31
TQISFELALEEINK

SEQ ID NO: 112212 - protein, 14 aa, Borrelia burgdorferi B31
QISFELALEEINKK

SEQ ID NO: 112213 - protein, 14 aa, Borrelia burgdorferi B31
ISFELALEEINKKI

SEQ ID NO: 112214 - protein, 14 aa, Borrelia burgdorferi B31
SFELALEEINKKIE

SEQ ID NO: 112215 - protein, 14 aa, Borrelia burgdorferi B31
FELALEEINKKIEI

SEQ ID NO: 112216 - protein, 14 aa, Borrelia burgdorferi B31
ELALEEINKKIEIF

SEQ ID NO: 112217 - protein, 14 aa, Borrelia burgdorferi B31
LALEEINKKIEIFN

SEQ ID NO: 112218 - protein, 14 aa, Borrelia burgdorferi B31
ALEEINKKIEIFNQ

SEQ ID NO: 112219 - protein, 14 aa, Borrelia burgdorferi B31
LEEINKKIEIFNQD

SEQ ID NO: 112220 - protein, 14 aa, Borrelia burgdorferi B31
EEINKKIEIFNQDY

SEQ ID NO: 112221 - protein, 14 aa, Borrelia burgdorferi B31
EINKKIEIFNQDYL

SEQ ID NO: 112222 - protein, 14 aa, Borrelia burgdorferi B31
INKKIEIFNQDYLN

SEQ ID NO: 112223 - protein, 14 aa, Borrelia burgdorferi B31
NKKIEIFNQDYLNA

SEQ ID NO: 112224 - protein, 14 aa, Borrelia burgdorferi B31
KKIEIFNQDYLNAK

SEQ ID NO: 112225 - protein, 14 aa, Borrelia burgdorferi B31
KIEIFNQDYLNAKI

SEQ ID NO: 112226 - protein, 14 aa, Borrelia burgdorferi B31
IEIFNQDYLNAKIN

SEQ ID NO: 112227 - protein, 14 aa, Borrelia burgdorferi B31
EIFNQDYLNAKINS

SEQ ID NO: 112228 - protein, 14 aa, Borrelia burgdorferi B31
IFNQDYLNAKINSF

SEQ ID NO: 112229 - protein, 14 aa, Borrelia burgdorferi B31
FNQDYLNAKINSFD

SEQ ID NO: 112230 - protein, 14 aa, Borrelia burgdorferi B31
NQDYLNAKINSFDF

SEQ ID NO: 112231 - protein, 14 aa, Borrelia burgdorferi B31
QDYLNAKINSFDFT

SEQ ID NO: 112232 - protein, 14 aa, Borrelia burgdorferi B31
DYLNAKINSFDFTM

SEQ ID NO: 112233 - protein, 14 aa, Borrelia burgdorferi B31
YLNAKINSFDFTMK

SEQ ID NO: 112234 - protein, 14 aa, Borrelia burgdorferi B31
LNAKINSFDFTMKL

SEQ ID NO: 112235 - protein, 14 aa, Borrelia burgdorferi B31
NAKINSFDFTMKLK

SEQ ID NO: 112236 - protein, 14 aa, Borrelia burgdorferi B31
AKINSFDFTMKLKE

SEQ ID NO: 112237 - protein, 14 aa, Borrelia burgdorferi B31
KINSFDFTMKLKEL

SEQ ID NO: 112238 - protein, 14 aa, Borrelia burgdorferi B31
INSFDFTMKLKELK

SEQ ID NO: 112239 - protein, 14 aa, Borrelia burgdorferi B31
NSFDFTMKLKELKS

SEQ ID NO: 112240 - protein, 14 aa, Borrelia burgdorferi B31
SFDFTMKLKELKSK

SEQ ID NO: 112241 - protein, 14 aa, Borrelia burgdorferi B31
FDFTMKLKELKSKL

SEQ ID NO: 112242 - protein, 14 aa, Borrelia burgdorferi B31
DFTMKLKELKSKLN

SEQ ID NO: 112243 - protein, 14 aa, Borrelia burgdorferi B31
FTMKLKELKSKLNQ

SEQ ID NO: 112244 - protein, 14 aa, Borrelia burgdorferi B31
TMKLKELKSKLNQI

SEQ ID NO: 112245 - protein, 14 aa, Borrelia burgdorferi B31
MKLKELKSKLNQIL

SEQ ID NO: 112246 - protein, 14 aa, Borrelia burgdorferi B31
KLKELKSKLNQILD

SEQ ID NO: 112247 - protein, 14 aa, Borrelia burgdorferi B31
LKELKSKLNQILDK

SEQ ID NO: 112248 - protein, 14 aa, Borrelia burgdorferi B31
KELKSKLNQILDKR

SEQ ID NO: 112249 - protein, 14 aa, Borrelia burgdorferi B31
ELKSKLNQILDKRK

SEQ ID NO: 112250 - protein, 14 aa, Borrelia burgdorferi B31
LKSKLNQILDKRKE

SEQ ID NO: 112251 - protein, 14 aa, Borrelia burgdorferi B31
KSKLNQILDKRKEW

SEQ ID NO: 112252 - protein, 14 aa, Borrelia burgdorferi B31
SKLNQILDKRKEWS

SEQ ID NO: 112253 - protein, 14 aa, Borrelia burgdorferi B31
KLNQILDKRKEWSR

SEQ ID NO: 112254 - protein, 14 aa, Borrelia burgdorferi B31
LNQILDKRKEWSRQ

SEQ ID NO: 112255 - protein, 14 aa, Borrelia burgdorferi B31
NQILDKRKEWSRQA

SEQ ID NO: 112256 - protein, 14 aa, Borrelia burgdorferi B31
QILDKRKEWSRQAD

SEQ ID NO: 112257 - protein, 14 aa, Borrelia burgdorferi B31
ILDKRKEWSRQADG

SEQ ID NO: 112258 - protein, 14 aa, Borrelia burgdorferi B31
LDKRKEWSRQADGL

SEQ ID NO: 112259 - protein, 14 aa, Borrelia burgdorferi B31
DKRKEWSRQADGLI

SEQ ID NO: 112260 - protein, 14 aa, Borrelia burgdorferi B31
KRKEWSRQADGLIA

SEQ ID NO: 112261 - protein, 14 aa, Borrelia burgdorferi B31
RKEWSRQADGLIAN

SEQ ID NO: 112262 - protein, 14 aa, Borrelia burgdorferi B31
KEWSRQADGLIANA

SEQ ID NO: 112263 - protein, 14 aa, Borrelia burgdorferi B31
EWSRQADGLIANAS

SEQ ID NO: 112264 - protein, 14 aa, Borrelia burgdorferi B31
WSRQADGLIANASS

SEQ ID NO: 112265 - protein, 14 aa, Borrelia burgdorferi B31
SRQADGLIANASSN

SEQ ID NO: 112266 - protein, 14 aa, Borrelia burgdorferi B31
RQADGLIANASSNS

SEQ ID NO: 112267 - protein, 14 aa, Borrelia burgdorferi B31
QADGLIANASSNSS

SEQ ID NO: 112268 - protein, 14 aa, Borrelia burgdorferi B31
ADGLIANASSNSSL

SEQ ID NO: 112269 - protein, 14 aa, Borrelia burgdorferi B31
DGLIANASSNSSLS

SEQ ID NO: 112270 - protein, 14 aa, Borrelia burgdorferi B31
GLIANASSNSSLSD

SEQ ID NO: 112271 - protein, 14 aa, Borrelia burgdorferi B31
LIANASSNSSLSDS

SEQ ID NO: 112272 - protein, 14 aa, Borrelia burgdorferi B31
IANASSNSSLSDSK

SEQ ID NO: 112273 - protein, 14 aa, Borrelia burgdorferi B31
ANASSNSSLSDSKS

SEQ ID NO: 112274 - protein, 14 aa, Borrelia burgdorferi B31
NASSNSSLSDSKSL

SEQ ID NO: 112275 - protein, 14 aa, Borrelia burgdorferi B31
ASSNSSLSDSKSLA

SEQ ID NO: 112276 - protein, 14 aa, Borrelia burgdorferi B31
SSNSSLSDSKSLAE

SEQ ID NO: 112277 - protein, 14 aa, Borrelia burgdorferi B31
SNSSLSDSKSLAEY

SEQ ID NO: 112278 - protein, 14 aa, Borrelia burgdorferi B31
NSSLSDSKSLAEYI

SEQ ID NO: 112279 - protein, 14 aa, Borrelia burgdorferi B31
SSLSDSKSLAEYIK

SEQ ID NO: 112280 - protein, 14 aa, Borrelia burgdorferi B31
SLSDSKSLAEYIKK

SEQ ID NO: 112281 - protein, 14 aa, Borrelia burgdorferi B31
LSDSKSLAEYIKKR

SEQ ID NO: 112282 - protein, 14 aa, Borrelia burgdorferi B31
SDSKSLAEYIKKRY

SEQ ID NO: 112283 - protein, 14 aa, Borrelia burgdorferi B31
DSKSLAEYIKKRYL

SEQ ID NO: 112284 - protein, 14 aa, Borrelia burgdorferi B31
SKSLAEYIKKRYLD

SEQ ID NO: 112285 - protein, 14 aa, Borrelia burgdorferi B31
KSLAEYIKKRYLDN

SEQ ID NO: 112286 - protein, 14 aa, Borrelia burgdorferi B31
SLAEYIKKRYLDNM

SEQ ID NO: 112287 - protein, 14 aa, Borrelia burgdorferi B31
LAEYIKKRYLDNMQ

SEQ ID NO: 112288 - protein, 14 aa, Borrelia burgdorferi B31
AEYIKKRYLDNMQN

SEQ ID NO: 112289 - protein, 14 aa, Borrelia burgdorferi B31
EYIKKRYLDNMQNA

SEQ ID NO: 112290 - protein, 14 aa, Borrelia burgdorferi B31
YIKKRYLDNMQNAR

SEQ ID NO: 112291 - protein, 14 aa, Borrelia burgdorferi B31
IKKRYLDNMQNARQ

SEQ ID NO: 112292 - protein, 14 aa, Borrelia burgdorferi B31
KKRYLDNMQNARQS

SEQ ID NO: 112293 - protein, 14 aa, Borrelia burgdorferi B31
KRYLDNMQNARQSV

SEQ ID NO: 112294 - protein, 14 aa, Borrelia burgdorferi B31
RYLDNMQNARQSVL

SEQ ID NO: 112295 - protein, 14 aa, Borrelia burgdorferi B31
YLDNMQNARQSVLE

SEQ ID NO: 112296 - protein, 14 aa, Borrelia burgdorferi B31
LDNMQNARQSVLEA

SEQ ID NO: 112297 - protein, 14 aa, Borrelia burgdorferi B31
DNMQNARQSVLEAY

SEQ ID NO: 112298 - protein, 14 aa, Borrelia burgdorferi B31
NMQNARQSVLEAYI

SEQ ID NO: 112299 - protein, 14 aa, Borrelia burgdorferi B31
MQNARQSVLEAYIS

SEQ ID NO: 112300 - protein, 14 aa, Borrelia burgdorferi B31
QNARQSVLEAYISI

SEQ ID NO: 112301 - protein, 14 aa, Borrelia burgdorferi B31
NARQSVLEAYISIM

SEQ ID NO: 112302 - protein, 15 aa, Borrelia burgdorferi B31
MKIKPLIQLKLLGLF

SEQ ID NO: 112303 - protein, 15 aa, Borrelia burgdorferi B31
KIKPLIQLKLLGLFL

SEQ ID NO: 112304 - protein, 15 aa, Borrelia burgdorferi B31
IKPLIQLKLLGLFLF

SEQ ID NO: 112305 - protein, 15 aa, Borrelia burgdorferi B31
KPLIQLKLLGLFLFS

SEQ ID NO: 112306 - protein, 15 aa, Borrelia burgdorferi B31
PLIQLKLLGLFLFSC

SEQ ID NO: 112307 - protein, 15 aa, Borrelia burgdorferi B31
LIQLKLLGLFLFSCT

SEQ ID NO: 112308 - protein, 15 aa, Borrelia burgdorferi B31
IQLKLLGLFLFSCTI

SEQ ID NO: 112309 - protein, 15 aa, Borrelia burgdorferi B31
QLKLLGLFLFSCTID

SEQ ID NO: 112310 - protein, 15 aa, Borrelia burgdorferi B31
LKLLGLFLFSCTIDA

SEQ ID NO: 112311 - protein, 15 aa, Borrelia burgdorferi B31
KLLGLFLFSCTIDAN

SEQ ID NO: 112312 - protein, 15 aa, Borrelia burgdorferi B31
LLGLFLFSCTIDANL

SEQ ID NO: 112313 - protein, 15 aa, Borrelia burgdorferi B31
LGLFLFSCTIDANLN

SEQ ID NO: 112314 - protein, 15 aa, Borrelia burgdorferi B31
GLFLFSCTIDANLNE

SEQ ID NO: 112315 - protein, 15 aa, Borrelia burgdorferi B31
LFLFSCTIDANLNED

SEQ ID NO: 112316 - protein, 15 aa, Borrelia burgdorferi B31
FLFSCTIDANLNEDY

SEQ ID NO: 112317 - protein, 15 aa, Borrelia burgdorferi B31
LFSCTIDANLNEDYK

SEQ ID NO: 112318 - protein, 15 aa, Borrelia burgdorferi B31
FSCTIDANLNEDYKN

SEQ ID NO: 112319 - protein, 15 aa, Borrelia burgdorferi B31
SCTIDANLNEDYKNK

SEQ ID NO: 112320 - protein, 15 aa, Borrelia burgdorferi B31
CTIDANLNEDYKNKV

SEQ ID NO: 112321 - protein, 15 aa, Borrelia burgdorferi B31
TIDANLNEDYKNKVK

SEQ ID NO: 112322 - protein, 15 aa, Borrelia burgdorferi B31
IDANLNEDYKNKVKG

SEQ ID NO: 112323 - protein, 15 aa, Borrelia burgdorferi B31
DANLNEDYKNKVKGI

SEQ ID NO: 112324 - protein, 15 aa, Borrelia burgdorferi B31
ANLNEDYKNKVKGIL

SEQ ID NO: 112325 - protein, 15 aa, Borrelia burgdorferi B31
NLNEDYKNKVKGILN

SEQ ID NO: 112326 - protein, 15 aa, Borrelia burgdorferi B31
LNEDYKNKVKGILNK

SEQ ID NO: 112327 - protein, 15 aa, Borrelia burgdorferi B31
NEDYKNKVKGILNKA

SEQ ID NO: 112328 - protein, 15 aa, Borrelia burgdorferi B31
EDYKNKVKGILNKAA

SEQ ID NO: 112329 - protein, 15 aa, Borrelia burgdorferi B31
DYKNKVKGILNKAAD

SEQ ID NO: 112330 - protein, 15 aa, Borrelia burgdorferi B31
YKNKVKGILNKAADD

SEQ ID NO: 112331 - protein, 15 aa, Borrelia burgdorferi B31
KNKVKGILNKAADDQ

SEQ ID NO: 112332 - protein, 15 aa, Borrelia burgdorferi B31
NKVKGILNKAADDQE

SEQ ID NO: 112333 - protein, 15 aa, Borrelia burgdorferi B31
KVKGILNKAADDQET

SEQ ID NO: 112334 - protein, 15 aa, Borrelia burgdorferi B31
VKGILNKAADDQETT

SEQ ID NO: 112335 - protein, 15 aa, Borrelia burgdorferi B31
KGILNKAADDQETTS

SEQ ID NO: 112336 - protein, 15 aa, Borrelia burgdorferi B31
GILNKAADDQETTSA

SEQ ID NO: 112337 - protein, 15 aa, Borrelia burgdorferi B31
ILNKAADDQETTSAD

SEQ ID NO: 112338 - protein, 15 aa, Borrelia burgdorferi B31
LNKAADDQETTSADT

SEQ ID NO: 112339 - protein, 15 aa, Borrelia burgdorferi B31
NKAADDQETTSADTN

SEQ ID NO: 112340 - protein, 15 aa, Borrelia burgdorferi B31
KAADDQETTSADTNS

SEQ ID NO: 112341 - protein, 15 aa, Borrelia burgdorferi B31
AADDQETTSADTNSN

SEQ ID NO: 112342 - protein, 15 aa, Borrelia burgdorferi B31
ADDQETTSADTNSNA

SEQ ID NO: 112343 - protein, 15 aa, Borrelia burgdorferi B31
DDQETTSADTNSNAA

SEQ ID NO: 112344 - protein, 15 aa, Borrelia burgdorferi B31
DQETTSADTNSNAAK

SEQ ID NO: 112345 - protein, 15 aa, Borrelia burgdorferi B31
QETTSADTNSNAAKN

SEQ ID NO: 112346 - protein, 15 aa, Borrelia burgdorferi B31
ETTSADTNSNAAKNI

SEQ ID NO: 112347 - protein, 15 aa, Borrelia burgdorferi B31
TTSADTNSNAAKNIP

SEQ ID NO: 112348 - protein, 15 aa, Borrelia burgdorferi B31
TSADTNSNAAKNIPI

SEQ ID NO: 112349 - protein, 15 aa, Borrelia burgdorferi B31
SADTNSNAAKNIPIA

SEQ ID NO: 112350 - protein, 15 aa, Borrelia burgdorferi B31
ADTNSNAAKNIPIAD

SEQ ID NO: 112351 - protein, 15 aa, Borrelia burgdorferi B31
DTNSNAAKNIPIADN

SEQ ID NO: 112352 - protein, 15 aa, Borrelia burgdorferi B31
TNSNAAKNIPIADND

SEQ ID NO: 112353 - protein, 15 aa, Borrelia burgdorferi B31
NSNAAKNIPIADNDK

SEQ ID NO: 112354 - protein, 15 aa, Borrelia burgdorferi B31
SNAAKNIPIADNDKV

SEQ ID NO: 112355 - protein, 15 aa, Borrelia burgdorferi B31
NAAKNIPIADNDKVA

SEQ ID NO: 112356 - protein, 15 aa, Borrelia burgdorferi B31
AAKNIPIADNDKVAA

SEQ ID NO: 112357 - protein, 15 aa, Borrelia burgdorferi B31
AKNIPIADNDKVAAE

SEQ ID NO: 112358 - protein, 15 aa, Borrelia burgdorferi B31
KNIPIADNDKVAAEL

SEQ ID NO: 112359 - protein, 15 aa, Borrelia burgdorferi B31
NIPIADNDKVAAELK

SEQ ID NO: 112360 - protein, 15 aa, Borrelia burgdorferi B31
IPIADNDKVAAELKK

SEQ ID NO: 112361 - protein, 15 aa, Borrelia burgdorferi B31
PIADNDKVAAELKKQ

SEQ ID NO: 112362 - protein, 15 aa, Borrelia burgdorferi B31
IADNDKVAAELKKQS

SEQ ID NO: 112363 - protein, 15 aa, Borrelia burgdorferi B31
ADNDKVAAELKKQSQ

SEQ ID NO: 112364 - protein, 15 aa, Borrelia burgdorferi B31
DNDKVAAELKKQSQA

SEQ ID NO: 112365 - protein, 15 aa, Borrelia burgdorferi B31
NDKVAAELKKQSQAA

SEQ ID NO: 112366 - protein, 15 aa, Borrelia burgdorferi B31
DKVAAELKKQSQAAK

SEQ ID NO: 112367 - protein, 15 aa, Borrelia burgdorferi B31
KVAAELKKQSQAAKT

SEQ ID NO: 112368 - protein, 15 aa, Borrelia burgdorferi B31
VAAELKKQSQAAKTV

SEQ ID NO: 112369 - protein, 15 aa, Borrelia burgdorferi B31
AAELKKQSQAAKTVA

SEQ ID NO: 112370 - protein, 15 aa, Borrelia burgdorferi B31
AELKKQSQAAKTVAA

SEQ ID NO: 112371 - protein, 15 aa, Borrelia burgdorferi B31
ELKKQSQAAKTVAAA

SEQ ID NO: 112372 - protein, 15 aa, Borrelia burgdorferi B31
LKKQSQAAKTVAAAP

SEQ ID NO: 112373 - protein, 15 aa, Borrelia burgdorferi B31
KKQSQAAKTVAAAPN

SEQ ID NO: 112374 - protein, 15 aa, Borrelia burgdorferi B31
KQSQAAKTVAAAPNK

SEQ ID NO: 112375 - protein, 15 aa, Borrelia burgdorferi B31
QSQAAKTVAAAPNKG

SEQ ID NO: 112376 - protein, 15 aa, Borrelia burgdorferi B31
SQAAKTVAAAPNKGS

SEQ ID NO: 112377 - protein, 15 aa, Borrelia burgdorferi B31
QAAKTVAAAPNKGSQ

SEQ ID NO: 112378 - protein, 15 aa, Borrelia burgdorferi B31
AAKTVAAAPNKGSQN

SEQ ID NO: 112379 - protein, 15 aa, Borrelia burgdorferi B31
AKTVAAAPNKGSQNQ

SEQ ID NO: 112380 - protein, 15 aa, Borrelia burgdorferi B31
KTVAAAPNKGSQNQP

SEQ ID NO: 112381 - protein, 15 aa, Borrelia burgdorferi B31
TVAAAPNKGSQNQPQ

SEQ ID NO: 112382 - protein, 15 aa, Borrelia burgdorferi B31
VAAAPNKGSQNQPQT

SEQ ID NO: 112383 - protein, 15 aa, Borrelia burgdorferi B31
AAAPNKGSQNQPQTT

SEQ ID NO: 112384 - protein, 15 aa, Borrelia burgdorferi B31
AAPNKGSQNQPQTTP

SEQ ID NO: 112385 - protein, 15 aa, Borrelia burgdorferi B31
APNKGSQNQPQTTPN

SEQ ID NO: 112386 - protein, 15 aa, Borrelia burgdorferi B31
PNKGSQNQPQTTPNK

SEQ ID NO: 112387 - protein, 15 aa, Borrelia burgdorferi B31
NKGSQNQPQTTPNKG

SEQ ID NO: 112388 - protein, 15 aa, Borrelia burgdorferi B31
KGSQNQPQTTPNKGS

SEQ ID NO: 112389 - protein, 15 aa, Borrelia burgdorferi B31
GSQNQPQTTPNKGSQ

SEQ ID NO: 112390 - protein, 15 aa, Borrelia burgdorferi B31
SQNQPQTTPNKGSQN

SEQ ID NO: 112391 - protein, 15 aa, Borrelia burgdorferi B31
QNQPQTTPNKGSQNQ

SEQ ID NO: 112392 - protein, 15 aa, Borrelia burgdorferi B31
NQPQTTPNKGSQNQQ

SEQ ID NO: 112393 - protein, 15 aa, Borrelia burgdorferi B31
QPQTTPNKGSQNQQA

SEQ ID NO: 112394 - protein, 15 aa, Borrelia burgdorferi B31
PQTTPNKGSQNQQAA

SEQ ID NO: 112395 - protein, 15 aa, Borrelia burgdorferi B31
QTTPNKGSQNQQAAP

SEQ ID NO: 112396 - protein, 15 aa, Borrelia burgdorferi B31
TTPNKGSQNQQAAPS

SEQ ID NO: 112397 - protein, 15 aa, Borrelia burgdorferi B31
TPNKGSQNQQAAPSP

SEQ ID NO: 112398 - protein, 15 aa, Borrelia burgdorferi B31
PNKGSQNQQAAPSPQ

SEQ ID NO: 112399 - protein, 15 aa, Borrelia burgdorferi B31
NKGSQNQQAAPSPQL

SEQ ID NO: 112400 - protein, 15 aa, Borrelia burgdorferi B31
KGSQNQQAAPSPQLQ

SEQ ID NO: 112401 - protein, 15 aa, Borrelia burgdorferi B31
GSQNQQAAPSPQLQS

SEQ ID NO: 112402 - protein, 15 aa, Borrelia burgdorferi B31
SQNQQAAPSPQLQSL

SEQ ID NO: 112403 - protein, 15 aa, Borrelia burgdorferi B31
QNQQAAPSPQLQSLS

SEQ ID NO: 112404 - protein, 15 aa, Borrelia burgdorferi B31
NQQAAPSPQLQSLSF

SEQ ID NO: 112405 - protein, 15 aa, Borrelia burgdorferi B31
QQAAPSPQLQSLSFS

SEQ ID NO: 112406 - protein, 15 aa, Borrelia burgdorferi B31
QAAPSPQLQSLSFSA

SEQ ID NO: 112407 - protein, 15 aa, Borrelia burgdorferi B31
AAPSPQLQSLSFSAD

SEQ ID NO: 112408 - protein, 15 aa, Borrelia burgdorferi B31
APSPQLQSLSFSADL

SEQ ID NO: 112409 - protein, 15 aa, Borrelia burgdorferi B31
PSPQLQSLSFSADLS

SEQ ID NO: 112410 - protein, 15 aa, Borrelia burgdorferi B31
SPQLQSLSFSADLSN

SEQ ID NO: 112411 - protein, 15 aa, Borrelia burgdorferi B31
PQLQSLSFSADLSNL

SEQ ID NO: 112412 - protein, 15 aa, Borrelia burgdorferi B31
QLQSLSFSADLSNLP

SEQ ID NO: 112413 - protein, 15 aa, Borrelia burgdorferi B31
LQSLSFSADLSNLPK

SEQ ID NO: 112414 - protein, 15 aa, Borrelia burgdorferi B31
QSLSFSADLSNLPKT

SEQ ID NO: 112415 - protein, 15 aa, Borrelia burgdorferi B31
SLSFSADLSNLPKTT

SEQ ID NO: 112416 - protein, 15 aa, Borrelia burgdorferi B31
LSFSADLSNLPKTTA

SEQ ID NO: 112417 - protein, 15 aa, Borrelia burgdorferi B31
SFSADLSNLPKTTAA

SEQ ID NO: 112418 - protein, 15 aa, Borrelia burgdorferi B31
FSADLSNLPKTTAAR

SEQ ID NO: 112419 - protein, 15 aa, Borrelia burgdorferi B31
SADLSNLPKTTAARA

SEQ ID NO: 112420 - protein, 15 aa, Borrelia burgdorferi B31
ADLSNLPKTTAARAA

SEQ ID NO: 112421 - protein, 15 aa, Borrelia burgdorferi B31
DLSNLPKTTAARAAS

SEQ ID NO: 112422 - protein, 15 aa, Borrelia burgdorferi B31
LSNLPKTTAARAASL

SEQ ID NO: 112423 - protein, 15 aa, Borrelia burgdorferi B31
SNLPKTTAARAASLT

SEQ ID NO: 112424 - protein, 15 aa, Borrelia burgdorferi B31
NLPKTTAARAASLTK

SEQ ID NO: 112425 - protein, 15 aa, Borrelia burgdorferi B31
LPKTTAARAASLTKQ

SEQ ID NO: 112426 - protein, 15 aa, Borrelia burgdorferi B31
PKTTAARAASLTKQR

SEQ ID NO: 112427 - protein, 15 aa, Borrelia burgdorferi B31
KTTAARAASLTKQRI

SEQ ID NO: 112428 - protein, 15 aa, Borrelia burgdorferi B31
TTAARAASLTKQRIP

SEQ ID NO: 112429 - protein, 15 aa, Borrelia burgdorferi B31
TAARAASLTKQRIPI

SEQ ID NO: 112430 - protein, 15 aa, Borrelia burgdorferi B31
AARAASLTKQRIPIQ

SEQ ID NO: 112431 - protein, 15 aa, Borrelia burgdorferi B31
ARAASLTKQRIPIQA

SEQ ID NO: 112432 - protein, 15 aa, Borrelia burgdorferi B31
RAASLTKQRIPIQAV

SEQ ID NO: 112433 - protein, 15 aa, Borrelia burgdorferi B31
AASLTKQRIPIQAVT

SEQ ID NO: 112434 - protein, 15 aa, Borrelia burgdorferi B31
ASLTKQRIPIQAVTT

SEQ ID NO: 112435 - protein, 15 aa, Borrelia burgdorferi B31
SLTKQRIPIQAVTTV

SEQ ID NO: 112436 - protein, 15 aa, Borrelia burgdorferi B31
LTKQRIPIQAVTTVP

SEQ ID NO: 112437 - protein, 15 aa, Borrelia burgdorferi B31
TKQRIPIQAVTTVPG

SEQ ID NO: 112438 - protein, 15 aa, Borrelia burgdorferi B31
KQRIPIQAVTTVPGN

SEQ ID NO: 112439 - protein, 15 aa, Borrelia burgdorferi B31
QRIPIQAVTTVPGNT

SEQ ID NO: 112440 - protein, 15 aa, Borrelia burgdorferi B31
RIPIQAVTTVPGNTR

SEQ ID NO: 112441 - protein, 15 aa, Borrelia burgdorferi B31
IPIQAVTTVPGNTRT

SEQ ID NO: 112442 - protein, 15 aa, Borrelia burgdorferi B31
PIQAVTTVPGNTRTF

SEQ ID NO: 112443 - protein, 15 aa, Borrelia burgdorferi B31
IQAVTTVPGNTRTFN

SEQ ID NO: 112444 - protein, 15 aa, Borrelia burgdorferi B31
QAVTTVPGNTRTFNS

SEQ ID NO: 112445 - protein, 15 aa, Borrelia burgdorferi B31
AVTTVPGNTRTFNSR

SEQ ID NO: 112446 - protein, 15 aa, Borrelia burgdorferi B31
VTTVPGNTRTFNSRN

SEQ ID NO: 112447 - protein, 15 aa, Borrelia burgdorferi B31
TTVPGNTRTFNSRNS

SEQ ID NO: 112448 - protein, 15 aa, Borrelia burgdorferi B31
TVPGNTRTFNSRNSG

SEQ ID NO: 112449 - protein, 15 aa, Borrelia burgdorferi B31
VPGNTRTFNSRNSGL

SEQ ID NO: 112450 - protein, 15 aa, Borrelia burgdorferi B31
PGNTRTFNSRNSGLP

SEQ ID NO: 112451 - protein, 15 aa, Borrelia burgdorferi B31
GNTRTFNSRNSGLPT

SEQ ID NO: 112452 - protein, 15 aa, Borrelia burgdorferi B31
NTRTFNSRNSGLPTF

SEQ ID NO: 112453 - protein, 15 aa, Borrelia burgdorferi B31
TRTFNSRNSGLPTFA

SEQ ID NO: 112454 - protein, 15 aa, Borrelia burgdorferi B31
RTFNSRNSGLPTFAL

SEQ ID NO: 112455 - protein, 15 aa, Borrelia burgdorferi B31
TFNSRNSGLPTFALN

SEQ ID NO: 112456 - protein, 15 aa, Borrelia burgdorferi B31
FNSRNSGLPTFALNY

SEQ ID NO: 112457 - protein, 15 aa, Borrelia burgdorferi B31
NSRNSGLPTFALNYS

SEQ ID NO: 112458 - protein, 15 aa, Borrelia burgdorferi B31
SRNSGLPTFALNYSF

SEQ ID NO: 112459 - protein, 15 aa, Borrelia burgdorferi B31
RNSGLPTFALNYSFS

SEQ ID NO: 112460 - protein, 15 aa, Borrelia burgdorferi B31
NSGLPTFALNYSFSQ

SEQ ID NO: 112461 - protein, 15 aa, Borrelia burgdorferi B31
SGLPTFALNYSFSQP

SEQ ID NO: 112462 - protein, 15 aa, Borrelia burgdorferi B31
GLPTFALNYSFSQPT

SEQ ID NO: 112463 - protein, 15 aa, Borrelia burgdorferi B31
LPTFALNYSFSQPTR

SEQ ID NO: 112464 - protein, 15 aa, Borrelia burgdorferi B31
PTFALNYSFSQPTRQ

SEQ ID NO: 112465 - protein, 15 aa, Borrelia burgdorferi B31
TFALNYSFSQPTRQQ

SEQ ID NO: 112466 - protein, 15 aa, Borrelia burgdorferi B31
FALNYSFSQPTRQQT

SEQ ID NO: 112467 - protein, 15 aa, Borrelia burgdorferi B31
ALNYSFSQPTRQQTN

SEQ ID NO: 112468 - protein, 15 aa, Borrelia burgdorferi B31
LNYSFSQPTRQQTNS

SEQ ID NO: 112469 - protein, 15 aa, Borrelia burgdorferi B31
NYSFSQPTRQQTNSS

SEQ ID NO: 112470 - protein, 15 aa, Borrelia burgdorferi B31
YSFSQPTRQQTNSSS

SEQ ID NO: 112471 - protein, 15 aa, Borrelia burgdorferi B31
SFSQPTRQQTNSSSA

SEQ ID NO: 112472 - protein, 15 aa, Borrelia burgdorferi B31
FSQPTRQQTNSSSAV

SEQ ID NO: 112473 - protein, 15 aa, Borrelia burgdorferi B31
SQPTRQQTNSSSAVQ

SEQ ID NO: 112474 - protein, 15 aa, Borrelia burgdorferi B31
QPTRQQTNSSSAVQT

SEQ ID NO: 112475 - protein, 15 aa, Borrelia burgdorferi B31
PTRQQTNSSSAVQTT

SEQ ID NO: 112476 - protein, 15 aa, Borrelia burgdorferi B31
TRQQTNSSSAVQTTT

SEQ ID NO: 112477 - protein, 15 aa, Borrelia burgdorferi B31
RQQTNSSSAVQTTTS

SEQ ID NO: 112478 - protein, 15 aa, Borrelia burgdorferi B31
QQTNSSSAVQTTTSS

SEQ ID NO: 112479 - protein, 15 aa, Borrelia burgdorferi B31
QTNSSSAVQTTTSSG

SEQ ID NO: 112480 - protein, 15 aa, Borrelia burgdorferi B31
TNSSSAVQTTTSSGS

SEQ ID NO: 112481 - protein, 15 aa, Borrelia burgdorferi B31
NSSSAVQTTTSSGSK

SEQ ID NO: 112482 - protein, 15 aa, Borrelia burgdorferi B31
SSSAVQTTTSSGSKL

SEQ ID NO: 112483 - protein, 15 aa, Borrelia burgdorferi B31
SSAVQTTTSSGSKLQ

SEQ ID NO: 112484 - protein, 15 aa, Borrelia burgdorferi B31
SAVQTTTSSGSKLQT

SEQ ID NO: 112485 - protein, 15 aa, Borrelia burgdorferi B31
AVQTTTSSGSKLQTL

SEQ ID NO: 112486 - protein, 15 aa, Borrelia burgdorferi B31
VQTTTSSGSKLQTLK

SEQ ID NO: 112487 - protein, 15 aa, Borrelia burgdorferi B31
QTTTSSGSKLQTLKN

SEQ ID NO: 112488 - protein, 15 aa, Borrelia burgdorferi B31
TTTSSGSKLQTLKNE

SEQ ID NO: 112489 - protein, 15 aa, Borrelia burgdorferi B31
TTSSGSKLQTLKNEL

SEQ ID NO: 112490 - protein, 15 aa, Borrelia burgdorferi B31
TSSGSKLQTLKNELI

SEQ ID NO: 112491 - protein, 15 aa, Borrelia burgdorferi B31
SSGSKLQTLKNELIR

SEQ ID NO: 112492 - protein, 15 aa, Borrelia burgdorferi B31
SGSKLQTLKNELIRA

SEQ ID NO: 112493 - protein, 15 aa, Borrelia burgdorferi B31
GSKLQTLKNELIRAI

SEQ ID NO: 112494 - protein, 15 aa, Borrelia burgdorferi B31
SKLQTLKNELIRAIS

SEQ ID NO: 112495 - protein, 15 aa, Borrelia burgdorferi B31
KLQTLKNELIRAISE

SEQ ID NO: 112496 - protein, 15 aa, Borrelia burgdorferi B31
LQTLKNELIRAISEE

SEQ ID NO: 112497 - protein, 15 aa, Borrelia burgdorferi B31
QTLKNELIRAISEEK

SEQ ID NO: 112498 - protein, 15 aa, Borrelia burgdorferi B31
TLKNELIRAISEEKN

SEQ ID NO: 112499 - protein, 15 aa, Borrelia burgdorferi B31
LKNELIRAISEEKNK

SEQ ID NO: 112500 - protein, 15 aa, Borrelia burgdorferi B31
KNELIRAISEEKNKT

SEQ ID NO: 112501 - protein, 15 aa, Borrelia burgdorferi B31
NELIRAISEEKNKTQ

SEQ ID NO: 112502 - protein, 15 aa, Borrelia burgdorferi B31
ELIRAISEEKNKTQN

SEQ ID NO: 112503 - protein, 15 aa, Borrelia burgdorferi B31
LIRAISEEKNKTQNN

SEQ ID NO: 112504 - protein, 15 aa, Borrelia burgdorferi B31
IRAISEEKNKTQNNF

SEQ ID NO: 112505 - protein, 15 aa, Borrelia burgdorferi B31
RAISEEKNKTQNNFG

SEQ ID NO: 112506 - protein, 15 aa, Borrelia burgdorferi B31
AISEEKNKTQNNFGF

SEQ ID NO: 112507 - protein, 15 aa, Borrelia burgdorferi B31
ISEEKNKTQNNFGFR

SEQ ID NO: 112508 - protein, 15 aa, Borrelia burgdorferi B31
SEEKNKTQNNFGFRE

SEQ ID NO: 112509 - protein, 15 aa, Borrelia burgdorferi B31
EEKNKTQNNFGFRET

SEQ ID NO: 112510 - protein, 15 aa, Borrelia burgdorferi B31
EKNKTQNNFGFRETY

SEQ ID NO: 112511 - protein, 15 aa, Borrelia burgdorferi B31
KNKTQNNFGFRETYD

SEQ ID NO: 112512 - protein, 15 aa, Borrelia burgdorferi B31
NKTQNNFGFRETYDQ

SEQ ID NO: 112513 - protein, 15 aa, Borrelia burgdorferi B31
KTQNNFGFRETYDQF

SEQ ID NO: 112514 - protein, 15 aa, Borrelia burgdorferi B31
TQNNFGFRETYDQFK

SEQ ID NO: 112515 - protein, 15 aa, Borrelia burgdorferi B31
QNNFGFRETYDQFKM

SEQ ID NO: 112516 - protein, 15 aa, Borrelia burgdorferi B31
NNFGFRETYDQFKMK

SEQ ID NO: 112517 - protein, 15 aa, Borrelia burgdorferi B31
NFGFRETYDQFKMKD

SEQ ID NO: 112518 - protein, 15 aa, Borrelia burgdorferi B31
FGFRETYDQFKMKDS

SEQ ID NO: 112519 - protein, 15 aa, Borrelia burgdorferi B31
GFRETYDQFKMKDSA

SEQ ID NO: 112520 - protein, 15 aa, Borrelia burgdorferi B31
FRETYDQFKMKDSAF

SEQ ID NO: 112521 - protein, 15 aa, Borrelia burgdorferi B31
RETYDQFKMKDSAFE

SEQ ID NO: 112522 - protein, 15 aa, Borrelia burgdorferi B31
ETYDQFKMKDSAFEL

SEQ ID NO: 112523 - protein, 15 aa, Borrelia burgdorferi B31
TYDQFKMKDSAFELL

SEQ ID NO: 112524 - protein, 15 aa, Borrelia burgdorferi B31
YDQFKMKDSAFELLD

SEQ ID NO: 112525 - protein, 15 aa, Borrelia burgdorferi B31
DQFKMKDSAFELLDV

SEQ ID NO: 112526 - protein, 15 aa, Borrelia burgdorferi B31
QFKMKDSAFELLDVI

SEQ ID NO: 112527 - protein, 15 aa, Borrelia burgdorferi B31
FKMKDSAFELLDVIS

SEQ ID NO: 112528 - protein, 15 aa, Borrelia burgdorferi B31
KMKDSAFELLDVISS

SEQ ID NO: 112529 - protein, 15 aa, Borrelia burgdorferi B31
MKDSAFELLDVISSA

SEQ ID NO: 112530 - protein, 15 aa, Borrelia burgdorferi B31
KDSAFELLDVISSAK

SEQ ID NO: 112531 - protein, 15 aa, Borrelia burgdorferi B31
DSAFELLDVISSAKV

SEQ ID NO: 112532 - protein, 15 aa, Borrelia burgdorferi B31
SAFELLDVISSAKVY

SEQ ID NO: 112533 - protein, 15 aa, Borrelia burgdorferi B31
AFELLDVISSAKVYD

SEQ ID NO: 112534 - protein, 15 aa, Borrelia burgdorferi B31
FELLDVISSAKVYDR

SEQ ID NO: 112535 - protein, 15 aa, Borrelia burgdorferi B31
ELLDVISSAKVYDRS

SEQ ID NO: 112536 - protein, 15 aa, Borrelia burgdorferi B31
LLDVISSAKVYDRSY

SEQ ID NO: 112537 - protein, 15 aa, Borrelia burgdorferi B31
LDVISSAKVYDRSYA

SEQ ID NO: 112538 - protein, 15 aa, Borrelia burgdorferi B31
DVISSAKVYDRSYAP

SEQ ID NO: 112539 - protein, 15 aa, Borrelia burgdorferi B31
VISSAKVYDRSYAPQ

SEQ ID NO: 112540 - protein, 15 aa, Borrelia burgdorferi B31
ISSAKVYDRSYAPQL

SEQ ID NO: 112541 - protein, 15 aa, Borrelia burgdorferi B31
SSAKVYDRSYAPQLN

SEQ ID NO: 112542 - protein, 15 aa, Borrelia burgdorferi B31
SAKVYDRSYAPQLNS

SEQ ID NO: 112543 - protein, 15 aa, Borrelia burgdorferi B31
AKVYDRSYAPQLNSN

SEQ ID NO: 112544 - protein, 15 aa, Borrelia burgdorferi B31
KVYDRSYAPQLNSNT

SEQ ID NO: 112545 - protein, 15 aa, Borrelia burgdorferi B31
VYDRSYAPQLNSNTP

SEQ ID NO: 112546 - protein, 15 aa, Borrelia burgdorferi B31
YDRSYAPQLNSNTPE

SEQ ID NO: 112547 - protein, 15 aa, Borrelia burgdorferi B31
DRSYAPQLNSNTPEA

SEQ ID NO: 112548 - protein, 15 aa, Borrelia burgdorferi B31
RSYAPQLNSNTPEAE

SEQ ID NO: 112549 - protein, 15 aa, Borrelia burgdorferi B31
SYAPQLNSNTPEAEN

SEQ ID NO: 112550 - protein, 15 aa, Borrelia burgdorferi B31
YAPQLNSNTPEAENE

SEQ ID NO: 112551 - protein, 15 aa, Borrelia burgdorferi B31
APQLNSNTPEAENER

SEQ ID NO: 112552 - protein, 15 aa, Borrelia burgdorferi B31
PQLNSNTPEAENERN

SEQ ID NO: 112553 - protein, 15 aa, Borrelia burgdorferi B31
QLNSNTPEAENERNK

SEQ ID NO: 112554 - protein, 15 aa, Borrelia burgdorferi B31
LNSNTPEAENERNKF

SEQ ID NO: 112555 - protein, 15 aa, Borrelia burgdorferi B31
NSNTPEAENERNKFY

SEQ ID NO: 112556 - protein, 15 aa, Borrelia burgdorferi B31
SNTPEAENERNKFYA

SEQ ID NO: 112557 - protein, 15 aa, Borrelia burgdorferi B31
NTPEAENERNKFYAL

SEQ ID NO: 112558 - protein, 15 aa, Borrelia burgdorferi B31
TPEAENERNKFYALM

SEQ ID NO: 112559 - protein, 15 aa, Borrelia burgdorferi B31
PEAENERNKFYALMD

SEQ ID NO: 112560 - protein, 15 aa, Borrelia burgdorferi B31
EAENERNKFYALMDF

SEQ ID NO: 112561 - protein, 15 aa, Borrelia burgdorferi B31
AENERNKFYALMDFD

SEQ ID NO: 112562 - protein, 15 aa, Borrelia burgdorferi B31
ENERNKFYALMDFDQ

SEQ ID NO: 112563 - protein, 15 aa, Borrelia burgdorferi B31
NERNKFYALMDFDQY

SEQ ID NO: 112564 - protein, 15 aa, Borrelia burgdorferi B31
ERNKFYALMDFDQYK

SEQ ID NO: 112565 - protein, 15 aa, Borrelia burgdorferi B31
RNKFYALMDFDQYKI

SEQ ID NO: 112566 - protein, 15 aa, Borrelia burgdorferi B31
NKFYALMDFDQYKIE

SEQ ID NO: 112567 - protein, 15 aa, Borrelia burgdorferi B31
KFYALMDFDQYKIEQ

SEQ ID NO: 112568 - protein, 15 aa, Borrelia burgdorferi B31
FYALMDFDQYKIEQF

SEQ ID NO: 112569 - protein, 15 aa, Borrelia burgdorferi B31
YALMDFDQYKIEQFG

SEQ ID NO: 112570 - protein, 15 aa, Borrelia burgdorferi B31
ALMDFDQYKIEQFGS

SEQ ID NO: 112571 - protein, 15 aa, Borrelia burgdorferi B31
LMDFDQYKIEQFGSI

SEQ ID NO: 112572 - protein, 15 aa, Borrelia burgdorferi B31
MDFDQYKIEQFGSIM

SEQ ID NO: 112573 - protein, 15 aa, Borrelia burgdorferi B31
DFDQYKIEQFGSIME

SEQ ID NO: 112574 - protein, 15 aa, Borrelia burgdorferi B31
FDQYKIEQFGSIMEA

SEQ ID NO: 112575 - protein, 15 aa, Borrelia burgdorferi B31
DQYKIEQFGSIMEAL

SEQ ID NO: 112576 - protein, 15 aa, Borrelia burgdorferi B31
QYKIEQFGSIMEALY

SEQ ID NO: 112577 - protein, 15 aa, Borrelia burgdorferi B31
YKIEQFGSIMEALYN

SEQ ID NO: 112578 - protein, 15 aa, Borrelia burgdorferi B31
KIEQFGSIMEALYNE

SEQ ID NO: 112579 - protein, 15 aa, Borrelia burgdorferi B31
IEQFGSIMEALYNEN

SEQ ID NO: 112580 - protein, 15 aa, Borrelia burgdorferi B31
EQFGSIMEALYNENQ

SEQ ID NO: 112581 - protein, 15 aa, Borrelia burgdorferi B31
QFGSIMEALYNENQN

SEQ ID NO: 112582 - protein, 15 aa, Borrelia burgdorferi B31
FGSIMEALYNENQNH

SEQ ID NO: 112583 - protein, 15 aa, Borrelia burgdorferi B31
GSIMEALYNENQNHS

SEQ ID NO: 112584 - protein, 15 aa, Borrelia burgdorferi B31
SIMEALYNENQNHSL

SEQ ID NO: 112585 - protein, 15 aa, Borrelia burgdorferi B31
IMEALYNENQNHSLI

SEQ ID NO: 112586 - protein, 15 aa, Borrelia burgdorferi B31
MEALYNENQNHSLIR

SEQ ID NO: 112587 - protein, 15 aa, Borrelia burgdorferi B31
EALYNENQNHSLIRE

SEQ ID NO: 112588 - protein, 15 aa, Borrelia burgdorferi B31
ALYNENQNHSLIREL

SEQ ID NO: 112589 - protein, 15 aa, Borrelia burgdorferi B31
LYNENQNHSLIRELM

SEQ ID NO: 112590 - protein, 15 aa, Borrelia burgdorferi B31
YNENQNHSLIRELMI

SEQ ID NO: 112591 - protein, 15 aa, Borrelia burgdorferi B31
NENQNHSLIRELMIS

SEQ ID NO: 112592 - protein, 15 aa, Borrelia burgdorferi B31
ENQNHSLIRELMISG

SEQ ID NO: 112593 - protein, 15 aa, Borrelia burgdorferi B31
NQNHSLIRELMISGL

SEQ ID NO: 112594 - protein, 15 aa, Borrelia burgdorferi B31
QNHSLIRELMISGLG

SEQ ID NO: 112595 - protein, 15 aa, Borrelia burgdorferi B31
NHSLIRELMISGLGT

SEQ ID NO: 112596 - protein, 15 aa, Borrelia burgdorferi B31
HSLIRELMISGLGTQ

SEQ ID NO: 112597 - protein, 15 aa, Borrelia burgdorferi B31
SLIRELMISGLGTQI

SEQ ID NO: 112598 - protein, 15 aa, Borrelia burgdorferi B31
LIRELMISGLGTQIS

SEQ ID NO: 112599 - protein, 15 aa, Borrelia burgdorferi B31
IRELMISGLGTQISF

SEQ ID NO: 112600 - protein, 15 aa, Borrelia burgdorferi B31
RELMISGLGTQISFE

SEQ ID NO: 112601 - protein, 15 aa, Borrelia burgdorferi B31
ELMISGLGTQISFEL

SEQ ID NO: 112602 - protein, 15 aa, Borrelia burgdorferi B31
LMISGLGTQISFELA

SEQ ID NO: 112603 - protein, 15 aa, Borrelia burgdorferi B31
MISGLGTQISFELAL

SEQ ID NO: 112604 - protein, 15 aa, Borrelia burgdorferi B31
ISGLGTQISFELALE

SEQ ID NO: 112605 - protein, 15 aa, Borrelia burgdorferi B31
SGLGTQISFELALEE

SEQ ID NO: 112606 - protein, 15 aa, Borrelia burgdorferi B31
GLGTQISFELALEEI

SEQ ID NO: 112607 - protein, 15 aa, Borrelia burgdorferi B31
LGTQISFELALEEIN

SEQ ID NO: 112608 - protein, 15 aa, Borrelia burgdorferi B31
GTQISFELALEEINK

SEQ ID NO: 112609 - protein, 15 aa, Borrelia burgdorferi B31
TQISFELALEEINKK

SEQ ID NO: 112610 - protein, 15 aa, Borrelia burgdorferi B31
QISFELALEEINKKI

SEQ ID NO: 112611 - protein, 15 aa, Borrelia burgdorferi B31
ISFELALEEINKKIE

SEQ ID NO: 112612 - protein, 15 aa, Borrelia burgdorferi B31
SFELALEEINKKIEI

SEQ ID NO: 112613 - protein, 15 aa, Borrelia burgdorferi B31
FELALEEINKKIEIF

SEQ ID NO: 112614 - protein, 15 aa, Borrelia burgdorferi B31
ELALEEINKKIEIFN

SEQ ID NO: 112615 - protein, 15 aa, Borrelia burgdorferi B31
LALEEINKKIEIFNQ

SEQ ID NO: 112616 - protein, 15 aa, Borrelia burgdorferi B31
ALEEINKKIEIFNQD

SEQ ID NO: 112617 - protein, 15 aa, Borrelia burgdorferi B31
LEEINKKIEIFNQDY

SEQ ID NO: 112618 - protein, 15 aa, Borrelia burgdorferi B31
EEINKKIEIFNQDYL

SEQ ID NO: 112619 - protein, 15 aa, Borrelia burgdorferi B31
EINKKIEIFNQDYLN

SEQ ID NO: 112620 - protein, 15 aa, Borrelia burgdorferi B31
INKKIEIFNQDYLNA

SEQ ID NO: 112621 - protein, 15 aa, Borrelia burgdorferi B31
NKKIEIFNQDYLNAK

SEQ ID NO: 112622 - protein, 15 aa, Borrelia burgdorferi B31
KKIEIFNQDYLNAKI

SEQ ID NO: 112623 - protein, 15 aa, Borrelia burgdorferi B31
KIEIFNQDYLNAKIN

SEQ ID NO: 112624 - protein, 15 aa, Borrelia burgdorferi B31
IEIFNQDYLNAKINS

SEQ ID NO: 112625 - protein, 15 aa, Borrelia burgdorferi B31
EIFNQDYLNAKINSF

SEQ ID NO: 112626 - protein, 15 aa, Borrelia burgdorferi B31
IFNQDYLNAKINSFD

SEQ ID NO: 112627 - protein, 15 aa, Borrelia burgdorferi B31
FNQDYLNAKINSFDF

SEQ ID NO: 112628 - protein, 15 aa, Borrelia burgdorferi B31
NQDYLNAKINSFDFT

SEQ ID NO: 112629 - protein, 15 aa, Borrelia burgdorferi B31
QDYLNAKINSFDFTM

SEQ ID NO: 112630 - protein, 15 aa, Borrelia burgdorferi B31
DYLNAKINSFDFTMK

SEQ ID NO: 112631 - protein, 15 aa, Borrelia burgdorferi B31
YLNAKINSFDFTMKL

SEQ ID NO: 112632 - protein, 15 aa, Borrelia burgdorferi B31
LNAKINSFDFTMKLK

SEQ ID NO: 112633 - protein, 15 aa, Borrelia burgdorferi B31
NAKINSFDFTMKLKE

SEQ ID NO: 112634 - protein, 15 aa, Borrelia burgdorferi B31
AKINSFDFTMKLKEL

SEQ ID NO: 112635 - protein, 15 aa, Borrelia burgdorferi B31
KINSFDFTMKLKELK

SEQ ID NO: 112636 - protein, 15 aa, Borrelia burgdorferi B31
INSFDFTMKLKELKS

SEQ ID NO: 112637 - protein, 15 aa, Borrelia burgdorferi B31
NSFDFTMKLKELKSK

SEQ ID NO: 112638 - protein, 15 aa, Borrelia burgdorferi B31
SFDFTMKLKELKSKL

SEQ ID NO: 112639 - protein, 15 aa, Borrelia burgdorferi B31
FDFTMKLKELKSKLN

SEQ ID NO: 112640 - protein, 15 aa, Borrelia burgdorferi B31
DFTMKLKELKSKLNQ

SEQ ID NO: 112641 - protein, 15 aa, Borrelia burgdorferi B31
FTMKLKELKSKLNQI

SEQ ID NO: 112642 - protein, 15 aa, Borrelia burgdorferi B31
TMKLKELKSKLNQIL

SEQ ID NO: 112643 - protein, 15 aa, Borrelia burgdorferi B31
MKLKELKSKLNQILD

SEQ ID NO: 112644 - protein, 15 aa, Borrelia burgdorferi B31
KLKELKSKLNQILDK

SEQ ID NO: 112645 - protein, 15 aa, Borrelia burgdorferi B31
LKELKSKLNQILDKR

SEQ ID NO: 112646 - protein, 15 aa, Borrelia burgdorferi B31
KELKSKLNQILDKRK

SEQ ID NO: 112647 - protein, 15 aa, Borrelia burgdorferi B31
ELKSKLNQILDKRKE

SEQ ID NO: 112648 - protein, 15 aa, Borrelia burgdorferi B31
LKSKLNQILDKRKEW

SEQ ID NO: 112649 - protein, 15 aa, Borrelia burgdorferi B31
KSKLNQILDKRKEWS

SEQ ID NO: 112650 - protein, 15 aa, Borrelia burgdorferi B31
SKLNQILDKRKEWSR

SEQ ID NO: 112651 - protein, 15 aa, Borrelia burgdorferi B31
KLNQILDKRKEWSRQ

SEQ ID NO: 112652 - protein, 15 aa, Borrelia burgdorferi B31
LNQILDKRKEWSRQA

SEQ ID NO: 112653 - protein, 15 aa, Borrelia burgdorferi B31
NQILDKRKEWSRQAD

SEQ ID NO: 112654 - protein, 15 aa, Borrelia burgdorferi B31
QILDKRKEWSRQADG

SEQ ID NO: 112655 - protein, 15 aa, Borrelia burgdorferi B31
ILDKRKEWSRQADGL

SEQ ID NO: 112656 - protein, 15 aa, Borrelia burgdorferi B31
LDKRKEWSRQADGLI

SEQ ID NO: 112657 - protein, 15 aa, Borrelia burgdorferi B31
DKRKEWSRQADGLIA

SEQ ID NO: 112658 - protein, 15 aa, Borrelia burgdorferi B31
KRKEWSRQADGLIAN

SEQ ID NO: 112659 - protein, 15 aa, Borrelia burgdorferi B31
RKEWSRQADGLIANA

SEQ ID NO: 112660 - protein, 15 aa, Borrelia burgdorferi B31
KEWSRQADGLIANAS

SEQ ID NO: 112661 - protein, 15 aa, Borrelia burgdorferi B31
EWSRQADGLIANASS

SEQ ID NO: 112662 - protein, 15 aa, Borrelia burgdorferi B31
WSRQADGLIANASSN

SEQ ID NO: 112663 - protein, 15 aa, Borrelia burgdorferi B31
SRQADGLIANASSNS

SEQ ID NO: 112664 - protein, 15 aa, Borrelia burgdorferi B31
RQADGLIANASSNSS

SEQ ID NO: 112665 - protein, 15 aa, Borrelia burgdorferi B31
QADGLIANASSNSSL

SEQ ID NO: 112666 - protein, 15 aa, Borrelia burgdorferi B31
ADGLIANASSNSSLS

SEQ ID NO: 112667 - protein, 15 aa, Borrelia burgdorferi B31
DGLIANASSNSSLSD

SEQ ID NO: 112668 - protein, 15 aa, Borrelia burgdorferi B31
GLIANASSNSSLSDS

SEQ ID NO: 112669 - protein, 15 aa, Borrelia burgdorferi B31
LIANASSNSSLSDSK

SEQ ID NO: 112670 - protein, 15 aa, Borrelia burgdorferi B31
IANASSNSSLSDSKS

SEQ ID NO: 112671 - protein, 15 aa, Borrelia burgdorferi B31
ANASSNSSLSDSKSL

SEQ ID NO: 112672 - protein, 15 aa, Borrelia burgdorferi B31
NASSNSSLSDSKSLA

SEQ ID NO: 112673 - protein, 15 aa, Borrelia burgdorferi B31
ASSNSSLSDSKSLAE

SEQ ID NO: 112674 - protein, 15 aa, Borrelia burgdorferi B31
SSNSSLSDSKSLAEY

SEQ ID NO: 112675 - protein, 15 aa, Borrelia burgdorferi B31
SNSSLSDSKSLAEYI

SEQ ID NO: 112676 - protein, 15 aa, Borrelia burgdorferi B31
NSSLSDSKSLAEYIK

SEQ ID NO: 112677 - protein, 15 aa, Borrelia burgdorferi B31
SSLSDSKSLAEYIKK

SEQ ID NO: 112678 - protein, 15 aa, Borrelia burgdorferi B31
SLSDSKSLAEYIKKR

SEQ ID NO: 112679 - protein, 15 aa, Borrelia burgdorferi B31
LSDSKSLAEYIKKRY

SEQ ID NO: 112680 - protein, 15 aa, Borrelia burgdorferi B31
SDSKSLAEYIKKRYL

SEQ ID NO: 112681 - protein, 15 aa, Borrelia burgdorferi B31
DSKSLAEYIKKRYLD

SEQ ID NO: 112682 - protein, 15 aa, Borrelia burgdorferi B31
SKSLAEYIKKRYLDN

SEQ ID NO: 112683 - protein, 15 aa, Borrelia burgdorferi B31
KSLAEYIKKRYLDNM

SEQ ID NO: 112684 - protein, 15 aa, Borrelia burgdorferi B31
SLAEYIKKRYLDNMQ

SEQ ID NO: 112685 - protein, 15 aa, Borrelia burgdorferi B31
LAEYIKKRYLDNMQN

SEQ ID NO: 112686 - protein, 15 aa, Borrelia burgdorferi B31
AEYIKKRYLDNMQNA

SEQ ID NO: 112687 - protein, 15 aa, Borrelia burgdorferi B31
EYIKKRYLDNMQNAR

SEQ ID NO: 112688 - protein, 15 aa, Borrelia burgdorferi B31
YIKKRYLDNMQNARQ

SEQ ID NO: 112689 - protein, 15 aa, Borrelia burgdorferi B31
IKKRYLDNMQNARQS

SEQ ID NO: 112690 - protein, 15 aa, Borrelia burgdorferi B31
KKRYLDNMQNARQSV

SEQ ID NO: 112691 - protein, 15 aa, Borrelia burgdorferi B31
KRYLDNMQNARQSVL

SEQ ID NO: 112692 - protein, 15 aa, Borrelia burgdorferi B31
RYLDNMQNARQSVLE

SEQ ID NO: 112693 - protein, 15 aa, Borrelia burgdorferi B31
YLDNMQNARQSVLEA

SEQ ID NO: 112694 - protein, 15 aa, Borrelia burgdorferi B31
LDNMQNARQSVLEAY

SEQ ID NO: 112695 - protein, 15 aa, Borrelia burgdorferi B31
DNMQNARQSVLEAYI

SEQ ID NO: 112696 - protein, 15 aa, Borrelia burgdorferi B31
NMQNARQSVLEAYIS

SEQ ID NO: 112697 - protein, 15 aa, Borrelia burgdorferi B31
MQNARQSVLEAYISI

SEQ ID NO: 112698 - protein, 15 aa, Borrelia burgdorferi B31
QNARQSVLEAYISIM

SEQ ID NO: 112699 - protein, 16 aa, Borrelia burgdorferi B31
MKIKPLIQLKLLGLFL

SEQ ID NO: 112700 - protein, 16 aa, Borrelia burgdorferi B31
KIKPLIQLKLLGLFLF

SEQ ID NO: 112701 - protein, 16 aa, Borrelia burgdorferi B31
IKPLIQLKLLGLFLFS

SEQ ID NO: 112702 - protein, 16 aa, Borrelia burgdorferi B31
KPLIQLKLLGLFLFSC

SEQ ID NO: 112703 - protein, 16 aa, Borrelia burgdorferi B31
PLIQLKLLGLFLFSCT

SEQ ID NO: 112704 - protein, 16 aa, Borrelia burgdorferi B31
LIQLKLLGLFLFSCTI

SEQ ID NO: 112705 - protein, 16 aa, Borrelia burgdorferi B31
IQLKLLGLFLFSCTID

SEQ ID NO: 112706 - protein, 16 aa, Borrelia burgdorferi B31
QLKLLGLFLFSCTIDA

SEQ ID NO: 112707 - protein, 16 aa, Borrelia burgdorferi B31
LKLLGLFLFSCTIDAN

SEQ ID NO: 112708 - protein, 16 aa, Borrelia burgdorferi B31
KLLGLFLFSCTIDANL

SEQ ID NO: 112709 - protein, 16 aa, Borrelia burgdorferi B31
LLGLFLFSCTIDANLN

SEQ ID NO: 112710 - protein, 16 aa, Borrelia burgdorferi B31
LGLFLFSCTIDANLNE

SEQ ID NO: 112711 - protein, 16 aa, Borrelia burgdorferi B31
GLFLFSCTIDANLNED

SEQ ID NO: 112712 - protein, 16 aa, Borrelia burgdorferi B31
LFLFSCTIDANLNEDY

SEQ ID NO: 112713 - protein, 16 aa, Borrelia burgdorferi B31
FLFSCTIDANLNEDYK

SEQ ID NO: 112714 - protein, 16 aa, Borrelia burgdorferi B31
LFSCTIDANLNEDYKN

SEQ ID NO: 112715 - protein, 16 aa, Borrelia burgdorferi B31
FSCTIDANLNEDYKNK

SEQ ID NO: 112716 - protein, 16 aa, Borrelia burgdorferi B31
SCTIDANLNEDYKNKV

SEQ ID NO: 112717 - protein, 16 aa, Borrelia burgdorferi B31
CTIDANLNEDYKNKVK

SEQ ID NO: 112718 - protein, 16 aa, Borrelia burgdorferi B31
TIDANLNEDYKNKVKG

SEQ ID NO: 112719 - protein, 16 aa, Borrelia burgdorferi B31
IDANLNEDYKNKVKGI

SEQ ID NO: 112720 - protein, 16 aa, Borrelia burgdorferi B31
DANLNEDYKNKVKGIL

SEQ ID NO: 112721 - protein, 16 aa, Borrelia burgdorferi B31
ANLNEDYKNKVKGILN

SEQ ID NO: 112722 - protein, 16 aa, Borrelia burgdorferi B31
NLNEDYKNKVKGILNK

SEQ ID NO: 112723 - protein, 16 aa, Borrelia burgdorferi B31
LNEDYKNKVKGILNKA

SEQ ID NO: 112724 - protein, 16 aa, Borrelia burgdorferi B31
NEDYKNKVKGILNKAA

SEQ ID NO: 112725 - protein, 16 aa, Borrelia burgdorferi B31
EDYKNKVKGILNKAAD

SEQ ID NO: 112726 - protein, 16 aa, Borrelia burgdorferi B31
DYKNKVKGILNKAADD

SEQ ID NO: 112727 - protein, 16 aa, Borrelia burgdorferi B31
YKNKVKGILNKAADDQ

SEQ ID NO: 112728 - protein, 16 aa, Borrelia burgdorferi B31
KNKVKGILNKAADDQE

SEQ ID NO: 112729 - protein, 16 aa, Borrelia burgdorferi B31
NKVKGILNKAADDQET

SEQ ID NO: 112730 - protein, 16 aa, Borrelia burgdorferi B31
KVKGILNKAADDQETT

SEQ ID NO: 112731 - protein, 16 aa, Borrelia burgdorferi B31
VKGILNKAADDQETTS

SEQ ID NO: 112732 - protein, 16 aa, Borrelia burgdorferi B31
KGILNKAADDQETTSA

SEQ ID NO: 112733 - protein, 16 aa, Borrelia burgdorferi B31
GILNKAADDQETTSAD

SEQ ID NO: 112734 - protein, 16 aa, Borrelia burgdorferi B31
ILNKAADDQETTSADT

SEQ ID NO: 112735 - protein, 16 aa, Borrelia burgdorferi B31
LNKAADDQETTSADTN

SEQ ID NO: 112736 - protein, 16 aa, Borrelia burgdorferi B31
NKAADDQETTSADTNS

SEQ ID NO: 112737 - protein, 16 aa, Borrelia burgdorferi B31
KAADDQETTSADTNSN

SEQ ID NO: 112738 - protein, 16 aa, Borrelia burgdorferi B31
AADDQETTSADTNSNA

SEQ ID NO: 112739 - protein, 16 aa, Borrelia burgdorferi B31
ADDQETTSADTNSNAA

SEQ ID NO: 112740 - protein, 16 aa, Borrelia burgdorferi B31
DDQETTSADTNSNAAK

SEQ ID NO: 112741 - protein, 16 aa, Borrelia burgdorferi B31
DQETTSADTNSNAAKN

SEQ ID NO: 112742 - protein, 16 aa, Borrelia burgdorferi B31
QETTSADTNSNAAKNI

SEQ ID NO: 112743 - protein, 16 aa, Borrelia burgdorferi B31
ETTSADTNSNAAKNIP

SEQ ID NO: 112744 - protein, 16 aa, Borrelia burgdorferi B31
TTSADTNSNAAKNIPI

SEQ ID NO: 112745 - protein, 16 aa, Borrelia burgdorferi B31
TSADTNSNAAKNIPIA

SEQ ID NO: 112746 - protein, 16 aa, Borrelia burgdorferi B31
SADTNSNAAKNIPIAD

SEQ ID NO: 112747 - protein, 16 aa, Borrelia burgdorferi B31
ADTNSNAAKNIPIADN

SEQ ID NO: 112748 - protein, 16 aa, Borrelia burgdorferi B31
DTNSNAAKNIPIADND

SEQ ID NO: 112749 - protein, 16 aa, Borrelia burgdorferi B31
TNSNAAKNIPIADNDK

SEQ ID NO: 112750 - protein, 16 aa, Borrelia burgdorferi B31
NSNAAKNIPIADNDKV

SEQ ID NO: 112751 - protein, 16 aa, Borrelia burgdorferi B31
SNAAKNIPIADNDKVA

SEQ ID NO: 112752 - protein, 16 aa, Borrelia burgdorferi B31
NAAKNIPIADNDKVAA

SEQ ID NO: 112753 - protein, 16 aa, Borrelia burgdorferi B31
AAKNIPIADNDKVAAE

SEQ ID NO: 112754 - protein, 16 aa, Borrelia burgdorferi B31
AKNIPIADNDKVAAEL

SEQ ID NO: 112755 - protein, 16 aa, Borrelia burgdorferi B31
KNIPIADNDKVAAELK

SEQ ID NO: 112756 - protein, 16 aa, Borrelia burgdorferi B31
NIPIADNDKVAAELKK

SEQ ID NO: 112757 - protein, 16 aa, Borrelia burgdorferi B31
IPIADNDKVAAELKKQ

SEQ ID NO: 112758 - protein, 16 aa, Borrelia burgdorferi B31
PIADNDKVAAELKKQS

SEQ ID NO: 112759 - protein, 16 aa, Borrelia burgdorferi B31
IADNDKVAAELKKQSQ

SEQ ID NO: 112760 - protein, 16 aa, Borrelia burgdorferi B31
ADNDKVAAELKKQSQA

SEQ ID NO: 112761 - protein, 16 aa, Borrelia burgdorferi B31
DNDKVAAELKKQSQAA

SEQ ID NO: 112762 - protein, 16 aa, Borrelia burgdorferi B31
NDKVAAELKKQSQAAK

SEQ ID NO: 112763 - protein, 16 aa, Borrelia burgdorferi B31
DKVAAELKKQSQAAKT

SEQ ID NO: 112764 - protein, 16 aa, Borrelia burgdorferi B31
KVAAELKKQSQAAKTV

SEQ ID NO: 112765 - protein, 16 aa, Borrelia burgdorferi B31
VAAELKKQSQAAKTVA

SEQ ID NO: 112766 - protein, 16 aa, Borrelia burgdorferi B31
AAELKKQSQAAKTVAA

SEQ ID NO: 112767 - protein, 16 aa, Borrelia burgdorferi B31
AELKKQSQAAKTVAAA

SEQ ID NO: 112768 - protein, 16 aa, Borrelia burgdorferi B31
ELKKQSQAAKTVAAAP

SEQ ID NO: 112769 - protein, 16 aa, Borrelia burgdorferi B31
LKKQSQAAKTVAAAPN

SEQ ID NO: 112770 - protein, 16 aa, Borrelia burgdorferi B31
KKQSQAAKTVAAAPNK

SEQ ID NO: 112771 - protein, 16 aa, Borrelia burgdorferi B31
KQSQAAKTVAAAPNKG

SEQ ID NO: 112772 - protein, 16 aa, Borrelia burgdorferi B31
QSQAAKTVAAAPNKGS

SEQ ID NO: 112773 - protein, 16 aa, Borrelia burgdorferi B31
SQAAKTVAAAPNKGSQ

SEQ ID NO: 112774 - protein, 16 aa, Borrelia burgdorferi B31
QAAKTVAAAPNKGSQN

SEQ ID NO: 112775 - protein, 16 aa, Borrelia burgdorferi B31
AAKTVAAAPNKGSQNQ

SEQ ID NO: 112776 - protein, 16 aa, Borrelia burgdorferi B31
AKTVAAAPNKGSQNQP

SEQ ID NO: 112777 - protein, 16 aa, Borrelia burgdorferi B31
KTVAAAPNKGSQNQPQ

SEQ ID NO: 112778 - protein, 16 aa, Borrelia burgdorferi B31
TVAAAPNKGSQNQPQT

SEQ ID NO: 112779 - protein, 16 aa, Borrelia burgdorferi B31
VAAAPNKGSQNQPQTT

SEQ ID NO: 112780 - protein, 16 aa, Borrelia burgdorferi B31
AAAPNKGSQNQPQTTP

SEQ ID NO: 112781 - protein, 16 aa, Borrelia burgdorferi B31
AAPNKGSQNQPQTTPN

SEQ ID NO: 112782 - protein, 16 aa, Borrelia burgdorferi B31
APNKGSQNQPQTTPNK

SEQ ID NO: 112783 - protein, 16 aa, Borrelia burgdorferi B31
PNKGSQNQPQTTPNKG

SEQ ID NO: 112784 - protein, 16 aa, Borrelia burgdorferi B31
NKGSQNQPQTTPNKGS

SEQ ID NO: 112785 - protein, 16 aa, Borrelia burgdorferi B31
KGSQNQPQTTPNKGSQ

SEQ ID NO: 112786 - protein, 16 aa, Borrelia burgdorferi B31
GSQNQPQTTPNKGSQN

SEQ ID NO: 112787 - protein, 16 aa, Borrelia burgdorferi B31
SQNQPQTTPNKGSQNQ

SEQ ID NO: 112788 - protein, 16 aa, Borrelia burgdorferi B31
QNQPQTTPNKGSQNQQ

SEQ ID NO: 112789 - protein, 16 aa, Borrelia burgdorferi B31
NQPQTTPNKGSQNQQA

SEQ ID NO: 112790 - protein, 16 aa, Borrelia burgdorferi B31
QPQTTPNKGSQNQQAA

SEQ ID NO: 112791 - protein, 16 aa, Borrelia burgdorferi B31
PQTTPNKGSQNQQAAP

SEQ ID NO: 112792 - protein, 16 aa, Borrelia burgdorferi B31
QTTPNKGSQNQQAAPS

SEQ ID NO: 112793 - protein, 16 aa, Borrelia burgdorferi B31
TTPNKGSQNQQAAPSP

SEQ ID NO: 112794 - protein, 16 aa, Borrelia burgdorferi B31
TPNKGSQNQQAAPSPQ

SEQ ID NO: 112795 - protein, 16 aa, Borrelia burgdorferi B31
PNKGSQNQQAAPSPQL

SEQ ID NO: 112796 - protein, 16 aa, Borrelia burgdorferi B31
NKGSQNQQAAPSPQLQ

SEQ ID NO: 112797 - protein, 16 aa, Borrelia burgdorferi B31
KGSQNQQAAPSPQLQS

SEQ ID NO: 112798 - protein, 16 aa, Borrelia burgdorferi B31
GSQNQQAAPSPQLQSL

SEQ ID NO: 112799 - protein, 16 aa, Borrelia burgdorferi B31
SQNQQAAPSPQLQSLS

SEQ ID NO: 112800 - protein, 16 aa, Borrelia burgdorferi B31
QNQQAAPSPQLQSLSF

SEQ ID NO: 112801 - protein, 16 aa, Borrelia burgdorferi B31
NQQAAPSPQLQSLSFS

SEQ ID NO: 112802 - protein, 16 aa, Borrelia burgdorferi B31
QQAAPSPQLQSLSFSA

SEQ ID NO: 112803 - protein, 16 aa, Borrelia burgdorferi B31
QAAPSPQLQSLSFSAD

SEQ ID NO: 112804 - protein, 16 aa, Borrelia burgdorferi B31
AAPSPQLQSLSFSADL

SEQ ID NO: 112805 - protein, 16 aa, Borrelia burgdorferi B31
APSPQLQSLSFSADLS

SEQ ID NO: 112806 - protein, 16 aa, Borrelia burgdorferi B31
PSPQLQSLSFSADLSN

SEQ ID NO: 112807 - protein, 16 aa, Borrelia burgdorferi B31
SPQLQSLSFSADLSNL

SEQ ID NO: 112808 - protein, 16 aa, Borrelia burgdorferi B31
PQLQSLSFSADLSNLP

SEQ ID NO: 112809 - protein, 16 aa, Borrelia burgdorferi B31
QLQSLSFSADLSNLPK

SEQ ID NO: 112810 - protein, 16 aa, Borrelia burgdorferi B31
LQSLSFSADLSNLPKT

SEQ ID NO: 112811 - protein, 16 aa, Borrelia burgdorferi B31
QSLSFSADLSNLPKTT

SEQ ID NO: 112812 - protein, 16 aa, Borrelia burgdorferi B31
SLSFSADLSNLPKTTA

SEQ ID NO: 112813 - protein, 16 aa, Borrelia burgdorferi B31
LSFSADLSNLPKTTAA

SEQ ID NO: 112814 - protein, 16 aa, Borrelia burgdorferi B31
SFSADLSNLPKTTAAR

SEQ ID NO: 112815 - protein, 16 aa, Borrelia burgdorferi B31
FSADLSNLPKTTAARA

SEQ ID NO: 112816 - protein, 16 aa, Borrelia burgdorferi B31
SADLSNLPKTTAARAA

SEQ ID NO: 112817 - protein, 16 aa, Borrelia burgdorferi B31
ADLSNLPKTTAARAAS

SEQ ID NO: 112818 - protein, 16 aa, Borrelia burgdorferi B31
DLSNLPKTTAARAASL

SEQ ID NO: 112819 - protein, 16 aa, Borrelia burgdorferi B31
LSNLPKTTAARAASLT

SEQ ID NO: 112820 - protein, 16 aa, Borrelia burgdorferi B31
SNLPKTTAARAASLTK

SEQ ID NO: 112821 - protein, 16 aa, Borrelia burgdorferi B31
NLPKTTAARAASLTKQ

SEQ ID NO: 112822 - protein, 16 aa, Borrelia burgdorferi B31
LPKTTAARAASLTKQR

SEQ ID NO: 112823 - protein, 16 aa, Borrelia burgdorferi B31
PKTTAARAASLTKQRI

SEQ ID NO: 112824 - protein, 16 aa, Borrelia burgdorferi B31
KTTAARAASLTKQRIP

SEQ ID NO: 112825 - protein, 16 aa, Borrelia burgdorferi B31
TTAARAASLTKQRIPI

SEQ ID NO: 112826 - protein, 16 aa, Borrelia burgdorferi B31
TAARAASLTKQRIPIQ

SEQ ID NO: 112827 - protein, 16 aa, Borrelia burgdorferi B31
AARAASLTKQRIPIQA

SEQ ID NO: 112828 - protein, 16 aa, Borrelia burgdorferi B31
ARAASLTKQRIPIQAV

SEQ ID NO: 112829 - protein, 16 aa, Borrelia burgdorferi B31
RAASLTKQRIPIQAVT

SEQ ID NO: 112830 - protein, 16 aa, Borrelia burgdorferi B31
AASLTKQRIPIQAVTT

SEQ ID NO: 112831 - protein, 16 aa, Borrelia burgdorferi B31
ASLTKQRIPIQAVTTV

SEQ ID NO: 112832 - protein, 16 aa, Borrelia burgdorferi B31
SLTKQRIPIQAVTTVP

SEQ ID NO: 112833 - protein, 16 aa, Borrelia burgdorferi B31
LTKQRIPIQAVTTVPG

SEQ ID NO: 112834 - protein, 16 aa, Borrelia burgdorferi B31
TKQRIPIQAVTTVPGN

SEQ ID NO: 112835 - protein, 16 aa, Borrelia burgdorferi B31
KQRIPIQAVTTVPGNT

SEQ ID NO: 112836 - protein, 16 aa, Borrelia burgdorferi B31
QRIPIQAVTTVPGNTR

SEQ ID NO: 112837 - protein, 16 aa, Borrelia burgdorferi B31
RIPIQAVTTVPGNTRT

SEQ ID NO: 112838 - protein, 16 aa, Borrelia burgdorferi B31
IPIQAVTTVPGNTRTF

SEQ ID NO: 112839 - protein, 16 aa, Borrelia burgdorferi B31
PIQAVTTVPGNTRTFN

SEQ ID NO: 112840 - protein, 16 aa, Borrelia burgdorferi B31
IQAVTTVPGNTRTFNS

SEQ ID NO: 112841 - protein, 16 aa, Borrelia burgdorferi B31
QAVTTVPGNTRTFNSR

SEQ ID NO: 112842 - protein, 16 aa, Borrelia burgdorferi B31
AVTTVPGNTRTFNSRN

SEQ ID NO: 112843 - protein, 16 aa, Borrelia burgdorferi B31
VTTVPGNTRTFNSRNS

SEQ ID NO: 112844 - protein, 16 aa, Borrelia burgdorferi B31
TTVPGNTRTFNSRNSG

SEQ ID NO: 112845 - protein, 16 aa, Borrelia burgdorferi B31
TVPGNTRTFNSRNSGL

SEQ ID NO: 112846 - protein, 16 aa, Borrelia burgdorferi B31
VPGNTRTFNSRNSGLP

SEQ ID NO: 112847 - protein, 16 aa, Borrelia burgdorferi B31
PGNTRTFNSRNSGLPT

SEQ ID NO: 112848 - protein, 16 aa, Borrelia burgdorferi B31
GNTRTFNSRNSGLPTF

SEQ ID NO: 112849 - protein, 16 aa, Borrelia burgdorferi B31
NTRTFNSRNSGLPTFA

SEQ ID NO: 112850 - protein, 16 aa, Borrelia burgdorferi B31
TRTFNSRNSGLPTFAL

SEQ ID NO: 112851 - protein, 16 aa, Borrelia burgdorferi B31
RTFNSRNSGLPTFALN

SEQ ID NO: 112852 - protein, 16 aa, Borrelia burgdorferi B31
TFNSRNSGLPTFALNY

SEQ ID NO: 112853 - protein, 16 aa, Borrelia burgdorferi B31
FNSRNSGLPTFALNYS

SEQ ID NO: 112854 - protein, 16 aa, Borrelia burgdorferi B31
NSRNSGLPTFALNYSF

SEQ ID NO: 112855 - protein, 16 aa, Borrelia burgdorferi B31
SRNSGLPTFALNYSFS

SEQ ID NO: 112856 - protein, 16 aa, Borrelia burgdorferi B31
RNSGLPTFALNYSFSQ

SEQ ID NO: 112857 - protein, 16 aa, Borrelia burgdorferi B31
NSGLPTFALNYSFSQP

SEQ ID NO: 112858 - protein, 16 aa, Borrelia burgdorferi B31
SGLPTFALNYSFSQPT

SEQ ID NO: 112859 - protein, 16 aa, Borrelia burgdorferi B31
GLPTFALNYSFSQPTR

SEQ ID NO: 112860 - protein, 16 aa, Borrelia burgdorferi B31
LPTFALNYSFSQPTRQ

SEQ ID NO: 112861 - protein, 16 aa, Borrelia burgdorferi B31
PTFALNYSFSQPTRQQ

SEQ ID NO: 112862 - protein, 16 aa, Borrelia burgdorferi B31
TFALNYSFSQPTRQQT

SEQ ID NO: 112863 - protein, 16 aa, Borrelia burgdorferi B31
FALNYSFSQPTRQQTN

SEQ ID NO: 112864 - protein, 16 aa, Borrelia burgdorferi B31
ALNYSFSQPTRQQTNS

SEQ ID NO: 112865 - protein, 16 aa, Borrelia burgdorferi B31
LNYSFSQPTRQQTNSS

SEQ ID NO: 112866 - protein, 16 aa, Borrelia burgdorferi B31
NYSFSQPTRQQTNSSS

SEQ ID NO: 112867 - protein, 16 aa, Borrelia burgdorferi B31
YSFSQPTRQQTNSSSA

SEQ ID NO: 112868 - protein, 16 aa, Borrelia burgdorferi B31
SFSQPTRQQTNSSSAV

SEQ ID NO: 112869 - protein, 16 aa, Borrelia burgdorferi B31
FSQPTRQQTNSSSAVQ

SEQ ID NO: 112870 - protein, 16 aa, Borrelia burgdorferi B31
SQPTRQQTNSSSAVQT

SEQ ID NO: 112871 - protein, 16 aa, Borrelia burgdorferi B31
QPTRQQTNSSSAVQTT

SEQ ID NO: 112872 - protein, 16 aa, Borrelia burgdorferi B31
PTRQQTNSSSAVQTTT

SEQ ID NO: 112873 - protein, 16 aa, Borrelia burgdorferi B31
TRQQTNSSSAVQTTTS

SEQ ID NO: 112874 - protein, 16 aa, Borrelia burgdorferi B31
RQQTNSSSAVQTTTSS

SEQ ID NO: 112875 - protein, 16 aa, Borrelia burgdorferi B31
QQTNSSSAVQTTTSSG

SEQ ID NO: 112876 - protein, 16 aa, Borrelia burgdorferi B31
QTNSSSAVQTTTSSGS

SEQ ID NO: 112877 - protein, 16 aa, Borrelia burgdorferi B31
TNSSSAVQTTTSSGSK

SEQ ID NO: 112878 - protein, 16 aa, Borrelia burgdorferi B31
NSSSAVQTTTSSGSKL

SEQ ID NO: 112879 - protein, 16 aa, Borrelia burgdorferi B31
SSSAVQTTTSSGSKLQ

SEQ ID NO: 112880 - protein, 16 aa, Borrelia burgdorferi B31
SSAVQTTTSSGSKLQT

SEQ ID NO: 112881 - protein, 16 aa, Borrelia burgdorferi B31
SAVQTTTSSGSKLQTL

SEQ ID NO: 112882 - protein, 16 aa, Borrelia burgdorferi B31
AVQTTTSSGSKLQTLK

SEQ ID NO: 112883 - protein, 16 aa, Borrelia burgdorferi B31
VQTTTSSGSKLQTLKN

SEQ ID NO: 112884 - protein, 16 aa, Borrelia burgdorferi B31
QTTTSSGSKLQTLKNE

SEQ ID NO: 112885 - protein, 16 aa, Borrelia burgdorferi B31
TTTSSGSKLQTLKNEL

SEQ ID NO: 112886 - protein, 16 aa, Borrelia burgdorferi B31
TTSSGSKLQTLKNELI

SEQ ID NO: 112887 - protein, 16 aa, Borrelia burgdorferi B31
TSSGSKLQTLKNELIR

SEQ ID NO: 112888 - protein, 16 aa, Borrelia burgdorferi B31
SSGSKLQTLKNELIRA

SEQ ID NO: 112889 - protein, 16 aa, Borrelia burgdorferi B31
SGSKLQTLKNELIRAI

SEQ ID NO: 112890 - protein, 16 aa, Borrelia burgdorferi B31
GSKLQTLKNELIRAIS

SEQ ID NO: 112891 - protein, 16 aa, Borrelia burgdorferi B31
SKLQTLKNELIRAISE

SEQ ID NO: 112892 - protein, 16 aa, Borrelia burgdorferi B31
KLQTLKNELIRAISEE

SEQ ID NO: 112893 - protein, 16 aa, Borrelia burgdorferi B31
LQTLKNELIRAISEEK

SEQ ID NO: 112894 - protein, 16 aa, Borrelia burgdorferi B31
QTLKNELIRAISEEKN

SEQ ID NO: 112895 - protein, 16 aa, Borrelia burgdorferi B31
TLKNELIRAISEEKNK

SEQ ID NO: 112896 - protein, 16 aa, Borrelia burgdorferi B31
LKNELIRAISEEKNKT

SEQ ID NO: 112897 - protein, 16 aa, Borrelia burgdorferi B31
KNELIRAISEEKNKTQ

SEQ ID NO: 112898 - protein, 16 aa, Borrelia burgdorferi B31
NELIRAISEEKNKTQN

SEQ ID NO: 112899 - protein, 16 aa, Borrelia burgdorferi B31
ELIRAISEEKNKTQNN

SEQ ID NO: 112900 - protein, 16 aa, Borrelia burgdorferi B31
LIRAISEEKNKTQNNF

SEQ ID NO: 112901 - protein, 16 aa, Borrelia burgdorferi B31
IRAISEEKNKTQNNFG

SEQ ID NO: 112902 - protein, 16 aa, Borrelia burgdorferi B31
RAISEEKNKTQNNFGF

SEQ ID NO: 112903 - protein, 16 aa, Borrelia burgdorferi B31
AISEEKNKTQNNFGFR

SEQ ID NO: 112904 - protein, 16 aa, Borrelia burgdorferi B31
ISEEKNKTQNNFGFRE

SEQ ID NO: 112905 - protein, 16 aa, Borrelia burgdorferi B31
SEEKNKTQNNFGFRET

SEQ ID NO: 112906 - protein, 16 aa, Borrelia burgdorferi B31
EEKNKTQNNFGFRETY

SEQ ID NO: 112907 - protein, 16 aa, Borrelia burgdorferi B31
EKNKTQNNFGFRETYD

SEQ ID NO: 112908 - protein, 16 aa, Borrelia burgdorferi B31
KNKTQNNFGFRETYDQ

SEQ ID NO: 112909 - protein, 16 aa, Borrelia burgdorferi B31
NKTQNNFGFRETYDQF

SEQ ID NO: 112910 - protein, 16 aa, Borrelia burgdorferi B31
KTQNNFGFRETYDQFK

SEQ ID NO: 112911 - protein, 16 aa, Borrelia burgdorferi B31
TQNNFGFRETYDQFKM

SEQ ID NO: 112912 - protein, 16 aa, Borrelia burgdorferi B31
QNNFGFRETYDQFKMK

SEQ ID NO: 112913 - protein, 16 aa, Borrelia burgdorferi B31
NNFGFRETYDQFKMKD

SEQ ID NO: 112914 - protein, 16 aa, Borrelia burgdorferi B31
NFGFRETYDQFKMKDS

SEQ ID NO: 112915 - protein, 16 aa, Borrelia burgdorferi B31
FGFRETYDQFKMKDSA

SEQ ID NO: 112916 - protein, 16 aa, Borrelia burgdorferi B31
GFRETYDQFKMKDSAF

SEQ ID NO: 112917 - protein, 16 aa, Borrelia burgdorferi B31
FRETYDQFKMKDSAFE

SEQ ID NO: 112918 - protein, 16 aa, Borrelia burgdorferi B31
RETYDQFKMKDSAFEL

SEQ ID NO: 112919 - protein, 16 aa, Borrelia burgdorferi B31
ETYDQFKMKDSAFELL

SEQ ID NO: 112920 - protein, 16 aa, Borrelia burgdorferi B31
TYDQFKMKDSAFELLD

SEQ ID NO: 112921 - protein, 16 aa, Borrelia burgdorferi B31
YDQFKMKDSAFELLDV

SEQ ID NO: 112922 - protein, 16 aa, Borrelia burgdorferi B31
DQFKMKDSAFELLDVI

SEQ ID NO: 112923 - protein, 16 aa, Borrelia burgdorferi B31
QFKMKDSAFELLDVIS

SEQ ID NO: 112924 - protein, 16 aa, Borrelia burgdorferi B31
FKMKDSAFELLDVISS

SEQ ID NO: 112925 - protein, 16 aa, Borrelia burgdorferi B31
KMKDSAFELLDVISSA

SEQ ID NO: 112926 - protein, 16 aa, Borrelia burgdorferi B31
MKDSAFELLDVISSAK

SEQ ID NO: 112927 - protein, 16 aa, Borrelia burgdorferi B31
KDSAFELLDVISSAKV

SEQ ID NO: 112928 - protein, 16 aa, Borrelia burgdorferi B31
DSAFELLDVISSAKVY

SEQ ID NO: 112929 - protein, 16 aa, Borrelia burgdorferi B31
SAFELLDVISSAKVYD

SEQ ID NO: 112930 - protein, 16 aa, Borrelia burgdorferi B31
AFELLDVISSAKVYDR

SEQ ID NO: 112931 - protein, 16 aa, Borrelia burgdorferi B31
FELLDVISSAKVYDRS

SEQ ID NO: 112932 - protein, 16 aa, Borrelia burgdorferi B31
ELLDVISSAKVYDRSY

SEQ ID NO: 112933 - protein, 16 aa, Borrelia burgdorferi B31
LLDVISSAKVYDRSYA

SEQ ID NO: 112934 - protein, 16 aa, Borrelia burgdorferi B31
LDVISSAKVYDRSYAP

SEQ ID NO: 112935 - protein, 16 aa, Borrelia burgdorferi B31
DVISSAKVYDRSYAPQ

SEQ ID NO: 112936 - protein, 16 aa, Borrelia burgdorferi B31
VISSAKVYDRSYAPQL

SEQ ID NO: 112937 - protein, 16 aa, Borrelia burgdorferi B31
ISSAKVYDRSYAPQLN

SEQ ID NO: 112938 - protein, 16 aa, Borrelia burgdorferi B31
SSAKVYDRSYAPQLNS

SEQ ID NO: 112939 - protein, 16 aa, Borrelia burgdorferi B31
SAKVYDRSYAPQLNSN

SEQ ID NO: 112940 - protein, 16 aa, Borrelia burgdorferi B31
AKVYDRSYAPQLNSNT

SEQ ID NO: 112941 - protein, 16 aa, Borrelia burgdorferi B31
KVYDRSYAPQLNSNTP

SEQ ID NO: 112942 - protein, 16 aa, Borrelia burgdorferi B31
VYDRSYAPQLNSNTPE

SEQ ID NO: 112943 - protein, 16 aa, Borrelia burgdorferi B31
YDRSYAPQLNSNTPEA

SEQ ID NO: 112944 - protein, 16 aa, Borrelia burgdorferi B31
DRSYAPQLNSNTPEAE

SEQ ID NO: 112945 - protein, 16 aa, Borrelia burgdorferi B31
RSYAPQLNSNTPEAEN

SEQ ID NO: 112946 - protein, 16 aa, Borrelia burgdorferi B31
SYAPQLNSNTPEAENE

SEQ ID NO: 112947 - protein, 16 aa, Borrelia burgdorferi B31
YAPQLNSNTPEAENER

SEQ ID NO: 112948 - protein, 16 aa, Borrelia burgdorferi B31
APQLNSNTPEAENERN

SEQ ID NO: 112949 - protein, 16 aa, Borrelia burgdorferi B31
PQLNSNTPEAENERNK

SEQ ID NO: 112950 - protein, 16 aa, Borrelia burgdorferi B31
QLNSNTPEAENERNKF

SEQ ID NO: 112951 - protein, 16 aa, Borrelia burgdorferi B31
LNSNTPEAENERNKFY

SEQ ID NO: 112952 - protein, 16 aa, Borrelia burgdorferi B31
NSNTPEAENERNKFYA

SEQ ID NO: 112953 - protein, 16 aa, Borrelia burgdorferi B31
SNTPEAENERNKFYAL

SEQ ID NO: 112954 - protein, 16 aa, Borrelia burgdorferi B31
NTPEAENERNKFYALM

SEQ ID NO: 112955 - protein, 16 aa, Borrelia burgdorferi B31
TPEAENERNKFYALMD

SEQ ID NO: 112956 - protein, 16 aa, Borrelia burgdorferi B31
PEAENERNKFYALMDF

SEQ ID NO: 112957 - protein, 16 aa, Borrelia burgdorferi B31
EAENERNKFYALMDFD

SEQ ID NO: 112958 - protein, 16 aa, Borrelia burgdorferi B31
AENERNKFYALMDFDQ

SEQ ID NO: 112959 - protein, 16 aa, Borrelia burgdorferi B31
ENERNKFYALMDFDQY

SEQ ID NO: 112960 - protein, 16 aa, Borrelia burgdorferi B31
NERNKFYALMDFDQYK

SEQ ID NO: 112961 - protein, 16 aa, Borrelia burgdorferi B31
ERNKFYALMDFDQYKI

SEQ ID NO: 112962 - protein, 16 aa, Borrelia burgdorferi B31
RNKFYALMDFDQYKIE

SEQ ID NO: 112963 - protein, 16 aa, Borrelia burgdorferi B31
NKFYALMDFDQYKIEQ

SEQ ID NO: 112964 - protein, 16 aa, Borrelia burgdorferi B31
KFYALMDFDQYKIEQF

SEQ ID NO: 112965 - protein, 16 aa, Borrelia burgdorferi B31
FYALMDFDQYKIEQFG

SEQ ID NO: 112966 - protein, 16 aa, Borrelia burgdorferi B31
YALMDFDQYKIEQFGS

SEQ ID NO: 112967 - protein, 16 aa, Borrelia burgdorferi B31
ALMDFDQYKIEQFGSI

SEQ ID NO: 112968 - protein, 16 aa, Borrelia burgdorferi B31
LMDFDQYKIEQFGSIM

SEQ ID NO: 112969 - protein, 16 aa, Borrelia burgdorferi B31
MDFDQYKIEQFGSIME

SEQ ID NO: 112970 - protein, 16 aa, Borrelia burgdorferi B31
DFDQYKIEQFGSIMEA

SEQ ID NO: 112971 - protein, 16 aa, Borrelia burgdorferi B31
FDQYKIEQFGSIMEAL

SEQ ID NO: 112972 - protein, 16 aa, Borrelia burgdorferi B31
DQYKIEQFGSIMEALY

SEQ ID NO: 112973 - protein, 16 aa, Borrelia burgdorferi B31
QYKIEQFGSIMEALYN

SEQ ID NO: 112974 - protein, 16 aa, Borrelia burgdorferi B31
YKIEQFGSIMEALYNE

SEQ ID NO: 112975 - protein, 16 aa, Borrelia burgdorferi B31
KIEQFGSIMEALYNEN

SEQ ID NO: 112976 - protein, 16 aa, Borrelia burgdorferi B31
IEQFGSIMEALYNENQ

SEQ ID NO: 112977 - protein, 16 aa, Borrelia burgdorferi B31
EQFGSIMEALYNENQN

SEQ ID NO: 112978 - protein, 16 aa, Borrelia burgdorferi B31
QFGSIMEALYNENQNH

SEQ ID NO: 112979 - protein, 16 aa, Borrelia burgdorferi B31
FGSIMEALYNENQNHS

SEQ ID NO: 112980 - protein, 16 aa, Borrelia burgdorferi B31
GSIMEALYNENQNHSL

SEQ ID NO: 112981 - protein, 16 aa, Borrelia burgdorferi B31
SIMEALYNENQNHSLI

SEQ ID NO: 112982 - protein, 16 aa, Borrelia burgdorferi B31
IMEALYNENQNHSLIR

SEQ ID NO: 112983 - protein, 16 aa, Borrelia burgdorferi B31
MEALYNENQNHSLIRE

SEQ ID NO: 112984 - protein, 16 aa, Borrelia burgdorferi B31
EALYNENQNHSLIREL

SEQ ID NO: 112985 - protein, 16 aa, Borrelia burgdorferi B31
ALYNENQNHSLIRELM

SEQ ID NO: 112986 - protein, 16 aa, Borrelia burgdorferi B31
LYNENQNHSLIRELMI

SEQ ID NO: 112987 - protein, 16 aa, Borrelia burgdorferi B31
YNENQNHSLIRELMIS

SEQ ID NO: 112988 - protein, 16 aa, Borrelia burgdorferi B31
NENQNHSLIRELMISG

SEQ ID NO: 112989 - protein, 16 aa, Borrelia burgdorferi B31
ENQNHSLIRELMISGL

SEQ ID NO: 112990 - protein, 16 aa, Borrelia burgdorferi B31
NQNHSLIRELMISGLG

SEQ ID NO: 112991 - protein, 16 aa, Borrelia burgdorferi B31
QNHSLIRELMISGLGT

SEQ ID NO: 112992 - protein, 16 aa, Borrelia burgdorferi B31
NHSLIRELMISGLGTQ

SEQ ID NO: 112993 - protein, 16 aa, Borrelia burgdorferi B31
HSLIRELMISGLGTQI

SEQ ID NO: 112994 - protein, 16 aa, Borrelia burgdorferi B31
SLIRELMISGLGTQIS

SEQ ID NO: 112995 - protein, 16 aa, Borrelia burgdorferi B31
LIRELMISGLGTQISF

SEQ ID NO: 112996 - protein, 16 aa, Borrelia burgdorferi B31
IRELMISGLGTQISFE

SEQ ID NO: 112997 - protein, 16 aa, Borrelia burgdorferi B31
RELMISGLGTQISFEL

SEQ ID NO: 112998 - protein, 16 aa, Borrelia burgdorferi B31
ELMISGLGTQISFELA

SEQ ID NO: 112999 - protein, 16 aa, Borrelia burgdorferi B31
LMISGLGTQISFELAL

SEQ ID NO: 113000 - protein, 16 aa, Borrelia burgdorferi B31
MISGLGTQISFELALE

SEQ ID NO: 113001 - protein, 16 aa, Borrelia burgdorferi B31
ISGLGTQISFELALEE

SEQ ID NO: 113002 - protein, 16 aa, Borrelia burgdorferi B31
SGLGTQISFELALEEI

SEQ ID NO: 113003 - protein, 16 aa, Borrelia burgdorferi B31
GLGTQISFELALEEIN

SEQ ID NO: 113004 - protein, 16 aa, Borrelia burgdorferi B31
LGTQISFELALEEINK

SEQ ID NO: 113005 - protein, 16 aa, Borrelia burgdorferi B31
GTQISFELALEEINKK

SEQ ID NO: 113006 - protein, 16 aa, Borrelia burgdorferi B31
TQISFELALEEINKKI

SEQ ID NO: 113007 - protein, 16 aa, Borrelia burgdorferi B31
QISFELALEEINKKIE

SEQ ID NO: 113008 - protein, 16 aa, Borrelia burgdorferi B31
ISFELALEEINKKIEI

SEQ ID NO: 113009 - protein, 16 aa, Borrelia burgdorferi B31
SFELALEEINKKIEIF

SEQ ID NO: 113010 - protein, 16 aa, Borrelia burgdorferi B31
FELALEEINKKIEIFN

SEQ ID NO: 113011 - protein, 16 aa, Borrelia burgdorferi B31
ELALEEINKKIEIFNQ

SEQ ID NO: 113012 - protein, 16 aa, Borrelia burgdorferi B31
LALEEINKKIEIFNQD

SEQ ID NO: 113013 - protein, 16 aa, Borrelia burgdorferi B31
ALEEINKKIEIFNQDY

SEQ ID NO: 113014 - protein, 16 aa, Borrelia burgdorferi B31
LEEINKKIEIFNQDYL

SEQ ID NO: 113015 - protein, 16 aa, Borrelia burgdorferi B31
EEINKKIEIFNQDYLN

SEQ ID NO: 113016 - protein, 16 aa, Borrelia burgdorferi B31
EINKKIEIFNQDYLNA

SEQ ID NO: 113017 - protein, 16 aa, Borrelia burgdorferi B31
INKKIEIFNQDYLNAK

SEQ ID NO: 113018 - protein, 16 aa, Borrelia burgdorferi B31
NKKIEIFNQDYLNAKI

SEQ ID NO: 113019 - protein, 16 aa, Borrelia burgdorferi B31
KKIEIFNQDYLNAKIN

SEQ ID NO: 113020 - protein, 16 aa, Borrelia burgdorferi B31
KIEIFNQDYLNAKINS

SEQ ID NO: 113021 - protein, 16 aa, Borrelia burgdorferi B31
IEIFNQDYLNAKINSF

SEQ ID NO: 113022 - protein, 16 aa, Borrelia burgdorferi B31
EIFNQDYLNAKINSFD

SEQ ID NO: 113023 - protein, 16 aa, Borrelia burgdorferi B31
IFNQDYLNAKINSFDF

SEQ ID NO: 113024 - protein, 16 aa, Borrelia burgdorferi B31
FNQDYLNAKINSFDFT

SEQ ID NO: 113025 - protein, 16 aa, Borrelia burgdorferi B31
NQDYLNAKINSFDFTM

SEQ ID NO: 113026 - protein, 16 aa, Borrelia burgdorferi B31
QDYLNAKINSFDFTMK

SEQ ID NO: 113027 - protein, 16 aa, Borrelia burgdorferi B31
DYLNAKINSFDFTMKL

SEQ ID NO: 113028 - protein, 16 aa, Borrelia burgdorferi B31
YLNAKINSFDFTMKLK

SEQ ID NO: 113029 - protein, 16 aa, Borrelia burgdorferi B31
LNAKINSFDFTMKLKE

SEQ ID NO: 113030 - protein, 16 aa, Borrelia burgdorferi B31
NAKINSFDFTMKLKEL

SEQ ID NO: 113031 - protein, 16 aa, Borrelia burgdorferi B31
AKINSFDFTMKLKELK

SEQ ID NO: 113032 - protein, 16 aa, Borrelia burgdorferi B31
KINSFDFTMKLKELKS

SEQ ID NO: 113033 - protein, 16 aa, Borrelia burgdorferi B31
INSFDFTMKLKELKSK

SEQ ID NO: 113034 - protein, 16 aa, Borrelia burgdorferi B31
NSFDFTMKLKELKSKL

SEQ ID NO: 113035 - protein, 16 aa, Borrelia burgdorferi B31
SFDFTMKLKELKSKLN

SEQ ID NO: 113036 - protein, 16 aa, Borrelia burgdorferi B31
FDFTMKLKELKSKLNQ

SEQ ID NO: 113037 - protein, 16 aa, Borrelia burgdorferi B31
DFTMKLKELKSKLNQI

SEQ ID NO: 113038 - protein, 16 aa, Borrelia burgdorferi B31
FTMKLKELKSKLNQIL

SEQ ID NO: 113039 - protein, 16 aa, Borrelia burgdorferi B31
TMKLKELKSKLNQILD

SEQ ID NO: 113040 - protein, 16 aa, Borrelia burgdorferi B31
MKLKELKSKLNQILDK

SEQ ID NO: 113041 - protein, 16 aa, Borrelia burgdorferi B31
KLKELKSKLNQILDKR

SEQ ID NO: 113042 - protein, 16 aa, Borrelia burgdorferi B31
LKELKSKLNQILDKRK

SEQ ID NO: 113043 - protein, 16 aa, Borrelia burgdorferi B31
KELKSKLNQILDKRKE

SEQ ID NO: 113044 - protein, 16 aa, Borrelia burgdorferi B31
ELKSKLNQILDKRKEW

SEQ ID NO: 113045 - protein, 16 aa, Borrelia burgdorferi B31
LKSKLNQILDKRKEWS

SEQ ID NO: 113046 - protein, 16 aa, Borrelia burgdorferi B31
KSKLNQILDKRKEWSR

SEQ ID NO: 113047 - protein, 16 aa, Borrelia burgdorferi B31
SKLNQILDKRKEWSRQ

SEQ ID NO: 113048 - protein, 16 aa, Borrelia burgdorferi B31
KLNQILDKRKEWSRQA

SEQ ID NO: 113049 - protein, 16 aa, Borrelia burgdorferi B31
LNQILDKRKEWSRQAD

SEQ ID NO: 113050 - protein, 16 aa, Borrelia burgdorferi B31
NQILDKRKEWSRQADG

SEQ ID NO: 113051 - protein, 16 aa, Borrelia burgdorferi B31
QILDKRKEWSRQADGL

SEQ ID NO: 113052 - protein, 16 aa, Borrelia burgdorferi B31
ILDKRKEWSRQADGLI

SEQ ID NO: 113053 - protein, 16 aa, Borrelia burgdorferi B31
LDKRKEWSRQADGLIA

SEQ ID NO: 113054 - protein, 16 aa, Borrelia burgdorferi B31
DKRKEWSRQADGLIAN

SEQ ID NO: 113055 - protein, 16 aa, Borrelia burgdorferi B31
KRKEWSRQADGLIANA

SEQ ID NO: 113056 - protein, 16 aa, Borrelia burgdorferi B31
RKEWSRQADGLIANAS

SEQ ID NO: 113057 - protein, 16 aa, Borrelia burgdorferi B31
KEWSRQADGLIANASS

SEQ ID NO: 113058 - protein, 16 aa, Borrelia burgdorferi B31
EWSRQADGLIANASSN

SEQ ID NO: 113059 - protein, 16 aa, Borrelia burgdorferi B31
WSRQADGLIANASSNS

SEQ ID NO: 113060 - protein, 16 aa, Borrelia burgdorferi B31
SRQADGLIANASSNSS

SEQ ID NO: 113061 - protein, 16 aa, Borrelia burgdorferi B31
RQADGLIANASSNSSL

SEQ ID NO: 113062 - protein, 16 aa, Borrelia burgdorferi B31
QADGLIANASSNSSLS

SEQ ID NO: 113063 - protein, 16 aa, Borrelia burgdorferi B31
ADGLIANASSNSSLSD

SEQ ID NO: 113064 - protein, 16 aa, Borrelia burgdorferi B31
DGLIANASSNSSLSDS

SEQ ID NO: 113065 - protein, 16 aa, Borrelia burgdorferi B31
GLIANASSNSSLSDSK

SEQ ID NO: 113066 - protein, 16 aa, Borrelia burgdorferi B31
LIANASSNSSLSDSKS

SEQ ID NO: 113067 - protein, 16 aa, Borrelia burgdorferi B31
IANASSNSSLSDSKSL

SEQ ID NO: 113068 - protein, 16 aa, Borrelia burgdorferi B31
ANASSNSSLSDSKSLA

SEQ ID NO: 113069 - protein, 16 aa, Borrelia burgdorferi B31
NASSNSSLSDSKSLAE

SEQ ID NO: 113070 - protein, 16 aa, Borrelia burgdorferi B31
ASSNSSLSDSKSLAEY

SEQ ID NO: 113071 - protein, 16 aa, Borrelia burgdorferi B31
SSNSSLSDSKSLAEYI

SEQ ID NO: 113072 - protein, 16 aa, Borrelia burgdorferi B31
SNSSLSDSKSLAEYIK

SEQ ID NO: 113073 - protein, 16 aa, Borrelia burgdorferi B31
NSSLSDSKSLAEYIKK

SEQ ID NO: 113074 - protein, 16 aa, Borrelia burgdorferi B31
SSLSDSKSLAEYIKKR

SEQ ID NO: 113075 - protein, 16 aa, Borrelia burgdorferi B31
SLSDSKSLAEYIKKRY

SEQ ID NO: 113076 - protein, 16 aa, Borrelia burgdorferi B31
LSDSKSLAEYIKKRYL

SEQ ID NO: 113077 - protein, 16 aa, Borrelia burgdorferi B31
SDSKSLAEYIKKRYLD

SEQ ID NO: 113078 - protein, 16 aa, Borrelia burgdorferi B31
DSKSLAEYIKKRYLDN

SEQ ID NO: 113079 - protein, 16 aa, Borrelia burgdorferi B31
SKSLAEYIKKRYLDNM

SEQ ID NO: 113080 - protein, 16 aa, Borrelia burgdorferi B31
KSLAEYIKKRYLDNMQ

SEQ ID NO: 113081 - protein, 16 aa, Borrelia burgdorferi B31
SLAEYIKKRYLDNMQN

SEQ ID NO: 113082 - protein, 16 aa, Borrelia burgdorferi B31
LAEYIKKRYLDNMQNA

SEQ ID NO: 113083 - protein, 16 aa, Borrelia burgdorferi B31
AEYIKKRYLDNMQNAR

SEQ ID NO: 113084 - protein, 16 aa, Borrelia burgdorferi B31
EYIKKRYLDNMQNARQ

SEQ ID NO: 113085 - protein, 16 aa, Borrelia burgdorferi B31
YIKKRYLDNMQNARQS

SEQ ID NO: 113086 - protein, 16 aa, Borrelia burgdorferi B31
IKKRYLDNMQNARQSV

SEQ ID NO: 113087 - protein, 16 aa, Borrelia burgdorferi B31
KKRYLDNMQNARQSVL

SEQ ID NO: 113088 - protein, 16 aa, Borrelia burgdorferi B31
KRYLDNMQNARQSVLE

SEQ ID NO: 113089 - protein, 16 aa, Borrelia burgdorferi B31
RYLDNMQNARQSVLEA

SEQ ID NO: 113090 - protein, 16 aa, Borrelia burgdorferi B31
YLDNMQNARQSVLEAY

SEQ ID NO: 113091 - protein, 16 aa, Borrelia burgdorferi B31
LDNMQNARQSVLEAYI

SEQ ID NO: 113092 - protein, 16 aa, Borrelia burgdorferi B31
DNMQNARQSVLEAYIS

SEQ ID NO: 113093 - protein, 16 aa, Borrelia burgdorferi B31
NMQNARQSVLEAYISI

SEQ ID NO: 113094 - protein, 16 aa, Borrelia burgdorferi B31
MQNARQSVLEAYISIM

SEQ ID NO: 113095 - protein, 13 aa, Borrelia garinii PBi
MSSCTIDANLNKD

SEQ ID NO: 113096 - protein, 13 aa, Borrelia garinii PBi
SSCTIDANLNKDY

SEQ ID NO: 113097 - protein, 13 aa, Borrelia garinii PBi
SCTIDANLNKDYK

SEQ ID NO: 113098 - protein, 13 aa, Borrelia garinii PBi
CTIDANLNKDYKN

SEQ ID NO: 113099 - protein, 13 aa, Borrelia garinii PBi
TIDANLNKDYKNK

SEQ ID NO: 113100 - protein, 13 aa, Borrelia garinii PBi
IDANLNKDYKNKV

SEQ ID NO: 113101 - protein, 13 aa, Borrelia garinii PBi
DANLNKDYKNKVE

SEQ ID NO: 113102 - protein, 13 aa, Borrelia garinii PBi
ANLNKDYKNKVEE

SEQ ID NO: 113103 - protein, 13 aa, Borrelia garinii PBi
NLNKDYKNKVEEL

SEQ ID NO: 113104 - protein, 13 aa, Borrelia garinii PBi
LNKDYKNKVEELL

SEQ ID NO: 113105 - protein, 13 aa, Borrelia garinii PBi
NKDYKNKVEELLN

SEQ ID NO: 113106 - protein, 13 aa, Borrelia garinii PBi
KDYKNKVEELLNS

SEQ ID NO: 113107 - protein, 13 aa, Borrelia garinii PBi
DYKNKVEELLNSS

SEQ ID NO: 113108 - protein, 13 aa, Borrelia garinii PBi
YKNKVEELLNSST

SEQ ID NO: 113109 - protein, 13 aa, Borrelia garinii PBi
KNKVEELLNSSTD

SEQ ID NO: 113110 - protein, 13 aa, Borrelia garinii PBi
NKVEELLNSSTDD

SEQ ID NO: 113111 - protein, 13 aa, Borrelia garinii PBi
KVEELLNSSTDDQ

SEQ ID NO: 113112 - protein, 13 aa, Borrelia garinii PBi
VEELLNSSTDDQA

SEQ ID NO: 113113 - protein, 13 aa, Borrelia garinii PBi
EELLNSSTDDQAK

SEQ ID NO: 113114 - protein, 13 aa, Borrelia garinii PBi
ELLNSSTDDQAKI

SEQ ID NO: 113115 - protein, 13 aa, Borrelia garinii PBi
LLNSSTDDQAKIS

SEQ ID NO: 113116 - protein, 13 aa, Borrelia garinii PBi
LNSSTDDQAKISI

SEQ ID NO: 113117 - protein, 13 aa, Borrelia garinii PBi
NSSTDDQAKISIN

SEQ ID NO: 113118 - protein, 13 aa, Borrelia garinii PBi
SSTDDQAKISINT

SEQ ID NO: 113119 - protein, 13 aa, Borrelia garinii PBi
STDDQAKISINTG

SEQ ID NO: 113120 - protein, 13 aa, Borrelia garinii PBi
TDDQAKISINTGS

SEQ ID NO: 113121 - protein, 13 aa, Borrelia garinii PBi
DDQAKISINTGSN

SEQ ID NO: 113122 - protein, 13 aa, Borrelia garinii PBi
DQAKISINTGSNA

SEQ ID NO: 113123 - protein, 13 aa, Borrelia garinii PBi
QAKISINTGSNAT

SEQ ID NO: 113124 - protein, 13 aa, Borrelia garinii PBi
AKISINTGSNATK

SEQ ID NO: 113125 - protein, 13 aa, Borrelia garinii PBi
KISINTGSNATKN

SEQ ID NO: 113126 - protein, 13 aa, Borrelia garinii PBi
ISINTGSNATKNK

SEQ ID NO: 113127 - protein, 13 aa, Borrelia garinii PBi
SINTGSNATKNKT

SEQ ID NO: 113128 - protein, 13 aa, Borrelia garinii PBi
INTGSNATKNKTN

SEQ ID NO: 113129 - protein, 13 aa, Borrelia garinii PBi
NTGSNATKNKTNI

SEQ ID NO: 113130 - protein, 13 aa, Borrelia garinii PBi
TGSNATKNKTNIK

SEQ ID NO: 113131 - protein, 13 aa, Borrelia garinii PBi
GSNATKNKTNIKV

SEQ ID NO: 113132 - protein, 13 aa, Borrelia garinii PBi
SNATKNKTNIKVA

SEQ ID NO: 113133 - protein, 13 aa, Borrelia garinii PBi
NATKNKTNIKVAG

SEQ ID NO: 113134 - protein, 13 aa, Borrelia garinii PBi
ATKNKTNIKVAGL

SEQ ID NO: 113135 - protein, 13 aa, Borrelia garinii PBi
TKNKTNIKVAGLQ

SEQ ID NO: 113136 - protein, 13 aa, Borrelia garinii PBi
KNKTNIKVAGLQK

SEQ ID NO: 113137 - protein, 13 aa, Borrelia garinii PBi
NKTNIKVAGLQKN

SEQ ID NO: 113138 - protein, 13 aa, Borrelia garinii PBi
KTNIKVAGLQKNT

SEQ ID NO: 113139 - protein, 13 aa, Borrelia garinii PBi
TNIKVAGLQKNTQ

SEQ ID NO: 113140 - protein, 13 aa, Borrelia garinii PBi
NIKVAGLQKNTQS

SEQ ID NO: 113141 - protein, 13 aa, Borrelia garinii PBi
IKVAGLQKNTQSK

SEQ ID NO: 113142 - protein, 13 aa, Borrelia garinii PBi
KVAGLQKNTQSKK

SEQ ID NO: 113143 - protein, 13 aa, Borrelia garinii PBi
VAGLQKNTQSKKN

SEQ ID NO: 113144 - protein, 13 aa, Borrelia garinii PBi
AGLQKNTQSKKNN

SEQ ID NO: 113145 - protein, 13 aa, Borrelia garinii PBi
GLQKNTQSKKNNN

SEQ ID NO: 113146 - protein, 13 aa, Borrelia garinii PBi
LQKNTQSKKNNNL

SEQ ID NO: 113147 - protein, 13 aa, Borrelia garinii PBi
QKNTQSKKNNNLQ

SEQ ID NO: 113148 - protein, 13 aa, Borrelia garinii PBi
KNTQSKKNNNLQG

SEQ ID NO: 113149 - protein, 13 aa, Borrelia garinii PBi
NTQSKKNNNLQGL

SEQ ID NO: 113150 - protein, 13 aa, Borrelia garinii PBi
TQSKKNNNLQGLN

SEQ ID NO: 113151 - protein, 13 aa, Borrelia garinii PBi
QSKKNNNLQGLNP

SEQ ID NO: 113152 - protein, 13 aa, Borrelia garinii PBi
SKKNNNLQGLNPA

SEQ ID NO: 113153 - protein, 13 aa, Borrelia garinii PBi
KKNNNLQGLNPAN

SEQ ID NO: 113154 - protein, 13 aa, Borrelia garinii PBi
KNNNLQGLNPANQ

SEQ ID NO: 113155 - protein, 13 aa, Borrelia garinii PBi
NNNLQGLNPANQV

SEQ ID NO: 113156 - protein, 13 aa, Borrelia garinii PBi
NNLQGLNPANQVN

SEQ ID NO: 113157 - protein, 13 aa, Borrelia garinii PBi
NLQGLNPANQVNP

SEQ ID NO: 113158 - protein, 13 aa, Borrelia garinii PBi
LQGLNPANQVNPG

SEQ ID NO: 113159 - protein, 13 aa, Borrelia garinii PBi
QGLNPANQVNPGN

SEQ ID NO: 113160 - protein, 13 aa, Borrelia garinii PBi
GLNPANQVNPGNP

SEQ ID NO: 113161 - protein, 13 aa, Borrelia garinii PBi
LNPANQVNPGNPM

SEQ ID NO: 113162 - protein, 13 aa, Borrelia garinii PBi
NPANQVNPGNPMQ

SEQ ID NO: 113163 - protein, 13 aa, Borrelia garinii PBi
PANQVNPGNPMQI

SEQ ID NO: 113164 - protein, 13 aa, Borrelia garinii PBi
ANQVNPGNPMQIA

SEQ ID NO: 113165 - protein, 13 aa, Borrelia garinii PBi
NQVNPGNPMQIAN

SEQ ID NO: 113166 - protein, 13 aa, Borrelia garinii PBi
QVNPGNPMQIANQ

SEQ ID NO: 113167 - protein, 13 aa, Borrelia garinii PBi
VNPGNPMQIANQA

SEQ ID NO: 113168 - protein, 13 aa, Borrelia garinii PBi
NPGNPMQIANQAN

SEQ ID NO: 113169 - protein, 13 aa, Borrelia garinii PBi
PGNPMQIANQANQ

SEQ ID NO: 113170 - protein, 13 aa, Borrelia garinii PBi
GNPMQIANQANQA

SEQ ID NO: 113171 - protein, 13 aa, Borrelia garinii PBi
NPMQIANQANQAN

SEQ ID NO: 113172 - protein, 13 aa, Borrelia garinii PBi
PMQIANQANQANQ

SEQ ID NO: 113173 - protein, 13 aa, Borrelia garinii PBi
MQIANQANQANQA

SEQ ID NO: 113174 - protein, 13 aa, Borrelia garinii PBi
QIANQANQANQAN

SEQ ID NO: 113175 - protein, 13 aa, Borrelia garinii PBi
IANQANQANQANQ

SEQ ID NO: 113176 - protein, 13 aa, Borrelia garinii PBi
ANQANQANQANQA

SEQ ID NO: 113177 - protein, 13 aa, Borrelia garinii PBi
NQANQANQANQAN

SEQ ID NO: 113178 - protein, 13 aa, Borrelia garinii PBi
QANQANQANQANQ

SEQ ID NO: 113179 - protein, 13 aa, Borrelia garinii PBi
ANQANQANQANQA

SEQ ID NO: 113180 - protein, 13 aa, Borrelia garinii PBi
NQANQANQANQAN

SEQ ID NO: 113181 - protein, 13 aa, Borrelia garinii PBi
QANQANQANQANQ

SEQ ID NO: 113182 - protein, 13 aa, Borrelia garinii PBi
ANQANQANQANQA

SEQ ID NO: 113183 - protein, 13 aa, Borrelia garinii PBi
NQANQANQANQAS

SEQ ID NO: 113184 - protein, 13 aa, Borrelia garinii PBi
QANQANQANQASQ

SEQ ID NO: 113185 - protein, 13 aa, Borrelia garinii PBi
ANQANQANQASQA

SEQ ID NO: 113186 - protein, 13 aa, Borrelia garinii PBi
NQANQANQASQAS

SEQ ID NO: 113187 - protein, 13 aa, Borrelia garinii PBi
QANQANQASQASQ

SEQ ID NO: 113188 - protein, 13 aa, Borrelia garinii PBi
ANQANQASQASQA

SEQ ID NO: 113189 - protein, 13 aa, Borrelia garinii PBi
NQANQASQASQAS

SEQ ID NO: 113190 - protein, 13 aa, Borrelia garinii PBi
QANQASQASQASQ

SEQ ID NO: 113191 - protein, 13 aa, Borrelia garinii PBi
ANQASQASQASQV

SEQ ID NO: 113192 - protein, 13 aa, Borrelia garinii PBi
NQASQASQASQVA

SEQ ID NO: 113193 - protein, 13 aa, Borrelia garinii PBi
QASQASQASQVAS

SEQ ID NO: 113194 - protein, 13 aa, Borrelia garinii PBi
ASQASQASQVASS

SEQ ID NO: 113195 - protein, 13 aa, Borrelia garinii PBi
SQASQASQVASSA

SEQ ID NO: 113196 - protein, 13 aa, Borrelia garinii PBi
QASQASQVASSAS

SEQ ID NO: 113197 - protein, 13 aa, Borrelia garinii PBi
ASQASQVASSASQ

SEQ ID NO: 113198 - protein, 13 aa, Borrelia garinii PBi
SQASQVASSASQA

SEQ ID NO: 113199 - protein, 13 aa, Borrelia garinii PBi
QASQVASSASQAS

SEQ ID NO: 113200 - protein, 13 aa, Borrelia garinii PBi
ASQVASSASQASP

SEQ ID NO: 113201 - protein, 13 aa, Borrelia garinii PBi
SQVASSASQASPV

SEQ ID NO: 113202 - protein, 13 aa, Borrelia garinii PBi
QVASSASQASPVA

SEQ ID NO: 113203 - protein, 13 aa, Borrelia garinii PBi
VASSASQASPVAS

SEQ ID NO: 113204 - protein, 13 aa, Borrelia garinii PBi
ASSASQASPVASP

SEQ ID NO: 113205 - protein, 13 aa, Borrelia garinii PBi
SSASQASPVASPA

SEQ ID NO: 113206 - protein, 13 aa, Borrelia garinii PBi
SASQASPVASPAT

SEQ ID NO: 113207 - protein, 13 aa, Borrelia garinii PBi
ASQASPVASPATN

SEQ ID NO: 113208 - protein, 13 aa, Borrelia garinii PBi
SQASPVASPATNV

SEQ ID NO: 113209 - protein, 13 aa, Borrelia garinii PBi
QASPVASPATNVQ

SEQ ID NO: 113210 - protein, 13 aa, Borrelia garinii PBi
ASPVASPATNVQA

SEQ ID NO: 113211 - protein, 13 aa, Borrelia garinii PBi
SPVASPATNVQAT

SEQ ID NO: 113212 - protein, 13 aa, Borrelia garinii PBi
PVASPATNVQATP

SEQ ID NO: 113213 - protein, 13 aa, Borrelia garinii PBi
VASPATNVQATPP

SEQ ID NO: 113214 - protein, 13 aa, Borrelia garinii PBi
ASPATNVQATPPK

SEQ ID NO: 113215 - protein, 13 aa, Borrelia garinii PBi
SPATNVQATPPKQ

SEQ ID NO: 113216 - protein, 13 aa, Borrelia garinii PBi
PATNVQATPPKQI

SEQ ID NO: 113217 - protein, 13 aa, Borrelia garinii PBi
ATNVQATPPKQIA

SEQ ID NO: 113218 - protein, 13 aa, Borrelia garinii PBi
TNVQATPPKQIAS

SEQ ID NO: 113219 - protein, 13 aa, Borrelia garinii PBi
NVQATPPKQIASA

SEQ ID NO: 113220 - protein, 13 aa, Borrelia garinii PBi
VQATPPKQIASAQ

SEQ ID NO: 113221 - protein, 13 aa, Borrelia garinii PBi
QATPPKQIASAQA

SEQ ID NO: 113222 - protein, 13 aa, Borrelia garinii PBi
ATPPKQIASAQAI

SEQ ID NO: 113223 - protein, 13 aa, Borrelia garinii PBi
TPPKQIASAQAIQ

SEQ ID NO: 113224 - protein, 13 aa, Borrelia garinii PBi
PPKQIASAQAIQT

SEQ ID NO: 113225 - protein, 13 aa, Borrelia garinii PBi
PKQIASAQAIQTV

SEQ ID NO: 113226 - protein, 13 aa, Borrelia garinii PBi
KQIASAQAIQTVP

SEQ ID NO: 113227 - protein, 13 aa, Borrelia garinii PBi
QIASAQAIQTVPN

SEQ ID NO: 113228 - protein, 13 aa, Borrelia garinii PBi
IASAQAIQTVPNN

SEQ ID NO: 113229 - protein, 13 aa, Borrelia garinii PBi
ASAQAIQTVPNNT

SEQ ID NO: 113230 - protein, 13 aa, Borrelia garinii PBi
SAQAIQTVPNNTS

SEQ ID NO: 113231 - protein, 13 aa, Borrelia garinii PBi
AQAIQTVPNNTST

SEQ ID NO: 113232 - protein, 13 aa, Borrelia garinii PBi
QAIQTVPNNTSTP

SEQ ID NO: 113233 - protein, 13 aa, Borrelia garinii PBi
AIQTVPNNTSTPN

SEQ ID NO: 113234 - protein, 13 aa, Borrelia garinii PBi
IQTVPNNTSTPNQ

SEQ ID NO: 113235 - protein, 13 aa, Borrelia garinii PBi
QTVPNNTSTPNQS

SEQ ID NO: 113236 - protein, 13 aa, Borrelia garinii PBi
TVPNNTSTPNQSI

SEQ ID NO: 113237 - protein, 13 aa, Borrelia garinii PBi
VPNNTSTPNQSII

SEQ ID NO: 113238 - protein, 13 aa, Borrelia garinii PBi
PNNTSTPNQSIIK

SEQ ID NO: 113239 - protein, 13 aa, Borrelia garinii PBi
NNTSTPNQSIIKP

SEQ ID NO: 113240 - protein, 13 aa, Borrelia garinii PBi
NTSTPNQSIIKPQ

SEQ ID NO: 113241 - protein, 13 aa, Borrelia garinii PBi
TSTPNQSIIKPQQ

SEQ ID NO: 113242 - protein, 13 aa, Borrelia garinii PBi
STPNQSIIKPQQY

SEQ ID NO: 113243 - protein, 13 aa, Borrelia garinii PBi
TPNQSIIKPQQYT

SEQ ID NO: 113244 - protein, 13 aa, Borrelia garinii PBi
PNQSIIKPQQYTF

SEQ ID NO: 113245 - protein, 13 aa, Borrelia garinii PBi
NQSIIKPQQYTFS

SEQ ID NO: 113246 - protein, 13 aa, Borrelia garinii PBi
QSIIKPQQYTFSS

SEQ ID NO: 113247 - protein, 13 aa, Borrelia garinii PBi
SIIKPQQYTFSSS

SEQ ID NO: 113248 - protein, 13 aa, Borrelia garinii PBi
IIKPQQYTFSSSF

SEQ ID NO: 113249 - protein, 13 aa, Borrelia garinii PBi
IKPQQYTFSSSFS

SEQ ID NO: 113250 - protein, 13 aa, Borrelia garinii PBi
KPQQYTFSSSFSQ

SEQ ID NO: 113251 - protein, 13 aa, Borrelia garinii PBi
PQQYTFSSSFSQP

SEQ ID NO: 113252 - protein, 13 aa, Borrelia garinii PBi
QQYTFSSSFSQPT

SEQ ID NO: 113253 - protein, 13 aa, Borrelia garinii PBi
QYTFSSSFSQPTS

SEQ ID NO: 113254 - protein, 13 aa, Borrelia garinii PBi
YTFSSSFSQPTSQ

SEQ ID NO: 113255 - protein, 13 aa, Borrelia garinii PBi
TFSSSFSQPTSQT

SEQ ID NO: 113256 - protein, 13 aa, Borrelia garinii PBi
FSSSFSQPTSQTN

SEQ ID NO: 113257 - protein, 13 aa, Borrelia garinii PBi
SSSFSQPTSQTNF

SEQ ID NO: 113258 - protein, 13 aa, Borrelia garinii PBi
SSFSQPTSQTNFN

SEQ ID NO: 113259 - protein, 13 aa, Borrelia garinii PBi
SFSQPTSQTNFNN

SEQ ID NO: 113260 - protein, 13 aa, Borrelia garinii PBi
FSQPTSQTNFNNS

SEQ ID NO: 113261 - protein, 13 aa, Borrelia garinii PBi
SQPTSQTNFNNSQ

SEQ ID NO: 113262 - protein, 13 aa, Borrelia garinii PBi
QPTSQTNFNNSQS

SEQ ID NO: 113263 - protein, 13 aa, Borrelia garinii PBi
PTSQTNFNNSQSN

SEQ ID NO: 113264 - protein, 13 aa, Borrelia garinii PBi
TSQTNFNNSQSNN

SEQ ID NO: 113265 - protein, 13 aa, Borrelia garinii PBi
SQTNFNNSQSNNV

SEQ ID NO: 113266 - protein, 13 aa, Borrelia garinii PBi
QTNFNNSQSNNVL

SEQ ID NO: 113267 - protein, 13 aa, Borrelia garinii PBi
TNFNNSQSNNVLT

SEQ ID NO: 113268 - protein, 13 aa, Borrelia garinii PBi
NFNNSQSNNVLTN

SEQ ID NO: 113269 - protein, 13 aa, Borrelia garinii PBi
FNNSQSNNVLTNY

SEQ ID NO: 113270 - protein, 13 aa, Borrelia garinii PBi
NNSQSNNVLTNYR

SEQ ID NO: 113271 - protein, 13 aa, Borrelia garinii PBi
NSQSNNVLTNYRH

SEQ ID NO: 113272 - protein, 13 aa, Borrelia garinii PBi
SQSNNVLTNYRHQ

SEQ ID NO: 113273 - protein, 13 aa, Borrelia garinii PBi
QSNNVLTNYRHQT

SEQ ID NO: 113274 - protein, 13 aa, Borrelia garinii PBi
SNNVLTNYRHQTQ

SEQ ID NO: 113275 - protein, 13 aa, Borrelia garinii PBi
NNVLTNYRHQTQP

SEQ ID NO: 113276 - protein, 13 aa, Borrelia garinii PBi
NVLTNYRHQTQPS

SEQ ID NO: 113277 - protein, 13 aa, Borrelia garinii PBi
VLTNYRHQTQPSF

SEQ ID NO: 113278 - protein, 13 aa, Borrelia garinii PBi
LTNYRHQTQPSFV

SEQ ID NO: 113279 - protein, 13 aa, Borrelia garinii PBi
TNYRHQTQPSFVV

SEQ ID NO: 113280 - protein, 13 aa, Borrelia garinii PBi
NYRHQTQPSFVVP

SEQ ID NO: 113281 - protein, 13 aa, Borrelia garinii PBi
YRHQTQPSFVVPV

SEQ ID NO: 113282 - protein, 13 aa, Borrelia garinii PBi
RHQTQPSFVVPVY

SEQ ID NO: 113283 - protein, 13 aa, Borrelia garinii PBi
HQTQPSFVVPVYS

SEQ ID NO: 113284 - protein, 13 aa, Borrelia garinii PBi
QTQPSFVVPVYSG

SEQ ID NO: 113285 - protein, 13 aa, Borrelia garinii PBi
TQPSFVVPVYSGN

SEQ ID NO: 113286 - protein, 13 aa, Borrelia garinii PBi
QPSFVVPVYSGNS

SEQ ID NO: 113287 - protein, 13 aa, Borrelia garinii PBi
PSFVVPVYSGNSP

SEQ ID NO: 113288 - protein, 13 aa, Borrelia garinii PBi
SFVVPVYSGNSPL

SEQ ID NO: 113289 - protein, 13 aa, Borrelia garinii PBi
FVVPVYSGNSPLQ

SEQ ID NO: 113290 - protein, 13 aa, Borrelia garinii PBi
VVPVYSGNSPLQK

SEQ ID NO: 113291 - protein, 13 aa, Borrelia garinii PBi
VPVYSGNSPLQKL

SEQ ID NO: 113292 - protein, 13 aa, Borrelia garinii PBi
PVYSGNSPLQKLK

SEQ ID NO: 113293 - protein, 13 aa, Borrelia garinii PBi
VYSGNSPLQKLKN

SEQ ID NO: 113294 - protein, 13 aa, Borrelia garinii PBi
YSGNSPLQKLKNN

SEQ ID NO: 113295 - protein, 13 aa, Borrelia garinii PBi
SGNSPLQKLKNNL

SEQ ID NO: 113296 - protein, 13 aa, Borrelia garinii PBi
GNSPLQKLKNNLL

SEQ ID NO: 113297 - protein, 13 aa, Borrelia garinii PBi
NSPLQKLKNNLLR

SEQ ID NO: 113298 - protein, 13 aa, Borrelia garinii PBi
SPLQKLKNNLLRR

SEQ ID NO: 113299 - protein, 13 aa, Borrelia garinii PBi
PLQKLKNNLLRRI

SEQ ID NO: 113300 - protein, 13 aa, Borrelia garinii PBi
LQKLKNNLLRRIA

SEQ ID NO: 113301 - protein, 13 aa, Borrelia garinii PBi
QKLKNNLLRRIAE

SEQ ID NO: 113302 - protein, 13 aa, Borrelia garinii PBi
KLKNNLLRRIAEE

SEQ ID NO: 113303 - protein, 13 aa, Borrelia garinii PBi
LKNNLLRRIAEEK

SEQ ID NO: 113304 - protein, 13 aa, Borrelia garinii PBi
KNNLLRRIAEEKN

SEQ ID NO: 113305 - protein, 13 aa, Borrelia garinii PBi
NNLLRRIAEEKNK

SEQ ID NO: 113306 - protein, 13 aa, Borrelia garinii PBi
NLLRRIAEEKNKT

SEQ ID NO: 113307 - protein, 13 aa, Borrelia garinii PBi
LLRRIAEEKNKTH

SEQ ID NO: 113308 - protein, 13 aa, Borrelia garinii PBi
LRRIAEEKNKTHN

SEQ ID NO: 113309 - protein, 13 aa, Borrelia garinii PBi
RRIAEEKNKTHNH

SEQ ID NO: 113310 - protein, 13 aa, Borrelia garinii PBi
RIAEEKNKTHNHG

SEQ ID NO: 113311 - protein, 13 aa, Borrelia garinii PBi
IAEEKNKTHNHGF

SEQ ID NO: 113312 - protein, 13 aa, Borrelia garinii PBi
AEEKNKTHNHGFR

SEQ ID NO: 113313 - protein, 13 aa, Borrelia garinii PBi
EEKNKTHNHGFRE

SEQ ID NO: 113314 - protein, 13 aa, Borrelia garinii PBi
EKNKTHNHGFRET

SEQ ID NO: 113315 - protein, 13 aa, Borrelia garinii PBi
KNKTHNHGFRETY

SEQ ID NO: 113316 - protein, 13 aa, Borrelia garinii PBi
NKTHNHGFRETYD

SEQ ID NO: 113317 - protein, 13 aa, Borrelia garinii PBi
KTHNHGFRETYDQ

SEQ ID NO: 113318 - protein, 13 aa, Borrelia garinii PBi
THNHGFRETYDQF

SEQ ID NO: 113319 - protein, 13 aa, Borrelia garinii PBi
HNHGFRETYDQFK

SEQ ID NO: 113320 - protein, 13 aa, Borrelia garinii PBi
NHGFRETYDQFKM

SEQ ID NO: 113321 - protein, 13 aa, Borrelia garinii PBi
HGFRETYDQFKMK

SEQ ID NO: 113322 - protein, 13 aa, Borrelia garinii PBi
GFRETYDQFKMKD

SEQ ID NO: 113323 - protein, 13 aa, Borrelia garinii PBi
FRETYDQFKMKDS

SEQ ID NO: 113324 - protein, 13 aa, Borrelia garinii PBi
RETYDQFKMKDSA

SEQ ID NO: 113325 - protein, 13 aa, Borrelia garinii PBi
ETYDQFKMKDSAF

SEQ ID NO: 113326 - protein, 13 aa, Borrelia garinii PBi
TYDQFKMKDSAFT

SEQ ID NO: 113327 - protein, 13 aa, Borrelia garinii PBi
YDQFKMKDSAFTL

SEQ ID NO: 113328 - protein, 13 aa, Borrelia garinii PBi
DQFKMKDSAFTLL

SEQ ID NO: 113329 - protein, 13 aa, Borrelia garinii PBi
QFKMKDSAFTLLD

SEQ ID NO: 113330 - protein, 13 aa, Borrelia garinii PBi
FKMKDSAFTLLDV

SEQ ID NO: 113331 - protein, 13 aa, Borrelia garinii PBi
KMKDSAFTLLDVI

SEQ ID NO: 113332 - protein, 13 aa, Borrelia garinii PBi
MKDSAFTLLDVIS

SEQ ID NO: 113333 - protein, 13 aa, Borrelia garinii PBi
KDSAFTLLDVISN

SEQ ID NO: 113334 - protein, 13 aa, Borrelia garinii PBi
DSAFTLLDVISNI

SEQ ID NO: 113335 - protein, 13 aa, Borrelia garinii PBi
SAFTLLDVISNIS

SEQ ID NO: 113336 - protein, 13 aa, Borrelia garinii PBi
AFTLLDVISNISV

SEQ ID NO: 113337 - protein, 13 aa, Borrelia garinii PBi
FTLLDVISNISVF

SEQ ID NO: 113338 - protein, 13 aa, Borrelia garinii PBi
TLLDVISNISVFD

SEQ ID NO: 113339 - protein, 13 aa, Borrelia garinii PBi
LLDVISNISVFDR

SEQ ID NO: 113340 - protein, 13 aa, Borrelia garinii PBi
LDVISNISVFDRG

SEQ ID NO: 113341 - protein, 13 aa, Borrelia garinii PBi
DVISNISVFDRGS

SEQ ID NO: 113342 - protein, 13 aa, Borrelia garinii PBi
VISNISVFDRGSA

SEQ ID NO: 113343 - protein, 13 aa, Borrelia garinii PBi
ISNISVFDRGSAP

SEQ ID NO: 113344 - protein, 13 aa, Borrelia garinii PBi
SNISVFDRGSAPQ

SEQ ID NO: 113345 - protein, 13 aa, Borrelia garinii PBi
NISVFDRGSAPQL

SEQ ID NO: 113346 - protein, 13 aa, Borrelia garinii PBi
ISVFDRGSAPQLS

SEQ ID NO: 113347 - protein, 13 aa, Borrelia garinii PBi
SVFDRGSAPQLSS

SEQ ID NO: 113348 - protein, 13 aa, Borrelia garinii PBi
VFDRGSAPQLSSN

SEQ ID NO: 113349 - protein, 13 aa, Borrelia garinii PBi
FDRGSAPQLSSNT

SEQ ID NO: 113350 - protein, 13 aa, Borrelia garinii PBi
DRGSAPQLSSNTP

SEQ ID NO: 113351 - protein, 13 aa, Borrelia garinii PBi
RGSAPQLSSNTPE

SEQ ID NO: 113352 - protein, 13 aa, Borrelia garinii PBi
GSAPQLSSNTPEA

SEQ ID NO: 113353 - protein, 13 aa, Borrelia garinii PBi
SAPQLSSNTPEAE

SEQ ID NO: 113354 - protein, 13 aa, Borrelia garinii PBi
APQLSSNTPEAES

SEQ ID NO: 113355 - protein, 13 aa, Borrelia garinii PBi
PQLSSNTPEAESE

SEQ ID NO: 113356 - protein, 13 aa, Borrelia garinii PBi
QLSSNTPEAESER

SEQ ID NO: 113357 - protein, 13 aa, Borrelia garinii PBi
LSSNTPEAESERN

SEQ ID NO: 113358 - protein, 13 aa, Borrelia garinii PBi
SSNTPEAESERNR

SEQ ID NO: 113359 - protein, 13 aa, Borrelia garinii PBi
SNTPEAESERNRL

SEQ ID NO: 113360 - protein, 13 aa, Borrelia garinii PBi
NTPEAESERNRLY

SEQ ID NO: 113361 - protein, 13 aa, Borrelia garinii PBi
TPEAESERNRLYA

SEQ ID NO: 113362 - protein, 13 aa, Borrelia garinii PBi
PEAESERNRLYAM

SEQ ID NO: 113363 - protein, 13 aa, Borrelia garinii PBi
EAESERNRLYAMM

SEQ ID NO: 113364 - protein, 13 aa, Borrelia garinii PBi
AESERNRLYAMMD

SEQ ID NO: 113365 - protein, 13 aa, Borrelia garinii PBi
ESERNRLYAMMDF

SEQ ID NO: 113366 - protein, 13 aa, Borrelia garinii PBi
SERNRLYAMMDFD

SEQ ID NO: 113367 - protein, 13 aa, Borrelia garinii PBi
ERNRLYAMMDFDQ

SEQ ID NO: 113368 - protein, 13 aa, Borrelia garinii PBi
RNRLYAMMDFDQA

SEQ ID NO: 113369 - protein, 13 aa, Borrelia garinii PBi
NRLYAMMDFDQAK

SEQ ID NO: 113370 - protein, 13 aa, Borrelia garinii PBi
RLYAMMDFDQAKT

SEQ ID NO: 113371 - protein, 13 aa, Borrelia garinii PBi
LYAMMDFDQAKTT

SEQ ID NO: 113372 - protein, 13 aa, Borrelia garinii PBi
YAMMDFDQAKTTE

SEQ ID NO: 113373 - protein, 13 aa, Borrelia garinii PBi
AMMDFDQAKTTEF

SEQ ID NO: 113374 - protein, 13 aa, Borrelia garinii PBi
MMDFDQAKTTEFG

SEQ ID NO: 113375 - protein, 13 aa, Borrelia garinii PBi
MDFDQAKTTEFGS

SEQ ID NO: 113376 - protein, 13 aa, Borrelia garinii PBi
DFDQAKTTEFGSI

SEQ ID NO: 113377 - protein, 13 aa, Borrelia garinii PBi
FDQAKTTEFGSIM

SEQ ID NO: 113378 - protein, 13 aa, Borrelia garinii PBi
DQAKTTEFGSIMN

SEQ ID NO: 113379 - protein, 13 aa, Borrelia garinii PBi
QAKTTEFGSIMNI

SEQ ID NO: 113380 - protein, 13 aa, Borrelia garinii PBi
AKTTEFGSIMNIL

SEQ ID NO: 113381 - protein, 13 aa, Borrelia garinii PBi
KTTEFGSIMNILY

SEQ ID NO: 113382 - protein, 13 aa, Borrelia garinii PBi
TTEFGSIMNILYQ

SEQ ID NO: 113383 - protein, 13 aa, Borrelia garinii PBi
TEFGSIMNILYQE

SEQ ID NO: 113384 - protein, 13 aa, Borrelia garinii PBi
EFGSIMNILYQEN

SEQ ID NO: 113385 - protein, 13 aa, Borrelia garinii PBi
FGSIMNILYQENQ

SEQ ID NO: 113386 - protein, 13 aa, Borrelia garinii PBi
GSIMNILYQENQN

SEQ ID NO: 113387 - protein, 13 aa, Borrelia garinii PBi
SIMNILYQENQNH

SEQ ID NO: 113388 - protein, 13 aa, Borrelia garinii PBi
IMNILYQENQNHS

SEQ ID NO: 113389 - protein, 13 aa, Borrelia garinii PBi
MNILYQENQNHSL

SEQ ID NO: 113390 - protein, 13 aa, Borrelia garinii PBi
NILYQENQNHSLI

SEQ ID NO: 113391 - protein, 13 aa, Borrelia garinii PBi
ILYQENQNHSLIR

SEQ ID NO: 113392 - protein, 13 aa, Borrelia garinii PBi
LYQENQNHSLIRS

SEQ ID NO: 113393 - protein, 13 aa, Borrelia garinii PBi
YQENQNHSLIRSL

SEQ ID NO: 113394 - protein, 13 aa, Borrelia garinii PBi
QENQNHSLIRSLI

SEQ ID NO: 113395 - protein, 13 aa, Borrelia garinii PBi
ENQNHSLIRSLII

SEQ ID NO: 113396 - protein, 13 aa, Borrelia garinii PBi
NQNHSLIRSLIIS

SEQ ID NO: 113397 - protein, 13 aa, Borrelia garinii PBi
QNHSLIRSLIISG

SEQ ID NO: 113398 - protein, 13 aa, Borrelia garinii PBi
NHSLIRSLIISGL

SEQ ID NO: 113399 - protein, 13 aa, Borrelia garinii PBi
HSLIRSLIISGLG

SEQ ID NO: 113400 - protein, 13 aa, Borrelia garinii PBi
SLIRSLIISGLGI

SEQ ID NO: 113401 - protein, 13 aa, Borrelia garinii PBi
LIRSLIISGLGIQ

SEQ ID NO: 113402 - protein, 13 aa, Borrelia garinii PBi
IRSLIISGLGIQI

SEQ ID NO: 113403 - protein, 13 aa, Borrelia garinii PBi
RSLIISGLGIQIS

SEQ ID NO: 113404 - protein, 13 aa, Borrelia garinii PBi
SLIISGLGIQISL

SEQ ID NO: 113405 - protein, 13 aa, Borrelia garinii PBi
LIISGLGIQISLE

SEQ ID NO: 113406 - protein, 13 aa, Borrelia garinii PBi
IISGLGIQISLES

SEQ ID NO: 113407 - protein, 13 aa, Borrelia garinii PBi
ISGLGIQISLEST

SEQ ID NO: 113408 - protein, 13 aa, Borrelia garinii PBi
SGLGIQISLESTL

SEQ ID NO: 113409 - protein, 13 aa, Borrelia garinii PBi
GLGIQISLESTLE

SEQ ID NO: 113410 - protein, 13 aa, Borrelia garinii PBi
LGIQISLESTLEE

SEQ ID NO: 113411 - protein, 13 aa, Borrelia garinii PBi
GIQISLESTLEEI

SEQ ID NO: 113412 - protein, 13 aa, Borrelia garinii PBi
IQISLESTLEEIE

SEQ ID NO: 113413 - protein, 13 aa, Borrelia garinii PBi
QISLESTLEEIEK

SEQ ID NO: 113414 - protein, 13 aa, Borrelia garinii PBi
ISLESTLEEIEKK

SEQ ID NO: 113415 - protein, 13 aa, Borrelia garinii PBi
SLESTLEEIEKKI

SEQ ID NO: 113416 - protein, 13 aa, Borrelia garinii PBi
LESTLEEIEKKIE

SEQ ID NO: 113417 - protein, 13 aa, Borrelia garinii PBi
ESTLEEIEKKIES

SEQ ID NO: 113418 - protein, 13 aa, Borrelia garinii PBi
STLEEIEKKIESF

SEQ ID NO: 113419 - protein, 13 aa, Borrelia garinii PBi
TLEEIEKKIESFN

SEQ ID NO: 113420 - protein, 13 aa, Borrelia garinii PBi
LEEIEKKIESFNT

SEQ ID NO: 113421 - protein, 13 aa, Borrelia garinii PBi
EEIEKKIESFNTQ

SEQ ID NO: 113422 - protein, 13 aa, Borrelia garinii PBi
EIEKKIESFNTQY

SEQ ID NO: 113423 - protein, 13 aa, Borrelia garinii PBi
IEKKIESFNTQYL

SEQ ID NO: 113424 - protein, 13 aa, Borrelia garinii PBi
EKKIESFNTQYLN

SEQ ID NO: 113425 - protein, 13 aa, Borrelia garinii PBi
KKIESFNTQYLNT

SEQ ID NO: 113426 - protein, 13 aa, Borrelia garinii PBi
KIESFNTQYLNTI

SEQ ID NO: 113427 - protein, 13 aa, Borrelia garinii PBi
IESFNTQYLNTII

SEQ ID NO: 113428 - protein, 13 aa, Borrelia garinii PBi
ESFNTQYLNTIIN

SEQ ID NO: 113429 - protein, 13 aa, Borrelia garinii PBi
SFNTQYLNTIINS

SEQ ID NO: 113430 - protein, 13 aa, Borrelia garinii PBi
FNTQYLNTIINSY

SEQ ID NO: 113431 - protein, 13 aa, Borrelia garinii PBi
NTQYLNTIINSYT

SEQ ID NO: 113432 - protein, 13 aa, Borrelia garinii PBi
TQYLNTIINSYTF

SEQ ID NO: 113433 - protein, 13 aa, Borrelia garinii PBi
QYLNTIINSYTFK

SEQ ID NO: 113434 - protein, 13 aa, Borrelia garinii PBi
YLNTIINSYTFKD

SEQ ID NO: 113435 - protein, 13 aa, Borrelia garinii PBi
LNTIINSYTFKDK

SEQ ID NO: 113436 - protein, 13 aa, Borrelia garinii PBi
NTIINSYTFKDKL

SEQ ID NO: 113437 - protein, 13 aa, Borrelia garinii PBi
TIINSYTFKDKLK

SEQ ID NO: 113438 - protein, 13 aa, Borrelia garinii PBi
IINSYTFKDKLKE

SEQ ID NO: 113439 - protein, 13 aa, Borrelia garinii PBi
INSYTFKDKLKEL

SEQ ID NO: 113440 - protein, 13 aa, Borrelia garinii PBi
NSYTFKDKLKELE

SEQ ID NO: 113441 - protein, 13 aa, Borrelia garinii PBi
SYTFKDKLKELES

SEQ ID NO: 113442 - protein, 13 aa, Borrelia garinii PBi
YTFKDKLKELESK

SEQ ID NO: 113443 - protein, 13 aa, Borrelia garinii PBi
TFKDKLKELESKL

SEQ ID NO: 113444 - protein, 13 aa, Borrelia garinii PBi
FKDKLKELESKLN

SEQ ID NO: 113445 - protein, 13 aa, Borrelia garinii PBi
KDKLKELESKLNS

SEQ ID NO: 113446 - protein, 13 aa, Borrelia garinii PBi
DKLKELESKLNSI

SEQ ID NO: 113447 - protein, 13 aa, Borrelia garinii PBi
KLKELESKLNSIL

SEQ ID NO: 113448 - protein, 13 aa, Borrelia garinii PBi
LKELESKLNSILA

SEQ ID NO: 113449 - protein, 13 aa, Borrelia garinii PBi
KELESKLNSILAE

SEQ ID NO: 113450 - protein, 13 aa, Borrelia garinii PBi
ELESKLNSILAEK

SEQ ID NO: 113451 - protein, 13 aa, Borrelia garinii PBi
LESKLNSILAEKK

SEQ ID NO: 113452 - protein, 13 aa, Borrelia garinii PBi
ESKLNSILAEKKE

SEQ ID NO: 113453 - protein, 13 aa, Borrelia garinii PBi
SKLNSILAEKKEW

SEQ ID NO: 113454 - protein, 13 aa, Borrelia garinii PBi
KLNSILAEKKEWL

SEQ ID NO: 113455 - protein, 13 aa, Borrelia garinii PBi
LNSILAEKKEWLN

SEQ ID NO: 113456 - protein, 13 aa, Borrelia garinii PBi
NSILAEKKEWLNY

SEQ ID NO: 113457 - protein, 13 aa, Borrelia garinii PBi
SILAEKKEWLNYA

SEQ ID NO: 113458 - protein, 13 aa, Borrelia garinii PBi
ILAEKKEWLNYAD

SEQ ID NO: 113459 - protein, 13 aa, Borrelia garinii PBi
LAEKKEWLNYADA

SEQ ID NO: 113460 - protein, 13 aa, Borrelia garinii PBi
AEKKEWLNYADAI

SEQ ID NO: 113461 - protein, 13 aa, Borrelia garinii PBi
EKKEWLNYADAII

SEQ ID NO: 113462 - protein, 13 aa, Borrelia garinii PBi
KKEWLNYADAIIT

SEQ ID NO: 113463 - protein, 13 aa, Borrelia garinii PBi
KEWLNYADAIITN

SEQ ID NO: 113464 - protein, 13 aa, Borrelia garinii PBi
EWLNYADAIITNT

SEQ ID NO: 113465 - protein, 13 aa, Borrelia garinii PBi
WLNYADAIITNTS

SEQ ID NO: 113466 - protein, 13 aa, Borrelia garinii PBi
LNYADAIITNTSS

SEQ ID NO: 113467 - protein, 13 aa, Borrelia garinii PBi
NYADAIITNTSSN

SEQ ID NO: 113468 - protein, 13 aa, Borrelia garinii PBi
YADAIITNTSSNS

SEQ ID NO: 113469 - protein, 13 aa, Borrelia garinii PBi
ADAIITNTSSNSK

SEQ ID NO: 113470 - protein, 13 aa, Borrelia garinii PBi
DAIITNTSSNSKR

SEQ ID NO: 113471 - protein, 13 aa, Borrelia garinii PBi
AIITNTSSNSKRN

SEQ ID NO: 113472 - protein, 13 aa, Borrelia garinii PBi
IITNTSSNSKRND

SEQ ID NO: 113473 - protein, 13 aa, Borrelia garinii PBi
ITNTSSNSKRNDP

SEQ ID NO: 113474 - protein, 13 aa, Borrelia garinii PBi
TNTSSNSKRNDPQ

SEQ ID NO: 113475 - protein, 13 aa, Borrelia garinii PBi
NTSSNSKRNDPQS

SEQ ID NO: 113476 - protein, 13 aa, Borrelia garinii PBi
TSSNSKRNDPQSL

SEQ ID NO: 113477 - protein, 13 aa, Borrelia garinii PBi
SSNSKRNDPQSLG

SEQ ID NO: 113478 - protein, 13 aa, Borrelia garinii PBi
SNSKRNDPQSLGQ

SEQ ID NO: 113479 - protein, 13 aa, Borrelia garinii PBi
NSKRNDPQSLGQY

SEQ ID NO: 113480 - protein, 13 aa, Borrelia garinii PBi
SKRNDPQSLGQYI

SEQ ID NO: 113481 - protein, 13 aa, Borrelia garinii PBi
KRNDPQSLGQYIK

SEQ ID NO: 113482 - protein, 13 aa, Borrelia garinii PBi
RNDPQSLGQYIKN

SEQ ID NO: 113483 - protein, 13 aa, Borrelia garinii PBi
NDPQSLGQYIKNK

SEQ ID NO: 113484 - protein, 13 aa, Borrelia garinii PBi
DPQSLGQYIKNKY

SEQ ID NO: 113485 - protein, 13 aa, Borrelia garinii PBi
PQSLGQYIKNKYL

SEQ ID NO: 113486 - protein, 13 aa, Borrelia garinii PBi
QSLGQYIKNKYLD

SEQ ID NO: 113487 - protein, 13 aa, Borrelia garinii PBi
SLGQYIKNKYLDK

SEQ ID NO: 113488 - protein, 13 aa, Borrelia garinii PBi
LGQYIKNKYLDKM

SEQ ID NO: 113489 - protein, 13 aa, Borrelia garinii PBi
GQYIKNKYLDKMQ

SEQ ID NO: 113490 - protein, 13 aa, Borrelia garinii PBi
QYIKNKYLDKMQD

SEQ ID NO: 113491 - protein, 13 aa, Borrelia garinii PBi
YIKNKYLDKMQDA

SEQ ID NO: 113492 - protein, 13 aa, Borrelia garinii PBi
IKNKYLDKMQDAR

SEQ ID NO: 113493 - protein, 13 aa, Borrelia garinii PBi
KNKYLDKMQDARQ

SEQ ID NO: 113494 - protein, 13 aa, Borrelia garinii PBi
NKYLDKMQDARQS

SEQ ID NO: 113495 - protein, 13 aa, Borrelia garinii PBi
KYLDKMQDARQSA

SEQ ID NO: 113496 - protein, 13 aa, Borrelia garinii PBi
YLDKMQDARQSAL

SEQ ID NO: 113497 - protein, 13 aa, Borrelia garinii PBi
LDKMQDARQSALD

SEQ ID NO: 113498 - protein, 13 aa, Borrelia garinii PBi
DKMQDARQSALDL

SEQ ID NO: 113499 - protein, 13 aa, Borrelia garinii PBi
KMQDARQSALDLY

SEQ ID NO: 113500 - protein, 13 aa, Borrelia garinii PBi
MQDARQSALDLYL

SEQ ID NO: 113501 - protein, 13 aa, Borrelia garinii PBi
QDARQSALDLYLN

SEQ ID NO: 113502 - protein, 13 aa, Borrelia garinii PBi
DARQSALDLYLNI

SEQ ID NO: 113503 - protein, 13 aa, Borrelia garinii PBi
ARQSALDLYLNIT

SEQ ID NO: 113504 - protein, 13 aa, Borrelia garinii PBi
RQSALDLYLNITE

SEQ ID NO: 113505 - protein, 13 aa, Borrelia garinii PBi
QSALDLYLNITEI

SEQ ID NO: 113506 - protein, 13 aa, Borrelia garinii PBi
SALDLYLNITEIR

SEQ ID NO: 113507 - protein, 14 aa, Borrelia garinii PBi
MSSCTIDANLNKDY

SEQ ID NO: 113508 - protein, 14 aa, Borrelia garinii PBi
SSCTIDANLNKDYK

SEQ ID NO: 113509 - protein, 14 aa, Borrelia garinii PBi
SCTIDANLNKDYKN

SEQ ID NO: 113510 - protein, 14 aa, Borrelia garinii PBi
CTIDANLNKDYKNK

SEQ ID NO: 113511 - protein, 14 aa, Borrelia garinii PBi
TIDANLNKDYKNKV

SEQ ID NO: 113512 - protein, 14 aa, Borrelia garinii PBi
IDANLNKDYKNKVE

SEQ ID NO: 113513 - protein, 14 aa, Borrelia garinii PBi
DANLNKDYKNKVEE

SEQ ID NO: 113514 - protein, 14 aa, Borrelia garinii PBi
ANLNKDYKNKVEEL

SEQ ID NO: 113515 - protein, 14 aa, Borrelia garinii PBi
NLNKDYKNKVEELL

SEQ ID NO: 113516 - protein, 14 aa, Borrelia garinii PBi
LNKDYKNKVEELLN

SEQ ID NO: 113517 - protein, 14 aa, Borrelia garinii PBi
NKDYKNKVEELLNS

SEQ ID NO: 113518 - protein, 14 aa, Borrelia garinii PBi
KDYKNKVEELLNSS

SEQ ID NO: 113519 - protein, 14 aa, Borrelia garinii PBi
DYKNKVEELLNSST

SEQ ID NO: 113520 - protein, 14 aa, Borrelia garinii PBi
YKNKVEELLNSSTD

SEQ ID NO: 113521 - protein, 14 aa, Borrelia garinii PBi
KNKVEELLNSSTDD

SEQ ID NO: 113522 - protein, 14 aa, Borrelia garinii PBi
NKVEELLNSSTDDQ

SEQ ID NO: 113523 - protein, 14 aa, Borrelia garinii PBi
KVEELLNSSTDDQA

SEQ ID NO: 113524 - protein, 14 aa, Borrelia garinii PBi
VEELLNSSTDDQAK

SEQ ID NO: 113525 - protein, 14 aa, Borrelia garinii PBi
EELLNSSTDDQAKI

SEQ ID NO: 113526 - protein, 14 aa, Borrelia garinii PBi
ELLNSSTDDQAKIS

SEQ ID NO: 113527 - protein, 14 aa, Borrelia garinii PBi
LLNSSTDDQAKISI

SEQ ID NO: 113528 - protein, 14 aa, Borrelia garinii PBi
LNSSTDDQAKISIN

SEQ ID NO: 113529 - protein, 14 aa, Borrelia garinii PBi
NSSTDDQAKISINT

SEQ ID NO: 113530 - protein, 14 aa, Borrelia garinii PBi
SSTDDQAKISINTG

SEQ ID NO: 113531 - protein, 14 aa, Borrelia garinii PBi
STDDQAKISINTGS

SEQ ID NO: 113532 - protein, 14 aa, Borrelia garinii PBi
TDDQAKISINTGSN

SEQ ID NO: 113533 - protein, 14 aa, Borrelia garinii PBi
DDQAKISINTGSNA

SEQ ID NO: 113534 - protein, 14 aa, Borrelia garinii PBi
DQAKISINTGSNAT

SEQ ID NO: 113535 - protein, 14 aa, Borrelia garinii PBi
QAKISINTGSNATK

SEQ ID NO: 113536 - protein, 14 aa, Borrelia garinii PBi
AKISINTGSNATKN

SEQ ID NO: 113537 - protein, 14 aa, Borrelia garinii PBi
KISINTGSNATKNK

SEQ ID NO: 113538 - protein, 14 aa, Borrelia garinii PBi
ISINTGSNATKNKT

SEQ ID NO: 113539 - protein, 14 aa, Borrelia garinii PBi
SINTGSNATKNKTN

SEQ ID NO: 113540 - protein, 14 aa, Borrelia garinii PBi
INTGSNATKNKTNI

SEQ ID NO: 113541 - protein, 14 aa, Borrelia garinii PBi
NTGSNATKNKTNIK

SEQ ID NO: 113542 - protein, 14 aa, Borrelia garinii PBi
TGSNATKNKTNIKV

SEQ ID NO: 113543 - protein, 14 aa, Borrelia garinii PBi
GSNATKNKTNIKVA

SEQ ID NO: 113544 - protein, 14 aa, Borrelia garinii PBi
SNATKNKTNIKVAG

SEQ ID NO: 113545 - protein, 14 aa, Borrelia garinii PBi
NATKNKTNIKVAGL

SEQ ID NO: 113546 - protein, 14 aa, Borrelia garinii PBi
ATKNKTNIKVAGLQ

SEQ ID NO: 113547 - protein, 14 aa, Borrelia garinii PBi
TKNKTNIKVAGLQK

SEQ ID NO: 113548 - protein, 14 aa, Borrelia garinii PBi
KNKTNIKVAGLQKN

SEQ ID NO: 113549 - protein, 14 aa, Borrelia garinii PBi
NKTNIKVAGLQKNT

SEQ ID NO: 113550 - protein, 14 aa, Borrelia garinii PBi
KTNIKVAGLQKNTQ

SEQ ID NO: 113551 - protein, 14 aa, Borrelia garinii PBi
TNIKVAGLQKNTQS

SEQ ID NO: 113552 - protein, 14 aa, Borrelia garinii PBi
NIKVAGLQKNTQSK

SEQ ID NO: 113553 - protein, 14 aa, Borrelia garinii PBi
IKVAGLQKNTQSKK

SEQ ID NO: 113554 - protein, 14 aa, Borrelia garinii PBi
KVAGLQKNTQSKKN

SEQ ID NO: 113555 - protein, 14 aa, Borrelia garinii PBi
VAGLQKNTQSKKNN

SEQ ID NO: 113556 - protein, 14 aa, Borrelia garinii PBi
AGLQKNTQSKKNNN

SEQ ID NO: 113557 - protein, 14 aa, Borrelia garinii PBi
GLQKNTQSKKNNNL

SEQ ID NO: 113558 - protein, 14 aa, Borrelia garinii PBi
LQKNTQSKKNNNLQ

SEQ ID NO: 113559 - protein, 14 aa, Borrelia garinii PBi
QKNTQSKKNNNLQG

SEQ ID NO: 113560 - protein, 14 aa, Borrelia garinii PBi
KNTQSKKNNNLQGL

SEQ ID NO: 113561 - protein, 14 aa, Borrelia garinii PBi
NTQSKKNNNLQGLN

SEQ ID NO: 113562 - protein, 14 aa, Borrelia garinii PBi
TQSKKNNNLQGLNP

SEQ ID NO: 113563 - protein, 14 aa, Borrelia garinii PBi
QSKKNNNLQGLNPA

SEQ ID NO: 113564 - protein, 14 aa, Borrelia garinii PBi
SKKNNNLQGLNPAN

SEQ ID NO: 113565 - protein, 14 aa, Borrelia garinii PBi
KKNNNLQGLNPANQ

SEQ ID NO: 113566 - protein, 14 aa, Borrelia garinii PBi
KNNNLQGLNPANQV

SEQ ID NO: 113567 - protein, 14 aa, Borrelia garinii PBi
NNNLQGLNPANQVN

SEQ ID NO: 113568 - protein, 14 aa, Borrelia garinii PBi
NNLQGLNPANQVNP

SEQ ID NO: 113569 - protein, 14 aa, Borrelia garinii PBi
NLQGLNPANQVNPG

SEQ ID NO: 113570 - protein, 14 aa, Borrelia garinii PBi
LQGLNPANQVNPGN

SEQ ID NO: 113571 - protein, 14 aa, Borrelia garinii PBi
QGLNPANQVNPGNP

SEQ ID NO: 113572 - protein, 14 aa, Borrelia garinii PBi
GLNPANQVNPGNPM

SEQ ID NO: 113573 - protein, 14 aa, Borrelia garinii PBi
LNPANQVNPGNPMQ

SEQ ID NO: 113574 - protein, 14 aa, Borrelia garinii PBi
NPANQVNPGNPMQI

SEQ ID NO: 113575 - protein, 14 aa, Borrelia garinii PBi
PANQVNPGNPMQIA

SEQ ID NO: 113576 - protein, 14 aa, Borrelia garinii PBi
ANQVNPGNPMQIAN

SEQ ID NO: 113577 - protein, 14 aa, Borrelia garinii PBi
NQVNPGNPMQIANQ

SEQ ID NO: 113578 - protein, 14 aa, Borrelia garinii PBi
QVNPGNPMQIANQA

SEQ ID NO: 113579 - protein, 14 aa, Borrelia garinii PBi
VNPGNPMQIANQAN

SEQ ID NO: 113580 - protein, 14 aa, Borrelia garinii PBi
NPGNPMQIANQANQ

SEQ ID NO: 113581 - protein, 14 aa, Borrelia garinii PBi
PGNPMQIANQANQA

SEQ ID NO: 113582 - protein, 14 aa, Borrelia garinii PBi
GNPMQIANQANQAN

SEQ ID NO: 113583 - protein, 14 aa, Borrelia garinii PBi
NPMQIANQANQANQ

SEQ ID NO: 113584 - protein, 14 aa, Borrelia garinii PBi
PMQIANQANQANQA

SEQ ID NO: 113585 - protein, 14 aa, Borrelia garinii PBi
MQIANQANQANQAN

SEQ ID NO: 113586 - protein, 14 aa, Borrelia garinii PBi
QIANQANQANQANQ

SEQ ID NO: 113587 - protein, 14 aa, Borrelia garinii PBi
IANQANQANQANQA

SEQ ID NO: 113588 - protein, 14 aa, Borrelia garinii PBi
ANQANQANQANQAN

SEQ ID NO: 113589 - protein, 14 aa, Borrelia garinii PBi
NQANQANQANQANQ

SEQ ID NO: 113590 - protein, 14 aa, Borrelia garinii PBi
QANQANQANQANQA

SEQ ID NO: 113591 - protein, 14 aa, Borrelia garinii PBi
ANQANQANQANQAN

SEQ ID NO: 113592 - protein, 14 aa, Borrelia garinii PBi
NQANQANQANQANQ

SEQ ID NO: 113593 - protein, 14 aa, Borrelia garinii PBi
QANQANQANQANQA

SEQ ID NO: 113594 - protein, 14 aa, Borrelia garinii PBi
ANQANQANQANQAS

SEQ ID NO: 113595 - protein, 14 aa, Borrelia garinii PBi
NQANQANQANQASQ

SEQ ID NO: 113596 - protein, 14 aa, Borrelia garinii PBi
QANQANQANQASQA

SEQ ID NO: 113597 - protein, 14 aa, Borrelia garinii PBi
ANQANQANQASQAS

SEQ ID NO: 113598 - protein, 14 aa, Borrelia garinii PBi
NQANQANQASQASQ

SEQ ID NO: 113599 - protein, 14 aa, Borrelia garinii PBi
QANQANQASQASQA

SEQ ID NO: 113600 - protein, 14 aa, Borrelia garinii PBi
ANQANQASQASQAS

SEQ ID NO: 113601 - protein, 14 aa, Borrelia garinii PBi
NQANQASQASQASQ

SEQ ID NO: 113602 - protein, 14 aa, Borrelia garinii PBi
QANQASQASQASQV

SEQ ID NO: 113603 - protein, 14 aa, Borrelia garinii PBi
ANQASQASQASQVA

SEQ ID NO: 113604 - protein, 14 aa, Borrelia garinii PBi
NQASQASQASQVAS

SEQ ID NO: 113605 - protein, 14 aa, Borrelia garinii PBi
QASQASQASQVASS

SEQ ID NO: 113606 - protein, 14 aa, Borrelia garinii PBi
ASQASQASQVASSA

SEQ ID NO: 113607 - protein, 14 aa, Borrelia garinii PBi
SQASQASQVASSAS

SEQ ID NO: 113608 - protein, 14 aa, Borrelia garinii PBi
QASQASQVASSASQ

SEQ ID NO: 113609 - protein, 14 aa, Borrelia garinii PBi
ASQASQVASSASQA

SEQ ID NO: 113610 - protein, 14 aa, Borrelia garinii PBi
SQASQVASSASQAS

SEQ ID NO: 113611 - protein, 14 aa, Borrelia garinii PBi
QASQVASSASQASP

SEQ ID NO: 113612 - protein, 14 aa, Borrelia garinii PBi
ASQVASSASQASPV

SEQ ID NO: 113613 - protein, 14 aa, Borrelia garinii PBi
SQVASSASQASPVA

SEQ ID NO: 113614 - protein, 14 aa, Borrelia garinii PBi
QVASSASQASPVAS

SEQ ID NO: 113615 - protein, 14 aa, Borrelia garinii PBi
VASSASQASPVASP

SEQ ID NO: 113616 - protein, 14 aa, Borrelia garinii PBi
ASSASQASPVASPA

SEQ ID NO: 113617 - protein, 14 aa, Borrelia garinii PBi
SSASQASPVASPAT

SEQ ID NO: 113618 - protein, 14 aa, Borrelia garinii PBi
SASQASPVASPATN

SEQ ID NO: 113619 - protein, 14 aa, Borrelia garinii PBi
ASQASPVASPATNV

SEQ ID NO: 113620 - protein, 14 aa, Borrelia garinii PBi
SQASPVASPATNVQ

SEQ ID NO: 113621 - protein, 14 aa, Borrelia garinii PBi
QASPVASPATNVQA

SEQ ID NO: 113622 - protein, 14 aa, Borrelia garinii PBi
ASPVASPATNVQAT

SEQ ID NO: 113623 - protein, 14 aa, Borrelia garinii PBi
SPVASPATNVQATP

SEQ ID NO: 113624 - protein, 14 aa, Borrelia garinii PBi
PVASPATNVQATPP

SEQ ID NO: 113625 - protein, 14 aa, Borrelia garinii PBi
VASPATNVQATPPK

SEQ ID NO: 113626 - protein, 14 aa, Borrelia garinii PBi
ASPATNVQATPPKQ

SEQ ID NO: 113627 - protein, 14 aa, Borrelia garinii PBi
SPATNVQATPPKQI

SEQ ID NO: 113628 - protein, 14 aa, Borrelia garinii PBi
PATNVQATPPKQIA

SEQ ID NO: 113629 - protein, 14 aa, Borrelia garinii PBi
ATNVQATPPKQIAS

SEQ ID NO: 113630 - protein, 14 aa, Borrelia garinii PBi
TNVQATPPKQIASA

SEQ ID NO: 113631 - protein, 14 aa, Borrelia garinii PBi
NVQATPPKQIASAQ

SEQ ID NO: 113632 - protein, 14 aa, Borrelia garinii PBi
VQATPPKQIASAQA

SEQ ID NO: 113633 - protein, 14 aa, Borrelia garinii PBi
QATPPKQIASAQAI

SEQ ID NO: 113634 - protein, 14 aa, Borrelia garinii PBi
ATPPKQIASAQAIQ

SEQ ID NO: 113635 - protein, 14 aa, Borrelia garinii PBi
TPPKQIASAQAIQT

SEQ ID NO: 113636 - protein, 14 aa, Borrelia garinii PBi
PPKQIASAQAIQTV

SEQ ID NO: 113637 - protein, 14 aa, Borrelia garinii PBi
PKQIASAQAIQTVP

SEQ ID NO: 113638 - protein, 14 aa, Borrelia garinii PBi
KQIASAQAIQTVPN

SEQ ID NO: 113639 - protein, 14 aa, Borrelia garinii PBi
QIASAQAIQTVPNN

SEQ ID NO: 113640 - protein, 14 aa, Borrelia garinii PBi
IASAQAIQTVPNNT

SEQ ID NO: 113641 - protein, 14 aa, Borrelia garinii PBi
ASAQAIQTVPNNTS

SEQ ID NO: 113642 - protein, 14 aa, Borrelia garinii PBi
SAQAIQTVPNNTST

SEQ ID NO: 113643 - protein, 14 aa, Borrelia garinii PBi
AQAIQTVPNNTSTP

SEQ ID NO: 113644 - protein, 14 aa, Borrelia garinii PBi
QAIQTVPNNTSTPN

SEQ ID NO: 113645 - protein, 14 aa, Borrelia garinii PBi
AIQTVPNNTSTPNQ

SEQ ID NO: 113646 - protein, 14 aa, Borrelia garinii PBi
IQTVPNNTSTPNQS

SEQ ID NO: 113647 - protein, 14 aa, Borrelia garinii PBi
QTVPNNTSTPNQSI

SEQ ID NO: 113648 - protein, 14 aa, Borrelia garinii PBi
TVPNNTSTPNQSII

SEQ ID NO: 113649 - protein, 14 aa, Borrelia garinii PBi
VPNNTSTPNQSIIK

SEQ ID NO: 113650 - protein, 14 aa, Borrelia garinii PBi
PNNTSTPNQSIIKP

SEQ ID NO: 113651 - protein, 14 aa, Borrelia garinii PBi
NNTSTPNQSIIKPQ

SEQ ID NO: 113652 - protein, 14 aa, Borrelia garinii PBi
NTSTPNQSIIKPQQ

SEQ ID NO: 113653 - protein, 14 aa, Borrelia garinii PBi
TSTPNQSIIKPQQY

SEQ ID NO: 113654 - protein, 14 aa, Borrelia garinii PBi
STPNQSIIKPQQYT

SEQ ID NO: 113655 - protein, 14 aa, Borrelia garinii PBi
TPNQSIIKPQQYTF

SEQ ID NO: 113656 - protein, 14 aa, Borrelia garinii PBi
PNQSIIKPQQYTFS

SEQ ID NO: 113657 - protein, 14 aa, Borrelia garinii PBi
NQSIIKPQQYTFSS

SEQ ID NO: 113658 - protein, 14 aa, Borrelia garinii PBi
QSIIKPQQYTFSSS

SEQ ID NO: 113659 - protein, 14 aa, Borrelia garinii PBi
SIIKPQQYTFSSSF

SEQ ID NO: 113660 - protein, 14 aa, Borrelia garinii PBi
IIKPQQYTFSSSFS

SEQ ID NO: 113661 - protein, 14 aa, Borrelia garinii PBi
IKPQQYTFSSSFSQ

SEQ ID NO: 113662 - protein, 14 aa, Borrelia garinii PBi
KPQQYTFSSSFSQP

SEQ ID NO: 113663 - protein, 14 aa, Borrelia garinii PBi
PQQYTFSSSFSQPT

SEQ ID NO: 113664 - protein, 14 aa, Borrelia garinii PBi
QQYTFSSSFSQPTS

SEQ ID NO: 113665 - protein, 14 aa, Borrelia garinii PBi
QYTFSSSFSQPTSQ

SEQ ID NO: 113666 - protein, 14 aa, Borrelia garinii PBi
YTFSSSFSQPTSQT

SEQ ID NO: 113667 - protein, 14 aa, Borrelia garinii PBi
TFSSSFSQPTSQTN

SEQ ID NO: 113668 - protein, 14 aa, Borrelia garinii PBi
FSSSFSQPTSQTNF

SEQ ID NO: 113669 - protein, 14 aa, Borrelia garinii PBi
SSSFSQPTSQTNFN

SEQ ID NO: 113670 - protein, 14 aa, Borrelia garinii PBi
SSFSQPTSQTNFNN

SEQ ID NO: 113671 - protein, 14 aa, Borrelia garinii PBi
SFSQPTSQTNFNNS

SEQ ID NO: 113672 - protein, 14 aa, Borrelia garinii PBi
FSQPTSQTNFNNSQ

SEQ ID NO: 113673 - protein, 14 aa, Borrelia garinii PBi
SQPTSQTNFNNSQS

SEQ ID NO: 113674 - protein, 14 aa, Borrelia garinii PBi
QPTSQTNFNNSQSN

SEQ ID NO: 113675 - protein, 14 aa, Borrelia garinii PBi
PTSQTNFNNSQSNN

SEQ ID NO: 113676 - protein, 14 aa, Borrelia garinii PBi
TSQTNFNNSQSNNV

SEQ ID NO: 113677 - protein, 14 aa, Borrelia garinii PBi
SQTNFNNSQSNNVL

SEQ ID NO: 113678 - protein, 14 aa, Borrelia garinii PBi
QTNFNNSQSNNVLT

SEQ ID NO: 113679 - protein, 14 aa, Borrelia garinii PBi
TNFNNSQSNNVLTN

SEQ ID NO: 113680 - protein, 14 aa, Borrelia garinii PBi
NFNNSQSNNVLTNY

SEQ ID NO: 113681 - protein, 14 aa, Borrelia garinii PBi
FNNSQSNNVLTNYR

SEQ ID NO: 113682 - protein, 14 aa, Borrelia garinii PBi
NNSQSNNVLTNYRH

SEQ ID NO: 113683 - protein, 14 aa, Borrelia garinii PBi
NSQSNNVLTNYRHQ

SEQ ID NO: 113684 - protein, 14 aa, Borrelia garinii PBi
SQSNNVLTNYRHQT

SEQ ID NO: 113685 - protein, 14 aa, Borrelia garinii PBi
QSNNVLTNYRHQTQ

SEQ ID NO: 113686 - protein, 14 aa, Borrelia garinii PBi
SNNVLTNYRHQTQP

SEQ ID NO: 113687 - protein, 14 aa, Borrelia garinii PBi
NNVLTNYRHQTQPS

SEQ ID NO: 113688 - protein, 14 aa, Borrelia garinii PBi
NVLTNYRHQTQPSF

SEQ ID NO: 113689 - protein, 14 aa, Borrelia garinii PBi
VLTNYRHQTQPSFV

SEQ ID NO: 113690 - protein, 14 aa, Borrelia garinii PBi
LTNYRHQTQPSFVV

SEQ ID NO: 113691 - protein, 14 aa, Borrelia garinii PBi
TNYRHQTQPSFVVP

SEQ ID NO: 113692 - protein, 14 aa, Borrelia garinii PBi
NYRHQTQPSFVVPV

SEQ ID NO: 113693 - protein, 14 aa, Borrelia garinii PBi
YRHQTQPSFVVPVY

SEQ ID NO: 113694 - protein, 14 aa, Borrelia garinii PBi
RHQTQPSFVVPVYS

SEQ ID NO: 113695 - protein, 14 aa, Borrelia garinii PBi
HQTQPSFVVPVYSG

SEQ ID NO: 113696 - protein, 14 aa, Borrelia garinii PBi
QTQPSFVVPVYSGN

SEQ ID NO: 113697 - protein, 14 aa, Borrelia garinii PBi
TQPSFVVPVYSGNS

SEQ ID NO: 113698 - protein, 14 aa, Borrelia garinii PBi
QPSFVVPVYSGNSP

SEQ ID NO: 113699 - protein, 14 aa, Borrelia garinii PBi
PSFVVPVYSGNSPL

SEQ ID NO: 113700 - protein, 14 aa, Borrelia garinii PBi
SFVVPVYSGNSPLQ

SEQ ID NO: 113701 - protein, 14 aa, Borrelia garinii PBi
FVVPVYSGNSPLQK

SEQ ID NO: 113702 - protein, 14 aa, Borrelia garinii PBi
VVPVYSGNSPLQKL

SEQ ID NO: 113703 - protein, 14 aa, Borrelia garinii PBi
VPVYSGNSPLQKLK

SEQ ID NO: 113704 - protein, 14 aa, Borrelia garinii PBi
PVYSGNSPLQKLKN

SEQ ID NO: 113705 - protein, 14 aa, Borrelia garinii PBi
VYSGNSPLQKLKNN

SEQ ID NO: 113706 - protein, 14 aa, Borrelia garinii PBi
YSGNSPLQKLKNNL

SEQ ID NO: 113707 - protein, 14 aa, Borrelia garinii PBi
SGNSPLQKLKNNLL

SEQ ID NO: 113708 - protein, 14 aa, Borrelia garinii PBi
GNSPLQKLKNNLLR

SEQ ID NO: 113709 - protein, 14 aa, Borrelia garinii PBi
NSPLQKLKNNLLRR

SEQ ID NO: 113710 - protein, 14 aa, Borrelia garinii PBi
SPLQKLKNNLLRRI

SEQ ID NO: 113711 - protein, 14 aa, Borrelia garinii PBi
PLQKLKNNLLRRIA

SEQ ID NO: 113712 - protein, 14 aa, Borrelia garinii PBi
LQKLKNNLLRRIAE

SEQ ID NO: 113713 - protein, 14 aa, Borrelia garinii PBi
QKLKNNLLRRIAEE

SEQ ID NO: 113714 - protein, 14 aa, Borrelia garinii PBi
KLKNNLLRRIAEEK

SEQ ID NO: 113715 - protein, 14 aa, Borrelia garinii PBi
LKNNLLRRIAEEKN

SEQ ID NO: 113716 - protein, 14 aa, Borrelia garinii PBi
KNNLLRRIAEEKNK

SEQ ID NO: 113717 - protein, 14 aa, Borrelia garinii PBi
NNLLRRIAEEKNKT

SEQ ID NO: 113718 - protein, 14 aa, Borrelia garinii PBi
NLLRRIAEEKNKTH

SEQ ID NO: 113719 - protein, 14 aa, Borrelia garinii PBi
LLRRIAEEKNKTHN

SEQ ID NO: 113720 - protein, 14 aa, Borrelia garinii PBi
LRRIAEEKNKTHNH

SEQ ID NO: 113721 - protein, 14 aa, Borrelia garinii PBi
RRIAEEKNKTHNHG

SEQ ID NO: 113722 - protein, 14 aa, Borrelia garinii PBi
RIAEEKNKTHNHGF

SEQ ID NO: 113723 - protein, 14 aa, Borrelia garinii PBi
IAEEKNKTHNHGFR

SEQ ID NO: 113724 - protein, 14 aa, Borrelia garinii PBi
AEEKNKTHNHGFRE

SEQ ID NO: 113725 - protein, 14 aa, Borrelia garinii PBi
EEKNKTHNHGFRET

SEQ ID NO: 113726 - protein, 14 aa, Borrelia garinii PBi
EKNKTHNHGFRETY

SEQ ID NO: 113727 - protein, 14 aa, Borrelia garinii PBi
KNKTHNHGFRETYD

SEQ ID NO: 113728 - protein, 14 aa, Borrelia garinii PBi
NKTHNHGFRETYDQ

SEQ ID NO: 113729 - protein, 14 aa, Borrelia garinii PBi
KTHNHGFRETYDQF

SEQ ID NO: 113730 - protein, 14 aa, Borrelia garinii PBi
THNHGFRETYDQFK

SEQ ID NO: 113731 - protein, 14 aa, Borrelia garinii PBi
HNHGFRETYDQFKM

SEQ ID NO: 113732 - protein, 14 aa, Borrelia garinii PBi
NHGFRETYDQFKMK

SEQ ID NO: 113733 - protein, 14 aa, Borrelia garinii PBi
HGFRETYDQFKMKD

SEQ ID NO: 113734 - protein, 14 aa, Borrelia garinii PBi
GFRETYDQFKMKDS

SEQ ID NO: 113735 - protein, 14 aa, Borrelia garinii PBi
FRETYDQFKMKDSA

SEQ ID NO: 113736 - protein, 14 aa, Borrelia garinii PBi
RETYDQFKMKDSAF

SEQ ID NO: 113737 - protein, 14 aa, Borrelia garinii PBi
ETYDQFKMKDSAFT

SEQ ID NO: 113738 - protein, 14 aa, Borrelia garinii PBi
TYDQFKMKDSAFTL

SEQ ID NO: 113739 - protein, 14 aa, Borrelia garinii PBi
YDQFKMKDSAFTLL

SEQ ID NO: 113740 - protein, 14 aa, Borrelia garinii PBi
DQFKMKDSAFTLLD

SEQ ID NO: 113741 - protein, 14 aa, Borrelia garinii PBi
QFKMKDSAFTLLDV

SEQ ID NO: 113742 - protein, 14 aa, Borrelia garinii PBi
FKMKDSAFTLLDVI

SEQ ID NO: 113743 - protein, 14 aa, Borrelia garinii PBi
KMKDSAFTLLDVIS

SEQ ID NO: 113744 - protein, 14 aa, Borrelia garinii PBi
MKDSAFTLLDVISN

SEQ ID NO: 113745 - protein, 14 aa, Borrelia garinii PBi
KDSAFTLLDVISNI

SEQ ID NO: 113746 - protein, 14 aa, Borrelia garinii PBi
DSAFTLLDVISNIS

SEQ ID NO: 113747 - protein, 14 aa, Borrelia garinii PBi
SAFTLLDVISNISV

SEQ ID NO: 113748 - protein, 14 aa, Borrelia garinii PBi
AFTLLDVISNISVF

SEQ ID NO: 113749 - protein, 14 aa, Borrelia garinii PBi
FTLLDVISNISVFD

SEQ ID NO: 113750 - protein, 14 aa, Borrelia garinii PBi
TLLDVISNISVFDR

SEQ ID NO: 113751 - protein, 14 aa, Borrelia garinii PBi
LLDVISNISVFDRG

SEQ ID NO: 113752 - protein, 14 aa, Borrelia garinii PBi
LDVISNISVFDRGS

SEQ ID NO: 113753 - protein, 14 aa, Borrelia garinii PBi
DVISNISVFDRGSA

SEQ ID NO: 113754 - protein, 14 aa, Borrelia garinii PBi
VISNISVFDRGSAP

SEQ ID NO: 113755 - protein, 14 aa, Borrelia garinii PBi
ISNISVFDRGSAPQ

SEQ ID NO: 113756 - protein, 14 aa, Borrelia garinii PBi
SNISVFDRGSAPQL

SEQ ID NO: 113757 - protein, 14 aa, Borrelia garinii PBi
NISVFDRGSAPQLS

SEQ ID NO: 113758 - protein, 14 aa, Borrelia garinii PBi
ISVFDRGSAPQLSS

SEQ ID NO: 113759 - protein, 14 aa, Borrelia garinii PBi
SVFDRGSAPQLSSN

SEQ ID NO: 113760 - protein, 14 aa, Borrelia garinii PBi
VFDRGSAPQLSSNT

SEQ ID NO: 113761 - protein, 14 aa, Borrelia garinii PBi
FDRGSAPQLSSNTP

SEQ ID NO: 113762 - protein, 14 aa, Borrelia garinii PBi
DRGSAPQLSSNTPE

SEQ ID NO: 113763 - protein, 14 aa, Borrelia garinii PBi
RGSAPQLSSNTPEA

SEQ ID NO: 113764 - protein, 14 aa, Borrelia garinii PBi
GSAPQLSSNTPEAE

SEQ ID NO: 113765 - protein, 14 aa, Borrelia garinii PBi
SAPQLSSNTPEAES

SEQ ID NO: 113766 - protein, 14 aa, Borrelia garinii PBi
APQLSSNTPEAESE

SEQ ID NO: 113767 - protein, 14 aa, Borrelia garinii PBi
PQLSSNTPEAESER

SEQ ID NO: 113768 - protein, 14 aa, Borrelia garinii PBi
QLSSNTPEAESERN

SEQ ID NO: 113769 - protein, 14 aa, Borrelia garinii PBi
LSSNTPEAESERNR

SEQ ID NO: 113770 - protein, 14 aa, Borrelia garinii PBi
SSNTPEAESERNRL

SEQ ID NO: 113771 - protein, 14 aa, Borrelia garinii PBi
SNTPEAESERNRLY

SEQ ID NO: 113772 - protein, 14 aa, Borrelia garinii PBi
NTPEAESERNRLYA

SEQ ID NO: 113773 - protein, 14 aa, Borrelia garinii PBi
TPEAESERNRLYAM

SEQ ID NO: 113774 - protein, 14 aa, Borrelia garinii PBi
PEAESERNRLYAMM

SEQ ID NO: 113775 - protein, 14 aa, Borrelia garinii PBi
EAESERNRLYAMMD

SEQ ID NO: 113776 - protein, 14 aa, Borrelia garinii PBi
AESERNRLYAMMDF

SEQ ID NO: 113777 - protein, 14 aa, Borrelia garinii PBi
ESERNRLYAMMDFD

SEQ ID NO: 113778 - protein, 14 aa, Borrelia garinii PBi
SERNRLYAMMDFDQ

SEQ ID NO: 113779 - protein, 14 aa, Borrelia garinii PBi
ERNRLYAMMDFDQA

SEQ ID NO: 113780 - protein, 14 aa, Borrelia garinii PBi
RNRLYAMMDFDQAK

SEQ ID NO: 113781 - protein, 14 aa, Borrelia garinii PBi
NRLYAMMDFDQAKT

SEQ ID NO: 113782 - protein, 14 aa, Borrelia garinii PBi
RLYAMMDFDQAKTT

SEQ ID NO: 113783 - protein, 14 aa, Borrelia garinii PBi
LYAMMDFDQAKTTE

SEQ ID NO: 113784 - protein, 14 aa, Borrelia garinii PBi
YAMMDFDQAKTTEF

SEQ ID NO: 113785 - protein, 14 aa, Borrelia garinii PBi
AMMDFDQAKTTEFG

SEQ ID NO: 113786 - protein, 14 aa, Borrelia garinii PBi
MMDFDQAKTTEFGS

SEQ ID NO: 113787 - protein, 14 aa, Borrelia garinii PBi
MDFDQAKTTEFGSI

SEQ ID NO: 113788 - protein, 14 aa, Borrelia garinii PBi
DFDQAKTTEFGSIM

SEQ ID NO: 113789 - protein, 14 aa, Borrelia garinii PBi
FDQAKTTEFGSIMN

SEQ ID NO: 113790 - protein, 14 aa, Borrelia garinii PBi
DQAKTTEFGSIMNI

SEQ ID NO: 113791 - protein, 14 aa, Borrelia garinii PBi
QAKTTEFGSIMNIL

SEQ ID NO: 113792 - protein, 14 aa, Borrelia garinii PBi
AKTTEFGSIMNILY

SEQ ID NO: 113793 - protein, 14 aa, Borrelia garinii PBi
KTTEFGSIMNILYQ

SEQ ID NO: 113794 - protein, 14 aa, Borrelia garinii PBi
TTEFGSIMNILYQE

SEQ ID NO: 113795 - protein, 14 aa, Borrelia garinii PBi
TEFGSIMNILYQEN

SEQ ID NO: 113796 - protein, 14 aa, Borrelia garinii PBi
EFGSIMNILYQENQ

SEQ ID NO: 113797 - protein, 14 aa, Borrelia garinii PBi
FGSIMNILYQENQN

SEQ ID NO: 113798 - protein, 14 aa, Borrelia garinii PBi
GSIMNILYQENQNH

SEQ ID NO: 113799 - protein, 14 aa, Borrelia garinii PBi
SIMNILYQENQNHS

SEQ ID NO: 113800 - protein, 14 aa, Borrelia garinii PBi
IMNILYQENQNHSL

SEQ ID NO: 113801 - protein, 14 aa, Borrelia garinii PBi
MNILYQENQNHSLI

SEQ ID NO: 113802 - protein, 14 aa, Borrelia garinii PBi
NILYQENQNHSLIR

SEQ ID NO: 113803 - protein, 14 aa, Borrelia garinii PBi
ILYQENQNHSLIRS

SEQ ID NO: 113804 - protein, 14 aa, Borrelia garinii PBi
LYQENQNHSLIRSL

SEQ ID NO: 113805 - protein, 14 aa, Borrelia garinii PBi
YQENQNHSLIRSLI

SEQ ID NO: 113806 - protein, 14 aa, Borrelia garinii PBi
QENQNHSLIRSLII

SEQ ID NO: 113807 - protein, 14 aa, Borrelia garinii PBi
ENQNHSLIRSLIIS

SEQ ID NO: 113808 - protein, 14 aa, Borrelia garinii PBi
NQNHSLIRSLIISG

SEQ ID NO: 113809 - protein, 14 aa, Borrelia garinii PBi
QNHSLIRSLIISGL

SEQ ID NO: 113810 - protein, 14 aa, Borrelia garinii PBi
NHSLIRSLIISGLG

SEQ ID NO: 113811 - protein, 14 aa, Borrelia garinii PBi
HSLIRSLIISGLGI

SEQ ID NO: 113812 - protein, 14 aa, Borrelia garinii PBi
SLIRSLIISGLGIQ

SEQ ID NO: 113813 - protein, 14 aa, Borrelia garinii PBi
LIRSLIISGLGIQI

SEQ ID NO: 113814 - protein, 14 aa, Borrelia garinii PBi
IRSLIISGLGIQIS

SEQ ID NO: 113815 - protein, 14 aa, Borrelia garinii PBi
RSLIISGLGIQISL

SEQ ID NO: 113816 - protein, 14 aa, Borrelia garinii PBi
SLIISGLGIQISLE

SEQ ID NO: 113817 - protein, 14 aa, Borrelia garinii PBi
LIISGLGIQISLES

SEQ ID NO: 113818 - protein, 14 aa, Borrelia garinii PBi
IISGLGIQISLEST

SEQ ID NO: 113819 - protein, 14 aa, Borrelia garinii PBi
ISGLGIQISLESTL

SEQ ID NO: 113820 - protein, 14 aa, Borrelia garinii PBi
SGLGIQISLESTLE

SEQ ID NO: 113821 - protein, 14 aa, Borrelia garinii PBi
GLGIQISLESTLEE

SEQ ID NO: 113822 - protein, 14 aa, Borrelia garinii PBi
LGIQISLESTLEEI

SEQ ID NO: 113823 - protein, 14 aa, Borrelia garinii PBi
GIQISLESTLEEIE

SEQ ID NO: 113824 - protein, 14 aa, Borrelia garinii PBi
IQISLESTLEEIEK

SEQ ID NO: 113825 - protein, 14 aa, Borrelia garinii PBi
QISLESTLEEIEKK

SEQ ID NO: 113826 - protein, 14 aa, Borrelia garinii PBi
ISLESTLEEIEKKI

SEQ ID NO: 113827 - protein, 14 aa, Borrelia garinii PBi
SLESTLEEIEKKIE

SEQ ID NO: 113828 - protein, 14 aa, Borrelia garinii PBi
LESTLEEIEKKIES

SEQ ID NO: 113829 - protein, 14 aa, Borrelia garinii PBi
ESTLEEIEKKIESF

SEQ ID NO: 113830 - protein, 14 aa, Borrelia garinii PBi
STLEEIEKKIESFN

SEQ ID NO: 113831 - protein, 14 aa, Borrelia garinii PBi
TLEEIEKKIESFNT

SEQ ID NO: 113832 - protein, 14 aa, Borrelia garinii PBi
LEEIEKKIESFNTQ

SEQ ID NO: 113833 - protein, 14 aa, Borrelia garinii PBi
EEIEKKIESFNTQY

SEQ ID NO: 113834 - protein, 14 aa, Borrelia garinii PBi
EIEKKIESFNTQYL

SEQ ID NO: 113835 - protein, 14 aa, Borrelia garinii PBi
IEKKIESFNTQYLN

SEQ ID NO: 113836 - protein, 14 aa, Borrelia garinii PBi
EKKIESFNTQYLNT

SEQ ID NO: 113837 - protein, 14 aa, Borrelia garinii PBi
KKIESFNTQYLNTI

SEQ ID NO: 113838 - protein, 14 aa, Borrelia garinii PBi
KIESFNTQYLNTII

SEQ ID NO: 113839 - protein, 14 aa, Borrelia garinii PBi
IESFNTQYLNTIIN

SEQ ID NO: 113840 - protein, 14 aa, Borrelia garinii PBi
ESFNTQYLNTIINS

SEQ ID NO: 113841 - protein, 14 aa, Borrelia garinii PBi
SFNTQYLNTIINSY

SEQ ID NO: 113842 - protein, 14 aa, Borrelia garinii PBi
FNTQYLNTIINSYT

SEQ ID NO: 113843 - protein, 14 aa, Borrelia garinii PBi
NTQYLNTIINSYTF

SEQ ID NO: 113844 - protein, 14 aa, Borrelia garinii PBi
TQYLNTIINSYTFK

SEQ ID NO: 113845 - protein, 14 aa, Borrelia garinii PBi
QYLNTIINSYTFKD

SEQ ID NO: 113846 - protein, 14 aa, Borrelia garinii PBi
YLNTIINSYTFKDK

SEQ ID NO: 113847 - protein, 14 aa, Borrelia garinii PBi
LNTIINSYTFKDKL

SEQ ID NO: 113848 - protein, 14 aa, Borrelia garinii PBi
NTIINSYTFKDKLK

SEQ ID NO: 113849 - protein, 14 aa, Borrelia garinii PBi
TIINSYTFKDKLKE

SEQ ID NO: 113850 - protein, 14 aa, Borrelia garinii PBi
IINSYTFKDKLKEL

SEQ ID NO: 113851 - protein, 14 aa, Borrelia garinii PBi
INSYTFKDKLKELE

SEQ ID NO: 113852 - protein, 14 aa, Borrelia garinii PBi
NSYTFKDKLKELES

SEQ ID NO: 113853 - protein, 14 aa, Borrelia garinii PBi
SYTFKDKLKELESK

SEQ ID NO: 113854 - protein, 14 aa, Borrelia garinii PBi
YTFKDKLKELESKL

SEQ ID NO: 113855 - protein, 14 aa, Borrelia garinii PBi
TFKDKLKELESKLN

SEQ ID NO: 113856 - protein, 14 aa, Borrelia garinii PBi
FKDKLKELESKLNS

SEQ ID NO: 113857 - protein, 14 aa, Borrelia garinii PBi
KDKLKELESKLNSI

SEQ ID NO: 113858 - protein, 14 aa, Borrelia garinii PBi
DKLKELESKLNSIL

SEQ ID NO: 113859 - protein, 14 aa, Borrelia garinii PBi
KLKELESKLNSILA

SEQ ID NO: 113860 - protein, 14 aa, Borrelia garinii PBi
LKELESKLNSILAE

SEQ ID NO: 113861 - protein, 14 aa, Borrelia garinii PBi
KELESKLNSILAEK

SEQ ID NO: 113862 - protein, 14 aa, Borrelia garinii PBi
ELESKLNSILAEKK

SEQ ID NO: 113863 - protein, 14 aa, Borrelia garinii PBi
LESKLNSILAEKKE

SEQ ID NO: 113864 - protein, 14 aa, Borrelia garinii PBi
ESKLNSILAEKKEW

SEQ ID NO: 113865 - protein, 14 aa, Borrelia garinii PBi
SKLNSILAEKKEWL

SEQ ID NO: 113866 - protein, 14 aa, Borrelia garinii PBi
KLNSILAEKKEWLN

SEQ ID NO: 113867 - protein, 14 aa, Borrelia garinii PBi
LNSILAEKKEWLNY

SEQ ID NO: 113868 - protein, 14 aa, Borrelia garinii PBi
NSILAEKKEWLNYA

SEQ ID NO: 113869 - protein, 14 aa, Borrelia garinii PBi
SILAEKKEWLNYAD

SEQ ID NO: 113870 - protein, 14 aa, Borrelia garinii PBi
ILAEKKEWLNYADA

SEQ ID NO: 113871 - protein, 14 aa, Borrelia garinii PBi
LAEKKEWLNYADAI

SEQ ID NO: 113872 - protein, 14 aa, Borrelia garinii PBi
AEKKEWLNYADAII

SEQ ID NO: 113873 - protein, 14 aa, Borrelia garinii PBi
EKKEWLNYADAIIT

SEQ ID NO: 113874 - protein, 14 aa, Borrelia garinii PBi
KKEWLNYADAIITN

SEQ ID NO: 113875 - protein, 14 aa, Borrelia garinii PBi
KEWLNYADAIITNT

SEQ ID NO: 113876 - protein, 14 aa, Borrelia garinii PBi
EWLNYADAIITNTS

SEQ ID NO: 113877 - protein, 14 aa, Borrelia garinii PBi
WLNYADAIITNTSS

SEQ ID NO: 113878 - protein, 14 aa, Borrelia garinii PBi
LNYADAIITNTSSN

SEQ ID NO: 113879 - protein, 14 aa, Borrelia garinii PBi
NYADAIITNTSSNS

SEQ ID NO: 113880 - protein, 14 aa, Borrelia garinii PBi
YADAIITNTSSNSK

SEQ ID NO: 113881 - protein, 14 aa, Borrelia garinii PBi
ADAIITNTSSNSKR

SEQ ID NO: 113882 - protein, 14 aa, Borrelia garinii PBi
DAIITNTSSNSKRN

SEQ ID NO: 113883 - protein, 14 aa, Borrelia garinii PBi
AIITNTSSNSKRND

SEQ ID NO: 113884 - protein, 14 aa, Borrelia garinii PBi
IITNTSSNSKRNDP

SEQ ID NO: 113885 - protein, 14 aa, Borrelia garinii PBi
ITNTSSNSKRNDPQ

SEQ ID NO: 113886 - protein, 14 aa, Borrelia garinii PBi
TNTSSNSKRNDPQS

SEQ ID NO: 113887 - protein, 14 aa, Borrelia garinii PBi
NTSSNSKRNDPQSL

SEQ ID NO: 113888 - protein, 14 aa, Borrelia garinii PBi
TSSNSKRNDPQSLG

SEQ ID NO: 113889 - protein, 14 aa, Borrelia garinii PBi
SSNSKRNDPQSLGQ

SEQ ID NO: 113890 - protein, 14 aa, Borrelia garinii PBi
SNSKRNDPQSLGQY

SEQ ID NO: 113891 - protein, 14 aa, Borrelia garinii PBi
NSKRNDPQSLGQYI

SEQ ID NO: 113892 - protein, 14 aa, Borrelia garinii PBi
SKRNDPQSLGQYIK

SEQ ID NO: 113893 - protein, 14 aa, Borrelia garinii PBi
KRNDPQSLGQYIKN

SEQ ID NO: 113894 - protein, 14 aa, Borrelia garinii PBi
RNDPQSLGQYIKNK

SEQ ID NO: 113895 - protein, 14 aa, Borrelia garinii PBi
NDPQSLGQYIKNKY

SEQ ID NO: 113896 - protein, 14 aa, Borrelia garinii PBi
DPQSLGQYIKNKYL

SEQ ID NO: 113897 - protein, 14 aa, Borrelia garinii PBi
PQSLGQYIKNKYLD

SEQ ID NO: 113898 - protein, 14 aa, Borrelia garinii PBi
QSLGQYIKNKYLDK

SEQ ID NO: 113899 - protein, 14 aa, Borrelia garinii PBi
SLGQYIKNKYLDKM

SEQ ID NO: 113900 - protein, 14 aa, Borrelia garinii PBi
LGQYIKNKYLDKMQ

SEQ ID NO: 113901 - protein, 14 aa, Borrelia garinii PBi
GQYIKNKYLDKMQD

SEQ ID NO: 113902 - protein, 14 aa, Borrelia garinii PBi
QYIKNKYLDKMQDA

SEQ ID NO: 113903 - protein, 14 aa, Borrelia garinii PBi
YIKNKYLDKMQDAR

SEQ ID NO: 113904 - protein, 14 aa, Borrelia garinii PBi
IKNKYLDKMQDARQ

SEQ ID NO: 113905 - protein, 14 aa, Borrelia garinii PBi
KNKYLDKMQDARQS

SEQ ID NO: 113906 - protein, 14 aa, Borrelia garinii PBi
NKYLDKMQDARQSA

SEQ ID NO: 113907 - protein, 14 aa, Borrelia garinii PBi
KYLDKMQDARQSAL

SEQ ID NO: 113908 - protein, 14 aa, Borrelia garinii PBi
YLDKMQDARQSALD

SEQ ID NO: 113909 - protein, 14 aa, Borrelia garinii PBi
LDKMQDARQSALDL

SEQ ID NO: 113910 - protein, 14 aa, Borrelia garinii PBi
DKMQDARQSALDLY

SEQ ID NO: 113911 - protein, 14 aa, Borrelia garinii PBi
KMQDARQSALDLYL

SEQ ID NO: 113912 - protein, 14 aa, Borrelia garinii PBi
MQDARQSALDLYLN

SEQ ID NO: 113913 - protein, 14 aa, Borrelia garinii PBi
QDARQSALDLYLNI

SEQ ID NO: 113914 - protein, 14 aa, Borrelia garinii PBi
DARQSALDLYLNIT

SEQ ID NO: 113915 - protein, 14 aa, Borrelia garinii PBi
ARQSALDLYLNITE

SEQ ID NO: 113916 - protein, 14 aa, Borrelia garinii PBi
RQSALDLYLNITEI

SEQ ID NO: 113917 - protein, 14 aa, Borrelia garinii PBi
QSALDLYLNITEIR

SEQ ID NO: 113918 - protein, 15 aa, Borrelia garinii PBi
MSSCTIDANLNKDYK

SEQ ID NO: 113919 - protein, 15 aa, Borrelia garinii PBi
SSCTIDANLNKDYKN

SEQ ID NO: 113920 - protein, 15 aa, Borrelia garinii PBi
SCTIDANLNKDYKNK

SEQ ID NO: 113921 - protein, 15 aa, Borrelia garinii PBi
CTIDANLNKDYKNKV

SEQ ID NO: 113922 - protein, 15 aa, Borrelia garinii PBi
TIDANLNKDYKNKVE

SEQ ID NO: 113923 - protein, 15 aa, Borrelia garinii PBi
IDANLNKDYKNKVEE

SEQ ID NO: 113924 - protein, 15 aa, Borrelia garinii PBi
DANLNKDYKNKVEEL

SEQ ID NO: 113925 - protein, 15 aa, Borrelia garinii PBi
ANLNKDYKNKVEELL

SEQ ID NO: 113926 - protein, 15 aa, Borrelia garinii PBi
NLNKDYKNKVEELLN

SEQ ID NO: 113927 - protein, 15 aa, Borrelia garinii PBi
LNKDYKNKVEELLNS

SEQ ID NO: 113928 - protein, 15 aa, Borrelia garinii PBi
NKDYKNKVEELLNSS

SEQ ID NO: 113929 - protein, 15 aa, Borrelia garinii PBi
KDYKNKVEELLNSST

SEQ ID NO: 113930 - protein, 15 aa, Borrelia garinii PBi
DYKNKVEELLNSSTD

SEQ ID NO: 113931 - protein, 15 aa, Borrelia garinii PBi
YKNKVEELLNSSTDD

SEQ ID NO: 113932 - protein, 15 aa, Borrelia garinii PBi
KNKVEELLNSSTDDQ

SEQ ID NO: 113933 - protein, 15 aa, Borrelia garinii PBi
NKVEELLNSSTDDQA

SEQ ID NO: 113934 - protein, 15 aa, Borrelia garinii PBi
KVEELLNSSTDDQAK

SEQ ID NO: 113935 - protein, 15 aa, Borrelia garinii PBi
VEELLNSSTDDQAKI

SEQ ID NO: 113936 - protein, 15 aa, Borrelia garinii PBi
EELLNSSTDDQAKIS

SEQ ID NO: 113937 - protein, 15 aa, Borrelia garinii PBi
ELLNSSTDDQAKISI

SEQ ID NO: 113938 - protein, 15 aa, Borrelia garinii PBi
LLNSSTDDQAKISIN

SEQ ID NO: 113939 - protein, 15 aa, Borrelia garinii PBi
LNSSTDDQAKISINT

SEQ ID NO: 113940 - protein, 15 aa, Borrelia garinii PBi
NSSTDDQAKISINTG

SEQ ID NO: 113941 - protein, 15 aa, Borrelia garinii PBi
SSTDDQAKISINTGS

SEQ ID NO: 113942 - protein, 15 aa, Borrelia garinii PBi
STDDQAKISINTGSN

SEQ ID NO: 113943 - protein, 15 aa, Borrelia garinii PBi
TDDQAKISINTGSNA

SEQ ID NO: 113944 - protein, 15 aa, Borrelia garinii PBi
DDQAKISINTGSNAT

SEQ ID NO: 113945 - protein, 15 aa, Borrelia garinii PBi
DQAKISINTGSNATK

SEQ ID NO: 113946 - protein, 15 aa, Borrelia garinii PBi
QAKISINTGSNATKN

SEQ ID NO: 113947 - protein, 15 aa, Borrelia garinii PBi
AKISINTGSNATKNK

SEQ ID NO: 113948 - protein, 15 aa, Borrelia garinii PBi
KISINTGSNATKNKT

SEQ ID NO: 113949 - protein, 15 aa, Borrelia garinii PBi
ISINTGSNATKNKTN

SEQ ID NO: 113950 - protein, 15 aa, Borrelia garinii PBi
SINTGSNATKNKTNI

SEQ ID NO: 113951 - protein, 15 aa, Borrelia garinii PBi
INTGSNATKNKTNIK

SEQ ID NO: 113952 - protein, 15 aa, Borrelia garinii PBi
NTGSNATKNKTNIKV

SEQ ID NO: 113953 - protein, 15 aa, Borrelia garinii PBi
TGSNATKNKTNIKVA

SEQ ID NO: 113954 - protein, 15 aa, Borrelia garinii PBi
GSNATKNKTNIKVAG

SEQ ID NO: 113955 - protein, 15 aa, Borrelia garinii PBi
SNATKNKTNIKVAGL

SEQ ID NO: 113956 - protein, 15 aa, Borrelia garinii PBi
NATKNKTNIKVAGLQ

SEQ ID NO: 113957 - protein, 15 aa, Borrelia garinii PBi
ATKNKTNIKVAGLQK

SEQ ID NO: 113958 - protein, 15 aa, Borrelia garinii PBi
TKNKTNIKVAGLQKN

SEQ ID NO: 113959 - protein, 15 aa, Borrelia garinii PBi
KNKTNIKVAGLQKNT

SEQ ID NO: 113960 - protein, 15 aa, Borrelia garinii PBi
NKTNIKVAGLQKNTQ

SEQ ID NO: 113961 - protein, 15 aa, Borrelia garinii PBi
KTNIKVAGLQKNTQS

SEQ ID NO: 113962 - protein, 15 aa, Borrelia garinii PBi
TNIKVAGLQKNTQSK

SEQ ID NO: 113963 - protein, 15 aa, Borrelia garinii PBi
NIKVAGLQKNTQSKK

SEQ ID NO: 113964 - protein, 15 aa, Borrelia garinii PBi
IKVAGLQKNTQSKKN

SEQ ID NO: 113965 - protein, 15 aa, Borrelia garinii PBi
KVAGLQKNTQSKKNN

SEQ ID NO: 113966 - protein, 15 aa, Borrelia garinii PBi
VAGLQKNTQSKKNNN

SEQ ID NO: 113967 - protein, 15 aa, Borrelia garinii PBi
AGLQKNTQSKKNNNL

SEQ ID NO: 113968 - protein, 15 aa, Borrelia garinii PBi
GLQKNTQSKKNNNLQ

SEQ ID NO: 113969 - protein, 15 aa, Borrelia garinii PBi
LQKNTQSKKNNNLQG

SEQ ID NO: 113970 - protein, 15 aa, Borrelia garinii PBi
QKNTQSKKNNNLQGL

SEQ ID NO: 113971 - protein, 15 aa, Borrelia garinii PBi
KNTQSKKNNNLQGLN

SEQ ID NO: 113972 - protein, 15 aa, Borrelia garinii PBi
NTQSKKNNNLQGLNP

SEQ ID NO: 113973 - protein, 15 aa, Borrelia garinii PBi
TQSKKNNNLQGLNPA

SEQ ID NO: 113974 - protein, 15 aa, Borrelia garinii PBi
QSKKNNNLQGLNPAN

SEQ ID NO: 113975 - protein, 15 aa, Borrelia garinii PBi
SKKNNNLQGLNPANQ

SEQ ID NO: 113976 - protein, 15 aa, Borrelia garinii PBi
KKNNNLQGLNPANQV

SEQ ID NO: 113977 - protein, 15 aa, Borrelia garinii PBi
KNNNLQGLNPANQVN

SEQ ID NO: 113978 - protein, 15 aa, Borrelia garinii PBi
NNNLQGLNPANQVNP

SEQ ID NO: 113979 - protein, 15 aa, Borrelia garinii PBi
NNLQGLNPANQVNPG

SEQ ID NO: 113980 - protein, 15 aa, Borrelia garinii PBi
NLQGLNPANQVNPGN

SEQ ID NO: 113981 - protein, 15 aa, Borrelia garinii PBi
LQGLNPANQVNPGNP

SEQ ID NO: 113982 - protein, 15 aa, Borrelia garinii PBi
QGLNPANQVNPGNPM

SEQ ID NO: 113983 - protein, 15 aa, Borrelia garinii PBi
GLNPANQVNPGNPMQ

SEQ ID NO: 113984 - protein, 15 aa, Borrelia garinii PBi
LNPANQVNPGNPMQI

SEQ ID NO: 113985 - protein, 15 aa, Borrelia garinii PBi
NPANQVNPGNPMQIA

SEQ ID NO: 113986 - protein, 15 aa, Borrelia garinii PBi
PANQVNPGNPMQIAN

SEQ ID NO: 113987 - protein, 15 aa, Borrelia garinii PBi
ANQVNPGNPMQIANQ

SEQ ID NO: 113988 - protein, 15 aa, Borrelia garinii PBi
NQVNPGNPMQIANQA

SEQ ID NO: 113989 - protein, 15 aa, Borrelia garinii PBi
QVNPGNPMQIANQAN

SEQ ID NO: 113990 - protein, 15 aa, Borrelia garinii PBi
VNPGNPMQIANQANQ

SEQ ID NO: 113991 - protein, 15 aa, Borrelia garinii PBi
NPGNPMQIANQANQA

SEQ ID NO: 113992 - protein, 15 aa, Borrelia garinii PBi
PGNPMQIANQANQAN

SEQ ID NO: 113993 - protein, 15 aa, Borrelia garinii PBi
GNPMQIANQANQANQ

SEQ ID NO: 113994 - protein, 15 aa, Borrelia garinii PBi
NPMQIANQANQANQA

SEQ ID NO: 113995 - protein, 15 aa, Borrelia garinii PBi
PMQIANQANQANQAN

SEQ ID NO: 113996 - protein, 15 aa, Borrelia garinii PBi
MQIANQANQANQANQ

SEQ ID NO: 113997 - protein, 15 aa, Borrelia garinii PBi
QIANQANQANQANQA

SEQ ID NO: 113998 - protein, 15 aa, Borrelia garinii PBi
IANQANQANQANQAN

SEQ ID NO: 113999 - protein, 15 aa, Borrelia garinii PBi
ANQANQANQANQANQ

SEQ ID NO: 114000 - protein, 15 aa, Borrelia garinii PBi
NQANQANQANQANQA

SEQ ID NO: 114001 - protein, 15 aa, Borrelia garinii PBi
QANQANQANQANQAN

SEQ ID NO: 114002 - protein, 15 aa, Borrelia garinii PBi
ANQANQANQANQANQ

SEQ ID NO: 114003 - protein, 15 aa, Borrelia garinii PBi
NQANQANQANQANQA

SEQ ID NO: 114004 - protein, 15 aa, Borrelia garinii PBi
QANQANQANQANQAS

SEQ ID NO: 114005 - protein, 15 aa, Borrelia garinii PBi
ANQANQANQANQASQ

SEQ ID NO: 114006 - protein, 15 aa, Borrelia garinii PBi
NQANQANQANQASQA

SEQ ID NO: 114007 - protein, 15 aa, Borrelia garinii PBi
QANQANQANQASQAS

SEQ ID NO: 114008 - protein, 15 aa, Borrelia garinii PBi
ANQANQANQASQASQ

SEQ ID NO: 114009 - protein, 15 aa, Borrelia garinii PBi
NQANQANQASQASQA

SEQ ID NO: 114010 - protein, 15 aa, Borrelia garinii PBi
QANQANQASQASQAS

SEQ ID NO: 114011 - protein, 15 aa, Borrelia garinii PBi
ANQANQASQASQASQ

SEQ ID NO: 114012 - protein, 15 aa, Borrelia garinii PBi
NQANQASQASQASQV

SEQ ID NO: 114013 - protein, 15 aa, Borrelia garinii PBi
QANQASQASQASQVA

SEQ ID NO: 114014 - protein, 15 aa, Borrelia garinii PBi
ANQASQASQASQVAS

SEQ ID NO: 114015 - protein, 15 aa, Borrelia garinii PBi
NQASQASQASQVASS

SEQ ID NO: 114016 - protein, 15 aa, Borrelia garinii PBi
QASQASQASQVASSA

SEQ ID NO: 114017 - protein, 15 aa, Borrelia garinii PBi
ASQASQASQVASSAS

SEQ ID NO: 114018 - protein, 15 aa, Borrelia garinii PBi
SQASQASQVASSASQ

SEQ ID NO: 114019 - protein, 15 aa, Borrelia garinii PBi
QASQASQVASSASQA

SEQ ID NO: 114020 - protein, 15 aa, Borrelia garinii PBi
ASQASQVASSASQAS

SEQ ID NO: 114021 - protein, 15 aa, Borrelia garinii PBi
SQASQVASSASQASP

SEQ ID NO: 114022 - protein, 15 aa, Borrelia garinii PBi
QASQVASSASQASPV

SEQ ID NO: 114023 - protein, 15 aa, Borrelia garinii PBi
ASQVASSASQASPVA

SEQ ID NO: 114024 - protein, 15 aa, Borrelia garinii PBi
SQVASSASQASPVAS

SEQ ID NO: 114025 - protein, 15 aa, Borrelia garinii PBi
QVASSASQASPVASP

SEQ ID NO: 114026 - protein, 15 aa, Borrelia garinii PBi
VASSASQASPVASPA

SEQ ID NO: 114027 - protein, 15 aa, Borrelia garinii PBi
ASSASQASPVASPAT

SEQ ID NO: 114028 - protein, 15 aa, Borrelia garinii PBi
SSASQASPVASPATN

SEQ ID NO: 114029 - protein, 15 aa, Borrelia garinii PBi
SASQASPVASPATNV

SEQ ID NO: 114030 - protein, 15 aa, Borrelia garinii PBi
ASQASPVASPATNVQ

SEQ ID NO: 114031 - protein, 15 aa, Borrelia garinii PBi
SQASPVASPATNVQA

SEQ ID NO: 114032 - protein, 15 aa, Borrelia garinii PBi
QASPVASPATNVQAT

SEQ ID NO: 114033 - protein, 15 aa, Borrelia garinii PBi
ASPVASPATNVQATP

SEQ ID NO: 114034 - protein, 15 aa, Borrelia garinii PBi
SPVASPATNVQATPP

SEQ ID NO: 114035 - protein, 15 aa, Borrelia garinii PBi
PVASPATNVQATPPK

SEQ ID NO: 114036 - protein, 15 aa, Borrelia garinii PBi
VASPATNVQATPPKQ

SEQ ID NO: 114037 - protein, 15 aa, Borrelia garinii PBi
ASPATNVQATPPKQI

SEQ ID NO: 114038 - protein, 15 aa, Borrelia garinii PBi
SPATNVQATPPKQIA

SEQ ID NO: 114039 - protein, 15 aa, Borrelia garinii PBi
PATNVQATPPKQIAS

SEQ ID NO: 114040 - protein, 15 aa, Borrelia garinii PBi
ATNVQATPPKQIASA

SEQ ID NO: 114041 - protein, 15 aa, Borrelia garinii PBi
TNVQATPPKQIASAQ

SEQ ID NO: 114042 - protein, 15 aa, Borrelia garinii PBi
NVQATPPKQIASAQA

SEQ ID NO: 114043 - protein, 15 aa, Borrelia garinii PBi
VQATPPKQIASAQAI

SEQ ID NO: 114044 - protein, 15 aa, Borrelia garinii PBi
QATPPKQIASAQAIQ

SEQ ID NO: 114045 - protein, 15 aa, Borrelia garinii PBi
ATPPKQIASAQAIQT

SEQ ID NO: 114046 - protein, 15 aa, Borrelia garinii PBi
TPPKQIASAQAIQTV

SEQ ID NO: 114047 - protein, 15 aa, Borrelia garinii PBi
PPKQIASAQAIQTVP

SEQ ID NO: 114048 - protein, 15 aa, Borrelia garinii PBi
PKQIASAQAIQTVPN

SEQ ID NO: 114049 - protein, 15 aa, Borrelia garinii PBi
KQIASAQAIQTVPNN

SEQ ID NO: 114050 - protein, 15 aa, Borrelia garinii PBi
QIASAQAIQTVPNNT

SEQ ID NO: 114051 - protein, 15 aa, Borrelia garinii PBi
IASAQAIQTVPNNTS

SEQ ID NO: 114052 - protein, 15 aa, Borrelia garinii PBi
ASAQAIQTVPNNTST

SEQ ID NO: 114053 - protein, 15 aa, Borrelia garinii PBi
SAQAIQTVPNNTSTP

SEQ ID NO: 114054 - protein, 15 aa, Borrelia garinii PBi
AQAIQTVPNNTSTPN

SEQ ID NO: 114055 - protein, 15 aa, Borrelia garinii PBi
QAIQTVPNNTSTPNQ

SEQ ID NO: 114056 - protein, 15 aa, Borrelia garinii PBi
AIQTVPNNTSTPNQS

SEQ ID NO: 114057 - protein, 15 aa, Borrelia garinii PBi
IQTVPNNTSTPNQSI

SEQ ID NO: 114058 - protein, 15 aa, Borrelia garinii PBi
QTVPNNTSTPNQSII

SEQ ID NO: 114059 - protein, 15 aa, Borrelia garinii PBi
TVPNNTSTPNQSIIK

SEQ ID NO: 114060 - protein, 15 aa, Borrelia garinii PBi
VPNNTSTPNQSIIKP

SEQ ID NO: 114061 - protein, 15 aa, Borrelia garinii PBi
PNNTSTPNQSIIKPQ

SEQ ID NO: 114062 - protein, 15 aa, Borrelia garinii PBi
NNTSTPNQSIIKPQQ

SEQ ID NO: 114063 - protein, 15 aa, Borrelia garinii PBi
NTSTPNQSIIKPQQY

SEQ ID NO: 114064 - protein, 15 aa, Borrelia garinii PBi
TSTPNQSIIKPQQYT

SEQ ID NO: 114065 - protein, 15 aa, Borrelia garinii PBi
STPNQSIIKPQQYTF

SEQ ID NO: 114066 - protein, 15 aa, Borrelia garinii PBi
TPNQSIIKPQQYTFS

SEQ ID NO: 114067 - protein, 15 aa, Borrelia garinii PBi
PNQSIIKPQQYTFSS

SEQ ID NO: 114068 - protein, 15 aa, Borrelia garinii PBi
NQSIIKPQQYTFSSS

SEQ ID NO: 114069 - protein, 15 aa, Borrelia garinii PBi
QSIIKPQQYTFSSSF

SEQ ID NO: 114070 - protein, 15 aa, Borrelia garinii PBi
SIIKPQQYTFSSSFS

SEQ ID NO: 114071 - protein, 15 aa, Borrelia garinii PBi
IIKPQQYTFSSSFSQ

SEQ ID NO: 114072 - protein, 15 aa, Borrelia garinii PBi
IKPQQYTFSSSFSQP

SEQ ID NO: 114073 - protein, 15 aa, Borrelia garinii PBi
KPQQYTFSSSFSQPT

SEQ ID NO: 114074 - protein, 15 aa, Borrelia garinii PBi
PQQYTFSSSFSQPTS

SEQ ID NO: 114075 - protein, 15 aa, Borrelia garinii PBi
QQYTFSSSFSQPTSQ

SEQ ID NO: 114076 - protein, 15 aa, Borrelia garinii PBi
QYTFSSSFSQPTSQT

SEQ ID NO: 114077 - protein, 15 aa, Borrelia garinii PBi
YTFSSSFSQPTSQTN

SEQ ID NO: 114078 - protein, 15 aa, Borrelia garinii PBi
TFSSSFSQPTSQTNF

SEQ ID NO: 114079 - protein, 15 aa, Borrelia garinii PBi
FSSSFSQPTSQTNFN

SEQ ID NO: 114080 - protein, 15 aa, Borrelia garinii PBi
SSSFSQPTSQTNFNN

SEQ ID NO: 114081 - protein, 15 aa, Borrelia garinii PBi
SSFSQPTSQTNFNNS

SEQ ID NO: 114082 - protein, 15 aa, Borrelia garinii PBi
SFSQPTSQTNFNNSQ

SEQ ID NO: 114083 - protein, 15 aa, Borrelia garinii PBi
FSQPTSQTNFNNSQS

SEQ ID NO: 114084 - protein, 15 aa, Borrelia garinii PBi
SQPTSQTNFNNSQSN

SEQ ID NO: 114085 - protein, 15 aa, Borrelia garinii PBi
QPTSQTNFNNSQSNN

SEQ ID NO: 114086 - protein, 15 aa, Borrelia garinii PBi
PTSQTNFNNSQSNNV

SEQ ID NO: 114087 - protein, 15 aa, Borrelia garinii PBi
TSQTNFNNSQSNNVL

SEQ ID NO: 114088 - protein, 15 aa, Borrelia garinii PBi
SQTNFNNSQSNNVLT

SEQ ID NO: 114089 - protein, 15 aa, Borrelia garinii PBi
QTNFNNSQSNNVLTN

SEQ ID NO: 114090 - protein, 15 aa, Borrelia garinii PBi
TNFNNSQSNNVLTNY

SEQ ID NO: 114091 - protein, 15 aa, Borrelia garinii PBi
NFNNSQSNNVLTNYR

SEQ ID NO: 114092 - protein, 15 aa, Borrelia garinii PBi
FNNSQSNNVLTNYRH

SEQ ID NO: 114093 - protein, 15 aa, Borrelia garinii PBi
NNSQSNNVLTNYRHQ

SEQ ID NO: 114094 - protein, 15 aa, Borrelia garinii PBi
NSQSNNVLTNYRHQT

SEQ ID NO: 114095 - protein, 15 aa, Borrelia garinii PBi
SQSNNVLTNYRHQTQ

SEQ ID NO: 114096 - protein, 15 aa, Borrelia garinii PBi
QSNNVLTNYRHQTQP

SEQ ID NO: 114097 - protein, 15 aa, Borrelia garinii PBi
SNNVLTNYRHQTQPS

SEQ ID NO: 114098 - protein, 15 aa, Borrelia garinii PBi
NNVLTNYRHQTQPSF

SEQ ID NO: 114099 - protein, 15 aa, Borrelia garinii PBi
NVLTNYRHQTQPSFV

SEQ ID NO: 114100 - protein, 15 aa, Borrelia garinii PBi
VLTNYRHQTQPSFVV

SEQ ID NO: 114101 - protein, 15 aa, Borrelia garinii PBi
LTNYRHQTQPSFVVP

SEQ ID NO: 114102 - protein, 15 aa, Borrelia garinii PBi
TNYRHQTQPSFVVPV

SEQ ID NO: 114103 - protein, 15 aa, Borrelia garinii PBi
NYRHQTQPSFVVPVY

SEQ ID NO: 114104 - protein, 15 aa, Borrelia garinii PBi
YRHQTQPSFVVPVYS

SEQ ID NO: 114105 - protein, 15 aa, Borrelia garinii PBi
RHQTQPSFVVPVYSG

SEQ ID NO: 114106 - protein, 15 aa, Borrelia garinii PBi
HQTQPSFVVPVYSGN

SEQ ID NO: 114107 - protein, 15 aa, Borrelia garinii PBi
QTQPSFVVPVYSGNS

SEQ ID NO: 114108 - protein, 15 aa, Borrelia garinii PBi
TQPSFVVPVYSGNSP

SEQ ID NO: 114109 - protein, 15 aa, Borrelia garinii PBi
QPSFVVPVYSGNSPL

SEQ ID NO: 114110 - protein, 15 aa, Borrelia garinii PBi
PSFVVPVYSGNSPLQ

SEQ ID NO: 114111 - protein, 15 aa, Borrelia garinii PBi
SFVVPVYSGNSPLQK

SEQ ID NO: 114112 - protein, 15 aa, Borrelia garinii PBi
FVVPVYSGNSPLQKL

SEQ ID NO: 114113 - protein, 15 aa, Borrelia garinii PBi
VVPVYSGNSPLQKLK

SEQ ID NO: 114114 - protein, 15 aa, Borrelia garinii PBi
VPVYSGNSPLQKLKN

SEQ ID NO: 114115 - protein, 15 aa, Borrelia garinii PBi
PVYSGNSPLQKLKNN

SEQ ID NO: 114116 - protein, 15 aa, Borrelia garinii PBi
VYSGNSPLQKLKNNL

SEQ ID NO: 114117 - protein, 15 aa, Borrelia garinii PBi
YSGNSPLQKLKNNLL

SEQ ID NO: 114118 - protein, 15 aa, Borrelia garinii PBi
SGNSPLQKLKNNLLR

SEQ ID NO: 114119 - protein, 15 aa, Borrelia garinii PBi
GNSPLQKLKNNLLRR

SEQ ID NO: 114120 - protein, 15 aa, Borrelia garinii PBi
NSPLQKLKNNLLRRI

SEQ ID NO: 114121 - protein, 15 aa, Borrelia garinii PBi
SPLQKLKNNLLRRIA

SEQ ID NO: 114122 - protein, 15 aa, Borrelia garinii PBi
PLQKLKNNLLRRIAE

SEQ ID NO: 114123 - protein, 15 aa, Borrelia garinii PBi
LQKLKNNLLRRIAEE

SEQ ID NO: 114124 - protein, 15 aa, Borrelia garinii PBi
QKLKNNLLRRIAEEK

SEQ ID NO: 114125 - protein, 15 aa, Borrelia garinii PBi
KLKNNLLRRIAEEKN

SEQ ID NO: 114126 - protein, 15 aa, Borrelia garinii PBi
LKNNLLRRIAEEKNK

SEQ ID NO: 114127 - protein, 15 aa, Borrelia garinii PBi
KNNLLRRIAEEKNKT

SEQ ID NO: 114128 - protein, 15 aa, Borrelia garinii PBi
NNLLRRIAEEKNKTH

SEQ ID NO: 114129 - protein, 15 aa, Borrelia garinii PBi
NLLRRIAEEKNKTHN

SEQ ID NO: 114130 - protein, 15 aa, Borrelia garinii PBi
LLRRIAEEKNKTHNH

SEQ ID NO: 114131 - protein, 15 aa, Borrelia garinii PBi
LRRIAEEKNKTHNHG

SEQ ID NO: 114132 - protein, 15 aa, Borrelia garinii PBi
RRIAEEKNKTHNHGF

SEQ ID NO: 114133 - protein, 15 aa, Borrelia garinii PBi
RIAEEKNKTHNHGFR

SEQ ID NO: 114134 - protein, 15 aa, Borrelia garinii PBi
IAEEKNKTHNHGFRE

SEQ ID NO: 114135 - protein, 15 aa, Borrelia garinii PBi
AEEKNKTHNHGFRET

SEQ ID NO: 114136 - protein, 15 aa, Borrelia garinii PBi
EEKNKTHNHGFRETY

SEQ ID NO: 114137 - protein, 15 aa, Borrelia garinii PBi
EKNKTHNHGFRETYD

SEQ ID NO: 114138 - protein, 15 aa, Borrelia garinii PBi
KNKTHNHGFRETYDQ

SEQ ID NO: 114139 - protein, 15 aa, Borrelia garinii PBi
NKTHNHGFRETYDQF

SEQ ID NO: 114140 - protein, 15 aa, Borrelia garinii PBi
KTHNHGFRETYDQFK

SEQ ID NO: 114141 - protein, 15 aa, Borrelia garinii PBi
THNHGFRETYDQFKM

SEQ ID NO: 114142 - protein, 15 aa, Borrelia garinii PBi
HNHGFRETYDQFKMK

SEQ ID NO: 114143 - protein, 15 aa, Borrelia garinii PBi
NHGFRETYDQFKMKD

SEQ ID NO: 114144 - protein, 15 aa, Borrelia garinii PBi
HGFRETYDQFKMKDS

SEQ ID NO: 114145 - protein, 15 aa, Borrelia garinii PBi
GFRETYDQFKMKDSA

SEQ ID NO: 114146 - protein, 15 aa, Borrelia garinii PBi
FRETYDQFKMKDSAF

SEQ ID NO: 114147 - protein, 15 aa, Borrelia garinii PBi
RETYDQFKMKDSAFT

SEQ ID NO: 114148 - protein, 15 aa, Borrelia garinii PBi
ETYDQFKMKDSAFTL

SEQ ID NO: 114149 - protein, 15 aa, Borrelia garinii PBi
TYDQFKMKDSAFTLL

SEQ ID NO: 114150 - protein, 15 aa, Borrelia garinii PBi
YDQFKMKDSAFTLLD

SEQ ID NO: 114151 - protein, 15 aa, Borrelia garinii PBi
DQFKMKDSAFTLLDV

SEQ ID NO: 114152 - protein, 15 aa, Borrelia garinii PBi
QFKMKDSAFTLLDVI

SEQ ID NO: 114153 - protein, 15 aa, Borrelia garinii PBi
FKMKDSAFTLLDVIS

SEQ ID NO: 114154 - protein, 15 aa, Borrelia garinii PBi
KMKDSAFTLLDVISN

SEQ ID NO: 114155 - protein, 15 aa, Borrelia garinii PBi
MKDSAFTLLDVISNI

SEQ ID NO: 114156 - protein, 15 aa, Borrelia garinii PBi
KDSAFTLLDVISNIS

SEQ ID NO: 114157 - protein, 15 aa, Borrelia garinii PBi
DSAFTLLDVISNISV

SEQ ID NO: 114158 - protein, 15 aa, Borrelia garinii PBi
SAFTLLDVISNISVF

SEQ ID NO: 114159 - protein, 15 aa, Borrelia garinii PBi
AFTLLDVISNISVFD

SEQ ID NO: 114160 - protein, 15 aa, Borrelia garinii PBi
FTLLDVISNISVFDR

SEQ ID NO: 114161 - protein, 15 aa, Borrelia garinii PBi
TLLDVISNISVFDRG

SEQ ID NO: 114162 - protein, 15 aa, Borrelia garinii PBi
LLDVISNISVFDRGS

SEQ ID NO: 114163 - protein, 15 aa, Borrelia garinii PBi
LDVISNISVFDRGSA

SEQ ID NO: 114164 - protein, 15 aa, Borrelia garinii PBi
DVISNISVFDRGSAP

SEQ ID NO: 114165 - protein, 15 aa, Borrelia garinii PBi
VISNISVFDRGSAPQ

SEQ ID NO: 114166 - protein, 15 aa, Borrelia garinii PBi
ISNISVFDRGSAPQL

SEQ ID NO: 114167 - protein, 15 aa, Borrelia garinii PBi
SNISVFDRGSAPQLS

SEQ ID NO: 114168 - protein, 15 aa, Borrelia garinii PBi
NISVFDRGSAPQLSS

SEQ ID NO: 114169 - protein, 15 aa, Borrelia garinii PBi
ISVFDRGSAPQLSSN

SEQ ID NO: 114170 - protein, 15 aa, Borrelia garinii PBi
SVFDRGSAPQLSSNT

SEQ ID NO: 114171 - protein, 15 aa, Borrelia garinii PBi
VFDRGSAPQLSSNTP

SEQ ID NO: 114172 - protein, 15 aa, Borrelia garinii PBi
FDRGSAPQLSSNTPE

SEQ ID NO: 114173 - protein, 15 aa, Borrelia garinii PBi
DRGSAPQLSSNTPEA

SEQ ID NO: 114174 - protein, 15 aa, Borrelia garinii PBi
RGSAPQLSSNTPEAE

SEQ ID NO: 114175 - protein, 15 aa, Borrelia garinii PBi
GSAPQLSSNTPEAES

SEQ ID NO: 114176 - protein, 15 aa, Borrelia garinii PBi
SAPQLSSNTPEAESE

SEQ ID NO: 114177 - protein, 15 aa, Borrelia garinii PBi
APQLSSNTPEAESER

SEQ ID NO: 114178 - protein, 15 aa, Borrelia garinii PBi
PQLSSNTPEAESERN

SEQ ID NO: 114179 - protein, 15 aa, Borrelia garinii PBi
QLSSNTPEAESERNR

SEQ ID NO: 114180 - protein, 15 aa, Borrelia garinii PBi
LSSNTPEAESERNRL

SEQ ID NO: 114181 - protein, 15 aa, Borrelia garinii PBi
SSNTPEAESERNRLY

SEQ ID NO: 114182 - protein, 15 aa, Borrelia garinii PBi
SNTPEAESERNRLYA

SEQ ID NO: 114183 - protein, 15 aa, Borrelia garinii PBi
NTPEAESERNRLYAM

SEQ ID NO: 114184 - protein, 15 aa, Borrelia garinii PBi
TPEAESERNRLYAMM

SEQ ID NO: 114185 - protein, 15 aa, Borrelia garinii PBi
PEAESERNRLYAMMD

SEQ ID NO: 114186 - protein, 15 aa, Borrelia garinii PBi
EAESERNRLYAMMDF

SEQ ID NO: 114187 - protein, 15 aa, Borrelia garinii PBi
AESERNRLYAMMDFD

SEQ ID NO: 114188 - protein, 15 aa, Borrelia garinii PBi
ESERNRLYAMMDFDQ

SEQ ID NO: 114189 - protein, 15 aa, Borrelia garinii PBi
SERNRLYAMMDFDQA

SEQ ID NO: 114190 - protein, 15 aa, Borrelia garinii PBi
ERNRLYAMMDFDQAK

SEQ ID NO: 114191 - protein, 15 aa, Borrelia garinii PBi
RNRLYAMMDFDQAKT

SEQ ID NO: 114192 - protein, 15 aa, Borrelia garinii PBi
NRLYAMMDFDQAKTT

SEQ ID NO: 114193 - protein, 15 aa, Borrelia garinii PBi
RLYAMMDFDQAKTTE

SEQ ID NO: 114194 - protein, 15 aa, Borrelia garinii PBi
LYAMMDFDQAKTTEF

SEQ ID NO: 114195 - protein, 15 aa, Borrelia garinii PBi
YAMMDFDQAKTTEFG

SEQ ID NO: 114196 - protein, 15 aa, Borrelia garinii PBi
AMMDFDQAKTTEFGS

SEQ ID NO: 114197 - protein, 15 aa, Borrelia garinii PBi
MMDFDQAKTTEFGSI

SEQ ID NO: 114198 - protein, 15 aa, Borrelia garinii PBi
MDFDQAKTTEFGSIM

SEQ ID NO: 114199 - protein, 15 aa, Borrelia garinii PBi
DFDQAKTTEFGSIMN

SEQ ID NO: 114200 - protein, 15 aa, Borrelia garinii PBi
FDQAKTTEFGSIMNI

SEQ ID NO: 114201 - protein, 15 aa, Borrelia garinii PBi
DQAKTTEFGSIMNIL

SEQ ID NO: 114202 - protein, 15 aa, Borrelia garinii PBi
QAKTTEFGSIMNILY

SEQ ID NO: 114203 - protein, 15 aa, Borrelia garinii PBi
AKTTEFGSIMNILYQ

SEQ ID NO: 114204 - protein, 15 aa, Borrelia garinii PBi
KTTEFGSIMNILYQE

SEQ ID NO: 114205 - protein, 15 aa, Borrelia garinii PBi
TTEFGSIMNILYQEN

SEQ ID NO: 114206 - protein, 15 aa, Borrelia garinii PBi
TEFGSIMNILYQENQ

SEQ ID NO: 114207 - protein, 15 aa, Borrelia garinii PBi
EFGSIMNILYQENQN

SEQ ID NO: 114208 - protein, 15 aa, Borrelia garinii PBi
FGSIMNILYQENQNH

SEQ ID NO: 114209 - protein, 15 aa, Borrelia garinii PBi
GSIMNILYQENQNHS

SEQ ID NO: 114210 - protein, 15 aa, Borrelia garinii PBi
SIMNILYQENQNHSL

SEQ ID NO: 114211 - protein, 15 aa, Borrelia garinii PBi
IMNILYQENQNHSLI

SEQ ID NO: 114212 - protein, 15 aa, Borrelia garinii PBi
MNILYQENQNHSLIR

SEQ ID NO: 114213 - protein, 15 aa, Borrelia garinii PBi
NILYQENQNHSLIRS

SEQ ID NO: 114214 - protein, 15 aa, Borrelia garinii PBi
ILYQENQNHSLIRSL

SEQ ID NO: 114215 - protein, 15 aa, Borrelia garinii PBi
LYQENQNHSLIRSLI

SEQ ID NO: 114216 - protein, 15 aa, Borrelia garinii PBi
YQENQNHSLIRSLII

SEQ ID NO: 114217 - protein, 15 aa, Borrelia garinii PBi
QENQNHSLIRSLIIS

SEQ ID NO: 114218 - protein, 15 aa, Borrelia garinii PBi
ENQNHSLIRSLIISG

SEQ ID NO: 114219 - protein, 15 aa, Borrelia garinii PBi
NQNHSLIRSLIISGL

SEQ ID NO: 114220 - protein, 15 aa, Borrelia garinii PBi
QNHSLIRSLIISGLG

SEQ ID NO: 114221 - protein, 15 aa, Borrelia garinii PBi
NHSLIRSLIISGLGI

SEQ ID NO: 114222 - protein, 15 aa, Borrelia garinii PBi
HSLIRSLIISGLGIQ

SEQ ID NO: 114223 - protein, 15 aa, Borrelia garinii PBi
SLIRSLIISGLGIQI

SEQ ID NO: 114224 - protein, 15 aa, Borrelia garinii PBi
LIRSLIISGLGIQIS

SEQ ID NO: 114225 - protein, 15 aa, Borrelia garinii PBi
IRSLIISGLGIQISL

SEQ ID NO: 114226 - protein, 15 aa, Borrelia garinii PBi
RSLIISGLGIQISLE

SEQ ID NO: 114227 - protein, 15 aa, Borrelia garinii PBi
SLIISGLGIQISLES

SEQ ID NO: 114228 - protein, 15 aa, Borrelia garinii PBi
LIISGLGIQISLEST

SEQ ID NO: 114229 - protein, 15 aa, Borrelia garinii PBi
IISGLGIQISLESTL

SEQ ID NO: 114230 - protein, 15 aa, Borrelia garinii PBi
ISGLGIQISLESTLE

SEQ ID NO: 114231 - protein, 15 aa, Borrelia garinii PBi
SGLGIQISLESTLEE

SEQ ID NO: 114232 - protein, 15 aa, Borrelia garinii PBi
GLGIQISLESTLEEI

SEQ ID NO: 114233 - protein, 15 aa, Borrelia garinii PBi
LGIQISLESTLEEIE

SEQ ID NO: 114234 - protein, 15 aa, Borrelia garinii PBi
GIQISLESTLEEIEK

SEQ ID NO: 114235 - protein, 15 aa, Borrelia garinii PBi
IQISLESTLEEIEKK

SEQ ID NO: 114236 - protein, 15 aa, Borrelia garinii PBi
QISLESTLEEIEKKI

SEQ ID NO: 114237 - protein, 15 aa, Borrelia garinii PBi
ISLESTLEEIEKKIE

SEQ ID NO: 114238 - protein, 15 aa, Borrelia garinii PBi
SLESTLEEIEKKIES

SEQ ID NO: 114239 - protein, 15 aa, Borrelia garinii PBi
LESTLEEIEKKIESF

SEQ ID NO: 114240 - protein, 15 aa, Borrelia garinii PBi
ESTLEEIEKKIESFN

SEQ ID NO: 114241 - protein, 15 aa, Borrelia garinii PBi
STLEEIEKKIESFNT

SEQ ID NO: 114242 - protein, 15 aa, Borrelia garinii PBi
TLEEIEKKIESFNTQ

SEQ ID NO: 114243 - protein, 15 aa, Borrelia garinii PBi
LEEIEKKIESFNTQY

SEQ ID NO: 114244 - protein, 15 aa, Borrelia garinii PBi
EEIEKKIESFNTQYL

SEQ ID NO: 114245 - protein, 15 aa, Borrelia garinii PBi
EIEKKIESFNTQYLN

SEQ ID NO: 114246 - protein, 15 aa, Borrelia garinii PBi
IEKKIESFNTQYLNT

SEQ ID NO: 114247 - protein, 15 aa, Borrelia garinii PBi
EKKIESFNTQYLNTI

SEQ ID NO: 114248 - protein, 15 aa, Borrelia garinii PBi
KKIESFNTQYLNTII

SEQ ID NO: 114249 - protein, 15 aa, Borrelia garinii PBi
KIESFNTQYLNTIIN

SEQ ID NO: 114250 - protein, 15 aa, Borrelia garinii PBi
IESFNTQYLNTIINS

SEQ ID NO: 114251 - protein, 15 aa, Borrelia garinii PBi
ESFNTQYLNTIINSY

SEQ ID NO: 114252 - protein, 15 aa, Borrelia garinii PBi
SFNTQYLNTIINSYT

SEQ ID NO: 114253 - protein, 15 aa, Borrelia garinii PBi
FNTQYLNTIINSYTF

SEQ ID NO: 114254 - protein, 15 aa, Borrelia garinii PBi
NTQYLNTIINSYTFK

SEQ ID NO: 114255 - protein, 15 aa, Borrelia garinii PBi
TQYLNTIINSYTFKD

SEQ ID NO: 114256 - protein, 15 aa, Borrelia garinii PBi
QYLNTIINSYTFKDK

SEQ ID NO: 114257 - protein, 15 aa, Borrelia garinii PBi
YLNTIINSYTFKDKL

SEQ ID NO: 114258 - protein, 15 aa, Borrelia garinii PBi
LNTIINSYTFKDKLK

SEQ ID NO: 114259 - protein, 15 aa, Borrelia garinii PBi
NTIINSYTFKDKLKE

SEQ ID NO: 114260 - protein, 15 aa, Borrelia garinii PBi
TIINSYTFKDKLKEL

SEQ ID NO: 114261 - protein, 15 aa, Borrelia garinii PBi
IINSYTFKDKLKELE

SEQ ID NO: 114262 - protein, 15 aa, Borrelia garinii PBi
INSYTFKDKLKELES

SEQ ID NO: 114263 - protein, 15 aa, Borrelia garinii PBi
NSYTFKDKLKELESK

SEQ ID NO: 114264 - protein, 15 aa, Borrelia garinii PBi
SYTFKDKLKELESKL

SEQ ID NO: 114265 - protein, 15 aa, Borrelia garinii PBi
YTFKDKLKELESKLN

SEQ ID NO: 114266 - protein, 15 aa, Borrelia garinii PBi
TFKDKLKELESKLNS

SEQ ID NO: 114267 - protein, 15 aa, Borrelia garinii PBi
FKDKLKELESKLNSI

SEQ ID NO: 114268 - protein, 15 aa, Borrelia garinii PBi
KDKLKELESKLNSIL

SEQ ID NO: 114269 - protein, 15 aa, Borrelia garinii PBi
DKLKELESKLNSILA

SEQ ID NO: 114270 - protein, 15 aa, Borrelia garinii PBi
KLKELESKLNSILAE

SEQ ID NO: 114271 - protein, 15 aa, Borrelia garinii PBi
LKELESKLNSILAEK

SEQ ID NO: 114272 - protein, 15 aa, Borrelia garinii PBi
KELESKLNSILAEKK

SEQ ID NO: 114273 - protein, 15 aa, Borrelia garinii PBi
ELESKLNSILAEKKE

SEQ ID NO: 114274 - protein, 15 aa, Borrelia garinii PBi
LESKLNSILAEKKEW

SEQ ID NO: 114275 - protein, 15 aa, Borrelia garinii PBi
ESKLNSILAEKKEWL

SEQ ID NO: 114276 - protein, 15 aa, Borrelia garinii PBi
SKLNSILAEKKEWLN

SEQ ID NO: 114277 - protein, 15 aa, Borrelia garinii PBi
KLNSILAEKKEWLNY

SEQ ID NO: 114278 - protein, 15 aa, Borrelia garinii PBi
LNSILAEKKEWLNYA

SEQ ID NO: 114279 - protein, 15 aa, Borrelia garinii PBi
NSILAEKKEWLNYAD

SEQ ID NO: 114280 - protein, 15 aa, Borrelia garinii PBi
SILAEKKEWLNYADA

SEQ ID NO: 114281 - protein, 15 aa, Borrelia garinii PBi
ILAEKKEWLNYADAI

SEQ ID NO: 114282 - protein, 15 aa, Borrelia garinii PBi
LAEKKEWLNYADAII

SEQ ID NO: 114283 - protein, 15 aa, Borrelia garinii PBi
AEKKEWLNYADAIIT

SEQ ID NO: 114284 - protein, 15 aa, Borrelia garinii PBi
EKKEWLNYADAIITN

SEQ ID NO: 114285 - protein, 15 aa, Borrelia garinii PBi
KKEWLNYADAIITNT

SEQ ID NO: 114286 - protein, 15 aa, Borrelia garinii PBi
KEWLNYADAIITNTS

SEQ ID NO: 114287 - protein, 15 aa, Borrelia garinii PBi
EWLNYADAIITNTSS

SEQ ID NO: 114288 - protein, 15 aa, Borrelia garinii PBi
WLNYADAIITNTSSN

SEQ ID NO: 114289 - protein, 15 aa, Borrelia garinii PBi
LNYADAIITNTSSNS

SEQ ID NO: 114290 - protein, 15 aa, Borrelia garinii PBi
NYADAIITNTSSNSK

SEQ ID NO: 114291 - protein, 15 aa, Borrelia garinii PBi
YADAIITNTSSNSKR

SEQ ID NO: 114292 - protein, 15 aa, Borrelia garinii PBi
ADAIITNTSSNSKRN

SEQ ID NO: 114293 - protein, 15 aa, Borrelia garinii PBi
DAIITNTSSNSKRND

SEQ ID NO: 114294 - protein, 15 aa, Borrelia garinii PBi
AIITNTSSNSKRNDP

SEQ ID NO: 114295 - protein, 15 aa, Borrelia garinii PBi
IITNTSSNSKRNDPQ

SEQ ID NO: 114296 - protein, 15 aa, Borrelia garinii PBi
ITNTSSNSKRNDPQS

SEQ ID NO: 114297 - protein, 15 aa, Borrelia garinii PBi
TNTSSNSKRNDPQSL

SEQ ID NO: 114298 - protein, 15 aa, Borrelia garinii PBi
NTSSNSKRNDPQSLG

SEQ ID NO: 114299 - protein, 15 aa, Borrelia garinii PBi
TSSNSKRNDPQSLGQ

SEQ ID NO: 114300 - protein, 15 aa, Borrelia garinii PBi
SSNSKRNDPQSLGQY

SEQ ID NO: 114301 - protein, 15 aa, Borrelia garinii PBi
SNSKRNDPQSLGQYI

SEQ ID NO: 114302 - protein, 15 aa, Borrelia garinii PBi
NSKRNDPQSLGQYIK

SEQ ID NO: 114303 - protein, 15 aa, Borrelia garinii PBi
SKRNDPQSLGQYIKN

SEQ ID NO: 114304 - protein, 15 aa, Borrelia garinii PBi
KRNDPQSLGQYIKNK

SEQ ID NO: 114305 - protein, 15 aa, Borrelia garinii PBi
RNDPQSLGQYIKNKY

SEQ ID NO: 114306 - protein, 15 aa, Borrelia garinii PBi
NDPQSLGQYIKNKYL

SEQ ID NO: 114307 - protein, 15 aa, Borrelia garinii PBi
DPQSLGQYIKNKYLD

SEQ ID NO: 114308 - protein, 15 aa, Borrelia garinii PBi
PQSLGQYIKNKYLDK

SEQ ID NO: 114309 - protein, 15 aa, Borrelia garinii PBi
QSLGQYIKNKYLDKM

SEQ ID NO: 114310 - protein, 15 aa, Borrelia garinii PBi
SLGQYIKNKYLDKMQ

SEQ ID NO: 114311 - protein, 15 aa, Borrelia garinii PBi
LGQYIKNKYLDKMQD

SEQ ID NO: 114312 - protein, 15 aa, Borrelia garinii PBi
GQYIKNKYLDKMQDA

SEQ ID NO: 114313 - protein, 15 aa, Borrelia garinii PBi
QYIKNKYLDKMQDAR

SEQ ID NO: 114314 - protein, 15 aa, Borrelia garinii PBi
YIKNKYLDKMQDARQ

SEQ ID NO: 114315 - protein, 15 aa, Borrelia garinii PBi
IKNKYLDKMQDARQS

SEQ ID NO: 114316 - protein, 15 aa, Borrelia garinii PBi
KNKYLDKMQDARQSA

SEQ ID NO: 114317 - protein, 15 aa, Borrelia garinii PBi
NKYLDKMQDARQSAL

SEQ ID NO: 114318 - protein, 15 aa, Borrelia garinii PBi
KYLDKMQDARQSALD

SEQ ID NO: 114319 - protein, 15 aa, Borrelia garinii PBi
YLDKMQDARQSALDL

SEQ ID NO: 114320 - protein, 15 aa, Borrelia garinii PBi
LDKMQDARQSALDLY

SEQ ID NO: 114321 - protein, 15 aa, Borrelia garinii PBi
DKMQDARQSALDLYL

SEQ ID NO: 114322 - protein, 15 aa, Borrelia garinii PBi
KMQDARQSALDLYLN

SEQ ID NO: 114323 - protein, 15 aa, Borrelia garinii PBi
MQDARQSALDLYLNI

SEQ ID NO: 114324 - protein, 15 aa, Borrelia garinii PBi
QDARQSALDLYLNIT

SEQ ID NO: 114325 - protein, 15 aa, Borrelia garinii PBi
DARQSALDLYLNITE

SEQ ID NO: 114326 - protein, 15 aa, Borrelia garinii PBi
ARQSALDLYLNITEI

SEQ ID NO: 114327 - protein, 15 aa, Borrelia garinii PBi
RQSALDLYLNITEIR

SEQ ID NO: 114328 - protein, 16 aa, Borrelia garinii PBi
MSSCTIDANLNKDYKN

SEQ ID NO: 114329 - protein, 16 aa, Borrelia garinii PBi
SSCTIDANLNKDYKNK

SEQ ID NO: 114330 - protein, 16 aa, Borrelia garinii PBi
SCTIDANLNKDYKNKV

SEQ ID NO: 114331 - protein, 16 aa, Borrelia garinii PBi
CTIDANLNKDYKNKVE

SEQ ID NO: 114332 - protein, 16 aa, Borrelia garinii PBi
TIDANLNKDYKNKVEE

SEQ ID NO: 114333 - protein, 16 aa, Borrelia garinii PBi
IDANLNKDYKNKVEEL

SEQ ID NO: 114334 - protein, 16 aa, Borrelia garinii PBi
DANLNKDYKNKVEELL

SEQ ID NO: 114335 - protein, 16 aa, Borrelia garinii PBi
ANLNKDYKNKVEELLN

SEQ ID NO: 114336 - protein, 16 aa, Borrelia garinii PBi
NLNKDYKNKVEELLNS

SEQ ID NO: 114337 - protein, 16 aa, Borrelia garinii PBi
LNKDYKNKVEELLNSS

SEQ ID NO: 114338 - protein, 16 aa, Borrelia garinii PBi
NKDYKNKVEELLNSST

SEQ ID NO: 114339 - protein, 16 aa, Borrelia garinii PBi
KDYKNKVEELLNSSTD

SEQ ID NO: 114340 - protein, 16 aa, Borrelia garinii PBi
DYKNKVEELLNSSTDD

SEQ ID NO: 114341 - protein, 16 aa, Borrelia garinii PBi
YKNKVEELLNSSTDDQ

SEQ ID NO: 114342 - protein, 16 aa, Borrelia garinii PBi
KNKVEELLNSSTDDQA

SEQ ID NO: 114343 - protein, 16 aa, Borrelia garinii PBi
NKVEELLNSSTDDQAK

SEQ ID NO: 114344 - protein, 16 aa, Borrelia garinii PBi
KVEELLNSSTDDQAKI

SEQ ID NO: 114345 - protein, 16 aa, Borrelia garinii PBi
VEELLNSSTDDQAKIS

SEQ ID NO: 114346 - protein, 16 aa, Borrelia garinii PBi
EELLNSSTDDQAKISI

SEQ ID NO: 114347 - protein, 16 aa, Borrelia garinii PBi
ELLNSSTDDQAKISIN

SEQ ID NO: 114348 - protein, 16 aa, Borrelia garinii PBi
LLNSSTDDQAKISINT

SEQ ID NO: 114349 - protein, 16 aa, Borrelia garinii PBi
LNSSTDDQAKISINTG

SEQ ID NO: 114350 - protein, 16 aa, Borrelia garinii PBi
NSSTDDQAKISINTGS

SEQ ID NO: 114351 - protein, 16 aa, Borrelia garinii PBi
SSTDDQAKISINTGSN

SEQ ID NO: 114352 - protein, 16 aa, Borrelia garinii PBi
STDDQAKISINTGSNA

SEQ ID NO: 114353 - protein, 16 aa, Borrelia garinii PBi
TDDQAKISINTGSNAT

SEQ ID NO: 114354 - protein, 16 aa, Borrelia garinii PBi
DDQAKISINTGSNATK

SEQ ID NO: 114355 - protein, 16 aa, Borrelia garinii PBi
DQAKISINTGSNATKN

SEQ ID NO: 114356 - protein, 16 aa, Borrelia garinii PBi
QAKISINTGSNATKNK

SEQ ID NO: 114357 - protein, 16 aa, Borrelia garinii PBi
AKISINTGSNATKNKT

SEQ ID NO: 114358 - protein, 16 aa, Borrelia garinii PBi
KISINTGSNATKNKTN

SEQ ID NO: 114359 - protein, 16 aa, Borrelia garinii PBi
ISINTGSNATKNKTNI

SEQ ID NO: 114360 - protein, 16 aa, Borrelia garinii PBi
SINTGSNATKNKTNIK

SEQ ID NO: 114361 - protein, 16 aa, Borrelia garinii PBi
INTGSNATKNKTNIKV

SEQ ID NO: 114362 - protein, 16 aa, Borrelia garinii PBi
NTGSNATKNKTNIKVA

SEQ ID NO: 114363 - protein, 16 aa, Borrelia garinii PBi
TGSNATKNKTNIKVAG

SEQ ID NO: 114364 - protein, 16 aa, Borrelia garinii PBi
GSNATKNKTNIKVAGL

SEQ ID NO: 114365 - protein, 16 aa, Borrelia garinii PBi
SNATKNKTNIKVAGLQ

SEQ ID NO: 114366 - protein, 16 aa, Borrelia garinii PBi
NATKNKTNIKVAGLQK

SEQ ID NO: 114367 - protein, 16 aa, Borrelia garinii PBi
ATKNKTNIKVAGLQKN

SEQ ID NO: 114368 - protein, 16 aa, Borrelia garinii PBi
TKNKTNIKVAGLQKNT

SEQ ID NO: 114369 - protein, 16 aa, Borrelia garinii PBi
KNKTNIKVAGLQKNTQ

SEQ ID NO: 114370 - protein, 16 aa, Borrelia garinii PBi
NKTNIKVAGLQKNTQS

SEQ ID NO: 114371 - protein, 16 aa, Borrelia garinii PBi
KTNIKVAGLQKNTQSK

SEQ ID NO: 114372 - protein, 16 aa, Borrelia garinii PBi
TNIKVAGLQKNTQSKK

SEQ ID NO: 114373 - protein, 16 aa, Borrelia garinii PBi
NIKVAGLQKNTQSKKN

SEQ ID NO: 114374 - protein, 16 aa, Borrelia garinii PBi
IKVAGLQKNTQSKKNN

SEQ ID NO: 114375 - protein, 16 aa, Borrelia garinii PBi
KVAGLQKNTQSKKNNN

SEQ ID NO: 114376 - protein, 16 aa, Borrelia garinii PBi
VAGLQKNTQSKKNNNL

SEQ ID NO: 114377 - protein, 16 aa, Borrelia garinii PBi
AGLQKNTQSKKNNNLQ

SEQ ID NO: 114378 - protein, 16 aa, Borrelia garinii PBi
GLQKNTQSKKNNNLQG

SEQ ID NO: 114379 - protein, 16 aa, Borrelia garinii PBi
LQKNTQSKKNNNLQGL

SEQ ID NO: 114380 - protein, 16 aa, Borrelia garinii PBi
QKNTQSKKNNNLQGLN

SEQ ID NO: 114381 - protein, 16 aa, Borrelia garinii PBi
KNTQSKKNNNLQGLNP

SEQ ID NO: 114382 - protein, 16 aa, Borrelia garinii PBi
NTQSKKNNNLQGLNPA

SEQ ID NO: 114383 - protein, 16 aa, Borrelia garinii PBi
TQSKKNNNLQGLNPAN

SEQ ID NO: 114384 - protein, 16 aa, Borrelia garinii PBi
QSKKNNNLQGLNPANQ

SEQ ID NO: 114385 - protein, 16 aa, Borrelia garinii PBi
SKKNNNLQGLNPANQV

SEQ ID NO: 114386 - protein, 16 aa, Borrelia garinii PBi
KKNNNLQGLNPANQVN

SEQ ID NO: 114387 - protein, 16 aa, Borrelia garinii PBi
KNNNLQGLNPANQVNP

SEQ ID NO: 114388 - protein, 16 aa, Borrelia garinii PBi
NNNLQGLNPANQVNPG

SEQ ID NO: 114389 - protein, 16 aa, Borrelia garinii PBi
NNLQGLNPANQVNPGN

SEQ ID NO: 114390 - protein, 16 aa, Borrelia garinii PBi
NLQGLNPANQVNPGNP

SEQ ID NO: 114391 - protein, 16 aa, Borrelia garinii PBi
LQGLNPANQVNPGNPM

SEQ ID NO: 114392 - protein, 16 aa, Borrelia garinii PBi
QGLNPANQVNPGNPMQ

SEQ ID NO: 114393 - protein, 16 aa, Borrelia garinii PBi
GLNPANQVNPGNPMQI

SEQ ID NO: 114394 - protein, 16 aa, Borrelia garinii PBi
LNPANQVNPGNPMQIA

SEQ ID NO: 114395 - protein, 16 aa, Borrelia garinii PBi
NPANQVNPGNPMQIAN

SEQ ID NO: 114396 - protein, 16 aa, Borrelia garinii PBi
PANQVNPGNPMQIANQ

SEQ ID NO: 114397 - protein, 16 aa, Borrelia garinii PBi
ANQVNPGNPMQIANQA

SEQ ID NO: 114398 - protein, 16 aa, Borrelia garinii PBi
NQVNPGNPMQIANQAN

SEQ ID NO: 114399 - protein, 16 aa, Borrelia garinii PBi
QVNPGNPMQIANQANQ

SEQ ID NO: 114400 - protein, 16 aa, Borrelia garinii PBi
VNPGNPMQIANQANQA

SEQ ID NO: 114401 - protein, 16 aa, Borrelia garinii PBi
NPGNPMQIANQANQAN

SEQ ID NO: 114402 - protein, 16 aa, Borrelia garinii PBi
PGNPMQIANQANQANQ

SEQ ID NO: 114403 - protein, 16 aa, Borrelia garinii PBi
GNPMQIANQANQANQA

SEQ ID NO: 114404 - protein, 16 aa, Borrelia garinii PBi
NPMQIANQANQANQAN

SEQ ID NO: 114405 - protein, 16 aa, Borrelia garinii PBi
PMQIANQANQANQANQ

SEQ ID NO: 114406 - protein, 16 aa, Borrelia garinii PBi
MQIANQANQANQANQA

SEQ ID NO: 114407 - protein, 16 aa, Borrelia garinii PBi
QIANQANQANQANQAN

SEQ ID NO: 114408 - protein, 16 aa, Borrelia garinii PBi
IANQANQANQANQANQ

SEQ ID NO: 114409 - protein, 16 aa, Borrelia garinii PBi
ANQANQANQANQANQA

SEQ ID NO: 114410 - protein, 16 aa, Borrelia garinii PBi
NQANQANQANQANQAN

SEQ ID NO: 114411 - protein, 16 aa, Borrelia garinii PBi
QANQANQANQANQANQ

SEQ ID NO: 114412 - protein, 16 aa, Borrelia garinii PBi
ANQANQANQANQANQA

SEQ ID NO: 114413 - protein, 16 aa, Borrelia garinii PBi
NQANQANQANQANQAS

SEQ ID NO: 114414 - protein, 16 aa, Borrelia garinii PBi
QANQANQANQANQASQ

SEQ ID NO: 114415 - protein, 16 aa, Borrelia garinii PBi
ANQANQANQANQASQA

SEQ ID NO: 114416 - protein, 16 aa, Borrelia garinii PBi
NQANQANQANQASQAS

SEQ ID NO: 114417 - protein, 16 aa, Borrelia garinii PBi
QANQANQANQASQASQ

SEQ ID NO: 114418 - protein, 16 aa, Borrelia garinii PBi
ANQANQANQASQASQA

SEQ ID NO: 114419 - protein, 16 aa, Borrelia garinii PBi
NQANQANQASQASQAS

SEQ ID NO: 114420 - protein, 16 aa, Borrelia garinii PBi
QANQANQASQASQASQ

SEQ ID NO: 114421 - protein, 16 aa, Borrelia garinii PBi
ANQANQASQASQASQV

SEQ ID NO: 114422 - protein, 16 aa, Borrelia garinii PBi
NQANQASQASQASQVA

SEQ ID NO: 114423 - protein, 16 aa, Borrelia garinii PBi
QANQASQASQASQVAS

SEQ ID NO: 114424 - protein, 16 aa, Borrelia garinii PBi
ANQASQASQASQVASS

SEQ ID NO: 114425 - protein, 16 aa, Borrelia garinii PBi
NQASQASQASQVASSA

SEQ ID NO: 114426 - protein, 16 aa, Borrelia garinii PBi
QASQASQASQVASSAS

SEQ ID NO: 114427 - protein, 16 aa, Borrelia garinii PBi
ASQASQASQVASSASQ

SEQ ID NO: 114428 - protein, 16 aa, Borrelia garinii PBi
SQASQASQVASSASQA

SEQ ID NO: 114429 - protein, 16 aa, Borrelia garinii PBi
QASQASQVASSASQAS

SEQ ID NO: 114430 - protein, 16 aa, Borrelia garinii PBi
ASQASQVASSASQASP

SEQ ID NO: 114431 - protein, 16 aa, Borrelia garinii PBi
SQASQVASSASQASPV

SEQ ID NO: 114432 - protein, 16 aa, Borrelia garinii PBi
QASQVASSASQASPVA

SEQ ID NO: 114433 - protein, 16 aa, Borrelia garinii PBi
ASQVASSASQASPVAS

SEQ ID NO: 114434 - protein, 16 aa, Borrelia garinii PBi
SQVASSASQASPVASP

SEQ ID NO: 114435 - protein, 16 aa, Borrelia garinii PBi
QVASSASQASPVASPA

SEQ ID NO: 114436 - protein, 16 aa, Borrelia garinii PBi
VASSASQASPVASPAT

SEQ ID NO: 114437 - protein, 16 aa, Borrelia garinii PBi
ASSASQASPVASPATN

SEQ ID NO: 114438 - protein, 16 aa, Borrelia garinii PBi
SSASQASPVASPATNV

SEQ ID NO: 114439 - protein, 16 aa, Borrelia garinii PBi
SASQASPVASPATNVQ

SEQ ID NO: 114440 - protein, 16 aa, Borrelia garinii PBi
ASQASPVASPATNVQA

SEQ ID NO: 114441 - protein, 16 aa, Borrelia garinii PBi
SQASPVASPATNVQAT

SEQ ID NO: 114442 - protein, 16 aa, Borrelia garinii PBi
QASPVASPATNVQATP

SEQ ID NO: 114443 - protein, 16 aa, Borrelia garinii PBi
ASPVASPATNVQATPP

SEQ ID NO: 114444 - protein, 16 aa, Borrelia garinii PBi
SPVASPATNVQATPPK

SEQ ID NO: 114445 - protein, 16 aa, Borrelia garinii PBi
PVASPATNVQATPPKQ

SEQ ID NO: 114446 - protein, 16 aa, Borrelia garinii PBi
VASPATNVQATPPKQI

SEQ ID NO: 114447 - protein, 16 aa, Borrelia garinii PBi
ASPATNVQATPPKQIA

SEQ ID NO: 114448 - protein, 16 aa, Borrelia garinii PBi
SPATNVQATPPKQIAS

SEQ ID NO: 114449 - protein, 16 aa, Borrelia garinii PBi
PATNVQATPPKQIASA

SEQ ID NO: 114450 - protein, 16 aa, Borrelia garinii PBi
ATNVQATPPKQIASAQ

SEQ ID NO: 114451 - protein, 16 aa, Borrelia garinii PBi
TNVQATPPKQIASAQA

SEQ ID NO: 114452 - protein, 16 aa, Borrelia garinii PBi
NVQATPPKQIASAQAI

SEQ ID NO: 114453 - protein, 16 aa, Borrelia garinii PBi
VQATPPKQIASAQAIQ

SEQ ID NO: 114454 - protein, 16 aa, Borrelia garinii PBi
QATPPKQIASAQAIQT

SEQ ID NO: 114455 - protein, 16 aa, Borrelia garinii PBi
ATPPKQIASAQAIQTV

SEQ ID NO: 114456 - protein, 16 aa, Borrelia garinii PBi
TPPKQIASAQAIQTVP

SEQ ID NO: 114457 - protein, 16 aa, Borrelia garinii PBi
PPKQIASAQAIQTVPN

SEQ ID NO: 114458 - protein, 16 aa, Borrelia garinii PBi
PKQIASAQAIQTVPNN

SEQ ID NO: 114459 - protein, 16 aa, Borrelia garinii PBi
KQIASAQAIQTVPNNT

SEQ ID NO: 114460 - protein, 16 aa, Borrelia garinii PBi
QIASAQAIQTVPNNTS

SEQ ID NO: 114461 - protein, 16 aa, Borrelia garinii PBi
IASAQAIQTVPNNTST

SEQ ID NO: 114462 - protein, 16 aa, Borrelia garinii PBi
ASAQAIQTVPNNTSTP

SEQ ID NO: 114463 - protein, 16 aa, Borrelia garinii PBi
SAQAIQTVPNNTSTPN

SEQ ID NO: 114464 - protein, 16 aa, Borrelia garinii PBi
AQAIQTVPNNTSTPNQ

SEQ ID NO: 114465 - protein, 16 aa, Borrelia garinii PBi
QAIQTVPNNTSTPNQS

SEQ ID NO: 114466 - protein, 16 aa, Borrelia garinii PBi
AIQTVPNNTSTPNQSI

SEQ ID NO: 114467 - protein, 16 aa, Borrelia garinii PBi
IQTVPNNTSTPNQSII

SEQ ID NO: 114468 - protein, 16 aa, Borrelia garinii PBi
QTVPNNTSTPNQSIIK

SEQ ID NO: 114469 - protein, 16 aa, Borrelia garinii PBi
TVPNNTSTPNQSIIKP

SEQ ID NO: 114470 - protein, 16 aa, Borrelia garinii PBi
VPNNTSTPNQSIIKPQ

SEQ ID NO: 114471 - protein, 16 aa, Borrelia garinii PBi
PNNTSTPNQSIIKPQQ

SEQ ID NO: 114472 - protein, 16 aa, Borrelia garinii PBi
NNTSTPNQSIIKPQQY

SEQ ID NO: 114473 - protein, 16 aa, Borrelia garinii PBi
NTSTPNQSIIKPQQYT

SEQ ID NO: 114474 - protein, 16 aa, Borrelia garinii PBi
TSTPNQSIIKPQQYTF

SEQ ID NO: 114475 - protein, 16 aa, Borrelia garinii PBi
STPNQSIIKPQQYTFS

SEQ ID NO: 114476 - protein, 16 aa, Borrelia garinii PBi
TPNQSIIKPQQYTFSS

SEQ ID NO: 114477 - protein, 16 aa, Borrelia garinii PBi
PNQSIIKPQQYTFSSS

SEQ ID NO: 114478 - protein, 16 aa, Borrelia garinii PBi
NQSIIKPQQYTFSSSF

SEQ ID NO: 114479 - protein, 16 aa, Borrelia garinii PBi
QSIIKPQQYTFSSSFS

SEQ ID NO: 114480 - protein, 16 aa, Borrelia garinii PBi
SIIKPQQYTFSSSFSQ

SEQ ID NO: 114481 - protein, 16 aa, Borrelia garinii PBi
IIKPQQYTFSSSFSQP

SEQ ID NO: 114482 - protein, 16 aa, Borrelia garinii PBi
IKPQQYTFSSSFSQPT

SEQ ID NO: 114483 - protein, 16 aa, Borrelia garinii PBi
KPQQYTFSSSFSQPTS

SEQ ID NO: 114484 - protein, 16 aa, Borrelia garinii PBi
PQQYTFSSSFSQPTSQ

SEQ ID NO: 114485 - protein, 16 aa, Borrelia garinii PBi
QQYTFSSSFSQPTSQT

SEQ ID NO: 114486 - protein, 16 aa, Borrelia garinii PBi
QYTFSSSFSQPTSQTN

SEQ ID NO: 114487 - protein, 16 aa, Borrelia garinii PBi
YTFSSSFSQPTSQTNF

SEQ ID NO: 114488 - protein, 16 aa, Borrelia garinii PBi
TFSSSFSQPTSQTNFN

SEQ ID NO: 114489 - protein, 16 aa, Borrelia garinii PBi
FSSSFSQPTSQTNFNN

SEQ ID NO: 114490 - protein, 16 aa, Borrelia garinii PBi
SSSFSQPTSQTNFNNS

SEQ ID NO: 114491 - protein, 16 aa, Borrelia garinii PBi
SSFSQPTSQTNFNNSQ

SEQ ID NO: 114492 - protein, 16 aa, Borrelia garinii PBi
SFSQPTSQTNFNNSQS

SEQ ID NO: 114493 - protein, 16 aa, Borrelia garinii PBi
FSQPTSQTNFNNSQSN

SEQ ID NO: 114494 - protein, 16 aa, Borrelia garinii PBi
SQPTSQTNFNNSQSNN

SEQ ID NO: 114495 - protein, 16 aa, Borrelia garinii PBi
QPTSQTNFNNSQSNNV

SEQ ID NO: 114496 - protein, 16 aa, Borrelia garinii PBi
PTSQTNFNNSQSNNVL

SEQ ID NO: 114497 - protein, 16 aa, Borrelia garinii PBi
TSQTNFNNSQSNNVLT

SEQ ID NO: 114498 - protein, 16 aa, Borrelia garinii PBi
SQTNFNNSQSNNVLTN

SEQ ID NO: 114499 - protein, 16 aa, Borrelia garinii PBi
QTNFNNSQSNNVLTNY

SEQ ID NO: 114500 - protein, 16 aa, Borrelia garinii PBi
TNFNNSQSNNVLTNYR

SEQ ID NO: 114501 - protein, 16 aa, Borrelia garinii PBi
NFNNSQSNNVLTNYRH

SEQ ID NO: 114502 - protein, 16 aa, Borrelia garinii PBi
FNNSQSNNVLTNYRHQ

SEQ ID NO: 114503 - protein, 16 aa, Borrelia garinii PBi
NNSQSNNVLTNYRHQT

SEQ ID NO: 114504 - protein, 16 aa, Borrelia garinii PBi
NSQSNNVLTNYRHQTQ

SEQ ID NO: 114505 - protein, 16 aa, Borrelia garinii PBi
SQSNNVLTNYRHQTQP

SEQ ID NO: 114506 - protein, 16 aa, Borrelia garinii PBi
QSNNVLTNYRHQTQPS

SEQ ID NO: 114507 - protein, 16 aa, Borrelia garinii PBi
SNNVLTNYRHQTQPSF

SEQ ID NO: 114508 - protein, 16 aa, Borrelia garinii PBi
NNVLTNYRHQTQPSFV

SEQ ID NO: 114509 - protein, 16 aa, Borrelia garinii PBi
NVLTNYRHQTQPSFVV

SEQ ID NO: 114510 - protein, 16 aa, Borrelia garinii PBi
VLTNYRHQTQPSFVVP

SEQ ID NO: 114511 - protein, 16 aa, Borrelia garinii PBi
LTNYRHQTQPSFVVPV

SEQ ID NO: 114512 - protein, 16 aa, Borrelia garinii PBi
TNYRHQTQPSFVVPVY

SEQ ID NO: 114513 - protein, 16 aa, Borrelia garinii PBi
NYRHQTQPSFVVPVYS

SEQ ID NO: 114514 - protein, 16 aa, Borrelia garinii PBi
YRHQTQPSFVVPVYSG

SEQ ID NO: 114515 - protein, 16 aa, Borrelia garinii PBi
RHQTQPSFVVPVYSGN

SEQ ID NO: 114516 - protein, 16 aa, Borrelia garinii PBi
HQTQPSFVVPVYSGNS

SEQ ID NO: 114517 - protein, 16 aa, Borrelia garinii PBi
QTQPSFVVPVYSGNSP

SEQ ID NO: 114518 - protein, 16 aa, Borrelia garinii PBi
TQPSFVVPVYSGNSPL

SEQ ID NO: 114519 - protein, 16 aa, Borrelia garinii PBi
QPSFVVPVYSGNSPLQ

SEQ ID NO: 114520 - protein, 16 aa, Borrelia garinii PBi
PSFVVPVYSGNSPLQK

SEQ ID NO: 114521 - protein, 16 aa, Borrelia garinii PBi
SFVVPVYSGNSPLQKL

SEQ ID NO: 114522 - protein, 16 aa, Borrelia garinii PBi
FVVPVYSGNSPLQKLK

SEQ ID NO: 114523 - protein, 16 aa, Borrelia garinii PBi
VVPVYSGNSPLQKLKN

SEQ ID NO: 114524 - protein, 16 aa, Borrelia garinii PBi
VPVYSGNSPLQKLKNN

SEQ ID NO: 114525 - protein, 16 aa, Borrelia garinii PBi
PVYSGNSPLQKLKNNL

SEQ ID NO: 114526 - protein, 16 aa, Borrelia garinii PBi
VYSGNSPLQKLKNNLL

SEQ ID NO: 114527 - protein, 16 aa, Borrelia garinii PBi
YSGNSPLQKLKNNLLR

SEQ ID NO: 114528 - protein, 16 aa, Borrelia garinii PBi
SGNSPLQKLKNNLLRR

SEQ ID NO: 114529 - protein, 16 aa, Borrelia garinii PBi
GNSPLQKLKNNLLRRI

SEQ ID NO: 114530 - protein, 16 aa, Borrelia garinii PBi
NSPLQKLKNNLLRRIA

SEQ ID NO: 114531 - protein, 16 aa, Borrelia garinii PBi
SPLQKLKNNLLRRIAE

SEQ ID NO: 114532 - protein, 16 aa, Borrelia garinii PBi
PLQKLKNNLLRRIAEE

SEQ ID NO: 114533 - protein, 16 aa, Borrelia garinii PBi
LQKLKNNLLRRIAEEK

SEQ ID NO: 114534 - protein, 16 aa, Borrelia garinii PBi
QKLKNNLLRRIAEEKN

SEQ ID NO: 114535 - protein, 16 aa, Borrelia garinii PBi
KLKNNLLRRIAEEKNK

SEQ ID NO: 114536 - protein, 16 aa, Borrelia garinii PBi
LKNNLLRRIAEEKNKT

SEQ ID NO: 114537 - protein, 16 aa, Borrelia garinii PBi
KNNLLRRIAEEKNKTH

SEQ ID NO: 114538 - protein, 16 aa, Borrelia garinii PBi
NNLLRRIAEEKNKTHN

SEQ ID NO: 114539 - protein, 16 aa, Borrelia garinii PBi
NLLRRIAEEKNKTHNH

SEQ ID NO: 114540 - protein, 16 aa, Borrelia garinii PBi
LLRRIAEEKNKTHNHG

SEQ ID NO: 114541 - protein, 16 aa, Borrelia garinii PBi
LRRIAEEKNKTHNHGF

SEQ ID NO: 114542 - protein, 16 aa, Borrelia garinii PBi
RRIAEEKNKTHNHGFR

SEQ ID NO: 114543 - protein, 16 aa, Borrelia garinii PBi
RIAEEKNKTHNHGFRE

SEQ ID NO: 114544 - protein, 16 aa, Borrelia garinii PBi
IAEEKNKTHNHGFRET

SEQ ID NO: 114545 - protein, 16 aa, Borrelia garinii PBi
AEEKNKTHNHGFRETY

SEQ ID NO: 114546 - protein, 16 aa, Borrelia garinii PBi
EEKNKTHNHGFRETYD

SEQ ID NO: 114547 - protein, 16 aa, Borrelia garinii PBi
EKNKTHNHGFRETYDQ

SEQ ID NO: 114548 - protein, 16 aa, Borrelia garinii PBi
KNKTHNHGFRETYDQF

SEQ ID NO: 114549 - protein, 16 aa, Borrelia garinii PBi
NKTHNHGFRETYDQFK

SEQ ID NO: 114550 - protein, 16 aa, Borrelia garinii PBi
KTHNHGFRETYDQFKM

SEQ ID NO: 114551 - protein, 16 aa, Borrelia garinii PBi
THNHGFRETYDQFKMK

SEQ ID NO: 114552 - protein, 16 aa, Borrelia garinii PBi
HNHGFRETYDQFKMKD

SEQ ID NO: 114553 - protein, 16 aa, Borrelia garinii PBi
NHGFRETYDQFKMKDS

SEQ ID NO: 114554 - protein, 16 aa, Borrelia garinii PBi
HGFRETYDQFKMKDSA

SEQ ID NO: 114555 - protein, 16 aa, Borrelia garinii PBi
GFRETYDQFKMKDSAF

SEQ ID NO: 114556 - protein, 16 aa, Borrelia garinii PBi
FRETYDQFKMKDSAFT

SEQ ID NO: 114557 - protein, 16 aa, Borrelia garinii PBi
RETYDQFKMKDSAFTL

SEQ ID NO: 114558 - protein, 16 aa, Borrelia garinii PBi
ETYDQFKMKDSAFTLL

SEQ ID NO: 114559 - protein, 16 aa, Borrelia garinii PBi
TYDQFKMKDSAFTLLD

SEQ ID NO: 114560 - protein, 16 aa, Borrelia garinii PBi
YDQFKMKDSAFTLLDV

SEQ ID NO: 114561 - protein, 16 aa, Borrelia garinii PBi
DQFKMKDSAFTLLDVI

SEQ ID NO: 114562 - protein, 16 aa, Borrelia garinii PBi
QFKMKDSAFTLLDVIS

SEQ ID NO: 114563 - protein, 16 aa, Borrelia garinii PBi
FKMKDSAFTLLDVISN

SEQ ID NO: 114564 - protein, 16 aa, Borrelia garinii PBi
KMKDSAFTLLDVISNI

SEQ ID NO: 114565 - protein, 16 aa, Borrelia garinii PBi
MKDSAFTLLDVISNIS

SEQ ID NO: 114566 - protein, 16 aa, Borrelia garinii PBi
KDSAFTLLDVISNISV

SEQ ID NO: 114567 - protein, 16 aa, Borrelia garinii PBi
DSAFTLLDVISNISVF

SEQ ID NO: 114568 - protein, 16 aa, Borrelia garinii PBi
SAFTLLDVISNISVFD

SEQ ID NO: 114569 - protein, 16 aa, Borrelia garinii PBi
AFTLLDVISNISVFDR

SEQ ID NO: 114570 - protein, 16 aa, Borrelia garinii PBi
FTLLDVISNISVFDRG

SEQ ID NO: 114571 - protein, 16 aa, Borrelia garinii PBi
TLLDVISNISVFDRGS

SEQ ID NO: 114572 - protein, 16 aa, Borrelia garinii PBi
LLDVISNISVFDRGSA

SEQ ID NO: 114573 - protein, 16 aa, Borrelia garinii PBi
LDVISNISVFDRGSAP

SEQ ID NO: 114574 - protein, 16 aa, Borrelia garinii PBi
DVISNISVFDRGSAPQ

SEQ ID NO: 114575 - protein, 16 aa, Borrelia garinii PBi
VISNISVFDRGSAPQL

SEQ ID NO: 114576 - protein, 16 aa, Borrelia garinii PBi
ISNISVFDRGSAPQLS

SEQ ID NO: 114577 - protein, 16 aa, Borrelia garinii PBi
SNISVFDRGSAPQLSS

SEQ ID NO: 114578 - protein, 16 aa, Borrelia garinii PBi
NISVFDRGSAPQLSSN

SEQ ID NO: 114579 - protein, 16 aa, Borrelia garinii PBi
ISVFDRGSAPQLSSNT

SEQ ID NO: 114580 - protein, 16 aa, Borrelia garinii PBi
SVFDRGSAPQLSSNTP

SEQ ID NO: 114581 - protein, 16 aa, Borrelia garinii PBi
VFDRGSAPQLSSNTPE

SEQ ID NO: 114582 - protein, 16 aa, Borrelia garinii PBi
FDRGSAPQLSSNTPEA

SEQ ID NO: 114583 - protein, 16 aa, Borrelia garinii PBi
DRGSAPQLSSNTPEAE

SEQ ID NO: 114584 - protein, 16 aa, Borrelia garinii PBi
RGSAPQLSSNTPEAES

SEQ ID NO: 114585 - protein, 16 aa, Borrelia garinii PBi
GSAPQLSSNTPEAESE

SEQ ID NO: 114586 - protein, 16 aa, Borrelia garinii PBi
SAPQLSSNTPEAESER

SEQ ID NO: 114587 - protein, 16 aa, Borrelia garinii PBi
APQLSSNTPEAESERN

SEQ ID NO: 114588 - protein, 16 aa, Borrelia garinii PBi
PQLSSNTPEAESERNR

SEQ ID NO: 114589 - protein, 16 aa, Borrelia garinii PBi
QLSSNTPEAESERNRL

SEQ ID NO: 114590 - protein, 16 aa, Borrelia garinii PBi
LSSNTPEAESERNRLY

SEQ ID NO: 114591 - protein, 16 aa, Borrelia garinii PBi
SSNTPEAESERNRLYA

SEQ ID NO: 114592 - protein, 16 aa, Borrelia garinii PBi
SNTPEAESERNRLYAM

SEQ ID NO: 114593 - protein, 16 aa, Borrelia garinii PBi
NTPEAESERNRLYAMM

SEQ ID NO: 114594 - protein, 16 aa, Borrelia garinii PBi
TPEAESERNRLYAMMD

SEQ ID NO: 114595 - protein, 16 aa, Borrelia garinii PBi
PEAESERNRLYAMMDF

SEQ ID NO: 114596 - protein, 16 aa, Borrelia garinii PBi
EAESERNRLYAMMDFD

SEQ ID NO: 114597 - protein, 16 aa, Borrelia garinii PBi
AESERNRLYAMMDFDQ

SEQ ID NO: 114598 - protein, 16 aa, Borrelia garinii PBi
ESERNRLYAMMDFDQA

SEQ ID NO: 114599 - protein, 16 aa, Borrelia garinii PBi
SERNRLYAMMDFDQAK

SEQ ID NO: 114600 - protein, 16 aa, Borrelia garinii PBi
ERNRLYAMMDFDQAKT

SEQ ID NO: 114601 - protein, 16 aa, Borrelia garinii PBi
RNRLYAMMDFDQAKTT

SEQ ID NO: 114602 - protein, 16 aa, Borrelia garinii PBi
NRLYAMMDFDQAKTTE

SEQ ID NO: 114603 - protein, 16 aa, Borrelia garinii PBi
RLYAMMDFDQAKTTEF

SEQ ID NO: 114604 - protein, 16 aa, Borrelia garinii PBi
LYAMMDFDQAKTTEFG

SEQ ID NO: 114605 - protein, 16 aa, Borrelia garinii PBi
YAMMDFDQAKTTEFGS

SEQ ID NO: 114606 - protein, 16 aa, Borrelia garinii PBi
AMMDFDQAKTTEFGSI

SEQ ID NO: 114607 - protein, 16 aa, Borrelia garinii PBi
MMDFDQAKTTEFGSIM

SEQ ID NO: 114608 - protein, 16 aa, Borrelia garinii PBi
MDFDQAKTTEFGSIMN

SEQ ID NO: 114609 - protein, 16 aa, Borrelia garinii PBi
DFDQAKTTEFGSIMNI

SEQ ID NO: 114610 - protein, 16 aa, Borrelia garinii PBi
FDQAKTTEFGSIMNIL

SEQ ID NO: 114611 - protein, 16 aa, Borrelia garinii PBi
DQAKTTEFGSIMNILY

SEQ ID NO: 114612 - protein, 16 aa, Borrelia garinii PBi
QAKTTEFGSIMNILYQ

SEQ ID NO: 114613 - protein, 16 aa, Borrelia garinii PBi
AKTTEFGSIMNILYQE

SEQ ID NO: 114614 - protein, 16 aa, Borrelia garinii PBi
KTTEFGSIMNILYQEN

SEQ ID NO: 114615 - protein, 16 aa, Borrelia garinii PBi
TTEFGSIMNILYQENQ

SEQ ID NO: 114616 - protein, 16 aa, Borrelia garinii PBi
TEFGSIMNILYQENQN

SEQ ID NO: 114617 - protein, 16 aa, Borrelia garinii PBi
EFGSIMNILYQENQNH

SEQ ID NO: 114618 - protein, 16 aa, Borrelia garinii PBi
FGSIMNILYQENQNHS

SEQ ID NO: 114619 - protein, 16 aa, Borrelia garinii PBi
GSIMNILYQENQNHSL

SEQ ID NO: 114620 - protein, 16 aa, Borrelia garinii PBi
SIMNILYQENQNHSLI

SEQ ID NO: 114621 - protein, 16 aa, Borrelia garinii PBi
IMNILYQENQNHSLIR

SEQ ID NO: 114622 - protein, 16 aa, Borrelia garinii PBi
MNILYQENQNHSLIRS

SEQ ID NO: 114623 - protein, 16 aa, Borrelia garinii PBi
NILYQENQNHSLIRSL

SEQ ID NO: 114624 - protein, 16 aa, Borrelia garinii PBi
ILYQENQNHSLIRSLI

SEQ ID NO: 114625 - protein, 16 aa, Borrelia garinii PBi
LYQENQNHSLIRSLII

SEQ ID NO: 114626 - protein, 16 aa, Borrelia garinii PBi
YQENQNHSLIRSLIIS

SEQ ID NO: 114627 - protein, 16 aa, Borrelia garinii PBi
QENQNHSLIRSLIISG

SEQ ID NO: 114628 - protein, 16 aa, Borrelia garinii PBi
ENQNHSLIRSLIISGL

SEQ ID NO: 114629 - protein, 16 aa, Borrelia garinii PBi
NQNHSLIRSLIISGLG

SEQ ID NO: 114630 - protein, 16 aa, Borrelia garinii PBi
QNHSLIRSLIISGLGI

SEQ ID NO: 114631 - protein, 16 aa, Borrelia garinii PBi
NHSLIRSLIISGLGIQ

SEQ ID NO: 114632 - protein, 16 aa, Borrelia garinii PBi
HSLIRSLIISGLGIQI

SEQ ID NO: 114633 - protein, 16 aa, Borrelia garinii PBi
SLIRSLIISGLGIQIS

SEQ ID NO: 114634 - protein, 16 aa, Borrelia garinii PBi
LIRSLIISGLGIQISL

SEQ ID NO: 114635 - protein, 16 aa, Borrelia garinii PBi
IRSLIISGLGIQISLE

SEQ ID NO: 114636 - protein, 16 aa, Borrelia garinii PBi
RSLIISGLGIQISLES

SEQ ID NO: 114637 - protein, 16 aa, Borrelia garinii PBi
SLIISGLGIQISLEST

SEQ ID NO: 114638 - protein, 16 aa, Borrelia garinii PBi
LIISGLGIQISLESTL

SEQ ID NO: 114639 - protein, 16 aa, Borrelia garinii PBi
IISGLGIQISLESTLE

SEQ ID NO: 114640 - protein, 16 aa, Borrelia garinii PBi
ISGLGIQISLESTLEE

SEQ ID NO: 114641 - protein, 16 aa, Borrelia garinii PBi
SGLGIQISLESTLEEI

SEQ ID NO: 114642 - protein, 16 aa, Borrelia garinii PBi
GLGIQISLESTLEEIE

SEQ ID NO: 114643 - protein, 16 aa, Borrelia garinii PBi
LGIQISLESTLEEIEK

SEQ ID NO: 114644 - protein, 16 aa, Borrelia garinii PBi
GIQISLESTLEEIEKK

SEQ ID NO: 114645 - protein, 16 aa, Borrelia garinii PBi
IQISLESTLEEIEKKI

SEQ ID NO: 114646 - protein, 16 aa, Borrelia garinii PBi
QISLESTLEEIEKKIE

SEQ ID NO: 114647 - protein, 16 aa, Borrelia garinii PBi
ISLESTLEEIEKKIES

SEQ ID NO: 114648 - protein, 16 aa, Borrelia garinii PBi
SLESTLEEIEKKIESF

SEQ ID NO: 114649 - protein, 16 aa, Borrelia garinii PBi
LESTLEEIEKKIESFN

SEQ ID NO: 114650 - protein, 16 aa, Borrelia garinii PBi
ESTLEEIEKKIESFNT

SEQ ID NO: 114651 - protein, 16 aa, Borrelia garinii PBi
STLEEIEKKIESFNTQ

SEQ ID NO: 114652 - protein, 16 aa, Borrelia garinii PBi
TLEEIEKKIESFNTQY

SEQ ID NO: 114653 - protein, 16 aa, Borrelia garinii PBi
LEEIEKKIESFNTQYL

SEQ ID NO: 114654 - protein, 16 aa, Borrelia garinii PBi
EEIEKKIESFNTQYLN

SEQ ID NO: 114655 - protein, 16 aa, Borrelia garinii PBi
EIEKKIESFNTQYLNT

SEQ ID NO: 114656 - protein, 16 aa, Borrelia garinii PBi
IEKKIESFNTQYLNTI

SEQ ID NO: 114657 - protein, 16 aa, Borrelia garinii PBi
EKKIESFNTQYLNTII

SEQ ID NO: 114658 - protein, 16 aa, Borrelia garinii PBi
KKIESFNTQYLNTIIN

SEQ ID NO: 114659 - protein, 16 aa, Borrelia garinii PBi
KIESFNTQYLNTIINS

SEQ ID NO: 114660 - protein, 16 aa, Borrelia garinii PBi
IESFNTQYLNTIINSY

SEQ ID NO: 114661 - protein, 16 aa, Borrelia garinii PBi
ESFNTQYLNTIINSYT

SEQ ID NO: 114662 - protein, 16 aa, Borrelia garinii PBi
SFNTQYLNTIINSYTF

SEQ ID NO: 114663 - protein, 16 aa, Borrelia garinii PBi
FNTQYLNTIINSYTFK

SEQ ID NO: 114664 - protein, 16 aa, Borrelia garinii PBi
NTQYLNTIINSYTFKD

SEQ ID NO: 114665 - protein, 16 aa, Borrelia garinii PBi
TQYLNTIINSYTFKDK

SEQ ID NO: 114666 - protein, 16 aa, Borrelia garinii PBi
QYLNTIINSYTFKDKL

SEQ ID NO: 114667 - protein, 16 aa, Borrelia garinii PBi
YLNTIINSYTFKDKLK

SEQ ID NO: 114668 - protein, 16 aa, Borrelia garinii PBi
LNTIINSYTFKDKLKE

SEQ ID NO: 114669 - protein, 16 aa, Borrelia garinii PBi
NTIINSYTFKDKLKEL

SEQ ID NO: 114670 - protein, 16 aa, Borrelia garinii PBi
TIINSYTFKDKLKELE

SEQ ID NO: 114671 - protein, 16 aa, Borrelia garinii PBi
IINSYTFKDKLKELES

SEQ ID NO: 114672 - protein, 16 aa, Borrelia garinii PBi
INSYTFKDKLKELESK

SEQ ID NO: 114673 - protein, 16 aa, Borrelia garinii PBi
NSYTFKDKLKELESKL

SEQ ID NO: 114674 - protein, 16 aa, Borrelia garinii PBi
SYTFKDKLKELESKLN

SEQ ID NO: 114675 - protein, 16 aa, Borrelia garinii PBi
YTFKDKLKELESKLNS

SEQ ID NO: 114676 - protein, 16 aa, Borrelia garinii PBi
TFKDKLKELESKLNSI

SEQ ID NO: 114677 - protein, 16 aa, Borrelia garinii PBi
FKDKLKELESKLNSIL

SEQ ID NO: 114678 - protein, 16 aa, Borrelia garinii PBi
KDKLKELESKLNSILA

SEQ ID NO: 114679 - protein, 16 aa, Borrelia garinii PBi
DKLKELESKLNSILAE

SEQ ID NO: 114680 - protein, 16 aa, Borrelia garinii PBi
KLKELESKLNSILAEK

SEQ ID NO: 114681 - protein, 16 aa, Borrelia garinii PBi
LKELESKLNSILAEKK

SEQ ID NO: 114682 - protein, 16 aa, Borrelia garinii PBi
KELESKLNSILAEKKE

SEQ ID NO: 114683 - protein, 16 aa, Borrelia garinii PBi
ELESKLNSILAEKKEW

SEQ ID NO: 114684 - protein, 16 aa, Borrelia garinii PBi
LESKLNSILAEKKEWL

SEQ ID NO: 114685 - protein, 16 aa, Borrelia garinii PBi
ESKLNSILAEKKEWLN

SEQ ID NO: 114686 - protein, 16 aa, Borrelia garinii PBi
SKLNSILAEKKEWLNY

SEQ ID NO: 114687 - protein, 16 aa, Borrelia garinii PBi
KLNSILAEKKEWLNYA

SEQ ID NO: 114688 - protein, 16 aa, Borrelia garinii PBi
LNSILAEKKEWLNYAD

SEQ ID NO: 114689 - protein, 16 aa, Borrelia garinii PBi
NSILAEKKEWLNYADA

SEQ ID NO: 114690 - protein, 16 aa, Borrelia garinii PBi
SILAEKKEWLNYADAI

SEQ ID NO: 114691 - protein, 16 aa, Borrelia garinii PBi
ILAEKKEWLNYADAII

SEQ ID NO: 114692 - protein, 16 aa, Borrelia garinii PBi
LAEKKEWLNYADAIIT

SEQ ID NO: 114693 - protein, 16 aa, Borrelia garinii PBi
AEKKEWLNYADAIITN

SEQ ID NO: 114694 - protein, 16 aa, Borrelia garinii PBi
EKKEWLNYADAIITNT

SEQ ID NO: 114695 - protein, 16 aa, Borrelia garinii PBi
KKEWLNYADAIITNTS

SEQ ID NO: 114696 - protein, 16 aa, Borrelia garinii PBi
KEWLNYADAIITNTSS

SEQ ID NO: 114697 - protein, 16 aa, Borrelia garinii PBi
EWLNYADAIITNTSSN

SEQ ID NO: 114698 - protein, 16 aa, Borrelia garinii PBi
WLNYADAIITNTSSNS

SEQ ID NO: 114699 - protein, 16 aa, Borrelia garinii PBi
LNYADAIITNTSSNSK

SEQ ID NO: 114700 - protein, 16 aa, Borrelia garinii PBi
NYADAIITNTSSNSKR

SEQ ID NO: 114701 - protein, 16 aa, Borrelia garinii PBi
YADAIITNTSSNSKRN

SEQ ID NO: 114702 - protein, 16 aa, Borrelia garinii PBi
ADAIITNTSSNSKRND

SEQ ID NO: 114703 - protein, 16 aa, Borrelia garinii PBi
DAIITNTSSNSKRNDP

SEQ ID NO: 114704 - protein, 16 aa, Borrelia garinii PBi
AIITNTSSNSKRNDPQ

SEQ ID NO: 114705 - protein, 16 aa, Borrelia garinii PBi
IITNTSSNSKRNDPQS

SEQ ID NO: 114706 - protein, 16 aa, Borrelia garinii PBi
ITNTSSNSKRNDPQSL

SEQ ID NO: 114707 - protein, 16 aa, Borrelia garinii PBi
TNTSSNSKRNDPQSLG

SEQ ID NO: 114708 - protein, 16 aa, Borrelia garinii PBi
NTSSNSKRNDPQSLGQ

SEQ ID NO: 114709 - protein, 16 aa, Borrelia garinii PBi
TSSNSKRNDPQSLGQY

SEQ ID NO: 114710 - protein, 16 aa, Borrelia garinii PBi
SSNSKRNDPQSLGQYI

SEQ ID NO: 114711 - protein, 16 aa, Borrelia garinii PBi
SNSKRNDPQSLGQYIK

SEQ ID NO: 114712 - protein, 16 aa, Borrelia garinii PBi
NSKRNDPQSLGQYIKN

SEQ ID NO: 114713 - protein, 16 aa, Borrelia garinii PBi
SKRNDPQSLGQYIKNK

SEQ ID NO: 114714 - protein, 16 aa, Borrelia garinii PBi
KRNDPQSLGQYIKNKY

SEQ ID NO: 114715 - protein, 16 aa, Borrelia garinii PBi
RNDPQSLGQYIKNKYL

SEQ ID NO: 114716 - protein, 16 aa, Borrelia garinii PBi
NDPQSLGQYIKNKYLD

SEQ ID NO: 114717 - protein, 16 aa, Borrelia garinii PBi
DPQSLGQYIKNKYLDK

SEQ ID NO: 114718 - protein, 16 aa, Borrelia garinii PBi
PQSLGQYIKNKYLDKM

SEQ ID NO: 114719 - protein, 16 aa, Borrelia garinii PBi
QSLGQYIKNKYLDKMQ

SEQ ID NO: 114720 - protein, 16 aa, Borrelia garinii PBi
SLGQYIKNKYLDKMQD

SEQ ID NO: 114721 - protein, 16 aa, Borrelia garinii PBi
LGQYIKNKYLDKMQDA

SEQ ID NO: 114722 - protein, 16 aa, Borrelia garinii PBi
GQYIKNKYLDKMQDAR

SEQ ID NO: 114723 - protein, 16 aa, Borrelia garinii PBi
QYIKNKYLDKMQDARQ

SEQ ID NO: 114724 - protein, 16 aa, Borrelia garinii PBi
YIKNKYLDKMQDARQS

SEQ ID NO: 114725 - protein, 16 aa, Borrelia garinii PBi
IKNKYLDKMQDARQSA

SEQ ID NO: 114726 - protein, 16 aa, Borrelia garinii PBi
KNKYLDKMQDARQSAL

SEQ ID NO: 114727 - protein, 16 aa, Borrelia garinii PBi
NKYLDKMQDARQSALD

SEQ ID NO: 114728 - protein, 16 aa, Borrelia garinii PBi
KYLDKMQDARQSALDL

SEQ ID NO: 114729 - protein, 16 aa, Borrelia garinii PBi
YLDKMQDARQSALDLY

SEQ ID NO: 114730 - protein, 16 aa, Borrelia garinii PBi
LDKMQDARQSALDLYL

SEQ ID NO: 114731 - protein, 16 aa, Borrelia garinii PBi
DKMQDARQSALDLYLN

SEQ ID NO: 114732 - protein, 16 aa, Borrelia garinii PBi
KMQDARQSALDLYLNI

SEQ ID NO: 114733 - protein, 16 aa, Borrelia garinii PBi
MQDARQSALDLYLNIT

SEQ ID NO: 114734 - protein, 16 aa, Borrelia garinii PBi
QDARQSALDLYLNITE

SEQ ID NO: 114735 - protein, 16 aa, Borrelia garinii PBi
DARQSALDLYLNITEI

SEQ ID NO: 114736 - protein, 16 aa, Borrelia garinii PBi
ARQSALDLYLNITEIR

SEQ ID NO: 114737 - protein, 13 aa, Borrelia burgdorferi B31
MSSCTIDANLNKD

SEQ ID NO: 114738 - protein, 13 aa, Borrelia burgdorferi B31
SSCTIDANLNKDY

SEQ ID NO: 114739 - protein, 13 aa, Borrelia burgdorferi B31
SCTIDANLNKDYK

SEQ ID NO: 114740 - protein, 13 aa, Borrelia burgdorferi B31
CTIDANLNKDYKN

SEQ ID NO: 114741 - protein, 13 aa, Borrelia burgdorferi B31
TIDANLNKDYKNK

SEQ ID NO: 114742 - protein, 13 aa, Borrelia burgdorferi B31
IDANLNKDYKNKV

SEQ ID NO: 114743 - protein, 13 aa, Borrelia burgdorferi B31
DANLNKDYKNKVE

SEQ ID NO: 114744 - protein, 13 aa, Borrelia burgdorferi B31
ANLNKDYKNKVEE

SEQ ID NO: 114745 - protein, 13 aa, Borrelia burgdorferi B31
NLNKDYKNKVEEL

SEQ ID NO: 114746 - protein, 13 aa, Borrelia burgdorferi B31
LNKDYKNKVEELL

SEQ ID NO: 114747 - protein, 13 aa, Borrelia burgdorferi B31
NKDYKNKVEELLN

SEQ ID NO: 114748 - protein, 13 aa, Borrelia burgdorferi B31
KDYKNKVEELLNS

SEQ ID NO: 114749 - protein, 13 aa, Borrelia burgdorferi B31
DYKNKVEELLNSS

SEQ ID NO: 114750 - protein, 13 aa, Borrelia burgdorferi B31
YKNKVEELLNSST

SEQ ID NO: 114751 - protein, 13 aa, Borrelia burgdorferi B31
KNKVEELLNSSTD

SEQ ID NO: 114752 - protein, 13 aa, Borrelia burgdorferi B31
NKVEELLNSSTDD

SEQ ID NO: 114753 - protein, 13 aa, Borrelia burgdorferi B31
KVEELLNSSTDDQ

SEQ ID NO: 114754 - protein, 13 aa, Borrelia burgdorferi B31
VEELLNSSTDDQA

SEQ ID NO: 114755 - protein, 13 aa, Borrelia burgdorferi B31
EELLNSSTDDQAK

SEQ ID NO: 114756 - protein, 13 aa, Borrelia burgdorferi B31
ELLNSSTDDQAKI

SEQ ID NO: 114757 - protein, 13 aa, Borrelia burgdorferi B31
LLNSSTDDQAKIS

SEQ ID NO: 114758 - protein, 13 aa, Borrelia burgdorferi B31
LNSSTDDQAKISI

SEQ ID NO: 114759 - protein, 13 aa, Borrelia burgdorferi B31
NSSTDDQAKISIN

SEQ ID NO: 114760 - protein, 13 aa, Borrelia burgdorferi B31
SSTDDQAKISINT

SEQ ID NO: 114761 - protein, 13 aa, Borrelia burgdorferi B31
STDDQAKISINTG

SEQ ID NO: 114762 - protein, 13 aa, Borrelia burgdorferi B31
TDDQAKISINTGS

SEQ ID NO: 114763 - protein, 13 aa, Borrelia burgdorferi B31
DDQAKISINTGSN

SEQ ID NO: 114764 - protein, 13 aa, Borrelia burgdorferi B31
DQAKISINTGSNA

SEQ ID NO: 114765 - protein, 13 aa, Borrelia burgdorferi B31
QAKISINTGSNAT

SEQ ID NO: 114766 - protein, 13 aa, Borrelia burgdorferi B31
AKISINTGSNATK

SEQ ID NO: 114767 - protein, 13 aa, Borrelia burgdorferi B31
KISINTGSNATKN

SEQ ID NO: 114768 - protein, 13 aa, Borrelia burgdorferi B31
ISINTGSNATKNK

SEQ ID NO: 114769 - protein, 13 aa, Borrelia burgdorferi B31
SINTGSNATKNKT

SEQ ID NO: 114770 - protein, 13 aa, Borrelia burgdorferi B31
INTGSNATKNKTN

SEQ ID NO: 114771 - protein, 13 aa, Borrelia burgdorferi B31
NTGSNATKNKTNI

SEQ ID NO: 114772 - protein, 13 aa, Borrelia burgdorferi B31
TGSNATKNKTNIK

SEQ ID NO: 114773 - protein, 13 aa, Borrelia burgdorferi B31
GSNATKNKTNIKV

SEQ ID NO: 114774 - protein, 13 aa, Borrelia burgdorferi B31
SNATKNKTNIKVA

SEQ ID NO: 114775 - protein, 13 aa, Borrelia burgdorferi B31
NATKNKTNIKVAG

SEQ ID NO: 114776 - protein, 13 aa, Borrelia burgdorferi B31
ATKNKTNIKVAGL

SEQ ID NO: 114777 - protein, 13 aa, Borrelia burgdorferi B31
TKNKTNIKVAGLQ

SEQ ID NO: 114778 - protein, 13 aa, Borrelia burgdorferi B31
KNKTNIKVAGLQK

SEQ ID NO: 114779 - protein, 13 aa, Borrelia burgdorferi B31
NKTNIKVAGLQKN

SEQ ID NO: 114780 - protein, 13 aa, Borrelia burgdorferi B31
KTNIKVAGLQKNT

SEQ ID NO: 114781 - protein, 13 aa, Borrelia burgdorferi B31
TNIKVAGLQKNTQ

SEQ ID NO: 114782 - protein, 13 aa, Borrelia burgdorferi B31
NIKVAGLQKNTQS

SEQ ID NO: 114783 - protein, 13 aa, Borrelia burgdorferi B31
IKVAGLQKNTQSK

SEQ ID NO: 114784 - protein, 13 aa, Borrelia burgdorferi B31
KVAGLQKNTQSKK

SEQ ID NO: 114785 - protein, 13 aa, Borrelia burgdorferi B31
VAGLQKNTQSKKN

SEQ ID NO: 114786 - protein, 13 aa, Borrelia burgdorferi B31
AGLQKNTQSKKNN

SEQ ID NO: 114787 - protein, 13 aa, Borrelia burgdorferi B31
GLQKNTQSKKNNN

SEQ ID NO: 114788 - protein, 13 aa, Borrelia burgdorferi B31
LQKNTQSKKNNNL

SEQ ID NO: 114789 - protein, 13 aa, Borrelia burgdorferi B31
QKNTQSKKNNNLQ

SEQ ID NO: 114790 - protein, 13 aa, Borrelia burgdorferi B31
KNTQSKKNNNLQG

SEQ ID NO: 114791 - protein, 13 aa, Borrelia burgdorferi B31
NTQSKKNNNLQGL

SEQ ID NO: 114792 - protein, 13 aa, Borrelia burgdorferi B31
TQSKKNNNLQGLN

SEQ ID NO: 114793 - protein, 13 aa, Borrelia burgdorferi B31
QSKKNNNLQGLNP

SEQ ID NO: 114794 - protein, 13 aa, Borrelia burgdorferi B31
SKKNNNLQGLNPA

SEQ ID NO: 114795 - protein, 13 aa, Borrelia burgdorferi B31
KKNNNLQGLNPAN

SEQ ID NO: 114796 - protein, 13 aa, Borrelia burgdorferi B31
KNNNLQGLNPANQ

SEQ ID NO: 114797 - protein, 13 aa, Borrelia burgdorferi B31
NNNLQGLNPANQV

SEQ ID NO: 114798 - protein, 13 aa, Borrelia burgdorferi B31
NNLQGLNPANQVN

SEQ ID NO: 114799 - protein, 13 aa, Borrelia burgdorferi B31
NLQGLNPANQVNP

SEQ ID NO: 114800 - protein, 13 aa, Borrelia burgdorferi B31
LQGLNPANQVNPG

SEQ ID NO: 114801 - protein, 13 aa, Borrelia burgdorferi B31
QGLNPANQVNPGN

SEQ ID NO: 114802 - protein, 13 aa, Borrelia burgdorferi B31
GLNPANQVNPGNP

SEQ ID NO: 114803 - protein, 13 aa, Borrelia burgdorferi B31
LNPANQVNPGNPM

SEQ ID NO: 114804 - protein, 13 aa, Borrelia burgdorferi B31
NPANQVNPGNPMQ

SEQ ID NO: 114805 - protein, 13 aa, Borrelia burgdorferi B31
PANQVNPGNPMQI

SEQ ID NO: 114806 - protein, 13 aa, Borrelia burgdorferi B31
ANQVNPGNPMQIA

SEQ ID NO: 114807 - protein, 13 aa, Borrelia burgdorferi B31
NQVNPGNPMQIAN

SEQ ID NO: 114808 - protein, 13 aa, Borrelia burgdorferi B31
QVNPGNPMQIANQ

SEQ ID NO: 114809 - protein, 13 aa, Borrelia burgdorferi B31
VNPGNPMQIANQA

SEQ ID NO: 114810 - protein, 13 aa, Borrelia burgdorferi B31
NPGNPMQIANQAN

SEQ ID NO: 114811 - protein, 13 aa, Borrelia burgdorferi B31
PGNPMQIANQANQ

SEQ ID NO: 114812 - protein, 13 aa, Borrelia burgdorferi B31
GNPMQIANQANQA

SEQ ID NO: 114813 - protein, 13 aa, Borrelia burgdorferi B31
NPMQIANQANQAN

SEQ ID NO: 114814 - protein, 13 aa, Borrelia burgdorferi B31
PMQIANQANQANQ

SEQ ID NO: 114815 - protein, 13 aa, Borrelia burgdorferi B31
MQIANQANQANQA

SEQ ID NO: 114816 - protein, 13 aa, Borrelia burgdorferi B31
QIANQANQANQAN

SEQ ID NO: 114817 - protein, 13 aa, Borrelia burgdorferi B31
IANQANQANQANQ

SEQ ID NO: 114818 - protein, 13 aa, Borrelia burgdorferi B31
ANQANQANQANQA

SEQ ID NO: 114819 - protein, 13 aa, Borrelia burgdorferi B31
NQANQANQANQAN

SEQ ID NO: 114820 - protein, 13 aa, Borrelia burgdorferi B31
QANQANQANQANQ

SEQ ID NO: 114821 - protein, 13 aa, Borrelia burgdorferi B31
ANQANQANQANQA

SEQ ID NO: 114822 - protein, 13 aa, Borrelia burgdorferi B31
NQANQANQANQAN

SEQ ID NO: 114823 - protein, 13 aa, Borrelia burgdorferi B31
QANQANQANQANQ

SEQ ID NO: 114824 - protein, 13 aa, Borrelia burgdorferi B31
ANQANQANQANQA

SEQ ID NO: 114825 - protein, 13 aa, Borrelia burgdorferi B31
NQANQANQANQAS

SEQ ID NO: 114826 - protein, 13 aa, Borrelia burgdorferi B31
QANQANQANQASQ

SEQ ID NO: 114827 - protein, 13 aa, Borrelia burgdorferi B31
ANQANQANQASQA

SEQ ID NO: 114828 - protein, 13 aa, Borrelia burgdorferi B31
NQANQANQASQAS

SEQ ID NO: 114829 - protein, 13 aa, Borrelia burgdorferi B31
QANQANQASQASQ

SEQ ID NO: 114830 - protein, 13 aa, Borrelia burgdorferi B31
ANQANQASQASQA

SEQ ID NO: 114831 - protein, 13 aa, Borrelia burgdorferi B31
NQANQASQASQAS

SEQ ID NO: 114832 - protein, 13 aa, Borrelia burgdorferi B31
QANQASQASQASQ

SEQ ID NO: 114833 - protein, 13 aa, Borrelia burgdorferi B31
ANQASQASQASQV

SEQ ID NO: 114834 - protein, 13 aa, Borrelia burgdorferi B31
NQASQASQASQVA

SEQ ID NO: 114835 - protein, 13 aa, Borrelia burgdorferi B31
QASQASQASQVAS

SEQ ID NO: 114836 - protein, 13 aa, Borrelia burgdorferi B31
ASQASQASQVASS

SEQ ID NO: 114837 - protein, 13 aa, Borrelia burgdorferi B31
SQASQASQVASSA

SEQ ID NO: 114838 - protein, 13 aa, Borrelia burgdorferi B31
QASQASQVASSAS

SEQ ID NO: 114839 - protein, 13 aa, Borrelia burgdorferi B31
ASQASQVASSASQ

SEQ ID NO: 114840 - protein, 13 aa, Borrelia burgdorferi B31
SQASQVASSASQA

SEQ ID NO: 114841 - protein, 13 aa, Borrelia burgdorferi B31
QASQVASSASQAS

SEQ ID NO: 114842 - protein, 13 aa, Borrelia burgdorferi B31
ASQVASSASQASP

SEQ ID NO: 114843 - protein, 13 aa, Borrelia burgdorferi B31
SQVASSASQASPV

SEQ ID NO: 114844 - protein, 13 aa, Borrelia burgdorferi B31
QVASSASQASPVA

SEQ ID NO: 114845 - protein, 13 aa, Borrelia burgdorferi B31
VASSASQASPVAS

SEQ ID NO: 114846 - protein, 13 aa, Borrelia burgdorferi B31
ASSASQASPVASP

SEQ ID NO: 114847 - protein, 13 aa, Borrelia burgdorferi B31
SSASQASPVASPA

SEQ ID NO: 114848 - protein, 13 aa, Borrelia burgdorferi B31
SASQASPVASPAT

SEQ ID NO: 114849 - protein, 13 aa, Borrelia burgdorferi B31
ASQASPVASPATN

SEQ ID NO: 114850 - protein, 13 aa, Borrelia burgdorferi B31
SQASPVASPATNV

SEQ ID NO: 114851 - protein, 13 aa, Borrelia burgdorferi B31
QASPVASPATNVQ

SEQ ID NO: 114852 - protein, 13 aa, Borrelia burgdorferi B31
ASPVASPATNVQA

SEQ ID NO: 114853 - protein, 13 aa, Borrelia burgdorferi B31
SPVASPATNVQAT

SEQ ID NO: 114854 - protein, 13 aa, Borrelia burgdorferi B31
PVASPATNVQATP

SEQ ID NO: 114855 - protein, 13 aa, Borrelia burgdorferi B31
VASPATNVQATPP

SEQ ID NO: 114856 - protein, 13 aa, Borrelia burgdorferi B31
ASPATNVQATPPK

SEQ ID NO: 114857 - protein, 13 aa, Borrelia burgdorferi B31
SPATNVQATPPKQ

SEQ ID NO: 114858 - protein, 13 aa, Borrelia burgdorferi B31
PATNVQATPPKQI

SEQ ID NO: 114859 - protein, 13 aa, Borrelia burgdorferi B31
ATNVQATPPKQIA

SEQ ID NO: 114860 - protein, 13 aa, Borrelia burgdorferi B31
TNVQATPPKQIAS

SEQ ID NO: 114861 - protein, 13 aa, Borrelia burgdorferi B31
NVQATPPKQIASA

SEQ ID NO: 114862 - protein, 13 aa, Borrelia burgdorferi B31
VQATPPKQIASAQ

SEQ ID NO: 114863 - protein, 13 aa, Borrelia burgdorferi B31
QATPPKQIASAQA

SEQ ID NO: 114864 - protein, 13 aa, Borrelia burgdorferi B31
ATPPKQIASAQAI

SEQ ID NO: 114865 - protein, 13 aa, Borrelia burgdorferi B31
TPPKQIASAQAIQ

SEQ ID NO: 114866 - protein, 13 aa, Borrelia burgdorferi B31
PPKQIASAQAIQT

SEQ ID NO: 114867 - protein, 13 aa, Borrelia burgdorferi B31
PKQIASAQAIQTV

SEQ ID NO: 114868 - protein, 13 aa, Borrelia burgdorferi B31
KQIASAQAIQTVP

SEQ ID NO: 114869 - protein, 13 aa, Borrelia burgdorferi B31
QIASAQAIQTVPN

SEQ ID NO: 114870 - protein, 13 aa, Borrelia burgdorferi B31
IASAQAIQTVPNN

SEQ ID NO: 114871 - protein, 13 aa, Borrelia burgdorferi B31
ASAQAIQTVPNNT

SEQ ID NO: 114872 - protein, 13 aa, Borrelia burgdorferi B31
SAQAIQTVPNNTS

SEQ ID NO: 114873 - protein, 13 aa, Borrelia burgdorferi B31
AQAIQTVPNNTST

SEQ ID NO: 114874 - protein, 13 aa, Borrelia burgdorferi B31
QAIQTVPNNTSTP

SEQ ID NO: 114875 - protein, 13 aa, Borrelia burgdorferi B31
AIQTVPNNTSTPN

SEQ ID NO: 114876 - protein, 13 aa, Borrelia burgdorferi B31
IQTVPNNTSTPNQ

SEQ ID NO: 114877 - protein, 13 aa, Borrelia burgdorferi B31
QTVPNNTSTPNQS

SEQ ID NO: 114878 - protein, 13 aa, Borrelia burgdorferi B31
TVPNNTSTPNQSI

SEQ ID NO: 114879 - protein, 13 aa, Borrelia burgdorferi B31
VPNNTSTPNQSII

SEQ ID NO: 114880 - protein, 13 aa, Borrelia burgdorferi B31
PNNTSTPNQSIIK

SEQ ID NO: 114881 - protein, 13 aa, Borrelia burgdorferi B31
NNTSTPNQSIIKP

SEQ ID NO: 114882 - protein, 13 aa, Borrelia burgdorferi B31
NTSTPNQSIIKPQ

SEQ ID NO: 114883 - protein, 13 aa, Borrelia burgdorferi B31
TSTPNQSIIKPQQ

SEQ ID NO: 114884 - protein, 13 aa, Borrelia burgdorferi B31
STPNQSIIKPQQY

SEQ ID NO: 114885 - protein, 13 aa, Borrelia burgdorferi B31
TPNQSIIKPQQYT

SEQ ID NO: 114886 - protein, 13 aa, Borrelia burgdorferi B31
PNQSIIKPQQYTF

SEQ ID NO: 114887 - protein, 13 aa, Borrelia burgdorferi B31
NQSIIKPQQYTFS

SEQ ID NO: 114888 - protein, 13 aa, Borrelia burgdorferi B31
QSIIKPQQYTFSS

SEQ ID NO: 114889 - protein, 13 aa, Borrelia burgdorferi B31
SIIKPQQYTFSSS

SEQ ID NO: 114890 - protein, 13 aa, Borrelia burgdorferi B31
IIKPQQYTFSSSF

SEQ ID NO: 114891 - protein, 13 aa, Borrelia burgdorferi B31
IKPQQYTFSSSFS

SEQ ID NO: 114892 - protein, 13 aa, Borrelia burgdorferi B31
KPQQYTFSSSFSQ

SEQ ID NO: 114893 - protein, 13 aa, Borrelia burgdorferi B31
PQQYTFSSSFSQP

SEQ ID NO: 114894 - protein, 13 aa, Borrelia burgdorferi B31
QQYTFSSSFSQPT

SEQ ID NO: 114895 - protein, 13 aa, Borrelia burgdorferi B31
QYTFSSSFSQPTS

SEQ ID NO: 114896 - protein, 13 aa, Borrelia burgdorferi B31
YTFSSSFSQPTSQ

SEQ ID NO: 114897 - protein, 13 aa, Borrelia burgdorferi B31
TFSSSFSQPTSQT

SEQ ID NO: 114898 - protein, 13 aa, Borrelia burgdorferi B31
FSSSFSQPTSQTN

SEQ ID NO: 114899 - protein, 13 aa, Borrelia burgdorferi B31
SSSFSQPTSQTNF

SEQ ID NO: 114900 - protein, 13 aa, Borrelia burgdorferi B31
SSFSQPTSQTNFN

SEQ ID NO: 114901 - protein, 13 aa, Borrelia burgdorferi B31
SFSQPTSQTNFNN

SEQ ID NO: 114902 - protein, 13 aa, Borrelia burgdorferi B31
FSQPTSQTNFNNS

SEQ ID NO: 114903 - protein, 13 aa, Borrelia burgdorferi B31
SQPTSQTNFNNSQ

SEQ ID NO: 114904 - protein, 13 aa, Borrelia burgdorferi B31
QPTSQTNFNNSQS

SEQ ID NO: 114905 - protein, 13 aa, Borrelia burgdorferi B31
PTSQTNFNNSQSN

SEQ ID NO: 114906 - protein, 13 aa, Borrelia burgdorferi B31
TSQTNFNNSQSNN

SEQ ID NO: 114907 - protein, 13 aa, Borrelia burgdorferi B31
SQTNFNNSQSNNV

SEQ ID NO: 114908 - protein, 13 aa, Borrelia burgdorferi B31
QTNFNNSQSNNVL

SEQ ID NO: 114909 - protein, 13 aa, Borrelia burgdorferi B31
TNFNNSQSNNVLT

SEQ ID NO: 114910 - protein, 13 aa, Borrelia burgdorferi B31
NFNNSQSNNVLTN

SEQ ID NO: 114911 - protein, 13 aa, Borrelia burgdorferi B31
FNNSQSNNVLTNY

SEQ ID NO: 114912 - protein, 13 aa, Borrelia burgdorferi B31
NNSQSNNVLTNYR

SEQ ID NO: 114913 - protein, 13 aa, Borrelia burgdorferi B31
NSQSNNVLTNYRH

SEQ ID NO: 114914 - protein, 13 aa, Borrelia burgdorferi B31
SQSNNVLTNYRHQ

SEQ ID NO: 114915 - protein, 13 aa, Borrelia burgdorferi B31
QSNNVLTNYRHQT

SEQ ID NO: 114916 - protein, 13 aa, Borrelia burgdorferi B31
SNNVLTNYRHQTQ

SEQ ID NO: 114917 - protein, 13 aa, Borrelia burgdorferi B31
NNVLTNYRHQTQP

SEQ ID NO: 114918 - protein, 13 aa, Borrelia burgdorferi B31
NVLTNYRHQTQPS

SEQ ID NO: 114919 - protein, 13 aa, Borrelia burgdorferi B31
VLTNYRHQTQPSF

SEQ ID NO: 114920 - protein, 13 aa, Borrelia burgdorferi B31
LTNYRHQTQPSFV

SEQ ID NO: 114921 - protein, 13 aa, Borrelia burgdorferi B31
TNYRHQTQPSFVV

SEQ ID NO: 114922 - protein, 13 aa, Borrelia burgdorferi B31
NYRHQTQPSFVVP

SEQ ID NO: 114923 - protein, 13 aa, Borrelia burgdorferi B31
YRHQTQPSFVVPV

SEQ ID NO: 114924 - protein, 13 aa, Borrelia burgdorferi B31
RHQTQPSFVVPVY

SEQ ID NO: 114925 - protein, 13 aa, Borrelia burgdorferi B31
HQTQPSFVVPVYS

SEQ ID NO: 114926 - protein, 13 aa, Borrelia burgdorferi B31
QTQPSFVVPVYSG

SEQ ID NO: 114927 - protein, 13 aa, Borrelia burgdorferi B31
TQPSFVVPVYSGN

SEQ ID NO: 114928 - protein, 13 aa, Borrelia burgdorferi B31
QPSFVVPVYSGNS

SEQ ID NO: 114929 - protein, 13 aa, Borrelia burgdorferi B31
PSFVVPVYSGNSP

SEQ ID NO: 114930 - protein, 13 aa, Borrelia burgdorferi B31
SFVVPVYSGNSPL

SEQ ID NO: 114931 - protein, 13 aa, Borrelia burgdorferi B31
FVVPVYSGNSPLQ

SEQ ID NO: 114932 - protein, 13 aa, Borrelia burgdorferi B31
VVPVYSGNSPLQK

SEQ ID NO: 114933 - protein, 13 aa, Borrelia burgdorferi B31
VPVYSGNSPLQKL

SEQ ID NO: 114934 - protein, 13 aa, Borrelia burgdorferi B31
PVYSGNSPLQKLK

SEQ ID NO: 114935 - protein, 13 aa, Borrelia burgdorferi B31
VYSGNSPLQKLKN

SEQ ID NO: 114936 - protein, 13 aa, Borrelia burgdorferi B31
YSGNSPLQKLKNN

SEQ ID NO: 114937 - protein, 13 aa, Borrelia burgdorferi B31
SGNSPLQKLKNNL

SEQ ID NO: 114938 - protein, 13 aa, Borrelia burgdorferi B31
GNSPLQKLKNNLL

SEQ ID NO: 114939 - protein, 13 aa, Borrelia burgdorferi B31
NSPLQKLKNNLLR

SEQ ID NO: 114940 - protein, 13 aa, Borrelia burgdorferi B31
SPLQKLKNNLLRR

SEQ ID NO: 114941 - protein, 13 aa, Borrelia burgdorferi B31
PLQKLKNNLLRRI

SEQ ID NO: 114942 - protein, 13 aa, Borrelia burgdorferi B31
LQKLKNNLLRRIA

SEQ ID NO: 114943 - protein, 13 aa, Borrelia burgdorferi B31
QKLKNNLLRRIAE

SEQ ID NO: 114944 - protein, 13 aa, Borrelia burgdorferi B31
KLKNNLLRRIAEE

SEQ ID NO: 114945 - protein, 13 aa, Borrelia burgdorferi B31
LKNNLLRRIAEEK

SEQ ID NO: 114946 - protein, 13 aa, Borrelia burgdorferi B31
KNNLLRRIAEEKN

SEQ ID NO: 114947 - protein, 13 aa, Borrelia burgdorferi B31
NNLLRRIAEEKNK

SEQ ID NO: 114948 - protein, 13 aa, Borrelia burgdorferi B31
NLLRRIAEEKNKT

SEQ ID NO: 114949 - protein, 13 aa, Borrelia burgdorferi B31
LLRRIAEEKNKTH

SEQ ID NO: 114950 - protein, 13 aa, Borrelia burgdorferi B31
LRRIAEEKNKTHN

SEQ ID NO: 114951 - protein, 13 aa, Borrelia burgdorferi B31
RRIAEEKNKTHNH

SEQ ID NO: 114952 - protein, 13 aa, Borrelia burgdorferi B31
RIAEEKNKTHNHG

SEQ ID NO: 114953 - protein, 13 aa, Borrelia burgdorferi B31
IAEEKNKTHNHGF

SEQ ID NO: 114954 - protein, 13 aa, Borrelia burgdorferi B31
AEEKNKTHNHGFR

SEQ ID NO: 114955 - protein, 13 aa, Borrelia burgdorferi B31
EEKNKTHNHGFRE

SEQ ID NO: 114956 - protein, 13 aa, Borrelia burgdorferi B31
EKNKTHNHGFRET

SEQ ID NO: 114957 - protein, 13 aa, Borrelia burgdorferi B31
KNKTHNHGFRETY

SEQ ID NO: 114958 - protein, 13 aa, Borrelia burgdorferi B31
NKTHNHGFRETYD

SEQ ID NO: 114959 - protein, 13 aa, Borrelia burgdorferi B31
KTHNHGFRETYDQ

SEQ ID NO: 114960 - protein, 13 aa, Borrelia burgdorferi B31
THNHGFRETYDQF

SEQ ID NO: 114961 - protein, 13 aa, Borrelia burgdorferi B31
HNHGFRETYDQFK

SEQ ID NO: 114962 - protein, 13 aa, Borrelia burgdorferi B31
NHGFRETYDQFKM

SEQ ID NO: 114963 - protein, 13 aa, Borrelia burgdorferi B31
HGFRETYDQFKMK

SEQ ID NO: 114964 - protein, 13 aa, Borrelia burgdorferi B31
GFRETYDQFKMKD

SEQ ID NO: 114965 - protein, 13 aa, Borrelia burgdorferi B31
FRETYDQFKMKDS

SEQ ID NO: 114966 - protein, 13 aa, Borrelia burgdorferi B31
RETYDQFKMKDSA

SEQ ID NO: 114967 - protein, 13 aa, Borrelia burgdorferi B31
ETYDQFKMKDSAF

SEQ ID NO: 114968 - protein, 13 aa, Borrelia burgdorferi B31
TYDQFKMKDSAFT

SEQ ID NO: 114969 - protein, 13 aa, Borrelia burgdorferi B31
YDQFKMKDSAFTL

SEQ ID NO: 114970 - protein, 13 aa, Borrelia burgdorferi B31
DQFKMKDSAFTLL

SEQ ID NO: 114971 - protein, 13 aa, Borrelia burgdorferi B31
QFKMKDSAFTLLD

SEQ ID NO: 114972 - protein, 13 aa, Borrelia burgdorferi B31
FKMKDSAFTLLDV

SEQ ID NO: 114973 - protein, 13 aa, Borrelia burgdorferi B31
KMKDSAFTLLDVI

SEQ ID NO: 114974 - protein, 13 aa, Borrelia burgdorferi B31
MKDSAFTLLDVIS

SEQ ID NO: 114975 - protein, 13 aa, Borrelia burgdorferi B31
KDSAFTLLDVISN

SEQ ID NO: 114976 - protein, 13 aa, Borrelia burgdorferi B31
DSAFTLLDVISNI

SEQ ID NO: 114977 - protein, 13 aa, Borrelia burgdorferi B31
SAFTLLDVISNIS

SEQ ID NO: 114978 - protein, 13 aa, Borrelia burgdorferi B31
AFTLLDVISNISV

SEQ ID NO: 114979 - protein, 13 aa, Borrelia burgdorferi B31
FTLLDVISNISVF

SEQ ID NO: 114980 - protein, 13 aa, Borrelia burgdorferi B31
TLLDVISNISVFD

SEQ ID NO: 114981 - protein, 13 aa, Borrelia burgdorferi B31
LLDVISNISVFDR

SEQ ID NO: 114982 - protein, 13 aa, Borrelia burgdorferi B31
LDVISNISVFDRG

SEQ ID NO: 114983 - protein, 13 aa, Borrelia burgdorferi B31
DVISNISVFDRGS

SEQ ID NO: 114984 - protein, 13 aa, Borrelia burgdorferi B31
VISNISVFDRGSA

SEQ ID NO: 114985 - protein, 13 aa, Borrelia burgdorferi B31
ISNISVFDRGSAP

SEQ ID NO: 114986 - protein, 13 aa, Borrelia burgdorferi B31
SNISVFDRGSAPQ

SEQ ID NO: 114987 - protein, 13 aa, Borrelia burgdorferi B31
NISVFDRGSAPQL

SEQ ID NO: 114988 - protein, 13 aa, Borrelia burgdorferi B31
ISVFDRGSAPQLS

SEQ ID NO: 114989 - protein, 13 aa, Borrelia burgdorferi B31
SVFDRGSAPQLSS

SEQ ID NO: 114990 - protein, 13 aa, Borrelia burgdorferi B31
VFDRGSAPQLSSN

SEQ ID NO: 114991 - protein, 13 aa, Borrelia burgdorferi B31
FDRGSAPQLSSNT

SEQ ID NO: 114992 - protein, 13 aa, Borrelia burgdorferi B31
DRGSAPQLSSNTP

SEQ ID NO: 114993 - protein, 13 aa, Borrelia burgdorferi B31
RGSAPQLSSNTPE

SEQ ID NO: 114994 - protein, 13 aa, Borrelia burgdorferi B31
GSAPQLSSNTPEA

SEQ ID NO: 114995 - protein, 13 aa, Borrelia burgdorferi B31
SAPQLSSNTPEAE

SEQ ID NO: 114996 - protein, 13 aa, Borrelia burgdorferi B31
APQLSSNTPEAES

SEQ ID NO: 114997 - protein, 13 aa, Borrelia burgdorferi B31
PQLSSNTPEAESE

SEQ ID NO: 114998 - protein, 13 aa, Borrelia burgdorferi B31
QLSSNTPEAESER

SEQ ID NO: 114999 - protein, 13 aa, Borrelia burgdorferi B31
LSSNTPEAESERN

SEQ ID NO: 115000 - protein, 13 aa, Borrelia burgdorferi B31
SSNTPEAESERNR

SEQ ID NO: 115001 - protein, 13 aa, Borrelia burgdorferi B31
SNTPEAESERNRL

SEQ ID NO: 115002 - protein, 13 aa, Borrelia burgdorferi B31
NTPEAESERNRLY

SEQ ID NO: 115003 - protein, 13 aa, Borrelia burgdorferi B31
TPEAESERNRLYA

SEQ ID NO: 115004 - protein, 13 aa, Borrelia burgdorferi B31
PEAESERNRLYAM

SEQ ID NO: 115005 - protein, 13 aa, Borrelia burgdorferi B31
EAESERNRLYAMM

SEQ ID NO: 115006 - protein, 13 aa, Borrelia burgdorferi B31
AESERNRLYAMMD

SEQ ID NO: 115007 - protein, 13 aa, Borrelia burgdorferi B31
ESERNRLYAMMDF

SEQ ID NO: 115008 - protein, 13 aa, Borrelia burgdorferi B31
SERNRLYAMMDFD

SEQ ID NO: 115009 - protein, 13 aa, Borrelia burgdorferi B31
ERNRLYAMMDFDQ

SEQ ID NO: 115010 - protein, 13 aa, Borrelia burgdorferi B31
RNRLYAMMDFDQA

SEQ ID NO: 115011 - protein, 13 aa, Borrelia burgdorferi B31
NRLYAMMDFDQAK

SEQ ID NO: 115012 - protein, 13 aa, Borrelia burgdorferi B31
RLYAMMDFDQAKT

SEQ ID NO: 115013 - protein, 13 aa, Borrelia burgdorferi B31
LYAMMDFDQAKTT

SEQ ID NO: 115014 - protein, 13 aa, Borrelia burgdorferi B31
YAMMDFDQAKTTE

SEQ ID NO: 115015 - protein, 13 aa, Borrelia burgdorferi B31
AMMDFDQAKTTEF

SEQ ID NO: 115016 - protein, 13 aa, Borrelia burgdorferi B31
MMDFDQAKTTEFG

SEQ ID NO: 115017 - protein, 13 aa, Borrelia burgdorferi B31
MDFDQAKTTEFGS

SEQ ID NO: 115018 - protein, 13 aa, Borrelia burgdorferi B31
DFDQAKTTEFGSI

SEQ ID NO: 115019 - protein, 13 aa, Borrelia burgdorferi B31
FDQAKTTEFGSIM

SEQ ID NO: 115020 - protein, 13 aa, Borrelia burgdorferi B31
DQAKTTEFGSIMN

SEQ ID NO: 115021 - protein, 13 aa, Borrelia burgdorferi B31
QAKTTEFGSIMNI

SEQ ID NO: 115022 - protein, 13 aa, Borrelia burgdorferi B31
AKTTEFGSIMNIL

SEQ ID NO: 115023 - protein, 13 aa, Borrelia burgdorferi B31
KTTEFGSIMNILY

SEQ ID NO: 115024 - protein, 13 aa, Borrelia burgdorferi B31
TTEFGSIMNILYQ

SEQ ID NO: 115025 - protein, 13 aa, Borrelia burgdorferi B31
TEFGSIMNILYQE

SEQ ID NO: 115026 - protein, 13 aa, Borrelia burgdorferi B31
EFGSIMNILYQEN

SEQ ID NO: 115027 - protein, 13 aa, Borrelia burgdorferi B31
FGSIMNILYQENQ

SEQ ID NO: 115028 - protein, 13 aa, Borrelia burgdorferi B31
GSIMNILYQENQN

SEQ ID NO: 115029 - protein, 13 aa, Borrelia burgdorferi B31
SIMNILYQENQNH

SEQ ID NO: 115030 - protein, 13 aa, Borrelia burgdorferi B31
IMNILYQENQNHS

SEQ ID NO: 115031 - protein, 13 aa, Borrelia burgdorferi B31
MNILYQENQNHSL

SEQ ID NO: 115032 - protein, 13 aa, Borrelia burgdorferi B31
NILYQENQNHSLI

SEQ ID NO: 115033 - protein, 13 aa, Borrelia burgdorferi B31
ILYQENQNHSLIR

SEQ ID NO: 115034 - protein, 13 aa, Borrelia burgdorferi B31
LYQENQNHSLIRS

SEQ ID NO: 115035 - protein, 13 aa, Borrelia burgdorferi B31
YQENQNHSLIRSL

SEQ ID NO: 115036 - protein, 13 aa, Borrelia burgdorferi B31
QENQNHSLIRSLI

SEQ ID NO: 115037 - protein, 13 aa, Borrelia burgdorferi B31
ENQNHSLIRSLII

SEQ ID NO: 115038 - protein, 13 aa, Borrelia burgdorferi B31
NQNHSLIRSLIIS

SEQ ID NO: 115039 - protein, 13 aa, Borrelia burgdorferi B31
QNHSLIRSLIISG

SEQ ID NO: 115040 - protein, 13 aa, Borrelia burgdorferi B31
NHSLIRSLIISGL

SEQ ID NO: 115041 - protein, 13 aa, Borrelia burgdorferi B31
HSLIRSLIISGLG

SEQ ID NO: 115042 - protein, 13 aa, Borrelia burgdorferi B31
SLIRSLIISGLGI

SEQ ID NO: 115043 - protein, 13 aa, Borrelia burgdorferi B31
LIRSLIISGLGIQ

SEQ ID NO: 115044 - protein, 13 aa, Borrelia burgdorferi B31
IRSLIISGLGIQI

SEQ ID NO: 115045 - protein, 13 aa, Borrelia burgdorferi B31
RSLIISGLGIQIS

SEQ ID NO: 115046 - protein, 13 aa, Borrelia burgdorferi B31
SLIISGLGIQISL

SEQ ID NO: 115047 - protein, 13 aa, Borrelia burgdorferi B31
LIISGLGIQISLE

SEQ ID NO: 115048 - protein, 13 aa, Borrelia burgdorferi B31
IISGLGIQISLES

SEQ ID NO: 115049 - protein, 13 aa, Borrelia burgdorferi B31
ISGLGIQISLEST

SEQ ID NO: 115050 - protein, 13 aa, Borrelia burgdorferi B31
SGLGIQISLESTL

SEQ ID NO: 115051 - protein, 13 aa, Borrelia burgdorferi B31
GLGIQISLESTLE

SEQ ID NO: 115052 - protein, 13 aa, Borrelia burgdorferi B31
LGIQISLESTLEE

SEQ ID NO: 115053 - protein, 13 aa, Borrelia burgdorferi B31
GIQISLESTLEEI

SEQ ID NO: 115054 - protein, 13 aa, Borrelia burgdorferi B31
IQISLESTLEEIE

SEQ ID NO: 115055 - protein, 13 aa, Borrelia burgdorferi B31
QISLESTLEEIEK

SEQ ID NO: 115056 - protein, 13 aa, Borrelia burgdorferi B31
ISLESTLEEIEKK

SEQ ID NO: 115057 - protein, 13 aa, Borrelia burgdorferi B31
SLESTLEEIEKKI

SEQ ID NO: 115058 - protein, 13 aa, Borrelia burgdorferi B31
LESTLEEIEKKIE

SEQ ID NO: 115059 - protein, 13 aa, Borrelia burgdorferi B31
ESTLEEIEKKIES

SEQ ID NO: 115060 - protein, 13 aa, Borrelia burgdorferi B31
STLEEIEKKIESF

SEQ ID NO: 115061 - protein, 13 aa, Borrelia burgdorferi B31
TLEEIEKKIESFN

SEQ ID NO: 115062 - protein, 13 aa, Borrelia burgdorferi B31
LEEIEKKIESFNT

SEQ ID NO: 115063 - protein, 13 aa, Borrelia burgdorferi B31
EEIEKKIESFNTQ

SEQ ID NO: 115064 - protein, 13 aa, Borrelia burgdorferi B31
EIEKKIESFNTQY

SEQ ID NO: 115065 - protein, 13 aa, Borrelia burgdorferi B31
IEKKIESFNTQYL

SEQ ID NO: 115066 - protein, 13 aa, Borrelia burgdorferi B31
EKKIESFNTQYLN

SEQ ID NO: 115067 - protein, 13 aa, Borrelia burgdorferi B31
KKIESFNTQYLNT

SEQ ID NO: 115068 - protein, 13 aa, Borrelia burgdorferi B31
KIESFNTQYLNTI

SEQ ID NO: 115069 - protein, 13 aa, Borrelia burgdorferi B31
IESFNTQYLNTII

SEQ ID NO: 115070 - protein, 13 aa, Borrelia burgdorferi B31
ESFNTQYLNTIIN

SEQ ID NO: 115071 - protein, 13 aa, Borrelia burgdorferi B31
SFNTQYLNTIINS

SEQ ID NO: 115072 - protein, 13 aa, Borrelia burgdorferi B31
FNTQYLNTIINSY

SEQ ID NO: 115073 - protein, 13 aa, Borrelia burgdorferi B31
NTQYLNTIINSYT

SEQ ID NO: 115074 - protein, 13 aa, Borrelia burgdorferi B31
TQYLNTIINSYTF

SEQ ID NO: 115075 - protein, 13 aa, Borrelia burgdorferi B31
QYLNTIINSYTFK

SEQ ID NO: 115076 - protein, 13 aa, Borrelia burgdorferi B31
YLNTIINSYTFKD

SEQ ID NO: 115077 - protein, 13 aa, Borrelia burgdorferi B31
LNTIINSYTFKDK

SEQ ID NO: 115078 - protein, 13 aa, Borrelia burgdorferi B31
NTIINSYTFKDKL

SEQ ID NO: 115079 - protein, 13 aa, Borrelia burgdorferi B31
TIINSYTFKDKLK

SEQ ID NO: 115080 - protein, 13 aa, Borrelia burgdorferi B31
IINSYTFKDKLKE

SEQ ID NO: 115081 - protein, 13 aa, Borrelia burgdorferi B31
INSYTFKDKLKEL

SEQ ID NO: 115082 - protein, 13 aa, Borrelia burgdorferi B31
NSYTFKDKLKELE

SEQ ID NO: 115083 - protein, 13 aa, Borrelia burgdorferi B31
SYTFKDKLKELES

SEQ ID NO: 115084 - protein, 13 aa, Borrelia burgdorferi B31
YTFKDKLKELESK

SEQ ID NO: 115085 - protein, 13 aa, Borrelia burgdorferi B31
TFKDKLKELESKL

SEQ ID NO: 115086 - protein, 13 aa, Borrelia burgdorferi B31
FKDKLKELESKLN

SEQ ID NO: 115087 - protein, 13 aa, Borrelia burgdorferi B31
KDKLKELESKLNS

SEQ ID NO: 115088 - protein, 13 aa, Borrelia burgdorferi B31
DKLKELESKLNSI

SEQ ID NO: 115089 - protein, 13 aa, Borrelia burgdorferi B31
KLKELESKLNSIL

SEQ ID NO: 115090 - protein, 13 aa, Borrelia burgdorferi B31
LKELESKLNSILA

SEQ ID NO: 115091 - protein, 13 aa, Borrelia burgdorferi B31
KELESKLNSILAE

SEQ ID NO: 115092 - protein, 13 aa, Borrelia burgdorferi B31
ELESKLNSILAEK

SEQ ID NO: 115093 - protein, 13 aa, Borrelia burgdorferi B31
LESKLNSILAEKK

SEQ ID NO: 115094 - protein, 13 aa, Borrelia burgdorferi B31
ESKLNSILAEKKE

SEQ ID NO: 115095 - protein, 13 aa, Borrelia burgdorferi B31
SKLNSILAEKKEW

SEQ ID NO: 115096 - protein, 13 aa, Borrelia burgdorferi B31
KLNSILAEKKEWL

SEQ ID NO: 115097 - protein, 13 aa, Borrelia burgdorferi B31
LNSILAEKKEWLN

SEQ ID NO: 115098 - protein, 13 aa, Borrelia burgdorferi B31
NSILAEKKEWLNY

SEQ ID NO: 115099 - protein, 13 aa, Borrelia burgdorferi B31
SILAEKKEWLNYA

SEQ ID NO: 115100 - protein, 13 aa, Borrelia burgdorferi B31
ILAEKKEWLNYAD

SEQ ID NO: 115101 - protein, 13 aa, Borrelia burgdorferi B31
LAEKKEWLNYADA

SEQ ID NO: 115102 - protein, 13 aa, Borrelia burgdorferi B31
AEKKEWLNYADAI

SEQ ID NO: 115103 - protein, 13 aa, Borrelia burgdorferi B31
EKKEWLNYADAII

SEQ ID NO: 115104 - protein, 13 aa, Borrelia burgdorferi B31
KKEWLNYADAIIT

SEQ ID NO: 115105 - protein, 13 aa, Borrelia burgdorferi B31
KEWLNYADAIITN

SEQ ID NO: 115106 - protein, 13 aa, Borrelia burgdorferi B31
EWLNYADAIITNT

SEQ ID NO: 115107 - protein, 13 aa, Borrelia burgdorferi B31
WLNYADAIITNTS

SEQ ID NO: 115108 - protein, 13 aa, Borrelia burgdorferi B31
LNYADAIITNTSS

SEQ ID NO: 115109 - protein, 13 aa, Borrelia burgdorferi B31
NYADAIITNTSSN

SEQ ID NO: 115110 - protein, 13 aa, Borrelia burgdorferi B31
YADAIITNTSSNS

SEQ ID NO: 115111 - protein, 13 aa, Borrelia burgdorferi B31
ADAIITNTSSNSK

SEQ ID NO: 115112 - protein, 13 aa, Borrelia burgdorferi B31
DAIITNTSSNSKR

SEQ ID NO: 115113 - protein, 13 aa, Borrelia burgdorferi B31
AIITNTSSNSKRN

SEQ ID NO: 115114 - protein, 13 aa, Borrelia burgdorferi B31
IITNTSSNSKRND

SEQ ID NO: 115115 - protein, 13 aa, Borrelia burgdorferi B31
ITNTSSNSKRNDP

SEQ ID NO: 115116 - protein, 13 aa, Borrelia burgdorferi B31
TNTSSNSKRNDPQ

SEQ ID NO: 115117 - protein, 13 aa, Borrelia burgdorferi B31
NTSSNSKRNDPQS

SEQ ID NO: 115118 - protein, 13 aa, Borrelia burgdorferi B31
TSSNSKRNDPQSL

SEQ ID NO: 115119 - protein, 13 aa, Borrelia burgdorferi B31
SSNSKRNDPQSLG

SEQ ID NO: 115120 - protein, 13 aa, Borrelia burgdorferi B31
SNSKRNDPQSLGQ

SEQ ID NO: 115121 - protein, 13 aa, Borrelia burgdorferi B31
NSKRNDPQSLGQY

SEQ ID NO: 115122 - protein, 13 aa, Borrelia burgdorferi B31
SKRNDPQSLGQYI

SEQ ID NO: 115123 - protein, 13 aa, Borrelia burgdorferi B31
KRNDPQSLGQYIK

SEQ ID NO: 115124 - protein, 13 aa, Borrelia burgdorferi B31
RNDPQSLGQYIKN

SEQ ID NO: 115125 - protein, 13 aa, Borrelia burgdorferi B31
NDPQSLGQYIKNK

SEQ ID NO: 115126 - protein, 13 aa, Borrelia burgdorferi B31
DPQSLGQYIKNKY

SEQ ID NO: 115127 - protein, 13 aa, Borrelia burgdorferi B31
PQSLGQYIKNKYL

SEQ ID NO: 115128 - protein, 13 aa, Borrelia burgdorferi B31
QSLGQYIKNKYLD

SEQ ID NO: 115129 - protein, 13 aa, Borrelia burgdorferi B31
SLGQYIKNKYLDK

SEQ ID NO: 115130 - protein, 13 aa, Borrelia burgdorferi B31
LGQYIKNKYLDKM

SEQ ID NO: 115131 - protein, 13 aa, Borrelia burgdorferi B31
GQYIKNKYLDKMQ

SEQ ID NO: 115132 - protein, 13 aa, Borrelia burgdorferi B31
QYIKNKYLDKMQD

SEQ ID NO: 115133 - protein, 13 aa, Borrelia burgdorferi B31
YIKNKYLDKMQDA

SEQ ID NO: 115134 - protein, 13 aa, Borrelia burgdorferi B31
IKNKYLDKMQDAR

SEQ ID NO: 115135 - protein, 13 aa, Borrelia burgdorferi B31
KNKYLDKMQDARQ

SEQ ID NO: 115136 - protein, 13 aa, Borrelia burgdorferi B31
NKYLDKMQDARQS

SEQ ID NO: 115137 - protein, 13 aa, Borrelia burgdorferi B31
KYLDKMQDARQSA

SEQ ID NO: 115138 - protein, 13 aa, Borrelia burgdorferi B31
YLDKMQDARQSAL

SEQ ID NO: 115139 - protein, 13 aa, Borrelia burgdorferi B31
LDKMQDARQSALD

SEQ ID NO: 115140 - protein, 13 aa, Borrelia burgdorferi B31
DKMQDARQSALDL

SEQ ID NO: 115141 - protein, 13 aa, Borrelia burgdorferi B31
KMQDARQSALDLY

SEQ ID NO: 115142 - protein, 13 aa, Borrelia burgdorferi B31
MQDARQSALDLYL

SEQ ID NO: 115143 - protein, 13 aa, Borrelia burgdorferi B31
QDARQSALDLYLN

SEQ ID NO: 115144 - protein, 13 aa, Borrelia burgdorferi B31
DARQSALDLYLNI

SEQ ID NO: 115145 - protein, 13 aa, Borrelia burgdorferi B31
ARQSALDLYLNIT

SEQ ID NO: 115146 - protein, 13 aa, Borrelia burgdorferi B31
RQSALDLYLNITE

SEQ ID NO: 115147 - protein, 13 aa, Borrelia burgdorferi B31
QSALDLYLNITEI

SEQ ID NO: 115148 - protein, 13 aa, Borrelia burgdorferi B31
SALDLYLNITEIR

SEQ ID NO: 115149 - protein, 14 aa, Borrelia burgdorferi B31
MSSCTIDANLNKDY

SEQ ID NO: 115150 - protein, 14 aa, Borrelia burgdorferi B31
SSCTIDANLNKDYK

SEQ ID NO: 115151 - protein, 14 aa, Borrelia burgdorferi B31
SCTIDANLNKDYKN

SEQ ID NO: 115152 - protein, 14 aa, Borrelia burgdorferi B31
CTIDANLNKDYKNK

SEQ ID NO: 115153 - protein, 14 aa, Borrelia burgdorferi B31
TIDANLNKDYKNKV

SEQ ID NO: 115154 - protein, 14 aa, Borrelia burgdorferi B31
IDANLNKDYKNKVE

SEQ ID NO: 115155 - protein, 14 aa, Borrelia burgdorferi B31
DANLNKDYKNKVEE

SEQ ID NO: 115156 - protein, 14 aa, Borrelia burgdorferi B31
ANLNKDYKNKVEEL

SEQ ID NO: 115157 - protein, 14 aa, Borrelia burgdorferi B31
NLNKDYKNKVEELL

SEQ ID NO: 115158 - protein, 14 aa, Borrelia burgdorferi B31
LNKDYKNKVEELLN

SEQ ID NO: 115159 - protein, 14 aa, Borrelia burgdorferi B31
NKDYKNKVEELLNS

SEQ ID NO: 115160 - protein, 14 aa, Borrelia burgdorferi B31
KDYKNKVEELLNSS

SEQ ID NO: 115161 - protein, 14 aa, Borrelia burgdorferi B31
DYKNKVEELLNSST

SEQ ID NO: 115162 - protein, 14 aa, Borrelia burgdorferi B31
YKNKVEELLNSSTD

SEQ ID NO: 115163 - protein, 14 aa, Borrelia burgdorferi B31
KNKVEELLNSSTDD

SEQ ID NO: 115164 - protein, 14 aa, Borrelia burgdorferi B31
NKVEELLNSSTDDQ

SEQ ID NO: 115165 - protein, 14 aa, Borrelia burgdorferi B31
KVEELLNSSTDDQA

SEQ ID NO: 115166 - protein, 14 aa, Borrelia burgdorferi B31
VEELLNSSTDDQAK

SEQ ID NO: 115167 - protein, 14 aa, Borrelia burgdorferi B31
EELLNSSTDDQAKI

SEQ ID NO: 115168 - protein, 14 aa, Borrelia burgdorferi B31
ELLNSSTDDQAKIS

SEQ ID NO: 115169 - protein, 14 aa, Borrelia burgdorferi B31
LLNSSTDDQAKISI

SEQ ID NO: 115170 - protein, 14 aa, Borrelia burgdorferi B31
LNSSTDDQAKISIN

SEQ ID NO: 115171 - protein, 14 aa, Borrelia burgdorferi B31
NSSTDDQAKISINT

SEQ ID NO: 115172 - protein, 14 aa, Borrelia burgdorferi B31
SSTDDQAKISINTG

SEQ ID NO: 115173 - protein, 14 aa, Borrelia burgdorferi B31
STDDQAKISINTGS

SEQ ID NO: 115174 - protein, 14 aa, Borrelia burgdorferi B31
TDDQAKISINTGSN

SEQ ID NO: 115175 - protein, 14 aa, Borrelia burgdorferi B31
DDQAKISINTGSNA

SEQ ID NO: 115176 - protein, 14 aa, Borrelia burgdorferi B31
DQAKISINTGSNAT

SEQ ID NO: 115177 - protein, 14 aa, Borrelia burgdorferi B31
QAKISINTGSNATK

SEQ ID NO: 115178 - protein, 14 aa, Borrelia burgdorferi B31
AKISINTGSNATKN

SEQ ID NO: 115179 - protein, 14 aa, Borrelia burgdorferi B31
KISINTGSNATKNK

SEQ ID NO: 115180 - protein, 14 aa, Borrelia burgdorferi B31
ISINTGSNATKNKT

SEQ ID NO: 115181 - protein, 14 aa, Borrelia burgdorferi B31
SINTGSNATKNKTN

SEQ ID NO: 115182 - protein, 14 aa, Borrelia burgdorferi B31
INTGSNATKNKTNI

SEQ ID NO: 115183 - protein, 14 aa, Borrelia burgdorferi B31
NTGSNATKNKTNIK

SEQ ID NO: 115184 - protein, 14 aa, Borrelia burgdorferi B31
TGSNATKNKTNIKV

SEQ ID NO: 115185 - protein, 14 aa, Borrelia burgdorferi B31
GSNATKNKTNIKVA

SEQ ID NO: 115186 - protein, 14 aa, Borrelia burgdorferi B31
SNATKNKTNIKVAG

SEQ ID NO: 115187 - protein, 14 aa, Borrelia burgdorferi B31
NATKNKTNIKVAGL

SEQ ID NO: 115188 - protein, 14 aa, Borrelia burgdorferi B31
ATKNKTNIKVAGLQ

SEQ ID NO: 115189 - protein, 14 aa, Borrelia burgdorferi B31
TKNKTNIKVAGLQK

SEQ ID NO: 115190 - protein, 14 aa, Borrelia burgdorferi B31
KNKTNIKVAGLQKN

SEQ ID NO: 115191 - protein, 14 aa, Borrelia burgdorferi B31
NKTNIKVAGLQKNT

SEQ ID NO: 115192 - protein, 14 aa, Borrelia burgdorferi B31
KTNIKVAGLQKNTQ

SEQ ID NO: 115193 - protein, 14 aa, Borrelia burgdorferi B31
TNIKVAGLQKNTQS

SEQ ID NO: 115194 - protein, 14 aa, Borrelia burgdorferi B31
NIKVAGLQKNTQSK

SEQ ID NO: 115195 - protein, 14 aa, Borrelia burgdorferi B31
IKVAGLQKNTQSKK

SEQ ID NO: 115196 - protein, 14 aa, Borrelia burgdorferi B31
KVAGLQKNTQSKKN

SEQ ID NO: 115197 - protein, 14 aa, Borrelia burgdorferi B31
VAGLQKNTQSKKNN

SEQ ID NO: 115198 - protein, 14 aa, Borrelia burgdorferi B31
AGLQKNTQSKKNNN

SEQ ID NO: 115199 - protein, 14 aa, Borrelia burgdorferi B31
GLQKNTQSKKNNNL

SEQ ID NO: 115200 - protein, 14 aa, Borrelia burgdorferi B31
LQKNTQSKKNNNLQ

SEQ ID NO: 115201 - protein, 14 aa, Borrelia burgdorferi B31
QKNTQSKKNNNLQG

SEQ ID NO: 115202 - protein, 14 aa, Borrelia burgdorferi B31
KNTQSKKNNNLQGL

SEQ ID NO: 115203 - protein, 14 aa, Borrelia burgdorferi B31
NTQSKKNNNLQGLN

SEQ ID NO: 115204 - protein, 14 aa, Borrelia burgdorferi B31
TQSKKNNNLQGLNP

SEQ ID NO: 115205 - protein, 14 aa, Borrelia burgdorferi B31
QSKKNNNLQGLNPA

SEQ ID NO: 115206 - protein, 14 aa, Borrelia burgdorferi B31
SKKNNNLQGLNPAN

SEQ ID NO: 115207 - protein, 14 aa, Borrelia burgdorferi B31
KKNNNLQGLNPANQ

SEQ ID NO: 115208 - protein, 14 aa, Borrelia burgdorferi B31
KNNNLQGLNPANQV

SEQ ID NO: 115209 - protein, 14 aa, Borrelia burgdorferi B31
NNNLQGLNPANQVN

SEQ ID NO: 115210 - protein, 14 aa, Borrelia burgdorferi B31
NNLQGLNPANQVNP

SEQ ID NO: 115211 - protein, 14 aa, Borrelia burgdorferi B31
NLQGLNPANQVNPG

SEQ ID NO: 115212 - protein, 14 aa, Borrelia burgdorferi B31
LQGLNPANQVNPGN

SEQ ID NO: 115213 - protein, 14 aa, Borrelia burgdorferi B31
QGLNPANQVNPGNP

SEQ ID NO: 115214 - protein, 14 aa, Borrelia burgdorferi B31
GLNPANQVNPGNPM

SEQ ID NO: 115215 - protein, 14 aa, Borrelia burgdorferi B31
LNPANQVNPGNPMQ

SEQ ID NO: 115216 - protein, 14 aa, Borrelia burgdorferi B31
NPANQVNPGNPMQI

SEQ ID NO: 115217 - protein, 14 aa, Borrelia burgdorferi B31
PANQVNPGNPMQIA

SEQ ID NO: 115218 - protein, 14 aa, Borrelia burgdorferi B31
ANQVNPGNPMQIAN

SEQ ID NO: 115219 - protein, 14 aa, Borrelia burgdorferi B31
NQVNPGNPMQIANQ

SEQ ID NO: 115220 - protein, 14 aa, Borrelia burgdorferi B31
QVNPGNPMQIANQA

SEQ ID NO: 115221 - protein, 14 aa, Borrelia burgdorferi B31
VNPGNPMQIANQAN

SEQ ID NO: 115222 - protein, 14 aa, Borrelia burgdorferi B31
NPGNPMQIANQANQ

SEQ ID NO: 115223 - protein, 14 aa, Borrelia burgdorferi B31
PGNPMQIANQANQA

SEQ ID NO: 115224 - protein, 14 aa, Borrelia burgdorferi B31
GNPMQIANQANQAN

SEQ ID NO: 115225 - protein, 14 aa, Borrelia burgdorferi B31
NPMQIANQANQANQ

SEQ ID NO: 115226 - protein, 14 aa, Borrelia burgdorferi B31
PMQIANQANQANQA

SEQ ID NO: 115227 - protein, 14 aa, Borrelia burgdorferi B31
MQIANQANQANQAN

SEQ ID NO: 115228 - protein, 14 aa, Borrelia burgdorferi B31
QIANQANQANQANQ

SEQ ID NO: 115229 - protein, 14 aa, Borrelia burgdorferi B31
IANQANQANQANQA

SEQ ID NO: 115230 - protein, 14 aa, Borrelia burgdorferi B31
ANQANQANQANQAN

SEQ ID NO: 115231 - protein, 14 aa, Borrelia burgdorferi B31
NQANQANQANQANQ

SEQ ID NO: 115232 - protein, 14 aa, Borrelia burgdorferi B31
QANQANQANQANQA

SEQ ID NO: 115233 - protein, 14 aa, Borrelia burgdorferi B31
ANQANQANQANQAN

SEQ ID NO: 115234 - protein, 14 aa, Borrelia burgdorferi B31
NQANQANQANQANQ

SEQ ID NO: 115235 - protein, 14 aa, Borrelia burgdorferi B31
QANQANQANQANQA

SEQ ID NO: 115236 - protein, 14 aa, Borrelia burgdorferi B31
ANQANQANQANQAS

SEQ ID NO: 115237 - protein, 14 aa, Borrelia burgdorferi B31
NQANQANQANQASQ

SEQ ID NO: 115238 - protein, 14 aa, Borrelia burgdorferi B31
QANQANQANQASQA

SEQ ID NO: 115239 - protein, 14 aa, Borrelia burgdorferi B31
ANQANQANQASQAS

SEQ ID NO: 115240 - protein, 14 aa, Borrelia burgdorferi B31
NQANQANQASQASQ

SEQ ID NO: 115241 - protein, 14 aa, Borrelia burgdorferi B31
QANQANQASQASQA

SEQ ID NO: 115242 - protein, 14 aa, Borrelia burgdorferi B31
ANQANQASQASQAS

SEQ ID NO: 115243 - protein, 14 aa, Borrelia burgdorferi B31
NQANQASQASQASQ

SEQ ID NO: 115244 - protein, 14 aa, Borrelia burgdorferi B31
QANQASQASQASQV

SEQ ID NO: 115245 - protein, 14 aa, Borrelia burgdorferi B31
ANQASQASQASQVA

SEQ ID NO: 115246 - protein, 14 aa, Borrelia burgdorferi B31
NQASQASQASQVAS

SEQ ID NO: 115247 - protein, 14 aa, Borrelia burgdorferi B31
QASQASQASQVASS

SEQ ID NO: 115248 - protein, 14 aa, Borrelia burgdorferi B31
ASQASQASQVASSA

SEQ ID NO: 115249 - protein, 14 aa, Borrelia burgdorferi B31
SQASQASQVASSAS

SEQ ID NO: 115250 - protein, 14 aa, Borrelia burgdorferi B31
QASQASQVASSASQ

SEQ ID NO: 115251 - protein, 14 aa, Borrelia burgdorferi B31
ASQASQVASSASQA

SEQ ID NO: 115252 - protein, 14 aa, Borrelia burgdorferi B31
SQASQVASSASQAS

SEQ ID NO: 115253 - protein, 14 aa, Borrelia burgdorferi B31
QASQVASSASQASP

SEQ ID NO: 115254 - protein, 14 aa, Borrelia burgdorferi B31
ASQVASSASQASPV

SEQ ID NO: 115255 - protein, 14 aa, Borrelia burgdorferi B31
SQVASSASQASPVA

SEQ ID NO: 115256 - protein, 14 aa, Borrelia burgdorferi B31
QVASSASQASPVAS

SEQ ID NO: 115257 - protein, 14 aa, Borrelia burgdorferi B31
VASSASQASPVASP

SEQ ID NO: 115258 - protein, 14 aa, Borrelia burgdorferi B31
ASSASQASPVASPA

SEQ ID NO: 115259 - protein, 14 aa, Borrelia burgdorferi B31
SSASQASPVASPAT

SEQ ID NO: 115260 - protein, 14 aa, Borrelia burgdorferi B31
SASQASPVASPATN

SEQ ID NO: 115261 - protein, 14 aa, Borrelia burgdorferi B31
ASQASPVASPATNV

SEQ ID NO: 115262 - protein, 14 aa, Borrelia burgdorferi B31
SQASPVASPATNVQ

SEQ ID NO: 115263 - protein, 14 aa, Borrelia burgdorferi B31
QASPVASPATNVQA

SEQ ID NO: 115264 - protein, 14 aa, Borrelia burgdorferi B31
ASPVASPATNVQAT

SEQ ID NO: 115265 - protein, 14 aa, Borrelia burgdorferi B31
SPVASPATNVQATP

SEQ ID NO: 115266 - protein, 14 aa, Borrelia burgdorferi B31
PVASPATNVQATPP

SEQ ID NO: 115267 - protein, 14 aa, Borrelia burgdorferi B31
VASPATNVQATPPK

SEQ ID NO: 115268 - protein, 14 aa, Borrelia burgdorferi B31
ASPATNVQATPPKQ

SEQ ID NO: 115269 - protein, 14 aa, Borrelia burgdorferi B31
SPATNVQATPPKQI

SEQ ID NO: 115270 - protein, 14 aa, Borrelia burgdorferi B31
PATNVQATPPKQIA

SEQ ID NO: 115271 - protein, 14 aa, Borrelia burgdorferi B31
ATNVQATPPKQIAS

SEQ ID NO: 115272 - protein, 14 aa, Borrelia burgdorferi B31
TNVQATPPKQIASA

SEQ ID NO: 115273 - protein, 14 aa, Borrelia burgdorferi B31
NVQATPPKQIASAQ

SEQ ID NO: 115274 - protein, 14 aa, Borrelia burgdorferi B31
VQATPPKQIASAQA

SEQ ID NO: 115275 - protein, 14 aa, Borrelia burgdorferi B31
QATPPKQIASAQAI

SEQ ID NO: 115276 - protein, 14 aa, Borrelia burgdorferi B31
ATPPKQIASAQAIQ

SEQ ID NO: 115277 - protein, 14 aa, Borrelia burgdorferi B31
TPPKQIASAQAIQT

SEQ ID NO: 115278 - protein, 14 aa, Borrelia burgdorferi B31
PPKQIASAQAIQTV

SEQ ID NO: 115279 - protein, 14 aa, Borrelia burgdorferi B31
PKQIASAQAIQTVP

SEQ ID NO: 115280 - protein, 14 aa, Borrelia burgdorferi B31
KQIASAQAIQTVPN

SEQ ID NO: 115281 - protein, 14 aa, Borrelia burgdorferi B31
QIASAQAIQTVPNN

SEQ ID NO: 115282 - protein, 14 aa, Borrelia burgdorferi B31
IASAQAIQTVPNNT

SEQ ID NO: 115283 - protein, 14 aa, Borrelia burgdorferi B31
ASAQAIQTVPNNTS

SEQ ID NO: 115284 - protein, 14 aa, Borrelia burgdorferi B31
SAQAIQTVPNNTST

SEQ ID NO: 115285 - protein, 14 aa, Borrelia burgdorferi B31
AQAIQTVPNNTSTP

SEQ ID NO: 115286 - protein, 14 aa, Borrelia burgdorferi B31
QAIQTVPNNTSTPN

SEQ ID NO: 115287 - protein, 14 aa, Borrelia burgdorferi B31
AIQTVPNNTSTPNQ

SEQ ID NO: 115288 - protein, 14 aa, Borrelia burgdorferi B31
IQTVPNNTSTPNQS

SEQ ID NO: 115289 - protein, 14 aa, Borrelia burgdorferi B31
QTVPNNTSTPNQSI

SEQ ID NO: 115290 - protein, 14 aa, Borrelia burgdorferi B31
TVPNNTSTPNQSII

SEQ ID NO: 115291 - protein, 14 aa, Borrelia burgdorferi B31
VPNNTSTPNQSIIK

SEQ ID NO: 115292 - protein, 14 aa, Borrelia burgdorferi B31
PNNTSTPNQSIIKP

SEQ ID NO: 115293 - protein, 14 aa, Borrelia burgdorferi B31
NNTSTPNQSIIKPQ

SEQ ID NO: 115294 - protein, 14 aa, Borrelia burgdorferi B31
NTSTPNQSIIKPQQ

SEQ ID NO: 115295 - protein, 14 aa, Borrelia burgdorferi B31
TSTPNQSIIKPQQY

SEQ ID NO: 115296 - protein, 14 aa, Borrelia burgdorferi B31
STPNQSIIKPQQYT

SEQ ID NO: 115297 - protein, 14 aa, Borrelia burgdorferi B31
TPNQSIIKPQQYTF

SEQ ID NO: 115298 - protein, 14 aa, Borrelia burgdorferi B31
PNQSIIKPQQYTFS

SEQ ID NO: 115299 - protein, 14 aa, Borrelia burgdorferi B31
NQSIIKPQQYTFSS

SEQ ID NO: 115300 - protein, 14 aa, Borrelia burgdorferi B31
QSIIKPQQYTFSSS

SEQ ID NO: 115301 - protein, 14 aa, Borrelia burgdorferi B31
SIIKPQQYTFSSSF

SEQ ID NO: 115302 - protein, 14 aa, Borrelia burgdorferi B31
IIKPQQYTFSSSFS

SEQ ID NO: 115303 - protein, 14 aa, Borrelia burgdorferi B31
IKPQQYTFSSSFSQ

SEQ ID NO: 115304 - protein, 14 aa, Borrelia burgdorferi B31
KPQQYTFSSSFSQP

SEQ ID NO: 115305 - protein, 14 aa, Borrelia burgdorferi B31
PQQYTFSSSFSQPT

SEQ ID NO: 115306 - protein, 14 aa, Borrelia burgdorferi B31
QQYTFSSSFSQPTS

SEQ ID NO: 115307 - protein, 14 aa, Borrelia burgdorferi B31
QYTFSSSFSQPTSQ

SEQ ID NO: 115308 - protein, 14 aa, Borrelia burgdorferi B31
YTFSSSFSQPTSQT

SEQ ID NO: 115309 - protein, 14 aa, Borrelia burgdorferi B31
TFSSSFSQPTSQTN

SEQ ID NO: 115310 - protein, 14 aa, Borrelia burgdorferi B31
FSSSFSQPTSQTNF

SEQ ID NO: 115311 - protein, 14 aa, Borrelia burgdorferi B31
SSSFSQPTSQTNFN

SEQ ID NO: 115312 - protein, 14 aa, Borrelia burgdorferi B31
SSFSQPTSQTNFNN

SEQ ID NO: 115313 - protein, 14 aa, Borrelia burgdorferi B31
SFSQPTSQTNFNNS

SEQ ID NO: 115314 - protein, 14 aa, Borrelia burgdorferi B31
FSQPTSQTNFNNSQ

SEQ ID NO: 115315 - protein, 14 aa, Borrelia burgdorferi B31
SQPTSQTNFNNSQS

SEQ ID NO: 115316 - protein, 14 aa, Borrelia burgdorferi B31
QPTSQTNFNNSQSN

SEQ ID NO: 115317 - protein, 14 aa, Borrelia burgdorferi B31
PTSQTNFNNSQSNN

SEQ ID NO: 115318 - protein, 14 aa, Borrelia burgdorferi B31
TSQTNFNNSQSNNV

SEQ ID NO: 115319 - protein, 14 aa, Borrelia burgdorferi B31
SQTNFNNSQSNNVL

SEQ ID NO: 115320 - protein, 14 aa, Borrelia burgdorferi B31
QTNFNNSQSNNVLT

SEQ ID NO: 115321 - protein, 14 aa, Borrelia burgdorferi B31
TNFNNSQSNNVLTN

SEQ ID NO: 115322 - protein, 14 aa, Borrelia burgdorferi B31
NFNNSQSNNVLTNY

SEQ ID NO: 115323 - protein, 14 aa, Borrelia burgdorferi B31
FNNSQSNNVLTNYR

SEQ ID NO: 115324 - protein, 14 aa, Borrelia burgdorferi B31
NNSQSNNVLTNYRH

SEQ ID NO: 115325 - protein, 14 aa, Borrelia burgdorferi B31
NSQSNNVLTNYRHQ

SEQ ID NO: 115326 - protein, 14 aa, Borrelia burgdorferi B31
SQSNNVLTNYRHQT

SEQ ID NO: 115327 - protein, 14 aa, Borrelia burgdorferi B31
QSNNVLTNYRHQTQ

SEQ ID NO: 115328 - protein, 14 aa, Borrelia burgdorferi B31
SNNVLTNYRHQTQP

SEQ ID NO: 115329 - protein, 14 aa, Borrelia burgdorferi B31
NNVLTNYRHQTQPS

SEQ ID NO: 115330 - protein, 14 aa, Borrelia burgdorferi B31
NVLTNYRHQTQPSF

SEQ ID NO: 115331 - protein, 14 aa, Borrelia burgdorferi B31
VLTNYRHQTQPSFV

SEQ ID NO: 115332 - protein, 14 aa, Borrelia burgdorferi B31
LTNYRHQTQPSFVV

SEQ ID NO: 115333 - protein, 14 aa, Borrelia burgdorferi B31
TNYRHQTQPSFVVP

SEQ ID NO: 115334 - protein, 14 aa, Borrelia burgdorferi B31
NYRHQTQPSFVVPV

SEQ ID NO: 115335 - protein, 14 aa, Borrelia burgdorferi B31
YRHQTQPSFVVPVY

SEQ ID NO: 115336 - protein, 14 aa, Borrelia burgdorferi B31
RHQTQPSFVVPVYS

SEQ ID NO: 115337 - protein, 14 aa, Borrelia burgdorferi B31
HQTQPSFVVPVYSG

SEQ ID NO: 115338 - protein, 14 aa, Borrelia burgdorferi B31
QTQPSFVVPVYSGN

SEQ ID NO: 115339 - protein, 14 aa, Borrelia burgdorferi B31
TQPSFVVPVYSGNS

SEQ ID NO: 115340 - protein, 14 aa, Borrelia burgdorferi B31
QPSFVVPVYSGNSP

SEQ ID NO: 115341 - protein, 14 aa, Borrelia burgdorferi B31
PSFVVPVYSGNSPL

SEQ ID NO: 115342 - protein, 14 aa, Borrelia burgdorferi B31
SFVVPVYSGNSPLQ

SEQ ID NO: 115343 - protein, 14 aa, Borrelia burgdorferi B31
FVVPVYSGNSPLQK

SEQ ID NO: 115344 - protein, 14 aa, Borrelia burgdorferi B31
VVPVYSGNSPLQKL

SEQ ID NO: 115345 - protein, 14 aa, Borrelia burgdorferi B31
VPVYSGNSPLQKLK

SEQ ID NO: 115346 - protein, 14 aa, Borrelia burgdorferi B31
PVYSGNSPLQKLKN

SEQ ID NO: 115347 - protein, 14 aa, Borrelia burgdorferi B31
VYSGNSPLQKLKNN

SEQ ID NO: 115348 - protein, 14 aa, Borrelia burgdorferi B31
YSGNSPLQKLKNNL

SEQ ID NO: 115349 - protein, 14 aa, Borrelia burgdorferi B31
SGNSPLQKLKNNLL

SEQ ID NO: 115350 - protein, 14 aa, Borrelia burgdorferi B31
GNSPLQKLKNNLLR

SEQ ID NO: 115351 - protein, 14 aa, Borrelia burgdorferi B31
NSPLQKLKNNLLRR

SEQ ID NO: 115352 - protein, 14 aa, Borrelia burgdorferi B31
SPLQKLKNNLLRRI

SEQ ID NO: 115353 - protein, 14 aa, Borrelia burgdorferi B31
PLQKLKNNLLRRIA

SEQ ID NO: 115354 - protein, 14 aa, Borrelia burgdorferi B31
LQKLKNNLLRRIAE

SEQ ID NO: 115355 - protein, 14 aa, Borrelia burgdorferi B31
QKLKNNLLRRIAEE

SEQ ID NO: 115356 - protein, 14 aa, Borrelia burgdorferi B31
KLKNNLLRRIAEEK

SEQ ID NO: 115357 - protein, 14 aa, Borrelia burgdorferi B31
LKNNLLRRIAEEKN

SEQ ID NO: 115358 - protein, 14 aa, Borrelia burgdorferi B31
KNNLLRRIAEEKNK

SEQ ID NO: 115359 - protein, 14 aa, Borrelia burgdorferi B31
NNLLRRIAEEKNKT

SEQ ID NO: 115360 - protein, 14 aa, Borrelia burgdorferi B31
NLLRRIAEEKNKTH

SEQ ID NO: 115361 - protein, 14 aa, Borrelia burgdorferi B31
LLRRIAEEKNKTHN

SEQ ID NO: 115362 - protein, 14 aa, Borrelia burgdorferi B31
LRRIAEEKNKTHNH

SEQ ID NO: 115363 - protein, 14 aa, Borrelia burgdorferi B31
RRIAEEKNKTHNHG

SEQ ID NO: 115364 - protein, 14 aa, Borrelia burgdorferi B31
RIAEEKNKTHNHGF

SEQ ID NO: 115365 - protein, 14 aa, Borrelia burgdorferi B31
IAEEKNKTHNHGFR

SEQ ID NO: 115366 - protein, 14 aa, Borrelia burgdorferi B31
AEEKNKTHNHGFRE

SEQ ID NO: 115367 - protein, 14 aa, Borrelia burgdorferi B31
EEKNKTHNHGFRET

SEQ ID NO: 115368 - protein, 14 aa, Borrelia burgdorferi B31
EKNKTHNHGFRETY

SEQ ID NO: 115369 - protein, 14 aa, Borrelia burgdorferi B31
KNKTHNHGFRETYD

SEQ ID NO: 115370 - protein, 14 aa, Borrelia burgdorferi B31
NKTHNHGFRETYDQ

SEQ ID NO: 115371 - protein, 14 aa, Borrelia burgdorferi B31
KTHNHGFRETYDQF

SEQ ID NO: 115372 - protein, 14 aa, Borrelia burgdorferi B31
THNHGFRETYDQFK

SEQ ID NO: 115373 - protein, 14 aa, Borrelia burgdorferi B31
HNHGFRETYDQFKM

SEQ ID NO: 115374 - protein, 14 aa, Borrelia burgdorferi B31
NHGFRETYDQFKMK

SEQ ID NO: 115375 - protein, 14 aa, Borrelia burgdorferi B31
HGFRETYDQFKMKD

SEQ ID NO: 115376 - protein, 14 aa, Borrelia burgdorferi B31
GFRETYDQFKMKDS

SEQ ID NO: 115377 - protein, 14 aa, Borrelia burgdorferi B31
FRETYDQFKMKDSA

SEQ ID NO: 115378 - protein, 14 aa, Borrelia burgdorferi B31
RETYDQFKMKDSAF

SEQ ID NO: 115379 - protein, 14 aa, Borrelia burgdorferi B31
ETYDQFKMKDSAFT

SEQ ID NO: 115380 - protein, 14 aa, Borrelia burgdorferi B31
TYDQFKMKDSAFTL

SEQ ID NO: 115381 - protein, 14 aa, Borrelia burgdorferi B31
YDQFKMKDSAFTLL

SEQ ID NO: 115382 - protein, 14 aa, Borrelia burgdorferi B31
DQFKMKDSAFTLLD

SEQ ID NO: 115383 - protein, 14 aa, Borrelia burgdorferi B31
QFKMKDSAFTLLDV

SEQ ID NO: 115384 - protein, 14 aa, Borrelia burgdorferi B31
FKMKDSAFTLLDVI

SEQ ID NO: 115385 - protein, 14 aa, Borrelia burgdorferi B31
KMKDSAFTLLDVIS

SEQ ID NO: 115386 - protein, 14 aa, Borrelia burgdorferi B31
MKDSAFTLLDVISN

SEQ ID NO: 115387 - protein, 14 aa, Borrelia burgdorferi B31
KDSAFTLLDVISNI

SEQ ID NO: 115388 - protein, 14 aa, Borrelia burgdorferi B31
DSAFTLLDVISNIS

SEQ ID NO: 115389 - protein, 14 aa, Borrelia burgdorferi B31
SAFTLLDVISNISV

SEQ ID NO: 115390 - protein, 14 aa, Borrelia burgdorferi B31
AFTLLDVISNISVF

SEQ ID NO: 115391 - protein, 14 aa, Borrelia burgdorferi B31
FTLLDVISNISVFD

SEQ ID NO: 115392 - protein, 14 aa, Borrelia burgdorferi B31
TLLDVISNISVFDR

SEQ ID NO: 115393 - protein, 14 aa, Borrelia burgdorferi B31
LLDVISNISVFDRG

SEQ ID NO: 115394 - protein, 14 aa, Borrelia burgdorferi B31
LDVISNISVFDRGS

SEQ ID NO: 115395 - protein, 14 aa, Borrelia burgdorferi B31
DVISNISVFDRGSA

SEQ ID NO: 115396 - protein, 14 aa, Borrelia burgdorferi B31
VISNISVFDRGSAP

SEQ ID NO: 115397 - protein, 14 aa, Borrelia burgdorferi B31
ISNISVFDRGSAPQ

SEQ ID NO: 115398 - protein, 14 aa, Borrelia burgdorferi B31
SNISVFDRGSAPQL

SEQ ID NO: 115399 - protein, 14 aa, Borrelia burgdorferi B31
NISVFDRGSAPQLS

SEQ ID NO: 115400 - protein, 14 aa, Borrelia burgdorferi B31
ISVFDRGSAPQLSS

SEQ ID NO: 115401 - protein, 14 aa, Borrelia burgdorferi B31
SVFDRGSAPQLSSN

SEQ ID NO: 115402 - protein, 14 aa, Borrelia burgdorferi B31
VFDRGSAPQLSSNT

SEQ ID NO: 115403 - protein, 14 aa, Borrelia burgdorferi B31
FDRGSAPQLSSNTP

SEQ ID NO: 115404 - protein, 14 aa, Borrelia burgdorferi B31
DRGSAPQLSSNTPE

SEQ ID NO: 115405 - protein, 14 aa, Borrelia burgdorferi B31
RGSAPQLSSNTPEA

SEQ ID NO: 115406 - protein, 14 aa, Borrelia burgdorferi B31
GSAPQLSSNTPEAE

SEQ ID NO: 115407 - protein, 14 aa, Borrelia burgdorferi B31
SAPQLSSNTPEAES

SEQ ID NO: 115408 - protein, 14 aa, Borrelia burgdorferi B31
APQLSSNTPEAESE

SEQ ID NO: 115409 - protein, 14 aa, Borrelia burgdorferi B31
PQLSSNTPEAESER

SEQ ID NO: 115410 - protein, 14 aa, Borrelia burgdorferi B31
QLSSNTPEAESERN

SEQ ID NO: 115411 - protein, 14 aa, Borrelia burgdorferi B31
LSSNTPEAESERNR

SEQ ID NO: 115412 - protein, 14 aa, Borrelia burgdorferi B31
SSNTPEAESERNRL

SEQ ID NO: 115413 - protein, 14 aa, Borrelia burgdorferi B31
SNTPEAESERNRLY

SEQ ID NO: 115414 - protein, 14 aa, Borrelia burgdorferi B31
NTPEAESERNRLYA

SEQ ID NO: 115415 - protein, 14 aa, Borrelia burgdorferi B31
TPEAESERNRLYAM

SEQ ID NO: 115416 - protein, 14 aa, Borrelia burgdorferi B31
PEAESERNRLYAMM

SEQ ID NO: 115417 - protein, 14 aa, Borrelia burgdorferi B31
EAESERNRLYAMMD

SEQ ID NO: 115418 - protein, 14 aa, Borrelia burgdorferi B31
AESERNRLYAMMDF

SEQ ID NO: 115419 - protein, 14 aa, Borrelia burgdorferi B31
ESERNRLYAMMDFD

SEQ ID NO: 115420 - protein, 14 aa, Borrelia burgdorferi B31
SERNRLYAMMDFDQ

SEQ ID NO: 115421 - protein, 14 aa, Borrelia burgdorferi B31
ERNRLYAMMDFDQA

SEQ ID NO: 115422 - protein, 14 aa, Borrelia burgdorferi B31
RNRLYAMMDFDQAK

SEQ ID NO: 115423 - protein, 14 aa, Borrelia burgdorferi B31
NRLYAMMDFDQAKT

SEQ ID NO: 115424 - protein, 14 aa, Borrelia burgdorferi B31
RLYAMMDFDQAKTT

SEQ ID NO: 115425 - protein, 14 aa, Borrelia burgdorferi B31
LYAMMDFDQAKTTE

SEQ ID NO: 115426 - protein, 14 aa, Borrelia burgdorferi B31
YAMMDFDQAKTTEF

SEQ ID NO: 115427 - protein, 14 aa, Borrelia burgdorferi B31
AMMDFDQAKTTEFG

SEQ ID NO: 115428 - protein, 14 aa, Borrelia burgdorferi B31
MMDFDQAKTTEFGS

SEQ ID NO: 115429 - protein, 14 aa, Borrelia burgdorferi B31
MDFDQAKTTEFGSI

SEQ ID NO: 115430 - protein, 14 aa, Borrelia burgdorferi B31
DFDQAKTTEFGSIM

SEQ ID NO: 115431 - protein, 14 aa, Borrelia burgdorferi B31
FDQAKTTEFGSIMN

SEQ ID NO: 115432 - protein, 14 aa, Borrelia burgdorferi B31
DQAKTTEFGSIMNI

SEQ ID NO: 115433 - protein, 14 aa, Borrelia burgdorferi B31
QAKTTEFGSIMNIL

SEQ ID NO: 115434 - protein, 14 aa, Borrelia burgdorferi B31
AKTTEFGSIMNILY

SEQ ID NO: 115435 - protein, 14 aa, Borrelia burgdorferi B31
KTTEFGSIMNILYQ

SEQ ID NO: 115436 - protein, 14 aa, Borrelia burgdorferi B31
TTEFGSIMNILYQE

SEQ ID NO: 115437 - protein, 14 aa, Borrelia burgdorferi B31
TEFGSIMNILYQEN

SEQ ID NO: 115438 - protein, 14 aa, Borrelia burgdorferi B31
EFGSIMNILYQENQ

SEQ ID NO: 115439 - protein, 14 aa, Borrelia burgdorferi B31
FGSIMNILYQENQN

SEQ ID NO: 115440 - protein, 14 aa, Borrelia burgdorferi B31
GSIMNILYQENQNH

SEQ ID NO: 115441 - protein, 14 aa, Borrelia burgdorferi B31
SIMNILYQENQNHS

SEQ ID NO: 115442 - protein, 14 aa, Borrelia burgdorferi B31
IMNILYQENQNHSL

SEQ ID NO: 115443 - protein, 14 aa, Borrelia burgdorferi B31
MNILYQENQNHSLI

SEQ ID NO: 115444 - protein, 14 aa, Borrelia burgdorferi B31
NILYQENQNHSLIR

SEQ ID NO: 115445 - protein, 14 aa, Borrelia burgdorferi B31
ILYQENQNHSLIRS

SEQ ID NO: 115446 - protein, 14 aa, Borrelia burgdorferi B31
LYQENQNHSLIRSL

SEQ ID NO: 115447 - protein, 14 aa, Borrelia burgdorferi B31
YQENQNHSLIRSLI

SEQ ID NO: 115448 - protein, 14 aa, Borrelia burgdorferi B31
QENQNHSLIRSLII

SEQ ID NO: 115449 - protein, 14 aa, Borrelia burgdorferi B31
ENQNHSLIRSLIIS

SEQ ID NO: 115450 - protein, 14 aa, Borrelia burgdorferi B31
NQNHSLIRSLIISG

SEQ ID NO: 115451 - protein, 14 aa, Borrelia burgdorferi B31
QNHSLIRSLIISGL

SEQ ID NO: 115452 - protein, 14 aa, Borrelia burgdorferi B31
NHSLIRSLIISGLG

SEQ ID NO: 115453 - protein, 14 aa, Borrelia burgdorferi B31
HSLIRSLIISGLGI

SEQ ID NO: 115454 - protein, 14 aa, Borrelia burgdorferi B31
SLIRSLIISGLGIQ

SEQ ID NO: 115455 - protein, 14 aa, Borrelia burgdorferi B31
LIRSLIISGLGIQI

SEQ ID NO: 115456 - protein, 14 aa, Borrelia burgdorferi B31
IRSLIISGLGIQIS

SEQ ID NO: 115457 - protein, 14 aa, Borrelia burgdorferi B31
RSLIISGLGIQISL

SEQ ID NO: 115458 - protein, 14 aa, Borrelia burgdorferi B31
SLIISGLGIQISLE

SEQ ID NO: 115459 - protein, 14 aa, Borrelia burgdorferi B31
LIISGLGIQISLES

SEQ ID NO: 115460 - protein, 14 aa, Borrelia burgdorferi B31
IISGLGIQISLEST

SEQ ID NO: 115461 - protein, 14 aa, Borrelia burgdorferi B31
ISGLGIQISLESTL

SEQ ID NO: 115462 - protein, 14 aa, Borrelia burgdorferi B31
SGLGIQISLESTLE

SEQ ID NO: 115463 - protein, 14 aa, Borrelia burgdorferi B31
GLGIQISLESTLEE

SEQ ID NO: 115464 - protein, 14 aa, Borrelia burgdorferi B31
LGIQISLESTLEEI

SEQ ID NO: 115465 - protein, 14 aa, Borrelia burgdorferi B31
GIQISLESTLEEIE

SEQ ID NO: 115466 - protein, 14 aa, Borrelia burgdorferi B31
IQISLESTLEEIEK

SEQ ID NO: 115467 - protein, 14 aa, Borrelia burgdorferi B31
QISLESTLEEIEKK

SEQ ID NO: 115468 - protein, 14 aa, Borrelia burgdorferi B31
ISLESTLEEIEKKI

SEQ ID NO: 115469 - protein, 14 aa, Borrelia burgdorferi B31
SLESTLEEIEKKIE

SEQ ID NO: 115470 - protein, 14 aa, Borrelia burgdorferi B31
LESTLEEIEKKIES

SEQ ID NO: 115471 - protein, 14 aa, Borrelia burgdorferi B31
ESTLEEIEKKIESF

SEQ ID NO: 115472 - protein, 14 aa, Borrelia burgdorferi B31
STLEEIEKKIESFN

SEQ ID NO: 115473 - protein, 14 aa, Borrelia burgdorferi B31
TLEEIEKKIESFNT

SEQ ID NO: 115474 - protein, 14 aa, Borrelia burgdorferi B31
LEEIEKKIESFNTQ

SEQ ID NO: 115475 - protein, 14 aa, Borrelia burgdorferi B31
EEIEKKIESFNTQY

SEQ ID NO: 115476 - protein, 14 aa, Borrelia burgdorferi B31
EIEKKIESFNTQYL

SEQ ID NO: 115477 - protein, 14 aa, Borrelia burgdorferi B31
IEKKIESFNTQYLN

SEQ ID NO: 115478 - protein, 14 aa, Borrelia burgdorferi B31
EKKIESFNTQYLNT

SEQ ID NO: 115479 - protein, 14 aa, Borrelia burgdorferi B31
KKIESFNTQYLNTI

SEQ ID NO: 115480 - protein, 14 aa, Borrelia burgdorferi B31
KIESFNTQYLNTII

SEQ ID NO: 115481 - protein, 14 aa, Borrelia burgdorferi B31
IESFNTQYLNTIIN

SEQ ID NO: 115482 - protein, 14 aa, Borrelia burgdorferi B31
ESFNTQYLNTIINS

SEQ ID NO: 115483 - protein, 14 aa, Borrelia burgdorferi B31
SFNTQYLNTIINSY

SEQ ID NO: 115484 - protein, 14 aa, Borrelia burgdorferi B31
FNTQYLNTIINSYT

SEQ ID NO: 115485 - protein, 14 aa, Borrelia burgdorferi B31
NTQYLNTIINSYTF

SEQ ID NO: 115486 - protein, 14 aa, Borrelia burgdorferi B31
TQYLNTIINSYTFK

SEQ ID NO: 115487 - protein, 14 aa, Borrelia burgdorferi B31
QYLNTIINSYTFKD

SEQ ID NO: 115488 - protein, 14 aa, Borrelia burgdorferi B31
YLNTIINSYTFKDK

SEQ ID NO: 115489 - protein, 14 aa, Borrelia burgdorferi B31
LNTIINSYTFKDKL

SEQ ID NO: 115490 - protein, 14 aa, Borrelia burgdorferi B31
NTIINSYTFKDKLK

SEQ ID NO: 115491 - protein, 14 aa, Borrelia burgdorferi B31
TIINSYTFKDKLKE

SEQ ID NO: 115492 - protein, 14 aa, Borrelia burgdorferi B31
IINSYTFKDKLKEL

SEQ ID NO: 115493 - protein, 14 aa, Borrelia burgdorferi B31
INSYTFKDKLKELE

SEQ ID NO: 115494 - protein, 14 aa, Borrelia burgdorferi B31
NSYTFKDKLKELES

SEQ ID NO: 115495 - protein, 14 aa, Borrelia burgdorferi B31
SYTFKDKLKELESK

SEQ ID NO: 115496 - protein, 14 aa, Borrelia burgdorferi B31
YTFKDKLKELESKL

SEQ ID NO: 115497 - protein, 14 aa, Borrelia burgdorferi B31
TFKDKLKELESKLN

SEQ ID NO: 115498 - protein, 14 aa, Borrelia burgdorferi B31
FKDKLKELESKLNS

SEQ ID NO: 115499 - protein, 14 aa, Borrelia burgdorferi B31
KDKLKELESKLNSI

SEQ ID NO: 115500 - protein, 14 aa, Borrelia burgdorferi B31
DKLKELESKLNSIL

SEQ ID NO: 115501 - protein, 14 aa, Borrelia burgdorferi B31
KLKELESKLNSILA

SEQ ID NO: 115502 - protein, 14 aa, Borrelia burgdorferi B31
LKELESKLNSILAE

SEQ ID NO: 115503 - protein, 14 aa, Borrelia burgdorferi B31
KELESKLNSILAEK

SEQ ID NO: 115504 - protein, 14 aa, Borrelia burgdorferi B31
ELESKLNSILAEKK

SEQ ID NO: 115505 - protein, 14 aa, Borrelia burgdorferi B31
LESKLNSILAEKKE

SEQ ID NO: 115506 - protein, 14 aa, Borrelia burgdorferi B31
ESKLNSILAEKKEW

SEQ ID NO: 115507 - protein, 14 aa, Borrelia burgdorferi B31
SKLNSILAEKKEWL

SEQ ID NO: 115508 - protein, 14 aa, Borrelia burgdorferi B31
KLNSILAEKKEWLN

SEQ ID NO: 115509 - protein, 14 aa, Borrelia burgdorferi B31
LNSILAEKKEWLNY

SEQ ID NO: 115510 - protein, 14 aa, Borrelia burgdorferi B31
NSILAEKKEWLNYA

SEQ ID NO: 115511 - protein, 14 aa, Borrelia burgdorferi B31
SILAEKKEWLNYAD

SEQ ID NO: 115512 - protein, 14 aa, Borrelia burgdorferi B31
ILAEKKEWLNYADA

SEQ ID NO: 115513 - protein, 14 aa, Borrelia burgdorferi B31
LAEKKEWLNYADAI

SEQ ID NO: 115514 - protein, 14 aa, Borrelia burgdorferi B31
AEKKEWLNYADAII

SEQ ID NO: 115515 - protein, 14 aa, Borrelia burgdorferi B31
EKKEWLNYADAIIT

SEQ ID NO: 115516 - protein, 14 aa, Borrelia burgdorferi B31
KKEWLNYADAIITN

SEQ ID NO: 115517 - protein, 14 aa, Borrelia burgdorferi B31
KEWLNYADAIITNT

SEQ ID NO: 115518 - protein, 14 aa, Borrelia burgdorferi B31
EWLNYADAIITNTS

SEQ ID NO: 115519 - protein, 14 aa, Borrelia burgdorferi B31
WLNYADAIITNTSS

SEQ ID NO: 115520 - protein, 14 aa, Borrelia burgdorferi B31
LNYADAIITNTSSN

SEQ ID NO: 115521 - protein, 14 aa, Borrelia burgdorferi B31
NYADAIITNTSSNS

SEQ ID NO: 115522 - protein, 14 aa, Borrelia burgdorferi B31
YADAIITNTSSNSK

SEQ ID NO: 115523 - protein, 14 aa, Borrelia burgdorferi B31
ADAIITNTSSNSKR

SEQ ID NO: 115524 - protein, 14 aa, Borrelia burgdorferi B31
DAIITNTSSNSKRN

SEQ ID NO: 115525 - protein, 14 aa, Borrelia burgdorferi B31
AIITNTSSNSKRND

SEQ ID NO: 115526 - protein, 14 aa, Borrelia burgdorferi B31
IITNTSSNSKRNDP

SEQ ID NO: 115527 - protein, 14 aa, Borrelia burgdorferi B31
ITNTSSNSKRNDPQ

SEQ ID NO: 115528 - protein, 14 aa, Borrelia burgdorferi B31
TNTSSNSKRNDPQS

SEQ ID NO: 115529 - protein, 14 aa, Borrelia burgdorferi B31
NTSSNSKRNDPQSL

SEQ ID NO: 115530 - protein, 14 aa, Borrelia burgdorferi B31
TSSNSKRNDPQSLG

SEQ ID NO: 115531 - protein, 14 aa, Borrelia burgdorferi B31
SSNSKRNDPQSLGQ

SEQ ID NO: 115532 - protein, 14 aa, Borrelia burgdorferi B31
SNSKRNDPQSLGQY

SEQ ID NO: 115533 - protein, 14 aa, Borrelia burgdorferi B31
NSKRNDPQSLGQYI

SEQ ID NO: 115534 - protein, 14 aa, Borrelia burgdorferi B31
SKRNDPQSLGQYIK

SEQ ID NO: 115535 - protein, 14 aa, Borrelia burgdorferi B31
KRNDPQSLGQYIKN

SEQ ID NO: 115536 - protein, 14 aa, Borrelia burgdorferi B31
RNDPQSLGQYIKNK

SEQ ID NO: 115537 - protein, 14 aa, Borrelia burgdorferi B31
NDPQSLGQYIKNKY

SEQ ID NO: 115538 - protein, 14 aa, Borrelia burgdorferi B31
DPQSLGQYIKNKYL

SEQ ID NO: 115539 - protein, 14 aa, Borrelia burgdorferi B31
PQSLGQYIKNKYLD

SEQ ID NO: 115540 - protein, 14 aa, Borrelia burgdorferi B31
QSLGQYIKNKYLDK

SEQ ID NO: 115541 - protein, 14 aa, Borrelia burgdorferi B31
SLGQYIKNKYLDKM

SEQ ID NO: 115542 - protein, 14 aa, Borrelia burgdorferi B31
LGQYIKNKYLDKMQ

SEQ ID NO: 115543 - protein, 14 aa, Borrelia burgdorferi B31
GQYIKNKYLDKMQD

SEQ ID NO: 115544 - protein, 14 aa, Borrelia burgdorferi B31
QYIKNKYLDKMQDA

SEQ ID NO: 115545 - protein, 14 aa, Borrelia burgdorferi B31
YIKNKYLDKMQDAR

SEQ ID NO: 115546 - protein, 14 aa, Borrelia burgdorferi B31
IKNKYLDKMQDARQ

SEQ ID NO: 115547 - protein, 14 aa, Borrelia burgdorferi B31
KNKYLDKMQDARQS

SEQ ID NO: 115548 - protein, 14 aa, Borrelia burgdorferi B31
NKYLDKMQDARQSA

SEQ ID NO: 115549 - protein, 14 aa, Borrelia burgdorferi B31
KYLDKMQDARQSAL

SEQ ID NO: 115550 - protein, 14 aa, Borrelia burgdorferi B31
YLDKMQDARQSALD

SEQ ID NO: 115551 - protein, 14 aa, Borrelia burgdorferi B31
LDKMQDARQSALDL

SEQ ID NO: 115552 - protein, 14 aa, Borrelia burgdorferi B31
DKMQDARQSALDLY

SEQ ID NO: 115553 - protein, 14 aa, Borrelia burgdorferi B31
KMQDARQSALDLYL

SEQ ID NO: 115554 - protein, 14 aa, Borrelia burgdorferi B31
MQDARQSALDLYLN

SEQ ID NO: 115555 - protein, 14 aa, Borrelia burgdorferi B31
QDARQSALDLYLNI

SEQ ID NO: 115556 - protein, 14 aa, Borrelia burgdorferi B31
DARQSALDLYLNIT

SEQ ID NO: 115557 - protein, 14 aa, Borrelia burgdorferi B31
ARQSALDLYLNITE

SEQ ID NO: 115558 - protein, 14 aa, Borrelia burgdorferi B31
RQSALDLYLNITEI

SEQ ID NO: 115559 - protein, 14 aa, Borrelia burgdorferi B31
QSALDLYLNITEIR

SEQ ID NO: 115560 - protein, 15 aa, Borrelia burgdorferi B31
MSSCTIDANLNKDYK

SEQ ID NO: 115561 - protein, 15 aa, Borrelia burgdorferi B31
SSCTIDANLNKDYKN

SEQ ID NO: 115562 - protein, 15 aa, Borrelia burgdorferi B31
SCTIDANLNKDYKNK

SEQ ID NO: 115563 - protein, 15 aa, Borrelia burgdorferi B31
CTIDANLNKDYKNKV

SEQ ID NO: 115564 - protein, 15 aa, Borrelia burgdorferi B31
TIDANLNKDYKNKVE

SEQ ID NO: 115565 - protein, 15 aa, Borrelia burgdorferi B31
IDANLNKDYKNKVEE

SEQ ID NO: 115566 - protein, 15 aa, Borrelia burgdorferi B31
DANLNKDYKNKVEEL

SEQ ID NO: 115567 - protein, 15 aa, Borrelia burgdorferi B31
ANLNKDYKNKVEELL

SEQ ID NO: 115568 - protein, 15 aa, Borrelia burgdorferi B31
NLNKDYKNKVEELLN

SEQ ID NO: 115569 - protein, 15 aa, Borrelia burgdorferi B31
LNKDYKNKVEELLNS

SEQ ID NO: 115570 - protein, 15 aa, Borrelia burgdorferi B31
NKDYKNKVEELLNSS

SEQ ID NO: 115571 - protein, 15 aa, Borrelia burgdorferi B31
KDYKNKVEELLNSST

SEQ ID NO: 115572 - protein, 15 aa, Borrelia burgdorferi B31
DYKNKVEELLNSSTD

SEQ ID NO: 115573 - protein, 15 aa, Borrelia burgdorferi B31
YKNKVEELLNSSTDD

SEQ ID NO: 115574 - protein, 15 aa, Borrelia burgdorferi B31
KNKVEELLNSSTDDQ

SEQ ID NO: 115575 - protein, 15 aa, Borrelia burgdorferi B31
NKVEELLNSSTDDQA

SEQ ID NO: 115576 - protein, 15 aa, Borrelia burgdorferi B31
KVEELLNSSTDDQAK

SEQ ID NO: 115577 - protein, 15 aa, Borrelia burgdorferi B31
VEELLNSSTDDQAKI

SEQ ID NO: 115578 - protein, 15 aa, Borrelia burgdorferi B31
EELLNSSTDDQAKIS

SEQ ID NO: 115579 - protein, 15 aa, Borrelia burgdorferi B31
ELLNSSTDDQAKISI

SEQ ID NO: 115580 - protein, 15 aa, Borrelia burgdorferi B31
LLNSSTDDQAKISIN

SEQ ID NO: 115581 - protein, 15 aa, Borrelia burgdorferi B31
LNSSTDDQAKISINT

SEQ ID NO: 115582 - protein, 15 aa, Borrelia burgdorferi B31
NSSTDDQAKISINTG

SEQ ID NO: 115583 - protein, 15 aa, Borrelia burgdorferi B31
SSTDDQAKISINTGS

SEQ ID NO: 115584 - protein, 15 aa, Borrelia burgdorferi B31
STDDQAKISINTGSN

SEQ ID NO: 115585 - protein, 15 aa, Borrelia burgdorferi B31
TDDQAKISINTGSNA

SEQ ID NO: 115586 - protein, 15 aa, Borrelia burgdorferi B31
DDQAKISINTGSNAT

SEQ ID NO: 115587 - protein, 15 aa, Borrelia burgdorferi B31
DQAKISINTGSNATK

SEQ ID NO: 115588 - protein, 15 aa, Borrelia burgdorferi B31
QAKISINTGSNATKN

SEQ ID NO: 115589 - protein, 15 aa, Borrelia burgdorferi B31
AKISINTGSNATKNK

SEQ ID NO: 115590 - protein, 15 aa, Borrelia burgdorferi B31
KISINTGSNATKNKT

SEQ ID NO: 115591 - protein, 15 aa, Borrelia burgdorferi B31
ISINTGSNATKNKTN

SEQ ID NO: 115592 - protein, 15 aa, Borrelia burgdorferi B31
SINTGSNATKNKTNI

SEQ ID NO: 115593 - protein, 15 aa, Borrelia burgdorferi B31
INTGSNATKNKTNIK

SEQ ID NO: 115594 - protein, 15 aa, Borrelia burgdorferi B31
NTGSNATKNKTNIKV

SEQ ID NO: 115595 - protein, 15 aa, Borrelia burgdorferi B31
TGSNATKNKTNIKVA

SEQ ID NO: 115596 - protein, 15 aa, Borrelia burgdorferi B31
GSNATKNKTNIKVAG

SEQ ID NO: 115597 - protein, 15 aa, Borrelia burgdorferi B31
SNATKNKTNIKVAGL

SEQ ID NO: 115598 - protein, 15 aa, Borrelia burgdorferi B31
NATKNKTNIKVAGLQ

SEQ ID NO: 115599 - protein, 15 aa, Borrelia burgdorferi B31
ATKNKTNIKVAGLQK

SEQ ID NO: 115600 - protein, 15 aa, Borrelia burgdorferi B31
TKNKTNIKVAGLQKN

SEQ ID NO: 115601 - protein, 15 aa, Borrelia burgdorferi B31
KNKTNIKVAGLQKNT

SEQ ID NO: 115602 - protein, 15 aa, Borrelia burgdorferi B31
NKTNIKVAGLQKNTQ

SEQ ID NO: 115603 - protein, 15 aa, Borrelia burgdorferi B31
KTNIKVAGLQKNTQS

SEQ ID NO: 115604 - protein, 15 aa, Borrelia burgdorferi B31
TNIKVAGLQKNTQSK

SEQ ID NO: 115605 - protein, 15 aa, Borrelia burgdorferi B31
NIKVAGLQKNTQSKK

SEQ ID NO: 115606 - protein, 15 aa, Borrelia burgdorferi B31
IKVAGLQKNTQSKKN

SEQ ID NO: 115607 - protein, 15 aa, Borrelia burgdorferi B31
KVAGLQKNTQSKKNN

SEQ ID NO: 115608 - protein, 15 aa, Borrelia burgdorferi B31
VAGLQKNTQSKKNNN

SEQ ID NO: 115609 - protein, 15 aa, Borrelia burgdorferi B31
AGLQKNTQSKKNNNL

SEQ ID NO: 115610 - protein, 15 aa, Borrelia burgdorferi B31
GLQKNTQSKKNNNLQ

SEQ ID NO: 115611 - protein, 15 aa, Borrelia burgdorferi B31
LQKNTQSKKNNNLQG

SEQ ID NO: 115612 - protein, 15 aa, Borrelia burgdorferi B31
QKNTQSKKNNNLQGL

SEQ ID NO: 115613 - protein, 15 aa, Borrelia burgdorferi B31
KNTQSKKNNNLQGLN

SEQ ID NO: 115614 - protein, 15 aa, Borrelia burgdorferi B31
NTQSKKNNNLQGLNP

SEQ ID NO: 115615 - protein, 15 aa, Borrelia burgdorferi B31
TQSKKNNNLQGLNPA

SEQ ID NO: 115616 - protein, 15 aa, Borrelia burgdorferi B31
QSKKNNNLQGLNPAN

SEQ ID NO: 115617 - protein, 15 aa, Borrelia burgdorferi B31
SKKNNNLQGLNPANQ

SEQ ID NO: 115618 - protein, 15 aa, Borrelia burgdorferi B31
KKNNNLQGLNPANQV

SEQ ID NO: 115619 - protein, 15 aa, Borrelia burgdorferi B31
KNNNLQGLNPANQVN

SEQ ID NO: 115620 - protein, 15 aa, Borrelia burgdorferi B31
NNNLQGLNPANQVNP

SEQ ID NO: 115621 - protein, 15 aa, Borrelia burgdorferi B31
NNLQGLNPANQVNPG

SEQ ID NO: 115622 - protein, 15 aa, Borrelia burgdorferi B31
NLQGLNPANQVNPGN

SEQ ID NO: 115623 - protein, 15 aa, Borrelia burgdorferi B31
LQGLNPANQVNPGNP

SEQ ID NO: 115624 - protein, 15 aa, Borrelia burgdorferi B31
QGLNPANQVNPGNPM

SEQ ID NO: 115625 - protein, 15 aa, Borrelia burgdorferi B31
GLNPANQVNPGNPMQ

SEQ ID NO: 115626 - protein, 15 aa, Borrelia burgdorferi B31
LNPANQVNPGNPMQI

SEQ ID NO: 115627 - protein, 15 aa, Borrelia burgdorferi B31
NPANQVNPGNPMQIA

SEQ ID NO: 115628 - protein, 15 aa, Borrelia burgdorferi B31
PANQVNPGNPMQIAN

SEQ ID NO: 115629 - protein, 15 aa, Borrelia burgdorferi B31
ANQVNPGNPMQIANQ

SEQ ID NO: 115630 - protein, 15 aa, Borrelia burgdorferi B31
NQVNPGNPMQIANQA

SEQ ID NO: 115631 - protein, 15 aa, Borrelia burgdorferi B31
QVNPGNPMQIANQAN

SEQ ID NO: 115632 - protein, 15 aa, Borrelia burgdorferi B31
VNPGNPMQIANQANQ

SEQ ID NO: 115633 - protein, 15 aa, Borrelia burgdorferi B31
NPGNPMQIANQANQA

SEQ ID NO: 115634 - protein, 15 aa, Borrelia burgdorferi B31
PGNPMQIANQANQAN

SEQ ID NO: 115635 - protein, 15 aa, Borrelia burgdorferi B31
GNPMQIANQANQANQ

SEQ ID NO: 115636 - protein, 15 aa, Borrelia burgdorferi B31
NPMQIANQANQANQA

SEQ ID NO: 115637 - protein, 15 aa, Borrelia burgdorferi B31
PMQIANQANQANQAN

SEQ ID NO: 115638 - protein, 15 aa, Borrelia burgdorferi B31
MQIANQANQANQANQ

SEQ ID NO: 115639 - protein, 15 aa, Borrelia burgdorferi B31
QIANQANQANQANQA

SEQ ID NO: 115640 - protein, 15 aa, Borrelia burgdorferi B31
IANQANQANQANQAN

SEQ ID NO: 115641 - protein, 15 aa, Borrelia burgdorferi B31
ANQANQANQANQANQ

SEQ ID NO: 115642 - protein, 15 aa, Borrelia burgdorferi B31
NQANQANQANQANQA

SEQ ID NO: 115643 - protein, 15 aa, Borrelia burgdorferi B31
QANQANQANQANQAN

SEQ ID NO: 115644 - protein, 15 aa, Borrelia burgdorferi B31
ANQANQANQANQANQ

SEQ ID NO: 115645 - protein, 15 aa, Borrelia burgdorferi B31
NQANQANQANQANQA

SEQ ID NO: 115646 - protein, 15 aa, Borrelia burgdorferi B31
QANQANQANQANQAS

SEQ ID NO: 115647 - protein, 15 aa, Borrelia burgdorferi B31
ANQANQANQANQASQ

SEQ ID NO: 115648 - protein, 15 aa, Borrelia burgdorferi B31
NQANQANQANQASQA

SEQ ID NO: 115649 - protein, 15 aa, Borrelia burgdorferi B31
QANQANQANQASQAS

SEQ ID NO: 115650 - protein, 15 aa, Borrelia burgdorferi B31
ANQANQANQASQASQ

SEQ ID NO: 115651 - protein, 15 aa, Borrelia burgdorferi B31
NQANQANQASQASQA

SEQ ID NO: 115652 - protein, 15 aa, Borrelia burgdorferi B31
QANQANQASQASQAS

SEQ ID NO: 115653 - protein, 15 aa, Borrelia burgdorferi B31
ANQANQASQASQASQ

SEQ ID NO: 115654 - protein, 15 aa, Borrelia burgdorferi B31
NQANQASQASQASQV

SEQ ID NO: 115655 - protein, 15 aa, Borrelia burgdorferi B31
QANQASQASQASQVA

SEQ ID NO: 115656 - protein, 15 aa, Borrelia burgdorferi B31
ANQASQASQASQVAS

SEQ ID NO: 115657 - protein, 15 aa, Borrelia burgdorferi B31
NQASQASQASQVASS

SEQ ID NO: 115658 - protein, 15 aa, Borrelia burgdorferi B31
QASQASQASQVASSA

SEQ ID NO: 115659 - protein, 15 aa, Borrelia burgdorferi B31
ASQASQASQVASSAS

SEQ ID NO: 115660 - protein, 15 aa, Borrelia burgdorferi B31
SQASQASQVASSASQ

SEQ ID NO: 115661 - protein, 15 aa, Borrelia burgdorferi B31
QASQASQVASSASQA

SEQ ID NO: 115662 - protein, 15 aa, Borrelia burgdorferi B31
ASQASQVASSASQAS

SEQ ID NO: 115663 - protein, 15 aa, Borrelia burgdorferi B31
SQASQVASSASQASP

SEQ ID NO: 115664 - protein, 15 aa, Borrelia burgdorferi B31
QASQVASSASQASPV

SEQ ID NO: 115665 - protein, 15 aa, Borrelia burgdorferi B31
ASQVASSASQASPVA

SEQ ID NO: 115666 - protein, 15 aa, Borrelia burgdorferi B31
SQVASSASQASPVAS

SEQ ID NO: 115667 - protein, 15 aa, Borrelia burgdorferi B31
QVASSASQASPVASP

SEQ ID NO: 115668 - protein, 15 aa, Borrelia burgdorferi B31
VASSASQASPVASPA

SEQ ID NO: 115669 - protein, 15 aa, Borrelia burgdorferi B31
ASSASQASPVASPAT

SEQ ID NO: 115670 - protein, 15 aa, Borrelia burgdorferi B31
SSASQASPVASPATN

SEQ ID NO: 115671 - protein, 15 aa, Borrelia burgdorferi B31
SASQASPVASPATNV

SEQ ID NO: 115672 - protein, 15 aa, Borrelia burgdorferi B31
ASQASPVASPATNVQ

SEQ ID NO: 115673 - protein, 15 aa, Borrelia burgdorferi B31
SQASPVASPATNVQA

SEQ ID NO: 115674 - protein, 15 aa, Borrelia burgdorferi B31
QASPVASPATNVQAT

SEQ ID NO: 115675 - protein, 15 aa, Borrelia burgdorferi B31
ASPVASPATNVQATP

SEQ ID NO: 115676 - protein, 15 aa, Borrelia burgdorferi B31
SPVASPATNVQATPP

SEQ ID NO: 115677 - protein, 15 aa, Borrelia burgdorferi B31
PVASPATNVQATPPK

SEQ ID NO: 115678 - protein, 15 aa, Borrelia burgdorferi B31
VASPATNVQATPPKQ

SEQ ID NO: 115679 - protein, 15 aa, Borrelia burgdorferi B31
ASPATNVQATPPKQI

SEQ ID NO: 115680 - protein, 15 aa, Borrelia burgdorferi B31
SPATNVQATPPKQIA

SEQ ID NO: 115681 - protein, 15 aa, Borrelia burgdorferi B31
PATNVQATPPKQIAS

SEQ ID NO: 115682 - protein, 15 aa, Borrelia burgdorferi B31
ATNVQATPPKQIASA

SEQ ID NO: 115683 - protein, 15 aa, Borrelia burgdorferi B31
TNVQATPPKQIASAQ

SEQ ID NO: 115684 - protein, 15 aa, Borrelia burgdorferi B31
NVQATPPKQIASAQA

SEQ ID NO: 115685 - protein, 15 aa, Borrelia burgdorferi B31
VQATPPKQIASAQAI

SEQ ID NO: 115686 - protein, 15 aa, Borrelia burgdorferi B31
QATPPKQIASAQAIQ

SEQ ID NO: 115687 - protein, 15 aa, Borrelia burgdorferi B31
ATPPKQIASAQAIQT

SEQ ID NO: 115688 - protein, 15 aa, Borrelia burgdorferi B31
TPPKQIASAQAIQTV

SEQ ID NO: 115689 - protein, 15 aa, Borrelia burgdorferi B31
PPKQIASAQAIQTVP

SEQ ID NO: 115690 - protein, 15 aa, Borrelia burgdorferi B31
PKQIASAQAIQTVPN

SEQ ID NO: 115691 - protein, 15 aa, Borrelia burgdorferi B31
KQIASAQAIQTVPNN

SEQ ID NO: 115692 - protein, 15 aa, Borrelia burgdorferi B31
QIASAQAIQTVPNNT

SEQ ID NO: 115693 - protein, 15 aa, Borrelia burgdorferi B31
IASAQAIQTVPNNTS

SEQ ID NO: 115694 - protein, 15 aa, Borrelia burgdorferi B31
ASAQAIQTVPNNTST

SEQ ID NO: 115695 - protein, 15 aa, Borrelia burgdorferi B31
SAQAIQTVPNNTSTP

SEQ ID NO: 115696 - protein, 15 aa, Borrelia burgdorferi B31
AQAIQTVPNNTSTPN

SEQ ID NO: 115697 - protein, 15 aa, Borrelia burgdorferi B31
QAIQTVPNNTSTPNQ

SEQ ID NO: 115698 - protein, 15 aa, Borrelia burgdorferi B31
AIQTVPNNTSTPNQS

SEQ ID NO: 115699 - protein, 15 aa, Borrelia burgdorferi B31
IQTVPNNTSTPNQSI

SEQ ID NO: 115700 - protein, 15 aa, Borrelia burgdorferi B31
QTVPNNTSTPNQSII

SEQ ID NO: 115701 - protein, 15 aa, Borrelia burgdorferi B31
TVPNNTSTPNQSIIK

SEQ ID NO: 115702 - protein, 15 aa, Borrelia burgdorferi B31
VPNNTSTPNQSIIKP

SEQ ID NO: 115703 - protein, 15 aa, Borrelia burgdorferi B31
PNNTSTPNQSIIKPQ

SEQ ID NO: 115704 - protein, 15 aa, Borrelia burgdorferi B31
NNTSTPNQSIIKPQQ

SEQ ID NO: 115705 - protein, 15 aa, Borrelia burgdorferi B31
NTSTPNQSIIKPQQY

SEQ ID NO: 115706 - protein, 15 aa, Borrelia burgdorferi B31
TSTPNQSIIKPQQYT

SEQ ID NO: 115707 - protein, 15 aa, Borrelia burgdorferi B31
STPNQSIIKPQQYTF

SEQ ID NO: 115708 - protein, 15 aa, Borrelia burgdorferi B31
TPNQSIIKPQQYTFS

SEQ ID NO: 115709 - protein, 15 aa, Borrelia burgdorferi B31
PNQSIIKPQQYTFSS

SEQ ID NO: 115710 - protein, 15 aa, Borrelia burgdorferi B31
NQSIIKPQQYTFSSS

SEQ ID NO: 115711 - protein, 15 aa, Borrelia burgdorferi B31
QSIIKPQQYTFSSSF

SEQ ID NO: 115712 - protein, 15 aa, Borrelia burgdorferi B31
SIIKPQQYTFSSSFS

SEQ ID NO: 115713 - protein, 15 aa, Borrelia burgdorferi B31
IIKPQQYTFSSSFSQ

SEQ ID NO: 115714 - protein, 15 aa, Borrelia burgdorferi B31
IKPQQYTFSSSFSQP

SEQ ID NO: 115715 - protein, 15 aa, Borrelia burgdorferi B31
KPQQYTFSSSFSQPT

SEQ ID NO: 115716 - protein, 15 aa, Borrelia burgdorferi B31
PQQYTFSSSFSQPTS

SEQ ID NO: 115717 - protein, 15 aa, Borrelia burgdorferi B31
QQYTFSSSFSQPTSQ

SEQ ID NO: 115718 - protein, 15 aa, Borrelia burgdorferi B31
QYTFSSSFSQPTSQT

SEQ ID NO: 115719 - protein, 15 aa, Borrelia burgdorferi B31
YTFSSSFSQPTSQTN

SEQ ID NO: 115720 - protein, 15 aa, Borrelia burgdorferi B31
TFSSSFSQPTSQTNF

SEQ ID NO: 115721 - protein, 15 aa, Borrelia burgdorferi B31
FSSSFSQPTSQTNFN

SEQ ID NO: 115722 - protein, 15 aa, Borrelia burgdorferi B31
SSSFSQPTSQTNFNN

SEQ ID NO: 115723 - protein, 15 aa, Borrelia burgdorferi B31
SSFSQPTSQTNFNNS

SEQ ID NO: 115724 - protein, 15 aa, Borrelia burgdorferi B31
SFSQPTSQTNFNNSQ

SEQ ID NO: 115725 - protein, 15 aa, Borrelia burgdorferi B31
FSQPTSQTNFNNSQS

SEQ ID NO: 115726 - protein, 15 aa, Borrelia burgdorferi B31
SQPTSQTNFNNSQSN

SEQ ID NO: 115727 - protein, 15 aa, Borrelia burgdorferi B31
QPTSQTNFNNSQSNN

SEQ ID NO: 115728 - protein, 15 aa, Borrelia burgdorferi B31
PTSQTNFNNSQSNNV

SEQ ID NO: 115729 - protein, 15 aa, Borrelia burgdorferi B31
TSQTNFNNSQSNNVL

SEQ ID NO: 115730 - protein, 15 aa, Borrelia burgdorferi B31
SQTNFNNSQSNNVLT

SEQ ID NO: 115731 - protein, 15 aa, Borrelia burgdorferi B31
QTNFNNSQSNNVLTN

SEQ ID NO: 115732 - protein, 15 aa, Borrelia burgdorferi B31
TNFNNSQSNNVLTNY

SEQ ID NO: 115733 - protein, 15 aa, Borrelia burgdorferi B31
NFNNSQSNNVLTNYR

SEQ ID NO: 115734 - protein, 15 aa, Borrelia burgdorferi B31
FNNSQSNNVLTNYRH

SEQ ID NO: 115735 - protein, 15 aa, Borrelia burgdorferi B31
NNSQSNNVLTNYRHQ

SEQ ID NO: 115736 - protein, 15 aa, Borrelia burgdorferi B31
NSQSNNVLTNYRHQT

SEQ ID NO: 115737 - protein, 15 aa, Borrelia burgdorferi B31
SQSNNVLTNYRHQTQ

SEQ ID NO: 115738 - protein, 15 aa, Borrelia burgdorferi B31
QSNNVLTNYRHQTQP

SEQ ID NO: 115739 - protein, 15 aa, Borrelia burgdorferi B31
SNNVLTNYRHQTQPS

SEQ ID NO: 115740 - protein, 15 aa, Borrelia burgdorferi B31
NNVLTNYRHQTQPSF

SEQ ID NO: 115741 - protein, 15 aa, Borrelia burgdorferi B31
NVLTNYRHQTQPSFV

SEQ ID NO: 115742 - protein, 15 aa, Borrelia burgdorferi B31
VLTNYRHQTQPSFVV

SEQ ID NO: 115743 - protein, 15 aa, Borrelia burgdorferi B31
LTNYRHQTQPSFVVP

SEQ ID NO: 115744 - protein, 15 aa, Borrelia burgdorferi B31
TNYRHQTQPSFVVPV

SEQ ID NO: 115745 - protein, 15 aa, Borrelia burgdorferi B31
NYRHQTQPSFVVPVY

SEQ ID NO: 115746 - protein, 15 aa, Borrelia burgdorferi B31
YRHQTQPSFVVPVYS

SEQ ID NO: 115747 - protein, 15 aa, Borrelia burgdorferi B31
RHQTQPSFVVPVYSG

SEQ ID NO: 115748 - protein, 15 aa, Borrelia burgdorferi B31
HQTQPSFVVPVYSGN

SEQ ID NO: 115749 - protein, 15 aa, Borrelia burgdorferi B31
QTQPSFVVPVYSGNS

SEQ ID NO: 115750 - protein, 15 aa, Borrelia burgdorferi B31
TQPSFVVPVYSGNSP

SEQ ID NO: 115751 - protein, 15 aa, Borrelia burgdorferi B31
QPSFVVPVYSGNSPL

SEQ ID NO: 115752 - protein, 15 aa, Borrelia burgdorferi B31
PSFVVPVYSGNSPLQ

SEQ ID NO: 115753 - protein, 15 aa, Borrelia burgdorferi B31
SFVVPVYSGNSPLQK

SEQ ID NO: 115754 - protein, 15 aa, Borrelia burgdorferi B31
FVVPVYSGNSPLQKL

SEQ ID NO: 115755 - protein, 15 aa, Borrelia burgdorferi B31
VVPVYSGNSPLQKLK

SEQ ID NO: 115756 - protein, 15 aa, Borrelia burgdorferi B31
VPVYSGNSPLQKLKN

SEQ ID NO: 115757 - protein, 15 aa, Borrelia burgdorferi B31
PVYSGNSPLQKLKNN

SEQ ID NO: 115758 - protein, 15 aa, Borrelia burgdorferi B31
VYSGNSPLQKLKNNL

SEQ ID NO: 115759 - protein, 15 aa, Borrelia burgdorferi B31
YSGNSPLQKLKNNLL

SEQ ID NO: 115760 - protein, 15 aa, Borrelia burgdorferi B31
SGNSPLQKLKNNLLR

SEQ ID NO: 115761 - protein, 15 aa, Borrelia burgdorferi B31
GNSPLQKLKNNLLRR

SEQ ID NO: 115762 - protein, 15 aa, Borrelia burgdorferi B31
NSPLQKLKNNLLRRI

SEQ ID NO: 115763 - protein, 15 aa, Borrelia burgdorferi B31
SPLQKLKNNLLRRIA

SEQ ID NO: 115764 - protein, 15 aa, Borrelia burgdorferi B31
PLQKLKNNLLRRIAE

SEQ ID NO: 115765 - protein, 15 aa, Borrelia burgdorferi B31
LQKLKNNLLRRIAEE

SEQ ID NO: 115766 - protein, 15 aa, Borrelia burgdorferi B31
QKLKNNLLRRIAEEK

SEQ ID NO: 115767 - protein, 15 aa, Borrelia burgdorferi B31
KLKNNLLRRIAEEKN

SEQ ID NO: 115768 - protein, 15 aa, Borrelia burgdorferi B31
LKNNLLRRIAEEKNK

SEQ ID NO: 115769 - protein, 15 aa, Borrelia burgdorferi B31
KNNLLRRIAEEKNKT

SEQ ID NO: 115770 - protein, 15 aa, Borrelia burgdorferi B31
NNLLRRIAEEKNKTH

SEQ ID NO: 115771 - protein, 15 aa, Borrelia burgdorferi B31
NLLRRIAEEKNKTHN

SEQ ID NO: 115772 - protein, 15 aa, Borrelia burgdorferi B31
LLRRIAEEKNKTHNH

SEQ ID NO: 115773 - protein, 15 aa, Borrelia burgdorferi B31
LRRIAEEKNKTHNHG

SEQ ID NO: 115774 - protein, 15 aa, Borrelia burgdorferi B31
RRIAEEKNKTHNHGF

SEQ ID NO: 115775 - protein, 15 aa, Borrelia burgdorferi B31
RIAEEKNKTHNHGFR

SEQ ID NO: 115776 - protein, 15 aa, Borrelia burgdorferi B31
IAEEKNKTHNHGFRE

SEQ ID NO: 115777 - protein, 15 aa, Borrelia burgdorferi B31
AEEKNKTHNHGFRET

SEQ ID NO: 115778 - protein, 15 aa, Borrelia burgdorferi B31
EEKNKTHNHGFRETY

SEQ ID NO: 115779 - protein, 15 aa, Borrelia burgdorferi B31
EKNKTHNHGFRETYD

SEQ ID NO: 115780 - protein, 15 aa, Borrelia burgdorferi B31
KNKTHNHGFRETYDQ

SEQ ID NO: 115781 - protein, 15 aa, Borrelia burgdorferi B31
NKTHNHGFRETYDQF

SEQ ID NO: 115782 - protein, 15 aa, Borrelia burgdorferi B31
KTHNHGFRETYDQFK

SEQ ID NO: 115783 - protein, 15 aa, Borrelia burgdorferi B31
THNHGFRETYDQFKM

SEQ ID NO: 115784 - protein, 15 aa, Borrelia burgdorferi B31
HNHGFRETYDQFKMK

SEQ ID NO: 115785 - protein, 15 aa, Borrelia burgdorferi B31
NHGFRETYDQFKMKD

SEQ ID NO: 115786 - protein, 15 aa, Borrelia burgdorferi B31
HGFRETYDQFKMKDS

SEQ ID NO: 115787 - protein, 15 aa, Borrelia burgdorferi B31
GFRETYDQFKMKDSA

SEQ ID NO: 115788 - protein, 15 aa, Borrelia burgdorferi B31
FRETYDQFKMKDSAF

SEQ ID NO: 115789 - protein, 15 aa, Borrelia burgdorferi B31
RETYDQFKMKDSAFT

SEQ ID NO: 115790 - protein, 15 aa, Borrelia burgdorferi B31
ETYDQFKMKDSAFTL

SEQ ID NO: 115791 - protein, 15 aa, Borrelia burgdorferi B31
TYDQFKMKDSAFTLL

SEQ ID NO: 115792 - protein, 15 aa, Borrelia burgdorferi B31
YDQFKMKDSAFTLLD

SEQ ID NO: 115793 - protein, 15 aa, Borrelia burgdorferi B31
DQFKMKDSAFTLLDV

SEQ ID NO: 115794 - protein, 15 aa, Borrelia burgdorferi B31
QFKMKDSAFTLLDVI

SEQ ID NO: 115795 - protein, 15 aa, Borrelia burgdorferi B31
FKMKDSAFTLLDVIS

SEQ ID NO: 115796 - protein, 15 aa, Borrelia burgdorferi B31
KMKDSAFTLLDVISN

SEQ ID NO: 115797 - protein, 15 aa, Borrelia burgdorferi B31
MKDSAFTLLDVISNI

SEQ ID NO: 115798 - protein, 15 aa, Borrelia burgdorferi B31
KDSAFTLLDVISNIS

SEQ ID NO: 115799 - protein, 15 aa, Borrelia burgdorferi B31
DSAFTLLDVISNISV

SEQ ID NO: 115800 - protein, 15 aa, Borrelia burgdorferi B31
SAFTLLDVISNISVF

SEQ ID NO: 115801 - protein, 15 aa, Borrelia burgdorferi B31
AFTLLDVISNISVFD

SEQ ID NO: 115802 - protein, 15 aa, Borrelia burgdorferi B31
FTLLDVISNISVFDR

SEQ ID NO: 115803 - protein, 15 aa, Borrelia burgdorferi B31
TLLDVISNISVFDRG

SEQ ID NO: 115804 - protein, 15 aa, Borrelia burgdorferi B31
LLDVISNISVFDRGS

SEQ ID NO: 115805 - protein, 15 aa, Borrelia burgdorferi B31
LDVISNISVFDRGSA

SEQ ID NO: 115806 - protein, 15 aa, Borrelia burgdorferi B31
DVISNISVFDRGSAP

SEQ ID NO: 115807 - protein, 15 aa, Borrelia burgdorferi B31
VISNISVFDRGSAPQ

SEQ ID NO: 115808 - protein, 15 aa, Borrelia burgdorferi B31
ISNISVFDRGSAPQL

SEQ ID NO: 115809 - protein, 15 aa, Borrelia burgdorferi B31
SNISVFDRGSAPQLS

SEQ ID NO: 115810 - protein, 15 aa, Borrelia burgdorferi B31
NISVFDRGSAPQLSS

SEQ ID NO: 115811 - protein, 15 aa, Borrelia burgdorferi B31
ISVFDRGSAPQLSSN

SEQ ID NO: 115812 - protein, 15 aa, Borrelia burgdorferi B31
SVFDRGSAPQLSSNT

SEQ ID NO: 115813 - protein, 15 aa, Borrelia burgdorferi B31
VFDRGSAPQLSSNTP

SEQ ID NO: 115814 - protein, 15 aa, Borrelia burgdorferi B31
FDRGSAPQLSSNTPE

SEQ ID NO: 115815 - protein, 15 aa, Borrelia burgdorferi B31
DRGSAPQLSSNTPEA

SEQ ID NO: 115816 - protein, 15 aa, Borrelia burgdorferi B31
RGSAPQLSSNTPEAE

SEQ ID NO: 115817 - protein, 15 aa, Borrelia burgdorferi B31
GSAPQLSSNTPEAES

SEQ ID NO: 115818 - protein, 15 aa, Borrelia burgdorferi B31
SAPQLSSNTPEAESE

SEQ ID NO: 115819 - protein, 15 aa, Borrelia burgdorferi B31
APQLSSNTPEAESER

SEQ ID NO: 115820 - protein, 15 aa, Borrelia burgdorferi B31
PQLSSNTPEAESERN

SEQ ID NO: 115821 - protein, 15 aa, Borrelia burgdorferi B31
QLSSNTPEAESERNR

SEQ ID NO: 115822 - protein, 15 aa, Borrelia burgdorferi B31
LSSNTPEAESERNRL

SEQ ID NO: 115823 - protein, 15 aa, Borrelia burgdorferi B31
SSNTPEAESERNRLY

SEQ ID NO: 115824 - protein, 15 aa, Borrelia burgdorferi B31
SNTPEAESERNRLYA

SEQ ID NO: 115825 - protein, 15 aa, Borrelia burgdorferi B31
NTPEAESERNRLYAM

SEQ ID NO: 115826 - protein, 15 aa, Borrelia burgdorferi B31
TPEAESERNRLYAMM

SEQ ID NO: 115827 - protein, 15 aa, Borrelia burgdorferi B31
PEAESERNRLYAMMD

SEQ ID NO: 115828 - protein, 15 aa, Borrelia burgdorferi B31
EAESERNRLYAMMDF

SEQ ID NO: 115829 - protein, 15 aa, Borrelia burgdorferi B31
AESERNRLYAMMDFD

SEQ ID NO: 115830 - protein, 15 aa, Borrelia burgdorferi B31
ESERNRLYAMMDFDQ

SEQ ID NO: 115831 - protein, 15 aa, Borrelia burgdorferi B31
SERNRLYAMMDFDQA

SEQ ID NO: 115832 - protein, 15 aa, Borrelia burgdorferi B31
ERNRLYAMMDFDQAK

SEQ ID NO: 115833 - protein, 15 aa, Borrelia burgdorferi B31
RNRLYAMMDFDQAKT

SEQ ID NO: 115834 - protein, 15 aa, Borrelia burgdorferi B31
NRLYAMMDFDQAKTT

SEQ ID NO: 115835 - protein, 15 aa, Borrelia burgdorferi B31
RLYAMMDFDQAKTTE

SEQ ID NO: 115836 - protein, 15 aa, Borrelia burgdorferi B31
LYAMMDFDQAKTTEF

SEQ ID NO: 115837 - protein, 15 aa, Borrelia burgdorferi B31
YAMMDFDQAKTTEFG

SEQ ID NO: 115838 - protein, 15 aa, Borrelia burgdorferi B31
AMMDFDQAKTTEFGS

SEQ ID NO: 115839 - protein, 15 aa, Borrelia burgdorferi B31
MMDFDQAKTTEFGSI

SEQ ID NO: 115840 - protein, 15 aa, Borrelia burgdorferi B31
MDFDQAKTTEFGSIM

SEQ ID NO: 115841 - protein, 15 aa, Borrelia burgdorferi B31
DFDQAKTTEFGSIMN

SEQ ID NO: 115842 - protein, 15 aa, Borrelia burgdorferi B31
FDQAKTTEFGSIMNI

SEQ ID NO: 115843 - protein, 15 aa, Borrelia burgdorferi B31
DQAKTTEFGSIMNIL

SEQ ID NO: 115844 - protein, 15 aa, Borrelia burgdorferi B31
QAKTTEFGSIMNILY

SEQ ID NO: 115845 - protein, 15 aa, Borrelia burgdorferi B31
AKTTEFGSIMNILYQ

SEQ ID NO: 115846 - protein, 15 aa, Borrelia burgdorferi B31
KTTEFGSIMNILYQE

SEQ ID NO: 115847 - protein, 15 aa, Borrelia burgdorferi B31
TTEFGSIMNILYQEN

SEQ ID NO: 115848 - protein, 15 aa, Borrelia burgdorferi B31
TEFGSIMNILYQENQ

SEQ ID NO: 115849 - protein, 15 aa, Borrelia burgdorferi B31
EFGSIMNILYQENQN

SEQ ID NO: 115850 - protein, 15 aa, Borrelia burgdorferi B31
FGSIMNILYQENQNH

SEQ ID NO: 115851 - protein, 15 aa, Borrelia burgdorferi B31
GSIMNILYQENQNHS

SEQ ID NO: 115852 - protein, 15 aa, Borrelia burgdorferi B31
SIMNILYQENQNHSL

SEQ ID NO: 115853 - protein, 15 aa, Borrelia burgdorferi B31
IMNILYQENQNHSLI

SEQ ID NO: 115854 - protein, 15 aa, Borrelia burgdorferi B31
MNILYQENQNHSLIR

SEQ ID NO: 115855 - protein, 15 aa, Borrelia burgdorferi B31
NILYQENQNHSLIRS

SEQ ID NO: 115856 - protein, 15 aa, Borrelia burgdorferi B31
ILYQENQNHSLIRSL

SEQ ID NO: 115857 - protein, 15 aa, Borrelia burgdorferi B31
LYQENQNHSLIRSLI

SEQ ID NO: 115858 - protein, 15 aa, Borrelia burgdorferi B31
YQENQNHSLIRSLII

SEQ ID NO: 115859 - protein, 15 aa, Borrelia burgdorferi B31
QENQNHSLIRSLIIS

SEQ ID NO: 115860 - protein, 15 aa, Borrelia burgdorferi B31
ENQNHSLIRSLIISG

SEQ ID NO: 115861 - protein, 15 aa, Borrelia burgdorferi B31
NQNHSLIRSLIISGL

SEQ ID NO: 115862 - protein, 15 aa, Borrelia burgdorferi B31
QNHSLIRSLIISGLG

SEQ ID NO: 115863 - protein, 15 aa, Borrelia burgdorferi B31
NHSLIRSLIISGLGI

SEQ ID NO: 115864 - protein, 15 aa, Borrelia burgdorferi B31
HSLIRSLIISGLGIQ

SEQ ID NO: 115865 - protein, 15 aa, Borrelia burgdorferi B31
SLIRSLIISGLGIQI

SEQ ID NO: 115866 - protein, 15 aa, Borrelia burgdorferi B31
LIRSLIISGLGIQIS

SEQ ID NO: 115867 - protein, 15 aa, Borrelia burgdorferi B31
IRSLIISGLGIQISL

SEQ ID NO: 115868 - protein, 15 aa, Borrelia burgdorferi B31
RSLIISGLGIQISLE

SEQ ID NO: 115869 - protein, 15 aa, Borrelia burgdorferi B31
SLIISGLGIQISLES

SEQ ID NO: 115870 - protein, 15 aa, Borrelia burgdorferi B31
LIISGLGIQISLEST

SEQ ID NO: 115871 - protein, 15 aa, Borrelia burgdorferi B31
IISGLGIQISLESTL

SEQ ID NO: 115872 - protein, 15 aa, Borrelia burgdorferi B31
ISGLGIQISLESTLE

SEQ ID NO: 115873 - protein, 15 aa, Borrelia burgdorferi B31
SGLGIQISLESTLEE

SEQ ID NO: 115874 - protein, 15 aa, Borrelia burgdorferi B31
GLGIQISLESTLEEI

SEQ ID NO: 115875 - protein, 15 aa, Borrelia burgdorferi B31
LGIQISLESTLEEIE

SEQ ID NO: 115876 - protein, 15 aa, Borrelia burgdorferi B31
GIQISLESTLEEIEK

SEQ ID NO: 115877 - protein, 15 aa, Borrelia burgdorferi B31
IQISLESTLEEIEKK

SEQ ID NO: 115878 - protein, 15 aa, Borrelia burgdorferi B31
QISLESTLEEIEKKI

SEQ ID NO: 115879 - protein, 15 aa, Borrelia burgdorferi B31
ISLESTLEEIEKKIE

SEQ ID NO: 115880 - protein, 15 aa, Borrelia burgdorferi B31
SLESTLEEIEKKIES

SEQ ID NO: 115881 - protein, 15 aa, Borrelia burgdorferi B31
LESTLEEIEKKIESF

SEQ ID NO: 115882 - protein, 15 aa, Borrelia burgdorferi B31
ESTLEEIEKKIESFN

SEQ ID NO: 115883 - protein, 15 aa, Borrelia burgdorferi B31
STLEEIEKKIESFNT

SEQ ID NO: 115884 - protein, 15 aa, Borrelia burgdorferi B31
TLEEIEKKIESFNTQ

SEQ ID NO: 115885 - protein, 15 aa, Borrelia burgdorferi B31
LEEIEKKIESFNTQY

SEQ ID NO: 115886 - protein, 15 aa, Borrelia burgdorferi B31
EEIEKKIESFNTQYL

SEQ ID NO: 115887 - protein, 15 aa, Borrelia burgdorferi B31
EIEKKIESFNTQYLN

SEQ ID NO: 115888 - protein, 15 aa, Borrelia burgdorferi B31
IEKKIESFNTQYLNT

SEQ ID NO: 115889 - protein, 15 aa, Borrelia burgdorferi B31
EKKIESFNTQYLNTI

SEQ ID NO: 115890 - protein, 15 aa, Borrelia burgdorferi B31
KKIESFNTQYLNTII

SEQ ID NO: 115891 - protein, 15 aa, Borrelia burgdorferi B31
KIESFNTQYLNTIIN

SEQ ID NO: 115892 - protein, 15 aa, Borrelia burgdorferi B31
IESFNTQYLNTIINS

SEQ ID NO: 115893 - protein, 15 aa, Borrelia burgdorferi B31
ESFNTQYLNTIINSY

SEQ ID NO: 115894 - protein, 15 aa, Borrelia burgdorferi B31
SFNTQYLNTIINSYT

SEQ ID NO: 115895 - protein, 15 aa, Borrelia burgdorferi B31
FNTQYLNTIINSYTF

SEQ ID NO: 115896 - protein, 15 aa, Borrelia burgdorferi B31
NTQYLNTIINSYTFK

SEQ ID NO: 115897 - protein, 15 aa, Borrelia burgdorferi B31
TQYLNTIINSYTFKD

SEQ ID NO: 115898 - protein, 15 aa, Borrelia burgdorferi B31
QYLNTIINSYTFKDK

SEQ ID NO: 115899 - protein, 15 aa, Borrelia burgdorferi B31
YLNTIINSYTFKDKL

SEQ ID NO: 115900 - protein, 15 aa, Borrelia burgdorferi B31
LNTIINSYTFKDKLK

SEQ ID NO: 115901 - protein, 15 aa, Borrelia burgdorferi B31
NTIINSYTFKDKLKE

SEQ ID NO: 115902 - protein, 15 aa, Borrelia burgdorferi B31
TIINSYTFKDKLKEL

SEQ ID NO: 115903 - protein, 15 aa, Borrelia burgdorferi B31
IINSYTFKDKLKELE

SEQ ID NO: 115904 - protein, 15 aa, Borrelia burgdorferi B31
INSYTFKDKLKELES

SEQ ID NO: 115905 - protein, 15 aa, Borrelia burgdorferi B31
NSYTFKDKLKELESK

SEQ ID NO: 115906 - protein, 15 aa, Borrelia burgdorferi B31
SYTFKDKLKELESKL

SEQ ID NO: 115907 - protein, 15 aa, Borrelia burgdorferi B31
YTFKDKLKELESKLN

SEQ ID NO: 115908 - protein, 15 aa, Borrelia burgdorferi B31
TFKDKLKELESKLNS

SEQ ID NO: 115909 - protein, 15 aa, Borrelia burgdorferi B31
FKDKLKELESKLNSI

SEQ ID NO: 115910 - protein, 15 aa, Borrelia burgdorferi B31
KDKLKELESKLNSIL

SEQ ID NO: 115911 - protein, 15 aa, Borrelia burgdorferi B31
DKLKELESKLNSILA

SEQ ID NO: 115912 - protein, 15 aa, Borrelia burgdorferi B31
KLKELESKLNSILAE

SEQ ID NO: 115913 - protein, 15 aa, Borrelia burgdorferi B31
LKELESKLNSILAEK

SEQ ID NO: 115914 - protein, 15 aa, Borrelia burgdorferi B31
KELESKLNSILAEKK

SEQ ID NO: 115915 - protein, 15 aa, Borrelia burgdorferi B31
ELESKLNSILAEKKE

SEQ ID NO: 115916 - protein, 15 aa, Borrelia burgdorferi B31
LESKLNSILAEKKEW

SEQ ID NO: 115917 - protein, 15 aa, Borrelia burgdorferi B31
ESKLNSILAEKKEWL

SEQ ID NO: 115918 - protein, 15 aa, Borrelia burgdorferi B31
SKLNSILAEKKEWLN

SEQ ID NO: 115919 - protein, 15 aa, Borrelia burgdorferi B31
KLNSILAEKKEWLNY

SEQ ID NO: 115920 - protein, 15 aa, Borrelia burgdorferi B31
LNSILAEKKEWLNYA

SEQ ID NO: 115921 - protein, 15 aa, Borrelia burgdorferi B31
NSILAEKKEWLNYAD

SEQ ID NO: 115922 - protein, 15 aa, Borrelia burgdorferi B31
SILAEKKEWLNYADA

SEQ ID NO: 115923 - protein, 15 aa, Borrelia burgdorferi B31
ILAEKKEWLNYADAI

SEQ ID NO: 115924 - protein, 15 aa, Borrelia burgdorferi B31
LAEKKEWLNYADAII

SEQ ID NO: 115925 - protein, 15 aa, Borrelia burgdorferi B31
AEKKEWLNYADAIIT

SEQ ID NO: 115926 - protein, 15 aa, Borrelia burgdorferi B31
EKKEWLNYADAIITN

SEQ ID NO: 115927 - protein, 15 aa, Borrelia burgdorferi B31
KKEWLNYADAIITNT

SEQ ID NO: 115928 - protein, 15 aa, Borrelia burgdorferi B31
KEWLNYADAIITNTS

SEQ ID NO: 115929 - protein, 15 aa, Borrelia burgdorferi B31
EWLNYADAIITNTSS

SEQ ID NO: 115930 - protein, 15 aa, Borrelia burgdorferi B31
WLNYADAIITNTSSN

SEQ ID NO: 115931 - protein, 15 aa, Borrelia burgdorferi B31
LNYADAIITNTSSNS

SEQ ID NO: 115932 - protein, 15 aa, Borrelia burgdorferi B31
NYADAIITNTSSNSK

SEQ ID NO: 115933 - protein, 15 aa, Borrelia burgdorferi B31
YADAIITNTSSNSKR

SEQ ID NO: 115934 - protein, 15 aa, Borrelia burgdorferi B31
ADAIITNTSSNSKRN

SEQ ID NO: 115935 - protein, 15 aa, Borrelia burgdorferi B31
DAIITNTSSNSKRND

SEQ ID NO: 115936 - protein, 15 aa, Borrelia burgdorferi B31
AIITNTSSNSKRNDP

SEQ ID NO: 115937 - protein, 15 aa, Borrelia burgdorferi B31
IITNTSSNSKRNDPQ

SEQ ID NO: 115938 - protein, 15 aa, Borrelia burgdorferi B31
ITNTSSNSKRNDPQS

SEQ ID NO: 115939 - protein, 15 aa, Borrelia burgdorferi B31
TNTSSNSKRNDPQSL

SEQ ID NO: 115940 - protein, 15 aa, Borrelia burgdorferi B31
NTSSNSKRNDPQSLG

SEQ ID NO: 115941 - protein, 15 aa, Borrelia burgdorferi B31
TSSNSKRNDPQSLGQ

SEQ ID NO: 115942 - protein, 15 aa, Borrelia burgdorferi B31
SSNSKRNDPQSLGQY

SEQ ID NO: 115943 - protein, 15 aa, Borrelia burgdorferi B31
SNSKRNDPQSLGQYI

SEQ ID NO: 115944 - protein, 15 aa, Borrelia burgdorferi B31
NSKRNDPQSLGQYIK

SEQ ID NO: 115945 - protein, 15 aa, Borrelia burgdorferi B31
SKRNDPQSLGQYIKN

SEQ ID NO: 115946 - protein, 15 aa, Borrelia burgdorferi B31
KRNDPQSLGQYIKNK

SEQ ID NO: 115947 - protein, 15 aa, Borrelia burgdorferi B31
RNDPQSLGQYIKNKY

SEQ ID NO: 115948 - protein, 15 aa, Borrelia burgdorferi B31
NDPQSLGQYIKNKYL

SEQ ID NO: 115949 - protein, 15 aa, Borrelia burgdorferi B31
DPQSLGQYIKNKYLD

SEQ ID NO: 115950 - protein, 15 aa, Borrelia burgdorferi B31
PQSLGQYIKNKYLDK

SEQ ID NO: 115951 - protein, 15 aa, Borrelia burgdorferi B31
QSLGQYIKNKYLDKM

SEQ ID NO: 115952 - protein, 15 aa, Borrelia burgdorferi B31
SLGQYIKNKYLDKMQ

SEQ ID NO: 115953 - protein, 15 aa, Borrelia burgdorferi B31
LGQYIKNKYLDKMQD

SEQ ID NO: 115954 - protein, 15 aa, Borrelia burgdorferi B31
GQYIKNKYLDKMQDA

SEQ ID NO: 115955 - protein, 15 aa, Borrelia burgdorferi B31
QYIKNKYLDKMQDAR

SEQ ID NO: 115956 - protein, 15 aa, Borrelia burgdorferi B31
YIKNKYLDKMQDARQ

SEQ ID NO: 115957 - protein, 15 aa, Borrelia burgdorferi B31
IKNKYLDKMQDARQS

SEQ ID NO: 115958 - protein, 15 aa, Borrelia burgdorferi B31
KNKYLDKMQDARQSA

SEQ ID NO: 115959 - protein, 15 aa, Borrelia burgdorferi B31
NKYLDKMQDARQSAL

SEQ ID NO: 115960 - protein, 15 aa, Borrelia burgdorferi B31
KYLDKMQDARQSALD

SEQ ID NO: 115961 - protein, 15 aa, Borrelia burgdorferi B31
YLDKMQDARQSALDL

SEQ ID NO: 115962 - protein, 15 aa, Borrelia burgdorferi B31
LDKMQDARQSALDLY

SEQ ID NO: 115963 - protein, 15 aa, Borrelia burgdorferi B31
DKMQDARQSALDLYL

SEQ ID NO: 115964 - protein, 15 aa, Borrelia burgdorferi B31
KMQDARQSALDLYLN

SEQ ID NO: 115965 - protein, 15 aa, Borrelia burgdorferi B31
MQDARQSALDLYLNI

SEQ ID NO: 115966 - protein, 15 aa, Borrelia burgdorferi B31
QDARQSALDLYLNIT

SEQ ID NO: 115967 - protein, 15 aa, Borrelia burgdorferi B31
DARQSALDLYLNITE

SEQ ID NO: 115968 - protein, 15 aa, Borrelia burgdorferi B31
ARQSALDLYLNITEI

SEQ ID NO: 115969 - protein, 15 aa, Borrelia burgdorferi B31
RQSALDLYLNITEIR

SEQ ID NO: 115970 - protein, 16 aa, Borrelia burgdorferi B31
MSSCTIDANLNKDYKN

SEQ ID NO: 115971 - protein, 16 aa, Borrelia burgdorferi B31
SSCTIDANLNKDYKNK

SEQ ID NO: 115972 - protein, 16 aa, Borrelia burgdorferi B31
SCTIDANLNKDYKNKV

SEQ ID NO: 115973 - protein, 16 aa, Borrelia burgdorferi B31
CTIDANLNKDYKNKVE

SEQ ID NO: 115974 - protein, 16 aa, Borrelia burgdorferi B31
TIDANLNKDYKNKVEE

SEQ ID NO: 115975 - protein, 16 aa, Borrelia burgdorferi B31
IDANLNKDYKNKVEEL

SEQ ID NO: 115976 - protein, 16 aa, Borrelia burgdorferi B31
DANLNKDYKNKVEELL

SEQ ID NO: 115977 - protein, 16 aa, Borrelia burgdorferi B31
ANLNKDYKNKVEELLN

SEQ ID NO: 115978 - protein, 16 aa, Borrelia burgdorferi B31
NLNKDYKNKVEELLNS

SEQ ID NO: 115979 - protein, 16 aa, Borrelia burgdorferi B31
LNKDYKNKVEELLNSS

SEQ ID NO: 115980 - protein, 16 aa, Borrelia burgdorferi B31
NKDYKNKVEELLNSST

SEQ ID NO: 115981 - protein, 16 aa, Borrelia burgdorferi B31
KDYKNKVEELLNSSTD

SEQ ID NO: 115982 - protein, 16 aa, Borrelia burgdorferi B31
DYKNKVEELLNSSTDD

SEQ ID NO: 115983 - protein, 16 aa, Borrelia burgdorferi B31
YKNKVEELLNSSTDDQ

SEQ ID NO: 115984 - protein, 16 aa, Borrelia burgdorferi B31
KNKVEELLNSSTDDQA

SEQ ID NO: 115985 - protein, 16 aa, Borrelia burgdorferi B31
NKVEELLNSSTDDQAK

SEQ ID NO: 115986 - protein, 16 aa, Borrelia burgdorferi B31
KVEELLNSSTDDQAKI

SEQ ID NO: 115987 - protein, 16 aa, Borrelia burgdorferi B31
VEELLNSSTDDQAKIS

SEQ ID NO: 115988 - protein, 16 aa, Borrelia burgdorferi B31
EELLNSSTDDQAKISI

SEQ ID NO: 115989 - protein, 16 aa, Borrelia burgdorferi B31
ELLNSSTDDQAKISIN

SEQ ID NO: 115990 - protein, 16 aa, Borrelia burgdorferi B31
LLNSSTDDQAKISINT

SEQ ID NO: 115991 - protein, 16 aa, Borrelia burgdorferi B31
LNSSTDDQAKISINTG

SEQ ID NO: 115992 - protein, 16 aa, Borrelia burgdorferi B31
NSSTDDQAKISINTGS

SEQ ID NO: 115993 - protein, 16 aa, Borrelia burgdorferi B31
SSTDDQAKISINTGSN

SEQ ID NO: 115994 - protein, 16 aa, Borrelia burgdorferi B31
STDDQAKISINTGSNA

SEQ ID NO: 115995 - protein, 16 aa, Borrelia burgdorferi B31
TDDQAKISINTGSNAT

SEQ ID NO: 115996 - protein, 16 aa, Borrelia burgdorferi B31
DDQAKISINTGSNATK

SEQ ID NO: 115997 - protein, 16 aa, Borrelia burgdorferi B31
DQAKISINTGSNATKN

SEQ ID NO: 115998 - protein, 16 aa, Borrelia burgdorferi B31
QAKISINTGSNATKNK

SEQ ID NO: 115999 - protein, 16 aa, Borrelia burgdorferi B31
AKISINTGSNATKNKT

SEQ ID NO: 116000 - protein, 16 aa, Borrelia burgdorferi B31
KISINTGSNATKNKTN

SEQ ID NO: 116001 - protein, 16 aa, Borrelia burgdorferi B31
ISINTGSNATKNKTNI

SEQ ID NO: 116002 - protein, 16 aa, Borrelia burgdorferi B31
SINTGSNATKNKTNIK

SEQ ID NO: 116003 - protein, 16 aa, Borrelia burgdorferi B31
INTGSNATKNKTNIKV

SEQ ID NO: 116004 - protein, 16 aa, Borrelia burgdorferi B31
NTGSNATKNKTNIKVA

SEQ ID NO: 116005 - protein, 16 aa, Borrelia burgdorferi B31
TGSNATKNKTNIKVAG

SEQ ID NO: 116006 - protein, 16 aa, Borrelia burgdorferi B31
GSNATKNKTNIKVAGL

SEQ ID NO: 116007 - protein, 16 aa, Borrelia burgdorferi B31
SNATKNKTNIKVAGLQ

SEQ ID NO: 116008 - protein, 16 aa, Borrelia burgdorferi B31
NATKNKTNIKVAGLQK

SEQ ID NO: 116009 - protein, 16 aa, Borrelia burgdorferi B31
ATKNKTNIKVAGLQKN

SEQ ID NO: 116010 - protein, 16 aa, Borrelia burgdorferi B31
TKNKTNIKVAGLQKNT

SEQ ID NO: 116011 - protein, 16 aa, Borrelia burgdorferi B31
KNKTNIKVAGLQKNTQ

SEQ ID NO: 116012 - protein, 16 aa, Borrelia burgdorferi B31
NKTNIKVAGLQKNTQS

SEQ ID NO: 116013 - protein, 16 aa, Borrelia burgdorferi B31
KTNIKVAGLQKNTQSK

SEQ ID NO: 116014 - protein, 16 aa, Borrelia burgdorferi B31
TNIKVAGLQKNTQSKK

SEQ ID NO: 116015 - protein, 16 aa, Borrelia burgdorferi B31
NIKVAGLQKNTQSKKN

SEQ ID NO: 116016 - protein, 16 aa, Borrelia burgdorferi B31
IKVAGLQKNTQSKKNN

SEQ ID NO: 116017 - protein, 16 aa, Borrelia burgdorferi B31
KVAGLQKNTQSKKNNN

SEQ ID NO: 116018 - protein, 16 aa, Borrelia burgdorferi B31
VAGLQKNTQSKKNNNL

SEQ ID NO: 116019 - protein, 16 aa, Borrelia burgdorferi B31
AGLQKNTQSKKNNNLQ

SEQ ID NO: 116020 - protein, 16 aa, Borrelia burgdorferi B31
GLQKNTQSKKNNNLQG

SEQ ID NO: 116021 - protein, 16 aa, Borrelia burgdorferi B31
LQKNTQSKKNNNLQGL

SEQ ID NO: 116022 - protein, 16 aa, Borrelia burgdorferi B31
QKNTQSKKNNNLQGLN

SEQ ID NO: 116023 - protein, 16 aa, Borrelia burgdorferi B31
KNTQSKKNNNLQGLNP

SEQ ID NO: 116024 - protein, 16 aa, Borrelia burgdorferi B31
NTQSKKNNNLQGLNPA

SEQ ID NO: 116025 - protein, 16 aa, Borrelia burgdorferi B31
TQSKKNNNLQGLNPAN

SEQ ID NO: 116026 - protein, 16 aa, Borrelia burgdorferi B31
QSKKNNNLQGLNPANQ

SEQ ID NO: 116027 - protein, 16 aa, Borrelia burgdorferi B31
SKKNNNLQGLNPANQV

SEQ ID NO: 116028 - protein, 16 aa, Borrelia burgdorferi B31
KKNNNLQGLNPANQVN

SEQ ID NO: 116029 - protein, 16 aa, Borrelia burgdorferi B31
KNNNLQGLNPANQVNP

SEQ ID NO: 116030 - protein, 16 aa, Borrelia burgdorferi B31
NNNLQGLNPANQVNPG

SEQ ID NO: 116031 - protein, 16 aa, Borrelia burgdorferi B31
NNLQGLNPANQVNPGN

SEQ ID NO: 116032 - protein, 16 aa, Borrelia burgdorferi B31
NLQGLNPANQVNPGNP

SEQ ID NO: 116033 - protein, 16 aa, Borrelia burgdorferi B31
LQGLNPANQVNPGNPM

SEQ ID NO: 116034 - protein, 16 aa, Borrelia burgdorferi B31
QGLNPANQVNPGNPMQ

SEQ ID NO: 116035 - protein, 16 aa, Borrelia burgdorferi B31
GLNPANQVNPGNPMQI

SEQ ID NO: 116036 - protein, 16 aa, Borrelia burgdorferi B31
LNPANQVNPGNPMQIA

SEQ ID NO: 116037 - protein, 16 aa, Borrelia burgdorferi B31
NPANQVNPGNPMQIAN

SEQ ID NO: 116038 - protein, 16 aa, Borrelia burgdorferi B31
PANQVNPGNPMQIANQ

SEQ ID NO: 116039 - protein, 16 aa, Borrelia burgdorferi B31
ANQVNPGNPMQIANQA

SEQ ID NO: 116040 - protein, 16 aa, Borrelia burgdorferi B31
NQVNPGNPMQIANQAN

SEQ ID NO: 116041 - protein, 16 aa, Borrelia burgdorferi B31
QVNPGNPMQIANQANQ

SEQ ID NO: 116042 - protein, 16 aa, Borrelia burgdorferi B31
VNPGNPMQIANQANQA

SEQ ID NO: 116043 - protein, 16 aa, Borrelia burgdorferi B31
NPGNPMQIANQANQAN

SEQ ID NO: 116044 - protein, 16 aa, Borrelia burgdorferi B31
PGNPMQIANQANQANQ

SEQ ID NO: 116045 - protein, 16 aa, Borrelia burgdorferi B31
GNPMQIANQANQANQA

SEQ ID NO: 116046 - protein, 16 aa, Borrelia burgdorferi B31
NPMQIANQANQANQAN

SEQ ID NO: 116047 - protein, 16 aa, Borrelia burgdorferi B31
PMQIANQANQANQANQ

SEQ ID NO: 116048 - protein, 16 aa, Borrelia burgdorferi B31
MQIANQANQANQANQA

SEQ ID NO: 116049 - protein, 16 aa, Borrelia burgdorferi B31
QIANQANQANQANQAN

SEQ ID NO: 116050 - protein, 16 aa, Borrelia burgdorferi B31
IANQANQANQANQANQ

SEQ ID NO: 116051 - protein, 16 aa, Borrelia burgdorferi B31
ANQANQANQANQANQA

SEQ ID NO: 116052 - protein, 16 aa, Borrelia burgdorferi B31
NQANQANQANQANQAN

SEQ ID NO: 116053 - protein, 16 aa, Borrelia burgdorferi B31
QANQANQANQANQANQ

SEQ ID NO: 116054 - protein, 16 aa, Borrelia burgdorferi B31
ANQANQANQANQANQA

SEQ ID NO: 116055 - protein, 16 aa, Borrelia burgdorferi B31
NQANQANQANQANQAS

SEQ ID NO: 116056 - protein, 16 aa, Borrelia burgdorferi B31
QANQANQANQANQASQ

SEQ ID NO: 116057 - protein, 16 aa, Borrelia burgdorferi B31
ANQANQANQANQASQA

SEQ ID NO: 116058 - protein, 16 aa, Borrelia burgdorferi B31
NQANQANQANQASQAS

SEQ ID NO: 116059 - protein, 16 aa, Borrelia burgdorferi B31
QANQANQANQASQASQ

SEQ ID NO: 116060 - protein, 16 aa, Borrelia burgdorferi B31
ANQANQANQASQASQA

SEQ ID NO: 116061 - protein, 16 aa, Borrelia burgdorferi B31
NQANQANQASQASQAS

SEQ ID NO: 116062 - protein, 16 aa, Borrelia burgdorferi B31
QANQANQASQASQASQ

SEQ ID NO: 116063 - protein, 16 aa, Borrelia burgdorferi B31
ANQANQASQASQASQV

SEQ ID NO: 116064 - protein, 16 aa, Borrelia burgdorferi B31
NQANQASQASQASQVA

SEQ ID NO: 116065 - protein, 16 aa, Borrelia burgdorferi B31
QANQASQASQASQVAS

SEQ ID NO: 116066 - protein, 16 aa, Borrelia burgdorferi B31
ANQASQASQASQVASS

SEQ ID NO: 116067 - protein, 16 aa, Borrelia burgdorferi B31
NQASQASQASQVASSA

SEQ ID NO: 116068 - protein, 16 aa, Borrelia burgdorferi B31
QASQASQASQVASSAS

SEQ ID NO: 116069 - protein, 16 aa, Borrelia burgdorferi B31
ASQASQASQVASSASQ

SEQ ID NO: 116070 - protein, 16 aa, Borrelia burgdorferi B31
SQASQASQVASSASQA

SEQ ID NO: 116071 - protein, 16 aa, Borrelia burgdorferi B31
QASQASQVASSASQAS

SEQ ID NO: 116072 - protein, 16 aa, Borrelia burgdorferi B31
ASQASQVASSASQASP

SEQ ID NO: 116073 - protein, 16 aa, Borrelia burgdorferi B31
SQASQVASSASQASPV

SEQ ID NO: 116074 - protein, 16 aa, Borrelia burgdorferi B31
QASQVASSASQASPVA

SEQ ID NO: 116075 - protein, 16 aa, Borrelia burgdorferi B31
ASQVASSASQASPVAS

SEQ ID NO: 116076 - protein, 16 aa, Borrelia burgdorferi B31
SQVASSASQASPVASP

SEQ ID NO: 116077 - protein, 16 aa, Borrelia burgdorferi B31
QVASSASQASPVASPA

SEQ ID NO: 116078 - protein, 16 aa, Borrelia burgdorferi B31
VASSASQASPVASPAT

SEQ ID NO: 116079 - protein, 16 aa, Borrelia burgdorferi B31
ASSASQASPVASPATN

SEQ ID NO: 116080 - protein, 16 aa, Borrelia burgdorferi B31
SSASQASPVASPATNV

SEQ ID NO: 116081 - protein, 16 aa, Borrelia burgdorferi B31
SASQASPVASPATNVQ

SEQ ID NO: 116082 - protein, 16 aa, Borrelia burgdorferi B31
ASQASPVASPATNVQA

SEQ ID NO: 116083 - protein, 16 aa, Borrelia burgdorferi B31
SQASPVASPATNVQAT

SEQ ID NO: 116084 - protein, 16 aa, Borrelia burgdorferi B31
QASPVASPATNVQATP

SEQ ID NO: 116085 - protein, 16 aa, Borrelia burgdorferi B31
ASPVASPATNVQATPP

SEQ ID NO: 116086 - protein, 16 aa, Borrelia burgdorferi B31
SPVASPATNVQATPPK

SEQ ID NO: 116087 - protein, 16 aa, Borrelia burgdorferi B31
PVASPATNVQATPPKQ

SEQ ID NO: 116088 - protein, 16 aa, Borrelia burgdorferi B31
VASPATNVQATPPKQI

SEQ ID NO: 116089 - protein, 16 aa, Borrelia burgdorferi B31
ASPATNVQATPPKQIA

SEQ ID NO: 116090 - protein, 16 aa, Borrelia burgdorferi B31
SPATNVQATPPKQIAS

SEQ ID NO: 116091 - protein, 16 aa, Borrelia burgdorferi B31
PATNVQATPPKQIASA

SEQ ID NO: 116092 - protein, 16 aa, Borrelia burgdorferi B31
ATNVQATPPKQIASAQ

SEQ ID NO: 116093 - protein, 16 aa, Borrelia burgdorferi B31
TNVQATPPKQIASAQA

SEQ ID NO: 116094 - protein, 16 aa, Borrelia burgdorferi B31
NVQATPPKQIASAQAI

SEQ ID NO: 116095 - protein, 16 aa, Borrelia burgdorferi B31
VQATPPKQIASAQAIQ

SEQ ID NO: 116096 - protein, 16 aa, Borrelia burgdorferi B31
QATPPKQIASAQAIQT

SEQ ID NO: 116097 - protein, 16 aa, Borrelia burgdorferi B31
ATPPKQIASAQAIQTV

SEQ ID NO: 116098 - protein, 16 aa, Borrelia burgdorferi B31
TPPKQIASAQAIQTVP

SEQ ID NO: 116099 - protein, 16 aa, Borrelia burgdorferi B31
PPKQIASAQAIQTVPN

SEQ ID NO: 116100 - protein, 16 aa, Borrelia burgdorferi B31
PKQIASAQAIQTVPNN

SEQ ID NO: 116101 - protein, 16 aa, Borrelia burgdorferi B31
KQIASAQAIQTVPNNT

SEQ ID NO: 116102 - protein, 16 aa, Borrelia burgdorferi B31
QIASAQAIQTVPNNTS

SEQ ID NO: 116103 - protein, 16 aa, Borrelia burgdorferi B31
IASAQAIQTVPNNTST

SEQ ID NO: 116104 - protein, 16 aa, Borrelia burgdorferi B31
ASAQAIQTVPNNTSTP

SEQ ID NO: 116105 - protein, 16 aa, Borrelia burgdorferi B31
SAQAIQTVPNNTSTPN

SEQ ID NO: 116106 - protein, 16 aa, Borrelia burgdorferi B31
AQAIQTVPNNTSTPNQ

SEQ ID NO: 116107 - protein, 16 aa, Borrelia burgdorferi B31
QAIQTVPNNTSTPNQS

SEQ ID NO: 116108 - protein, 16 aa, Borrelia burgdorferi B31
AIQTVPNNTSTPNQSI

SEQ ID NO: 116109 - protein, 16 aa, Borrelia burgdorferi B31
IQTVPNNTSTPNQSII

SEQ ID NO: 116110 - protein, 16 aa, Borrelia burgdorferi B31
QTVPNNTSTPNQSIIK

SEQ ID NO: 116111 - protein, 16 aa, Borrelia burgdorferi B31
TVPNNTSTPNQSIIKP

SEQ ID NO: 116112 - protein, 16 aa, Borrelia burgdorferi B31
VPNNTSTPNQSIIKPQ

SEQ ID NO: 116113 - protein, 16 aa, Borrelia burgdorferi B31
PNNTSTPNQSIIKPQQ

SEQ ID NO: 116114 - protein, 16 aa, Borrelia burgdorferi B31
NNTSTPNQSIIKPQQY

SEQ ID NO: 116115 - protein, 16 aa, Borrelia burgdorferi B31
NTSTPNQSIIKPQQYT

SEQ ID NO: 116116 - protein, 16 aa, Borrelia burgdorferi B31
TSTPNQSIIKPQQYTF

SEQ ID NO: 116117 - protein, 16 aa, Borrelia burgdorferi B31
STPNQSIIKPQQYTFS

SEQ ID NO: 116118 - protein, 16 aa, Borrelia burgdorferi B31
TPNQSIIKPQQYTFSS

SEQ ID NO: 116119 - protein, 16 aa, Borrelia burgdorferi B31
PNQSIIKPQQYTFSSS

SEQ ID NO: 116120 - protein, 16 aa, Borrelia burgdorferi B31
NQSIIKPQQYTFSSSF

SEQ ID NO: 116121 - protein, 16 aa, Borrelia burgdorferi B31
QSIIKPQQYTFSSSFS

SEQ ID NO: 116122 - protein, 16 aa, Borrelia burgdorferi B31
SIIKPQQYTFSSSFSQ

SEQ ID NO: 116123 - protein, 16 aa, Borrelia burgdorferi B31
IIKPQQYTFSSSFSQP

SEQ ID NO: 116124 - protein, 16 aa, Borrelia burgdorferi B31
IKPQQYTFSSSFSQPT

SEQ ID NO: 116125 - protein, 16 aa, Borrelia burgdorferi B31
KPQQYTFSSSFSQPTS

SEQ ID NO: 116126 - protein, 16 aa, Borrelia burgdorferi B31
PQQYTFSSSFSQPTSQ

SEQ ID NO: 116127 - protein, 16 aa, Borrelia burgdorferi B31
QQYTFSSSFSQPTSQT

SEQ ID NO: 116128 - protein, 16 aa, Borrelia burgdorferi B31
QYTFSSSFSQPTSQTN

SEQ ID NO: 116129 - protein, 16 aa, Borrelia burgdorferi B31
YTFSSSFSQPTSQTNF

SEQ ID NO: 116130 - protein, 16 aa, Borrelia burgdorferi B31
TFSSSFSQPTSQTNFN

SEQ ID NO: 116131 - protein, 16 aa, Borrelia burgdorferi B31
FSSSFSQPTSQTNFNN

SEQ ID NO: 116132 - protein, 16 aa, Borrelia burgdorferi B31
SSSFSQPTSQTNFNNS

SEQ ID NO: 116133 - protein, 16 aa, Borrelia burgdorferi B31
SSFSQPTSQTNFNNSQ

SEQ ID NO: 116134 - protein, 16 aa, Borrelia burgdorferi B31
SFSQPTSQTNFNNSQS

SEQ ID NO: 116135 - protein, 16 aa, Borrelia burgdorferi B31
FSQPTSQTNFNNSQSN

SEQ ID NO: 116136 - protein, 16 aa, Borrelia burgdorferi B31
SQPTSQTNFNNSQSNN

SEQ ID NO: 116137 - protein, 16 aa, Borrelia burgdorferi B31
QPTSQTNFNNSQSNNV

SEQ ID NO: 116138 - protein, 16 aa, Borrelia burgdorferi B31
PTSQTNFNNSQSNNVL

SEQ ID NO: 116139 - protein, 16 aa, Borrelia burgdorferi B31
TSQTNFNNSQSNNVLT

SEQ ID NO: 116140 - protein, 16 aa, Borrelia burgdorferi B31
SQTNFNNSQSNNVLTN

SEQ ID NO: 116141 - protein, 16 aa, Borrelia burgdorferi B31
QTNFNNSQSNNVLTNY

SEQ ID NO: 116142 - protein, 16 aa, Borrelia burgdorferi B31
TNFNNSQSNNVLTNYR

SEQ ID NO: 116143 - protein, 16 aa, Borrelia burgdorferi B31
NFNNSQSNNVLTNYRH

SEQ ID NO: 116144 - protein, 16 aa, Borrelia burgdorferi B31
FNNSQSNNVLTNYRHQ

SEQ ID NO: 116145 - protein, 16 aa, Borrelia burgdorferi B31
NNSQSNNVLTNYRHQT

SEQ ID NO: 116146 - protein, 16 aa, Borrelia burgdorferi B31
NSQSNNVLTNYRHQTQ

SEQ ID NO: 116147 - protein, 16 aa, Borrelia burgdorferi B31
SQSNNVLTNYRHQTQP

SEQ ID NO: 116148 - protein, 16 aa, Borrelia burgdorferi B31
QSNNVLTNYRHQTQPS

SEQ ID NO: 116149 - protein, 16 aa, Borrelia burgdorferi B31
SNNVLTNYRHQTQPSF

SEQ ID NO: 116150 - protein, 16 aa, Borrelia burgdorferi B31
NNVLTNYRHQTQPSFV

SEQ ID NO: 116151 - protein, 16 aa, Borrelia burgdorferi B31
NVLTNYRHQTQPSFVV

SEQ ID NO: 116152 - protein, 16 aa, Borrelia burgdorferi B31
VLTNYRHQTQPSFVVP

SEQ ID NO: 116153 - protein, 16 aa, Borrelia burgdorferi B31
LTNYRHQTQPSFVVPV

SEQ ID NO: 116154 - protein, 16 aa, Borrelia burgdorferi B31
TNYRHQTQPSFVVPVY

SEQ ID NO: 116155 - protein, 16 aa, Borrelia burgdorferi B31
NYRHQTQPSFVVPVYS

SEQ ID NO: 116156 - protein, 16 aa, Borrelia burgdorferi B31
YRHQTQPSFVVPVYSG

SEQ ID NO: 116157 - protein, 16 aa, Borrelia burgdorferi B31
RHQTQPSFVVPVYSGN

SEQ ID NO: 116158 - protein, 16 aa, Borrelia burgdorferi B31
HQTQPSFVVPVYSGNS

SEQ ID NO: 116159 - protein, 16 aa, Borrelia burgdorferi B31
QTQPSFVVPVYSGNSP

SEQ ID NO: 116160 - protein, 16 aa, Borrelia burgdorferi B31
TQPSFVVPVYSGNSPL

SEQ ID NO: 116161 - protein, 16 aa, Borrelia burgdorferi B31
QPSFVVPVYSGNSPLQ

SEQ ID NO: 116162 - protein, 16 aa, Borrelia burgdorferi B31
PSFVVPVYSGNSPLQK

SEQ ID NO: 116163 - protein, 16 aa, Borrelia burgdorferi B31
SFVVPVYSGNSPLQKL

SEQ ID NO: 116164 - protein, 16 aa, Borrelia burgdorferi B31
FVVPVYSGNSPLQKLK

SEQ ID NO: 116165 - protein, 16 aa, Borrelia burgdorferi B31
VVPVYSGNSPLQKLKN

SEQ ID NO: 116166 - protein, 16 aa, Borrelia burgdorferi B31
VPVYSGNSPLQKLKNN

SEQ ID NO: 116167 - protein, 16 aa, Borrelia burgdorferi B31
PVYSGNSPLQKLKNNL

SEQ ID NO: 116168 - protein, 16 aa, Borrelia burgdorferi B31
VYSGNSPLQKLKNNLL

SEQ ID NO: 116169 - protein, 16 aa, Borrelia burgdorferi B31
YSGNSPLQKLKNNLLR

SEQ ID NO: 116170 - protein, 16 aa, Borrelia burgdorferi B31
SGNSPLQKLKNNLLRR

SEQ ID NO: 116171 - protein, 16 aa, Borrelia burgdorferi B31
GNSPLQKLKNNLLRRI

SEQ ID NO: 116172 - protein, 16 aa, Borrelia burgdorferi B31
NSPLQKLKNNLLRRIA

SEQ ID NO: 116173 - protein, 16 aa, Borrelia burgdorferi B31
SPLQKLKNNLLRRIAE

SEQ ID NO: 116174 - protein, 16 aa, Borrelia burgdorferi B31
PLQKLKNNLLRRIAEE

SEQ ID NO: 116175 - protein, 16 aa, Borrelia burgdorferi B31
LQKLKNNLLRRIAEEK

SEQ ID NO: 116176 - protein, 16 aa, Borrelia burgdorferi B31
QKLKNNLLRRIAEEKN

SEQ ID NO: 116177 - protein, 16 aa, Borrelia burgdorferi B31
KLKNNLLRRIAEEKNK

SEQ ID NO: 116178 - protein, 16 aa, Borrelia burgdorferi B31
LKNNLLRRIAEEKNKT

SEQ ID NO: 116179 - protein, 16 aa, Borrelia burgdorferi B31
KNNLLRRIAEEKNKTH

SEQ ID NO: 116180 - protein, 16 aa, Borrelia burgdorferi B31
NNLLRRIAEEKNKTHN

SEQ ID NO: 116181 - protein, 16 aa, Borrelia burgdorferi B31
NLLRRIAEEKNKTHNH

SEQ ID NO: 116182 - protein, 16 aa, Borrelia burgdorferi B31
LLRRIAEEKNKTHNHG

SEQ ID NO: 116183 - protein, 16 aa, Borrelia burgdorferi B31
LRRIAEEKNKTHNHGF

SEQ ID NO: 116184 - protein, 16 aa, Borrelia burgdorferi B31
RRIAEEKNKTHNHGFR

SEQ ID NO: 116185 - protein, 16 aa, Borrelia burgdorferi B31
RIAEEKNKTHNHGFRE

SEQ ID NO: 116186 - protein, 16 aa, Borrelia burgdorferi B31
IAEEKNKTHNHGFRET

SEQ ID NO: 116187 - protein, 16 aa, Borrelia burgdorferi B31
AEEKNKTHNHGFRETY

SEQ ID NO: 116188 - protein, 16 aa, Borrelia burgdorferi B31
EEKNKTHNHGFRETYD

SEQ ID NO: 116189 - protein, 16 aa, Borrelia burgdorferi B31
EKNKTHNHGFRETYDQ

SEQ ID NO: 116190 - protein, 16 aa, Borrelia burgdorferi B31
KNKTHNHGFRETYDQF

SEQ ID NO: 116191 - protein, 16 aa, Borrelia burgdorferi B31
NKTHNHGFRETYDQFK

SEQ ID NO: 116192 - protein, 16 aa, Borrelia burgdorferi B31
KTHNHGFRETYDQFKM

SEQ ID NO: 116193 - protein, 16 aa, Borrelia burgdorferi B31
THNHGFRETYDQFKMK

SEQ ID NO: 116194 - protein, 16 aa, Borrelia burgdorferi B31
HNHGFRETYDQFKMKD

SEQ ID NO: 116195 - protein, 16 aa, Borrelia burgdorferi B31
NHGFRETYDQFKMKDS

SEQ ID NO: 116196 - protein, 16 aa, Borrelia burgdorferi B31
HGFRETYDQFKMKDSA

SEQ ID NO: 116197 - protein, 16 aa, Borrelia burgdorferi B31
GFRETYDQFKMKDSAF

SEQ ID NO: 116198 - protein, 16 aa, Borrelia burgdorferi B31
FRETYDQFKMKDSAFT

SEQ ID NO: 116199 - protein, 16 aa, Borrelia burgdorferi B31
RETYDQFKMKDSAFTL

SEQ ID NO: 116200 - protein, 16 aa, Borrelia burgdorferi B31
ETYDQFKMKDSAFTLL

SEQ ID NO: 116201 - protein, 16 aa, Borrelia burgdorferi B31
TYDQFKMKDSAFTLLD

SEQ ID NO: 116202 - protein, 16 aa, Borrelia burgdorferi B31
YDQFKMKDSAFTLLDV

SEQ ID NO: 116203 - protein, 16 aa, Borrelia burgdorferi B31
DQFKMKDSAFTLLDVI

SEQ ID NO: 116204 - protein, 16 aa, Borrelia burgdorferi B31
QFKMKDSAFTLLDVIS

SEQ ID NO: 116205 - protein, 16 aa, Borrelia burgdorferi B31
FKMKDSAFTLLDVISN

SEQ ID NO: 116206 - protein, 16 aa, Borrelia burgdorferi B31
KMKDSAFTLLDVISNI

SEQ ID NO: 116207 - protein, 16 aa, Borrelia burgdorferi B31
MKDSAFTLLDVISNIS

SEQ ID NO: 116208 - protein, 16 aa, Borrelia burgdorferi B31
KDSAFTLLDVISNISV

SEQ ID NO: 116209 - protein, 16 aa, Borrelia burgdorferi B31
DSAFTLLDVISNISVF

SEQ ID NO: 116210 - protein, 16 aa, Borrelia burgdorferi B31
SAFTLLDVISNISVFD

SEQ ID NO: 116211 - protein, 16 aa, Borrelia burgdorferi B31
AFTLLDVISNISVFDR

SEQ ID NO: 116212 - protein, 16 aa, Borrelia burgdorferi B31
FTLLDVISNISVFDRG

SEQ ID NO: 116213 - protein, 16 aa, Borrelia burgdorferi B31
TLLDVISNISVFDRGS

SEQ ID NO: 116214 - protein, 16 aa, Borrelia burgdorferi B31
LLDVISNISVFDRGSA

SEQ ID NO: 116215 - protein, 16 aa, Borrelia burgdorferi B31
LDVISNISVFDRGSAP

SEQ ID NO: 116216 - protein, 16 aa, Borrelia burgdorferi B31
DVISNISVFDRGSAPQ

SEQ ID NO: 116217 - protein, 16 aa, Borrelia burgdorferi B31
VISNISVFDRGSAPQL

SEQ ID NO: 116218 - protein, 16 aa, Borrelia burgdorferi B31
ISNISVFDRGSAPQLS

SEQ ID NO: 116219 - protein, 16 aa, Borrelia burgdorferi B31
SNISVFDRGSAPQLSS

SEQ ID NO: 116220 - protein, 16 aa, Borrelia burgdorferi B31
NISVFDRGSAPQLSSN

SEQ ID NO: 116221 - protein, 16 aa, Borrelia burgdorferi B31
ISVFDRGSAPQLSSNT

SEQ ID NO: 116222 - protein, 16 aa, Borrelia burgdorferi B31
SVFDRGSAPQLSSNTP

SEQ ID NO: 116223 - protein, 16 aa, Borrelia burgdorferi B31
VFDRGSAPQLSSNTPE

SEQ ID NO: 116224 - protein, 16 aa, Borrelia burgdorferi B31
FDRGSAPQLSSNTPEA

SEQ ID NO: 116225 - protein, 16 aa, Borrelia burgdorferi B31
DRGSAPQLSSNTPEAE

SEQ ID NO: 116226 - protein, 16 aa, Borrelia burgdorferi B31
RGSAPQLSSNTPEAES

SEQ ID NO: 116227 - protein, 16 aa, Borrelia burgdorferi B31
GSAPQLSSNTPEAESE

SEQ ID NO: 116228 - protein, 16 aa, Borrelia burgdorferi B31
SAPQLSSNTPEAESER

SEQ ID NO: 116229 - protein, 16 aa, Borrelia burgdorferi B31
APQLSSNTPEAESERN

SEQ ID NO: 116230 - protein, 16 aa, Borrelia burgdorferi B31
PQLSSNTPEAESERNR

SEQ ID NO: 116231 - protein, 16 aa, Borrelia burgdorferi B31
QLSSNTPEAESERNRL

SEQ ID NO: 116232 - protein, 16 aa, Borrelia burgdorferi B31
LSSNTPEAESERNRLY

SEQ ID NO: 116233 - protein, 16 aa, Borrelia burgdorferi B31
SSNTPEAESERNRLYA

SEQ ID NO: 116234 - protein, 16 aa, Borrelia burgdorferi B31
SNTPEAESERNRLYAM

SEQ ID NO: 116235 - protein, 16 aa, Borrelia burgdorferi B31
NTPEAESERNRLYAMM

SEQ ID NO: 116236 - protein, 16 aa, Borrelia burgdorferi B31
TPEAESERNRLYAMMD

SEQ ID NO: 116237 - protein, 16 aa, Borrelia burgdorferi B31
PEAESERNRLYAMMDF

SEQ ID NO: 116238 - protein, 16 aa, Borrelia burgdorferi B31
EAESERNRLYAMMDFD

SEQ ID NO: 116239 - protein, 16 aa, Borrelia burgdorferi B31
AESERNRLYAMMDFDQ

SEQ ID NO: 116240 - protein, 16 aa, Borrelia burgdorferi B31
ESERNRLYAMMDFDQA

SEQ ID NO: 116241 - protein, 16 aa, Borrelia burgdorferi B31
SERNRLYAMMDFDQAK

SEQ ID NO: 116242 - protein, 16 aa, Borrelia burgdorferi B31
ERNRLYAMMDFDQAKT

SEQ ID NO: 116243 - protein, 16 aa, Borrelia burgdorferi B31
RNRLYAMMDFDQAKTT

SEQ ID NO: 116244 - protein, 16 aa, Borrelia burgdorferi B31
NRLYAMMDFDQAKTTE

SEQ ID NO: 116245 - protein, 16 aa, Borrelia burgdorferi B31
RLYAMMDFDQAKTTEF

SEQ ID NO: 116246 - protein, 16 aa, Borrelia burgdorferi B31
LYAMMDFDQAKTTEFG

SEQ ID NO: 116247 - protein, 16 aa, Borrelia burgdorferi B31
YAMMDFDQAKTTEFGS

SEQ ID NO: 116248 - protein, 16 aa, Borrelia burgdorferi B31
AMMDFDQAKTTEFGSI

SEQ ID NO: 116249 - protein, 16 aa, Borrelia burgdorferi B31
MMDFDQAKTTEFGSIM

SEQ ID NO: 116250 - protein, 16 aa, Borrelia burgdorferi B31
MDFDQAKTTEFGSIMN

SEQ ID NO: 116251 - protein, 16 aa, Borrelia burgdorferi B31
DFDQAKTTEFGSIMNI

SEQ ID NO: 116252 - protein, 16 aa, Borrelia burgdorferi B31
FDQAKTTEFGSIMNIL

SEQ ID NO: 116253 - protein, 16 aa, Borrelia burgdorferi B31
DQAKTTEFGSIMNILY

SEQ ID NO: 116254 - protein, 16 aa, Borrelia burgdorferi B31
QAKTTEFGSIMNILYQ

SEQ ID NO: 116255 - protein, 16 aa, Borrelia burgdorferi B31
AKTTEFGSIMNILYQE

SEQ ID NO: 116256 - protein, 16 aa, Borrelia burgdorferi B31
KTTEFGSIMNILYQEN

SEQ ID NO: 116257 - protein, 16 aa, Borrelia burgdorferi B31
TTEFGSIMNILYQENQ

SEQ ID NO: 116258 - protein, 16 aa, Borrelia burgdorferi B31
TEFGSIMNILYQENQN

SEQ ID NO: 116259 - protein, 16 aa, Borrelia burgdorferi B31
EFGSIMNILYQENQNH

SEQ ID NO: 116260 - protein, 16 aa, Borrelia burgdorferi B31
FGSIMNILYQENQNHS

SEQ ID NO: 116261 - protein, 16 aa, Borrelia burgdorferi B31
GSIMNILYQENQNHSL

SEQ ID NO: 116262 - protein, 16 aa, Borrelia burgdorferi B31
SIMNILYQENQNHSLI

SEQ ID NO: 116263 - protein, 16 aa, Borrelia burgdorferi B31
IMNILYQENQNHSLIR

SEQ ID NO: 116264 - protein, 16 aa, Borrelia burgdorferi B31
MNILYQENQNHSLIRS

SEQ ID NO: 116265 - protein, 16 aa, Borrelia burgdorferi B31
NILYQENQNHSLIRSL

SEQ ID NO: 116266 - protein, 16 aa, Borrelia burgdorferi B31
ILYQENQNHSLIRSLI

SEQ ID NO: 116267 - protein, 16 aa, Borrelia burgdorferi B31
LYQENQNHSLIRSLII

SEQ ID NO: 116268 - protein, 16 aa, Borrelia burgdorferi B31
YQENQNHSLIRSLIIS

SEQ ID NO: 116269 - protein, 16 aa, Borrelia burgdorferi B31
QENQNHSLIRSLIISG

SEQ ID NO: 116270 - protein, 16 aa, Borrelia burgdorferi B31
ENQNHSLIRSLIISGL

SEQ ID NO: 116271 - protein, 16 aa, Borrelia burgdorferi B31
NQNHSLIRSLIISGLG

SEQ ID NO: 116272 - protein, 16 aa, Borrelia burgdorferi B31
QNHSLIRSLIISGLGI

SEQ ID NO: 116273 - protein, 16 aa, Borrelia burgdorferi B31
NHSLIRSLIISGLGIQ

SEQ ID NO: 116274 - protein, 16 aa, Borrelia burgdorferi B31
HSLIRSLIISGLGIQI

SEQ ID NO: 116275 - protein, 16 aa, Borrelia burgdorferi B31
SLIRSLIISGLGIQIS

SEQ ID NO: 116276 - protein, 16 aa, Borrelia burgdorferi B31
LIRSLIISGLGIQISL

SEQ ID NO: 116277 - protein, 16 aa, Borrelia burgdorferi B31
IRSLIISGLGIQISLE

SEQ ID NO: 116278 - protein, 16 aa, Borrelia burgdorferi B31
RSLIISGLGIQISLES

SEQ ID NO: 116279 - protein, 16 aa, Borrelia burgdorferi B31
SLIISGLGIQISLEST

SEQ ID NO: 116280 - protein, 16 aa, Borrelia burgdorferi B31
LIISGLGIQISLESTL

SEQ ID NO: 116281 - protein, 16 aa, Borrelia burgdorferi B31
IISGLGIQISLESTLE

SEQ ID NO: 116282 - protein, 16 aa, Borrelia burgdorferi B31
ISGLGIQISLESTLEE

SEQ ID NO: 116283 - protein, 16 aa, Borrelia burgdorferi B31
SGLGIQISLESTLEEI

SEQ ID NO: 116284 - protein, 16 aa, Borrelia burgdorferi B31
GLGIQISLESTLEEIE

SEQ ID NO: 116285 - protein, 16 aa, Borrelia burgdorferi B31
LGIQISLESTLEEIEK

SEQ ID NO: 116286 - protein, 16 aa, Borrelia burgdorferi B31
GIQISLESTLEEIEKK

SEQ ID NO: 116287 - protein, 16 aa, Borrelia burgdorferi B31
IQISLESTLEEIEKKI

SEQ ID NO: 116288 - protein, 16 aa, Borrelia burgdorferi B31
QISLESTLEEIEKKIE

SEQ ID NO: 116289 - protein, 16 aa, Borrelia burgdorferi B31
ISLESTLEEIEKKIES

SEQ ID NO: 116290 - protein, 16 aa, Borrelia burgdorferi B31
SLESTLEEIEKKIESF

SEQ ID NO: 116291 - protein, 16 aa, Borrelia burgdorferi B31
LESTLEEIEKKIESFN

SEQ ID NO: 116292 - protein, 16 aa, Borrelia burgdorferi B31
ESTLEEIEKKIESFNT

SEQ ID NO: 116293 - protein, 16 aa, Borrelia burgdorferi B31
STLEEIEKKIESFNTQ

SEQ ID NO: 116294 - protein, 16 aa, Borrelia burgdorferi B31
TLEEIEKKIESFNTQY

SEQ ID NO: 116295 - protein, 16 aa, Borrelia burgdorferi B31
LEEIEKKIESFNTQYL

SEQ ID NO: 116296 - protein, 16 aa, Borrelia burgdorferi B31
EEIEKKIESFNTQYLN

SEQ ID NO: 116297 - protein, 16 aa, Borrelia burgdorferi B31
EIEKKIESFNTQYLNT

SEQ ID NO: 116298 - protein, 16 aa, Borrelia burgdorferi B31
IEKKIESFNTQYLNTI

SEQ ID NO: 116299 - protein, 16 aa, Borrelia burgdorferi B31
EKKIESFNTQYLNTII

SEQ ID NO: 116300 - protein, 16 aa, Borrelia burgdorferi B31
KKIESFNTQYLNTIIN

SEQ ID NO: 116301 - protein, 16 aa, Borrelia burgdorferi B31
KIESFNTQYLNTIINS

SEQ ID NO: 116302 - protein, 16 aa, Borrelia burgdorferi B31
IESFNTQYLNTIINSY

SEQ ID NO: 116303 - protein, 16 aa, Borrelia burgdorferi B31
ESFNTQYLNTIINSYT

SEQ ID NO: 116304 - protein, 16 aa, Borrelia burgdorferi B31
SFNTQYLNTIINSYTF

SEQ ID NO: 116305 - protein, 16 aa, Borrelia burgdorferi B31
FNTQYLNTIINSYTFK

SEQ ID NO: 116306 - protein, 16 aa, Borrelia burgdorferi B31
NTQYLNTIINSYTFKD

SEQ ID NO: 116307 - protein, 16 aa, Borrelia burgdorferi B31
TQYLNTIINSYTFKDK

SEQ ID NO: 116308 - protein, 16 aa, Borrelia burgdorferi B31
QYLNTIINSYTFKDKL

SEQ ID NO: 116309 - protein, 16 aa, Borrelia burgdorferi B31
YLNTIINSYTFKDKLK

SEQ ID NO: 116310 - protein, 16 aa, Borrelia burgdorferi B31
LNTIINSYTFKDKLKE

SEQ ID NO: 116311 - protein, 16 aa, Borrelia burgdorferi B31
NTIINSYTFKDKLKEL

SEQ ID NO: 116312 - protein, 16 aa, Borrelia burgdorferi B31
TIINSYTFKDKLKELE

SEQ ID NO: 116313 - protein, 16 aa, Borrelia burgdorferi B31
IINSYTFKDKLKELES

SEQ ID NO: 116314 - protein, 16 aa, Borrelia burgdorferi B31
INSYTFKDKLKELESK

SEQ ID NO: 116315 - protein, 16 aa, Borrelia burgdorferi B31
NSYTFKDKLKELESKL

SEQ ID NO: 116316 - protein, 16 aa, Borrelia burgdorferi B31
SYTFKDKLKELESKLN

SEQ ID NO: 116317 - protein, 16 aa, Borrelia burgdorferi B31
YTFKDKLKELESKLNS

SEQ ID NO: 116318 - protein, 16 aa, Borrelia burgdorferi B31
TFKDKLKELESKLNSI

SEQ ID NO: 116319 - protein, 16 aa, Borrelia burgdorferi B31
FKDKLKELESKLNSIL

SEQ ID NO: 116320 - protein, 16 aa, Borrelia burgdorferi B31
KDKLKELESKLNSILA

SEQ ID NO: 116321 - protein, 16 aa, Borrelia burgdorferi B31
DKLKELESKLNSILAE

SEQ ID NO: 116322 - protein, 16 aa, Borrelia burgdorferi B31
KLKELESKLNSILAEK

SEQ ID NO: 116323 - protein, 16 aa, Borrelia burgdorferi B31
LKELESKLNSILAEKK

SEQ ID NO: 116324 - protein, 16 aa, Borrelia burgdorferi B31
KELESKLNSILAEKKE

SEQ ID NO: 116325 - protein, 16 aa, Borrelia burgdorferi B31
ELESKLNSILAEKKEW

SEQ ID NO: 116326 - protein, 16 aa, Borrelia burgdorferi B31
LESKLNSILAEKKEWL

SEQ ID NO: 116327 - protein, 16 aa, Borrelia burgdorferi B31
ESKLNSILAEKKEWLN

SEQ ID NO: 116328 - protein, 16 aa, Borrelia burgdorferi B31
SKLNSILAEKKEWLNY

SEQ ID NO: 116329 - protein, 16 aa, Borrelia burgdorferi B31
KLNSILAEKKEWLNYA

SEQ ID NO: 116330 - protein, 16 aa, Borrelia burgdorferi B31
LNSILAEKKEWLNYAD

SEQ ID NO: 116331 - protein, 16 aa, Borrelia burgdorferi B31
NSILAEKKEWLNYADA

SEQ ID NO: 116332 - protein, 16 aa, Borrelia burgdorferi B31
SILAEKKEWLNYADAI

SEQ ID NO: 116333 - protein, 16 aa, Borrelia burgdorferi B31
ILAEKKEWLNYADAII

SEQ ID NO: 116334 - protein, 16 aa, Borrelia burgdorferi B31
LAEKKEWLNYADAIIT

SEQ ID NO: 116335 - protein, 16 aa, Borrelia burgdorferi B31
AEKKEWLNYADAIITN

SEQ ID NO: 116336 - protein, 16 aa, Borrelia burgdorferi B31
EKKEWLNYADAIITNT

SEQ ID NO: 116337 - protein, 16 aa, Borrelia burgdorferi B31
KKEWLNYADAIITNTS

SEQ ID NO: 116338 - protein, 16 aa, Borrelia burgdorferi B31
KEWLNYADAIITNTSS

SEQ ID NO: 116339 - protein, 16 aa, Borrelia burgdorferi B31
EWLNYADAIITNTSSN

SEQ ID NO: 116340 - protein, 16 aa, Borrelia burgdorferi B31
WLNYADAIITNTSSNS

SEQ ID NO: 116341 - protein, 16 aa, Borrelia burgdorferi B31
LNYADAIITNTSSNSK

SEQ ID NO: 116342 - protein, 16 aa, Borrelia burgdorferi B31
NYADAIITNTSSNSKR

SEQ ID NO: 116343 - protein, 16 aa, Borrelia burgdorferi B31
YADAIITNTSSNSKRN

SEQ ID NO: 116344 - protein, 16 aa, Borrelia burgdorferi B31
ADAIITNTSSNSKRND

SEQ ID NO: 116345 - protein, 16 aa, Borrelia burgdorferi B31
DAIITNTSSNSKRNDP

SEQ ID NO: 116346 - protein, 16 aa, Borrelia burgdorferi B31
AIITNTSSNSKRNDPQ

SEQ ID NO: 116347 - protein, 16 aa, Borrelia burgdorferi B31
IITNTSSNSKRNDPQS

SEQ ID NO: 116348 - protein, 16 aa, Borrelia burgdorferi B31
ITNTSSNSKRNDPQSL

SEQ ID NO: 116349 - protein, 16 aa, Borrelia burgdorferi B31
TNTSSNSKRNDPQSLG

SEQ ID NO: 116350 - protein, 16 aa, Borrelia burgdorferi B31
NTSSNSKRNDPQSLGQ

SEQ ID NO: 116351 - protein, 16 aa, Borrelia burgdorferi B31
TSSNSKRNDPQSLGQY

SEQ ID NO: 116352 - protein, 16 aa, Borrelia burgdorferi B31
SSNSKRNDPQSLGQYI

SEQ ID NO: 116353 - protein, 16 aa, Borrelia burgdorferi B31
SNSKRNDPQSLGQYIK

SEQ ID NO: 116354 - protein, 16 aa, Borrelia burgdorferi B31
NSKRNDPQSLGQYIKN

SEQ ID NO: 116355 - protein, 16 aa, Borrelia burgdorferi B31
SKRNDPQSLGQYIKNK

SEQ ID NO: 116356 - protein, 16 aa, Borrelia burgdorferi B31
KRNDPQSLGQYIKNKY

SEQ ID NO: 116357 - protein, 16 aa, Borrelia burgdorferi B31
RNDPQSLGQYIKNKYL

SEQ ID NO: 116358 - protein, 16 aa, Borrelia burgdorferi B31
NDPQSLGQYIKNKYLD

SEQ ID NO: 116359 - protein, 16 aa, Borrelia burgdorferi B31
DPQSLGQYIKNKYLDK

SEQ ID NO: 116360 - protein, 16 aa, Borrelia burgdorferi B31
PQSLGQYIKNKYLDKM

SEQ ID NO: 116361 - protein, 16 aa, Borrelia burgdorferi B31
QSLGQYIKNKYLDKMQ

SEQ ID NO: 116362 - protein, 16 aa, Borrelia burgdorferi B31
SLGQYIKNKYLDKMQD

SEQ ID NO: 116363 - protein, 16 aa, Borrelia burgdorferi B31
LGQYIKNKYLDKMQDA

SEQ ID NO: 116364 - protein, 16 aa, Borrelia burgdorferi B31
GQYIKNKYLDKMQDAR

SEQ ID NO: 116365 - protein, 16 aa, Borrelia burgdorferi B31
QYIKNKYLDKMQDARQ

SEQ ID NO: 116366 - protein, 16 aa, Borrelia burgdorferi B31
YIKNKYLDKMQDARQS

SEQ ID NO: 116367 - protein, 16 aa, Borrelia burgdorferi B31
IKNKYLDKMQDARQSA

SEQ ID NO: 116368 - protein, 16 aa, Borrelia burgdorferi B31
KNKYLDKMQDARQSAL

SEQ ID NO: 116369 - protein, 16 aa, Borrelia burgdorferi B31
NKYLDKMQDARQSALD

SEQ ID NO: 116370 - protein, 16 aa, Borrelia burgdorferi B31
KYLDKMQDARQSALDL

SEQ ID NO: 116371 - protein, 16 aa, Borrelia burgdorferi B31
YLDKMQDARQSALDLY

SEQ ID NO: 116372 - protein, 16 aa, Borrelia burgdorferi B31
LDKMQDARQSALDLYL

SEQ ID NO: 116373 - protein, 16 aa, Borrelia burgdorferi B31
DKMQDARQSALDLYLN

SEQ ID NO: 116374 - protein, 16 aa, Borrelia burgdorferi B31
KMQDARQSALDLYLNI

SEQ ID NO: 116375 - protein, 16 aa, Borrelia burgdorferi B31
MQDARQSALDLYLNIT

SEQ ID NO: 116376 - protein, 16 aa, Borrelia burgdorferi B31
QDARQSALDLYLNITE

SEQ ID NO: 116377 - protein, 16 aa, Borrelia burgdorferi B31
DARQSALDLYLNITEI

SEQ ID NO: 116378 - protein, 16 aa, Borrelia burgdorferi B31
ARQSALDLYLNITEIR

SEQ ID NO: 116379 - protein, 13 aa, Borrelia garinii PBi
MKKTKLNIIKLNI

SEQ ID NO: 116380 - protein, 13 aa, Borrelia garinii PBi
KKTKLNIIKLNIL

SEQ ID NO: 116381 - protein, 13 aa, Borrelia garinii PBi
KTKLNIIKLNILT

SEQ ID NO: 116382 - protein, 13 aa, Borrelia garinii PBi
TKLNIIKLNILTT

SEQ ID NO: 116383 - protein, 13 aa, Borrelia garinii PBi
KLNIIKLNILTTT

SEQ ID NO: 116384 - protein, 13 aa, Borrelia garinii PBi
LNIIKLNILTTTL

SEQ ID NO: 116385 - protein, 13 aa, Borrelia garinii PBi
NIIKLNILTTTLT

SEQ ID NO: 116386 - protein, 13 aa, Borrelia garinii PBi
IIKLNILTTTLTL

SEQ ID NO: 116387 - protein, 13 aa, Borrelia garinii PBi
IKLNILTTTLTLI

SEQ ID NO: 116388 - protein, 13 aa, Borrelia garinii PBi
KLNILTTTLTLIC

SEQ ID NO: 116389 - protein, 13 aa, Borrelia garinii PBi
LNILTTTLTLICI

SEQ ID NO: 116390 - protein, 13 aa, Borrelia garinii PBi
NILTTTLTLICIS

SEQ ID NO: 116391 - protein, 13 aa, Borrelia garinii PBi
ILTTTLTLICISC

SEQ ID NO: 116392 - protein, 13 aa, Borrelia garinii PBi
LTTTLTLICISCA

SEQ ID NO: 116393 - protein, 13 aa, Borrelia garinii PBi
TTTLTLICISCAV

SEQ ID NO: 116394 - protein, 13 aa, Borrelia garinii PBi
TTLTLICISCAVN

SEQ ID NO: 116395 - protein, 13 aa, Borrelia garinii PBi
TLTLICISCAVNK

SEQ ID NO: 116396 - protein, 13 aa, Borrelia garinii PBi
LTLICISCAVNKI

SEQ ID NO: 116397 - protein, 13 aa, Borrelia garinii PBi
TLICISCAVNKID

SEQ ID NO: 116398 - protein, 13 aa, Borrelia garinii PBi
LICISCAVNKIDP

SEQ ID NO: 116399 - protein, 13 aa, Borrelia garinii PBi
ICISCAVNKIDPE

SEQ ID NO: 116400 - protein, 13 aa, Borrelia garinii PBi
CISCAVNKIDPEP

SEQ ID NO: 116401 - protein, 13 aa, Borrelia garinii PBi
ISCAVNKIDPEPK

SEQ ID NO: 116402 - protein, 13 aa, Borrelia garinii PBi
SCAVNKIDPEPKS

SEQ ID NO: 116403 - protein, 13 aa, Borrelia garinii PBi
CAVNKIDPEPKSK

SEQ ID NO: 116404 - protein, 13 aa, Borrelia garinii PBi
AVNKIDPEPKSKT

SEQ ID NO: 116405 - protein, 13 aa, Borrelia garinii PBi
VNKIDPEPKSKTN

SEQ ID NO: 116406 - protein, 13 aa, Borrelia garinii PBi
NKIDPEPKSKTNK

SEQ ID NO: 116407 - protein, 13 aa, Borrelia garinii PBi
KIDPEPKSKTNKK

SEQ ID NO: 116408 - protein, 13 aa, Borrelia garinii PBi
IDPEPKSKTNKKE

SEQ ID NO: 116409 - protein, 13 aa, Borrelia garinii PBi
DPEPKSKTNKKEN

SEQ ID NO: 116410 - protein, 13 aa, Borrelia garinii PBi
PEPKSKTNKKENI

SEQ ID NO: 116411 - protein, 13 aa, Borrelia garinii PBi
EPKSKTNKKENIK

SEQ ID NO: 116412 - protein, 13 aa, Borrelia garinii PBi
PKSKTNKKENIKN

SEQ ID NO: 116413 - protein, 13 aa, Borrelia garinii PBi
KSKTNKKENIKNF

SEQ ID NO: 116414 - protein, 13 aa, Borrelia garinii PBi
SKTNKKENIKNFV

SEQ ID NO: 116415 - protein, 13 aa, Borrelia garinii PBi
KTNKKENIKNFVN

SEQ ID NO: 116416 - protein, 13 aa, Borrelia garinii PBi
TNKKENIKNFVNK

SEQ ID NO: 116417 - protein, 13 aa, Borrelia garinii PBi
NKKENIKNFVNKF

SEQ ID NO: 116418 - protein, 13 aa, Borrelia garinii PBi
KKENIKNFVNKFQ

SEQ ID NO: 116419 - protein, 13 aa, Borrelia garinii PBi
KENIKNFVNKFQD

SEQ ID NO: 116420 - protein, 13 aa, Borrelia garinii PBi
ENIKNFVNKFQDL

SEQ ID NO: 116421 - protein, 13 aa, Borrelia garinii PBi
NIKNFVNKFQDLE

SEQ ID NO: 116422 - protein, 13 aa, Borrelia garinii PBi
IKNFVNKFQDLEP

SEQ ID NO: 116423 - protein, 13 aa, Borrelia garinii PBi
KNFVNKFQDLEPS

SEQ ID NO: 116424 - protein, 13 aa, Borrelia garinii PBi
NFVNKFQDLEPSK

SEQ ID NO: 116425 - protein, 13 aa, Borrelia garinii PBi
FVNKFQDLEPSKK

SEQ ID NO: 116426 - protein, 13 aa, Borrelia garinii PBi
VNKFQDLEPSKKQ

SEQ ID NO: 116427 - protein, 13 aa, Borrelia garinii PBi
NKFQDLEPSKKQN

SEQ ID NO: 116428 - protein, 13 aa, Borrelia garinii PBi
KFQDLEPSKKQNK

SEQ ID NO: 116429 - protein, 13 aa, Borrelia garinii PBi
FQDLEPSKKQNKD

SEQ ID NO: 116430 - protein, 13 aa, Borrelia garinii PBi
QDLEPSKKQNKDL

SEQ ID NO: 116431 - protein, 13 aa, Borrelia garinii PBi
DLEPSKKQNKDLE

SEQ ID NO: 116432 - protein, 13 aa, Borrelia garinii PBi
LEPSKKQNKDLEP

SEQ ID NO: 116433 - protein, 13 aa, Borrelia garinii PBi
EPSKKQNKDLEPL

SEQ ID NO: 116434 - protein, 13 aa, Borrelia garinii PBi
PSKKQNKDLEPLR

SEQ ID NO: 116435 - protein, 13 aa, Borrelia garinii PBi
SKKQNKDLEPLRE

SEQ ID NO: 116436 - protein, 13 aa, Borrelia garinii PBi
KKQNKDLEPLREK

SEQ ID NO: 116437 - protein, 13 aa, Borrelia garinii PBi
KQNKDLEPLREKY

SEQ ID NO: 116438 - protein, 13 aa, Borrelia garinii PBi
QNKDLEPLREKYP

SEQ ID NO: 116439 - protein, 13 aa, Borrelia garinii PBi
NKDLEPLREKYPE

SEQ ID NO: 116440 - protein, 13 aa, Borrelia garinii PBi
KDLEPLREKYPEA

SEQ ID NO: 116441 - protein, 13 aa, Borrelia garinii PBi
DLEPLREKYPEAT

SEQ ID NO: 116442 - protein, 13 aa, Borrelia garinii PBi
LEPLREKYPEATA

SEQ ID NO: 116443 - protein, 13 aa, Borrelia garinii PBi
EPLREKYPEATAS

SEQ ID NO: 116444 - protein, 13 aa, Borrelia garinii PBi
PLREKYPEATASK

SEQ ID NO: 116445 - protein, 13 aa, Borrelia garinii PBi
LREKYPEATASKL

SEQ ID NO: 116446 - protein, 13 aa, Borrelia garinii PBi
REKYPEATASKLE

SEQ ID NO: 116447 - protein, 13 aa, Borrelia garinii PBi
EKYPEATASKLET

SEQ ID NO: 116448 - protein, 13 aa, Borrelia garinii PBi
KYPEATASKLETT

SEQ ID NO: 116449 - protein, 13 aa, Borrelia garinii PBi
YPEATASKLETTL

SEQ ID NO: 116450 - protein, 13 aa, Borrelia garinii PBi
PEATASKLETTLK

SEQ ID NO: 116451 - protein, 13 aa, Borrelia garinii PBi
EATASKLETTLKI

SEQ ID NO: 116452 - protein, 13 aa, Borrelia garinii PBi
ATASKLETTLKIL

SEQ ID NO: 116453 - protein, 13 aa, Borrelia garinii PBi
TASKLETTLKILE

SEQ ID NO: 116454 - protein, 13 aa, Borrelia garinii PBi
ASKLETTLKILEA

SEQ ID NO: 116455 - protein, 13 aa, Borrelia garinii PBi
SKLETTLKILEAQ

SEQ ID NO: 116456 - protein, 13 aa, Borrelia garinii PBi
KLETTLKILEAQK

SEQ ID NO: 116457 - protein, 13 aa, Borrelia garinii PBi
LETTLKILEAQKE

SEQ ID NO: 116458 - protein, 13 aa, Borrelia garinii PBi
ETTLKILEAQKEK

SEQ ID NO: 116459 - protein, 13 aa, Borrelia garinii PBi
TTLKILEAQKEKE

SEQ ID NO: 116460 - protein, 13 aa, Borrelia garinii PBi
TLKILEAQKEKEN

SEQ ID NO: 116461 - protein, 13 aa, Borrelia garinii PBi
LKILEAQKEKENI

SEQ ID NO: 116462 - protein, 13 aa, Borrelia garinii PBi
KILEAQKEKENIE

SEQ ID NO: 116463 - protein, 13 aa, Borrelia garinii PBi
ILEAQKEKENIEI

SEQ ID NO: 116464 - protein, 13 aa, Borrelia garinii PBi
LEAQKEKENIEIA

SEQ ID NO: 116465 - protein, 13 aa, Borrelia garinii PBi
EAQKEKENIEIAK

SEQ ID NO: 116466 - protein, 13 aa, Borrelia garinii PBi
AQKEKENIEIAKI

SEQ ID NO: 116467 - protein, 13 aa, Borrelia garinii PBi
QKEKENIEIAKID

SEQ ID NO: 116468 - protein, 13 aa, Borrelia garinii PBi
KEKENIEIAKIDN

SEQ ID NO: 116469 - protein, 13 aa, Borrelia garinii PBi
EKENIEIAKIDNT

SEQ ID NO: 116470 - protein, 13 aa, Borrelia garinii PBi
KENIEIAKIDNTQ

SEQ ID NO: 116471 - protein, 13 aa, Borrelia garinii PBi
ENIEIAKIDNTQI

SEQ ID NO: 116472 - protein, 13 aa, Borrelia garinii PBi
NIEIAKIDNTQID

SEQ ID NO: 116473 - protein, 13 aa, Borrelia garinii PBi
IEIAKIDNTQIDF

SEQ ID NO: 116474 - protein, 13 aa, Borrelia garinii PBi
EIAKIDNTQIDFL

SEQ ID NO: 116475 - protein, 13 aa, Borrelia garinii PBi
IAKIDNTQIDFLK

SEQ ID NO: 116476 - protein, 13 aa, Borrelia garinii PBi
AKIDNTQIDFLKT

SEQ ID NO: 116477 - protein, 13 aa, Borrelia garinii PBi
KIDNTQIDFLKTF

SEQ ID NO: 116478 - protein, 13 aa, Borrelia garinii PBi
IDNTQIDFLKTFK

SEQ ID NO: 116479 - protein, 13 aa, Borrelia garinii PBi
DNTQIDFLKTFKT

SEQ ID NO: 116480 - protein, 13 aa, Borrelia garinii PBi
NTQIDFLKTFKTD

SEQ ID NO: 116481 - protein, 13 aa, Borrelia garinii PBi
TQIDFLKTFKTDP

SEQ ID NO: 116482 - protein, 13 aa, Borrelia garinii PBi
QIDFLKTFKTDPH

SEQ ID NO: 116483 - protein, 13 aa, Borrelia garinii PBi
IDFLKTFKTDPHD

SEQ ID NO: 116484 - protein, 13 aa, Borrelia garinii PBi
DFLKTFKTDPHDS

SEQ ID NO: 116485 - protein, 13 aa, Borrelia garinii PBi
FLKTFKTDPHDSL

SEQ ID NO: 116486 - protein, 13 aa, Borrelia garinii PBi
LKTFKTDPHDSLP

SEQ ID NO: 116487 - protein, 13 aa, Borrelia garinii PBi
KTFKTDPHDSLPE

SEQ ID NO: 116488 - protein, 13 aa, Borrelia garinii PBi
TFKTDPHDSLPED

SEQ ID NO: 116489 - protein, 13 aa, Borrelia garinii PBi
FKTDPHDSLPEDE

SEQ ID NO: 116490 - protein, 13 aa, Borrelia garinii PBi
KTDPHDSLPEDEK

SEQ ID NO: 116491 - protein, 13 aa, Borrelia garinii PBi
TDPHDSLPEDEKM

SEQ ID NO: 116492 - protein, 13 aa, Borrelia garinii PBi
DPHDSLPEDEKMQ

SEQ ID NO: 116493 - protein, 13 aa, Borrelia garinii PBi
PHDSLPEDEKMQM

SEQ ID NO: 116494 - protein, 13 aa, Borrelia garinii PBi
HDSLPEDEKMQMK

SEQ ID NO: 116495 - protein, 13 aa, Borrelia garinii PBi
DSLPEDEKMQMKK

SEQ ID NO: 116496 - protein, 13 aa, Borrelia garinii PBi
SLPEDEKMQMKKI

SEQ ID NO: 116497 - protein, 13 aa, Borrelia garinii PBi
LPEDEKMQMKKII

SEQ ID NO: 116498 - protein, 13 aa, Borrelia garinii PBi
PEDEKMQMKKIIY

SEQ ID NO: 116499 - protein, 13 aa, Borrelia garinii PBi
EDEKMQMKKIIYS

SEQ ID NO: 116500 - protein, 13 aa, Borrelia garinii PBi
DEKMQMKKIIYSS

SEQ ID NO: 116501 - protein, 13 aa, Borrelia garinii PBi
EKMQMKKIIYSSL

SEQ ID NO: 116502 - protein, 13 aa, Borrelia garinii PBi
KMQMKKIIYSSLN

SEQ ID NO: 116503 - protein, 13 aa, Borrelia garinii PBi
MQMKKIIYSSLNY

SEQ ID NO: 116504 - protein, 13 aa, Borrelia garinii PBi
QMKKIIYSSLNYE

SEQ ID NO: 116505 - protein, 13 aa, Borrelia garinii PBi
MKKIIYSSLNYET

SEQ ID NO: 116506 - protein, 13 aa, Borrelia garinii PBi
KKIIYSSLNYETE

SEQ ID NO: 116507 - protein, 13 aa, Borrelia garinii PBi
KIIYSSLNYETEK

SEQ ID NO: 116508 - protein, 13 aa, Borrelia garinii PBi
IIYSSLNYETEKI

SEQ ID NO: 116509 - protein, 13 aa, Borrelia garinii PBi
IYSSLNYETEKIK

SEQ ID NO: 116510 - protein, 13 aa, Borrelia garinii PBi
YSSLNYETEKIKI

SEQ ID NO: 116511 - protein, 13 aa, Borrelia garinii PBi
SSLNYETEKIKIL

SEQ ID NO: 116512 - protein, 13 aa, Borrelia garinii PBi
SLNYETEKIKILQ

SEQ ID NO: 116513 - protein, 13 aa, Borrelia garinii PBi
LNYETEKIKILQE

SEQ ID NO: 116514 - protein, 13 aa, Borrelia garinii PBi
NYETEKIKILQEI

SEQ ID NO: 116515 - protein, 13 aa, Borrelia garinii PBi
YETEKIKILQEIL

SEQ ID NO: 116516 - protein, 13 aa, Borrelia garinii PBi
ETEKIKILQEILE

SEQ ID NO: 116517 - protein, 13 aa, Borrelia garinii PBi
TEKIKILQEILEK

SEQ ID NO: 116518 - protein, 13 aa, Borrelia garinii PBi
EKIKILQEILEKL

SEQ ID NO: 116519 - protein, 13 aa, Borrelia garinii PBi
KIKILQEILEKLD

SEQ ID NO: 116520 - protein, 13 aa, Borrelia garinii PBi
IKILQEILEKLDK

SEQ ID NO: 116521 - protein, 13 aa, Borrelia garinii PBi
KILQEILEKLDKN

SEQ ID NO: 116522 - protein, 13 aa, Borrelia garinii PBi
ILQEILEKLDKNL

SEQ ID NO: 116523 - protein, 13 aa, Borrelia garinii PBi
LQEILEKLDKNLQ

SEQ ID NO: 116524 - protein, 13 aa, Borrelia garinii PBi
QEILEKLDKNLQH

SEQ ID NO: 116525 - protein, 13 aa, Borrelia garinii PBi
EILEKLDKNLQHK

SEQ ID NO: 116526 - protein, 13 aa, Borrelia garinii PBi
ILEKLDKNLQHKK

SEQ ID NO: 116527 - protein, 13 aa, Borrelia garinii PBi
LEKLDKNLQHKKI

SEQ ID NO: 116528 - protein, 13 aa, Borrelia garinii PBi
EKLDKNLQHKKIA

SEQ ID NO: 116529 - protein, 13 aa, Borrelia garinii PBi
KLDKNLQHKKIAK

SEQ ID NO: 116530 - protein, 13 aa, Borrelia garinii PBi
LDKNLQHKKIAKN

SEQ ID NO: 116531 - protein, 13 aa, Borrelia garinii PBi
DKNLQHKKIAKNF

SEQ ID NO: 116532 - protein, 13 aa, Borrelia garinii PBi
KNLQHKKIAKNFI

SEQ ID NO: 116533 - protein, 13 aa, Borrelia garinii PBi
NLQHKKIAKNFIY

SEQ ID NO: 116534 - protein, 13 aa, Borrelia garinii PBi
LQHKKIAKNFIYD

SEQ ID NO: 116535 - protein, 13 aa, Borrelia garinii PBi
QHKKIAKNFIYDI

SEQ ID NO: 116536 - protein, 13 aa, Borrelia garinii PBi
HKKIAKNFIYDIP

SEQ ID NO: 116537 - protein, 13 aa, Borrelia garinii PBi
KKIAKNFIYDIPI

SEQ ID NO: 116538 - protein, 13 aa, Borrelia garinii PBi
KIAKNFIYDIPII

SEQ ID NO: 116539 - protein, 13 aa, Borrelia garinii PBi
IAKNFIYDIPIII

SEQ ID NO: 116540 - protein, 13 aa, Borrelia garinii PBi
AKNFIYDIPIIIQ

SEQ ID NO: 116541 - protein, 13 aa, Borrelia garinii PBi
KNFIYDIPIIIQS

SEQ ID NO: 116542 - protein, 13 aa, Borrelia garinii PBi
NFIYDIPIIIQSR

SEQ ID NO: 116543 - protein, 13 aa, Borrelia garinii PBi
FIYDIPIIIQSRL

SEQ ID NO: 116544 - protein, 13 aa, Borrelia garinii PBi
IYDIPIIIQSRLD

SEQ ID NO: 116545 - protein, 13 aa, Borrelia garinii PBi
YDIPIIIQSRLDI

SEQ ID NO: 116546 - protein, 13 aa, Borrelia garinii PBi
DIPIIIQSRLDII

SEQ ID NO: 116547 - protein, 13 aa, Borrelia garinii PBi
IPIIIQSRLDIIS

SEQ ID NO: 116548 - protein, 13 aa, Borrelia garinii PBi
PIIIQSRLDIISK

SEQ ID NO: 116549 - protein, 13 aa, Borrelia garinii PBi
IIIQSRLDIISKV

SEQ ID NO: 116550 - protein, 13 aa, Borrelia garinii PBi
IIQSRLDIISKVI

SEQ ID NO: 116551 - protein, 13 aa, Borrelia garinii PBi
IQSRLDIISKVIK

SEQ ID NO: 116552 - protein, 13 aa, Borrelia garinii PBi
QSRLDIISKVIKN

SEQ ID NO: 116553 - protein, 13 aa, Borrelia garinii PBi
SRLDIISKVIKNP

SEQ ID NO: 116554 - protein, 13 aa, Borrelia garinii PBi
RLDIISKVIKNPI

SEQ ID NO: 116555 - protein, 13 aa, Borrelia garinii PBi
LDIISKVIKNPIK

SEQ ID NO: 116556 - protein, 13 aa, Borrelia garinii PBi
DIISKVIKNPIKD

SEQ ID NO: 116557 - protein, 13 aa, Borrelia garinii PBi
IISKVIKNPIKDE

SEQ ID NO: 116558 - protein, 13 aa, Borrelia garinii PBi
ISKVIKNPIKDEL

SEQ ID NO: 116559 - protein, 13 aa, Borrelia garinii PBi
SKVIKNPIKDELQ

SEQ ID NO: 116560 - protein, 13 aa, Borrelia garinii PBi
KVIKNPIKDELQI

SEQ ID NO: 116561 - protein, 13 aa, Borrelia garinii PBi
VIKNPIKDELQIL

SEQ ID NO: 116562 - protein, 13 aa, Borrelia garinii PBi
IKNPIKDELQILN

SEQ ID NO: 116563 - protein, 13 aa, Borrelia garinii PBi
KNPIKDELQILNQ

SEQ ID NO: 116564 - protein, 13 aa, Borrelia garinii PBi
NPIKDELQILNQK

SEQ ID NO: 116565 - protein, 13 aa, Borrelia garinii PBi
PIKDELQILNQKE

SEQ ID NO: 116566 - protein, 13 aa, Borrelia garinii PBi
IKDELQILNQKEI

SEQ ID NO: 116567 - protein, 13 aa, Borrelia garinii PBi
KDELQILNQKEIE

SEQ ID NO: 116568 - protein, 13 aa, Borrelia garinii PBi
DELQILNQKEIEE

SEQ ID NO: 116569 - protein, 13 aa, Borrelia garinii PBi
ELQILNQKEIEEL

SEQ ID NO: 116570 - protein, 13 aa, Borrelia garinii PBi
LQILNQKEIEELL

SEQ ID NO: 116571 - protein, 13 aa, Borrelia garinii PBi
QILNQKEIEELLM

SEQ ID NO: 116572 - protein, 13 aa, Borrelia garinii PBi
ILNQKEIEELLMR

SEQ ID NO: 116573 - protein, 13 aa, Borrelia garinii PBi
LNQKEIEELLMRI

SEQ ID NO: 116574 - protein, 13 aa, Borrelia garinii PBi
NQKEIEELLMRIE

SEQ ID NO: 116575 - protein, 13 aa, Borrelia garinii PBi
QKEIEELLMRIES

SEQ ID NO: 116576 - protein, 13 aa, Borrelia garinii PBi
KEIEELLMRIESE

SEQ ID NO: 116577 - protein, 13 aa, Borrelia garinii PBi
EIEELLMRIESEL

SEQ ID NO: 116578 - protein, 13 aa, Borrelia garinii PBi
IEELLMRIESELK

SEQ ID NO: 116579 - protein, 13 aa, Borrelia garinii PBi
EELLMRIESELKI

SEQ ID NO: 116580 - protein, 13 aa, Borrelia garinii PBi
ELLMRIESELKIK

SEQ ID NO: 116581 - protein, 13 aa, Borrelia garinii PBi
LLMRIESELKIKE

SEQ ID NO: 116582 - protein, 13 aa, Borrelia garinii PBi
LMRIESELKIKEN

SEQ ID NO: 116583 - protein, 13 aa, Borrelia garinii PBi
MRIESELKIKENF

SEQ ID NO: 116584 - protein, 13 aa, Borrelia garinii PBi
RIESELKIKENFK

SEQ ID NO: 116585 - protein, 13 aa, Borrelia garinii PBi
IESELKIKENFKK

SEQ ID NO: 116586 - protein, 13 aa, Borrelia garinii PBi
ESELKIKENFKKA

SEQ ID NO: 116587 - protein, 13 aa, Borrelia garinii PBi
SELKIKENFKKAL

SEQ ID NO: 116588 - protein, 13 aa, Borrelia garinii PBi
ELKIKENFKKALN

SEQ ID NO: 116589 - protein, 13 aa, Borrelia garinii PBi
LKIKENFKKALNK

SEQ ID NO: 116590 - protein, 13 aa, Borrelia garinii PBi
KIKENFKKALNKT

SEQ ID NO: 116591 - protein, 13 aa, Borrelia garinii PBi
IKENFKKALNKTI

SEQ ID NO: 116592 - protein, 13 aa, Borrelia garinii PBi
KENFKKALNKTID

SEQ ID NO: 116593 - protein, 13 aa, Borrelia garinii PBi
ENFKKALNKTIDA

SEQ ID NO: 116594 - protein, 13 aa, Borrelia garinii PBi
NFKKALNKTIDAY

SEQ ID NO: 116595 - protein, 13 aa, Borrelia garinii PBi
FKKALNKTIDAYN

SEQ ID NO: 116596 - protein, 13 aa, Borrelia garinii PBi
KKALNKTIDAYNQ

SEQ ID NO: 116597 - protein, 13 aa, Borrelia garinii PBi
KALNKTIDAYNQD

SEQ ID NO: 116598 - protein, 13 aa, Borrelia garinii PBi
ALNKTIDAYNQDS

SEQ ID NO: 116599 - protein, 13 aa, Borrelia garinii PBi
LNKTIDAYNQDSE

SEQ ID NO: 116600 - protein, 13 aa, Borrelia garinii PBi
NKTIDAYNQDSEN

SEQ ID NO: 116601 - protein, 13 aa, Borrelia garinii PBi
KTIDAYNQDSENI

SEQ ID NO: 116602 - protein, 13 aa, Borrelia garinii PBi
TIDAYNQDSENIK

SEQ ID NO: 116603 - protein, 13 aa, Borrelia garinii PBi
IDAYNQDSENIKT

SEQ ID NO: 116604 - protein, 13 aa, Borrelia garinii PBi
DAYNQDSENIKTS

SEQ ID NO: 116605 - protein, 13 aa, Borrelia garinii PBi
AYNQDSENIKTSA

SEQ ID NO: 116606 - protein, 13 aa, Borrelia garinii PBi
YNQDSENIKTSAE

SEQ ID NO: 116607 - protein, 13 aa, Borrelia garinii PBi
NQDSENIKTSAEQ

SEQ ID NO: 116608 - protein, 13 aa, Borrelia garinii PBi
QDSENIKTSAEQL

SEQ ID NO: 116609 - protein, 13 aa, Borrelia garinii PBi
DSENIKTSAEQLE

SEQ ID NO: 116610 - protein, 13 aa, Borrelia garinii PBi
SENIKTSAEQLEK

SEQ ID NO: 116611 - protein, 13 aa, Borrelia garinii PBi
ENIKTSAEQLEKH

SEQ ID NO: 116612 - protein, 13 aa, Borrelia garinii PBi
NIKTSAEQLEKHI

SEQ ID NO: 116613 - protein, 13 aa, Borrelia garinii PBi
IKTSAEQLEKHIN

SEQ ID NO: 116614 - protein, 13 aa, Borrelia garinii PBi
KTSAEQLEKHINE

SEQ ID NO: 116615 - protein, 13 aa, Borrelia garinii PBi
TSAEQLEKHINEN

SEQ ID NO: 116616 - protein, 13 aa, Borrelia garinii PBi
SAEQLEKHINENY

SEQ ID NO: 116617 - protein, 13 aa, Borrelia garinii PBi
AEQLEKHINENYK

SEQ ID NO: 116618 - protein, 13 aa, Borrelia garinii PBi
EQLEKHINENYKE

SEQ ID NO: 116619 - protein, 13 aa, Borrelia garinii PBi
QLEKHINENYKEF

SEQ ID NO: 116620 - protein, 13 aa, Borrelia garinii PBi
LEKHINENYKEFN

SEQ ID NO: 116621 - protein, 13 aa, Borrelia garinii PBi
EKHINENYKEFNS

SEQ ID NO: 116622 - protein, 13 aa, Borrelia garinii PBi
KHINENYKEFNSL

SEQ ID NO: 116623 - protein, 13 aa, Borrelia garinii PBi
HINENYKEFNSLK

SEQ ID NO: 116624 - protein, 13 aa, Borrelia garinii PBi
INENYKEFNSLKP

SEQ ID NO: 116625 - protein, 13 aa, Borrelia garinii PBi
NENYKEFNSLKPI

SEQ ID NO: 116626 - protein, 13 aa, Borrelia garinii PBi
ENYKEFNSLKPIY

SEQ ID NO: 116627 - protein, 14 aa, Borrelia garinii PBi
MKKTKLNIIKLNIL

SEQ ID NO: 116628 - protein, 14 aa, Borrelia garinii PBi
KKTKLNIIKLNILT

SEQ ID NO: 116629 - protein, 14 aa, Borrelia garinii PBi
KTKLNIIKLNILTT

SEQ ID NO: 116630 - protein, 14 aa, Borrelia garinii PBi
TKLNIIKLNILTTT

SEQ ID NO: 116631 - protein, 14 aa, Borrelia garinii PBi
KLNIIKLNILTTTL

SEQ ID NO: 116632 - protein, 14 aa, Borrelia garinii PBi
LNIIKLNILTTTLT

SEQ ID NO: 116633 - protein, 14 aa, Borrelia garinii PBi
NIIKLNILTTTLTL

SEQ ID NO: 116634 - protein, 14 aa, Borrelia garinii PBi
IIKLNILTTTLTLI

SEQ ID NO: 116635 - protein, 14 aa, Borrelia garinii PBi
IKLNILTTTLTLIC

SEQ ID NO: 116636 - protein, 14 aa, Borrelia garinii PBi
KLNILTTTLTLICI

SEQ ID NO: 116637 - protein, 14 aa, Borrelia garinii PBi
LNILTTTLTLICIS

SEQ ID NO: 116638 - protein, 14 aa, Borrelia garinii PBi
NILTTTLTLICISC

SEQ ID NO: 116639 - protein, 14 aa, Borrelia garinii PBi
ILTTTLTLICISCA

SEQ ID NO: 116640 - protein, 14 aa, Borrelia garinii PBi
LTTTLTLICISCAV

SEQ ID NO: 116641 - protein, 14 aa, Borrelia garinii PBi
TTTLTLICISCAVN

SEQ ID NO: 116642 - protein, 14 aa, Borrelia garinii PBi
TTLTLICISCAVNK

SEQ ID NO: 116643 - protein, 14 aa, Borrelia garinii PBi
TLTLICISCAVNKI

SEQ ID NO: 116644 - protein, 14 aa, Borrelia garinii PBi
LTLICISCAVNKID

SEQ ID NO: 116645 - protein, 14 aa, Borrelia garinii PBi
TLICISCAVNKIDP

SEQ ID NO: 116646 - protein, 14 aa, Borrelia garinii PBi
LICISCAVNKIDPE

SEQ ID NO: 116647 - protein, 14 aa, Borrelia garinii PBi
ICISCAVNKIDPEP

SEQ ID NO: 116648 - protein, 14 aa, Borrelia garinii PBi
CISCAVNKIDPEPK

SEQ ID NO: 116649 - protein, 14 aa, Borrelia garinii PBi
ISCAVNKIDPEPKS

SEQ ID NO: 116650 - protein, 14 aa, Borrelia garinii PBi
SCAVNKIDPEPKSK

SEQ ID NO: 116651 - protein, 14 aa, Borrelia garinii PBi
CAVNKIDPEPKSKT

SEQ ID NO: 116652 - protein, 14 aa, Borrelia garinii PBi
AVNKIDPEPKSKTN

SEQ ID NO: 116653 - protein, 14 aa, Borrelia garinii PBi
VNKIDPEPKSKTNK

SEQ ID NO: 116654 - protein, 14 aa, Borrelia garinii PBi
NKIDPEPKSKTNKK

SEQ ID NO: 116655 - protein, 14 aa, Borrelia garinii PBi
KIDPEPKSKTNKKE

SEQ ID NO: 116656 - protein, 14 aa, Borrelia garinii PBi
IDPEPKSKTNKKEN

SEQ ID NO: 116657 - protein, 14 aa, Borrelia garinii PBi
DPEPKSKTNKKENI

SEQ ID NO: 116658 - protein, 14 aa, Borrelia garinii PBi
PEPKSKTNKKENIK

SEQ ID NO: 116659 - protein, 14 aa, Borrelia garinii PBi
EPKSKTNKKENIKN

SEQ ID NO: 116660 - protein, 14 aa, Borrelia garinii PBi
PKSKTNKKENIKNF

SEQ ID NO: 116661 - protein, 14 aa, Borrelia garinii PBi
KSKTNKKENIKNFV

SEQ ID NO: 116662 - protein, 14 aa, Borrelia garinii PBi
SKTNKKENIKNFVN

SEQ ID NO: 116663 - protein, 14 aa, Borrelia garinii PBi
KTNKKENIKNFVNK

SEQ ID NO: 116664 - protein, 14 aa, Borrelia garinii PBi
TNKKENIKNFVNKF

SEQ ID NO: 116665 - protein, 14 aa, Borrelia garinii PBi
NKKENIKNFVNKFQ

SEQ ID NO: 116666 - protein, 14 aa, Borrelia garinii PBi
KKENIKNFVNKFQD

SEQ ID NO: 116667 - protein, 14 aa, Borrelia garinii PBi
KENIKNFVNKFQDL

SEQ ID NO: 116668 - protein, 14 aa, Borrelia garinii PBi
ENIKNFVNKFQDLE

SEQ ID NO: 116669 - protein, 14 aa, Borrelia garinii PBi
NIKNFVNKFQDLEP

SEQ ID NO: 116670 - protein, 14 aa, Borrelia garinii PBi
IKNFVNKFQDLEPS

SEQ ID NO: 116671 - protein, 14 aa, Borrelia garinii PBi
KNFVNKFQDLEPSK

SEQ ID NO: 116672 - protein, 14 aa, Borrelia garinii PBi
NFVNKFQDLEPSKK

SEQ ID NO: 116673 - protein, 14 aa, Borrelia garinii PBi
FVNKFQDLEPSKKQ

SEQ ID NO: 116674 - protein, 14 aa, Borrelia garinii PBi
VNKFQDLEPSKKQN

SEQ ID NO: 116675 - protein, 14 aa, Borrelia garinii PBi
NKFQDLEPSKKQNK

SEQ ID NO: 116676 - protein, 14 aa, Borrelia garinii PBi
KFQDLEPSKKQNKD

SEQ ID NO: 116677 - protein, 14 aa, Borrelia garinii PBi
FQDLEPSKKQNKDL

SEQ ID NO: 116678 - protein, 14 aa, Borrelia garinii PBi
QDLEPSKKQNKDLE

SEQ ID NO: 116679 - protein, 14 aa, Borrelia garinii PBi
DLEPSKKQNKDLEP

SEQ ID NO: 116680 - protein, 14 aa, Borrelia garinii PBi
LEPSKKQNKDLEPL

SEQ ID NO: 116681 - protein, 14 aa, Borrelia garinii PBi
EPSKKQNKDLEPLR

SEQ ID NO: 116682 - protein, 14 aa, Borrelia garinii PBi
PSKKQNKDLEPLRE

SEQ ID NO: 116683 - protein, 14 aa, Borrelia garinii PBi
SKKQNKDLEPLREK

SEQ ID NO: 116684 - protein, 14 aa, Borrelia garinii PBi
KKQNKDLEPLREKY

SEQ ID NO: 116685 - protein, 14 aa, Borrelia garinii PBi
KQNKDLEPLREKYP

SEQ ID NO: 116686 - protein, 14 aa, Borrelia garinii PBi
QNKDLEPLREKYPE

SEQ ID NO: 116687 - protein, 14 aa, Borrelia garinii PBi
NKDLEPLREKYPEA

SEQ ID NO: 116688 - protein, 14 aa, Borrelia garinii PBi
KDLEPLREKYPEAT

SEQ ID NO: 116689 - protein, 14 aa, Borrelia garinii PBi
DLEPLREKYPEATA

SEQ ID NO: 116690 - protein, 14 aa, Borrelia garinii PBi
LEPLREKYPEATAS

SEQ ID NO: 116691 - protein, 14 aa, Borrelia garinii PBi
EPLREKYPEATASK

SEQ ID NO: 116692 - protein, 14 aa, Borrelia garinii PBi
PLREKYPEATASKL

SEQ ID NO: 116693 - protein, 14 aa, Borrelia garinii PBi
LREKYPEATASKLE

SEQ ID NO: 116694 - protein, 14 aa, Borrelia garinii PBi
REKYPEATASKLET

SEQ ID NO: 116695 - protein, 14 aa, Borrelia garinii PBi
EKYPEATASKLETT

SEQ ID NO: 116696 - protein, 14 aa, Borrelia garinii PBi
KYPEATASKLETTL

SEQ ID NO: 116697 - protein, 14 aa, Borrelia garinii PBi
YPEATASKLETTLK

SEQ ID NO: 116698 - protein, 14 aa, Borrelia garinii PBi
PEATASKLETTLKI

SEQ ID NO: 116699 - protein, 14 aa, Borrelia garinii PBi
EATASKLETTLKIL

SEQ ID NO: 116700 - protein, 14 aa, Borrelia garinii PBi
ATASKLETTLKILE

SEQ ID NO: 116701 - protein, 14 aa, Borrelia garinii PBi
TASKLETTLKILEA

SEQ ID NO: 116702 - protein, 14 aa, Borrelia garinii PBi
ASKLETTLKILEAQ

SEQ ID NO: 116703 - protein, 14 aa, Borrelia garinii PBi
SKLETTLKILEAQK

SEQ ID NO: 116704 - protein, 14 aa, Borrelia garinii PBi
KLETTLKILEAQKE

SEQ ID NO: 116705 - protein, 14 aa, Borrelia garinii PBi
LETTLKILEAQKEK

SEQ ID NO: 116706 - protein, 14 aa, Borrelia garinii PBi
ETTLKILEAQKEKE

SEQ ID NO: 116707 - protein, 14 aa, Borrelia garinii PBi
TTLKILEAQKEKEN

SEQ ID NO: 116708 - protein, 14 aa, Borrelia garinii PBi
TLKILEAQKEKENI

SEQ ID NO: 116709 - protein, 14 aa, Borrelia garinii PBi
LKILEAQKEKENIE

SEQ ID NO: 116710 - protein, 14 aa, Borrelia garinii PBi
KILEAQKEKENIEI

SEQ ID NO: 116711 - protein, 14 aa, Borrelia garinii PBi
ILEAQKEKENIEIA

SEQ ID NO: 116712 - protein, 14 aa, Borrelia garinii PBi
LEAQKEKENIEIAK

SEQ ID NO: 116713 - protein, 14 aa, Borrelia garinii PBi
EAQKEKENIEIAKI

SEQ ID NO: 116714 - protein, 14 aa, Borrelia garinii PBi
AQKEKENIEIAKID

SEQ ID NO: 116715 - protein, 14 aa, Borrelia garinii PBi
QKEKENIEIAKIDN

SEQ ID NO: 116716 - protein, 14 aa, Borrelia garinii PBi
KEKENIEIAKIDNT

SEQ ID NO: 116717 - protein, 14 aa, Borrelia garinii PBi
EKENIEIAKIDNTQ

SEQ ID NO: 116718 - protein, 14 aa, Borrelia garinii PBi
KENIEIAKIDNTQI

SEQ ID NO: 116719 - protein, 14 aa, Borrelia garinii PBi
ENIEIAKIDNTQID

SEQ ID NO: 116720 - protein, 14 aa, Borrelia garinii PBi
NIEIAKIDNTQIDF

SEQ ID NO: 116721 - protein, 14 aa, Borrelia garinii PBi
IEIAKIDNTQIDFL

SEQ ID NO: 116722 - protein, 14 aa, Borrelia garinii PBi
EIAKIDNTQIDFLK

SEQ ID NO: 116723 - protein, 14 aa, Borrelia garinii PBi
IAKIDNTQIDFLKT

SEQ ID NO: 116724 - protein, 14 aa, Borrelia garinii PBi
AKIDNTQIDFLKTF

SEQ ID NO: 116725 - protein, 14 aa, Borrelia garinii PBi
KIDNTQIDFLKTFK

SEQ ID NO: 116726 - protein, 14 aa, Borrelia garinii PBi
IDNTQIDFLKTFKT

SEQ ID NO: 116727 - protein, 14 aa, Borrelia garinii PBi
DNTQIDFLKTFKTD

SEQ ID NO: 116728 - protein, 14 aa, Borrelia garinii PBi
NTQIDFLKTFKTDP

SEQ ID NO: 116729 - protein, 14 aa, Borrelia garinii PBi
TQIDFLKTFKTDPH

SEQ ID NO: 116730 - protein, 14 aa, Borrelia garinii PBi
QIDFLKTFKTDPHD

SEQ ID NO: 116731 - protein, 14 aa, Borrelia garinii PBi
IDFLKTFKTDPHDS

SEQ ID NO: 116732 - protein, 14 aa, Borrelia garinii PBi
DFLKTFKTDPHDSL

SEQ ID NO: 116733 - protein, 14 aa, Borrelia garinii PBi
FLKTFKTDPHDSLP

SEQ ID NO: 116734 - protein, 14 aa, Borrelia garinii PBi
LKTFKTDPHDSLPE

SEQ ID NO: 116735 - protein, 14 aa, Borrelia garinii PBi
KTFKTDPHDSLPED

SEQ ID NO: 116736 - protein, 14 aa, Borrelia garinii PBi
TFKTDPHDSLPEDE

SEQ ID NO: 116737 - protein, 14 aa, Borrelia garinii PBi
FKTDPHDSLPEDEK

SEQ ID NO: 116738 - protein, 14 aa, Borrelia garinii PBi
KTDPHDSLPEDEKM

SEQ ID NO: 116739 - protein, 14 aa, Borrelia garinii PBi
TDPHDSLPEDEKMQ

SEQ ID NO: 116740 - protein, 14 aa, Borrelia garinii PBi
DPHDSLPEDEKMQM

SEQ ID NO: 116741 - protein, 14 aa, Borrelia garinii PBi
PHDSLPEDEKMQMK

SEQ ID NO: 116742 - protein, 14 aa, Borrelia garinii PBi
HDSLPEDEKMQMKK

SEQ ID NO: 116743 - protein, 14 aa, Borrelia garinii PBi
DSLPEDEKMQMKKI

SEQ ID NO: 116744 - protein, 14 aa, Borrelia garinii PBi
SLPEDEKMQMKKII

SEQ ID NO: 116745 - protein, 14 aa, Borrelia garinii PBi
LPEDEKMQMKKIIY

SEQ ID NO: 116746 - protein, 14 aa, Borrelia garinii PBi
PEDEKMQMKKIIYS

SEQ ID NO: 116747 - protein, 14 aa, Borrelia garinii PBi
EDEKMQMKKIIYSS

SEQ ID NO: 116748 - protein, 14 aa, Borrelia garinii PBi
DEKMQMKKIIYSSL

SEQ ID NO: 116749 - protein, 14 aa, Borrelia garinii PBi
EKMQMKKIIYSSLN

SEQ ID NO: 116750 - protein, 14 aa, Borrelia garinii PBi
KMQMKKIIYSSLNY

SEQ ID NO: 116751 - protein, 14 aa, Borrelia garinii PBi
MQMKKIIYSSLNYE

SEQ ID NO: 116752 - protein, 14 aa, Borrelia garinii PBi
QMKKIIYSSLNYET

SEQ ID NO: 116753 - protein, 14 aa, Borrelia garinii PBi
MKKIIYSSLNYETE

SEQ ID NO: 116754 - protein, 14 aa, Borrelia garinii PBi
KKIIYSSLNYETEK

SEQ ID NO: 116755 - protein, 14 aa, Borrelia garinii PBi
KIIYSSLNYETEKI

SEQ ID NO: 116756 - protein, 14 aa, Borrelia garinii PBi
IIYSSLNYETEKIK

SEQ ID NO: 116757 - protein, 14 aa, Borrelia garinii PBi
IYSSLNYETEKIKI

SEQ ID NO: 116758 - protein, 14 aa, Borrelia garinii PBi
YSSLNYETEKIKIL

SEQ ID NO: 116759 - protein, 14 aa, Borrelia garinii PBi
SSLNYETEKIKILQ

SEQ ID NO: 116760 - protein, 14 aa, Borrelia garinii PBi
SLNYETEKIKILQE

SEQ ID NO: 116761 - protein, 14 aa, Borrelia garinii PBi
LNYETEKIKILQEI

SEQ ID NO: 116762 - protein, 14 aa, Borrelia garinii PBi
NYETEKIKILQEIL

SEQ ID NO: 116763 - protein, 14 aa, Borrelia garinii PBi
YETEKIKILQEILE

SEQ ID NO: 116764 - protein, 14 aa, Borrelia garinii PBi
ETEKIKILQEILEK

SEQ ID NO: 116765 - protein, 14 aa, Borrelia garinii PBi
TEKIKILQEILEKL

SEQ ID NO: 116766 - protein, 14 aa, Borrelia garinii PBi
EKIKILQEILEKLD

SEQ ID NO: 116767 - protein, 14 aa, Borrelia garinii PBi
KIKILQEILEKLDK

SEQ ID NO: 116768 - protein, 14 aa, Borrelia garinii PBi
IKILQEILEKLDKN

SEQ ID NO: 116769 - protein, 14 aa, Borrelia garinii PBi
KILQEILEKLDKNL

SEQ ID NO: 116770 - protein, 14 aa, Borrelia garinii PBi
ILQEILEKLDKNLQ

SEQ ID NO: 116771 - protein, 14 aa, Borrelia garinii PBi
LQEILEKLDKNLQH

SEQ ID NO: 116772 - protein, 14 aa, Borrelia garinii PBi
QEILEKLDKNLQHK

SEQ ID NO: 116773 - protein, 14 aa, Borrelia garinii PBi
EILEKLDKNLQHKK

SEQ ID NO: 116774 - protein, 14 aa, Borrelia garinii PBi
ILEKLDKNLQHKKI

SEQ ID NO: 116775 - protein, 14 aa, Borrelia garinii PBi
LEKLDKNLQHKKIA

SEQ ID NO: 116776 - protein, 14 aa, Borrelia garinii PBi
EKLDKNLQHKKIAK

SEQ ID NO: 116777 - protein, 14 aa, Borrelia garinii PBi
KLDKNLQHKKIAKN

SEQ ID NO: 116778 - protein, 14 aa, Borrelia garinii PBi
LDKNLQHKKIAKNF

SEQ ID NO: 116779 - protein, 14 aa, Borrelia garinii PBi
DKNLQHKKIAKNFI

SEQ ID NO: 116780 - protein, 14 aa, Borrelia garinii PBi
KNLQHKKIAKNFIY

SEQ ID NO: 116781 - protein, 14 aa, Borrelia garinii PBi
NLQHKKIAKNFIYD

SEQ ID NO: 116782 - protein, 14 aa, Borrelia garinii PBi
LQHKKIAKNFIYDI

SEQ ID NO: 116783 - protein, 14 aa, Borrelia garinii PBi
QHKKIAKNFIYDIP

SEQ ID NO: 116784 - protein, 14 aa, Borrelia garinii PBi
HKKIAKNFIYDIPI

SEQ ID NO: 116785 - protein, 14 aa, Borrelia garinii PBi
KKIAKNFIYDIPII

SEQ ID NO: 116786 - protein, 14 aa, Borrelia garinii PBi
KIAKNFIYDIPIII

SEQ ID NO: 116787 - protein, 14 aa, Borrelia garinii PBi
IAKNFIYDIPIIIQ

SEQ ID NO: 116788 - protein, 14 aa, Borrelia garinii PBi
AKNFIYDIPIIIQS

SEQ ID NO: 116789 - protein, 14 aa, Borrelia garinii PBi
KNFIYDIPIIIQSR

SEQ ID NO: 116790 - protein, 14 aa, Borrelia garinii PBi
NFIYDIPIIIQSRL

SEQ ID NO: 116791 - protein, 14 aa, Borrelia garinii PBi
FIYDIPIIIQSRLD

SEQ ID NO: 116792 - protein, 14 aa, Borrelia garinii PBi
IYDIPIIIQSRLDI

SEQ ID NO: 116793 - protein, 14 aa, Borrelia garinii PBi
YDIPIIIQSRLDII

SEQ ID NO: 116794 - protein, 14 aa, Borrelia garinii PBi
DIPIIIQSRLDIIS

SEQ ID NO: 116795 - protein, 14 aa, Borrelia garinii PBi
IPIIIQSRLDIISK

SEQ ID NO: 116796 - protein, 14 aa, Borrelia garinii PBi
PIIIQSRLDIISKV

SEQ ID NO: 116797 - protein, 14 aa, Borrelia garinii PBi
IIIQSRLDIISKVI

SEQ ID NO: 116798 - protein, 14 aa, Borrelia garinii PBi
IIQSRLDIISKVIK

SEQ ID NO: 116799 - protein, 14 aa, Borrelia garinii PBi
IQSRLDIISKVIKN

SEQ ID NO: 116800 - protein, 14 aa, Borrelia garinii PBi
QSRLDIISKVIKNP

SEQ ID NO: 116801 - protein, 14 aa, Borrelia garinii PBi
SRLDIISKVIKNPI

SEQ ID NO: 116802 - protein, 14 aa, Borrelia garinii PBi
RLDIISKVIKNPIK

SEQ ID NO: 116803 - protein, 14 aa, Borrelia garinii PBi
LDIISKVIKNPIKD

SEQ ID NO: 116804 - protein, 14 aa, Borrelia garinii PBi
DIISKVIKNPIKDE

SEQ ID NO: 116805 - protein, 14 aa, Borrelia garinii PBi
IISKVIKNPIKDEL

SEQ ID NO: 116806 - protein, 14 aa, Borrelia garinii PBi
ISKVIKNPIKDELQ

SEQ ID NO: 116807 - protein, 14 aa, Borrelia garinii PBi
SKVIKNPIKDELQI

SEQ ID NO: 116808 - protein, 14 aa, Borrelia garinii PBi
KVIKNPIKDELQIL

SEQ ID NO: 116809 - protein, 14 aa, Borrelia garinii PBi
VIKNPIKDELQILN

SEQ ID NO: 116810 - protein, 14 aa, Borrelia garinii PBi
IKNPIKDELQILNQ

SEQ ID NO: 116811 - protein, 14 aa, Borrelia garinii PBi
KNPIKDELQILNQK

SEQ ID NO: 116812 - protein, 14 aa, Borrelia garinii PBi
NPIKDELQILNQKE

SEQ ID NO: 116813 - protein, 14 aa, Borrelia garinii PBi
PIKDELQILNQKEI

SEQ ID NO: 116814 - protein, 14 aa, Borrelia garinii PBi
IKDELQILNQKEIE

SEQ ID NO: 116815 - protein, 14 aa, Borrelia garinii PBi
KDELQILNQKEIEE

SEQ ID NO: 116816 - protein, 14 aa, Borrelia garinii PBi
DELQILNQKEIEEL

SEQ ID NO: 116817 - protein, 14 aa, Borrelia garinii PBi
ELQILNQKEIEELL

SEQ ID NO: 116818 - protein, 14 aa, Borrelia garinii PBi
LQILNQKEIEELLM

SEQ ID NO: 116819 - protein, 14 aa, Borrelia garinii PBi
QILNQKEIEELLMR

SEQ ID NO: 116820 - protein, 14 aa, Borrelia garinii PBi
ILNQKEIEELLMRI

SEQ ID NO: 116821 - protein, 14 aa, Borrelia garinii PBi
LNQKEIEELLMRIE

SEQ ID NO: 116822 - protein, 14 aa, Borrelia garinii PBi
NQKEIEELLMRIES

SEQ ID NO: 116823 - protein, 14 aa, Borrelia garinii PBi
QKEIEELLMRIESE

SEQ ID NO: 116824 - protein, 14 aa, Borrelia garinii PBi
KEIEELLMRIESEL

SEQ ID NO: 116825 - protein, 14 aa, Borrelia garinii PBi
EIEELLMRIESELK

SEQ ID NO: 116826 - protein, 14 aa, Borrelia garinii PBi
IEELLMRIESELKI

SEQ ID NO: 116827 - protein, 14 aa, Borrelia garinii PBi
EELLMRIESELKIK

SEQ ID NO: 116828 - protein, 14 aa, Borrelia garinii PBi
ELLMRIESELKIKE

SEQ ID NO: 116829 - protein, 14 aa, Borrelia garinii PBi
LLMRIESELKIKEN

SEQ ID NO: 116830 - protein, 14 aa, Borrelia garinii PBi
LMRIESELKIKENF

SEQ ID NO: 116831 - protein, 14 aa, Borrelia garinii PBi
MRIESELKIKENFK

SEQ ID NO: 116832 - protein, 14 aa, Borrelia garinii PBi
RIESELKIKENFKK

SEQ ID NO: 116833 - protein, 14 aa, Borrelia garinii PBi
IESELKIKENFKKA

SEQ ID NO: 116834 - protein, 14 aa, Borrelia garinii PBi
ESELKIKENFKKAL

SEQ ID NO: 116835 - protein, 14 aa, Borrelia garinii PBi
SELKIKENFKKALN

SEQ ID NO: 116836 - protein, 14 aa, Borrelia garinii PBi
ELKIKENFKKALNK

SEQ ID NO: 116837 - protein, 14 aa, Borrelia garinii PBi
LKIKENFKKALNKT

SEQ ID NO: 116838 - protein, 14 aa, Borrelia garinii PBi
KIKENFKKALNKTI

SEQ ID NO: 116839 - protein, 14 aa, Borrelia garinii PBi
IKENFKKALNKTID

SEQ ID NO: 116840 - protein, 14 aa, Borrelia garinii PBi
KENFKKALNKTIDA

SEQ ID NO: 116841 - protein, 14 aa, Borrelia garinii PBi
ENFKKALNKTIDAY

SEQ ID NO: 116842 - protein, 14 aa, Borrelia garinii PBi
NFKKALNKTIDAYN

SEQ ID NO: 116843 - protein, 14 aa, Borrelia garinii PBi
FKKALNKTIDAYNQ

SEQ ID NO: 116844 - protein, 14 aa, Borrelia garinii PBi
KKALNKTIDAYNQD

SEQ ID NO: 116845 - protein, 14 aa, Borrelia garinii PBi
KALNKTIDAYNQDS

SEQ ID NO: 116846 - protein, 14 aa, Borrelia garinii PBi
ALNKTIDAYNQDSE

SEQ ID NO: 116847 - protein, 14 aa, Borrelia garinii PBi
LNKTIDAYNQDSEN

SEQ ID NO: 116848 - protein, 14 aa, Borrelia garinii PBi
NKTIDAYNQDSENI

SEQ ID NO: 116849 - protein, 14 aa, Borrelia garinii PBi
KTIDAYNQDSENIK

SEQ ID NO: 116850 - protein, 14 aa, Borrelia garinii PBi
TIDAYNQDSENIKT

SEQ ID NO: 116851 - protein, 14 aa, Borrelia garinii PBi
IDAYNQDSENIKTS

SEQ ID NO: 116852 - protein, 14 aa, Borrelia garinii PBi
DAYNQDSENIKTSA

SEQ ID NO: 116853 - protein, 14 aa, Borrelia garinii PBi
AYNQDSENIKTSAE

SEQ ID NO: 116854 - protein, 14 aa, Borrelia garinii PBi
YNQDSENIKTSAEQ

SEQ ID NO: 116855 - protein, 14 aa, Borrelia garinii PBi
NQDSENIKTSAEQL

SEQ ID NO: 116856 - protein, 14 aa, Borrelia garinii PBi
QDSENIKTSAEQLE

SEQ ID NO: 116857 - protein, 14 aa, Borrelia garinii PBi
DSENIKTSAEQLEK

SEQ ID NO: 116858 - protein, 14 aa, Borrelia garinii PBi
SENIKTSAEQLEKH

SEQ ID NO: 116859 - protein, 14 aa, Borrelia garinii PBi
ENIKTSAEQLEKHI

SEQ ID NO: 116860 - protein, 14 aa, Borrelia garinii PBi
NIKTSAEQLEKHIN

SEQ ID NO: 116861 - protein, 14 aa, Borrelia garinii PBi
IKTSAEQLEKHINE

SEQ ID NO: 116862 - protein, 14 aa, Borrelia garinii PBi
KTSAEQLEKHINEN

SEQ ID NO: 116863 - protein, 14 aa, Borrelia garinii PBi
TSAEQLEKHINENY

SEQ ID NO: 116864 - protein, 14 aa, Borrelia garinii PBi
SAEQLEKHINENYK

SEQ ID NO: 116865 - protein, 14 aa, Borrelia garinii PBi
AEQLEKHINENYKE

SEQ ID NO: 116866 - protein, 14 aa, Borrelia garinii PBi
EQLEKHINENYKEF

SEQ ID NO: 116867 - protein, 14 aa, Borrelia garinii PBi
QLEKHINENYKEFN

SEQ ID NO: 116868 - protein, 14 aa, Borrelia garinii PBi
LEKHINENYKEFNS

SEQ ID NO: 116869 - protein, 14 aa, Borrelia garinii PBi
EKHINENYKEFNSL

SEQ ID NO: 116870 - protein, 14 aa, Borrelia garinii PBi
KHINENYKEFNSLK

SEQ ID NO: 116871 - protein, 14 aa, Borrelia garinii PBi
HINENYKEFNSLKP

SEQ ID NO: 116872 - protein, 14 aa, Borrelia garinii PBi
INENYKEFNSLKPI

SEQ ID NO: 116873 - protein, 14 aa, Borrelia garinii PBi
NENYKEFNSLKPIY

SEQ ID NO: 116874 - protein, 15 aa, Borrelia garinii PBi
MKKTKLNIIKLNILT

SEQ ID NO: 116875 - protein, 15 aa, Borrelia garinii PBi
KKTKLNIIKLNILTT

SEQ ID NO: 116876 - protein, 15 aa, Borrelia garinii PBi
KTKLNIIKLNILTTT

SEQ ID NO: 116877 - protein, 15 aa, Borrelia garinii PBi
TKLNIIKLNILTTTL

SEQ ID NO: 116878 - protein, 15 aa, Borrelia garinii PBi
KLNIIKLNILTTTLT

SEQ ID NO: 116879 - protein, 15 aa, Borrelia garinii PBi
LNIIKLNILTTTLTL

SEQ ID NO: 116880 - protein, 15 aa, Borrelia garinii PBi
NIIKLNILTTTLTLI

SEQ ID NO: 116881 - protein, 15 aa, Borrelia garinii PBi
IIKLNILTTTLTLIC

SEQ ID NO: 116882 - protein, 15 aa, Borrelia garinii PBi
IKLNILTTTLTLICI

SEQ ID NO: 116883 - protein, 15 aa, Borrelia garinii PBi
KLNILTTTLTLICIS

SEQ ID NO: 116884 - protein, 15 aa, Borrelia garinii PBi
LNILTTTLTLICISC

SEQ ID NO: 116885 - protein, 15 aa, Borrelia garinii PBi
NILTTTLTLICISCA

SEQ ID NO: 116886 - protein, 15 aa, Borrelia garinii PBi
ILTTTLTLICISCAV

SEQ ID NO: 116887 - protein, 15 aa, Borrelia garinii PBi
LTTTLTLICISCAVN

SEQ ID NO: 116888 - protein, 15 aa, Borrelia garinii PBi
TTTLTLICISCAVNK

SEQ ID NO: 116889 - protein, 15 aa, Borrelia garinii PBi
TTLTLICISCAVNKI

SEQ ID NO: 116890 - protein, 15 aa, Borrelia garinii PBi
TLTLICISCAVNKID

SEQ ID NO: 116891 - protein, 15 aa, Borrelia garinii PBi
LTLICISCAVNKIDP

SEQ ID NO: 116892 - protein, 15 aa, Borrelia garinii PBi
TLICISCAVNKIDPE

SEQ ID NO: 116893 - protein, 15 aa, Borrelia garinii PBi
LICISCAVNKIDPEP

SEQ ID NO: 116894 - protein, 15 aa, Borrelia garinii PBi
ICISCAVNKIDPEPK

SEQ ID NO: 116895 - protein, 15 aa, Borrelia garinii PBi
CISCAVNKIDPEPKS

SEQ ID NO: 116896 - protein, 15 aa, Borrelia garinii PBi
ISCAVNKIDPEPKSK

SEQ ID NO: 116897 - protein, 15 aa, Borrelia garinii PBi
SCAVNKIDPEPKSKT

SEQ ID NO: 116898 - protein, 15 aa, Borrelia garinii PBi
CAVNKIDPEPKSKTN

SEQ ID NO: 116899 - protein, 15 aa, Borrelia garinii PBi
AVNKIDPEPKSKTNK

SEQ ID NO: 116900 - protein, 15 aa, Borrelia garinii PBi
VNKIDPEPKSKTNKK

SEQ ID NO: 116901 - protein, 15 aa, Borrelia garinii PBi
NKIDPEPKSKTNKKE

SEQ ID NO: 116902 - protein, 15 aa, Borrelia garinii PBi
KIDPEPKSKTNKKEN

SEQ ID NO: 116903 - protein, 15 aa, Borrelia garinii PBi
IDPEPKSKTNKKENI

SEQ ID NO: 116904 - protein, 15 aa, Borrelia garinii PBi
DPEPKSKTNKKENIK

SEQ ID NO: 116905 - protein, 15 aa, Borrelia garinii PBi
PEPKSKTNKKENIKN

SEQ ID NO: 116906 - protein, 15 aa, Borrelia garinii PBi
EPKSKTNKKENIKNF

SEQ ID NO: 116907 - protein, 15 aa, Borrelia garinii PBi
PKSKTNKKENIKNFV

SEQ ID NO: 116908 - protein, 15 aa, Borrelia garinii PBi
KSKTNKKENIKNFVN

SEQ ID NO: 116909 - protein, 15 aa, Borrelia garinii PBi
SKTNKKENIKNFVNK

SEQ ID NO: 116910 - protein, 15 aa, Borrelia garinii PBi
KTNKKENIKNFVNKF

SEQ ID NO: 116911 - protein, 15 aa, Borrelia garinii PBi
TNKKENIKNFVNKFQ

SEQ ID NO: 116912 - protein, 15 aa, Borrelia garinii PBi
NKKENIKNFVNKFQD

SEQ ID NO: 116913 - protein, 15 aa, Borrelia garinii PBi
KKENIKNFVNKFQDL

SEQ ID NO: 116914 - protein, 15 aa, Borrelia garinii PBi
KENIKNFVNKFQDLE

SEQ ID NO: 116915 - protein, 15 aa, Borrelia garinii PBi
ENIKNFVNKFQDLEP

SEQ ID NO: 116916 - protein, 15 aa, Borrelia garinii PBi
NIKNFVNKFQDLEPS

SEQ ID NO: 116917 - protein, 15 aa, Borrelia garinii PBi
IKNFVNKFQDLEPSK

SEQ ID NO: 116918 - protein, 15 aa, Borrelia garinii PBi
KNFVNKFQDLEPSKK

SEQ ID NO: 116919 - protein, 15 aa, Borrelia garinii PBi
NFVNKFQDLEPSKKQ

SEQ ID NO: 116920 - protein, 15 aa, Borrelia garinii PBi
FVNKFQDLEPSKKQN

SEQ ID NO: 116921 - protein, 15 aa, Borrelia garinii PBi
VNKFQDLEPSKKQNK

SEQ ID NO: 116922 - protein, 15 aa, Borrelia garinii PBi
NKFQDLEPSKKQNKD

SEQ ID NO: 116923 - protein, 15 aa, Borrelia garinii PBi
KFQDLEPSKKQNKDL

SEQ ID NO: 116924 - protein, 15 aa, Borrelia garinii PBi
FQDLEPSKKQNKDLE

SEQ ID NO: 116925 - protein, 15 aa, Borrelia garinii PBi
QDLEPSKKQNKDLEP

SEQ ID NO: 116926 - protein, 15 aa, Borrelia garinii PBi
DLEPSKKQNKDLEPL

SEQ ID NO: 116927 - protein, 15 aa, Borrelia garinii PBi
LEPSKKQNKDLEPLR

SEQ ID NO: 116928 - protein, 15 aa, Borrelia garinii PBi
EPSKKQNKDLEPLRE

SEQ ID NO: 116929 - protein, 15 aa, Borrelia garinii PBi
PSKKQNKDLEPLREK

SEQ ID NO: 116930 - protein, 15 aa, Borrelia garinii PBi
SKKQNKDLEPLREKY

SEQ ID NO: 116931 - protein, 15 aa, Borrelia garinii PBi
KKQNKDLEPLREKYP

SEQ ID NO: 116932 - protein, 15 aa, Borrelia garinii PBi
KQNKDLEPLREKYPE

SEQ ID NO: 116933 - protein, 15 aa, Borrelia garinii PBi
QNKDLEPLREKYPEA

SEQ ID NO: 116934 - protein, 15 aa, Borrelia garinii PBi
NKDLEPLREKYPEAT

SEQ ID NO: 116935 - protein, 15 aa, Borrelia garinii PBi
KDLEPLREKYPEATA

SEQ ID NO: 116936 - protein, 15 aa, Borrelia garinii PBi
DLEPLREKYPEATAS

SEQ ID NO: 116937 - protein, 15 aa, Borrelia garinii PBi
LEPLREKYPEATASK

SEQ ID NO: 116938 - protein, 15 aa, Borrelia garinii PBi
EPLREKYPEATASKL

SEQ ID NO: 116939 - protein, 15 aa, Borrelia garinii PBi
PLREKYPEATASKLE

SEQ ID NO: 116940 - protein, 15 aa, Borrelia garinii PBi
LREKYPEATASKLET

SEQ ID NO: 116941 - protein, 15 aa, Borrelia garinii PBi
REKYPEATASKLETT

SEQ ID NO: 116942 - protein, 15 aa, Borrelia garinii PBi
EKYPEATASKLETTL

SEQ ID NO: 116943 - protein, 15 aa, Borrelia garinii PBi
KYPEATASKLETTLK

SEQ ID NO: 116944 - protein, 15 aa, Borrelia garinii PBi
YPEATASKLETTLKI

SEQ ID NO: 116945 - protein, 15 aa, Borrelia garinii PBi
PEATASKLETTLKIL

SEQ ID NO: 116946 - protein, 15 aa, Borrelia garinii PBi
EATASKLETTLKILE

SEQ ID NO: 116947 - protein, 15 aa, Borrelia garinii PBi
ATASKLETTLKILEA

SEQ ID NO: 116948 - protein, 15 aa, Borrelia garinii PBi
TASKLETTLKILEAQ

SEQ ID NO: 116949 - protein, 15 aa, Borrelia garinii PBi
ASKLETTLKILEAQK

SEQ ID NO: 116950 - protein, 15 aa, Borrelia garinii PBi
SKLETTLKILEAQKE

SEQ ID NO: 116951 - protein, 15 aa, Borrelia garinii PBi
KLETTLKILEAQKEK

SEQ ID NO: 116952 - protein, 15 aa, Borrelia garinii PBi
LETTLKILEAQKEKE

SEQ ID NO: 116953 - protein, 15 aa, Borrelia garinii PBi
ETTLKILEAQKEKEN

SEQ ID NO: 116954 - protein, 15 aa, Borrelia garinii PBi
TTLKILEAQKEKENI

SEQ ID NO: 116955 - protein, 15 aa, Borrelia garinii PBi
TLKILEAQKEKENIE

SEQ ID NO: 116956 - protein, 15 aa, Borrelia garinii PBi
LKILEAQKEKENIEI

SEQ ID NO: 116957 - protein, 15 aa, Borrelia garinii PBi
KILEAQKEKENIEIA

SEQ ID NO: 116958 - protein, 15 aa, Borrelia garinii PBi
ILEAQKEKENIEIAK

SEQ ID NO: 116959 - protein, 15 aa, Borrelia garinii PBi
LEAQKEKENIEIAKI

SEQ ID NO: 116960 - protein, 15 aa, Borrelia garinii PBi
EAQKEKENIEIAKID

SEQ ID NO: 116961 - protein, 15 aa, Borrelia garinii PBi
AQKEKENIEIAKIDN

SEQ ID NO: 116962 - protein, 15 aa, Borrelia garinii PBi
QKEKENIEIAKIDNT

SEQ ID NO: 116963 - protein, 15 aa, Borrelia garinii PBi
KEKENIEIAKIDNTQ

SEQ ID NO: 116964 - protein, 15 aa, Borrelia garinii PBi
EKENIEIAKIDNTQI

SEQ ID NO: 116965 - protein, 15 aa, Borrelia garinii PBi
KENIEIAKIDNTQID

SEQ ID NO: 116966 - protein, 15 aa, Borrelia garinii PBi
ENIEIAKIDNTQIDF

SEQ ID NO: 116967 - protein, 15 aa, Borrelia garinii PBi
NIEIAKIDNTQIDFL

SEQ ID NO: 116968 - protein, 15 aa, Borrelia garinii PBi
IEIAKIDNTQIDFLK

SEQ ID NO: 116969 - protein, 15 aa, Borrelia garinii PBi
EIAKIDNTQIDFLKT

SEQ ID NO: 116970 - protein, 15 aa, Borrelia garinii PBi
IAKIDNTQIDFLKTF

SEQ ID NO: 116971 - protein, 15 aa, Borrelia garinii PBi
AKIDNTQIDFLKTFK

SEQ ID NO: 116972 - protein, 15 aa, Borrelia garinii PBi
KIDNTQIDFLKTFKT

SEQ ID NO: 116973 - protein, 15 aa, Borrelia garinii PBi
IDNTQIDFLKTFKTD

SEQ ID NO: 116974 - protein, 15 aa, Borrelia garinii PBi
DNTQIDFLKTFKTDP

SEQ ID NO: 116975 - protein, 15 aa, Borrelia garinii PBi
NTQIDFLKTFKTDPH

SEQ ID NO: 116976 - protein, 15 aa, Borrelia garinii PBi
TQIDFLKTFKTDPHD

SEQ ID NO: 116977 - protein, 15 aa, Borrelia garinii PBi
QIDFLKTFKTDPHDS

SEQ ID NO: 116978 - protein, 15 aa, Borrelia garinii PBi
IDFLKTFKTDPHDSL

SEQ ID NO: 116979 - protein, 15 aa, Borrelia garinii PBi
DFLKTFKTDPHDSLP

SEQ ID NO: 116980 - protein, 15 aa, Borrelia garinii PBi
FLKTFKTDPHDSLPE

SEQ ID NO: 116981 - protein, 15 aa, Borrelia garinii PBi
LKTFKTDPHDSLPED

SEQ ID NO: 116982 - protein, 15 aa, Borrelia garinii PBi
KTFKTDPHDSLPEDE

SEQ ID NO: 116983 - protein, 15 aa, Borrelia garinii PBi
TFKTDPHDSLPEDEK

SEQ ID NO: 116984 - protein, 15 aa, Borrelia garinii PBi
FKTDPHDSLPEDEKM

SEQ ID NO: 116985 - protein, 15 aa, Borrelia garinii PBi
KTDPHDSLPEDEKMQ

SEQ ID NO: 116986 - protein, 15 aa, Borrelia garinii PBi
TDPHDSLPEDEKMQM

SEQ ID NO: 116987 - protein, 15 aa, Borrelia garinii PBi
DPHDSLPEDEKMQMK

SEQ ID NO: 116988 - protein, 15 aa, Borrelia garinii PBi
PHDSLPEDEKMQMKK

SEQ ID NO: 116989 - protein, 15 aa, Borrelia garinii PBi
HDSLPEDEKMQMKKI

SEQ ID NO: 116990 - protein, 15 aa, Borrelia garinii PBi
DSLPEDEKMQMKKII

SEQ ID NO: 116991 - protein, 15 aa, Borrelia garinii PBi
SLPEDEKMQMKKIIY

SEQ ID NO: 116992 - protein, 15 aa, Borrelia garinii PBi
LPEDEKMQMKKIIYS

SEQ ID NO: 116993 - protein, 15 aa, Borrelia garinii PBi
PEDEKMQMKKIIYSS

SEQ ID NO: 116994 - protein, 15 aa, Borrelia garinii PBi
EDEKMQMKKIIYSSL

SEQ ID NO: 116995 - protein, 15 aa, Borrelia garinii PBi
DEKMQMKKIIYSSLN

SEQ ID NO: 116996 - protein, 15 aa, Borrelia garinii PBi
EKMQMKKIIYSSLNY

SEQ ID NO: 116997 - protein, 15 aa, Borrelia garinii PBi
KMQMKKIIYSSLNYE

SEQ ID NO: 116998 - protein, 15 aa, Borrelia garinii PBi
MQMKKIIYSSLNYET

SEQ ID NO: 116999 - protein, 15 aa, Borrelia garinii PBi
QMKKIIYSSLNYETE

SEQ ID NO: 117000 - protein, 15 aa, Borrelia garinii PBi
MKKIIYSSLNYETEK

SEQ ID NO: 117001 - protein, 15 aa, Borrelia garinii PBi
KKIIYSSLNYETEKI

SEQ ID NO: 117002 - protein, 15 aa, Borrelia garinii PBi
KIIYSSLNYETEKIK

SEQ ID NO: 117003 - protein, 15 aa, Borrelia garinii PBi
IIYSSLNYETEKIKI

SEQ ID NO: 117004 - protein, 15 aa, Borrelia garinii PBi
IYSSLNYETEKIKIL

SEQ ID NO: 117005 - protein, 15 aa, Borrelia garinii PBi
YSSLNYETEKIKILQ

SEQ ID NO: 117006 - protein, 15 aa, Borrelia garinii PBi
SSLNYETEKIKILQE

SEQ ID NO: 117007 - protein, 15 aa, Borrelia garinii PBi
SLNYETEKIKILQEI

SEQ ID NO: 117008 - protein, 15 aa, Borrelia garinii PBi
LNYETEKIKILQEIL

SEQ ID NO: 117009 - protein, 15 aa, Borrelia garinii PBi
NYETEKIKILQEILE

SEQ ID NO: 117010 - protein, 15 aa, Borrelia garinii PBi
YETEKIKILQEILEK

SEQ ID NO: 117011 - protein, 15 aa, Borrelia garinii PBi
ETEKIKILQEILEKL

SEQ ID NO: 117012 - protein, 15 aa, Borrelia garinii PBi
TEKIKILQEILEKLD

SEQ ID NO: 117013 - protein, 15 aa, Borrelia garinii PBi
EKIKILQEILEKLDK

SEQ ID NO: 117014 - protein, 15 aa, Borrelia garinii PBi
KIKILQEILEKLDKN

SEQ ID NO: 117015 - protein, 15 aa, Borrelia garinii PBi
IKILQEILEKLDKNL

SEQ ID NO: 117016 - protein, 15 aa, Borrelia garinii PBi
KILQEILEKLDKNLQ

SEQ ID NO: 117017 - protein, 15 aa, Borrelia garinii PBi
ILQEILEKLDKNLQH

SEQ ID NO: 117018 - protein, 15 aa, Borrelia garinii PBi
LQEILEKLDKNLQHK

SEQ ID NO: 117019 - protein, 15 aa, Borrelia garinii PBi
QEILEKLDKNLQHKK

SEQ ID NO: 117020 - protein, 15 aa, Borrelia garinii PBi
EILEKLDKNLQHKKI

SEQ ID NO: 117021 - protein, 15 aa, Borrelia garinii PBi
ILEKLDKNLQHKKIA

SEQ ID NO: 117022 - protein, 15 aa, Borrelia garinii PBi
LEKLDKNLQHKKIAK

SEQ ID NO: 117023 - protein, 15 aa, Borrelia garinii PBi
EKLDKNLQHKKIAKN

SEQ ID NO: 117024 - protein, 15 aa, Borrelia garinii PBi
KLDKNLQHKKIAKNF

SEQ ID NO: 117025 - protein, 15 aa, Borrelia garinii PBi
LDKNLQHKKIAKNFI

SEQ ID NO: 117026 - protein, 15 aa, Borrelia garinii PBi
DKNLQHKKIAKNFIY

SEQ ID NO: 117027 - protein, 15 aa, Borrelia garinii PBi
KNLQHKKIAKNFIYD

SEQ ID NO: 117028 - protein, 15 aa, Borrelia garinii PBi
NLQHKKIAKNFIYDI

SEQ ID NO: 117029 - protein, 15 aa, Borrelia garinii PBi
LQHKKIAKNFIYDIP

SEQ ID NO: 117030 - protein, 15 aa, Borrelia garinii PBi
QHKKIAKNFIYDIPI

SEQ ID NO: 117031 - protein, 15 aa, Borrelia garinii PBi
HKKIAKNFIYDIPII

SEQ ID NO: 117032 - protein, 15 aa, Borrelia garinii PBi
KKIAKNFIYDIPIII

SEQ ID NO: 117033 - protein, 15 aa, Borrelia garinii PBi
KIAKNFIYDIPIIIQ

SEQ ID NO: 117034 - protein, 15 aa, Borrelia garinii PBi
IAKNFIYDIPIIIQS

SEQ ID NO: 117035 - protein, 15 aa, Borrelia garinii PBi
AKNFIYDIPIIIQSR

SEQ ID NO: 117036 - protein, 15 aa, Borrelia garinii PBi
KNFIYDIPIIIQSRL

SEQ ID NO: 117037 - protein, 15 aa, Borrelia garinii PBi
NFIYDIPIIIQSRLD

SEQ ID NO: 117038 - protein, 15 aa, Borrelia garinii PBi
FIYDIPIIIQSRLDI

SEQ ID NO: 117039 - protein, 15 aa, Borrelia garinii PBi
IYDIPIIIQSRLDII

SEQ ID NO: 117040 - protein, 15 aa, Borrelia garinii PBi
YDIPIIIQSRLDIIS

SEQ ID NO: 117041 - protein, 15 aa, Borrelia garinii PBi
DIPIIIQSRLDIISK

SEQ ID NO: 117042 - protein, 15 aa, Borrelia garinii PBi
IPIIIQSRLDIISKV

SEQ ID NO: 117043 - protein, 15 aa, Borrelia garinii PBi
PIIIQSRLDIISKVI

SEQ ID NO: 117044 - protein, 15 aa, Borrelia garinii PBi
IIIQSRLDIISKVIK

SEQ ID NO: 117045 - protein, 15 aa, Borrelia garinii PBi
IIQSRLDIISKVIKN

SEQ ID NO: 117046 - protein, 15 aa, Borrelia garinii PBi
IQSRLDIISKVIKNP

SEQ ID NO: 117047 - protein, 15 aa, Borrelia garinii PBi
QSRLDIISKVIKNPI

SEQ ID NO: 117048 - protein, 15 aa, Borrelia garinii PBi
SRLDIISKVIKNPIK

SEQ ID NO: 117049 - protein, 15 aa, Borrelia garinii PBi
RLDIISKVIKNPIKD

SEQ ID NO: 117050 - protein, 15 aa, Borrelia garinii PBi
LDIISKVIKNPIKDE

SEQ ID NO: 117051 - protein, 15 aa, Borrelia garinii PBi
DIISKVIKNPIKDEL

SEQ ID NO: 117052 - protein, 15 aa, Borrelia garinii PBi
IISKVIKNPIKDELQ

SEQ ID NO: 117053 - protein, 15 aa, Borrelia garinii PBi
ISKVIKNPIKDELQI

SEQ ID NO: 117054 - protein, 15 aa, Borrelia garinii PBi
SKVIKNPIKDELQIL

SEQ ID NO: 117055 - protein, 15 aa, Borrelia garinii PBi
KVIKNPIKDELQILN

SEQ ID NO: 117056 - protein, 15 aa, Borrelia garinii PBi
VIKNPIKDELQILNQ

SEQ ID NO: 117057 - protein, 15 aa, Borrelia garinii PBi
IKNPIKDELQILNQK

SEQ ID NO: 117058 - protein, 15 aa, Borrelia garinii PBi
KNPIKDELQILNQKE

SEQ ID NO: 117059 - protein, 15 aa, Borrelia garinii PBi
NPIKDELQILNQKEI

SEQ ID NO: 117060 - protein, 15 aa, Borrelia garinii PBi
PIKDELQILNQKEIE

SEQ ID NO: 117061 - protein, 15 aa, Borrelia garinii PBi
IKDELQILNQKEIEE

SEQ ID NO: 117062 - protein, 15 aa, Borrelia garinii PBi
KDELQILNQKEIEEL

SEQ ID NO: 117063 - protein, 15 aa, Borrelia garinii PBi
DELQILNQKEIEELL

SEQ ID NO: 117064 - protein, 15 aa, Borrelia garinii PBi
ELQILNQKEIEELLM

SEQ ID NO: 117065 - protein, 15 aa, Borrelia garinii PBi
LQILNQKEIEELLMR

SEQ ID NO: 117066 - protein, 15 aa, Borrelia garinii PBi
QILNQKEIEELLMRI

SEQ ID NO: 117067 - protein, 15 aa, Borrelia garinii PBi
ILNQKEIEELLMRIE

SEQ ID NO: 117068 - protein, 15 aa, Borrelia garinii PBi
LNQKEIEELLMRIES

SEQ ID NO: 117069 - protein, 15 aa, Borrelia garinii PBi
NQKEIEELLMRIESE

SEQ ID NO: 117070 - protein, 15 aa, Borrelia garinii PBi
QKEIEELLMRIESEL

SEQ ID NO: 117071 - protein, 15 aa, Borrelia garinii PBi
KEIEELLMRIESELK

SEQ ID NO: 117072 - protein, 15 aa, Borrelia garinii PBi
EIEELLMRIESELKI

SEQ ID NO: 117073 - protein, 15 aa, Borrelia garinii PBi
IEELLMRIESELKIK

SEQ ID NO: 117074 - protein, 15 aa, Borrelia garinii PBi
EELLMRIESELKIKE

SEQ ID NO: 117075 - protein, 15 aa, Borrelia garinii PBi
ELLMRIESELKIKEN

SEQ ID NO: 117076 - protein, 15 aa, Borrelia garinii PBi
LLMRIESELKIKENF

SEQ ID NO: 117077 - protein, 15 aa, Borrelia garinii PBi
LMRIESELKIKENFK

SEQ ID NO: 117078 - protein, 15 aa, Borrelia garinii PBi
MRIESELKIKENFKK

SEQ ID NO: 117079 - protein, 15 aa, Borrelia garinii PBi
RIESELKIKENFKKA

SEQ ID NO: 117080 - protein, 15 aa, Borrelia garinii PBi
IESELKIKENFKKAL

SEQ ID NO: 117081 - protein, 15 aa, Borrelia garinii PBi
ESELKIKENFKKALN

SEQ ID NO: 117082 - protein, 15 aa, Borrelia garinii PBi
SELKIKENFKKALNK

SEQ ID NO: 117083 - protein, 15 aa, Borrelia garinii PBi
ELKIKENFKKALNKT

SEQ ID NO: 117084 - protein, 15 aa, Borrelia garinii PBi
LKIKENFKKALNKTI

SEQ ID NO: 117085 - protein, 15 aa, Borrelia garinii PBi
KIKENFKKALNKTID

SEQ ID NO: 117086 - protein, 15 aa, Borrelia garinii PBi
IKENFKKALNKTIDA

SEQ ID NO: 117087 - protein, 15 aa, Borrelia garinii PBi
KENFKKALNKTIDAY

SEQ ID NO: 117088 - protein, 15 aa, Borrelia garinii PBi
ENFKKALNKTIDAYN

SEQ ID NO: 117089 - protein, 15 aa, Borrelia garinii PBi
NFKKALNKTIDAYNQ

SEQ ID NO: 117090 - protein, 15 aa, Borrelia garinii PBi
FKKALNKTIDAYNQD

SEQ ID NO: 117091 - protein, 15 aa, Borrelia garinii PBi
KKALNKTIDAYNQDS

SEQ ID NO: 117092 - protein, 15 aa, Borrelia garinii PBi
KALNKTIDAYNQDSE

SEQ ID NO: 117093 - protein, 15 aa, Borrelia garinii PBi
ALNKTIDAYNQDSEN

SEQ ID NO: 117094 - protein, 15 aa, Borrelia garinii PBi
LNKTIDAYNQDSENI

SEQ ID NO: 117095 - protein, 15 aa, Borrelia garinii PBi
NKTIDAYNQDSENIK

SEQ ID NO: 117096 - protein, 15 aa, Borrelia garinii PBi
KTIDAYNQDSENIKT

SEQ ID NO: 117097 - protein, 15 aa, Borrelia garinii PBi
TIDAYNQDSENIKTS

SEQ ID NO: 117098 - protein, 15 aa, Borrelia garinii PBi
IDAYNQDSENIKTSA

SEQ ID NO: 117099 - protein, 15 aa, Borrelia garinii PBi
DAYNQDSENIKTSAE

SEQ ID NO: 117100 - protein, 15 aa, Borrelia garinii PBi
AYNQDSENIKTSAEQ

SEQ ID NO: 117101 - protein, 15 aa, Borrelia garinii PBi
YNQDSENIKTSAEQL

SEQ ID NO: 117102 - protein, 15 aa, Borrelia garinii PBi
NQDSENIKTSAEQLE

SEQ ID NO: 117103 - protein, 15 aa, Borrelia garinii PBi
QDSENIKTSAEQLEK

SEQ ID NO: 117104 - protein, 15 aa, Borrelia garinii PBi
DSENIKTSAEQLEKH

SEQ ID NO: 117105 - protein, 15 aa, Borrelia garinii PBi
SENIKTSAEQLEKHI

SEQ ID NO: 117106 - protein, 15 aa, Borrelia garinii PBi
ENIKTSAEQLEKHIN

SEQ ID NO: 117107 - protein, 15 aa, Borrelia garinii PBi
NIKTSAEQLEKHINE

SEQ ID NO: 117108 - protein, 15 aa, Borrelia garinii PBi
IKTSAEQLEKHINEN

SEQ ID NO: 117109 - protein, 15 aa, Borrelia garinii PBi
KTSAEQLEKHINENY

SEQ ID NO: 117110 - protein, 15 aa, Borrelia garinii PBi
TSAEQLEKHINENYK

SEQ ID NO: 117111 - protein, 15 aa, Borrelia garinii PBi
SAEQLEKHINENYKE

SEQ ID NO: 117112 - protein, 15 aa, Borrelia garinii PBi
AEQLEKHINENYKEF

SEQ ID NO: 117113 - protein, 15 aa, Borrelia garinii PBi
EQLEKHINENYKEFN

SEQ ID NO: 117114 - protein, 15 aa, Borrelia garinii PBi
QLEKHINENYKEFNS

SEQ ID NO: 117115 - protein, 15 aa, Borrelia garinii PBi
LEKHINENYKEFNSL

SEQ ID NO: 117116 - protein, 15 aa, Borrelia garinii PBi
EKHINENYKEFNSLK

SEQ ID NO: 117117 - protein, 15 aa, Borrelia garinii PBi
KHINENYKEFNSLKP

SEQ ID NO: 117118 - protein, 15 aa, Borrelia garinii PBi
HINENYKEFNSLKPI

SEQ ID NO: 117119 - protein, 15 aa, Borrelia garinii PBi
INENYKEFNSLKPIY

SEQ ID NO: 117120 - protein, 16 aa, Borrelia garinii PBi
MKKTKLNIIKLNILTT

SEQ ID NO: 117121 - protein, 16 aa, Borrelia garinii PBi
KKTKLNIIKLNILTTT

SEQ ID NO: 117122 - protein, 16 aa, Borrelia garinii PBi
KTKLNIIKLNILTTTL

SEQ ID NO: 117123 - protein, 16 aa, Borrelia garinii PBi
TKLNIIKLNILTTTLT

SEQ ID NO: 117124 - protein, 16 aa, Borrelia garinii PBi
KLNIIKLNILTTTLTL

SEQ ID NO: 117125 - protein, 16 aa, Borrelia garinii PBi
LNIIKLNILTTTLTLI

SEQ ID NO: 117126 - protein, 16 aa, Borrelia garinii PBi
NIIKLNILTTTLTLIC

SEQ ID NO: 117127 - protein, 16 aa, Borrelia garinii PBi
IIKLNILTTTLTLICI

SEQ ID NO: 117128 - protein, 16 aa, Borrelia garinii PBi
IKLNILTTTLTLICIS

SEQ ID NO: 117129 - protein, 16 aa, Borrelia garinii PBi
KLNILTTTLTLICISC

SEQ ID NO: 117130 - protein, 16 aa, Borrelia garinii PBi
LNILTTTLTLICISCA

SEQ ID NO: 117131 - protein, 16 aa, Borrelia garinii PBi
NILTTTLTLICISCAV

SEQ ID NO: 117132 - protein, 16 aa, Borrelia garinii PBi
ILTTTLTLICISCAVN

SEQ ID NO: 117133 - protein, 16 aa, Borrelia garinii PBi
LTTTLTLICISCAVNK

SEQ ID NO: 117134 - protein, 16 aa, Borrelia garinii PBi
TTTLTLICISCAVNKI

SEQ ID NO: 117135 - protein, 16 aa, Borrelia garinii PBi
TTLTLICISCAVNKID

SEQ ID NO: 117136 - protein, 16 aa, Borrelia garinii PBi
TLTLICISCAVNKIDP

SEQ ID NO: 117137 - protein, 16 aa, Borrelia garinii PBi
LTLICISCAVNKIDPE

SEQ ID NO: 117138 - protein, 16 aa, Borrelia garinii PBi
TLICISCAVNKIDPEP

SEQ ID NO: 117139 - protein, 16 aa, Borrelia garinii PBi
LICISCAVNKIDPEPK

SEQ ID NO: 117140 - protein, 16 aa, Borrelia garinii PBi
ICISCAVNKIDPEPKS

SEQ ID NO: 117141 - protein, 16 aa, Borrelia garinii PBi
CISCAVNKIDPEPKSK

SEQ ID NO: 117142 - protein, 16 aa, Borrelia garinii PBi
ISCAVNKIDPEPKSKT

SEQ ID NO: 117143 - protein, 16 aa, Borrelia garinii PBi
SCAVNKIDPEPKSKTN

SEQ ID NO: 117144 - protein, 16 aa, Borrelia garinii PBi
CAVNKIDPEPKSKTNK

SEQ ID NO: 117145 - protein, 16 aa, Borrelia garinii PBi
AVNKIDPEPKSKTNKK

SEQ ID NO: 117146 - protein, 16 aa, Borrelia garinii PBi
VNKIDPEPKSKTNKKE

SEQ ID NO: 117147 - protein, 16 aa, Borrelia garinii PBi
NKIDPEPKSKTNKKEN

SEQ ID NO: 117148 - protein, 16 aa, Borrelia garinii PBi
KIDPEPKSKTNKKENI

SEQ ID NO: 117149 - protein, 16 aa, Borrelia garinii PBi
IDPEPKSKTNKKENIK

SEQ ID NO: 117150 - protein, 16 aa, Borrelia garinii PBi
DPEPKSKTNKKENIKN

SEQ ID NO: 117151 - protein, 16 aa, Borrelia garinii PBi
PEPKSKTNKKENIKNF

SEQ ID NO: 117152 - protein, 16 aa, Borrelia garinii PBi
EPKSKTNKKENIKNFV

SEQ ID NO: 117153 - protein, 16 aa, Borrelia garinii PBi
PKSKTNKKENIKNFVN

SEQ ID NO: 117154 - protein, 16 aa, Borrelia garinii PBi
KSKTNKKENIKNFVNK

SEQ ID NO: 117155 - protein, 16 aa, Borrelia garinii PBi
SKTNKKENIKNFVNKF

SEQ ID NO: 117156 - protein, 16 aa, Borrelia garinii PBi
KTNKKENIKNFVNKFQ

SEQ ID NO: 117157 - protein, 16 aa, Borrelia garinii PBi
TNKKENIKNFVNKFQD

SEQ ID NO: 117158 - protein, 16 aa, Borrelia garinii PBi
NKKENIKNFVNKFQDL

SEQ ID NO: 117159 - protein, 16 aa, Borrelia garinii PBi
KKENIKNFVNKFQDLE

SEQ ID NO: 117160 - protein, 16 aa, Borrelia garinii PBi
KENIKNFVNKFQDLEP

SEQ ID NO: 117161 - protein, 16 aa, Borrelia garinii PBi
ENIKNFVNKFQDLEPS

SEQ ID NO: 117162 - protein, 16 aa, Borrelia garinii PBi
NIKNFVNKFQDLEPSK

SEQ ID NO: 117163 - protein, 16 aa, Borrelia garinii PBi
IKNFVNKFQDLEPSKK

SEQ ID NO: 117164 - protein, 16 aa, Borrelia garinii PBi
KNFVNKFQDLEPSKKQ

SEQ ID NO: 117165 - protein, 16 aa, Borrelia garinii PBi
NFVNKFQDLEPSKKQN

SEQ ID NO: 117166 - protein, 16 aa, Borrelia garinii PBi
FVNKFQDLEPSKKQNK

SEQ ID NO: 117167 - protein, 16 aa, Borrelia garinii PBi
VNKFQDLEPSKKQNKD

SEQ ID NO: 117168 - protein, 16 aa, Borrelia garinii PBi
NKFQDLEPSKKQNKDL

SEQ ID NO: 117169 - protein, 16 aa, Borrelia garinii PBi
KFQDLEPSKKQNKDLE

SEQ ID NO: 117170 - protein, 16 aa, Borrelia garinii PBi
FQDLEPSKKQNKDLEP

SEQ ID NO: 117171 - protein, 16 aa, Borrelia garinii PBi
QDLEPSKKQNKDLEPL

SEQ ID NO: 117172 - protein, 16 aa, Borrelia garinii PBi
DLEPSKKQNKDLEPLR

SEQ ID NO: 117173 - protein, 16 aa, Borrelia garinii PBi
LEPSKKQNKDLEPLRE

SEQ ID NO: 117174 - protein, 16 aa, Borrelia garinii PBi
EPSKKQNKDLEPLREK

SEQ ID NO: 117175 - protein, 16 aa, Borrelia garinii PBi
PSKKQNKDLEPLREKY

SEQ ID NO: 117176 - protein, 16 aa, Borrelia garinii PBi
SKKQNKDLEPLREKYP

SEQ ID NO: 117177 - protein, 16 aa, Borrelia garinii PBi
KKQNKDLEPLREKYPE

SEQ ID NO: 117178 - protein, 16 aa, Borrelia garinii PBi
KQNKDLEPLREKYPEA

SEQ ID NO: 117179 - protein, 16 aa, Borrelia garinii PBi
QNKDLEPLREKYPEAT

SEQ ID NO: 117180 - protein, 16 aa, Borrelia garinii PBi
NKDLEPLREKYPEATA

SEQ ID NO: 117181 - protein, 16 aa, Borrelia garinii PBi
KDLEPLREKYPEATAS

SEQ ID NO: 117182 - protein, 16 aa, Borrelia garinii PBi
DLEPLREKYPEATASK

SEQ ID NO: 117183 - protein, 16 aa, Borrelia garinii PBi
LEPLREKYPEATASKL

SEQ ID NO: 117184 - protein, 16 aa, Borrelia garinii PBi
EPLREKYPEATASKLE

SEQ ID NO: 117185 - protein, 16 aa, Borrelia garinii PBi
PLREKYPEATASKLET

SEQ ID NO: 117186 - protein, 16 aa, Borrelia garinii PBi
LREKYPEATASKLETT

SEQ ID NO: 117187 - protein, 16 aa, Borrelia garinii PBi
REKYPEATASKLETTL

SEQ ID NO: 117188 - protein, 16 aa, Borrelia garinii PBi
EKYPEATASKLETTLK

SEQ ID NO: 117189 - protein, 16 aa, Borrelia garinii PBi
KYPEATASKLETTLKI

SEQ ID NO: 117190 - protein, 16 aa, Borrelia garinii PBi
YPEATASKLETTLKIL

SEQ ID NO: 117191 - protein, 16 aa, Borrelia garinii PBi
PEATASKLETTLKILE

SEQ ID NO: 117192 - protein, 16 aa, Borrelia garinii PBi
EATASKLETTLKILEA

SEQ ID NO: 117193 - protein, 16 aa, Borrelia garinii PBi
ATASKLETTLKILEAQ

SEQ ID NO: 117194 - protein, 16 aa, Borrelia garinii PBi
TASKLETTLKILEAQK

SEQ ID NO: 117195 - protein, 16 aa, Borrelia garinii PBi
ASKLETTLKILEAQKE

SEQ ID NO: 117196 - protein, 16 aa, Borrelia garinii PBi
SKLETTLKILEAQKEK

SEQ ID NO: 117197 - protein, 16 aa, Borrelia garinii PBi
KLETTLKILEAQKEKE

SEQ ID NO: 117198 - protein, 16 aa, Borrelia garinii PBi
LETTLKILEAQKEKEN

SEQ ID NO: 117199 - protein, 16 aa, Borrelia garinii PBi
ETTLKILEAQKEKENI

SEQ ID NO: 117200 - protein, 16 aa, Borrelia garinii PBi
TTLKILEAQKEKENIE

SEQ ID NO: 117201 - protein, 16 aa, Borrelia garinii PBi
TLKILEAQKEKENIEI

SEQ ID NO: 117202 - protein, 16 aa, Borrelia garinii PBi
LKILEAQKEKENIEIA

SEQ ID NO: 117203 - protein, 16 aa, Borrelia garinii PBi
KILEAQKEKENIEIAK

SEQ ID NO: 117204 - protein, 16 aa, Borrelia garinii PBi
ILEAQKEKENIEIAKI

SEQ ID NO: 117205 - protein, 16 aa, Borrelia garinii PBi
LEAQKEKENIEIAKID

SEQ ID NO: 117206 - protein, 16 aa, Borrelia garinii PBi
EAQKEKENIEIAKIDN

SEQ ID NO: 117207 - protein, 16 aa, Borrelia garinii PBi
AQKEKENIEIAKIDNT

SEQ ID NO: 117208 - protein, 16 aa, Borrelia garinii PBi
QKEKENIEIAKIDNTQ

SEQ ID NO: 117209 - protein, 16 aa, Borrelia garinii PBi
KEKENIEIAKIDNTQI

SEQ ID NO: 117210 - protein, 16 aa, Borrelia garinii PBi
EKENIEIAKIDNTQID

SEQ ID NO: 117211 - protein, 16 aa, Borrelia garinii PBi
KENIEIAKIDNTQIDF

SEQ ID NO: 117212 - protein, 16 aa, Borrelia garinii PBi
ENIEIAKIDNTQIDFL

SEQ ID NO: 117213 - protein, 16 aa, Borrelia garinii PBi
NIEIAKIDNTQIDFLK

SEQ ID NO: 117214 - protein, 16 aa, Borrelia garinii PBi
IEIAKIDNTQIDFLKT

SEQ ID NO: 117215 - protein, 16 aa, Borrelia garinii PBi
EIAKIDNTQIDFLKTF

SEQ ID NO: 117216 - protein, 16 aa, Borrelia garinii PBi
IAKIDNTQIDFLKTFK

SEQ ID NO: 117217 - protein, 16 aa, Borrelia garinii PBi
AKIDNTQIDFLKTFKT

SEQ ID NO: 117218 - protein, 16 aa, Borrelia garinii PBi
KIDNTQIDFLKTFKTD

SEQ ID NO: 117219 - protein, 16 aa, Borrelia garinii PBi
IDNTQIDFLKTFKTDP

SEQ ID NO: 117220 - protein, 16 aa, Borrelia garinii PBi
DNTQIDFLKTFKTDPH

SEQ ID NO: 117221 - protein, 16 aa, Borrelia garinii PBi
NTQIDFLKTFKTDPHD

SEQ ID NO: 117222 - protein, 16 aa, Borrelia garinii PBi
TQIDFLKTFKTDPHDS

SEQ ID NO: 117223 - protein, 16 aa, Borrelia garinii PBi
QIDFLKTFKTDPHDSL

SEQ ID NO: 117224 - protein, 16 aa, Borrelia garinii PBi
IDFLKTFKTDPHDSLP

SEQ ID NO: 117225 - protein, 16 aa, Borrelia garinii PBi
DFLKTFKTDPHDSLPE

SEQ ID NO: 117226 - protein, 16 aa, Borrelia garinii PBi
FLKTFKTDPHDSLPED

SEQ ID NO: 117227 - protein, 16 aa, Borrelia garinii PBi
LKTFKTDPHDSLPEDE

SEQ ID NO: 117228 - protein, 16 aa, Borrelia garinii PBi
KTFKTDPHDSLPEDEK

SEQ ID NO: 117229 - protein, 16 aa, Borrelia garinii PBi
TFKTDPHDSLPEDEKM

SEQ ID NO: 117230 - protein, 16 aa, Borrelia garinii PBi
FKTDPHDSLPEDEKMQ

SEQ ID NO: 117231 - protein, 16 aa, Borrelia garinii PBi
KTDPHDSLPEDEKMQM

SEQ ID NO: 117232 - protein, 16 aa, Borrelia garinii PBi
TDPHDSLPEDEKMQMK

SEQ ID NO: 117233 - protein, 16 aa, Borrelia garinii PBi
DPHDSLPEDEKMQMKK

SEQ ID NO: 117234 - protein, 16 aa, Borrelia garinii PBi
PHDSLPEDEKMQMKKI

SEQ ID NO: 117235 - protein, 16 aa, Borrelia garinii PBi
HDSLPEDEKMQMKKII

SEQ ID NO: 117236 - protein, 16 aa, Borrelia garinii PBi
DSLPEDEKMQMKKIIY

SEQ ID NO: 117237 - protein, 16 aa, Borrelia garinii PBi
SLPEDEKMQMKKIIYS

SEQ ID NO: 117238 - protein, 16 aa, Borrelia garinii PBi
LPEDEKMQMKKIIYSS

SEQ ID NO: 117239 - protein, 16 aa, Borrelia garinii PBi
PEDEKMQMKKIIYSSL

SEQ ID NO: 117240 - protein, 16 aa, Borrelia garinii PBi
EDEKMQMKKIIYSSLN

SEQ ID NO: 117241 - protein, 16 aa, Borrelia garinii PBi
DEKMQMKKIIYSSLNY

SEQ ID NO: 117242 - protein, 16 aa, Borrelia garinii PBi
EKMQMKKIIYSSLNYE

SEQ ID NO: 117243 - protein, 16 aa, Borrelia garinii PBi
KMQMKKIIYSSLNYET

SEQ ID NO: 117244 - protein, 16 aa, Borrelia garinii PBi
MQMKKIIYSSLNYETE

SEQ ID NO: 117245 - protein, 16 aa, Borrelia garinii PBi
QMKKIIYSSLNYETEK

SEQ ID NO: 117246 - protein, 16 aa, Borrelia garinii PBi
MKKIIYSSLNYETEKI

SEQ ID NO: 117247 - protein, 16 aa, Borrelia garinii PBi
KKIIYSSLNYETEKIK

SEQ ID NO: 117248 - protein, 16 aa, Borrelia garinii PBi
KIIYSSLNYETEKIKI

SEQ ID NO: 117249 - protein, 16 aa, Borrelia garinii PBi
IIYSSLNYETEKIKIL

SEQ ID NO: 117250 - protein, 16 aa, Borrelia garinii PBi
IYSSLNYETEKIKILQ

SEQ ID NO: 117251 - protein, 16 aa, Borrelia garinii PBi
YSSLNYETEKIKILQE

SEQ ID NO: 117252 - protein, 16 aa, Borrelia garinii PBi
SSLNYETEKIKILQEI

SEQ ID NO: 117253 - protein, 16 aa, Borrelia garinii PBi
SLNYETEKIKILQEIL

SEQ ID NO: 117254 - protein, 16 aa, Borrelia garinii PBi
LNYETEKIKILQEILE

SEQ ID NO: 117255 - protein, 16 aa, Borrelia garinii PBi
NYETEKIKILQEILEK

SEQ ID NO: 117256 - protein, 16 aa, Borrelia garinii PBi
YETEKIKILQEILEKL

SEQ ID NO: 117257 - protein, 16 aa, Borrelia garinii PBi
ETEKIKILQEILEKLD

SEQ ID NO: 117258 - protein, 16 aa, Borrelia garinii PBi
TEKIKILQEILEKLDK

SEQ ID NO: 117259 - protein, 16 aa, Borrelia garinii PBi
EKIKILQEILEKLDKN

SEQ ID NO: 117260 - protein, 16 aa, Borrelia garinii PBi
KIKILQEILEKLDKNL

SEQ ID NO: 117261 - protein, 16 aa, Borrelia garinii PBi
IKILQEILEKLDKNLQ

SEQ ID NO: 117262 - protein, 16 aa, Borrelia garinii PBi
KILQEILEKLDKNLQH

SEQ ID NO: 117263 - protein, 16 aa, Borrelia garinii PBi
ILQEILEKLDKNLQHK

SEQ ID NO: 117264 - protein, 16 aa, Borrelia garinii PBi
LQEILEKLDKNLQHKK

SEQ ID NO: 117265 - protein, 16 aa, Borrelia garinii PBi
QEILEKLDKNLQHKKI

SEQ ID NO: 117266 - protein, 16 aa, Borrelia garinii PBi
EILEKLDKNLQHKKIA

SEQ ID NO: 117267 - protein, 16 aa, Borrelia garinii PBi
ILEKLDKNLQHKKIAK

SEQ ID NO: 117268 - protein, 16 aa, Borrelia garinii PBi
LEKLDKNLQHKKIAKN

SEQ ID NO: 117269 - protein, 16 aa, Borrelia garinii PBi
EKLDKNLQHKKIAKNF

SEQ ID NO: 117270 - protein, 16 aa, Borrelia garinii PBi
KLDKNLQHKKIAKNFI

SEQ ID NO: 117271 - protein, 16 aa, Borrelia garinii PBi
LDKNLQHKKIAKNFIY

SEQ ID NO: 117272 - protein, 16 aa, Borrelia garinii PBi
DKNLQHKKIAKNFIYD

SEQ ID NO: 117273 - protein, 16 aa, Borrelia garinii PBi
KNLQHKKIAKNFIYDI

SEQ ID NO: 117274 - protein, 16 aa, Borrelia garinii PBi
NLQHKKIAKNFIYDIP

SEQ ID NO: 117275 - protein, 16 aa, Borrelia garinii PBi
LQHKKIAKNFIYDIPI

SEQ ID NO: 117276 - protein, 16 aa, Borrelia garinii PBi
QHKKIAKNFIYDIPII

SEQ ID NO: 117277 - protein, 16 aa, Borrelia garinii PBi
HKKIAKNFIYDIPIII

SEQ ID NO: 117278 - protein, 16 aa, Borrelia garinii PBi
KKIAKNFIYDIPIIIQ

SEQ ID NO: 117279 - protein, 16 aa, Borrelia garinii PBi
KIAKNFIYDIPIIIQS

SEQ ID NO: 117280 - protein, 16 aa, Borrelia garinii PBi
IAKNFIYDIPIIIQSR

SEQ ID NO: 117281 - protein, 16 aa, Borrelia garinii PBi
AKNFIYDIPIIIQSRL

SEQ ID NO: 117282 - protein, 16 aa, Borrelia garinii PBi
KNFIYDIPIIIQSRLD

SEQ ID NO: 117283 - protein, 16 aa, Borrelia garinii PBi
NFIYDIPIIIQSRLDI

SEQ ID NO: 117284 - protein, 16 aa, Borrelia garinii PBi
FIYDIPIIIQSRLDII

SEQ ID NO: 117285 - protein, 16 aa, Borrelia garinii PBi
IYDIPIIIQSRLDIIS

SEQ ID NO: 117286 - protein, 16 aa, Borrelia garinii PBi
YDIPIIIQSRLDIISK

SEQ ID NO: 117287 - protein, 16 aa, Borrelia garinii PBi
DIPIIIQSRLDIISKV

SEQ ID NO: 117288 - protein, 16 aa, Borrelia garinii PBi
IPIIIQSRLDIISKVI

SEQ ID NO: 117289 - protein, 16 aa, Borrelia garinii PBi
PIIIQSRLDIISKVIK

SEQ ID NO: 117290 - protein, 16 aa, Borrelia garinii PBi
IIIQSRLDIISKVIKN

SEQ ID NO: 117291 - protein, 16 aa, Borrelia garinii PBi
IIQSRLDIISKVIKNP

SEQ ID NO: 117292 - protein, 16 aa, Borrelia garinii PBi
IQSRLDIISKVIKNPI

SEQ ID NO: 117293 - protein, 16 aa, Borrelia garinii PBi
QSRLDIISKVIKNPIK

SEQ ID NO: 117294 - protein, 16 aa, Borrelia garinii PBi
SRLDIISKVIKNPIKD

SEQ ID NO: 117295 - protein, 16 aa, Borrelia garinii PBi
RLDIISKVIKNPIKDE

SEQ ID NO: 117296 - protein, 16 aa, Borrelia garinii PBi
LDIISKVIKNPIKDEL

SEQ ID NO: 117297 - protein, 16 aa, Borrelia garinii PBi
DIISKVIKNPIKDELQ

SEQ ID NO: 117298 - protein, 16 aa, Borrelia garinii PBi
IISKVIKNPIKDELQI

SEQ ID NO: 117299 - protein, 16 aa, Borrelia garinii PBi
ISKVIKNPIKDELQIL

SEQ ID NO: 117300 - protein, 16 aa, Borrelia garinii PBi
SKVIKNPIKDELQILN

SEQ ID NO: 117301 - protein, 16 aa, Borrelia garinii PBi
KVIKNPIKDELQILNQ

SEQ ID NO: 117302 - protein, 16 aa, Borrelia garinii PBi
VIKNPIKDELQILNQK

SEQ ID NO: 117303 - protein, 16 aa, Borrelia garinii PBi
IKNPIKDELQILNQKE

SEQ ID NO: 117304 - protein, 16 aa, Borrelia garinii PBi
KNPIKDELQILNQKEI

SEQ ID NO: 117305 - protein, 16 aa, Borrelia garinii PBi
NPIKDELQILNQKEIE

SEQ ID NO: 117306 - protein, 16 aa, Borrelia garinii PBi
PIKDELQILNQKEIEE

SEQ ID NO: 117307 - protein, 16 aa, Borrelia garinii PBi
IKDELQILNQKEIEEL

SEQ ID NO: 117308 - protein, 16 aa, Borrelia garinii PBi
KDELQILNQKEIEELL

SEQ ID NO: 117309 - protein, 16 aa, Borrelia garinii PBi
DELQILNQKEIEELLM

SEQ ID NO: 117310 - protein, 16 aa, Borrelia garinii PBi
ELQILNQKEIEELLMR

SEQ ID NO: 117311 - protein, 16 aa, Borrelia garinii PBi
LQILNQKEIEELLMRI

SEQ ID NO: 117312 - protein, 16 aa, Borrelia garinii PBi
QILNQKEIEELLMRIE

SEQ ID NO: 117313 - protein, 16 aa, Borrelia garinii PBi
ILNQKEIEELLMRIES

SEQ ID NO: 117314 - protein, 16 aa, Borrelia garinii PBi
LNQKEIEELLMRIESE

SEQ ID NO: 117315 - protein, 16 aa, Borrelia garinii PBi
NQKEIEELLMRIESEL

SEQ ID NO: 117316 - protein, 16 aa, Borrelia garinii PBi
QKEIEELLMRIESELK

SEQ ID NO: 117317 - protein, 16 aa, Borrelia garinii PBi
KEIEELLMRIESELKI

SEQ ID NO: 117318 - protein, 16 aa, Borrelia garinii PBi
EIEELLMRIESELKIK

SEQ ID NO: 117319 - protein, 16 aa, Borrelia garinii PBi
IEELLMRIESELKIKE

SEQ ID NO: 117320 - protein, 16 aa, Borrelia garinii PBi
EELLMRIESELKIKEN

SEQ ID NO: 117321 - protein, 16 aa, Borrelia garinii PBi
ELLMRIESELKIKENF

SEQ ID NO: 117322 - protein, 16 aa, Borrelia garinii PBi
LLMRIESELKIKENFK

SEQ ID NO: 117323 - protein, 16 aa, Borrelia garinii PBi
LMRIESELKIKENFKK

SEQ ID NO: 117324 - protein, 16 aa, Borrelia garinii PBi
MRIESELKIKENFKKA

SEQ ID NO: 117325 - protein, 16 aa, Borrelia garinii PBi
RIESELKIKENFKKAL

SEQ ID NO: 117326 - protein, 16 aa, Borrelia garinii PBi
IESELKIKENFKKALN

SEQ ID NO: 117327 - protein, 16 aa, Borrelia garinii PBi
ESELKIKENFKKALNK

SEQ ID NO: 117328 - protein, 16 aa, Borrelia garinii PBi
SELKIKENFKKALNKT

SEQ ID NO: 117329 - protein, 16 aa, Borrelia garinii PBi
ELKIKENFKKALNKTI

SEQ ID NO: 117330 - protein, 16 aa, Borrelia garinii PBi
LKIKENFKKALNKTID

SEQ ID NO: 117331 - protein, 16 aa, Borrelia garinii PBi
KIKENFKKALNKTIDA

SEQ ID NO: 117332 - protein, 16 aa, Borrelia garinii PBi
IKENFKKALNKTIDAY

SEQ ID NO: 117333 - protein, 16 aa, Borrelia garinii PBi
KENFKKALNKTIDAYN

SEQ ID NO: 117334 - protein, 16 aa, Borrelia garinii PBi
ENFKKALNKTIDAYNQ

SEQ ID NO: 117335 - protein, 16 aa, Borrelia garinii PBi
NFKKALNKTIDAYNQD

SEQ ID NO: 117336 - protein, 16 aa, Borrelia garinii PBi
FKKALNKTIDAYNQDS

SEQ ID NO: 117337 - protein, 16 aa, Borrelia garinii PBi
KKALNKTIDAYNQDSE

SEQ ID NO: 117338 - protein, 16 aa, Borrelia garinii PBi
KALNKTIDAYNQDSEN

SEQ ID NO: 117339 - protein, 16 aa, Borrelia garinii PBi
ALNKTIDAYNQDSENI

SEQ ID NO: 117340 - protein, 16 aa, Borrelia garinii PBi
LNKTIDAYNQDSENIK

SEQ ID NO: 117341 - protein, 16 aa, Borrelia garinii PBi
NKTIDAYNQDSENIKT

SEQ ID NO: 117342 - protein, 16 aa, Borrelia garinii PBi
KTIDAYNQDSENIKTS

SEQ ID NO: 117343 - protein, 16 aa, Borrelia garinii PBi
TIDAYNQDSENIKTSA

SEQ ID NO: 117344 - protein, 16 aa, Borrelia garinii PBi
IDAYNQDSENIKTSAE

SEQ ID NO: 117345 - protein, 16 aa, Borrelia garinii PBi
DAYNQDSENIKTSAEQ

SEQ ID NO: 117346 - protein, 16 aa, Borrelia garinii PBi
AYNQDSENIKTSAEQL

SEQ ID NO: 117347 - protein, 16 aa, Borrelia garinii PBi
YNQDSENIKTSAEQLE

SEQ ID NO: 117348 - protein, 16 aa, Borrelia garinii PBi
NQDSENIKTSAEQLEK

SEQ ID NO: 117349 - protein, 16 aa, Borrelia garinii PBi
QDSENIKTSAEQLEKH

SEQ ID NO: 117350 - protein, 16 aa, Borrelia garinii PBi
DSENIKTSAEQLEKHI

SEQ ID NO: 117351 - protein, 16 aa, Borrelia garinii PBi
SENIKTSAEQLEKHIN

SEQ ID NO: 117352 - protein, 16 aa, Borrelia garinii PBi
ENIKTSAEQLEKHINE

SEQ ID NO: 117353 - protein, 16 aa, Borrelia garinii PBi
NIKTSAEQLEKHINEN

SEQ ID NO: 117354 - protein, 16 aa, Borrelia garinii PBi
IKTSAEQLEKHINENY

SEQ ID NO: 117355 - protein, 16 aa, Borrelia garinii PBi
KTSAEQLEKHINENYK

SEQ ID NO: 117356 - protein, 16 aa, Borrelia garinii PBi
TSAEQLEKHINENYKE

SEQ ID NO: 117357 - protein, 16 aa, Borrelia garinii PBi
SAEQLEKHINENYKEF

SEQ ID NO: 117358 - protein, 16 aa, Borrelia garinii PBi
AEQLEKHINENYKEFN

SEQ ID NO: 117359 - protein, 16 aa, Borrelia garinii PBi
EQLEKHINENYKEFNS

SEQ ID NO: 117360 - protein, 16 aa, Borrelia garinii PBi
QLEKHINENYKEFNSL

SEQ ID NO: 117361 - protein, 16 aa, Borrelia garinii PBi
LEKHINENYKEFNSLK

SEQ ID NO: 117362 - protein, 16 aa, Borrelia garinii PBi
EKHINENYKEFNSLKP

SEQ ID NO: 117363 - protein, 16 aa, Borrelia garinii PBi
KHINENYKEFNSLKPI

SEQ ID NO: 117364 - protein, 16 aa, Borrelia garinii PBi
HINENYKEFNSLKPIY

SEQ ID NO: 117365 - protein, 13 aa, Borrelia burgdorferi B31
MRILVGVCIIALA

SEQ ID NO: 117366 - protein, 13 aa, Borrelia burgdorferi B31
RILVGVCIIALAL

SEQ ID NO: 117367 - protein, 13 aa, Borrelia burgdorferi B31
ILVGVCIIALALL

SEQ ID NO: 117368 - protein, 13 aa, Borrelia burgdorferi B31
LVGVCIIALALLG

SEQ ID NO: 117369 - protein, 13 aa, Borrelia burgdorferi B31
VGVCIIALALLGC

SEQ ID NO: 117370 - protein, 13 aa, Borrelia burgdorferi B31
GVCIIALALLGCY

SEQ ID NO: 117371 - protein, 13 aa, Borrelia burgdorferi B31
VCIIALALLGCYL

SEQ ID NO: 117372 - protein, 13 aa, Borrelia burgdorferi B31
CIIALALLGCYLP

SEQ ID NO: 117373 - protein, 13 aa, Borrelia burgdorferi B31
IIALALLGCYLPD

SEQ ID NO: 117374 - protein, 13 aa, Borrelia burgdorferi B31
IALALLGCYLPDN

SEQ ID NO: 117375 - protein, 13 aa, Borrelia burgdorferi B31
ALALLGCYLPDNQ

SEQ ID NO: 117376 - protein, 13 aa, Borrelia burgdorferi B31
LALLGCYLPDNQE

SEQ ID NO: 117377 - protein, 13 aa, Borrelia burgdorferi B31
ALLGCYLPDNQEQ

SEQ ID NO: 117378 - protein, 13 aa, Borrelia burgdorferi B31
LLGCYLPDNQEQA

SEQ ID NO: 117379 - protein, 13 aa, Borrelia burgdorferi B31
LGCYLPDNQEQAV

SEQ ID NO: 117380 - protein, 13 aa, Borrelia burgdorferi B31
GCYLPDNQEQAVQ

SEQ ID NO: 117381 - protein, 13 aa, Borrelia burgdorferi B31
CYLPDNQEQAVQT

SEQ ID NO: 117382 - protein, 13 aa, Borrelia burgdorferi B31
YLPDNQEQAVQTF

SEQ ID NO: 117383 - protein, 13 aa, Borrelia burgdorferi B31
LPDNQEQAVQTFF

SEQ ID NO: 117384 - protein, 13 aa, Borrelia burgdorferi B31
PDNQEQAVQTFFE

SEQ ID NO: 117385 - protein, 13 aa, Borrelia burgdorferi B31
DNQEQAVQTFFEN

SEQ ID NO: 117386 - protein, 13 aa, Borrelia burgdorferi B31
NQEQAVQTFFENS

SEQ ID NO: 117387 - protein, 13 aa, Borrelia burgdorferi B31
QEQAVQTFFENSE

SEQ ID NO: 117388 - protein, 13 aa, Borrelia burgdorferi B31
EQAVQTFFENSES

SEQ ID NO: 117389 - protein, 13 aa, Borrelia burgdorferi B31
QAVQTFFENSESS

SEQ ID NO: 117390 - protein, 13 aa, Borrelia burgdorferi B31
AVQTFFENSESSD

SEQ ID NO: 117391 - protein, 13 aa, Borrelia burgdorferi B31
VQTFFENSESSDM

SEQ ID NO: 117392 - protein, 13 aa, Borrelia burgdorferi B31
QTFFENSESSDMG

SEQ ID NO: 117393 - protein, 13 aa, Borrelia burgdorferi B31
TFFENSESSDMGS

SEQ ID NO: 117394 - protein, 13 aa, Borrelia burgdorferi B31
FFENSESSDMGSD

SEQ ID NO: 117395 - protein, 13 aa, Borrelia burgdorferi B31
FENSESSDMGSDE

SEQ ID NO: 117396 - protein, 13 aa, Borrelia burgdorferi B31
ENSESSDMGSDEI

SEQ ID NO: 117397 - protein, 13 aa, Borrelia burgdorferi B31
NSESSDMGSDEIV

SEQ ID NO: 117398 - protein, 13 aa, Borrelia burgdorferi B31
SESSDMGSDEIVT

SEQ ID NO: 117399 - protein, 13 aa, Borrelia burgdorferi B31
ESSDMGSDEIVTE

SEQ ID NO: 117400 - protein, 13 aa, Borrelia burgdorferi B31
SSDMGSDEIVTEG

SEQ ID NO: 117401 - protein, 13 aa, Borrelia burgdorferi B31
SDMGSDEIVTEGI

SEQ ID NO: 117402 - protein, 13 aa, Borrelia burgdorferi B31
DMGSDEIVTEGIF

SEQ ID NO: 117403 - protein, 13 aa, Borrelia burgdorferi B31
MGSDEIVTEGIFS

SEQ ID NO: 117404 - protein, 13 aa, Borrelia burgdorferi B31
GSDEIVTEGIFSS

SEQ ID NO: 117405 - protein, 13 aa, Borrelia burgdorferi B31
SDEIVTEGIFSSL

SEQ ID NO: 117406 - protein, 13 aa, Borrelia burgdorferi B31
DEIVTEGIFSSLK

SEQ ID NO: 117407 - protein, 13 aa, Borrelia burgdorferi B31
EIVTEGIFSSLKL

SEQ ID NO: 117408 - protein, 13 aa, Borrelia burgdorferi B31
IVTEGIFSSLKLY

SEQ ID NO: 117409 - protein, 13 aa, Borrelia burgdorferi B31
VTEGIFSSLKLYA

SEQ ID NO: 117410 - protein, 13 aa, Borrelia burgdorferi B31
TEGIFSSLKLYAS

SEQ ID NO: 117411 - protein, 13 aa, Borrelia burgdorferi B31
EGIFSSLKLYASE

SEQ ID NO: 117412 - protein, 13 aa, Borrelia burgdorferi B31
GIFSSLKLYASEH

SEQ ID NO: 117413 - protein, 13 aa, Borrelia burgdorferi B31
IFSSLKLYASEHR

SEQ ID NO: 117414 - protein, 13 aa, Borrelia burgdorferi B31
FSSLKLYASEHRL

SEQ ID NO: 117415 - protein, 13 aa, Borrelia burgdorferi B31
SSLKLYASEHRLL

SEQ ID NO: 117416 - protein, 13 aa, Borrelia burgdorferi B31
SLKLYASEHRLLV

SEQ ID NO: 117417 - protein, 13 aa, Borrelia burgdorferi B31
LKLYASEHRLLVE

SEQ ID NO: 117418 - protein, 13 aa, Borrelia burgdorferi B31
KLYASEHRLLVEI

SEQ ID NO: 117419 - protein, 13 aa, Borrelia burgdorferi B31
LYASEHRLLVEIK

SEQ ID NO: 117420 - protein, 13 aa, Borrelia burgdorferi B31
YASEHRLLVEIKK

SEQ ID NO: 117421 - protein, 13 aa, Borrelia burgdorferi B31
ASEHRLLVEIKKT

SEQ ID NO: 117422 - protein, 13 aa, Borrelia burgdorferi B31
SEHRLLVEIKKTL

SEQ ID NO: 117423 - protein, 13 aa, Borrelia burgdorferi B31
EHRLLVEIKKTLI

SEQ ID NO: 117424 - protein, 13 aa, Borrelia burgdorferi B31
HRLLVEIKKTLIS

SEQ ID NO: 117425 - protein, 13 aa, Borrelia burgdorferi B31
RLLVEIKKTLISL

SEQ ID NO: 117426 - protein, 13 aa, Borrelia burgdorferi B31
LLVEIKKTLISLK

SEQ ID NO: 117427 - protein, 13 aa, Borrelia burgdorferi B31
LVEIKKTLISLKD

SEQ ID NO: 117428 - protein, 13 aa, Borrelia burgdorferi B31
VEIKKTLISLKDP

SEQ ID NO: 117429 - protein, 13 aa, Borrelia burgdorferi B31
EIKKTLISLKDPN

SEQ ID NO: 117430 - protein, 13 aa, Borrelia burgdorferi B31
IKKTLISLKDPNY

SEQ ID NO: 117431 - protein, 13 aa, Borrelia burgdorferi B31
KKTLISLKDPNYR

SEQ ID NO: 117432 - protein, 13 aa, Borrelia burgdorferi B31
KTLISLKDPNYRG

SEQ ID NO: 117433 - protein, 13 aa, Borrelia burgdorferi B31
TLISLKDPNYRGV

SEQ ID NO: 117434 - protein, 13 aa, Borrelia burgdorferi B31
LISLKDPNYRGVV

SEQ ID NO: 117435 - protein, 13 aa, Borrelia burgdorferi B31
ISLKDPNYRGVVL

SEQ ID NO: 117436 - protein, 13 aa, Borrelia burgdorferi B31
SLKDPNYRGVVLP

SEQ ID NO: 117437 - protein, 13 aa, Borrelia burgdorferi B31
LKDPNYRGVVLPV

SEQ ID NO: 117438 - protein, 13 aa, Borrelia burgdorferi B31
KDPNYRGVVLPVS

SEQ ID NO: 117439 - protein, 13 aa, Borrelia burgdorferi B31
DPNYRGVVLPVSD

SEQ ID NO: 117440 - protein, 13 aa, Borrelia burgdorferi B31
PNYRGVVLPVSDY

SEQ ID NO: 117441 - protein, 13 aa, Borrelia burgdorferi B31
NYRGVVLPVSDYN

SEQ ID NO: 117442 - protein, 13 aa, Borrelia burgdorferi B31
YRGVVLPVSDYNE

SEQ ID NO: 117443 - protein, 13 aa, Borrelia burgdorferi B31
RGVVLPVSDYNEE

SEQ ID NO: 117444 - protein, 13 aa, Borrelia burgdorferi B31
GVVLPVSDYNEEY

SEQ ID NO: 117445 - protein, 13 aa, Borrelia burgdorferi B31
VVLPVSDYNEEYF

SEQ ID NO: 117446 - protein, 13 aa, Borrelia burgdorferi B31
VLPVSDYNEEYFN

SEQ ID NO: 117447 - protein, 13 aa, Borrelia burgdorferi B31
LPVSDYNEEYFNK

SEQ ID NO: 117448 - protein, 13 aa, Borrelia burgdorferi B31
PVSDYNEEYFNKF

SEQ ID NO: 117449 - protein, 13 aa, Borrelia burgdorferi B31
VSDYNEEYFNKFF

SEQ ID NO: 117450 - protein, 13 aa, Borrelia burgdorferi B31
SDYNEEYFNKFFL

SEQ ID NO: 117451 - protein, 13 aa, Borrelia burgdorferi B31
DYNEEYFNKFFLD

SEQ ID NO: 117452 - protein, 13 aa, Borrelia burgdorferi B31
YNEEYFNKFFLDL

SEQ ID NO: 117453 - protein, 13 aa, Borrelia burgdorferi B31
NEEYFNKFFLDLG

SEQ ID NO: 117454 - protein, 13 aa, Borrelia burgdorferi B31
EEYFNKFFLDLGS

SEQ ID NO: 117455 - protein, 13 aa, Borrelia burgdorferi B31
EYFNKFFLDLGSE

SEQ ID NO: 117456 - protein, 13 aa, Borrelia burgdorferi B31
YFNKFFLDLGSEQ

SEQ ID NO: 117457 - protein, 13 aa, Borrelia burgdorferi B31
FNKFFLDLGSEQS

SEQ ID NO: 117458 - protein, 13 aa, Borrelia burgdorferi B31
NKFFLDLGSEQSK

SEQ ID NO: 117459 - protein, 13 aa, Borrelia burgdorferi B31
KFFLDLGSEQSKD

SEQ ID NO: 117460 - protein, 13 aa, Borrelia burgdorferi B31
FFLDLGSEQSKDL

SEQ ID NO: 117461 - protein, 13 aa, Borrelia burgdorferi B31
FLDLGSEQSKDLI

SEQ ID NO: 117462 - protein, 13 aa, Borrelia burgdorferi B31
LDLGSEQSKDLIK

SEQ ID NO: 117463 - protein, 13 aa, Borrelia burgdorferi B31
DLGSEQSKDLIKL

SEQ ID NO: 117464 - protein, 13 aa, Borrelia burgdorferi B31
LGSEQSKDLIKLF

SEQ ID NO: 117465 - protein, 13 aa, Borrelia burgdorferi B31
GSEQSKDLIKLFI

SEQ ID NO: 117466 - protein, 13 aa, Borrelia burgdorferi B31
SEQSKDLIKLFIM

SEQ ID NO: 117467 - protein, 13 aa, Borrelia burgdorferi B31
EQSKDLIKLFIMV

SEQ ID NO: 117468 - protein, 13 aa, Borrelia burgdorferi B31
QSKDLIKLFIMVK

SEQ ID NO: 117469 - protein, 13 aa, Borrelia burgdorferi B31
SKDLIKLFIMVKN

SEQ ID NO: 117470 - protein, 13 aa, Borrelia burgdorferi B31
KDLIKLFIMVKNE

SEQ ID NO: 117471 - protein, 13 aa, Borrelia burgdorferi B31
DLIKLFIMVKNEQ

SEQ ID NO: 117472 - protein, 13 aa, Borrelia burgdorferi B31
LIKLFIMVKNEQN

SEQ ID NO: 117473 - protein, 13 aa, Borrelia burgdorferi B31
IKLFIMVKNEQNN

SEQ ID NO: 117474 - protein, 13 aa, Borrelia burgdorferi B31
KLFIMVKNEQNNN

SEQ ID NO: 117475 - protein, 13 aa, Borrelia burgdorferi B31
LFIMVKNEQNNNK

SEQ ID NO: 117476 - protein, 13 aa, Borrelia burgdorferi B31
FIMVKNEQNNNKF

SEQ ID NO: 117477 - protein, 13 aa, Borrelia burgdorferi B31
IMVKNEQNNNKFM

SEQ ID NO: 117478 - protein, 13 aa, Borrelia burgdorferi B31
MVKNEQNNNKFMR

SEQ ID NO: 117479 - protein, 13 aa, Borrelia burgdorferi B31
VKNEQNNNKFMRI

SEQ ID NO: 117480 - protein, 13 aa, Borrelia burgdorferi B31
KNEQNNNKFMRIV

SEQ ID NO: 117481 - protein, 13 aa, Borrelia burgdorferi B31
NEQNNNKFMRIVR

SEQ ID NO: 117482 - protein, 13 aa, Borrelia burgdorferi B31
EQNNNKFMRIVRW

SEQ ID NO: 117483 - protein, 13 aa, Borrelia burgdorferi B31
QNNNKFMRIVRWL

SEQ ID NO: 117484 - protein, 13 aa, Borrelia burgdorferi B31
NNNKFMRIVRWLY

SEQ ID NO: 117485 - protein, 13 aa, Borrelia burgdorferi B31
NNKFMRIVRWLYS

SEQ ID NO: 117486 - protein, 13 aa, Borrelia burgdorferi B31
NKFMRIVRWLYSC

SEQ ID NO: 117487 - protein, 13 aa, Borrelia burgdorferi B31
KFMRIVRWLYSCI

SEQ ID NO: 117488 - protein, 13 aa, Borrelia burgdorferi B31
FMRIVRWLYSCIE

SEQ ID NO: 117489 - protein, 13 aa, Borrelia burgdorferi B31
MRIVRWLYSCIEE

SEQ ID NO: 117490 - protein, 13 aa, Borrelia burgdorferi B31
RIVRWLYSCIEEL

SEQ ID NO: 117491 - protein, 13 aa, Borrelia burgdorferi B31
IVRWLYSCIEELY

SEQ ID NO: 117492 - protein, 13 aa, Borrelia burgdorferi B31
VRWLYSCIEELYS

SEQ ID NO: 117493 - protein, 13 aa, Borrelia burgdorferi B31
RWLYSCIEELYSP

SEQ ID NO: 117494 - protein, 13 aa, Borrelia burgdorferi B31
WLYSCIEELYSPD

SEQ ID NO: 117495 - protein, 13 aa, Borrelia burgdorferi B31
LYSCIEELYSPDI

SEQ ID NO: 117496 - protein, 13 aa, Borrelia burgdorferi B31
YSCIEELYSPDIK

SEQ ID NO: 117497 - protein, 13 aa, Borrelia burgdorferi B31
SCIEELYSPDIKY

SEQ ID NO: 117498 - protein, 13 aa, Borrelia burgdorferi B31
CIEELYSPDIKYS

SEQ ID NO: 117499 - protein, 13 aa, Borrelia burgdorferi B31
IEELYSPDIKYSG

SEQ ID NO: 117500 - protein, 13 aa, Borrelia burgdorferi B31
EELYSPDIKYSGE

SEQ ID NO: 117501 - protein, 13 aa, Borrelia burgdorferi B31
ELYSPDIKYSGEE

SEQ ID NO: 117502 - protein, 13 aa, Borrelia burgdorferi B31
LYSPDIKYSGEEG

SEQ ID NO: 117503 - protein, 13 aa, Borrelia burgdorferi B31
YSPDIKYSGEEGS

SEQ ID NO: 117504 - protein, 13 aa, Borrelia burgdorferi B31
SPDIKYSGEEGSP

SEQ ID NO: 117505 - protein, 13 aa, Borrelia burgdorferi B31
PDIKYSGEEGSPE

SEQ ID NO: 117506 - protein, 13 aa, Borrelia burgdorferi B31
DIKYSGEEGSPEY

SEQ ID NO: 117507 - protein, 13 aa, Borrelia burgdorferi B31
IKYSGEEGSPEYY

SEQ ID NO: 117508 - protein, 13 aa, Borrelia burgdorferi B31
KYSGEEGSPEYYR

SEQ ID NO: 117509 - protein, 13 aa, Borrelia burgdorferi B31
YSGEEGSPEYYRN

SEQ ID NO: 117510 - protein, 13 aa, Borrelia burgdorferi B31
SGEEGSPEYYRNM

SEQ ID NO: 117511 - protein, 13 aa, Borrelia burgdorferi B31
GEEGSPEYYRNMP

SEQ ID NO: 117512 - protein, 13 aa, Borrelia burgdorferi B31
EEGSPEYYRNMPR

SEQ ID NO: 117513 - protein, 13 aa, Borrelia burgdorferi B31
EGSPEYYRNMPRP

SEQ ID NO: 117514 - protein, 13 aa, Borrelia burgdorferi B31
GSPEYYRNMPRPT

SEQ ID NO: 117515 - protein, 13 aa, Borrelia burgdorferi B31
SPEYYRNMPRPTA

SEQ ID NO: 117516 - protein, 13 aa, Borrelia burgdorferi B31
PEYYRNMPRPTAY

SEQ ID NO: 117517 - protein, 13 aa, Borrelia burgdorferi B31
EYYRNMPRPTAYQ

SEQ ID NO: 117518 - protein, 13 aa, Borrelia burgdorferi B31
YYRNMPRPTAYQQ

SEQ ID NO: 117519 - protein, 13 aa, Borrelia burgdorferi B31
YRNMPRPTAYQQY

SEQ ID NO: 117520 - protein, 13 aa, Borrelia burgdorferi B31
RNMPRPTAYQQYL

SEQ ID NO: 117521 - protein, 13 aa, Borrelia burgdorferi B31
NMPRPTAYQQYLK

SEQ ID NO: 117522 - protein, 13 aa, Borrelia burgdorferi B31
MPRPTAYQQYLKV

SEQ ID NO: 117523 - protein, 13 aa, Borrelia burgdorferi B31
PRPTAYQQYLKVK

SEQ ID NO: 117524 - protein, 13 aa, Borrelia burgdorferi B31
RPTAYQQYLKVKR

SEQ ID NO: 117525 - protein, 13 aa, Borrelia burgdorferi B31
PTAYQQYLKVKRY

SEQ ID NO: 117526 - protein, 13 aa, Borrelia burgdorferi B31
TAYQQYLKVKRYD

SEQ ID NO: 117527 - protein, 13 aa, Borrelia burgdorferi B31
AYQQYLKVKRYDY

SEQ ID NO: 117528 - protein, 13 aa, Borrelia burgdorferi B31
YQQYLKVKRYDYN

SEQ ID NO: 117529 - protein, 13 aa, Borrelia burgdorferi B31
QQYLKVKRYDYNR

SEQ ID NO: 117530 - protein, 13 aa, Borrelia burgdorferi B31
QYLKVKRYDYNRP

SEQ ID NO: 117531 - protein, 13 aa, Borrelia burgdorferi B31
YLKVKRYDYNRPV

SEQ ID NO: 117532 - protein, 13 aa, Borrelia burgdorferi B31
LKVKRYDYNRPVP

SEQ ID NO: 117533 - protein, 13 aa, Borrelia burgdorferi B31
KVKRYDYNRPVPI

SEQ ID NO: 117534 - protein, 13 aa, Borrelia burgdorferi B31
VKRYDYNRPVPIL

SEQ ID NO: 117535 - protein, 13 aa, Borrelia burgdorferi B31
KRYDYNRPVPILP

SEQ ID NO: 117536 - protein, 13 aa, Borrelia burgdorferi B31
RYDYNRPVPILPT

SEQ ID NO: 117537 - protein, 14 aa, Borrelia burgdorferi B31
MRILVGVCIIALAL

SEQ ID NO: 117538 - protein, 14 aa, Borrelia burgdorferi B31
RILVGVCIIALALL

SEQ ID NO: 117539 - protein, 14 aa, Borrelia burgdorferi B31
ILVGVCIIALALLG

SEQ ID NO: 117540 - protein, 14 aa, Borrelia burgdorferi B31
LVGVCIIALALLGC

SEQ ID NO: 117541 - protein, 14 aa, Borrelia burgdorferi B31
VGVCIIALALLGCY

SEQ ID NO: 117542 - protein, 14 aa, Borrelia burgdorferi B31
GVCIIALALLGCYL

SEQ ID NO: 117543 - protein, 14 aa, Borrelia burgdorferi B31
VCIIALALLGCYLP

SEQ ID NO: 117544 - protein, 14 aa, Borrelia burgdorferi B31
CIIALALLGCYLPD

SEQ ID NO: 117545 - protein, 14 aa, Borrelia burgdorferi B31
IIALALLGCYLPDN

SEQ ID NO: 117546 - protein, 14 aa, Borrelia burgdorferi B31
IALALLGCYLPDNQ

SEQ ID NO: 117547 - protein, 14 aa, Borrelia burgdorferi B31
ALALLGCYLPDNQE

SEQ ID NO: 117548 - protein, 14 aa, Borrelia burgdorferi B31
LALLGCYLPDNQEQ

SEQ ID NO: 117549 - protein, 14 aa, Borrelia burgdorferi B31
ALLGCYLPDNQEQA

SEQ ID NO: 117550 - protein, 14 aa, Borrelia burgdorferi B31
LLGCYLPDNQEQAV

SEQ ID NO: 117551 - protein, 14 aa, Borrelia burgdorferi B31
LGCYLPDNQEQAVQ

SEQ ID NO: 117552 - protein, 14 aa, Borrelia burgdorferi B31
GCYLPDNQEQAVQT

SEQ ID NO: 117553 - protein, 14 aa, Borrelia burgdorferi B31
CYLPDNQEQAVQTF

SEQ ID NO: 117554 - protein, 14 aa, Borrelia burgdorferi B31
YLPDNQEQAVQTFF

SEQ ID NO: 117555 - protein, 14 aa, Borrelia burgdorferi B31
LPDNQEQAVQTFFE

SEQ ID NO: 117556 - protein, 14 aa, Borrelia burgdorferi B31
PDNQEQAVQTFFEN

SEQ ID NO: 117557 - protein, 14 aa, Borrelia burgdorferi B31
DNQEQAVQTFFENS

SEQ ID NO: 117558 - protein, 14 aa, Borrelia burgdorferi B31
NQEQAVQTFFENSE

SEQ ID NO: 117559 - protein, 14 aa, Borrelia burgdorferi B31
QEQAVQTFFENSES

SEQ ID NO: 117560 - protein, 14 aa, Borrelia burgdorferi B31
EQAVQTFFENSESS

SEQ ID NO: 117561 - protein, 14 aa, Borrelia burgdorferi B31
QAVQTFFENSESSD

SEQ ID NO: 117562 - protein, 14 aa, Borrelia burgdorferi B31
AVQTFFENSESSDM

SEQ ID NO: 117563 - protein, 14 aa, Borrelia burgdorferi B31
VQTFFENSESSDMG

SEQ ID NO: 117564 - protein, 14 aa, Borrelia burgdorferi B31
QTFFENSESSDMGS

SEQ ID NO: 117565 - protein, 14 aa, Borrelia burgdorferi B31
TFFENSESSDMGSD

SEQ ID NO: 117566 - protein, 14 aa, Borrelia burgdorferi B31
FFENSESSDMGSDE

SEQ ID NO: 117567 - protein, 14 aa, Borrelia burgdorferi B31
FENSESSDMGSDEI

SEQ ID NO: 117568 - protein, 14 aa, Borrelia burgdorferi B31
ENSESSDMGSDEIV

SEQ ID NO: 117569 - protein, 14 aa, Borrelia burgdorferi B31
NSESSDMGSDEIVT

SEQ ID NO: 117570 - protein, 14 aa, Borrelia burgdorferi B31
SESSDMGSDEIVTE

SEQ ID NO: 117571 - protein, 14 aa, Borrelia burgdorferi B31
ESSDMGSDEIVTEG

SEQ ID NO: 117572 - protein, 14 aa, Borrelia burgdorferi B31
SSDMGSDEIVTEGI

SEQ ID NO: 117573 - protein, 14 aa, Borrelia burgdorferi B31
SDMGSDEIVTEGIF

SEQ ID NO: 117574 - protein, 14 aa, Borrelia burgdorferi B31
DMGSDEIVTEGIFS

SEQ ID NO: 117575 - protein, 14 aa, Borrelia burgdorferi B31
MGSDEIVTEGIFSS

SEQ ID NO: 117576 - protein, 14 aa, Borrelia burgdorferi B31
GSDEIVTEGIFSSL

SEQ ID NO: 117577 - protein, 14 aa, Borrelia burgdorferi B31
SDEIVTEGIFSSLK

SEQ ID NO: 117578 - protein, 14 aa, Borrelia burgdorferi B31
DEIVTEGIFSSLKL

SEQ ID NO: 117579 - protein, 14 aa, Borrelia burgdorferi B31
EIVTEGIFSSLKLY

SEQ ID NO: 117580 - protein, 14 aa, Borrelia burgdorferi B31
IVTEGIFSSLKLYA

SEQ ID NO: 117581 - protein, 14 aa, Borrelia burgdorferi B31
VTEGIFSSLKLYAS

SEQ ID NO: 117582 - protein, 14 aa, Borrelia burgdorferi B31
TEGIFSSLKLYASE

SEQ ID NO: 117583 - protein, 14 aa, Borrelia burgdorferi B31
EGIFSSLKLYASEH

SEQ ID NO: 117584 - protein, 14 aa, Borrelia burgdorferi B31
GIFSSLKLYASEHR

SEQ ID NO: 117585 - protein, 14 aa, Borrelia burgdorferi B31
IFSSLKLYASEHRL

SEQ ID NO: 117586 - protein, 14 aa, Borrelia burgdorferi B31
FSSLKLYASEHRLL

SEQ ID NO: 117587 - protein, 14 aa, Borrelia burgdorferi B31
SSLKLYASEHRLLV

SEQ ID NO: 117588 - protein, 14 aa, Borrelia burgdorferi B31
SLKLYASEHRLLVE

SEQ ID NO: 117589 - protein, 14 aa, Borrelia burgdorferi B31
LKLYASEHRLLVEI

SEQ ID NO: 117590 - protein, 14 aa, Borrelia burgdorferi B31
KLYASEHRLLVEIK

SEQ ID NO: 117591 - protein, 14 aa, Borrelia burgdorferi B31
LYASEHRLLVEIKK

SEQ ID NO: 117592 - protein, 14 aa, Borrelia burgdorferi B31
YASEHRLLVEIKKT

SEQ ID NO: 117593 - protein, 14 aa, Borrelia burgdorferi B31
ASEHRLLVEIKKTL

SEQ ID NO: 117594 - protein, 14 aa, Borrelia burgdorferi B31
SEHRLLVEIKKTLI

SEQ ID NO: 117595 - protein, 14 aa, Borrelia burgdorferi B31
EHRLLVEIKKTLIS

SEQ ID NO: 117596 - protein, 14 aa, Borrelia burgdorferi B31
HRLLVEIKKTLISL

SEQ ID NO: 117597 - protein, 14 aa, Borrelia burgdorferi B31
RLLVEIKKTLISLK

SEQ ID NO: 117598 - protein, 14 aa, Borrelia burgdorferi B31
LLVEIKKTLISLKD

SEQ ID NO: 117599 - protein, 14 aa, Borrelia burgdorferi B31
LVEIKKTLISLKDP

SEQ ID NO: 117600 - protein, 14 aa, Borrelia burgdorferi B31
VEIKKTLISLKDPN

SEQ ID NO: 117601 - protein, 14 aa, Borrelia burgdorferi B31
EIKKTLISLKDPNY

SEQ ID NO: 117602 - protein, 14 aa, Borrelia burgdorferi B31
IKKTLISLKDPNYR

SEQ ID NO: 117603 - protein, 14 aa, Borrelia burgdorferi B31
KKTLISLKDPNYRG

SEQ ID NO: 117604 - protein, 14 aa, Borrelia burgdorferi B31
KTLISLKDPNYRGV

SEQ ID NO: 117605 - protein, 14 aa, Borrelia burgdorferi B31
TLISLKDPNYRGVV

SEQ ID NO: 117606 - protein, 14 aa, Borrelia burgdorferi B31
LISLKDPNYRGVVL

SEQ ID NO: 117607 - protein, 14 aa, Borrelia burgdorferi B31
ISLKDPNYRGVVLP

SEQ ID NO: 117608 - protein, 14 aa, Borrelia burgdorferi B31
SLKDPNYRGVVLPV

SEQ ID NO: 117609 - protein, 14 aa, Borrelia burgdorferi B31
LKDPNYRGVVLPVS

SEQ ID NO: 117610 - protein, 14 aa, Borrelia burgdorferi B31
KDPNYRGVVLPVSD

SEQ ID NO: 117611 - protein, 14 aa, Borrelia burgdorferi B31
DPNYRGVVLPVSDY

SEQ ID NO: 117612 - protein, 14 aa, Borrelia burgdorferi B31
PNYRGVVLPVSDYN

SEQ ID NO: 117613 - protein, 14 aa, Borrelia burgdorferi B31
NYRGVVLPVSDYNE

SEQ ID NO: 117614 - protein, 14 aa, Borrelia burgdorferi B31
YRGVVLPVSDYNEE

SEQ ID NO: 117615 - protein, 14 aa, Borrelia burgdorferi B31
RGVVLPVSDYNEEY

SEQ ID NO: 117616 - protein, 14 aa, Borrelia burgdorferi B31
GVVLPVSDYNEEYF

SEQ ID NO: 117617 - protein, 14 aa, Borrelia burgdorferi B31
VVLPVSDYNEEYFN

SEQ ID NO: 117618 - protein, 14 aa, Borrelia burgdorferi B31
VLPVSDYNEEYFNK

SEQ ID NO: 117619 - protein, 14 aa, Borrelia burgdorferi B31
LPVSDYNEEYFNKF

SEQ ID NO: 117620 - protein, 14 aa, Borrelia burgdorferi B31
PVSDYNEEYFNKFF

SEQ ID NO: 117621 - protein, 14 aa, Borrelia burgdorferi B31
VSDYNEEYFNKFFL

SEQ ID NO: 117622 - protein, 14 aa, Borrelia burgdorferi B31
SDYNEEYFNKFFLD

SEQ ID NO: 117623 - protein, 14 aa, Borrelia burgdorferi B31
DYNEEYFNKFFLDL

SEQ ID NO: 117624 - protein, 14 aa, Borrelia burgdorferi B31
YNEEYFNKFFLDLG

SEQ ID NO: 117625 - protein, 14 aa, Borrelia burgdorferi B31
NEEYFNKFFLDLGS

SEQ ID NO: 117626 - protein, 14 aa, Borrelia burgdorferi B31
EEYFNKFFLDLGSE

SEQ ID NO: 117627 - protein, 14 aa, Borrelia burgdorferi B31
EYFNKFFLDLGSEQ

SEQ ID NO: 117628 - protein, 14 aa, Borrelia burgdorferi B31
YFNKFFLDLGSEQS

SEQ ID NO: 117629 - protein, 14 aa, Borrelia burgdorferi B31
FNKFFLDLGSEQSK

SEQ ID NO: 117630 - protein, 14 aa, Borrelia burgdorferi B31
NKFFLDLGSEQSKD

SEQ ID NO: 117631 - protein, 14 aa, Borrelia burgdorferi B31
KFFLDLGSEQSKDL

SEQ ID NO: 117632 - protein, 14 aa, Borrelia burgdorferi B31
FFLDLGSEQSKDLI

SEQ ID NO: 117633 - protein, 14 aa, Borrelia burgdorferi B31
FLDLGSEQSKDLIK

SEQ ID NO: 117634 - protein, 14 aa, Borrelia burgdorferi B31
LDLGSEQSKDLIKL

SEQ ID NO: 117635 - protein, 14 aa, Borrelia burgdorferi B31
DLGSEQSKDLIKLF

SEQ ID NO: 117636 - protein, 14 aa, Borrelia burgdorferi B31
LGSEQSKDLIKLFI

SEQ ID NO: 117637 - protein, 14 aa, Borrelia burgdorferi B31
GSEQSKDLIKLFIM

SEQ ID NO: 117638 - protein, 14 aa, Borrelia burgdorferi B31
SEQSKDLIKLFIMV

SEQ ID NO: 117639 - protein, 14 aa, Borrelia burgdorferi B31
EQSKDLIKLFIMVK

SEQ ID NO: 117640 - protein, 14 aa, Borrelia burgdorferi B31
QSKDLIKLFIMVKN

SEQ ID NO: 117641 - protein, 14 aa, Borrelia burgdorferi B31
SKDLIKLFIMVKNE

SEQ ID NO: 117642 - protein, 14 aa, Borrelia burgdorferi B31
KDLIKLFIMVKNEQ

SEQ ID NO: 117643 - protein, 14 aa, Borrelia burgdorferi B31
DLIKLFIMVKNEQN

SEQ ID NO: 117644 - protein, 14 aa, Borrelia burgdorferi B31
LIKLFIMVKNEQNN

SEQ ID NO: 117645 - protein, 14 aa, Borrelia burgdorferi B31
IKLFIMVKNEQNNN

SEQ ID NO: 117646 - protein, 14 aa, Borrelia burgdorferi B31
KLFIMVKNEQNNNK

SEQ ID NO: 117647 - protein, 14 aa, Borrelia burgdorferi B31
LFIMVKNEQNNNKF

SEQ ID NO: 117648 - protein, 14 aa, Borrelia burgdorferi B31
FIMVKNEQNNNKFM

SEQ ID NO: 117649 - protein, 14 aa, Borrelia burgdorferi B31
IMVKNEQNNNKFMR

SEQ ID NO: 117650 - protein, 14 aa, Borrelia burgdorferi B31
MVKNEQNNNKFMRI

SEQ ID NO: 117651 - protein, 14 aa, Borrelia burgdorferi B31
VKNEQNNNKFMRIV

SEQ ID NO: 117652 - protein, 14 aa, Borrelia burgdorferi B31
KNEQNNNKFMRIVR

SEQ ID NO: 117653 - protein, 14 aa, Borrelia burgdorferi B31
NEQNNNKFMRIVRW

SEQ ID NO: 117654 - protein, 14 aa, Borrelia burgdorferi B31
EQNNNKFMRIVRWL

SEQ ID NO: 117655 - protein, 14 aa, Borrelia burgdorferi B31
QNNNKFMRIVRWLY

SEQ ID NO: 117656 - protein, 14 aa, Borrelia burgdorferi B31
NNNKFMRIVRWLYS

SEQ ID NO: 117657 - protein, 14 aa, Borrelia burgdorferi B31
NNKFMRIVRWLYSC

SEQ ID NO: 117658 - protein, 14 aa, Borrelia burgdorferi B31
NKFMRIVRWLYSCI

SEQ ID NO: 117659 - protein, 14 aa, Borrelia burgdorferi B31
KFMRIVRWLYSCIE

SEQ ID NO: 117660 - protein, 14 aa, Borrelia burgdorferi B31
FMRIVRWLYSCIEE

SEQ ID NO: 117661 - protein, 14 aa, Borrelia burgdorferi B31
MRIVRWLYSCIEEL

SEQ ID NO: 117662 - protein, 14 aa, Borrelia burgdorferi B31
RIVRWLYSCIEELY

SEQ ID NO: 117663 - protein, 14 aa, Borrelia burgdorferi B31
IVRWLYSCIEELYS

SEQ ID NO: 117664 - protein, 14 aa, Borrelia burgdorferi B31
VRWLYSCIEELYSP

SEQ ID NO: 117665 - protein, 14 aa, Borrelia burgdorferi B31
RWLYSCIEELYSPD

SEQ ID NO: 117666 - protein, 14 aa, Borrelia burgdorferi B31
WLYSCIEELYSPDI

SEQ ID NO: 117667 - protein, 14 aa, Borrelia burgdorferi B31
LYSCIEELYSPDIK

SEQ ID NO: 117668 - protein, 14 aa, Borrelia burgdorferi B31
YSCIEELYSPDIKY

SEQ ID NO: 117669 - protein, 14 aa, Borrelia burgdorferi B31
SCIEELYSPDIKYS

SEQ ID NO: 117670 - protein, 14 aa, Borrelia burgdorferi B31
CIEELYSPDIKYSG

SEQ ID NO: 117671 - protein, 14 aa, Borrelia burgdorferi B31
IEELYSPDIKYSGE

SEQ ID NO: 117672 - protein, 14 aa, Borrelia burgdorferi B31
EELYSPDIKYSGEE

SEQ ID NO: 117673 - protein, 14 aa, Borrelia burgdorferi B31
ELYSPDIKYSGEEG

SEQ ID NO: 117674 - protein, 14 aa, Borrelia burgdorferi B31
LYSPDIKYSGEEGS

SEQ ID NO: 117675 - protein, 14 aa, Borrelia burgdorferi B31
YSPDIKYSGEEGSP

SEQ ID NO: 117676 - protein, 14 aa, Borrelia burgdorferi B31
SPDIKYSGEEGSPE

SEQ ID NO: 117677 - protein, 14 aa, Borrelia burgdorferi B31
PDIKYSGEEGSPEY

SEQ ID NO: 117678 - protein, 14 aa, Borrelia burgdorferi B31
DIKYSGEEGSPEYY

SEQ ID NO: 117679 - protein, 14 aa, Borrelia burgdorferi B31
IKYSGEEGSPEYYR

SEQ ID NO: 117680 - protein, 14 aa, Borrelia burgdorferi B31
KYSGEEGSPEYYRN

SEQ ID NO: 117681 - protein, 14 aa, Borrelia burgdorferi B31
YSGEEGSPEYYRNM

SEQ ID NO: 117682 - protein, 14 aa, Borrelia burgdorferi B31
SGEEGSPEYYRNMP

SEQ ID NO: 117683 - protein, 14 aa, Borrelia burgdorferi B31
GEEGSPEYYRNMPR

SEQ ID NO: 117684 - protein, 14 aa, Borrelia burgdorferi B31
EEGSPEYYRNMPRP

SEQ ID NO: 117685 - protein, 14 aa, Borrelia burgdorferi B31
EGSPEYYRNMPRPT

SEQ ID NO: 117686 - protein, 14 aa, Borrelia burgdorferi B31
GSPEYYRNMPRPTA

SEQ ID NO: 117687 - protein, 14 aa, Borrelia burgdorferi B31
SPEYYRNMPRPTAY

SEQ ID NO: 117688 - protein, 14 aa, Borrelia burgdorferi B31
PEYYRNMPRPTAYQ

SEQ ID NO: 117689 - protein, 14 aa, Borrelia burgdorferi B31
EYYRNMPRPTAYQQ

SEQ ID NO: 117690 - protein, 14 aa, Borrelia burgdorferi B31
YYRNMPRPTAYQQY

SEQ ID NO: 117691 - protein, 14 aa, Borrelia burgdorferi B31
YRNMPRPTAYQQYL

SEQ ID NO: 117692 - protein, 14 aa, Borrelia burgdorferi B31
RNMPRPTAYQQYLK

SEQ ID NO: 117693 - protein, 14 aa, Borrelia burgdorferi B31
NMPRPTAYQQYLKV

SEQ ID NO: 117694 - protein, 14 aa, Borrelia burgdorferi B31
MPRPTAYQQYLKVK

SEQ ID NO: 117695 - protein, 14 aa, Borrelia burgdorferi B31
PRPTAYQQYLKVKR

SEQ ID NO: 117696 - protein, 14 aa, Borrelia burgdorferi B31
RPTAYQQYLKVKRY

SEQ ID NO: 117697 - protein, 14 aa, Borrelia burgdorferi B31
PTAYQQYLKVKRYD

SEQ ID NO: 117698 - protein, 14 aa, Borrelia burgdorferi B31
TAYQQYLKVKRYDY

SEQ ID NO: 117699 - protein, 14 aa, Borrelia burgdorferi B31
AYQQYLKVKRYDYN

SEQ ID NO: 117700 - protein, 14 aa, Borrelia burgdorferi B31
YQQYLKVKRYDYNR

SEQ ID NO: 117701 - protein, 14 aa, Borrelia burgdorferi B31
QQYLKVKRYDYNRP

SEQ ID NO: 117702 - protein, 14 aa, Borrelia burgdorferi B31
QYLKVKRYDYNRPV

SEQ ID NO: 117703 - protein, 14 aa, Borrelia burgdorferi B31
YLKVKRYDYNRPVP

SEQ ID NO: 117704 - protein, 14 aa, Borrelia burgdorferi B31
LKVKRYDYNRPVPI

SEQ ID NO: 117705 - protein, 14 aa, Borrelia burgdorferi B31
KVKRYDYNRPVPIL

SEQ ID NO: 117706 - protein, 14 aa, Borrelia burgdorferi B31
VKRYDYNRPVPILP

SEQ ID NO: 117707 - protein, 14 aa, Borrelia burgdorferi B31
KRYDYNRPVPILPT

SEQ ID NO: 117708 - protein, 15 aa, Borrelia burgdorferi B31
MRILVGVCIIALALL

SEQ ID NO: 117709 - protein, 15 aa, Borrelia burgdorferi B31
RILVGVCIIALALLG

SEQ ID NO: 117710 - protein, 15 aa, Borrelia burgdorferi B31
ILVGVCIIALALLGC

SEQ ID NO: 117711 - protein, 15 aa, Borrelia burgdorferi B31
LVGVCIIALALLGCY

SEQ ID NO: 117712 - protein, 15 aa, Borrelia burgdorferi B31
VGVCIIALALLGCYL

SEQ ID NO: 117713 - protein, 15 aa, Borrelia burgdorferi B31
GVCIIALALLGCYLP

SEQ ID NO: 117714 - protein, 15 aa, Borrelia burgdorferi B31
VCIIALALLGCYLPD

SEQ ID NO: 117715 - protein, 15 aa, Borrelia burgdorferi B31
CIIALALLGCYLPDN

SEQ ID NO: 117716 - protein, 15 aa, Borrelia burgdorferi B31
IIALALLGCYLPDNQ

SEQ ID NO: 117717 - protein, 15 aa, Borrelia burgdorferi B31
IALALLGCYLPDNQE

SEQ ID NO: 117718 - protein, 15 aa, Borrelia burgdorferi B31
ALALLGCYLPDNQEQ

SEQ ID NO: 117719 - protein, 15 aa, Borrelia burgdorferi B31
LALLGCYLPDNQEQA

SEQ ID NO: 117720 - protein, 15 aa, Borrelia burgdorferi B31
ALLGCYLPDNQEQAV

SEQ ID NO: 117721 - protein, 15 aa, Borrelia burgdorferi B31
LLGCYLPDNQEQAVQ

SEQ ID NO: 117722 - protein, 15 aa, Borrelia burgdorferi B31
LGCYLPDNQEQAVQT

SEQ ID NO: 117723 - protein, 15 aa, Borrelia burgdorferi B31
GCYLPDNQEQAVQTF

SEQ ID NO: 117724 - protein, 15 aa, Borrelia burgdorferi B31
CYLPDNQEQAVQTFF

SEQ ID NO: 117725 - protein, 15 aa, Borrelia burgdorferi B31
YLPDNQEQAVQTFFE

SEQ ID NO: 117726 - protein, 15 aa, Borrelia burgdorferi B31
LPDNQEQAVQTFFEN

SEQ ID NO: 117727 - protein, 15 aa, Borrelia burgdorferi B31
PDNQEQAVQTFFENS

SEQ ID NO: 117728 - protein, 15 aa, Borrelia burgdorferi B31
DNQEQAVQTFFENSE

SEQ ID NO: 117729 - protein, 15 aa, Borrelia burgdorferi B31
NQEQAVQTFFENSES

SEQ ID NO: 117730 - protein, 15 aa, Borrelia burgdorferi B31
QEQAVQTFFENSESS

SEQ ID NO: 117731 - protein, 15 aa, Borrelia burgdorferi B31
EQAVQTFFENSESSD

SEQ ID NO: 117732 - protein, 15 aa, Borrelia burgdorferi B31
QAVQTFFENSESSDM

SEQ ID NO: 117733 - protein, 15 aa, Borrelia burgdorferi B31
AVQTFFENSESSDMG

SEQ ID NO: 117734 - protein, 15 aa, Borrelia burgdorferi B31
VQTFFENSESSDMGS

SEQ ID NO: 117735 - protein, 15 aa, Borrelia burgdorferi B31
QTFFENSESSDMGSD

SEQ ID NO: 117736 - protein, 15 aa, Borrelia burgdorferi B31
TFFENSESSDMGSDE

SEQ ID NO: 117737 - protein, 15 aa, Borrelia burgdorferi B31
FFENSESSDMGSDEI

SEQ ID NO: 117738 - protein, 15 aa, Borrelia burgdorferi B31
FENSESSDMGSDEIV

SEQ ID NO: 117739 - protein, 15 aa, Borrelia burgdorferi B31
ENSESSDMGSDEIVT

SEQ ID NO: 117740 - protein, 15 aa, Borrelia burgdorferi B31
NSESSDMGSDEIVTE

SEQ ID NO: 117741 - protein, 15 aa, Borrelia burgdorferi B31
SESSDMGSDEIVTEG

SEQ ID NO: 117742 - protein, 15 aa, Borrelia burgdorferi B31
ESSDMGSDEIVTEGI

SEQ ID NO: 117743 - protein, 15 aa, Borrelia burgdorferi B31
SSDMGSDEIVTEGIF

SEQ ID NO: 117744 - protein, 15 aa, Borrelia burgdorferi B31
SDMGSDEIVTEGIFS

SEQ ID NO: 117745 - protein, 15 aa, Borrelia burgdorferi B31
DMGSDEIVTEGIFSS

SEQ ID NO: 117746 - protein, 15 aa, Borrelia burgdorferi B31
MGSDEIVTEGIFSSL

SEQ ID NO: 117747 - protein, 15 aa, Borrelia burgdorferi B31
GSDEIVTEGIFSSLK

SEQ ID NO: 117748 - protein, 15 aa, Borrelia burgdorferi B31
SDEIVTEGIFSSLKL

SEQ ID NO: 117749 - protein, 15 aa, Borrelia burgdorferi B31
DEIVTEGIFSSLKLY

SEQ ID NO: 117750 - protein, 15 aa, Borrelia burgdorferi B31
EIVTEGIFSSLKLYA

SEQ ID NO: 117751 - protein, 15 aa, Borrelia burgdorferi B31
IVTEGIFSSLKLYAS

SEQ ID NO: 117752 - protein, 15 aa, Borrelia burgdorferi B31
VTEGIFSSLKLYASE

SEQ ID NO: 117753 - protein, 15 aa, Borrelia burgdorferi B31
TEGIFSSLKLYASEH

SEQ ID NO: 117754 - protein, 15 aa, Borrelia burgdorferi B31
EGIFSSLKLYASEHR

SEQ ID NO: 117755 - protein, 15 aa, Borrelia burgdorferi B31
GIFSSLKLYASEHRL

SEQ ID NO: 117756 - protein, 15 aa, Borrelia burgdorferi B31
IFSSLKLYASEHRLL

SEQ ID NO: 117757 - protein, 15 aa, Borrelia burgdorferi B31
FSSLKLYASEHRLLV

SEQ ID NO: 117758 - protein, 15 aa, Borrelia burgdorferi B31
SSLKLYASEHRLLVE

SEQ ID NO: 117759 - protein, 15 aa, Borrelia burgdorferi B31
SLKLYASEHRLLVEI

SEQ ID NO: 117760 - protein, 15 aa, Borrelia burgdorferi B31
LKLYASEHRLLVEIK

SEQ ID NO: 117761 - protein, 15 aa, Borrelia burgdorferi B31
KLYASEHRLLVEIKK

SEQ ID NO: 117762 - protein, 15 aa, Borrelia burgdorferi B31
LYASEHRLLVEIKKT

SEQ ID NO: 117763 - protein, 15 aa, Borrelia burgdorferi B31
YASEHRLLVEIKKTL

SEQ ID NO: 117764 - protein, 15 aa, Borrelia burgdorferi B31
ASEHRLLVEIKKTLI

SEQ ID NO: 117765 - protein, 15 aa, Borrelia burgdorferi B31
SEHRLLVEIKKTLIS

SEQ ID NO: 117766 - protein, 15 aa, Borrelia burgdorferi B31
EHRLLVEIKKTLISL

SEQ ID NO: 117767 - protein, 15 aa, Borrelia burgdorferi B31
HRLLVEIKKTLISLK

SEQ ID NO: 117768 - protein, 15 aa, Borrelia burgdorferi B31
RLLVEIKKTLISLKD

SEQ ID NO: 117769 - protein, 15 aa, Borrelia burgdorferi B31
LLVEIKKTLISLKDP

SEQ ID NO: 117770 - protein, 15 aa, Borrelia burgdorferi B31
LVEIKKTLISLKDPN

SEQ ID NO: 117771 - protein, 15 aa, Borrelia burgdorferi B31
VEIKKTLISLKDPNY

SEQ ID NO: 117772 - protein, 15 aa, Borrelia burgdorferi B31
EIKKTLISLKDPNYR

SEQ ID NO: 117773 - protein, 15 aa, Borrelia burgdorferi B31
IKKTLISLKDPNYRG

SEQ ID NO: 117774 - protein, 15 aa, Borrelia burgdorferi B31
KKTLISLKDPNYRGV

SEQ ID NO: 117775 - protein, 15 aa, Borrelia burgdorferi B31
KTLISLKDPNYRGVV

SEQ ID NO: 117776 - protein, 15 aa, Borrelia burgdorferi B31
TLISLKDPNYRGVVL

SEQ ID NO: 117777 - protein, 15 aa, Borrelia burgdorferi B31
LISLKDPNYRGVVLP

SEQ ID NO: 117778 - protein, 15 aa, Borrelia burgdorferi B31
ISLKDPNYRGVVLPV

SEQ ID NO: 117779 - protein, 15 aa, Borrelia burgdorferi B31
SLKDPNYRGVVLPVS

SEQ ID NO: 117780 - protein, 15 aa, Borrelia burgdorferi B31
LKDPNYRGVVLPVSD

SEQ ID NO: 117781 - protein, 15 aa, Borrelia burgdorferi B31
KDPNYRGVVLPVSDY

SEQ ID NO: 117782 - protein, 15 aa, Borrelia burgdorferi B31
DPNYRGVVLPVSDYN

SEQ ID NO: 117783 - protein, 15 aa, Borrelia burgdorferi B31
PNYRGVVLPVSDYNE

SEQ ID NO: 117784 - protein, 15 aa, Borrelia burgdorferi B31
NYRGVVLPVSDYNEE

SEQ ID NO: 117785 - protein, 15 aa, Borrelia burgdorferi B31
YRGVVLPVSDYNEEY

SEQ ID NO: 117786 - protein, 15 aa, Borrelia burgdorferi B31
RGVVLPVSDYNEEYF

SEQ ID NO: 117787 - protein, 15 aa, Borrelia burgdorferi B31
GVVLPVSDYNEEYFN

SEQ ID NO: 117788 - protein, 15 aa, Borrelia burgdorferi B31
VVLPVSDYNEEYFNK

SEQ ID NO: 117789 - protein, 15 aa, Borrelia burgdorferi B31
VLPVSDYNEEYFNKF

SEQ ID NO: 117790 - protein, 15 aa, Borrelia burgdorferi B31
LPVSDYNEEYFNKFF

SEQ ID NO: 117791 - protein, 15 aa, Borrelia burgdorferi B31
PVSDYNEEYFNKFFL

SEQ ID NO: 117792 - protein, 15 aa, Borrelia burgdorferi B31
VSDYNEEYFNKFFLD

SEQ ID NO: 117793 - protein, 15 aa, Borrelia burgdorferi B31
SDYNEEYFNKFFLDL

SEQ ID NO: 117794 - protein, 15 aa, Borrelia burgdorferi B31
DYNEEYFNKFFLDLG

SEQ ID NO: 117795 - protein, 15 aa, Borrelia burgdorferi B31
YNEEYFNKFFLDLGS

SEQ ID NO: 117796 - protein, 15 aa, Borrelia burgdorferi B31
NEEYFNKFFLDLGSE

SEQ ID NO: 117797 - protein, 15 aa, Borrelia burgdorferi B31
EEYFNKFFLDLGSEQ

SEQ ID NO: 117798 - protein, 15 aa, Borrelia burgdorferi B31
EYFNKFFLDLGSEQS

SEQ ID NO: 117799 - protein, 15 aa, Borrelia burgdorferi B31
YFNKFFLDLGSEQSK

SEQ ID NO: 117800 - protein, 15 aa, Borrelia burgdorferi B31
FNKFFLDLGSEQSKD

SEQ ID NO: 117801 - protein, 15 aa, Borrelia burgdorferi B31
NKFFLDLGSEQSKDL

SEQ ID NO: 117802 - protein, 15 aa, Borrelia burgdorferi B31
KFFLDLGSEQSKDLI

SEQ ID NO: 117803 - protein, 15 aa, Borrelia burgdorferi B31
FFLDLGSEQSKDLIK

SEQ ID NO: 117804 - protein, 15 aa, Borrelia burgdorferi B31
FLDLGSEQSKDLIKL

SEQ ID NO: 117805 - protein, 15 aa, Borrelia burgdorferi B31
LDLGSEQSKDLIKLF

SEQ ID NO: 117806 - protein, 15 aa, Borrelia burgdorferi B31
DLGSEQSKDLIKLFI

SEQ ID NO: 117807 - protein, 15 aa, Borrelia burgdorferi B31
LGSEQSKDLIKLFIM

SEQ ID NO: 117808 - protein, 15 aa, Borrelia burgdorferi B31
GSEQSKDLIKLFIMV

SEQ ID NO: 117809 - protein, 15 aa, Borrelia burgdorferi B31
SEQSKDLIKLFIMVK

SEQ ID NO: 117810 - protein, 15 aa, Borrelia burgdorferi B31
EQSKDLIKLFIMVKN

SEQ ID NO: 117811 - protein, 15 aa, Borrelia burgdorferi B31
QSKDLIKLFIMVKNE

SEQ ID NO: 117812 - protein, 15 aa, Borrelia burgdorferi B31
SKDLIKLFIMVKNEQ

SEQ ID NO: 117813 - protein, 15 aa, Borrelia burgdorferi B31
KDLIKLFIMVKNEQN

SEQ ID NO: 117814 - protein, 15 aa, Borrelia burgdorferi B31
DLIKLFIMVKNEQNN

SEQ ID NO: 117815 - protein, 15 aa, Borrelia burgdorferi B31
LIKLFIMVKNEQNNN

SEQ ID NO: 117816 - protein, 15 aa, Borrelia burgdorferi B31
IKLFIMVKNEQNNNK

SEQ ID NO: 117817 - protein, 15 aa, Borrelia burgdorferi B31
KLFIMVKNEQNNNKF

SEQ ID NO: 117818 - protein, 15 aa, Borrelia burgdorferi B31
LFIMVKNEQNNNKFM

SEQ ID NO: 117819 - protein, 15 aa, Borrelia burgdorferi B31
FIMVKNEQNNNKFMR

SEQ ID NO: 117820 - protein, 15 aa, Borrelia burgdorferi B31
IMVKNEQNNNKFMRI

SEQ ID NO: 117821 - protein, 15 aa, Borrelia burgdorferi B31
MVKNEQNNNKFMRIV

SEQ ID NO: 117822 - protein, 15 aa, Borrelia burgdorferi B31
VKNEQNNNKFMRIVR

SEQ ID NO: 117823 - protein, 15 aa, Borrelia burgdorferi B31
KNEQNNNKFMRIVRW

SEQ ID NO: 117824 - protein, 15 aa, Borrelia burgdorferi B31
NEQNNNKFMRIVRWL

SEQ ID NO: 117825 - protein, 15 aa, Borrelia burgdorferi B31
EQNNNKFMRIVRWLY

SEQ ID NO: 117826 - protein, 15 aa, Borrelia burgdorferi B31
QNNNKFMRIVRWLYS

SEQ ID NO: 117827 - protein, 15 aa, Borrelia burgdorferi B31
NNNKFMRIVRWLYSC

SEQ ID NO: 117828 - protein, 15 aa, Borrelia burgdorferi B31
NNKFMRIVRWLYSCI

SEQ ID NO: 117829 - protein, 15 aa, Borrelia burgdorferi B31
NKFMRIVRWLYSCIE

SEQ ID NO: 117830 - protein, 15 aa, Borrelia burgdorferi B31
KFMRIVRWLYSCIEE

SEQ ID NO: 117831 - protein, 15 aa, Borrelia burgdorferi B31
FMRIVRWLYSCIEEL

SEQ ID NO: 117832 - protein, 15 aa, Borrelia burgdorferi B31
MRIVRWLYSCIEELY

SEQ ID NO: 117833 - protein, 15 aa, Borrelia burgdorferi B31
RIVRWLYSCIEELYS

SEQ ID NO: 117834 - protein, 15 aa, Borrelia burgdorferi B31
IVRWLYSCIEELYSP

SEQ ID NO: 117835 - protein, 15 aa, Borrelia burgdorferi B31
VRWLYSCIEELYSPD

SEQ ID NO: 117836 - protein, 15 aa, Borrelia burgdorferi B31
RWLYSCIEELYSPDI

SEQ ID NO: 117837 - protein, 15 aa, Borrelia burgdorferi B31
WLYSCIEELYSPDIK

SEQ ID NO: 117838 - protein, 15 aa, Borrelia burgdorferi B31
LYSCIEELYSPDIKY

SEQ ID NO: 117839 - protein, 15 aa, Borrelia burgdorferi B31
YSCIEELYSPDIKYS

SEQ ID NO: 117840 - protein, 15 aa, Borrelia burgdorferi B31
SCIEELYSPDIKYSG

SEQ ID NO: 117841 - protein, 15 aa, Borrelia burgdorferi B31
CIEELYSPDIKYSGE

SEQ ID NO: 117842 - protein, 15 aa, Borrelia burgdorferi B31
IEELYSPDIKYSGEE

SEQ ID NO: 117843 - protein, 15 aa, Borrelia burgdorferi B31
EELYSPDIKYSGEEG

SEQ ID NO: 117844 - protein, 15 aa, Borrelia burgdorferi B31
ELYSPDIKYSGEEGS

SEQ ID NO: 117845 - protein, 15 aa, Borrelia burgdorferi B31
LYSPDIKYSGEEGSP

SEQ ID NO: 117846 - protein, 15 aa, Borrelia burgdorferi B31
YSPDIKYSGEEGSPE

SEQ ID NO: 117847 - protein, 15 aa, Borrelia burgdorferi B31
SPDIKYSGEEGSPEY

SEQ ID NO: 117848 - protein, 15 aa, Borrelia burgdorferi B31
PDIKYSGEEGSPEYY

SEQ ID NO: 117849 - protein, 15 aa, Borrelia burgdorferi B31
DIKYSGEEGSPEYYR

SEQ ID NO: 117850 - protein, 15 aa, Borrelia burgdorferi B31
IKYSGEEGSPEYYRN

SEQ ID NO: 117851 - protein, 15 aa, Borrelia burgdorferi B31
KYSGEEGSPEYYRNM

SEQ ID NO: 117852 - protein, 15 aa, Borrelia burgdorferi B31
YSGEEGSPEYYRNMP

SEQ ID NO: 117853 - protein, 15 aa, Borrelia burgdorferi B31
SGEEGSPEYYRNMPR

SEQ ID NO: 117854 - protein, 15 aa, Borrelia burgdorferi B31
GEEGSPEYYRNMPRP

SEQ ID NO: 117855 - protein, 15 aa, Borrelia burgdorferi B31
EEGSPEYYRNMPRPT

SEQ ID NO: 117856 - protein, 15 aa, Borrelia burgdorferi B31
EGSPEYYRNMPRPTA

SEQ ID NO: 117857 - protein, 15 aa, Borrelia burgdorferi B31
GSPEYYRNMPRPTAY

SEQ ID NO: 117858 - protein, 15 aa, Borrelia burgdorferi B31
SPEYYRNMPRPTAYQ

SEQ ID NO: 117859 - protein, 15 aa, Borrelia burgdorferi B31
PEYYRNMPRPTAYQQ

SEQ ID NO: 117860 - protein, 15 aa, Borrelia burgdorferi B31
EYYRNMPRPTAYQQY

SEQ ID NO: 117861 - protein, 15 aa, Borrelia burgdorferi B31
YYRNMPRPTAYQQYL

SEQ ID NO: 117862 - protein, 15 aa, Borrelia burgdorferi B31
YRNMPRPTAYQQYLK

SEQ ID NO: 117863 - protein, 15 aa, Borrelia burgdorferi B31
RNMPRPTAYQQYLKV

SEQ ID NO: 117864 - protein, 15 aa, Borrelia burgdorferi B31
NMPRPTAYQQYLKVK

SEQ ID NO: 117865 - protein, 15 aa, Borrelia burgdorferi B31
MPRPTAYQQYLKVKR

SEQ ID NO: 117866 - protein, 15 aa, Borrelia burgdorferi B31
PRPTAYQQYLKVKRY

SEQ ID NO: 117867 - protein, 15 aa, Borrelia burgdorferi B31
RPTAYQQYLKVKRYD

SEQ ID NO: 117868 - protein, 15 aa, Borrelia burgdorferi B31
PTAYQQYLKVKRYDY

SEQ ID NO: 117869 - protein, 15 aa, Borrelia burgdorferi B31
TAYQQYLKVKRYDYN

SEQ ID NO: 117870 - protein, 15 aa, Borrelia burgdorferi B31
AYQQYLKVKRYDYNR

SEQ ID NO: 117871 - protein, 15 aa, Borrelia burgdorferi B31
YQQYLKVKRYDYNRP

SEQ ID NO: 117872 - protein, 15 aa, Borrelia burgdorferi B31
QQYLKVKRYDYNRPV

SEQ ID NO: 117873 - protein, 15 aa, Borrelia burgdorferi B31
QYLKVKRYDYNRPVP

SEQ ID NO: 117874 - protein, 15 aa, Borrelia burgdorferi B31
YLKVKRYDYNRPVPI

SEQ ID NO: 117875 - protein, 15 aa, Borrelia burgdorferi B31
LKVKRYDYNRPVPIL

SEQ ID NO: 117876 - protein, 15 aa, Borrelia burgdorferi B31
KVKRYDYNRPVPILP

SEQ ID NO: 117877 - protein, 15 aa, Borrelia burgdorferi B31
VKRYDYNRPVPILPT

SEQ ID NO: 117878 - protein, 16 aa, Borrelia burgdorferi B31
MRILVGVCIIALALLG

SEQ ID NO: 117879 - protein, 16 aa, Borrelia burgdorferi B31
RILVGVCIIALALLGC

SEQ ID NO: 117880 - protein, 16 aa, Borrelia burgdorferi B31
ILVGVCIIALALLGCY

SEQ ID NO: 117881 - protein, 16 aa, Borrelia burgdorferi B31
LVGVCIIALALLGCYL

SEQ ID NO: 117882 - protein, 16 aa, Borrelia burgdorferi B31
VGVCIIALALLGCYLP

SEQ ID NO: 117883 - protein, 16 aa, Borrelia burgdorferi B31
GVCIIALALLGCYLPD

SEQ ID NO: 117884 - protein, 16 aa, Borrelia burgdorferi B31
VCIIALALLGCYLPDN

SEQ ID NO: 117885 - protein, 16 aa, Borrelia burgdorferi B31
CIIALALLGCYLPDNQ

SEQ ID NO: 117886 - protein, 16 aa, Borrelia burgdorferi B31
IIALALLGCYLPDNQE

SEQ ID NO: 117887 - protein, 16 aa, Borrelia burgdorferi B31
IALALLGCYLPDNQEQ

SEQ ID NO: 117888 - protein, 16 aa, Borrelia burgdorferi B31
ALALLGCYLPDNQEQA

SEQ ID NO: 117889 - protein, 16 aa, Borrelia burgdorferi B31
LALLGCYLPDNQEQAV

SEQ ID NO: 117890 - protein, 16 aa, Borrelia burgdorferi B31
ALLGCYLPDNQEQAVQ

SEQ ID NO: 117891 - protein, 16 aa, Borrelia burgdorferi B31
LLGCYLPDNQEQAVQT

SEQ ID NO: 117892 - protein, 16 aa, Borrelia burgdorferi B31
LGCYLPDNQEQAVQTF

SEQ ID NO: 117893 - protein, 16 aa, Borrelia burgdorferi B31
GCYLPDNQEQAVQTFF

SEQ ID NO: 117894 - protein, 16 aa, Borrelia burgdorferi B31
CYLPDNQEQAVQTFFE

SEQ ID NO: 117895 - protein, 16 aa, Borrelia burgdorferi B31
YLPDNQEQAVQTFFEN

SEQ ID NO: 117896 - protein, 16 aa, Borrelia burgdorferi B31
LPDNQEQAVQTFFENS

SEQ ID NO: 117897 - protein, 16 aa, Borrelia burgdorferi B31
PDNQEQAVQTFFENSE

SEQ ID NO: 117898 - protein, 16 aa, Borrelia burgdorferi B31
DNQEQAVQTFFENSES

SEQ ID NO: 117899 - protein, 16 aa, Borrelia burgdorferi B31
NQEQAVQTFFENSESS

SEQ ID NO: 117900 - protein, 16 aa, Borrelia burgdorferi B31
QEQAVQTFFENSESSD

SEQ ID NO: 117901 - protein, 16 aa, Borrelia burgdorferi B31
EQAVQTFFENSESSDM

SEQ ID NO: 117902 - protein, 16 aa, Borrelia burgdorferi B31
QAVQTFFENSESSDMG

SEQ ID NO: 117903 - protein, 16 aa, Borrelia burgdorferi B31
AVQTFFENSESSDMGS

SEQ ID NO: 117904 - protein, 16 aa, Borrelia burgdorferi B31
VQTFFENSESSDMGSD

SEQ ID NO: 117905 - protein, 16 aa, Borrelia burgdorferi B31
QTFFENSESSDMGSDE

SEQ ID NO: 117906 - protein, 16 aa, Borrelia burgdorferi B31
TFFENSESSDMGSDEI

SEQ ID NO: 117907 - protein, 16 aa, Borrelia burgdorferi B31
FFENSESSDMGSDEIV

SEQ ID NO: 117908 - protein, 16 aa, Borrelia burgdorferi B31
FENSESSDMGSDEIVT

SEQ ID NO: 117909 - protein, 16 aa, Borrelia burgdorferi B31
ENSESSDMGSDEIVTE

SEQ ID NO: 117910 - protein, 16 aa, Borrelia burgdorferi B31
NSESSDMGSDEIVTEG

SEQ ID NO: 117911 - protein, 16 aa, Borrelia burgdorferi B31
SESSDMGSDEIVTEGI

SEQ ID NO: 117912 - protein, 16 aa, Borrelia burgdorferi B31
ESSDMGSDEIVTEGIF

SEQ ID NO: 117913 - protein, 16 aa, Borrelia burgdorferi B31
SSDMGSDEIVTEGIFS

SEQ ID NO: 117914 - protein, 16 aa, Borrelia burgdorferi B31
SDMGSDEIVTEGIFSS

SEQ ID NO: 117915 - protein, 16 aa, Borrelia burgdorferi B31
DMGSDEIVTEGIFSSL

SEQ ID NO: 117916 - protein, 16 aa, Borrelia burgdorferi B31
MGSDEIVTEGIFSSLK

SEQ ID NO: 117917 - protein, 16 aa, Borrelia burgdorferi B31
GSDEIVTEGIFSSLKL

SEQ ID NO: 117918 - protein, 16 aa, Borrelia burgdorferi B31
SDEIVTEGIFSSLKLY

SEQ ID NO: 117919 - protein, 16 aa, Borrelia burgdorferi B31
DEIVTEGIFSSLKLYA

SEQ ID NO: 117920 - protein, 16 aa, Borrelia burgdorferi B31
EIVTEGIFSSLKLYAS

SEQ ID NO: 117921 - protein, 16 aa, Borrelia burgdorferi B31
IVTEGIFSSLKLYASE

SEQ ID NO: 117922 - protein, 16 aa, Borrelia burgdorferi B31
VTEGIFSSLKLYASEH

SEQ ID NO: 117923 - protein, 16 aa, Borrelia burgdorferi B31
TEGIFSSLKLYASEHR

SEQ ID NO: 117924 - protein, 16 aa, Borrelia burgdorferi B31
EGIFSSLKLYASEHRL

SEQ ID NO: 117925 - protein, 16 aa, Borrelia burgdorferi B31
GIFSSLKLYASEHRLL

SEQ ID NO: 117926 - protein, 16 aa, Borrelia burgdorferi B31
IFSSLKLYASEHRLLV

SEQ ID NO: 117927 - protein, 16 aa, Borrelia burgdorferi B31
FSSLKLYASEHRLLVE

SEQ ID NO: 117928 - protein, 16 aa, Borrelia burgdorferi B31
SSLKLYASEHRLLVEI

SEQ ID NO: 117929 - protein, 16 aa, Borrelia burgdorferi B31
SLKLYASEHRLLVEIK

SEQ ID NO: 117930 - protein, 16 aa, Borrelia burgdorferi B31
LKLYASEHRLLVEIKK

SEQ ID NO: 117931 - protein, 16 aa, Borrelia burgdorferi B31
KLYASEHRLLVEIKKT

SEQ ID NO: 117932 - protein, 16 aa, Borrelia burgdorferi B31
LYASEHRLLVEIKKTL

SEQ ID NO: 117933 - protein, 16 aa, Borrelia burgdorferi B31
YASEHRLLVEIKKTLI

SEQ ID NO: 117934 - protein, 16 aa, Borrelia burgdorferi B31
ASEHRLLVEIKKTLIS

SEQ ID NO: 117935 - protein, 16 aa, Borrelia burgdorferi B31
SEHRLLVEIKKTLISL

SEQ ID NO: 117936 - protein, 16 aa, Borrelia burgdorferi B31
EHRLLVEIKKTLISLK

SEQ ID NO: 117937 - protein, 16 aa, Borrelia burgdorferi B31
HRLLVEIKKTLISLKD

SEQ ID NO: 117938 - protein, 16 aa, Borrelia burgdorferi B31
RLLVEIKKTLISLKDP

SEQ ID NO: 117939 - protein, 16 aa, Borrelia burgdorferi B31
LLVEIKKTLISLKDPN

SEQ ID NO: 117940 - protein, 16 aa, Borrelia burgdorferi B31
LVEIKKTLISLKDPNY

SEQ ID NO: 117941 - protein, 16 aa, Borrelia burgdorferi B31
VEIKKTLISLKDPNYR

SEQ ID NO: 117942 - protein, 16 aa, Borrelia burgdorferi B31
EIKKTLISLKDPNYRG

SEQ ID NO: 117943 - protein, 16 aa, Borrelia burgdorferi B31
IKKTLISLKDPNYRGV

SEQ ID NO: 117944 - protein, 16 aa, Borrelia burgdorferi B31
KKTLISLKDPNYRGVV

SEQ ID NO: 117945 - protein, 16 aa, Borrelia burgdorferi B31
KTLISLKDPNYRGVVL

SEQ ID NO: 117946 - protein, 16 aa, Borrelia burgdorferi B31
TLISLKDPNYRGVVLP

SEQ ID NO: 117947 - protein, 16 aa, Borrelia burgdorferi B31
LISLKDPNYRGVVLPV

SEQ ID NO: 117948 - protein, 16 aa, Borrelia burgdorferi B31
ISLKDPNYRGVVLPVS

SEQ ID NO: 117949 - protein, 16 aa, Borrelia burgdorferi B31
SLKDPNYRGVVLPVSD

SEQ ID NO: 117950 - protein, 16 aa, Borrelia burgdorferi B31
LKDPNYRGVVLPVSDY

SEQ ID NO: 117951 - protein, 16 aa, Borrelia burgdorferi B31
KDPNYRGVVLPVSDYN

SEQ ID NO: 117952 - protein, 16 aa, Borrelia burgdorferi B31
DPNYRGVVLPVSDYNE

SEQ ID NO: 117953 - protein, 16 aa, Borrelia burgdorferi B31
PNYRGVVLPVSDYNEE

SEQ ID NO: 117954 - protein, 16 aa, Borrelia burgdorferi B31
NYRGVVLPVSDYNEEY

SEQ ID NO: 117955 - protein, 16 aa, Borrelia burgdorferi B31
YRGVVLPVSDYNEEYF

SEQ ID NO: 117956 - protein, 16 aa, Borrelia burgdorferi B31
RGVVLPVSDYNEEYFN

SEQ ID NO: 117957 - protein, 16 aa, Borrelia burgdorferi B31
GVVLPVSDYNEEYFNK

SEQ ID NO: 117958 - protein, 16 aa, Borrelia burgdorferi B31
VVLPVSDYNEEYFNKF

SEQ ID NO: 117959 - protein, 16 aa, Borrelia burgdorferi B31
VLPVSDYNEEYFNKFF

SEQ ID NO: 117960 - protein, 16 aa, Borrelia burgdorferi B31
LPVSDYNEEYFNKFFL

SEQ ID NO: 117961 - protein, 16 aa, Borrelia burgdorferi B31
PVSDYNEEYFNKFFLD

SEQ ID NO: 117962 - protein, 16 aa, Borrelia burgdorferi B31
VSDYNEEYFNKFFLDL

SEQ ID NO: 117963 - protein, 16 aa, Borrelia burgdorferi B31
SDYNEEYFNKFFLDLG

SEQ ID NO: 117964 - protein, 16 aa, Borrelia burgdorferi B31
DYNEEYFNKFFLDLGS

SEQ ID NO: 117965 - protein, 16 aa, Borrelia burgdorferi B31
YNEEYFNKFFLDLGSE

SEQ ID NO: 117966 - protein, 16 aa, Borrelia burgdorferi B31
NEEYFNKFFLDLGSEQ

SEQ ID NO: 117967 - protein, 16 aa, Borrelia burgdorferi B31
EEYFNKFFLDLGSEQS

SEQ ID NO: 117968 - protein, 16 aa, Borrelia burgdorferi B31
EYFNKFFLDLGSEQSK

SEQ ID NO: 117969 - protein, 16 aa, Borrelia burgdorferi B31
YFNKFFLDLGSEQSKD

SEQ ID NO: 117970 - protein, 16 aa, Borrelia burgdorferi B31
FNKFFLDLGSEQSKDL

SEQ ID NO: 117971 - protein, 16 aa, Borrelia burgdorferi B31
NKFFLDLGSEQSKDLI

SEQ ID NO: 117972 - protein, 16 aa, Borrelia burgdorferi B31
KFFLDLGSEQSKDLIK

SEQ ID NO: 117973 - protein, 16 aa, Borrelia burgdorferi B31
FFLDLGSEQSKDLIKL

SEQ ID NO: 117974 - protein, 16 aa, Borrelia burgdorferi B31
FLDLGSEQSKDLIKLF

SEQ ID NO: 117975 - protein, 16 aa, Borrelia burgdorferi B31
LDLGSEQSKDLIKLFI

SEQ ID NO: 117976 - protein, 16 aa, Borrelia burgdorferi B31
DLGSEQSKDLIKLFIM

SEQ ID NO: 117977 - protein, 16 aa, Borrelia burgdorferi B31
LGSEQSKDLIKLFIMV

SEQ ID NO: 117978 - protein, 16 aa, Borrelia burgdorferi B31
GSEQSKDLIKLFIMVK

SEQ ID NO: 117979 - protein, 16 aa, Borrelia burgdorferi B31
SEQSKDLIKLFIMVKN

SEQ ID NO: 117980 - protein, 16 aa, Borrelia burgdorferi B31
EQSKDLIKLFIMVKNE

SEQ ID NO: 117981 - protein, 16 aa, Borrelia burgdorferi B31
QSKDLIKLFIMVKNEQ

SEQ ID NO: 117982 - protein, 16 aa, Borrelia burgdorferi B31
SKDLIKLFIMVKNEQN

SEQ ID NO: 117983 - protein, 16 aa, Borrelia burgdorferi B31
KDLIKLFIMVKNEQNN

SEQ ID NO: 117984 - protein, 16 aa, Borrelia burgdorferi B31
DLIKLFIMVKNEQNNN

SEQ ID NO: 117985 - protein, 16 aa, Borrelia burgdorferi B31
LIKLFIMVKNEQNNNK

SEQ ID NO: 117986 - protein, 16 aa, Borrelia burgdorferi B31
IKLFIMVKNEQNNNKF

SEQ ID NO: 117987 - protein, 16 aa, Borrelia burgdorferi B31
KLFIMVKNEQNNNKFM

SEQ ID NO: 117988 - protein, 16 aa, Borrelia burgdorferi B31
LFIMVKNEQNNNKFMR

SEQ ID NO: 117989 - protein, 16 aa, Borrelia burgdorferi B31
FIMVKNEQNNNKFMRI

SEQ ID NO: 117990 - protein, 16 aa, Borrelia burgdorferi B31
IMVKNEQNNNKFMRIV

SEQ ID NO: 117991 - protein, 16 aa, Borrelia burgdorferi B31
MVKNEQNNNKFMRIVR

SEQ ID NO: 117992 - protein, 16 aa, Borrelia burgdorferi B31
VKNEQNNNKFMRIVRW

SEQ ID NO: 117993 - protein, 16 aa, Borrelia burgdorferi B31
KNEQNNNKFMRIVRWL

SEQ ID NO: 117994 - protein, 16 aa, Borrelia burgdorferi B31
NEQNNNKFMRIVRWLY

SEQ ID NO: 117995 - protein, 16 aa, Borrelia burgdorferi B31
EQNNNKFMRIVRWLYS

SEQ ID NO: 117996 - protein, 16 aa, Borrelia burgdorferi B31
QNNNKFMRIVRWLYSC

SEQ ID NO: 117997 - protein, 16 aa, Borrelia burgdorferi B31
NNNKFMRIVRWLYSCI

SEQ ID NO: 117998 - protein, 16 aa, Borrelia burgdorferi B31
NNKFMRIVRWLYSCIE

SEQ ID NO: 117999 - protein, 16 aa, Borrelia burgdorferi B31
NKFMRIVRWLYSCIEE

SEQ ID NO: 118000 - protein, 16 aa, Borrelia burgdorferi B31
KFMRIVRWLYSCIEEL

SEQ ID NO: 118001 - protein, 16 aa, Borrelia burgdorferi B31
FMRIVRWLYSCIEELY

SEQ ID NO: 118002 - protein, 16 aa, Borrelia burgdorferi B31
MRIVRWLYSCIEELYS

SEQ ID NO: 118003 - protein, 16 aa, Borrelia burgdorferi B31
RIVRWLYSCIEELYSP

SEQ ID NO: 118004 - protein, 16 aa, Borrelia burgdorferi B31
IVRWLYSCIEELYSPD

SEQ ID NO: 118005 - protein, 16 aa, Borrelia burgdorferi B31
VRWLYSCIEELYSPDI

SEQ ID NO: 118006 - protein, 16 aa, Borrelia burgdorferi B31
RWLYSCIEELYSPDIK

SEQ ID NO: 118007 - protein, 16 aa, Borrelia burgdorferi B31
WLYSCIEELYSPDIKY

SEQ ID NO: 118008 - protein, 16 aa, Borrelia burgdorferi B31
LYSCIEELYSPDIKYS

SEQ ID NO: 118009 - protein, 16 aa, Borrelia burgdorferi B31
YSCIEELYSPDIKYSG

SEQ ID NO: 118010 - protein, 16 aa, Borrelia burgdorferi B31
SCIEELYSPDIKYSGE

SEQ ID NO: 118011 - protein, 16 aa, Borrelia burgdorferi B31
CIEELYSPDIKYSGEE

SEQ ID NO: 118012 - protein, 16 aa, Borrelia burgdorferi B31
IEELYSPDIKYSGEEG

SEQ ID NO: 118013 - protein, 16 aa, Borrelia burgdorferi B31
EELYSPDIKYSGEEGS

SEQ ID NO: 118014 - protein, 16 aa, Borrelia burgdorferi B31
ELYSPDIKYSGEEGSP

SEQ ID NO: 118015 - protein, 16 aa, Borrelia burgdorferi B31
LYSPDIKYSGEEGSPE

SEQ ID NO: 118016 - protein, 16 aa, Borrelia burgdorferi B31
YSPDIKYSGEEGSPEY

SEQ ID NO: 118017 - protein, 16 aa, Borrelia burgdorferi B31
SPDIKYSGEEGSPEYY

SEQ ID NO: 118018 - protein, 16 aa, Borrelia burgdorferi B31
PDIKYSGEEGSPEYYR

SEQ ID NO: 118019 - protein, 16 aa, Borrelia burgdorferi B31
DIKYSGEEGSPEYYRN

SEQ ID NO: 118020 - protein, 16 aa, Borrelia burgdorferi B31
IKYSGEEGSPEYYRNM

SEQ ID NO: 118021 - protein, 16 aa, Borrelia burgdorferi B31
KYSGEEGSPEYYRNMP

SEQ ID NO: 118022 - protein, 16 aa, Borrelia burgdorferi B31
YSGEEGSPEYYRNMPR

SEQ ID NO: 118023 - protein, 16 aa, Borrelia burgdorferi B31
SGEEGSPEYYRNMPRP

SEQ ID NO: 118024 - protein, 16 aa, Borrelia burgdorferi B31
GEEGSPEYYRNMPRPT

SEQ ID NO: 118025 - protein, 16 aa, Borrelia burgdorferi B31
EEGSPEYYRNMPRPTA

SEQ ID NO: 118026 - protein, 16 aa, Borrelia burgdorferi B31
EGSPEYYRNMPRPTAY

SEQ ID NO: 118027 - protein, 16 aa, Borrelia burgdorferi B31
GSPEYYRNMPRPTAYQ

SEQ ID NO: 118028 - protein, 16 aa, Borrelia burgdorferi B31
SPEYYRNMPRPTAYQQ

SEQ ID NO: 118029 - protein, 16 aa, Borrelia burgdorferi B31
PEYYRNMPRPTAYQQY

SEQ ID NO: 118030 - protein, 16 aa, Borrelia burgdorferi B31
EYYRNMPRPTAYQQYL

SEQ ID NO: 118031 - protein, 16 aa, Borrelia burgdorferi B31
YYRNMPRPTAYQQYLK

SEQ ID NO: 118032 - protein, 16 aa, Borrelia burgdorferi B31
YRNMPRPTAYQQYLKV

SEQ ID NO: 118033 - protein, 16 aa, Borrelia burgdorferi B31
RNMPRPTAYQQYLKVK

SEQ ID NO: 118034 - protein, 16 aa, Borrelia burgdorferi B31
NMPRPTAYQQYLKVKR

SEQ ID NO: 118035 - protein, 16 aa, Borrelia burgdorferi B31
MPRPTAYQQYLKVKRY

SEQ ID NO: 118036 - protein, 16 aa, Borrelia burgdorferi B31
PRPTAYQQYLKVKRYD

SEQ ID NO: 118037 - protein, 16 aa, Borrelia burgdorferi B31
RPTAYQQYLKVKRYDY

SEQ ID NO: 118038 - protein, 16 aa, Borrelia burgdorferi B31
PTAYQQYLKVKRYDYN

SEQ ID NO: 118039 - protein, 16 aa, Borrelia burgdorferi B31
TAYQQYLKVKRYDYNR

SEQ ID NO: 118040 - protein, 16 aa, Borrelia burgdorferi B31
AYQQYLKVKRYDYNRP

SEQ ID NO: 118041 - protein, 16 aa, Borrelia burgdorferi B31
YQQYLKVKRYDYNRPV

SEQ ID NO: 118042 - protein, 16 aa, Borrelia burgdorferi B31
QQYLKVKRYDYNRPVP

SEQ ID NO: 118043 - protein, 16 aa, Borrelia burgdorferi B31
QYLKVKRYDYNRPVPI

SEQ ID NO: 118044 - protein, 16 aa, Borrelia burgdorferi B31
YLKVKRYDYNRPVPIL

SEQ ID NO: 118045 - protein, 16 aa, Borrelia burgdorferi B31
LKVKRYDYNRPVPILP

SEQ ID NO: 118046 - protein, 16 aa, Borrelia burgdorferi B31
KVKRYDYNRPVPILPT

SEQ ID NO: 118047 - protein, 13 aa, Borrelia burgdorferi B31
MRNKNIFKLFFAS

SEQ ID NO: 118048 - protein, 13 aa, Borrelia burgdorferi B31
RNKNIFKLFFASM

SEQ ID NO: 118049 - protein, 13 aa, Borrelia burgdorferi B31
NKNIFKLFFASML

SEQ ID NO: 118050 - protein, 13 aa, Borrelia burgdorferi B31
KNIFKLFFASMLF

SEQ ID NO: 118051 - protein, 13 aa, Borrelia burgdorferi B31
NIFKLFFASMLFV

SEQ ID NO: 118052 - protein, 13 aa, Borrelia burgdorferi B31
IFKLFFASMLFVM

SEQ ID NO: 118053 - protein, 13 aa, Borrelia burgdorferi B31
FKLFFASMLFVMA

SEQ ID NO: 118054 - protein, 13 aa, Borrelia burgdorferi B31
KLFFASMLFVMAC

SEQ ID NO: 118055 - protein, 13 aa, Borrelia burgdorferi B31
LFFASMLFVMACK

SEQ ID NO: 118056 - protein, 13 aa, Borrelia burgdorferi B31
FFASMLFVMACKA

SEQ ID NO: 118057 - protein, 13 aa, Borrelia burgdorferi B31
FASMLFVMACKAY

SEQ ID NO: 118058 - protein, 13 aa, Borrelia burgdorferi B31
ASMLFVMACKAYV

SEQ ID NO: 118059 - protein, 13 aa, Borrelia burgdorferi B31
SMLFVMACKAYVE

SEQ ID NO: 118060 - protein, 13 aa, Borrelia burgdorferi B31
MLFVMACKAYVEE

SEQ ID NO: 118061 - protein, 13 aa, Borrelia burgdorferi B31
LFVMACKAYVEEK

SEQ ID NO: 118062 - protein, 13 aa, Borrelia burgdorferi B31
FVMACKAYVEEKK

SEQ ID NO: 118063 - protein, 13 aa, Borrelia burgdorferi B31
VMACKAYVEEKKE

SEQ ID NO: 118064 - protein, 13 aa, Borrelia burgdorferi B31
MACKAYVEEKKEI

SEQ ID NO: 118065 - protein, 13 aa, Borrelia burgdorferi B31
ACKAYVEEKKEID

SEQ ID NO: 118066 - protein, 13 aa, Borrelia burgdorferi B31
CKAYVEEKKEIDS

SEQ ID NO: 118067 - protein, 13 aa, Borrelia burgdorferi B31
KAYVEEKKEIDSL

SEQ ID NO: 118068 - protein, 13 aa, Borrelia burgdorferi B31
AYVEEKKEIDSLM

SEQ ID NO: 118069 - protein, 13 aa, Borrelia burgdorferi B31
YVEEKKEIDSLME

SEQ ID NO: 118070 - protein, 13 aa, Borrelia burgdorferi B31
VEEKKEIDSLMED

SEQ ID NO: 118071 - protein, 13 aa, Borrelia burgdorferi B31
EEKKEIDSLMEDV

SEQ ID NO: 118072 - protein, 13 aa, Borrelia burgdorferi B31
EKKEIDSLMEDVL

SEQ ID NO: 118073 - protein, 13 aa, Borrelia burgdorferi B31
KKEIDSLMEDVLA

SEQ ID NO: 118074 - protein, 13 aa, Borrelia burgdorferi B31
KEIDSLMEDVLAL

SEQ ID NO: 118075 - protein, 13 aa, Borrelia burgdorferi B31
EIDSLMEDVLALV

SEQ ID NO: 118076 - protein, 13 aa, Borrelia burgdorferi B31
IDSLMEDVLALVN

SEQ ID NO: 118077 - protein, 13 aa, Borrelia burgdorferi B31
DSLMEDVLALVND

SEQ ID NO: 118078 - protein, 13 aa, Borrelia burgdorferi B31
SLMEDVLALVNDS

SEQ ID NO: 118079 - protein, 13 aa, Borrelia burgdorferi B31
LMEDVLALVNDSS

SEQ ID NO: 118080 - protein, 13 aa, Borrelia burgdorferi B31
MEDVLALVNDSSG

SEQ ID NO: 118081 - protein, 13 aa, Borrelia burgdorferi B31
EDVLALVNDSSGG

SEQ ID NO: 118082 - protein, 13 aa, Borrelia burgdorferi B31
DVLALVNDSSGGK

SEQ ID NO: 118083 - protein, 13 aa, Borrelia burgdorferi B31
VLALVNDSSGGKF

SEQ ID NO: 118084 - protein, 13 aa, Borrelia burgdorferi B31
LALVNDSSGGKFK

SEQ ID NO: 118085 - protein, 13 aa, Borrelia burgdorferi B31
ALVNDSSGGKFKD

SEQ ID NO: 118086 - protein, 13 aa, Borrelia burgdorferi B31
LVNDSSGGKFKDY

SEQ ID NO: 118087 - protein, 13 aa, Borrelia burgdorferi B31
VNDSSGGKFKDYK

SEQ ID NO: 118088 - protein, 13 aa, Borrelia burgdorferi B31
NDSSGGKFKDYKD

SEQ ID NO: 118089 - protein, 13 aa, Borrelia burgdorferi B31
DSSGGKFKDYKDK

SEQ ID NO: 118090 - protein, 13 aa, Borrelia burgdorferi B31
SSGGKFKDYKDKI

SEQ ID NO: 118091 - protein, 13 aa, Borrelia burgdorferi B31
SGGKFKDYKDKIN

SEQ ID NO: 118092 - protein, 13 aa, Borrelia burgdorferi B31
GGKFKDYKDKINE

SEQ ID NO: 118093 - protein, 13 aa, Borrelia burgdorferi B31
GKFKDYKDKINEL

SEQ ID NO: 118094 - protein, 13 aa, Borrelia burgdorferi B31
KFKDYKDKINELK

SEQ ID NO: 118095 - protein, 13 aa, Borrelia burgdorferi B31
FKDYKDKINELKE

SEQ ID NO: 118096 - protein, 13 aa, Borrelia burgdorferi B31
KDYKDKINELKEN

SEQ ID NO: 118097 - protein, 13 aa, Borrelia burgdorferi B31
DYKDKINELKENL

SEQ ID NO: 118098 - protein, 13 aa, Borrelia burgdorferi B31
YKDKINELKENLK

SEQ ID NO: 118099 - protein, 13 aa, Borrelia burgdorferi B31
KDKINELKENLKD

SEQ ID NO: 118100 - protein, 13 aa, Borrelia burgdorferi B31
DKINELKENLKDI

SEQ ID NO: 118101 - protein, 13 aa, Borrelia burgdorferi B31
KINELKENLKDIG

SEQ ID NO: 118102 - protein, 13 aa, Borrelia burgdorferi B31
INELKENLKDIGN

SEQ ID NO: 118103 - protein, 13 aa, Borrelia burgdorferi B31
NELKENLKDIGNA

SEQ ID NO: 118104 - protein, 13 aa, Borrelia burgdorferi B31
ELKENLKDIGNAE

SEQ ID NO: 118105 - protein, 13 aa, Borrelia burgdorferi B31
LKENLKDIGNAEL

SEQ ID NO: 118106 - protein, 13 aa, Borrelia burgdorferi B31
KENLKDIGNAELK

SEQ ID NO: 118107 - protein, 13 aa, Borrelia burgdorferi B31
ENLKDIGNAELKE

SEQ ID NO: 118108 - protein, 13 aa, Borrelia burgdorferi B31
NLKDIGNAELKEK

SEQ ID NO: 118109 - protein, 13 aa, Borrelia burgdorferi B31
LKDIGNAELKEKL

SEQ ID NO: 118110 - protein, 13 aa, Borrelia burgdorferi B31
KDIGNAELKEKLL

SEQ ID NO: 118111 - protein, 13 aa, Borrelia burgdorferi B31
DIGNAELKEKLLN

SEQ ID NO: 118112 - protein, 13 aa, Borrelia burgdorferi B31
IGNAELKEKLLNL

SEQ ID NO: 118113 - protein, 13 aa, Borrelia burgdorferi B31
GNAELKEKLLNLQ

SEQ ID NO: 118114 - protein, 13 aa, Borrelia burgdorferi B31
NAELKEKLLNLQN

SEQ ID NO: 118115 - protein, 13 aa, Borrelia burgdorferi B31
AELKEKLLNLQNS

SEQ ID NO: 118116 - protein, 13 aa, Borrelia burgdorferi B31
ELKEKLLNLQNSF

SEQ ID NO: 118117 - protein, 13 aa, Borrelia burgdorferi B31
LKEKLLNLQNSFQ

SEQ ID NO: 118118 - protein, 13 aa, Borrelia burgdorferi B31
KEKLLNLQNSFQD

SEQ ID NO: 118119 - protein, 13 aa, Borrelia burgdorferi B31
EKLLNLQNSFQDK

SEQ ID NO: 118120 - protein, 13 aa, Borrelia burgdorferi B31
KLLNLQNSFQDKL

SEQ ID NO: 118121 - protein, 13 aa, Borrelia burgdorferi B31
LLNLQNSFQDKLA

SEQ ID NO: 118122 - protein, 13 aa, Borrelia burgdorferi B31
LNLQNSFQDKLAA

SEQ ID NO: 118123 - protein, 13 aa, Borrelia burgdorferi B31
NLQNSFQDKLAAK

SEQ ID NO: 118124 - protein, 13 aa, Borrelia burgdorferi B31
LQNSFQDKLAAKL

SEQ ID NO: 118125 - protein, 13 aa, Borrelia burgdorferi B31
QNSFQDKLAAKLA

SEQ ID NO: 118126 - protein, 13 aa, Borrelia burgdorferi B31
NSFQDKLAAKLAA

SEQ ID NO: 118127 - protein, 13 aa, Borrelia burgdorferi B31
SFQDKLAAKLAAL

SEQ ID NO: 118128 - protein, 13 aa, Borrelia burgdorferi B31
FQDKLAAKLAALK

SEQ ID NO: 118129 - protein, 13 aa, Borrelia burgdorferi B31
QDKLAAKLAALKA

SEQ ID NO: 118130 - protein, 13 aa, Borrelia burgdorferi B31
DKLAAKLAALKAA

SEQ ID NO: 118131 - protein, 13 aa, Borrelia burgdorferi B31
KLAAKLAALKAAK

SEQ ID NO: 118132 - protein, 13 aa, Borrelia burgdorferi B31
LAAKLAALKAAKN

SEQ ID NO: 118133 - protein, 13 aa, Borrelia burgdorferi B31
AAKLAALKAAKNT

SEQ ID NO: 118134 - protein, 13 aa, Borrelia burgdorferi B31
AKLAALKAAKNTI

SEQ ID NO: 118135 - protein, 13 aa, Borrelia burgdorferi B31
KLAALKAAKNTIE

SEQ ID NO: 118136 - protein, 13 aa, Borrelia burgdorferi B31
LAALKAAKNTIEN

SEQ ID NO: 118137 - protein, 13 aa, Borrelia burgdorferi B31
AALKAAKNTIENI

SEQ ID NO: 118138 - protein, 13 aa, Borrelia burgdorferi B31
ALKAAKNTIENIT

SEQ ID NO: 118139 - protein, 13 aa, Borrelia burgdorferi B31
LKAAKNTIENITD

SEQ ID NO: 118140 - protein, 13 aa, Borrelia burgdorferi B31
KAAKNTIENITDK

SEQ ID NO: 118141 - protein, 13 aa, Borrelia burgdorferi B31
AAKNTIENITDKD

SEQ ID NO: 118142 - protein, 13 aa, Borrelia burgdorferi B31
AKNTIENITDKDQ

SEQ ID NO: 118143 - protein, 13 aa, Borrelia burgdorferi B31
KNTIENITDKDQD

SEQ ID NO: 118144 - protein, 13 aa, Borrelia burgdorferi B31
NTIENITDKDQDI

SEQ ID NO: 118145 - protein, 13 aa, Borrelia burgdorferi B31
TIENITDKDQDIS

SEQ ID NO: 118146 - protein, 13 aa, Borrelia burgdorferi B31
IENITDKDQDISK

SEQ ID NO: 118147 - protein, 13 aa, Borrelia burgdorferi B31
ENITDKDQDISKR

SEQ ID NO: 118148 - protein, 13 aa, Borrelia burgdorferi B31
NITDKDQDISKRK

SEQ ID NO: 118149 - protein, 13 aa, Borrelia burgdorferi B31
ITDKDQDISKRKI

SEQ ID NO: 118150 - protein, 13 aa, Borrelia burgdorferi B31
TDKDQDISKRKIW

SEQ ID NO: 118151 - protein, 13 aa, Borrelia burgdorferi B31
DKDQDISKRKIWS

SEQ ID NO: 118152 - protein, 13 aa, Borrelia burgdorferi B31
KDQDISKRKIWSE

SEQ ID NO: 118153 - protein, 13 aa, Borrelia burgdorferi B31
DQDISKRKIWSEA

SEQ ID NO: 118154 - protein, 13 aa, Borrelia burgdorferi B31
QDISKRKIWSEAK

SEQ ID NO: 118155 - protein, 13 aa, Borrelia burgdorferi B31
DISKRKIWSEAKL

SEQ ID NO: 118156 - protein, 13 aa, Borrelia burgdorferi B31
ISKRKIWSEAKLV

SEQ ID NO: 118157 - protein, 13 aa, Borrelia burgdorferi B31
SKRKIWSEAKLVG

SEQ ID NO: 118158 - protein, 13 aa, Borrelia burgdorferi B31
KRKIWSEAKLVGV

SEQ ID NO: 118159 - protein, 13 aa, Borrelia burgdorferi B31
RKIWSEAKLVGVT

SEQ ID NO: 118160 - protein, 13 aa, Borrelia burgdorferi B31
KIWSEAKLVGVTV

SEQ ID NO: 118161 - protein, 13 aa, Borrelia burgdorferi B31
IWSEAKLVGVTVP

SEQ ID NO: 118162 - protein, 13 aa, Borrelia burgdorferi B31
WSEAKLVGVTVPL

SEQ ID NO: 118163 - protein, 13 aa, Borrelia burgdorferi B31
SEAKLVGVTVPLL

SEQ ID NO: 118164 - protein, 13 aa, Borrelia burgdorferi B31
EAKLVGVTVPLLG

SEQ ID NO: 118165 - protein, 13 aa, Borrelia burgdorferi B31
AKLVGVTVPLLGS

SEQ ID NO: 118166 - protein, 13 aa, Borrelia burgdorferi B31
KLVGVTVPLLGSN

SEQ ID NO: 118167 - protein, 13 aa, Borrelia burgdorferi B31
LVGVTVPLLGSNT

SEQ ID NO: 118168 - protein, 13 aa, Borrelia burgdorferi B31
VGVTVPLLGSNTS

SEQ ID NO: 118169 - protein, 13 aa, Borrelia burgdorferi B31
GVTVPLLGSNTSG

SEQ ID NO: 118170 - protein, 13 aa, Borrelia burgdorferi B31
VTVPLLGSNTSGN

SEQ ID NO: 118171 - protein, 13 aa, Borrelia burgdorferi B31
TVPLLGSNTSGNG

SEQ ID NO: 118172 - protein, 13 aa, Borrelia burgdorferi B31
VPLLGSNTSGNGD

SEQ ID NO: 118173 - protein, 13 aa, Borrelia burgdorferi B31
PLLGSNTSGNGDK

SEQ ID NO: 118174 - protein, 13 aa, Borrelia burgdorferi B31
LLGSNTSGNGDKM

SEQ ID NO: 118175 - protein, 13 aa, Borrelia burgdorferi B31
LGSNTSGNGDKMS

SEQ ID NO: 118176 - protein, 13 aa, Borrelia burgdorferi B31
GSNTSGNGDKMSK

SEQ ID NO: 118177 - protein, 13 aa, Borrelia burgdorferi B31
SNTSGNGDKMSKN

SEQ ID NO: 118178 - protein, 13 aa, Borrelia burgdorferi B31
NTSGNGDKMSKNA

SEQ ID NO: 118179 - protein, 13 aa, Borrelia burgdorferi B31
TSGNGDKMSKNAV

SEQ ID NO: 118180 - protein, 13 aa, Borrelia burgdorferi B31
SGNGDKMSKNAVE

SEQ ID NO: 118181 - protein, 13 aa, Borrelia burgdorferi B31
GNGDKMSKNAVEQ

SEQ ID NO: 118182 - protein, 13 aa, Borrelia burgdorferi B31
NGDKMSKNAVEQI

SEQ ID NO: 118183 - protein, 13 aa, Borrelia burgdorferi B31
GDKMSKNAVEQID

SEQ ID NO: 118184 - protein, 13 aa, Borrelia burgdorferi B31
DKMSKNAVEQIDK

SEQ ID NO: 118185 - protein, 13 aa, Borrelia burgdorferi B31
KMSKNAVEQIDKV

SEQ ID NO: 118186 - protein, 13 aa, Borrelia burgdorferi B31
MSKNAVEQIDKVI

SEQ ID NO: 118187 - protein, 13 aa, Borrelia burgdorferi B31
SKNAVEQIDKVIK

SEQ ID NO: 118188 - protein, 13 aa, Borrelia burgdorferi B31
KNAVEQIDKVIKF

SEQ ID NO: 118189 - protein, 13 aa, Borrelia burgdorferi B31
NAVEQIDKVIKFL

SEQ ID NO: 118190 - protein, 13 aa, Borrelia burgdorferi B31
AVEQIDKVIKFLE

SEQ ID NO: 118191 - protein, 13 aa, Borrelia burgdorferi B31
VEQIDKVIKFLEE

SEQ ID NO: 118192 - protein, 13 aa, Borrelia burgdorferi B31
EQIDKVIKFLEEG

SEQ ID NO: 118193 - protein, 13 aa, Borrelia burgdorferi B31
QIDKVIKFLEEGT

SEQ ID NO: 118194 - protein, 13 aa, Borrelia burgdorferi B31
IDKVIKFLEEGTN

SEQ ID NO: 118195 - protein, 14 aa, Borrelia burgdorferi B31
MRNKNIFKLFFASM

SEQ ID NO: 118196 - protein, 14 aa, Borrelia burgdorferi B31
RNKNIFKLFFASML

SEQ ID NO: 118197 - protein, 14 aa, Borrelia burgdorferi B31
NKNIFKLFFASMLF

SEQ ID NO: 118198 - protein, 14 aa, Borrelia burgdorferi B31
KNIFKLFFASMLFV

SEQ ID NO: 118199 - protein, 14 aa, Borrelia burgdorferi B31
NIFKLFFASMLFVM

SEQ ID NO: 118200 - protein, 14 aa, Borrelia burgdorferi B31
IFKLFFASMLFVMA

SEQ ID NO: 118201 - protein, 14 aa, Borrelia burgdorferi B31
FKLFFASMLFVMAC

SEQ ID NO: 118202 - protein, 14 aa, Borrelia burgdorferi B31
KLFFASMLFVMACK

SEQ ID NO: 118203 - protein, 14 aa, Borrelia burgdorferi B31
LFFASMLFVMACKA

SEQ ID NO: 118204 - protein, 14 aa, Borrelia burgdorferi B31
FFASMLFVMACKAY

SEQ ID NO: 118205 - protein, 14 aa, Borrelia burgdorferi B31
FASMLFVMACKAYV

SEQ ID NO: 118206 - protein, 14 aa, Borrelia burgdorferi B31
ASMLFVMACKAYVE

SEQ ID NO: 118207 - protein, 14 aa, Borrelia burgdorferi B31
SMLFVMACKAYVEE

SEQ ID NO: 118208 - protein, 14 aa, Borrelia burgdorferi B31
MLFVMACKAYVEEK

SEQ ID NO: 118209 - protein, 14 aa, Borrelia burgdorferi B31
LFVMACKAYVEEKK

SEQ ID NO: 118210 - protein, 14 aa, Borrelia burgdorferi B31
FVMACKAYVEEKKE

SEQ ID NO: 118211 - protein, 14 aa, Borrelia burgdorferi B31
VMACKAYVEEKKEI

SEQ ID NO: 118212 - protein, 14 aa, Borrelia burgdorferi B31
MACKAYVEEKKEID

SEQ ID NO: 118213 - protein, 14 aa, Borrelia burgdorferi B31
ACKAYVEEKKEIDS

SEQ ID NO: 118214 - protein, 14 aa, Borrelia burgdorferi B31
CKAYVEEKKEIDSL

SEQ ID NO: 118215 - protein, 14 aa, Borrelia burgdorferi B31
KAYVEEKKEIDSLM

SEQ ID NO: 118216 - protein, 14 aa, Borrelia burgdorferi B31
AYVEEKKEIDSLME

SEQ ID NO: 118217 - protein, 14 aa, Borrelia burgdorferi B31
YVEEKKEIDSLMED

SEQ ID NO: 118218 - protein, 14 aa, Borrelia burgdorferi B31
VEEKKEIDSLMEDV

SEQ ID NO: 118219 - protein, 14 aa, Borrelia burgdorferi B31
EEKKEIDSLMEDVL

SEQ ID NO: 118220 - protein, 14 aa, Borrelia burgdorferi B31
EKKEIDSLMEDVLA

SEQ ID NO: 118221 - protein, 14 aa, Borrelia burgdorferi B31
KKEIDSLMEDVLAL

SEQ ID NO: 118222 - protein, 14 aa, Borrelia burgdorferi B31
KEIDSLMEDVLALV

SEQ ID NO: 118223 - protein, 14 aa, Borrelia burgdorferi B31
EIDSLMEDVLALVN

SEQ ID NO: 118224 - protein, 14 aa, Borrelia burgdorferi B31
IDSLMEDVLALVND

SEQ ID NO: 118225 - protein, 14 aa, Borrelia burgdorferi B31
DSLMEDVLALVNDS

SEQ ID NO: 118226 - protein, 14 aa, Borrelia burgdorferi B31
SLMEDVLALVNDSS

SEQ ID NO: 118227 - protein, 14 aa, Borrelia burgdorferi B31
LMEDVLALVNDSSG

SEQ ID NO: 118228 - protein, 14 aa, Borrelia burgdorferi B31
MEDVLALVNDSSGG

SEQ ID NO: 118229 - protein, 14 aa, Borrelia burgdorferi B31
EDVLALVNDSSGGK

SEQ ID NO: 118230 - protein, 14 aa, Borrelia burgdorferi B31
DVLALVNDSSGGKF

SEQ ID NO: 118231 - protein, 14 aa, Borrelia burgdorferi B31
VLALVNDSSGGKFK

SEQ ID NO: 118232 - protein, 14 aa, Borrelia burgdorferi B31
LALVNDSSGGKFKD

SEQ ID NO: 118233 - protein, 14 aa, Borrelia burgdorferi B31
ALVNDSSGGKFKDY

SEQ ID NO: 118234 - protein, 14 aa, Borrelia burgdorferi B31
LVNDSSGGKFKDYK

SEQ ID NO: 118235 - protein, 14 aa, Borrelia burgdorferi B31
VNDSSGGKFKDYKD

SEQ ID NO: 118236 - protein, 14 aa, Borrelia burgdorferi B31
NDSSGGKFKDYKDK

SEQ ID NO: 118237 - protein, 14 aa, Borrelia burgdorferi B31
DSSGGKFKDYKDKI

SEQ ID NO: 118238 - protein, 14 aa, Borrelia burgdorferi B31
SSGGKFKDYKDKIN

SEQ ID NO: 118239 - protein, 14 aa, Borrelia burgdorferi B31
SGGKFKDYKDKINE

SEQ ID NO: 118240 - protein, 14 aa, Borrelia burgdorferi B31
GGKFKDYKDKINEL

SEQ ID NO: 118241 - protein, 14 aa, Borrelia burgdorferi B31
GKFKDYKDKINELK

SEQ ID NO: 118242 - protein, 14 aa, Borrelia burgdorferi B31
KFKDYKDKINELKE

SEQ ID NO: 118243 - protein, 14 aa, Borrelia burgdorferi B31
FKDYKDKINELKEN

SEQ ID NO: 118244 - protein, 14 aa, Borrelia burgdorferi B31
KDYKDKINELKENL

SEQ ID NO: 118245 - protein, 14 aa, Borrelia burgdorferi B31
DYKDKINELKENLK

SEQ ID NO: 118246 - protein, 14 aa, Borrelia burgdorferi B31
YKDKINELKENLKD

SEQ ID NO: 118247 - protein, 14 aa, Borrelia burgdorferi B31
KDKINELKENLKDI

SEQ ID NO: 118248 - protein, 14 aa, Borrelia burgdorferi B31
DKINELKENLKDIG

SEQ ID NO: 118249 - protein, 14 aa, Borrelia burgdorferi B31
KINELKENLKDIGN

SEQ ID NO: 118250 - protein, 14 aa, Borrelia burgdorferi B31
INELKENLKDIGNA

SEQ ID NO: 118251 - protein, 14 aa, Borrelia burgdorferi B31
NELKENLKDIGNAE

SEQ ID NO: 118252 - protein, 14 aa, Borrelia burgdorferi B31
ELKENLKDIGNAEL

SEQ ID NO: 118253 - protein, 14 aa, Borrelia burgdorferi B31
LKENLKDIGNAELK

SEQ ID NO: 118254 - protein, 14 aa, Borrelia burgdorferi B31
KENLKDIGNAELKE

SEQ ID NO: 118255 - protein, 14 aa, Borrelia burgdorferi B31
ENLKDIGNAELKEK

SEQ ID NO: 118256 - protein, 14 aa, Borrelia burgdorferi B31
NLKDIGNAELKEKL

SEQ ID NO: 118257 - protein, 14 aa, Borrelia burgdorferi B31
LKDIGNAELKEKLL

SEQ ID NO: 118258 - protein, 14 aa, Borrelia burgdorferi B31
KDIGNAELKEKLLN

SEQ ID NO: 118259 - protein, 14 aa, Borrelia burgdorferi B31
DIGNAELKEKLLNL

SEQ ID NO: 118260 - protein, 14 aa, Borrelia burgdorferi B31
IGNAELKEKLLNLQ

SEQ ID NO: 118261 - protein, 14 aa, Borrelia burgdorferi B31
GNAELKEKLLNLQN

SEQ ID NO: 118262 - protein, 14 aa, Borrelia burgdorferi B31
NAELKEKLLNLQNS

SEQ ID NO: 118263 - protein, 14 aa, Borrelia burgdorferi B31
AELKEKLLNLQNSF

SEQ ID NO: 118264 - protein, 14 aa, Borrelia burgdorferi B31
ELKEKLLNLQNSFQ

SEQ ID NO: 118265 - protein, 14 aa, Borrelia burgdorferi B31
LKEKLLNLQNSFQD

SEQ ID NO: 118266 - protein, 14 aa, Borrelia burgdorferi B31
KEKLLNLQNSFQDK

SEQ ID NO: 118267 - protein, 14 aa, Borrelia burgdorferi B31
EKLLNLQNSFQDKL

SEQ ID NO: 118268 - protein, 14 aa, Borrelia burgdorferi B31
KLLNLQNSFQDKLA

SEQ ID NO: 118269 - protein, 14 aa, Borrelia burgdorferi B31
LLNLQNSFQDKLAA

SEQ ID NO: 118270 - protein, 14 aa, Borrelia burgdorferi B31
LNLQNSFQDKLAAK

SEQ ID NO: 118271 - protein, 14 aa, Borrelia burgdorferi B31
NLQNSFQDKLAAKL

SEQ ID NO: 118272 - protein, 14 aa, Borrelia burgdorferi B31
LQNSFQDKLAAKLA

SEQ ID NO: 118273 - protein, 14 aa, Borrelia burgdorferi B31
QNSFQDKLAAKLAA

SEQ ID NO: 118274 - protein, 14 aa, Borrelia burgdorferi B31
NSFQDKLAAKLAAL

SEQ ID NO: 118275 - protein, 14 aa, Borrelia burgdorferi B31
SFQDKLAAKLAALK

SEQ ID NO: 118276 - protein, 14 aa, Borrelia burgdorferi B31
FQDKLAAKLAALKA

SEQ ID NO: 118277 - protein, 14 aa, Borrelia burgdorferi B31
QDKLAAKLAALKAA

SEQ ID NO: 118278 - protein, 14 aa, Borrelia burgdorferi B31
DKLAAKLAALKAAK

SEQ ID NO: 118279 - protein, 14 aa, Borrelia burgdorferi B31
KLAAKLAALKAAKN

SEQ ID NO: 118280 - protein, 14 aa, Borrelia burgdorferi B31
LAAKLAALKAAKNT

SEQ ID NO: 118281 - protein, 14 aa, Borrelia burgdorferi B31
AAKLAALKAAKNTI

SEQ ID NO: 118282 - protein, 14 aa, Borrelia burgdorferi B31
AKLAALKAAKNTIE

SEQ ID NO: 118283 - protein, 14 aa, Borrelia burgdorferi B31
KLAALKAAKNTIEN

SEQ ID NO: 118284 - protein, 14 aa, Borrelia burgdorferi B31
LAALKAAKNTIENI

SEQ ID NO: 118285 - protein, 14 aa, Borrelia burgdorferi B31
AALKAAKNTIENIT

SEQ ID NO: 118286 - protein, 14 aa, Borrelia burgdorferi B31
ALKAAKNTIENITD

SEQ ID NO: 118287 - protein, 14 aa, Borrelia burgdorferi B31
LKAAKNTIENITDK

SEQ ID NO: 118288 - protein, 14 aa, Borrelia burgdorferi B31
KAAKNTIENITDKD

SEQ ID NO: 118289 - protein, 14 aa, Borrelia burgdorferi B31
AAKNTIENITDKDQ

SEQ ID NO: 118290 - protein, 14 aa, Borrelia burgdorferi B31
AKNTIENITDKDQD

SEQ ID NO: 118291 - protein, 14 aa, Borrelia burgdorferi B31
KNTIENITDKDQDI

SEQ ID NO: 118292 - protein, 14 aa, Borrelia burgdorferi B31
NTIENITDKDQDIS

SEQ ID NO: 118293 - protein, 14 aa, Borrelia burgdorferi B31
TIENITDKDQDISK

SEQ ID NO: 118294 - protein, 14 aa, Borrelia burgdorferi B31
IENITDKDQDISKR

SEQ ID NO: 118295 - protein, 14 aa, Borrelia burgdorferi B31
ENITDKDQDISKRK

SEQ ID NO: 118296 - protein, 14 aa, Borrelia burgdorferi B31
NITDKDQDISKRKI

SEQ ID NO: 118297 - protein, 14 aa, Borrelia burgdorferi B31
ITDKDQDISKRKIW

SEQ ID NO: 118298 - protein, 14 aa, Borrelia burgdorferi B31
TDKDQDISKRKIWS

SEQ ID NO: 118299 - protein, 14 aa, Borrelia burgdorferi B31
DKDQDISKRKIWSE

SEQ ID NO: 118300 - protein, 14 aa, Borrelia burgdorferi B31
KDQDISKRKIWSEA

SEQ ID NO: 118301 - protein, 14 aa, Borrelia burgdorferi B31
DQDISKRKIWSEAK

SEQ ID NO: 118302 - protein, 14 aa, Borrelia burgdorferi B31
QDISKRKIWSEAKL

SEQ ID NO: 118303 - protein, 14 aa, Borrelia burgdorferi B31
DISKRKIWSEAKLV

SEQ ID NO: 118304 - protein, 14 aa, Borrelia burgdorferi B31
ISKRKIWSEAKLVG

SEQ ID NO: 118305 - protein, 14 aa, Borrelia burgdorferi B31
SKRKIWSEAKLVGV

SEQ ID NO: 118306 - protein, 14 aa, Borrelia burgdorferi B31
KRKIWSEAKLVGVT

SEQ ID NO: 118307 - protein, 14 aa, Borrelia burgdorferi B31
RKIWSEAKLVGVTV

SEQ ID NO: 118308 - protein, 14 aa, Borrelia burgdorferi B31
KIWSEAKLVGVTVP

SEQ ID NO: 118309 - protein, 14 aa, Borrelia burgdorferi B31
IWSEAKLVGVTVPL

SEQ ID NO: 118310 - protein, 14 aa, Borrelia burgdorferi B31
WSEAKLVGVTVPLL

SEQ ID NO: 118311 - protein, 14 aa, Borrelia burgdorferi B31
SEAKLVGVTVPLLG

SEQ ID NO: 118312 - protein, 14 aa, Borrelia burgdorferi B31
EAKLVGVTVPLLGS

SEQ ID NO: 118313 - protein, 14 aa, Borrelia burgdorferi B31
AKLVGVTVPLLGSN

SEQ ID NO: 118314 - protein, 14 aa, Borrelia burgdorferi B31
KLVGVTVPLLGSNT

SEQ ID NO: 118315 - protein, 14 aa, Borrelia burgdorferi B31
LVGVTVPLLGSNTS

SEQ ID NO: 118316 - protein, 14 aa, Borrelia burgdorferi B31
VGVTVPLLGSNTSG

SEQ ID NO: 118317 - protein, 14 aa, Borrelia burgdorferi B31
GVTVPLLGSNTSGN

SEQ ID NO: 118318 - protein, 14 aa, Borrelia burgdorferi B31
VTVPLLGSNTSGNG

SEQ ID NO: 118319 - protein, 14 aa, Borrelia burgdorferi B31
TVPLLGSNTSGNGD

SEQ ID NO: 118320 - protein, 14 aa, Borrelia burgdorferi B31
VPLLGSNTSGNGDK

SEQ ID NO: 118321 - protein, 14 aa, Borrelia burgdorferi B31
PLLGSNTSGNGDKM

SEQ ID NO: 118322 - protein, 14 aa, Borrelia burgdorferi B31
LLGSNTSGNGDKMS

SEQ ID NO: 118323 - protein, 14 aa, Borrelia burgdorferi B31
LGSNTSGNGDKMSK

SEQ ID NO: 118324 - protein, 14 aa, Borrelia burgdorferi B31
GSNTSGNGDKMSKN

SEQ ID NO: 118325 - protein, 14 aa, Borrelia burgdorferi B31
SNTSGNGDKMSKNA

SEQ ID NO: 118326 - protein, 14 aa, Borrelia burgdorferi B31
NTSGNGDKMSKNAV

SEQ ID NO: 118327 - protein, 14 aa, Borrelia burgdorferi B31
TSGNGDKMSKNAVE

SEQ ID NO: 118328 - protein, 14 aa, Borrelia burgdorferi B31
SGNGDKMSKNAVEQ

SEQ ID NO: 118329 - protein, 14 aa, Borrelia burgdorferi B31
GNGDKMSKNAVEQI

SEQ ID NO: 118330 - protein, 14 aa, Borrelia burgdorferi B31
NGDKMSKNAVEQID

SEQ ID NO: 118331 - protein, 14 aa, Borrelia burgdorferi B31
GDKMSKNAVEQIDK

SEQ ID NO: 118332 - protein, 14 aa, Borrelia burgdorferi B31
DKMSKNAVEQIDKV

SEQ ID NO: 118333 - protein, 14 aa, Borrelia burgdorferi B31
KMSKNAVEQIDKVI

SEQ ID NO: 118334 - protein, 14 aa, Borrelia burgdorferi B31
MSKNAVEQIDKVIK

SEQ ID NO: 118335 - protein, 14 aa, Borrelia burgdorferi B31
SKNAVEQIDKVIKF

SEQ ID NO: 118336 - protein, 14 aa, Borrelia burgdorferi B31
KNAVEQIDKVIKFL

SEQ ID NO: 118337 - protein, 14 aa, Borrelia burgdorferi B31
NAVEQIDKVIKFLE

SEQ ID NO: 118338 - protein, 14 aa, Borrelia burgdorferi B31
AVEQIDKVIKFLEE

SEQ ID NO: 118339 - protein, 14 aa, Borrelia burgdorferi B31
VEQIDKVIKFLEEG

SEQ ID NO: 118340 - protein, 14 aa, Borrelia burgdorferi B31
EQIDKVIKFLEEGT

SEQ ID NO: 118341 - protein, 14 aa, Borrelia burgdorferi B31
QIDKVIKFLEEGTN

SEQ ID NO: 118342 - protein, 15 aa, Borrelia burgdorferi B31
MRNKNIFKLFFASML

SEQ ID NO: 118343 - protein, 15 aa, Borrelia burgdorferi B31
RNKNIFKLFFASMLF

SEQ ID NO: 118344 - protein, 15 aa, Borrelia burgdorferi B31
NKNIFKLFFASMLFV

SEQ ID NO: 118345 - protein, 15 aa, Borrelia burgdorferi B31
KNIFKLFFASMLFVM

SEQ ID NO: 118346 - protein, 15 aa, Borrelia burgdorferi B31
NIFKLFFASMLFVMA

SEQ ID NO: 118347 - protein, 15 aa, Borrelia burgdorferi B31
IFKLFFASMLFVMAC

SEQ ID NO: 118348 - protein, 15 aa, Borrelia burgdorferi B31
FKLFFASMLFVMACK

SEQ ID NO: 118349 - protein, 15 aa, Borrelia burgdorferi B31
KLFFASMLFVMACKA

SEQ ID NO: 118350 - protein, 15 aa, Borrelia burgdorferi B31
LFFASMLFVMACKAY

SEQ ID NO: 118351 - protein, 15 aa, Borrelia burgdorferi B31
FFASMLFVMACKAYV

SEQ ID NO: 118352 - protein, 15 aa, Borrelia burgdorferi B31
FASMLFVMACKAYVE

SEQ ID NO: 118353 - protein, 15 aa, Borrelia burgdorferi B31
ASMLFVMACKAYVEE

SEQ ID NO: 118354 - protein, 15 aa, Borrelia burgdorferi B31
SMLFVMACKAYVEEK

SEQ ID NO: 118355 - protein, 15 aa, Borrelia burgdorferi B31
MLFVMACKAYVEEKK

SEQ ID NO: 118356 - protein, 15 aa, Borrelia burgdorferi B31
LFVMACKAYVEEKKE

SEQ ID NO: 118357 - protein, 15 aa, Borrelia burgdorferi B31
FVMACKAYVEEKKEI

SEQ ID NO: 118358 - protein, 15 aa, Borrelia burgdorferi B31
VMACKAYVEEKKEID

SEQ ID NO: 118359 - protein, 15 aa, Borrelia burgdorferi B31
MACKAYVEEKKEIDS

SEQ ID NO: 118360 - protein, 15 aa, Borrelia burgdorferi B31
ACKAYVEEKKEIDSL

SEQ ID NO: 118361 - protein, 15 aa, Borrelia burgdorferi B31
CKAYVEEKKEIDSLM

SEQ ID NO: 118362 - protein, 15 aa, Borrelia burgdorferi B31
KAYVEEKKEIDSLME

SEQ ID NO: 118363 - protein, 15 aa, Borrelia burgdorferi B31
AYVEEKKEIDSLMED

SEQ ID NO: 118364 - protein, 15 aa, Borrelia burgdorferi B31
YVEEKKEIDSLMEDV

SEQ ID NO: 118365 - protein, 15 aa, Borrelia burgdorferi B31
VEEKKEIDSLMEDVL

SEQ ID NO: 118366 - protein, 15 aa, Borrelia burgdorferi B31
EEKKEIDSLMEDVLA

SEQ ID NO: 118367 - protein, 15 aa, Borrelia burgdorferi B31
EKKEIDSLMEDVLAL

SEQ ID NO: 118368 - protein, 15 aa, Borrelia burgdorferi B31
KKEIDSLMEDVLALV

SEQ ID NO: 118369 - protein, 15 aa, Borrelia burgdorferi B31
KEIDSLMEDVLALVN

SEQ ID NO: 118370 - protein, 15 aa, Borrelia burgdorferi B31
EIDSLMEDVLALVND

SEQ ID NO: 118371 - protein, 15 aa, Borrelia burgdorferi B31
IDSLMEDVLALVNDS

SEQ ID NO: 118372 - protein, 15 aa, Borrelia burgdorferi B31
DSLMEDVLALVNDSS

SEQ ID NO: 118373 - protein, 15 aa, Borrelia burgdorferi B31
SLMEDVLALVNDSSG

SEQ ID NO: 118374 - protein, 15 aa, Borrelia burgdorferi B31
LMEDVLALVNDSSGG

SEQ ID NO: 118375 - protein, 15 aa, Borrelia burgdorferi B31
MEDVLALVNDSSGGK

SEQ ID NO: 118376 - protein, 15 aa, Borrelia burgdorferi B31
EDVLALVNDSSGGKF

SEQ ID NO: 118377 - protein, 15 aa, Borrelia burgdorferi B31
DVLALVNDSSGGKFK

SEQ ID NO: 118378 - protein, 15 aa, Borrelia burgdorferi B31
VLALVNDSSGGKFKD

SEQ ID NO: 118379 - protein, 15 aa, Borrelia burgdorferi B31
LALVNDSSGGKFKDY

SEQ ID NO: 118380 - protein, 15 aa, Borrelia burgdorferi B31
ALVNDSSGGKFKDYK

SEQ ID NO: 118381 - protein, 15 aa, Borrelia burgdorferi B31
LVNDSSGGKFKDYKD

SEQ ID NO: 118382 - protein, 15 aa, Borrelia burgdorferi B31
VNDSSGGKFKDYKDK

SEQ ID NO: 118383 - protein, 15 aa, Borrelia burgdorferi B31
NDSSGGKFKDYKDKI

SEQ ID NO: 118384 - protein, 15 aa, Borrelia burgdorferi B31
DSSGGKFKDYKDKIN

SEQ ID NO: 118385 - protein, 15 aa, Borrelia burgdorferi B31
SSGGKFKDYKDKINE

SEQ ID NO: 118386 - protein, 15 aa, Borrelia burgdorferi B31
SGGKFKDYKDKINEL

SEQ ID NO: 118387 - protein, 15 aa, Borrelia burgdorferi B31
GGKFKDYKDKINELK

SEQ ID NO: 118388 - protein, 15 aa, Borrelia burgdorferi B31
GKFKDYKDKINELKE

SEQ ID NO: 118389 - protein, 15 aa, Borrelia burgdorferi B31
KFKDYKDKINELKEN

SEQ ID NO: 118390 - protein, 15 aa, Borrelia burgdorferi B31
FKDYKDKINELKENL

SEQ ID NO: 118391 - protein, 15 aa, Borrelia burgdorferi B31
KDYKDKINELKENLK

SEQ ID NO: 118392 - protein, 15 aa, Borrelia burgdorferi B31
DYKDKINELKENLKD

SEQ ID NO: 118393 - protein, 15 aa, Borrelia burgdorferi B31
YKDKINELKENLKDI

SEQ ID NO: 118394 - protein, 15 aa, Borrelia burgdorferi B31
KDKINELKENLKDIG

SEQ ID NO: 118395 - protein, 15 aa, Borrelia burgdorferi B31
DKINELKENLKDIGN

SEQ ID NO: 118396 - protein, 15 aa, Borrelia burgdorferi B31
KINELKENLKDIGNA

SEQ ID NO: 118397 - protein, 15 aa, Borrelia burgdorferi B31
INELKENLKDIGNAE

SEQ ID NO: 118398 - protein, 15 aa, Borrelia burgdorferi B31
NELKENLKDIGNAEL

SEQ ID NO: 118399 - protein, 15 aa, Borrelia burgdorferi B31
ELKENLKDIGNAELK

SEQ ID NO: 118400 - protein, 15 aa, Borrelia burgdorferi B31
LKENLKDIGNAELKE

SEQ ID NO: 118401 - protein, 15 aa, Borrelia burgdorferi B31
KENLKDIGNAELKEK

SEQ ID NO: 118402 - protein, 15 aa, Borrelia burgdorferi B31
ENLKDIGNAELKEKL

SEQ ID NO: 118403 - protein, 15 aa, Borrelia burgdorferi B31
NLKDIGNAELKEKLL

SEQ ID NO: 118404 - protein, 15 aa, Borrelia burgdorferi B31
LKDIGNAELKEKLLN

SEQ ID NO: 118405 - protein, 15 aa, Borrelia burgdorferi B31
KDIGNAELKEKLLNL

SEQ ID NO: 118406 - protein, 15 aa, Borrelia burgdorferi B31
DIGNAELKEKLLNLQ

SEQ ID NO: 118407 - protein, 15 aa, Borrelia burgdorferi B31
IGNAELKEKLLNLQN

SEQ ID NO: 118408 - protein, 15 aa, Borrelia burgdorferi B31
GNAELKEKLLNLQNS

SEQ ID NO: 118409 - protein, 15 aa, Borrelia burgdorferi B31
NAELKEKLLNLQNSF

SEQ ID NO: 118410 - protein, 15 aa, Borrelia burgdorferi B31
AELKEKLLNLQNSFQ

SEQ ID NO: 118411 - protein, 15 aa, Borrelia burgdorferi B31
ELKEKLLNLQNSFQD

SEQ ID NO: 118412 - protein, 15 aa, Borrelia burgdorferi B31
LKEKLLNLQNSFQDK

SEQ ID NO: 118413 - protein, 15 aa, Borrelia burgdorferi B31
KEKLLNLQNSFQDKL

SEQ ID NO: 118414 - protein, 15 aa, Borrelia burgdorferi B31
EKLLNLQNSFQDKLA

SEQ ID NO: 118415 - protein, 15 aa, Borrelia burgdorferi B31
KLLNLQNSFQDKLAA

SEQ ID NO: 118416 - protein, 15 aa, Borrelia burgdorferi B31
LLNLQNSFQDKLAAK

SEQ ID NO: 118417 - protein, 15 aa, Borrelia burgdorferi B31
LNLQNSFQDKLAAKL

SEQ ID NO: 118418 - protein, 15 aa, Borrelia burgdorferi B31
NLQNSFQDKLAAKLA

SEQ ID NO: 118419 - protein, 15 aa, Borrelia burgdorferi B31
LQNSFQDKLAAKLAA

SEQ ID NO: 118420 - protein, 15 aa, Borrelia burgdorferi B31
QNSFQDKLAAKLAAL

SEQ ID NO: 118421 - protein, 15 aa, Borrelia burgdorferi B31
NSFQDKLAAKLAALK

SEQ ID NO: 118422 - protein, 15 aa, Borrelia burgdorferi B31
SFQDKLAAKLAALKA

SEQ ID NO: 118423 - protein, 15 aa, Borrelia burgdorferi B31
FQDKLAAKLAALKAA

SEQ ID NO: 118424 - protein, 15 aa, Borrelia burgdorferi B31
QDKLAAKLAALKAAK

SEQ ID NO: 118425 - protein, 15 aa, Borrelia burgdorferi B31
DKLAAKLAALKAAKN

SEQ ID NO: 118426 - protein, 15 aa, Borrelia burgdorferi B31
KLAAKLAALKAAKNT

SEQ ID NO: 118427 - protein, 15 aa, Borrelia burgdorferi B31
LAAKLAALKAAKNTI

SEQ ID NO: 118428 - protein, 15 aa, Borrelia burgdorferi B31
AAKLAALKAAKNTIE

SEQ ID NO: 118429 - protein, 15 aa, Borrelia burgdorferi B31
AKLAALKAAKNTIEN

SEQ ID NO: 118430 - protein, 15 aa, Borrelia burgdorferi B31
KLAALKAAKNTIENI

SEQ ID NO: 118431 - protein, 15 aa, Borrelia burgdorferi B31
LAALKAAKNTIENIT

SEQ ID NO: 118432 - protein, 15 aa, Borrelia burgdorferi B31
AALKAAKNTIENITD

SEQ ID NO: 118433 - protein, 15 aa, Borrelia burgdorferi B31
ALKAAKNTIENITDK

SEQ ID NO: 118434 - protein, 15 aa, Borrelia burgdorferi B31
LKAAKNTIENITDKD

SEQ ID NO: 118435 - protein, 15 aa, Borrelia burgdorferi B31
KAAKNTIENITDKDQ

SEQ ID NO: 118436 - protein, 15 aa, Borrelia burgdorferi B31
AAKNTIENITDKDQD

SEQ ID NO: 118437 - protein, 15 aa, Borrelia burgdorferi B31
AKNTIENITDKDQDI

SEQ ID NO: 118438 - protein, 15 aa, Borrelia burgdorferi B31
KNTIENITDKDQDIS

SEQ ID NO: 118439 - protein, 15 aa, Borrelia burgdorferi B31
NTIENITDKDQDISK

SEQ ID NO: 118440 - protein, 15 aa, Borrelia burgdorferi B31
TIENITDKDQDISKR

SEQ ID NO: 118441 - protein, 15 aa, Borrelia burgdorferi B31
IENITDKDQDISKRK

SEQ ID NO: 118442 - protein, 15 aa, Borrelia burgdorferi B31
ENITDKDQDISKRKI

SEQ ID NO: 118443 - protein, 15 aa, Borrelia burgdorferi B31
NITDKDQDISKRKIW

SEQ ID NO: 118444 - protein, 15 aa, Borrelia burgdorferi B31
ITDKDQDISKRKIWS

SEQ ID NO: 118445 - protein, 15 aa, Borrelia burgdorferi B31
TDKDQDISKRKIWSE

SEQ ID NO: 118446 - protein, 15 aa, Borrelia burgdorferi B31
DKDQDISKRKIWSEA

SEQ ID NO: 118447 - protein, 15 aa, Borrelia burgdorferi B31
KDQDISKRKIWSEAK

SEQ ID NO: 118448 - protein, 15 aa, Borrelia burgdorferi B31
DQDISKRKIWSEAKL

SEQ ID NO: 118449 - protein, 15 aa, Borrelia burgdorferi B31
QDISKRKIWSEAKLV

SEQ ID NO: 118450 - protein, 15 aa, Borrelia burgdorferi B31
DISKRKIWSEAKLVG

SEQ ID NO: 118451 - protein, 15 aa, Borrelia burgdorferi B31
ISKRKIWSEAKLVGV

SEQ ID NO: 118452 - protein, 15 aa, Borrelia burgdorferi B31
SKRKIWSEAKLVGVT

SEQ ID NO: 118453 - protein, 15 aa, Borrelia burgdorferi B31
KRKIWSEAKLVGVTV

SEQ ID NO: 118454 - protein, 15 aa, Borrelia burgdorferi B31
RKIWSEAKLVGVTVP

SEQ ID NO: 118455 - protein, 15 aa, Borrelia burgdorferi B31
KIWSEAKLVGVTVPL

SEQ ID NO: 118456 - protein, 15 aa, Borrelia burgdorferi B31
IWSEAKLVGVTVPLL

SEQ ID NO: 118457 - protein, 15 aa, Borrelia burgdorferi B31
WSEAKLVGVTVPLLG

SEQ ID NO: 118458 - protein, 15 aa, Borrelia burgdorferi B31
SEAKLVGVTVPLLGS

SEQ ID NO: 118459 - protein, 15 aa, Borrelia burgdorferi B31
EAKLVGVTVPLLGSN

SEQ ID NO: 118460 - protein, 15 aa, Borrelia burgdorferi B31
AKLVGVTVPLLGSNT

SEQ ID NO: 118461 - protein, 15 aa, Borrelia burgdorferi B31
KLVGVTVPLLGSNTS

SEQ ID NO: 118462 - protein, 15 aa, Borrelia burgdorferi B31
LVGVTVPLLGSNTSG

SEQ ID NO: 118463 - protein, 15 aa, Borrelia burgdorferi B31
VGVTVPLLGSNTSGN

SEQ ID NO: 118464 - protein, 15 aa, Borrelia burgdorferi B31
GVTVPLLGSNTSGNG

SEQ ID NO: 118465 - protein, 15 aa, Borrelia burgdorferi B31
VTVPLLGSNTSGNGD

SEQ ID NO: 118466 - protein, 15 aa, Borrelia burgdorferi B31
TVPLLGSNTSGNGDK

SEQ ID NO: 118467 - protein, 15 aa, Borrelia burgdorferi B31
VPLLGSNTSGNGDKM

SEQ ID NO: 118468 - protein, 15 aa, Borrelia burgdorferi B31
PLLGSNTSGNGDKMS

SEQ ID NO: 118469 - protein, 15 aa, Borrelia burgdorferi B31
LLGSNTSGNGDKMSK

SEQ ID NO: 118470 - protein, 15 aa, Borrelia burgdorferi B31
LGSNTSGNGDKMSKN

SEQ ID NO: 118471 - protein, 15 aa, Borrelia burgdorferi B31
GSNTSGNGDKMSKNA

SEQ ID NO: 118472 - protein, 15 aa, Borrelia burgdorferi B31
SNTSGNGDKMSKNAV

SEQ ID NO: 118473 - protein, 15 aa, Borrelia burgdorferi B31
NTSGNGDKMSKNAVE

SEQ ID NO: 118474 - protein, 15 aa, Borrelia burgdorferi B31
TSGNGDKMSKNAVEQ

SEQ ID NO: 118475 - protein, 15 aa, Borrelia burgdorferi B31
SGNGDKMSKNAVEQI

SEQ ID NO: 118476 - protein, 15 aa, Borrelia burgdorferi B31
GNGDKMSKNAVEQID

SEQ ID NO: 118477 - protein, 15 aa, Borrelia burgdorferi B31
NGDKMSKNAVEQIDK

SEQ ID NO: 118478 - protein, 15 aa, Borrelia burgdorferi B31
GDKMSKNAVEQIDKV

SEQ ID NO: 118479 - protein, 15 aa, Borrelia burgdorferi B31
DKMSKNAVEQIDKVI

SEQ ID NO: 118480 - protein, 15 aa, Borrelia burgdorferi B31
KMSKNAVEQIDKVIK

SEQ ID NO: 118481 - protein, 15 aa, Borrelia burgdorferi B31
MSKNAVEQIDKVIKF

SEQ ID NO: 118482 - protein, 15 aa, Borrelia burgdorferi B31
SKNAVEQIDKVIKFL

SEQ ID NO: 118483 - protein, 15 aa, Borrelia burgdorferi B31
KNAVEQIDKVIKFLE

SEQ ID NO: 118484 - protein, 15 aa, Borrelia burgdorferi B31
NAVEQIDKVIKFLEE

SEQ ID NO: 118485 - protein, 15 aa, Borrelia burgdorferi B31
AVEQIDKVIKFLEEG

SEQ ID NO: 118486 - protein, 15 aa, Borrelia burgdorferi B31
VEQIDKVIKFLEEGT

SEQ ID NO: 118487 - protein, 15 aa, Borrelia burgdorferi B31
EQIDKVIKFLEEGTN

SEQ ID NO: 118488 - protein, 16 aa, Borrelia burgdorferi B31
MRNKNIFKLFFASMLF

SEQ ID NO: 118489 - protein, 16 aa, Borrelia burgdorferi B31
RNKNIFKLFFASMLFV

SEQ ID NO: 118490 - protein, 16 aa, Borrelia burgdorferi B31
NKNIFKLFFASMLFVM

SEQ ID NO: 118491 - protein, 16 aa, Borrelia burgdorferi B31
KNIFKLFFASMLFVMA

SEQ ID NO: 118492 - protein, 16 aa, Borrelia burgdorferi B31
NIFKLFFASMLFVMAC

SEQ ID NO: 118493 - protein, 16 aa, Borrelia burgdorferi B31
IFKLFFASMLFVMACK

SEQ ID NO: 118494 - protein, 16 aa, Borrelia burgdorferi B31
FKLFFASMLFVMACKA

SEQ ID NO: 118495 - protein, 16 aa, Borrelia burgdorferi B31
KLFFASMLFVMACKAY

SEQ ID NO: 118496 - protein, 16 aa, Borrelia burgdorferi B31
LFFASMLFVMACKAYV

SEQ ID NO: 118497 - protein, 16 aa, Borrelia burgdorferi B31
FFASMLFVMACKAYVE

SEQ ID NO: 118498 - protein, 16 aa, Borrelia burgdorferi B31
FASMLFVMACKAYVEE

SEQ ID NO: 118499 - protein, 16 aa, Borrelia burgdorferi B31
ASMLFVMACKAYVEEK

SEQ ID NO: 118500 - protein, 16 aa, Borrelia burgdorferi B31
SMLFVMACKAYVEEKK

SEQ ID NO: 118501 - protein, 16 aa, Borrelia burgdorferi B31
MLFVMACKAYVEEKKE

SEQ ID NO: 118502 - protein, 16 aa, Borrelia burgdorferi B31
LFVMACKAYVEEKKEI

SEQ ID NO: 118503 - protein, 16 aa, Borrelia burgdorferi B31
FVMACKAYVEEKKEID

SEQ ID NO: 118504 - protein, 16 aa, Borrelia burgdorferi B31
VMACKAYVEEKKEIDS

SEQ ID NO: 118505 - protein, 16 aa, Borrelia burgdorferi B31
MACKAYVEEKKEIDSL

SEQ ID NO: 118506 - protein, 16 aa, Borrelia burgdorferi B31
ACKAYVEEKKEIDSLM

SEQ ID NO: 118507 - protein, 16 aa, Borrelia burgdorferi B31
CKAYVEEKKEIDSLME

SEQ ID NO: 118508 - protein, 16 aa, Borrelia burgdorferi B31
KAYVEEKKEIDSLMED

SEQ ID NO: 118509 - protein, 16 aa, Borrelia burgdorferi B31
AYVEEKKEIDSLMEDV

SEQ ID NO: 118510 - protein, 16 aa, Borrelia burgdorferi B31
YVEEKKEIDSLMEDVL

SEQ ID NO: 118511 - protein, 16 aa, Borrelia burgdorferi B31
VEEKKEIDSLMEDVLA

SEQ ID NO: 118512 - protein, 16 aa, Borrelia burgdorferi B31
EEKKEIDSLMEDVLAL

SEQ ID NO: 118513 - protein, 16 aa, Borrelia burgdorferi B31
EKKEIDSLMEDVLALV

SEQ ID NO: 118514 - protein, 16 aa, Borrelia burgdorferi B31
KKEIDSLMEDVLALVN

SEQ ID NO: 118515 - protein, 16 aa, Borrelia burgdorferi B31
KEIDSLMEDVLALVND

SEQ ID NO: 118516 - protein, 16 aa, Borrelia burgdorferi B31
EIDSLMEDVLALVNDS

SEQ ID NO: 118517 - protein, 16 aa, Borrelia burgdorferi B31
IDSLMEDVLALVNDSS

SEQ ID NO: 118518 - protein, 16 aa, Borrelia burgdorferi B31
DSLMEDVLALVNDSSG

SEQ ID NO: 118519 - protein, 16 aa, Borrelia burgdorferi B31
SLMEDVLALVNDSSGG

SEQ ID NO: 118520 - protein, 16 aa, Borrelia burgdorferi B31
LMEDVLALVNDSSGGK

SEQ ID NO: 118521 - protein, 16 aa, Borrelia burgdorferi B31
MEDVLALVNDSSGGKF

SEQ ID NO: 118522 - protein, 16 aa, Borrelia burgdorferi B31
EDVLALVNDSSGGKFK

SEQ ID NO: 118523 - protein, 16 aa, Borrelia burgdorferi B31
DVLALVNDSSGGKFKD

SEQ ID NO: 118524 - protein, 16 aa, Borrelia burgdorferi B31
VLALVNDSSGGKFKDY

SEQ ID NO: 118525 - protein, 16 aa, Borrelia burgdorferi B31
LALVNDSSGGKFKDYK

SEQ ID NO: 118526 - protein, 16 aa, Borrelia burgdorferi B31
ALVNDSSGGKFKDYKD

SEQ ID NO: 118527 - protein, 16 aa, Borrelia burgdorferi B31
LVNDSSGGKFKDYKDK

SEQ ID NO: 118528 - protein, 16 aa, Borrelia burgdorferi B31
VNDSSGGKFKDYKDKI

SEQ ID NO: 118529 - protein, 16 aa, Borrelia burgdorferi B31
NDSSGGKFKDYKDKIN

SEQ ID NO: 118530 - protein, 16 aa, Borrelia burgdorferi B31
DSSGGKFKDYKDKINE

SEQ ID NO: 118531 - protein, 16 aa, Borrelia burgdorferi B31
SSGGKFKDYKDKINEL

SEQ ID NO: 118532 - protein, 16 aa, Borrelia burgdorferi B31
SGGKFKDYKDKINELK

SEQ ID NO: 118533 - protein, 16 aa, Borrelia burgdorferi B31
GGKFKDYKDKINELKE

SEQ ID NO: 118534 - protein, 16 aa, Borrelia burgdorferi B31
GKFKDYKDKINELKEN

SEQ ID NO: 118535 - protein, 16 aa, Borrelia burgdorferi B31
KFKDYKDKINELKENL

SEQ ID NO: 118536 - protein, 16 aa, Borrelia burgdorferi B31
FKDYKDKINELKENLK

SEQ ID NO: 118537 - protein, 16 aa, Borrelia burgdorferi B31
KDYKDKINELKENLKD

SEQ ID NO: 118538 - protein, 16 aa, Borrelia burgdorferi B31
DYKDKINELKENLKDI

SEQ ID NO: 118539 - protein, 16 aa, Borrelia burgdorferi B31
YKDKINELKENLKDIG

SEQ ID NO: 118540 - protein, 16 aa, Borrelia burgdorferi B31
KDKINELKENLKDIGN

SEQ ID NO: 118541 - protein, 16 aa, Borrelia burgdorferi B31
DKINELKENLKDIGNA

SEQ ID NO: 118542 - protein, 16 aa, Borrelia burgdorferi B31
KINELKENLKDIGNAE

SEQ ID NO: 118543 - protein, 16 aa, Borrelia burgdorferi B31
INELKENLKDIGNAEL

SEQ ID NO: 118544 - protein, 16 aa, Borrelia burgdorferi B31
NELKENLKDIGNAELK

SEQ ID NO: 118545 - protein, 16 aa, Borrelia burgdorferi B31
ELKENLKDIGNAELKE

SEQ ID NO: 118546 - protein, 16 aa, Borrelia burgdorferi B31
LKENLKDIGNAELKEK

SEQ ID NO: 118547 - protein, 16 aa, Borrelia burgdorferi B31
KENLKDIGNAELKEKL

SEQ ID NO: 118548 - protein, 16 aa, Borrelia burgdorferi B31
ENLKDIGNAELKEKLL

SEQ ID NO: 118549 - protein, 16 aa, Borrelia burgdorferi B31
NLKDIGNAELKEKLLN

SEQ ID NO: 118550 - protein, 16 aa, Borrelia burgdorferi B31
LKDIGNAELKEKLLNL

SEQ ID NO: 118551 - protein, 16 aa, Borrelia burgdorferi B31
KDIGNAELKEKLLNLQ

SEQ ID NO: 118552 - protein, 16 aa, Borrelia burgdorferi B31
DIGNAELKEKLLNLQN

SEQ ID NO: 118553 - protein, 16 aa, Borrelia burgdorferi B31
IGNAELKEKLLNLQNS

SEQ ID NO: 118554 - protein, 16 aa, Borrelia burgdorferi B31
GNAELKEKLLNLQNSF

SEQ ID NO: 118555 - protein, 16 aa, Borrelia burgdorferi B31
NAELKEKLLNLQNSFQ

SEQ ID NO: 118556 - protein, 16 aa, Borrelia burgdorferi B31
AELKEKLLNLQNSFQD

SEQ ID NO: 118557 - protein, 16 aa, Borrelia burgdorferi B31
ELKEKLLNLQNSFQDK

SEQ ID NO: 118558 - protein, 16 aa, Borrelia burgdorferi B31
LKEKLLNLQNSFQDKL

SEQ ID NO: 118559 - protein, 16 aa, Borrelia burgdorferi B31
KEKLLNLQNSFQDKLA

SEQ ID NO: 118560 - protein, 16 aa, Borrelia burgdorferi B31
EKLLNLQNSFQDKLAA

SEQ ID NO: 118561 - protein, 16 aa, Borrelia burgdorferi B31
KLLNLQNSFQDKLAAK

SEQ ID NO: 118562 - protein, 16 aa, Borrelia burgdorferi B31
LLNLQNSFQDKLAAKL

SEQ ID NO: 118563 - protein, 16 aa, Borrelia burgdorferi B31
LNLQNSFQDKLAAKLA

SEQ ID NO: 118564 - protein, 16 aa, Borrelia burgdorferi B31
NLQNSFQDKLAAKLAA

SEQ ID NO: 118565 - protein, 16 aa, Borrelia burgdorferi B31
LQNSFQDKLAAKLAAL

SEQ ID NO: 118566 - protein, 16 aa, Borrelia burgdorferi B31
QNSFQDKLAAKLAALK

SEQ ID NO: 118567 - protein, 16 aa, Borrelia burgdorferi B31
NSFQDKLAAKLAALKA

SEQ ID NO: 118568 - protein, 16 aa, Borrelia burgdorferi B31
SFQDKLAAKLAALKAA

SEQ ID NO: 118569 - protein, 16 aa, Borrelia burgdorferi B31
FQDKLAAKLAALKAAK

SEQ ID NO: 118570 - protein, 16 aa, Borrelia burgdorferi B31
QDKLAAKLAALKAAKN

SEQ ID NO: 118571 - protein, 16 aa, Borrelia burgdorferi B31
DKLAAKLAALKAAKNT

SEQ ID NO: 118572 - protein, 16 aa, Borrelia burgdorferi B31
KLAAKLAALKAAKNTI

SEQ ID NO: 118573 - protein, 16 aa, Borrelia burgdorferi B31
LAAKLAALKAAKNTIE

SEQ ID NO: 118574 - protein, 16 aa, Borrelia burgdorferi B31
AAKLAALKAAKNTIEN

SEQ ID NO: 118575 - protein, 16 aa, Borrelia burgdorferi B31
AKLAALKAAKNTIENI

SEQ ID NO: 118576 - protein, 16 aa, Borrelia burgdorferi B31
KLAALKAAKNTIENIT

SEQ ID NO: 118577 - protein, 16 aa, Borrelia burgdorferi B31
LAALKAAKNTIENITD

SEQ ID NO: 118578 - protein, 16 aa, Borrelia burgdorferi B31
AALKAAKNTIENITDK

SEQ ID NO: 118579 - protein, 16 aa, Borrelia burgdorferi B31
ALKAAKNTIENITDKD

SEQ ID NO: 118580 - protein, 16 aa, Borrelia burgdorferi B31
LKAAKNTIENITDKDQ

SEQ ID NO: 118581 - protein, 16 aa, Borrelia burgdorferi B31
KAAKNTIENITDKDQD

SEQ ID NO: 118582 - protein, 16 aa, Borrelia burgdorferi B31
AAKNTIENITDKDQDI

SEQ ID NO: 118583 - protein, 16 aa, Borrelia burgdorferi B31
AKNTIENITDKDQDIS

SEQ ID NO: 118584 - protein, 16 aa, Borrelia burgdorferi B31
KNTIENITDKDQDISK

SEQ ID NO: 118585 - protein, 16 aa, Borrelia burgdorferi B31
NTIENITDKDQDISKR

SEQ ID NO: 118586 - protein, 16 aa, Borrelia burgdorferi B31
TIENITDKDQDISKRK

SEQ ID NO: 118587 - protein, 16 aa, Borrelia burgdorferi B31
IENITDKDQDISKRKI

SEQ ID NO: 118588 - protein, 16 aa, Borrelia burgdorferi B31
ENITDKDQDISKRKIW

SEQ ID NO: 118589 - protein, 16 aa, Borrelia burgdorferi B31
NITDKDQDISKRKIWS

SEQ ID NO: 118590 - protein, 16 aa, Borrelia burgdorferi B31
ITDKDQDISKRKIWSE

SEQ ID NO: 118591 - protein, 16 aa, Borrelia burgdorferi B31
TDKDQDISKRKIWSEA

SEQ ID NO: 118592 - protein, 16 aa, Borrelia burgdorferi B31
DKDQDISKRKIWSEAK

SEQ ID NO: 118593 - protein, 16 aa, Borrelia burgdorferi B31
KDQDISKRKIWSEAKL

SEQ ID NO: 118594 - protein, 16 aa, Borrelia burgdorferi B31
DQDISKRKIWSEAKLV

SEQ ID NO: 118595 - protein, 16 aa, Borrelia burgdorferi B31
QDISKRKIWSEAKLVG

SEQ ID NO: 118596 - protein, 16 aa, Borrelia burgdorferi B31
DISKRKIWSEAKLVGV

SEQ ID NO: 118597 - protein, 16 aa, Borrelia burgdorferi B31
ISKRKIWSEAKLVGVT

SEQ ID NO: 118598 - protein, 16 aa, Borrelia burgdorferi B31
SKRKIWSEAKLVGVTV

SEQ ID NO: 118599 - protein, 16 aa, Borrelia burgdorferi B31
KRKIWSEAKLVGVTVP

SEQ ID NO: 118600 - protein, 16 aa, Borrelia burgdorferi B31
RKIWSEAKLVGVTVPL

SEQ ID NO: 118601 - protein, 16 aa, Borrelia burgdorferi B31
KIWSEAKLVGVTVPLL

SEQ ID NO: 118602 - protein, 16 aa, Borrelia burgdorferi B31
IWSEAKLVGVTVPLLG

SEQ ID NO: 118603 - protein, 16 aa, Borrelia burgdorferi B31
WSEAKLVGVTVPLLGS

SEQ ID NO: 118604 - protein, 16 aa, Borrelia burgdorferi B31
SEAKLVGVTVPLLGSN

SEQ ID NO: 118605 - protein, 16 aa, Borrelia burgdorferi B31
EAKLVGVTVPLLGSNT

SEQ ID NO: 118606 - protein, 16 aa, Borrelia burgdorferi B31
AKLVGVTVPLLGSNTS

SEQ ID NO: 118607 - protein, 16 aa, Borrelia burgdorferi B31
KLVGVTVPLLGSNTSG

SEQ ID NO: 118608 - protein, 16 aa, Borrelia burgdorferi B31
LVGVTVPLLGSNTSGN

SEQ ID NO: 118609 - protein, 16 aa, Borrelia burgdorferi B31
VGVTVPLLGSNTSGNG

SEQ ID NO: 118610 - protein, 16 aa, Borrelia burgdorferi B31
GVTVPLLGSNTSGNGD

SEQ ID NO: 118611 - protein, 16 aa, Borrelia burgdorferi B31
VTVPLLGSNTSGNGDK

SEQ ID NO: 118612 - protein, 16 aa, Borrelia burgdorferi B31
TVPLLGSNTSGNGDKM

SEQ ID NO: 118613 - protein, 16 aa, Borrelia burgdorferi B31
VPLLGSNTSGNGDKMS

SEQ ID NO: 118614 - protein, 16 aa, Borrelia burgdorferi B31
PLLGSNTSGNGDKMSK

SEQ ID NO: 118615 - protein, 16 aa, Borrelia burgdorferi B31
LLGSNTSGNGDKMSKN

SEQ ID NO: 118616 - protein, 16 aa, Borrelia burgdorferi B31
LGSNTSGNGDKMSKNA

SEQ ID NO: 118617 - protein, 16 aa, Borrelia burgdorferi B31
GSNTSGNGDKMSKNAV

SEQ ID NO: 118618 - protein, 16 aa, Borrelia burgdorferi B31
SNTSGNGDKMSKNAVE

SEQ ID NO: 118619 - protein, 16 aa, Borrelia burgdorferi B31
NTSGNGDKMSKNAVEQ

SEQ ID NO: 118620 - protein, 16 aa, Borrelia burgdorferi B31
TSGNGDKMSKNAVEQI

SEQ ID NO: 118621 - protein, 16 aa, Borrelia burgdorferi B31
SGNGDKMSKNAVEQID

SEQ ID NO: 118622 - protein, 16 aa, Borrelia burgdorferi B31
GNGDKMSKNAVEQIDK

SEQ ID NO: 118623 - protein, 16 aa, Borrelia burgdorferi B31
NGDKMSKNAVEQIDKV

SEQ ID NO: 118624 - protein, 16 aa, Borrelia burgdorferi B31
GDKMSKNAVEQIDKVI

SEQ ID NO: 118625 - protein, 16 aa, Borrelia burgdorferi B31
DKMSKNAVEQIDKVIK

SEQ ID NO: 118626 - protein, 16 aa, Borrelia burgdorferi B31
KMSKNAVEQIDKVIKF

SEQ ID NO: 118627 - protein, 16 aa, Borrelia burgdorferi B31
MSKNAVEQIDKVIKFL

SEQ ID NO: 118628 - protein, 16 aa, Borrelia burgdorferi B31
SKNAVEQIDKVIKFLE

SEQ ID NO: 118629 - protein, 16 aa, Borrelia burgdorferi B31
KNAVEQIDKVIKFLEE

SEQ ID NO: 118630 - protein, 16 aa, Borrelia burgdorferi B31
NAVEQIDKVIKFLEEG

SEQ ID NO: 118631 - protein, 16 aa, Borrelia burgdorferi B31
AVEQIDKVIKFLEEGT

SEQ ID NO: 118632 - protein, 16 aa, Borrelia burgdorferi B31
VEQIDKVIKFLEEGTN

SEQ ID NO: 118633 - protein, 13 aa, Borrelia burgdorferi B31
MKDNILKNNKLIA

SEQ ID NO: 118634 - protein, 13 aa, Borrelia burgdorferi B31
KDNILKNNKLIAI

SEQ ID NO: 118635 - protein, 13 aa, Borrelia burgdorferi B31
DNILKNNKLIAIF

SEQ ID NO: 118636 - protein, 13 aa, Borrelia burgdorferi B31
NILKNNKLIAIFL

SEQ ID NO: 118637 - protein, 13 aa, Borrelia burgdorferi B31
ILKNNKLIAIFLL

SEQ ID NO: 118638 - protein, 13 aa, Borrelia burgdorferi B31
LKNNKLIAIFLLH

SEQ ID NO: 118639 - protein, 13 aa, Borrelia burgdorferi B31
KNNKLIAIFLLHV

SEQ ID NO: 118640 - protein, 13 aa, Borrelia burgdorferi B31
NNKLIAIFLLHVL

SEQ ID NO: 118641 - protein, 13 aa, Borrelia burgdorferi B31
NKLIAIFLLHVLT

SEQ ID NO: 118642 - protein, 13 aa, Borrelia burgdorferi B31
KLIAIFLLHVLTV

SEQ ID NO: 118643 - protein, 13 aa, Borrelia burgdorferi B31
LIAIFLLHVLTVL

SEQ ID NO: 118644 - protein, 13 aa, Borrelia burgdorferi B31
IAIFLLHVLTVLI

SEQ ID NO: 118645 - protein, 13 aa, Borrelia burgdorferi B31
AIFLLHVLTVLIL

SEQ ID NO: 118646 - protein, 13 aa, Borrelia burgdorferi B31
IFLLHVLTVLILI

SEQ ID NO: 118647 - protein, 13 aa, Borrelia burgdorferi B31
FLLHVLTVLILIS

SEQ ID NO: 118648 - protein, 13 aa, Borrelia burgdorferi B31
LLHVLTVLILISC

SEQ ID NO: 118649 - protein, 13 aa, Borrelia burgdorferi B31
LHVLTVLILISCS

SEQ ID NO: 118650 - protein, 13 aa, Borrelia burgdorferi B31
HVLTVLILISCSL

SEQ ID NO: 118651 - protein, 13 aa, Borrelia burgdorferi B31
VLTVLILISCSLE

SEQ ID NO: 118652 - protein, 13 aa, Borrelia burgdorferi B31
LTVLILISCSLEV

SEQ ID NO: 118653 - protein, 13 aa, Borrelia burgdorferi B31
TVLILISCSLEVK

SEQ ID NO: 118654 - protein, 13 aa, Borrelia burgdorferi B31
VLILISCSLEVKD

SEQ ID NO: 118655 - protein, 13 aa, Borrelia burgdorferi B31
LILISCSLEVKDS

SEQ ID NO: 118656 - protein, 13 aa, Borrelia burgdorferi B31
ILISCSLEVKDSN

SEQ ID NO: 118657 - protein, 13 aa, Borrelia burgdorferi B31
LISCSLEVKDSNE

SEQ ID NO: 118658 - protein, 13 aa, Borrelia burgdorferi B31
ISCSLEVKDSNES

SEQ ID NO: 118659 - protein, 13 aa, Borrelia burgdorferi B31
SCSLEVKDSNESK

SEQ ID NO: 118660 - protein, 13 aa, Borrelia burgdorferi B31
CSLEVKDSNESKK

SEQ ID NO: 118661 - protein, 13 aa, Borrelia burgdorferi B31
SLEVKDSNESKKH

SEQ ID NO: 118662 - protein, 13 aa, Borrelia burgdorferi B31
LEVKDSNESKKHK

SEQ ID NO: 118663 - protein, 13 aa, Borrelia burgdorferi B31
EVKDSNESKKHKK

SEQ ID NO: 118664 - protein, 13 aa, Borrelia burgdorferi B31
VKDSNESKKHKKE

SEQ ID NO: 118665 - protein, 13 aa, Borrelia burgdorferi B31
KDSNESKKHKKEK

SEQ ID NO: 118666 - protein, 13 aa, Borrelia burgdorferi B31
DSNESKKHKKEKR

SEQ ID NO: 118667 - protein, 13 aa, Borrelia burgdorferi B31
SNESKKHKKEKRK

SEQ ID NO: 118668 - protein, 13 aa, Borrelia burgdorferi B31
NESKKHKKEKRKG

SEQ ID NO: 118669 - protein, 13 aa, Borrelia burgdorferi B31
ESKKHKKEKRKGK

SEQ ID NO: 118670 - protein, 13 aa, Borrelia burgdorferi B31
SKKHKKEKRKGKV

SEQ ID NO: 118671 - protein, 13 aa, Borrelia burgdorferi B31
KKHKKEKRKGKVE

SEQ ID NO: 118672 - protein, 13 aa, Borrelia burgdorferi B31
KHKKEKRKGKVEN

SEQ ID NO: 118673 - protein, 13 aa, Borrelia burgdorferi B31
HKKEKRKGKVENL

SEQ ID NO: 118674 - protein, 13 aa, Borrelia burgdorferi B31
KKEKRKGKVENLL

SEQ ID NO: 118675 - protein, 13 aa, Borrelia burgdorferi B31
KEKRKGKVENLLV

SEQ ID NO: 118676 - protein, 13 aa, Borrelia burgdorferi B31
EKRKGKVENLLVA

SEQ ID NO: 118677 - protein, 13 aa, Borrelia burgdorferi B31
KRKGKVENLLVAI

SEQ ID NO: 118678 - protein, 13 aa, Borrelia burgdorferi B31
RKGKVENLLVAIN

SEQ ID NO: 118679 - protein, 13 aa, Borrelia burgdorferi B31
KGKVENLLVAINN

SEQ ID NO: 118680 - protein, 13 aa, Borrelia burgdorferi B31
GKVENLLVAINNL

SEQ ID NO: 118681 - protein, 13 aa, Borrelia burgdorferi B31
KVENLLVAINNLK

SEQ ID NO: 118682 - protein, 13 aa, Borrelia burgdorferi B31
VENLLVAINNLKN

SEQ ID NO: 118683 - protein, 13 aa, Borrelia burgdorferi B31
ENLLVAINNLKNP

SEQ ID NO: 118684 - protein, 13 aa, Borrelia burgdorferi B31
NLLVAINNLKNPT

SEQ ID NO: 118685 - protein, 13 aa, Borrelia burgdorferi B31
LLVAINNLKNPTK

SEQ ID NO: 118686 - protein, 13 aa, Borrelia burgdorferi B31
LVAINNLKNPTKP

SEQ ID NO: 118687 - protein, 13 aa, Borrelia burgdorferi B31
VAINNLKNPTKPA

SEQ ID NO: 118688 - protein, 13 aa, Borrelia burgdorferi B31
AINNLKNPTKPAA

SEQ ID NO: 118689 - protein, 13 aa, Borrelia burgdorferi B31
INNLKNPTKPAAG

SEQ ID NO: 118690 - protein, 13 aa, Borrelia burgdorferi B31
NNLKNPTKPAAGK

SEQ ID NO: 118691 - protein, 13 aa, Borrelia burgdorferi B31
NLKNPTKPAAGKN

SEQ ID NO: 118692 - protein, 13 aa, Borrelia burgdorferi B31
LKNPTKPAAGKNK

SEQ ID NO: 118693 - protein, 13 aa, Borrelia burgdorferi B31
KNPTKPAAGKNKA

SEQ ID NO: 118694 - protein, 13 aa, Borrelia burgdorferi B31
NPTKPAAGKNKAN

SEQ ID NO: 118695 - protein, 13 aa, Borrelia burgdorferi B31
PTKPAAGKNKANS

SEQ ID NO: 118696 - protein, 13 aa, Borrelia burgdorferi B31
TKPAAGKNKANSK

SEQ ID NO: 118697 - protein, 13 aa, Borrelia burgdorferi B31
KPAAGKNKANSKA

SEQ ID NO: 118698 - protein, 13 aa, Borrelia burgdorferi B31
PAAGKNKANSKAS

SEQ ID NO: 118699 - protein, 13 aa, Borrelia burgdorferi B31
AAGKNKANSKASK

SEQ ID NO: 118700 - protein, 13 aa, Borrelia burgdorferi B31
AGKNKANSKASKQ

SEQ ID NO: 118701 - protein, 13 aa, Borrelia burgdorferi B31
GKNKANSKASKQK

SEQ ID NO: 118702 - protein, 13 aa, Borrelia burgdorferi B31
KNKANSKASKQKN

SEQ ID NO: 118703 - protein, 13 aa, Borrelia burgdorferi B31
NKANSKASKQKNN

SEQ ID NO: 118704 - protein, 13 aa, Borrelia burgdorferi B31
KANSKASKQKNNP

SEQ ID NO: 118705 - protein, 13 aa, Borrelia burgdorferi B31
ANSKASKQKNNPN

SEQ ID NO: 118706 - protein, 13 aa, Borrelia burgdorferi B31
NSKASKQKNNPNA

SEQ ID NO: 118707 - protein, 13 aa, Borrelia burgdorferi B31
SKASKQKNNPNAN

SEQ ID NO: 118708 - protein, 13 aa, Borrelia burgdorferi B31
KASKQKNNPNANA

SEQ ID NO: 118709 - protein, 13 aa, Borrelia burgdorferi B31
ASKQKNNPNANAN

SEQ ID NO: 118710 - protein, 13 aa, Borrelia burgdorferi B31
SKQKNNPNANANN

SEQ ID NO: 118711 - protein, 13 aa, Borrelia burgdorferi B31
KQKNNPNANANNA

SEQ ID NO: 118712 - protein, 13 aa, Borrelia burgdorferi B31
QKNNPNANANNAP

SEQ ID NO: 118713 - protein, 13 aa, Borrelia burgdorferi B31
KNNPNANANNAPK

SEQ ID NO: 118714 - protein, 13 aa, Borrelia burgdorferi B31
NNPNANANNAPKK

SEQ ID NO: 118715 - protein, 13 aa, Borrelia burgdorferi B31
NPNANANNAPKKI

SEQ ID NO: 118716 - protein, 13 aa, Borrelia burgdorferi B31
PNANANNAPKKIL

SEQ ID NO: 118717 - protein, 13 aa, Borrelia burgdorferi B31
NANANNAPKKILD

SEQ ID NO: 118718 - protein, 13 aa, Borrelia burgdorferi B31
ANANNAPKKILDP

SEQ ID NO: 118719 - protein, 13 aa, Borrelia burgdorferi B31
NANNAPKKILDPE

SEQ ID NO: 118720 - protein, 13 aa, Borrelia burgdorferi B31
ANNAPKKILDPEV

SEQ ID NO: 118721 - protein, 13 aa, Borrelia burgdorferi B31
NNAPKKILDPEVA

SEQ ID NO: 118722 - protein, 13 aa, Borrelia burgdorferi B31
NAPKKILDPEVAK

SEQ ID NO: 118723 - protein, 13 aa, Borrelia burgdorferi B31
APKKILDPEVAKL

SEQ ID NO: 118724 - protein, 13 aa, Borrelia burgdorferi B31
PKKILDPEVAKLI

SEQ ID NO: 118725 - protein, 13 aa, Borrelia burgdorferi B31
KKILDPEVAKLIQ

SEQ ID NO: 118726 - protein, 13 aa, Borrelia burgdorferi B31
KILDPEVAKLIQK

SEQ ID NO: 118727 - protein, 13 aa, Borrelia burgdorferi B31
ILDPEVAKLIQKI

SEQ ID NO: 118728 - protein, 13 aa, Borrelia burgdorferi B31
LDPEVAKLIQKIL

SEQ ID NO: 118729 - protein, 13 aa, Borrelia burgdorferi B31
DPEVAKLIQKILD

SEQ ID NO: 118730 - protein, 13 aa, Borrelia burgdorferi B31
PEVAKLIQKILDR

SEQ ID NO: 118731 - protein, 13 aa, Borrelia burgdorferi B31
EVAKLIQKILDRS

SEQ ID NO: 118732 - protein, 13 aa, Borrelia burgdorferi B31
VAKLIQKILDRSE

SEQ ID NO: 118733 - protein, 13 aa, Borrelia burgdorferi B31
AKLIQKILDRSEN

SEQ ID NO: 118734 - protein, 13 aa, Borrelia burgdorferi B31
KLIQKILDRSENI

SEQ ID NO: 118735 - protein, 13 aa, Borrelia burgdorferi B31
LIQKILDRSENII

SEQ ID NO: 118736 - protein, 13 aa, Borrelia burgdorferi B31
IQKILDRSENIIQ

SEQ ID NO: 118737 - protein, 13 aa, Borrelia burgdorferi B31
QKILDRSENIIQI

SEQ ID NO: 118738 - protein, 13 aa, Borrelia burgdorferi B31
KILDRSENIIQIS

SEQ ID NO: 118739 - protein, 13 aa, Borrelia burgdorferi B31
ILDRSENIIQISE

SEQ ID NO: 118740 - protein, 13 aa, Borrelia burgdorferi B31
LDRSENIIQISEM

SEQ ID NO: 118741 - protein, 13 aa, Borrelia burgdorferi B31
DRSENIIQISEMD

SEQ ID NO: 118742 - protein, 13 aa, Borrelia burgdorferi B31
RSENIIQISEMDS

SEQ ID NO: 118743 - protein, 13 aa, Borrelia burgdorferi B31
SENIIQISEMDSS

SEQ ID NO: 118744 - protein, 13 aa, Borrelia burgdorferi B31
ENIIQISEMDSSR

SEQ ID NO: 118745 - protein, 13 aa, Borrelia burgdorferi B31
NIIQISEMDSSRG

SEQ ID NO: 118746 - protein, 13 aa, Borrelia burgdorferi B31
IIQISEMDSSRGE

SEQ ID NO: 118747 - protein, 13 aa, Borrelia burgdorferi B31
IQISEMDSSRGEP

SEQ ID NO: 118748 - protein, 13 aa, Borrelia burgdorferi B31
QISEMDSSRGEPN

SEQ ID NO: 118749 - protein, 13 aa, Borrelia burgdorferi B31
ISEMDSSRGEPND

SEQ ID NO: 118750 - protein, 13 aa, Borrelia burgdorferi B31
SEMDSSRGEPNDQ

SEQ ID NO: 118751 - protein, 13 aa, Borrelia burgdorferi B31
EMDSSRGEPNDQF

SEQ ID NO: 118752 - protein, 13 aa, Borrelia burgdorferi B31
MDSSRGEPNDQFG

SEQ ID NO: 118753 - protein, 13 aa, Borrelia burgdorferi B31
DSSRGEPNDQFGM

SEQ ID NO: 118754 - protein, 13 aa, Borrelia burgdorferi B31
SSRGEPNDQFGMR

SEQ ID NO: 118755 - protein, 13 aa, Borrelia burgdorferi B31
SRGEPNDQFGMRA

SEQ ID NO: 118756 - protein, 13 aa, Borrelia burgdorferi B31
RGEPNDQFGMRAE

SEQ ID NO: 118757 - protein, 13 aa, Borrelia burgdorferi B31
GEPNDQFGMRAEI

SEQ ID NO: 118758 - protein, 13 aa, Borrelia burgdorferi B31
EPNDQFGMRAEIF

SEQ ID NO: 118759 - protein, 13 aa, Borrelia burgdorferi B31
PNDQFGMRAEIFS

SEQ ID NO: 118760 - protein, 13 aa, Borrelia burgdorferi B31
NDQFGMRAEIFSK

SEQ ID NO: 118761 - protein, 13 aa, Borrelia burgdorferi B31
DQFGMRAEIFSKI

SEQ ID NO: 118762 - protein, 13 aa, Borrelia burgdorferi B31
QFGMRAEIFSKIF

SEQ ID NO: 118763 - protein, 13 aa, Borrelia burgdorferi B31
FGMRAEIFSKIFF

SEQ ID NO: 118764 - protein, 13 aa, Borrelia burgdorferi B31
GMRAEIFSKIFFN

SEQ ID NO: 118765 - protein, 13 aa, Borrelia burgdorferi B31
MRAEIFSKIFFNA

SEQ ID NO: 118766 - protein, 13 aa, Borrelia burgdorferi B31
RAEIFSKIFFNAN

SEQ ID NO: 118767 - protein, 13 aa, Borrelia burgdorferi B31
AEIFSKIFFNANS

SEQ ID NO: 118768 - protein, 13 aa, Borrelia burgdorferi B31
EIFSKIFFNANST

SEQ ID NO: 118769 - protein, 13 aa, Borrelia burgdorferi B31
IFSKIFFNANSTV

SEQ ID NO: 118770 - protein, 13 aa, Borrelia burgdorferi B31
FSKIFFNANSTVH

SEQ ID NO: 118771 - protein, 13 aa, Borrelia burgdorferi B31
SKIFFNANSTVHF

SEQ ID NO: 118772 - protein, 13 aa, Borrelia burgdorferi B31
KIFFNANSTVHFD

SEQ ID NO: 118773 - protein, 13 aa, Borrelia burgdorferi B31
IFFNANSTVHFDS

SEQ ID NO: 118774 - protein, 13 aa, Borrelia burgdorferi B31
FFNANSTVHFDSH

SEQ ID NO: 118775 - protein, 13 aa, Borrelia burgdorferi B31
FNANSTVHFDSHE

SEQ ID NO: 118776 - protein, 13 aa, Borrelia burgdorferi B31
NANSTVHFDSHEY

SEQ ID NO: 118777 - protein, 13 aa, Borrelia burgdorferi B31
ANSTVHFDSHEYT

SEQ ID NO: 118778 - protein, 13 aa, Borrelia burgdorferi B31
NSTVHFDSHEYTE

SEQ ID NO: 118779 - protein, 13 aa, Borrelia burgdorferi B31
STVHFDSHEYTEE

SEQ ID NO: 118780 - protein, 13 aa, Borrelia burgdorferi B31
TVHFDSHEYTEER

SEQ ID NO: 118781 - protein, 13 aa, Borrelia burgdorferi B31
VHFDSHEYTEERR

SEQ ID NO: 118782 - protein, 13 aa, Borrelia burgdorferi B31
HFDSHEYTEERRM

SEQ ID NO: 118783 - protein, 13 aa, Borrelia burgdorferi B31
FDSHEYTEERRML

SEQ ID NO: 118784 - protein, 13 aa, Borrelia burgdorferi B31
DSHEYTEERRMLY

SEQ ID NO: 118785 - protein, 13 aa, Borrelia burgdorferi B31
SHEYTEERRMLYT

SEQ ID NO: 118786 - protein, 13 aa, Borrelia burgdorferi B31
HEYTEERRMLYTS

SEQ ID NO: 118787 - protein, 13 aa, Borrelia burgdorferi B31
EYTEERRMLYTSL

SEQ ID NO: 118788 - protein, 13 aa, Borrelia burgdorferi B31
YTEERRMLYTSLN

SEQ ID NO: 118789 - protein, 13 aa, Borrelia burgdorferi B31
TEERRMLYTSLNF

SEQ ID NO: 118790 - protein, 13 aa, Borrelia burgdorferi B31
EERRMLYTSLNFN

SEQ ID NO: 118791 - protein, 13 aa, Borrelia burgdorferi B31
ERRMLYTSLNFNE

SEQ ID NO: 118792 - protein, 13 aa, Borrelia burgdorferi B31
RRMLYTSLNFNEG

SEQ ID NO: 118793 - protein, 13 aa, Borrelia burgdorferi B31
RMLYTSLNFNEGK

SEQ ID NO: 118794 - protein, 13 aa, Borrelia burgdorferi B31
MLYTSLNFNEGKI

SEQ ID NO: 118795 - protein, 13 aa, Borrelia burgdorferi B31
LYTSLNFNEGKIF

SEQ ID NO: 118796 - protein, 13 aa, Borrelia burgdorferi B31
YTSLNFNEGKIFN

SEQ ID NO: 118797 - protein, 13 aa, Borrelia burgdorferi B31
TSLNFNEGKIFNL

SEQ ID NO: 118798 - protein, 13 aa, Borrelia burgdorferi B31
SLNFNEGKIFNLG

SEQ ID NO: 118799 - protein, 13 aa, Borrelia burgdorferi B31
LNFNEGKIFNLGQ

SEQ ID NO: 118800 - protein, 13 aa, Borrelia burgdorferi B31
NFNEGKIFNLGQI

SEQ ID NO: 118801 - protein, 13 aa, Borrelia burgdorferi B31
FNEGKIFNLGQIL

SEQ ID NO: 118802 - protein, 13 aa, Borrelia burgdorferi B31
NEGKIFNLGQILS

SEQ ID NO: 118803 - protein, 13 aa, Borrelia burgdorferi B31
EGKIFNLGQILSK

SEQ ID NO: 118804 - protein, 13 aa, Borrelia burgdorferi B31
GKIFNLGQILSKL

SEQ ID NO: 118805 - protein, 13 aa, Borrelia burgdorferi B31
KIFNLGQILSKLS

SEQ ID NO: 118806 - protein, 13 aa, Borrelia burgdorferi B31
IFNLGQILSKLSQ

SEQ ID NO: 118807 - protein, 13 aa, Borrelia burgdorferi B31
FNLGQILSKLSQD

SEQ ID NO: 118808 - protein, 13 aa, Borrelia burgdorferi B31
NLGQILSKLSQDS

SEQ ID NO: 118809 - protein, 13 aa, Borrelia burgdorferi B31
LGQILSKLSQDSN

SEQ ID NO: 118810 - protein, 13 aa, Borrelia burgdorferi B31
GQILSKLSQDSNY

SEQ ID NO: 118811 - protein, 13 aa, Borrelia burgdorferi B31
QILSKLSQDSNYR

SEQ ID NO: 118812 - protein, 13 aa, Borrelia burgdorferi B31
ILSKLSQDSNYRG

SEQ ID NO: 118813 - protein, 13 aa, Borrelia burgdorferi B31
LSKLSQDSNYRGL

SEQ ID NO: 118814 - protein, 13 aa, Borrelia burgdorferi B31
SKLSQDSNYRGLV

SEQ ID NO: 118815 - protein, 13 aa, Borrelia burgdorferi B31
KLSQDSNYRGLVK

SEQ ID NO: 118816 - protein, 13 aa, Borrelia burgdorferi B31
LSQDSNYRGLVKE

SEQ ID NO: 118817 - protein, 13 aa, Borrelia burgdorferi B31
SQDSNYRGLVKET

SEQ ID NO: 118818 - protein, 13 aa, Borrelia burgdorferi B31
QDSNYRGLVKETL

SEQ ID NO: 118819 - protein, 13 aa, Borrelia burgdorferi B31
DSNYRGLVKETLI

SEQ ID NO: 118820 - protein, 13 aa, Borrelia burgdorferi B31
SNYRGLVKETLIN

SEQ ID NO: 118821 - protein, 13 aa, Borrelia burgdorferi B31
NYRGLVKETLINR

SEQ ID NO: 118822 - protein, 13 aa, Borrelia burgdorferi B31
YRGLVKETLINRG

SEQ ID NO: 118823 - protein, 13 aa, Borrelia burgdorferi B31
RGLVKETLINRGF

SEQ ID NO: 118824 - protein, 13 aa, Borrelia burgdorferi B31
GLVKETLINRGFS

SEQ ID NO: 118825 - protein, 13 aa, Borrelia burgdorferi B31
LVKETLINRGFSI

SEQ ID NO: 118826 - protein, 13 aa, Borrelia burgdorferi B31
VKETLINRGFSIQ

SEQ ID NO: 118827 - protein, 13 aa, Borrelia burgdorferi B31
KETLINRGFSIQL

SEQ ID NO: 118828 - protein, 13 aa, Borrelia burgdorferi B31
ETLINRGFSIQLA

SEQ ID NO: 118829 - protein, 13 aa, Borrelia burgdorferi B31
TLINRGFSIQLAM

SEQ ID NO: 118830 - protein, 13 aa, Borrelia burgdorferi B31
LINRGFSIQLAME

SEQ ID NO: 118831 - protein, 13 aa, Borrelia burgdorferi B31
INRGFSIQLAMEE

SEQ ID NO: 118832 - protein, 13 aa, Borrelia burgdorferi B31
NRGFSIQLAMEEI

SEQ ID NO: 118833 - protein, 13 aa, Borrelia burgdorferi B31
RGFSIQLAMEEIS

SEQ ID NO: 118834 - protein, 13 aa, Borrelia burgdorferi B31
GFSIQLAMEEISA

SEQ ID NO: 118835 - protein, 13 aa, Borrelia burgdorferi B31
FSIQLAMEEISAK

SEQ ID NO: 118836 - protein, 13 aa, Borrelia burgdorferi B31
SIQLAMEEISAKI

SEQ ID NO: 118837 - protein, 13 aa, Borrelia burgdorferi B31
IQLAMEEISAKIL

SEQ ID NO: 118838 - protein, 13 aa, Borrelia burgdorferi B31
QLAMEEISAKILN

SEQ ID NO: 118839 - protein, 13 aa, Borrelia burgdorferi B31
LAMEEISAKILNV

SEQ ID NO: 118840 - protein, 13 aa, Borrelia burgdorferi B31
AMEEISAKILNVK

SEQ ID NO: 118841 - protein, 13 aa, Borrelia burgdorferi B31
MEEISAKILNVKD

SEQ ID NO: 118842 - protein, 13 aa, Borrelia burgdorferi B31
EEISAKILNVKDK

SEQ ID NO: 118843 - protein, 13 aa, Borrelia burgdorferi B31
EISAKILNVKDKL

SEQ ID NO: 118844 - protein, 13 aa, Borrelia burgdorferi B31
ISAKILNVKDKLQ

SEQ ID NO: 118845 - protein, 13 aa, Borrelia burgdorferi B31
SAKILNVKDKLQQ

SEQ ID NO: 118846 - protein, 13 aa, Borrelia burgdorferi B31
AKILNVKDKLQQL

SEQ ID NO: 118847 - protein, 13 aa, Borrelia burgdorferi B31
KILNVKDKLQQLN

SEQ ID NO: 118848 - protein, 13 aa, Borrelia burgdorferi B31
ILNVKDKLQQLNK

SEQ ID NO: 118849 - protein, 13 aa, Borrelia burgdorferi B31
LNVKDKLQQLNKP

SEQ ID NO: 118850 - protein, 13 aa, Borrelia burgdorferi B31
NVKDKLQQLNKPN

SEQ ID NO: 118851 - protein, 13 aa, Borrelia burgdorferi B31
VKDKLQQLNKPNL

SEQ ID NO: 118852 - protein, 13 aa, Borrelia burgdorferi B31
KDKLQQLNKPNLE

SEQ ID NO: 118853 - protein, 13 aa, Borrelia burgdorferi B31
DKLQQLNKPNLET

SEQ ID NO: 118854 - protein, 13 aa, Borrelia burgdorferi B31
KLQQLNKPNLETL

SEQ ID NO: 118855 - protein, 13 aa, Borrelia burgdorferi B31
LQQLNKPNLETLY

SEQ ID NO: 118856 - protein, 13 aa, Borrelia burgdorferi B31
QQLNKPNLETLYN

SEQ ID NO: 118857 - protein, 13 aa, Borrelia burgdorferi B31
QLNKPNLETLYND

SEQ ID NO: 118858 - protein, 13 aa, Borrelia burgdorferi B31
LNKPNLETLYNDF

SEQ ID NO: 118859 - protein, 13 aa, Borrelia burgdorferi B31
NKPNLETLYNDFE

SEQ ID NO: 118860 - protein, 13 aa, Borrelia burgdorferi B31
KPNLETLYNDFEK

SEQ ID NO: 118861 - protein, 13 aa, Borrelia burgdorferi B31
PNLETLYNDFEKL

SEQ ID NO: 118862 - protein, 13 aa, Borrelia burgdorferi B31
NLETLYNDFEKLT

SEQ ID NO: 118863 - protein, 13 aa, Borrelia burgdorferi B31
LETLYNDFEKLTS

SEQ ID NO: 118864 - protein, 13 aa, Borrelia burgdorferi B31
ETLYNDFEKLTSL

SEQ ID NO: 118865 - protein, 13 aa, Borrelia burgdorferi B31
TLYNDFEKLTSLK

SEQ ID NO: 118866 - protein, 13 aa, Borrelia burgdorferi B31
LYNDFEKLTSLKE

SEQ ID NO: 118867 - protein, 13 aa, Borrelia burgdorferi B31
YNDFEKLTSLKEK

SEQ ID NO: 118868 - protein, 13 aa, Borrelia burgdorferi B31
NDFEKLTSLKEKW

SEQ ID NO: 118869 - protein, 13 aa, Borrelia burgdorferi B31
DFEKLTSLKEKWL

SEQ ID NO: 118870 - protein, 13 aa, Borrelia burgdorferi B31
FEKLTSLKEKWLK

SEQ ID NO: 118871 - protein, 13 aa, Borrelia burgdorferi B31
EKLTSLKEKWLKD

SEQ ID NO: 118872 - protein, 13 aa, Borrelia burgdorferi B31
KLTSLKEKWLKDT

SEQ ID NO: 118873 - protein, 13 aa, Borrelia burgdorferi B31
LTSLKEKWLKDTD

SEQ ID NO: 118874 - protein, 13 aa, Borrelia burgdorferi B31
TSLKEKWLKDTDD

SEQ ID NO: 118875 - protein, 13 aa, Borrelia burgdorferi B31
SLKEKWLKDTDDL

SEQ ID NO: 118876 - protein, 13 aa, Borrelia burgdorferi B31
LKEKWLKDTDDLI

SEQ ID NO: 118877 - protein, 13 aa, Borrelia burgdorferi B31
KEKWLKDTDDLID

SEQ ID NO: 118878 - protein, 13 aa, Borrelia burgdorferi B31
EKWLKDTDDLIDE

SEQ ID NO: 118879 - protein, 13 aa, Borrelia burgdorferi B31
KWLKDTDDLIDEY

SEQ ID NO: 118880 - protein, 13 aa, Borrelia burgdorferi B31
WLKDTDDLIDEYN

SEQ ID NO: 118881 - protein, 13 aa, Borrelia burgdorferi B31
LKDTDDLIDEYNT

SEQ ID NO: 118882 - protein, 13 aa, Borrelia burgdorferi B31
KDTDDLIDEYNTN

SEQ ID NO: 118883 - protein, 13 aa, Borrelia burgdorferi B31
DTDDLIDEYNTNP

SEQ ID NO: 118884 - protein, 13 aa, Borrelia burgdorferi B31
TDDLIDEYNTNPD

SEQ ID NO: 118885 - protein, 13 aa, Borrelia burgdorferi B31
DDLIDEYNTNPDL

SEQ ID NO: 118886 - protein, 13 aa, Borrelia burgdorferi B31
DLIDEYNTNPDLQ

SEQ ID NO: 118887 - protein, 13 aa, Borrelia burgdorferi B31
LIDEYNTNPDLQT

SEQ ID NO: 118888 - protein, 13 aa, Borrelia burgdorferi B31
IDEYNTNPDLQTD

SEQ ID NO: 118889 - protein, 13 aa, Borrelia burgdorferi B31
DEYNTNPDLQTDV

SEQ ID NO: 118890 - protein, 13 aa, Borrelia burgdorferi B31
EYNTNPDLQTDVS

SEQ ID NO: 118891 - protein, 13 aa, Borrelia burgdorferi B31
YNTNPDLQTDVSK

SEQ ID NO: 118892 - protein, 13 aa, Borrelia burgdorferi B31
NTNPDLQTDVSKL

SEQ ID NO: 118893 - protein, 13 aa, Borrelia burgdorferi B31
TNPDLQTDVSKLN

SEQ ID NO: 118894 - protein, 13 aa, Borrelia burgdorferi B31
NPDLQTDVSKLND

SEQ ID NO: 118895 - protein, 13 aa, Borrelia burgdorferi B31
PDLQTDVSKLNDT

SEQ ID NO: 118896 - protein, 13 aa, Borrelia burgdorferi B31
DLQTDVSKLNDTL

SEQ ID NO: 118897 - protein, 13 aa, Borrelia burgdorferi B31
LQTDVSKLNDTLR

SEQ ID NO: 118898 - protein, 13 aa, Borrelia burgdorferi B31
QTDVSKLNDTLRS

SEQ ID NO: 118899 - protein, 13 aa, Borrelia burgdorferi B31
TDVSKLNDTLRSK

SEQ ID NO: 118900 - protein, 13 aa, Borrelia burgdorferi B31
DVSKLNDTLRSKN

SEQ ID NO: 118901 - protein, 13 aa, Borrelia burgdorferi B31
VSKLNDTLRSKNS

SEQ ID NO: 118902 - protein, 13 aa, Borrelia burgdorferi B31
SKLNDTLRSKNSR

SEQ ID NO: 118903 - protein, 13 aa, Borrelia burgdorferi B31
KLNDTLRSKNSRA

SEQ ID NO: 118904 - protein, 13 aa, Borrelia burgdorferi B31
LNDTLRSKNSRAQ

SEQ ID NO: 118905 - protein, 13 aa, Borrelia burgdorferi B31
NDTLRSKNSRAQF

SEQ ID NO: 118906 - protein, 13 aa, Borrelia burgdorferi B31
DTLRSKNSRAQFA

SEQ ID NO: 118907 - protein, 13 aa, Borrelia burgdorferi B31
TLRSKNSRAQFAN

SEQ ID NO: 118908 - protein, 13 aa, Borrelia burgdorferi B31
LRSKNSRAQFANI

SEQ ID NO: 118909 - protein, 13 aa, Borrelia burgdorferi B31
RSKNSRAQFANIH

SEQ ID NO: 118910 - protein, 13 aa, Borrelia burgdorferi B31
SKNSRAQFANIHD

SEQ ID NO: 118911 - protein, 13 aa, Borrelia burgdorferi B31
KNSRAQFANIHDI

SEQ ID NO: 118912 - protein, 13 aa, Borrelia burgdorferi B31
NSRAQFANIHDII

SEQ ID NO: 118913 - protein, 13 aa, Borrelia burgdorferi B31
SRAQFANIHDIIL

SEQ ID NO: 118914 - protein, 13 aa, Borrelia burgdorferi B31
RAQFANIHDIILD

SEQ ID NO: 118915 - protein, 13 aa, Borrelia burgdorferi B31
AQFANIHDIILDL

SEQ ID NO: 118916 - protein, 13 aa, Borrelia burgdorferi B31
QFANIHDIILDLV

SEQ ID NO: 118917 - protein, 13 aa, Borrelia burgdorferi B31
FANIHDIILDLVN

SEQ ID NO: 118918 - protein, 13 aa, Borrelia burgdorferi B31
ANIHDIILDLVNT

SEQ ID NO: 118919 - protein, 13 aa, Borrelia burgdorferi B31
NIHDIILDLVNTT

SEQ ID NO: 118920 - protein, 13 aa, Borrelia burgdorferi B31
IHDIILDLVNTTT

SEQ ID NO: 118921 - protein, 13 aa, Borrelia burgdorferi B31
HDIILDLVNTTTN

SEQ ID NO: 118922 - protein, 13 aa, Borrelia burgdorferi B31
DIILDLVNTTTNI

SEQ ID NO: 118923 - protein, 13 aa, Borrelia burgdorferi B31
IILDLVNTTTNIL

SEQ ID NO: 118924 - protein, 13 aa, Borrelia burgdorferi B31
ILDLVNTTTNILA

SEQ ID NO: 118925 - protein, 13 aa, Borrelia burgdorferi B31
LDLVNTTTNILAP

SEQ ID NO: 118926 - protein, 13 aa, Borrelia burgdorferi B31
DLVNTTTNILAPI

SEQ ID NO: 118927 - protein, 13 aa, Borrelia burgdorferi B31
LVNTTTNILAPIQ

SEQ ID NO: 118928 - protein, 14 aa, Borrelia burgdorferi B31
MKDNILKNNKLIAI

SEQ ID NO: 118929 - protein, 14 aa, Borrelia burgdorferi B31
KDNILKNNKLIAIF

SEQ ID NO: 118930 - protein, 14 aa, Borrelia burgdorferi B31
DNILKNNKLIAIFL

SEQ ID NO: 118931 - protein, 14 aa, Borrelia burgdorferi B31
NILKNNKLIAIFLL

SEQ ID NO: 118932 - protein, 14 aa, Borrelia burgdorferi B31
ILKNNKLIAIFLLH

SEQ ID NO: 118933 - protein, 14 aa, Borrelia burgdorferi B31
LKNNKLIAIFLLHV

SEQ ID NO: 118934 - protein, 14 aa, Borrelia burgdorferi B31
KNNKLIAIFLLHVL

SEQ ID NO: 118935 - protein, 14 aa, Borrelia burgdorferi B31
NNKLIAIFLLHVLT

SEQ ID NO: 118936 - protein, 14 aa, Borrelia burgdorferi B31
NKLIAIFLLHVLTV

SEQ ID NO: 118937 - protein, 14 aa, Borrelia burgdorferi B31
KLIAIFLLHVLTVL

SEQ ID NO: 118938 - protein, 14 aa, Borrelia burgdorferi B31
LIAIFLLHVLTVLI

SEQ ID NO: 118939 - protein, 14 aa, Borrelia burgdorferi B31
IAIFLLHVLTVLIL

SEQ ID NO: 118940 - protein, 14 aa, Borrelia burgdorferi B31
AIFLLHVLTVLILI

SEQ ID NO: 118941 - protein, 14 aa, Borrelia burgdorferi B31
IFLLHVLTVLILIS

SEQ ID NO: 118942 - protein, 14 aa, Borrelia burgdorferi B31
FLLHVLTVLILISC

SEQ ID NO: 118943 - protein, 14 aa, Borrelia burgdorferi B31
LLHVLTVLILISCS

SEQ ID NO: 118944 - protein, 14 aa, Borrelia burgdorferi B31
LHVLTVLILISCSL

SEQ ID NO: 118945 - protein, 14 aa, Borrelia burgdorferi B31
HVLTVLILISCSLE

SEQ ID NO: 118946 - protein, 14 aa, Borrelia burgdorferi B31
VLTVLILISCSLEV

SEQ ID NO: 118947 - protein, 14 aa, Borrelia burgdorferi B31
LTVLILISCSLEVK

SEQ ID NO: 118948 - protein, 14 aa, Borrelia burgdorferi B31
TVLILISCSLEVKD

SEQ ID NO: 118949 - protein, 14 aa, Borrelia burgdorferi B31
VLILISCSLEVKDS

SEQ ID NO: 118950 - protein, 14 aa, Borrelia burgdorferi B31
LILISCSLEVKDSN

SEQ ID NO: 118951 - protein, 14 aa, Borrelia burgdorferi B31
ILISCSLEVKDSNE

SEQ ID NO: 118952 - protein, 14 aa, Borrelia burgdorferi B31
LISCSLEVKDSNES

SEQ ID NO: 118953 - protein, 14 aa, Borrelia burgdorferi B31
ISCSLEVKDSNESK

SEQ ID NO: 118954 - protein, 14 aa, Borrelia burgdorferi B31
SCSLEVKDSNESKK

SEQ ID NO: 118955 - protein, 14 aa, Borrelia burgdorferi B31
CSLEVKDSNESKKH

SEQ ID NO: 118956 - protein, 14 aa, Borrelia burgdorferi B31
SLEVKDSNESKKHK

SEQ ID NO: 118957 - protein, 14 aa, Borrelia burgdorferi B31
LEVKDSNESKKHKK

SEQ ID NO: 118958 - protein, 14 aa, Borrelia burgdorferi B31
EVKDSNESKKHKKE

SEQ ID NO: 118959 - protein, 14 aa, Borrelia burgdorferi B31
VKDSNESKKHKKEK

SEQ ID NO: 118960 - protein, 14 aa, Borrelia burgdorferi B31
KDSNESKKHKKEKR

SEQ ID NO: 118961 - protein, 14 aa, Borrelia burgdorferi B31
DSNESKKHKKEKRK

SEQ ID NO: 118962 - protein, 14 aa, Borrelia burgdorferi B31
SNESKKHKKEKRKG

SEQ ID NO: 118963 - protein, 14 aa, Borrelia burgdorferi B31
NESKKHKKEKRKGK

SEQ ID NO: 118964 - protein, 14 aa, Borrelia burgdorferi B31
ESKKHKKEKRKGKV

SEQ ID NO: 118965 - protein, 14 aa, Borrelia burgdorferi B31
SKKHKKEKRKGKVE

SEQ ID NO: 118966 - protein, 14 aa, Borrelia burgdorferi B31
KKHKKEKRKGKVEN

SEQ ID NO: 118967 - protein, 14 aa, Borrelia burgdorferi B31
KHKKEKRKGKVENL

SEQ ID NO: 118968 - protein, 14 aa, Borrelia burgdorferi B31
HKKEKRKGKVENLL

SEQ ID NO: 118969 - protein, 14 aa, Borrelia burgdorferi B31
KKEKRKGKVENLLV

SEQ ID NO: 118970 - protein, 14 aa, Borrelia burgdorferi B31
KEKRKGKVENLLVA

SEQ ID NO: 118971 - protein, 14 aa, Borrelia burgdorferi B31
EKRKGKVENLLVAI

SEQ ID NO: 118972 - protein, 14 aa, Borrelia burgdorferi B31
KRKGKVENLLVAIN

SEQ ID NO: 118973 - protein, 14 aa, Borrelia burgdorferi B31
RKGKVENLLVAINN

SEQ ID NO: 118974 - protein, 14 aa, Borrelia burgdorferi B31
KGKVENLLVAINNL

SEQ ID NO: 118975 - protein, 14 aa, Borrelia burgdorferi B31
GKVENLLVAINNLK

SEQ ID NO: 118976 - protein, 14 aa, Borrelia burgdorferi B31
KVENLLVAINNLKN

SEQ ID NO: 118977 - protein, 14 aa, Borrelia burgdorferi B31
VENLLVAINNLKNP

SEQ ID NO: 118978 - protein, 14 aa, Borrelia burgdorferi B31
ENLLVAINNLKNPT

SEQ ID NO: 118979 - protein, 14 aa, Borrelia burgdorferi B31
NLLVAINNLKNPTK

SEQ ID NO: 118980 - protein, 14 aa, Borrelia burgdorferi B31
LLVAINNLKNPTKP

SEQ ID NO: 118981 - protein, 14 aa, Borrelia burgdorferi B31
LVAINNLKNPTKPA

SEQ ID NO: 118982 - protein, 14 aa, Borrelia burgdorferi B31
VAINNLKNPTKPAA

SEQ ID NO: 118983 - protein, 14 aa, Borrelia burgdorferi B31
AINNLKNPTKPAAG

SEQ ID NO: 118984 - protein, 14 aa, Borrelia burgdorferi B31
INNLKNPTKPAAGK

SEQ ID NO: 118985 - protein, 14 aa, Borrelia burgdorferi B31
NNLKNPTKPAAGKN

SEQ ID NO: 118986 - protein, 14 aa, Borrelia burgdorferi B31
NLKNPTKPAAGKNK

SEQ ID NO: 118987 - protein, 14 aa, Borrelia burgdorferi B31
LKNPTKPAAGKNKA

SEQ ID NO: 118988 - protein, 14 aa, Borrelia burgdorferi B31
KNPTKPAAGKNKAN

SEQ ID NO: 118989 - protein, 14 aa, Borrelia burgdorferi B31
NPTKPAAGKNKANS

SEQ ID NO: 118990 - protein, 14 aa, Borrelia burgdorferi B31
PTKPAAGKNKANSK

SEQ ID NO: 118991 - protein, 14 aa, Borrelia burgdorferi B31
TKPAAGKNKANSKA

SEQ ID NO: 118992 - protein, 14 aa, Borrelia burgdorferi B31
KPAAGKNKANSKAS

SEQ ID NO: 118993 - protein, 14 aa, Borrelia burgdorferi B31
PAAGKNKANSKASK

SEQ ID NO: 118994 - protein, 14 aa, Borrelia burgdorferi B31
AAGKNKANSKASKQ

SEQ ID NO: 118995 - protein, 14 aa, Borrelia burgdorferi B31
AGKNKANSKASKQK

SEQ ID NO: 118996 - protein, 14 aa, Borrelia burgdorferi B31
GKNKANSKASKQKN

SEQ ID NO: 118997 - protein, 14 aa, Borrelia burgdorferi B31
KNKANSKASKQKNN

SEQ ID NO: 118998 - protein, 14 aa, Borrelia burgdorferi B31
NKANSKASKQKNNP

SEQ ID NO: 118999 - protein, 14 aa, Borrelia burgdorferi B31
KANSKASKQKNNPN

SEQ ID NO: 119000 - protein, 14 aa, Borrelia burgdorferi B31
ANSKASKQKNNPNA

SEQ ID NO: 119001 - protein, 14 aa, Borrelia burgdorferi B31
NSKASKQKNNPNAN

SEQ ID NO: 119002 - protein, 14 aa, Borrelia burgdorferi B31
SKASKQKNNPNANA

SEQ ID NO: 119003 - protein, 14 aa, Borrelia burgdorferi B31
KASKQKNNPNANAN

SEQ ID NO: 119004 - protein, 14 aa, Borrelia burgdorferi B31
ASKQKNNPNANANN

SEQ ID NO: 119005 - protein, 14 aa, Borrelia burgdorferi B31
SKQKNNPNANANNA

SEQ ID NO: 119006 - protein, 14 aa, Borrelia burgdorferi B31
KQKNNPNANANNAP

SEQ ID NO: 119007 - protein, 14 aa, Borrelia burgdorferi B31
QKNNPNANANNAPK

SEQ ID NO: 119008 - protein, 14 aa, Borrelia burgdorferi B31
KNNPNANANNAPKK

SEQ ID NO: 119009 - protein, 14 aa, Borrelia burgdorferi B31
NNPNANANNAPKKI

SEQ ID NO: 119010 - protein, 14 aa, Borrelia burgdorferi B31
NPNANANNAPKKIL

SEQ ID NO: 119011 - protein, 14 aa, Borrelia burgdorferi B31
PNANANNAPKKILD

SEQ ID NO: 119012 - protein, 14 aa, Borrelia burgdorferi B31
NANANNAPKKILDP

SEQ ID NO: 119013 - protein, 14 aa, Borrelia burgdorferi B31
ANANNAPKKILDPE

SEQ ID NO: 119014 - protein, 14 aa, Borrelia burgdorferi B31
NANNAPKKILDPEV

SEQ ID NO: 119015 - protein, 14 aa, Borrelia burgdorferi B31
ANNAPKKILDPEVA

SEQ ID NO: 119016 - protein, 14 aa, Borrelia burgdorferi B31
NNAPKKILDPEVAK

SEQ ID NO: 119017 - protein, 14 aa, Borrelia burgdorferi B31
NAPKKILDPEVAKL

SEQ ID NO: 119018 - protein, 14 aa, Borrelia burgdorferi B31
APKKILDPEVAKLI

SEQ ID NO: 119019 - protein, 14 aa, Borrelia burgdorferi B31
PKKILDPEVAKLIQ

SEQ ID NO: 119020 - protein, 14 aa, Borrelia burgdorferi B31
KKILDPEVAKLIQK

SEQ ID NO: 119021 - protein, 14 aa, Borrelia burgdorferi B31
KILDPEVAKLIQKI

SEQ ID NO: 119022 - protein, 14 aa, Borrelia burgdorferi B31
ILDPEVAKLIQKIL

SEQ ID NO: 119023 - protein, 14 aa, Borrelia burgdorferi B31
LDPEVAKLIQKILD

SEQ ID NO: 119024 - protein, 14 aa, Borrelia burgdorferi B31
DPEVAKLIQKILDR

SEQ ID NO: 119025 - protein, 14 aa, Borrelia burgdorferi B31
PEVAKLIQKILDRS

SEQ ID NO: 119026 - protein, 14 aa, Borrelia burgdorferi B31
EVAKLIQKILDRSE

SEQ ID NO: 119027 - protein, 14 aa, Borrelia burgdorferi B31
VAKLIQKILDRSEN

SEQ ID NO: 119028 - protein, 14 aa, Borrelia burgdorferi B31
AKLIQKILDRSENI

SEQ ID NO: 119029 - protein, 14 aa, Borrelia burgdorferi B31
KLIQKILDRSENII

SEQ ID NO: 119030 - protein, 14 aa, Borrelia burgdorferi B31
LIQKILDRSENIIQ

SEQ ID NO: 119031 - protein, 14 aa, Borrelia burgdorferi B31
IQKILDRSENIIQI

SEQ ID NO: 119032 - protein, 14 aa, Borrelia burgdorferi B31
QKILDRSENIIQIS

SEQ ID NO: 119033 - protein, 14 aa, Borrelia burgdorferi B31
KILDRSENIIQISE

SEQ ID NO: 119034 - protein, 14 aa, Borrelia burgdorferi B31
ILDRSENIIQISEM

SEQ ID NO: 119035 - protein, 14 aa, Borrelia burgdorferi B31
LDRSENIIQISEMD

SEQ ID NO: 119036 - protein, 14 aa, Borrelia burgdorferi B31
DRSENIIQISEMDS

SEQ ID NO: 119037 - protein, 14 aa, Borrelia burgdorferi B31
RSENIIQISEMDSS

SEQ ID NO: 119038 - protein, 14 aa, Borrelia burgdorferi B31
SENIIQISEMDSSR

SEQ ID NO: 119039 - protein, 14 aa, Borrelia burgdorferi B31
ENIIQISEMDSSRG

SEQ ID NO: 119040 - protein, 14 aa, Borrelia burgdorferi B31
NIIQISEMDSSRGE

SEQ ID NO: 119041 - protein, 14 aa, Borrelia burgdorferi B31
IIQISEMDSSRGEP

SEQ ID NO: 119042 - protein, 14 aa, Borrelia burgdorferi B31
IQISEMDSSRGEPN

SEQ ID NO: 119043 - protein, 14 aa, Borrelia burgdorferi B31
QISEMDSSRGEPND

SEQ ID NO: 119044 - protein, 14 aa, Borrelia burgdorferi B31
ISEMDSSRGEPNDQ

SEQ ID NO: 119045 - protein, 14 aa, Borrelia burgdorferi B31
SEMDSSRGEPNDQF

SEQ ID NO: 119046 - protein, 14 aa, Borrelia burgdorferi B31
EMDSSRGEPNDQFG

SEQ ID NO: 119047 - protein, 14 aa, Borrelia burgdorferi B31
MDSSRGEPNDQFGM

SEQ ID NO: 119048 - protein, 14 aa, Borrelia burgdorferi B31
DSSRGEPNDQFGMR

SEQ ID NO: 119049 - protein, 14 aa, Borrelia burgdorferi B31
SSRGEPNDQFGMRA

SEQ ID NO: 119050 - protein, 14 aa, Borrelia burgdorferi B31
SRGEPNDQFGMRAE

SEQ ID NO: 119051 - protein, 14 aa, Borrelia burgdorferi B31
RGEPNDQFGMRAEI

SEQ ID NO: 119052 - protein, 14 aa, Borrelia burgdorferi B31
GEPNDQFGMRAEIF

SEQ ID NO: 119053 - protein, 14 aa, Borrelia burgdorferi B31
EPNDQFGMRAEIFS

SEQ ID NO: 119054 - protein, 14 aa, Borrelia burgdorferi B31
PNDQFGMRAEIFSK

SEQ ID NO: 119055 - protein, 14 aa, Borrelia burgdorferi B31
NDQFGMRAEIFSKI

SEQ ID NO: 119056 - protein, 14 aa, Borrelia burgdorferi B31
DQFGMRAEIFSKIF

SEQ ID NO: 119057 - protein, 14 aa, Borrelia burgdorferi B31
QFGMRAEIFSKIFF

SEQ ID NO: 119058 - protein, 14 aa, Borrelia burgdorferi B31
FGMRAEIFSKIFFN

SEQ ID NO: 119059 - protein, 14 aa, Borrelia burgdorferi B31
GMRAEIFSKIFFNA

SEQ ID NO: 119060 - protein, 14 aa, Borrelia burgdorferi B31
MRAEIFSKIFFNAN

SEQ ID NO: 119061 - protein, 14 aa, Borrelia burgdorferi B31
RAEIFSKIFFNANS

SEQ ID NO: 119062 - protein, 14 aa, Borrelia burgdorferi B31
AEIFSKIFFNANST

SEQ ID NO: 119063 - protein, 14 aa, Borrelia burgdorferi B31
EIFSKIFFNANSTV

SEQ ID NO: 119064 - protein, 14 aa, Borrelia burgdorferi B31
IFSKIFFNANSTVH

SEQ ID NO: 119065 - protein, 14 aa, Borrelia burgdorferi B31
FSKIFFNANSTVHF

SEQ ID NO: 119066 - protein, 14 aa, Borrelia burgdorferi B31
SKIFFNANSTVHFD

SEQ ID NO: 119067 - protein, 14 aa, Borrelia burgdorferi B31
KIFFNANSTVHFDS

SEQ ID NO: 119068 - protein, 14 aa, Borrelia burgdorferi B31
IFFNANSTVHFDSH

SEQ ID NO: 119069 - protein, 14 aa, Borrelia burgdorferi B31
FFNANSTVHFDSHE

SEQ ID NO: 119070 - protein, 14 aa, Borrelia burgdorferi B31
FNANSTVHFDSHEY

SEQ ID NO: 119071 - protein, 14 aa, Borrelia burgdorferi B31
NANSTVHFDSHEYT

SEQ ID NO: 119072 - protein, 14 aa, Borrelia burgdorferi B31
ANSTVHFDSHEYTE

SEQ ID NO: 119073 - protein, 14 aa, Borrelia burgdorferi B31
NSTVHFDSHEYTEE

SEQ ID NO: 119074 - protein, 14 aa, Borrelia burgdorferi B31
STVHFDSHEYTEER

SEQ ID NO: 119075 - protein, 14 aa, Borrelia burgdorferi B31
TVHFDSHEYTEERR

SEQ ID NO: 119076 - protein, 14 aa, Borrelia burgdorferi B31
VHFDSHEYTEERRM

SEQ ID NO: 119077 - protein, 14 aa, Borrelia burgdorferi B31
HFDSHEYTEERRML

SEQ ID NO: 119078 - protein, 14 aa, Borrelia burgdorferi B31
FDSHEYTEERRMLY

SEQ ID NO: 119079 - protein, 14 aa, Borrelia burgdorferi B31
DSHEYTEERRMLYT

SEQ ID NO: 119080 - protein, 14 aa, Borrelia burgdorferi B31
SHEYTEERRMLYTS

SEQ ID NO: 119081 - protein, 14 aa, Borrelia burgdorferi B31
HEYTEERRMLYTSL

SEQ ID NO: 119082 - protein, 14 aa, Borrelia burgdorferi B31
EYTEERRMLYTSLN

SEQ ID NO: 119083 - protein, 14 aa, Borrelia burgdorferi B31
YTEERRMLYTSLNF

SEQ ID NO: 119084 - protein, 14 aa, Borrelia burgdorferi B31
TEERRMLYTSLNFN

SEQ ID NO: 119085 - protein, 14 aa, Borrelia burgdorferi B31
EERRMLYTSLNFNE

SEQ ID NO: 119086 - protein, 14 aa, Borrelia burgdorferi B31
ERRMLYTSLNFNEG

SEQ ID NO: 119087 - protein, 14 aa, Borrelia burgdorferi B31
RRMLYTSLNFNEGK

SEQ ID NO: 119088 - protein, 14 aa, Borrelia burgdorferi B31
RMLYTSLNFNEGKI

SEQ ID NO: 119089 - protein, 14 aa, Borrelia burgdorferi B31
MLYTSLNFNEGKIF

SEQ ID NO: 119090 - protein, 14 aa, Borrelia burgdorferi B31
LYTSLNFNEGKIFN

SEQ ID NO: 119091 - protein, 14 aa, Borrelia burgdorferi B31
YTSLNFNEGKIFNL

SEQ ID NO: 119092 - protein, 14 aa, Borrelia burgdorferi B31
TSLNFNEGKIFNLG

SEQ ID NO: 119093 - protein, 14 aa, Borrelia burgdorferi B31
SLNFNEGKIFNLGQ

SEQ ID NO: 119094 - protein, 14 aa, Borrelia burgdorferi B31
LNFNEGKIFNLGQI

SEQ ID NO: 119095 - protein, 14 aa, Borrelia burgdorferi B31
NFNEGKIFNLGQIL

SEQ ID NO: 119096 - protein, 14 aa, Borrelia burgdorferi B31
FNEGKIFNLGQILS

SEQ ID NO: 119097 - protein, 14 aa, Borrelia burgdorferi B31
NEGKIFNLGQILSK

SEQ ID NO: 119098 - protein, 14 aa, Borrelia burgdorferi B31
EGKIFNLGQILSKL

SEQ ID NO: 119099 - protein, 14 aa, Borrelia burgdorferi B31
GKIFNLGQILSKLS

SEQ ID NO: 119100 - protein, 14 aa, Borrelia burgdorferi B31
KIFNLGQILSKLSQ

SEQ ID NO: 119101 - protein, 14 aa, Borrelia burgdorferi B31
IFNLGQILSKLSQD

SEQ ID NO: 119102 - protein, 14 aa, Borrelia burgdorferi B31
FNLGQILSKLSQDS

SEQ ID NO: 119103 - protein, 14 aa, Borrelia burgdorferi B31
NLGQILSKLSQDSN

SEQ ID NO: 119104 - protein, 14 aa, Borrelia burgdorferi B31
LGQILSKLSQDSNY

SEQ ID NO: 119105 - protein, 14 aa, Borrelia burgdorferi B31
GQILSKLSQDSNYR

SEQ ID NO: 119106 - protein, 14 aa, Borrelia burgdorferi B31
QILSKLSQDSNYRG

SEQ ID NO: 119107 - protein, 14 aa, Borrelia burgdorferi B31
ILSKLSQDSNYRGL

SEQ ID NO: 119108 - protein, 14 aa, Borrelia burgdorferi B31
LSKLSQDSNYRGLV

SEQ ID NO: 119109 - protein, 14 aa, Borrelia burgdorferi B31
SKLSQDSNYRGLVK

SEQ ID NO: 119110 - protein, 14 aa, Borrelia burgdorferi B31
KLSQDSNYRGLVKE

SEQ ID NO: 119111 - protein, 14 aa, Borrelia burgdorferi B31
LSQDSNYRGLVKET

SEQ ID NO: 119112 - protein, 14 aa, Borrelia burgdorferi B31
SQDSNYRGLVKETL

SEQ ID NO: 119113 - protein, 14 aa, Borrelia burgdorferi B31
QDSNYRGLVKETLI

SEQ ID NO: 119114 - protein, 14 aa, Borrelia burgdorferi B31
DSNYRGLVKETLIN

SEQ ID NO: 119115 - protein, 14 aa, Borrelia burgdorferi B31
SNYRGLVKETLINR

SEQ ID NO: 119116 - protein, 14 aa, Borrelia burgdorferi B31
NYRGLVKETLINRG

SEQ ID NO: 119117 - protein, 14 aa, Borrelia burgdorferi B31
YRGLVKETLINRGF

SEQ ID NO: 119118 - protein, 14 aa, Borrelia burgdorferi B31
RGLVKETLINRGFS

SEQ ID NO: 119119 - protein, 14 aa, Borrelia burgdorferi B31
GLVKETLINRGFSI

SEQ ID NO: 119120 - protein, 14 aa, Borrelia burgdorferi B31
LVKETLINRGFSIQ

SEQ ID NO: 119121 - protein, 14 aa, Borrelia burgdorferi B31
VKETLINRGFSIQL

SEQ ID NO: 119122 - protein, 14 aa, Borrelia burgdorferi B31
KETLINRGFSIQLA

SEQ ID NO: 119123 - protein, 14 aa, Borrelia burgdorferi B31
ETLINRGFSIQLAM

SEQ ID NO: 119124 - protein, 14 aa, Borrelia burgdorferi B31
TLINRGFSIQLAME

SEQ ID NO: 119125 - protein, 14 aa, Borrelia burgdorferi B31
LINRGFSIQLAMEE

SEQ ID NO: 119126 - protein, 14 aa, Borrelia burgdorferi B31
INRGFSIQLAMEEI

SEQ ID NO: 119127 - protein, 14 aa, Borrelia burgdorferi B31
NRGFSIQLAMEEIS

SEQ ID NO: 119128 - protein, 14 aa, Borrelia burgdorferi B31
RGFSIQLAMEEISA

SEQ ID NO: 119129 - protein, 14 aa, Borrelia burgdorferi B31
GFSIQLAMEEISAK

SEQ ID NO: 119130 - protein, 14 aa, Borrelia burgdorferi B31
FSIQLAMEEISAKI

SEQ ID NO: 119131 - protein, 14 aa, Borrelia burgdorferi B31
SIQLAMEEISAKIL

SEQ ID NO: 119132 - protein, 14 aa, Borrelia burgdorferi B31
IQLAMEEISAKILN

SEQ ID NO: 119133 - protein, 14 aa, Borrelia burgdorferi B31
QLAMEEISAKILNV

SEQ ID NO: 119134 - protein, 14 aa, Borrelia burgdorferi B31
LAMEEISAKILNVK

SEQ ID NO: 119135 - protein, 14 aa, Borrelia burgdorferi B31
AMEEISAKILNVKD

SEQ ID NO: 119136 - protein, 14 aa, Borrelia burgdorferi B31
MEEISAKILNVKDK

SEQ ID NO: 119137 - protein, 14 aa, Borrelia burgdorferi B31
EEISAKILNVKDKL

SEQ ID NO: 119138 - protein, 14 aa, Borrelia burgdorferi B31
EISAKILNVKDKLQ

SEQ ID NO: 119139 - protein, 14 aa, Borrelia burgdorferi B31
ISAKILNVKDKLQQ

SEQ ID NO: 119140 - protein, 14 aa, Borrelia burgdorferi B31
SAKILNVKDKLQQL

SEQ ID NO: 119141 - protein, 14 aa, Borrelia burgdorferi B31
AKILNVKDKLQQLN

SEQ ID NO: 119142 - protein, 14 aa, Borrelia burgdorferi B31
KILNVKDKLQQLNK

SEQ ID NO: 119143 - protein, 14 aa, Borrelia burgdorferi B31
ILNVKDKLQQLNKP

SEQ ID NO: 119144 - protein, 14 aa, Borrelia burgdorferi B31
LNVKDKLQQLNKPN

SEQ ID NO: 119145 - protein, 14 aa, Borrelia burgdorferi B31
NVKDKLQQLNKPNL

SEQ ID NO: 119146 - protein, 14 aa, Borrelia burgdorferi B31
VKDKLQQLNKPNLE

SEQ ID NO: 119147 - protein, 14 aa, Borrelia burgdorferi B31
KDKLQQLNKPNLET

SEQ ID NO: 119148 - protein, 14 aa, Borrelia burgdorferi B31
DKLQQLNKPNLETL

SEQ ID NO: 119149 - protein, 14 aa, Borrelia burgdorferi B31
KLQQLNKPNLETLY

SEQ ID NO: 119150 - protein, 14 aa, Borrelia burgdorferi B31
LQQLNKPNLETLYN

SEQ ID NO: 119151 - protein, 14 aa, Borrelia burgdorferi B31
QQLNKPNLETLYND

SEQ ID NO: 119152 - protein, 14 aa, Borrelia burgdorferi B31
QLNKPNLETLYNDF

SEQ ID NO: 119153 - protein, 14 aa, Borrelia burgdorferi B31
LNKPNLETLYNDFE

SEQ ID NO: 119154 - protein, 14 aa, Borrelia burgdorferi B31
NKPNLETLYNDFEK

SEQ ID NO: 119155 - protein, 14 aa, Borrelia burgdorferi B31
KPNLETLYNDFEKL

SEQ ID NO: 119156 - protein, 14 aa, Borrelia burgdorferi B31
PNLETLYNDFEKLT

SEQ ID NO: 119157 - protein, 14 aa, Borrelia burgdorferi B31
NLETLYNDFEKLTS

SEQ ID NO: 119158 - protein, 14 aa, Borrelia burgdorferi B31
LETLYNDFEKLTSL

SEQ ID NO: 119159 - protein, 14 aa, Borrelia burgdorferi B31
ETLYNDFEKLTSLK

SEQ ID NO: 119160 - protein, 14 aa, Borrelia burgdorferi B31
TLYNDFEKLTSLKE

SEQ ID NO: 119161 - protein, 14 aa, Borrelia burgdorferi B31
LYNDFEKLTSLKEK

SEQ ID NO: 119162 - protein, 14 aa, Borrelia burgdorferi B31
YNDFEKLTSLKEKW

SEQ ID NO: 119163 - protein, 14 aa, Borrelia burgdorferi B31
NDFEKLTSLKEKWL

SEQ ID NO: 119164 - protein, 14 aa, Borrelia burgdorferi B31
DFEKLTSLKEKWLK

SEQ ID NO: 119165 - protein, 14 aa, Borrelia burgdorferi B31
FEKLTSLKEKWLKD

SEQ ID NO: 119166 - protein, 14 aa, Borrelia burgdorferi B31
EKLTSLKEKWLKDT

SEQ ID NO: 119167 - protein, 14 aa, Borrelia burgdorferi B31
KLTSLKEKWLKDTD

SEQ ID NO: 119168 - protein, 14 aa, Borrelia burgdorferi B31
LTSLKEKWLKDTDD

SEQ ID NO: 119169 - protein, 14 aa, Borrelia burgdorferi B31
TSLKEKWLKDTDDL

SEQ ID NO: 119170 - protein, 14 aa, Borrelia burgdorferi B31
SLKEKWLKDTDDLI

SEQ ID NO: 119171 - protein, 14 aa, Borrelia burgdorferi B31
LKEKWLKDTDDLID

SEQ ID NO: 119172 - protein, 14 aa, Borrelia burgdorferi B31
KEKWLKDTDDLIDE

SEQ ID NO: 119173 - protein, 14 aa, Borrelia burgdorferi B31
EKWLKDTDDLIDEY

SEQ ID NO: 119174 - protein, 14 aa, Borrelia burgdorferi B31
KWLKDTDDLIDEYN

SEQ ID NO: 119175 - protein, 14 aa, Borrelia burgdorferi B31
WLKDTDDLIDEYNT

SEQ ID NO: 119176 - protein, 14 aa, Borrelia burgdorferi B31
LKDTDDLIDEYNTN

SEQ ID NO: 119177 - protein, 14 aa, Borrelia burgdorferi B31
KDTDDLIDEYNTNP

SEQ ID NO: 119178 - protein, 14 aa, Borrelia burgdorferi B31
DTDDLIDEYNTNPD

SEQ ID NO: 119179 - protein, 14 aa, Borrelia burgdorferi B31
TDDLIDEYNTNPDL

SEQ ID NO: 119180 - protein, 14 aa, Borrelia burgdorferi B31
DDLIDEYNTNPDLQ

SEQ ID NO: 119181 - protein, 14 aa, Borrelia burgdorferi B31
DLIDEYNTNPDLQT

SEQ ID NO: 119182 - protein, 14 aa, Borrelia burgdorferi B31
LIDEYNTNPDLQTD

SEQ ID NO: 119183 - protein, 14 aa, Borrelia burgdorferi B31
IDEYNTNPDLQTDV

SEQ ID NO: 119184 - protein, 14 aa, Borrelia burgdorferi B31
DEYNTNPDLQTDVS

SEQ ID NO: 119185 - protein, 14 aa, Borrelia burgdorferi B31
EYNTNPDLQTDVSK

SEQ ID NO: 119186 - protein, 14 aa, Borrelia burgdorferi B31
YNTNPDLQTDVSKL

SEQ ID NO: 119187 - protein, 14 aa, Borrelia burgdorferi B31
NTNPDLQTDVSKLN

SEQ ID NO: 119188 - protein, 14 aa, Borrelia burgdorferi B31
TNPDLQTDVSKLND

SEQ ID NO: 119189 - protein, 14 aa, Borrelia burgdorferi B31
NPDLQTDVSKLNDT

SEQ ID NO: 119190 - protein, 14 aa, Borrelia burgdorferi B31
PDLQTDVSKLNDTL

SEQ ID NO: 119191 - protein, 14 aa, Borrelia burgdorferi B31
DLQTDVSKLNDTLR

SEQ ID NO: 119192 - protein, 14 aa, Borrelia burgdorferi B31
LQTDVSKLNDTLRS

SEQ ID NO: 119193 - protein, 14 aa, Borrelia burgdorferi B31
QTDVSKLNDTLRSK

SEQ ID NO: 119194 - protein, 14 aa, Borrelia burgdorferi B31
TDVSKLNDTLRSKN

SEQ ID NO: 119195 - protein, 14 aa, Borrelia burgdorferi B31
DVSKLNDTLRSKNS

SEQ ID NO: 119196 - protein, 14 aa, Borrelia burgdorferi B31
VSKLNDTLRSKNSR

SEQ ID NO: 119197 - protein, 14 aa, Borrelia burgdorferi B31
SKLNDTLRSKNSRA

SEQ ID NO: 119198 - protein, 14 aa, Borrelia burgdorferi B31
KLNDTLRSKNSRAQ

SEQ ID NO: 119199 - protein, 14 aa, Borrelia burgdorferi B31
LNDTLRSKNSRAQF

SEQ ID NO: 119200 - protein, 14 aa, Borrelia burgdorferi B31
NDTLRSKNSRAQFA

SEQ ID NO: 119201 - protein, 14 aa, Borrelia burgdorferi B31
DTLRSKNSRAQFAN

SEQ ID NO: 119202 - protein, 14 aa, Borrelia burgdorferi B31
TLRSKNSRAQFANI

SEQ ID NO: 119203 - protein, 14 aa, Borrelia burgdorferi B31
LRSKNSRAQFANIH

SEQ ID NO: 119204 - protein, 14 aa, Borrelia burgdorferi B31
RSKNSRAQFANIHD

SEQ ID NO: 119205 - protein, 14 aa, Borrelia burgdorferi B31
SKNSRAQFANIHDI

SEQ ID NO: 119206 - protein, 14 aa, Borrelia burgdorferi B31
KNSRAQFANIHDII

SEQ ID NO: 119207 - protein, 14 aa, Borrelia burgdorferi B31
NSRAQFANIHDIIL

SEQ ID NO: 119208 - protein, 14 aa, Borrelia burgdorferi B31
SRAQFANIHDIILD

SEQ ID NO: 119209 - protein, 14 aa, Borrelia burgdorferi B31
RAQFANIHDIILDL

SEQ ID NO: 119210 - protein, 14 aa, Borrelia burgdorferi B31
AQFANIHDIILDLV

SEQ ID NO: 119211 - protein, 14 aa, Borrelia burgdorferi B31
QFANIHDIILDLVN

SEQ ID NO: 119212 - protein, 14 aa, Borrelia burgdorferi B31
FANIHDIILDLVNT

SEQ ID NO: 119213 - protein, 14 aa, Borrelia burgdorferi B31
ANIHDIILDLVNTT

SEQ ID NO: 119214 - protein, 14 aa, Borrelia burgdorferi B31
NIHDIILDLVNTTT

SEQ ID NO: 119215 - protein, 14 aa, Borrelia burgdorferi B31
IHDIILDLVNTTTN

SEQ ID NO: 119216 - protein, 14 aa, Borrelia burgdorferi B31
HDIILDLVNTTTNI

SEQ ID NO: 119217 - protein, 14 aa, Borrelia burgdorferi B31
DIILDLVNTTTNIL

SEQ ID NO: 119218 - protein, 14 aa, Borrelia burgdorferi B31
IILDLVNTTTNILA

SEQ ID NO: 119219 - protein, 14 aa, Borrelia burgdorferi B31
ILDLVNTTTNILAP

SEQ ID NO: 119220 - protein, 14 aa, Borrelia burgdorferi B31
LDLVNTTTNILAPI

SEQ ID NO: 119221 - protein, 14 aa, Borrelia burgdorferi B31
DLVNTTTNILAPIQ

SEQ ID NO: 119222 - protein, 15 aa, Borrelia burgdorferi B31
MKDNILKNNKLIAIF

SEQ ID NO: 119223 - protein, 15 aa, Borrelia burgdorferi B31
KDNILKNNKLIAIFL

SEQ ID NO: 119224 - protein, 15 aa, Borrelia burgdorferi B31
DNILKNNKLIAIFLL

SEQ ID NO: 119225 - protein, 15 aa, Borrelia burgdorferi B31
NILKNNKLIAIFLLH

SEQ ID NO: 119226 - protein, 15 aa, Borrelia burgdorferi B31
ILKNNKLIAIFLLHV

SEQ ID NO: 119227 - protein, 15 aa, Borrelia burgdorferi B31
LKNNKLIAIFLLHVL

SEQ ID NO: 119228 - protein, 15 aa, Borrelia burgdorferi B31
KNNKLIAIFLLHVLT

SEQ ID NO: 119229 - protein, 15 aa, Borrelia burgdorferi B31
NNKLIAIFLLHVLTV

SEQ ID NO: 119230 - protein, 15 aa, Borrelia burgdorferi B31
NKLIAIFLLHVLTVL

SEQ ID NO: 119231 - protein, 15 aa, Borrelia burgdorferi B31
KLIAIFLLHVLTVLI

SEQ ID NO: 119232 - protein, 15 aa, Borrelia burgdorferi B31
LIAIFLLHVLTVLIL

SEQ ID NO: 119233 - protein, 15 aa, Borrelia burgdorferi B31
IAIFLLHVLTVLILI

SEQ ID NO: 119234 - protein, 15 aa, Borrelia burgdorferi B31
AIFLLHVLTVLILIS

SEQ ID NO: 119235 - protein, 15 aa, Borrelia burgdorferi B31
IFLLHVLTVLILISC

SEQ ID NO: 119236 - protein, 15 aa, Borrelia burgdorferi B31
FLLHVLTVLILISCS

SEQ ID NO: 119237 - protein, 15 aa, Borrelia burgdorferi B31
LLHVLTVLILISCSL

SEQ ID NO: 119238 - protein, 15 aa, Borrelia burgdorferi B31
LHVLTVLILISCSLE

SEQ ID NO: 119239 - protein, 15 aa, Borrelia burgdorferi B31
HVLTVLILISCSLEV

SEQ ID NO: 119240 - protein, 15 aa, Borrelia burgdorferi B31
VLTVLILISCSLEVK

SEQ ID NO: 119241 - protein, 15 aa, Borrelia burgdorferi B31
LTVLILISCSLEVKD

SEQ ID NO: 119242 - protein, 15 aa, Borrelia burgdorferi B31
TVLILISCSLEVKDS

SEQ ID NO: 119243 - protein, 15 aa, Borrelia burgdorferi B31
VLILISCSLEVKDSN

SEQ ID NO: 119244 - protein, 15 aa, Borrelia burgdorferi B31
LILISCSLEVKDSNE

SEQ ID NO: 119245 - protein, 15 aa, Borrelia burgdorferi B31
ILISCSLEVKDSNES

SEQ ID NO: 119246 - protein, 15 aa, Borrelia burgdorferi B31
LISCSLEVKDSNESK

SEQ ID NO: 119247 - protein, 15 aa, Borrelia burgdorferi B31
ISCSLEVKDSNESKK

SEQ ID NO: 119248 - protein, 15 aa, Borrelia burgdorferi B31
SCSLEVKDSNESKKH

SEQ ID NO: 119249 - protein, 15 aa, Borrelia burgdorferi B31
CSLEVKDSNESKKHK

SEQ ID NO: 119250 - protein, 15 aa, Borrelia burgdorferi B31
SLEVKDSNESKKHKK

SEQ ID NO: 119251 - protein, 15 aa, Borrelia burgdorferi B31
LEVKDSNESKKHKKE

SEQ ID NO: 119252 - protein, 15 aa, Borrelia burgdorferi B31
EVKDSNESKKHKKEK

SEQ ID NO: 119253 - protein, 15 aa, Borrelia burgdorferi B31
VKDSNESKKHKKEKR

SEQ ID NO: 119254 - protein, 15 aa, Borrelia burgdorferi B31
KDSNESKKHKKEKRK

SEQ ID NO: 119255 - protein, 15 aa, Borrelia burgdorferi B31
DSNESKKHKKEKRKG

SEQ ID NO: 119256 - protein, 15 aa, Borrelia burgdorferi B31
SNESKKHKKEKRKGK

SEQ ID NO: 119257 - protein, 15 aa, Borrelia burgdorferi B31
NESKKHKKEKRKGKV

SEQ ID NO: 119258 - protein, 15 aa, Borrelia burgdorferi B31
ESKKHKKEKRKGKVE

SEQ ID NO: 119259 - protein, 15 aa, Borrelia burgdorferi B31
SKKHKKEKRKGKVEN

SEQ ID NO: 119260 - protein, 15 aa, Borrelia burgdorferi B31
KKHKKEKRKGKVENL

SEQ ID NO: 119261 - protein, 15 aa, Borrelia burgdorferi B31
KHKKEKRKGKVENLL

SEQ ID NO: 119262 - protein, 15 aa, Borrelia burgdorferi B31
HKKEKRKGKVENLLV

SEQ ID NO: 119263 - protein, 15 aa, Borrelia burgdorferi B31
KKEKRKGKVENLLVA

SEQ ID NO: 119264 - protein, 15 aa, Borrelia burgdorferi B31
KEKRKGKVENLLVAI

SEQ ID NO: 119265 - protein, 15 aa, Borrelia burgdorferi B31
EKRKGKVENLLVAIN

SEQ ID NO: 119266 - protein, 15 aa, Borrelia burgdorferi B31
KRKGKVENLLVAINN

SEQ ID NO: 119267 - protein, 15 aa, Borrelia burgdorferi B31
RKGKVENLLVAINNL

SEQ ID NO: 119268 - protein, 15 aa, Borrelia burgdorferi B31
KGKVENLLVAINNLK

SEQ ID NO: 119269 - protein, 15 aa, Borrelia burgdorferi B31
GKVENLLVAINNLKN

SEQ ID NO: 119270 - protein, 15 aa, Borrelia burgdorferi B31
KVENLLVAINNLKNP

SEQ ID NO: 119271 - protein, 15 aa, Borrelia burgdorferi B31
VENLLVAINNLKNPT

SEQ ID NO: 119272 - protein, 15 aa, Borrelia burgdorferi B31
ENLLVAINNLKNPTK

SEQ ID NO: 119273 - protein, 15 aa, Borrelia burgdorferi B31
NLLVAINNLKNPTKP

SEQ ID NO: 119274 - protein, 15 aa, Borrelia burgdorferi B31
LLVAINNLKNPTKPA

SEQ ID NO: 119275 - protein, 15 aa, Borrelia burgdorferi B31
LVAINNLKNPTKPAA

SEQ ID NO: 119276 - protein, 15 aa, Borrelia burgdorferi B31
VAINNLKNPTKPAAG

SEQ ID NO: 119277 - protein, 15 aa, Borrelia burgdorferi B31
AINNLKNPTKPAAGK

SEQ ID NO: 119278 - protein, 15 aa, Borrelia burgdorferi B31
INNLKNPTKPAAGKN

SEQ ID NO: 119279 - protein, 15 aa, Borrelia burgdorferi B31
NNLKNPTKPAAGKNK

SEQ ID NO: 119280 - protein, 15 aa, Borrelia burgdorferi B31
NLKNPTKPAAGKNKA

SEQ ID NO: 119281 - protein, 15 aa, Borrelia burgdorferi B31
LKNPTKPAAGKNKAN

SEQ ID NO: 119282 - protein, 15 aa, Borrelia burgdorferi B31
KNPTKPAAGKNKANS

SEQ ID NO: 119283 - protein, 15 aa, Borrelia burgdorferi B31
NPTKPAAGKNKANSK

SEQ ID NO: 119284 - protein, 15 aa, Borrelia burgdorferi B31
PTKPAAGKNKANSKA

SEQ ID NO: 119285 - protein, 15 aa, Borrelia burgdorferi B31
TKPAAGKNKANSKAS

SEQ ID NO: 119286 - protein, 15 aa, Borrelia burgdorferi B31
KPAAGKNKANSKASK

SEQ ID NO: 119287 - protein, 15 aa, Borrelia burgdorferi B31
PAAGKNKANSKASKQ

SEQ ID NO: 119288 - protein, 15 aa, Borrelia burgdorferi B31
AAGKNKANSKASKQK

SEQ ID NO: 119289 - protein, 15 aa, Borrelia burgdorferi B31
AGKNKANSKASKQKN

SEQ ID NO: 119290 - protein, 15 aa, Borrelia burgdorferi B31
GKNKANSKASKQKNN

SEQ ID NO: 119291 - protein, 15 aa, Borrelia burgdorferi B31
KNKANSKASKQKNNP

SEQ ID NO: 119292 - protein, 15 aa, Borrelia burgdorferi B31
NKANSKASKQKNNPN

SEQ ID NO: 119293 - protein, 15 aa, Borrelia burgdorferi B31
KANSKASKQKNNPNA

SEQ ID NO: 119294 - protein, 15 aa, Borrelia burgdorferi B31
ANSKASKQKNNPNAN

SEQ ID NO: 119295 - protein, 15 aa, Borrelia burgdorferi B31
NSKASKQKNNPNANA

SEQ ID NO: 119296 - protein, 15 aa, Borrelia burgdorferi B31
SKASKQKNNPNANAN

SEQ ID NO: 119297 - protein, 15 aa, Borrelia burgdorferi B31
KASKQKNNPNANANN

SEQ ID NO: 119298 - protein, 15 aa, Borrelia burgdorferi B31
ASKQKNNPNANANNA

SEQ ID NO: 119299 - protein, 15 aa, Borrelia burgdorferi B31
SKQKNNPNANANNAP

SEQ ID NO: 119300 - protein, 15 aa, Borrelia burgdorferi B31
KQKNNPNANANNAPK

SEQ ID NO: 119301 - protein, 15 aa, Borrelia burgdorferi B31
QKNNPNANANNAPKK

SEQ ID NO: 119302 - protein, 15 aa, Borrelia burgdorferi B31
KNNPNANANNAPKKI

SEQ ID NO: 119303 - protein, 15 aa, Borrelia burgdorferi B31
NNPNANANNAPKKIL

SEQ ID NO: 119304 - protein, 15 aa, Borrelia burgdorferi B31
NPNANANNAPKKILD

SEQ ID NO: 119305 - protein, 15 aa, Borrelia burgdorferi B31
PNANANNAPKKILDP

SEQ ID NO: 119306 - protein, 15 aa, Borrelia burgdorferi B31
NANANNAPKKILDPE

SEQ ID NO: 119307 - protein, 15 aa, Borrelia burgdorferi B31
ANANNAPKKILDPEV

SEQ ID NO: 119308 - protein, 15 aa, Borrelia burgdorferi B31
NANNAPKKILDPEVA

SEQ ID NO: 119309 - protein, 15 aa, Borrelia burgdorferi B31
ANNAPKKILDPEVAK

SEQ ID NO: 119310 - protein, 15 aa, Borrelia burgdorferi B31
NNAPKKILDPEVAKL

SEQ ID NO: 119311 - protein, 15 aa, Borrelia burgdorferi B31
NAPKKILDPEVAKLI

SEQ ID NO: 119312 - protein, 15 aa, Borrelia burgdorferi B31
APKKILDPEVAKLIQ

SEQ ID NO: 119313 - protein, 15 aa, Borrelia burgdorferi B31
PKKILDPEVAKLIQK

SEQ ID NO: 119314 - protein, 15 aa, Borrelia burgdorferi B31
KKILDPEVAKLIQKI

SEQ ID NO: 119315 - protein, 15 aa, Borrelia burgdorferi B31
KILDPEVAKLIQKIL

SEQ ID NO: 119316 - protein, 15 aa, Borrelia burgdorferi B31
ILDPEVAKLIQKILD

SEQ ID NO: 119317 - protein, 15 aa, Borrelia burgdorferi B31
LDPEVAKLIQKILDR

SEQ ID NO: 119318 - protein, 15 aa, Borrelia burgdorferi B31
DPEVAKLIQKILDRS

SEQ ID NO: 119319 - protein, 15 aa, Borrelia burgdorferi B31
PEVAKLIQKILDRSE

SEQ ID NO: 119320 - protein, 15 aa, Borrelia burgdorferi B31
EVAKLIQKILDRSEN

SEQ ID NO: 119321 - protein, 15 aa, Borrelia burgdorferi B31
VAKLIQKILDRSENI

SEQ ID NO: 119322 - protein, 15 aa, Borrelia burgdorferi B31
AKLIQKILDRSENII

SEQ ID NO: 119323 - protein, 15 aa, Borrelia burgdorferi B31
KLIQKILDRSENIIQ

SEQ ID NO: 119324 - protein, 15 aa, Borrelia burgdorferi B31
LIQKILDRSENIIQI

SEQ ID NO: 119325 - protein, 15 aa, Borrelia burgdorferi B31
IQKILDRSENIIQIS

SEQ ID NO: 119326 - protein, 15 aa, Borrelia burgdorferi B31
QKILDRSENIIQISE

SEQ ID NO: 119327 - protein, 15 aa, Borrelia burgdorferi B31
KILDRSENIIQISEM

SEQ ID NO: 119328 - protein, 15 aa, Borrelia burgdorferi B31
ILDRSENIIQISEMD

SEQ ID NO: 119329 - protein, 15 aa, Borrelia burgdorferi B31
LDRSENIIQISEMDS

SEQ ID NO: 119330 - protein, 15 aa, Borrelia burgdorferi B31
DRSENIIQISEMDSS

SEQ ID NO: 119331 - protein, 15 aa, Borrelia burgdorferi B31
RSENIIQISEMDSSR

SEQ ID NO: 119332 - protein, 15 aa, Borrelia burgdorferi B31
SENIIQISEMDSSRG

SEQ ID NO: 119333 - protein, 15 aa, Borrelia burgdorferi B31
ENIIQISEMDSSRGE

SEQ ID NO: 119334 - protein, 15 aa, Borrelia burgdorferi B31
NIIQISEMDSSRGEP

SEQ ID NO: 119335 - protein, 15 aa, Borrelia burgdorferi B31
IIQISEMDSSRGEPN

SEQ ID NO: 119336 - protein, 15 aa, Borrelia burgdorferi B31
IQISEMDSSRGEPND

SEQ ID NO: 119337 - protein, 15 aa, Borrelia burgdorferi B31
QISEMDSSRGEPNDQ

SEQ ID NO: 119338 - protein, 15 aa, Borrelia burgdorferi B31
ISEMDSSRGEPNDQF

SEQ ID NO: 119339 - protein, 15 aa, Borrelia burgdorferi B31
SEMDSSRGEPNDQFG

SEQ ID NO: 119340 - protein, 15 aa, Borrelia burgdorferi B31
EMDSSRGEPNDQFGM

SEQ ID NO: 119341 - protein, 15 aa, Borrelia burgdorferi B31
MDSSRGEPNDQFGMR

SEQ ID NO: 119342 - protein, 15 aa, Borrelia burgdorferi B31
DSSRGEPNDQFGMRA

SEQ ID NO: 119343 - protein, 15 aa, Borrelia burgdorferi B31
SSRGEPNDQFGMRAE

SEQ ID NO: 119344 - protein, 15 aa, Borrelia burgdorferi B31
SRGEPNDQFGMRAEI

SEQ ID NO: 119345 - protein, 15 aa, Borrelia burgdorferi B31
RGEPNDQFGMRAEIF

SEQ ID NO: 119346 - protein, 15 aa, Borrelia burgdorferi B31
GEPNDQFGMRAEIFS

SEQ ID NO: 119347 - protein, 15 aa, Borrelia burgdorferi B31
EPNDQFGMRAEIFSK

SEQ ID NO: 119348 - protein, 15 aa, Borrelia burgdorferi B31
PNDQFGMRAEIFSKI

SEQ ID NO: 119349 - protein, 15 aa, Borrelia burgdorferi B31
NDQFGMRAEIFSKIF

SEQ ID NO: 119350 - protein, 15 aa, Borrelia burgdorferi B31
DQFGMRAEIFSKIFF

SEQ ID NO: 119351 - protein, 15 aa, Borrelia burgdorferi B31
QFGMRAEIFSKIFFN

SEQ ID NO: 119352 - protein, 15 aa, Borrelia burgdorferi B31
FGMRAEIFSKIFFNA

SEQ ID NO: 119353 - protein, 15 aa, Borrelia burgdorferi B31
GMRAEIFSKIFFNAN

SEQ ID NO: 119354 - protein, 15 aa, Borrelia burgdorferi B31
MRAEIFSKIFFNANS

SEQ ID NO: 119355 - protein, 15 aa, Borrelia burgdorferi B31
RAEIFSKIFFNANST

SEQ ID NO: 119356 - protein, 15 aa, Borrelia burgdorferi B31
AEIFSKIFFNANSTV

SEQ ID NO: 119357 - protein, 15 aa, Borrelia burgdorferi B31
EIFSKIFFNANSTVH

SEQ ID NO: 119358 - protein, 15 aa, Borrelia burgdorferi B31
IFSKIFFNANSTVHF

SEQ ID NO: 119359 - protein, 15 aa, Borrelia burgdorferi B31
FSKIFFNANSTVHFD

SEQ ID NO: 119360 - protein, 15 aa, Borrelia burgdorferi B31
SKIFFNANSTVHFDS

SEQ ID NO: 119361 - protein, 15 aa, Borrelia burgdorferi B31
KIFFNANSTVHFDSH

SEQ ID NO: 119362 - protein, 15 aa, Borrelia burgdorferi B31
IFFNANSTVHFDSHE

SEQ ID NO: 119363 - protein, 15 aa, Borrelia burgdorferi B31
FFNANSTVHFDSHEY

SEQ ID NO: 119364 - protein, 15 aa, Borrelia burgdorferi B31
FNANSTVHFDSHEYT

SEQ ID NO: 119365 - protein, 15 aa, Borrelia burgdorferi B31
NANSTVHFDSHEYTE

SEQ ID NO: 119366 - protein, 15 aa, Borrelia burgdorferi B31
ANSTVHFDSHEYTEE

SEQ ID NO: 119367 - protein, 15 aa, Borrelia burgdorferi B31
NSTVHFDSHEYTEER

SEQ ID NO: 119368 - protein, 15 aa, Borrelia burgdorferi B31
STVHFDSHEYTEERR

SEQ ID NO: 119369 - protein, 15 aa, Borrelia burgdorferi B31
TVHFDSHEYTEERRM

SEQ ID NO: 119370 - protein, 15 aa, Borrelia burgdorferi B31
VHFDSHEYTEERRML

SEQ ID NO: 119371 - protein, 15 aa, Borrelia burgdorferi B31
HFDSHEYTEERRMLY

SEQ ID NO: 119372 - protein, 15 aa, Borrelia burgdorferi B31
FDSHEYTEERRMLYT

SEQ ID NO: 119373 - protein, 15 aa, Borrelia burgdorferi B31
DSHEYTEERRMLYTS

SEQ ID NO: 119374 - protein, 15 aa, Borrelia burgdorferi B31
SHEYTEERRMLYTSL

SEQ ID NO: 119375 - protein, 15 aa, Borrelia burgdorferi B31
HEYTEERRMLYTSLN

SEQ ID NO: 119376 - protein, 15 aa, Borrelia burgdorferi B31
EYTEERRMLYTSLNF

SEQ ID NO: 119377 - protein, 15 aa, Borrelia burgdorferi B31
YTEERRMLYTSLNFN

SEQ ID NO: 119378 - protein, 15 aa, Borrelia burgdorferi B31
TEERRMLYTSLNFNE

SEQ ID NO: 119379 - protein, 15 aa, Borrelia burgdorferi B31
EERRMLYTSLNFNEG

SEQ ID NO: 119380 - protein, 15 aa, Borrelia burgdorferi B31
ERRMLYTSLNFNEGK

SEQ ID NO: 119381 - protein, 15 aa, Borrelia burgdorferi B31
RRMLYTSLNFNEGKI

SEQ ID NO: 119382 - protein, 15 aa, Borrelia burgdorferi B31
RMLYTSLNFNEGKIF

SEQ ID NO: 119383 - protein, 15 aa, Borrelia burgdorferi B31
MLYTSLNFNEGKIFN

SEQ ID NO: 119384 - protein, 15 aa, Borrelia burgdorferi B31
LYTSLNFNEGKIFNL

SEQ ID NO: 119385 - protein, 15 aa, Borrelia burgdorferi B31
YTSLNFNEGKIFNLG

SEQ ID NO: 119386 - protein, 15 aa, Borrelia burgdorferi B31
TSLNFNEGKIFNLGQ

SEQ ID NO: 119387 - protein, 15 aa, Borrelia burgdorferi B31
SLNFNEGKIFNLGQI

SEQ ID NO: 119388 - protein, 15 aa, Borrelia burgdorferi B31
LNFNEGKIFNLGQIL

SEQ ID NO: 119389 - protein, 15 aa, Borrelia burgdorferi B31
NFNEGKIFNLGQILS

SEQ ID NO: 119390 - protein, 15 aa, Borrelia burgdorferi B31
FNEGKIFNLGQILSK

SEQ ID NO: 119391 - protein, 15 aa, Borrelia burgdorferi B31
NEGKIFNLGQILSKL

SEQ ID NO: 119392 - protein, 15 aa, Borrelia burgdorferi B31
EGKIFNLGQILSKLS

SEQ ID NO: 119393 - protein, 15 aa, Borrelia burgdorferi B31
GKIFNLGQILSKLSQ

SEQ ID NO: 119394 - protein, 15 aa, Borrelia burgdorferi B31
KIFNLGQILSKLSQD

SEQ ID NO: 119395 - protein, 15 aa, Borrelia burgdorferi B31
IFNLGQILSKLSQDS

SEQ ID NO: 119396 - protein, 15 aa, Borrelia burgdorferi B31
FNLGQILSKLSQDSN

SEQ ID NO: 119397 - protein, 15 aa, Borrelia burgdorferi B31
NLGQILSKLSQDSNY

SEQ ID NO: 119398 - protein, 15 aa, Borrelia burgdorferi B31
LGQILSKLSQDSNYR

SEQ ID NO: 119399 - protein, 15 aa, Borrelia burgdorferi B31
GQILSKLSQDSNYRG

SEQ ID NO: 119400 - protein, 15 aa, Borrelia burgdorferi B31
QILSKLSQDSNYRGL

SEQ ID NO: 119401 - protein, 15 aa, Borrelia burgdorferi B31
ILSKLSQDSNYRGLV

SEQ ID NO: 119402 - protein, 15 aa, Borrelia burgdorferi B31
LSKLSQDSNYRGLVK

SEQ ID NO: 119403 - protein, 15 aa, Borrelia burgdorferi B31
SKLSQDSNYRGLVKE

SEQ ID NO: 119404 - protein, 15 aa, Borrelia burgdorferi B31
KLSQDSNYRGLVKET

SEQ ID NO: 119405 - protein, 15 aa, Borrelia burgdorferi B31
LSQDSNYRGLVKETL

SEQ ID NO: 119406 - protein, 15 aa, Borrelia burgdorferi B31
SQDSNYRGLVKETLI

SEQ ID NO: 119407 - protein, 15 aa, Borrelia burgdorferi B31
QDSNYRGLVKETLIN

SEQ ID NO: 119408 - protein, 15 aa, Borrelia burgdorferi B31
DSNYRGLVKETLINR

SEQ ID NO: 119409 - protein, 15 aa, Borrelia burgdorferi B31
SNYRGLVKETLINRG

SEQ ID NO: 119410 - protein, 15 aa, Borrelia burgdorferi B31
NYRGLVKETLINRGF

SEQ ID NO: 119411 - protein, 15 aa, Borrelia burgdorferi B31
YRGLVKETLINRGFS

SEQ ID NO: 119412 - protein, 15 aa, Borrelia burgdorferi B31
RGLVKETLINRGFSI

SEQ ID NO: 119413 - protein, 15 aa, Borrelia burgdorferi B31
GLVKETLINRGFSIQ

SEQ ID NO: 119414 - protein, 15 aa, Borrelia burgdorferi B31
LVKETLINRGFSIQL

SEQ ID NO: 119415 - protein, 15 aa, Borrelia burgdorferi B31
VKETLINRGFSIQLA

SEQ ID NO: 119416 - protein, 15 aa, Borrelia burgdorferi B31
KETLINRGFSIQLAM

SEQ ID NO: 119417 - protein, 15 aa, Borrelia burgdorferi B31
ETLINRGFSIQLAME

SEQ ID NO: 119418 - protein, 15 aa, Borrelia burgdorferi B31
TLINRGFSIQLAMEE

SEQ ID NO: 119419 - protein, 15 aa, Borrelia burgdorferi B31
LINRGFSIQLAMEEI

SEQ ID NO: 119420 - protein, 15 aa, Borrelia burgdorferi B31
INRGFSIQLAMEEIS

SEQ ID NO: 119421 - protein, 15 aa, Borrelia burgdorferi B31
NRGFSIQLAMEEISA

SEQ ID NO: 119422 - protein, 15 aa, Borrelia burgdorferi B31
RGFSIQLAMEEISAK

SEQ ID NO: 119423 - protein, 15 aa, Borrelia burgdorferi B31
GFSIQLAMEEISAKI

SEQ ID NO: 119424 - protein, 15 aa, Borrelia burgdorferi B31
FSIQLAMEEISAKIL

SEQ ID NO: 119425 - protein, 15 aa, Borrelia burgdorferi B31
SIQLAMEEISAKILN

SEQ ID NO: 119426 - protein, 15 aa, Borrelia burgdorferi B31
IQLAMEEISAKILNV

SEQ ID NO: 119427 - protein, 15 aa, Borrelia burgdorferi B31
QLAMEEISAKILNVK

SEQ ID NO: 119428 - protein, 15 aa, Borrelia burgdorferi B31
LAMEEISAKILNVKD

SEQ ID NO: 119429 - protein, 15 aa, Borrelia burgdorferi B31
AMEEISAKILNVKDK

SEQ ID NO: 119430 - protein, 15 aa, Borrelia burgdorferi B31
MEEISAKILNVKDKL

SEQ ID NO: 119431 - protein, 15 aa, Borrelia burgdorferi B31
EEISAKILNVKDKLQ

SEQ ID NO: 119432 - protein, 15 aa, Borrelia burgdorferi B31
EISAKILNVKDKLQQ

SEQ ID NO: 119433 - protein, 15 aa, Borrelia burgdorferi B31
ISAKILNVKDKLQQL

SEQ ID NO: 119434 - protein, 15 aa, Borrelia burgdorferi B31
SAKILNVKDKLQQLN

SEQ ID NO: 119435 - protein, 15 aa, Borrelia burgdorferi B31
AKILNVKDKLQQLNK

SEQ ID NO: 119436 - protein, 15 aa, Borrelia burgdorferi B31
KILNVKDKLQQLNKP

SEQ ID NO: 119437 - protein, 15 aa, Borrelia burgdorferi B31
ILNVKDKLQQLNKPN

SEQ ID NO: 119438 - protein, 15 aa, Borrelia burgdorferi B31
LNVKDKLQQLNKPNL

SEQ ID NO: 119439 - protein, 15 aa, Borrelia burgdorferi B31
NVKDKLQQLNKPNLE

SEQ ID NO: 119440 - protein, 15 aa, Borrelia burgdorferi B31
VKDKLQQLNKPNLET

SEQ ID NO: 119441 - protein, 15 aa, Borrelia burgdorferi B31
KDKLQQLNKPNLETL

SEQ ID NO: 119442 - protein, 15 aa, Borrelia burgdorferi B31
DKLQQLNKPNLETLY

SEQ ID NO: 119443 - protein, 15 aa, Borrelia burgdorferi B31
KLQQLNKPNLETLYN

SEQ ID NO: 119444 - protein, 15 aa, Borrelia burgdorferi B31
LQQLNKPNLETLYND

SEQ ID NO: 119445 - protein, 15 aa, Borrelia burgdorferi B31
QQLNKPNLETLYNDF

SEQ ID NO: 119446 - protein, 15 aa, Borrelia burgdorferi B31
QLNKPNLETLYNDFE

SEQ ID NO: 119447 - protein, 15 aa, Borrelia burgdorferi B31
LNKPNLETLYNDFEK

SEQ ID NO: 119448 - protein, 15 aa, Borrelia burgdorferi B31
NKPNLETLYNDFEKL

SEQ ID NO: 119449 - protein, 15 aa, Borrelia burgdorferi B31
KPNLETLYNDFEKLT

SEQ ID NO: 119450 - protein, 15 aa, Borrelia burgdorferi B31
PNLETLYNDFEKLTS

SEQ ID NO: 119451 - protein, 15 aa, Borrelia burgdorferi B31
NLETLYNDFEKLTSL

SEQ ID NO: 119452 - protein, 15 aa, Borrelia burgdorferi B31
LETLYNDFEKLTSLK

SEQ ID NO: 119453 - protein, 15 aa, Borrelia burgdorferi B31
ETLYNDFEKLTSLKE

SEQ ID NO: 119454 - protein, 15 aa, Borrelia burgdorferi B31
TLYNDFEKLTSLKEK

SEQ ID NO: 119455 - protein, 15 aa, Borrelia burgdorferi B31
LYNDFEKLTSLKEKW

SEQ ID NO: 119456 - protein, 15 aa, Borrelia burgdorferi B31
YNDFEKLTSLKEKWL

SEQ ID NO: 119457 - protein, 15 aa, Borrelia burgdorferi B31
NDFEKLTSLKEKWLK

SEQ ID NO: 119458 - protein, 15 aa, Borrelia burgdorferi B31
DFEKLTSLKEKWLKD

SEQ ID NO: 119459 - protein, 15 aa, Borrelia burgdorferi B31
FEKLTSLKEKWLKDT

SEQ ID NO: 119460 - protein, 15 aa, Borrelia burgdorferi B31
EKLTSLKEKWLKDTD

SEQ ID NO: 119461 - protein, 15 aa, Borrelia burgdorferi B31
KLTSLKEKWLKDTDD

SEQ ID NO: 119462 - protein, 15 aa, Borrelia burgdorferi B31
LTSLKEKWLKDTDDL

SEQ ID NO: 119463 - protein, 15 aa, Borrelia burgdorferi B31
TSLKEKWLKDTDDLI

SEQ ID NO: 119464 - protein, 15 aa, Borrelia burgdorferi B31
SLKEKWLKDTDDLID

SEQ ID NO: 119465 - protein, 15 aa, Borrelia burgdorferi B31
LKEKWLKDTDDLIDE

SEQ ID NO: 119466 - protein, 15 aa, Borrelia burgdorferi B31
KEKWLKDTDDLIDEY

SEQ ID NO: 119467 - protein, 15 aa, Borrelia burgdorferi B31
EKWLKDTDDLIDEYN

SEQ ID NO: 119468 - protein, 15 aa, Borrelia burgdorferi B31
KWLKDTDDLIDEYNT

SEQ ID NO: 119469 - protein, 15 aa, Borrelia burgdorferi B31
WLKDTDDLIDEYNTN

SEQ ID NO: 119470 - protein, 15 aa, Borrelia burgdorferi B31
LKDTDDLIDEYNTNP

SEQ ID NO: 119471 - protein, 15 aa, Borrelia burgdorferi B31
KDTDDLIDEYNTNPD

SEQ ID NO: 119472 - protein, 15 aa, Borrelia burgdorferi B31
DTDDLIDEYNTNPDL

SEQ ID NO: 119473 - protein, 15 aa, Borrelia burgdorferi B31
TDDLIDEYNTNPDLQ

SEQ ID NO: 119474 - protein, 15 aa, Borrelia burgdorferi B31
DDLIDEYNTNPDLQT

SEQ ID NO: 119475 - protein, 15 aa, Borrelia burgdorferi B31
DLIDEYNTNPDLQTD

SEQ ID NO: 119476 - protein, 15 aa, Borrelia burgdorferi B31
LIDEYNTNPDLQTDV

SEQ ID NO: 119477 - protein, 15 aa, Borrelia burgdorferi B31
IDEYNTNPDLQTDVS

SEQ ID NO: 119478 - protein, 15 aa, Borrelia burgdorferi B31
DEYNTNPDLQTDVSK

SEQ ID NO: 119479 - protein, 15 aa, Borrelia burgdorferi B31
EYNTNPDLQTDVSKL

SEQ ID NO: 119480 - protein, 15 aa, Borrelia burgdorferi B31
YNTNPDLQTDVSKLN

SEQ ID NO: 119481 - protein, 15 aa, Borrelia burgdorferi B31
NTNPDLQTDVSKLND

SEQ ID NO: 119482 - protein, 15 aa, Borrelia burgdorferi B31
TNPDLQTDVSKLNDT

SEQ ID NO: 119483 - protein, 15 aa, Borrelia burgdorferi B31
NPDLQTDVSKLNDTL

SEQ ID NO: 119484 - protein, 15 aa, Borrelia burgdorferi B31
PDLQTDVSKLNDTLR

SEQ ID NO: 119485 - protein, 15 aa, Borrelia burgdorferi B31
DLQTDVSKLNDTLRS

SEQ ID NO: 119486 - protein, 15 aa, Borrelia burgdorferi B31
LQTDVSKLNDTLRSK

SEQ ID NO: 119487 - protein, 15 aa, Borrelia burgdorferi B31
QTDVSKLNDTLRSKN

SEQ ID NO: 119488 - protein, 15 aa, Borrelia burgdorferi B31
TDVSKLNDTLRSKNS

SEQ ID NO: 119489 - protein, 15 aa, Borrelia burgdorferi B31
DVSKLNDTLRSKNSR

SEQ ID NO: 119490 - protein, 15 aa, Borrelia burgdorferi B31
VSKLNDTLRSKNSRA

SEQ ID NO: 119491 - protein, 15 aa, Borrelia burgdorferi B31
SKLNDTLRSKNSRAQ

SEQ ID NO: 119492 - protein, 15 aa, Borrelia burgdorferi B31
KLNDTLRSKNSRAQF

SEQ ID NO: 119493 - protein, 15 aa, Borrelia burgdorferi B31
LNDTLRSKNSRAQFA

SEQ ID NO: 119494 - protein, 15 aa, Borrelia burgdorferi B31
NDTLRSKNSRAQFAN

SEQ ID NO: 119495 - protein, 15 aa, Borrelia burgdorferi B31
DTLRSKNSRAQFANI

SEQ ID NO: 119496 - protein, 15 aa, Borrelia burgdorferi B31
TLRSKNSRAQFANIH

SEQ ID NO: 119497 - protein, 15 aa, Borrelia burgdorferi B31
LRSKNSRAQFANIHD

SEQ ID NO: 119498 - protein, 15 aa, Borrelia burgdorferi B31
RSKNSRAQFANIHDI

SEQ ID NO: 119499 - protein, 15 aa, Borrelia burgdorferi B31
SKNSRAQFANIHDII

SEQ ID NO: 119500 - protein, 15 aa, Borrelia burgdorferi B31
KNSRAQFANIHDIIL

SEQ ID NO: 119501 - protein, 15 aa, Borrelia burgdorferi B31
NSRAQFANIHDIILD

SEQ ID NO: 119502 - protein, 15 aa, Borrelia burgdorferi B31
SRAQFANIHDIILDL

SEQ ID NO: 119503 - protein, 15 aa, Borrelia burgdorferi B31
RAQFANIHDIILDLV

SEQ ID NO: 119504 - protein, 15 aa, Borrelia burgdorferi B31
AQFANIHDIILDLVN

SEQ ID NO: 119505 - protein, 15 aa, Borrelia burgdorferi B31
QFANIHDIILDLVNT

SEQ ID NO: 119506 - protein, 15 aa, Borrelia burgdorferi B31
FANIHDIILDLVNTT

SEQ ID NO: 119507 - protein, 15 aa, Borrelia burgdorferi B31
ANIHDIILDLVNTTT

SEQ ID NO: 119508 - protein, 15 aa, Borrelia burgdorferi B31
NIHDIILDLVNTTTN

SEQ ID NO: 119509 - protein, 15 aa, Borrelia burgdorferi B31
IHDIILDLVNTTTNI

SEQ ID NO: 119510 - protein, 15 aa, Borrelia burgdorferi B31
HDIILDLVNTTTNIL

SEQ ID NO: 119511 - protein, 15 aa, Borrelia burgdorferi B31
DIILDLVNTTTNILA

SEQ ID NO: 119512 - protein, 15 aa, Borrelia burgdorferi B31
IILDLVNTTTNILAP

SEQ ID NO: 119513 - protein, 15 aa, Borrelia burgdorferi B31
ILDLVNTTTNILAPI

SEQ ID NO: 119514 - protein, 15 aa, Borrelia burgdorferi B31
LDLVNTTTNILAPIQ

SEQ ID NO: 119515 - protein, 16 aa, Borrelia burgdorferi B31
MKDNILKNNKLIAIFL

SEQ ID NO: 119516 - protein, 16 aa, Borrelia burgdorferi B31
KDNILKNNKLIAIFLL

SEQ ID NO: 119517 - protein, 16 aa, Borrelia burgdorferi B31
DNILKNNKLIAIFLLH

SEQ ID NO: 119518 - protein, 16 aa, Borrelia burgdorferi B31
NILKNNKLIAIFLLHV

SEQ ID NO: 119519 - protein, 16 aa, Borrelia burgdorferi B31
ILKNNKLIAIFLLHVL

SEQ ID NO: 119520 - protein, 16 aa, Borrelia burgdorferi B31
LKNNKLIAIFLLHVLT

SEQ ID NO: 119521 - protein, 16 aa, Borrelia burgdorferi B31
KNNKLIAIFLLHVLTV

SEQ ID NO: 119522 - protein, 16 aa, Borrelia burgdorferi B31
NNKLIAIFLLHVLTVL

SEQ ID NO: 119523 - protein, 16 aa, Borrelia burgdorferi B31
NKLIAIFLLHVLTVLI

SEQ ID NO: 119524 - protein, 16 aa, Borrelia burgdorferi B31
KLIAIFLLHVLTVLIL

SEQ ID NO: 119525 - protein, 16 aa, Borrelia burgdorferi B31
LIAIFLLHVLTVLILI

SEQ ID NO: 119526 - protein, 16 aa, Borrelia burgdorferi B31
IAIFLLHVLTVLILIS

SEQ ID NO: 119527 - protein, 16 aa, Borrelia burgdorferi B31
AIFLLHVLTVLILISC

SEQ ID NO: 119528 - protein, 16 aa, Borrelia burgdorferi B31
IFLLHVLTVLILISCS

SEQ ID NO: 119529 - protein, 16 aa, Borrelia burgdorferi B31
FLLHVLTVLILISCSL

SEQ ID NO: 119530 - protein, 16 aa, Borrelia burgdorferi B31
LLHVLTVLILISCSLE

SEQ ID NO: 119531 - protein, 16 aa, Borrelia burgdorferi B31
LHVLTVLILISCSLEV

SEQ ID NO: 119532 - protein, 16 aa, Borrelia burgdorferi B31
HVLTVLILISCSLEVK

SEQ ID NO: 119533 - protein, 16 aa, Borrelia burgdorferi B31
VLTVLILISCSLEVKD

SEQ ID NO: 119534 - protein, 16 aa, Borrelia burgdorferi B31
LTVLILISCSLEVKDS

SEQ ID NO: 119535 - protein, 16 aa, Borrelia burgdorferi B31
TVLILISCSLEVKDSN

SEQ ID NO: 119536 - protein, 16 aa, Borrelia burgdorferi B31
VLILISCSLEVKDSNE

SEQ ID NO: 119537 - protein, 16 aa, Borrelia burgdorferi B31
LILISCSLEVKDSNES

SEQ ID NO: 119538 - protein, 16 aa, Borrelia burgdorferi B31
ILISCSLEVKDSNESK

SEQ ID NO: 119539 - protein, 16 aa, Borrelia burgdorferi B31
LISCSLEVKDSNESKK

SEQ ID NO: 119540 - protein, 16 aa, Borrelia burgdorferi B31
ISCSLEVKDSNESKKH

SEQ ID NO: 119541 - protein, 16 aa, Borrelia burgdorferi B31
SCSLEVKDSNESKKHK

SEQ ID NO: 119542 - protein, 16 aa, Borrelia burgdorferi B31
CSLEVKDSNESKKHKK

SEQ ID NO: 119543 - protein, 16 aa, Borrelia burgdorferi B31
SLEVKDSNESKKHKKE

SEQ ID NO: 119544 - protein, 16 aa, Borrelia burgdorferi B31
LEVKDSNESKKHKKEK

SEQ ID NO: 119545 - protein, 16 aa, Borrelia burgdorferi B31
EVKDSNESKKHKKEKR

SEQ ID NO: 119546 - protein, 16 aa, Borrelia burgdorferi B31
VKDSNESKKHKKEKRK

SEQ ID NO: 119547 - protein, 16 aa, Borrelia burgdorferi B31
KDSNESKKHKKEKRKG

SEQ ID NO: 119548 - protein, 16 aa, Borrelia burgdorferi B31
DSNESKKHKKEKRKGK

SEQ ID NO: 119549 - protein, 16 aa, Borrelia burgdorferi B31
SNESKKHKKEKRKGKV

SEQ ID NO: 119550 - protein, 16 aa, Borrelia burgdorferi B31
NESKKHKKEKRKGKVE

SEQ ID NO: 119551 - protein, 16 aa, Borrelia burgdorferi B31
ESKKHKKEKRKGKVEN

SEQ ID NO: 119552 - protein, 16 aa, Borrelia burgdorferi B31
SKKHKKEKRKGKVENL

SEQ ID NO: 119553 - protein, 16 aa, Borrelia burgdorferi B31
KKHKKEKRKGKVENLL

SEQ ID NO: 119554 - protein, 16 aa, Borrelia burgdorferi B31
KHKKEKRKGKVENLLV

SEQ ID NO: 119555 - protein, 16 aa, Borrelia burgdorferi B31
HKKEKRKGKVENLLVA

SEQ ID NO: 119556 - protein, 16 aa, Borrelia burgdorferi B31
KKEKRKGKVENLLVAI

SEQ ID NO: 119557 - protein, 16 aa, Borrelia burgdorferi B31
KEKRKGKVENLLVAIN

SEQ ID NO: 119558 - protein, 16 aa, Borrelia burgdorferi B31
EKRKGKVENLLVAINN

SEQ ID NO: 119559 - protein, 16 aa, Borrelia burgdorferi B31
KRKGKVENLLVAINNL

SEQ ID NO: 119560 - protein, 16 aa, Borrelia burgdorferi B31
RKGKVENLLVAINNLK

SEQ ID NO: 119561 - protein, 16 aa, Borrelia burgdorferi B31
KGKVENLLVAINNLKN

SEQ ID NO: 119562 - protein, 16 aa, Borrelia burgdorferi B31
GKVENLLVAINNLKNP

SEQ ID NO: 119563 - protein, 16 aa, Borrelia burgdorferi B31
KVENLLVAINNLKNPT

SEQ ID NO: 119564 - protein, 16 aa, Borrelia burgdorferi B31
VENLLVAINNLKNPTK

SEQ ID NO: 119565 - protein, 16 aa, Borrelia burgdorferi B31
ENLLVAINNLKNPTKP

SEQ ID NO: 119566 - protein, 16 aa, Borrelia burgdorferi B31
NLLVAINNLKNPTKPA

SEQ ID NO: 119567 - protein, 16 aa, Borrelia burgdorferi B31
LLVAINNLKNPTKPAA

SEQ ID NO: 119568 - protein, 16 aa, Borrelia burgdorferi B31
LVAINNLKNPTKPAAG

SEQ ID NO: 119569 - protein, 16 aa, Borrelia burgdorferi B31
VAINNLKNPTKPAAGK

SEQ ID NO: 119570 - protein, 16 aa, Borrelia burgdorferi B31
AINNLKNPTKPAAGKN

SEQ ID NO: 119571 - protein, 16 aa, Borrelia burgdorferi B31
INNLKNPTKPAAGKNK

SEQ ID NO: 119572 - protein, 16 aa, Borrelia burgdorferi B31
NNLKNPTKPAAGKNKA

SEQ ID NO: 119573 - protein, 16 aa, Borrelia burgdorferi B31
NLKNPTKPAAGKNKAN

SEQ ID NO: 119574 - protein, 16 aa, Borrelia burgdorferi B31
LKNPTKPAAGKNKANS

SEQ ID NO: 119575 - protein, 16 aa, Borrelia burgdorferi B31
KNPTKPAAGKNKANSK

SEQ ID NO: 119576 - protein, 16 aa, Borrelia burgdorferi B31
NPTKPAAGKNKANSKA

SEQ ID NO: 119577 - protein, 16 aa, Borrelia burgdorferi B31
PTKPAAGKNKANSKAS

SEQ ID NO: 119578 - protein, 16 aa, Borrelia burgdorferi B31
TKPAAGKNKANSKASK

SEQ ID NO: 119579 - protein, 16 aa, Borrelia burgdorferi B31
KPAAGKNKANSKASKQ

SEQ ID NO: 119580 - protein, 16 aa, Borrelia burgdorferi B31
PAAGKNKANSKASKQK

SEQ ID NO: 119581 - protein, 16 aa, Borrelia burgdorferi B31
AAGKNKANSKASKQKN

SEQ ID NO: 119582 - protein, 16 aa, Borrelia burgdorferi B31
AGKNKANSKASKQKNN

SEQ ID NO: 119583 - protein, 16 aa, Borrelia burgdorferi B31
GKNKANSKASKQKNNP

SEQ ID NO: 119584 - protein, 16 aa, Borrelia burgdorferi B31
KNKANSKASKQKNNPN

SEQ ID NO: 119585 - protein, 16 aa, Borrelia burgdorferi B31
NKANSKASKQKNNPNA

SEQ ID NO: 119586 - protein, 16 aa, Borrelia burgdorferi B31
KANSKASKQKNNPNAN

SEQ ID NO: 119587 - protein, 16 aa, Borrelia burgdorferi B31
ANSKASKQKNNPNANA

SEQ ID NO: 119588 - protein, 16 aa, Borrelia burgdorferi B31
NSKASKQKNNPNANAN

SEQ ID NO: 119589 - protein, 16 aa, Borrelia burgdorferi B31
SKASKQKNNPNANANN

SEQ ID NO: 119590 - protein, 16 aa, Borrelia burgdorferi B31
KASKQKNNPNANANNA

SEQ ID NO: 119591 - protein, 16 aa, Borrelia burgdorferi B31
ASKQKNNPNANANNAP

SEQ ID NO: 119592 - protein, 16 aa, Borrelia burgdorferi B31
SKQKNNPNANANNAPK

SEQ ID NO: 119593 - protein, 16 aa, Borrelia burgdorferi B31
KQKNNPNANANNAPKK

SEQ ID NO: 119594 - protein, 16 aa, Borrelia burgdorferi B31
QKNNPNANANNAPKKI

SEQ ID NO: 119595 - protein, 16 aa, Borrelia burgdorferi B31
KNNPNANANNAPKKIL

SEQ ID NO: 119596 - protein, 16 aa, Borrelia burgdorferi B31
NNPNANANNAPKKILD

SEQ ID NO: 119597 - protein, 16 aa, Borrelia burgdorferi B31
NPNANANNAPKKILDP

SEQ ID NO: 119598 - protein, 16 aa, Borrelia burgdorferi B31
PNANANNAPKKILDPE

SEQ ID NO: 119599 - protein, 16 aa, Borrelia burgdorferi B31
NANANNAPKKILDPEV

SEQ ID NO: 119600 - protein, 16 aa, Borrelia burgdorferi B31
ANANNAPKKILDPEVA

SEQ ID NO: 119601 - protein, 16 aa, Borrelia burgdorferi B31
NANNAPKKILDPEVAK

SEQ ID NO: 119602 - protein, 16 aa, Borrelia burgdorferi B31
ANNAPKKILDPEVAKL

SEQ ID NO: 119603 - protein, 16 aa, Borrelia burgdorferi B31
NNAPKKILDPEVAKLI

SEQ ID NO: 119604 - protein, 16 aa, Borrelia burgdorferi B31
NAPKKILDPEVAKLIQ

SEQ ID NO: 119605 - protein, 16 aa, Borrelia burgdorferi B31
APKKILDPEVAKLIQK

SEQ ID NO: 119606 - protein, 16 aa, Borrelia burgdorferi B31
PKKILDPEVAKLIQKI

SEQ ID NO: 119607 - protein, 16 aa, Borrelia burgdorferi B31
KKILDPEVAKLIQKIL

SEQ ID NO: 119608 - protein, 16 aa, Borrelia burgdorferi B31
KILDPEVAKLIQKILD

SEQ ID NO: 119609 - protein, 16 aa, Borrelia burgdorferi B31
ILDPEVAKLIQKILDR

SEQ ID NO: 119610 - protein, 16 aa, Borrelia burgdorferi B31
LDPEVAKLIQKILDRS

SEQ ID NO: 119611 - protein, 16 aa, Borrelia burgdorferi B31
DPEVAKLIQKILDRSE

SEQ ID NO: 119612 - protein, 16 aa, Borrelia burgdorferi B31
PEVAKLIQKILDRSEN

SEQ ID NO: 119613 - protein, 16 aa, Borrelia burgdorferi B31
EVAKLIQKILDRSENI

SEQ ID NO: 119614 - protein, 16 aa, Borrelia burgdorferi B31
VAKLIQKILDRSENII

SEQ ID NO: 119615 - protein, 16 aa, Borrelia burgdorferi B31
AKLIQKILDRSENIIQ

SEQ ID NO: 119616 - protein, 16 aa, Borrelia burgdorferi B31
KLIQKILDRSENIIQI

SEQ ID NO: 119617 - protein, 16 aa, Borrelia burgdorferi B31
LIQKILDRSENIIQIS

SEQ ID NO: 119618 - protein, 16 aa, Borrelia burgdorferi B31
IQKILDRSENIIQISE

SEQ ID NO: 119619 - protein, 16 aa, Borrelia burgdorferi B31
QKILDRSENIIQISEM

SEQ ID NO: 119620 - protein, 16 aa, Borrelia burgdorferi B31
KILDRSENIIQISEMD

SEQ ID NO: 119621 - protein, 16 aa, Borrelia burgdorferi B31
ILDRSENIIQISEMDS

SEQ ID NO: 119622 - protein, 16 aa, Borrelia burgdorferi B31
LDRSENIIQISEMDSS

SEQ ID NO: 119623 - protein, 16 aa, Borrelia burgdorferi B31
DRSENIIQISEMDSSR

SEQ ID NO: 119624 - protein, 16 aa, Borrelia burgdorferi B31
RSENIIQISEMDSSRG

SEQ ID NO: 119625 - protein, 16 aa, Borrelia burgdorferi B31
SENIIQISEMDSSRGE

SEQ ID NO: 119626 - protein, 16 aa, Borrelia burgdorferi B31
ENIIQISEMDSSRGEP

SEQ ID NO: 119627 - protein, 16 aa, Borrelia burgdorferi B31
NIIQISEMDSSRGEPN

SEQ ID NO: 119628 - protein, 16 aa, Borrelia burgdorferi B31
IIQISEMDSSRGEPND

SEQ ID NO: 119629 - protein, 16 aa, Borrelia burgdorferi B31
IQISEMDSSRGEPNDQ

SEQ ID NO: 119630 - protein, 16 aa, Borrelia burgdorferi B31
QISEMDSSRGEPNDQF

SEQ ID NO: 119631 - protein, 16 aa, Borrelia burgdorferi B31
ISEMDSSRGEPNDQFG

SEQ ID NO: 119632 - protein, 16 aa, Borrelia burgdorferi B31
SEMDSSRGEPNDQFGM

SEQ ID NO: 119633 - protein, 16 aa, Borrelia burgdorferi B31
EMDSSRGEPNDQFGMR

SEQ ID NO: 119634 - protein, 16 aa, Borrelia burgdorferi B31
MDSSRGEPNDQFGMRA

SEQ ID NO: 119635 - protein, 16 aa, Borrelia burgdorferi B31
DSSRGEPNDQFGMRAE

SEQ ID NO: 119636 - protein, 16 aa, Borrelia burgdorferi B31
SSRGEPNDQFGMRAEI

SEQ ID NO: 119637 - protein, 16 aa, Borrelia burgdorferi B31
SRGEPNDQFGMRAEIF

SEQ ID NO: 119638 - protein, 16 aa, Borrelia burgdorferi B31
RGEPNDQFGMRAEIFS

SEQ ID NO: 119639 - protein, 16 aa, Borrelia burgdorferi B31
GEPNDQFGMRAEIFSK

SEQ ID NO: 119640 - protein, 16 aa, Borrelia burgdorferi B31
EPNDQFGMRAEIFSKI

SEQ ID NO: 119641 - protein, 16 aa, Borrelia burgdorferi B31
PNDQFGMRAEIFSKIF

SEQ ID NO: 119642 - protein, 16 aa, Borrelia burgdorferi B31
NDQFGMRAEIFSKIFF

SEQ ID NO: 119643 - protein, 16 aa, Borrelia burgdorferi B31
DQFGMRAEIFSKIFFN

SEQ ID NO: 119644 - protein, 16 aa, Borrelia burgdorferi B31
QFGMRAEIFSKIFFNA

SEQ ID NO: 119645 - protein, 16 aa, Borrelia burgdorferi B31
FGMRAEIFSKIFFNAN

SEQ ID NO: 119646 - protein, 16 aa, Borrelia burgdorferi B31
GMRAEIFSKIFFNANS

SEQ ID NO: 119647 - protein, 16 aa, Borrelia burgdorferi B31
MRAEIFSKIFFNANST

SEQ ID NO: 119648 - protein, 16 aa, Borrelia burgdorferi B31
RAEIFSKIFFNANSTV

SEQ ID NO: 119649 - protein, 16 aa, Borrelia burgdorferi B31
AEIFSKIFFNANSTVH

SEQ ID NO: 119650 - protein, 16 aa, Borrelia burgdorferi B31
EIFSKIFFNANSTVHF

SEQ ID NO: 119651 - protein, 16 aa, Borrelia burgdorferi B31
IFSKIFFNANSTVHFD

SEQ ID NO: 119652 - protein, 16 aa, Borrelia burgdorferi B31
FSKIFFNANSTVHFDS

SEQ ID NO: 119653 - protein, 16 aa, Borrelia burgdorferi B31
SKIFFNANSTVHFDSH

SEQ ID NO: 119654 - protein, 16 aa, Borrelia burgdorferi B31
KIFFNANSTVHFDSHE

SEQ ID NO: 119655 - protein, 16 aa, Borrelia burgdorferi B31
IFFNANSTVHFDSHEY

SEQ ID NO: 119656 - protein, 16 aa, Borrelia burgdorferi B31
FFNANSTVHFDSHEYT

SEQ ID NO: 119657 - protein, 16 aa, Borrelia burgdorferi B31
FNANSTVHFDSHEYTE

SEQ ID NO: 119658 - protein, 16 aa, Borrelia burgdorferi B31
NANSTVHFDSHEYTEE

SEQ ID NO: 119659 - protein, 16 aa, Borrelia burgdorferi B31
ANSTVHFDSHEYTEER

SEQ ID NO: 119660 - protein, 16 aa, Borrelia burgdorferi B31
NSTVHFDSHEYTEERR

SEQ ID NO: 119661 - protein, 16 aa, Borrelia burgdorferi B31
STVHFDSHEYTEERRM

SEQ ID NO: 119662 - protein, 16 aa, Borrelia burgdorferi B31
TVHFDSHEYTEERRML

SEQ ID NO: 119663 - protein, 16 aa, Borrelia burgdorferi B31
VHFDSHEYTEERRMLY

SEQ ID NO: 119664 - protein, 16 aa, Borrelia burgdorferi B31
HFDSHEYTEERRMLYT

SEQ ID NO: 119665 - protein, 16 aa, Borrelia burgdorferi B31
FDSHEYTEERRMLYTS

SEQ ID NO: 119666 - protein, 16 aa, Borrelia burgdorferi B31
DSHEYTEERRMLYTSL

SEQ ID NO: 119667 - protein, 16 aa, Borrelia burgdorferi B31
SHEYTEERRMLYTSLN

SEQ ID NO: 119668 - protein, 16 aa, Borrelia burgdorferi B31
HEYTEERRMLYTSLNF

SEQ ID NO: 119669 - protein, 16 aa, Borrelia burgdorferi B31
EYTEERRMLYTSLNFN

SEQ ID NO: 119670 - protein, 16 aa, Borrelia burgdorferi B31
YTEERRMLYTSLNFNE

SEQ ID NO: 119671 - protein, 16 aa, Borrelia burgdorferi B31
TEERRMLYTSLNFNEG

SEQ ID NO: 119672 - protein, 16 aa, Borrelia burgdorferi B31
EERRMLYTSLNFNEGK

SEQ ID NO: 119673 - protein, 16 aa, Borrelia burgdorferi B31
ERRMLYTSLNFNEGKI

SEQ ID NO: 119674 - protein, 16 aa, Borrelia burgdorferi B31
RRMLYTSLNFNEGKIF

SEQ ID NO: 119675 - protein, 16 aa, Borrelia burgdorferi B31
RMLYTSLNFNEGKIFN

SEQ ID NO: 119676 - protein, 16 aa, Borrelia burgdorferi B31
MLYTSLNFNEGKIFNL

SEQ ID NO: 119677 - protein, 16 aa, Borrelia burgdorferi B31
LYTSLNFNEGKIFNLG

SEQ ID NO: 119678 - protein, 16 aa, Borrelia burgdorferi B31
YTSLNFNEGKIFNLGQ

SEQ ID NO: 119679 - protein, 16 aa, Borrelia burgdorferi B31
TSLNFNEGKIFNLGQI

SEQ ID NO: 119680 - protein, 16 aa, Borrelia burgdorferi B31
SLNFNEGKIFNLGQIL

SEQ ID NO: 119681 - protein, 16 aa, Borrelia burgdorferi B31
LNFNEGKIFNLGQILS

SEQ ID NO: 119682 - protein, 16 aa, Borrelia burgdorferi B31
NFNEGKIFNLGQILSK

SEQ ID NO: 119683 - protein, 16 aa, Borrelia burgdorferi B31
FNEGKIFNLGQILSKL

SEQ ID NO: 119684 - protein, 16 aa, Borrelia burgdorferi B31
NEGKIFNLGQILSKLS

SEQ ID NO: 119685 - protein, 16 aa, Borrelia burgdorferi B31
EGKIFNLGQILSKLSQ

SEQ ID NO: 119686 - protein, 16 aa, Borrelia burgdorferi B31
GKIFNLGQILSKLSQD

SEQ ID NO: 119687 - protein, 16 aa, Borrelia burgdorferi B31
KIFNLGQILSKLSQDS

SEQ ID NO: 119688 - protein, 16 aa, Borrelia burgdorferi B31
IFNLGQILSKLSQDSN

SEQ ID NO: 119689 - protein, 16 aa, Borrelia burgdorferi B31
FNLGQILSKLSQDSNY

SEQ ID NO: 119690 - protein, 16 aa, Borrelia burgdorferi B31
NLGQILSKLSQDSNYR

SEQ ID NO: 119691 - protein, 16 aa, Borrelia burgdorferi B31
LGQILSKLSQDSNYRG

SEQ ID NO: 119692 - protein, 16 aa, Borrelia burgdorferi B31
GQILSKLSQDSNYRGL

SEQ ID NO: 119693 - protein, 16 aa, Borrelia burgdorferi B31
QILSKLSQDSNYRGLV

SEQ ID NO: 119694 - protein, 16 aa, Borrelia burgdorferi B31
ILSKLSQDSNYRGLVK

SEQ ID NO: 119695 - protein, 16 aa, Borrelia burgdorferi B31
LSKLSQDSNYRGLVKE

SEQ ID NO: 119696 - protein, 16 aa, Borrelia burgdorferi B31
SKLSQDSNYRGLVKET

SEQ ID NO: 119697 - protein, 16 aa, Borrelia burgdorferi B31
KLSQDSNYRGLVKETL

SEQ ID NO: 119698 - protein, 16 aa, Borrelia burgdorferi B31
LSQDSNYRGLVKETLI

SEQ ID NO: 119699 - protein, 16 aa, Borrelia burgdorferi B31
SQDSNYRGLVKETLIN

SEQ ID NO: 119700 - protein, 16 aa, Borrelia burgdorferi B31
QDSNYRGLVKETLINR

SEQ ID NO: 119701 - protein, 16 aa, Borrelia burgdorferi B31
DSNYRGLVKETLINRG

SEQ ID NO: 119702 - protein, 16 aa, Borrelia burgdorferi B31
SNYRGLVKETLINRGF

SEQ ID NO: 119703 - protein, 16 aa, Borrelia burgdorferi B31
NYRGLVKETLINRGFS

SEQ ID NO: 119704 - protein, 16 aa, Borrelia burgdorferi B31
YRGLVKETLINRGFSI

SEQ ID NO: 119705 - protein, 16 aa, Borrelia burgdorferi B31
RGLVKETLINRGFSIQ

SEQ ID NO: 119706 - protein, 16 aa, Borrelia burgdorferi B31
GLVKETLINRGFSIQL

SEQ ID NO: 119707 - protein, 16 aa, Borrelia burgdorferi B31
LVKETLINRGFSIQLA

SEQ ID NO: 119708 - protein, 16 aa, Borrelia burgdorferi B31
VKETLINRGFSIQLAM

SEQ ID NO: 119709 - protein, 16 aa, Borrelia burgdorferi B31
KETLINRGFSIQLAME

SEQ ID NO: 119710 - protein, 16 aa, Borrelia burgdorferi B31
ETLINRGFSIQLAMEE

SEQ ID NO: 119711 - protein, 16 aa, Borrelia burgdorferi B31
TLINRGFSIQLAMEEI

SEQ ID NO: 119712 - protein, 16 aa, Borrelia burgdorferi B31
LINRGFSIQLAMEEIS

SEQ ID NO: 119713 - protein, 16 aa, Borrelia burgdorferi B31
INRGFSIQLAMEEISA

SEQ ID NO: 119714 - protein, 16 aa, Borrelia burgdorferi B31
NRGFSIQLAMEEISAK

SEQ ID NO: 119715 - protein, 16 aa, Borrelia burgdorferi B31
RGFSIQLAMEEISAKI

SEQ ID NO: 119716 - protein, 16 aa, Borrelia burgdorferi B31
GFSIQLAMEEISAKIL

SEQ ID NO: 119717 - protein, 16 aa, Borrelia burgdorferi B31
FSIQLAMEEISAKILN

SEQ ID NO: 119718 - protein, 16 aa, Borrelia burgdorferi B31
SIQLAMEEISAKILNV

SEQ ID NO: 119719 - protein, 16 aa, Borrelia burgdorferi B31
IQLAMEEISAKILNVK

SEQ ID NO: 119720 - protein, 16 aa, Borrelia burgdorferi B31
QLAMEEISAKILNVKD

SEQ ID NO: 119721 - protein, 16 aa, Borrelia burgdorferi B31
LAMEEISAKILNVKDK

SEQ ID NO: 119722 - protein, 16 aa, Borrelia burgdorferi B31
AMEEISAKILNVKDKL

SEQ ID NO: 119723 - protein, 16 aa, Borrelia burgdorferi B31
MEEISAKILNVKDKLQ

SEQ ID NO: 119724 - protein, 16 aa, Borrelia burgdorferi B31
EEISAKILNVKDKLQQ

SEQ ID NO: 119725 - protein, 16 aa, Borrelia burgdorferi B31
EISAKILNVKDKLQQL

SEQ ID NO: 119726 - protein, 16 aa, Borrelia burgdorferi B31
ISAKILNVKDKLQQLN

SEQ ID NO: 119727 - protein, 16 aa, Borrelia burgdorferi B31
SAKILNVKDKLQQLNK

SEQ ID NO: 119728 - protein, 16 aa, Borrelia burgdorferi B31
AKILNVKDKLQQLNKP

SEQ ID NO: 119729 - protein, 16 aa, Borrelia burgdorferi B31
KILNVKDKLQQLNKPN

SEQ ID NO: 119730 - protein, 16 aa, Borrelia burgdorferi B31
ILNVKDKLQQLNKPNL

SEQ ID NO: 119731 - protein, 16 aa, Borrelia burgdorferi B31
LNVKDKLQQLNKPNLE

SEQ ID NO: 119732 - protein, 16 aa, Borrelia burgdorferi B31
NVKDKLQQLNKPNLET

SEQ ID NO: 119733 - protein, 16 aa, Borrelia burgdorferi B31
VKDKLQQLNKPNLETL

SEQ ID NO: 119734 - protein, 16 aa, Borrelia burgdorferi B31
KDKLQQLNKPNLETLY

SEQ ID NO: 119735 - protein, 16 aa, Borrelia burgdorferi B31
DKLQQLNKPNLETLYN

SEQ ID NO: 119736 - protein, 16 aa, Borrelia burgdorferi B31
KLQQLNKPNLETLYND

SEQ ID NO: 119737 - protein, 16 aa, Borrelia burgdorferi B31
LQQLNKPNLETLYNDF

SEQ ID NO: 119738 - protein, 16 aa, Borrelia burgdorferi B31
QQLNKPNLETLYNDFE

SEQ ID NO: 119739 - protein, 16 aa, Borrelia burgdorferi B31
QLNKPNLETLYNDFEK

SEQ ID NO: 119740 - protein, 16 aa, Borrelia burgdorferi B31
LNKPNLETLYNDFEKL

SEQ ID NO: 119741 - protein, 16 aa, Borrelia burgdorferi B31
NKPNLETLYNDFEKLT

SEQ ID NO: 119742 - protein, 16 aa, Borrelia burgdorferi B31
KPNLETLYNDFEKLTS

SEQ ID NO: 119743 - protein, 16 aa, Borrelia burgdorferi B31
PNLETLYNDFEKLTSL

SEQ ID NO: 119744 - protein, 16 aa, Borrelia burgdorferi B31
NLETLYNDFEKLTSLK

SEQ ID NO: 119745 - protein, 16 aa, Borrelia burgdorferi B31
LETLYNDFEKLTSLKE

SEQ ID NO: 119746 - protein, 16 aa, Borrelia burgdorferi B31
ETLYNDFEKLTSLKEK

SEQ ID NO: 119747 - protein, 16 aa, Borrelia burgdorferi B31
TLYNDFEKLTSLKEKW

SEQ ID NO: 119748 - protein, 16 aa, Borrelia burgdorferi B31
LYNDFEKLTSLKEKWL

SEQ ID NO: 119749 - protein, 16 aa, Borrelia burgdorferi B31
YNDFEKLTSLKEKWLK

SEQ ID NO: 119750 - protein, 16 aa, Borrelia burgdorferi B31
NDFEKLTSLKEKWLKD

SEQ ID NO: 119751 - protein, 16 aa, Borrelia burgdorferi B31
DFEKLTSLKEKWLKDT

SEQ ID NO: 119752 - protein, 16 aa, Borrelia burgdorferi B31
FEKLTSLKEKWLKDTD

SEQ ID NO: 119753 - protein, 16 aa, Borrelia burgdorferi B31
EKLTSLKEKWLKDTDD

SEQ ID NO: 119754 - protein, 16 aa, Borrelia burgdorferi B31
KLTSLKEKWLKDTDDL

SEQ ID NO: 119755 - protein, 16 aa, Borrelia burgdorferi B31
LTSLKEKWLKDTDDLI

SEQ ID NO: 119756 - protein, 16 aa, Borrelia burgdorferi B31
TSLKEKWLKDTDDLID

SEQ ID NO: 119757 - protein, 16 aa, Borrelia burgdorferi B31
SLKEKWLKDTDDLIDE

SEQ ID NO: 119758 - protein, 16 aa, Borrelia burgdorferi B31
LKEKWLKDTDDLIDEY

SEQ ID NO: 119759 - protein, 16 aa, Borrelia burgdorferi B31
KEKWLKDTDDLIDEYN

SEQ ID NO: 119760 - protein, 16 aa, Borrelia burgdorferi B31
EKWLKDTDDLIDEYNT

SEQ ID NO: 119761 - protein, 16 aa, Borrelia burgdorferi B31
KWLKDTDDLIDEYNTN

SEQ ID NO: 119762 - protein, 16 aa, Borrelia burgdorferi B31
WLKDTDDLIDEYNTNP

SEQ ID NO: 119763 - protein, 16 aa, Borrelia burgdorferi B31
LKDTDDLIDEYNTNPD

SEQ ID NO: 119764 - protein, 16 aa, Borrelia burgdorferi B31
KDTDDLIDEYNTNPDL

SEQ ID NO: 119765 - protein, 16 aa, Borrelia burgdorferi B31
DTDDLIDEYNTNPDLQ

SEQ ID NO: 119766 - protein, 16 aa, Borrelia burgdorferi B31
TDDLIDEYNTNPDLQT

SEQ ID NO: 119767 - protein, 16 aa, Borrelia burgdorferi B31
DDLIDEYNTNPDLQTD

SEQ ID NO: 119768 - protein, 16 aa, Borrelia burgdorferi B31
DLIDEYNTNPDLQTDV

SEQ ID NO: 119769 - protein, 16 aa, Borrelia burgdorferi B31
LIDEYNTNPDLQTDVS

SEQ ID NO: 119770 - protein, 16 aa, Borrelia burgdorferi B31
IDEYNTNPDLQTDVSK

SEQ ID NO: 119771 - protein, 16 aa, Borrelia burgdorferi B31
DEYNTNPDLQTDVSKL

SEQ ID NO: 119772 - protein, 16 aa, Borrelia burgdorferi B31
EYNTNPDLQTDVSKLN

SEQ ID NO: 119773 - protein, 16 aa, Borrelia burgdorferi B31
YNTNPDLQTDVSKLND

SEQ ID NO: 119774 - protein, 16 aa, Borrelia burgdorferi B31
NTNPDLQTDVSKLNDT

SEQ ID NO: 119775 - protein, 16 aa, Borrelia burgdorferi B31
TNPDLQTDVSKLNDTL

SEQ ID NO: 119776 - protein, 16 aa, Borrelia burgdorferi B31
NPDLQTDVSKLNDTLR

SEQ ID NO: 119777 - protein, 16 aa, Borrelia burgdorferi B31
PDLQTDVSKLNDTLRS

SEQ ID NO: 119778 - protein, 16 aa, Borrelia burgdorferi B31
DLQTDVSKLNDTLRSK

SEQ ID NO: 119779 - protein, 16 aa, Borrelia burgdorferi B31
LQTDVSKLNDTLRSKN

SEQ ID NO: 119780 - protein, 16 aa, Borrelia burgdorferi B31
QTDVSKLNDTLRSKNS

SEQ ID NO: 119781 - protein, 16 aa, Borrelia burgdorferi B31
TDVSKLNDTLRSKNSR

SEQ ID NO: 119782 - protein, 16 aa, Borrelia burgdorferi B31
DVSKLNDTLRSKNSRA

SEQ ID NO: 119783 - protein, 16 aa, Borrelia burgdorferi B31
VSKLNDTLRSKNSRAQ

SEQ ID NO: 119784 - protein, 16 aa, Borrelia burgdorferi B31
SKLNDTLRSKNSRAQF

SEQ ID NO: 119785 - protein, 16 aa, Borrelia burgdorferi B31
KLNDTLRSKNSRAQFA

SEQ ID NO: 119786 - protein, 16 aa, Borrelia burgdorferi B31
LNDTLRSKNSRAQFAN

SEQ ID NO: 119787 - protein, 16 aa, Borrelia burgdorferi B31
NDTLRSKNSRAQFANI

SEQ ID NO: 119788 - protein, 16 aa, Borrelia burgdorferi B31
DTLRSKNSRAQFANIH

SEQ ID NO: 119789 - protein, 16 aa, Borrelia burgdorferi B31
TLRSKNSRAQFANIHD

SEQ ID NO: 119790 - protein, 16 aa, Borrelia burgdorferi B31
LRSKNSRAQFANIHDI

SEQ ID NO: 119791 - protein, 16 aa, Borrelia burgdorferi B31
RSKNSRAQFANIHDII

SEQ ID NO: 119792 - protein, 16 aa, Borrelia burgdorferi B31
SKNSRAQFANIHDIIL

SEQ ID NO: 119793 - protein, 16 aa, Borrelia burgdorferi B31
KNSRAQFANIHDIILD

SEQ ID NO: 119794 - protein, 16 aa, Borrelia burgdorferi B31
NSRAQFANIHDIILDL

SEQ ID NO: 119795 - protein, 16 aa, Borrelia burgdorferi B31
SRAQFANIHDIILDLV

SEQ ID NO: 119796 - protein, 16 aa, Borrelia burgdorferi B31
RAQFANIHDIILDLVN

SEQ ID NO: 119797 - protein, 16 aa, Borrelia burgdorferi B31
AQFANIHDIILDLVNT

SEQ ID NO: 119798 - protein, 16 aa, Borrelia burgdorferi B31
QFANIHDIILDLVNTT

SEQ ID NO: 119799 - protein, 16 aa, Borrelia burgdorferi B31
FANIHDIILDLVNTTT

SEQ ID NO: 119800 - protein, 16 aa, Borrelia burgdorferi B31
ANIHDIILDLVNTTTN

SEQ ID NO: 119801 - protein, 16 aa, Borrelia burgdorferi B31
NIHDIILDLVNTTTNI

SEQ ID NO: 119802 - protein, 16 aa, Borrelia burgdorferi B31
IHDIILDLVNTTTNIL

SEQ ID NO: 119803 - protein, 16 aa, Borrelia burgdorferi B31
HDIILDLVNTTTNILA

SEQ ID NO: 119804 - protein, 16 aa, Borrelia burgdorferi B31
DIILDLVNTTTNILAP

SEQ ID NO: 119805 - protein, 16 aa, Borrelia burgdorferi B31
IILDLVNTTTNILAPI

SEQ ID NO: 119806 - protein, 16 aa, Borrelia burgdorferi B31
ILDLVNTTTNILAPIQ

SEQ ID NO: 119807 - protein, 13 aa, Borrelia garinii PBi
MKNNKLIAIFLLH

SEQ ID NO: 119808 - protein, 13 aa, Borrelia garinii PBi
KNNKLIAIFLLHI

SEQ ID NO: 119809 - protein, 13 aa, Borrelia garinii PBi
NNKLIAIFLLHIL

SEQ ID NO: 119810 - protein, 13 aa, Borrelia garinii PBi
NKLIAIFLLHILT

SEQ ID NO: 119811 - protein, 13 aa, Borrelia garinii PBi
KLIAIFLLHILTG

SEQ ID NO: 119812 - protein, 13 aa, Borrelia garinii PBi
LIAIFLLHILTGL

SEQ ID NO: 119813 - protein, 13 aa, Borrelia garinii PBi
IAIFLLHILTGLI

SEQ ID NO: 119814 - protein, 13 aa, Borrelia garinii PBi
AIFLLHILTGLIL

SEQ ID NO: 119815 - protein, 13 aa, Borrelia garinii PBi
IFLLHILTGLILL

SEQ ID NO: 119816 - protein, 13 aa, Borrelia garinii PBi
FLLHILTGLILLS

SEQ ID NO: 119817 - protein, 13 aa, Borrelia garinii PBi
LLHILTGLILLSC

SEQ ID NO: 119818 - protein, 13 aa, Borrelia garinii PBi
LHILTGLILLSCS

SEQ ID NO: 119819 - protein, 13 aa, Borrelia garinii PBi
HILTGLILLSCSL

SEQ ID NO: 119820 - protein, 13 aa, Borrelia garinii PBi
ILTGLILLSCSLE

SEQ ID NO: 119821 - protein, 13 aa, Borrelia garinii PBi
LTGLILLSCSLEV

SEQ ID NO: 119822 - protein, 13 aa, Borrelia garinii PBi
TGLILLSCSLEVN

SEQ ID NO: 119823 - protein, 13 aa, Borrelia garinii PBi
GLILLSCSLEVNQ

SEQ ID NO: 119824 - protein, 13 aa, Borrelia garinii PBi
LILLSCSLEVNQD

SEQ ID NO: 119825 - protein, 13 aa, Borrelia garinii PBi
ILLSCSLEVNQDD

SEQ ID NO: 119826 - protein, 13 aa, Borrelia garinii PBi
LLSCSLEVNQDDN

SEQ ID NO: 119827 - protein, 13 aa, Borrelia garinii PBi
LSCSLEVNQDDNQ

SEQ ID NO: 119828 - protein, 13 aa, Borrelia garinii PBi
SCSLEVNQDDNQE

SEQ ID NO: 119829 - protein, 13 aa, Borrelia garinii PBi
CSLEVNQDDNQEK

SEQ ID NO: 119830 - protein, 13 aa, Borrelia garinii PBi
SLEVNQDDNQEKQ

SEQ ID NO: 119831 - protein, 13 aa, Borrelia garinii PBi
LEVNQDDNQEKQK

SEQ ID NO: 119832 - protein, 13 aa, Borrelia garinii PBi
EVNQDDNQEKQKK

SEQ ID NO: 119833 - protein, 13 aa, Borrelia garinii PBi
VNQDDNQEKQKKA

SEQ ID NO: 119834 - protein, 13 aa, Borrelia garinii PBi
NQDDNQEKQKKAK

SEQ ID NO: 119835 - protein, 13 aa, Borrelia garinii PBi
QDDNQEKQKKAKT

SEQ ID NO: 119836 - protein, 13 aa, Borrelia garinii PBi
DDNQEKQKKAKTK

SEQ ID NO: 119837 - protein, 13 aa, Borrelia garinii PBi
DNQEKQKKAKTKT

SEQ ID NO: 119838 - protein, 13 aa, Borrelia garinii PBi
NQEKQKKAKTKTS

SEQ ID NO: 119839 - protein, 13 aa, Borrelia garinii PBi
QEKQKKAKTKTSK

SEQ ID NO: 119840 - protein, 13 aa, Borrelia garinii PBi
EKQKKAKTKTSKS

SEQ ID NO: 119841 - protein, 13 aa, Borrelia garinii PBi
KQKKAKTKTSKSE

SEQ ID NO: 119842 - protein, 13 aa, Borrelia garinii PBi
QKKAKTKTSKSEN

SEQ ID NO: 119843 - protein, 13 aa, Borrelia garinii PBi
KKAKTKTSKSENN

SEQ ID NO: 119844 - protein, 13 aa, Borrelia garinii PBi
KAKTKTSKSENNS

SEQ ID NO: 119845 - protein, 13 aa, Borrelia garinii PBi
AKTKTSKSENNSS

SEQ ID NO: 119846 - protein, 13 aa, Borrelia garinii PBi
KTKTSKSENNSSK

SEQ ID NO: 119847 - protein, 13 aa, Borrelia garinii PBi
TKTSKSENNSSKM

SEQ ID NO: 119848 - protein, 13 aa, Borrelia garinii PBi
KTSKSENNSSKMK

SEQ ID NO: 119849 - protein, 13 aa, Borrelia garinii PBi
TSKSENNSSKMKK

SEQ ID NO: 119850 - protein, 13 aa, Borrelia garinii PBi
SKSENNSSKMKKL

SEQ ID NO: 119851 - protein, 13 aa, Borrelia garinii PBi
KSENNSSKMKKLS

SEQ ID NO: 119852 - protein, 13 aa, Borrelia garinii PBi
SENNSSKMKKLSK

SEQ ID NO: 119853 - protein, 13 aa, Borrelia garinii PBi
ENNSSKMKKLSKN

SEQ ID NO: 119854 - protein, 13 aa, Borrelia garinii PBi
NNSSKMKKLSKNA

SEQ ID NO: 119855 - protein, 13 aa, Borrelia garinii PBi
NSSKMKKLSKNAK

SEQ ID NO: 119856 - protein, 13 aa, Borrelia garinii PBi
SSKMKKLSKNAKN

SEQ ID NO: 119857 - protein, 13 aa, Borrelia garinii PBi
SKMKKLSKNAKNK

SEQ ID NO: 119858 - protein, 13 aa, Borrelia garinii PBi
KMKKLSKNAKNKK

SEQ ID NO: 119859 - protein, 13 aa, Borrelia garinii PBi
MKKLSKNAKNKKP

SEQ ID NO: 119860 - protein, 13 aa, Borrelia garinii PBi
KKLSKNAKNKKPT

SEQ ID NO: 119861 - protein, 13 aa, Borrelia garinii PBi
KLSKNAKNKKPTV

SEQ ID NO: 119862 - protein, 13 aa, Borrelia garinii PBi
LSKNAKNKKPTVD

SEQ ID NO: 119863 - protein, 13 aa, Borrelia garinii PBi
SKNAKNKKPTVDN

SEQ ID NO: 119864 - protein, 13 aa, Borrelia garinii PBi
KNAKNKKPTVDNL

SEQ ID NO: 119865 - protein, 13 aa, Borrelia garinii PBi
NAKNKKPTVDNLL

SEQ ID NO: 119866 - protein, 13 aa, Borrelia garinii PBi
AKNKKPTVDNLLV

SEQ ID NO: 119867 - protein, 13 aa, Borrelia garinii PBi
KNKKPTVDNLLVA

SEQ ID NO: 119868 - protein, 13 aa, Borrelia garinii PBi
NKKPTVDNLLVAI

SEQ ID NO: 119869 - protein, 13 aa, Borrelia garinii PBi
KKPTVDNLLVAIN

SEQ ID NO: 119870 - protein, 13 aa, Borrelia garinii PBi
KPTVDNLLVAINT

SEQ ID NO: 119871 - protein, 13 aa, Borrelia garinii PBi
PTVDNLLVAINTL

SEQ ID NO: 119872 - protein, 13 aa, Borrelia garinii PBi
TVDNLLVAINTLK

SEQ ID NO: 119873 - protein, 13 aa, Borrelia garinii PBi
VDNLLVAINTLKN

SEQ ID NO: 119874 - protein, 13 aa, Borrelia garinii PBi
DNLLVAINTLKNP

SEQ ID NO: 119875 - protein, 13 aa, Borrelia garinii PBi
NLLVAINTLKNPP

SEQ ID NO: 119876 - protein, 13 aa, Borrelia garinii PBi
LLVAINTLKNPPK

SEQ ID NO: 119877 - protein, 13 aa, Borrelia garinii PBi
LVAINTLKNPPKT

SEQ ID NO: 119878 - protein, 13 aa, Borrelia garinii PBi
VAINTLKNPPKTA

SEQ ID NO: 119879 - protein, 13 aa, Borrelia garinii PBi
AINTLKNPPKTAG

SEQ ID NO: 119880 - protein, 13 aa, Borrelia garinii PBi
INTLKNPPKTAGK

SEQ ID NO: 119881 - protein, 13 aa, Borrelia garinii PBi
NTLKNPPKTAGKN

SEQ ID NO: 119882 - protein, 13 aa, Borrelia garinii PBi
TLKNPPKTAGKNK

SEQ ID NO: 119883 - protein, 13 aa, Borrelia garinii PBi
LKNPPKTAGKNKS

SEQ ID NO: 119884 - protein, 13 aa, Borrelia garinii PBi
KNPPKTAGKNKSN

SEQ ID NO: 119885 - protein, 13 aa, Borrelia garinii PBi
NPPKTAGKNKSNS

SEQ ID NO: 119886 - protein, 13 aa, Borrelia garinii PBi
PPKTAGKNKSNSA

SEQ ID NO: 119887 - protein, 13 aa, Borrelia garinii PBi
PKTAGKNKSNSAA

SEQ ID NO: 119888 - protein, 13 aa, Borrelia garinii PBi
KTAGKNKSNSAAA

SEQ ID NO: 119889 - protein, 13 aa, Borrelia garinii PBi
TAGKNKSNSAAAL

SEQ ID NO: 119890 - protein, 13 aa, Borrelia garinii PBi
AGKNKSNSAAALK

SEQ ID NO: 119891 - protein, 13 aa, Borrelia garinii PBi
GKNKSNSAAALKQ

SEQ ID NO: 119892 - protein, 13 aa, Borrelia garinii PBi
KNKSNSAAALKQP

SEQ ID NO: 119893 - protein, 13 aa, Borrelia garinii PBi
NKSNSAAALKQPN

SEQ ID NO: 119894 - protein, 13 aa, Borrelia garinii PBi
KSNSAAALKQPNN

SEQ ID NO: 119895 - protein, 13 aa, Borrelia garinii PBi
SNSAAALKQPNNA

SEQ ID NO: 119896 - protein, 13 aa, Borrelia garinii PBi
NSAAALKQPNNAN

SEQ ID NO: 119897 - protein, 13 aa, Borrelia garinii PBi
SAAALKQPNNANA

SEQ ID NO: 119898 - protein, 13 aa, Borrelia garinii PBi
AAALKQPNNANAL

SEQ ID NO: 119899 - protein, 13 aa, Borrelia garinii PBi
AALKQPNNANALK

SEQ ID NO: 119900 - protein, 13 aa, Borrelia garinii PBi
ALKQPNNANALKQ

SEQ ID NO: 119901 - protein, 13 aa, Borrelia garinii PBi
LKQPNNANALKQI

SEQ ID NO: 119902 - protein, 13 aa, Borrelia garinii PBi
KQPNNANALKQID

SEQ ID NO: 119903 - protein, 13 aa, Borrelia garinii PBi
QPNNANALKQIDP

SEQ ID NO: 119904 - protein, 13 aa, Borrelia garinii PBi
PNNANALKQIDPE

SEQ ID NO: 119905 - protein, 13 aa, Borrelia garinii PBi
NNANALKQIDPEA

SEQ ID NO: 119906 - protein, 13 aa, Borrelia garinii PBi
NANALKQIDPEAK

SEQ ID NO: 119907 - protein, 13 aa, Borrelia garinii PBi
ANALKQIDPEAKE

SEQ ID NO: 119908 - protein, 13 aa, Borrelia garinii PBi
NALKQIDPEAKEL

SEQ ID NO: 119909 - protein, 13 aa, Borrelia garinii PBi
ALKQIDPEAKELI

SEQ ID NO: 119910 - protein, 13 aa, Borrelia garinii PBi
LKQIDPEAKELIQ

SEQ ID NO: 119911 - protein, 13 aa, Borrelia garinii PBi
KQIDPEAKELIQK

SEQ ID NO: 119912 - protein, 13 aa, Borrelia garinii PBi
QIDPEAKELIQKI

SEQ ID NO: 119913 - protein, 13 aa, Borrelia garinii PBi
IDPEAKELIQKIL

SEQ ID NO: 119914 - protein, 13 aa, Borrelia garinii PBi
DPEAKELIQKILE

SEQ ID NO: 119915 - protein, 13 aa, Borrelia garinii PBi
PEAKELIQKILER

SEQ ID NO: 119916 - protein, 13 aa, Borrelia garinii PBi
EAKELIQKILERS

SEQ ID NO: 119917 - protein, 13 aa, Borrelia garinii PBi
AKELIQKILERSE

SEQ ID NO: 119918 - protein, 13 aa, Borrelia garinii PBi
KELIQKILERSED

SEQ ID NO: 119919 - protein, 13 aa, Borrelia garinii PBi
ELIQKILERSEDI

SEQ ID NO: 119920 - protein, 13 aa, Borrelia garinii PBi
LIQKILERSEDIV

SEQ ID NO: 119921 - protein, 13 aa, Borrelia garinii PBi
IQKILERSEDIVQ

SEQ ID NO: 119922 - protein, 13 aa, Borrelia garinii PBi
QKILERSEDIVQI

SEQ ID NO: 119923 - protein, 13 aa, Borrelia garinii PBi
KILERSEDIVQIS

SEQ ID NO: 119924 - protein, 13 aa, Borrelia garinii PBi
ILERSEDIVQISE

SEQ ID NO: 119925 - protein, 13 aa, Borrelia garinii PBi
LERSEDIVQISEI

SEQ ID NO: 119926 - protein, 13 aa, Borrelia garinii PBi
ERSEDIVQISEID

SEQ ID NO: 119927 - protein, 13 aa, Borrelia garinii PBi
RSEDIVQISEIDA

SEQ ID NO: 119928 - protein, 13 aa, Borrelia garinii PBi
SEDIVQISEIDAN

SEQ ID NO: 119929 - protein, 13 aa, Borrelia garinii PBi
EDIVQISEIDANK

SEQ ID NO: 119930 - protein, 13 aa, Borrelia garinii PBi
DIVQISEIDANKG

SEQ ID NO: 119931 - protein, 13 aa, Borrelia garinii PBi
IVQISEIDANKGE

SEQ ID NO: 119932 - protein, 13 aa, Borrelia garinii PBi
VQISEIDANKGEP

SEQ ID NO: 119933 - protein, 13 aa, Borrelia garinii PBi
QISEIDANKGEPD

SEQ ID NO: 119934 - protein, 13 aa, Borrelia garinii PBi
ISEIDANKGEPDD

SEQ ID NO: 119935 - protein, 13 aa, Borrelia garinii PBi
SEIDANKGEPDDQ

SEQ ID NO: 119936 - protein, 13 aa, Borrelia garinii PBi
EIDANKGEPDDQF

SEQ ID NO: 119937 - protein, 13 aa, Borrelia garinii PBi
IDANKGEPDDQFE

SEQ ID NO: 119938 - protein, 13 aa, Borrelia garinii PBi
DANKGEPDDQFEM

SEQ ID NO: 119939 - protein, 13 aa, Borrelia garinii PBi
ANKGEPDDQFEMK

SEQ ID NO: 119940 - protein, 13 aa, Borrelia garinii PBi
NKGEPDDQFEMKA

SEQ ID NO: 119941 - protein, 13 aa, Borrelia garinii PBi
KGEPDDQFEMKAE

SEQ ID NO: 119942 - protein, 13 aa, Borrelia garinii PBi
GEPDDQFEMKAEI

SEQ ID NO: 119943 - protein, 13 aa, Borrelia garinii PBi
EPDDQFEMKAEIF

SEQ ID NO: 119944 - protein, 13 aa, Borrelia garinii PBi
PDDQFEMKAEIFS

SEQ ID NO: 119945 - protein, 13 aa, Borrelia garinii PBi
DDQFEMKAEIFSK

SEQ ID NO: 119946 - protein, 13 aa, Borrelia garinii PBi
DQFEMKAEIFSKI

SEQ ID NO: 119947 - protein, 13 aa, Borrelia garinii PBi
QFEMKAEIFSKIF

SEQ ID NO: 119948 - protein, 13 aa, Borrelia garinii PBi
FEMKAEIFSKIFF

SEQ ID NO: 119949 - protein, 13 aa, Borrelia garinii PBi
EMKAEIFSKIFFN

SEQ ID NO: 119950 - protein, 13 aa, Borrelia garinii PBi
MKAEIFSKIFFNA

SEQ ID NO: 119951 - protein, 13 aa, Borrelia garinii PBi
KAEIFSKIFFNAG

SEQ ID NO: 119952 - protein, 13 aa, Borrelia garinii PBi
AEIFSKIFFNAGS

SEQ ID NO: 119953 - protein, 13 aa, Borrelia garinii PBi
EIFSKIFFNAGST

SEQ ID NO: 119954 - protein, 13 aa, Borrelia garinii PBi
IFSKIFFNAGSTV

SEQ ID NO: 119955 - protein, 13 aa, Borrelia garinii PBi
FSKIFFNAGSTVT

SEQ ID NO: 119956 - protein, 13 aa, Borrelia garinii PBi
SKIFFNAGSTVTF

SEQ ID NO: 119957 - protein, 13 aa, Borrelia garinii PBi
KIFFNAGSTVTFD

SEQ ID NO: 119958 - protein, 13 aa, Borrelia garinii PBi
IFFNAGSTVTFDD

SEQ ID NO: 119959 - protein, 13 aa, Borrelia garinii PBi
FFNAGSTVTFDDN

SEQ ID NO: 119960 - protein, 13 aa, Borrelia garinii PBi
FNAGSTVTFDDNE

SEQ ID NO: 119961 - protein, 13 aa, Borrelia garinii PBi
NAGSTVTFDDNEY

SEQ ID NO: 119962 - protein, 13 aa, Borrelia garinii PBi
AGSTVTFDDNEYV

SEQ ID NO: 119963 - protein, 13 aa, Borrelia garinii PBi
GSTVTFDDNEYVN

SEQ ID NO: 119964 - protein, 13 aa, Borrelia garinii PBi
STVTFDDNEYVNE

SEQ ID NO: 119965 - protein, 13 aa, Borrelia garinii PBi
TVTFDDNEYVNER

SEQ ID NO: 119966 - protein, 13 aa, Borrelia garinii PBi
VTFDDNEYVNERR

SEQ ID NO: 119967 - protein, 13 aa, Borrelia garinii PBi
TFDDNEYVNERRI

SEQ ID NO: 119968 - protein, 13 aa, Borrelia garinii PBi
FDDNEYVNERRIL

SEQ ID NO: 119969 - protein, 13 aa, Borrelia garinii PBi
DDNEYVNERRILY

SEQ ID NO: 119970 - protein, 13 aa, Borrelia garinii PBi
DNEYVNERRILYT

SEQ ID NO: 119971 - protein, 13 aa, Borrelia garinii PBi
NEYVNERRILYTS

SEQ ID NO: 119972 - protein, 13 aa, Borrelia garinii PBi
EYVNERRILYTSL

SEQ ID NO: 119973 - protein, 13 aa, Borrelia garinii PBi
YVNERRILYTSLN

SEQ ID NO: 119974 - protein, 13 aa, Borrelia garinii PBi
VNERRILYTSLNF

SEQ ID NO: 119975 - protein, 13 aa, Borrelia garinii PBi
NERRILYTSLNFN

SEQ ID NO: 119976 - protein, 13 aa, Borrelia garinii PBi
ERRILYTSLNFNE

SEQ ID NO: 119977 - protein, 13 aa, Borrelia garinii PBi
RRILYTSLNFNEN

SEQ ID NO: 119978 - protein, 13 aa, Borrelia garinii PBi
RILYTSLNFNENK

SEQ ID NO: 119979 - protein, 13 aa, Borrelia garinii PBi
ILYTSLNFNENKI

SEQ ID NO: 119980 - protein, 13 aa, Borrelia garinii PBi
LYTSLNFNENKIL

SEQ ID NO: 119981 - protein, 13 aa, Borrelia garinii PBi
YTSLNFNENKILN

SEQ ID NO: 119982 - protein, 13 aa, Borrelia garinii PBi
TSLNFNENKILNL

SEQ ID NO: 119983 - protein, 13 aa, Borrelia garinii PBi
SLNFNENKILNLG

SEQ ID NO: 119984 - protein, 13 aa, Borrelia garinii PBi
LNFNENKILNLGK

SEQ ID NO: 119985 - protein, 13 aa, Borrelia garinii PBi
NFNENKILNLGKI

SEQ ID NO: 119986 - protein, 13 aa, Borrelia garinii PBi
FNENKILNLGKIL

SEQ ID NO: 119987 - protein, 13 aa, Borrelia garinii PBi
NENKILNLGKILS

SEQ ID NO: 119988 - protein, 13 aa, Borrelia garinii PBi
ENKILNLGKILSK

SEQ ID NO: 119989 - protein, 13 aa, Borrelia garinii PBi
NKILNLGKILSKL

SEQ ID NO: 119990 - protein, 13 aa, Borrelia garinii PBi
KILNLGKILSKLS

SEQ ID NO: 119991 - protein, 13 aa, Borrelia garinii PBi
ILNLGKILSKLSQ

SEQ ID NO: 119992 - protein, 13 aa, Borrelia garinii PBi
LNLGKILSKLSQD

SEQ ID NO: 119993 - protein, 13 aa, Borrelia garinii PBi
NLGKILSKLSQDS

SEQ ID NO: 119994 - protein, 13 aa, Borrelia garinii PBi
LGKILSKLSQDSN

SEQ ID NO: 119995 - protein, 13 aa, Borrelia garinii PBi
GKILSKLSQDSNY

SEQ ID NO: 119996 - protein, 13 aa, Borrelia garinii PBi
KILSKLSQDSNYR

SEQ ID NO: 119997 - protein, 13 aa, Borrelia garinii PBi
ILSKLSQDSNYRS

SEQ ID NO: 119998 - protein, 13 aa, Borrelia garinii PBi
LSKLSQDSNYRSL

SEQ ID NO: 119999 - protein, 13 aa, Borrelia garinii PBi
SKLSQDSNYRSLV

SEQ ID NO: 120000 - protein, 13 aa, Borrelia garinii PBi
KLSQDSNYRSLVK

SEQ ID NO: 120001 - protein, 13 aa, Borrelia garinii PBi
LSQDSNYRSLVKE

SEQ ID NO: 120002 - protein, 13 aa, Borrelia garinii PBi
SQDSNYRSLVKEI

SEQ ID NO: 120003 - protein, 13 aa, Borrelia garinii PBi
QDSNYRSLVKEIL

SEQ ID NO: 120004 - protein, 13 aa, Borrelia garinii PBi
DSNYRSLVKEILI

SEQ ID NO: 120005 - protein, 13 aa, Borrelia garinii PBi
SNYRSLVKEILIN

SEQ ID NO: 120006 - protein, 13 aa, Borrelia garinii PBi
NYRSLVKEILINR

SEQ ID NO: 120007 - protein, 13 aa, Borrelia garinii PBi
YRSLVKEILINRG

SEQ ID NO: 120008 - protein, 13 aa, Borrelia garinii PBi
RSLVKEILINRGF

SEQ ID NO: 120009 - protein, 13 aa, Borrelia garinii PBi
SLVKEILINRGFS

SEQ ID NO: 120010 - protein, 13 aa, Borrelia garinii PBi
LVKEILINRGFSI

SEQ ID NO: 120011 - protein, 13 aa, Borrelia garinii PBi
VKEILINRGFSIQ

SEQ ID NO: 120012 - protein, 13 aa, Borrelia garinii PBi
KEILINRGFSIQL

SEQ ID NO: 120013 - protein, 13 aa, Borrelia garinii PBi
EILINRGFSIQLA

SEQ ID NO: 120014 - protein, 13 aa, Borrelia garinii PBi
ILINRGFSIQLAI

SEQ ID NO: 120015 - protein, 13 aa, Borrelia garinii PBi
LINRGFSIQLAIE

SEQ ID NO: 120016 - protein, 13 aa, Borrelia garinii PBi
INRGFSIQLAIEE

SEQ ID NO: 120017 - protein, 13 aa, Borrelia garinii PBi
NRGFSIQLAIEEI

SEQ ID NO: 120018 - protein, 13 aa, Borrelia garinii PBi
RGFSIQLAIEEIS

SEQ ID NO: 120019 - protein, 13 aa, Borrelia garinii PBi
GFSIQLAIEEISL

SEQ ID NO: 120020 - protein, 13 aa, Borrelia garinii PBi
FSIQLAIEEISLR

SEQ ID NO: 120021 - protein, 13 aa, Borrelia garinii PBi
SIQLAIEEISLRT

SEQ ID NO: 120022 - protein, 13 aa, Borrelia garinii PBi
IQLAIEEISLRTL

SEQ ID NO: 120023 - protein, 13 aa, Borrelia garinii PBi
QLAIEEISLRTLN

SEQ ID NO: 120024 - protein, 13 aa, Borrelia garinii PBi
LAIEEISLRTLNV

SEQ ID NO: 120025 - protein, 13 aa, Borrelia garinii PBi
AIEEISLRTLNVK

SEQ ID NO: 120026 - protein, 13 aa, Borrelia garinii PBi
IEEISLRTLNVKD

SEQ ID NO: 120027 - protein, 13 aa, Borrelia garinii PBi
EEISLRTLNVKDK

SEQ ID NO: 120028 - protein, 13 aa, Borrelia garinii PBi
EISLRTLNVKDKI

SEQ ID NO: 120029 - protein, 13 aa, Borrelia garinii PBi
ISLRTLNVKDKIQ

SEQ ID NO: 120030 - protein, 13 aa, Borrelia garinii PBi
SLRTLNVKDKIQH

SEQ ID NO: 120031 - protein, 13 aa, Borrelia garinii PBi
LRTLNVKDKIQHL

SEQ ID NO: 120032 - protein, 13 aa, Borrelia garinii PBi
RTLNVKDKIQHLN

SEQ ID NO: 120033 - protein, 13 aa, Borrelia garinii PBi
TLNVKDKIQHLNK

SEQ ID NO: 120034 - protein, 13 aa, Borrelia garinii PBi
LNVKDKIQHLNKP

SEQ ID NO: 120035 - protein, 13 aa, Borrelia garinii PBi
NVKDKIQHLNKPN

SEQ ID NO: 120036 - protein, 13 aa, Borrelia garinii PBi
VKDKIQHLNKPNL

SEQ ID NO: 120037 - protein, 13 aa, Borrelia garinii PBi
KDKIQHLNKPNLK

SEQ ID NO: 120038 - protein, 13 aa, Borrelia garinii PBi
DKIQHLNKPNLKT

SEQ ID NO: 120039 - protein, 13 aa, Borrelia garinii PBi
KIQHLNKPNLKTL

SEQ ID NO: 120040 - protein, 13 aa, Borrelia garinii PBi
IQHLNKPNLKTLY

SEQ ID NO: 120041 - protein, 13 aa, Borrelia garinii PBi
QHLNKPNLKTLYH

SEQ ID NO: 120042 - protein, 13 aa, Borrelia garinii PBi
HLNKPNLKTLYHD

SEQ ID NO: 120043 - protein, 13 aa, Borrelia garinii PBi
LNKPNLKTLYHDF

SEQ ID NO: 120044 - protein, 13 aa, Borrelia garinii PBi
NKPNLKTLYHDFN

SEQ ID NO: 120045 - protein, 13 aa, Borrelia garinii PBi
KPNLKTLYHDFNK

SEQ ID NO: 120046 - protein, 13 aa, Borrelia garinii PBi
PNLKTLYHDFNKL

SEQ ID NO: 120047 - protein, 13 aa, Borrelia garinii PBi
NLKTLYHDFNKLI

SEQ ID NO: 120048 - protein, 13 aa, Borrelia garinii PBi
LKTLYHDFNKLIP

SEQ ID NO: 120049 - protein, 13 aa, Borrelia garinii PBi
KTLYHDFNKLIPL

SEQ ID NO: 120050 - protein, 13 aa, Borrelia garinii PBi
TLYHDFNKLIPLK

SEQ ID NO: 120051 - protein, 13 aa, Borrelia garinii PBi
LYHDFNKLIPLKE

SEQ ID NO: 120052 - protein, 13 aa, Borrelia garinii PBi
YHDFNKLIPLKEK

SEQ ID NO: 120053 - protein, 13 aa, Borrelia garinii PBi
HDFNKLIPLKEKW

SEQ ID NO: 120054 - protein, 13 aa, Borrelia garinii PBi
DFNKLIPLKEKWL

SEQ ID NO: 120055 - protein, 13 aa, Borrelia garinii PBi
FNKLIPLKEKWLK

SEQ ID NO: 120056 - protein, 13 aa, Borrelia garinii PBi
NKLIPLKEKWLKD

SEQ ID NO: 120057 - protein, 13 aa, Borrelia garinii PBi
KLIPLKEKWLKDV

SEQ ID NO: 120058 - protein, 13 aa, Borrelia garinii PBi
LIPLKEKWLKDVD

SEQ ID NO: 120059 - protein, 13 aa, Borrelia garinii PBi
IPLKEKWLKDVDD

SEQ ID NO: 120060 - protein, 13 aa, Borrelia garinii PBi
PLKEKWLKDVDDI

SEQ ID NO: 120061 - protein, 13 aa, Borrelia garinii PBi
LKEKWLKDVDDII

SEQ ID NO: 120062 - protein, 13 aa, Borrelia garinii PBi
KEKWLKDVDDIIK

SEQ ID NO: 120063 - protein, 13 aa, Borrelia garinii PBi
EKWLKDVDDIIKD

SEQ ID NO: 120064 - protein, 13 aa, Borrelia garinii PBi
KWLKDVDDIIKDY

SEQ ID NO: 120065 - protein, 13 aa, Borrelia garinii PBi
WLKDVDDIIKDYN

SEQ ID NO: 120066 - protein, 13 aa, Borrelia garinii PBi
LKDVDDIIKDYNA

SEQ ID NO: 120067 - protein, 13 aa, Borrelia garinii PBi
KDVDDIIKDYNAN

SEQ ID NO: 120068 - protein, 13 aa, Borrelia garinii PBi
DVDDIIKDYNANP

SEQ ID NO: 120069 - protein, 13 aa, Borrelia garinii PBi
VDDIIKDYNANPE

SEQ ID NO: 120070 - protein, 13 aa, Borrelia garinii PBi
DDIIKDYNANPEL

SEQ ID NO: 120071 - protein, 13 aa, Borrelia garinii PBi
DIIKDYNANPELR

SEQ ID NO: 120072 - protein, 13 aa, Borrelia garinii PBi
IIKDYNANPELRT

SEQ ID NO: 120073 - protein, 13 aa, Borrelia garinii PBi
IKDYNANPELRTD

SEQ ID NO: 120074 - protein, 13 aa, Borrelia garinii PBi
KDYNANPELRTDI

SEQ ID NO: 120075 - protein, 13 aa, Borrelia garinii PBi
DYNANPELRTDIS

SEQ ID NO: 120076 - protein, 13 aa, Borrelia garinii PBi
YNANPELRTDISK

SEQ ID NO: 120077 - protein, 13 aa, Borrelia garinii PBi
NANPELRTDISKL

SEQ ID NO: 120078 - protein, 13 aa, Borrelia garinii PBi
ANPELRTDISKLN

SEQ ID NO: 120079 - protein, 13 aa, Borrelia garinii PBi
NPELRTDISKLND

SEQ ID NO: 120080 - protein, 13 aa, Borrelia garinii PBi
PELRTDISKLNDY

SEQ ID NO: 120081 - protein, 13 aa, Borrelia garinii PBi
ELRTDISKLNDYI

SEQ ID NO: 120082 - protein, 13 aa, Borrelia garinii PBi
LRTDISKLNDYII

SEQ ID NO: 120083 - protein, 13 aa, Borrelia garinii PBi
RTDISKLNDYIIS

SEQ ID NO: 120084 - protein, 13 aa, Borrelia garinii PBi
TDISKLNDYIISK

SEQ ID NO: 120085 - protein, 13 aa, Borrelia garinii PBi
DISKLNDYIISKN

SEQ ID NO: 120086 - protein, 13 aa, Borrelia garinii PBi
ISKLNDYIISKNS

SEQ ID NO: 120087 - protein, 13 aa, Borrelia garinii PBi
SKLNDYIISKNSK

SEQ ID NO: 120088 - protein, 13 aa, Borrelia garinii PBi
KLNDYIISKNSKA

SEQ ID NO: 120089 - protein, 13 aa, Borrelia garinii PBi
LNDYIISKNSKAQ

SEQ ID NO: 120090 - protein, 13 aa, Borrelia garinii PBi
NDYIISKNSKAQF

SEQ ID NO: 120091 - protein, 13 aa, Borrelia garinii PBi
DYIISKNSKAQFT

SEQ ID NO: 120092 - protein, 13 aa, Borrelia garinii PBi
YIISKNSKAQFTD

SEQ ID NO: 120093 - protein, 13 aa, Borrelia garinii PBi
IISKNSKAQFTDI

SEQ ID NO: 120094 - protein, 13 aa, Borrelia garinii PBi
ISKNSKAQFTDIH

SEQ ID NO: 120095 - protein, 13 aa, Borrelia garinii PBi
SKNSKAQFTDIHN

SEQ ID NO: 120096 - protein, 13 aa, Borrelia garinii PBi
KNSKAQFTDIHNI

SEQ ID NO: 120097 - protein, 13 aa, Borrelia garinii PBi
NSKAQFTDIHNII

SEQ ID NO: 120098 - protein, 13 aa, Borrelia garinii PBi
SKAQFTDIHNIIL

SEQ ID NO: 120099 - protein, 13 aa, Borrelia garinii PBi
KAQFTDIHNIILN

SEQ ID NO: 120100 - protein, 13 aa, Borrelia garinii PBi
AQFTDIHNIILNL

SEQ ID NO: 120101 - protein, 13 aa, Borrelia garinii PBi
QFTDIHNIILNLI

SEQ ID NO: 120102 - protein, 13 aa, Borrelia garinii PBi
FTDIHNIILNLIN

SEQ ID NO: 120103 - protein, 13 aa, Borrelia garinii PBi
TDIHNIILNLINT

SEQ ID NO: 120104 - protein, 13 aa, Borrelia garinii PBi
DIHNIILNLINTT

SEQ ID NO: 120105 - protein, 13 aa, Borrelia garinii PBi
IHNIILNLINTTT

SEQ ID NO: 120106 - protein, 13 aa, Borrelia garinii PBi
HNIILNLINTTTN

SEQ ID NO: 120107 - protein, 13 aa, Borrelia garinii PBi
NIILNLINTTTNI

SEQ ID NO: 120108 - protein, 13 aa, Borrelia garinii PBi
IILNLINTTTNIL

SEQ ID NO: 120109 - protein, 13 aa, Borrelia garinii PBi
ILNLINTTTNILA

SEQ ID NO: 120110 - protein, 13 aa, Borrelia garinii PBi
LNLINTTTNILAP

SEQ ID NO: 120111 - protein, 13 aa, Borrelia garinii PBi
NLINTTTNILAPI

SEQ ID NO: 120112 - protein, 13 aa, Borrelia garinii PBi
LINTTTNILAPIQ

SEQ ID NO: 120113 - protein, 14 aa, Borrelia garinii PBi
MKNNKLIAIFLLHI

SEQ ID NO: 120114 - protein, 14 aa, Borrelia garinii PBi
KNNKLIAIFLLHIL

SEQ ID NO: 120115 - protein, 14 aa, Borrelia garinii PBi
NNKLIAIFLLHILT

SEQ ID NO: 120116 - protein, 14 aa, Borrelia garinii PBi
NKLIAIFLLHILTG

SEQ ID NO: 120117 - protein, 14 aa, Borrelia garinii PBi
KLIAIFLLHILTGL

SEQ ID NO: 120118 - protein, 14 aa, Borrelia garinii PBi
LIAIFLLHILTGLI

SEQ ID NO: 120119 - protein, 14 aa, Borrelia garinii PBi
IAIFLLHILTGLIL

SEQ ID NO: 120120 - protein, 14 aa, Borrelia garinii PBi
AIFLLHILTGLILL

SEQ ID NO: 120121 - protein, 14 aa, Borrelia garinii PBi
IFLLHILTGLILLS

SEQ ID NO: 120122 - protein, 14 aa, Borrelia garinii PBi
FLLHILTGLILLSC

SEQ ID NO: 120123 - protein, 14 aa, Borrelia garinii PBi
LLHILTGLILLSCS

SEQ ID NO: 120124 - protein, 14 aa, Borrelia garinii PBi
LHILTGLILLSCSL

SEQ ID NO: 120125 - protein, 14 aa, Borrelia garinii PBi
HILTGLILLSCSLE

SEQ ID NO: 120126 - protein, 14 aa, Borrelia garinii PBi
ILTGLILLSCSLEV

SEQ ID NO: 120127 - protein, 14 aa, Borrelia garinii PBi
LTGLILLSCSLEVN

SEQ ID NO: 120128 - protein, 14 aa, Borrelia garinii PBi
TGLILLSCSLEVNQ

SEQ ID NO: 120129 - protein, 14 aa, Borrelia garinii PBi
GLILLSCSLEVNQD

SEQ ID NO: 120130 - protein, 14 aa, Borrelia garinii PBi
LILLSCSLEVNQDD

SEQ ID NO: 120131 - protein, 14 aa, Borrelia garinii PBi
ILLSCSLEVNQDDN

SEQ ID NO: 120132 - protein, 14 aa, Borrelia garinii PBi
LLSCSLEVNQDDNQ

SEQ ID NO: 120133 - protein, 14 aa, Borrelia garinii PBi
LSCSLEVNQDDNQE

SEQ ID NO: 120134 - protein, 14 aa, Borrelia garinii PBi
SCSLEVNQDDNQEK

SEQ ID NO: 120135 - protein, 14 aa, Borrelia garinii PBi
CSLEVNQDDNQEKQ

SEQ ID NO: 120136 - protein, 14 aa, Borrelia garinii PBi
SLEVNQDDNQEKQK

SEQ ID NO: 120137 - protein, 14 aa, Borrelia garinii PBi
LEVNQDDNQEKQKK

SEQ ID NO: 120138 - protein, 14 aa, Borrelia garinii PBi
EVNQDDNQEKQKKA

SEQ ID NO: 120139 - protein, 14 aa, Borrelia garinii PBi
VNQDDNQEKQKKAK

SEQ ID NO: 120140 - protein, 14 aa, Borrelia garinii PBi
NQDDNQEKQKKAKT

SEQ ID NO: 120141 - protein, 14 aa, Borrelia garinii PBi
QDDNQEKQKKAKTK

SEQ ID NO: 120142 - protein, 14 aa, Borrelia garinii PBi
DDNQEKQKKAKTKT

SEQ ID NO: 120143 - protein, 14 aa, Borrelia garinii PBi
DNQEKQKKAKTKTS

SEQ ID NO: 120144 - protein, 14 aa, Borrelia garinii PBi
NQEKQKKAKTKTSK

SEQ ID NO: 120145 - protein, 14 aa, Borrelia garinii PBi
QEKQKKAKTKTSKS

SEQ ID NO: 120146 - protein, 14 aa, Borrelia garinii PBi
EKQKKAKTKTSKSE

SEQ ID NO: 120147 - protein, 14 aa, Borrelia garinii PBi
KQKKAKTKTSKSEN

SEQ ID NO: 120148 - protein, 14 aa, Borrelia garinii PBi
QKKAKTKTSKSENN

SEQ ID NO: 120149 - protein, 14 aa, Borrelia garinii PBi
KKAKTKTSKSENNS

SEQ ID NO: 120150 - protein, 14 aa, Borrelia garinii PBi
KAKTKTSKSENNSS

SEQ ID NO: 120151 - protein, 14 aa, Borrelia garinii PBi
AKTKTSKSENNSSK

SEQ ID NO: 120152 - protein, 14 aa, Borrelia garinii PBi
KTKTSKSENNSSKM

SEQ ID NO: 120153 - protein, 14 aa, Borrelia garinii PBi
TKTSKSENNSSKMK

SEQ ID NO: 120154 - protein, 14 aa, Borrelia garinii PBi
KTSKSENNSSKMKK

SEQ ID NO: 120155 - protein, 14 aa, Borrelia garinii PBi
TSKSENNSSKMKKL

SEQ ID NO: 120156 - protein, 14 aa, Borrelia garinii PBi
SKSENNSSKMKKLS

SEQ ID NO: 120157 - protein, 14 aa, Borrelia garinii PBi
KSENNSSKMKKLSK

SEQ ID NO: 120158 - protein, 14 aa, Borrelia garinii PBi
SENNSSKMKKLSKN

SEQ ID NO: 120159 - protein, 14 aa, Borrelia garinii PBi
ENNSSKMKKLSKNA

SEQ ID NO: 120160 - protein, 14 aa, Borrelia garinii PBi
NNSSKMKKLSKNAK

SEQ ID NO: 120161 - protein, 14 aa, Borrelia garinii PBi
NSSKMKKLSKNAKN

SEQ ID NO: 120162 - protein, 14 aa, Borrelia garinii PBi
SSKMKKLSKNAKNK

SEQ ID NO: 120163 - protein, 14 aa, Borrelia garinii PBi
SKMKKLSKNAKNKK

SEQ ID NO: 120164 - protein, 14 aa, Borrelia garinii PBi
KMKKLSKNAKNKKP

SEQ ID NO: 120165 - protein, 14 aa, Borrelia garinii PBi
MKKLSKNAKNKKPT

SEQ ID NO: 120166 - protein, 14 aa, Borrelia garinii PBi
KKLSKNAKNKKPTV

SEQ ID NO: 120167 - protein, 14 aa, Borrelia garinii PBi
KLSKNAKNKKPTVD

SEQ ID NO: 120168 - protein, 14 aa, Borrelia garinii PBi
LSKNAKNKKPTVDN

SEQ ID NO: 120169 - protein, 14 aa, Borrelia garinii PBi
SKNAKNKKPTVDNL

SEQ ID NO: 120170 - protein, 14 aa, Borrelia garinii PBi
KNAKNKKPTVDNLL

SEQ ID NO: 120171 - protein, 14 aa, Borrelia garinii PBi
NAKNKKPTVDNLLV

SEQ ID NO: 120172 - protein, 14 aa, Borrelia garinii PBi
AKNKKPTVDNLLVA

SEQ ID NO: 120173 - protein, 14 aa, Borrelia garinii PBi
KNKKPTVDNLLVAI

SEQ ID NO: 120174 - protein, 14 aa, Borrelia garinii PBi
NKKPTVDNLLVAIN

SEQ ID NO: 120175 - protein, 14 aa, Borrelia garinii PBi
KKPTVDNLLVAINT

SEQ ID NO: 120176 - protein, 14 aa, Borrelia garinii PBi
KPTVDNLLVAINTL

SEQ ID NO: 120177 - protein, 14 aa, Borrelia garinii PBi
PTVDNLLVAINTLK

SEQ ID NO: 120178 - protein, 14 aa, Borrelia garinii PBi
TVDNLLVAINTLKN

SEQ ID NO: 120179 - protein, 14 aa, Borrelia garinii PBi
VDNLLVAINTLKNP

SEQ ID NO: 120180 - protein, 14 aa, Borrelia garinii PBi
DNLLVAINTLKNPP

SEQ ID NO: 120181 - protein, 14 aa, Borrelia garinii PBi
NLLVAINTLKNPPK

SEQ ID NO: 120182 - protein, 14 aa, Borrelia garinii PBi
LLVAINTLKNPPKT

SEQ ID NO: 120183 - protein, 14 aa, Borrelia garinii PBi
LVAINTLKNPPKTA

SEQ ID NO: 120184 - protein, 14 aa, Borrelia garinii PBi
VAINTLKNPPKTAG

SEQ ID NO: 120185 - protein, 14 aa, Borrelia garinii PBi
AINTLKNPPKTAGK

SEQ ID NO: 120186 - protein, 14 aa, Borrelia garinii PBi
INTLKNPPKTAGKN

SEQ ID NO: 120187 - protein, 14 aa, Borrelia garinii PBi
NTLKNPPKTAGKNK

SEQ ID NO: 120188 - protein, 14 aa, Borrelia garinii PBi
TLKNPPKTAGKNKS

SEQ ID NO: 120189 - protein, 14 aa, Borrelia garinii PBi
LKNPPKTAGKNKSN

SEQ ID NO: 120190 - protein, 14 aa, Borrelia garinii PBi
KNPPKTAGKNKSNS

SEQ ID NO: 120191 - protein, 14 aa, Borrelia garinii PBi
NPPKTAGKNKSNSA

SEQ ID NO: 120192 - protein, 14 aa, Borrelia garinii PBi
PPKTAGKNKSNSAA

SEQ ID NO: 120193 - protein, 14 aa, Borrelia garinii PBi
PKTAGKNKSNSAAA

SEQ ID NO: 120194 - protein, 14 aa, Borrelia garinii PBi
KTAGKNKSNSAAAL

SEQ ID NO: 120195 - protein, 14 aa, Borrelia garinii PBi
TAGKNKSNSAAALK

SEQ ID NO: 120196 - protein, 14 aa, Borrelia garinii PBi
AGKNKSNSAAALKQ

SEQ ID NO: 120197 - protein, 14 aa, Borrelia garinii PBi
GKNKSNSAAALKQP

SEQ ID NO: 120198 - protein, 14 aa, Borrelia garinii PBi
KNKSNSAAALKQPN

SEQ ID NO: 120199 - protein, 14 aa, Borrelia garinii PBi
NKSNSAAALKQPNN

SEQ ID NO: 120200 - protein, 14 aa, Borrelia garinii PBi
KSNSAAALKQPNNA

SEQ ID NO: 120201 - protein, 14 aa, Borrelia garinii PBi
SNSAAALKQPNNAN

SEQ ID NO: 120202 - protein, 14 aa, Borrelia garinii PBi
NSAAALKQPNNANA

SEQ ID NO: 120203 - protein, 14 aa, Borrelia garinii PBi
SAAALKQPNNANAL

SEQ ID NO: 120204 - protein, 14 aa, Borrelia garinii PBi
AAALKQPNNANALK

SEQ ID NO: 120205 - protein, 14 aa, Borrelia garinii PBi
AALKQPNNANALKQ

SEQ ID NO: 120206 - protein, 14 aa, Borrelia garinii PBi
ALKQPNNANALKQI

SEQ ID NO: 120207 - protein, 14 aa, Borrelia garinii PBi
LKQPNNANALKQID

SEQ ID NO: 120208 - protein, 14 aa, Borrelia garinii PBi
KQPNNANALKQIDP

SEQ ID NO: 120209 - protein, 14 aa, Borrelia garinii PBi
QPNNANALKQIDPE

SEQ ID NO: 120210 - protein, 14 aa, Borrelia garinii PBi
PNNANALKQIDPEA

SEQ ID NO: 120211 - protein, 14 aa, Borrelia garinii PBi
NNANALKQIDPEAK

SEQ ID NO: 120212 - protein, 14 aa, Borrelia garinii PBi
NANALKQIDPEAKE

SEQ ID NO: 120213 - protein, 14 aa, Borrelia garinii PBi
ANALKQIDPEAKEL

SEQ ID NO: 120214 - protein, 14 aa, Borrelia garinii PBi
NALKQIDPEAKELI

SEQ ID NO: 120215 - protein, 14 aa, Borrelia garinii PBi
ALKQIDPEAKELIQ

SEQ ID NO: 120216 - protein, 14 aa, Borrelia garinii PBi
LKQIDPEAKELIQK

SEQ ID NO: 120217 - protein, 14 aa, Borrelia garinii PBi
KQIDPEAKELIQKI

SEQ ID NO: 120218 - protein, 14 aa, Borrelia garinii PBi
QIDPEAKELIQKIL

SEQ ID NO: 120219 - protein, 14 aa, Borrelia garinii PBi
IDPEAKELIQKILE

SEQ ID NO: 120220 - protein, 14 aa, Borrelia garinii PBi
DPEAKELIQKILER

SEQ ID NO: 120221 - protein, 14 aa, Borrelia garinii PBi
PEAKELIQKILERS

SEQ ID NO: 120222 - protein, 14 aa, Borrelia garinii PBi
EAKELIQKILERSE

SEQ ID NO: 120223 - protein, 14 aa, Borrelia garinii PBi
AKELIQKILERSED

SEQ ID NO: 120224 - protein, 14 aa, Borrelia garinii PBi
KELIQKILERSEDI

SEQ ID NO: 120225 - protein, 14 aa, Borrelia garinii PBi
ELIQKILERSEDIV

SEQ ID NO: 120226 - protein, 14 aa, Borrelia garinii PBi
LIQKILERSEDIVQ

SEQ ID NO: 120227 - protein, 14 aa, Borrelia garinii PBi
IQKILERSEDIVQI

SEQ ID NO: 120228 - protein, 14 aa, Borrelia garinii PBi
QKILERSEDIVQIS

SEQ ID NO: 120229 - protein, 14 aa, Borrelia garinii PBi
KILERSEDIVQISE

SEQ ID NO: 120230 - protein, 14 aa, Borrelia garinii PBi
ILERSEDIVQISEI

SEQ ID NO: 120231 - protein, 14 aa, Borrelia garinii PBi
LERSEDIVQISEID

SEQ ID NO: 120232 - protein, 14 aa, Borrelia garinii PBi
ERSEDIVQISEIDA

SEQ ID NO: 120233 - protein, 14 aa, Borrelia garinii PBi
RSEDIVQISEIDAN

SEQ ID NO: 120234 - protein, 14 aa, Borrelia garinii PBi
SEDIVQISEIDANK

SEQ ID NO: 120235 - protein, 14 aa, Borrelia garinii PBi
EDIVQISEIDANKG

SEQ ID NO: 120236 - protein, 14 aa, Borrelia garinii PBi
DIVQISEIDANKGE

SEQ ID NO: 120237 - protein, 14 aa, Borrelia garinii PBi
IVQISEIDANKGEP

SEQ ID NO: 120238 - protein, 14 aa, Borrelia garinii PBi
VQISEIDANKGEPD

SEQ ID NO: 120239 - protein, 14 aa, Borrelia garinii PBi
QISEIDANKGEPDD

SEQ ID NO: 120240 - protein, 14 aa, Borrelia garinii PBi
ISEIDANKGEPDDQ

SEQ ID NO: 120241 - protein, 14 aa, Borrelia garinii PBi
SEIDANKGEPDDQF

SEQ ID NO: 120242 - protein, 14 aa, Borrelia garinii PBi
EIDANKGEPDDQFE

SEQ ID NO: 120243 - protein, 14 aa, Borrelia garinii PBi
IDANKGEPDDQFEM

SEQ ID NO: 120244 - protein, 14 aa, Borrelia garinii PBi
DANKGEPDDQFEMK

SEQ ID NO: 120245 - protein, 14 aa, Borrelia garinii PBi
ANKGEPDDQFEMKA

SEQ ID NO: 120246 - protein, 14 aa, Borrelia garinii PBi
NKGEPDDQFEMKAE

SEQ ID NO: 120247 - protein, 14 aa, Borrelia garinii PBi
KGEPDDQFEMKAEI

SEQ ID NO: 120248 - protein, 14 aa, Borrelia garinii PBi
GEPDDQFEMKAEIF

SEQ ID NO: 120249 - protein, 14 aa, Borrelia garinii PBi
EPDDQFEMKAEIFS

SEQ ID NO: 120250 - protein, 14 aa, Borrelia garinii PBi
PDDQFEMKAEIFSK

SEQ ID NO: 120251 - protein, 14 aa, Borrelia garinii PBi
DDQFEMKAEIFSKI

SEQ ID NO: 120252 - protein, 14 aa, Borrelia garinii PBi
DQFEMKAEIFSKIF

SEQ ID NO: 120253 - protein, 14 aa, Borrelia garinii PBi
QFEMKAEIFSKIFF

SEQ ID NO: 120254 - protein, 14 aa, Borrelia garinii PBi
FEMKAEIFSKIFFN

SEQ ID NO: 120255 - protein, 14 aa, Borrelia garinii PBi
EMKAEIFSKIFFNA

SEQ ID NO: 120256 - protein, 14 aa, Borrelia garinii PBi
MKAEIFSKIFFNAG

SEQ ID NO: 120257 - protein, 14 aa, Borrelia garinii PBi
KAEIFSKIFFNAGS

SEQ ID NO: 120258 - protein, 14 aa, Borrelia garinii PBi
AEIFSKIFFNAGST

SEQ ID NO: 120259 - protein, 14 aa, Borrelia garinii PBi
EIFSKIFFNAGSTV

SEQ ID NO: 120260 - protein, 14 aa, Borrelia garinii PBi
IFSKIFFNAGSTVT

SEQ ID NO: 120261 - protein, 14 aa, Borrelia garinii PBi
FSKIFFNAGSTVTF

SEQ ID NO: 120262 - protein, 14 aa, Borrelia garinii PBi
SKIFFNAGSTVTFD

SEQ ID NO: 120263 - protein, 14 aa, Borrelia garinii PBi
KIFFNAGSTVTFDD

SEQ ID NO: 120264 - protein, 14 aa, Borrelia garinii PBi
IFFNAGSTVTFDDN

SEQ ID NO: 120265 - protein, 14 aa, Borrelia garinii PBi
FFNAGSTVTFDDNE

SEQ ID NO: 120266 - protein, 14 aa, Borrelia garinii PBi
FNAGSTVTFDDNEY

SEQ ID NO: 120267 - protein, 14 aa, Borrelia garinii PBi
NAGSTVTFDDNEYV

SEQ ID NO: 120268 - protein, 14 aa, Borrelia garinii PBi
AGSTVTFDDNEYVN

SEQ ID NO: 120269 - protein, 14 aa, Borrelia garinii PBi
GSTVTFDDNEYVNE

SEQ ID NO: 120270 - protein, 14 aa, Borrelia garinii PBi
STVTFDDNEYVNER

SEQ ID NO: 120271 - protein, 14 aa, Borrelia garinii PBi
TVTFDDNEYVNERR

SEQ ID NO: 120272 - protein, 14 aa, Borrelia garinii PBi
VTFDDNEYVNERRI

SEQ ID NO: 120273 - protein, 14 aa, Borrelia garinii PBi
TFDDNEYVNERRIL

SEQ ID NO: 120274 - protein, 14 aa, Borrelia garinii PBi
FDDNEYVNERRILY

SEQ ID NO: 120275 - protein, 14 aa, Borrelia garinii PBi
DDNEYVNERRILYT

SEQ ID NO: 120276 - protein, 14 aa, Borrelia garinii PBi
DNEYVNERRILYTS

SEQ ID NO: 120277 - protein, 14 aa, Borrelia garinii PBi
NEYVNERRILYTSL

SEQ ID NO: 120278 - protein, 14 aa, Borrelia garinii PBi
EYVNERRILYTSLN

SEQ ID NO: 120279 - protein, 14 aa, Borrelia garinii PBi
YVNERRILYTSLNF

SEQ ID NO: 120280 - protein, 14 aa, Borrelia garinii PBi
VNERRILYTSLNFN

SEQ ID NO: 120281 - protein, 14 aa, Borrelia garinii PBi
NERRILYTSLNFNE

SEQ ID NO: 120282 - protein, 14 aa, Borrelia garinii PBi
ERRILYTSLNFNEN

SEQ ID NO: 120283 - protein, 14 aa, Borrelia garinii PBi
RRILYTSLNFNENK

SEQ ID NO: 120284 - protein, 14 aa, Borrelia garinii PBi
RILYTSLNFNENKI

SEQ ID NO: 120285 - protein, 14 aa, Borrelia garinii PBi
ILYTSLNFNENKIL

SEQ ID NO: 120286 - protein, 14 aa, Borrelia garinii PBi
LYTSLNFNENKILN

SEQ ID NO: 120287 - protein, 14 aa, Borrelia garinii PBi
YTSLNFNENKILNL

SEQ ID NO: 120288 - protein, 14 aa, Borrelia garinii PBi
TSLNFNENKILNLG

SEQ ID NO: 120289 - protein, 14 aa, Borrelia garinii PBi
SLNFNENKILNLGK

SEQ ID NO: 120290 - protein, 14 aa, Borrelia garinii PBi
LNFNENKILNLGKI

SEQ ID NO: 120291 - protein, 14 aa, Borrelia garinii PBi
NFNENKILNLGKIL

SEQ ID NO: 120292 - protein, 14 aa, Borrelia garinii PBi
FNENKILNLGKILS

SEQ ID NO: 120293 - protein, 14 aa, Borrelia garinii PBi
NENKILNLGKILSK

SEQ ID NO: 120294 - protein, 14 aa, Borrelia garinii PBi
ENKILNLGKILSKL

SEQ ID NO: 120295 - protein, 14 aa, Borrelia garinii PBi
NKILNLGKILSKLS

SEQ ID NO: 120296 - protein, 14 aa, Borrelia garinii PBi
KILNLGKILSKLSQ

SEQ ID NO: 120297 - protein, 14 aa, Borrelia garinii PBi
ILNLGKILSKLSQD

SEQ ID NO: 120298 - protein, 14 aa, Borrelia garinii PBi
LNLGKILSKLSQDS

SEQ ID NO: 120299 - protein, 14 aa, Borrelia garinii PBi
NLGKILSKLSQDSN

SEQ ID NO: 120300 - protein, 14 aa, Borrelia garinii PBi
LGKILSKLSQDSNY

SEQ ID NO: 120301 - protein, 14 aa, Borrelia garinii PBi
GKILSKLSQDSNYR

SEQ ID NO: 120302 - protein, 14 aa, Borrelia garinii PBi
KILSKLSQDSNYRS

SEQ ID NO: 120303 - protein, 14 aa, Borrelia garinii PBi
ILSKLSQDSNYRSL

SEQ ID NO: 120304 - protein, 14 aa, Borrelia garinii PBi
LSKLSQDSNYRSLV

SEQ ID NO: 120305 - protein, 14 aa, Borrelia garinii PBi
SKLSQDSNYRSLVK

SEQ ID NO: 120306 - protein, 14 aa, Borrelia garinii PBi
KLSQDSNYRSLVKE

SEQ ID NO: 120307 - protein, 14 aa, Borrelia garinii PBi
LSQDSNYRSLVKEI

SEQ ID NO: 120308 - protein, 14 aa, Borrelia garinii PBi
SQDSNYRSLVKEIL

SEQ ID NO: 120309 - protein, 14 aa, Borrelia garinii PBi
QDSNYRSLVKEILI

SEQ ID NO: 120310 - protein, 14 aa, Borrelia garinii PBi
DSNYRSLVKEILIN

SEQ ID NO: 120311 - protein, 14 aa, Borrelia garinii PBi
SNYRSLVKEILINR

SEQ ID NO: 120312 - protein, 14 aa, Borrelia garinii PBi
NYRSLVKEILINRG

SEQ ID NO: 120313 - protein, 14 aa, Borrelia garinii PBi
YRSLVKEILINRGF

SEQ ID NO: 120314 - protein, 14 aa, Borrelia garinii PBi
RSLVKEILINRGFS

SEQ ID NO: 120315 - protein, 14 aa, Borrelia garinii PBi
SLVKEILINRGFSI

SEQ ID NO: 120316 - protein, 14 aa, Borrelia garinii PBi
LVKEILINRGFSIQ

SEQ ID NO: 120317 - protein, 14 aa, Borrelia garinii PBi
VKEILINRGFSIQL

SEQ ID NO: 120318 - protein, 14 aa, Borrelia garinii PBi
KEILINRGFSIQLA

SEQ ID NO: 120319 - protein, 14 aa, Borrelia garinii PBi
EILINRGFSIQLAI

SEQ ID NO: 120320 - protein, 14 aa, Borrelia garinii PBi
ILINRGFSIQLAIE

SEQ ID NO: 120321 - protein, 14 aa, Borrelia garinii PBi
LINRGFSIQLAIEE

SEQ ID NO: 120322 - protein, 14 aa, Borrelia garinii PBi
INRGFSIQLAIEEI

SEQ ID NO: 120323 - protein, 14 aa, Borrelia garinii PBi
NRGFSIQLAIEEIS

SEQ ID NO: 120324 - protein, 14 aa, Borrelia garinii PBi
RGFSIQLAIEEISL

SEQ ID NO: 120325 - protein, 14 aa, Borrelia garinii PBi
GFSIQLAIEEISLR

SEQ ID NO: 120326 - protein, 14 aa, Borrelia garinii PBi
FSIQLAIEEISLRT

SEQ ID NO: 120327 - protein, 14 aa, Borrelia garinii PBi
SIQLAIEEISLRTL

SEQ ID NO: 120328 - protein, 14 aa, Borrelia garinii PBi
IQLAIEEISLRTLN

SEQ ID NO: 120329 - protein, 14 aa, Borrelia garinii PBi
QLAIEEISLRTLNV

SEQ ID NO: 120330 - protein, 14 aa, Borrelia garinii PBi
LAIEEISLRTLNVK

SEQ ID NO: 120331 - protein, 14 aa, Borrelia garinii PBi
AIEEISLRTLNVKD

SEQ ID NO: 120332 - protein, 14 aa, Borrelia garinii PBi
IEEISLRTLNVKDK

SEQ ID NO: 120333 - protein, 14 aa, Borrelia garinii PBi
EEISLRTLNVKDKI

SEQ ID NO: 120334 - protein, 14 aa, Borrelia garinii PBi
EISLRTLNVKDKIQ

SEQ ID NO: 120335 - protein, 14 aa, Borrelia garinii PBi
ISLRTLNVKDKIQH

SEQ ID NO: 120336 - protein, 14 aa, Borrelia garinii PBi
SLRTLNVKDKIQHL

SEQ ID NO: 120337 - protein, 14 aa, Borrelia garinii PBi
LRTLNVKDKIQHLN

SEQ ID NO: 120338 - protein, 14 aa, Borrelia garinii PBi
RTLNVKDKIQHLNK

SEQ ID NO: 120339 - protein, 14 aa, Borrelia garinii PBi
TLNVKDKIQHLNKP

SEQ ID NO: 120340 - protein, 14 aa, Borrelia garinii PBi
LNVKDKIQHLNKPN

SEQ ID NO: 120341 - protein, 14 aa, Borrelia garinii PBi
NVKDKIQHLNKPNL

SEQ ID NO: 120342 - protein, 14 aa, Borrelia garinii PBi
VKDKIQHLNKPNLK

SEQ ID NO: 120343 - protein, 14 aa, Borrelia garinii PBi
KDKIQHLNKPNLKT

SEQ ID NO: 120344 - protein, 14 aa, Borrelia garinii PBi
DKIQHLNKPNLKTL

SEQ ID NO: 120345 - protein, 14 aa, Borrelia garinii PBi
KIQHLNKPNLKTLY

SEQ ID NO: 120346 - protein, 14 aa, Borrelia garinii PBi
IQHLNKPNLKTLYH

SEQ ID NO: 120347 - protein, 14 aa, Borrelia garinii PBi
QHLNKPNLKTLYHD

SEQ ID NO: 120348 - protein, 14 aa, Borrelia garinii PBi
HLNKPNLKTLYHDF

SEQ ID NO: 120349 - protein, 14 aa, Borrelia garinii PBi
LNKPNLKTLYHDFN

SEQ ID NO: 120350 - protein, 14 aa, Borrelia garinii PBi
NKPNLKTLYHDFNK

SEQ ID NO: 120351 - protein, 14 aa, Borrelia garinii PBi
KPNLKTLYHDFNKL

SEQ ID NO: 120352 - protein, 14 aa, Borrelia garinii PBi
PNLKTLYHDFNKLI

SEQ ID NO: 120353 - protein, 14 aa, Borrelia garinii PBi
NLKTLYHDFNKLIP

SEQ ID NO: 120354 - protein, 14 aa, Borrelia garinii PBi
LKTLYHDFNKLIPL

SEQ ID NO: 120355 - protein, 14 aa, Borrelia garinii PBi
KTLYHDFNKLIPLK

SEQ ID NO: 120356 - protein, 14 aa, Borrelia garinii PBi
TLYHDFNKLIPLKE

SEQ ID NO: 120357 - protein, 14 aa, Borrelia garinii PBi
LYHDFNKLIPLKEK

SEQ ID NO: 120358 - protein, 14 aa, Borrelia garinii PBi
YHDFNKLIPLKEKW

SEQ ID NO: 120359 - protein, 14 aa, Borrelia garinii PBi
HDFNKLIPLKEKWL

SEQ ID NO: 120360 - protein, 14 aa, Borrelia garinii PBi
DFNKLIPLKEKWLK

SEQ ID NO: 120361 - protein, 14 aa, Borrelia garinii PBi
FNKLIPLKEKWLKD

SEQ ID NO: 120362 - protein, 14 aa, Borrelia garinii PBi
NKLIPLKEKWLKDV

SEQ ID NO: 120363 - protein, 14 aa, Borrelia garinii PBi
KLIPLKEKWLKDVD

SEQ ID NO: 120364 - protein, 14 aa, Borrelia garinii PBi
LIPLKEKWLKDVDD

SEQ ID NO: 120365 - protein, 14 aa, Borrelia garinii PBi
IPLKEKWLKDVDDI

SEQ ID NO: 120366 - protein, 14 aa, Borrelia garinii PBi
PLKEKWLKDVDDII

SEQ ID NO: 120367 - protein, 14 aa, Borrelia garinii PBi
LKEKWLKDVDDIIK

SEQ ID NO: 120368 - protein, 14 aa, Borrelia garinii PBi
KEKWLKDVDDIIKD

SEQ ID NO: 120369 - protein, 14 aa, Borrelia garinii PBi
EKWLKDVDDIIKDY

SEQ ID NO: 120370 - protein, 14 aa, Borrelia garinii PBi
KWLKDVDDIIKDYN

SEQ ID NO: 120371 - protein, 14 aa, Borrelia garinii PBi
WLKDVDDIIKDYNA

SEQ ID NO: 120372 - protein, 14 aa, Borrelia garinii PBi
LKDVDDIIKDYNAN

SEQ ID NO: 120373 - protein, 14 aa, Borrelia garinii PBi
KDVDDIIKDYNANP

SEQ ID NO: 120374 - protein, 14 aa, Borrelia garinii PBi
DVDDIIKDYNANPE

SEQ ID NO: 120375 - protein, 14 aa, Borrelia garinii PBi
VDDIIKDYNANPEL

SEQ ID NO: 120376 - protein, 14 aa, Borrelia garinii PBi
DDIIKDYNANPELR

SEQ ID NO: 120377 - protein, 14 aa, Borrelia garinii PBi
DIIKDYNANPELRT

SEQ ID NO: 120378 - protein, 14 aa, Borrelia garinii PBi
IIKDYNANPELRTD

SEQ ID NO: 120379 - protein, 14 aa, Borrelia garinii PBi
IKDYNANPELRTDI

SEQ ID NO: 120380 - protein, 14 aa, Borrelia garinii PBi
KDYNANPELRTDIS

SEQ ID NO: 120381 - protein, 14 aa, Borrelia garinii PBi
DYNANPELRTDISK

SEQ ID NO: 120382 - protein, 14 aa, Borrelia garinii PBi
YNANPELRTDISKL

SEQ ID NO: 120383 - protein, 14 aa, Borrelia garinii PBi
NANPELRTDISKLN

SEQ ID NO: 120384 - protein, 14 aa, Borrelia garinii PBi
ANPELRTDISKLND

SEQ ID NO: 120385 - protein, 14 aa, Borrelia garinii PBi
NPELRTDISKLNDY

SEQ ID NO: 120386 - protein, 14 aa, Borrelia garinii PBi
PELRTDISKLNDYI

SEQ ID NO: 120387 - protein, 14 aa, Borrelia garinii PBi
ELRTDISKLNDYII

SEQ ID NO: 120388 - protein, 14 aa, Borrelia garinii PBi
LRTDISKLNDYIIS

SEQ ID NO: 120389 - protein, 14 aa, Borrelia garinii PBi
RTDISKLNDYIISK

SEQ ID NO: 120390 - protein, 14 aa, Borrelia garinii PBi
TDISKLNDYIISKN

SEQ ID NO: 120391 - protein, 14 aa, Borrelia garinii PBi
DISKLNDYIISKNS

SEQ ID NO: 120392 - protein, 14 aa, Borrelia garinii PBi
ISKLNDYIISKNSK

SEQ ID NO: 120393 - protein, 14 aa, Borrelia garinii PBi
SKLNDYIISKNSKA

SEQ ID NO: 120394 - protein, 14 aa, Borrelia garinii PBi
KLNDYIISKNSKAQ

SEQ ID NO: 120395 - protein, 14 aa, Borrelia garinii PBi
LNDYIISKNSKAQF

SEQ ID NO: 120396 - protein, 14 aa, Borrelia garinii PBi
NDYIISKNSKAQFT

SEQ ID NO: 120397 - protein, 14 aa, Borrelia garinii PBi
DYIISKNSKAQFTD

SEQ ID NO: 120398 - protein, 14 aa, Borrelia garinii PBi
YIISKNSKAQFTDI

SEQ ID NO: 120399 - protein, 14 aa, Borrelia garinii PBi
IISKNSKAQFTDIH

SEQ ID NO: 120400 - protein, 14 aa, Borrelia garinii PBi
ISKNSKAQFTDIHN

SEQ ID NO: 120401 - protein, 14 aa, Borrelia garinii PBi
SKNSKAQFTDIHNI

SEQ ID NO: 120402 - protein, 14 aa, Borrelia garinii PBi
KNSKAQFTDIHNII

SEQ ID NO: 120403 - protein, 14 aa, Borrelia garinii PBi
NSKAQFTDIHNIIL

SEQ ID NO: 120404 - protein, 14 aa, Borrelia garinii PBi
SKAQFTDIHNIILN

SEQ ID NO: 120405 - protein, 14 aa, Borrelia garinii PBi
KAQFTDIHNIILNL

SEQ ID NO: 120406 - protein, 14 aa, Borrelia garinii PBi
AQFTDIHNIILNLI

SEQ ID NO: 120407 - protein, 14 aa, Borrelia garinii PBi
QFTDIHNIILNLIN

SEQ ID NO: 120408 - protein, 14 aa, Borrelia garinii PBi
FTDIHNIILNLINT

SEQ ID NO: 120409 - protein, 14 aa, Borrelia garinii PBi
TDIHNIILNLINTT

SEQ ID NO: 120410 - protein, 14 aa, Borrelia garinii PBi
DIHNIILNLINTTT

SEQ ID NO: 120411 - protein, 14 aa, Borrelia garinii PBi
IHNIILNLINTTTN

SEQ ID NO: 120412 - protein, 14 aa, Borrelia garinii PBi
HNIILNLINTTTNI

SEQ ID NO: 120413 - protein, 14 aa, Borrelia garinii PBi
NIILNLINTTTNIL

SEQ ID NO: 120414 - protein, 14 aa, Borrelia garinii PBi
IILNLINTTTNILA

SEQ ID NO: 120415 - protein, 14 aa, Borrelia garinii PBi
ILNLINTTTNILAP

SEQ ID NO: 120416 - protein, 14 aa, Borrelia garinii PBi
LNLINTTTNILAPI

SEQ ID NO: 120417 - protein, 14 aa, Borrelia garinii PBi
NLINTTTNILAPIQ

SEQ ID NO: 120418 - protein, 15 aa, Borrelia garinii PBi
MKNNKLIAIFLLHIL

SEQ ID NO: 120419 - protein, 15 aa, Borrelia garinii PBi
KNNKLIAIFLLHILT

SEQ ID NO: 120420 - protein, 15 aa, Borrelia garinii PBi
NNKLIAIFLLHILTG

SEQ ID NO: 120421 - protein, 15 aa, Borrelia garinii PBi
NKLIAIFLLHILTGL

SEQ ID NO: 120422 - protein, 15 aa, Borrelia garinii PBi
KLIAIFLLHILTGLI

SEQ ID NO: 120423 - protein, 15 aa, Borrelia garinii PBi
LIAIFLLHILTGLIL

SEQ ID NO: 120424 - protein, 15 aa, Borrelia garinii PBi
IAIFLLHILTGLILL

SEQ ID NO: 120425 - protein, 15 aa, Borrelia garinii PBi
AIFLLHILTGLILLS

SEQ ID NO: 120426 - protein, 15 aa, Borrelia garinii PBi
IFLLHILTGLILLSC

SEQ ID NO: 120427 - protein, 15 aa, Borrelia garinii PBi
FLLHILTGLILLSCS

SEQ ID NO: 120428 - protein, 15 aa, Borrelia garinii PBi
LLHILTGLILLSCSL

SEQ ID NO: 120429 - protein, 15 aa, Borrelia garinii PBi
LHILTGLILLSCSLE

SEQ ID NO: 120430 - protein, 15 aa, Borrelia garinii PBi
HILTGLILLSCSLEV

SEQ ID NO: 120431 - protein, 15 aa, Borrelia garinii PBi
ILTGLILLSCSLEVN

SEQ ID NO: 120432 - protein, 15 aa, Borrelia garinii PBi
LTGLILLSCSLEVNQ

SEQ ID NO: 120433 - protein, 15 aa, Borrelia garinii PBi
TGLILLSCSLEVNQD

SEQ ID NO: 120434 - protein, 15 aa, Borrelia garinii PBi
GLILLSCSLEVNQDD

SEQ ID NO: 120435 - protein, 15 aa, Borrelia garinii PBi
LILLSCSLEVNQDDN

SEQ ID NO: 120436 - protein, 15 aa, Borrelia garinii PBi
ILLSCSLEVNQDDNQ

SEQ ID NO: 120437 - protein, 15 aa, Borrelia garinii PBi
LLSCSLEVNQDDNQE

SEQ ID NO: 120438 - protein, 15 aa, Borrelia garinii PBi
LSCSLEVNQDDNQEK

SEQ ID NO: 120439 - protein, 15 aa, Borrelia garinii PBi
SCSLEVNQDDNQEKQ

SEQ ID NO: 120440 - protein, 15 aa, Borrelia garinii PBi
CSLEVNQDDNQEKQK

SEQ ID NO: 120441 - protein, 15 aa, Borrelia garinii PBi
SLEVNQDDNQEKQKK

SEQ ID NO: 120442 - protein, 15 aa, Borrelia garinii PBi
LEVNQDDNQEKQKKA

SEQ ID NO: 120443 - protein, 15 aa, Borrelia garinii PBi
EVNQDDNQEKQKKAK

SEQ ID NO: 120444 - protein, 15 aa, Borrelia garinii PBi
VNQDDNQEKQKKAKT

SEQ ID NO: 120445 - protein, 15 aa, Borrelia garinii PBi
NQDDNQEKQKKAKTK

SEQ ID NO: 120446 - protein, 15 aa, Borrelia garinii PBi
QDDNQEKQKKAKTKT

SEQ ID NO: 120447 - protein, 15 aa, Borrelia garinii PBi
DDNQEKQKKAKTKTS

SEQ ID NO: 120448 - protein, 15 aa, Borrelia garinii PBi
DNQEKQKKAKTKTSK

SEQ ID NO: 120449 - protein, 15 aa, Borrelia garinii PBi
NQEKQKKAKTKTSKS

SEQ ID NO: 120450 - protein, 15 aa, Borrelia garinii PBi
QEKQKKAKTKTSKSE

SEQ ID NO: 120451 - protein, 15 aa, Borrelia garinii PBi
EKQKKAKTKTSKSEN

SEQ ID NO: 120452 - protein, 15 aa, Borrelia garinii PBi
KQKKAKTKTSKSENN

SEQ ID NO: 120453 - protein, 15 aa, Borrelia garinii PBi
QKKAKTKTSKSENNS

SEQ ID NO: 120454 - protein, 15 aa, Borrelia garinii PBi
KKAKTKTSKSENNSS

SEQ ID NO: 120455 - protein, 15 aa, Borrelia garinii PBi
KAKTKTSKSENNSSK

SEQ ID NO: 120456 - protein, 15 aa, Borrelia garinii PBi
AKTKTSKSENNSSKM

SEQ ID NO: 120457 - protein, 15 aa, Borrelia garinii PBi
KTKTSKSENNSSKMK

SEQ ID NO: 120458 - protein, 15 aa, Borrelia garinii PBi
TKTSKSENNSSKMKK

SEQ ID NO: 120459 - protein, 15 aa, Borrelia garinii PBi
KTSKSENNSSKMKKL

SEQ ID NO: 120460 - protein, 15 aa, Borrelia garinii PBi
TSKSENNSSKMKKLS

SEQ ID NO: 120461 - protein, 15 aa, Borrelia garinii PBi
SKSENNSSKMKKLSK

SEQ ID NO: 120462 - protein, 15 aa, Borrelia garinii PBi
KSENNSSKMKKLSKN

SEQ ID NO: 120463 - protein, 15 aa, Borrelia garinii PBi
SENNSSKMKKLSKNA

SEQ ID NO: 120464 - protein, 15 aa, Borrelia garinii PBi
ENNSSKMKKLSKNAK

SEQ ID NO: 120465 - protein, 15 aa, Borrelia garinii PBi
NNSSKMKKLSKNAKN

SEQ ID NO: 120466 - protein, 15 aa, Borrelia garinii PBi
NSSKMKKLSKNAKNK

SEQ ID NO: 120467 - protein, 15 aa, Borrelia garinii PBi
SSKMKKLSKNAKNKK

SEQ ID NO: 120468 - protein, 15 aa, Borrelia garinii PBi
SKMKKLSKNAKNKKP

SEQ ID NO: 120469 - protein, 15 aa, Borrelia garinii PBi
KMKKLSKNAKNKKPT

SEQ ID NO: 120470 - protein, 15 aa, Borrelia garinii PBi
MKKLSKNAKNKKPTV

SEQ ID NO: 120471 - protein, 15 aa, Borrelia garinii PBi
KKLSKNAKNKKPTVD

SEQ ID NO: 120472 - protein, 15 aa, Borrelia garinii PBi
KLSKNAKNKKPTVDN

SEQ ID NO: 120473 - protein, 15 aa, Borrelia garinii PBi
LSKNAKNKKPTVDNL

SEQ ID NO: 120474 - protein, 15 aa, Borrelia garinii PBi
SKNAKNKKPTVDNLL

SEQ ID NO: 120475 - protein, 15 aa, Borrelia garinii PBi
KNAKNKKPTVDNLLV

SEQ ID NO: 120476 - protein, 15 aa, Borrelia garinii PBi
NAKNKKPTVDNLLVA

SEQ ID NO: 120477 - protein, 15 aa, Borrelia garinii PBi
AKNKKPTVDNLLVAI

SEQ ID NO: 120478 - protein, 15 aa, Borrelia garinii PBi
KNKKPTVDNLLVAIN

SEQ ID NO: 120479 - protein, 15 aa, Borrelia garinii PBi
NKKPTVDNLLVAINT

SEQ ID NO: 120480 - protein, 15 aa, Borrelia garinii PBi
KKPTVDNLLVAINTL

SEQ ID NO: 120481 - protein, 15 aa, Borrelia garinii PBi
KPTVDNLLVAINTLK

SEQ ID NO: 120482 - protein, 15 aa, Borrelia garinii PBi
PTVDNLLVAINTLKN

SEQ ID NO: 120483 - protein, 15 aa, Borrelia garinii PBi
TVDNLLVAINTLKNP

SEQ ID NO: 120484 - protein, 15 aa, Borrelia garinii PBi
VDNLLVAINTLKNPP

SEQ ID NO: 120485 - protein, 15 aa, Borrelia garinii PBi
DNLLVAINTLKNPPK

SEQ ID NO: 120486 - protein, 15 aa, Borrelia garinii PBi
NLLVAINTLKNPPKT

SEQ ID NO: 120487 - protein, 15 aa, Borrelia garinii PBi
LLVAINTLKNPPKTA

SEQ ID NO: 120488 - protein, 15 aa, Borrelia garinii PBi
LVAINTLKNPPKTAG

SEQ ID NO: 120489 - protein, 15 aa, Borrelia garinii PBi
VAINTLKNPPKTAGK

SEQ ID NO: 120490 - protein, 15 aa, Borrelia garinii PBi
AINTLKNPPKTAGKN

SEQ ID NO: 120491 - protein, 15 aa, Borrelia garinii PBi
INTLKNPPKTAGKNK

SEQ ID NO: 120492 - protein, 15 aa, Borrelia garinii PBi
NTLKNPPKTAGKNKS

SEQ ID NO: 120493 - protein, 15 aa, Borrelia garinii PBi
TLKNPPKTAGKNKSN

SEQ ID NO: 120494 - protein, 15 aa, Borrelia garinii PBi
LKNPPKTAGKNKSNS

SEQ ID NO: 120495 - protein, 15 aa, Borrelia garinii PBi
KNPPKTAGKNKSNSA

SEQ ID NO: 120496 - protein, 15 aa, Borrelia garinii PBi
NPPKTAGKNKSNSAA

SEQ ID NO: 120497 - protein, 15 aa, Borrelia garinii PBi
PPKTAGKNKSNSAAA

SEQ ID NO: 120498 - protein, 15 aa, Borrelia garinii PBi
PKTAGKNKSNSAAAL

SEQ ID NO: 120499 - protein, 15 aa, Borrelia garinii PBi
KTAGKNKSNSAAALK

SEQ ID NO: 120500 - protein, 15 aa, Borrelia garinii PBi
TAGKNKSNSAAALKQ

SEQ ID NO: 120501 - protein, 15 aa, Borrelia garinii PBi
AGKNKSNSAAALKQP

SEQ ID NO: 120502 - protein, 15 aa, Borrelia garinii PBi
GKNKSNSAAALKQPN

SEQ ID NO: 120503 - protein, 15 aa, Borrelia garinii PBi
KNKSNSAAALKQPNN

SEQ ID NO: 120504 - protein, 15 aa, Borrelia garinii PBi
NKSNSAAALKQPNNA

SEQ ID NO: 120505 - protein, 15 aa, Borrelia garinii PBi
KSNSAAALKQPNNAN

SEQ ID NO: 120506 - protein, 15 aa, Borrelia garinii PBi
SNSAAALKQPNNANA

SEQ ID NO: 120507 - protein, 15 aa, Borrelia garinii PBi
NSAAALKQPNNANAL

SEQ ID NO: 120508 - protein, 15 aa, Borrelia garinii PBi
SAAALKQPNNANALK

SEQ ID NO: 120509 - protein, 15 aa, Borrelia garinii PBi
AAALKQPNNANALKQ

SEQ ID NO: 120510 - protein, 15 aa, Borrelia garinii PBi
AALKQPNNANALKQI

SEQ ID NO: 120511 - protein, 15 aa, Borrelia garinii PBi
ALKQPNNANALKQID

SEQ ID NO: 120512 - protein, 15 aa, Borrelia garinii PBi
LKQPNNANALKQIDP

SEQ ID NO: 120513 - protein, 15 aa, Borrelia garinii PBi
KQPNNANALKQIDPE

SEQ ID NO: 120514 - protein, 15 aa, Borrelia garinii PBi
QPNNANALKQIDPEA

SEQ ID NO: 120515 - protein, 15 aa, Borrelia garinii PBi
PNNANALKQIDPEAK

SEQ ID NO: 120516 - protein, 15 aa, Borrelia garinii PBi
NNANALKQIDPEAKE

SEQ ID NO: 120517 - protein, 15 aa, Borrelia garinii PBi
NANALKQIDPEAKEL

SEQ ID NO: 120518 - protein, 15 aa, Borrelia garinii PBi
ANALKQIDPEAKELI

SEQ ID NO: 120519 - protein, 15 aa, Borrelia garinii PBi
NALKQIDPEAKELIQ

SEQ ID NO: 120520 - protein, 15 aa, Borrelia garinii PBi
ALKQIDPEAKELIQK

SEQ ID NO: 120521 - protein, 15 aa, Borrelia garinii PBi
LKQIDPEAKELIQKI

SEQ ID NO: 120522 - protein, 15 aa, Borrelia garinii PBi
KQIDPEAKELIQKIL

SEQ ID NO: 120523 - protein, 15 aa, Borrelia garinii PBi
QIDPEAKELIQKILE

SEQ ID NO: 120524 - protein, 15 aa, Borrelia garinii PBi
IDPEAKELIQKILER

SEQ ID NO: 120525 - protein, 15 aa, Borrelia garinii PBi
DPEAKELIQKILERS

SEQ ID NO: 120526 - protein, 15 aa, Borrelia garinii PBi
PEAKELIQKILERSE

SEQ ID NO: 120527 - protein, 15 aa, Borrelia garinii PBi
EAKELIQKILERSED

SEQ ID NO: 120528 - protein, 15 aa, Borrelia garinii PBi
AKELIQKILERSEDI

SEQ ID NO: 120529 - protein, 15 aa, Borrelia garinii PBi
KELIQKILERSEDIV

SEQ ID NO: 120530 - protein, 15 aa, Borrelia garinii PBi
ELIQKILERSEDIVQ

SEQ ID NO: 120531 - protein, 15 aa, Borrelia garinii PBi
LIQKILERSEDIVQI

SEQ ID NO: 120532 - protein, 15 aa, Borrelia garinii PBi
IQKILERSEDIVQIS

SEQ ID NO: 120533 - protein, 15 aa, Borrelia garinii PBi
QKILERSEDIVQISE

SEQ ID NO: 120534 - protein, 15 aa, Borrelia garinii PBi
KILERSEDIVQISEI

SEQ ID NO: 120535 - protein, 15 aa, Borrelia garinii PBi
ILERSEDIVQISEID

SEQ ID NO: 120536 - protein, 15 aa, Borrelia garinii PBi
LERSEDIVQISEIDA

SEQ ID NO: 120537 - protein, 15 aa, Borrelia garinii PBi
ERSEDIVQISEIDAN

SEQ ID NO: 120538 - protein, 15 aa, Borrelia garinii PBi
RSEDIVQISEIDANK

SEQ ID NO: 120539 - protein, 15 aa, Borrelia garinii PBi
SEDIVQISEIDANKG

SEQ ID NO: 120540 - protein, 15 aa, Borrelia garinii PBi
EDIVQISEIDANKGE

SEQ ID NO: 120541 - protein, 15 aa, Borrelia garinii PBi
DIVQISEIDANKGEP

SEQ ID NO: 120542 - protein, 15 aa, Borrelia garinii PBi
IVQISEIDANKGEPD

SEQ ID NO: 120543 - protein, 15 aa, Borrelia garinii PBi
VQISEIDANKGEPDD

SEQ ID NO: 120544 - protein, 15 aa, Borrelia garinii PBi
QISEIDANKGEPDDQ

SEQ ID NO: 120545 - protein, 15 aa, Borrelia garinii PBi
ISEIDANKGEPDDQF

SEQ ID NO: 120546 - protein, 15 aa, Borrelia garinii PBi
SEIDANKGEPDDQFE

SEQ ID NO: 120547 - protein, 15 aa, Borrelia garinii PBi
EIDANKGEPDDQFEM

SEQ ID NO: 120548 - protein, 15 aa, Borrelia garinii PBi
IDANKGEPDDQFEMK

SEQ ID NO: 120549 - protein, 15 aa, Borrelia garinii PBi
DANKGEPDDQFEMKA

SEQ ID NO: 120550 - protein, 15 aa, Borrelia garinii PBi
ANKGEPDDQFEMKAE

SEQ ID NO: 120551 - protein, 15 aa, Borrelia garinii PBi
NKGEPDDQFEMKAEI

SEQ ID NO: 120552 - protein, 15 aa, Borrelia garinii PBi
KGEPDDQFEMKAEIF

SEQ ID NO: 120553 - protein, 15 aa, Borrelia garinii PBi
GEPDDQFEMKAEIFS

SEQ ID NO: 120554 - protein, 15 aa, Borrelia garinii PBi
EPDDQFEMKAEIFSK

SEQ ID NO: 120555 - protein, 15 aa, Borrelia garinii PBi
PDDQFEMKAEIFSKI

SEQ ID NO: 120556 - protein, 15 aa, Borrelia garinii PBi
DDQFEMKAEIFSKIF

SEQ ID NO: 120557 - protein, 15 aa, Borrelia garinii PBi
DQFEMKAEIFSKIFF

SEQ ID NO: 120558 - protein, 15 aa, Borrelia garinii PBi
QFEMKAEIFSKIFFN

SEQ ID NO: 120559 - protein, 15 aa, Borrelia garinii PBi
FEMKAEIFSKIFFNA

SEQ ID NO: 120560 - protein, 15 aa, Borrelia garinii PBi
EMKAEIFSKIFFNAG

SEQ ID NO: 120561 - protein, 15 aa, Borrelia garinii PBi
MKAEIFSKIFFNAGS

SEQ ID NO: 120562 - protein, 15 aa, Borrelia garinii PBi
KAEIFSKIFFNAGST

SEQ ID NO: 120563 - protein, 15 aa, Borrelia garinii PBi
AEIFSKIFFNAGSTV

SEQ ID NO: 120564 - protein, 15 aa, Borrelia garinii PBi
EIFSKIFFNAGSTVT

SEQ ID NO: 120565 - protein, 15 aa, Borrelia garinii PBi
IFSKIFFNAGSTVTF

SEQ ID NO: 120566 - protein, 15 aa, Borrelia garinii PBi
FSKIFFNAGSTVTFD

SEQ ID NO: 120567 - protein, 15 aa, Borrelia garinii PBi
SKIFFNAGSTVTFDD

SEQ ID NO: 120568 - protein, 15 aa, Borrelia garinii PBi
KIFFNAGSTVTFDDN

SEQ ID NO: 120569 - protein, 15 aa, Borrelia garinii PBi
IFFNAGSTVTFDDNE

SEQ ID NO: 120570 - protein, 15 aa, Borrelia garinii PBi
FFNAGSTVTFDDNEY

SEQ ID NO: 120571 - protein, 15 aa, Borrelia garinii PBi
FNAGSTVTFDDNEYV

SEQ ID NO: 120572 - protein, 15 aa, Borrelia garinii PBi
NAGSTVTFDDNEYVN

SEQ ID NO: 120573 - protein, 15 aa, Borrelia garinii PBi
AGSTVTFDDNEYVNE

SEQ ID NO: 120574 - protein, 15 aa, Borrelia garinii PBi
GSTVTFDDNEYVNER

SEQ ID NO: 120575 - protein, 15 aa, Borrelia garinii PBi
STVTFDDNEYVNERR

SEQ ID NO: 120576 - protein, 15 aa, Borrelia garinii PBi
TVTFDDNEYVNERRI

SEQ ID NO: 120577 - protein, 15 aa, Borrelia garinii PBi
VTFDDNEYVNERRIL

SEQ ID NO: 120578 - protein, 15 aa, Borrelia garinii PBi
TFDDNEYVNERRILY

SEQ ID NO: 120579 - protein, 15 aa, Borrelia garinii PBi
FDDNEYVNERRILYT

SEQ ID NO: 120580 - protein, 15 aa, Borrelia garinii PBi
DDNEYVNERRILYTS

SEQ ID NO: 120581 - protein, 15 aa, Borrelia garinii PBi
DNEYVNERRILYTSL

SEQ ID NO: 120582 - protein, 15 aa, Borrelia garinii PBi
NEYVNERRILYTSLN

SEQ ID NO: 120583 - protein, 15 aa, Borrelia garinii PBi
EYVNERRILYTSLNF

SEQ ID NO: 120584 - protein, 15 aa, Borrelia garinii PBi
YVNERRILYTSLNFN

SEQ ID NO: 120585 - protein, 15 aa, Borrelia garinii PBi
VNERRILYTSLNFNE

SEQ ID NO: 120586 - protein, 15 aa, Borrelia garinii PBi
NERRILYTSLNFNEN

SEQ ID NO: 120587 - protein, 15 aa, Borrelia garinii PBi
ERRILYTSLNFNENK

SEQ ID NO: 120588 - protein, 15 aa, Borrelia garinii PBi
RRILYTSLNFNENKI

SEQ ID NO: 120589 - protein, 15 aa, Borrelia garinii PBi
RILYTSLNFNENKIL

SEQ ID NO: 120590 - protein, 15 aa, Borrelia garinii PBi
ILYTSLNFNENKILN

SEQ ID NO: 120591 - protein, 15 aa, Borrelia garinii PBi
LYTSLNFNENKILNL

SEQ ID NO: 120592 - protein, 15 aa, Borrelia garinii PBi
YTSLNFNENKILNLG

SEQ ID NO: 120593 - protein, 15 aa, Borrelia garinii PBi
TSLNFNENKILNLGK

SEQ ID NO: 120594 - protein, 15 aa, Borrelia garinii PBi
SLNFNENKILNLGKI

SEQ ID NO: 120595 - protein, 15 aa, Borrelia garinii PBi
LNFNENKILNLGKIL

SEQ ID NO: 120596 - protein, 15 aa, Borrelia garinii PBi
NFNENKILNLGKILS

SEQ ID NO: 120597 - protein, 15 aa, Borrelia garinii PBi
FNENKILNLGKILSK

SEQ ID NO: 120598 - protein, 15 aa, Borrelia garinii PBi
NENKILNLGKILSKL

SEQ ID NO: 120599 - protein, 15 aa, Borrelia garinii PBi
ENKILNLGKILSKLS

SEQ ID NO: 120600 - protein, 15 aa, Borrelia garinii PBi
NKILNLGKILSKLSQ

SEQ ID NO: 120601 - protein, 15 aa, Borrelia garinii PBi
KILNLGKILSKLSQD

SEQ ID NO: 120602 - protein, 15 aa, Borrelia garinii PBi
ILNLGKILSKLSQDS

SEQ ID NO: 120603 - protein, 15 aa, Borrelia garinii PBi
LNLGKILSKLSQDSN

SEQ ID NO: 120604 - protein, 15 aa, Borrelia garinii PBi
NLGKILSKLSQDSNY

SEQ ID NO: 120605 - protein, 15 aa, Borrelia garinii PBi
LGKILSKLSQDSNYR

SEQ ID NO: 120606 - protein, 15 aa, Borrelia garinii PBi
GKILSKLSQDSNYRS

SEQ ID NO: 120607 - protein, 15 aa, Borrelia garinii PBi
KILSKLSQDSNYRSL

SEQ ID NO: 120608 - protein, 15 aa, Borrelia garinii PBi
ILSKLSQDSNYRSLV

SEQ ID NO: 120609 - protein, 15 aa, Borrelia garinii PBi
LSKLSQDSNYRSLVK

SEQ ID NO: 120610 - protein, 15 aa, Borrelia garinii PBi
SKLSQDSNYRSLVKE

SEQ ID NO: 120611 - protein, 15 aa, Borrelia garinii PBi
KLSQDSNYRSLVKEI

SEQ ID NO: 120612 - protein, 15 aa, Borrelia garinii PBi
LSQDSNYRSLVKEIL

SEQ ID NO: 120613 - protein, 15 aa, Borrelia garinii PBi
SQDSNYRSLVKEILI

SEQ ID NO: 120614 - protein, 15 aa, Borrelia garinii PBi
QDSNYRSLVKEILIN

SEQ ID NO: 120615 - protein, 15 aa, Borrelia garinii PBi
DSNYRSLVKEILINR

SEQ ID NO: 120616 - protein, 15 aa, Borrelia garinii PBi
SNYRSLVKEILINRG

SEQ ID NO: 120617 - protein, 15 aa, Borrelia garinii PBi
NYRSLVKEILINRGF

SEQ ID NO: 120618 - protein, 15 aa, Borrelia garinii PBi
YRSLVKEILINRGFS

SEQ ID NO: 120619 - protein, 15 aa, Borrelia garinii PBi
RSLVKEILINRGFSI

SEQ ID NO: 120620 - protein, 15 aa, Borrelia garinii PBi
SLVKEILINRGFSIQ

SEQ ID NO: 120621 - protein, 15 aa, Borrelia garinii PBi
LVKEILINRGFSIQL

SEQ ID NO: 120622 - protein, 15 aa, Borrelia garinii PBi
VKEILINRGFSIQLA

SEQ ID NO: 120623 - protein, 15 aa, Borrelia garinii PBi
KEILINRGFSIQLAI

SEQ ID NO: 120624 - protein, 15 aa, Borrelia garinii PBi
EILINRGFSIQLAIE

SEQ ID NO: 120625 - protein, 15 aa, Borrelia garinii PBi
ILINRGFSIQLAIEE

SEQ ID NO: 120626 - protein, 15 aa, Borrelia garinii PBi
LINRGFSIQLAIEEI

SEQ ID NO: 120627 - protein, 15 aa, Borrelia garinii PBi
INRGFSIQLAIEEIS

SEQ ID NO: 120628 - protein, 15 aa, Borrelia garinii PBi
NRGFSIQLAIEEISL

SEQ ID NO: 120629 - protein, 15 aa, Borrelia garinii PBi
RGFSIQLAIEEISLR

SEQ ID NO: 120630 - protein, 15 aa, Borrelia garinii PBi
GFSIQLAIEEISLRT

SEQ ID NO: 120631 - protein, 15 aa, Borrelia garinii PBi
FSIQLAIEEISLRTL

SEQ ID NO: 120632 - protein, 15 aa, Borrelia garinii PBi
SIQLAIEEISLRTLN

SEQ ID NO: 120633 - protein, 15 aa, Borrelia garinii PBi
IQLAIEEISLRTLNV

SEQ ID NO: 120634 - protein, 15 aa, Borrelia garinii PBi
QLAIEEISLRTLNVK

SEQ ID NO: 120635 - protein, 15 aa, Borrelia garinii PBi
LAIEEISLRTLNVKD

SEQ ID NO: 120636 - protein, 15 aa, Borrelia garinii PBi
AIEEISLRTLNVKDK

SEQ ID NO: 120637 - protein, 15 aa, Borrelia garinii PBi
IEEISLRTLNVKDKI

SEQ ID NO: 120638 - protein, 15 aa, Borrelia garinii PBi
EEISLRTLNVKDKIQ

SEQ ID NO: 120639 - protein, 15 aa, Borrelia garinii PBi
EISLRTLNVKDKIQH

SEQ ID NO: 120640 - protein, 15 aa, Borrelia garinii PBi
ISLRTLNVKDKIQHL

SEQ ID NO: 120641 - protein, 15 aa, Borrelia garinii PBi
SLRTLNVKDKIQHLN

SEQ ID NO: 120642 - protein, 15 aa, Borrelia garinii PBi
LRTLNVKDKIQHLNK

SEQ ID NO: 120643 - protein, 15 aa, Borrelia garinii PBi
RTLNVKDKIQHLNKP

SEQ ID NO: 120644 - protein, 15 aa, Borrelia garinii PBi
TLNVKDKIQHLNKPN

SEQ ID NO: 120645 - protein, 15 aa, Borrelia garinii PBi
LNVKDKIQHLNKPNL

SEQ ID NO: 120646 - protein, 15 aa, Borrelia garinii PBi
NVKDKIQHLNKPNLK

SEQ ID NO: 120647 - protein, 15 aa, Borrelia garinii PBi
VKDKIQHLNKPNLKT

SEQ ID NO: 120648 - protein, 15 aa, Borrelia garinii PBi
KDKIQHLNKPNLKTL

SEQ ID NO: 120649 - protein, 15 aa, Borrelia garinii PBi
DKIQHLNKPNLKTLY

SEQ ID NO: 120650 - protein, 15 aa, Borrelia garinii PBi
KIQHLNKPNLKTLYH

SEQ ID NO: 120651 - protein, 15 aa, Borrelia garinii PBi
IQHLNKPNLKTLYHD

SEQ ID NO: 120652 - protein, 15 aa, Borrelia garinii PBi
QHLNKPNLKTLYHDF

SEQ ID NO: 120653 - protein, 15 aa, Borrelia garinii PBi
HLNKPNLKTLYHDFN

SEQ ID NO: 120654 - protein, 15 aa, Borrelia garinii PBi
LNKPNLKTLYHDFNK

SEQ ID NO: 120655 - protein, 15 aa, Borrelia garinii PBi
NKPNLKTLYHDFNKL

SEQ ID NO: 120656 - protein, 15 aa, Borrelia garinii PBi
KPNLKTLYHDFNKLI

SEQ ID NO: 120657 - protein, 15 aa, Borrelia garinii PBi
PNLKTLYHDFNKLIP

SEQ ID NO: 120658 - protein, 15 aa, Borrelia garinii PBi
NLKTLYHDFNKLIPL

SEQ ID NO: 120659 - protein, 15 aa, Borrelia garinii PBi
LKTLYHDFNKLIPLK

SEQ ID NO: 120660 - protein, 15 aa, Borrelia garinii PBi
KTLYHDFNKLIPLKE

SEQ ID NO: 120661 - protein, 15 aa, Borrelia garinii PBi
TLYHDFNKLIPLKEK

SEQ ID NO: 120662 - protein, 15 aa, Borrelia garinii PBi
LYHDFNKLIPLKEKW

SEQ ID NO: 120663 - protein, 15 aa, Borrelia garinii PBi
YHDFNKLIPLKEKWL

SEQ ID NO: 120664 - protein, 15 aa, Borrelia garinii PBi
HDFNKLIPLKEKWLK

SEQ ID NO: 120665 - protein, 15 aa, Borrelia garinii PBi
DFNKLIPLKEKWLKD

SEQ ID NO: 120666 - protein, 15 aa, Borrelia garinii PBi
FNKLIPLKEKWLKDV

SEQ ID NO: 120667 - protein, 15 aa, Borrelia garinii PBi
NKLIPLKEKWLKDVD

SEQ ID NO: 120668 - protein, 15 aa, Borrelia garinii PBi
KLIPLKEKWLKDVDD

SEQ ID NO: 120669 - protein, 15 aa, Borrelia garinii PBi
LIPLKEKWLKDVDDI

SEQ ID NO: 120670 - protein, 15 aa, Borrelia garinii PBi
IPLKEKWLKDVDDII

SEQ ID NO: 120671 - protein, 15 aa, Borrelia garinii PBi
PLKEKWLKDVDDIIK

SEQ ID NO: 120672 - protein, 15 aa, Borrelia garinii PBi
LKEKWLKDVDDIIKD

SEQ ID NO: 120673 - protein, 15 aa, Borrelia garinii PBi
KEKWLKDVDDIIKDY

SEQ ID NO: 120674 - protein, 15 aa, Borrelia garinii PBi
EKWLKDVDDIIKDYN

SEQ ID NO: 120675 - protein, 15 aa, Borrelia garinii PBi
KWLKDVDDIIKDYNA

SEQ ID NO: 120676 - protein, 15 aa, Borrelia garinii PBi
WLKDVDDIIKDYNAN

SEQ ID NO: 120677 - protein, 15 aa, Borrelia garinii PBi
LKDVDDIIKDYNANP

SEQ ID NO: 120678 - protein, 15 aa, Borrelia garinii PBi
KDVDDIIKDYNANPE

SEQ ID NO: 120679 - protein, 15 aa, Borrelia garinii PBi
DVDDIIKDYNANPEL

SEQ ID NO: 120680 - protein, 15 aa, Borrelia garinii PBi
VDDIIKDYNANPELR

SEQ ID NO: 120681 - protein, 15 aa, Borrelia garinii PBi
DDIIKDYNANPELRT

SEQ ID NO: 120682 - protein, 15 aa, Borrelia garinii PBi
DIIKDYNANPELRTD

SEQ ID NO: 120683 - protein, 15 aa, Borrelia garinii PBi
IIKDYNANPELRTDI

SEQ ID NO: 120684 - protein, 15 aa, Borrelia garinii PBi
IKDYNANPELRTDIS

SEQ ID NO: 120685 - protein, 15 aa, Borrelia garinii PBi
KDYNANPELRTDISK

SEQ ID NO: 120686 - protein, 15 aa, Borrelia garinii PBi
DYNANPELRTDISKL

SEQ ID NO: 120687 - protein, 15 aa, Borrelia garinii PBi
YNANPELRTDISKLN

SEQ ID NO: 120688 - protein, 15 aa, Borrelia garinii PBi
NANPELRTDISKLND

SEQ ID NO: 120689 - protein, 15 aa, Borrelia garinii PBi
ANPELRTDISKLNDY

SEQ ID NO: 120690 - protein, 15 aa, Borrelia garinii PBi
NPELRTDISKLNDYI

SEQ ID NO: 120691 - protein, 15 aa, Borrelia garinii PBi
PELRTDISKLNDYII

SEQ ID NO: 120692 - protein, 15 aa, Borrelia garinii PBi
ELRTDISKLNDYIIS

SEQ ID NO: 120693 - protein, 15 aa, Borrelia garinii PBi
LRTDISKLNDYIISK

SEQ ID NO: 120694 - protein, 15 aa, Borrelia garinii PBi
RTDISKLNDYIISKN

SEQ ID NO: 120695 - protein, 15 aa, Borrelia garinii PBi
TDISKLNDYIISKNS

SEQ ID NO: 120696 - protein, 15 aa, Borrelia garinii PBi
DISKLNDYIISKNSK

SEQ ID NO: 120697 - protein, 15 aa, Borrelia garinii PBi
ISKLNDYIISKNSKA

SEQ ID NO: 120698 - protein, 15 aa, Borrelia garinii PBi
SKLNDYIISKNSKAQ

SEQ ID NO: 120699 - protein, 15 aa, Borrelia garinii PBi
KLNDYIISKNSKAQF

SEQ ID NO: 120700 - protein, 15 aa, Borrelia garinii PBi
LNDYIISKNSKAQFT

SEQ ID NO: 120701 - protein, 15 aa, Borrelia garinii PBi
NDYIISKNSKAQFTD

SEQ ID NO: 120702 - protein, 15 aa, Borrelia garinii PBi
DYIISKNSKAQFTDI

SEQ ID NO: 120703 - protein, 15 aa, Borrelia garinii PBi
YIISKNSKAQFTDIH

SEQ ID NO: 120704 - protein, 15 aa, Borrelia garinii PBi
IISKNSKAQFTDIHN

SEQ ID NO: 120705 - protein, 15 aa, Borrelia garinii PBi
ISKNSKAQFTDIHNI

SEQ ID NO: 120706 - protein, 15 aa, Borrelia garinii PBi
SKNSKAQFTDIHNII

SEQ ID NO: 120707 - protein, 15 aa, Borrelia garinii PBi
KNSKAQFTDIHNIIL

SEQ ID NO: 120708 - protein, 15 aa, Borrelia garinii PBi
NSKAQFTDIHNIILN

SEQ ID NO: 120709 - protein, 15 aa, Borrelia garinii PBi
SKAQFTDIHNIILNL

SEQ ID NO: 120710 - protein, 15 aa, Borrelia garinii PBi
KAQFTDIHNIILNLI

SEQ ID NO: 120711 - protein, 15 aa, Borrelia garinii PBi
AQFTDIHNIILNLIN

SEQ ID NO: 120712 - protein, 15 aa, Borrelia garinii PBi
QFTDIHNIILNLINT

SEQ ID NO: 120713 - protein, 15 aa, Borrelia garinii PBi
FTDIHNIILNLINTT

SEQ ID NO: 120714 - protein, 15 aa, Borrelia garinii PBi
TDIHNIILNLINTTT

SEQ ID NO: 120715 - protein, 15 aa, Borrelia garinii PBi
DIHNIILNLINTTTN

SEQ ID NO: 120716 - protein, 15 aa, Borrelia garinii PBi
IHNIILNLINTTTNI

SEQ ID NO: 120717 - protein, 15 aa, Borrelia garinii PBi
HNIILNLINTTTNIL

SEQ ID NO: 120718 - protein, 15 aa, Borrelia garinii PBi
NIILNLINTTTNILA

SEQ ID NO: 120719 - protein, 15 aa, Borrelia garinii PBi
IILNLINTTTNILAP

SEQ ID NO: 120720 - protein, 15 aa, Borrelia garinii PBi
ILNLINTTTNILAPI

SEQ ID NO: 120721 - protein, 15 aa, Borrelia garinii PBi
LNLINTTTNILAPIQ

SEQ ID NO: 120722 - protein, 16 aa, Borrelia garinii PBi
MKNNKLIAIFLLHILT

SEQ ID NO: 120723 - protein, 16 aa, Borrelia garinii PBi
KNNKLIAIFLLHILTG

SEQ ID NO: 120724 - protein, 16 aa, Borrelia garinii PBi
NNKLIAIFLLHILTGL

SEQ ID NO: 120725 - protein, 16 aa, Borrelia garinii PBi
NKLIAIFLLHILTGLI

SEQ ID NO: 120726 - protein, 16 aa, Borrelia garinii PBi
KLIAIFLLHILTGLIL

SEQ ID NO: 120727 - protein, 16 aa, Borrelia garinii PBi
LIAIFLLHILTGLILL

SEQ ID NO: 120728 - protein, 16 aa, Borrelia garinii PBi
IAIFLLHILTGLILLS

SEQ ID NO: 120729 - protein, 16 aa, Borrelia garinii PBi
AIFLLHILTGLILLSC

SEQ ID NO: 120730 - protein, 16 aa, Borrelia garinii PBi
IFLLHILTGLILLSCS

SEQ ID NO: 120731 - protein, 16 aa, Borrelia garinii PBi
FLLHILTGLILLSCSL

SEQ ID NO: 120732 - protein, 16 aa, Borrelia garinii PBi
LLHILTGLILLSCSLE

SEQ ID NO: 120733 - protein, 16 aa, Borrelia garinii PBi
LHILTGLILLSCSLEV

SEQ ID NO: 120734 - protein, 16 aa, Borrelia garinii PBi
HILTGLILLSCSLEVN

SEQ ID NO: 120735 - protein, 16 aa, Borrelia garinii PBi
ILTGLILLSCSLEVNQ

SEQ ID NO: 120736 - protein, 16 aa, Borrelia garinii PBi
LTGLILLSCSLEVNQD

SEQ ID NO: 120737 - protein, 16 aa, Borrelia garinii PBi
TGLILLSCSLEVNQDD

SEQ ID NO: 120738 - protein, 16 aa, Borrelia garinii PBi
GLILLSCSLEVNQDDN

SEQ ID NO: 120739 - protein, 16 aa, Borrelia garinii PBi
LILLSCSLEVNQDDNQ

SEQ ID NO: 120740 - protein, 16 aa, Borrelia garinii PBi
ILLSCSLEVNQDDNQE

SEQ ID NO: 120741 - protein, 16 aa, Borrelia garinii PBi
LLSCSLEVNQDDNQEK

SEQ ID NO: 120742 - protein, 16 aa, Borrelia garinii PBi
LSCSLEVNQDDNQEKQ

SEQ ID NO: 120743 - protein, 16 aa, Borrelia garinii PBi
SCSLEVNQDDNQEKQK

SEQ ID NO: 120744 - protein, 16 aa, Borrelia garinii PBi
CSLEVNQDDNQEKQKK

SEQ ID NO: 120745 - protein, 16 aa, Borrelia garinii PBi
SLEVNQDDNQEKQKKA

SEQ ID NO: 120746 - protein, 16 aa, Borrelia garinii PBi
LEVNQDDNQEKQKKAK

SEQ ID NO: 120747 - protein, 16 aa, Borrelia garinii PBi
EVNQDDNQEKQKKAKT

SEQ ID NO: 120748 - protein, 16 aa, Borrelia garinii PBi
VNQDDNQEKQKKAKTK

SEQ ID NO: 120749 - protein, 16 aa, Borrelia garinii PBi
NQDDNQEKQKKAKTKT

SEQ ID NO: 120750 - protein, 16 aa, Borrelia garinii PBi
QDDNQEKQKKAKTKTS

SEQ ID NO: 120751 - protein, 16 aa, Borrelia garinii PBi
DDNQEKQKKAKTKTSK

SEQ ID NO: 120752 - protein, 16 aa, Borrelia garinii PBi
DNQEKQKKAKTKTSKS

SEQ ID NO: 120753 - protein, 16 aa, Borrelia garinii PBi
NQEKQKKAKTKTSKSE

SEQ ID NO: 120754 - protein, 16 aa, Borrelia garinii PBi
QEKQKKAKTKTSKSEN

SEQ ID NO: 120755 - protein, 16 aa, Borrelia garinii PBi
EKQKKAKTKTSKSENN

SEQ ID NO: 120756 - protein, 16 aa, Borrelia garinii PBi
KQKKAKTKTSKSENNS

SEQ ID NO: 120757 - protein, 16 aa, Borrelia garinii PBi
QKKAKTKTSKSENNSS

SEQ ID NO: 120758 - protein, 16 aa, Borrelia garinii PBi
KKAKTKTSKSENNSSK

SEQ ID NO: 120759 - protein, 16 aa, Borrelia garinii PBi
KAKTKTSKSENNSSKM

SEQ ID NO: 120760 - protein, 16 aa, Borrelia garinii PBi
AKTKTSKSENNSSKMK

SEQ ID NO: 120761 - protein, 16 aa, Borrelia garinii PBi
KTKTSKSENNSSKMKK

SEQ ID NO: 120762 - protein, 16 aa, Borrelia garinii PBi
TKTSKSENNSSKMKKL

SEQ ID NO: 120763 - protein, 16 aa, Borrelia garinii PBi
KTSKSENNSSKMKKLS

SEQ ID NO: 120764 - protein, 16 aa, Borrelia garinii PBi
TSKSENNSSKMKKLSK

SEQ ID NO: 120765 - protein, 16 aa, Borrelia garinii PBi
SKSENNSSKMKKLSKN

SEQ ID NO: 120766 - protein, 16 aa, Borrelia garinii PBi
KSENNSSKMKKLSKNA

SEQ ID NO: 120767 - protein, 16 aa, Borrelia garinii PBi
SENNSSKMKKLSKNAK

SEQ ID NO: 120768 - protein, 16 aa, Borrelia garinii PBi
ENNSSKMKKLSKNAKN

SEQ ID NO: 120769 - protein, 16 aa, Borrelia garinii PBi
NNSSKMKKLSKNAKNK

SEQ ID NO: 120770 - protein, 16 aa, Borrelia garinii PBi
NSSKMKKLSKNAKNKK

SEQ ID NO: 120771 - protein, 16 aa, Borrelia garinii PBi
SSKMKKLSKNAKNKKP

SEQ ID NO: 120772 - protein, 16 aa, Borrelia garinii PBi
SKMKKLSKNAKNKKPT

SEQ ID NO: 120773 - protein, 16 aa, Borrelia garinii PBi
KMKKLSKNAKNKKPTV

SEQ ID NO: 120774 - protein, 16 aa, Borrelia garinii PBi
MKKLSKNAKNKKPTVD

SEQ ID NO: 120775 - protein, 16 aa, Borrelia garinii PBi
KKLSKNAKNKKPTVDN

SEQ ID NO: 120776 - protein, 16 aa, Borrelia garinii PBi
KLSKNAKNKKPTVDNL

SEQ ID NO: 120777 - protein, 16 aa, Borrelia garinii PBi
LSKNAKNKKPTVDNLL

SEQ ID NO: 120778 - protein, 16 aa, Borrelia garinii PBi
SKNAKNKKPTVDNLLV

SEQ ID NO: 120779 - protein, 16 aa, Borrelia garinii PBi
KNAKNKKPTVDNLLVA

SEQ ID NO: 120780 - protein, 16 aa, Borrelia garinii PBi
NAKNKKPTVDNLLVAI

SEQ ID NO: 120781 - protein, 16 aa, Borrelia garinii PBi
AKNKKPTVDNLLVAIN

SEQ ID NO: 120782 - protein, 16 aa, Borrelia garinii PBi
KNKKPTVDNLLVAINT

SEQ ID NO: 120783 - protein, 16 aa, Borrelia garinii PBi
NKKPTVDNLLVAINTL

SEQ ID NO: 120784 - protein, 16 aa, Borrelia garinii PBi
KKPTVDNLLVAINTLK

SEQ ID NO: 120785 - protein, 16 aa, Borrelia garinii PBi
KPTVDNLLVAINTLKN

SEQ ID NO: 120786 - protein, 16 aa, Borrelia garinii PBi
PTVDNLLVAINTLKNP

SEQ ID NO: 120787 - protein, 16 aa, Borrelia garinii PBi
TVDNLLVAINTLKNPP

SEQ ID NO: 120788 - protein, 16 aa, Borrelia garinii PBi
VDNLLVAINTLKNPPK

SEQ ID NO: 120789 - protein, 16 aa, Borrelia garinii PBi
DNLLVAINTLKNPPKT

SEQ ID NO: 120790 - protein, 16 aa, Borrelia garinii PBi
NLLVAINTLKNPPKTA

SEQ ID NO: 120791 - protein, 16 aa, Borrelia garinii PBi
LLVAINTLKNPPKTAG

SEQ ID NO: 120792 - protein, 16 aa, Borrelia garinii PBi
LVAINTLKNPPKTAGK

SEQ ID NO: 120793 - protein, 16 aa, Borrelia garinii PBi
VAINTLKNPPKTAGKN

SEQ ID NO: 120794 - protein, 16 aa, Borrelia garinii PBi
AINTLKNPPKTAGKNK

SEQ ID NO: 120795 - protein, 16 aa, Borrelia garinii PBi
INTLKNPPKTAGKNKS

SEQ ID NO: 120796 - protein, 16 aa, Borrelia garinii PBi
NTLKNPPKTAGKNKSN

SEQ ID NO: 120797 - protein, 16 aa, Borrelia garinii PBi
TLKNPPKTAGKNKSNS

SEQ ID NO: 120798 - protein, 16 aa, Borrelia garinii PBi
LKNPPKTAGKNKSNSA

SEQ ID NO: 120799 - protein, 16 aa, Borrelia garinii PBi
KNPPKTAGKNKSNSAA

SEQ ID NO: 120800 - protein, 16 aa, Borrelia garinii PBi
NPPKTAGKNKSNSAAA

SEQ ID NO: 120801 - protein, 16 aa, Borrelia garinii PBi
PPKTAGKNKSNSAAAL

SEQ ID NO: 120802 - protein, 16 aa, Borrelia garinii PBi
PKTAGKNKSNSAAALK

SEQ ID NO: 120803 - protein, 16 aa, Borrelia garinii PBi
KTAGKNKSNSAAALKQ

SEQ ID NO: 120804 - protein, 16 aa, Borrelia garinii PBi
TAGKNKSNSAAALKQP

SEQ ID NO: 120805 - protein, 16 aa, Borrelia garinii PBi
AGKNKSNSAAALKQPN

SEQ ID NO: 120806 - protein, 16 aa, Borrelia garinii PBi
GKNKSNSAAALKQPNN

SEQ ID NO: 120807 - protein, 16 aa, Borrelia garinii PBi
KNKSNSAAALKQPNNA

SEQ ID NO: 120808 - protein, 16 aa, Borrelia garinii PBi
NKSNSAAALKQPNNAN

SEQ ID NO: 120809 - protein, 16 aa, Borrelia garinii PBi
KSNSAAALKQPNNANA

SEQ ID NO: 120810 - protein, 16 aa, Borrelia garinii PBi
SNSAAALKQPNNANAL

SEQ ID NO: 120811 - protein, 16 aa, Borrelia garinii PBi
NSAAALKQPNNANALK

SEQ ID NO: 120812 - protein, 16 aa, Borrelia garinii PBi
SAAALKQPNNANALKQ

SEQ ID NO: 120813 - protein, 16 aa, Borrelia garinii PBi
AAALKQPNNANALKQI

SEQ ID NO: 120814 - protein, 16 aa, Borrelia garinii PBi
AALKQPNNANALKQID

SEQ ID NO: 120815 - protein, 16 aa, Borrelia garinii PBi
ALKQPNNANALKQIDP

SEQ ID NO: 120816 - protein, 16 aa, Borrelia garinii PBi
LKQPNNANALKQIDPE

SEQ ID NO: 120817 - protein, 16 aa, Borrelia garinii PBi
KQPNNANALKQIDPEA

SEQ ID NO: 120818 - protein, 16 aa, Borrelia garinii PBi
QPNNANALKQIDPEAK

SEQ ID NO: 120819 - protein, 16 aa, Borrelia garinii PBi
PNNANALKQIDPEAKE

SEQ ID NO: 120820 - protein, 16 aa, Borrelia garinii PBi
NNANALKQIDPEAKEL

SEQ ID NO: 120821 - protein, 16 aa, Borrelia garinii PBi
NANALKQIDPEAKELI

SEQ ID NO: 120822 - protein, 16 aa, Borrelia garinii PBi
ANALKQIDPEAKELIQ

SEQ ID NO: 120823 - protein, 16 aa, Borrelia garinii PBi
NALKQIDPEAKELIQK

SEQ ID NO: 120824 - protein, 16 aa, Borrelia garinii PBi
ALKQIDPEAKELIQKI

SEQ ID NO: 120825 - protein, 16 aa, Borrelia garinii PBi
LKQIDPEAKELIQKIL

SEQ ID NO: 120826 - protein, 16 aa, Borrelia garinii PBi
KQIDPEAKELIQKILE

SEQ ID NO: 120827 - protein, 16 aa, Borrelia garinii PBi
QIDPEAKELIQKILER

SEQ ID NO: 120828 - protein, 16 aa, Borrelia garinii PBi
IDPEAKELIQKILERS

SEQ ID NO: 120829 - protein, 16 aa, Borrelia garinii PBi
DPEAKELIQKILERSE

SEQ ID NO: 120830 - protein, 16 aa, Borrelia garinii PBi
PEAKELIQKILERSED

SEQ ID NO: 120831 - protein, 16 aa, Borrelia garinii PBi
EAKELIQKILERSEDI

SEQ ID NO: 120832 - protein, 16 aa, Borrelia garinii PBi
AKELIQKILERSEDIV

SEQ ID NO: 120833 - protein, 16 aa, Borrelia garinii PBi
KELIQKILERSEDIVQ

SEQ ID NO: 120834 - protein, 16 aa, Borrelia garinii PBi
ELIQKILERSEDIVQI

SEQ ID NO: 120835 - protein, 16 aa, Borrelia garinii PBi
LIQKILERSEDIVQIS

SEQ ID NO: 120836 - protein, 16 aa, Borrelia garinii PBi
IQKILERSEDIVQISE

SEQ ID NO: 120837 - protein, 16 aa, Borrelia garinii PBi
QKILERSEDIVQISEI

SEQ ID NO: 120838 - protein, 16 aa, Borrelia garinii PBi
KILERSEDIVQISEID

SEQ ID NO: 120839 - protein, 16 aa, Borrelia garinii PBi
ILERSEDIVQISEIDA

SEQ ID NO: 120840 - protein, 16 aa, Borrelia garinii PBi
LERSEDIVQISEIDAN

SEQ ID NO: 120841 - protein, 16 aa, Borrelia garinii PBi
ERSEDIVQISEIDANK

SEQ ID NO: 120842 - protein, 16 aa, Borrelia garinii PBi
RSEDIVQISEIDANKG

SEQ ID NO: 120843 - protein, 16 aa, Borrelia garinii PBi
SEDIVQISEIDANKGE

SEQ ID NO: 120844 - protein, 16 aa, Borrelia garinii PBi
EDIVQISEIDANKGEP

SEQ ID NO: 120845 - protein, 16 aa, Borrelia garinii PBi
DIVQISEIDANKGEPD

SEQ ID NO: 120846 - protein, 16 aa, Borrelia garinii PBi
IVQISEIDANKGEPDD

SEQ ID NO: 120847 - protein, 16 aa, Borrelia garinii PBi
VQISEIDANKGEPDDQ

SEQ ID NO: 120848 - protein, 16 aa, Borrelia garinii PBi
QISEIDANKGEPDDQF

SEQ ID NO: 120849 - protein, 16 aa, Borrelia garinii PBi
ISEIDANKGEPDDQFE

SEQ ID NO: 120850 - protein, 16 aa, Borrelia garinii PBi
SEIDANKGEPDDQFEM

SEQ ID NO: 120851 - protein, 16 aa, Borrelia garinii PBi
EIDANKGEPDDQFEMK

SEQ ID NO: 120852 - protein, 16 aa, Borrelia garinii PBi
IDANKGEPDDQFEMKA

SEQ ID NO: 120853 - protein, 16 aa, Borrelia garinii PBi
DANKGEPDDQFEMKAE

SEQ ID NO: 120854 - protein, 16 aa, Borrelia garinii PBi
ANKGEPDDQFEMKAEI

SEQ ID NO: 120855 - protein, 16 aa, Borrelia garinii PBi
NKGEPDDQFEMKAEIF

SEQ ID NO: 120856 - protein, 16 aa, Borrelia garinii PBi
KGEPDDQFEMKAEIFS

SEQ ID NO: 120857 - protein, 16 aa, Borrelia garinii PBi
GEPDDQFEMKAEIFSK

SEQ ID NO: 120858 - protein, 16 aa, Borrelia garinii PBi
EPDDQFEMKAEIFSKI

SEQ ID NO: 120859 - protein, 16 aa, Borrelia garinii PBi
PDDQFEMKAEIFSKIF

SEQ ID NO: 120860 - protein, 16 aa, Borrelia garinii PBi
DDQFEMKAEIFSKIFF

SEQ ID NO: 120861 - protein, 16 aa, Borrelia garinii PBi
DQFEMKAEIFSKIFFN

SEQ ID NO: 120862 - protein, 16 aa, Borrelia garinii PBi
QFEMKAEIFSKIFFNA

SEQ ID NO: 120863 - protein, 16 aa, Borrelia garinii PBi
FEMKAEIFSKIFFNAG

SEQ ID NO: 120864 - protein, 16 aa, Borrelia garinii PBi
EMKAEIFSKIFFNAGS

SEQ ID NO: 120865 - protein, 16 aa, Borrelia garinii PBi
MKAEIFSKIFFNAGST

SEQ ID NO: 120866 - protein, 16 aa, Borrelia garinii PBi
KAEIFSKIFFNAGSTV

SEQ ID NO: 120867 - protein, 16 aa, Borrelia garinii PBi
AEIFSKIFFNAGSTVT

SEQ ID NO: 120868 - protein, 16 aa, Borrelia garinii PBi
EIFSKIFFNAGSTVTF

SEQ ID NO: 120869 - protein, 16 aa, Borrelia garinii PBi
IFSKIFFNAGSTVTFD

SEQ ID NO: 120870 - protein, 16 aa, Borrelia garinii PBi
FSKIFFNAGSTVTFDD

SEQ ID NO: 120871 - protein, 16 aa, Borrelia garinii PBi
SKIFFNAGSTVTFDDN

SEQ ID NO: 120872 - protein, 16 aa, Borrelia garinii PBi
KIFFNAGSTVTFDDNE

SEQ ID NO: 120873 - protein, 16 aa, Borrelia garinii PBi
IFFNAGSTVTFDDNEY

SEQ ID NO: 120874 - protein, 16 aa, Borrelia garinii PBi
FFNAGSTVTFDDNEYV

SEQ ID NO: 120875 - protein, 16 aa, Borrelia garinii PBi
FNAGSTVTFDDNEYVN

SEQ ID NO: 120876 - protein, 16 aa, Borrelia garinii PBi
NAGSTVTFDDNEYVNE

SEQ ID NO: 120877 - protein, 16 aa, Borrelia garinii PBi
AGSTVTFDDNEYVNER

SEQ ID NO: 120878 - protein, 16 aa, Borrelia garinii PBi
GSTVTFDDNEYVNERR

SEQ ID NO: 120879 - protein, 16 aa, Borrelia garinii PBi
STVTFDDNEYVNERRI

SEQ ID NO: 120880 - protein, 16 aa, Borrelia garinii PBi
TVTFDDNEYVNERRIL

SEQ ID NO: 120881 - protein, 16 aa, Borrelia garinii PBi
VTFDDNEYVNERRILY

SEQ ID NO: 120882 - protein, 16 aa, Borrelia garinii PBi
TFDDNEYVNERRILYT

SEQ ID NO: 120883 - protein, 16 aa, Borrelia garinii PBi
FDDNEYVNERRILYTS

SEQ ID NO: 120884 - protein, 16 aa, Borrelia garinii PBi
DDNEYVNERRILYTSL

SEQ ID NO: 120885 - protein, 16 aa, Borrelia garinii PBi
DNEYVNERRILYTSLN

SEQ ID NO: 120886 - protein, 16 aa, Borrelia garinii PBi
NEYVNERRILYTSLNF

SEQ ID NO: 120887 - protein, 16 aa, Borrelia garinii PBi
EYVNERRILYTSLNFN

SEQ ID NO: 120888 - protein, 16 aa, Borrelia garinii PBi
YVNERRILYTSLNFNE

SEQ ID NO: 120889 - protein, 16 aa, Borrelia garinii PBi
VNERRILYTSLNFNEN

SEQ ID NO: 120890 - protein, 16 aa, Borrelia garinii PBi
NERRILYTSLNFNENK

SEQ ID NO: 120891 - protein, 16 aa, Borrelia garinii PBi
ERRILYTSLNFNENKI

SEQ ID NO: 120892 - protein, 16 aa, Borrelia garinii PBi
RRILYTSLNFNENKIL

SEQ ID NO: 120893 - protein, 16 aa, Borrelia garinii PBi
RILYTSLNFNENKILN

SEQ ID NO: 120894 - protein, 16 aa, Borrelia garinii PBi
ILYTSLNFNENKILNL

SEQ ID NO: 120895 - protein, 16 aa, Borrelia garinii PBi
LYTSLNFNENKILNLG

SEQ ID NO: 120896 - protein, 16 aa, Borrelia garinii PBi
YTSLNFNENKILNLGK

SEQ ID NO: 120897 - protein, 16 aa, Borrelia garinii PBi
TSLNFNENKILNLGKI

SEQ ID NO: 120898 - protein, 16 aa, Borrelia garinii PBi
SLNFNENKILNLGKIL

SEQ ID NO: 120899 - protein, 16 aa, Borrelia garinii PBi
LNFNENKILNLGKILS

SEQ ID NO: 120900 - protein, 16 aa, Borrelia garinii PBi
NFNENKILNLGKILSK

SEQ ID NO: 120901 - protein, 16 aa, Borrelia garinii PBi
FNENKILNLGKILSKL

SEQ ID NO: 120902 - protein, 16 aa, Borrelia garinii PBi
NENKILNLGKILSKLS

SEQ ID NO: 120903 - protein, 16 aa, Borrelia garinii PBi
ENKILNLGKILSKLSQ

SEQ ID NO: 120904 - protein, 16 aa, Borrelia garinii PBi
NKILNLGKILSKLSQD

SEQ ID NO: 120905 - protein, 16 aa, Borrelia garinii PBi
KILNLGKILSKLSQDS

SEQ ID NO: 120906 - protein, 16 aa, Borrelia garinii PBi
ILNLGKILSKLSQDSN

SEQ ID NO: 120907 - protein, 16 aa, Borrelia garinii PBi
LNLGKILSKLSQDSNY

SEQ ID NO: 120908 - protein, 16 aa, Borrelia garinii PBi
NLGKILSKLSQDSNYR

SEQ ID NO: 120909 - protein, 16 aa, Borrelia garinii PBi
LGKILSKLSQDSNYRS

SEQ ID NO: 120910 - protein, 16 aa, Borrelia garinii PBi
GKILSKLSQDSNYRSL

SEQ ID NO: 120911 - protein, 16 aa, Borrelia garinii PBi
KILSKLSQDSNYRSLV

SEQ ID NO: 120912 - protein, 16 aa, Borrelia garinii PBi
ILSKLSQDSNYRSLVK

SEQ ID NO: 120913 - protein, 16 aa, Borrelia garinii PBi
LSKLSQDSNYRSLVKE

SEQ ID NO: 120914 - protein, 16 aa, Borrelia garinii PBi
SKLSQDSNYRSLVKEI

SEQ ID NO: 120915 - protein, 16 aa, Borrelia garinii PBi
KLSQDSNYRSLVKEIL

SEQ ID NO: 120916 - protein, 16 aa, Borrelia garinii PBi
LSQDSNYRSLVKEILI

SEQ ID NO: 120917 - protein, 16 aa, Borrelia garinii PBi
SQDSNYRSLVKEILIN

SEQ ID NO: 120918 - protein, 16 aa, Borrelia garinii PBi
QDSNYRSLVKEILINR

SEQ ID NO: 120919 - protein, 16 aa, Borrelia garinii PBi
DSNYRSLVKEILINRG

SEQ ID NO: 120920 - protein, 16 aa, Borrelia garinii PBi
SNYRSLVKEILINRGF

SEQ ID NO: 120921 - protein, 16 aa, Borrelia garinii PBi
NYRSLVKEILINRGFS

SEQ ID NO: 120922 - protein, 16 aa, Borrelia garinii PBi
YRSLVKEILINRGFSI

SEQ ID NO: 120923 - protein, 16 aa, Borrelia garinii PBi
RSLVKEILINRGFSIQ

SEQ ID NO: 120924 - protein, 16 aa, Borrelia garinii PBi
SLVKEILINRGFSIQL

SEQ ID NO: 120925 - protein, 16 aa, Borrelia garinii PBi
LVKEILINRGFSIQLA

SEQ ID NO: 120926 - protein, 16 aa, Borrelia garinii PBi
VKEILINRGFSIQLAI

SEQ ID NO: 120927 - protein, 16 aa, Borrelia garinii PBi
KEILINRGFSIQLAIE

SEQ ID NO: 120928 - protein, 16 aa, Borrelia garinii PBi
EILINRGFSIQLAIEE

SEQ ID NO: 120929 - protein, 16 aa, Borrelia garinii PBi
ILINRGFSIQLAIEEI

SEQ ID NO: 120930 - protein, 16 aa, Borrelia garinii PBi
LINRGFSIQLAIEEIS

SEQ ID NO: 120931 - protein, 16 aa, Borrelia garinii PBi
INRGFSIQLAIEEISL

SEQ ID NO: 120932 - protein, 16 aa, Borrelia garinii PBi
NRGFSIQLAIEEISLR

SEQ ID NO: 120933 - protein, 16 aa, Borrelia garinii PBi
RGFSIQLAIEEISLRT

SEQ ID NO: 120934 - protein, 16 aa, Borrelia garinii PBi
GFSIQLAIEEISLRTL

SEQ ID NO: 120935 - protein, 16 aa, Borrelia garinii PBi
FSIQLAIEEISLRTLN

SEQ ID NO: 120936 - protein, 16 aa, Borrelia garinii PBi
SIQLAIEEISLRTLNV

SEQ ID NO: 120937 - protein, 16 aa, Borrelia garinii PBi
IQLAIEEISLRTLNVK

SEQ ID NO: 120938 - protein, 16 aa, Borrelia garinii PBi
QLAIEEISLRTLNVKD

SEQ ID NO: 120939 - protein, 16 aa, Borrelia garinii PBi
LAIEEISLRTLNVKDK

SEQ ID NO: 120940 - protein, 16 aa, Borrelia garinii PBi
AIEEISLRTLNVKDKI

SEQ ID NO: 120941 - protein, 16 aa, Borrelia garinii PBi
IEEISLRTLNVKDKIQ

SEQ ID NO: 120942 - protein, 16 aa, Borrelia garinii PBi
EEISLRTLNVKDKIQH

SEQ ID NO: 120943 - protein, 16 aa, Borrelia garinii PBi
EISLRTLNVKDKIQHL

SEQ ID NO: 120944 - protein, 16 aa, Borrelia garinii PBi
ISLRTLNVKDKIQHLN

SEQ ID NO: 120945 - protein, 16 aa, Borrelia garinii PBi
SLRTLNVKDKIQHLNK

SEQ ID NO: 120946 - protein, 16 aa, Borrelia garinii PBi
LRTLNVKDKIQHLNKP

SEQ ID NO: 120947 - protein, 16 aa, Borrelia garinii PBi
RTLNVKDKIQHLNKPN

SEQ ID NO: 120948 - protein, 16 aa, Borrelia garinii PBi
TLNVKDKIQHLNKPNL

SEQ ID NO: 120949 - protein, 16 aa, Borrelia garinii PBi
LNVKDKIQHLNKPNLK

SEQ ID NO: 120950 - protein, 16 aa, Borrelia garinii PBi
NVKDKIQHLNKPNLKT

SEQ ID NO: 120951 - protein, 16 aa, Borrelia garinii PBi
VKDKIQHLNKPNLKTL

SEQ ID NO: 120952 - protein, 16 aa, Borrelia garinii PBi
KDKIQHLNKPNLKTLY

SEQ ID NO: 120953 - protein, 16 aa, Borrelia garinii PBi
DKIQHLNKPNLKTLYH

SEQ ID NO: 120954 - protein, 16 aa, Borrelia garinii PBi
KIQHLNKPNLKTLYHD

SEQ ID NO: 120955 - protein, 16 aa, Borrelia garinii PBi
IQHLNKPNLKTLYHDF

SEQ ID NO: 120956 - protein, 16 aa, Borrelia garinii PBi
QHLNKPNLKTLYHDFN

SEQ ID NO: 120957 - protein, 16 aa, Borrelia garinii PBi
HLNKPNLKTLYHDFNK

SEQ ID NO: 120958 - protein, 16 aa, Borrelia garinii PBi
LNKPNLKTLYHDFNKL

SEQ ID NO: 120959 - protein, 16 aa, Borrelia garinii PBi
NKPNLKTLYHDFNKLI

SEQ ID NO: 120960 - protein, 16 aa, Borrelia garinii PBi
KPNLKTLYHDFNKLIP

SEQ ID NO: 120961 - protein, 16 aa, Borrelia garinii PBi
PNLKTLYHDFNKLIPL

SEQ ID NO: 120962 - protein, 16 aa, Borrelia garinii PBi
NLKTLYHDFNKLIPLK

SEQ ID NO: 120963 - protein, 16 aa, Borrelia garinii PBi
LKTLYHDFNKLIPLKE

SEQ ID NO: 120964 - protein, 16 aa, Borrelia garinii PBi
KTLYHDFNKLIPLKEK

SEQ ID NO: 120965 - protein, 16 aa, Borrelia garinii PBi
TLYHDFNKLIPLKEKW

SEQ ID NO: 120966 - protein, 16 aa, Borrelia garinii PBi
LYHDFNKLIPLKEKWL

SEQ ID NO: 120967 - protein, 16 aa, Borrelia garinii PBi
YHDFNKLIPLKEKWLK

SEQ ID NO: 120968 - protein, 16 aa, Borrelia garinii PBi
HDFNKLIPLKEKWLKD

SEQ ID NO: 120969 - protein, 16 aa, Borrelia garinii PBi
DFNKLIPLKEKWLKDV

SEQ ID NO: 120970 - protein, 16 aa, Borrelia garinii PBi
FNKLIPLKEKWLKDVD

SEQ ID NO: 120971 - protein, 16 aa, Borrelia garinii PBi
NKLIPLKEKWLKDVDD

SEQ ID NO: 120972 - protein, 16 aa, Borrelia garinii PBi
KLIPLKEKWLKDVDDI

SEQ ID NO: 120973 - protein, 16 aa, Borrelia garinii PBi
LIPLKEKWLKDVDDII

SEQ ID NO: 120974 - protein, 16 aa, Borrelia garinii PBi
IPLKEKWLKDVDDIIK

SEQ ID NO: 120975 - protein, 16 aa, Borrelia garinii PBi
PLKEKWLKDVDDIIKD

SEQ ID NO: 120976 - protein, 16 aa, Borrelia garinii PBi
LKEKWLKDVDDIIKDY

SEQ ID NO: 120977 - protein, 16 aa, Borrelia garinii PBi
KEKWLKDVDDIIKDYN

SEQ ID NO: 120978 - protein, 16 aa, Borrelia garinii PBi
EKWLKDVDDIIKDYNA

SEQ ID NO: 120979 - protein, 16 aa, Borrelia garinii PBi
KWLKDVDDIIKDYNAN

SEQ ID NO: 120980 - protein, 16 aa, Borrelia garinii PBi
WLKDVDDIIKDYNANP

SEQ ID NO: 120981 - protein, 16 aa, Borrelia garinii PBi
LKDVDDIIKDYNANPE

SEQ ID NO: 120982 - protein, 16 aa, Borrelia garinii PBi
KDVDDIIKDYNANPEL

SEQ ID NO: 120983 - protein, 16 aa, Borrelia garinii PBi
DVDDIIKDYNANPELR

SEQ ID NO: 120984 - protein, 16 aa, Borrelia garinii PBi
VDDIIKDYNANPELRT

SEQ ID NO: 120985 - protein, 16 aa, Borrelia garinii PBi
DDIIKDYNANPELRTD

SEQ ID NO: 120986 - protein, 16 aa, Borrelia garinii PBi
DIIKDYNANPELRTDI

SEQ ID NO: 120987 - protein, 16 aa, Borrelia garinii PBi
IIKDYNANPELRTDIS

SEQ ID NO: 120988 - protein, 16 aa, Borrelia garinii PBi
IKDYNANPELRTDISK

SEQ ID NO: 120989 - protein, 16 aa, Borrelia garinii PBi
KDYNANPELRTDISKL

SEQ ID NO: 120990 - protein, 16 aa, Borrelia garinii PBi
DYNANPELRTDISKLN

SEQ ID NO: 120991 - protein, 16 aa, Borrelia garinii PBi
YNANPELRTDISKLND

SEQ ID NO: 120992 - protein, 16 aa, Borrelia garinii PBi
NANPELRTDISKLNDY

SEQ ID NO: 120993 - protein, 16 aa, Borrelia garinii PBi
ANPELRTDISKLNDYI

SEQ ID NO: 120994 - protein, 16 aa, Borrelia garinii PBi
NPELRTDISKLNDYII

SEQ ID NO: 120995 - protein, 16 aa, Borrelia garinii PBi
PELRTDISKLNDYIIS

SEQ ID NO: 120996 - protein, 16 aa, Borrelia garinii PBi
ELRTDISKLNDYIISK

SEQ ID NO: 120997 - protein, 16 aa, Borrelia garinii PBi
LRTDISKLNDYIISKN

SEQ ID NO: 120998 - protein, 16 aa, Borrelia garinii PBi
RTDISKLNDYIISKNS

SEQ ID NO: 120999 - protein, 16 aa, Borrelia garinii PBi
TDISKLNDYIISKNSK

SEQ ID NO: 121000 - protein, 16 aa, Borrelia garinii PBi
DISKLNDYIISKNSKA

SEQ ID NO: 121001 - protein, 16 aa, Borrelia garinii PBi
ISKLNDYIISKNSKAQ

SEQ ID NO: 121002 - protein, 16 aa, Borrelia garinii PBi
SKLNDYIISKNSKAQF

SEQ ID NO: 121003 - protein, 16 aa, Borrelia garinii PBi
KLNDYIISKNSKAQFT

SEQ ID NO: 121004 - protein, 16 aa, Borrelia garinii PBi
LNDYIISKNSKAQFTD

SEQ ID NO: 121005 - protein, 16 aa, Borrelia garinii PBi
NDYIISKNSKAQFTDI

SEQ ID NO: 121006 - protein, 16 aa, Borrelia garinii PBi
DYIISKNSKAQFTDIH

SEQ ID NO: 121007 - protein, 16 aa, Borrelia garinii PBi
YIISKNSKAQFTDIHN

SEQ ID NO: 121008 - protein, 16 aa, Borrelia garinii PBi
IISKNSKAQFTDIHNI

SEQ ID NO: 121009 - protein, 16 aa, Borrelia garinii PBi
ISKNSKAQFTDIHNII

SEQ ID NO: 121010 - protein, 16 aa, Borrelia garinii PBi
SKNSKAQFTDIHNIIL

SEQ ID NO: 121011 - protein, 16 aa, Borrelia garinii PBi
KNSKAQFTDIHNIILN

SEQ ID NO: 121012 - protein, 16 aa, Borrelia garinii PBi
NSKAQFTDIHNIILNL

SEQ ID NO: 121013 - protein, 16 aa, Borrelia garinii PBi
SKAQFTDIHNIILNLI

SEQ ID NO: 121014 - protein, 16 aa, Borrelia garinii PBi
KAQFTDIHNIILNLIN

SEQ ID NO: 121015 - protein, 16 aa, Borrelia garinii PBi
AQFTDIHNIILNLINT

SEQ ID NO: 121016 - protein, 16 aa, Borrelia garinii PBi
QFTDIHNIILNLINTT

SEQ ID NO: 121017 - protein, 16 aa, Borrelia garinii PBi
FTDIHNIILNLINTTT

SEQ ID NO: 121018 - protein, 16 aa, Borrelia garinii PBi
TDIHNIILNLINTTTN

SEQ ID NO: 121019 - protein, 16 aa, Borrelia garinii PBi
DIHNIILNLINTTTNI

SEQ ID NO: 121020 - protein, 16 aa, Borrelia garinii PBi
IHNIILNLINTTTNIL

SEQ ID NO: 121021 - protein, 16 aa, Borrelia garinii PBi
HNIILNLINTTTNILA

SEQ ID NO: 121022 - protein, 16 aa, Borrelia garinii PBi
NIILNLINTTTNILAP

SEQ ID NO: 121023 - protein, 16 aa, Borrelia garinii PBi
IILNLINTTTNILAPI

SEQ ID NO: 121024 - protein, 16 aa, Borrelia garinii PBi
ILNLINTTTNILAPIQ

SEQ ID NO: 121025 - protein, 13 aa, Borrelia burgdorferi
MKKVKSKYLALGL

SEQ ID NO: 121026 - protein, 13 aa, Borrelia burgdorferi
KKVKSKYLALGLL

SEQ ID NO: 121027 - protein, 13 aa, Borrelia burgdorferi
KVKSKYLALGLLF

SEQ ID NO: 121028 - protein, 13 aa, Borrelia burgdorferi
VKSKYLALGLLFG

SEQ ID NO: 121029 - protein, 13 aa, Borrelia burgdorferi
KSKYLALGLLFGF

SEQ ID NO: 121030 - protein, 13 aa, Borrelia burgdorferi
SKYLALGLLFGFI

SEQ ID NO: 121031 - protein, 13 aa, Borrelia burgdorferi
KYLALGLLFGFIS

SEQ ID NO: 121032 - protein, 13 aa, Borrelia burgdorferi
YLALGLLFGFISC

SEQ ID NO: 121033 - protein, 13 aa, Borrelia burgdorferi
LALGLLFGFISCD

SEQ ID NO: 121034 - protein, 13 aa, Borrelia burgdorferi
ALGLLFGFISCDL

SEQ ID NO: 121035 - protein, 13 aa, Borrelia burgdorferi
LGLLFGFISCDLF

SEQ ID NO: 121036 - protein, 13 aa, Borrelia burgdorferi
GLLFGFISCDLFI

SEQ ID NO: 121037 - protein, 13 aa, Borrelia burgdorferi
LLFGFISCDLFIR

SEQ ID NO: 121038 - protein, 13 aa, Borrelia burgdorferi
LFGFISCDLFIRY

SEQ ID NO: 121039 - protein, 13 aa, Borrelia burgdorferi
FGFISCDLFIRYE

SEQ ID NO: 121040 - protein, 13 aa, Borrelia burgdorferi
GFISCDLFIRYEM

SEQ ID NO: 121041 - protein, 13 aa, Borrelia burgdorferi
FISCDLFIRYEMK

SEQ ID NO: 121042 - protein, 13 aa, Borrelia burgdorferi
ISCDLFIRYEMKE

SEQ ID NO: 121043 - protein, 13 aa, Borrelia burgdorferi
SCDLFIRYEMKEE

SEQ ID NO: 121044 - protein, 13 aa, Borrelia burgdorferi
CDLFIRYEMKEES

SEQ ID NO: 121045 - protein, 13 aa, Borrelia burgdorferi
DLFIRYEMKEESP

SEQ ID NO: 121046 - protein, 13 aa, Borrelia burgdorferi
LFIRYEMKEESPG

SEQ ID NO: 121047 - protein, 13 aa, Borrelia burgdorferi
FIRYEMKEESPGL

SEQ ID NO: 121048 - protein, 13 aa, Borrelia burgdorferi
IRYEMKEESPGLF

SEQ ID NO: 121049 - protein, 13 aa, Borrelia burgdorferi
RYEMKEESPGLFD

SEQ ID NO: 121050 - protein, 13 aa, Borrelia burgdorferi
YEMKEESPGLFDK

SEQ ID NO: 121051 - protein, 13 aa, Borrelia burgdorferi
EMKEESPGLFDKG

SEQ ID NO: 121052 - protein, 13 aa, Borrelia burgdorferi
MKEESPGLFDKGN

SEQ ID NO: 121053 - protein, 13 aa, Borrelia burgdorferi
KEESPGLFDKGNS

SEQ ID NO: 121054 - protein, 13 aa, Borrelia burgdorferi
EESPGLFDKGNSI

SEQ ID NO: 121055 - protein, 13 aa, Borrelia burgdorferi
ESPGLFDKGNSIL

SEQ ID NO: 121056 - protein, 13 aa, Borrelia burgdorferi
SPGLFDKGNSILE

SEQ ID NO: 121057 - protein, 13 aa, Borrelia burgdorferi
PGLFDKGNSILET

SEQ ID NO: 121058 - protein, 13 aa, Borrelia burgdorferi
GLFDKGNSILETS

SEQ ID NO: 121059 - protein, 13 aa, Borrelia burgdorferi
LFDKGNSILETSE

SEQ ID NO: 121060 - protein, 13 aa, Borrelia burgdorferi
FDKGNSILETSEE

SEQ ID NO: 121061 - protein, 13 aa, Borrelia burgdorferi
DKGNSILETSEES

SEQ ID NO: 121062 - protein, 13 aa, Borrelia burgdorferi
KGNSILETSEESI

SEQ ID NO: 121063 - protein, 13 aa, Borrelia burgdorferi
GNSILETSEESIK

SEQ ID NO: 121064 - protein, 13 aa, Borrelia burgdorferi
NSILETSEESIKK

SEQ ID NO: 121065 - protein, 13 aa, Borrelia burgdorferi
SILETSEESIKKP

SEQ ID NO: 121066 - protein, 13 aa, Borrelia burgdorferi
ILETSEESIKKPM

SEQ ID NO: 121067 - protein, 13 aa, Borrelia burgdorferi
LETSEESIKKPMN

SEQ ID NO: 121068 - protein, 13 aa, Borrelia burgdorferi
ETSEESIKKPMNK

SEQ ID NO: 121069 - protein, 13 aa, Borrelia burgdorferi
TSEESIKKPMNKK

SEQ ID NO: 121070 - protein, 13 aa, Borrelia burgdorferi
SEESIKKPMNKKG

SEQ ID NO: 121071 - protein, 13 aa, Borrelia burgdorferi
EESIKKPMNKKGK

SEQ ID NO: 121072 - protein, 13 aa, Borrelia burgdorferi
ESIKKPMNKKGKG

SEQ ID NO: 121073 - protein, 13 aa, Borrelia burgdorferi
SIKKPMNKKGKGK

SEQ ID NO: 121074 - protein, 13 aa, Borrelia burgdorferi
IKKPMNKKGKGKI

SEQ ID NO: 121075 - protein, 13 aa, Borrelia burgdorferi
KKPMNKKGKGKIA

SEQ ID NO: 121076 - protein, 13 aa, Borrelia burgdorferi
KPMNKKGKGKIAR

SEQ ID NO: 121077 - protein, 13 aa, Borrelia burgdorferi
PMNKKGKGKIARK

SEQ ID NO: 121078 - protein, 13 aa, Borrelia burgdorferi
MNKKGKGKIARKK

SEQ ID NO: 121079 - protein, 13 aa, Borrelia burgdorferi
NKKGKGKIARKKG

SEQ ID NO: 121080 - protein, 13 aa, Borrelia burgdorferi
KKGKGKIARKKGK

SEQ ID NO: 121081 - protein, 13 aa, Borrelia burgdorferi
KGKGKIARKKGKS

SEQ ID NO: 121082 - protein, 13 aa, Borrelia burgdorferi
GKGKIARKKGKSK

SEQ ID NO: 121083 - protein, 13 aa, Borrelia burgdorferi
KGKIARKKGKSKV

SEQ ID NO: 121084 - protein, 13 aa, Borrelia burgdorferi
GKIARKKGKSKVS

SEQ ID NO: 121085 - protein, 13 aa, Borrelia burgdorferi
KIARKKGKSKVSR

SEQ ID NO: 121086 - protein, 13 aa, Borrelia burgdorferi
IARKKGKSKVSRK

SEQ ID NO: 121087 - protein, 13 aa, Borrelia burgdorferi
ARKKGKSKVSRKE

SEQ ID NO: 121088 - protein, 13 aa, Borrelia burgdorferi
RKKGKSKVSRKEP

SEQ ID NO: 121089 - protein, 13 aa, Borrelia burgdorferi
KKGKSKVSRKEPY

SEQ ID NO: 121090 - protein, 13 aa, Borrelia burgdorferi
KGKSKVSRKEPYI

SEQ ID NO: 121091 - protein, 13 aa, Borrelia burgdorferi
GKSKVSRKEPYIH

SEQ ID NO: 121092 - protein, 13 aa, Borrelia burgdorferi
KSKVSRKEPYIHS

SEQ ID NO: 121093 - protein, 13 aa, Borrelia burgdorferi
SKVSRKEPYIHSL

SEQ ID NO: 121094 - protein, 13 aa, Borrelia burgdorferi
KVSRKEPYIHSLK

SEQ ID NO: 121095 - protein, 13 aa, Borrelia burgdorferi
VSRKEPYIHSLKR

SEQ ID NO: 121096 - protein, 13 aa, Borrelia burgdorferi
SRKEPYIHSLKRD

SEQ ID NO: 121097 - protein, 13 aa, Borrelia burgdorferi
RKEPYIHSLKRDS

SEQ ID NO: 121098 - protein, 13 aa, Borrelia burgdorferi
KEPYIHSLKRDSA

SEQ ID NO: 121099 - protein, 13 aa, Borrelia burgdorferi
EPYIHSLKRDSAN

SEQ ID NO: 121100 - protein, 13 aa, Borrelia burgdorferi
PYIHSLKRDSANK

SEQ ID NO: 121101 - protein, 13 aa, Borrelia burgdorferi
YIHSLKRDSANKS

SEQ ID NO: 121102 - protein, 13 aa, Borrelia burgdorferi
IHSLKRDSANKSN

SEQ ID NO: 121103 - protein, 13 aa, Borrelia burgdorferi
HSLKRDSANKSNF

SEQ ID NO: 121104 - protein, 13 aa, Borrelia burgdorferi
SLKRDSANKSNFL

SEQ ID NO: 121105 - protein, 13 aa, Borrelia burgdorferi
LKRDSANKSNFLQ

SEQ ID NO: 121106 - protein, 13 aa, Borrelia burgdorferi
KRDSANKSNFLQK

SEQ ID NO: 121107 - protein, 13 aa, Borrelia burgdorferi
RDSANKSNFLQKN

SEQ ID NO: 121108 - protein, 13 aa, Borrelia burgdorferi
DSANKSNFLQKNV

SEQ ID NO: 121109 - protein, 13 aa, Borrelia burgdorferi
SANKSNFLQKNVI

SEQ ID NO: 121110 - protein, 13 aa, Borrelia burgdorferi
ANKSNFLQKNVIL

SEQ ID NO: 121111 - protein, 13 aa, Borrelia burgdorferi
NKSNFLQKNVILE

SEQ ID NO: 121112 - protein, 13 aa, Borrelia burgdorferi
KSNFLQKNVILEE

SEQ ID NO: 121113 - protein, 13 aa, Borrelia burgdorferi
SNFLQKNVILEEE

SEQ ID NO: 121114 - protein, 13 aa, Borrelia burgdorferi
NFLQKNVILEEES

SEQ ID NO: 121115 - protein, 13 aa, Borrelia burgdorferi
FLQKNVILEEESL

SEQ ID NO: 121116 - protein, 13 aa, Borrelia burgdorferi
LQKNVILEEESLK

SEQ ID NO: 121117 - protein, 13 aa, Borrelia burgdorferi
QKNVILEEESLKT

SEQ ID NO: 121118 - protein, 13 aa, Borrelia burgdorferi
KNVILEEESLKTE

SEQ ID NO: 121119 - protein, 13 aa, Borrelia burgdorferi
NVILEEESLKTEL

SEQ ID NO: 121120 - protein, 13 aa, Borrelia burgdorferi
VILEEESLKTELL

SEQ ID NO: 121121 - protein, 13 aa, Borrelia burgdorferi
ILEEESLKTELLK

SEQ ID NO: 121122 - protein, 13 aa, Borrelia burgdorferi
LEEESLKTELLKE

SEQ ID NO: 121123 - protein, 13 aa, Borrelia burgdorferi
EEESLKTELLKEQ

SEQ ID NO: 121124 - protein, 13 aa, Borrelia burgdorferi
EESLKTELLKEQS

SEQ ID NO: 121125 - protein, 13 aa, Borrelia burgdorferi
ESLKTELLKEQSE

SEQ ID NO: 121126 - protein, 13 aa, Borrelia burgdorferi
SLKTELLKEQSET

SEQ ID NO: 121127 - protein, 13 aa, Borrelia burgdorferi
LKTELLKEQSETR

SEQ ID NO: 121128 - protein, 13 aa, Borrelia burgdorferi
KTELLKEQSETRK

SEQ ID NO: 121129 - protein, 13 aa, Borrelia burgdorferi
TELLKEQSETRKE

SEQ ID NO: 121130 - protein, 13 aa, Borrelia burgdorferi
ELLKEQSETRKEK

SEQ ID NO: 121131 - protein, 13 aa, Borrelia burgdorferi
LLKEQSETRKEKI

SEQ ID NO: 121132 - protein, 13 aa, Borrelia burgdorferi
LKEQSETRKEKIQ

SEQ ID NO: 121133 - protein, 13 aa, Borrelia burgdorferi
KEQSETRKEKIQK

SEQ ID NO: 121134 - protein, 13 aa, Borrelia burgdorferi
EQSETRKEKIQKQ

SEQ ID NO: 121135 - protein, 13 aa, Borrelia burgdorferi
QSETRKEKIQKQQ

SEQ ID NO: 121136 - protein, 13 aa, Borrelia burgdorferi
SETRKEKIQKQQD

SEQ ID NO: 121137 - protein, 13 aa, Borrelia burgdorferi
ETRKEKIQKQQDE

SEQ ID NO: 121138 - protein, 13 aa, Borrelia burgdorferi
TRKEKIQKQQDEY

SEQ ID NO: 121139 - protein, 13 aa, Borrelia burgdorferi
RKEKIQKQQDEYK

SEQ ID NO: 121140 - protein, 13 aa, Borrelia burgdorferi
KEKIQKQQDEYKG

SEQ ID NO: 121141 - protein, 13 aa, Borrelia burgdorferi
EKIQKQQDEYKGM

SEQ ID NO: 121142 - protein, 13 aa, Borrelia burgdorferi
KIQKQQDEYKGMT

SEQ ID NO: 121143 - protein, 13 aa, Borrelia burgdorferi
IQKQQDEYKGMTQ

SEQ ID NO: 121144 - protein, 13 aa, Borrelia burgdorferi
QKQQDEYKGMTQG

SEQ ID NO: 121145 - protein, 13 aa, Borrelia burgdorferi
KQQDEYKGMTQGS

SEQ ID NO: 121146 - protein, 13 aa, Borrelia burgdorferi
QQDEYKGMTQGSL

SEQ ID NO: 121147 - protein, 13 aa, Borrelia burgdorferi
QDEYKGMTQGSLN

SEQ ID NO: 121148 - protein, 13 aa, Borrelia burgdorferi
DEYKGMTQGSLNS

SEQ ID NO: 121149 - protein, 13 aa, Borrelia burgdorferi
EYKGMTQGSLNSL

SEQ ID NO: 121150 - protein, 13 aa, Borrelia burgdorferi
YKGMTQGSLNSLS

SEQ ID NO: 121151 - protein, 13 aa, Borrelia burgdorferi
KGMTQGSLNSLSG

SEQ ID NO: 121152 - protein, 13 aa, Borrelia burgdorferi
GMTQGSLNSLSGE

SEQ ID NO: 121153 - protein, 13 aa, Borrelia burgdorferi
MTQGSLNSLSGES

SEQ ID NO: 121154 - protein, 13 aa, Borrelia burgdorferi
TQGSLNSLSGESG

SEQ ID NO: 121155 - protein, 13 aa, Borrelia burgdorferi
QGSLNSLSGESGE

SEQ ID NO: 121156 - protein, 13 aa, Borrelia burgdorferi
GSLNSLSGESGEL

SEQ ID NO: 121157 - protein, 13 aa, Borrelia burgdorferi
SLNSLSGESGELK

SEQ ID NO: 121158 - protein, 13 aa, Borrelia burgdorferi
LNSLSGESGELKE

SEQ ID NO: 121159 - protein, 13 aa, Borrelia burgdorferi
NSLSGESGELKET

SEQ ID NO: 121160 - protein, 13 aa, Borrelia burgdorferi
SLSGESGELKETI

SEQ ID NO: 121161 - protein, 13 aa, Borrelia burgdorferi
LSGESGELKETIE

SEQ ID NO: 121162 - protein, 13 aa, Borrelia burgdorferi
SGESGELKETIES

SEQ ID NO: 121163 - protein, 13 aa, Borrelia burgdorferi
GESGELKETIESN

SEQ ID NO: 121164 - protein, 13 aa, Borrelia burgdorferi
ESGELKETIESNE

SEQ ID NO: 121165 - protein, 13 aa, Borrelia burgdorferi
SGELKETIESNEI

SEQ ID NO: 121166 - protein, 13 aa, Borrelia burgdorferi
GELKETIESNEID

SEQ ID NO: 121167 - protein, 13 aa, Borrelia burgdorferi
ELKETIESNEIDI

SEQ ID NO: 121168 - protein, 13 aa, Borrelia burgdorferi
LKETIESNEIDIT

SEQ ID NO: 121169 - protein, 13 aa, Borrelia burgdorferi
KETIESNEIDITI

SEQ ID NO: 121170 - protein, 13 aa, Borrelia burgdorferi
ETIESNEIDITID

SEQ ID NO: 121171 - protein, 13 aa, Borrelia burgdorferi
TIESNEIDITIDS

SEQ ID NO: 121172 - protein, 13 aa, Borrelia burgdorferi
IESNEIDITIDSD

SEQ ID NO: 121173 - protein, 13 aa, Borrelia burgdorferi
ESNEIDITIDSDL

SEQ ID NO: 121174 - protein, 13 aa, Borrelia burgdorferi
SNEIDITIDSDLR

SEQ ID NO: 121175 - protein, 13 aa, Borrelia burgdorferi
NEIDITIDSDLRP

SEQ ID NO: 121176 - protein, 13 aa, Borrelia burgdorferi
EIDITIDSDLRPK

SEQ ID NO: 121177 - protein, 13 aa, Borrelia burgdorferi
IDITIDSDLRPKS

SEQ ID NO: 121178 - protein, 13 aa, Borrelia burgdorferi
DITIDSDLRPKSS

SEQ ID NO: 121179 - protein, 13 aa, Borrelia burgdorferi
ITIDSDLRPKSSL

SEQ ID NO: 121180 - protein, 13 aa, Borrelia burgdorferi
TIDSDLRPKSSLQ

SEQ ID NO: 121181 - protein, 13 aa, Borrelia burgdorferi
IDSDLRPKSSLQD

SEQ ID NO: 121182 - protein, 13 aa, Borrelia burgdorferi
DSDLRPKSSLQDI

SEQ ID NO: 121183 - protein, 13 aa, Borrelia burgdorferi
SDLRPKSSLQDIA

SEQ ID NO: 121184 - protein, 13 aa, Borrelia burgdorferi
DLRPKSSLQDIAG

SEQ ID NO: 121185 - protein, 13 aa, Borrelia burgdorferi
LRPKSSLQDIAGS

SEQ ID NO: 121186 - protein, 13 aa, Borrelia burgdorferi
RPKSSLQDIAGSN

SEQ ID NO: 121187 - protein, 13 aa, Borrelia burgdorferi
PKSSLQDIAGSNS

SEQ ID NO: 121188 - protein, 13 aa, Borrelia burgdorferi
KSSLQDIAGSNSI

SEQ ID NO: 121189 - protein, 13 aa, Borrelia burgdorferi
SSLQDIAGSNSIS

SEQ ID NO: 121190 - protein, 13 aa, Borrelia burgdorferi
SLQDIAGSNSISY

SEQ ID NO: 121191 - protein, 13 aa, Borrelia burgdorferi
LQDIAGSNSISYT

SEQ ID NO: 121192 - protein, 13 aa, Borrelia burgdorferi
QDIAGSNSISYTD

SEQ ID NO: 121193 - protein, 13 aa, Borrelia burgdorferi
DIAGSNSISYTDE

SEQ ID NO: 121194 - protein, 13 aa, Borrelia burgdorferi
IAGSNSISYTDEI

SEQ ID NO: 121195 - protein, 13 aa, Borrelia burgdorferi
AGSNSISYTDEIE

SEQ ID NO: 121196 - protein, 13 aa, Borrelia burgdorferi
GSNSISYTDEIEE

SEQ ID NO: 121197 - protein, 13 aa, Borrelia burgdorferi
SNSISYTDEIEEE

SEQ ID NO: 121198 - protein, 13 aa, Borrelia burgdorferi
NSISYTDEIEEED

SEQ ID NO: 121199 - protein, 13 aa, Borrelia burgdorferi
SISYTDEIEEEDY

SEQ ID NO: 121200 - protein, 13 aa, Borrelia burgdorferi
ISYTDEIEEEDYA

SEQ ID NO: 121201 - protein, 13 aa, Borrelia burgdorferi
SYTDEIEEEDYAR

SEQ ID NO: 121202 - protein, 13 aa, Borrelia burgdorferi
YTDEIEEEDYARY

SEQ ID NO: 121203 - protein, 13 aa, Borrelia burgdorferi
TDEIEEEDYARYY

SEQ ID NO: 121204 - protein, 13 aa, Borrelia burgdorferi
DEIEEEDYARYYL

SEQ ID NO: 121205 - protein, 13 aa, Borrelia burgdorferi
EIEEEDYARYYLD

SEQ ID NO: 121206 - protein, 13 aa, Borrelia burgdorferi
IEEEDYARYYLDE

SEQ ID NO: 121207 - protein, 13 aa, Borrelia burgdorferi
EEEDYARYYLDED

SEQ ID NO: 121208 - protein, 13 aa, Borrelia burgdorferi
EEDYARYYLDEDD

SEQ ID NO: 121209 - protein, 13 aa, Borrelia burgdorferi
EDYARYYLDEDDE

SEQ ID NO: 121210 - protein, 13 aa, Borrelia burgdorferi
DYARYYLDEDDED

SEQ ID NO: 121211 - protein, 13 aa, Borrelia burgdorferi
YARYYLDEDDEDD

SEQ ID NO: 121212 - protein, 13 aa, Borrelia burgdorferi
ARYYLDEDDEDDE

SEQ ID NO: 121213 - protein, 13 aa, Borrelia burgdorferi
RYYLDEDDEDDEY

SEQ ID NO: 121214 - protein, 13 aa, Borrelia burgdorferi
YYLDEDDEDDEYY

SEQ ID NO: 121215 - protein, 13 aa, Borrelia burgdorferi
YLDEDDEDDEYYE

SEQ ID NO: 121216 - protein, 13 aa, Borrelia burgdorferi
LDEDDEDDEYYED

SEQ ID NO: 121217 - protein, 13 aa, Borrelia burgdorferi
DEDDEDDEYYEDD

SEQ ID NO: 121218 - protein, 13 aa, Borrelia burgdorferi
EDDEDDEYYEDDY

SEQ ID NO: 121219 - protein, 13 aa, Borrelia burgdorferi
DDEDDEYYEDDYE

SEQ ID NO: 121220 - protein, 13 aa, Borrelia burgdorferi
DEDDEYYEDDYEE

SEQ ID NO: 121221 - protein, 13 aa, Borrelia burgdorferi
EDDEYYEDDYEEI

SEQ ID NO: 121222 - protein, 13 aa, Borrelia burgdorferi
DDEYYEDDYEEIR

SEQ ID NO: 121223 - protein, 13 aa, Borrelia burgdorferi
DEYYEDDYEEIRL

SEQ ID NO: 121224 - protein, 13 aa, Borrelia burgdorferi
EYYEDDYEEIRLS

SEQ ID NO: 121225 - protein, 13 aa, Borrelia burgdorferi
YYEDDYEEIRLSN

SEQ ID NO: 121226 - protein, 13 aa, Borrelia burgdorferi
YEDDYEEIRLSNR

SEQ ID NO: 121227 - protein, 13 aa, Borrelia burgdorferi
EDDYEEIRLSNRY

SEQ ID NO: 121228 - protein, 13 aa, Borrelia burgdorferi
DDYEEIRLSNRYQ

SEQ ID NO: 121229 - protein, 13 aa, Borrelia burgdorferi
DYEEIRLSNRYQS

SEQ ID NO: 121230 - protein, 13 aa, Borrelia burgdorferi
YEEIRLSNRYQSY

SEQ ID NO: 121231 - protein, 13 aa, Borrelia burgdorferi
EEIRLSNRYQSYL

SEQ ID NO: 121232 - protein, 13 aa, Borrelia burgdorferi
EIRLSNRYQSYLE

SEQ ID NO: 121233 - protein, 13 aa, Borrelia burgdorferi
IRLSNRYQSYLEG

SEQ ID NO: 121234 - protein, 13 aa, Borrelia burgdorferi
RLSNRYQSYLEGV

SEQ ID NO: 121235 - protein, 13 aa, Borrelia burgdorferi
LSNRYQSYLEGVK

SEQ ID NO: 121236 - protein, 13 aa, Borrelia burgdorferi
SNRYQSYLEGVKY

SEQ ID NO: 121237 - protein, 13 aa, Borrelia burgdorferi
NRYQSYLEGVKYN

SEQ ID NO: 121238 - protein, 13 aa, Borrelia burgdorferi
RYQSYLEGVKYNV

SEQ ID NO: 121239 - protein, 13 aa, Borrelia burgdorferi
YQSYLEGVKYNVD

SEQ ID NO: 121240 - protein, 13 aa, Borrelia burgdorferi
QSYLEGVKYNVDS

SEQ ID NO: 121241 - protein, 13 aa, Borrelia burgdorferi
SYLEGVKYNVDSA

SEQ ID NO: 121242 - protein, 13 aa, Borrelia burgdorferi
YLEGVKYNVDSAI

SEQ ID NO: 121243 - protein, 13 aa, Borrelia burgdorferi
LEGVKYNVDSAIN

SEQ ID NO: 121244 - protein, 13 aa, Borrelia burgdorferi
EGVKYNVDSAINT

SEQ ID NO: 121245 - protein, 13 aa, Borrelia burgdorferi
GVKYNVDSAINTI

SEQ ID NO: 121246 - protein, 13 aa, Borrelia burgdorferi
VKYNVDSAINTIN

SEQ ID NO: 121247 - protein, 13 aa, Borrelia burgdorferi
KYNVDSAINTINK

SEQ ID NO: 121248 - protein, 13 aa, Borrelia burgdorferi
YNVDSAINTINKI

SEQ ID NO: 121249 - protein, 13 aa, Borrelia burgdorferi
NVDSAINTINKIY

SEQ ID NO: 121250 - protein, 13 aa, Borrelia burgdorferi
VDSAINTINKIYD

SEQ ID NO: 121251 - protein, 13 aa, Borrelia burgdorferi
DSAINTINKIYDT

SEQ ID NO: 121252 - protein, 13 aa, Borrelia burgdorferi
SAINTINKIYDTY

SEQ ID NO: 121253 - protein, 13 aa, Borrelia burgdorferi
AINTINKIYDTYT

SEQ ID NO: 121254 - protein, 13 aa, Borrelia burgdorferi
INTINKIYDTYTL

SEQ ID NO: 121255 - protein, 13 aa, Borrelia burgdorferi
NTINKIYDTYTLF

SEQ ID NO: 121256 - protein, 13 aa, Borrelia burgdorferi
TINKIYDTYTLFS

SEQ ID NO: 121257 - protein, 13 aa, Borrelia burgdorferi
INKIYDTYTLFST

SEQ ID NO: 121258 - protein, 13 aa, Borrelia burgdorferi
NKIYDTYTLFSTK

SEQ ID NO: 121259 - protein, 13 aa, Borrelia burgdorferi
KIYDTYTLFSTKL

SEQ ID NO: 121260 - protein, 13 aa, Borrelia burgdorferi
IYDTYTLFSTKLT

SEQ ID NO: 121261 - protein, 13 aa, Borrelia burgdorferi
YDTYTLFSTKLTQ

SEQ ID NO: 121262 - protein, 13 aa, Borrelia burgdorferi
DTYTLFSTKLTQM

SEQ ID NO: 121263 - protein, 13 aa, Borrelia burgdorferi
TYTLFSTKLTQMY

SEQ ID NO: 121264 - protein, 13 aa, Borrelia burgdorferi
YTLFSTKLTQMYS

SEQ ID NO: 121265 - protein, 13 aa, Borrelia burgdorferi
TLFSTKLTQMYST

SEQ ID NO: 121266 - protein, 13 aa, Borrelia burgdorferi
LFSTKLTQMYSTR

SEQ ID NO: 121267 - protein, 13 aa, Borrelia burgdorferi
FSTKLTQMYSTRL

SEQ ID NO: 121268 - protein, 13 aa, Borrelia burgdorferi
STKLTQMYSTRLD

SEQ ID NO: 121269 - protein, 13 aa, Borrelia burgdorferi
TKLTQMYSTRLDN

SEQ ID NO: 121270 - protein, 13 aa, Borrelia burgdorferi
KLTQMYSTRLDNL

SEQ ID NO: 121271 - protein, 13 aa, Borrelia burgdorferi
LTQMYSTRLDNLA

SEQ ID NO: 121272 - protein, 13 aa, Borrelia burgdorferi
TQMYSTRLDNLAK

SEQ ID NO: 121273 - protein, 13 aa, Borrelia burgdorferi
QMYSTRLDNLAKA

SEQ ID NO: 121274 - protein, 13 aa, Borrelia burgdorferi
MYSTRLDNLAKAK

SEQ ID NO: 121275 - protein, 13 aa, Borrelia burgdorferi
YSTRLDNLAKAKA

SEQ ID NO: 121276 - protein, 13 aa, Borrelia burgdorferi
STRLDNLAKAKAK

SEQ ID NO: 121277 - protein, 13 aa, Borrelia burgdorferi
TRLDNLAKAKAKE

SEQ ID NO: 121278 - protein, 13 aa, Borrelia burgdorferi
RLDNLAKAKAKEE

SEQ ID NO: 121279 - protein, 13 aa, Borrelia burgdorferi
LDNLAKAKAKEEA

SEQ ID NO: 121280 - protein, 13 aa, Borrelia burgdorferi
DNLAKAKAKEEAA

SEQ ID NO: 121281 - protein, 13 aa, Borrelia burgdorferi
NLAKAKAKEEAAK

SEQ ID NO: 121282 - protein, 13 aa, Borrelia burgdorferi
LAKAKAKEEAAKF

SEQ ID NO: 121283 - protein, 13 aa, Borrelia burgdorferi
AKAKAKEEAAKFT

SEQ ID NO: 121284 - protein, 13 aa, Borrelia burgdorferi
KAKAKEEAAKFTK

SEQ ID NO: 121285 - protein, 13 aa, Borrelia burgdorferi
AKAKEEAAKFTKE

SEQ ID NO: 121286 - protein, 13 aa, Borrelia burgdorferi
KAKEEAAKFTKED

SEQ ID NO: 121287 - protein, 13 aa, Borrelia burgdorferi
AKEEAAKFTKEDL

SEQ ID NO: 121288 - protein, 13 aa, Borrelia burgdorferi
KEEAAKFTKEDLE

SEQ ID NO: 121289 - protein, 13 aa, Borrelia burgdorferi
EEAAKFTKEDLEK

SEQ ID NO: 121290 - protein, 13 aa, Borrelia burgdorferi
EAAKFTKEDLEKN

SEQ ID NO: 121291 - protein, 13 aa, Borrelia burgdorferi
AAKFTKEDLEKNF

SEQ ID NO: 121292 - protein, 13 aa, Borrelia burgdorferi
AKFTKEDLEKNFK

SEQ ID NO: 121293 - protein, 13 aa, Borrelia burgdorferi
KFTKEDLEKNFKT

SEQ ID NO: 121294 - protein, 13 aa, Borrelia burgdorferi
FTKEDLEKNFKTL

SEQ ID NO: 121295 - protein, 13 aa, Borrelia burgdorferi
TKEDLEKNFKTLL

SEQ ID NO: 121296 - protein, 13 aa, Borrelia burgdorferi
KEDLEKNFKTLLN

SEQ ID NO: 121297 - protein, 13 aa, Borrelia burgdorferi
EDLEKNFKTLLNY

SEQ ID NO: 121298 - protein, 13 aa, Borrelia burgdorferi
DLEKNFKTLLNYI

SEQ ID NO: 121299 - protein, 13 aa, Borrelia burgdorferi
LEKNFKTLLNYIQ

SEQ ID NO: 121300 - protein, 13 aa, Borrelia burgdorferi
EKNFKTLLNYIQV

SEQ ID NO: 121301 - protein, 13 aa, Borrelia burgdorferi
KNFKTLLNYIQVS

SEQ ID NO: 121302 - protein, 13 aa, Borrelia burgdorferi
NFKTLLNYIQVSV

SEQ ID NO: 121303 - protein, 13 aa, Borrelia burgdorferi
FKTLLNYIQVSVK

SEQ ID NO: 121304 - protein, 13 aa, Borrelia burgdorferi
KTLLNYIQVSVKT

SEQ ID NO: 121305 - protein, 13 aa, Borrelia burgdorferi
TLLNYIQVSVKTA

SEQ ID NO: 121306 - protein, 13 aa, Borrelia burgdorferi
LLNYIQVSVKTAA

SEQ ID NO: 121307 - protein, 13 aa, Borrelia burgdorferi
LNYIQVSVKTAAN

SEQ ID NO: 121308 - protein, 13 aa, Borrelia burgdorferi
NYIQVSVKTAANF

SEQ ID NO: 121309 - protein, 13 aa, Borrelia burgdorferi
YIQVSVKTAANFV

SEQ ID NO: 121310 - protein, 13 aa, Borrelia burgdorferi
IQVSVKTAANFVY

SEQ ID NO: 121311 - protein, 13 aa, Borrelia burgdorferi
QVSVKTAANFVYI

SEQ ID NO: 121312 - protein, 13 aa, Borrelia burgdorferi
VSVKTAANFVYIN

SEQ ID NO: 121313 - protein, 13 aa, Borrelia burgdorferi
SVKTAANFVYIND

SEQ ID NO: 121314 - protein, 13 aa, Borrelia burgdorferi
VKTAANFVYINDT

SEQ ID NO: 121315 - protein, 13 aa, Borrelia burgdorferi
KTAANFVYINDTH

SEQ ID NO: 121316 - protein, 13 aa, Borrelia burgdorferi
TAANFVYINDTHA

SEQ ID NO: 121317 - protein, 13 aa, Borrelia burgdorferi
AANFVYINDTHAK

SEQ ID NO: 121318 - protein, 13 aa, Borrelia burgdorferi
ANFVYINDTHAKR

SEQ ID NO: 121319 - protein, 13 aa, Borrelia burgdorferi
NFVYINDTHAKRK

SEQ ID NO: 121320 - protein, 13 aa, Borrelia burgdorferi
FVYINDTHAKRKL

SEQ ID NO: 121321 - protein, 13 aa, Borrelia burgdorferi
VYINDTHAKRKLE

SEQ ID NO: 121322 - protein, 13 aa, Borrelia burgdorferi
YINDTHAKRKLEN

SEQ ID NO: 121323 - protein, 13 aa, Borrelia burgdorferi
INDTHAKRKLENI

SEQ ID NO: 121324 - protein, 13 aa, Borrelia burgdorferi
NDTHAKRKLENIE

SEQ ID NO: 121325 - protein, 13 aa, Borrelia burgdorferi
DTHAKRKLENIEA

SEQ ID NO: 121326 - protein, 13 aa, Borrelia burgdorferi
THAKRKLENIEAE

SEQ ID NO: 121327 - protein, 13 aa, Borrelia burgdorferi
HAKRKLENIEAEI

SEQ ID NO: 121328 - protein, 13 aa, Borrelia burgdorferi
AKRKLENIEAEIK

SEQ ID NO: 121329 - protein, 13 aa, Borrelia burgdorferi
KRKLENIEAEIKT

SEQ ID NO: 121330 - protein, 13 aa, Borrelia burgdorferi
RKLENIEAEIKTL

SEQ ID NO: 121331 - protein, 13 aa, Borrelia burgdorferi
KLENIEAEIKTLI

SEQ ID NO: 121332 - protein, 13 aa, Borrelia burgdorferi
LENIEAEIKTLIA

SEQ ID NO: 121333 - protein, 13 aa, Borrelia burgdorferi
ENIEAEIKTLIAK

SEQ ID NO: 121334 - protein, 13 aa, Borrelia burgdorferi
NIEAEIKTLIAKI

SEQ ID NO: 121335 - protein, 13 aa, Borrelia burgdorferi
IEAEIKTLIAKIK

SEQ ID NO: 121336 - protein, 13 aa, Borrelia burgdorferi
EAEIKTLIAKIKE

SEQ ID NO: 121337 - protein, 13 aa, Borrelia burgdorferi
AEIKTLIAKIKEQ

SEQ ID NO: 121338 - protein, 13 aa, Borrelia burgdorferi
EIKTLIAKIKEQS

SEQ ID NO: 121339 - protein, 13 aa, Borrelia burgdorferi
IKTLIAKIKEQSN

SEQ ID NO: 121340 - protein, 13 aa, Borrelia burgdorferi
KTLIAKIKEQSNL

SEQ ID NO: 121341 - protein, 13 aa, Borrelia burgdorferi
TLIAKIKEQSNLY

SEQ ID NO: 121342 - protein, 13 aa, Borrelia burgdorferi
LIAKIKEQSNLYE

SEQ ID NO: 121343 - protein, 13 aa, Borrelia burgdorferi
IAKIKEQSNLYEA

SEQ ID NO: 121344 - protein, 13 aa, Borrelia burgdorferi
AKIKEQSNLYEAY

SEQ ID NO: 121345 - protein, 13 aa, Borrelia burgdorferi
KIKEQSNLYEAYK

SEQ ID NO: 121346 - protein, 13 aa, Borrelia burgdorferi
IKEQSNLYEAYKA

SEQ ID NO: 121347 - protein, 13 aa, Borrelia burgdorferi
KEQSNLYEAYKAI

SEQ ID NO: 121348 - protein, 13 aa, Borrelia burgdorferi
EQSNLYEAYKAIV

SEQ ID NO: 121349 - protein, 13 aa, Borrelia burgdorferi
QSNLYEAYKAIVT

SEQ ID NO: 121350 - protein, 13 aa, Borrelia burgdorferi
SNLYEAYKAIVTS

SEQ ID NO: 121351 - protein, 13 aa, Borrelia burgdorferi
NLYEAYKAIVTSI

SEQ ID NO: 121352 - protein, 13 aa, Borrelia burgdorferi
LYEAYKAIVTSIL

SEQ ID NO: 121353 - protein, 13 aa, Borrelia burgdorferi
YEAYKAIVTSILL

SEQ ID NO: 121354 - protein, 13 aa, Borrelia burgdorferi
EAYKAIVTSILLM

SEQ ID NO: 121355 - protein, 13 aa, Borrelia burgdorferi
AYKAIVTSILLMR

SEQ ID NO: 121356 - protein, 13 aa, Borrelia burgdorferi
YKAIVTSILLMRD

SEQ ID NO: 121357 - protein, 13 aa, Borrelia burgdorferi
KAIVTSILLMRDS

SEQ ID NO: 121358 - protein, 13 aa, Borrelia burgdorferi
AIVTSILLMRDSL

SEQ ID NO: 121359 - protein, 13 aa, Borrelia burgdorferi
IVTSILLMRDSLK

SEQ ID NO: 121360 - protein, 13 aa, Borrelia burgdorferi
VTSILLMRDSLKE

SEQ ID NO: 121361 - protein, 13 aa, Borrelia burgdorferi
TSILLMRDSLKEV

SEQ ID NO: 121362 - protein, 13 aa, Borrelia burgdorferi
SILLMRDSLKEVQ

SEQ ID NO: 121363 - protein, 13 aa, Borrelia burgdorferi
ILLMRDSLKEVQG

SEQ ID NO: 121364 - protein, 13 aa, Borrelia burgdorferi
LLMRDSLKEVQGI

SEQ ID NO: 121365 - protein, 13 aa, Borrelia burgdorferi
LMRDSLKEVQGII

SEQ ID NO: 121366 - protein, 13 aa, Borrelia burgdorferi
MRDSLKEVQGIID

SEQ ID NO: 121367 - protein, 13 aa, Borrelia burgdorferi
RDSLKEVQGIIDK

SEQ ID NO: 121368 - protein, 13 aa, Borrelia burgdorferi
DSLKEVQGIIDKN

SEQ ID NO: 121369 - protein, 13 aa, Borrelia burgdorferi
SLKEVQGIIDKNG

SEQ ID NO: 121370 - protein, 13 aa, Borrelia burgdorferi
LKEVQGIIDKNGV

SEQ ID NO: 121371 - protein, 13 aa, Borrelia burgdorferi
KEVQGIIDKNGVW

SEQ ID NO: 121372 - protein, 13 aa, Borrelia burgdorferi
EVQGIIDKNGVWY

SEQ ID NO: 121373 - protein, 14 aa, Borrelia burgdorferi
MKKVKSKYLALGLL

SEQ ID NO: 121374 - protein, 14 aa, Borrelia burgdorferi
KKVKSKYLALGLLF

SEQ ID NO: 121375 - protein, 14 aa, Borrelia burgdorferi
KVKSKYLALGLLFG

SEQ ID NO: 121376 - protein, 14 aa, Borrelia burgdorferi
VKSKYLALGLLFGF

SEQ ID NO: 121377 - protein, 14 aa, Borrelia burgdorferi
KSKYLALGLLFGFI

SEQ ID NO: 121378 - protein, 14 aa, Borrelia burgdorferi
SKYLALGLLFGFIS

SEQ ID NO: 121379 - protein, 14 aa, Borrelia burgdorferi
KYLALGLLFGFISC

SEQ ID NO: 121380 - protein, 14 aa, Borrelia burgdorferi
YLALGLLFGFISCD

SEQ ID NO: 121381 - protein, 14 aa, Borrelia burgdorferi
LALGLLFGFISCDL

SEQ ID NO: 121382 - protein, 14 aa, Borrelia burgdorferi
ALGLLFGFISCDLF

SEQ ID NO: 121383 - protein, 14 aa, Borrelia burgdorferi
LGLLFGFISCDLFI

SEQ ID NO: 121384 - protein, 14 aa, Borrelia burgdorferi
GLLFGFISCDLFIR

SEQ ID NO: 121385 - protein, 14 aa, Borrelia burgdorferi
LLFGFISCDLFIRY

SEQ ID NO: 121386 - protein, 14 aa, Borrelia burgdorferi
LFGFISCDLFIRYE

SEQ ID NO: 121387 - protein, 14 aa, Borrelia burgdorferi
FGFISCDLFIRYEM

SEQ ID NO: 121388 - protein, 14 aa, Borrelia burgdorferi
GFISCDLFIRYEMK

SEQ ID NO: 121389 - protein, 14 aa, Borrelia burgdorferi
FISCDLFIRYEMKE

SEQ ID NO: 121390 - protein, 14 aa, Borrelia burgdorferi
ISCDLFIRYEMKEE

SEQ ID NO: 121391 - protein, 14 aa, Borrelia burgdorferi
SCDLFIRYEMKEES

SEQ ID NO: 121392 - protein, 14 aa, Borrelia burgdorferi
CDLFIRYEMKEESP

SEQ ID NO: 121393 - protein, 14 aa, Borrelia burgdorferi
DLFIRYEMKEESPG

SEQ ID NO: 121394 - protein, 14 aa, Borrelia burgdorferi
LFIRYEMKEESPGL

SEQ ID NO: 121395 - protein, 14 aa, Borrelia burgdorferi
FIRYEMKEESPGLF

SEQ ID NO: 121396 - protein, 14 aa, Borrelia burgdorferi
IRYEMKEESPGLFD

SEQ ID NO: 121397 - protein, 14 aa, Borrelia burgdorferi
RYEMKEESPGLFDK

SEQ ID NO: 121398 - protein, 14 aa, Borrelia burgdorferi
YEMKEESPGLFDKG

SEQ ID NO: 121399 - protein, 14 aa, Borrelia burgdorferi
EMKEESPGLFDKGN

SEQ ID NO: 121400 - protein, 14 aa, Borrelia burgdorferi
MKEESPGLFDKGNS

SEQ ID NO: 121401 - protein, 14 aa, Borrelia burgdorferi
KEESPGLFDKGNSI

SEQ ID NO: 121402 - protein, 14 aa, Borrelia burgdorferi
EESPGLFDKGNSIL

SEQ ID NO: 121403 - protein, 14 aa, Borrelia burgdorferi
ESPGLFDKGNSILE

SEQ ID NO: 121404 - protein, 14 aa, Borrelia burgdorferi
SPGLFDKGNSILET

SEQ ID NO: 121405 - protein, 14 aa, Borrelia burgdorferi
PGLFDKGNSILETS

SEQ ID NO: 121406 - protein, 14 aa, Borrelia burgdorferi
GLFDKGNSILETSE

SEQ ID NO: 121407 - protein, 14 aa, Borrelia burgdorferi
LFDKGNSILETSEE

SEQ ID NO: 121408 - protein, 14 aa, Borrelia burgdorferi
FDKGNSILETSEES

SEQ ID NO: 121409 - protein, 14 aa, Borrelia burgdorferi
DKGNSILETSEESI

SEQ ID NO: 121410 - protein, 14 aa, Borrelia burgdorferi
KGNSILETSEESIK

SEQ ID NO: 121411 - protein, 14 aa, Borrelia burgdorferi
GNSILETSEESIKK

SEQ ID NO: 121412 - protein, 14 aa, Borrelia burgdorferi
NSILETSEESIKKP

SEQ ID NO: 121413 - protein, 14 aa, Borrelia burgdorferi
SILETSEESIKKPM

SEQ ID NO: 121414 - protein, 14 aa, Borrelia burgdorferi
ILETSEESIKKPMN

SEQ ID NO: 121415 - protein, 14 aa, Borrelia burgdorferi
LETSEESIKKPMNK

SEQ ID NO: 121416 - protein, 14 aa, Borrelia burgdorferi
ETSEESIKKPMNKK

SEQ ID NO: 121417 - protein, 14 aa, Borrelia burgdorferi
TSEESIKKPMNKKG

SEQ ID NO: 121418 - protein, 14 aa, Borrelia burgdorferi
SEESIKKPMNKKGK

SEQ ID NO: 121419 - protein, 14 aa, Borrelia burgdorferi
EESIKKPMNKKGKG

SEQ ID NO: 121420 - protein, 14 aa, Borrelia burgdorferi
ESIKKPMNKKGKGK

SEQ ID NO: 121421 - protein, 14 aa, Borrelia burgdorferi
SIKKPMNKKGKGKI

SEQ ID NO: 121422 - protein, 14 aa, Borrelia burgdorferi
IKKPMNKKGKGKIA

SEQ ID NO: 121423 - protein, 14 aa, Borrelia burgdorferi
KKPMNKKGKGKIAR

SEQ ID NO: 121424 - protein, 14 aa, Borrelia burgdorferi
KPMNKKGKGKIARK

SEQ ID NO: 121425 - protein, 14 aa, Borrelia burgdorferi
PMNKKGKGKIARKK

SEQ ID NO: 121426 - protein, 14 aa, Borrelia burgdorferi
MNKKGKGKIARKKG

SEQ ID NO: 121427 - protein, 14 aa, Borrelia burgdorferi
NKKGKGKIARKKGK

SEQ ID NO: 121428 - protein, 14 aa, Borrelia burgdorferi
KKGKGKIARKKGKS

SEQ ID NO: 121429 - protein, 14 aa, Borrelia burgdorferi
KGKGKIARKKGKSK

SEQ ID NO: 121430 - protein, 14 aa, Borrelia burgdorferi
GKGKIARKKGKSKV

SEQ ID NO: 121431 - protein, 14 aa, Borrelia burgdorferi
KGKIARKKGKSKVS

SEQ ID NO: 121432 - protein, 14 aa, Borrelia burgdorferi
GKIARKKGKSKVSR

SEQ ID NO: 121433 - protein, 14 aa, Borrelia burgdorferi
KIARKKGKSKVSRK

SEQ ID NO: 121434 - protein, 14 aa, Borrelia burgdorferi
IARKKGKSKVSRKE

SEQ ID NO: 121435 - protein, 14 aa, Borrelia burgdorferi
ARKKGKSKVSRKEP

SEQ ID NO: 121436 - protein, 14 aa, Borrelia burgdorferi
RKKGKSKVSRKEPY

SEQ ID NO: 121437 - protein, 14 aa, Borrelia burgdorferi
KKGKSKVSRKEPYI

SEQ ID NO: 121438 - protein, 14 aa, Borrelia burgdorferi
KGKSKVSRKEPYIH

SEQ ID NO: 121439 - protein, 14 aa, Borrelia burgdorferi
GKSKVSRKEPYIHS

SEQ ID NO: 121440 - protein, 14 aa, Borrelia burgdorferi
KSKVSRKEPYIHSL

SEQ ID NO: 121441 - protein, 14 aa, Borrelia burgdorferi
SKVSRKEPYIHSLK

SEQ ID NO: 121442 - protein, 14 aa, Borrelia burgdorferi
KVSRKEPYIHSLKR

SEQ ID NO: 121443 - protein, 14 aa, Borrelia burgdorferi
VSRKEPYIHSLKRD

SEQ ID NO: 121444 - protein, 14 aa, Borrelia burgdorferi
SRKEPYIHSLKRDS

SEQ ID NO: 121445 - protein, 14 aa, Borrelia burgdorferi
RKEPYIHSLKRDSA

SEQ ID NO: 121446 - protein, 14 aa, Borrelia burgdorferi
KEPYIHSLKRDSAN

SEQ ID NO: 121447 - protein, 14 aa, Borrelia burgdorferi
EPYIHSLKRDSANK

SEQ ID NO: 121448 - protein, 14 aa, Borrelia burgdorferi
PYIHSLKRDSANKS

SEQ ID NO: 121449 - protein, 14 aa, Borrelia burgdorferi
YIHSLKRDSANKSN

SEQ ID NO: 121450 - protein, 14 aa, Borrelia burgdorferi
IHSLKRDSANKSNF

SEQ ID NO: 121451 - protein, 14 aa, Borrelia burgdorferi
HSLKRDSANKSNFL

SEQ ID NO: 121452 - protein, 14 aa, Borrelia burgdorferi
SLKRDSANKSNFLQ

SEQ ID NO: 121453 - protein, 14 aa, Borrelia burgdorferi
LKRDSANKSNFLQK

SEQ ID NO: 121454 - protein, 14 aa, Borrelia burgdorferi
KRDSANKSNFLQKN

SEQ ID NO: 121455 - protein, 14 aa, Borrelia burgdorferi
RDSANKSNFLQKNV

SEQ ID NO: 121456 - protein, 14 aa, Borrelia burgdorferi
DSANKSNFLQKNVI

SEQ ID NO: 121457 - protein, 14 aa, Borrelia burgdorferi
SANKSNFLQKNVIL

SEQ ID NO: 121458 - protein, 14 aa, Borrelia burgdorferi
ANKSNFLQKNVILE

SEQ ID NO: 121459 - protein, 14 aa, Borrelia burgdorferi
NKSNFLQKNVILEE

SEQ ID NO: 121460 - protein, 14 aa, Borrelia burgdorferi
KSNFLQKNVILEEE

SEQ ID NO: 121461 - protein, 14 aa, Borrelia burgdorferi
SNFLQKNVILEEES

SEQ ID NO: 121462 - protein, 14 aa, Borrelia burgdorferi
NFLQKNVILEEESL

SEQ ID NO: 121463 - protein, 14 aa, Borrelia burgdorferi
FLQKNVILEEESLK

SEQ ID NO: 121464 - protein, 14 aa, Borrelia burgdorferi
LQKNVILEEESLKT

SEQ ID NO: 121465 - protein, 14 aa, Borrelia burgdorferi
QKNVILEEESLKTE

SEQ ID NO: 121466 - protein, 14 aa, Borrelia burgdorferi
KNVILEEESLKTEL

SEQ ID NO: 121467 - protein, 14 aa, Borrelia burgdorferi
NVILEEESLKTELL

SEQ ID NO: 121468 - protein, 14 aa, Borrelia burgdorferi
VILEEESLKTELLK

SEQ ID NO: 121469 - protein, 14 aa, Borrelia burgdorferi
ILEEESLKTELLKE

SEQ ID NO: 121470 - protein, 14 aa, Borrelia burgdorferi
LEEESLKTELLKEQ

SEQ ID NO: 121471 - protein, 14 aa, Borrelia burgdorferi
EEESLKTELLKEQS

SEQ ID NO: 121472 - protein, 14 aa, Borrelia burgdorferi
EESLKTELLKEQSE

SEQ ID NO: 121473 - protein, 14 aa, Borrelia burgdorferi
ESLKTELLKEQSET

SEQ ID NO: 121474 - protein, 14 aa, Borrelia burgdorferi
SLKTELLKEQSETR

SEQ ID NO: 121475 - protein, 14 aa, Borrelia burgdorferi
LKTELLKEQSETRK

SEQ ID NO: 121476 - protein, 14 aa, Borrelia burgdorferi
KTELLKEQSETRKE

SEQ ID NO: 121477 - protein, 14 aa, Borrelia burgdorferi
TELLKEQSETRKEK

SEQ ID NO: 121478 - protein, 14 aa, Borrelia burgdorferi
ELLKEQSETRKEKI

SEQ ID NO: 121479 - protein, 14 aa, Borrelia burgdorferi
LLKEQSETRKEKIQ

SEQ ID NO: 121480 - protein, 14 aa, Borrelia burgdorferi
LKEQSETRKEKIQK

SEQ ID NO: 121481 - protein, 14 aa, Borrelia burgdorferi
KEQSETRKEKIQKQ

SEQ ID NO: 121482 - protein, 14 aa, Borrelia burgdorferi
EQSETRKEKIQKQQ

SEQ ID NO: 121483 - protein, 14 aa, Borrelia burgdorferi
QSETRKEKIQKQQD

SEQ ID NO: 121484 - protein, 14 aa, Borrelia burgdorferi
SETRKEKIQKQQDE

SEQ ID NO: 121485 - protein, 14 aa, Borrelia burgdorferi
ETRKEKIQKQQDEY

SEQ ID NO: 121486 - protein, 14 aa, Borrelia burgdorferi
TRKEKIQKQQDEYK

SEQ ID NO: 121487 - protein, 14 aa, Borrelia burgdorferi
RKEKIQKQQDEYKG

SEQ ID NO: 121488 - protein, 14 aa, Borrelia burgdorferi
KEKIQKQQDEYKGM

SEQ ID NO: 121489 - protein, 14 aa, Borrelia burgdorferi
EKIQKQQDEYKGMT

SEQ ID NO: 121490 - protein, 14 aa, Borrelia burgdorferi
KIQKQQDEYKGMTQ

SEQ ID NO: 121491 - protein, 14 aa, Borrelia burgdorferi
IQKQQDEYKGMTQG

SEQ ID NO: 121492 - protein, 14 aa, Borrelia burgdorferi
QKQQDEYKGMTQGS

SEQ ID NO: 121493 - protein, 14 aa, Borrelia burgdorferi
KQQDEYKGMTQGSL

SEQ ID NO: 121494 - protein, 14 aa, Borrelia burgdorferi
QQDEYKGMTQGSLN

SEQ ID NO: 121495 - protein, 14 aa, Borrelia burgdorferi
QDEYKGMTQGSLNS

SEQ ID NO: 121496 - protein, 14 aa, Borrelia burgdorferi
DEYKGMTQGSLNSL

SEQ ID NO: 121497 - protein, 14 aa, Borrelia burgdorferi
EYKGMTQGSLNSLS

SEQ ID NO: 121498 - protein, 14 aa, Borrelia burgdorferi
YKGMTQGSLNSLSG

SEQ ID NO: 121499 - protein, 14 aa, Borrelia burgdorferi
KGMTQGSLNSLSGE

SEQ ID NO: 121500 - protein, 14 aa, Borrelia burgdorferi
GMTQGSLNSLSGES

SEQ ID NO: 121501 - protein, 14 aa, Borrelia burgdorferi
MTQGSLNSLSGESG

SEQ ID NO: 121502 - protein, 14 aa, Borrelia burgdorferi
TQGSLNSLSGESGE

SEQ ID NO: 121503 - protein, 14 aa, Borrelia burgdorferi
QGSLNSLSGESGEL

SEQ ID NO: 121504 - protein, 14 aa, Borrelia burgdorferi
GSLNSLSGESGELK

SEQ ID NO: 121505 - protein, 14 aa, Borrelia burgdorferi
SLNSLSGESGELKE

SEQ ID NO: 121506 - protein, 14 aa, Borrelia burgdorferi
LNSLSGESGELKET

SEQ ID NO: 121507 - protein, 14 aa, Borrelia burgdorferi
NSLSGESGELKETI

SEQ ID NO: 121508 - protein, 14 aa, Borrelia burgdorferi
SLSGESGELKETIE

SEQ ID NO: 121509 - protein, 14 aa, Borrelia burgdorferi
LSGESGELKETIES

SEQ ID NO: 121510 - protein, 14 aa, Borrelia burgdorferi
SGESGELKETIESN

SEQ ID NO: 121511 - protein, 14 aa, Borrelia burgdorferi
GESGELKETIESNE

SEQ ID NO: 121512 - protein, 14 aa, Borrelia burgdorferi
ESGELKETIESNEI

SEQ ID NO: 121513 - protein, 14 aa, Borrelia burgdorferi
SGELKETIESNEID

SEQ ID NO: 121514 - protein, 14 aa, Borrelia burgdorferi
GELKETIESNEIDI

SEQ ID NO: 121515 - protein, 14 aa, Borrelia burgdorferi
ELKETIESNEIDIT

SEQ ID NO: 121516 - protein, 14 aa, Borrelia burgdorferi
LKETIESNEIDITI

SEQ ID NO: 121517 - protein, 14 aa, Borrelia burgdorferi
KETIESNEIDITID

SEQ ID NO: 121518 - protein, 14 aa, Borrelia burgdorferi
ETIESNEIDITIDS

SEQ ID NO: 121519 - protein, 14 aa, Borrelia burgdorferi
TIESNEIDITIDSD

SEQ ID NO: 121520 - protein, 14 aa, Borrelia burgdorferi
IESNEIDITIDSDL

SEQ ID NO: 121521 - protein, 14 aa, Borrelia burgdorferi
ESNEIDITIDSDLR

SEQ ID NO: 121522 - protein, 14 aa, Borrelia burgdorferi
SNEIDITIDSDLRP

SEQ ID NO: 121523 - protein, 14 aa, Borrelia burgdorferi
NEIDITIDSDLRPK

SEQ ID NO: 121524 - protein, 14 aa, Borrelia burgdorferi
EIDITIDSDLRPKS

SEQ ID NO: 121525 - protein, 14 aa, Borrelia burgdorferi
IDITIDSDLRPKSS

SEQ ID NO: 121526 - protein, 14 aa, Borrelia burgdorferi
DITIDSDLRPKSSL

SEQ ID NO: 121527 - protein, 14 aa, Borrelia burgdorferi
ITIDSDLRPKSSLQ

SEQ ID NO: 121528 - protein, 14 aa, Borrelia burgdorferi
TIDSDLRPKSSLQD

SEQ ID NO: 121529 - protein, 14 aa, Borrelia burgdorferi
IDSDLRPKSSLQDI

SEQ ID NO: 121530 - protein, 14 aa, Borrelia burgdorferi
DSDLRPKSSLQDIA

SEQ ID NO: 121531 - protein, 14 aa, Borrelia burgdorferi
SDLRPKSSLQDIAG

SEQ ID NO: 121532 - protein, 14 aa, Borrelia burgdorferi
DLRPKSSLQDIAGS

SEQ ID NO: 121533 - protein, 14 aa, Borrelia burgdorferi
LRPKSSLQDIAGSN

SEQ ID NO: 121534 - protein, 14 aa, Borrelia burgdorferi
RPKSSLQDIAGSNS

SEQ ID NO: 121535 - protein, 14 aa, Borrelia burgdorferi
PKSSLQDIAGSNSI

SEQ ID NO: 121536 - protein, 14 aa, Borrelia burgdorferi
KSSLQDIAGSNSIS

SEQ ID NO: 121537 - protein, 14 aa, Borrelia burgdorferi
SSLQDIAGSNSISY

SEQ ID NO: 121538 - protein, 14 aa, Borrelia burgdorferi
SLQDIAGSNSISYT

SEQ ID NO: 121539 - protein, 14 aa, Borrelia burgdorferi
LQDIAGSNSISYTD

SEQ ID NO: 121540 - protein, 14 aa, Borrelia burgdorferi
QDIAGSNSISYTDE

SEQ ID NO: 121541 - protein, 14 aa, Borrelia burgdorferi
DIAGSNSISYTDEI

SEQ ID NO: 121542 - protein, 14 aa, Borrelia burgdorferi
IAGSNSISYTDEIE

SEQ ID NO: 121543 - protein, 14 aa, Borrelia burgdorferi
AGSNSISYTDEIEE

SEQ ID NO: 121544 - protein, 14 aa, Borrelia burgdorferi
GSNSISYTDEIEEE

SEQ ID NO: 121545 - protein, 14 aa, Borrelia burgdorferi
SNSISYTDEIEEED

SEQ ID NO: 121546 - protein, 14 aa, Borrelia burgdorferi
NSISYTDEIEEEDY

SEQ ID NO: 121547 - protein, 14 aa, Borrelia burgdorferi
SISYTDEIEEEDYA

SEQ ID NO: 121548 - protein, 14 aa, Borrelia burgdorferi
ISYTDEIEEEDYAR

SEQ ID NO: 121549 - protein, 14 aa, Borrelia burgdorferi
SYTDEIEEEDYARY

SEQ ID NO: 121550 - protein, 14 aa, Borrelia burgdorferi
YTDEIEEEDYARYY

SEQ ID NO: 121551 - protein, 14 aa, Borrelia burgdorferi
TDEIEEEDYARYYL

SEQ ID NO: 121552 - protein, 14 aa, Borrelia burgdorferi
DEIEEEDYARYYLD

SEQ ID NO: 121553 - protein, 14 aa, Borrelia burgdorferi
EIEEEDYARYYLDE

SEQ ID NO: 121554 - protein, 14 aa, Borrelia burgdorferi
IEEEDYARYYLDED

SEQ ID NO: 121555 - protein, 14 aa, Borrelia burgdorferi
EEEDYARYYLDEDD

SEQ ID NO: 121556 - protein, 14 aa, Borrelia burgdorferi
EEDYARYYLDEDDE

SEQ ID NO: 121557 - protein, 14 aa, Borrelia burgdorferi
EDYARYYLDEDDED

SEQ ID NO: 121558 - protein, 14 aa, Borrelia burgdorferi
DYARYYLDEDDEDD

SEQ ID NO: 121559 - protein, 14 aa, Borrelia burgdorferi
YARYYLDEDDEDDE

SEQ ID NO: 121560 - protein, 14 aa, Borrelia burgdorferi
ARYYLDEDDEDDEY

SEQ ID NO: 121561 - protein, 14 aa, Borrelia burgdorferi
RYYLDEDDEDDEYY

SEQ ID NO: 121562 - protein, 14 aa, Borrelia burgdorferi
YYLDEDDEDDEYYE

SEQ ID NO: 121563 - protein, 14 aa, Borrelia burgdorferi
YLDEDDEDDEYYED

SEQ ID NO: 121564 - protein, 14 aa, Borrelia burgdorferi
LDEDDEDDEYYEDD

SEQ ID NO: 121565 - protein, 14 aa, Borrelia burgdorferi
DEDDEDDEYYEDDY

SEQ ID NO: 121566 - protein, 14 aa, Borrelia burgdorferi
EDDEDDEYYEDDYE

SEQ ID NO: 121567 - protein, 14 aa, Borrelia burgdorferi
DDEDDEYYEDDYEE

SEQ ID NO: 121568 - protein, 14 aa, Borrelia burgdorferi
DEDDEYYEDDYEEI

SEQ ID NO: 121569 - protein, 14 aa, Borrelia burgdorferi
EDDEYYEDDYEEIR

SEQ ID NO: 121570 - protein, 14 aa, Borrelia burgdorferi
DDEYYEDDYEEIRL

SEQ ID NO: 121571 - protein, 14 aa, Borrelia burgdorferi
DEYYEDDYEEIRLS

SEQ ID NO: 121572 - protein, 14 aa, Borrelia burgdorferi
EYYEDDYEEIRLSN

SEQ ID NO: 121573 - protein, 14 aa, Borrelia burgdorferi
YYEDDYEEIRLSNR

SEQ ID NO: 121574 - protein, 14 aa, Borrelia burgdorferi
YEDDYEEIRLSNRY

SEQ ID NO: 121575 - protein, 14 aa, Borrelia burgdorferi
EDDYEEIRLSNRYQ

SEQ ID NO: 121576 - protein, 14 aa, Borrelia burgdorferi
DDYEEIRLSNRYQS

SEQ ID NO: 121577 - protein, 14 aa, Borrelia burgdorferi
DYEEIRLSNRYQSY

SEQ ID NO: 121578 - protein, 14 aa, Borrelia burgdorferi
YEEIRLSNRYQSYL

SEQ ID NO: 121579 - protein, 14 aa, Borrelia burgdorferi
EEIRLSNRYQSYLE

SEQ ID NO: 121580 - protein, 14 aa, Borrelia burgdorferi
EIRLSNRYQSYLEG

SEQ ID NO: 121581 - protein, 14 aa, Borrelia burgdorferi
IRLSNRYQSYLEGV

SEQ ID NO: 121582 - protein, 14 aa, Borrelia burgdorferi
RLSNRYQSYLEGVK

SEQ ID NO: 121583 - protein, 14 aa, Borrelia burgdorferi
LSNRYQSYLEGVKY

SEQ ID NO: 121584 - protein, 14 aa, Borrelia burgdorferi
SNRYQSYLEGVKYN

SEQ ID NO: 121585 - protein, 14 aa, Borrelia burgdorferi
NRYQSYLEGVKYNV

SEQ ID NO: 121586 - protein, 14 aa, Borrelia burgdorferi
RYQSYLEGVKYNVD

SEQ ID NO: 121587 - protein, 14 aa, Borrelia burgdorferi
YQSYLEGVKYNVDS

SEQ ID NO: 121588 - protein, 14 aa, Borrelia burgdorferi
QSYLEGVKYNVDSA

SEQ ID NO: 121589 - protein, 14 aa, Borrelia burgdorferi
SYLEGVKYNVDSAI

SEQ ID NO: 121590 - protein, 14 aa, Borrelia burgdorferi
YLEGVKYNVDSAIN

SEQ ID NO: 121591 - protein, 14 aa, Borrelia burgdorferi
LEGVKYNVDSAINT

SEQ ID NO: 121592 - protein, 14 aa, Borrelia burgdorferi
EGVKYNVDSAINTI

SEQ ID NO: 121593 - protein, 14 aa, Borrelia burgdorferi
GVKYNVDSAINTIN

SEQ ID NO: 121594 - protein, 14 aa, Borrelia burgdorferi
VKYNVDSAINTINK

SEQ ID NO: 121595 - protein, 14 aa, Borrelia burgdorferi
KYNVDSAINTINKI

SEQ ID NO: 121596 - protein, 14 aa, Borrelia burgdorferi
YNVDSAINTINKIY

SEQ ID NO: 121597 - protein, 14 aa, Borrelia burgdorferi
NVDSAINTINKIYD

SEQ ID NO: 121598 - protein, 14 aa, Borrelia burgdorferi
VDSAINTINKIYDT

SEQ ID NO: 121599 - protein, 14 aa, Borrelia burgdorferi
DSAINTINKIYDTY

SEQ ID NO: 121600 - protein, 14 aa, Borrelia burgdorferi
SAINTINKIYDTYT

SEQ ID NO: 121601 - protein, 14 aa, Borrelia burgdorferi
AINTINKIYDTYTL

SEQ ID NO: 121602 - protein, 14 aa, Borrelia burgdorferi
INTINKIYDTYTLF

SEQ ID NO: 121603 - protein, 14 aa, Borrelia burgdorferi
NTINKIYDTYTLFS

SEQ ID NO: 121604 - protein, 14 aa, Borrelia burgdorferi
TINKIYDTYTLFST

SEQ ID NO: 121605 - protein, 14 aa, Borrelia burgdorferi
INKIYDTYTLFSTK

SEQ ID NO: 121606 - protein, 14 aa, Borrelia burgdorferi
NKIYDTYTLFSTKL

SEQ ID NO: 121607 - protein, 14 aa, Borrelia burgdorferi
KIYDTYTLFSTKLT

SEQ ID NO: 121608 - protein, 14 aa, Borrelia burgdorferi
IYDTYTLFSTKLTQ

SEQ ID NO: 121609 - protein, 14 aa, Borrelia burgdorferi
YDTYTLFSTKLTQM

SEQ ID NO: 121610 - protein, 14 aa, Borrelia burgdorferi
DTYTLFSTKLTQMY

SEQ ID NO: 121611 - protein, 14 aa, Borrelia burgdorferi
TYTLFSTKLTQMYS

SEQ ID NO: 121612 - protein, 14 aa, Borrelia burgdorferi
YTLFSTKLTQMYST

SEQ ID NO: 121613 - protein, 14 aa, Borrelia burgdorferi
TLFSTKLTQMYSTR

SEQ ID NO: 121614 - protein, 14 aa, Borrelia burgdorferi
LFSTKLTQMYSTRL

SEQ ID NO: 121615 - protein, 14 aa, Borrelia burgdorferi
FSTKLTQMYSTRLD

SEQ ID NO: 121616 - protein, 14 aa, Borrelia burgdorferi
STKLTQMYSTRLDN

SEQ ID NO: 121617 - protein, 14 aa, Borrelia burgdorferi
TKLTQMYSTRLDNL

SEQ ID NO: 121618 - protein, 14 aa, Borrelia burgdorferi
KLTQMYSTRLDNLA

SEQ ID NO: 121619 - protein, 14 aa, Borrelia burgdorferi
LTQMYSTRLDNLAK

SEQ ID NO: 121620 - protein, 14 aa, Borrelia burgdorferi
TQMYSTRLDNLAKA

SEQ ID NO: 121621 - protein, 14 aa, Borrelia burgdorferi
QMYSTRLDNLAKAK

SEQ ID NO: 121622 - protein, 14 aa, Borrelia burgdorferi
MYSTRLDNLAKAKA

SEQ ID NO: 121623 - protein, 14 aa, Borrelia burgdorferi
YSTRLDNLAKAKAK

SEQ ID NO: 121624 - protein, 14 aa, Borrelia burgdorferi
STRLDNLAKAKAKE

SEQ ID NO: 121625 - protein, 14 aa, Borrelia burgdorferi
TRLDNLAKAKAKEE

SEQ ID NO: 121626 - protein, 14 aa, Borrelia burgdorferi
RLDNLAKAKAKEEA

SEQ ID NO: 121627 - protein, 14 aa, Borrelia burgdorferi
LDNLAKAKAKEEAA

SEQ ID NO: 121628 - protein, 14 aa, Borrelia burgdorferi
DNLAKAKAKEEAAK

SEQ ID NO: 121629 - protein, 14 aa, Borrelia burgdorferi
NLAKAKAKEEAAKF

SEQ ID NO: 121630 - protein, 14 aa, Borrelia burgdorferi
LAKAKAKEEAAKFT

SEQ ID NO: 121631 - protein, 14 aa, Borrelia burgdorferi
AKAKAKEEAAKFTK

SEQ ID NO: 121632 - protein, 14 aa, Borrelia burgdorferi
KAKAKEEAAKFTKE

SEQ ID NO: 121633 - protein, 14 aa, Borrelia burgdorferi
AKAKEEAAKFTKED

SEQ ID NO: 121634 - protein, 14 aa, Borrelia burgdorferi
KAKEEAAKFTKEDL

SEQ ID NO: 121635 - protein, 14 aa, Borrelia burgdorferi
AKEEAAKFTKEDLE

SEQ ID NO: 121636 - protein, 14 aa, Borrelia burgdorferi
KEEAAKFTKEDLEK

SEQ ID NO: 121637 - protein, 14 aa, Borrelia burgdorferi
EEAAKFTKEDLEKN

SEQ ID NO: 121638 - protein, 14 aa, Borrelia burgdorferi
EAAKFTKEDLEKNF

SEQ ID NO: 121639 - protein, 14 aa, Borrelia burgdorferi
AAKFTKEDLEKNFK

SEQ ID NO: 121640 - protein, 14 aa, Borrelia burgdorferi
AKFTKEDLEKNFKT

SEQ ID NO: 121641 - protein, 14 aa, Borrelia burgdorferi
KFTKEDLEKNFKTL

SEQ ID NO: 121642 - protein, 14 aa, Borrelia burgdorferi
FTKEDLEKNFKTLL

SEQ ID NO: 121643 - protein, 14 aa, Borrelia burgdorferi
TKEDLEKNFKTLLN

SEQ ID NO: 121644 - protein, 14 aa, Borrelia burgdorferi
KEDLEKNFKTLLNY

SEQ ID NO: 121645 - protein, 14 aa, Borrelia burgdorferi
EDLEKNFKTLLNYI

SEQ ID NO: 121646 - protein, 14 aa, Borrelia burgdorferi
DLEKNFKTLLNYIQ

SEQ ID NO: 121647 - protein, 14 aa, Borrelia burgdorferi
LEKNFKTLLNYIQV

SEQ ID NO: 121648 - protein, 14 aa, Borrelia burgdorferi
EKNFKTLLNYIQVS

SEQ ID NO: 121649 - protein, 14 aa, Borrelia burgdorferi
KNFKTLLNYIQVSV

SEQ ID NO: 121650 - protein, 14 aa, Borrelia burgdorferi
NFKTLLNYIQVSVK

SEQ ID NO: 121651 - protein, 14 aa, Borrelia burgdorferi
FKTLLNYIQVSVKT

SEQ ID NO: 121652 - protein, 14 aa, Borrelia burgdorferi
KTLLNYIQVSVKTA

SEQ ID NO: 121653 - protein, 14 aa, Borrelia burgdorferi
TLLNYIQVSVKTAA

SEQ ID NO: 121654 - protein, 14 aa, Borrelia burgdorferi
LLNYIQVSVKTAAN

SEQ ID NO: 121655 - protein, 14 aa, Borrelia burgdorferi
LNYIQVSVKTAANF

SEQ ID NO: 121656 - protein, 14 aa, Borrelia burgdorferi
NYIQVSVKTAANFV

SEQ ID NO: 121657 - protein, 14 aa, Borrelia burgdorferi
YIQVSVKTAANFVY

SEQ ID NO: 121658 - protein, 14 aa, Borrelia burgdorferi
IQVSVKTAANFVYI

SEQ ID NO: 121659 - protein, 14 aa, Borrelia burgdorferi
QVSVKTAANFVYIN

SEQ ID NO: 121660 - protein, 14 aa, Borrelia burgdorferi
VSVKTAANFVYIND

SEQ ID NO: 121661 - protein, 14 aa, Borrelia burgdorferi
SVKTAANFVYINDT

SEQ ID NO: 121662 - protein, 14 aa, Borrelia burgdorferi
VKTAANFVYINDTH

SEQ ID NO: 121663 - protein, 14 aa, Borrelia burgdorferi
KTAANFVYINDTHA

SEQ ID NO: 121664 - protein, 14 aa, Borrelia burgdorferi
TAANFVYINDTHAK

SEQ ID NO: 121665 - protein, 14 aa, Borrelia burgdorferi
AANFVYINDTHAKR

SEQ ID NO: 121666 - protein, 14 aa, Borrelia burgdorferi
ANFVYINDTHAKRK

SEQ ID NO: 121667 - protein, 14 aa, Borrelia burgdorferi
NFVYINDTHAKRKL

SEQ ID NO: 121668 - protein, 14 aa, Borrelia burgdorferi
FVYINDTHAKRKLE

SEQ ID NO: 121669 - protein, 14 aa, Borrelia burgdorferi
VYINDTHAKRKLEN

SEQ ID NO: 121670 - protein, 14 aa, Borrelia burgdorferi
YINDTHAKRKLENI

SEQ ID NO: 121671 - protein, 14 aa, Borrelia burgdorferi
INDTHAKRKLENIE

SEQ ID NO: 121672 - protein, 14 aa, Borrelia burgdorferi
NDTHAKRKLENIEA

SEQ ID NO: 121673 - protein, 14 aa, Borrelia burgdorferi
DTHAKRKLENIEAE

SEQ ID NO: 121674 - protein, 14 aa, Borrelia burgdorferi
THAKRKLENIEAEI

SEQ ID NO: 121675 - protein, 14 aa, Borrelia burgdorferi
HAKRKLENIEAEIK

SEQ ID NO: 121676 - protein, 14 aa, Borrelia burgdorferi
AKRKLENIEAEIKT

SEQ ID NO: 121677 - protein, 14 aa, Borrelia burgdorferi
KRKLENIEAEIKTL

SEQ ID NO: 121678 - protein, 14 aa, Borrelia burgdorferi
RKLENIEAEIKTLI

SEQ ID NO: 121679 - protein, 14 aa, Borrelia burgdorferi
KLENIEAEIKTLIA

SEQ ID NO: 121680 - protein, 14 aa, Borrelia burgdorferi
LENIEAEIKTLIAK

SEQ ID NO: 121681 - protein, 14 aa, Borrelia burgdorferi
ENIEAEIKTLIAKI

SEQ ID NO: 121682 - protein, 14 aa, Borrelia burgdorferi
NIEAEIKTLIAKIK

SEQ ID NO: 121683 - protein, 14 aa, Borrelia burgdorferi
IEAEIKTLIAKIKE

SEQ ID NO: 121684 - protein, 14 aa, Borrelia burgdorferi
EAEIKTLIAKIKEQ

SEQ ID NO: 121685 - protein, 14 aa, Borrelia burgdorferi
AEIKTLIAKIKEQS

SEQ ID NO: 121686 - protein, 14 aa, Borrelia burgdorferi
EIKTLIAKIKEQSN

SEQ ID NO: 121687 - protein, 14 aa, Borrelia burgdorferi
IKTLIAKIKEQSNL

SEQ ID NO: 121688 - protein, 14 aa, Borrelia burgdorferi
KTLIAKIKEQSNLY

SEQ ID NO: 121689 - protein, 14 aa, Borrelia burgdorferi
TLIAKIKEQSNLYE

SEQ ID NO: 121690 - protein, 14 aa, Borrelia burgdorferi
LIAKIKEQSNLYEA

SEQ ID NO: 121691 - protein, 14 aa, Borrelia burgdorferi
IAKIKEQSNLYEAY

SEQ ID NO: 121692 - protein, 14 aa, Borrelia burgdorferi
AKIKEQSNLYEAYK

SEQ ID NO: 121693 - protein, 14 aa, Borrelia burgdorferi
KIKEQSNLYEAYKA

SEQ ID NO: 121694 - protein, 14 aa, Borrelia burgdorferi
IKEQSNLYEAYKAI

SEQ ID NO: 121695 - protein, 14 aa, Borrelia burgdorferi
KEQSNLYEAYKAIV

SEQ ID NO: 121696 - protein, 14 aa, Borrelia burgdorferi
EQSNLYEAYKAIVT

SEQ ID NO: 121697 - protein, 14 aa, Borrelia burgdorferi
QSNLYEAYKAIVTS

SEQ ID NO: 121698 - protein, 14 aa, Borrelia burgdorferi
SNLYEAYKAIVTSI

SEQ ID NO: 121699 - protein, 14 aa, Borrelia burgdorferi
NLYEAYKAIVTSIL

SEQ ID NO: 121700 - protein, 14 aa, Borrelia burgdorferi
LYEAYKAIVTSILL

SEQ ID NO: 121701 - protein, 14 aa, Borrelia burgdorferi
YEAYKAIVTSILLM

SEQ ID NO: 121702 - protein, 14 aa, Borrelia burgdorferi
EAYKAIVTSILLMR

SEQ ID NO: 121703 - protein, 14 aa, Borrelia burgdorferi
AYKAIVTSILLMRD

SEQ ID NO: 121704 - protein, 14 aa, Borrelia burgdorferi
YKAIVTSILLMRDS

SEQ ID NO: 121705 - protein, 14 aa, Borrelia burgdorferi
KAIVTSILLMRDSL

SEQ ID NO: 121706 - protein, 14 aa, Borrelia burgdorferi
AIVTSILLMRDSLK

SEQ ID NO: 121707 - protein, 14 aa, Borrelia burgdorferi
IVTSILLMRDSLKE

SEQ ID NO: 121708 - protein, 14 aa, Borrelia burgdorferi
VTSILLMRDSLKEV

SEQ ID NO: 121709 - protein, 14 aa, Borrelia burgdorferi
TSILLMRDSLKEVQ

SEQ ID NO: 121710 - protein, 14 aa, Borrelia burgdorferi
SILLMRDSLKEVQG

SEQ ID NO: 121711 - protein, 14 aa, Borrelia burgdorferi
ILLMRDSLKEVQGI

SEQ ID NO: 121712 - protein, 14 aa, Borrelia burgdorferi
LLMRDSLKEVQGII

SEQ ID NO: 121713 - protein, 14 aa, Borrelia burgdorferi
LMRDSLKEVQGIID

SEQ ID NO: 121714 - protein, 14 aa, Borrelia burgdorferi
MRDSLKEVQGIIDK

SEQ ID NO: 121715 - protein, 14 aa, Borrelia burgdorferi
RDSLKEVQGIIDKN

SEQ ID NO: 121716 - protein, 14 aa, Borrelia burgdorferi
DSLKEVQGIIDKNG

SEQ ID NO: 121717 - protein, 14 aa, Borrelia burgdorferi
SLKEVQGIIDKNGV

SEQ ID NO: 121718 - protein, 14 aa, Borrelia burgdorferi
LKEVQGIIDKNGVW

SEQ ID NO: 121719 - protein, 14 aa, Borrelia burgdorferi
KEVQGIIDKNGVWY

SEQ ID NO: 121720 - protein, 15 aa, Borrelia burgdorferi
MKKVKSKYLALGLLF

SEQ ID NO: 121721 - protein, 15 aa, Borrelia burgdorferi
KKVKSKYLALGLLFG

SEQ ID NO: 121722 - protein, 15 aa, Borrelia burgdorferi
KVKSKYLALGLLFGF

SEQ ID NO: 121723 - protein, 15 aa, Borrelia burgdorferi
VKSKYLALGLLFGFI

SEQ ID NO: 121724 - protein, 15 aa, Borrelia burgdorferi
KSKYLALGLLFGFIS

SEQ ID NO: 121725 - protein, 15 aa, Borrelia burgdorferi
SKYLALGLLFGFISC

SEQ ID NO: 121726 - protein, 15 aa, Borrelia burgdorferi
KYLALGLLFGFISCD

SEQ ID NO: 121727 - protein, 15 aa, Borrelia burgdorferi
YLALGLLFGFISCDL

SEQ ID NO: 121728 - protein, 15 aa, Borrelia burgdorferi
LALGLLFGFISCDLF

SEQ ID NO: 121729 - protein, 15 aa, Borrelia burgdorferi
ALGLLFGFISCDLFI

SEQ ID NO: 121730 - protein, 15 aa, Borrelia burgdorferi
LGLLFGFISCDLFIR

SEQ ID NO: 121731 - protein, 15 aa, Borrelia burgdorferi
GLLFGFISCDLFIRY

SEQ ID NO: 121732 - protein, 15 aa, Borrelia burgdorferi
LLFGFISCDLFIRYE

SEQ ID NO: 121733 - protein, 15 aa, Borrelia burgdorferi
LFGFISCDLFIRYEM

SEQ ID NO: 121734 - protein, 15 aa, Borrelia burgdorferi
FGFISCDLFIRYEMK

SEQ ID NO: 121735 - protein, 15 aa, Borrelia burgdorferi
GFISCDLFIRYEMKE

SEQ ID NO: 121736 - protein, 15 aa, Borrelia burgdorferi
FISCDLFIRYEMKEE

SEQ ID NO: 121737 - protein, 15 aa, Borrelia burgdorferi
ISCDLFIRYEMKEES

SEQ ID NO: 121738 - protein, 15 aa, Borrelia burgdorferi
SCDLFIRYEMKEESP

SEQ ID NO: 121739 - protein, 15 aa, Borrelia burgdorferi
CDLFIRYEMKEESPG

SEQ ID NO: 121740 - protein, 15 aa, Borrelia burgdorferi
DLFIRYEMKEESPGL

SEQ ID NO: 121741 - protein, 15 aa, Borrelia burgdorferi
LFIRYEMKEESPGLF

SEQ ID NO: 121742 - protein, 15 aa, Borrelia burgdorferi
FIRYEMKEESPGLFD

SEQ ID NO: 121743 - protein, 15 aa, Borrelia burgdorferi
IRYEMKEESPGLFDK

SEQ ID NO: 121744 - protein, 15 aa, Borrelia burgdorferi
RYEMKEESPGLFDKG

SEQ ID NO: 121745 - protein, 15 aa, Borrelia burgdorferi
YEMKEESPGLFDKGN

SEQ ID NO: 121746 - protein, 15 aa, Borrelia burgdorferi
EMKEESPGLFDKGNS

SEQ ID NO: 121747 - protein, 15 aa, Borrelia burgdorferi
MKEESPGLFDKGNSI

SEQ ID NO: 121748 - protein, 15 aa, Borrelia burgdorferi
KEESPGLFDKGNSIL

SEQ ID NO: 121749 - protein, 15 aa, Borrelia burgdorferi
EESPGLFDKGNSILE

SEQ ID NO: 121750 - protein, 15 aa, Borrelia burgdorferi
ESPGLFDKGNSILET

SEQ ID NO: 121751 - protein, 15 aa, Borrelia burgdorferi
SPGLFDKGNSILETS

SEQ ID NO: 121752 - protein, 15 aa, Borrelia burgdorferi
PGLFDKGNSILETSE

SEQ ID NO: 121753 - protein, 15 aa, Borrelia burgdorferi
GLFDKGNSILETSEE

SEQ ID NO: 121754 - protein, 15 aa, Borrelia burgdorferi
LFDKGNSILETSEES

SEQ ID NO: 121755 - protein, 15 aa, Borrelia burgdorferi
FDKGNSILETSEESI

SEQ ID NO: 121756 - protein, 15 aa, Borrelia burgdorferi
DKGNSILETSEESIK

SEQ ID NO: 121757 - protein, 15 aa, Borrelia burgdorferi
KGNSILETSEESIKK

SEQ ID NO: 121758 - protein, 15 aa, Borrelia burgdorferi
GNSILETSEESIKKP

SEQ ID NO: 121759 - protein, 15 aa, Borrelia burgdorferi
NSILETSEESIKKPM

SEQ ID NO: 121760 - protein, 15 aa, Borrelia burgdorferi
SILETSEESIKKPMN

SEQ ID NO: 121761 - protein, 15 aa, Borrelia burgdorferi
ILETSEESIKKPMNK

SEQ ID NO: 121762 - protein, 15 aa, Borrelia burgdorferi
LETSEESIKKPMNKK

SEQ ID NO: 121763 - protein, 15 aa, Borrelia burgdorferi
ETSEESIKKPMNKKG

SEQ ID NO: 121764 - protein, 15 aa, Borrelia burgdorferi
TSEESIKKPMNKKGK

SEQ ID NO: 121765 - protein, 15 aa, Borrelia burgdorferi
SEESIKKPMNKKGKG

SEQ ID NO: 121766 - protein, 15 aa, Borrelia burgdorferi
EESIKKPMNKKGKGK

SEQ ID NO: 121767 - protein, 15 aa, Borrelia burgdorferi
ESIKKPMNKKGKGKI

SEQ ID NO: 121768 - protein, 15 aa, Borrelia burgdorferi
SIKKPMNKKGKGKIA

SEQ ID NO: 121769 - protein, 15 aa, Borrelia burgdorferi
IKKPMNKKGKGKIAR

SEQ ID NO: 121770 - protein, 15 aa, Borrelia burgdorferi
KKPMNKKGKGKIARK

SEQ ID NO: 121771 - protein, 15 aa, Borrelia burgdorferi
KPMNKKGKGKIARKK

SEQ ID NO: 121772 - protein, 15 aa, Borrelia burgdorferi
PMNKKGKGKIARKKG

SEQ ID NO: 121773 - protein, 15 aa, Borrelia burgdorferi
MNKKGKGKIARKKGK

SEQ ID NO: 121774 - protein, 15 aa, Borrelia burgdorferi
NKKGKGKIARKKGKS

SEQ ID NO: 121775 - protein, 15 aa, Borrelia burgdorferi
KKGKGKIARKKGKSK

SEQ ID NO: 121776 - protein, 15 aa, Borrelia burgdorferi
KGKGKIARKKGKSKV

SEQ ID NO: 121777 - protein, 15 aa, Borrelia burgdorferi
GKGKIARKKGKSKVS

SEQ ID NO: 121778 - protein, 15 aa, Borrelia burgdorferi
KGKIARKKGKSKVSR

SEQ ID NO: 121779 - protein, 15 aa, Borrelia burgdorferi
GKIARKKGKSKVSRK

SEQ ID NO: 121780 - protein, 15 aa, Borrelia burgdorferi
KIARKKGKSKVSRKE

SEQ ID NO: 121781 - protein, 15 aa, Borrelia burgdorferi
IARKKGKSKVSRKEP

SEQ ID NO: 121782 - protein, 15 aa, Borrelia burgdorferi
ARKKGKSKVSRKEPY

SEQ ID NO: 121783 - protein, 15 aa, Borrelia burgdorferi
RKKGKSKVSRKEPYI

SEQ ID NO: 121784 - protein, 15 aa, Borrelia burgdorferi
KKGKSKVSRKEPYIH

SEQ ID NO: 121785 - protein, 15 aa, Borrelia burgdorferi
KGKSKVSRKEPYIHS

SEQ ID NO: 121786 - protein, 15 aa, Borrelia burgdorferi
GKSKVSRKEPYIHSL

SEQ ID NO: 121787 - protein, 15 aa, Borrelia burgdorferi
KSKVSRKEPYIHSLK

SEQ ID NO: 121788 - protein, 15 aa, Borrelia burgdorferi
SKVSRKEPYIHSLKR

SEQ ID NO: 121789 - protein, 15 aa, Borrelia burgdorferi
KVSRKEPYIHSLKRD

SEQ ID NO: 121790 - protein, 15 aa, Borrelia burgdorferi
VSRKEPYIHSLKRDS

SEQ ID NO: 121791 - protein, 15 aa, Borrelia burgdorferi
SRKEPYIHSLKRDSA

SEQ ID NO: 121792 - protein, 15 aa, Borrelia burgdorferi
RKEPYIHSLKRDSAN

SEQ ID NO: 121793 - protein, 15 aa, Borrelia burgdorferi
KEPYIHSLKRDSANK

SEQ ID NO: 121794 - protein, 15 aa, Borrelia burgdorferi
EPYIHSLKRDSANKS

SEQ ID NO: 121795 - protein, 15 aa, Borrelia burgdorferi
PYIHSLKRDSANKSN

SEQ ID NO: 121796 - protein, 15 aa, Borrelia burgdorferi
YIHSLKRDSANKSNF

SEQ ID NO: 121797 - protein, 15 aa, Borrelia burgdorferi
IHSLKRDSANKSNFL

SEQ ID NO: 121798 - protein, 15 aa, Borrelia burgdorferi
HSLKRDSANKSNFLQ

SEQ ID NO: 121799 - protein, 15 aa, Borrelia burgdorferi
SLKRDSANKSNFLQK

SEQ ID NO: 121800 - protein, 15 aa, Borrelia burgdorferi
LKRDSANKSNFLQKN

SEQ ID NO: 121801 - protein, 15 aa, Borrelia burgdorferi
KRDSANKSNFLQKNV

SEQ ID NO: 121802 - protein, 15 aa, Borrelia burgdorferi
RDSANKSNFLQKNVI

SEQ ID NO: 121803 - protein, 15 aa, Borrelia burgdorferi
DSANKSNFLQKNVIL

SEQ ID NO: 121804 - protein, 15 aa, Borrelia burgdorferi
SANKSNFLQKNVILE

SEQ ID NO: 121805 - protein, 15 aa, Borrelia burgdorferi
ANKSNFLQKNVILEE

SEQ ID NO: 121806 - protein, 15 aa, Borrelia burgdorferi
NKSNFLQKNVILEEE

SEQ ID NO: 121807 - protein, 15 aa, Borrelia burgdorferi
KSNFLQKNVILEEES

SEQ ID NO: 121808 - protein, 15 aa, Borrelia burgdorferi
SNFLQKNVILEEESL

SEQ ID NO: 121809 - protein, 15 aa, Borrelia burgdorferi
NFLQKNVILEEESLK

SEQ ID NO: 121810 - protein, 15 aa, Borrelia burgdorferi
FLQKNVILEEESLKT

SEQ ID NO: 121811 - protein, 15 aa, Borrelia burgdorferi
LQKNVILEEESLKTE

SEQ ID NO: 121812 - protein, 15 aa, Borrelia burgdorferi
QKNVILEEESLKTEL

SEQ ID NO: 121813 - protein, 15 aa, Borrelia burgdorferi
KNVILEEESLKTELL

SEQ ID NO: 121814 - protein, 15 aa, Borrelia burgdorferi
NVILEEESLKTELLK

SEQ ID NO: 121815 - protein, 15 aa, Borrelia burgdorferi
VILEEESLKTELLKE

SEQ ID NO: 121816 - protein, 15 aa, Borrelia burgdorferi
ILEEESLKTELLKEQ

SEQ ID NO: 121817 - protein, 15 aa, Borrelia burgdorferi
LEEESLKTELLKEQS

SEQ ID NO: 121818 - protein, 15 aa, Borrelia burgdorferi
EEESLKTELLKEQSE

SEQ ID NO: 121819 - protein, 15 aa, Borrelia burgdorferi
EESLKTELLKEQSET

SEQ ID NO: 121820 - protein, 15 aa, Borrelia burgdorferi
ESLKTELLKEQSETR

SEQ ID NO: 121821 - protein, 15 aa, Borrelia burgdorferi
SLKTELLKEQSETRK

SEQ ID NO: 121822 - protein, 15 aa, Borrelia burgdorferi
LKTELLKEQSETRKE

SEQ ID NO: 121823 - protein, 15 aa, Borrelia burgdorferi
KTELLKEQSETRKEK

SEQ ID NO: 121824 - protein, 15 aa, Borrelia burgdorferi
TELLKEQSETRKEKI

SEQ ID NO: 121825 - protein, 15 aa, Borrelia burgdorferi
ELLKEQSETRKEKIQ

SEQ ID NO: 121826 - protein, 15 aa, Borrelia burgdorferi
LLKEQSETRKEKIQK

SEQ ID NO: 121827 - protein, 15 aa, Borrelia burgdorferi
LKEQSETRKEKIQKQ

SEQ ID NO: 121828 - protein, 15 aa, Borrelia burgdorferi
KEQSETRKEKIQKQQ

SEQ ID NO: 121829 - protein, 15 aa, Borrelia burgdorferi
EQSETRKEKIQKQQD

SEQ ID NO: 121830 - protein, 15 aa, Borrelia burgdorferi
QSETRKEKIQKQQDE

SEQ ID NO: 121831 - protein, 15 aa, Borrelia burgdorferi
SETRKEKIQKQQDEY

SEQ ID NO: 121832 - protein, 15 aa, Borrelia burgdorferi
ETRKEKIQKQQDEYK

SEQ ID NO: 121833 - protein, 15 aa, Borrelia burgdorferi
TRKEKIQKQQDEYKG

SEQ ID NO: 121834 - protein, 15 aa, Borrelia burgdorferi
RKEKIQKQQDEYKGM

SEQ ID NO: 121835 - protein, 15 aa, Borrelia burgdorferi
KEKIQKQQDEYKGMT

SEQ ID NO: 121836 - protein, 15 aa, Borrelia burgdorferi
EKIQKQQDEYKGMTQ

SEQ ID NO: 121837 - protein, 15 aa, Borrelia burgdorferi
KIQKQQDEYKGMTQG

SEQ ID NO: 121838 - protein, 15 aa, Borrelia burgdorferi
IQKQQDEYKGMTQGS

SEQ ID NO: 121839 - protein, 15 aa, Borrelia burgdorferi
QKQQDEYKGMTQGSL

SEQ ID NO: 121840 - protein, 15 aa, Borrelia burgdorferi
KQQDEYKGMTQGSLN

SEQ ID NO: 121841 - protein, 15 aa, Borrelia burgdorferi
QQDEYKGMTQGSLNS

SEQ ID NO: 121842 - protein, 15 aa, Borrelia burgdorferi
QDEYKGMTQGSLNSL

SEQ ID NO: 121843 - protein, 15 aa, Borrelia burgdorferi
DEYKGMTQGSLNSLS

SEQ ID NO: 121844 - protein, 15 aa, Borrelia burgdorferi
EYKGMTQGSLNSLSG

SEQ ID NO: 121845 - protein, 15 aa, Borrelia burgdorferi
YKGMTQGSLNSLSGE

SEQ ID NO: 121846 - protein, 15 aa, Borrelia burgdorferi
KGMTQGSLNSLSGES

SEQ ID NO: 121847 - protein, 15 aa, Borrelia burgdorferi
GMTQGSLNSLSGESG

SEQ ID NO: 121848 - protein, 15 aa, Borrelia burgdorferi
MTQGSLNSLSGESGE

SEQ ID NO: 121849 - protein, 15 aa, Borrelia burgdorferi
TQGSLNSLSGESGEL

SEQ ID NO: 121850 - protein, 15 aa, Borrelia burgdorferi
QGSLNSLSGESGELK

SEQ ID NO: 121851 - protein, 15 aa, Borrelia burgdorferi
GSLNSLSGESGELKE

SEQ ID NO: 121852 - protein, 15 aa, Borrelia burgdorferi
SLNSLSGESGELKET

SEQ ID NO: 121853 - protein, 15 aa, Borrelia burgdorferi
LNSLSGESGELKETI

SEQ ID NO: 121854 - protein, 15 aa, Borrelia burgdorferi
NSLSGESGELKETIE

SEQ ID NO: 121855 - protein, 15 aa, Borrelia burgdorferi
SLSGESGELKETIES

SEQ ID NO: 121856 - protein, 15 aa, Borrelia burgdorferi
LSGESGELKETIESN

SEQ ID NO: 121857 - protein, 15 aa, Borrelia burgdorferi
SGESGELKETIESNE

SEQ ID NO: 121858 - protein, 15 aa, Borrelia burgdorferi
GESGELKETIESNEI

SEQ ID NO: 121859 - protein, 15 aa, Borrelia burgdorferi
ESGELKETIESNEID

SEQ ID NO: 121860 - protein, 15 aa, Borrelia burgdorferi
SGELKETIESNEIDI

SEQ ID NO: 121861 - protein, 15 aa, Borrelia burgdorferi
GELKETIESNEIDIT

SEQ ID NO: 121862 - protein, 15 aa, Borrelia burgdorferi
ELKETIESNEIDITI

SEQ ID NO: 121863 - protein, 15 aa, Borrelia burgdorferi
LKETIESNEIDITID

SEQ ID NO: 121864 - protein, 15 aa, Borrelia burgdorferi
KETIESNEIDITIDS

SEQ ID NO: 121865 - protein, 15 aa, Borrelia burgdorferi
ETIESNEIDITIDSD

SEQ ID NO: 121866 - protein, 15 aa, Borrelia burgdorferi
TIESNEIDITIDSDL

SEQ ID NO: 121867 - protein, 15 aa, Borrelia burgdorferi
IESNEIDITIDSDLR

SEQ ID NO: 121868 - protein, 15 aa, Borrelia burgdorferi
ESNEIDITIDSDLRP

SEQ ID NO: 121869 - protein, 15 aa, Borrelia burgdorferi
SNEIDITIDSDLRPK

SEQ ID NO: 121870 - protein, 15 aa, Borrelia burgdorferi
NEIDITIDSDLRPKS

SEQ ID NO: 121871 - protein, 15 aa, Borrelia burgdorferi
EIDITIDSDLRPKSS

SEQ ID NO: 121872 - protein, 15 aa, Borrelia burgdorferi
IDITIDSDLRPKSSL

SEQ ID NO: 121873 - protein, 15 aa, Borrelia burgdorferi
DITIDSDLRPKSSLQ

SEQ ID NO: 121874 - protein, 15 aa, Borrelia burgdorferi
ITIDSDLRPKSSLQD

SEQ ID NO: 121875 - protein, 15 aa, Borrelia burgdorferi
TIDSDLRPKSSLQDI

SEQ ID NO: 121876 - protein, 15 aa, Borrelia burgdorferi
IDSDLRPKSSLQDIA

SEQ ID NO: 121877 - protein, 15 aa, Borrelia burgdorferi
DSDLRPKSSLQDIAG

SEQ ID NO: 121878 - protein, 15 aa, Borrelia burgdorferi
SDLRPKSSLQDIAGS

SEQ ID NO: 121879 - protein, 15 aa, Borrelia burgdorferi
DLRPKSSLQDIAGSN

SEQ ID NO: 121880 - protein, 15 aa, Borrelia burgdorferi
LRPKSSLQDIAGSNS

SEQ ID NO: 121881 - protein, 15 aa, Borrelia burgdorferi
RPKSSLQDIAGSNSI

SEQ ID NO: 121882 - protein, 15 aa, Borrelia burgdorferi
PKSSLQDIAGSNSIS

SEQ ID NO: 121883 - protein, 15 aa, Borrelia burgdorferi
KSSLQDIAGSNSISY

SEQ ID NO: 121884 - protein, 15 aa, Borrelia burgdorferi
SSLQDIAGSNSISYT

SEQ ID NO: 121885 - protein, 15 aa, Borrelia burgdorferi
SLQDIAGSNSISYTD

SEQ ID NO: 121886 - protein, 15 aa, Borrelia burgdorferi
LQDIAGSNSISYTDE

SEQ ID NO: 121887 - protein, 15 aa, Borrelia burgdorferi
QDIAGSNSISYTDEI

SEQ ID NO: 121888 - protein, 15 aa, Borrelia burgdorferi
DIAGSNSISYTDEIE

SEQ ID NO: 121889 - protein, 15 aa, Borrelia burgdorferi
IAGSNSISYTDEIEE

SEQ ID NO: 121890 - protein, 15 aa, Borrelia burgdorferi
AGSNSISYTDEIEEE

SEQ ID NO: 121891 - protein, 15 aa, Borrelia burgdorferi
GSNSISYTDEIEEED

SEQ ID NO: 121892 - protein, 15 aa, Borrelia burgdorferi
SNSISYTDEIEEEDY

SEQ ID NO: 121893 - protein, 15 aa, Borrelia burgdorferi
NSISYTDEIEEEDYA

SEQ ID NO: 121894 - protein, 15 aa, Borrelia burgdorferi
SISYTDEIEEEDYAR

SEQ ID NO: 121895 - protein, 15 aa, Borrelia burgdorferi
ISYTDEIEEEDYARY

SEQ ID NO: 121896 - protein, 15 aa, Borrelia burgdorferi
SYTDEIEEEDYARYY

SEQ ID NO: 121897 - protein, 15 aa, Borrelia burgdorferi
YTDEIEEEDYARYYL

SEQ ID NO: 121898 - protein, 15 aa, Borrelia burgdorferi
TDEIEEEDYARYYLD

SEQ ID NO: 121899 - protein, 15 aa, Borrelia burgdorferi
DEIEEEDYARYYLDE

SEQ ID NO: 121900 - protein, 15 aa, Borrelia burgdorferi
EIEEEDYARYYLDED

SEQ ID NO: 121901 - protein, 15 aa, Borrelia burgdorferi
IEEEDYARYYLDEDD

SEQ ID NO: 121902 - protein, 15 aa, Borrelia burgdorferi
EEEDYARYYLDEDDE

SEQ ID NO: 121903 - protein, 15 aa, Borrelia burgdorferi
EEDYARYYLDEDDED

SEQ ID NO: 121904 - protein, 15 aa, Borrelia burgdorferi
EDYARYYLDEDDEDD

SEQ ID NO: 121905 - protein, 15 aa, Borrelia burgdorferi
DYARYYLDEDDEDDE

SEQ ID NO: 121906 - protein, 15 aa, Borrelia burgdorferi
YARYYLDEDDEDDEY

SEQ ID NO: 121907 - protein, 15 aa, Borrelia burgdorferi
ARYYLDEDDEDDEYY

SEQ ID NO: 121908 - protein, 15 aa, Borrelia burgdorferi
RYYLDEDDEDDEYYE

SEQ ID NO: 121909 - protein, 15 aa, Borrelia burgdorferi
YYLDEDDEDDEYYED

SEQ ID NO: 121910 - protein, 15 aa, Borrelia burgdorferi
YLDEDDEDDEYYEDD

SEQ ID NO: 121911 - protein, 15 aa, Borrelia burgdorferi
LDEDDEDDEYYEDDY

SEQ ID NO: 121912 - protein, 15 aa, Borrelia burgdorferi
DEDDEDDEYYEDDYE

SEQ ID NO: 121913 - protein, 15 aa, Borrelia burgdorferi
EDDEDDEYYEDDYEE

SEQ ID NO: 121914 - protein, 15 aa, Borrelia burgdorferi
DDEDDEYYEDDYEEI

SEQ ID NO: 121915 - protein, 15 aa, Borrelia burgdorferi
DEDDEYYEDDYEEIR

SEQ ID NO: 121916 - protein, 15 aa, Borrelia burgdorferi
EDDEYYEDDYEEIRL

SEQ ID NO: 121917 - protein, 15 aa, Borrelia burgdorferi
DDEYYEDDYEEIRLS

SEQ ID NO: 121918 - protein, 15 aa, Borrelia burgdorferi
DEYYEDDYEEIRLSN

SEQ ID NO: 121919 - protein, 15 aa, Borrelia burgdorferi
EYYEDDYEEIRLSNR

SEQ ID NO: 121920 - protein, 15 aa, Borrelia burgdorferi
YYEDDYEEIRLSNRY

SEQ ID NO: 121921 - protein, 15 aa, Borrelia burgdorferi
YEDDYEEIRLSNRYQ

SEQ ID NO: 121922 - protein, 15 aa, Borrelia burgdorferi
EDDYEEIRLSNRYQS

SEQ ID NO: 121923 - protein, 15 aa, Borrelia burgdorferi
DDYEEIRLSNRYQSY

SEQ ID NO: 121924 - protein, 15 aa, Borrelia burgdorferi
DYEEIRLSNRYQSYL

SEQ ID NO: 121925 - protein, 15 aa, Borrelia burgdorferi
YEEIRLSNRYQSYLE

SEQ ID NO: 121926 - protein, 15 aa, Borrelia burgdorferi
EEIRLSNRYQSYLEG

SEQ ID NO: 121927 - protein, 15 aa, Borrelia burgdorferi
EIRLSNRYQSYLEGV

SEQ ID NO: 121928 - protein, 15 aa, Borrelia burgdorferi
IRLSNRYQSYLEGVK

SEQ ID NO: 121929 - protein, 15 aa, Borrelia burgdorferi
RLSNRYQSYLEGVKY

SEQ ID NO: 121930 - protein, 15 aa, Borrelia burgdorferi
LSNRYQSYLEGVKYN

SEQ ID NO: 121931 - protein, 15 aa, Borrelia burgdorferi
SNRYQSYLEGVKYNV

SEQ ID NO: 121932 - protein, 15 aa, Borrelia burgdorferi
NRYQSYLEGVKYNVD

SEQ ID NO: 121933 - protein, 15 aa, Borrelia burgdorferi
RYQSYLEGVKYNVDS

SEQ ID NO: 121934 - protein, 15 aa, Borrelia burgdorferi
YQSYLEGVKYNVDSA

SEQ ID NO: 121935 - protein, 15 aa, Borrelia burgdorferi
QSYLEGVKYNVDSAI

SEQ ID NO: 121936 - protein, 15 aa, Borrelia burgdorferi
SYLEGVKYNVDSAIN

SEQ ID NO: 121937 - protein, 15 aa, Borrelia burgdorferi
YLEGVKYNVDSAINT

SEQ ID NO: 121938 - protein, 15 aa, Borrelia burgdorferi
LEGVKYNVDSAINTI

SEQ ID NO: 121939 - protein, 15 aa, Borrelia burgdorferi
EGVKYNVDSAINTIN

SEQ ID NO: 121940 - protein, 15 aa, Borrelia burgdorferi
GVKYNVDSAINTINK

SEQ ID NO: 121941 - protein, 15 aa, Borrelia burgdorferi
VKYNVDSAINTINKI

SEQ ID NO: 121942 - protein, 15 aa, Borrelia burgdorferi
KYNVDSAINTINKIY

SEQ ID NO: 121943 - protein, 15 aa, Borrelia burgdorferi
YNVDSAINTINKIYD

SEQ ID NO: 121944 - protein, 15 aa, Borrelia burgdorferi
NVDSAINTINKIYDT

SEQ ID NO: 121945 - protein, 15 aa, Borrelia burgdorferi
VDSAINTINKIYDTY

SEQ ID NO: 121946 - protein, 15 aa, Borrelia burgdorferi
DSAINTINKIYDTYT

SEQ ID NO: 121947 - protein, 15 aa, Borrelia burgdorferi
SAINTINKIYDTYTL

SEQ ID NO: 121948 - protein, 15 aa, Borrelia burgdorferi
AINTINKIYDTYTLF

SEQ ID NO: 121949 - protein, 15 aa, Borrelia burgdorferi
INTINKIYDTYTLFS

SEQ ID NO: 121950 - protein, 15 aa, Borrelia burgdorferi
NTINKIYDTYTLFST

SEQ ID NO: 121951 - protein, 15 aa, Borrelia burgdorferi
TINKIYDTYTLFSTK

SEQ ID NO: 121952 - protein, 15 aa, Borrelia burgdorferi
INKIYDTYTLFSTKL

SEQ ID NO: 121953 - protein, 15 aa, Borrelia burgdorferi
NKIYDTYTLFSTKLT

SEQ ID NO: 121954 - protein, 15 aa, Borrelia burgdorferi
KIYDTYTLFSTKLTQ

SEQ ID NO: 121955 - protein, 15 aa, Borrelia burgdorferi
IYDTYTLFSTKLTQM

SEQ ID NO: 121956 - protein, 15 aa, Borrelia burgdorferi
YDTYTLFSTKLTQMY

SEQ ID NO: 121957 - protein, 15 aa, Borrelia burgdorferi
DTYTLFSTKLTQMYS

SEQ ID NO: 121958 - protein, 15 aa, Borrelia burgdorferi
TYTLFSTKLTQMYST

SEQ ID NO: 121959 - protein, 15 aa, Borrelia burgdorferi
YTLFSTKLTQMYSTR

SEQ ID NO: 121960 - protein, 15 aa, Borrelia burgdorferi
TLFSTKLTQMYSTRL

SEQ ID NO: 121961 - protein, 15 aa, Borrelia burgdorferi
LFSTKLTQMYSTRLD

SEQ ID NO: 121962 - protein, 15 aa, Borrelia burgdorferi
FSTKLTQMYSTRLDN

SEQ ID NO: 121963 - protein, 15 aa, Borrelia burgdorferi
STKLTQMYSTRLDNL

SEQ ID NO: 121964 - protein, 15 aa, Borrelia burgdorferi
TKLTQMYSTRLDNLA

SEQ ID NO: 121965 - protein, 15 aa, Borrelia burgdorferi
KLTQMYSTRLDNLAK

SEQ ID NO: 121966 - protein, 15 aa, Borrelia burgdorferi
LTQMYSTRLDNLAKA

SEQ ID NO: 121967 - protein, 15 aa, Borrelia burgdorferi
TQMYSTRLDNLAKAK

SEQ ID NO: 121968 - protein, 15 aa, Borrelia burgdorferi
QMYSTRLDNLAKAKA

SEQ ID NO: 121969 - protein, 15 aa, Borrelia burgdorferi
MYSTRLDNLAKAKAK

SEQ ID NO: 121970 - protein, 15 aa, Borrelia burgdorferi
YSTRLDNLAKAKAKE

SEQ ID NO: 121971 - protein, 15 aa, Borrelia burgdorferi
STRLDNLAKAKAKEE

SEQ ID NO: 121972 - protein, 15 aa, Borrelia burgdorferi
TRLDNLAKAKAKEEA

SEQ ID NO: 121973 - protein, 15 aa, Borrelia burgdorferi
RLDNLAKAKAKEEAA

SEQ ID NO: 121974 - protein, 15 aa, Borrelia burgdorferi
LDNLAKAKAKEEAAK

SEQ ID NO: 121975 - protein, 15 aa, Borrelia burgdorferi
DNLAKAKAKEEAAKF

SEQ ID NO: 121976 - protein, 15 aa, Borrelia burgdorferi
NLAKAKAKEEAAKFT

SEQ ID NO: 121977 - protein, 15 aa, Borrelia burgdorferi
LAKAKAKEEAAKFTK

SEQ ID NO: 121978 - protein, 15 aa, Borrelia burgdorferi
AKAKAKEEAAKFTKE

SEQ ID NO: 121979 - protein, 15 aa, Borrelia burgdorferi
KAKAKEEAAKFTKED

SEQ ID NO: 121980 - protein, 15 aa, Borrelia burgdorferi
AKAKEEAAKFTKEDL

SEQ ID NO: 121981 - protein, 15 aa, Borrelia burgdorferi
KAKEEAAKFTKEDLE

SEQ ID NO: 121982 - protein, 15 aa, Borrelia burgdorferi
AKEEAAKFTKEDLEK

SEQ ID NO: 121983 - protein, 15 aa, Borrelia burgdorferi
KEEAAKFTKEDLEKN

SEQ ID NO: 121984 - protein, 15 aa, Borrelia burgdorferi
EEAAKFTKEDLEKNF

SEQ ID NO: 121985 - protein, 15 aa, Borrelia burgdorferi
EAAKFTKEDLEKNFK

SEQ ID NO: 121986 - protein, 15 aa, Borrelia burgdorferi
AAKFTKEDLEKNFKT

SEQ ID NO: 121987 - protein, 15 aa, Borrelia burgdorferi
AKFTKEDLEKNFKTL

SEQ ID NO: 121988 - protein, 15 aa, Borrelia burgdorferi
KFTKEDLEKNFKTLL

SEQ ID NO: 121989 - protein, 15 aa, Borrelia burgdorferi
FTKEDLEKNFKTLLN

SEQ ID NO: 121990 - protein, 15 aa, Borrelia burgdorferi
TKEDLEKNFKTLLNY

SEQ ID NO: 121991 - protein, 15 aa, Borrelia burgdorferi
KEDLEKNFKTLLNYI

SEQ ID NO: 121992 - protein, 15 aa, Borrelia burgdorferi
EDLEKNFKTLLNYIQ

SEQ ID NO: 121993 - protein, 15 aa, Borrelia burgdorferi
DLEKNFKTLLNYIQV

SEQ ID NO: 121994 - protein, 15 aa, Borrelia burgdorferi
LEKNFKTLLNYIQVS

SEQ ID NO: 121995 - protein, 15 aa, Borrelia burgdorferi
EKNFKTLLNYIQVSV

SEQ ID NO: 121996 - protein, 15 aa, Borrelia burgdorferi
KNFKTLLNYIQVSVK

SEQ ID NO: 121997 - protein, 15 aa, Borrelia burgdorferi
NFKTLLNYIQVSVKT

SEQ ID NO: 121998 - protein, 15 aa, Borrelia burgdorferi
FKTLLNYIQVSVKTA

SEQ ID NO: 121999 - protein, 15 aa, Borrelia burgdorferi
KTLLNYIQVSVKTAA

SEQ ID NO: 122000 - protein, 15 aa, Borrelia burgdorferi
TLLNYIQVSVKTAAN

SEQ ID NO: 122001 - protein, 15 aa, Borrelia burgdorferi
LLNYIQVSVKTAANF

SEQ ID NO: 122002 - protein, 15 aa, Borrelia burgdorferi
LNYIQVSVKTAANFV

SEQ ID NO: 122003 - protein, 15 aa, Borrelia burgdorferi
NYIQVSVKTAANFVY

SEQ ID NO: 122004 - protein, 15 aa, Borrelia burgdorferi
YIQVSVKTAANFVYI

SEQ ID NO: 122005 - protein, 15 aa, Borrelia burgdorferi
IQVSVKTAANFVYIN

SEQ ID NO: 122006 - protein, 15 aa, Borrelia burgdorferi
QVSVKTAANFVYIND

SEQ ID NO: 122007 - protein, 15 aa, Borrelia burgdorferi
VSVKTAANFVYINDT

SEQ ID NO: 122008 - protein, 15 aa, Borrelia burgdorferi
SVKTAANFVYINDTH

SEQ ID NO: 122009 - protein, 15 aa, Borrelia burgdorferi
VKTAANFVYINDTHA

SEQ ID NO: 122010 - protein, 15 aa, Borrelia burgdorferi
KTAANFVYINDTHAK

SEQ ID NO: 122011 - protein, 15 aa, Borrelia burgdorferi
TAANFVYINDTHAKR

SEQ ID NO: 122012 - protein, 15 aa, Borrelia burgdorferi
AANFVYINDTHAKRK

SEQ ID NO: 122013 - protein, 15 aa, Borrelia burgdorferi
ANFVYINDTHAKRKL

SEQ ID NO: 122014 - protein, 15 aa, Borrelia burgdorferi
NFVYINDTHAKRKLE

SEQ ID NO: 122015 - protein, 15 aa, Borrelia burgdorferi
FVYINDTHAKRKLEN

SEQ ID NO: 122016 - protein, 15 aa, Borrelia burgdorferi
VYINDTHAKRKLENI

SEQ ID NO: 122017 - protein, 15 aa, Borrelia burgdorferi
YINDTHAKRKLENIE

SEQ ID NO: 122018 - protein, 15 aa, Borrelia burgdorferi
INDTHAKRKLENIEA

SEQ ID NO: 122019 - protein, 15 aa, Borrelia burgdorferi
NDTHAKRKLENIEAE

SEQ ID NO: 122020 - protein, 15 aa, Borrelia burgdorferi
DTHAKRKLENIEAEI

SEQ ID NO: 122021 - protein, 15 aa, Borrelia burgdorferi
THAKRKLENIEAEIK

SEQ ID NO: 122022 - protein, 15 aa, Borrelia burgdorferi
HAKRKLENIEAEIKT

SEQ ID NO: 122023 - protein, 15 aa, Borrelia burgdorferi
AKRKLENIEAEIKTL

SEQ ID NO: 122024 - protein, 15 aa, Borrelia burgdorferi
KRKLENIEAEIKTLI

SEQ ID NO: 122025 - protein, 15 aa, Borrelia burgdorferi
RKLENIEAEIKTLIA

SEQ ID NO: 122026 - protein, 15 aa, Borrelia burgdorferi
KLENIEAEIKTLIAK

SEQ ID NO: 122027 - protein, 15 aa, Borrelia burgdorferi
LENIEAEIKTLIAKI

SEQ ID NO: 122028 - protein, 15 aa, Borrelia burgdorferi
ENIEAEIKTLIAKIK

SEQ ID NO: 122029 - protein, 15 aa, Borrelia burgdorferi
NIEAEIKTLIAKIKE

SEQ ID NO: 122030 - protein, 15 aa, Borrelia burgdorferi
IEAEIKTLIAKIKEQ

SEQ ID NO: 122031 - protein, 15 aa, Borrelia burgdorferi
EAEIKTLIAKIKEQS

SEQ ID NO: 122032 - protein, 15 aa, Borrelia burgdorferi
AEIKTLIAKIKEQSN

SEQ ID NO: 122033 - protein, 15 aa, Borrelia burgdorferi
EIKTLIAKIKEQSNL

SEQ ID NO: 122034 - protein, 15 aa, Borrelia burgdorferi
IKTLIAKIKEQSNLY

SEQ ID NO: 122035 - protein, 15 aa, Borrelia burgdorferi
KTLIAKIKEQSNLYE

SEQ ID NO: 122036 - protein, 15 aa, Borrelia burgdorferi
TLIAKIKEQSNLYEA

SEQ ID NO: 122037 - protein, 15 aa, Borrelia burgdorferi
LIAKIKEQSNLYEAY

SEQ ID NO: 122038 - protein, 15 aa, Borrelia burgdorferi
IAKIKEQSNLYEAYK

SEQ ID NO: 122039 - protein, 15 aa, Borrelia burgdorferi
AKIKEQSNLYEAYKA

SEQ ID NO: 122040 - protein, 15 aa, Borrelia burgdorferi
KIKEQSNLYEAYKAI

SEQ ID NO: 122041 - protein, 15 aa, Borrelia burgdorferi
IKEQSNLYEAYKAIV

SEQ ID NO: 122042 - protein, 15 aa, Borrelia burgdorferi
KEQSNLYEAYKAIVT

SEQ ID NO: 122043 - protein, 15 aa, Borrelia burgdorferi
EQSNLYEAYKAIVTS

SEQ ID NO: 122044 - protein, 15 aa, Borrelia burgdorferi
QSNLYEAYKAIVTSI

SEQ ID NO: 122045 - protein, 15 aa, Borrelia burgdorferi
SNLYEAYKAIVTSIL

SEQ ID NO: 122046 - protein, 15 aa, Borrelia burgdorferi
NLYEAYKAIVTSILL

SEQ ID NO: 122047 - protein, 15 aa, Borrelia burgdorferi
LYEAYKAIVTSILLM

SEQ ID NO: 122048 - protein, 15 aa, Borrelia burgdorferi
YEAYKAIVTSILLMR

SEQ ID NO: 122049 - protein, 15 aa, Borrelia burgdorferi
EAYKAIVTSILLMRD

SEQ ID NO: 122050 - protein, 15 aa, Borrelia burgdorferi
AYKAIVTSILLMRDS

SEQ ID NO: 122051 - protein, 15 aa, Borrelia burgdorferi
YKAIVTSILLMRDSL

SEQ ID NO: 122052 - protein, 15 aa, Borrelia burgdorferi
KAIVTSILLMRDSLK

SEQ ID NO: 122053 - protein, 15 aa, Borrelia burgdorferi
AIVTSILLMRDSLKE

SEQ ID NO: 122054 - protein, 15 aa, Borrelia burgdorferi
IVTSILLMRDSLKEV

SEQ ID NO: 122055 - protein, 15 aa, Borrelia burgdorferi
VTSILLMRDSLKEVQ

SEQ ID NO: 122056 - protein, 15 aa, Borrelia burgdorferi
TSILLMRDSLKEVQG

SEQ ID NO: 122057 - protein, 15 aa, Borrelia burgdorferi
SILLMRDSLKEVQGI

SEQ ID NO: 122058 - protein, 15 aa, Borrelia burgdorferi
ILLMRDSLKEVQGII

SEQ ID NO: 122059 - protein, 15 aa, Borrelia burgdorferi
LLMRDSLKEVQGIID

SEQ ID NO: 122060 - protein, 15 aa, Borrelia burgdorferi
LMRDSLKEVQGIIDK

SEQ ID NO: 122061 - protein, 15 aa, Borrelia burgdorferi
MRDSLKEVQGIIDKN

SEQ ID NO: 122062 - protein, 15 aa, Borrelia burgdorferi
RDSLKEVQGIIDKNG

SEQ ID NO: 122063 - protein, 15 aa, Borrelia burgdorferi
DSLKEVQGIIDKNGV

SEQ ID NO: 122064 - protein, 15 aa, Borrelia burgdorferi
SLKEVQGIIDKNGVW

SEQ ID NO: 122065 - protein, 15 aa, Borrelia burgdorferi
LKEVQGIIDKNGVWY

SEQ ID NO: 122066 - protein, 16 aa, Borrelia burgdorferi
MKKVKSKYLALGLLFG

SEQ ID NO: 122067 - protein, 16 aa, Borrelia burgdorferi
KKVKSKYLALGLLFGF

SEQ ID NO: 122068 - protein, 16 aa, Borrelia burgdorferi
KVKSKYLALGLLFGFI

SEQ ID NO: 122069 - protein, 16 aa, Borrelia burgdorferi
VKSKYLALGLLFGFIS

SEQ ID NO: 122070 - protein, 16 aa, Borrelia burgdorferi
KSKYLALGLLFGFISC

SEQ ID NO: 122071 - protein, 16 aa, Borrelia burgdorferi
SKYLALGLLFGFISCD

SEQ ID NO: 122072 - protein, 16 aa, Borrelia burgdorferi
KYLALGLLFGFISCDL

SEQ ID NO: 122073 - protein, 16 aa, Borrelia burgdorferi
YLALGLLFGFISCDLF

SEQ ID NO: 122074 - protein, 16 aa, Borrelia burgdorferi
LALGLLFGFISCDLFI

SEQ ID NO: 122075 - protein, 16 aa, Borrelia burgdorferi
ALGLLFGFISCDLFIR

SEQ ID NO: 122076 - protein, 16 aa, Borrelia burgdorferi
LGLLFGFISCDLFIRY

SEQ ID NO: 122077 - protein, 16 aa, Borrelia burgdorferi
GLLFGFISCDLFIRYE

SEQ ID NO: 122078 - protein, 16 aa, Borrelia burgdorferi
LLFGFISCDLFIRYEM

SEQ ID NO: 122079 - protein, 16 aa, Borrelia burgdorferi
LFGFISCDLFIRYEMK

SEQ ID NO: 122080 - protein, 16 aa, Borrelia burgdorferi
FGFISCDLFIRYEMKE

SEQ ID NO: 122081 - protein, 16 aa, Borrelia burgdorferi
GFISCDLFIRYEMKEE

SEQ ID NO: 122082 - protein, 16 aa, Borrelia burgdorferi
FISCDLFIRYEMKEES

SEQ ID NO: 122083 - protein, 16 aa, Borrelia burgdorferi
ISCDLFIRYEMKEESP

SEQ ID NO: 122084 - protein, 16 aa, Borrelia burgdorferi
SCDLFIRYEMKEESPG

SEQ ID NO: 122085 - protein, 16 aa, Borrelia burgdorferi
CDLFIRYEMKEESPGL

SEQ ID NO: 122086 - protein, 16 aa, Borrelia burgdorferi
DLFIRYEMKEESPGLF

SEQ ID NO: 122087 - protein, 16 aa, Borrelia burgdorferi
LFIRYEMKEESPGLFD

SEQ ID NO: 122088 - protein, 16 aa, Borrelia burgdorferi
FIRYEMKEESPGLFDK

SEQ ID NO: 122089 - protein, 16 aa, Borrelia burgdorferi
IRYEMKEESPGLFDKG

SEQ ID NO: 122090 - protein, 16 aa, Borrelia burgdorferi
RYEMKEESPGLFDKGN

SEQ ID NO: 122091 - protein, 16 aa, Borrelia burgdorferi
YEMKEESPGLFDKGNS

SEQ ID NO: 122092 - protein, 16 aa, Borrelia burgdorferi
EMKEESPGLFDKGNSI

SEQ ID NO: 122093 - protein, 16 aa, Borrelia burgdorferi
MKEESPGLFDKGNSIL

SEQ ID NO: 122094 - protein, 16 aa, Borrelia burgdorferi
KEESPGLFDKGNSILE

SEQ ID NO: 122095 - protein, 16 aa, Borrelia burgdorferi
EESPGLFDKGNSILET

SEQ ID NO: 122096 - protein, 16 aa, Borrelia burgdorferi
ESPGLFDKGNSILETS

SEQ ID NO: 122097 - protein, 16 aa, Borrelia burgdorferi
SPGLFDKGNSILETSE

SEQ ID NO: 122098 - protein, 16 aa, Borrelia burgdorferi
PGLFDKGNSILETSEE

SEQ ID NO: 122099 - protein, 16 aa, Borrelia burgdorferi
GLFDKGNSILETSEES

SEQ ID NO: 122100 - protein, 16 aa, Borrelia burgdorferi
LFDKGNSILETSEESI

SEQ ID NO: 122101 - protein, 16 aa, Borrelia burgdorferi
FDKGNSILETSEESIK

SEQ ID NO: 122102 - protein, 16 aa, Borrelia burgdorferi
DKGNSILETSEESIKK

SEQ ID NO: 122103 - protein, 16 aa, Borrelia burgdorferi
KGNSILETSEESIKKP

SEQ ID NO: 122104 - protein, 16 aa, Borrelia burgdorferi
GNSILETSEESIKKPM

SEQ ID NO: 122105 - protein, 16 aa, Borrelia burgdorferi
NSILETSEESIKKPMN

SEQ ID NO: 122106 - protein, 16 aa, Borrelia burgdorferi
SILETSEESIKKPMNK

SEQ ID NO: 122107 - protein, 16 aa, Borrelia burgdorferi
ILETSEESIKKPMNKK

SEQ ID NO: 122108 - protein, 16 aa, Borrelia burgdorferi
LETSEESIKKPMNKKG

SEQ ID NO: 122109 - protein, 16 aa, Borrelia burgdorferi
ETSEESIKKPMNKKGK

SEQ ID NO: 122110 - protein, 16 aa, Borrelia burgdorferi
TSEESIKKPMNKKGKG

SEQ ID NO: 122111 - protein, 16 aa, Borrelia burgdorferi
SEESIKKPMNKKGKGK

SEQ ID NO: 122112 - protein, 16 aa, Borrelia burgdorferi
EESIKKPMNKKGKGKI

SEQ ID NO: 122113 - protein, 16 aa, Borrelia burgdorferi
ESIKKPMNKKGKGKIA

SEQ ID NO: 122114 - protein, 16 aa, Borrelia burgdorferi
SIKKPMNKKGKGKIAR

SEQ ID NO: 122115 - protein, 16 aa, Borrelia burgdorferi
IKKPMNKKGKGKIARK

SEQ ID NO: 122116 - protein, 16 aa, Borrelia burgdorferi
KKPMNKKGKGKIARKK

SEQ ID NO: 122117 - protein, 16 aa, Borrelia burgdorferi
KPMNKKGKGKIARKKG

SEQ ID NO: 122118 - protein, 16 aa, Borrelia burgdorferi
PMNKKGKGKIARKKGK

SEQ ID NO: 122119 - protein, 16 aa, Borrelia burgdorferi
MNKKGKGKIARKKGKS

SEQ ID NO: 122120 - protein, 16 aa, Borrelia burgdorferi
NKKGKGKIARKKGKSK

SEQ ID NO: 122121 - protein, 16 aa, Borrelia burgdorferi
KKGKGKIARKKGKSKV

SEQ ID NO: 122122 - protein, 16 aa, Borrelia burgdorferi
KGKGKIARKKGKSKVS

SEQ ID NO: 122123 - protein, 16 aa, Borrelia burgdorferi
GKGKIARKKGKSKVSR

SEQ ID NO: 122124 - protein, 16 aa, Borrelia burgdorferi
KGKIARKKGKSKVSRK

SEQ ID NO: 122125 - protein, 16 aa, Borrelia burgdorferi
GKIARKKGKSKVSRKE

SEQ ID NO: 122126 - protein, 16 aa, Borrelia burgdorferi
KIARKKGKSKVSRKEP

SEQ ID NO: 122127 - protein, 16 aa, Borrelia burgdorferi
IARKKGKSKVSRKEPY

SEQ ID NO: 122128 - protein, 16 aa, Borrelia burgdorferi
ARKKGKSKVSRKEPYI

SEQ ID NO: 122129 - protein, 16 aa, Borrelia burgdorferi
RKKGKSKVSRKEPYIH

SEQ ID NO: 122130 - protein, 16 aa, Borrelia burgdorferi
KKGKSKVSRKEPYIHS

SEQ ID NO: 122131 - protein, 16 aa, Borrelia burgdorferi
KGKSKVSRKEPYIHSL

SEQ ID NO: 122132 - protein, 16 aa, Borrelia burgdorferi
GKSKVSRKEPYIHSLK

SEQ ID NO: 122133 - protein, 16 aa, Borrelia burgdorferi
KSKVSRKEPYIHSLKR

SEQ ID NO: 122134 - protein, 16 aa, Borrelia burgdorferi
SKVSRKEPYIHSLKRD

SEQ ID NO: 122135 - protein, 16 aa, Borrelia burgdorferi
KVSRKEPYIHSLKRDS

SEQ ID NO: 122136 - protein, 16 aa, Borrelia burgdorferi
VSRKEPYIHSLKRDSA

SEQ ID NO: 122137 - protein, 16 aa, Borrelia burgdorferi
SRKEPYIHSLKRDSAN

SEQ ID NO: 122138 - protein, 16 aa, Borrelia burgdorferi
RKEPYIHSLKRDSANK

SEQ ID NO: 122139 - protein, 16 aa, Borrelia burgdorferi
KEPYIHSLKRDSANKS

SEQ ID NO: 122140 - protein, 16 aa, Borrelia burgdorferi
EPYIHSLKRDSANKSN

SEQ ID NO: 122141 - protein, 16 aa, Borrelia burgdorferi
PYIHSLKRDSANKSNF

SEQ ID NO: 122142 - protein, 16 aa, Borrelia burgdorferi
YIHSLKRDSANKSNFL

SEQ ID NO: 122143 - protein, 16 aa, Borrelia burgdorferi
IHSLKRDSANKSNFLQ

SEQ ID NO: 122144 - protein, 16 aa, Borrelia burgdorferi
HSLKRDSANKSNFLQK

SEQ ID NO: 122145 - protein, 16 aa, Borrelia burgdorferi
SLKRDSANKSNFLQKN

SEQ ID NO: 122146 - protein, 16 aa, Borrelia burgdorferi
LKRDSANKSNFLQKNV

SEQ ID NO: 122147 - protein, 16 aa, Borrelia burgdorferi
KRDSANKSNFLQKNVI

SEQ ID NO: 122148 - protein, 16 aa, Borrelia burgdorferi
RDSANKSNFLQKNVIL

SEQ ID NO: 122149 - protein, 16 aa, Borrelia burgdorferi
DSANKSNFLQKNVILE

SEQ ID NO: 122150 - protein, 16 aa, Borrelia burgdorferi
SANKSNFLQKNVILEE

SEQ ID NO: 122151 - protein, 16 aa, Borrelia burgdorferi
ANKSNFLQKNVILEEE

SEQ ID NO: 122152 - protein, 16 aa, Borrelia burgdorferi
NKSNFLQKNVILEEES

SEQ ID NO: 122153 - protein, 16 aa, Borrelia burgdorferi
KSNFLQKNVILEEESL

SEQ ID NO: 122154 - protein, 16 aa, Borrelia burgdorferi
SNFLQKNVILEEESLK

SEQ ID NO: 122155 - protein, 16 aa, Borrelia burgdorferi
NFLQKNVILEEESLKT

SEQ ID NO: 122156 - protein, 16 aa, Borrelia burgdorferi
FLQKNVILEEESLKTE

SEQ ID NO: 122157 - protein, 16 aa, Borrelia burgdorferi
LQKNVILEEESLKTEL

SEQ ID NO: 122158 - protein, 16 aa, Borrelia burgdorferi
QKNVILEEESLKTELL

SEQ ID NO: 122159 - protein, 16 aa, Borrelia burgdorferi
KNVILEEESLKTELLK

SEQ ID NO: 122160 - protein, 16 aa, Borrelia burgdorferi
NVILEEESLKTELLKE

SEQ ID NO: 122161 - protein, 16 aa, Borrelia burgdorferi
VILEEESLKTELLKEQ

SEQ ID NO: 122162 - protein, 16 aa, Borrelia burgdorferi
ILEEESLKTELLKEQS

SEQ ID NO: 122163 - protein, 16 aa, Borrelia burgdorferi
LEEESLKTELLKEQSE

SEQ ID NO: 122164 - protein, 16 aa, Borrelia burgdorferi
EEESLKTELLKEQSET

SEQ ID NO: 122165 - protein, 16 aa, Borrelia burgdorferi
EESLKTELLKEQSETR

SEQ ID NO: 122166 - protein, 16 aa, Borrelia burgdorferi
ESLKTELLKEQSETRK

SEQ ID NO: 122167 - protein, 16 aa, Borrelia burgdorferi
SLKTELLKEQSETRKE

SEQ ID NO: 122168 - protein, 16 aa, Borrelia burgdorferi
LKTELLKEQSETRKEK

SEQ ID NO: 122169 - protein, 16 aa, Borrelia burgdorferi
KTELLKEQSETRKEKI

SEQ ID NO: 122170 - protein, 16 aa, Borrelia burgdorferi
TELLKEQSETRKEKIQ

SEQ ID NO: 122171 - protein, 16 aa, Borrelia burgdorferi
ELLKEQSETRKEKIQK

SEQ ID NO: 122172 - protein, 16 aa, Borrelia burgdorferi
LLKEQSETRKEKIQKQ

SEQ ID NO: 122173 - protein, 16 aa, Borrelia burgdorferi
LKEQSETRKEKIQKQQ

SEQ ID NO: 122174 - protein, 16 aa, Borrelia burgdorferi
KEQSETRKEKIQKQQD

SEQ ID NO: 122175 - protein, 16 aa, Borrelia burgdorferi
EQSETRKEKIQKQQDE

SEQ ID NO: 122176 - protein, 16 aa, Borrelia burgdorferi
QSETRKEKIQKQQDEY

SEQ ID NO: 122177 - protein, 16 aa, Borrelia burgdorferi
SETRKEKIQKQQDEYK

SEQ ID NO: 122178 - protein, 16 aa, Borrelia burgdorferi
ETRKEKIQKQQDEYKG

SEQ ID NO: 122179 - protein, 16 aa, Borrelia burgdorferi
TRKEKIQKQQDEYKGM

SEQ ID NO: 122180 - protein, 16 aa, Borrelia burgdorferi
RKEKIQKQQDEYKGMT

SEQ ID NO: 122181 - protein, 16 aa, Borrelia burgdorferi
KEKIQKQQDEYKGMTQ

SEQ ID NO: 122182 - protein, 16 aa, Borrelia burgdorferi
EKIQKQQDEYKGMTQG

SEQ ID NO: 122183 - protein, 16 aa, Borrelia burgdorferi
KIQKQQDEYKGMTQGS

SEQ ID NO: 122184 - protein, 16 aa, Borrelia burgdorferi
IQKQQDEYKGMTQGSL

SEQ ID NO: 122185 - protein, 16 aa, Borrelia burgdorferi
QKQQDEYKGMTQGSLN

SEQ ID NO: 122186 - protein, 16 aa, Borrelia burgdorferi
KQQDEYKGMTQGSLNS

SEQ ID NO: 122187 - protein, 16 aa, Borrelia burgdorferi
QQDEYKGMTQGSLNSL

SEQ ID NO: 122188 - protein, 16 aa, Borrelia burgdorferi
QDEYKGMTQGSLNSLS

SEQ ID NO: 122189 - protein, 16 aa, Borrelia burgdorferi
DEYKGMTQGSLNSLSG

SEQ ID NO: 122190 - protein, 16 aa, Borrelia burgdorferi
EYKGMTQGSLNSLSGE

SEQ ID NO: 122191 - protein, 16 aa, Borrelia burgdorferi
YKGMTQGSLNSLSGES

SEQ ID NO: 122192 - protein, 16 aa, Borrelia burgdorferi
KGMTQGSLNSLSGESG

SEQ ID NO: 122193 - protein, 16 aa, Borrelia burgdorferi
GMTQGSLNSLSGESGE

SEQ ID NO: 122194 - protein, 16 aa, Borrelia burgdorferi
MTQGSLNSLSGESGEL

SEQ ID NO: 122195 - protein, 16 aa, Borrelia burgdorferi
TQGSLNSLSGESGELK

SEQ ID NO: 122196 - protein, 16 aa, Borrelia burgdorferi
QGSLNSLSGESGELKE

SEQ ID NO: 122197 - protein, 16 aa, Borrelia burgdorferi
GSLNSLSGESGELKET

SEQ ID NO: 122198 - protein, 16 aa, Borrelia burgdorferi
SLNSLSGESGELKETI

SEQ ID NO: 122199 - protein, 16 aa, Borrelia burgdorferi
LNSLSGESGELKETIE

SEQ ID NO: 122200 - protein, 16 aa, Borrelia burgdorferi
NSLSGESGELKETIES

SEQ ID NO: 122201 - protein, 16 aa, Borrelia burgdorferi
SLSGESGELKETIESN

SEQ ID NO: 122202 - protein, 16 aa, Borrelia burgdorferi
LSGESGELKETIESNE

SEQ ID NO: 122203 - protein, 16 aa, Borrelia burgdorferi
SGESGELKETIESNEI

SEQ ID NO: 122204 - protein, 16 aa, Borrelia burgdorferi
GESGELKETIESNEID

SEQ ID NO: 122205 - protein, 16 aa, Borrelia burgdorferi
ESGELKETIESNEIDI

SEQ ID NO: 122206 - protein, 16 aa, Borrelia burgdorferi
SGELKETIESNEIDIT

SEQ ID NO: 122207 - protein, 16 aa, Borrelia burgdorferi
GELKETIESNEIDITI

SEQ ID NO: 122208 - protein, 16 aa, Borrelia burgdorferi
ELKETIESNEIDITID

SEQ ID NO: 122209 - protein, 16 aa, Borrelia burgdorferi
LKETIESNEIDITIDS

SEQ ID NO: 122210 - protein, 16 aa, Borrelia burgdorferi
KETIESNEIDITIDSD

SEQ ID NO: 122211 - protein, 16 aa, Borrelia burgdorferi
ETIESNEIDITIDSDL

SEQ ID NO: 122212 - protein, 16 aa, Borrelia burgdorferi
TIESNEIDITIDSDLR

SEQ ID NO: 122213 - protein, 16 aa, Borrelia burgdorferi
IESNEIDITIDSDLRP

SEQ ID NO: 122214 - protein, 16 aa, Borrelia burgdorferi
ESNEIDITIDSDLRPK

SEQ ID NO: 122215 - protein, 16 aa, Borrelia burgdorferi
SNEIDITIDSDLRPKS

SEQ ID NO: 122216 - protein, 16 aa, Borrelia burgdorferi
NEIDITIDSDLRPKSS

SEQ ID NO: 122217 - protein, 16 aa, Borrelia burgdorferi
EIDITIDSDLRPKSSL

SEQ ID NO: 122218 - protein, 16 aa, Borrelia burgdorferi
IDITIDSDLRPKSSLQ

SEQ ID NO: 122219 - protein, 16 aa, Borrelia burgdorferi
DITIDSDLRPKSSLQD

SEQ ID NO: 122220 - protein, 16 aa, Borrelia burgdorferi
ITIDSDLRPKSSLQDI

SEQ ID NO: 122221 - protein, 16 aa, Borrelia burgdorferi
TIDSDLRPKSSLQDIA

SEQ ID NO: 122222 - protein, 16 aa, Borrelia burgdorferi
IDSDLRPKSSLQDIAG

SEQ ID NO: 122223 - protein, 16 aa, Borrelia burgdorferi
DSDLRPKSSLQDIAGS

SEQ ID NO: 122224 - protein, 16 aa, Borrelia burgdorferi
SDLRPKSSLQDIAGSN

SEQ ID NO: 122225 - protein, 16 aa, Borrelia burgdorferi
DLRPKSSLQDIAGSNS

SEQ ID NO: 122226 - protein, 16 aa, Borrelia burgdorferi
LRPKSSLQDIAGSNSI

SEQ ID NO: 122227 - protein, 16 aa, Borrelia burgdorferi
RPKSSLQDIAGSNSIS

SEQ ID NO: 122228 - protein, 16 aa, Borrelia burgdorferi
PKSSLQDIAGSNSISY

SEQ ID NO: 122229 - protein, 16 aa, Borrelia burgdorferi
KSSLQDIAGSNSISYT

SEQ ID NO: 122230 - protein, 16 aa, Borrelia burgdorferi
SSLQDIAGSNSISYTD

SEQ ID NO: 122231 - protein, 16 aa, Borrelia burgdorferi
SLQDIAGSNSISYTDE

SEQ ID NO: 122232 - protein, 16 aa, Borrelia burgdorferi
LQDIAGSNSISYTDEI

SEQ ID NO: 122233 - protein, 16 aa, Borrelia burgdorferi
QDIAGSNSISYTDEIE

SEQ ID NO: 122234 - protein, 16 aa, Borrelia burgdorferi
DIAGSNSISYTDEIEE

SEQ ID NO: 122235 - protein, 16 aa, Borrelia burgdorferi
IAGSNSISYTDEIEEE

SEQ ID NO: 122236 - protein, 16 aa, Borrelia burgdorferi
AGSNSISYTDEIEEED

SEQ ID NO: 122237 - protein, 16 aa, Borrelia burgdorferi
GSNSISYTDEIEEEDY

SEQ ID NO: 122238 - protein, 16 aa, Borrelia burgdorferi
SNSISYTDEIEEEDYA

SEQ ID NO: 122239 - protein, 16 aa, Borrelia burgdorferi
NSISYTDEIEEEDYAR

SEQ ID NO: 122240 - protein, 16 aa, Borrelia burgdorferi
SISYTDEIEEEDYARY

SEQ ID NO: 122241 - protein, 16 aa, Borrelia burgdorferi
ISYTDEIEEEDYARYY

SEQ ID NO: 122242 - protein, 16 aa, Borrelia burgdorferi
SYTDEIEEEDYARYYL

SEQ ID NO: 122243 - protein, 16 aa, Borrelia burgdorferi
YTDEIEEEDYARYYLD

SEQ ID NO: 122244 - protein, 16 aa, Borrelia burgdorferi
TDEIEEEDYARYYLDE

SEQ ID NO: 122245 - protein, 16 aa, Borrelia burgdorferi
DEIEEEDYARYYLDED

SEQ ID NO: 122246 - protein, 16 aa, Borrelia burgdorferi
EIEEEDYARYYLDEDD

SEQ ID NO: 122247 - protein, 16 aa, Borrelia burgdorferi
IEEEDYARYYLDEDDE

SEQ ID NO: 122248 - protein, 16 aa, Borrelia burgdorferi
EEEDYARYYLDEDDED

SEQ ID NO: 122249 - protein, 16 aa, Borrelia burgdorferi
EEDYARYYLDEDDEDD

SEQ ID NO: 122250 - protein, 16 aa, Borrelia burgdorferi
EDYARYYLDEDDEDDE

SEQ ID NO: 122251 - protein, 16 aa, Borrelia burgdorferi
DYARYYLDEDDEDDEY

SEQ ID NO: 122252 - protein, 16 aa, Borrelia burgdorferi
YARYYLDEDDEDDEYY

SEQ ID NO: 122253 - protein, 16 aa, Borrelia burgdorferi
ARYYLDEDDEDDEYYE

SEQ ID NO: 122254 - protein, 16 aa, Borrelia burgdorferi
RYYLDEDDEDDEYYED

SEQ ID NO: 122255 - protein, 16 aa, Borrelia burgdorferi
YYLDEDDEDDEYYEDD

SEQ ID NO: 122256 - protein, 16 aa, Borrelia burgdorferi
YLDEDDEDDEYYEDDY

SEQ ID NO: 122257 - protein, 16 aa, Borrelia burgdorferi
LDEDDEDDEYYEDDYE

SEQ ID NO: 122258 - protein, 16 aa, Borrelia burgdorferi
DEDDEDDEYYEDDYEE

SEQ ID NO: 122259 - protein, 16 aa, Borrelia burgdorferi
EDDEDDEYYEDDYEEI

SEQ ID NO: 122260 - protein, 16 aa, Borrelia burgdorferi
DDEDDEYYEDDYEEIR

SEQ ID NO: 122261 - protein, 16 aa, Borrelia burgdorferi
DEDDEYYEDDYEEIRL

SEQ ID NO: 122262 - protein, 16 aa, Borrelia burgdorferi
EDDEYYEDDYEEIRLS

SEQ ID NO: 122263 - protein, 16 aa, Borrelia burgdorferi
DDEYYEDDYEEIRLSN

SEQ ID NO: 122264 - protein, 16 aa, Borrelia burgdorferi
DEYYEDDYEEIRLSNR

SEQ ID NO: 122265 - protein, 16 aa, Borrelia burgdorferi
EYYEDDYEEIRLSNRY

SEQ ID NO: 122266 - protein, 16 aa, Borrelia burgdorferi
YYEDDYEEIRLSNRYQ

SEQ ID NO: 122267 - protein, 16 aa, Borrelia burgdorferi
YEDDYEEIRLSNRYQS

SEQ ID NO: 122268 - protein, 16 aa, Borrelia burgdorferi
EDDYEEIRLSNRYQSY

SEQ ID NO: 122269 - protein, 16 aa, Borrelia burgdorferi
DDYEEIRLSNRYQSYL

SEQ ID NO: 122270 - protein, 16 aa, Borrelia burgdorferi
DYEEIRLSNRYQSYLE

SEQ ID NO: 122271 - protein, 16 aa, Borrelia burgdorferi
YEEIRLSNRYQSYLEG

SEQ ID NO: 122272 - protein, 16 aa, Borrelia burgdorferi
EEIRLSNRYQSYLEGV

SEQ ID NO: 122273 - protein, 16 aa, Borrelia burgdorferi
EIRLSNRYQSYLEGVK

SEQ ID NO: 122274 - protein, 16 aa, Borrelia burgdorferi
IRLSNRYQSYLEGVKY

SEQ ID NO: 122275 - protein, 16 aa, Borrelia burgdorferi
RLSNRYQSYLEGVKYN

SEQ ID NO: 122276 - protein, 16 aa, Borrelia burgdorferi
LSNRYQSYLEGVKYNV

SEQ ID NO: 122277 - protein, 16 aa, Borrelia burgdorferi
SNRYQSYLEGVKYNVD

SEQ ID NO: 122278 - protein, 16 aa, Borrelia burgdorferi
NRYQSYLEGVKYNVDS

SEQ ID NO: 122279 - protein, 16 aa, Borrelia burgdorferi
RYQSYLEGVKYNVDSA

SEQ ID NO: 122280 - protein, 16 aa, Borrelia burgdorferi
YQSYLEGVKYNVDSAI

SEQ ID NO: 122281 - protein, 16 aa, Borrelia burgdorferi
QSYLEGVKYNVDSAIN

SEQ ID NO: 122282 - protein, 16 aa, Borrelia burgdorferi
SYLEGVKYNVDSAINT

SEQ ID NO: 122283 - protein, 16 aa, Borrelia burgdorferi
YLEGVKYNVDSAINTI

SEQ ID NO: 122284 - protein, 16 aa, Borrelia burgdorferi
LEGVKYNVDSAINTIN

SEQ ID NO: 122285 - protein, 16 aa, Borrelia burgdorferi
EGVKYNVDSAINTINK

SEQ ID NO: 122286 - protein, 16 aa, Borrelia burgdorferi
GVKYNVDSAINTINKI

SEQ ID NO: 122287 - protein, 16 aa, Borrelia burgdorferi
VKYNVDSAINTINKIY

SEQ ID NO: 122288 - protein, 16 aa, Borrelia burgdorferi
KYNVDSAINTINKIYD

SEQ ID NO: 122289 - protein, 16 aa, Borrelia burgdorferi
YNVDSAINTINKIYDT

SEQ ID NO: 122290 - protein, 16 aa, Borrelia burgdorferi
NVDSAINTINKIYDTY

SEQ ID NO: 122291 - protein, 16 aa, Borrelia burgdorferi
VDSAINTINKIYDTYT

SEQ ID NO: 122292 - protein, 16 aa, Borrelia burgdorferi
DSAINTINKIYDTYTL

SEQ ID NO: 122293 - protein, 16 aa, Borrelia burgdorferi
SAINTINKIYDTYTLF

SEQ ID NO: 122294 - protein, 16 aa, Borrelia burgdorferi
AINTINKIYDTYTLFS

SEQ ID NO: 122295 - protein, 16 aa, Borrelia burgdorferi
INTINKIYDTYTLFST

SEQ ID NO: 122296 - protein, 16 aa, Borrelia burgdorferi
NTINKIYDTYTLFSTK

SEQ ID NO: 122297 - protein, 16 aa, Borrelia burgdorferi
TINKIYDTYTLFSTKL

SEQ ID NO: 122298 - protein, 16 aa, Borrelia burgdorferi
INKIYDTYTLFSTKLT

SEQ ID NO: 122299 - protein, 16 aa, Borrelia burgdorferi
NKIYDTYTLFSTKLTQ

SEQ ID NO: 122300 - protein, 16 aa, Borrelia burgdorferi
KIYDTYTLFSTKLTQM

SEQ ID NO: 122301 - protein, 16 aa, Borrelia burgdorferi
IYDTYTLFSTKLTQMY

SEQ ID NO: 122302 - protein, 16 aa, Borrelia burgdorferi
YDTYTLFSTKLTQMYS

SEQ ID NO: 122303 - protein, 16 aa, Borrelia burgdorferi
DTYTLFSTKLTQMYST

SEQ ID NO: 122304 - protein, 16 aa, Borrelia burgdorferi
TYTLFSTKLTQMYSTR

SEQ ID NO: 122305 - protein, 16 aa, Borrelia burgdorferi
YTLFSTKLTQMYSTRL

SEQ ID NO: 122306 - protein, 16 aa, Borrelia burgdorferi
TLFSTKLTQMYSTRLD

SEQ ID NO: 122307 - protein, 16 aa, Borrelia burgdorferi
LFSTKLTQMYSTRLDN

SEQ ID NO: 122308 - protein, 16 aa, Borrelia burgdorferi
FSTKLTQMYSTRLDNL

SEQ ID NO: 122309 - protein, 16 aa, Borrelia burgdorferi
STKLTQMYSTRLDNLA

SEQ ID NO: 122310 - protein, 16 aa, Borrelia burgdorferi
TKLTQMYSTRLDNLAK

SEQ ID NO: 122311 - protein, 16 aa, Borrelia burgdorferi
KLTQMYSTRLDNLAKA

SEQ ID NO: 122312 - protein, 16 aa, Borrelia burgdorferi
LTQMYSTRLDNLAKAK

SEQ ID NO: 122313 - protein, 16 aa, Borrelia burgdorferi
TQMYSTRLDNLAKAKA

SEQ ID NO: 122314 - protein, 16 aa, Borrelia burgdorferi
QMYSTRLDNLAKAKAK

SEQ ID NO: 122315 - protein, 16 aa, Borrelia burgdorferi
MYSTRLDNLAKAKAKE

SEQ ID NO: 122316 - protein, 16 aa, Borrelia burgdorferi
YSTRLDNLAKAKAKEE

SEQ ID NO: 122317 - protein, 16 aa, Borrelia burgdorferi
STRLDNLAKAKAKEEA

SEQ ID NO: 122318 - protein, 16 aa, Borrelia burgdorferi
TRLDNLAKAKAKEEAA

SEQ ID NO: 122319 - protein, 16 aa, Borrelia burgdorferi
RLDNLAKAKAKEEAAK

SEQ ID NO: 122320 - protein, 16 aa, Borrelia burgdorferi
LDNLAKAKAKEEAAKF

SEQ ID NO: 122321 - protein, 16 aa, Borrelia burgdorferi
DNLAKAKAKEEAAKFT

SEQ ID NO: 122322 - protein, 16 aa, Borrelia burgdorferi
NLAKAKAKEEAAKFTK

SEQ ID NO: 122323 - protein, 16 aa, Borrelia burgdorferi
LAKAKAKEEAAKFTKE

SEQ ID NO: 122324 - protein, 16 aa, Borrelia burgdorferi
AKAKAKEEAAKFTKED

SEQ ID NO: 122325 - protein, 16 aa, Borrelia burgdorferi
KAKAKEEAAKFTKEDL

SEQ ID NO: 122326 - protein, 16 aa, Borrelia burgdorferi
AKAKEEAAKFTKEDLE

SEQ ID NO: 122327 - protein, 16 aa, Borrelia burgdorferi
KAKEEAAKFTKEDLEK

SEQ ID NO: 122328 - protein, 16 aa, Borrelia burgdorferi
AKEEAAKFTKEDLEKN

SEQ ID NO: 122329 - protein, 16 aa, Borrelia burgdorferi
KEEAAKFTKEDLEKNF

SEQ ID NO: 122330 - protein, 16 aa, Borrelia burgdorferi
EEAAKFTKEDLEKNFK

SEQ ID NO: 122331 - protein, 16 aa, Borrelia burgdorferi
EAAKFTKEDLEKNFKT

SEQ ID NO: 122332 - protein, 16 aa, Borrelia burgdorferi
AAKFTKEDLEKNFKTL

SEQ ID NO: 122333 - protein, 16 aa, Borrelia burgdorferi
AKFTKEDLEKNFKTLL

SEQ ID NO: 122334 - protein, 16 aa, Borrelia burgdorferi
KFTKEDLEKNFKTLLN

SEQ ID NO: 122335 - protein, 16 aa, Borrelia burgdorferi
FTKEDLEKNFKTLLNY

SEQ ID NO: 122336 - protein, 16 aa, Borrelia burgdorferi
TKEDLEKNFKTLLNYI

SEQ ID NO: 122337 - protein, 16 aa, Borrelia burgdorferi
KEDLEKNFKTLLNYIQ

SEQ ID NO: 122338 - protein, 16 aa, Borrelia burgdorferi
EDLEKNFKTLLNYIQV

SEQ ID NO: 122339 - protein, 16 aa, Borrelia burgdorferi
DLEKNFKTLLNYIQVS

SEQ ID NO: 122340 - protein, 16 aa, Borrelia burgdorferi
LEKNFKTLLNYIQVSV

SEQ ID NO: 122341 - protein, 16 aa, Borrelia burgdorferi
EKNFKTLLNYIQVSVK

SEQ ID NO: 122342 - protein, 16 aa, Borrelia burgdorferi
KNFKTLLNYIQVSVKT

SEQ ID NO: 122343 - protein, 16 aa, Borrelia burgdorferi
NFKTLLNYIQVSVKTA

SEQ ID NO: 122344 - protein, 16 aa, Borrelia burgdorferi
FKTLLNYIQVSVKTAA

SEQ ID NO: 122345 - protein, 16 aa, Borrelia burgdorferi
KTLLNYIQVSVKTAAN

SEQ ID NO: 122346 - protein, 16 aa, Borrelia burgdorferi
TLLNYIQVSVKTAANF

SEQ ID NO: 122347 - protein, 16 aa, Borrelia burgdorferi
LLNYIQVSVKTAANFV

SEQ ID NO: 122348 - protein, 16 aa, Borrelia burgdorferi
LNYIQVSVKTAANFVY

SEQ ID NO: 122349 - protein, 16 aa, Borrelia burgdorferi
NYIQVSVKTAANFVYI

SEQ ID NO: 122350 - protein, 16 aa, Borrelia burgdorferi
YIQVSVKTAANFVYIN

SEQ ID NO: 122351 - protein, 16 aa, Borrelia burgdorferi
IQVSVKTAANFVYIND

SEQ ID NO: 122352 - protein, 16 aa, Borrelia burgdorferi
QVSVKTAANFVYINDT

SEQ ID NO: 122353 - protein, 16 aa, Borrelia burgdorferi
VSVKTAANFVYINDTH

SEQ ID NO: 122354 - protein, 16 aa, Borrelia burgdorferi
SVKTAANFVYINDTHA

SEQ ID NO: 122355 - protein, 16 aa, Borrelia burgdorferi
VKTAANFVYINDTHAK

SEQ ID NO: 122356 - protein, 16 aa, Borrelia burgdorferi
KTAANFVYINDTHAKR

SEQ ID NO: 122357 - protein, 16 aa, Borrelia burgdorferi
TAANFVYINDTHAKRK

SEQ ID NO: 122358 - protein, 16 aa, Borrelia burgdorferi
AANFVYINDTHAKRKL

SEQ ID NO: 122359 - protein, 16 aa, Borrelia burgdorferi
ANFVYINDTHAKRKLE

SEQ ID NO: 122360 - protein, 16 aa, Borrelia burgdorferi
NFVYINDTHAKRKLEN

SEQ ID NO: 122361 - protein, 16 aa, Borrelia burgdorferi
FVYINDTHAKRKLENI

SEQ ID NO: 122362 - protein, 16 aa, Borrelia burgdorferi
VYINDTHAKRKLENIE

SEQ ID NO: 122363 - protein, 16 aa, Borrelia burgdorferi
YINDTHAKRKLENIEA

SEQ ID NO: 122364 - protein, 16 aa, Borrelia burgdorferi
INDTHAKRKLENIEAE

SEQ ID NO: 122365 - protein, 16 aa, Borrelia burgdorferi
NDTHAKRKLENIEAEI

SEQ ID NO: 122366 - protein, 16 aa, Borrelia burgdorferi
DTHAKRKLENIEAEIK

SEQ ID NO: 122367 - protein, 16 aa, Borrelia burgdorferi
THAKRKLENIEAEIKT

SEQ ID NO: 122368 - protein, 16 aa, Borrelia burgdorferi
HAKRKLENIEAEIKTL

SEQ ID NO: 122369 - protein, 16 aa, Borrelia burgdorferi
AKRKLENIEAEIKTLI

SEQ ID NO: 122370 - protein, 16 aa, Borrelia burgdorferi
KRKLENIEAEIKTLIA

SEQ ID NO: 122371 - protein, 16 aa, Borrelia burgdorferi
RKLENIEAEIKTLIAK

SEQ ID NO: 122372 - protein, 16 aa, Borrelia burgdorferi
KLENIEAEIKTLIAKI

SEQ ID NO: 122373 - protein, 16 aa, Borrelia burgdorferi
LENIEAEIKTLIAKIK

SEQ ID NO: 122374 - protein, 16 aa, Borrelia burgdorferi
ENIEAEIKTLIAKIKE

SEQ ID NO: 122375 - protein, 16 aa, Borrelia burgdorferi
NIEAEIKTLIAKIKEQ

SEQ ID NO: 122376 - protein, 16 aa, Borrelia burgdorferi
IEAEIKTLIAKIKEQS

SEQ ID NO: 122377 - protein, 16 aa, Borrelia burgdorferi
EAEIKTLIAKIKEQSN

SEQ ID NO: 122378 - protein, 16 aa, Borrelia burgdorferi
AEIKTLIAKIKEQSNL

SEQ ID NO: 122379 - protein, 16 aa, Borrelia burgdorferi
EIKTLIAKIKEQSNLY

SEQ ID NO: 122380 - protein, 16 aa, Borrelia burgdorferi
IKTLIAKIKEQSNLYE

SEQ ID NO: 122381 - protein, 16 aa, Borrelia burgdorferi
KTLIAKIKEQSNLYEA

SEQ ID NO: 122382 - protein, 16 aa, Borrelia burgdorferi
TLIAKIKEQSNLYEAY

SEQ ID NO: 122383 - protein, 16 aa, Borrelia burgdorferi
LIAKIKEQSNLYEAYK

SEQ ID NO: 122384 - protein, 16 aa, Borrelia burgdorferi
IAKIKEQSNLYEAYKA

SEQ ID NO: 122385 - protein, 16 aa, Borrelia burgdorferi
AKIKEQSNLYEAYKAI

SEQ ID NO: 122386 - protein, 16 aa, Borrelia burgdorferi
KIKEQSNLYEAYKAIV

SEQ ID NO: 122387 - protein, 16 aa, Borrelia burgdorferi
IKEQSNLYEAYKAIVT

SEQ ID NO: 122388 - protein, 16 aa, Borrelia burgdorferi
KEQSNLYEAYKAIVTS

SEQ ID NO: 122389 - protein, 16 aa, Borrelia burgdorferi
EQSNLYEAYKAIVTSI

SEQ ID NO: 122390 - protein, 16 aa, Borrelia burgdorferi
QSNLYEAYKAIVTSIL

SEQ ID NO: 122391 - protein, 16 aa, Borrelia burgdorferi
SNLYEAYKAIVTSILL

SEQ ID NO: 122392 - protein, 16 aa, Borrelia burgdorferi
NLYEAYKAIVTSILLM

SEQ ID NO: 122393 - protein, 16 aa, Borrelia burgdorferi
LYEAYKAIVTSILLMR

SEQ ID NO: 122394 - protein, 16 aa, Borrelia burgdorferi
YEAYKAIVTSILLMRD

SEQ ID NO: 122395 - protein, 16 aa, Borrelia burgdorferi
EAYKAIVTSILLMRDS

SEQ ID NO: 122396 - protein, 16 aa, Borrelia burgdorferi
AYKAIVTSILLMRDSL

SEQ ID NO: 122397 - protein, 16 aa, Borrelia burgdorferi
YKAIVTSILLMRDSLK

SEQ ID NO: 122398 - protein, 16 aa, Borrelia burgdorferi
KAIVTSILLMRDSLKE

SEQ ID NO: 122399 - protein, 16 aa, Borrelia burgdorferi
AIVTSILLMRDSLKEV

SEQ ID NO: 122400 - protein, 16 aa, Borrelia burgdorferi
IVTSILLMRDSLKEVQ

SEQ ID NO: 122401 - protein, 16 aa, Borrelia burgdorferi
VTSILLMRDSLKEVQG

SEQ ID NO: 122402 - protein, 16 aa, Borrelia burgdorferi
TSILLMRDSLKEVQGI

SEQ ID NO: 122403 - protein, 16 aa, Borrelia burgdorferi
SILLMRDSLKEVQGII

SEQ ID NO: 122404 - protein, 16 aa, Borrelia burgdorferi
ILLMRDSLKEVQGIID

SEQ ID NO: 122405 - protein, 16 aa, Borrelia burgdorferi
LLMRDSLKEVQGIIDK

SEQ ID NO: 122406 - protein, 16 aa, Borrelia burgdorferi
LMRDSLKEVQGIIDKN

SEQ ID NO: 122407 - protein, 16 aa, Borrelia burgdorferi
MRDSLKEVQGIIDKNG

SEQ ID NO: 122408 - protein, 16 aa, Borrelia burgdorferi
RDSLKEVQGIIDKNGV

SEQ ID NO: 122409 - protein, 16 aa, Borrelia burgdorferi
DSLKEVQGIIDKNGVW

SEQ ID NO: 122410 - protein, 16 aa, Borrelia burgdorferi
SLKEVQGIIDKNGVWY

SEQ ID NO: 122411 - protein, 13 aa, Borrelia afzelii
MKIKSKCLALGLL

SEQ ID NO: 122412 - protein, 13 aa, Borrelia afzelii
KIKSKCLALGLLF

SEQ ID NO: 122413 - protein, 13 aa, Borrelia afzelii
IKSKCLALGLLFG

SEQ ID NO: 122414 - protein, 13 aa, Borrelia afzelii
KSKCLALGLLFGF

SEQ ID NO: 122415 - protein, 13 aa, Borrelia afzelii
SKCLALGLLFGFI

SEQ ID NO: 122416 - protein, 13 aa, Borrelia afzelii
KCLALGLLFGFIS

SEQ ID NO: 122417 - protein, 13 aa, Borrelia afzelii
CLALGLLFGFISC

SEQ ID NO: 122418 - protein, 13 aa, Borrelia afzelii
LALGLLFGFISCD

SEQ ID NO: 122419 - protein, 13 aa, Borrelia afzelii
ALGLLFGFISCDL

SEQ ID NO: 122420 - protein, 13 aa, Borrelia afzelii
LGLLFGFISCDLF

SEQ ID NO: 122421 - protein, 13 aa, Borrelia afzelii
GLLFGFISCDLFI

SEQ ID NO: 122422 - protein, 13 aa, Borrelia afzelii
LLFGFISCDLFIR

SEQ ID NO: 122423 - protein, 13 aa, Borrelia afzelii
LFGFISCDLFIRD

SEQ ID NO: 122424 - protein, 13 aa, Borrelia afzelii
FGFISCDLFIRDE

SEQ ID NO: 122425 - protein, 13 aa, Borrelia afzelii
GFISCDLFIRDEI

SEQ ID NO: 122426 - protein, 13 aa, Borrelia afzelii
FISCDLFIRDEIK

SEQ ID NO: 122427 - protein, 13 aa, Borrelia afzelii
ISCDLFIRDEIKE

SEQ ID NO: 122428 - protein, 13 aa, Borrelia afzelii
SCDLFIRDEIKEK

SEQ ID NO: 122429 - protein, 13 aa, Borrelia afzelii
CDLFIRDEIKEKS

SEQ ID NO: 122430 - protein, 13 aa, Borrelia afzelii
DLFIRDEIKEKSL

SEQ ID NO: 122431 - protein, 13 aa, Borrelia afzelii
LFIRDEIKEKSLG

SEQ ID NO: 122432 - protein, 13 aa, Borrelia afzelii
FIRDEIKEKSLGL

SEQ ID NO: 122433 - protein, 13 aa, Borrelia afzelii
IRDEIKEKSLGLC

SEQ ID NO: 122434 - protein, 13 aa, Borrelia afzelii
RDEIKEKSLGLCD

SEQ ID NO: 122435 - protein, 13 aa, Borrelia afzelii
DEIKEKSLGLCDE

SEQ ID NO: 122436 - protein, 13 aa, Borrelia afzelii
EIKEKSLGLCDEE

SEQ ID NO: 122437 - protein, 13 aa, Borrelia afzelii
IKEKSLGLCDEES

SEQ ID NO: 122438 - protein, 13 aa, Borrelia afzelii
KEKSLGLCDEESS

SEQ ID NO: 122439 - protein, 13 aa, Borrelia afzelii
EKSLGLCDEESSI

SEQ ID NO: 122440 - protein, 13 aa, Borrelia afzelii
KSLGLCDEESSIL

SEQ ID NO: 122441 - protein, 13 aa, Borrelia afzelii
SLGLCDEESSILE

SEQ ID NO: 122442 - protein, 13 aa, Borrelia afzelii
LGLCDEESSILET

SEQ ID NO: 122443 - protein, 13 aa, Borrelia afzelii
GLCDEESSILETG

SEQ ID NO: 122444 - protein, 13 aa, Borrelia afzelii
LCDEESSILETGD

SEQ ID NO: 122445 - protein, 13 aa, Borrelia afzelii
CDEESSILETGDK

SEQ ID NO: 122446 - protein, 13 aa, Borrelia afzelii
DEESSILETGDKS

SEQ ID NO: 122447 - protein, 13 aa, Borrelia afzelii
EESSILETGDKSV

SEQ ID NO: 122448 - protein, 13 aa, Borrelia afzelii
ESSILETGDKSVK

SEQ ID NO: 122449 - protein, 13 aa, Borrelia afzelii
SSILETGDKSVKK

SEQ ID NO: 122450 - protein, 13 aa, Borrelia afzelii
SILETGDKSVKKS

SEQ ID NO: 122451 - protein, 13 aa, Borrelia afzelii
ILETGDKSVKKSL

SEQ ID NO: 122452 - protein, 13 aa, Borrelia afzelii
LETGDKSVKKSLN

SEQ ID NO: 122453 - protein, 13 aa, Borrelia afzelii
ETGDKSVKKSLNK

SEQ ID NO: 122454 - protein, 13 aa, Borrelia afzelii
TGDKSVKKSLNKK

SEQ ID NO: 122455 - protein, 13 aa, Borrelia afzelii
GDKSVKKSLNKKG

SEQ ID NO: 122456 - protein, 13 aa, Borrelia afzelii
DKSVKKSLNKKGK

SEQ ID NO: 122457 - protein, 13 aa, Borrelia afzelii
KSVKKSLNKKGKD

SEQ ID NO: 122458 - protein, 13 aa, Borrelia afzelii
SVKKSLNKKGKDK

SEQ ID NO: 122459 - protein, 13 aa, Borrelia afzelii
VKKSLNKKGKDKV

SEQ ID NO: 122460 - protein, 13 aa, Borrelia afzelii
KKSLNKKGKDKVA

SEQ ID NO: 122461 - protein, 13 aa, Borrelia afzelii
KSLNKKGKDKVAR

SEQ ID NO: 122462 - protein, 13 aa, Borrelia afzelii
SLNKKGKDKVARK

SEQ ID NO: 122463 - protein, 13 aa, Borrelia afzelii
LNKKGKDKVARKK

SEQ ID NO: 122464 - protein, 13 aa, Borrelia afzelii
NKKGKDKVARKKV

SEQ ID NO: 122465 - protein, 13 aa, Borrelia afzelii
KKGKDKVARKKVE

SEQ ID NO: 122466 - protein, 13 aa, Borrelia afzelii
KGKDKVARKKVEG

SEQ ID NO: 122467 - protein, 13 aa, Borrelia afzelii
GKDKVARKKVEGN

SEQ ID NO: 122468 - protein, 13 aa, Borrelia afzelii
KDKVARKKVEGNA

SEQ ID NO: 122469 - protein, 13 aa, Borrelia afzelii
DKVARKKVEGNAV

SEQ ID NO: 122470 - protein, 13 aa, Borrelia afzelii
KVARKKVEGNAVK

SEQ ID NO: 122471 - protein, 13 aa, Borrelia afzelii
VARKKVEGNAVKK

SEQ ID NO: 122472 - protein, 13 aa, Borrelia afzelii
ARKKVEGNAVKKD

SEQ ID NO: 122473 - protein, 13 aa, Borrelia afzelii
RKKVEGNAVKKDP

SEQ ID NO: 122474 - protein, 13 aa, Borrelia afzelii
KKVEGNAVKKDPF

SEQ ID NO: 122475 - protein, 13 aa, Borrelia afzelii
KVEGNAVKKDPFN

SEQ ID NO: 122476 - protein, 13 aa, Borrelia afzelii
VEGNAVKKDPFNH

SEQ ID NO: 122477 - protein, 13 aa, Borrelia afzelii
EGNAVKKDPFNHH

SEQ ID NO: 122478 - protein, 13 aa, Borrelia afzelii
GNAVKKDPFNHHV

SEQ ID NO: 122479 - protein, 13 aa, Borrelia afzelii
NAVKKDPFNHHVK

SEQ ID NO: 122480 - protein, 13 aa, Borrelia afzelii
AVKKDPFNHHVKR

SEQ ID NO: 122481 - protein, 13 aa, Borrelia afzelii
VKKDPFNHHVKRE

SEQ ID NO: 122482 - protein, 13 aa, Borrelia afzelii
KKDPFNHHVKRES

SEQ ID NO: 122483 - protein, 13 aa, Borrelia afzelii
KDPFNHHVKRESV

SEQ ID NO: 122484 - protein, 13 aa, Borrelia afzelii
DPFNHHVKRESVN

SEQ ID NO: 122485 - protein, 13 aa, Borrelia afzelii
PFNHHVKRESVNN

SEQ ID NO: 122486 - protein, 13 aa, Borrelia afzelii
FNHHVKRESVNNS

SEQ ID NO: 122487 - protein, 13 aa, Borrelia afzelii
NHHVKRESVNNSN

SEQ ID NO: 122488 - protein, 13 aa, Borrelia afzelii
HHVKRESVNNSNL

SEQ ID NO: 122489 - protein, 13 aa, Borrelia afzelii
HVKRESVNNSNLS

SEQ ID NO: 122490 - protein, 13 aa, Borrelia afzelii
VKRESVNNSNLSQ

SEQ ID NO: 122491 - protein, 13 aa, Borrelia afzelii
KRESVNNSNLSQK

SEQ ID NO: 122492 - protein, 13 aa, Borrelia afzelii
RESVNNSNLSQKN

SEQ ID NO: 122493 - protein, 13 aa, Borrelia afzelii
ESVNNSNLSQKNV

SEQ ID NO: 122494 - protein, 13 aa, Borrelia afzelii
SVNNSNLSQKNVI

SEQ ID NO: 122495 - protein, 13 aa, Borrelia afzelii
VNNSNLSQKNVIS

SEQ ID NO: 122496 - protein, 13 aa, Borrelia afzelii
NNSNLSQKNVISE

SEQ ID NO: 122497 - protein, 13 aa, Borrelia afzelii
NSNLSQKNVISEE

SEQ ID NO: 122498 - protein, 13 aa, Borrelia afzelii
SNLSQKNVISEEE

SEQ ID NO: 122499 - protein, 13 aa, Borrelia afzelii
NLSQKNVISEEEI

SEQ ID NO: 122500 - protein, 13 aa, Borrelia afzelii
LSQKNVISEEEIL

SEQ ID NO: 122501 - protein, 13 aa, Borrelia afzelii
SQKNVISEEEILK

SEQ ID NO: 122502 - protein, 13 aa, Borrelia afzelii
QKNVISEEEILKT

SEQ ID NO: 122503 - protein, 13 aa, Borrelia afzelii
KNVISEEEILKTK

SEQ ID NO: 122504 - protein, 13 aa, Borrelia afzelii
NVISEEEILKTKL

SEQ ID NO: 122505 - protein, 13 aa, Borrelia afzelii
VISEEEILKTKLL

SEQ ID NO: 122506 - protein, 13 aa, Borrelia afzelii
ISEEEILKTKLLR

SEQ ID NO: 122507 - protein, 13 aa, Borrelia afzelii
SEEEILKTKLLRE

SEQ ID NO: 122508 - protein, 13 aa, Borrelia afzelii
EEEILKTKLLRER

SEQ ID NO: 122509 - protein, 13 aa, Borrelia afzelii
EEILKTKLLRERP

SEQ ID NO: 122510 - protein, 13 aa, Borrelia afzelii
EILKTKLLRERPE

SEQ ID NO: 122511 - protein, 13 aa, Borrelia afzelii
ILKTKLLRERPET

SEQ ID NO: 122512 - protein, 13 aa, Borrelia afzelii
LKTKLLRERPETR

SEQ ID NO: 122513 - protein, 13 aa, Borrelia afzelii
KTKLLRERPETRK

SEQ ID NO: 122514 - protein, 13 aa, Borrelia afzelii
TKLLRERPETRKE

SEQ ID NO: 122515 - protein, 13 aa, Borrelia afzelii
KLLRERPETRKEE

SEQ ID NO: 122516 - protein, 13 aa, Borrelia afzelii
LLRERPETRKEEI

SEQ ID NO: 122517 - protein, 13 aa, Borrelia afzelii
LRERPETRKEEIQ

SEQ ID NO: 122518 - protein, 13 aa, Borrelia afzelii
RERPETRKEEIQK

SEQ ID NO: 122519 - protein, 13 aa, Borrelia afzelii
ERPETRKEEIQKQ

SEQ ID NO: 122520 - protein, 13 aa, Borrelia afzelii
RPETRKEEIQKQQ

SEQ ID NO: 122521 - protein, 13 aa, Borrelia afzelii
PETRKEEIQKQQD

SEQ ID NO: 122522 - protein, 13 aa, Borrelia afzelii
ETRKEEIQKQQDE

SEQ ID NO: 122523 - protein, 13 aa, Borrelia afzelii
TRKEEIQKQQDEH

SEQ ID NO: 122524 - protein, 13 aa, Borrelia afzelii
RKEEIQKQQDEHK

SEQ ID NO: 122525 - protein, 13 aa, Borrelia afzelii
KEEIQKQQDEHKR

SEQ ID NO: 122526 - protein, 13 aa, Borrelia afzelii
EEIQKQQDEHKRM

SEQ ID NO: 122527 - protein, 13 aa, Borrelia afzelii
EIQKQQDEHKRML

SEQ ID NO: 122528 - protein, 13 aa, Borrelia afzelii
IQKQQDEHKRMLQ

SEQ ID NO: 122529 - protein, 13 aa, Borrelia afzelii
QKQQDEHKRMLQG

SEQ ID NO: 122530 - protein, 13 aa, Borrelia afzelii
KQQDEHKRMLQGS

SEQ ID NO: 122531 - protein, 13 aa, Borrelia afzelii
QQDEHKRMLQGSL

SEQ ID NO: 122532 - protein, 13 aa, Borrelia afzelii
QDEHKRMLQGSLS

SEQ ID NO: 122533 - protein, 13 aa, Borrelia afzelii
DEHKRMLQGSLSF

SEQ ID NO: 122534 - protein, 13 aa, Borrelia afzelii
EHKRMLQGSLSFL

SEQ ID NO: 122535 - protein, 13 aa, Borrelia afzelii
HKRMLQGSLSFLS

SEQ ID NO: 122536 - protein, 13 aa, Borrelia afzelii
KRMLQGSLSFLSG

SEQ ID NO: 122537 - protein, 13 aa, Borrelia afzelii
RMLQGSLSFLSGE

SEQ ID NO: 122538 - protein, 13 aa, Borrelia afzelii
MLQGSLSFLSGES

SEQ ID NO: 122539 - protein, 13 aa, Borrelia afzelii
LQGSLSFLSGESG

SEQ ID NO: 122540 - protein, 13 aa, Borrelia afzelii
QGSLSFLSGESGE

SEQ ID NO: 122541 - protein, 13 aa, Borrelia afzelii
GSLSFLSGESGEL

SEQ ID NO: 122542 - protein, 13 aa, Borrelia afzelii
SLSFLSGESGELK

SEQ ID NO: 122543 - protein, 13 aa, Borrelia afzelii
LSFLSGESGELKD

SEQ ID NO: 122544 - protein, 13 aa, Borrelia afzelii
SFLSGESGELKDT

SEQ ID NO: 122545 - protein, 13 aa, Borrelia afzelii
FLSGESGELKDTI

SEQ ID NO: 122546 - protein, 13 aa, Borrelia afzelii
LSGESGELKDTIE

SEQ ID NO: 122547 - protein, 13 aa, Borrelia afzelii
SGESGELKDTIES

SEQ ID NO: 122548 - protein, 13 aa, Borrelia afzelii
GESGELKDTIESN

SEQ ID NO: 122549 - protein, 13 aa, Borrelia afzelii
ESGELKDTIESNE

SEQ ID NO: 122550 - protein, 13 aa, Borrelia afzelii
SGELKDTIESNEI

SEQ ID NO: 122551 - protein, 13 aa, Borrelia afzelii
GELKDTIESNEID

SEQ ID NO: 122552 - protein, 13 aa, Borrelia afzelii
ELKDTIESNEIDF

SEQ ID NO: 122553 - protein, 13 aa, Borrelia afzelii
LKDTIESNEIDFT

SEQ ID NO: 122554 - protein, 13 aa, Borrelia afzelii
KDTIESNEIDFTI

SEQ ID NO: 122555 - protein, 13 aa, Borrelia afzelii
DTIESNEIDFTID

SEQ ID NO: 122556 - protein, 13 aa, Borrelia afzelii
TIESNEIDFTIDS

SEQ ID NO: 122557 - protein, 13 aa, Borrelia afzelii
IESNEIDFTIDSD

SEQ ID NO: 122558 - protein, 13 aa, Borrelia afzelii
ESNEIDFTIDSDL

SEQ ID NO: 122559 - protein, 13 aa, Borrelia afzelii
SNEIDFTIDSDLR

SEQ ID NO: 122560 - protein, 13 aa, Borrelia afzelii
NEIDFTIDSDLRL

SEQ ID NO: 122561 - protein, 13 aa, Borrelia afzelii
EIDFTIDSDLRLK

SEQ ID NO: 122562 - protein, 13 aa, Borrelia afzelii
IDFTIDSDLRLKS

SEQ ID NO: 122563 - protein, 13 aa, Borrelia afzelii
DFTIDSDLRLKSD

SEQ ID NO: 122564 - protein, 13 aa, Borrelia afzelii
FTIDSDLRLKSDL

SEQ ID NO: 122565 - protein, 13 aa, Borrelia afzelii
TIDSDLRLKSDLQ

SEQ ID NO: 122566 - protein, 13 aa, Borrelia afzelii
IDSDLRLKSDLQA

SEQ ID NO: 122567 - protein, 13 aa, Borrelia afzelii
DSDLRLKSDLQAI

SEQ ID NO: 122568 - protein, 13 aa, Borrelia afzelii
SDLRLKSDLQAIS

SEQ ID NO: 122569 - protein, 13 aa, Borrelia afzelii
DLRLKSDLQAISG

SEQ ID NO: 122570 - protein, 13 aa, Borrelia afzelii
LRLKSDLQAISGS

SEQ ID NO: 122571 - protein, 13 aa, Borrelia afzelii
RLKSDLQAISGSN

SEQ ID NO: 122572 - protein, 13 aa, Borrelia afzelii
LKSDLQAISGSNS

SEQ ID NO: 122573 - protein, 13 aa, Borrelia afzelii
KSDLQAISGSNSI

SEQ ID NO: 122574 - protein, 13 aa, Borrelia afzelii
SDLQAISGSNSIS

SEQ ID NO: 122575 - protein, 13 aa, Borrelia afzelii
DLQAISGSNSISY

SEQ ID NO: 122576 - protein, 13 aa, Borrelia afzelii
LQAISGSNSISYT

SEQ ID NO: 122577 - protein, 13 aa, Borrelia afzelii
QAISGSNSISYTD

SEQ ID NO: 122578 - protein, 13 aa, Borrelia afzelii
AISGSNSISYTDE

SEQ ID NO: 122579 - protein, 13 aa, Borrelia afzelii
ISGSNSISYTDEI

SEQ ID NO: 122580 - protein, 13 aa, Borrelia afzelii
SGSNSISYTDEIE

SEQ ID NO: 122581 - protein, 13 aa, Borrelia afzelii
GSNSISYTDEIEE

SEQ ID NO: 122582 - protein, 13 aa, Borrelia afzelii
SNSISYTDEIEEE

SEQ ID NO: 122583 - protein, 13 aa, Borrelia afzelii
NSISYTDEIEEED

SEQ ID NO: 122584 - protein, 13 aa, Borrelia afzelii
SISYTDEIEEEDY

SEQ ID NO: 122585 - protein, 13 aa, Borrelia afzelii
ISYTDEIEEEDYD

SEQ ID NO: 122586 - protein, 13 aa, Borrelia afzelii
SYTDEIEEEDYDQ

SEQ ID NO: 122587 - protein, 13 aa, Borrelia afzelii
YTDEIEEEDYDQY

SEQ ID NO: 122588 - protein, 13 aa, Borrelia afzelii
TDEIEEEDYDQYS

SEQ ID NO: 122589 - protein, 13 aa, Borrelia afzelii
DEIEEEDYDQYSL

SEQ ID NO: 122590 - protein, 13 aa, Borrelia afzelii
EIEEEDYDQYSLE

SEQ ID NO: 122591 - protein, 13 aa, Borrelia afzelii
IEEEDYDQYSLEE

SEQ ID NO: 122592 - protein, 13 aa, Borrelia afzelii
EEEDYDQYSLEED

SEQ ID NO: 122593 - protein, 13 aa, Borrelia afzelii
EEDYDQYSLEEDY

SEQ ID NO: 122594 - protein, 13 aa, Borrelia afzelii
EDYDQYSLEEDYY

SEQ ID NO: 122595 - protein, 13 aa, Borrelia afzelii
DYDQYSLEEDYYY

SEQ ID NO: 122596 - protein, 13 aa, Borrelia afzelii
YDQYSLEEDYYYD

SEQ ID NO: 122597 - protein, 13 aa, Borrelia afzelii
DQYSLEEDYYYDG

SEQ ID NO: 122598 - protein, 13 aa, Borrelia afzelii
QYSLEEDYYYDGE

SEQ ID NO: 122599 - protein, 13 aa, Borrelia afzelii
YSLEEDYYYDGET

SEQ ID NO: 122600 - protein, 13 aa, Borrelia afzelii
SLEEDYYYDGETR

SEQ ID NO: 122601 - protein, 13 aa, Borrelia afzelii
LEEDYYYDGETRL

SEQ ID NO: 122602 - protein, 13 aa, Borrelia afzelii
EEDYYYDGETRLS

SEQ ID NO: 122603 - protein, 13 aa, Borrelia afzelii
EDYYYDGETRLSN

SEQ ID NO: 122604 - protein, 13 aa, Borrelia afzelii
DYYYDGETRLSNR

SEQ ID NO: 122605 - protein, 13 aa, Borrelia afzelii
YYYDGETRLSNRY

SEQ ID NO: 122606 - protein, 13 aa, Borrelia afzelii
YYDGETRLSNRYE

SEQ ID NO: 122607 - protein, 13 aa, Borrelia afzelii
YDGETRLSNRYES

SEQ ID NO: 122608 - protein, 13 aa, Borrelia afzelii
DGETRLSNRYESY

SEQ ID NO: 122609 - protein, 13 aa, Borrelia afzelii
GETRLSNRYESYL

SEQ ID NO: 122610 - protein, 13 aa, Borrelia afzelii
ETRLSNRYESYLE

SEQ ID NO: 122611 - protein, 13 aa, Borrelia afzelii
TRLSNRYESYLEG

SEQ ID NO: 122612 - protein, 13 aa, Borrelia afzelii
RLSNRYESYLEGV

SEQ ID NO: 122613 - protein, 13 aa, Borrelia afzelii
LSNRYESYLEGVK

SEQ ID NO: 122614 - protein, 13 aa, Borrelia afzelii
SNRYESYLEGVKY

SEQ ID NO: 122615 - protein, 13 aa, Borrelia afzelii
NRYESYLEGVKYN

SEQ ID NO: 122616 - protein, 13 aa, Borrelia afzelii
RYESYLEGVKYNV

SEQ ID NO: 122617 - protein, 13 aa, Borrelia afzelii
YESYLEGVKYNVS

SEQ ID NO: 122618 - protein, 13 aa, Borrelia afzelii
ESYLEGVKYNVSS

SEQ ID NO: 122619 - protein, 13 aa, Borrelia afzelii
SYLEGVKYNVSSA

SEQ ID NO: 122620 - protein, 13 aa, Borrelia afzelii
YLEGVKYNVSSAI

SEQ ID NO: 122621 - protein, 13 aa, Borrelia afzelii
LEGVKYNVSSAIK

SEQ ID NO: 122622 - protein, 13 aa, Borrelia afzelii
EGVKYNVSSAIKT

SEQ ID NO: 122623 - protein, 13 aa, Borrelia afzelii
GVKYNVSSAIKTI

SEQ ID NO: 122624 - protein, 13 aa, Borrelia afzelii
VKYNVSSAIKTIV

SEQ ID NO: 122625 - protein, 13 aa, Borrelia afzelii
KYNVSSAIKTIVK

SEQ ID NO: 122626 - protein, 13 aa, Borrelia afzelii
YNVSSAIKTIVKI

SEQ ID NO: 122627 - protein, 13 aa, Borrelia afzelii
NVSSAIKTIVKIY

SEQ ID NO: 122628 - protein, 13 aa, Borrelia afzelii
VSSAIKTIVKIYD

SEQ ID NO: 122629 - protein, 13 aa, Borrelia afzelii
SSAIKTIVKIYDN

SEQ ID NO: 122630 - protein, 13 aa, Borrelia afzelii
SAIKTIVKIYDNY

SEQ ID NO: 122631 - protein, 13 aa, Borrelia afzelii
AIKTIVKIYDNYT

SEQ ID NO: 122632 - protein, 13 aa, Borrelia afzelii
IKTIVKIYDNYTL

SEQ ID NO: 122633 - protein, 13 aa, Borrelia afzelii
KTIVKIYDNYTLL

SEQ ID NO: 122634 - protein, 13 aa, Borrelia afzelii
TIVKIYDNYTLLS

SEQ ID NO: 122635 - protein, 13 aa, Borrelia afzelii
IVKIYDNYTLLST

SEQ ID NO: 122636 - protein, 13 aa, Borrelia afzelii
VKIYDNYTLLSTK

SEQ ID NO: 122637 - protein, 13 aa, Borrelia afzelii
KIYDNYTLLSTKQ

SEQ ID NO: 122638 - protein, 13 aa, Borrelia afzelii
IYDNYTLLSTKQT

SEQ ID NO: 122639 - protein, 13 aa, Borrelia afzelii
YDNYTLLSTKQTQ

SEQ ID NO: 122640 - protein, 13 aa, Borrelia afzelii
DNYTLLSTKQTQM

SEQ ID NO: 122641 - protein, 13 aa, Borrelia afzelii
NYTLLSTKQTQMY

SEQ ID NO: 122642 - protein, 13 aa, Borrelia afzelii
YTLLSTKQTQMYS

SEQ ID NO: 122643 - protein, 13 aa, Borrelia afzelii
TLLSTKQTQMYST

SEQ ID NO: 122644 - protein, 13 aa, Borrelia afzelii
LLSTKQTQMYSTR

SEQ ID NO: 122645 - protein, 13 aa, Borrelia afzelii
LSTKQTQMYSTRL

SEQ ID NO: 122646 - protein, 13 aa, Borrelia afzelii
STKQTQMYSTRLD

SEQ ID NO: 122647 - protein, 13 aa, Borrelia afzelii
TKQTQMYSTRLDN

SEQ ID NO: 122648 - protein, 13 aa, Borrelia afzelii
KQTQMYSTRLDNL

SEQ ID NO: 122649 - protein, 13 aa, Borrelia afzelii
QTQMYSTRLDNLA

SEQ ID NO: 122650 - protein, 13 aa, Borrelia afzelii
TQMYSTRLDNLAK

SEQ ID NO: 122651 - protein, 13 aa, Borrelia afzelii
QMYSTRLDNLAKA

SEQ ID NO: 122652 - protein, 13 aa, Borrelia afzelii
MYSTRLDNLAKAK

SEQ ID NO: 122653 - protein, 13 aa, Borrelia afzelii
YSTRLDNLAKAKA

SEQ ID NO: 122654 - protein, 13 aa, Borrelia afzelii
STRLDNLAKAKAR

SEQ ID NO: 122655 - protein, 13 aa, Borrelia afzelii
TRLDNLAKAKARE

SEQ ID NO: 122656 - protein, 13 aa, Borrelia afzelii
RLDNLAKAKAREE

SEQ ID NO: 122657 - protein, 13 aa, Borrelia afzelii
LDNLAKAKAREEA

SEQ ID NO: 122658 - protein, 13 aa, Borrelia afzelii
DNLAKAKAREEAK

SEQ ID NO: 122659 - protein, 13 aa, Borrelia afzelii
NLAKAKAREEAKK

SEQ ID NO: 122660 - protein, 13 aa, Borrelia afzelii
LAKAKAREEAKKF

SEQ ID NO: 122661 - protein, 13 aa, Borrelia afzelii
AKAKAREEAKKFT

SEQ ID NO: 122662 - protein, 13 aa, Borrelia afzelii
KAKAREEAKKFTK

SEQ ID NO: 122663 - protein, 13 aa, Borrelia afzelii
AKAREEAKKFTKE

SEQ ID NO: 122664 - protein, 13 aa, Borrelia afzelii
KAREEAKKFTKEE

SEQ ID NO: 122665 - protein, 13 aa, Borrelia afzelii
AREEAKKFTKEEL

SEQ ID NO: 122666 - protein, 13 aa, Borrelia afzelii
REEAKKFTKEELE

SEQ ID NO: 122667 - protein, 13 aa, Borrelia afzelii
EEAKKFTKEELEK

SEQ ID NO: 122668 - protein, 13 aa, Borrelia afzelii
EAKKFTKEELEKD

SEQ ID NO: 122669 - protein, 13 aa, Borrelia afzelii
AKKFTKEELEKDL

SEQ ID NO: 122670 - protein, 13 aa, Borrelia afzelii
KKFTKEELEKDLK

SEQ ID NO: 122671 - protein, 13 aa, Borrelia afzelii
KFTKEELEKDLKT

SEQ ID NO: 122672 - protein, 13 aa, Borrelia afzelii
FTKEELEKDLKTL

SEQ ID NO: 122673 - protein, 13 aa, Borrelia afzelii
TKEELEKDLKTLL

SEQ ID NO: 122674 - protein, 13 aa, Borrelia afzelii
KEELEKDLKTLLN

SEQ ID NO: 122675 - protein, 13 aa, Borrelia afzelii
EELEKDLKTLLNY

SEQ ID NO: 122676 - protein, 13 aa, Borrelia afzelii
ELEKDLKTLLNYI

SEQ ID NO: 122677 - protein, 13 aa, Borrelia afzelii
LEKDLKTLLNYIQ

SEQ ID NO: 122678 - protein, 13 aa, Borrelia afzelii
EKDLKTLLNYIQV

SEQ ID NO: 122679 - protein, 13 aa, Borrelia afzelii
KDLKTLLNYIQVS

SEQ ID NO: 122680 - protein, 13 aa, Borrelia afzelii
DLKTLLNYIQVSA

SEQ ID NO: 122681 - protein, 13 aa, Borrelia afzelii
LKTLLNYIQVSAR

SEQ ID NO: 122682 - protein, 13 aa, Borrelia afzelii
KTLLNYIQVSART

SEQ ID NO: 122683 - protein, 13 aa, Borrelia afzelii
TLLNYIQVSARTA

SEQ ID NO: 122684 - protein, 13 aa, Borrelia afzelii
LLNYIQVSARTAT

SEQ ID NO: 122685 - protein, 13 aa, Borrelia afzelii
LNYIQVSARTATN

SEQ ID NO: 122686 - protein, 13 aa, Borrelia afzelii
NYIQVSARTATNF

SEQ ID NO: 122687 - protein, 13 aa, Borrelia afzelii
YIQVSARTATNFV

SEQ ID NO: 122688 - protein, 13 aa, Borrelia afzelii
IQVSARTATNFVY

SEQ ID NO: 122689 - protein, 13 aa, Borrelia afzelii
QVSARTATNFVYA

SEQ ID NO: 122690 - protein, 13 aa, Borrelia afzelii
VSARTATNFVYAR

SEQ ID NO: 122691 - protein, 13 aa, Borrelia afzelii
SARTATNFVYARE

SEQ ID NO: 122692 - protein, 13 aa, Borrelia afzelii
ARTATNFVYAREI

SEQ ID NO: 122693 - protein, 13 aa, Borrelia afzelii
RTATNFVYAREIY

SEQ ID NO: 122694 - protein, 13 aa, Borrelia afzelii
TATNFVYAREIYS

SEQ ID NO: 122695 - protein, 13 aa, Borrelia afzelii
ATNFVYAREIYSK

SEQ ID NO: 122696 - protein, 13 aa, Borrelia afzelii
TNFVYAREIYSKR

SEQ ID NO: 122697 - protein, 13 aa, Borrelia afzelii
NFVYAREIYSKRK

SEQ ID NO: 122698 - protein, 13 aa, Borrelia afzelii
FVYAREIYSKRKL

SEQ ID NO: 122699 - protein, 13 aa, Borrelia afzelii
VYAREIYSKRKLD

SEQ ID NO: 122700 - protein, 13 aa, Borrelia afzelii
YAREIYSKRKLDA

SEQ ID NO: 122701 - protein, 13 aa, Borrelia afzelii
AREIYSKRKLDAI

SEQ ID NO: 122702 - protein, 13 aa, Borrelia afzelii
REIYSKRKLDAIE

SEQ ID NO: 122703 - protein, 13 aa, Borrelia afzelii
EIYSKRKLDAIET

SEQ ID NO: 122704 - protein, 13 aa, Borrelia afzelii
IYSKRKLDAIETE

SEQ ID NO: 122705 - protein, 13 aa, Borrelia afzelii
YSKRKLDAIETEI

SEQ ID NO: 122706 - protein, 13 aa, Borrelia afzelii
SKRKLDAIETEIK

SEQ ID NO: 122707 - protein, 13 aa, Borrelia afzelii
KRKLDAIETEIKN

SEQ ID NO: 122708 - protein, 13 aa, Borrelia afzelii
RKLDAIETEIKNL

SEQ ID NO: 122709 - protein, 13 aa, Borrelia afzelii
KLDAIETEIKNLI

SEQ ID NO: 122710 - protein, 13 aa, Borrelia afzelii
LDAIETEIKNLIL

SEQ ID NO: 122711 - protein, 13 aa, Borrelia afzelii
DAIETEIKNLILK

SEQ ID NO: 122712 - protein, 13 aa, Borrelia afzelii
AIETEIKNLILKI

SEQ ID NO: 122713 - protein, 13 aa, Borrelia afzelii
IETEIKNLILKIK

SEQ ID NO: 122714 - protein, 13 aa, Borrelia afzelii
ETEIKNLILKIKG

SEQ ID NO: 122715 - protein, 13 aa, Borrelia afzelii
TEIKNLILKIKGQ

SEQ ID NO: 122716 - protein, 13 aa, Borrelia afzelii
EIKNLILKIKGQS

SEQ ID NO: 122717 - protein, 13 aa, Borrelia afzelii
IKNLILKIKGQSD

SEQ ID NO: 122718 - protein, 13 aa, Borrelia afzelii
KNLILKIKGQSDL

SEQ ID NO: 122719 - protein, 13 aa, Borrelia afzelii
NLILKIKGQSDLY

SEQ ID NO: 122720 - protein, 13 aa, Borrelia afzelii
LILKIKGQSDLYE

SEQ ID NO: 122721 - protein, 13 aa, Borrelia afzelii
ILKIKGQSDLYEA

SEQ ID NO: 122722 - protein, 13 aa, Borrelia afzelii
LKIKGQSDLYEAY

SEQ ID NO: 122723 - protein, 13 aa, Borrelia afzelii
KIKGQSDLYEAYK

SEQ ID NO: 122724 - protein, 13 aa, Borrelia afzelii
IKGQSDLYEAYKA

SEQ ID NO: 122725 - protein, 13 aa, Borrelia afzelii
KGQSDLYEAYKAI

SEQ ID NO: 122726 - protein, 13 aa, Borrelia afzelii
GQSDLYEAYKAIV

SEQ ID NO: 122727 - protein, 13 aa, Borrelia afzelii
QSDLYEAYKAIVR

SEQ ID NO: 122728 - protein, 13 aa, Borrelia afzelii
SDLYEAYKAIVRS

SEQ ID NO: 122729 - protein, 13 aa, Borrelia afzelii
DLYEAYKAIVRSI

SEQ ID NO: 122730 - protein, 13 aa, Borrelia afzelii
LYEAYKAIVRSIL

SEQ ID NO: 122731 - protein, 13 aa, Borrelia afzelii
YEAYKAIVRSILL

SEQ ID NO: 122732 - protein, 13 aa, Borrelia afzelii
EAYKAIVRSILLM

SEQ ID NO: 122733 - protein, 13 aa, Borrelia afzelii
AYKAIVRSILLMK

SEQ ID NO: 122734 - protein, 13 aa, Borrelia afzelii
YKAIVRSILLMKD

SEQ ID NO: 122735 - protein, 13 aa, Borrelia afzelii
KAIVRSILLMKDS

SEQ ID NO: 122736 - protein, 13 aa, Borrelia afzelii
AIVRSILLMKDSL

SEQ ID NO: 122737 - protein, 13 aa, Borrelia afzelii
IVRSILLMKDSLK

SEQ ID NO: 122738 - protein, 13 aa, Borrelia afzelii
VRSILLMKDSLKI

SEQ ID NO: 122739 - protein, 13 aa, Borrelia afzelii
RSILLMKDSLKII

SEQ ID NO: 122740 - protein, 13 aa, Borrelia afzelii
SILLMKDSLKIIE

SEQ ID NO: 122741 - protein, 13 aa, Borrelia afzelii
ILLMKDSLKIIEI

SEQ ID NO: 122742 - protein, 13 aa, Borrelia afzelii
LLMKDSLKIIEIV

SEQ ID NO: 122743 - protein, 13 aa, Borrelia afzelii
LMKDSLKIIEIVI

SEQ ID NO: 122744 - protein, 13 aa, Borrelia afzelii
MKDSLKIIEIVID

SEQ ID NO: 122745 - protein, 13 aa, Borrelia afzelii
KDSLKIIEIVIDK

SEQ ID NO: 122746 - protein, 13 aa, Borrelia afzelii
DSLKIIEIVIDKN

SEQ ID NO: 122747 - protein, 13 aa, Borrelia afzelii
SLKIIEIVIDKNG

SEQ ID NO: 122748 - protein, 13 aa, Borrelia afzelii
LKIIEIVIDKNGV

SEQ ID NO: 122749 - protein, 13 aa, Borrelia afzelii
KIIEIVIDKNGVW

SEQ ID NO: 122750 - protein, 13 aa, Borrelia afzelii
IIEIVIDKNGVWY

SEQ ID NO: 122751 - protein, 14 aa, Borrelia afzelii
MKIKSKCLALGLLF

SEQ ID NO: 122752 - protein, 14 aa, Borrelia afzelii
KIKSKCLALGLLFG

SEQ ID NO: 122753 - protein, 14 aa, Borrelia afzelii
IKSKCLALGLLFGF

SEQ ID NO: 122754 - protein, 14 aa, Borrelia afzelii
KSKCLALGLLFGFI

SEQ ID NO: 122755 - protein, 14 aa, Borrelia afzelii
SKCLALGLLFGFIS

SEQ ID NO: 122756 - protein, 14 aa, Borrelia afzelii
KCLALGLLFGFISC

SEQ ID NO: 122757 - protein, 14 aa, Borrelia afzelii
CLALGLLFGFISCD

SEQ ID NO: 122758 - protein, 14 aa, Borrelia afzelii
LALGLLFGFISCDL

SEQ ID NO: 122759 - protein, 14 aa, Borrelia afzelii
ALGLLFGFISCDLF

SEQ ID NO: 122760 - protein, 14 aa, Borrelia afzelii
LGLLFGFISCDLFI

SEQ ID NO: 122761 - protein, 14 aa, Borrelia afzelii
GLLFGFISCDLFIR

SEQ ID NO: 122762 - protein, 14 aa, Borrelia afzelii
LLFGFISCDLFIRD

SEQ ID NO: 122763 - protein, 14 aa, Borrelia afzelii
LFGFISCDLFIRDE

SEQ ID NO: 122764 - protein, 14 aa, Borrelia afzelii
FGFISCDLFIRDEI

SEQ ID NO: 122765 - protein, 14 aa, Borrelia afzelii
GFISCDLFIRDEIK

SEQ ID NO: 122766 - protein, 14 aa, Borrelia afzelii
FISCDLFIRDEIKE

SEQ ID NO: 122767 - protein, 14 aa, Borrelia afzelii
ISCDLFIRDEIKEK

SEQ ID NO: 122768 - protein, 14 aa, Borrelia afzelii
SCDLFIRDEIKEKS

SEQ ID NO: 122769 - protein, 14 aa, Borrelia afzelii
CDLFIRDEIKEKSL

SEQ ID NO: 122770 - protein, 14 aa, Borrelia afzelii
DLFIRDEIKEKSLG

SEQ ID NO: 122771 - protein, 14 aa, Borrelia afzelii
LFIRDEIKEKSLGL

SEQ ID NO: 122772 - protein, 14 aa, Borrelia afzelii
FIRDEIKEKSLGLC

SEQ ID NO: 122773 - protein, 14 aa, Borrelia afzelii
IRDEIKEKSLGLCD

SEQ ID NO: 122774 - protein, 14 aa, Borrelia afzelii
RDEIKEKSLGLCDE

SEQ ID NO: 122775 - protein, 14 aa, Borrelia afzelii
DEIKEKSLGLCDEE

SEQ ID NO: 122776 - protein, 14 aa, Borrelia afzelii
EIKEKSLGLCDEES

SEQ ID NO: 122777 - protein, 14 aa, Borrelia afzelii
IKEKSLGLCDEESS

SEQ ID NO: 122778 - protein, 14 aa, Borrelia afzelii
KEKSLGLCDEESSI

SEQ ID NO: 122779 - protein, 14 aa, Borrelia afzelii
EKSLGLCDEESSIL

SEQ ID NO: 122780 - protein, 14 aa, Borrelia afzelii
KSLGLCDEESSILE

SEQ ID NO: 122781 - protein, 14 aa, Borrelia afzelii
SLGLCDEESSILET

SEQ ID NO: 122782 - protein, 14 aa, Borrelia afzelii
LGLCDEESSILETG

SEQ ID NO: 122783 - protein, 14 aa, Borrelia afzelii
GLCDEESSILETGD

SEQ ID NO: 122784 - protein, 14 aa, Borrelia afzelii
LCDEESSILETGDK

SEQ ID NO: 122785 - protein, 14 aa, Borrelia afzelii
CDEESSILETGDKS

SEQ ID NO: 122786 - protein, 14 aa, Borrelia afzelii
DEESSILETGDKSV

SEQ ID NO: 122787 - protein, 14 aa, Borrelia afzelii
EESSILETGDKSVK

SEQ ID NO: 122788 - protein, 14 aa, Borrelia afzelii
ESSILETGDKSVKK

SEQ ID NO: 122789 - protein, 14 aa, Borrelia afzelii
SSILETGDKSVKKS

SEQ ID NO: 122790 - protein, 14 aa, Borrelia afzelii
SILETGDKSVKKSL

SEQ ID NO: 122791 - protein, 14 aa, Borrelia afzelii
ILETGDKSVKKSLN

SEQ ID NO: 122792 - protein, 14 aa, Borrelia afzelii
LETGDKSVKKSLNK

SEQ ID NO: 122793 - protein, 14 aa, Borrelia afzelii
ETGDKSVKKSLNKK

SEQ ID NO: 122794 - protein, 14 aa, Borrelia afzelii
TGDKSVKKSLNKKG

SEQ ID NO: 122795 - protein, 14 aa, Borrelia afzelii
GDKSVKKSLNKKGK

SEQ ID NO: 122796 - protein, 14 aa, Borrelia afzelii
DKSVKKSLNKKGKD

SEQ ID NO: 122797 - protein, 14 aa, Borrelia afzelii
KSVKKSLNKKGKDK

SEQ ID NO: 122798 - protein, 14 aa, Borrelia afzelii
SVKKSLNKKGKDKV

SEQ ID NO: 122799 - protein, 14 aa, Borrelia afzelii
VKKSLNKKGKDKVA

SEQ ID NO: 122800 - protein, 14 aa, Borrelia afzelii
KKSLNKKGKDKVAR

SEQ ID NO: 122801 - protein, 14 aa, Borrelia afzelii
KSLNKKGKDKVARK

SEQ ID NO: 122802 - protein, 14 aa, Borrelia afzelii
SLNKKGKDKVARKK

SEQ ID NO: 122803 - protein, 14 aa, Borrelia afzelii
LNKKGKDKVARKKV

SEQ ID NO: 122804 - protein, 14 aa, Borrelia afzelii
NKKGKDKVARKKVE

SEQ ID NO: 122805 - protein, 14 aa, Borrelia afzelii
KKGKDKVARKKVEG

SEQ ID NO: 122806 - protein, 14 aa, Borrelia afzelii
KGKDKVARKKVEGN

SEQ ID NO: 122807 - protein, 14 aa, Borrelia afzelii
GKDKVARKKVEGNA

SEQ ID NO: 122808 - protein, 14 aa, Borrelia afzelii
KDKVARKKVEGNAV

SEQ ID NO: 122809 - protein, 14 aa, Borrelia afzelii
DKVARKKVEGNAVK

SEQ ID NO: 122810 - protein, 14 aa, Borrelia afzelii
KVARKKVEGNAVKK

SEQ ID NO: 122811 - protein, 14 aa, Borrelia afzelii
VARKKVEGNAVKKD

SEQ ID NO: 122812 - protein, 14 aa, Borrelia afzelii
ARKKVEGNAVKKDP

SEQ ID NO: 122813 - protein, 14 aa, Borrelia afzelii
RKKVEGNAVKKDPF

SEQ ID NO: 122814 - protein, 14 aa, Borrelia afzelii
KKVEGNAVKKDPFN

SEQ ID NO: 122815 - protein, 14 aa, Borrelia afzelii
KVEGNAVKKDPFNH

SEQ ID NO: 122816 - protein, 14 aa, Borrelia afzelii
VEGNAVKKDPFNHH

SEQ ID NO: 122817 - protein, 14 aa, Borrelia afzelii
EGNAVKKDPFNHHV

SEQ ID NO: 122818 - protein, 14 aa, Borrelia afzelii
GNAVKKDPFNHHVK

SEQ ID NO: 122819 - protein, 14 aa, Borrelia afzelii
NAVKKDPFNHHVKR

SEQ ID NO: 122820 - protein, 14 aa, Borrelia afzelii
AVKKDPFNHHVKRE

SEQ ID NO: 122821 - protein, 14 aa, Borrelia afzelii
VKKDPFNHHVKRES

SEQ ID NO: 122822 - protein, 14 aa, Borrelia afzelii
KKDPFNHHVKRESV

SEQ ID NO: 122823 - protein, 14 aa, Borrelia afzelii
KDPFNHHVKRESVN

SEQ ID NO: 122824 - protein, 14 aa, Borrelia afzelii
DPFNHHVKRESVNN

SEQ ID NO: 122825 - protein, 14 aa, Borrelia afzelii
PFNHHVKRESVNNS

SEQ ID NO: 122826 - protein, 14 aa, Borrelia afzelii
FNHHVKRESVNNSN

SEQ ID NO: 122827 - protein, 14 aa, Borrelia afzelii
NHHVKRESVNNSNL

SEQ ID NO: 122828 - protein, 14 aa, Borrelia afzelii
HHVKRESVNNSNLS

SEQ ID NO: 122829 - protein, 14 aa, Borrelia afzelii
HVKRESVNNSNLSQ

SEQ ID NO: 122830 - protein, 14 aa, Borrelia afzelii
VKRESVNNSNLSQK

SEQ ID NO: 122831 - protein, 14 aa, Borrelia afzelii
KRESVNNSNLSQKN

SEQ ID NO: 122832 - protein, 14 aa, Borrelia afzelii
RESVNNSNLSQKNV

SEQ ID NO: 122833 - protein, 14 aa, Borrelia afzelii
ESVNNSNLSQKNVI

SEQ ID NO: 122834 - protein, 14 aa, Borrelia afzelii
SVNNSNLSQKNVIS

SEQ ID NO: 122835 - protein, 14 aa, Borrelia afzelii
VNNSNLSQKNVISE

SEQ ID NO: 122836 - protein, 14 aa, Borrelia afzelii
NNSNLSQKNVISEE

SEQ ID NO: 122837 - protein, 14 aa, Borrelia afzelii
NSNLSQKNVISEEE

SEQ ID NO: 122838 - protein, 14 aa, Borrelia afzelii
SNLSQKNVISEEEI

SEQ ID NO: 122839 - protein, 14 aa, Borrelia afzelii
NLSQKNVISEEEIL

SEQ ID NO: 122840 - protein, 14 aa, Borrelia afzelii
LSQKNVISEEEILK

SEQ ID NO: 122841 - protein, 14 aa, Borrelia afzelii
SQKNVISEEEILKT

SEQ ID NO: 122842 - protein, 14 aa, Borrelia afzelii
QKNVISEEEILKTK

SEQ ID NO: 122843 - protein, 14 aa, Borrelia afzelii
KNVISEEEILKTKL

SEQ ID NO: 122844 - protein, 14 aa, Borrelia afzelii
NVISEEEILKTKLL

SEQ ID NO: 122845 - protein, 14 aa, Borrelia afzelii
VISEEEILKTKLLR

SEQ ID NO: 122846 - protein, 14 aa, Borrelia afzelii
ISEEEILKTKLLRE

SEQ ID NO: 122847 - protein, 14 aa, Borrelia afzelii
SEEEILKTKLLRER

SEQ ID NO: 122848 - protein, 14 aa, Borrelia afzelii
EEEILKTKLLRERP

SEQ ID NO: 122849 - protein, 14 aa, Borrelia afzelii
EEILKTKLLRERPE

SEQ ID NO: 122850 - protein, 14 aa, Borrelia afzelii
EILKTKLLRERPET

SEQ ID NO: 122851 - protein, 14 aa, Borrelia afzelii
ILKTKLLRERPETR

SEQ ID NO: 122852 - protein, 14 aa, Borrelia afzelii
LKTKLLRERPETRK

SEQ ID NO: 122853 - protein, 14 aa, Borrelia afzelii
KTKLLRERPETRKE

SEQ ID NO: 122854 - protein, 14 aa, Borrelia afzelii
TKLLRERPETRKEE

SEQ ID NO: 122855 - protein, 14 aa, Borrelia afzelii
KLLRERPETRKEEI

SEQ ID NO: 122856 - protein, 14 aa, Borrelia afzelii
LLRERPETRKEEIQ

SEQ ID NO: 122857 - protein, 14 aa, Borrelia afzelii
LRERPETRKEEIQK

SEQ ID NO: 122858 - protein, 14 aa, Borrelia afzelii
RERPETRKEEIQKQ

SEQ ID NO: 122859 - protein, 14 aa, Borrelia afzelii
ERPETRKEEIQKQQ

SEQ ID NO: 122860 - protein, 14 aa, Borrelia afzelii
RPETRKEEIQKQQD

SEQ ID NO: 122861 - protein, 14 aa, Borrelia afzelii
PETRKEEIQKQQDE

SEQ ID NO: 122862 - protein, 14 aa, Borrelia afzelii
ETRKEEIQKQQDEH

SEQ ID NO: 122863 - protein, 14 aa, Borrelia afzelii
TRKEEIQKQQDEHK

SEQ ID NO: 122864 - protein, 14 aa, Borrelia afzelii
RKEEIQKQQDEHKR

SEQ ID NO: 122865 - protein, 14 aa, Borrelia afzelii
KEEIQKQQDEHKRM

SEQ ID NO: 122866 - protein, 14 aa, Borrelia afzelii
EEIQKQQDEHKRML

SEQ ID NO: 122867 - protein, 14 aa, Borrelia afzelii
EIQKQQDEHKRMLQ

SEQ ID NO: 122868 - protein, 14 aa, Borrelia afzelii
IQKQQDEHKRMLQG

SEQ ID NO: 122869 - protein, 14 aa, Borrelia afzelii
QKQQDEHKRMLQGS

SEQ ID NO: 122870 - protein, 14 aa, Borrelia afzelii
KQQDEHKRMLQGSL

SEQ ID NO: 122871 - protein, 14 aa, Borrelia afzelii
QQDEHKRMLQGSLS

SEQ ID NO: 122872 - protein, 14 aa, Borrelia afzelii
QDEHKRMLQGSLSF

SEQ ID NO: 122873 - protein, 14 aa, Borrelia afzelii
DEHKRMLQGSLSFL

SEQ ID NO: 122874 - protein, 14 aa, Borrelia afzelii
EHKRMLQGSLSFLS

SEQ ID NO: 122875 - protein, 14 aa, Borrelia afzelii
HKRMLQGSLSFLSG

SEQ ID NO: 122876 - protein, 14 aa, Borrelia afzelii
KRMLQGSLSFLSGE

SEQ ID NO: 122877 - protein, 14 aa, Borrelia afzelii
RMLQGSLSFLSGES

SEQ ID NO: 122878 - protein, 14 aa, Borrelia afzelii
MLQGSLSFLSGESG

SEQ ID NO: 122879 - protein, 14 aa, Borrelia afzelii
LQGSLSFLSGESGE

SEQ ID NO: 122880 - protein, 14 aa, Borrelia afzelii
QGSLSFLSGESGEL

SEQ ID NO: 122881 - protein, 14 aa, Borrelia afzelii
GSLSFLSGESGELK

SEQ ID NO: 122882 - protein, 14 aa, Borrelia afzelii
SLSFLSGESGELKD

SEQ ID NO: 122883 - protein, 14 aa, Borrelia afzelii
LSFLSGESGELKDT

SEQ ID NO: 122884 - protein, 14 aa, Borrelia afzelii
SFLSGESGELKDTI

SEQ ID NO: 122885 - protein, 14 aa, Borrelia afzelii
FLSGESGELKDTIE

SEQ ID NO: 122886 - protein, 14 aa, Borrelia afzelii
LSGESGELKDTIES

SEQ ID NO: 122887 - protein, 14 aa, Borrelia afzelii
SGESGELKDTIESN

SEQ ID NO: 122888 - protein, 14 aa, Borrelia afzelii
GESGELKDTIESNE

SEQ ID NO: 122889 - protein, 14 aa, Borrelia afzelii
ESGELKDTIESNEI

SEQ ID NO: 122890 - protein, 14 aa, Borrelia afzelii
SGELKDTIESNEID

SEQ ID NO: 122891 - protein, 14 aa, Borrelia afzelii
GELKDTIESNEIDF

SEQ ID NO: 122892 - protein, 14 aa, Borrelia afzelii
ELKDTIESNEIDFT

SEQ ID NO: 122893 - protein, 14 aa, Borrelia afzelii
LKDTIESNEIDFTI

SEQ ID NO: 122894 - protein, 14 aa, Borrelia afzelii
KDTIESNEIDFTID

SEQ ID NO: 122895 - protein, 14 aa, Borrelia afzelii
DTIESNEIDFTIDS

SEQ ID NO: 122896 - protein, 14 aa, Borrelia afzelii
TIESNEIDFTIDSD

SEQ ID NO: 122897 - protein, 14 aa, Borrelia afzelii
IESNEIDFTIDSDL

SEQ ID NO: 122898 - protein, 14 aa, Borrelia afzelii
ESNEIDFTIDSDLR

SEQ ID NO: 122899 - protein, 14 aa, Borrelia afzelii
SNEIDFTIDSDLRL

SEQ ID NO: 122900 - protein, 14 aa, Borrelia afzelii
NEIDFTIDSDLRLK

SEQ ID NO: 122901 - protein, 14 aa, Borrelia afzelii
EIDFTIDSDLRLKS

SEQ ID NO: 122902 - protein, 14 aa, Borrelia afzelii
IDFTIDSDLRLKSD

SEQ ID NO: 122903 - protein, 14 aa, Borrelia afzelii
DFTIDSDLRLKSDL

SEQ ID NO: 122904 - protein, 14 aa, Borrelia afzelii
FTIDSDLRLKSDLQ

SEQ ID NO: 122905 - protein, 14 aa, Borrelia afzelii
TIDSDLRLKSDLQA

SEQ ID NO: 122906 - protein, 14 aa, Borrelia afzelii
IDSDLRLKSDLQAI

SEQ ID NO: 122907 - protein, 14 aa, Borrelia afzelii
DSDLRLKSDLQAIS

SEQ ID NO: 122908 - protein, 14 aa, Borrelia afzelii
SDLRLKSDLQAISG

SEQ ID NO: 122909 - protein, 14 aa, Borrelia afzelii
DLRLKSDLQAISGS

SEQ ID NO: 122910 - protein, 14 aa, Borrelia afzelii
LRLKSDLQAISGSN

SEQ ID NO: 122911 - protein, 14 aa, Borrelia afzelii
RLKSDLQAISGSNS

SEQ ID NO: 122912 - protein, 14 aa, Borrelia afzelii
LKSDLQAISGSNSI

SEQ ID NO: 122913 - protein, 14 aa, Borrelia afzelii
KSDLQAISGSNSIS

SEQ ID NO: 122914 - protein, 14 aa, Borrelia afzelii
SDLQAISGSNSISY

SEQ ID NO: 122915 - protein, 14 aa, Borrelia afzelii
DLQAISGSNSISYT

SEQ ID NO: 122916 - protein, 14 aa, Borrelia afzelii
LQAISGSNSISYTD

SEQ ID NO: 122917 - protein, 14 aa, Borrelia afzelii
QAISGSNSISYTDE

SEQ ID NO: 122918 - protein, 14 aa, Borrelia afzelii
AISGSNSISYTDEI

SEQ ID NO: 122919 - protein, 14 aa, Borrelia afzelii
ISGSNSISYTDEIE

SEQ ID NO: 122920 - protein, 14 aa, Borrelia afzelii
SGSNSISYTDEIEE

SEQ ID NO: 122921 - protein, 14 aa, Borrelia afzelii
GSNSISYTDEIEEE

SEQ ID NO: 122922 - protein, 14 aa, Borrelia afzelii
SNSISYTDEIEEED

SEQ ID NO: 122923 - protein, 14 aa, Borrelia afzelii
NSISYTDEIEEEDY

SEQ ID NO: 122924 - protein, 14 aa, Borrelia afzelii
SISYTDEIEEEDYD

SEQ ID NO: 122925 - protein, 14 aa, Borrelia afzelii
ISYTDEIEEEDYDQ

SEQ ID NO: 122926 - protein, 14 aa, Borrelia afzelii
SYTDEIEEEDYDQY

SEQ ID NO: 122927 - protein, 14 aa, Borrelia afzelii
YTDEIEEEDYDQYS

SEQ ID NO: 122928 - protein, 14 aa, Borrelia afzelii
TDEIEEEDYDQYSL

SEQ ID NO: 122929 - protein, 14 aa, Borrelia afzelii
DEIEEEDYDQYSLE

SEQ ID NO: 122930 - protein, 14 aa, Borrelia afzelii
EIEEEDYDQYSLEE

SEQ ID NO: 122931 - protein, 14 aa, Borrelia afzelii
IEEEDYDQYSLEED

SEQ ID NO: 122932 - protein, 14 aa, Borrelia afzelii
EEEDYDQYSLEEDY

SEQ ID NO: 122933 - protein, 14 aa, Borrelia afzelii
EEDYDQYSLEEDYY

SEQ ID NO: 122934 - protein, 14 aa, Borrelia afzelii
EDYDQYSLEEDYYY

SEQ ID NO: 122935 - protein, 14 aa, Borrelia afzelii
DYDQYSLEEDYYYD

SEQ ID NO: 122936 - protein, 14 aa, Borrelia afzelii
YDQYSLEEDYYYDG

SEQ ID NO: 122937 - protein, 14 aa, Borrelia afzelii
DQYSLEEDYYYDGE

SEQ ID NO: 122938 - protein, 14 aa, Borrelia afzelii
QYSLEEDYYYDGET

SEQ ID NO: 122939 - protein, 14 aa, Borrelia afzelii
YSLEEDYYYDGETR

SEQ ID NO: 122940 - protein, 14 aa, Borrelia afzelii
SLEEDYYYDGETRL

SEQ ID NO: 122941 - protein, 14 aa, Borrelia afzelii
LEEDYYYDGETRLS

SEQ ID NO: 122942 - protein, 14 aa, Borrelia afzelii
EEDYYYDGETRLSN

SEQ ID NO: 122943 - protein, 14 aa, Borrelia afzelii
EDYYYDGETRLSNR

SEQ ID NO: 122944 - protein, 14 aa, Borrelia afzelii
DYYYDGETRLSNRY

SEQ ID NO: 122945 - protein, 14 aa, Borrelia afzelii
YYYDGETRLSNRYE

SEQ ID NO: 122946 - protein, 14 aa, Borrelia afzelii
YYDGETRLSNRYES

SEQ ID NO: 122947 - protein, 14 aa, Borrelia afzelii
YDGETRLSNRYESY

SEQ ID NO: 122948 - protein, 14 aa, Borrelia afzelii
DGETRLSNRYESYL

SEQ ID NO: 122949 - protein, 14 aa, Borrelia afzelii
GETRLSNRYESYLE

SEQ ID NO: 122950 - protein, 14 aa, Borrelia afzelii
ETRLSNRYESYLEG

SEQ ID NO: 122951 - protein, 14 aa, Borrelia afzelii
TRLSNRYESYLEGV

SEQ ID NO: 122952 - protein, 14 aa, Borrelia afzelii
RLSNRYESYLEGVK

SEQ ID NO: 122953 - protein, 14 aa, Borrelia afzelii
LSNRYESYLEGVKY

SEQ ID NO: 122954 - protein, 14 aa, Borrelia afzelii
SNRYESYLEGVKYN

SEQ ID NO: 122955 - protein, 14 aa, Borrelia afzelii
NRYESYLEGVKYNV

SEQ ID NO: 122956 - protein, 14 aa, Borrelia afzelii
RYESYLEGVKYNVS

SEQ ID NO: 122957 - protein, 14 aa, Borrelia afzelii
YESYLEGVKYNVSS

SEQ ID NO: 122958 - protein, 14 aa, Borrelia afzelii
ESYLEGVKYNVSSA

SEQ ID NO: 122959 - protein, 14 aa, Borrelia afzelii
SYLEGVKYNVSSAI

SEQ ID NO: 122960 - protein, 14 aa, Borrelia afzelii
YLEGVKYNVSSAIK

SEQ ID NO: 122961 - protein, 14 aa, Borrelia afzelii
LEGVKYNVSSAIKT

SEQ ID NO: 122962 - protein, 14 aa, Borrelia afzelii
EGVKYNVSSAIKTI

SEQ ID NO: 122963 - protein, 14 aa, Borrelia afzelii
GVKYNVSSAIKTIV

SEQ ID NO: 122964 - protein, 14 aa, Borrelia afzelii
VKYNVSSAIKTIVK

SEQ ID NO: 122965 - protein, 14 aa, Borrelia afzelii
KYNVSSAIKTIVKI

SEQ ID NO: 122966 - protein, 14 aa, Borrelia afzelii
YNVSSAIKTIVKIY

SEQ ID NO: 122967 - protein, 14 aa, Borrelia afzelii
NVSSAIKTIVKIYD

SEQ ID NO: 122968 - protein, 14 aa, Borrelia afzelii
VSSAIKTIVKIYDN

SEQ ID NO: 122969 - protein, 14 aa, Borrelia afzelii
SSAIKTIVKIYDNY

SEQ ID NO: 122970 - protein, 14 aa, Borrelia afzelii
SAIKTIVKIYDNYT

SEQ ID NO: 122971 - protein, 14 aa, Borrelia afzelii
AIKTIVKIYDNYTL

SEQ ID NO: 122972 - protein, 14 aa, Borrelia afzelii
IKTIVKIYDNYTLL

SEQ ID NO: 122973 - protein, 14 aa, Borrelia afzelii
KTIVKIYDNYTLLS

SEQ ID NO: 122974 - protein, 14 aa, Borrelia afzelii
TIVKIYDNYTLLST

SEQ ID NO: 122975 - protein, 14 aa, Borrelia afzelii
IVKIYDNYTLLSTK

SEQ ID NO: 122976 - protein, 14 aa, Borrelia afzelii
VKIYDNYTLLSTKQ

SEQ ID NO: 122977 - protein, 14 aa, Borrelia afzelii
KIYDNYTLLSTKQT

SEQ ID NO: 122978 - protein, 14 aa, Borrelia afzelii
IYDNYTLLSTKQTQ

SEQ ID NO: 122979 - protein, 14 aa, Borrelia afzelii
YDNYTLLSTKQTQM

SEQ ID NO: 122980 - protein, 14 aa, Borrelia afzelii
DNYTLLSTKQTQMY

SEQ ID NO: 122981 - protein, 14 aa, Borrelia afzelii
NYTLLSTKQTQMYS

SEQ ID NO: 122982 - protein, 14 aa, Borrelia afzelii
YTLLSTKQTQMYST

SEQ ID NO: 122983 - protein, 14 aa, Borrelia afzelii
TLLSTKQTQMYSTR

SEQ ID NO: 122984 - protein, 14 aa, Borrelia afzelii
LLSTKQTQMYSTRL

SEQ ID NO: 122985 - protein, 14 aa, Borrelia afzelii
LSTKQTQMYSTRLD

SEQ ID NO: 122986 - protein, 14 aa, Borrelia afzelii
STKQTQMYSTRLDN

SEQ ID NO: 122987 - protein, 14 aa, Borrelia afzelii
TKQTQMYSTRLDNL

SEQ ID NO: 122988 - protein, 14 aa, Borrelia afzelii
KQTQMYSTRLDNLA

SEQ ID NO: 122989 - protein, 14 aa, Borrelia afzelii
QTQMYSTRLDNLAK

SEQ ID NO: 122990 - protein, 14 aa, Borrelia afzelii
TQMYSTRLDNLAKA

SEQ ID NO: 122991 - protein, 14 aa, Borrelia afzelii
QMYSTRLDNLAKAK

SEQ ID NO: 122992 - protein, 14 aa, Borrelia afzelii
MYSTRLDNLAKAKA

SEQ ID NO: 122993 - protein, 14 aa, Borrelia afzelii
YSTRLDNLAKAKAR

SEQ ID NO: 122994 - protein, 14 aa, Borrelia afzelii
STRLDNLAKAKARE

SEQ ID NO: 122995 - protein, 14 aa, Borrelia afzelii
TRLDNLAKAKAREE

SEQ ID NO: 122996 - protein, 14 aa, Borrelia afzelii
RLDNLAKAKAREEA

SEQ ID NO: 122997 - protein, 14 aa, Borrelia afzelii
LDNLAKAKAREEAK

SEQ ID NO: 122998 - protein, 14 aa, Borrelia afzelii
DNLAKAKAREEAKK

SEQ ID NO: 122999 - protein, 14 aa, Borrelia afzelii
NLAKAKAREEAKKF

SEQ ID NO: 123000 - protein, 14 aa, Borrelia afzelii
LAKAKAREEAKKFT

SEQ ID NO: 123001 - protein, 14 aa, Borrelia afzelii
AKAKAREEAKKFTK

SEQ ID NO: 123002 - protein, 14 aa, Borrelia afzelii
KAKAREEAKKFTKE

SEQ ID NO: 123003 - protein, 14 aa, Borrelia afzelii
AKAREEAKKFTKEE

SEQ ID NO: 123004 - protein, 14 aa, Borrelia afzelii
KAREEAKKFTKEEL

SEQ ID NO: 123005 - protein, 14 aa, Borrelia afzelii
AREEAKKFTKEELE

SEQ ID NO: 123006 - protein, 14 aa, Borrelia afzelii
REEAKKFTKEELEK

SEQ ID NO: 123007 - protein, 14 aa, Borrelia afzelii
EEAKKFTKEELEKD

SEQ ID NO: 123008 - protein, 14 aa, Borrelia afzelii
EAKKFTKEELEKDL

SEQ ID NO: 123009 - protein, 14 aa, Borrelia afzelii
AKKFTKEELEKDLK

SEQ ID NO: 123010 - protein, 14 aa, Borrelia afzelii
KKFTKEELEKDLKT

SEQ ID NO: 123011 - protein, 14 aa, Borrelia afzelii
KFTKEELEKDLKTL

SEQ ID NO: 123012 - protein, 14 aa, Borrelia afzelii
FTKEELEKDLKTLL

SEQ ID NO: 123013 - protein, 14 aa, Borrelia afzelii
TKEELEKDLKTLLN

SEQ ID NO: 123014 - protein, 14 aa, Borrelia afzelii
KEELEKDLKTLLNY

SEQ ID NO: 123015 - protein, 14 aa, Borrelia afzelii
EELEKDLKTLLNYI

SEQ ID NO: 123016 - protein, 14 aa, Borrelia afzelii
ELEKDLKTLLNYIQ

SEQ ID NO: 123017 - protein, 14 aa, Borrelia afzelii
LEKDLKTLLNYIQV

SEQ ID NO: 123018 - protein, 14 aa, Borrelia afzelii
EKDLKTLLNYIQVS

SEQ ID NO: 123019 - protein, 14 aa, Borrelia afzelii
KDLKTLLNYIQVSA

SEQ ID NO: 123020 - protein, 14 aa, Borrelia afzelii
DLKTLLNYIQVSAR

SEQ ID NO: 123021 - protein, 14 aa, Borrelia afzelii
LKTLLNYIQVSART

SEQ ID NO: 123022 - protein, 14 aa, Borrelia afzelii
KTLLNYIQVSARTA

SEQ ID NO: 123023 - protein, 14 aa, Borrelia afzelii
TLLNYIQVSARTAT

SEQ ID NO: 123024 - protein, 14 aa, Borrelia afzelii
LLNYIQVSARTATN

SEQ ID NO: 123025 - protein, 14 aa, Borrelia afzelii
LNYIQVSARTATNF

SEQ ID NO: 123026 - protein, 14 aa, Borrelia afzelii
NYIQVSARTATNFV

SEQ ID NO: 123027 - protein, 14 aa, Borrelia afzelii
YIQVSARTATNFVY

SEQ ID NO: 123028 - protein, 14 aa, Borrelia afzelii
IQVSARTATNFVYA

SEQ ID NO: 123029 - protein, 14 aa, Borrelia afzelii
QVSARTATNFVYAR

SEQ ID NO: 123030 - protein, 14 aa, Borrelia afzelii
VSARTATNFVYARE

SEQ ID NO: 123031 - protein, 14 aa, Borrelia afzelii
SARTATNFVYAREI

SEQ ID NO: 123032 - protein, 14 aa, Borrelia afzelii
ARTATNFVYAREIY

SEQ ID NO: 123033 - protein, 14 aa, Borrelia afzelii
RTATNFVYAREIYS

SEQ ID NO: 123034 - protein, 14 aa, Borrelia afzelii
TATNFVYAREIYSK

SEQ ID NO: 123035 - protein, 14 aa, Borrelia afzelii
ATNFVYAREIYSKR

SEQ ID NO: 123036 - protein, 14 aa, Borrelia afzelii
TNFVYAREIYSKRK

SEQ ID NO: 123037 - protein, 14 aa, Borrelia afzelii
NFVYAREIYSKRKL

SEQ ID NO: 123038 - protein, 14 aa, Borrelia afzelii
FVYAREIYSKRKLD

SEQ ID NO: 123039 - protein, 14 aa, Borrelia afzelii
VYAREIYSKRKLDA

SEQ ID NO: 123040 - protein, 14 aa, Borrelia afzelii
YAREIYSKRKLDAI

SEQ ID NO: 123041 - protein, 14 aa, Borrelia afzelii
AREIYSKRKLDAIE

SEQ ID NO: 123042 - protein, 14 aa, Borrelia afzelii
REIYSKRKLDAIET

SEQ ID NO: 123043 - protein, 14 aa, Borrelia afzelii
EIYSKRKLDAIETE

SEQ ID NO: 123044 - protein, 14 aa, Borrelia afzelii
IYSKRKLDAIETEI

SEQ ID NO: 123045 - protein, 14 aa, Borrelia afzelii
YSKRKLDAIETEIK

SEQ ID NO: 123046 - protein, 14 aa, Borrelia afzelii
SKRKLDAIETEIKN

SEQ ID NO: 123047 - protein, 14 aa, Borrelia afzelii
KRKLDAIETEIKNL

SEQ ID NO: 123048 - protein, 14 aa, Borrelia afzelii
RKLDAIETEIKNLI

SEQ ID NO: 123049 - protein, 14 aa, Borrelia afzelii
KLDAIETEIKNLIL

SEQ ID NO: 123050 - protein, 14 aa, Borrelia afzelii
LDAIETEIKNLILK

SEQ ID NO: 123051 - protein, 14 aa, Borrelia afzelii
DAIETEIKNLILKI

SEQ ID NO: 123052 - protein, 14 aa, Borrelia afzelii
AIETEIKNLILKIK

SEQ ID NO: 123053 - protein, 14 aa, Borrelia afzelii
IETEIKNLILKIKG

SEQ ID NO: 123054 - protein, 14 aa, Borrelia afzelii
ETEIKNLILKIKGQ

SEQ ID NO: 123055 - protein, 14 aa, Borrelia afzelii
TEIKNLILKIKGQS

SEQ ID NO: 123056 - protein, 14 aa, Borrelia afzelii
EIKNLILKIKGQSD

SEQ ID NO: 123057 - protein, 14 aa, Borrelia afzelii
IKNLILKIKGQSDL

SEQ ID NO: 123058 - protein, 14 aa, Borrelia afzelii
KNLILKIKGQSDLY

SEQ ID NO: 123059 - protein, 14 aa, Borrelia afzelii
NLILKIKGQSDLYE

SEQ ID NO: 123060 - protein, 14 aa, Borrelia afzelii
LILKIKGQSDLYEA

SEQ ID NO: 123061 - protein, 14 aa, Borrelia afzelii
ILKIKGQSDLYEAY

SEQ ID NO: 123062 - protein, 14 aa, Borrelia afzelii
LKIKGQSDLYEAYK

SEQ ID NO: 123063 - protein, 14 aa, Borrelia afzelii
KIKGQSDLYEAYKA

SEQ ID NO: 123064 - protein, 14 aa, Borrelia afzelii
IKGQSDLYEAYKAI

SEQ ID NO: 123065 - protein, 14 aa, Borrelia afzelii
KGQSDLYEAYKAIV

SEQ ID NO: 123066 - protein, 14 aa, Borrelia afzelii
GQSDLYEAYKAIVR

SEQ ID NO: 123067 - protein, 14 aa, Borrelia afzelii
QSDLYEAYKAIVRS

SEQ ID NO: 123068 - protein, 14 aa, Borrelia afzelii
SDLYEAYKAIVRSI

SEQ ID NO: 123069 - protein, 14 aa, Borrelia afzelii
DLYEAYKAIVRSIL

SEQ ID NO: 123070 - protein, 14 aa, Borrelia afzelii
LYEAYKAIVRSILL

SEQ ID NO: 123071 - protein, 14 aa, Borrelia afzelii
YEAYKAIVRSILLM

SEQ ID NO: 123072 - protein, 14 aa, Borrelia afzelii
EAYKAIVRSILLMK

SEQ ID NO: 123073 - protein, 14 aa, Borrelia afzelii
AYKAIVRSILLMKD

SEQ ID NO: 123074 - protein, 14 aa, Borrelia afzelii
YKAIVRSILLMKDS

SEQ ID NO: 123075 - protein, 14 aa, Borrelia afzelii
KAIVRSILLMKDSL

SEQ ID NO: 123076 - protein, 14 aa, Borrelia afzelii
AIVRSILLMKDSLK

SEQ ID NO: 123077 - protein, 14 aa, Borrelia afzelii
IVRSILLMKDSLKI

SEQ ID NO: 123078 - protein, 14 aa, Borrelia afzelii
VRSILLMKDSLKII

SEQ ID NO: 123079 - protein, 14 aa, Borrelia afzelii
RSILLMKDSLKIIE

SEQ ID NO: 123080 - protein, 14 aa, Borrelia afzelii
SILLMKDSLKIIEI

SEQ ID NO: 123081 - protein, 14 aa, Borrelia afzelii
ILLMKDSLKIIEIV

SEQ ID NO: 123082 - protein, 14 aa, Borrelia afzelii
LLMKDSLKIIEIVI

SEQ ID NO: 123083 - protein, 14 aa, Borrelia afzelii
LMKDSLKIIEIVID

SEQ ID NO: 123084 - protein, 14 aa, Borrelia afzelii
MKDSLKIIEIVIDK

SEQ ID NO: 123085 - protein, 14 aa, Borrelia afzelii
KDSLKIIEIVIDKN

SEQ ID NO: 123086 - protein, 14 aa, Borrelia afzelii
DSLKIIEIVIDKNG

SEQ ID NO: 123087 - protein, 14 aa, Borrelia afzelii
SLKIIEIVIDKNGV

SEQ ID NO: 123088 - protein, 14 aa, Borrelia afzelii
LKIIEIVIDKNGVW

SEQ ID NO: 123089 - protein, 14 aa, Borrelia afzelii
KIIEIVIDKNGVWY

SEQ ID NO: 123090 - protein, 15 aa, Borrelia afzelii
MKIKSKCLALGLLFG

SEQ ID NO: 123091 - protein, 15 aa, Borrelia afzelii
KIKSKCLALGLLFGF

SEQ ID NO: 123092 - protein, 15 aa, Borrelia afzelii
IKSKCLALGLLFGFI

SEQ ID NO: 123093 - protein, 15 aa, Borrelia afzelii
KSKCLALGLLFGFIS

SEQ ID NO: 123094 - protein, 15 aa, Borrelia afzelii
SKCLALGLLFGFISC

SEQ ID NO: 123095 - protein, 15 aa, Borrelia afzelii
KCLALGLLFGFISCD

SEQ ID NO: 123096 - protein, 15 aa, Borrelia afzelii
CLALGLLFGFISCDL

SEQ ID NO: 123097 - protein, 15 aa, Borrelia afzelii
LALGLLFGFISCDLF

SEQ ID NO: 123098 - protein, 15 aa, Borrelia afzelii
ALGLLFGFISCDLFI

SEQ ID NO: 123099 - protein, 15 aa, Borrelia afzelii
LGLLFGFISCDLFIR

SEQ ID NO: 123100 - protein, 15 aa, Borrelia afzelii
GLLFGFISCDLFIRD

SEQ ID NO: 123101 - protein, 15 aa, Borrelia afzelii
LLFGFISCDLFIRDE

SEQ ID NO: 123102 - protein, 15 aa, Borrelia afzelii
LFGFISCDLFIRDEI

SEQ ID NO: 123103 - protein, 15 aa, Borrelia afzelii
FGFISCDLFIRDEIK

SEQ ID NO: 123104 - protein, 15 aa, Borrelia afzelii
GFISCDLFIRDEIKE

SEQ ID NO: 123105 - protein, 15 aa, Borrelia afzelii
FISCDLFIRDEIKEK

SEQ ID NO: 123106 - protein, 15 aa, Borrelia afzelii
ISCDLFIRDEIKEKS

SEQ ID NO: 123107 - protein, 15 aa, Borrelia afzelii
SCDLFIRDEIKEKSL

SEQ ID NO: 123108 - protein, 15 aa, Borrelia afzelii
CDLFIRDEIKEKSLG

SEQ ID NO: 123109 - protein, 15 aa, Borrelia afzelii
DLFIRDEIKEKSLGL

SEQ ID NO: 123110 - protein, 15 aa, Borrelia afzelii
LFIRDEIKEKSLGLC

SEQ ID NO: 123111 - protein, 15 aa, Borrelia afzelii
FIRDEIKEKSLGLCD

SEQ ID NO: 123112 - protein, 15 aa, Borrelia afzelii
IRDEIKEKSLGLCDE

SEQ ID NO: 123113 - protein, 15 aa, Borrelia afzelii
RDEIKEKSLGLCDEE

SEQ ID NO: 123114 - protein, 15 aa, Borrelia afzelii
DEIKEKSLGLCDEES

SEQ ID NO: 123115 - protein, 15 aa, Borrelia afzelii
EIKEKSLGLCDEESS

SEQ ID NO: 123116 - protein, 15 aa, Borrelia afzelii
IKEKSLGLCDEESSI

SEQ ID NO: 123117 - protein, 15 aa, Borrelia afzelii
KEKSLGLCDEESSIL

SEQ ID NO: 123118 - protein, 15 aa, Borrelia afzelii
EKSLGLCDEESSILE

SEQ ID NO: 123119 - protein, 15 aa, Borrelia afzelii
KSLGLCDEESSILET

SEQ ID NO: 123120 - protein, 15 aa, Borrelia afzelii
SLGLCDEESSILETG

SEQ ID NO: 123121 - protein, 15 aa, Borrelia afzelii
LGLCDEESSILETGD

SEQ ID NO: 123122 - protein, 15 aa, Borrelia afzelii
GLCDEESSILETGDK

SEQ ID NO: 123123 - protein, 15 aa, Borrelia afzelii
LCDEESSILETGDKS

SEQ ID NO: 123124 - protein, 15 aa, Borrelia afzelii
CDEESSILETGDKSV

SEQ ID NO: 123125 - protein, 15 aa, Borrelia afzelii
DEESSILETGDKSVK

SEQ ID NO: 123126 - protein, 15 aa, Borrelia afzelii
EESSILETGDKSVKK

SEQ ID NO: 123127 - protein, 15 aa, Borrelia afzelii
ESSILETGDKSVKKS

SEQ ID NO: 123128 - protein, 15 aa, Borrelia afzelii
SSILETGDKSVKKSL

SEQ ID NO: 123129 - protein, 15 aa, Borrelia afzelii
SILETGDKSVKKSLN

SEQ ID NO: 123130 - protein, 15 aa, Borrelia afzelii
ILETGDKSVKKSLNK

SEQ ID NO: 123131 - protein, 15 aa, Borrelia afzelii
LETGDKSVKKSLNKK

SEQ ID NO: 123132 - protein, 15 aa, Borrelia afzelii
ETGDKSVKKSLNKKG

SEQ ID NO: 123133 - protein, 15 aa, Borrelia afzelii
TGDKSVKKSLNKKGK

SEQ ID NO: 123134 - protein, 15 aa, Borrelia afzelii
GDKSVKKSLNKKGKD

SEQ ID NO: 123135 - protein, 15 aa, Borrelia afzelii
DKSVKKSLNKKGKDK

SEQ ID NO: 123136 - protein, 15 aa, Borrelia afzelii
KSVKKSLNKKGKDKV

SEQ ID NO: 123137 - protein, 15 aa, Borrelia afzelii
SVKKSLNKKGKDKVA

SEQ ID NO: 123138 - protein, 15 aa, Borrelia afzelii
VKKSLNKKGKDKVAR

SEQ ID NO: 123139 - protein, 15 aa, Borrelia afzelii
KKSLNKKGKDKVARK

SEQ ID NO: 123140 - protein, 15 aa, Borrelia afzelii
KSLNKKGKDKVARKK

SEQ ID NO: 123141 - protein, 15 aa, Borrelia afzelii
SLNKKGKDKVARKKV

SEQ ID NO: 123142 - protein, 15 aa, Borrelia afzelii
LNKKGKDKVARKKVE

SEQ ID NO: 123143 - protein, 15 aa, Borrelia afzelii
NKKGKDKVARKKVEG

SEQ ID NO: 123144 - protein, 15 aa, Borrelia afzelii
KKGKDKVARKKVEGN

SEQ ID NO: 123145 - protein, 15 aa, Borrelia afzelii
KGKDKVARKKVEGNA

SEQ ID NO: 123146 - protein, 15 aa, Borrelia afzelii
GKDKVARKKVEGNAV

SEQ ID NO: 123147 - protein, 15 aa, Borrelia afzelii
KDKVARKKVEGNAVK

SEQ ID NO: 123148 - protein, 15 aa, Borrelia afzelii
DKVARKKVEGNAVKK

SEQ ID NO: 123149 - protein, 15 aa, Borrelia afzelii
KVARKKVEGNAVKKD

SEQ ID NO: 123150 - protein, 15 aa, Borrelia afzelii
VARKKVEGNAVKKDP

SEQ ID NO: 123151 - protein, 15 aa, Borrelia afzelii
ARKKVEGNAVKKDPF

SEQ ID NO: 123152 - protein, 15 aa, Borrelia afzelii
RKKVEGNAVKKDPFN

SEQ ID NO: 123153 - protein, 15 aa, Borrelia afzelii
KKVEGNAVKKDPFNH

SEQ ID NO: 123154 - protein, 15 aa, Borrelia afzelii
KVEGNAVKKDPFNHH

SEQ ID NO: 123155 - protein, 15 aa, Borrelia afzelii
VEGNAVKKDPFNHHV

SEQ ID NO: 123156 - protein, 15 aa, Borrelia afzelii
EGNAVKKDPFNHHVK

SEQ ID NO: 123157 - protein, 15 aa, Borrelia afzelii
GNAVKKDPFNHHVKR

SEQ ID NO: 123158 - protein, 15 aa, Borrelia afzelii
NAVKKDPFNHHVKRE

SEQ ID NO: 123159 - protein, 15 aa, Borrelia afzelii
AVKKDPFNHHVKRES

SEQ ID NO: 123160 - protein, 15 aa, Borrelia afzelii
VKKDPFNHHVKRESV

SEQ ID NO: 123161 - protein, 15 aa, Borrelia afzelii
KKDPFNHHVKRESVN

SEQ ID NO: 123162 - protein, 15 aa, Borrelia afzelii
KDPFNHHVKRESVNN

SEQ ID NO: 123163 - protein, 15 aa, Borrelia afzelii
DPFNHHVKRESVNNS

SEQ ID NO: 123164 - protein, 15 aa, Borrelia afzelii
PFNHHVKRESVNNSN

SEQ ID NO: 123165 - protein, 15 aa, Borrelia afzelii
FNHHVKRESVNNSNL

SEQ ID NO: 123166 - protein, 15 aa, Borrelia afzelii
NHHVKRESVNNSNLS

SEQ ID NO: 123167 - protein, 15 aa, Borrelia afzelii
HHVKRESVNNSNLSQ

SEQ ID NO: 123168 - protein, 15 aa, Borrelia afzelii
HVKRESVNNSNLSQK

SEQ ID NO: 123169 - protein, 15 aa, Borrelia afzelii
VKRESVNNSNLSQKN

SEQ ID NO: 123170 - protein, 15 aa, Borrelia afzelii
KRESVNNSNLSQKNV

SEQ ID NO: 123171 - protein, 15 aa, Borrelia afzelii
RESVNNSNLSQKNVI

SEQ ID NO: 123172 - protein, 15 aa, Borrelia afzelii
ESVNNSNLSQKNVIS

SEQ ID NO: 123173 - protein, 15 aa, Borrelia afzelii
SVNNSNLSQKNVISE

SEQ ID NO: 123174 - protein, 15 aa, Borrelia afzelii
VNNSNLSQKNVISEE

SEQ ID NO: 123175 - protein, 15 aa, Borrelia afzelii
NNSNLSQKNVISEEE

SEQ ID NO: 123176 - protein, 15 aa, Borrelia afzelii
NSNLSQKNVISEEEI

SEQ ID NO: 123177 - protein, 15 aa, Borrelia afzelii
SNLSQKNVISEEEIL

SEQ ID NO: 123178 - protein, 15 aa, Borrelia afzelii
NLSQKNVISEEEILK

SEQ ID NO: 123179 - protein, 15 aa, Borrelia afzelii
LSQKNVISEEEILKT

SEQ ID NO: 123180 - protein, 15 aa, Borrelia afzelii
SQKNVISEEEILKTK

SEQ ID NO: 123181 - protein, 15 aa, Borrelia afzelii
QKNVISEEEILKTKL

SEQ ID NO: 123182 - protein, 15 aa, Borrelia afzelii
KNVISEEEILKTKLL

SEQ ID NO: 123183 - protein, 15 aa, Borrelia afzelii
NVISEEEILKTKLLR

SEQ ID NO: 123184 - protein, 15 aa, Borrelia afzelii
VISEEEILKTKLLRE

SEQ ID NO: 123185 - protein, 15 aa, Borrelia afzelii
ISEEEILKTKLLRER

SEQ ID NO: 123186 - protein, 15 aa, Borrelia afzelii
SEEEILKTKLLRERP

SEQ ID NO: 123187 - protein, 15 aa, Borrelia afzelii
EEEILKTKLLRERPE

SEQ ID NO: 123188 - protein, 15 aa, Borrelia afzelii
EEILKTKLLRERPET

SEQ ID NO: 123189 - protein, 15 aa, Borrelia afzelii
EILKTKLLRERPETR

SEQ ID NO: 123190 - protein, 15 aa, Borrelia afzelii
ILKTKLLRERPETRK

SEQ ID NO: 123191 - protein, 15 aa, Borrelia afzelii
LKTKLLRERPETRKE

SEQ ID NO: 123192 - protein, 15 aa, Borrelia afzelii
KTKLLRERPETRKEE

SEQ ID NO: 123193 - protein, 15 aa, Borrelia afzelii
TKLLRERPETRKEEI

SEQ ID NO: 123194 - protein, 15 aa, Borrelia afzelii
KLLRERPETRKEEIQ

SEQ ID NO: 123195 - protein, 15 aa, Borrelia afzelii
LLRERPETRKEEIQK

SEQ ID NO: 123196 - protein, 15 aa, Borrelia afzelii
LRERPETRKEEIQKQ

SEQ ID NO: 123197 - protein, 15 aa, Borrelia afzelii
RERPETRKEEIQKQQ

SEQ ID NO: 123198 - protein, 15 aa, Borrelia afzelii
ERPETRKEEIQKQQD

SEQ ID NO: 123199 - protein, 15 aa, Borrelia afzelii
RPETRKEEIQKQQDE

SEQ ID NO: 123200 - protein, 15 aa, Borrelia afzelii
PETRKEEIQKQQDEH

SEQ ID NO: 123201 - protein, 15 aa, Borrelia afzelii
ETRKEEIQKQQDEHK

SEQ ID NO: 123202 - protein, 15 aa, Borrelia afzelii
TRKEEIQKQQDEHKR

SEQ ID NO: 123203 - protein, 15 aa, Borrelia afzelii
RKEEIQKQQDEHKRM

SEQ ID NO: 123204 - protein, 15 aa, Borrelia afzelii
KEEIQKQQDEHKRML

SEQ ID NO: 123205 - protein, 15 aa, Borrelia afzelii
EEIQKQQDEHKRMLQ

SEQ ID NO: 123206 - protein, 15 aa, Borrelia afzelii
EIQKQQDEHKRMLQG

SEQ ID NO: 123207 - protein, 15 aa, Borrelia afzelii
IQKQQDEHKRMLQGS

SEQ ID NO: 123208 - protein, 15 aa, Borrelia afzelii
QKQQDEHKRMLQGSL

SEQ ID NO: 123209 - protein, 15 aa, Borrelia afzelii
KQQDEHKRMLQGSLS

SEQ ID NO: 123210 - protein, 15 aa, Borrelia afzelii
QQDEHKRMLQGSLSF

SEQ ID NO: 123211 - protein, 15 aa, Borrelia afzelii
QDEHKRMLQGSLSFL

SEQ ID NO: 123212 - protein, 15 aa, Borrelia afzelii
DEHKRMLQGSLSFLS

SEQ ID NO: 123213 - protein, 15 aa, Borrelia afzelii
EHKRMLQGSLSFLSG

SEQ ID NO: 123214 - protein, 15 aa, Borrelia afzelii
HKRMLQGSLSFLSGE

SEQ ID NO: 123215 - protein, 15 aa, Borrelia afzelii
KRMLQGSLSFLSGES

SEQ ID NO: 123216 - protein, 15 aa, Borrelia afzelii
RMLQGSLSFLSGESG

SEQ ID NO: 123217 - protein, 15 aa, Borrelia afzelii
MLQGSLSFLSGESGE

SEQ ID NO: 123218 - protein, 15 aa, Borrelia afzelii
LQGSLSFLSGESGEL

SEQ ID NO: 123219 - protein, 15 aa, Borrelia afzelii
QGSLSFLSGESGELK

SEQ ID NO: 123220 - protein, 15 aa, Borrelia afzelii
GSLSFLSGESGELKD

SEQ ID NO: 123221 - protein, 15 aa, Borrelia afzelii
SLSFLSGESGELKDT

SEQ ID NO: 123222 - protein, 15 aa, Borrelia afzelii
LSFLSGESGELKDTI

SEQ ID NO: 123223 - protein, 15 aa, Borrelia afzelii
SFLSGESGELKDTIE

SEQ ID NO: 123224 - protein, 15 aa, Borrelia afzelii
FLSGESGELKDTIES

SEQ ID NO: 123225 - protein, 15 aa, Borrelia afzelii
LSGESGELKDTIESN

SEQ ID NO: 123226 - protein, 15 aa, Borrelia afzelii
SGESGELKDTIESNE

SEQ ID NO: 123227 - protein, 15 aa, Borrelia afzelii
GESGELKDTIESNEI

SEQ ID NO: 123228 - protein, 15 aa, Borrelia afzelii
ESGELKDTIESNEID

SEQ ID NO: 123229 - protein, 15 aa, Borrelia afzelii
SGELKDTIESNEIDF

SEQ ID NO: 123230 - protein, 15 aa, Borrelia afzelii
GELKDTIESNEIDFT

SEQ ID NO: 123231 - protein, 15 aa, Borrelia afzelii
ELKDTIESNEIDFTI

SEQ ID NO: 123232 - protein, 15 aa, Borrelia afzelii
LKDTIESNEIDFTID

SEQ ID NO: 123233 - protein, 15 aa, Borrelia afzelii
KDTIESNEIDFTIDS

SEQ ID NO: 123234 - protein, 15 aa, Borrelia afzelii
DTIESNEIDFTIDSD

SEQ ID NO: 123235 - protein, 15 aa, Borrelia afzelii
TIESNEIDFTIDSDL

SEQ ID NO: 123236 - protein, 15 aa, Borrelia afzelii
IESNEIDFTIDSDLR

SEQ ID NO: 123237 - protein, 15 aa, Borrelia afzelii
ESNEIDFTIDSDLRL

SEQ ID NO: 123238 - protein, 15 aa, Borrelia afzelii
SNEIDFTIDSDLRLK

SEQ ID NO: 123239 - protein, 15 aa, Borrelia afzelii
NEIDFTIDSDLRLKS

SEQ ID NO: 123240 - protein, 15 aa, Borrelia afzelii
EIDFTIDSDLRLKSD

SEQ ID NO: 123241 - protein, 15 aa, Borrelia afzelii
IDFTIDSDLRLKSDL

SEQ ID NO: 123242 - protein, 15 aa, Borrelia afzelii
DFTIDSDLRLKSDLQ

SEQ ID NO: 123243 - protein, 15 aa, Borrelia afzelii
FTIDSDLRLKSDLQA

SEQ ID NO: 123244 - protein, 15 aa, Borrelia afzelii
TIDSDLRLKSDLQAI

SEQ ID NO: 123245 - protein, 15 aa, Borrelia afzelii
IDSDLRLKSDLQAIS

SEQ ID NO: 123246 - protein, 15 aa, Borrelia afzelii
DSDLRLKSDLQAISG

SEQ ID NO: 123247 - protein, 15 aa, Borrelia afzelii
SDLRLKSDLQAISGS

SEQ ID NO: 123248 - protein, 15 aa, Borrelia afzelii
DLRLKSDLQAISGSN

SEQ ID NO: 123249 - protein, 15 aa, Borrelia afzelii
LRLKSDLQAISGSNS

SEQ ID NO: 123250 - protein, 15 aa, Borrelia afzelii
RLKSDLQAISGSNSI

SEQ ID NO: 123251 - protein, 15 aa, Borrelia afzelii
LKSDLQAISGSNSIS

SEQ ID NO: 123252 - protein, 15 aa, Borrelia afzelii
KSDLQAISGSNSISY

SEQ ID NO: 123253 - protein, 15 aa, Borrelia afzelii
SDLQAISGSNSISYT

SEQ ID NO: 123254 - protein, 15 aa, Borrelia afzelii
DLQAISGSNSISYTD

SEQ ID NO: 123255 - protein, 15 aa, Borrelia afzelii
LQAISGSNSISYTDE

SEQ ID NO: 123256 - protein, 15 aa, Borrelia afzelii
QAISGSNSISYTDEI

SEQ ID NO: 123257 - protein, 15 aa, Borrelia afzelii
AISGSNSISYTDEIE

SEQ ID NO: 123258 - protein, 15 aa, Borrelia afzelii
ISGSNSISYTDEIEE

SEQ ID NO: 123259 - protein, 15 aa, Borrelia afzelii
SGSNSISYTDEIEEE

SEQ ID NO: 123260 - protein, 15 aa, Borrelia afzelii
GSNSISYTDEIEEED

SEQ ID NO: 123261 - protein, 15 aa, Borrelia afzelii
SNSISYTDEIEEEDY

SEQ ID NO: 123262 - protein, 15 aa, Borrelia afzelii
NSISYTDEIEEEDYD

SEQ ID NO: 123263 - protein, 15 aa, Borrelia afzelii
SISYTDEIEEEDYDQ

SEQ ID NO: 123264 - protein, 15 aa, Borrelia afzelii
ISYTDEIEEEDYDQY

SEQ ID NO: 123265 - protein, 15 aa, Borrelia afzelii
SYTDEIEEEDYDQYS

SEQ ID NO: 123266 - protein, 15 aa, Borrelia afzelii
YTDEIEEEDYDQYSL

SEQ ID NO: 123267 - protein, 15 aa, Borrelia afzelii
TDEIEEEDYDQYSLE

SEQ ID NO: 123268 - protein, 15 aa, Borrelia afzelii
DEIEEEDYDQYSLEE

SEQ ID NO: 123269 - protein, 15 aa, Borrelia afzelii
EIEEEDYDQYSLEED

SEQ ID NO: 123270 - protein, 15 aa, Borrelia afzelii
IEEEDYDQYSLEEDY

SEQ ID NO: 123271 - protein, 15 aa, Borrelia afzelii
EEEDYDQYSLEEDYY

SEQ ID NO: 123272 - protein, 15 aa, Borrelia afzelii
EEDYDQYSLEEDYYY

SEQ ID NO: 123273 - protein, 15 aa, Borrelia afzelii
EDYDQYSLEEDYYYD

SEQ ID NO: 123274 - protein, 15 aa, Borrelia afzelii
DYDQYSLEEDYYYDG

SEQ ID NO: 123275 - protein, 15 aa, Borrelia afzelii
YDQYSLEEDYYYDGE

SEQ ID NO: 123276 - protein, 15 aa, Borrelia afzelii
DQYSLEEDYYYDGET

SEQ ID NO: 123277 - protein, 15 aa, Borrelia afzelii
QYSLEEDYYYDGETR

SEQ ID NO: 123278 - protein, 15 aa, Borrelia afzelii
YSLEEDYYYDGETRL

SEQ ID NO: 123279 - protein, 15 aa, Borrelia afzelii
SLEEDYYYDGETRLS

SEQ ID NO: 123280 - protein, 15 aa, Borrelia afzelii
LEEDYYYDGETRLSN

SEQ ID NO: 123281 - protein, 15 aa, Borrelia afzelii
EEDYYYDGETRLSNR

SEQ ID NO: 123282 - protein, 15 aa, Borrelia afzelii
EDYYYDGETRLSNRY

SEQ ID NO: 123283 - protein, 15 aa, Borrelia afzelii
DYYYDGETRLSNRYE

SEQ ID NO: 123284 - protein, 15 aa, Borrelia afzelii
YYYDGETRLSNRYES

SEQ ID NO: 123285 - protein, 15 aa, Borrelia afzelii
YYDGETRLSNRYESY

SEQ ID NO: 123286 - protein, 15 aa, Borrelia afzelii
YDGETRLSNRYESYL

SEQ ID NO: 123287 - protein, 15 aa, Borrelia afzelii
DGETRLSNRYESYLE

SEQ ID NO: 123288 - protein, 15 aa, Borrelia afzelii
GETRLSNRYESYLEG

SEQ ID NO: 123289 - protein, 15 aa, Borrelia afzelii
ETRLSNRYESYLEGV

SEQ ID NO: 123290 - protein, 15 aa, Borrelia afzelii
TRLSNRYESYLEGVK

SEQ ID NO: 123291 - protein, 15 aa, Borrelia afzelii
RLSNRYESYLEGVKY

SEQ ID NO: 123292 - protein, 15 aa, Borrelia afzelii
LSNRYESYLEGVKYN

SEQ ID NO: 123293 - protein, 15 aa, Borrelia afzelii
SNRYESYLEGVKYNV

SEQ ID NO: 123294 - protein, 15 aa, Borrelia afzelii
NRYESYLEGVKYNVS

SEQ ID NO: 123295 - protein, 15 aa, Borrelia afzelii
RYESYLEGVKYNVSS

SEQ ID NO: 123296 - protein, 15 aa, Borrelia afzelii
YESYLEGVKYNVSSA

SEQ ID NO: 123297 - protein, 15 aa, Borrelia afzelii
ESYLEGVKYNVSSAI

SEQ ID NO: 123298 - protein, 15 aa, Borrelia afzelii
SYLEGVKYNVSSAIK

SEQ ID NO: 123299 - protein, 15 aa, Borrelia afzelii
YLEGVKYNVSSAIKT

SEQ ID NO: 123300 - protein, 15 aa, Borrelia afzelii
LEGVKYNVSSAIKTI

SEQ ID NO: 123301 - protein, 15 aa, Borrelia afzelii
EGVKYNVSSAIKTIV

SEQ ID NO: 123302 - protein, 15 aa, Borrelia afzelii
GVKYNVSSAIKTIVK

SEQ ID NO: 123303 - protein, 15 aa, Borrelia afzelii
VKYNVSSAIKTIVKI

SEQ ID NO: 123304 - protein, 15 aa, Borrelia afzelii
KYNVSSAIKTIVKIY

SEQ ID NO: 123305 - protein, 15 aa, Borrelia afzelii
YNVSSAIKTIVKIYD

SEQ ID NO: 123306 - protein, 15 aa, Borrelia afzelii
NVSSAIKTIVKIYDN

SEQ ID NO: 123307 - protein, 15 aa, Borrelia afzelii
VSSAIKTIVKIYDNY

SEQ ID NO: 123308 - protein, 15 aa, Borrelia afzelii
SSAIKTIVKIYDNYT

SEQ ID NO: 123309 - protein, 15 aa, Borrelia afzelii
SAIKTIVKIYDNYTL

SEQ ID NO: 123310 - protein, 15 aa, Borrelia afzelii
AIKTIVKIYDNYTLL

SEQ ID NO: 123311 - protein, 15 aa, Borrelia afzelii
IKTIVKIYDNYTLLS

SEQ ID NO: 123312 - protein, 15 aa, Borrelia afzelii
KTIVKIYDNYTLLST

SEQ ID NO: 123313 - protein, 15 aa, Borrelia afzelii
TIVKIYDNYTLLSTK

SEQ ID NO: 123314 - protein, 15 aa, Borrelia afzelii
IVKIYDNYTLLSTKQ

SEQ ID NO: 123315 - protein, 15 aa, Borrelia afzelii
VKIYDNYTLLSTKQT

SEQ ID NO: 123316 - protein, 15 aa, Borrelia afzelii
KIYDNYTLLSTKQTQ

SEQ ID NO: 123317 - protein, 15 aa, Borrelia afzelii
IYDNYTLLSTKQTQM

SEQ ID NO: 123318 - protein, 15 aa, Borrelia afzelii
YDNYTLLSTKQTQMY

SEQ ID NO: 123319 - protein, 15 aa, Borrelia afzelii
DNYTLLSTKQTQMYS

SEQ ID NO: 123320 - protein, 15 aa, Borrelia afzelii
NYTLLSTKQTQMYST

SEQ ID NO: 123321 - protein, 15 aa, Borrelia afzelii
YTLLSTKQTQMYSTR

SEQ ID NO: 123322 - protein, 15 aa, Borrelia afzelii
TLLSTKQTQMYSTRL

SEQ ID NO: 123323 - protein, 15 aa, Borrelia afzelii
LLSTKQTQMYSTRLD

SEQ ID NO: 123324 - protein, 15 aa, Borrelia afzelii
LSTKQTQMYSTRLDN

SEQ ID NO: 123325 - protein, 15 aa, Borrelia afzelii
STKQTQMYSTRLDNL

SEQ ID NO: 123326 - protein, 15 aa, Borrelia afzelii
TKQTQMYSTRLDNLA

SEQ ID NO: 123327 - protein, 15 aa, Borrelia afzelii
KQTQMYSTRLDNLAK

SEQ ID NO: 123328 - protein, 15 aa, Borrelia afzelii
QTQMYSTRLDNLAKA

SEQ ID NO: 123329 - protein, 15 aa, Borrelia afzelii
TQMYSTRLDNLAKAK

SEQ ID NO: 123330 - protein, 15 aa, Borrelia afzelii
QMYSTRLDNLAKAKA

SEQ ID NO: 123331 - protein, 15 aa, Borrelia afzelii
MYSTRLDNLAKAKAR

SEQ ID NO: 123332 - protein, 15 aa, Borrelia afzelii
YSTRLDNLAKAKARE

SEQ ID NO: 123333 - protein, 15 aa, Borrelia afzelii
STRLDNLAKAKAREE

SEQ ID NO: 123334 - protein, 15 aa, Borrelia afzelii
TRLDNLAKAKAREEA

SEQ ID NO: 123335 - protein, 15 aa, Borrelia afzelii
RLDNLAKAKAREEAK

SEQ ID NO: 123336 - protein, 15 aa, Borrelia afzelii
LDNLAKAKAREEAKK

SEQ ID NO: 123337 - protein, 15 aa, Borrelia afzelii
DNLAKAKAREEAKKF

SEQ ID NO: 123338 - protein, 15 aa, Borrelia afzelii
NLAKAKAREEAKKFT

SEQ ID NO: 123339 - protein, 15 aa, Borrelia afzelii
LAKAKAREEAKKFTK

SEQ ID NO: 123340 - protein, 15 aa, Borrelia afzelii
AKAKAREEAKKFTKE

SEQ ID NO: 123341 - protein, 15 aa, Borrelia afzelii
KAKAREEAKKFTKEE

SEQ ID NO: 123342 - protein, 15 aa, Borrelia afzelii
AKAREEAKKFTKEEL

SEQ ID NO: 123343 - protein, 15 aa, Borrelia afzelii
KAREEAKKFTKEELE

SEQ ID NO: 123344 - protein, 15 aa, Borrelia afzelii
AREEAKKFTKEELEK

SEQ ID NO: 123345 - protein, 15 aa, Borrelia afzelii
REEAKKFTKEELEKD

SEQ ID NO: 123346 - protein, 15 aa, Borrelia afzelii
EEAKKFTKEELEKDL

SEQ ID NO: 123347 - protein, 15 aa, Borrelia afzelii
EAKKFTKEELEKDLK

SEQ ID NO: 123348 - protein, 15 aa, Borrelia afzelii
AKKFTKEELEKDLKT

SEQ ID NO: 123349 - protein, 15 aa, Borrelia afzelii
KKFTKEELEKDLKTL

SEQ ID NO: 123350 - protein, 15 aa, Borrelia afzelii
KFTKEELEKDLKTLL

SEQ ID NO: 123351 - protein, 15 aa, Borrelia afzelii
FTKEELEKDLKTLLN

SEQ ID NO: 123352 - protein, 15 aa, Borrelia afzelii
TKEELEKDLKTLLNY

SEQ ID NO: 123353 - protein, 15 aa, Borrelia afzelii
KEELEKDLKTLLNYI

SEQ ID NO: 123354 - protein, 15 aa, Borrelia afzelii
EELEKDLKTLLNYIQ

SEQ ID NO: 123355 - protein, 15 aa, Borrelia afzelii
ELEKDLKTLLNYIQV

SEQ ID NO: 123356 - protein, 15 aa, Borrelia afzelii
LEKDLKTLLNYIQVS

SEQ ID NO: 123357 - protein, 15 aa, Borrelia afzelii
EKDLKTLLNYIQVSA

SEQ ID NO: 123358 - protein, 15 aa, Borrelia afzelii
KDLKTLLNYIQVSAR

SEQ ID NO: 123359 - protein, 15 aa, Borrelia afzelii
DLKTLLNYIQVSART

SEQ ID NO: 123360 - protein, 15 aa, Borrelia afzelii
LKTLLNYIQVSARTA

SEQ ID NO: 123361 - protein, 15 aa, Borrelia afzelii
KTLLNYIQVSARTAT

SEQ ID NO: 123362 - protein, 15 aa, Borrelia afzelii
TLLNYIQVSARTATN

SEQ ID NO: 123363 - protein, 15 aa, Borrelia afzelii
LLNYIQVSARTATNF

SEQ ID NO: 123364 - protein, 15 aa, Borrelia afzelii
LNYIQVSARTATNFV

SEQ ID NO: 123365 - protein, 15 aa, Borrelia afzelii
NYIQVSARTATNFVY

SEQ ID NO: 123366 - protein, 15 aa, Borrelia afzelii
YIQVSARTATNFVYA

SEQ ID NO: 123367 - protein, 15 aa, Borrelia afzelii
IQVSARTATNFVYAR

SEQ ID NO: 123368 - protein, 15 aa, Borrelia afzelii
QVSARTATNFVYARE

SEQ ID NO: 123369 - protein, 15 aa, Borrelia afzelii
VSARTATNFVYAREI

SEQ ID NO: 123370 - protein, 15 aa, Borrelia afzelii
SARTATNFVYAREIY

SEQ ID NO: 123371 - protein, 15 aa, Borrelia afzelii
ARTATNFVYAREIYS

SEQ ID NO: 123372 - protein, 15 aa, Borrelia afzelii
RTATNFVYAREIYSK

SEQ ID NO: 123373 - protein, 15 aa, Borrelia afzelii
TATNFVYAREIYSKR

SEQ ID NO: 123374 - protein, 15 aa, Borrelia afzelii
ATNFVYAREIYSKRK

SEQ ID NO: 123375 - protein, 15 aa, Borrelia afzelii
TNFVYAREIYSKRKL

SEQ ID NO: 123376 - protein, 15 aa, Borrelia afzelii
NFVYAREIYSKRKLD

SEQ ID NO: 123377 - protein, 15 aa, Borrelia afzelii
FVYAREIYSKRKLDA

SEQ ID NO: 123378 - protein, 15 aa, Borrelia afzelii
VYAREIYSKRKLDAI

SEQ ID NO: 123379 - protein, 15 aa, Borrelia afzelii
YAREIYSKRKLDAIE

SEQ ID NO: 123380 - protein, 15 aa, Borrelia afzelii
AREIYSKRKLDAIET

SEQ ID NO: 123381 - protein, 15 aa, Borrelia afzelii
REIYSKRKLDAIETE

SEQ ID NO: 123382 - protein, 15 aa, Borrelia afzelii
EIYSKRKLDAIETEI

SEQ ID NO: 123383 - protein, 15 aa, Borrelia afzelii
IYSKRKLDAIETEIK

SEQ ID NO: 123384 - protein, 15 aa, Borrelia afzelii
YSKRKLDAIETEIKN

SEQ ID NO: 123385 - protein, 15 aa, Borrelia afzelii
SKRKLDAIETEIKNL

SEQ ID NO: 123386 - protein, 15 aa, Borrelia afzelii
KRKLDAIETEIKNLI

SEQ ID NO: 123387 - protein, 15 aa, Borrelia afzelii
RKLDAIETEIKNLIL

SEQ ID NO: 123388 - protein, 15 aa, Borrelia afzelii
KLDAIETEIKNLILK

SEQ ID NO: 123389 - protein, 15 aa, Borrelia afzelii
LDAIETEIKNLILKI

SEQ ID NO: 123390 - protein, 15 aa, Borrelia afzelii
DAIETEIKNLILKIK

SEQ ID NO: 123391 - protein, 15 aa, Borrelia afzelii
AIETEIKNLILKIKG

SEQ ID NO: 123392 - protein, 15 aa, Borrelia afzelii
IETEIKNLILKIKGQ

SEQ ID NO: 123393 - protein, 15 aa, Borrelia afzelii
ETEIKNLILKIKGQS

SEQ ID NO: 123394 - protein, 15 aa, Borrelia afzelii
TEIKNLILKIKGQSD

SEQ ID NO: 123395 - protein, 15 aa, Borrelia afzelii
EIKNLILKIKGQSDL

SEQ ID NO: 123396 - protein, 15 aa, Borrelia afzelii
IKNLILKIKGQSDLY

SEQ ID NO: 123397 - protein, 15 aa, Borrelia afzelii
KNLILKIKGQSDLYE

SEQ ID NO: 123398 - protein, 15 aa, Borrelia afzelii
NLILKIKGQSDLYEA

SEQ ID NO: 123399 - protein, 15 aa, Borrelia afzelii
LILKIKGQSDLYEAY

SEQ ID NO: 123400 - protein, 15 aa, Borrelia afzelii
ILKIKGQSDLYEAYK

SEQ ID NO: 123401 - protein, 15 aa, Borrelia afzelii
LKIKGQSDLYEAYKA

SEQ ID NO: 123402 - protein, 15 aa, Borrelia afzelii
KIKGQSDLYEAYKAI

SEQ ID NO: 123403 - protein, 15 aa, Borrelia afzelii
IKGQSDLYEAYKAIV

SEQ ID NO: 123404 - protein, 15 aa, Borrelia afzelii
KGQSDLYEAYKAIVR

SEQ ID NO: 123405 - protein, 15 aa, Borrelia afzelii
GQSDLYEAYKAIVRS

SEQ ID NO: 123406 - protein, 15 aa, Borrelia afzelii
QSDLYEAYKAIVRSI

SEQ ID NO: 123407 - protein, 15 aa, Borrelia afzelii
SDLYEAYKAIVRSIL

SEQ ID NO: 123408 - protein, 15 aa, Borrelia afzelii
DLYEAYKAIVRSILL

SEQ ID NO: 123409 - protein, 15 aa, Borrelia afzelii
LYEAYKAIVRSILLM

SEQ ID NO: 123410 - protein, 15 aa, Borrelia afzelii
YEAYKAIVRSILLMK

SEQ ID NO: 123411 - protein, 15 aa, Borrelia afzelii
EAYKAIVRSILLMKD

SEQ ID NO: 123412 - protein, 15 aa, Borrelia afzelii
AYKAIVRSILLMKDS

SEQ ID NO: 123413 - protein, 15 aa, Borrelia afzelii
YKAIVRSILLMKDSL

SEQ ID NO: 123414 - protein, 15 aa, Borrelia afzelii
KAIVRSILLMKDSLK

SEQ ID NO: 123415 - protein, 15 aa, Borrelia afzelii
AIVRSILLMKDSLKI

SEQ ID NO: 123416 - protein, 15 aa, Borrelia afzelii
IVRSILLMKDSLKII

SEQ ID NO: 123417 - protein, 15 aa, Borrelia afzelii
VRSILLMKDSLKIIE

SEQ ID NO: 123418 - protein, 15 aa, Borrelia afzelii
RSILLMKDSLKIIEI

SEQ ID NO: 123419 - protein, 15 aa, Borrelia afzelii
SILLMKDSLKIIEIV

SEQ ID NO: 123420 - protein, 15 aa, Borrelia afzelii
ILLMKDSLKIIEIVI

SEQ ID NO: 123421 - protein, 15 aa, Borrelia afzelii
LLMKDSLKIIEIVID

SEQ ID NO: 123422 - protein, 15 aa, Borrelia afzelii
LMKDSLKIIEIVIDK

SEQ ID NO: 123423 - protein, 15 aa, Borrelia afzelii
MKDSLKIIEIVIDKN

SEQ ID NO: 123424 - protein, 15 aa, Borrelia afzelii
KDSLKIIEIVIDKNG

SEQ ID NO: 123425 - protein, 15 aa, Borrelia afzelii
DSLKIIEIVIDKNGV

SEQ ID NO: 123426 - protein, 15 aa, Borrelia afzelii
SLKIIEIVIDKNGVW

SEQ ID NO: 123427 - protein, 15 aa, Borrelia afzelii
LKIIEIVIDKNGVWY

SEQ ID NO: 123428 - protein, 16 aa, Borrelia afzelii
MKIKSKCLALGLLFGF

SEQ ID NO: 123429 - protein, 16 aa, Borrelia afzelii
KIKSKCLALGLLFGFI

SEQ ID NO: 123430 - protein, 16 aa, Borrelia afzelii
IKSKCLALGLLFGFIS

SEQ ID NO: 123431 - protein, 16 aa, Borrelia afzelii
KSKCLALGLLFGFISC

SEQ ID NO: 123432 - protein, 16 aa, Borrelia afzelii
SKCLALGLLFGFISCD

SEQ ID NO: 123433 - protein, 16 aa, Borrelia afzelii
KCLALGLLFGFISCDL

SEQ ID NO: 123434 - protein, 16 aa, Borrelia afzelii
CLALGLLFGFISCDLF

SEQ ID NO: 123435 - protein, 16 aa, Borrelia afzelii
LALGLLFGFISCDLFI

SEQ ID NO: 123436 - protein, 16 aa, Borrelia afzelii
ALGLLFGFISCDLFIR

SEQ ID NO: 123437 - protein, 16 aa, Borrelia afzelii
LGLLFGFISCDLFIRD

SEQ ID NO: 123438 - protein, 16 aa, Borrelia afzelii
GLLFGFISCDLFIRDE

SEQ ID NO: 123439 - protein, 16 aa, Borrelia afzelii
LLFGFISCDLFIRDEI

SEQ ID NO: 123440 - protein, 16 aa, Borrelia afzelii
LFGFISCDLFIRDEIK

SEQ ID NO: 123441 - protein, 16 aa, Borrelia afzelii
FGFISCDLFIRDEIKE

SEQ ID NO: 123442 - protein, 16 aa, Borrelia afzelii
GFISCDLFIRDEIKEK

SEQ ID NO: 123443 - protein, 16 aa, Borrelia afzelii
FISCDLFIRDEIKEKS

SEQ ID NO: 123444 - protein, 16 aa, Borrelia afzelii
ISCDLFIRDEIKEKSL

SEQ ID NO: 123445 - protein, 16 aa, Borrelia afzelii
SCDLFIRDEIKEKSLG

SEQ ID NO: 123446 - protein, 16 aa, Borrelia afzelii
CDLFIRDEIKEKSLGL

SEQ ID NO: 123447 - protein, 16 aa, Borrelia afzelii
DLFIRDEIKEKSLGLC

SEQ ID NO: 123448 - protein, 16 aa, Borrelia afzelii
LFIRDEIKEKSLGLCD

SEQ ID NO: 123449 - protein, 16 aa, Borrelia afzelii
FIRDEIKEKSLGLCDE

SEQ ID NO: 123450 - protein, 16 aa, Borrelia afzelii
IRDEIKEKSLGLCDEE

SEQ ID NO: 123451 - protein, 16 aa, Borrelia afzelii
RDEIKEKSLGLCDEES

SEQ ID NO: 123452 - protein, 16 aa, Borrelia afzelii
DEIKEKSLGLCDEESS

SEQ ID NO: 123453 - protein, 16 aa, Borrelia afzelii
EIKEKSLGLCDEESSI

SEQ ID NO: 123454 - protein, 16 aa, Borrelia afzelii
IKEKSLGLCDEESSIL

SEQ ID NO: 123455 - protein, 16 aa, Borrelia afzelii
KEKSLGLCDEESSILE

SEQ ID NO: 123456 - protein, 16 aa, Borrelia afzelii
EKSLGLCDEESSILET

SEQ ID NO: 123457 - protein, 16 aa, Borrelia afzelii
KSLGLCDEESSILETG

SEQ ID NO: 123458 - protein, 16 aa, Borrelia afzelii
SLGLCDEESSILETGD

SEQ ID NO: 123459 - protein, 16 aa, Borrelia afzelii
LGLCDEESSILETGDK

SEQ ID NO: 123460 - protein, 16 aa, Borrelia afzelii
GLCDEESSILETGDKS

SEQ ID NO: 123461 - protein, 16 aa, Borrelia afzelii
LCDEESSILETGDKSV

SEQ ID NO: 123462 - protein, 16 aa, Borrelia afzelii
CDEESSILETGDKSVK

SEQ ID NO: 123463 - protein, 16 aa, Borrelia afzelii
DEESSILETGDKSVKK

SEQ ID NO: 123464 - protein, 16 aa, Borrelia afzelii
EESSILETGDKSVKKS

SEQ ID NO: 123465 - protein, 16 aa, Borrelia afzelii
ESSILETGDKSVKKSL

SEQ ID NO: 123466 - protein, 16 aa, Borrelia afzelii
SSILETGDKSVKKSLN

SEQ ID NO: 123467 - protein, 16 aa, Borrelia afzelii
SILETGDKSVKKSLNK

SEQ ID NO: 123468 - protein, 16 aa, Borrelia afzelii
ILETGDKSVKKSLNKK

SEQ ID NO: 123469 - protein, 16 aa, Borrelia afzelii
LETGDKSVKKSLNKKG

SEQ ID NO: 123470 - protein, 16 aa, Borrelia afzelii
ETGDKSVKKSLNKKGK

SEQ ID NO: 123471 - protein, 16 aa, Borrelia afzelii
TGDKSVKKSLNKKGKD

SEQ ID NO: 123472 - protein, 16 aa, Borrelia afzelii
GDKSVKKSLNKKGKDK

SEQ ID NO: 123473 - protein, 16 aa, Borrelia afzelii
DKSVKKSLNKKGKDKV

SEQ ID NO: 123474 - protein, 16 aa, Borrelia afzelii
KSVKKSLNKKGKDKVA

SEQ ID NO: 123475 - protein, 16 aa, Borrelia afzelii
SVKKSLNKKGKDKVAR

SEQ ID NO: 123476 - protein, 16 aa, Borrelia afzelii
VKKSLNKKGKDKVARK

SEQ ID NO: 123477 - protein, 16 aa, Borrelia afzelii
KKSLNKKGKDKVARKK

SEQ ID NO: 123478 - protein, 16 aa, Borrelia afzelii
KSLNKKGKDKVARKKV

SEQ ID NO: 123479 - protein, 16 aa, Borrelia afzelii
SLNKKGKDKVARKKVE

SEQ ID NO: 123480 - protein, 16 aa, Borrelia afzelii
LNKKGKDKVARKKVEG

SEQ ID NO: 123481 - protein, 16 aa, Borrelia afzelii
NKKGKDKVARKKVEGN

SEQ ID NO: 123482 - protein, 16 aa, Borrelia afzelii
KKGKDKVARKKVEGNA

SEQ ID NO: 123483 - protein, 16 aa, Borrelia afzelii
KGKDKVARKKVEGNAV

SEQ ID NO: 123484 - protein, 16 aa, Borrelia afzelii
GKDKVARKKVEGNAVK

SEQ ID NO: 123485 - protein, 16 aa, Borrelia afzelii
KDKVARKKVEGNAVKK

SEQ ID NO: 123486 - protein, 16 aa, Borrelia afzelii
DKVARKKVEGNAVKKD

SEQ ID NO: 123487 - protein, 16 aa, Borrelia afzelii
KVARKKVEGNAVKKDP

SEQ ID NO: 123488 - protein, 16 aa, Borrelia afzelii
VARKKVEGNAVKKDPF

SEQ ID NO: 123489 - protein, 16 aa, Borrelia afzelii
ARKKVEGNAVKKDPFN

SEQ ID NO: 123490 - protein, 16 aa, Borrelia afzelii
RKKVEGNAVKKDPFNH

SEQ ID NO: 123491 - protein, 16 aa, Borrelia afzelii
KKVEGNAVKKDPFNHH

SEQ ID NO: 123492 - protein, 16 aa, Borrelia afzelii
KVEGNAVKKDPFNHHV

SEQ ID NO: 123493 - protein, 16 aa, Borrelia afzelii
VEGNAVKKDPFNHHVK

SEQ ID NO: 123494 - protein, 16 aa, Borrelia afzelii
EGNAVKKDPFNHHVKR

SEQ ID NO: 123495 - protein, 16 aa, Borrelia afzelii
GNAVKKDPFNHHVKRE

SEQ ID NO: 123496 - protein, 16 aa, Borrelia afzelii
NAVKKDPFNHHVKRES

SEQ ID NO: 123497 - protein, 16 aa, Borrelia afzelii
AVKKDPFNHHVKRESV

SEQ ID NO: 123498 - protein, 16 aa, Borrelia afzelii
VKKDPFNHHVKRESVN

SEQ ID NO: 123499 - protein, 16 aa, Borrelia afzelii
KKDPFNHHVKRESVNN

SEQ ID NO: 123500 - protein, 16 aa, Borrelia afzelii
KDPFNHHVKRESVNNS

SEQ ID NO: 123501 - protein, 16 aa, Borrelia afzelii
DPFNHHVKRESVNNSN

SEQ ID NO: 123502 - protein, 16 aa, Borrelia afzelii
PFNHHVKRESVNNSNL

SEQ ID NO: 123503 - protein, 16 aa, Borrelia afzelii
FNHHVKRESVNNSNLS

SEQ ID NO: 123504 - protein, 16 aa, Borrelia afzelii
NHHVKRESVNNSNLSQ

SEQ ID NO: 123505 - protein, 16 aa, Borrelia afzelii
HHVKRESVNNSNLSQK

SEQ ID NO: 123506 - protein, 16 aa, Borrelia afzelii
HVKRESVNNSNLSQKN

SEQ ID NO: 123507 - protein, 16 aa, Borrelia afzelii
VKRESVNNSNLSQKNV

SEQ ID NO: 123508 - protein, 16 aa, Borrelia afzelii
KRESVNNSNLSQKNVI

SEQ ID NO: 123509 - protein, 16 aa, Borrelia afzelii
RESVNNSNLSQKNVIS

SEQ ID NO: 123510 - protein, 16 aa, Borrelia afzelii
ESVNNSNLSQKNVISE

SEQ ID NO: 123511 - protein, 16 aa, Borrelia afzelii
SVNNSNLSQKNVISEE

SEQ ID NO: 123512 - protein, 16 aa, Borrelia afzelii
VNNSNLSQKNVISEEE

SEQ ID NO: 123513 - protein, 16 aa, Borrelia afzelii
NNSNLSQKNVISEEEI

SEQ ID NO: 123514 - protein, 16 aa, Borrelia afzelii
NSNLSQKNVISEEEIL

SEQ ID NO: 123515 - protein, 16 aa, Borrelia afzelii
SNLSQKNVISEEEILK

SEQ ID NO: 123516 - protein, 16 aa, Borrelia afzelii
NLSQKNVISEEEILKT

SEQ ID NO: 123517 - protein, 16 aa, Borrelia afzelii
LSQKNVISEEEILKTK

SEQ ID NO: 123518 - protein, 16 aa, Borrelia afzelii
SQKNVISEEEILKTKL

SEQ ID NO: 123519 - protein, 16 aa, Borrelia afzelii
QKNVISEEEILKTKLL

SEQ ID NO: 123520 - protein, 16 aa, Borrelia afzelii
KNVISEEEILKTKLLR

SEQ ID NO: 123521 - protein, 16 aa, Borrelia afzelii
NVISEEEILKTKLLRE

SEQ ID NO: 123522 - protein, 16 aa, Borrelia afzelii
VISEEEILKTKLLRER

SEQ ID NO: 123523 - protein, 16 aa, Borrelia afzelii
ISEEEILKTKLLRERP

SEQ ID NO: 123524 - protein, 16 aa, Borrelia afzelii
SEEEILKTKLLRERPE

SEQ ID NO: 123525 - protein, 16 aa, Borrelia afzelii
EEEILKTKLLRERPET

SEQ ID NO: 123526 - protein, 16 aa, Borrelia afzelii
EEILKTKLLRERPETR

SEQ ID NO: 123527 - protein, 16 aa, Borrelia afzelii
EILKTKLLRERPETRK

SEQ ID NO: 123528 - protein, 16 aa, Borrelia afzelii
ILKTKLLRERPETRKE

SEQ ID NO: 123529 - protein, 16 aa, Borrelia afzelii
LKTKLLRERPETRKEE

SEQ ID NO: 123530 - protein, 16 aa, Borrelia afzelii
KTKLLRERPETRKEEI

SEQ ID NO: 123531 - protein, 16 aa, Borrelia afzelii
TKLLRERPETRKEEIQ

SEQ ID NO: 123532 - protein, 16 aa, Borrelia afzelii
KLLRERPETRKEEIQK

SEQ ID NO: 123533 - protein, 16 aa, Borrelia afzelii
LLRERPETRKEEIQKQ

SEQ ID NO: 123534 - protein, 16 aa, Borrelia afzelii
LRERPETRKEEIQKQQ

SEQ ID NO: 123535 - protein, 16 aa, Borrelia afzelii
RERPETRKEEIQKQQD

SEQ ID NO: 123536 - protein, 16 aa, Borrelia afzelii
ERPETRKEEIQKQQDE

SEQ ID NO: 123537 - protein, 16 aa, Borrelia afzelii
RPETRKEEIQKQQDEH

SEQ ID NO: 123538 - protein, 16 aa, Borrelia afzelii
PETRKEEIQKQQDEHK

SEQ ID NO: 123539 - protein, 16 aa, Borrelia afzelii
ETRKEEIQKQQDEHKR

SEQ ID NO: 123540 - protein, 16 aa, Borrelia afzelii
TRKEEIQKQQDEHKRM

SEQ ID NO: 123541 - protein, 16 aa, Borrelia afzelii
RKEEIQKQQDEHKRML

SEQ ID NO: 123542 - protein, 16 aa, Borrelia afzelii
KEEIQKQQDEHKRMLQ

SEQ ID NO: 123543 - protein, 16 aa, Borrelia afzelii
EEIQKQQDEHKRMLQG

SEQ ID NO: 123544 - protein, 16 aa, Borrelia afzelii
EIQKQQDEHKRMLQGS

SEQ ID NO: 123545 - protein, 16 aa, Borrelia afzelii
IQKQQDEHKRMLQGSL

SEQ ID NO: 123546 - protein, 16 aa, Borrelia afzelii
QKQQDEHKRMLQGSLS

SEQ ID NO: 123547 - protein, 16 aa, Borrelia afzelii
KQQDEHKRMLQGSLSF

SEQ ID NO: 123548 - protein, 16 aa, Borrelia afzelii
QQDEHKRMLQGSLSFL

SEQ ID NO: 123549 - protein, 16 aa, Borrelia afzelii
QDEHKRMLQGSLSFLS

SEQ ID NO: 123550 - protein, 16 aa, Borrelia afzelii
DEHKRMLQGSLSFLSG

SEQ ID NO: 123551 - protein, 16 aa, Borrelia afzelii
EHKRMLQGSLSFLSGE

SEQ ID NO: 123552 - protein, 16 aa, Borrelia afzelii
HKRMLQGSLSFLSGES

SEQ ID NO: 123553 - protein, 16 aa, Borrelia afzelii
KRMLQGSLSFLSGESG

SEQ ID NO: 123554 - protein, 16 aa, Borrelia afzelii
RMLQGSLSFLSGESGE

SEQ ID NO: 123555 - protein, 16 aa, Borrelia afzelii
MLQGSLSFLSGESGEL

SEQ ID NO: 123556 - protein, 16 aa, Borrelia afzelii
LQGSLSFLSGESGELK

SEQ ID NO: 123557 - protein, 16 aa, Borrelia afzelii
QGSLSFLSGESGELKD

SEQ ID NO: 123558 - protein, 16 aa, Borrelia afzelii
GSLSFLSGESGELKDT

SEQ ID NO: 123559 - protein, 16 aa, Borrelia afzelii
SLSFLSGESGELKDTI

SEQ ID NO: 123560 - protein, 16 aa, Borrelia afzelii
LSFLSGESGELKDTIE

SEQ ID NO: 123561 - protein, 16 aa, Borrelia afzelii
SFLSGESGELKDTIES

SEQ ID NO: 123562 - protein, 16 aa, Borrelia afzelii
FLSGESGELKDTIESN

SEQ ID NO: 123563 - protein, 16 aa, Borrelia afzelii
LSGESGELKDTIESNE

SEQ ID NO: 123564 - protein, 16 aa, Borrelia afzelii
SGESGELKDTIESNEI

SEQ ID NO: 123565 - protein, 16 aa, Borrelia afzelii
GESGELKDTIESNEID

SEQ ID NO: 123566 - protein, 16 aa, Borrelia afzelii
ESGELKDTIESNEIDF

SEQ ID NO: 123567 - protein, 16 aa, Borrelia afzelii
SGELKDTIESNEIDFT

SEQ ID NO: 123568 - protein, 16 aa, Borrelia afzelii
GELKDTIESNEIDFTI

SEQ ID NO: 123569 - protein, 16 aa, Borrelia afzelii
ELKDTIESNEIDFTID

SEQ ID NO: 123570 - protein, 16 aa, Borrelia afzelii
LKDTIESNEIDFTIDS

SEQ ID NO: 123571 - protein, 16 aa, Borrelia afzelii
KDTIESNEIDFTIDSD

SEQ ID NO: 123572 - protein, 16 aa, Borrelia afzelii
DTIESNEIDFTIDSDL

SEQ ID NO: 123573 - protein, 16 aa, Borrelia afzelii
TIESNEIDFTIDSDLR

SEQ ID NO: 123574 - protein, 16 aa, Borrelia afzelii
IESNEIDFTIDSDLRL

SEQ ID NO: 123575 - protein, 16 aa, Borrelia afzelii
ESNEIDFTIDSDLRLK

SEQ ID NO: 123576 - protein, 16 aa, Borrelia afzelii
SNEIDFTIDSDLRLKS

SEQ ID NO: 123577 - protein, 16 aa, Borrelia afzelii
NEIDFTIDSDLRLKSD

SEQ ID NO: 123578 - protein, 16 aa, Borrelia afzelii
EIDFTIDSDLRLKSDL

SEQ ID NO: 123579 - protein, 16 aa, Borrelia afzelii
IDFTIDSDLRLKSDLQ

SEQ ID NO: 123580 - protein, 16 aa, Borrelia afzelii
DFTIDSDLRLKSDLQA

SEQ ID NO: 123581 - protein, 16 aa, Borrelia afzelii
FTIDSDLRLKSDLQAI

SEQ ID NO: 123582 - protein, 16 aa, Borrelia afzelii
TIDSDLRLKSDLQAIS

SEQ ID NO: 123583 - protein, 16 aa, Borrelia afzelii
IDSDLRLKSDLQAISG

SEQ ID NO: 123584 - protein, 16 aa, Borrelia afzelii
DSDLRLKSDLQAISGS

SEQ ID NO: 123585 - protein, 16 aa, Borrelia afzelii
SDLRLKSDLQAISGSN

SEQ ID NO: 123586 - protein, 16 aa, Borrelia afzelii
DLRLKSDLQAISGSNS

SEQ ID NO: 123587 - protein, 16 aa, Borrelia afzelii
LRLKSDLQAISGSNSI

SEQ ID NO: 123588 - protein, 16 aa, Borrelia afzelii
RLKSDLQAISGSNSIS

SEQ ID NO: 123589 - protein, 16 aa, Borrelia afzelii
LKSDLQAISGSNSISY

SEQ ID NO: 123590 - protein, 16 aa, Borrelia afzelii
KSDLQAISGSNSISYT

SEQ ID NO: 123591 - protein, 16 aa, Borrelia afzelii
SDLQAISGSNSISYTD

SEQ ID NO: 123592 - protein, 16 aa, Borrelia afzelii
DLQAISGSNSISYTDE

SEQ ID NO: 123593 - protein, 16 aa, Borrelia afzelii
LQAISGSNSISYTDEI

SEQ ID NO: 123594 - protein, 16 aa, Borrelia afzelii
QAISGSNSISYTDEIE

SEQ ID NO: 123595 - protein, 16 aa, Borrelia afzelii
AISGSNSISYTDEIEE

SEQ ID NO: 123596 - protein, 16 aa, Borrelia afzelii
ISGSNSISYTDEIEEE

SEQ ID NO: 123597 - protein, 16 aa, Borrelia afzelii
SGSNSISYTDEIEEED

SEQ ID NO: 123598 - protein, 16 aa, Borrelia afzelii
GSNSISYTDEIEEEDY

SEQ ID NO: 123599 - protein, 16 aa, Borrelia afzelii
SNSISYTDEIEEEDYD

SEQ ID NO: 123600 - protein, 16 aa, Borrelia afzelii
NSISYTDEIEEEDYDQ

SEQ ID NO: 123601 - protein, 16 aa, Borrelia afzelii
SISYTDEIEEEDYDQY

SEQ ID NO: 123602 - protein, 16 aa, Borrelia afzelii
ISYTDEIEEEDYDQYS

SEQ ID NO: 123603 - protein, 16 aa, Borrelia afzelii
SYTDEIEEEDYDQYSL

SEQ ID NO: 123604 - protein, 16 aa, Borrelia afzelii
YTDEIEEEDYDQYSLE

SEQ ID NO: 123605 - protein, 16 aa, Borrelia afzelii
TDEIEEEDYDQYSLEE

SEQ ID NO: 123606 - protein, 16 aa, Borrelia afzelii
DEIEEEDYDQYSLEED

SEQ ID NO: 123607 - protein, 16 aa, Borrelia afzelii
EIEEEDYDQYSLEEDY

SEQ ID NO: 123608 - protein, 16 aa, Borrelia afzelii
IEEEDYDQYSLEEDYY

SEQ ID NO: 123609 - protein, 16 aa, Borrelia afzelii
EEEDYDQYSLEEDYYY

SEQ ID NO: 123610 - protein, 16 aa, Borrelia afzelii
EEDYDQYSLEEDYYYD

SEQ ID NO: 123611 - protein, 16 aa, Borrelia afzelii
EDYDQYSLEEDYYYDG

SEQ ID NO: 123612 - protein, 16 aa, Borrelia afzelii
DYDQYSLEEDYYYDGE

SEQ ID NO: 123613 - protein, 16 aa, Borrelia afzelii
YDQYSLEEDYYYDGET

SEQ ID NO: 123614 - protein, 16 aa, Borrelia afzelii
DQYSLEEDYYYDGETR

SEQ ID NO: 123615 - protein, 16 aa, Borrelia afzelii
QYSLEEDYYYDGETRL

SEQ ID NO: 123616 - protein, 16 aa, Borrelia afzelii
YSLEEDYYYDGETRLS

SEQ ID NO: 123617 - protein, 16 aa, Borrelia afzelii
SLEEDYYYDGETRLSN

SEQ ID NO: 123618 - protein, 16 aa, Borrelia afzelii
LEEDYYYDGETRLSNR

SEQ ID NO: 123619 - protein, 16 aa, Borrelia afzelii
EEDYYYDGETRLSNRY

SEQ ID NO: 123620 - protein, 16 aa, Borrelia afzelii
EDYYYDGETRLSNRYE

SEQ ID NO: 123621 - protein, 16 aa, Borrelia afzelii
DYYYDGETRLSNRYES

SEQ ID NO: 123622 - protein, 16 aa, Borrelia afzelii
YYYDGETRLSNRYESY

SEQ ID NO: 123623 - protein, 16 aa, Borrelia afzelii
YYDGETRLSNRYESYL

SEQ ID NO: 123624 - protein, 16 aa, Borrelia afzelii
YDGETRLSNRYESYLE

SEQ ID NO: 123625 - protein, 16 aa, Borrelia afzelii
DGETRLSNRYESYLEG

SEQ ID NO: 123626 - protein, 16 aa, Borrelia afzelii
GETRLSNRYESYLEGV

SEQ ID NO: 123627 - protein, 16 aa, Borrelia afzelii
ETRLSNRYESYLEGVK

SEQ ID NO: 123628 - protein, 16 aa, Borrelia afzelii
TRLSNRYESYLEGVKY

SEQ ID NO: 123629 - protein, 16 aa, Borrelia afzelii
RLSNRYESYLEGVKYN

SEQ ID NO: 123630 - protein, 16 aa, Borrelia afzelii
LSNRYESYLEGVKYNV

SEQ ID NO: 123631 - protein, 16 aa, Borrelia afzelii
SNRYESYLEGVKYNVS

SEQ ID NO: 123632 - protein, 16 aa, Borrelia afzelii
NRYESYLEGVKYNVSS

SEQ ID NO: 123633 - protein, 16 aa, Borrelia afzelii
RYESYLEGVKYNVSSA

SEQ ID NO: 123634 - protein, 16 aa, Borrelia afzelii
YESYLEGVKYNVSSAI

SEQ ID NO: 123635 - protein, 16 aa, Borrelia afzelii
ESYLEGVKYNVSSAIK

SEQ ID NO: 123636 - protein, 16 aa, Borrelia afzelii
SYLEGVKYNVSSAIKT

SEQ ID NO: 123637 - protein, 16 aa, Borrelia afzelii
YLEGVKYNVSSAIKTI

SEQ ID NO: 123638 - protein, 16 aa, Borrelia afzelii
LEGVKYNVSSAIKTIV

SEQ ID NO: 123639 - protein, 16 aa, Borrelia afzelii
EGVKYNVSSAIKTIVK

SEQ ID NO: 123640 - protein, 16 aa, Borrelia afzelii
GVKYNVSSAIKTIVKI

SEQ ID NO: 123641 - protein, 16 aa, Borrelia afzelii
VKYNVSSAIKTIVKIY

SEQ ID NO: 123642 - protein, 16 aa, Borrelia afzelii
KYNVSSAIKTIVKIYD

SEQ ID NO: 123643 - protein, 16 aa, Borrelia afzelii
YNVSSAIKTIVKIYDN

SEQ ID NO: 123644 - protein, 16 aa, Borrelia afzelii
NVSSAIKTIVKIYDNY

SEQ ID NO: 123645 - protein, 16 aa, Borrelia afzelii
VSSAIKTIVKIYDNYT

SEQ ID NO: 123646 - protein, 16 aa, Borrelia afzelii
SSAIKTIVKIYDNYTL

SEQ ID NO: 123647 - protein, 16 aa, Borrelia afzelii
SAIKTIVKIYDNYTLL

SEQ ID NO: 123648 - protein, 16 aa, Borrelia afzelii
AIKTIVKIYDNYTLLS

SEQ ID NO: 123649 - protein, 16 aa, Borrelia afzelii
IKTIVKIYDNYTLLST

SEQ ID NO: 123650 - protein, 16 aa, Borrelia afzelii
KTIVKIYDNYTLLSTK

SEQ ID NO: 123651 - protein, 16 aa, Borrelia afzelii
TIVKIYDNYTLLSTKQ

SEQ ID NO: 123652 - protein, 16 aa, Borrelia afzelii
IVKIYDNYTLLSTKQT

SEQ ID NO: 123653 - protein, 16 aa, Borrelia afzelii
VKIYDNYTLLSTKQTQ

SEQ ID NO: 123654 - protein, 16 aa, Borrelia afzelii
KIYDNYTLLSTKQTQM

SEQ ID NO: 123655 - protein, 16 aa, Borrelia afzelii
IYDNYTLLSTKQTQMY

SEQ ID NO: 123656 - protein, 16 aa, Borrelia afzelii
YDNYTLLSTKQTQMYS

SEQ ID NO: 123657 - protein, 16 aa, Borrelia afzelii
DNYTLLSTKQTQMYST

SEQ ID NO: 123658 - protein, 16 aa, Borrelia afzelii
NYTLLSTKQTQMYSTR

SEQ ID NO: 123659 - protein, 16 aa, Borrelia afzelii
YTLLSTKQTQMYSTRL

SEQ ID NO: 123660 - protein, 16 aa, Borrelia afzelii
TLLSTKQTQMYSTRLD

SEQ ID NO: 123661 - protein, 16 aa, Borrelia afzelii
LLSTKQTQMYSTRLDN

SEQ ID NO: 123662 - protein, 16 aa, Borrelia afzelii
LSTKQTQMYSTRLDNL

SEQ ID NO: 123663 - protein, 16 aa, Borrelia afzelii
STKQTQMYSTRLDNLA

SEQ ID NO: 123664 - protein, 16 aa, Borrelia afzelii
TKQTQMYSTRLDNLAK

SEQ ID NO: 123665 - protein, 16 aa, Borrelia afzelii
KQTQMYSTRLDNLAKA

SEQ ID NO: 123666 - protein, 16 aa, Borrelia afzelii
QTQMYSTRLDNLAKAK

SEQ ID NO: 123667 - protein, 16 aa, Borrelia afzelii
TQMYSTRLDNLAKAKA

SEQ ID NO: 123668 - protein, 16 aa, Borrelia afzelii
QMYSTRLDNLAKAKAR

SEQ ID NO: 123669 - protein, 16 aa, Borrelia afzelii
MYSTRLDNLAKAKARE

SEQ ID NO: 123670 - protein, 16 aa, Borrelia afzelii
YSTRLDNLAKAKAREE

SEQ ID NO: 123671 - protein, 16 aa, Borrelia afzelii
STRLDNLAKAKAREEA

SEQ ID NO: 123672 - protein, 16 aa, Borrelia afzelii
TRLDNLAKAKAREEAK

SEQ ID NO: 123673 - protein, 16 aa, Borrelia afzelii
RLDNLAKAKAREEAKK

SEQ ID NO: 123674 - protein, 16 aa, Borrelia afzelii
LDNLAKAKAREEAKKF

SEQ ID NO: 123675 - protein, 16 aa, Borrelia afzelii
DNLAKAKAREEAKKFT

SEQ ID NO: 123676 - protein, 16 aa, Borrelia afzelii
NLAKAKAREEAKKFTK

SEQ ID NO: 123677 - protein, 16 aa, Borrelia afzelii
LAKAKAREEAKKFTKE

SEQ ID NO: 123678 - protein, 16 aa, Borrelia afzelii
AKAKAREEAKKFTKEE

SEQ ID NO: 123679 - protein, 16 aa, Borrelia afzelii
KAKAREEAKKFTKEEL

SEQ ID NO: 123680 - protein, 16 aa, Borrelia afzelii
AKAREEAKKFTKEELE

SEQ ID NO: 123681 - protein, 16 aa, Borrelia afzelii
KAREEAKKFTKEELEK

SEQ ID NO: 123682 - protein, 16 aa, Borrelia afzelii
AREEAKKFTKEELEKD

SEQ ID NO: 123683 - protein, 16 aa, Borrelia afzelii
REEAKKFTKEELEKDL

SEQ ID NO: 123684 - protein, 16 aa, Borrelia afzelii
EEAKKFTKEELEKDLK

SEQ ID NO: 123685 - protein, 16 aa, Borrelia afzelii
EAKKFTKEELEKDLKT

SEQ ID NO: 123686 - protein, 16 aa, Borrelia afzelii
AKKFTKEELEKDLKTL

SEQ ID NO: 123687 - protein, 16 aa, Borrelia afzelii
KKFTKEELEKDLKTLL

SEQ ID NO: 123688 - protein, 16 aa, Borrelia afzelii
KFTKEELEKDLKTLLN

SEQ ID NO: 123689 - protein, 16 aa, Borrelia afzelii
FTKEELEKDLKTLLNY

SEQ ID NO: 123690 - protein, 16 aa, Borrelia afzelii
TKEELEKDLKTLLNYI

SEQ ID NO: 123691 - protein, 16 aa, Borrelia afzelii
KEELEKDLKTLLNYIQ

SEQ ID NO: 123692 - protein, 16 aa, Borrelia afzelii
EELEKDLKTLLNYIQV

SEQ ID NO: 123693 - protein, 16 aa, Borrelia afzelii
ELEKDLKTLLNYIQVS

SEQ ID NO: 123694 - protein, 16 aa, Borrelia afzelii
LEKDLKTLLNYIQVSA

SEQ ID NO: 123695 - protein, 16 aa, Borrelia afzelii
EKDLKTLLNYIQVSAR

SEQ ID NO: 123696 - protein, 16 aa, Borrelia afzelii
KDLKTLLNYIQVSART

SEQ ID NO: 123697 - protein, 16 aa, Borrelia afzelii
DLKTLLNYIQVSARTA

SEQ ID NO: 123698 - protein, 16 aa, Borrelia afzelii
LKTLLNYIQVSARTAT

SEQ ID NO: 123699 - protein, 16 aa, Borrelia afzelii
KTLLNYIQVSARTATN

SEQ ID NO: 123700 - protein, 16 aa, Borrelia afzelii
TLLNYIQVSARTATNF

SEQ ID NO: 123701 - protein, 16 aa, Borrelia afzelii
LLNYIQVSARTATNFV

SEQ ID NO: 123702 - protein, 16 aa, Borrelia afzelii
LNYIQVSARTATNFVY

SEQ ID NO: 123703 - protein, 16 aa, Borrelia afzelii
NYIQVSARTATNFVYA

SEQ ID NO: 123704 - protein, 16 aa, Borrelia afzelii
YIQVSARTATNFVYAR

SEQ ID NO: 123705 - protein, 16 aa, Borrelia afzelii
IQVSARTATNFVYARE

SEQ ID NO: 123706 - protein, 16 aa, Borrelia afzelii
QVSARTATNFVYAREI

SEQ ID NO: 123707 - protein, 16 aa, Borrelia afzelii
VSARTATNFVYAREIY

SEQ ID NO: 123708 - protein, 16 aa, Borrelia afzelii
SARTATNFVYAREIYS

SEQ ID NO: 123709 - protein, 16 aa, Borrelia afzelii
ARTATNFVYAREIYSK

SEQ ID NO: 123710 - protein, 16 aa, Borrelia afzelii
RTATNFVYAREIYSKR

SEQ ID NO: 123711 - protein, 16 aa, Borrelia afzelii
TATNFVYAREIYSKRK

SEQ ID NO: 123712 - protein, 16 aa, Borrelia afzelii
ATNFVYAREIYSKRKL

SEQ ID NO: 123713 - protein, 16 aa, Borrelia afzelii
TNFVYAREIYSKRKLD

SEQ ID NO: 123714 - protein, 16 aa, Borrelia afzelii
NFVYAREIYSKRKLDA

SEQ ID NO: 123715 - protein, 16 aa, Borrelia afzelii
FVYAREIYSKRKLDAI

SEQ ID NO: 123716 - protein, 16 aa, Borrelia afzelii
VYAREIYSKRKLDAIE

SEQ ID NO: 123717 - protein, 16 aa, Borrelia afzelii
YAREIYSKRKLDAIET

SEQ ID NO: 123718 - protein, 16 aa, Borrelia afzelii
AREIYSKRKLDAIETE

SEQ ID NO: 123719 - protein, 16 aa, Borrelia afzelii
REIYSKRKLDAIETEI

SEQ ID NO: 123720 - protein, 16 aa, Borrelia afzelii
EIYSKRKLDAIETEIK

SEQ ID NO: 123721 - protein, 16 aa, Borrelia afzelii
IYSKRKLDAIETEIKN

SEQ ID NO: 123722 - protein, 16 aa, Borrelia afzelii
YSKRKLDAIETEIKNL

SEQ ID NO: 123723 - protein, 16 aa, Borrelia afzelii
SKRKLDAIETEIKNLI

SEQ ID NO: 123724 - protein, 16 aa, Borrelia afzelii
KRKLDAIETEIKNLIL

SEQ ID NO: 123725 - protein, 16 aa, Borrelia afzelii
RKLDAIETEIKNLILK

SEQ ID NO: 123726 - protein, 16 aa, Borrelia afzelii
KLDAIETEIKNLILKI

SEQ ID NO: 123727 - protein, 16 aa, Borrelia afzelii
LDAIETEIKNLILKIK

SEQ ID NO: 123728 - protein, 16 aa, Borrelia afzelii
DAIETEIKNLILKIKG

SEQ ID NO: 123729 - protein, 16 aa, Borrelia afzelii
AIETEIKNLILKIKGQ

SEQ ID NO: 123730 - protein, 16 aa, Borrelia afzelii
IETEIKNLILKIKGQS

SEQ ID NO: 123731 - protein, 16 aa, Borrelia afzelii
ETEIKNLILKIKGQSD

SEQ ID NO: 123732 - protein, 16 aa, Borrelia afzelii
TEIKNLILKIKGQSDL

SEQ ID NO: 123733 - protein, 16 aa, Borrelia afzelii
EIKNLILKIKGQSDLY

SEQ ID NO: 123734 - protein, 16 aa, Borrelia afzelii
IKNLILKIKGQSDLYE

SEQ ID NO: 123735 - protein, 16 aa, Borrelia afzelii
KNLILKIKGQSDLYEA

SEQ ID NO: 123736 - protein, 16 aa, Borrelia afzelii
NLILKIKGQSDLYEAY

SEQ ID NO: 123737 - protein, 16 aa, Borrelia afzelii
LILKIKGQSDLYEAYK

SEQ ID NO: 123738 - protein, 16 aa, Borrelia afzelii
ILKIKGQSDLYEAYKA

SEQ ID NO: 123739 - protein, 16 aa, Borrelia afzelii
LKIKGQSDLYEAYKAI

SEQ ID NO: 123740 - protein, 16 aa, Borrelia afzelii
KIKGQSDLYEAYKAIV

SEQ ID NO: 123741 - protein, 16 aa, Borrelia afzelii
IKGQSDLYEAYKAIVR

SEQ ID NO: 123742 - protein, 16 aa, Borrelia afzelii
KGQSDLYEAYKAIVRS

SEQ ID NO: 123743 - protein, 16 aa, Borrelia afzelii
GQSDLYEAYKAIVRSI

SEQ ID NO: 123744 - protein, 16 aa, Borrelia afzelii
QSDLYEAYKAIVRSIL

SEQ ID NO: 123745 - protein, 16 aa, Borrelia afzelii
SDLYEAYKAIVRSILL

SEQ ID NO: 123746 - protein, 16 aa, Borrelia afzelii
DLYEAYKAIVRSILLM

SEQ ID NO: 123747 - protein, 16 aa, Borrelia afzelii
LYEAYKAIVRSILLMK

SEQ ID NO: 123748 - protein, 16 aa, Borrelia afzelii
YEAYKAIVRSILLMKD

SEQ ID NO: 123749 - protein, 16 aa, Borrelia afzelii
EAYKAIVRSILLMKDS

SEQ ID NO: 123750 - protein, 16 aa, Borrelia afzelii
AYKAIVRSILLMKDSL

SEQ ID NO: 123751 - protein, 16 aa, Borrelia afzelii
YKAIVRSILLMKDSLK

SEQ ID NO: 123752 - protein, 16 aa, Borrelia afzelii
KAIVRSILLMKDSLKI

SEQ ID NO: 123753 - protein, 16 aa, Borrelia afzelii
AIVRSILLMKDSLKII

SEQ ID NO: 123754 - protein, 16 aa, Borrelia afzelii
IVRSILLMKDSLKIIE

SEQ ID NO: 123755 - protein, 16 aa, Borrelia afzelii
VRSILLMKDSLKIIEI

SEQ ID NO: 123756 - protein, 16 aa, Borrelia afzelii
RSILLMKDSLKIIEIV

SEQ ID NO: 123757 - protein, 16 aa, Borrelia afzelii
SILLMKDSLKIIEIVI

SEQ ID NO: 123758 - protein, 16 aa, Borrelia afzelii
ILLMKDSLKIIEIVID

SEQ ID NO: 123759 - protein, 16 aa, Borrelia afzelii
LLMKDSLKIIEIVIDK

SEQ ID NO: 123760 - protein, 16 aa, Borrelia afzelii
LMKDSLKIIEIVIDKN

SEQ ID NO: 123761 - protein, 16 aa, Borrelia afzelii
MKDSLKIIEIVIDKNG

SEQ ID NO: 123762 - protein, 16 aa, Borrelia afzelii
KDSLKIIEIVIDKNGV

SEQ ID NO: 123763 - protein, 16 aa, Borrelia afzelii
DSLKIIEIVIDKNGVW

SEQ ID NO: 123764 - protein, 16 aa, Borrelia afzelii
SLKIIEIVIDKNGVWY

SEQ ID NO: 123765 - protein, 13 aa, Borrelia garinii
MKKVKSKYLALGL

SEQ ID NO: 123766 - protein, 13 aa, Borrelia garinii
KKVKSKYLALGLL

SEQ ID NO: 123767 - protein, 13 aa, Borrelia garinii
KVKSKYLALGLLF

SEQ ID NO: 123768 - protein, 13 aa, Borrelia garinii
VKSKYLALGLLFG

SEQ ID NO: 123769 - protein, 13 aa, Borrelia garinii
KSKYLALGLLFGF

SEQ ID NO: 123770 - protein, 13 aa, Borrelia garinii
SKYLALGLLFGFI

SEQ ID NO: 123771 - protein, 13 aa, Borrelia garinii
KYLALGLLFGFIS

SEQ ID NO: 123772 - protein, 13 aa, Borrelia garinii
YLALGLLFGFISC

SEQ ID NO: 123773 - protein, 13 aa, Borrelia garinii
LALGLLFGFISCD

SEQ ID NO: 123774 - protein, 13 aa, Borrelia garinii
ALGLLFGFISCDL

SEQ ID NO: 123775 - protein, 13 aa, Borrelia garinii
LGLLFGFISCDLF

SEQ ID NO: 123776 - protein, 13 aa, Borrelia garinii
GLLFGFISCDLFI

SEQ ID NO: 123777 - protein, 13 aa, Borrelia garinii
LLFGFISCDLFIR

SEQ ID NO: 123778 - protein, 13 aa, Borrelia garinii
LFGFISCDLFIRY

SEQ ID NO: 123779 - protein, 13 aa, Borrelia garinii
FGFISCDLFIRYE

SEQ ID NO: 123780 - protein, 13 aa, Borrelia garinii
GFISCDLFIRYEM

SEQ ID NO: 123781 - protein, 13 aa, Borrelia garinii
FISCDLFIRYEMK

SEQ ID NO: 123782 - protein, 13 aa, Borrelia garinii
ISCDLFIRYEMKE

SEQ ID NO: 123783 - protein, 13 aa, Borrelia garinii
SCDLFIRYEMKEE

SEQ ID NO: 123784 - protein, 13 aa, Borrelia garinii
CDLFIRYEMKEES

SEQ ID NO: 123785 - protein, 13 aa, Borrelia garinii
DLFIRYEMKEESP

SEQ ID NO: 123786 - protein, 13 aa, Borrelia garinii
LFIRYEMKEESPG

SEQ ID NO: 123787 - protein, 13 aa, Borrelia garinii
FIRYEMKEESPGL

SEQ ID NO: 123788 - protein, 13 aa, Borrelia garinii
IRYEMKEESPGLF

SEQ ID NO: 123789 - protein, 13 aa, Borrelia garinii
RYEMKEESPGLFD

SEQ ID NO: 123790 - protein, 13 aa, Borrelia garinii
YEMKEESPGLFDK

SEQ ID NO: 123791 - protein, 13 aa, Borrelia garinii
EMKEESPGLFDKG

SEQ ID NO: 123792 - protein, 13 aa, Borrelia garinii
MKEESPGLFDKGN

SEQ ID NO: 123793 - protein, 13 aa, Borrelia garinii
KEESPGLFDKGNS

SEQ ID NO: 123794 - protein, 13 aa, Borrelia garinii
EESPGLFDKGNSI

SEQ ID NO: 123795 - protein, 13 aa, Borrelia garinii
ESPGLFDKGNSIL

SEQ ID NO: 123796 - protein, 13 aa, Borrelia garinii
SPGLFDKGNSILE

SEQ ID NO: 123797 - protein, 13 aa, Borrelia garinii
PGLFDKGNSILET

SEQ ID NO: 123798 - protein, 13 aa, Borrelia garinii
GLFDKGNSILETS

SEQ ID NO: 123799 - protein, 13 aa, Borrelia garinii
LFDKGNSILETSE

SEQ ID NO: 123800 - protein, 13 aa, Borrelia garinii
FDKGNSILETSEE

SEQ ID NO: 123801 - protein, 13 aa, Borrelia garinii
DKGNSILETSEES

SEQ ID NO: 123802 - protein, 13 aa, Borrelia garinii
KGNSILETSEESI

SEQ ID NO: 123803 - protein, 13 aa, Borrelia garinii
GNSILETSEESIK

SEQ ID NO: 123804 - protein, 13 aa, Borrelia garinii
NSILETSEESIKK

SEQ ID NO: 123805 - protein, 13 aa, Borrelia garinii
SILETSEESIKKP

SEQ ID NO: 123806 - protein, 13 aa, Borrelia garinii
ILETSEESIKKPM

SEQ ID NO: 123807 - protein, 13 aa, Borrelia garinii
LETSEESIKKPMN

SEQ ID NO: 123808 - protein, 13 aa, Borrelia garinii
ETSEESIKKPMNK

SEQ ID NO: 123809 - protein, 13 aa, Borrelia garinii
TSEESIKKPMNKK

SEQ ID NO: 123810 - protein, 13 aa, Borrelia garinii
SEESIKKPMNKKG

SEQ ID NO: 123811 - protein, 13 aa, Borrelia garinii
EESIKKPMNKKGK

SEQ ID NO: 123812 - protein, 13 aa, Borrelia garinii
ESIKKPMNKKGKG

SEQ ID NO: 123813 - protein, 13 aa, Borrelia garinii
SIKKPMNKKGKGK

SEQ ID NO: 123814 - protein, 13 aa, Borrelia garinii
IKKPMNKKGKGKI

SEQ ID NO: 123815 - protein, 13 aa, Borrelia garinii
KKPMNKKGKGKIA

SEQ ID NO: 123816 - protein, 13 aa, Borrelia garinii
KPMNKKGKGKIAR

SEQ ID NO: 123817 - protein, 13 aa, Borrelia garinii
PMNKKGKGKIARK

SEQ ID NO: 123818 - protein, 13 aa, Borrelia garinii
MNKKGKGKIARKN

SEQ ID NO: 123819 - protein, 13 aa, Borrelia garinii
NKKGKGKIARKNG

SEQ ID NO: 123820 - protein, 13 aa, Borrelia garinii
KKGKGKIARKNGK

SEQ ID NO: 123821 - protein, 13 aa, Borrelia garinii
KGKGKIARKNGKS

SEQ ID NO: 123822 - protein, 13 aa, Borrelia garinii
GKGKIARKNGKSK

SEQ ID NO: 123823 - protein, 13 aa, Borrelia garinii
KGKIARKNGKSKV

SEQ ID NO: 123824 - protein, 13 aa, Borrelia garinii
GKIARKNGKSKVS

SEQ ID NO: 123825 - protein, 13 aa, Borrelia garinii
KIARKNGKSKVSG

SEQ ID NO: 123826 - protein, 13 aa, Borrelia garinii
IARKNGKSKVSGK

SEQ ID NO: 123827 - protein, 13 aa, Borrelia garinii
ARKNGKSKVSGKE

SEQ ID NO: 123828 - protein, 13 aa, Borrelia garinii
RKNGKSKVSGKEP

SEQ ID NO: 123829 - protein, 13 aa, Borrelia garinii
KNGKSKVSGKEPF

SEQ ID NO: 123830 - protein, 13 aa, Borrelia garinii
NGKSKVSGKEPFI

SEQ ID NO: 123831 - protein, 13 aa, Borrelia garinii
GKSKVSGKEPFIH

SEQ ID NO: 123832 - protein, 13 aa, Borrelia garinii
KSKVSGKEPFIHS

SEQ ID NO: 123833 - protein, 13 aa, Borrelia garinii
SKVSGKEPFIHSF

SEQ ID NO: 123834 - protein, 13 aa, Borrelia garinii
KVSGKEPFIHSFK

SEQ ID NO: 123835 - protein, 13 aa, Borrelia garinii
VSGKEPFIHSFKR

SEQ ID NO: 123836 - protein, 13 aa, Borrelia garinii
SGKEPFIHSFKRD

SEQ ID NO: 123837 - protein, 13 aa, Borrelia garinii
GKEPFIHSFKRDA

SEQ ID NO: 123838 - protein, 13 aa, Borrelia garinii
KEPFIHSFKRDAA

SEQ ID NO: 123839 - protein, 13 aa, Borrelia garinii
EPFIHSFKRDAAN

SEQ ID NO: 123840 - protein, 13 aa, Borrelia garinii
PFIHSFKRDAANK

SEQ ID NO: 123841 - protein, 13 aa, Borrelia garinii
FIHSFKRDAANKS

SEQ ID NO: 123842 - protein, 13 aa, Borrelia garinii
IHSFKRDAANKSN

SEQ ID NO: 123843 - protein, 13 aa, Borrelia garinii
HSFKRDAANKSNF

SEQ ID NO: 123844 - protein, 13 aa, Borrelia garinii
SFKRDAANKSNFL

SEQ ID NO: 123845 - protein, 13 aa, Borrelia garinii
FKRDAANKSNFLQ

SEQ ID NO: 123846 - protein, 13 aa, Borrelia garinii
KRDAANKSNFLQK

SEQ ID NO: 123847 - protein, 13 aa, Borrelia garinii
RDAANKSNFLQKN

SEQ ID NO: 123848 - protein, 13 aa, Borrelia garinii
DAANKSNFLQKNV

SEQ ID NO: 123849 - protein, 13 aa, Borrelia garinii
AANKSNFLQKNVM

SEQ ID NO: 123850 - protein, 13 aa, Borrelia garinii
ANKSNFLQKNVML

SEQ ID NO: 123851 - protein, 13 aa, Borrelia garinii
NKSNFLQKNVMLE

SEQ ID NO: 123852 - protein, 13 aa, Borrelia garinii
KSNFLQKNVMLEE

SEQ ID NO: 123853 - protein, 13 aa, Borrelia garinii
SNFLQKNVMLEEE

SEQ ID NO: 123854 - protein, 13 aa, Borrelia garinii
NFLQKNVMLEEES

SEQ ID NO: 123855 - protein, 13 aa, Borrelia garinii
FLQKNVMLEEESL

SEQ ID NO: 123856 - protein, 13 aa, Borrelia garinii
LQKNVMLEEESLK

SEQ ID NO: 123857 - protein, 13 aa, Borrelia garinii
QKNVMLEEESLKT

SEQ ID NO: 123858 - protein, 13 aa, Borrelia garinii
KNVMLEEESLKTE

SEQ ID NO: 123859 - protein, 13 aa, Borrelia garinii
NVMLEEESLKTEL

SEQ ID NO: 123860 - protein, 13 aa, Borrelia garinii
VMLEEESLKTELL

SEQ ID NO: 123861 - protein, 13 aa, Borrelia garinii
MLEEESLKTELLK

SEQ ID NO: 123862 - protein, 13 aa, Borrelia garinii
LEEESLKTELLKE

SEQ ID NO: 123863 - protein, 13 aa, Borrelia garinii
EEESLKTELLKEQ

SEQ ID NO: 123864 - protein, 13 aa, Borrelia garinii
EESLKTELLKEQS

SEQ ID NO: 123865 - protein, 13 aa, Borrelia garinii
ESLKTELLKEQSE

SEQ ID NO: 123866 - protein, 13 aa, Borrelia garinii
SLKTELLKEQSET

SEQ ID NO: 123867 - protein, 13 aa, Borrelia garinii
LKTELLKEQSETR

SEQ ID NO: 123868 - protein, 13 aa, Borrelia garinii
KTELLKEQSETRK

SEQ ID NO: 123869 - protein, 13 aa, Borrelia garinii
TELLKEQSETRKE

SEQ ID NO: 123870 - protein, 13 aa, Borrelia garinii
ELLKEQSETRKEK

SEQ ID NO: 123871 - protein, 13 aa, Borrelia garinii
LLKEQSETRKEKI

SEQ ID NO: 123872 - protein, 13 aa, Borrelia garinii
LKEQSETRKEKIQ

SEQ ID NO: 123873 - protein, 13 aa, Borrelia garinii
KEQSETRKEKIQK

SEQ ID NO: 123874 - protein, 13 aa, Borrelia garinii
EQSETRKEKIQKQ

SEQ ID NO: 123875 - protein, 13 aa, Borrelia garinii
QSETRKEKIQKQQ

SEQ ID NO: 123876 - protein, 13 aa, Borrelia garinii
SETRKEKIQKQQD

SEQ ID NO: 123877 - protein, 13 aa, Borrelia garinii
ETRKEKIQKQQDE

SEQ ID NO: 123878 - protein, 13 aa, Borrelia garinii
TRKEKIQKQQDEY

SEQ ID NO: 123879 - protein, 13 aa, Borrelia garinii
RKEKIQKQQDEYK

SEQ ID NO: 123880 - protein, 13 aa, Borrelia garinii
KEKIQKQQDEYKG

SEQ ID NO: 123881 - protein, 13 aa, Borrelia garinii
EKIQKQQDEYKGM

SEQ ID NO: 123882 - protein, 13 aa, Borrelia garinii
KIQKQQDEYKGMT

SEQ ID NO: 123883 - protein, 13 aa, Borrelia garinii
IQKQQDEYKGMTK

SEQ ID NO: 123884 - protein, 13 aa, Borrelia garinii
QKQQDEYKGMTKG

SEQ ID NO: 123885 - protein, 13 aa, Borrelia garinii
KQQDEYKGMTKGS

SEQ ID NO: 123886 - protein, 13 aa, Borrelia garinii
QQDEYKGMTKGSL

SEQ ID NO: 123887 - protein, 13 aa, Borrelia garinii
QDEYKGMTKGSLN

SEQ ID NO: 123888 - protein, 13 aa, Borrelia garinii
DEYKGMTKGSLNS

SEQ ID NO: 123889 - protein, 13 aa, Borrelia garinii
EYKGMTKGSLNSL

SEQ ID NO: 123890 - protein, 13 aa, Borrelia garinii
YKGMTKGSLNSLS

SEQ ID NO: 123891 - protein, 13 aa, Borrelia garinii
KGMTKGSLNSLSG

SEQ ID NO: 123892 - protein, 13 aa, Borrelia garinii
GMTKGSLNSLSGE

SEQ ID NO: 123893 - protein, 13 aa, Borrelia garinii
MTKGSLNSLSGES

SEQ ID NO: 123894 - protein, 13 aa, Borrelia garinii
TKGSLNSLSGESG

SEQ ID NO: 123895 - protein, 13 aa, Borrelia garinii
KGSLNSLSGESGE

SEQ ID NO: 123896 - protein, 13 aa, Borrelia garinii
GSLNSLSGESGEL

SEQ ID NO: 123897 - protein, 13 aa, Borrelia garinii
SLNSLSGESGELK

SEQ ID NO: 123898 - protein, 13 aa, Borrelia garinii
LNSLSGESGELKE

SEQ ID NO: 123899 - protein, 13 aa, Borrelia garinii
NSLSGESGELKET

SEQ ID NO: 123900 - protein, 13 aa, Borrelia garinii
SLSGESGELKETI

SEQ ID NO: 123901 - protein, 13 aa, Borrelia garinii
LSGESGELKETIE

SEQ ID NO: 123902 - protein, 13 aa, Borrelia garinii
SGESGELKETIES

SEQ ID NO: 123903 - protein, 13 aa, Borrelia garinii
GESGELKETIESN

SEQ ID NO: 123904 - protein, 13 aa, Borrelia garinii
ESGELKETIESNE

SEQ ID NO: 123905 - protein, 13 aa, Borrelia garinii
SGELKETIESNEI

SEQ ID NO: 123906 - protein, 13 aa, Borrelia garinii
GELKETIESNEID

SEQ ID NO: 123907 - protein, 13 aa, Borrelia garinii
ELKETIESNEIDI

SEQ ID NO: 123908 - protein, 13 aa, Borrelia garinii
LKETIESNEIDIT

SEQ ID NO: 123909 - protein, 13 aa, Borrelia garinii
KETIESNEIDITI

SEQ ID NO: 123910 - protein, 13 aa, Borrelia garinii
ETIESNEIDITID

SEQ ID NO: 123911 - protein, 13 aa, Borrelia garinii
TIESNEIDITIDS

SEQ ID NO: 123912 - protein, 13 aa, Borrelia garinii
IESNEIDITIDSD

SEQ ID NO: 123913 - protein, 13 aa, Borrelia garinii
ESNEIDITIDSDL

SEQ ID NO: 123914 - protein, 13 aa, Borrelia garinii
SNEIDITIDSDLR

SEQ ID NO: 123915 - protein, 13 aa, Borrelia garinii
NEIDITIDSDLRP

SEQ ID NO: 123916 - protein, 13 aa, Borrelia garinii
EIDITIDSDLRPK

SEQ ID NO: 123917 - protein, 13 aa, Borrelia garinii
IDITIDSDLRPKS

SEQ ID NO: 123918 - protein, 13 aa, Borrelia garinii
DITIDSDLRPKSS

SEQ ID NO: 123919 - protein, 13 aa, Borrelia garinii
ITIDSDLRPKSSL

SEQ ID NO: 123920 - protein, 13 aa, Borrelia garinii
TIDSDLRPKSSLQ

SEQ ID NO: 123921 - protein, 13 aa, Borrelia garinii
IDSDLRPKSSLQD

SEQ ID NO: 123922 - protein, 13 aa, Borrelia garinii
DSDLRPKSSLQDI

SEQ ID NO: 123923 - protein, 13 aa, Borrelia garinii
SDLRPKSSLQDIA

SEQ ID NO: 123924 - protein, 13 aa, Borrelia garinii
DLRPKSSLQDIAG

SEQ ID NO: 123925 - protein, 13 aa, Borrelia garinii
LRPKSSLQDIAGS

SEQ ID NO: 123926 - protein, 13 aa, Borrelia garinii
RPKSSLQDIAGSN

SEQ ID NO: 123927 - protein, 13 aa, Borrelia garinii
PKSSLQDIAGSNS

SEQ ID NO: 123928 - protein, 13 aa, Borrelia garinii
KSSLQDIAGSNSI

SEQ ID NO: 123929 - protein, 13 aa, Borrelia garinii
SSLQDIAGSNSIS

SEQ ID NO: 123930 - protein, 13 aa, Borrelia garinii
SLQDIAGSNSISY

SEQ ID NO: 123931 - protein, 13 aa, Borrelia garinii
LQDIAGSNSISYT

SEQ ID NO: 123932 - protein, 13 aa, Borrelia garinii
QDIAGSNSISYTD

SEQ ID NO: 123933 - protein, 13 aa, Borrelia garinii
DIAGSNSISYTDE

SEQ ID NO: 123934 - protein, 13 aa, Borrelia garinii
IAGSNSISYTDEI

SEQ ID NO: 123935 - protein, 13 aa, Borrelia garinii
AGSNSISYTDEIE

SEQ ID NO: 123936 - protein, 13 aa, Borrelia garinii
GSNSISYTDEIEE

SEQ ID NO: 123937 - protein, 13 aa, Borrelia garinii
SNSISYTDEIEEE

SEQ ID NO: 123938 - protein, 13 aa, Borrelia garinii
NSISYTDEIEEED

SEQ ID NO: 123939 - protein, 13 aa, Borrelia garinii
SISYTDEIEEEDY

SEQ ID NO: 123940 - protein, 13 aa, Borrelia garinii
ISYTDEIEEEDYA

SEQ ID NO: 123941 - protein, 13 aa, Borrelia garinii
SYTDEIEEEDYAR

SEQ ID NO: 123942 - protein, 13 aa, Borrelia garinii
YTDEIEEEDYARY

SEQ ID NO: 123943 - protein, 13 aa, Borrelia garinii
TDEIEEEDYARYY

SEQ ID NO: 123944 - protein, 13 aa, Borrelia garinii
DEIEEEDYARYYL

SEQ ID NO: 123945 - protein, 13 aa, Borrelia garinii
EIEEEDYARYYLD

SEQ ID NO: 123946 - protein, 13 aa, Borrelia garinii
IEEEDYARYYLDE

SEQ ID NO: 123947 - protein, 13 aa, Borrelia garinii
EEEDYARYYLDED

SEQ ID NO: 123948 - protein, 13 aa, Borrelia garinii
EEDYARYYLDEDD

SEQ ID NO: 123949 - protein, 13 aa, Borrelia garinii
EDYARYYLDEDDE

SEQ ID NO: 123950 - protein, 13 aa, Borrelia garinii
DYARYYLDEDDED

SEQ ID NO: 123951 - protein, 13 aa, Borrelia garinii
YARYYLDEDDEDD

SEQ ID NO: 123952 - protein, 13 aa, Borrelia garinii
ARYYLDEDDEDDE

SEQ ID NO: 123953 - protein, 13 aa, Borrelia garinii
RYYLDEDDEDDEY

SEQ ID NO: 123954 - protein, 13 aa, Borrelia garinii
YYLDEDDEDDEYY

SEQ ID NO: 123955 - protein, 13 aa, Borrelia garinii
YLDEDDEDDEYYE

SEQ ID NO: 123956 - protein, 13 aa, Borrelia garinii
LDEDDEDDEYYED

SEQ ID NO: 123957 - protein, 13 aa, Borrelia garinii
DEDDEDDEYYEDD

SEQ ID NO: 123958 - protein, 13 aa, Borrelia garinii
EDDEDDEYYEDDY

SEQ ID NO: 123959 - protein, 13 aa, Borrelia garinii
DDEDDEYYEDDYE

SEQ ID NO: 123960 - protein, 13 aa, Borrelia garinii
DEDDEYYEDDYEE

SEQ ID NO: 123961 - protein, 13 aa, Borrelia garinii
EDDEYYEDDYEEI

SEQ ID NO: 123962 - protein, 13 aa, Borrelia garinii
DDEYYEDDYEEIR

SEQ ID NO: 123963 - protein, 13 aa, Borrelia garinii
DEYYEDDYEEIRL

SEQ ID NO: 123964 - protein, 13 aa, Borrelia garinii
EYYEDDYEEIRLS

SEQ ID NO: 123965 - protein, 13 aa, Borrelia garinii
YYEDDYEEIRLSN

SEQ ID NO: 123966 - protein, 13 aa, Borrelia garinii
YEDDYEEIRLSNR

SEQ ID NO: 123967 - protein, 13 aa, Borrelia garinii
EDDYEEIRLSNRY

SEQ ID NO: 123968 - protein, 13 aa, Borrelia garinii
DDYEEIRLSNRYQ

SEQ ID NO: 123969 - protein, 13 aa, Borrelia garinii
DYEEIRLSNRYQS

SEQ ID NO: 123970 - protein, 13 aa, Borrelia garinii
YEEIRLSNRYQSY

SEQ ID NO: 123971 - protein, 13 aa, Borrelia garinii
EEIRLSNRYQSYL

SEQ ID NO: 123972 - protein, 13 aa, Borrelia garinii
EIRLSNRYQSYLE

SEQ ID NO: 123973 - protein, 13 aa, Borrelia garinii
IRLSNRYQSYLEG

SEQ ID NO: 123974 - protein, 13 aa, Borrelia garinii
RLSNRYQSYLEGV

SEQ ID NO: 123975 - protein, 13 aa, Borrelia garinii
LSNRYQSYLEGVK

SEQ ID NO: 123976 - protein, 13 aa, Borrelia garinii
SNRYQSYLEGVKY

SEQ ID NO: 123977 - protein, 13 aa, Borrelia garinii
NRYQSYLEGVKYN

SEQ ID NO: 123978 - protein, 13 aa, Borrelia garinii
RYQSYLEGVKYNV

SEQ ID NO: 123979 - protein, 13 aa, Borrelia garinii
YQSYLEGVKYNVD

SEQ ID NO: 123980 - protein, 13 aa, Borrelia garinii
QSYLEGVKYNVDS

SEQ ID NO: 123981 - protein, 13 aa, Borrelia garinii
SYLEGVKYNVDSA

SEQ ID NO: 123982 - protein, 13 aa, Borrelia garinii
YLEGVKYNVDSAI

SEQ ID NO: 123983 - protein, 13 aa, Borrelia garinii
LEGVKYNVDSAIN

SEQ ID NO: 123984 - protein, 13 aa, Borrelia garinii
EGVKYNVDSAINT

SEQ ID NO: 123985 - protein, 13 aa, Borrelia garinii
GVKYNVDSAINTI

SEQ ID NO: 123986 - protein, 13 aa, Borrelia garinii
VKYNVDSAINTIN

SEQ ID NO: 123987 - protein, 13 aa, Borrelia garinii
KYNVDSAINTINK

SEQ ID NO: 123988 - protein, 13 aa, Borrelia garinii
YNVDSAINTINKI

SEQ ID NO: 123989 - protein, 13 aa, Borrelia garinii
NVDSAINTINKIY

SEQ ID NO: 123990 - protein, 13 aa, Borrelia garinii
VDSAINTINKIYD

SEQ ID NO: 123991 - protein, 13 aa, Borrelia garinii
DSAINTINKIYDT

SEQ ID NO: 123992 - protein, 13 aa, Borrelia garinii
SAINTINKIYDTY

SEQ ID NO: 123993 - protein, 13 aa, Borrelia garinii
AINTINKIYDTYT

SEQ ID NO: 123994 - protein, 13 aa, Borrelia garinii
INTINKIYDTYTL

SEQ ID NO: 123995 - protein, 13 aa, Borrelia garinii
NTINKIYDTYTLF

SEQ ID NO: 123996 - protein, 13 aa, Borrelia garinii
TINKIYDTYTLFS

SEQ ID NO: 123997 - protein, 13 aa, Borrelia garinii
INKIYDTYTLFST

SEQ ID NO: 123998 - protein, 13 aa, Borrelia garinii
NKIYDTYTLFSTK

SEQ ID NO: 123999 - protein, 13 aa, Borrelia garinii
KIYDTYTLFSTKL

SEQ ID NO: 124000 - protein, 13 aa, Borrelia garinii
IYDTYTLFSTKLT

SEQ ID NO: 124001 - protein, 13 aa, Borrelia garinii
YDTYTLFSTKLTQ

SEQ ID NO: 124002 - protein, 13 aa, Borrelia garinii
DTYTLFSTKLTQM

SEQ ID NO: 124003 - protein, 13 aa, Borrelia garinii
TYTLFSTKLTQMY

SEQ ID NO: 124004 - protein, 13 aa, Borrelia garinii
YTLFSTKLTQMYS

SEQ ID NO: 124005 - protein, 13 aa, Borrelia garinii
TLFSTKLTQMYST

SEQ ID NO: 124006 - protein, 13 aa, Borrelia garinii
LFSTKLTQMYSTR

SEQ ID NO: 124007 - protein, 13 aa, Borrelia garinii
FSTKLTQMYSTRL

SEQ ID NO: 124008 - protein, 13 aa, Borrelia garinii
STKLTQMYSTRLD

SEQ ID NO: 124009 - protein, 13 aa, Borrelia garinii
TKLTQMYSTRLDN

SEQ ID NO: 124010 - protein, 13 aa, Borrelia garinii
KLTQMYSTRLDNL

SEQ ID NO: 124011 - protein, 13 aa, Borrelia garinii
LTQMYSTRLDNLA

SEQ ID NO: 124012 - protein, 13 aa, Borrelia garinii
TQMYSTRLDNLAK

SEQ ID NO: 124013 - protein, 13 aa, Borrelia garinii
QMYSTRLDNLAKA

SEQ ID NO: 124014 - protein, 13 aa, Borrelia garinii
MYSTRLDNLAKAK

SEQ ID NO: 124015 - protein, 13 aa, Borrelia garinii
YSTRLDNLAKAKA

SEQ ID NO: 124016 - protein, 13 aa, Borrelia garinii
STRLDNLAKAKAK

SEQ ID NO: 124017 - protein, 13 aa, Borrelia garinii
TRLDNLAKAKAKE

SEQ ID NO: 124018 - protein, 13 aa, Borrelia garinii
RLDNLAKAKAKEE

SEQ ID NO: 124019 - protein, 13 aa, Borrelia garinii
LDNLAKAKAKEEA

SEQ ID NO: 124020 - protein, 13 aa, Borrelia garinii
DNLAKAKAKEEAA

SEQ ID NO: 124021 - protein, 13 aa, Borrelia garinii
NLAKAKAKEEAAK

SEQ ID NO: 124022 - protein, 13 aa, Borrelia garinii
LAKAKAKEEAAKF

SEQ ID NO: 124023 - protein, 13 aa, Borrelia garinii
AKAKAKEEAAKFT

SEQ ID NO: 124024 - protein, 13 aa, Borrelia garinii
KAKAKEEAAKFTK

SEQ ID NO: 124025 - protein, 13 aa, Borrelia garinii
AKAKEEAAKFTKE

SEQ ID NO: 124026 - protein, 13 aa, Borrelia garinii
KAKEEAAKFTKED

SEQ ID NO: 124027 - protein, 13 aa, Borrelia garinii
AKEEAAKFTKEDL

SEQ ID NO: 124028 - protein, 13 aa, Borrelia garinii
KEEAAKFTKEDLE

SEQ ID NO: 124029 - protein, 13 aa, Borrelia garinii
EEAAKFTKEDLEK

SEQ ID NO: 124030 - protein, 13 aa, Borrelia garinii
EAAKFTKEDLEKN

SEQ ID NO: 124031 - protein, 13 aa, Borrelia garinii
AAKFTKEDLEKNF

SEQ ID NO: 124032 - protein, 13 aa, Borrelia garinii
AKFTKEDLEKNFK

SEQ ID NO: 124033 - protein, 13 aa, Borrelia garinii
KFTKEDLEKNFKT

SEQ ID NO: 124034 - protein, 13 aa, Borrelia garinii
FTKEDLEKNFKTL

SEQ ID NO: 124035 - protein, 13 aa, Borrelia garinii
TKEDLEKNFKTLL

SEQ ID NO: 124036 - protein, 13 aa, Borrelia garinii
KEDLEKNFKTLLN

SEQ ID NO: 124037 - protein, 13 aa, Borrelia garinii
EDLEKNFKTLLNY

SEQ ID NO: 124038 - protein, 13 aa, Borrelia garinii
DLEKNFKTLLNYI

SEQ ID NO: 124039 - protein, 13 aa, Borrelia garinii
LEKNFKTLLNYIQ

SEQ ID NO: 124040 - protein, 13 aa, Borrelia garinii
EKNFKTLLNYIQV

SEQ ID NO: 124041 - protein, 13 aa, Borrelia garinii
KNFKTLLNYIQVS

SEQ ID NO: 124042 - protein, 13 aa, Borrelia garinii
NFKTLLNYIQVSV

SEQ ID NO: 124043 - protein, 13 aa, Borrelia garinii
FKTLLNYIQVSVK

SEQ ID NO: 124044 - protein, 13 aa, Borrelia garinii
KTLLNYIQVSVKT

SEQ ID NO: 124045 - protein, 13 aa, Borrelia garinii
TLLNYIQVSVKTA

SEQ ID NO: 124046 - protein, 13 aa, Borrelia garinii
LLNYIQVSVKTAT

SEQ ID NO: 124047 - protein, 13 aa, Borrelia garinii
LNYIQVSVKTATN

SEQ ID NO: 124048 - protein, 13 aa, Borrelia garinii
NYIQVSVKTATNF

SEQ ID NO: 124049 - protein, 13 aa, Borrelia garinii
YIQVSVKTATNFV

SEQ ID NO: 124050 - protein, 13 aa, Borrelia garinii
IQVSVKTATNFVY

SEQ ID NO: 124051 - protein, 13 aa, Borrelia garinii
QVSVKTATNFVYI

SEQ ID NO: 124052 - protein, 13 aa, Borrelia garinii
VSVKTATNFVYIN

SEQ ID NO: 124053 - protein, 13 aa, Borrelia garinii
SVKTATNFVYINE

SEQ ID NO: 124054 - protein, 13 aa, Borrelia garinii
VKTATNFVYINEM

SEQ ID NO: 124055 - protein, 13 aa, Borrelia garinii
KTATNFVYINEMH

SEQ ID NO: 124056 - protein, 13 aa, Borrelia garinii
TATNFVYINEMHA

SEQ ID NO: 124057 - protein, 13 aa, Borrelia garinii
ATNFVYINEMHAK

SEQ ID NO: 124058 - protein, 13 aa, Borrelia garinii
TNFVYINEMHAKR

SEQ ID NO: 124059 - protein, 13 aa, Borrelia garinii
NFVYINEMHAKRK

SEQ ID NO: 124060 - protein, 13 aa, Borrelia garinii
FVYINEMHAKRKL

SEQ ID NO: 124061 - protein, 13 aa, Borrelia garinii
VYINEMHAKRKLE

SEQ ID NO: 124062 - protein, 13 aa, Borrelia garinii
YINEMHAKRKLEN

SEQ ID NO: 124063 - protein, 13 aa, Borrelia garinii
INEMHAKRKLENI

SEQ ID NO: 124064 - protein, 13 aa, Borrelia garinii
NEMHAKRKLENIE

SEQ ID NO: 124065 - protein, 13 aa, Borrelia garinii
EMHAKRKLENIEA

SEQ ID NO: 124066 - protein, 13 aa, Borrelia garinii
MHAKRKLENIEAK

SEQ ID NO: 124067 - protein, 13 aa, Borrelia garinii
HAKRKLENIEAKI

SEQ ID NO: 124068 - protein, 13 aa, Borrelia garinii
AKRKLENIEAKIK

SEQ ID NO: 124069 - protein, 13 aa, Borrelia garinii
KRKLENIEAKIKT

SEQ ID NO: 124070 - protein, 13 aa, Borrelia garinii
RKLENIEAKIKTL

SEQ ID NO: 124071 - protein, 13 aa, Borrelia garinii
KLENIEAKIKTLI

SEQ ID NO: 124072 - protein, 13 aa, Borrelia garinii
LENIEAKIKTLIA

SEQ ID NO: 124073 - protein, 13 aa, Borrelia garinii
ENIEAKIKTLIAK

SEQ ID NO: 124074 - protein, 13 aa, Borrelia garinii
NIEAKIKTLIAKI

SEQ ID NO: 124075 - protein, 13 aa, Borrelia garinii
IEAKIKTLIAKIK

SEQ ID NO: 124076 - protein, 13 aa, Borrelia garinii
EAKIKTLIAKIKE

SEQ ID NO: 124077 - protein, 13 aa, Borrelia garinii
AKIKTLIAKIKEK

SEQ ID NO: 124078 - protein, 13 aa, Borrelia garinii
KIKTLIAKIKEKS

SEQ ID NO: 124079 - protein, 13 aa, Borrelia garinii
IKTLIAKIKEKSN

SEQ ID NO: 124080 - protein, 13 aa, Borrelia garinii
KTLIAKIKEKSNL

SEQ ID NO: 124081 - protein, 13 aa, Borrelia garinii
TLIAKIKEKSNLY

SEQ ID NO: 124082 - protein, 13 aa, Borrelia garinii
LIAKIKEKSNLYS

SEQ ID NO: 124083 - protein, 13 aa, Borrelia garinii
IAKIKEKSNLYSA

SEQ ID NO: 124084 - protein, 13 aa, Borrelia garinii
AKIKEKSNLYSAY

SEQ ID NO: 124085 - protein, 13 aa, Borrelia garinii
KIKEKSNLYSAYK

SEQ ID NO: 124086 - protein, 13 aa, Borrelia garinii
IKEKSNLYSAYKA

SEQ ID NO: 124087 - protein, 13 aa, Borrelia garinii
KEKSNLYSAYKAI

SEQ ID NO: 124088 - protein, 13 aa, Borrelia garinii
EKSNLYSAYKAIV

SEQ ID NO: 124089 - protein, 13 aa, Borrelia garinii
KSNLYSAYKAIVS

SEQ ID NO: 124090 - protein, 13 aa, Borrelia garinii
SNLYSAYKAIVSS

SEQ ID NO: 124091 - protein, 13 aa, Borrelia garinii
NLYSAYKAIVSSI

SEQ ID NO: 124092 - protein, 13 aa, Borrelia garinii
LYSAYKAIVSSIL

SEQ ID NO: 124093 - protein, 13 aa, Borrelia garinii
YSAYKAIVSSILL

SEQ ID NO: 124094 - protein, 13 aa, Borrelia garinii
SAYKAIVSSILLM

SEQ ID NO: 124095 - protein, 13 aa, Borrelia garinii
AYKAIVSSILLMR

SEQ ID NO: 124096 - protein, 13 aa, Borrelia garinii
YKAIVSSILLMRD

SEQ ID NO: 124097 - protein, 13 aa, Borrelia garinii
KAIVSSILLMRDS

SEQ ID NO: 124098 - protein, 13 aa, Borrelia garinii
AIVSSILLMRDSL

SEQ ID NO: 124099 - protein, 13 aa, Borrelia garinii
IVSSILLMRDSLK

SEQ ID NO: 124100 - protein, 13 aa, Borrelia garinii
VSSILLMRDSLKE

SEQ ID NO: 124101 - protein, 13 aa, Borrelia garinii
SSILLMRDSLKEV

SEQ ID NO: 124102 - protein, 13 aa, Borrelia garinii
SILLMRDSLKEVQ

SEQ ID NO: 124103 - protein, 13 aa, Borrelia garinii
ILLMRDSLKEVQY

SEQ ID NO: 124104 - protein, 13 aa, Borrelia garinii
LLMRDSLKEVQYA

SEQ ID NO: 124105 - protein, 13 aa, Borrelia garinii
LMRDSLKEVQYAI

SEQ ID NO: 124106 - protein, 13 aa, Borrelia garinii
MRDSLKEVQYAID

SEQ ID NO: 124107 - protein, 13 aa, Borrelia garinii
RDSLKEVQYAIDK

SEQ ID NO: 124108 - protein, 13 aa, Borrelia garinii
DSLKEVQYAIDKN

SEQ ID NO: 124109 - protein, 13 aa, Borrelia garinii
SLKEVQYAIDKNG

SEQ ID NO: 124110 - protein, 13 aa, Borrelia garinii
LKEVQYAIDKNGI

SEQ ID NO: 124111 - protein, 13 aa, Borrelia garinii
KEVQYAIDKNGIW

SEQ ID NO: 124112 - protein, 13 aa, Borrelia garinii
EVQYAIDKNGIWY

SEQ ID NO: 124113 - protein, 13 aa, Borrelia garinii
VQYAIDKNGIWYR

SEQ ID NO: 124114 - protein, 13 aa, Borrelia garinii
QYAIDKNGIWYRK

SEQ ID NO: 124115 - protein, 13 aa, Borrelia garinii
YAIDKNGIWYRKL

SEQ ID NO: 124116 - protein, 13 aa, Borrelia garinii
AIDKNGIWYRKLD

SEQ ID NO: 124117 - protein, 13 aa, Borrelia garinii
IDKNGIWYRKLDA

SEQ ID NO: 124118 - protein, 13 aa, Borrelia garinii
DKNGIWYRKLDAI

SEQ ID NO: 124119 - protein, 13 aa, Borrelia garinii
KNGIWYRKLDAIE

SEQ ID NO: 124120 - protein, 13 aa, Borrelia garinii
NGIWYRKLDAIET

SEQ ID NO: 124121 - protein, 13 aa, Borrelia garinii
GIWYRKLDAIETE

SEQ ID NO: 124122 - protein, 13 aa, Borrelia garinii
IWYRKLDAIETEI

SEQ ID NO: 124123 - protein, 13 aa, Borrelia garinii
WYRKLDAIETEIK

SEQ ID NO: 124124 - protein, 13 aa, Borrelia garinii
YRKLDAIETEIKN

SEQ ID NO: 124125 - protein, 13 aa, Borrelia garinii
RKLDAIETEIKNL

SEQ ID NO: 124126 - protein, 13 aa, Borrelia garinii
KLDAIETEIKNLI

SEQ ID NO: 124127 - protein, 13 aa, Borrelia garinii
LDAIETEIKNLIL

SEQ ID NO: 124128 - protein, 13 aa, Borrelia garinii
DAIETEIKNLILK

SEQ ID NO: 124129 - protein, 13 aa, Borrelia garinii
AIETEIKNLILKI

SEQ ID NO: 124130 - protein, 13 aa, Borrelia garinii
IETEIKNLILKIK

SEQ ID NO: 124131 - protein, 13 aa, Borrelia garinii
ETEIKNLILKIKG

SEQ ID NO: 124132 - protein, 13 aa, Borrelia garinii
TEIKNLILKIKGQ

SEQ ID NO: 124133 - protein, 13 aa, Borrelia garinii
EIKNLILKIKGQS

SEQ ID NO: 124134 - protein, 13 aa, Borrelia garinii
IKNLILKIKGQSD

SEQ ID NO: 124135 - protein, 13 aa, Borrelia garinii
KNLILKIKGQSDL

SEQ ID NO: 124136 - protein, 13 aa, Borrelia garinii
NLILKIKGQSDLY

SEQ ID NO: 124137 - protein, 13 aa, Borrelia garinii
LILKIKGQSDLYE

SEQ ID NO: 124138 - protein, 13 aa, Borrelia garinii
ILKIKGQSDLYEA

SEQ ID NO: 124139 - protein, 13 aa, Borrelia garinii
LKIKGQSDLYEAY

SEQ ID NO: 124140 - protein, 13 aa, Borrelia garinii
KIKGQSDLYEAYK

SEQ ID NO: 124141 - protein, 13 aa, Borrelia garinii
IKGQSDLYEAYKA

SEQ ID NO: 124142 - protein, 13 aa, Borrelia garinii
KGQSDLYEAYKAI

SEQ ID NO: 124143 - protein, 13 aa, Borrelia garinii
GQSDLYEAYKAIV

SEQ ID NO: 124144 - protein, 13 aa, Borrelia garinii
QSDLYEAYKAIVR

SEQ ID NO: 124145 - protein, 13 aa, Borrelia garinii
SDLYEAYKAIVRS

SEQ ID NO: 124146 - protein, 13 aa, Borrelia garinii
DLYEAYKAIVRSI

SEQ ID NO: 124147 - protein, 13 aa, Borrelia garinii
LYEAYKAIVRSIL

SEQ ID NO: 124148 - protein, 13 aa, Borrelia garinii
YEAYKAIVRSILL

SEQ ID NO: 124149 - protein, 13 aa, Borrelia garinii
EAYKAIVRSILLM

SEQ ID NO: 124150 - protein, 13 aa, Borrelia garinii
AYKAIVRSILLMK

SEQ ID NO: 124151 - protein, 13 aa, Borrelia garinii
YKAIVRSILLMKD

SEQ ID NO: 124152 - protein, 13 aa, Borrelia garinii
KAIVRSILLMKDS

SEQ ID NO: 124153 - protein, 13 aa, Borrelia garinii
AIVRSILLMKDSL

SEQ ID NO: 124154 - protein, 13 aa, Borrelia garinii
IVRSILLMKDSLK

SEQ ID NO: 124155 - protein, 13 aa, Borrelia garinii
VRSILLMKDSLKI

SEQ ID NO: 124156 - protein, 13 aa, Borrelia garinii
RSILLMKDSLKII

SEQ ID NO: 124157 - protein, 13 aa, Borrelia garinii
SILLMKDSLKIIE

SEQ ID NO: 124158 - protein, 13 aa, Borrelia garinii
ILLMKDSLKIIEI

SEQ ID NO: 124159 - protein, 13 aa, Borrelia garinii
LLMKDSLKIIEIV

SEQ ID NO: 124160 - protein, 13 aa, Borrelia garinii
LMKDSLKIIEIVI

SEQ ID NO: 124161 - protein, 13 aa, Borrelia garinii
MKDSLKIIEIVID

SEQ ID NO: 124162 - protein, 13 aa, Borrelia garinii
KDSLKIIEIVIDK

SEQ ID NO: 124163 - protein, 13 aa, Borrelia garinii
DSLKIIEIVIDKN

SEQ ID NO: 124164 - protein, 13 aa, Borrelia garinii
SLKIIEIVIDKNG

SEQ ID NO: 124165 - protein, 13 aa, Borrelia garinii
LKIIEIVIDKNGV

SEQ ID NO: 124166 - protein, 13 aa, Borrelia garinii
KIIEIVIDKNGVW

SEQ ID NO: 124167 - protein, 13 aa, Borrelia garinii
IIEIVIDKNGVWY

SEQ ID NO: 124168 - protein, 14 aa, Borrelia garinii
MKKVKSKYLALGLL

SEQ ID NO: 124169 - protein, 14 aa, Borrelia garinii
KKVKSKYLALGLLF

SEQ ID NO: 124170 - protein, 14 aa, Borrelia garinii
KVKSKYLALGLLFG

SEQ ID NO: 124171 - protein, 14 aa, Borrelia garinii
VKSKYLALGLLFGF

SEQ ID NO: 124172 - protein, 14 aa, Borrelia garinii
KSKYLALGLLFGFI

SEQ ID NO: 124173 - protein, 14 aa, Borrelia garinii
SKYLALGLLFGFIS

SEQ ID NO: 124174 - protein, 14 aa, Borrelia garinii
KYLALGLLFGFISC

SEQ ID NO: 124175 - protein, 14 aa, Borrelia garinii
YLALGLLFGFISCD

SEQ ID NO: 124176 - protein, 14 aa, Borrelia garinii
LALGLLFGFISCDL

SEQ ID NO: 124177 - protein, 14 aa, Borrelia garinii
ALGLLFGFISCDLF

SEQ ID NO: 124178 - protein, 14 aa, Borrelia garinii
LGLLFGFISCDLFI

SEQ ID NO: 124179 - protein, 14 aa, Borrelia garinii
GLLFGFISCDLFIR

SEQ ID NO: 124180 - protein, 14 aa, Borrelia garinii
LLFGFISCDLFIRY

SEQ ID NO: 124181 - protein, 14 aa, Borrelia garinii
LFGFISCDLFIRYE

SEQ ID NO: 124182 - protein, 14 aa, Borrelia garinii
FGFISCDLFIRYEM

SEQ ID NO: 124183 - protein, 14 aa, Borrelia garinii
GFISCDLFIRYEMK

SEQ ID NO: 124184 - protein, 14 aa, Borrelia garinii
FISCDLFIRYEMKE

SEQ ID NO: 124185 - protein, 14 aa, Borrelia garinii
ISCDLFIRYEMKEE

SEQ ID NO: 124186 - protein, 14 aa, Borrelia garinii
SCDLFIRYEMKEES

SEQ ID NO: 124187 - protein, 14 aa, Borrelia garinii
CDLFIRYEMKEESP

SEQ ID NO: 124188 - protein, 14 aa, Borrelia garinii
DLFIRYEMKEESPG

SEQ ID NO: 124189 - protein, 14 aa, Borrelia garinii
LFIRYEMKEESPGL

SEQ ID NO: 124190 - protein, 14 aa, Borrelia garinii
FIRYEMKEESPGLF

SEQ ID NO: 124191 - protein, 14 aa, Borrelia garinii
IRYEMKEESPGLFD

SEQ ID NO: 124192 - protein, 14 aa, Borrelia garinii
RYEMKEESPGLFDK

SEQ ID NO: 124193 - protein, 14 aa, Borrelia garinii
YEMKEESPGLFDKG

SEQ ID NO: 124194 - protein, 14 aa, Borrelia garinii
EMKEESPGLFDKGN

SEQ ID NO: 124195 - protein, 14 aa, Borrelia garinii
MKEESPGLFDKGNS

SEQ ID NO: 124196 - protein, 14 aa, Borrelia garinii
KEESPGLFDKGNSI

SEQ ID NO: 124197 - protein, 14 aa, Borrelia garinii
EESPGLFDKGNSIL

SEQ ID NO: 124198 - protein, 14 aa, Borrelia garinii
ESPGLFDKGNSILE

SEQ ID NO: 124199 - protein, 14 aa, Borrelia garinii
SPGLFDKGNSILET

SEQ ID NO: 124200 - protein, 14 aa, Borrelia garinii
PGLFDKGNSILETS

SEQ ID NO: 124201 - protein, 14 aa, Borrelia garinii
GLFDKGNSILETSE

SEQ ID NO: 124202 - protein, 14 aa, Borrelia garinii
LFDKGNSILETSEE

SEQ ID NO: 124203 - protein, 14 aa, Borrelia garinii
FDKGNSILETSEES

SEQ ID NO: 124204 - protein, 14 aa, Borrelia garinii
DKGNSILETSEESI

SEQ ID NO: 124205 - protein, 14 aa, Borrelia garinii
KGNSILETSEESIK

SEQ ID NO: 124206 - protein, 14 aa, Borrelia garinii
GNSILETSEESIKK

SEQ ID NO: 124207 - protein, 14 aa, Borrelia garinii
NSILETSEESIKKP

SEQ ID NO: 124208 - protein, 14 aa, Borrelia garinii
SILETSEESIKKPM

SEQ ID NO: 124209 - protein, 14 aa, Borrelia garinii
ILETSEESIKKPMN

SEQ ID NO: 124210 - protein, 14 aa, Borrelia garinii
LETSEESIKKPMNK

SEQ ID NO: 124211 - protein, 14 aa, Borrelia garinii
ETSEESIKKPMNKK

SEQ ID NO: 124212 - protein, 14 aa, Borrelia garinii
TSEESIKKPMNKKG

SEQ ID NO: 124213 - protein, 14 aa, Borrelia garinii
SEESIKKPMNKKGK

SEQ ID NO: 124214 - protein, 14 aa, Borrelia garinii
EESIKKPMNKKGKG

SEQ ID NO: 124215 - protein, 14 aa, Borrelia garinii
ESIKKPMNKKGKGK

SEQ ID NO: 124216 - protein, 14 aa, Borrelia garinii
SIKKPMNKKGKGKI

SEQ ID NO: 124217 - protein, 14 aa, Borrelia garinii
IKKPMNKKGKGKIA

SEQ ID NO: 124218 - protein, 14 aa, Borrelia garinii
KKPMNKKGKGKIAR

SEQ ID NO: 124219 - protein, 14 aa, Borrelia garinii
KPMNKKGKGKIARK

SEQ ID NO: 124220 - protein, 14 aa, Borrelia garinii
PMNKKGKGKIARKN

SEQ ID NO: 124221 - protein, 14 aa, Borrelia garinii
MNKKGKGKIARKNG

SEQ ID NO: 124222 - protein, 14 aa, Borrelia garinii
NKKGKGKIARKNGK

SEQ ID NO: 124223 - protein, 14 aa, Borrelia garinii
KKGKGKIARKNGKS

SEQ ID NO: 124224 - protein, 14 aa, Borrelia garinii
KGKGKIARKNGKSK

SEQ ID NO: 124225 - protein, 14 aa, Borrelia garinii
GKGKIARKNGKSKV

SEQ ID NO: 124226 - protein, 14 aa, Borrelia garinii
KGKIARKNGKSKVS

SEQ ID NO: 124227 - protein, 14 aa, Borrelia garinii
GKIARKNGKSKVSG

SEQ ID NO: 124228 - protein, 14 aa, Borrelia garinii
KIARKNGKSKVSGK

SEQ ID NO: 124229 - protein, 14 aa, Borrelia garinii
IARKNGKSKVSGKE

SEQ ID NO: 124230 - protein, 14 aa, Borrelia garinii
ARKNGKSKVSGKEP

SEQ ID NO: 124231 - protein, 14 aa, Borrelia garinii
RKNGKSKVSGKEPF

SEQ ID NO: 124232 - protein, 14 aa, Borrelia garinii
KNGKSKVSGKEPFI

SEQ ID NO: 124233 - protein, 14 aa, Borrelia garinii
NGKSKVSGKEPFIH

SEQ ID NO: 124234 - protein, 14 aa, Borrelia garinii
GKSKVSGKEPFIHS

SEQ ID NO: 124235 - protein, 14 aa, Borrelia garinii
KSKVSGKEPFIHSF

SEQ ID NO: 124236 - protein, 14 aa, Borrelia garinii
SKVSGKEPFIHSFK

SEQ ID NO: 124237 - protein, 14 aa, Borrelia garinii
KVSGKEPFIHSFKR

SEQ ID NO: 124238 - protein, 14 aa, Borrelia garinii
VSGKEPFIHSFKRD

SEQ ID NO: 124239 - protein, 14 aa, Borrelia garinii
SGKEPFIHSFKRDA

SEQ ID NO: 124240 - protein, 14 aa, Borrelia garinii
GKEPFIHSFKRDAA

SEQ ID NO: 124241 - protein, 14 aa, Borrelia garinii
KEPFIHSFKRDAAN

SEQ ID NO: 124242 - protein, 14 aa, Borrelia garinii
EPFIHSFKRDAANK

SEQ ID NO: 124243 - protein, 14 aa, Borrelia garinii
PFIHSFKRDAANKS

SEQ ID NO: 124244 - protein, 14 aa, Borrelia garinii
FIHSFKRDAANKSN

SEQ ID NO: 124245 - protein, 14 aa, Borrelia garinii
IHSFKRDAANKSNF

SEQ ID NO: 124246 - protein, 14 aa, Borrelia garinii
HSFKRDAANKSNFL

SEQ ID NO: 124247 - protein, 14 aa, Borrelia garinii
SFKRDAANKSNFLQ

SEQ ID NO: 124248 - protein, 14 aa, Borrelia garinii
FKRDAANKSNFLQK

SEQ ID NO: 124249 - protein, 14 aa, Borrelia garinii
KRDAANKSNFLQKN

SEQ ID NO: 124250 - protein, 14 aa, Borrelia garinii
RDAANKSNFLQKNV

SEQ ID NO: 124251 - protein, 14 aa, Borrelia garinii
DAANKSNFLQKNVM

SEQ ID NO: 124252 - protein, 14 aa, Borrelia garinii
AANKSNFLQKNVML

SEQ ID NO: 124253 - protein, 14 aa, Borrelia garinii
ANKSNFLQKNVMLE

SEQ ID NO: 124254 - protein, 14 aa, Borrelia garinii
NKSNFLQKNVMLEE

SEQ ID NO: 124255 - protein, 14 aa, Borrelia garinii
KSNFLQKNVMLEEE

SEQ ID NO: 124256 - protein, 14 aa, Borrelia garinii
SNFLQKNVMLEEES

SEQ ID NO: 124257 - protein, 14 aa, Borrelia garinii
NFLQKNVMLEEESL

SEQ ID NO: 124258 - protein, 14 aa, Borrelia garinii
FLQKNVMLEEESLK

SEQ ID NO: 124259 - protein, 14 aa, Borrelia garinii
LQKNVMLEEESLKT

SEQ ID NO: 124260 - protein, 14 aa, Borrelia garinii
QKNVMLEEESLKTE

SEQ ID NO: 124261 - protein, 14 aa, Borrelia garinii
KNVMLEEESLKTEL

SEQ ID NO: 124262 - protein, 14 aa, Borrelia garinii
NVMLEEESLKTELL

SEQ ID NO: 124263 - protein, 14 aa, Borrelia garinii
VMLEEESLKTELLK

SEQ ID NO: 124264 - protein, 14 aa, Borrelia garinii
MLEEESLKTELLKE

SEQ ID NO: 124265 - protein, 14 aa, Borrelia garinii
LEEESLKTELLKEQ

SEQ ID NO: 124266 - protein, 14 aa, Borrelia garinii
EEESLKTELLKEQS

SEQ ID NO: 124267 - protein, 14 aa, Borrelia garinii
EESLKTELLKEQSE

SEQ ID NO: 124268 - protein, 14 aa, Borrelia garinii
ESLKTELLKEQSET

SEQ ID NO: 124269 - protein, 14 aa, Borrelia garinii
SLKTELLKEQSETR

SEQ ID NO: 124270 - protein, 14 aa, Borrelia garinii
LKTELLKEQSETRK

SEQ ID NO: 124271 - protein, 14 aa, Borrelia garinii
KTELLKEQSETRKE

SEQ ID NO: 124272 - protein, 14 aa, Borrelia garinii
TELLKEQSETRKEK

SEQ ID NO: 124273 - protein, 14 aa, Borrelia garinii
ELLKEQSETRKEKI

SEQ ID NO: 124274 - protein, 14 aa, Borrelia garinii
LLKEQSETRKEKIQ

SEQ ID NO: 124275 - protein, 14 aa, Borrelia garinii
LKEQSETRKEKIQK

SEQ ID NO: 124276 - protein, 14 aa, Borrelia garinii
KEQSETRKEKIQKQ

SEQ ID NO: 124277 - protein, 14 aa, Borrelia garinii
EQSETRKEKIQKQQ

SEQ ID NO: 124278 - protein, 14 aa, Borrelia garinii
QSETRKEKIQKQQD

SEQ ID NO: 124279 - protein, 14 aa, Borrelia garinii
SETRKEKIQKQQDE

SEQ ID NO: 124280 - protein, 14 aa, Borrelia garinii
ETRKEKIQKQQDEY

SEQ ID NO: 124281 - protein, 14 aa, Borrelia garinii
TRKEKIQKQQDEYK

SEQ ID NO: 124282 - protein, 14 aa, Borrelia garinii
RKEKIQKQQDEYKG

SEQ ID NO: 124283 - protein, 14 aa, Borrelia garinii
KEKIQKQQDEYKGM

SEQ ID NO: 124284 - protein, 14 aa, Borrelia garinii
EKIQKQQDEYKGMT

SEQ ID NO: 124285 - protein, 14 aa, Borrelia garinii
KIQKQQDEYKGMTK

SEQ ID NO: 124286 - protein, 14 aa, Borrelia garinii
IQKQQDEYKGMTKG

SEQ ID NO: 124287 - protein, 14 aa, Borrelia garinii
QKQQDEYKGMTKGS

SEQ ID NO: 124288 - protein, 14 aa, Borrelia garinii
KQQDEYKGMTKGSL

SEQ ID NO: 124289 - protein, 14 aa, Borrelia garinii
QQDEYKGMTKGSLN

SEQ ID NO: 124290 - protein, 14 aa, Borrelia garinii
QDEYKGMTKGSLNS

SEQ ID NO: 124291 - protein, 14 aa, Borrelia garinii
DEYKGMTKGSLNSL

SEQ ID NO: 124292 - protein, 14 aa, Borrelia garinii
EYKGMTKGSLNSLS

SEQ ID NO: 124293 - protein, 14 aa, Borrelia garinii
YKGMTKGSLNSLSG

SEQ ID NO: 124294 - protein, 14 aa, Borrelia garinii
KGMTKGSLNSLSGE

SEQ ID NO: 124295 - protein, 14 aa, Borrelia garinii
GMTKGSLNSLSGES

SEQ ID NO: 124296 - protein, 14 aa, Borrelia garinii
MTKGSLNSLSGESG

SEQ ID NO: 124297 - protein, 14 aa, Borrelia garinii
TKGSLNSLSGESGE

SEQ ID NO: 124298 - protein, 14 aa, Borrelia garinii
KGSLNSLSGESGEL

SEQ ID NO: 124299 - protein, 14 aa, Borrelia garinii
GSLNSLSGESGELK

SEQ ID NO: 124300 - protein, 14 aa, Borrelia garinii
SLNSLSGESGELKE

SEQ ID NO: 124301 - protein, 14 aa, Borrelia garinii
LNSLSGESGELKET

SEQ ID NO: 124302 - protein, 14 aa, Borrelia garinii
NSLSGESGELKETI

SEQ ID NO: 124303 - protein, 14 aa, Borrelia garinii
SLSGESGELKETIE

SEQ ID NO: 124304 - protein, 14 aa, Borrelia garinii
LSGESGELKETIES

SEQ ID NO: 124305 - protein, 14 aa, Borrelia garinii
SGESGELKETIESN

SEQ ID NO: 124306 - protein, 14 aa, Borrelia garinii
GESGELKETIESNE

SEQ ID NO: 124307 - protein, 14 aa, Borrelia garinii
ESGELKETIESNEI

SEQ ID NO: 124308 - protein, 14 aa, Borrelia garinii
SGELKETIESNEID

SEQ ID NO: 124309 - protein, 14 aa, Borrelia garinii
GELKETIESNEIDI

SEQ ID NO: 124310 - protein, 14 aa, Borrelia garinii
ELKETIESNEIDIT

SEQ ID NO: 124311 - protein, 14 aa, Borrelia garinii
LKETIESNEIDITI

SEQ ID NO: 124312 - protein, 14 aa, Borrelia garinii
KETIESNEIDITID

SEQ ID NO: 124313 - protein, 14 aa, Borrelia garinii
ETIESNEIDITIDS

SEQ ID NO: 124314 - protein, 14 aa, Borrelia garinii
TIESNEIDITIDSD

SEQ ID NO: 124315 - protein, 14 aa, Borrelia garinii
IESNEIDITIDSDL

SEQ ID NO: 124316 - protein, 14 aa, Borrelia garinii
ESNEIDITIDSDLR

SEQ ID NO: 124317 - protein, 14 aa, Borrelia garinii
SNEIDITIDSDLRP

SEQ ID NO: 124318 - protein, 14 aa, Borrelia garinii
NEIDITIDSDLRPK

SEQ ID NO: 124319 - protein, 14 aa, Borrelia garinii
EIDITIDSDLRPKS

SEQ ID NO: 124320 - protein, 14 aa, Borrelia garinii
IDITIDSDLRPKSS

SEQ ID NO: 124321 - protein, 14 aa, Borrelia garinii
DITIDSDLRPKSSL

SEQ ID NO: 124322 - protein, 14 aa, Borrelia garinii
ITIDSDLRPKSSLQ

SEQ ID NO: 124323 - protein, 14 aa, Borrelia garinii
TIDSDLRPKSSLQD

SEQ ID NO: 124324 - protein, 14 aa, Borrelia garinii
IDSDLRPKSSLQDI

SEQ ID NO: 124325 - protein, 14 aa, Borrelia garinii
DSDLRPKSSLQDIA

SEQ ID NO: 124326 - protein, 14 aa, Borrelia garinii
SDLRPKSSLQDIAG

SEQ ID NO: 124327 - protein, 14 aa, Borrelia garinii
DLRPKSSLQDIAGS

SEQ ID NO: 124328 - protein, 14 aa, Borrelia garinii
LRPKSSLQDIAGSN

SEQ ID NO: 124329 - protein, 14 aa, Borrelia garinii
RPKSSLQDIAGSNS

SEQ ID NO: 124330 - protein, 14 aa, Borrelia garinii
PKSSLQDIAGSNSI

SEQ ID NO: 124331 - protein, 14 aa, Borrelia garinii
KSSLQDIAGSNSIS

SEQ ID NO: 124332 - protein, 14 aa, Borrelia garinii
SSLQDIAGSNSISY

SEQ ID NO: 124333 - protein, 14 aa, Borrelia garinii
SLQDIAGSNSISYT

SEQ ID NO: 124334 - protein, 14 aa, Borrelia garinii
LQDIAGSNSISYTD

SEQ ID NO: 124335 - protein, 14 aa, Borrelia garinii
QDIAGSNSISYTDE

SEQ ID NO: 124336 - protein, 14 aa, Borrelia garinii
DIAGSNSISYTDEI

SEQ ID NO: 124337 - protein, 14 aa, Borrelia garinii
IAGSNSISYTDEIE

SEQ ID NO: 124338 - protein, 14 aa, Borrelia garinii
AGSNSISYTDEIEE

SEQ ID NO: 124339 - protein, 14 aa, Borrelia garinii
GSNSISYTDEIEEE

SEQ ID NO: 124340 - protein, 14 aa, Borrelia garinii
SNSISYTDEIEEED

SEQ ID NO: 124341 - protein, 14 aa, Borrelia garinii
NSISYTDEIEEEDY

SEQ ID NO: 124342 - protein, 14 aa, Borrelia garinii
SISYTDEIEEEDYA

SEQ ID NO: 124343 - protein, 14 aa, Borrelia garinii
ISYTDEIEEEDYAR

SEQ ID NO: 124344 - protein, 14 aa, Borrelia garinii
SYTDEIEEEDYARY

SEQ ID NO: 124345 - protein, 14 aa, Borrelia garinii
YTDEIEEEDYARYY

SEQ ID NO: 124346 - protein, 14 aa, Borrelia garinii
TDEIEEEDYARYYL

SEQ ID NO: 124347 - protein, 14 aa, Borrelia garinii
DEIEEEDYARYYLD

SEQ ID NO: 124348 - protein, 14 aa, Borrelia garinii
EIEEEDYARYYLDE

SEQ ID NO: 124349 - protein, 14 aa, Borrelia garinii
IEEEDYARYYLDED

SEQ ID NO: 124350 - protein, 14 aa, Borrelia garinii
EEEDYARYYLDEDD

SEQ ID NO: 124351 - protein, 14 aa, Borrelia garinii
EEDYARYYLDEDDE

SEQ ID NO: 124352 - protein, 14 aa, Borrelia garinii
EDYARYYLDEDDED

SEQ ID NO: 124353 - protein, 14 aa, Borrelia garinii
DYARYYLDEDDEDD

SEQ ID NO: 124354 - protein, 14 aa, Borrelia garinii
YARYYLDEDDEDDE

SEQ ID NO: 124355 - protein, 14 aa, Borrelia garinii
ARYYLDEDDEDDEY

SEQ ID NO: 124356 - protein, 14 aa, Borrelia garinii
RYYLDEDDEDDEYY

SEQ ID NO: 124357 - protein, 14 aa, Borrelia garinii
YYLDEDDEDDEYYE

SEQ ID NO: 124358 - protein, 14 aa, Borrelia garinii
YLDEDDEDDEYYED

SEQ ID NO: 124359 - protein, 14 aa, Borrelia garinii
LDEDDEDDEYYEDD

SEQ ID NO: 124360 - protein, 14 aa, Borrelia garinii
DEDDEDDEYYEDDY

SEQ ID NO: 124361 - protein, 14 aa, Borrelia garinii
EDDEDDEYYEDDYE

SEQ ID NO: 124362 - protein, 14 aa, Borrelia garinii
DDEDDEYYEDDYEE

SEQ ID NO: 124363 - protein, 14 aa, Borrelia garinii
DEDDEYYEDDYEEI

SEQ ID NO: 124364 - protein, 14 aa, Borrelia garinii
EDDEYYEDDYEEIR

SEQ ID NO: 124365 - protein, 14 aa, Borrelia garinii
DDEYYEDDYEEIRL

SEQ ID NO: 124366 - protein, 14 aa, Borrelia garinii
DEYYEDDYEEIRLS

SEQ ID NO: 124367 - protein, 14 aa, Borrelia garinii
EYYEDDYEEIRLSN

SEQ ID NO: 124368 - protein, 14 aa, Borrelia garinii
YYEDDYEEIRLSNR

SEQ ID NO: 124369 - protein, 14 aa, Borrelia garinii
YEDDYEEIRLSNRY

SEQ ID NO: 124370 - protein, 14 aa, Borrelia garinii
EDDYEEIRLSNRYQ

SEQ ID NO: 124371 - protein, 14 aa, Borrelia garinii
DDYEEIRLSNRYQS

SEQ ID NO: 124372 - protein, 14 aa, Borrelia garinii
DYEEIRLSNRYQSY

SEQ ID NO: 124373 - protein, 14 aa, Borrelia garinii
YEEIRLSNRYQSYL

SEQ ID NO: 124374 - protein, 14 aa, Borrelia garinii
EEIRLSNRYQSYLE

SEQ ID NO: 124375 - protein, 14 aa, Borrelia garinii
EIRLSNRYQSYLEG

SEQ ID NO: 124376 - protein, 14 aa, Borrelia garinii
IRLSNRYQSYLEGV

SEQ ID NO: 124377 - protein, 14 aa, Borrelia garinii
RLSNRYQSYLEGVK

SEQ ID NO: 124378 - protein, 14 aa, Borrelia garinii
LSNRYQSYLEGVKY

SEQ ID NO: 124379 - protein, 14 aa, Borrelia garinii
SNRYQSYLEGVKYN

SEQ ID NO: 124380 - protein, 14 aa, Borrelia garinii
NRYQSYLEGVKYNV

SEQ ID NO: 124381 - protein, 14 aa, Borrelia garinii
RYQSYLEGVKYNVD

SEQ ID NO: 124382 - protein, 14 aa, Borrelia garinii
YQSYLEGVKYNVDS

SEQ ID NO: 124383 - protein, 14 aa, Borrelia garinii
QSYLEGVKYNVDSA

SEQ ID NO: 124384 - protein, 14 aa, Borrelia garinii
SYLEGVKYNVDSAI

SEQ ID NO: 124385 - protein, 14 aa, Borrelia garinii
YLEGVKYNVDSAIN

SEQ ID NO: 124386 - protein, 14 aa, Borrelia garinii
LEGVKYNVDSAINT

SEQ ID NO: 124387 - protein, 14 aa, Borrelia garinii
EGVKYNVDSAINTI

SEQ ID NO: 124388 - protein, 14 aa, Borrelia garinii
GVKYNVDSAINTIN

SEQ ID NO: 124389 - protein, 14 aa, Borrelia garinii
VKYNVDSAINTINK

SEQ ID NO: 124390 - protein, 14 aa, Borrelia garinii
KYNVDSAINTINKI

SEQ ID NO: 124391 - protein, 14 aa, Borrelia garinii
YNVDSAINTINKIY

SEQ ID NO: 124392 - protein, 14 aa, Borrelia garinii
NVDSAINTINKIYD

SEQ ID NO: 124393 - protein, 14 aa, Borrelia garinii
VDSAINTINKIYDT

SEQ ID NO: 124394 - protein, 14 aa, Borrelia garinii
DSAINTINKIYDTY

SEQ ID NO: 124395 - protein, 14 aa, Borrelia garinii
SAINTINKIYDTYT

SEQ ID NO: 124396 - protein, 14 aa, Borrelia garinii
AINTINKIYDTYTL

SEQ ID NO: 124397 - protein, 14 aa, Borrelia garinii
INTINKIYDTYTLF

SEQ ID NO: 124398 - protein, 14 aa, Borrelia garinii
NTINKIYDTYTLFS

SEQ ID NO: 124399 - protein, 14 aa, Borrelia garinii
TINKIYDTYTLFST

SEQ ID NO: 124400 - protein, 14 aa, Borrelia garinii
INKIYDTYTLFSTK

SEQ ID NO: 124401 - protein, 14 aa, Borrelia garinii
NKIYDTYTLFSTKL

SEQ ID NO: 124402 - protein, 14 aa, Borrelia garinii
KIYDTYTLFSTKLT

SEQ ID NO: 124403 - protein, 14 aa, Borrelia garinii
IYDTYTLFSTKLTQ

SEQ ID NO: 124404 - protein, 14 aa, Borrelia garinii
YDTYTLFSTKLTQM

SEQ ID NO: 124405 - protein, 14 aa, Borrelia garinii
DTYTLFSTKLTQMY

SEQ ID NO: 124406 - protein, 14 aa, Borrelia garinii
TYTLFSTKLTQMYS

SEQ ID NO: 124407 - protein, 14 aa, Borrelia garinii
YTLFSTKLTQMYST

SEQ ID NO: 124408 - protein, 14 aa, Borrelia garinii
TLFSTKLTQMYSTR

SEQ ID NO: 124409 - protein, 14 aa, Borrelia garinii
LFSTKLTQMYSTRL

SEQ ID NO: 124410 - protein, 14 aa, Borrelia garinii
FSTKLTQMYSTRLD

SEQ ID NO: 124411 - protein, 14 aa, Borrelia garinii
STKLTQMYSTRLDN

SEQ ID NO: 124412 - protein, 14 aa, Borrelia garinii
TKLTQMYSTRLDNL

SEQ ID NO: 124413 - protein, 14 aa, Borrelia garinii
KLTQMYSTRLDNLA

SEQ ID NO: 124414 - protein, 14 aa, Borrelia garinii
LTQMYSTRLDNLAK

SEQ ID NO: 124415 - protein, 14 aa, Borrelia garinii
TQMYSTRLDNLAKA

SEQ ID NO: 124416 - protein, 14 aa, Borrelia garinii
QMYSTRLDNLAKAK

SEQ ID NO: 124417 - protein, 14 aa, Borrelia garinii
MYSTRLDNLAKAKA

SEQ ID NO: 124418 - protein, 14 aa, Borrelia garinii
YSTRLDNLAKAKAK

SEQ ID NO: 124419 - protein, 14 aa, Borrelia garinii
STRLDNLAKAKAKE

SEQ ID NO: 124420 - protein, 14 aa, Borrelia garinii
TRLDNLAKAKAKEE

SEQ ID NO: 124421 - protein, 14 aa, Borrelia garinii
RLDNLAKAKAKEEA

SEQ ID NO: 124422 - protein, 14 aa, Borrelia garinii
LDNLAKAKAKEEAA

SEQ ID NO: 124423 - protein, 14 aa, Borrelia garinii
DNLAKAKAKEEAAK

SEQ ID NO: 124424 - protein, 14 aa, Borrelia garinii
NLAKAKAKEEAAKF

SEQ ID NO: 124425 - protein, 14 aa, Borrelia garinii
LAKAKAKEEAAKFT

SEQ ID NO: 124426 - protein, 14 aa, Borrelia garinii
AKAKAKEEAAKFTK

SEQ ID NO: 124427 - protein, 14 aa, Borrelia garinii
KAKAKEEAAKFTKE

SEQ ID NO: 124428 - protein, 14 aa, Borrelia garinii
AKAKEEAAKFTKED

SEQ ID NO: 124429 - protein, 14 aa, Borrelia garinii
KAKEEAAKFTKEDL

SEQ ID NO: 124430 - protein, 14 aa, Borrelia garinii
AKEEAAKFTKEDLE

SEQ ID NO: 124431 - protein, 14 aa, Borrelia garinii
KEEAAKFTKEDLEK

SEQ ID NO: 124432 - protein, 14 aa, Borrelia garinii
EEAAKFTKEDLEKN

SEQ ID NO: 124433 - protein, 14 aa, Borrelia garinii
EAAKFTKEDLEKNF

SEQ ID NO: 124434 - protein, 14 aa, Borrelia garinii
AAKFTKEDLEKNFK

SEQ ID NO: 124435 - protein, 14 aa, Borrelia garinii
AKFTKEDLEKNFKT

SEQ ID NO: 124436 - protein, 14 aa, Borrelia garinii
KFTKEDLEKNFKTL

SEQ ID NO: 124437 - protein, 14 aa, Borrelia garinii
FTKEDLEKNFKTLL

SEQ ID NO: 124438 - protein, 14 aa, Borrelia garinii
TKEDLEKNFKTLLN

SEQ ID NO: 124439 - protein, 14 aa, Borrelia garinii
KEDLEKNFKTLLNY

SEQ ID NO: 124440 - protein, 14 aa, Borrelia garinii
EDLEKNFKTLLNYI

SEQ ID NO: 124441 - protein, 14 aa, Borrelia garinii
DLEKNFKTLLNYIQ

SEQ ID NO: 124442 - protein, 14 aa, Borrelia garinii
LEKNFKTLLNYIQV

SEQ ID NO: 124443 - protein, 14 aa, Borrelia garinii
EKNFKTLLNYIQVS

SEQ ID NO: 124444 - protein, 14 aa, Borrelia garinii
KNFKTLLNYIQVSV

SEQ ID NO: 124445 - protein, 14 aa, Borrelia garinii
NFKTLLNYIQVSVK

SEQ ID NO: 124446 - protein, 14 aa, Borrelia garinii
FKTLLNYIQVSVKT

SEQ ID NO: 124447 - protein, 14 aa, Borrelia garinii
KTLLNYIQVSVKTA

SEQ ID NO: 124448 - protein, 14 aa, Borrelia garinii
TLLNYIQVSVKTAT

SEQ ID NO: 124449 - protein, 14 aa, Borrelia garinii
LLNYIQVSVKTATN

SEQ ID NO: 124450 - protein, 14 aa, Borrelia garinii
LNYIQVSVKTATNF

SEQ ID NO: 124451 - protein, 14 aa, Borrelia garinii
NYIQVSVKTATNFV

SEQ ID NO: 124452 - protein, 14 aa, Borrelia garinii
YIQVSVKTATNFVY

SEQ ID NO: 124453 - protein, 14 aa, Borrelia garinii
IQVSVKTATNFVYI

SEQ ID NO: 124454 - protein, 14 aa, Borrelia garinii
QVSVKTATNFVYIN

SEQ ID NO: 124455 - protein, 14 aa, Borrelia garinii
VSVKTATNFVYINE

SEQ ID NO: 124456 - protein, 14 aa, Borrelia garinii
SVKTATNFVYINEM

SEQ ID NO: 124457 - protein, 14 aa, Borrelia garinii
VKTATNFVYINEMH

SEQ ID NO: 124458 - protein, 14 aa, Borrelia garinii
KTATNFVYINEMHA

SEQ ID NO: 124459 - protein, 14 aa, Borrelia garinii
TATNFVYINEMHAK

SEQ ID NO: 124460 - protein, 14 aa, Borrelia garinii
ATNFVYINEMHAKR

SEQ ID NO: 124461 - protein, 14 aa, Borrelia garinii
TNFVYINEMHAKRK

SEQ ID NO: 124462 - protein, 14 aa, Borrelia garinii
NFVYINEMHAKRKL

SEQ ID NO: 124463 - protein, 14 aa, Borrelia garinii
FVYINEMHAKRKLE

SEQ ID NO: 124464 - protein, 14 aa, Borrelia garinii
VYINEMHAKRKLEN

SEQ ID NO: 124465 - protein, 14 aa, Borrelia garinii
YINEMHAKRKLENI

SEQ ID NO: 124466 - protein, 14 aa, Borrelia garinii
INEMHAKRKLENIE

SEQ ID NO: 124467 - protein, 14 aa, Borrelia garinii
NEMHAKRKLENIEA

SEQ ID NO: 124468 - protein, 14 aa, Borrelia garinii
EMHAKRKLENIEAK

SEQ ID NO: 124469 - protein, 14 aa, Borrelia garinii
MHAKRKLENIEAKI

SEQ ID NO: 124470 - protein, 14 aa, Borrelia garinii
HAKRKLENIEAKIK

SEQ ID NO: 124471 - protein, 14 aa, Borrelia garinii
AKRKLENIEAKIKT

SEQ ID NO: 124472 - protein, 14 aa, Borrelia garinii
KRKLENIEAKIKTL

SEQ ID NO: 124473 - protein, 14 aa, Borrelia garinii
RKLENIEAKIKTLI

SEQ ID NO: 124474 - protein, 14 aa, Borrelia garinii
KLENIEAKIKTLIA

SEQ ID NO: 124475 - protein, 14 aa, Borrelia garinii
LENIEAKIKTLIAK

SEQ ID NO: 124476 - protein, 14 aa, Borrelia garinii
ENIEAKIKTLIAKI

SEQ ID NO: 124477 - protein, 14 aa, Borrelia garinii
NIEAKIKTLIAKIK

SEQ ID NO: 124478 - protein, 14 aa, Borrelia garinii
IEAKIKTLIAKIKE

SEQ ID NO: 124479 - protein, 14 aa, Borrelia garinii
EAKIKTLIAKIKEK

SEQ ID NO: 124480 - protein, 14 aa, Borrelia garinii
AKIKTLIAKIKEKS

SEQ ID NO: 124481 - protein, 14 aa, Borrelia garinii
KIKTLIAKIKEKSN

SEQ ID NO: 124482 - protein, 14 aa, Borrelia garinii
IKTLIAKIKEKSNL

SEQ ID NO: 124483 - protein, 14 aa, Borrelia garinii
KTLIAKIKEKSNLY

SEQ ID NO: 124484 - protein, 14 aa, Borrelia garinii
TLIAKIKEKSNLYS

SEQ ID NO: 124485 - protein, 14 aa, Borrelia garinii
LIAKIKEKSNLYSA

SEQ ID NO: 124486 - protein, 14 aa, Borrelia garinii
IAKIKEKSNLYSAY

SEQ ID NO: 124487 - protein, 14 aa, Borrelia garinii
AKIKEKSNLYSAYK

SEQ ID NO: 124488 - protein, 14 aa, Borrelia garinii
KIKEKSNLYSAYKA

SEQ ID NO: 124489 - protein, 14 aa, Borrelia garinii
IKEKSNLYSAYKAI

SEQ ID NO: 124490 - protein, 14 aa, Borrelia garinii
KEKSNLYSAYKAIV

SEQ ID NO: 124491 - protein, 14 aa, Borrelia garinii
EKSNLYSAYKAIVS

SEQ ID NO: 124492 - protein, 14 aa, Borrelia garinii
KSNLYSAYKAIVSS

SEQ ID NO: 124493 - protein, 14 aa, Borrelia garinii
SNLYSAYKAIVSSI

SEQ ID NO: 124494 - protein, 14 aa, Borrelia garinii
NLYSAYKAIVSSIL

SEQ ID NO: 124495 - protein, 14 aa, Borrelia garinii
LYSAYKAIVSSILL

SEQ ID NO: 124496 - protein, 14 aa, Borrelia garinii
YSAYKAIVSSILLM

SEQ ID NO: 124497 - protein, 14 aa, Borrelia garinii
SAYKAIVSSILLMR

SEQ ID NO: 124498 - protein, 14 aa, Borrelia garinii
AYKAIVSSILLMRD

SEQ ID NO: 124499 - protein, 14 aa, Borrelia garinii
YKAIVSSILLMRDS

SEQ ID NO: 124500 - protein, 14 aa, Borrelia garinii
KAIVSSILLMRDSL

SEQ ID NO: 124501 - protein, 14 aa, Borrelia garinii
AIVSSILLMRDSLK

SEQ ID NO: 124502 - protein, 14 aa, Borrelia garinii
IVSSILLMRDSLKE

SEQ ID NO: 124503 - protein, 14 aa, Borrelia garinii
VSSILLMRDSLKEV

SEQ ID NO: 124504 - protein, 14 aa, Borrelia garinii
SSILLMRDSLKEVQ

SEQ ID NO: 124505 - protein, 14 aa, Borrelia garinii
SILLMRDSLKEVQY

SEQ ID NO: 124506 - protein, 14 aa, Borrelia garinii
ILLMRDSLKEVQYA

SEQ ID NO: 124507 - protein, 14 aa, Borrelia garinii
LLMRDSLKEVQYAI

SEQ ID NO: 124508 - protein, 14 aa, Borrelia garinii
LMRDSLKEVQYAID

SEQ ID NO: 124509 - protein, 14 aa, Borrelia garinii
MRDSLKEVQYAIDK

SEQ ID NO: 124510 - protein, 14 aa, Borrelia garinii
RDSLKEVQYAIDKN

SEQ ID NO: 124511 - protein, 14 aa, Borrelia garinii
DSLKEVQYAIDKNG

SEQ ID NO: 124512 - protein, 14 aa, Borrelia garinii
SLKEVQYAIDKNGI

SEQ ID NO: 124513 - protein, 14 aa, Borrelia garinii
LKEVQYAIDKNGIW

SEQ ID NO: 124514 - protein, 14 aa, Borrelia garinii
KEVQYAIDKNGIWY

SEQ ID NO: 124515 - protein, 14 aa, Borrelia garinii
EVQYAIDKNGIWYR

SEQ ID NO: 124516 - protein, 14 aa, Borrelia garinii
VQYAIDKNGIWYRK

SEQ ID NO: 124517 - protein, 14 aa, Borrelia garinii
QYAIDKNGIWYRKL

SEQ ID NO: 124518 - protein, 14 aa, Borrelia garinii
YAIDKNGIWYRKLD

SEQ ID NO: 124519 - protein, 14 aa, Borrelia garinii
AIDKNGIWYRKLDA

SEQ ID NO: 124520 - protein, 14 aa, Borrelia garinii
IDKNGIWYRKLDAI

SEQ ID NO: 124521 - protein, 14 aa, Borrelia garinii
DKNGIWYRKLDAIE

SEQ ID NO: 124522 - protein, 14 aa, Borrelia garinii
KNGIWYRKLDAIET

SEQ ID NO: 124523 - protein, 14 aa, Borrelia garinii
NGIWYRKLDAIETE

SEQ ID NO: 124524 - protein, 14 aa, Borrelia garinii
GIWYRKLDAIETEI

SEQ ID NO: 124525 - protein, 14 aa, Borrelia garinii
IWYRKLDAIETEIK

SEQ ID NO: 124526 - protein, 14 aa, Borrelia garinii
WYRKLDAIETEIKN

SEQ ID NO: 124527 - protein, 14 aa, Borrelia garinii
YRKLDAIETEIKNL

SEQ ID NO: 124528 - protein, 14 aa, Borrelia garinii
RKLDAIETEIKNLI

SEQ ID NO: 124529 - protein, 14 aa, Borrelia garinii
KLDAIETEIKNLIL

SEQ ID NO: 124530 - protein, 14 aa, Borrelia garinii
LDAIETEIKNLILK

SEQ ID NO: 124531 - protein, 14 aa, Borrelia garinii
DAIETEIKNLILKI

SEQ ID NO: 124532 - protein, 14 aa, Borrelia garinii
AIETEIKNLILKIK

SEQ ID NO: 124533 - protein, 14 aa, Borrelia garinii
IETEIKNLILKIKG

SEQ ID NO: 124534 - protein, 14 aa, Borrelia garinii
ETEIKNLILKIKGQ

SEQ ID NO: 124535 - protein, 14 aa, Borrelia garinii
TEIKNLILKIKGQS

SEQ ID NO: 124536 - protein, 14 aa, Borrelia garinii
EIKNLILKIKGQSD

SEQ ID NO: 124537 - protein, 14 aa, Borrelia garinii
IKNLILKIKGQSDL

SEQ ID NO: 124538 - protein, 14 aa, Borrelia garinii
KNLILKIKGQSDLY

SEQ ID NO: 124539 - protein, 14 aa, Borrelia garinii
NLILKIKGQSDLYE

SEQ ID NO: 124540 - protein, 14 aa, Borrelia garinii
LILKIKGQSDLYEA

SEQ ID NO: 124541 - protein, 14 aa, Borrelia garinii
ILKIKGQSDLYEAY

SEQ ID NO: 124542 - protein, 14 aa, Borrelia garinii
LKIKGQSDLYEAYK

SEQ ID NO: 124543 - protein, 14 aa, Borrelia garinii
KIKGQSDLYEAYKA

SEQ ID NO: 124544 - protein, 14 aa, Borrelia garinii
IKGQSDLYEAYKAI

SEQ ID NO: 124545 - protein, 14 aa, Borrelia garinii
KGQSDLYEAYKAIV

SEQ ID NO: 124546 - protein, 14 aa, Borrelia garinii
GQSDLYEAYKAIVR

SEQ ID NO: 124547 - protein, 14 aa, Borrelia garinii
QSDLYEAYKAIVRS

SEQ ID NO: 124548 - protein, 14 aa, Borrelia garinii
SDLYEAYKAIVRSI

SEQ ID NO: 124549 - protein, 14 aa, Borrelia garinii
DLYEAYKAIVRSIL

SEQ ID NO: 124550 - protein, 14 aa, Borrelia garinii
LYEAYKAIVRSILL

SEQ ID NO: 124551 - protein, 14 aa, Borrelia garinii
YEAYKAIVRSILLM

SEQ ID NO: 124552 - protein, 14 aa, Borrelia garinii
EAYKAIVRSILLMK

SEQ ID NO: 124553 - protein, 14 aa, Borrelia garinii
AYKAIVRSILLMKD

SEQ ID NO: 124554 - protein, 14 aa, Borrelia garinii
YKAIVRSILLMKDS

SEQ ID NO: 124555 - protein, 14 aa, Borrelia garinii
KAIVRSILLMKDSL

SEQ ID NO: 124556 - protein, 14 aa, Borrelia garinii
AIVRSILLMKDSLK

SEQ ID NO: 124557 - protein, 14 aa, Borrelia garinii
IVRSILLMKDSLKI

SEQ ID NO: 124558 - protein, 14 aa, Borrelia garinii
VRSILLMKDSLKII

SEQ ID NO: 124559 - protein, 14 aa, Borrelia garinii
RSILLMKDSLKIIE

SEQ ID NO: 124560 - protein, 14 aa, Borrelia garinii
SILLMKDSLKIIEI

SEQ ID NO: 124561 - protein, 14 aa, Borrelia garinii
ILLMKDSLKIIEIV

SEQ ID NO: 124562 - protein, 14 aa, Borrelia garinii
LLMKDSLKIIEIVI

SEQ ID NO: 124563 - protein, 14 aa, Borrelia garinii
LMKDSLKIIEIVID

SEQ ID NO: 124564 - protein, 14 aa, Borrelia garinii
MKDSLKIIEIVIDK

SEQ ID NO: 124565 - protein, 14 aa, Borrelia garinii
KDSLKIIEIVIDKN

SEQ ID NO: 124566 - protein, 14 aa, Borrelia garinii
DSLKIIEIVIDKNG

SEQ ID NO: 124567 - protein, 14 aa, Borrelia garinii
SLKIIEIVIDKNGV

SEQ ID NO: 124568 - protein, 14 aa, Borrelia garinii
LKIIEIVIDKNGVW

SEQ ID NO: 124569 - protein, 14 aa, Borrelia garinii
KIIEIVIDKNGVWY

SEQ ID NO: 124570 - protein, 15 aa, Borrelia garinii
MKKVKSKYLALGLLF

SEQ ID NO: 124571 - protein, 15 aa, Borrelia garinii
KKVKSKYLALGLLFG

SEQ ID NO: 124572 - protein, 15 aa, Borrelia garinii
KVKSKYLALGLLFGF

SEQ ID NO: 124573 - protein, 15 aa, Borrelia garinii
VKSKYLALGLLFGFI

SEQ ID NO: 124574 - protein, 15 aa, Borrelia garinii
KSKYLALGLLFGFIS

SEQ ID NO: 124575 - protein, 15 aa, Borrelia garinii
SKYLALGLLFGFISC

SEQ ID NO: 124576 - protein, 15 aa, Borrelia garinii
KYLALGLLFGFISCD

SEQ ID NO: 124577 - protein, 15 aa, Borrelia garinii
YLALGLLFGFISCDL

SEQ ID NO: 124578 - protein, 15 aa, Borrelia garinii
LALGLLFGFISCDLF

SEQ ID NO: 124579 - protein, 15 aa, Borrelia garinii
ALGLLFGFISCDLFI

SEQ ID NO: 124580 - protein, 15 aa, Borrelia garinii
LGLLFGFISCDLFIR

SEQ ID NO: 124581 - protein, 15 aa, Borrelia garinii
GLLFGFISCDLFIRY

SEQ ID NO: 124582 - protein, 15 aa, Borrelia garinii
LLFGFISCDLFIRYE

SEQ ID NO: 124583 - protein, 15 aa, Borrelia garinii
LFGFISCDLFIRYEM

SEQ ID NO: 124584 - protein, 15 aa, Borrelia garinii
FGFISCDLFIRYEMK

SEQ ID NO: 124585 - protein, 15 aa, Borrelia garinii
GFISCDLFIRYEMKE

SEQ ID NO: 124586 - protein, 15 aa, Borrelia garinii
FISCDLFIRYEMKEE

SEQ ID NO: 124587 - protein, 15 aa, Borrelia garinii
ISCDLFIRYEMKEES

SEQ ID NO: 124588 - protein, 15 aa, Borrelia garinii
SCDLFIRYEMKEESP

SEQ ID NO: 124589 - protein, 15 aa, Borrelia garinii
CDLFIRYEMKEESPG

SEQ ID NO: 124590 - protein, 15 aa, Borrelia garinii
DLFIRYEMKEESPGL

SEQ ID NO: 124591 - protein, 15 aa, Borrelia garinii
LFIRYEMKEESPGLF

SEQ ID NO: 124592 - protein, 15 aa, Borrelia garinii
FIRYEMKEESPGLFD

SEQ ID NO: 124593 - protein, 15 aa, Borrelia garinii
IRYEMKEESPGLFDK

SEQ ID NO: 124594 - protein, 15 aa, Borrelia garinii
RYEMKEESPGLFDKG

SEQ ID NO: 124595 - protein, 15 aa, Borrelia garinii
YEMKEESPGLFDKGN

SEQ ID NO: 124596 - protein, 15 aa, Borrelia garinii
EMKEESPGLFDKGNS

SEQ ID NO: 124597 - protein, 15 aa, Borrelia garinii
MKEESPGLFDKGNSI

SEQ ID NO: 124598 - protein, 15 aa, Borrelia garinii
KEESPGLFDKGNSIL

SEQ ID NO: 124599 - protein, 15 aa, Borrelia garinii
EESPGLFDKGNSILE

SEQ ID NO: 124600 - protein, 15 aa, Borrelia garinii
ESPGLFDKGNSILET

SEQ ID NO: 124601 - protein, 15 aa, Borrelia garinii
SPGLFDKGNSILETS

SEQ ID NO: 124602 - protein, 15 aa, Borrelia garinii
PGLFDKGNSILETSE

SEQ ID NO: 124603 - protein, 15 aa, Borrelia garinii
GLFDKGNSILETSEE

SEQ ID NO: 124604 - protein, 15 aa, Borrelia garinii
LFDKGNSILETSEES

SEQ ID NO: 124605 - protein, 15 aa, Borrelia garinii
FDKGNSILETSEESI

SEQ ID NO: 124606 - protein, 15 aa, Borrelia garinii
DKGNSILETSEESIK

SEQ ID NO: 124607 - protein, 15 aa, Borrelia garinii
KGNSILETSEESIKK

SEQ ID NO: 124608 - protein, 15 aa, Borrelia garinii
GNSILETSEESIKKP

SEQ ID NO: 124609 - protein, 15 aa, Borrelia garinii
NSILETSEESIKKPM

SEQ ID NO: 124610 - protein, 15 aa, Borrelia garinii
SILETSEESIKKPMN

SEQ ID NO: 124611 - protein, 15 aa, Borrelia garinii
ILETSEESIKKPMNK

SEQ ID NO: 124612 - protein, 15 aa, Borrelia garinii
LETSEESIKKPMNKK

SEQ ID NO: 124613 - protein, 15 aa, Borrelia garinii
ETSEESIKKPMNKKG

SEQ ID NO: 124614 - protein, 15 aa, Borrelia garinii
TSEESIKKPMNKKGK

SEQ ID NO: 124615 - protein, 15 aa, Borrelia garinii
SEESIKKPMNKKGKG

SEQ ID NO: 124616 - protein, 15 aa, Borrelia garinii
EESIKKPMNKKGKGK

SEQ ID NO: 124617 - protein, 15 aa, Borrelia garinii
ESIKKPMNKKGKGKI

SEQ ID NO: 124618 - protein, 15 aa, Borrelia garinii
SIKKPMNKKGKGKIA

SEQ ID NO: 124619 - protein, 15 aa, Borrelia garinii
IKKPMNKKGKGKIAR

SEQ ID NO: 124620 - protein, 15 aa, Borrelia garinii
KKPMNKKGKGKIARK

SEQ ID NO: 124621 - protein, 15 aa, Borrelia garinii
KPMNKKGKGKIARKN

SEQ ID NO: 124622 - protein, 15 aa, Borrelia garinii
PMNKKGKGKIARKNG

SEQ ID NO: 124623 - protein, 15 aa, Borrelia garinii
MNKKGKGKIARKNGK

SEQ ID NO: 124624 - protein, 15 aa, Borrelia garinii
NKKGKGKIARKNGKS

SEQ ID NO: 124625 - protein, 15 aa, Borrelia garinii
KKGKGKIARKNGKSK

SEQ ID NO: 124626 - protein, 15 aa, Borrelia garinii
KGKGKIARKNGKSKV

SEQ ID NO: 124627 - protein, 15 aa, Borrelia garinii
GKGKIARKNGKSKVS

SEQ ID NO: 124628 - protein, 15 aa, Borrelia garinii
KGKIARKNGKSKVSG

SEQ ID NO: 124629 - protein, 15 aa, Borrelia garinii
GKIARKNGKSKVSGK

SEQ ID NO: 124630 - protein, 15 aa, Borrelia garinii
KIARKNGKSKVSGKE

SEQ ID NO: 124631 - protein, 15 aa, Borrelia garinii
IARKNGKSKVSGKEP

SEQ ID NO: 124632 - protein, 15 aa, Borrelia garinii
ARKNGKSKVSGKEPF

SEQ ID NO: 124633 - protein, 15 aa, Borrelia garinii
RKNGKSKVSGKEPFI

SEQ ID NO: 124634 - protein, 15 aa, Borrelia garinii
KNGKSKVSGKEPFIH

SEQ ID NO: 124635 - protein, 15 aa, Borrelia garinii
NGKSKVSGKEPFIHS

SEQ ID NO: 124636 - protein, 15 aa, Borrelia garinii
GKSKVSGKEPFIHSF

SEQ ID NO: 124637 - protein, 15 aa, Borrelia garinii
KSKVSGKEPFIHSFK

SEQ ID NO: 124638 - protein, 15 aa, Borrelia garinii
SKVSGKEPFIHSFKR

SEQ ID NO: 124639 - protein, 15 aa, Borrelia garinii
KVSGKEPFIHSFKRD

SEQ ID NO: 124640 - protein, 15 aa, Borrelia garinii
VSGKEPFIHSFKRDA

SEQ ID NO: 124641 - protein, 15 aa, Borrelia garinii
SGKEPFIHSFKRDAA

SEQ ID NO: 124642 - protein, 15 aa, Borrelia garinii
GKEPFIHSFKRDAAN

SEQ ID NO: 124643 - protein, 15 aa, Borrelia garinii
KEPFIHSFKRDAANK

SEQ ID NO: 124644 - protein, 15 aa, Borrelia garinii
EPFIHSFKRDAANKS

SEQ ID NO: 124645 - protein, 15 aa, Borrelia garinii
PFIHSFKRDAANKSN

SEQ ID NO: 124646 - protein, 15 aa, Borrelia garinii
FIHSFKRDAANKSNF

SEQ ID NO: 124647 - protein, 15 aa, Borrelia garinii
IHSFKRDAANKSNFL

SEQ ID NO: 124648 - protein, 15 aa, Borrelia garinii
HSFKRDAANKSNFLQ

SEQ ID NO: 124649 - protein, 15 aa, Borrelia garinii
SFKRDAANKSNFLQK

SEQ ID NO: 124650 - protein, 15 aa, Borrelia garinii
FKRDAANKSNFLQKN

SEQ ID NO: 124651 - protein, 15 aa, Borrelia garinii
KRDAANKSNFLQKNV

SEQ ID NO: 124652 - protein, 15 aa, Borrelia garinii
RDAANKSNFLQKNVM

SEQ ID NO: 124653 - protein, 15 aa, Borrelia garinii
DAANKSNFLQKNVML

SEQ ID NO: 124654 - protein, 15 aa, Borrelia garinii
AANKSNFLQKNVMLE

SEQ ID NO: 124655 - protein, 15 aa, Borrelia garinii
ANKSNFLQKNVMLEE

SEQ ID NO: 124656 - protein, 15 aa, Borrelia garinii
NKSNFLQKNVMLEEE

SEQ ID NO: 124657 - protein, 15 aa, Borrelia garinii
KSNFLQKNVMLEEES

SEQ ID NO: 124658 - protein, 15 aa, Borrelia garinii
SNFLQKNVMLEEESL

SEQ ID NO: 124659 - protein, 15 aa, Borrelia garinii
NFLQKNVMLEEESLK

SEQ ID NO: 124660 - protein, 15 aa, Borrelia garinii
FLQKNVMLEEESLKT

SEQ ID NO: 124661 - protein, 15 aa, Borrelia garinii
LQKNVMLEEESLKTE

SEQ ID NO: 124662 - protein, 15 aa, Borrelia garinii
QKNVMLEEESLKTEL

SEQ ID NO: 124663 - protein, 15 aa, Borrelia garinii
KNVMLEEESLKTELL

SEQ ID NO: 124664 - protein, 15 aa, Borrelia garinii
NVMLEEESLKTELLK

SEQ ID NO: 124665 - protein, 15 aa, Borrelia garinii
VMLEEESLKTELLKE

SEQ ID NO: 124666 - protein, 15 aa, Borrelia garinii
MLEEESLKTELLKEQ

SEQ ID NO: 124667 - protein, 15 aa, Borrelia garinii
LEEESLKTELLKEQS

SEQ ID NO: 124668 - protein, 15 aa, Borrelia garinii
EEESLKTELLKEQSE

SEQ ID NO: 124669 - protein, 15 aa, Borrelia garinii
EESLKTELLKEQSET

SEQ ID NO: 124670 - protein, 15 aa, Borrelia garinii
ESLKTELLKEQSETR

SEQ ID NO: 124671 - protein, 15 aa, Borrelia garinii
SLKTELLKEQSETRK

SEQ ID NO: 124672 - protein, 15 aa, Borrelia garinii
LKTELLKEQSETRKE

SEQ ID NO: 124673 - protein, 15 aa, Borrelia garinii
KTELLKEQSETRKEK

SEQ ID NO: 124674 - protein, 15 aa, Borrelia garinii
TELLKEQSETRKEKI

SEQ ID NO: 124675 - protein, 15 aa, Borrelia garinii
ELLKEQSETRKEKIQ

SEQ ID NO: 124676 - protein, 15 aa, Borrelia garinii
LLKEQSETRKEKIQK

SEQ ID NO: 124677 - protein, 15 aa, Borrelia garinii
LKEQSETRKEKIQKQ

SEQ ID NO: 124678 - protein, 15 aa, Borrelia garinii
KEQSETRKEKIQKQQ

SEQ ID NO: 124679 - protein, 15 aa, Borrelia garinii
EQSETRKEKIQKQQD

SEQ ID NO: 124680 - protein, 15 aa, Borrelia garinii
QSETRKEKIQKQQDE

SEQ ID NO: 124681 - protein, 15 aa, Borrelia garinii
SETRKEKIQKQQDEY

SEQ ID NO: 124682 - protein, 15 aa, Borrelia garinii
ETRKEKIQKQQDEYK

SEQ ID NO: 124683 - protein, 15 aa, Borrelia garinii
TRKEKIQKQQDEYKG

SEQ ID NO: 124684 - protein, 15 aa, Borrelia garinii
RKEKIQKQQDEYKGM

SEQ ID NO: 124685 - protein, 15 aa, Borrelia garinii
KEKIQKQQDEYKGMT

SEQ ID NO: 124686 - protein, 15 aa, Borrelia garinii
EKIQKQQDEYKGMTK

SEQ ID NO: 124687 - protein, 15 aa, Borrelia garinii
KIQKQQDEYKGMTKG

SEQ ID NO: 124688 - protein, 15 aa, Borrelia garinii
IQKQQDEYKGMTKGS

SEQ ID NO: 124689 - protein, 15 aa, Borrelia garinii
QKQQDEYKGMTKGSL

SEQ ID NO: 124690 - protein, 15 aa, Borrelia garinii
KQQDEYKGMTKGSLN

SEQ ID NO: 124691 - protein, 15 aa, Borrelia garinii
QQDEYKGMTKGSLNS

SEQ ID NO: 124692 - protein, 15 aa, Borrelia garinii
QDEYKGMTKGSLNSL

SEQ ID NO: 124693 - protein, 15 aa, Borrelia garinii
DEYKGMTKGSLNSLS

SEQ ID NO: 124694 - protein, 15 aa, Borrelia garinii
EYKGMTKGSLNSLSG

SEQ ID NO: 124695 - protein, 15 aa, Borrelia garinii
YKGMTKGSLNSLSGE

SEQ ID NO: 124696 - protein, 15 aa, Borrelia garinii
KGMTKGSLNSLSGES

SEQ ID NO: 124697 - protein, 15 aa, Borrelia garinii
GMTKGSLNSLSGESG

SEQ ID NO: 124698 - protein, 15 aa, Borrelia garinii
MTKGSLNSLSGESGE

SEQ ID NO: 124699 - protein, 15 aa, Borrelia garinii
TKGSLNSLSGESGEL

SEQ ID NO: 124700 - protein, 15 aa, Borrelia garinii
KGSLNSLSGESGELK

SEQ ID NO: 124701 - protein, 15 aa, Borrelia garinii
GSLNSLSGESGELKE

SEQ ID NO: 124702 - protein, 15 aa, Borrelia garinii
SLNSLSGESGELKET

SEQ ID NO: 124703 - protein, 15 aa, Borrelia garinii
LNSLSGESGELKETI

SEQ ID NO: 124704 - protein, 15 aa, Borrelia garinii
NSLSGESGELKETIE

SEQ ID NO: 124705 - protein, 15 aa, Borrelia garinii
SLSGESGELKETIES

SEQ ID NO: 124706 - protein, 15 aa, Borrelia garinii
LSGESGELKETIESN

SEQ ID NO: 124707 - protein, 15 aa, Borrelia garinii
SGESGELKETIESNE

SEQ ID NO: 124708 - protein, 15 aa, Borrelia garinii
GESGELKETIESNEI

SEQ ID NO: 124709 - protein, 15 aa, Borrelia garinii
ESGELKETIESNEID

SEQ ID NO: 124710 - protein, 15 aa, Borrelia garinii
SGELKETIESNEIDI

SEQ ID NO: 124711 - protein, 15 aa, Borrelia garinii
GELKETIESNEIDIT

SEQ ID NO: 124712 - protein, 15 aa, Borrelia garinii
ELKETIESNEIDITI

SEQ ID NO: 124713 - protein, 15 aa, Borrelia garinii
LKETIESNEIDITID

SEQ ID NO: 124714 - protein, 15 aa, Borrelia garinii
KETIESNEIDITIDS

SEQ ID NO: 124715 - protein, 15 aa, Borrelia garinii
ETIESNEIDITIDSD

SEQ ID NO: 124716 - protein, 15 aa, Borrelia garinii
TIESNEIDITIDSDL

SEQ ID NO: 124717 - protein, 15 aa, Borrelia garinii
IESNEIDITIDSDLR

SEQ ID NO: 124718 - protein, 15 aa, Borrelia garinii
ESNEIDITIDSDLRP

SEQ ID NO: 124719 - protein, 15 aa, Borrelia garinii
SNEIDITIDSDLRPK

SEQ ID NO: 124720 - protein, 15 aa, Borrelia garinii
NEIDITIDSDLRPKS

SEQ ID NO: 124721 - protein, 15 aa, Borrelia garinii
EIDITIDSDLRPKSS

SEQ ID NO: 124722 - protein, 15 aa, Borrelia garinii
IDITIDSDLRPKSSL

SEQ ID NO: 124723 - protein, 15 aa, Borrelia garinii
DITIDSDLRPKSSLQ

SEQ ID NO: 124724 - protein, 15 aa, Borrelia garinii
ITIDSDLRPKSSLQD

SEQ ID NO: 124725 - protein, 15 aa, Borrelia garinii
TIDSDLRPKSSLQDI

SEQ ID NO: 124726 - protein, 15 aa, Borrelia garinii
IDSDLRPKSSLQDIA

SEQ ID NO: 124727 - protein, 15 aa, Borrelia garinii
DSDLRPKSSLQDIAG

SEQ ID NO: 124728 - protein, 15 aa, Borrelia garinii
SDLRPKSSLQDIAGS

SEQ ID NO: 124729 - protein, 15 aa, Borrelia garinii
DLRPKSSLQDIAGSN

SEQ ID NO: 124730 - protein, 15 aa, Borrelia garinii
LRPKSSLQDIAGSNS

SEQ ID NO: 124731 - protein, 15 aa, Borrelia garinii
RPKSSLQDIAGSNSI

SEQ ID NO: 124732 - protein, 15 aa, Borrelia garinii
PKSSLQDIAGSNSIS

SEQ ID NO: 124733 - protein, 15 aa, Borrelia garinii
KSSLQDIAGSNSISY

SEQ ID NO: 124734 - protein, 15 aa, Borrelia garinii
SSLQDIAGSNSISYT

SEQ ID NO: 124735 - protein, 15 aa, Borrelia garinii
SLQDIAGSNSISYTD

SEQ ID NO: 124736 - protein, 15 aa, Borrelia garinii
LQDIAGSNSISYTDE

SEQ ID NO: 124737 - protein, 15 aa, Borrelia garinii
QDIAGSNSISYTDEI

SEQ ID NO: 124738 - protein, 15 aa, Borrelia garinii
DIAGSNSISYTDEIE

SEQ ID NO: 124739 - protein, 15 aa, Borrelia garinii
IAGSNSISYTDEIEE

SEQ ID NO: 124740 - protein, 15 aa, Borrelia garinii
AGSNSISYTDEIEEE

SEQ ID NO: 124741 - protein, 15 aa, Borrelia garinii
GSNSISYTDEIEEED

SEQ ID NO: 124742 - protein, 15 aa, Borrelia garinii
SNSISYTDEIEEEDY

SEQ ID NO: 124743 - protein, 15 aa, Borrelia garinii
NSISYTDEIEEEDYA

SEQ ID NO: 124744 - protein, 15 aa, Borrelia garinii
SISYTDEIEEEDYAR

SEQ ID NO: 124745 - protein, 15 aa, Borrelia garinii
ISYTDEIEEEDYARY

SEQ ID NO: 124746 - protein, 15 aa, Borrelia garinii
SYTDEIEEEDYARYY

SEQ ID NO: 124747 - protein, 15 aa, Borrelia garinii
YTDEIEEEDYARYYL

SEQ ID NO: 124748 - protein, 15 aa, Borrelia garinii
TDEIEEEDYARYYLD

SEQ ID NO: 124749 - protein, 15 aa, Borrelia garinii
DEIEEEDYARYYLDE

SEQ ID NO: 124750 - protein, 15 aa, Borrelia garinii
EIEEEDYARYYLDED

SEQ ID NO: 124751 - protein, 15 aa, Borrelia garinii
IEEEDYARYYLDEDD

SEQ ID NO: 124752 - protein, 15 aa, Borrelia garinii
EEEDYARYYLDEDDE

SEQ ID NO: 124753 - protein, 15 aa, Borrelia garinii
EEDYARYYLDEDDED

SEQ ID NO: 124754 - protein, 15 aa, Borrelia garinii
EDYARYYLDEDDEDD

SEQ ID NO: 124755 - protein, 15 aa, Borrelia garinii
DYARYYLDEDDEDDE

SEQ ID NO: 124756 - protein, 15 aa, Borrelia garinii
YARYYLDEDDEDDEY

SEQ ID NO: 124757 - protein, 15 aa, Borrelia garinii
ARYYLDEDDEDDEYY

SEQ ID NO: 124758 - protein, 15 aa, Borrelia garinii
RYYLDEDDEDDEYYE

SEQ ID NO: 124759 - protein, 15 aa, Borrelia garinii
YYLDEDDEDDEYYED

SEQ ID NO: 124760 - protein, 15 aa, Borrelia garinii
YLDEDDEDDEYYEDD

SEQ ID NO: 124761 - protein, 15 aa, Borrelia garinii
LDEDDEDDEYYEDDY

SEQ ID NO: 124762 - protein, 15 aa, Borrelia garinii
DEDDEDDEYYEDDYE

SEQ ID NO: 124763 - protein, 15 aa, Borrelia garinii
EDDEDDEYYEDDYEE

SEQ ID NO: 124764 - protein, 15 aa, Borrelia garinii
DDEDDEYYEDDYEEI

SEQ ID NO: 124765 - protein, 15 aa, Borrelia garinii
DEDDEYYEDDYEEIR

SEQ ID NO: 124766 - protein, 15 aa, Borrelia garinii
EDDEYYEDDYEEIRL

SEQ ID NO: 124767 - protein, 15 aa, Borrelia garinii
DDEYYEDDYEEIRLS

SEQ ID NO: 124768 - protein, 15 aa, Borrelia garinii
DEYYEDDYEEIRLSN

SEQ ID NO: 124769 - protein, 15 aa, Borrelia garinii
EYYEDDYEEIRLSNR

SEQ ID NO: 124770 - protein, 15 aa, Borrelia garinii
YYEDDYEEIRLSNRY

SEQ ID NO: 124771 - protein, 15 aa, Borrelia garinii
YEDDYEEIRLSNRYQ

SEQ ID NO: 124772 - protein, 15 aa, Borrelia garinii
EDDYEEIRLSNRYQS

SEQ ID NO: 124773 - protein, 15 aa, Borrelia garinii
DDYEEIRLSNRYQSY

SEQ ID NO: 124774 - protein, 15 aa, Borrelia garinii
DYEEIRLSNRYQSYL

SEQ ID NO: 124775 - protein, 15 aa, Borrelia garinii
YEEIRLSNRYQSYLE

SEQ ID NO: 124776 - protein, 15 aa, Borrelia garinii
EEIRLSNRYQSYLEG

SEQ ID NO: 124777 - protein, 15 aa, Borrelia garinii
EIRLSNRYQSYLEGV

SEQ ID NO: 124778 - protein, 15 aa, Borrelia garinii
IRLSNRYQSYLEGVK

SEQ ID NO: 124779 - protein, 15 aa, Borrelia garinii
RLSNRYQSYLEGVKY

SEQ ID NO: 124780 - protein, 15 aa, Borrelia garinii
LSNRYQSYLEGVKYN

SEQ ID NO: 124781 - protein, 15 aa, Borrelia garinii
SNRYQSYLEGVKYNV

SEQ ID NO: 124782 - protein, 15 aa, Borrelia garinii
NRYQSYLEGVKYNVD

SEQ ID NO: 124783 - protein, 15 aa, Borrelia garinii
RYQSYLEGVKYNVDS

SEQ ID NO: 124784 - protein, 15 aa, Borrelia garinii
YQSYLEGVKYNVDSA

SEQ ID NO: 124785 - protein, 15 aa, Borrelia garinii
QSYLEGVKYNVDSAI

SEQ ID NO: 124786 - protein, 15 aa, Borrelia garinii
SYLEGVKYNVDSAIN

SEQ ID NO: 124787 - protein, 15 aa, Borrelia garinii
YLEGVKYNVDSAINT

SEQ ID NO: 124788 - protein, 15 aa, Borrelia garinii
LEGVKYNVDSAINTI

SEQ ID NO: 124789 - protein, 15 aa, Borrelia garinii
EGVKYNVDSAINTIN

SEQ ID NO: 124790 - protein, 15 aa, Borrelia garinii
GVKYNVDSAINTINK

SEQ ID NO: 124791 - protein, 15 aa, Borrelia garinii
VKYNVDSAINTINKI

SEQ ID NO: 124792 - protein, 15 aa, Borrelia garinii
KYNVDSAINTINKIY

SEQ ID NO: 124793 - protein, 15 aa, Borrelia garinii
YNVDSAINTINKIYD

SEQ ID NO: 124794 - protein, 15 aa, Borrelia garinii
NVDSAINTINKIYDT

SEQ ID NO: 124795 - protein, 15 aa, Borrelia garinii
VDSAINTINKIYDTY

SEQ ID NO: 124796 - protein, 15 aa, Borrelia garinii
DSAINTINKIYDTYT

SEQ ID NO: 124797 - protein, 15 aa, Borrelia garinii
SAINTINKIYDTYTL

SEQ ID NO: 124798 - protein, 15 aa, Borrelia garinii
AINTINKIYDTYTLF

SEQ ID NO: 124799 - protein, 15 aa, Borrelia garinii
INTINKIYDTYTLFS

SEQ ID NO: 124800 - protein, 15 aa, Borrelia garinii
NTINKIYDTYTLFST

SEQ ID NO: 124801 - protein, 15 aa, Borrelia garinii
TINKIYDTYTLFSTK

SEQ ID NO: 124802 - protein, 15 aa, Borrelia garinii
INKIYDTYTLFSTKL

SEQ ID NO: 124803 - protein, 15 aa, Borrelia garinii
NKIYDTYTLFSTKLT

SEQ ID NO: 124804 - protein, 15 aa, Borrelia garinii
KIYDTYTLFSTKLTQ

SEQ ID NO: 124805 - protein, 15 aa, Borrelia garinii
IYDTYTLFSTKLTQM

SEQ ID NO: 124806 - protein, 15 aa, Borrelia garinii
YDTYTLFSTKLTQMY

SEQ ID NO: 124807 - protein, 15 aa, Borrelia garinii
DTYTLFSTKLTQMYS

SEQ ID NO: 124808 - protein, 15 aa, Borrelia garinii
TYTLFSTKLTQMYST

SEQ ID NO: 124809 - protein, 15 aa, Borrelia garinii
YTLFSTKLTQMYSTR

SEQ ID NO: 124810 - protein, 15 aa, Borrelia garinii
TLFSTKLTQMYSTRL

SEQ ID NO: 124811 - protein, 15 aa, Borrelia garinii
LFSTKLTQMYSTRLD

SEQ ID NO: 124812 - protein, 15 aa, Borrelia garinii
FSTKLTQMYSTRLDN

SEQ ID NO: 124813 - protein, 15 aa, Borrelia garinii
STKLTQMYSTRLDNL

SEQ ID NO: 124814 - protein, 15 aa, Borrelia garinii
TKLTQMYSTRLDNLA

SEQ ID NO: 124815 - protein, 15 aa, Borrelia garinii
KLTQMYSTRLDNLAK

SEQ ID NO: 124816 - protein, 15 aa, Borrelia garinii
LTQMYSTRLDNLAKA

SEQ ID NO: 124817 - protein, 15 aa, Borrelia garinii
TQMYSTRLDNLAKAK

SEQ ID NO: 124818 - protein, 15 aa, Borrelia garinii
QMYSTRLDNLAKAKA

SEQ ID NO: 124819 - protein, 15 aa, Borrelia garinii
MYSTRLDNLAKAKAK

SEQ ID NO: 124820 - protein, 15 aa, Borrelia garinii
YSTRLDNLAKAKAKE

SEQ ID NO: 124821 - protein, 15 aa, Borrelia garinii
STRLDNLAKAKAKEE

SEQ ID NO: 124822 - protein, 15 aa, Borrelia garinii
TRLDNLAKAKAKEEA

SEQ ID NO: 124823 - protein, 15 aa, Borrelia garinii
RLDNLAKAKAKEEAA

SEQ ID NO: 124824 - protein, 15 aa, Borrelia garinii
LDNLAKAKAKEEAAK

SEQ ID NO: 124825 - protein, 15 aa, Borrelia garinii
DNLAKAKAKEEAAKF

SEQ ID NO: 124826 - protein, 15 aa, Borrelia garinii
NLAKAKAKEEAAKFT

SEQ ID NO: 124827 - protein, 15 aa, Borrelia garinii
LAKAKAKEEAAKFTK

SEQ ID NO: 124828 - protein, 15 aa, Borrelia garinii
AKAKAKEEAAKFTKE

SEQ ID NO: 124829 - protein, 15 aa, Borrelia garinii
KAKAKEEAAKFTKED

SEQ ID NO: 124830 - protein, 15 aa, Borrelia garinii
AKAKEEAAKFTKEDL

SEQ ID NO: 124831 - protein, 15 aa, Borrelia garinii
KAKEEAAKFTKEDLE

SEQ ID NO: 124832 - protein, 15 aa, Borrelia garinii
AKEEAAKFTKEDLEK

SEQ ID NO: 124833 - protein, 15 aa, Borrelia garinii
KEEAAKFTKEDLEKN

SEQ ID NO: 124834 - protein, 15 aa, Borrelia garinii
EEAAKFTKEDLEKNF

SEQ ID NO: 124835 - protein, 15 aa, Borrelia garinii
EAAKFTKEDLEKNFK

SEQ ID NO: 124836 - protein, 15 aa, Borrelia garinii
AAKFTKEDLEKNFKT

SEQ ID NO: 124837 - protein, 15 aa, Borrelia garinii
AKFTKEDLEKNFKTL

SEQ ID NO: 124838 - protein, 15 aa, Borrelia garinii
KFTKEDLEKNFKTLL

SEQ ID NO: 124839 - protein, 15 aa, Borrelia garinii
FTKEDLEKNFKTLLN

SEQ ID NO: 124840 - protein, 15 aa, Borrelia garinii
TKEDLEKNFKTLLNY

SEQ ID NO: 124841 - protein, 15 aa, Borrelia garinii
KEDLEKNFKTLLNYI

SEQ ID NO: 124842 - protein, 15 aa, Borrelia garinii
EDLEKNFKTLLNYIQ

SEQ ID NO: 124843 - protein, 15 aa, Borrelia garinii
DLEKNFKTLLNYIQV

SEQ ID NO: 124844 - protein, 15 aa, Borrelia garinii
LEKNFKTLLNYIQVS

SEQ ID NO: 124845 - protein, 15 aa, Borrelia garinii
EKNFKTLLNYIQVSV

SEQ ID NO: 124846 - protein, 15 aa, Borrelia garinii
KNFKTLLNYIQVSVK

SEQ ID NO: 124847 - protein, 15 aa, Borrelia garinii
NFKTLLNYIQVSVKT

SEQ ID NO: 124848 - protein, 15 aa, Borrelia garinii
FKTLLNYIQVSVKTA

SEQ ID NO: 124849 - protein, 15 aa, Borrelia garinii
KTLLNYIQVSVKTAT

SEQ ID NO: 124850 - protein, 15 aa, Borrelia garinii
TLLNYIQVSVKTATN

SEQ ID NO: 124851 - protein, 15 aa, Borrelia garinii
LLNYIQVSVKTATNF

SEQ ID NO: 124852 - protein, 15 aa, Borrelia garinii
LNYIQVSVKTATNFV

SEQ ID NO: 124853 - protein, 15 aa, Borrelia garinii
NYIQVSVKTATNFVY

SEQ ID NO: 124854 - protein, 15 aa, Borrelia garinii
YIQVSVKTATNFVYI

SEQ ID NO: 124855 - protein, 15 aa, Borrelia garinii
IQVSVKTATNFVYIN

SEQ ID NO: 124856 - protein, 15 aa, Borrelia garinii
QVSVKTATNFVYINE

SEQ ID NO: 124857 - protein, 15 aa, Borrelia garinii
VSVKTATNFVYINEM

SEQ ID NO: 124858 - protein, 15 aa, Borrelia garinii
SVKTATNFVYINEMH

SEQ ID NO: 124859 - protein, 15 aa, Borrelia garinii
VKTATNFVYINEMHA

SEQ ID NO: 124860 - protein, 15 aa, Borrelia garinii
KTATNFVYINEMHAK

SEQ ID NO: 124861 - protein, 15 aa, Borrelia garinii
TATNFVYINEMHAKR

SEQ ID NO: 124862 - protein, 15 aa, Borrelia garinii
ATNFVYINEMHAKRK

SEQ ID NO: 124863 - protein, 15 aa, Borrelia garinii
TNFVYINEMHAKRKL

SEQ ID NO: 124864 - protein, 15 aa, Borrelia garinii
NFVYINEMHAKRKLE

SEQ ID NO: 124865 - protein, 15 aa, Borrelia garinii
FVYINEMHAKRKLEN

SEQ ID NO: 124866 - protein, 15 aa, Borrelia garinii
VYINEMHAKRKLENI

SEQ ID NO: 124867 - protein, 15 aa, Borrelia garinii
YINEMHAKRKLENIE

SEQ ID NO: 124868 - protein, 15 aa, Borrelia garinii
INEMHAKRKLENIEA

SEQ ID NO: 124869 - protein, 15 aa, Borrelia garinii
NEMHAKRKLENIEAK

SEQ ID NO: 124870 - protein, 15 aa, Borrelia garinii
EMHAKRKLENIEAKI

SEQ ID NO: 124871 - protein, 15 aa, Borrelia garinii
MHAKRKLENIEAKIK

SEQ ID NO: 124872 - protein, 15 aa, Borrelia garinii
HAKRKLENIEAKIKT

SEQ ID NO: 124873 - protein, 15 aa, Borrelia garinii
AKRKLENIEAKIKTL

SEQ ID NO: 124874 - protein, 15 aa, Borrelia garinii
KRKLENIEAKIKTLI

SEQ ID NO: 124875 - protein, 15 aa, Borrelia garinii
RKLENIEAKIKTLIA

SEQ ID NO: 124876 - protein, 15 aa, Borrelia garinii
KLENIEAKIKTLIAK

SEQ ID NO: 124877 - protein, 15 aa, Borrelia garinii
LENIEAKIKTLIAKI

SEQ ID NO: 124878 - protein, 15 aa, Borrelia garinii
ENIEAKIKTLIAKIK

SEQ ID NO: 124879 - protein, 15 aa, Borrelia garinii
NIEAKIKTLIAKIKE

SEQ ID NO: 124880 - protein, 15 aa, Borrelia garinii
IEAKIKTLIAKIKEK

SEQ ID NO: 124881 - protein, 15 aa, Borrelia garinii
EAKIKTLIAKIKEKS

SEQ ID NO: 124882 - protein, 15 aa, Borrelia garinii
AKIKTLIAKIKEKSN

SEQ ID NO: 124883 - protein, 15 aa, Borrelia garinii
KIKTLIAKIKEKSNL

SEQ ID NO: 124884 - protein, 15 aa, Borrelia garinii
IKTLIAKIKEKSNLY

SEQ ID NO: 124885 - protein, 15 aa, Borrelia garinii
KTLIAKIKEKSNLYS

SEQ ID NO: 124886 - protein, 15 aa, Borrelia garinii
TLIAKIKEKSNLYSA

SEQ ID NO: 124887 - protein, 15 aa, Borrelia garinii
LIAKIKEKSNLYSAY

SEQ ID NO: 124888 - protein, 15 aa, Borrelia garinii
IAKIKEKSNLYSAYK

SEQ ID NO: 124889 - protein, 15 aa, Borrelia garinii
AKIKEKSNLYSAYKA

SEQ ID NO: 124890 - protein, 15 aa, Borrelia garinii
KIKEKSNLYSAYKAI

SEQ ID NO: 124891 - protein, 15 aa, Borrelia garinii
IKEKSNLYSAYKAIV

SEQ ID NO: 124892 - protein, 15 aa, Borrelia garinii
KEKSNLYSAYKAIVS

SEQ ID NO: 124893 - protein, 15 aa, Borrelia garinii
EKSNLYSAYKAIVSS

SEQ ID NO: 124894 - protein, 15 aa, Borrelia garinii
KSNLYSAYKAIVSSI

SEQ ID NO: 124895 - protein, 15 aa, Borrelia garinii
SNLYSAYKAIVSSIL

SEQ ID NO: 124896 - protein, 15 aa, Borrelia garinii
NLYSAYKAIVSSILL

SEQ ID NO: 124897 - protein, 15 aa, Borrelia garinii
LYSAYKAIVSSILLM

SEQ ID NO: 124898 - protein, 15 aa, Borrelia garinii
YSAYKAIVSSILLMR

SEQ ID NO: 124899 - protein, 15 aa, Borrelia garinii
SAYKAIVSSILLMRD

SEQ ID NO: 124900 - protein, 15 aa, Borrelia garinii
AYKAIVSSILLMRDS

SEQ ID NO: 124901 - protein, 15 aa, Borrelia garinii
YKAIVSSILLMRDSL

SEQ ID NO: 124902 - protein, 15 aa, Borrelia garinii
KAIVSSILLMRDSLK

SEQ ID NO: 124903 - protein, 15 aa, Borrelia garinii
AIVSSILLMRDSLKE

SEQ ID NO: 124904 - protein, 15 aa, Borrelia garinii
IVSSILLMRDSLKEV

SEQ ID NO: 124905 - protein, 15 aa, Borrelia garinii
VSSILLMRDSLKEVQ

SEQ ID NO: 124906 - protein, 15 aa, Borrelia garinii
SSILLMRDSLKEVQY

SEQ ID NO: 124907 - protein, 15 aa, Borrelia garinii
SILLMRDSLKEVQYA

SEQ ID NO: 124908 - protein, 15 aa, Borrelia garinii
ILLMRDSLKEVQYAI

SEQ ID NO: 124909 - protein, 15 aa, Borrelia garinii
LLMRDSLKEVQYAID

SEQ ID NO: 124910 - protein, 15 aa, Borrelia garinii
LMRDSLKEVQYAIDK

SEQ ID NO: 124911 - protein, 15 aa, Borrelia garinii
MRDSLKEVQYAIDKN

SEQ ID NO: 124912 - protein, 15 aa, Borrelia garinii
RDSLKEVQYAIDKNG

SEQ ID NO: 124913 - protein, 15 aa, Borrelia garinii
DSLKEVQYAIDKNGI

SEQ ID NO: 124914 - protein, 15 aa, Borrelia garinii
SLKEVQYAIDKNGIW

SEQ ID NO: 124915 - protein, 15 aa, Borrelia garinii
LKEVQYAIDKNGIWY

SEQ ID NO: 124916 - protein, 15 aa, Borrelia garinii
KEVQYAIDKNGIWYR

SEQ ID NO: 124917 - protein, 15 aa, Borrelia garinii
EVQYAIDKNGIWYRK

SEQ ID NO: 124918 - protein, 15 aa, Borrelia garinii
VQYAIDKNGIWYRKL

SEQ ID NO: 124919 - protein, 15 aa, Borrelia garinii
QYAIDKNGIWYRKLD

SEQ ID NO: 124920 - protein, 15 aa, Borrelia garinii
YAIDKNGIWYRKLDA

SEQ ID NO: 124921 - protein, 15 aa, Borrelia garinii
AIDKNGIWYRKLDAI

SEQ ID NO: 124922 - protein, 15 aa, Borrelia garinii
IDKNGIWYRKLDAIE

SEQ ID NO: 124923 - protein, 15 aa, Borrelia garinii
DKNGIWYRKLDAIET

SEQ ID NO: 124924 - protein, 15 aa, Borrelia garinii
KNGIWYRKLDAIETE

SEQ ID NO: 124925 - protein, 15 aa, Borrelia garinii
NGIWYRKLDAIETEI

SEQ ID NO: 124926 - protein, 15 aa, Borrelia garinii
GIWYRKLDAIETEIK

SEQ ID NO: 124927 - protein, 15 aa, Borrelia garinii
IWYRKLDAIETEIKN

SEQ ID NO: 124928 - protein, 15 aa, Borrelia garinii
WYRKLDAIETEIKNL

SEQ ID NO: 124929 - protein, 15 aa, Borrelia garinii
YRKLDAIETEIKNLI

SEQ ID NO: 124930 - protein, 15 aa, Borrelia garinii
RKLDAIETEIKNLIL

SEQ ID NO: 124931 - protein, 15 aa, Borrelia garinii
KLDAIETEIKNLILK

SEQ ID NO: 124932 - protein, 15 aa, Borrelia garinii
LDAIETEIKNLILKI

SEQ ID NO: 124933 - protein, 15 aa, Borrelia garinii
DAIETEIKNLILKIK

SEQ ID NO: 124934 - protein, 15 aa, Borrelia garinii
AIETEIKNLILKIKG

SEQ ID NO: 124935 - protein, 15 aa, Borrelia garinii
IETEIKNLILKIKGQ

SEQ ID NO: 124936 - protein, 15 aa, Borrelia garinii
ETEIKNLILKIKGQS

SEQ ID NO: 124937 - protein, 15 aa, Borrelia garinii
TEIKNLILKIKGQSD

SEQ ID NO: 124938 - protein, 15 aa, Borrelia garinii
EIKNLILKIKGQSDL

SEQ ID NO: 124939 - protein, 15 aa, Borrelia garinii
IKNLILKIKGQSDLY

SEQ ID NO: 124940 - protein, 15 aa, Borrelia garinii
KNLILKIKGQSDLYE

SEQ ID NO: 124941 - protein, 15 aa, Borrelia garinii
NLILKIKGQSDLYEA

SEQ ID NO: 124942 - protein, 15 aa, Borrelia garinii
LILKIKGQSDLYEAY

SEQ ID NO: 124943 - protein, 15 aa, Borrelia garinii
ILKIKGQSDLYEAYK

SEQ ID NO: 124944 - protein, 15 aa, Borrelia garinii
LKIKGQSDLYEAYKA

SEQ ID NO: 124945 - protein, 15 aa, Borrelia garinii
KIKGQSDLYEAYKAI

SEQ ID NO: 124946 - protein, 15 aa, Borrelia garinii
IKGQSDLYEAYKAIV

SEQ ID NO: 124947 - protein, 15 aa, Borrelia garinii
KGQSDLYEAYKAIVR

SEQ ID NO: 124948 - protein, 15 aa, Borrelia garinii
GQSDLYEAYKAIVRS

SEQ ID NO: 124949 - protein, 15 aa, Borrelia garinii
QSDLYEAYKAIVRSI

SEQ ID NO: 124950 - protein, 15 aa, Borrelia garinii
SDLYEAYKAIVRSIL

SEQ ID NO: 124951 - protein, 15 aa, Borrelia garinii
DLYEAYKAIVRSILL

SEQ ID NO: 124952 - protein, 15 aa, Borrelia garinii
LYEAYKAIVRSILLM

SEQ ID NO: 124953 - protein, 15 aa, Borrelia garinii
YEAYKAIVRSILLMK

SEQ ID NO: 124954 - protein, 15 aa, Borrelia garinii
EAYKAIVRSILLMKD

SEQ ID NO: 124955 - protein, 15 aa, Borrelia garinii
AYKAIVRSILLMKDS

SEQ ID NO: 124956 - protein, 15 aa, Borrelia garinii
YKAIVRSILLMKDSL

SEQ ID NO: 124957 - protein, 15 aa, Borrelia garinii
KAIVRSILLMKDSLK

SEQ ID NO: 124958 - protein, 15 aa, Borrelia garinii
AIVRSILLMKDSLKI

SEQ ID NO: 124959 - protein, 15 aa, Borrelia garinii
IVRSILLMKDSLKII

SEQ ID NO: 124960 - protein, 15 aa, Borrelia garinii
VRSILLMKDSLKIIE

SEQ ID NO: 124961 - protein, 15 aa, Borrelia garinii
RSILLMKDSLKIIEI

SEQ ID NO: 124962 - protein, 15 aa, Borrelia garinii
SILLMKDSLKIIEIV

SEQ ID NO: 124963 - protein, 15 aa, Borrelia garinii
ILLMKDSLKIIEIVI

SEQ ID NO: 124964 - protein, 15 aa, Borrelia garinii
LLMKDSLKIIEIVID

SEQ ID NO: 124965 - protein, 15 aa, Borrelia garinii
LMKDSLKIIEIVIDK

SEQ ID NO: 124966 - protein, 15 aa, Borrelia garinii
MKDSLKIIEIVIDKN

SEQ ID NO: 124967 - protein, 15 aa, Borrelia garinii
KDSLKIIEIVIDKNG

SEQ ID NO: 124968 - protein, 15 aa, Borrelia garinii
DSLKIIEIVIDKNGV

SEQ ID NO: 124969 - protein, 15 aa, Borrelia garinii
SLKIIEIVIDKNGVW

SEQ ID NO: 124970 - protein, 15 aa, Borrelia garinii
LKIIEIVIDKNGVWY

SEQ ID NO: 124971 - protein, 16 aa, Borrelia garinii
MKKVKSKYLALGLLFG

SEQ ID NO: 124972 - protein, 16 aa, Borrelia garinii
KKVKSKYLALGLLFGF

SEQ ID NO: 124973 - protein, 16 aa, Borrelia garinii
KVKSKYLALGLLFGFI

SEQ ID NO: 124974 - protein, 16 aa, Borrelia garinii
VKSKYLALGLLFGFIS

SEQ ID NO: 124975 - protein, 16 aa, Borrelia garinii
KSKYLALGLLFGFISC

SEQ ID NO: 124976 - protein, 16 aa, Borrelia garinii
SKYLALGLLFGFISCD

SEQ ID NO: 124977 - protein, 16 aa, Borrelia garinii
KYLALGLLFGFISCDL

SEQ ID NO: 124978 - protein, 16 aa, Borrelia garinii
YLALGLLFGFISCDLF

SEQ ID NO: 124979 - protein, 16 aa, Borrelia garinii
LALGLLFGFISCDLFI

SEQ ID NO: 124980 - protein, 16 aa, Borrelia garinii
ALGLLFGFISCDLFIR

SEQ ID NO: 124981 - protein, 16 aa, Borrelia garinii
LGLLFGFISCDLFIRY

SEQ ID NO: 124982 - protein, 16 aa, Borrelia garinii
GLLFGFISCDLFIRYE

SEQ ID NO: 124983 - protein, 16 aa, Borrelia garinii
LLFGFISCDLFIRYEM

SEQ ID NO: 124984 - protein, 16 aa, Borrelia garinii
LFGFISCDLFIRYEMK

SEQ ID NO: 124985 - protein, 16 aa, Borrelia garinii
FGFISCDLFIRYEMKE

SEQ ID NO: 124986 - protein, 16 aa, Borrelia garinii
GFISCDLFIRYEMKEE

SEQ ID NO: 124987 - protein, 16 aa, Borrelia garinii
FISCDLFIRYEMKEES

SEQ ID NO: 124988 - protein, 16 aa, Borrelia garinii
ISCDLFIRYEMKEESP

SEQ ID NO: 124989 - protein, 16 aa, Borrelia garinii
SCDLFIRYEMKEESPG

SEQ ID NO: 124990 - protein, 16 aa, Borrelia garinii
CDLFIRYEMKEESPGL

SEQ ID NO: 124991 - protein, 16 aa, Borrelia garinii
DLFIRYEMKEESPGLF

SEQ ID NO: 124992 - protein, 16 aa, Borrelia garinii
LFIRYEMKEESPGLFD

SEQ ID NO: 124993 - protein, 16 aa, Borrelia garinii
FIRYEMKEESPGLFDK

SEQ ID NO: 124994 - protein, 16 aa, Borrelia garinii
IRYEMKEESPGLFDKG

SEQ ID NO: 124995 - protein, 16 aa, Borrelia garinii
RYEMKEESPGLFDKGN

SEQ ID NO: 124996 - protein, 16 aa, Borrelia garinii
YEMKEESPGLFDKGNS

SEQ ID NO: 124997 - protein, 16 aa, Borrelia garinii
EMKEESPGLFDKGNSI

SEQ ID NO: 124998 - protein, 16 aa, Borrelia garinii
MKEESPGLFDKGNSIL

SEQ ID NO: 124999 - protein, 16 aa, Borrelia garinii
KEESPGLFDKGNSILE

SEQ ID NO: 125000 - protein, 16 aa, Borrelia garinii
EESPGLFDKGNSILET

SEQ ID NO: 125001 - protein, 16 aa, Borrelia garinii
ESPGLFDKGNSILETS

SEQ ID NO: 125002 - protein, 16 aa, Borrelia garinii
SPGLFDKGNSILETSE

SEQ ID NO: 125003 - protein, 16 aa, Borrelia garinii
PGLFDKGNSILETSEE

SEQ ID NO: 125004 - protein, 16 aa, Borrelia garinii
GLFDKGNSILETSEES

SEQ ID NO: 125005 - protein, 16 aa, Borrelia garinii
LFDKGNSILETSEESI

SEQ ID NO: 125006 - protein, 16 aa, Borrelia garinii
FDKGNSILETSEESIK

SEQ ID NO: 125007 - protein, 16 aa, Borrelia garinii
DKGNSILETSEESIKK

SEQ ID NO: 125008 - protein, 16 aa, Borrelia garinii
KGNSILETSEESIKKP

SEQ ID NO: 125009 - protein, 16 aa, Borrelia garinii
GNSILETSEESIKKPM

SEQ ID NO: 125010 - protein, 16 aa, Borrelia garinii
NSILETSEESIKKPMN

SEQ ID NO: 125011 - protein, 16 aa, Borrelia garinii
SILETSEESIKKPMNK

SEQ ID NO: 125012 - protein, 16 aa, Borrelia garinii
ILETSEESIKKPMNKK

SEQ ID NO: 125013 - protein, 16 aa, Borrelia garinii
LETSEESIKKPMNKKG

SEQ ID NO: 125014 - protein, 16 aa, Borrelia garinii
ETSEESIKKPMNKKGK

SEQ ID NO: 125015 - protein, 16 aa, Borrelia garinii
TSEESIKKPMNKKGKG

SEQ ID NO: 125016 - protein, 16 aa, Borrelia garinii
SEESIKKPMNKKGKGK

SEQ ID NO: 125017 - protein, 16 aa, Borrelia garinii
EESIKKPMNKKGKGKI

SEQ ID NO: 125018 - protein, 16 aa, Borrelia garinii
ESIKKPMNKKGKGKIA

SEQ ID NO: 125019 - protein, 16 aa, Borrelia garinii
SIKKPMNKKGKGKIAR

SEQ ID NO: 125020 - protein, 16 aa, Borrelia garinii
IKKPMNKKGKGKIARK

SEQ ID NO: 125021 - protein, 16 aa, Borrelia garinii
KKPMNKKGKGKIARKN

SEQ ID NO: 125022 - protein, 16 aa, Borrelia garinii
KPMNKKGKGKIARKNG

SEQ ID NO: 125023 - protein, 16 aa, Borrelia garinii
PMNKKGKGKIARKNGK

SEQ ID NO: 125024 - protein, 16 aa, Borrelia garinii
MNKKGKGKIARKNGKS

SEQ ID NO: 125025 - protein, 16 aa, Borrelia garinii
NKKGKGKIARKNGKSK

SEQ ID NO: 125026 - protein, 16 aa, Borrelia garinii
KKGKGKIARKNGKSKV

SEQ ID NO: 125027 - protein, 16 aa, Borrelia garinii
KGKGKIARKNGKSKVS

SEQ ID NO: 125028 - protein, 16 aa, Borrelia garinii
GKGKIARKNGKSKVSG

SEQ ID NO: 125029 - protein, 16 aa, Borrelia garinii
KGKIARKNGKSKVSGK

SEQ ID NO: 125030 - protein, 16 aa, Borrelia garinii
GKIARKNGKSKVSGKE

SEQ ID NO: 125031 - protein, 16 aa, Borrelia garinii
KIARKNGKSKVSGKEP

SEQ ID NO: 125032 - protein, 16 aa, Borrelia garinii
IARKNGKSKVSGKEPF

SEQ ID NO: 125033 - protein, 16 aa, Borrelia garinii
ARKNGKSKVSGKEPFI

SEQ ID NO: 125034 - protein, 16 aa, Borrelia garinii
RKNGKSKVSGKEPFIH

SEQ ID NO: 125035 - protein, 16 aa, Borrelia garinii
KNGKSKVSGKEPFIHS

SEQ ID NO: 125036 - protein, 16 aa, Borrelia garinii
NGKSKVSGKEPFIHSF

SEQ ID NO: 125037 - protein, 16 aa, Borrelia garinii
GKSKVSGKEPFIHSFK

SEQ ID NO: 125038 - protein, 16 aa, Borrelia garinii
KSKVSGKEPFIHSFKR

SEQ ID NO: 125039 - protein, 16 aa, Borrelia garinii
SKVSGKEPFIHSFKRD

SEQ ID NO: 125040 - protein, 16 aa, Borrelia garinii
KVSGKEPFIHSFKRDA

SEQ ID NO: 125041 - protein, 16 aa, Borrelia garinii
VSGKEPFIHSFKRDAA

SEQ ID NO: 125042 - protein, 16 aa, Borrelia garinii
SGKEPFIHSFKRDAAN

SEQ ID NO: 125043 - protein, 16 aa, Borrelia garinii
GKEPFIHSFKRDAANK

SEQ ID NO: 125044 - protein, 16 aa, Borrelia garinii
KEPFIHSFKRDAANKS

SEQ ID NO: 125045 - protein, 16 aa, Borrelia garinii
EPFIHSFKRDAANKSN

SEQ ID NO: 125046 - protein, 16 aa, Borrelia garinii
PFIHSFKRDAANKSNF

SEQ ID NO: 125047 - protein, 16 aa, Borrelia garinii
FIHSFKRDAANKSNFL

SEQ ID NO: 125048 - protein, 16 aa, Borrelia garinii
IHSFKRDAANKSNFLQ

SEQ ID NO: 125049 - protein, 16 aa, Borrelia garinii
HSFKRDAANKSNFLQK

SEQ ID NO: 125050 - protein, 16 aa, Borrelia garinii
SFKRDAANKSNFLQKN

SEQ ID NO: 125051 - protein, 16 aa, Borrelia garinii
FKRDAANKSNFLQKNV

SEQ ID NO: 125052 - protein, 16 aa, Borrelia garinii
KRDAANKSNFLQKNVM

SEQ ID NO: 125053 - protein, 16 aa, Borrelia garinii
RDAANKSNFLQKNVML

SEQ ID NO: 125054 - protein, 16 aa, Borrelia garinii
DAANKSNFLQKNVMLE

SEQ ID NO: 125055 - protein, 16 aa, Borrelia garinii
AANKSNFLQKNVMLEE

SEQ ID NO: 125056 - protein, 16 aa, Borrelia garinii
ANKSNFLQKNVMLEEE

SEQ ID NO: 125057 - protein, 16 aa, Borrelia garinii
NKSNFLQKNVMLEEES

SEQ ID NO: 125058 - protein, 16 aa, Borrelia garinii
KSNFLQKNVMLEEESL

SEQ ID NO: 125059 - protein, 16 aa, Borrelia garinii
SNFLQKNVMLEEESLK

SEQ ID NO: 125060 - protein, 16 aa, Borrelia garinii
NFLQKNVMLEEESLKT

SEQ ID NO: 125061 - protein, 16 aa, Borrelia garinii
FLQKNVMLEEESLKTE

SEQ ID NO: 125062 - protein, 16 aa, Borrelia garinii
LQKNVMLEEESLKTEL

SEQ ID NO: 125063 - protein, 16 aa, Borrelia garinii
QKNVMLEEESLKTELL

SEQ ID NO: 125064 - protein, 16 aa, Borrelia garinii
KNVMLEEESLKTELLK

SEQ ID NO: 125065 - protein, 16 aa, Borrelia garinii
NVMLEEESLKTELLKE

SEQ ID NO: 125066 - protein, 16 aa, Borrelia garinii
VMLEEESLKTELLKEQ

SEQ ID NO: 125067 - protein, 16 aa, Borrelia garinii
MLEEESLKTELLKEQS

SEQ ID NO: 125068 - protein, 16 aa, Borrelia garinii
LEEESLKTELLKEQSE

SEQ ID NO: 125069 - protein, 16 aa, Borrelia garinii
EEESLKTELLKEQSET

SEQ ID NO: 125070 - protein, 16 aa, Borrelia garinii
EESLKTELLKEQSETR

SEQ ID NO: 125071 - protein, 16 aa, Borrelia garinii
ESLKTELLKEQSETRK

SEQ ID NO: 125072 - protein, 16 aa, Borrelia garinii
SLKTELLKEQSETRKE

SEQ ID NO: 125073 - protein, 16 aa, Borrelia garinii
LKTELLKEQSETRKEK

SEQ ID NO: 125074 - protein, 16 aa, Borrelia garinii
KTELLKEQSETRKEKI

SEQ ID NO: 125075 - protein, 16 aa, Borrelia garinii
TELLKEQSETRKEKIQ

SEQ ID NO: 125076 - protein, 16 aa, Borrelia garinii
ELLKEQSETRKEKIQK

SEQ ID NO: 125077 - protein, 16 aa, Borrelia garinii
LLKEQSETRKEKIQKQ

SEQ ID NO: 125078 - protein, 16 aa, Borrelia garinii
LKEQSETRKEKIQKQQ

SEQ ID NO: 125079 - protein, 16 aa, Borrelia garinii
KEQSETRKEKIQKQQD

SEQ ID NO: 125080 - protein, 16 aa, Borrelia garinii
EQSETRKEKIQKQQDE

SEQ ID NO: 125081 - protein, 16 aa, Borrelia garinii
QSETRKEKIQKQQDEY

SEQ ID NO: 125082 - protein, 16 aa, Borrelia garinii
SETRKEKIQKQQDEYK

SEQ ID NO: 125083 - protein, 16 aa, Borrelia garinii
ETRKEKIQKQQDEYKG

SEQ ID NO: 125084 - protein, 16 aa, Borrelia garinii
TRKEKIQKQQDEYKGM

SEQ ID NO: 125085 - protein, 16 aa, Borrelia garinii
RKEKIQKQQDEYKGMT

SEQ ID NO: 125086 - protein, 16 aa, Borrelia garinii
KEKIQKQQDEYKGMTK

SEQ ID NO: 125087 - protein, 16 aa, Borrelia garinii
EKIQKQQDEYKGMTKG

SEQ ID NO: 125088 - protein, 16 aa, Borrelia garinii
KIQKQQDEYKGMTKGS

SEQ ID NO: 125089 - protein, 16 aa, Borrelia garinii
IQKQQDEYKGMTKGSL

SEQ ID NO: 125090 - protein, 16 aa, Borrelia garinii
QKQQDEYKGMTKGSLN

SEQ ID NO: 125091 - protein, 16 aa, Borrelia garinii
KQQDEYKGMTKGSLNS

SEQ ID NO: 125092 - protein, 16 aa, Borrelia garinii
QQDEYKGMTKGSLNSL

SEQ ID NO: 125093 - protein, 16 aa, Borrelia garinii
QDEYKGMTKGSLNSLS

SEQ ID NO: 125094 - protein, 16 aa, Borrelia garinii
DEYKGMTKGSLNSLSG

SEQ ID NO: 125095 - protein, 16 aa, Borrelia garinii
EYKGMTKGSLNSLSGE

SEQ ID NO: 125096 - protein, 16 aa, Borrelia garinii
YKGMTKGSLNSLSGES

SEQ ID NO: 125097 - protein, 16 aa, Borrelia garinii
KGMTKGSLNSLSGESG

SEQ ID NO: 125098 - protein, 16 aa, Borrelia garinii
GMTKGSLNSLSGESGE

SEQ ID NO: 125099 - protein, 16 aa, Borrelia garinii
MTKGSLNSLSGESGEL

SEQ ID NO: 125100 - protein, 16 aa, Borrelia garinii
TKGSLNSLSGESGELK

SEQ ID NO: 125101 - protein, 16 aa, Borrelia garinii
KGSLNSLSGESGELKE

SEQ ID NO: 125102 - protein, 16 aa, Borrelia garinii
GSLNSLSGESGELKET

SEQ ID NO: 125103 - protein, 16 aa, Borrelia garinii
SLNSLSGESGELKETI

SEQ ID NO: 125104 - protein, 16 aa, Borrelia garinii
LNSLSGESGELKETIE

SEQ ID NO: 125105 - protein, 16 aa, Borrelia garinii
NSLSGESGELKETIES

SEQ ID NO: 125106 - protein, 16 aa, Borrelia garinii
SLSGESGELKETIESN

SEQ ID NO: 125107 - protein, 16 aa, Borrelia garinii
LSGESGELKETIESNE

SEQ ID NO: 125108 - protein, 16 aa, Borrelia garinii
SGESGELKETIESNEI

SEQ ID NO: 125109 - protein, 16 aa, Borrelia garinii
GESGELKETIESNEID

SEQ ID NO: 125110 - protein, 16 aa, Borrelia garinii
ESGELKETIESNEIDI

SEQ ID NO: 125111 - protein, 16 aa, Borrelia garinii
SGELKETIESNEIDIT

SEQ ID NO: 125112 - protein, 16 aa, Borrelia garinii
GELKETIESNEIDITI

SEQ ID NO: 125113 - protein, 16 aa, Borrelia garinii
ELKETIESNEIDITID

SEQ ID NO: 125114 - protein, 16 aa, Borrelia garinii
LKETIESNEIDITIDS

SEQ ID NO: 125115 - protein, 16 aa, Borrelia garinii
KETIESNEIDITIDSD

SEQ ID NO: 125116 - protein, 16 aa, Borrelia garinii
ETIESNEIDITIDSDL

SEQ ID NO: 125117 - protein, 16 aa, Borrelia garinii
TIESNEIDITIDSDLR

SEQ ID NO: 125118 - protein, 16 aa, Borrelia garinii
IESNEIDITIDSDLRP

SEQ ID NO: 125119 - protein, 16 aa, Borrelia garinii
ESNEIDITIDSDLRPK

SEQ ID NO: 125120 - protein, 16 aa, Borrelia garinii
SNEIDITIDSDLRPKS

SEQ ID NO: 125121 - protein, 16 aa, Borrelia garinii
NEIDITIDSDLRPKSS

SEQ ID NO: 125122 - protein, 16 aa, Borrelia garinii
EIDITIDSDLRPKSSL

SEQ ID NO: 125123 - protein, 16 aa, Borrelia garinii
IDITIDSDLRPKSSLQ

SEQ ID NO: 125124 - protein, 16 aa, Borrelia garinii
DITIDSDLRPKSSLQD

SEQ ID NO: 125125 - protein, 16 aa, Borrelia garinii
ITIDSDLRPKSSLQDI

SEQ ID NO: 125126 - protein, 16 aa, Borrelia garinii
TIDSDLRPKSSLQDIA

SEQ ID NO: 125127 - protein, 16 aa, Borrelia garinii
IDSDLRPKSSLQDIAG

SEQ ID NO: 125128 - protein, 16 aa, Borrelia garinii
DSDLRPKSSLQDIAGS

SEQ ID NO: 125129 - protein, 16 aa, Borrelia garinii
SDLRPKSSLQDIAGSN

SEQ ID NO: 125130 - protein, 16 aa, Borrelia garinii
DLRPKSSLQDIAGSNS

SEQ ID NO: 125131 - protein, 16 aa, Borrelia garinii
LRPKSSLQDIAGSNSI

SEQ ID NO: 125132 - protein, 16 aa, Borrelia garinii
RPKSSLQDIAGSNSIS

SEQ ID NO: 125133 - protein, 16 aa, Borrelia garinii
PKSSLQDIAGSNSISY

SEQ ID NO: 125134 - protein, 16 aa, Borrelia garinii
KSSLQDIAGSNSISYT

SEQ ID NO: 125135 - protein, 16 aa, Borrelia garinii
SSLQDIAGSNSISYTD

SEQ ID NO: 125136 - protein, 16 aa, Borrelia garinii
SLQDIAGSNSISYTDE

SEQ ID NO: 125137 - protein, 16 aa, Borrelia garinii
LQDIAGSNSISYTDEI

SEQ ID NO: 125138 - protein, 16 aa, Borrelia garinii
QDIAGSNSISYTDEIE

SEQ ID NO: 125139 - protein, 16 aa, Borrelia garinii
DIAGSNSISYTDEIEE

SEQ ID NO: 125140 - protein, 16 aa, Borrelia garinii
IAGSNSISYTDEIEEE

SEQ ID NO: 125141 - protein, 16 aa, Borrelia garinii
AGSNSISYTDEIEEED

SEQ ID NO: 125142 - protein, 16 aa, Borrelia garinii
GSNSISYTDEIEEEDY

SEQ ID NO: 125143 - protein, 16 aa, Borrelia garinii
SNSISYTDEIEEEDYA

SEQ ID NO: 125144 - protein, 16 aa, Borrelia garinii
NSISYTDEIEEEDYAR

SEQ ID NO: 125145 - protein, 16 aa, Borrelia garinii
SISYTDEIEEEDYARY

SEQ ID NO: 125146 - protein, 16 aa, Borrelia garinii
ISYTDEIEEEDYARYY

SEQ ID NO: 125147 - protein, 16 aa, Borrelia garinii
SYTDEIEEEDYARYYL

SEQ ID NO: 125148 - protein, 16 aa, Borrelia garinii
YTDEIEEEDYARYYLD

SEQ ID NO: 125149 - protein, 16 aa, Borrelia garinii
TDEIEEEDYARYYLDE

SEQ ID NO: 125150 - protein, 16 aa, Borrelia garinii
DEIEEEDYARYYLDED

SEQ ID NO: 125151 - protein, 16 aa, Borrelia garinii
EIEEEDYARYYLDEDD

SEQ ID NO: 125152 - protein, 16 aa, Borrelia garinii
IEEEDYARYYLDEDDE

SEQ ID NO: 125153 - protein, 16 aa, Borrelia garinii
EEEDYARYYLDEDDED

SEQ ID NO: 125154 - protein, 16 aa, Borrelia garinii
EEDYARYYLDEDDEDD

SEQ ID NO: 125155 - protein, 16 aa, Borrelia garinii
EDYARYYLDEDDEDDE

SEQ ID NO: 125156 - protein, 16 aa, Borrelia garinii
DYARYYLDEDDEDDEY

SEQ ID NO: 125157 - protein, 16 aa, Borrelia garinii
YARYYLDEDDEDDEYY

SEQ ID NO: 125158 - protein, 16 aa, Borrelia garinii
ARYYLDEDDEDDEYYE

SEQ ID NO: 125159 - protein, 16 aa, Borrelia garinii
RYYLDEDDEDDEYYED

SEQ ID NO: 125160 - protein, 16 aa, Borrelia garinii
YYLDEDDEDDEYYEDD

SEQ ID NO: 125161 - protein, 16 aa, Borrelia garinii
YLDEDDEDDEYYEDDY

SEQ ID NO: 125162 - protein, 16 aa, Borrelia garinii
LDEDDEDDEYYEDDYE

SEQ ID NO: 125163 - protein, 16 aa, Borrelia garinii
DEDDEDDEYYEDDYEE

SEQ ID NO: 125164 - protein, 16 aa, Borrelia garinii
EDDEDDEYYEDDYEEI

SEQ ID NO: 125165 - protein, 16 aa, Borrelia garinii
DDEDDEYYEDDYEEIR

SEQ ID NO: 125166 - protein, 16 aa, Borrelia garinii
DEDDEYYEDDYEEIRL

SEQ ID NO: 125167 - protein, 16 aa, Borrelia garinii
EDDEYYEDDYEEIRLS

SEQ ID NO: 125168 - protein, 16 aa, Borrelia garinii
DDEYYEDDYEEIRLSN

SEQ ID NO: 125169 - protein, 16 aa, Borrelia garinii
DEYYEDDYEEIRLSNR

SEQ ID NO: 125170 - protein, 16 aa, Borrelia garinii
EYYEDDYEEIRLSNRY

SEQ ID NO: 125171 - protein, 16 aa, Borrelia garinii
YYEDDYEEIRLSNRYQ

SEQ ID NO: 125172 - protein, 16 aa, Borrelia garinii
YEDDYEEIRLSNRYQS

SEQ ID NO: 125173 - protein, 16 aa, Borrelia garinii
EDDYEEIRLSNRYQSY

SEQ ID NO: 125174 - protein, 16 aa, Borrelia garinii
DDYEEIRLSNRYQSYL

SEQ ID NO: 125175 - protein, 16 aa, Borrelia garinii
DYEEIRLSNRYQSYLE

SEQ ID NO: 125176 - protein, 16 aa, Borrelia garinii
YEEIRLSNRYQSYLEG

SEQ ID NO: 125177 - protein, 16 aa, Borrelia garinii
EEIRLSNRYQSYLEGV

SEQ ID NO: 125178 - protein, 16 aa, Borrelia garinii
EIRLSNRYQSYLEGVK

SEQ ID NO: 125179 - protein, 16 aa, Borrelia garinii
IRLSNRYQSYLEGVKY

SEQ ID NO: 125180 - protein, 16 aa, Borrelia garinii
RLSNRYQSYLEGVKYN

SEQ ID NO: 125181 - protein, 16 aa, Borrelia garinii
LSNRYQSYLEGVKYNV

SEQ ID NO: 125182 - protein, 16 aa, Borrelia garinii
SNRYQSYLEGVKYNVD

SEQ ID NO: 125183 - protein, 16 aa, Borrelia garinii
NRYQSYLEGVKYNVDS

SEQ ID NO: 125184 - protein, 16 aa, Borrelia garinii
RYQSYLEGVKYNVDSA

SEQ ID NO: 125185 - protein, 16 aa, Borrelia garinii
YQSYLEGVKYNVDSAI

SEQ ID NO: 125186 - protein, 16 aa, Borrelia garinii
QSYLEGVKYNVDSAIN

SEQ ID NO: 125187 - protein, 16 aa, Borrelia garinii
SYLEGVKYNVDSAINT

SEQ ID NO: 125188 - protein, 16 aa, Borrelia garinii
YLEGVKYNVDSAINTI

SEQ ID NO: 125189 - protein, 16 aa, Borrelia garinii
LEGVKYNVDSAINTIN

SEQ ID NO: 125190 - protein, 16 aa, Borrelia garinii
EGVKYNVDSAINTINK

SEQ ID NO: 125191 - protein, 16 aa, Borrelia garinii
GVKYNVDSAINTINKI

SEQ ID NO: 125192 - protein, 16 aa, Borrelia garinii
VKYNVDSAINTINKIY

SEQ ID NO: 125193 - protein, 16 aa, Borrelia garinii
KYNVDSAINTINKIYD

SEQ ID NO: 125194 - protein, 16 aa, Borrelia garinii
YNVDSAINTINKIYDT

SEQ ID NO: 125195 - protein, 16 aa, Borrelia garinii
NVDSAINTINKIYDTY

SEQ ID NO: 125196 - protein, 16 aa, Borrelia garinii
VDSAINTINKIYDTYT

SEQ ID NO: 125197 - protein, 16 aa, Borrelia garinii
DSAINTINKIYDTYTL

SEQ ID NO: 125198 - protein, 16 aa, Borrelia garinii
SAINTINKIYDTYTLF

SEQ ID NO: 125199 - protein, 16 aa, Borrelia garinii
AINTINKIYDTYTLFS

SEQ ID NO: 125200 - protein, 16 aa, Borrelia garinii
INTINKIYDTYTLFST

SEQ ID NO: 125201 - protein, 16 aa, Borrelia garinii
NTINKIYDTYTLFSTK

SEQ ID NO: 125202 - protein, 16 aa, Borrelia garinii
TINKIYDTYTLFSTKL

SEQ ID NO: 125203 - protein, 16 aa, Borrelia garinii
INKIYDTYTLFSTKLT

SEQ ID NO: 125204 - protein, 16 aa, Borrelia garinii
NKIYDTYTLFSTKLTQ

SEQ ID NO: 125205 - protein, 16 aa, Borrelia garinii
KIYDTYTLFSTKLTQM

SEQ ID NO: 125206 - protein, 16 aa, Borrelia garinii
IYDTYTLFSTKLTQMY

SEQ ID NO: 125207 - protein, 16 aa, Borrelia garinii
YDTYTLFSTKLTQMYS

SEQ ID NO: 125208 - protein, 16 aa, Borrelia garinii
DTYTLFSTKLTQMYST

SEQ ID NO: 125209 - protein, 16 aa, Borrelia garinii
TYTLFSTKLTQMYSTR

SEQ ID NO: 125210 - protein, 16 aa, Borrelia garinii
YTLFSTKLTQMYSTRL

SEQ ID NO: 125211 - protein, 16 aa, Borrelia garinii
TLFSTKLTQMYSTRLD

SEQ ID NO: 125212 - protein, 16 aa, Borrelia garinii
LFSTKLTQMYSTRLDN

SEQ ID NO: 125213 - protein, 16 aa, Borrelia garinii
FSTKLTQMYSTRLDNL

SEQ ID NO: 125214 - protein, 16 aa, Borrelia garinii
STKLTQMYSTRLDNLA

SEQ ID NO: 125215 - protein, 16 aa, Borrelia garinii
TKLTQMYSTRLDNLAK

SEQ ID NO: 125216 - protein, 16 aa, Borrelia garinii
KLTQMYSTRLDNLAKA

SEQ ID NO: 125217 - protein, 16 aa, Borrelia garinii
LTQMYSTRLDNLAKAK

SEQ ID NO: 125218 - protein, 16 aa, Borrelia garinii
TQMYSTRLDNLAKAKA

SEQ ID NO: 125219 - protein, 16 aa, Borrelia garinii
QMYSTRLDNLAKAKAK

SEQ ID NO: 125220 - protein, 16 aa, Borrelia garinii
MYSTRLDNLAKAKAKE

SEQ ID NO: 125221 - protein, 16 aa, Borrelia garinii
YSTRLDNLAKAKAKEE

SEQ ID NO: 125222 - protein, 16 aa, Borrelia garinii
STRLDNLAKAKAKEEA

SEQ ID NO: 125223 - protein, 16 aa, Borrelia garinii
TRLDNLAKAKAKEEAA

SEQ ID NO: 125224 - protein, 16 aa, Borrelia garinii
RLDNLAKAKAKEEAAK

SEQ ID NO: 125225 - protein, 16 aa, Borrelia garinii
LDNLAKAKAKEEAAKF

SEQ ID NO: 125226 - protein, 16 aa, Borrelia garinii
DNLAKAKAKEEAAKFT

SEQ ID NO: 125227 - protein, 16 aa, Borrelia garinii
NLAKAKAKEEAAKFTK

SEQ ID NO: 125228 - protein, 16 aa, Borrelia garinii
LAKAKAKEEAAKFTKE

SEQ ID NO: 125229 - protein, 16 aa, Borrelia garinii
AKAKAKEEAAKFTKED

SEQ ID NO: 125230 - protein, 16 aa, Borrelia garinii
KAKAKEEAAKFTKEDL

SEQ ID NO: 125231 - protein, 16 aa, Borrelia garinii
AKAKEEAAKFTKEDLE

SEQ ID NO: 125232 - protein, 16 aa, Borrelia garinii
KAKEEAAKFTKEDLEK

SEQ ID NO: 125233 - protein, 16 aa, Borrelia garinii
AKEEAAKFTKEDLEKN

SEQ ID NO: 125234 - protein, 16 aa, Borrelia garinii
KEEAAKFTKEDLEKNF

SEQ ID NO: 125235 - protein, 16 aa, Borrelia garinii
EEAAKFTKEDLEKNFK

SEQ ID NO: 125236 - protein, 16 aa, Borrelia garinii
EAAKFTKEDLEKNFKT

SEQ ID NO: 125237 - protein, 16 aa, Borrelia garinii
AAKFTKEDLEKNFKTL

SEQ ID NO: 125238 - protein, 16 aa, Borrelia garinii
AKFTKEDLEKNFKTLL

SEQ ID NO: 125239 - protein, 16 aa, Borrelia garinii
KFTKEDLEKNFKTLLN

SEQ ID NO: 125240 - protein, 16 aa, Borrelia garinii
FTKEDLEKNFKTLLNY

SEQ ID NO: 125241 - protein, 16 aa, Borrelia garinii
TKEDLEKNFKTLLNYI

SEQ ID NO: 125242 - protein, 16 aa, Borrelia garinii
KEDLEKNFKTLLNYIQ

SEQ ID NO: 125243 - protein, 16 aa, Borrelia garinii
EDLEKNFKTLLNYIQV

SEQ ID NO: 125244 - protein, 16 aa, Borrelia garinii
DLEKNFKTLLNYIQVS

SEQ ID NO: 125245 - protein, 16 aa, Borrelia garinii
LEKNFKTLLNYIQVSV

SEQ ID NO: 125246 - protein, 16 aa, Borrelia garinii
EKNFKTLLNYIQVSVK

SEQ ID NO: 125247 - protein, 16 aa, Borrelia garinii
KNFKTLLNYIQVSVKT

SEQ ID NO: 125248 - protein, 16 aa, Borrelia garinii
NFKTLLNYIQVSVKTA

SEQ ID NO: 125249 - protein, 16 aa, Borrelia garinii
FKTLLNYIQVSVKTAT

SEQ ID NO: 125250 - protein, 16 aa, Borrelia garinii
KTLLNYIQVSVKTATN

SEQ ID NO: 125251 - protein, 16 aa, Borrelia garinii
TLLNYIQVSVKTATNF

SEQ ID NO: 125252 - protein, 16 aa, Borrelia garinii
LLNYIQVSVKTATNFV

SEQ ID NO: 125253 - protein, 16 aa, Borrelia garinii
LNYIQVSVKTATNFVY

SEQ ID NO: 125254 - protein, 16 aa, Borrelia garinii
NYIQVSVKTATNFVYI

SEQ ID NO: 125255 - protein, 16 aa, Borrelia garinii
YIQVSVKTATNFVYIN

SEQ ID NO: 125256 - protein, 16 aa, Borrelia garinii
IQVSVKTATNFVYINE

SEQ ID NO: 125257 - protein, 16 aa, Borrelia garinii
QVSVKTATNFVYINEM

SEQ ID NO: 125258 - protein, 16 aa, Borrelia garinii
VSVKTATNFVYINEMH

SEQ ID NO: 125259 - protein, 16 aa, Borrelia garinii
SVKTATNFVYINEMHA

SEQ ID NO: 125260 - protein, 16 aa, Borrelia garinii
VKTATNFVYINEMHAK

SEQ ID NO: 125261 - protein, 16 aa, Borrelia garinii
KTATNFVYINEMHAKR

SEQ ID NO: 125262 - protein, 16 aa, Borrelia garinii
TATNFVYINEMHAKRK

SEQ ID NO: 125263 - protein, 16 aa, Borrelia garinii
ATNFVYINEMHAKRKL

SEQ ID NO: 125264 - protein, 16 aa, Borrelia garinii
TNFVYINEMHAKRKLE

SEQ ID NO: 125265 - protein, 16 aa, Borrelia garinii
NFVYINEMHAKRKLEN

SEQ ID NO: 125266 - protein, 16 aa, Borrelia garinii
FVYINEMHAKRKLENI

SEQ ID NO: 125267 - protein, 16 aa, Borrelia garinii
VYINEMHAKRKLENIE

SEQ ID NO: 125268 - protein, 16 aa, Borrelia garinii
YINEMHAKRKLENIEA

SEQ ID NO: 125269 - protein, 16 aa, Borrelia garinii
INEMHAKRKLENIEAK

SEQ ID NO: 125270 - protein, 16 aa, Borrelia garinii
NEMHAKRKLENIEAKI

SEQ ID NO: 125271 - protein, 16 aa, Borrelia garinii
EMHAKRKLENIEAKIK

SEQ ID NO: 125272 - protein, 16 aa, Borrelia garinii
MHAKRKLENIEAKIKT

SEQ ID NO: 125273 - protein, 16 aa, Borrelia garinii
HAKRKLENIEAKIKTL

SEQ ID NO: 125274 - protein, 16 aa, Borrelia garinii
AKRKLENIEAKIKTLI

SEQ ID NO: 125275 - protein, 16 aa, Borrelia garinii
KRKLENIEAKIKTLIA

SEQ ID NO: 125276 - protein, 16 aa, Borrelia garinii
RKLENIEAKIKTLIAK

SEQ ID NO: 125277 - protein, 16 aa, Borrelia garinii
KLENIEAKIKTLIAKI

SEQ ID NO: 125278 - protein, 16 aa, Borrelia garinii
LENIEAKIKTLIAKIK

SEQ ID NO: 125279 - protein, 16 aa, Borrelia garinii
ENIEAKIKTLIAKIKE

SEQ ID NO: 125280 - protein, 16 aa, Borrelia garinii
NIEAKIKTLIAKIKEK

SEQ ID NO: 125281 - protein, 16 aa, Borrelia garinii
IEAKIKTLIAKIKEKS

SEQ ID NO: 125282 - protein, 16 aa, Borrelia garinii
EAKIKTLIAKIKEKSN

SEQ ID NO: 125283 - protein, 16 aa, Borrelia garinii
AKIKTLIAKIKEKSNL

SEQ ID NO: 125284 - protein, 16 aa, Borrelia garinii
KIKTLIAKIKEKSNLY

SEQ ID NO: 125285 - protein, 16 aa, Borrelia garinii
IKTLIAKIKEKSNLYS

SEQ ID NO: 125286 - protein, 16 aa, Borrelia garinii
KTLIAKIKEKSNLYSA

SEQ ID NO: 125287 - protein, 16 aa, Borrelia garinii
TLIAKIKEKSNLYSAY

SEQ ID NO: 125288 - protein, 16 aa, Borrelia garinii
LIAKIKEKSNLYSAYK

SEQ ID NO: 125289 - protein, 16 aa, Borrelia garinii
IAKIKEKSNLYSAYKA

SEQ ID NO: 125290 - protein, 16 aa, Borrelia garinii
AKIKEKSNLYSAYKAI

SEQ ID NO: 125291 - protein, 16 aa, Borrelia garinii
KIKEKSNLYSAYKAIV

SEQ ID NO: 125292 - protein, 16 aa, Borrelia garinii
IKEKSNLYSAYKAIVS

SEQ ID NO: 125293 - protein, 16 aa, Borrelia garinii
KEKSNLYSAYKAIVSS

SEQ ID NO: 125294 - protein, 16 aa, Borrelia garinii
EKSNLYSAYKAIVSSI

SEQ ID NO: 125295 - protein, 16 aa, Borrelia garinii
KSNLYSAYKAIVSSIL

SEQ ID NO: 125296 - protein, 16 aa, Borrelia garinii
SNLYSAYKAIVSSILL

SEQ ID NO: 125297 - protein, 16 aa, Borrelia garinii
NLYSAYKAIVSSILLM

SEQ ID NO: 125298 - protein, 16 aa, Borrelia garinii
LYSAYKAIVSSILLMR

SEQ ID NO: 125299 - protein, 16 aa, Borrelia garinii
YSAYKAIVSSILLMRD

SEQ ID NO: 125300 - protein, 16 aa, Borrelia garinii
SAYKAIVSSILLMRDS

SEQ ID NO: 125301 - protein, 16 aa, Borrelia garinii
AYKAIVSSILLMRDSL

SEQ ID NO: 125302 - protein, 16 aa, Borrelia garinii
YKAIVSSILLMRDSLK

SEQ ID NO: 125303 - protein, 16 aa, Borrelia garinii
KAIVSSILLMRDSLKE

SEQ ID NO: 125304 - protein, 16 aa, Borrelia garinii
AIVSSILLMRDSLKEV

SEQ ID NO: 125305 - protein, 16 aa, Borrelia garinii
IVSSILLMRDSLKEVQ

SEQ ID NO: 125306 - protein, 16 aa, Borrelia garinii
VSSILLMRDSLKEVQY

SEQ ID NO: 125307 - protein, 16 aa, Borrelia garinii
SSILLMRDSLKEVQYA

SEQ ID NO: 125308 - protein, 16 aa, Borrelia garinii
SILLMRDSLKEVQYAI

SEQ ID NO: 125309 - protein, 16 aa, Borrelia garinii
ILLMRDSLKEVQYAID

SEQ ID NO: 125310 - protein, 16 aa, Borrelia garinii
LLMRDSLKEVQYAIDK

SEQ ID NO: 125311 - protein, 16 aa, Borrelia garinii
LMRDSLKEVQYAIDKN

SEQ ID NO: 125312 - protein, 16 aa, Borrelia garinii
MRDSLKEVQYAIDKNG

SEQ ID NO: 125313 - protein, 16 aa, Borrelia garinii
RDSLKEVQYAIDKNGI

SEQ ID NO: 125314 - protein, 16 aa, Borrelia garinii
DSLKEVQYAIDKNGIW

SEQ ID NO: 125315 - protein, 16 aa, Borrelia garinii
SLKEVQYAIDKNGIWY

SEQ ID NO: 125316 - protein, 16 aa, Borrelia garinii
LKEVQYAIDKNGIWYR

SEQ ID NO: 125317 - protein, 16 aa, Borrelia garinii
KEVQYAIDKNGIWYRK

SEQ ID NO: 125318 - protein, 16 aa, Borrelia garinii
EVQYAIDKNGIWYRKL

SEQ ID NO: 125319 - protein, 16 aa, Borrelia garinii
VQYAIDKNGIWYRKLD

SEQ ID NO: 125320 - protein, 16 aa, Borrelia garinii
QYAIDKNGIWYRKLDA

SEQ ID NO: 125321 - protein, 16 aa, Borrelia garinii
YAIDKNGIWYRKLDAI

SEQ ID NO: 125322 - protein, 16 aa, Borrelia garinii
AIDKNGIWYRKLDAIE

SEQ ID NO: 125323 - protein, 16 aa, Borrelia garinii
IDKNGIWYRKLDAIET

SEQ ID NO: 125324 - protein, 16 aa, Borrelia garinii
DKNGIWYRKLDAIETE

SEQ ID NO: 125325 - protein, 16 aa, Borrelia garinii
KNGIWYRKLDAIETEI

SEQ ID NO: 125326 - protein, 16 aa, Borrelia garinii
NGIWYRKLDAIETEIK

SEQ ID NO: 125327 - protein, 16 aa, Borrelia garinii
GIWYRKLDAIETEIKN

SEQ ID NO: 125328 - protein, 16 aa, Borrelia garinii
IWYRKLDAIETEIKNL

SEQ ID NO: 125329 - protein, 16 aa, Borrelia garinii
WYRKLDAIETEIKNLI

SEQ ID NO: 125330 - protein, 16 aa, Borrelia garinii
YRKLDAIETEIKNLIL

SEQ ID NO: 125331 - protein, 16 aa, Borrelia garinii
RKLDAIETEIKNLILK

SEQ ID NO: 125332 - protein, 16 aa, Borrelia garinii
KLDAIETEIKNLILKI

SEQ ID NO: 125333 - protein, 16 aa, Borrelia garinii
LDAIETEIKNLILKIK

SEQ ID NO: 125334 - protein, 16 aa, Borrelia garinii
DAIETEIKNLILKIKG

SEQ ID NO: 125335 - protein, 16 aa, Borrelia garinii
AIETEIKNLILKIKGQ

SEQ ID NO: 125336 - protein, 16 aa, Borrelia garinii
IETEIKNLILKIKGQS

SEQ ID NO: 125337 - protein, 16 aa, Borrelia garinii
ETEIKNLILKIKGQSD

SEQ ID NO: 125338 - protein, 16 aa, Borrelia garinii
TEIKNLILKIKGQSDL

SEQ ID NO: 125339 - protein, 16 aa, Borrelia garinii
EIKNLILKIKGQSDLY

SEQ ID NO: 125340 - protein, 16 aa, Borrelia garinii
IKNLILKIKGQSDLYE

SEQ ID NO: 125341 - protein, 16 aa, Borrelia garinii
KNLILKIKGQSDLYEA

SEQ ID NO: 125342 - protein, 16 aa, Borrelia garinii
NLILKIKGQSDLYEAY

SEQ ID NO: 125343 - protein, 16 aa, Borrelia garinii
LILKIKGQSDLYEAYK

SEQ ID NO: 125344 - protein, 16 aa, Borrelia garinii
ILKIKGQSDLYEAYKA

SEQ ID NO: 125345 - protein, 16 aa, Borrelia garinii
LKIKGQSDLYEAYKAI

SEQ ID NO: 125346 - protein, 16 aa, Borrelia garinii
KIKGQSDLYEAYKAIV

SEQ ID NO: 125347 - protein, 16 aa, Borrelia garinii
IKGQSDLYEAYKAIVR

SEQ ID NO: 125348 - protein, 16 aa, Borrelia garinii
KGQSDLYEAYKAIVRS

SEQ ID NO: 125349 - protein, 16 aa, Borrelia garinii
GQSDLYEAYKAIVRSI

SEQ ID NO: 125350 - protein, 16 aa, Borrelia garinii
QSDLYEAYKAIVRSIL

SEQ ID NO: 125351 - protein, 16 aa, Borrelia garinii
SDLYEAYKAIVRSILL

SEQ ID NO: 125352 - protein, 16 aa, Borrelia garinii
DLYEAYKAIVRSILLM

SEQ ID NO: 125353 - protein, 16 aa, Borrelia garinii
LYEAYKAIVRSILLMK

SEQ ID NO: 125354 - protein, 16 aa, Borrelia garinii
YEAYKAIVRSILLMKD

SEQ ID NO: 125355 - protein, 16 aa, Borrelia garinii
EAYKAIVRSILLMKDS

SEQ ID NO: 125356 - protein, 16 aa, Borrelia garinii
AYKAIVRSILLMKDSL

SEQ ID NO: 125357 - protein, 16 aa, Borrelia garinii
YKAIVRSILLMKDSLK

SEQ ID NO: 125358 - protein, 16 aa, Borrelia garinii
KAIVRSILLMKDSLKI

SEQ ID NO: 125359 - protein, 16 aa, Borrelia garinii
AIVRSILLMKDSLKII

SEQ ID NO: 125360 - protein, 16 aa, Borrelia garinii
IVRSILLMKDSLKIIE

SEQ ID NO: 125361 - protein, 16 aa, Borrelia garinii
VRSILLMKDSLKIIEI

SEQ ID NO: 125362 - protein, 16 aa, Borrelia garinii
RSILLMKDSLKIIEIV

SEQ ID NO: 125363 - protein, 16 aa, Borrelia garinii
SILLMKDSLKIIEIVI

SEQ ID NO: 125364 - protein, 16 aa, Borrelia garinii
ILLMKDSLKIIEIVID

SEQ ID NO: 125365 - protein, 16 aa, Borrelia garinii
LLMKDSLKIIEIVIDK

SEQ ID NO: 125366 - protein, 16 aa, Borrelia garinii
LMKDSLKIIEIVIDKN

SEQ ID NO: 125367 - protein, 16 aa, Borrelia garinii
MKDSLKIIEIVIDKNG

SEQ ID NO: 125368 - protein, 16 aa, Borrelia garinii
KDSLKIIEIVIDKNGV

SEQ ID NO: 125369 - protein, 16 aa, Borrelia garinii
DSLKIIEIVIDKNGVW

SEQ ID NO: 125370 - protein, 16 aa, Borrelia garinii
SLKIIEIVIDKNGVWY

SEQ ID NO: 125371 - protein, 15 aa, Borrelia burgdorferi B31
GSFADLEAGRSVATR

SEQ ID NO: 125372 - protein, 9 aa, Borrelia burgdorferi B31
LEAGRSVAT

SEQ ID NO: 125373 - protein, 15 aa, Borrelia burgdorferi B31
IGSFADLEAGRSVAT

SEQ ID NO: 125374 - protein, 9 aa, Borrelia burgdorferi B31
FADLEAGRS

SEQ ID NO: 125375 - protein, 15 aa, Borrelia burgdorferi B31
FADLEAGRSVATRMY

SEQ ID NO: 125376 - protein, 9 aa, Borrelia burgdorferi B31
LEAGRSVAT

SEQ ID NO: 125377 - protein, 15 aa, Borrelia burgdorferi B31
SFADLEAGRSVATRM

SEQ ID NO: 125378 - protein, 9 aa, Borrelia burgdorferi B31
LEAGRSVAT

SEQ ID NO: 125379 - protein, 15 aa, Borrelia burgdorferi B31
ADLEAGRSVATRMYS

SEQ ID NO: 125380 - protein, 9 aa, Borrelia burgdorferi B31
LEAGRSVAT

SEQ ID NO: 125381 - protein, 15 aa, Borrelia burgdorferi B31
AFLTGYIAAKLSKTG

SEQ ID NO: 125382 - protein, 9 aa, Borrelia burgdorferi B31
YIAAKLSKT

SEQ ID NO: 125383 - protein, 15 aa, Borrelia burgdorferi B31
FLTGYIAAKLSKTGK

SEQ ID NO: 125384 - protein, 9 aa, Borrelia burgdorferi B31
IAAKLSKTG

SEQ ID NO: 125385 - protein, 15 aa, Borrelia burgdorferi B31
LTGYIAAKLSKTGKI

SEQ ID NO: 125386 - protein, 9 aa, Borrelia burgdorferi B31
IAAKLSKTG

SEQ ID NO: 125387 - protein, 15 aa, Borrelia burgdorferi B31
TGYIAAKLSKTGKIG

SEQ ID NO: 125388 - protein, 9 aa, Borrelia burgdorferi B31
IAAKLSKTG

SEQ ID NO: 125389 - protein, 15 aa, Borrelia burgdorferi B31
DLEAGRSVATRMYSD

SEQ ID NO: 125390 - protein, 9 aa, Borrelia burgdorferi B31
LEAGRSVAT

SEQ ID NO: 125391 - protein, 15 aa, Borrelia burgdorferi B31
LEAGRSVATRMYSDE

SEQ ID NO: 125392 - protein, 9 aa, Borrelia burgdorferi B31
LEAGRSVAT

SEQ ID NO: 125393 - protein, 15 aa, Borrelia burgdorferi B31
GAFLTGYIAAKLSKT

SEQ ID NO: 125394 - protein, 9 aa, Borrelia burgdorferi B31
LTGYIAAKL

SEQ ID NO: 125395 - protein, 15 aa, Borrelia burgdorferi B31
GYIAAKLSKTGKIGF

SEQ ID NO: 125396 - protein, 9 aa, Borrelia burgdorferi B31
IAAKLSKTG

SEQ ID NO: 125397 - protein, 15 aa, Borrelia burgdorferi B31
IHHAAGLGGIGAIEV

SEQ ID NO: 125398 - protein, 9 aa, Borrelia burgdorferi B31
IHHAAGLGG

SEQ ID NO: 125399 - protein, 15 aa, Borrelia burgdorferi B31
LVGMTFRAQEGAFLT

SEQ ID NO: 125400 - protein, 9 aa, Borrelia burgdorferi B31
FRAQEGAFL

SEQ ID NO: 125401 - protein, 15 aa, Borrelia burgdorferi B31
NLVGMTFRAQEGAFL

SEQ ID NO: 125402 - protein, 9 aa, Borrelia burgdorferi B31
LVGMTFRAQ

SEQ ID NO: 125403 - protein, 15 aa, Borrelia burgdorferi B31
HHAAGLGGIGAIEVA

SEQ ID NO: 125404 - protein, 9 aa, Borrelia burgdorferi B31
LGGIGAIEV

SEQ ID NO: 125405 - protein, 15 aa, Borrelia burgdorferi B31
HAAGLGGIGAIEVAK

SEQ ID NO: 125406 - protein, 9 aa, Borrelia burgdorferi B31
LGGIGAIEV

SEQ ID NO: 125407 - protein, 15 aa, Borrelia burgdorferi B31
AAGLGGIGAIEVAKE

SEQ ID NO: 125408 - protein, 9 aa, Borrelia burgdorferi B31
LGGIGAIEV

SEQ ID NO: 125409 - protein, 15 aa, Borrelia burgdorferi B31
AGLGGIGAIEVAKEL

SEQ ID NO: 125410 - protein, 9 aa, Borrelia burgdorferi B31
LGGIGAIEV

SEQ ID NO: 125411 - protein, 15 aa, Borrelia burgdorferi B31
EGAFLTGYIAAKLSK

SEQ ID NO: 125412 - protein, 9 aa, Borrelia burgdorferi B31
LTGYIAAKL

SEQ ID NO: 125413 - protein, 15 aa, Borrelia burgdorferi B31
YIAAKLSKTGKIGFL

SEQ ID NO: 125414 - protein, 9 aa, Borrelia burgdorferi B31
IAAKLSKTG

SEQ ID NO: 125415 - protein, 15 aa, Borrelia burgdorferi B31
GMTFRAQEGAFLTGY

SEQ ID NO: 125416 - protein, 9 aa, Borrelia burgdorferi B31
FRAQEGAFL

SEQ ID NO: 125417 - protein, 15 aa, Borrelia burgdorferi B31
QEGAFLTGYIAAKLS

SEQ ID NO: 125418 - protein, 9 aa, Borrelia burgdorferi B31
LTGYIAAKL

SEQ ID NO: 125419 - protein, 15 aa, Borrelia burgdorferi B31
EKEIDNLSSKIINKE

SEQ ID NO: 125420 - protein, 9 aa, Borrelia burgdorferi B31
IDNLSSKII

SEQ ID NO: 125421 - protein, 15 aa, Borrelia burgdorferi B31
LEKEIDNLSSKIINK

SEQ ID NO: 125422 - protein, 9 aa, Borrelia burgdorferi B31
IDNLSSKII

SEQ ID NO: 125423 - protein, 15 aa, Borrelia burgdorferi B31
KEIDNLSSKIINKEI

SEQ ID NO: 125424 - protein, 9 aa, Borrelia burgdorferi B31
IDNLSSKII

SEQ ID NO: 125425 - protein, 15 aa, Borrelia burgdorferi B31
MTFRAQEGAFLTGYI

SEQ ID NO: 125426 - protein, 9 aa, Borrelia burgdorferi B31
FRAQEGAFL

SEQ ID NO: 125427 - protein, 15 aa, Borrelia burgdorferi B31
ELEKEIDNLSSKIIN

SEQ ID NO: 125428 - protein, 9 aa, Borrelia burgdorferi B31
IDNLSSKII

SEQ ID NO: 125429 - protein, 15 aa, Borrelia burgdorferi B31
VGMTFRAQEGAFLTG

SEQ ID NO: 125430 - protein, 9 aa, Borrelia burgdorferi B31
FRAQEGAFL

SEQ ID NO: 125431 - protein, 15 aa, Borrelia burgdorferi B31
FELEKEIDNLSSKII

SEQ ID NO: 125432 - protein, 9 aa, Borrelia burgdorferi B31
FELEKEIDN

SEQ ID NO: 125433 - protein, 15 aa, Borrelia burgdorferi B31
DMKYAIIDPIYSNDP

SEQ ID NO: 125434 - protein, 9 aa, Borrelia burgdorferi B31
YAIIDPIYS

SEQ ID NO: 125435 - protein, 15 aa, Borrelia burgdorferi B31
MKYAIIDPIYSNDPI

SEQ ID NO: 125436 - protein, 9 aa, Borrelia burgdorferi B31
YAIIDPIYS

SEQ ID NO: 125437 - protein, 15 aa, Borrelia burgdorferi B31
DPIPANLVGMTFRAQ

SEQ ID NO: 125438 - protein, 9 aa, Borrelia burgdorferi B31
IPANLVGMT

SEQ ID NO: 125439 - protein, 15 aa, Borrelia burgdorferi B31
TQYIGSFADLEAGRS

SEQ ID NO: 125440 - protein, 9 aa, Borrelia burgdorferi B31
IGSFADLEA

SEQ ID NO: 125441 - protein, 15 aa, Borrelia burgdorferi B31
QYIGSFADLEAGRSV

SEQ ID NO: 125442 - protein, 9 aa, Borrelia burgdorferi B31
FADLEAGRS

SEQ ID NO: 125443 - protein, 15 aa, Borrelia burgdorferi B31
YIGSFADLEAGRSVA

SEQ ID NO: 125444 - protein, 9 aa, Borrelia burgdorferi B31
FADLEAGRS

SEQ ID NO: 125445 - protein, 15 aa, Borrelia burgdorferi B31
IPANLVGMTFRAQEG

SEQ ID NO: 125446 - protein, 9 aa, Borrelia burgdorferi B31
LVGMTFRAQ

SEQ ID NO: 125447 - protein, 15 aa, Borrelia burgdorferi B31
PANLVGMTFRAQEGA

SEQ ID NO: 125448 - protein, 9 aa, Borrelia burgdorferi B31
LVGMTFRAQ

SEQ ID NO: 125449 - protein, 15 aa, Borrelia burgdorferi B31
PIPANLVGMTFRAQE

SEQ ID NO: 125450 - protein, 9 aa, Borrelia burgdorferi B31
LVGMTFRAQ

SEQ ID NO: 125451 - protein, 15 aa, Borrelia burgdorferi B31
AQEGAFLTGYIAAKL

SEQ ID NO: 125452 - protein, 9 aa, Borrelia burgdorferi B31
FLTGYIAAK

SEQ ID NO: 125453 - protein, 15 aa, Borrelia burgdorferi B31
SDLIWLIGYRFSDVA

SEQ ID NO: 125454 - protein, 9 aa, Borrelia burgdorferi B31
LIWLIGYRF

SEQ ID NO: 125455 - protein, 15 aa, Borrelia burgdorferi B31
ANLVGMTFRAQEGAF

SEQ ID NO: 125456 - protein, 9 aa, Borrelia burgdorferi B31
LVGMTFRAQ

SEQ ID NO: 125457 - protein, 15 aa, Borrelia burgdorferi B31
GSDLIWLIGYRFSDV

SEQ ID NO: 125458 - protein, 9 aa, Borrelia burgdorferi B31
LIWLIGYRF

SEQ ID NO: 125459 - protein, 15 aa, Borrelia burgdorferi B31
VAKVAALQNPDMKYA

SEQ ID NO: 125460 - protein, 9 aa, Borrelia burgdorferi B31
VAALQNPDM

SEQ ID NO: 125461 - protein, 15 aa, Borrelia burgdorferi B31
DAGSDLIWLIGYRFS

SEQ ID NO: 125462 - protein, 9 aa, Borrelia burgdorferi B31
LIWLIGYRF

SEQ ID NO: 125463 - protein, 15 aa, Borrelia burgdorferi B31
AGSDLIWLIGYRFSD

SEQ ID NO: 125464 - protein, 9 aa, Borrelia burgdorferi B31
LIWLIGYRF

SEQ ID NO: 125465 - protein, 15 aa, Borrelia burgdorferi B31
IDIIHHAAGLGGIGA

SEQ ID NO: 125466 - protein, 9 aa, Borrelia burgdorferi B31
IHHAAGLGG

SEQ ID NO: 125467 - protein, 15 aa, Borrelia burgdorferi B31
PDMKYAIIDPIYSND

SEQ ID NO: 125468 - protein, 9 aa, Borrelia burgdorferi B31
YAIIDPIYS

SEQ ID NO: 125469 - protein, 15 aa, Borrelia burgdorferi B31
NPDMKYAIIDPIYSN

SEQ ID NO: 125470 - protein, 9 aa, Borrelia burgdorferi B31
YAIIDPIYS

SEQ ID NO: 125471 - protein, 15 aa, Borrelia burgdorferi B31
AKVAALQNPDMKYAI

SEQ ID NO: 125472 - protein, 9 aa, Borrelia burgdorferi B31
LQNPDMKYA

SEQ ID NO: 125473 - protein, 15 aa, Borrelia burgdorferi B31
QNPDMKYAIIDPIYS

SEQ ID NO: 125474 - protein, 9 aa, Borrelia burgdorferi B31
MKYAIIDPI

SEQ ID NO: 125475 - protein, 15 aa, Borrelia burgdorferi B31
FSDVAKVAALQNPDM

SEQ ID NO: 125476 - protein, 9 aa, Borrelia burgdorferi B31
VAKVAALQN

SEQ ID NO: 125477 - protein, 15 aa, Borrelia burgdorferi B31
EIDIIHHAAGLGGIG

SEQ ID NO: 125478 - protein, 9 aa, Borrelia burgdorferi B31
IHHAAGLGG

SEQ ID NO: 125479 - protein, 15 aa, Borrelia burgdorferi B31
DEIDIIHHAAGLGGI

SEQ ID NO: 125480 - protein, 9 aa, Borrelia burgdorferi B31
IHHAAGLGG

SEQ ID NO: 125481 - protein, 15 aa, Borrelia burgdorferi B31
SDVAKVAALQNPDMK

SEQ ID NO: 125482 - protein, 9 aa, Borrelia burgdorferi B31
VAKVAALQN

SEQ ID NO: 125483 - protein, 15 aa, Borrelia burgdorferi B31
SDEIDIIHHAAGLGG

SEQ ID NO: 125484 - protein, 9 aa, Borrelia burgdorferi B31
IIHHAAGLG

SEQ ID NO: 125485 - protein, 15 aa, Borrelia burgdorferi B31
YLAPDNVITSTTKDV

SEQ ID NO: 125486 - protein, 9 aa, Borrelia burgdorferi B31
YLAPDNVIT

SEQ ID NO: 125487 - protein, 15 aa, Borrelia burgdorferi B31
DPIYSNDPIPANLVG

SEQ ID NO: 125488 - protein, 9 aa, Borrelia burgdorferi B31
NDPIPANLV

SEQ ID NO: 125489 - protein, 15 aa, Borrelia burgdorferi B31
IDPIYSNDPIPANLV

SEQ ID NO: 125490 - protein, 9 aa, Borrelia burgdorferi B31
IYSNDPIPA

SEQ ID NO: 125491 - protein, 15 aa, Borrelia burgdorferi B31
LIWLIGYRFSDVAKV

SEQ ID NO: 125492 - protein, 9 aa, Borrelia burgdorferi B31
LIWLIGYRF

SEQ ID NO: 125493 - protein, 15 aa, Borrelia burgdorferi B31
VAALQNPDMKYAIID

SEQ ID NO: 125494 - protein, 9 aa, Borrelia burgdorferi B31
LQNPDMKYA

SEQ ID NO: 125495 - protein, 15 aa, Borrelia burgdorferi B31
KVAALQNPDMKYAII

SEQ ID NO: 125496 - protein, 9 aa, Borrelia burgdorferi B31
LQNPDMKYA

SEQ ID NO: 125497 - protein, 15 aa, Borrelia burgdorferi B31
DIIHHAAGLGGIGAI

SEQ ID NO: 125498 - protein, 9 aa, Borrelia burgdorferi B31
IHHAAGLGG

SEQ ID NO: 125499 - protein, 15 aa, Borrelia burgdorferi B31
GYRFSDVAKVAALQN

SEQ ID NO: 125500 - protein, 9 aa, Borrelia burgdorferi B31
YRFSDVAKV

SEQ ID NO: 125501 - protein, 15 aa, Borrelia burgdorferi B31
YRFSDVAKVAALQNP

SEQ ID NO: 125502 - protein, 9 aa, Borrelia burgdorferi B31
VAKVAALQN

SEQ ID NO: 125503 - protein, 15 aa, Borrelia burgdorferi B31
YAIIDPIYSNDPIPA

SEQ ID NO: 125504 - protein, 9 aa, Borrelia burgdorferi B31
YAIIDPIYS

SEQ ID NO: 125505 - protein, 15 aa, Borrelia burgdorferi B31
TFRAQEGAFLTGYIA

SEQ ID NO: 125506 - protein, 9 aa, Borrelia burgdorferi B31
FRAQEGAFL

SEQ ID NO: 125507 - protein, 15 aa, Borrelia burgdorferi B31
KDAGSDLIWLIGYRF

SEQ ID NO: 125508 - protein, 9 aa, Borrelia burgdorferi B31
GSDLIWLIG

SEQ ID NO: 125509 - protein, 15 aa, Borrelia burgdorferi B31
GLGGIGAIEVAKELG

SEQ ID NO: 125510 - protein, 9 aa, Borrelia burgdorferi B31
LGGIGAIEV

SEQ ID NO: 125511 - protein, 15 aa, Borrelia burgdorferi B31
IYSNDPIPANLVGMT

SEQ ID NO: 125512 - protein, 9 aa, Borrelia burgdorferi B31
NDPIPANLV

SEQ ID NO: 125513 - protein, 15 aa, Borrelia burgdorferi B31
LGGIGAIEVAKELGS

SEQ ID NO: 125514 - protein, 9 aa, Borrelia burgdorferi B31
LGGIGAIEV

SEQ ID NO: 125515 - protein, 15 aa, Borrelia burgdorferi B31
IAAKLSKTGKIGFLG

SEQ ID NO: 125516 - protein, 9 aa, Borrelia burgdorferi B31
IAAKLSKTG

SEQ ID NO: 125517 - protein, 15 aa, Borrelia burgdorferi B31
CSGKGSLGSEIPKVS

SEQ ID NO: 125518 - protein, 9 aa, Borrelia burgdorferi B31
KGSLGSEIP

SEQ ID NO: 125519 - protein, 15 aa, Borrelia burgdorferi B31
FRAQEGAFLTGYIAA

SEQ ID NO: 125520 - protein, 9 aa, Borrelia burgdorferi B31
FRAQEGAFL

SEQ ID NO: 125521 - protein, 15 aa, Borrelia burgdorferi B31
PIYSNDPIPANLVGM

SEQ ID NO: 125522 - protein, 9 aa, Borrelia burgdorferi B31
YSNDPIPAN

SEQ ID NO: 125523 - protein, 15 aa, Borrelia burgdorferi B31
DQAYLAPDNVITSTT

SEQ ID NO: 125524 - protein, 9 aa, Borrelia burgdorferi B31
YLAPDNVIT

SEQ ID NO: 125525 - protein, 15 aa, Borrelia burgdorferi B31
LAPDNVITSTTKDVG

SEQ ID NO: 125526 - protein, 9 aa, Borrelia burgdorferi B31
VITSTTKDV

SEQ ID NO: 125527 - protein, 15 aa, Borrelia burgdorferi B31
QAYLAPDNVITSTTK

SEQ ID NO: 125528 - protein, 9 aa, Borrelia burgdorferi B31
YLAPDNVIT

SEQ ID NO: 125529 - protein, 15 aa, Borrelia burgdorferi B31
AALQNPDMKYAIIDP

SEQ ID NO: 125530 - protein, 9 aa, Borrelia burgdorferi B31
LQNPDMKYA

SEQ ID NO: 125531 - protein, 15 aa, Borrelia burgdorferi B31
DLIWLIGYRFSDVAK

SEQ ID NO: 125532 - protein, 9 aa, Borrelia burgdorferi B31
LIWLIGYRF

SEQ ID NO: 125533 - protein, 15 aa, Borrelia burgdorferi B31
PDNVITSTTKDVGRA

SEQ ID NO: 125534 - protein, 9 aa, Borrelia burgdorferi B31
VITSTTKDV

SEQ ID NO: 125535 - protein, 15 aa, Borrelia burgdorferi B31
SGKGSLGSEIPKVSL

SEQ ID NO: 125536 - protein, 9 aa, Borrelia burgdorferi B31
LGSEIPKVS

SEQ ID NO: 125537 - protein, 15 aa, Borrelia burgdorferi B31
LSDLEGLKDAGSDLI

SEQ ID NO: 125538 - protein, 9 aa, Borrelia burgdorferi B31
LEGLKDAGS

SEQ ID NO: 125539 - protein, 15 aa, Borrelia burgdorferi B31
RFSDVAKVAALQNPD

SEQ ID NO: 125540 - protein, 9 aa, Borrelia burgdorferi B31
VAKVAALQN

SEQ ID NO: 125541 - protein, 15 aa, Borrelia burgdorferi B31
KYAIIDPIYSNDPIP

SEQ ID NO: 125542 - protein, 9 aa, Borrelia burgdorferi B31
YAIIDPIYS

SEQ ID NO: 125543 - protein, 15 aa, Borrelia burgdorferi B31
APDNVITSTTKDVGR

SEQ ID NO: 125544 - protein, 9 aa, Borrelia burgdorferi B31
VITSTTKDV

SEQ ID NO: 125545 - protein, 15 aa, Borrelia burgdorferi B31
AIIDPIYSNDPIPAN

SEQ ID NO: 125546 - protein, 9 aa, Borrelia burgdorferi B31
IYSNDPIPA

SEQ ID NO: 125547 - protein, 15 aa, Borrelia burgdorferi B31
SDLEGLKDAGSDLIW

SEQ ID NO: 125548 - protein, 9 aa, Borrelia burgdorferi B31
LKDAGSDLI

SEQ ID NO: 125549 - protein, 15 aa, Borrelia burgdorferi B31
KGSLGSEIPKVSLII

SEQ ID NO: 125550 - protein, 9 aa, Borrelia burgdorferi B31
LGSEIPKVS

SEQ ID NO: 125551 - protein, 15 aa, Borrelia burgdorferi B31
EDQAYLAPDNVITST

SEQ ID NO: 125552 - protein, 9 aa, Borrelia burgdorferi B31
YLAPDNVIT

SEQ ID NO: 125553 - protein, 15 aa, Borrelia burgdorferi B31
YEAGAKYANKDIKIS

SEQ ID NO: 125554 - protein, 9 aa, Borrelia burgdorferi B31
YEAGAKYAN

SEQ ID NO: 125555 - protein, 15 aa, Borrelia burgdorferi B31
DEDQAYLAPDNVITS

SEQ ID NO: 125556 - protein, 9 aa, Borrelia burgdorferi B31
YLAPDNVIT

SEQ ID NO: 125557 - protein, 15 aa, Borrelia burgdorferi B31
VGFVRNPKMISFELE

SEQ ID NO: 125558 - protein, 9 aa, Borrelia burgdorferi B31
FVRNPKMIS

SEQ ID NO: 125559 - protein, 15 aa, Borrelia burgdorferi B31
VVGFVRNPKMISFEL

SEQ ID NO: 125560 - protein, 9 aa, Borrelia burgdorferi B31
FVRNPKMIS

SEQ ID NO: 125561 - protein, 15 aa, Borrelia burgdorferi B31
YSNDPIPANLVGMTF

SEQ ID NO: 125562 - protein, 9 aa, Borrelia burgdorferi B31
IPANLVGMT

SEQ ID NO: 125563 - protein, 15 aa, Borrelia burgdorferi B31
DVAKVAALQNPDMKY

SEQ ID NO: 125564 - protein, 9 aa, Borrelia burgdorferi B31
VAALQNPDM

SEQ ID NO: 125565 - protein, 15 aa, Borrelia burgdorferi B31
EIDNLSSKIINKEII

SEQ ID NO: 125566 - protein, 9 aa, Borrelia burgdorferi B31
IDNLSSKII

SEQ ID NO: 125567 - protein, 15 aa, Borrelia burgdorferi B31
VDEDQAYLAPDNVIT

SEQ ID NO: 125568 - protein, 9 aa, Borrelia burgdorferi B31
VDEDQAYLA

SEQ ID NO: 125569 - protein, 15 aa, Borrelia burgdorferi B31
IDNLSSKIINKEIIV

SEQ ID NO: 125570 - protein, 9 aa, Borrelia burgdorferi B31
IDNLSSKII

SEQ ID NO: 125571 - protein, 15 aa, Borrelia burgdorferi B31
DNVITSTTKDVGRAL

SEQ ID NO: 125572 - protein, 9 aa, Borrelia burgdorferi B31
VITSTTKDV

SEQ ID NO: 125573 - protein, 15 aa, Borrelia burgdorferi B31
GVVGFVRNPKMISFE

SEQ ID NO: 125574 - protein, 9 aa, Borrelia burgdorferi B31
FVRNPKMIS

SEQ ID NO: 125575 - protein, 15 aa, Borrelia burgdorferi B31
AKYANKDIKISTQYI

SEQ ID NO: 125576 - protein, 9 aa, Borrelia burgdorferi B31
YANKDIKIS

SEQ ID NO: 125577 - protein, 15 aa, Borrelia burgdorferi B31
EGVVGFVRNPKMISF

SEQ ID NO: 125578 - protein, 9 aa, Borrelia burgdorferi B31
FVRNPKMIS

SEQ ID NO: 125579 - protein, 15 aa, Borrelia burgdorferi B31
GKGSLGSEIPKVSLI

SEQ ID NO: 125580 - protein, 9 aa, Borrelia burgdorferi B31
LGSEIPKVS

SEQ ID NO: 125581 - protein, 15 aa, Borrelia burgdorferi B31
MNKILLLILLESIVF

SEQ ID NO: 125582 - protein, 9 aa, Borrelia burgdorferi B31
MNKILLLIL

SEQ ID NO: 125583 - protein, 15 aa, Borrelia burgdorferi B31
KDVGRALNIFTSNHL

SEQ ID NO: 125584 - protein, 9 aa, Borrelia burgdorferi B31
VGRALNIFT

SEQ ID NO: 125585 - protein, 14 aa, Borrelia burgdorferi B31
GYRFSDVAKVAALQ

SEQ ID NO: 125586 - protein, 9 aa, Borrelia burgdorferi B31
YRFSDVAKV

SEQ ID NO: 125587 - protein, 15 aa, Borrelia burgdorferi B31
GSLGSEIPKVSLIID

SEQ ID NO: 125588 - protein, 9 aa, Borrelia burgdorferi B31
LGSEIPKVS

SEQ ID NO: 125589 - protein, 15 aa, Borrelia burgdorferi B31
LEGLKDAGSDLIWLI

SEQ ID NO: 125590 - protein, 9 aa, Borrelia burgdorferi B31
LKDAGSDLI

SEQ ID NO: 125591 - protein, 15 aa, Borrelia burgdorferi B31
NKILLLILLESIVFL

SEQ ID NO: 125592 - protein, 9 aa, Borrelia burgdorferi B31
LILLESIVF

SEQ ID NO: 125593 - protein, 15 aa, Borrelia burgdorferi B31
IIDPIYSNDPIPANL

SEQ ID NO: 125594 - protein, 9 aa, Borrelia burgdorferi B31
IYSNDPIPA

SEQ ID NO: 125595 - protein, 15 aa, Borrelia burgdorferi B31
EGLKDAGSDLIWLIG

SEQ ID NO: 125596 - protein, 9 aa, Borrelia burgdorferi B31
LKDAGSDLI

SEQ ID NO: 125597 - protein, 15 aa, Borrelia burgdorferi B31
AGAKYANKDIKISTQ

SEQ ID NO: 125598 - protein, 9 aa, Borrelia burgdorferi B31
YANKDIKIS

SEQ ID NO: 125599 - protein, 15 aa, Borrelia burgdorferi B31
IIHHAAGLGGIGAIE

SEQ ID NO: 125600 - protein, 9 aa, Borrelia burgdorferi B31
IHHAAGLGG

SEQ ID NO: 125601 - protein, 15 aa, Borrelia burgdorferi B31
EAGAKYANKDIKIST

SEQ ID NO: 125602 - protein, 9 aa, Borrelia burgdorferi B31
YANKDIKIS

SEQ ID NO: 125603 - protein, 15 aa, Borrelia burgdorferi B31
GAKYANKDIKISTQY

SEQ ID NO: 125604 - protein, 9 aa, Borrelia burgdorferi B31
YANKDIKIS

SEQ ID NO: 125605 - protein, 15 aa, Borrelia burgdorferi B31
IWLIGYRFSDVAKVA

SEQ ID NO: 125606 - protein, 9 aa, Borrelia burgdorferi B31
YRFSDVAKV

SEQ ID NO: 125607 - protein, 15 aa, Borrelia burgdorferi B31
LIGYRFSDVAKVAAL

SEQ ID NO: 125608 - protein, 9 aa, Borrelia burgdorferi B31
YRFSDVAKV

SEQ ID NO: 125609 - protein, 15 aa, Borrelia burgdorferi B31
WLIGYRFSDVAKVAA

SEQ ID NO: 125610 - protein, 9 aa, Borrelia burgdorferi B31
YRFSDVAKV

SEQ ID NO: 125611 - protein, 15 aa, Borrelia burgdorferi B31
GGKLINYGLKEGVVG

SEQ ID NO: 125612 - protein, 9 aa, Borrelia burgdorferi B31
LINYGLKEG

SEQ ID NO: 125613 - protein, 15 aa, Borrelia burgdorferi B31
GKLINYGLKEGVVGF

SEQ ID NO: 125614 - protein, 9 aa, Borrelia burgdorferi B31
YGLKEGVVG

SEQ ID NO: 125615 - protein, 15 aa, Borrelia burgdorferi B31
KILLLILLESIVFLS

SEQ ID NO: 125616 - protein, 9 aa, Borrelia burgdorferi B31
LILLESIVF

SEQ ID NO: 125617 - protein, 15 aa, Borrelia burgdorferi B31
IELVLKESSSNSYLS

SEQ ID NO: 125618 - protein, 9 aa, Borrelia burgdorferi B31
LKESSSNSY

SEQ ID NO: 125619 - protein, 15 aa, Borrelia burgdorferi B31
KIELVLKESSSNSYL

SEQ ID NO: 125620 - protein, 9 aa, Borrelia burgdorferi B31
LKESSSNSY

SEQ ID NO: 125621 - protein, 15 aa, Borrelia burgdorferi B31
VGRALNIFTSNHLKT

SEQ ID NO: 125622 - protein, 9 aa, Borrelia burgdorferi B31
LNIFTSNHL

SEQ ID NO: 125623 - protein, 15 aa, Borrelia burgdorferi B31
FKIELVLKESSSNSY

SEQ ID NO: 125624 - protein, 9 aa, Borrelia burgdorferi B31
LVLKESSSN

SEQ ID NO: 125625 - protein, 15 aa, Borrelia burgdorferi B31
KLINYGLKEGVVGFV

SEQ ID NO: 125626 - protein, 9 aa, Borrelia burgdorferi B31
YGLKEGVVG

SEQ ID NO: 125627 - protein, 15 aa, Borrelia burgdorferi B31
ILLLILLESIVFLSC

SEQ ID NO: 125628 - protein, 9 aa, Borrelia burgdorferi B31
LILLESIVF

SEQ ID NO: 125629 - protein, 15 aa, Borrelia burgdorferi B31
GRALNIFTSNHLKTN

SEQ ID NO: 125630 - protein, 9 aa, Borrelia burgdorferi B31
LNIFTSNHL

SEQ ID NO: 125631 - protein, 15 aa, Borrelia burgdorferi B31
LINYGLKEGVVGFVR

SEQ ID NO: 125632 - protein, 9 aa, Borrelia burgdorferi B31
YGLKEGVVG

SEQ ID NO: 125633 - protein, 15 aa, Borrelia burgdorferi B31
DVGRALNIFTSNHLK

SEQ ID NO: 125634 - protein, 9 aa, Borrelia burgdorferi B31
LNIFTSNHL

SEQ ID NO: 125635 - protein, 15 aa, Borrelia burgdorferi B31
NDPIPANLVGMTFRA

SEQ ID NO: 125636 - protein, 9 aa, Borrelia burgdorferi B31
IPANLVGMT

SEQ ID NO: 125637 - protein, 15 aa, Borrelia burgdorferi B31
DKSFNESALNGVKKV

SEQ ID NO: 125638 - protein, 9 aa, Borrelia burgdorferi B31
FNESALNGV

SEQ ID NO: 125639 - protein, 15 aa, Borrelia burgdorferi B31
RALNIFTSNHLKTNT

SEQ ID NO: 125640 - protein, 9 aa, Borrelia burgdorferi B31
LNIFTSNHL

SEQ ID NO: 125641 - protein, 15 aa, Borrelia burgdorferi B31
GFVRNPKMISFELEK

SEQ ID NO: 125642 - protein, 9 aa, Borrelia burgdorferi B31
VRNPKMISF

SEQ ID NO: 125643 - protein, 15 aa, Borrelia burgdorferi B31
ELVLKESSSNSYLSD

SEQ ID NO: 125644 - protein, 9 aa, Borrelia burgdorferi B31
LKESSSNSY

SEQ ID NO: 125645 - protein, 15 aa, Borrelia burgdorferi B31
SNDPIPANLVGMTFR

SEQ ID NO: 125646 - protein, 9 aa, Borrelia burgdorferi B31
IPANLVGMT

SEQ ID NO: 125647 - protein, 15 aa, Borrelia burgdorferi B31
DDKSFNESALNGVKK

SEQ ID NO: 125648 - protein, 9 aa, Borrelia burgdorferi B31
FNESALNGV

SEQ ID NO: 125649 - protein, 15 aa, Borrelia burgdorferi B31
LLLILLESIVFLSCS

SEQ ID NO: 125650 - protein, 9 aa, Borrelia burgdorferi B31
LILLESIVF

SEQ ID NO: 125651 - protein, 15 aa, Borrelia burgdorferi B31
AYLAPDNVITSTTKD

SEQ ID NO: 125652 - protein, 9 aa, Borrelia burgdorferi B31
YLAPDNVIT

SEQ ID NO: 125653 - protein, 15 aa, Borrelia burgdorferi B31
ALQNPDMKYAIIDPI

SEQ ID NO: 125654 - protein, 9 aa, Borrelia burgdorferi B31
LQNPDMKYA

SEQ ID NO: 125655 - protein, 15 aa, Borrelia burgdorferi B31
FDDKSFNESALNGVK

SEQ ID NO: 125656 - protein, 9 aa, Borrelia burgdorferi B31
FNESALNGV

SEQ ID NO: 125657 - protein, 15 aa, Borrelia burgdorferi B31
TFDDKSFNESALNGV

SEQ ID NO: 125658 - protein, 9 aa, Borrelia burgdorferi B31
SFNESALNG

SEQ ID NO: 125659 - protein, 15 aa, Borrelia burgdorferi B31
LQNPDMKYAIIDPIY

SEQ ID NO: 125660 - protein, 9 aa, Borrelia burgdorferi B31
LQNPDMKYA

SEQ ID NO: 125661 - protein, 15 aa, Borrelia burgdorferi B31
TKDVGRALNIFTSNH

SEQ ID NO: 125662 - protein, 9 aa, Borrelia burgdorferi B31
VGRALNIFT

SEQ ID NO: 125663 - protein, 15 aa, Borrelia burgdorferi B31
TTKDVGRALNIFTSN

SEQ ID NO: 125664 - protein, 9 aa, Borrelia burgdorferi B31
VGRALNIFT

SEQ ID NO: 125665 - protein, 15 aa, Borrelia burgdorferi B31
KEGVVGFVRNPKMIS

SEQ ID NO: 125666 - protein, 9 aa, Borrelia burgdorferi B31
VGFVRNPKM

SEQ ID NO: 125667 - protein, 15 aa, Borrelia burgdorferi B31
SIVFLSCSGKGSLGS

SEQ ID NO: 125668 - protein, 9 aa, Borrelia burgdorferi B31
FLSCSGKGS

SEQ ID NO: 125669 - protein, 15 aa, Borrelia burgdorferi B31
YSDEIDIIHHAAGLG

SEQ ID NO: 125670 - protein, 9 aa, Borrelia burgdorferi B31
EIDIIHHAA

SEQ ID NO: 125671 - protein, 15 aa, Borrelia burgdorferi B31
INYGLKEGVVGFVRN

SEQ ID NO: 125672 - protein, 9 aa, Borrelia burgdorferi B31
YGLKEGVVG

SEQ ID NO: 125673 - protein, 15 aa, Borrelia burgdorferi B31
STTKDVGRALNIFTS

SEQ ID NO: 125674 - protein, 9 aa, Borrelia burgdorferi B31
VGRALNIFT

SEQ ID NO: 125675 - protein, 15 aa, Borrelia burgdorferi B31
FKIELVLKESSSNSY

SEQ ID NO: 125676 - protein, 9 aa, Borrelia burgdorferi B31
VLKESSSNS

SEQ ID NO: 125677 - protein, 15 aa, Borrelia burgdorferi B31
IELVLKESSSNSYLS

SEQ ID NO: 125678 - protein, 9 aa, Borrelia burgdorferi B31
LKESSSNSY

SEQ ID NO: 125679 - protein, 15 aa, Borrelia burgdorferi B31
ELVLKESSSNSYLSD

SEQ ID NO: 125680 - protein, 9 aa, Borrelia burgdorferi B31
LKESSSNSY

SEQ ID NO: 125681 - protein, 15 aa, Borrelia burgdorferi B31
KIELVLKESSSNSYL

SEQ ID NO: 125682 - protein, 9 aa, Borrelia burgdorferi B31
LKESSSNSY

SEQ ID NO: 125683 - protein, 15 aa, Borrelia burgdorferi B31
LVLKESSSNSYLSDL

SEQ ID NO: 125684 - protein, 9 aa, Borrelia burgdorferi B31
LKESSSNSY

SEQ ID NO: 125685 - protein, 15 aa, Borrelia burgdorferi B31
KIINKEIIVPSNKES

SEQ ID NO: 125686 - protein, 9 aa, Borrelia burgdorferi B31
INKEIIVPS

SEQ ID NO: 125687 - protein, 15 aa, Borrelia burgdorferi B31
SKIINKEIIVPSNKE

SEQ ID NO: 125688 - protein, 9 aa, Borrelia burgdorferi B31
INKEIIVPS

SEQ ID NO: 125689 - protein, 15 aa, Borrelia burgdorferi B31
SSKIINKEIIVPSNK

SEQ ID NO: 125690 - protein, 9 aa, Borrelia burgdorferi B31
INKEIIVPS

SEQ ID NO: 125691 - protein, 15 aa, Borrelia burgdorferi B31
LSSKIINKEIIVPSN

SEQ ID NO: 125692 - protein, 9 aa, Borrelia burgdorferi B31
INKEIIVPS

SEQ ID NO: 125693 - protein, 15 aa, Borrelia burgdorferi B31
NLSSKIINKEIIVPS

SEQ ID NO: 125694 - protein, 9 aa, Borrelia burgdorferi B31
LSSKIINKE

SEQ ID NO: 125695 - protein, 15 aa, Borrelia burgdorferi B31
EGVVGFVRNPKMISF

SEQ ID NO: 125696 - protein, 9 aa, Borrelia burgdorferi B31
FVRNPKMIS

SEQ ID NO: 125697 - protein, 15 aa, Borrelia burgdorferi B31
KEGVVGFVRNPKMIS

SEQ ID NO: 125698 - protein, 9 aa, Borrelia burgdorferi B31
VVGFVRNPK

SEQ ID NO: 125699 - protein, 15 aa, Borrelia burgdorferi B31
ISFELEKEIDNLSSK

SEQ ID NO: 125700 - protein, 9 aa, Borrelia burgdorferi B31
LEKEIDNLS

SEQ ID NO: 125701 - protein, 15 aa, Borrelia burgdorferi B31
MISFELEKEIDNLSS

SEQ ID NO: 125702 - protein, 9 aa, Borrelia burgdorferi B31
LEKEIDNLS

SEQ ID NO: 125703 - protein, 15 aa, Borrelia burgdorferi B31
GVVGFVRNPKMISFE

SEQ ID NO: 125704 - protein, 9 aa, Borrelia burgdorferi B31
FVRNPKMIS

SEQ ID NO: 125705 - protein, 15 aa, Borrelia burgdorferi B31
FELEKEIDNLSSKII

SEQ ID NO: 125706 - protein, 9 aa, Borrelia burgdorferi B31
LEKEIDNLS

SEQ ID NO: 125707 - protein, 15 aa, Borrelia burgdorferi B31
SFELEKEIDNLSSKI

SEQ ID NO: 125708 - protein, 9 aa, Borrelia burgdorferi B31
LEKEIDNLS

SEQ ID NO: 125709 - protein, 15 aa, Borrelia burgdorferi B31
AIIDPIYSNDPIPAN

SEQ ID NO: 125710 - protein, 9 aa, Borrelia burgdorferi B31
IYSNDPIPA

SEQ ID NO: 125711 - protein, 15 aa, Borrelia burgdorferi B31
VVGFVRNPKMISFEL

SEQ ID NO: 125712 - protein, 9 aa, Borrelia burgdorferi B31
FVRNPKMIS

SEQ ID NO: 125713 - protein, 15 aa, Borrelia burgdorferi B31
VGFVRNPKMISFELE

SEQ ID NO: 125714 - protein, 9 aa, Borrelia burgdorferi B31
FVRNPKMIS

SEQ ID NO: 125715 - protein, 15 aa, Borrelia burgdorferi B31
IIDPIYSNDPIPANL

SEQ ID NO: 125716 - protein, 9 aa, Borrelia burgdorferi B31
IYSNDPIPA

SEQ ID NO: 125717 - protein, 15 aa, Borrelia burgdorferi B31
IDPIYSNDPIPANLV

SEQ ID NO: 125718 - protein, 9 aa, Borrelia burgdorferi B31
IYSNDPIPA

SEQ ID NO: 125719 - protein, 15 aa, Borrelia burgdorferi B31
KMISFELEKEIDNLS

SEQ ID NO: 125720 - protein, 9 aa, Borrelia burgdorferi B31
MISFELEKE

SEQ ID NO: 125721 - protein, 15 aa, Borrelia burgdorferi B31
DPIYSNDPIPANLVG

SEQ ID NO: 125722 - protein, 9 aa, Borrelia burgdorferi B31
IYSNDPIPA

SEQ ID NO: 125723 - protein, 15 aa, Borrelia burgdorferi B31
VLKESSSNSYLSDLE

SEQ ID NO: 125724 - protein, 9 aa, Borrelia burgdorferi B31
LKESSSNSY

SEQ ID NO: 125725 - protein, 15 aa, Borrelia burgdorferi B31
LKESSSNSYLSDLEG

SEQ ID NO: 125726 - protein, 9 aa, Borrelia burgdorferi B31
LKESSSNSY

SEQ ID NO: 125727 - protein, 15 aa, Borrelia burgdorferi B31
RALNIFTSNHLKTNT

SEQ ID NO: 125728 - protein, 9 aa, Borrelia burgdorferi B31
LNIFTSNHL

SEQ ID NO: 125729 - protein, 15 aa, Borrelia burgdorferi B31
GRALNIFTSNHLKTN

SEQ ID NO: 125730 - protein, 9 aa, Borrelia burgdorferi B31
LNIFTSNHL

SEQ ID NO: 125731 - protein, 15 aa, Borrelia burgdorferi B31
VGRALNIFTSNHLKT

SEQ ID NO: 125732 - protein, 9 aa, Borrelia burgdorferi B31
LNIFTSNHL

SEQ ID NO: 125733 - protein, 15 aa, Borrelia burgdorferi B31
IINKEIIVPSNKESY

SEQ ID NO: 125734 - protein, 9 aa, Borrelia burgdorferi B31
INKEIIVPS

SEQ ID NO: 125735 - protein, 15 aa, Borrelia burgdorferi B31
KDVGRALNIFTSNHL

SEQ ID NO: 125736 - protein, 9 aa, Borrelia burgdorferi B31
VGRALNIFT

SEQ ID NO: 125737 - protein, 15 aa, Borrelia burgdorferi B31
INKEIIVPSNKESYE

SEQ ID NO: 125738 - protein, 9 aa, Borrelia burgdorferi B31
INKEIIVPS

SEQ ID NO: 125739 - protein, 15 aa, Borrelia burgdorferi B31
DVGRALNIFTSNHLK

SEQ ID NO: 125740 - protein, 9 aa, Borrelia burgdorferi B31
LNIFTSNHL

SEQ ID NO: 125741 - protein, 15 aa, Borrelia burgdorferi B31
YAIIDPIYSNDPIPA

SEQ ID NO: 125742 - protein, 9 aa, Borrelia burgdorferi B31
IDPIYSNDP

SEQ ID NO: 125743 - protein, 15 aa, Borrelia burgdorferi B31
VGRALNIFTSNHLKT

SEQ ID NO: 125744 - protein, 9 aa, Borrelia burgdorferi B31
ALNIFTSNH

SEQ ID NO: 125745 - protein, 15 aa, Borrelia burgdorferi B31
GRALNIFTSNHLKTN

SEQ ID NO: 125746 - protein, 9 aa, Borrelia burgdorferi B31
ALNIFTSNH

SEQ ID NO: 125747 - protein, 15 aa, Borrelia burgdorferi B31
KDVGRALNIFTSNHL

SEQ ID NO: 125748 - protein, 9 aa, Borrelia burgdorferi B31
ALNIFTSNH

SEQ ID NO: 125749 - protein, 15 aa, Borrelia burgdorferi B31
DVGRALNIFTSNHLK

SEQ ID NO: 125750 - protein, 9 aa, Borrelia burgdorferi B31
ALNIFTSNH

SEQ ID NO: 125751 - protein, 15 aa, Borrelia burgdorferi B31
TKDVGRALNIFTSNH

SEQ ID NO: 125752 - protein, 9 aa, Borrelia burgdorferi B31
VGRALNIFT

SEQ ID NO: 125753 - protein, 15 aa, Borrelia burgdorferi B31
RALNIFTSNHLKTNT

SEQ ID NO: 125754 - protein, 9 aa, Borrelia burgdorferi B31
ALNIFTSNH

SEQ ID NO: 125755 - protein, 15 aa, Borrelia burgdorferi B31
ALNIFTSNHLKTNTF

SEQ ID NO: 125756 - protein, 9 aa, Borrelia burgdorferi B31
ALNIFTSNH

SEQ ID NO: 125757 - protein, 15 aa, Borrelia burgdorferi B31
FKIELVLKESSSNSY

SEQ ID NO: 125758 - protein, 9 aa, Borrelia burgdorferi B31
VLKESSSNS

SEQ ID NO: 125759 - protein, 15 aa, Borrelia burgdorferi B31
KIELVLKESSSNSYL

SEQ ID NO: 125760 - protein, 9 aa, Borrelia burgdorferi B31
VLKESSSNS

SEQ ID NO: 125761 - protein, 15 aa, Borrelia burgdorferi B31
IELVLKESSSNSYLS

SEQ ID NO: 125762 - protein, 9 aa, Borrelia burgdorferi B31
VLKESSSNS

SEQ ID NO: 125763 - protein, 15 aa, Borrelia burgdorferi B31
ELVLKESSSNSYLSD

SEQ ID NO: 125764 - protein, 9 aa, Borrelia burgdorferi B31
VLKESSSNS

SEQ ID NO: 125765 - protein, 15 aa, Borrelia burgdorferi B31
AIIDPIYSNDPIPAN

SEQ ID NO: 125766 - protein, 9 aa, Borrelia burgdorferi B31
IYSNDPIPA

SEQ ID NO: 125767 - protein, 15 aa, Borrelia burgdorferi B31
IIDPIYSNDPIPANL

SEQ ID NO: 125768 - protein, 9 aa, Borrelia burgdorferi B31
YSNDPIPAN

SEQ ID NO: 125769 - protein, 15 aa, Borrelia burgdorferi B31
IDPIYSNDPIPANLV

SEQ ID NO: 125770 - protein, 9 aa, Borrelia burgdorferi B31
YSNDPIPAN

SEQ ID NO: 125771 - protein, 15 aa, Borrelia burgdorferi B31
DPIYSNDPIPANLVG

SEQ ID NO: 125772 - protein, 9 aa, Borrelia burgdorferi B31
YSNDPIPAN

SEQ ID NO: 125773 - protein, 15 aa, Borrelia burgdorferi B31
PIYSNDPIPANLVGM

SEQ ID NO: 125774 - protein, 9 aa, Borrelia burgdorferi B31
YSNDPIPAN

SEQ ID NO: 125775 - protein, 15 aa, Borrelia burgdorferi B31
KIINKEIIVPSNKES

SEQ ID NO: 125776 - protein, 9 aa, Borrelia burgdorferi B31
EIIVPSNKE

SEQ ID NO: 125777 - protein, 15 aa, Borrelia burgdorferi B31
KEGVVGFVRNPKMIS

SEQ ID NO: 125778 - protein, 9 aa, Borrelia burgdorferi B31
VVGFVRNPK

SEQ ID NO: 125779 - protein, 15 aa, Borrelia burgdorferi B31
EGVVGFVRNPKMISF

SEQ ID NO: 125780 - protein, 9 aa, Borrelia burgdorferi B31
FVRNPKMIS

SEQ ID NO: 125781 - protein, 15 aa, Borrelia burgdorferi B31
IYSNDPIPANLVGMT

SEQ ID NO: 125782 - protein, 9 aa, Borrelia burgdorferi B31
YSNDPIPAN

SEQ ID NO: 125783 - protein, 15 aa, Borrelia burgdorferi B31
INKEIIVPSNKESYE

SEQ ID NO: 125784 - protein, 9 aa, Borrelia burgdorferi B31
EIIVPSNKE

SEQ ID NO: 125785 - protein, 15 aa, Borrelia burgdorferi B31
SKIINKEIIVPSNKE

SEQ ID NO: 125786 - protein, 9 aa, Borrelia burgdorferi B31
INKEIIVPS

SEQ ID NO: 125787 - protein, 15 aa, Borrelia burgdorferi B31
GVVGFVRNPKMISFE

SEQ ID NO: 125788 - protein, 9 aa, Borrelia burgdorferi B31
FVRNPKMIS

SEQ ID NO: 125789 - protein, 15 aa, Borrelia burgdorferi B31
IINKEIIVPSNKESY

SEQ ID NO: 125790 - protein, 9 aa, Borrelia burgdorferi B31
EIIVPSNKE

SEQ ID NO: 125791 - protein, 15 aa, Borrelia burgdorferi B31
VGRALNIFTSNHLKT

SEQ ID NO: 125792 - protein, 9 aa, Borrelia burgdorferi B31
LNIFTSNHL

SEQ ID NO: 125793 - protein, 15 aa, Borrelia burgdorferi B31
GRALNIFTSNHLKTN

SEQ ID NO: 125794 - protein, 9 aa, Borrelia burgdorferi B31
LNIFTSNHL

SEQ ID NO: 125795 - protein, 15 aa, Borrelia burgdorferi B31
DVGRALNIFTSNHLK

SEQ ID NO: 125796 - protein, 9 aa, Borrelia burgdorferi B31
LNIFTSNHL

SEQ ID NO: 125797 - protein, 15 aa, Borrelia burgdorferi B31
KDVGRALNIFTSNHL

SEQ ID NO: 125798 - protein, 9 aa, Borrelia burgdorferi B31
ALNIFTSNH

SEQ ID NO: 125799 - protein, 15 aa, Borrelia burgdorferi B31
RALNIFTSNHLKTNT

SEQ ID NO: 125800 - protein, 9 aa, Borrelia burgdorferi B31
LNIFTSNHL

SEQ ID NO: 125801 - protein, 15 aa, Borrelia burgdorferi B31
LAPDNVITSTTKDVG

SEQ ID NO: 125802 - protein, 9 aa, Borrelia burgdorferi B31
VITSTTKDV

SEQ ID NO: 125803 - protein, 15 aa, Borrelia burgdorferi B31
APDNVITSTTKDVGR

SEQ ID NO: 125804 - protein, 9 aa, Borrelia burgdorferi B31
VITSTTKDV

SEQ ID NO: 125805 - protein, 15 aa, Borrelia burgdorferi B31
PDNVITSTTKDVGRA

SEQ ID NO: 125806 - protein, 9 aa, Borrelia burgdorferi B31
VITSTTKDV

SEQ ID NO: 125807 - protein, 15 aa, Borrelia burgdorferi B31
DNVITSTTKDVGRAL

SEQ ID NO: 125808 - protein, 9 aa, Borrelia burgdorferi B31
VITSTTKDV

SEQ ID NO: 125809 - protein, 15 aa, Borrelia burgdorferi B31
WLIGYRFSDVAKVAA

SEQ ID NO: 125810 - protein, 9 aa, Borrelia burgdorferi B31
YRFSDVAKV

SEQ ID NO: 125811 - protein, 15 aa, Borrelia burgdorferi B31
LIGYRFSDVAKVAAL

SEQ ID NO: 125812 - protein, 9 aa, Borrelia burgdorferi B31
YRFSDVAKV

SEQ ID NO: 125813 - protein, 15 aa, Borrelia burgdorferi B31
IGYRFSDVAKVAALQ

SEQ ID NO: 125814 - protein, 9 aa, Borrelia burgdorferi B31
YRFSDVAKV

SEQ ID NO: 125815 - protein, 15 aa, Borrelia burgdorferi B31
LEGLKDAGSDLIWLI

SEQ ID NO: 125816 - protein, 9 aa, Borrelia burgdorferi B31
LKDAGSDLI

SEQ ID NO: 125817 - protein, 15 aa, Borrelia burgdorferi B31
GAFLTGYIAAKLSKT

SEQ ID NO: 125818 - protein, 9 aa, Borrelia burgdorferi B31
LTGYIAAKL

SEQ ID NO: 125819 - protein, 15 aa, Borrelia burgdorferi B31
DLEGLKDAGSDLIWL

SEQ ID NO: 125820 - protein, 9 aa, Borrelia burgdorferi B31
LKDAGSDLI

SEQ ID NO: 125821 - protein, 15 aa, Borrelia burgdorferi B31
SDLEGLKDAGSDLIW

SEQ ID NO: 125822 - protein, 9 aa, Borrelia burgdorferi B31
LKDAGSDLI

SEQ ID NO: 125823 - protein, 15 aa, Borrelia burgdorferi B31
LSDLEGLKDAGSDLI

SEQ ID NO: 125824 - protein, 9 aa, Borrelia burgdorferi B31
LEGLKDAGS

SEQ ID NO: 125825 - protein, 15 aa, Borrelia burgdorferi B31
LIWLIGYRFSDVAKV

SEQ ID NO: 125826 - protein, 9 aa, Borrelia burgdorferi B31
LIGYRFSDV

SEQ ID NO: 125827 - protein, 15 aa, Borrelia burgdorferi B31
EGLKDAGSDLIWLIG

SEQ ID NO: 125828 - protein, 9 aa, Borrelia burgdorferi B31
LKDAGSDLI

SEQ ID NO: 125829 - protein, 15 aa, Borrelia burgdorferi B31
IWLIGYRFSDVAKVA

SEQ ID NO: 125830 - protein, 9 aa, Borrelia burgdorferi B31
YRFSDVAKV

SEQ ID NO: 125831 - protein, 15 aa, Borrelia burgdorferi B31
AFLTGYIAAKLSKTG

SEQ ID NO: 125832 - protein, 9 aa, Borrelia burgdorferi B31
YIAAKLSKT

SEQ ID NO: 125833 - protein, 15 aa, Borrelia burgdorferi B31
GSDLIWLIGYRFSDV

SEQ ID NO: 125834 - protein, 9 aa, Borrelia burgdorferi B31
LIWLIGYRF

SEQ ID NO: 125835 - protein, 15 aa, Borrelia burgdorferi B31
SDLIWLIGYRFSDVA

SEQ ID NO: 125836 - protein, 9 aa, Borrelia burgdorferi B31
LIWLIGYRF

SEQ ID NO: 125837 - protein, 15 aa, Borrelia burgdorferi B31
AGSDLIWLIGYRFSD

SEQ ID NO: 125838 - protein, 9 aa, Borrelia burgdorferi B31
LIWLIGYRF

SEQ ID NO: 125839 - protein, 15 aa, Borrelia burgdorferi B31
DAGSDLIWLIGYRFS

SEQ ID NO: 125840 - protein, 9 aa, Borrelia burgdorferi B31
LIWLIGYRF

SEQ ID NO: 125841 - protein, 15 aa, Borrelia burgdorferi B31
PIPANLVGMTFRAQE

SEQ ID NO: 125842 - protein, 9 aa, Borrelia burgdorferi B31
LVGMTFRAQ

SEQ ID NO: 125843 - protein, 15 aa, Borrelia burgdorferi B31
PANLVGMTFRAQEGA

SEQ ID NO: 125844 - protein, 9 aa, Borrelia burgdorferi B31
LVGMTFRAQ

SEQ ID NO: 125845 - protein, 15 aa, Borrelia burgdorferi B31
IPANLVGMTFRAQEG

SEQ ID NO: 125846 - protein, 9 aa, Borrelia burgdorferi B31
LVGMTFRAQ

SEQ ID NO: 125847 - protein, 15 aa, Borrelia burgdorferi B31
DLIWLIGYRFSDVAK

SEQ ID NO: 125848 - protein, 9 aa, Borrelia burgdorferi B31
LIWLIGYRF

SEQ ID NO: 125849 - protein, 15 aa, Borrelia burgdorferi B31
ANLVGMTFRAQEGAF

SEQ ID NO: 125850 - protein, 9 aa, Borrelia burgdorferi B31
LVGMTFRAQ

SEQ ID NO: 125851 - protein, 15 aa, Borrelia burgdorferi B31
DPIPANLVGMTFRAQ

SEQ ID NO: 125852 - protein, 9 aa, Borrelia burgdorferi B31
PANLVGMTF

SEQ ID NO: 125853 - protein, 15 aa, Borrelia burgdorferi B31
KYANKDIKISTQYIG

SEQ ID NO: 125854 - protein, 9 aa, Borrelia burgdorferi B31
YANKDIKIS

SEQ ID NO: 125855 - protein, 15 aa, Borrelia burgdorferi B31
NLSSKIINKEIIVPS

SEQ ID NO: 125856 - protein, 9 aa, Borrelia burgdorferi B31
IINKEIIVP

SEQ ID NO: 125857 - protein, 15 aa, Borrelia burgdorferi B31
LSSKIINKEIIVPSN

SEQ ID NO: 125858 - protein, 9 aa, Borrelia burgdorferi B31
INKEIIVPS

SEQ ID NO: 125859 - protein, 15 aa, Borrelia burgdorferi B31
YANKDIKISTQYIGS

SEQ ID NO: 125860 - protein, 9 aa, Borrelia burgdorferi B31
IKISTQYIG

SEQ ID NO: 125861 - protein, 15 aa, Borrelia burgdorferi B31
SSKIINKEIIVPSNK

SEQ ID NO: 125862 - protein, 9 aa, Borrelia burgdorferi B31
IINKEIIVP

SEQ ID NO: 125863 - protein, 15 aa, Borrelia burgdorferi B31
SKIINKEIIVPSNKE

SEQ ID NO: 125864 - protein, 9 aa, Borrelia burgdorferi B31
IINKEIIVP

SEQ ID NO: 125865 - protein, 15 aa, Borrelia burgdorferi B31
ANKDIKISTQYIGSF

SEQ ID NO: 125866 - protein, 9 aa, Borrelia burgdorferi B31
IKISTQYIG

SEQ ID NO: 125867 - protein, 15 aa, Borrelia burgdorferi B31
NKDIKISTQYIGSFA

SEQ ID NO: 125868 - protein, 9 aa, Borrelia burgdorferi B31
IKISTQYIG

SEQ ID NO: 125869 - protein, 15 aa, Borrelia burgdorferi B31
KDIKISTQYIGSFAD

SEQ ID NO: 125870 - protein, 9 aa, Borrelia burgdorferi B31
IKISTQYIG

SEQ ID NO: 125871 - protein, 15 aa, Borrelia burgdorferi B31
VGRALNIFTSNHLKT

SEQ ID NO: 125872 - protein, 9 aa, Borrelia burgdorferi B31
LNIFTSNHL

SEQ ID NO: 125873 - protein, 15 aa, Borrelia burgdorferi B31
KIINKEIIVPSNKES

SEQ ID NO: 125874 - protein, 9 aa, Borrelia burgdorferi B31
INKEIIVPS

SEQ ID NO: 125875 - protein, 15 aa, Borrelia burgdorferi B31
EGVVGFVRNPKMISF

SEQ ID NO: 125876 - protein, 9 aa, Borrelia burgdorferi B31
FVRNPKMIS

SEQ ID NO: 125877 - protein, 15 aa, Borrelia burgdorferi B31
MNKILLLILLESIVF

SEQ ID NO: 125878 - protein, 9 aa, Borrelia burgdorferi B31
ILLLILLES

SEQ ID NO: 125879 - protein, 15 aa, Borrelia burgdorferi B31
KDVGRALNIFTSNHL

SEQ ID NO: 125880 - protein, 9 aa, Borrelia burgdorferi B31
VGRALNIFT

SEQ ID NO: 125881 - protein, 15 aa, Borrelia burgdorferi B31
DNLSSKIINKEIIVP

SEQ ID NO: 125882 - protein, 9 aa, Borrelia burgdorferi B31
LSSKIINKE

SEQ ID NO: 125883 - protein, 15 aa, Borrelia burgdorferi B31
RALNIFTSNHLKTNT

SEQ ID NO: 125884 - protein, 9 aa, Borrelia burgdorferi B31
LNIFTSNHL

SEQ ID NO: 125885 - protein, 15 aa, Borrelia burgdorferi B31
KEGVVGFVRNPKMIS

SEQ ID NO: 125886 - protein, 9 aa, Borrelia burgdorferi B31
VGFVRNPKM

SEQ ID NO: 125887 - protein, 15 aa, Borrelia burgdorferi B31
NKILLLILLESIVFL

SEQ ID NO: 125888 - protein, 9 aa, Borrelia burgdorferi B31
ILLLILLES

SEQ ID NO: 125889 - protein, 15 aa, Borrelia burgdorferi B31
GVVGFVRNPKMISFE

SEQ ID NO: 125890 - protein, 9 aa, Borrelia burgdorferi B31
FVRNPKMIS

SEQ ID NO: 125891 - protein, 15 aa, Borrelia burgdorferi B31
GRALNIFTSNHLKTN

SEQ ID NO: 125892 - protein, 9 aa, Borrelia burgdorferi B31
LNIFTSNHL

SEQ ID NO: 125893 - protein, 15 aa, Borrelia burgdorferi B31
GGKLINYGLKEGVVG

SEQ ID NO: 125894 - protein, 9 aa, Borrelia burgdorferi B31
LINYGLKEG

SEQ ID NO: 125895 - protein, 15 aa, Borrelia burgdorferi B31
VVGFVRNPKMISFEL

SEQ ID NO: 125896 - protein, 9 aa, Borrelia burgdorferi B31
FVRNPKMIS

SEQ ID NO: 125897 - protein, 15 aa, Borrelia burgdorferi B31
DVGRALNIFTSNHLK

SEQ ID NO: 125898 - protein, 9 aa, Borrelia burgdorferi B31
LNIFTSNHL

SEQ ID NO: 125899 - protein, 15 aa, Borrelia burgdorferi B31
ILLLILLESIVFLSC

SEQ ID NO: 125900 - protein, 9 aa, Borrelia burgdorferi B31
LILLESIVF

SEQ ID NO: 125901 - protein, 15 aa, Borrelia burgdorferi B31
KILLLILLESIVFLS

SEQ ID NO: 125902 - protein, 9 aa, Borrelia burgdorferi B31
ILLLILLES

SEQ ID NO: 125903 - protein, 15 aa, Borrelia burgdorferi B31
ELEKEIDNLSSKIIN

SEQ ID NO: 125904 - protein, 9 aa, Borrelia burgdorferi B31
IDNLSSKII

SEQ ID NO: 125905 - protein, 15 aa, Borrelia burgdorferi B31
GKLINYGLKEGVVGF

SEQ ID NO: 125906 - protein, 9 aa, Borrelia burgdorferi B31
LINYGLKEG

SEQ ID NO: 125907 - protein, 15 aa, Borrelia burgdorferi B31
LEKEIDNLSSKIINK

SEQ ID NO: 125908 - protein, 9 aa, Borrelia burgdorferi B31
IDNLSSKII

SEQ ID NO: 125909 - protein, 15 aa, Borrelia burgdorferi B31
EKEIDNLSSKIINKE

SEQ ID NO: 125910 - protein, 9 aa, Borrelia burgdorferi B31
IDNLSSKII

SEQ ID NO: 125911 - protein, 15 aa, Borrelia burgdorferi B31
KEIDNLSSKIINKEI

SEQ ID NO: 125912 - protein, 9 aa, Borrelia burgdorferi B31
IDNLSSKII

SEQ ID NO: 125913 - protein, 15 aa, Borrelia burgdorferi B31
FELEKEIDNLSSKII

SEQ ID NO: 125914 - protein, 9 aa, Borrelia burgdorferi B31
LEKEIDNLS

SEQ ID NO: 125915 - protein, 15 aa, Borrelia burgdorferi B31
IINKEIIVPSNKESY

SEQ ID NO: 125916 - protein, 9 aa, Borrelia burgdorferi B31
IINKEIIVP

SEQ ID NO: 125917 - protein, 15 aa, Borrelia burgdorferi B31
ALNIFTSNHLKTNTF

SEQ ID NO: 125918 - protein, 9 aa, Borrelia burgdorferi B31
LNIFTSNHL

SEQ ID NO: 125919 - protein, 15 aa, Borrelia burgdorferi B31
LNIFTSNHLKTNTFE

SEQ ID NO: 125920 - protein, 9 aa, Borrelia burgdorferi B31
LNIFTSNHL

SEQ ID NO: 125921 - protein, 15 aa, Borrelia burgdorferi B31
VGFVRNPKMISFELE

SEQ ID NO: 125922 - protein, 9 aa, Borrelia burgdorferi B31
FVRNPKMIS

SEQ ID NO: 125923 - protein, 15 aa, Borrelia burgdorferi B31
IDNLSSKIINKEIIV

SEQ ID NO: 125924 - protein, 9 aa, Borrelia burgdorferi B31
IDNLSSKII

SEQ ID NO: 125925 - protein, 15 aa, Borrelia burgdorferi B31
DIKISTQYIGSFADL

SEQ ID NO: 125926 - protein, 9 aa, Borrelia burgdorferi B31
IKISTQYIG

SEQ ID NO: 125927 - protein, 15 aa, Borrelia burgdorferi B31
KLINYGLKEGVVGFV

SEQ ID NO: 125928 - protein, 9 aa, Borrelia burgdorferi B31
YGLKEGVVG

SEQ ID NO: 125929 - protein, 15 aa, Borrelia burgdorferi B31
EIDNLSSKIINKEII

SEQ ID NO: 125930 - protein, 9 aa, Borrelia burgdorferi B31
IDNLSSKII

SEQ ID NO: 125931 - protein, 15 aa, Borrelia burgdorferi B31
FEGGKLINYGLKEGV

SEQ ID NO: 125932 - protein, 9 aa, Borrelia burgdorferi B31
LINYGLKEG

SEQ ID NO: 125933 - protein, 15 aa, Borrelia burgdorferi B31
DAGSDLIWLIGYRFS

SEQ ID NO: 125934 - protein, 9 aa, Borrelia burgdorferi B31
LIWLIGYRF

SEQ ID NO: 125935 - protein, 15 aa, Borrelia burgdorferi B31
AGSDLIWLIGYRFSD

SEQ ID NO: 125936 - protein, 9 aa, Borrelia burgdorferi B31
LIWLIGYRF

SEQ ID NO: 125937 - protein, 15 aa, Borrelia burgdorferi B31
SDLIWLIGYRFSDVA

SEQ ID NO: 125938 - protein, 9 aa, Borrelia burgdorferi B31
LIWLIGYRF

SEQ ID NO: 125939 - protein, 15 aa, Borrelia burgdorferi B31
LINYGLKEGVVGFVR

SEQ ID NO: 125940 - protein, 9 aa, Borrelia burgdorferi B31
YGLKEGVVG

SEQ ID NO: 125941 - protein, 15 aa, Borrelia burgdorferi B31
IFTSNHLKTNTFEGG

SEQ ID NO: 125942 - protein, 9 aa, Borrelia burgdorferi B31
SNHLKTNTF

SEQ ID NO: 125943 - protein, 15 aa, Borrelia burgdorferi B31
GSDLIWLIGYRFSDV

SEQ ID NO: 125944 - protein, 9 aa, Borrelia burgdorferi B31
LIWLIGYRF

SEQ ID NO: 125945 - protein, 15 aa, Borrelia burgdorferi B31
LLLILLESIVFLSCS

SEQ ID NO: 125946 - protein, 9 aa, Borrelia burgdorferi B31
LILLESIVF

SEQ ID NO: 125947 - protein, 15 aa, Borrelia burgdorferi B31
EGGKLINYGLKEGVV

SEQ ID NO: 125948 - protein, 9 aa, Borrelia burgdorferi B31
LINYGLKEG

SEQ ID NO: 125949 - protein, 15 aa, Borrelia burgdorferi B31
TFEGGKLINYGLKEG

SEQ ID NO: 125950 - protein, 9 aa, Borrelia burgdorferi B31
GGKLINYGL

SEQ ID NO: 125951 - protein, 15 aa, Borrelia burgdorferi B31
AKYANKDIKISTQYI

SEQ ID NO: 125952 - protein, 9 aa, Borrelia burgdorferi B31
YANKDIKIS

SEQ ID NO: 125953 - protein, 15 aa, Borrelia burgdorferi B31
IKISTQYIGSFADLE

SEQ ID NO: 125954 - protein, 9 aa, Borrelia burgdorferi B31
IKISTQYIG

SEQ ID NO: 125955 - protein, 15 aa, Borrelia burgdorferi B31
GSLGSEIPKVSLIID

SEQ ID NO: 125956 - protein, 9 aa, Borrelia burgdorferi B31
LGSEIPKVS

SEQ ID NO: 125957 - protein, 15 aa, Borrelia burgdorferi B31
AGAKYANKDIKISTQ

SEQ ID NO: 125958 - protein, 9 aa, Borrelia burgdorferi B31
YANKDIKIS

SEQ ID NO: 125959 - protein, 15 aa, Borrelia burgdorferi B31
GAKYANKDIKISTQY

SEQ ID NO: 125960 - protein, 9 aa, Borrelia burgdorferi B31
YANKDIKIS

SEQ ID NO: 125961 - protein, 15 aa, Borrelia burgdorferi B31
EAGAKYANKDIKIST

SEQ ID NO: 125962 - protein, 9 aa, Borrelia burgdorferi B31
YANKDIKIS

SEQ ID NO: 125963 - protein, 15 aa, Borrelia burgdorferi B31
PDMKYAIIDPIYSND

SEQ ID NO: 125964 - protein, 9 aa, Borrelia burgdorferi B31
MKYAIIDPI

SEQ ID NO: 125965 - protein, 15 aa, Borrelia burgdorferi B31
QNPDMKYAIIDPIYS

SEQ ID NO: 125966 - protein, 9 aa, Borrelia burgdorferi B31
MKYAIIDPI

SEQ ID NO: 125967 - protein, 15 aa, Borrelia burgdorferi B31
NPDMKYAIIDPIYSN

SEQ ID NO: 125968 - protein, 9 aa, Borrelia burgdorferi B31
MKYAIIDPI

SEQ ID NO: 125969 - protein, 15 aa, Borrelia burgdorferi B31
KDAGSDLIWLIGYRF

SEQ ID NO: 125970 - protein, 9 aa, Borrelia burgdorferi B31
AGSDLIWLI

SEQ ID NO: 125971 - protein, 15 aa, Borrelia burgdorferi B31
FTSNHLKTNTFEGGK

SEQ ID NO: 125972 - protein, 9 aa, Borrelia burgdorferi B31
SNHLKTNTF

SEQ ID NO: 125973 - protein, 15 aa, Borrelia burgdorferi B31
NKILLLILLESIVFL

SEQ ID NO: 125974 - protein, 9 aa, Borrelia burgdorferi B31
ILLLILLES

SEQ ID NO: 125975 - protein, 15 aa, Borrelia burgdorferi B31
MNKILLLILLESIVF

SEQ ID NO: 125976 - protein, 9 aa, Borrelia burgdorferi B31
ILLLILLES

SEQ ID NO: 125977 - protein, 15 aa, Borrelia burgdorferi B31
KILLLILLESIVFLS

SEQ ID NO: 125978 - protein, 9 aa, Borrelia burgdorferi B31
LILLESIVF

SEQ ID NO: 125979 - protein, 15 aa, Borrelia burgdorferi B31
GSDLIWLIGYRFSDV

SEQ ID NO: 125980 - protein, 9 aa, Borrelia burgdorferi B31
DLIWLIGYR

SEQ ID NO: 125981 - protein, 15 aa, Borrelia burgdorferi B31
SDLIWLIGYRFSDVA

SEQ ID NO: 125982 - protein, 9 aa, Borrelia burgdorferi B31
LIGYRFSDV

SEQ ID NO: 125983 - protein, 15 aa, Borrelia burgdorferi B31
DLIWLIGYRFSDVAK

SEQ ID NO: 125984 - protein, 9 aa, Borrelia burgdorferi B31
LIGYRFSDV

SEQ ID NO: 125985 - protein, 15 aa, Borrelia burgdorferi B31
ILLLILLESIVFLSC

SEQ ID NO: 125986 - protein, 9 aa, Borrelia burgdorferi B31
LILLESIVF

SEQ ID NO: 125987 - protein, 15 aa, Borrelia burgdorferi B31
LIWLIGYRFSDVAKV

SEQ ID NO: 125988 - protein, 9 aa, Borrelia burgdorferi B31
LIGYRFSDV

SEQ ID NO: 125989 - protein, 15 aa, Borrelia burgdorferi B31
IWLIGYRFSDVAKVA

SEQ ID NO: 125990 - protein, 9 aa, Borrelia burgdorferi B31
LIGYRFSDV

SEQ ID NO: 125991 - protein, 15 aa, Borrelia burgdorferi B31
EGVVGFVRNPKMISF

SEQ ID NO: 125992 - protein, 9 aa, Borrelia burgdorferi B31
VVGFVRNPK

SEQ ID NO: 125993 - protein, 15 aa, Borrelia burgdorferi B31
AGSDLIWLIGYRFSD

SEQ ID NO: 125994 - protein, 9 aa, Borrelia burgdorferi B31
DLIWLIGYR

SEQ ID NO: 125995 - protein, 15 aa, Borrelia burgdorferi B31
KEGVVGFVRNPKMIS

SEQ ID NO: 125996 - protein, 9 aa, Borrelia burgdorferi B31
VVGFVRNPK

SEQ ID NO: 125997 - protein, 15 aa, Borrelia burgdorferi B31
LLLILLESIVFLSCS

SEQ ID NO: 125998 - protein, 9 aa, Borrelia burgdorferi B31
LILLESIVF

SEQ ID NO: 125999 - protein, 15 aa, Borrelia burgdorferi B31
LKEGVVGFVRNPKMI

SEQ ID NO: 126000 - protein, 9 aa, Borrelia burgdorferi B31
VVGFVRNPK

SEQ ID NO: 126001 - protein, 15 aa, Borrelia burgdorferi B31
DVGRALNIFTSNHLK

SEQ ID NO: 126002 - protein, 9 aa, Borrelia burgdorferi B31
LNIFTSNHL

SEQ ID NO: 126003 - protein, 15 aa, Borrelia burgdorferi B31
KDVGRALNIFTSNHL

SEQ ID NO: 126004 - protein, 9 aa, Borrelia burgdorferi B31
GRALNIFTS

SEQ ID NO: 126005 - protein, 15 aa, Borrelia burgdorferi B31
LILLESIVFLSCSGK

SEQ ID NO: 126006 - protein, 9 aa, Borrelia burgdorferi B31
LILLESIVF

SEQ ID NO: 126007 - protein, 15 aa, Borrelia burgdorferi B31
GLKEGVVGFVRNPKM

SEQ ID NO: 126008 - protein, 9 aa, Borrelia burgdorferi B31
VVGFVRNPK

SEQ ID NO: 126009 - protein, 15 aa, Borrelia burgdorferi B31
DAGSDLIWLIGYRFS

SEQ ID NO: 126010 - protein, 9 aa, Borrelia burgdorferi B31
DLIWLIGYR

SEQ ID NO: 126011 - protein, 15 aa, Borrelia burgdorferi B31
AFLTGYIAAKLSKTG

SEQ ID NO: 126012 - protein, 9 aa, Borrelia burgdorferi B31
FLTGYIAAK

SEQ ID NO: 126013 - protein, 15 aa, Borrelia burgdorferi B31
FLTGYIAAKLSKTGK

SEQ ID NO: 126014 - protein, 9 aa, Borrelia burgdorferi B31
IAAKLSKTG

SEQ ID NO: 126015 - protein, 15 aa, Borrelia burgdorferi B31
SDLIWLIGYRFSDVA

SEQ ID NO: 126016 - protein, 9 aa, Borrelia burgdorferi B31
LIWLIGYRF

SEQ ID NO: 126017 - protein, 15 aa, Borrelia burgdorferi B31
GSDLIWLIGYRFSDV

SEQ ID NO: 126018 - protein, 9 aa, Borrelia burgdorferi B31
LIWLIGYRF

SEQ ID NO: 126019 - protein, 15 aa, Borrelia burgdorferi B31
DAGSDLIWLIGYRFS

SEQ ID NO: 126020 - protein, 9 aa, Borrelia burgdorferi B31
LIWLIGYRF

SEQ ID NO: 126021 - protein, 15 aa, Borrelia burgdorferi B31
AGSDLIWLIGYRFSD

SEQ ID NO: 126022 - protein, 9 aa, Borrelia burgdorferi B31
LIWLIGYRF

SEQ ID NO: 126023 - protein, 15 aa, Borrelia burgdorferi B31
DLIWLIGYRFSDVAK

SEQ ID NO: 126024 - protein, 9 aa, Borrelia burgdorferi B31
LIWLIGYRF

SEQ ID NO: 126025 - protein, 15 aa, Borrelia burgdorferi B31 Seq2
WLVGYMLTDASLLVS

SEQ ID NO: 126026 - protein, 9 aa, Borrelia burgdorferi B31 Seq2
MLTDASLLV

SEQ ID NO: 126027 - protein, 15 aa, Borrelia burgdorferi B31 Seq2
IWLVGYMLTDASLLV

SEQ ID NO: 126028 - protein, 9 aa, Borrelia burgdorferi B31 Seq2
YMLTDASLL

SEQ ID NO: 126029 - protein, 15 aa, Borrelia burgdorferi B31 Seq2
LVGYMLTDASLLVSS

SEQ ID NO: 126030 - protein, 9 aa, Borrelia burgdorferi B31 Seq2
MLTDASLLV

SEQ ID NO: 126031 - protein, 15 aa, Borrelia burgdorferi B31 Seq2
VGYMLTDASLLVSSE

SEQ ID NO: 126032 - protein, 9 aa, Borrelia burgdorferi B31 Seq2
MLTDASLLV

SEQ ID NO: 126033 - protein, 15 aa, Borrelia burgdorferi B31 Seq2
SDLIWLVGYMLTDAS

SEQ ID NO: 126034 - protein, 9 aa, Borrelia burgdorferi B31 Seq2
LIWLVGYML

SEQ ID NO: 126035 - protein, 15 aa, Borrelia burgdorferi B31 Seq2
GYMLTDASLLVSSEN

SEQ ID NO: 126036 - protein, 9 aa, Borrelia burgdorferi B31 Seq2
MLTDASLLV

SEQ ID NO: 126037 - protein, 15 aa, Borrelia burgdorferi B31 Seq2
GSDLIWLVGYMLTDA

SEQ ID NO: 126038 - protein, 9 aa, Borrelia burgdorferi B31 Seq2
LIWLVGYML

SEQ ID NO: 126039 - protein, 15 aa, Borrelia burgdorferi B31 Seq2
LIWLVGYMLTDASLL

SEQ ID NO: 126040 - protein, 9 aa, Borrelia burgdorferi B31 Seq2
LIWLVGYML

SEQ ID NO: 126041 - protein, 15 aa, Borrelia burgdorferi B31 Seq2
DLIWLVGYMLTDASL

SEQ ID NO: 126042 - protein, 9 aa, Borrelia burgdorferi B31 Seq2
LIWLVGYML

SEQ ID NO: 126043 - protein, 15 aa, Borrelia burgdorferi B31 Seq2
NGSDLIWLVGYMLTD

SEQ ID NO: 126044 - protein, 9 aa, Borrelia burgdorferi B31 Seq2
LIWLVGYML

SEQ ID NO: 126045 - protein, 15 aa, Borrelia burgdorferi B31 Seq2
IDVIHFAAGLAGIGV

SEQ ID NO: 126046 - protein, 9 aa, Borrelia burgdorferi B31 Seq2
FAAGLAGIG

SEQ ID NO: 126047 - protein, 15 aa, Borrelia burgdorferi B31 Seq2
DVIHFAAGLAGIGVI

SEQ ID NO: 126048 - protein, 9 aa, Borrelia burgdorferi B31 Seq2
FAAGLAGIG

SEQ ID NO: 126049 - protein, 15 aa, Borrelia burgdorferi B31 Seq2
IHFAAGLAGIGVIET

SEQ ID NO: 126050 - protein, 9 aa, Borrelia burgdorferi B31 Seq2
FAAGLAGIG

SEQ ID NO: 126051 - protein, 15 aa, Borrelia burgdorferi B31 Seq2
RNGSDLIWLVGYMLT

SEQ ID NO: 126052 - protein, 9 aa, Borrelia burgdorferi B31 Seq2
LIWLVGYML

SEQ ID NO: 126053 - protein, 15 aa, Borrelia burgdorferi B31 Seq2
YMLTDASLLVSSENP

SEQ ID NO: 126054 - protein, 9 aa, Borrelia burgdorferi B31 Seq2
LTDASLLVS

SEQ ID NO: 126055 - protein, 15 aa, Borrelia burgdorferi B31 Seq2
GIDVIHFAAGLAGIG

SEQ ID NO: 126056 - protein, 9 aa, Borrelia burgdorferi B31 Seq2
IHFAAGLAG

SEQ ID NO: 126057 - protein, 15 aa, Borrelia burgdorferi B31 Seq2
VIHFAAGLAGIGVIE

SEQ ID NO: 126058 - protein, 9 aa, Borrelia burgdorferi B31 Seq2
FAAGLAGIG

SEQ ID NO: 126059 - protein, 15 aa, Borrelia burgdorferi B31 Seq2
WEGGKVVQMGLRDGV

SEQ ID NO: 126060 - protein, 9 aa, Borrelia burgdorferi B31 Seq2
VVQMGLRDG

SEQ ID NO: 126061 - protein, 15 aa, Borrelia burgdorferi B31 Seq2
GGKVVQMGLRDGVIG

SEQ ID NO: 126062 - protein, 9 aa, Borrelia burgdorferi B31 Seq2
VVQMGLRDG

SEQ ID NO: 126063 - protein, 15 aa, Borrelia burgdorferi B31 Seq2
GKVVQMGLRDGVIGL

SEQ ID NO: 126064 - protein, 9 aa, Borrelia burgdorferi B31 Seq2
VVQMGLRDG

SEQ ID NO: 126065 - protein, 15 aa, Borrelia burgdorferi B31 Seq2
FIFGILLTSCFSRNG

SEQ ID NO: 126066 - protein, 9 aa, Borrelia burgdorferi B31 Seq2
FGILLTSCF

SEQ ID NO: 126067 - protein, 15 aa, Borrelia burgdorferi B31 Seq2
HFAAGLAGIGVIETA

SEQ ID NO: 126068 - protein, 9 aa, Borrelia burgdorferi B31 Seq2
LAGIGVIET

SEQ ID NO: 126069 - protein, 15 aa, Borrelia burgdorferi B31 Seq2
IVIFIFGILLTSCFS

SEQ ID NO: 126070 - protein, 9 aa, Borrelia burgdorferi B31 Seq2
FGILLTSCF

SEQ ID NO: 126071 - protein, 15 aa, Borrelia burgdorferi B31 Seq2
KRNGSDLIWLVGYML

SEQ ID NO: 126072 - protein, 9 aa, Borrelia burgdorferi B31 Seq2
GSDLIWLVG

SEQ ID NO: 126073 - protein, 15 aa, Borrelia burgdorferi B31 Seq2
RIVIFIFGILLTSCF

SEQ ID NO: 126074 - protein, 9 aa, Borrelia burgdorferi B31 Seq2
IFGILLTSC

SEQ ID NO: 126075 - protein, 15 aa, Borrelia burgdorferi B31 Seq2
VWEGGKVVQMGLRDG

SEQ ID NO: 126076 - protein, 9 aa, Borrelia burgdorferi B31 Seq2
WEGGKVVQM

SEQ ID NO: 126077 - protein, 15 aa, Borrelia burgdorferi B31 Seq2
IFIFGILLTSCFSRN

SEQ ID NO: 126078 - protein, 9 aa, Borrelia burgdorferi B31 Seq2
FGILLTSCF

SEQ ID NO: 126079 - protein, 15 aa, Borrelia burgdorferi B31 Seq2
EGGKVVQMGLRDGVI

SEQ ID NO: 126080 - protein, 9 aa, Borrelia burgdorferi B31 Seq2
VVQMGLRDG

SEQ ID NO: 126081 - protein, 15 aa, Borrelia burgdorferi B31 Seq2
VIFIFGILLTSCFSR

SEQ ID NO: 126082 - protein, 9 aa, Borrelia burgdorferi B31 Seq2
FGILLTSCF

SEQ ID NO: 126083 - protein, 15 aa, Borrelia burgdorferi B31 Seq2
FAAGLAGIGVIETAK

SEQ ID NO: 126084 - protein, 9 aa, Borrelia burgdorferi B31 Seq2
LAGIGVIET

SEQ ID NO: 126085 - protein, 15 aa, Borrelia burgdorferi B31 Seq2
MLTDASLLVSSENPK

SEQ ID NO: 126086 - protein, 9 aa, Borrelia burgdorferi B31 Seq2
MLTDASLLV

SEQ ID NO: 126087 - protein, 15 aa, Borrelia burgdorferi B31 Seq2
AAGLAGIGVIETAKN

SEQ ID NO: 126088 - protein, 9 aa, Borrelia burgdorferi B31 Seq2
LAGIGVIET

SEQ ID NO: 126089 - protein, 15 aa, Borrelia burgdorferi B31 Seq2
IGFIGGMKGNIVDAF

SEQ ID NO: 126090 - protein, 9 aa, Borrelia burgdorferi B31 Seq2
IGGMKGNIV

SEQ ID NO: 126091 - protein, 15 aa, Borrelia burgdorferi B31 Seq2
GFIGGMKGNIVDAFR

SEQ ID NO: 126092 - protein, 9 aa, Borrelia burgdorferi B31 Seq2
IGGMKGNIV

SEQ ID NO: 126093 - protein, 15 aa, Borrelia burgdorferi B31 Seq2
AGLAGIGVIETAKNL

SEQ ID NO: 126094 - protein, 9 aa, Borrelia burgdorferi B31 Seq2
LAGIGVIET

SEQ ID NO: 126095 - protein, 15 aa, Borrelia burgdorferi B31 Seq2
IFGILLTSCFSRNGI

SEQ ID NO: 126096 - protein, 9 aa, Borrelia burgdorferi B31 Seq2
FGILLTSCF

SEQ ID NO: 126097 - protein, 15 aa, Borrelia burgdorferi B31 Seq2
SGKIGFIGGMKGNIV

SEQ ID NO: 126098 - protein, 9 aa, Borrelia burgdorferi B31 Seq2
IGFIGGMKG

SEQ ID NO: 126099 - protein, 15 aa, Borrelia burgdorferi B31 Seq2
GKIGFIGGMKGNIVD

SEQ ID NO: 126100 - protein, 9 aa, Borrelia burgdorferi B31 Seq2
IGGMKGNIV

SEQ ID NO: 126101 - protein, 15 aa, Borrelia burgdorferi B31 Seq2
KIGFIGGMKGNIVDA

SEQ ID NO: 126102 - protein, 9 aa, Borrelia burgdorferi B31 Seq2
IGGMKGNIV

SEQ ID NO: 126103 - protein, 15 aa, Borrelia burgdorferi B31 Seq2
SDVDIGRTIASKMYS

SEQ ID NO: 126104 - protein, 9 aa, Borrelia burgdorferi B31 Seq2
VDIGRTIAS

SEQ ID NO: 126105 - protein, 15 aa, Borrelia burgdorferi B31 Seq2
KGIDVIHFAAGLAGI

SEQ ID NO: 126106 - protein, 9 aa, Borrelia burgdorferi B31 Seq2
IHFAAGLAG

SEQ ID NO: 126107 - protein, 15 aa, Borrelia burgdorferi B31 Seq2
FSDVDIGRTIASKMY

SEQ ID NO: 126108 - protein, 9 aa, Borrelia burgdorferi B31 Seq2
VDIGRTIAS

SEQ ID NO: 126109 - protein, 15 aa, Borrelia burgdorferi B31 Seq2
AFLAGYIAAKKSFSG

SEQ ID NO: 126110 - protein, 9 aa, Borrelia burgdorferi B31 Seq2
AGYIAAKKS

SEQ ID NO: 126111 - protein, 15 aa, Borrelia burgdorferi B31 Seq2
KVVQMGLRDGVIGLP

SEQ ID NO: 126112 - protein, 9 aa, Borrelia burgdorferi B31 Seq2
VVQMGLRDG

SEQ ID NO: 126113 - protein, 15 aa, Borrelia burgdorferi B31 Seq2
FLAGYIAAKKSFSGK

SEQ ID NO: 126114 - protein, 9 aa, Borrelia burgdorferi B31 Seq2
IAAKKSFSG

SEQ ID NO: 126115 - protein, 15 aa, Borrelia burgdorferi B31 Seq2
DKSFNSSANEALLRL

SEQ ID NO: 126116 - protein, 9 aa, Borrelia burgdorferi B31 Seq2
FNSSANEAL

SEQ ID NO: 126117 - protein, 15 aa, Borrelia burgdorferi B31 Seq2
FGILLTSCFSRNGIE

SEQ ID NO: 126118 - protein, 9 aa, Borrelia burgdorferi B31 Seq2
FGILLTSCF

SEQ ID NO: 126119 - protein, 15 aa, Borrelia burgdorferi B31 Seq2
KSFNSSANEALLRLK

SEQ ID NO: 126120 - protein, 9 aa, Borrelia burgdorferi B31 Seq2
FNSSANEAL

SEQ ID NO: 126121 - protein, 15 aa, Borrelia burgdorferi B31 Seq2
VVFRVEQGAFLAGYI

SEQ ID NO: 126122 - protein, 9 aa, Borrelia burgdorferi B31 Seq2
FRVEQGAFL

SEQ ID NO: 126123 - protein, 15 aa, Borrelia burgdorferi B31 Seq2
AVVFRVEQGAFLAGY

SEQ ID NO: 126124 - protein, 9 aa, Borrelia burgdorferi B31 Seq2
FRVEQGAFL

SEQ ID NO: 126125 - protein, 15 aa, Borrelia burgdorferi B31 Seq2
VVQMGLRDGVIGLPN

SEQ ID NO: 126126 - protein, 9 aa, Borrelia burgdorferi B31 Seq2
VVQMGLRDG

SEQ ID NO: 126127 - protein, 15 aa, Borrelia burgdorferi B31 Seq2
AGYIAAKKSFSGKIG

SEQ ID NO: 126128 - protein, 9 aa, Borrelia burgdorferi B31 Seq2
IAAKKSFSG

SEQ ID NO: 126129 - protein, 15 aa, Borrelia burgdorferi B31 Seq2
SKGIDVIHFAAGLAG

SEQ ID NO: 126130 - protein, 9 aa, Borrelia burgdorferi B31 Seq2
VIHFAAGLA

SEQ ID NO: 126131 - protein, 15 aa, Borrelia burgdorferi B31 Seq2
LAGYIAAKKSFSGKI

SEQ ID NO: 126132 - protein, 9 aa, Borrelia burgdorferi B31 Seq2
IAAKKSFSG

SEQ ID NO: 126133 - protein, 15 aa, Borrelia burgdorferi B31 Seq2
VDIGRTIASKMYSKG

SEQ ID NO: 126134 - protein, 9 aa, Borrelia burgdorferi B31 Seq2
IGRTIASKM

SEQ ID NO: 126135 - protein, 15 aa, Borrelia burgdorferi B31 Seq2
VFSCAISGVYSSYVS

SEQ ID NO: 126136 - protein, 9 aa, Borrelia burgdorferi B31 Seq2
ISGVYSSYV

SEQ ID NO: 126137 - protein, 15 aa, Borrelia burgdorferi B31 Seq2
SCAISGVYSSYVSDL

SEQ ID NO: 126138 - protein, 9 aa, Borrelia burgdorferi B31 Seq2
ISGVYSSYV

SEQ ID NO: 126139 - protein, 15 aa, Borrelia burgdorferi B31 Seq2
EVFSCAISGVYSSYV

SEQ ID NO: 126140 - protein, 9 aa, Borrelia burgdorferi B31 Seq2
SCAISGVYS

SEQ ID NO: 126141 - protein, 15 aa, Borrelia burgdorferi B31 Seq2
NNNVWEGGKVVQMGL

SEQ ID NO: 126142 - protein, 9 aa, Borrelia burgdorferi B31 Seq2
WEGGKVVQM

SEQ ID NO: 126143 - protein, 15 aa, Borrelia burgdorferi B31 Seq2
FSCAISGVYSSYVSD

SEQ ID NO: 126144 - protein, 9 aa, Borrelia burgdorferi B31 Seq2
ISGVYSSYV

SEQ ID NO: 126145 - protein, 15 aa, Borrelia burgdorferi B31 Seq2
CAISGVYSSYVSDLD

SEQ ID NO: 126146 - protein, 9 aa, Borrelia burgdorferi B31 Seq2
ISGVYSSYV

SEQ ID NO: 126147 - protein, 15 aa, Borrelia burgdorferi B31 Seq2
NNVWEGGKVVQMGLR

SEQ ID NO: 126148 - protein, 9 aa, Borrelia burgdorferi B31 Seq2
WEGGKVVQM

SEQ ID NO: 126149 - protein, 15 aa, Borrelia burgdorferi B31 Seq2
NVWEGGKVVQMGLRD

SEQ ID NO: 126150 - protein, 9 aa, Borrelia burgdorferi B31 Seq2
WEGGKVVQM

SEQ ID NO: 126151 - protein, 15 aa, Borrelia burgdorferi B31 Seq2
KNNNVWEGGKVVQMG

SEQ ID NO: 126152 - protein, 9 aa, Borrelia burgdorferi B31 Seq2
WEGGKVVQM

SEQ ID NO: 126153 - protein, 15 aa, Borrelia burgdorferi B31 Seq2
IKNNNVWEGGKVVQM

SEQ ID NO: 126154 - protein, 9 aa, Borrelia burgdorferi B31 Seq2
NVWEGGKVV

SEQ ID NO: 126155 - protein, 15 aa, Borrelia burgdorferi B31 Seq2
MRIVIFIFGILLTSC

SEQ ID NO: 126156 - protein, 9 aa, Borrelia burgdorferi B31 Seq2
FIFGILLTS

SEQ ID NO: 126157 - protein, 15 aa, Borrelia burgdorferi B31 Seq2
LDDKSFNSSANEALL

SEQ ID NO: 126158 - protein, 9 aa, Borrelia burgdorferi B31 Seq2
FNSSANEAL

SEQ ID NO: 126159 - protein, 15 aa, Borrelia burgdorferi B31 Seq2
DDKSFNSSANEALLR

SEQ ID NO: 126160 - protein, 9 aa, Borrelia burgdorferi B31 Seq2
FNSSANEAL

SEQ ID NO: 126161 - protein, 15 aa, Borrelia burgdorferi B31 Seq2
IAVVFRVEQGAFLAG

SEQ ID NO: 126162 - protein, 9 aa, Borrelia burgdorferi B31 Seq2
FRVEQGAFL

SEQ ID NO: 126163 - protein, 15 aa, Borrelia burgdorferi B31 Seq2
DVDIGRTIASKMYSK

SEQ ID NO: 126164 - protein, 9 aa, Borrelia burgdorferi B31 Seq2
IGRTIASKM

SEQ ID NO: 126165 - protein, 15 aa, Borrelia burgdorferi B31 Seq2
VLDDKSFNSSANEAL

SEQ ID NO: 126166 - protein, 9 aa, Borrelia burgdorferi B31 Seq2
SFNSSANEA

SEQ ID NO: 126167 - protein, 15 aa, Borrelia burgdorferi B31 Seq2
LTDASLLVSSENPKI

SEQ ID NO: 126168 - protein, 9 aa, Borrelia burgdorferi B31 Seq2
LTDASLLVS

SEQ ID NO: 126169 - protein, 15 aa, Borrelia burgdorferi B31 Seq2
GYIAAKKSFSGKIGF

SEQ ID NO: 126170 - protein, 9 aa, Borrelia burgdorferi B31 Seq2
IAAKKSFSG

SEQ ID NO: 126171 - protein, 15 aa, Borrelia burgdorferi B31 Seq2
SSKKIKISMLVDGVL

SEQ ID NO: 126172 - protein, 9 aa, Borrelia burgdorferi B31 Seq2
IKISMLVDG

SEQ ID NO: 126173 - protein, 15 aa, Borrelia burgdorferi B31 Seq2
SFSDVDIGRTIASKM

SEQ ID NO: 126174 - protein, 9 aa, Borrelia burgdorferi B31 Seq2
VDIGRTIAS

SEQ ID NO: 126175 - protein, 15 aa, Borrelia burgdorferi B31 Seq2
FRVEQGAFLAGYIAA

SEQ ID NO: 126176 - protein, 9 aa, Borrelia burgdorferi B31 Seq2
VEQGAFLAG

SEQ ID NO: 126177 - protein, 15 aa, Borrelia burgdorferi B31 Seq2
VFRVEQGAFLAGYIA

SEQ ID NO: 126178 - protein, 9 aa, Borrelia burgdorferi B31 Seq2
VEQGAFLAG

SEQ ID NO: 126179 - protein, 15 aa, Borrelia burgdorferi B31 Seq2
SSSKKIKISMLVDGV

SEQ ID NO: 126180 - protein, 9 aa, Borrelia burgdorferi B31 Seq2
IKISMLVDG

SEQ ID NO: 126181 - protein, 15 aa, Borrelia burgdorferi B31 Seq2
ESSSKKIKISMLVDG

SEQ ID NO: 126182 - protein, 9 aa, Borrelia burgdorferi B31 Seq2
KKIKISMLV

SEQ ID NO: 126183 - protein, 15 aa, Borrelia burgdorferi B31 Seq2
GAFLAGYIAAKKSFS

SEQ ID NO: 126184 - protein, 9 aa, Borrelia burgdorferi B31 Seq2
LAGYIAAKK

SEQ ID NO: 126185 - protein, 15 aa, Borrelia burgdorferi B31 Seq2
FIGGMKGNIVDAFRY

SEQ ID NO: 126186 - protein, 9 aa, Borrelia burgdorferi B31 Seq2
IGGMKGNIV

SEQ ID NO: 126187 - protein, 15 aa, Borrelia burgdorferi B31 Seq2
IGGMKGNIVDAFRYG

SEQ ID NO: 126188 - protein, 9 aa, Borrelia burgdorferi B31 Seq2
IGGMKGNIV

SEQ ID NO: 126189 - protein, 15 aa, Borrelia burgdorferi B31 Seq2
GLAGIGVIETAKNLG

SEQ ID NO: 126190 - protein, 9 aa, Borrelia burgdorferi B31 Seq2
LAGIGVIET

SEQ ID NO: 126191 - protein, 15 aa, Borrelia burgdorferi B31 Seq2
LAGIGVIETAKNLGD

SEQ ID NO: 126192 - protein, 9 aa, Borrelia burgdorferi B31 Seq2
LAGIGVIET

SEQ ID NO: 126193 - protein, 15 aa, Borrelia burgdorferi B31 Seq2
KISYGIIDPIYGDDV

SEQ ID NO: 126194 - protein, 9 aa, Borrelia burgdorferi B31 Seq2
YGIIDPIYG

SEQ ID NO: 126195 - protein, 15 aa, Borrelia burgdorferi B31 Seq2
ENPKISYGIIDPIYG

SEQ ID NO: 126196 - protein, 9 aa, Borrelia burgdorferi B31 Seq2
ENPKISYGI

SEQ ID NO: 126197 - protein, 15 aa, Borrelia burgdorferi B31 Seq2
ISYGIIDPIYGDDVQ

SEQ ID NO: 126198 - protein, 9 aa, Borrelia burgdorferi B31 Seq2
YGIIDPIYG

SEQ ID NO: 126199 - protein, 15 aa, Borrelia burgdorferi B31 Seq2
SKKIKISMLVDGVLD

SEQ ID NO: 126200 - protein, 9 aa, Borrelia burgdorferi B31 Seq2
IKISMLVDG

SEQ ID NO: 126201 - protein, 15 aa, Borrelia burgdorferi B31 Seq2
SVIKNIGDALYLITG

SEQ ID NO: 126202 - protein, 9 aa, Borrelia burgdorferi B31 Seq2
IKNIGDALY

SEQ ID NO: 126203 - protein, 15 aa, Borrelia burgdorferi B31 Seq2
KKIKISMLVDGVLDD

SEQ ID NO: 126204 - protein, 9 aa, Borrelia burgdorferi B31 Seq2
IKISMLVDG

SEQ ID NO: 126205 - protein, 15 aa, Borrelia burgdorferi B31 Seq2
EQGAFLAGYIAAKKS

SEQ ID NO: 126206 - protein, 9 aa, Borrelia burgdorferi B31 Seq2
LAGYIAAKK

SEQ ID NO: 126207 - protein, 15 aa, Borrelia burgdorferi B31 Seq2
PKISYGIIDPIYGDD

SEQ ID NO: 126208 - protein, 9 aa, Borrelia burgdorferi B31 Seq2
YGIIDPIYG

SEQ ID NO: 126209 - protein, 15 aa, Borrelia burgdorferi B31 Seq2
TSVIKNIGDALYLIT

SEQ ID NO: 126210 - protein, 9 aa, Borrelia burgdorferi B31 Seq2
IKNIGDALY

SEQ ID NO: 126211 - protein, 15 aa, Borrelia burgdorferi B31 Seq2
SFNSSANEALLRLKK

SEQ ID NO: 126212 - protein, 9 aa, Borrelia burgdorferi B31 Seq2
FNSSANEAL

SEQ ID NO: 126213 - protein, 15 aa, Borrelia burgdorferi B31 Seq2
FNSSANEALLRLKKD

SEQ ID NO: 126214 - protein, 9 aa, Borrelia burgdorferi B31 Seq2
FNSSANEAL

SEQ ID NO: 126215 - protein, 15 aa, Borrelia burgdorferi B31 Seq2
NPKISYGIIDPIYGD

SEQ ID NO: 126216 - protein, 9 aa, Borrelia burgdorferi B31 Seq2
YGIIDPIYG

SEQ ID NO: 126217 - protein, 15 aa, Borrelia burgdorferi B31 Seq2
NSFSDVDIGRTIASK

SEQ ID NO: 126218 - protein, 9 aa, Borrelia burgdorferi B31 Seq2
VDIGRTIAS

SEQ ID NO: 126219 - protein, 15 aa, Borrelia burgdorferi B31 Seq2
DIGRTIASKMYSKGI

SEQ ID NO: 126220 - protein, 9 aa, Borrelia burgdorferi B31 Seq2
GRTIASKMY

SEQ ID NO: 126221 - protein, 15 aa, Borrelia burgdorferi B31 Seq2
QGAFLAGYIAAKKSF

SEQ ID NO: 126222 - protein, 9 aa, Borrelia burgdorferi B31 Seq2
LAGYIAAKK

SEQ ID NO: 126223 - protein, 15 aa, Borrelia burgdorferi B31 Seq2
SNSFSDVDIGRTIAS

SEQ ID NO: 126224 - protein, 9 aa, Borrelia burgdorferi B31 Seq2
FSDVDIGRT

SEQ ID NO: 126225 - protein, 15 aa, Borrelia burgdorferi B31 Seq2
GILLTSCFSRNGIES

SEQ ID NO: 126226 - protein, 9 aa, Borrelia burgdorferi B31 Seq2
LTSCFSRNG

SEQ ID NO: 126227 - protein, 15 aa, Borrelia burgdorferi B31 Seq2
VEQGAFLAGYIAAKK

SEQ ID NO: 126228 - protein, 9 aa, Borrelia burgdorferi B31 Seq2
FLAGYIAAK

SEQ ID NO: 126229 - protein, 15 aa, Borrelia burgdorferi B31 Seq2
ILLTSCFSRNGIESS

SEQ ID NO: 126230 - protein, 9 aa, Borrelia burgdorferi B31 Seq2
LTSCFSRNG

SEQ ID NO: 126231 - protein, 15 aa, Borrelia burgdorferi B31 Seq2
IGRTIASKMYSKGID

SEQ ID NO: 126232 - protein, 9 aa, Borrelia burgdorferi B31 Seq2
IGRTIASKM

SEQ ID NO: 126233 - protein, 15 aa, Borrelia burgdorferi B31 Seq2
LIAVVFRVEQGAFLA

SEQ ID NO: 126234 - protein, 9 aa, Borrelia burgdorferi B31 Seq2
FRVEQGAFL

SEQ ID NO: 126235 - protein, 15 aa, Borrelia burgdorferi B31 Seq2
VIKNIGDALYLITGE

SEQ ID NO: 126236 - protein, 9 aa, Borrelia burgdorferi B31 Seq2
IGDALYLIT

SEQ ID NO: 126237 - protein, 15 aa, Borrelia burgdorferi B31 Seq2
DDVQIPENLIAVVFR

SEQ ID NO: 126238 - protein, 9 aa, Borrelia burgdorferi B31 Seq2
VQIPENLIA

SEQ ID NO: 126239 - protein, 15 aa, Borrelia burgdorferi B31 Seq2
RVEQGAFLAGYIAAK

SEQ ID NO: 126240 - protein, 9 aa, Borrelia burgdorferi B31 Seq2
VEQGAFLAG

SEQ ID NO: 126241 - protein, 15 aa, Borrelia burgdorferi B31 Seq2
GDDVQIPENLIAVVF

SEQ ID NO: 126242 - protein, 9 aa, Borrelia burgdorferi B31 Seq2
VQIPENLIA

SEQ ID NO: 126243 - protein, 15 aa, Borrelia burgdorferi B31 Seq2
ANKDIEIISEYSNSF

SEQ ID NO: 126244 - protein, 9 aa, Borrelia burgdorferi B31 Seq2
ANKDIEIIS

SEQ ID NO: 126245 - protein, 15 aa, Borrelia burgdorferi B31 Seq2
NKDIEIISEYSNSFS

SEQ ID NO: 126246 - protein, 9 aa, Borrelia burgdorferi B31 Seq2
IISEYSNSF

SEQ ID NO: 126247 - protein, 15 aa, Borrelia burgdorferi B31 Seq2
KDIEIISEYSNSFSD

SEQ ID NO: 126248 - protein, 9 aa, Borrelia burgdorferi B31 Seq2
IISEYSNSF

SEQ ID NO: 126249 - protein, 15 aa, Borrelia burgdorferi B31 Seq2
DIEIISEYSNSFSDV

SEQ ID NO: 126250 - protein, 9 aa, Borrelia burgdorferi B31 Seq2
IISEYSNSF

SEQ ID NO: 126251 - protein, 15 aa, Borrelia burgdorferi B31 Seq2
IEIISEYSNSFSDVD

SEQ ID NO: 126252 - protein, 9 aa, Borrelia burgdorferi B31 Seq2
IISEYSNSF

SEQ ID NO: 126253 - protein, 15 aa, Borrelia burgdorferi B31 Seq2
EIISEYSNSFSDVDI

SEQ ID NO: 126254 - protein, 9 aa, Borrelia burgdorferi B31 Seq2
IISEYSNSF

SEQ ID NO: 126255 - protein, 15 aa, Borrelia burgdorferi B31 Seq2
IISEYSNSFSDVDIG

SEQ ID NO: 126256 - protein, 9 aa, Borrelia burgdorferi B31 Seq2
IISEYSNSF

SEQ ID NO: 126257 - protein, 15 aa, Borrelia burgdorferi B31 Seq2
WLVGYMLTDASLLVS

SEQ ID NO: 126258 - protein, 9 aa, Borrelia burgdorferi B31 Seq2
MLTDASLLV

SEQ ID NO: 126259 - protein, 15 aa, Borrelia burgdorferi B31 Seq2
IWLVGYMLTDASLLV

SEQ ID NO: 126260 - protein, 9 aa, Borrelia burgdorferi B31 Seq2
VGYMLTDAS

SEQ ID NO: 126261 - protein, 15 aa, Borrelia burgdorferi B31 Seq2
VGYMLTDASLLVSSE

SEQ ID NO: 126262 - protein, 9 aa, Borrelia burgdorferi B31 Seq2
MLTDASLLV

SEQ ID NO: 126263 - protein, 15 aa, Borrelia burgdorferi B31 Seq2
LVGYMLTDASLLVSS

SEQ ID NO: 126264 - protein, 9 aa, Borrelia burgdorferi B31 Seq2
MLTDASLLV

SEQ ID NO: 126265 - protein, 15 aa, Borrelia burgdorferi B31 Seq2
GYMLTDASLLVSSEN

SEQ ID NO: 126266 - protein, 9 aa, Borrelia burgdorferi B31 Seq2
MLTDASLLV

SEQ ID NO: 126267 - protein, 15 aa, Borrelia burgdorferi B31 Seq2
LAGIGVIETAKNLGD

SEQ ID NO: 126268 - protein, 9 aa, Borrelia burgdorferi B31 Seq2
VIETAKNLG

SEQ ID NO: 126269 - protein, 15 aa, Borrelia burgdorferi B31 Seq2
GLAGIGVIETAKNLG

SEQ ID NO: 126270 - protein, 9 aa, Borrelia burgdorferi B31 Seq2
IGVIETAKN

SEQ ID NO: 126271 - protein, 15 aa, Borrelia burgdorferi B31 Seq2
AGIGVIETAKNLGDG

SEQ ID NO: 126272 - protein, 9 aa, Borrelia burgdorferi B31 Seq2
VIETAKNLG

SEQ ID NO: 126273 - protein, 15 aa, Borrelia burgdorferi B31 Seq2
IGVIETAKNLGDGYY

SEQ ID NO: 126274 - protein, 9 aa, Borrelia burgdorferi B31 Seq2
VIETAKNLG

SEQ ID NO: 126275 - protein, 15 aa, Borrelia burgdorferi B31 Seq2
LIWLVGYMLTDASLL

SEQ ID NO: 126276 - protein, 9 aa, Borrelia burgdorferi B31 Seq2
VGYMLTDAS

SEQ ID NO: 126277 - protein, 15 aa, Borrelia burgdorferi B31 Seq2
IWLVGYMLTDASLLV

SEQ ID NO: 126278 - protein, 9 aa, Borrelia burgdorferi B31 Seq2
YMLTDASLL

SEQ ID NO: 126279 - protein, 15 aa, Borrelia burgdorferi B31 Seq2
GIGVIETAKNLGDGY

SEQ ID NO: 126280 - protein, 9 aa, Borrelia burgdorferi B31 Seq2
VIETAKNLG

SEQ ID NO: 126281 - protein, 15 aa, Borrelia burgdorferi B31 Seq2
WLVGYMLTDASLLVS

SEQ ID NO: 126282 - protein, 9 aa, Borrelia burgdorferi B31 Seq2
YMLTDASLL

SEQ ID NO: 126283 - protein, 15 aa, Borrelia burgdorferi B31 Seq2
LVGYMLTDASLLVSS

SEQ ID NO: 126284 - protein, 9 aa, Borrelia burgdorferi B31 Seq2
YMLTDASLL

SEQ ID NO: 126285 - protein, 15 aa, Borrelia burgdorferi B31 Seq2
VGYMLTDASLLVSSE

SEQ ID NO: 126286 - protein, 9 aa, Borrelia burgdorferi B31 Seq2
YMLTDASLL

SEQ ID NO: 126287 - protein, 15 aa, Borrelia burgdorferi B31 Seq2
SDLIWLVGYMLTDAS

SEQ ID NO: 126288 - protein, 9 aa, Borrelia burgdorferi B31 Seq2
WLVGYMLTD

SEQ ID NO: 126289 - protein, 15 aa, Borrelia burgdorferi B31 Seq2
DLIWLVGYMLTDASL

SEQ ID NO: 126290 - protein, 9 aa, Borrelia burgdorferi B31 Seq2
VGYMLTDAS

SEQ ID NO: 126291 - protein, 15 aa, Borrelia burgdorferi B31 Seq2
GVYSSYVSDLDNLKR

SEQ ID NO: 126292 - protein, 9 aa, Borrelia burgdorferi B31 Seq2
YSSYVSDLD

SEQ ID NO: 126293 - protein, 15 aa, Borrelia burgdorferi B31 Seq2
SGVYSSYVSDLDNLK

SEQ ID NO: 126294 - protein, 9 aa, Borrelia burgdorferi B31 Seq2
YSSYVSDLD

SEQ ID NO: 126295 - protein, 15 aa, Borrelia burgdorferi B31 Seq2
CAISGVYSSYVSDLD

SEQ ID NO: 126296 - protein, 9 aa, Borrelia burgdorferi B31 Seq2
ISGVYSSYV

SEQ ID NO: 126297 - protein, 15 aa, Borrelia burgdorferi B31 Seq2
AISGVYSSYVSDLDN

SEQ ID NO: 126298 - protein, 9 aa, Borrelia burgdorferi B31 Seq2
YSSYVSDLD

SEQ ID NO: 126299 - protein, 15 aa, Borrelia burgdorferi B31 Seq2
ISGVYSSYVSDLDNL

SEQ ID NO: 126300 - protein, 9 aa, Borrelia burgdorferi B31 Seq2
YSSYVSDLD

SEQ ID NO: 126301 - protein, 15 aa, Borrelia burgdorferi B31 Seq2
VYSSYVSDLDNLKRN

SEQ ID NO: 126302 - protein, 9 aa, Borrelia burgdorferi B31 Seq2
YSSYVSDLD

SEQ ID NO: 126303 - protein, 15 aa, Borrelia burgdorferi B31 Seq2
YSSYVSDLDNLKRNG

SEQ ID NO: 126304 - protein, 9 aa, Borrelia burgdorferi B31 Seq2
YSSYVSDLD

SEQ ID NO: 126305 - protein, 15 aa, Borrelia burgdorferi B31 Seq2
LAGIGVIETAKNLGD

SEQ ID NO: 126306 - protein, 9 aa, Borrelia burgdorferi B31 Seq2
IGVIETAKN

SEQ ID NO: 126307 - protein, 15 aa, Borrelia burgdorferi B31 Seq2
AGIGVIETAKNLGDG

SEQ ID NO: 126308 - protein, 9 aa, Borrelia burgdorferi B31 Seq2
IETAKNLGD

SEQ ID NO: 126309 - protein, 15 aa, Borrelia burgdorferi B31 Seq2
MGLRDGVIGLPNANE

SEQ ID NO: 126310 - protein, 9 aa, Borrelia burgdorferi B31 Seq2
RDGVIGLPN

SEQ ID NO: 126311 - protein, 15 aa, Borrelia burgdorferi B31 Seq2
EIISEYSNSFSDVDI

SEQ ID NO: 126312 - protein, 9 aa, Borrelia burgdorferi B31 Seq2
YSNSFSDVD

SEQ ID NO: 126313 - protein, 15 aa, Borrelia burgdorferi B31 Seq2
GIGVIETAKNLGDGY

SEQ ID NO: 126314 - protein, 9 aa, Borrelia burgdorferi B31 Seq2
IETAKNLGD

SEQ ID NO: 126315 - protein, 15 aa, Borrelia burgdorferi B31 Seq2
IGVIETAKNLGDGYY

SEQ ID NO: 126316 - protein, 9 aa, Borrelia burgdorferi B31 Seq2
IETAKNLGD

SEQ ID NO: 126317 - protein, 15 aa, Borrelia burgdorferi B31 Seq2
GLRDGVIGLPNANEF

SEQ ID NO: 126318 - protein, 9 aa, Borrelia burgdorferi B31 Seq2
VIGLPNANE

SEQ ID NO: 126319 - protein, 15 aa, Borrelia burgdorferi B31 Seq2
IEIISEYSNSFSDVD

SEQ ID NO: 126320 - protein, 9 aa, Borrelia burgdorferi B31 Seq2
ISEYSNSFS

SEQ ID NO: 126321 - protein, 15 aa, Borrelia burgdorferi B31 Seq2
LRDGVIGLPNANEFE

SEQ ID NO: 126322 - protein, 9 aa, Borrelia burgdorferi B31 Seq2
VIGLPNANE

SEQ ID NO: 126323 - protein, 15 aa, Borrelia burgdorferi B31 Seq2
RDGVIGLPNANEFEY

SEQ ID NO: 126324 - protein, 9 aa, Borrelia burgdorferi B31 Seq2
VIGLPNANE

SEQ ID NO: 126325 - protein, 15 aa, Borrelia burgdorferi B31 Seq2
EVFSCAISGVYSSYV

SEQ ID NO: 126326 - protein, 9 aa, Borrelia burgdorferi B31 Seq2
FSCAISGVY

SEQ ID NO: 126327 - protein, 15 aa, Borrelia burgdorferi B31 Seq2
EEVFSCAISGVYSSY

SEQ ID NO: 126328 - protein, 9 aa, Borrelia burgdorferi B31 Seq2
FSCAISGVY

SEQ ID NO: 126329 - protein, 15 aa, Borrelia burgdorferi B31 Seq2
ENIEEVFSCAISGVY

SEQ ID NO: 126330 - protein, 9 aa, Borrelia burgdorferi B31 Seq2
VFSCAISGV

SEQ ID NO: 126331 - protein, 15 aa, Borrelia burgdorferi B31 Seq2
NIEEVFSCAISGVYS

SEQ ID NO: 126332 - protein, 9 aa, Borrelia burgdorferi B31 Seq2
FSCAISGVY

SEQ ID NO: 126333 - protein, 15 aa, Borrelia burgdorferi B31 Seq2
IEEVFSCAISGVYSS

SEQ ID NO: 126334 - protein, 9 aa, Borrelia burgdorferi B31 Seq2
FSCAISGVY

SEQ ID NO: 126335 - protein, 15 aa, Borrelia burgdorferi B31 Seq2
VFSCAISGVYSSYVS
